United States Patent 7,250,289 (METHODS OF GENETIC ANALYSIS OF MOUSE) - sequence listing, part 8

SEQ ID NO: 282454 - DNA, 25 bp, Mus musculus
attgaccttggcgagaacgatgtgt

SEQ ID NO: 282455 - DNA, 25 bp, Mus musculus
attgaccttttcattgagctacagt

SEQ ID NO: 282456 - DNA, 25 bp, Mus musculus
attgaccttttctttgagctacagt

SEQ ID NO: 282457 - DNA, 25 bp, Mus musculus
attgacgactgtaatgcttcagaac

SEQ ID NO: 282458 - DNA, 25 bp, Mus musculus
attgacgactgttatgcttcagaac

SEQ ID NO: 282459 - DNA, 25 bp, Mus musculus
attgacgatactatgcactgctcta

SEQ ID NO: 282460 - DNA, 25 bp, Mus musculus
attgacgatactttgcactgctcta

SEQ ID NO: 282461 - DNA, 25 bp, Mus musculus
attgacggacttctagtgatgagga

SEQ ID NO: 282462 - DNA, 25 bp, Mus musculus
attgacggacttgtagtgatgagga

SEQ ID NO: 282463 - DNA, 25 bp, Mus musculus
attgacggctgccagctactgtgct

SEQ ID NO: 282464 - DNA, 25 bp, Mus musculus
attgacggctgcgagctactgtgct

SEQ ID NO: 282465 - DNA, 25 bp, Mus musculus
attgacggcttgatttctcttggta

SEQ ID NO: 282466 - DNA, 25 bp, Mus musculus
attgacggcttgttttctcttggta

SEQ ID NO: 282467 - DNA, 25 bp, Mus musculus
attgacgggaaaacagcaaatatta

SEQ ID NO: 282468 - DNA, 25 bp, Mus musculus
attgacgggaaatcagcaaatatta

SEQ ID NO: 282469 - DNA, 25 bp, Mus musculus
attgacgggtacatatctggatgaa

SEQ ID NO: 282470 - DNA, 25 bp, Mus musculus
attgacgggtacttatctggatgaa

SEQ ID NO: 282471 - DNA, 25 bp, Mus musculus
attgacggtgaacttgcatgcctgc

SEQ ID NO: 282472 - DNA, 25 bp, Mus musculus
attgacggtgaagttgcatgcctgc

SEQ ID NO: 282473 - DNA, 25 bp, Mus musculus
attgacgtagccaggtgtctcggac

SEQ ID NO: 282474 - DNA, 25 bp, Mus musculus
attgacgtagcctggtgtctcggac

SEQ ID NO: 282475 - DNA, 25 bp, Mus musculus
attgacgtgaaacagtgtgtcctgc

SEQ ID NO: 282476 - DNA, 25 bp, Mus musculus
attgacgtgaaagagtgtgtcctgc

SEQ ID NO: 282477 - DNA, 25 bp, Mus musculus
attgacgttaatctgttttcactgg

SEQ ID NO: 282478 - DNA, 25 bp, Mus musculus
attgacgttaatgtgttttcactgg

SEQ ID NO: 282479 - DNA, 25 bp, Mus musculus
attgactacaaacccatctattgct

SEQ ID NO: 282480 - DNA, 25 bp, Mus musculus
attgactacaaagccatctattgct

SEQ ID NO: 282481 - DNA, 25 bp, Mus musculus
attgactactctagggactccaggg

SEQ ID NO: 282482 - DNA, 25 bp, Mus musculus
attgactactcttgggactccaggg

SEQ ID NO: 282483 - DNA, 25 bp, Mus musculus
attgactagaccaagattctgtggg

SEQ ID NO: 282484 - DNA, 25 bp, Mus musculus
attgactagacctagattctgtggg

SEQ ID NO: 282485 - DNA, 25 bp, Mus musculus
attgactaggagatttgactgcaca

SEQ ID NO: 282486 - DNA, 25 bp, Mus musculus
attgactaggagttttgactgcaca

SEQ ID NO: 282487 - DNA, 25 bp, Mus musculus
attgactattgaaagcccctcccag

SEQ ID NO: 282488 - DNA, 25 bp, Mus musculus
attgactattgatagcccctcccag

SEQ ID NO: 282489 - DNA, 25 bp, Mus musculus
attgactcaaccctaaatttcgttg

SEQ ID NO: 282490 - DNA, 25 bp, Mus musculus
attgactcaaccgtaaatttcgttg

SEQ ID NO: 282491 - DNA, 25 bp, Mus musculus
attgactcagatatcagcggcaccc

SEQ ID NO: 282492 - DNA, 25 bp, Mus musculus
attgactcagatttcagcggcaccc

SEQ ID NO: 282493 - DNA, 25 bp, Mus musculus
attgactccagtccccaggacaaat

SEQ ID NO: 282494 - DNA, 25 bp, Mus musculus
attgactccagtgcccaggacaaat

SEQ ID NO: 282495 - DNA, 25 bp, Mus musculus
attgactcgttgctgtccaggacgt

SEQ ID NO: 282496 - DNA, 25 bp, Mus musculus
attgactcgttggtgtccaggacgt

SEQ ID NO: 282497 - DNA, 25 bp, Mus musculus
attgactctactcatctctttttca

SEQ ID NO: 282498 - DNA, 25 bp, Mus musculus
attgactctactgatctctttttca

SEQ ID NO: 282499 - DNA, 25 bp, Mus musculus
attgactctcatagttacccttttc

SEQ ID NO: 282500 - DNA, 25 bp, Mus musculus
attgactctcattgttacccttttc

SEQ ID NO: 282501 - DNA, 25 bp, Mus musculus
attgactctctgacaagtgttaaag

SEQ ID NO: 282502 - DNA, 25 bp, Mus musculus
attgactctctgtcaagtgttaaag

SEQ ID NO: 282503 - DNA, 25 bp, Mus musculus
attgactctggcctaggcttggcac

SEQ ID NO: 282504 - DNA, 25 bp, Mus musculus
attgactctggcgtaggcttggcac

SEQ ID NO: 282505 - DNA, 25 bp, Mus musculus
attgactctttgaatttcatgttaa

SEQ ID NO: 282506 - DNA, 25 bp, Mus musculus
attgactctttgtatttcatgttaa

SEQ ID NO: 282507 - DNA, 25 bp, Mus musculus
attgactgacataggtgtgtgtgga

SEQ ID NO: 282508 - DNA, 25 bp, Mus musculus
attgactgacattggtgtgtgtgga

SEQ ID NO: 282509 - DNA, 25 bp, Mus musculus
attgactgagtcagcagtttactgc

SEQ ID NO: 282510 - DNA, 25 bp, Mus musculus
attgactgagtctgcagtttactgc

SEQ ID NO: 282511 - DNA, 25 bp, Mus musculus
attgactgcaaaagcctacttcaca

SEQ ID NO: 282512 - DNA, 25 bp, Mus musculus
attgactgcaaatgcctacttcaca

SEQ ID NO: 282513 - DNA, 25 bp, Mus musculus
attgactgcactactctgatttaaa

SEQ ID NO: 282514 - DNA, 25 bp, Mus musculus
attgactgcacttctctgatttaaa

SEQ ID NO: 282515 - DNA, 25 bp, Mus musculus
attgactgccgtcttgtgtggccat

SEQ ID NO: 282516 - DNA, 25 bp, Mus musculus
attgactgccgtgttgtgtggccat

SEQ ID NO: 282517 - DNA, 25 bp, Mus musculus
attgactgggacaaccactgggccg

SEQ ID NO: 282518 - DNA, 25 bp, Mus musculus
attgactgggactaccactgggccg

SEQ ID NO: 282519 - DNA, 25 bp, Mus musculus
attgactgtaaaaccagctgctgct

SEQ ID NO: 282520 - DNA, 25 bp, Mus musculus
attgactgtaaatccagctgctgct

SEQ ID NO: 282521 - DNA, 25 bp, Mus musculus
attgactgtacaatctcttgccttc

SEQ ID NO: 282522 - DNA, 25 bp, Mus musculus
attgactgtacattctcttgccttc

SEQ ID NO: 282523 - DNA, 25 bp, Mus musculus
attgactgtagaacaccctcatgtg

SEQ ID NO: 282524 - DNA, 25 bp, Mus musculus
attgactgtagatcaccctcatgtg

SEQ ID NO: 282525 - DNA, 25 bp, Mus musculus
attgactgtattacttctgtgttat

SEQ ID NO: 282526 - DNA, 25 bp, Mus musculus
attgactgtatttcttctgtgttat

SEQ ID NO: 282527 - DNA, 25 bp, Mus musculus
attgactgtcaaactagaaaccgga

SEQ ID NO: 282528 - DNA, 25 bp, Mus musculus
attgactgtcaaatattctggcgtt

SEQ ID NO: 282529 - DNA, 25 bp, Mus musculus
attgactgtcaatctagaaaccgga

SEQ ID NO: 282530 - DNA, 25 bp, Mus musculus
attgactgtcaattattctggcgtt

SEQ ID NO: 282531 - DNA, 25 bp, Mus musculus
attgactgtcgtaattccatcgtgt

SEQ ID NO: 282532 - DNA, 25 bp, Mus musculus
attgactgtcgttattccatcgtgt

SEQ ID NO: 282533 - DNA, 25 bp, Mus musculus
attgacttaaccacctgatgttcac

SEQ ID NO: 282534 - DNA, 25 bp, Mus musculus
attgacttaacctcctgatgttcac

SEQ ID NO: 282535 - DNA, 25 bp, Mus musculus
attgacttacacacatagcctagag

SEQ ID NO: 282536 - DNA, 25 bp, Mus musculus
attgacttacactcatagcctagag

SEQ ID NO: 282537 - DNA, 25 bp, Mus musculus
attgacttacttctaagcccttgag

SEQ ID NO: 282538 - DNA, 25 bp, Mus musculus
attgacttacttgtaagcccttgag

SEQ ID NO: 282539 - DNA, 25 bp, Mus musculus
attgacttcacaacgggctcagagc

SEQ ID NO: 282540 - DNA, 25 bp, Mus musculus
attgacttcacatcgggctcagagc

SEQ ID NO: 282541 - DNA, 25 bp, Mus musculus
attgacttcagtaggtatcctatga

SEQ ID NO: 282542 - DNA, 25 bp, Mus musculus
attgacttcagttggtatcctatga

SEQ ID NO: 282543 - DNA, 25 bp, Mus musculus
attgacttccacaaaagatgtgtgc

SEQ ID NO: 282544 - DNA, 25 bp, Mus musculus
attgacttccacagaagatgggtgg

SEQ ID NO: 282545 - DNA, 25 bp, Mus musculus
attgacttccactaaagatgtgtgc

SEQ ID NO: 282546 - DNA, 25 bp, Mus musculus
attgacttccactgaagatgggtgg

SEQ ID NO: 282547 - DNA, 25 bp, Mus musculus
attgacttcctgaacgtggtgacct

SEQ ID NO: 282548 - DNA, 25 bp, Mus musculus
attgacttcctgtacgtggtgacct

SEQ ID NO: 282549 - DNA, 25 bp, Mus musculus
attgacttccttatatacttaatag

SEQ ID NO: 282550 - DNA, 25 bp, Mus musculus
attgacttccttttatacttaatag

SEQ ID NO: 282551 - DNA, 25 bp, Mus musculus
attgactttaaaacctaaatctgag

SEQ ID NO: 282552 - DNA, 25 bp, Mus musculus
attgactttaaatcctaaatctgag

SEQ ID NO: 282553 - DNA, 25 bp, Mus musculus
attgagaaagttattgtcagaattt

SEQ ID NO: 282554 - DNA, 25 bp, Mus musculus
attgagaaagtttttgtcagaattt

SEQ ID NO: 282555 - DNA, 25 bp, Mus musculus
attgagaaatctccctatcagtttt

SEQ ID NO: 282556 - DNA, 25 bp, Mus musculus
attgagaaatctgcctatcagtttt

SEQ ID NO: 282557 - DNA, 25 bp, Mus musculus
attgagaagaacctgtcctgcgggt

SEQ ID NO: 282558 - DNA, 25 bp, Mus musculus
attgagaagaacgtgtcctgcgggt

SEQ ID NO: 282559 - DNA, 25 bp, Mus musculus
attgagaagcgtctcagctatctta

SEQ ID NO: 282560 - DNA, 25 bp, Mus musculus
attgagaagcgtgtcagctatctta

SEQ ID NO: 282561 - DNA, 25 bp, Mus musculus
attgagaagctcaacctgtgatctg

SEQ ID NO: 282562 - DNA, 25 bp, Mus musculus
attgagaagctctacctgtgatctg

SEQ ID NO: 282563 - DNA, 25 bp, Mus musculus
attgagaagctgacctgttgactgt

SEQ ID NO: 282564 - DNA, 25 bp, Mus musculus
attgagaagctgtcctgttgactgt

SEQ ID NO: 282565 - DNA, 25 bp, Mus musculus
attgagaatagaaccagtcagcccc

SEQ ID NO: 282566 - DNA, 25 bp, Mus musculus
attgagaatagatccagtcagcccc

SEQ ID NO: 282567 - DNA, 25 bp, Mus musculus
attgagaatgctaagaggttttgtt

SEQ ID NO: 282568 - DNA, 25 bp, Mus musculus
attgagaatgcttagaggttttgtt

SEQ ID NO: 282569 - DNA, 25 bp, Mus musculus
attgagacaggcatctatttctacc

SEQ ID NO: 282570 - DNA, 25 bp, Mus musculus
attgagacaggcttctatttctacc

SEQ ID NO: 282571 - DNA, 25 bp, Mus musculus
attgagaccaaactgaacctctttt

SEQ ID NO: 282572 - DNA, 25 bp, Mus musculus
attgagaccaaagtgaacctctttt

SEQ ID NO: 282573 - DNA, 25 bp, Mus musculus
attgagacccctagtgctagacctt

SEQ ID NO: 282574 - DNA, 25 bp, Mus musculus
attgagaccccttgtgctagacctt

SEQ ID NO: 282575 - DNA, 25 bp, Mus musculus
attgagacccgcaaaataatatgta

SEQ ID NO: 282576 - DNA, 25 bp, Mus musculus
attgagacccgctaaataatatgta

SEQ ID NO: 282577 - DNA, 25 bp, Mus musculus
attgagacctctatacctgtgacat

SEQ ID NO: 282578 - DNA, 25 bp, Mus musculus
attgagacctctttacctgtgacat

SEQ ID NO: 282579 - DNA, 25 bp, Mus musculus
attgagacgtggatcctggatttca

SEQ ID NO: 282580 - DNA, 25 bp, Mus musculus
attgagacgtggttcctggatttca

SEQ ID NO: 282581 - DNA, 25 bp, Mus musculus
attgagactcgacattcctcggtat

SEQ ID NO: 282582 - DNA, 25 bp, Mus musculus
attgagactcgagattcctcggtat

SEQ ID NO: 282583 - DNA, 25 bp, Mus musculus
attgagagactcagcatccacccga

SEQ ID NO: 282584 - DNA, 25 bp, Mus musculus
attgagagactcatgctagggcctg

SEQ ID NO: 282585 - DNA, 25 bp, Mus musculus
attgagagactctgcatccacccga

SEQ ID NO: 282586 - DNA, 25 bp, Mus musculus
attgagagactcttgctagggcctg

SEQ ID NO: 282587 - DNA, 25 bp, Mus musculus
attgagagccaaatctttttcctga

SEQ ID NO: 282588 - DNA, 25 bp, Mus musculus
attgagagccaattctttttcctga

SEQ ID NO: 282589 - DNA, 25 bp, Mus musculus
attgagagcccaaaggtggcaataa

SEQ ID NO: 282590 - DNA, 25 bp, Mus musculus
attgagagcccataggtggcaataa

SEQ ID NO: 282591 - DNA, 25 bp, Mus musculus
attgagagctgcagttctagactct

SEQ ID NO: 282592 - DNA, 25 bp, Mus musculus
attgagagctgctgttctagactct

SEQ ID NO: 282593 - DNA, 25 bp, Mus musculus
attgagaggcccagtgctccggctt

SEQ ID NO: 282594 - DNA, 25 bp, Mus musculus
attgagaggccctgtgctccggctt

SEQ ID NO: 282595 - DNA, 25 bp, Mus musculus
attgagaggcttacctaccacatgt

SEQ ID NO: 282596 - DNA, 25 bp, Mus musculus
attgagaggctttcctaccacatgt

SEQ ID NO: 282597 - DNA, 25 bp, Mus musculus
attgagagggatccttcaccaactt

SEQ ID NO: 282598 - DNA, 25 bp, Mus musculus
attgagagggatgcttcaccaactt

SEQ ID NO: 282599 - DNA, 25 bp, Mus musculus
attgagagttctctatgttttgaaa

SEQ ID NO: 282600 - DNA, 25 bp, Mus musculus
attgagagttctgtatgttttgaaa

SEQ ID NO: 282601 - DNA, 25 bp, Mus musculus
attgagatacagctcatgcttccat

SEQ ID NO: 282602 - DNA, 25 bp, Mus musculus
attgagatacaggtcatgcttccat

SEQ ID NO: 282603 - DNA, 25 bp, Mus musculus
attgagatagcgaaagccatgaggc

SEQ ID NO: 282604 - DNA, 25 bp, Mus musculus
attgagatagcgtaagccatgaggc

SEQ ID NO: 282605 - DNA, 25 bp, Mus musculus
attgagatcacaaacctcttcataa

SEQ ID NO: 282606 - DNA, 25 bp, Mus musculus
attgagatcacatacctcttcataa

SEQ ID NO: 282607 - DNA, 25 bp, Mus musculus
attgagatcagtcaccttttctccc

SEQ ID NO: 282608 - DNA, 25 bp, Mus musculus
attgagatcagtgaccttttctccc

SEQ ID NO: 282609 - DNA, 25 bp, Mus musculus
attgagatccatctgcatggccctc

SEQ ID NO: 282610 - DNA, 25 bp, Mus musculus
attgagatccatgtgcatggccctc

SEQ ID NO: 282611 - DNA, 25 bp, Mus musculus
attgagatgcctatagattttgttt

SEQ ID NO: 282612 - DNA, 25 bp, Mus musculus
attgagatgcctttagattttgttt

SEQ ID NO: 282613 - DNA, 25 bp, Mus musculus
attgagattagcagaggccgactct

SEQ ID NO: 282614 - DNA, 25 bp, Mus musculus
attgagattagctgaggccgactct

SEQ ID NO: 282615 - DNA, 25 bp, Mus musculus
attgagattcaaatctggctattct

SEQ ID NO: 282616 - DNA, 25 bp, Mus musculus
attgagattcaattctggctattct

SEQ ID NO: 282617 - DNA, 25 bp, Mus musculus
attgagattcccacaagaagattct

SEQ ID NO: 282618 - DNA, 25 bp, Mus musculus
attgagattccctcaagaagattct

SEQ ID NO: 282619 - DNA, 25 bp, Mus musculus
attgagattcttatgtgggcttttt

SEQ ID NO: 282620 - DNA, 25 bp, Mus musculus
attgagattcttttgtgggcttttt

SEQ ID NO: 282621 - DNA, 25 bp, Mus musculus
attgagattgttcttgttcaaacat

SEQ ID NO: 282622 - DNA, 25 bp, Mus musculus
attgagattgttgttgttcaaacat

SEQ ID NO: 282623 - DNA, 25 bp, Mus musculus
attgagatttgcattcagggcctcc

SEQ ID NO: 282624 - DNA, 25 bp, Mus musculus
attgagatttgctttcagggcctcc

SEQ ID NO: 282625 - DNA, 25 bp, Mus musculus
attgagcaaagccactcagggacac

SEQ ID NO: 282626 - DNA, 25 bp, Mus musculus
attgagcaaagcgactcagggacac

SEQ ID NO: 282627 - DNA, 25 bp, Mus musculus
attgagcaattcaatctcccgtgga

SEQ ID NO: 282628 - DNA, 25 bp, Mus musculus
attgagcaattctatctcccgtgga

SEQ ID NO: 282629 - DNA, 25 bp, Mus musculus
attgagcacatactttattcttcta

SEQ ID NO: 282630 - DNA, 25 bp, Mus musculus
attgagcacatagtttattcttcta

SEQ ID NO: 282631 - DNA, 25 bp, Mus musculus
attgagcacatccttcgcaagctgc

SEQ ID NO: 282632 - DNA, 25 bp, Mus musculus
attgagcacatcgttcgcaagctgc

SEQ ID NO: 282633 - DNA, 25 bp, Mus musculus
attgagcagcaaacgttctgaacca

SEQ ID NO: 282634 - DNA, 25 bp, Mus musculus
attgagcagcaatcgttctgaacca

SEQ ID NO: 282635 - DNA, 25 bp, Mus musculus
attgagcagcggaagctggatgaca

SEQ ID NO: 282636 - DNA, 25 bp, Mus musculus
attgagcagcggtagctggatgaca

SEQ ID NO: 282637 - DNA, 25 bp, Mus musculus
attgagcagctcactcatcagtgct

SEQ ID NO: 282638 - DNA, 25 bp, Mus musculus
attgagcagctcatcaccaaatttg

SEQ ID NO: 282639 - DNA, 25 bp, Mus musculus
attgagcagctctctcatcagtgct

SEQ ID NO: 282640 - DNA, 25 bp, Mus musculus
attgagcagctcttcaccaaatttg

SEQ ID NO: 282641 - DNA, 25 bp, Mus musculus
attgagcagctgaggtaccatcgca

SEQ ID NO: 282642 - DNA, 25 bp, Mus musculus
attgagcagctgtggtaccatcgca

SEQ ID NO: 282643 - DNA, 25 bp, Mus musculus
attgagcatgccaagcagcggcagg

SEQ ID NO: 282644 - DNA, 25 bp, Mus musculus
attgagcatgcctagcagcggcagg

SEQ ID NO: 282645 - DNA, 25 bp, Mus musculus
attgagccaatcaagcttttttcag

SEQ ID NO: 282646 - DNA, 25 bp, Mus musculus
attgagccaatctagcttttttcag

SEQ ID NO: 282647 - DNA, 25 bp, Mus musculus
attgagccatgactttagctcccca

SEQ ID NO: 282648 - DNA, 25 bp, Mus musculus
attgagccatgagtttagctcccca

SEQ ID NO: 282649 - DNA, 25 bp, Mus musculus
attgagccatttatatagctcctaa

SEQ ID NO: 282650 - DNA, 25 bp, Mus musculus
attgagccatttttatagctcctaa

SEQ ID NO: 282651 - DNA, 25 bp, Mus musculus
attgagcccaagaatatttacatta

SEQ ID NO: 282652 - DNA, 25 bp, Mus musculus
attgagcccaagtatatttacatta

SEQ ID NO: 282653 - DNA, 25 bp, Mus musculus
attgagcctccaagcagttgcacat

SEQ ID NO: 282654 - DNA, 25 bp, Mus musculus
attgagcctccatgcagttgcacat

SEQ ID NO: 282655 - DNA, 25 bp, Mus musculus
attgagccttatcatcagccccaaa

SEQ ID NO: 282656 - DNA, 25 bp, Mus musculus
attgagccttatgatcagccccaaa

SEQ ID NO: 282657 - DNA, 25 bp, Mus musculus
attgagcctttaagacgcttctcct

SEQ ID NO: 282658 - DNA, 25 bp, Mus musculus
attgagcctttatgacgcttctcct

SEQ ID NO: 282659 - DNA, 25 bp, Mus musculus
attgagcgccaaccatcacagagtg

SEQ ID NO: 282660 - DNA, 25 bp, Mus musculus
attgagcgccaagcatcacagagtg

SEQ ID NO: 282661 - DNA, 25 bp, Mus musculus
attgagctacacctgaatggaccct

SEQ ID NO: 282662 - DNA, 25 bp, Mus musculus
attgagctacacgtgaatggaccct

SEQ ID NO: 282663 - DNA, 25 bp, Mus musculus
attgagctattacaccagttttaac

SEQ ID NO: 282664 - DNA, 25 bp, Mus musculus
attgagctattagaccagttttaac

SEQ ID NO: 282665 - DNA, 25 bp, Mus musculus
attgagctatttacacttactgtgt

SEQ ID NO: 282666 - DNA, 25 bp, Mus musculus
attgagctattttcacttactgtgt

SEQ ID NO: 282667 - DNA, 25 bp, Mus musculus
attgagctctaaatattcctggtgg

SEQ ID NO: 282668 - DNA, 25 bp, Mus musculus
attgagctctaattattcctggtgg

SEQ ID NO: 282669 - DNA, 25 bp, Mus musculus
attgagctctagcttcgatatcggg

SEQ ID NO: 282670 - DNA, 25 bp, Mus musculus
attgagctctaggttcgatatcggg

SEQ ID NO: 282671 - DNA, 25 bp, Mus musculus
attgagctgaatctccctggcacca

SEQ ID NO: 282672 - DNA, 25 bp, Mus musculus
attgagctgaatgtccctggcacca

SEQ ID NO: 282673 - DNA, 25 bp, Mus musculus
attgagctgcaaagaccctctcttt

SEQ ID NO: 282674 - DNA, 25 bp, Mus musculus
attgagctgcaatgaccctctcttt

SEQ ID NO: 282675 - DNA, 25 bp, Mus musculus
attgagctgcgcctccagcctgaat

SEQ ID NO: 282676 - DNA, 25 bp, Mus musculus
attgagctgcgcgtccagcctgaat

SEQ ID NO: 282677 - DNA, 25 bp, Mus musculus
attgagcttatcacttctcagattt

SEQ ID NO: 282678 - DNA, 25 bp, Mus musculus
attgagcttatctcttctcagattt

SEQ ID NO: 282679 - DNA, 25 bp, Mus musculus
attgagcttccaatttagtggttca

SEQ ID NO: 282680 - DNA, 25 bp, Mus musculus
attgagcttccattttagtggttca

SEQ ID NO: 282681 - DNA, 25 bp, Mus musculus
attgaggaacagagctgatgtgatc

SEQ ID NO: 282682 - DNA, 25 bp, Mus musculus
attgaggaacagtgctgatgtgatc

SEQ ID NO: 282683 - DNA, 25 bp, Mus musculus
attgaggactcaccacaggtggccc

SEQ ID NO: 282684 - DNA, 25 bp, Mus musculus
attgaggactcagcacaggtggccc

SEQ ID NO: 282685 - DNA, 25 bp, Mus musculus
attgaggaggaccactgtcaccgcc

SEQ ID NO: 282686 - DNA, 25 bp, Mus musculus
attgaggaggacgactgtcaccgcc

SEQ ID NO: 282687 - DNA, 25 bp, Mus musculus
attgaggccagcatgtgccggataa

SEQ ID NO: 282688 - DNA, 25 bp, Mus musculus
attgaggccagcttgtgccggataa

SEQ ID NO: 282689 - DNA, 25 bp, Mus musculus
attgaggcctccatgtgggaagtgt

SEQ ID NO: 282690 - DNA, 25 bp, Mus musculus
attgaggcctccttgtgggaagtgt

SEQ ID NO: 282691 - DNA, 25 bp, Mus musculus
attgaggctaagacacctgtaggat

SEQ ID NO: 282692 - DNA, 25 bp, Mus musculus
attgaggctaagtcacctgtaggat

SEQ ID NO: 282693 - DNA, 25 bp, Mus musculus
attgaggctgcaactcggatccgag

SEQ ID NO: 282694 - DNA, 25 bp, Mus musculus
attgaggctgcatctcggatccgag

SEQ ID NO: 282695 - DNA, 25 bp, Mus musculus
attgaggctgtaacttaatgggaac

SEQ ID NO: 282696 - DNA, 25 bp, Mus musculus
attgaggctgtatcttaatgggaac

SEQ ID NO: 282697 - DNA, 25 bp, Mus musculus
attgagggactgacctcctgggtca

SEQ ID NO: 282698 - DNA, 25 bp, Mus musculus
attgagggactgctgcttgtaccac

SEQ ID NO: 282699 - DNA, 25 bp, Mus musculus
attgagggactggtgcttgtaccac

SEQ ID NO: 282700 - DNA, 25 bp, Mus musculus
attgagggactgtcctcctgggtca

SEQ ID NO: 282701 - DNA, 25 bp, Mus musculus
attgagggtgttcgcatccttctca

SEQ ID NO: 282702 - DNA, 25 bp, Mus musculus
attgagggtgttggcatccttctca

SEQ ID NO: 282703 - DNA, 25 bp, Mus musculus
attgaggtcctgctggacgctgacc

SEQ ID NO: 282704 - DNA, 25 bp, Mus musculus
attgaggtcctggtggacgctgacc

SEQ ID NO: 282705 - DNA, 25 bp, Mus musculus
attgaggtgctcaggttggaataaa

SEQ ID NO: 282706 - DNA, 25 bp, Mus musculus
attgaggtgctctggttggaataaa

SEQ ID NO: 282707 - DNA, 25 bp, Mus musculus
attgaggtggatcccgacaccaagg

SEQ ID NO: 282708 - DNA, 25 bp, Mus musculus
attgaggtggatgccgacaccaagg

SEQ ID NO: 282709 - DNA, 25 bp, Mus musculus
attgaggttcctccacattggattt

SEQ ID NO: 282710 - DNA, 25 bp, Mus musculus
attgaggttcctgcacattggattt

SEQ ID NO: 282711 - DNA, 25 bp, Mus musculus
attgaggtttacacttcactggcgt

SEQ ID NO: 282712 - DNA, 25 bp, Mus musculus
attgaggtttactcttcactggcgt

SEQ ID NO: 282713 - DNA, 25 bp, Mus musculus
attgaggtttttaccatggaactag

SEQ ID NO: 282714 - DNA, 25 bp, Mus musculus
attgaggttttttccatggaactag

SEQ ID NO: 282715 - DNA, 25 bp, Mus musculus
attgagtaactcacccatccttctc

SEQ ID NO: 282716 - DNA, 25 bp, Mus musculus
attgagtaactctcccatccttctc

SEQ ID NO: 282717 - DNA, 25 bp, Mus musculus
attgagtactaccttgggttcacag

SEQ ID NO: 282718 - DNA, 25 bp, Mus musculus
attgagtactacgttgggttcacag

SEQ ID NO: 282719 - DNA, 25 bp, Mus musculus
attgagtagaccaggacctctctgc

SEQ ID NO: 282720 - DNA, 25 bp, Mus musculus
attgagtagacctggacctctctgc

SEQ ID NO: 282721 - DNA, 25 bp, Mus musculus
attgagtatcctaaaggacaagttc

SEQ ID NO: 282722 - DNA, 25 bp, Mus musculus
attgagtatccttaaggacaagttc

SEQ ID NO: 282723 - DNA, 25 bp, Mus musculus
attgagtatgctcacttcttccttc

SEQ ID NO: 282724 - DNA, 25 bp, Mus musculus
attgagtatgctgacttcttccttc

SEQ ID NO: 282725 - DNA, 25 bp, Mus musculus
attgagtcacctagcccgttcaata

SEQ ID NO: 282726 - DNA, 25 bp, Mus musculus
attgagtcaccttgcccgttcaata

SEQ ID NO: 282727 - DNA, 25 bp, Mus musculus
attgagtccaggcacaggccagcaa

SEQ ID NO: 282728 - DNA, 25 bp, Mus musculus
attgagtccagggacaggccagcaa

SEQ ID NO: 282729 - DNA, 25 bp, Mus musculus
attgagtccttccttctgtcagcta

SEQ ID NO: 282730 - DNA, 25 bp, Mus musculus
attgagtccttcgttctgtcagcta

SEQ ID NO: 282731 - DNA, 25 bp, Mus musculus
attgagtccttgagtcatcgtcata

SEQ ID NO: 282732 - DNA, 25 bp, Mus musculus
attgagtccttgtgtcatcgtcata

SEQ ID NO: 282733 - DNA, 25 bp, Mus musculus
attgagtgacttatcgctgtaccgt

SEQ ID NO: 282734 - DNA, 25 bp, Mus musculus
attgagtgacttttcgctgtaccgt

SEQ ID NO: 282735 - DNA, 25 bp, Mus musculus
attgagtgccaacccaggatcagcc

SEQ ID NO: 282736 - DNA, 25 bp, Mus musculus
attgagtgccaagccaggatcagcc

SEQ ID NO: 282737 - DNA, 25 bp, Mus musculus
attgagtggattagcacggatcttt

SEQ ID NO: 282738 - DNA, 25 bp, Mus musculus
attgagtggatttgcacggatcttt

SEQ ID NO: 282739 - DNA, 25 bp, Mus musculus
attgagtgtcacatgcacggaaagt

SEQ ID NO: 282740 - DNA, 25 bp, Mus musculus
attgagtgtcacttgcacggaaagt

SEQ ID NO: 282741 - DNA, 25 bp, Mus musculus
attgagttacttcctgtacccagaa

SEQ ID NO: 282742 - DNA, 25 bp, Mus musculus
attgagttacttgctgtacccagaa

SEQ ID NO: 282743 - DNA, 25 bp, Mus musculus
attgagttatctatgtatgctgaaa

SEQ ID NO: 282744 - DNA, 25 bp, Mus musculus
attgagttatctttgtatgctgaaa

SEQ ID NO: 282745 - DNA, 25 bp, Mus musculus
attgagttcaacaagaggtaacact

SEQ ID NO: 282746 - DNA, 25 bp, Mus musculus
attgagttcaactagaggtaacact

SEQ ID NO: 282747 - DNA, 25 bp, Mus musculus
attgagttccatagttcctgagtct

SEQ ID NO: 282748 - DNA, 25 bp, Mus musculus
attgagttccattgttcctgagtct

SEQ ID NO: 282749 - DNA, 25 bp, Mus musculus
attgagttgacaagtgaccagcgaa

SEQ ID NO: 282750 - DNA, 25 bp, Mus musculus
attgagttgacatgtgaccagcgaa

SEQ ID NO: 282751 - DNA, 25 bp, Mus musculus
attgagttgcgccagactttgtctc

SEQ ID NO: 282752 - DNA, 25 bp, Mus musculus
attgagttgcgcgagactttgtctc

SEQ ID NO: 282753 - DNA, 25 bp, Mus musculus
attgagttgtgcattcactgctggg

SEQ ID NO: 282754 - DNA, 25 bp, Mus musculus
attgagttgtgctttcactgctggg

SEQ ID NO: 282755 - DNA, 25 bp, Mus musculus
attgagtttgtaacgggcaccaaga

SEQ ID NO: 282756 - DNA, 25 bp, Mus musculus
attgagtttgtatcgggcaccaaga

SEQ ID NO: 282757 - DNA, 25 bp, Mus musculus
attgagttttcactccttggattta

SEQ ID NO: 282758 - DNA, 25 bp, Mus musculus
attgagttttcagtccttggattta

SEQ ID NO: 282759 - DNA, 25 bp, Mus musculus
attgataaatctatggaccagagcg

SEQ ID NO: 282760 - DNA, 25 bp, Mus musculus
attgataaatctttggaccagagcg

SEQ ID NO: 282761 - DNA, 25 bp, Mus musculus
attgataaccacagagttctgctct

SEQ ID NO: 282762 - DNA, 25 bp, Mus musculus
attgataaccactgagttctgctct

SEQ ID NO: 282763 - DNA, 25 bp, Mus musculus
attgataagcagatcatattgatta

SEQ ID NO: 282764 - DNA, 25 bp, Mus musculus
attgataagcagttcatattgatta

SEQ ID NO: 282765 - DNA, 25 bp, Mus musculus
attgatacacctacagatcgccatt

SEQ ID NO: 282766 - DNA, 25 bp, Mus musculus
attgatacaccttcagatcgccatt

SEQ ID NO: 282767 - DNA, 25 bp, Mus musculus
attgataccaagatcggctgcttcg

SEQ ID NO: 282768 - DNA, 25 bp, Mus musculus
attgataccaagttcggctgcttcg

SEQ ID NO: 282769 - DNA, 25 bp, Mus musculus
attgataccattatgtgggctggga

SEQ ID NO: 282770 - DNA, 25 bp, Mus musculus
attgataccattttgtgggctggga

SEQ ID NO: 282771 - DNA, 25 bp, Mus musculus
attgatacccatctctgcatactct

SEQ ID NO: 282772 - DNA, 25 bp, Mus musculus
attgatacccatgtctgcatactct

SEQ ID NO: 282773 - DNA, 25 bp, Mus musculus
attgatacctatctgcacgtgtgca

SEQ ID NO: 282774 - DNA, 25 bp, Mus musculus
attgatacctatgtgcacgtgtgca

SEQ ID NO: 282775 - DNA, 25 bp, Mus musculus
attgatagctacaggctacttcctt

SEQ ID NO: 282776 - DNA, 25 bp, Mus musculus
attgatagctactggctacttcctt

SEQ ID NO: 282777 - DNA, 25 bp, Mus musculus
attgataggacgctccctccggaga

SEQ ID NO: 282778 - DNA, 25 bp, Mus musculus
attgataggacggtccctccggaga

SEQ ID NO: 282779 - DNA, 25 bp, Mus musculus
attgatataggtactctcaagcccc

SEQ ID NO: 282780 - DNA, 25 bp, Mus musculus
attgatataggttctctcaagcccc

SEQ ID NO: 282781 - DNA, 25 bp, Mus musculus
attgatatcatcctttctccacacg

SEQ ID NO: 282782 - DNA, 25 bp, Mus musculus
attgatatcatcgtttctccacacg

SEQ ID NO: 282783 - DNA, 25 bp, Mus musculus
attgatatcctgctctccaatgctg

SEQ ID NO: 282784 - DNA, 25 bp, Mus musculus
attgatatcctggtctccaatgctg

SEQ ID NO: 282785 - DNA, 25 bp, Mus musculus
attgatatctacatggtcactctgg

SEQ ID NO: 282786 - DNA, 25 bp, Mus musculus
attgatatctacttggtcactctgg

SEQ ID NO: 282787 - DNA, 25 bp, Mus musculus
attgatatgtgcatcttatgattct

SEQ ID NO: 282788 - DNA, 25 bp, Mus musculus
attgatatgtgcttcttatgattct

SEQ ID NO: 282789 - DNA, 25 bp, Mus musculus
attgatattgccagtcggtcctgca

SEQ ID NO: 282790 - DNA, 25 bp, Mus musculus
attgatattgcctgtcggtcctgca

SEQ ID NO: 282791 - DNA, 25 bp, Mus musculus
attgatatttccaatctttcctatc

SEQ ID NO: 282792 - DNA, 25 bp, Mus musculus
attgatatttcctatctttcctatc

SEQ ID NO: 282793 - DNA, 25 bp, Mus musculus
attgatatttgtccttctgcctaaa

SEQ ID NO: 282794 - DNA, 25 bp, Mus musculus
attgatatttgtgcttctgcctaaa

SEQ ID NO: 282795 - DNA, 25 bp, Mus musculus
attgatcaagccacatgtgacacac

SEQ ID NO: 282796 - DNA, 25 bp, Mus musculus
attgatcaagcctcatgtgacacac

SEQ ID NO: 282797 - DNA, 25 bp, Mus musculus
attgatcacacaagaaaaccctctc

SEQ ID NO: 282798 - DNA, 25 bp, Mus musculus
attgatcacacatgaaaaccctctc

SEQ ID NO: 282799 - DNA, 25 bp, Mus musculus
attgatcacagtcactattattgtt

SEQ ID NO: 282800 - DNA, 25 bp, Mus musculus
attgatcacagtgactattattgtt

SEQ ID NO: 282801 - DNA, 25 bp, Mus musculus
attgatcacggcatggatggcttac

SEQ ID NO: 282802 - DNA, 25 bp, Mus musculus
attgatcacggcttggatggcttac

SEQ ID NO: 282803 - DNA, 25 bp, Mus musculus
attgatcactgcagccccaaactag

SEQ ID NO: 282804 - DNA, 25 bp, Mus musculus
attgatcactgctgccccaaactag

SEQ ID NO: 282805 - DNA, 25 bp, Mus musculus
attgatcagtcaagaaccaattagg

SEQ ID NO: 282806 - DNA, 25 bp, Mus musculus
attgatcagtcatgaaccaattagg

SEQ ID NO: 282807 - DNA, 25 bp, Mus musculus
attgatcatcctatggcagctgttt

SEQ ID NO: 282808 - DNA, 25 bp, Mus musculus
attgatcatcctctgattcgggcca

SEQ ID NO: 282809 - DNA, 25 bp, Mus musculus
attgatcatcctgtgattcgggcca

SEQ ID NO: 282810 - DNA, 25 bp, Mus musculus
attgatcatcctttggcagctgttt

SEQ ID NO: 282811 - DNA, 25 bp, Mus musculus
attgatcatctgaccagacggcaag

SEQ ID NO: 282812 - DNA, 25 bp, Mus musculus
attgatcatctgtccagacggcaag

SEQ ID NO: 282813 - DNA, 25 bp, Mus musculus
attgatcatgtcagtggaccaggct

SEQ ID NO: 282814 - DNA, 25 bp, Mus musculus
attgatcatgtctgtggaccaggct

SEQ ID NO: 282815 - DNA, 25 bp, Mus musculus
attgatccagcacgcctggaccata

SEQ ID NO: 282816 - DNA, 25 bp, Mus musculus
attgatccagcaggcctggaccata

SEQ ID NO: 282817 - DNA, 25 bp, Mus musculus
attgatccatcaaagagacccactt

SEQ ID NO: 282818 - DNA, 25 bp, Mus musculus
attgatccatcacaacattacattc

SEQ ID NO: 282819 - DNA, 25 bp, Mus musculus
attgatccatcagaacattacattc

SEQ ID NO: 282820 - DNA, 25 bp, Mus musculus
attgatccatcatagagacccactt

SEQ ID NO: 282821 - DNA, 25 bp, Mus musculus
attgatccgcaacttttctatgagc

SEQ ID NO: 282822 - DNA, 25 bp, Mus musculus
attgatccgcaagttttctatgagc

SEQ ID NO: 282823 - DNA, 25 bp, Mus musculus
attgatcctctaattcccttggtta

SEQ ID NO: 282824 - DNA, 25 bp, Mus musculus
attgatcctctatttcccttggtta

SEQ ID NO: 282825 - DNA, 25 bp, Mus musculus
attgatcctgaaatcacttgccatg

SEQ ID NO: 282826 - DNA, 25 bp, Mus musculus
attgatcctgaattcacttgccatg

SEQ ID NO: 282827 - DNA, 25 bp, Mus musculus
attgatcctttcaagcctcagggat

SEQ ID NO: 282828 - DNA, 25 bp, Mus musculus
attgatcctttctagcctcagggat

SEQ ID NO: 282829 - DNA, 25 bp, Mus musculus
attgatcgggtgaagaaacagggca

SEQ ID NO: 282830 - DNA, 25 bp, Mus musculus
attgatcgggtgtagaaacagggca

SEQ ID NO: 282831 - DNA, 25 bp, Mus musculus
attgatctagaaaacctggcccgga

SEQ ID NO: 282832 - DNA, 25 bp, Mus musculus
attgatctagaatacctggcccgga

SEQ ID NO: 282833 - DNA, 25 bp, Mus musculus
attgatctcactactaggtctttgt

SEQ ID NO: 282834 - DNA, 25 bp, Mus musculus
attgatctcacttctaggtctttgt

SEQ ID NO: 282835 - DNA, 25 bp, Mus musculus
attgatctcaggactgttggtaaca

SEQ ID NO: 282836 - DNA, 25 bp, Mus musculus
attgatctcaggtctgttggtaaca

SEQ ID NO: 282837 - DNA, 25 bp, Mus musculus
attgatctccacattctacaacaga

SEQ ID NO: 282838 - DNA, 25 bp, Mus musculus
attgatctccactttctacaacaga

SEQ ID NO: 282839 - DNA, 25 bp, Mus musculus
attgatctctttcatctctcttgag

SEQ ID NO: 282840 - DNA, 25 bp, Mus musculus
attgatctctttgatctctcttgag

SEQ ID NO: 282841 - DNA, 25 bp, Mus musculus
attgatcttaatcgacacctattgt

SEQ ID NO: 282842 - DNA, 25 bp, Mus musculus
attgatcttaatggacacctattgt

SEQ ID NO: 282843 - DNA, 25 bp, Mus musculus
attgatcttctgactgtggaaacca

SEQ ID NO: 282844 - DNA, 25 bp, Mus musculus
attgatcttctgtctgtggaaacca

SEQ ID NO: 282845 - DNA, 25 bp, Mus musculus
attgatctttccactttccgtggtt

SEQ ID NO: 282846 - DNA, 25 bp, Mus musculus
attgatctttcctctttccgtggtt

SEQ ID NO: 282847 - DNA, 25 bp, Mus musculus
attgatgaacgaaaccgcccacttt

SEQ ID NO: 282848 - DNA, 25 bp, Mus musculus
attgatgaacgataccgcccacttt

SEQ ID NO: 282849 - DNA, 25 bp, Mus musculus
attgatgaagcccagtctgaccttg

SEQ ID NO: 282850 - DNA, 25 bp, Mus musculus
attgatgaagccgagtctgaccttg

SEQ ID NO: 282851 - DNA, 25 bp, Mus musculus
attgatgacattccacattgtaaaa

SEQ ID NO: 282852 - DNA, 25 bp, Mus musculus
attgatgacattccactgggctagt

SEQ ID NO: 282853 - DNA, 25 bp, Mus musculus
attgatgacattctctctggccaca

SEQ ID NO: 282854 - DNA, 25 bp, Mus musculus
attgatgacattgcacattgtaaaa

SEQ ID NO: 282855 - DNA, 25 bp, Mus musculus
attgatgacattgcactgggctagt

SEQ ID NO: 282856 - DNA, 25 bp, Mus musculus
attgatgacattgtctctggccaca

SEQ ID NO: 282857 - DNA, 25 bp, Mus musculus
attgatgaccctatgatgccagcca

SEQ ID NO: 282858 - DNA, 25 bp, Mus musculus
attgatgaccctttgatgccagcca

SEQ ID NO: 282859 - DNA, 25 bp, Mus musculus
attgatgagtgccagccagttcgtc

SEQ ID NO: 282860 - DNA, 25 bp, Mus musculus
attgatgagtgcgagccagttcgtc

SEQ ID NO: 282861 - DNA, 25 bp, Mus musculus
attgatgcagacatccacagcacag

SEQ ID NO: 282862 - DNA, 25 bp, Mus musculus
attgatgcagacttccacagcacag

SEQ ID NO: 282863 - DNA, 25 bp, Mus musculus
attgatgcagtgcacctcagtggtt

SEQ ID NO: 282864 - DNA, 25 bp, Mus musculus
attgatgcagtggacctcagtggtt

SEQ ID NO: 282865 - DNA, 25 bp, Mus musculus
attgatgccatcagtactaggttag

SEQ ID NO: 282866 - DNA, 25 bp, Mus musculus
attgatgccatctgtactaggttag

SEQ ID NO: 282867 - DNA, 25 bp, Mus musculus
attgatgcccagatgccatgcttcg

SEQ ID NO: 282868 - DNA, 25 bp, Mus musculus
attgatgcccagttgccatgcttcg

SEQ ID NO: 282869 - DNA, 25 bp, Mus musculus
attgatgcccccacatggatacacg

SEQ ID NO: 282870 - DNA, 25 bp, Mus musculus
attgatgccccctcatggatacacg

SEQ ID NO: 282871 - DNA, 25 bp, Mus musculus
attgatgccctcacagaagatttgg

SEQ ID NO: 282872 - DNA, 25 bp, Mus musculus
attgatgccctctcagaagatttgg

SEQ ID NO: 282873 - DNA, 25 bp, Mus musculus
attgatgcccttaagcctcgtgaga

SEQ ID NO: 282874 - DNA, 25 bp, Mus musculus
attgatgccctttagcctcgtgaga

SEQ ID NO: 282875 - DNA, 25 bp, Mus musculus
attgatgccttaagggtctccataa

SEQ ID NO: 282876 - DNA, 25 bp, Mus musculus
attgatgccttatgggtctccataa

SEQ ID NO: 282877 - DNA, 25 bp, Mus musculus
attgatgcgcatccactacactggg

SEQ ID NO: 282878 - DNA, 25 bp, Mus musculus
attgatgcgcatgcactacactggg

SEQ ID NO: 282879 - DNA, 25 bp, Mus musculus
attgatgcgttgagtgttgcaccaa

SEQ ID NO: 282880 - DNA, 25 bp, Mus musculus
attgatgcgttgtgtgttgcaccaa

SEQ ID NO: 282881 - DNA, 25 bp, Mus musculus
attgatgctcaacaactgttcattc

SEQ ID NO: 282882 - DNA, 25 bp, Mus musculus
attgatgctcaagaactgttcattc

SEQ ID NO: 282883 - DNA, 25 bp, Mus musculus
attgatgctggaaggtcttgtccct

SEQ ID NO: 282884 - DNA, 25 bp, Mus musculus
attgatgctggatggtcttgtccct

SEQ ID NO: 282885 - DNA, 25 bp, Mus musculus
attgatgctgttcttagcgtggcgc

SEQ ID NO: 282886 - DNA, 25 bp, Mus musculus
attgatgctgttgttagcgtggcgc

SEQ ID NO: 282887 - DNA, 25 bp, Mus musculus
attgatgcttacattgtggtatagt

SEQ ID NO: 282888 - DNA, 25 bp, Mus musculus
attgatgcttactttgtggtatagt

SEQ ID NO: 282889 - DNA, 25 bp, Mus musculus
attgatgctttccagagaccccagg

SEQ ID NO: 282890 - DNA, 25 bp, Mus musculus
attgatgctttcgagagaccccagg

SEQ ID NO: 282891 - DNA, 25 bp, Mus musculus
attgatggagacaaccgacttgttc

SEQ ID NO: 282892 - DNA, 25 bp, Mus musculus
attgatggagactaccgacttgttc

SEQ ID NO: 282893 - DNA, 25 bp, Mus musculus
attgatggatcacgccactgacctg

SEQ ID NO: 282894 - DNA, 25 bp, Mus musculus
attgatggatcaggccactgacctg

SEQ ID NO: 282895 - DNA, 25 bp, Mus musculus
attgatggccgactgatccctttac

SEQ ID NO: 282896 - DNA, 25 bp, Mus musculus
attgatggccgagtgatccctttac

SEQ ID NO: 282897 - DNA, 25 bp, Mus musculus
attgatgggacaatgcgccgtgcag

SEQ ID NO: 282898 - DNA, 25 bp, Mus musculus
attgatgggacattgcgccgtgcag

SEQ ID NO: 282899 - DNA, 25 bp, Mus musculus
attgatggtggcactgcagtgtcac

SEQ ID NO: 282900 - DNA, 25 bp, Mus musculus
attgatggtggctctgcagtgtcac

SEQ ID NO: 282901 - DNA, 25 bp, Mus musculus
attgatgtaaaacccttggacttag

SEQ ID NO: 282902 - DNA, 25 bp, Mus musculus
attgatgtaaaagccttggacttag

SEQ ID NO: 282903 - DNA, 25 bp, Mus musculus
attgatgtacttatcctcgggtgac

SEQ ID NO: 282904 - DNA, 25 bp, Mus musculus
attgatgtacttttcctcgggtgac

SEQ ID NO: 282905 - DNA, 25 bp, Mus musculus
attgatgtagaaataactcgctgga

SEQ ID NO: 282906 - DNA, 25 bp, Mus musculus
attgatgtagaattaactcgctgga

SEQ ID NO: 282907 - DNA, 25 bp, Mus musculus
attgatgtagctaatgccctcctga

SEQ ID NO: 282908 - DNA, 25 bp, Mus musculus
attgatgtagcttatgccctcctga

SEQ ID NO: 282909 - DNA, 25 bp, Mus musculus
attgatgtcagcagatttaggagca

SEQ ID NO: 282910 - DNA, 25 bp, Mus musculus
attgatgtcagctgatttaggagca

SEQ ID NO: 282911 - DNA, 25 bp, Mus musculus
attgatgtccttacaggcccaatga

SEQ ID NO: 282912 - DNA, 25 bp, Mus musculus
attgatgtcctttcaggcccaatga

SEQ ID NO: 282913 - DNA, 25 bp, Mus musculus
attgatgtctaccacaattattcca

SEQ ID NO: 282914 - DNA, 25 bp, Mus musculus
attgatgtctacgacaattattcca

SEQ ID NO: 282915 - DNA, 25 bp, Mus musculus
attgatgtctctcagtgaccgaccc

SEQ ID NO: 282916 - DNA, 25 bp, Mus musculus
attgatgtctctgagtgaccgaccc

SEQ ID NO: 282917 - DNA, 25 bp, Mus musculus
attgatgtgattcgccacaagcctg

SEQ ID NO: 282918 - DNA, 25 bp, Mus musculus
attgatgtgattggccacaagcctg

SEQ ID NO: 282919 - DNA, 25 bp, Mus musculus
attgatgtgcagcaggtctccttag

SEQ ID NO: 282920 - DNA, 25 bp, Mus musculus
attgatgtgcaggaggtctccttag

SEQ ID NO: 282921 - DNA, 25 bp, Mus musculus
attgatgtgtaacccatgccggtct

SEQ ID NO: 282922 - DNA, 25 bp, Mus musculus
attgatgtgtaagccatgccggtct

SEQ ID NO: 282923 - DNA, 25 bp, Mus musculus
attgatgtgtataaactgctgccaa

SEQ ID NO: 282924 - DNA, 25 bp, Mus musculus
attgatgtgtattaactgctgccaa

SEQ ID NO: 282925 - DNA, 25 bp, Mus musculus
attgatgttggtctctctcattgag

SEQ ID NO: 282926 - DNA, 25 bp, Mus musculus
attgatgttggtgtctctcattgag

SEQ ID NO: 282927 - DNA, 25 bp, Mus musculus
attgatgtttgtccctaaccccata

SEQ ID NO: 282928 - DNA, 25 bp, Mus musculus
attgatgtttgtgcctaaccccata

SEQ ID NO: 282929 - DNA, 25 bp, Mus musculus
attgatgttttaactcaacagccag

SEQ ID NO: 282930 - DNA, 25 bp, Mus musculus
attgatgttttatctcaacagccag

SEQ ID NO: 282931 - DNA, 25 bp, Mus musculus
attgattaattcaccatgtcttatt

SEQ ID NO: 282932 - DNA, 25 bp, Mus musculus
attgattaattctccatgtcttatt

SEQ ID NO: 282933 - DNA, 25 bp, Mus musculus
attgattagggtagagggcagcaac

SEQ ID NO: 282934 - DNA, 25 bp, Mus musculus
attgattagggttgagggcagcaac

SEQ ID NO: 282935 - DNA, 25 bp, Mus musculus
attgattcacacatcagcctggaac

SEQ ID NO: 282936 - DNA, 25 bp, Mus musculus
attgattcacacttcagcctggaac

SEQ ID NO: 282937 - DNA, 25 bp, Mus musculus
attgattcacgccactgtggagaca

SEQ ID NO: 282938 - DNA, 25 bp, Mus musculus
attgattcacgcgactgtggagaca

SEQ ID NO: 282939 - DNA, 25 bp, Mus musculus
attgattccctgatcactgcattat

SEQ ID NO: 282940 - DNA, 25 bp, Mus musculus
attgattccctgttcactgcattat

SEQ ID NO: 282941 - DNA, 25 bp, Mus musculus
attgattcctatatgcgagacttac

SEQ ID NO: 282942 - DNA, 25 bp, Mus musculus
attgattcctatttgcgagacttac

SEQ ID NO: 282943 - DNA, 25 bp, Mus musculus
attgattcgctcatctaccattccg

SEQ ID NO: 282944 - DNA, 25 bp, Mus musculus
attgattcgctcttctaccattccg

SEQ ID NO: 282945 - DNA, 25 bp, Mus musculus
attgattcgttaccgttcttcagca

SEQ ID NO: 282946 - DNA, 25 bp, Mus musculus
attgattcgttagcgttcttcagca

SEQ ID NO: 282947 - DNA, 25 bp, Mus musculus
attgattctctacctccagatggaa

SEQ ID NO: 282948 - DNA, 25 bp, Mus musculus
attgattctctagctccagatggaa

SEQ ID NO: 282949 - DNA, 25 bp, Mus musculus
attgattgaaagacaactgcctcat

SEQ ID NO: 282950 - DNA, 25 bp, Mus musculus
attgattgaaagtcaactgcctcat

SEQ ID NO: 282951 - DNA, 25 bp, Mus musculus
attgattgaactcacactgctgctt

SEQ ID NO: 282952 - DNA, 25 bp, Mus musculus
attgattgaactgacactgctgctt

SEQ ID NO: 282953 - DNA, 25 bp, Mus musculus
attgattgattcagcctgtcacaga

SEQ ID NO: 282954 - DNA, 25 bp, Mus musculus
attgattgattctgcctgtcacaga

SEQ ID NO: 282955 - DNA, 25 bp, Mus musculus
attgattgccttcaagtcttcctga

SEQ ID NO: 282956 - DNA, 25 bp, Mus musculus
attgattgccttgaagtcttcctga

SEQ ID NO: 282957 - DNA, 25 bp, Mus musculus
attgattgctaacagtgctcttact

SEQ ID NO: 282958 - DNA, 25 bp, Mus musculus
attgattgctaagagtgctcttact

SEQ ID NO: 282959 - DNA, 25 bp, Mus musculus
attgattgctagacgggctgcacac

SEQ ID NO: 282960 - DNA, 25 bp, Mus musculus
attgattgctagtcgggctgcacac

SEQ ID NO: 282961 - DNA, 25 bp, Mus musculus
attgattgtagcagctcttaacccc

SEQ ID NO: 282962 - DNA, 25 bp, Mus musculus
attgattgtagctgctcttaacccc

SEQ ID NO: 282963 - DNA, 25 bp, Mus musculus
attgatttactgatgagcaccttca

SEQ ID NO: 282964 - DNA, 25 bp, Mus musculus
attgatttactgttgagcaccttca

SEQ ID NO: 282965 - DNA, 25 bp, Mus musculus
attgatttcagtctcctttgtggca

SEQ ID NO: 282966 - DNA, 25 bp, Mus musculus
attgatttcagtgtcctttgtggca

SEQ ID NO: 282967 - DNA, 25 bp, Mus musculus
attgatttccaaagtatcctccctt

SEQ ID NO: 282968 - DNA, 25 bp, Mus musculus
attgatttccaacccggtggacctc

SEQ ID NO: 282969 - DNA, 25 bp, Mus musculus
attgatttccaacggtccatcttca

SEQ ID NO: 282970 - DNA, 25 bp, Mus musculus
attgatttccaagccggtggacctc

SEQ ID NO: 282971 - DNA, 25 bp, Mus musculus
attgatttccaagggtccatcttca

SEQ ID NO: 282972 - DNA, 25 bp, Mus musculus
attgatttccaatgtatcctccctt

SEQ ID NO: 282973 - DNA, 25 bp, Mus musculus
attgatttcctccatactactttct

SEQ ID NO: 282974 - DNA, 25 bp, Mus musculus
attgatttcctcgatactactttct

SEQ ID NO: 282975 - DNA, 25 bp, Mus musculus
attgatttcttacaacatgcctctg

SEQ ID NO: 282976 - DNA, 25 bp, Mus musculus
attgatttcttagaacatgcctctg

SEQ ID NO: 282977 - DNA, 25 bp, Mus musculus
attgatttcttccattggttttcgt

SEQ ID NO: 282978 - DNA, 25 bp, Mus musculus
attgatttcttcgattggttttcgt

SEQ ID NO: 282979 - DNA, 25 bp, Mus musculus
attgatttctttctgggcctcatgg

SEQ ID NO: 282980 - DNA, 25 bp, Mus musculus
attgatttctttgtgggcctcatgg

SEQ ID NO: 282981 - DNA, 25 bp, Mus musculus
attgattttcccaacactgtccaaa

SEQ ID NO: 282982 - DNA, 25 bp, Mus musculus
attgattttccctacactgtccaaa

SEQ ID NO: 282983 - DNA, 25 bp, Mus musculus
attgattttgacagagaccccaagc

SEQ ID NO: 282984 - DNA, 25 bp, Mus musculus
attgattttgactgagaccccaagc

SEQ ID NO: 282985 - DNA, 25 bp, Mus musculus
attgattttgggaaggcccagccca

SEQ ID NO: 282986 - DNA, 25 bp, Mus musculus
attgattttgggtaggcccagccca

SEQ ID NO: 282987 - DNA, 25 bp, Mus musculus
attgatttttgtatcatctcccctt

SEQ ID NO: 282988 - DNA, 25 bp, Mus musculus
attgatttttgtttcatctcccctt

SEQ ID NO: 282989 - DNA, 25 bp, Mus musculus
attgcaaaatcccacttttcagggg

SEQ ID NO: 282990 - DNA, 25 bp, Mus musculus
attgcaaaatccgacttttcagggg

SEQ ID NO: 282991 - DNA, 25 bp, Mus musculus
attgcaaacacactgtggcccgcgg

SEQ ID NO: 282992 - DNA, 25 bp, Mus musculus
attgcaaacacagtgtggcccgcgg

SEQ ID NO: 282993 - DNA, 25 bp, Mus musculus
attgcaaacattaaactccctaaga

SEQ ID NO: 282994 - DNA, 25 bp, Mus musculus
attgcaaacatttaactccctaaga

SEQ ID NO: 282995 - DNA, 25 bp, Mus musculus
attgcaaacgctaagggtccaggat

SEQ ID NO: 282996 - DNA, 25 bp, Mus musculus
attgcaaacgcttagggtccaggat

SEQ ID NO: 282997 - DNA, 25 bp, Mus musculus
attgcaacacggctatgtggactca

SEQ ID NO: 282998 - DNA, 25 bp, Mus musculus
attgcaacacgggtatgtggactca

SEQ ID NO: 282999 - DNA, 25 bp, Mus musculus
attgcaacactaatccagccagaac

SEQ ID NO: 283000 - DNA, 25 bp, Mus musculus
attgcaacactattccagccagaac

SEQ ID NO: 283001 - DNA, 25 bp, Mus musculus
attgcaacactcaggctgtttgctt

SEQ ID NO: 283002 - DNA, 25 bp, Mus musculus
attgcaacactctggctgtttgctt

SEQ ID NO: 283003 - DNA, 25 bp, Mus musculus
attgcaacagagaactttgcccctc

SEQ ID NO: 283004 - DNA, 25 bp, Mus musculus
attgcaacagagtactttgcccctc

SEQ ID NO: 283005 - DNA, 25 bp, Mus musculus
attgcaaccttgagccatcatttaa

SEQ ID NO: 283006 - DNA, 25 bp, Mus musculus
attgcaaccttgcttgggcacaaaa

SEQ ID NO: 283007 - DNA, 25 bp, Mus musculus
attgcaaccttggttgggcacaaaa

SEQ ID NO: 283008 - DNA, 25 bp, Mus musculus
attgcaaccttgtgccatcatttaa

SEQ ID NO: 283009 - DNA, 25 bp, Mus musculus
attgcaactaccatcaaaccgggac

SEQ ID NO: 283010 - DNA, 25 bp, Mus musculus
attgcaactaccttcaaaccgggac

SEQ ID NO: 283011 - DNA, 25 bp, Mus musculus
attgcaactggtcctataaacacca

SEQ ID NO: 283012 - DNA, 25 bp, Mus musculus
attgcaactggtgctataaacacca

SEQ ID NO: 283013 - DNA, 25 bp, Mus musculus
attgcaactttgcaaaacccagatg

SEQ ID NO: 283014 - DNA, 25 bp, Mus musculus
attgcaactttggaaaacccagatg

SEQ ID NO: 283015 - DNA, 25 bp, Mus musculus
attgcaagagatatcacagacctga

SEQ ID NO: 283016 - DNA, 25 bp, Mus musculus
attgcaagagatttcacagacctga

SEQ ID NO: 283017 - DNA, 25 bp, Mus musculus
attgcaagatgtaggtatggaacac

SEQ ID NO: 283018 - DNA, 25 bp, Mus musculus
attgcaagatgttggtatggaacac

SEQ ID NO: 283019 - DNA, 25 bp, Mus musculus
attgcaaggcacatccatcacagac

SEQ ID NO: 283020 - DNA, 25 bp, Mus musculus
attgcaaggcacttccatcacagac

SEQ ID NO: 283021 - DNA, 25 bp, Mus musculus
attgcaaggtccacagttccatgtt

SEQ ID NO: 283022 - DNA, 25 bp, Mus musculus
attgcaaggtcctcagttccatgtt

SEQ ID NO: 283023 - DNA, 25 bp, Mus musculus
attgcaaggtgtcatggtctggttt

SEQ ID NO: 283024 - DNA, 25 bp, Mus musculus
attgcaaggtgtgatggtctggttt

SEQ ID NO: 283025 - DNA, 25 bp, Mus musculus
attgcaagtatacctcgggaatcct

SEQ ID NO: 283026 - DNA, 25 bp, Mus musculus
attgcaagtatagctcgggaatcct

SEQ ID NO: 283027 - DNA, 25 bp, Mus musculus
attgcaagtgctaaccgctccaagt

SEQ ID NO: 283028 - DNA, 25 bp, Mus musculus
attgcaagtgcttaccgctccaagt

SEQ ID NO: 283029 - DNA, 25 bp, Mus musculus
attgcaataactatcagagccctag

SEQ ID NO: 283030 - DNA, 25 bp, Mus musculus
attgcaataactttcagagccctag

SEQ ID NO: 283031 - DNA, 25 bp, Mus musculus
attgcaatcgtaaagctgggtatcc

SEQ ID NO: 283032 - DNA, 25 bp, Mus musculus
attgcaatcgtatagctgggtatcc

SEQ ID NO: 283033 - DNA, 25 bp, Mus musculus
attgcaattaatacactgggttcct

SEQ ID NO: 283034 - DNA, 25 bp, Mus musculus
attgcaattaattcactgggttcct

SEQ ID NO: 283035 - DNA, 25 bp, Mus musculus
attgcaattatcaaatgccttccac

SEQ ID NO: 283036 - DNA, 25 bp, Mus musculus
attgcaattatctaatgccttccac

SEQ ID NO: 283037 - DNA, 25 bp, Mus musculus
attgcaattccaagcctctaggtag

SEQ ID NO: 283038 - DNA, 25 bp, Mus musculus
attgcaattccatgcctctaggtag

SEQ ID NO: 283039 - DNA, 25 bp, Mus musculus
attgcaattctgaggcttcggctgt

SEQ ID NO: 283040 - DNA, 25 bp, Mus musculus
attgcaattctgtggcttcggctgt

SEQ ID NO: 283041 - DNA, 25 bp, Mus musculus
attgcacaagaaaccacagcccgtt

SEQ ID NO: 283042 - DNA, 25 bp, Mus musculus
attgcacaagaatccacagcccgtt

SEQ ID NO: 283043 - DNA, 25 bp, Mus musculus
attgcacaagcgaaaccgaatggtc

SEQ ID NO: 283044 - DNA, 25 bp, Mus musculus
attgcacaagcgtaaccgaatggtc

SEQ ID NO: 283045 - DNA, 25 bp, Mus musculus
attgcacaataccaagacatcgatg

SEQ ID NO: 283046 - DNA, 25 bp, Mus musculus
attgcacaatacgaagacatcgatg

SEQ ID NO: 283047 - DNA, 25 bp, Mus musculus
attgcacaccctaaatgaccagatt

SEQ ID NO: 283048 - DNA, 25 bp, Mus musculus
attgcacacccttaatgaccagatt

SEQ ID NO: 283049 - DNA, 25 bp, Mus musculus
attgcacacgcacaagccagtttta

SEQ ID NO: 283050 - DNA, 25 bp, Mus musculus
attgcacacgcagaagccagtttta

SEQ ID NO: 283051 - DNA, 25 bp, Mus musculus
attgcacactgtaaccatgggttta

SEQ ID NO: 283052 - DNA, 25 bp, Mus musculus
attgcacactgttaccatgggttta

SEQ ID NO: 283053 - DNA, 25 bp, Mus musculus
attgcacagctacacacggatttca

SEQ ID NO: 283054 - DNA, 25 bp, Mus musculus
attgcacagctagacacggatttca

SEQ ID NO: 283055 - DNA, 25 bp, Mus musculus
attgcacaggctccgtgtgacagca

SEQ ID NO: 283056 - DNA, 25 bp, Mus musculus
attgcacaggctgcgtgtgacagca

SEQ ID NO: 283057 - DNA, 25 bp, Mus musculus
attgcacatatgacacactccacag

SEQ ID NO: 283058 - DNA, 25 bp, Mus musculus
attgcacatatgtcacactccacag

SEQ ID NO: 283059 - DNA, 25 bp, Mus musculus
attgcacattctccttgctgtacaa

SEQ ID NO: 283060 - DNA, 25 bp, Mus musculus
attgcacattctgcttgctgtacaa

SEQ ID NO: 283061 - DNA, 25 bp, Mus musculus
attgcaccaattacccaaggtctgt

SEQ ID NO: 283062 - DNA, 25 bp, Mus musculus
attgcaccaatttcccaaggtctgt

SEQ ID NO: 283063 - DNA, 25 bp, Mus musculus
attgcaccacacctttctttgagac

SEQ ID NO: 283064 - DNA, 25 bp, Mus musculus
attgcaccacacgtttctttgagac

SEQ ID NO: 283065 - DNA, 25 bp, Mus musculus
attgcaccagaaatcggccaaggaa

SEQ ID NO: 283066 - DNA, 25 bp, Mus musculus
attgcaccagaattcggccaaggaa

SEQ ID NO: 283067 - DNA, 25 bp, Mus musculus
attgcaccagcactccagaattcct

SEQ ID NO: 283068 - DNA, 25 bp, Mus musculus
attgcaccagcagtccagaattcct

SEQ ID NO: 283069 - DNA, 25 bp, Mus musculus
attgcaccatgcatgttttaggcca

SEQ ID NO: 283070 - DNA, 25 bp, Mus musculus
attgcaccatgcttgttttaggcca

SEQ ID NO: 283071 - DNA, 25 bp, Mus musculus
attgcacccacaagtctggagttca

SEQ ID NO: 283072 - DNA, 25 bp, Mus musculus
attgcacccacatgtctggagttca

SEQ ID NO: 283073 - DNA, 25 bp, Mus musculus
attgcacccgtgacttcagacaaaa

SEQ ID NO: 283074 - DNA, 25 bp, Mus musculus
attgcacccgtgtcttcagacaaaa

SEQ ID NO: 283075 - DNA, 25 bp, Mus musculus
attgcacctcagatttcagggactc

SEQ ID NO: 283076 - DNA, 25 bp, Mus musculus
attgcacctcagttttcagggactc

SEQ ID NO: 283077 - DNA, 25 bp, Mus musculus
attgcacctcgtactttctggatga

SEQ ID NO: 283078 - DNA, 25 bp, Mus musculus
attgcacctcgttctttctggatga

SEQ ID NO: 283079 - DNA, 25 bp, Mus musculus
attgcacgccaaaggattcccaaga

SEQ ID NO: 283080 - DNA, 25 bp, Mus musculus
attgcacgccaacctgaatgtgagt

SEQ ID NO: 283081 - DNA, 25 bp, Mus musculus
attgcacgccaagctgaatgtgagt

SEQ ID NO: 283082 - DNA, 25 bp, Mus musculus
attgcacgccaatggattcccaaga

SEQ ID NO: 283083 - DNA, 25 bp, Mus musculus
attgcacgggcactgttctgaggat

SEQ ID NO: 283084 - DNA, 25 bp, Mus musculus
attgcacgggcagtgttctgaggat

SEQ ID NO: 283085 - DNA, 25 bp, Mus musculus
attgcactaggaatctggctctctg

SEQ ID NO: 283086 - DNA, 25 bp, Mus musculus
attgcactaggattctggctctctg

SEQ ID NO: 283087 - DNA, 25 bp, Mus musculus
attgcactagtcattttcttcttga

SEQ ID NO: 283088 - DNA, 25 bp, Mus musculus
attgcactagtctttttcttcttga

SEQ ID NO: 283089 - DNA, 25 bp, Mus musculus
attgcactatgcatgttctggcttc

SEQ ID NO: 283090 - DNA, 25 bp, Mus musculus
attgcactatgcttgttctggcttc

SEQ ID NO: 283091 - DNA, 25 bp, Mus musculus
attgcactatggactctactctggg

SEQ ID NO: 283092 - DNA, 25 bp, Mus musculus
attgcactatggtctctactctggg

SEQ ID NO: 283093 - DNA, 25 bp, Mus musculus
attgcactcaataatcttagggatt

SEQ ID NO: 283094 - DNA, 25 bp, Mus musculus
attgcactcaattatcttagggatt

SEQ ID NO: 283095 - DNA, 25 bp, Mus musculus
attgcactccacattattctgttaa

SEQ ID NO: 283096 - DNA, 25 bp, Mus musculus
attgcactccactttattctgttaa

SEQ ID NO: 283097 - DNA, 25 bp, Mus musculus
attgcactctttagttgacacccag

SEQ ID NO: 283098 - DNA, 25 bp, Mus musculus
attgcactcttttgttgacacccag

SEQ ID NO: 283099 - DNA, 25 bp, Mus musculus
attgcactgccactctggtattaac

SEQ ID NO: 283100 - DNA, 25 bp, Mus musculus
attgcactgccagtctggtattaac

SEQ ID NO: 283101 - DNA, 25 bp, Mus musculus
attgcactgggcctgttcgttactg

SEQ ID NO: 283102 - DNA, 25 bp, Mus musculus
attgcactgggcgtgttcgttactg

SEQ ID NO: 283103 - DNA, 25 bp, Mus musculus
attgcactgtggaaactcacggtat

SEQ ID NO: 283104 - DNA, 25 bp, Mus musculus
attgcactgtggtaactcacggtat

SEQ ID NO: 283105 - DNA, 25 bp, Mus musculus
attgcacttgagattggcctccgtt

SEQ ID NO: 283106 - DNA, 25 bp, Mus musculus
attgcacttgagtttggcctccgtt

SEQ ID NO: 283107 - DNA, 25 bp, Mus musculus
attgcacttgtgagaccaggagcca

SEQ ID NO: 283108 - DNA, 25 bp, Mus musculus
attgcacttgtgtgaccaggagcca

SEQ ID NO: 283109 - DNA, 25 bp, Mus musculus
attgcacttttgatgagggaagcca

SEQ ID NO: 283110 - DNA, 25 bp, Mus musculus
attgcacttttgttgagggaagcca

SEQ ID NO: 283111 - DNA, 25 bp, Mus musculus
attgcagaaaggattatgtcttgtt

SEQ ID NO: 283112 - DNA, 25 bp, Mus musculus
attgcagaaaggtttatgtcttgtt

SEQ ID NO: 283113 - DNA, 25 bp, Mus musculus
attgcagacaagaacgacccgttca

SEQ ID NO: 283114 - DNA, 25 bp, Mus musculus
attgcagacaagtacgacccgttca

SEQ ID NO: 283115 - DNA, 25 bp, Mus musculus
attgcagaccgcaccaggttgctct

SEQ ID NO: 283116 - DNA, 25 bp, Mus musculus
attgcagaccgctccaggttgctct

SEQ ID NO: 283117 - DNA, 25 bp, Mus musculus
attgcagacctaagcctttaccaac

SEQ ID NO: 283118 - DNA, 25 bp, Mus musculus
attgcagacctatgcctttaccaac

SEQ ID NO: 283119 - DNA, 25 bp, Mus musculus
attgcagagactctgccagaagagg

SEQ ID NO: 283120 - DNA, 25 bp, Mus musculus
attgcagagactgtgccagaagagg

SEQ ID NO: 283121 - DNA, 25 bp, Mus musculus
attgcagagagaacccgactccctg

SEQ ID NO: 283122 - DNA, 25 bp, Mus musculus
attgcagagagatcccgactccctg

SEQ ID NO: 283123 - DNA, 25 bp, Mus musculus
attgcagagccgaccgagaccctgg

SEQ ID NO: 283124 - DNA, 25 bp, Mus musculus
attgcagagccgtccgagaccctgg

SEQ ID NO: 283125 - DNA, 25 bp, Mus musculus
attgcagatgagatcccgctcatgg

SEQ ID NO: 283126 - DNA, 25 bp, Mus musculus
attgcagatgagttcccgctcatgg

SEQ ID NO: 283127 - DNA, 25 bp, Mus musculus
attgcagatgccaaagacaactgaa

SEQ ID NO: 283128 - DNA, 25 bp, Mus musculus
attgcagatgcctaagacaactgaa

SEQ ID NO: 283129 - DNA, 25 bp, Mus musculus
attgcagatgttctttcgctcttca

SEQ ID NO: 283130 - DNA, 25 bp, Mus musculus
attgcagatgttgtttcgctcttca

SEQ ID NO: 283131 - DNA, 25 bp, Mus musculus
attgcagcactgattagcggtaagc

SEQ ID NO: 283132 - DNA, 25 bp, Mus musculus
attgcagcactgtttagcggtaagc

SEQ ID NO: 283133 - DNA, 25 bp, Mus musculus
attgcagcagtacaatggcccctat

SEQ ID NO: 283134 - DNA, 25 bp, Mus musculus
attgcagcagtagaatggcccctat

SEQ ID NO: 283135 - DNA, 25 bp, Mus musculus
attgcagcatttacatcaccactag

SEQ ID NO: 283136 - DNA, 25 bp, Mus musculus
attgcagcatttccgtaccacctca

SEQ ID NO: 283137 - DNA, 25 bp, Mus musculus
attgcagcatttgcgtaccacctca

SEQ ID NO: 283138 - DNA, 25 bp, Mus musculus
attgcagcattttcatcaccactag

SEQ ID NO: 283139 - DNA, 25 bp, Mus musculus
attgcagccagtccagtgatcataa

SEQ ID NO: 283140 - DNA, 25 bp, Mus musculus
attgcagccagtgcagtgatcataa

SEQ ID NO: 283141 - DNA, 25 bp, Mus musculus
attgcagcccggcagacgcagctca

SEQ ID NO: 283142 - DNA, 25 bp, Mus musculus
attgcagcccgggagacgcagctca

SEQ ID NO: 283143 - DNA, 25 bp, Mus musculus
attgcagcccttcaggatcaggtgt

SEQ ID NO: 283144 - DNA, 25 bp, Mus musculus
attgcagcccttccagtgcctgaag

SEQ ID NO: 283145 - DNA, 25 bp, Mus musculus
attgcagcccttgaggatcaggtgt

SEQ ID NO: 283146 - DNA, 25 bp, Mus musculus
attgcagcccttgcagtgcctgaag

SEQ ID NO: 283147 - DNA, 25 bp, Mus musculus
attgcagccgctctagtggctaaag

SEQ ID NO: 283148 - DNA, 25 bp, Mus musculus
attgcagccgctgtagtggctaaag

SEQ ID NO: 283149 - DNA, 25 bp, Mus musculus
attgcagccgtacctgtggagaaca

SEQ ID NO: 283150 - DNA, 25 bp, Mus musculus
attgcagccgtagctgtggagaaca

SEQ ID NO: 283151 - DNA, 25 bp, Mus musculus
attgcagcctgaagcgtgtgcgcat

SEQ ID NO: 283152 - DNA, 25 bp, Mus musculus
attgcagcctgatgcgtgtgcgcat

SEQ ID NO: 283153 - DNA, 25 bp, Mus musculus
attgcagcggacatcagaggcaagg

SEQ ID NO: 283154 - DNA, 25 bp, Mus musculus
attgcagcggacttcagaggcaagg

SEQ ID NO: 283155 - DNA, 25 bp, Mus musculus
attgcagcgggtagcagttggccaa

SEQ ID NO: 283156 - DNA, 25 bp, Mus musculus
attgcagcgggttgcagttggccaa

SEQ ID NO: 283157 - DNA, 25 bp, Mus musculus
attgcagctgatcccaactagttga

SEQ ID NO: 283158 - DNA, 25 bp, Mus musculus
attgcagctgatgccaactagttga

SEQ ID NO: 283159 - DNA, 25 bp, Mus musculus
attgcagctgcactccgcggcaact

SEQ ID NO: 283160 - DNA, 25 bp, Mus musculus
attgcagctgcagtccgcggcaact

SEQ ID NO: 283161 - DNA, 25 bp, Mus musculus
attgcagcttgtcattttaccttac

SEQ ID NO: 283162 - DNA, 25 bp, Mus musculus
attgcagcttgtgattttaccttac

SEQ ID NO: 283163 - DNA, 25 bp, Mus musculus
attgcagcttttactctgacgggaa

SEQ ID NO: 283164 - DNA, 25 bp, Mus musculus
attgcagctttttctctgacgggaa

SEQ ID NO: 283165 - DNA, 25 bp, Mus musculus
attgcaggactcactggaacactca

SEQ ID NO: 283166 - DNA, 25 bp, Mus musculus
attgcaggactctctggaacactca

SEQ ID NO: 283167 - DNA, 25 bp, Mus musculus
attgcaggcaccagtgtcttgtcac

SEQ ID NO: 283168 - DNA, 25 bp, Mus musculus
attgcaggcaccattggaggagcgt

SEQ ID NO: 283169 - DNA, 25 bp, Mus musculus
attgcaggcacctgtgtcttgtcac

SEQ ID NO: 283170 - DNA, 25 bp, Mus musculus
attgcaggcacctttggaggagcgt

SEQ ID NO: 283171 - DNA, 25 bp, Mus musculus
attgcaggcagacactcagagggaa

SEQ ID NO: 283172 - DNA, 25 bp, Mus musculus
attgcaggcagagactcagagggaa

SEQ ID NO: 283173 - DNA, 25 bp, Mus musculus
attgcaggccgtctgtcaccctgac

SEQ ID NO: 283174 - DNA, 25 bp, Mus musculus
attgcaggccgtgtgtcaccctgac

SEQ ID NO: 283175 - DNA, 25 bp, Mus musculus
attgcaggctagaatataccgaggg

SEQ ID NO: 283176 - DNA, 25 bp, Mus musculus
attgcaggctagtatataccgaggg

SEQ ID NO: 283177 - DNA, 25 bp, Mus musculus
attgcaggctgtagggtttctgtcg

SEQ ID NO: 283178 - DNA, 25 bp, Mus musculus
attgcaggctgttgggtttctgtcg

SEQ ID NO: 283179 - DNA, 25 bp, Mus musculus
attgcaggcttactctgtggctact

SEQ ID NO: 283180 - DNA, 25 bp, Mus musculus
attgcaggcttagtctgtggctact

SEQ ID NO: 283181 - DNA, 25 bp, Mus musculus
attgcaggcttccttgacggcttca

SEQ ID NO: 283182 - DNA, 25 bp, Mus musculus
attgcaggcttcgttgacggcttca

SEQ ID NO: 283183 - DNA, 25 bp, Mus musculus
attgcaggcttgagctgctaccatg

SEQ ID NO: 283184 - DNA, 25 bp, Mus musculus
attgcaggcttgctgcagagcgctc

SEQ ID NO: 283185 - DNA, 25 bp, Mus musculus
attgcaggcttggtgcagagcgctc

SEQ ID NO: 283186 - DNA, 25 bp, Mus musculus
attgcaggcttgtgctgctaccatg

SEQ ID NO: 283187 - DNA, 25 bp, Mus musculus
attgcagggccccatgtgacaggct

SEQ ID NO: 283188 - DNA, 25 bp, Mus musculus
attgcagggcccgatgtgacaggct

SEQ ID NO: 283189 - DNA, 25 bp, Mus musculus
attgcagggtgcaagggtgcctcta

SEQ ID NO: 283190 - DNA, 25 bp, Mus musculus
attgcagggtgctagggtgcctcta

SEQ ID NO: 283191 - DNA, 25 bp, Mus musculus
attgcaggtagcactagcggcccta

SEQ ID NO: 283192 - DNA, 25 bp, Mus musculus
attgcaggtagctctagcggcccta

SEQ ID NO: 283193 - DNA, 25 bp, Mus musculus
attgcaggtatcactcttccatatg

SEQ ID NO: 283194 - DNA, 25 bp, Mus musculus
attgcaggtatctctcttccatatg

SEQ ID NO: 283195 - DNA, 25 bp, Mus musculus
attgcaggtgtgcaccatcgcacct

SEQ ID NO: 283196 - DNA, 25 bp, Mus musculus
attgcaggtgtggaccatcgcacct

SEQ ID NO: 283197 - DNA, 25 bp, Mus musculus
attgcagtacttcgcctccgaaact

SEQ ID NO: 283198 - DNA, 25 bp, Mus musculus
attgcagtacttggcctccgaaact

SEQ ID NO: 283199 - DNA, 25 bp, Mus musculus
attgcagtagctcagacctgtcttt

SEQ ID NO: 283200 - DNA, 25 bp, Mus musculus
attgcagtagctgagacctgtcttt

SEQ ID NO: 283201 - DNA, 25 bp, Mus musculus
attgcagtcaaactggcctgacccc

SEQ ID NO: 283202 - DNA, 25 bp, Mus musculus
attgcagtcaaagtggcctgacccc

SEQ ID NO: 283203 - DNA, 25 bp, Mus musculus
attgcagtccagactgaaccccagt

SEQ ID NO: 283204 - DNA, 25 bp, Mus musculus
attgcagtccagtctgaaccccagt

SEQ ID NO: 283205 - DNA, 25 bp, Mus musculus
attgcagtctagatgacttcctgga

SEQ ID NO: 283206 - DNA, 25 bp, Mus musculus
attgcagtctagttgacttcctgga

SEQ ID NO: 283207 - DNA, 25 bp, Mus musculus
attgcagtgcggacctgcattccac

SEQ ID NO: 283208 - DNA, 25 bp, Mus musculus
attgcagtgcggtcctgcattccac

SEQ ID NO: 283209 - DNA, 25 bp, Mus musculus
attgcagtgggcaaggtttcaaaac

SEQ ID NO: 283210 - DNA, 25 bp, Mus musculus
attgcagtgggctaggtttcaaaac

SEQ ID NO: 283211 - DNA, 25 bp, Mus musculus
attgcagttgcaacttggcagcttt

SEQ ID NO: 283212 - DNA, 25 bp, Mus musculus
attgcagttgcatcttggcagcttt

SEQ ID NO: 283213 - DNA, 25 bp, Mus musculus
attgcagttgcccaactatttattg

SEQ ID NO: 283214 - DNA, 25 bp, Mus musculus
attgcagttgccgaactatttattg

SEQ ID NO: 283215 - DNA, 25 bp, Mus musculus
attgcataatggacttcagctcata

SEQ ID NO: 283216 - DNA, 25 bp, Mus musculus
attgcataatggtcttcagctcata

SEQ ID NO: 283217 - DNA, 25 bp, Mus musculus
attgcatacaggagggaatcttgta

SEQ ID NO: 283218 - DNA, 25 bp, Mus musculus
attgcatacaggtgggaatcttgta

SEQ ID NO: 283219 - DNA, 25 bp, Mus musculus
attgcatactgcattgtattctgga

SEQ ID NO: 283220 - DNA, 25 bp, Mus musculus
attgcatactgctttgtattctgga

SEQ ID NO: 283221 - DNA, 25 bp, Mus musculus
attgcatagaccagggctcctttgt

SEQ ID NO: 283222 - DNA, 25 bp, Mus musculus
attgcatagacctgggctcctttgt

SEQ ID NO: 283223 - DNA, 25 bp, Mus musculus
attgcataggcactacagattttct

SEQ ID NO: 283224 - DNA, 25 bp, Mus musculus
attgcataggcagtacagattttct

SEQ ID NO: 283225 - DNA, 25 bp, Mus musculus
attgcataggtcagtcttctttgtc

SEQ ID NO: 283226 - DNA, 25 bp, Mus musculus
attgcataggtctgtcttctttgtc

SEQ ID NO: 283227 - DNA, 25 bp, Mus musculus
attgcatatctcactcaacactacg

SEQ ID NO: 283228 - DNA, 25 bp, Mus musculus
attgcatatctctctcaacactacg

SEQ ID NO: 283229 - DNA, 25 bp, Mus musculus
attgcatcagatactgatctgagac

SEQ ID NO: 283230 - DNA, 25 bp, Mus musculus
attgcatcagattctgatctgagac

SEQ ID NO: 283231 - DNA, 25 bp, Mus musculus
attgcatcatgccactggagcaggt

SEQ ID NO: 283232 - DNA, 25 bp, Mus musculus
attgcatcatgcgactggagcaggt

SEQ ID NO: 283233 - DNA, 25 bp, Mus musculus
attgcatcctatctaacagcatttg

SEQ ID NO: 283234 - DNA, 25 bp, Mus musculus
attgcatcctatgtaacagcatttg

SEQ ID NO: 283235 - DNA, 25 bp, Mus musculus
attgcatcgtttaccaacatacttt

SEQ ID NO: 283236 - DNA, 25 bp, Mus musculus
attgcatcgttttccaacatacttt

SEQ ID NO: 283237 - DNA, 25 bp, Mus musculus
attgcatctcaaagagctctccctt

SEQ ID NO: 283238 - DNA, 25 bp, Mus musculus
attgcatctcaatgagctctccctt

SEQ ID NO: 283239 - DNA, 25 bp, Mus musculus
attgcatctcagctgagtctgcctt

SEQ ID NO: 283240 - DNA, 25 bp, Mus musculus
attgcatctcaggtgagtctgcctt

SEQ ID NO: 283241 - DNA, 25 bp, Mus musculus
attgcatctccaaggacatcagcag

SEQ ID NO: 283242 - DNA, 25 bp, Mus musculus
attgcatctccatggacatcagcag

SEQ ID NO: 283243 - DNA, 25 bp, Mus musculus
attgcatctgagacctgttgtgacc

SEQ ID NO: 283244 - DNA, 25 bp, Mus musculus
attgcatctgagtcctgttgtgacc

SEQ ID NO: 283245 - DNA, 25 bp, Mus musculus
attgcatctgtaacctacctgggag

SEQ ID NO: 283246 - DNA, 25 bp, Mus musculus
attgcatctgtatcctacctgggag

SEQ ID NO: 283247 - DNA, 25 bp, Mus musculus
attgcatgaacgctttactaaatac

SEQ ID NO: 283248 - DNA, 25 bp, Mus musculus
attgcatgaacggtttactaaatac

SEQ ID NO: 283249 - DNA, 25 bp, Mus musculus
attgcatgagaccttttagttgtag

SEQ ID NO: 283250 - DNA, 25 bp, Mus musculus
attgcatgagacgttttagttgtag

SEQ ID NO: 283251 - DNA, 25 bp, Mus musculus
attgcatgatgccttacggtttcca

SEQ ID NO: 283252 - DNA, 25 bp, Mus musculus
attgcatgatgcgttacggtttcca

SEQ ID NO: 283253 - DNA, 25 bp, Mus musculus
attgcatgcacacagagaattcttg

SEQ ID NO: 283254 - DNA, 25 bp, Mus musculus
attgcatgcacagagagaattcttg

SEQ ID NO: 283255 - DNA, 25 bp, Mus musculus
attgcatgggaacatccgtattacc

SEQ ID NO: 283256 - DNA, 25 bp, Mus musculus
attgcatgggaagatccgtattacc

SEQ ID NO: 283257 - DNA, 25 bp, Mus musculus
attgcatgggagcaatacgggatcc

SEQ ID NO: 283258 - DNA, 25 bp, Mus musculus
attgcatgggaggaatacgggatcc

SEQ ID NO: 283259 - DNA, 25 bp, Mus musculus
attgcatgggccaggcttaccagac

SEQ ID NO: 283260 - DNA, 25 bp, Mus musculus
attgcatgggcctggcttaccagac

SEQ ID NO: 283261 - DNA, 25 bp, Mus musculus
attgcatgtatgagtcacttgtacg

SEQ ID NO: 283262 - DNA, 25 bp, Mus musculus
attgcatgtatgtgtcacttgtacg

SEQ ID NO: 283263 - DNA, 25 bp, Mus musculus
attgcatgtcccacttgacttaaga

SEQ ID NO: 283264 - DNA, 25 bp, Mus musculus
attgcatgtcccagcagcagccgga

SEQ ID NO: 283265 - DNA, 25 bp, Mus musculus
attgcatgtccctcttgacttaaga

SEQ ID NO: 283266 - DNA, 25 bp, Mus musculus
attgcatgtccctgcagcagccgga

SEQ ID NO: 283267 - DNA, 25 bp, Mus musculus
attgcatgtgttaccaacttgtcat

SEQ ID NO: 283268 - DNA, 25 bp, Mus musculus
attgcatgtgtttccaacttgtcat

SEQ ID NO: 283269 - DNA, 25 bp, Mus musculus
attgcattagaaaaacaccaggatt

SEQ ID NO: 283270 - DNA, 25 bp, Mus musculus
attgcattagaataacaccaggatt

SEQ ID NO: 283271 - DNA, 25 bp, Mus musculus
attgcattcactaatcagggtctga

SEQ ID NO: 283272 - DNA, 25 bp, Mus musculus
attgcattcacttatcagggtctga

SEQ ID NO: 283273 - DNA, 25 bp, Mus musculus
attgcattccacctgtagcattctg

SEQ ID NO: 283274 - DNA, 25 bp, Mus musculus
attgcattccacgtgtagcattctg

SEQ ID NO: 283275 - DNA, 25 bp, Mus musculus
attgcattccatctactttttccat

SEQ ID NO: 283276 - DNA, 25 bp, Mus musculus
attgcattccatgtactttttccat

SEQ ID NO: 283277 - DNA, 25 bp, Mus musculus
attgcattcctaagcccacataaag

SEQ ID NO: 283278 - DNA, 25 bp, Mus musculus
attgcattcctatgcccacataaag

SEQ ID NO: 283279 - DNA, 25 bp, Mus musculus
attgcattcgtaaggcggtctttct

SEQ ID NO: 283280 - DNA, 25 bp, Mus musculus
attgcattcgtatggcggtctttct

SEQ ID NO: 283281 - DNA, 25 bp, Mus musculus
attgcattcttgagtaatatcccct

SEQ ID NO: 283282 - DNA, 25 bp, Mus musculus
attgcattcttgtgtaatatcccct

SEQ ID NO: 283283 - DNA, 25 bp, Mus musculus
attgcattggagagactgaacaaca

SEQ ID NO: 283284 - DNA, 25 bp, Mus musculus
attgcattggagtgactgaacaaca

SEQ ID NO: 283285 - DNA, 25 bp, Mus musculus
attgcattgtccaactacgcttagg

SEQ ID NO: 283286 - DNA, 25 bp, Mus musculus
attgcattgtcctactacgcttagg

SEQ ID NO: 283287 - DNA, 25 bp, Mus musculus
attgcatttctcagaattcacgatg

SEQ ID NO: 283288 - DNA, 25 bp, Mus musculus
attgcatttctctgaattcacgatg

SEQ ID NO: 283289 - DNA, 25 bp, Mus musculus
attgccaaactcctcctgtctagca

SEQ ID NO: 283290 - DNA, 25 bp, Mus musculus
attgccaaactcgtcctgtctagca

SEQ ID NO: 283291 - DNA, 25 bp, Mus musculus
attgccaacaacaagatccaaggtt

SEQ ID NO: 283292 - DNA, 25 bp, Mus musculus
attgccaacaactagatccaaggtt

SEQ ID NO: 283293 - DNA, 25 bp, Mus musculus
attgccaacgctaacctcatgagga

SEQ ID NO: 283294 - DNA, 25 bp, Mus musculus
attgccaacgcttacctcatgagga

SEQ ID NO: 283295 - DNA, 25 bp, Mus musculus
attgccaactggaagtcggaaacga

SEQ ID NO: 283296 - DNA, 25 bp, Mus musculus
attgccaactggtagtcggaaacga

SEQ ID NO: 283297 - DNA, 25 bp, Mus musculus
attgccaactgtatcaccagctgag

SEQ ID NO: 283298 - DNA, 25 bp, Mus musculus
attgccaactgtttcaccagctgag

SEQ ID NO: 283299 - DNA, 25 bp, Mus musculus
attgccaaggacctcttcctggagg

SEQ ID NO: 283300 - DNA, 25 bp, Mus musculus
attgccaaggacgtcttcctggagg

SEQ ID NO: 283301 - DNA, 25 bp, Mus musculus
attgccaaggctaccggtgactgga

SEQ ID NO: 283302 - DNA, 25 bp, Mus musculus
attgccaaggcttccggtgactgga

SEQ ID NO: 283303 - DNA, 25 bp, Mus musculus
attgccaccaaacgtatcacactgg

SEQ ID NO: 283304 - DNA, 25 bp, Mus musculus
attgccaccaaaggtatcacactgg

SEQ ID NO: 283305 - DNA, 25 bp, Mus musculus
attgccaccaagagattcgatgccc

SEQ ID NO: 283306 - DNA, 25 bp, Mus musculus
attgccaccaagtgattcgatgccc

SEQ ID NO: 283307 - DNA, 25 bp, Mus musculus
attgccacctctacaaaagttgata

SEQ ID NO: 283308 - DNA, 25 bp, Mus musculus
attgccacctcttcaaaagttgata

SEQ ID NO: 283309 - DNA, 25 bp, Mus musculus
attgccacgcaaaccatgtaaacac

SEQ ID NO: 283310 - DNA, 25 bp, Mus musculus
attgccacgcaatccatgtaaacac

SEQ ID NO: 283311 - DNA, 25 bp, Mus musculus
attgccactagcattatcttgccaa

SEQ ID NO: 283312 - DNA, 25 bp, Mus musculus
attgccactagctttatcttgccaa

SEQ ID NO: 283313 - DNA, 25 bp, Mus musculus
attgccactcagctcggaccaggac

SEQ ID NO: 283314 - DNA, 25 bp, Mus musculus
attgccactcaggtcggaccaggac

SEQ ID NO: 283315 - DNA, 25 bp, Mus musculus
attgccacttacaactgtcaacagg

SEQ ID NO: 283316 - DNA, 25 bp, Mus musculus
attgccacttactactgtcaacagg

SEQ ID NO: 283317 - DNA, 25 bp, Mus musculus
attgccacttccacaactgcttttt

SEQ ID NO: 283318 - DNA, 25 bp, Mus musculus
attgccacttcctcaactgcttttt

SEQ ID NO: 283319 - DNA, 25 bp, Mus musculus
attgccagactcctttttagcttga

SEQ ID NO: 283320 - DNA, 25 bp, Mus musculus
attgccagactcgtttttagcttga

SEQ ID NO: 283321 - DNA, 25 bp, Mus musculus
attgccagagatagacccggttttg

SEQ ID NO: 283322 - DNA, 25 bp, Mus musculus
attgccagagattgacccggttttg

SEQ ID NO: 283323 - DNA, 25 bp, Mus musculus
attgccagcagccaagagcgtacga

SEQ ID NO: 283324 - DNA, 25 bp, Mus musculus
attgccagcagcgaagagcgtacga

SEQ ID NO: 283325 - DNA, 25 bp, Mus musculus
attgccagcatgagtgactagcgcg

SEQ ID NO: 283326 - DNA, 25 bp, Mus musculus
attgccagcatgtgtgactagcgcg

SEQ ID NO: 283327 - DNA, 25 bp, Mus musculus
attgccagctaaatcttccatatcc

SEQ ID NO: 283328 - DNA, 25 bp, Mus musculus
attgccagctaattcttccatatcc

SEQ ID NO: 283329 - DNA, 25 bp, Mus musculus
attgccagctccaaaaagttatggt

SEQ ID NO: 283330 - DNA, 25 bp, Mus musculus
attgccagctcccagggacagctca

SEQ ID NO: 283331 - DNA, 25 bp, Mus musculus
attgccagctccgagggacagctca

SEQ ID NO: 283332 - DNA, 25 bp, Mus musculus
attgccagctcctaaaagttatggt

SEQ ID NO: 283333 - DNA, 25 bp, Mus musculus
attgccaggaggacctgcccactag

SEQ ID NO: 283334 - DNA, 25 bp, Mus musculus
attgccaggaggtcctgcccactag

SEQ ID NO: 283335 - DNA, 25 bp, Mus musculus
attgccaggcgtagaagcccagact

SEQ ID NO: 283336 - DNA, 25 bp, Mus musculus
attgccaggcgttgaagcccagact

SEQ ID NO: 283337 - DNA, 25 bp, Mus musculus
attgccaggttaatttcattttcag

SEQ ID NO: 283338 - DNA, 25 bp, Mus musculus
attgccaggttattttcattttcag

SEQ ID NO: 283339 - DNA, 25 bp, Mus musculus
attgccagtagtagagcccacgacg

SEQ ID NO: 283340 - DNA, 25 bp, Mus musculus
attgccagtagttgagcccacgacg

SEQ ID NO: 283341 - DNA, 25 bp, Mus musculus
attgccagtcaaatgatacttggtt

SEQ ID NO: 283342 - DNA, 25 bp, Mus musculus
attgccagtcaattgatacttggtt

SEQ ID NO: 283343 - DNA, 25 bp, Mus musculus
attgccatacatcaggtgggcccag

SEQ ID NO: 283344 - DNA, 25 bp, Mus musculus
attgccatacatgaggtgggcccag

SEQ ID NO: 283345 - DNA, 25 bp, Mus musculus
attgccatacctcaggcctcgaagt

SEQ ID NO: 283346 - DNA, 25 bp, Mus musculus
attgccatacctgaggcctcgaagt

SEQ ID NO: 283347 - DNA, 25 bp, Mus musculus
attgccataggccagtggtcccaag

SEQ ID NO: 283348 - DNA, 25 bp, Mus musculus
attgccataggccattatgactttc

SEQ ID NO: 283349 - DNA, 25 bp, Mus musculus
attgccataggcgagtggtcccaag

SEQ ID NO: 283350 - DNA, 25 bp, Mus musculus
attgccataggcgattatgactttc

SEQ ID NO: 283351 - DNA, 25 bp, Mus musculus
attgccatattcatacttggatgct

SEQ ID NO: 283352 - DNA, 25 bp, Mus musculus
attgccatattcttacttggatgct

SEQ ID NO: 283353 - DNA, 25 bp, Mus musculus
attgccatccatacaagcagttcct

SEQ ID NO: 283354 - DNA, 25 bp, Mus musculus
attgccatccattcaagcagttcct

SEQ ID NO: 283355 - DNA, 25 bp, Mus musculus
attgccatcctaatcttaatacccc

SEQ ID NO: 283356 - DNA, 25 bp, Mus musculus
attgccatcctattcttaatacccc

SEQ ID NO: 283357 - DNA, 25 bp, Mus musculus
attgccatcctgagctaatcttgta

SEQ ID NO: 283358 - DNA, 25 bp, Mus musculus
attgccatcctgtgctaatcttgta

SEQ ID NO: 283359 - DNA, 25 bp, Mus musculus
attgccatccttagtttgtaattaa

SEQ ID NO: 283360 - DNA, 25 bp, Mus musculus
attgccatcctttgtttgtaattaa

SEQ ID NO: 283361 - DNA, 25 bp, Mus musculus
attgccatcgacaggtacgtcacca

SEQ ID NO: 283362 - DNA, 25 bp, Mus musculus
attgccatcgactggtacgtcacca

SEQ ID NO: 283363 - DNA, 25 bp, Mus musculus
attgccatcttacaccatatttttg

SEQ ID NO: 283364 - DNA, 25 bp, Mus musculus
attgccatcttagaccatatttttg

SEQ ID NO: 283365 - DNA, 25 bp, Mus musculus
attgccatctttaagctctgcatgt

SEQ ID NO: 283366 - DNA, 25 bp, Mus musculus
attgccatcttttagctctgcatgt

SEQ ID NO: 283367 - DNA, 25 bp, Mus musculus
attgccatgacaactctttgtactg

SEQ ID NO: 283368 - DNA, 25 bp, Mus musculus
attgccatgacatctctttgtactg

SEQ ID NO: 283369 - DNA, 25 bp, Mus musculus
attgccatgattccaatccgctaca

SEQ ID NO: 283370 - DNA, 25 bp, Mus musculus
attgccatgattgcaatccgctaca

SEQ ID NO: 283371 - DNA, 25 bp, Mus musculus
attgccatgcatctcctactgtgct

SEQ ID NO: 283372 - DNA, 25 bp, Mus musculus
attgccatgcatgtcctactgtgct

SEQ ID NO: 283373 - DNA, 25 bp, Mus musculus
attgccatggcaaccgactatgatt

SEQ ID NO: 283374 - DNA, 25 bp, Mus musculus
attgccatggcatccgactatgatt

SEQ ID NO: 283375 - DNA, 25 bp, Mus musculus
attgccatgtctactatgcacacag

SEQ ID NO: 283376 - DNA, 25 bp, Mus musculus
attgccatgtctagactcttttctg

SEQ ID NO: 283377 - DNA, 25 bp, Mus musculus
attgccatgtcttctatgcacacag

SEQ ID NO: 283378 - DNA, 25 bp, Mus musculus
attgccatgtcttgactcttttctg

SEQ ID NO: 283379 - DNA, 25 bp, Mus musculus
attgccattatgatgcatgcaggtt

SEQ ID NO: 283380 - DNA, 25 bp, Mus musculus
attgccattatgttgcatgcaggtt

SEQ ID NO: 283381 - DNA, 25 bp, Mus musculus
attgccattgctccagtatagtttg

SEQ ID NO: 283382 - DNA, 25 bp, Mus musculus
attgccattgctgcagtatagtttg

SEQ ID NO: 283383 - DNA, 25 bp, Mus musculus
attgccattgtaagtacaaccgtgg

SEQ ID NO: 283384 - DNA, 25 bp, Mus musculus
attgccattgtatgtacaaccgtgg

SEQ ID NO: 283385 - DNA, 25 bp, Mus musculus
attgccatttttctctgcacctgtg

SEQ ID NO: 283386 - DNA, 25 bp, Mus musculus
attgccatttttgtctgcacctgtg

SEQ ID NO: 283387 - DNA, 25 bp, Mus musculus
attgcccaaagacacctggtccatc

SEQ ID NO: 283388 - DNA, 25 bp, Mus musculus
attgcccaaagagacctggtccatc

SEQ ID NO: 283389 - DNA, 25 bp, Mus musculus
attgcccaacaaaattcatttcccc

SEQ ID NO: 283390 - DNA, 25 bp, Mus musculus
attgcccaacaatattcatttcccc

SEQ ID NO: 283391 - DNA, 25 bp, Mus musculus
attgcccaagaacctcattttttag

SEQ ID NO: 283392 - DNA, 25 bp, Mus musculus
attgcccaagaagctcattttttag

SEQ ID NO: 283393 - DNA, 25 bp, Mus musculus
attgcccaagatatgctttctatgc

SEQ ID NO: 283394 - DNA, 25 bp, Mus musculus
attgcccaagatttgctttctatgc

SEQ ID NO: 283395 - DNA, 25 bp, Mus musculus
attgcccaatcgcgacccaaatgac

SEQ ID NO: 283396 - DNA, 25 bp, Mus musculus
attgcccaatcgggacccaaatgac

SEQ ID NO: 283397 - DNA, 25 bp, Mus musculus
attgcccagagtatcgggttccctg

SEQ ID NO: 283398 - DNA, 25 bp, Mus musculus
attgcccagagtttcgggttccctg

SEQ ID NO: 283399 - DNA, 25 bp, Mus musculus
attgcccagatgatgttatgtttat

SEQ ID NO: 283400 - DNA, 25 bp, Mus musculus
attgcccagatgttgttatgtttat

SEQ ID NO: 283401 - DNA, 25 bp, Mus musculus
attgcccaggacacgttaatgttgc

SEQ ID NO: 283402 - DNA, 25 bp, Mus musculus
attgcccaggactcgttaatgttgc

SEQ ID NO: 283403 - DNA, 25 bp, Mus musculus
attgcccagtatccccgggagatct

SEQ ID NO: 283404 - DNA, 25 bp, Mus musculus
attgcccagtatgcccgggagatct

SEQ ID NO: 283405 - DNA, 25 bp, Mus musculus
attgcccagtcaactagaactctct

SEQ ID NO: 283406 - DNA, 25 bp, Mus musculus
attgcccagtcatctagaactctct

SEQ ID NO: 283407 - DNA, 25 bp, Mus musculus
attgcccagttcatcgaaacgacca

SEQ ID NO: 283408 - DNA, 25 bp, Mus musculus
attgcccagttcttcgaaacgacca

SEQ ID NO: 283409 - DNA, 25 bp, Mus musculus
attgcccagttgatagtgtcggtgc

SEQ ID NO: 283410 - DNA, 25 bp, Mus musculus
attgcccagttgttagtgtcggtgc

SEQ ID NO: 283411 - DNA, 25 bp, Mus musculus
attgcccataagatcggtttgagga

SEQ ID NO: 283412 - DNA, 25 bp, Mus musculus
attgcccataagttcggtttgagga

SEQ ID NO: 283413 - DNA, 25 bp, Mus musculus
attgcccatggcacacacttaaacc

SEQ ID NO: 283414 - DNA, 25 bp, Mus musculus
attgcccatggctcacacttaaacc

SEQ ID NO: 283415 - DNA, 25 bp, Mus musculus
attgccccaaggaactaggccatag

SEQ ID NO: 283416 - DNA, 25 bp, Mus musculus
attgccccaaggtactaggccatag

SEQ ID NO: 283417 - DNA, 25 bp, Mus musculus
attgccccacctacagatggctcag

SEQ ID NO: 283418 - DNA, 25 bp, Mus musculus
attgccccaccttcagatggctcag

SEQ ID NO: 283419 - DNA, 25 bp, Mus musculus
attgccccaggcacatatgtagcag

SEQ ID NO: 283420 - DNA, 25 bp, Mus musculus
attgccccaggctcatatgtagcag

SEQ ID NO: 283421 - DNA, 25 bp, Mus musculus
attgccccagttactggacttgttg

SEQ ID NO: 283422 - DNA, 25 bp, Mus musculus
attgccccagtttctggacttgttg

SEQ ID NO: 283423 - DNA, 25 bp, Mus musculus
attgccccatctacacaggaaggta

SEQ ID NO: 283424 - DNA, 25 bp, Mus musculus
attgccccatcttcacaggaaggta

SEQ ID NO: 283425 - DNA, 25 bp, Mus musculus
attgccccgatgatcggcacaaata

SEQ ID NO: 283426 - DNA, 25 bp, Mus musculus
attgccccgatgttcggcacaaata

SEQ ID NO: 283427 - DNA, 25 bp, Mus musculus
attgcccctacaatggtggtccatg

SEQ ID NO: 283428 - DNA, 25 bp, Mus musculus
attgcccctacattggtggtccatg

SEQ ID NO: 283429 - DNA, 25 bp, Mus musculus
attgcccctcaaaattatgacatga

SEQ ID NO: 283430 - DNA, 25 bp, Mus musculus
attgcccctcaatattatgacatga

SEQ ID NO: 283431 - DNA, 25 bp, Mus musculus
attgcccgagagattgctccagacc

SEQ ID NO: 283432 - DNA, 25 bp, Mus musculus
attgcccgagagtttgctccagacc

SEQ ID NO: 283433 - DNA, 25 bp, Mus musculus
attgcccggctcaatacgatgatgt

SEQ ID NO: 283434 - DNA, 25 bp, Mus musculus
attgcccggctctatacgatgatgt

SEQ ID NO: 283435 - DNA, 25 bp, Mus musculus
attgcccgtaatctccacgaagggt

SEQ ID NO: 283436 - DNA, 25 bp, Mus musculus
attgcccgtaatgtccacgaagggt

SEQ ID NO: 283437 - DNA, 25 bp, Mus musculus
attgccctcaagactgcttccagga

SEQ ID NO: 283438 - DNA, 25 bp, Mus musculus
attgccctcaagtctgcttccagga

SEQ ID NO: 283439 - DNA, 25 bp, Mus musculus
attgccctcaataaagaaagtcctt

SEQ ID NO: 283440 - DNA, 25 bp, Mus musculus
attgccctcaattaagaaagtcctt

SEQ ID NO: 283441 - DNA, 25 bp, Mus musculus
attgccctcacaccagatttgggag

SEQ ID NO: 283442 - DNA, 25 bp, Mus musculus
attgccctcacagcagatttgggag

SEQ ID NO: 283443 - DNA, 25 bp, Mus musculus
attgccctcagtaaggaacagccac

SEQ ID NO: 283444 - DNA, 25 bp, Mus musculus
attgccctcagttaggaacagccac

SEQ ID NO: 283445 - DNA, 25 bp, Mus musculus
attgccctcccgagatggcatctta

SEQ ID NO: 283446 - DNA, 25 bp, Mus musculus
attgccctcccgtgatggcatctta

SEQ ID NO: 283447 - DNA, 25 bp, Mus musculus
attgccctgcatcgtgagttgtttt

SEQ ID NO: 283448 - DNA, 25 bp, Mus musculus
attgccctgcatggtgagttgtttt

SEQ ID NO: 283449 - DNA, 25 bp, Mus musculus
attgccctgcgcctagttacagttc

SEQ ID NO: 283450 - DNA, 25 bp, Mus musculus
attgccctgcgcgtagttacagttc

SEQ ID NO: 283451 - DNA, 25 bp, Mus musculus
attgccctggcacataaatgaacat

SEQ ID NO: 283452 - DNA, 25 bp, Mus musculus
attgccctggcagataaatgaacat

SEQ ID NO: 283453 - DNA, 25 bp, Mus musculus
attgccctggctctatatgactgaa

SEQ ID NO: 283454 - DNA, 25 bp, Mus musculus
attgccctggctgtatatgactgaa

SEQ ID NO: 283455 - DNA, 25 bp, Mus musculus
attgccctgggcacgagtgtatctg

SEQ ID NO: 283456 - DNA, 25 bp, Mus musculus
attgccctgggctcgagtgtatctg

SEQ ID NO: 283457 - DNA, 25 bp, Mus musculus
attgcccttagcagaagagttgaga

SEQ ID NO: 283458 - DNA, 25 bp, Mus musculus
attgcccttagctgaagagttgaga

SEQ ID NO: 283459 - DNA, 25 bp, Mus musculus
attgccctttatcgcttagtggtcc

SEQ ID NO: 283460 - DNA, 25 bp, Mus musculus
attgccctttatggcttagtggtcc

SEQ ID NO: 283461 - DNA, 25 bp, Mus musculus
attgccgaatctcgccccatgtttt

SEQ ID NO: 283462 - DNA, 25 bp, Mus musculus
attgccgaatctggccccatgtttt

SEQ ID NO: 283463 - DNA, 25 bp, Mus musculus
attgccgaattcatctccgatctct

SEQ ID NO: 283464 - DNA, 25 bp, Mus musculus
attgccgaattcttctccgatctct

SEQ ID NO: 283465 - DNA, 25 bp, Mus musculus
attgccgacgtccagtgttacactg

SEQ ID NO: 283466 - DNA, 25 bp, Mus musculus
attgccgacgtcgagtgttacactg

SEQ ID NO: 283467 - DNA, 25 bp, Mus musculus
attgccgagggcactcatccaaatg

SEQ ID NO: 283468 - DNA, 25 bp, Mus musculus
attgccgagggcagcacaaggacta

SEQ ID NO: 283469 - DNA, 25 bp, Mus musculus
attgccgagggctctcatccaaatg

SEQ ID NO: 283470 - DNA, 25 bp, Mus musculus
attgccgagggctgcacaaggacta

SEQ ID NO: 283471 - DNA, 25 bp, Mus musculus
attgccgaggtgcagctgactcagc

SEQ ID NO: 283472 - DNA, 25 bp, Mus musculus
attgccgaggtggagctgactcagc

SEQ ID NO: 283473 - DNA, 25 bp, Mus musculus
attgccgatagcatcacttcctttt

SEQ ID NO: 283474 - DNA, 25 bp, Mus musculus
attgccgatagcttcacttcctttt

SEQ ID NO: 283475 - DNA, 25 bp, Mus musculus
attgccgatcagagtagagctggtc

SEQ ID NO: 283476 - DNA, 25 bp, Mus musculus
attgccgatcagtgtagagctggtc

SEQ ID NO: 283477 - DNA, 25 bp, Mus musculus
attgccgccaccctagaaggatgtg

SEQ ID NO: 283478 - DNA, 25 bp, Mus musculus
attgccgccaccgtagaaggatgtg

SEQ ID NO: 283479 - DNA, 25 bp, Mus musculus
attgccgcctgtatgttacgatgca

SEQ ID NO: 283480 - DNA, 25 bp, Mus musculus
attgccgcctgtttgttacgatgca

SEQ ID NO: 283481 - DNA, 25 bp, Mus musculus
attgccgcgcttacccacttagaag

SEQ ID NO: 283482 - DNA, 25 bp, Mus musculus
attgccgcgctttcccacttagaag

SEQ ID NO: 283483 - DNA, 25 bp, Mus musculus
attgccgcggagattttaagtactg

SEQ ID NO: 283484 - DNA, 25 bp, Mus musculus
attgccgcggagtttttaagtactg

SEQ ID NO: 283485 - DNA, 25 bp, Mus musculus
attgccgctgtaattgagactgtgt

SEQ ID NO: 283486 - DNA, 25 bp, Mus musculus
attgccgctgtatttgagactgtgt

SEQ ID NO: 283487 - DNA, 25 bp, Mus musculus
attgccgctgttaggagctcggtaa

SEQ ID NO: 283488 - DNA, 25 bp, Mus musculus
attgccgctgtttggagctcggtaa

SEQ ID NO: 283489 - DNA, 25 bp, Mus musculus
attgccggcaatcgacgttgtaaaa

SEQ ID NO: 283490 - DNA, 25 bp, Mus musculus
attgccggcaatcggtgtctctttt

SEQ ID NO: 283491 - DNA, 25 bp, Mus musculus
attgccggcaatggacgttgtaaaa

SEQ ID NO: 283492 - DNA, 25 bp, Mus musculus
attgccggcaatgggtgtctctttt

SEQ ID NO: 283493 - DNA, 25 bp, Mus musculus
attgccggccctacatccttctgag

SEQ ID NO: 283494 - DNA, 25 bp, Mus musculus
attgccggcccttcatccttctgag

SEQ ID NO: 283495 - DNA, 25 bp, Mus musculus
attgccggtgccatagttatgccat

SEQ ID NO: 283496 - DNA, 25 bp, Mus musculus
attgccggtgccttagttatgccat

SEQ ID NO: 283497 - DNA, 25 bp, Mus musculus
attgccgtcaaaatacattcattag

SEQ ID NO: 283498 - DNA, 25 bp, Mus musculus
attgccgtcaaattacattcattag

SEQ ID NO: 283499 - DNA, 25 bp, Mus musculus
attgccgtcatgagctaagctaaac

SEQ ID NO: 283500 - DNA, 25 bp, Mus musculus
attgccgtcatgtgctaagctaaac

SEQ ID NO: 283501 - DNA, 25 bp, Mus musculus
attgccgtgatgctgacgtctgaac

SEQ ID NO: 283502 - DNA, 25 bp, Mus musculus
attgccgtgatggtgacgtctgaac

SEQ ID NO: 283503 - DNA, 25 bp, Mus musculus
attgccgttcaaccctataatgcct

SEQ ID NO: 283504 - DNA, 25 bp, Mus musculus
attgccgttcaagcctataatgcct

SEQ ID NO: 283505 - DNA, 25 bp, Mus musculus
attgccgttgtaattgggtccagta

SEQ ID NO: 283506 - DNA, 25 bp, Mus musculus
attgccgttgtatttgggtccagta

SEQ ID NO: 283507 - DNA, 25 bp, Mus musculus
attgccgtttttacagttactgctt

SEQ ID NO: 283508 - DNA, 25 bp, Mus musculus
attgccgttttttcagttactgctt

SEQ ID NO: 283509 - DNA, 25 bp, Mus musculus
attgcctaagctaggctgccctgga

SEQ ID NO: 283510 - DNA, 25 bp, Mus musculus
attgcctaagcttggctgccctgga

SEQ ID NO: 283511 - DNA, 25 bp, Mus musculus
attgcctaagttacattcaccttga

SEQ ID NO: 283512 - DNA, 25 bp, Mus musculus
attgcctaagtttcattcaccttga

SEQ ID NO: 283513 - DNA, 25 bp, Mus musculus
attgcctacaacatgtctctcattt

SEQ ID NO: 283514 - DNA, 25 bp, Mus musculus
attgcctacaacttgtctctcattt

SEQ ID NO: 283515 - DNA, 25 bp, Mus musculus
attgcctacacgactgcacctagag

SEQ ID NO: 283516 - DNA, 25 bp, Mus musculus
attgcctacacgtctgcacctagag

SEQ ID NO: 283517 - DNA, 25 bp, Mus musculus
attgcctactgacacttttagcagg

SEQ ID NO: 283518 - DNA, 25 bp, Mus musculus
attgcctactgagacttttagcagg

SEQ ID NO: 283519 - DNA, 25 bp, Mus musculus
attgcctactgcaatcttgattcat

SEQ ID NO: 283520 - DNA, 25 bp, Mus musculus
attgcctactgctatcttgattcat

SEQ ID NO: 283521 - DNA, 25 bp, Mus musculus
attgcctagagcaggagggtcaccc

SEQ ID NO: 283522 - DNA, 25 bp, Mus musculus
attgcctagagctggagggtcaccc

SEQ ID NO: 283523 - DNA, 25 bp, Mus musculus
attgcctagcaaagtctccttagaa

SEQ ID NO: 283524 - DNA, 25 bp, Mus musculus
attgcctagcaatgtctccttagaa

SEQ ID NO: 283525 - DNA, 25 bp, Mus musculus
attgcctataccatccttggcagca

SEQ ID NO: 283526 - DNA, 25 bp, Mus musculus
attgcctataccttccttggcagca

SEQ ID NO: 283527 - DNA, 25 bp, Mus musculus
attgcctatcctctggttctagggt

SEQ ID NO: 283528 - DNA, 25 bp, Mus musculus
attgcctatcctgtggttctagggt

SEQ ID NO: 283529 - DNA, 25 bp, Mus musculus
attgcctatgctatctttcatctac

SEQ ID NO: 283530 - DNA, 25 bp, Mus musculus
attgcctatgctttctttcatctac

SEQ ID NO: 283531 - DNA, 25 bp, Mus musculus
attgcctatttgctgtgacaccatg

SEQ ID NO: 283532 - DNA, 25 bp, Mus musculus
attgcctatttggtgtgacaccatg

SEQ ID NO: 283533 - DNA, 25 bp, Mus musculus
attgcctcaaaccttctgcagtaga

SEQ ID NO: 283534 - DNA, 25 bp, Mus musculus
attgcctcaaacgttctgcagtaga

SEQ ID NO: 283535 - DNA, 25 bp, Mus musculus
attgcctcaatgagtctttggctga

SEQ ID NO: 283536 - DNA, 25 bp, Mus musculus
attgcctcaatgtgtctttggctga

SEQ ID NO: 283537 - DNA, 25 bp, Mus musculus
attgcctcacagcaattgactattc

SEQ ID NO: 283538 - DNA, 25 bp, Mus musculus
attgcctcacaggaattgactattc

SEQ ID NO: 283539 - DNA, 25 bp, Mus musculus
attgcctcacgaccaggccagtgtg

SEQ ID NO: 283540 - DNA, 25 bp, Mus musculus
attgcctcacgagcaggccagtgtg

SEQ ID NO: 283541 - DNA, 25 bp, Mus musculus
attgcctcagtcatttaccactaga

SEQ ID NO: 283542 - DNA, 25 bp, Mus musculus
attgcctcagtcttttaccactaga

SEQ ID NO: 283543 - DNA, 25 bp, Mus musculus
attgcctcatagctgctgactgact

SEQ ID NO: 283544 - DNA, 25 bp, Mus musculus
attgcctcataggtgctgactgact

SEQ ID NO: 283545 - DNA, 25 bp, Mus musculus
attgcctccaatataaagctccacg

SEQ ID NO: 283546 - DNA, 25 bp, Mus musculus
attgcctccaatcaaagtgacccag

SEQ ID NO: 283547 - DNA, 25 bp, Mus musculus
attgcctccaatgaaagtgacccag

SEQ ID NO: 283548 - DNA, 25 bp, Mus musculus
attgcctccaatttaaagctccacg

SEQ ID NO: 283549 - DNA, 25 bp, Mus musculus
attgcctccacaaggcagaactcca

SEQ ID NO: 283550 - DNA, 25 bp, Mus musculus
attgcctccacatggcagaactcca

SEQ ID NO: 283551 - DNA, 25 bp, Mus musculus
attgcctcctctaattatttctctg

SEQ ID NO: 283552 - DNA, 25 bp, Mus musculus
attgcctcctcttattatttctctg

SEQ ID NO: 283553 - DNA, 25 bp, Mus musculus
attgcctcctgcattagggaattgt

SEQ ID NO: 283554 - DNA, 25 bp, Mus musculus
attgcctcctgctttagggaattgt

SEQ ID NO: 283555 - DNA, 25 bp, Mus musculus
attgcctcctggactctaggtttgc

SEQ ID NO: 283556 - DNA, 25 bp, Mus musculus
attgcctcctggtctctaggtttgc

SEQ ID NO: 283557 - DNA, 25 bp, Mus musculus
attgcctcgtgcatttctacagatg

SEQ ID NO: 283558 - DNA, 25 bp, Mus musculus
attgcctcgtgcttttctacagatg

SEQ ID NO: 283559 - DNA, 25 bp, Mus musculus
attgcctctctcattaatcagtgta

SEQ ID NO: 283560 - DNA, 25 bp, Mus musculus
attgcctctctctttaatcagtgta

SEQ ID NO: 283561 - DNA, 25 bp, Mus musculus
attgcctctgaacccagtgatgtca

SEQ ID NO: 283562 - DNA, 25 bp, Mus musculus
attgcctctgaagccagtgatgtca

SEQ ID NO: 283563 - DNA, 25 bp, Mus musculus
attgcctctgacagctccagcgact

SEQ ID NO: 283564 - DNA, 25 bp, Mus musculus
attgcctctgactgctccagcgact

SEQ ID NO: 283565 - DNA, 25 bp, Mus musculus
attgcctctggaatctagcagcttg

SEQ ID NO: 283566 - DNA, 25 bp, Mus musculus
attgcctctggattctagcagcttg

SEQ ID NO: 283567 - DNA, 25 bp, Mus musculus
attgcctctggcagtccattgagat

SEQ ID NO: 283568 - DNA, 25 bp, Mus musculus
attgcctctggctgtccattgagat

SEQ ID NO: 283569 - DNA, 25 bp, Mus musculus
attgcctctggtcaggataatagga

SEQ ID NO: 283570 - DNA, 25 bp, Mus musculus
attgcctctggtcattaccgcaagg

SEQ ID NO: 283571 - DNA, 25 bp, Mus musculus
attgcctctggtgaggataatagga

SEQ ID NO: 283572 - DNA, 25 bp, Mus musculus
attgcctctggtgattaccgcaagg

SEQ ID NO: 283573 - DNA, 25 bp, Mus musculus
attgcctcttgtaatgtgggcctct

SEQ ID NO: 283574 - DNA, 25 bp, Mus musculus
attgcctcttgttatgtgggcctct

SEQ ID NO: 283575 - DNA, 25 bp, Mus musculus
attgcctgaatgaaccttagctgac

SEQ ID NO: 283576 - DNA, 25 bp, Mus musculus
attgcctgaatgtaccttagctgac

SEQ ID NO: 283577 - DNA, 25 bp, Mus musculus
attgcctgacccactgcagtatgac

SEQ ID NO: 283578 - DNA, 25 bp, Mus musculus
attgcctgaccctctgcagtatgac

SEQ ID NO: 283579 - DNA, 25 bp, Mus musculus
attgcctgagaactctggatcccta

SEQ ID NO: 283580 - DNA, 25 bp, Mus musculus
attgcctgagaagtctggatcccta

SEQ ID NO: 283581 - DNA, 25 bp, Mus musculus
attgcctgagttccttgagttgttt

SEQ ID NO: 283582 - DNA, 25 bp, Mus musculus
attgcctgagttgcttgagttgttt

SEQ ID NO: 283583 - DNA, 25 bp, Mus musculus
attgcctgatgtaaagaatgtttag

SEQ ID NO: 283584 - DNA, 25 bp, Mus musculus
attgcctgatgttaagaatgtttag

SEQ ID NO: 283585 - DNA, 25 bp, Mus musculus
attgcctgcaggaatggttttccct

SEQ ID NO: 283586 - DNA, 25 bp, Mus musculus
attgcctgcaggtatggttttccct

SEQ ID NO: 283587 - DNA, 25 bp, Mus musculus
attgcctgccagctgatgtgtgcac

SEQ ID NO: 283588 - DNA, 25 bp, Mus musculus
attgcctgccaggtgatgtgtgcac

SEQ ID NO: 283589 - DNA, 25 bp, Mus musculus
attgcctgccctcgctagttttata

SEQ ID NO: 283590 - DNA, 25 bp, Mus musculus
attgcctgccctggctagttttata

SEQ ID NO: 283591 - DNA, 25 bp, Mus musculus
attgcctggagtatagttttgacac

SEQ ID NO: 283592 - DNA, 25 bp, Mus musculus
attgcctggagtttagttttgacac

SEQ ID NO: 283593 - DNA, 25 bp, Mus musculus
attgcctggctgagcctcacaggta

SEQ ID NO: 283594 - DNA, 25 bp, Mus musculus
attgcctggctgtgcctcacaggta

SEQ ID NO: 283595 - DNA, 25 bp, Mus musculus
attgcctggtgactaatgcttcggg

SEQ ID NO: 283596 - DNA, 25 bp, Mus musculus
attgcctggtgagtaatgcttcggg

SEQ ID NO: 283597 - DNA, 25 bp, Mus musculus
attgcctgtattagcatttctggac

SEQ ID NO: 283598 - DNA, 25 bp, Mus musculus
attgcctgtatttgcatttctggac

SEQ ID NO: 283599 - DNA, 25 bp, Mus musculus
attgcctgttcaccttatcatgggt

SEQ ID NO: 283600 - DNA, 25 bp, Mus musculus
attgcctgttcagcttatcatgggt

SEQ ID NO: 283601 - DNA, 25 bp, Mus musculus
attgcctgttggaagttgaaatata

SEQ ID NO: 283602 - DNA, 25 bp, Mus musculus
attgcctgttggtagttgaaatata

SEQ ID NO: 283603 - DNA, 25 bp, Mus musculus
attgcctgtttgattcaatgtctcc

SEQ ID NO: 283604 - DNA, 25 bp, Mus musculus
attgcctgtttgtttcaatgtctcc

SEQ ID NO: 283605 - DNA, 25 bp, Mus musculus
attgccttaagccaggactccaaag

SEQ ID NO: 283606 - DNA, 25 bp, Mus musculus
attgccttaagcgaggactccaaag

SEQ ID NO: 283607 - DNA, 25 bp, Mus musculus
attgccttaatgactcttaaccctg

SEQ ID NO: 283608 - DNA, 25 bp, Mus musculus
attgccttaatgtctcttaaccctg

SEQ ID NO: 283609 - DNA, 25 bp, Mus musculus
attgccttaattctcattgccctgg

SEQ ID NO: 283610 - DNA, 25 bp, Mus musculus
attgccttaattgtcattgccctgg

SEQ ID NO: 283611 - DNA, 25 bp, Mus musculus
attgccttagacaattccatcactg

SEQ ID NO: 283612 - DNA, 25 bp, Mus musculus
attgccttagactattccatcactg

SEQ ID NO: 283613 - DNA, 25 bp, Mus musculus
attgccttaggaccgtgacagcgtg

SEQ ID NO: 283614 - DNA, 25 bp, Mus musculus
attgccttaggagcgtgacagcgtg

SEQ ID NO: 283615 - DNA, 25 bp, Mus musculus
attgccttagtaagaatcttccttc

SEQ ID NO: 283616 - DNA, 25 bp, Mus musculus
attgccttagtatgaatcttccttc

SEQ ID NO: 283617 - DNA, 25 bp, Mus musculus
attgccttagtcacagtagcataac

SEQ ID NO: 283618 - DNA, 25 bp, Mus musculus
attgccttagtctcagtagcataac

SEQ ID NO: 283619 - DNA, 25 bp, Mus musculus
attgccttcaatacccatcagacaa

SEQ ID NO: 283620 - DNA, 25 bp, Mus musculus
attgccttcaattcccatcagacaa

SEQ ID NO: 283621 - DNA, 25 bp, Mus musculus
attgccttccaacccactttaggtc

SEQ ID NO: 283622 - DNA, 25 bp, Mus musculus
attgccttccaagccactttaggtc

SEQ ID NO: 283623 - DNA, 25 bp, Mus musculus
attgccttccgaaaatgctcggttt

SEQ ID NO: 283624 - DNA, 25 bp, Mus musculus
attgccttccgataatgctcggttt

SEQ ID NO: 283625 - DNA, 25 bp, Mus musculus
attgccttcctgcaaattttctggg

SEQ ID NO: 283626 - DNA, 25 bp, Mus musculus
attgccttcctggaaattttctggg

SEQ ID NO: 283627 - DNA, 25 bp, Mus musculus
attgccttcgacatctgttgacagc

SEQ ID NO: 283628 - DNA, 25 bp, Mus musculus
attgccttcgacttctgttgacagc

SEQ ID NO: 283629 - DNA, 25 bp, Mus musculus
attgccttctatatacctttgttgt

SEQ ID NO: 283630 - DNA, 25 bp, Mus musculus
attgccttctatttacctttgttgt

SEQ ID NO: 283631 - DNA, 25 bp, Mus musculus
attgccttcttactagaaagccttt

SEQ ID NO: 283632 - DNA, 25 bp, Mus musculus
attgccttcttagtagaaagccttt

SEQ ID NO: 283633 - DNA, 25 bp, Mus musculus
attgccttcttgacaatcctactgg

SEQ ID NO: 283634 - DNA, 25 bp, Mus musculus
attgccttcttgtcaatcctactgg

SEQ ID NO: 283635 - DNA, 25 bp, Mus musculus
attgccttgctgaagatacgtacca

SEQ ID NO: 283636 - DNA, 25 bp, Mus musculus
attgccttgctgtagatacgtacca

SEQ ID NO: 283637 - DNA, 25 bp, Mus musculus
attgccttggtaagtaactattgta

SEQ ID NO: 283638 - DNA, 25 bp, Mus musculus
attgccttggtatgtaactattgta

SEQ ID NO: 283639 - DNA, 25 bp, Mus musculus
attgccttgtttctcttgcatgtaa

SEQ ID NO: 283640 - DNA, 25 bp, Mus musculus
attgccttgtttgtcttgcatgtaa

SEQ ID NO: 283641 - DNA, 25 bp, Mus musculus
attgcctttgcacagaaagtttgct

SEQ ID NO: 283642 - DNA, 25 bp, Mus musculus
attgcctttgcagagaaagtttgct

SEQ ID NO: 283643 - DNA, 25 bp, Mus musculus
attgccttttgcagtgctactactg

SEQ ID NO: 283644 - DNA, 25 bp, Mus musculus
attgccttttgctgtgctactactg

SEQ ID NO: 283645 - DNA, 25 bp, Mus musculus
attgcgactctaagcttatattata

SEQ ID NO: 283646 - DNA, 25 bp, Mus musculus
attgcgactctatgcttatattata

SEQ ID NO: 283647 - DNA, 25 bp, Mus musculus
attgcgactgtcaagctttatccag

SEQ ID NO: 283648 - DNA, 25 bp, Mus musculus
attgcgactgtctagctttatccag

SEQ ID NO: 283649 - DNA, 25 bp, Mus musculus
attgcgagacctaggctgccgtgtg

SEQ ID NO: 283650 - DNA, 25 bp, Mus musculus
attgcgagaccttggctgccgtgtg

SEQ ID NO: 283651 - DNA, 25 bp, Mus musculus
attgcgatcccaatgcagaagagaa

SEQ ID NO: 283652 - DNA, 25 bp, Mus musculus
attgcgatcccattgcagaagagaa

SEQ ID NO: 283653 - DNA, 25 bp, Mus musculus
attgcgcaatgccataaatttcttc

SEQ ID NO: 283654 - DNA, 25 bp, Mus musculus
attgcgcaatgcgataaatttcttc

SEQ ID NO: 283655 - DNA, 25 bp, Mus musculus
attgcgccgctacaggtgaaattct

SEQ ID NO: 283656 - DNA, 25 bp, Mus musculus
attgcgccgctagaggtgaaattct

SEQ ID NO: 283657 - DNA, 25 bp, Mus musculus
attgcgctttatatctgacttttca

SEQ ID NO: 283658 - DNA, 25 bp, Mus musculus
attgcgctttatttctgacttttca

SEQ ID NO: 283659 - DNA, 25 bp, Mus musculus
attgcggaagcccagactcgccata

SEQ ID NO: 283660 - DNA, 25 bp, Mus musculus
attgcggaagccgagactcgccata

SEQ ID NO: 283661 - DNA, 25 bp, Mus musculus
attgcggagcagatatcgatggaga

SEQ ID NO: 283662 - DNA, 25 bp, Mus musculus
attgcggagcagttatcgatggaga

SEQ ID NO: 283663 - DNA, 25 bp, Mus musculus
attgcggatttgatgcattttcagc

SEQ ID NO: 283664 - DNA, 25 bp, Mus musculus
attgcggatttgttgcattttcagc

SEQ ID NO: 283665 - DNA, 25 bp, Mus musculus
attgcggccactatctggccagtag

SEQ ID NO: 283666 - DNA, 25 bp, Mus musculus
attgcggccactttctggccagtag

SEQ ID NO: 283667 - DNA, 25 bp, Mus musculus
attgcggccggacgcatcttctatg

SEQ ID NO: 283668 - DNA, 25 bp, Mus musculus
attgcggccggaggcatcttctatg

SEQ ID NO: 283669 - DNA, 25 bp, Mus musculus
attgcggctctcaatggtcccttgt

SEQ ID NO: 283670 - DNA, 25 bp, Mus musculus
attgcggctctctatggtcccttgt

SEQ ID NO: 283671 - DNA, 25 bp, Mus musculus
attgcggtccccaacggcgagattc

SEQ ID NO: 283672 - DNA, 25 bp, Mus musculus
attgcggtcccctacggcgagattc

SEQ ID NO: 283673 - DNA, 25 bp, Mus musculus
attgcggtgttcagtcacctaggca

SEQ ID NO: 283674 - DNA, 25 bp, Mus musculus
attgcggtgttctgtcacctaggca

SEQ ID NO: 283675 - DNA, 25 bp, Mus musculus
attgcgtcactactgtgtgccaggg

SEQ ID NO: 283676 - DNA, 25 bp, Mus musculus
attgcgtcactagtgtgtgccaggg

SEQ ID NO: 283677 - DNA, 25 bp, Mus musculus
attgcgtggcctccagagcagatga

SEQ ID NO: 283678 - DNA, 25 bp, Mus musculus
attgcgtggcctgcagagcagatga

SEQ ID NO: 283679 - DNA, 25 bp, Mus musculus
attgctaaactgctgttccttcttc

SEQ ID NO: 283680 - DNA, 25 bp, Mus musculus
attgctaaactggtgttccttcttc

SEQ ID NO: 283681 - DNA, 25 bp, Mus musculus
attgctaacctacccctttctatgg

SEQ ID NO: 283682 - DNA, 25 bp, Mus musculus
attgctaacctagccctttctatgg

SEQ ID NO: 283683 - DNA, 25 bp, Mus musculus
attgctaactttaagagtgcctgtc

SEQ ID NO: 283684 - DNA, 25 bp, Mus musculus
attgctaacttttagagtgcctgtc

SEQ ID NO: 283685 - DNA, 25 bp, Mus musculus
attgctaagaccctatttcctgtgt

SEQ ID NO: 283686 - DNA, 25 bp, Mus musculus
attgctaagaccgtatttcctgtgt

SEQ ID NO: 283687 - DNA, 25 bp, Mus musculus
attgctaagctaaacctcccagact

SEQ ID NO: 283688 - DNA, 25 bp, Mus musculus
attgctaagctatacctcccagact

SEQ ID NO: 283689 - DNA, 25 bp, Mus musculus
attgctaaggtgagtgtgccactac

SEQ ID NO: 283690 - DNA, 25 bp, Mus musculus
attgctaaggtgtgtgtgccactac

SEQ ID NO: 283691 - DNA, 25 bp, Mus musculus
attgctaatatactctatgatgaac

SEQ ID NO: 283692 - DNA, 25 bp, Mus musculus
attgctaatatagtctatgatgaac

SEQ ID NO: 283693 - DNA, 25 bp, Mus musculus
attgctaattccctcaactggaagg

SEQ ID NO: 283694 - DNA, 25 bp, Mus musculus
attgctaattccgtcaactggaagg

SEQ ID NO: 283695 - DNA, 25 bp, Mus musculus
attgctacaagtactctaccttagt

SEQ ID NO: 283696 - DNA, 25 bp, Mus musculus
attgctacaagttctctaccttagt

SEQ ID NO: 283697 - DNA, 25 bp, Mus musculus
attgctacacagattttcctttcta

SEQ ID NO: 283698 - DNA, 25 bp, Mus musculus
attgctacacagtttttcctttcta

SEQ ID NO: 283699 - DNA, 25 bp, Mus musculus
attgctacactgcatcagcagcctt

SEQ ID NO: 283700 - DNA, 25 bp, Mus musculus
attgctacactggatcagcagcctt

SEQ ID NO: 283701 - DNA, 25 bp, Mus musculus
attgctaccaatcggacgccagagc

SEQ ID NO: 283702 - DNA, 25 bp, Mus musculus
attgctaccaatgggacgccagagc

SEQ ID NO: 283703 - DNA, 25 bp, Mus musculus
attgctaccatcactgcagacctac

SEQ ID NO: 283704 - DNA, 25 bp, Mus musculus
attgctaccatctctgcagacctac

SEQ ID NO: 283705 - DNA, 25 bp, Mus musculus
attgctacccacattggtctatgga

SEQ ID NO: 283706 - DNA, 25 bp, Mus musculus
attgctacccactttggtctatgga

SEQ ID NO: 283707 - DNA, 25 bp, Mus musculus
attgctacctctaccctgatgtgta

SEQ ID NO: 283708 - DNA, 25 bp, Mus musculus
attgctacctcttccctgatgtgta

SEQ ID NO: 283709 - DNA, 25 bp, Mus musculus
attgctacggccagtgtgaccactg

SEQ ID NO: 283710 - DNA, 25 bp, Mus musculus
attgctacggcctgtgtgaccactg

SEQ ID NO: 283711 - DNA, 25 bp, Mus musculus
attgctactgacatggcatctcgag

SEQ ID NO: 283712 - DNA, 25 bp, Mus musculus
attgctactgacttggcatctcgag

SEQ ID NO: 283713 - DNA, 25 bp, Mus musculus
attgctactgagattcccaggtgaa

SEQ ID NO: 283714 - DNA, 25 bp, Mus musculus
attgctactgagtttcccaggtgaa

SEQ ID NO: 283715 - DNA, 25 bp, Mus musculus
attgctagatgcagtctcttccttc

SEQ ID NO: 283716 - DNA, 25 bp, Mus musculus
attgctagatgctgtctcttccttc

SEQ ID NO: 283717 - DNA, 25 bp, Mus musculus
attgctagcagcattctttaccttg

SEQ ID NO: 283718 - DNA, 25 bp, Mus musculus
attgctagcagctttctttaccttg

SEQ ID NO: 283719 - DNA, 25 bp, Mus musculus
attgctagcttacttcagtcttaga

SEQ ID NO: 283720 - DNA, 25 bp, Mus musculus
attgctagcttagttcagtcttaga

SEQ ID NO: 283721 - DNA, 25 bp, Mus musculus
attgctaggcttatacttggatcct

SEQ ID NO: 283722 - DNA, 25 bp, Mus musculus
attgctaggcttttacttggatcct

SEQ ID NO: 283723 - DNA, 25 bp, Mus musculus
attgctagtaggagtgaggccccaa

SEQ ID NO: 283724 - DNA, 25 bp, Mus musculus
attgctagtaggtgtgaggccccaa

SEQ ID NO: 283725 - DNA, 25 bp, Mus musculus
attgctagttatagctcttacccag

SEQ ID NO: 283726 - DNA, 25 bp, Mus musculus
attgctagttattgctcttacccag

SEQ ID NO: 283727 - DNA, 25 bp, Mus musculus
attgctatccatccagcctttgggc

SEQ ID NO: 283728 - DNA, 25 bp, Mus musculus
attgctatccatgcagcctttgggc

SEQ ID NO: 283729 - DNA, 25 bp, Mus musculus
attgctatccctagcagcgattcaa

SEQ ID NO: 283730 - DNA, 25 bp, Mus musculus
attgctatcccttgcagcgattcaa

SEQ ID NO: 283731 - DNA, 25 bp, Mus musculus
attgctatgaataacccatctcaag

SEQ ID NO: 283732 - DNA, 25 bp, Mus musculus
attgctatgaattacccatctcaag

SEQ ID NO: 283733 - DNA, 25 bp, Mus musculus
attgctatgatgcacatgtgccctg

SEQ ID NO: 283734 - DNA, 25 bp, Mus musculus
attgctatgatggacatgtgccctg

SEQ ID NO: 283735 - DNA, 25 bp, Mus musculus
attgctatgattctattgtgcgttc

SEQ ID NO: 283736 - DNA, 25 bp, Mus musculus
attgctatgattgtattgtgcgttc

SEQ ID NO: 283737 - DNA, 25 bp, Mus musculus
attgctatgcagatctaccttgcga

SEQ ID NO: 283738 - DNA, 25 bp, Mus musculus
attgctatgcagttctaccttgcga

SEQ ID NO: 283739 - DNA, 25 bp, Mus musculus
attgctatggagaagaggccttcag

SEQ ID NO: 283740 - DNA, 25 bp, Mus musculus
attgctatggagtagaggccttcag

SEQ ID NO: 283741 - DNA, 25 bp, Mus musculus
attgctatggcgcttttcagatagg

SEQ ID NO: 283742 - DNA, 25 bp, Mus musculus
attgctatggcggttttcagatagg

SEQ ID NO: 283743 - DNA, 25 bp, Mus musculus
attgctatgtctagtgatttttgtc

SEQ ID NO: 283744 - DNA, 25 bp, Mus musculus
attgctatgtcttgtgatttttgtc

SEQ ID NO: 283745 - DNA, 25 bp, Mus musculus
attgctatgttaatggagaatgtcc

SEQ ID NO: 283746 - DNA, 25 bp, Mus musculus
attgctatgttattggagaatgtcc

SEQ ID NO: 283747 - DNA, 25 bp, Mus musculus
attgctatgttcctattttctataa

SEQ ID NO: 283748 - DNA, 25 bp, Mus musculus
attgctatgttcgtattttctataa

SEQ ID NO: 283749 - DNA, 25 bp, Mus musculus
attgctattgatatcgaccctgtta

SEQ ID NO: 283750 - DNA, 25 bp, Mus musculus
attgctattgatttcgaccctgtta

SEQ ID NO: 283751 - DNA, 25 bp, Mus musculus
attgctcaaggcatacgtctctaca

SEQ ID NO: 283752 - DNA, 25 bp, Mus musculus
attgctcaaggcttacgtctctaca

SEQ ID NO: 283753 - DNA, 25 bp, Mus musculus
attgctcaccaaaggttggctcttg

SEQ ID NO: 283754 - DNA, 25 bp, Mus musculus
attgctcaccaatggttggctcttg

SEQ ID NO: 283755 - DNA, 25 bp, Mus musculus
attgctcaccttagcttcatcattg

SEQ ID NO: 283756 - DNA, 25 bp, Mus musculus
attgctcacctttgcttcatcattg

SEQ ID NO: 283757 - DNA, 25 bp, Mus musculus
attgctcactatatgtctgctgcag

SEQ ID NO: 283758 - DNA, 25 bp, Mus musculus
attgctcactatttgtctgctgcag

SEQ ID NO: 283759 - DNA, 25 bp, Mus musculus
attgctcactctataaacataccag

SEQ ID NO: 283760 - DNA, 25 bp, Mus musculus
attgctcactctttaaacataccag

SEQ ID NO: 283761 - DNA, 25 bp, Mus musculus
attgctcagcacctcataatggtta

SEQ ID NO: 283762 - DNA, 25 bp, Mus musculus
attgctcagcacgtcataatggtta

SEQ ID NO: 283763 - DNA, 25 bp, Mus musculus
attgctcagcatacgtgtcagggtg

SEQ ID NO: 283764 - DNA, 25 bp, Mus musculus
attgctcagcattcgtgtcagggtg

SEQ ID NO: 283765 - DNA, 25 bp, Mus musculus
attgctcagggacctccaggaggca

SEQ ID NO: 283766 - DNA, 25 bp, Mus musculus
attgctcagggagctccaggaggca

SEQ ID NO: 283767 - DNA, 25 bp, Mus musculus
attgctcagtggatatgcacactta

SEQ ID NO: 283768 - DNA, 25 bp, Mus musculus
attgctcagtggttatgcacactta

SEQ ID NO: 283769 - DNA, 25 bp, Mus musculus
attgctcagttcacttaaatgggac

SEQ ID NO: 283770 - DNA, 25 bp, Mus musculus
attgctcagttctcttaaatgggac

SEQ ID NO: 283771 - DNA, 25 bp, Mus musculus
attgctcatatcctggaacttctag

SEQ ID NO: 283772 - DNA, 25 bp, Mus musculus
attgctcatatcgtggaacttctag

SEQ ID NO: 283773 - DNA, 25 bp, Mus musculus
attgctcatcaaattttgccttaag

SEQ ID NO: 283774 - DNA, 25 bp, Mus musculus
attgctcatcaatttttgccttaag

SEQ ID NO: 283775 - DNA, 25 bp, Mus musculus
attgctcatgaaaatcactccttat

SEQ ID NO: 283776 - DNA, 25 bp, Mus musculus
attgctcatgaatatcactccttat

SEQ ID NO: 283777 - DNA, 25 bp, Mus musculus
attgctcatgagaacacctgccctg

SEQ ID NO: 283778 - DNA, 25 bp, Mus musculus
attgctcatgagtacacctgccctg

SEQ ID NO: 283779 - DNA, 25 bp, Mus musculus
attgctcattgaactctgtgttgga

SEQ ID NO: 283780 - DNA, 25 bp, Mus musculus
attgctcattgatctctgtgttgga

SEQ ID NO: 283781 - DNA, 25 bp, Mus musculus
attgctccaataagattccgcctga

SEQ ID NO: 283782 - DNA, 25 bp, Mus musculus
attgctccaatatgattccgcctga

SEQ ID NO: 283783 - DNA, 25 bp, Mus musculus
attgctccagaaatgtcatagtccg

SEQ ID NO: 283784 - DNA, 25 bp, Mus musculus
attgctccagaattgtcatagtccg

SEQ ID NO: 283785 - DNA, 25 bp, Mus musculus
attgctccagtaatcatgctcctta

SEQ ID NO: 283786 - DNA, 25 bp, Mus musculus
attgctccagtattcatgctcctta

SEQ ID NO: 283787 - DNA, 25 bp, Mus musculus
attgctccagtgacttcagctggta

SEQ ID NO: 283788 - DNA, 25 bp, Mus musculus
attgctccagtgtcttcagctggta

SEQ ID NO: 283789 - DNA, 25 bp, Mus musculus
attgctcccagtatgggctctaata

SEQ ID NO: 283790 - DNA, 25 bp, Mus musculus
attgctcccagtttgggctctaata

SEQ ID NO: 283791 - DNA, 25 bp, Mus musculus
attgctcccataacttttagttgtg

SEQ ID NO: 283792 - DNA, 25 bp, Mus musculus
attgctcccatatcttttagttgtg

SEQ ID NO: 283793 - DNA, 25 bp, Mus musculus
attgctcccgttaattcagagtggt

SEQ ID NO: 283794 - DNA, 25 bp, Mus musculus
attgctcccgtttattcagagtggt

SEQ ID NO: 283795 - DNA, 25 bp, Mus musculus
attgctcctggaagtaacatccttt

SEQ ID NO: 283796 - DNA, 25 bp, Mus musculus
attgctcctggatgtaacatccttt

SEQ ID NO: 283797 - DNA, 25 bp, Mus musculus
attgctcctgtcagtgagcctattg

SEQ ID NO: 283798 - DNA, 25 bp, Mus musculus
attgctcctgtctgtgagcctattg

SEQ ID NO: 283799 - DNA, 25 bp, Mus musculus
attgctcctgtgaagctatctgaca

SEQ ID NO: 283800 - DNA, 25 bp, Mus musculus
attgctcctgtgtagctatctgaca

SEQ ID NO: 283801 - DNA, 25 bp, Mus musculus
attgctccttgtatatgtccttcat

SEQ ID NO: 283802 - DNA, 25 bp, Mus musculus
attgctccttgtttatgtccttcat

SEQ ID NO: 283803 - DNA, 25 bp, Mus musculus
attgctcgagatctggctcctacag

SEQ ID NO: 283804 - DNA, 25 bp, Mus musculus
attgctcgagatgtggctcctacag

SEQ ID NO: 283805 - DNA, 25 bp, Mus musculus
attgctcgtggcactaagttgtaaa

SEQ ID NO: 283806 - DNA, 25 bp, Mus musculus
attgctcgtggctctaagttgtaaa

SEQ ID NO: 283807 - DNA, 25 bp, Mus musculus
attgctctaagtagactgtcatggc

SEQ ID NO: 283808 - DNA, 25 bp, Mus musculus
attgctctaagttgactgtcatggc

SEQ ID NO: 283809 - DNA, 25 bp, Mus musculus
attgctctagagatgttgcctgttc

SEQ ID NO: 283810 - DNA, 25 bp, Mus musculus
attgctctagagttgttgcctgttc

SEQ ID NO: 283811 - DNA, 25 bp, Mus musculus
attgctctagttcaacatgccctca

SEQ ID NO: 283812 - DNA, 25 bp, Mus musculus
attgctctagttgaacatgccctca

SEQ ID NO: 283813 - DNA, 25 bp, Mus musculus
attgctctcaatctctacagatctc

SEQ ID NO: 283814 - DNA, 25 bp, Mus musculus
attgctctcaatgtctacagatctc

SEQ ID NO: 283815 - DNA, 25 bp, Mus musculus
attgctctcaggctgatctcctgct

SEQ ID NO: 283816 - DNA, 25 bp, Mus musculus
attgctctcagggtgatctcctgct

SEQ ID NO: 283817 - DNA, 25 bp, Mus musculus
attgctctcctcaatttctccctgg

SEQ ID NO: 283818 - DNA, 25 bp, Mus musculus
attgctctcctctatttctccctgg

SEQ ID NO: 283819 - DNA, 25 bp, Mus musculus
attgctctcctgatgggattctgtt

SEQ ID NO: 283820 - DNA, 25 bp, Mus musculus
attgctctcctgttgggattctgtt

SEQ ID NO: 283821 - DNA, 25 bp, Mus musculus
attgctctccttcatgcctgtgtag

SEQ ID NO: 283822 - DNA, 25 bp, Mus musculus
attgctctccttcgcagttcaaaca

SEQ ID NO: 283823 - DNA, 25 bp, Mus musculus
attgctctccttgatgcctgtgtag

SEQ ID NO: 283824 - DNA, 25 bp, Mus musculus
attgctctccttggcagttcaaaca

SEQ ID NO: 283825 - DNA, 25 bp, Mus musculus
attgctctctgacgctaaaacagga

SEQ ID NO: 283826 - DNA, 25 bp, Mus musculus
attgctctctgaggctaaaacagga

SEQ ID NO: 283827 - DNA, 25 bp, Mus musculus
attgctctctgtacttgactgttga

SEQ ID NO: 283828 - DNA, 25 bp, Mus musculus
attgctctctgttcttgactgttga

SEQ ID NO: 283829 - DNA, 25 bp, Mus musculus
attgctctgaccaaagactgcttgt

SEQ ID NO: 283830 - DNA, 25 bp, Mus musculus
attgctctgacctaagactgcttgt

SEQ ID NO: 283831 - DNA, 25 bp, Mus musculus
attgctctgagcctgacctcgcgtg

SEQ ID NO: 283832 - DNA, 25 bp, Mus musculus
attgctctgagcgtgacctcgcgtg

SEQ ID NO: 283833 - DNA, 25 bp, Mus musculus
attgctctgagtcactgacgtgaga

SEQ ID NO: 283834 - DNA, 25 bp, Mus musculus
attgctctgagtgactgacgtgaga

SEQ ID NO: 283835 - DNA, 25 bp, Mus musculus
attgctctgcatctcttaattggta

SEQ ID NO: 283836 - DNA, 25 bp, Mus musculus
attgctctgcatgtcttaattggta

SEQ ID NO: 283837 - DNA, 25 bp, Mus musculus
attgctctggctaagtacccagcaa

SEQ ID NO: 283838 - DNA, 25 bp, Mus musculus
attgctctggcttagtacccagcaa

SEQ ID NO: 283839 - DNA, 25 bp, Mus musculus
attgctctgtcgatttatacatttg

SEQ ID NO: 283840 - DNA, 25 bp, Mus musculus
attgctctgtcgttttatacatttg

SEQ ID NO: 283841 - DNA, 25 bp, Mus musculus
attgctctgtctaatgtctacatcc

SEQ ID NO: 283842 - DNA, 25 bp, Mus musculus
attgctctgtcttatgtctacatcc

SEQ ID NO: 283843 - DNA, 25 bp, Mus musculus
attgctctgttcagacttctaggtg

SEQ ID NO: 283844 - DNA, 25 bp, Mus musculus
attgctctgttctgacttctaggtg

SEQ ID NO: 283845 - DNA, 25 bp, Mus musculus
attgctctgttgatgctattggtca

SEQ ID NO: 283846 - DNA, 25 bp, Mus musculus
attgctctgttgttgctattggtca

SEQ ID NO: 283847 - DNA, 25 bp, Mus musculus
attgctcttcttccagtcagctttg

SEQ ID NO: 283848 - DNA, 25 bp, Mus musculus
attgctcttcttgcagtcagctttg

SEQ ID NO: 283849 - DNA, 25 bp, Mus musculus
attgctcttgaaccagataaaactg

SEQ ID NO: 283850 - DNA, 25 bp, Mus musculus
attgctcttgaagcagataaaactg

SEQ ID NO: 283851 - DNA, 25 bp, Mus musculus
attgctctttatcctgaagctttag

SEQ ID NO: 283852 - DNA, 25 bp, Mus musculus
attgctctttatgctgaagctttag

SEQ ID NO: 283853 - DNA, 25 bp, Mus musculus
attgctctttctaactggaaccgaa

SEQ ID NO: 283854 - DNA, 25 bp, Mus musculus
attgctctttcttactggaaccgaa

SEQ ID NO: 283855 - DNA, 25 bp, Mus musculus
attgctctttgcagttacccacctc

SEQ ID NO: 283856 - DNA, 25 bp, Mus musculus
attgctctttgctgttacccacctc

SEQ ID NO: 283857 - DNA, 25 bp, Mus musculus
attgctgaaaacaggatcctgcatg

SEQ ID NO: 283858 - DNA, 25 bp, Mus musculus
attgctgaaaactggatcctgcatg

SEQ ID NO: 283859 - DNA, 25 bp, Mus musculus
attgctgaaccgagctgggagagaa

SEQ ID NO: 283860 - DNA, 25 bp, Mus musculus
attgctgaaccgtgctgggagagaa

SEQ ID NO: 283861 - DNA, 25 bp, Mus musculus
attgctgaactaaccatgcctgtgt

SEQ ID NO: 283862 - DNA, 25 bp, Mus musculus
attgctgaactatccatgcctgtgt

SEQ ID NO: 283863 - DNA, 25 bp, Mus musculus
attgctgaactcattacagccccgt

SEQ ID NO: 283864 - DNA, 25 bp, Mus musculus
attgctgaactctttacagccccgt

SEQ ID NO: 283865 - DNA, 25 bp, Mus musculus
attgctgaagcaacaaaggacaaga

SEQ ID NO: 283866 - DNA, 25 bp, Mus musculus
attgctgaagcatcaaaggacaaga

SEQ ID NO: 283867 - DNA, 25 bp, Mus musculus
attgctgaagccagggcccgtctgg

SEQ ID NO: 283868 - DNA, 25 bp, Mus musculus
attgctgaagcctgggcccgtctgg

SEQ ID NO: 283869 - DNA, 25 bp, Mus musculus
attgctgaagctactcagactcacc

SEQ ID NO: 283870 - DNA, 25 bp, Mus musculus
attgctgaagcttctcagactcacc

SEQ ID NO: 283871 - DNA, 25 bp, Mus musculus
attgctgaagtcaaattggcttttt

SEQ ID NO: 283872 - DNA, 25 bp, Mus musculus
attgctgaagtcctagaactgtgag

SEQ ID NO: 283873 - DNA, 25 bp, Mus musculus
attgctgaagtcgtagaactgtgag

SEQ ID NO: 283874 - DNA, 25 bp, Mus musculus
attgctgaagtctaattggcttttt

SEQ ID NO: 283875 - DNA, 25 bp, Mus musculus
attgctgacaacaagagaaccctag

SEQ ID NO: 283876 - DNA, 25 bp, Mus musculus
attgctgacaactagagaaccctag

SEQ ID NO: 283877 - DNA, 25 bp, Mus musculus
attgctgacagacagtgccctttac

SEQ ID NO: 283878 - DNA, 25 bp, Mus musculus
attgctgacagagagtgccctttac

SEQ ID NO: 283879 - DNA, 25 bp, Mus musculus
attgctgacctgcaaaccctgtgag

SEQ ID NO: 283880 - DNA, 25 bp, Mus musculus
attgctgacctggaaaccctgtgag

SEQ ID NO: 283881 - DNA, 25 bp, Mus musculus
attgctgagaacatgcttttaattg

SEQ ID NO: 283882 - DNA, 25 bp, Mus musculus
attgctgagaacttgcttttaattg

SEQ ID NO: 283883 - DNA, 25 bp, Mus musculus
attgctgagccactcattggaaagc

SEQ ID NO: 283884 - DNA, 25 bp, Mus musculus
attgctgagccagtcattggaaagc

SEQ ID NO: 283885 - DNA, 25 bp, Mus musculus
attgctgagcttccgcgtactaatg

SEQ ID NO: 283886 - DNA, 25 bp, Mus musculus
attgctgagcttgcgcgtactaatg

SEQ ID NO: 283887 - DNA, 25 bp, Mus musculus
attgctgaggatacttcaggccact

SEQ ID NO: 283888 - DNA, 25 bp, Mus musculus
attgctgaggattcttcaggccact

SEQ ID NO: 283889 - DNA, 25 bp, Mus musculus
attgctgagggcaaacaacccttgc

SEQ ID NO: 283890 - DNA, 25 bp, Mus musculus
attgctgagggctaacaacccttgc

SEQ ID NO: 283891 - DNA, 25 bp, Mus musculus
attgctgagtgcctgctagtgtttt

SEQ ID NO: 283892 - DNA, 25 bp, Mus musculus
attgctgagtgcgtgctagtgtttt

SEQ ID NO: 283893 - DNA, 25 bp, Mus musculus
attgctgagttgaatgccactgtgt

SEQ ID NO: 283894 - DNA, 25 bp, Mus musculus
attgctgagttgtatgccactgtgt

SEQ ID NO: 283895 - DNA, 25 bp, Mus musculus
attgctgatcggaagaaaaatatgc

SEQ ID NO: 283896 - DNA, 25 bp, Mus musculus
attgctgatcggtagaaaaatatgc

SEQ ID NO: 283897 - DNA, 25 bp, Mus musculus
attgctgatctgagttggtgctcat

SEQ ID NO: 283898 - DNA, 25 bp, Mus musculus
attgctgatctgtgttggtgctcat

SEQ ID NO: 283899 - DNA, 25 bp, Mus musculus
attgctgatttcatccaaatgagga

SEQ ID NO: 283900 - DNA, 25 bp, Mus musculus
attgctgatttcttccaaatgagga

SEQ ID NO: 283901 - DNA, 25 bp, Mus musculus
attgctgatttgagtagttgcttat

SEQ ID NO: 283902 - DNA, 25 bp, Mus musculus
attgctgatttgtgtagttgcttat

SEQ ID NO: 283903 - DNA, 25 bp, Mus musculus
attgctgattttagagttcccgaca

SEQ ID NO: 283904 - DNA, 25 bp, Mus musculus
attgctgatttttgagttcccgaca

SEQ ID NO: 283905 - DNA, 25 bp, Mus musculus
attgctgcaactcgcaaacctgccg

SEQ ID NO: 283906 - DNA, 25 bp, Mus musculus
attgctgcaactggcaaacctgccg

SEQ ID NO: 283907 - DNA, 25 bp, Mus musculus
attgctgcaagcaggttctctaaaa

SEQ ID NO: 283908 - DNA, 25 bp, Mus musculus
attgctgcaagctggttctctaaaa

SEQ ID NO: 283909 - DNA, 25 bp, Mus musculus
attgctgcactcctccactatggtg

SEQ ID NO: 283910 - DNA, 25 bp, Mus musculus
attgctgcactcgtccactatggtg

SEQ ID NO: 283911 - DNA, 25 bp, Mus musculus
attgctgcagaactctaaacctctc

SEQ ID NO: 283912 - DNA, 25 bp, Mus musculus
attgctgcagaagtctaaacctctc

SEQ ID NO: 283913 - DNA, 25 bp, Mus musculus
attgctgcagggagtgtcaagtcaa

SEQ ID NO: 283914 - DNA, 25 bp, Mus musculus
attgctgcagggtgtgtcaagtcaa

SEQ ID NO: 283915 - DNA, 25 bp, Mus musculus
attgctgccagcctgagactgttct

SEQ ID NO: 283916 - DNA, 25 bp, Mus musculus
attgctgccagcgtgagactgttct

SEQ ID NO: 283917 - DNA, 25 bp, Mus musculus
attgctgccccgaggaatcctgagg

SEQ ID NO: 283918 - DNA, 25 bp, Mus musculus
attgctgccccgtggaatcctgagg

SEQ ID NO: 283919 - DNA, 25 bp, Mus musculus
attgctgccctcagctaaagacact

SEQ ID NO: 283920 - DNA, 25 bp, Mus musculus
attgctgccctctgctaaagacact

SEQ ID NO: 283921 - DNA, 25 bp, Mus musculus
attgctgcccttacagatatgtgca

SEQ ID NO: 283922 - DNA, 25 bp, Mus musculus
attgctgccctttcagatatgtgca

SEQ ID NO: 283923 - DNA, 25 bp, Mus musculus
attgctgcctacagagctaaaggaa

SEQ ID NO: 283924 - DNA, 25 bp, Mus musculus
attgctgcctactgagctaaaggaa

SEQ ID NO: 283925 - DNA, 25 bp, Mus musculus
attgctgcctgtatttcatcgattc

SEQ ID NO: 283926 - DNA, 25 bp, Mus musculus
attgctgcctgtttttcatcgattc

SEQ ID NO: 283927 - DNA, 25 bp, Mus musculus
attgctgccttcaatcgactcagaa

SEQ ID NO: 283928 - DNA, 25 bp, Mus musculus
attgctgccttctatcgactcagaa

SEQ ID NO: 283929 - DNA, 25 bp, Mus musculus
attgctgccttgctggctagcccaa

SEQ ID NO: 283930 - DNA, 25 bp, Mus musculus
attgctgccttggtggctagcccaa

SEQ ID NO: 283931 - DNA, 25 bp, Mus musculus
attgctgcgcaaagacttgtatttt

SEQ ID NO: 283932 - DNA, 25 bp, Mus musculus
attgctgcgcaatgacttgtatttt

SEQ ID NO: 283933 - DNA, 25 bp, Mus musculus
attgctgcgtctcagtggcgtgtcc

SEQ ID NO: 283934 - DNA, 25 bp, Mus musculus
attgctgcgtctgagtggcgtgtcc

SEQ ID NO: 283935 - DNA, 25 bp, Mus musculus
attgctgctaggattcttactgccc

SEQ ID NO: 283936 - DNA, 25 bp, Mus musculus
attgctgctaggtttcttactgccc

SEQ ID NO: 283937 - DNA, 25 bp, Mus musculus
attgctgctatactggtctttctat

SEQ ID NO: 283938 - DNA, 25 bp, Mus musculus
attgctgctatagtggtctttctat

SEQ ID NO: 283939 - DNA, 25 bp, Mus musculus
attgctgctctacgaaatatgttca

SEQ ID NO: 283940 - DNA, 25 bp, Mus musculus
attgctgctctaggaaatatgttca

SEQ ID NO: 283941 - DNA, 25 bp, Mus musculus
attgctgctctgcagtgtatgcacg

SEQ ID NO: 283942 - DNA, 25 bp, Mus musculus
attgctgctctggagtgtatgcacg

SEQ ID NO: 283943 - DNA, 25 bp, Mus musculus
attgctgctgcaagtctggctcttt

SEQ ID NO: 283944 - DNA, 25 bp, Mus musculus
attgctgctgcacgatttgcaggcc

SEQ ID NO: 283945 - DNA, 25 bp, Mus musculus
attgctgctgcaggatttgcaggcc

SEQ ID NO: 283946 - DNA, 25 bp, Mus musculus
attgctgctgcatgtctggctcttt

SEQ ID NO: 283947 - DNA, 25 bp, Mus musculus
attgctgctgctcaatgtgccttat

SEQ ID NO: 283948 - DNA, 25 bp, Mus musculus
attgctgctgctgaatgtgccttat

SEQ ID NO: 283949 - DNA, 25 bp, Mus musculus
attgctgctggaaatccatatctaa

SEQ ID NO: 283950 - DNA, 25 bp, Mus musculus
attgctgctggatatccatatctaa

SEQ ID NO: 283951 - DNA, 25 bp, Mus musculus
attgctgctgtaactagtcatctct

SEQ ID NO: 283952 - DNA, 25 bp, Mus musculus
attgctgctgtatctagtcatctct

SEQ ID NO: 283953 - DNA, 25 bp, Mus musculus
attgctgcttaactcatctgggtat

SEQ ID NO: 283954 - DNA, 25 bp, Mus musculus
attgctgcttaagtcatctgggtat

SEQ ID NO: 283955 - DNA, 25 bp, Mus musculus
attgctggaaacacagctgtgctcc

SEQ ID NO: 283956 - DNA, 25 bp, Mus musculus
attgctggaaactcagctgtgctcc

SEQ ID NO: 283957 - DNA, 25 bp, Mus musculus
attgctggagctcccttccacttgg

SEQ ID NO: 283958 - DNA, 25 bp, Mus musculus
attgctggagctgccttccacttgg

SEQ ID NO: 283959 - DNA, 25 bp, Mus musculus
attgctggagtcaactctactggga

SEQ ID NO: 283960 - DNA, 25 bp, Mus musculus
attgctggagtctactctactggga

SEQ ID NO: 283961 - DNA, 25 bp, Mus musculus
attgctggcaagctgcacaggtcca

SEQ ID NO: 283962 - DNA, 25 bp, Mus musculus
attgctggcaaggtgcacaggtcca

SEQ ID NO: 283963 - DNA, 25 bp, Mus musculus
attgctggccttataaagcgttcct

SEQ ID NO: 283964 - DNA, 25 bp, Mus musculus
attgctggccttttaaagcgttcct

SEQ ID NO: 283965 - DNA, 25 bp, Mus musculus
attgctggctttcttctagctctct

SEQ ID NO: 283966 - DNA, 25 bp, Mus musculus
attgctggctttgttctagctctct

SEQ ID NO: 283967 - DNA, 25 bp, Mus musculus
attgctgggacaaatgcctccatta

SEQ ID NO: 283968 - DNA, 25 bp, Mus musculus
attgctgggacatatgcctccatta

SEQ ID NO: 283969 - DNA, 25 bp, Mus musculus
attgctgggactagctgccttgtag

SEQ ID NO: 283970 - DNA, 25 bp, Mus musculus
attgctgggacttgctgccttgtag

SEQ ID NO: 283971 - DNA, 25 bp, Mus musculus
attgctgggtttctcttcttgggga

SEQ ID NO: 283972 - DNA, 25 bp, Mus musculus
attgctgggtttctgcttcgatttc

SEQ ID NO: 283973 - DNA, 25 bp, Mus musculus
attgctgggtttgtcttcttgggga

SEQ ID NO: 283974 - DNA, 25 bp, Mus musculus
attgctgggtttgtgcttcgatttc

SEQ ID NO: 283975 - DNA, 25 bp, Mus musculus
attgctggtggtagtggccatcgca

SEQ ID NO: 283976 - DNA, 25 bp, Mus musculus
attgctggtggttgtggccatcgca

SEQ ID NO: 283977 - DNA, 25 bp, Mus musculus
attgctgtaaagattgatttcaaac

SEQ ID NO: 283978 - DNA, 25 bp, Mus musculus
attgctgtaaagtttgatttcaaac

SEQ ID NO: 283979 - DNA, 25 bp, Mus musculus
attgctgtaactactttaacttcca

SEQ ID NO: 283980 - DNA, 25 bp, Mus musculus
attgctgtaacttctttaacttcca

SEQ ID NO: 283981 - DNA, 25 bp, Mus musculus
attgctgtagacaaagccacctatt

SEQ ID NO: 283982 - DNA, 25 bp, Mus musculus
attgctgtagactaagccacctatt

SEQ ID NO: 283983 - DNA, 25 bp, Mus musculus
attgctgtagctccaagagccagga

SEQ ID NO: 283984 - DNA, 25 bp, Mus musculus
attgctgtagctcctctgataacga

SEQ ID NO: 283985 - DNA, 25 bp, Mus musculus
attgctgtagctgcaagagccagga

SEQ ID NO: 283986 - DNA, 25 bp, Mus musculus
attgctgtagctgctctgataacga

SEQ ID NO: 283987 - DNA, 25 bp, Mus musculus
attgctgtatgcactttgtgtcagg

SEQ ID NO: 283988 - DNA, 25 bp, Mus musculus
attgctgtatgctctttgtgtcagg

SEQ ID NO: 283989 - DNA, 25 bp, Mus musculus
attgctgtattgaaagaccgcccct

SEQ ID NO: 283990 - DNA, 25 bp, Mus musculus
attgctgtattgtaagaccgcccct

SEQ ID NO: 283991 - DNA, 25 bp, Mus musculus
attgctgtcagcaaaggaggaagag

SEQ ID NO: 283992 - DNA, 25 bp, Mus musculus
attgctgtcagcacatcgagttcat

SEQ ID NO: 283993 - DNA, 25 bp, Mus musculus
attgctgtcagctaaggaggaagag

SEQ ID NO: 283994 - DNA, 25 bp, Mus musculus
attgctgtcagctcatcgagttcat

SEQ ID NO: 283995 - DNA, 25 bp, Mus musculus
attgctgtcagtagggggccctgcc

SEQ ID NO: 283996 - DNA, 25 bp, Mus musculus
attgctgtcagttgggggccctgcc

SEQ ID NO: 283997 - DNA, 25 bp, Mus musculus
attgctgtcatcagcgtggtggtcc

SEQ ID NO: 283998 - DNA, 25 bp, Mus musculus
attgctgtcatcctcctggattggg

SEQ ID NO: 283999 - DNA, 25 bp, Mus musculus
attgctgtcatcgtcctggattggg

SEQ ID NO: 284000 - DNA, 25 bp, Mus musculus
attgctgtcatctgcgtggtggtcc

SEQ ID NO: 284001 - DNA, 25 bp, Mus musculus
attgctgtcattaaattccaccgaa

SEQ ID NO: 284002 - DNA, 25 bp, Mus musculus
attgctgtcattcaggttggtggca

SEQ ID NO: 284003 - DNA, 25 bp, Mus musculus
attgctgtcattgaggttggtggca

SEQ ID NO: 284004 - DNA, 25 bp, Mus musculus
attgctgtcatttaattccaccgaa

SEQ ID NO: 284005 - DNA, 25 bp, Mus musculus
attgctgtcgagcaggaaccccaag

SEQ ID NO: 284006 - DNA, 25 bp, Mus musculus
attgctgtcgaggaggaaccccaag

SEQ ID NO: 284007 - DNA, 25 bp, Mus musculus
attgctgtcgccacaattactctag

SEQ ID NO: 284008 - DNA, 25 bp, Mus musculus
attgctgtcgcctcaattactctag

SEQ ID NO: 284009 - DNA, 25 bp, Mus musculus
attgctgtcgtgctagattttgtta

SEQ ID NO: 284010 - DNA, 25 bp, Mus musculus
attgctgtcgtggtagattttgtta

SEQ ID NO: 284011 - DNA, 25 bp, Mus musculus
attgctgtgaatatctggtatgaca

SEQ ID NO: 284012 - DNA, 25 bp, Mus musculus
attgctgtgaatttctggtatgaca

SEQ ID NO: 284013 - DNA, 25 bp, Mus musculus
attgctgtgactcgttctgcccagg

SEQ ID NO: 284014 - DNA, 25 bp, Mus musculus
attgctgtgactggttctgcccagg

SEQ ID NO: 284015 - DNA, 25 bp, Mus musculus
attgctgtgcagctcatgcatgttc

SEQ ID NO: 284016 - DNA, 25 bp, Mus musculus
attgctgtgcaggtcatgcatgttc

SEQ ID NO: 284017 - DNA, 25 bp, Mus musculus
attgctgtgcataatccaaagtgga

SEQ ID NO: 284018 - DNA, 25 bp, Mus musculus
attgctgtgcattatccaaagtgga

SEQ ID NO: 284019 - DNA, 25 bp, Mus musculus
attgctgtggttacttctccattct

SEQ ID NO: 284020 - DNA, 25 bp, Mus musculus
attgctgtggtttcttctccattct

SEQ ID NO: 284021 - DNA, 25 bp, Mus musculus
attgctgttcagacttaacgatttg

SEQ ID NO: 284022 - DNA, 25 bp, Mus musculus
attgctgttcagatccatatcttta

SEQ ID NO: 284023 - DNA, 25 bp, Mus musculus
attgctgttcagtcttaacgatttg

SEQ ID NO: 284024 - DNA, 25 bp, Mus musculus
attgctgttcagttccatatcttta

SEQ ID NO: 284025 - DNA, 25 bp, Mus musculus
attgctgttcctagaatcaataaac

SEQ ID NO: 284026 - DNA, 25 bp, Mus musculus
attgctgttccttgaatcaataaac

SEQ ID NO: 284027 - DNA, 25 bp, Mus musculus
attgctgttcgcctaggaacacatc

SEQ ID NO: 284028 - DNA, 25 bp, Mus musculus
attgctgttcgcgtaggaacacatc

SEQ ID NO: 284029 - DNA, 25 bp, Mus musculus
attgctgttctacccaatcatcaga

SEQ ID NO: 284030 - DNA, 25 bp, Mus musculus
attgctgttctagccaatcatcaga

SEQ ID NO: 284031 - DNA, 25 bp, Mus musculus
attgctgttctgatgtccacttgta

SEQ ID NO: 284032 - DNA, 25 bp, Mus musculus
attgctgttctgttgtccacttgta

SEQ ID NO: 284033 - DNA, 25 bp, Mus musculus
attgctgttgtgctccgatcgtaag

SEQ ID NO: 284034 - DNA, 25 bp, Mus musculus
attgctgttgtggtccgatcgtaag

SEQ ID NO: 284035 - DNA, 25 bp, Mus musculus
attgctgtttctccgtgtggcgttc

SEQ ID NO: 284036 - DNA, 25 bp, Mus musculus
attgctgtttctgcgtgtggcgttc

SEQ ID NO: 284037 - DNA, 25 bp, Mus musculus
attgctgtttgcataactttcccct

SEQ ID NO: 284038 - DNA, 25 bp, Mus musculus
attgctgtttgcttaactttcccct

SEQ ID NO: 284039 - DNA, 25 bp, Mus musculus
attgctgttttaatacctaggattt

SEQ ID NO: 284040 - DNA, 25 bp, Mus musculus
attgctgttttattacctaggattt

SEQ ID NO: 284041 - DNA, 25 bp, Mus musculus
attgcttaaaccatacattctctta

SEQ ID NO: 284042 - DNA, 25 bp, Mus musculus
attgcttaaaccttacattctctta

SEQ ID NO: 284043 - DNA, 25 bp, Mus musculus
attgcttaaactcgcaatgctttcc

SEQ ID NO: 284044 - DNA, 25 bp, Mus musculus
attgcttaaactggcaatgctttcc

SEQ ID NO: 284045 - DNA, 25 bp, Mus musculus
attgcttaacttacagctcagactg

SEQ ID NO: 284046 - DNA, 25 bp, Mus musculus
attgcttaactttcagctcagactg

SEQ ID NO: 284047 - DNA, 25 bp, Mus musculus
attgcttaaggtcattctggtggct

SEQ ID NO: 284048 - DNA, 25 bp, Mus musculus
attgcttaaggtgattctggtggct

SEQ ID NO: 284049 - DNA, 25 bp, Mus musculus
attgcttacaacatactgacttggg

SEQ ID NO: 284050 - DNA, 25 bp, Mus musculus
attgcttacaacttactgacttggg

SEQ ID NO: 284051 - DNA, 25 bp, Mus musculus
attgcttacatccttttattcctct

SEQ ID NO: 284052 - DNA, 25 bp, Mus musculus
attgcttacatcgttttattcctct

SEQ ID NO: 284053 - DNA, 25 bp, Mus musculus
attgcttacctccatcttgtctgta

SEQ ID NO: 284054 - DNA, 25 bp, Mus musculus
attgcttacctcgatcttgtctgta

SEQ ID NO: 284055 - DNA, 25 bp, Mus musculus
attgcttacgctctttcccagtcaa

SEQ ID NO: 284056 - DNA, 25 bp, Mus musculus
attgcttacgctgtttcccagtcaa

SEQ ID NO: 284057 - DNA, 25 bp, Mus musculus
attgcttagacacttggtatgagtt

SEQ ID NO: 284058 - DNA, 25 bp, Mus musculus
attgcttagacagttggtatgagtt

SEQ ID NO: 284059 - DNA, 25 bp, Mus musculus
attgcttagcagataggcagcttgc

SEQ ID NO: 284060 - DNA, 25 bp, Mus musculus
attgcttagcagttaggcagcttgc

SEQ ID NO: 284061 - DNA, 25 bp, Mus musculus
attgcttagcccatcttaaactatg

SEQ ID NO: 284062 - DNA, 25 bp, Mus musculus
attgcttagcccttcttaaactatg

SEQ ID NO: 284063 - DNA, 25 bp, Mus musculus
attgcttagctaataatctgaacat

SEQ ID NO: 284064 - DNA, 25 bp, Mus musculus
attgcttagctattaatctgaacat

SEQ ID NO: 284065 - DNA, 25 bp, Mus musculus
attgcttagctcaacctgcctgtta

SEQ ID NO: 284066 - DNA, 25 bp, Mus musculus
attgcttagctctacctgcctgtta

SEQ ID NO: 284067 - DNA, 25 bp, Mus musculus
attgcttatcttaccaagacctgtc

SEQ ID NO: 284068 - DNA, 25 bp, Mus musculus
attgcttatcttcacacacagtagg

SEQ ID NO: 284069 - DNA, 25 bp, Mus musculus
attgcttatcttgacacacagtagg

SEQ ID NO: 284070 - DNA, 25 bp, Mus musculus
attgcttatctttccaagacctgtc

SEQ ID NO: 284071 - DNA, 25 bp, Mus musculus
attgcttatgcaaatttctagttaa

SEQ ID NO: 284072 - DNA, 25 bp, Mus musculus
attgcttatgcatatttctagttaa

SEQ ID NO: 284073 - DNA, 25 bp, Mus musculus
attgcttatgttctactttatgggc

SEQ ID NO: 284074 - DNA, 25 bp, Mus musculus
attgcttatgttgtactttatgggc

SEQ ID NO: 284075 - DNA, 25 bp, Mus musculus
attgcttattacatggtggctggaa

SEQ ID NO: 284076 - DNA, 25 bp, Mus musculus
attgcttattacttggtggctggaa

SEQ ID NO: 284077 - DNA, 25 bp, Mus musculus
attgcttcaaaaattctgacatgtc

SEQ ID NO: 284078 - DNA, 25 bp, Mus musculus
attgcttcaaaatttctgacatgtc

SEQ ID NO: 284079 - DNA, 25 bp, Mus musculus
attgcttcaaccaaagaaaaagtat

SEQ ID NO: 284080 - DNA, 25 bp, Mus musculus
attgcttcaacctaagaaaaagtat

SEQ ID NO: 284081 - DNA, 25 bp, Mus musculus
attgcttcaatgctatccagccaag

SEQ ID NO: 284082 - DNA, 25 bp, Mus musculus
attgcttcaatggtatccagccaag

SEQ ID NO: 284083 - DNA, 25 bp, Mus musculus
attgcttcacttcagtgctgattca

SEQ ID NO: 284084 - DNA, 25 bp, Mus musculus
attgcttcacttgagtgctgattca

SEQ ID NO: 284085 - DNA, 25 bp, Mus musculus
attgcttcagctcgccacttggagt

SEQ ID NO: 284086 - DNA, 25 bp, Mus musculus
attgcttcagctggccacttggagt

SEQ ID NO: 284087 - DNA, 25 bp, Mus musculus
attgcttcaggactttcacattggc

SEQ ID NO: 284088 - DNA, 25 bp, Mus musculus
attgcttcaggagtttcacattggc

SEQ ID NO: 284089 - DNA, 25 bp, Mus musculus
attgcttcagtgaccctaatgctgc

SEQ ID NO: 284090 - DNA, 25 bp, Mus musculus
attgcttcagtgtccctaatgctgc

SEQ ID NO: 284091 - DNA, 25 bp, Mus musculus
attgcttcataactaaccaggcttt

SEQ ID NO: 284092 - DNA, 25 bp, Mus musculus
attgcttcataagtaaccaggcttt

SEQ ID NO: 284093 - DNA, 25 bp, Mus musculus
attgcttcatcaatcttcagaaagg

SEQ ID NO: 284094 - DNA, 25 bp, Mus musculus
attgcttcatcattcttcagaaagg

SEQ ID NO: 284095 - DNA, 25 bp, Mus musculus
attgcttcattgcttttaacccttt

SEQ ID NO: 284096 - DNA, 25 bp, Mus musculus
attgcttcattggttttaacccttt

SEQ ID NO: 284097 - DNA, 25 bp, Mus musculus
attgcttccaccagtgtgtttctga

SEQ ID NO: 284098 - DNA, 25 bp, Mus musculus
attgcttccacctgtgtgtttctga

SEQ ID NO: 284099 - DNA, 25 bp, Mus musculus
attgcttccattcccagaagtgtta

SEQ ID NO: 284100 - DNA, 25 bp, Mus musculus
attgcttccattgccagaagtgtta

SEQ ID NO: 284101 - DNA, 25 bp, Mus musculus
attgcttcctagagcccattgctag

SEQ ID NO: 284102 - DNA, 25 bp, Mus musculus
attgcttcctagattacagcatgat

SEQ ID NO: 284103 - DNA, 25 bp, Mus musculus
attgcttcctagtgcccattgctag

SEQ ID NO: 284104 - DNA, 25 bp, Mus musculus
attgcttcctagtttacagcatgat

SEQ ID NO: 284105 - DNA, 25 bp, Mus musculus
attgcttcgcaccatgattacattt

SEQ ID NO: 284106 - DNA, 25 bp, Mus musculus
attgcttcgcacgatgattacattt

SEQ ID NO: 284107 - DNA, 25 bp, Mus musculus
attgcttctacaatcattgctctat

SEQ ID NO: 284108 - DNA, 25 bp, Mus musculus
attgcttctacattcattgctctat

SEQ ID NO: 284109 - DNA, 25 bp, Mus musculus
attgcttctataatggttctgctca

SEQ ID NO: 284110 - DNA, 25 bp, Mus musculus
attgcttctatattggttctgctca

SEQ ID NO: 284111 - DNA, 25 bp, Mus musculus
attgcttctcaaacctttccttcga

SEQ ID NO: 284112 - DNA, 25 bp, Mus musculus
attgcttctcaatcctttccttcga

SEQ ID NO: 284113 - DNA, 25 bp, Mus musculus
attgcttctcgtactttcggtttgt

SEQ ID NO: 284114 - DNA, 25 bp, Mus musculus
attgcttctcgttctttcggtttgt

SEQ ID NO: 284115 - DNA, 25 bp, Mus musculus
attgcttctctcactctggagggcc

SEQ ID NO: 284116 - DNA, 25 bp, Mus musculus
attgcttctctctctctggagggcc

SEQ ID NO: 284117 - DNA, 25 bp, Mus musculus
attgcttctggaattgagcaaccag

SEQ ID NO: 284118 - DNA, 25 bp, Mus musculus
attgcttctggatttgagcaaccag

SEQ ID NO: 284119 - DNA, 25 bp, Mus musculus
attgcttcttgtcttttactgtcag

SEQ ID NO: 284120 - DNA, 25 bp, Mus musculus
attgcttcttgtgttttactgtcag

SEQ ID NO: 284121 - DNA, 25 bp, Mus musculus
attgcttctttcagttgtctctgct

SEQ ID NO: 284122 - DNA, 25 bp, Mus musculus
attgcttctttctgttgtctctgct

SEQ ID NO: 284123 - DNA, 25 bp, Mus musculus
attgcttgacataccttgttgtcac

SEQ ID NO: 284124 - DNA, 25 bp, Mus musculus
attgcttgacattccttgttgtcac

SEQ ID NO: 284125 - DNA, 25 bp, Mus musculus
attgcttgagtgacatgctgaggga

SEQ ID NO: 284126 - DNA, 25 bp, Mus musculus
attgcttgagtgtcatgctgaggga

SEQ ID NO: 284127 - DNA, 25 bp, Mus musculus
attgcttgcccgctgtatacacagt

SEQ ID NO: 284128 - DNA, 25 bp, Mus musculus
attgcttgcccggtgtatacacagt

SEQ ID NO: 284129 - DNA, 25 bp, Mus musculus
attgcttgctcccttctacagtcag

SEQ ID NO: 284130 - DNA, 25 bp, Mus musculus
attgcttgctccgttctacagtcag

SEQ ID NO: 284131 - DNA, 25 bp, Mus musculus
attgcttggaacatgaaccacttta

SEQ ID NO: 284132 - DNA, 25 bp, Mus musculus
attgcttggaacttgaaccacttta

SEQ ID NO: 284133 - DNA, 25 bp, Mus musculus
attgcttggcctctttgaggtgcct

SEQ ID NO: 284134 - DNA, 25 bp, Mus musculus
attgcttggcctgtttgaggtgcct

SEQ ID NO: 284135 - DNA, 25 bp, Mus musculus
attgcttgtaatctggtgttgaaca

SEQ ID NO: 284136 - DNA, 25 bp, Mus musculus
attgcttgtaatgtggtgttgaaca

SEQ ID NO: 284137 - DNA, 25 bp, Mus musculus
attgcttgtatgaagatgctctttc

SEQ ID NO: 284138 - DNA, 25 bp, Mus musculus
attgcttgtatgtagatgctctttc

SEQ ID NO: 284139 - DNA, 25 bp, Mus musculus
attgcttgtgcaacctactgtttta

SEQ ID NO: 284140 - DNA, 25 bp, Mus musculus
attgcttgtgcatcctactgtttta

SEQ ID NO: 284141 - DNA, 25 bp, Mus musculus
attgcttgtgccagtatctaccttg

SEQ ID NO: 284142 - DNA, 25 bp, Mus musculus
attgcttgtgcctgtatctaccttg

SEQ ID NO: 284143 - DNA, 25 bp, Mus musculus
attgcttgttccagcatcttggtga

SEQ ID NO: 284144 - DNA, 25 bp, Mus musculus
attgcttgttcctgcatcttggtga

SEQ ID NO: 284145 - DNA, 25 bp, Mus musculus
attgcttgttctcccctataaagta

SEQ ID NO: 284146 - DNA, 25 bp, Mus musculus
attgcttgttctgccctataaagta

SEQ ID NO: 284147 - DNA, 25 bp, Mus musculus
attgcttgtttacatccatcccaca

SEQ ID NO: 284148 - DNA, 25 bp, Mus musculus
attgcttgtttagatccatcccaca

SEQ ID NO: 284149 - DNA, 25 bp, Mus musculus
attgctttacccatagcctattcaa

SEQ ID NO: 284150 - DNA, 25 bp, Mus musculus
attgctttacccttagcctattcaa

SEQ ID NO: 284151 - DNA, 25 bp, Mus musculus
attgctttactgaaacagctctgtt

SEQ ID NO: 284152 - DNA, 25 bp, Mus musculus
attgctttactgtaacagctctgtt

SEQ ID NO: 284153 - DNA, 25 bp, Mus musculus
attgctttattgactaatgcgtagt

SEQ ID NO: 284154 - DNA, 25 bp, Mus musculus
attgctttattgtctaatgcgtagt

SEQ ID NO: 284155 - DNA, 25 bp, Mus musculus
attgctttcaaaactcaaggccagc

SEQ ID NO: 284156 - DNA, 25 bp, Mus musculus
attgctttcaaatctcaaggccagc

SEQ ID NO: 284157 - DNA, 25 bp, Mus musculus
attgctttcacacctgcgtttcttg

SEQ ID NO: 284158 - DNA, 25 bp, Mus musculus
attgctttcacagctgcgtttcttg

SEQ ID NO: 284159 - DNA, 25 bp, Mus musculus
attgctttcagcctgctgcctaaat

SEQ ID NO: 284160 - DNA, 25 bp, Mus musculus
attgctttcagcgtgctgcctaaat

SEQ ID NO: 284161 - DNA, 25 bp, Mus musculus
attgctttcatcatggatatttttt

SEQ ID NO: 284162 - DNA, 25 bp, Mus musculus
attgctttcatcttggatatttttt

SEQ ID NO: 284163 - DNA, 25 bp, Mus musculus
attgctttcattctctggctctgaa

SEQ ID NO: 284164 - DNA, 25 bp, Mus musculus
attgctttcattgtctggctctgaa

SEQ ID NO: 284165 - DNA, 25 bp, Mus musculus
attgctttctgacgtgtgtatgtgt

SEQ ID NO: 284166 - DNA, 25 bp, Mus musculus
attgctttctgaggtgtgtatgtgt

SEQ ID NO: 284167 - DNA, 25 bp, Mus musculus
attgctttgaaacctggagctgaag

SEQ ID NO: 284168 - DNA, 25 bp, Mus musculus
attgctttgaaagctggagctgaag

SEQ ID NO: 284169 - DNA, 25 bp, Mus musculus
attgctttgactctgaccatgggca

SEQ ID NO: 284170 - DNA, 25 bp, Mus musculus
attgctttgactgtgaccatgggca

SEQ ID NO: 284171 - DNA, 25 bp, Mus musculus
attgctttgatcatctcgctctgtg

SEQ ID NO: 284172 - DNA, 25 bp, Mus musculus
attgctttgatcttctcgctctgtg

SEQ ID NO: 284173 - DNA, 25 bp, Mus musculus
attgctttgctgctttcatatttat

SEQ ID NO: 284174 - DNA, 25 bp, Mus musculus
attgctttgctggtttcatatttat

SEQ ID NO: 284175 - DNA, 25 bp, Mus musculus
attgctttggcgctggctctgacca

SEQ ID NO: 284176 - DNA, 25 bp, Mus musculus
attgctttggcggtggctctgacca

SEQ ID NO: 284177 - DNA, 25 bp, Mus musculus
attgctttgtatctttcacgttgtt

SEQ ID NO: 284178 - DNA, 25 bp, Mus musculus
attgctttgtatgtttcacgttgtt

SEQ ID NO: 284179 - DNA, 25 bp, Mus musculus
attgcttttaacagccagccaggag

SEQ ID NO: 284180 - DNA, 25 bp, Mus musculus
attgcttttaactgccagccaggag

SEQ ID NO: 284181 - DNA, 25 bp, Mus musculus
attgcttttactctggtctgtggcc

SEQ ID NO: 284182 - DNA, 25 bp, Mus musculus
attgcttttactgtggtctgtggcc

SEQ ID NO: 284183 - DNA, 25 bp, Mus musculus
attgcttttcatcgcagcaggtgca

SEQ ID NO: 284184 - DNA, 25 bp, Mus musculus
attgcttttcatggcagcaggtgca

SEQ ID NO: 284185 - DNA, 25 bp, Mus musculus
attgcttttctcagcggtgactctt

SEQ ID NO: 284186 - DNA, 25 bp, Mus musculus
attgcttttctctgcggtgactctt

SEQ ID NO: 284187 - DNA, 25 bp, Mus musculus
attgcttttgtgcttgttctcatac

SEQ ID NO: 284188 - DNA, 25 bp, Mus musculus
attgcttttgtggttgttctcatac

SEQ ID NO: 284189 - DNA, 25 bp, Mus musculus
attgcttttgttcagatggcatcac

SEQ ID NO: 284190 - DNA, 25 bp, Mus musculus
attgcttttgttgagatggcatcac

SEQ ID NO: 284191 - DNA, 25 bp, Mus musculus
attgctttttctcaagctcctctca

SEQ ID NO: 284192 - DNA, 25 bp, Mus musculus
attgctttttctgaagctcctctca

SEQ ID NO: 284193 - DNA, 25 bp, Mus musculus
attgctttttgtaggccatggctta

SEQ ID NO: 284194 - DNA, 25 bp, Mus musculus
attgctttttgttggccatggctta

SEQ ID NO: 284195 - DNA, 25 bp, Mus musculus
attggaaaacttcaggcccactcac

SEQ ID NO: 284196 - DNA, 25 bp, Mus musculus
attggaaaacttgaggcccactcac

SEQ ID NO: 284197 - DNA, 25 bp, Mus musculus
attggaaacctacctaagagtgctt

SEQ ID NO: 284198 - DNA, 25 bp, Mus musculus
attggaaacctagctaagagtgctt

SEQ ID NO: 284199 - DNA, 25 bp, Mus musculus
attggaaacctcactgtccagtggg

SEQ ID NO: 284200 - DNA, 25 bp, Mus musculus
attggaaacctctctgtccagtggg

SEQ ID NO: 284201 - DNA, 25 bp, Mus musculus
attggaaaccttctcggccatcttt

SEQ ID NO: 284202 - DNA, 25 bp, Mus musculus
attggaaaccttgtcggccatcttt

SEQ ID NO: 284203 - DNA, 25 bp, Mus musculus
attggaaacgatctgggccactctc

SEQ ID NO: 284204 - DNA, 25 bp, Mus musculus
attggaaacgatgtgggccactctc

SEQ ID NO: 284205 - DNA, 25 bp, Mus musculus
attggaaacggcagcacggagtcgc

SEQ ID NO: 284206 - DNA, 25 bp, Mus musculus
attggaaacggctgcacggagtcgc

SEQ ID NO: 284207 - DNA, 25 bp, Mus musculus
attggaaactgtctctcctcgttca

SEQ ID NO: 284208 - DNA, 25 bp, Mus musculus
attggaaactgtgtctcctcgttca

SEQ ID NO: 284209 - DNA, 25 bp, Mus musculus
attggaaagactctcctgcttcata

SEQ ID NO: 284210 - DNA, 25 bp, Mus musculus
attggaaagactgtcctgcttcata

SEQ ID NO: 284211 - DNA, 25 bp, Mus musculus
attggaaaggccctcaggactcaaa

SEQ ID NO: 284212 - DNA, 25 bp, Mus musculus
attggaaaggccgtcaggactcaaa

SEQ ID NO: 284213 - DNA, 25 bp, Mus musculus
attggaaagtggactcctgccatcc

SEQ ID NO: 284214 - DNA, 25 bp, Mus musculus
attggaaagtggtctcctgccatcc

SEQ ID NO: 284215 - DNA, 25 bp, Mus musculus
attggaaattgtaggctattctggt

SEQ ID NO: 284216 - DNA, 25 bp, Mus musculus
attggaaattgttggctattctggt

SEQ ID NO: 284217 - DNA, 25 bp, Mus musculus
attggaacagtgaacccgtcccatc

SEQ ID NO: 284218 - DNA, 25 bp, Mus musculus
attggaacagtgtacccgtcccatc

SEQ ID NO: 284219 - DNA, 25 bp, Mus musculus
attggaaccctactacacagcttcg

SEQ ID NO: 284220 - DNA, 25 bp, Mus musculus
attggaaccctagtacacagcttcg

SEQ ID NO: 284221 - DNA, 25 bp, Mus musculus
attggaaccgtcatcgaggcctggc

SEQ ID NO: 284222 - DNA, 25 bp, Mus musculus
attggaaccgtcttcgaggcctggc

SEQ ID NO: 284223 - DNA, 25 bp, Mus musculus
attggaacctccaactggtctggaa

SEQ ID NO: 284224 - DNA, 25 bp, Mus musculus
attggaacctccatgggcttcaatt

SEQ ID NO: 284225 - DNA, 25 bp, Mus musculus
attggaacctcctactggtctggaa

SEQ ID NO: 284226 - DNA, 25 bp, Mus musculus
attggaacctccttgggcttcaatt

SEQ ID NO: 284227 - DNA, 25 bp, Mus musculus
attggaacctggaagcttcttctca

SEQ ID NO: 284228 - DNA, 25 bp, Mus musculus
attggaacctggtagcttcttctca

SEQ ID NO: 284229 - DNA, 25 bp, Mus musculus
attggaactaacaccctctctgatc

SEQ ID NO: 284230 - DNA, 25 bp, Mus musculus
attggaactaactccctctctgatc

SEQ ID NO: 284231 - DNA, 25 bp, Mus musculus
attggaactcacaacttcaaactca

SEQ ID NO: 284232 - DNA, 25 bp, Mus musculus
attggaactcactacttcaaactca

SEQ ID NO: 284233 - DNA, 25 bp, Mus musculus
attggaactcttaatgaaacacttg

SEQ ID NO: 284234 - DNA, 25 bp, Mus musculus
attggaactctttatgaaacacttg

SEQ ID NO: 284235 - DNA, 25 bp, Mus musculus
attggaacttggcagcctccatcac

SEQ ID NO: 284236 - DNA, 25 bp, Mus musculus
attggaacttgggagcctccatcac

SEQ ID NO: 284237 - DNA, 25 bp, Mus musculus
attggaagaagtcgccgcctctctt

SEQ ID NO: 284238 - DNA, 25 bp, Mus musculus
attggaagaagtggccgcctctctt

SEQ ID NO: 284239 - DNA, 25 bp, Mus musculus
attggaagacttcgtaccaccacca

SEQ ID NO: 284240 - DNA, 25 bp, Mus musculus
attggaagacttggtaccaccacca

SEQ ID NO: 284241 - DNA, 25 bp, Mus musculus
attggaagatgcctgcgagcacctg

SEQ ID NO: 284242 - DNA, 25 bp, Mus musculus
attggaagatgcgtgcgagcacctg

SEQ ID NO: 284243 - DNA, 25 bp, Mus musculus
attggaagccataccaccattgcat

SEQ ID NO: 284244 - DNA, 25 bp, Mus musculus
attggaagccattccaccattgcat

SEQ ID NO: 284245 - DNA, 25 bp, Mus musculus
attggaagcctcaaggctgagccct

SEQ ID NO: 284246 - DNA, 25 bp, Mus musculus
attggaagcctctaggctgagccct

SEQ ID NO: 284247 - DNA, 25 bp, Mus musculus
attggaagtcatacctcggttgcac

SEQ ID NO: 284248 - DNA, 25 bp, Mus musculus
attggaagtcattcctcggttgcac

SEQ ID NO: 284249 - DNA, 25 bp, Mus musculus
attggaagttccagaagcaccgtcc

SEQ ID NO: 284250 - DNA, 25 bp, Mus musculus
attggaagttcctgaagcaccgtcc

SEQ ID NO: 284251 - DNA, 25 bp, Mus musculus
attggaatcttcctgcccataagtg

SEQ ID NO: 284252 - DNA, 25 bp, Mus musculus
attggaatcttcgtgcccataagtg

SEQ ID NO: 284253 - DNA, 25 bp, Mus musculus
attggaatgacaacttctgccagca

SEQ ID NO: 284254 - DNA, 25 bp, Mus musculus
attggaatgacatcttctgccagca

SEQ ID NO: 284255 - DNA, 25 bp, Mus musculus
attggaattcatctttcctctgaaa

SEQ ID NO: 284256 - DNA, 25 bp, Mus musculus
attggaattcatgtttcctctgaaa

SEQ ID NO: 284257 - DNA, 25 bp, Mus musculus
attggaattgtgacacagccgcagt

SEQ ID NO: 284258 - DNA, 25 bp, Mus musculus
attggaattgtgtcacagccgcagt

SEQ ID NO: 284259 - DNA, 25 bp, Mus musculus
attggaatttctcagccttggcatt

SEQ ID NO: 284260 - DNA, 25 bp, Mus musculus
attggaatttctgagccttggcatt

SEQ ID NO: 284261 - DNA, 25 bp, Mus musculus
attggacacaccagctacttcagac

SEQ ID NO: 284262 - DNA, 25 bp, Mus musculus
attggacacacccaggctgtagaga

SEQ ID NO: 284263 - DNA, 25 bp, Mus musculus
attggacacaccgaggctgtagaga

SEQ ID NO: 284264 - DNA, 25 bp, Mus musculus
attggacacacctgctacttcagac

SEQ ID NO: 284265 - DNA, 25 bp, Mus musculus
attggacaccacattcactactttt

SEQ ID NO: 284266 - DNA, 25 bp, Mus musculus
attggacaccactttcactactttt

SEQ ID NO: 284267 - DNA, 25 bp, Mus musculus
attggacagggcaacagttgttttc

SEQ ID NO: 284268 - DNA, 25 bp, Mus musculus
attggacagggctacagttgttttc

SEQ ID NO: 284269 - DNA, 25 bp, Mus musculus
attggacagttaagccttctgccct

SEQ ID NO: 284270 - DNA, 25 bp, Mus musculus
attggacagttatgccttctgccct

SEQ ID NO: 284271 - DNA, 25 bp, Mus musculus
attggacatataaccatgggagtga

SEQ ID NO: 284272 - DNA, 25 bp, Mus musculus
attggacatatatccatgggagtga

SEQ ID NO: 284273 - DNA, 25 bp, Mus musculus
attggacatcccagtacaccatggt

SEQ ID NO: 284274 - DNA, 25 bp, Mus musculus
attggacatccctgtacaccatggt

SEQ ID NO: 284275 - DNA, 25 bp, Mus musculus
attggacatgcacctttccttaggg

SEQ ID NO: 284276 - DNA, 25 bp, Mus musculus
attggacatgcagctttccttaggg

SEQ ID NO: 284277 - DNA, 25 bp, Mus musculus
attggaccacctactgattctgttt

SEQ ID NO: 284278 - DNA, 25 bp, Mus musculus
attggaccaccttctgattctgttt

SEQ ID NO: 284279 - DNA, 25 bp, Mus musculus
attggacccagaaaacacagtttgc

SEQ ID NO: 284280 - DNA, 25 bp, Mus musculus
attggacccagataacacagtttgc

SEQ ID NO: 284281 - DNA, 25 bp, Mus musculus
attggacccgaaaactttatgataa

SEQ ID NO: 284282 - DNA, 25 bp, Mus musculus
attggacccgaatactttatgataa

SEQ ID NO: 284283 - DNA, 25 bp, Mus musculus
attggacccggaccaagcgtgtctt

SEQ ID NO: 284284 - DNA, 25 bp, Mus musculus
attggacccggagcaagcgtgtctt

SEQ ID NO: 284285 - DNA, 25 bp, Mus musculus
attggaccctaacgtggtatgtgtt

SEQ ID NO: 284286 - DNA, 25 bp, Mus musculus
attggaccctaaggtggtatgtgtt

SEQ ID NO: 284287 - DNA, 25 bp, Mus musculus
attggaccctgcctcagcagagctc

SEQ ID NO: 284288 - DNA, 25 bp, Mus musculus
attggaccctgcgtcagcagagctc

SEQ ID NO: 284289 - DNA, 25 bp, Mus musculus
attggaccctgtctcacaaaccctt

SEQ ID NO: 284290 - DNA, 25 bp, Mus musculus
attggaccctgtgtcacaaaccctt

SEQ ID NO: 284291 - DNA, 25 bp, Mus musculus
attggaccgctgatctggttgagcc

SEQ ID NO: 284292 - DNA, 25 bp, Mus musculus
attggaccgctgttctggttgagcc

SEQ ID NO: 284293 - DNA, 25 bp, Mus musculus
attggacctaatcttacagctacta

SEQ ID NO: 284294 - DNA, 25 bp, Mus musculus
attggacctaatgttacagctacta

SEQ ID NO: 284295 - DNA, 25 bp, Mus musculus
attggacctactcaaggccttcctt

SEQ ID NO: 284296 - DNA, 25 bp, Mus musculus
attggacctactgaaggccttcctt

SEQ ID NO: 284297 - DNA, 25 bp, Mus musculus
attggacctcttaattcagtgggat

SEQ ID NO: 284298 - DNA, 25 bp, Mus musculus
attggacctctttattcagtgggat

SEQ ID NO: 284299 - DNA, 25 bp, Mus musculus
attggacctgatcgccgactgacac

SEQ ID NO: 284300 - DNA, 25 bp, Mus musculus
attggacctgatggccgactgacac

SEQ ID NO: 284301 - DNA, 25 bp, Mus musculus
attggacctgggacatcaactctgc

SEQ ID NO: 284302 - DNA, 25 bp, Mus musculus
attggacctgggtcatcaactctgc

SEQ ID NO: 284303 - DNA, 25 bp, Mus musculus
attggacgctgcctacctataatgc

SEQ ID NO: 284304 - DNA, 25 bp, Mus musculus
attggacgctgcgtacctataatgc

SEQ ID NO: 284305 - DNA, 25 bp, Mus musculus
attggacgtcgtcccttcagccagg

SEQ ID NO: 284306 - DNA, 25 bp, Mus musculus
attggacgtcgtgccttcagccagg

SEQ ID NO: 284307 - DNA, 25 bp, Mus musculus
attggacgtggtatgctaacataca

SEQ ID NO: 284308 - DNA, 25 bp, Mus musculus
attggacgtggtttgctaacataca

SEQ ID NO: 284309 - DNA, 25 bp, Mus musculus
attggactacaaactagccccggga

SEQ ID NO: 284310 - DNA, 25 bp, Mus musculus
attggactacaatctagccccggga

SEQ ID NO: 284311 - DNA, 25 bp, Mus musculus
attggactatcaacagcttctctgt

SEQ ID NO: 284312 - DNA, 25 bp, Mus musculus
attggactatcatcagcttctctgt

SEQ ID NO: 284313 - DNA, 25 bp, Mus musculus
attggactcataatgcctgggtctc

SEQ ID NO: 284314 - DNA, 25 bp, Mus musculus
attggactcatattgcctgggtctc

SEQ ID NO: 284315 - DNA, 25 bp, Mus musculus
attggactcttgctctttctagctc

SEQ ID NO: 284316 - DNA, 25 bp, Mus musculus
attggactcttggtctttctagctc

SEQ ID NO: 284317 - DNA, 25 bp, Mus musculus
attggactgaaacacctaggacctt

SEQ ID NO: 284318 - DNA, 25 bp, Mus musculus
attggactgaaagacctaggacctt

SEQ ID NO: 284319 - DNA, 25 bp, Mus musculus
attggactgagcagcgacacaggct

SEQ ID NO: 284320 - DNA, 25 bp, Mus musculus
attggactgagctgcgacacaggct

SEQ ID NO: 284321 - DNA, 25 bp, Mus musculus
attggactgaggcttcaccctaccc

SEQ ID NO: 284322 - DNA, 25 bp, Mus musculus
attggactgagggttcaccctaccc

SEQ ID NO: 284323 - DNA, 25 bp, Mus musculus
attggactgtacctccctgggattg

SEQ ID NO: 284324 - DNA, 25 bp, Mus musculus
attggactgtacgtccctgggattg

SEQ ID NO: 284325 - DNA, 25 bp, Mus musculus
attggactgtccatgtcccaggcag

SEQ ID NO: 284326 - DNA, 25 bp, Mus musculus
attggactgtccttgtcccaggcag

SEQ ID NO: 284327 - DNA, 25 bp, Mus musculus
attggacttcaaccgtaaagcacga

SEQ ID NO: 284328 - DNA, 25 bp, Mus musculus
attggacttcaagcgtaaagcacga

SEQ ID NO: 284329 - DNA, 25 bp, Mus musculus
attggacttgtgactcccttgagat

SEQ ID NO: 284330 - DNA, 25 bp, Mus musculus
attggacttgtgtctcccttgagat

SEQ ID NO: 284331 - DNA, 25 bp, Mus musculus
attggactttttccacagctacacc

SEQ ID NO: 284332 - DNA, 25 bp, Mus musculus
attggactttttgcacagctacacc

SEQ ID NO: 284333 - DNA, 25 bp, Mus musculus
attggagaacaccaccgagctatcc

SEQ ID NO: 284334 - DNA, 25 bp, Mus musculus
attggagaacacgaccgagctatcc

SEQ ID NO: 284335 - DNA, 25 bp, Mus musculus
attggagacctgaactcaactgtta

SEQ ID NO: 284336 - DNA, 25 bp, Mus musculus
attggagacctgtactcaactgtta

SEQ ID NO: 284337 - DNA, 25 bp, Mus musculus
attggagaggctcagtcccacggca

SEQ ID NO: 284338 - DNA, 25 bp, Mus musculus
attggagaggctgagtcccacggca

SEQ ID NO: 284339 - DNA, 25 bp, Mus musculus
attggagagggcatgctgcccgact

SEQ ID NO: 284340 - DNA, 25 bp, Mus musculus
attggagagggcttgctgcccgact

SEQ ID NO: 284341 - DNA, 25 bp, Mus musculus
attggagagtatcgactccggaaca

SEQ ID NO: 284342 - DNA, 25 bp, Mus musculus
attggagagtatggactccggaaca

SEQ ID NO: 284343 - DNA, 25 bp, Mus musculus
attggagatcaccatgctgtcccag

SEQ ID NO: 284344 - DNA, 25 bp, Mus musculus
attggagatcacgatgctgtcccag

SEQ ID NO: 284345 - DNA, 25 bp, Mus musculus
attggagatccacacagttgtgaac

SEQ ID NO: 284346 - DNA, 25 bp, Mus musculus
attggagatccagacagttgtgaac

SEQ ID NO: 284347 - DNA, 25 bp, Mus musculus
attggagatctcacgcaggctgctg

SEQ ID NO: 284348 - DNA, 25 bp, Mus musculus
attggagatctctcgcaggctgctg

SEQ ID NO: 284349 - DNA, 25 bp, Mus musculus
attggagatgacagtgatcctagct

SEQ ID NO: 284350 - DNA, 25 bp, Mus musculus
attggagatgactgtgatcctagct

SEQ ID NO: 284351 - DNA, 25 bp, Mus musculus
attggagcacttcaacagcactgac

SEQ ID NO: 284352 - DNA, 25 bp, Mus musculus
attggagcacttgaacagcactgac

SEQ ID NO: 284353 - DNA, 25 bp, Mus musculus
attggagcagcaagcacagaagtca

SEQ ID NO: 284354 - DNA, 25 bp, Mus musculus
attggagcagcatgcacagaagtca

SEQ ID NO: 284355 - DNA, 25 bp, Mus musculus
attggagcaggcctactgtgcgctc

SEQ ID NO: 284356 - DNA, 25 bp, Mus musculus
attggagcaggcgtactgtgcgctc

SEQ ID NO: 284357 - DNA, 25 bp, Mus musculus
attggagcagtgaagaacccgagga

SEQ ID NO: 284358 - DNA, 25 bp, Mus musculus
attggagcagtgtagaacccgagga

SEQ ID NO: 284359 - DNA, 25 bp, Mus musculus
attggagcccagcactggacttgag

SEQ ID NO: 284360 - DNA, 25 bp, Mus musculus
attggagcccaggactggacttgag

SEQ ID NO: 284361 - DNA, 25 bp, Mus musculus
attggagcccctctgctaggaagct

SEQ ID NO: 284362 - DNA, 25 bp, Mus musculus
attggagcccctgtgctaggaagct

SEQ ID NO: 284363 - DNA, 25 bp, Mus musculus
attggagcccggaaaccacactatg

SEQ ID NO: 284364 - DNA, 25 bp, Mus musculus
attggagcccggtaaccacactatg

SEQ ID NO: 284365 - DNA, 25 bp, Mus musculus
attggagccctcaatggcatctttg

SEQ ID NO: 284366 - DNA, 25 bp, Mus musculus
attggagccctctatggcatctttg

SEQ ID NO: 284367 - DNA, 25 bp, Mus musculus
attggagcctttcgcatttcctttc

SEQ ID NO: 284368 - DNA, 25 bp, Mus musculus
attggagcctttggcatttcctttc

SEQ ID NO: 284369 - DNA, 25 bp, Mus musculus
attggagctacgagccattcagctt

SEQ ID NO: 284370 - DNA, 25 bp, Mus musculus
attggagctacgtgccattcagctt

SEQ ID NO: 284371 - DNA, 25 bp, Mus musculus
attggagctattagtaattactgta

SEQ ID NO: 284372 - DNA, 25 bp, Mus musculus
attggagctatttgtaattactgta

SEQ ID NO: 284373 - DNA, 25 bp, Mus musculus
attggagctgatagcctcatcgggc

SEQ ID NO: 284374 - DNA, 25 bp, Mus musculus
attggagctgattgcctcatcgggc

SEQ ID NO: 284375 - DNA, 25 bp, Mus musculus
attggagctttcaggttattaggta

SEQ ID NO: 284376 - DNA, 25 bp, Mus musculus
attggagctttctggttattaggta

SEQ ID NO: 284377 - DNA, 25 bp, Mus musculus
attggaggaattctctcccaactgc

SEQ ID NO: 284378 - DNA, 25 bp, Mus musculus
attggaggaattgtctcccaactgc

SEQ ID NO: 284379 - DNA, 25 bp, Mus musculus
attggaggccacagcagccggataa

SEQ ID NO: 284380 - DNA, 25 bp, Mus musculus
attggaggccacattaaagccattg

SEQ ID NO: 284381 - DNA, 25 bp, Mus musculus
attggaggccactgcagccggataa

SEQ ID NO: 284382 - DNA, 25 bp, Mus musculus
attggaggccactttaaagccattg

SEQ ID NO: 284383 - DNA, 25 bp, Mus musculus
attggaggcctcaggcaggagccca

SEQ ID NO: 284384 - DNA, 25 bp, Mus musculus
attggaggcctctggcaggagccca

SEQ ID NO: 284385 - DNA, 25 bp, Mus musculus
attggagggcacacttcgaagcatt

SEQ ID NO: 284386 - DNA, 25 bp, Mus musculus
attggagggcactcttcgaagcatt

SEQ ID NO: 284387 - DNA, 25 bp, Mus musculus
attggagggctaataacagacattt

SEQ ID NO: 284388 - DNA, 25 bp, Mus musculus
attggagggctattaacagacattt

SEQ ID NO: 284389 - DNA, 25 bp, Mus musculus
attggagggtacagagcctcagaac

SEQ ID NO: 284390 - DNA, 25 bp, Mus musculus
attggagggtactgagcctcagaac

SEQ ID NO: 284391 - DNA, 25 bp, Mus musculus
attggagtacaaatcatatgaaatg

SEQ ID NO: 284392 - DNA, 25 bp, Mus musculus
attggagtacaattcatatgaaatg

SEQ ID NO: 284393 - DNA, 25 bp, Mus musculus
attggagtcctcaagtttgcctttc

SEQ ID NO: 284394 - DNA, 25 bp, Mus musculus
attggagtcctctagtttgcctttc

SEQ ID NO: 284395 - DNA, 25 bp, Mus musculus
attggagtggcccagatctttccat

SEQ ID NO: 284396 - DNA, 25 bp, Mus musculus
attggagtggccgagatctttccat

SEQ ID NO: 284397 - DNA, 25 bp, Mus musculus
attggagttactctcctctgtaaaa

SEQ ID NO: 284398 - DNA, 25 bp, Mus musculus
attggagttactgtcctctgtaaaa

SEQ ID NO: 284399 - DNA, 25 bp, Mus musculus
attggagtttgtattctctgccagt

SEQ ID NO: 284400 - DNA, 25 bp, Mus musculus
attggagtttgttttctctgccagt

SEQ ID NO: 284401 - DNA, 25 bp, Mus musculus
attggataagtgcttgctgccccgg

SEQ ID NO: 284402 - DNA, 25 bp, Mus musculus
attggataagtggttgctgccccgg

SEQ ID NO: 284403 - DNA, 25 bp, Mus musculus
attggataccctcagtagttgttct

SEQ ID NO: 284404 - DNA, 25 bp, Mus musculus
attggataccctgagtagttgttct

SEQ ID NO: 284405 - DNA, 25 bp, Mus musculus
attggatagcatcaactctccctcc

SEQ ID NO: 284406 - DNA, 25 bp, Mus musculus
attggatagcatgaactctccctcc

SEQ ID NO: 284407 - DNA, 25 bp, Mus musculus
attggatatgcaatcttcacctaga

SEQ ID NO: 284408 - DNA, 25 bp, Mus musculus
attggatatgcattcttcacctaga

SEQ ID NO: 284409 - DNA, 25 bp, Mus musculus
attggatatggtaatgttgattaaa

SEQ ID NO: 284410 - DNA, 25 bp, Mus musculus
attggatatggttatgttgattaaa

SEQ ID NO: 284411 - DNA, 25 bp, Mus musculus
attggatatgtgacccgaaagccct

SEQ ID NO: 284412 - DNA, 25 bp, Mus musculus
attggatatgtgtcccgaaagccct

SEQ ID NO: 284413 - DNA, 25 bp, Mus musculus
attggatcacatctctcctaggaca

SEQ ID NO: 284414 - DNA, 25 bp, Mus musculus
attggatcacatgtctcctaggaca

SEQ ID NO: 284415 - DNA, 25 bp, Mus musculus
attggatcagaacctgcctagcttc

SEQ ID NO: 284416 - DNA, 25 bp, Mus musculus
attggatcagaagctgcctagcttc

SEQ ID NO: 284417 - DNA, 25 bp, Mus musculus
attggatcagtccatagctacccac

SEQ ID NO: 284418 - DNA, 25 bp, Mus musculus
attggatcagtcgatagctacccac

SEQ ID NO: 284419 - DNA, 25 bp, Mus musculus
attggatccttcacagtactcatga

SEQ ID NO: 284420 - DNA, 25 bp, Mus musculus
attggatccttctcagtactcatga

SEQ ID NO: 284421 - DNA, 25 bp, Mus musculus
attggatctgatctgaccctcacct

SEQ ID NO: 284422 - DNA, 25 bp, Mus musculus
attggatctgatgtgaccctcacct

SEQ ID NO: 284423 - DNA, 25 bp, Mus musculus
attggatcttcaacttagacatttt

SEQ ID NO: 284424 - DNA, 25 bp, Mus musculus
attggatcttcatcttagacatttt

SEQ ID NO: 284425 - DNA, 25 bp, Mus musculus
attggatgagatccactgcctcctc

SEQ ID NO: 284426 - DNA, 25 bp, Mus musculus
attggatgagatctgccaagatgaa

SEQ ID NO: 284427 - DNA, 25 bp, Mus musculus
attggatgagatgcactgcctcctc

SEQ ID NO: 284428 - DNA, 25 bp, Mus musculus
attggatgagatgtgccaagatgaa

SEQ ID NO: 284429 - DNA, 25 bp, Mus musculus
attggatgcatcaagtagtgtatac

SEQ ID NO: 284430 - DNA, 25 bp, Mus musculus
attggatgcatctagtagtgtatac

SEQ ID NO: 284431 - DNA, 25 bp, Mus musculus
attggatgcccaactagtggttatc

SEQ ID NO: 284432 - DNA, 25 bp, Mus musculus
attggatgcccatctagtggttatc

SEQ ID NO: 284433 - DNA, 25 bp, Mus musculus
attggatgctcaaagggtttctggc

SEQ ID NO: 284434 - DNA, 25 bp, Mus musculus
attggatgctcatagggtttctggc

SEQ ID NO: 284435 - DNA, 25 bp, Mus musculus
attggatggaacatgaggactctca

SEQ ID NO: 284436 - DNA, 25 bp, Mus musculus
attggatggaacttgaggactctca

SEQ ID NO: 284437 - DNA, 25 bp, Mus musculus
attggatggtccataaaatgtattc

SEQ ID NO: 284438 - DNA, 25 bp, Mus musculus
attggatggtccttaaaatgtattc

SEQ ID NO: 284439 - DNA, 25 bp, Mus musculus
attggatggtgcacccacacttaga

SEQ ID NO: 284440 - DNA, 25 bp, Mus musculus
attggatggtgctcccacacttaga

SEQ ID NO: 284441 - DNA, 25 bp, Mus musculus
attggatgtcttccttgatcattgt

SEQ ID NO: 284442 - DNA, 25 bp, Mus musculus
attggatgtcttgcttgatcattgt

SEQ ID NO: 284443 - DNA, 25 bp, Mus musculus
attggatgtgtgatgtgtacccctg

SEQ ID NO: 284444 - DNA, 25 bp, Mus musculus
attggatgtgtgttgtgtacccctg

SEQ ID NO: 284445 - DNA, 25 bp, Mus musculus
attggatgttaactgaattcacgtg

SEQ ID NO: 284446 - DNA, 25 bp, Mus musculus
attggatgttaagtgaattcacgtg

SEQ ID NO: 284447 - DNA, 25 bp, Mus musculus
attggattcccaagctgataatata

SEQ ID NO: 284448 - DNA, 25 bp, Mus musculus
attggattcccatgctgataatata

SEQ ID NO: 284449 - DNA, 25 bp, Mus musculus
attggattgctgattccgtctgtca

SEQ ID NO: 284450 - DNA, 25 bp, Mus musculus
attggattgctgtttccgtctgtca

SEQ ID NO: 284451 - DNA, 25 bp, Mus musculus
attggattggttcccctggcttact

SEQ ID NO: 284452 - DNA, 25 bp, Mus musculus
attggattggttgccctggcttact

SEQ ID NO: 284453 - DNA, 25 bp, Mus musculus
attggattgtacagcatgttctctt

SEQ ID NO: 284454 - DNA, 25 bp, Mus musculus
attggattgtactgcatgttctctt

SEQ ID NO: 284455 - DNA, 25 bp, Mus musculus
attggattgttcagcagatgccact

SEQ ID NO: 284456 - DNA, 25 bp, Mus musculus
attggattgttctgcagatgccact

SEQ ID NO: 284457 - DNA, 25 bp, Mus musculus
attggcaacaagacccagcggtgat

SEQ ID NO: 284458 - DNA, 25 bp, Mus musculus
attggcaacaagtcccagcggtgat

SEQ ID NO: 284459 - DNA, 25 bp, Mus musculus
attggcaacagcaccgctattcagg

SEQ ID NO: 284460 - DNA, 25 bp, Mus musculus
attggcaacagctccgctattcagg

SEQ ID NO: 284461 - DNA, 25 bp, Mus musculus
attggcaaccagatcatctgcgctg

SEQ ID NO: 284462 - DNA, 25 bp, Mus musculus
attggcaaccagttcatctgcgctg

SEQ ID NO: 284463 - DNA, 25 bp, Mus musculus
attggcaacctgatctcttctaaga

SEQ ID NO: 284464 - DNA, 25 bp, Mus musculus
attggcaacctgttctcttctaaga

SEQ ID NO: 284465 - DNA, 25 bp, Mus musculus
attggcaactctactgggctgttac

SEQ ID NO: 284466 - DNA, 25 bp, Mus musculus
attggcaactcttctgggctgttac

SEQ ID NO: 284467 - DNA, 25 bp, Mus musculus
attggcaagataagctcagagacac

SEQ ID NO: 284468 - DNA, 25 bp, Mus musculus
attggcaagatatgctcagagacac

SEQ ID NO: 284469 - DNA, 25 bp, Mus musculus
attggcaatgagcaaatagcgtatc

SEQ ID NO: 284470 - DNA, 25 bp, Mus musculus
attggcaatgaggaaatagcgtatc

SEQ ID NO: 284471 - DNA, 25 bp, Mus musculus
attggcaatgcccaattaccctcca

SEQ ID NO: 284472 - DNA, 25 bp, Mus musculus
attggcaatgccgaattaccctcca

SEQ ID NO: 284473 - DNA, 25 bp, Mus musculus
attggcaatgtaacagggctccgtt

SEQ ID NO: 284474 - DNA, 25 bp, Mus musculus
attggcaatgtatcagggctccgtt

SEQ ID NO: 284475 - DNA, 25 bp, Mus musculus
attggcacagctcagtccagaatcc

SEQ ID NO: 284476 - DNA, 25 bp, Mus musculus
attggcacagctgagtccagaatcc

SEQ ID NO: 284477 - DNA, 25 bp, Mus musculus
attggcacagtgcaaaacttcctga

SEQ ID NO: 284478 - DNA, 25 bp, Mus musculus
attggcacagtgctagactcggttg

SEQ ID NO: 284479 - DNA, 25 bp, Mus musculus
attggcacagtggaaaacttcctga

SEQ ID NO: 284480 - DNA, 25 bp, Mus musculus
attggcacagtggtagactcggttg

SEQ ID NO: 284481 - DNA, 25 bp, Mus musculus
attggcacatataccccagcgtgtg

SEQ ID NO: 284482 - DNA, 25 bp, Mus musculus
attggcacatattccccagcgtgtg

SEQ ID NO: 284483 - DNA, 25 bp, Mus musculus
attggcacccagctagtttcagggc

SEQ ID NO: 284484 - DNA, 25 bp, Mus musculus
attggcacccaggtagtttcagggc

SEQ ID NO: 284485 - DNA, 25 bp, Mus musculus
attggcacctttcttttaggagaga

SEQ ID NO: 284486 - DNA, 25 bp, Mus musculus
attggcacctttgttttaggagaga

SEQ ID NO: 284487 - DNA, 25 bp, Mus musculus
attggcacggatctctacctacggc

SEQ ID NO: 284488 - DNA, 25 bp, Mus musculus
attggcacggatgtctacctacggc

SEQ ID NO: 284489 - DNA, 25 bp, Mus musculus
attggcacggccatctgtgtgatca

SEQ ID NO: 284490 - DNA, 25 bp, Mus musculus
attggcacggccttctgtgtgatca

SEQ ID NO: 284491 - DNA, 25 bp, Mus musculus
attggcactgttcttgggtttgctc

SEQ ID NO: 284492 - DNA, 25 bp, Mus musculus
attggcactgttgttgggtttgctc

SEQ ID NO: 284493 - DNA, 25 bp, Mus musculus
attggcacttagacagcctgaggtc

SEQ ID NO: 284494 - DNA, 25 bp, Mus musculus
attggcacttagtcagcctgaggtc

SEQ ID NO: 284495 - DNA, 25 bp, Mus musculus
attggcacttcacgcgggataggtc

SEQ ID NO: 284496 - DNA, 25 bp, Mus musculus
attggcacttcaggcgggataggtc

SEQ ID NO: 284497 - DNA, 25 bp, Mus musculus
attggcactttgaggagtcctgctg

SEQ ID NO: 284498 - DNA, 25 bp, Mus musculus
attggcactttgtggagtcctgctg

SEQ ID NO: 284499 - DNA, 25 bp, Mus musculus
attggcagaggcacacgtttcttct

SEQ ID NO: 284500 - DNA, 25 bp, Mus musculus
attggcagaggctcacgtttcttct

SEQ ID NO: 284501 - DNA, 25 bp, Mus musculus
attggcagattacctttctttgttt

SEQ ID NO: 284502 - DNA, 25 bp, Mus musculus
attggcagattagctttctttgttt

SEQ ID NO: 284503 - DNA, 25 bp, Mus musculus
attggcagcgtcataacacctgtaa

SEQ ID NO: 284504 - DNA, 25 bp, Mus musculus
attggcagcgtcttaacacctgtaa

SEQ ID NO: 284505 - DNA, 25 bp, Mus musculus
attggcagctcgatgatctggtacc

SEQ ID NO: 284506 - DNA, 25 bp, Mus musculus
attggcagctcgttgatctggtacc

SEQ ID NO: 284507 - DNA, 25 bp, Mus musculus
attggcaggactacctttgcctttt

SEQ ID NO: 284508 - DNA, 25 bp, Mus musculus
attggcaggacttcctttgcctttt

SEQ ID NO: 284509 - DNA, 25 bp, Mus musculus
attggcagggctacttcagggctag

SEQ ID NO: 284510 - DNA, 25 bp, Mus musculus
attggcagggcttcttcagggctag

SEQ ID NO: 284511 - DNA, 25 bp, Mus musculus
attggcaggtgcaccctaatgctta

SEQ ID NO: 284512 - DNA, 25 bp, Mus musculus
attggcaggtgctccctaatgctta

SEQ ID NO: 284513 - DNA, 25 bp, Mus musculus
attggcataaagacggttcttgctg

SEQ ID NO: 284514 - DNA, 25 bp, Mus musculus
attggcataaagtcggttcttgctg

SEQ ID NO: 284515 - DNA, 25 bp, Mus musculus
attggcatcaccataaccgttggat

SEQ ID NO: 284516 - DNA, 25 bp, Mus musculus
attggcatcaccttaaccgttggat

SEQ ID NO: 284517 - DNA, 25 bp, Mus musculus
attggcatcggaaatctaaggaggc

SEQ ID NO: 284518 - DNA, 25 bp, Mus musculus
attggcatcggacagcgcatcttga

SEQ ID NO: 284519 - DNA, 25 bp, Mus musculus
attggcatcggagagcgcatcttga

SEQ ID NO: 284520 - DNA, 25 bp, Mus musculus
attggcatcggatatctaaggaggc

SEQ ID NO: 284521 - DNA, 25 bp, Mus musculus
attggcatcggcatcgttatcacag

SEQ ID NO: 284522 - DNA, 25 bp, Mus musculus
attggcatcggcttcgttatcacag

SEQ ID NO: 284523 - DNA, 25 bp, Mus musculus
attggcatctatcgttcctcctgag

SEQ ID NO: 284524 - DNA, 25 bp, Mus musculus
attggcatctatggttcctcctgag

SEQ ID NO: 284525 - DNA, 25 bp, Mus musculus
attggcatctgtcagctggctttgc

SEQ ID NO: 284526 - DNA, 25 bp, Mus musculus
attggcatctgtgagctggctttgc

SEQ ID NO: 284527 - DNA, 25 bp, Mus musculus
attggcatgaagacttgagaactct

SEQ ID NO: 284528 - DNA, 25 bp, Mus musculus
attggcatgaagtcttgagaactct

SEQ ID NO: 284529 - DNA, 25 bp, Mus musculus
attggcatggcaactttgacatcta

SEQ ID NO: 284530 - DNA, 25 bp, Mus musculus
attggcatggcatctttgacatcta

SEQ ID NO: 284531 - DNA, 25 bp, Mus musculus
attggcatgggcatgagctcatgaa

SEQ ID NO: 284532 - DNA, 25 bp, Mus musculus
attggcatgggcttgagctcatgaa

SEQ ID NO: 284533 - DNA, 25 bp, Mus musculus
attggcatgtgccatcacacctgac

SEQ ID NO: 284534 - DNA, 25 bp, Mus musculus
attggcatgtgccttgctaccttgg

SEQ ID NO: 284535 - DNA, 25 bp, Mus musculus
attggcatgtgcgatcacacctgac

SEQ ID NO: 284536 - DNA, 25 bp, Mus musculus
attggcatgtgcgttgctaccttgg

SEQ ID NO: 284537 - DNA, 25 bp, Mus musculus
attggcattctccagtacttttaaa

SEQ ID NO: 284538 - DNA, 25 bp, Mus musculus
attggcattctcgagtacttttaaa

SEQ ID NO: 284539 - DNA, 25 bp, Mus musculus
attggcattggtctgtgacaaaaca

SEQ ID NO: 284540 - DNA, 25 bp, Mus musculus
attggcattggtgtgtgacaaaaca

SEQ ID NO: 284541 - DNA, 25 bp, Mus musculus
attggcatttccattgttacatcat

SEQ ID NO: 284542 - DNA, 25 bp, Mus musculus
attggcatttcctttgttacatcat

SEQ ID NO: 284543 - DNA, 25 bp, Mus musculus
attggcatttggcaccgagtacact

SEQ ID NO: 284544 - DNA, 25 bp, Mus musculus
attggcatttgggaccgagtacact

SEQ ID NO: 284545 - DNA, 25 bp, Mus musculus
attggccaagtcactggaagccctt

SEQ ID NO: 284546 - DNA, 25 bp, Mus musculus
attggccaagtctctggaagccctt

SEQ ID NO: 284547 - DNA, 25 bp, Mus musculus
attggccacacacttccacagagga

SEQ ID NO: 284548 - DNA, 25 bp, Mus musculus
attggccacacagttccacagagga

SEQ ID NO: 284549 - DNA, 25 bp, Mus musculus
attggccaccaaattctgtgaccca

SEQ ID NO: 284550 - DNA, 25 bp, Mus musculus
attggccaccaactgtagatgtata

SEQ ID NO: 284551 - DNA, 25 bp, Mus musculus
attggccaccaagtgtagatgtata

SEQ ID NO: 284552 - DNA, 25 bp, Mus musculus
attggccaccaatttctgtgaccca

SEQ ID NO: 284553 - DNA, 25 bp, Mus musculus
attggccaccatacatacttttatc

SEQ ID NO: 284554 - DNA, 25 bp, Mus musculus
attggccaccattcatacttttatc

SEQ ID NO: 284555 - DNA, 25 bp, Mus musculus
attggccaccggatattgcctgtgc

SEQ ID NO: 284556 - DNA, 25 bp, Mus musculus
attggccaccggttattgcctgtgc

SEQ ID NO: 284557 - DNA, 25 bp, Mus musculus
attggccacttgcactcttttgatg

SEQ ID NO: 284558 - DNA, 25 bp, Mus musculus
attggccacttggactcttttgatg

SEQ ID NO: 284559 - DNA, 25 bp, Mus musculus
attggccagctacgtcgttactcag

SEQ ID NO: 284560 - DNA, 25 bp, Mus musculus
attggccagctaggtcgttactcag

SEQ ID NO: 284561 - DNA, 25 bp, Mus musculus
attggccaggatacaagcacagcta

SEQ ID NO: 284562 - DNA, 25 bp, Mus musculus
attggccaggatacttgtccgccta

SEQ ID NO: 284563 - DNA, 25 bp, Mus musculus
attggccaggattcaagcacagcta

SEQ ID NO: 284564 - DNA, 25 bp, Mus musculus
attggccaggattcttgtccgccta

SEQ ID NO: 284565 - DNA, 25 bp, Mus musculus
attggccagtacagtcatttccatc

SEQ ID NO: 284566 - DNA, 25 bp, Mus musculus
attggccagtactgtcatttccatc

SEQ ID NO: 284567 - DNA, 25 bp, Mus musculus
attggccagtggagaatactttttg

SEQ ID NO: 284568 - DNA, 25 bp, Mus musculus
attggccagtggtgaatactttttg

SEQ ID NO: 284569 - DNA, 25 bp, Mus musculus
attggccataccagagagagctcct

SEQ ID NO: 284570 - DNA, 25 bp, Mus musculus
attggccatacctgagagagctcct

SEQ ID NO: 284571 - DNA, 25 bp, Mus musculus
attggccatcagagtgtcctgatag

SEQ ID NO: 284572 - DNA, 25 bp, Mus musculus
attggccatcagtgtgtcctgatag

SEQ ID NO: 284573 - DNA, 25 bp, Mus musculus
attggccatcgaaactaccacgcag

SEQ ID NO: 284574 - DNA, 25 bp, Mus musculus
attggccatcgatactaccacgcag

SEQ ID NO: 284575 - DNA, 25 bp, Mus musculus
attggcccaacacgaatggcttcaa

SEQ ID NO: 284576 - DNA, 25 bp, Mus musculus
attggcccaacaggaatggcttcaa

SEQ ID NO: 284577 - DNA, 25 bp, Mus musculus
attggcccaataccctactgtgtga

SEQ ID NO: 284578 - DNA, 25 bp, Mus musculus
attggcccaatagcctactgtgtga

SEQ ID NO: 284579 - DNA, 25 bp, Mus musculus
attggcccacaaagatggcattctg

SEQ ID NO: 284580 - DNA, 25 bp, Mus musculus
attggcccacaatgatggcattctg

SEQ ID NO: 284581 - DNA, 25 bp, Mus musculus
attggcccagtcattactcggtaga

SEQ ID NO: 284582 - DNA, 25 bp, Mus musculus
attggcccagtctttactcggtaga

SEQ ID NO: 284583 - DNA, 25 bp, Mus musculus
attggcccattactggtcacacctc

SEQ ID NO: 284584 - DNA, 25 bp, Mus musculus
attggcccattagtggtcacacctc

SEQ ID NO: 284585 - DNA, 25 bp, Mus musculus
attggcccgaggatcacacagtctt

SEQ ID NO: 284586 - DNA, 25 bp, Mus musculus
attggcccgaggttcacacagtctt

SEQ ID NO: 284587 - DNA, 25 bp, Mus musculus
attggccctataactatctcgtaga

SEQ ID NO: 284588 - DNA, 25 bp, Mus musculus
attggccctatatctatctcgtaga

SEQ ID NO: 284589 - DNA, 25 bp, Mus musculus
attggccctctacctcattttttga

SEQ ID NO: 284590 - DNA, 25 bp, Mus musculus
attggccctctagctcattttttga

SEQ ID NO: 284591 - DNA, 25 bp, Mus musculus
attggccctgaacctacatggatat

SEQ ID NO: 284592 - DNA, 25 bp, Mus musculus
attggccctgaagctacatggatat

SEQ ID NO: 284593 - DNA, 25 bp, Mus musculus
attggccctgtaacgtctgggtgga

SEQ ID NO: 284594 - DNA, 25 bp, Mus musculus
attggccctgtatcgtctgggtgga

SEQ ID NO: 284595 - DNA, 25 bp, Mus musculus
attggccctgtgaaggctgatcata

SEQ ID NO: 284596 - DNA, 25 bp, Mus musculus
attggccctgtgtaggctgatcata

SEQ ID NO: 284597 - DNA, 25 bp, Mus musculus
attggccctgttagctttttataag

SEQ ID NO: 284598 - DNA, 25 bp, Mus musculus
attggccctgtttgctttttataag

SEQ ID NO: 284599 - DNA, 25 bp, Mus musculus
attggcccttacagcataggcttta

SEQ ID NO: 284600 - DNA, 25 bp, Mus musculus
attggcccttactgcataggcttta

SEQ ID NO: 284601 - DNA, 25 bp, Mus musculus
attggccgcgcacggaggaaattat

SEQ ID NO: 284602 - DNA, 25 bp, Mus musculus
attggccgcgcagggaggaaattat

SEQ ID NO: 284603 - DNA, 25 bp, Mus musculus
attggccggtgcagggcgccaacta

SEQ ID NO: 284604 - DNA, 25 bp, Mus musculus
attggccggtgctgggcgccaacta

SEQ ID NO: 284605 - DNA, 25 bp, Mus musculus
attggccgtacacgtcgtgttggaa

SEQ ID NO: 284606 - DNA, 25 bp, Mus musculus
attggccgtacaggtcgtgttggaa

SEQ ID NO: 284607 - DNA, 25 bp, Mus musculus
attggcctatagacgttcactacta

SEQ ID NO: 284608 - DNA, 25 bp, Mus musculus
attggcctatagtcgttcactacta

SEQ ID NO: 284609 - DNA, 25 bp, Mus musculus
attggcctcagactctagtggcaga

SEQ ID NO: 284610 - DNA, 25 bp, Mus musculus
attggcctcagagtctagtggcaga

SEQ ID NO: 284611 - DNA, 25 bp, Mus musculus
attggcctccagaactttgtaacag

SEQ ID NO: 284612 - DNA, 25 bp, Mus musculus
attggcctccagtactttgtaacag

SEQ ID NO: 284613 - DNA, 25 bp, Mus musculus
attggcctgtatctcttgcacactg

SEQ ID NO: 284614 - DNA, 25 bp, Mus musculus
attggcctgtatgtcttgcacactg

SEQ ID NO: 284615 - DNA, 25 bp, Mus musculus
attggcctgttactgtatacctgta

SEQ ID NO: 284616 - DNA, 25 bp, Mus musculus
attggcctgttagtgtatacctgta

SEQ ID NO: 284617 - DNA, 25 bp, Mus musculus
attggccttgccatgctgctgattt

SEQ ID NO: 284618 - DNA, 25 bp, Mus musculus
attggccttgccttgctgctgattt

SEQ ID NO: 284619 - DNA, 25 bp, Mus musculus
attggccttgttccctgtacaatta

SEQ ID NO: 284620 - DNA, 25 bp, Mus musculus
attggccttgttgcctgtacaatta

SEQ ID NO: 284621 - DNA, 25 bp, Mus musculus
attggcctttctctgccaaggattg

SEQ ID NO: 284622 - DNA, 25 bp, Mus musculus
attggcctttctgtgccaaggattg

SEQ ID NO: 284623 - DNA, 25 bp, Mus musculus
attggcctttgactcaccaaatagg

SEQ ID NO: 284624 - DNA, 25 bp, Mus musculus
attggcctttgagtcaccaaatagg

SEQ ID NO: 284625 - DNA, 25 bp, Mus musculus
attggcctttgccacagaagttaca

SEQ ID NO: 284626 - DNA, 25 bp, Mus musculus
attggcctttgcgacagaagttaca

SEQ ID NO: 284627 - DNA, 25 bp, Mus musculus
attggccttttcaattcctgtaatg

SEQ ID NO: 284628 - DNA, 25 bp, Mus musculus
attggccttttctattcctgtaatg

SEQ ID NO: 284629 - DNA, 25 bp, Mus musculus
attggccttttgcacaccggttttg

SEQ ID NO: 284630 - DNA, 25 bp, Mus musculus
attggccttttggacaccggttttg

SEQ ID NO: 284631 - DNA, 25 bp, Mus musculus
attggcctttttcaatagctgcctc

SEQ ID NO: 284632 - DNA, 25 bp, Mus musculus
attggcctttttgaatagctgcctc

SEQ ID NO: 284633 - DNA, 25 bp, Mus musculus
attggcgaaattatgttgtgaactt

SEQ ID NO: 284634 - DNA, 25 bp, Mus musculus
attggcgaaattttgttgtgaactt

SEQ ID NO: 284635 - DNA, 25 bp, Mus musculus
attggcgcacgtccgcccagtactg

SEQ ID NO: 284636 - DNA, 25 bp, Mus musculus
attggcgcacgtgcgcccagtactg

SEQ ID NO: 284637 - DNA, 25 bp, Mus musculus
attggcgcaggcagcacggtcaaca

SEQ ID NO: 284638 - DNA, 25 bp, Mus musculus
attggcgcaggctgcacggtcaaca

SEQ ID NO: 284639 - DNA, 25 bp, Mus musculus
attggcgccatcactctggctggtg

SEQ ID NO: 284640 - DNA, 25 bp, Mus musculus
attggcgccatctctctggctggtg

SEQ ID NO: 284641 - DNA, 25 bp, Mus musculus
attggcgccattcgtctagagctgt

SEQ ID NO: 284642 - DNA, 25 bp, Mus musculus
attggcgccattggtctagagctgt

SEQ ID NO: 284643 - DNA, 25 bp, Mus musculus
attggcgcctttacagagttcacac

SEQ ID NO: 284644 - DNA, 25 bp, Mus musculus
attggcgccttttcagagttcacac

SEQ ID NO: 284645 - DNA, 25 bp, Mus musculus
attggcgctcaactccagggtgtgt

SEQ ID NO: 284646 - DNA, 25 bp, Mus musculus
attggcgctcaagtccagggtgtgt

SEQ ID NO: 284647 - DNA, 25 bp, Mus musculus
attggcgctgagacactgagttcat

SEQ ID NO: 284648 - DNA, 25 bp, Mus musculus
attggcgctgagtcactgagttcat

SEQ ID NO: 284649 - DNA, 25 bp, Mus musculus
attggcggcatgatctacgcactca

SEQ ID NO: 284650 - DNA, 25 bp, Mus musculus
attggcggcatgttctacgcactca

SEQ ID NO: 284651 - DNA, 25 bp, Mus musculus
attggcggcctgaacttttgagaac

SEQ ID NO: 284652 - DNA, 25 bp, Mus musculus
attggcggcctgtacttttgagaac

SEQ ID NO: 284653 - DNA, 25 bp, Mus musculus
attggcgtaactaaaaagctctgta

SEQ ID NO: 284654 - DNA, 25 bp, Mus musculus
attggcgtaacttaaaagctctgta

SEQ ID NO: 284655 - DNA, 25 bp, Mus musculus
attggcgtatggcactcattcaaaa

SEQ ID NO: 284656 - DNA, 25 bp, Mus musculus
attggcgtatgggactcattcaaaa

SEQ ID NO: 284657 - DNA, 25 bp, Mus musculus
attggcgtgggaactgcctgcactc

SEQ ID NO: 284658 - DNA, 25 bp, Mus musculus
attggcgtgggatctgcctgcactc

SEQ ID NO: 284659 - DNA, 25 bp, Mus musculus
attggcgtgtatactctgcctgcac

SEQ ID NO: 284660 - DNA, 25 bp, Mus musculus
attggcgtgtattctctgcctgcac

SEQ ID NO: 284661 - DNA, 25 bp, Mus musculus
attggcgtttggaacccaagcacga

SEQ ID NO: 284662 - DNA, 25 bp, Mus musculus
attggcgtttggtacccaagcacga

SEQ ID NO: 284663 - DNA, 25 bp, Mus musculus
attggctaagacatggatcccagaa

SEQ ID NO: 284664 - DNA, 25 bp, Mus musculus
attggctaagacttggatcccagaa

SEQ ID NO: 284665 - DNA, 25 bp, Mus musculus
attggctaagataacttgatgctct

SEQ ID NO: 284666 - DNA, 25 bp, Mus musculus
attggctaagattacttgatgctct

SEQ ID NO: 284667 - DNA, 25 bp, Mus musculus
attggctacgttagaagagctgctt

SEQ ID NO: 284668 - DNA, 25 bp, Mus musculus
attggctacgtttgaagagctgctt

SEQ ID NO: 284669 - DNA, 25 bp, Mus musculus
attggctagagtactttggtcatta

SEQ ID NO: 284670 - DNA, 25 bp, Mus musculus
attggctagagttctttggtcatta

SEQ ID NO: 284671 - DNA, 25 bp, Mus musculus
attggctagtcaacagtggcctctc

SEQ ID NO: 284672 - DNA, 25 bp, Mus musculus
attggctagtcatcagtggcctctc

SEQ ID NO: 284673 - DNA, 25 bp, Mus musculus
attggctatctcatatttcatttta

SEQ ID NO: 284674 - DNA, 25 bp, Mus musculus
attggctatctcttatttcatttta

SEQ ID NO: 284675 - DNA, 25 bp, Mus musculus
attggctattctccacaaactggta

SEQ ID NO: 284676 - DNA, 25 bp, Mus musculus
attggctattctgcacaaactggta

SEQ ID NO: 284677 - DNA, 25 bp, Mus musculus
attggctattgtaggtataaccgca

SEQ ID NO: 284678 - DNA, 25 bp, Mus musculus
attggctattgttggtataaccgca

SEQ ID NO: 284679 - DNA, 25 bp, Mus musculus
attggctcagatattcccatctcag

SEQ ID NO: 284680 - DNA, 25 bp, Mus musculus
attggctcagattttcccatctcag

SEQ ID NO: 284681 - DNA, 25 bp, Mus musculus
attggctcagccatcggacaggacc

SEQ ID NO: 284682 - DNA, 25 bp, Mus musculus
attggctcagccttcggacaggacc

SEQ ID NO: 284683 - DNA, 25 bp, Mus musculus
attggctcaggccttgtatgaatta

SEQ ID NO: 284684 - DNA, 25 bp, Mus musculus
attggctcaggcgttgtatgaatta

SEQ ID NO: 284685 - DNA, 25 bp, Mus musculus
attggctcagtaagctaatgtgaca

SEQ ID NO: 284686 - DNA, 25 bp, Mus musculus
attggctcagtatgctaatgtgaca

SEQ ID NO: 284687 - DNA, 25 bp, Mus musculus
attggctccaaaagctattcctatg

SEQ ID NO: 284688 - DNA, 25 bp, Mus musculus
attggctccaaatgctattcctatg

SEQ ID NO: 284689 - DNA, 25 bp, Mus musculus
attggctcccaactgtgatggcctc

SEQ ID NO: 284690 - DNA, 25 bp, Mus musculus
attggctcccaagtgtgatggcctc

SEQ ID NO: 284691 - DNA, 25 bp, Mus musculus
attggctcccagcatgctctcatag

SEQ ID NO: 284692 - DNA, 25 bp, Mus musculus
attggctcccaggatgctctcatag

SEQ ID NO: 284693 - DNA, 25 bp, Mus musculus
attggctccctgcatctttagttac

SEQ ID NO: 284694 - DNA, 25 bp, Mus musculus
attggctccctggatctttagttac

SEQ ID NO: 284695 - DNA, 25 bp, Mus musculus
attggctccgtcatgtgctgaggaa

SEQ ID NO: 284696 - DNA, 25 bp, Mus musculus
attggctccgtcttgtgctgaggaa

SEQ ID NO: 284697 - DNA, 25 bp, Mus musculus
attggctcctggagggtgtttagca

SEQ ID NO: 284698 - DNA, 25 bp, Mus musculus
attggctcctggtgggtgtttagca

SEQ ID NO: 284699 - DNA, 25 bp, Mus musculus
attggctcgagaaggtgacatttac

SEQ ID NO: 284700 - DNA, 25 bp, Mus musculus
attggctcgagatggtgacatttac

SEQ ID NO: 284701 - DNA, 25 bp, Mus musculus
attggctctatcagacacttgtatc

SEQ ID NO: 284702 - DNA, 25 bp, Mus musculus
attggctctatctgacacttgtatc

SEQ ID NO: 284703 - DNA, 25 bp, Mus musculus
attggctctctgatggacgactact

SEQ ID NO: 284704 - DNA, 25 bp, Mus musculus
attggctctctgttggacgactact

SEQ ID NO: 284705 - DNA, 25 bp, Mus musculus
attggctcttaaaccagttacagat

SEQ ID NO: 284706 - DNA, 25 bp, Mus musculus
attggctcttaatccagttacagat

SEQ ID NO: 284707 - DNA, 25 bp, Mus musculus
attggctgaagcagggtaataggca

SEQ ID NO: 284708 - DNA, 25 bp, Mus musculus
attggctgaagctgggtaataggca

SEQ ID NO: 284709 - DNA, 25 bp, Mus musculus
attggctgacatcgtaatctagttt

SEQ ID NO: 284710 - DNA, 25 bp, Mus musculus
attggctgacatggtaatctagttt

SEQ ID NO: 284711 - DNA, 25 bp, Mus musculus
attggctgatgaaatttccctggta

SEQ ID NO: 284712 - DNA, 25 bp, Mus musculus
attggctgatgatatttccctggta

SEQ ID NO: 284713 - DNA, 25 bp, Mus musculus
attggctggactccggtgatgacac

SEQ ID NO: 284714 - DNA, 25 bp, Mus musculus
attggctggactgcggtgatgacac

SEQ ID NO: 284715 - DNA, 25 bp, Mus musculus
attggctggcaccattttcttatgc

SEQ ID NO: 284716 - DNA, 25 bp, Mus musculus
attggctggcacgattttcttatgc

SEQ ID NO: 284717 - DNA, 25 bp, Mus musculus
attggctggctcatatcttttttac

SEQ ID NO: 284718 - DNA, 25 bp, Mus musculus
attggctggctcttatcttttttac

SEQ ID NO: 284719 - DNA, 25 bp, Mus musculus
attggctgtaaacgtctgtctggac

SEQ ID NO: 284720 - DNA, 25 bp, Mus musculus
attggctgtaaaggtctgtctggac

SEQ ID NO: 284721 - DNA, 25 bp, Mus musculus
attggctgtactcttcgggattttc

SEQ ID NO: 284722 - DNA, 25 bp, Mus musculus
attggctgtactgttcgggattttc

SEQ ID NO: 284723 - DNA, 25 bp, Mus musculus
attggctgtagccacacagacatga

SEQ ID NO: 284724 - DNA, 25 bp, Mus musculus
attggctgtagcgacacagacatga

SEQ ID NO: 284725 - DNA, 25 bp, Mus musculus
attggctgtcatagcatcggaccta

SEQ ID NO: 284726 - DNA, 25 bp, Mus musculus
attggctgtcattgcatcggaccta

SEQ ID NO: 284727 - DNA, 25 bp, Mus musculus
attggctgtctaccttcttggatct

SEQ ID NO: 284728 - DNA, 25 bp, Mus musculus
attggctgtctactccatggatgtt

SEQ ID NO: 284729 - DNA, 25 bp, Mus musculus
attggctgtctagcttcttggatct

SEQ ID NO: 284730 - DNA, 25 bp, Mus musculus
attggctgtctagtccatggatgtt

SEQ ID NO: 284731 - DNA, 25 bp, Mus musculus
attggctgtcttattgccaaacttt

SEQ ID NO: 284732 - DNA, 25 bp, Mus musculus
attggctgtctttttgccaaacttt

SEQ ID NO: 284733 - DNA, 25 bp, Mus musculus
attggctgttctaggagagaattct

SEQ ID NO: 284734 - DNA, 25 bp, Mus musculus
attggctgttctcctcaggttggga

SEQ ID NO: 284735 - DNA, 25 bp, Mus musculus
attggctgttctgctcaggttggga

SEQ ID NO: 284736 - DNA, 25 bp, Mus musculus
attggctgttcttggagagaattct

SEQ ID NO: 284737 - DNA, 25 bp, Mus musculus
attggcttaattatctctactcaca

SEQ ID NO: 284738 - DNA, 25 bp, Mus musculus
attggcttaattttctctactcaca

SEQ ID NO: 284739 - DNA, 25 bp, Mus musculus
attggcttacatactttgctcacct

SEQ ID NO: 284740 - DNA, 25 bp, Mus musculus
attggcttacattctttgctcacct

SEQ ID NO: 284741 - DNA, 25 bp, Mus musculus
attggcttattcacatgcattagac

SEQ ID NO: 284742 - DNA, 25 bp, Mus musculus
attggcttattctcatgcattagac

SEQ ID NO: 284743 - DNA, 25 bp, Mus musculus
attggcttcattactggctcccgag

SEQ ID NO: 284744 - DNA, 25 bp, Mus musculus
attggcttcatttctggctcccgag

SEQ ID NO: 284745 - DNA, 25 bp, Mus musculus
attggcttccaaactagcatttggg

SEQ ID NO: 284746 - DNA, 25 bp, Mus musculus
attggcttccaatctagcatttggg

SEQ ID NO: 284747 - DNA, 25 bp, Mus musculus
attggcttccctcgaggtcgaggaa

SEQ ID NO: 284748 - DNA, 25 bp, Mus musculus
attggcttccctggaggtcgaggaa

SEQ ID NO: 284749 - DNA, 25 bp, Mus musculus
attggcttcctgatcattaaccagt

SEQ ID NO: 284750 - DNA, 25 bp, Mus musculus
attggcttcctgttcattaaccagt

SEQ ID NO: 284751 - DNA, 25 bp, Mus musculus
attggcttgcacaatgacctccttg

SEQ ID NO: 284752 - DNA, 25 bp, Mus musculus
attggcttgcactatgacctccttg

SEQ ID NO: 284753 - DNA, 25 bp, Mus musculus
attggcttgcgacacgtagaccctg

SEQ ID NO: 284754 - DNA, 25 bp, Mus musculus
attggcttgcgagacgtagaccctg

SEQ ID NO: 284755 - DNA, 25 bp, Mus musculus
attggcttgcttatgttaaagtgca

SEQ ID NO: 284756 - DNA, 25 bp, Mus musculus
attggcttgcttttgttaaagtgca

SEQ ID NO: 284757 - DNA, 25 bp, Mus musculus
attggcttggtgacagagcccttgc

SEQ ID NO: 284758 - DNA, 25 bp, Mus musculus
attggcttggtgtcagagcccttgc

SEQ ID NO: 284759 - DNA, 25 bp, Mus musculus
attggcttgtctcctgaacaaaaaa

SEQ ID NO: 284760 - DNA, 25 bp, Mus musculus
attggcttgtctgctgaacaaaaaa

SEQ ID NO: 284761 - DNA, 25 bp, Mus musculus
attggcttgtgacatcgatggcaga

SEQ ID NO: 284762 - DNA, 25 bp, Mus musculus
attggcttgtgagatcgatggcaga

SEQ ID NO: 284763 - DNA, 25 bp, Mus musculus
attggctttaatacacttggatcac

SEQ ID NO: 284764 - DNA, 25 bp, Mus musculus
attggctttaattcacttggatcac

SEQ ID NO: 284765 - DNA, 25 bp, Mus musculus
attggctttcttaacttgtatgcac

SEQ ID NO: 284766 - DNA, 25 bp, Mus musculus
attggctttctttacttgtatgcac

SEQ ID NO: 284767 - DNA, 25 bp, Mus musculus
attggctttggtcctcactgggtga

SEQ ID NO: 284768 - DNA, 25 bp, Mus musculus
attggctttggtgctcactgggtga

SEQ ID NO: 284769 - DNA, 25 bp, Mus musculus
attgggaacagtagtcagccctgtc

SEQ ID NO: 284770 - DNA, 25 bp, Mus musculus
attgggaacagttgtcagccctgtc

SEQ ID NO: 284771 - DNA, 25 bp, Mus musculus
attgggaaccatactaccttccctg

SEQ ID NO: 284772 - DNA, 25 bp, Mus musculus
attgggaaccattctaccttccctg

SEQ ID NO: 284773 - DNA, 25 bp, Mus musculus
attgggaactgcactgtgcactgag

SEQ ID NO: 284774 - DNA, 25 bp, Mus musculus
attgggaactgctctgtgcactgag

SEQ ID NO: 284775 - DNA, 25 bp, Mus musculus
attgggaagagtcctttgaggctcc

SEQ ID NO: 284776 - DNA, 25 bp, Mus musculus
attgggaagagtgctttgaggctcc

SEQ ID NO: 284777 - DNA, 25 bp, Mus musculus
attgggacaagactggcagtgattc

SEQ ID NO: 284778 - DNA, 25 bp, Mus musculus
attgggacaagagtggcagtgattc

SEQ ID NO: 284779 - DNA, 25 bp, Mus musculus
attgggacacagaggtgcattcctg

SEQ ID NO: 284780 - DNA, 25 bp, Mus musculus
attgggacacagtggtgcattcctg

SEQ ID NO: 284781 - DNA, 25 bp, Mus musculus
attgggacactaagcacacagttgc

SEQ ID NO: 284782 - DNA, 25 bp, Mus musculus
attgggacactatgcacacagttgc

SEQ ID NO: 284783 - DNA, 25 bp, Mus musculus
attgggacactgatcacagcagcta

SEQ ID NO: 284784 - DNA, 25 bp, Mus musculus
attgggacactgttcacagcagcta

SEQ ID NO: 284785 - DNA, 25 bp, Mus musculus
attgggacatggcacacgtgacagt

SEQ ID NO: 284786 - DNA, 25 bp, Mus musculus
attgggacatgggacacgtgacagt

SEQ ID NO: 284787 - DNA, 25 bp, Mus musculus
attgggaccaagcttttttggcaag

SEQ ID NO: 284788 - DNA, 25 bp, Mus musculus
attgggaccaaggttttttggcaag

SEQ ID NO: 284789 - DNA, 25 bp, Mus musculus
attgggaccactaccatgaagcttt

SEQ ID NO: 284790 - DNA, 25 bp, Mus musculus
attgggaccacttccatgaagcttt

SEQ ID NO: 284791 - DNA, 25 bp, Mus musculus
attgggacccaacgtctccacagca

SEQ ID NO: 284792 - DNA, 25 bp, Mus musculus
attgggacccaaggtctccacagca

SEQ ID NO: 284793 - DNA, 25 bp, Mus musculus
attgggacctgactacttgtgggaa

SEQ ID NO: 284794 - DNA, 25 bp, Mus musculus
attgggacctgagtacttgtgggaa

SEQ ID NO: 284795 - DNA, 25 bp, Mus musculus
attgggacctttctgaaccatccgc

SEQ ID NO: 284796 - DNA, 25 bp, Mus musculus
attgggacctttgtgaaccatccgc

SEQ ID NO: 284797 - DNA, 25 bp, Mus musculus
attgggacgacaactctgactctgc

SEQ ID NO: 284798 - DNA, 25 bp, Mus musculus
attgggacgacatctctgactctgc

SEQ ID NO: 284799 - DNA, 25 bp, Mus musculus
attgggactacaaaaaaggctgggc

SEQ ID NO: 284800 - DNA, 25 bp, Mus musculus
attgggactacataaaaggctgggc

SEQ ID NO: 284801 - DNA, 25 bp, Mus musculus
attgggactataacagccactctgt

SEQ ID NO: 284802 - DNA, 25 bp, Mus musculus
attgggactatatcagccactctgt

SEQ ID NO: 284803 - DNA, 25 bp, Mus musculus
attgggactctaccacatcttgacc

SEQ ID NO: 284804 - DNA, 25 bp, Mus musculus
attgggactctagcacatcttgacc

SEQ ID NO: 284805 - DNA, 25 bp, Mus musculus
attgggactctcaatctggtttgat

SEQ ID NO: 284806 - DNA, 25 bp, Mus musculus
attgggactctctatctggtttgat

SEQ ID NO: 284807 - DNA, 25 bp, Mus musculus
attgggactgacatagctccagctc

SEQ ID NO: 284808 - DNA, 25 bp, Mus musculus
attgggactgacttagctccagctc

SEQ ID NO: 284809 - DNA, 25 bp, Mus musculus
attgggactgggacaatctcttccg

SEQ ID NO: 284810 - DNA, 25 bp, Mus musculus
attgggactgggtcaatctcttccg

SEQ ID NO: 284811 - DNA, 25 bp, Mus musculus
attgggactgtactctcctatctat

SEQ ID NO: 284812 - DNA, 25 bp, Mus musculus
attgggactgtagtctcctatctat

SEQ ID NO: 284813 - DNA, 25 bp, Mus musculus
attgggagactgattgcctagcata

SEQ ID NO: 284814 - DNA, 25 bp, Mus musculus
attgggagactgtttgcctagcata

SEQ ID NO: 284815 - DNA, 25 bp, Mus musculus
attgggagcaagagagtactcggat

SEQ ID NO: 284816 - DNA, 25 bp, Mus musculus
attgggagcaagtgagtactcggat

SEQ ID NO: 284817 - DNA, 25 bp, Mus musculus
attgggagcccactttccagtgggt

SEQ ID NO: 284818 - DNA, 25 bp, Mus musculus
attgggagcccagtttccagtgggt

SEQ ID NO: 284819 - DNA, 25 bp, Mus musculus
attgggaggcacatcagaccacaac

SEQ ID NO: 284820 - DNA, 25 bp, Mus musculus
attgggaggcacttcagaccacaac

SEQ ID NO: 284821 - DNA, 25 bp, Mus musculus
attgggatacatcgtgcttctggaa

SEQ ID NO: 284822 - DNA, 25 bp, Mus musculus
attgggatacatggtgcttctggaa

SEQ ID NO: 284823 - DNA, 25 bp, Mus musculus
attgggatcaaactgtctccccagg

SEQ ID NO: 284824 - DNA, 25 bp, Mus musculus
attgggatcaaagtgtctccccagg

SEQ ID NO: 284825 - DNA, 25 bp, Mus musculus
attgggatcacaattaccaatacat

SEQ ID NO: 284826 - DNA, 25 bp, Mus musculus
attgggatcacatttaccaatacat

SEQ ID NO: 284827 - DNA, 25 bp, Mus musculus
attgggatctcaaagctaggggtga

SEQ ID NO: 284828 - DNA, 25 bp, Mus musculus
attgggatctcatagctaggggtga

SEQ ID NO: 284829 - DNA, 25 bp, Mus musculus
attgggatctccattctgtaattca

SEQ ID NO: 284830 - DNA, 25 bp, Mus musculus
attgggatctcctttctgtaattca

SEQ ID NO: 284831 - DNA, 25 bp, Mus musculus
attgggattactatattggccactc

SEQ ID NO: 284832 - DNA, 25 bp, Mus musculus
attgggattactttattggccactc

SEQ ID NO: 284833 - DNA, 25 bp, Mus musculus
attgggattgcgcagtaaacattcc

SEQ ID NO: 284834 - DNA, 25 bp, Mus musculus
attgggattgcggagtaaacattcc

SEQ ID NO: 284835 - DNA, 25 bp, Mus musculus
attgggcaacaaaggcaaattgcat

SEQ ID NO: 284836 - DNA, 25 bp, Mus musculus
attgggcaacaatggcaaattgcat

SEQ ID NO: 284837 - DNA, 25 bp, Mus musculus
attgggcaagatatgacacaggctt

SEQ ID NO: 284838 - DNA, 25 bp, Mus musculus
attgggcaagatttgacacaggctt

SEQ ID NO: 284839 - DNA, 25 bp, Mus musculus
attgggcaagcgacagacctgaaac

SEQ ID NO: 284840 - DNA, 25 bp, Mus musculus
attgggcaagcgtcagacctgaaac

SEQ ID NO: 284841 - DNA, 25 bp, Mus musculus
attgggcaattgctattatgtcccc

SEQ ID NO: 284842 - DNA, 25 bp, Mus musculus
attgggcaattggtattatgtcccc

SEQ ID NO: 284843 - DNA, 25 bp, Mus musculus
attgggcagcccactgtttcttact

SEQ ID NO: 284844 - DNA, 25 bp, Mus musculus
attgggcagccctctgtttcttact

SEQ ID NO: 284845 - DNA, 25 bp, Mus musculus
attgggcattagactgttaggtaca

SEQ ID NO: 284846 - DNA, 25 bp, Mus musculus
attgggcattagtctgttaggtaca

SEQ ID NO: 284847 - DNA, 25 bp, Mus musculus
attgggcatttaccacgtcatcttc

SEQ ID NO: 284848 - DNA, 25 bp, Mus musculus
attgggcatttactatttacggttg

SEQ ID NO: 284849 - DNA, 25 bp, Mus musculus
attgggcatttagcacgtcatcttc

SEQ ID NO: 284850 - DNA, 25 bp, Mus musculus
attgggcatttagtatttacggttg

SEQ ID NO: 284851 - DNA, 25 bp, Mus musculus
attgggccacatacggtggatatcc

SEQ ID NO: 284852 - DNA, 25 bp, Mus musculus
attgggccacattcggtggatatcc

SEQ ID NO: 284853 - DNA, 25 bp, Mus musculus
attgggccagacaccatggatccag

SEQ ID NO: 284854 - DNA, 25 bp, Mus musculus
attgggccagactccatggatccag

SEQ ID NO: 284855 - DNA, 25 bp, Mus musculus
attgggccagcaagaaggttcagca

SEQ ID NO: 284856 - DNA, 25 bp, Mus musculus
attgggccagcatgaaggttcagca

SEQ ID NO: 284857 - DNA, 25 bp, Mus musculus
attgggccatatagaattcacgctg

SEQ ID NO: 284858 - DNA, 25 bp, Mus musculus
attgggccatattgaattcacgctg

SEQ ID NO: 284859 - DNA, 25 bp, Mus musculus
attgggcccacaataacactctctt

SEQ ID NO: 284860 - DNA, 25 bp, Mus musculus
attgggcccacattaacactctctt

SEQ ID NO: 284861 - DNA, 25 bp, Mus musculus
attgggcccgataatccaccgtgaa

SEQ ID NO: 284862 - DNA, 25 bp, Mus musculus
attgggcccgattatccaccgtgaa

SEQ ID NO: 284863 - DNA, 25 bp, Mus musculus
attgggcccgcaaggacaaggcctt

SEQ ID NO: 284864 - DNA, 25 bp, Mus musculus
attgggcccgcatggacaaggcctt

SEQ ID NO: 284865 - DNA, 25 bp, Mus musculus
attgggcctcagagatgactgttga

SEQ ID NO: 284866 - DNA, 25 bp, Mus musculus
attgggcctcagtgatgactgttga

SEQ ID NO: 284867 - DNA, 25 bp, Mus musculus
attgggcctcctcatattcttcctc

SEQ ID NO: 284868 - DNA, 25 bp, Mus musculus
attgggcctcctgatattcttcctc

SEQ ID NO: 284869 - DNA, 25 bp, Mus musculus
attgggcctggtacgggcattgctc

SEQ ID NO: 284870 - DNA, 25 bp, Mus musculus
attgggcctggttcgggcattgctc

SEQ ID NO: 284871 - DNA, 25 bp, Mus musculus
attgggcctgtaaccttccccgagg

SEQ ID NO: 284872 - DNA, 25 bp, Mus musculus
attgggcctgtatccttccccgagg

SEQ ID NO: 284873 - DNA, 25 bp, Mus musculus
attgggccttcactcagccagataa

SEQ ID NO: 284874 - DNA, 25 bp, Mus musculus
attgggccttcagtcagccagataa

SEQ ID NO: 284875 - DNA, 25 bp, Mus musculus
attgggccttgtcagaactgtattc

SEQ ID NO: 284876 - DNA, 25 bp, Mus musculus
attgggccttgtgagaactgtattc

SEQ ID NO: 284877 - DNA, 25 bp, Mus musculus
attgggcgagtgctggcacagcggt

SEQ ID NO: 284878 - DNA, 25 bp, Mus musculus
attgggcgagtggtggcacagcggt

SEQ ID NO: 284879 - DNA, 25 bp, Mus musculus
attgggcgcacacagtagtcggaaa

SEQ ID NO: 284880 - DNA, 25 bp, Mus musculus
attgggcgcacagagtagtcggaaa

SEQ ID NO: 284881 - DNA, 25 bp, Mus musculus
attgggcgcactcgccgctttggca

SEQ ID NO: 284882 - DNA, 25 bp, Mus musculus
attgggcgcactggccgctttggca

SEQ ID NO: 284883 - DNA, 25 bp, Mus musculus
attgggctcagaagagggctcgcct

SEQ ID NO: 284884 - DNA, 25 bp, Mus musculus
attgggctcagatgagggctcgcct

SEQ ID NO: 284885 - DNA, 25 bp, Mus musculus
attgggctccatacaaaagcagcag

SEQ ID NO: 284886 - DNA, 25 bp, Mus musculus
attgggctccattcaaaagcagcag

SEQ ID NO: 284887 - DNA, 25 bp, Mus musculus
attgggctgcttcggatttccaaag

SEQ ID NO: 284888 - DNA, 25 bp, Mus musculus
attgggctgcttgggatttccaaag

SEQ ID NO: 284889 - DNA, 25 bp, Mus musculus
attgggctgtatcgaggttctgttt

SEQ ID NO: 284890 - DNA, 25 bp, Mus musculus
attgggctgtatggaggttctgttt

SEQ ID NO: 284891 - DNA, 25 bp, Mus musculus
attgggcttggtcgtcttcttcttc

SEQ ID NO: 284892 - DNA, 25 bp, Mus musculus
attgggcttggtggtcttcttcttc

SEQ ID NO: 284893 - DNA, 25 bp, Mus musculus
attgggctttggcaaatcatgtatt

SEQ ID NO: 284894 - DNA, 25 bp, Mus musculus
attgggctttgggaaatcatgtatt

SEQ ID NO: 284895 - DNA, 25 bp, Mus musculus
attgggcttttgaatcggtttgagg

SEQ ID NO: 284896 - DNA, 25 bp, Mus musculus
attgggcttttgtatcggtttgagg

SEQ ID NO: 284897 - DNA, 25 bp, Mus musculus
attgggggcgagagagatttttcct

SEQ ID NO: 284898 - DNA, 25 bp, Mus musculus
attgggggcgagtgagatttttcct

SEQ ID NO: 284899 - DNA, 25 bp, Mus musculus
attgggtagaccatttggcctcttc

SEQ ID NO: 284900 - DNA, 25 bp, Mus musculus
attgggtagaccttttggcctcttc

SEQ ID NO: 284901 - DNA, 25 bp, Mus musculus
attgggtataacctgctgtctcact

SEQ ID NO: 284902 - DNA, 25 bp, Mus musculus
attgggtataacgtgctgtctcact

SEQ ID NO: 284903 - DNA, 25 bp, Mus musculus
attgggtatatgatgcccctggtgc

SEQ ID NO: 284904 - DNA, 25 bp, Mus musculus
attgggtatatgttgcccctggtgc

SEQ ID NO: 284905 - DNA, 25 bp, Mus musculus
attgggtattttcttcgtgcaaagt

SEQ ID NO: 284906 - DNA, 25 bp, Mus musculus
attgggtattttgttcgtgcaaagt

SEQ ID NO: 284907 - DNA, 25 bp, Mus musculus
attgggtcattgacagcggtgctgt

SEQ ID NO: 284908 - DNA, 25 bp, Mus musculus
attgggtcattgtcagcggtgctgt

SEQ ID NO: 284909 - DNA, 25 bp, Mus musculus
attgggtccattacaatggagtgac

SEQ ID NO: 284910 - DNA, 25 bp, Mus musculus
attgggtccatttcaatggagtgac

SEQ ID NO: 284911 - DNA, 25 bp, Mus musculus
attgggtctgtcattcctggactgt

SEQ ID NO: 284912 - DNA, 25 bp, Mus musculus
attgggtctgtctttcctggactgt

SEQ ID NO: 284913 - DNA, 25 bp, Mus musculus
attgggtcttcacagcttagcgata

SEQ ID NO: 284914 - DNA, 25 bp, Mus musculus
attgggtcttcagagcttagcgata

SEQ ID NO: 284915 - DNA, 25 bp, Mus musculus
attgggtcttctatcccatgtttgc

SEQ ID NO: 284916 - DNA, 25 bp, Mus musculus
attgggtcttctttcccatgtttgc

SEQ ID NO: 284917 - DNA, 25 bp, Mus musculus
attgggtgacaactaaagacctggg

SEQ ID NO: 284918 - DNA, 25 bp, Mus musculus
attgggtgacaagtaaagacctggg

SEQ ID NO: 284919 - DNA, 25 bp, Mus musculus
attgggtgccaaacgttgtacgctc

SEQ ID NO: 284920 - DNA, 25 bp, Mus musculus
attgggtgccaatcgttgtacgctc

SEQ ID NO: 284921 - DNA, 25 bp, Mus musculus
attgggtgctagctctgtaccaagc

SEQ ID NO: 284922 - DNA, 25 bp, Mus musculus
attgggtgctaggtctgtaccaagc

SEQ ID NO: 284923 - DNA, 25 bp, Mus musculus
attgggtggacacatcactcaacct

SEQ ID NO: 284924 - DNA, 25 bp, Mus musculus
attgggtggacagatcactcaacct

SEQ ID NO: 284925 - DNA, 25 bp, Mus musculus
attgggtggcttctctgtgtgtaca

SEQ ID NO: 284926 - DNA, 25 bp, Mus musculus
attgggtggcttgtctgtgtgtaca

SEQ ID NO: 284927 - DNA, 25 bp, Mus musculus
attgggtgtccaagcagtcctttca

SEQ ID NO: 284928 - DNA, 25 bp, Mus musculus
attgggtgtccatgcagtcctttca

SEQ ID NO: 284929 - DNA, 25 bp, Mus musculus
attgggtgtccgcacatctgtaatc

SEQ ID NO: 284930 - DNA, 25 bp, Mus musculus
attgggtgtccggacatctgtaatc

SEQ ID NO: 284931 - DNA, 25 bp, Mus musculus
attgggtgtttcacaaggacctgta

SEQ ID NO: 284932 - DNA, 25 bp, Mus musculus
attgggtgtttctcaaggacctgta

SEQ ID NO: 284933 - DNA, 25 bp, Mus musculus
attgggttagaacacctacactcag

SEQ ID NO: 284934 - DNA, 25 bp, Mus musculus
attgggttagaagacctacactcag

SEQ ID NO: 284935 - DNA, 25 bp, Mus musculus
attgggttagatcagacactcatta

SEQ ID NO: 284936 - DNA, 25 bp, Mus musculus
attgggttagatgagacactcatta

SEQ ID NO: 284937 - DNA, 25 bp, Mus musculus
attgggttccatcttgctgactctc

SEQ ID NO: 284938 - DNA, 25 bp, Mus musculus
attgggttccatgttgctgactctc

SEQ ID NO: 284939 - DNA, 25 bp, Mus musculus
attgggttcctgaatgcaccataat

SEQ ID NO: 284940 - DNA, 25 bp, Mus musculus
attgggttcctgtatgcaccataat

SEQ ID NO: 284941 - DNA, 25 bp, Mus musculus
attgggttctcaaagctaccactct

SEQ ID NO: 284942 - DNA, 25 bp, Mus musculus
attgggttctcatagctaccactct

SEQ ID NO: 284943 - DNA, 25 bp, Mus musculus
attgggttgaacatctaccacgaac

SEQ ID NO: 284944 - DNA, 25 bp, Mus musculus
attgggttgaacttctaccacgaac

SEQ ID NO: 284945 - DNA, 25 bp, Mus musculus
attgggtttaacactgcaaaagcca

SEQ ID NO: 284946 - DNA, 25 bp, Mus musculus
attgggtttaactctgcaaaagcca

SEQ ID NO: 284947 - DNA, 25 bp, Mus musculus
attgggtttatcagcatccccaggc

SEQ ID NO: 284948 - DNA, 25 bp, Mus musculus
attgggtttatctgcatccccaggc

SEQ ID NO: 284949 - DNA, 25 bp, Mus musculus
attgggtttcaacagctcacctcca

SEQ ID NO: 284950 - DNA, 25 bp, Mus musculus
attgggtttcaagagctcacctcca

SEQ ID NO: 284951 - DNA, 25 bp, Mus musculus
attgggtttcataaattgggtagat

SEQ ID NO: 284952 - DNA, 25 bp, Mus musculus
attgggtttcattaattgggtagat

SEQ ID NO: 284953 - DNA, 25 bp, Mus musculus
attgggtttggacggcttacacagc

SEQ ID NO: 284954 - DNA, 25 bp, Mus musculus
attgggtttggagggcttacacagc

SEQ ID NO: 284955 - DNA, 25 bp, Mus musculus
attggtaatgtgagccactacgttt

SEQ ID NO: 284956 - DNA, 25 bp, Mus musculus
attggtaatgtgtgccactacgttt

SEQ ID NO: 284957 - DNA, 25 bp, Mus musculus
attggtacaattctcaggtagatca

SEQ ID NO: 284958 - DNA, 25 bp, Mus musculus
attggtacaattgtcaggtagatca

SEQ ID NO: 284959 - DNA, 25 bp, Mus musculus
attggtacacagactattgaattct

SEQ ID NO: 284960 - DNA, 25 bp, Mus musculus
attggtacacagtctattgaattct

SEQ ID NO: 284961 - DNA, 25 bp, Mus musculus
attggtacaccgaggcgtggcacta

SEQ ID NO: 284962 - DNA, 25 bp, Mus musculus
attggtacaccgtggcgtggcacta

SEQ ID NO: 284963 - DNA, 25 bp, Mus musculus
attggtaccaaacgcttcgacagtg

SEQ ID NO: 284964 - DNA, 25 bp, Mus musculus
attggtaccaaaggcttcgacagtg

SEQ ID NO: 284965 - DNA, 25 bp, Mus musculus
attggtacccttaccttcctgacat

SEQ ID NO: 284966 - DNA, 25 bp, Mus musculus
attggtaccctttccttcctgacat

SEQ ID NO: 284967 - DNA, 25 bp, Mus musculus
attggtaccgctcggccctgagtca

SEQ ID NO: 284968 - DNA, 25 bp, Mus musculus
attggtaccgctgggccctgagtca

SEQ ID NO: 284969 - DNA, 25 bp, Mus musculus
attggtacgcgacaccgagtgcaga

SEQ ID NO: 284970 - DNA, 25 bp, Mus musculus
attggtacgcgagaccgagtgcaga

SEQ ID NO: 284971 - DNA, 25 bp, Mus musculus
attggtactacaccaccacctggtg

SEQ ID NO: 284972 - DNA, 25 bp, Mus musculus
attggtactacagcaccacctggtg

SEQ ID NO: 284973 - DNA, 25 bp, Mus musculus
attggtactgccattatatgccttt

SEQ ID NO: 284974 - DNA, 25 bp, Mus musculus
attggtactgcctttatatgccttt

SEQ ID NO: 284975 - DNA, 25 bp, Mus musculus
attggtactgtacatgcctggcttc

SEQ ID NO: 284976 - DNA, 25 bp, Mus musculus
attggtactgtagatgcctggcttc

SEQ ID NO: 284977 - DNA, 25 bp, Mus musculus
attggtaggaccacagttgcagcca

SEQ ID NO: 284978 - DNA, 25 bp, Mus musculus
attggtaggacctcagttgcagcca

SEQ ID NO: 284979 - DNA, 25 bp, Mus musculus
attggtagggcacgtacttctctct

SEQ ID NO: 284980 - DNA, 25 bp, Mus musculus
attggtagggcaggtacttctctct

SEQ ID NO: 284981 - DNA, 25 bp, Mus musculus
attggtagtccacgaacacctgtca

SEQ ID NO: 284982 - DNA, 25 bp, Mus musculus
attggtagtccaggaacacctgtca

SEQ ID NO: 284983 - DNA, 25 bp, Mus musculus
attggtataatacctgcctcacgct

SEQ ID NO: 284984 - DNA, 25 bp, Mus musculus
attggtataatagctgcctcacgct

SEQ ID NO: 284985 - DNA, 25 bp, Mus musculus
attggtatacaacagtttatgccac

SEQ ID NO: 284986 - DNA, 25 bp, Mus musculus
attggtatacaagagtttatgccac

SEQ ID NO: 284987 - DNA, 25 bp, Mus musculus
attggtatcgtaaccacagagtgta

SEQ ID NO: 284988 - DNA, 25 bp, Mus musculus
attggtatcgtatccacagagtgta

SEQ ID NO: 284989 - DNA, 25 bp, Mus musculus
attggtattaccagctgtgtcccca

SEQ ID NO: 284990 - DNA, 25 bp, Mus musculus
attggtattacctgctgtgtcccca

SEQ ID NO: 284991 - DNA, 25 bp, Mus musculus
attggtcaaccaacctagtgtcttg

SEQ ID NO: 284992 - DNA, 25 bp, Mus musculus
attggtcaaccatcctagtgtcttg

SEQ ID NO: 284993 - DNA, 25 bp, Mus musculus
attggtcacataacttagtgctagc

SEQ ID NO: 284994 - DNA, 25 bp, Mus musculus
attggtcacatatcttagtgctagc

SEQ ID NO: 284995 - DNA, 25 bp, Mus musculus
attggtcacgttacaatcatgctat

SEQ ID NO: 284996 - DNA, 25 bp, Mus musculus
attggtcacgttatcctatcaaggc

SEQ ID NO: 284997 - DNA, 25 bp, Mus musculus
attggtcacgtttcaatcatgctat

SEQ ID NO: 284998 - DNA, 25 bp, Mus musculus
attggtcacgttttcctatcaaggc

SEQ ID NO: 284999 - DNA, 25 bp, Mus musculus
attggtcagcaaagtttcagccgag

SEQ ID NO: 285000 - DNA, 25 bp, Mus musculus
attggtcagcaatgtttcagccgag

SEQ ID NO: 285001 - DNA, 25 bp, Mus musculus
attggtcagccaatgaattacatta

SEQ ID NO: 285002 - DNA, 25 bp, Mus musculus
attggtcagccattgaattacatta

SEQ ID NO: 285003 - DNA, 25 bp, Mus musculus
attggtcagcttaaccattagctta

SEQ ID NO: 285004 - DNA, 25 bp, Mus musculus
attggtcagctttaccattagctta

SEQ ID NO: 285005 - DNA, 25 bp, Mus musculus
attggtcagtgaaaccgtgctttta

SEQ ID NO: 285006 - DNA, 25 bp, Mus musculus
attggtcagtgataccgtgctttta

SEQ ID NO: 285007 - DNA, 25 bp, Mus musculus
attggtcatgggatgacaatggccc

SEQ ID NO: 285008 - DNA, 25 bp, Mus musculus
attggtcatgggttgacaatggccc

SEQ ID NO: 285009 - DNA, 25 bp, Mus musculus
attggtcattatcgacgtgaagcca

SEQ ID NO: 285010 - DNA, 25 bp, Mus musculus
attggtcattatggacgtgaagcca

SEQ ID NO: 285011 - DNA, 25 bp, Mus musculus
attggtccagacaagtaccccatga

SEQ ID NO: 285012 - DNA, 25 bp, Mus musculus
attggtccagactagtaccccatga

SEQ ID NO: 285013 - DNA, 25 bp, Mus musculus
attggtccatgtctgatttagcttt

SEQ ID NO: 285014 - DNA, 25 bp, Mus musculus
attggtccatgtgtgatttagcttt

SEQ ID NO: 285015 - DNA, 25 bp, Mus musculus
attggtccattgcaactaagccaaa

SEQ ID NO: 285016 - DNA, 25 bp, Mus musculus
attggtccattggaactaagccaaa

SEQ ID NO: 285017 - DNA, 25 bp, Mus musculus
attggtcccagacatcttttgtcct

SEQ ID NO: 285018 - DNA, 25 bp, Mus musculus
attggtcccagagatcttttgtcct

SEQ ID NO: 285019 - DNA, 25 bp, Mus musculus
attggtccccacattactgactgta

SEQ ID NO: 285020 - DNA, 25 bp, Mus musculus
attggtccccactttactgactgta

SEQ ID NO: 285021 - DNA, 25 bp, Mus musculus
attggtccctctaattatagtattg

SEQ ID NO: 285022 - DNA, 25 bp, Mus musculus
attggtccctcttattatagtattg

SEQ ID NO: 285023 - DNA, 25 bp, Mus musculus
attggtccctttctgtctctgttta

SEQ ID NO: 285024 - DNA, 25 bp, Mus musculus
attggtccctttgtgtctctgttta

SEQ ID NO: 285025 - DNA, 25 bp, Mus musculus
attggtcctaccatgcctggaagga

SEQ ID NO: 285026 - DNA, 25 bp, Mus musculus
attggtcctaccttgcctggaagga

SEQ ID NO: 285027 - DNA, 25 bp, Mus musculus
attggtcctgcaactacatgagtgt

SEQ ID NO: 285028 - DNA, 25 bp, Mus musculus
attggtcctgcacagtgatgttgat

SEQ ID NO: 285029 - DNA, 25 bp, Mus musculus
attggtcctgcagagtgatgttgat

SEQ ID NO: 285030 - DNA, 25 bp, Mus musculus
attggtcctgcatctacatgagtgt

SEQ ID NO: 285031 - DNA, 25 bp, Mus musculus
attggtcctgctcggagagtctgca

SEQ ID NO: 285032 - DNA, 25 bp, Mus musculus
attggtcctgctgggagagtctgca

SEQ ID NO: 285033 - DNA, 25 bp, Mus musculus
attggtcgaggcaatgccctggtga

SEQ ID NO: 285034 - DNA, 25 bp, Mus musculus
attggtcgaggctatgccctggtga

SEQ ID NO: 285035 - DNA, 25 bp, Mus musculus
attggtctataaacctttctcaggt

SEQ ID NO: 285036 - DNA, 25 bp, Mus musculus
attggtctataatcctttctcaggt

SEQ ID NO: 285037 - DNA, 25 bp, Mus musculus
attggtctatatcctagggcaccgc

SEQ ID NO: 285038 - DNA, 25 bp, Mus musculus
attggtctatatgctagggcaccgc

SEQ ID NO: 285039 - DNA, 25 bp, Mus musculus
attggtctattcaaagggcctgagg

SEQ ID NO: 285040 - DNA, 25 bp, Mus musculus
attggtctattctaagggcctgagg

SEQ ID NO: 285041 - DNA, 25 bp, Mus musculus
attggtctatttcctgtatgtgtgg

SEQ ID NO: 285042 - DNA, 25 bp, Mus musculus
attggtctatttgctgtatgtgtgg

SEQ ID NO: 285043 - DNA, 25 bp, Mus musculus
attggtctcacaattacctgctcct

SEQ ID NO: 285044 - DNA, 25 bp, Mus musculus
attggtctcacatttacctgctcct

SEQ ID NO: 285045 - DNA, 25 bp, Mus musculus
attggtctcatgctgaaggaagctt

SEQ ID NO: 285046 - DNA, 25 bp, Mus musculus
attggtctcatggtgaaggaagctt

SEQ ID NO: 285047 - DNA, 25 bp, Mus musculus
attggtctccttatgttatctggtc

SEQ ID NO: 285048 - DNA, 25 bp, Mus musculus
attggtctccttttgttatctggtc

SEQ ID NO: 285049 - DNA, 25 bp, Mus musculus
attggtctgaccactaacccattgt

SEQ ID NO: 285050 - DNA, 25 bp, Mus musculus
attggtctgacctctaacccattgt

SEQ ID NO: 285051 - DNA, 25 bp, Mus musculus
attggtctgcaaaaactcatcaggt

SEQ ID NO: 285052 - DNA, 25 bp, Mus musculus
attggtctgcaataactcatcaggt

SEQ ID NO: 285053 - DNA, 25 bp, Mus musculus
attggtctgcgaatttccagccagg

SEQ ID NO: 285054 - DNA, 25 bp, Mus musculus
attggtctgcgattttccagccagg

SEQ ID NO: 285055 - DNA, 25 bp, Mus musculus
attggtctgtcaacctgtgatggac

SEQ ID NO: 285056 - DNA, 25 bp, Mus musculus
attggtctgtcatcctgtgatggac

SEQ ID NO: 285057 - DNA, 25 bp, Mus musculus
attggtctgtctctgcctgcttcct

SEQ ID NO: 285058 - DNA, 25 bp, Mus musculus
attggtctgtctgtgcctgcttcct

SEQ ID NO: 285059 - DNA, 25 bp, Mus musculus
attggtcttcccacaaagtcttgga

SEQ ID NO: 285060 - DNA, 25 bp, Mus musculus
attggtcttccctcaaagtcttgga

SEQ ID NO: 285061 - DNA, 25 bp, Mus musculus
attggtcttgtacgtaacatcttca

SEQ ID NO: 285062 - DNA, 25 bp, Mus musculus
attggtcttgtaggtaacatcttca

SEQ ID NO: 285063 - DNA, 25 bp, Mus musculus
attggtcttttgctttgcatttctg

SEQ ID NO: 285064 - DNA, 25 bp, Mus musculus
attggtcttttggtttgcatttctg

SEQ ID NO: 285065 - DNA, 25 bp, Mus musculus
attggtgaaaggaacactgccccag

SEQ ID NO: 285066 - DNA, 25 bp, Mus musculus
attggtgaaaggtacactgccccag

SEQ ID NO: 285067 - DNA, 25 bp, Mus musculus
attggtgaacttagaatccctccct

SEQ ID NO: 285068 - DNA, 25 bp, Mus musculus
attggtgaactttgaatccctccct

SEQ ID NO: 285069 - DNA, 25 bp, Mus musculus
attggtgaagcaaggctcagctact

SEQ ID NO: 285070 - DNA, 25 bp, Mus musculus
attggtgaagcatggctcagctact

SEQ ID NO: 285071 - DNA, 25 bp, Mus musculus
attggtgaccatctacagccacgag

SEQ ID NO: 285072 - DNA, 25 bp, Mus musculus
attggtgaccatgtacagccacgag

SEQ ID NO: 285073 - DNA, 25 bp, Mus musculus
attggtgacctactgctaacaactt

SEQ ID NO: 285074 - DNA, 25 bp, Mus musculus
attggtgacctagtgctaacaactt

SEQ ID NO: 285075 - DNA, 25 bp, Mus musculus
attggtgacctgacaagtgcctggc

SEQ ID NO: 285076 - DNA, 25 bp, Mus musculus
attggtgacctgtcaagtgcctggc

SEQ ID NO: 285077 - DNA, 25 bp, Mus musculus
attggtgacgtaagtctacctcctg

SEQ ID NO: 285078 - DNA, 25 bp, Mus musculus
attggtgacgtatgtctacctcctg

SEQ ID NO: 285079 - DNA, 25 bp, Mus musculus
attggtgacgtccagattgcctgca

SEQ ID NO: 285080 - DNA, 25 bp, Mus musculus
attggtgacgtcgagattgcctgca

SEQ ID NO: 285081 - DNA, 25 bp, Mus musculus
attggtgactgcaatgacatgctgt

SEQ ID NO: 285082 - DNA, 25 bp, Mus musculus
attggtgactgctatgacatgctgt

SEQ ID NO: 285083 - DNA, 25 bp, Mus musculus
attggtgagatcaagggccacgaca

SEQ ID NO: 285084 - DNA, 25 bp, Mus musculus
attggtgagatctagggccacgaca

SEQ ID NO: 285085 - DNA, 25 bp, Mus musculus
attggtgaggcgagagccctcccta

SEQ ID NO: 285086 - DNA, 25 bp, Mus musculus
attggtgaggcgtgagccctcccta

SEQ ID NO: 285087 - DNA, 25 bp, Mus musculus
attggtgagttaaggtcgatttgaa

SEQ ID NO: 285088 - DNA, 25 bp, Mus musculus
attggtgagttatggtcgatttgaa

SEQ ID NO: 285089 - DNA, 25 bp, Mus musculus
attggtgatcggcattgccaggccc

SEQ ID NO: 285090 - DNA, 25 bp, Mus musculus
attggtgatcgggattgccaggccc

SEQ ID NO: 285091 - DNA, 25 bp, Mus musculus
attggtgcaaccctagttttgagga

SEQ ID NO: 285092 - DNA, 25 bp, Mus musculus
attggtgcaaccgtagttttgagga

SEQ ID NO: 285093 - DNA, 25 bp, Mus musculus
attggtgcagtgatgccccttgaac

SEQ ID NO: 285094 - DNA, 25 bp, Mus musculus
attggtgcagtgttgccccttgaac

SEQ ID NO: 285095 - DNA, 25 bp, Mus musculus
attggtgccaagattgacatcgata

SEQ ID NO: 285096 - DNA, 25 bp, Mus musculus
attggtgccaagtttgacatcgata

SEQ ID NO: 285097 - DNA, 25 bp, Mus musculus
attggtgcccagacccaacctcaca

SEQ ID NO: 285098 - DNA, 25 bp, Mus musculus
attggtgcccagtcccaacctcaca

SEQ ID NO: 285099 - DNA, 25 bp, Mus musculus
attggtgcccgtcggtgaatatcac

SEQ ID NO: 285100 - DNA, 25 bp, Mus musculus
attggtgcccgtgggtgaatatcac

SEQ ID NO: 285101 - DNA, 25 bp, Mus musculus
attggtgctaatcaagacaccggac

SEQ ID NO: 285102 - DNA, 25 bp, Mus musculus
attggtgctaatgaagacaccggac

SEQ ID NO: 285103 - DNA, 25 bp, Mus musculus
attggtgctagacagtggatttgtt

SEQ ID NO: 285104 - DNA, 25 bp, Mus musculus
attggtgctagagagtggatttgtt

SEQ ID NO: 285105 - DNA, 25 bp, Mus musculus
attggtgctcatctgtttgagtaga

SEQ ID NO: 285106 - DNA, 25 bp, Mus musculus
attggtgctcatgtgtttgagtaga

SEQ ID NO: 285107 - DNA, 25 bp, Mus musculus
attggtgctctaagtatcccttctc

SEQ ID NO: 285108 - DNA, 25 bp, Mus musculus
attggtgctctatgtatcccttctc

SEQ ID NO: 285109 - DNA, 25 bp, Mus musculus
attggtgctgttcagtttgttcttc

SEQ ID NO: 285110 - DNA, 25 bp, Mus musculus
attggtgctgttgagtttgttcttc

SEQ ID NO: 285111 - DNA, 25 bp, Mus musculus
attggtgctttgactcgggttatac

SEQ ID NO: 285112 - DNA, 25 bp, Mus musculus
attggtgctttgtctcgggttatac

SEQ ID NO: 285113 - DNA, 25 bp, Mus musculus
attggtggaagcacagttggctcct

SEQ ID NO: 285114 - DNA, 25 bp, Mus musculus
attggtggaagctcagttggctcct

SEQ ID NO: 285115 - DNA, 25 bp, Mus musculus
attggtggacacattctggctcacg

SEQ ID NO: 285116 - DNA, 25 bp, Mus musculus
attggtggacactttctggctcacg

SEQ ID NO: 285117 - DNA, 25 bp, Mus musculus
attggtggcagcatgttcacaacaa

SEQ ID NO: 285118 - DNA, 25 bp, Mus musculus
attggtggcagcttgttcacaacaa

SEQ ID NO: 285119 - DNA, 25 bp, Mus musculus
attggtggccggcttgtatgacata

SEQ ID NO: 285120 - DNA, 25 bp, Mus musculus
attggtggccgggttgtatgacata

SEQ ID NO: 285121 - DNA, 25 bp, Mus musculus
attggtgggaaacgaactgctcgta

SEQ ID NO: 285122 - DNA, 25 bp, Mus musculus
attggtgggaaaggaactgctcgta

SEQ ID NO: 285123 - DNA, 25 bp, Mus musculus
attggtgggtgtaactgagttcctt

SEQ ID NO: 285124 - DNA, 25 bp, Mus musculus
attggtgggtgttactgagttcctt

SEQ ID NO: 285125 - DNA, 25 bp, Mus musculus
attggtggtcgtccattcctggcca

SEQ ID NO: 285126 - DNA, 25 bp, Mus musculus
attggtggtcgtgcattcctggcca

SEQ ID NO: 285127 - DNA, 25 bp, Mus musculus
attggtggtgctcatccttggagtc

SEQ ID NO: 285128 - DNA, 25 bp, Mus musculus
attggtggtgctgatccttggagtc

SEQ ID NO: 285129 - DNA, 25 bp, Mus musculus
attggtggttaccttgcctcatcaa

SEQ ID NO: 285130 - DNA, 25 bp, Mus musculus
attggtggttacgttgcctcatcaa

SEQ ID NO: 285131 - DNA, 25 bp, Mus musculus
attggtgtaacacccttcattatgc

SEQ ID NO: 285132 - DNA, 25 bp, Mus musculus
attggtgtaacagccttcattatgc

SEQ ID NO: 285133 - DNA, 25 bp, Mus musculus
attggtgtatttctgctccagcagc

SEQ ID NO: 285134 - DNA, 25 bp, Mus musculus
attggtgtatttgtgctccagcagc

SEQ ID NO: 285135 - DNA, 25 bp, Mus musculus
attggtgtcaccatagttcaacatt

SEQ ID NO: 285136 - DNA, 25 bp, Mus musculus
attggtgtcaccttagttcaacatt

SEQ ID NO: 285137 - DNA, 25 bp, Mus musculus
attggtgtccatacactggccgtga

SEQ ID NO: 285138 - DNA, 25 bp, Mus musculus
attggtgtccattcactggccgtga

SEQ ID NO: 285139 - DNA, 25 bp, Mus musculus
attggtgtcgtgagttcagctggcc

SEQ ID NO: 285140 - DNA, 25 bp, Mus musculus
attggtgtcgtgtgttcagctggcc

SEQ ID NO: 285141 - DNA, 25 bp, Mus musculus
attggtgtgccgattaaagtcttgc

SEQ ID NO: 285142 - DNA, 25 bp, Mus musculus
attggtgtgccgtttaaagtcttgc

SEQ ID NO: 285143 - DNA, 25 bp, Mus musculus
attggtgtgtttattgcccaggaca

SEQ ID NO: 285144 - DNA, 25 bp, Mus musculus
attggtgtgttttttgcccaggaca

SEQ ID NO: 285145 - DNA, 25 bp, Mus musculus
attggtgttcatctagctggaacct

SEQ ID NO: 285146 - DNA, 25 bp, Mus musculus
attggtgttcatgtagctggaacct

SEQ ID NO: 285147 - DNA, 25 bp, Mus musculus
attggtgttgatatttcaagctttt

SEQ ID NO: 285148 - DNA, 25 bp, Mus musculus
attggtgttgatctggagtctctta

SEQ ID NO: 285149 - DNA, 25 bp, Mus musculus
attggtgttgatgtggagtctctta

SEQ ID NO: 285150 - DNA, 25 bp, Mus musculus
attggtgttgatttttcaagctttt

SEQ ID NO: 285151 - DNA, 25 bp, Mus musculus
attggtgtttctaggcgataggctc

SEQ ID NO: 285152 - DNA, 25 bp, Mus musculus
attggtgtttcttggcgataggctc

SEQ ID NO: 285153 - DNA, 25 bp, Mus musculus
attggttaacaaatattcctagcta

SEQ ID NO: 285154 - DNA, 25 bp, Mus musculus
attggttaacaattattcctagcta

SEQ ID NO: 285155 - DNA, 25 bp, Mus musculus
attggttaaggcctattatcaggta

SEQ ID NO: 285156 - DNA, 25 bp, Mus musculus
attggttaaggcgtattatcaggta

SEQ ID NO: 285157 - DNA, 25 bp, Mus musculus
attggttactagagatatgattatt

SEQ ID NO: 285158 - DNA, 25 bp, Mus musculus
attggttactagtgatatgattatt

SEQ ID NO: 285159 - DNA, 25 bp, Mus musculus
attggttagccaagtagagcgttaa

SEQ ID NO: 285160 - DNA, 25 bp, Mus musculus
attggttagccatgtagagcgttaa

SEQ ID NO: 285161 - DNA, 25 bp, Mus musculus
attggttaggttaccagcactaggt

SEQ ID NO: 285162 - DNA, 25 bp, Mus musculus
attggttaggtttccagcactaggt

SEQ ID NO: 285163 - DNA, 25 bp, Mus musculus
attggttatttgcatttggagtgat

SEQ ID NO: 285164 - DNA, 25 bp, Mus musculus
attggttatttgctgtgccccaacc

SEQ ID NO: 285165 - DNA, 25 bp, Mus musculus
attggttatttggatttggagtgat

SEQ ID NO: 285166 - DNA, 25 bp, Mus musculus
attggttatttggtgtgccccaacc

SEQ ID NO: 285167 - DNA, 25 bp, Mus musculus
attggttcaaccaagacaggacagt

SEQ ID NO: 285168 - DNA, 25 bp, Mus musculus
attggttcaacctagacaggacagt

SEQ ID NO: 285169 - DNA, 25 bp, Mus musculus
attggttcatctataatttccctgt

SEQ ID NO: 285170 - DNA, 25 bp, Mus musculus
attggttcatctttaatttccctgt

SEQ ID NO: 285171 - DNA, 25 bp, Mus musculus
attggttccattccgtgattgccta

SEQ ID NO: 285172 - DNA, 25 bp, Mus musculus
attggttccattgcgtgattgccta

SEQ ID NO: 285173 - DNA, 25 bp, Mus musculus
attggttcccagagtcctgaagcca

SEQ ID NO: 285174 - DNA, 25 bp, Mus musculus
attggttcccagtgtcctgaagcca

SEQ ID NO: 285175 - DNA, 25 bp, Mus musculus
attggttccgttcagtaccttcatg

SEQ ID NO: 285176 - DNA, 25 bp, Mus musculus
attggttccgttgagtaccttcatg

SEQ ID NO: 285177 - DNA, 25 bp, Mus musculus
attggttcctacagacatattcatc

SEQ ID NO: 285178 - DNA, 25 bp, Mus musculus
attggttcctactgacatattcatc

SEQ ID NO: 285179 - DNA, 25 bp, Mus musculus
attggttcttccagacttggtttat

SEQ ID NO: 285180 - DNA, 25 bp, Mus musculus
attggttcttcctgacttggtttat

SEQ ID NO: 285181 - DNA, 25 bp, Mus musculus
attggttgtgcccaaaacaattctt

SEQ ID NO: 285182 - DNA, 25 bp, Mus musculus
attggttgtgccgaaaacaattctt

SEQ ID NO: 285183 - DNA, 25 bp, Mus musculus
attggtttagtcaataaatggacgt

SEQ ID NO: 285184 - DNA, 25 bp, Mus musculus
attggtttagtctataaatggacgt

SEQ ID NO: 285185 - DNA, 25 bp, Mus musculus
attggtttcagaactacagcatcaa

SEQ ID NO: 285186 - DNA, 25 bp, Mus musculus
attggtttcagatctacagcatcaa

SEQ ID NO: 285187 - DNA, 25 bp, Mus musculus
attggtttccacagaaccattgtta

SEQ ID NO: 285188 - DNA, 25 bp, Mus musculus
attggtttccacagcactaggtttc

SEQ ID NO: 285189 - DNA, 25 bp, Mus musculus
attggtttccactgaaccattgtta

SEQ ID NO: 285190 - DNA, 25 bp, Mus musculus
attggtttccactgcactaggtttc

SEQ ID NO: 285191 - DNA, 25 bp, Mus musculus
attggtttgacccaccgggcatatg

SEQ ID NO: 285192 - DNA, 25 bp, Mus musculus
attggtttgaccgaccgggcatatg

SEQ ID NO: 285193 - DNA, 25 bp, Mus musculus
attggtttgcacaagttccctggag

SEQ ID NO: 285194 - DNA, 25 bp, Mus musculus
attggtttgcactagttccctggag

SEQ ID NO: 285195 - DNA, 25 bp, Mus musculus
attggtttgctacagcgagctcaga

SEQ ID NO: 285196 - DNA, 25 bp, Mus musculus
attggtttgctagagcgagctcaga

SEQ ID NO: 285197 - DNA, 25 bp, Mus musculus
attggtttgtatcgccacgtgcatt

SEQ ID NO: 285198 - DNA, 25 bp, Mus musculus
attggtttgtatggccacgtgcatt

SEQ ID NO: 285199 - DNA, 25 bp, Mus musculus
attggtttgttcaagtcagctctcc

SEQ ID NO: 285200 - DNA, 25 bp, Mus musculus
attggtttgttcatggcccttcagg

SEQ ID NO: 285201 - DNA, 25 bp, Mus musculus
attggtttgttctagtcagctctcc

SEQ ID NO: 285202 - DNA, 25 bp, Mus musculus
attggtttgttcttggcccttcagg

SEQ ID NO: 285203 - DNA, 25 bp, Mus musculus
attggttttcagaattggcccagct

SEQ ID NO: 285204 - DNA, 25 bp, Mus musculus
attggttttcagtattggcccagct

SEQ ID NO: 285205 - DNA, 25 bp, Mus musculus
attggttttcccaggagtgaaatca

SEQ ID NO: 285206 - DNA, 25 bp, Mus musculus
attggttttccctggagtgaaatca

SEQ ID NO: 285207 - DNA, 25 bp, Mus musculus
attggttttcttaatttcatcactg

SEQ ID NO: 285208 - DNA, 25 bp, Mus musculus
attggttttcttcctcagtgtcaga

SEQ ID NO: 285209 - DNA, 25 bp, Mus musculus
attggttttcttgctcagtgtcaga

SEQ ID NO: 285210 - DNA, 25 bp, Mus musculus
attggttttctttatttcatcactg

SEQ ID NO: 285211 - DNA, 25 bp, Mus musculus
attggttttgctccttgatgttcac

SEQ ID NO: 285212 - DNA, 25 bp, Mus musculus
attggttttgctctgtcctgaagaa

SEQ ID NO: 285213 - DNA, 25 bp, Mus musculus
attggttttgctgcttgatgttcac

SEQ ID NO: 285214 - DNA, 25 bp, Mus musculus
attggttttgctgtgtcctgaagaa

SEQ ID NO: 285215 - DNA, 25 bp, Mus musculus
attgtaaatcgcaggcagatgcctt

SEQ ID NO: 285216 - DNA, 25 bp, Mus musculus
attgtaaatcgctggcagatgcctt

SEQ ID NO: 285217 - DNA, 25 bp, Mus musculus
attgtaaccagtcctttggctactt

SEQ ID NO: 285218 - DNA, 25 bp, Mus musculus
attgtaaccagtgctttggctactt

SEQ ID NO: 285219 - DNA, 25 bp, Mus musculus
attgtaacctttcttgtcactgtag

SEQ ID NO: 285220 - DNA, 25 bp, Mus musculus
attgtaacctttgttgtcactgtag

SEQ ID NO: 285221 - DNA, 25 bp, Mus musculus
attgtaagagccaccacactgactt

SEQ ID NO: 285222 - DNA, 25 bp, Mus musculus
attgtaagagcctccacactgactt

SEQ ID NO: 285223 - DNA, 25 bp, Mus musculus
attgtaagcttaagccagggcccag

SEQ ID NO: 285224 - DNA, 25 bp, Mus musculus
attgtaagcttatgccagggcccag

SEQ ID NO: 285225 - DNA, 25 bp, Mus musculus
attgtaatacaaccttttggattag

SEQ ID NO: 285226 - DNA, 25 bp, Mus musculus
attgtaatacaagcttttggattag

SEQ ID NO: 285227 - DNA, 25 bp, Mus musculus
attgtaatactcatctctcgttggt

SEQ ID NO: 285228 - DNA, 25 bp, Mus musculus
attgtaatactcttctctcgttggt

SEQ ID NO: 285229 - DNA, 25 bp, Mus musculus
attgtaatcacaaccagtccactaa

SEQ ID NO: 285230 - DNA, 25 bp, Mus musculus
attgtaatcacatccagtccactaa

SEQ ID NO: 285231 - DNA, 25 bp, Mus musculus
attgtaatcttcaggcctggagacc

SEQ ID NO: 285232 - DNA, 25 bp, Mus musculus
attgtaatcttctggcctggagacc

SEQ ID NO: 285233 - DNA, 25 bp, Mus musculus
attgtaatggcgatgactggcgtca

SEQ ID NO: 285234 - DNA, 25 bp, Mus musculus
attgtaatggcgttgactggcgtca

SEQ ID NO: 285235 - DNA, 25 bp, Mus musculus
attgtaattcttcccacactgaagt

SEQ ID NO: 285236 - DNA, 25 bp, Mus musculus
attgtaattcttgccacactgaagt

SEQ ID NO: 285237 - DNA, 25 bp, Mus musculus
attgtacaatgtatccctacaacag

SEQ ID NO: 285238 - DNA, 25 bp, Mus musculus
attgtacaatgtttccctacaacag

SEQ ID NO: 285239 - DNA, 25 bp, Mus musculus
attgtacaattgatcagagcttaac

SEQ ID NO: 285240 - DNA, 25 bp, Mus musculus
attgtacaattgttcagagcttaac

SEQ ID NO: 285241 - DNA, 25 bp, Mus musculus
attgtacactctcagtaaccccagc

SEQ ID NO: 285242 - DNA, 25 bp, Mus musculus
attgtacactctgagtaaccccagc

SEQ ID NO: 285243 - DNA, 25 bp, Mus musculus
attgtacataaccacctcattctcc

SEQ ID NO: 285244 - DNA, 25 bp, Mus musculus
attgtacataacgacctcattctcc

SEQ ID NO: 285245 - DNA, 25 bp, Mus musculus
attgtacataccactctttgcttat

SEQ ID NO: 285246 - DNA, 25 bp, Mus musculus
attgtacatacctctctttgcttat

SEQ ID NO: 285247 - DNA, 25 bp, Mus musculus
attgtacatgcaagccttttgtcct

SEQ ID NO: 285248 - DNA, 25 bp, Mus musculus
attgtacatgcatgccttttgtcct

SEQ ID NO: 285249 - DNA, 25 bp, Mus musculus
attgtacatggacaggctttacccc

SEQ ID NO: 285250 - DNA, 25 bp, Mus musculus
attgtacatggagaggctttacccc

SEQ ID NO: 285251 - DNA, 25 bp, Mus musculus
attgtaccaggcattgggcccactg

SEQ ID NO: 285252 - DNA, 25 bp, Mus musculus
attgtaccaggctttgggcccactg

SEQ ID NO: 285253 - DNA, 25 bp, Mus musculus
attgtaccatttctgaacttcatca

SEQ ID NO: 285254 - DNA, 25 bp, Mus musculus
attgtaccatttgtgaacttcatca

SEQ ID NO: 285255 - DNA, 25 bp, Mus musculus
attgtacccacccatggtgtggcat

SEQ ID NO: 285256 - DNA, 25 bp, Mus musculus
attgtacccaccgatggtgtggcat

SEQ ID NO: 285257 - DNA, 25 bp, Mus musculus
attgtacccagactctgtccccaga

SEQ ID NO: 285258 - DNA, 25 bp, Mus musculus
attgtacccagagtctgtccccaga

SEQ ID NO: 285259 - DNA, 25 bp, Mus musculus
attgtaccgtgtctaatatcagcta

SEQ ID NO: 285260 - DNA, 25 bp, Mus musculus
attgtaccgtgtgtaatatcagcta

SEQ ID NO: 285261 - DNA, 25 bp, Mus musculus
attgtacctagaatcctgtcttgtt

SEQ ID NO: 285262 - DNA, 25 bp, Mus musculus
attgtacctagattcctgtcttgtt

SEQ ID NO: 285263 - DNA, 25 bp, Mus musculus
attgtacctataatcacccacttgg

SEQ ID NO: 285264 - DNA, 25 bp, Mus musculus
attgtacctatattcacccacttgg

SEQ ID NO: 285265 - DNA, 25 bp, Mus musculus
attgtacctcatatcactattggga

SEQ ID NO: 285266 - DNA, 25 bp, Mus musculus
attgtacctcatttcactattggga

SEQ ID NO: 285267 - DNA, 25 bp, Mus musculus
attgtaccttttacccatacttgat

SEQ ID NO: 285268 - DNA, 25 bp, Mus musculus
attgtacctttttcccatacttgat

SEQ ID NO: 285269 - DNA, 25 bp, Mus musculus
attgtacgacttacgatggcatcga

SEQ ID NO: 285270 - DNA, 25 bp, Mus musculus
attgtacgactttcgatggcatcga

SEQ ID NO: 285271 - DNA, 25 bp, Mus musculus
attgtacgatctatgcggactgcag

SEQ ID NO: 285272 - DNA, 25 bp, Mus musculus
attgtacgatctttgcggactgcag

SEQ ID NO: 285273 - DNA, 25 bp, Mus musculus
attgtacggcacacaagcagcgtgt

SEQ ID NO: 285274 - DNA, 25 bp, Mus musculus
attgtacggcactcaagcagcgtgt

SEQ ID NO: 285275 - DNA, 25 bp, Mus musculus
attgtacgtcagcaatctgcctttc

SEQ ID NO: 285276 - DNA, 25 bp, Mus musculus
attgtacgtcaggaatctgcctttc

SEQ ID NO: 285277 - DNA, 25 bp, Mus musculus
attgtacgttgccacagaagccccg

SEQ ID NO: 285278 - DNA, 25 bp, Mus musculus
attgtacgttgcgacagaagccccg

SEQ ID NO: 285279 - DNA, 25 bp, Mus musculus
attgtactacacaatacctgtttgt

SEQ ID NO: 285280 - DNA, 25 bp, Mus musculus
attgtactacactatacctgtttgt

SEQ ID NO: 285281 - DNA, 25 bp, Mus musculus
attgtactagtccttcttgtaggca

SEQ ID NO: 285282 - DNA, 25 bp, Mus musculus
attgtactagtcgttcttgtaggca

SEQ ID NO: 285283 - DNA, 25 bp, Mus musculus
attgtactcagtccagccatattta

SEQ ID NO: 285284 - DNA, 25 bp, Mus musculus
attgtactcagtgcagccatattta

SEQ ID NO: 285285 - DNA, 25 bp, Mus musculus
attgtactccaaaatatagccatca

SEQ ID NO: 285286 - DNA, 25 bp, Mus musculus
attgtactccaatatatagccatca

SEQ ID NO: 285287 - DNA, 25 bp, Mus musculus
attgtactcttcaaggctggaccga

SEQ ID NO: 285288 - DNA, 25 bp, Mus musculus
attgtactcttctaggctggaccga

SEQ ID NO: 285289 - DNA, 25 bp, Mus musculus
attgtactgacaaagagctgccttc

SEQ ID NO: 285290 - DNA, 25 bp, Mus musculus
attgtactgacatagagctgccttc

SEQ ID NO: 285291 - DNA, 25 bp, Mus musculus
attgtactgccaatcctaatgtatt

SEQ ID NO: 285292 - DNA, 25 bp, Mus musculus
attgtactgccattcctaatgtatt

SEQ ID NO: 285293 - DNA, 25 bp, Mus musculus
attgtactgctaaatgtggacactt

SEQ ID NO: 285294 - DNA, 25 bp, Mus musculus
attgtactgctatatgtggacactt

SEQ ID NO: 285295 - DNA, 25 bp, Mus musculus
attgtactggccctttctagctgtg

SEQ ID NO: 285296 - DNA, 25 bp, Mus musculus
attgtactggccgtttctagctgtg

SEQ ID NO: 285297 - DNA, 25 bp, Mus musculus
attgtactgggacctgtgatctcca

SEQ ID NO: 285298 - DNA, 25 bp, Mus musculus
attgtactgggagctgtgatctcca

SEQ ID NO: 285299 - DNA, 25 bp, Mus musculus
attgtactgtgtctgaacacctgga

SEQ ID NO: 285300 - DNA, 25 bp, Mus musculus
attgtactgtgtgtgaacacctgga

SEQ ID NO: 285301 - DNA, 25 bp, Mus musculus
attgtactgttcagccttgaaaggc

SEQ ID NO: 285302 - DNA, 25 bp, Mus musculus
attgtactgttctgccttgaaaggc

SEQ ID NO: 285303 - DNA, 25 bp, Mus musculus
attgtactttatctgtgtgctcgga

SEQ ID NO: 285304 - DNA, 25 bp, Mus musculus
attgtactttatgtgtgtgctcgga

SEQ ID NO: 285305 - DNA, 25 bp, Mus musculus
attgtagacacacgcacctctctgc

SEQ ID NO: 285306 - DNA, 25 bp, Mus musculus
attgtagacacaggcacctctctgc

SEQ ID NO: 285307 - DNA, 25 bp, Mus musculus
attgtagacagcagtgctgccttgg

SEQ ID NO: 285308 - DNA, 25 bp, Mus musculus
attgtagacagctgtgctgccttgg

SEQ ID NO: 285309 - DNA, 25 bp, Mus musculus
attgtagacaggcacatttcttttc

SEQ ID NO: 285310 - DNA, 25 bp, Mus musculus
attgtagacagggacatttcttttc

SEQ ID NO: 285311 - DNA, 25 bp, Mus musculus
attgtagacagtaagctccggcctc

SEQ ID NO: 285312 - DNA, 25 bp, Mus musculus
attgtagacagttagctccggcctc

SEQ ID NO: 285313 - DNA, 25 bp, Mus musculus
attgtagacattcccttgaacccca

SEQ ID NO: 285314 - DNA, 25 bp, Mus musculus
attgtagacattgccttgaacccca

SEQ ID NO: 285315 - DNA, 25 bp, Mus musculus
attgtagaccataagcagccataga

SEQ ID NO: 285316 - DNA, 25 bp, Mus musculus
attgtagaccattagcagccataga

SEQ ID NO: 285317 - DNA, 25 bp, Mus musculus
attgtagagcatcctgaagctggaa

SEQ ID NO: 285318 - DNA, 25 bp, Mus musculus
attgtagagcatgctgaagctggaa

SEQ ID NO: 285319 - DNA, 25 bp, Mus musculus
attgtagagctaactgcgcaccggg

SEQ ID NO: 285320 - DNA, 25 bp, Mus musculus
attgtagagctatctgcgcaccggg

SEQ ID NO: 285321 - DNA, 25 bp, Mus musculus
attgtagcaaggatccagtttgttg

SEQ ID NO: 285322 - DNA, 25 bp, Mus musculus
attgtagcaaggttccagtttgttg

SEQ ID NO: 285323 - DNA, 25 bp, Mus musculus
attgtagcctagacatttctctgcc

SEQ ID NO: 285324 - DNA, 25 bp, Mus musculus
attgtagcctagtcatttctctgcc

SEQ ID NO: 285325 - DNA, 25 bp, Mus musculus
attgtagcctttctggtccctgatc

SEQ ID NO: 285326 - DNA, 25 bp, Mus musculus
attgtagcctttgtggtccctgatc

SEQ ID NO: 285327 - DNA, 25 bp, Mus musculus
attgtagcgtgtccacctgtgccct

SEQ ID NO: 285328 - DNA, 25 bp, Mus musculus
attgtagcgtgtgcacctgtgccct

SEQ ID NO: 285329 - DNA, 25 bp, Mus musculus
attgtagctactcaattgcctctca

SEQ ID NO: 285330 - DNA, 25 bp, Mus musculus
attgtagctactgaattgcctctca

SEQ ID NO: 285331 - DNA, 25 bp, Mus musculus
attgtagctgagcttcgttccacca

SEQ ID NO: 285332 - DNA, 25 bp, Mus musculus
attgtagctgaggttcgttccacca

SEQ ID NO: 285333 - DNA, 25 bp, Mus musculus
attgtagctgttcccactgggatgt

SEQ ID NO: 285334 - DNA, 25 bp, Mus musculus
attgtagctgttgccactgggatgt

SEQ ID NO: 285335 - DNA, 25 bp, Mus musculus
attgtagctttgagtacccaacagt

SEQ ID NO: 285336 - DNA, 25 bp, Mus musculus
attgtagctttgatctgaattgaga

SEQ ID NO: 285337 - DNA, 25 bp, Mus musculus
attgtagctttgtgtacccaacagt

SEQ ID NO: 285338 - DNA, 25 bp, Mus musculus
attgtagctttgttctgaattgaga

SEQ ID NO: 285339 - DNA, 25 bp, Mus musculus
attgtagcttttcaccaactcaggc

SEQ ID NO: 285340 - DNA, 25 bp, Mus musculus
attgtagcttttgaccaactcaggc

SEQ ID NO: 285341 - DNA, 25 bp, Mus musculus
attgtaggaaatcctgtgccttccc

SEQ ID NO: 285342 - DNA, 25 bp, Mus musculus
attgtaggaaatgctgtgccttccc

SEQ ID NO: 285343 - DNA, 25 bp, Mus musculus
attgtaggcactccaaaccttcagt

SEQ ID NO: 285344 - DNA, 25 bp, Mus musculus
attgtaggcactgcaaaccttcagt

SEQ ID NO: 285345 - DNA, 25 bp, Mus musculus
attgtaggccggaccaccaagaagt

SEQ ID NO: 285346 - DNA, 25 bp, Mus musculus
attgtaggccggtccaccaagaagt

SEQ ID NO: 285347 - DNA, 25 bp, Mus musculus
attgtaggcctgataacttcatgaa

SEQ ID NO: 285348 - DNA, 25 bp, Mus musculus
attgtaggcctgttaacttcatgaa

SEQ ID NO: 285349 - DNA, 25 bp, Mus musculus
attgtagggtttcagggccaccact

SEQ ID NO: 285350 - DNA, 25 bp, Mus musculus
attgtagggtttgagggccaccact

SEQ ID NO: 285351 - DNA, 25 bp, Mus musculus
attgtaggtggcacgatgcgctcct

SEQ ID NO: 285352 - DNA, 25 bp, Mus musculus
attgtaggtggctcgatgcgctcct

SEQ ID NO: 285353 - DNA, 25 bp, Mus musculus
attgtagtacacacctagaatccta

SEQ ID NO: 285354 - DNA, 25 bp, Mus musculus
attgtagtacactcctagaatccta

SEQ ID NO: 285355 - DNA, 25 bp, Mus musculus
attgtagtacttagcatgagctctt

SEQ ID NO: 285356 - DNA, 25 bp, Mus musculus
attgtagtactttgcatgagctctt

SEQ ID NO: 285357 - DNA, 25 bp, Mus musculus
attgtagtcagcatttaacctccgg

SEQ ID NO: 285358 - DNA, 25 bp, Mus musculus
attgtagtcagcttttaacctccgg

SEQ ID NO: 285359 - DNA, 25 bp, Mus musculus
attgtagtcgcgatgctggaccagc

SEQ ID NO: 285360 - DNA, 25 bp, Mus musculus
attgtagtcgcgttgctggaccagc

SEQ ID NO: 285361 - DNA, 25 bp, Mus musculus
attgtagtgagcatgtgccatcccc

SEQ ID NO: 285362 - DNA, 25 bp, Mus musculus
attgtagtgagcttgtgccatcccc

SEQ ID NO: 285363 - DNA, 25 bp, Mus musculus
attgtagtgctcagcccatatgttc

SEQ ID NO: 285364 - DNA, 25 bp, Mus musculus
attgtagtgctctgcccatatgttc

SEQ ID NO: 285365 - DNA, 25 bp, Mus musculus
attgtatacactagtcctcaggctc

SEQ ID NO: 285366 - DNA, 25 bp, Mus musculus
attgtatacacttgtcctcaggctc

SEQ ID NO: 285367 - DNA, 25 bp, Mus musculus
attgtatacatcacacgaaaccatt

SEQ ID NO: 285368 - DNA, 25 bp, Mus musculus
attgtatacatctcacgaaaccatt

SEQ ID NO: 285369 - DNA, 25 bp, Mus musculus
attgtatacctacctgcagtggcac

SEQ ID NO: 285370 - DNA, 25 bp, Mus musculus
attgtatacctagctgcagtggcac

SEQ ID NO: 285371 - DNA, 25 bp, Mus musculus
attgtatactttcttggctgtgtga

SEQ ID NO: 285372 - DNA, 25 bp, Mus musculus
attgtatactttgttggctgtgtga

SEQ ID NO: 285373 - DNA, 25 bp, Mus musculus
attgtatagctcagactggccccag

SEQ ID NO: 285374 - DNA, 25 bp, Mus musculus
attgtatagctctgactggccccag

SEQ ID NO: 285375 - DNA, 25 bp, Mus musculus
attgtatatctaaaaccctcgttgg

SEQ ID NO: 285376 - DNA, 25 bp, Mus musculus
attgtatatctataaccctcgttgg

SEQ ID NO: 285377 - DNA, 25 bp, Mus musculus
attgtatatggacaggattcagtgc

SEQ ID NO: 285378 - DNA, 25 bp, Mus musculus
attgtatatggagaggattcagtgc

SEQ ID NO: 285379 - DNA, 25 bp, Mus musculus
attgtatattatactgctgcccatg

SEQ ID NO: 285380 - DNA, 25 bp, Mus musculus
attgtatattattctgctgcccatg

SEQ ID NO: 285381 - DNA, 25 bp, Mus musculus
attgtatattcactttaacagaaat

SEQ ID NO: 285382 - DNA, 25 bp, Mus musculus
attgtatattcagtttaacagaaat

SEQ ID NO: 285383 - DNA, 25 bp, Mus musculus
attgtatattcgctatgtattcctt

SEQ ID NO: 285384 - DNA, 25 bp, Mus musculus
attgtatattcggtatgtattcctt

SEQ ID NO: 285385 - DNA, 25 bp, Mus musculus
attgtatccataccggcaagagcga

SEQ ID NO: 285386 - DNA, 25 bp, Mus musculus
attgtatccatagcggcaagagcga

SEQ ID NO: 285387 - DNA, 25 bp, Mus musculus
attgtatccttaagccacacattgc

SEQ ID NO: 285388 - DNA, 25 bp, Mus musculus
attgtatccttatgccacacattgc

SEQ ID NO: 285389 - DNA, 25 bp, Mus musculus
attgtatctacaagccagctgacag

SEQ ID NO: 285390 - DNA, 25 bp, Mus musculus
attgtatctacatgccagctgacag

SEQ ID NO: 285391 - DNA, 25 bp, Mus musculus
attgtatctcatcatctgaatatag

SEQ ID NO: 285392 - DNA, 25 bp, Mus musculus
attgtatctcatgatctgaatatag

SEQ ID NO: 285393 - DNA, 25 bp, Mus musculus
attgtatctgtacactttgcctctg

SEQ ID NO: 285394 - DNA, 25 bp, Mus musculus
attgtatctgtagactttgcctctg

SEQ ID NO: 285395 - DNA, 25 bp, Mus musculus
attgtatcttctatatcttctctcc

SEQ ID NO: 285396 - DNA, 25 bp, Mus musculus
attgtatcttctttatcttctctcc

SEQ ID NO: 285397 - DNA, 25 bp, Mus musculus
attgtatcttgtaaggccatacttg

SEQ ID NO: 285398 - DNA, 25 bp, Mus musculus
attgtatcttgttaggccatacttg

SEQ ID NO: 285399 - DNA, 25 bp, Mus musculus
attgtatgaagtccaccagtccctc

SEQ ID NO: 285400 - DNA, 25 bp, Mus musculus
attgtatgaagtgcaccagtccctc

SEQ ID NO: 285401 - DNA, 25 bp, Mus musculus
attgtatgaggtcttctctcctgca

SEQ ID NO: 285402 - DNA, 25 bp, Mus musculus
attgtatgaggtgttctctcctgca

SEQ ID NO: 285403 - DNA, 25 bp, Mus musculus
attgtatggccgattcttaagacga

SEQ ID NO: 285404 - DNA, 25 bp, Mus musculus
attgtatggccgtttcttaagacga

SEQ ID NO: 285405 - DNA, 25 bp, Mus musculus
attgtatgggtaaggctgctgcctt

SEQ ID NO: 285406 - DNA, 25 bp, Mus musculus
attgtatgggtatggctgctgcctt

SEQ ID NO: 285407 - DNA, 25 bp, Mus musculus
attgtatgtcttagagtttcctctt

SEQ ID NO: 285408 - DNA, 25 bp, Mus musculus
attgtatgtctttgagtttcctctt

SEQ ID NO: 285409 - DNA, 25 bp, Mus musculus
attgtattacagcttcccagagaga

SEQ ID NO: 285410 - DNA, 25 bp, Mus musculus
attgtattacaggttcccagagaga

SEQ ID NO: 285411 - DNA, 25 bp, Mus musculus
attgtattcactctggaactcccag

SEQ ID NO: 285412 - DNA, 25 bp, Mus musculus
attgtattcactgtggaactcccag

SEQ ID NO: 285413 - DNA, 25 bp, Mus musculus
attgtattccctctaaatcgattta

SEQ ID NO: 285414 - DNA, 25 bp, Mus musculus
attgtattccctgtaaatcgattta

SEQ ID NO: 285415 - DNA, 25 bp, Mus musculus
attgtattctttccatggaccttgt

SEQ ID NO: 285416 - DNA, 25 bp, Mus musculus
attgtattctttgcatggaccttgt

SEQ ID NO: 285417 - DNA, 25 bp, Mus musculus
attgtattgagcatggtgacctgga

SEQ ID NO: 285418 - DNA, 25 bp, Mus musculus
attgtattgagcttggtgacctgga

SEQ ID NO: 285419 - DNA, 25 bp, Mus musculus
attgtattgctgcagatgatgtgac

SEQ ID NO: 285420 - DNA, 25 bp, Mus musculus
attgtattgctggagatgatgtgac

SEQ ID NO: 285421 - DNA, 25 bp, Mus musculus
attgtattggcaaccactccttgta

SEQ ID NO: 285422 - DNA, 25 bp, Mus musculus
attgtattggcatccactccttgta

SEQ ID NO: 285423 - DNA, 25 bp, Mus musculus
attgtattgtgccttcttatttaat

SEQ ID NO: 285424 - DNA, 25 bp, Mus musculus
attgtattgtgcgttcttatttaat

SEQ ID NO: 285425 - DNA, 25 bp, Mus musculus
attgtattgttgatgactgctagta

SEQ ID NO: 285426 - DNA, 25 bp, Mus musculus
attgtattgttgttgactgctagta

SEQ ID NO: 285427 - DNA, 25 bp, Mus musculus
attgtatttcctattctcccctttg

SEQ ID NO: 285428 - DNA, 25 bp, Mus musculus
attgtatttccttttctcccctttg

SEQ ID NO: 285429 - DNA, 25 bp, Mus musculus
attgtatttgccactttggtgccca

SEQ ID NO: 285430 - DNA, 25 bp, Mus musculus
attgtatttgcctctttggtgccca

SEQ ID NO: 285431 - DNA, 25 bp, Mus musculus
attgtatttggtcgtctatctaggc

SEQ ID NO: 285432 - DNA, 25 bp, Mus musculus
attgtatttggtggtctatctaggc

SEQ ID NO: 285433 - DNA, 25 bp, Mus musculus
attgtcaaaccacctgatactgagt

SEQ ID NO: 285434 - DNA, 25 bp, Mus musculus
attgtcaaaccagctgatactgagt

SEQ ID NO: 285435 - DNA, 25 bp, Mus musculus
attgtcaacaataatatctcctttc

SEQ ID NO: 285436 - DNA, 25 bp, Mus musculus
attgtcaacaattatatctcctttc

SEQ ID NO: 285437 - DNA, 25 bp, Mus musculus
attgtcaacctgaactgactctgtg

SEQ ID NO: 285438 - DNA, 25 bp, Mus musculus
attgtcaacctgtactgactctgtg

SEQ ID NO: 285439 - DNA, 25 bp, Mus musculus
attgtcaacggacaccaggacccat

SEQ ID NO: 285440 - DNA, 25 bp, Mus musculus
attgtcaacggagaccaggacccat

SEQ ID NO: 285441 - DNA, 25 bp, Mus musculus
attgtcaacgtgaggcctagtggtc

SEQ ID NO: 285442 - DNA, 25 bp, Mus musculus
attgtcaacgtgtggcctagtggtc

SEQ ID NO: 285443 - DNA, 25 bp, Mus musculus
attgtcaagaatctcagctgtcagt

SEQ ID NO: 285444 - DNA, 25 bp, Mus musculus
attgtcaagaatgtcagctgtcagt

SEQ ID NO: 285445 - DNA, 25 bp, Mus musculus
attgtcaagctgcatgctctctgag

SEQ ID NO: 285446 - DNA, 25 bp, Mus musculus
attgtcaagctggatgctctctgag

SEQ ID NO: 285447 - DNA, 25 bp, Mus musculus
attgtcaaggtgcaggacgcagcct

SEQ ID NO: 285448 - DNA, 25 bp, Mus musculus
attgtcaaggtggaggacgcagcct

SEQ ID NO: 285449 - DNA, 25 bp, Mus musculus
attgtcaatggaactcatgaggcga

SEQ ID NO: 285450 - DNA, 25 bp, Mus musculus
attgtcaatggatctcatgaggcga

SEQ ID NO: 285451 - DNA, 25 bp, Mus musculus
attgtcaatgtcaccagcatggtgg

SEQ ID NO: 285452 - DNA, 25 bp, Mus musculus
attgtcaatgtcagcttccgtgtgt

SEQ ID NO: 285453 - DNA, 25 bp, Mus musculus
attgtcaatgtctccagcatggtgg

SEQ ID NO: 285454 - DNA, 25 bp, Mus musculus
attgtcaatgtctgcttccgtgtgt

SEQ ID NO: 285455 - DNA, 25 bp, Mus musculus
attgtcaattttccatctttagtaa

SEQ ID NO: 285456 - DNA, 25 bp, Mus musculus
attgtcaattttgcatctttagtaa

SEQ ID NO: 285457 - DNA, 25 bp, Mus musculus
attgtcacagcaaaacctctctaac

SEQ ID NO: 285458 - DNA, 25 bp, Mus musculus
attgtcacagcataacctctctaac

SEQ ID NO: 285459 - DNA, 25 bp, Mus musculus
attgtcaccaggaacttttgcacag

SEQ ID NO: 285460 - DNA, 25 bp, Mus musculus
attgtcaccaggtacttttgcacag

SEQ ID NO: 285461 - DNA, 25 bp, Mus musculus
attgtcaccattatctatccattgc

SEQ ID NO: 285462 - DNA, 25 bp, Mus musculus
attgtcaccattttctatccattgc

SEQ ID NO: 285463 - DNA, 25 bp, Mus musculus
attgtcaccccaaagaggagcaggc

SEQ ID NO: 285464 - DNA, 25 bp, Mus musculus
attgtcaccccatagaggagcaggc

SEQ ID NO: 285465 - DNA, 25 bp, Mus musculus
attgtcacctccatgtcaaggtcat

SEQ ID NO: 285466 - DNA, 25 bp, Mus musculus
attgtcacctccttgtcaaggtcat

SEQ ID NO: 285467 - DNA, 25 bp, Mus musculus
attgtcaccttcatcaccaaagttc

SEQ ID NO: 285468 - DNA, 25 bp, Mus musculus
attgtcaccttcttcaccaaagttc

SEQ ID NO: 285469 - DNA, 25 bp, Mus musculus
attgtcactccaatataggaatacc

SEQ ID NO: 285470 - DNA, 25 bp, Mus musculus
attgtcactccattataggaatacc

SEQ ID NO: 285471 - DNA, 25 bp, Mus musculus
attgtcactcttcaccatttgtata

SEQ ID NO: 285472 - DNA, 25 bp, Mus musculus
attgtcactcttgaccatttgtata

SEQ ID NO: 285473 - DNA, 25 bp, Mus musculus
attgtcactggtaaacaacttgcga

SEQ ID NO: 285474 - DNA, 25 bp, Mus musculus
attgtcactggttaacaacttgcga

SEQ ID NO: 285475 - DNA, 25 bp, Mus musculus
attgtcactgtcatccgaagcttct

SEQ ID NO: 285476 - DNA, 25 bp, Mus musculus
attgtcactgtcttccgaagcttct

SEQ ID NO: 285477 - DNA, 25 bp, Mus musculus
attgtcactgtgagcttctgtgctt

SEQ ID NO: 285478 - DNA, 25 bp, Mus musculus
attgtcactgtgtgcttctgtgctt

SEQ ID NO: 285479 - DNA, 25 bp, Mus musculus
attgtcagctctcctgcattgaggg

SEQ ID NO: 285480 - DNA, 25 bp, Mus musculus
attgtcagctctgctgcattgaggg

SEQ ID NO: 285481 - DNA, 25 bp, Mus musculus
attgtcagtcaccagtcatgtacca

SEQ ID NO: 285482 - DNA, 25 bp, Mus musculus
attgtcagtcacgagtcatgtacca

SEQ ID NO: 285483 - DNA, 25 bp, Mus musculus
attgtcagttctcgaggcttggctt

SEQ ID NO: 285484 - DNA, 25 bp, Mus musculus
attgtcagttctggaggcttggctt

SEQ ID NO: 285485 - DNA, 25 bp, Mus musculus
attgtcataaccatggtggtctgaa

SEQ ID NO: 285486 - DNA, 25 bp, Mus musculus
attgtcataaccttggtggtctgaa

SEQ ID NO: 285487 - DNA, 25 bp, Mus musculus
attgtcataatacagcactggtttt

SEQ ID NO: 285488 - DNA, 25 bp, Mus musculus
attgtcataatagagcactggtttt

SEQ ID NO: 285489 - DNA, 25 bp, Mus musculus
attgtcatcacgaccattctgggct

SEQ ID NO: 285490 - DNA, 25 bp, Mus musculus
attgtcatcacgtccattctgggct

SEQ ID NO: 285491 - DNA, 25 bp, Mus musculus
attgtcatcatgatgtcagccagcc

SEQ ID NO: 285492 - DNA, 25 bp, Mus musculus
attgtcatcatgttgtcagccagcc

SEQ ID NO: 285493 - DNA, 25 bp, Mus musculus
attgtcatccagaacttcatcttcc

SEQ ID NO: 285494 - DNA, 25 bp, Mus musculus
attgtcatccagtacttcatcttcc

SEQ ID NO: 285495 - DNA, 25 bp, Mus musculus
attgtcatctccaatgtccacatat

SEQ ID NO: 285496 - DNA, 25 bp, Mus musculus
attgtcatctcctatgtccacatat

SEQ ID NO: 285497 - DNA, 25 bp, Mus musculus
attgtcatctgcctgatgtgggtcc

SEQ ID NO: 285498 - DNA, 25 bp, Mus musculus
attgtcatctgcgtgatgtgggtcc

SEQ ID NO: 285499 - DNA, 25 bp, Mus musculus
attgtcatcttaactcttgctctca

SEQ ID NO: 285500 - DNA, 25 bp, Mus musculus
attgtcatcttatctcttgctctca

SEQ ID NO: 285501 - DNA, 25 bp, Mus musculus
attgtcatgcatactacggctgttg

SEQ ID NO: 285502 - DNA, 25 bp, Mus musculus
attgtcatgcattctacggctgttg

SEQ ID NO: 285503 - DNA, 25 bp, Mus musculus
attgtcatggttcagggccaccgtg

SEQ ID NO: 285504 - DNA, 25 bp, Mus musculus
attgtcatggttgagggccaccgtg

SEQ ID NO: 285505 - DNA, 25 bp, Mus musculus
attgtcattatacaaccatcagttg

SEQ ID NO: 285506 - DNA, 25 bp, Mus musculus
attgtcattatagaaccatcagttg

SEQ ID NO: 285507 - DNA, 25 bp, Mus musculus
attgtcattcatccctgtaacctgg

SEQ ID NO: 285508 - DNA, 25 bp, Mus musculus
attgtcattcatgcctgtaacctgg

SEQ ID NO: 285509 - DNA, 25 bp, Mus musculus
attgtcattgcaagcgctgttggcg

SEQ ID NO: 285510 - DNA, 25 bp, Mus musculus
attgtcattgcatgcgctgttggcg

SEQ ID NO: 285511 - DNA, 25 bp, Mus musculus
attgtcattggcctcctaatcattg

SEQ ID NO: 285512 - DNA, 25 bp, Mus musculus
attgtcattggcgtcctaatcattg

SEQ ID NO: 285513 - DNA, 25 bp, Mus musculus
attgtcattgtaataggtcccatcc

SEQ ID NO: 285514 - DNA, 25 bp, Mus musculus
attgtcattgtattaggtcccatcc

SEQ ID NO: 285515 - DNA, 25 bp, Mus musculus
attgtcatttggagagaagttacgt

SEQ ID NO: 285516 - DNA, 25 bp, Mus musculus
attgtcatttggtgagaagttacgt

SEQ ID NO: 285517 - DNA, 25 bp, Mus musculus
attgtcattttgcttggaagcctcc

SEQ ID NO: 285518 - DNA, 25 bp, Mus musculus
attgtcattttggttggaagcctcc

SEQ ID NO: 285519 - DNA, 25 bp, Mus musculus
attgtccaagttactttccctactg

SEQ ID NO: 285520 - DNA, 25 bp, Mus musculus
attgtccaagtttctttccctactg

SEQ ID NO: 285521 - DNA, 25 bp, Mus musculus
attgtccacaagatccagccggtat

SEQ ID NO: 285522 - DNA, 25 bp, Mus musculus
attgtccacaagttccagccggtat

SEQ ID NO: 285523 - DNA, 25 bp, Mus musculus
attgtccacaatccgccagtcaaca

SEQ ID NO: 285524 - DNA, 25 bp, Mus musculus
attgtccacaatgcgccagtcaaca

SEQ ID NO: 285525 - DNA, 25 bp, Mus musculus
attgtccacgtgatcctagagcagt

SEQ ID NO: 285526 - DNA, 25 bp, Mus musculus
attgtccacgtgttcctagagcagt

SEQ ID NO: 285527 - DNA, 25 bp, Mus musculus
attgtccaggacatcaccaaacaga

SEQ ID NO: 285528 - DNA, 25 bp, Mus musculus
attgtccaggacttcaccaaacaga

SEQ ID NO: 285529 - DNA, 25 bp, Mus musculus
attgtccatatcattatctccttac

SEQ ID NO: 285530 - DNA, 25 bp, Mus musculus
attgtccatatctttatctccttac

SEQ ID NO: 285531 - DNA, 25 bp, Mus musculus
attgtccatctacagcactgctgaa

SEQ ID NO: 285532 - DNA, 25 bp, Mus musculus
attgtccatctagagcactgctgaa

SEQ ID NO: 285533 - DNA, 25 bp, Mus musculus
attgtcccacgtcagctggtgctct

SEQ ID NO: 285534 - DNA, 25 bp, Mus musculus
attgtcccacgtgagctggtgctct

SEQ ID NO: 285535 - DNA, 25 bp, Mus musculus
attgtcccatctatgagtcagatat

SEQ ID NO: 285536 - DNA, 25 bp, Mus musculus
attgtcccatctttgagtcagatat

SEQ ID NO: 285537 - DNA, 25 bp, Mus musculus
attgtcccattaaagttgtattcct

SEQ ID NO: 285538 - DNA, 25 bp, Mus musculus
attgtcccattatagttgtattcct

SEQ ID NO: 285539 - DNA, 25 bp, Mus musculus
attgtccccagcatgagagtttcta

SEQ ID NO: 285540 - DNA, 25 bp, Mus musculus
attgtccccagcttgagagtttcta

SEQ ID NO: 285541 - DNA, 25 bp, Mus musculus
attgtccccagtacaggtggcacag

SEQ ID NO: 285542 - DNA, 25 bp, Mus musculus
attgtccccagttcaggtggcacag

SEQ ID NO: 285543 - DNA, 25 bp, Mus musculus
attgtccctattagatatgttggcc

SEQ ID NO: 285544 - DNA, 25 bp, Mus musculus
attgtccctatttgatatgttggcc

SEQ ID NO: 285545 - DNA, 25 bp, Mus musculus
attgtccctgtaactctgagctagt

SEQ ID NO: 285546 - DNA, 25 bp, Mus musculus
attgtccctgtatctctgagctagt

SEQ ID NO: 285547 - DNA, 25 bp, Mus musculus
attgtccctgtgactgctgcttcca

SEQ ID NO: 285548 - DNA, 25 bp, Mus musculus
attgtccctgtgtctgctgcttcca

SEQ ID NO: 285549 - DNA, 25 bp, Mus musculus
attgtcccttttatgtcttctctta

SEQ ID NO: 285550 - DNA, 25 bp, Mus musculus
attgtcccttttttgtcttctctta

SEQ ID NO: 285551 - DNA, 25 bp, Mus musculus
attgtccgagtaaatgcagaagcca

SEQ ID NO: 285552 - DNA, 25 bp, Mus musculus
attgtccgagtatatgcagaagcca

SEQ ID NO: 285553 - DNA, 25 bp, Mus musculus
attgtccgcggaagtccccgaggca

SEQ ID NO: 285554 - DNA, 25 bp, Mus musculus
attgtccgcggatgtccccgaggca

SEQ ID NO: 285555 - DNA, 25 bp, Mus musculus
attgtccggagtaggcacctcctga

SEQ ID NO: 285556 - DNA, 25 bp, Mus musculus
attgtccggagttggcacctcctga

SEQ ID NO: 285557 - DNA, 25 bp, Mus musculus
attgtccgggctagtccagtgtcac

SEQ ID NO: 285558 - DNA, 25 bp, Mus musculus
attgtccgggcttgtccagtgtcac

SEQ ID NO: 285559 - DNA, 25 bp, Mus musculus
attgtcctaagaaactgcaccccag

SEQ ID NO: 285560 - DNA, 25 bp, Mus musculus
attgtcctaagatactgcaccccag

SEQ ID NO: 285561 - DNA, 25 bp, Mus musculus
attgtcctacatcctcgttgtacct

SEQ ID NO: 285562 - DNA, 25 bp, Mus musculus
attgtcctacatgctcgttgtacct

SEQ ID NO: 285563 - DNA, 25 bp, Mus musculus
attgtcctagatatgcaaattggga

SEQ ID NO: 285564 - DNA, 25 bp, Mus musculus
attgtcctagatttgcaaattggga

SEQ ID NO: 285565 - DNA, 25 bp, Mus musculus
attgtcctagttcgcctagaacttt

SEQ ID NO: 285566 - DNA, 25 bp, Mus musculus
attgtcctagttggcctagaacttt

SEQ ID NO: 285567 - DNA, 25 bp, Mus musculus
attgtcctatctccagcggccctgt

SEQ ID NO: 285568 - DNA, 25 bp, Mus musculus
attgtcctatctgcagcggccctgt

SEQ ID NO: 285569 - DNA, 25 bp, Mus musculus
attgtcctcaggctgggtagtctta

SEQ ID NO: 285570 - DNA, 25 bp, Mus musculus
attgtcctcagggtgggtagtctta

SEQ ID NO: 285571 - DNA, 25 bp, Mus musculus
attgtcctctgaagagtccttttca

SEQ ID NO: 285572 - DNA, 25 bp, Mus musculus
attgtcctctgatgagtccttttca

SEQ ID NO: 285573 - DNA, 25 bp, Mus musculus
attgtcctcttacctcaagtactgt

SEQ ID NO: 285574 - DNA, 25 bp, Mus musculus
attgtcctcttagctcaagtactgt

SEQ ID NO: 285575 - DNA, 25 bp, Mus musculus
attgtcctggagacattcacccaca

SEQ ID NO: 285576 - DNA, 25 bp, Mus musculus
attgtcctggagtcattcacccaca

SEQ ID NO: 285577 - DNA, 25 bp, Mus musculus
attgtcctgtctatctatgtgtgtc

SEQ ID NO: 285578 - DNA, 25 bp, Mus musculus
attgtcctgtctttctatgtgtgtc

SEQ ID NO: 285579 - DNA, 25 bp, Mus musculus
attgtccttaaaaacccactcagaa

SEQ ID NO: 285580 - DNA, 25 bp, Mus musculus
attgtccttaaatacccactcagaa

SEQ ID NO: 285581 - DNA, 25 bp, Mus musculus
attgtccttacccttggtcatacct

SEQ ID NO: 285582 - DNA, 25 bp, Mus musculus
attgtccttaccgttggtcatacct

SEQ ID NO: 285583 - DNA, 25 bp, Mus musculus
attgtccttgctcatgcgaacttcc

SEQ ID NO: 285584 - DNA, 25 bp, Mus musculus
attgtccttgctgatgcgaacttcc

SEQ ID NO: 285585 - DNA, 25 bp, Mus musculus
attgtccttggcattggcgtttaca

SEQ ID NO: 285586 - DNA, 25 bp, Mus musculus
attgtccttggctttggcgtttaca

SEQ ID NO: 285587 - DNA, 25 bp, Mus musculus
attgtccttggtatcactgatcact

SEQ ID NO: 285588 - DNA, 25 bp, Mus musculus
attgtccttggtttcactgatcact

SEQ ID NO: 285589 - DNA, 25 bp, Mus musculus
attgtccttgttcaggtcaccttta

SEQ ID NO: 285590 - DNA, 25 bp, Mus musculus
attgtccttgttgaggtcaccttta

SEQ ID NO: 285591 - DNA, 25 bp, Mus musculus
attgtcctttaaagtcacaccctac

SEQ ID NO: 285592 - DNA, 25 bp, Mus musculus
attgtcctttaatgtcacaccctac

SEQ ID NO: 285593 - DNA, 25 bp, Mus musculus
attgtcctttctaccattcttacca

SEQ ID NO: 285594 - DNA, 25 bp, Mus musculus
attgtcctttcttccattcttacca

SEQ ID NO: 285595 - DNA, 25 bp, Mus musculus
attgtcctttggagacattgccaac

SEQ ID NO: 285596 - DNA, 25 bp, Mus musculus
attgtcctttggtgacattgccaac

SEQ ID NO: 285597 - DNA, 25 bp, Mus musculus
attgtccttttcacgggagggatct

SEQ ID NO: 285598 - DNA, 25 bp, Mus musculus
attgtccttttctcgggagggatct

SEQ ID NO: 285599 - DNA, 25 bp, Mus musculus
attgtcgcaagtcacagaattattt

SEQ ID NO: 285600 - DNA, 25 bp, Mus musculus
attgtcgcaagtgacagaattattt

SEQ ID NO: 285601 - DNA, 25 bp, Mus musculus
attgtcgcccctcaggtagatcatt

SEQ ID NO: 285602 - DNA, 25 bp, Mus musculus
attgtcgcccctgaggtagatcatt

SEQ ID NO: 285603 - DNA, 25 bp, Mus musculus
attgtcgggacaattccaggcctag

SEQ ID NO: 285604 - DNA, 25 bp, Mus musculus
attgtcgggacacttctaggatttg

SEQ ID NO: 285605 - DNA, 25 bp, Mus musculus
attgtcgggacagttctaggatttg

SEQ ID NO: 285606 - DNA, 25 bp, Mus musculus
attgtcgggacatttccaggcctag

SEQ ID NO: 285607 - DNA, 25 bp, Mus musculus
attgtcgtagacattgtggctctga

SEQ ID NO: 285608 - DNA, 25 bp, Mus musculus
attgtcgtagactttgtggctctga

SEQ ID NO: 285609 - DNA, 25 bp, Mus musculus
attgtctacatcacagcaatccctg

SEQ ID NO: 285610 - DNA, 25 bp, Mus musculus
attgtctacatctcagcaatccctg

SEQ ID NO: 285611 - DNA, 25 bp, Mus musculus
attgtctaccctcggcaacgttatt

SEQ ID NO: 285612 - DNA, 25 bp, Mus musculus
attgtctaccctgggcaacgttatt

SEQ ID NO: 285613 - DNA, 25 bp, Mus musculus
attgtctacgacattgctcaggtga

SEQ ID NO: 285614 - DNA, 25 bp, Mus musculus
attgtctacgactttgctcaggtga

SEQ ID NO: 285615 - DNA, 25 bp, Mus musculus
attgtctactggctagggtccgata

SEQ ID NO: 285616 - DNA, 25 bp, Mus musculus
attgtctactgggtagggtccgata

SEQ ID NO: 285617 - DNA, 25 bp, Mus musculus
attgtctacttcacactgtgaatgt

SEQ ID NO: 285618 - DNA, 25 bp, Mus musculus
attgtctacttctcactgtgaatgt

SEQ ID NO: 285619 - DNA, 25 bp, Mus musculus
attgtctatctcacaggagtgtccc

SEQ ID NO: 285620 - DNA, 25 bp, Mus musculus
attgtctatctctcaggagtgtccc

SEQ ID NO: 285621 - DNA, 25 bp, Mus musculus
attgtctattttatgtccacttagg

SEQ ID NO: 285622 - DNA, 25 bp, Mus musculus
attgtctattttttgtccacttagg

SEQ ID NO: 285623 - DNA, 25 bp, Mus musculus
attgtctcaattatgctatgaacca

SEQ ID NO: 285624 - DNA, 25 bp, Mus musculus
attgtctcaattttgctatgaacca

SEQ ID NO: 285625 - DNA, 25 bp, Mus musculus
attgtctcatagataggacctcact

SEQ ID NO: 285626 - DNA, 25 bp, Mus musculus
attgtctcatagttaggacctcact

SEQ ID NO: 285627 - DNA, 25 bp, Mus musculus
attgtctcatttctaaattacccct

SEQ ID NO: 285628 - DNA, 25 bp, Mus musculus
attgtctcatttgtaaattacccct

SEQ ID NO: 285629 - DNA, 25 bp, Mus musculus
attgtctccatgatgggcaccactg

SEQ ID NO: 285630 - DNA, 25 bp, Mus musculus
attgtctccatgttgggcaccactg

SEQ ID NO: 285631 - DNA, 25 bp, Mus musculus
attgtctccccaaattgccacaggg

SEQ ID NO: 285632 - DNA, 25 bp, Mus musculus
attgtctccccatattgccacaggg

SEQ ID NO: 285633 - DNA, 25 bp, Mus musculus
attgtctcctcccatggctaggaag

SEQ ID NO: 285634 - DNA, 25 bp, Mus musculus
attgtctcctccgatggctaggaag

SEQ ID NO: 285635 - DNA, 25 bp, Mus musculus
attgtctccttccatccgtgtggat

SEQ ID NO: 285636 - DNA, 25 bp, Mus musculus
attgtctccttcgatccgtgtggat

SEQ ID NO: 285637 - DNA, 25 bp, Mus musculus
attgtctccttgagaacttgttggg

SEQ ID NO: 285638 - DNA, 25 bp, Mus musculus
attgtctccttgtgaacttgttggg

SEQ ID NO: 285639 - DNA, 25 bp, Mus musculus
attgtctctctaaattgagagggaa

SEQ ID NO: 285640 - DNA, 25 bp, Mus musculus
attgtctctctatattgagagggaa

SEQ ID NO: 285641 - DNA, 25 bp, Mus musculus
attgtctctctcatcaggatcgctt

SEQ ID NO: 285642 - DNA, 25 bp, Mus musculus
attgtctctctcttcaggatcgctt

SEQ ID NO: 285643 - DNA, 25 bp, Mus musculus
attgtctctctgctcctgcaagtgg

SEQ ID NO: 285644 - DNA, 25 bp, Mus musculus
attgtctctctggtcctgcaagtgg

SEQ ID NO: 285645 - DNA, 25 bp, Mus musculus
attgtctctcttcttatccccagag

SEQ ID NO: 285646 - DNA, 25 bp, Mus musculus
attgtctctcttgttatccccagag

SEQ ID NO: 285647 - DNA, 25 bp, Mus musculus
attgtctctggcaacatcctcattg

SEQ ID NO: 285648 - DNA, 25 bp, Mus musculus
attgtctctggctacatcctcattg

SEQ ID NO: 285649 - DNA, 25 bp, Mus musculus
attgtctctgtgaacggcactacaa

SEQ ID NO: 285650 - DNA, 25 bp, Mus musculus
attgtctctgtgtacggcactacaa

SEQ ID NO: 285651 - DNA, 25 bp, Mus musculus
attgtctcttccagaacactttatc

SEQ ID NO: 285652 - DNA, 25 bp, Mus musculus
attgtctcttcctgaacactttatc

SEQ ID NO: 285653 - DNA, 25 bp, Mus musculus
attgtctcttctagtacccgaatct

SEQ ID NO: 285654 - DNA, 25 bp, Mus musculus
attgtctcttctctctgccgtggac

SEQ ID NO: 285655 - DNA, 25 bp, Mus musculus
attgtctcttctgtctgccgtggac

SEQ ID NO: 285656 - DNA, 25 bp, Mus musculus
attgtctcttcttgtacccgaatct

SEQ ID NO: 285657 - DNA, 25 bp, Mus musculus
attgtctgacctccgtacatgtgta

SEQ ID NO: 285658 - DNA, 25 bp, Mus musculus
attgtctgacctgcgtacatgtgta

SEQ ID NO: 285659 - DNA, 25 bp, Mus musculus
attgtctgatggctgctgagctagc

SEQ ID NO: 285660 - DNA, 25 bp, Mus musculus
attgtctgatgggtgctgagctagc

SEQ ID NO: 285661 - DNA, 25 bp, Mus musculus
attgtctgcgtcagggagggattta

SEQ ID NO: 285662 - DNA, 25 bp, Mus musculus
attgtctgcgtctgggagggattta

SEQ ID NO: 285663 - DNA, 25 bp, Mus musculus
attgtctgcttcaatacaagaaaca

SEQ ID NO: 285664 - DNA, 25 bp, Mus musculus
attgtctgcttcatttgtcatctcc

SEQ ID NO: 285665 - DNA, 25 bp, Mus musculus
attgtctgcttctatacaagaaaca

SEQ ID NO: 285666 - DNA, 25 bp, Mus musculus
attgtctgcttcttttgtcatctcc

SEQ ID NO: 285667 - DNA, 25 bp, Mus musculus
attgtctgggttaactttctcggca

SEQ ID NO: 285668 - DNA, 25 bp, Mus musculus
attgtctgggttatggcagtcacaa

SEQ ID NO: 285669 - DNA, 25 bp, Mus musculus
attgtctgggtttactttctcggca

SEQ ID NO: 285670 - DNA, 25 bp, Mus musculus
attgtctgggttttggcagtcacaa

SEQ ID NO: 285671 - DNA, 25 bp, Mus musculus
attgtctgtagacgctcgtctgcac

SEQ ID NO: 285672 - DNA, 25 bp, Mus musculus
attgtctgtagaggctcgtctgcac

SEQ ID NO: 285673 - DNA, 25 bp, Mus musculus
attgtctgtctcaagactacgtgta

SEQ ID NO: 285674 - DNA, 25 bp, Mus musculus
attgtctgtctctagactacgtgta

SEQ ID NO: 285675 - DNA, 25 bp, Mus musculus
attgtctgtgacatcaagatctgac

SEQ ID NO: 285676 - DNA, 25 bp, Mus musculus
attgtctgtgacttcaagatctgac

SEQ ID NO: 285677 - DNA, 25 bp, Mus musculus
attgtctgtgcactcagccctcagt

SEQ ID NO: 285678 - DNA, 25 bp, Mus musculus
attgtctgtgcacttttgaacctcc

SEQ ID NO: 285679 - DNA, 25 bp, Mus musculus
attgtctgtgcagtcagccctcagt

SEQ ID NO: 285680 - DNA, 25 bp, Mus musculus
attgtctgtgcagttttgaacctcc

SEQ ID NO: 285681 - DNA, 25 bp, Mus musculus
attgtcttaattatcctcgcttcag

SEQ ID NO: 285682 - DNA, 25 bp, Mus musculus
attgtcttaattttcctcgcttcag

SEQ ID NO: 285683 - DNA, 25 bp, Mus musculus
attgtcttacacatgctgtctggaa

SEQ ID NO: 285684 - DNA, 25 bp, Mus musculus
attgtcttacacttgctgtctggaa

SEQ ID NO: 285685 - DNA, 25 bp, Mus musculus
attgtcttacttatcctcagcgggt

SEQ ID NO: 285686 - DNA, 25 bp, Mus musculus
attgtcttacttttcctcagcgggt

SEQ ID NO: 285687 - DNA, 25 bp, Mus musculus
attgtcttatatatcttaacctctt

SEQ ID NO: 285688 - DNA, 25 bp, Mus musculus
attgtcttatatttcttaacctctt

SEQ ID NO: 285689 - DNA, 25 bp, Mus musculus
attgtcttcaatctgcttatatcca

SEQ ID NO: 285690 - DNA, 25 bp, Mus musculus
attgtcttcaatgtgcttatatcca

SEQ ID NO: 285691 - DNA, 25 bp, Mus musculus
attgtcttcaccaacgtagctttac

SEQ ID NO: 285692 - DNA, 25 bp, Mus musculus
attgtcttcaccatcggcagtgtta

SEQ ID NO: 285693 - DNA, 25 bp, Mus musculus
attgtcttcacctacgtagctttac

SEQ ID NO: 285694 - DNA, 25 bp, Mus musculus
attgtcttcaccttcggcagtgtta

SEQ ID NO: 285695 - DNA, 25 bp, Mus musculus
attgtcttcccactcatgttactgg

SEQ ID NO: 285696 - DNA, 25 bp, Mus musculus
attgtcttcccagtcatgttactgg

SEQ ID NO: 285697 - DNA, 25 bp, Mus musculus
attgtcttccccagtccagactcag

SEQ ID NO: 285698 - DNA, 25 bp, Mus musculus
attgtcttcccctgtccagactcag

SEQ ID NO: 285699 - DNA, 25 bp, Mus musculus
attgtcttcctactgggctttgtca

SEQ ID NO: 285700 - DNA, 25 bp, Mus musculus
attgtcttcctagtgggctttgtca

SEQ ID NO: 285701 - DNA, 25 bp, Mus musculus
attgtcttccttaatattgttatct

SEQ ID NO: 285702 - DNA, 25 bp, Mus musculus
attgtcttccttagatcctaatgtg

SEQ ID NO: 285703 - DNA, 25 bp, Mus musculus
attgtcttcctttatattgttatct

SEQ ID NO: 285704 - DNA, 25 bp, Mus musculus
attgtcttcctttgatcctaatgtg

SEQ ID NO: 285705 - DNA, 25 bp, Mus musculus
attgtcttctcactgtgcagttaac

SEQ ID NO: 285706 - DNA, 25 bp, Mus musculus
attgtcttctcagtgtgcagttaac

SEQ ID NO: 285707 - DNA, 25 bp, Mus musculus
attgtcttgccaatccctgctggga

SEQ ID NO: 285708 - DNA, 25 bp, Mus musculus
attgtcttgccattccctgctggga

SEQ ID NO: 285709 - DNA, 25 bp, Mus musculus
attgtcttgcctcacctgacttgct

SEQ ID NO: 285710 - DNA, 25 bp, Mus musculus
attgtcttgcctgacctgacttgct

SEQ ID NO: 285711 - DNA, 25 bp, Mus musculus
attgtcttgcgtcccatccatgtaa

SEQ ID NO: 285712 - DNA, 25 bp, Mus musculus
attgtcttgcgtgccatccatgtaa

SEQ ID NO: 285713 - DNA, 25 bp, Mus musculus
attgtctttcttcatgttaacctat

SEQ ID NO: 285714 - DNA, 25 bp, Mus musculus
attgtctttcttgatgttaacctat

SEQ ID NO: 285715 - DNA, 25 bp, Mus musculus
attgtctttgcaaaattcttctcca

SEQ ID NO: 285716 - DNA, 25 bp, Mus musculus
attgtctttgcataattcttctcca

SEQ ID NO: 285717 - DNA, 25 bp, Mus musculus
attgtctttgggaacactgtctagc

SEQ ID NO: 285718 - DNA, 25 bp, Mus musculus
attgtctttgggtacactgtctagc

SEQ ID NO: 285719 - DNA, 25 bp, Mus musculus
attgtctttgttccaaggtctcggc

SEQ ID NO: 285720 - DNA, 25 bp, Mus musculus
attgtctttgttcctctgctataaa

SEQ ID NO: 285721 - DNA, 25 bp, Mus musculus
attgtctttgttgcaaggtctcggc

SEQ ID NO: 285722 - DNA, 25 bp, Mus musculus
attgtctttgttgctctgctataaa

SEQ ID NO: 285723 - DNA, 25 bp, Mus musculus
attgtgaacaacattcaagccaccg

SEQ ID NO: 285724 - DNA, 25 bp, Mus musculus
attgtgaacaactttcaagccaccg

SEQ ID NO: 285725 - DNA, 25 bp, Mus musculus
attgtgaagacacctaagtacgact

SEQ ID NO: 285726 - DNA, 25 bp, Mus musculus
attgtgaagacagctaagtacgact

SEQ ID NO: 285727 - DNA, 25 bp, Mus musculus
attgtgaatagcacaggaccagcat

SEQ ID NO: 285728 - DNA, 25 bp, Mus musculus
attgtgaatagctcaggaccagcat

SEQ ID NO: 285729 - DNA, 25 bp, Mus musculus
attgtgaatcttcacatcgccacct

SEQ ID NO: 285730 - DNA, 25 bp, Mus musculus
attgtgaatcttgacatcgccacct

SEQ ID NO: 285731 - DNA, 25 bp, Mus musculus
attgtgaattttaccctgatttgta

SEQ ID NO: 285732 - DNA, 25 bp, Mus musculus
attgtgaatttttccctgatttgta

SEQ ID NO: 285733 - DNA, 25 bp, Mus musculus
attgtgacacccattgaggcccaaa

SEQ ID NO: 285734 - DNA, 25 bp, Mus musculus
attgtgacaccctttgaggcccaaa

SEQ ID NO: 285735 - DNA, 25 bp, Mus musculus
attgtgacactgaccactgactgca

SEQ ID NO: 285736 - DNA, 25 bp, Mus musculus
attgtgacactgtccactgactgca

SEQ ID NO: 285737 - DNA, 25 bp, Mus musculus
attgtgacagtaaccctgagtgtga

SEQ ID NO: 285738 - DNA, 25 bp, Mus musculus
attgtgacagtatccctgagtgtga

SEQ ID NO: 285739 - DNA, 25 bp, Mus musculus
attgtgaccagacctcgggaacggc

SEQ ID NO: 285740 - DNA, 25 bp, Mus musculus
attgtgaccagagctcgggaacggc

SEQ ID NO: 285741 - DNA, 25 bp, Mus musculus
attgtgacctgtccagtggtccaga

SEQ ID NO: 285742 - DNA, 25 bp, Mus musculus
attgtgacctgtgcagtggtccaga

SEQ ID NO: 285743 - DNA, 25 bp, Mus musculus
attgtgacgtcacgtggtctgtgcc

SEQ ID NO: 285744 - DNA, 25 bp, Mus musculus
attgtgacgtcaggtggtctgtgcc

SEQ ID NO: 285745 - DNA, 25 bp, Mus musculus
attgtgactaatctatgtgctgtta

SEQ ID NO: 285746 - DNA, 25 bp, Mus musculus
attgtgactaatgtatgtgctgtta

SEQ ID NO: 285747 - DNA, 25 bp, Mus musculus
attgtgactccccaggatacggctg

SEQ ID NO: 285748 - DNA, 25 bp, Mus musculus
attgtgactcccgaggatacggctg

SEQ ID NO: 285749 - DNA, 25 bp, Mus musculus
attgtgactttgacagagctttcat

SEQ ID NO: 285750 - DNA, 25 bp, Mus musculus
attgtgactttgtcagagctttcat

SEQ ID NO: 285751 - DNA, 25 bp, Mus musculus
attgtgacttttatccagccccttg

SEQ ID NO: 285752 - DNA, 25 bp, Mus musculus
attgtgacttttcccatgcttcggg

SEQ ID NO: 285753 - DNA, 25 bp, Mus musculus
attgtgacttttgccatgcttcggg

SEQ ID NO: 285754 - DNA, 25 bp, Mus musculus
attgtgacttttttccagccccttg

SEQ ID NO: 285755 - DNA, 25 bp, Mus musculus
attgtgagctgaactggaggccagt

SEQ ID NO: 285756 - DNA, 25 bp, Mus musculus
attgtgagctgatctggaggccagt

SEQ ID NO: 285757 - DNA, 25 bp, Mus musculus
attgtgagctgcctggtccctggtc

SEQ ID NO: 285758 - DNA, 25 bp, Mus musculus
attgtgagctgcgtggtccctggtc

SEQ ID NO: 285759 - DNA, 25 bp, Mus musculus
attgtgatactcagctttatgacac

SEQ ID NO: 285760 - DNA, 25 bp, Mus musculus
attgtgatactctgctttatgacac

SEQ ID NO: 285761 - DNA, 25 bp, Mus musculus
attgtgatcacacgagacgcagctc

SEQ ID NO: 285762 - DNA, 25 bp, Mus musculus
attgtgatcacaggagacgcagctc

SEQ ID NO: 285763 - DNA, 25 bp, Mus musculus
attgtgatcctgctaagggcggcct

SEQ ID NO: 285764 - DNA, 25 bp, Mus musculus
attgtgatcctggtaagggcggcct

SEQ ID NO: 285765 - DNA, 25 bp, Mus musculus
attgtgattagtcagtgccgcttga

SEQ ID NO: 285766 - DNA, 25 bp, Mus musculus
attgtgattagtgagtgccgcttga

SEQ ID NO: 285767 - DNA, 25 bp, Mus musculus
attgtgattcatcccagtgtgccag

SEQ ID NO: 285768 - DNA, 25 bp, Mus musculus
attgtgattcatgccagtgtgccag

SEQ ID NO: 285769 - DNA, 25 bp, Mus musculus
attgtgcaaaccagcttagcccagt

SEQ ID NO: 285770 - DNA, 25 bp, Mus musculus
attgtgcaaacctgcttagcccagt

SEQ ID NO: 285771 - DNA, 25 bp, Mus musculus
attgtgcaagcaagtgggtcccagg

SEQ ID NO: 285772 - DNA, 25 bp, Mus musculus
attgtgcaagcactgagcaaatcta

SEQ ID NO: 285773 - DNA, 25 bp, Mus musculus
attgtgcaagcagtgagcaaatcta

SEQ ID NO: 285774 - DNA, 25 bp, Mus musculus
attgtgcaagcatgtgggtcccagg

SEQ ID NO: 285775 - DNA, 25 bp, Mus musculus
attgtgcaatctatggcttgatttc

SEQ ID NO: 285776 - DNA, 25 bp, Mus musculus
attgtgcaatctttggcttgatttc

SEQ ID NO: 285777 - DNA, 25 bp, Mus musculus
attgtgcacacacagaccgtatatt

SEQ ID NO: 285778 - DNA, 25 bp, Mus musculus
attgtgcacacagagaccgtatatt

SEQ ID NO: 285779 - DNA, 25 bp, Mus musculus
attgtgcactacaaccaagctgtaa

SEQ ID NO: 285780 - DNA, 25 bp, Mus musculus
attgtgcactactaccaagctgtaa

SEQ ID NO: 285781 - DNA, 25 bp, Mus musculus
attgtgcagaaacgacaagtcttta

SEQ ID NO: 285782 - DNA, 25 bp, Mus musculus
attgtgcagaaaggacaagtcttta

SEQ ID NO: 285783 - DNA, 25 bp, Mus musculus
attgtgcagtgcctgtagtaccttg

SEQ ID NO: 285784 - DNA, 25 bp, Mus musculus
attgtgcagtgcgtgtagtaccttg

SEQ ID NO: 285785 - DNA, 25 bp, Mus musculus
attgtgcatcttctcaaccaacctg

SEQ ID NO: 285786 - DNA, 25 bp, Mus musculus
attgtgcatcttgtcaaccaacctg

SEQ ID NO: 285787 - DNA, 25 bp, Mus musculus
attgtgcatgtccttcactctcgac

SEQ ID NO: 285788 - DNA, 25 bp, Mus musculus
attgtgcatgtcgttcactctcgac

SEQ ID NO: 285789 - DNA, 25 bp, Mus musculus
attgtgcattataccactgaggacc

SEQ ID NO: 285790 - DNA, 25 bp, Mus musculus
attgtgcattattccactgaggacc

SEQ ID NO: 285791 - DNA, 25 bp, Mus musculus
attgtgcattgactctgttggatac

SEQ ID NO: 285792 - DNA, 25 bp, Mus musculus
attgtgcattgagtctgttggatac

SEQ ID NO: 285793 - DNA, 25 bp, Mus musculus
attgtgccaccaaggggcattcctc

SEQ ID NO: 285794 - DNA, 25 bp, Mus musculus
attgtgccaccatggggcattcctc

SEQ ID NO: 285795 - DNA, 25 bp, Mus musculus
attgtgccacctcaggacgacggta

SEQ ID NO: 285796 - DNA, 25 bp, Mus musculus
attgtgccacctgaggacgacggta

SEQ ID NO: 285797 - DNA, 25 bp, Mus musculus
attgtgccatgaacttccggcagct

SEQ ID NO: 285798 - DNA, 25 bp, Mus musculus
attgtgccatgatcttccggcagct

SEQ ID NO: 285799 - DNA, 25 bp, Mus musculus
attgtgcccaacaggttccaggcaa

SEQ ID NO: 285800 - DNA, 25 bp, Mus musculus
attgtgcccaactggttccaggcaa

SEQ ID NO: 285801 - DNA, 25 bp, Mus musculus
attgtgcccagcatgcatgaagtgt

SEQ ID NO: 285802 - DNA, 25 bp, Mus musculus
attgtgcccagcttgcatgaagtgt

SEQ ID NO: 285803 - DNA, 25 bp, Mus musculus
attgtgccccaaaatgtaaagtaga

SEQ ID NO: 285804 - DNA, 25 bp, Mus musculus
attgtgccccaatatgtaaagtaga

SEQ ID NO: 285805 - DNA, 25 bp, Mus musculus
attgtgccctgaatgccactatcac

SEQ ID NO: 285806 - DNA, 25 bp, Mus musculus
attgtgccctgattgccactatcac

SEQ ID NO: 285807 - DNA, 25 bp, Mus musculus
attgtgccgctaaagctcaggctga

SEQ ID NO: 285808 - DNA, 25 bp, Mus musculus
attgtgccgctatagctcaggctga

SEQ ID NO: 285809 - DNA, 25 bp, Mus musculus
attgtgcctactcccatttcttcat

SEQ ID NO: 285810 - DNA, 25 bp, Mus musculus
attgtgcctactgccatttcttcat

SEQ ID NO: 285811 - DNA, 25 bp, Mus musculus
attgtgcctcagacttctcgaaagt

SEQ ID NO: 285812 - DNA, 25 bp, Mus musculus
attgtgcctcagtcttctcgaaagt

SEQ ID NO: 285813 - DNA, 25 bp, Mus musculus
attgtgcctgctacattttgcagta

SEQ ID NO: 285814 - DNA, 25 bp, Mus musculus
attgtgcctgcttcattttgcagta

SEQ ID NO: 285815 - DNA, 25 bp, Mus musculus
attgtgcctggaagctgttgaactg

SEQ ID NO: 285816 - DNA, 25 bp, Mus musculus
attgtgcctggaattaccatggccc

SEQ ID NO: 285817 - DNA, 25 bp, Mus musculus
attgtgcctggatgctgttgaactg

SEQ ID NO: 285818 - DNA, 25 bp, Mus musculus
attgtgcctggatttaccatggccc

SEQ ID NO: 285819 - DNA, 25 bp, Mus musculus
attgtgcctgtgcttgtttcagaac

SEQ ID NO: 285820 - DNA, 25 bp, Mus musculus
attgtgcctgtggttgtttcagaac

SEQ ID NO: 285821 - DNA, 25 bp, Mus musculus
attgtgccttatatcacttccataa

SEQ ID NO: 285822 - DNA, 25 bp, Mus musculus
attgtgccttatttcacttccataa

SEQ ID NO: 285823 - DNA, 25 bp, Mus musculus
attgtgcgtgcgaggagggcagctt

SEQ ID NO: 285824 - DNA, 25 bp, Mus musculus
attgtgcgtgcgtggagggcagctt

SEQ ID NO: 285825 - DNA, 25 bp, Mus musculus
attgtgctaccaaagaagttctgtg

SEQ ID NO: 285826 - DNA, 25 bp, Mus musculus
attgtgctaccatagaagttctgtg

SEQ ID NO: 285827 - DNA, 25 bp, Mus musculus
attgtgctagttaagtcctgtgaac

SEQ ID NO: 285828 - DNA, 25 bp, Mus musculus
attgtgctagttatcgctgttttaa

SEQ ID NO: 285829 - DNA, 25 bp, Mus musculus
attgtgctagtttagtcctgtgaac

SEQ ID NO: 285830 - DNA, 25 bp, Mus musculus
attgtgctagttttcgctgttttaa

SEQ ID NO: 285831 - DNA, 25 bp, Mus musculus
attgtgctattgatctgtgttaagc

SEQ ID NO: 285832 - DNA, 25 bp, Mus musculus
attgtgctattgttctgtgttaagc

SEQ ID NO: 285833 - DNA, 25 bp, Mus musculus
attgtgctcaggctcaggtggctct

SEQ ID NO: 285834 - DNA, 25 bp, Mus musculus
attgtgctcagggtcaggtggctct

SEQ ID NO: 285835 - DNA, 25 bp, Mus musculus
attgtgctcatcaggtcacctgtgc

SEQ ID NO: 285836 - DNA, 25 bp, Mus musculus
attgtgctcatctggtcacctgtgc

SEQ ID NO: 285837 - DNA, 25 bp, Mus musculus
attgtgctcgttaatgcctatggct

SEQ ID NO: 285838 - DNA, 25 bp, Mus musculus
attgtgctcgtttatgcctatggct

SEQ ID NO: 285839 - DNA, 25 bp, Mus musculus
attgtgctcttgctgatgctacaga

SEQ ID NO: 285840 - DNA, 25 bp, Mus musculus
attgtgctcttgctgctctggactc

SEQ ID NO: 285841 - DNA, 25 bp, Mus musculus
attgtgctcttggtgatgctacaga

SEQ ID NO: 285842 - DNA, 25 bp, Mus musculus
attgtgctcttggtgctctggactc

SEQ ID NO: 285843 - DNA, 25 bp, Mus musculus
attgtgctgggcaatctgaagccat

SEQ ID NO: 285844 - DNA, 25 bp, Mus musculus
attgtgctgggctatctgaagccat

SEQ ID NO: 285845 - DNA, 25 bp, Mus musculus
attgtgctgtctcttttgggcgctc

SEQ ID NO: 285846 - DNA, 25 bp, Mus musculus
attgtgctgtctgttttgggcgctc

SEQ ID NO: 285847 - DNA, 25 bp, Mus musculus
attgtgcttaaacctttccagtgcc

SEQ ID NO: 285848 - DNA, 25 bp, Mus musculus
attgtgcttaaagctttccagtgcc

SEQ ID NO: 285849 - DNA, 25 bp, Mus musculus
attgtgctttctcagatccgtgccc

SEQ ID NO: 285850 - DNA, 25 bp, Mus musculus
attgtgctttctgagatccgtgccc

SEQ ID NO: 285851 - DNA, 25 bp, Mus musculus
attgtgctttgcatcaagaaaccag

SEQ ID NO: 285852 - DNA, 25 bp, Mus musculus
attgtgctttgcttcaagaaaccag

SEQ ID NO: 285853 - DNA, 25 bp, Mus musculus
attgtggaacttcgccttactctat

SEQ ID NO: 285854 - DNA, 25 bp, Mus musculus
attgtggaacttggccttactctat

SEQ ID NO: 285855 - DNA, 25 bp, Mus musculus
attgtggaagacacccaagatcaac

SEQ ID NO: 285856 - DNA, 25 bp, Mus musculus
attgtggaagacagatctccccaga

SEQ ID NO: 285857 - DNA, 25 bp, Mus musculus
attgtggaagactcccaagatcaac

SEQ ID NO: 285858 - DNA, 25 bp, Mus musculus
attgtggaagactgatctccccaga

SEQ ID NO: 285859 - DNA, 25 bp, Mus musculus
attgtggacactctctctgccgagt

SEQ ID NO: 285860 - DNA, 25 bp, Mus musculus
attgtggacactgtctctgccgagt

SEQ ID NO: 285861 - DNA, 25 bp, Mus musculus
attgtggacctcaggcatcctaatg

SEQ ID NO: 285862 - DNA, 25 bp, Mus musculus
attgtggacctctggcatcctaatg

SEQ ID NO: 285863 - DNA, 25 bp, Mus musculus
attgtggacgcccaacacggacaag

SEQ ID NO: 285864 - DNA, 25 bp, Mus musculus
attgtggacgccgaacacggacaag

SEQ ID NO: 285865 - DNA, 25 bp, Mus musculus
attgtggacttaatctttactttgt

SEQ ID NO: 285866 - DNA, 25 bp, Mus musculus
attgtggacttattctttactttgt

SEQ ID NO: 285867 - DNA, 25 bp, Mus musculus
attgtggaggtgctgcacccttgtt

SEQ ID NO: 285868 - DNA, 25 bp, Mus musculus
attgtggaggtggtgcacccttgtt

SEQ ID NO: 285869 - DNA, 25 bp, Mus musculus
attgtggatacaccaaggcagcagg

SEQ ID NO: 285870 - DNA, 25 bp, Mus musculus
attgtggatacagcaaggcagcagg

SEQ ID NO: 285871 - DNA, 25 bp, Mus musculus
attgtggatagacccctgggaccca

SEQ ID NO: 285872 - DNA, 25 bp, Mus musculus
attgtggatagagccctgggaccca

SEQ ID NO: 285873 - DNA, 25 bp, Mus musculus
attgtggatccaatttttattgcat

SEQ ID NO: 285874 - DNA, 25 bp, Mus musculus
attgtggatccattttttattgcat

SEQ ID NO: 285875 - DNA, 25 bp, Mus musculus
attgtggatcctaccaatttggaat

SEQ ID NO: 285876 - DNA, 25 bp, Mus musculus
attgtggatccttccaatttggaat

SEQ ID NO: 285877 - DNA, 25 bp, Mus musculus
attgtggatgctatatccgatccaa

SEQ ID NO: 285878 - DNA, 25 bp, Mus musculus
attgtggatgctttatccgatccaa

SEQ ID NO: 285879 - DNA, 25 bp, Mus musculus
attgtggattttagctgctcccctc

SEQ ID NO: 285880 - DNA, 25 bp, Mus musculus
attgtggatttttgctgctcccctc

SEQ ID NO: 285881 - DNA, 25 bp, Mus musculus
attgtggcagtaccatcctcttgaa

SEQ ID NO: 285882 - DNA, 25 bp, Mus musculus
attgtggcagtagcatcctcttgaa

SEQ ID NO: 285883 - DNA, 25 bp, Mus musculus
attgtggcatgcagggtaactggaa

SEQ ID NO: 285884 - DNA, 25 bp, Mus musculus
attgtggcatgctgggtaactggaa

SEQ ID NO: 285885 - DNA, 25 bp, Mus musculus
attgtggcattgctgtacaacgtgt

SEQ ID NO: 285886 - DNA, 25 bp, Mus musculus
attgtggcattggtgtacaacgtgt

SEQ ID NO: 285887 - DNA, 25 bp, Mus musculus
attgtggccacacttgaccgtgacc

SEQ ID NO: 285888 - DNA, 25 bp, Mus musculus
attgtggccacagttgaccgtgacc

SEQ ID NO: 285889 - DNA, 25 bp, Mus musculus
attgtggccattataaagtcagatg

SEQ ID NO: 285890 - DNA, 25 bp, Mus musculus
attgtggccattttaaagtcagatg

SEQ ID NO: 285891 - DNA, 25 bp, Mus musculus
attgtggcccttaagcttaactgtg

SEQ ID NO: 285892 - DNA, 25 bp, Mus musculus
attgtggccctttagcttaactgtg

SEQ ID NO: 285893 - DNA, 25 bp, Mus musculus
attgtggcgccaatttttggacaac

SEQ ID NO: 285894 - DNA, 25 bp, Mus musculus
attgtggcgccattttttggacaac

SEQ ID NO: 285895 - DNA, 25 bp, Mus musculus
attgtggcggtaatggtgtttctta

SEQ ID NO: 285896 - DNA, 25 bp, Mus musculus
attgtggcggtattggtgtttctta

SEQ ID NO: 285897 - DNA, 25 bp, Mus musculus
attgtggctcacaggtgggcagtac

SEQ ID NO: 285898 - DNA, 25 bp, Mus musculus
attgtggctcactggtgggcagtac

SEQ ID NO: 285899 - DNA, 25 bp, Mus musculus
attgtgggaagtctctaacctggga

SEQ ID NO: 285900 - DNA, 25 bp, Mus musculus
attgtgggaagtgtctaacctggga

SEQ ID NO: 285901 - DNA, 25 bp, Mus musculus
attgtgggacagaaccccagtcctg

SEQ ID NO: 285902 - DNA, 25 bp, Mus musculus
attgtgggacagtaccccagtcctg

SEQ ID NO: 285903 - DNA, 25 bp, Mus musculus
attgtgggacatcctctaatgccag

SEQ ID NO: 285904 - DNA, 25 bp, Mus musculus
attgtgggacatgctctaatgccag

SEQ ID NO: 285905 - DNA, 25 bp, Mus musculus
attgtgggagctactccgatttgga

SEQ ID NO: 285906 - DNA, 25 bp, Mus musculus
attgtgggagcttctccgatttgga

SEQ ID NO: 285907 - DNA, 25 bp, Mus musculus
attgtgggccagatttactccctta

SEQ ID NO: 285908 - DNA, 25 bp, Mus musculus
attgtgggccagttttactccctta

SEQ ID NO: 285909 - DNA, 25 bp, Mus musculus
attgtgggctccaaggcatgagaaa

SEQ ID NO: 285910 - DNA, 25 bp, Mus musculus
attgtgggctcctaggcatgagaaa

SEQ ID NO: 285911 - DNA, 25 bp, Mus musculus
attgtgggctggagcaagctgaact

SEQ ID NO: 285912 - DNA, 25 bp, Mus musculus
attgtgggctggtgcaagctgaact

SEQ ID NO: 285913 - DNA, 25 bp, Mus musculus
attgtgggtagaaggcccttgtgcc

SEQ ID NO: 285914 - DNA, 25 bp, Mus musculus
attgtgggtagatggcccttgtgcc

SEQ ID NO: 285915 - DNA, 25 bp, Mus musculus
attgtgggtgggatgacagcctcaa

SEQ ID NO: 285916 - DNA, 25 bp, Mus musculus
attgtgggtgggttgacagcctcaa

SEQ ID NO: 285917 - DNA, 25 bp, Mus musculus
attgtgggtgtgatctagaggcaga

SEQ ID NO: 285918 - DNA, 25 bp, Mus musculus
attgtgggtgtgttctagaggcaga

SEQ ID NO: 285919 - DNA, 25 bp, Mus musculus
attgtggtaatgctctgtaatggtt

SEQ ID NO: 285920 - DNA, 25 bp, Mus musculus
attgtggtaatggtctgtaatggtt

SEQ ID NO: 285921 - DNA, 25 bp, Mus musculus
attgtggtcaatacgctggcatggc

SEQ ID NO: 285922 - DNA, 25 bp, Mus musculus
attgtggtcaattcgctggcatggc

SEQ ID NO: 285923 - DNA, 25 bp, Mus musculus
attgtggtcctgaaagtctgttcaa

SEQ ID NO: 285924 - DNA, 25 bp, Mus musculus
attgtggtcctgtaagtctgttcaa

SEQ ID NO: 285925 - DNA, 25 bp, Mus musculus
attgtggtcgctaagtcctgcttcc

SEQ ID NO: 285926 - DNA, 25 bp, Mus musculus
attgtggtcgcttagtcctgcttcc

SEQ ID NO: 285927 - DNA, 25 bp, Mus musculus
attgtggtgactaacactgccccaa

SEQ ID NO: 285928 - DNA, 25 bp, Mus musculus
attgtggtgacttacactgccccaa

SEQ ID NO: 285929 - DNA, 25 bp, Mus musculus
attgtggtgtccaaccagctactca

SEQ ID NO: 285930 - DNA, 25 bp, Mus musculus
attgtggtgtcctaccagctactca

SEQ ID NO: 285931 - DNA, 25 bp, Mus musculus
attgtggtgtttcctctgggatctc

SEQ ID NO: 285932 - DNA, 25 bp, Mus musculus
attgtggtgtttgctctgggatctc

SEQ ID NO: 285933 - DNA, 25 bp, Mus musculus
attgtggttacccactgcccagaga

SEQ ID NO: 285934 - DNA, 25 bp, Mus musculus
attgtggttaccgactgcccagaga

SEQ ID NO: 285935 - DNA, 25 bp, Mus musculus
attgtggttagcatgtctgagatac

SEQ ID NO: 285936 - DNA, 25 bp, Mus musculus
attgtggttagcttgtctgagatac

SEQ ID NO: 285937 - DNA, 25 bp, Mus musculus
attgtggttatcacaagtccttgtt

SEQ ID NO: 285938 - DNA, 25 bp, Mus musculus
attgtggttatctcaagtccttgtt

SEQ ID NO: 285939 - DNA, 25 bp, Mus musculus
attgtggttcttccccagagttaca

SEQ ID NO: 285940 - DNA, 25 bp, Mus musculus
attgtggttcttgcccagagttaca

SEQ ID NO: 285941 - DNA, 25 bp, Mus musculus
attgtggttggtcagcacagcccct

SEQ ID NO: 285942 - DNA, 25 bp, Mus musculus
attgtggttggtgagcacagcccct

SEQ ID NO: 285943 - DNA, 25 bp, Mus musculus
attgtggttttaagctgcttgaaag

SEQ ID NO: 285944 - DNA, 25 bp, Mus musculus
attgtggttttatgctgcttgaaag

SEQ ID NO: 285945 - DNA, 25 bp, Mus musculus
attgtggtttttacactgttcgtgg

SEQ ID NO: 285946 - DNA, 25 bp, Mus musculus
attgtggttttttcactgttcgtgg

SEQ ID NO: 285947 - DNA, 25 bp, Mus musculus
attgtgtaacacaatgctcatgcta

SEQ ID NO: 285948 - DNA, 25 bp, Mus musculus
attgtgtaacactatgctcatgcta

SEQ ID NO: 285949 - DNA, 25 bp, Mus musculus
attgtgtaaccaaggatgggaagga

SEQ ID NO: 285950 - DNA, 25 bp, Mus musculus
attgtgtaaccatggatgggaagga

SEQ ID NO: 285951 - DNA, 25 bp, Mus musculus
attgtgtaactgctctctttttccc

SEQ ID NO: 285952 - DNA, 25 bp, Mus musculus
attgtgtaactggtctctttttccc

SEQ ID NO: 285953 - DNA, 25 bp, Mus musculus
attgtgtactaccagccactggtct

SEQ ID NO: 285954 - DNA, 25 bp, Mus musculus
attgtgtactacgagccactggtct

SEQ ID NO: 285955 - DNA, 25 bp, Mus musculus
attgtgtacttgagaataacgtgca

SEQ ID NO: 285956 - DNA, 25 bp, Mus musculus
attgtgtacttgtgaataacgtgca

SEQ ID NO: 285957 - DNA, 25 bp, Mus musculus
attgtgtagaaactgactccggcca

SEQ ID NO: 285958 - DNA, 25 bp, Mus musculus
attgtgtagaaagtgactccggcca

SEQ ID NO: 285959 - DNA, 25 bp, Mus musculus
attgtgtagtaactgtagaaccctg

SEQ ID NO: 285960 - DNA, 25 bp, Mus musculus
attgtgtagtaagtgtagaaccctg

SEQ ID NO: 285961 - DNA, 25 bp, Mus musculus
attgtgtagtgacccttgtttatta

SEQ ID NO: 285962 - DNA, 25 bp, Mus musculus
attgtgtagtgagccttgtttatta

SEQ ID NO: 285963 - DNA, 25 bp, Mus musculus
attgtgtagtgccatgtttgtgaaa

SEQ ID NO: 285964 - DNA, 25 bp, Mus musculus
attgtgtagtgcgatgtttgtgaaa

SEQ ID NO: 285965 - DNA, 25 bp, Mus musculus
attgtgtataccactttcaactgga

SEQ ID NO: 285966 - DNA, 25 bp, Mus musculus
attgtgtatacctctttcaactgga

SEQ ID NO: 285967 - DNA, 25 bp, Mus musculus
attgtgtattccatacttcttatag

SEQ ID NO: 285968 - DNA, 25 bp, Mus musculus
attgtgtattccttacttcttatag

SEQ ID NO: 285969 - DNA, 25 bp, Mus musculus
attgtgtcaattcatggatggttat

SEQ ID NO: 285970 - DNA, 25 bp, Mus musculus
attgtgtcaattgatggatggttat

SEQ ID NO: 285971 - DNA, 25 bp, Mus musculus
attgtgtcacagactctcagagtag

SEQ ID NO: 285972 - DNA, 25 bp, Mus musculus
attgtgtcacagtctctcagagtag

SEQ ID NO: 285973 - DNA, 25 bp, Mus musculus
attgtgtcacatatctgttcctcca

SEQ ID NO: 285974 - DNA, 25 bp, Mus musculus
attgtgtcacatttctgttcctcca

SEQ ID NO: 285975 - DNA, 25 bp, Mus musculus
attgtgtcactcatgacctgcttga

SEQ ID NO: 285976 - DNA, 25 bp, Mus musculus
attgtgtcactcttgacctgcttga

SEQ ID NO: 285977 - DNA, 25 bp, Mus musculus
attgtgtcagtgagttatcagtcta

SEQ ID NO: 285978 - DNA, 25 bp, Mus musculus
attgtgtcagtgtgttatcagtcta

SEQ ID NO: 285979 - DNA, 25 bp, Mus musculus
attgtgtcatgtatccttaggcttt

SEQ ID NO: 285980 - DNA, 25 bp, Mus musculus
attgtgtcatgtttccttaggcttt

SEQ ID NO: 285981 - DNA, 25 bp, Mus musculus
attgtgtcccggctgaattcattaa

SEQ ID NO: 285982 - DNA, 25 bp, Mus musculus
attgtgtcccgggtgaattcattaa

SEQ ID NO: 285983 - DNA, 25 bp, Mus musculus
attgtgtccttactttctcatccta

SEQ ID NO: 285984 - DNA, 25 bp, Mus musculus
attgtgtccttagtttctcatccta

SEQ ID NO: 285985 - DNA, 25 bp, Mus musculus
attgtgtcggagaccgagatccccg

SEQ ID NO: 285986 - DNA, 25 bp, Mus musculus
attgtgtcggagtccgagatccccg

SEQ ID NO: 285987 - DNA, 25 bp, Mus musculus
attgtgtctagaaatcttttcatta

SEQ ID NO: 285988 - DNA, 25 bp, Mus musculus
attgtgtctagatatcttttcatta

SEQ ID NO: 285989 - DNA, 25 bp, Mus musculus
attgtgtctcccacatgaagcccta

SEQ ID NO: 285990 - DNA, 25 bp, Mus musculus
attgtgtctccctcatgaagcccta

SEQ ID NO: 285991 - DNA, 25 bp, Mus musculus
attgtgtcttcactgctccattaga

SEQ ID NO: 285992 - DNA, 25 bp, Mus musculus
attgtgtcttcagtgctccattaga

SEQ ID NO: 285993 - DNA, 25 bp, Mus musculus
attgtgtgacaaaaaccctgcagta

SEQ ID NO: 285994 - DNA, 25 bp, Mus musculus
attgtgtgacaataaccctgcagta

SEQ ID NO: 285995 - DNA, 25 bp, Mus musculus
attgtgtgactaacagctatctgtg

SEQ ID NO: 285996 - DNA, 25 bp, Mus musculus
attgtgtgactatcagctatctgtg

SEQ ID NO: 285997 - DNA, 25 bp, Mus musculus
attgtgtgacttactgctgaggagt

SEQ ID NO: 285998 - DNA, 25 bp, Mus musculus
attgtgtgactttctgctgaggagt

SEQ ID NO: 285999 - DNA, 25 bp, Mus musculus
attgtgtgcaatatgggccattcca

SEQ ID NO: 286000 - DNA, 25 bp, Mus musculus
attgtgtgcaatttgggccattcca

SEQ ID NO: 286001 - DNA, 25 bp, Mus musculus
attgtgtgcattaccacctatgcca

SEQ ID NO: 286002 - DNA, 25 bp, Mus musculus
attgtgtgcatttccacctatgcca

SEQ ID NO: 286003 - DNA, 25 bp, Mus musculus
attgtgtgccataggaccttctgct

SEQ ID NO: 286004 - DNA, 25 bp, Mus musculus
attgtgtgccattggaccttctgct

SEQ ID NO: 286005 - DNA, 25 bp, Mus musculus
attgtgtggcccatttatgtttcag

SEQ ID NO: 286006 - DNA, 25 bp, Mus musculus
attgtgtggcccttttatgtttcag

SEQ ID NO: 286007 - DNA, 25 bp, Mus musculus
attgtgtggcgaaaactactaatac

SEQ ID NO: 286008 - DNA, 25 bp, Mus musculus
attgtgtggcgataactactaatac

SEQ ID NO: 286009 - DNA, 25 bp, Mus musculus
attgtgtggctgattatggtggtat

SEQ ID NO: 286010 - DNA, 25 bp, Mus musculus
attgtgtggctgtttatggtggtat

SEQ ID NO: 286011 - DNA, 25 bp, Mus musculus
attgtgtgtgtcatgagccctggct

SEQ ID NO: 286012 - DNA, 25 bp, Mus musculus
attgtgtgtgtcttgagccctggct

SEQ ID NO: 286013 - DNA, 25 bp, Mus musculus
attgtgtgtttcagcaatcctggtg

SEQ ID NO: 286014 - DNA, 25 bp, Mus musculus
attgtgtgtttctgcaatcctggtg

SEQ ID NO: 286015 - DNA, 25 bp, Mus musculus
attgtgttaagtcgctcagtacagc

SEQ ID NO: 286016 - DNA, 25 bp, Mus musculus
attgtgttaagtggctcagtacagc

SEQ ID NO: 286017 - DNA, 25 bp, Mus musculus
attgtgttacaacactcctggaatc

SEQ ID NO: 286018 - DNA, 25 bp, Mus musculus
attgtgttacaagactcctggaatc

SEQ ID NO: 286019 - DNA, 25 bp, Mus musculus
attgtgttacctcaggcagagtagt

SEQ ID NO: 286020 - DNA, 25 bp, Mus musculus
attgtgttacctgaggcagagtagt

SEQ ID NO: 286021 - DNA, 25 bp, Mus musculus
attgtgttcacaccaaccatcttca

SEQ ID NO: 286022 - DNA, 25 bp, Mus musculus
attgtgttcacagcaaccatcttca

SEQ ID NO: 286023 - DNA, 25 bp, Mus musculus
attgtgttcctcagagctaagcagc

SEQ ID NO: 286024 - DNA, 25 bp, Mus musculus
attgtgttcctctgagctaagcagc

SEQ ID NO: 286025 - DNA, 25 bp, Mus musculus
attgtgttctgcagtgtggcatcca

SEQ ID NO: 286026 - DNA, 25 bp, Mus musculus
attgtgttctgctgtgtggcatcca

SEQ ID NO: 286027 - DNA, 25 bp, Mus musculus
attgtgttgctgctcttggaaggtc

SEQ ID NO: 286028 - DNA, 25 bp, Mus musculus
attgtgttgctggtcttggaaggtc

SEQ ID NO: 286029 - DNA, 25 bp, Mus musculus
attgtgtttcagctacaccagcgag

SEQ ID NO: 286030 - DNA, 25 bp, Mus musculus
attgtgtttcaggtacaccagcgag

SEQ ID NO: 286031 - DNA, 25 bp, Mus musculus
attgtgtttccccagtgctcaatga

SEQ ID NO: 286032 - DNA, 25 bp, Mus musculus
attgtgtttcccgagtgctcaatga

SEQ ID NO: 286033 - DNA, 25 bp, Mus musculus
attgtgtttcctcgcccggcttata

SEQ ID NO: 286034 - DNA, 25 bp, Mus musculus
attgtgtttcctggcccggcttata

SEQ ID NO: 286035 - DNA, 25 bp, Mus musculus
attgtgttttctctgtattatgtgc

SEQ ID NO: 286036 - DNA, 25 bp, Mus musculus
attgtgttttctgtgtattatgtgc

SEQ ID NO: 286037 - DNA, 25 bp, Mus musculus
attgttaagctaattctttgtaaag

SEQ ID NO: 286038 - DNA, 25 bp, Mus musculus
attgttaagctatttctttgtaaag

SEQ ID NO: 286039 - DNA, 25 bp, Mus musculus
attgttaataagaaggcagggcctg

SEQ ID NO: 286040 - DNA, 25 bp, Mus musculus
attgttaataagtaggcagggcctg

SEQ ID NO: 286041 - DNA, 25 bp, Mus musculus
attgttaataccaggctcacctata

SEQ ID NO: 286042 - DNA, 25 bp, Mus musculus
attgttaatacctggctcacctata

SEQ ID NO: 286043 - DNA, 25 bp, Mus musculus
attgttaatgctctcttcttatgga

SEQ ID NO: 286044 - DNA, 25 bp, Mus musculus
attgttaatgctgtcttcttatgga

SEQ ID NO: 286045 - DNA, 25 bp, Mus musculus
attgttaatggactttttctatggg

SEQ ID NO: 286046 - DNA, 25 bp, Mus musculus
attgttaatggagtttttctatggg

SEQ ID NO: 286047 - DNA, 25 bp, Mus musculus
attgttaattgcagggcctgtggct

SEQ ID NO: 286048 - DNA, 25 bp, Mus musculus
attgttaattgctgggcctgtggct

SEQ ID NO: 286049 - DNA, 25 bp, Mus musculus
attgttacaacacaaaggacttttg

SEQ ID NO: 286050 - DNA, 25 bp, Mus musculus
attgttacaacagaaaggacttttg

SEQ ID NO: 286051 - DNA, 25 bp, Mus musculus
attgttacaatccatgcccatgcac

SEQ ID NO: 286052 - DNA, 25 bp, Mus musculus
attgttacaatcgatgcccatgcac

SEQ ID NO: 286053 - DNA, 25 bp, Mus musculus
attgttacaccacttatcacccttc

SEQ ID NO: 286054 - DNA, 25 bp, Mus musculus
attgttacaccagttatcacccttc

SEQ ID NO: 286055 - DNA, 25 bp, Mus musculus
attgttacacctaaggctcctgttt

SEQ ID NO: 286056 - DNA, 25 bp, Mus musculus
attgttacaccttaggctcctgttt

SEQ ID NO: 286057 - DNA, 25 bp, Mus musculus
attgttacagtgcaccaaccccagt

SEQ ID NO: 286058 - DNA, 25 bp, Mus musculus
attgttacagtggaccaaccccagt

SEQ ID NO: 286059 - DNA, 25 bp, Mus musculus
attgttaccactcccaaatcttagt

SEQ ID NO: 286060 - DNA, 25 bp, Mus musculus
attgttaccactgccaaatcttagt

SEQ ID NO: 286061 - DNA, 25 bp, Mus musculus
attgttacgggcatggtgtcacctt

SEQ ID NO: 286062 - DNA, 25 bp, Mus musculus
attgttacgggcttggtgtcacctt

SEQ ID NO: 286063 - DNA, 25 bp, Mus musculus
attgttactgccatggttccagtct

SEQ ID NO: 286064 - DNA, 25 bp, Mus musculus
attgttactgccttggttccagtct

SEQ ID NO: 286065 - DNA, 25 bp, Mus musculus
attgttagaaacatgtccccattta

SEQ ID NO: 286066 - DNA, 25 bp, Mus musculus
attgttagaaacttgtccccattta

SEQ ID NO: 286067 - DNA, 25 bp, Mus musculus
attgttagagttcttcacctccact

SEQ ID NO: 286068 - DNA, 25 bp, Mus musculus
attgttagagttgttcacctccact

SEQ ID NO: 286069 - DNA, 25 bp, Mus musculus
attgttagcatgaacttgaaatgga

SEQ ID NO: 286070 - DNA, 25 bp, Mus musculus
attgttagcatgtacttgaaatgga

SEQ ID NO: 286071 - DNA, 25 bp, Mus musculus
attgttagcttcagcttgcccatgt

SEQ ID NO: 286072 - DNA, 25 bp, Mus musculus
attgttagcttctgcttgcccatgt

SEQ ID NO: 286073 - DNA, 25 bp, Mus musculus
attgttagggacagaatgtgtgtac

SEQ ID NO: 286074 - DNA, 25 bp, Mus musculus
attgttagggacagcacagcctttc

SEQ ID NO: 286075 - DNA, 25 bp, Mus musculus
attgttagggactgaatgtgtgtac

SEQ ID NO: 286076 - DNA, 25 bp, Mus musculus
attgttagggactgcacagcctttc

SEQ ID NO: 286077 - DNA, 25 bp, Mus musculus
attgttagggtacgcagcaagcact

SEQ ID NO: 286078 - DNA, 25 bp, Mus musculus
attgttagggtaggcagcaagcact

SEQ ID NO: 286079 - DNA, 25 bp, Mus musculus
attgttagtcttagaacattttaca

SEQ ID NO: 286080 - DNA, 25 bp, Mus musculus
attgttagtctttgaacattttaca

SEQ ID NO: 286081 - DNA, 25 bp, Mus musculus
attgttagtgttaagcttctggcca

SEQ ID NO: 286082 - DNA, 25 bp, Mus musculus
attgttagtgtttagcttctggcca

SEQ ID NO: 286083 - DNA, 25 bp, Mus musculus
attgttataatcactgcctcttgca

SEQ ID NO: 286084 - DNA, 25 bp, Mus musculus
attgttataatctctgcctcttgca

SEQ ID NO: 286085 - DNA, 25 bp, Mus musculus
attgttataccaatcaagtgtcttg

SEQ ID NO: 286086 - DNA, 25 bp, Mus musculus
attgttataccattcaagtgtcttg

SEQ ID NO: 286087 - DNA, 25 bp, Mus musculus
attgttatcactattccttgctatc

SEQ ID NO: 286088 - DNA, 25 bp, Mus musculus
attgttatcacttttccttgctatc

SEQ ID NO: 286089 - DNA, 25 bp, Mus musculus
attgttatccggaccaggagacctt

SEQ ID NO: 286090 - DNA, 25 bp, Mus musculus
attgttatccggtccaggagacctt

SEQ ID NO: 286091 - DNA, 25 bp, Mus musculus
attgttatgaagatccctggcactc

SEQ ID NO: 286092 - DNA, 25 bp, Mus musculus
attgttatgaagttccctggcactc

SEQ ID NO: 286093 - DNA, 25 bp, Mus musculus
attgttatgtaacccttgttcttat

SEQ ID NO: 286094 - DNA, 25 bp, Mus musculus
attgttatgtaagccttgttcttat

SEQ ID NO: 286095 - DNA, 25 bp, Mus musculus
attgttattctgacaacctccagag

SEQ ID NO: 286096 - DNA, 25 bp, Mus musculus
attgttattctgtcaacctccagag

SEQ ID NO: 286097 - DNA, 25 bp, Mus musculus
attgttatttatcctgtcttgtgaa

SEQ ID NO: 286098 - DNA, 25 bp, Mus musculus
attgttatttatgctgtcttgtgaa

SEQ ID NO: 286099 - DNA, 25 bp, Mus musculus
attgttcaaagactctctcccactc

SEQ ID NO: 286100 - DNA, 25 bp, Mus musculus
attgttcaaagagtctctcccactc

SEQ ID NO: 286101 - DNA, 25 bp, Mus musculus
attgttcacaggcaaaatcaggaaa

SEQ ID NO: 286102 - DNA, 25 bp, Mus musculus
attgttcacagggaaaatcaggaaa

SEQ ID NO: 286103 - DNA, 25 bp, Mus musculus
attgttcaccagcagacttttgccc

SEQ ID NO: 286104 - DNA, 25 bp, Mus musculus
attgttcaccaggagacttttgccc

SEQ ID NO: 286105 - DNA, 25 bp, Mus musculus
attgttcaccctcgataatgtctgt

SEQ ID NO: 286106 - DNA, 25 bp, Mus musculus
attgttcaccctggataatgtctgt

SEQ ID NO: 286107 - DNA, 25 bp, Mus musculus
attgttcaccggcaaagatcctgcg

SEQ ID NO: 286108 - DNA, 25 bp, Mus musculus
attgttcaccgggaaagatcctgcg

SEQ ID NO: 286109 - DNA, 25 bp, Mus musculus
attgttcacctcaagctagcacaga

SEQ ID NO: 286110 - DNA, 25 bp, Mus musculus
attgttcacctctagctagcacaga

SEQ ID NO: 286111 - DNA, 25 bp, Mus musculus
attgttcagcatatgacaaggcctg

SEQ ID NO: 286112 - DNA, 25 bp, Mus musculus
attgttcagcatttgacaaggcctg

SEQ ID NO: 286113 - DNA, 25 bp, Mus musculus
attgttcaggatatttctgtacagg

SEQ ID NO: 286114 - DNA, 25 bp, Mus musculus
attgttcaggatttttctgtacagg

SEQ ID NO: 286115 - DNA, 25 bp, Mus musculus
attgttcagggtccaatcccgagcc

SEQ ID NO: 286116 - DNA, 25 bp, Mus musculus
attgttcagggtgcaatcccgagcc

SEQ ID NO: 286117 - DNA, 25 bp, Mus musculus
attgttcatcccatttgtttgccag

SEQ ID NO: 286118 - DNA, 25 bp, Mus musculus
attgttcatcccttttgtttgccag

SEQ ID NO: 286119 - DNA, 25 bp, Mus musculus
attgttcatgaaccagggcccgtca

SEQ ID NO: 286120 - DNA, 25 bp, Mus musculus
attgttcatgaagcagggcccgtca

SEQ ID NO: 286121 - DNA, 25 bp, Mus musculus
attgttccaaagctttagtgatgta

SEQ ID NO: 286122 - DNA, 25 bp, Mus musculus
attgttccaaaggtttagtgatgta

SEQ ID NO: 286123 - DNA, 25 bp, Mus musculus
attgttccacacagcatggcacaag

SEQ ID NO: 286124 - DNA, 25 bp, Mus musculus
attgttccacactgcatggcacaag

SEQ ID NO: 286125 - DNA, 25 bp, Mus musculus
attgttccacgccatttctggagag

SEQ ID NO: 286126 - DNA, 25 bp, Mus musculus
attgttccacgcgatttctggagag

SEQ ID NO: 286127 - DNA, 25 bp, Mus musculus
attgttccagataacaccttcacta

SEQ ID NO: 286128 - DNA, 25 bp, Mus musculus
attgttccagattacaccttcacta

SEQ ID NO: 286129 - DNA, 25 bp, Mus musculus
attgttcccaaccttagtatacaga

SEQ ID NO: 286130 - DNA, 25 bp, Mus musculus
attgttcccaacgttagtatacaga

SEQ ID NO: 286131 - DNA, 25 bp, Mus musculus
attgttcccttacccaaactgacat

SEQ ID NO: 286132 - DNA, 25 bp, Mus musculus
attgttcccttagccaaactgacat

SEQ ID NO: 286133 - DNA, 25 bp, Mus musculus
attgttcctaggctgctgctatgta

SEQ ID NO: 286134 - DNA, 25 bp, Mus musculus
attgttcctaggctgctgctgtgta

SEQ ID NO: 286135 - DNA, 25 bp, Mus musculus
attgttcctagggtgctgctatgta

SEQ ID NO: 286136 - DNA, 25 bp, Mus musculus
attgttcctagggtgctgctgtgta

SEQ ID NO: 286137 - DNA, 25 bp, Mus musculus
attgttcctcgcatactctgtgttt

SEQ ID NO: 286138 - DNA, 25 bp, Mus musculus
attgttcctcgcttactctgtgttt

SEQ ID NO: 286139 - DNA, 25 bp, Mus musculus
attgttcctggtcgtggatgtgcca

SEQ ID NO: 286140 - DNA, 25 bp, Mus musculus
attgttcctggtggtggatgtgcca

SEQ ID NO: 286141 - DNA, 25 bp, Mus musculus
attgttcctgtgaagacctgtgtac

SEQ ID NO: 286142 - DNA, 25 bp, Mus musculus
attgttcctgtgtagacctgtgtac

SEQ ID NO: 286143 - DNA, 25 bp, Mus musculus
attgttccttctattgttctctgtg

SEQ ID NO: 286144 - DNA, 25 bp, Mus musculus
attgttccttcttttgttctctgtg

SEQ ID NO: 286145 - DNA, 25 bp, Mus musculus
attgttccttggctcaccctcaggg

SEQ ID NO: 286146 - DNA, 25 bp, Mus musculus
attgttccttgggtcaccctcaggg

SEQ ID NO: 286147 - DNA, 25 bp, Mus musculus
attgttcgagcaccgtgtggatgat

SEQ ID NO: 286148 - DNA, 25 bp, Mus musculus
attgttcgagcagcgtgtggatgat

SEQ ID NO: 286149 - DNA, 25 bp, Mus musculus
attgttcgcactccttaagacccag

SEQ ID NO: 286150 - DNA, 25 bp, Mus musculus
attgttcgcactgcttaagacccag

SEQ ID NO: 286151 - DNA, 25 bp, Mus musculus
attgttcggacaaagtgccctttga

SEQ ID NO: 286152 - DNA, 25 bp, Mus musculus
attgttcggacatagtgccctttga

SEQ ID NO: 286153 - DNA, 25 bp, Mus musculus
attgttctaaccaatcatattgtga

SEQ ID NO: 286154 - DNA, 25 bp, Mus musculus
attgttctaacctatcatattgtga

SEQ ID NO: 286155 - DNA, 25 bp, Mus musculus
attgttctaccacataaggagctaa

SEQ ID NO: 286156 - DNA, 25 bp, Mus musculus
attgttctaccagataaggagctaa

SEQ ID NO: 286157 - DNA, 25 bp, Mus musculus
attgttctagctccatgttatttat

SEQ ID NO: 286158 - DNA, 25 bp, Mus musculus
attgttctagctgcatgttatttat

SEQ ID NO: 286159 - DNA, 25 bp, Mus musculus
attgttctaggcctctcccaaagtc

SEQ ID NO: 286160 - DNA, 25 bp, Mus musculus
attgttctaggcgtctcccaaagtc

SEQ ID NO: 286161 - DNA, 25 bp, Mus musculus
attgttctcctaaactgactctctg

SEQ ID NO: 286162 - DNA, 25 bp, Mus musculus
attgttctcctatactgactctctg

SEQ ID NO: 286163 - DNA, 25 bp, Mus musculus
attgttctgcctcacacccttggat

SEQ ID NO: 286164 - DNA, 25 bp, Mus musculus
attgttctgcctgacacccttggat

SEQ ID NO: 286165 - DNA, 25 bp, Mus musculus
attgttctgcggcatattgggtcac

SEQ ID NO: 286166 - DNA, 25 bp, Mus musculus
attgttctgcgggatattgggtcac

SEQ ID NO: 286167 - DNA, 25 bp, Mus musculus
attgttctgcttcttctgtggttat

SEQ ID NO: 286168 - DNA, 25 bp, Mus musculus
attgttctgcttgttctgtggttat

SEQ ID NO: 286169 - DNA, 25 bp, Mus musculus
attgttctggatcacctagctgctc

SEQ ID NO: 286170 - DNA, 25 bp, Mus musculus
attgttctggatgacctagctgctc

SEQ ID NO: 286171 - DNA, 25 bp, Mus musculus
attgttctgggcatgtcagtgggac

SEQ ID NO: 286172 - DNA, 25 bp, Mus musculus
attgttctgggcttgtcagtgggac

SEQ ID NO: 286173 - DNA, 25 bp, Mus musculus
attgttctgtccacttttgacgttg

SEQ ID NO: 286174 - DNA, 25 bp, Mus musculus
attgttctgtcctcttttgacgttg

SEQ ID NO: 286175 - DNA, 25 bp, Mus musculus
attgttcttattccaaccacagttt

SEQ ID NO: 286176 - DNA, 25 bp, Mus musculus
attgttcttattcgccttgccttgc

SEQ ID NO: 286177 - DNA, 25 bp, Mus musculus
attgttcttattgcaaccacagttt

SEQ ID NO: 286178 - DNA, 25 bp, Mus musculus
attgttcttattggccttgccttgc

SEQ ID NO: 286179 - DNA, 25 bp, Mus musculus
attgttcttcacatttccattggca

SEQ ID NO: 286180 - DNA, 25 bp, Mus musculus
attgttcttcacttttccattggca

SEQ ID NO: 286181 - DNA, 25 bp, Mus musculus
attgttcttgaaaaaaggctccacc

SEQ ID NO: 286182 - DNA, 25 bp, Mus musculus
attgttcttgaaaatagtcgatgct

SEQ ID NO: 286183 - DNA, 25 bp, Mus musculus
attgttcttgaataaaggctccacc

SEQ ID NO: 286184 - DNA, 25 bp, Mus musculus
attgttcttgaatatagtcgatgct

SEQ ID NO: 286185 - DNA, 25 bp, Mus musculus
attgttcttggtccactgatcacta

SEQ ID NO: 286186 - DNA, 25 bp, Mus musculus
attgttcttggtgcactgatcacta

SEQ ID NO: 286187 - DNA, 25 bp, Mus musculus
attgttgaacctaaccacttagaga

SEQ ID NO: 286188 - DNA, 25 bp, Mus musculus
attgttgaaccttaccacttagaga

SEQ ID NO: 286189 - DNA, 25 bp, Mus musculus
attgttgaatgcataaccattgtaa

SEQ ID NO: 286190 - DNA, 25 bp, Mus musculus
attgttgaatgcttaaccattgtaa

SEQ ID NO: 286191 - DNA, 25 bp, Mus musculus
attgttgacaaccatggcctgccct

SEQ ID NO: 286192 - DNA, 25 bp, Mus musculus
attgttgacaacgatggcctgccct

SEQ ID NO: 286193 - DNA, 25 bp, Mus musculus
attgttgactctcacttatctccac

SEQ ID NO: 286194 - DNA, 25 bp, Mus musculus
attgttgactctgacttatctccac

SEQ ID NO: 286195 - DNA, 25 bp, Mus musculus
attgttgacttaagtgcacactgtt

SEQ ID NO: 286196 - DNA, 25 bp, Mus musculus
attgttgacttatgtgcacactgtt

SEQ ID NO: 286197 - DNA, 25 bp, Mus musculus
attgttgactttcaaatcccttgat

SEQ ID NO: 286198 - DNA, 25 bp, Mus musculus
attgttgactttgaaatcccttgat

SEQ ID NO: 286199 - DNA, 25 bp, Mus musculus
attgttgaggtcactctctgttttc

SEQ ID NO: 286200 - DNA, 25 bp, Mus musculus
attgttgaggtctctctctgttttc

SEQ ID NO: 286201 - DNA, 25 bp, Mus musculus
attgttgatgagcattcgccggtcc

SEQ ID NO: 286202 - DNA, 25 bp, Mus musculus
attgttgatgaggattcgccggtcc

SEQ ID NO: 286203 - DNA, 25 bp, Mus musculus
attgttgatgctctctcattgttac

SEQ ID NO: 286204 - DNA, 25 bp, Mus musculus
attgttgatgctgtctcattgttac

SEQ ID NO: 286205 - DNA, 25 bp, Mus musculus
attgttgcaattcgattagagagtg

SEQ ID NO: 286206 - DNA, 25 bp, Mus musculus
attgttgcaattggattagagagtg

SEQ ID NO: 286207 - DNA, 25 bp, Mus musculus
attgttgcacatatatgtacttcag

SEQ ID NO: 286208 - DNA, 25 bp, Mus musculus
attgttgcacatttatgtacttcag

SEQ ID NO: 286209 - DNA, 25 bp, Mus musculus
attgttgccgcaactagttctgata

SEQ ID NO: 286210 - DNA, 25 bp, Mus musculus
attgttgccgcatctagttctgata

SEQ ID NO: 286211 - DNA, 25 bp, Mus musculus
attgttgcctcaatagtcggtggga

SEQ ID NO: 286212 - DNA, 25 bp, Mus musculus
attgttgcctcattagtcggtggga

SEQ ID NO: 286213 - DNA, 25 bp, Mus musculus
attgttgcctgacaaccccggacat

SEQ ID NO: 286214 - DNA, 25 bp, Mus musculus
attgttgcctgagaaccccggacat

SEQ ID NO: 286215 - DNA, 25 bp, Mus musculus
attgttgccttaactgtattcttga

SEQ ID NO: 286216 - DNA, 25 bp, Mus musculus
attgttgccttatctgtattcttga

SEQ ID NO: 286217 - DNA, 25 bp, Mus musculus
attgttgcggttattgtacatggct

SEQ ID NO: 286218 - DNA, 25 bp, Mus musculus
attgttgcggtttttgtacatggct

SEQ ID NO: 286219 - DNA, 25 bp, Mus musculus
attgttgcgtgccttgtaattcccc

SEQ ID NO: 286220 - DNA, 25 bp, Mus musculus
attgttgcgtgcgttgtaattcccc

SEQ ID NO: 286221 - DNA, 25 bp, Mus musculus
attgttgcttgtcctgatgggtcat

SEQ ID NO: 286222 - DNA, 25 bp, Mus musculus
attgttgcttgtgctgatgggtcat

SEQ ID NO: 286223 - DNA, 25 bp, Mus musculus
attgttggaatcacagacctggtaa

SEQ ID NO: 286224 - DNA, 25 bp, Mus musculus
attgttggaatctcagacctggtaa

SEQ ID NO: 286225 - DNA, 25 bp, Mus musculus
attgttggaattcagtttaactaca

SEQ ID NO: 286226 - DNA, 25 bp, Mus musculus
attgttggaattgagtttaactaca

SEQ ID NO: 286227 - DNA, 25 bp, Mus musculus
attgttggacatctagactagcttt

SEQ ID NO: 286228 - DNA, 25 bp, Mus musculus
attgttggacatgtagactagcttt

SEQ ID NO: 286229 - DNA, 25 bp, Mus musculus
attgttggataacccttcccagcca

SEQ ID NO: 286230 - DNA, 25 bp, Mus musculus
attgttggataagccttcccagcca

SEQ ID NO: 286231 - DNA, 25 bp, Mus musculus
attgttggctacacagcccgaagga

SEQ ID NO: 286232 - DNA, 25 bp, Mus musculus
attgttggctacatttctaaggaga

SEQ ID NO: 286233 - DNA, 25 bp, Mus musculus
attgttggctactcagcccgaagga

SEQ ID NO: 286234 - DNA, 25 bp, Mus musculus
attgttggctacttttctaaggaga

SEQ ID NO: 286235 - DNA, 25 bp, Mus musculus
attgttggctggaggtagctcatgc

SEQ ID NO: 286236 - DNA, 25 bp, Mus musculus
attgttggctggtggtagctcatgc

SEQ ID NO: 286237 - DNA, 25 bp, Mus musculus
attgttgggagtacctctctcacta

SEQ ID NO: 286238 - DNA, 25 bp, Mus musculus
attgttgggagttcctctctcacta

SEQ ID NO: 286239 - DNA, 25 bp, Mus musculus
attgttgggatcaaggcttccttac

SEQ ID NO: 286240 - DNA, 25 bp, Mus musculus
attgttgggatctaggcttccttac

SEQ ID NO: 286241 - DNA, 25 bp, Mus musculus
attgttgggattcctggctttctga

SEQ ID NO: 286242 - DNA, 25 bp, Mus musculus
attgttgggattgctggctttctga

SEQ ID NO: 286243 - DNA, 25 bp, Mus musculus
attgttggtactctgctgtttgtta

SEQ ID NO: 286244 - DNA, 25 bp, Mus musculus
attgttggtactgtgctgtttgtta

SEQ ID NO: 286245 - DNA, 25 bp, Mus musculus
attgttggtctacgttgtgtgtttc

SEQ ID NO: 286246 - DNA, 25 bp, Mus musculus
attgttggtctaggttgtgtgtttc

SEQ ID NO: 286247 - DNA, 25 bp, Mus musculus
attgttggttcccttttgccaagca

SEQ ID NO: 286248 - DNA, 25 bp, Mus musculus
attgttggttccgttttgccaagca

SEQ ID NO: 286249 - DNA, 25 bp, Mus musculus
attgttgtagctatctgttccactg

SEQ ID NO: 286250 - DNA, 25 bp, Mus musculus
attgttgtagctttctgttccactg

SEQ ID NO: 286251 - DNA, 25 bp, Mus musculus
attgttgtattcaatacttttatcc

SEQ ID NO: 286252 - DNA, 25 bp, Mus musculus
attgttgtattctatacttttatcc

SEQ ID NO: 286253 - DNA, 25 bp, Mus musculus
attgttgtccttagtaactgaatga

SEQ ID NO: 286254 - DNA, 25 bp, Mus musculus
attgttgtcctttgtaactgaatga

SEQ ID NO: 286255 - DNA, 25 bp, Mus musculus
attgttgtctatcatcactggcttc

SEQ ID NO: 286256 - DNA, 25 bp, Mus musculus
attgttgtctatgatcactggcttc

SEQ ID NO: 286257 - DNA, 25 bp, Mus musculus
attgttgtgccaatgttgcagcccc

SEQ ID NO: 286258 - DNA, 25 bp, Mus musculus
attgttgtgccattgttgcagcccc

SEQ ID NO: 286259 - DNA, 25 bp, Mus musculus
attgttgtgctgattttagtggtca

SEQ ID NO: 286260 - DNA, 25 bp, Mus musculus
attgttgtgctgtttttagtggtca

SEQ ID NO: 286261 - DNA, 25 bp, Mus musculus
attgttgtgtgtattctcttgtagc

SEQ ID NO: 286262 - DNA, 25 bp, Mus musculus
attgttgtgtgttttctcttgtagc

SEQ ID NO: 286263 - DNA, 25 bp, Mus musculus
attgttgttaggacacgtgtagtac

SEQ ID NO: 286264 - DNA, 25 bp, Mus musculus
attgttgttaggtcacgtgtagtac

SEQ ID NO: 286265 - DNA, 25 bp, Mus musculus
attgttgttcagcatggagttactc

SEQ ID NO: 286266 - DNA, 25 bp, Mus musculus
attgttgttcaggatggagttactc

SEQ ID NO: 286267 - DNA, 25 bp, Mus musculus
attgttgtttaaaatctgtgatcca

SEQ ID NO: 286268 - DNA, 25 bp, Mus musculus
attgttgtttaatatctgtgatcca

SEQ ID NO: 286269 - DNA, 25 bp, Mus musculus
attgtttaaactctgcacttggctg

SEQ ID NO: 286270 - DNA, 25 bp, Mus musculus
attgtttaaactgtgcacttggctg

SEQ ID NO: 286271 - DNA, 25 bp, Mus musculus
attgtttaaccaacacttgtctcct

SEQ ID NO: 286272 - DNA, 25 bp, Mus musculus
attgtttaaccatcacttgtctcct

SEQ ID NO: 286273 - DNA, 25 bp, Mus musculus
attgtttacagcatcaaccattgaa

SEQ ID NO: 286274 - DNA, 25 bp, Mus musculus
attgtttacagcttcaaccattgaa

SEQ ID NO: 286275 - DNA, 25 bp, Mus musculus
attgtttactaacttcccagcctgg

SEQ ID NO: 286276 - DNA, 25 bp, Mus musculus
attgtttactaagttcccagcctgg

SEQ ID NO: 286277 - DNA, 25 bp, Mus musculus
attgtttactcaaagctctcaatgg

SEQ ID NO: 286278 - DNA, 25 bp, Mus musculus
attgtttactcatagctctcaatgg

SEQ ID NO: 286279 - DNA, 25 bp, Mus musculus
attgtttactggcaggtggcatcca

SEQ ID NO: 286280 - DNA, 25 bp, Mus musculus
attgtttactgggaggtggcatcca

SEQ ID NO: 286281 - DNA, 25 bp, Mus musculus
attgtttagcgtacgcttttcccag

SEQ ID NO: 286282 - DNA, 25 bp, Mus musculus
attgtttagcgttcgcttttcccag

SEQ ID NO: 286283 - DNA, 25 bp, Mus musculus
attgtttagctgcagagggtgccct

SEQ ID NO: 286284 - DNA, 25 bp, Mus musculus
attgtttagctggagagggtgccct

SEQ ID NO: 286285 - DNA, 25 bp, Mus musculus
attgtttatcatatgcagtgcgccc

SEQ ID NO: 286286 - DNA, 25 bp, Mus musculus
attgtttatcatttgcagtgcgccc

SEQ ID NO: 286287 - DNA, 25 bp, Mus musculus
attgtttatccaatatccagcctca

SEQ ID NO: 286288 - DNA, 25 bp, Mus musculus
attgtttatccattatccagcctca

SEQ ID NO: 286289 - DNA, 25 bp, Mus musculus
attgtttattctataatctcacaga

SEQ ID NO: 286290 - DNA, 25 bp, Mus musculus
attgtttattctttaatctcacaga

SEQ ID NO: 286291 - DNA, 25 bp, Mus musculus
attgtttattgaaggctcttcttgc

SEQ ID NO: 286292 - DNA, 25 bp, Mus musculus
attgtttattgatggctcttcttgc

SEQ ID NO: 286293 - DNA, 25 bp, Mus musculus
attgtttcaacacgactatttttat

SEQ ID NO: 286294 - DNA, 25 bp, Mus musculus
attgtttcaacaggactatttttat

SEQ ID NO: 286295 - DNA, 25 bp, Mus musculus
attgtttcaggcatgtgactggcag

SEQ ID NO: 286296 - DNA, 25 bp, Mus musculus
attgtttcaggcttgtgactggcag

SEQ ID NO: 286297 - DNA, 25 bp, Mus musculus
attgtttcattaatgtcccctgttg

SEQ ID NO: 286298 - DNA, 25 bp, Mus musculus
attgtttcattattgtcccctgttg

SEQ ID NO: 286299 - DNA, 25 bp, Mus musculus
attgtttccatcatattgcagtgta

SEQ ID NO: 286300 - DNA, 25 bp, Mus musculus
attgtttccatcttattgcagtgta

SEQ ID NO: 286301 - DNA, 25 bp, Mus musculus
attgtttccgctacacagattggag

SEQ ID NO: 286302 - DNA, 25 bp, Mus musculus
attgtttccgcttcacagattggag

SEQ ID NO: 286303 - DNA, 25 bp, Mus musculus
attgtttcctaaaactatgctctga

SEQ ID NO: 286304 - DNA, 25 bp, Mus musculus
attgtttcctaatactatgctctga

SEQ ID NO: 286305 - DNA, 25 bp, Mus musculus
attgtttcctatacttccgacccag

SEQ ID NO: 286306 - DNA, 25 bp, Mus musculus
attgtttcctattcttccgacccag

SEQ ID NO: 286307 - DNA, 25 bp, Mus musculus
attgtttcctctcttctgtcacagg

SEQ ID NO: 286308 - DNA, 25 bp, Mus musculus
attgtttcctctgttctgtcacagg

SEQ ID NO: 286309 - DNA, 25 bp, Mus musculus
attgtttctaatctccatcttctga

SEQ ID NO: 286310 - DNA, 25 bp, Mus musculus
attgtttctaatgtccatcttctga

SEQ ID NO: 286311 - DNA, 25 bp, Mus musculus
attgtttctacacttctatgctatg

SEQ ID NO: 286312 - DNA, 25 bp, Mus musculus
attgtttctacagttctatgctatg

SEQ ID NO: 286313 - DNA, 25 bp, Mus musculus
attgtttctagcagtgtttttccca

SEQ ID NO: 286314 - DNA, 25 bp, Mus musculus
attgtttctagcatttcctaaatag

SEQ ID NO: 286315 - DNA, 25 bp, Mus musculus
attgtttctagctgtgtttttccca

SEQ ID NO: 286316 - DNA, 25 bp, Mus musculus
attgtttctagcttttcctaaatag

SEQ ID NO: 286317 - DNA, 25 bp, Mus musculus
attgtttctctcagatgatgtatgc

SEQ ID NO: 286318 - DNA, 25 bp, Mus musculus
attgtttctctctgatgatgtatgc

SEQ ID NO: 286319 - DNA, 25 bp, Mus musculus
attgtttctctgaatgcctcagtat

SEQ ID NO: 286320 - DNA, 25 bp, Mus musculus
attgtttctctgtatgcctcagtat

SEQ ID NO: 286321 - DNA, 25 bp, Mus musculus
attgtttctgcacacaagctcagct

SEQ ID NO: 286322 - DNA, 25 bp, Mus musculus
attgtttctgcagacaagctcagct

SEQ ID NO: 286323 - DNA, 25 bp, Mus musculus
attgtttctgtcagacatttggcca

SEQ ID NO: 286324 - DNA, 25 bp, Mus musculus
attgtttctgtctgacatttggcca

SEQ ID NO: 286325 - DNA, 25 bp, Mus musculus
attgtttcttatatgggaggataat

SEQ ID NO: 286326 - DNA, 25 bp, Mus musculus
attgtttcttatttgggaggataat

SEQ ID NO: 286327 - DNA, 25 bp, Mus musculus
attgtttctttcaacaggcgccttt

SEQ ID NO: 286328 - DNA, 25 bp, Mus musculus
attgtttctttctacaggcgccttt

SEQ ID NO: 286329 - DNA, 25 bp, Mus musculus
attgtttctttgcaggtcgcacagc

SEQ ID NO: 286330 - DNA, 25 bp, Mus musculus
attgtttctttggaggtcgcacagc

SEQ ID NO: 286331 - DNA, 25 bp, Mus musculus
attgtttgaactctctctggagcct

SEQ ID NO: 286332 - DNA, 25 bp, Mus musculus
attgtttgaactgtctctggagcct

SEQ ID NO: 286333 - DNA, 25 bp, Mus musculus
attgtttgaatgcatgggcctctca

SEQ ID NO: 286334 - DNA, 25 bp, Mus musculus
attgtttgaatggatgggcctctca

SEQ ID NO: 286335 - DNA, 25 bp, Mus musculus
attgtttgaggacccactgagtaat

SEQ ID NO: 286336 - DNA, 25 bp, Mus musculus
attgtttgaggagccactgagtaat

SEQ ID NO: 286337 - DNA, 25 bp, Mus musculus
attgtttgccataatgtctgtgctc

SEQ ID NO: 286338 - DNA, 25 bp, Mus musculus
attgtttgccattatgtctgtgctc

SEQ ID NO: 286339 - DNA, 25 bp, Mus musculus
attgtttgctatctcagtaccttca

SEQ ID NO: 286340 - DNA, 25 bp, Mus musculus
attgtttgctatgtcagtaccttca

SEQ ID NO: 286341 - DNA, 25 bp, Mus musculus
attgtttggccaatgaatcttcgga

SEQ ID NO: 286342 - DNA, 25 bp, Mus musculus
attgtttggccattgaatcttcgga

SEQ ID NO: 286343 - DNA, 25 bp, Mus musculus
attgtttggctgatcctgggttctc

SEQ ID NO: 286344 - DNA, 25 bp, Mus musculus
attgtttggctgttcctgggttctc

SEQ ID NO: 286345 - DNA, 25 bp, Mus musculus
attgtttgtcctacagtaggctctg

SEQ ID NO: 286346 - DNA, 25 bp, Mus musculus
attgtttgtccttcagtaggctctg

SEQ ID NO: 286347 - DNA, 25 bp, Mus musculus
attgttttaaaccatgcttcatttt

SEQ ID NO: 286348 - DNA, 25 bp, Mus musculus
attgttttaaacgatgcttcatttt

SEQ ID NO: 286349 - DNA, 25 bp, Mus musculus
attgttttaaccacaggcatctgcc

SEQ ID NO: 286350 - DNA, 25 bp, Mus musculus
attgttttaacctcaggcatctgcc

SEQ ID NO: 286351 - DNA, 25 bp, Mus musculus
attgttttaattcctctcagatgtc

SEQ ID NO: 286352 - DNA, 25 bp, Mus musculus
attgttttaattgctctcagatgtc

SEQ ID NO: 286353 - DNA, 25 bp, Mus musculus
attgttttacttatcagcaaatatg

SEQ ID NO: 286354 - DNA, 25 bp, Mus musculus
attgttttacttctcaaagcaccaa

SEQ ID NO: 286355 - DNA, 25 bp, Mus musculus
attgttttacttgtcaaagcaccaa

SEQ ID NO: 286356 - DNA, 25 bp, Mus musculus
attgttttacttttcagcaaatatg

SEQ ID NO: 286357 - DNA, 25 bp, Mus musculus
attgttttcacgatgggtccccttg

SEQ ID NO: 286358 - DNA, 25 bp, Mus musculus
attgttttcacgttgggtccccttg

SEQ ID NO: 286359 - DNA, 25 bp, Mus musculus
attgttttcagtatgtcatcaggac

SEQ ID NO: 286360 - DNA, 25 bp, Mus musculus
attgttttcagtttgtcatcaggac

SEQ ID NO: 286361 - DNA, 25 bp, Mus musculus
attgttttctatacagacctccttc

SEQ ID NO: 286362 - DNA, 25 bp, Mus musculus
attgttttctattcagacctccttc

SEQ ID NO: 286363 - DNA, 25 bp, Mus musculus
attgttttctgcaaattctctagta

SEQ ID NO: 286364 - DNA, 25 bp, Mus musculus
attgttttctgctaattctctagta

SEQ ID NO: 286365 - DNA, 25 bp, Mus musculus
attgttttgacaatgcagagtggga

SEQ ID NO: 286366 - DNA, 25 bp, Mus musculus
attgttttgacattgcagagtggga

SEQ ID NO: 286367 - DNA, 25 bp, Mus musculus
attgtttttcaaacaggcacagaaa

SEQ ID NO: 286368 - DNA, 25 bp, Mus musculus
attgtttttcaatcaggcacagaaa

SEQ ID NO: 286369 - DNA, 25 bp, Mus musculus
attgtttttgtaagactgcgtgtga

SEQ ID NO: 286370 - DNA, 25 bp, Mus musculus
attgtttttgtatgactgcgtgtga

SEQ ID NO: 286371 - DNA, 25 bp, Mus musculus
atttaaaacatgctcagtccctgga

SEQ ID NO: 286372 - DNA, 25 bp, Mus musculus
atttaaaacatggtcagtccctgga

SEQ ID NO: 286373 - DNA, 25 bp, Mus musculus
atttaaaaccttctcatccaggctc

SEQ ID NO: 286374 - DNA, 25 bp, Mus musculus
atttaaaaccttgtcatccaggctc

SEQ ID NO: 286375 - DNA, 25 bp, Mus musculus
atttaaaacttcattgcccaataca

SEQ ID NO: 286376 - DNA, 25 bp, Mus musculus
atttaaaacttctttgcccaataca

SEQ ID NO: 286377 - DNA, 25 bp, Mus musculus
atttaaaagctgactctcgaggtgg

SEQ ID NO: 286378 - DNA, 25 bp, Mus musculus
atttaaaagctgtctctcgaggtgg

SEQ ID NO: 286379 - DNA, 25 bp, Mus musculus
atttaaaaggctcagccaatcacag

SEQ ID NO: 286380 - DNA, 25 bp, Mus musculus
atttaaaaggctgagccaatcacag

SEQ ID NO: 286381 - DNA, 25 bp, Mus musculus
atttaaaatgtcactacttactcta

SEQ ID NO: 286382 - DNA, 25 bp, Mus musculus
atttaaaatgtctctacttactcta

SEQ ID NO: 286383 - DNA, 25 bp, Mus musculus
atttaaaattctactctacgtgagc

SEQ ID NO: 286384 - DNA, 25 bp, Mus musculus
atttaaaattcttctctacgtgagc

SEQ ID NO: 286385 - DNA, 25 bp, Mus musculus
atttaaacattcactaacattagag

SEQ ID NO: 286386 - DNA, 25 bp, Mus musculus
atttaaacattctctaacattagag

SEQ ID NO: 286387 - DNA, 25 bp, Mus musculus
atttaaactaccatccactagtgtg

SEQ ID NO: 286388 - DNA, 25 bp, Mus musculus
atttaaactaccttccactagtgtg

SEQ ID NO: 286389 - DNA, 25 bp, Mus musculus
atttaaagatcccacctgtaactga

SEQ ID NO: 286390 - DNA, 25 bp, Mus musculus
atttaaagatccgacctgtaactga

SEQ ID NO: 286391 - DNA, 25 bp, Mus musculus
atttaaagcaccaaatgcccgtgaa

SEQ ID NO: 286392 - DNA, 25 bp, Mus musculus
atttaaagcacctaatgcccgtgaa

SEQ ID NO: 286393 - DNA, 25 bp, Mus musculus
atttaaagctgcaccagccactgtg

SEQ ID NO: 286394 - DNA, 25 bp, Mus musculus
atttaaagctgctccagccactgtg

SEQ ID NO: 286395 - DNA, 25 bp, Mus musculus
atttaaaggcggcaccaggtggcac

SEQ ID NO: 286396 - DNA, 25 bp, Mus musculus
atttaaaggcgggaccaggtggcac

SEQ ID NO: 286397 - DNA, 25 bp, Mus musculus
atttaaaggcgtcctcttgttcccg

SEQ ID NO: 286398 - DNA, 25 bp, Mus musculus
atttaaaggcgtgctcttgttcccg

SEQ ID NO: 286399 - DNA, 25 bp, Mus musculus
atttaaagggtgactatgcgcgtgg

SEQ ID NO: 286400 - DNA, 25 bp, Mus musculus
atttaaagggtgtctatgcgcgtgg

SEQ ID NO: 286401 - DNA, 25 bp, Mus musculus
atttaaagtgtcatgtctccacggc

SEQ ID NO: 286402 - DNA, 25 bp, Mus musculus
atttaaagtgtcttgtctccacggc

SEQ ID NO: 286403 - DNA, 25 bp, Mus musculus
atttaaagttgcctttcctgcagct

SEQ ID NO: 286404 - DNA, 25 bp, Mus musculus
atttaaagttgcgtttcctgcagct

SEQ ID NO: 286405 - DNA, 25 bp, Mus musculus
atttaaatacttcgccttcagctgg

SEQ ID NO: 286406 - DNA, 25 bp, Mus musculus
atttaaatacttggccttcagctgg

SEQ ID NO: 286407 - DNA, 25 bp, Mus musculus
atttaaatagctccaatgtctcggg

SEQ ID NO: 286408 - DNA, 25 bp, Mus musculus
atttaaatagctgcaatgtctcggg

SEQ ID NO: 286409 - DNA, 25 bp, Mus musculus
atttaaatatatctctccctctcta

SEQ ID NO: 286410 - DNA, 25 bp, Mus musculus
atttaaatatatgtctccctctcta

SEQ ID NO: 286411 - DNA, 25 bp, Mus musculus
atttaaatcatcaactggtgctgac

SEQ ID NO: 286412 - DNA, 25 bp, Mus musculus
atttaaatcatctactggtgctgac

SEQ ID NO: 286413 - DNA, 25 bp, Mus musculus
atttaaatggtcagaatcccccgag

SEQ ID NO: 286414 - DNA, 25 bp, Mus musculus
atttaaatggtctgaatcccccgag

SEQ ID NO: 286415 - DNA, 25 bp, Mus musculus
atttaaatggttacacgttaatgca

SEQ ID NO: 286416 - DNA, 25 bp, Mus musculus
atttaaatggtttcacgttaatgca

SEQ ID NO: 286417 - DNA, 25 bp, Mus musculus
atttaaattacactgaccaagtcac

SEQ ID NO: 286418 - DNA, 25 bp, Mus musculus
atttaaattacagtgaccaagtcac

SEQ ID NO: 286419 - DNA, 25 bp, Mus musculus
atttaaattgtgaagcctgttgcta

SEQ ID NO: 286420 - DNA, 25 bp, Mus musculus
atttaaattgtgtagcctgttgcta

SEQ ID NO: 286421 - DNA, 25 bp, Mus musculus
atttaaatttccacagttggctaag

SEQ ID NO: 286422 - DNA, 25 bp, Mus musculus
atttaaatttcctcagttggctaag

SEQ ID NO: 286423 - DNA, 25 bp, Mus musculus
atttaaatttctcgtgctctttcac

SEQ ID NO: 286424 - DNA, 25 bp, Mus musculus
atttaaatttctggtgctctttcac

SEQ ID NO: 286425 - DNA, 25 bp, Mus musculus
atttaacaagcaactctgtcatttg

SEQ ID NO: 286426 - DNA, 25 bp, Mus musculus
atttaacaagcatctctgtcatttg

SEQ ID NO: 286427 - DNA, 25 bp, Mus musculus
atttaacaatacaggccacgaagac

SEQ ID NO: 286428 - DNA, 25 bp, Mus musculus
atttaacaatactggccacgaagac

SEQ ID NO: 286429 - DNA, 25 bp, Mus musculus
atttaacacgttcgaagagacagta

SEQ ID NO: 286430 - DNA, 25 bp, Mus musculus
atttaacacgttggaagagacagta

SEQ ID NO: 286431 - DNA, 25 bp, Mus musculus
atttaacactcacagaccagactct

SEQ ID NO: 286432 - DNA, 25 bp, Mus musculus
atttaacactcagagaccagactct

SEQ ID NO: 286433 - DNA, 25 bp, Mus musculus
atttaacactgcagtcatccatctc

SEQ ID NO: 286434 - DNA, 25 bp, Mus musculus
atttaacactgctgtcatccatctc

SEQ ID NO: 286435 - DNA, 25 bp, Mus musculus
atttaacagccaacatcagaagaga

SEQ ID NO: 286436 - DNA, 25 bp, Mus musculus
atttaacagccatcatcagaagaga

SEQ ID NO: 286437 - DNA, 25 bp, Mus musculus
atttaacatcaaatttgctccctta

SEQ ID NO: 286438 - DNA, 25 bp, Mus musculus
atttaacatcaattttgctccctta

SEQ ID NO: 286439 - DNA, 25 bp, Mus musculus
atttaaccatgccaacggtctcaca

SEQ ID NO: 286440 - DNA, 25 bp, Mus musculus
atttaaccatgcgaacggtctcaca

SEQ ID NO: 286441 - DNA, 25 bp, Mus musculus
atttaaccatgtactttcctgtctc

SEQ ID NO: 286442 - DNA, 25 bp, Mus musculus
atttaaccatgttctttcctgtctc

SEQ ID NO: 286443 - DNA, 25 bp, Mus musculus
atttaacccacacacggtattctgg

SEQ ID NO: 286444 - DNA, 25 bp, Mus musculus
atttaacccacagacggtattctgg

SEQ ID NO: 286445 - DNA, 25 bp, Mus musculus
atttaacccttgatcgggctgaaag

SEQ ID NO: 286446 - DNA, 25 bp, Mus musculus
atttaacccttgttcgggctgaaag

SEQ ID NO: 286447 - DNA, 25 bp, Mus musculus
atttaacctctgatcaggcccatga

SEQ ID NO: 286448 - DNA, 25 bp, Mus musculus
atttaacctctgttcaggcccatga

SEQ ID NO: 286449 - DNA, 25 bp, Mus musculus
atttaactcataacctaagccgcgc

SEQ ID NO: 286450 - DNA, 25 bp, Mus musculus
atttaactcatatcctaagccgcgc

SEQ ID NO: 286451 - DNA, 25 bp, Mus musculus
atttaactctggagcggtatccccg

SEQ ID NO: 286452 - DNA, 25 bp, Mus musculus
atttaactctggtgcggtatccccg

SEQ ID NO: 286453 - DNA, 25 bp, Mus musculus
atttaactgaagaagccacagtgca

SEQ ID NO: 286454 - DNA, 25 bp, Mus musculus
atttaactgaagtagccacagtgca

SEQ ID NO: 286455 - DNA, 25 bp, Mus musculus
atttaactgactccttatgcctccg

SEQ ID NO: 286456 - DNA, 25 bp, Mus musculus
atttaactgactgcttatgcctccg

SEQ ID NO: 286457 - DNA, 25 bp, Mus musculus
atttaactttcaagcttaaggctgg

SEQ ID NO: 286458 - DNA, 25 bp, Mus musculus
atttaactttcatgcttaaggctgg

SEQ ID NO: 286459 - DNA, 25 bp, Mus musculus
atttaagacatacccatggagccca

SEQ ID NO: 286460 - DNA, 25 bp, Mus musculus
atttaagacatagccatggagccca

SEQ ID NO: 286461 - DNA, 25 bp, Mus musculus
atttaagacctaagcatagttgggc

SEQ ID NO: 286462 - DNA, 25 bp, Mus musculus
atttaagacctatgcatagttgggc

SEQ ID NO: 286463 - DNA, 25 bp, Mus musculus
atttaagactaaactggccgggcgt

SEQ ID NO: 286464 - DNA, 25 bp, Mus musculus
atttaagactaatctggccgggcgt

SEQ ID NO: 286465 - DNA, 25 bp, Mus musculus
atttaagagcctcgcagtctcctgt

SEQ ID NO: 286466 - DNA, 25 bp, Mus musculus
atttaagagcctggcagtctcctgt

SEQ ID NO: 286467 - DNA, 25 bp, Mus musculus
atttaagcacaaacccaccattttt

SEQ ID NO: 286468 - DNA, 25 bp, Mus musculus
atttaagcacaatcccaccattttt

SEQ ID NO: 286469 - DNA, 25 bp, Mus musculus
atttaagcacttcacagtattccca

SEQ ID NO: 286470 - DNA, 25 bp, Mus musculus
atttaagcacttgacagtattccca

SEQ ID NO: 286471 - DNA, 25 bp, Mus musculus
atttaagcagaacatccggaagcag

SEQ ID NO: 286472 - DNA, 25 bp, Mus musculus
atttaagcagaagatccggaagcag

SEQ ID NO: 286473 - DNA, 25 bp, Mus musculus
atttaagcatgaaccaaccaagggc

SEQ ID NO: 286474 - DNA, 25 bp, Mus musculus
atttaagcatgatccaaccaagggc

SEQ ID NO: 286475 - DNA, 25 bp, Mus musculus
atttaagcatttatctcccctttca

SEQ ID NO: 286476 - DNA, 25 bp, Mus musculus
atttaagcatttttctcccctttca

SEQ ID NO: 286477 - DNA, 25 bp, Mus musculus
atttaagccaggacattccttgcat

SEQ ID NO: 286478 - DNA, 25 bp, Mus musculus
atttaagccaggtcattccttgcat

SEQ ID NO: 286479 - DNA, 25 bp, Mus musculus
atttaagcctcaataaggtctctgg

SEQ ID NO: 286480 - DNA, 25 bp, Mus musculus
atttaagcctcattaaggtctctgg

SEQ ID NO: 286481 - DNA, 25 bp, Mus musculus
atttaagctacgagttgttgcccct

SEQ ID NO: 286482 - DNA, 25 bp, Mus musculus
atttaagctacgtgttgttgcccct

SEQ ID NO: 286483 - DNA, 25 bp, Mus musculus
atttaagctcctattctcactgaac

SEQ ID NO: 286484 - DNA, 25 bp, Mus musculus
atttaagctccttttctcactgaac

SEQ ID NO: 286485 - DNA, 25 bp, Mus musculus
atttaagctctgacccacactgatt

SEQ ID NO: 286486 - DNA, 25 bp, Mus musculus
atttaagctctgtcccacactgatt

SEQ ID NO: 286487 - DNA, 25 bp, Mus musculus
atttaagctgaaaatacctttgagg

SEQ ID NO: 286488 - DNA, 25 bp, Mus musculus
atttaagctgaatatacctttgagg

SEQ ID NO: 286489 - DNA, 25 bp, Mus musculus
atttaaggaagcagctcggcttgca

SEQ ID NO: 286490 - DNA, 25 bp, Mus musculus
atttaaggaagctgctcggcttgca

SEQ ID NO: 286491 - DNA, 25 bp, Mus musculus
atttaaggaggcctccagagagccc

SEQ ID NO: 286492 - DNA, 25 bp, Mus musculus
atttaaggaggcgtccagagagccc

SEQ ID NO: 286493 - DNA, 25 bp, Mus musculus
atttaaggccaacttcacgggatga

SEQ ID NO: 286494 - DNA, 25 bp, Mus musculus
atttaaggccaagttcacgggatga

SEQ ID NO: 286495 - DNA, 25 bp, Mus musculus
atttaaggcctaatgccattctaat

SEQ ID NO: 286496 - DNA, 25 bp, Mus musculus
atttaaggcctaccactttcagaag

SEQ ID NO: 286497 - DNA, 25 bp, Mus musculus
atttaaggcctagcactttcagaag

SEQ ID NO: 286498 - DNA, 25 bp, Mus musculus
atttaaggcctattgccattctaat

SEQ ID NO: 286499 - DNA, 25 bp, Mus musculus
atttaaggttcaagccccagcactg

SEQ ID NO: 286500 - DNA, 25 bp, Mus musculus
atttaaggttcatgccccagcactg

SEQ ID NO: 286501 - DNA, 25 bp, Mus musculus
atttaagtaatcaaaggcccaatct

SEQ ID NO: 286502 - DNA, 25 bp, Mus musculus
atttaagtaatctaaggcccaatct

SEQ ID NO: 286503 - DNA, 25 bp, Mus musculus
atttaagtacttccactccgcagag

SEQ ID NO: 286504 - DNA, 25 bp, Mus musculus
atttaagtacttgcactccgcagag

SEQ ID NO: 286505 - DNA, 25 bp, Mus musculus
atttaagtatgaatttaggccctga

SEQ ID NO: 286506 - DNA, 25 bp, Mus musculus
atttaagtatgattttaggccctga

SEQ ID NO: 286507 - DNA, 25 bp, Mus musculus
atttaagtccgtaatgcagctctct

SEQ ID NO: 286508 - DNA, 25 bp, Mus musculus
atttaagtccgttatgcagctctct

SEQ ID NO: 286509 - DNA, 25 bp, Mus musculus
atttaagtctgacccttcctttcca

SEQ ID NO: 286510 - DNA, 25 bp, Mus musculus
atttaagtctgagccttcctttcca

SEQ ID NO: 286511 - DNA, 25 bp, Mus musculus
atttaagtcttcaacgctcattccg

SEQ ID NO: 286512 - DNA, 25 bp, Mus musculus
atttaagtcttctacgctcattccg

SEQ ID NO: 286513 - DNA, 25 bp, Mus musculus
atttaagtgactagaactgggttca

SEQ ID NO: 286514 - DNA, 25 bp, Mus musculus
atttaagtgacttgaactgggttca

SEQ ID NO: 286515 - DNA, 25 bp, Mus musculus
atttaagtgcttaccagagtcccct

SEQ ID NO: 286516 - DNA, 25 bp, Mus musculus
atttaagtgctttccagagtcccct

SEQ ID NO: 286517 - DNA, 25 bp, Mus musculus
atttaagtgttgatctgctagcaga

SEQ ID NO: 286518 - DNA, 25 bp, Mus musculus
atttaagtgttgttctgctagcaga

SEQ ID NO: 286519 - DNA, 25 bp, Mus musculus
atttaagttttcagagtcgtgcgcc

SEQ ID NO: 286520 - DNA, 25 bp, Mus musculus
atttaagttttctgagtcgtgcgcc

SEQ ID NO: 286521 - DNA, 25 bp, Mus musculus
atttaataacctacatacctgattt

SEQ ID NO: 286522 - DNA, 25 bp, Mus musculus
atttaataaccttcatacctgattt

SEQ ID NO: 286523 - DNA, 25 bp, Mus musculus
atttaatactacaggccagcgagga

SEQ ID NO: 286524 - DNA, 25 bp, Mus musculus
atttaatactactggccagcgagga

SEQ ID NO: 286525 - DNA, 25 bp, Mus musculus
atttaatagctgcaaacctctggtt

SEQ ID NO: 286526 - DNA, 25 bp, Mus musculus
atttaatagctggaaacctctggtt

SEQ ID NO: 286527 - DNA, 25 bp, Mus musculus
atttaatatcggctcttccctgctt

SEQ ID NO: 286528 - DNA, 25 bp, Mus musculus
atttaatatcgggtcttccctgctt

SEQ ID NO: 286529 - DNA, 25 bp, Mus musculus
atttaatatgcaagagctggtactc

SEQ ID NO: 286530 - DNA, 25 bp, Mus musculus
atttaatatgcatgagctggtactc

SEQ ID NO: 286531 - DNA, 25 bp, Mus musculus
atttaatcacaaccatcacaagccc

SEQ ID NO: 286532 - DNA, 25 bp, Mus musculus
atttaatcacaagcatcacaagccc

SEQ ID NO: 286533 - DNA, 25 bp, Mus musculus
atttaatcagtcatcccgtgctggc

SEQ ID NO: 286534 - DNA, 25 bp, Mus musculus
atttaatcagtcttcccgtgctggc

SEQ ID NO: 286535 - DNA, 25 bp, Mus musculus
atttaatcatggactgagtcctcag

SEQ ID NO: 286536 - DNA, 25 bp, Mus musculus
atttaatcatggtctgagtcctcag

SEQ ID NO: 286537 - DNA, 25 bp, Mus musculus
atttaatccttcaaactgcttgatg

SEQ ID NO: 286538 - DNA, 25 bp, Mus musculus
atttaatccttctaactgcttgatg

SEQ ID NO: 286539 - DNA, 25 bp, Mus musculus
atttaatcctttctacttgtcgcta

SEQ ID NO: 286540 - DNA, 25 bp, Mus musculus
atttaatcctttgtacttgtcgcta

SEQ ID NO: 286541 - DNA, 25 bp, Mus musculus
atttaatgagacaacattgagccct

SEQ ID NO: 286542 - DNA, 25 bp, Mus musculus
atttaatgagactacattgagccct

SEQ ID NO: 286543 - DNA, 25 bp, Mus musculus
atttaatggagcactttcgaaaggc

SEQ ID NO: 286544 - DNA, 25 bp, Mus musculus
atttaatggagctctttcgaaaggc

SEQ ID NO: 286545 - DNA, 25 bp, Mus musculus
atttaatggctaaccagggaaatct

SEQ ID NO: 286546 - DNA, 25 bp, Mus musculus
atttaatggctatccagggaaatct

SEQ ID NO: 286547 - DNA, 25 bp, Mus musculus
atttaatggtgtcggctggcagttc

SEQ ID NO: 286548 - DNA, 25 bp, Mus musculus
atttaatggtgtgggctggcagttc

SEQ ID NO: 286549 - DNA, 25 bp, Mus musculus
atttaatgtaaccaccggtgtgctt

SEQ ID NO: 286550 - DNA, 25 bp, Mus musculus
atttaatgtaacgaccggtgtgctt

SEQ ID NO: 286551 - DNA, 25 bp, Mus musculus
atttaatgtgtgagccatgccttca

SEQ ID NO: 286552 - DNA, 25 bp, Mus musculus
atttaatgtgtgtgccatgccttca

SEQ ID NO: 286553 - DNA, 25 bp, Mus musculus
atttaattattgatctctgacaaaa

SEQ ID NO: 286554 - DNA, 25 bp, Mus musculus
atttaattattgttctctgacaaaa

SEQ ID NO: 286555 - DNA, 25 bp, Mus musculus
atttaattcattaccctagtttcat

SEQ ID NO: 286556 - DNA, 25 bp, Mus musculus
atttaattcatttccctagtttcat

SEQ ID NO: 286557 - DNA, 25 bp, Mus musculus
atttaattcgacatcattgcctccc

SEQ ID NO: 286558 - DNA, 25 bp, Mus musculus
atttaattcgacttcattgcctccc

SEQ ID NO: 286559 - DNA, 25 bp, Mus musculus
atttaattctgtaagaagcttccag

SEQ ID NO: 286560 - DNA, 25 bp, Mus musculus
atttaattctgttagaagcttccag

SEQ ID NO: 286561 - DNA, 25 bp, Mus musculus
atttaattgtaccatgaagaagagc

SEQ ID NO: 286562 - DNA, 25 bp, Mus musculus
atttaattgtacgatgaagaagagc

SEQ ID NO: 286563 - DNA, 25 bp, Mus musculus
atttaattgtagagatttgaacccg

SEQ ID NO: 286564 - DNA, 25 bp, Mus musculus
atttaattgtagtgatttgaacccg

SEQ ID NO: 286565 - DNA, 25 bp, Mus musculus
atttaattgtttctcagccatttga

SEQ ID NO: 286566 - DNA, 25 bp, Mus musculus
atttaattgtttgtcagccatttga

SEQ ID NO: 286567 - DNA, 25 bp, Mus musculus
atttaatttataacagtcctattgg

SEQ ID NO: 286568 - DNA, 25 bp, Mus musculus
atttaatttatatcagtcctattgg

SEQ ID NO: 286569 - DNA, 25 bp, Mus musculus
atttaatttcatattgcacccagga

SEQ ID NO: 286570 - DNA, 25 bp, Mus musculus
atttaatttcattttgcacccagga

SEQ ID NO: 286571 - DNA, 25 bp, Mus musculus
atttaattttccacctttgtgtgag

SEQ ID NO: 286572 - DNA, 25 bp, Mus musculus
atttaattttcctcctttgtgtgag

SEQ ID NO: 286573 - DNA, 25 bp, Mus musculus
atttacaacttactcattatcttaa

SEQ ID NO: 286574 - DNA, 25 bp, Mus musculus
atttacaacttagtcattatcttaa

SEQ ID NO: 286575 - DNA, 25 bp, Mus musculus
atttacaagacaagatcctgccaat

SEQ ID NO: 286576 - DNA, 25 bp, Mus musculus
atttacaagacatgatcctgccaat

SEQ ID NO: 286577 - DNA, 25 bp, Mus musculus
atttacaagagcctggttgctagcg

SEQ ID NO: 286578 - DNA, 25 bp, Mus musculus
atttacaagagcgtggttgctagcg

SEQ ID NO: 286579 - DNA, 25 bp, Mus musculus
atttacaatgccagggaatagtcta

SEQ ID NO: 286580 - DNA, 25 bp, Mus musculus
atttacaatgcctgggaatagtcta

SEQ ID NO: 286581 - DNA, 25 bp, Mus musculus
atttacacatttcttggttcagaga

SEQ ID NO: 286582 - DNA, 25 bp, Mus musculus
atttacacatttgttggttcagaga

SEQ ID NO: 286583 - DNA, 25 bp, Mus musculus
atttacaccctacaggctttcctag

SEQ ID NO: 286584 - DNA, 25 bp, Mus musculus
atttacaccctagaggctttcctag

SEQ ID NO: 286585 - DNA, 25 bp, Mus musculus
atttacaccgacaactctgtgaagc

SEQ ID NO: 286586 - DNA, 25 bp, Mus musculus
atttacaccgactactctgtgaagc

SEQ ID NO: 286587 - DNA, 25 bp, Mus musculus
atttacactcagaagtcccatcacg

SEQ ID NO: 286588 - DNA, 25 bp, Mus musculus
atttacactcagtagtcccatcacg

SEQ ID NO: 286589 - DNA, 25 bp, Mus musculus
atttacactcggatcatgttgttga

SEQ ID NO: 286590 - DNA, 25 bp, Mus musculus
atttacactcggttcatgttgttga

SEQ ID NO: 286591 - DNA, 25 bp, Mus musculus
atttacactgccactcagcattttc

SEQ ID NO: 286592 - DNA, 25 bp, Mus musculus
atttacactgcctctcagcattttc

SEQ ID NO: 286593 - DNA, 25 bp, Mus musculus
atttacactgtgattctctgaagag

SEQ ID NO: 286594 - DNA, 25 bp, Mus musculus
atttacactgtgtttctctgaagag

SEQ ID NO: 286595 - DNA, 25 bp, Mus musculus
atttacagaaacattgcctcattat

SEQ ID NO: 286596 - DNA, 25 bp, Mus musculus
atttacagaaactttgcctcattat

SEQ ID NO: 286597 - DNA, 25 bp, Mus musculus
atttacagaccaattttccttatgt

SEQ ID NO: 286598 - DNA, 25 bp, Mus musculus
atttacagaccatttttccttatgt

SEQ ID NO: 286599 - DNA, 25 bp, Mus musculus
atttacagacctcatccatggctga

SEQ ID NO: 286600 - DNA, 25 bp, Mus musculus
atttacagacctgatccatggctga

SEQ ID NO: 286601 - DNA, 25 bp, Mus musculus
atttacagcaatcccaaatatggat

SEQ ID NO: 286602 - DNA, 25 bp, Mus musculus
atttacagcaatgccaaatatggat

SEQ ID NO: 286603 - DNA, 25 bp, Mus musculus
atttacagcagacccttaggtgaca

SEQ ID NO: 286604 - DNA, 25 bp, Mus musculus
atttacagcagagccttaggtgaca

SEQ ID NO: 286605 - DNA, 25 bp, Mus musculus
atttacagcctgaaaactgctcccc

SEQ ID NO: 286606 - DNA, 25 bp, Mus musculus
atttacagcctgatttcccttctgg

SEQ ID NO: 286607 - DNA, 25 bp, Mus musculus
atttacagcctgtaaactgctcccc

SEQ ID NO: 286608 - DNA, 25 bp, Mus musculus
atttacagcctgttttcccttctgg

SEQ ID NO: 286609 - DNA, 25 bp, Mus musculus
atttacagccttcggaaaactcact

SEQ ID NO: 286610 - DNA, 25 bp, Mus musculus
atttacagccttgggaaaactcact

SEQ ID NO: 286611 - DNA, 25 bp, Mus musculus
atttacagctccctcttgtggtcat

SEQ ID NO: 286612 - DNA, 25 bp, Mus musculus
atttacagctccgtcttgtggtcat

SEQ ID NO: 286613 - DNA, 25 bp, Mus musculus
atttacaggaagcagaacccaggcc

SEQ ID NO: 286614 - DNA, 25 bp, Mus musculus
atttacaggaaggagaacccaggcc

SEQ ID NO: 286615 - DNA, 25 bp, Mus musculus
atttacaggccaacatatgcatatg

SEQ ID NO: 286616 - DNA, 25 bp, Mus musculus
atttacaggccatcatatgcatatg

SEQ ID NO: 286617 - DNA, 25 bp, Mus musculus
atttacagggctagccatctgttcc

SEQ ID NO: 286618 - DNA, 25 bp, Mus musculus
atttacagggcttgccatctgttcc

SEQ ID NO: 286619 - DNA, 25 bp, Mus musculus
atttacatagtgaaggtccagaata

SEQ ID NO: 286620 - DNA, 25 bp, Mus musculus
atttacatagtgtaggtccagaata

SEQ ID NO: 286621 - DNA, 25 bp, Mus musculus
atttacatatctcttctaatgcttt

SEQ ID NO: 286622 - DNA, 25 bp, Mus musculus
atttacatatctgttctaatgcttt

SEQ ID NO: 286623 - DNA, 25 bp, Mus musculus
atttacatcatgatttctttgctaa

SEQ ID NO: 286624 - DNA, 25 bp, Mus musculus
atttacatcatgttttctttgctaa

SEQ ID NO: 286625 - DNA, 25 bp, Mus musculus
atttacatccatatcctgggtgtcc

SEQ ID NO: 286626 - DNA, 25 bp, Mus musculus
atttacatccatttcctgggtgtcc

SEQ ID NO: 286627 - DNA, 25 bp, Mus musculus
atttacatgccacttctgaatctgc

SEQ ID NO: 286628 - DNA, 25 bp, Mus musculus
atttacatgccagttctgaatctgc

SEQ ID NO: 286629 - DNA, 25 bp, Mus musculus
atttacatggaaactgcttccggtg

SEQ ID NO: 286630 - DNA, 25 bp, Mus musculus
atttacatggaatctgcttccggtg

SEQ ID NO: 286631 - DNA, 25 bp, Mus musculus
atttacattatcaaggcccattaca

SEQ ID NO: 286632 - DNA, 25 bp, Mus musculus
atttacattatctaggcccattaca

SEQ ID NO: 286633 - DNA, 25 bp, Mus musculus
atttacattccaccagctcagagta

SEQ ID NO: 286634 - DNA, 25 bp, Mus musculus
atttacattccagcagctcagagta

SEQ ID NO: 286635 - DNA, 25 bp, Mus musculus
atttacattccccaaatggaatctg

SEQ ID NO: 286636 - DNA, 25 bp, Mus musculus
atttacattcccgaaatggaatctg

SEQ ID NO: 286637 - DNA, 25 bp, Mus musculus
atttacattcctcattgtgggcaat

SEQ ID NO: 286638 - DNA, 25 bp, Mus musculus
atttacattcctgattgtgggcaat

SEQ ID NO: 286639 - DNA, 25 bp, Mus musculus
atttacatttgcagtgaacattcaa

SEQ ID NO: 286640 - DNA, 25 bp, Mus musculus
atttacatttgctgtgaacattcaa

SEQ ID NO: 286641 - DNA, 25 bp, Mus musculus
atttacattttcctgatgctgtctg

SEQ ID NO: 286642 - DNA, 25 bp, Mus musculus
atttacattttcgtgatgctgtctg

SEQ ID NO: 286643 - DNA, 25 bp, Mus musculus
atttaccacattatcatatgcacac

SEQ ID NO: 286644 - DNA, 25 bp, Mus musculus
atttaccacattttcatatgcacac

SEQ ID NO: 286645 - DNA, 25 bp, Mus musculus
atttaccactcacaaagtcgccctg

SEQ ID NO: 286646 - DNA, 25 bp, Mus musculus
atttaccactcagaaagtcgccctg

SEQ ID NO: 286647 - DNA, 25 bp, Mus musculus
atttaccactctaagaactactggc

SEQ ID NO: 286648 - DNA, 25 bp, Mus musculus
atttaccactcttagaactactggc

SEQ ID NO: 286649 - DNA, 25 bp, Mus musculus
atttaccagcagagggtccaccaaa

SEQ ID NO: 286650 - DNA, 25 bp, Mus musculus
atttaccagcagtgggtccaccaaa

SEQ ID NO: 286651 - DNA, 25 bp, Mus musculus
atttaccagctgaaggaactccgtg

SEQ ID NO: 286652 - DNA, 25 bp, Mus musculus
atttaccagctgtaggaactccgtg

SEQ ID NO: 286653 - DNA, 25 bp, Mus musculus
atttaccagggaagctatgtaggcc

SEQ ID NO: 286654 - DNA, 25 bp, Mus musculus
atttaccagggatgctatgtaggcc

SEQ ID NO: 286655 - DNA, 25 bp, Mus musculus
atttaccatcttatcccttggctgt

SEQ ID NO: 286656 - DNA, 25 bp, Mus musculus
atttaccatcttttcccttggctgt

SEQ ID NO: 286657 - DNA, 25 bp, Mus musculus
atttaccattagctggtcttctctg

SEQ ID NO: 286658 - DNA, 25 bp, Mus musculus
atttaccattaggtggtcttctctg

SEQ ID NO: 286659 - DNA, 25 bp, Mus musculus
atttaccattgtcttatagctgctt

SEQ ID NO: 286660 - DNA, 25 bp, Mus musculus
atttaccattgtgttatagctgctt

SEQ ID NO: 286661 - DNA, 25 bp, Mus musculus
atttacccagaaatgacctgccttt

SEQ ID NO: 286662 - DNA, 25 bp, Mus musculus
atttacccagaattgacctgccttt

SEQ ID NO: 286663 - DNA, 25 bp, Mus musculus
atttacccaggcctcacaacttaga

SEQ ID NO: 286664 - DNA, 25 bp, Mus musculus
atttacccaggcgtcacaacttaga

SEQ ID NO: 286665 - DNA, 25 bp, Mus musculus
atttacccagtacgcatacctgcca

SEQ ID NO: 286666 - DNA, 25 bp, Mus musculus
atttacccagtaggcatacctgcca

SEQ ID NO: 286667 - DNA, 25 bp, Mus musculus
atttacccattacctttgtcaaact

SEQ ID NO: 286668 - DNA, 25 bp, Mus musculus
atttacccattagctttgtcaaact

SEQ ID NO: 286669 - DNA, 25 bp, Mus musculus
atttaccccagaaatgcaactctct

SEQ ID NO: 286670 - DNA, 25 bp, Mus musculus
atttaccccagatatgcaactctct

SEQ ID NO: 286671 - DNA, 25 bp, Mus musculus
atttaccccgatacaagtagcacct

SEQ ID NO: 286672 - DNA, 25 bp, Mus musculus
atttaccccgattcaagtagcacct

SEQ ID NO: 286673 - DNA, 25 bp, Mus musculus
atttaccccgtcagtactctgtatt

SEQ ID NO: 286674 - DNA, 25 bp, Mus musculus
atttaccccgtctgtactctgtatt

SEQ ID NO: 286675 - DNA, 25 bp, Mus musculus
atttaccctctcagaggctcagcca

SEQ ID NO: 286676 - DNA, 25 bp, Mus musculus
atttaccctctctgaggctcagcca

SEQ ID NO: 286677 - DNA, 25 bp, Mus musculus
atttaccctgagaggaagatgtcct

SEQ ID NO: 286678 - DNA, 25 bp, Mus musculus
atttaccctgagtggaagatgtcct

SEQ ID NO: 286679 - DNA, 25 bp, Mus musculus
atttaccgaagcatcagtcgctggg

SEQ ID NO: 286680 - DNA, 25 bp, Mus musculus
atttaccgaagcttcagtcgctggg

SEQ ID NO: 286681 - DNA, 25 bp, Mus musculus
atttaccgagtcacttcatatctca

SEQ ID NO: 286682 - DNA, 25 bp, Mus musculus
atttaccgagtctcttcatatctca

SEQ ID NO: 286683 - DNA, 25 bp, Mus musculus
atttaccgctagctggctttgaact

SEQ ID NO: 286684 - DNA, 25 bp, Mus musculus
atttaccgctaggtggctttgaact

SEQ ID NO: 286685 - DNA, 25 bp, Mus musculus
atttacctagaaccattgtctacta

SEQ ID NO: 286686 - DNA, 25 bp, Mus musculus
atttacctagaagcattgtctacta

SEQ ID NO: 286687 - DNA, 25 bp, Mus musculus
atttacctagtccacagtcatcagt

SEQ ID NO: 286688 - DNA, 25 bp, Mus musculus
atttacctagtcgacagtcatcagt

SEQ ID NO: 286689 - DNA, 25 bp, Mus musculus
atttacctagtgattgtgagggcct

SEQ ID NO: 286690 - DNA, 25 bp, Mus musculus
atttacctagtgtttgtgagggcct

SEQ ID NO: 286691 - DNA, 25 bp, Mus musculus
atttacctatctagatggcttagtt

SEQ ID NO: 286692 - DNA, 25 bp, Mus musculus
atttacctatctatttatgttgcta

SEQ ID NO: 286693 - DNA, 25 bp, Mus musculus
atttacctatcttgatggcttagtt

SEQ ID NO: 286694 - DNA, 25 bp, Mus musculus
atttacctatctttttatgttgcta

SEQ ID NO: 286695 - DNA, 25 bp, Mus musculus
atttacctcatacgaccttgcctct

SEQ ID NO: 286696 - DNA, 25 bp, Mus musculus
atttacctcataggaccttgcctct

SEQ ID NO: 286697 - DNA, 25 bp, Mus musculus
atttacctcggaacctcttgtcatg

SEQ ID NO: 286698 - DNA, 25 bp, Mus musculus
atttacctcggatcctcttgtcatg

SEQ ID NO: 286699 - DNA, 25 bp, Mus musculus
atttacctgaacatagcctgctcaa

SEQ ID NO: 286700 - DNA, 25 bp, Mus musculus
atttacctgaacttagcctgctcaa

SEQ ID NO: 286701 - DNA, 25 bp, Mus musculus
atttacctgctgactaaatcaacag

SEQ ID NO: 286702 - DNA, 25 bp, Mus musculus
atttacctgctgtctaaatcaacag

SEQ ID NO: 286703 - DNA, 25 bp, Mus musculus
atttacctgtcaattatcatgctct

SEQ ID NO: 286704 - DNA, 25 bp, Mus musculus
atttacctgtcatttatcatgctct

SEQ ID NO: 286705 - DNA, 25 bp, Mus musculus
atttacctgttcaaatgcgagttgg

SEQ ID NO: 286706 - DNA, 25 bp, Mus musculus
atttacctgttctaatgcgagttgg

SEQ ID NO: 286707 - DNA, 25 bp, Mus musculus
atttaccttcaaatttcttgcttca

SEQ ID NO: 286708 - DNA, 25 bp, Mus musculus
atttaccttcaattttcttgcttca

SEQ ID NO: 286709 - DNA, 25 bp, Mus musculus
atttaccttccccatatttaagatg

SEQ ID NO: 286710 - DNA, 25 bp, Mus musculus
atttaccttcccgatatttaagatg

SEQ ID NO: 286711 - DNA, 25 bp, Mus musculus
atttaccttgatctgtatatggaca

SEQ ID NO: 286712 - DNA, 25 bp, Mus musculus
atttaccttgatgtgtatatggaca

SEQ ID NO: 286713 - DNA, 25 bp, Mus musculus
atttaccttggaagcactgtttgtg

SEQ ID NO: 286714 - DNA, 25 bp, Mus musculus
atttaccttggatgcactgtttgtg

SEQ ID NO: 286715 - DNA, 25 bp, Mus musculus
atttacctttgaatacttctctctt

SEQ ID NO: 286716 - DNA, 25 bp, Mus musculus
atttacctttgattacttctctctt

SEQ ID NO: 286717 - DNA, 25 bp, Mus musculus
atttacgagagaacgcgcctgcaga

SEQ ID NO: 286718 - DNA, 25 bp, Mus musculus
atttacgagagatcgcgcctgcaga

SEQ ID NO: 286719 - DNA, 25 bp, Mus musculus
atttacgagatgacctcaaggtgca

SEQ ID NO: 286720 - DNA, 25 bp, Mus musculus
atttacgagatgtcctcaaggtgca

SEQ ID NO: 286721 - DNA, 25 bp, Mus musculus
atttacgctgtgattcttaggaaac

SEQ ID NO: 286722 - DNA, 25 bp, Mus musculus
atttacgctgtgtttcttaggaaac

SEQ ID NO: 286723 - DNA, 25 bp, Mus musculus
atttacgctgttattcttatatgga

SEQ ID NO: 286724 - DNA, 25 bp, Mus musculus
atttacgctgtttttcttatatgga

SEQ ID NO: 286725 - DNA, 25 bp, Mus musculus
atttacggcgtgatgccagagagct

SEQ ID NO: 286726 - DNA, 25 bp, Mus musculus
atttacggcgtgttgccagagagct

SEQ ID NO: 286727 - DNA, 25 bp, Mus musculus
atttacggttagatgcaggatgaca

SEQ ID NO: 286728 - DNA, 25 bp, Mus musculus
atttacggttagttgcaggatgaca

SEQ ID NO: 286729 - DNA, 25 bp, Mus musculus
atttacgtagtactccttgaagaga

SEQ ID NO: 286730 - DNA, 25 bp, Mus musculus
atttacgtagtagtccttgaagaga

SEQ ID NO: 286731 - DNA, 25 bp, Mus musculus
atttacgtcatcacagggcagttcc

SEQ ID NO: 286732 - DNA, 25 bp, Mus musculus
atttacgtcatctcagggcagttcc

SEQ ID NO: 286733 - DNA, 25 bp, Mus musculus
atttactactgcaagcgttcttctc

SEQ ID NO: 286734 - DNA, 25 bp, Mus musculus
atttactactgctagcgttcttctc

SEQ ID NO: 286735 - DNA, 25 bp, Mus musculus
atttactaggacatcccatacggag

SEQ ID NO: 286736 - DNA, 25 bp, Mus musculus
atttactaggacttcccatacggag

SEQ ID NO: 286737 - DNA, 25 bp, Mus musculus
atttactatatcctactgtcttccc

SEQ ID NO: 286738 - DNA, 25 bp, Mus musculus
atttactatatcgtactgtcttccc

SEQ ID NO: 286739 - DNA, 25 bp, Mus musculus
atttactatattaagaatccagtga

SEQ ID NO: 286740 - DNA, 25 bp, Mus musculus
atttactatatttagaatccagtga

SEQ ID NO: 286741 - DNA, 25 bp, Mus musculus
atttactatgccaactggtgcaccc

SEQ ID NO: 286742 - DNA, 25 bp, Mus musculus
atttactatgcctactggtgcaccc

SEQ ID NO: 286743 - DNA, 25 bp, Mus musculus
atttactcaggtcatactctctctg

SEQ ID NO: 286744 - DNA, 25 bp, Mus musculus
atttactcaggtgatactctctctg

SEQ ID NO: 286745 - DNA, 25 bp, Mus musculus
atttactcagtaatggcacgttcca

SEQ ID NO: 286746 - DNA, 25 bp, Mus musculus
atttactcagtattggcacgttcca

SEQ ID NO: 286747 - DNA, 25 bp, Mus musculus
atttactccaagagacttacgttca

SEQ ID NO: 286748 - DNA, 25 bp, Mus musculus
atttactccaagtgacttacgttca

SEQ ID NO: 286749 - DNA, 25 bp, Mus musculus
atttactccactctcttagaaacca

SEQ ID NO: 286750 - DNA, 25 bp, Mus musculus
atttactccactgtcttagaaacca

SEQ ID NO: 286751 - DNA, 25 bp, Mus musculus
atttactcctaaattcagattcctg

SEQ ID NO: 286752 - DNA, 25 bp, Mus musculus
atttactcctaatttcagattcctg

SEQ ID NO: 286753 - DNA, 25 bp, Mus musculus
atttactctatgcatgagacaacaa

SEQ ID NO: 286754 - DNA, 25 bp, Mus musculus
atttactctatggatgagacaacaa

SEQ ID NO: 286755 - DNA, 25 bp, Mus musculus
atttactctgcactttgtatatcca

SEQ ID NO: 286756 - DNA, 25 bp, Mus musculus
atttactctgcagtttgtatatcca

SEQ ID NO: 286757 - DNA, 25 bp, Mus musculus
atttactgagggagtacctggacat

SEQ ID NO: 286758 - DNA, 25 bp, Mus musculus
atttactgagggtgtacctggacat

SEQ ID NO: 286759 - DNA, 25 bp, Mus musculus
atttactgccatagtctatttcata

SEQ ID NO: 286760 - DNA, 25 bp, Mus musculus
atttactgccattgtctatttcata

SEQ ID NO: 286761 - DNA, 25 bp, Mus musculus
atttactgctttctttgtgccttga

SEQ ID NO: 286762 - DNA, 25 bp, Mus musculus
atttactgctttgtttgtgccttga

SEQ ID NO: 286763 - DNA, 25 bp, Mus musculus
atttactggaggcacacctacactt

SEQ ID NO: 286764 - DNA, 25 bp, Mus musculus
atttactggagggacacctacactt

SEQ ID NO: 286765 - DNA, 25 bp, Mus musculus
atttactggcttctcggcttagact

SEQ ID NO: 286766 - DNA, 25 bp, Mus musculus
atttactggcttgtcggcttagact

SEQ ID NO: 286767 - DNA, 25 bp, Mus musculus
atttactgggtcacacctgggagga

SEQ ID NO: 286768 - DNA, 25 bp, Mus musculus
atttactgggtctcacctgggagga

SEQ ID NO: 286769 - DNA, 25 bp, Mus musculus
atttacttattaagagcttgatttt

SEQ ID NO: 286770 - DNA, 25 bp, Mus musculus
atttacttattatgagcttgatttt

SEQ ID NO: 286771 - DNA, 25 bp, Mus musculus
atttacttcaatacctggaccacct

SEQ ID NO: 286772 - DNA, 25 bp, Mus musculus
atttacttcaattcctggaccacct

SEQ ID NO: 286773 - DNA, 25 bp, Mus musculus
atttacttcatgatgacctggccag

SEQ ID NO: 286774 - DNA, 25 bp, Mus musculus
atttacttcatgttgacctggccag

SEQ ID NO: 286775 - DNA, 25 bp, Mus musculus
atttacttctccatacacagacctc

SEQ ID NO: 286776 - DNA, 25 bp, Mus musculus
atttacttctccttacacagacctc

SEQ ID NO: 286777 - DNA, 25 bp, Mus musculus
atttacttgatgaagcatttctggc

SEQ ID NO: 286778 - DNA, 25 bp, Mus musculus
atttacttgatgtagcatttctggc

SEQ ID NO: 286779 - DNA, 25 bp, Mus musculus
atttactttcccaatattctgttga

SEQ ID NO: 286780 - DNA, 25 bp, Mus musculus
atttactttccctatattctgttga

SEQ ID NO: 286781 - DNA, 25 bp, Mus musculus
atttacttttccactagaccacact

SEQ ID NO: 286782 - DNA, 25 bp, Mus musculus
atttacttttcctctagaccacact

SEQ ID NO: 286783 - DNA, 25 bp, Mus musculus
atttacttttgtctgaggatggctg

SEQ ID NO: 286784 - DNA, 25 bp, Mus musculus
atttacttttgtgtgaggatggctg

SEQ ID NO: 286785 - DNA, 25 bp, Mus musculus
atttagaaaactcgcctgtattatt

SEQ ID NO: 286786 - DNA, 25 bp, Mus musculus
atttagaaaactggcctgtattatt

SEQ ID NO: 286787 - DNA, 25 bp, Mus musculus
atttagaaaatcaagctcccttctc

SEQ ID NO: 286788 - DNA, 25 bp, Mus musculus
atttagaaaatctagctcccttctc

SEQ ID NO: 286789 - DNA, 25 bp, Mus musculus
atttagaacagaattcccagctcct

SEQ ID NO: 286790 - DNA, 25 bp, Mus musculus
atttagaacagatttcccagctcct

SEQ ID NO: 286791 - DNA, 25 bp, Mus musculus
atttagaaggtaagcatcacacagg

SEQ ID NO: 286792 - DNA, 25 bp, Mus musculus
atttagaaggtatgcatcacacagg

SEQ ID NO: 286793 - DNA, 25 bp, Mus musculus
atttagacacgtcacaccagcgggt

SEQ ID NO: 286794 - DNA, 25 bp, Mus musculus
atttagacacgtgacaccagcgggt

SEQ ID NO: 286795 - DNA, 25 bp, Mus musculus
atttagacactcacttttgcacata

SEQ ID NO: 286796 - DNA, 25 bp, Mus musculus
atttagacactctcttttgcacata

SEQ ID NO: 286797 - DNA, 25 bp, Mus musculus
atttagactgtaattgttgctggaa

SEQ ID NO: 286798 - DNA, 25 bp, Mus musculus
atttagactgtatttgttgctggaa

SEQ ID NO: 286799 - DNA, 25 bp, Mus musculus
atttagagctgcagcggctggtcca

SEQ ID NO: 286800 - DNA, 25 bp, Mus musculus
atttagagctgctgcggctggtcca

SEQ ID NO: 286801 - DNA, 25 bp, Mus musculus
atttagataccactgttcccttgag

SEQ ID NO: 286802 - DNA, 25 bp, Mus musculus
atttagataccagtgttcccttgag

SEQ ID NO: 286803 - DNA, 25 bp, Mus musculus
atttagatcattcctcatgctaggc

SEQ ID NO: 286804 - DNA, 25 bp, Mus musculus
atttagatcattgctcatgctaggc

SEQ ID NO: 286805 - DNA, 25 bp, Mus musculus
atttagatgggcaccgatctctgtc

SEQ ID NO: 286806 - DNA, 25 bp, Mus musculus
atttagatgggctccgatctctgtc

SEQ ID NO: 286807 - DNA, 25 bp, Mus musculus
atttagatttgtccccatggcttga

SEQ ID NO: 286808 - DNA, 25 bp, Mus musculus
atttagatttgtgcccatggcttga

SEQ ID NO: 286809 - DNA, 25 bp, Mus musculus
atttagcacaagctatttttccctc

SEQ ID NO: 286810 - DNA, 25 bp, Mus musculus
atttagcacaaggtatttttccctc

SEQ ID NO: 286811 - DNA, 25 bp, Mus musculus
atttagcacataacaggcactcaat

SEQ ID NO: 286812 - DNA, 25 bp, Mus musculus
atttagcacatatcaggcactcaat

SEQ ID NO: 286813 - DNA, 25 bp, Mus musculus
atttagcagaggaccaaatgttccg

SEQ ID NO: 286814 - DNA, 25 bp, Mus musculus
atttagcagaggtccaaatgttccg

SEQ ID NO: 286815 - DNA, 25 bp, Mus musculus
atttagcaggctagatacctgatac

SEQ ID NO: 286816 - DNA, 25 bp, Mus musculus
atttagcaggcttgatacctgatac

SEQ ID NO: 286817 - DNA, 25 bp, Mus musculus
atttagcagggaacttgtaaagaca

SEQ ID NO: 286818 - DNA, 25 bp, Mus musculus
atttagcagggatcttgtaaagaca

SEQ ID NO: 286819 - DNA, 25 bp, Mus musculus
atttagcagtgtcaaaggccccagc

SEQ ID NO: 286820 - DNA, 25 bp, Mus musculus
atttagcagtgtgaaaggccccagc

SEQ ID NO: 286821 - DNA, 25 bp, Mus musculus
atttagccaacaatcagaaatgatc

SEQ ID NO: 286822 - DNA, 25 bp, Mus musculus
atttagccaacattcagaaatgatc

SEQ ID NO: 286823 - DNA, 25 bp, Mus musculus
atttagccacacattgaccagcaaa

SEQ ID NO: 286824 - DNA, 25 bp, Mus musculus
atttagccacactttgaccagcaaa

SEQ ID NO: 286825 - DNA, 25 bp, Mus musculus
atttagccagtgacttgagctgctc

SEQ ID NO: 286826 - DNA, 25 bp, Mus musculus
atttagccagtgtcttgagctgctc

SEQ ID NO: 286827 - DNA, 25 bp, Mus musculus
atttagccccctcagacaagcctgt

SEQ ID NO: 286828 - DNA, 25 bp, Mus musculus
atttagccccctgagacaagcctgt

SEQ ID NO: 286829 - DNA, 25 bp, Mus musculus
atttagccctcacaccaagcaaggc

SEQ ID NO: 286830 - DNA, 25 bp, Mus musculus
atttagccctcagaccaagcaaggc

SEQ ID NO: 286831 - DNA, 25 bp, Mus musculus
atttagccctccagagtgtgaaaat

SEQ ID NO: 286832 - DNA, 25 bp, Mus musculus
atttagccctcctgagtgtgaaaat

SEQ ID NO: 286833 - DNA, 25 bp, Mus musculus
atttagccgactcttcgacggatcc

SEQ ID NO: 286834 - DNA, 25 bp, Mus musculus
atttagccgactgttcgacggatcc

SEQ ID NO: 286835 - DNA, 25 bp, Mus musculus
atttagcctagcagagaggtgagta

SEQ ID NO: 286836 - DNA, 25 bp, Mus musculus
atttagcctagctgagaggtgagta

SEQ ID NO: 286837 - DNA, 25 bp, Mus musculus
atttagctaattagctgatgctata

SEQ ID NO: 286838 - DNA, 25 bp, Mus musculus
atttagctaatttgctgatgctata

SEQ ID NO: 286839 - DNA, 25 bp, Mus musculus
atttagctacccactgtgttactct

SEQ ID NO: 286840 - DNA, 25 bp, Mus musculus
atttagctaccctctgtgttactct

SEQ ID NO: 286841 - DNA, 25 bp, Mus musculus
atttagctcagtcgtagagcgcttg

SEQ ID NO: 286842 - DNA, 25 bp, Mus musculus
atttagctcagtggtagagcgcttg

SEQ ID NO: 286843 - DNA, 25 bp, Mus musculus
atttagctcattaatcacccaacat

SEQ ID NO: 286844 - DNA, 25 bp, Mus musculus
atttagctcatttatcacccaacat

SEQ ID NO: 286845 - DNA, 25 bp, Mus musculus
atttagctctgtactgtctcttact

SEQ ID NO: 286846 - DNA, 25 bp, Mus musculus
atttagctctgttctgtctcttact

SEQ ID NO: 286847 - DNA, 25 bp, Mus musculus
atttagctgtttcgaacagagttgt

SEQ ID NO: 286848 - DNA, 25 bp, Mus musculus
atttagctgtttggaacagagttgt

SEQ ID NO: 286849 - DNA, 25 bp, Mus musculus
atttagcttcacacagattctcagg

SEQ ID NO: 286850 - DNA, 25 bp, Mus musculus
atttagcttcactcagattctcagg

SEQ ID NO: 286851 - DNA, 25 bp, Mus musculus
atttagcttgagacacctaggatac

SEQ ID NO: 286852 - DNA, 25 bp, Mus musculus
atttagcttgagtcacctaggatac

SEQ ID NO: 286853 - DNA, 25 bp, Mus musculus
atttagcttttgaacatgcatgtgc

SEQ ID NO: 286854 - DNA, 25 bp, Mus musculus
atttagcttttgtacatgcatgtgc

SEQ ID NO: 286855 - DNA, 25 bp, Mus musculus
atttaggaaggaaggttcagctctt

SEQ ID NO: 286856 - DNA, 25 bp, Mus musculus
atttaggaaggatggttcagctctt

SEQ ID NO: 286857 - DNA, 25 bp, Mus musculus
atttaggaaggcactgctgcaggct

SEQ ID NO: 286858 - DNA, 25 bp, Mus musculus
atttaggaaggctctgctgcaggct

SEQ ID NO: 286859 - DNA, 25 bp, Mus musculus
atttaggaattcacaggcactgttg

SEQ ID NO: 286860 - DNA, 25 bp, Mus musculus
atttaggaattctcaggcactgttg

SEQ ID NO: 286861 - DNA, 25 bp, Mus musculus
atttaggacctgagctgccctaaag

SEQ ID NO: 286862 - DNA, 25 bp, Mus musculus
atttaggacctgtgctgccctaaag

SEQ ID NO: 286863 - DNA, 25 bp, Mus musculus
atttaggagcctatattccaccagc

SEQ ID NO: 286864 - DNA, 25 bp, Mus musculus
atttaggagcctttattccaccagc

SEQ ID NO: 286865 - DNA, 25 bp, Mus musculus
atttaggagctaacaggccgaattt

SEQ ID NO: 286866 - DNA, 25 bp, Mus musculus
atttaggagctatcaggccgaattt

SEQ ID NO: 286867 - DNA, 25 bp, Mus musculus
atttaggatttgcttcacctgagga

SEQ ID NO: 286868 - DNA, 25 bp, Mus musculus
atttaggatttggttcacctgagga

SEQ ID NO: 286869 - DNA, 25 bp, Mus musculus
atttaggcatttctccggtgtcttc

SEQ ID NO: 286870 - DNA, 25 bp, Mus musculus
atttaggcatttgtccggtgtcttc

SEQ ID NO: 286871 - DNA, 25 bp, Mus musculus
atttaggccaagaactagaacaagg

SEQ ID NO: 286872 - DNA, 25 bp, Mus musculus
atttaggccaagtactagaacaagg

SEQ ID NO: 286873 - DNA, 25 bp, Mus musculus
atttaggcccgtcaatgctgcagag

SEQ ID NO: 286874 - DNA, 25 bp, Mus musculus
atttaggcccgtgaatgctgcagag

SEQ ID NO: 286875 - DNA, 25 bp, Mus musculus
atttaggctacacatgcccactgct

SEQ ID NO: 286876 - DNA, 25 bp, Mus musculus
atttaggctacagatgcccactgct

SEQ ID NO: 286877 - DNA, 25 bp, Mus musculus
atttagggagctcacaaatcctgaa

SEQ ID NO: 286878 - DNA, 25 bp, Mus musculus
atttagggagctgacaaatcctgaa

SEQ ID NO: 286879 - DNA, 25 bp, Mus musculus
atttagggaggcaccacacttggga

SEQ ID NO: 286880 - DNA, 25 bp, Mus musculus
atttagggaggctccacacttggga

SEQ ID NO: 286881 - DNA, 25 bp, Mus musculus
atttagggcaatcttctgtttagac

SEQ ID NO: 286882 - DNA, 25 bp, Mus musculus
atttagggcaatgttctgtttagac

SEQ ID NO: 286883 - DNA, 25 bp, Mus musculus
atttaggggtggctcattacatgct

SEQ ID NO: 286884 - DNA, 25 bp, Mus musculus
atttaggggtgggtcattacatgct

SEQ ID NO: 286885 - DNA, 25 bp, Mus musculus
atttaggtcattcgttgtcagtaac

SEQ ID NO: 286886 - DNA, 25 bp, Mus musculus
atttaggtcattggttgtcagtaac

SEQ ID NO: 286887 - DNA, 25 bp, Mus musculus
atttaggtccaccattctcaggaac

SEQ ID NO: 286888 - DNA, 25 bp, Mus musculus
atttaggtccacgattctcaggaac

SEQ ID NO: 286889 - DNA, 25 bp, Mus musculus
atttaggtctggaaccagcttccag

SEQ ID NO: 286890 - DNA, 25 bp, Mus musculus
atttaggtctggtaccagcttccag

SEQ ID NO: 286891 - DNA, 25 bp, Mus musculus
atttaggtgtcaataacccagtcct

SEQ ID NO: 286892 - DNA, 25 bp, Mus musculus
atttaggtgtcattaacccagtcct

SEQ ID NO: 286893 - DNA, 25 bp, Mus musculus
atttaggttggaccgaacagcaaag

SEQ ID NO: 286894 - DNA, 25 bp, Mus musculus
atttaggttggagcgaacagcaaag

SEQ ID NO: 286895 - DNA, 25 bp, Mus musculus
atttaggttttaatccaatgtcatg

SEQ ID NO: 286896 - DNA, 25 bp, Mus musculus
atttaggttttattccaatgtcatg

SEQ ID NO: 286897 - DNA, 25 bp, Mus musculus
atttagtataaaaagcctgtgcagt

SEQ ID NO: 286898 - DNA, 25 bp, Mus musculus
atttagtataaatagcctgtgcagt

SEQ ID NO: 286899 - DNA, 25 bp, Mus musculus
atttagtattagactgccaagccct

SEQ ID NO: 286900 - DNA, 25 bp, Mus musculus
atttagtattagtctgccaagccct

SEQ ID NO: 286901 - DNA, 25 bp, Mus musculus
atttagtcatggactgcctgtgagc

SEQ ID NO: 286902 - DNA, 25 bp, Mus musculus
atttagtcatggtctgcctgtgagc

SEQ ID NO: 286903 - DNA, 25 bp, Mus musculus
atttagtccagcatctgtggctcat

SEQ ID NO: 286904 - DNA, 25 bp, Mus musculus
atttagtccagcttctgtggctcat

SEQ ID NO: 286905 - DNA, 25 bp, Mus musculus
atttagtcctgacatgtatatataa

SEQ ID NO: 286906 - DNA, 25 bp, Mus musculus
atttagtcctgagatgtatatataa

SEQ ID NO: 286907 - DNA, 25 bp, Mus musculus
atttagtcctttagctgtgcaatac

SEQ ID NO: 286908 - DNA, 25 bp, Mus musculus
atttagtccttttgctgtgcaatac

SEQ ID NO: 286909 - DNA, 25 bp, Mus musculus
atttagtgatttccaatatgagcca

SEQ ID NO: 286910 - DNA, 25 bp, Mus musculus
atttagtgatttgcaatatgagcca

SEQ ID NO: 286911 - DNA, 25 bp, Mus musculus
atttagtgccttaatcaagtcacca

SEQ ID NO: 286912 - DNA, 25 bp, Mus musculus
atttagtgccttcttatatcctcag

SEQ ID NO: 286913 - DNA, 25 bp, Mus musculus
atttagtgccttgttatatcctcag

SEQ ID NO: 286914 - DNA, 25 bp, Mus musculus
atttagtgcctttatcaagtcacca

SEQ ID NO: 286915 - DNA, 25 bp, Mus musculus
atttagtggactacgcccgtgctga

SEQ ID NO: 286916 - DNA, 25 bp, Mus musculus
atttagtggacttcgcccgtgctga

SEQ ID NO: 286917 - DNA, 25 bp, Mus musculus
atttagtgggtcatggttcctgaag

SEQ ID NO: 286918 - DNA, 25 bp, Mus musculus
atttagtgggtcttggttcctgaag

SEQ ID NO: 286919 - DNA, 25 bp, Mus musculus
atttagtgtcaaccctagcggtcaa

SEQ ID NO: 286920 - DNA, 25 bp, Mus musculus
atttagtgtcaagcctagcggtcaa

SEQ ID NO: 286921 - DNA, 25 bp, Mus musculus
atttagttactgctagactggtctg

SEQ ID NO: 286922 - DNA, 25 bp, Mus musculus
atttagttactggtagactggtctg

SEQ ID NO: 286923 - DNA, 25 bp, Mus musculus
atttagttccacagctgtctatcgc

SEQ ID NO: 286924 - DNA, 25 bp, Mus musculus
atttagttccactgctgtctatcgc

SEQ ID NO: 286925 - DNA, 25 bp, Mus musculus
atttagttcctgcagcttgatttaa

SEQ ID NO: 286926 - DNA, 25 bp, Mus musculus
atttagttcctggagcttgatttaa

SEQ ID NO: 286927 - DNA, 25 bp, Mus musculus
atttagttctccagcttggtgactc

SEQ ID NO: 286928 - DNA, 25 bp, Mus musculus
atttagttctcctgcttggtgactc

SEQ ID NO: 286929 - DNA, 25 bp, Mus musculus
atttagttgctgacaagtgcctgga

SEQ ID NO: 286930 - DNA, 25 bp, Mus musculus
atttagttgctgtcaagtgcctgga

SEQ ID NO: 286931 - DNA, 25 bp, Mus musculus
atttagttggtaccatcctcacctg

SEQ ID NO: 286932 - DNA, 25 bp, Mus musculus
atttagttggtagcatcctcacctg

SEQ ID NO: 286933 - DNA, 25 bp, Mus musculus
atttagttgtccataggctggccta

SEQ ID NO: 286934 - DNA, 25 bp, Mus musculus
atttagttgtccttaggctggccta

SEQ ID NO: 286935 - DNA, 25 bp, Mus musculus
atttagtttgctcggtagctgccac

SEQ ID NO: 286936 - DNA, 25 bp, Mus musculus
atttagtttgctgggtagctgccac

SEQ ID NO: 286937 - DNA, 25 bp, Mus musculus
atttagtttgtactgcagcccttca

SEQ ID NO: 286938 - DNA, 25 bp, Mus musculus
atttagtttgtagtgcagcccttca

SEQ ID NO: 286939 - DNA, 25 bp, Mus musculus
atttagtttttaccagtgcatcaca

SEQ ID NO: 286940 - DNA, 25 bp, Mus musculus
atttagtttttagcagtgcatcaca

SEQ ID NO: 286941 - DNA, 25 bp, Mus musculus
atttataacataatcttgcagccaa

SEQ ID NO: 286942 - DNA, 25 bp, Mus musculus
atttataacatattcttgcagccaa

SEQ ID NO: 286943 - DNA, 25 bp, Mus musculus
atttataatgatccctaccctcttt

SEQ ID NO: 286944 - DNA, 25 bp, Mus musculus
atttataatgatgcctaccctcttt

SEQ ID NO: 286945 - DNA, 25 bp, Mus musculus
atttatacacatcagatcacaaatt

SEQ ID NO: 286946 - DNA, 25 bp, Mus musculus
atttatacacatgagatcacaaatt

SEQ ID NO: 286947 - DNA, 25 bp, Mus musculus
atttatacaccaccagtttagacaa

SEQ ID NO: 286948 - DNA, 25 bp, Mus musculus
atttatacaccagcagtttagacaa

SEQ ID NO: 286949 - DNA, 25 bp, Mus musculus
atttatacagatcaccaggaagcca

SEQ ID NO: 286950 - DNA, 25 bp, Mus musculus
atttatacagatgaccaggaagcca

SEQ ID NO: 286951 - DNA, 25 bp, Mus musculus
atttatacatccctttttaatgact

SEQ ID NO: 286952 - DNA, 25 bp, Mus musculus
atttatacatccgtttttaatgact

SEQ ID NO: 286953 - DNA, 25 bp, Mus musculus
atttataccgttactgtcctgaggg

SEQ ID NO: 286954 - DNA, 25 bp, Mus musculus
atttataccgtttctgtcctgaggg

SEQ ID NO: 286955 - DNA, 25 bp, Mus musculus
atttatacggaaccagtgtgcaatc

SEQ ID NO: 286956 - DNA, 25 bp, Mus musculus
atttatacggaagcagtgtgcaatc

SEQ ID NO: 286957 - DNA, 25 bp, Mus musculus
atttatacgtgaaagcatgctctct

SEQ ID NO: 286958 - DNA, 25 bp, Mus musculus
atttatacgtgatagcatgctctct

SEQ ID NO: 286959 - DNA, 25 bp, Mus musculus
atttatactgtcaaagaaggtctta

SEQ ID NO: 286960 - DNA, 25 bp, Mus musculus
atttatactgtctaagaaggtctta

SEQ ID NO: 286961 - DNA, 25 bp, Mus musculus
atttatagaacccactagcttccca

SEQ ID NO: 286962 - DNA, 25 bp, Mus musculus
atttatagaaccgactagcttccca

SEQ ID NO: 286963 - DNA, 25 bp, Mus musculus
atttatagagaacacgtgcctccag

SEQ ID NO: 286964 - DNA, 25 bp, Mus musculus
atttatagagaagacgtgcctccag

SEQ ID NO: 286965 - DNA, 25 bp, Mus musculus
atttatagatagaactcccaagagt

SEQ ID NO: 286966 - DNA, 25 bp, Mus musculus
atttatagatagtactcccaagagt

SEQ ID NO: 286967 - DNA, 25 bp, Mus musculus
atttatagcagtcacttttacacac

SEQ ID NO: 286968 - DNA, 25 bp, Mus musculus
atttatagcagtgacttttacacac

SEQ ID NO: 286969 - DNA, 25 bp, Mus musculus
atttatagcctgagtcctgagcaaa

SEQ ID NO: 286970 - DNA, 25 bp, Mus musculus
atttatagcctgtgtcctgagcaaa

SEQ ID NO: 286971 - DNA, 25 bp, Mus musculus
atttatatacccagcatctatctcc

SEQ ID NO: 286972 - DNA, 25 bp, Mus musculus
atttatataccctgcatctatctcc

SEQ ID NO: 286973 - DNA, 25 bp, Mus musculus
atttatatactcagcctcacgagga

SEQ ID NO: 286974 - DNA, 25 bp, Mus musculus
atttatatactctgcctcacgagga

SEQ ID NO: 286975 - DNA, 25 bp, Mus musculus
atttatatattacaccatgctgcag

SEQ ID NO: 286976 - DNA, 25 bp, Mus musculus
atttatatattagaccatgctgcag

SEQ ID NO: 286977 - DNA, 25 bp, Mus musculus
atttatattgtaattcccaaggaat

SEQ ID NO: 286978 - DNA, 25 bp, Mus musculus
atttatattgtatttcccaaggaat

SEQ ID NO: 286979 - DNA, 25 bp, Mus musculus
atttatatttacacgatggttcatc

SEQ ID NO: 286980 - DNA, 25 bp, Mus musculus
atttatatttactcgatggttcatc

SEQ ID NO: 286981 - DNA, 25 bp, Mus musculus
atttatcaacagcacttcgcttggg

SEQ ID NO: 286982 - DNA, 25 bp, Mus musculus
atttatcaacaggacttcgcttggg

SEQ ID NO: 286983 - DNA, 25 bp, Mus musculus
atttatcaaccaccgcgagaagccc

SEQ ID NO: 286984 - DNA, 25 bp, Mus musculus
atttatcaaccagcgcgagaagccc

SEQ ID NO: 286985 - DNA, 25 bp, Mus musculus
atttatcaaggtcacatgggtttct

SEQ ID NO: 286986 - DNA, 25 bp, Mus musculus
atttatcaaggtgacatgggtttct

SEQ ID NO: 286987 - DNA, 25 bp, Mus musculus
atttatcacactcatgagagcagta

SEQ ID NO: 286988 - DNA, 25 bp, Mus musculus
atttatcacactgatgagagcagta

SEQ ID NO: 286989 - DNA, 25 bp, Mus musculus
atttatcagcctacggtagttttcg

SEQ ID NO: 286990 - DNA, 25 bp, Mus musculus
atttatcagcctatgggtgagtccc

SEQ ID NO: 286991 - DNA, 25 bp, Mus musculus
atttatcagccttcggtagttttcg

SEQ ID NO: 286992 - DNA, 25 bp, Mus musculus
atttatcagcctttgggtgagtccc

SEQ ID NO: 286993 - DNA, 25 bp, Mus musculus
atttatcaggctaaaaaatcatgta

SEQ ID NO: 286994 - DNA, 25 bp, Mus musculus
atttatcaggcttaaaaatcatgta

SEQ ID NO: 286995 - DNA, 25 bp, Mus musculus
atttatcatctcatggcttgctcgg

SEQ ID NO: 286996 - DNA, 25 bp, Mus musculus
atttatcatctcttggcttgctcgg

SEQ ID NO: 286997 - DNA, 25 bp, Mus musculus
atttatcatttaattgtccccattt

SEQ ID NO: 286998 - DNA, 25 bp, Mus musculus
atttatcatttatttgtccccattt

SEQ ID NO: 286999 - DNA, 25 bp, Mus musculus
atttatcatttccagacgaccgcaa

SEQ ID NO: 287000 - DNA, 25 bp, Mus musculus
atttatcatttcgagacgaccgcaa

SEQ ID NO: 287001 - DNA, 25 bp, Mus musculus
atttatccaattaccgtctttgtct

SEQ ID NO: 287002 - DNA, 25 bp, Mus musculus
atttatccaatttccgtctttgtct

SEQ ID NO: 287003 - DNA, 25 bp, Mus musculus
atttatccacggcactccgcgagct

SEQ ID NO: 287004 - DNA, 25 bp, Mus musculus
atttatccacgggactccgcgagct

SEQ ID NO: 287005 - DNA, 25 bp, Mus musculus
atttatccaggtaccatgggttctg

SEQ ID NO: 287006 - DNA, 25 bp, Mus musculus
atttatccaggttccatgggttctg

SEQ ID NO: 287007 - DNA, 25 bp, Mus musculus
atttatccatgtcagcacacagaga

SEQ ID NO: 287008 - DNA, 25 bp, Mus musculus
atttatccatgtgagcacacagaga

SEQ ID NO: 287009 - DNA, 25 bp, Mus musculus
atttatccccaacggccaattctgt

SEQ ID NO: 287010 - DNA, 25 bp, Mus musculus
atttatccccaagggccaattctgt

SEQ ID NO: 287011 - DNA, 25 bp, Mus musculus
atttatcccctccagcacagcatag

SEQ ID NO: 287012 - DNA, 25 bp, Mus musculus
atttatcccctcgagcacagcatag

SEQ ID NO: 287013 - DNA, 25 bp, Mus musculus
atttatcccgtgcattttacctctg

SEQ ID NO: 287014 - DNA, 25 bp, Mus musculus
atttatcccgtggattttacctctg

SEQ ID NO: 287015 - DNA, 25 bp, Mus musculus
atttatccctagagttgccctaaga

SEQ ID NO: 287016 - DNA, 25 bp, Mus musculus
atttatccctagtgttgccctaaga

SEQ ID NO: 287017 - DNA, 25 bp, Mus musculus
atttatcctgcacatgcccgagatg

SEQ ID NO: 287018 - DNA, 25 bp, Mus musculus
atttatcctgcagatgcccgagatg

SEQ ID NO: 287019 - DNA, 25 bp, Mus musculus
atttatccttggcagattccttccg

SEQ ID NO: 287020 - DNA, 25 bp, Mus musculus
atttatccttgggagattccttccg

SEQ ID NO: 287021 - DNA, 25 bp, Mus musculus
atttatccttgtatatatctggctg

SEQ ID NO: 287022 - DNA, 25 bp, Mus musculus
atttatccttgtttatatctggctg

SEQ ID NO: 287023 - DNA, 25 bp, Mus musculus
atttatcctttgagtgagccgtatt

SEQ ID NO: 287024 - DNA, 25 bp, Mus musculus
atttatcctttgtgtgagccgtatt

SEQ ID NO: 287025 - DNA, 25 bp, Mus musculus
atttatcgcaccactttagggacta

SEQ ID NO: 287026 - DNA, 25 bp, Mus musculus
atttatcgcacctctttagggacta

SEQ ID NO: 287027 - DNA, 25 bp, Mus musculus
atttatcgggatcacaaatccatag

SEQ ID NO: 287028 - DNA, 25 bp, Mus musculus
atttatcgggatgacaaatccatag

SEQ ID NO: 287029 - DNA, 25 bp, Mus musculus
atttatcgtttgctgtcatcttccc

SEQ ID NO: 287030 - DNA, 25 bp, Mus musculus
atttatcgtttggtgtcatcttccc

SEQ ID NO: 287031 - DNA, 25 bp, Mus musculus
atttatctacccatcacttgctatt

SEQ ID NO: 287032 - DNA, 25 bp, Mus musculus
atttatctacccttcacttgctatt

SEQ ID NO: 287033 - DNA, 25 bp, Mus musculus
atttatctatacaccatgctccttg

SEQ ID NO: 287034 - DNA, 25 bp, Mus musculus
atttatctatactccatgctccttg

SEQ ID NO: 287035 - DNA, 25 bp, Mus musculus
atttatctcaaaacacaagggcagc

SEQ ID NO: 287036 - DNA, 25 bp, Mus musculus
atttatctcaaatcacaagggcagc

SEQ ID NO: 287037 - DNA, 25 bp, Mus musculus
atttatctctctattttgggccttc

SEQ ID NO: 287038 - DNA, 25 bp, Mus musculus
atttatctctcttttttgggccttc

SEQ ID NO: 287039 - DNA, 25 bp, Mus musculus
atttatctgcagacagtgcttattc

SEQ ID NO: 287040 - DNA, 25 bp, Mus musculus
atttatctgcagtcagtgcttattc

SEQ ID NO: 287041 - DNA, 25 bp, Mus musculus
atttatctgccaatcttttctccaa

SEQ ID NO: 287042 - DNA, 25 bp, Mus musculus
atttatctgccattcttttctccaa

SEQ ID NO: 287043 - DNA, 25 bp, Mus musculus
atttatctggagagccattcctgcc

SEQ ID NO: 287044 - DNA, 25 bp, Mus musculus
atttatctggagtgccattcctgcc

SEQ ID NO: 287045 - DNA, 25 bp, Mus musculus
atttatctgttacctgaactctgaa

SEQ ID NO: 287046 - DNA, 25 bp, Mus musculus
atttatctgttagctgaactctgaa

SEQ ID NO: 287047 - DNA, 25 bp, Mus musculus
atttatcttctaatgctctctctgc

SEQ ID NO: 287048 - DNA, 25 bp, Mus musculus
atttatcttctattgctctctctgc

SEQ ID NO: 287049 - DNA, 25 bp, Mus musculus
atttatcttggcaggtgctgtgtag

SEQ ID NO: 287050 - DNA, 25 bp, Mus musculus
atttatcttggctggtgctgtgtag

SEQ ID NO: 287051 - DNA, 25 bp, Mus musculus
atttatgaacgacagccacccttgt

SEQ ID NO: 287052 - DNA, 25 bp, Mus musculus
atttatgaacgagagccacccttgt

SEQ ID NO: 287053 - DNA, 25 bp, Mus musculus
atttatgaccttatgttgagactaa

SEQ ID NO: 287054 - DNA, 25 bp, Mus musculus
atttatgaccttttgttgagactaa

SEQ ID NO: 287055 - DNA, 25 bp, Mus musculus
atttatgacggactgcccatctggc

SEQ ID NO: 287056 - DNA, 25 bp, Mus musculus
atttatgacggagtgcccatctggc

SEQ ID NO: 287057 - DNA, 25 bp, Mus musculus
atttatgactcaaaaagcgtcttta

SEQ ID NO: 287058 - DNA, 25 bp, Mus musculus
atttatgactcataaagcgtcttta

SEQ ID NO: 287059 - DNA, 25 bp, Mus musculus
atttatgatcggcatacccaatgtt

SEQ ID NO: 287060 - DNA, 25 bp, Mus musculus
atttatgatcgggatacccaatgtt

SEQ ID NO: 287061 - DNA, 25 bp, Mus musculus
atttatgatctcatgaaatgagtca

SEQ ID NO: 287062 - DNA, 25 bp, Mus musculus
atttatgatctcttgaaatgagtca

SEQ ID NO: 287063 - DNA, 25 bp, Mus musculus
atttatgatgtaagcctatcccaca

SEQ ID NO: 287064 - DNA, 25 bp, Mus musculus
atttatgatgtatgcctatcccaca

SEQ ID NO: 287065 - DNA, 25 bp, Mus musculus
atttatgcaataatggtacaccttc

SEQ ID NO: 287066 - DNA, 25 bp, Mus musculus
atttatgcaatattggtacaccttc

SEQ ID NO: 287067 - DNA, 25 bp, Mus musculus
atttatgcacgacaggcctgatcct

SEQ ID NO: 287068 - DNA, 25 bp, Mus musculus
atttatgcacgagaggcctgatcct

SEQ ID NO: 287069 - DNA, 25 bp, Mus musculus
atttatgcacttatcaatatcttga

SEQ ID NO: 287070 - DNA, 25 bp, Mus musculus
atttatgcacttttcaatatcttga

SEQ ID NO: 287071 - DNA, 25 bp, Mus musculus
atttatgcagttacactttcttggg

SEQ ID NO: 287072 - DNA, 25 bp, Mus musculus
atttatgcagtttcactttcttggg

SEQ ID NO: 287073 - DNA, 25 bp, Mus musculus
atttatgccaagagcggtttcgaaa

SEQ ID NO: 287074 - DNA, 25 bp, Mus musculus
atttatgccaagtgcggtttcgaaa

SEQ ID NO: 287075 - DNA, 25 bp, Mus musculus
atttatgccacaaaagggcctcaga

SEQ ID NO: 287076 - DNA, 25 bp, Mus musculus
atttatgccacataagggcctcaga

SEQ ID NO: 287077 - DNA, 25 bp, Mus musculus
atttatgccattagttggagtcctg

SEQ ID NO: 287078 - DNA, 25 bp, Mus musculus
atttatgccatttgttggagtcctg

SEQ ID NO: 287079 - DNA, 25 bp, Mus musculus
atttatgcctgtatctcttggacat

SEQ ID NO: 287080 - DNA, 25 bp, Mus musculus
atttatgcctgtttctcttggacat

SEQ ID NO: 287081 - DNA, 25 bp, Mus musculus
atttatgctgatatactgttgtgat

SEQ ID NO: 287082 - DNA, 25 bp, Mus musculus
atttatgctgatttactgttgtgat

SEQ ID NO: 287083 - DNA, 25 bp, Mus musculus
atttatgctggaagaactctgtaca

SEQ ID NO: 287084 - DNA, 25 bp, Mus musculus
atttatgctggatgaactctgtaca

SEQ ID NO: 287085 - DNA, 25 bp, Mus musculus
atttatggccatctacacgttctga

SEQ ID NO: 287086 - DNA, 25 bp, Mus musculus
atttatggccatgtacacgttctga

SEQ ID NO: 287087 - DNA, 25 bp, Mus musculus
atttatggcctcagttcacgtgtgt

SEQ ID NO: 287088 - DNA, 25 bp, Mus musculus
atttatggcctctgttcacgtgtgt

SEQ ID NO: 287089 - DNA, 25 bp, Mus musculus
atttatggctccataacctgtttgc

SEQ ID NO: 287090 - DNA, 25 bp, Mus musculus
atttatggctccttaacctgtttgc

SEQ ID NO: 287091 - DNA, 25 bp, Mus musculus
atttatggtctaattctgcagttct

SEQ ID NO: 287092 - DNA, 25 bp, Mus musculus
atttatggtctatttctgcagttct

SEQ ID NO: 287093 - DNA, 25 bp, Mus musculus
atttatggtgctatttaacatacat

SEQ ID NO: 287094 - DNA, 25 bp, Mus musculus
atttatggtgctccgtattctggca

SEQ ID NO: 287095 - DNA, 25 bp, Mus musculus
atttatggtgctgcgtattctggca

SEQ ID NO: 287096 - DNA, 25 bp, Mus musculus
atttatggtgctttttaacatacat

SEQ ID NO: 287097 - DNA, 25 bp, Mus musculus
atttatggtgtgatcaccctggagg

SEQ ID NO: 287098 - DNA, 25 bp, Mus musculus
atttatggtgtgttcaccctggagg

SEQ ID NO: 287099 - DNA, 25 bp, Mus musculus
atttatggttttcctctgttccaca

SEQ ID NO: 287100 - DNA, 25 bp, Mus musculus
atttatggttttgctctgttccaca

SEQ ID NO: 287101 - DNA, 25 bp, Mus musculus
atttatgtaccactgtgaccccttc

SEQ ID NO: 287102 - DNA, 25 bp, Mus musculus
atttatgtaccagtgtgaccccttc

SEQ ID NO: 287103 - DNA, 25 bp, Mus musculus
atttatgtacttcagtggaacagga

SEQ ID NO: 287104 - DNA, 25 bp, Mus musculus
atttatgtacttgagtggaacagga

SEQ ID NO: 287105 - DNA, 25 bp, Mus musculus
atttatgtatgcctactgtactgtt

SEQ ID NO: 287106 - DNA, 25 bp, Mus musculus
atttatgtatgcgtactgtactgtt

SEQ ID NO: 287107 - DNA, 25 bp, Mus musculus
atttatgtatttactctatcccgag

SEQ ID NO: 287108 - DNA, 25 bp, Mus musculus
atttatgtattttctctatcccgag

SEQ ID NO: 287109 - DNA, 25 bp, Mus musculus
atttatgtcctactgaaggtggcag

SEQ ID NO: 287110 - DNA, 25 bp, Mus musculus
atttatgtcctagtgaaggtggcag

SEQ ID NO: 287111 - DNA, 25 bp, Mus musculus
atttatgtctttccaggccggctct

SEQ ID NO: 287112 - DNA, 25 bp, Mus musculus
atttatgtctttgcaggccggctct

SEQ ID NO: 287113 - DNA, 25 bp, Mus musculus
atttatgtgaccatcccctccacag

SEQ ID NO: 287114 - DNA, 25 bp, Mus musculus
atttatgtgaccttcccctccacag

SEQ ID NO: 287115 - DNA, 25 bp, Mus musculus
atttatgtgttcaaagtctctgtcc

SEQ ID NO: 287116 - DNA, 25 bp, Mus musculus
atttatgtgttcacttcttttgcag

SEQ ID NO: 287117 - DNA, 25 bp, Mus musculus
atttatgtgttctaagtctctgtcc

SEQ ID NO: 287118 - DNA, 25 bp, Mus musculus
atttatgtgttctcttcttttgcag

SEQ ID NO: 287119 - DNA, 25 bp, Mus musculus
atttatgttcagcattcgggcttta

SEQ ID NO: 287120 - DNA, 25 bp, Mus musculus
atttatgttcaggattcgggcttta

SEQ ID NO: 287121 - DNA, 25 bp, Mus musculus
atttatgttcccagcacagagcaaa

SEQ ID NO: 287122 - DNA, 25 bp, Mus musculus
atttatgttccctgcacagagcaaa

SEQ ID NO: 287123 - DNA, 25 bp, Mus musculus
atttatgttctacgcttcaggtttg

SEQ ID NO: 287124 - DNA, 25 bp, Mus musculus
atttatgttctaggcttcaggtttg

SEQ ID NO: 287125 - DNA, 25 bp, Mus musculus
atttatgtttccaggaacgccgctc

SEQ ID NO: 287126 - DNA, 25 bp, Mus musculus
atttatgtttcctggaacgccgctc

SEQ ID NO: 287127 - DNA, 25 bp, Mus musculus
atttattaagacatgatgcccctaa

SEQ ID NO: 287128 - DNA, 25 bp, Mus musculus
atttattaagacttgatgcccctaa

SEQ ID NO: 287129 - DNA, 25 bp, Mus musculus
atttattaatgcctgttcactgccc

SEQ ID NO: 287130 - DNA, 25 bp, Mus musculus
atttattaatgcgtgttcactgccc

SEQ ID NO: 287131 - DNA, 25 bp, Mus musculus
atttattaattccattgcccagatg

SEQ ID NO: 287132 - DNA, 25 bp, Mus musculus
atttattaattcgattgcccagatg

SEQ ID NO: 287133 - DNA, 25 bp, Mus musculus
atttattacctgcaggcctgttcca

SEQ ID NO: 287134 - DNA, 25 bp, Mus musculus
atttattacctggaggcctgttcca

SEQ ID NO: 287135 - DNA, 25 bp, Mus musculus
atttattaggtcaagtatctcacac

SEQ ID NO: 287136 - DNA, 25 bp, Mus musculus
atttattaggtctagtatctcacac

SEQ ID NO: 287137 - DNA, 25 bp, Mus musculus
atttattagtgtctgggctgtttta

SEQ ID NO: 287138 - DNA, 25 bp, Mus musculus
atttattagtgtgtgggctgtttta

SEQ ID NO: 287139 - DNA, 25 bp, Mus musculus
atttattcacccatatcaaactaat

SEQ ID NO: 287140 - DNA, 25 bp, Mus musculus
atttattcacccttatcaaactaat

SEQ ID NO: 287141 - DNA, 25 bp, Mus musculus
atttattcacttcctttatgtccca

SEQ ID NO: 287142 - DNA, 25 bp, Mus musculus
atttattcacttgctttatgtccca

SEQ ID NO: 287143 - DNA, 25 bp, Mus musculus
atttattcaggaagcccacaacttc

SEQ ID NO: 287144 - DNA, 25 bp, Mus musculus
atttattcaggatgcccacaacttc

SEQ ID NO: 287145 - DNA, 25 bp, Mus musculus
atttattcaggtctcttttggcaag

SEQ ID NO: 287146 - DNA, 25 bp, Mus musculus
atttattcaggtctgggtgcacccc

SEQ ID NO: 287147 - DNA, 25 bp, Mus musculus
atttattcaggtgtcttttggcaag

SEQ ID NO: 287148 - DNA, 25 bp, Mus musculus
atttattcaggtgtgggtgcacccc

SEQ ID NO: 287149 - DNA, 25 bp, Mus musculus
atttattcatggagcctgggcctca

SEQ ID NO: 287150 - DNA, 25 bp, Mus musculus
atttattcatggtgcctgggcctca

SEQ ID NO: 287151 - DNA, 25 bp, Mus musculus
atttattccagtctgctgcaggaga

SEQ ID NO: 287152 - DNA, 25 bp, Mus musculus
atttattccagtgtgctgcaggaga

SEQ ID NO: 287153 - DNA, 25 bp, Mus musculus
atttattcccctataggttgcagag

SEQ ID NO: 287154 - DNA, 25 bp, Mus musculus
atttattcccctttaggttgcagag

SEQ ID NO: 287155 - DNA, 25 bp, Mus musculus
atttattccctcagctttgaagcac

SEQ ID NO: 287156 - DNA, 25 bp, Mus musculus
atttattccctctgctttgaagcac

SEQ ID NO: 287157 - DNA, 25 bp, Mus musculus
atttattccctgaaagtctgtcaga

SEQ ID NO: 287158 - DNA, 25 bp, Mus musculus
atttattccctgtaagtctgtcaga

SEQ ID NO: 287159 - DNA, 25 bp, Mus musculus
atttattcccttattgcattgctga

SEQ ID NO: 287160 - DNA, 25 bp, Mus musculus
atttattccctttttgcattgctga

SEQ ID NO: 287161 - DNA, 25 bp, Mus musculus
atttattcctatctggtctgtctcc

SEQ ID NO: 287162 - DNA, 25 bp, Mus musculus
atttattcctatgtggtctgtctcc

SEQ ID NO: 287163 - DNA, 25 bp, Mus musculus
atttattcctgaccaaatctctagc

SEQ ID NO: 287164 - DNA, 25 bp, Mus musculus
atttattcctgagcaaatctctagc

SEQ ID NO: 287165 - DNA, 25 bp, Mus musculus
atttattccttcattatggcacatt

SEQ ID NO: 287166 - DNA, 25 bp, Mus musculus
atttattccttctttatggcacatt

SEQ ID NO: 287167 - DNA, 25 bp, Mus musculus
atttattcgtttacattcctcctca

SEQ ID NO: 287168 - DNA, 25 bp, Mus musculus
atttattcgttttcattcctcctca

SEQ ID NO: 287169 - DNA, 25 bp, Mus musculus
atttattctatgacaggccaagctg

SEQ ID NO: 287170 - DNA, 25 bp, Mus musculus
atttattctatgtcaggccaagctg

SEQ ID NO: 287171 - DNA, 25 bp, Mus musculus
atttattctcccaaaactcgttcat

SEQ ID NO: 287172 - DNA, 25 bp, Mus musculus
atttattctccctaaactcgttcat

SEQ ID NO: 287173 - DNA, 25 bp, Mus musculus
atttattctgccagcattcctacag

SEQ ID NO: 287174 - DNA, 25 bp, Mus musculus
atttattctgcctgcattcctacag

SEQ ID NO: 287175 - DNA, 25 bp, Mus musculus
atttattcttggcatcctcatggat

SEQ ID NO: 287176 - DNA, 25 bp, Mus musculus
atttattcttgggatcctcatggat

SEQ ID NO: 287177 - DNA, 25 bp, Mus musculus
atttattcttgtccactgaccactt

SEQ ID NO: 287178 - DNA, 25 bp, Mus musculus
atttattcttgtgcactgaccactt

SEQ ID NO: 287179 - DNA, 25 bp, Mus musculus
atttattgacacctgtgtgctatca

SEQ ID NO: 287180 - DNA, 25 bp, Mus musculus
atttattgacacgtgtgtgctatca

SEQ ID NO: 287181 - DNA, 25 bp, Mus musculus
atttattgagtgaccaggcagtcac

SEQ ID NO: 287182 - DNA, 25 bp, Mus musculus
atttattgagtgtccaggcagtcac

SEQ ID NO: 287183 - DNA, 25 bp, Mus musculus
atttattgatttccctatctctccc

SEQ ID NO: 287184 - DNA, 25 bp, Mus musculus
atttattgatttgcctatctctccc

SEQ ID NO: 287185 - DNA, 25 bp, Mus musculus
atttattgccacagcctattgtata

SEQ ID NO: 287186 - DNA, 25 bp, Mus musculus
atttattgccactgcctattgtata

SEQ ID NO: 287187 - DNA, 25 bp, Mus musculus
atttattgcctccatgcatgtgtgt

SEQ ID NO: 287188 - DNA, 25 bp, Mus musculus
atttattgcctcgatgcatgtgtgt

SEQ ID NO: 287189 - DNA, 25 bp, Mus musculus
atttattggaagaacttgtcacagg

SEQ ID NO: 287190 - DNA, 25 bp, Mus musculus
atttattggaagtacttgtcacagg

SEQ ID NO: 287191 - DNA, 25 bp, Mus musculus
atttattggattcccagcccctgcg

SEQ ID NO: 287192 - DNA, 25 bp, Mus musculus
atttattggattgccagcccctgcg

SEQ ID NO: 287193 - DNA, 25 bp, Mus musculus
atttattggctaaattgatacccat

SEQ ID NO: 287194 - DNA, 25 bp, Mus musculus
atttattggctatattgatacccat

SEQ ID NO: 287195 - DNA, 25 bp, Mus musculus
atttattgtacaaaccatgtgagcc

SEQ ID NO: 287196 - DNA, 25 bp, Mus musculus
atttattgtacataccatgtgagcc

SEQ ID NO: 287197 - DNA, 25 bp, Mus musculus
atttattgtggcactgattatgtac

SEQ ID NO: 287198 - DNA, 25 bp, Mus musculus
atttattgtggctctgattatgtac

SEQ ID NO: 287199 - DNA, 25 bp, Mus musculus
atttatttaaccagccattgtgtgt

SEQ ID NO: 287200 - DNA, 25 bp, Mus musculus
atttatttaacctgccattgtgtgt

SEQ ID NO: 287201 - DNA, 25 bp, Mus musculus
atttatttaatgaacctcaaggtgt

SEQ ID NO: 287202 - DNA, 25 bp, Mus musculus
atttatttaatgtacctcaaggtgt

SEQ ID NO: 287203 - DNA, 25 bp, Mus musculus
atttatttatctcttgtccctcttc

SEQ ID NO: 287204 - DNA, 25 bp, Mus musculus
atttatttatctgttgtccctcttc

SEQ ID NO: 287205 - DNA, 25 bp, Mus musculus
atttatttattgctagcctgcctgc

SEQ ID NO: 287206 - DNA, 25 bp, Mus musculus
atttatttattggtagcctgcctgc

SEQ ID NO: 287207 - DNA, 25 bp, Mus musculus
atttatttcacgcagcattcgcctc

SEQ ID NO: 287208 - DNA, 25 bp, Mus musculus
atttatttcacggagcattcgcctc

SEQ ID NO: 287209 - DNA, 25 bp, Mus musculus
atttatttcactcttgggctgtcac

SEQ ID NO: 287210 - DNA, 25 bp, Mus musculus
atttatttcactgttgggctgtcac

SEQ ID NO: 287211 - DNA, 25 bp, Mus musculus
atttatttcatcagcaggacctgat

SEQ ID NO: 287212 - DNA, 25 bp, Mus musculus
atttatttcatctgcaggacctgat

SEQ ID NO: 287213 - DNA, 25 bp, Mus musculus
atttatttctacattcatacttgga

SEQ ID NO: 287214 - DNA, 25 bp, Mus musculus
atttatttctaccagattgccaccc

SEQ ID NO: 287215 - DNA, 25 bp, Mus musculus
atttatttctacgagattgccaccc

SEQ ID NO: 287216 - DNA, 25 bp, Mus musculus
atttatttctactttcatacttgga

SEQ ID NO: 287217 - DNA, 25 bp, Mus musculus
atttatttctcacctggtcagtcag

SEQ ID NO: 287218 - DNA, 25 bp, Mus musculus
atttatttctcagctggtcagtcag

SEQ ID NO: 287219 - DNA, 25 bp, Mus musculus
atttatttgaacatatcagggtcag

SEQ ID NO: 287220 - DNA, 25 bp, Mus musculus
atttatttgaacttatcagggtcag

SEQ ID NO: 287221 - DNA, 25 bp, Mus musculus
atttatttgaccagccatcacctag

SEQ ID NO: 287222 - DNA, 25 bp, Mus musculus
atttatttgacctgccatcacctag

SEQ ID NO: 287223 - DNA, 25 bp, Mus musculus
atttatttgtagaaatggagcctgt

SEQ ID NO: 287224 - DNA, 25 bp, Mus musculus
atttatttgtagtaatggagcctgt

SEQ ID NO: 287225 - DNA, 25 bp, Mus musculus
atttattttcaacgccttctgggct

SEQ ID NO: 287226 - DNA, 25 bp, Mus musculus
atttattttcaaggccttctgggct

SEQ ID NO: 287227 - DNA, 25 bp, Mus musculus
atttattttccacgtcctgctgtag

SEQ ID NO: 287228 - DNA, 25 bp, Mus musculus
atttattttccacgtgcatcccctt

SEQ ID NO: 287229 - DNA, 25 bp, Mus musculus
atttattttccaggtcctgctgtag

SEQ ID NO: 287230 - DNA, 25 bp, Mus musculus
atttattttccaggtgcatcccctt

SEQ ID NO: 287231 - DNA, 25 bp, Mus musculus
atttattttctacacagccctttct

SEQ ID NO: 287232 - DNA, 25 bp, Mus musculus
atttattttctagacagccctttct

SEQ ID NO: 287233 - DNA, 25 bp, Mus musculus
atttattttgacaccacaggcctct

SEQ ID NO: 287234 - DNA, 25 bp, Mus musculus
atttattttgactccacaggcctct

SEQ ID NO: 287235 - DNA, 25 bp, Mus musculus
atttattttgccagttcgagacagg

SEQ ID NO: 287236 - DNA, 25 bp, Mus musculus
atttattttgccctagttgatcctg

SEQ ID NO: 287237 - DNA, 25 bp, Mus musculus
atttattttgccgtagttgatcctg

SEQ ID NO: 287238 - DNA, 25 bp, Mus musculus
atttattttgcctgttcgagacagg

SEQ ID NO: 287239 - DNA, 25 bp, Mus musculus
atttatttttacactcatgcaggtt

SEQ ID NO: 287240 - DNA, 25 bp, Mus musculus
atttatttttactctcatgcaggtt

SEQ ID NO: 287241 - DNA, 25 bp, Mus musculus
atttcaaacacactagtatactctg

SEQ ID NO: 287242 - DNA, 25 bp, Mus musculus
atttcaaacacagtagtatactctg

SEQ ID NO: 287243 - DNA, 25 bp, Mus musculus
atttcaaacctgaagccacacacag

SEQ ID NO: 287244 - DNA, 25 bp, Mus musculus
atttcaaacctgtagccacacacag

SEQ ID NO: 287245 - DNA, 25 bp, Mus musculus
atttcaaactgtctcaaggcgatgt

SEQ ID NO: 287246 - DNA, 25 bp, Mus musculus
atttcaaactgtgtcaaggcgatgt

SEQ ID NO: 287247 - DNA, 25 bp, Mus musculus
atttcaaacttgacagacgtgatct

SEQ ID NO: 287248 - DNA, 25 bp, Mus musculus
atttcaaacttgtcagacgtgatct

SEQ ID NO: 287249 - DNA, 25 bp, Mus musculus
atttcaaagaggctgctttcccacc

SEQ ID NO: 287250 - DNA, 25 bp, Mus musculus
atttcaaagagggtgctttcccacc

SEQ ID NO: 287251 - DNA, 25 bp, Mus musculus
atttcaaagcgtagccaggttccct

SEQ ID NO: 287252 - DNA, 25 bp, Mus musculus
atttcaaagcgttgccaggttccct

SEQ ID NO: 287253 - DNA, 25 bp, Mus musculus
atttcaaatatcattcaggctgcag

SEQ ID NO: 287254 - DNA, 25 bp, Mus musculus
atttcaaatatctttcaggctgcag

SEQ ID NO: 287255 - DNA, 25 bp, Mus musculus
atttcaaatctaagcatcccacctg

SEQ ID NO: 287256 - DNA, 25 bp, Mus musculus
atttcaaatctatgcatcccacctg

SEQ ID NO: 287257 - DNA, 25 bp, Mus musculus
atttcaaatgccactggatattcca

SEQ ID NO: 287258 - DNA, 25 bp, Mus musculus
atttcaaatgcctctggatattcca

SEQ ID NO: 287259 - DNA, 25 bp, Mus musculus
atttcaaatgttcttcccctccatg

SEQ ID NO: 287260 - DNA, 25 bp, Mus musculus
atttcaaatgttgttcccctccatg

SEQ ID NO: 287261 - DNA, 25 bp, Mus musculus
atttcaaattgacccacatgccttt

SEQ ID NO: 287262 - DNA, 25 bp, Mus musculus
atttcaaattgagccacatgccttt

SEQ ID NO: 287263 - DNA, 25 bp, Mus musculus
atttcaacaaacaggcacttgccgg

SEQ ID NO: 287264 - DNA, 25 bp, Mus musculus
atttcaacaaactggcacttgccgg

SEQ ID NO: 287265 - DNA, 25 bp, Mus musculus
atttcaacaaatactctgcaacctg

SEQ ID NO: 287266 - DNA, 25 bp, Mus musculus
atttcaacaaattctctgcaacctg

SEQ ID NO: 287267 - DNA, 25 bp, Mus musculus
atttcaacaatcaacccctgtcctc

SEQ ID NO: 287268 - DNA, 25 bp, Mus musculus
atttcaacaatctacccctgtcctc

SEQ ID NO: 287269 - DNA, 25 bp, Mus musculus
atttcaacagagaccagcttatcct

SEQ ID NO: 287270 - DNA, 25 bp, Mus musculus
atttcaacagagtccagcttatcct

SEQ ID NO: 287271 - DNA, 25 bp, Mus musculus
atttcaaccacgcagcctgttctgt

SEQ ID NO: 287272 - DNA, 25 bp, Mus musculus
atttcaaccacggagcctgttctgt

SEQ ID NO: 287273 - DNA, 25 bp, Mus musculus
atttcaaccagcacccatgaagcta

SEQ ID NO: 287274 - DNA, 25 bp, Mus musculus
atttcaaccagctcccatgaagcta

SEQ ID NO: 287275 - DNA, 25 bp, Mus musculus
atttcaacccatccattttaaagcg

SEQ ID NO: 287276 - DNA, 25 bp, Mus musculus
atttcaacccatgcattttaaagcg

SEQ ID NO: 287277 - DNA, 25 bp, Mus musculus
atttcaactcaaacatgattttaag

SEQ ID NO: 287278 - DNA, 25 bp, Mus musculus
atttcaactcaatcatgattttaag

SEQ ID NO: 287279 - DNA, 25 bp, Mus musculus
atttcaactgacaaatgtatatggt

SEQ ID NO: 287280 - DNA, 25 bp, Mus musculus
atttcaactgactaatgtatatggt

SEQ ID NO: 287281 - DNA, 25 bp, Mus musculus
atttcaacttctatgggtgtgtcct

SEQ ID NO: 287282 - DNA, 25 bp, Mus musculus
atttcaacttctttgggtgtgtcct

SEQ ID NO: 287283 - DNA, 25 bp, Mus musculus
atttcaagaaacctttgccagcccg

SEQ ID NO: 287284 - DNA, 25 bp, Mus musculus
atttcaagaaacgtttgccagcccg

SEQ ID NO: 287285 - DNA, 25 bp, Mus musculus
atttcaagacttaggctcagggtca

SEQ ID NO: 287286 - DNA, 25 bp, Mus musculus
atttcaagactttggctcagggtca

SEQ ID NO: 287287 - DNA, 25 bp, Mus musculus
atttcaagagaaagacactgtcagc

SEQ ID NO: 287288 - DNA, 25 bp, Mus musculus
atttcaagagaaccgtggagtttga

SEQ ID NO: 287289 - DNA, 25 bp, Mus musculus
atttcaagagaagcgtggagtttga

SEQ ID NO: 287290 - DNA, 25 bp, Mus musculus
atttcaagagaatgacactgtcagc

SEQ ID NO: 287291 - DNA, 25 bp, Mus musculus
atttcaagcactctcactgcgatgc

SEQ ID NO: 287292 - DNA, 25 bp, Mus musculus
atttcaagcactgtcactgcgatgc

SEQ ID NO: 287293 - DNA, 25 bp, Mus musculus
atttcaagccttcttgtctggtccc

SEQ ID NO: 287294 - DNA, 25 bp, Mus musculus
atttcaagccttgttgtctggtccc

SEQ ID NO: 287295 - DNA, 25 bp, Mus musculus
atttcaagctctcacctgcacatgt

SEQ ID NO: 287296 - DNA, 25 bp, Mus musculus
atttcaagctctgacctgcacatgt

SEQ ID NO: 287297 - DNA, 25 bp, Mus musculus
atttcaaggactcataaccctgctg

SEQ ID NO: 287298 - DNA, 25 bp, Mus musculus
atttcaaggactgataaccctgctg

SEQ ID NO: 287299 - DNA, 25 bp, Mus musculus
atttcaaggccacagtgaattccag

SEQ ID NO: 287300 - DNA, 25 bp, Mus musculus
atttcaaggccagagtgaattccag

SEQ ID NO: 287301 - DNA, 25 bp, Mus musculus
atttcaagtacaagtagtctcgata

SEQ ID NO: 287302 - DNA, 25 bp, Mus musculus
atttcaagtacatgtagtctcgata

SEQ ID NO: 287303 - DNA, 25 bp, Mus musculus
atttcaagtcagagctatgggatta

SEQ ID NO: 287304 - DNA, 25 bp, Mus musculus
atttcaagtcagtgctatgggatta

SEQ ID NO: 287305 - DNA, 25 bp, Mus musculus
atttcaagtctgaaataaccatagc

SEQ ID NO: 287306 - DNA, 25 bp, Mus musculus
atttcaagtctgtaataaccatagc

SEQ ID NO: 287307 - DNA, 25 bp, Mus musculus
atttcaagtgaacctgcctccagga

SEQ ID NO: 287308 - DNA, 25 bp, Mus musculus
atttcaagtgaagctgcctccagga

SEQ ID NO: 287309 - DNA, 25 bp, Mus musculus
atttcaagtggtcacccatgcccac

SEQ ID NO: 287310 - DNA, 25 bp, Mus musculus
atttcaagtggtgacccatgcccac

SEQ ID NO: 287311 - DNA, 25 bp, Mus musculus
atttcaagttctcacataccagtgt

SEQ ID NO: 287312 - DNA, 25 bp, Mus musculus
atttcaagttctgacataccagtgt

SEQ ID NO: 287313 - DNA, 25 bp, Mus musculus
atttcaatagcgatagactctaata

SEQ ID NO: 287314 - DNA, 25 bp, Mus musculus
atttcaatagcgttagactctaata

SEQ ID NO: 287315 - DNA, 25 bp, Mus musculus
atttcaatatcaacaacttcgtcag

SEQ ID NO: 287316 - DNA, 25 bp, Mus musculus
atttcaatatcatcaacttcgtcag

SEQ ID NO: 287317 - DNA, 25 bp, Mus musculus
atttcaatattacgccctgcttcat

SEQ ID NO: 287318 - DNA, 25 bp, Mus musculus
atttcaatattaggccctgcttcat

SEQ ID NO: 287319 - DNA, 25 bp, Mus musculus
atttcaatcagaactcgtggttggc

SEQ ID NO: 287320 - DNA, 25 bp, Mus musculus
atttcaatcagatctcgtggttggc

SEQ ID NO: 287321 - DNA, 25 bp, Mus musculus
atttcaatctgtagctttccctagc

SEQ ID NO: 287322 - DNA, 25 bp, Mus musculus
atttcaatctgttgctttccctagc

SEQ ID NO: 287323 - DNA, 25 bp, Mus musculus
atttcaatgatgagtccctggaatc

SEQ ID NO: 287324 - DNA, 25 bp, Mus musculus
atttcaatgatgtgtccctggaatc

SEQ ID NO: 287325 - DNA, 25 bp, Mus musculus
atttcaatggagaagatccagcctt

SEQ ID NO: 287326 - DNA, 25 bp, Mus musculus
atttcaatggagtagatccagcctt

SEQ ID NO: 287327 - DNA, 25 bp, Mus musculus
atttcaatgtccataccaggaatta

SEQ ID NO: 287328 - DNA, 25 bp, Mus musculus
atttcaatgtccttaccaggaatta

SEQ ID NO: 287329 - DNA, 25 bp, Mus musculus
atttcacaactcaagagctccacag

SEQ ID NO: 287330 - DNA, 25 bp, Mus musculus
atttcacaactctagagctccacag

SEQ ID NO: 287331 - DNA, 25 bp, Mus musculus
atttcacacatgctactaatgtcat

SEQ ID NO: 287332 - DNA, 25 bp, Mus musculus
atttcacacatggtactaatgtcat

SEQ ID NO: 287333 - DNA, 25 bp, Mus musculus
atttcacacctaagctcaggttggc

SEQ ID NO: 287334 - DNA, 25 bp, Mus musculus
atttcacacctatgctcaggttggc

SEQ ID NO: 287335 - DNA, 25 bp, Mus musculus
atttcacactatagcccgggctggt

SEQ ID NO: 287336 - DNA, 25 bp, Mus musculus
atttcacactattgcccgggctggt

SEQ ID NO: 287337 - DNA, 25 bp, Mus musculus
atttcacactccacaagagacctgg

SEQ ID NO: 287338 - DNA, 25 bp, Mus musculus
atttcacactcctcaagagacctgg

SEQ ID NO: 287339 - DNA, 25 bp, Mus musculus
atttcacagactcaagccagactca

SEQ ID NO: 287340 - DNA, 25 bp, Mus musculus
atttcacagactgaagccagactca

SEQ ID NO: 287341 - DNA, 25 bp, Mus musculus
atttcacagcggcataagcctcctt

SEQ ID NO: 287342 - DNA, 25 bp, Mus musculus
atttcacagcgggataagcctcctt

SEQ ID NO: 287343 - DNA, 25 bp, Mus musculus
atttcacagctcagggcttcgaggc

SEQ ID NO: 287344 - DNA, 25 bp, Mus musculus
atttcacagctctgggcttcgaggc

SEQ ID NO: 287345 - DNA, 25 bp, Mus musculus
atttcacaggaaagctcaagttttg

SEQ ID NO: 287346 - DNA, 25 bp, Mus musculus
atttcacaggaatgctcaagttttg

SEQ ID NO: 287347 - DNA, 25 bp, Mus musculus
atttcacaggatcgtgctgccagag

SEQ ID NO: 287348 - DNA, 25 bp, Mus musculus
atttcacaggatggtgctgccagag

SEQ ID NO: 287349 - DNA, 25 bp, Mus musculus
atttcacagggtagagatgcttgct

SEQ ID NO: 287350 - DNA, 25 bp, Mus musculus
atttcacagggttgagatgcttgct

SEQ ID NO: 287351 - DNA, 25 bp, Mus musculus
atttcacagtcccaagcccacgttt

SEQ ID NO: 287352 - DNA, 25 bp, Mus musculus
atttcacagtccgaagcccacgttt

SEQ ID NO: 287353 - DNA, 25 bp, Mus musculus
atttcacatatacaaggttctttgg

SEQ ID NO: 287354 - DNA, 25 bp, Mus musculus
atttcacatatagaaggttctttgg

SEQ ID NO: 287355 - DNA, 25 bp, Mus musculus
atttcacatgctacttgactttttt

SEQ ID NO: 287356 - DNA, 25 bp, Mus musculus
atttcacatgcttcttgactttttt

SEQ ID NO: 287357 - DNA, 25 bp, Mus musculus
atttcacatttcaaacgttctcctg

SEQ ID NO: 287358 - DNA, 25 bp, Mus musculus
atttcacatttctaacgttctcctg

SEQ ID NO: 287359 - DNA, 25 bp, Mus musculus
atttcacattttaaactatcagttt

SEQ ID NO: 287360 - DNA, 25 bp, Mus musculus
atttcacatttttaactatcagttt

SEQ ID NO: 287361 - DNA, 25 bp, Mus musculus
atttcaccatttccatgccagatcg

SEQ ID NO: 287362 - DNA, 25 bp, Mus musculus
atttcaccatttgcatgccagatcg

SEQ ID NO: 287363 - DNA, 25 bp, Mus musculus
atttcacccattaattcagccaatc

SEQ ID NO: 287364 - DNA, 25 bp, Mus musculus
atttcacccatttattcagccaatc

SEQ ID NO: 287365 - DNA, 25 bp, Mus musculus
atttcacccgtcagctttctggaaa

SEQ ID NO: 287366 - DNA, 25 bp, Mus musculus
atttcacccgtctgctttctggaaa

SEQ ID NO: 287367 - DNA, 25 bp, Mus musculus
atttcaccctcaagatttctagctg

SEQ ID NO: 287368 - DNA, 25 bp, Mus musculus
atttcaccctcatgatttctagctg

SEQ ID NO: 287369 - DNA, 25 bp, Mus musculus
atttcacccttcatcctgtagctac

SEQ ID NO: 287370 - DNA, 25 bp, Mus musculus
atttcacccttcttcctgtagctac

SEQ ID NO: 287371 - DNA, 25 bp, Mus musculus
atttcaccgcagactagctccgatt

SEQ ID NO: 287372 - DNA, 25 bp, Mus musculus
atttcaccgcagtctagctccgatt

SEQ ID NO: 287373 - DNA, 25 bp, Mus musculus
atttcacctaagagtcacccttcag

SEQ ID NO: 287374 - DNA, 25 bp, Mus musculus
atttcacctaagtgtcacccttcag

SEQ ID NO: 287375 - DNA, 25 bp, Mus musculus
atttcacctctaagtttaccccagt

SEQ ID NO: 287376 - DNA, 25 bp, Mus musculus
atttcacctctatgtttaccccagt

SEQ ID NO: 287377 - DNA, 25 bp, Mus musculus
atttcacctgccaattgacagctgc

SEQ ID NO: 287378 - DNA, 25 bp, Mus musculus
atttcacctgcctattgacagctgc

SEQ ID NO: 287379 - DNA, 25 bp, Mus musculus
atttcacctggaacagtgttaactg

SEQ ID NO: 287380 - DNA, 25 bp, Mus musculus
atttcacctggatcagtgttaactg

SEQ ID NO: 287381 - DNA, 25 bp, Mus musculus
atttcaccttatacctgtcagacta

SEQ ID NO: 287382 - DNA, 25 bp, Mus musculus
atttcaccttattcctgtcagacta

SEQ ID NO: 287383 - DNA, 25 bp, Mus musculus
atttcaccttgcaaagcctttccca

SEQ ID NO: 287384 - DNA, 25 bp, Mus musculus
atttcaccttgctaagcctttccca

SEQ ID NO: 287385 - DNA, 25 bp, Mus musculus
atttcaccttttatcacattcggag

SEQ ID NO: 287386 - DNA, 25 bp, Mus musculus
atttcaccttttttcacattcggag

SEQ ID NO: 287387 - DNA, 25 bp, Mus musculus
atttcacgtaccctggttgcccaga

SEQ ID NO: 287388 - DNA, 25 bp, Mus musculus
atttcacgtaccgtggttgcccaga

SEQ ID NO: 287389 - DNA, 25 bp, Mus musculus
atttcacgtatcagtgaccaatacg

SEQ ID NO: 287390 - DNA, 25 bp, Mus musculus
atttcacgtatctgtgaccaatacg

SEQ ID NO: 287391 - DNA, 25 bp, Mus musculus
atttcacgtgctattttgagactga

SEQ ID NO: 287392 - DNA, 25 bp, Mus musculus
atttcacgtgcttttttgagactga

SEQ ID NO: 287393 - DNA, 25 bp, Mus musculus
atttcactaacaacagacttctcat

SEQ ID NO: 287394 - DNA, 25 bp, Mus musculus
atttcactaacatcagacttctcat

SEQ ID NO: 287395 - DNA, 25 bp, Mus musculus
atttcactaactaggttccgttgcg

SEQ ID NO: 287396 - DNA, 25 bp, Mus musculus
atttcactaactcagcagtgtccct

SEQ ID NO: 287397 - DNA, 25 bp, Mus musculus
atttcactaactgagcagtgtccct

SEQ ID NO: 287398 - DNA, 25 bp, Mus musculus
atttcactaacttggttccgttgcg

SEQ ID NO: 287399 - DNA, 25 bp, Mus musculus
atttcactacttatgggatattggc

SEQ ID NO: 287400 - DNA, 25 bp, Mus musculus
atttcactacttttgggatattggc

SEQ ID NO: 287401 - DNA, 25 bp, Mus musculus
atttcactcacacatccgtagaaca

SEQ ID NO: 287402 - DNA, 25 bp, Mus musculus
atttcactcacagatccgtagaaca

SEQ ID NO: 287403 - DNA, 25 bp, Mus musculus
atttcactctccatggtgtcgggca

SEQ ID NO: 287404 - DNA, 25 bp, Mus musculus
atttcactctccttggtgtcgggca

SEQ ID NO: 287405 - DNA, 25 bp, Mus musculus
atttcactctgtatattagaaaaca

SEQ ID NO: 287406 - DNA, 25 bp, Mus musculus
atttcactctgtttattagaaaaca

SEQ ID NO: 287407 - DNA, 25 bp, Mus musculus
atttcactgattctgagtctccatg

SEQ ID NO: 287408 - DNA, 25 bp, Mus musculus
atttcactgattgtgagtctccatg

SEQ ID NO: 287409 - DNA, 25 bp, Mus musculus
atttcactggaaatggaccgtgttg

SEQ ID NO: 287410 - DNA, 25 bp, Mus musculus
atttcactggaattggaccgtgttg

SEQ ID NO: 287411 - DNA, 25 bp, Mus musculus
atttcactgtagatagaattctgga

SEQ ID NO: 287412 - DNA, 25 bp, Mus musculus
atttcactgtagctccttgtattta

SEQ ID NO: 287413 - DNA, 25 bp, Mus musculus
atttcactgtaggtccttgtattta

SEQ ID NO: 287414 - DNA, 25 bp, Mus musculus
atttcactgtagttagaattctgga

SEQ ID NO: 287415 - DNA, 25 bp, Mus musculus
atttcactgtccaatgccatccttt

SEQ ID NO: 287416 - DNA, 25 bp, Mus musculus
atttcactgtcctatgccatccttt

SEQ ID NO: 287417 - DNA, 25 bp, Mus musculus
atttcactgtgcactgcggatacac

SEQ ID NO: 287418 - DNA, 25 bp, Mus musculus
atttcactgtgctctgcggatacac

SEQ ID NO: 287419 - DNA, 25 bp, Mus musculus
atttcacttcttacggttaatacag

SEQ ID NO: 287420 - DNA, 25 bp, Mus musculus
atttcacttctttcggttaatacag

SEQ ID NO: 287421 - DNA, 25 bp, Mus musculus
atttcagaaaaaaccattgcacact

SEQ ID NO: 287422 - DNA, 25 bp, Mus musculus
atttcagaaaaatccattgcacact

SEQ ID NO: 287423 - DNA, 25 bp, Mus musculus
atttcagaacatctgttaatagcac

SEQ ID NO: 287424 - DNA, 25 bp, Mus musculus
atttcagaacatgtgttaatagcac

SEQ ID NO: 287425 - DNA, 25 bp, Mus musculus
atttcagaagcactagcagcacttt

SEQ ID NO: 287426 - DNA, 25 bp, Mus musculus
atttcagaagcagtagcagcacttt

SEQ ID NO: 287427 - DNA, 25 bp, Mus musculus
atttcagaagctaattgtcccacag

SEQ ID NO: 287428 - DNA, 25 bp, Mus musculus
atttcagaagcttattgtcccacag

SEQ ID NO: 287429 - DNA, 25 bp, Mus musculus
atttcagaagtgaatggtacccggg

SEQ ID NO: 287430 - DNA, 25 bp, Mus musculus
atttcagaagtgtatggtacccggg

SEQ ID NO: 287431 - DNA, 25 bp, Mus musculus
atttcagaatgtaaacgggtactca

SEQ ID NO: 287432 - DNA, 25 bp, Mus musculus
atttcagaatgtcggtcagcctcaa

SEQ ID NO: 287433 - DNA, 25 bp, Mus musculus
atttcagaatgtgggtcagcctcaa

SEQ ID NO: 287434 - DNA, 25 bp, Mus musculus
atttcagaatgttaacgggtactca

SEQ ID NO: 287435 - DNA, 25 bp, Mus musculus
atttcagacagcacagcctactagt

SEQ ID NO: 287436 - DNA, 25 bp, Mus musculus
atttcagacagctcagcctactagt

SEQ ID NO: 287437 - DNA, 25 bp, Mus musculus
atttcagaccaacaagtaaaccatg

SEQ ID NO: 287438 - DNA, 25 bp, Mus musculus
atttcagaccaagaagtaaaccatg

SEQ ID NO: 287439 - DNA, 25 bp, Mus musculus
atttcagaccacagcatttcttagt

SEQ ID NO: 287440 - DNA, 25 bp, Mus musculus
atttcagaccactgcatttcttagt

SEQ ID NO: 287441 - DNA, 25 bp, Mus musculus
atttcagaccatatacacggaccat

SEQ ID NO: 287442 - DNA, 25 bp, Mus musculus
atttcagaccatttacacggaccat

SEQ ID NO: 287443 - DNA, 25 bp, Mus musculus
atttcagagcacatggctcccggtg

SEQ ID NO: 287444 - DNA, 25 bp, Mus musculus
atttcagagcacttggctcccggtg

SEQ ID NO: 287445 - DNA, 25 bp, Mus musculus
atttcagagcccaacttctctgtgg

SEQ ID NO: 287446 - DNA, 25 bp, Mus musculus
atttcagagccctacttctctgtgg

SEQ ID NO: 287447 - DNA, 25 bp, Mus musculus
atttcagagctcaaacctactttca

SEQ ID NO: 287448 - DNA, 25 bp, Mus musculus
atttcagagctctaacctactttca

SEQ ID NO: 287449 - DNA, 25 bp, Mus musculus
atttcagagggacggtcctcttcat

SEQ ID NO: 287450 - DNA, 25 bp, Mus musculus
atttcagagggagggtcctcttcat

SEQ ID NO: 287451 - DNA, 25 bp, Mus musculus
atttcagagtcaccacgggctgtac

SEQ ID NO: 287452 - DNA, 25 bp, Mus musculus
atttcagagtcagcacgggctgtac

SEQ ID NO: 287453 - DNA, 25 bp, Mus musculus
atttcagatcacacctcagggattt

SEQ ID NO: 287454 - DNA, 25 bp, Mus musculus
atttcagatcactcctcagggattt

SEQ ID NO: 287455 - DNA, 25 bp, Mus musculus
atttcagatgttaacaacttgggat

SEQ ID NO: 287456 - DNA, 25 bp, Mus musculus
atttcagatgtttacaacttgggat

SEQ ID NO: 287457 - DNA, 25 bp, Mus musculus
atttcagattaacctttaaatgcta

SEQ ID NO: 287458 - DNA, 25 bp, Mus musculus
atttcagattaagctttaaatgcta

SEQ ID NO: 287459 - DNA, 25 bp, Mus musculus
atttcagatttcaccaccagctata

SEQ ID NO: 287460 - DNA, 25 bp, Mus musculus
atttcagatttctccaccagctata

SEQ ID NO: 287461 - DNA, 25 bp, Mus musculus
atttcagatttgatccggcccagag

SEQ ID NO: 287462 - DNA, 25 bp, Mus musculus
atttcagatttgttccggcccagag

SEQ ID NO: 287463 - DNA, 25 bp, Mus musculus
atttcagcaagcaggccacagacgt

SEQ ID NO: 287464 - DNA, 25 bp, Mus musculus
atttcagcaagctggccacagacgt

SEQ ID NO: 287465 - DNA, 25 bp, Mus musculus
atttcagcagcaaagttgcccagtg

SEQ ID NO: 287466 - DNA, 25 bp, Mus musculus
atttcagcagcacttggcattccag

SEQ ID NO: 287467 - DNA, 25 bp, Mus musculus
atttcagcagcagttggcattccag

SEQ ID NO: 287468 - DNA, 25 bp, Mus musculus
atttcagcagcatagttgcccagtg

SEQ ID NO: 287469 - DNA, 25 bp, Mus musculus
atttcagcaggtaggcacggtttcg

SEQ ID NO: 287470 - DNA, 25 bp, Mus musculus
atttcagcaggttggcacggtttcg

SEQ ID NO: 287471 - DNA, 25 bp, Mus musculus
atttcagcataacctctcacccaat

SEQ ID NO: 287472 - DNA, 25 bp, Mus musculus
atttcagcataagctctcacccaat

SEQ ID NO: 287473 - DNA, 25 bp, Mus musculus
atttcagccttgattatagtaagag

SEQ ID NO: 287474 - DNA, 25 bp, Mus musculus
atttcagccttgtttatagtaagag

SEQ ID NO: 287475 - DNA, 25 bp, Mus musculus
atttcagctaagaacatggccagtt

SEQ ID NO: 287476 - DNA, 25 bp, Mus musculus
atttcagctaagtacatggccagtt

SEQ ID NO: 287477 - DNA, 25 bp, Mus musculus
atttcagctaccaataatccacagt

SEQ ID NO: 287478 - DNA, 25 bp, Mus musculus
atttcagctacctataatccacagt

SEQ ID NO: 287479 - DNA, 25 bp, Mus musculus
atttcagctatgacgttaacgtcat

SEQ ID NO: 287480 - DNA, 25 bp, Mus musculus
atttcagctatgtcgttaacgtcat

SEQ ID NO: 287481 - DNA, 25 bp, Mus musculus
atttcagctattcctctcactaata

SEQ ID NO: 287482 - DNA, 25 bp, Mus musculus
atttcagctattgctctcactaata

SEQ ID NO: 287483 - DNA, 25 bp, Mus musculus
atttcagctcacaagagtgtgagaa

SEQ ID NO: 287484 - DNA, 25 bp, Mus musculus
atttcagctcactagagtgtgagaa

SEQ ID NO: 287485 - DNA, 25 bp, Mus musculus
atttcagctgcactggtattgacct

SEQ ID NO: 287486 - DNA, 25 bp, Mus musculus
atttcagctgcagtggtattgacct

SEQ ID NO: 287487 - DNA, 25 bp, Mus musculus
atttcagctgggagccaggcgactt

SEQ ID NO: 287488 - DNA, 25 bp, Mus musculus
atttcagctgggtgccaggcgactt

SEQ ID NO: 287489 - DNA, 25 bp, Mus musculus
atttcagcttatacaagttcattct

SEQ ID NO: 287490 - DNA, 25 bp, Mus musculus
atttcagcttattcaagttcattct

SEQ ID NO: 287491 - DNA, 25 bp, Mus musculus
atttcagcttgtactcaaatctagt

SEQ ID NO: 287492 - DNA, 25 bp, Mus musculus
atttcagcttgtacttattagtcat

SEQ ID NO: 287493 - DNA, 25 bp, Mus musculus
atttcagcttgttctcaaatctagt

SEQ ID NO: 287494 - DNA, 25 bp, Mus musculus
atttcagcttgttcttattagtcat

SEQ ID NO: 287495 - DNA, 25 bp, Mus musculus
atttcaggaaaactccatacaactg

SEQ ID NO: 287496 - DNA, 25 bp, Mus musculus
atttcaggaaaagtccatacaactg

SEQ ID NO: 287497 - DNA, 25 bp, Mus musculus
atttcaggaatcataacttgctcag

SEQ ID NO: 287498 - DNA, 25 bp, Mus musculus
atttcaggaatcttaacttgctcag

SEQ ID NO: 287499 - DNA, 25 bp, Mus musculus
atttcaggacaccttttgctttgct

SEQ ID NO: 287500 - DNA, 25 bp, Mus musculus
atttcaggacacgttttgctttgct

SEQ ID NO: 287501 - DNA, 25 bp, Mus musculus
atttcaggacagattttggattata

SEQ ID NO: 287502 - DNA, 25 bp, Mus musculus
atttcaggacagtttttggattata

SEQ ID NO: 287503 - DNA, 25 bp, Mus musculus
atttcaggaggaattctgttactga

SEQ ID NO: 287504 - DNA, 25 bp, Mus musculus
atttcaggaggatttctgttactga

SEQ ID NO: 287505 - DNA, 25 bp, Mus musculus
atttcaggaggtatttgcattcagt

SEQ ID NO: 287506 - DNA, 25 bp, Mus musculus
atttcaggaggtttttgcattcagt

SEQ ID NO: 287507 - DNA, 25 bp, Mus musculus
atttcaggagtactggtccacatct

SEQ ID NO: 287508 - DNA, 25 bp, Mus musculus
atttcaggagtagtggtccacatct

SEQ ID NO: 287509 - DNA, 25 bp, Mus musculus
atttcaggcaaacaaggctagttgt

SEQ ID NO: 287510 - DNA, 25 bp, Mus musculus
atttcaggcaaagaaggctagttgt

SEQ ID NO: 287511 - DNA, 25 bp, Mus musculus
atttcaggcactcttcaaagacttg

SEQ ID NO: 287512 - DNA, 25 bp, Mus musculus
atttcaggcactgttcaaagacttg

SEQ ID NO: 287513 - DNA, 25 bp, Mus musculus
atttcagggactatgctccaacaca

SEQ ID NO: 287514 - DNA, 25 bp, Mus musculus
atttcagggactttgctccaacaca

SEQ ID NO: 287515 - DNA, 25 bp, Mus musculus
atttcaggtaacaagcccccagagg

SEQ ID NO: 287516 - DNA, 25 bp, Mus musculus
atttcaggtaactagcccccagagg

SEQ ID NO: 287517 - DNA, 25 bp, Mus musculus
atttcaggtcgcaagattctcttgt

SEQ ID NO: 287518 - DNA, 25 bp, Mus musculus
atttcaggtcgctagattctcttgt

SEQ ID NO: 287519 - DNA, 25 bp, Mus musculus
atttcaggtctgacactcttgttac

SEQ ID NO: 287520 - DNA, 25 bp, Mus musculus
atttcaggtctgtcactcttgttac

SEQ ID NO: 287521 - DNA, 25 bp, Mus musculus
atttcaggtgagaatgtgcttcaat

SEQ ID NO: 287522 - DNA, 25 bp, Mus musculus
atttcaggtgagtatgtgcttcaat

SEQ ID NO: 287523 - DNA, 25 bp, Mus musculus
atttcaggtggaactaaagaccttg

SEQ ID NO: 287524 - DNA, 25 bp, Mus musculus
atttcaggtggatctaaagaccttg

SEQ ID NO: 287525 - DNA, 25 bp, Mus musculus
atttcagtacccctaatagcctatg

SEQ ID NO: 287526 - DNA, 25 bp, Mus musculus
atttcagtacccgtaatagcctatg

SEQ ID NO: 287527 - DNA, 25 bp, Mus musculus
atttcagtatttaccagccttatgt

SEQ ID NO: 287528 - DNA, 25 bp, Mus musculus
atttcagtattttccagccttatgt

SEQ ID NO: 287529 - DNA, 25 bp, Mus musculus
atttcagtcaagctaacagatcgct

SEQ ID NO: 287530 - DNA, 25 bp, Mus musculus
atttcagtcaaggtaacagatcgct

SEQ ID NO: 287531 - DNA, 25 bp, Mus musculus
atttcagtcagcatgttcctctgga

SEQ ID NO: 287532 - DNA, 25 bp, Mus musculus
atttcagtcagcttgttcctctgga

SEQ ID NO: 287533 - DNA, 25 bp, Mus musculus
atttcagtccctataggccagtcat

SEQ ID NO: 287534 - DNA, 25 bp, Mus musculus
atttcagtccctttaggccagtcat

SEQ ID NO: 287535 - DNA, 25 bp, Mus musculus
atttcagtctctacagctcatcctg

SEQ ID NO: 287536 - DNA, 25 bp, Mus musculus
atttcagtctcttcagctcatcctg

SEQ ID NO: 287537 - DNA, 25 bp, Mus musculus
atttcagtctttctcattcacttga

SEQ ID NO: 287538 - DNA, 25 bp, Mus musculus
atttcagtctttgtcattcacttga

SEQ ID NO: 287539 - DNA, 25 bp, Mus musculus
atttcagtgactacaatcgcaagct

SEQ ID NO: 287540 - DNA, 25 bp, Mus musculus
atttcagtgacttcaatcgcaagct

SEQ ID NO: 287541 - DNA, 25 bp, Mus musculus
atttcagtgatcagcaattcattgc

SEQ ID NO: 287542 - DNA, 25 bp, Mus musculus
atttcagtgatctgcaattcattgc

SEQ ID NO: 287543 - DNA, 25 bp, Mus musculus
atttcagtgcacaccttgagtcctg

SEQ ID NO: 287544 - DNA, 25 bp, Mus musculus
atttcagtgcactccttgagtcctg

SEQ ID NO: 287545 - DNA, 25 bp, Mus musculus
atttcagtgccaacctcacaagaag

SEQ ID NO: 287546 - DNA, 25 bp, Mus musculus
atttcagtgccatcctcacaagaag

SEQ ID NO: 287547 - DNA, 25 bp, Mus musculus
atttcagtgggcatgcttctttcta

SEQ ID NO: 287548 - DNA, 25 bp, Mus musculus
atttcagtgggcttgcttctttcta

SEQ ID NO: 287549 - DNA, 25 bp, Mus musculus
atttcagttaacaggctttctaagc

SEQ ID NO: 287550 - DNA, 25 bp, Mus musculus
atttcagttaactggctttctaagc

SEQ ID NO: 287551 - DNA, 25 bp, Mus musculus
atttcagttagaagtcagacatagg

SEQ ID NO: 287552 - DNA, 25 bp, Mus musculus
atttcagttagatgtcagacatagg

SEQ ID NO: 287553 - DNA, 25 bp, Mus musculus
atttcagttcagagggtgttgttta

SEQ ID NO: 287554 - DNA, 25 bp, Mus musculus
atttcagttcagtgggtgttgttta

SEQ ID NO: 287555 - DNA, 25 bp, Mus musculus
atttcagttccgctggttatggtgc

SEQ ID NO: 287556 - DNA, 25 bp, Mus musculus
atttcagttccggtggttatggtgc

SEQ ID NO: 287557 - DNA, 25 bp, Mus musculus
atttcataaagtacacctcatgggt

SEQ ID NO: 287558 - DNA, 25 bp, Mus musculus
atttcataaagttcacctcatgggt

SEQ ID NO: 287559 - DNA, 25 bp, Mus musculus
atttcataatagcatgtccctgtga

SEQ ID NO: 287560 - DNA, 25 bp, Mus musculus
atttcataataggatgtccctgtga

SEQ ID NO: 287561 - DNA, 25 bp, Mus musculus
atttcatacatcctttctttatccc

SEQ ID NO: 287562 - DNA, 25 bp, Mus musculus
atttcatacatcgtttctttatccc

SEQ ID NO: 287563 - DNA, 25 bp, Mus musculus
atttcataccaaagcgggttcttct

SEQ ID NO: 287564 - DNA, 25 bp, Mus musculus
atttcataccaatgcgggttcttct

SEQ ID NO: 287565 - DNA, 25 bp, Mus musculus
atttcataccatactttttccacta

SEQ ID NO: 287566 - DNA, 25 bp, Mus musculus
atttcataccattctttttccacta

SEQ ID NO: 287567 - DNA, 25 bp, Mus musculus
atttcatagctaatacctcagtcat

SEQ ID NO: 287568 - DNA, 25 bp, Mus musculus
atttcatagctattacctcagtcat

SEQ ID NO: 287569 - DNA, 25 bp, Mus musculus
atttcatatggcagcacgtgtctca

SEQ ID NO: 287570 - DNA, 25 bp, Mus musculus
atttcatatggctgcacgtgtctca

SEQ ID NO: 287571 - DNA, 25 bp, Mus musculus
atttcatcaaagactccatgggttg

SEQ ID NO: 287572 - DNA, 25 bp, Mus musculus
atttcatcaaagtctccatgggttg

SEQ ID NO: 287573 - DNA, 25 bp, Mus musculus
atttcatcaagtacctacattttag

SEQ ID NO: 287574 - DNA, 25 bp, Mus musculus
atttcatcaagttcctacattttag

SEQ ID NO: 287575 - DNA, 25 bp, Mus musculus
atttcatcagacataccagaggacc

SEQ ID NO: 287576 - DNA, 25 bp, Mus musculus
atttcatcagacttaccagaggacc

SEQ ID NO: 287577 - DNA, 25 bp, Mus musculus
atttcatcaggaatgagtgggcact

SEQ ID NO: 287578 - DNA, 25 bp, Mus musculus
atttcatcaggattgagtgggcact

SEQ ID NO: 287579 - DNA, 25 bp, Mus musculus
atttcatcataacgatcctcctcca

SEQ ID NO: 287580 - DNA, 25 bp, Mus musculus
atttcatcataaggatcctcctcca

SEQ ID NO: 287581 - DNA, 25 bp, Mus musculus
atttcatcatgtaaataatttccat

SEQ ID NO: 287582 - DNA, 25 bp, Mus musculus
atttcatcatgttaataatttccat

SEQ ID NO: 287583 - DNA, 25 bp, Mus musculus
atttcatcctatacgctcacttctt

SEQ ID NO: 287584 - DNA, 25 bp, Mus musculus
atttcatcctattcgctcacttctt

SEQ ID NO: 287585 - DNA, 25 bp, Mus musculus
atttcatcgcaacggcttttccaca

SEQ ID NO: 287586 - DNA, 25 bp, Mus musculus
atttcatcgcaagggcttttccaca

SEQ ID NO: 287587 - DNA, 25 bp, Mus musculus
atttcatcgccactaactacctcat

SEQ ID NO: 287588 - DNA, 25 bp, Mus musculus
atttcatcgccagtaactacctcat

SEQ ID NO: 287589 - DNA, 25 bp, Mus musculus
atttcatcggtgacctagcaaggca

SEQ ID NO: 287590 - DNA, 25 bp, Mus musculus
atttcatcggtgtcctagcaaggca

SEQ ID NO: 287591 - DNA, 25 bp, Mus musculus
atttcatctccactgcagatcatgt

SEQ ID NO: 287592 - DNA, 25 bp, Mus musculus
atttcatctccagtgcagatcatgt

SEQ ID NO: 287593 - DNA, 25 bp, Mus musculus
atttcatctcctagtggtcaacgaa

SEQ ID NO: 287594 - DNA, 25 bp, Mus musculus
atttcatctccttgtggtcaacgaa

SEQ ID NO: 287595 - DNA, 25 bp, Mus musculus
atttcatctctacttaaatagctca

SEQ ID NO: 287596 - DNA, 25 bp, Mus musculus
atttcatctctagttaaatagctca

SEQ ID NO: 287597 - DNA, 25 bp, Mus musculus
atttcatctctcactagtttagtaa

SEQ ID NO: 287598 - DNA, 25 bp, Mus musculus
atttcatctctctctagtttagtaa

SEQ ID NO: 287599 - DNA, 25 bp, Mus musculus
atttcatctctgatggaagggtgac

SEQ ID NO: 287600 - DNA, 25 bp, Mus musculus
atttcatctctgttggaagggtgac

SEQ ID NO: 287601 - DNA, 25 bp, Mus musculus
atttcatctcttcctacgggttcaa

SEQ ID NO: 287602 - DNA, 25 bp, Mus musculus
atttcatctcttgctacgggttcaa

SEQ ID NO: 287603 - DNA, 25 bp, Mus musculus
atttcatctgcacaaagtctgctta

SEQ ID NO: 287604 - DNA, 25 bp, Mus musculus
atttcatctgcagaaagtctgctta

SEQ ID NO: 287605 - DNA, 25 bp, Mus musculus
atttcatctgccagttgggtaattt

SEQ ID NO: 287606 - DNA, 25 bp, Mus musculus
atttcatctgcctgttgggtaattt

SEQ ID NO: 287607 - DNA, 25 bp, Mus musculus
atttcatctgtgatacacctttacc

SEQ ID NO: 287608 - DNA, 25 bp, Mus musculus
atttcatctgtgttacacctttacc

SEQ ID NO: 287609 - DNA, 25 bp, Mus musculus
atttcatcttacagtccattaaggg

SEQ ID NO: 287610 - DNA, 25 bp, Mus musculus
atttcatcttactgtccattaaggg

SEQ ID NO: 287611 - DNA, 25 bp, Mus musculus
atttcatctttcaacatcctttctt

SEQ ID NO: 287612 - DNA, 25 bp, Mus musculus
atttcatctttctacatcctttctt

SEQ ID NO: 287613 - DNA, 25 bp, Mus musculus
atttcatgagtaatgttttccaatg

SEQ ID NO: 287614 - DNA, 25 bp, Mus musculus
atttcatgagtattgttttccaatg

SEQ ID NO: 287615 - DNA, 25 bp, Mus musculus
atttcatgatacagtggttgcccaa

SEQ ID NO: 287616 - DNA, 25 bp, Mus musculus
atttcatgatactgtggttgcccaa

SEQ ID NO: 287617 - DNA, 25 bp, Mus musculus
atttcatgccctagagaggtcttga

SEQ ID NO: 287618 - DNA, 25 bp, Mus musculus
atttcatgcccttgagaggtcttga

SEQ ID NO: 287619 - DNA, 25 bp, Mus musculus
atttcatgcctcctttaatggcggc

SEQ ID NO: 287620 - DNA, 25 bp, Mus musculus
atttcatgcctcgtttaatggcggc

SEQ ID NO: 287621 - DNA, 25 bp, Mus musculus
atttcatgctggcacattcggtgga

SEQ ID NO: 287622 - DNA, 25 bp, Mus musculus
atttcatgctgggacattcggtgga

SEQ ID NO: 287623 - DNA, 25 bp, Mus musculus
atttcatgcttgcacactctacatg

SEQ ID NO: 287624 - DNA, 25 bp, Mus musculus
atttcatgcttggacactctacatg

SEQ ID NO: 287625 - DNA, 25 bp, Mus musculus
atttcatggccaacttgggctctaa

SEQ ID NO: 287626 - DNA, 25 bp, Mus musculus
atttcatggccatcttgggctctaa

SEQ ID NO: 287627 - DNA, 25 bp, Mus musculus
atttcatggccgacaagtccaatgg

SEQ ID NO: 287628 - DNA, 25 bp, Mus musculus
atttcatggccgtcaagtccaatgg

SEQ ID NO: 287629 - DNA, 25 bp, Mus musculus
atttcatgggaaagcggcagatccg

SEQ ID NO: 287630 - DNA, 25 bp, Mus musculus
atttcatgggaatgcggcagatccg

SEQ ID NO: 287631 - DNA, 25 bp, Mus musculus
atttcatggtctatccctggaggtg

SEQ ID NO: 287632 - DNA, 25 bp, Mus musculus
atttcatggtctttccctggaggtg

SEQ ID NO: 287633 - DNA, 25 bp, Mus musculus
atttcatgtgaccatcttgctgacc

SEQ ID NO: 287634 - DNA, 25 bp, Mus musculus
atttcatgtgacgatcttgctgacc

SEQ ID NO: 287635 - DNA, 25 bp, Mus musculus
atttcatgtggaacgcccatgccaa

SEQ ID NO: 287636 - DNA, 25 bp, Mus musculus
atttcatgtggatcgcccatgccaa

SEQ ID NO: 287637 - DNA, 25 bp, Mus musculus
atttcatgtgtgactcttcattcca

SEQ ID NO: 287638 - DNA, 25 bp, Mus musculus
atttcatgtgtgtctcttcattcca

SEQ ID NO: 287639 - DNA, 25 bp, Mus musculus
atttcattactcacagctttctcct

SEQ ID NO: 287640 - DNA, 25 bp, Mus musculus
atttcattactctcagctttctcct

SEQ ID NO: 287641 - DNA, 25 bp, Mus musculus
atttcattagtacaggtcagtttcc

SEQ ID NO: 287642 - DNA, 25 bp, Mus musculus
atttcattagtagaggtcagtttcc

SEQ ID NO: 287643 - DNA, 25 bp, Mus musculus
atttcattatttcccttgaattaga

SEQ ID NO: 287644 - DNA, 25 bp, Mus musculus
atttcattatttgccttgaattaga

SEQ ID NO: 287645 - DNA, 25 bp, Mus musculus
atttcattcattcctttcttgcaga

SEQ ID NO: 287646 - DNA, 25 bp, Mus musculus
atttcattcattgctttcttgcaga

SEQ ID NO: 287647 - DNA, 25 bp, Mus musculus
atttcattcccaacctaggcattga

SEQ ID NO: 287648 - DNA, 25 bp, Mus musculus
atttcattcccatcctaggcattga

SEQ ID NO: 287649 - DNA, 25 bp, Mus musculus
atttcattccctatcattcctattg

SEQ ID NO: 287650 - DNA, 25 bp, Mus musculus
atttcattccctttcattcctattg

SEQ ID NO: 287651 - DNA, 25 bp, Mus musculus
atttcattcctaccccaaatatact

SEQ ID NO: 287652 - DNA, 25 bp, Mus musculus
atttcattcctagcccaaatatact

SEQ ID NO: 287653 - DNA, 25 bp, Mus musculus
atttcattccttctgctatttacca

SEQ ID NO: 287654 - DNA, 25 bp, Mus musculus
atttcattccttgtgctatttacca

SEQ ID NO: 287655 - DNA, 25 bp, Mus musculus
atttcattcttgaaggcggcctctg

SEQ ID NO: 287656 - DNA, 25 bp, Mus musculus
atttcattcttgtaggcggcctctg

SEQ ID NO: 287657 - DNA, 25 bp, Mus musculus
atttcattgacacatttcggtccag

SEQ ID NO: 287658 - DNA, 25 bp, Mus musculus
atttcattgacagatttcggtccag

SEQ ID NO: 287659 - DNA, 25 bp, Mus musculus
atttcattgcccagaggccctcttt

SEQ ID NO: 287660 - DNA, 25 bp, Mus musculus
atttcattgccctgaggccctcttt

SEQ ID NO: 287661 - DNA, 25 bp, Mus musculus
atttcattgcctacatcttcatgtg

SEQ ID NO: 287662 - DNA, 25 bp, Mus musculus
atttcattgccttcatcttcatgtg

SEQ ID NO: 287663 - DNA, 25 bp, Mus musculus
atttcattgctgactctttattata

SEQ ID NO: 287664 - DNA, 25 bp, Mus musculus
atttcattgctgtctctttattata

SEQ ID NO: 287665 - DNA, 25 bp, Mus musculus
atttcattggaacaatttgccacat

SEQ ID NO: 287666 - DNA, 25 bp, Mus musculus
atttcattggaagaatttgccacat

SEQ ID NO: 287667 - DNA, 25 bp, Mus musculus
atttcattggtactatggcccgcgg

SEQ ID NO: 287668 - DNA, 25 bp, Mus musculus
atttcattggtagtatggcccgcgg

SEQ ID NO: 287669 - DNA, 25 bp, Mus musculus
atttcattggttcgctggtgctcat

SEQ ID NO: 287670 - DNA, 25 bp, Mus musculus
atttcattggttggctggtgctcat

SEQ ID NO: 287671 - DNA, 25 bp, Mus musculus
atttcattgtccagttgaagcccct

SEQ ID NO: 287672 - DNA, 25 bp, Mus musculus
atttcattgtcctgttgaagcccct

SEQ ID NO: 287673 - DNA, 25 bp, Mus musculus
atttcattgttcaggccctaagcat

SEQ ID NO: 287674 - DNA, 25 bp, Mus musculus
atttcattgttctggccctaagcat

SEQ ID NO: 287675 - DNA, 25 bp, Mus musculus
atttcatttactacttgtcacattg

SEQ ID NO: 287676 - DNA, 25 bp, Mus musculus
atttcatttacttcttgtcacattg

SEQ ID NO: 287677 - DNA, 25 bp, Mus musculus
atttcatttcatcctcacaacaacc

SEQ ID NO: 287678 - DNA, 25 bp, Mus musculus
atttcatttcatgctcacaacaacc

SEQ ID NO: 287679 - DNA, 25 bp, Mus musculus
atttcatttcgactcttgacttctg

SEQ ID NO: 287680 - DNA, 25 bp, Mus musculus
atttcatttcgagtcttgacttctg

SEQ ID NO: 287681 - DNA, 25 bp, Mus musculus
atttcatttctacactggtggtgga

SEQ ID NO: 287682 - DNA, 25 bp, Mus musculus
atttcatttctagactggtggtgga

SEQ ID NO: 287683 - DNA, 25 bp, Mus musculus
atttcattttctcggacactcggtg

SEQ ID NO: 287684 - DNA, 25 bp, Mus musculus
atttcattttctgggacactcggtg

SEQ ID NO: 287685 - DNA, 25 bp, Mus musculus
atttcattttgtaatgtaccccaga

SEQ ID NO: 287686 - DNA, 25 bp, Mus musculus
atttcattttgttatgtaccccaga

SEQ ID NO: 287687 - DNA, 25 bp, Mus musculus
atttccaaacccagtgcatctgaat

SEQ ID NO: 287688 - DNA, 25 bp, Mus musculus
atttccaaaccctgtgcatctgaat

SEQ ID NO: 287689 - DNA, 25 bp, Mus musculus
atttccaaagaaccaatcctccagg

SEQ ID NO: 287690 - DNA, 25 bp, Mus musculus
atttccaaagaagcaatcctccagg

SEQ ID NO: 287691 - DNA, 25 bp, Mus musculus
atttccaaagcaaggtctgaggcct

SEQ ID NO: 287692 - DNA, 25 bp, Mus musculus
atttccaaagcatggtctgaggcct

SEQ ID NO: 287693 - DNA, 25 bp, Mus musculus
atttccaacaacatgactgtcagtg

SEQ ID NO: 287694 - DNA, 25 bp, Mus musculus
atttccaacaacttgactgtcagtg

SEQ ID NO: 287695 - DNA, 25 bp, Mus musculus
atttccaacccacacgggctgtgtt

SEQ ID NO: 287696 - DNA, 25 bp, Mus musculus
atttccaacccagacgggctgtgtt

SEQ ID NO: 287697 - DNA, 25 bp, Mus musculus
atttccaaccttcgagcatctcatg

SEQ ID NO: 287698 - DNA, 25 bp, Mus musculus
atttccaaccttggagcatctcatg

SEQ ID NO: 287699 - DNA, 25 bp, Mus musculus
atttccaagaagactactgccagag

SEQ ID NO: 287700 - DNA, 25 bp, Mus musculus
atttccaagaagtctactgccagag

SEQ ID NO: 287701 - DNA, 25 bp, Mus musculus
atttccaagacaacttaggctttct

SEQ ID NO: 287702 - DNA, 25 bp, Mus musculus
atttccaagacatcttaggctttct

SEQ ID NO: 287703 - DNA, 25 bp, Mus musculus
atttccaagcctacacttctattct

SEQ ID NO: 287704 - DNA, 25 bp, Mus musculus
atttccaagccttcacttctattct

SEQ ID NO: 287705 - DNA, 25 bp, Mus musculus
atttccaagctcagcggacatttgt

SEQ ID NO: 287706 - DNA, 25 bp, Mus musculus
atttccaagctctgcggacatttgt

SEQ ID NO: 287707 - DNA, 25 bp, Mus musculus
atttccaagctgagtgggccttttc

SEQ ID NO: 287708 - DNA, 25 bp, Mus musculus
atttccaagctgtgtgggccttttc

SEQ ID NO: 287709 - DNA, 25 bp, Mus musculus
atttccaaggcaacttttctgacca

SEQ ID NO: 287710 - DNA, 25 bp, Mus musculus
atttccaaggcatcttttctgacca

SEQ ID NO: 287711 - DNA, 25 bp, Mus musculus
atttccaatcttaatagacctgaga

SEQ ID NO: 287712 - DNA, 25 bp, Mus musculus
atttccaatctttatagacctgaga

SEQ ID NO: 287713 - DNA, 25 bp, Mus musculus
atttccaatgagaacaaggaactga

SEQ ID NO: 287714 - DNA, 25 bp, Mus musculus
atttccaatgagtacaaggaactga

SEQ ID NO: 287715 - DNA, 25 bp, Mus musculus
atttccaatttcatgttcatgtaag

SEQ ID NO: 287716 - DNA, 25 bp, Mus musculus
atttccaatttcttgttcatgtaag

SEQ ID NO: 287717 - DNA, 25 bp, Mus musculus
atttccacaagaaacttctgggatt

SEQ ID NO: 287718 - DNA, 25 bp, Mus musculus
atttccacaagatacttctgggatt

SEQ ID NO: 287719 - DNA, 25 bp, Mus musculus
atttccacacataggactgtccatg

SEQ ID NO: 287720 - DNA, 25 bp, Mus musculus
atttccacacattggactgtccatg

SEQ ID NO: 287721 - DNA, 25 bp, Mus musculus
atttccacactaatctgagctacat

SEQ ID NO: 287722 - DNA, 25 bp, Mus musculus
atttccacactattctgagctacat

SEQ ID NO: 287723 - DNA, 25 bp, Mus musculus
atttccacactcatttcttctgaat

SEQ ID NO: 287724 - DNA, 25 bp, Mus musculus
atttccacactcttttcttctgaat

SEQ ID NO: 287725 - DNA, 25 bp, Mus musculus
atttccaccaggcacaaatctagga

SEQ ID NO: 287726 - DNA, 25 bp, Mus musculus
atttccaccagggacaaatctagga

SEQ ID NO: 287727 - DNA, 25 bp, Mus musculus
atttccacccaacgatgcatgcagt

SEQ ID NO: 287728 - DNA, 25 bp, Mus musculus
atttccacccaaggatgcatgcagt

SEQ ID NO: 287729 - DNA, 25 bp, Mus musculus
atttccacctcaaatcttatttgtt

SEQ ID NO: 287730 - DNA, 25 bp, Mus musculus
atttccacctcatatcttatttgtt

SEQ ID NO: 287731 - DNA, 25 bp, Mus musculus
atttccactaaactgtgacccacag

SEQ ID NO: 287732 - DNA, 25 bp, Mus musculus
atttccactaaagtgtgacccacag

SEQ ID NO: 287733 - DNA, 25 bp, Mus musculus
atttccactagcaacttttccagct

SEQ ID NO: 287734 - DNA, 25 bp, Mus musculus
atttccactagctacttttccagct

SEQ ID NO: 287735 - DNA, 25 bp, Mus musculus
atttccactcctccttttcaggata

SEQ ID NO: 287736 - DNA, 25 bp, Mus musculus
atttccactcctgcttttcaggata

SEQ ID NO: 287737 - DNA, 25 bp, Mus musculus
atttccactgaaacctcatgccaag

SEQ ID NO: 287738 - DNA, 25 bp, Mus musculus
atttccactgaatcctcatgccaag

SEQ ID NO: 287739 - DNA, 25 bp, Mus musculus
atttccactggaagctacagcccct

SEQ ID NO: 287740 - DNA, 25 bp, Mus musculus
atttccactggatgctacagcccct

SEQ ID NO: 287741 - DNA, 25 bp, Mus musculus
atttccactgtgctttttacctgtt

SEQ ID NO: 287742 - DNA, 25 bp, Mus musculus
atttccactgtggtttttacctgtt

SEQ ID NO: 287743 - DNA, 25 bp, Mus musculus
atttccacttcaaagggcggtcaga

SEQ ID NO: 287744 - DNA, 25 bp, Mus musculus
atttccacttcatagggcggtcaga

SEQ ID NO: 287745 - DNA, 25 bp, Mus musculus
atttccacttggaaagccctgttag

SEQ ID NO: 287746 - DNA, 25 bp, Mus musculus
atttccacttggtaagccctgttag

SEQ ID NO: 287747 - DNA, 25 bp, Mus musculus
atttccagaaagatatattccatca

SEQ ID NO: 287748 - DNA, 25 bp, Mus musculus
atttccagaaagttatattccatca

SEQ ID NO: 287749 - DNA, 25 bp, Mus musculus
atttccagaaccctcactctagtgg

SEQ ID NO: 287750 - DNA, 25 bp, Mus musculus
atttccagaaccgtcactctagtgg

SEQ ID NO: 287751 - DNA, 25 bp, Mus musculus
atttccagaagtcacctgcgcacct

SEQ ID NO: 287752 - DNA, 25 bp, Mus musculus
atttccagaagtgacctgcgcacct

SEQ ID NO: 287753 - DNA, 25 bp, Mus musculus
atttccagaatgagggcaccccagt

SEQ ID NO: 287754 - DNA, 25 bp, Mus musculus
atttccagaatgtgggcaccccagt

SEQ ID NO: 287755 - DNA, 25 bp, Mus musculus
atttccagaccacttttctcatttt

SEQ ID NO: 287756 - DNA, 25 bp, Mus musculus
atttccagaccagttttctcatttt

SEQ ID NO: 287757 - DNA, 25 bp, Mus musculus
atttccagattccacagaggcatcc

SEQ ID NO: 287758 - DNA, 25 bp, Mus musculus
atttccagattcgacagaggcatcc

SEQ ID NO: 287759 - DNA, 25 bp, Mus musculus
atttccagcacactgattccttgct

SEQ ID NO: 287760 - DNA, 25 bp, Mus musculus
atttccagcacagtgattccttgct

SEQ ID NO: 287761 - DNA, 25 bp, Mus musculus
atttccagcattccagaagtagaag

SEQ ID NO: 287762 - DNA, 25 bp, Mus musculus
atttccagcattgcagaagtagaag

SEQ ID NO: 287763 - DNA, 25 bp, Mus musculus
atttccagccgtcagccataagatg

SEQ ID NO: 287764 - DNA, 25 bp, Mus musculus
atttccagccgtgagccataagatg

SEQ ID NO: 287765 - DNA, 25 bp, Mus musculus
atttccagcggactcatcgtggcca

SEQ ID NO: 287766 - DNA, 25 bp, Mus musculus
atttccagcggagtcatcgtggcca

SEQ ID NO: 287767 - DNA, 25 bp, Mus musculus
atttccagctctagagtcaggctca

SEQ ID NO: 287768 - DNA, 25 bp, Mus musculus
atttccagctcttgagtcaggctca

SEQ ID NO: 287769 - DNA, 25 bp, Mus musculus
atttccaggaacaccaaacttccag

SEQ ID NO: 287770 - DNA, 25 bp, Mus musculus
atttccaggaactccaaacttccag

SEQ ID NO: 287771 - DNA, 25 bp, Mus musculus
atttccagtaacatcaccttcatgc

SEQ ID NO: 287772 - DNA, 25 bp, Mus musculus
atttccagtaacttcaccttcatgc

SEQ ID NO: 287773 - DNA, 25 bp, Mus musculus
atttccagtcttctgttggcgttca

SEQ ID NO: 287774 - DNA, 25 bp, Mus musculus
atttccagtcttgtgttggcgttca

SEQ ID NO: 287775 - DNA, 25 bp, Mus musculus
atttccagtgatccttctgtaagaa

SEQ ID NO: 287776 - DNA, 25 bp, Mus musculus
atttccagtgatgcttctgtaagaa

SEQ ID NO: 287777 - DNA, 25 bp, Mus musculus
atttccataacccaggagtggctcc

SEQ ID NO: 287778 - DNA, 25 bp, Mus musculus
atttccataaccgaggagtggctcc

SEQ ID NO: 287779 - DNA, 25 bp, Mus musculus
atttccataagcagaagtgccctgg

SEQ ID NO: 287780 - DNA, 25 bp, Mus musculus
atttccataagctgaagtgccctgg

SEQ ID NO: 287781 - DNA, 25 bp, Mus musculus
atttccataagtcacggtgtgttat

SEQ ID NO: 287782 - DNA, 25 bp, Mus musculus
atttccataagtgacggtgtgttat

SEQ ID NO: 287783 - DNA, 25 bp, Mus musculus
atttccatagaacacgcctgcggct

SEQ ID NO: 287784 - DNA, 25 bp, Mus musculus
atttccatagaagacgcctgcggct

SEQ ID NO: 287785 - DNA, 25 bp, Mus musculus
atttccatagttccacagcataagt

SEQ ID NO: 287786 - DNA, 25 bp, Mus musculus
atttccatagttgcacagcataagt

SEQ ID NO: 287787 - DNA, 25 bp, Mus musculus
atttccatatacagctgcctggagg

SEQ ID NO: 287788 - DNA, 25 bp, Mus musculus
atttccatatactgctgcctggagg

SEQ ID NO: 287789 - DNA, 25 bp, Mus musculus
atttccatcaacataaatcactctt

SEQ ID NO: 287790 - DNA, 25 bp, Mus musculus
atttccatcaacttaaatcactctt

SEQ ID NO: 287791 - DNA, 25 bp, Mus musculus
atttccatcactccaaggttccttt

SEQ ID NO: 287792 - DNA, 25 bp, Mus musculus
atttccatcactgcaaggttccttt

SEQ ID NO: 287793 - DNA, 25 bp, Mus musculus
atttccatcaggcttttaaactcag

SEQ ID NO: 287794 - DNA, 25 bp, Mus musculus
atttccatcagggttttaaactcag

SEQ ID NO: 287795 - DNA, 25 bp, Mus musculus
atttccatcccaactgctggtctga

SEQ ID NO: 287796 - DNA, 25 bp, Mus musculus
atttccatcccatctgctggtctga

SEQ ID NO: 287797 - DNA, 25 bp, Mus musculus
atttccatctcactgaagctagcac

SEQ ID NO: 287798 - DNA, 25 bp, Mus musculus
atttccatctcagtgaagctagcac

SEQ ID NO: 287799 - DNA, 25 bp, Mus musculus
atttccatgccacatcggtcggtcg

SEQ ID NO: 287800 - DNA, 25 bp, Mus musculus
atttccatgccagatcggtcggtcg

SEQ ID NO: 287801 - DNA, 25 bp, Mus musculus
atttccatgcctaggctccacgttg

SEQ ID NO: 287802 - DNA, 25 bp, Mus musculus
atttccatgccttggctccacgttg

SEQ ID NO: 287803 - DNA, 25 bp, Mus musculus
atttccatgctacacggttctttgc

SEQ ID NO: 287804 - DNA, 25 bp, Mus musculus
atttccatgctagacggttctttgc

SEQ ID NO: 287805 - DNA, 25 bp, Mus musculus
atttccatgcttcggtgagtggcct

SEQ ID NO: 287806 - DNA, 25 bp, Mus musculus
atttccatgcttgggtgagtggcct

SEQ ID NO: 287807 - DNA, 25 bp, Mus musculus
atttccatggagacaacaccctatt

SEQ ID NO: 287808 - DNA, 25 bp, Mus musculus
atttccatggagtcaacaccctatt

SEQ ID NO: 287809 - DNA, 25 bp, Mus musculus
atttccatggtgctgggcctcatag

SEQ ID NO: 287810 - DNA, 25 bp, Mus musculus
atttccatggtggtgggcctcatag

SEQ ID NO: 287811 - DNA, 25 bp, Mus musculus
atttccatgtgaaccattcttgcct

SEQ ID NO: 287812 - DNA, 25 bp, Mus musculus
atttccatgtgatccattcttgcct

SEQ ID NO: 287813 - DNA, 25 bp, Mus musculus
atttccatgtggaagccctgttgct

SEQ ID NO: 287814 - DNA, 25 bp, Mus musculus
atttccatgtggtagccctgttgct

SEQ ID NO: 287815 - DNA, 25 bp, Mus musculus
atttccatgttacaaccactgtgtt

SEQ ID NO: 287816 - DNA, 25 bp, Mus musculus
atttccatgttagaaccactgtgtt

SEQ ID NO: 287817 - DNA, 25 bp, Mus musculus
atttccatgtttcttcagctattga

SEQ ID NO: 287818 - DNA, 25 bp, Mus musculus
atttccatgtttgttcagctattga

SEQ ID NO: 287819 - DNA, 25 bp, Mus musculus
atttccattagaaaaatgcaaggag

SEQ ID NO: 287820 - DNA, 25 bp, Mus musculus
atttccattagaatctccactgctt

SEQ ID NO: 287821 - DNA, 25 bp, Mus musculus
atttccattagataaatgcaaggag

SEQ ID NO: 287822 - DNA, 25 bp, Mus musculus
atttccattagattctccactgctt

SEQ ID NO: 287823 - DNA, 25 bp, Mus musculus
atttccattcttactcatggccagt

SEQ ID NO: 287824 - DNA, 25 bp, Mus musculus
atttccattctttctcatggccagt

SEQ ID NO: 287825 - DNA, 25 bp, Mus musculus
atttccattgatcctaggttcttac

SEQ ID NO: 287826 - DNA, 25 bp, Mus musculus
atttccattgatgctaggttcttac

SEQ ID NO: 287827 - DNA, 25 bp, Mus musculus
atttccattggaattgaacattgaa

SEQ ID NO: 287828 - DNA, 25 bp, Mus musculus
atttccattggatttgaacattgaa

SEQ ID NO: 287829 - DNA, 25 bp, Mus musculus
atttccatttatatgatggcctcca

SEQ ID NO: 287830 - DNA, 25 bp, Mus musculus
atttccatttatttgatggcctcca

SEQ ID NO: 287831 - DNA, 25 bp, Mus musculus
atttccatttctaagcagctgggtg

SEQ ID NO: 287832 - DNA, 25 bp, Mus musculus
atttccatttctctcactgatctac

SEQ ID NO: 287833 - DNA, 25 bp, Mus musculus
atttccatttctgtcactgatctac

SEQ ID NO: 287834 - DNA, 25 bp, Mus musculus
atttccatttcttagcagctgggtg

SEQ ID NO: 287835 - DNA, 25 bp, Mus musculus
atttccatttggagcgatctgcagc

SEQ ID NO: 287836 - DNA, 25 bp, Mus musculus
atttccatttggtgcgatctgcagc

SEQ ID NO: 287837 - DNA, 25 bp, Mus musculus
atttccattttaaccctgacatagt

SEQ ID NO: 287838 - DNA, 25 bp, Mus musculus
atttccattttatccctgacatagt

SEQ ID NO: 287839 - DNA, 25 bp, Mus musculus
atttcccaacacatcacgactgagg

SEQ ID NO: 287840 - DNA, 25 bp, Mus musculus
atttcccaacacttcacgactgagg

SEQ ID NO: 287841 - DNA, 25 bp, Mus musculus
atttcccaacttaaagaagcagctt

SEQ ID NO: 287842 - DNA, 25 bp, Mus musculus
atttcccaactttaagaagcagctt

SEQ ID NO: 287843 - DNA, 25 bp, Mus musculus
atttcccaagcccactggcattttt

SEQ ID NO: 287844 - DNA, 25 bp, Mus musculus
atttcccaagccgactggcattttt

SEQ ID NO: 287845 - DNA, 25 bp, Mus musculus
atttcccaatgaccaaatggtctga

SEQ ID NO: 287846 - DNA, 25 bp, Mus musculus
atttcccaatgagcaaatggtctga

SEQ ID NO: 287847 - DNA, 25 bp, Mus musculus
atttcccacaaaaacgtcactgcta

SEQ ID NO: 287848 - DNA, 25 bp, Mus musculus
atttcccacaaatacgtcactgcta

SEQ ID NO: 287849 - DNA, 25 bp, Mus musculus
atttcccacatgaatatctagcata

SEQ ID NO: 287850 - DNA, 25 bp, Mus musculus
atttcccacatgtatatctagcata

SEQ ID NO: 287851 - DNA, 25 bp, Mus musculus
atttcccaccctctttataatctgc

SEQ ID NO: 287852 - DNA, 25 bp, Mus musculus
atttcccaccctgtttataatctgc

SEQ ID NO: 287853 - DNA, 25 bp, Mus musculus
atttcccacgagagctgatgaccag

SEQ ID NO: 287854 - DNA, 25 bp, Mus musculus
atttcccacgagtgctgatgaccag

SEQ ID NO: 287855 - DNA, 25 bp, Mus musculus
atttcccacgctagaagaccatgag

SEQ ID NO: 287856 - DNA, 25 bp, Mus musculus
atttcccacgcttgaagaccatgag

SEQ ID NO: 287857 - DNA, 25 bp, Mus musculus
atttcccactgtccatttcgctttc

SEQ ID NO: 287858 - DNA, 25 bp, Mus musculus
atttcccactgtgcatttcgctttc

SEQ ID NO: 287859 - DNA, 25 bp, Mus musculus
atttcccacttcctttgaggtctct

SEQ ID NO: 287860 - DNA, 25 bp, Mus musculus
atttcccacttcgtttgaggtctct

SEQ ID NO: 287861 - DNA, 25 bp, Mus musculus
atttcccagaatacccagcacgaag

SEQ ID NO: 287862 - DNA, 25 bp, Mus musculus
atttcccagaattcccagcacgaag

SEQ ID NO: 287863 - DNA, 25 bp, Mus musculus
atttcccagacaagcaacctggata

SEQ ID NO: 287864 - DNA, 25 bp, Mus musculus
atttcccagacatgcaacctggata

SEQ ID NO: 287865 - DNA, 25 bp, Mus musculus
atttcccagataccgccagtgactg

SEQ ID NO: 287866 - DNA, 25 bp, Mus musculus
atttcccagatagcgccagtgactg

SEQ ID NO: 287867 - DNA, 25 bp, Mus musculus
atttcccaggagaatcccacattca

SEQ ID NO: 287868 - DNA, 25 bp, Mus musculus
atttcccaggagctaaattcatttg

SEQ ID NO: 287869 - DNA, 25 bp, Mus musculus
atttcccaggagctgaaccacaact

SEQ ID NO: 287870 - DNA, 25 bp, Mus musculus
atttcccaggaggtaaattcatttg

SEQ ID NO: 287871 - DNA, 25 bp, Mus musculus
atttcccaggaggtgaaccacaact

SEQ ID NO: 287872 - DNA, 25 bp, Mus musculus
atttcccaggagtatcccacattca

SEQ ID NO: 287873 - DNA, 25 bp, Mus musculus
atttcccagggacaatcaggcttag

SEQ ID NO: 287874 - DNA, 25 bp, Mus musculus
atttcccagggagaatcaggcttag

SEQ ID NO: 287875 - DNA, 25 bp, Mus musculus
atttcccaggtgagcatccctgagt

SEQ ID NO: 287876 - DNA, 25 bp, Mus musculus
atttcccaggtgtgcatccctgagt

SEQ ID NO: 287877 - DNA, 25 bp, Mus musculus
atttcccatccaagtatctgcagaa

SEQ ID NO: 287878 - DNA, 25 bp, Mus musculus
atttcccatccatgtatctgcagaa

SEQ ID NO: 287879 - DNA, 25 bp, Mus musculus
atttcccatctcaataacctatata

SEQ ID NO: 287880 - DNA, 25 bp, Mus musculus
atttcccatctctataacctatata

SEQ ID NO: 287881 - DNA, 25 bp, Mus musculus
atttcccattagcataattttatgt

SEQ ID NO: 287882 - DNA, 25 bp, Mus musculus
atttcccattaggataattttatgt

SEQ ID NO: 287883 - DNA, 25 bp, Mus musculus
atttcccattctccctggattgcta

SEQ ID NO: 287884 - DNA, 25 bp, Mus musculus
atttcccattctgcctggattgcta

SEQ ID NO: 287885 - DNA, 25 bp, Mus musculus
atttcccattttaactgcttttcag

SEQ ID NO: 287886 - DNA, 25 bp, Mus musculus
atttcccatttttactgcttttcag

SEQ ID NO: 287887 - DNA, 25 bp, Mus musculus
atttccccaagtaatgtcgcagatc

SEQ ID NO: 287888 - DNA, 25 bp, Mus musculus
atttccccaagttatgtcgcagatc

SEQ ID NO: 287889 - DNA, 25 bp, Mus musculus
atttccccacataggcagttatgcc

SEQ ID NO: 287890 - DNA, 25 bp, Mus musculus
atttccccacattggcagttatgcc

SEQ ID NO: 287891 - DNA, 25 bp, Mus musculus
atttccccagagatttttgaacaga

SEQ ID NO: 287892 - DNA, 25 bp, Mus musculus
atttccccagagttttttgaacaga

SEQ ID NO: 287893 - DNA, 25 bp, Mus musculus
atttccccagatcaccagcattgta

SEQ ID NO: 287894 - DNA, 25 bp, Mus musculus
atttccccagatgaccagcattgta

SEQ ID NO: 287895 - DNA, 25 bp, Mus musculus
atttccccagcaccatctgtatttg

SEQ ID NO: 287896 - DNA, 25 bp, Mus musculus
atttccccagcagcatctgtatttg

SEQ ID NO: 287897 - DNA, 25 bp, Mus musculus
atttccccaggaacagtaggagtcc

SEQ ID NO: 287898 - DNA, 25 bp, Mus musculus
atttccccaggacctagtcacgtaa

SEQ ID NO: 287899 - DNA, 25 bp, Mus musculus
atttccccaggagctagtcacgtaa

SEQ ID NO: 287900 - DNA, 25 bp, Mus musculus
atttccccaggatcagtaggagtcc

SEQ ID NO: 287901 - DNA, 25 bp, Mus musculus
atttccccataaccttttgctgatg

SEQ ID NO: 287902 - DNA, 25 bp, Mus musculus
atttccccataagcttttgctgatg

SEQ ID NO: 287903 - DNA, 25 bp, Mus musculus
atttccccatttactatgcctttgc

SEQ ID NO: 287904 - DNA, 25 bp, Mus musculus
atttccccattttctatgcctttgc

SEQ ID NO: 287905 - DNA, 25 bp, Mus musculus
atttccccgtcaattctcaagatga

SEQ ID NO: 287906 - DNA, 25 bp, Mus musculus
atttccccgtcatttctcaagatga

SEQ ID NO: 287907 - DNA, 25 bp, Mus musculus
atttccccgtctacatgaacgagaa

SEQ ID NO: 287908 - DNA, 25 bp, Mus musculus
atttccccgtcttcatgaacgagaa

SEQ ID NO: 287909 - DNA, 25 bp, Mus musculus
atttccccgttccatgaattcgcgg

SEQ ID NO: 287910 - DNA, 25 bp, Mus musculus
atttccccgttcgatgaattcgcgg

SEQ ID NO: 287911 - DNA, 25 bp, Mus musculus
atttcccctccacttactgatgaac

SEQ ID NO: 287912 - DNA, 25 bp, Mus musculus
atttcccctccagttactgatgaac

SEQ ID NO: 287913 - DNA, 25 bp, Mus musculus
atttcccctgatcaaaatgaataaa

SEQ ID NO: 287914 - DNA, 25 bp, Mus musculus
atttcccctgatgaaaatgaataaa

SEQ ID NO: 287915 - DNA, 25 bp, Mus musculus
atttcccctgctagctaagcatgtt

SEQ ID NO: 287916 - DNA, 25 bp, Mus musculus
atttcccctgcttgctaagcatgtt

SEQ ID NO: 287917 - DNA, 25 bp, Mus musculus
atttcccctttcatcatgaatcaca

SEQ ID NO: 287918 - DNA, 25 bp, Mus musculus
atttcccctttcttcatgaatcaca

SEQ ID NO: 287919 - DNA, 25 bp, Mus musculus
atttccccttttctttagcagacat

SEQ ID NO: 287920 - DNA, 25 bp, Mus musculus
atttccccttttgtttagcagacat

SEQ ID NO: 287921 - DNA, 25 bp, Mus musculus
atttcccgaatgatgatatgggtct

SEQ ID NO: 287922 - DNA, 25 bp, Mus musculus
atttcccgaatgttgatatgggtct

SEQ ID NO: 287923 - DNA, 25 bp, Mus musculus
atttcccgagacaggaactcactgt

SEQ ID NO: 287924 - DNA, 25 bp, Mus musculus
atttcccgagactggaactcactgt

SEQ ID NO: 287925 - DNA, 25 bp, Mus musculus
atttcccgctctagttccaagagta

SEQ ID NO: 287926 - DNA, 25 bp, Mus musculus
atttcccgctcttgttccaagagta

SEQ ID NO: 287927 - DNA, 25 bp, Mus musculus
atttcccgcttaaaaatagaagatg

SEQ ID NO: 287928 - DNA, 25 bp, Mus musculus
atttcccgcttataaatagaagatg

SEQ ID NO: 287929 - DNA, 25 bp, Mus musculus
atttcccggatgacataccaatcat

SEQ ID NO: 287930 - DNA, 25 bp, Mus musculus
atttcccggatgtcataccaatcat

SEQ ID NO: 287931 - DNA, 25 bp, Mus musculus
atttcccgtgctaggatctgattga

SEQ ID NO: 287932 - DNA, 25 bp, Mus musculus
atttcccgtgcttggatctgattga

SEQ ID NO: 287933 - DNA, 25 bp, Mus musculus
atttccctactaacattctttagca

SEQ ID NO: 287934 - DNA, 25 bp, Mus musculus
atttccctactatcattctttagca

SEQ ID NO: 287935 - DNA, 25 bp, Mus musculus
atttccctatctcctgtgtgtttgg

SEQ ID NO: 287936 - DNA, 25 bp, Mus musculus
atttccctatctgctgtgtgtttgg

SEQ ID NO: 287937 - DNA, 25 bp, Mus musculus
atttccctcacaaaatttctctgtc

SEQ ID NO: 287938 - DNA, 25 bp, Mus musculus
atttccctcacataatttctctgtc

SEQ ID NO: 287939 - DNA, 25 bp, Mus musculus
atttccctccttaggagtccctcag

SEQ ID NO: 287940 - DNA, 25 bp, Mus musculus
atttccctcctttggagtccctcag

SEQ ID NO: 287941 - DNA, 25 bp, Mus musculus
atttccctctgccaatgactttggg

SEQ ID NO: 287942 - DNA, 25 bp, Mus musculus
atttccctctgcgaatgactttggg

SEQ ID NO: 287943 - DNA, 25 bp, Mus musculus
atttccctctttatgtccctctaga

SEQ ID NO: 287944 - DNA, 25 bp, Mus musculus
atttccctctttccattatgctggc

SEQ ID NO: 287945 - DNA, 25 bp, Mus musculus
atttccctctttgcattatgctggc

SEQ ID NO: 287946 - DNA, 25 bp, Mus musculus
atttccctctttttgtccctctaga

SEQ ID NO: 287947 - DNA, 25 bp, Mus musculus
atttccctgacgacagccaaaatgc

SEQ ID NO: 287948 - DNA, 25 bp, Mus musculus
atttccctgacgtcagccaaaatgc

SEQ ID NO: 287949 - DNA, 25 bp, Mus musculus
atttccctgatcagtaaggactctg

SEQ ID NO: 287950 - DNA, 25 bp, Mus musculus
atttccctgatctgtaaggactctg

SEQ ID NO: 287951 - DNA, 25 bp, Mus musculus
atttccctggaacaaggaactgaca

SEQ ID NO: 287952 - DNA, 25 bp, Mus musculus
atttccctggaagaaggaactgaca

SEQ ID NO: 287953 - DNA, 25 bp, Mus musculus
atttccctggagatattgctgaacc

SEQ ID NO: 287954 - DNA, 25 bp, Mus musculus
atttccctggagttattgctgaacc

SEQ ID NO: 287955 - DNA, 25 bp, Mus musculus
atttccctgtatctgtcatctttga

SEQ ID NO: 287956 - DNA, 25 bp, Mus musculus
atttccctgtatgtgtcatctttga

SEQ ID NO: 287957 - DNA, 25 bp, Mus musculus
atttccctgtttatgctgtcaagca

SEQ ID NO: 287958 - DNA, 25 bp, Mus musculus
atttccctgtttttgctgtcaagca

SEQ ID NO: 287959 - DNA, 25 bp, Mus musculus
atttcccttataagacgcacccttc

SEQ ID NO: 287960 - DNA, 25 bp, Mus musculus
atttcccttatatgacgcacccttc

SEQ ID NO: 287961 - DNA, 25 bp, Mus musculus
atttcccttgatatgggcacacaaa

SEQ ID NO: 287962 - DNA, 25 bp, Mus musculus
atttcccttgatttgggcacacaaa

SEQ ID NO: 287963 - DNA, 25 bp, Mus musculus
atttcccttggacagtgttatgtgc

SEQ ID NO: 287964 - DNA, 25 bp, Mus musculus
atttcccttggagagtgttatgtgc

SEQ ID NO: 287965 - DNA, 25 bp, Mus musculus
atttcccttggcagacacccaggta

SEQ ID NO: 287966 - DNA, 25 bp, Mus musculus
atttcccttggctgacacccaggta

SEQ ID NO: 287967 - DNA, 25 bp, Mus musculus
atttcccttgtcctctggaaaggag

SEQ ID NO: 287968 - DNA, 25 bp, Mus musculus
atttcccttgtcgtctggaaaggag

SEQ ID NO: 287969 - DNA, 25 bp, Mus musculus
atttcccttgtgactcttaatactg

SEQ ID NO: 287970 - DNA, 25 bp, Mus musculus
atttcccttgtgtctcttaatactg

SEQ ID NO: 287971 - DNA, 25 bp, Mus musculus
atttccctttaaagtgatgtctctg

SEQ ID NO: 287972 - DNA, 25 bp, Mus musculus
atttccctttaatgtgatgtctctg

SEQ ID NO: 287973 - DNA, 25 bp, Mus musculus
atttccctttccaatctggatgtgc

SEQ ID NO: 287974 - DNA, 25 bp, Mus musculus
atttccctttcctatctggatgtgc

SEQ ID NO: 287975 - DNA, 25 bp, Mus musculus
atttccctttgacatgccagaagag

SEQ ID NO: 287976 - DNA, 25 bp, Mus musculus
atttccctttgacgtccaagtcata

SEQ ID NO: 287977 - DNA, 25 bp, Mus musculus
atttccctttgagatgccagaagag

SEQ ID NO: 287978 - DNA, 25 bp, Mus musculus
atttccctttgaggtccaagtcata

SEQ ID NO: 287979 - DNA, 25 bp, Mus musculus
atttccctttgccaatctgtaccag

SEQ ID NO: 287980 - DNA, 25 bp, Mus musculus
atttccctttgcgaatctgtaccag

SEQ ID NO: 287981 - DNA, 25 bp, Mus musculus
atttccctttttctctgcttggtat

SEQ ID NO: 287982 - DNA, 25 bp, Mus musculus
atttccctttttgtctgcttggtat

SEQ ID NO: 287983 - DNA, 25 bp, Mus musculus
atttccgagagtacatctgtgccct

SEQ ID NO: 287984 - DNA, 25 bp, Mus musculus
atttccgagagttcatctgtgccct

SEQ ID NO: 287985 - DNA, 25 bp, Mus musculus
atttccgagcagaggcagtaattca

SEQ ID NO: 287986 - DNA, 25 bp, Mus musculus
atttccgagcagtggcagtaattca

SEQ ID NO: 287987 - DNA, 25 bp, Mus musculus
atttccgcaaatatttggaagctgg

SEQ ID NO: 287988 - DNA, 25 bp, Mus musculus
atttccgcaaatttttggaagctgg

SEQ ID NO: 287989 - DNA, 25 bp, Mus musculus
atttccgcgtgcctcgtgcgctggt

SEQ ID NO: 287990 - DNA, 25 bp, Mus musculus
atttccgcgtgcgtcgtgcgctggt

SEQ ID NO: 287991 - DNA, 25 bp, Mus musculus
atttccggatgaattaggccctcca

SEQ ID NO: 287992 - DNA, 25 bp, Mus musculus
atttccggatgatttaggccctcca

SEQ ID NO: 287993 - DNA, 25 bp, Mus musculus
atttccggattcactttgcatctac

SEQ ID NO: 287994 - DNA, 25 bp, Mus musculus
atttccggattctctttgcatctac

SEQ ID NO: 287995 - DNA, 25 bp, Mus musculus
atttccgtctctatcatcaataagg

SEQ ID NO: 287996 - DNA, 25 bp, Mus musculus
atttccgtctctttcatcaataagg

SEQ ID NO: 287997 - DNA, 25 bp, Mus musculus
atttccgtgatgacattaccacctg

SEQ ID NO: 287998 - DNA, 25 bp, Mus musculus
atttccgtgatgtcattaccacctg

SEQ ID NO: 287999 - DNA, 25 bp, Mus musculus
atttccgttctcacatggaccagat

SEQ ID NO: 288000 - DNA, 25 bp, Mus musculus
atttccgttctctcatggaccagat

SEQ ID NO: 288001 - DNA, 25 bp, Mus musculus
atttccgtttgccttcatccttcat

SEQ ID NO: 288002 - DNA, 25 bp, Mus musculus
atttccgtttgcgttcatccttcat

SEQ ID NO: 288003 - DNA, 25 bp, Mus musculus
atttcctaagacagatggggcagcc

SEQ ID NO: 288004 - DNA, 25 bp, Mus musculus
atttcctaagactgatggggcagcc

SEQ ID NO: 288005 - DNA, 25 bp, Mus musculus
atttcctaagtgagactgctcttct

SEQ ID NO: 288006 - DNA, 25 bp, Mus musculus
atttcctaagtgtgactgctcttct

SEQ ID NO: 288007 - DNA, 25 bp, Mus musculus
atttcctaagttctgctgagtcccg

SEQ ID NO: 288008 - DNA, 25 bp, Mus musculus
atttcctaagttgtgctgagtcccg

SEQ ID NO: 288009 - DNA, 25 bp, Mus musculus
atttcctaatcacgaatcccatctg

SEQ ID NO: 288010 - DNA, 25 bp, Mus musculus
atttcctaatcaggaatcccatctg

SEQ ID NO: 288011 - DNA, 25 bp, Mus musculus
atttcctacatgatttggtactgac

SEQ ID NO: 288012 - DNA, 25 bp, Mus musculus
atttcctacatgttttggtactgac

SEQ ID NO: 288013 - DNA, 25 bp, Mus musculus
atttcctactttacttcagactgtg

SEQ ID NO: 288014 - DNA, 25 bp, Mus musculus
atttcctacttttcttcagactgtg

SEQ ID NO: 288015 - DNA, 25 bp, Mus musculus
atttcctagaagacgcagcaaagtt

SEQ ID NO: 288016 - DNA, 25 bp, Mus musculus
atttcctagaagtcgcagcaaagtt

SEQ ID NO: 288017 - DNA, 25 bp, Mus musculus
atttcctagagacctattactttca

SEQ ID NO: 288018 - DNA, 25 bp, Mus musculus
atttcctagagactgttaatgtacc

SEQ ID NO: 288019 - DNA, 25 bp, Mus musculus
atttcctagagagctattactttca

SEQ ID NO: 288020 - DNA, 25 bp, Mus musculus
atttcctagagagtgttaatgtacc

SEQ ID NO: 288021 - DNA, 25 bp, Mus musculus
atttcctaggaacggtctctgactc

SEQ ID NO: 288022 - DNA, 25 bp, Mus musculus
atttcctaggaagggtctctgactc

SEQ ID NO: 288023 - DNA, 25 bp, Mus musculus
atttcctaggatcgttctgttctta

SEQ ID NO: 288024 - DNA, 25 bp, Mus musculus
atttcctaggatggttctgttctta

SEQ ID NO: 288025 - DNA, 25 bp, Mus musculus
atttcctaggcaaattaaacttcaa

SEQ ID NO: 288026 - DNA, 25 bp, Mus musculus
atttcctaggcatattaaacttcaa

SEQ ID NO: 288027 - DNA, 25 bp, Mus musculus
atttcctagtcaaggccactattgg

SEQ ID NO: 288028 - DNA, 25 bp, Mus musculus
atttcctagtcatggccactattgg

SEQ ID NO: 288029 - DNA, 25 bp, Mus musculus
atttcctattagactctcagcacca

SEQ ID NO: 288030 - DNA, 25 bp, Mus musculus
atttcctattagtctctcagcacca

SEQ ID NO: 288031 - DNA, 25 bp, Mus musculus
atttcctcaaaaagtatcagctcag

SEQ ID NO: 288032 - DNA, 25 bp, Mus musculus
atttcctcaaaactggagccccaga

SEQ ID NO: 288033 - DNA, 25 bp, Mus musculus
atttcctcaaaagtggagccccaga

SEQ ID NO: 288034 - DNA, 25 bp, Mus musculus
atttcctcaaaatgtatcagctcag

SEQ ID NO: 288035 - DNA, 25 bp, Mus musculus
atttcctcactgattcgtgtcgtgg

SEQ ID NO: 288036 - DNA, 25 bp, Mus musculus
atttcctcactgtttcgtgtcgtgg

SEQ ID NO: 288037 - DNA, 25 bp, Mus musculus
atttcctcatgtaaattcacactca

SEQ ID NO: 288038 - DNA, 25 bp, Mus musculus
atttcctcatgttaattcacactca

SEQ ID NO: 288039 - DNA, 25 bp, Mus musculus
atttcctccatcagcagttacagca

SEQ ID NO: 288040 - DNA, 25 bp, Mus musculus
atttcctccatctgcagttacagca

SEQ ID NO: 288041 - DNA, 25 bp, Mus musculus
atttcctccattaatttctctgtta

SEQ ID NO: 288042 - DNA, 25 bp, Mus musculus
atttcctccattcctgagattctgt

SEQ ID NO: 288043 - DNA, 25 bp, Mus musculus
atttcctccattgctgagattctgt

SEQ ID NO: 288044 - DNA, 25 bp, Mus musculus
atttcctccatttatttctctgtta

SEQ ID NO: 288045 - DNA, 25 bp, Mus musculus
atttcctcccagaggcgttggccac

SEQ ID NO: 288046 - DNA, 25 bp, Mus musculus
atttcctcccagtggcgttggccac

SEQ ID NO: 288047 - DNA, 25 bp, Mus musculus
atttcctcccttcatgaactcttat

SEQ ID NO: 288048 - DNA, 25 bp, Mus musculus
atttcctcccttgatgaactcttat

SEQ ID NO: 288049 - DNA, 25 bp, Mus musculus
atttcctccggaccgatttacctgg

SEQ ID NO: 288050 - DNA, 25 bp, Mus musculus
atttcctccggagcgatttacctgg

SEQ ID NO: 288051 - DNA, 25 bp, Mus musculus
atttcctcctacattgagcagacac

SEQ ID NO: 288052 - DNA, 25 bp, Mus musculus
atttcctcctactttgagcagacac

SEQ ID NO: 288053 - DNA, 25 bp, Mus musculus
atttcctcctagctcatcattaaaa

SEQ ID NO: 288054 - DNA, 25 bp, Mus musculus
atttcctcctaggtcatcattaaaa

SEQ ID NO: 288055 - DNA, 25 bp, Mus musculus
atttcctcctatactctacttttat

SEQ ID NO: 288056 - DNA, 25 bp, Mus musculus
atttcctcctattctctacttttat

SEQ ID NO: 288057 - DNA, 25 bp, Mus musculus
atttcctccttactttatctcctat

SEQ ID NO: 288058 - DNA, 25 bp, Mus musculus
atttcctccttagtttatctcctat

SEQ ID NO: 288059 - DNA, 25 bp, Mus musculus
atttcctcggctcctttgtcattgg

SEQ ID NO: 288060 - DNA, 25 bp, Mus musculus
atttcctcggctgctttgtcattgg

SEQ ID NO: 288061 - DNA, 25 bp, Mus musculus
atttcctctaagagctacctaacag

SEQ ID NO: 288062 - DNA, 25 bp, Mus musculus
atttcctctaagtgctacctaacag

SEQ ID NO: 288063 - DNA, 20 bp, Mus musculus
atttcctctagtcttctgga

SEQ ID NO: 288064 - DNA, 20 bp, Mus musculus
atttcctctcgtcttctgga

SEQ ID NO: 288065 - DNA, 25 bp, Mus musculus
atttcctctgggaatctctgtaact

SEQ ID NO: 288066 - DNA, 25 bp, Mus musculus
atttcctctgggtatctctgtaact

SEQ ID NO: 288067 - DNA, 20 bp, Mus musculus
atttcctctggtcttctgga

SEQ ID NO: 288068 - DNA, 25 bp, Mus musculus
atttcctctgtcatgtgctatacct

SEQ ID NO: 288069 - DNA, 25 bp, Mus musculus
atttcctctgtcttgtgctatacct

SEQ ID NO: 288070 - DNA, 25 bp, Mus musculus
atttcctcttaactttgatctctgg

SEQ ID NO: 288071 - DNA, 25 bp, Mus musculus
atttcctcttaagtttgatctctgg

SEQ ID NO: 288072 - DNA, 25 bp, Mus musculus
atttcctcttgccatgctagggatg

SEQ ID NO: 288073 - DNA, 25 bp, Mus musculus
atttcctcttgcgatgctagggatg

SEQ ID NO: 288074 - DNA, 20 bp, Mus musculus
atttcctcttgtcttctgga

SEQ ID NO: 288075 - DNA, 25 bp, Mus musculus
atttcctcttttcgttagaattcag

SEQ ID NO: 288076 - DNA, 25 bp, Mus musculus
atttcctcttttggttagaattcag

SEQ ID NO: 288077 - DNA, 25 bp, Mus musculus
atttcctgaaatcgtctcatgtgga

SEQ ID NO: 288078 - DNA, 25 bp, Mus musculus
atttcctgaaatggtctcatgtgga

SEQ ID NO: 288079 - DNA, 25 bp, Mus musculus
atttcctgactgctcaagctgactt

SEQ ID NO: 288080 - DNA, 25 bp, Mus musculus
atttcctgactggtcaagctgactt

SEQ ID NO: 288081 - DNA, 25 bp, Mus musculus
atttcctgacttaatgttcttgtgt

SEQ ID NO: 288082 - DNA, 25 bp, Mus musculus
atttcctgacttatattgccttcta

SEQ ID NO: 288083 - DNA, 25 bp, Mus musculus
atttcctgactttatgttcttgtgt

SEQ ID NO: 288084 - DNA, 25 bp, Mus musculus
atttcctgacttttattgccttcta

SEQ ID NO: 288085 - DNA, 25 bp, Mus musculus
atttcctgagataccagcccaaggg

SEQ ID NO: 288086 - DNA, 25 bp, Mus musculus
atttcctgagattccagcccaaggg

SEQ ID NO: 288087 - DNA, 25 bp, Mus musculus
atttcctgagtcaacatggccgttc

SEQ ID NO: 288088 - DNA, 25 bp, Mus musculus
atttcctgagtctacatggccgttc

SEQ ID NO: 288089 - DNA, 25 bp, Mus musculus
atttcctgatgaactttccttagac

SEQ ID NO: 288090 - DNA, 25 bp, Mus musculus
atttcctgatgatctttccttagac

SEQ ID NO: 288091 - DNA, 25 bp, Mus musculus
atttcctgatgtaccaaaacctctc

SEQ ID NO: 288092 - DNA, 25 bp, Mus musculus
atttcctgatgttccaaaacctctc

SEQ ID NO: 288093 - DNA, 25 bp, Mus musculus
atttcctgcaatctgaatctatcca

SEQ ID NO: 288094 - DNA, 25 bp, Mus musculus
atttcctgcaatgtgaatctatcca

SEQ ID NO: 288095 - DNA, 25 bp, Mus musculus
atttcctgcacaaacccatgtatac

SEQ ID NO: 288096 - DNA, 25 bp, Mus musculus
atttcctgcacatacccatgtatac

SEQ ID NO: 288097 - DNA, 25 bp, Mus musculus
atttcctgcaccataatgcttctgc

SEQ ID NO: 288098 - DNA, 25 bp, Mus musculus
atttcctgcaccttaatgcttctgc

SEQ ID NO: 288099 - DNA, 25 bp, Mus musculus
atttcctgcaggatcatagcctcag

SEQ ID NO: 288100 - DNA, 25 bp, Mus musculus
atttcctgcaggctacaggctgtag

SEQ ID NO: 288101 - DNA, 25 bp, Mus musculus
atttcctgcagggtacaggctgtag

SEQ ID NO: 288102 - DNA, 25 bp, Mus musculus
atttcctgcaggttcatagcctcag

SEQ ID NO: 288103 - DNA, 25 bp, Mus musculus
atttcctgccaaatagtatgatttc

SEQ ID NO: 288104 - DNA, 25 bp, Mus musculus
atttcctgccaattagtatgatttc

SEQ ID NO: 288105 - DNA, 25 bp, Mus musculus
atttcctgcccaatatgtactgaat

SEQ ID NO: 288106 - DNA, 25 bp, Mus musculus
atttcctgcccattatgtactgaat

SEQ ID NO: 288107 - DNA, 25 bp, Mus musculus
atttcctgccctcaggtttgggagt

SEQ ID NO: 288108 - DNA, 25 bp, Mus musculus
atttcctgccctgaggtttgggagt

SEQ ID NO: 288109 - DNA, 25 bp, Mus musculus
atttcctgctgaagtgtacctttgc

SEQ ID NO: 288110 - DNA, 25 bp, Mus musculus
atttcctgctgatgtgtacctttgc

SEQ ID NO: 288111 - DNA, 25 bp, Mus musculus
atttcctgctttaactctcaatgaa

SEQ ID NO: 288112 - DNA, 25 bp, Mus musculus
atttcctgctttccctagaatgtat

SEQ ID NO: 288113 - DNA, 25 bp, Mus musculus
atttcctgctttgcctagaatgtat

SEQ ID NO: 288114 - DNA, 25 bp, Mus musculus
atttcctgcttttactctcaatgaa

SEQ ID NO: 288115 - DNA, 25 bp, Mus musculus
atttcctggaccatggtattcagtt

SEQ ID NO: 288116 - DNA, 25 bp, Mus musculus
atttcctggaccttggtattcagtt

SEQ ID NO: 288117 - DNA, 25 bp, Mus musculus
atttcctggagcattgttactttga

SEQ ID NO: 288118 - DNA, 25 bp, Mus musculus
atttcctggagctttgttactttga

SEQ ID NO: 288119 - DNA, 25 bp, Mus musculus
atttcctgggcaccatctttcttgc

SEQ ID NO: 288120 - DNA, 25 bp, Mus musculus
atttcctgggcagcatctttcttgc

SEQ ID NO: 288121 - DNA, 25 bp, Mus musculus
atttcctgggccactgttgtgcagc

SEQ ID NO: 288122 - DNA, 25 bp, Mus musculus
atttcctgggcctctgttgtgcagc

SEQ ID NO: 288123 - DNA, 25 bp, Mus musculus
atttcctgggtgatgggcaagtaga

SEQ ID NO: 288124 - DNA, 25 bp, Mus musculus
atttcctgggtgttgggcaagtaga

SEQ ID NO: 288125 - DNA, 25 bp, Mus musculus
atttcctggttcaagaatggcctgg

SEQ ID NO: 288126 - DNA, 25 bp, Mus musculus
atttcctggttctagaatggcctgg

SEQ ID NO: 288127 - DNA, 25 bp, Mus musculus
atttcctgtaccattatagcaccac

SEQ ID NO: 288128 - DNA, 25 bp, Mus musculus
atttcctgtacctttatagcaccac

SEQ ID NO: 288129 - DNA, 25 bp, Mus musculus
atttcctgtacgactggttttatca

SEQ ID NO: 288130 - DNA, 25 bp, Mus musculus
atttcctgtacgatgaagtccaccc

SEQ ID NO: 288131 - DNA, 25 bp, Mus musculus
atttcctgtacgtctggttttatca

SEQ ID NO: 288132 - DNA, 25 bp, Mus musculus
atttcctgtacgttgaagtccaccc

SEQ ID NO: 288133 - DNA, 25 bp, Mus musculus
atttcctgtagtctgtccggagaca

SEQ ID NO: 288134 - DNA, 25 bp, Mus musculus
atttcctgtagtgtgtccggagaca

SEQ ID NO: 288135 - DNA, 25 bp, Mus musculus
atttcctgtatcataaacacttggt

SEQ ID NO: 288136 - DNA, 25 bp, Mus musculus
atttcctgtatcttaaacacttggt

SEQ ID NO: 288137 - DNA, 25 bp, Mus musculus
atttcctgtcaaccttccttcaagg

SEQ ID NO: 288138 - DNA, 25 bp, Mus musculus
atttcctgtcaagcttccttcaagg

SEQ ID NO: 288139 - DNA, 25 bp, Mus musculus
atttcctgtctcaactcttgccctg

SEQ ID NO: 288140 - DNA, 25 bp, Mus musculus
atttcctgtctctactcttgccctg

SEQ ID NO: 288141 - DNA, 25 bp, Mus musculus
atttcctgtgttctttgaagctaat

SEQ ID NO: 288142 - DNA, 25 bp, Mus musculus
atttcctgtgttgtttgaagctaat

SEQ ID NO: 288143 - DNA, 25 bp, Mus musculus
atttcctgttctactgggtttgaga

SEQ ID NO: 288144 - DNA, 25 bp, Mus musculus
atttcctgttcttctgggtttgaga

SEQ ID NO: 288145 - DNA, 25 bp, Mus musculus
atttcctgtttcatgaccttaactg

SEQ ID NO: 288146 - DNA, 25 bp, Mus musculus
atttcctgtttcttgaccttaactg

SEQ ID NO: 288147 - DNA, 25 bp, Mus musculus
atttccttaatcatgtaactatgtt

SEQ ID NO: 288148 - DNA, 25 bp, Mus musculus
atttccttaatcttgtaactatgtt

SEQ ID NO: 288149 - DNA, 25 bp, Mus musculus
atttccttacctctcatgtcataag

SEQ ID NO: 288150 - DNA, 25 bp, Mus musculus
atttccttacctgtcatgtcataag

SEQ ID NO: 288151 - DNA, 25 bp, Mus musculus
atttccttatccatttgtctgtctg

SEQ ID NO: 288152 - DNA, 25 bp, Mus musculus
atttccttatccttttgtctgtctg

SEQ ID NO: 288153 - DNA, 25 bp, Mus musculus
atttccttatgactctgtcccttgg

SEQ ID NO: 288154 - DNA, 25 bp, Mus musculus
atttccttatgagtctgtcccttgg

SEQ ID NO: 288155 - DNA, 25 bp, Mus musculus
atttccttatgtaaatcctttagca

SEQ ID NO: 288156 - DNA, 25 bp, Mus musculus
atttccttatgttaatcctttagca

SEQ ID NO: 288157 - DNA, 25 bp, Mus musculus
atttccttcagaccaactgtcattc

SEQ ID NO: 288158 - DNA, 25 bp, Mus musculus
atttccttcagagcaactgtcattc

SEQ ID NO: 288159 - DNA, 25 bp, Mus musculus
atttccttcagtaatgtgtccacag

SEQ ID NO: 288160 - DNA, 25 bp, Mus musculus
atttccttcagttatgtgtccacag

SEQ ID NO: 288161 - DNA, 25 bp, Mus musculus
atttccttcccaagtcattcaagaa

SEQ ID NO: 288162 - DNA, 25 bp, Mus musculus
atttccttcccaatgtacctcaagg

SEQ ID NO: 288163 - DNA, 25 bp, Mus musculus
atttccttcccatgtcattcaagaa

SEQ ID NO: 288164 - DNA, 25 bp, Mus musculus
atttccttcccattgtacctcaagg

SEQ ID NO: 288165 - DNA, 25 bp, Mus musculus
atttccttcctcactattggaataa

SEQ ID NO: 288166 - DNA, 25 bp, Mus musculus
atttccttcctctctattggaataa

SEQ ID NO: 288167 - DNA, 25 bp, Mus musculus
atttccttcggcaggtttatgcacg

SEQ ID NO: 288168 - DNA, 25 bp, Mus musculus
atttccttcggctggtttatgcacg

SEQ ID NO: 288169 - DNA, 25 bp, Mus musculus
atttccttctcaatcttctaaaagt

SEQ ID NO: 288170 - DNA, 25 bp, Mus musculus
atttccttctcattcttctaaaagt

SEQ ID NO: 288171 - DNA, 25 bp, Mus musculus
atttccttctgcaacccaagtgctg

SEQ ID NO: 288172 - DNA, 25 bp, Mus musculus
atttccttctgctacccaagtgctg

SEQ ID NO: 288173 - DNA, 25 bp, Mus musculus
atttccttcttgaaccacagagctg

SEQ ID NO: 288174 - DNA, 25 bp, Mus musculus
atttccttcttgtaccacagagctg

SEQ ID NO: 288175 - DNA, 25 bp, Mus musculus
atttccttctttactgtctctctta

SEQ ID NO: 288176 - DNA, 25 bp, Mus musculus
atttccttcttttctgtctctctta

SEQ ID NO: 288177 - DNA, 25 bp, Mus musculus
atttccttgcaaacgattcaaagag

SEQ ID NO: 288178 - DNA, 25 bp, Mus musculus
atttccttgcaatcgattcaaagag

SEQ ID NO: 288179 - DNA, 25 bp, Mus musculus
atttccttgcacactgggacacaaa

SEQ ID NO: 288180 - DNA, 25 bp, Mus musculus
atttccttgcactctgggacacaaa

SEQ ID NO: 288181 - DNA, 25 bp, Mus musculus
atttccttgcttctgccttccaagt

SEQ ID NO: 288182 - DNA, 25 bp, Mus musculus
atttccttgcttgtgccttccaagt

SEQ ID NO: 288183 - DNA, 25 bp, Mus musculus
atttccttggaacatatgcctaata

SEQ ID NO: 288184 - DNA, 25 bp, Mus musculus
atttccttggaactgctaagaatgg

SEQ ID NO: 288185 - DNA, 25 bp, Mus musculus
atttccttggaagatatgcctaata

SEQ ID NO: 288186 - DNA, 25 bp, Mus musculus
atttccttggaagtgctaagaatgg

SEQ ID NO: 288187 - DNA, 25 bp, Mus musculus
atttccttggagaattgatctcttc

SEQ ID NO: 288188 - DNA, 25 bp, Mus musculus
atttccttggagtattgatctcttc

SEQ ID NO: 288189 - DNA, 25 bp, Mus musculus
atttccttggtgatagagtactgct

SEQ ID NO: 288190 - DNA, 25 bp, Mus musculus
atttccttggtgttagagtactgct

SEQ ID NO: 288191 - DNA, 25 bp, Mus musculus
atttccttgtgaatcttatttggta

SEQ ID NO: 288192 - DNA, 25 bp, Mus musculus
atttccttgtgaatgcttatttctt

SEQ ID NO: 288193 - DNA, 25 bp, Mus musculus
atttccttgtgattcttatttggta

SEQ ID NO: 288194 - DNA, 25 bp, Mus musculus
atttccttgtgattgcttatttctt

SEQ ID NO: 288195 - DNA, 25 bp, Mus musculus
atttcctttcaaatcacagtaatta

SEQ ID NO: 288196 - DNA, 25 bp, Mus musculus
atttcctttcaattcacagtaatta

SEQ ID NO: 288197 - DNA, 25 bp, Mus musculus
atttcctttcgaatggcactacctt

SEQ ID NO: 288198 - DNA, 25 bp, Mus musculus
atttcctttcgattggcactacctt

SEQ ID NO: 288199 - DNA, 25 bp, Mus musculus
atttcctttctaatcttctgtccat

SEQ ID NO: 288200 - DNA, 25 bp, Mus musculus
atttcctttctattcttctgtccat

SEQ ID NO: 288201 - DNA, 25 bp, Mus musculus
atttcctttcttcggtgggtcagct

SEQ ID NO: 288202 - DNA, 25 bp, Mus musculus
atttcctttcttgggtgggtcagct

SEQ ID NO: 288203 - DNA, 25 bp, Mus musculus
atttcctttgcgaatataattgctc

SEQ ID NO: 288204 - DNA, 25 bp, Mus musculus
atttcctttgcgtatataattgctc

SEQ ID NO: 288205 - DNA, 25 bp, Mus musculus
atttcctttttcaacgcccacagtg

SEQ ID NO: 288206 - DNA, 25 bp, Mus musculus
atttcctttttctacgcccacagtg

SEQ ID NO: 288207 - DNA, 25 bp, Mus musculus
atttcgaccaagatctcaagccgta

SEQ ID NO: 288208 - DNA, 25 bp, Mus musculus
atttcgaccaagttctcaagccgta

SEQ ID NO: 288209 - DNA, 25 bp, Mus musculus
atttcgagagaaaaagcactttgtc

SEQ ID NO: 288210 - DNA, 25 bp, Mus musculus
atttcgagagaataagcactttgtc

SEQ ID NO: 288211 - DNA, 25 bp, Mus musculus
atttcgaggctgattctatccccat

SEQ ID NO: 288212 - DNA, 25 bp, Mus musculus
atttcgaggctgtttctatccccat

SEQ ID NO: 288213 - DNA, 25 bp, Mus musculus
atttcgatacttatattaccttcag

SEQ ID NO: 288214 - DNA, 25 bp, Mus musculus
atttcgatacttttattaccttcag

SEQ ID NO: 288215 - DNA, 25 bp, Mus musculus
atttcgatccatatttctgtgacat

SEQ ID NO: 288216 - DNA, 25 bp, Mus musculus
atttcgatccatttttctgtgacat

SEQ ID NO: 288217 - DNA, 25 bp, Mus musculus
atttcgatgaatattatgtgtttta

SEQ ID NO: 288218 - DNA, 25 bp, Mus musculus
atttcgatgaattttatgtgtttta

SEQ ID NO: 288219 - DNA, 25 bp, Mus musculus
atttcgatttgcatatacatagatt

SEQ ID NO: 288220 - DNA, 25 bp, Mus musculus
atttcgatttgcttatacatagatt

SEQ ID NO: 288221 - DNA, 25 bp, Mus musculus
atttcgcagaggagcgtcctcacaa

SEQ ID NO: 288222 - DNA, 25 bp, Mus musculus
atttcgcagaggtgcgtcctcacaa

SEQ ID NO: 288223 - DNA, 25 bp, Mus musculus
atttcgccagagactctccatgaaa

SEQ ID NO: 288224 - DNA, 25 bp, Mus musculus
atttcgccagagtctctccatgaaa

SEQ ID NO: 288225 - DNA, 25 bp, Mus musculus
atttcgcccgtcaggcagttgacat

SEQ ID NO: 288226 - DNA, 25 bp, Mus musculus
atttcgcccgtctggcagttgacat

SEQ ID NO: 288227 - DNA, 25 bp, Mus musculus
atttcgctctgacaactttcttccc

SEQ ID NO: 288228 - DNA, 25 bp, Mus musculus
atttcgctctgagaactttcttccc

SEQ ID NO: 288229 - DNA, 25 bp, Mus musculus
atttcgctgctgaatgagcccaaca

SEQ ID NO: 288230 - DNA, 25 bp, Mus musculus
atttcgctgctgtatgagcccaaca

SEQ ID NO: 288231 - DNA, 25 bp, Mus musculus
atttcgcttccaagaccatttgtag

SEQ ID NO: 288232 - DNA, 25 bp, Mus musculus
atttcgcttccatgaccatttgtag

SEQ ID NO: 288233 - DNA, 25 bp, Mus musculus
atttcggaactacctttctccatag

SEQ ID NO: 288234 - DNA, 25 bp, Mus musculus
atttcggaactagctttctccatag

SEQ ID NO: 288235 - DNA, 25 bp, Mus musculus
atttcggagtttcaggctagttaga

SEQ ID NO: 288236 - DNA, 25 bp, Mus musculus
atttcggagtttgaggctagttaga

SEQ ID NO: 288237 - DNA, 25 bp, Mus musculus
atttcggatgccaacaccttcggtg

SEQ ID NO: 288238 - DNA, 25 bp, Mus musculus
atttcggatgcctacaccttcggtg

SEQ ID NO: 288239 - DNA, 25 bp, Mus musculus
atttcggattttcagtcatctcgac

SEQ ID NO: 288240 - DNA, 25 bp, Mus musculus
atttcggattttgagtcatctcgac

SEQ ID NO: 288241 - DNA, 25 bp, Mus musculus
atttcggcccatagaccatctgaca

SEQ ID NO: 288242 - DNA, 25 bp, Mus musculus
atttcggcccattgaccatctgaca

SEQ ID NO: 288243 - DNA, 25 bp, Mus musculus
atttcggcgaggcaccatttcagac

SEQ ID NO: 288244 - DNA, 25 bp, Mus musculus
atttcggcgagggaccatttcagac

SEQ ID NO: 288245 - DNA, 25 bp, Mus musculus
atttcgggaaggagagctctccagc

SEQ ID NO: 288246 - DNA, 25 bp, Mus musculus
atttcgggaaggtgagctctccagc

SEQ ID NO: 288247 - DNA, 25 bp, Mus musculus
atttcgggttttaacagatggcaga

SEQ ID NO: 288248 - DNA, 25 bp, Mus musculus
atttcgggtttttacagatggcaga

SEQ ID NO: 288249 - DNA, 25 bp, Mus musculus
atttcggtcagaaacttgaggctgt

SEQ ID NO: 288250 - DNA, 25 bp, Mus musculus
atttcggtcagatacttgaggctgt

SEQ ID NO: 288251 - DNA, 25 bp, Mus musculus
atttcgtatccacttcagcattcag

SEQ ID NO: 288252 - DNA, 25 bp, Mus musculus
atttcgtatccagttcagcattcag

SEQ ID NO: 288253 - DNA, 25 bp, Mus musculus
atttcgtcctgcaagtcagctacaa

SEQ ID NO: 288254 - DNA, 25 bp, Mus musculus
atttcgtcctgctagtcagctacaa

SEQ ID NO: 288255 - DNA, 25 bp, Mus musculus
atttcgtctcggactcttgtataac

SEQ ID NO: 288256 - DNA, 25 bp, Mus musculus
atttcgtctcggtctcttgtataac

SEQ ID NO: 288257 - DNA, 25 bp, Mus musculus
atttcgtctgtgaaagccattcatg

SEQ ID NO: 288258 - DNA, 25 bp, Mus musculus
atttcgtctgtgtaagccattcatg

SEQ ID NO: 288259 - DNA, 25 bp, Mus musculus
atttcgtgaatactgagccgaatat

SEQ ID NO: 288260 - DNA, 25 bp, Mus musculus
atttcgtgaatagtgagccgaatat

SEQ ID NO: 288261 - DNA, 25 bp, Mus musculus
atttcgtgatcacagactccagctt

SEQ ID NO: 288262 - DNA, 25 bp, Mus musculus
atttcgtgatcagagactccagctt

SEQ ID NO: 288263 - DNA, 25 bp, Mus musculus
atttcgtggcatacatattctttat

SEQ ID NO: 288264 - DNA, 25 bp, Mus musculus
atttcgtggcattcatattctttat

SEQ ID NO: 288265 - DNA, 25 bp, Mus musculus
atttcgtggcttatcacacacccat

SEQ ID NO: 288266 - DNA, 25 bp, Mus musculus
atttcgtggcttttcacacacccat

SEQ ID NO: 288267 - DNA, 25 bp, Mus musculus
atttcgttaatacaaactgatcctg

SEQ ID NO: 288268 - DNA, 25 bp, Mus musculus
atttcgttaatagaaactgatcctg

SEQ ID NO: 288269 - DNA, 25 bp, Mus musculus
atttcgttgtagatcgggttcagat

SEQ ID NO: 288270 - DNA, 25 bp, Mus musculus
atttcgttgtagttcgggttcagat

SEQ ID NO: 288271 - DNA, 25 bp, Mus musculus
atttcgtttcaaatggagcttttgc

SEQ ID NO: 288272 - DNA, 25 bp, Mus musculus
atttcgtttcaattggagcttttgc

SEQ ID NO: 288273 - DNA, 25 bp, Mus musculus
atttctaaaagtctaggctaccatt

SEQ ID NO: 288274 - DNA, 25 bp, Mus musculus
atttctaaaagtgtaggctaccatt

SEQ ID NO: 288275 - DNA, 25 bp, Mus musculus
atttctaaagagacttctgggctgt

SEQ ID NO: 288276 - DNA, 25 bp, Mus musculus
atttctaaagagtcttctgggctgt

SEQ ID NO: 288277 - DNA, 25 bp, Mus musculus
atttctaaatcactctcgcctgtgc

SEQ ID NO: 288278 - DNA, 25 bp, Mus musculus
atttctaaatcagtctcgcctgtgc

SEQ ID NO: 288279 - DNA, 25 bp, Mus musculus
atttctaaatctaccaacttgtcaa

SEQ ID NO: 288280 - DNA, 25 bp, Mus musculus
atttctaaatcttccaacttgtcaa

SEQ ID NO: 288281 - DNA, 25 bp, Mus musculus
atttctaaatgccatccttgctgtc

SEQ ID NO: 288282 - DNA, 25 bp, Mus musculus
atttctaaatgcgatccttgctgtc

SEQ ID NO: 288283 - DNA, 25 bp, Mus musculus
atttctaacacaagctcttggtgtg

SEQ ID NO: 288284 - DNA, 25 bp, Mus musculus
atttctaacacatgctcttggtgtg

SEQ ID NO: 288285 - DNA, 25 bp, Mus musculus
atttctaatgtgatctatgggtttc

SEQ ID NO: 288286 - DNA, 25 bp, Mus musculus
atttctaatgtgttctatgggtttc

SEQ ID NO: 288287 - DNA, 25 bp, Mus musculus
atttctaattctccatatttgtaag

SEQ ID NO: 288288 - DNA, 25 bp, Mus musculus
atttctaattctgcatatttgtaag

SEQ ID NO: 288289 - DNA, 25 bp, Mus musculus
atttctacaacactggactaatagg

SEQ ID NO: 288290 - DNA, 25 bp, Mus musculus
atttctacaacagtggactaatagg

SEQ ID NO: 288291 - DNA, 25 bp, Mus musculus
atttctacaccactctctgaggagg

SEQ ID NO: 288292 - DNA, 25 bp, Mus musculus
atttctacaccagtctctgaggagg

SEQ ID NO: 288293 - DNA, 25 bp, Mus musculus
atttctacactgctacctcctaagt

SEQ ID NO: 288294 - DNA, 25 bp, Mus musculus
atttctacactggtacctcctaagt

SEQ ID NO: 288295 - DNA, 25 bp, Mus musculus
atttctacacttcccatttgcatgt

SEQ ID NO: 288296 - DNA, 25 bp, Mus musculus
atttctacacttgccatttgcatgt

SEQ ID NO: 288297 - DNA, 25 bp, Mus musculus
atttctacatcaccagagcacattc

SEQ ID NO: 288298 - DNA, 25 bp, Mus musculus
atttctacatcagcagagcacattc

SEQ ID NO: 288299 - DNA, 25 bp, Mus musculus
atttctacatgtcatactgtgatac

SEQ ID NO: 288300 - DNA, 25 bp, Mus musculus
atttctacatgtgatactgtgatac

SEQ ID NO: 288301 - DNA, 25 bp, Mus musculus
atttctacattaatggctcccttat

SEQ ID NO: 288302 - DNA, 25 bp, Mus musculus
atttctacattattggctcccttat

SEQ ID NO: 288303 - DNA, 25 bp, Mus musculus
atttctacctttactgcattgcata

SEQ ID NO: 288304 - DNA, 25 bp, Mus musculus
atttctaccttttctgcattgcata

SEQ ID NO: 288305 - DNA, 25 bp, Mus musculus
atttctacggtaacactcttggctt

SEQ ID NO: 288306 - DNA, 25 bp, Mus musculus
atttctacggtatcactcttggctt

SEQ ID NO: 288307 - DNA, 25 bp, Mus musculus
atttctactgctcactaggcgctgt

SEQ ID NO: 288308 - DNA, 25 bp, Mus musculus
atttctactgctgactaggcgctgt

SEQ ID NO: 288309 - DNA, 25 bp, Mus musculus
atttctactgttaattcccatcttg

SEQ ID NO: 288310 - DNA, 25 bp, Mus musculus
atttctactgtttattcccatcttg

SEQ ID NO: 288311 - DNA, 25 bp, Mus musculus
atttctagaagcacacttttgtgtt

SEQ ID NO: 288312 - DNA, 25 bp, Mus musculus
atttctagaagctcacttttgtgtt

SEQ ID NO: 288313 - DNA, 25 bp, Mus musculus
atttctagaagtacagtgtcctgca

SEQ ID NO: 288314 - DNA, 25 bp, Mus musculus
atttctagaagttcagtgtcctgca

SEQ ID NO: 288315 - DNA, 25 bp, Mus musculus
atttctagaggcaaccctggtggaa

SEQ ID NO: 288316 - DNA, 25 bp, Mus musculus
atttctagaggctaccctggtggaa

SEQ ID NO: 288317 - DNA, 25 bp, Mus musculus
atttctagagttagagtccttgccg

SEQ ID NO: 288318 - DNA, 25 bp, Mus musculus
atttctagagtttgagtccttgccg

SEQ ID NO: 288319 - DNA, 25 bp, Mus musculus
atttctagcaggaattaggctccct

SEQ ID NO: 288320 - DNA, 25 bp, Mus musculus
atttctagcaggtattaggctccct

SEQ ID NO: 288321 - DNA, 25 bp, Mus musculus
atttctagcatgcacgtctgaccaa

SEQ ID NO: 288322 - DNA, 25 bp, Mus musculus
atttctagcatggacgtctgaccaa

SEQ ID NO: 288323 - DNA, 25 bp, Mus musculus
atttctagccagctttcgttctaag

SEQ ID NO: 288324 - DNA, 25 bp, Mus musculus
atttctagccaggtttcgttctaag

SEQ ID NO: 288325 - DNA, 25 bp, Mus musculus
atttctagccttaccgtcagcactg

SEQ ID NO: 288326 - DNA, 25 bp, Mus musculus
atttctagcctttccgtcagcactg

SEQ ID NO: 288327 - DNA, 25 bp, Mus musculus
atttctaggcggcagcagctctgga

SEQ ID NO: 288328 - DNA, 25 bp, Mus musculus
atttctaggcgggagcagctctgga

SEQ ID NO: 288329 - DNA, 25 bp, Mus musculus
atttctaggctgcaaggtgagtttg

SEQ ID NO: 288330 - DNA, 25 bp, Mus musculus
atttctaggctggaaggtgagtttg

SEQ ID NO: 288331 - DNA, 25 bp, Mus musculus
atttctaggcttacataatatggga

SEQ ID NO: 288332 - DNA, 25 bp, Mus musculus
atttctaggctttcataatatggga

SEQ ID NO: 288333 - DNA, 25 bp, Mus musculus
atttctagggaaactgagtctctct

SEQ ID NO: 288334 - DNA, 25 bp, Mus musculus
atttctagggaatctgagtctctct

SEQ ID NO: 288335 - DNA, 25 bp, Mus musculus
atttctaggtttacatgcagtttca

SEQ ID NO: 288336 - DNA, 25 bp, Mus musculus
atttctaggttttcatgcagtttca

SEQ ID NO: 288337 - DNA, 25 bp, Mus musculus
atttctagtgaaatggtcttagcta

SEQ ID NO: 288338 - DNA, 25 bp, Mus musculus
atttctagtgaattggtcttagcta

SEQ ID NO: 288339 - DNA, 25 bp, Mus musculus
atttctagttctctaagtttccaat

SEQ ID NO: 288340 - DNA, 25 bp, Mus musculus
atttctagttctgtaagtttccaat

SEQ ID NO: 288341 - DNA, 25 bp, Mus musculus
atttctataatcataacccgggcat

SEQ ID NO: 288342 - DNA, 25 bp, Mus musculus
atttctataatcttaacccgggcat

SEQ ID NO: 288343 - DNA, 25 bp, Mus musculus
atttctataatgcaaaggttctcaa

SEQ ID NO: 288344 - DNA, 25 bp, Mus musculus
atttctataatggaaaggttctcaa

SEQ ID NO: 288345 - DNA, 25 bp, Mus musculus
atttctatactgagaaccgcataag

SEQ ID NO: 288346 - DNA, 25 bp, Mus musculus
atttctatactgtgaaccgcataag

SEQ ID NO: 288347 - DNA, 25 bp, Mus musculus
atttctatatgcatatctatgccca

SEQ ID NO: 288348 - DNA, 25 bp, Mus musculus
atttctatatgcttatctatgccca

SEQ ID NO: 288349 - DNA, 25 bp, Mus musculus
atttctatcaacagtggttctggca

SEQ ID NO: 288350 - DNA, 25 bp, Mus musculus
atttctatcaactgtggttctggca

SEQ ID NO: 288351 - DNA, 25 bp, Mus musculus
atttctatcatccattccgatgtca

SEQ ID NO: 288352 - DNA, 25 bp, Mus musculus
atttctatcatcgattccgatgtca

SEQ ID NO: 288353 - DNA, 25 bp, Mus musculus
atttctatcctcaatggctgcagtg

SEQ ID NO: 288354 - DNA, 25 bp, Mus musculus
atttctatcctctatggctgcagtg

SEQ ID NO: 288355 - DNA, 25 bp, Mus musculus
atttctatcttaacttctcattatg

SEQ ID NO: 288356 - DNA, 25 bp, Mus musculus
atttctatcttatcttctcattatg

SEQ ID NO: 288357 - DNA, 25 bp, Mus musculus
atttctatgaaaacgcgcttcttga

SEQ ID NO: 288358 - DNA, 25 bp, Mus musculus
atttctatgaaatcgcgcttcttga

SEQ ID NO: 288359 - DNA, 25 bp, Mus musculus
atttctatgaacactgcccattagg

SEQ ID NO: 288360 - DNA, 25 bp, Mus musculus
atttctatgaactctgcccattagg

SEQ ID NO: 288361 - DNA, 25 bp, Mus musculus
atttctatgatacctatacagttgt

SEQ ID NO: 288362 - DNA, 25 bp, Mus musculus
atttctatgatagctatacagttgt

SEQ ID NO: 288363 - DNA, 25 bp, Mus musculus
atttctatgatgctccctggcttct

SEQ ID NO: 288364 - DNA, 25 bp, Mus musculus
atttctatgatggtccctggcttct

SEQ ID NO: 288365 - DNA, 25 bp, Mus musculus
atttctatgcatacctaaaagacag

SEQ ID NO: 288366 - DNA, 25 bp, Mus musculus
atttctatgcattcctaaaagacag

SEQ ID NO: 288367 - DNA, 25 bp, Mus musculus
atttctatgcccatggtgtccagag

SEQ ID NO: 288368 - DNA, 25 bp, Mus musculus
atttctatgcccttggtgtccagag

SEQ ID NO: 288369 - DNA, 25 bp, Mus musculus
atttctatgtagactcgatgatatg

SEQ ID NO: 288370 - DNA, 25 bp, Mus musculus
atttctatgtagtctcgatgatatg

SEQ ID NO: 288371 - DNA, 25 bp, Mus musculus
atttctatgtctcttgctatggcct

SEQ ID NO: 288372 - DNA, 25 bp, Mus musculus
atttctatgtctgttgctatggcct

SEQ ID NO: 288373 - DNA, 25 bp, Mus musculus
atttctatgttaaatcctttgatta

SEQ ID NO: 288374 - DNA, 25 bp, Mus musculus
atttctatgttatatcctttgatta

SEQ ID NO: 288375 - DNA, 25 bp, Mus musculus
atttctattcctaatcctggaggac

SEQ ID NO: 288376 - DNA, 25 bp, Mus musculus
atttctattccttatcctggaggac

SEQ ID NO: 288377 - DNA, 25 bp, Mus musculus
atttctattctacacactggaactt

SEQ ID NO: 288378 - DNA, 25 bp, Mus musculus
atttctattctagacactggaactt

SEQ ID NO: 288379 - DNA, 25 bp, Mus musculus
atttctattgtacctaccacattgg

SEQ ID NO: 288380 - DNA, 25 bp, Mus musculus
atttctattgtagctaccacattgg

SEQ ID NO: 288381 - DNA, 25 bp, Mus musculus
atttctattttactggctctttgat

SEQ ID NO: 288382 - DNA, 25 bp, Mus musculus
atttctattttagtggctctttgat

SEQ ID NO: 288383 - DNA, 25 bp, Mus musculus
atttctcaagctcggcatgatgaca

SEQ ID NO: 288384 - DNA, 25 bp, Mus musculus
atttctcaagctgggcatgatgaca

SEQ ID NO: 288385 - DNA, 25 bp, Mus musculus
atttctcaaggtatccggctgtatc

SEQ ID NO: 288386 - DNA, 25 bp, Mus musculus
atttctcaaggtttccggctgtatc

SEQ ID NO: 288387 - DNA, 25 bp, Mus musculus
atttctcaagttcctcatcactggt

SEQ ID NO: 288388 - DNA, 25 bp, Mus musculus
atttctcaagttgctcatcactggt

SEQ ID NO: 288389 - DNA, 25 bp, Mus musculus
atttctcaatctcgtatgaagaggc

SEQ ID NO: 288390 - DNA, 25 bp, Mus musculus
atttctcaatctggtatgaagaggc

SEQ ID NO: 288391 - DNA, 25 bp, Mus musculus
atttctcacaaacgctcccatgatg

SEQ ID NO: 288392 - DNA, 25 bp, Mus musculus
atttctcacaaaggctcccatgatg

SEQ ID NO: 288393 - DNA, 25 bp, Mus musculus
atttctcacaacatctgccatttaa

SEQ ID NO: 288394 - DNA, 25 bp, Mus musculus
atttctcacaacttctgccatttaa

SEQ ID NO: 288395 - DNA, 25 bp, Mus musculus
atttctcacccactgttggtcacag

SEQ ID NO: 288396 - DNA, 25 bp, Mus musculus
atttctcacccagtgttggtcacag

SEQ ID NO: 288397 - DNA, 25 bp, Mus musculus
atttctcactgcactggacacaagg

SEQ ID NO: 288398 - DNA, 25 bp, Mus musculus
atttctcactgccttgggtttgtgg

SEQ ID NO: 288399 - DNA, 25 bp, Mus musculus
atttctcactgcgttgggtttgtgg

SEQ ID NO: 288400 - DNA, 25 bp, Mus musculus
atttctcactgctctggacacaagg

SEQ ID NO: 288401 - DNA, 25 bp, Mus musculus
atttctcactgtacccaggactttc

SEQ ID NO: 288402 - DNA, 25 bp, Mus musculus
atttctcactgttcccaggactttc

SEQ ID NO: 288403 - DNA, 25 bp, Mus musculus
atttctcacttgactggactggctc

SEQ ID NO: 288404 - DNA, 25 bp, Mus musculus
atttctcacttgtctggactggctc

SEQ ID NO: 288405 - DNA, 25 bp, Mus musculus
atttctcagaatcaagctgttatac

SEQ ID NO: 288406 - DNA, 25 bp, Mus musculus
atttctcagaatgaagctgttatac

SEQ ID NO: 288407 - DNA, 25 bp, Mus musculus
atttctcagacccaaggaccaaagc

SEQ ID NO: 288408 - DNA, 25 bp, Mus musculus
atttctcagaccgaaggaccaaagc

SEQ ID NO: 288409 - DNA, 25 bp, Mus musculus
atttctcagaggatccttatccagc

SEQ ID NO: 288410 - DNA, 25 bp, Mus musculus
atttctcagaggttccttatccagc

SEQ ID NO: 288411 - DNA, 25 bp, Mus musculus
atttctcagatcagctgcgtcgtgg

SEQ ID NO: 288412 - DNA, 25 bp, Mus musculus
atttctcagatctgctgcgtcgtgg

SEQ ID NO: 288413 - DNA, 25 bp, Mus musculus
atttctcagatgcttctggaatcaa

SEQ ID NO: 288414 - DNA, 25 bp, Mus musculus
atttctcagatggttctggaatcaa

SEQ ID NO: 288415 - DNA, 25 bp, Mus musculus
atttctcagctcctcagtttctgct

SEQ ID NO: 288416 - DNA, 25 bp, Mus musculus
atttctcagctcgtcagtttctgct

SEQ ID NO: 288417 - DNA, 25 bp, Mus musculus
atttctcagctgatttgagcccaag

SEQ ID NO: 288418 - DNA, 25 bp, Mus musculus
atttctcagctgttttgagcccaag

SEQ ID NO: 288419 - DNA, 25 bp, Mus musculus
atttctcaggatacctgtgggctct

SEQ ID NO: 288420 - DNA, 25 bp, Mus musculus
atttctcaggattcctgtgggctct

SEQ ID NO: 288421 - DNA, 25 bp, Mus musculus
atttctcagggaacctatgcgggaa

SEQ ID NO: 288422 - DNA, 25 bp, Mus musculus
atttctcagggatcctatgcgggaa

SEQ ID NO: 288423 - DNA, 25 bp, Mus musculus
atttctcagtagcaggccagaagat

SEQ ID NO: 288424 - DNA, 25 bp, Mus musculus
atttctcagtaggaggccagaagat

SEQ ID NO: 288425 - DNA, 25 bp, Mus musculus
atttctcagtgtcttcaatctgtga

SEQ ID NO: 288426 - DNA, 25 bp, Mus musculus
atttctcagtgtgttcaatctgtga

SEQ ID NO: 288427 - DNA, 25 bp, Mus musculus
atttctcagttgattggttcatagc

SEQ ID NO: 288428 - DNA, 25 bp, Mus musculus
atttctcagttgtttggttcatagc

SEQ ID NO: 288429 - DNA, 25 bp, Mus musculus
atttctcatataacctggaggcttt

SEQ ID NO: 288430 - DNA, 25 bp, Mus musculus
atttctcatatatcctggaggcttt

SEQ ID NO: 288431 - DNA, 25 bp, Mus musculus
atttctcatcaaaacctcacgccag

SEQ ID NO: 288432 - DNA, 25 bp, Mus musculus
atttctcatcaatacctcacgccag

SEQ ID NO: 288433 - DNA, 25 bp, Mus musculus
atttctcatcaccactatacatgca

SEQ ID NO: 288434 - DNA, 25 bp, Mus musculus
atttctcatcacgactatacatgca

SEQ ID NO: 288435 - DNA, 25 bp, Mus musculus
atttctcatcttcactgttgctgtt

SEQ ID NO: 288436 - DNA, 25 bp, Mus musculus
atttctcatcttgactgttgctgtt

SEQ ID NO: 288437 - DNA, 25 bp, Mus musculus
atttctcatgcaccaaatgctgtga

SEQ ID NO: 288438 - DNA, 25 bp, Mus musculus
atttctcatgcagcaaatgctgtga

SEQ ID NO: 288439 - DNA, 25 bp, Mus musculus
atttctcattatatacatttgttcc

SEQ ID NO: 288440 - DNA, 25 bp, Mus musculus
atttctcattatttacatttgttcc

SEQ ID NO: 288441 - DNA, 25 bp, Mus musculus
atttctcattcgatttctcaggatt

SEQ ID NO: 288442 - DNA, 25 bp, Mus musculus
atttctcattcgttttctcaggatt

SEQ ID NO: 288443 - DNA, 25 bp, Mus musculus
atttctcattctctagcgtttgtca

SEQ ID NO: 288444 - DNA, 25 bp, Mus musculus
atttctcattctgtagcgtttgtca

SEQ ID NO: 288445 - DNA, 25 bp, Mus musculus
atttctccaactacatcagatcagg

SEQ ID NO: 288446 - DNA, 25 bp, Mus musculus
atttctccaacttcatcagatcagg

SEQ ID NO: 288447 - DNA, 25 bp, Mus musculus
atttctccacgtcgtgctggctaca

SEQ ID NO: 288448 - DNA, 25 bp, Mus musculus
atttctccacgtggtgctggctaca

SEQ ID NO: 288449 - DNA, 25 bp, Mus musculus
atttctccagatagcctcaacagag

SEQ ID NO: 288450 - DNA, 25 bp, Mus musculus
atttctccagattgcctcaacagag

SEQ ID NO: 288451 - DNA, 25 bp, Mus musculus
atttctccagctactgttgccaaca

SEQ ID NO: 288452 - DNA, 25 bp, Mus musculus
atttctccagcttctgttgccaaca

SEQ ID NO: 288453 - DNA, 25 bp, Mus musculus
atttctccagtcataaagttcaagg

SEQ ID NO: 288454 - DNA, 25 bp, Mus musculus
atttctccagtcttaaagttcaagg

SEQ ID NO: 288455 - DNA, 25 bp, Mus musculus
atttctcccaatctttctcaaccat

SEQ ID NO: 288456 - DNA, 25 bp, Mus musculus
atttctcccaatgtttctcaaccat

SEQ ID NO: 288457 - DNA, 25 bp, Mus musculus
atttctcccacgcacaggagacatg

SEQ ID NO: 288458 - DNA, 25 bp, Mus musculus
atttctcccacggacaggagacatg

SEQ ID NO: 288459 - DNA, 25 bp, Mus musculus
atttctcccagtcgtaatgcatatt

SEQ ID NO: 288460 - DNA, 25 bp, Mus musculus
atttctcccagtctaccatgtagca

SEQ ID NO: 288461 - DNA, 25 bp, Mus musculus
atttctcccagtggtaatgcatatt

SEQ ID NO: 288462 - DNA, 25 bp, Mus musculus
atttctcccagtgtaccatgtagca

SEQ ID NO: 288463 - DNA, 25 bp, Mus musculus
atttctcccatacctaggatccatg

SEQ ID NO: 288464 - DNA, 25 bp, Mus musculus
atttctcccatagctaggatccatg

SEQ ID NO: 288465 - DNA, 25 bp, Mus musculus
atttctccctctaatcgcaatatgg

SEQ ID NO: 288466 - DNA, 25 bp, Mus musculus
atttctccctcttatcgcaatatgg

SEQ ID NO: 288467 - DNA, 25 bp, Mus musculus
atttctccctgaactgttagtgttg

SEQ ID NO: 288468 - DNA, 25 bp, Mus musculus
atttctccctgatctgttagtgttg

SEQ ID NO: 288469 - DNA, 25 bp, Mus musculus
atttctccctggaagacactcactg

SEQ ID NO: 288470 - DNA, 25 bp, Mus musculus
atttctccctggtagacactcactg

SEQ ID NO: 288471 - DNA, 25 bp, Mus musculus
atttctccgcaaagggtctgatttt

SEQ ID NO: 288472 - DNA, 25 bp, Mus musculus
atttctccgcaatgggtctgatttt

SEQ ID NO: 288473 - DNA, 25 bp, Mus musculus
atttctcctaccacgtgcatgtgaa

SEQ ID NO: 288474 - DNA, 25 bp, Mus musculus
atttctcctacctcgtgcatgtgaa

SEQ ID NO: 288475 - DNA, 25 bp, Mus musculus
atttctcctcataactagctttaag

SEQ ID NO: 288476 - DNA, 25 bp, Mus musculus
atttctcctcattactagctttaag

SEQ ID NO: 288477 - DNA, 25 bp, Mus musculus
atttctcctctaaagaaaatgcagg

SEQ ID NO: 288478 - DNA, 25 bp, Mus musculus
atttctcctctatagaaaatgcagg

SEQ ID NO: 288479 - DNA, 25 bp, Mus musculus
atttctcctcttaagaataagtggt

SEQ ID NO: 288480 - DNA, 25 bp, Mus musculus
atttctcctctttagaataagtggt

SEQ ID NO: 288481 - DNA, 25 bp, Mus musculus
atttctcctgcacctaacagtttct

SEQ ID NO: 288482 - DNA, 25 bp, Mus musculus
atttctcctgcagctaacagtttct

SEQ ID NO: 288483 - DNA, 25 bp, Mus musculus
atttctcctggtaggtaacaagtca

SEQ ID NO: 288484 - DNA, 25 bp, Mus musculus
atttctcctggttggtaacaagtca

SEQ ID NO: 288485 - DNA, 25 bp, Mus musculus
atttctcctgtgaaagtcccactgg

SEQ ID NO: 288486 - DNA, 25 bp, Mus musculus
atttctcctgtgtaagtcccactgg

SEQ ID NO: 288487 - DNA, 25 bp, Mus musculus
atttctccttcactctctaatgtaa

SEQ ID NO: 288488 - DNA, 25 bp, Mus musculus
atttctccttcagtctctaatgtaa

SEQ ID NO: 288489 - DNA, 25 bp, Mus musculus
atttctccttgaacacatccttaac

SEQ ID NO: 288490 - DNA, 25 bp, Mus musculus
atttctccttgatcacatccttaac

SEQ ID NO: 288491 - DNA, 25 bp, Mus musculus
atttctccttttaagcatggcctct

SEQ ID NO: 288492 - DNA, 25 bp, Mus musculus
atttctcctttttagcatggcctct

SEQ ID NO: 288493 - DNA, 25 bp, Mus musculus
atttctcgaagacgcgcctcagggt

SEQ ID NO: 288494 - DNA, 25 bp, Mus musculus
atttctcgaagaggcgcctcagggt

SEQ ID NO: 288495 - DNA, 25 bp, Mus musculus
atttctcgaggtcccaccgctgaag

SEQ ID NO: 288496 - DNA, 25 bp, Mus musculus
atttctcgaggtgccaccgctgaag

SEQ ID NO: 288497 - DNA, 25 bp, Mus musculus
atttctcgcactctaaatcatggga

SEQ ID NO: 288498 - DNA, 25 bp, Mus musculus
atttctcgcactgtaaatcatggga

SEQ ID NO: 288499 - DNA, 25 bp, Mus musculus
atttctcggaaaagacggaagctac

SEQ ID NO: 288500 - DNA, 25 bp, Mus musculus
atttctcggaaatgacggaagctac

SEQ ID NO: 288501 - DNA, 25 bp, Mus musculus
atttctcggatccaagaccacctgt

SEQ ID NO: 288502 - DNA, 25 bp, Mus musculus
atttctcggatcgaagaccacctgt

SEQ ID NO: 288503 - DNA, 25 bp, Mus musculus
atttctcggcaccagcttccgggtt

SEQ ID NO: 288504 - DNA, 25 bp, Mus musculus
atttctcggcacgagcttccgggtt

SEQ ID NO: 288505 - DNA, 25 bp, Mus musculus
atttctcgtcaccatccatgagtag

SEQ ID NO: 288506 - DNA, 25 bp, Mus musculus
atttctcgtcacgatccatgagtag

SEQ ID NO: 288507 - DNA, 25 bp, Mus musculus
atttctcgtcccattggttgcgtga

SEQ ID NO: 288508 - DNA, 25 bp, Mus musculus
atttctcgtccctttggttgcgtga

SEQ ID NO: 288509 - DNA, 25 bp, Mus musculus
atttctcgtctgaagttttctggca

SEQ ID NO: 288510 - DNA, 25 bp, Mus musculus
atttctcgtctgtagttttctggca

SEQ ID NO: 288511 - DNA, 25 bp, Mus musculus
atttctctaagaccatccgtgatct

SEQ ID NO: 288512 - DNA, 25 bp, Mus musculus
atttctctaagagcatccgtgatct

SEQ ID NO: 288513 - DNA, 25 bp, Mus musculus
atttctctaatgaatgtgtgctcag

SEQ ID NO: 288514 - DNA, 25 bp, Mus musculus
atttctctaatgtatgtgtgctcag

SEQ ID NO: 288515 - DNA, 25 bp, Mus musculus
atttctctacatacctgaaacaatt

SEQ ID NO: 288516 - DNA, 25 bp, Mus musculus
atttctctacattcctgaaacaatt

SEQ ID NO: 288517 - DNA, 25 bp, Mus musculus
atttctctagcccacatatcagtgg

SEQ ID NO: 288518 - DNA, 25 bp, Mus musculus
atttctctagccgacatatcagtgg

SEQ ID NO: 288519 - DNA, 25 bp, Mus musculus
atttctctatctatctgtgtacctc

SEQ ID NO: 288520 - DNA, 25 bp, Mus musculus
atttctctatctttctgtgtacctc

SEQ ID NO: 288521 - DNA, 25 bp, Mus musculus
atttctctcaacctgattctgcaga

SEQ ID NO: 288522 - DNA, 25 bp, Mus musculus
atttctctcaacgtgattctgcaga

SEQ ID NO: 288523 - DNA, 25 bp, Mus musculus
atttctctccgcattcaaaacatgt

SEQ ID NO: 288524 - DNA, 25 bp, Mus musculus
atttctctccgctttcaaaacatgt

SEQ ID NO: 288525 - DNA, 25 bp, Mus musculus
atttctctcctacacttgcttagct

SEQ ID NO: 288526 - DNA, 25 bp, Mus musculus
atttctctcctagacttgcttagct

SEQ ID NO: 288527 - DNA, 25 bp, Mus musculus
atttctctcctcactgagcaatgaa

SEQ ID NO: 288528 - DNA, 25 bp, Mus musculus
atttctctcctctctgagcaatgaa

SEQ ID NO: 288529 - DNA, 25 bp, Mus musculus
atttctctcctgctgtcttttaaca

SEQ ID NO: 288530 - DNA, 25 bp, Mus musculus
atttctctcctggtgtcttttaaca

SEQ ID NO: 288531 - DNA, 25 bp, Mus musculus
atttctctcgttacataaaaggaga

SEQ ID NO: 288532 - DNA, 25 bp, Mus musculus
atttctctcgtttcataaaaggaga

SEQ ID NO: 288533 - DNA, 25 bp, Mus musculus
atttctctctacacacaaacatcac

SEQ ID NO: 288534 - DNA, 25 bp, Mus musculus
atttctctctactcacaaacatcac

SEQ ID NO: 288535 - DNA, 25 bp, Mus musculus
atttctctctgtcttgcacaggatc

SEQ ID NO: 288536 - DNA, 25 bp, Mus musculus
atttctctctgtgttgcacaggatc

SEQ ID NO: 288537 - DNA, 25 bp, Mus musculus
atttctctgaccattctagtgtact

SEQ ID NO: 288538 - DNA, 25 bp, Mus musculus
atttctctgacctttctagtgtact

SEQ ID NO: 288539 - DNA, 25 bp, Mus musculus
atttctctgaggcagctacacattg

SEQ ID NO: 288540 - DNA, 25 bp, Mus musculus
atttctctgagggagctacacattg

SEQ ID NO: 288541 - DNA, 25 bp, Mus musculus
atttctctgatgctgcaagttttaa

SEQ ID NO: 288542 - DNA, 25 bp, Mus musculus
atttctctgatggtgcaagttttaa

SEQ ID NO: 288543 - DNA, 25 bp, Mus musculus
atttctctgcacaattcaggcatct

SEQ ID NO: 288544 - DNA, 25 bp, Mus musculus
atttctctgcacagttgcaaattct

SEQ ID NO: 288545 - DNA, 25 bp, Mus musculus
atttctctgcactattcaggcatct

SEQ ID NO: 288546 - DNA, 25 bp, Mus musculus
atttctctgcactgttgcaaattct

SEQ ID NO: 288547 - DNA, 25 bp, Mus musculus
atttctctgcccctgacttggtaga

SEQ ID NO: 288548 - DNA, 25 bp, Mus musculus
atttctctgcccgtgacttggtaga

SEQ ID NO: 288549 - DNA, 25 bp, Mus musculus
atttctctgcgcatgactggatgtc

SEQ ID NO: 288550 - DNA, 25 bp, Mus musculus
atttctctgcgcttgactggatgtc

SEQ ID NO: 288551 - DNA, 25 bp, Mus musculus
atttctctgctcatgcgcttggtgg

SEQ ID NO: 288552 - DNA, 25 bp, Mus musculus
atttctctgctcttgcgcttggtgg

SEQ ID NO: 288553 - DNA, 25 bp, Mus musculus
atttctctgctgcgcacgcgcggac

SEQ ID NO: 288554 - DNA, 25 bp, Mus musculus
atttctctgctgggcacgcgcggac

SEQ ID NO: 288555 - DNA, 25 bp, Mus musculus
atttctctgcttagtcctttattct

SEQ ID NO: 288556 - DNA, 25 bp, Mus musculus
atttctctgctttgtcctttattct

SEQ ID NO: 288557 - DNA, 25 bp, Mus musculus
atttctctggacatctctatccttc

SEQ ID NO: 288558 - DNA, 25 bp, Mus musculus
atttctctggacttctctatccttc

SEQ ID NO: 288559 - DNA, 25 bp, Mus musculus
atttctctggatactgacccaggct

SEQ ID NO: 288560 - DNA, 25 bp, Mus musculus
atttctctggattctgacccaggct

SEQ ID NO: 288561 - DNA, 25 bp, Mus musculus
atttctctggctctaagatttatca

SEQ ID NO: 288562 - DNA, 25 bp, Mus musculus
atttctctggctgtaagatttatca

SEQ ID NO: 288563 - DNA, 25 bp, Mus musculus
atttctctggtgctagcttgattcg

SEQ ID NO: 288564 - DNA, 25 bp, Mus musculus
atttctctggtggtagcttgattcg

SEQ ID NO: 288565 - DNA, 25 bp, Mus musculus
atttctctggttagatattggtgca

SEQ ID NO: 288566 - DNA, 25 bp, Mus musculus
atttctctggtttgatattggtgca

SEQ ID NO: 288567 - DNA, 25 bp, Mus musculus
atttctctgtaaaaatcaccttggc

SEQ ID NO: 288568 - DNA, 25 bp, Mus musculus
atttctctgtaataatcaccttggc

SEQ ID NO: 288569 - DNA, 25 bp, Mus musculus
atttctctgtacattctttacgcac

SEQ ID NO: 288570 - DNA, 25 bp, Mus musculus
atttctctgtactttctttacgcac

SEQ ID NO: 288571 - DNA, 25 bp, Mus musculus
atttctctgtagactgtaactccta

SEQ ID NO: 288572 - DNA, 25 bp, Mus musculus
atttctctgtagtctgtaactccta

SEQ ID NO: 288573 - DNA, 25 bp, Mus musculus
atttctctgtcactgtaactattgt

SEQ ID NO: 288574 - DNA, 25 bp, Mus musculus
atttctctgtcagtgtaactattgt

SEQ ID NO: 288575 - DNA, 25 bp, Mus musculus
atttctctgtccaatcttgaggtca

SEQ ID NO: 288576 - DNA, 25 bp, Mus musculus
atttctctgtcctatcttgaggtca

SEQ ID NO: 288577 - DNA, 25 bp, Mus musculus
atttctctgtgcacatggagtgggc

SEQ ID NO: 288578 - DNA, 25 bp, Mus musculus
atttctctgtgctcatggagtgggc

SEQ ID NO: 288579 - DNA, 25 bp, Mus musculus
atttctcttcacacatgaatgtggt

SEQ ID NO: 288580 - DNA, 25 bp, Mus musculus
atttctcttcactcatgaatgtggt

SEQ ID NO: 288581 - DNA, 25 bp, Mus musculus
atttctcttcccacactatcagtca

SEQ ID NO: 288582 - DNA, 25 bp, Mus musculus
atttctcttccctcactatcagtca

SEQ ID NO: 288583 - DNA, 25 bp, Mus musculus
atttctcttgacataaagtgctgac

SEQ ID NO: 288584 - DNA, 25 bp, Mus musculus
atttctcttgacttaaagtgctgac

SEQ ID NO: 288585 - DNA, 25 bp, Mus musculus
atttctcttgctaaaatgactgcag

SEQ ID NO: 288586 - DNA, 25 bp, Mus musculus
atttctcttgcttaaatgactgcag

SEQ ID NO: 288587 - DNA, 25 bp, Mus musculus
atttctcttgttaatggttattatc

SEQ ID NO: 288588 - DNA, 25 bp, Mus musculus
atttctcttgtttatggttattatc

SEQ ID NO: 288589 - DNA, 25 bp, Mus musculus
atttctctttaaacctgaggcttgg

SEQ ID NO: 288590 - DNA, 25 bp, Mus musculus
atttctctttaatcctgaggcttgg

SEQ ID NO: 288591 - DNA, 25 bp, Mus musculus
atttctctttagacactggtaaact

SEQ ID NO: 288592 - DNA, 25 bp, Mus musculus
atttctctttagtcactggtaaact

SEQ ID NO: 288593 - DNA, 25 bp, Mus musculus
atttctctttatacagtagtgctgc

SEQ ID NO: 288594 - DNA, 25 bp, Mus musculus
atttctctttatactcctgtgcaga

SEQ ID NO: 288595 - DNA, 25 bp, Mus musculus
atttctctttattcagtagtgctgc

SEQ ID NO: 288596 - DNA, 25 bp, Mus musculus
atttctctttattctcctgtgcaga

SEQ ID NO: 288597 - DNA, 25 bp, Mus musculus
atttctctttcacctgtaatgttct

SEQ ID NO: 288598 - DNA, 25 bp, Mus musculus
atttctctttcagctgtaatgttct

SEQ ID NO: 288599 - DNA, 25 bp, Mus musculus
atttctctttctatcattatagctg

SEQ ID NO: 288600 - DNA, 25 bp, Mus musculus
atttctctttctttcattatagctg

SEQ ID NO: 288601 - DNA, 25 bp, Mus musculus
atttctctttgaagcgtggtgcgtg

SEQ ID NO: 288602 - DNA, 25 bp, Mus musculus
atttctctttgaattccatggagcc

SEQ ID NO: 288603 - DNA, 25 bp, Mus musculus
atttctctttgatgcgtggtgcgtg

SEQ ID NO: 288604 - DNA, 25 bp, Mus musculus
atttctctttgatttccatggagcc

SEQ ID NO: 288605 - DNA, 25 bp, Mus musculus
atttctgaaaacacgggatgacctg

SEQ ID NO: 288606 - DNA, 25 bp, Mus musculus
atttctgaaaactcgggatgacctg

SEQ ID NO: 288607 - DNA, 25 bp, Mus musculus
atttctgaaacccaactcttgcaac

SEQ ID NO: 288608 - DNA, 25 bp, Mus musculus
atttctgaaaccgaactcttgcaac

SEQ ID NO: 288609 - DNA, 25 bp, Mus musculus
atttctgaaattctggatcttcctc

SEQ ID NO: 288610 - DNA, 25 bp, Mus musculus
atttctgaaattgtggatcttcctc

SEQ ID NO: 288611 - DNA, 25 bp, Mus musculus
atttctgaacggatgcttttcttgc

SEQ ID NO: 288612 - DNA, 25 bp, Mus musculus
atttctgaacggttgcttttcttgc

SEQ ID NO: 288613 - DNA, 25 bp, Mus musculus
atttctgaactgcttctgcgcatgt

SEQ ID NO: 288614 - DNA, 25 bp, Mus musculus
atttctgaactggttctgcgcatgt

SEQ ID NO: 288615 - DNA, 25 bp, Mus musculus
atttctgaacttattagtgcttagt

SEQ ID NO: 288616 - DNA, 25 bp, Mus musculus
atttctgaactttttagtgcttagt

SEQ ID NO: 288617 - DNA, 25 bp, Mus musculus
atttctgaatcaactaccttagtag

SEQ ID NO: 288618 - DNA, 25 bp, Mus musculus
atttctgaatcatctaccttagtag

SEQ ID NO: 288619 - DNA, 25 bp, Mus musculus
atttctgacaacagtgttcctggcc

SEQ ID NO: 288620 - DNA, 25 bp, Mus musculus
atttctgacaactgtgttcctggcc

SEQ ID NO: 288621 - DNA, 25 bp, Mus musculus
atttctgaccagacagcaggcagtt

SEQ ID NO: 288622 - DNA, 25 bp, Mus musculus
atttctgaccagtcagcaggcagtt

SEQ ID NO: 288623 - DNA, 25 bp, Mus musculus
atttctgacctcagtttccgaaggg

SEQ ID NO: 288624 - DNA, 25 bp, Mus musculus
atttctgacctctgtttccgaaggg

SEQ ID NO: 288625 - DNA, 25 bp, Mus musculus
atttctgaccttaacaattctggga

SEQ ID NO: 288626 - DNA, 25 bp, Mus musculus
atttctgacctttacaattctggga

SEQ ID NO: 288627 - DNA, 25 bp, Mus musculus
atttctgactcccttaggcagtttc

SEQ ID NO: 288628 - DNA, 25 bp, Mus musculus
atttctgactccgttaggcagtttc

SEQ ID NO: 288629 - DNA, 25 bp, Mus musculus
atttctgactgcagatgagtacccc

SEQ ID NO: 288630 - DNA, 25 bp, Mus musculus
atttctgactgctgatgagtacccc

SEQ ID NO: 288631 - DNA, 25 bp, Mus musculus
atttctgactggaggaactgcacga

SEQ ID NO: 288632 - DNA, 25 bp, Mus musculus
atttctgactggtggaactgcacga

SEQ ID NO: 288633 - DNA, 25 bp, Mus musculus
atttctgagaataccccatcttggt

SEQ ID NO: 288634 - DNA, 25 bp, Mus musculus
atttctgagaattccccatcttggt

SEQ ID NO: 288635 - DNA, 25 bp, Mus musculus
atttctgagccaacatttgtgtgtg

SEQ ID NO: 288636 - DNA, 25 bp, Mus musculus
atttctgagccatcatttgtgtgtg

SEQ ID NO: 288637 - DNA, 25 bp, Mus musculus
atttctgagcgccaccagagggaca

SEQ ID NO: 288638 - DNA, 25 bp, Mus musculus
atttctgagcgcgaccagagggaca

SEQ ID NO: 288639 - DNA, 25 bp, Mus musculus
atttctgaggacctggtgtggttct

SEQ ID NO: 288640 - DNA, 25 bp, Mus musculus
atttctgaggacgtggtgtggttct

SEQ ID NO: 288641 - DNA, 25 bp, Mus musculus
atttctgaggttctaggtttggcta

SEQ ID NO: 288642 - DNA, 25 bp, Mus musculus
atttctgaggttgtaggtttggcta

SEQ ID NO: 288643 - DNA, 25 bp, Mus musculus
atttctgagtatatcgagtggtaca

SEQ ID NO: 288644 - DNA, 25 bp, Mus musculus
atttctgagtatttcgagtggtaca

SEQ ID NO: 288645 - DNA, 25 bp, Mus musculus
atttctgatacgcttagctgcgctg

SEQ ID NO: 288646 - DNA, 25 bp, Mus musculus
atttctgatacggttagctgcgctg

SEQ ID NO: 288647 - DNA, 25 bp, Mus musculus
atttctgataggagagcttgccctg

SEQ ID NO: 288648 - DNA, 25 bp, Mus musculus
atttctgataggtgagcttgccctg

SEQ ID NO: 288649 - DNA, 25 bp, Mus musculus
atttctgatcctattctttgaggta

SEQ ID NO: 288650 - DNA, 25 bp, Mus musculus
atttctgatccttttctttgaggta

SEQ ID NO: 288651 - DNA, 25 bp, Mus musculus
atttctgatgatcgcaaaccttgct

SEQ ID NO: 288652 - DNA, 25 bp, Mus musculus
atttctgatgatggcaaaccttgct

SEQ ID NO: 288653 - DNA, 25 bp, Mus musculus
atttctgatgctcccaaagatctgg

SEQ ID NO: 288654 - DNA, 25 bp, Mus musculus
atttctgatgctgccaaagatctgg

SEQ ID NO: 288655 - DNA, 25 bp, Mus musculus
atttctgatggtccgctggcgattg

SEQ ID NO: 288656 - DNA, 25 bp, Mus musculus
atttctgatggtgcgctggcgattg

SEQ ID NO: 288657 - DNA, 25 bp, Mus musculus
atttctgattacagtgtgcttccta

SEQ ID NO: 288658 - DNA, 25 bp, Mus musculus
atttctgattactgtgtgcttccta

SEQ ID NO: 288659 - DNA, 25 bp, Mus musculus
atttctgcaaccatcattcagtacc

SEQ ID NO: 288660 - DNA, 25 bp, Mus musculus
atttctgcaaccttcattcagtacc

SEQ ID NO: 288661 - DNA, 25 bp, Mus musculus
atttctgcaactcgttacgtggcct

SEQ ID NO: 288662 - DNA, 25 bp, Mus musculus
atttctgcaactggttacgtggcct

SEQ ID NO: 288663 - DNA, 25 bp, Mus musculus
atttctgcaagcctcttctgacttc

SEQ ID NO: 288664 - DNA, 25 bp, Mus musculus
atttctgcaagcgtcttctgacttc

SEQ ID NO: 288665 - DNA, 25 bp, Mus musculus
atttctgcacctattgttggctttc

SEQ ID NO: 288666 - DNA, 25 bp, Mus musculus
atttctgcaccttttgttggctttc

SEQ ID NO: 288667 - DNA, 25 bp, Mus musculus
atttctgcatacctcggcatagtgg

SEQ ID NO: 288668 - DNA, 25 bp, Mus musculus
atttctgcatacgtcggcatagtgg

SEQ ID NO: 288669 - DNA, 25 bp, Mus musculus
atttctgcatcaatacttacctgta

SEQ ID NO: 288670 - DNA, 25 bp, Mus musculus
atttctgcatcattacttacctgta

SEQ ID NO: 288671 - DNA, 25 bp, Mus musculus
atttctgcattcactgtttgctagt

SEQ ID NO: 288672 - DNA, 25 bp, Mus musculus
atttctgcattctctgtttgctagt

SEQ ID NO: 288673 - DNA, 25 bp, Mus musculus
atttctgcatttcacatttgtatac

SEQ ID NO: 288674 - DNA, 25 bp, Mus musculus
atttctgcatttgacatttgtatac

SEQ ID NO: 288675 - DNA, 25 bp, Mus musculus
atttctgccaagcaagtcgcacaaa

SEQ ID NO: 288676 - DNA, 25 bp, Mus musculus
atttctgccaaggaagtcgcacaaa

SEQ ID NO: 288677 - DNA, 25 bp, Mus musculus
atttctgccagcaagagtgttcctg

SEQ ID NO: 288678 - DNA, 25 bp, Mus musculus
atttctgccagctagagtgttcctg

SEQ ID NO: 288679 - DNA, 25 bp, Mus musculus
atttctgccatgcagctgtcattgc

SEQ ID NO: 288680 - DNA, 25 bp, Mus musculus
atttctgccatggagctgtcattgc

SEQ ID NO: 288681 - DNA, 25 bp, Mus musculus
atttctgcccagattgtggctcagt

SEQ ID NO: 288682 - DNA, 25 bp, Mus musculus
atttctgcccagtttgtggctcagt

SEQ ID NO: 288683 - DNA, 25 bp, Mus musculus
atttctgccctgctgcctaatagtg

SEQ ID NO: 288684 - DNA, 25 bp, Mus musculus
atttctgccctggtgcctaatagtg

SEQ ID NO: 288685 - DNA, 25 bp, Mus musculus
atttctgcccttacactgtgtgcag

SEQ ID NO: 288686 - DNA, 25 bp, Mus musculus
atttctgccctttcactgtgtgcag

SEQ ID NO: 288687 - DNA, 25 bp, Mus musculus
atttctgccgtgcatgcacatctat

SEQ ID NO: 288688 - DNA, 25 bp, Mus musculus
atttctgccgtggatgcacatctat

SEQ ID NO: 288689 - DNA, 25 bp, Mus musculus
atttctgcctctacaggttaggatt

SEQ ID NO: 288690 - DNA, 25 bp, Mus musculus
atttctgcctcttcaggttaggatt

SEQ ID NO: 288691 - DNA, 25 bp, Mus musculus
atttctgcgctgactgatgctagca

SEQ ID NO: 288692 - DNA, 25 bp, Mus musculus
atttctgcgctgtctgatgctagca

SEQ ID NO: 288693 - DNA, 25 bp, Mus musculus
atttctgctcctattctactttttg

SEQ ID NO: 288694 - DNA, 25 bp, Mus musculus
atttctgctcctcctgatgtccatc

SEQ ID NO: 288695 - DNA, 25 bp, Mus musculus
atttctgctcctgctgatgtccatc

SEQ ID NO: 288696 - DNA, 25 bp, Mus musculus
atttctgctccttttctactttttg

SEQ ID NO: 288697 - DNA, 25 bp, Mus musculus
atttctgctctcaacagcattgctg

SEQ ID NO: 288698 - DNA, 25 bp, Mus musculus
atttctgctctctacagcattgctg

SEQ ID NO: 288699 - DNA, 25 bp, Mus musculus
atttctgctgcaattctcttgtgac

SEQ ID NO: 288700 - DNA, 25 bp, Mus musculus
atttctgctgcatttctcttgtgac

SEQ ID NO: 288701 - DNA, 25 bp, Mus musculus
atttctgctgctattgatgttgcaa

SEQ ID NO: 288702 - DNA, 25 bp, Mus musculus
atttctgctgcttttgatgttgcaa

SEQ ID NO: 288703 - DNA, 25 bp, Mus musculus
atttctgctgttcatattccactct

SEQ ID NO: 288704 - DNA, 25 bp, Mus musculus
atttctgctgttgatattccactct

SEQ ID NO: 288705 - DNA, 25 bp, Mus musculus
atttctgcttaacatggtcatagtc

SEQ ID NO: 288706 - DNA, 25 bp, Mus musculus
atttctgcttaagatggtcatagtc

SEQ ID NO: 288707 - DNA, 25 bp, Mus musculus
atttctgcttcaatctcagatgcgc

SEQ ID NO: 288708 - DNA, 25 bp, Mus musculus
atttctgcttcattctcagatgcgc

SEQ ID NO: 288709 - DNA, 25 bp, Mus musculus
atttctgcttccaatgcaggtgcaa

SEQ ID NO: 288710 - DNA, 25 bp, Mus musculus
atttctgcttccacctattttccaa

SEQ ID NO: 288711 - DNA, 25 bp, Mus musculus
atttctgcttcctatgcaggtgcaa

SEQ ID NO: 288712 - DNA, 25 bp, Mus musculus
atttctgcttcctcctattttccaa

SEQ ID NO: 288713 - DNA, 25 bp, Mus musculus
atttctgctttgatccatactgaga

SEQ ID NO: 288714 - DNA, 25 bp, Mus musculus
atttctgctttgttccatactgaga

SEQ ID NO: 288715 - DNA, 25 bp, Mus musculus
atttctggaaaccacaattgcccat

SEQ ID NO: 288716 - DNA, 25 bp, Mus musculus
atttctggaaacgacaattgcccat

SEQ ID NO: 288717 - DNA, 25 bp, Mus musculus
atttctggaaatctgcgtgtgcgtg

SEQ ID NO: 288718 - DNA, 25 bp, Mus musculus
atttctggaaatgtgcgtgtgcgtg

SEQ ID NO: 288719 - DNA, 25 bp, Mus musculus
atttctggacaaatcatatggacat

SEQ ID NO: 288720 - DNA, 25 bp, Mus musculus
atttctggacaattcatatggacat

SEQ ID NO: 288721 - DNA, 25 bp, Mus musculus
atttctggacatcttcatgggctgt

SEQ ID NO: 288722 - DNA, 25 bp, Mus musculus
atttctggacatgttcatgggctgt

SEQ ID NO: 288723 - DNA, 25 bp, Mus musculus
atttctggactgactccgataaaag

SEQ ID NO: 288724 - DNA, 25 bp, Mus musculus
atttctggactgtctccgataaaag

SEQ ID NO: 288725 - DNA, 25 bp, Mus musculus
atttctggaggtatccatgacactt

SEQ ID NO: 288726 - DNA, 25 bp, Mus musculus
atttctggaggtttccatgacactt

SEQ ID NO: 288727 - DNA, 25 bp, Mus musculus
atttctggagttccaatggtctcaa

SEQ ID NO: 288728 - DNA, 25 bp, Mus musculus
atttctggagttgcaatggtctcaa

SEQ ID NO: 288729 - DNA, 25 bp, Mus musculus
atttctggatgtattgagtcccctg

SEQ ID NO: 288730 - DNA, 25 bp, Mus musculus
atttctggatgttttgagtcccctg

SEQ ID NO: 288731 - DNA, 25 bp, Mus musculus
atttctggatttctggatttcctgg

SEQ ID NO: 288732 - DNA, 25 bp, Mus musculus
atttctggatttgtggatttcctgg

SEQ ID NO: 288733 - DNA, 25 bp, Mus musculus
atttctggcaaaatctgtgcaccac

SEQ ID NO: 288734 - DNA, 25 bp, Mus musculus
atttctggcaaattctgtgcaccac

SEQ ID NO: 288735 - DNA, 25 bp, Mus musculus
atttctggcactcgaggtttcattt

SEQ ID NO: 288736 - DNA, 25 bp, Mus musculus
atttctggcactggaggtttcattt

SEQ ID NO: 288737 - DNA, 25 bp, Mus musculus
atttctggcatgagcgaggttccgc

SEQ ID NO: 288738 - DNA, 25 bp, Mus musculus
atttctggcatgtgcgaggttccgc

SEQ ID NO: 288739 - DNA, 25 bp, Mus musculus
atttctggccctagtgccttacaaa

SEQ ID NO: 288740 - DNA, 25 bp, Mus musculus
atttctggccctcggaattaggctt

SEQ ID NO: 288741 - DNA, 25 bp, Mus musculus
atttctggccctgggaattaggctt

SEQ ID NO: 288742 - DNA, 25 bp, Mus musculus
atttctggcccttgtgccttacaaa

SEQ ID NO: 288743 - DNA, 25 bp, Mus musculus
atttctgggagtagtgtaccctcct

SEQ ID NO: 288744 - DNA, 25 bp, Mus musculus
atttctgggagttgtgtaccctcct

SEQ ID NO: 288745 - DNA, 25 bp, Mus musculus
atttctgggcagagcaggtgatagc

SEQ ID NO: 288746 - DNA, 25 bp, Mus musculus
atttctgggcagtgcaggtgatagc

SEQ ID NO: 288747 - DNA, 25 bp, Mus musculus
atttctgggccacaggctactgttc

SEQ ID NO: 288748 - DNA, 25 bp, Mus musculus
atttctgggccagaggctactgttc

SEQ ID NO: 288749 - DNA, 25 bp, Mus musculus
atttctggggcccaattcccttcag

SEQ ID NO: 288750 - DNA, 25 bp, Mus musculus
atttctggggccgaattcccttcag

SEQ ID NO: 288751 - DNA, 25 bp, Mus musculus
atttctgggtatatcttttgtgcac

SEQ ID NO: 288752 - DNA, 25 bp, Mus musculus
atttctgggtatttcttttgtgcac

SEQ ID NO: 288753 - DNA, 25 bp, Mus musculus
atttctgggtggatgctagctcaca

SEQ ID NO: 288754 - DNA, 25 bp, Mus musculus
atttctgggtggttgctagctcaca

SEQ ID NO: 288755 - DNA, 25 bp, Mus musculus
atttctgggttccatatacagtacc

SEQ ID NO: 288756 - DNA, 25 bp, Mus musculus
atttctgggttcgatatacagtacc

SEQ ID NO: 288757 - DNA, 25 bp, Mus musculus
atttctggtagtcggtagtcatcaa

SEQ ID NO: 288758 - DNA, 25 bp, Mus musculus
atttctggtagtgggtagtcatcaa

SEQ ID NO: 288759 - DNA, 25 bp, Mus musculus
atttctggttgacacaccatggcgc

SEQ ID NO: 288760 - DNA, 25 bp, Mus musculus
atttctggttgagacaccatggcgc

SEQ ID NO: 288761 - DNA, 25 bp, Mus musculus
atttctggtttaattagctgacaaa

SEQ ID NO: 288762 - DNA, 25 bp, Mus musculus
atttctggtttatttagctgacaaa

SEQ ID NO: 288763 - DNA, 25 bp, Mus musculus
atttctgtaaacacaactacttagt

SEQ ID NO: 288764 - DNA, 25 bp, Mus musculus
atttctgtaaactcaactacttagt

SEQ ID NO: 288765 - DNA, 25 bp, Mus musculus
atttctgtaaagaaaagcccatgca

SEQ ID NO: 288766 - DNA, 25 bp, Mus musculus
atttctgtaaagtaaagcccatgca

SEQ ID NO: 288767 - DNA, 25 bp, Mus musculus
atttctgtaagacctggagtgccca

SEQ ID NO: 288768 - DNA, 25 bp, Mus musculus
atttctgtaagagctggagtgccca

SEQ ID NO: 288769 - DNA, 25 bp, Mus musculus
atttctgtaattatctttgctgttg

SEQ ID NO: 288770 - DNA, 25 bp, Mus musculus
atttctgtaattcccaaatgcctaa

SEQ ID NO: 288771 - DNA, 25 bp, Mus musculus
atttctgtaattgccaaatgcctaa

SEQ ID NO: 288772 - DNA, 25 bp, Mus musculus
atttctgtaattttctttgctgttg

SEQ ID NO: 288773 - DNA, 25 bp, Mus musculus
atttctgtacacactgttctcttgt

SEQ ID NO: 288774 - DNA, 25 bp, Mus musculus
atttctgtacactctgttctcttgt

SEQ ID NO: 288775 - DNA, 25 bp, Mus musculus
atttctgtacatctggctttattta

SEQ ID NO: 288776 - DNA, 25 bp, Mus musculus
atttctgtacatgtggctttattta

SEQ ID NO: 288777 - DNA, 25 bp, Mus musculus
atttctgtaggtctgtgtctctgtg

SEQ ID NO: 288778 - DNA, 25 bp, Mus musculus
atttctgtaggtgtgtgtctctgtg

SEQ ID NO: 288779 - DNA, 25 bp, Mus musculus
atttctgtagttccacaagaactga

SEQ ID NO: 288780 - DNA, 25 bp, Mus musculus
atttctgtagttgcacaagaactga

SEQ ID NO: 288781 - DNA, 25 bp, Mus musculus
atttctgtattaaccatcatgcgca

SEQ ID NO: 288782 - DNA, 25 bp, Mus musculus
atttctgtattaatccccttcaagc

SEQ ID NO: 288783 - DNA, 25 bp, Mus musculus
atttctgtattatccatcatgcgca

SEQ ID NO: 288784 - DNA, 25 bp, Mus musculus
atttctgtattattccccttcaagc

SEQ ID NO: 288785 - DNA, 25 bp, Mus musculus
atttctgtcacaatgtggcagcacc

SEQ ID NO: 288786 - DNA, 25 bp, Mus musculus
atttctgtcacattgtggcagcacc

SEQ ID NO: 288787 - DNA, 25 bp, Mus musculus
atttctgtcatgattgctgactcca

SEQ ID NO: 288788 - DNA, 25 bp, Mus musculus
atttctgtcatgtttgctgactcca

SEQ ID NO: 288789 - DNA, 25 bp, Mus musculus
atttctgtccatacccaaagaccgg

SEQ ID NO: 288790 - DNA, 25 bp, Mus musculus
atttctgtccattcccaaagaccgg

SEQ ID NO: 288791 - DNA, 25 bp, Mus musculus
atttctgtcctaaaggctgttcctt

SEQ ID NO: 288792 - DNA, 25 bp, Mus musculus
atttctgtcctataggctgttcctt

SEQ ID NO: 288793 - DNA, 25 bp, Mus musculus
atttctgtcctcagcagtggacaca

SEQ ID NO: 288794 - DNA, 25 bp, Mus musculus
atttctgtcctctgcagtggacaca

SEQ ID NO: 288795 - DNA, 25 bp, Mus musculus
atttctgtcgacacgccattaacaa

SEQ ID NO: 288796 - DNA, 25 bp, Mus musculus
atttctgtcgactcgccattaacaa

SEQ ID NO: 288797 - DNA, 25 bp, Mus musculus
atttctgtcgtgacacattcagcct

SEQ ID NO: 288798 - DNA, 25 bp, Mus musculus
atttctgtcgtgtcacattcagcct

SEQ ID NO: 288799 - DNA, 25 bp, Mus musculus
atttctgtctttcgctcttgtctga

SEQ ID NO: 288800 - DNA, 25 bp, Mus musculus
atttctgtctttggctcttgtctga

SEQ ID NO: 288801 - DNA, 25 bp, Mus musculus
atttctgtgacgaatggaacccata

SEQ ID NO: 288802 - DNA, 25 bp, Mus musculus
atttctgtgacgtatggaacccata

SEQ ID NO: 288803 - DNA, 25 bp, Mus musculus
atttctgtgactacagctttgaaag

SEQ ID NO: 288804 - DNA, 25 bp, Mus musculus
atttctgtgacttcagctttgaaag

SEQ ID NO: 288805 - DNA, 25 bp, Mus musculus
atttctgtgattagtatttgctgcc

SEQ ID NO: 288806 - DNA, 25 bp, Mus musculus
atttctgtgatttgtatttgctgcc

SEQ ID NO: 288807 - DNA, 25 bp, Mus musculus
atttctgtgcctacaaaatccccta

SEQ ID NO: 288808 - DNA, 25 bp, Mus musculus
atttctgtgccttcaaaatccccta

SEQ ID NO: 288809 - DNA, 25 bp, Mus musculus
atttctgtgggtacgggactactga

SEQ ID NO: 288810 - DNA, 25 bp, Mus musculus
atttctgtgggtagcggaaggcctt

SEQ ID NO: 288811 - DNA, 25 bp, Mus musculus
atttctgtgggttcgggactactga

SEQ ID NO: 288812 - DNA, 25 bp, Mus musculus
atttctgtgggttgcggaaggcctt

SEQ ID NO: 288813 - DNA, 25 bp, Mus musculus
atttctgtggtcactattcagcttg

SEQ ID NO: 288814 - DNA, 25 bp, Mus musculus
atttctgtggtcagggtacattcct

SEQ ID NO: 288815 - DNA, 25 bp, Mus musculus
atttctgtggtctctattcagcttg

SEQ ID NO: 288816 - DNA, 25 bp, Mus musculus
atttctgtggtctgggtacattcct

SEQ ID NO: 288817 - DNA, 25 bp, Mus musculus
atttctgtgtgaacctgaaccttct

SEQ ID NO: 288818 - DNA, 25 bp, Mus musculus
atttctgtgtgatcctgaaccttct

SEQ ID NO: 288819 - DNA, 25 bp, Mus musculus
atttctgtgtttcatgcagtcctct

SEQ ID NO: 288820 - DNA, 25 bp, Mus musculus
atttctgtgtttgatgcagtcctct

SEQ ID NO: 288821 - DNA, 25 bp, Mus musculus
atttctgttaacagaacattggcag

SEQ ID NO: 288822 - DNA, 25 bp, Mus musculus
atttctgttaactgaacattggcag

SEQ ID NO: 288823 - DNA, 25 bp, Mus musculus
atttctgttagaaggtgacactgtt

SEQ ID NO: 288824 - DNA, 25 bp, Mus musculus
atttctgttagatggtgacactgtt

SEQ ID NO: 288825 - DNA, 25 bp, Mus musculus
atttctgttcaaaccaccacgccaa

SEQ ID NO: 288826 - DNA, 25 bp, Mus musculus
atttctgttcaatccaccacgccaa

SEQ ID NO: 288827 - DNA, 25 bp, Mus musculus
atttctgttcagaagagtttcctgt

SEQ ID NO: 288828 - DNA, 25 bp, Mus musculus
atttctgttcagtagagtttcctgt

SEQ ID NO: 288829 - DNA, 25 bp, Mus musculus
atttctgttcatctattagcttatc

SEQ ID NO: 288830 - DNA, 25 bp, Mus musculus
atttctgttcatgtattagcttatc

SEQ ID NO: 288831 - DNA, 25 bp, Mus musculus
atttctgttccacggatatactccc

SEQ ID NO: 288832 - DNA, 25 bp, Mus musculus
atttctgttccagggatatactccc

SEQ ID NO: 288833 - DNA, 25 bp, Mus musculus
atttctgttcccagctatgaaaagt

SEQ ID NO: 288834 - DNA, 25 bp, Mus musculus
atttctgttccctgctatgaaaagt

SEQ ID NO: 288835 - DNA, 25 bp, Mus musculus
atttctgttctccagtttatacacc

SEQ ID NO: 288836 - DNA, 25 bp, Mus musculus
atttctgttctcgagtttatacacc

SEQ ID NO: 288837 - DNA, 25 bp, Mus musculus
atttctgttctgctcttcgttggga

SEQ ID NO: 288838 - DNA, 25 bp, Mus musculus
atttctgttctggtcttcgttggga

SEQ ID NO: 288839 - DNA, 25 bp, Mus musculus
atttctgttgagcatcacttggaca

SEQ ID NO: 288840 - DNA, 25 bp, Mus musculus
atttctgttgaggatcacttggaca

SEQ ID NO: 288841 - DNA, 25 bp, Mus musculus
atttctgttgatacgttgcccacta

SEQ ID NO: 288842 - DNA, 25 bp, Mus musculus
atttctgttgattcgttgcccacta

SEQ ID NO: 288843 - DNA, 25 bp, Mus musculus
atttctgttgccatagttttgtatt

SEQ ID NO: 288844 - DNA, 25 bp, Mus musculus
atttctgttgccttagttttgtatt

SEQ ID NO: 288845 - DNA, 25 bp, Mus musculus
atttctgttggtacaaggtgttcta

SEQ ID NO: 288846 - DNA, 25 bp, Mus musculus
atttctgttggttcaaggtgttcta

SEQ ID NO: 288847 - DNA, 25 bp, Mus musculus
atttctgttgtcaggtttgtggtac

SEQ ID NO: 288848 - DNA, 25 bp, Mus musculus
atttctgttgtcattatggcgtgtg

SEQ ID NO: 288849 - DNA, 25 bp, Mus musculus
atttctgttgtctggtttgtggtac

SEQ ID NO: 288850 - DNA, 25 bp, Mus musculus
atttctgttgtctttatggcgtgtg

SEQ ID NO: 288851 - DNA, 25 bp, Mus musculus
atttctgttgttctcaagccactgc

SEQ ID NO: 288852 - DNA, 25 bp, Mus musculus
atttctgttgttgtcaagccactgc

SEQ ID NO: 288853 - DNA, 25 bp, Mus musculus
atttctgtttcaaccatcactttgc

SEQ ID NO: 288854 - DNA, 25 bp, Mus musculus
atttctgtttcatccatcactttgc

SEQ ID NO: 288855 - DNA, 25 bp, Mus musculus
atttctgtttccaatcagcatgtaa

SEQ ID NO: 288856 - DNA, 25 bp, Mus musculus
atttctgtttccatctgtcttagtg

SEQ ID NO: 288857 - DNA, 25 bp, Mus musculus
atttctgtttccatggacctcataa

SEQ ID NO: 288858 - DNA, 25 bp, Mus musculus
atttctgtttcctatcagcatgtaa

SEQ ID NO: 288859 - DNA, 25 bp, Mus musculus
atttctgtttccttctgtcttagtg

SEQ ID NO: 288860 - DNA, 25 bp, Mus musculus
atttctgtttccttggacctcataa

SEQ ID NO: 288861 - DNA, 25 bp, Mus musculus
atttctgtttggctgcatccttaac

SEQ ID NO: 288862 - DNA, 25 bp, Mus musculus
atttctgtttgggtgcatccttaac

SEQ ID NO: 288863 - DNA, 25 bp, Mus musculus
atttctgttttcagtaggaacatgg

SEQ ID NO: 288864 - DNA, 25 bp, Mus musculus
atttctgttttctgtaggaacatgg

SEQ ID NO: 288865 - DNA, 25 bp, Mus musculus
atttctgtttttctctattgctgca

SEQ ID NO: 288866 - DNA, 25 bp, Mus musculus
atttctgtttttgtctattgctgca

SEQ ID NO: 288867 - DNA, 25 bp, Mus musculus
atttcttaaagcagcagacactgca

SEQ ID NO: 288868 - DNA, 25 bp, Mus musculus
atttcttaaagctgcagacactgca

SEQ ID NO: 288869 - DNA, 25 bp, Mus musculus
atttcttaagagctactatgatcga

SEQ ID NO: 288870 - DNA, 25 bp, Mus musculus
atttcttaagaggtactatgatcga

SEQ ID NO: 288871 - DNA, 25 bp, Mus musculus
atttcttaagtcatgcaaggtccaa

SEQ ID NO: 288872 - DNA, 25 bp, Mus musculus
atttcttaagtcttgcaaggtccaa

SEQ ID NO: 288873 - DNA, 25 bp, Mus musculus
atttcttaatccaactttgcagtgt

SEQ ID NO: 288874 - DNA, 25 bp, Mus musculus
atttcttaatcctactttgcagtgt

SEQ ID NO: 288875 - DNA, 25 bp, Mus musculus
atttcttactggcacagtaggtacc

SEQ ID NO: 288876 - DNA, 25 bp, Mus musculus
atttcttactgggacagtaggtacc

SEQ ID NO: 288877 - DNA, 25 bp, Mus musculus
atttcttactgtcccgagaagccgc

SEQ ID NO: 288878 - DNA, 25 bp, Mus musculus
atttcttactgtcctgggattgcaa

SEQ ID NO: 288879 - DNA, 25 bp, Mus musculus
atttcttactgtgccgagaagccgc

SEQ ID NO: 288880 - DNA, 25 bp, Mus musculus
atttcttactgtgctgggattgcaa

SEQ ID NO: 288881 - DNA, 25 bp, Mus musculus
atttcttacttgatcgggactacag

SEQ ID NO: 288882 - DNA, 25 bp, Mus musculus
atttcttacttgttcgggactacag

SEQ ID NO: 288883 - DNA, 25 bp, Mus musculus
atttcttagattctcactgtttcct

SEQ ID NO: 288884 - DNA, 25 bp, Mus musculus
atttcttagattgtcactgtttcct

SEQ ID NO: 288885 - DNA, 25 bp, Mus musculus
atttcttagtaacccctgatcttgg

SEQ ID NO: 288886 - DNA, 25 bp, Mus musculus
atttcttagtaagccctgatcttgg

SEQ ID NO: 288887 - DNA, 25 bp, Mus musculus
atttcttagttcagaaagatcctga

SEQ ID NO: 288888 - DNA, 25 bp, Mus musculus
atttcttagttctgaaagatcctga

SEQ ID NO: 288889 - DNA, 25 bp, Mus musculus
atttcttatacgatgatcctccagg

SEQ ID NO: 288890 - DNA, 25 bp, Mus musculus
atttcttatacgttgatcctccagg

SEQ ID NO: 288891 - DNA, 25 bp, Mus musculus
atttcttatagcacaataggatatt

SEQ ID NO: 288892 - DNA, 25 bp, Mus musculus
atttcttatagctcaataggatatt

SEQ ID NO: 288893 - DNA, 25 bp, Mus musculus
atttcttatggtcggccgccttggg

SEQ ID NO: 288894 - DNA, 25 bp, Mus musculus
atttcttatggtgggccgccttggg

SEQ ID NO: 288895 - DNA, 25 bp, Mus musculus
atttcttatttgatctttaccatga

SEQ ID NO: 288896 - DNA, 25 bp, Mus musculus
atttcttatttgttctttaccatga

SEQ ID NO: 288897 - DNA, 25 bp, Mus musculus
atttcttcaagacgtaccaactatg

SEQ ID NO: 288898 - DNA, 25 bp, Mus musculus
atttcttcaagaggtaccaactatg

SEQ ID NO: 288899 - DNA, 25 bp, Mus musculus
atttcttcacaaaaggcttgctcag

SEQ ID NO: 288900 - DNA, 25 bp, Mus musculus
atttcttcacaataggcttgctcag

SEQ ID NO: 288901 - DNA, 25 bp, Mus musculus
atttcttcacagagctatacggcgc

SEQ ID NO: 288902 - DNA, 25 bp, Mus musculus
atttcttcacagtgctatacggcgc

SEQ ID NO: 288903 - DNA, 25 bp, Mus musculus
atttcttcacatcttcagagtctta

SEQ ID NO: 288904 - DNA, 25 bp, Mus musculus
atttcttcacatgttcagagtctta

SEQ ID NO: 288905 - DNA, 25 bp, Mus musculus
atttcttcaccaccaaagacccagt

SEQ ID NO: 288906 - DNA, 25 bp, Mus musculus
atttcttcaccagcaaagacccagt

SEQ ID NO: 288907 - DNA, 25 bp, Mus musculus
atttcttcactgacacagacctgag

SEQ ID NO: 288908 - DNA, 25 bp, Mus musculus
atttcttcactgacgccgtacaagc

SEQ ID NO: 288909 - DNA, 25 bp, Mus musculus
atttcttcactgtcacagacctgag

SEQ ID NO: 288910 - DNA, 25 bp, Mus musculus
atttcttcactgtcgccgtacaagc

SEQ ID NO: 288911 - DNA, 25 bp, Mus musculus
atttcttcacttatgcaaggttcca

SEQ ID NO: 288912 - DNA, 25 bp, Mus musculus
atttcttcacttttgcaaggttcca

SEQ ID NO: 288913 - DNA, 25 bp, Mus musculus
atttcttcagatccgacggcgtctg

SEQ ID NO: 288914 - DNA, 25 bp, Mus musculus
atttcttcagatgcgacggcgtctg

SEQ ID NO: 288915 - DNA, 25 bp, Mus musculus
atttcttcagcccatgtcgtggaca

SEQ ID NO: 288916 - DNA, 25 bp, Mus musculus
atttcttcagccgatgtcgtggaca

SEQ ID NO: 288917 - DNA, 25 bp, Mus musculus
atttcttcaggcaagcttctacaac

SEQ ID NO: 288918 - DNA, 25 bp, Mus musculus
atttcttcaggctagcttctacaac

SEQ ID NO: 288919 - DNA, 25 bp, Mus musculus
atttcttcaggtatattccaagctt

SEQ ID NO: 288920 - DNA, 25 bp, Mus musculus
atttcttcaggtttattccaagctt

SEQ ID NO: 288921 - DNA, 25 bp, Mus musculus
atttcttcagtgatgctgtttccac

SEQ ID NO: 288922 - DNA, 25 bp, Mus musculus
atttcttcagtgctttcagctgctc

SEQ ID NO: 288923 - DNA, 25 bp, Mus musculus
atttcttcagtggtttcagctgctc

SEQ ID NO: 288924 - DNA, 25 bp, Mus musculus
atttcttcagtgttgctgtttccac

SEQ ID NO: 288925 - DNA, 25 bp, Mus musculus
atttcttcatcgacattttccttcc

SEQ ID NO: 288926 - DNA, 25 bp, Mus musculus
atttcttcatcgtcattttccttcc

SEQ ID NO: 288927 - DNA, 25 bp, Mus musculus
atttcttccaaacctccattcatct

SEQ ID NO: 288928 - DNA, 25 bp, Mus musculus
atttcttccaaagctccattcatct

SEQ ID NO: 288929 - DNA, 25 bp, Mus musculus
atttcttccccaagtggctccaggt

SEQ ID NO: 288930 - DNA, 25 bp, Mus musculus
atttcttccccatgtggctccaggt

SEQ ID NO: 288931 - DNA, 25 bp, Mus musculus
atttcttcccgcactagtaactgca

SEQ ID NO: 288932 - DNA, 25 bp, Mus musculus
atttcttcccgctctagtaactgca

SEQ ID NO: 288933 - DNA, 25 bp, Mus musculus
atttcttccctcaactcaagagtct

SEQ ID NO: 288934 - DNA, 25 bp, Mus musculus
atttcttccctctactcaagagtct

SEQ ID NO: 288935 - DNA, 25 bp, Mus musculus
atttcttccgagcatcatcacagtt

SEQ ID NO: 288936 - DNA, 25 bp, Mus musculus
atttcttccgaggatcatcacagtt

SEQ ID NO: 288937 - DNA, 25 bp, Mus musculus
atttcttccgccatccgtgtctgcg

SEQ ID NO: 288938 - DNA, 25 bp, Mus musculus
atttcttccgccttccgtgtctgcg

SEQ ID NO: 288939 - DNA, 25 bp, Mus musculus
atttcttcctaccaagtcaaacttg

SEQ ID NO: 288940 - DNA, 25 bp, Mus musculus
atttcttcctacgaagtcaaacttg

SEQ ID NO: 288941 - DNA, 25 bp, Mus musculus
atttcttcctgacggccgttggtga

SEQ ID NO: 288942 - DNA, 25 bp, Mus musculus
atttcttcctgagggccgttggtga

SEQ ID NO: 288943 - DNA, 25 bp, Mus musculus
atttcttccttgacctacctcacag

SEQ ID NO: 288944 - DNA, 25 bp, Mus musculus
atttcttccttgctcctgaactgtt

SEQ ID NO: 288945 - DNA, 25 bp, Mus musculus
atttcttccttggtcctgaactgtt

SEQ ID NO: 288946 - DNA, 25 bp, Mus musculus
atttcttccttgtcctacctcacag

SEQ ID NO: 288947 - DNA, 25 bp, Mus musculus
atttcttctacccaatgtcagatta

SEQ ID NO: 288948 - DNA, 25 bp, Mus musculus
atttcttctaccgaatgtcagatta

SEQ ID NO: 288949 - DNA, 25 bp, Mus musculus
atttcttctatgattgcttctagct

SEQ ID NO: 288950 - DNA, 25 bp, Mus musculus
atttcttctatgtttgcttctagct

SEQ ID NO: 288951 - DNA, 25 bp, Mus musculus
atttcttctcaacttgatacctttg

SEQ ID NO: 288952 - DNA, 25 bp, Mus musculus
atttcttctcaagttgatacctttg

SEQ ID NO: 288953 - DNA, 25 bp, Mus musculus
atttcttctcctacacgctgggcaa

SEQ ID NO: 288954 - DNA, 25 bp, Mus musculus
atttcttctccttcacgctgggcaa

SEQ ID NO: 288955 - DNA, 25 bp, Mus musculus
atttcttctggactggataagtaca

SEQ ID NO: 288956 - DNA, 25 bp, Mus musculus
atttcttctggagtggataagtaca

SEQ ID NO: 288957 - DNA, 25 bp, Mus musculus
atttcttctggccttttagcaattt

SEQ ID NO: 288958 - DNA, 25 bp, Mus musculus
atttcttctggcgttttagcaattt

SEQ ID NO: 288959 - DNA, 25 bp, Mus musculus
atttcttctgtgaaaggtacctgga

SEQ ID NO: 288960 - DNA, 25 bp, Mus musculus
atttcttctgtgtaaggtacctgga

SEQ ID NO: 288961 - DNA, 25 bp, Mus musculus
atttcttcttagaccactgaatgtt

SEQ ID NO: 288962 - DNA, 25 bp, Mus musculus
atttcttcttagacctatctgtaag

SEQ ID NO: 288963 - DNA, 25 bp, Mus musculus
atttcttcttagtccactgaatgtt

SEQ ID NO: 288964 - DNA, 25 bp, Mus musculus
atttcttcttagtcctatctgtaag

SEQ ID NO: 288965 - DNA, 25 bp, Mus musculus
atttcttcttcaactcttaccatta

SEQ ID NO: 288966 - DNA, 25 bp, Mus musculus
atttcttcttcatctcttaccatta

SEQ ID NO: 288967 - DNA, 25 bp, Mus musculus
atttcttgacatagagccagccagc

SEQ ID NO: 288968 - DNA, 25 bp, Mus musculus
atttcttgacattgagccagccagc

SEQ ID NO: 288969 - DNA, 25 bp, Mus musculus
atttcttgacctacatcttttctgc

SEQ ID NO: 288970 - DNA, 25 bp, Mus musculus
atttcttgaccttcatcttttctgc

SEQ ID NO: 288971 - DNA, 25 bp, Mus musculus
atttcttgactaagcctatacggga

SEQ ID NO: 288972 - DNA, 25 bp, Mus musculus
atttcttgactatgcctatacggga

SEQ ID NO: 288973 - DNA, 25 bp, Mus musculus
atttcttgagaacctattgcctgtc

SEQ ID NO: 288974 - DNA, 25 bp, Mus musculus
atttcttgagaagctattgcctgtc

SEQ ID NO: 288975 - DNA, 25 bp, Mus musculus
atttcttgagctctctggtctgata

SEQ ID NO: 288976 - DNA, 25 bp, Mus musculus
atttcttgagctgtctggtctgata

SEQ ID NO: 288977 - DNA, 25 bp, Mus musculus
atttcttgagtcaatggccctggca

SEQ ID NO: 288978 - DNA, 25 bp, Mus musculus
atttcttgagtctatggccctggca

SEQ ID NO: 288979 - DNA, 25 bp, Mus musculus
atttcttgatatacctcttatcccc

SEQ ID NO: 288980 - DNA, 25 bp, Mus musculus
atttcttgatattcctcttatcccc

SEQ ID NO: 288981 - DNA, 25 bp, Mus musculus
atttcttgatttctgcccttcagct

SEQ ID NO: 288982 - DNA, 25 bp, Mus musculus
atttcttgatttgtgcccttcagct

SEQ ID NO: 288983 - DNA, 25 bp, Mus musculus
atttcttgcaaaatgtgccatgggt

SEQ ID NO: 288984 - DNA, 25 bp, Mus musculus
atttcttgcaaattgtgccatgggt

SEQ ID NO: 288985 - DNA, 25 bp, Mus musculus
atttcttgcacccttgtaaacctgg

SEQ ID NO: 288986 - DNA, 25 bp, Mus musculus
atttcttgcaccgttgtaaacctgg

SEQ ID NO: 288987 - DNA, 25 bp, Mus musculus
atttcttgcagacagacccagctac

SEQ ID NO: 288988 - DNA, 25 bp, Mus musculus
atttcttgcagagagacccagctac

SEQ ID NO: 288989 - DNA, 25 bp, Mus musculus
atttcttgccatatattgtaaatag

SEQ ID NO: 288990 - DNA, 25 bp, Mus musculus
atttcttgccatttattgtaaatag

SEQ ID NO: 288991 - DNA, 25 bp, Mus musculus
atttcttgccggagtctgtatagct

SEQ ID NO: 288992 - DNA, 25 bp, Mus musculus
atttcttgccggtgtctgtatagct

SEQ ID NO: 288993 - DNA, 25 bp, Mus musculus
atttcttgccttccatttggttcaa

SEQ ID NO: 288994 - DNA, 25 bp, Mus musculus
atttcttgccttgcatttggttcaa

SEQ ID NO: 288995 - DNA, 25 bp, Mus musculus
atttcttgcgtaagcagcagctggc

SEQ ID NO: 288996 - DNA, 25 bp, Mus musculus
atttcttgcgtatgcagcagctggc

SEQ ID NO: 288997 - DNA, 25 bp, Mus musculus
atttcttgctagactgatgtgctaa

SEQ ID NO: 288998 - DNA, 25 bp, Mus musculus
atttcttgctagtctgatgtgctaa

SEQ ID NO: 288999 - DNA, 25 bp, Mus musculus
atttcttgctctcgtcagacgttaa

SEQ ID NO: 289000 - DNA, 25 bp, Mus musculus
atttcttgctctggtcagacgttaa

SEQ ID NO: 289001 - DNA, 25 bp, Mus musculus
atttcttggagcctccctttggctg

SEQ ID NO: 289002 - DNA, 25 bp, Mus musculus
atttcttggagcgtccctttggctg

SEQ ID NO: 289003 - DNA, 25 bp, Mus musculus
atttcttggccaatagtcacatgat

SEQ ID NO: 289004 - DNA, 25 bp, Mus musculus
atttcttggccattagtcacatgat

SEQ ID NO: 289005 - DNA, 25 bp, Mus musculus
atttcttgggcaacgccattatgag

SEQ ID NO: 289006 - DNA, 25 bp, Mus musculus
atttcttgggcatcgccattatgag

SEQ ID NO: 289007 - DNA, 25 bp, Mus musculus
atttcttggttaatgtggcccatgc

SEQ ID NO: 289008 - DNA, 25 bp, Mus musculus
atttcttggttattgtggcccatgc

SEQ ID NO: 289009 - DNA, 25 bp, Mus musculus
atttcttgtaaaccttacccacatt

SEQ ID NO: 289010 - DNA, 25 bp, Mus musculus
atttcttgtaaagcttacccacatt

SEQ ID NO: 289011 - DNA, 25 bp, Mus musculus
atttcttgtaagaagccatatagct

SEQ ID NO: 289012 - DNA, 25 bp, Mus musculus
atttcttgtaagtagccatatagct

SEQ ID NO: 289013 - DNA, 25 bp, Mus musculus
atttcttgtatcatgggcagttctc

SEQ ID NO: 289014 - DNA, 25 bp, Mus musculus
atttcttgtatcttgggcagttctc

SEQ ID NO: 289015 - DNA, 25 bp, Mus musculus
atttcttgtcatatagcggctctac

SEQ ID NO: 289016 - DNA, 25 bp, Mus musculus
atttcttgtcatttagcggctctac

SEQ ID NO: 289017 - DNA, 25 bp, Mus musculus
atttcttgtctgagatttttgcaga

SEQ ID NO: 289018 - DNA, 25 bp, Mus musculus
atttcttgtctgtgatttttgcaga

SEQ ID NO: 289019 - DNA, 25 bp, Mus musculus
atttcttgtgccagagaacctgtac

SEQ ID NO: 289020 - DNA, 25 bp, Mus musculus
atttcttgtgcctgagaacctgtac

SEQ ID NO: 289021 - DNA, 25 bp, Mus musculus
atttcttgttcaagtaagatttcaa

SEQ ID NO: 289022 - DNA, 25 bp, Mus musculus
atttcttgttcatgtaagatttcaa

SEQ ID NO: 289023 - DNA, 25 bp, Mus musculus
atttctttaccgaagcattgcatta

SEQ ID NO: 289024 - DNA, 25 bp, Mus musculus
atttctttaccgtagcattgcatta

SEQ ID NO: 289025 - DNA, 25 bp, Mus musculus
atttctttagagatgcaagtttcct

SEQ ID NO: 289026 - DNA, 25 bp, Mus musculus
atttctttagagttgcaagtttcct

SEQ ID NO: 289027 - DNA, 25 bp, Mus musculus
atttctttagttctgcacttttcca

SEQ ID NO: 289028 - DNA, 25 bp, Mus musculus
atttctttagttgtgcacttttcca

SEQ ID NO: 289029 - DNA, 25 bp, Mus musculus
atttctttatgtaaggtctggtcaa

SEQ ID NO: 289030 - DNA, 25 bp, Mus musculus
atttctttatgttaggtctggtcaa

SEQ ID NO: 289031 - DNA, 25 bp, Mus musculus
atttctttcatcacattcccagtgg

SEQ ID NO: 289032 - DNA, 25 bp, Mus musculus
atttctttcatctcattcccagtgg

SEQ ID NO: 289033 - DNA, 25 bp, Mus musculus
atttctttccctccactttgttaca

SEQ ID NO: 289034 - DNA, 25 bp, Mus musculus
atttctttccctgcactttgttaca

SEQ ID NO: 289035 - DNA, 25 bp, Mus musculus
atttctttcctgacagcatgactcc

SEQ ID NO: 289036 - DNA, 25 bp, Mus musculus
atttctttcctgtcagcatgactcc

SEQ ID NO: 289037 - DNA, 25 bp, Mus musculus
atttctttcggtaattctgcctgta

SEQ ID NO: 289038 - DNA, 25 bp, Mus musculus
atttctttcggttattctgcctgta

SEQ ID NO: 289039 - DNA, 25 bp, Mus musculus
atttctttctatacttggaaccatg

SEQ ID NO: 289040 - DNA, 25 bp, Mus musculus
atttctttctattcttggaaccatg

SEQ ID NO: 289041 - DNA, 25 bp, Mus musculus
atttctttcttactcctcagtggat

SEQ ID NO: 289042 - DNA, 25 bp, Mus musculus
atttctttcttagtcctcagtggat

SEQ ID NO: 289043 - DNA, 25 bp, Mus musculus
atttctttgatacatgctttttgta

SEQ ID NO: 289044 - DNA, 25 bp, Mus musculus
atttctttgatagatgctttttgta

SEQ ID NO: 289045 - DNA, 25 bp, Mus musculus
atttctttgcatcttgcttgcctaa

SEQ ID NO: 289046 - DNA, 25 bp, Mus musculus
atttctttgcatgttgcttgcctaa

SEQ ID NO: 289047 - DNA, 25 bp, Mus musculus
atttctttgctcatttgagcgctga

SEQ ID NO: 289048 - DNA, 25 bp, Mus musculus
atttctttgctcttttgagcgctga

SEQ ID NO: 289049 - DNA, 25 bp, Mus musculus
atttctttggacagagattctcttt

SEQ ID NO: 289050 - DNA, 25 bp, Mus musculus
atttctttggactgagattctcttt

SEQ ID NO: 289051 - DNA, 25 bp, Mus musculus
atttctttggctctggttaatgtca

SEQ ID NO: 289052 - DNA, 25 bp, Mus musculus
atttctttggctgtggttaatgtca

SEQ ID NO: 289053 - DNA, 25 bp, Mus musculus
atttcttttctgaatagacctggag

SEQ ID NO: 289054 - DNA, 25 bp, Mus musculus
atttcttttctgtatagacctggag

SEQ ID NO: 289055 - DNA, 25 bp, Mus musculus
atttcttttgtgagactcttttagc

SEQ ID NO: 289056 - DNA, 25 bp, Mus musculus
atttcttttgtgtgactcttttagc

SEQ ID NO: 289057 - DNA, 25 bp, Mus musculus
atttctttttatccccaatgactgc

SEQ ID NO: 289058 - DNA, 25 bp, Mus musculus
atttctttttatgcccaatgactgc

SEQ ID NO: 289059 - DNA, 25 bp, Mus musculus
atttgaaaagctaccatctcctgat

SEQ ID NO: 289060 - DNA, 25 bp, Mus musculus
atttgaaaagcttccatctcctgat

SEQ ID NO: 289061 - DNA, 25 bp, Mus musculus
atttgaaagactctgcctgcttacc

SEQ ID NO: 289062 - DNA, 25 bp, Mus musculus
atttgaaagactgtgcctgcttacc

SEQ ID NO: 289063 - DNA, 25 bp, Mus musculus
atttgaaagcccagtcttgtgactc

SEQ ID NO: 289064 - DNA, 25 bp, Mus musculus
atttgaaagccctgtcttgtgactc

SEQ ID NO: 289065 - DNA, 25 bp, Mus musculus
atttgaaaggtcctgctctgagctg

SEQ ID NO: 289066 - DNA, 25 bp, Mus musculus
atttgaaaggtcgtgctctgagctg

SEQ ID NO: 289067 - DNA, 25 bp, Mus musculus
atttgaaagtcacctacctcagcat

SEQ ID NO: 289068 - DNA, 25 bp, Mus musculus
atttgaaagtcagctacctcagcat

SEQ ID NO: 289069 - DNA, 25 bp, Mus musculus
atttgaaagtctatgggatccttga

SEQ ID NO: 289070 - DNA, 25 bp, Mus musculus
atttgaaagtctttgggatccttga

SEQ ID NO: 289071 - DNA, 25 bp, Mus musculus
atttgaaatgaaaccgcctccgact

SEQ ID NO: 289072 - DNA, 25 bp, Mus musculus
atttgaaatgaatccgcctccgact

SEQ ID NO: 289073 - DNA, 25 bp, Mus musculus
atttgaaattgtacggtcccatgaa

SEQ ID NO: 289074 - DNA, 25 bp, Mus musculus
atttgaaattgttcggtcccatgaa

SEQ ID NO: 289075 - DNA, 25 bp, Mus musculus
atttgaacaaccacacctgaacctt

SEQ ID NO: 289076 - DNA, 25 bp, Mus musculus
atttgaacaacctcacctgaacctt

SEQ ID NO: 289077 - DNA, 25 bp, Mus musculus
atttgaacagacagcacacggaccc

SEQ ID NO: 289078 - DNA, 25 bp, Mus musculus
atttgaacagactgcacacggaccc

SEQ ID NO: 289079 - DNA, 25 bp, Mus musculus
atttgaacattactccttaacaggt

SEQ ID NO: 289080 - DNA, 25 bp, Mus musculus
atttgaacattagtccttaacaggt

SEQ ID NO: 289081 - DNA, 25 bp, Mus musculus
atttgaaccgataaaatggcacctg

SEQ ID NO: 289082 - DNA, 25 bp, Mus musculus
atttgaaccgattaaatggcacctg

SEQ ID NO: 289083 - DNA, 25 bp, Mus musculus
atttgaacctggacagatgcagctg

SEQ ID NO: 289084 - DNA, 25 bp, Mus musculus
atttgaacctggtcagatgcagctg

SEQ ID NO: 289085 - DNA, 25 bp, Mus musculus
atttgaactcaacctccagggctat

SEQ ID NO: 289086 - DNA, 25 bp, Mus musculus
atttgaactcaagctccagggctat

SEQ ID NO: 289087 - DNA, 25 bp, Mus musculus
atttgaactctcacttctccattaa

SEQ ID NO: 289088 - DNA, 25 bp, Mus musculus
atttgaactctctcttctccattaa

SEQ ID NO: 289089 - DNA, 25 bp, Mus musculus
atttgaactcttcacacttccagct

SEQ ID NO: 289090 - DNA, 25 bp, Mus musculus
atttgaactcttgacacttccagct

SEQ ID NO: 289091 - DNA, 25 bp, Mus musculus
atttgaagaaagaagcccgggagca

SEQ ID NO: 289092 - DNA, 25 bp, Mus musculus
atttgaagaaagtagcccgggagca

SEQ ID NO: 289093 - DNA, 25 bp, Mus musculus
atttgaagaactacctgtccttagg

SEQ ID NO: 289094 - DNA, 25 bp, Mus musculus
atttgaagaacttcctgtccttagg

SEQ ID NO: 289095 - DNA, 25 bp, Mus musculus
atttgaagaattatgttcttgccct

SEQ ID NO: 289096 - DNA, 25 bp, Mus musculus
atttgaagaattttgttcttgccct

SEQ ID NO: 289097 - DNA, 25 bp, Mus musculus
atttgaagactaacccaagcccacc

SEQ ID NO: 289098 - DNA, 25 bp, Mus musculus
atttgaagactatcccaagcccacc

SEQ ID NO: 289099 - DNA, 25 bp, Mus musculus
atttgaagagctctactctctcctt

SEQ ID NO: 289100 - DNA, 25 bp, Mus musculus
atttgaagagctgtactctctcctt

SEQ ID NO: 289101 - DNA, 25 bp, Mus musculus
atttgaagagtcacccctatctcct

SEQ ID NO: 289102 - DNA, 25 bp, Mus musculus
atttgaagagtctcccctatctcct

SEQ ID NO: 289103 - DNA, 25 bp, Mus musculus
atttgaagccaaactgcatgacatg

SEQ ID NO: 289104 - DNA, 25 bp, Mus musculus
atttgaagccaaccaggaaatctga

SEQ ID NO: 289105 - DNA, 25 bp, Mus musculus
atttgaagccaagcaggaaatctga

SEQ ID NO: 289106 - DNA, 25 bp, Mus musculus
atttgaagccaatctgcatgacatg

SEQ ID NO: 289107 - DNA, 25 bp, Mus musculus
atttgaagccataggataatctgag

SEQ ID NO: 289108 - DNA, 25 bp, Mus musculus
atttgaagccattggataatctgag

SEQ ID NO: 289109 - DNA, 25 bp, Mus musculus
atttgaagcccaactcaagagagct

SEQ ID NO: 289110 - DNA, 25 bp, Mus musculus
atttgaagcccatctcaagagagct

SEQ ID NO: 289111 - DNA, 25 bp, Mus musculus
atttgaagggttacccaggctgaca

SEQ ID NO: 289112 - DNA, 25 bp, Mus musculus
atttgaagggtttcccaggctgaca

SEQ ID NO: 289113 - DNA, 25 bp, Mus musculus
atttgaagtcataccctcagagagg

SEQ ID NO: 289114 - DNA, 25 bp, Mus musculus
atttgaagtcattccctcagagagg

SEQ ID NO: 289115 - DNA, 25 bp, Mus musculus
atttgaagtcggaccagcttgcttt

SEQ ID NO: 289116 - DNA, 25 bp, Mus musculus
atttgaagtcggtccagcttgcttt

SEQ ID NO: 289117 - DNA, 25 bp, Mus musculus
atttgaagtctaactgtagtacata

SEQ ID NO: 289118 - DNA, 25 bp, Mus musculus
atttgaagtctatctgtagtacata

SEQ ID NO: 289119 - DNA, 25 bp, Mus musculus
atttgaataactcaactggctgatg

SEQ ID NO: 289120 - DNA, 25 bp, Mus musculus
atttgaataactgaactggctgatg

SEQ ID NO: 289121 - DNA, 25 bp, Mus musculus
atttgaataccaaagcggtgttcct

SEQ ID NO: 289122 - DNA, 25 bp, Mus musculus
atttgaataccatagcggtgttcct

SEQ ID NO: 289123 - DNA, 25 bp, Mus musculus
atttgaatcccaccctatgaatttt

SEQ ID NO: 289124 - DNA, 25 bp, Mus musculus
atttgaatcccagcctatgaatttt

SEQ ID NO: 289125 - DNA, 25 bp, Mus musculus
atttgaatcctcacttgatggccag

SEQ ID NO: 289126 - DNA, 25 bp, Mus musculus
atttgaatcctctcttgatggccag

SEQ ID NO: 289127 - DNA, 25 bp, Mus musculus
atttgaatgactattaaacgagtgg

SEQ ID NO: 289128 - DNA, 25 bp, Mus musculus
atttgaatgacttttaaacgagtgg

SEQ ID NO: 289129 - DNA, 25 bp, Mus musculus
atttgaatgatcaccgactccctta

SEQ ID NO: 289130 - DNA, 25 bp, Mus musculus
atttgaatgatctccgactccctta

SEQ ID NO: 289131 - DNA, 25 bp, Mus musculus
atttgaatgtggctggctggagaga

SEQ ID NO: 289132 - DNA, 25 bp, Mus musculus
atttgaatgtgggtggctggagaga

SEQ ID NO: 289133 - DNA, 25 bp, Mus musculus
atttgaattcagatcacttgttgct

SEQ ID NO: 289134 - DNA, 25 bp, Mus musculus
atttgaattcagttcacttgttgct

SEQ ID NO: 289135 - DNA, 25 bp, Mus musculus
atttgaattcatccagcgcgccctt

SEQ ID NO: 289136 - DNA, 25 bp, Mus musculus
atttgaattcatgcagcgcgccctt

SEQ ID NO: 289137 - DNA, 25 bp, Mus musculus
atttgaattcgacccatggactcta

SEQ ID NO: 289138 - DNA, 25 bp, Mus musculus
atttgaattcgagccatggactcta

SEQ ID NO: 289139 - DNA, 25 bp, Mus musculus
atttgaattcggctcctgaagccag

SEQ ID NO: 289140 - DNA, 25 bp, Mus musculus
atttgaattcgggtcctgaagccag

SEQ ID NO: 289141 - DNA, 25 bp, Mus musculus
atttgaattgtgagcggctcatcca

SEQ ID NO: 289142 - DNA, 25 bp, Mus musculus
atttgaattgtgtgcggctcatcca

SEQ ID NO: 289143 - DNA, 25 bp, Mus musculus
atttgaatttcaacaggacgggcaa

SEQ ID NO: 289144 - DNA, 25 bp, Mus musculus
atttgaatttcatcaggacgggcaa

SEQ ID NO: 289145 - DNA, 25 bp, Mus musculus
atttgaatttcgattgcatctgtaa

SEQ ID NO: 289146 - DNA, 25 bp, Mus musculus
atttgaatttcgtttgcatctgtaa

SEQ ID NO: 289147 - DNA, 25 bp, Mus musculus
atttgacaacttcacagccctggat

SEQ ID NO: 289148 - DNA, 25 bp, Mus musculus
atttgacaacttgacagccctggat

SEQ ID NO: 289149 - DNA, 25 bp, Mus musculus
atttgacaccatcacttgggaagaa

SEQ ID NO: 289150 - DNA, 25 bp, Mus musculus
atttgacaccatgacttgggaagaa

SEQ ID NO: 289151 - DNA, 25 bp, Mus musculus
atttgacaccctatgatccactgaa

SEQ ID NO: 289152 - DNA, 25 bp, Mus musculus
atttgacaccctcatgcagccacat

SEQ ID NO: 289153 - DNA, 25 bp, Mus musculus
atttgacaccctgatgcagccacat

SEQ ID NO: 289154 - DNA, 25 bp, Mus musculus
atttgacaccctttgatccactgaa

SEQ ID NO: 289155 - DNA, 25 bp, Mus musculus
atttgacaccttaagtgtatagaga

SEQ ID NO: 289156 - DNA, 25 bp, Mus musculus
atttgacacctttagtgtatagaga

SEQ ID NO: 289157 - DNA, 25 bp, Mus musculus
atttgacactgccatctccggctgg

SEQ ID NO: 289158 - DNA, 25 bp, Mus musculus
atttgacactgcgatctccggctgg

SEQ ID NO: 289159 - DNA, 25 bp, Mus musculus
atttgacagtgtatgcatttgaaca

SEQ ID NO: 289160 - DNA, 25 bp, Mus musculus
atttgacagtgtttgcatttgaaca

SEQ ID NO: 289161 - DNA, 25 bp, Mus musculus
atttgacataccatcttccatttcc

SEQ ID NO: 289162 - DNA, 25 bp, Mus musculus
atttgacataccttcttccatttcc

SEQ ID NO: 289163 - DNA, 25 bp, Mus musculus
atttgacatagtcttacctccacac

SEQ ID NO: 289164 - DNA, 25 bp, Mus musculus
atttgacatagtgttacctccacac

SEQ ID NO: 289165 - DNA, 25 bp, Mus musculus
atttgacatcggaccagtggagatc

SEQ ID NO: 289166 - DNA, 25 bp, Mus musculus
atttgacatcggtccagtggagatc

SEQ ID NO: 289167 - DNA, 25 bp, Mus musculus
atttgacatttcacactgagatctg

SEQ ID NO: 289168 - DNA, 25 bp, Mus musculus
atttgacatttctcactgagatctg

SEQ ID NO: 289169 - DNA, 25 bp, Mus musculus
atttgaccacacagaatggtgttca

SEQ ID NO: 289170 - DNA, 25 bp, Mus musculus
atttgaccacactgaatggtgttca

SEQ ID NO: 289171 - DNA, 25 bp, Mus musculus
atttgaccacagacttctcctgaac

SEQ ID NO: 289172 - DNA, 25 bp, Mus musculus
atttgaccacagtcttctcctgaac

SEQ ID NO: 289173 - DNA, 25 bp, Mus musculus
atttgaccatgacattttggagaaa

SEQ ID NO: 289174 - DNA, 25 bp, Mus musculus
atttgaccatgagattttggagaaa

SEQ ID NO: 289175 - DNA, 25 bp, Mus musculus
atttgaccgtctcaagaaactgcac

SEQ ID NO: 289176 - DNA, 25 bp, Mus musculus
atttgaccgtctgaagaaactgcac

SEQ ID NO: 289177 - DNA, 25 bp, Mus musculus
atttgacctgctacgttctggaaag

SEQ ID NO: 289178 - DNA, 25 bp, Mus musculus
atttgacctgcttcgttctggaaag

SEQ ID NO: 289179 - DNA, 25 bp, Mus musculus
atttgacctgtcacctgtgatatat

SEQ ID NO: 289180 - DNA, 25 bp, Mus musculus
atttgacctgtctcctgtgatatat

SEQ ID NO: 289181 - DNA, 25 bp, Mus musculus
atttgacggactacctgagggttct

SEQ ID NO: 289182 - DNA, 25 bp, Mus musculus
atttgacggacttcctgagggttct

SEQ ID NO: 289183 - DNA, 25 bp, Mus musculus
atttgactacgcatgggctttggag

SEQ ID NO: 289184 - DNA, 25 bp, Mus musculus
atttgactacgcttgggctttggag

SEQ ID NO: 289185 - DNA, 25 bp, Mus musculus
atttgactatttcagcattagcaag

SEQ ID NO: 289186 - DNA, 25 bp, Mus musculus
atttgactatttgagcattagcaag

SEQ ID NO: 289187 - DNA, 25 bp, Mus musculus
atttgactcattacttgatctcaga

SEQ ID NO: 289188 - DNA, 25 bp, Mus musculus
atttgactcatttcttgatctcaga

SEQ ID NO: 289189 - DNA, 25 bp, Mus musculus
atttgactccctcaggtgaagtttt

SEQ ID NO: 289190 - DNA, 25 bp, Mus musculus
atttgactccctgaggtgaagtttt

SEQ ID NO: 289191 - DNA, 25 bp, Mus musculus
atttgactctgtaacctgcatccct

SEQ ID NO: 289192 - DNA, 25 bp, Mus musculus
atttgactctgttacctgcatccct

SEQ ID NO: 289193 - DNA, 25 bp, Mus musculus
atttgactgagtattgcctagaaag

SEQ ID NO: 289194 - DNA, 25 bp, Mus musculus
atttgactgagttttgcctagaaag

SEQ ID NO: 289195 - DNA, 25 bp, Mus musculus
atttgactgcaaagccaatctcctc

SEQ ID NO: 289196 - DNA, 25 bp, Mus musculus
atttgactgcaatgccaatctcctc

SEQ ID NO: 289197 - DNA, 25 bp, Mus musculus
atttgactggagctgcagacccgcc

SEQ ID NO: 289198 - DNA, 25 bp, Mus musculus
atttgactggaggtgcagacccgcc

SEQ ID NO: 289199 - DNA, 25 bp, Mus musculus
atttgactgtgcctcttgacataat

SEQ ID NO: 289200 - DNA, 25 bp, Mus musculus
atttgactgtgcgtcttgacataat

SEQ ID NO: 289201 - DNA, 25 bp, Mus musculus
atttgacttatgacctacctgctat

SEQ ID NO: 289202 - DNA, 25 bp, Mus musculus
atttgacttatgtcctacctgctat

SEQ ID NO: 289203 - DNA, 25 bp, Mus musculus
atttgacttcaaacctcagcagctc

SEQ ID NO: 289204 - DNA, 25 bp, Mus musculus
atttgacttcaatcctcagcagctc

SEQ ID NO: 289205 - DNA, 25 bp, Mus musculus
atttgacttcagaatcgctgcctag

SEQ ID NO: 289206 - DNA, 25 bp, Mus musculus
atttgacttcagtatcgctgcctag

SEQ ID NO: 289207 - DNA, 25 bp, Mus musculus
atttgacttcatccagtgaagctga

SEQ ID NO: 289208 - DNA, 25 bp, Mus musculus
atttgacttcatgcagtgaagctga

SEQ ID NO: 289209 - DNA, 25 bp, Mus musculus
atttgacttcggacagattccttga

SEQ ID NO: 289210 - DNA, 25 bp, Mus musculus
atttgacttcggtcagattccttga

SEQ ID NO: 289211 - DNA, 25 bp, Mus musculus
atttgacttctaagtttgccccggg

SEQ ID NO: 289212 - DNA, 25 bp, Mus musculus
atttgacttctatgtttgccccggg

SEQ ID NO: 289213 - DNA, 25 bp, Mus musculus
atttgactttggactaggactggta

SEQ ID NO: 289214 - DNA, 25 bp, Mus musculus
atttgactttggtctaggactggta

SEQ ID NO: 289215 - DNA, 25 bp, Mus musculus
atttgactttgtaccctgggacaca

SEQ ID NO: 289216 - DNA, 25 bp, Mus musculus
atttgactttgttccctgggacaca

SEQ ID NO: 289217 - DNA, 25 bp, Mus musculus
atttgagaaatgctttatcttctaa

SEQ ID NO: 289218 - DNA, 25 bp, Mus musculus
atttgagaaatggtttatcttctaa

SEQ ID NO: 289219 - DNA, 25 bp, Mus musculus
atttgagacattctttccttaaggg

SEQ ID NO: 289220 - DNA, 25 bp, Mus musculus
atttgagacattgtttccttaaggg

SEQ ID NO: 289221 - DNA, 25 bp, Mus musculus
atttgagactcgaacacttgaagta

SEQ ID NO: 289222 - DNA, 25 bp, Mus musculus
atttgagactcgtacacttgaagta

SEQ ID NO: 289223 - DNA, 25 bp, Mus musculus
atttgagactggctagggatataca

SEQ ID NO: 289224 - DNA, 25 bp, Mus musculus
atttgagactgggtagggatataca

SEQ ID NO: 289225 - DNA, 25 bp, Mus musculus
atttgagacttcaaatgccaccaga

SEQ ID NO: 289226 - DNA, 25 bp, Mus musculus
atttgagacttctaatgccaccaga

SEQ ID NO: 289227 - DNA, 25 bp, Mus musculus
atttgagatgctagtcagtcgttac

SEQ ID NO: 289228 - DNA, 25 bp, Mus musculus
atttgagatgcttgtcagtcgttac

SEQ ID NO: 289229 - DNA, 25 bp, Mus musculus
atttgagcaaataccaagcagacaa

SEQ ID NO: 289230 - DNA, 25 bp, Mus musculus
atttgagcaaattccaagcagacaa

SEQ ID NO: 289231 - DNA, 25 bp, Mus musculus
atttgagccacgattggttccaaag

SEQ ID NO: 289232 - DNA, 25 bp, Mus musculus
atttgagccacgtttggttccaaag

SEQ ID NO: 289233 - DNA, 25 bp, Mus musculus
atttgagccgcccttggagagctga

SEQ ID NO: 289234 - DNA, 25 bp, Mus musculus
atttgagccgccgttggagagctga

SEQ ID NO: 289235 - DNA, 25 bp, Mus musculus
atttgagccgtcaagatgcttctct

SEQ ID NO: 289236 - DNA, 25 bp, Mus musculus
atttgagccgtctagatgcttctct

SEQ ID NO: 289237 - DNA, 25 bp, Mus musculus
atttgagcctcactgcaatgttagt

SEQ ID NO: 289238 - DNA, 25 bp, Mus musculus
atttgagcctcagtgcaatgttagt

SEQ ID NO: 289239 - DNA, 25 bp, Mus musculus
atttgagcctttacactttacacag

SEQ ID NO: 289240 - DNA, 25 bp, Mus musculus
atttgagccttttcactttacacag

SEQ ID NO: 289241 - DNA, 25 bp, Mus musculus
atttgagcgtttcccttagtgatta

SEQ ID NO: 289242 - DNA, 25 bp, Mus musculus
atttgagcgtttgccttagtgatta

SEQ ID NO: 289243 - DNA, 25 bp, Mus musculus
atttgagctgctctatttctccttg

SEQ ID NO: 289244 - DNA, 25 bp, Mus musculus
atttgagctgctgtatttctccttg

SEQ ID NO: 289245 - DNA, 25 bp, Mus musculus
atttgagctttcacgccagatgcaa

SEQ ID NO: 289246 - DNA, 25 bp, Mus musculus
atttgagctttctcgccagatgcaa

SEQ ID NO: 289247 - DNA, 25 bp, Mus musculus
atttgaggctgtcgatctttctgtg

SEQ ID NO: 289248 - DNA, 25 bp, Mus musculus
atttgaggctgtggatctttctgtg

SEQ ID NO: 289249 - DNA, 25 bp, Mus musculus
atttgagggctcaaagttctcagct

SEQ ID NO: 289250 - DNA, 25 bp, Mus musculus
atttgagggctctaagttctcagct

SEQ ID NO: 289251 - DNA, 25 bp, Mus musculus
atttgaggttgtatttaggcactat

SEQ ID NO: 289252 - DNA, 25 bp, Mus musculus
atttgaggttgtttttaggcactat

SEQ ID NO: 289253 - DNA, 25 bp, Mus musculus
atttgagtacaaaccaccacatttt

SEQ ID NO: 289254 - DNA, 25 bp, Mus musculus
atttgagtacaatccaccacatttt

SEQ ID NO: 289255 - DNA, 25 bp, Mus musculus
atttgagtcaatctccttcaccctt

SEQ ID NO: 289256 - DNA, 25 bp, Mus musculus
atttgagtcaatgtccttcaccctt

SEQ ID NO: 289257 - DNA, 25 bp, Mus musculus
atttgagtcctactgtaaaattgaa

SEQ ID NO: 289258 - DNA, 25 bp, Mus musculus
atttgagtcctagtgtaaaattgaa

SEQ ID NO: 289259 - DNA, 25 bp, Mus musculus
atttgagtcttgattcacactgtaa

SEQ ID NO: 289260 - DNA, 25 bp, Mus musculus
atttgagtcttgtttcacactgtaa

SEQ ID NO: 289261 - DNA, 25 bp, Mus musculus
atttgagtgcaccactatctcaggc

SEQ ID NO: 289262 - DNA, 25 bp, Mus musculus
atttgagtgcacgactatctcaggc

SEQ ID NO: 289263 - DNA, 25 bp, Mus musculus
atttgagtgcatcttaggtctgaaa

SEQ ID NO: 289264 - DNA, 25 bp, Mus musculus
atttgagtgcatgttaggtctgaaa

SEQ ID NO: 289265 - DNA, 25 bp, Mus musculus
atttgagtggctcacttaacccaga

SEQ ID NO: 289266 - DNA, 25 bp, Mus musculus
atttgagtggctgacttaacccaga

SEQ ID NO: 289267 - DNA, 25 bp, Mus musculus
atttgagtgtggaaagttatgcttt

SEQ ID NO: 289268 - DNA, 25 bp, Mus musculus
atttgagtgtggtaagttatgcttt

SEQ ID NO: 289269 - DNA, 25 bp, Mus musculus
atttgagttcgaatctgcagggctt

SEQ ID NO: 289270 - DNA, 25 bp, Mus musculus
atttgagttcgattctgcagggctt

SEQ ID NO: 289271 - DNA, 25 bp, Mus musculus
atttgagttctacggttctcctgga

SEQ ID NO: 289272 - DNA, 25 bp, Mus musculus
atttgagttctagggttctcctgga

SEQ ID NO: 289273 - DNA, 25 bp, Mus musculus
atttgagttctcaaggttggcggta

SEQ ID NO: 289274 - DNA, 25 bp, Mus musculus
atttgagttctcctcctccttgggt

SEQ ID NO: 289275 - DNA, 25 bp, Mus musculus
atttgagttctcgtcctccttgggt

SEQ ID NO: 289276 - DNA, 25 bp, Mus musculus
atttgagttctctaggttggcggta

SEQ ID NO: 289277 - DNA, 25 bp, Mus musculus
atttgagttgcaaacctcctgttga

SEQ ID NO: 289278 - DNA, 25 bp, Mus musculus
atttgagttgcatacctcctgttga

SEQ ID NO: 289279 - DNA, 25 bp, Mus musculus
atttgataaaggctacctcccaagc

SEQ ID NO: 289280 - DNA, 25 bp, Mus musculus
atttgataaagggtacctcccaagc

SEQ ID NO: 289281 - DNA, 25 bp, Mus musculus
atttgataacctctaaggcacgtga

SEQ ID NO: 289282 - DNA, 25 bp, Mus musculus
atttgataacctgtaaggcacgtga

SEQ ID NO: 289283 - DNA, 25 bp, Mus musculus
atttgataatacctttgtaccttga

SEQ ID NO: 289284 - DNA, 25 bp, Mus musculus
atttgataatacgtttgtaccttga

SEQ ID NO: 289285 - DNA, 25 bp, Mus musculus
atttgatacagtcttctggtacagg

SEQ ID NO: 289286 - DNA, 25 bp, Mus musculus
atttgatacagtgttctggtacagg

SEQ ID NO: 289287 - DNA, 25 bp, Mus musculus
atttgataccacagacacatacttc

SEQ ID NO: 289288 - DNA, 25 bp, Mus musculus
atttgataccactgacacatacttc

SEQ ID NO: 289289 - DNA, 25 bp, Mus musculus
atttgatagcacacgaggctctggc

SEQ ID NO: 289290 - DNA, 25 bp, Mus musculus
atttgatagcactcgaggctctggc

SEQ ID NO: 289291 - DNA, 25 bp, Mus musculus
atttgataggtacccattcttccct

SEQ ID NO: 289292 - DNA, 25 bp, Mus musculus
atttgataggtagccattcttccct

SEQ ID NO: 289293 - DNA, 25 bp, Mus musculus
atttgatatatgactcatgctaaaa

SEQ ID NO: 289294 - DNA, 25 bp, Mus musculus
atttgatatatgtctcatgctaaaa

SEQ ID NO: 289295 - DNA, 25 bp, Mus musculus
atttgatatcagataccctggcctc

SEQ ID NO: 289296 - DNA, 25 bp, Mus musculus
atttgatatcagttaccctggcctc

SEQ ID NO: 289297 - DNA, 25 bp, Mus musculus
atttgatatgtaattccccagattt

SEQ ID NO: 289298 - DNA, 25 bp, Mus musculus
atttgatatgtatttccccagattt

SEQ ID NO: 289299 - DNA, 25 bp, Mus musculus
atttgatcaattactttcccgagtc

SEQ ID NO: 289300 - DNA, 25 bp, Mus musculus
atttgatcaatttctttcccgagtc

SEQ ID NO: 289301 - DNA, 25 bp, Mus musculus
atttgatcagctacttttggacact

SEQ ID NO: 289302 - DNA, 25 bp, Mus musculus
atttgatcagcttcttttggacact

SEQ ID NO: 289303 - DNA, 25 bp, Mus musculus
atttgatcccatctgaggtgccacg

SEQ ID NO: 289304 - DNA, 25 bp, Mus musculus
atttgatcccatgtgaggtgccacg

SEQ ID NO: 289305 - DNA, 25 bp, Mus musculus
atttgatccctactacacactgtac

SEQ ID NO: 289306 - DNA, 25 bp, Mus musculus
atttgatccctagtacacactgtac

SEQ ID NO: 289307 - DNA, 25 bp, Mus musculus
atttgatccttgataatttcacacc

SEQ ID NO: 289308 - DNA, 25 bp, Mus musculus
atttgatccttgttaatttcacacc

SEQ ID NO: 289309 - DNA, 25 bp, Mus musculus
atttgatctcccacagggtggtgtc

SEQ ID NO: 289310 - DNA, 25 bp, Mus musculus
atttgatctccctcagggtggtgtc

SEQ ID NO: 289311 - DNA, 25 bp, Mus musculus
atttgatgagctagtgcactggcac

SEQ ID NO: 289312 - DNA, 25 bp, Mus musculus
atttgatgagcttgtgcactggcac

SEQ ID NO: 289313 - DNA, 25 bp, Mus musculus
atttgatgcccacctgacagaactg

SEQ ID NO: 289314 - DNA, 25 bp, Mus musculus
atttgatgcccagctgacagaactg

SEQ ID NO: 289315 - DNA, 25 bp, Mus musculus
atttgatgccgccattgctctgcag

SEQ ID NO: 289316 - DNA, 25 bp, Mus musculus
atttgatgccgcgattgctctgcag

SEQ ID NO: 289317 - DNA, 25 bp, Mus musculus
atttgatgctccagcagatgaccca

SEQ ID NO: 289318 - DNA, 25 bp, Mus musculus
atttgatgctcctgcagatgaccca

SEQ ID NO: 289319 - DNA, 25 bp, Mus musculus
atttgatggctcagaaactagacct

SEQ ID NO: 289320 - DNA, 25 bp, Mus musculus
atttgatggctctgaaactagacct

SEQ ID NO: 289321 - DNA, 25 bp, Mus musculus
atttgatgtctcaggaactaactga

SEQ ID NO: 289322 - DNA, 25 bp, Mus musculus
atttgatgtctctggaactaactga

SEQ ID NO: 289323 - DNA, 25 bp, Mus musculus
atttgatgtgacagtttgctcctat

SEQ ID NO: 289324 - DNA, 25 bp, Mus musculus
atttgatgtgactgtttgctcctat

SEQ ID NO: 289325 - DNA, 25 bp, Mus musculus
atttgatgtgcacaaggctttgtcc

SEQ ID NO: 289326 - DNA, 25 bp, Mus musculus
atttgatgtgcagaaggctttgtcc

SEQ ID NO: 289327 - DNA, 25 bp, Mus musculus
atttgatgtggcattcccttgagaa

SEQ ID NO: 289328 - DNA, 25 bp, Mus musculus
atttgatgtggctttcccttgagaa

SEQ ID NO: 289329 - DNA, 25 bp, Mus musculus
atttgattaagtcagggagccacac

SEQ ID NO: 289330 - DNA, 25 bp, Mus musculus
atttgattaagtgagggagccacac

SEQ ID NO: 289331 - DNA, 25 bp, Mus musculus
atttgattacttatcaaactctgaa

SEQ ID NO: 289332 - DNA, 25 bp, Mus musculus
atttgattacttttcaaactctgaa

SEQ ID NO: 289333 - DNA, 25 bp, Mus musculus
atttgattctccagtcaacctcatt

SEQ ID NO: 289334 - DNA, 25 bp, Mus musculus
atttgattctcctgtcaacctcatt

SEQ ID NO: 289335 - DNA, 25 bp, Mus musculus
atttgattggccaataattcttact

SEQ ID NO: 289336 - DNA, 25 bp, Mus musculus
atttgattggcctataattcttact

SEQ ID NO: 289337 - DNA, 25 bp, Mus musculus
atttgattggtgatgcctgttcatt

SEQ ID NO: 289338 - DNA, 25 bp, Mus musculus
atttgattggtgttgcctgttcatt

SEQ ID NO: 289339 - DNA, 25 bp, Mus musculus
atttgatttagcactctcaagtgga

SEQ ID NO: 289340 - DNA, 25 bp, Mus musculus
atttgatttagctctctcaagtgga

SEQ ID NO: 289341 - DNA, 25 bp, Mus musculus
atttgatttgtcctgtattggcagg

SEQ ID NO: 289342 - DNA, 25 bp, Mus musculus
atttgatttgtcgtgtattggcagg

SEQ ID NO: 289343 - DNA, 25 bp, Mus musculus
atttgatttgttatgacgattttgt

SEQ ID NO: 289344 - DNA, 25 bp, Mus musculus
atttgatttgttttgacgattttgt

SEQ ID NO: 289345 - DNA, 25 bp, Mus musculus
atttgattttgcagcctcaggtata

SEQ ID NO: 289346 - DNA, 25 bp, Mus musculus
atttgattttgctgcctcaggtata

SEQ ID NO: 289347 - DNA, 25 bp, Mus musculus
atttgcaaacagctatcggttggac

SEQ ID NO: 289348 - DNA, 25 bp, Mus musculus
atttgcaaacaggtatcggttggac

SEQ ID NO: 289349 - DNA, 25 bp, Mus musculus
atttgcaaattcaagctgctttata

SEQ ID NO: 289350 - DNA, 25 bp, Mus musculus
atttgcaaattctagctgctttata

SEQ ID NO: 289351 - DNA, 25 bp, Mus musculus
atttgcaacgcaatggagcgaggaa

SEQ ID NO: 289352 - DNA, 25 bp, Mus musculus
atttgcaacgcattggagcgaggaa

SEQ ID NO: 289353 - DNA, 25 bp, Mus musculus
atttgcaactgccaccgcaacgctg

SEQ ID NO: 289354 - DNA, 25 bp, Mus musculus
atttgcaactgcgaccgcaacgctg

SEQ ID NO: 289355 - DNA, 25 bp, Mus musculus
atttgcaacttgatcactggctacc

SEQ ID NO: 289356 - DNA, 25 bp, Mus musculus
atttgcaacttgttcactggctacc

SEQ ID NO: 289357 - DNA, 25 bp, Mus musculus
atttgcaagagtaccggccaggcca

SEQ ID NO: 289358 - DNA, 25 bp, Mus musculus
atttgcaagagttccggccaggcca

SEQ ID NO: 289359 - DNA, 25 bp, Mus musculus
atttgcaagcttcaagcctgccaag

SEQ ID NO: 289360 - DNA, 25 bp, Mus musculus
atttgcaagcttgaagcctgccaag

SEQ ID NO: 289361 - DNA, 25 bp, Mus musculus
atttgcaaggacaggccgcctggct

SEQ ID NO: 289362 - DNA, 25 bp, Mus musculus
atttgcaaggactggccgcctggct

SEQ ID NO: 289363 - DNA, 25 bp, Mus musculus
atttgcaagggtatggctgccggca

SEQ ID NO: 289364 - DNA, 25 bp, Mus musculus
atttgcaagggtttggctgccggca

SEQ ID NO: 289365 - DNA, 25 bp, Mus musculus
atttgcaatcttacttcttgatgag

SEQ ID NO: 289366 - DNA, 25 bp, Mus musculus
atttgcaatctttcttcttgatgag

SEQ ID NO: 289367 - DNA, 25 bp, Mus musculus
atttgcacattcaactagtatcaga

SEQ ID NO: 289368 - DNA, 25 bp, Mus musculus
atttgcacattctactagtatcaga

SEQ ID NO: 289369 - DNA, 25 bp, Mus musculus
atttgcacatttaggttacagcggg

SEQ ID NO: 289370 - DNA, 25 bp, Mus musculus
atttgcacattttggttacagcggg

SEQ ID NO: 289371 - DNA, 25 bp, Mus musculus
atttgcaccagaacttaatcaggaa

SEQ ID NO: 289372 - DNA, 25 bp, Mus musculus
atttgcaccagatcttaatcaggaa

SEQ ID NO: 289373 - DNA, 25 bp, Mus musculus
atttgcacctccctgaaaacagcct

SEQ ID NO: 289374 - DNA, 25 bp, Mus musculus
atttgcacctccgtgaaaacagcct

SEQ ID NO: 289375 - DNA, 25 bp, Mus musculus
atttgcacgaccatcagagaactca

SEQ ID NO: 289376 - DNA, 25 bp, Mus musculus
atttgcacgaccttcagagaactca

SEQ ID NO: 289377 - DNA, 25 bp, Mus musculus
atttgcacggagaaacacctgattt

SEQ ID NO: 289378 - DNA, 25 bp, Mus musculus
atttgcacggagtaacacctgattt

SEQ ID NO: 289379 - DNA, 25 bp, Mus musculus
atttgcacgtatatgccgagacctt

SEQ ID NO: 289380 - DNA, 25 bp, Mus musculus
atttgcacgtatttgccgagacctt

SEQ ID NO: 289381 - DNA, 25 bp, Mus musculus
atttgcactctaagtctgtgagctt

SEQ ID NO: 289382 - DNA, 25 bp, Mus musculus
atttgcactctatgtctgtgagctt

SEQ ID NO: 289383 - DNA, 25 bp, Mus musculus
atttgcactggaaactgccatggcc

SEQ ID NO: 289384 - DNA, 25 bp, Mus musculus
atttgcactggaacaggcgtcatcc

SEQ ID NO: 289385 - DNA, 25 bp, Mus musculus
atttgcactggatactgccatggcc

SEQ ID NO: 289386 - DNA, 25 bp, Mus musculus
atttgcactggatcaggcgtcatcc

SEQ ID NO: 289387 - DNA, 25 bp, Mus musculus
atttgcactttaatcgcccgacaaa

SEQ ID NO: 289388 - DNA, 25 bp, Mus musculus
atttgcactttattcgcccgacaaa

SEQ ID NO: 289389 - DNA, 25 bp, Mus musculus
atttgcagaaagaagacccacccta

SEQ ID NO: 289390 - DNA, 25 bp, Mus musculus
atttgcagaaagtagacccacccta

SEQ ID NO: 289391 - DNA, 25 bp, Mus musculus
atttgcagactcacaatgatctttt

SEQ ID NO: 289392 - DNA, 25 bp, Mus musculus
atttgcagactctcaatgatctttt

SEQ ID NO: 289393 - DNA, 25 bp, Mus musculus
atttgcagagccacagacacgtctt

SEQ ID NO: 289394 - DNA, 25 bp, Mus musculus
atttgcagagcctcagacacgtctt

SEQ ID NO: 289395 - DNA, 25 bp, Mus musculus
atttgcagagtcccgggcacttaac

SEQ ID NO: 289396 - DNA, 25 bp, Mus musculus
atttgcagagtcgcgggcacttaac

SEQ ID NO: 289397 - DNA, 25 bp, Mus musculus
atttgcagagttagttctctcccct

SEQ ID NO: 289398 - DNA, 25 bp, Mus musculus
atttgcagagtttgttctctcccct

SEQ ID NO: 289399 - DNA, 25 bp, Mus musculus
atttgcagcaacacaggctttataa

SEQ ID NO: 289400 - DNA, 25 bp, Mus musculus
atttgcagcaactcaggctttataa

SEQ ID NO: 289401 - DNA, 25 bp, Mus musculus
atttgcagcatgcttgaccttgatg

SEQ ID NO: 289402 - DNA, 25 bp, Mus musculus
atttgcagcatggttgaccttgatg

SEQ ID NO: 289403 - DNA, 25 bp, Mus musculus
atttgcagcattaccttatgcgtta

SEQ ID NO: 289404 - DNA, 25 bp, Mus musculus
atttgcagcatttccttatgcgtta

SEQ ID NO: 289405 - DNA, 25 bp, Mus musculus
atttgcagccttcaagtagccagtc

SEQ ID NO: 289406 - DNA, 25 bp, Mus musculus
atttgcagccttgaagtagccagtc

SEQ ID NO: 289407 - DNA, 25 bp, Mus musculus
atttgcagctaacgctctatggctt

SEQ ID NO: 289408 - DNA, 25 bp, Mus musculus
atttgcagctaaggctctatggctt

SEQ ID NO: 289409 - DNA, 25 bp, Mus musculus
atttgcagcttcactagttagaaat

SEQ ID NO: 289410 - DNA, 25 bp, Mus musculus
atttgcagcttctctagttagaaat

SEQ ID NO: 289411 - DNA, 25 bp, Mus musculus
atttgcagggcaattgtctctggca

SEQ ID NO: 289412 - DNA, 25 bp, Mus musculus
atttgcagggcatttgtctctggca

SEQ ID NO: 289413 - DNA, 25 bp, Mus musculus
atttgcagggctacctagcagggcc

SEQ ID NO: 289414 - DNA, 25 bp, Mus musculus
atttgcagggcttcctagcagggcc

SEQ ID NO: 289415 - DNA, 25 bp, Mus musculus
atttgcaggttcaacttctacaccc

SEQ ID NO: 289416 - DNA, 25 bp, Mus musculus
atttgcaggttctacttctacaccc

SEQ ID NO: 289417 - DNA, 25 bp, Mus musculus
atttgcagtaggaggatctagctaa

SEQ ID NO: 289418 - DNA, 25 bp, Mus musculus
atttgcagtaggtggatctagctaa

SEQ ID NO: 289419 - DNA, 25 bp, Mus musculus
atttgcagtctacggcacgttacac

SEQ ID NO: 289420 - DNA, 25 bp, Mus musculus
atttgcagtctagggcacgttacac

SEQ ID NO: 289421 - DNA, 25 bp, Mus musculus
atttgcagtctgagcctcttaggta

SEQ ID NO: 289422 - DNA, 25 bp, Mus musculus
atttgcagtctgctacgtcttgagt

SEQ ID NO: 289423 - DNA, 25 bp, Mus musculus
atttgcagtctggtacgtcttgagt

SEQ ID NO: 289424 - DNA, 25 bp, Mus musculus
atttgcagtctgtgcctcttaggta

SEQ ID NO: 289425 - DNA, 25 bp, Mus musculus
atttgcagtggaacttgggaacctt

SEQ ID NO: 289426 - DNA, 25 bp, Mus musculus
atttgcagtggatcttgggaacctt

SEQ ID NO: 289427 - DNA, 25 bp, Mus musculus
atttgcagtggtctaaaagcttatt

SEQ ID NO: 289428 - DNA, 25 bp, Mus musculus
atttgcagtggtgtaaaagcttatt

SEQ ID NO: 289429 - DNA, 25 bp, Mus musculus
atttgcagttctccccatcataggt

SEQ ID NO: 289430 - DNA, 25 bp, Mus musculus
atttgcagttctgcccatcataggt

SEQ ID NO: 289431 - DNA, 25 bp, Mus musculus
atttgcataccacgagcatcacaac

SEQ ID NO: 289432 - DNA, 25 bp, Mus musculus
atttgcataccaggagcatcacaac

SEQ ID NO: 289433 - DNA, 25 bp, Mus musculus
atttgcatactacgattatctggct

SEQ ID NO: 289434 - DNA, 25 bp, Mus musculus
atttgcatactaggattatctggct

SEQ ID NO: 289435 - DNA, 25 bp, Mus musculus
atttgcatactgctggcacatcagg

SEQ ID NO: 289436 - DNA, 25 bp, Mus musculus
atttgcatactggtggcacatcagg

SEQ ID NO: 289437 - DNA, 25 bp, Mus musculus
atttgcatacttcctcaagctcctg

SEQ ID NO: 289438 - DNA, 25 bp, Mus musculus
atttgcatacttgctcaagctcctg

SEQ ID NO: 289439 - DNA, 25 bp, Mus musculus
atttgcatatatattggtccctgtc

SEQ ID NO: 289440 - DNA, 25 bp, Mus musculus
atttgcatatattttggtccctgtc

SEQ ID NO: 289441 - DNA, 25 bp, Mus musculus
atttgcatatgactctgacacgcct

SEQ ID NO: 289442 - DNA, 25 bp, Mus musculus
atttgcatatgagtctgacacgcct

SEQ ID NO: 289443 - DNA, 25 bp, Mus musculus
atttgcatatttagtccccagttag

SEQ ID NO: 289444 - DNA, 25 bp, Mus musculus
atttgcatattttgtccccagttag

SEQ ID NO: 289445 - DNA, 25 bp, Mus musculus
atttgcatcagtcagtgatcttctg

SEQ ID NO: 289446 - DNA, 25 bp, Mus musculus
atttgcatcagtgagtgatcttctg

SEQ ID NO: 289447 - DNA, 25 bp, Mus musculus
atttgcatcctcatgtattttatgt

SEQ ID NO: 289448 - DNA, 25 bp, Mus musculus
atttgcatcctcttgtattttatgt

SEQ ID NO: 289449 - DNA, 25 bp, Mus musculus
atttgcatgaggcttgagtgtccaa

SEQ ID NO: 289450 - DNA, 25 bp, Mus musculus
atttgcatgagggttgagtgtccaa

SEQ ID NO: 289451 - DNA, 25 bp, Mus musculus
atttgcatgcataaagggactctca

SEQ ID NO: 289452 - DNA, 25 bp, Mus musculus
atttgcatgcattaagggactctca

SEQ ID NO: 289453 - DNA, 25 bp, Mus musculus
atttgcatgcgcatgctcacagtcc

SEQ ID NO: 289454 - DNA, 25 bp, Mus musculus
atttgcatgcgcttgctcacagtcc

SEQ ID NO: 289455 - DNA, 25 bp, Mus musculus
atttgcatgcggatcttgctacgaa

SEQ ID NO: 289456 - DNA, 25 bp, Mus musculus
atttgcatgcggttcttgctacgaa

SEQ ID NO: 289457 - DNA, 25 bp, Mus musculus
atttgcatggctaagtcatcggtcc

SEQ ID NO: 289458 - DNA, 25 bp, Mus musculus
atttgcatggctctatttacattaa

SEQ ID NO: 289459 - DNA, 25 bp, Mus musculus
atttgcatggctgtatttacattaa

SEQ ID NO: 289460 - DNA, 25 bp, Mus musculus
atttgcatggcttagtcatcggtcc

SEQ ID NO: 289461 - DNA, 25 bp, Mus musculus
atttgcatgtctactgatacctccc

SEQ ID NO: 289462 - DNA, 25 bp, Mus musculus
atttgcatgtcttctgatacctccc

SEQ ID NO: 289463 - DNA, 25 bp, Mus musculus
atttgcatgttaactgtaggccagt

SEQ ID NO: 289464 - DNA, 25 bp, Mus musculus
atttgcatgttatctgtaggccagt

SEQ ID NO: 289465 - DNA, 25 bp, Mus musculus
atttgcattactcccggagattctg

SEQ ID NO: 289466 - DNA, 25 bp, Mus musculus
atttgcattactgccggagattctg

SEQ ID NO: 289467 - DNA, 25 bp, Mus musculus
atttgcattatcagtggtcaccagc

SEQ ID NO: 289468 - DNA, 25 bp, Mus musculus
atttgcattatctgtggtcaccagc

SEQ ID NO: 289469 - DNA, 25 bp, Mus musculus
atttgcattgaaacactggtccagt

SEQ ID NO: 289470 - DNA, 25 bp, Mus musculus
atttgcattgaatcactggtccagt

SEQ ID NO: 289471 - DNA, 25 bp, Mus musculus
atttgcattgcaccccgaggaagga

SEQ ID NO: 289472 - DNA, 25 bp, Mus musculus
atttgcattgcagcccgaggaagga

SEQ ID NO: 289473 - DNA, 25 bp, Mus musculus
atttgcattgtcagagtgctcacat

SEQ ID NO: 289474 - DNA, 25 bp, Mus musculus
atttgcattgtctgagtgctcacat

SEQ ID NO: 289475 - DNA, 25 bp, Mus musculus
atttgcatttcactgagagcttagc

SEQ ID NO: 289476 - DNA, 25 bp, Mus musculus
atttgcatttcagtgagagcttagc

SEQ ID NO: 289477 - DNA, 25 bp, Mus musculus
atttgccacattcctattcacatga

SEQ ID NO: 289478 - DNA, 25 bp, Mus musculus
atttgccacattgctattcacatga

SEQ ID NO: 289479 - DNA, 25 bp, Mus musculus
atttgccaccaactcctcagaggat

SEQ ID NO: 289480 - DNA, 25 bp, Mus musculus
atttgccaccaagtcctcagaggat

SEQ ID NO: 289481 - DNA, 25 bp, Mus musculus
atttgccactatacccgggctagaa

SEQ ID NO: 289482 - DNA, 25 bp, Mus musculus
atttgccactatcaaatctttcttt

SEQ ID NO: 289483 - DNA, 25 bp, Mus musculus
atttgccactatgaaatctttcttt

SEQ ID NO: 289484 - DNA, 25 bp, Mus musculus
atttgccactattcccgggctagaa

SEQ ID NO: 289485 - DNA, 25 bp, Mus musculus
atttgccactttcggcattatcatc

SEQ ID NO: 289486 - DNA, 25 bp, Mus musculus
atttgccactttgggcattatcatc

SEQ ID NO: 289487 - DNA, 25 bp, Mus musculus
atttgccagaggagcttccgaaatc

SEQ ID NO: 289488 - DNA, 25 bp, Mus musculus
atttgccagaggtgcttccgaaatc

SEQ ID NO: 289489 - DNA, 25 bp, Mus musculus
atttgccagcaactacctgaacttc

SEQ ID NO: 289490 - DNA, 25 bp, Mus musculus
atttgccagcaagtacctgaacttc

SEQ ID NO: 289491 - DNA, 25 bp, Mus musculus
atttgccagcttagctcacggacag

SEQ ID NO: 289492 - DNA, 25 bp, Mus musculus
atttgccagctttgctcacggacag

SEQ ID NO: 289493 - DNA, 25 bp, Mus musculus
atttgccagggtcgtgttgtgttta

SEQ ID NO: 289494 - DNA, 25 bp, Mus musculus
atttgccagggtggtgttgtgttta

SEQ ID NO: 289495 - DNA, 25 bp, Mus musculus
atttgccatatgacagctctgtgcc

SEQ ID NO: 289496 - DNA, 25 bp, Mus musculus
atttgccatatgtcagctctgtgcc

SEQ ID NO: 289497 - DNA, 25 bp, Mus musculus
atttgccatcagatctctgctcaaa

SEQ ID NO: 289498 - DNA, 25 bp, Mus musculus
atttgccatcagttctctgctcaaa

SEQ ID NO: 289499 - DNA, 25 bp, Mus musculus
atttgccatgctcccagacataggc

SEQ ID NO: 289500 - DNA, 25 bp, Mus musculus
atttgccatgctgccagacataggc

SEQ ID NO: 289501 - DNA, 25 bp, Mus musculus
atttgcccacaacccctttaatgaa

SEQ ID NO: 289502 - DNA, 25 bp, Mus musculus
atttgcccacaagccctttaatgaa

SEQ ID NO: 289503 - DNA, 25 bp, Mus musculus
atttgccccaccctaaaatggagag

SEQ ID NO: 289504 - DNA, 25 bp, Mus musculus
atttgccccaccgtaaaatggagag

SEQ ID NO: 289505 - DNA, 25 bp, Mus musculus
atttgccccgtgagcaaatgcacag

SEQ ID NO: 289506 - DNA, 25 bp, Mus musculus
atttgccccgtgtgcaaatgcacag

SEQ ID NO: 289507 - DNA, 25 bp, Mus musculus
atttgcccctggaatctcagagcta

SEQ ID NO: 289508 - DNA, 25 bp, Mus musculus
atttgcccctggagctgaggttaac

SEQ ID NO: 289509 - DNA, 25 bp, Mus musculus
atttgcccctggtatctcagagcta

SEQ ID NO: 289510 - DNA, 25 bp, Mus musculus
atttgcccctggtgctgaggttaac

SEQ ID NO: 289511 - DNA, 25 bp, Mus musculus
atttgcccggcacctgatgcaggtg

SEQ ID NO: 289512 - DNA, 25 bp, Mus musculus
atttgcccggcagctgatgcaggtg

SEQ ID NO: 289513 - DNA, 25 bp, Mus musculus
atttgccctcaacttctgcatagaa

SEQ ID NO: 289514 - DNA, 25 bp, Mus musculus
atttgccctcaagttctgcatagaa

SEQ ID NO: 289515 - DNA, 25 bp, Mus musculus
atttgccctgaaagtggtcacctga

SEQ ID NO: 289516 - DNA, 25 bp, Mus musculus
atttgccctgaatgtggtcacctga

SEQ ID NO: 289517 - DNA, 25 bp, Mus musculus
atttgccgaatgctatgaatgctgc

SEQ ID NO: 289518 - DNA, 25 bp, Mus musculus
atttgccgaatggtatgaatgctgc

SEQ ID NO: 289519 - DNA, 25 bp, Mus musculus
atttgcctacacaaggtctttctag

SEQ ID NO: 289520 - DNA, 25 bp, Mus musculus
atttgcctacactaggtctttctag

SEQ ID NO: 289521 - DNA, 25 bp, Mus musculus
atttgcctactaccaagtttgcctg

SEQ ID NO: 289522 - DNA, 25 bp, Mus musculus
atttgcctactagcaagtttgcctg

SEQ ID NO: 289523 - DNA, 25 bp, Mus musculus
atttgcctatagacgagctgagttt

SEQ ID NO: 289524 - DNA, 25 bp, Mus musculus
atttgcctatagtcgagctgagttt

SEQ ID NO: 289525 - DNA, 25 bp, Mus musculus
atttgcctattaagacactgcaagg

SEQ ID NO: 289526 - DNA, 25 bp, Mus musculus
atttgcctattatgacactgcaagg

SEQ ID NO: 289527 - DNA, 25 bp, Mus musculus
atttgcctcaaacggtgctctgatt

SEQ ID NO: 289528 - DNA, 25 bp, Mus musculus
atttgcctcaaagggtgctctgatt

SEQ ID NO: 289529 - DNA, 25 bp, Mus musculus
atttgcctcatacacctcaagcaga

SEQ ID NO: 289530 - DNA, 25 bp, Mus musculus
atttgcctcatagacctcaagcaga

SEQ ID NO: 289531 - DNA, 25 bp, Mus musculus
atttgcctcctacttccatatctaa

SEQ ID NO: 289532 - DNA, 25 bp, Mus musculus
atttgcctcctagttccatatctaa

SEQ ID NO: 289533 - DNA, 25 bp, Mus musculus
atttgcctcctgactttgggaagtg

SEQ ID NO: 289534 - DNA, 25 bp, Mus musculus
atttgcctcctgtctttgggaagtg

SEQ ID NO: 289535 - DNA, 25 bp, Mus musculus
atttgcctctacattgtattgttga

SEQ ID NO: 289536 - DNA, 25 bp, Mus musculus
atttgcctctactttgtattgttga

SEQ ID NO: 289537 - DNA, 25 bp, Mus musculus
atttgcctctcacttatgacacagt

SEQ ID NO: 289538 - DNA, 25 bp, Mus musculus
atttgcctctcagttatgacacagt

SEQ ID NO: 289539 - DNA, 25 bp, Mus musculus
atttgcctcttcaatattccctaag

SEQ ID NO: 289540 - DNA, 25 bp, Mus musculus
atttgcctcttctatattccctaag

SEQ ID NO: 289541 - DNA, 25 bp, Mus musculus
atttgcctctttagactccacaaaa

SEQ ID NO: 289542 - DNA, 25 bp, Mus musculus
atttgcctcttttgactccacaaaa

SEQ ID NO: 289543 - DNA, 25 bp, Mus musculus
atttgcctgaccatgtgggatgtca

SEQ ID NO: 289544 - DNA, 25 bp, Mus musculus
atttgcctgaccttgtgggatgtca

SEQ ID NO: 289545 - DNA, 25 bp, Mus musculus
atttgcctgaggatcactttactcc

SEQ ID NO: 289546 - DNA, 25 bp, Mus musculus
atttgcctgaggttcactttactcc

SEQ ID NO: 289547 - DNA, 25 bp, Mus musculus
atttgcctgcataaccggtcgatgc

SEQ ID NO: 289548 - DNA, 25 bp, Mus musculus
atttgcctgcattaccggtcgatgc

SEQ ID NO: 289549 - DNA, 25 bp, Mus musculus
atttgcctgcgtatccaggacaatt

SEQ ID NO: 289550 - DNA, 25 bp, Mus musculus
atttgcctgcgtcactggtagacta

SEQ ID NO: 289551 - DNA, 25 bp, Mus musculus
atttgcctgcgtgactggtagacta

SEQ ID NO: 289552 - DNA, 25 bp, Mus musculus
atttgcctgcgtttccaggacaatt

SEQ ID NO: 289553 - DNA, 25 bp, Mus musculus
atttgcctggacagagactgttgga

SEQ ID NO: 289554 - DNA, 25 bp, Mus musculus
atttgcctggactgagactgttgga

SEQ ID NO: 289555 - DNA, 25 bp, Mus musculus
atttgcctggcaagcgcttactgac

SEQ ID NO: 289556 - DNA, 25 bp, Mus musculus
atttgcctggcatgcgcttactgac

SEQ ID NO: 289557 - DNA, 25 bp, Mus musculus
atttgcctggtgagtactgtagtct

SEQ ID NO: 289558 - DNA, 25 bp, Mus musculus
atttgcctggtgtgtactgtagtct

SEQ ID NO: 289559 - DNA, 25 bp, Mus musculus
atttgcctgtgactgttcgttccct

SEQ ID NO: 289560 - DNA, 25 bp, Mus musculus
atttgcctgtgagtgttcgttccct

SEQ ID NO: 289561 - DNA, 25 bp, Mus musculus
atttgcctgtgtaatgtgctcatca

SEQ ID NO: 289562 - DNA, 25 bp, Mus musculus
atttgcctgtgttatgtgctcatca

SEQ ID NO: 289563 - DNA, 25 bp, Mus musculus
atttgcctgttaatgttcaccttga

SEQ ID NO: 289564 - DNA, 25 bp, Mus musculus
atttgcctgttattgttcaccttga

SEQ ID NO: 289565 - DNA, 25 bp, Mus musculus
atttgccttccaaaccacaatgaga

SEQ ID NO: 289566 - DNA, 25 bp, Mus musculus
atttgccttccataccacaatgaga

SEQ ID NO: 289567 - DNA, 25 bp, Mus musculus
atttgccttccgcatccttttggta

SEQ ID NO: 289568 - DNA, 25 bp, Mus musculus
atttgccttccggatccttttggta

SEQ ID NO: 289569 - DNA, 25 bp, Mus musculus
atttgccttcctaaaatgaagtgga

SEQ ID NO: 289570 - DNA, 25 bp, Mus musculus
atttgccttccttaaatgaagtgga

SEQ ID NO: 289571 - DNA, 25 bp, Mus musculus
atttgccttctaactatcttgggac

SEQ ID NO: 289572 - DNA, 25 bp, Mus musculus
atttgccttctatctatcttgggac

SEQ ID NO: 289573 - DNA, 25 bp, Mus musculus
atttgccttgtactcccagagctca

SEQ ID NO: 289574 - DNA, 25 bp, Mus musculus
atttgccttgtagtcccagagctca

SEQ ID NO: 289575 - DNA, 25 bp, Mus musculus
atttgccttgtgctaaaatccagcg

SEQ ID NO: 289576 - DNA, 25 bp, Mus musculus
atttgccttgtggtaaaatccagcg

SEQ ID NO: 289577 - DNA, 25 bp, Mus musculus
atttgcgagccaaggcagctgccaa

SEQ ID NO: 289578 - DNA, 25 bp, Mus musculus
atttgcgagccatggcagctgccaa

SEQ ID NO: 289579 - DNA, 25 bp, Mus musculus
atttgcgagggaatgctttctgtat

SEQ ID NO: 289580 - DNA, 25 bp, Mus musculus
atttgcgagggattgctttctgtat

SEQ ID NO: 289581 - DNA, 25 bp, Mus musculus
atttgcgcctgtacttcatttcaca

SEQ ID NO: 289582 - DNA, 25 bp, Mus musculus
atttgcgcctgttcttcatttcaca

SEQ ID NO: 289583 - DNA, 25 bp, Mus musculus
atttgcggaactccactgagccagg

SEQ ID NO: 289584 - DNA, 25 bp, Mus musculus
atttgcggaactgcactgagccagg

SEQ ID NO: 289585 - DNA, 25 bp, Mus musculus
atttgcgtatgccttcaagcttgca

SEQ ID NO: 289586 - DNA, 25 bp, Mus musculus
atttgcgtatgcgttcaagcttgca

SEQ ID NO: 289587 - DNA, 25 bp, Mus musculus
atttgcgtctttctcggcacagaac

SEQ ID NO: 289588 - DNA, 25 bp, Mus musculus
atttgcgtctttgtcggcacagaac

SEQ ID NO: 289589 - DNA, 25 bp, Mus musculus
atttgcgtgcaacttgggtattttt

SEQ ID NO: 289590 - DNA, 25 bp, Mus musculus
atttgcgtgcaagttgggtattttt

SEQ ID NO: 289591 - DNA, 25 bp, Mus musculus
atttgctaatgcaacattgacccta

SEQ ID NO: 289592 - DNA, 25 bp, Mus musculus
atttgctaatgctacattgacccta

SEQ ID NO: 289593 - DNA, 25 bp, Mus musculus
atttgctacataacccaggcaagga

SEQ ID NO: 289594 - DNA, 25 bp, Mus musculus
atttgctacatatcccaggcaagga

SEQ ID NO: 289595 - DNA, 25 bp, Mus musculus
atttgctacatccatgttcttcctt

SEQ ID NO: 289596 - DNA, 25 bp, Mus musculus
atttgctacatcgatgttcttcctt

SEQ ID NO: 289597 - DNA, 25 bp, Mus musculus
atttgctaccaaccaagataccaag

SEQ ID NO: 289598 - DNA, 25 bp, Mus musculus
atttgctaccaagcaagataccaag

SEQ ID NO: 289599 - DNA, 25 bp, Mus musculus
atttgctaccacattcaggtttttg

SEQ ID NO: 289600 - DNA, 25 bp, Mus musculus
atttgctaccactttcaggtttttg

SEQ ID NO: 289601 - DNA, 25 bp, Mus musculus
atttgctacttcctggtctaaccag

SEQ ID NO: 289602 - DNA, 25 bp, Mus musculus
atttgctacttcgtggtctaaccag

SEQ ID NO: 289603 - DNA, 25 bp, Mus musculus
atttgctacttgcatgcccttgaaa

SEQ ID NO: 289604 - DNA, 25 bp, Mus musculus
atttgctacttggatgcccttgaaa

SEQ ID NO: 289605 - DNA, 25 bp, Mus musculus
atttgctagagcatgtttgtcagtt

SEQ ID NO: 289606 - DNA, 25 bp, Mus musculus
atttgctagagcttgtttgtcagtt

SEQ ID NO: 289607 - DNA, 25 bp, Mus musculus
atttgctatctactttggctatggg

SEQ ID NO: 289608 - DNA, 25 bp, Mus musculus
atttgctatctagtttggctatggg

SEQ ID NO: 289609 - DNA, 25 bp, Mus musculus
atttgctattagatttgtgccatat

SEQ ID NO: 289610 - DNA, 25 bp, Mus musculus
atttgctattagttttgtgccatat

SEQ ID NO: 289611 - DNA, 25 bp, Mus musculus
atttgctatttaatctacgtgttga

SEQ ID NO: 289612 - DNA, 25 bp, Mus musculus
atttgctatttattctacgtgttga

SEQ ID NO: 289613 - DNA, 25 bp, Mus musculus
atttgctcaactctatggctttagg

SEQ ID NO: 289614 - DNA, 25 bp, Mus musculus
atttgctcaactgtatggctttagg

SEQ ID NO: 289615 - DNA, 25 bp, Mus musculus
atttgctcaatgaagcctacccagg

SEQ ID NO: 289616 - DNA, 25 bp, Mus musculus
atttgctcaatgtagcctacccagg

SEQ ID NO: 289617 - DNA, 25 bp, Mus musculus
atttgctcactccataaaacagaag

SEQ ID NO: 289618 - DNA, 25 bp, Mus musculus
atttgctcactcgataaaacagaag

SEQ ID NO: 289619 - DNA, 25 bp, Mus musculus
atttgctcagagaagtcccatgttc

SEQ ID NO: 289620 - DNA, 25 bp, Mus musculus
atttgctcagagtagtcccatgttc

SEQ ID NO: 289621 - DNA, 25 bp, Mus musculus
atttgctcaggcaattattttgcta

SEQ ID NO: 289622 - DNA, 25 bp, Mus musculus
atttgctcaggctattattttgcta

SEQ ID NO: 289623 - DNA, 25 bp, Mus musculus
atttgctccataatgcccttaattg

SEQ ID NO: 289624 - DNA, 25 bp, Mus musculus
atttgctccatattgcccttaattg

SEQ ID NO: 289625 - DNA, 25 bp, Mus musculus
atttgctcctgaatcttgctcattc

SEQ ID NO: 289626 - DNA, 25 bp, Mus musculus
atttgctcctgattcttgctcattc

SEQ ID NO: 289627 - DNA, 25 bp, Mus musculus
atttgctccttgctgccatacacaa

SEQ ID NO: 289628 - DNA, 25 bp, Mus musculus
atttgctccttggtgccatacacaa

SEQ ID NO: 289629 - DNA, 25 bp, Mus musculus
atttgctctcatactgtgtgtggta

SEQ ID NO: 289630 - DNA, 25 bp, Mus musculus
atttgctctcattctgtgtgtggta

SEQ ID NO: 289631 - DNA, 25 bp, Mus musculus
atttgctctgtcagcagttctggac

SEQ ID NO: 289632 - DNA, 25 bp, Mus musculus
atttgctctgtctgcagttctggac

SEQ ID NO: 289633 - DNA, 25 bp, Mus musculus
atttgctcttagaagctgccctggg

SEQ ID NO: 289634 - DNA, 25 bp, Mus musculus
atttgctcttagtagctgccctggg

SEQ ID NO: 289635 - DNA, 25 bp, Mus musculus
atttgctcttgaagcagtgtcctac

SEQ ID NO: 289636 - DNA, 25 bp, Mus musculus
atttgctcttgatgcagtgtcctac

SEQ ID NO: 289637 - DNA, 25 bp, Mus musculus
atttgctcttggcatttaatactgg

SEQ ID NO: 289638 - DNA, 25 bp, Mus musculus
atttgctcttgggatttaatactgg

SEQ ID NO: 289639 - DNA, 25 bp, Mus musculus
atttgctgaaatcccttggtatcaa

SEQ ID NO: 289640 - DNA, 25 bp, Mus musculus
atttgctgaaatgccttggtatcaa

SEQ ID NO: 289641 - DNA, 25 bp, Mus musculus
atttgctgaaccatgcagggcctga

SEQ ID NO: 289642 - DNA, 25 bp, Mus musculus
atttgctgaaccttgcagggcctga

SEQ ID NO: 289643 - DNA, 25 bp, Mus musculus
atttgctgacagaggctcttgagtc

SEQ ID NO: 289644 - DNA, 25 bp, Mus musculus
atttgctgacagtggctcttgagtc

SEQ ID NO: 289645 - DNA, 25 bp, Mus musculus
atttgctgacctctatggaattccc

SEQ ID NO: 289646 - DNA, 25 bp, Mus musculus
atttgctgacctgtatggaattccc

SEQ ID NO: 289647 - DNA, 25 bp, Mus musculus
atttgctgagcacccactcgtggtg

SEQ ID NO: 289648 - DNA, 25 bp, Mus musculus
atttgctgagcagccactcgtggtg

SEQ ID NO: 289649 - DNA, 25 bp, Mus musculus
atttgctgagctcatcgggagcaat

SEQ ID NO: 289650 - DNA, 25 bp, Mus musculus
atttgctgagctgatcgggagcaat

SEQ ID NO: 289651 - DNA, 25 bp, Mus musculus
atttgctgatatctcatgcatggga

SEQ ID NO: 289652 - DNA, 25 bp, Mus musculus
atttgctgatatgtcatgcatggga

SEQ ID NO: 289653 - DNA, 25 bp, Mus musculus
atttgctgcaacaagcgaaggctca

SEQ ID NO: 289654 - DNA, 25 bp, Mus musculus
atttgctgcaactagcgaaggctca

SEQ ID NO: 289655 - DNA, 25 bp, Mus musculus
atttgctgcacacaatttgcaccag

SEQ ID NO: 289656 - DNA, 25 bp, Mus musculus
atttgctgcacagaatttgcaccag

SEQ ID NO: 289657 - DNA, 25 bp, Mus musculus
atttgctgccgcctgaccagagatg

SEQ ID NO: 289658 - DNA, 25 bp, Mus musculus
atttgctgccgcgtgaccagagatg

SEQ ID NO: 289659 - DNA, 25 bp, Mus musculus
atttgctgcctaaagctcttcaagt

SEQ ID NO: 289660 - DNA, 25 bp, Mus musculus
atttgctgcctatagctcttcaagt

SEQ ID NO: 289661 - DNA, 25 bp, Mus musculus
atttgctgccttccttgagtatgct

SEQ ID NO: 289662 - DNA, 25 bp, Mus musculus
atttgctgccttgcttgagtatgct

SEQ ID NO: 289663 - DNA, 25 bp, Mus musculus
atttgctggacactgatggatcatc

SEQ ID NO: 289664 - DNA, 25 bp, Mus musculus
atttgctggacagtgatggatcatc

SEQ ID NO: 289665 - DNA, 25 bp, Mus musculus
atttgctggcacaaattaacaaaca

SEQ ID NO: 289666 - DNA, 25 bp, Mus musculus
atttgctggcactaattaacaaaca

SEQ ID NO: 289667 - DNA, 25 bp, Mus musculus
atttgctggcctacttgagatttac

SEQ ID NO: 289668 - DNA, 25 bp, Mus musculus
atttgctggccttcttgagatttac

SEQ ID NO: 289669 - DNA, 25 bp, Mus musculus
atttgctgggatacaatgaaatctg

SEQ ID NO: 289670 - DNA, 25 bp, Mus musculus
atttgctgggattcaatgaaatctg

SEQ ID NO: 289671 - DNA, 25 bp, Mus musculus
atttgctgtaatagcaccagcatct

SEQ ID NO: 289672 - DNA, 25 bp, Mus musculus
atttgctgtaattgcaccagcatct

SEQ ID NO: 289673 - DNA, 25 bp, Mus musculus
atttgctgtaggctgctttctgcgt

SEQ ID NO: 289674 - DNA, 25 bp, Mus musculus
atttgctgtagggtgctttctgcgt

SEQ ID NO: 289675 - DNA, 25 bp, Mus musculus
atttgctgtatgcttgcacaacaaa

SEQ ID NO: 289676 - DNA, 25 bp, Mus musculus
atttgctgtatggttgcacaacaaa

SEQ ID NO: 289677 - DNA, 25 bp, Mus musculus
atttgctgtggcctcctcgacaaag

SEQ ID NO: 289678 - DNA, 25 bp, Mus musculus
atttgctgtggcgtcctcgacaaag

SEQ ID NO: 289679 - DNA, 25 bp, Mus musculus
atttgctgttcaactggaaatttca

SEQ ID NO: 289680 - DNA, 25 bp, Mus musculus
atttgctgttcatctggaaatttca

SEQ ID NO: 289681 - DNA, 25 bp, Mus musculus
atttgctgttgactgtgtttacaca

SEQ ID NO: 289682 - DNA, 25 bp, Mus musculus
atttgctgttgagtgtgtttacaca

SEQ ID NO: 289683 - DNA, 25 bp, Mus musculus
atttgcttaagaactccttaggaag

SEQ ID NO: 289684 - DNA, 25 bp, Mus musculus
atttgcttaagatctccttaggaag

SEQ ID NO: 289685 - DNA, 25 bp, Mus musculus
atttgcttaggccaatgtcaactgt

SEQ ID NO: 289686 - DNA, 25 bp, Mus musculus
atttgcttaggcgaatgtcaactgt

SEQ ID NO: 289687 - DNA, 25 bp, Mus musculus
atttgcttataaaatcccagggcac

SEQ ID NO: 289688 - DNA, 25 bp, Mus musculus
atttgcttataatatcccagggcac

SEQ ID NO: 289689 - DNA, 25 bp, Mus musculus
atttgcttcaatatcgtttttctat

SEQ ID NO: 289690 - DNA, 25 bp, Mus musculus
atttgcttcaatttcgtttttctat

SEQ ID NO: 289691 - DNA, 25 bp, Mus musculus
atttgcttccctcccgggtttattg

SEQ ID NO: 289692 - DNA, 25 bp, Mus musculus
atttgcttccctgccgggtttattg

SEQ ID NO: 289693 - DNA, 25 bp, Mus musculus
atttgcttgaaacatttctttagac

SEQ ID NO: 289694 - DNA, 25 bp, Mus musculus
atttgcttgaaagatttctttagac

SEQ ID NO: 289695 - DNA, 25 bp, Mus musculus
atttgctttactactggtctttgga

SEQ ID NO: 289696 - DNA, 25 bp, Mus musculus
atttgctttacttctggtctttgga

SEQ ID NO: 289697 - DNA, 25 bp, Mus musculus
atttgctttagcaggtgttttatgg

SEQ ID NO: 289698 - DNA, 25 bp, Mus musculus
atttgctttagctggtgttttatgg

SEQ ID NO: 289699 - DNA, 25 bp, Mus musculus
atttgctttcagaccaagagatgat

SEQ ID NO: 289700 - DNA, 25 bp, Mus musculus
atttgctttcagtccaagagatgat

SEQ ID NO: 289701 - DNA, 25 bp, Mus musculus
atttgctttcataaatatggttcat

SEQ ID NO: 289702 - DNA, 25 bp, Mus musculus
atttgctttcattaatatggttcat

SEQ ID NO: 289703 - DNA, 25 bp, Mus musculus
atttgctttcctacacagtatgagg

SEQ ID NO: 289704 - DNA, 25 bp, Mus musculus
atttgctttccttcacagtatgagg

SEQ ID NO: 289705 - DNA, 25 bp, Mus musculus
atttgctttgagcagatctactagg

SEQ ID NO: 289706 - DNA, 25 bp, Mus musculus
atttgctttgaggagatctactagg

SEQ ID NO: 289707 - DNA, 25 bp, Mus musculus
atttgctttggtactagggcactgc

SEQ ID NO: 289708 - DNA, 25 bp, Mus musculus
atttgctttggttctagggcactgc

SEQ ID NO: 289709 - DNA, 25 bp, Mus musculus
atttgctttgttatgatctgataca

SEQ ID NO: 289710 - DNA, 25 bp, Mus musculus
atttgctttgttttgatctgataca

SEQ ID NO: 289711 - DNA, 25 bp, Mus musculus
atttgcttttaaacatgtgcttcca

SEQ ID NO: 289712 - DNA, 25 bp, Mus musculus
atttgcttttaatcatgtgcttcca

SEQ ID NO: 289713 - DNA, 25 bp, Mus musculus
atttgcttttatctctccttttcag

SEQ ID NO: 289714 - DNA, 25 bp, Mus musculus
atttgcttttatgtctccttttcag

SEQ ID NO: 289715 - DNA, 25 bp, Mus musculus
atttgcttttccatggccagtttca

SEQ ID NO: 289716 - DNA, 25 bp, Mus musculus
atttgcttttcccttgtgagtcctg

SEQ ID NO: 289717 - DNA, 25 bp, Mus musculus
atttgcttttccgttgtgagtcctg

SEQ ID NO: 289718 - DNA, 25 bp, Mus musculus
atttgcttttccttggccagtttca

SEQ ID NO: 289719 - DNA, 25 bp, Mus musculus
atttgctttttgaacgctacgtcca

SEQ ID NO: 289720 - DNA, 25 bp, Mus musculus
atttgctttttgtacgctacgtcca

SEQ ID NO: 289721 - DNA, 25 bp, Mus musculus
atttggaaatcgctgctcattcttc

SEQ ID NO: 289722 - DNA, 25 bp, Mus musculus
atttggaaatcggtgctcattcttc

SEQ ID NO: 289723 - DNA, 25 bp, Mus musculus
atttggaacgcaccacactaggctg

SEQ ID NO: 289724 - DNA, 25 bp, Mus musculus
atttggaacgcagcacactaggctg

SEQ ID NO: 289725 - DNA, 25 bp, Mus musculus
atttggaactgaatcctcctctagc

SEQ ID NO: 289726 - DNA, 25 bp, Mus musculus
atttggaactgattcctcctctagc

SEQ ID NO: 289727 - DNA, 25 bp, Mus musculus
atttggaagcaactacgcagcccac

SEQ ID NO: 289728 - DNA, 25 bp, Mus musculus
atttggaagcaagtacgcagcccac

SEQ ID NO: 289729 - DNA, 25 bp, Mus musculus
atttggaagcgcagtactgtttttc

SEQ ID NO: 289730 - DNA, 25 bp, Mus musculus
atttggaagcgctgtactgtttttc

SEQ ID NO: 289731 - DNA, 25 bp, Mus musculus
atttggaaggctcgccgctggcttt

SEQ ID NO: 289732 - DNA, 25 bp, Mus musculus
atttggaaggctggccgctggcttt

SEQ ID NO: 289733 - DNA, 25 bp, Mus musculus
atttggaatccaacagcccctcaat

SEQ ID NO: 289734 - DNA, 25 bp, Mus musculus
atttggaatccaaccgcatctgcaa

SEQ ID NO: 289735 - DNA, 25 bp, Mus musculus
atttggaatccatcagcccctcaat

SEQ ID NO: 289736 - DNA, 25 bp, Mus musculus
atttggaatccatccgcatctgcaa

SEQ ID NO: 289737 - DNA, 25 bp, Mus musculus
atttggacacgacttatctacctct

SEQ ID NO: 289738 - DNA, 25 bp, Mus musculus
atttggacacgagttatctacctct

SEQ ID NO: 289739 - DNA, 25 bp, Mus musculus
atttggacacttcttgctgtttgag

SEQ ID NO: 289740 - DNA, 25 bp, Mus musculus
atttggacacttgttgctgtttgag

SEQ ID NO: 289741 - DNA, 25 bp, Mus musculus
atttggacatgtcctctgttctctc

SEQ ID NO: 289742 - DNA, 25 bp, Mus musculus
atttggacatgtgctctgttctctc

SEQ ID NO: 289743 - DNA, 25 bp, Mus musculus
atttggaccccacagatacttttct

SEQ ID NO: 289744 - DNA, 25 bp, Mus musculus
atttggaccccacggcttctatggc

SEQ ID NO: 289745 - DNA, 25 bp, Mus musculus
atttggaccccagagatacttttct

SEQ ID NO: 289746 - DNA, 25 bp, Mus musculus
atttggaccccagggcttctatggc

SEQ ID NO: 289747 - DNA, 25 bp, Mus musculus
atttggaccctgagaagaatgttcg

SEQ ID NO: 289748 - DNA, 25 bp, Mus musculus
atttggaccctgtgaagaatgttcg

SEQ ID NO: 289749 - DNA, 25 bp, Mus musculus
atttggaccgaaattctcttcactc

SEQ ID NO: 289750 - DNA, 25 bp, Mus musculus
atttggaccgaatttctcttcactc

SEQ ID NO: 289751 - DNA, 25 bp, Mus musculus
atttggaccttactcatccagtaga

SEQ ID NO: 289752 - DNA, 25 bp, Mus musculus
atttggaccttagtcatccagtaga

SEQ ID NO: 289753 - DNA, 25 bp, Mus musculus
atttggacgctactgagtcacctgg

SEQ ID NO: 289754 - DNA, 25 bp, Mus musculus
atttggacgctagtgagtcacctgg

SEQ ID NO: 289755 - DNA, 25 bp, Mus musculus
atttggactagccatcttcagtaga

SEQ ID NO: 289756 - DNA, 25 bp, Mus musculus
atttggactagcgatcttcagtaga

SEQ ID NO: 289757 - DNA, 25 bp, Mus musculus
atttggactcggcttttgctggcat

SEQ ID NO: 289758 - DNA, 25 bp, Mus musculus
atttggactcgggttttgctggcat

SEQ ID NO: 289759 - DNA, 25 bp, Mus musculus
atttggactctactactgttctgaa

SEQ ID NO: 289760 - DNA, 25 bp, Mus musculus
atttggactctagtactgttctgaa

SEQ ID NO: 289761 - DNA, 25 bp, Mus musculus
atttggactctgctgtgaagaggct

SEQ ID NO: 289762 - DNA, 25 bp, Mus musculus
atttggactctggtgtgaagaggct

SEQ ID NO: 289763 - DNA, 25 bp, Mus musculus
atttggactggaaggcataccacca

SEQ ID NO: 289764 - DNA, 25 bp, Mus musculus
atttggactggatggcataccacca

SEQ ID NO: 289765 - DNA, 25 bp, Mus musculus
atttggacttagctctctgtagatc

SEQ ID NO: 289766 - DNA, 25 bp, Mus musculus
atttggacttaggtctctgtagatc

SEQ ID NO: 289767 - DNA, 25 bp, Mus musculus
atttggagaaatcgcacgcccggcc

SEQ ID NO: 289768 - DNA, 25 bp, Mus musculus
atttggagaaatggcacgcccggcc

SEQ ID NO: 289769 - DNA, 25 bp, Mus musculus
atttggagaagtcagtgttcaccta

SEQ ID NO: 289770 - DNA, 25 bp, Mus musculus
atttggagaagtgagtgttcaccta

SEQ ID NO: 289771 - DNA, 25 bp, Mus musculus
atttggagactaactgccctgtagc

SEQ ID NO: 289772 - DNA, 25 bp, Mus musculus
atttggagactatctgccctgtagc

SEQ ID NO: 289773 - DNA, 25 bp, Mus musculus
atttggagacttcttgcagcattct

SEQ ID NO: 289774 - DNA, 25 bp, Mus musculus
atttggagacttgttgcagcattct

SEQ ID NO: 289775 - DNA, 25 bp, Mus musculus
atttggagagccacgggccaacaga

SEQ ID NO: 289776 - DNA, 25 bp, Mus musculus
atttggagagcctcgggccaacaga

SEQ ID NO: 289777 - DNA, 25 bp, Mus musculus
atttggagcaatcatattttctttt

SEQ ID NO: 289778 - DNA, 25 bp, Mus musculus
atttggagcaatgatattttctttt

SEQ ID NO: 289779 - DNA, 25 bp, Mus musculus
atttggagcctgcaaacgctgtgct

SEQ ID NO: 289780 - DNA, 25 bp, Mus musculus
atttggagcctggaaacgctgtgct

SEQ ID NO: 289781 - DNA, 25 bp, Mus musculus
atttggagcgaaaacacctggatct

SEQ ID NO: 289782 - DNA, 25 bp, Mus musculus
atttggagcgaatacacctggatct

SEQ ID NO: 289783 - DNA, 25 bp, Mus musculus
atttggaggattctccacgcccgtc

SEQ ID NO: 289784 - DNA, 25 bp, Mus musculus
atttggaggattgtccacgcccgtc

SEQ ID NO: 289785 - DNA, 25 bp, Mus musculus
atttggagggctcgcttcagtcgca

SEQ ID NO: 289786 - DNA, 25 bp, Mus musculus
atttggagggctggcttcagtcgca

SEQ ID NO: 289787 - DNA, 25 bp, Mus musculus
atttggagtataaccaagcacccac

SEQ ID NO: 289788 - DNA, 25 bp, Mus musculus
atttggagtatatccaagcacccac

SEQ ID NO: 289789 - DNA, 25 bp, Mus musculus
atttggagtgctattgttcttgttg

SEQ ID NO: 289790 - DNA, 25 bp, Mus musculus
atttggagtgcttttgttcttgttg

SEQ ID NO: 289791 - DNA, 25 bp, Mus musculus
atttggatcaggagcaggacacact

SEQ ID NO: 289792 - DNA, 25 bp, Mus musculus
atttggatcaggtgcaggacacact

SEQ ID NO: 289793 - DNA, 25 bp, Mus musculus
atttggatctctcagcacatgaact

SEQ ID NO: 289794 - DNA, 25 bp, Mus musculus
atttggatctctgagcacatgaact

SEQ ID NO: 289795 - DNA, 25 bp, Mus musculus
atttggatcttacagactaggagtc

SEQ ID NO: 289796 - DNA, 25 bp, Mus musculus
atttggatcttagagactaggagtc

SEQ ID NO: 289797 - DNA, 25 bp, Mus musculus
atttggatgtctcatgttttgtttc

SEQ ID NO: 289798 - DNA, 25 bp, Mus musculus
atttggatgtctgatgttttgtttc

SEQ ID NO: 289799 - DNA, 25 bp, Mus musculus
atttggattgcacaaacccacggtc

SEQ ID NO: 289800 - DNA, 25 bp, Mus musculus
atttggattgcagaaacccacggtc

SEQ ID NO: 289801 - DNA, 25 bp, Mus musculus
atttggattggtagcacgccatggt

SEQ ID NO: 289802 - DNA, 25 bp, Mus musculus
atttggattggttgcacgccatggt

SEQ ID NO: 289803 - DNA, 25 bp, Mus musculus
atttggatttcgatggtgctgtaga

SEQ ID NO: 289804 - DNA, 25 bp, Mus musculus
atttggatttcgttggtgctgtaga

SEQ ID NO: 289805 - DNA, 25 bp, Mus musculus
atttggcaagtcagaagatccctga

SEQ ID NO: 289806 - DNA, 25 bp, Mus musculus
atttggcaagtctgaagatccctga

SEQ ID NO: 289807 - DNA, 25 bp, Mus musculus
atttggcaataactcagctccctct

SEQ ID NO: 289808 - DNA, 25 bp, Mus musculus
atttggcaataagtcagctccctct

SEQ ID NO: 289809 - DNA, 25 bp, Mus musculus
atttggcaatgaagtccctctattc

SEQ ID NO: 289810 - DNA, 25 bp, Mus musculus
atttggcaatgatgtccctctattc

SEQ ID NO: 289811 - DNA, 25 bp, Mus musculus
atttggcacagcaagtcctttcctg

SEQ ID NO: 289812 - DNA, 25 bp, Mus musculus
atttggcacagctagtcctttcctg

SEQ ID NO: 289813 - DNA, 25 bp, Mus musculus
atttggcaccaacactgggatccac

SEQ ID NO: 289814 - DNA, 25 bp, Mus musculus
atttggcaccaagactgggatccac

SEQ ID NO: 289815 - DNA, 25 bp, Mus musculus
atttggcaccagaaggcccaggaga

SEQ ID NO: 289816 - DNA, 25 bp, Mus musculus
atttggcaccagtaggcccaggaga

SEQ ID NO: 289817 - DNA, 25 bp, Mus musculus
atttggcacgtcctcataagcatca

SEQ ID NO: 289818 - DNA, 25 bp, Mus musculus
atttggcacgtcgtcataagcatca

SEQ ID NO: 289819 - DNA, 25 bp, Mus musculus
atttggcagaagacgtagtccccag

SEQ ID NO: 289820 - DNA, 25 bp, Mus musculus
atttggcagaagtcgtagtccccag

SEQ ID NO: 289821 - DNA, 25 bp, Mus musculus
atttggcagatgctcgtgggttcct

SEQ ID NO: 289822 - DNA, 25 bp, Mus musculus
atttggcagatggtcgtgggttcct

SEQ ID NO: 289823 - DNA, 25 bp, Mus musculus
atttggcagtaacatgtccatgtct

SEQ ID NO: 289824 - DNA, 25 bp, Mus musculus
atttggcagtaagatgtccatgtct

SEQ ID NO: 289825 - DNA, 25 bp, Mus musculus
atttggcatcagattttcgtcatca

SEQ ID NO: 289826 - DNA, 25 bp, Mus musculus
atttggcatcagtttttcgtcatca

SEQ ID NO: 289827 - DNA, 25 bp, Mus musculus
atttggcatgttccaactggcctgg

SEQ ID NO: 289828 - DNA, 25 bp, Mus musculus
atttggcatgttgcaactggcctgg

SEQ ID NO: 289829 - DNA, 25 bp, Mus musculus
atttggccaagaacgttcagactaa

SEQ ID NO: 289830 - DNA, 25 bp, Mus musculus
atttggccaagatcgttcagactaa

SEQ ID NO: 289831 - DNA, 25 bp, Mus musculus
atttggccaagtcaatgaccctctc

SEQ ID NO: 289832 - DNA, 25 bp, Mus musculus
atttggccaagtgaatgaccctctc

SEQ ID NO: 289833 - DNA, 25 bp, Mus musculus
atttggccacatcatcaggacactg

SEQ ID NO: 289834 - DNA, 25 bp, Mus musculus
atttggccacatgatcaggacactg

SEQ ID NO: 289835 - DNA, 25 bp, Mus musculus
atttggccagtgacactctcccttc

SEQ ID NO: 289836 - DNA, 25 bp, Mus musculus
atttggccagtgtcactctcccttc

SEQ ID NO: 289837 - DNA, 25 bp, Mus musculus
atttggcctccgagtgtcttgttaa

SEQ ID NO: 289838 - DNA, 25 bp, Mus musculus
atttggcctccgtgtgtcttgttaa

SEQ ID NO: 289839 - DNA, 25 bp, Mus musculus
atttggcctctgatactgaagcact

SEQ ID NO: 289840 - DNA, 25 bp, Mus musculus
atttggcctctgcacaagtgtgagt

SEQ ID NO: 289841 - DNA, 25 bp, Mus musculus
atttggcctctgcactcgggactct

SEQ ID NO: 289842 - DNA, 25 bp, Mus musculus
atttggcctctggacaagtgtgagt

SEQ ID NO: 289843 - DNA, 25 bp, Mus musculus
atttggcctctggactcgggactct

SEQ ID NO: 289844 - DNA, 25 bp, Mus musculus
atttggcctctgttactgaagcact

SEQ ID NO: 289845 - DNA, 25 bp, Mus musculus
atttggcctcttagaagagacagcc

SEQ ID NO: 289846 - DNA, 25 bp, Mus musculus
atttggcctctttgaagagacagcc

SEQ ID NO: 289847 - DNA, 25 bp, Mus musculus
atttggcctgaaatcctagggccca

SEQ ID NO: 289848 - DNA, 25 bp, Mus musculus
atttggcctgaattcctagggccca

SEQ ID NO: 289849 - DNA, 25 bp, Mus musculus
atttggccttgtcgtctctaattac

SEQ ID NO: 289850 - DNA, 25 bp, Mus musculus
atttggccttgtggtctctaattac

SEQ ID NO: 289851 - DNA, 25 bp, Mus musculus
atttggcgacttcaatagctttggt

SEQ ID NO: 289852 - DNA, 25 bp, Mus musculus
atttggcgacttgaatagctttggt

SEQ ID NO: 289853 - DNA, 25 bp, Mus musculus
atttggcgcccacagcaaacctgag

SEQ ID NO: 289854 - DNA, 25 bp, Mus musculus
atttggcgcccagagcaaacctgag

SEQ ID NO: 289855 - DNA, 25 bp, Mus musculus
atttggcggattatgcaggccacac

SEQ ID NO: 289856 - DNA, 25 bp, Mus musculus
atttggcggattttgcaggccacac

SEQ ID NO: 289857 - DNA, 25 bp, Mus musculus
atttggcgggacacaaatcccaggt

SEQ ID NO: 289858 - DNA, 25 bp, Mus musculus
atttggcgggactcaaatcccaggt

SEQ ID NO: 289859 - DNA, 25 bp, Mus musculus
atttggcgggctcgaagggcctgga

SEQ ID NO: 289860 - DNA, 25 bp, Mus musculus
atttggcgggctggaagggcctgga

SEQ ID NO: 289861 - DNA, 25 bp, Mus musculus
atttggcgtcctacagattcttaat

SEQ ID NO: 289862 - DNA, 25 bp, Mus musculus
atttggcgtccttcagattcttaat

SEQ ID NO: 289863 - DNA, 25 bp, Mus musculus
atttggctaccacatgttgcaggaa

SEQ ID NO: 289864 - DNA, 25 bp, Mus musculus
atttggctaccagatgttgcaggaa

SEQ ID NO: 289865 - DNA, 25 bp, Mus musculus
atttggctacctaaagagagtcata

SEQ ID NO: 289866 - DNA, 25 bp, Mus musculus
atttggctaccttaagagagtcata

SEQ ID NO: 289867 - DNA, 25 bp, Mus musculus
atttggctatgtcctctttgagaac

SEQ ID NO: 289868 - DNA, 25 bp, Mus musculus
atttggctatgtgctctttgagaac

SEQ ID NO: 289869 - DNA, 25 bp, Mus musculus
atttggctcactcggaaattagccc

SEQ ID NO: 289870 - DNA, 25 bp, Mus musculus
atttggctcactgggaaattagccc

SEQ ID NO: 289871 - DNA, 25 bp, Mus musculus
atttggctccttatcatgtataaca

SEQ ID NO: 289872 - DNA, 25 bp, Mus musculus
atttggctccttttcatgtataaca

SEQ ID NO: 289873 - DNA, 25 bp, Mus musculus
atttggctcgttctaggctggccat

SEQ ID NO: 289874 - DNA, 25 bp, Mus musculus
atttggctcgttgtaggctggccat

SEQ ID NO: 289875 - DNA, 25 bp, Mus musculus
atttggctctggactttgttggctc

SEQ ID NO: 289876 - DNA, 25 bp, Mus musculus
atttggctctggtctttgttggctc

SEQ ID NO: 289877 - DNA, 25 bp, Mus musculus
atttggctgactcttaaacctgctc

SEQ ID NO: 289878 - DNA, 25 bp, Mus musculus
atttggctgactgttaaacctgctc

SEQ ID NO: 289879 - DNA, 25 bp, Mus musculus
atttggctgcctacttatgctttta

SEQ ID NO: 289880 - DNA, 25 bp, Mus musculus
atttggctgccttcttatgctttta

SEQ ID NO: 289881 - DNA, 25 bp, Mus musculus
atttggctgctacatttgtgtgtgt

SEQ ID NO: 289882 - DNA, 25 bp, Mus musculus
atttggctgctactaatacctgaca

SEQ ID NO: 289883 - DNA, 25 bp, Mus musculus
atttggctgctagatttgtgtgtgt

SEQ ID NO: 289884 - DNA, 25 bp, Mus musculus
atttggctgctagtaatacctgaca

SEQ ID NO: 289885 - DNA, 25 bp, Mus musculus
atttggctggaacaaggtggcccac

SEQ ID NO: 289886 - DNA, 25 bp, Mus musculus
atttggctggaagaaggtggcccac

SEQ ID NO: 289887 - DNA, 25 bp, Mus musculus
atttggctggccctaccagtgtcag

SEQ ID NO: 289888 - DNA, 25 bp, Mus musculus
atttggctggccgtaccagtgtcag

SEQ ID NO: 289889 - DNA, 25 bp, Mus musculus
atttggctggctaacactgtgatct

SEQ ID NO: 289890 - DNA, 25 bp, Mus musculus
atttggctggcttacactgtgatct

SEQ ID NO: 289891 - DNA, 25 bp, Mus musculus
atttggctgtgaagagactcccatt

SEQ ID NO: 289892 - DNA, 25 bp, Mus musculus
atttggctgtgatgagactcccatt

SEQ ID NO: 289893 - DNA, 25 bp, Mus musculus
atttggctgtgcattacttttgtca

SEQ ID NO: 289894 - DNA, 25 bp, Mus musculus
atttggctgtgcattatcatcgctg

SEQ ID NO: 289895 - DNA, 25 bp, Mus musculus
atttggctgtgctttacttttgtca

SEQ ID NO: 289896 - DNA, 25 bp, Mus musculus
atttggctgtgctttatcatcgctg

SEQ ID NO: 289897 - DNA, 25 bp, Mus musculus
atttggctgtgtatgttgcctcaaa

SEQ ID NO: 289898 - DNA, 25 bp, Mus musculus
atttggctgtgtttgttgcctcaaa

SEQ ID NO: 289899 - DNA, 25 bp, Mus musculus
atttggcttccgcaaactcacttct

SEQ ID NO: 289900 - DNA, 25 bp, Mus musculus
atttggcttccggaaactcacttct

SEQ ID NO: 289901 - DNA, 25 bp, Mus musculus
atttggcttggtatgttcacacctt

SEQ ID NO: 289902 - DNA, 25 bp, Mus musculus
atttggcttggtttgttcacacctt

SEQ ID NO: 289903 - DNA, 25 bp, Mus musculus
atttggctttatctctaggtgtcct

SEQ ID NO: 289904 - DNA, 25 bp, Mus musculus
atttggctttatgtctaggtgtcct

SEQ ID NO: 289905 - DNA, 25 bp, Mus musculus
atttggctttttcttgagtctctgg

SEQ ID NO: 289906 - DNA, 25 bp, Mus musculus
atttggctttttgttgagtctctgg

SEQ ID NO: 289907 - DNA, 25 bp, Mus musculus
atttgggaaatccaggcttccacca

SEQ ID NO: 289908 - DNA, 25 bp, Mus musculus
atttgggaaatcgaggcttccacca

SEQ ID NO: 289909 - DNA, 25 bp, Mus musculus
atttgggaaccactctccccagcag

SEQ ID NO: 289910 - DNA, 25 bp, Mus musculus
atttgggaaccagtctccccagcag

SEQ ID NO: 289911 - DNA, 25 bp, Mus musculus
atttgggactatctacttttcataa

SEQ ID NO: 289912 - DNA, 25 bp, Mus musculus
atttgggactatgtacttttcataa

SEQ ID NO: 289913 - DNA, 25 bp, Mus musculus
atttgggactttatagacttgttct

SEQ ID NO: 289914 - DNA, 25 bp, Mus musculus
atttgggactttttagacttgttct

SEQ ID NO: 289915 - DNA, 25 bp, Mus musculus
atttgggagagtccttgcctagcat

SEQ ID NO: 289916 - DNA, 25 bp, Mus musculus
atttgggagagtgcttgcctagcat

SEQ ID NO: 289917 - DNA, 25 bp, Mus musculus
atttgggagcccactgtgccattag

SEQ ID NO: 289918 - DNA, 25 bp, Mus musculus
atttgggagccctctgtgccattag

SEQ ID NO: 289919 - DNA, 25 bp, Mus musculus
atttgggagtcaacgccctcttctc

SEQ ID NO: 289920 - DNA, 25 bp, Mus musculus
atttgggagtcatcgccctcttctc

SEQ ID NO: 289921 - DNA, 25 bp, Mus musculus
atttgggatcagaaatatgcctttt

SEQ ID NO: 289922 - DNA, 25 bp, Mus musculus
atttgggatcagtaatatgcctttt

SEQ ID NO: 289923 - DNA, 25 bp, Mus musculus
atttgggatcttaggctctggagac

SEQ ID NO: 289924 - DNA, 25 bp, Mus musculus
atttgggatcttatgtggactctcc

SEQ ID NO: 289925 - DNA, 25 bp, Mus musculus
atttgggatctttggctctggagac

SEQ ID NO: 289926 - DNA, 25 bp, Mus musculus
atttgggatcttttgtggactctcc

SEQ ID NO: 289927 - DNA, 25 bp, Mus musculus
atttgggatgctacatcggccaagt

SEQ ID NO: 289928 - DNA, 25 bp, Mus musculus
atttgggatgcttcatcggccaagt

SEQ ID NO: 289929 - DNA, 25 bp, Mus musculus
atttgggattccacagtgccttgca

SEQ ID NO: 289930 - DNA, 25 bp, Mus musculus
atttgggattcctcagtgccttgca

SEQ ID NO: 289931 - DNA, 25 bp, Mus musculus
atttgggatttaagttctctcctgt

SEQ ID NO: 289932 - DNA, 25 bp, Mus musculus
atttgggatttatgttctctcctgt

SEQ ID NO: 289933 - DNA, 25 bp, Mus musculus
atttgggatttcaagagagacctga

SEQ ID NO: 289934 - DNA, 25 bp, Mus musculus
atttgggatttctagagagacctga

SEQ ID NO: 289935 - DNA, 25 bp, Mus musculus
atttgggcaagacccggcataaact

SEQ ID NO: 289936 - DNA, 25 bp, Mus musculus
atttgggcaagagccggcataaact

SEQ ID NO: 289937 - DNA, 25 bp, Mus musculus
atttgggcactaaggaaggttccag

SEQ ID NO: 289938 - DNA, 25 bp, Mus musculus
atttgggcactaatcttgttatcca

SEQ ID NO: 289939 - DNA, 25 bp, Mus musculus
atttgggcactatggaaggttccag

SEQ ID NO: 289940 - DNA, 25 bp, Mus musculus
atttgggcactattcttgttatcca

SEQ ID NO: 289941 - DNA, 25 bp, Mus musculus
atttgggcagatcgtcaacatgctg

SEQ ID NO: 289942 - DNA, 25 bp, Mus musculus
atttgggcagatggtcaacatgctg

SEQ ID NO: 289943 - DNA, 25 bp, Mus musculus
atttgggcatgtatccggaaacgga

SEQ ID NO: 289944 - DNA, 25 bp, Mus musculus
atttgggcatgtttccggaaacgga

SEQ ID NO: 289945 - DNA, 25 bp, Mus musculus
atttgggccactagttaatgtgcgt

SEQ ID NO: 289946 - DNA, 25 bp, Mus musculus
atttgggccacttgttaatgtgcgt

SEQ ID NO: 289947 - DNA, 25 bp, Mus musculus
atttgggcccacattgcatacagag

SEQ ID NO: 289948 - DNA, 25 bp, Mus musculus
atttgggcccactttgcatacagag

SEQ ID NO: 289949 - DNA, 25 bp, Mus musculus
atttgggcctagagttccctgctgc

SEQ ID NO: 289950 - DNA, 25 bp, Mus musculus
atttgggcctagtgttccctgctgc

SEQ ID NO: 289951 - DNA, 25 bp, Mus musculus
atttgggcctcacacttagagtcta

SEQ ID NO: 289952 - DNA, 25 bp, Mus musculus
atttgggcctcagacttagagtcta

SEQ ID NO: 289953 - DNA, 25 bp, Mus musculus
atttgggcctgtattggtgatgtca

SEQ ID NO: 289954 - DNA, 25 bp, Mus musculus
atttgggcctgttttggtgatgtca

SEQ ID NO: 289955 - DNA, 25 bp, Mus musculus
atttgggctctcaactgatttgagt

SEQ ID NO: 289956 - DNA, 25 bp, Mus musculus
atttgggctctctactgatttgagt

SEQ ID NO: 289957 - DNA, 25 bp, Mus musculus
atttgggctgcaagtttccccacca

SEQ ID NO: 289958 - DNA, 25 bp, Mus musculus
atttgggctgcatgtttccccacca

SEQ ID NO: 289959 - DNA, 25 bp, Mus musculus
atttgggctgccatggaagtgcctt

SEQ ID NO: 289960 - DNA, 25 bp, Mus musculus
atttgggctgccttggaagtgcctt

SEQ ID NO: 289961 - DNA, 25 bp, Mus musculus
atttgggctggaacaagtagggact

SEQ ID NO: 289962 - DNA, 25 bp, Mus musculus
atttgggctggatcaagtagggact

SEQ ID NO: 289963 - DNA, 25 bp, Mus musculus
atttgggcttgtctttccctcttag

SEQ ID NO: 289964 - DNA, 25 bp, Mus musculus
atttgggcttgtgtttccctcttag

SEQ ID NO: 289965 - DNA, 25 bp, Mus musculus
atttgggtacctattcttactgagt

SEQ ID NO: 289966 - DNA, 25 bp, Mus musculus
atttgggtaccttttcttactgagt

SEQ ID NO: 289967 - DNA, 25 bp, Mus musculus
atttgggtctatcctatatctgcgc

SEQ ID NO: 289968 - DNA, 25 bp, Mus musculus
atttgggtctatgctatatctgcgc

SEQ ID NO: 289969 - DNA, 25 bp, Mus musculus
atttgggtctcactcatgatgttct

SEQ ID NO: 289970 - DNA, 25 bp, Mus musculus
atttgggtctcagtcatgatgttct

SEQ ID NO: 289971 - DNA, 25 bp, Mus musculus
atttgggtcttacatccttccctct

SEQ ID NO: 289972 - DNA, 25 bp, Mus musculus
atttgggtcttagatccttccctct

SEQ ID NO: 289973 - DNA, 25 bp, Mus musculus
atttgggttaggacttcatatctca

SEQ ID NO: 289974 - DNA, 25 bp, Mus musculus
atttgggttaggtcttcatatctca

SEQ ID NO: 289975 - DNA, 25 bp, Mus musculus
atttgggttcctatggatgcgaagg

SEQ ID NO: 289976 - DNA, 25 bp, Mus musculus
atttgggttcctttggatgcgaagg

SEQ ID NO: 289977 - DNA, 25 bp, Mus musculus
atttggtaaacacttgctctcatct

SEQ ID NO: 289978 - DNA, 25 bp, Mus musculus
atttggtaaacagttgctctcatct

SEQ ID NO: 289979 - DNA, 25 bp, Mus musculus
atttggtaaattatgaactggtgta

SEQ ID NO: 289980 - DNA, 25 bp, Mus musculus
atttggtaaattttgaactggtgta

SEQ ID NO: 289981 - DNA, 25 bp, Mus musculus
atttggtaagtgattcttgtgctat

SEQ ID NO: 289982 - DNA, 25 bp, Mus musculus
atttggtaagtgtttcttgtgctat

SEQ ID NO: 289983 - DNA, 25 bp, Mus musculus
atttggtactgtccacatctgggtg

SEQ ID NO: 289984 - DNA, 25 bp, Mus musculus
atttggtactgtgcacatctgggtg

SEQ ID NO: 289985 - DNA, 25 bp, Mus musculus
atttggtacttcacagtcttaggca

SEQ ID NO: 289986 - DNA, 25 bp, Mus musculus
atttggtacttctcagtcttaggca

SEQ ID NO: 289987 - DNA, 25 bp, Mus musculus
atttggtagcccaaccttgggtcag

SEQ ID NO: 289988 - DNA, 25 bp, Mus musculus
atttggtagccctaccttgggtcag

SEQ ID NO: 289989 - DNA, 25 bp, Mus musculus
atttggtagctactttggcccagac

SEQ ID NO: 289990 - DNA, 25 bp, Mus musculus
atttggtagctagtttggcccagac

SEQ ID NO: 289991 - DNA, 25 bp, Mus musculus
atttggtagctcactgcgtccagaa

SEQ ID NO: 289992 - DNA, 25 bp, Mus musculus
atttggtagctcattctttgccaga

SEQ ID NO: 289993 - DNA, 25 bp, Mus musculus
atttggtagctctctgcgtccagaa

SEQ ID NO: 289994 - DNA, 25 bp, Mus musculus
atttggtagctctttctttgccaga

SEQ ID NO: 289995 - DNA, 25 bp, Mus musculus
atttggtagctgagaacttcctaag

SEQ ID NO: 289996 - DNA, 25 bp, Mus musculus
atttggtagctgtgaacttcctaag

SEQ ID NO: 289997 - DNA, 25 bp, Mus musculus
atttggtagtcaagggctggctcag

SEQ ID NO: 289998 - DNA, 25 bp, Mus musculus
atttggtagtcatgggctggctcag

SEQ ID NO: 289999 - DNA, 25 bp, Mus musculus
atttggtattcaacacgttctcgtg

SEQ ID NO: 290000 - DNA, 25 bp, Mus musculus
atttggtattcatcacgttctcgtg

SEQ ID NO: 290001 - DNA, 25 bp, Mus musculus
atttggtcacttctgtctgtggcca

SEQ ID NO: 290002 - DNA, 25 bp, Mus musculus
atttggtcacttgtgtctgtggcca

SEQ ID NO: 290003 - DNA, 25 bp, Mus musculus
atttggtccaatctccagtaccgat

SEQ ID NO: 290004 - DNA, 25 bp, Mus musculus
atttggtccaatgtccagtaccgat

SEQ ID NO: 290005 - DNA, 25 bp, Mus musculus
atttggtcctgaaaagggtgtctga

SEQ ID NO: 290006 - DNA, 25 bp, Mus musculus
atttggtcctgataagggtgtctga

SEQ ID NO: 290007 - DNA, 25 bp, Mus musculus
atttggtctataatccctgttggga

SEQ ID NO: 290008 - DNA, 25 bp, Mus musculus
atttggtctatattccctgttggga

SEQ ID NO: 290009 - DNA, 25 bp, Mus musculus
atttggtcttgcaccgctccgctca

SEQ ID NO: 290010 - DNA, 25 bp, Mus musculus
atttggtcttgctccgctccgctca

SEQ ID NO: 290011 - DNA, 25 bp, Mus musculus
atttggtctttcaaagccgcagtca

SEQ ID NO: 290012 - DNA, 25 bp, Mus musculus
atttggtctttctaagccgcagtca

SEQ ID NO: 290013 - DNA, 25 bp, Mus musculus
atttggtgactaatactctaacttt

SEQ ID NO: 290014 - DNA, 25 bp, Mus musculus
atttggtgactattactctaacttt

SEQ ID NO: 290015 - DNA, 25 bp, Mus musculus
atttggtgacttcaggccctggcca

SEQ ID NO: 290016 - DNA, 25 bp, Mus musculus
atttggtgacttgaggccctggcca

SEQ ID NO: 290017 - DNA, 25 bp, Mus musculus
atttggtgatttactgcctttgtct

SEQ ID NO: 290018 - DNA, 25 bp, Mus musculus
atttggtgattttctgcctttgtct

SEQ ID NO: 290019 - DNA, 25 bp, Mus musculus
atttggtgctaaagaggcgtgtgac

SEQ ID NO: 290020 - DNA, 25 bp, Mus musculus
atttggtgctaacagctctcccctg

SEQ ID NO: 290021 - DNA, 25 bp, Mus musculus
atttggtgctaagagctctcccctg

SEQ ID NO: 290022 - DNA, 25 bp, Mus musculus
atttggtgctaatgaggcgtgtgac

SEQ ID NO: 290023 - DNA, 25 bp, Mus musculus
atttggtgctagagactatcgacaa

SEQ ID NO: 290024 - DNA, 25 bp, Mus musculus
atttggtgctagtgactatcgacaa

SEQ ID NO: 290025 - DNA, 25 bp, Mus musculus
atttggtggcaacacagtcaacaca

SEQ ID NO: 290026 - DNA, 25 bp, Mus musculus
atttggtggcaagacagtcaacaca

SEQ ID NO: 290027 - DNA, 25 bp, Mus musculus
atttggtgggctcctgggtaatcat

SEQ ID NO: 290028 - DNA, 25 bp, Mus musculus
atttggtgggctgctgggtaatcat

SEQ ID NO: 290029 - DNA, 25 bp, Mus musculus
atttggtggtagactggactgctga

SEQ ID NO: 290030 - DNA, 25 bp, Mus musculus
atttggtggtagtctggactgctga

SEQ ID NO: 290031 - DNA, 25 bp, Mus musculus
atttggtgtactctgcaaggtgact

SEQ ID NO: 290032 - DNA, 25 bp, Mus musculus
atttggtgtactgtgcaaggtgact

SEQ ID NO: 290033 - DNA, 25 bp, Mus musculus
atttggtgtcatccttggcttctac

SEQ ID NO: 290034 - DNA, 25 bp, Mus musculus
atttggtgtcatgcttggcttctac

SEQ ID NO: 290035 - DNA, 25 bp, Mus musculus
atttggtgtcctaggagcacttcag

SEQ ID NO: 290036 - DNA, 25 bp, Mus musculus
atttggtgtccttggagcacttcag

SEQ ID NO: 290037 - DNA, 25 bp, Mus musculus
atttggtgtctgaatccctgcctaa

SEQ ID NO: 290038 - DNA, 25 bp, Mus musculus
atttggtgtctgtatccctgcctaa

SEQ ID NO: 290039 - DNA, 25 bp, Mus musculus
atttggtgtggacattggccctgtt

SEQ ID NO: 290040 - DNA, 25 bp, Mus musculus
atttggtgtggagattggccctgtt

SEQ ID NO: 290041 - DNA, 25 bp, Mus musculus
atttggtgttatcttttcatgttta

SEQ ID NO: 290042 - DNA, 25 bp, Mus musculus
atttggtgttatgttttcatgttta

SEQ ID NO: 290043 - DNA, 25 bp, Mus musculus
atttggttagccagcacccaggtac

SEQ ID NO: 290044 - DNA, 25 bp, Mus musculus
atttggttagcctgcacccaggtac

SEQ ID NO: 290045 - DNA, 25 bp, Mus musculus
atttggttcccactgtgaggctcat

SEQ ID NO: 290046 - DNA, 25 bp, Mus musculus
atttggttcccacttcgtggcacta

SEQ ID NO: 290047 - DNA, 25 bp, Mus musculus
atttggttcccagtgtgaggctcat

SEQ ID NO: 290048 - DNA, 25 bp, Mus musculus
atttggttcccagttcgtggcacta

SEQ ID NO: 290049 - DNA, 25 bp, Mus musculus
atttggttcctgaacagcccatttc

SEQ ID NO: 290050 - DNA, 25 bp, Mus musculus
atttggttcctgtacagcccatttc

SEQ ID NO: 290051 - DNA, 25 bp, Mus musculus
atttggttctatacctgataaacag

SEQ ID NO: 290052 - DNA, 25 bp, Mus musculus
atttggttctattcctgataaacag

SEQ ID NO: 290053 - DNA, 25 bp, Mus musculus
atttggttctgaaggtcccgccagg

SEQ ID NO: 290054 - DNA, 25 bp, Mus musculus
atttggttctgatggtcccgccagg

SEQ ID NO: 290055 - DNA, 25 bp, Mus musculus
atttggttgcctcaagctaccttag

SEQ ID NO: 290056 - DNA, 25 bp, Mus musculus
atttggttgcctgaagctaccttag

SEQ ID NO: 290057 - DNA, 25 bp, Mus musculus
atttggttgggcatgttcctaggaa

SEQ ID NO: 290058 - DNA, 25 bp, Mus musculus
atttggttgggcttgttcctaggaa

SEQ ID NO: 290059 - DNA, 25 bp, Mus musculus
atttggtttccgctttctcctcctg

SEQ ID NO: 290060 - DNA, 25 bp, Mus musculus
atttggtttccggtttctcctcctg

SEQ ID NO: 290061 - DNA, 25 bp, Mus musculus
atttggtttgggactgctgcccaca

SEQ ID NO: 290062 - DNA, 25 bp, Mus musculus
atttggtttgggtctgctgcccaca

SEQ ID NO: 290063 - DNA, 25 bp, Mus musculus
atttggtttgtgctgagcttgtctg

SEQ ID NO: 290064 - DNA, 25 bp, Mus musculus
atttggtttgtggtgagcttgtctg

SEQ ID NO: 290065 - DNA, 25 bp, Mus musculus
atttggttttgccataggtcactgg

SEQ ID NO: 290066 - DNA, 25 bp, Mus musculus
atttggttttgcgataggtcactgg

SEQ ID NO: 290067 - DNA, 25 bp, Mus musculus
atttgtaaaaccaccagcctgagct

SEQ ID NO: 290068 - DNA, 25 bp, Mus musculus
atttgtaaaacctccagcctgagct

SEQ ID NO: 290069 - DNA, 25 bp, Mus musculus
atttgtaaacataggaatcggaata

SEQ ID NO: 290070 - DNA, 25 bp, Mus musculus
atttgtaaacattggaatcggaata

SEQ ID NO: 290071 - DNA, 25 bp, Mus musculus
atttgtaaagccatgctccacagct

SEQ ID NO: 290072 - DNA, 25 bp, Mus musculus
atttgtaaagccttgctccacagct

SEQ ID NO: 290073 - DNA, 25 bp, Mus musculus
atttgtaacctcacaatctggaaag

SEQ ID NO: 290074 - DNA, 25 bp, Mus musculus
atttgtaacctctcaatctggaaag

SEQ ID NO: 290075 - DNA, 25 bp, Mus musculus
atttgtaataatccatcctatgtag

SEQ ID NO: 290076 - DNA, 25 bp, Mus musculus
atttgtaataatgcatcctatgtag

SEQ ID NO: 290077 - DNA, 25 bp, Mus musculus
atttgtaatatgatggctgcccttt

SEQ ID NO: 290078 - DNA, 25 bp, Mus musculus
atttgtaatatgttggctgcccttt

SEQ ID NO: 290079 - DNA, 25 bp, Mus musculus
atttgtaattgcattattctgtcag

SEQ ID NO: 290080 - DNA, 25 bp, Mus musculus
atttgtaattgctttattctgtcag

SEQ ID NO: 290081 - DNA, 25 bp, Mus musculus
atttgtacaactcgtcagcctccta

SEQ ID NO: 290082 - DNA, 25 bp, Mus musculus
atttgtacaactggtcagcctccta

SEQ ID NO: 290083 - DNA, 25 bp, Mus musculus
atttgtacaagaccatccccatgat

SEQ ID NO: 290084 - DNA, 25 bp, Mus musculus
atttgtacaagagcatccccatgat

SEQ ID NO: 290085 - DNA, 25 bp, Mus musculus
atttgtacactcaagtttctcccat

SEQ ID NO: 290086 - DNA, 25 bp, Mus musculus
atttgtacactctagtttctcccat

SEQ ID NO: 290087 - DNA, 25 bp, Mus musculus
atttgtacatcaccatacacatccc

SEQ ID NO: 290088 - DNA, 25 bp, Mus musculus
atttgtacatcagcatacacatccc

SEQ ID NO: 290089 - DNA, 25 bp, Mus musculus
atttgtacatccaagcgtattaata

SEQ ID NO: 290090 - DNA, 25 bp, Mus musculus
atttgtacatcctagcgtattaata

SEQ ID NO: 290091 - DNA, 25 bp, Mus musculus
atttgtaccaaacactgtgtcccct

SEQ ID NO: 290092 - DNA, 25 bp, Mus musculus
atttgtaccaaagactgtgtcccct

SEQ ID NO: 290093 - DNA, 25 bp, Mus musculus
atttgtaccagtatattcagctcta

SEQ ID NO: 290094 - DNA, 25 bp, Mus musculus
atttgtaccagtttattcagctcta

SEQ ID NO: 290095 - DNA, 25 bp, Mus musculus
atttgtaccatacaggactgtccgt

SEQ ID NO: 290096 - DNA, 25 bp, Mus musculus
atttgtaccatagaggactgtccgt

SEQ ID NO: 290097 - DNA, 25 bp, Mus musculus
atttgtaccctgagagttctctatc

SEQ ID NO: 290098 - DNA, 25 bp, Mus musculus
atttgtaccctgtgagttctctatc

SEQ ID NO: 290099 - DNA, 25 bp, Mus musculus
atttgtaccttcatttccagtggca

SEQ ID NO: 290100 - DNA, 25 bp, Mus musculus
atttgtaccttcttttccagtggca

SEQ ID NO: 290101 - DNA, 25 bp, Mus musculus
atttgtacctttcagggagggatgc

SEQ ID NO: 290102 - DNA, 25 bp, Mus musculus
atttgtacctttgagggagggatgc

SEQ ID NO: 290103 - DNA, 25 bp, Mus musculus
atttgtacgtttagctgtctggtca

SEQ ID NO: 290104 - DNA, 25 bp, Mus musculus
atttgtacgttttgctgtctggtca

SEQ ID NO: 290105 - DNA, 25 bp, Mus musculus
atttgtactaaccatgcccattcta

SEQ ID NO: 290106 - DNA, 25 bp, Mus musculus
atttgtactaacgatgcccattcta

SEQ ID NO: 290107 - DNA, 25 bp, Mus musculus
atttgtactgctcctcttggatgca

SEQ ID NO: 290108 - DNA, 25 bp, Mus musculus
atttgtactgctgctcttggatgca

SEQ ID NO: 290109 - DNA, 25 bp, Mus musculus
atttgtactgtaaaatggaggctga

SEQ ID NO: 290110 - DNA, 25 bp, Mus musculus
atttgtactgtataatggaggctga

SEQ ID NO: 290111 - DNA, 25 bp, Mus musculus
atttgtactgttaacggtgaagcta

SEQ ID NO: 290112 - DNA, 25 bp, Mus musculus
atttgtactgtttacggtgaagcta

SEQ ID NO: 290113 - DNA, 25 bp, Mus musculus
atttgtacttaaagtgccacagtgc

SEQ ID NO: 290114 - DNA, 25 bp, Mus musculus
atttgtacttaatgtgccacagtgc

SEQ ID NO: 290115 - DNA, 25 bp, Mus musculus
atttgtagccttctgtgggactcta

SEQ ID NO: 290116 - DNA, 25 bp, Mus musculus
atttgtagccttgtgtgggactcta

SEQ ID NO: 290117 - DNA, 25 bp, Mus musculus
atttgtagcgtactcttggccccaa

SEQ ID NO: 290118 - DNA, 25 bp, Mus musculus
atttgtagcgtagtcttggccccaa

SEQ ID NO: 290119 - DNA, 25 bp, Mus musculus
atttgtaggcatagagcagctctta

SEQ ID NO: 290120 - DNA, 25 bp, Mus musculus
atttgtaggcattgagcagctctta

SEQ ID NO: 290121 - DNA, 25 bp, Mus musculus
atttgtaggcggctttctgtctcag

SEQ ID NO: 290122 - DNA, 25 bp, Mus musculus
atttgtaggcgggtttctgtctcag

SEQ ID NO: 290123 - DNA, 25 bp, Mus musculus
atttgtagtgctcaaggaactcttg

SEQ ID NO: 290124 - DNA, 25 bp, Mus musculus
atttgtagtgctgaaggaactcttg

SEQ ID NO: 290125 - DNA, 25 bp, Mus musculus
atttgtagttcaatgaagcctctag

SEQ ID NO: 290126 - DNA, 25 bp, Mus musculus
atttgtagttcattgaagcctctag

SEQ ID NO: 290127 - DNA, 25 bp, Mus musculus
atttgtataagcaccatgccatgtt

SEQ ID NO: 290128 - DNA, 25 bp, Mus musculus
atttgtataagctccatgccatgtt

SEQ ID NO: 290129 - DNA, 25 bp, Mus musculus
atttgtatacctctggatctgccct

SEQ ID NO: 290130 - DNA, 25 bp, Mus musculus
atttgtatacctgtggatctgccct

SEQ ID NO: 290131 - DNA, 25 bp, Mus musculus
atttgtatagacattctactttcta

SEQ ID NO: 290132 - DNA, 25 bp, Mus musculus
atttgtatagactttctactttcta

SEQ ID NO: 290133 - DNA, 25 bp, Mus musculus
atttgtatcacccaaagctctctga

SEQ ID NO: 290134 - DNA, 25 bp, Mus musculus
atttgtatcaccgaaagctctctga

SEQ ID NO: 290135 - DNA, 25 bp, Mus musculus
atttgtatcagccagccttctgttt

SEQ ID NO: 290136 - DNA, 25 bp, Mus musculus
atttgtatcagcgagccttctgttt

SEQ ID NO: 290137 - DNA, 25 bp, Mus musculus
atttgtatcatcaggacatccgtgg

SEQ ID NO: 290138 - DNA, 25 bp, Mus musculus
atttgtatcatctggacatccgtgg

SEQ ID NO: 290139 - DNA, 25 bp, Mus musculus
atttgtatgcttatatcttctcgat

SEQ ID NO: 290140 - DNA, 25 bp, Mus musculus
atttgtatgcttttatcttctcgat

SEQ ID NO: 290141 - DNA, 25 bp, Mus musculus
atttgtatggacacatgggtctctc

SEQ ID NO: 290142 - DNA, 25 bp, Mus musculus
atttgtatggactcatgggtctctc

SEQ ID NO: 290143 - DNA, 25 bp, Mus musculus
atttgtatgggtaatgaagggcctg

SEQ ID NO: 290144 - DNA, 25 bp, Mus musculus
atttgtatgggttatgaagggcctg

SEQ ID NO: 290145 - DNA, 25 bp, Mus musculus
atttgtatggtaaagcttcgatgta

SEQ ID NO: 290146 - DNA, 25 bp, Mus musculus
atttgtatggtacatgcctccgact

SEQ ID NO: 290147 - DNA, 25 bp, Mus musculus
atttgtatggtagatgcctccgact

SEQ ID NO: 290148 - DNA, 25 bp, Mus musculus
atttgtatggtatagcttcgatgta

SEQ ID NO: 290149 - DNA, 25 bp, Mus musculus
atttgtatggttactgccactccgt

SEQ ID NO: 290150 - DNA, 25 bp, Mus musculus
atttgtatggtttctgccactccgt

SEQ ID NO: 290151 - DNA, 25 bp, Mus musculus
atttgtatgtctccttcttgcgttt

SEQ ID NO: 290152 - DNA, 25 bp, Mus musculus
atttgtatgtctgcttcttgcgttt

SEQ ID NO: 290153 - DNA, 25 bp, Mus musculus
atttgtatgtttatgctggagtgta

SEQ ID NO: 290154 - DNA, 25 bp, Mus musculus
atttgtatgtttttgctggagtgta

SEQ ID NO: 290155 - DNA, 25 bp, Mus musculus
atttgtattcatcctgtctatctaa

SEQ ID NO: 290156 - DNA, 25 bp, Mus musculus
atttgtattcatgctgtctatctaa

SEQ ID NO: 290157 - DNA, 25 bp, Mus musculus
atttgtattcttatgccttttcaat

SEQ ID NO: 290158 - DNA, 25 bp, Mus musculus
atttgtattcttttgccttttcaat

SEQ ID NO: 290159 - DNA, 25 bp, Mus musculus
atttgtattgacatgcttctgttcc

SEQ ID NO: 290160 - DNA, 25 bp, Mus musculus
atttgtattgacttgcttctgttcc

SEQ ID NO: 290161 - DNA, 25 bp, Mus musculus
atttgtattgttctcattgtcctga

SEQ ID NO: 290162 - DNA, 25 bp, Mus musculus
atttgtattgttgtcattgtcctga

SEQ ID NO: 290163 - DNA, 25 bp, Mus musculus
atttgtcaaagtcttccctcaggct

SEQ ID NO: 290164 - DNA, 25 bp, Mus musculus
atttgtcaaagtgttccctcaggct

SEQ ID NO: 290165 - DNA, 25 bp, Mus musculus
atttgtcaagaaccactctgtccac

SEQ ID NO: 290166 - DNA, 25 bp, Mus musculus
atttgtcaagaagcactctgtccac

SEQ ID NO: 290167 - DNA, 25 bp, Mus musculus
atttgtcaagtccttccaactacta

SEQ ID NO: 290168 - DNA, 25 bp, Mus musculus
atttgtcaagtcgttccaactacta

SEQ ID NO: 290169 - DNA, 25 bp, Mus musculus
atttgtcacaatattctgaatgctt

SEQ ID NO: 290170 - DNA, 25 bp, Mus musculus
atttgtcacaattttctgaatgctt

SEQ ID NO: 290171 - DNA, 25 bp, Mus musculus
atttgtcacagaccctttactttct

SEQ ID NO: 290172 - DNA, 25 bp, Mus musculus
atttgtcacagagcctttactttct

SEQ ID NO: 290173 - DNA, 25 bp, Mus musculus
atttgtcaccagagcccatgggaaa

SEQ ID NO: 290174 - DNA, 25 bp, Mus musculus
atttgtcaccagtgcccatgggaaa

SEQ ID NO: 290175 - DNA, 25 bp, Mus musculus
atttgtcaccatctagctctgtttg

SEQ ID NO: 290176 - DNA, 25 bp, Mus musculus
atttgtcaccatgtagctctgtttg

SEQ ID NO: 290177 - DNA, 25 bp, Mus musculus
atttgtcaccctatgatgttcaaga

SEQ ID NO: 290178 - DNA, 25 bp, Mus musculus
atttgtcaccctttgatgttcaaga

SEQ ID NO: 290179 - DNA, 25 bp, Mus musculus
atttgtcaccgactagagagtcccc

SEQ ID NO: 290180 - DNA, 25 bp, Mus musculus
atttgtcaccgagtagagagtcccc

SEQ ID NO: 290181 - DNA, 25 bp, Mus musculus
atttgtcacgtgcagctttctagga

SEQ ID NO: 290182 - DNA, 25 bp, Mus musculus
atttgtcacgtggagctttctagga

SEQ ID NO: 290183 - DNA, 25 bp, Mus musculus
atttgtcactgcaggcttgggttcc

SEQ ID NO: 290184 - DNA, 25 bp, Mus musculus
atttgtcactgctggcttgggttcc

SEQ ID NO: 290185 - DNA, 25 bp, Mus musculus
atttgtcacttgcttgacccgcaga

SEQ ID NO: 290186 - DNA, 25 bp, Mus musculus
atttgtcacttggttgacccgcaga

SEQ ID NO: 290187 - DNA, 25 bp, Mus musculus
atttgtcactttcctcttgacagtt

SEQ ID NO: 290188 - DNA, 25 bp, Mus musculus
atttgtcactttgctcttgacagtt

SEQ ID NO: 290189 - DNA, 25 bp, Mus musculus
atttgtcagagacttgctgctgtcc

SEQ ID NO: 290190 - DNA, 25 bp, Mus musculus
atttgtcagagagttgctgctgtcc

SEQ ID NO: 290191 - DNA, 25 bp, Mus musculus
atttgtcagctcaatcccaaggatg

SEQ ID NO: 290192 - DNA, 25 bp, Mus musculus
atttgtcagctctatcccaaggatg

SEQ ID NO: 290193 - DNA, 25 bp, Mus musculus
atttgtcataccaatagcctttgaa

SEQ ID NO: 290194 - DNA, 25 bp, Mus musculus
atttgtcatacctatagcctttgaa

SEQ ID NO: 290195 - DNA, 25 bp, Mus musculus
atttgtcatgcaagaaggcctgcga

SEQ ID NO: 290196 - DNA, 25 bp, Mus musculus
atttgtcatgcatgaaggcctgcga

SEQ ID NO: 290197 - DNA, 25 bp, Mus musculus
atttgtcatgtcatggttaacttct

SEQ ID NO: 290198 - DNA, 25 bp, Mus musculus
atttgtcatgtcttggttaacttct

SEQ ID NO: 290199 - DNA, 25 bp, Mus musculus
atttgtcattccattcacgtatcga

SEQ ID NO: 290200 - DNA, 25 bp, Mus musculus
atttgtcattcctttcacgtatcga

SEQ ID NO: 290201 - DNA, 25 bp, Mus musculus
atttgtccaaacaggtgctggccca

SEQ ID NO: 290202 - DNA, 25 bp, Mus musculus
atttgtccaaactggtgctggccca

SEQ ID NO: 290203 - DNA, 25 bp, Mus musculus
atttgtccaatcaaagcctacccac

SEQ ID NO: 290204 - DNA, 25 bp, Mus musculus
atttgtccaatctaagcctacccac

SEQ ID NO: 290205 - DNA, 25 bp, Mus musculus
atttgtccacagacagtgaactcag

SEQ ID NO: 290206 - DNA, 25 bp, Mus musculus
atttgtccacagtcagtgaactcag

SEQ ID NO: 290207 - DNA, 25 bp, Mus musculus
atttgtccacctcattaatgcctct

SEQ ID NO: 290208 - DNA, 25 bp, Mus musculus
atttgtccacctgattaatgcctct

SEQ ID NO: 290209 - DNA, 25 bp, Mus musculus
atttgtcccaccaacaatggcagct

SEQ ID NO: 290210 - DNA, 25 bp, Mus musculus
atttgtcccacctacaatggcagct

SEQ ID NO: 290211 - DNA, 25 bp, Mus musculus
atttgtcccatactgagtcttcctt

SEQ ID NO: 290212 - DNA, 25 bp, Mus musculus
atttgtcccatagtgagtcttcctt

SEQ ID NO: 290213 - DNA, 25 bp, Mus musculus
atttgtccccagacagacgactaga

SEQ ID NO: 290214 - DNA, 25 bp, Mus musculus
atttgtccccagtcagacgactaga

SEQ ID NO: 290215 - DNA, 25 bp, Mus musculus
atttgtcccgttacaacacagtgag

SEQ ID NO: 290216 - DNA, 25 bp, Mus musculus
atttgtcccgtttcaacacagtgag

SEQ ID NO: 290217 - DNA, 25 bp, Mus musculus
atttgtccctgcctgtgagtgagca

SEQ ID NO: 290218 - DNA, 25 bp, Mus musculus
atttgtccctgcgtgtgagtgagca

SEQ ID NO: 290219 - DNA, 25 bp, Mus musculus
atttgtcctactctgggcccaaagg

SEQ ID NO: 290220 - DNA, 25 bp, Mus musculus
atttgtcctactgtgggcccaaagg

SEQ ID NO: 290221 - DNA, 25 bp, Mus musculus
atttgtcctcctagtttctgtgtaa

SEQ ID NO: 290222 - DNA, 25 bp, Mus musculus
atttgtcctccttgtttctgtgtaa

SEQ ID NO: 290223 - DNA, 25 bp, Mus musculus
atttgtcctcgtacatttatgtgtg

SEQ ID NO: 290224 - DNA, 25 bp, Mus musculus
atttgtcctcgttcatttatgtgtg

SEQ ID NO: 290225 - DNA, 25 bp, Mus musculus
atttgtcctgcacattaatctgtaa

SEQ ID NO: 290226 - DNA, 25 bp, Mus musculus
atttgtcctgcagattaatctgtaa

SEQ ID NO: 290227 - DNA, 25 bp, Mus musculus
atttgtcctggcagtcacacagttt

SEQ ID NO: 290228 - DNA, 25 bp, Mus musculus
atttgtcctggctgtcacacagttt

SEQ ID NO: 290229 - DNA, 25 bp, Mus musculus
atttgtcctgtacttgaggcttcgt

SEQ ID NO: 290230 - DNA, 25 bp, Mus musculus
atttgtcctgtagttgaggcttcgt

SEQ ID NO: 290231 - DNA, 25 bp, Mus musculus
atttgtcctgtcctagtcttaatgg

SEQ ID NO: 290232 - DNA, 25 bp, Mus musculus
atttgtcctgtcgtagtcttaatgg

SEQ ID NO: 290233 - DNA, 25 bp, Mus musculus
atttgtccttacatcatcatgtcta

SEQ ID NO: 290234 - DNA, 25 bp, Mus musculus
atttgtccttacttcatcatgtcta

SEQ ID NO: 290235 - DNA, 25 bp, Mus musculus
atttgtccttatcactgctgtagtt

SEQ ID NO: 290236 - DNA, 25 bp, Mus musculus
atttgtccttatgactgctgtagtt

SEQ ID NO: 290237 - DNA, 25 bp, Mus musculus
atttgtcgaatacacgctggccgcg

SEQ ID NO: 290238 - DNA, 25 bp, Mus musculus
atttgtcgaatagacgctggccgcg

SEQ ID NO: 290239 - DNA, 25 bp, Mus musculus
atttgtcgacgactgacccggagga

SEQ ID NO: 290240 - DNA, 25 bp, Mus musculus
atttgtcgacgagtgacccggagga

SEQ ID NO: 290241 - DNA, 25 bp, Mus musculus
atttgtcgcctacagatgactggag

SEQ ID NO: 290242 - DNA, 25 bp, Mus musculus
atttgtcgcctagagatgactggag

SEQ ID NO: 290243 - DNA, 25 bp, Mus musculus
atttgtcgtcagctttgttaatggc

SEQ ID NO: 290244 - DNA, 25 bp, Mus musculus
atttgtcgtcaggtttgttaatggc

SEQ ID NO: 290245 - DNA, 25 bp, Mus musculus
atttgtctaagaagctggacccagt

SEQ ID NO: 290246 - DNA, 25 bp, Mus musculus
atttgtctaagatgctggacccagt

SEQ ID NO: 290247 - DNA, 25 bp, Mus musculus
atttgtctagccagtgacactgagt

SEQ ID NO: 290248 - DNA, 25 bp, Mus musculus
atttgtctagcctgtgacactgagt

SEQ ID NO: 290249 - DNA, 25 bp, Mus musculus
atttgtctatatatcctacggtgca

SEQ ID NO: 290250 - DNA, 25 bp, Mus musculus
atttgtctatatttcctacggtgca

SEQ ID NO: 290251 - DNA, 25 bp, Mus musculus
atttgtctcaaccaccaatgtttgg

SEQ ID NO: 290252 - DNA, 25 bp, Mus musculus
atttgtctcaacgaccaatgtttgg

SEQ ID NO: 290253 - DNA, 25 bp, Mus musculus
atttgtctcaagcttcagccgtatg

SEQ ID NO: 290254 - DNA, 25 bp, Mus musculus
atttgtctcaaggttcagccgtatg

SEQ ID NO: 290255 - DNA, 25 bp, Mus musculus
atttgtctccgtcctctgagtaggc

SEQ ID NO: 290256 - DNA, 25 bp, Mus musculus
atttgtctccgtgctctgagtaggc

SEQ ID NO: 290257 - DNA, 25 bp, Mus musculus
atttgtctctaaaagtcacgtgcac

SEQ ID NO: 290258 - DNA, 25 bp, Mus musculus
atttgtctctaacatgttccatcct

SEQ ID NO: 290259 - DNA, 25 bp, Mus musculus
atttgtctctaagatgttccatcct

SEQ ID NO: 290260 - DNA, 25 bp, Mus musculus
atttgtctctaatagtcacgtgcac

SEQ ID NO: 290261 - DNA, 25 bp, Mus musculus
atttgtctctagaccttttttctca

SEQ ID NO: 290262 - DNA, 25 bp, Mus musculus
atttgtctctagtccttttttctca

SEQ ID NO: 290263 - DNA, 25 bp, Mus musculus
atttgtctctgactggctgtgtctt

SEQ ID NO: 290264 - DNA, 25 bp, Mus musculus
atttgtctctgagtggctgtgtctt

SEQ ID NO: 290265 - DNA, 25 bp, Mus musculus
atttgtctctttatggaaattccaa

SEQ ID NO: 290266 - DNA, 25 bp, Mus musculus
atttgtctctttttggaaattccaa

SEQ ID NO: 290267 - DNA, 25 bp, Mus musculus
atttgtctgaagacagtgtggcctt

SEQ ID NO: 290268 - DNA, 25 bp, Mus musculus
atttgtctgaagtcagtgtggcctt

SEQ ID NO: 290269 - DNA, 25 bp, Mus musculus
atttgtctgcccaatcttcagatct

SEQ ID NO: 290270 - DNA, 25 bp, Mus musculus
atttgtctgccctatcttcagatct

SEQ ID NO: 290271 - DNA, 25 bp, Mus musculus
atttgtctggcaagcctgaggccca

SEQ ID NO: 290272 - DNA, 25 bp, Mus musculus
atttgtctggcatgcctgaggccca

SEQ ID NO: 290273 - DNA, 25 bp, Mus musculus
atttgtctgtttctctgggcttcac

SEQ ID NO: 290274 - DNA, 25 bp, Mus musculus
atttgtctgtttgtctgggcttcac

SEQ ID NO: 290275 - DNA, 25 bp, Mus musculus
atttgtcttatcagtacattgagga

SEQ ID NO: 290276 - DNA, 25 bp, Mus musculus
atttgtcttatctgtacattgagga

SEQ ID NO: 290277 - DNA, 25 bp, Mus musculus
atttgtcttcctcagtgtagatcta

SEQ ID NO: 290278 - DNA, 25 bp, Mus musculus
atttgtcttcctgagtgtagatcta

SEQ ID NO: 290279 - DNA, 25 bp, Mus musculus
atttgtcttcgactgagacctagga

SEQ ID NO: 290280 - DNA, 25 bp, Mus musculus
atttgtcttcgagtgagacctagga

SEQ ID NO: 290281 - DNA, 25 bp, Mus musculus
atttgtcttctaactgtcctcttta

SEQ ID NO: 290282 - DNA, 25 bp, Mus musculus
atttgtcttctatctgtcctcttta

SEQ ID NO: 290283 - DNA, 25 bp, Mus musculus
atttgtcttttcaatcttggctaac

SEQ ID NO: 290284 - DNA, 25 bp, Mus musculus
atttgtcttttctatcttggctaac

SEQ ID NO: 290285 - DNA, 25 bp, Mus musculus
atttgtctttttagctcagtctgtc

SEQ ID NO: 290286 - DNA, 25 bp, Mus musculus
atttgtcttttttgctcagtctgtc

SEQ ID NO: 290287 - DNA, 25 bp, Mus musculus
atttgtgaatgcatacgtccgtgta

SEQ ID NO: 290288 - DNA, 25 bp, Mus musculus
atttgtgaatgcttacgtccgtgta

SEQ ID NO: 290289 - DNA, 25 bp, Mus musculus
atttgtgacaagatgggaaggcagc

SEQ ID NO: 290290 - DNA, 25 bp, Mus musculus
atttgtgacaagttgggaaggcagc

SEQ ID NO: 290291 - DNA, 25 bp, Mus musculus
atttgtgacagccaattctccatca

SEQ ID NO: 290292 - DNA, 25 bp, Mus musculus
atttgtgacagcgaattctccatca

SEQ ID NO: 290293 - DNA, 25 bp, Mus musculus
atttgtgacattaagcaggagagtt

SEQ ID NO: 290294 - DNA, 25 bp, Mus musculus
atttgtgacatttagcaggagagtt

SEQ ID NO: 290295 - DNA, 25 bp, Mus musculus
atttgtgaccaaatgctggactttt

SEQ ID NO: 290296 - DNA, 25 bp, Mus musculus
atttgtgaccaattgctggactttt

SEQ ID NO: 290297 - DNA, 25 bp, Mus musculus
atttgtgacccgcactctatgagaa

SEQ ID NO: 290298 - DNA, 25 bp, Mus musculus
atttgtgacccggactctatgagaa

SEQ ID NO: 290299 - DNA, 25 bp, Mus musculus
atttgtgactctctatgtgacgatc

SEQ ID NO: 290300 - DNA, 25 bp, Mus musculus
atttgtgactctgtatgtgacgatc

SEQ ID NO: 290301 - DNA, 25 bp, Mus musculus
atttgtgactgaactattagccgga

SEQ ID NO: 290302 - DNA, 25 bp, Mus musculus
atttgtgactgatctattagccgga

SEQ ID NO: 290303 - DNA, 25 bp, Mus musculus
atttgtgagatacccaaggaggcaa

SEQ ID NO: 290304 - DNA, 25 bp, Mus musculus
atttgtgagatagccaaggaggcaa

SEQ ID NO: 290305 - DNA, 25 bp, Mus musculus
atttgtgaggccaaacattgtgttc

SEQ ID NO: 290306 - DNA, 25 bp, Mus musculus
atttgtgaggcctaacattgtgttc

SEQ ID NO: 290307 - DNA, 25 bp, Mus musculus
atttgtgaggcgaacattgaggctt

SEQ ID NO: 290308 - DNA, 25 bp, Mus musculus
atttgtgaggcgtacattgaggctt

SEQ ID NO: 290309 - DNA, 25 bp, Mus musculus
atttgtgagggtagcagacatgtgc

SEQ ID NO: 290310 - DNA, 25 bp, Mus musculus
atttgtgagggttgcagacatgtgc

SEQ ID NO: 290311 - DNA, 25 bp, Mus musculus
atttgtgagttaatgtaggttggcc

SEQ ID NO: 290312 - DNA, 25 bp, Mus musculus
atttgtgagttattgtaggttggcc

SEQ ID NO: 290313 - DNA, 25 bp, Mus musculus
atttgtgatctactgcttgcatgtg

SEQ ID NO: 290314 - DNA, 25 bp, Mus musculus
atttgtgatctagtgcttgcatgtg

SEQ ID NO: 290315 - DNA, 25 bp, Mus musculus
atttgtgatgcaactctcctgaccc

SEQ ID NO: 290316 - DNA, 25 bp, Mus musculus
atttgtgatgcatctctcctgaccc

SEQ ID NO: 290317 - DNA, 25 bp, Mus musculus
atttgtgcaatgattagccaaccca

SEQ ID NO: 290318 - DNA, 25 bp, Mus musculus
atttgtgcaatgtttagccaaccca

SEQ ID NO: 290319 - DNA, 25 bp, Mus musculus
atttgtgcaattcctcgccctggag

SEQ ID NO: 290320 - DNA, 25 bp, Mus musculus
atttgtgcaattgctcgccctggag

SEQ ID NO: 290321 - DNA, 25 bp, Mus musculus
atttgtgcagtcacatctcttggtc

SEQ ID NO: 290322 - DNA, 25 bp, Mus musculus
atttgtgcagtctcatctcttggtc

SEQ ID NO: 290323 - DNA, 25 bp, Mus musculus
atttgtgcagtgcattctcagctct

SEQ ID NO: 290324 - DNA, 25 bp, Mus musculus
atttgtgcagtggattctcagctct

SEQ ID NO: 290325 - DNA, 25 bp, Mus musculus
atttgtgcagttcctcttctggatg

SEQ ID NO: 290326 - DNA, 25 bp, Mus musculus
atttgtgcagttgctcttctggatg

SEQ ID NO: 290327 - DNA, 25 bp, Mus musculus
atttgtgcatataaacctacagtta

SEQ ID NO: 290328 - DNA, 25 bp, Mus musculus
atttgtgcatattaacctacagtta

SEQ ID NO: 290329 - DNA, 25 bp, Mus musculus
atttgtgcatcacacccattaccca

SEQ ID NO: 290330 - DNA, 25 bp, Mus musculus
atttgtgcatcagacccattaccca

SEQ ID NO: 290331 - DNA, 25 bp, Mus musculus
atttgtgcatgtacagtgtcctaga

SEQ ID NO: 290332 - DNA, 25 bp, Mus musculus
atttgtgcatgttcagtgtcctaga

SEQ ID NO: 290333 - DNA, 25 bp, Mus musculus
atttgtgccaccctgaaattgggac

SEQ ID NO: 290334 - DNA, 25 bp, Mus musculus
atttgtgccaccgtgaaattgggac

SEQ ID NO: 290335 - DNA, 25 bp, Mus musculus
atttgtgccattatgcagtcctcaa

SEQ ID NO: 290336 - DNA, 25 bp, Mus musculus
atttgtgccattttgcagtcctcaa

SEQ ID NO: 290337 - DNA, 25 bp, Mus musculus
atttgtgccgccagtacagtgacgc

SEQ ID NO: 290338 - DNA, 25 bp, Mus musculus
atttgtgccgccataagatccggaa

SEQ ID NO: 290339 - DNA, 25 bp, Mus musculus
atttgtgccgcctgtacagtgacgc

SEQ ID NO: 290340 - DNA, 25 bp, Mus musculus
atttgtgccgccttaagatccggaa

SEQ ID NO: 290341 - DNA, 25 bp, Mus musculus
atttgtgcctttattagatgctaaa

SEQ ID NO: 290342 - DNA, 25 bp, Mus musculus
atttgtgccttttttagatgctaaa

SEQ ID NO: 290343 - DNA, 25 bp, Mus musculus
atttgtgcgctccaagcaggcttta

SEQ ID NO: 290344 - DNA, 25 bp, Mus musculus
atttgtgcgctcgaagcaggcttta

SEQ ID NO: 290345 - DNA, 25 bp, Mus musculus
atttgtgctacccaggtactcttgg

SEQ ID NO: 290346 - DNA, 25 bp, Mus musculus
atttgtgctaccgaggtactcttgg

SEQ ID NO: 290347 - DNA, 25 bp, Mus musculus
atttgtgctcagctttgtctttcac

SEQ ID NO: 290348 - DNA, 25 bp, Mus musculus
atttgtgctcaggtttgtctttcac

SEQ ID NO: 290349 - DNA, 25 bp, Mus musculus
atttgtgctgctcagtggatccaca

SEQ ID NO: 290350 - DNA, 25 bp, Mus musculus
atttgtgctgctgagtggatccaca

SEQ ID NO: 290351 - DNA, 25 bp, Mus musculus
atttgtgctggtccatcgtgagtaa

SEQ ID NO: 290352 - DNA, 25 bp, Mus musculus
atttgtgctggtgcatcgtgagtaa

SEQ ID NO: 290353 - DNA, 25 bp, Mus musculus
atttgtgctgtcattccccaaagtg

SEQ ID NO: 290354 - DNA, 25 bp, Mus musculus
atttgtgctgtctttccccaaagtg

SEQ ID NO: 290355 - DNA, 25 bp, Mus musculus
atttgtgctgttcctagccgggcct

SEQ ID NO: 290356 - DNA, 25 bp, Mus musculus
atttgtgctgttgctagccgggcct

SEQ ID NO: 290357 - DNA, 25 bp, Mus musculus
atttgtgcttacagtacagcctgga

SEQ ID NO: 290358 - DNA, 25 bp, Mus musculus
atttgtgcttactgtacagcctgga

SEQ ID NO: 290359 - DNA, 25 bp, Mus musculus
atttgtgcttctcgtgtgtgcccac

SEQ ID NO: 290360 - DNA, 25 bp, Mus musculus
atttgtgcttctggtgtgtgcccac

SEQ ID NO: 290361 - DNA, 25 bp, Mus musculus
atttgtggagagagtcacaccgaaa

SEQ ID NO: 290362 - DNA, 25 bp, Mus musculus
atttgtggagagtgtcacaccgaaa

SEQ ID NO: 290363 - DNA, 25 bp, Mus musculus
atttgtggagctccttttctagcct

SEQ ID NO: 290364 - DNA, 25 bp, Mus musculus
atttgtggagctgcttttctagcct

SEQ ID NO: 290365 - DNA, 25 bp, Mus musculus
atttgtggatagatggacatctgta

SEQ ID NO: 290366 - DNA, 25 bp, Mus musculus
atttgtggatagttggacatctgta

SEQ ID NO: 290367 - DNA, 25 bp, Mus musculus
atttgtggattcaatcttgggaagg

SEQ ID NO: 290368 - DNA, 25 bp, Mus musculus
atttgtggattctatcttgggaagg

SEQ ID NO: 290369 - DNA, 25 bp, Mus musculus
atttgtggcatcacaaccaagggcc

SEQ ID NO: 290370 - DNA, 25 bp, Mus musculus
atttgtggcatctcaaccaagggcc

SEQ ID NO: 290371 - DNA, 25 bp, Mus musculus
atttgtggccctccatctgaatggg

SEQ ID NO: 290372 - DNA, 25 bp, Mus musculus
atttgtggccctgcatctgaatggg

SEQ ID NO: 290373 - DNA, 25 bp, Mus musculus
atttgtggcgttcaagttggtctta

SEQ ID NO: 290374 - DNA, 25 bp, Mus musculus
atttgtggcgttgaagttggtctta

SEQ ID NO: 290375 - DNA, 25 bp, Mus musculus
atttgtggggacactgcaatacctg

SEQ ID NO: 290376 - DNA, 25 bp, Mus musculus
atttgtggggactctgcaatacctg

SEQ ID NO: 290377 - DNA, 25 bp, Mus musculus
atttgtgggttcagagtgggtctta

SEQ ID NO: 290378 - DNA, 25 bp, Mus musculus
atttgtgggttctgagtgggtctta

SEQ ID NO: 290379 - DNA, 25 bp, Mus musculus
atttgtggtattactgtgggctcag

SEQ ID NO: 290380 - DNA, 25 bp, Mus musculus
atttgtggtatttctgtgggctcag

SEQ ID NO: 290381 - DNA, 25 bp, Mus musculus
atttgtggtccaatcagagtgctgt

SEQ ID NO: 290382 - DNA, 25 bp, Mus musculus
atttgtggtccattcagagtgctgt

SEQ ID NO: 290383 - DNA, 25 bp, Mus musculus
atttgtggtcctagcccctgaattc

SEQ ID NO: 290384 - DNA, 25 bp, Mus musculus
atttgtggtcctagttgccactaaa

SEQ ID NO: 290385 - DNA, 25 bp, Mus musculus
atttgtggtccttgcccctgaattc

SEQ ID NO: 290386 - DNA, 25 bp, Mus musculus
atttgtggtccttgttgccactaaa

SEQ ID NO: 290387 - DNA, 25 bp, Mus musculus
atttgtggtgcaaggccaagcttac

SEQ ID NO: 290388 - DNA, 25 bp, Mus musculus
atttgtggtgcatggccaagcttac

SEQ ID NO: 290389 - DNA, 25 bp, Mus musculus
atttgtggttataggtcatgaagtc

SEQ ID NO: 290390 - DNA, 25 bp, Mus musculus
atttgtggttattggtcatgaagtc

SEQ ID NO: 290391 - DNA, 25 bp, Mus musculus
atttgtggtttcatgtttgggtgca

SEQ ID NO: 290392 - DNA, 25 bp, Mus musculus
atttgtggtttcttgtttgggtgca

SEQ ID NO: 290393 - DNA, 25 bp, Mus musculus
atttgtgtacagagattcccctgtc

SEQ ID NO: 290394 - DNA, 25 bp, Mus musculus
atttgtgtacagtgattcccctgtc

SEQ ID NO: 290395 - DNA, 25 bp, Mus musculus
atttgtgtacatacatctcctttta

SEQ ID NO: 290396 - DNA, 25 bp, Mus musculus
atttgtgtacattcatctcctttta

SEQ ID NO: 290397 - DNA, 25 bp, Mus musculus
atttgtgtagttcggtgctttgttc

SEQ ID NO: 290398 - DNA, 25 bp, Mus musculus
atttgtgtagttgggtgctttgttc

SEQ ID NO: 290399 - DNA, 25 bp, Mus musculus
atttgtgtcataacggcggtggtcc

SEQ ID NO: 290400 - DNA, 25 bp, Mus musculus
atttgtgtcatatcggcggtggtcc

SEQ ID NO: 290401 - DNA, 25 bp, Mus musculus
atttgtgtggttatcttcggaggcg

SEQ ID NO: 290402 - DNA, 25 bp, Mus musculus
atttgtgtggttttcttcggaggcg

SEQ ID NO: 290403 - DNA, 25 bp, Mus musculus
atttgtgtgtgaccaggaggccctt

SEQ ID NO: 290404 - DNA, 25 bp, Mus musculus
atttgtgtgtgactctatccgtctg

SEQ ID NO: 290405 - DNA, 25 bp, Mus musculus
atttgtgtgtgagcaggaggccctt

SEQ ID NO: 290406 - DNA, 25 bp, Mus musculus
atttgtgtgtgagtctatccgtctg

SEQ ID NO: 290407 - DNA, 25 bp, Mus musculus
atttgtgttaaaaccatggactttt

SEQ ID NO: 290408 - DNA, 25 bp, Mus musculus
atttgtgttaaatccatggactttt

SEQ ID NO: 290409 - DNA, 25 bp, Mus musculus
atttgtgttacaatcaccacccaag

SEQ ID NO: 290410 - DNA, 25 bp, Mus musculus
atttgtgttacattcaccacccaag

SEQ ID NO: 290411 - DNA, 25 bp, Mus musculus
atttgtgttcacctcagtttgtttc

SEQ ID NO: 290412 - DNA, 25 bp, Mus musculus
atttgtgttcacgtcagtttgtttc

SEQ ID NO: 290413 - DNA, 25 bp, Mus musculus
atttgtgttctgatgatgttcttag

SEQ ID NO: 290414 - DNA, 25 bp, Mus musculus
atttgtgttctgttgatgttcttag

SEQ ID NO: 290415 - DNA, 25 bp, Mus musculus
atttgtgttgccagatgactatttc

SEQ ID NO: 290416 - DNA, 25 bp, Mus musculus
atttgtgttgcctgatgactatttc

SEQ ID NO: 290417 - DNA, 25 bp, Mus musculus
atttgtgttgctccacctatcctag

SEQ ID NO: 290418 - DNA, 25 bp, Mus musculus
atttgtgttgctgcacctatcctag

SEQ ID NO: 290419 - DNA, 25 bp, Mus musculus
atttgtgtttacctctcacttctga

SEQ ID NO: 290420 - DNA, 25 bp, Mus musculus
atttgtgtttacgtctcacttctga

SEQ ID NO: 290421 - DNA, 25 bp, Mus musculus
atttgtgttttccaacgtctgcaga

SEQ ID NO: 290422 - DNA, 25 bp, Mus musculus
atttgtgttttcgaacgtctgcaga

SEQ ID NO: 290423 - DNA, 25 bp, Mus musculus
atttgtgttttgatccaatcctgta

SEQ ID NO: 290424 - DNA, 25 bp, Mus musculus
atttgtgttttgttccaatcctgta

SEQ ID NO: 290425 - DNA, 25 bp, Mus musculus
atttgttaccatatctagcacagta

SEQ ID NO: 290426 - DNA, 25 bp, Mus musculus
atttgttaccatttctagcacagta

SEQ ID NO: 290427 - DNA, 25 bp, Mus musculus
atttgttagcacacacgctacctgt

SEQ ID NO: 290428 - DNA, 25 bp, Mus musculus
atttgttagcactcacgctacctgt

SEQ ID NO: 290429 - DNA, 25 bp, Mus musculus
atttgttagtagagagggccaggtc

SEQ ID NO: 290430 - DNA, 25 bp, Mus musculus
atttgttagtagtgagggccaggtc

SEQ ID NO: 290431 - DNA, 25 bp, Mus musculus
atttgttatgagatcccgatgctgg

SEQ ID NO: 290432 - DNA, 25 bp, Mus musculus
atttgttatgagttcccgatgctgg

SEQ ID NO: 290433 - DNA, 25 bp, Mus musculus
atttgttatggaagtcttgactgag

SEQ ID NO: 290434 - DNA, 25 bp, Mus musculus
atttgttatggatgtcttgactgag

SEQ ID NO: 290435 - DNA, 25 bp, Mus musculus
atttgttcaaagcactagtcttagc

SEQ ID NO: 290436 - DNA, 25 bp, Mus musculus
atttgttcaaaggactagtcttagc

SEQ ID NO: 290437 - DNA, 25 bp, Mus musculus
atttgttcaaatattgcctttgata

SEQ ID NO: 290438 - DNA, 25 bp, Mus musculus
atttgttcaaatccctatgatgctg

SEQ ID NO: 290439 - DNA, 25 bp, Mus musculus
atttgttcaaatgcctatgatgctg

SEQ ID NO: 290440 - DNA, 25 bp, Mus musculus
atttgttcaaattttgcctttgata

SEQ ID NO: 290441 - DNA, 25 bp, Mus musculus
atttgttcacgacgctttccaaggg

SEQ ID NO: 290442 - DNA, 25 bp, Mus musculus
atttgttcacgaggctttccaaggg

SEQ ID NO: 290443 - DNA, 25 bp, Mus musculus
atttgttcacttatgtaagactctg

SEQ ID NO: 290444 - DNA, 25 bp, Mus musculus
atttgttcacttttgtaagactctg

SEQ ID NO: 290445 - DNA, 25 bp, Mus musculus
atttgttcatcgatgtgttgcctca

SEQ ID NO: 290446 - DNA, 25 bp, Mus musculus
atttgttcatcgttgtgttgcctca

SEQ ID NO: 290447 - DNA, 25 bp, Mus musculus
atttgttccaaacccctggccacta

SEQ ID NO: 290448 - DNA, 25 bp, Mus musculus
atttgttccaaagccctggccacta

SEQ ID NO: 290449 - DNA, 25 bp, Mus musculus
atttgttcccaaccattacacgcta

SEQ ID NO: 290450 - DNA, 25 bp, Mus musculus
atttgttcccaagcattacacgcta

SEQ ID NO: 290451 - DNA, 25 bp, Mus musculus
atttgttcccagatgttacatagtc

SEQ ID NO: 290452 - DNA, 25 bp, Mus musculus
atttgttcccagttgttacatagtc

SEQ ID NO: 290453 - DNA, 25 bp, Mus musculus
atttgttcccctagagcgattctat

SEQ ID NO: 290454 - DNA, 25 bp, Mus musculus
atttgttccccttgagcgattctat

SEQ ID NO: 290455 - DNA, 25 bp, Mus musculus
atttgttccctgagcacttactgaa

SEQ ID NO: 290456 - DNA, 25 bp, Mus musculus
atttgttccctgtgcacttactgaa

SEQ ID NO: 290457 - DNA, 25 bp, Mus musculus
atttgttcctatagaatggtcacgg

SEQ ID NO: 290458 - DNA, 25 bp, Mus musculus
atttgttcctatcctctggctggga

SEQ ID NO: 290459 - DNA, 25 bp, Mus musculus
atttgttcctatgctctggctggga

SEQ ID NO: 290460 - DNA, 25 bp, Mus musculus
atttgttcctattgaatggtcacgg

SEQ ID NO: 290461 - DNA, 25 bp, Mus musculus
atttgttcctgcagggcagtgacca

SEQ ID NO: 290462 - DNA, 25 bp, Mus musculus
atttgttcctgctgggcagtgacca

SEQ ID NO: 290463 - DNA, 25 bp, Mus musculus
atttgttccttaccattttgtcgag

SEQ ID NO: 290464 - DNA, 25 bp, Mus musculus
atttgttccttagcattttgtcgag

SEQ ID NO: 290465 - DNA, 25 bp, Mus musculus
atttgttcgtccaccctgatccagc

SEQ ID NO: 290466 - DNA, 25 bp, Mus musculus
atttgttcgtcctccctgatccagc

SEQ ID NO: 290467 - DNA, 25 bp, Mus musculus
atttgttctaccaatgccacacttt

SEQ ID NO: 290468 - DNA, 25 bp, Mus musculus
atttgttctacctatgccacacttt

SEQ ID NO: 290469 - DNA, 25 bp, Mus musculus
atttgttctctgacctgagtgtgag

SEQ ID NO: 290470 - DNA, 25 bp, Mus musculus
atttgttctctgcattgagcttgcc

SEQ ID NO: 290471 - DNA, 25 bp, Mus musculus
atttgttctctggattgagcttgcc

SEQ ID NO: 290472 - DNA, 25 bp, Mus musculus
atttgttctctgtcctgagtgtgag

SEQ ID NO: 290473 - DNA, 25 bp, Mus musculus
atttgttctgataggcgtgctataa

SEQ ID NO: 290474 - DNA, 25 bp, Mus musculus
atttgttctgattggcgtgctataa

SEQ ID NO: 290475 - DNA, 25 bp, Mus musculus
atttgttctggccaggtctgaagct

SEQ ID NO: 290476 - DNA, 25 bp, Mus musculus
atttgttctggcgaggtctgaagct

SEQ ID NO: 290477 - DNA, 25 bp, Mus musculus
atttgttctttgaacaggcagtcac

SEQ ID NO: 290478 - DNA, 25 bp, Mus musculus
atttgttctttgtacaggcagtcac

SEQ ID NO: 290479 - DNA, 25 bp, Mus musculus
atttgttgaaatagcctggagttta

SEQ ID NO: 290480 - DNA, 25 bp, Mus musculus
atttgttgaaattgcctggagttta

SEQ ID NO: 290481 - DNA, 25 bp, Mus musculus
atttgttgaattaggcctccttaag

SEQ ID NO: 290482 - DNA, 25 bp, Mus musculus
atttgttgaatttggcctccttaag

SEQ ID NO: 290483 - DNA, 25 bp, Mus musculus
atttgttgcactatggcatggcgca

SEQ ID NO: 290484 - DNA, 25 bp, Mus musculus
atttgttgcactttggcatggcgca

SEQ ID NO: 290485 - DNA, 25 bp, Mus musculus
atttgttgccagaaccaataaatca

SEQ ID NO: 290486 - DNA, 25 bp, Mus musculus
atttgttgccagaatgcctctgacc

SEQ ID NO: 290487 - DNA, 25 bp, Mus musculus
atttgttgccagtaccaataaatca

SEQ ID NO: 290488 - DNA, 25 bp, Mus musculus
atttgttgccagtatgcctctgacc

SEQ ID NO: 290489 - DNA, 25 bp, Mus musculus
atttgttggagtactgtgtctgaaa

SEQ ID NO: 290490 - DNA, 25 bp, Mus musculus
atttgttggagttctgtgtctgaaa

SEQ ID NO: 290491 - DNA, 25 bp, Mus musculus
atttgttgggatctacctgttgcag

SEQ ID NO: 290492 - DNA, 25 bp, Mus musculus
atttgttgggatgtacctgttgcag

SEQ ID NO: 290493 - DNA, 25 bp, Mus musculus
atttgttgggcaatgctggctctgc

SEQ ID NO: 290494 - DNA, 25 bp, Mus musculus
atttgttgggcattgctggctctgc

SEQ ID NO: 290495 - DNA, 25 bp, Mus musculus
atttgttgtactcaattaggtggag

SEQ ID NO: 290496 - DNA, 25 bp, Mus musculus
atttgttgtactgaattaggtggag

SEQ ID NO: 290497 - DNA, 25 bp, Mus musculus
atttgttgtatcctatagtttccca

SEQ ID NO: 290498 - DNA, 25 bp, Mus musculus
atttgttgtatcgtatagtttccca

SEQ ID NO: 290499 - DNA, 25 bp, Mus musculus
atttgttgtcttaatggtactcccg

SEQ ID NO: 290500 - DNA, 25 bp, Mus musculus
atttgttgtctttatggtactcccg

SEQ ID NO: 290501 - DNA, 25 bp, Mus musculus
atttgttgtgatatttaattgcctc

SEQ ID NO: 290502 - DNA, 25 bp, Mus musculus
atttgttgtgatttttaattgcctc

SEQ ID NO: 290503 - DNA, 25 bp, Mus musculus
atttgttgttcacagccaccagtgg

SEQ ID NO: 290504 - DNA, 25 bp, Mus musculus
atttgttgttcagagccaccagtgg

SEQ ID NO: 290505 - DNA, 25 bp, Mus musculus
atttgttgttccacagacattccct

SEQ ID NO: 290506 - DNA, 25 bp, Mus musculus
atttgttgttcctcagacattccct

SEQ ID NO: 290507 - DNA, 25 bp, Mus musculus
atttgttgttgaacctaaccctgca

SEQ ID NO: 290508 - DNA, 25 bp, Mus musculus
atttgttgttgatcctaaccctgca

SEQ ID NO: 290509 - DNA, 25 bp, Mus musculus
atttgtttaagtcgctaacatccaa

SEQ ID NO: 290510 - DNA, 25 bp, Mus musculus
atttgtttaagtggctaacatccaa

SEQ ID NO: 290511 - DNA, 25 bp, Mus musculus
atttgtttaattctcgccccaatgc

SEQ ID NO: 290512 - DNA, 25 bp, Mus musculus
atttgtttaattgtcgccccaatgc

SEQ ID NO: 290513 - DNA, 25 bp, Mus musculus
atttgtttacctacccgacgatgag

SEQ ID NO: 290514 - DNA, 25 bp, Mus musculus
atttgtttaccttcccgacgatgag

SEQ ID NO: 290515 - DNA, 25 bp, Mus musculus
atttgtttactcaggatacatctat

SEQ ID NO: 290516 - DNA, 25 bp, Mus musculus
atttgtttactctggatacatctat

SEQ ID NO: 290517 - DNA, 25 bp, Mus musculus
atttgtttatctcacttccattcct

SEQ ID NO: 290518 - DNA, 25 bp, Mus musculus
atttgtttatctgacttccattcct

SEQ ID NO: 290519 - DNA, 25 bp, Mus musculus
atttgtttcctgagtcatgcatcgg

SEQ ID NO: 290520 - DNA, 25 bp, Mus musculus
atttgtttcctgtgtcatgcatcgg

SEQ ID NO: 290521 - DNA, 25 bp, Mus musculus
atttgtttctatatcttctcctgct

SEQ ID NO: 290522 - DNA, 25 bp, Mus musculus
atttgtttctatttcttctcctgct

SEQ ID NO: 290523 - DNA, 25 bp, Mus musculus
atttgtttctccatctctaatccca

SEQ ID NO: 290524 - DNA, 25 bp, Mus musculus
atttgtttctccttctctaatccca

SEQ ID NO: 290525 - DNA, 25 bp, Mus musculus
atttgtttgcaaagccacagagacc

SEQ ID NO: 290526 - DNA, 25 bp, Mus musculus
atttgtttgcaatgccacagagacc

SEQ ID NO: 290527 - DNA, 25 bp, Mus musculus
atttgtttgccacactaactcacac

SEQ ID NO: 290528 - DNA, 25 bp, Mus musculus
atttgtttgccagactaactcacac

SEQ ID NO: 290529 - DNA, 25 bp, Mus musculus
atttgtttgtgcaattgccacaata

SEQ ID NO: 290530 - DNA, 25 bp, Mus musculus
atttgtttgtgctattgccacaata

SEQ ID NO: 290531 - DNA, 25 bp, Mus musculus
atttgttttcccagctttgtaggca

SEQ ID NO: 290532 - DNA, 25 bp, Mus musculus
atttgttttccctgctttgtaggca

SEQ ID NO: 290533 - DNA, 25 bp, Mus musculus
atttgttttccgacttcagaagtga

SEQ ID NO: 290534 - DNA, 25 bp, Mus musculus
atttgttttccgtcttcagaagtga

SEQ ID NO: 290535 - DNA, 25 bp, Mus musculus
atttgttttgcccatttgcacatta

SEQ ID NO: 290536 - DNA, 25 bp, Mus musculus
atttgttttgccgatttgcacatta

SEQ ID NO: 290537 - DNA, 25 bp, Mus musculus
atttgttttgctcgctcattgatcc

SEQ ID NO: 290538 - DNA, 25 bp, Mus musculus
atttgttttgctggctcattgatcc

SEQ ID NO: 290539 - DNA, 25 bp, Mus musculus
atttgttttggacgcttcttgtgta

SEQ ID NO: 290540 - DNA, 25 bp, Mus musculus
atttgttttggaggcttcttgtgta

SEQ ID NO: 290541 - DNA, 25 bp, Mus musculus
atttgttttgtaagctcgtgggtaa

SEQ ID NO: 290542 - DNA, 25 bp, Mus musculus
atttgttttgtatgctcgtgggtaa

SEQ ID NO: 290543 - DNA, 25 bp, Mus musculus
attttaaaacgcacactgtgggcca

SEQ ID NO: 290544 - DNA, 25 bp, Mus musculus
attttaaaacgctcactgtgggcca

SEQ ID NO: 290545 - DNA, 25 bp, Mus musculus
attttaaacctgatgggccaatgag

SEQ ID NO: 290546 - DNA, 25 bp, Mus musculus
attttaaacctgttgggccaatgag

SEQ ID NO: 290547 - DNA, 25 bp, Mus musculus
attttaaaggtgaccctcactctgc

SEQ ID NO: 290548 - DNA, 25 bp, Mus musculus
attttaaaggtgtccctcactctgc

SEQ ID NO: 290549 - DNA, 25 bp, Mus musculus
attttaaatcataccctcctgtgta

SEQ ID NO: 290550 - DNA, 25 bp, Mus musculus
attttaaatcattccctcctgtgta

SEQ ID NO: 290551 - DNA, 25 bp, Mus musculus
attttaaatctcaaatccttccttg

SEQ ID NO: 290552 - DNA, 25 bp, Mus musculus
attttaaatctctaatccttccttg

SEQ ID NO: 290553 - DNA, 25 bp, Mus musculus
attttaaatttcacagcgctgccct

SEQ ID NO: 290554 - DNA, 25 bp, Mus musculus
attttaaatttctcagcgctgccct

SEQ ID NO: 290555 - DNA, 25 bp, Mus musculus
attttaacatcccttgtccatccat

SEQ ID NO: 290556 - DNA, 25 bp, Mus musculus
attttaacatccgttgtccatccat

SEQ ID NO: 290557 - DNA, 25 bp, Mus musculus
attttaaccaagaccaagcctgctg

SEQ ID NO: 290558 - DNA, 25 bp, Mus musculus
attttaaccaagtccaagcctgctg

SEQ ID NO: 290559 - DNA, 25 bp, Mus musculus
attttaacccaccaggcttcacaca

SEQ ID NO: 290560 - DNA, 25 bp, Mus musculus
attttaacccacgaggcttcacaca

SEQ ID NO: 290561 - DNA, 25 bp, Mus musculus
attttaacctcgaatctatgcatag

SEQ ID NO: 290562 - DNA, 25 bp, Mus musculus
attttaacctcgtatctatgcatag

SEQ ID NO: 290563 - DNA, 25 bp, Mus musculus
attttaacgtggacacatccctgct

SEQ ID NO: 290564 - DNA, 25 bp, Mus musculus
attttaacgtggtcacatccctgct

SEQ ID NO: 290565 - DNA, 25 bp, Mus musculus
attttaactgttactctgatcagaa

SEQ ID NO: 290566 - DNA, 25 bp, Mus musculus
attttaactgtttctctgatcagaa

SEQ ID NO: 290567 - DNA, 25 bp, Mus musculus
attttaacttaccatgccctctaga

SEQ ID NO: 290568 - DNA, 25 bp, Mus musculus
attttaacttacgatgccctctaga

SEQ ID NO: 290569 - DNA, 25 bp, Mus musculus
attttaagactacttgcttgataac

SEQ ID NO: 290570 - DNA, 25 bp, Mus musculus
attttaagactagttgcttgataac

SEQ ID NO: 290571 - DNA, 25 bp, Mus musculus
attttaagctagatggtccttgcct

SEQ ID NO: 290572 - DNA, 25 bp, Mus musculus
attttaagctagttggtccttgcct

SEQ ID NO: 290573 - DNA, 25 bp, Mus musculus
attttaagctgaaggcctattctgg

SEQ ID NO: 290574 - DNA, 25 bp, Mus musculus
attttaagctgatggcctattctgg

SEQ ID NO: 290575 - DNA, 25 bp, Mus musculus
attttaagctgtcgtactcagaaat

SEQ ID NO: 290576 - DNA, 25 bp, Mus musculus
attttaagctgtggtactcagaaat

SEQ ID NO: 290577 - DNA, 25 bp, Mus musculus
attttaaggcccaagcttctttcat

SEQ ID NO: 290578 - DNA, 25 bp, Mus musculus
attttaaggcccctacatcagagca

SEQ ID NO: 290579 - DNA, 25 bp, Mus musculus
attttaaggcccgtacatcagagca

SEQ ID NO: 290580 - DNA, 25 bp, Mus musculus
attttaaggccctagcttctttcat

SEQ ID NO: 290581 - DNA, 25 bp, Mus musculus
attttaaggcttagaaccacatagt

SEQ ID NO: 290582 - DNA, 25 bp, Mus musculus
attttaaggctttgaaccacatagt

SEQ ID NO: 290583 - DNA, 25 bp, Mus musculus
attttaagggcacatttcccatcag

SEQ ID NO: 290584 - DNA, 25 bp, Mus musculus
attttaagggcagatttcccatcag

SEQ ID NO: 290585 - DNA, 25 bp, Mus musculus
attttaagtccccagttgtgcatgc

SEQ ID NO: 290586 - DNA, 25 bp, Mus musculus
attttaagtcccgagttgtgcatgc

SEQ ID NO: 290587 - DNA, 25 bp, Mus musculus
attttaagttcaacactggctactc

SEQ ID NO: 290588 - DNA, 25 bp, Mus musculus
attttaagttcatcactggctactc

SEQ ID NO: 290589 - DNA, 25 bp, Mus musculus
attttaatccctagccatctatcag

SEQ ID NO: 290590 - DNA, 25 bp, Mus musculus
attttaatcccttgccatctatcag

SEQ ID NO: 290591 - DNA, 25 bp, Mus musculus
attttaatctgcacgctctcagtga

SEQ ID NO: 290592 - DNA, 25 bp, Mus musculus
attttaatctgctcgctctcagtga

SEQ ID NO: 290593 - DNA, 25 bp, Mus musculus
attttaatctttactccatctcttc

SEQ ID NO: 290594 - DNA, 25 bp, Mus musculus
attttaatctttcccacacaagcca

SEQ ID NO: 290595 - DNA, 25 bp, Mus musculus
attttaatctttgccacacaagcca

SEQ ID NO: 290596 - DNA, 25 bp, Mus musculus
attttaatcttttctccatctcttc

SEQ ID NO: 290597 - DNA, 25 bp, Mus musculus
attttaattcttacaggcatcttac

SEQ ID NO: 290598 - DNA, 25 bp, Mus musculus
attttaattctttcaggcatcttac

SEQ ID NO: 290599 - DNA, 25 bp, Mus musculus
attttacaaacacacaacctggaat

SEQ ID NO: 290600 - DNA, 25 bp, Mus musculus
attttacaaacagacaacctggaat

SEQ ID NO: 290601 - DNA, 25 bp, Mus musculus
attttacaaggtctctcttcggtgc

SEQ ID NO: 290602 - DNA, 25 bp, Mus musculus
attttacaaggtgtctcttcggtgc

SEQ ID NO: 290603 - DNA, 25 bp, Mus musculus
attttacactttattatgctgcatg

SEQ ID NO: 290604 - DNA, 25 bp, Mus musculus
attttacacttttttatgctgcatg

SEQ ID NO: 290605 - DNA, 25 bp, Mus musculus
attttacagaaaatgcgagtggcac

SEQ ID NO: 290606 - DNA, 25 bp, Mus musculus
attttacagaaattgcgagtggcac

SEQ ID NO: 290607 - DNA, 25 bp, Mus musculus
attttacagcttcaaacccatacct

SEQ ID NO: 290608 - DNA, 25 bp, Mus musculus
attttacagcttgaaacccatacct

SEQ ID NO: 290609 - DNA, 25 bp, Mus musculus
attttacaggtgagaaagccacttg

SEQ ID NO: 290610 - DNA, 25 bp, Mus musculus
attttacaggtgtgaaagccacttg

SEQ ID NO: 290611 - DNA, 25 bp, Mus musculus
attttacagtttactcacttttgca

SEQ ID NO: 290612 - DNA, 25 bp, Mus musculus
attttacagttttctcacttttgca

SEQ ID NO: 290613 - DNA, 25 bp, Mus musculus
attttaccacctcggacctggacat

SEQ ID NO: 290614 - DNA, 25 bp, Mus musculus
attttaccacctgggacctggacat

SEQ ID NO: 290615 - DNA, 25 bp, Mus musculus
attttaccagcgaagccatccccag

SEQ ID NO: 290616 - DNA, 25 bp, Mus musculus
attttaccagcgtagccatccccag

SEQ ID NO: 290617 - DNA, 25 bp, Mus musculus
attttaccagggaactcctacagct

SEQ ID NO: 290618 - DNA, 25 bp, Mus musculus
attttaccagggtactcctacagct

SEQ ID NO: 290619 - DNA, 25 bp, Mus musculus
attttaccagtcatttctccctctt

SEQ ID NO: 290620 - DNA, 25 bp, Mus musculus
attttaccagtcttttctccctctt

SEQ ID NO: 290621 - DNA, 25 bp, Mus musculus
attttaccatagatcttagcttgca

SEQ ID NO: 290622 - DNA, 25 bp, Mus musculus
attttaccatagttcttagcttgca

SEQ ID NO: 290623 - DNA, 25 bp, Mus musculus
attttacccagactgaacagctttt

SEQ ID NO: 290624 - DNA, 25 bp, Mus musculus
attttacccagagtgaacagctttt

SEQ ID NO: 290625 - DNA, 25 bp, Mus musculus
attttacccgggactccttatcatg

SEQ ID NO: 290626 - DNA, 25 bp, Mus musculus
attttacccgggtctccttatcatg

SEQ ID NO: 290627 - DNA, 25 bp, Mus musculus
attttaccctgtcccttaatgttga

SEQ ID NO: 290628 - DNA, 25 bp, Mus musculus
attttaccctgtgccttaatgttga

SEQ ID NO: 290629 - DNA, 25 bp, Mus musculus
attttacctcccaaactagatgcat

SEQ ID NO: 290630 - DNA, 25 bp, Mus musculus
attttacctccctaactagatgcat

SEQ ID NO: 290631 - DNA, 25 bp, Mus musculus
attttactaacacggatagctatcc

SEQ ID NO: 290632 - DNA, 25 bp, Mus musculus
attttactaacagggatagctatcc

SEQ ID NO: 290633 - DNA, 25 bp, Mus musculus
attttactcagccattcattggatg

SEQ ID NO: 290634 - DNA, 25 bp, Mus musculus
attttactcagcgattcattggatg

SEQ ID NO: 290635 - DNA, 25 bp, Mus musculus
attttactccctatttgatcttaag

SEQ ID NO: 290636 - DNA, 25 bp, Mus musculus
attttactccctttttgatcttaag

SEQ ID NO: 290637 - DNA, 25 bp, Mus musculus
attttactctatacctacagcttcc

SEQ ID NO: 290638 - DNA, 25 bp, Mus musculus
attttactctattcctacagcttcc

SEQ ID NO: 290639 - DNA, 25 bp, Mus musculus
attttactcttgactggctgcctgt

SEQ ID NO: 290640 - DNA, 25 bp, Mus musculus
attttactcttgtctggctgcctgt

SEQ ID NO: 290641 - DNA, 25 bp, Mus musculus
attttactgctgacagaatctcaaa

SEQ ID NO: 290642 - DNA, 25 bp, Mus musculus
attttactgctgtcagaatctcaaa

SEQ ID NO: 290643 - DNA, 25 bp, Mus musculus
attttacttcccagagctgccaggg

SEQ ID NO: 290644 - DNA, 25 bp, Mus musculus
attttacttcccagctgtttatttg

SEQ ID NO: 290645 - DNA, 25 bp, Mus musculus
attttacttccctgagctgccaggg

SEQ ID NO: 290646 - DNA, 25 bp, Mus musculus
attttacttccctgctgtttatttg

SEQ ID NO: 290647 - DNA, 25 bp, Mus musculus
attttacttctcaggacacagttga

SEQ ID NO: 290648 - DNA, 25 bp, Mus musculus
attttacttctctggacacagttga

SEQ ID NO: 290649 - DNA, 25 bp, Mus musculus
attttacttctgaggcggtgtacaa

SEQ ID NO: 290650 - DNA, 25 bp, Mus musculus
attttacttctgtggcggtgtacaa

SEQ ID NO: 290651 - DNA, 25 bp, Mus musculus
attttactttacatctggcacaaag

SEQ ID NO: 290652 - DNA, 25 bp, Mus musculus
attttactttacttctggcacaaag

SEQ ID NO: 290653 - DNA, 25 bp, Mus musculus
attttagaacttagccactggccta

SEQ ID NO: 290654 - DNA, 25 bp, Mus musculus
attttagaactttgccactggccta

SEQ ID NO: 290655 - DNA, 25 bp, Mus musculus
attttagaaggcacccaatgttgct

SEQ ID NO: 290656 - DNA, 25 bp, Mus musculus
attttagaaggctcccaatgttgct

SEQ ID NO: 290657 - DNA, 25 bp, Mus musculus
attttagaatctcagcaccatgcca

SEQ ID NO: 290658 - DNA, 25 bp, Mus musculus
attttagaatctgagcaccatgcca

SEQ ID NO: 290659 - DNA, 25 bp, Mus musculus
attttagacattatgaaggccctgt

SEQ ID NO: 290660 - DNA, 25 bp, Mus musculus
attttagacattttgaaggccctgt

SEQ ID NO: 290661 - DNA, 25 bp, Mus musculus
attttagacggtctggacttcgagt

SEQ ID NO: 290662 - DNA, 25 bp, Mus musculus
attttagacggtgtggacttcgagt

SEQ ID NO: 290663 - DNA, 25 bp, Mus musculus
attttagactctacttctgactcat

SEQ ID NO: 290664 - DNA, 25 bp, Mus musculus
attttagactcttcttctgactcat

SEQ ID NO: 290665 - DNA, 25 bp, Mus musculus
attttagatggactccgcccggagc

SEQ ID NO: 290666 - DNA, 25 bp, Mus musculus
attttagatggagtccgcccggagc

SEQ ID NO: 290667 - DNA, 25 bp, Mus musculus
attttagatttaatggatgtcaccc

SEQ ID NO: 290668 - DNA, 25 bp, Mus musculus
attttagatttattggatgtcaccc

SEQ ID NO: 290669 - DNA, 25 bp, Mus musculus
attttagcaatcacatctcacctga

SEQ ID NO: 290670 - DNA, 25 bp, Mus musculus
attttagcaatctcatctcacctga

SEQ ID NO: 290671 - DNA, 25 bp, Mus musculus
attttagcagcacagctaccggctt

SEQ ID NO: 290672 - DNA, 25 bp, Mus musculus
attttagcagcagagctaccggctt

SEQ ID NO: 290673 - DNA, 25 bp, Mus musculus
attttagcattcaggagttggaggc

SEQ ID NO: 290674 - DNA, 25 bp, Mus musculus
attttagcattctggagttggaggc

SEQ ID NO: 290675 - DNA, 25 bp, Mus musculus
attttagcattgatggattcttcac

SEQ ID NO: 290676 - DNA, 25 bp, Mus musculus
attttagcattgttggattcttcac

SEQ ID NO: 290677 - DNA, 25 bp, Mus musculus
attttagcatttctaggtggaggca

SEQ ID NO: 290678 - DNA, 25 bp, Mus musculus
attttagcatttgtaggtggaggca

SEQ ID NO: 290679 - DNA, 25 bp, Mus musculus
attttagccactcaccgaggtctct

SEQ ID NO: 290680 - DNA, 25 bp, Mus musculus
attttagccactgaccgaggtctct

SEQ ID NO: 290681 - DNA, 25 bp, Mus musculus
attttagctgccctgattatcatca

SEQ ID NO: 290682 - DNA, 25 bp, Mus musculus
attttagctgccgtgattatcatca

SEQ ID NO: 290683 - DNA, 25 bp, Mus musculus
attttagctgtaaaatgtcatcctg

SEQ ID NO: 290684 - DNA, 25 bp, Mus musculus
attttagctgtataatgtcatcctg

SEQ ID NO: 290685 - DNA, 25 bp, Mus musculus
attttagcttatcattttatagttg

SEQ ID NO: 290686 - DNA, 25 bp, Mus musculus
attttagcttatgattttatagttg

SEQ ID NO: 290687 - DNA, 25 bp, Mus musculus
attttaggagtcagaccctcactcg

SEQ ID NO: 290688 - DNA, 25 bp, Mus musculus
attttaggagtctgaccctcactcg

SEQ ID NO: 290689 - DNA, 25 bp, Mus musculus
attttaggctttcgtccctgctcac

SEQ ID NO: 290690 - DNA, 25 bp, Mus musculus
attttaggctttggtccctgctcac

SEQ ID NO: 290691 - DNA, 25 bp, Mus musculus
attttagggaacagtgtgtggtgac

SEQ ID NO: 290692 - DNA, 25 bp, Mus musculus
attttagggaactgtgtgtggtgac

SEQ ID NO: 290693 - DNA, 25 bp, Mus musculus
attttagggaccagctggctgtaaa

SEQ ID NO: 290694 - DNA, 25 bp, Mus musculus
attttagggacctgctggctgtaaa

SEQ ID NO: 290695 - DNA, 25 bp, Mus musculus
attttagggcacatttttccagaca

SEQ ID NO: 290696 - DNA, 25 bp, Mus musculus
attttagggcacttttttccagaca

SEQ ID NO: 290697 - DNA, 25 bp, Mus musculus
attttagggtgcagagacttgactc

SEQ ID NO: 290698 - DNA, 25 bp, Mus musculus
attttagggtgctgagacttgactc

SEQ ID NO: 290699 - DNA, 25 bp, Mus musculus
attttaggtacaacactgaatgttt

SEQ ID NO: 290700 - DNA, 25 bp, Mus musculus
attttaggtacatcactgaatgttt

SEQ ID NO: 290701 - DNA, 25 bp, Mus musculus
attttaggtcgacattgacgctccc

SEQ ID NO: 290702 - DNA, 25 bp, Mus musculus
attttaggtcgagattgacgctccc

SEQ ID NO: 290703 - DNA, 25 bp, Mus musculus
attttaggtgttcatttctggactc

SEQ ID NO: 290704 - DNA, 25 bp, Mus musculus
attttaggtgttgatttctggactc

SEQ ID NO: 290705 - DNA, 25 bp, Mus musculus
attttagtatataccagcctttctg

SEQ ID NO: 290706 - DNA, 25 bp, Mus musculus
attttagtatattccagcctttctg

SEQ ID NO: 290707 - DNA, 25 bp, Mus musculus
attttagtcatcagctgtttgtgga

SEQ ID NO: 290708 - DNA, 25 bp, Mus musculus
attttagtcatctgctgtttgtgga

SEQ ID NO: 290709 - DNA, 25 bp, Mus musculus
attttagtccccaatgctttaccat

SEQ ID NO: 290710 - DNA, 25 bp, Mus musculus
attttagtcccctatgctttaccat

SEQ ID NO: 290711 - DNA, 25 bp, Mus musculus
attttagtctatacagtggtacttg

SEQ ID NO: 290712 - DNA, 25 bp, Mus musculus
attttagtctattcagtggtacttg

SEQ ID NO: 290713 - DNA, 25 bp, Mus musculus
attttagtctcactgttgcctaggc

SEQ ID NO: 290714 - DNA, 25 bp, Mus musculus
attttagtctcagtgttgcctaggc

SEQ ID NO: 290715 - DNA, 25 bp, Mus musculus
attttagtgaaaaccatcttgacac

SEQ ID NO: 290716 - DNA, 25 bp, Mus musculus
attttagtgaaatccatcttgacac

SEQ ID NO: 290717 - DNA, 25 bp, Mus musculus
attttagtgcaaaaatctctgatta

SEQ ID NO: 290718 - DNA, 25 bp, Mus musculus
attttagtgcaataatctctgatta

SEQ ID NO: 290719 - DNA, 25 bp, Mus musculus
attttagtgcacatttatgctaagt

SEQ ID NO: 290720 - DNA, 25 bp, Mus musculus
attttagtgcacttttatgctaagt

SEQ ID NO: 290721 - DNA, 25 bp, Mus musculus
attttagtgtttagctccatgagac

SEQ ID NO: 290722 - DNA, 25 bp, Mus musculus
attttagtgttttgctccatgagac

SEQ ID NO: 290723 - DNA, 25 bp, Mus musculus
attttagttggccattcaagcaaat

SEQ ID NO: 290724 - DNA, 25 bp, Mus musculus
attttagttggcgattcaagcaaat

SEQ ID NO: 290725 - DNA, 25 bp, Mus musculus
attttataaagtagcactgcatttc

SEQ ID NO: 290726 - DNA, 25 bp, Mus musculus
attttataaagttgcactgcatttc

SEQ ID NO: 290727 - DNA, 25 bp, Mus musculus
attttataacccattgtgatcagag

SEQ ID NO: 290728 - DNA, 25 bp, Mus musculus
attttataaccctttgtgatcagag

SEQ ID NO: 290729 - DNA, 25 bp, Mus musculus
attttatagctgattcttctcttca

SEQ ID NO: 290730 - DNA, 25 bp, Mus musculus
attttatagctgtttcttctcttca

SEQ ID NO: 290731 - DNA, 25 bp, Mus musculus
attttatagtaccaatatttctgtc

SEQ ID NO: 290732 - DNA, 25 bp, Mus musculus
attttatagtacgaatatttctgtc

SEQ ID NO: 290733 - DNA, 25 bp, Mus musculus
attttatatacactggctgtagcat

SEQ ID NO: 290734 - DNA, 25 bp, Mus musculus
attttatatacagtggctgtagcat

SEQ ID NO: 290735 - DNA, 25 bp, Mus musculus
attttatatatgaaacccactggtt

SEQ ID NO: 290736 - DNA, 25 bp, Mus musculus
attttatatatgtaacccactggtt

SEQ ID NO: 290737 - DNA, 25 bp, Mus musculus
attttatatgcgactatggaccagc

SEQ ID NO: 290738 - DNA, 25 bp, Mus musculus
attttatatgcgtctatggaccagc

SEQ ID NO: 290739 - DNA, 25 bp, Mus musculus
attttatattcgacaggtggcaggt

SEQ ID NO: 290740 - DNA, 25 bp, Mus musculus
attttatattcgtcaggtggcaggt

SEQ ID NO: 290741 - DNA, 25 bp, Mus musculus
attttatatttacccacacgtgcag

SEQ ID NO: 290742 - DNA, 25 bp, Mus musculus
attttatatttagccacacgtgcag

SEQ ID NO: 290743 - DNA, 25 bp, Mus musculus
attttatcaactcgtggttcctctg

SEQ ID NO: 290744 - DNA, 25 bp, Mus musculus
attttatcaactggtggttcctctg

SEQ ID NO: 290745 - DNA, 25 bp, Mus musculus
attttatcaaggattctgctgctgt

SEQ ID NO: 290746 - DNA, 25 bp, Mus musculus
attttatcaaggtttctgctgctgt

SEQ ID NO: 290747 - DNA, 25 bp, Mus musculus
attttatcaccccaccattactgtg

SEQ ID NO: 290748 - DNA, 25 bp, Mus musculus
attttatcacccgaccattactgtg

SEQ ID NO: 290749 - DNA, 25 bp, Mus musculus
attttatcaccgactcactttcctt

SEQ ID NO: 290750 - DNA, 25 bp, Mus musculus
attttatcaccgtctcactttcctt

SEQ ID NO: 290751 - DNA, 25 bp, Mus musculus
attttatcatagacagaagcaggct

SEQ ID NO: 290752 - DNA, 25 bp, Mus musculus
attttatcatagtcagaagcaggct

SEQ ID NO: 290753 - DNA, 25 bp, Mus musculus
attttatcatcaacccagcctgggc

SEQ ID NO: 290754 - DNA, 25 bp, Mus musculus
attttatcatcatcccagcctgggc

SEQ ID NO: 290755 - DNA, 25 bp, Mus musculus
attttatcattccttgttttaatgc

SEQ ID NO: 290756 - DNA, 25 bp, Mus musculus
attttatcattcgttgttttaatgc

SEQ ID NO: 290757 - DNA, 25 bp, Mus musculus
attttatcatttcctacttcatgta

SEQ ID NO: 290758 - DNA, 25 bp, Mus musculus
attttatcatttgctacttcatgta

SEQ ID NO: 290759 - DNA, 25 bp, Mus musculus
attttatccttactcctaatacatt

SEQ ID NO: 290760 - DNA, 25 bp, Mus musculus
attttatccttagtcctaatacatt

SEQ ID NO: 290761 - DNA, 25 bp, Mus musculus
attttatctcagatgttttcccaga

SEQ ID NO: 290762 - DNA, 25 bp, Mus musculus
attttatctcagttgttttcccaga

SEQ ID NO: 290763 - DNA, 25 bp, Mus musculus
attttatctgatacttggtctgacc

SEQ ID NO: 290764 - DNA, 25 bp, Mus musculus
attttatctgattcttggtctgacc

SEQ ID NO: 290765 - DNA, 25 bp, Mus musculus
attttatctgggatctctgcctcca

SEQ ID NO: 290766 - DNA, 25 bp, Mus musculus
attttatctgggttctctgcctcca

SEQ ID NO: 290767 - DNA, 25 bp, Mus musculus
attttatctgtgaaccgaaggaagg

SEQ ID NO: 290768 - DNA, 25 bp, Mus musculus
attttatctgtgtaccgaaggaagg

SEQ ID NO: 290769 - DNA, 25 bp, Mus musculus
attttatcttagcatgctgcttaga

SEQ ID NO: 290770 - DNA, 25 bp, Mus musculus
attttatcttaggatgctgcttaga

SEQ ID NO: 290771 - DNA, 25 bp, Mus musculus
attttatcttcgacatctcctttgc

SEQ ID NO: 290772 - DNA, 25 bp, Mus musculus
attttatcttcgtcatctcctttgc

SEQ ID NO: 290773 - DNA, 25 bp, Mus musculus
attttatgagagagcagtcagtggc

SEQ ID NO: 290774 - DNA, 25 bp, Mus musculus
attttatgagagtgcagtcagtggc

SEQ ID NO: 290775 - DNA, 25 bp, Mus musculus
attttatgcactctccaacttgtct

SEQ ID NO: 290776 - DNA, 25 bp, Mus musculus
attttatgcactgtccaacttgtct

SEQ ID NO: 290777 - DNA, 25 bp, Mus musculus
attttatgcattctagtattttctg

SEQ ID NO: 290778 - DNA, 25 bp, Mus musculus
attttatgcattgtagtattttctg

SEQ ID NO: 290779 - DNA, 25 bp, Mus musculus
attttatgcccgattcatatcgttg

SEQ ID NO: 290780 - DNA, 25 bp, Mus musculus
attttatgcccgtttcatatcgttg

SEQ ID NO: 290781 - DNA, 25 bp, Mus musculus
attttatgcttgaatctcttgtccc

SEQ ID NO: 290782 - DNA, 25 bp, Mus musculus
attttatgcttgtatctcttgtccc

SEQ ID NO: 290783 - DNA, 25 bp, Mus musculus
attttatggcataaagcttttagct

SEQ ID NO: 290784 - DNA, 25 bp, Mus musculus
attttatggcattaagcttttagct

SEQ ID NO: 290785 - DNA, 25 bp, Mus musculus
attttatgttctattactatgctta

SEQ ID NO: 290786 - DNA, 25 bp, Mus musculus
attttatgttcttttactatgctta

SEQ ID NO: 290787 - DNA, 25 bp, Mus musculus
attttattactgcatgttcccaccg

SEQ ID NO: 290788 - DNA, 25 bp, Mus musculus
attttattactggatgttcccaccg

SEQ ID NO: 290789 - DNA, 25 bp, Mus musculus
attttattagagctgctgccgcgtc

SEQ ID NO: 290790 - DNA, 25 bp, Mus musculus
attttattagaggtgctgccgcgtc

SEQ ID NO: 290791 - DNA, 25 bp, Mus musculus
attttattagtcatgccagtctctt

SEQ ID NO: 290792 - DNA, 25 bp, Mus musculus
attttattagtcttgccagtctctt

SEQ ID NO: 290793 - DNA, 25 bp, Mus musculus
attttattagttaattctgaggcct

SEQ ID NO: 290794 - DNA, 25 bp, Mus musculus
attttattagtttattctgaggcct

SEQ ID NO: 290795 - DNA, 25 bp, Mus musculus
attttattatacaccctcgacttct

SEQ ID NO: 290796 - DNA, 25 bp, Mus musculus
attttattatactccctcgacttct

SEQ ID NO: 290797 - DNA, 25 bp, Mus musculus
attttattcaagaccgttgctccgt

SEQ ID NO: 290798 - DNA, 25 bp, Mus musculus
attttattcaagtccgttgctccgt

SEQ ID NO: 290799 - DNA, 25 bp, Mus musculus
attttattcagaagagaccgctcaa

SEQ ID NO: 290800 - DNA, 25 bp, Mus musculus
attttattcagatgagaccgctcaa

SEQ ID NO: 290801 - DNA, 25 bp, Mus musculus
attttattcattccctcctgcaaga

SEQ ID NO: 290802 - DNA, 25 bp, Mus musculus
attttattcattgcctcctgcaaga

SEQ ID NO: 290803 - DNA, 25 bp, Mus musculus
attttattccctccagctttgaagt

SEQ ID NO: 290804 - DNA, 25 bp, Mus musculus
attttattccctgcagctttgaagt

SEQ ID NO: 290805 - DNA, 25 bp, Mus musculus
attttattgaagatccctgctgtgg

SEQ ID NO: 290806 - DNA, 25 bp, Mus musculus
attttattgaagttccctgctgtgg

SEQ ID NO: 290807 - DNA, 25 bp, Mus musculus
attttattgcgtcacttttgccaag

SEQ ID NO: 290808 - DNA, 25 bp, Mus musculus
attttattgcgtgacttttgccaag

SEQ ID NO: 290809 - DNA, 25 bp, Mus musculus
attttcaaaaacagccctctgtgat

SEQ ID NO: 290810 - DNA, 25 bp, Mus musculus
attttcaaaaactgccctctgtgat

SEQ ID NO: 290811 - DNA, 25 bp, Mus musculus
attttcaaaatgaggagttcttcgg

SEQ ID NO: 290812 - DNA, 25 bp, Mus musculus
attttcaaaatgtggagttcttcgg

SEQ ID NO: 290813 - DNA, 25 bp, Mus musculus
attttcaaagctacacatttttaag

SEQ ID NO: 290814 - DNA, 25 bp, Mus musculus
attttcaaagcttcacatttttaag

SEQ ID NO: 290815 - DNA, 25 bp, Mus musculus
attttcaaatctcttgtaactggag

SEQ ID NO: 290816 - DNA, 25 bp, Mus musculus
attttcaaatctgttgtaactggag

SEQ ID NO: 290817 - DNA, 25 bp, Mus musculus
attttcaaggtcactgctctctgtt

SEQ ID NO: 290818 - DNA, 25 bp, Mus musculus
attttcaaggtctctgctctctgtt

SEQ ID NO: 290819 - DNA, 25 bp, Mus musculus
attttcaagtggctagacactgtta

SEQ ID NO: 290820 - DNA, 25 bp, Mus musculus
attttcaagtgggtagacactgtta

SEQ ID NO: 290821 - DNA, 25 bp, Mus musculus
attttcaatgccaaagatgtagctg

SEQ ID NO: 290822 - DNA, 25 bp, Mus musculus
attttcaatgcctaagatgtagctg

SEQ ID NO: 290823 - DNA, 25 bp, Mus musculus
attttcaatggaagtcctccgccga

SEQ ID NO: 290824 - DNA, 25 bp, Mus musculus
attttcaatggatgtcctccgccga

SEQ ID NO: 290825 - DNA, 25 bp, Mus musculus
attttcaatgtcagcgctttcgtaa

SEQ ID NO: 290826 - DNA, 25 bp, Mus musculus
attttcaatgtctgcgctttcgtaa

SEQ ID NO: 290827 - DNA, 25 bp, Mus musculus
attttcaattgtctctcccagtatc

SEQ ID NO: 290828 - DNA, 25 bp, Mus musculus
attttcaattgtgtctcccagtatc

SEQ ID NO: 290829 - DNA, 25 bp, Mus musculus
attttcacaattccacaccggtgtc

SEQ ID NO: 290830 - DNA, 25 bp, Mus musculus
attttcacaattgcacaccggtgtc

SEQ ID NO: 290831 - DNA, 25 bp, Mus musculus
attttcacacttacgctgtgggctg

SEQ ID NO: 290832 - DNA, 25 bp, Mus musculus
attttcacactttcgctgtgggctg

SEQ ID NO: 290833 - DNA, 25 bp, Mus musculus
attttcacagttagatatctgtaac

SEQ ID NO: 290834 - DNA, 25 bp, Mus musculus
attttcacagtttgatatctgtaac

SEQ ID NO: 290835 - DNA, 25 bp, Mus musculus
attttcaccaacactgggttagaag

SEQ ID NO: 290836 - DNA, 25 bp, Mus musculus
attttcaccaactctgggttagaag

SEQ ID NO: 290837 - DNA, 25 bp, Mus musculus
attttcaccgaaactttggactctc

SEQ ID NO: 290838 - DNA, 25 bp, Mus musculus
attttcaccgaatctttggactctc

SEQ ID NO: 290839 - DNA, 25 bp, Mus musculus
attttcaccgctcttggctccggaa

SEQ ID NO: 290840 - DNA, 25 bp, Mus musculus
attttcaccgctgttggctccggaa

SEQ ID NO: 290841 - DNA, 25 bp, Mus musculus
attttcacctttaaactgctatgca

SEQ ID NO: 290842 - DNA, 25 bp, Mus musculus
attttcaccttttaactgctatgca

SEQ ID NO: 290843 - DNA, 25 bp, Mus musculus
attttcacgcttaactcttacaggg

SEQ ID NO: 290844 - DNA, 25 bp, Mus musculus
attttcacgctttactcttacaggg

SEQ ID NO: 290845 - DNA, 25 bp, Mus musculus
attttcacgttgatggtatatctcc

SEQ ID NO: 290846 - DNA, 25 bp, Mus musculus
attttcacgttgttggtatatctcc

SEQ ID NO: 290847 - DNA, 25 bp, Mus musculus
attttcactcacacacttcatatta

SEQ ID NO: 290848 - DNA, 25 bp, Mus musculus
attttcactcactcacttcatatta

SEQ ID NO: 290849 - DNA, 25 bp, Mus musculus
attttcactcctatagcattgtcca

SEQ ID NO: 290850 - DNA, 25 bp, Mus musculus
attttcactcctttagcattgtcca

SEQ ID NO: 290851 - DNA, 25 bp, Mus musculus
attttcactgttatgtggtgtctca

SEQ ID NO: 290852 - DNA, 25 bp, Mus musculus
attttcactgttttgtggtgtctca

SEQ ID NO: 290853 - DNA, 25 bp, Mus musculus
attttcacttatacgttctgctctg

SEQ ID NO: 290854 - DNA, 25 bp, Mus musculus
attttcacttattcgttctgctctg

SEQ ID NO: 290855 - DNA, 25 bp, Mus musculus
attttcacttcgcacttgtacaata

SEQ ID NO: 290856 - DNA, 25 bp, Mus musculus
attttcacttcggacttgtacaata

SEQ ID NO: 290857 - DNA, 25 bp, Mus musculus
attttcagaacccttgattccactg

SEQ ID NO: 290858 - DNA, 25 bp, Mus musculus
attttcagaaccgttgattccactg

SEQ ID NO: 290859 - DNA, 25 bp, Mus musculus
attttcagacatctttccccaggca

SEQ ID NO: 290860 - DNA, 25 bp, Mus musculus
attttcagacatgtttccccaggca

SEQ ID NO: 290861 - DNA, 25 bp, Mus musculus
attttcagactgcagccagaatccc

SEQ ID NO: 290862 - DNA, 25 bp, Mus musculus
attttcagactggagccagaatccc

SEQ ID NO: 290863 - DNA, 25 bp, Mus musculus
attttcagcaatctcaccctaccgg

SEQ ID NO: 290864 - DNA, 25 bp, Mus musculus
attttcagcaatgtcaccctaccgg

SEQ ID NO: 290865 - DNA, 25 bp, Mus musculus
attttcagccagaatccccagtaaa

SEQ ID NO: 290866 - DNA, 25 bp, Mus musculus
attttcagccagtatccccagtaaa

SEQ ID NO: 290867 - DNA, 25 bp, Mus musculus
attttcagcccaactaaactttgct

SEQ ID NO: 290868 - DNA, 25 bp, Mus musculus
attttcagcccatctaaactttgct

SEQ ID NO: 290869 - DNA, 25 bp, Mus musculus
attttcagcggcaaagtggtggact

SEQ ID NO: 290870 - DNA, 25 bp, Mus musculus
attttcagcggctaagtggtggact

SEQ ID NO: 290871 - DNA, 25 bp, Mus musculus
attttcagctgtataattcacagaa

SEQ ID NO: 290872 - DNA, 25 bp, Mus musculus
attttcagctgtcttttctaaactc

SEQ ID NO: 290873 - DNA, 25 bp, Mus musculus
attttcagctgtgttttctaaactc

SEQ ID NO: 290874 - DNA, 25 bp, Mus musculus
attttcagctgtttaattcacagaa

SEQ ID NO: 290875 - DNA, 25 bp, Mus musculus
attttcagggctacatcgacagtgg

SEQ ID NO: 290876 - DNA, 25 bp, Mus musculus
attttcagggcttcatcgacagtgg

SEQ ID NO: 290877 - DNA, 25 bp, Mus musculus
attttcagtaatcctatctttagtc

SEQ ID NO: 290878 - DNA, 25 bp, Mus musculus
attttcagtaatgctatctttagtc

SEQ ID NO: 290879 - DNA, 25 bp, Mus musculus
attttcagtgagatgcagagtcttc

SEQ ID NO: 290880 - DNA, 25 bp, Mus musculus
attttcagtgagttgcagagtcttc

SEQ ID NO: 290881 - DNA, 25 bp, Mus musculus
attttcagtgcgaacaggctttaaa

SEQ ID NO: 290882 - DNA, 25 bp, Mus musculus
attttcagtgcgtacaggctttaaa

SEQ ID NO: 290883 - DNA, 25 bp, Mus musculus
attttcagttgcaccatttgaccag

SEQ ID NO: 290884 - DNA, 25 bp, Mus musculus
attttcagttgctccatttgaccag

SEQ ID NO: 290885 - DNA, 25 bp, Mus musculus
attttcagtttgaactgcctggtat

SEQ ID NO: 290886 - DNA, 25 bp, Mus musculus
attttcagtttgtactgcctggtat

SEQ ID NO: 290887 - DNA, 25 bp, Mus musculus
attttcataacccattttgaagagc

SEQ ID NO: 290888 - DNA, 25 bp, Mus musculus
attttcataaccgattttgaagagc

SEQ ID NO: 290889 - DNA, 25 bp, Mus musculus
attttcatatttctcagcccctgaa

SEQ ID NO: 290890 - DNA, 25 bp, Mus musculus
attttcatatttgtcagcccctgaa

SEQ ID NO: 290891 - DNA, 25 bp, Mus musculus
attttcatccagagcctttctgagt

SEQ ID NO: 290892 - DNA, 25 bp, Mus musculus
attttcatccagtgcctttctgagt

SEQ ID NO: 290893 - DNA, 25 bp, Mus musculus
attttcatcccaagcatggagcacg

SEQ ID NO: 290894 - DNA, 25 bp, Mus musculus
attttcatcccatgcatggagcacg

SEQ ID NO: 290895 - DNA, 25 bp, Mus musculus
attttcatgaccatggcttcagcca

SEQ ID NO: 290896 - DNA, 25 bp, Mus musculus
attttcatgaccttggcttcagcca

SEQ ID NO: 290897 - DNA, 25 bp, Mus musculus
attttcatgctgaggaactagacta

SEQ ID NO: 290898 - DNA, 25 bp, Mus musculus
attttcatgctgtggaactagacta

SEQ ID NO: 290899 - DNA, 25 bp, Mus musculus
attttcatggttcgcctgccccatc

SEQ ID NO: 290900 - DNA, 25 bp, Mus musculus
attttcatggttggcctgccccatc

SEQ ID NO: 290901 - DNA, 25 bp, Mus musculus
attttcatgtacatcctattctctg

SEQ ID NO: 290902 - DNA, 25 bp, Mus musculus
attttcatgtacttcctattctctg

SEQ ID NO: 290903 - DNA, 25 bp, Mus musculus
attttcatgtatagagttgttccaa

SEQ ID NO: 290904 - DNA, 25 bp, Mus musculus
attttcatgtattgagttgttccaa

SEQ ID NO: 290905 - DNA, 25 bp, Mus musculus
attttcatgtgcattcaactataaa

SEQ ID NO: 290906 - DNA, 25 bp, Mus musculus
attttcatgtgctttcaactataaa

SEQ ID NO: 290907 - DNA, 25 bp, Mus musculus
attttcattagcatgttcacagtca

SEQ ID NO: 290908 - DNA, 25 bp, Mus musculus
attttcattagcttgttcacagtca

SEQ ID NO: 290909 - DNA, 25 bp, Mus musculus
attttcattcagattctgctgctgt

SEQ ID NO: 290910 - DNA, 25 bp, Mus musculus
attttcattcagtttctgctgctgt

SEQ ID NO: 290911 - DNA, 25 bp, Mus musculus
attttcattcccacactggttcaga

SEQ ID NO: 290912 - DNA, 25 bp, Mus musculus
attttcattccctcactggttcaga

SEQ ID NO: 290913 - DNA, 25 bp, Mus musculus
attttcattctaacaactgtcttgc

SEQ ID NO: 290914 - DNA, 25 bp, Mus musculus
attttcattctatcaactgtcttgc

SEQ ID NO: 290915 - DNA, 25 bp, Mus musculus
attttcattcttcctgctacagtga

SEQ ID NO: 290916 - DNA, 25 bp, Mus musculus
attttcattcttgctgctacagtga

SEQ ID NO: 290917 - DNA, 25 bp, Mus musculus
attttcattgtcattatactatcat

SEQ ID NO: 290918 - DNA, 25 bp, Mus musculus
attttcattgtctttatactatcat

SEQ ID NO: 290919 - DNA, 25 bp, Mus musculus
attttcatttacctttccacataca

SEQ ID NO: 290920 - DNA, 25 bp, Mus musculus
attttcatttacgtttccacataca

SEQ ID NO: 290921 - DNA, 25 bp, Mus musculus
attttccaaagaagctcgacgtcag

SEQ ID NO: 290922 - DNA, 25 bp, Mus musculus
attttccaaagatgctcgacgtcag

SEQ ID NO: 290923 - DNA, 25 bp, Mus musculus
attttccaaataaatgactgcttta

SEQ ID NO: 290924 - DNA, 25 bp, Mus musculus
attttccaaatatatgactgcttta

SEQ ID NO: 290925 - DNA, 25 bp, Mus musculus
attttccaaccgagtattccatgag

SEQ ID NO: 290926 - DNA, 25 bp, Mus musculus
attttccaaccgtgtattccatgag

SEQ ID NO: 290927 - DNA, 25 bp, Mus musculus
attttccaaggcaagcaactctata

SEQ ID NO: 290928 - DNA, 25 bp, Mus musculus
attttccaaggctagcaactctata

SEQ ID NO: 290929 - DNA, 25 bp, Mus musculus
attttccaagttacatttactgcag

SEQ ID NO: 290930 - DNA, 25 bp, Mus musculus
attttccaagttcataggctcgtga

SEQ ID NO: 290931 - DNA, 25 bp, Mus musculus
attttccaagttgataggctcgtga

SEQ ID NO: 290932 - DNA, 25 bp, Mus musculus
attttccaagtttcatttactgcag

SEQ ID NO: 290933 - DNA, 25 bp, Mus musculus
attttccacaatattctccatcaag

SEQ ID NO: 290934 - DNA, 25 bp, Mus musculus
attttccacaattttctccatcaag

SEQ ID NO: 290935 - DNA, 25 bp, Mus musculus
attttccacccacactgaagtatca

SEQ ID NO: 290936 - DNA, 25 bp, Mus musculus
attttccacccagactgaagtatca

SEQ ID NO: 290937 - DNA, 25 bp, Mus musculus
attttccacgcccatatggtgccca

SEQ ID NO: 290938 - DNA, 25 bp, Mus musculus
attttccacgccgatatggtgccca

SEQ ID NO: 290939 - DNA, 25 bp, Mus musculus
attttccacgtacaatcgccacatc

SEQ ID NO: 290940 - DNA, 25 bp, Mus musculus
attttccacgtagaatcgccacatc

SEQ ID NO: 290941 - DNA, 25 bp, Mus musculus
attttccactggatcttgagactat

SEQ ID NO: 290942 - DNA, 25 bp, Mus musculus
attttccactggttcttgagactat

SEQ ID NO: 290943 - DNA, 25 bp, Mus musculus
attttccagaagagaacatttcatg

SEQ ID NO: 290944 - DNA, 25 bp, Mus musculus
attttccagaagtgaacatttcatg

SEQ ID NO: 290945 - DNA, 25 bp, Mus musculus
attttccagacccttcattatcagt

SEQ ID NO: 290946 - DNA, 25 bp, Mus musculus
attttccagaccgttcattatcagt

SEQ ID NO: 290947 - DNA, 25 bp, Mus musculus
attttccagccccattttccactgt

SEQ ID NO: 290948 - DNA, 25 bp, Mus musculus
attttccagcccgattttccactgt

SEQ ID NO: 290949 - DNA, 25 bp, Mus musculus
attttccagctacaatggatccaga

SEQ ID NO: 290950 - DNA, 25 bp, Mus musculus
attttccagctagaatggatccaga

SEQ ID NO: 290951 - DNA, 25 bp, Mus musculus
attttccagctgagagttttgtctc

SEQ ID NO: 290952 - DNA, 25 bp, Mus musculus
attttccagctgtgagttttgtctc

SEQ ID NO: 290953 - DNA, 25 bp, Mus musculus
attttccaggctattttctccctct

SEQ ID NO: 290954 - DNA, 25 bp, Mus musculus
attttccaggcttttttctccctct

SEQ ID NO: 290955 - DNA, 25 bp, Mus musculus
attttccagggcaccgggagagcat

SEQ ID NO: 290956 - DNA, 25 bp, Mus musculus
attttccagggctccgggagagcat

SEQ ID NO: 290957 - DNA, 25 bp, Mus musculus
attttccataaaaccttgatgtgta

SEQ ID NO: 290958 - DNA, 25 bp, Mus musculus
attttccataaatccttgatgtgta

SEQ ID NO: 290959 - DNA, 25 bp, Mus musculus
attttccataagctggccatgtcct

SEQ ID NO: 290960 - DNA, 25 bp, Mus musculus
attttccataaggtggccatgtcct

SEQ ID NO: 290961 - DNA, 25 bp, Mus musculus
attttccatacaaatgaacaccagg

SEQ ID NO: 290962 - DNA, 25 bp, Mus musculus
attttccatacatatgaacaccagg

SEQ ID NO: 290963 - DNA, 25 bp, Mus musculus
attttccatagtctggctctagcca

SEQ ID NO: 290964 - DNA, 25 bp, Mus musculus
attttccatagtgtggctctagcca

SEQ ID NO: 290965 - DNA, 25 bp, Mus musculus
attttccatgcacttagttcagaaa

SEQ ID NO: 290966 - DNA, 25 bp, Mus musculus
attttccatgcagttagttcagaaa

SEQ ID NO: 290967 - DNA, 25 bp, Mus musculus
attttccatggaagactgcccctaa

SEQ ID NO: 290968 - DNA, 25 bp, Mus musculus
attttccatggatgactgcccctaa

SEQ ID NO: 290969 - DNA, 25 bp, Mus musculus
attttccattaacgaccagctcttg

SEQ ID NO: 290970 - DNA, 25 bp, Mus musculus
attttccattaaggaccagctcttg

SEQ ID NO: 290971 - DNA, 25 bp, Mus musculus
attttcccactactgtcaataccag

SEQ ID NO: 290972 - DNA, 25 bp, Mus musculus
attttcccactagtgtcaataccag

SEQ ID NO: 290973 - DNA, 25 bp, Mus musculus
attttcccagatagcactaatgcta

SEQ ID NO: 290974 - DNA, 25 bp, Mus musculus
attttcccagattgcactaatgcta

SEQ ID NO: 290975 - DNA, 25 bp, Mus musculus
attttcccaggaacattactcagaa

SEQ ID NO: 290976 - DNA, 25 bp, Mus musculus
attttcccaggatcattactcagaa

SEQ ID NO: 290977 - DNA, 25 bp, Mus musculus
attttcccagtcatgtttgaatttg

SEQ ID NO: 290978 - DNA, 25 bp, Mus musculus
attttcccagtcttgtttgaatttg

SEQ ID NO: 290979 - DNA, 25 bp, Mus musculus
attttcccatccctgccctttcatt

SEQ ID NO: 290980 - DNA, 25 bp, Mus musculus
attttcccatcccttagtatcggct

SEQ ID NO: 290981 - DNA, 25 bp, Mus musculus
attttcccatccgtgccctttcatt

SEQ ID NO: 290982 - DNA, 25 bp, Mus musculus
attttcccatccgttagtatcggct

SEQ ID NO: 290983 - DNA, 25 bp, Mus musculus
attttccccactatggtgcttagca

SEQ ID NO: 290984 - DNA, 25 bp, Mus musculus
attttccccactttggtgcttagca

SEQ ID NO: 290985 - DNA, 25 bp, Mus musculus
attttcccccagactgcagaagaca

SEQ ID NO: 290986 - DNA, 25 bp, Mus musculus
attttcccccagtctgcagaagaca

SEQ ID NO: 290987 - DNA, 25 bp, Mus musculus
attttccccgctctcatgtcttact

SEQ ID NO: 290988 - DNA, 25 bp, Mus musculus
attttccccgctgtcatgtcttact

SEQ ID NO: 290989 - DNA, 25 bp, Mus musculus
attttcccctacagagccttttgtg

SEQ ID NO: 290990 - DNA, 25 bp, Mus musculus
attttcccctactgagccttttgtg

SEQ ID NO: 290991 - DNA, 25 bp, Mus musculus
attttcccctggagcagaggctgcc

SEQ ID NO: 290992 - DNA, 25 bp, Mus musculus
attttcccctggtgcagaggctgcc

SEQ ID NO: 290993 - DNA, 25 bp, Mus musculus
attttccctcagacttcaggacttt

SEQ ID NO: 290994 - DNA, 25 bp, Mus musculus
attttccctcagtcttcaggacttt

SEQ ID NO: 290995 - DNA, 25 bp, Mus musculus
attttccctccacttcagtattgtt

SEQ ID NO: 290996 - DNA, 25 bp, Mus musculus
attttccctccagttcagtattgtt

SEQ ID NO: 290997 - DNA, 25 bp, Mus musculus
attttccctctgctaagagctcttg

SEQ ID NO: 290998 - DNA, 25 bp, Mus musculus
attttccctctggtaagagctcttg

SEQ ID NO: 290999 - DNA, 25 bp, Mus musculus
attttccctgaaagatgctctctgg

SEQ ID NO: 291000 - DNA, 25 bp, Mus musculus
attttccctgaatgatgctctctgg

SEQ ID NO: 291001 - DNA, 25 bp, Mus musculus
attttccctggtacctctatgtgaa

SEQ ID NO: 291002 - DNA, 25 bp, Mus musculus
attttccctggttcctctatgtgaa

SEQ ID NO: 291003 - DNA, 25 bp, Mus musculus
attttccctgtactccacattagtg

SEQ ID NO: 291004 - DNA, 25 bp, Mus musculus
attttccctgtagtccacattagtg

SEQ ID NO: 291005 - DNA, 25 bp, Mus musculus
attttcccttcccttgcagattgtg

SEQ ID NO: 291006 - DNA, 25 bp, Mus musculus
attttcccttccgttgcagattgtg

SEQ ID NO: 291007 - DNA, 25 bp, Mus musculus
attttcccttgcacagggttgacat

SEQ ID NO: 291008 - DNA, 25 bp, Mus musculus
attttcccttgctcagggttgacat

SEQ ID NO: 291009 - DNA, 25 bp, Mus musculus
attttcccttggaatcttccagtca

SEQ ID NO: 291010 - DNA, 25 bp, Mus musculus
attttcccttggtatcttccagtca

SEQ ID NO: 291011 - DNA, 25 bp, Mus musculus
attttccctttgctcaaatgtcagt

SEQ ID NO: 291012 - DNA, 25 bp, Mus musculus
attttccctttggtcaaatgtcagt

SEQ ID NO: 291013 - DNA, 25 bp, Mus musculus
attttccgaactagggctgatttga

SEQ ID NO: 291014 - DNA, 25 bp, Mus musculus
attttccgaacttgggctgatttga

SEQ ID NO: 291015 - DNA, 25 bp, Mus musculus
attttcctaaaaacacagctatggg

SEQ ID NO: 291016 - DNA, 25 bp, Mus musculus
attttcctaaaacctcagcccactg

SEQ ID NO: 291017 - DNA, 25 bp, Mus musculus
attttcctaaaagctcagcccactg

SEQ ID NO: 291018 - DNA, 25 bp, Mus musculus
attttcctaaaatcacagctatggg

SEQ ID NO: 291019 - DNA, 25 bp, Mus musculus
attttcctagcccatggtggtgtcc

SEQ ID NO: 291020 - DNA, 25 bp, Mus musculus
attttcctagccgatggtggtgtcc

SEQ ID NO: 291021 - DNA, 25 bp, Mus musculus
attttcctagctcggtaagtagccg

SEQ ID NO: 291022 - DNA, 25 bp, Mus musculus
attttcctagctgggtaagtagccg

SEQ ID NO: 291023 - DNA, 25 bp, Mus musculus
attttcctaggcagtacatttcata

SEQ ID NO: 291024 - DNA, 25 bp, Mus musculus
attttcctaggctgtacatttcata

SEQ ID NO: 291025 - DNA, 25 bp, Mus musculus
attttcctcaaacatagctaccaga

SEQ ID NO: 291026 - DNA, 25 bp, Mus musculus
attttcctcaaagatagctaccaga

SEQ ID NO: 291027 - DNA, 25 bp, Mus musculus
attttcctcaacacaagatgccttt

SEQ ID NO: 291028 - DNA, 25 bp, Mus musculus
attttcctcaactcaagatgccttt

SEQ ID NO: 291029 - DNA, 25 bp, Mus musculus
attttcctcaataccccataatggg

SEQ ID NO: 291030 - DNA, 25 bp, Mus musculus
attttcctcaattccccataatggg

SEQ ID NO: 291031 - DNA, 25 bp, Mus musculus
attttcctcatgctttctcagccaa

SEQ ID NO: 291032 - DNA, 25 bp, Mus musculus
attttcctcatggtttctcagccaa

SEQ ID NO: 291033 - DNA, 25 bp, Mus musculus
attttcctcctcattcacagtaatt

SEQ ID NO: 291034 - DNA, 25 bp, Mus musculus
attttcctcctctttcacagtaatt

SEQ ID NO: 291035 - DNA, 25 bp, Mus musculus
attttcctctgtaattatgtgcata

SEQ ID NO: 291036 - DNA, 25 bp, Mus musculus
attttcctctgttattatgtgcata

SEQ ID NO: 291037 - DNA, 25 bp, Mus musculus
attttcctctttagcacagagggcc

SEQ ID NO: 291038 - DNA, 25 bp, Mus musculus
attttcctcttttgcacagagggcc

SEQ ID NO: 291039 - DNA, 25 bp, Mus musculus
attttcctgactcctattcacttat

SEQ ID NO: 291040 - DNA, 25 bp, Mus musculus
attttcctgactgctattcacttat

SEQ ID NO: 291041 - DNA, 25 bp, Mus musculus
attttcctgagtaagatcccagccc

SEQ ID NO: 291042 - DNA, 25 bp, Mus musculus
attttcctgagttagatcccagccc

SEQ ID NO: 291043 - DNA, 25 bp, Mus musculus
attttcctgattcatgcttcgtgga

SEQ ID NO: 291044 - DNA, 25 bp, Mus musculus
attttcctgattgatgcttcgtgga

SEQ ID NO: 291045 - DNA, 25 bp, Mus musculus
attttcctgcatctgggaatgatgg

SEQ ID NO: 291046 - DNA, 25 bp, Mus musculus
attttcctgcatgtgggaatgatgg

SEQ ID NO: 291047 - DNA, 25 bp, Mus musculus
attttcctgccaaacatctacaaag

SEQ ID NO: 291048 - DNA, 25 bp, Mus musculus
attttcctgccatacatctacaaag

SEQ ID NO: 291049 - DNA, 25 bp, Mus musculus
attttcctggataccaacctcttgg

SEQ ID NO: 291050 - DNA, 25 bp, Mus musculus
attttcctggattccaacctcttgg

SEQ ID NO: 291051 - DNA, 25 bp, Mus musculus
attttcctggtcaaatctttctgat

SEQ ID NO: 291052 - DNA, 25 bp, Mus musculus
attttcctggtctaatctttctgat

SEQ ID NO: 291053 - DNA, 25 bp, Mus musculus
attttcctgtcaactgtggtccaag

SEQ ID NO: 291054 - DNA, 25 bp, Mus musculus
attttcctgtcatctgtggtccaag

SEQ ID NO: 291055 - DNA, 25 bp, Mus musculus
attttcctgtgcataacctctgcat

SEQ ID NO: 291056 - DNA, 25 bp, Mus musculus
attttcctgtgcttaacctctgcat

SEQ ID NO: 291057 - DNA, 25 bp, Mus musculus
attttcctgtggaggtttcggatct

SEQ ID NO: 291058 - DNA, 25 bp, Mus musculus
attttcctgtggtggtttcggatct

SEQ ID NO: 291059 - DNA, 25 bp, Mus musculus
attttccttagcatgtctgagatac

SEQ ID NO: 291060 - DNA, 25 bp, Mus musculus
attttccttagcttgtctgagatac

SEQ ID NO: 291061 - DNA, 25 bp, Mus musculus
attttccttctaaatgggtcaacat

SEQ ID NO: 291062 - DNA, 25 bp, Mus musculus
attttccttctatatgggtcaacat

SEQ ID NO: 291063 - DNA, 25 bp, Mus musculus
attttccttgatcagctgggttttc

SEQ ID NO: 291064 - DNA, 25 bp, Mus musculus
attttccttgatgagctgggttttc

SEQ ID NO: 291065 - DNA, 25 bp, Mus musculus
attttccttgttatgcagcattgtg

SEQ ID NO: 291066 - DNA, 25 bp, Mus musculus
attttccttgttttgcagcattgtg

SEQ ID NO: 291067 - DNA, 25 bp, Mus musculus
attttcctttccagtctcagaagag

SEQ ID NO: 291068 - DNA, 25 bp, Mus musculus
attttcctttcctgtctcagaagag

SEQ ID NO: 291069 - DNA, 25 bp, Mus musculus
attttcctttgaatccaactgtggc

SEQ ID NO: 291070 - DNA, 25 bp, Mus musculus
attttcctttgattccaactgtggc

SEQ ID NO: 291071 - DNA, 25 bp, Mus musculus
attttcgatcgcatgttttcctgtt

SEQ ID NO: 291072 - DNA, 25 bp, Mus musculus
attttcgatcgcttgttttcctgtt

SEQ ID NO: 291073 - DNA, 25 bp, Mus musculus
attttcgatctcagagttgcacctc

SEQ ID NO: 291074 - DNA, 25 bp, Mus musculus
attttcgatctctgagttgcacctc

SEQ ID NO: 291075 - DNA, 25 bp, Mus musculus
attttcgccctgaaatgcatttcaa

SEQ ID NO: 291076 - DNA, 25 bp, Mus musculus
attttcgccctgtaatgcatttcaa

SEQ ID NO: 291077 - DNA, 25 bp, Mus musculus
attttcggtactctaattgtgttga

SEQ ID NO: 291078 - DNA, 25 bp, Mus musculus
attttcggtactgtaattgtgttga

SEQ ID NO: 291079 - DNA, 25 bp, Mus musculus
attttcggtctacgcggcagatttc

SEQ ID NO: 291080 - DNA, 25 bp, Mus musculus
attttcggtctaggcggcagatttc

SEQ ID NO: 291081 - DNA, 25 bp, Mus musculus
attttcggtttcagtcactagcaaa

SEQ ID NO: 291082 - DNA, 25 bp, Mus musculus
attttcggtttctgtcactagcaaa

SEQ ID NO: 291083 - DNA, 25 bp, Mus musculus
attttcgtcttcaccatgtttatgg

SEQ ID NO: 291084 - DNA, 25 bp, Mus musculus
attttcgtcttctccatgtttatgg

SEQ ID NO: 291085 - DNA, 25 bp, Mus musculus
attttcgtgtccagataccgcataa

SEQ ID NO: 291086 - DNA, 25 bp, Mus musculus
attttcgtgtcctgataccgcataa

SEQ ID NO: 291087 - DNA, 25 bp, Mus musculus
attttcgttatgagagtcccagtga

SEQ ID NO: 291088 - DNA, 25 bp, Mus musculus
attttcgttatgtgagtcccagtga

SEQ ID NO: 291089 - DNA, 25 bp, Mus musculus
attttcgttgccaatttaacaggat

SEQ ID NO: 291090 - DNA, 25 bp, Mus musculus
attttcgttgcctatttaacaggat

SEQ ID NO: 291091 - DNA, 25 bp, Mus musculus
attttctaaaccagtagtacaatgt

SEQ ID NO: 291092 - DNA, 25 bp, Mus musculus
attttctaaacctgtagtacaatgt

SEQ ID NO: 291093 - DNA, 25 bp, Mus musculus
attttctaacacatactgtgtggtg

SEQ ID NO: 291094 - DNA, 25 bp, Mus musculus
attttctaacacttactgtgtggtg

SEQ ID NO: 291095 - DNA, 25 bp, Mus musculus
attttctaagagcagtgactccaag

SEQ ID NO: 291096 - DNA, 25 bp, Mus musculus
attttctaagaggagtgactccaag

SEQ ID NO: 291097 - DNA, 25 bp, Mus musculus
attttctaatgtatgatgtgtccct

SEQ ID NO: 291098 - DNA, 25 bp, Mus musculus
attttctaatgtttgatgtgtccct

SEQ ID NO: 291099 - DNA, 25 bp, Mus musculus
attttctaatttactctgcactttg

SEQ ID NO: 291100 - DNA, 25 bp, Mus musculus
attttctaattttctctgcactttg

SEQ ID NO: 291101 - DNA, 25 bp, Mus musculus
attttctactccaaactgtcatgca

SEQ ID NO: 291102 - DNA, 25 bp, Mus musculus
attttctactcctaactgtcatgca

SEQ ID NO: 291103 - DNA, 25 bp, Mus musculus
attttctacttgactgatcaccacc

SEQ ID NO: 291104 - DNA, 25 bp, Mus musculus
attttctacttgtctgatcaccacc

SEQ ID NO: 291105 - DNA, 25 bp, Mus musculus
attttctactttagatgattaacat

SEQ ID NO: 291106 - DNA, 25 bp, Mus musculus
attttctacttttgatgattaacat

SEQ ID NO: 291107 - DNA, 25 bp, Mus musculus
attttctaggagatctattgtaaag

SEQ ID NO: 291108 - DNA, 25 bp, Mus musculus
attttctaggagttctattgtaaag

SEQ ID NO: 291109 - DNA, 25 bp, Mus musculus
attttctaggcgctagttctctgga

SEQ ID NO: 291110 - DNA, 25 bp, Mus musculus
attttctaggcggtagttctctgga

SEQ ID NO: 291111 - DNA, 25 bp, Mus musculus
attttctagtgaatctcccttcgta

SEQ ID NO: 291112 - DNA, 25 bp, Mus musculus
attttctagtgattctcccttcgta

SEQ ID NO: 291113 - DNA, 25 bp, Mus musculus
attttctatcctagtgtcactgagc

SEQ ID NO: 291114 - DNA, 25 bp, Mus musculus
attttctatccttgtgtcactgagc

SEQ ID NO: 291115 - DNA, 25 bp, Mus musculus
attttctatctgagagtacactatc

SEQ ID NO: 291116 - DNA, 25 bp, Mus musculus
attttctatctgtgagtacactatc

SEQ ID NO: 291117 - DNA, 25 bp, Mus musculus
attttctattctatcacatgcatgg

SEQ ID NO: 291118 - DNA, 25 bp, Mus musculus
attttctattctttcacatgcatgg

SEQ ID NO: 291119 - DNA, 25 bp, Mus musculus
attttctcacatcttacaccctaac

SEQ ID NO: 291120 - DNA, 25 bp, Mus musculus
attttctcacatgttacaccctaac

SEQ ID NO: 291121 - DNA, 25 bp, Mus musculus
attttctcactgattataccaaggt

SEQ ID NO: 291122 - DNA, 25 bp, Mus musculus
attttctcactgtttataccaaggt

SEQ ID NO: 291123 - DNA, 25 bp, Mus musculus
attttctcacttctattttaatatg

SEQ ID NO: 291124 - DNA, 25 bp, Mus musculus
attttctcacttgtattttaatatg

SEQ ID NO: 291125 - DNA, 25 bp, Mus musculus
attttctcagttacagatcctcagc

SEQ ID NO: 291126 - DNA, 25 bp, Mus musculus
attttctcagtttcagatcctcagc

SEQ ID NO: 291127 - DNA, 25 bp, Mus musculus
attttctcatcaaaacttgtctgta

SEQ ID NO: 291128 - DNA, 25 bp, Mus musculus
attttctcatcataacttgtctgta

SEQ ID NO: 291129 - DNA, 25 bp, Mus musculus
attttctcattaacaacattgttcc

SEQ ID NO: 291130 - DNA, 25 bp, Mus musculus
attttctcattatcaacattgttcc

SEQ ID NO: 291131 - DNA, 25 bp, Mus musculus
attttctcattcatagtctccttaa

SEQ ID NO: 291132 - DNA, 25 bp, Mus musculus
attttctcattcttagtctccttaa

SEQ ID NO: 291133 - DNA, 25 bp, Mus musculus
attttctcatttcaagcattcgttt

SEQ ID NO: 291134 - DNA, 25 bp, Mus musculus
attttctcatttgaagcattcgttt

SEQ ID NO: 291135 - DNA, 25 bp, Mus musculus
attttctccaacaacttgagaatta

SEQ ID NO: 291136 - DNA, 25 bp, Mus musculus
attttctccaactacttgagaatta

SEQ ID NO: 291137 - DNA, 25 bp, Mus musculus
attttctccacccactatatattga

SEQ ID NO: 291138 - DNA, 25 bp, Mus musculus
attttctccaccgactatatattga

SEQ ID NO: 291139 - DNA, 25 bp, Mus musculus
attttctccactatgtgatcggaag

SEQ ID NO: 291140 - DNA, 25 bp, Mus musculus
attttctccactttgtgatcggaag

SEQ ID NO: 291141 - DNA, 25 bp, Mus musculus
attttctccctcaagcttctatgtc

SEQ ID NO: 291142 - DNA, 25 bp, Mus musculus
attttctccctctagcttctatgtc

SEQ ID NO: 291143 - DNA, 25 bp, Mus musculus
attttctcccttagtcagccttgta

SEQ ID NO: 291144 - DNA, 25 bp, Mus musculus
attttctccctttgtcagccttgta

SEQ ID NO: 291145 - DNA, 25 bp, Mus musculus
attttctcctctatcaaaggtttct

SEQ ID NO: 291146 - DNA, 25 bp, Mus musculus
attttctcctctttcaaaggtttct

SEQ ID NO: 291147 - DNA, 25 bp, Mus musculus
attttctcctggagcccaatgcatg

SEQ ID NO: 291148 - DNA, 25 bp, Mus musculus
attttctcctggtgcccaatgcatg

SEQ ID NO: 291149 - DNA, 25 bp, Mus musculus
attttctcggagatgatgtctgtca

SEQ ID NO: 291150 - DNA, 25 bp, Mus musculus
attttctcggagttgatgtctgtca

SEQ ID NO: 291151 - DNA, 25 bp, Mus musculus
attttctctcccatgatacagttct

SEQ ID NO: 291152 - DNA, 25 bp, Mus musculus
attttctctcccttgatacagttct

SEQ ID NO: 291153 - DNA, 25 bp, Mus musculus
attttctctcttaccgttgtgtgga

SEQ ID NO: 291154 - DNA, 25 bp, Mus musculus
attttctctctttccgttgtgtgga

SEQ ID NO: 291155 - DNA, 25 bp, Mus musculus
attttctctgacatcaatttataca

SEQ ID NO: 291156 - DNA, 25 bp, Mus musculus
attttctctgaccaaagccgcttgc

SEQ ID NO: 291157 - DNA, 25 bp, Mus musculus
attttctctgacgaaagccgcttgc

SEQ ID NO: 291158 - DNA, 25 bp, Mus musculus
attttctctgacttcaatttataca

SEQ ID NO: 291159 - DNA, 25 bp, Mus musculus
attttctctgctctcggttgttttg

SEQ ID NO: 291160 - DNA, 25 bp, Mus musculus
attttctctgctgtcggttgttttg

SEQ ID NO: 291161 - DNA, 25 bp, Mus musculus
attttctctgtgaaggtaggtcgtc

SEQ ID NO: 291162 - DNA, 25 bp, Mus musculus
attttctctgtgtaggtaggtcgtc

SEQ ID NO: 291163 - DNA, 25 bp, Mus musculus
attttctcttatcccttatttctgg

SEQ ID NO: 291164 - DNA, 25 bp, Mus musculus
attttctcttatgccttatttctgg

SEQ ID NO: 291165 - DNA, 25 bp, Mus musculus
attttctcttccacagtctgaatgg

SEQ ID NO: 291166 - DNA, 25 bp, Mus musculus
attttctcttcctcagtctgaatgg

SEQ ID NO: 291167 - DNA, 25 bp, Mus musculus
attttctcttgacctcattctccga

SEQ ID NO: 291168 - DNA, 25 bp, Mus musculus
attttctcttgagctcattctccga

SEQ ID NO: 291169 - DNA, 25 bp, Mus musculus
attttctctttactcaggttacaca

SEQ ID NO: 291170 - DNA, 25 bp, Mus musculus
attttctctttagtcaggttacaca

SEQ ID NO: 291171 - DNA, 25 bp, Mus musculus
attttctgaccccaggtttggtatg

SEQ ID NO: 291172 - DNA, 25 bp, Mus musculus
attttctgacccgaggtttggtatg

SEQ ID NO: 291173 - DNA, 25 bp, Mus musculus
attttctgacctagacacgtggaca

SEQ ID NO: 291174 - DNA, 25 bp, Mus musculus
attttctgaccttgacacgtggaca

SEQ ID NO: 291175 - DNA, 25 bp, Mus musculus
attttctgacgtatgatcctatagc

SEQ ID NO: 291176 - DNA, 25 bp, Mus musculus
attttctgacgtttgatcctatagc

SEQ ID NO: 291177 - DNA, 25 bp, Mus musculus
attttctgcacacaacagggccggt

SEQ ID NO: 291178 - DNA, 25 bp, Mus musculus
attttctgcacagaacagggccggt

SEQ ID NO: 291179 - DNA, 25 bp, Mus musculus
attttctgcataatcttcaactcaa

SEQ ID NO: 291180 - DNA, 25 bp, Mus musculus
attttctgcatattcttcaactcaa

SEQ ID NO: 291181 - DNA, 25 bp, Mus musculus
attttctgccgtaccaaggacataa

SEQ ID NO: 291182 - DNA, 25 bp, Mus musculus
attttctgccgttccaaggacataa

SEQ ID NO: 291183 - DNA, 25 bp, Mus musculus
attttctgcctacagtccttgagta

SEQ ID NO: 291184 - DNA, 25 bp, Mus musculus
attttctgcctagagtccttgagta

SEQ ID NO: 291185 - DNA, 25 bp, Mus musculus
attttctgcctgaacattcatgcca

SEQ ID NO: 291186 - DNA, 25 bp, Mus musculus
attttctgcctgtacattcatgcca

SEQ ID NO: 291187 - DNA, 25 bp, Mus musculus
attttctgctaaattgttatggtgt

SEQ ID NO: 291188 - DNA, 25 bp, Mus musculus
attttctgctaatttgttatggtgt

SEQ ID NO: 291189 - DNA, 25 bp, Mus musculus
attttctggactagacacttgcctg

SEQ ID NO: 291190 - DNA, 25 bp, Mus musculus
attttctggacttgacacttgcctg

SEQ ID NO: 291191 - DNA, 25 bp, Mus musculus
attttctggagaagcctgtactggg

SEQ ID NO: 291192 - DNA, 25 bp, Mus musculus
attttctggagatgcctgtactggg

SEQ ID NO: 291193 - DNA, 25 bp, Mus musculus
attttctggcatacatgggtgtccc

SEQ ID NO: 291194 - DNA, 25 bp, Mus musculus
attttctggcattcatgggtgtccc

SEQ ID NO: 291195 - DNA, 25 bp, Mus musculus
attttctggctaccaaggattgggc

SEQ ID NO: 291196 - DNA, 25 bp, Mus musculus
attttctggctagcaaggattgggc

SEQ ID NO: 291197 - DNA, 25 bp, Mus musculus
attttctgggaaacatctcactgta

SEQ ID NO: 291198 - DNA, 25 bp, Mus musculus
attttctgggaatcatctcactgta

SEQ ID NO: 291199 - DNA, 25 bp, Mus musculus
attttctggttgaccaagttggctt

SEQ ID NO: 291200 - DNA, 25 bp, Mus musculus
attttctggttgtccaagttggctt

SEQ ID NO: 291201 - DNA, 25 bp, Mus musculus
attttctgtcgtacctgaataccac

SEQ ID NO: 291202 - DNA, 25 bp, Mus musculus
attttctgtcgttcctgaataccac

SEQ ID NO: 291203 - DNA, 25 bp, Mus musculus
attttctgtcttaatggtatcctac

SEQ ID NO: 291204 - DNA, 25 bp, Mus musculus
attttctgtctttatggtatcctac

SEQ ID NO: 291205 - DNA, 25 bp, Mus musculus
attttctgtgagcacactaaaagca

SEQ ID NO: 291206 - DNA, 25 bp, Mus musculus
attttctgtgaggacactaaaagca

SEQ ID NO: 291207 - DNA, 25 bp, Mus musculus
attttctgtggaaatcttttgatgt

SEQ ID NO: 291208 - DNA, 25 bp, Mus musculus
attttctgtggacttatttctgacc

SEQ ID NO: 291209 - DNA, 25 bp, Mus musculus
attttctgtggagttatttctgacc

SEQ ID NO: 291210 - DNA, 25 bp, Mus musculus
attttctgtggatatcttttgatgt

SEQ ID NO: 291211 - DNA, 25 bp, Mus musculus
attttctgtttacctttttgttgca

SEQ ID NO: 291212 - DNA, 25 bp, Mus musculus
attttctgtttagctttttgttgca

SEQ ID NO: 291213 - DNA, 25 bp, Mus musculus
attttctgtttcctagtcttgtata

SEQ ID NO: 291214 - DNA, 25 bp, Mus musculus
attttctgtttcgtagtcttgtata

SEQ ID NO: 291215 - DNA, 25 bp, Mus musculus
attttcttaaatagctcacagggat

SEQ ID NO: 291216 - DNA, 25 bp, Mus musculus
attttcttaaattgctcacagggat

SEQ ID NO: 291217 - DNA, 25 bp, Mus musculus
attttcttacagctaagtggtcagg

SEQ ID NO: 291218 - DNA, 25 bp, Mus musculus
attttcttacaggtaagtggtcagg

SEQ ID NO: 291219 - DNA, 25 bp, Mus musculus
attttcttactcagccctttcatca

SEQ ID NO: 291220 - DNA, 25 bp, Mus musculus
attttcttactctgccctttcatca

SEQ ID NO: 291221 - DNA, 25 bp, Mus musculus
attttcttagttagtacatcctttg

SEQ ID NO: 291222 - DNA, 25 bp, Mus musculus
attttcttagtttgtacatcctttg

SEQ ID NO: 291223 - DNA, 25 bp, Mus musculus
attttcttcagaacagggcagaacc

SEQ ID NO: 291224 - DNA, 25 bp, Mus musculus
attttcttcagatcagggcagaacc

SEQ ID NO: 291225 - DNA, 25 bp, Mus musculus
attttcttccaaagcataccttcct

SEQ ID NO: 291226 - DNA, 25 bp, Mus musculus
attttcttccaatgcataccttcct

SEQ ID NO: 291227 - DNA, 25 bp, Mus musculus
attttcttctaccatattcgcgctt

SEQ ID NO: 291228 - DNA, 25 bp, Mus musculus
attttcttctacgatattcgcgctt

SEQ ID NO: 291229 - DNA, 25 bp, Mus musculus
attttcttctatctgtgccaacctc

SEQ ID NO: 291230 - DNA, 25 bp, Mus musculus
attttcttctatgtgtgccaacctc

SEQ ID NO: 291231 - DNA, 25 bp, Mus musculus
attttcttctgccatgctgtagcct

SEQ ID NO: 291232 - DNA, 25 bp, Mus musculus
attttcttctgcgatgctgtagcct

SEQ ID NO: 291233 - DNA, 25 bp, Mus musculus
attttcttgagcacattccaaccat

SEQ ID NO: 291234 - DNA, 25 bp, Mus musculus
attttcttgagctcattccaaccat

SEQ ID NO: 291235 - DNA, 25 bp, Mus musculus
attttcttggctcatttttatactc

SEQ ID NO: 291236 - DNA, 25 bp, Mus musculus
attttcttggctgatttttatactc

SEQ ID NO: 291237 - DNA, 25 bp, Mus musculus
attttcttgggtcttggcactgtaa

SEQ ID NO: 291238 - DNA, 25 bp, Mus musculus
attttcttgggtgttggcactgtaa

SEQ ID NO: 291239 - DNA, 25 bp, Mus musculus
attttcttgtacactgctacctagc

SEQ ID NO: 291240 - DNA, 25 bp, Mus musculus
attttcttgtactctgctacctagc

SEQ ID NO: 291241 - DNA, 25 bp, Mus musculus
attttctttagcagtttcaatgaga

SEQ ID NO: 291242 - DNA, 25 bp, Mus musculus
attttctttagctgtttcaatgaga

SEQ ID NO: 291243 - DNA, 25 bp, Mus musculus
attttctttattcctagttggtgag

SEQ ID NO: 291244 - DNA, 25 bp, Mus musculus
attttctttattgctagttggtgag

SEQ ID NO: 291245 - DNA, 25 bp, Mus musculus
attttctttcccagggcttggatat

SEQ ID NO: 291246 - DNA, 25 bp, Mus musculus
attttctttccctgggcttggatat

SEQ ID NO: 291247 - DNA, 25 bp, Mus musculus
attttctttcctaaaggcagcttga

SEQ ID NO: 291248 - DNA, 25 bp, Mus musculus
attttctttccttaaggcagcttga

SEQ ID NO: 291249 - DNA, 25 bp, Mus musculus
attttctttgcacatgttgtaccaa

SEQ ID NO: 291250 - DNA, 25 bp, Mus musculus
attttctttgcagatgttgtaccaa

SEQ ID NO: 291251 - DNA, 25 bp, Mus musculus
attttctttgccctgcttactgaag

SEQ ID NO: 291252 - DNA, 25 bp, Mus musculus
attttctttgccgtgcttactgaag

SEQ ID NO: 291253 - DNA, 25 bp, Mus musculus
attttctttggccacaaccattgga

SEQ ID NO: 291254 - DNA, 25 bp, Mus musculus
attttctttggcgacaaccattgga

SEQ ID NO: 291255 - DNA, 25 bp, Mus musculus
attttctttgtcactgtagttcctc

SEQ ID NO: 291256 - DNA, 25 bp, Mus musculus
attttctttgtcatagatgctgaag

SEQ ID NO: 291257 - DNA, 25 bp, Mus musculus
attttctttgtctctgtagttcctc

SEQ ID NO: 291258 - DNA, 25 bp, Mus musculus
attttctttgtcttagatgctgaag

SEQ ID NO: 291259 - DNA, 25 bp, Mus musculus
attttcttttgcatcagtggcttac

SEQ ID NO: 291260 - DNA, 25 bp, Mus musculus
attttcttttgcttcagtggcttac

SEQ ID NO: 291261 - DNA, 25 bp, Mus musculus
attttctttttacttctctgcatgc

SEQ ID NO: 291262 - DNA, 25 bp, Mus musculus
attttctttttagttctctgcatgc

SEQ ID NO: 291263 - DNA, 25 bp, Mus musculus
attttctttttgacagcttcacttg

SEQ ID NO: 291264 - DNA, 25 bp, Mus musculus
attttctttttgtcagcttcacttg

SEQ ID NO: 291265 - DNA, 25 bp, Mus musculus
attttgaacagaaccacttacctcc

SEQ ID NO: 291266 - DNA, 25 bp, Mus musculus
attttgaacagatccacttacctcc

SEQ ID NO: 291267 - DNA, 25 bp, Mus musculus
attttgaacctacttgatcaactca

SEQ ID NO: 291268 - DNA, 25 bp, Mus musculus
attttgaacctagttgatcaactca

SEQ ID NO: 291269 - DNA, 25 bp, Mus musculus
attttgaatcgtactagctagcagg

SEQ ID NO: 291270 - DNA, 25 bp, Mus musculus
attttgaatcgttctagctagcagg

SEQ ID NO: 291271 - DNA, 25 bp, Mus musculus
attttgacaagcacactgacaggta

SEQ ID NO: 291272 - DNA, 25 bp, Mus musculus
attttgacaagctcactgacaggta

SEQ ID NO: 291273 - DNA, 25 bp, Mus musculus
attttgacagagaccccaagctgcc

SEQ ID NO: 291274 - DNA, 25 bp, Mus musculus
attttgacagagtccccaagctgcc

SEQ ID NO: 291275 - DNA, 25 bp, Mus musculus
attttgaccagcaggtctgcagacc

SEQ ID NO: 291276 - DNA, 25 bp, Mus musculus
attttgaccagctggtctgcagacc

SEQ ID NO: 291277 - DNA, 25 bp, Mus musculus
attttgaccattattggcatcttat

SEQ ID NO: 291278 - DNA, 25 bp, Mus musculus
attttgaccatttttggcatcttat

SEQ ID NO: 291279 - DNA, 25 bp, Mus musculus
attttgacccagattggccgatctc

SEQ ID NO: 291280 - DNA, 25 bp, Mus musculus
attttgacccagtttggccgatctc

SEQ ID NO: 291281 - DNA, 25 bp, Mus musculus
attttgacctccctgtggacaagga

SEQ ID NO: 291282 - DNA, 25 bp, Mus musculus
attttgacctccgtgtggacaagga

SEQ ID NO: 291283 - DNA, 25 bp, Mus musculus
attttgaccttactccatccagaaa

SEQ ID NO: 291284 - DNA, 25 bp, Mus musculus
attttgaccttagtccatccagaaa

SEQ ID NO: 291285 - DNA, 25 bp, Mus musculus
attttgactcatcgtgatagccaga

SEQ ID NO: 291286 - DNA, 25 bp, Mus musculus
attttgactcatggtgatagccaga

SEQ ID NO: 291287 - DNA, 25 bp, Mus musculus
attttgactgacatgatcctctctc

SEQ ID NO: 291288 - DNA, 25 bp, Mus musculus
attttgactgacttgatcctctctc

SEQ ID NO: 291289 - DNA, 25 bp, Mus musculus
attttgactgatagtgcatcctgga

SEQ ID NO: 291290 - DNA, 25 bp, Mus musculus
attttgactgattgtgcatcctgga

SEQ ID NO: 291291 - DNA, 25 bp, Mus musculus
attttgactgcccattctgtgtttc

SEQ ID NO: 291292 - DNA, 25 bp, Mus musculus
attttgactgccgattctgtgtttc

SEQ ID NO: 291293 - DNA, 25 bp, Mus musculus
attttgactgttcaagccatcacac

SEQ ID NO: 291294 - DNA, 25 bp, Mus musculus
attttgactgttgaagccatcacac

SEQ ID NO: 291295 - DNA, 25 bp, Mus musculus
attttgacttcactcctgtaggtat

SEQ ID NO: 291296 - DNA, 25 bp, Mus musculus
attttgacttcagtcctgtaggtat

SEQ ID NO: 291297 - DNA, 25 bp, Mus musculus
attttgacttgcagatcctttggat

SEQ ID NO: 291298 - DNA, 25 bp, Mus musculus
attttgacttgctgatcctttggat

SEQ ID NO: 291299 - DNA, 25 bp, Mus musculus
attttgacttgtatgcagctgtggg

SEQ ID NO: 291300 - DNA, 25 bp, Mus musculus
attttgacttgtttgcagctgtggg

SEQ ID NO: 291301 - DNA, 25 bp, Mus musculus
attttgagaaggcatacttggactc

SEQ ID NO: 291302 - DNA, 25 bp, Mus musculus
attttgagaagggatacttggactc

SEQ ID NO: 291303 - DNA, 25 bp, Mus musculus
attttgagagtgattttcagaagac

SEQ ID NO: 291304 - DNA, 25 bp, Mus musculus
attttgagagtgtttttcagaagac

SEQ ID NO: 291305 - DNA, 25 bp, Mus musculus
attttgagcaccctccaaattttgg

SEQ ID NO: 291306 - DNA, 25 bp, Mus musculus
attttgagcaccgtccaaattttgg

SEQ ID NO: 291307 - DNA, 25 bp, Mus musculus
attttgagctctaattttctgggac

SEQ ID NO: 291308 - DNA, 25 bp, Mus musculus
attttgagctcttattttctgggac

SEQ ID NO: 291309 - DNA, 25 bp, Mus musculus
attttgaggcggaggctagagcact

SEQ ID NO: 291310 - DNA, 25 bp, Mus musculus
attttgaggcggtggctagagcact

SEQ ID NO: 291311 - DNA, 25 bp, Mus musculus
attttgagtagtattcccatccagc

SEQ ID NO: 291312 - DNA, 25 bp, Mus musculus
attttgagtagttttcccatccagc

SEQ ID NO: 291313 - DNA, 25 bp, Mus musculus
attttgagtcagcactggccttggc

SEQ ID NO: 291314 - DNA, 25 bp, Mus musculus
attttgagtcaggactggccttggc

SEQ ID NO: 291315 - DNA, 25 bp, Mus musculus
attttgagtttgactccatctctga

SEQ ID NO: 291316 - DNA, 25 bp, Mus musculus
attttgagtttgtctccatctctga

SEQ ID NO: 291317 - DNA, 25 bp, Mus musculus
attttgataaaaaacttgactttgt

SEQ ID NO: 291318 - DNA, 25 bp, Mus musculus
attttgataaaatacttgactttgt

SEQ ID NO: 291319 - DNA, 25 bp, Mus musculus
attttgatacttattctagggttca

SEQ ID NO: 291320 - DNA, 25 bp, Mus musculus
attttgatactttttctagggttca

SEQ ID NO: 291321 - DNA, 25 bp, Mus musculus
attttgataggtcggtcacagtcaa

SEQ ID NO: 291322 - DNA, 25 bp, Mus musculus
attttgataggtgggtcacagtcaa

SEQ ID NO: 291323 - DNA, 25 bp, Mus musculus
attttgatcccaagcctcagctggg

SEQ ID NO: 291324 - DNA, 25 bp, Mus musculus
attttgatcccatgcctcagctggg

SEQ ID NO: 291325 - DNA, 25 bp, Mus musculus
attttgatcttgagggactcgggct

SEQ ID NO: 291326 - DNA, 25 bp, Mus musculus
attttgatcttgtgggactcgggct

SEQ ID NO: 291327 - DNA, 25 bp, Mus musculus
attttgatgatgatttcctcctcca

SEQ ID NO: 291328 - DNA, 25 bp, Mus musculus
attttgatgatgttttcctcctcca

SEQ ID NO: 291329 - DNA, 25 bp, Mus musculus
attttgatgcatccagattcagagc

SEQ ID NO: 291330 - DNA, 25 bp, Mus musculus
attttgatgcatcgccatcactgaa

SEQ ID NO: 291331 - DNA, 25 bp, Mus musculus
attttgatgcatgcagattcagagc

SEQ ID NO: 291332 - DNA, 25 bp, Mus musculus
attttgatgcatggccatcactgaa

SEQ ID NO: 291333 - DNA, 25 bp, Mus musculus
attttgattggtacgcgactgccta

SEQ ID NO: 291334 - DNA, 25 bp, Mus musculus
attttgattggttcgcgactgccta

SEQ ID NO: 291335 - DNA, 25 bp, Mus musculus
attttgcaagtcacattaggctaga

SEQ ID NO: 291336 - DNA, 25 bp, Mus musculus
attttgcaagtctcattaggctaga

SEQ ID NO: 291337 - DNA, 25 bp, Mus musculus
attttgcaatggacttcttaggtga

SEQ ID NO: 291338 - DNA, 25 bp, Mus musculus
attttgcaatggtcttcttaggtga

SEQ ID NO: 291339 - DNA, 25 bp, Mus musculus
attttgcacactccctgttcacact

SEQ ID NO: 291340 - DNA, 25 bp, Mus musculus
attttgcacactgcctgttcacact

SEQ ID NO: 291341 - DNA, 25 bp, Mus musculus
attttgcaccctagtaaaacgcagg

SEQ ID NO: 291342 - DNA, 25 bp, Mus musculus
attttgcacccttgtaaaacgcagg

SEQ ID NO: 291343 - DNA, 25 bp, Mus musculus
attttgcacgtcattattttccttt

SEQ ID NO: 291344 - DNA, 25 bp, Mus musculus
attttgcacgtctttattttccttt

SEQ ID NO: 291345 - DNA, 25 bp, Mus musculus
attttgcacttcaactttcttcgga

SEQ ID NO: 291346 - DNA, 25 bp, Mus musculus
attttgcacttctactttcttcgga

SEQ ID NO: 291347 - DNA, 25 bp, Mus musculus
attttgcactttagatactactaag

SEQ ID NO: 291348 - DNA, 25 bp, Mus musculus
attttgcacttttgatactactaag

SEQ ID NO: 291349 - DNA, 25 bp, Mus musculus
attttgcagagaacgagctggatct

SEQ ID NO: 291350 - DNA, 25 bp, Mus musculus
attttgcagagatcgagctggatct

SEQ ID NO: 291351 - DNA, 25 bp, Mus musculus
attttgcagagtcagccctacgcta

SEQ ID NO: 291352 - DNA, 25 bp, Mus musculus
attttgcagagtgagccctacgcta

SEQ ID NO: 291353 - DNA, 25 bp, Mus musculus
attttgcagcatacagttccctagt

SEQ ID NO: 291354 - DNA, 25 bp, Mus musculus
attttgcagcattcagttccctagt

SEQ ID NO: 291355 - DNA, 25 bp, Mus musculus
attttgcagcccaggcaagctggaa

SEQ ID NO: 291356 - DNA, 25 bp, Mus musculus
attttgcagccctggcaagctggaa

SEQ ID NO: 291357 - DNA, 25 bp, Mus musculus
attttgcagtccagtctagcctgaa

SEQ ID NO: 291358 - DNA, 25 bp, Mus musculus
attttgcagtcctgtctagcctgaa

SEQ ID NO: 291359 - DNA, 25 bp, Mus musculus
attttgcatcacctccagagaagct

SEQ ID NO: 291360 - DNA, 25 bp, Mus musculus
attttgcatcacgtccagagaagct

SEQ ID NO: 291361 - DNA, 25 bp, Mus musculus
attttgcatgctattttcttcccta

SEQ ID NO: 291362 - DNA, 25 bp, Mus musculus
attttgcatgcttttttcttcccta

SEQ ID NO: 291363 - DNA, 25 bp, Mus musculus
attttgcatgtactcaagtctcaaa

SEQ ID NO: 291364 - DNA, 25 bp, Mus musculus
attttgcatgtagtcaagtctcaaa

SEQ ID NO: 291365 - DNA, 25 bp, Mus musculus
attttgcatgtgagaccgtggtttt

SEQ ID NO: 291366 - DNA, 25 bp, Mus musculus
attttgcatgtgtgaccgtggtttt

SEQ ID NO: 291367 - DNA, 25 bp, Mus musculus
attttgcattgcatagattcttcag

SEQ ID NO: 291368 - DNA, 25 bp, Mus musculus
attttgcattgcttagattcttcag

SEQ ID NO: 291369 - DNA, 25 bp, Mus musculus
attttgcattggagagtggtactcc

SEQ ID NO: 291370 - DNA, 25 bp, Mus musculus
attttgcattggtgagtggtactcc

SEQ ID NO: 291371 - DNA, 25 bp, Mus musculus
attttgccaatacaaccgcactctc

SEQ ID NO: 291372 - DNA, 25 bp, Mus musculus
attttgccaatagaaccgcactctc

SEQ ID NO: 291373 - DNA, 25 bp, Mus musculus
attttgccacttacaagatcattta

SEQ ID NO: 291374 - DNA, 25 bp, Mus musculus
attttgccactttcaagatcattta

SEQ ID NO: 291375 - DNA, 25 bp, Mus musculus
attttgccagcaacgttaaacagga

SEQ ID NO: 291376 - DNA, 25 bp, Mus musculus
attttgccagcatcgttaaacagga

SEQ ID NO: 291377 - DNA, 25 bp, Mus musculus
attttgccattgactattgctcttg

SEQ ID NO: 291378 - DNA, 25 bp, Mus musculus
attttgccattgtctattgctcttg

SEQ ID NO: 291379 - DNA, 25 bp, Mus musculus
attttgcccagtcctttctattttg

SEQ ID NO: 291380 - DNA, 25 bp, Mus musculus
attttgcccagtgctttctattttg

SEQ ID NO: 291381 - DNA, 25 bp, Mus musculus
attttgccctccaatctacgtagat

SEQ ID NO: 291382 - DNA, 25 bp, Mus musculus
attttgccctcctatctacgtagat

SEQ ID NO: 291383 - DNA, 25 bp, Mus musculus
attttgccctgacttccgtgtatta

SEQ ID NO: 291384 - DNA, 25 bp, Mus musculus
attttgccctgagttccgtgtatta

SEQ ID NO: 291385 - DNA, 25 bp, Mus musculus
attttgccgcctcaagcttaccaag

SEQ ID NO: 291386 - DNA, 25 bp, Mus musculus
attttgccgcctgaagcttaccaag

SEQ ID NO: 291387 - DNA, 25 bp, Mus musculus
attttgcctcagctcccagactgag

SEQ ID NO: 291388 - DNA, 25 bp, Mus musculus
attttgcctcaggtcccagactgag

SEQ ID NO: 291389 - DNA, 25 bp, Mus musculus
attttgcctcgtataatgcttggaa

SEQ ID NO: 291390 - DNA, 25 bp, Mus musculus
attttgcctcgtttaatgcttggaa

SEQ ID NO: 291391 - DNA, 25 bp, Mus musculus
attttgcctctgatatagttttcta

SEQ ID NO: 291392 - DNA, 25 bp, Mus musculus
attttgcctctgatggccatgatta

SEQ ID NO: 291393 - DNA, 25 bp, Mus musculus
attttgcctctgttatagttttcta

SEQ ID NO: 291394 - DNA, 25 bp, Mus musculus
attttgcctctgttggccatgatta

SEQ ID NO: 291395 - DNA, 25 bp, Mus musculus
attttgcctgagactgggcgtgatt

SEQ ID NO: 291396 - DNA, 25 bp, Mus musculus
attttgcctgagtctgggcgtgatt

SEQ ID NO: 291397 - DNA, 25 bp, Mus musculus
attttgcctgtgcagtgaaaacatc

SEQ ID NO: 291398 - DNA, 25 bp, Mus musculus
attttgcctgtggagtgaaaacatc

SEQ ID NO: 291399 - DNA, 25 bp, Mus musculus
attttgcctgttagtctaatgaata

SEQ ID NO: 291400 - DNA, 25 bp, Mus musculus
attttgcctgttcgagacagggttt

SEQ ID NO: 291401 - DNA, 25 bp, Mus musculus
attttgcctgttggagacagggttt

SEQ ID NO: 291402 - DNA, 25 bp, Mus musculus
attttgcctgtttgtctaatgaata

SEQ ID NO: 291403 - DNA, 25 bp, Mus musculus
attttgccttatactgaggtcggac

SEQ ID NO: 291404 - DNA, 25 bp, Mus musculus
attttgccttattctgaggtcggac

SEQ ID NO: 291405 - DNA, 25 bp, Mus musculus
attttgccttgcaaacgctgcctac

SEQ ID NO: 291406 - DNA, 25 bp, Mus musculus
attttgccttgctaacgctgcctac

SEQ ID NO: 291407 - DNA, 25 bp, Mus musculus
attttgcggaatcttcttctacttc

SEQ ID NO: 291408 - DNA, 25 bp, Mus musculus
attttgcggaatgttcttctacttc

SEQ ID NO: 291409 - DNA, 25 bp, Mus musculus
attttgctacatatccattcactcc

SEQ ID NO: 291410 - DNA, 25 bp, Mus musculus
attttgctacatttccattcactcc

SEQ ID NO: 291411 - DNA, 25 bp, Mus musculus
attttgctacctaagtatttcagtg

SEQ ID NO: 291412 - DNA, 25 bp, Mus musculus
attttgctaccttagtatttcagtg

SEQ ID NO: 291413 - DNA, 25 bp, Mus musculus
attttgctactgagagtctcacaca

SEQ ID NO: 291414 - DNA, 25 bp, Mus musculus
attttgctactgcaacacttctgga

SEQ ID NO: 291415 - DNA, 25 bp, Mus musculus
attttgctactggaacacttctgga

SEQ ID NO: 291416 - DNA, 25 bp, Mus musculus
attttgctactgtgagtctcacaca

SEQ ID NO: 291417 - DNA, 25 bp, Mus musculus
attttgctagttccatctccaaaga

SEQ ID NO: 291418 - DNA, 25 bp, Mus musculus
attttgctagttgcatctccaaaga

SEQ ID NO: 291419 - DNA, 25 bp, Mus musculus
attttgctatgcatcccaatttttt

SEQ ID NO: 291420 - DNA, 25 bp, Mus musculus
attttgctatgcatctcctggtctt

SEQ ID NO: 291421 - DNA, 25 bp, Mus musculus
attttgctatgcttcccaatttttt

SEQ ID NO: 291422 - DNA, 25 bp, Mus musculus
attttgctatgcttctcctggtctt

SEQ ID NO: 291423 - DNA, 25 bp, Mus musculus
attttgctatttatgcgaccaccca

SEQ ID NO: 291424 - DNA, 25 bp, Mus musculus
attttgctatttttgcgaccaccca

SEQ ID NO: 291425 - DNA, 25 bp, Mus musculus
attttgctcataattctgtccccat

SEQ ID NO: 291426 - DNA, 25 bp, Mus musculus
attttgctcatatttctgtccccat

SEQ ID NO: 291427 - DNA, 25 bp, Mus musculus
attttgctcatcacactcacatttt

SEQ ID NO: 291428 - DNA, 25 bp, Mus musculus
attttgctcatctcactcacatttt

SEQ ID NO: 291429 - DNA, 25 bp, Mus musculus
attttgctctctacaagctgttaat

SEQ ID NO: 291430 - DNA, 25 bp, Mus musculus
attttgctctcttcaagctgttaat

SEQ ID NO: 291431 - DNA, 25 bp, Mus musculus
attttgctcttcctttgggctagaa

SEQ ID NO: 291432 - DNA, 25 bp, Mus musculus
attttgctcttcgtttgggctagaa

SEQ ID NO: 291433 - DNA, 25 bp, Mus musculus
attttgctgagacatagccgcaccc

SEQ ID NO: 291434 - DNA, 25 bp, Mus musculus
attttgctgagagatagccgcaccc

SEQ ID NO: 291435 - DNA, 25 bp, Mus musculus
attttgctgcagacaccaaacacct

SEQ ID NO: 291436 - DNA, 25 bp, Mus musculus
attttgctgcagtcaccaaacacct

SEQ ID NO: 291437 - DNA, 25 bp, Mus musculus
attttgctgcccatggtgaaagttt

SEQ ID NO: 291438 - DNA, 25 bp, Mus musculus
attttgctgcccttggtgaaagttt

SEQ ID NO: 291439 - DNA, 25 bp, Mus musculus
attttgctgctgaaccatgtgcatg

SEQ ID NO: 291440 - DNA, 25 bp, Mus musculus
attttgctgctgtaccatgtgcatg

SEQ ID NO: 291441 - DNA, 25 bp, Mus musculus
attttgctgtacctcgccggaaatt

SEQ ID NO: 291442 - DNA, 25 bp, Mus musculus
attttgctgtacgtcgccggaaatt

SEQ ID NO: 291443 - DNA, 25 bp, Mus musculus
attttgctgtatagacctggttgtc

SEQ ID NO: 291444 - DNA, 25 bp, Mus musculus
attttgctgtattgacctggttgtc

SEQ ID NO: 291445 - DNA, 25 bp, Mus musculus
attttgctgtgtcctacttcatgct

SEQ ID NO: 291446 - DNA, 25 bp, Mus musculus
attttgctgtgtgctacttcatgct

SEQ ID NO: 291447 - DNA, 25 bp, Mus musculus
attttgctgttactgcgcctaggaa

SEQ ID NO: 291448 - DNA, 25 bp, Mus musculus
attttgctgttagtgcgcctaggaa

SEQ ID NO: 291449 - DNA, 25 bp, Mus musculus
attttgcttatccagaatacataaa

SEQ ID NO: 291450 - DNA, 25 bp, Mus musculus
attttgcttatcgagaatacataaa

SEQ ID NO: 291451 - DNA, 25 bp, Mus musculus
attttgcttcatcatttgctctctc

SEQ ID NO: 291452 - DNA, 25 bp, Mus musculus
attttgcttcatgatttgctctctc

SEQ ID NO: 291453 - DNA, 25 bp, Mus musculus
attttgcttcctacatgcagacact

SEQ ID NO: 291454 - DNA, 25 bp, Mus musculus
attttgcttccttcatgcagacact

SEQ ID NO: 291455 - DNA, 25 bp, Mus musculus
attttgcttctaaagttcctcttct

SEQ ID NO: 291456 - DNA, 25 bp, Mus musculus
attttgcttctatagttcctcttct

SEQ ID NO: 291457 - DNA, 25 bp, Mus musculus
attttgcttgtacggtgactgttca

SEQ ID NO: 291458 - DNA, 25 bp, Mus musculus
attttgcttgtagggtgactgttca

SEQ ID NO: 291459 - DNA, 25 bp, Mus musculus
attttgctttgcattccaagacaga

SEQ ID NO: 291460 - DNA, 25 bp, Mus musculus
attttgctttgcctctgtgctttac

SEQ ID NO: 291461 - DNA, 25 bp, Mus musculus
attttgctttgcgtctgtgctttac

SEQ ID NO: 291462 - DNA, 25 bp, Mus musculus
attttgctttgctttccaagacaga

SEQ ID NO: 291463 - DNA, 25 bp, Mus musculus
attttgctttggcaacttgttgact

SEQ ID NO: 291464 - DNA, 25 bp, Mus musculus
attttgctttgggaacttgttgact

SEQ ID NO: 291465 - DNA, 25 bp, Mus musculus
attttgcttttaagctgtcctccat

SEQ ID NO: 291466 - DNA, 25 bp, Mus musculus
attttgcttttatgctgtcctccat

SEQ ID NO: 291467 - DNA, 25 bp, Mus musculus
attttggaaatcaagcgtgcagtca

SEQ ID NO: 291468 - DNA, 25 bp, Mus musculus
attttggaaatctagcgtgcagtca

SEQ ID NO: 291469 - DNA, 25 bp, Mus musculus
attttggaatgtacatgtgctatgc

SEQ ID NO: 291470 - DNA, 25 bp, Mus musculus
attttggaatgttcatgtgctatgc

SEQ ID NO: 291471 - DNA, 25 bp, Mus musculus
attttggacgtaatctcagtgttct

SEQ ID NO: 291472 - DNA, 25 bp, Mus musculus
attttggacgtattctcagtgttct

SEQ ID NO: 291473 - DNA, 25 bp, Mus musculus
attttggacttaaacctaaactcag

SEQ ID NO: 291474 - DNA, 25 bp, Mus musculus
attttggacttatacctaaactcag

SEQ ID NO: 291475 - DNA, 25 bp, Mus musculus
attttggatagacacggcctcctag

SEQ ID NO: 291476 - DNA, 25 bp, Mus musculus
attttggatagagacggcctcctag

SEQ ID NO: 291477 - DNA, 25 bp, Mus musculus
attttggatgctcgtgctaaacttc

SEQ ID NO: 291478 - DNA, 25 bp, Mus musculus
attttggatgctggtgctaaacttc

SEQ ID NO: 291479 - DNA, 25 bp, Mus musculus
attttggcaactaagctccttctct

SEQ ID NO: 291480 - DNA, 25 bp, Mus musculus
attttggcaacttagctccttctct

SEQ ID NO: 291481 - DNA, 25 bp, Mus musculus
attttggcagctagacttcctggag

SEQ ID NO: 291482 - DNA, 25 bp, Mus musculus
attttggcagcttgacttcctggag

SEQ ID NO: 291483 - DNA, 25 bp, Mus musculus
attttggcagttataggtaagcata

SEQ ID NO: 291484 - DNA, 25 bp, Mus musculus
attttggcagttttaggtaagcata

SEQ ID NO: 291485 - DNA, 25 bp, Mus musculus
attttggccaatatgcagattatca

SEQ ID NO: 291486 - DNA, 25 bp, Mus musculus
attttggccaatttgcagattatca

SEQ ID NO: 291487 - DNA, 25 bp, Mus musculus
attttggcccaaagactagacttag

SEQ ID NO: 291488 - DNA, 25 bp, Mus musculus
attttggcccaacagagttgtctct

SEQ ID NO: 291489 - DNA, 25 bp, Mus musculus
attttggcccaagagagttgtctct

SEQ ID NO: 291490 - DNA, 25 bp, Mus musculus
attttggcccaatgactagacttag

SEQ ID NO: 291491 - DNA, 25 bp, Mus musculus
attttggcctggaacttaatagtga

SEQ ID NO: 291492 - DNA, 25 bp, Mus musculus
attttggcctggtacttaatagtga

SEQ ID NO: 291493 - DNA, 25 bp, Mus musculus
attttggcctttacttgatctatta

SEQ ID NO: 291494 - DNA, 25 bp, Mus musculus
attttggccttttcttgatctatta

SEQ ID NO: 291495 - DNA, 25 bp, Mus musculus
attttggctctcaggactttattct

SEQ ID NO: 291496 - DNA, 25 bp, Mus musculus
attttggctctcagtttcacagggt

SEQ ID NO: 291497 - DNA, 25 bp, Mus musculus
attttggctctctggactttattct

SEQ ID NO: 291498 - DNA, 25 bp, Mus musculus
attttggctctctgtttcacagggt

SEQ ID NO: 291499 - DNA, 25 bp, Mus musculus
attttggctgctactataaagagtt

SEQ ID NO: 291500 - DNA, 25 bp, Mus musculus
attttggctgcttctataaagagtt

SEQ ID NO: 291501 - DNA, 25 bp, Mus musculus
attttggctgttaagatcctccttt

SEQ ID NO: 291502 - DNA, 25 bp, Mus musculus
attttggctgtttagatcctccttt

SEQ ID NO: 291503 - DNA, 25 bp, Mus musculus
attttggcttcaaggtctgtgtgac

SEQ ID NO: 291504 - DNA, 25 bp, Mus musculus
attttggcttcatggtctgtgtgac

SEQ ID NO: 291505 - DNA, 25 bp, Mus musculus
attttggctttacgtttgctgtcac

SEQ ID NO: 291506 - DNA, 25 bp, Mus musculus
attttggctttaggtttgctgtcac

SEQ ID NO: 291507 - DNA, 25 bp, Mus musculus
attttgggaataaagtgcaaagaga

SEQ ID NO: 291508 - DNA, 25 bp, Mus musculus
attttgggaatatagtgcaaagaga

SEQ ID NO: 291509 - DNA, 25 bp, Mus musculus
attttgggactcactgtgttcataa

SEQ ID NO: 291510 - DNA, 25 bp, Mus musculus
attttgggactctctgtgttcataa

SEQ ID NO: 291511 - DNA, 25 bp, Mus musculus
attttgggactgagttacctcactt

SEQ ID NO: 291512 - DNA, 25 bp, Mus musculus
attttgggactgtgttacctcactt

SEQ ID NO: 291513 - DNA, 25 bp, Mus musculus
attttgggcaggaagctgaggctct

SEQ ID NO: 291514 - DNA, 25 bp, Mus musculus
attttgggcaggtagctgaggctct

SEQ ID NO: 291515 - DNA, 25 bp, Mus musculus
attttgggcccaaagataacttatc

SEQ ID NO: 291516 - DNA, 25 bp, Mus musculus
attttgggcccaagcaggttcagtc

SEQ ID NO: 291517 - DNA, 25 bp, Mus musculus
attttgggcccaccatgatagtaca

SEQ ID NO: 291518 - DNA, 25 bp, Mus musculus
attttgggcccagcatgatagtaca

SEQ ID NO: 291519 - DNA, 25 bp, Mus musculus
attttgggcccatagataacttatc

SEQ ID NO: 291520 - DNA, 25 bp, Mus musculus
attttgggcccatgcaggttcagtc

SEQ ID NO: 291521 - DNA, 25 bp, Mus musculus
attttgggcctgagaaacctgctgc

SEQ ID NO: 291522 - DNA, 25 bp, Mus musculus
attttgggcctgtgaaacctgctgc

SEQ ID NO: 291523 - DNA, 25 bp, Mus musculus
attttgggctcacctagttttctgt

SEQ ID NO: 291524 - DNA, 25 bp, Mus musculus
attttgggctcagctagttttctgt

SEQ ID NO: 291525 - DNA, 25 bp, Mus musculus
attttgggtgcaaggccatgggtcc

SEQ ID NO: 291526 - DNA, 25 bp, Mus musculus
attttgggtgcatggccatgggtcc

SEQ ID NO: 291527 - DNA, 25 bp, Mus musculus
attttgggttccaagttcatgtcta

SEQ ID NO: 291528 - DNA, 25 bp, Mus musculus
attttgggttcctagttcatgtcta

SEQ ID NO: 291529 - DNA, 25 bp, Mus musculus
attttggtagataatcttgtgccgt

SEQ ID NO: 291530 - DNA, 25 bp, Mus musculus
attttggtagattatcttgtgccgt

SEQ ID NO: 291531 - DNA, 25 bp, Mus musculus
attttggtagtcagattgctgctat

SEQ ID NO: 291532 - DNA, 25 bp, Mus musculus
attttggtagtctgattgctgctat

SEQ ID NO: 291533 - DNA, 25 bp, Mus musculus
attttggtatggagcgctgtgacac

SEQ ID NO: 291534 - DNA, 25 bp, Mus musculus
attttggtatggtgcgctgtgacac

SEQ ID NO: 291535 - DNA, 25 bp, Mus musculus
attttggtatgtagagtcgctggga

SEQ ID NO: 291536 - DNA, 25 bp, Mus musculus
attttggtatgtatgggtctctggc

SEQ ID NO: 291537 - DNA, 25 bp, Mus musculus
attttggtatgttgagtcgctggga

SEQ ID NO: 291538 - DNA, 25 bp, Mus musculus
attttggtatgtttgggtctctggc

SEQ ID NO: 291539 - DNA, 25 bp, Mus musculus
attttggtgctcatccctgtctgct

SEQ ID NO: 291540 - DNA, 25 bp, Mus musculus
attttggtgctcttccctgtctgct

SEQ ID NO: 291541 - DNA, 25 bp, Mus musculus
attttggttgttacacgctgcctca

SEQ ID NO: 291542 - DNA, 25 bp, Mus musculus
attttggttgtttcacgctgcctca

SEQ ID NO: 291543 - DNA, 25 bp, Mus musculus
attttgtaaacccatagctatgaag

SEQ ID NO: 291544 - DNA, 25 bp, Mus musculus
attttgtaaaccgatagctatgaag

SEQ ID NO: 291545 - DNA, 25 bp, Mus musculus
attttgtaagaaagccagtccttgg

SEQ ID NO: 291546 - DNA, 25 bp, Mus musculus
attttgtaagaatgccagtccttgg

SEQ ID NO: 291547 - DNA, 25 bp, Mus musculus
attttgtaagaccaccctgcagtcc

SEQ ID NO: 291548 - DNA, 25 bp, Mus musculus
attttgtaagacgaccctgcagtcc

SEQ ID NO: 291549 - DNA, 25 bp, Mus musculus
attttgtaattaacatcgcctccct

SEQ ID NO: 291550 - DNA, 25 bp, Mus musculus
attttgtaattatcatcgcctccct

SEQ ID NO: 291551 - DNA, 25 bp, Mus musculus
attttgtacctaaattgtgcaatac

SEQ ID NO: 291552 - DNA, 25 bp, Mus musculus
attttgtacctatattgtgcaatac

SEQ ID NO: 291553 - DNA, 25 bp, Mus musculus
attttgtactagagaatgaggagac

SEQ ID NO: 291554 - DNA, 25 bp, Mus musculus
attttgtactagtgaatgaggagac

SEQ ID NO: 291555 - DNA, 25 bp, Mus musculus
attttgtagcatagtccccaagctc

SEQ ID NO: 291556 - DNA, 25 bp, Mus musculus
attttgtagcattgtccccaagctc

SEQ ID NO: 291557 - DNA, 25 bp, Mus musculus
attttgtaggacaccaggtcctcag

SEQ ID NO: 291558 - DNA, 25 bp, Mus musculus
attttgtaggactccaggtcctcag

SEQ ID NO: 291559 - DNA, 25 bp, Mus musculus
attttgtatcctctttgatcccttc

SEQ ID NO: 291560 - DNA, 25 bp, Mus musculus
attttgtatcctgtttgatcccttc

SEQ ID NO: 291561 - DNA, 25 bp, Mus musculus
attttgtatgcaatccacttctaat

SEQ ID NO: 291562 - DNA, 25 bp, Mus musculus
attttgtatgcattccacttctaat

SEQ ID NO: 291563 - DNA, 25 bp, Mus musculus
attttgtattacaccaagtctgttg

SEQ ID NO: 291564 - DNA, 25 bp, Mus musculus
attttgtattacagcctcacttgta

SEQ ID NO: 291565 - DNA, 25 bp, Mus musculus
attttgtattactccaagtctgttg

SEQ ID NO: 291566 - DNA, 25 bp, Mus musculus
attttgtattactgcctcacttgta

SEQ ID NO: 291567 - DNA, 25 bp, Mus musculus
attttgtcaagtagctagtagccac

SEQ ID NO: 291568 - DNA, 25 bp, Mus musculus
attttgtcaagttgctagtagccac

SEQ ID NO: 291569 - DNA, 25 bp, Mus musculus
attttgtcaatacgctaggttatag

SEQ ID NO: 291570 - DNA, 25 bp, Mus musculus
attttgtcaataggctaggttatag

SEQ ID NO: 291571 - DNA, 25 bp, Mus musculus
attttgtcatctaccacatctgtca

SEQ ID NO: 291572 - DNA, 25 bp, Mus musculus
attttgtcatcttccacatctgtca

SEQ ID NO: 291573 - DNA, 25 bp, Mus musculus
attttgtcatggactgctggttccc

SEQ ID NO: 291574 - DNA, 25 bp, Mus musculus
attttgtcatggtctgctggttccc

SEQ ID NO: 291575 - DNA, 25 bp, Mus musculus
attttgtcctgcagattctgtcagt

SEQ ID NO: 291576 - DNA, 25 bp, Mus musculus
attttgtcctgctgattctgtcagt

SEQ ID NO: 291577 - DNA, 25 bp, Mus musculus
attttgtccttgaagccagccatgg

SEQ ID NO: 291578 - DNA, 25 bp, Mus musculus
attttgtccttgtagccagccatgg

SEQ ID NO: 291579 - DNA, 25 bp, Mus musculus
attttgtctctcctcagcataagga

SEQ ID NO: 291580 - DNA, 25 bp, Mus musculus
attttgtctctcgtcagcataagga

SEQ ID NO: 291581 - DNA, 25 bp, Mus musculus
attttgtctggtacaaggtacattc

SEQ ID NO: 291582 - DNA, 25 bp, Mus musculus
attttgtctggttcaaggtacattc

SEQ ID NO: 291583 - DNA, 25 bp, Mus musculus
attttgtcttccactgtacccacag

SEQ ID NO: 291584 - DNA, 25 bp, Mus musculus
attttgtcttcctctgtacccacag

SEQ ID NO: 291585 - DNA, 25 bp, Mus musculus
attttgtcttcgaccgggttatatg

SEQ ID NO: 291586 - DNA, 25 bp, Mus musculus
attttgtcttcgtccgggttatatg

SEQ ID NO: 291587 - DNA, 25 bp, Mus musculus
attttgtgaggcaaagcccatgagg

SEQ ID NO: 291588 - DNA, 25 bp, Mus musculus
attttgtgaggcaggtttacaacac

SEQ ID NO: 291589 - DNA, 25 bp, Mus musculus
attttgtgaggctaagcccatgagg

SEQ ID NO: 291590 - DNA, 25 bp, Mus musculus
attttgtgaggctggtttacaacac

SEQ ID NO: 291591 - DNA, 25 bp, Mus musculus
attttgtgagtgatttccatgtcca

SEQ ID NO: 291592 - DNA, 25 bp, Mus musculus
attttgtgagtgttttccatgtcca

SEQ ID NO: 291593 - DNA, 25 bp, Mus musculus
attttgtgatagatggtggccccga

SEQ ID NO: 291594 - DNA, 25 bp, Mus musculus
attttgtgatagttggtggccccga

SEQ ID NO: 291595 - DNA, 25 bp, Mus musculus
attttgtgcaaaacccaggacgcga

SEQ ID NO: 291596 - DNA, 25 bp, Mus musculus
attttgtgcaaatcccaggacgcga

SEQ ID NO: 291597 - DNA, 25 bp, Mus musculus
attttgtgccaaccagtgtcttttt

SEQ ID NO: 291598 - DNA, 25 bp, Mus musculus
attttgtgccaagcagtgtcttttt

SEQ ID NO: 291599 - DNA, 25 bp, Mus musculus
attttgtgccttctgccagatgtca

SEQ ID NO: 291600 - DNA, 25 bp, Mus musculus
attttgtgccttgtgccagatgtca

SEQ ID NO: 291601 - DNA, 25 bp, Mus musculus
attttgtggaacaactattagcttg

SEQ ID NO: 291602 - DNA, 25 bp, Mus musculus
attttgtggaactactattagcttg

SEQ ID NO: 291603 - DNA, 25 bp, Mus musculus
attttgtggagcagatgggtcccaa

SEQ ID NO: 291604 - DNA, 25 bp, Mus musculus
attttgtggagctgatgggtcccaa

SEQ ID NO: 291605 - DNA, 25 bp, Mus musculus
attttgtggcacatactgcttcagc

SEQ ID NO: 291606 - DNA, 25 bp, Mus musculus
attttgtggcacttactgcttcagc

SEQ ID NO: 291607 - DNA, 25 bp, Mus musculus
attttgtgtattcctgtggtctgat

SEQ ID NO: 291608 - DNA, 25 bp, Mus musculus
attttgtgtattgctgtggtctgat

SEQ ID NO: 291609 - DNA, 25 bp, Mus musculus
attttgtgtgtactctgagcatgca

SEQ ID NO: 291610 - DNA, 25 bp, Mus musculus
attttgtgtgtagtctgagcatgca

SEQ ID NO: 291611 - DNA, 25 bp, Mus musculus
attttgttagaacccctactgatag

SEQ ID NO: 291612 - DNA, 25 bp, Mus musculus
attttgttagaagccctactgatag

SEQ ID NO: 291613 - DNA, 25 bp, Mus musculus
attttgttatatcattgccattgaa

SEQ ID NO: 291614 - DNA, 25 bp, Mus musculus
attttgttatatgattgccattgaa

SEQ ID NO: 291615 - DNA, 25 bp, Mus musculus
attttgttatgaatactccagttta

SEQ ID NO: 291616 - DNA, 25 bp, Mus musculus
attttgttatgattactccagttta

SEQ ID NO: 291617 - DNA, 25 bp, Mus musculus
attttgttcaatatggtctggttaa

SEQ ID NO: 291618 - DNA, 25 bp, Mus musculus
attttgttcaatttggtctggttaa

SEQ ID NO: 291619 - DNA, 25 bp, Mus musculus
attttgttccttactagccatcaag

SEQ ID NO: 291620 - DNA, 25 bp, Mus musculus
attttgttcctttctagccatcaag

SEQ ID NO: 291621 - DNA, 25 bp, Mus musculus
attttgttcttcctctgttatgacc

SEQ ID NO: 291622 - DNA, 25 bp, Mus musculus
attttgttcttcgtctgttatgacc

SEQ ID NO: 291623 - DNA, 25 bp, Mus musculus
attttgttgcccattatgtttctgg

SEQ ID NO: 291624 - DNA, 25 bp, Mus musculus
attttgttgccctttatgtttctgg

SEQ ID NO: 291625 - DNA, 25 bp, Mus musculus
attttgttgggaactggccagcctc

SEQ ID NO: 291626 - DNA, 25 bp, Mus musculus
attttgttgggatctggccagcctc

SEQ ID NO: 291627 - DNA, 25 bp, Mus musculus
attttgttggtaatgctttcataat

SEQ ID NO: 291628 - DNA, 25 bp, Mus musculus
attttgttggtattgctttcataat

SEQ ID NO: 291629 - DNA, 25 bp, Mus musculus
attttgttggtgactggccagttga

SEQ ID NO: 291630 - DNA, 25 bp, Mus musculus
attttgttggtgtctggccagttga

SEQ ID NO: 291631 - DNA, 25 bp, Mus musculus
attttgttgtagatcccatggctga

SEQ ID NO: 291632 - DNA, 25 bp, Mus musculus
attttgttgtagttcccatggctga

SEQ ID NO: 291633 - DNA, 25 bp, Mus musculus
attttgttgttgagggtgtccaagg

SEQ ID NO: 291634 - DNA, 25 bp, Mus musculus
attttgttgttgtgggtgtccaagg

SEQ ID NO: 291635 - DNA, 25 bp, Mus musculus
attttgtttaccaccatcatggttt

SEQ ID NO: 291636 - DNA, 25 bp, Mus musculus
attttgtttacctccatcatggttt

SEQ ID NO: 291637 - DNA, 25 bp, Mus musculus
attttgtttcacaggctgcctccat

SEQ ID NO: 291638 - DNA, 25 bp, Mus musculus
attttgtttcactggctgcctccat

SEQ ID NO: 291639 - DNA, 25 bp, Mus musculus
attttgtttcgcagtatctactttc

SEQ ID NO: 291640 - DNA, 25 bp, Mus musculus
attttgtttcgctgtatctactttc

SEQ ID NO: 291641 - DNA, 25 bp, Mus musculus
attttgtttgtaatgcagtggcctc

SEQ ID NO: 291642 - DNA, 25 bp, Mus musculus
attttgtttgtattgcagtggcctc

SEQ ID NO: 291643 - DNA, 25 bp, Mus musculus
attttgtttgtcaggtgtgggaatc

SEQ ID NO: 291644 - DNA, 25 bp, Mus musculus
attttgtttgtctggtgtgggaatc

SEQ ID NO: 291645 - DNA, 25 bp, Mus musculus
atttttaaactgagtgctaactgca

SEQ ID NO: 291646 - DNA, 25 bp, Mus musculus
atttttaaactgtgtgctaactgca

SEQ ID NO: 291647 - DNA, 25 bp, Mus musculus
atttttaacagcactatccttgagg

SEQ ID NO: 291648 - DNA, 25 bp, Mus musculus
atttttaacagctctatccttgagg

SEQ ID NO: 291649 - DNA, 25 bp, Mus musculus
atttttaacctaacagagtagagtg

SEQ ID NO: 291650 - DNA, 25 bp, Mus musculus
atttttaacctatcagagtagagtg

SEQ ID NO: 291651 - DNA, 25 bp, Mus musculus
atttttaacttcagtccatgttaga

SEQ ID NO: 291652 - DNA, 25 bp, Mus musculus
atttttaacttctgtccatgttaga

SEQ ID NO: 291653 - DNA, 25 bp, Mus musculus
atttttaagccaccgacttgtccac

SEQ ID NO: 291654 - DNA, 25 bp, Mus musculus
atttttaagccagcgacttgtccac

SEQ ID NO: 291655 - DNA, 25 bp, Mus musculus
atttttaagccccatattatgagat

SEQ ID NO: 291656 - DNA, 25 bp, Mus musculus
atttttaagcccgatattatgagat

SEQ ID NO: 291657 - DNA, 25 bp, Mus musculus
atttttaagctcactcaagctgctc

SEQ ID NO: 291658 - DNA, 25 bp, Mus musculus
atttttaagctctctcaagctgctc

SEQ ID NO: 291659 - DNA, 25 bp, Mus musculus
atttttaagtttaccatacagtgct

SEQ ID NO: 291660 - DNA, 25 bp, Mus musculus
atttttaagttttccatacagtgct

SEQ ID NO: 291661 - DNA, 25 bp, Mus musculus
atttttaatatcatcgtcccaagca

SEQ ID NO: 291662 - DNA, 25 bp, Mus musculus
atttttaatatcttcgtcccaagca

SEQ ID NO: 291663 - DNA, 25 bp, Mus musculus
atttttaatgggaccatgtgtcaca

SEQ ID NO: 291664 - DNA, 25 bp, Mus musculus
atttttaatgggtccatgtgtcaca

SEQ ID NO: 291665 - DNA, 25 bp, Mus musculus
atttttaattccacgaccaggcatg

SEQ ID NO: 291666 - DNA, 25 bp, Mus musculus
atttttaattcctcgaccaggcatg

SEQ ID NO: 291667 - DNA, 25 bp, Mus musculus
atttttaatttccagtccatcatag

SEQ ID NO: 291668 - DNA, 25 bp, Mus musculus
atttttaatttcgagtccatcatag

SEQ ID NO: 291669 - DNA, 25 bp, Mus musculus
atttttacaatcatggccatcagag

SEQ ID NO: 291670 - DNA, 25 bp, Mus musculus
atttttacaatcttggccatcagag

SEQ ID NO: 291671 - DNA, 25 bp, Mus musculus
atttttacaattcactggccatgga

SEQ ID NO: 291672 - DNA, 25 bp, Mus musculus
atttttacaattgactggccatgga

SEQ ID NO: 291673 - DNA, 25 bp, Mus musculus
atttttacagaccagctccttactc

SEQ ID NO: 291674 - DNA, 25 bp, Mus musculus
atttttacagacgagctccttactc

SEQ ID NO: 291675 - DNA, 25 bp, Mus musculus
atttttaccagtctggccaaagcct

SEQ ID NO: 291676 - DNA, 25 bp, Mus musculus
atttttaccagtgtggccaaagcct

SEQ ID NO: 291677 - DNA, 25 bp, Mus musculus
atttttacgagcagtgtgtctctcc

SEQ ID NO: 291678 - DNA, 25 bp, Mus musculus
atttttacgagctgtgtgtctctcc

SEQ ID NO: 291679 - DNA, 25 bp, Mus musculus
atttttactaatcccatcagatttt

SEQ ID NO: 291680 - DNA, 25 bp, Mus musculus
atttttactaatgccatcagatttt

SEQ ID NO: 291681 - DNA, 25 bp, Mus musculus
atttttactcctattacctggccat

SEQ ID NO: 291682 - DNA, 25 bp, Mus musculus
atttttactccttttacctggccat

SEQ ID NO: 291683 - DNA, 25 bp, Mus musculus
atttttactcgtctgcattctgggc

SEQ ID NO: 291684 - DNA, 25 bp, Mus musculus
atttttactcgtgtgcattctgggc

SEQ ID NO: 291685 - DNA, 25 bp, Mus musculus
atttttactcttctctgctaatgac

SEQ ID NO: 291686 - DNA, 25 bp, Mus musculus
atttttactcttgtctgctaatgac

SEQ ID NO: 291687 - DNA, 25 bp, Mus musculus
atttttagaaatcagctgcccctta

SEQ ID NO: 291688 - DNA, 25 bp, Mus musculus
atttttagaaatgagctgcccctta

SEQ ID NO: 291689 - DNA, 25 bp, Mus musculus
atttttagcaaaaggagaagtctcc

SEQ ID NO: 291690 - DNA, 25 bp, Mus musculus
atttttagcaaatggagaagtctcc

SEQ ID NO: 291691 - DNA, 25 bp, Mus musculus
atttttagcagaccctgtttcagcc

SEQ ID NO: 291692 - DNA, 25 bp, Mus musculus
atttttagcagagcctgtttcagcc

SEQ ID NO: 291693 - DNA, 25 bp, Mus musculus
atttttagccgcctgtttaaatgca

SEQ ID NO: 291694 - DNA, 25 bp, Mus musculus
atttttagccgcgtgtttaaatgca

SEQ ID NO: 291695 - DNA, 25 bp, Mus musculus
atttttagcctgacctggtggctca

SEQ ID NO: 291696 - DNA, 25 bp, Mus musculus
atttttagcctgtcctggtggctca

SEQ ID NO: 291697 - DNA, 25 bp, Mus musculus
atttttagcggacacgtccttgctc

SEQ ID NO: 291698 - DNA, 25 bp, Mus musculus
atttttagcggagacgtccttgctc

SEQ ID NO: 291699 - DNA, 25 bp, Mus musculus
atttttagtattctctagacctaca

SEQ ID NO: 291700 - DNA, 25 bp, Mus musculus
atttttagtattgtctagacctaca

SEQ ID NO: 291701 - DNA, 25 bp, Mus musculus
atttttagtgagatcctggcgctgg

SEQ ID NO: 291702 - DNA, 25 bp, Mus musculus
atttttagtgagttcctggcgctgg

SEQ ID NO: 291703 - DNA, 25 bp, Mus musculus
atttttatacatccccatggctatg

SEQ ID NO: 291704 - DNA, 25 bp, Mus musculus
atttttatacatgcccatggctatg

SEQ ID NO: 291705 - DNA, 25 bp, Mus musculus
atttttatagaacccctctcaatct

SEQ ID NO: 291706 - DNA, 25 bp, Mus musculus
atttttatagaagccctctcaatct

SEQ ID NO: 291707 - DNA, 25 bp, Mus musculus
atttttatcccaatgatacttctca

SEQ ID NO: 291708 - DNA, 25 bp, Mus musculus
atttttatcccattgatacttctca

SEQ ID NO: 291709 - DNA, 25 bp, Mus musculus
atttttatctttctctagttggaag

SEQ ID NO: 291710 - DNA, 25 bp, Mus musculus
atttttatctttgtctagttggaag

SEQ ID NO: 291711 - DNA, 25 bp, Mus musculus
atttttatgcccctgtattgactga

SEQ ID NO: 291712 - DNA, 25 bp, Mus musculus
atttttatgcccgtgtattgactga

SEQ ID NO: 291713 - DNA, 25 bp, Mus musculus
atttttatgcctaaccatggtgttg

SEQ ID NO: 291714 - DNA, 25 bp, Mus musculus
atttttatgccttaccatggtgttg

SEQ ID NO: 291715 - DNA, 25 bp, Mus musculus
atttttatggaaagctcagcctaag

SEQ ID NO: 291716 - DNA, 25 bp, Mus musculus
atttttatggaatgctcagcctaag

SEQ ID NO: 291717 - DNA, 25 bp, Mus musculus
atttttatggccacccaaagcattc

SEQ ID NO: 291718 - DNA, 25 bp, Mus musculus
atttttatggcctcccaaagcattc

SEQ ID NO: 291719 - DNA, 25 bp, Mus musculus
atttttatgggcatcggtgttttgt

SEQ ID NO: 291720 - DNA, 25 bp, Mus musculus
atttttatgggcttcggtgttttgt

SEQ ID NO: 291721 - DNA, 25 bp, Mus musculus
atttttatggtacatgccagacatg

SEQ ID NO: 291722 - DNA, 25 bp, Mus musculus
atttttatggtagatgccagacatg

SEQ ID NO: 291723 - DNA, 25 bp, Mus musculus
atttttatgtccacatctggtcttg

SEQ ID NO: 291724 - DNA, 25 bp, Mus musculus
atttttatgtcctcatctggtcttg

SEQ ID NO: 291725 - DNA, 25 bp, Mus musculus
atttttatgtgaccatctgccacct

SEQ ID NO: 291726 - DNA, 25 bp, Mus musculus
atttttatgtgagcatctgccacct

SEQ ID NO: 291727 - DNA, 25 bp, Mus musculus
atttttattaccagttgacaccttg

SEQ ID NO: 291728 - DNA, 25 bp, Mus musculus
atttttattacctgttgacaccttg

SEQ ID NO: 291729 - DNA, 25 bp, Mus musculus
atttttattcacatttcagacatga

SEQ ID NO: 291730 - DNA, 25 bp, Mus musculus
atttttattcacttttcagacatga

SEQ ID NO: 291731 - DNA, 25 bp, Mus musculus
atttttattcagcattagaccacta

SEQ ID NO: 291732 - DNA, 25 bp, Mus musculus
atttttattcaggattagaccacta

SEQ ID NO: 291733 - DNA, 25 bp, Mus musculus
atttttattctacgcacacagtggt

SEQ ID NO: 291734 - DNA, 25 bp, Mus musculus
atttttattctaggcacacagtggt

SEQ ID NO: 291735 - DNA, 25 bp, Mus musculus
atttttcaaagcaaggtctcatgta

SEQ ID NO: 291736 - DNA, 25 bp, Mus musculus
atttttcaaagctaggtctcatgta

SEQ ID NO: 291737 - DNA, 25 bp, Mus musculus
atttttcaacatcctcttgcagcaa

SEQ ID NO: 291738 - DNA, 25 bp, Mus musculus
atttttcaacatgctcttgcagcaa

SEQ ID NO: 291739 - DNA, 25 bp, Mus musculus
atttttcaagacaaccttggggcag

SEQ ID NO: 291740 - DNA, 25 bp, Mus musculus
atttttcaagactaccttggggcag

SEQ ID NO: 291741 - DNA, 25 bp, Mus musculus
atttttcaagtccttgtctccatat

SEQ ID NO: 291742 - DNA, 25 bp, Mus musculus
atttttcaagtcgttgtctccatat

SEQ ID NO: 291743 - DNA, 25 bp, Mus musculus
atttttcaatcaaagctgccccaac

SEQ ID NO: 291744 - DNA, 25 bp, Mus musculus
atttttcaatcatagctgccccaac

SEQ ID NO: 291745 - DNA, 25 bp, Mus musculus
atttttcacacacggttgtactcta

SEQ ID NO: 291746 - DNA, 25 bp, Mus musculus
atttttcacacactgctagcataat

SEQ ID NO: 291747 - DNA, 25 bp, Mus musculus
atttttcacacagggttgtactcta

SEQ ID NO: 291748 - DNA, 25 bp, Mus musculus
atttttcacacagtgctagcataat

SEQ ID NO: 291749 - DNA, 25 bp, Mus musculus
atttttcacaccatcacaggacaaa

SEQ ID NO: 291750 - DNA, 25 bp, Mus musculus
atttttcacaccttcacaggacaaa

SEQ ID NO: 291751 - DNA, 25 bp, Mus musculus
atttttcacaggctgaaccagtcct

SEQ ID NO: 291752 - DNA, 25 bp, Mus musculus
atttttcacagggtgaaccagtcct

SEQ ID NO: 291753 - DNA, 25 bp, Mus musculus
atttttcaccggaggcagacgcagc

SEQ ID NO: 291754 - DNA, 25 bp, Mus musculus
atttttcaccggtggcagacgcagc

SEQ ID NO: 291755 - DNA, 25 bp, Mus musculus
atttttcacctaataattttcagct

SEQ ID NO: 291756 - DNA, 25 bp, Mus musculus
atttttcacctattaattttcagct

SEQ ID NO: 291757 - DNA, 25 bp, Mus musculus
atttttcactgtagctagtctttta

SEQ ID NO: 291758 - DNA, 25 bp, Mus musculus
atttttcactgttgctagtctttta

SEQ ID NO: 291759 - DNA, 25 bp, Mus musculus
atttttcaggcacaaaatccctttg

SEQ ID NO: 291760 - DNA, 25 bp, Mus musculus
atttttcaggcagaaaatccctttg

SEQ ID NO: 291761 - DNA, 25 bp, Mus musculus
atttttcaggttctgctgtgcattt

SEQ ID NO: 291762 - DNA, 25 bp, Mus musculus
atttttcaggttgtgctgtgcattt

SEQ ID NO: 291763 - DNA, 25 bp, Mus musculus
atttttcagtcaaggctgcgctccc

SEQ ID NO: 291764 - DNA, 25 bp, Mus musculus
atttttcagtcatggctgcgctccc

SEQ ID NO: 291765 - DNA, 25 bp, Mus musculus
atttttcagtctctgagagcccgcc

SEQ ID NO: 291766 - DNA, 25 bp, Mus musculus
atttttcagtctgtgagagcccgcc

SEQ ID NO: 291767 - DNA, 25 bp, Mus musculus
atttttcagtgcatggtggcctact

SEQ ID NO: 291768 - DNA, 25 bp, Mus musculus
atttttcagtgcttggtggcctact

SEQ ID NO: 291769 - DNA, 25 bp, Mus musculus
atttttcatgtaatcatttgcagtc

SEQ ID NO: 291770 - DNA, 25 bp, Mus musculus
atttttcatgtattcatttgcagtc

SEQ ID NO: 291771 - DNA, 25 bp, Mus musculus
atttttcatttgctacatggattgt

SEQ ID NO: 291772 - DNA, 25 bp, Mus musculus
atttttcatttggtacatggattgt

SEQ ID NO: 291773 - DNA, 25 bp, Mus musculus
atttttccacaacagggtgattggc

SEQ ID NO: 291774 - DNA, 25 bp, Mus musculus
atttttccacaagagggtgattggc

SEQ ID NO: 291775 - DNA, 25 bp, Mus musculus
atttttccaccccatgtgagcgttc

SEQ ID NO: 291776 - DNA, 25 bp, Mus musculus
atttttccacccgatgtgagcgttc

SEQ ID NO: 291777 - DNA, 25 bp, Mus musculus
atttttccagaaagccttcatcttt

SEQ ID NO: 291778 - DNA, 25 bp, Mus musculus
atttttccagaatgccttcatcttt

SEQ ID NO: 291779 - DNA, 25 bp, Mus musculus
atttttcccagtcaagagttctgcc

SEQ ID NO: 291780 - DNA, 25 bp, Mus musculus
atttttcccagtgaagagttctgcc

SEQ ID NO: 291781 - DNA, 25 bp, Mus musculus
atttttccggtcacacttctaatga

SEQ ID NO: 291782 - DNA, 25 bp, Mus musculus
atttttccggtctcacttctaatga

SEQ ID NO: 291783 - DNA, 25 bp, Mus musculus
atttttcctatgattatgcctattg

SEQ ID NO: 291784 - DNA, 25 bp, Mus musculus
atttttcctatgctttcatgtcatt

SEQ ID NO: 291785 - DNA, 25 bp, Mus musculus
atttttcctatggtttcatgtcatt

SEQ ID NO: 291786 - DNA, 25 bp, Mus musculus
atttttcctatgtttatgcctattg

SEQ ID NO: 291787 - DNA, 25 bp, Mus musculus
atttttcctctgattccaattagca

SEQ ID NO: 291788 - DNA, 25 bp, Mus musculus
atttttcctctgtttccaattagca

SEQ ID NO: 291789 - DNA, 25 bp, Mus musculus
atttttcctcttctcaaatcatgta

SEQ ID NO: 291790 - DNA, 25 bp, Mus musculus
atttttcctcttgtcaaatcatgta

SEQ ID NO: 291791 - DNA, 25 bp, Mus musculus
atttttcctggacgtgatagctctg

SEQ ID NO: 291792 - DNA, 25 bp, Mus musculus
atttttcctggaggtgatagctctg

SEQ ID NO: 291793 - DNA, 25 bp, Mus musculus
atttttccttttctgccactatttg

SEQ ID NO: 291794 - DNA, 25 bp, Mus musculus
atttttccttttgtgccactatttg

SEQ ID NO: 291795 - DNA, 25 bp, Mus musculus
atttttcgccagactttaggactgc

SEQ ID NO: 291796 - DNA, 25 bp, Mus musculus
atttttcgccagtctttaggactgc

SEQ ID NO: 291797 - DNA, 25 bp, Mus musculus
atttttcgtcccaacagtggaatgt

SEQ ID NO: 291798 - DNA, 25 bp, Mus musculus
atttttcgtccctacagtggaatgt

SEQ ID NO: 291799 - DNA, 25 bp, Mus musculus
atttttctagccctgtgtcgtcctt

SEQ ID NO: 291800 - DNA, 25 bp, Mus musculus
atttttctagccgtgtgtcgtcctt

SEQ ID NO: 291801 - DNA, 25 bp, Mus musculus
atttttctaggcagttttcctgcga

SEQ ID NO: 291802 - DNA, 25 bp, Mus musculus
atttttctaggctgttttcctgcga

SEQ ID NO: 291803 - DNA, 25 bp, Mus musculus
atttttctcaaccagcaggatctgg

SEQ ID NO: 291804 - DNA, 25 bp, Mus musculus
atttttctcaacgagcaggatctgg

SEQ ID NO: 291805 - DNA, 25 bp, Mus musculus
atttttctcaataatgcctttctgg

SEQ ID NO: 291806 - DNA, 25 bp, Mus musculus
atttttctcaattatgcctttctgg

SEQ ID NO: 291807 - DNA, 25 bp, Mus musculus
atttttctcagaacctgggacggtc

SEQ ID NO: 291808 - DNA, 25 bp, Mus musculus
atttttctcagatcctgggacggtc

SEQ ID NO: 291809 - DNA, 25 bp, Mus musculus
atttttctcattacacatgttggta

SEQ ID NO: 291810 - DNA, 25 bp, Mus musculus
atttttctcatttcacatgttggta

SEQ ID NO: 291811 - DNA, 25 bp, Mus musculus
atttttctccttcaaagacctctga

SEQ ID NO: 291812 - DNA, 25 bp, Mus musculus
atttttctccttgaaagacctctga

SEQ ID NO: 291813 - DNA, 25 bp, Mus musculus
atttttctctatcaaagtccctctt

SEQ ID NO: 291814 - DNA, 25 bp, Mus musculus
atttttctctatgaaagtccctctt

SEQ ID NO: 291815 - DNA, 25 bp, Mus musculus
atttttctctcaatagttatcacat

SEQ ID NO: 291816 - DNA, 25 bp, Mus musculus
atttttctctcattagttatcacat

SEQ ID NO: 291817 - DNA, 25 bp, Mus musculus
atttttctctctatccattagatac

SEQ ID NO: 291818 - DNA, 25 bp, Mus musculus
atttttctctctttccattagatac

SEQ ID NO: 291819 - DNA, 25 bp, Mus musculus
atttttctctgtctccacctgtgta

SEQ ID NO: 291820 - DNA, 25 bp, Mus musculus
atttttctctgtgtccacctgtgta

SEQ ID NO: 291821 - DNA, 25 bp, Mus musculus
atttttctgatacttcgctgctgtg

SEQ ID NO: 291822 - DNA, 25 bp, Mus musculus
atttttctgatagttcgctgctgtg

SEQ ID NO: 291823 - DNA, 25 bp, Mus musculus
atttttctgatgaccattctgatac

SEQ ID NO: 291824 - DNA, 25 bp, Mus musculus
atttttctgatgagcggtgcctcta

SEQ ID NO: 291825 - DNA, 25 bp, Mus musculus
atttttctgatgtccattctgatac

SEQ ID NO: 291826 - DNA, 25 bp, Mus musculus
atttttctgatgtgcggtgcctcta

SEQ ID NO: 291827 - DNA, 25 bp, Mus musculus
atttttctgattcctattgcccaag

SEQ ID NO: 291828 - DNA, 25 bp, Mus musculus
atttttctgattgctattgcccaag

SEQ ID NO: 291829 - DNA, 25 bp, Mus musculus
atttttctgcatacttccttgcata

SEQ ID NO: 291830 - DNA, 25 bp, Mus musculus
atttttctgcatcacttttggaggg

SEQ ID NO: 291831 - DNA, 25 bp, Mus musculus
atttttctgcatgacttttggaggg

SEQ ID NO: 291832 - DNA, 25 bp, Mus musculus
atttttctgcattcttccttgcata

SEQ ID NO: 291833 - DNA, 25 bp, Mus musculus
atttttctggagcattttatgtgct

SEQ ID NO: 291834 - DNA, 25 bp, Mus musculus
atttttctggaggattttatgtgct

SEQ ID NO: 291835 - DNA, 25 bp, Mus musculus
atttttctggataatacatttgcac

SEQ ID NO: 291836 - DNA, 25 bp, Mus musculus
atttttctggattatacatttgcac

SEQ ID NO: 291837 - DNA, 25 bp, Mus musculus
atttttctgtgccatagtttactca

SEQ ID NO: 291838 - DNA, 25 bp, Mus musculus
atttttctgtgcgatagtttactca

SEQ ID NO: 291839 - DNA, 25 bp, Mus musculus
atttttctgtggcaacgaggtgaat

SEQ ID NO: 291840 - DNA, 25 bp, Mus musculus
atttttctgtgggaacgaggtgaat

SEQ ID NO: 291841 - DNA, 25 bp, Mus musculus
atttttctgtttcctaccgtcacct

SEQ ID NO: 291842 - DNA, 25 bp, Mus musculus
atttttctgtttgctaccgtcacct

SEQ ID NO: 291843 - DNA, 25 bp, Mus musculus
atttttcttcaaaagccttctacag

SEQ ID NO: 291844 - DNA, 25 bp, Mus musculus
atttttcttcaatagccttctacag

SEQ ID NO: 291845 - DNA, 25 bp, Mus musculus
atttttcttcagacaggaatctcat

SEQ ID NO: 291846 - DNA, 25 bp, Mus musculus
atttttcttcagtcaggaatctcat

SEQ ID NO: 291847 - DNA, 25 bp, Mus musculus
atttttcttccaccaatgtgattag

SEQ ID NO: 291848 - DNA, 25 bp, Mus musculus
atttttcttccagcaatgtgattag

SEQ ID NO: 291849 - DNA, 25 bp, Mus musculus
atttttcttccgatgcatctttccc

SEQ ID NO: 291850 - DNA, 25 bp, Mus musculus
atttttcttccgttgcatctttccc

SEQ ID NO: 291851 - DNA, 25 bp, Mus musculus
atttttcttggaaacattgacacgc

SEQ ID NO: 291852 - DNA, 25 bp, Mus musculus
atttttcttggatacattgacacgc

SEQ ID NO: 291853 - DNA, 25 bp, Mus musculus
atttttcttggcatattgctctagc

SEQ ID NO: 291854 - DNA, 25 bp, Mus musculus
atttttcttggcttattgctctagc

SEQ ID NO: 291855 - DNA, 25 bp, Mus musculus
atttttgaaggtctggtactgtgta

SEQ ID NO: 291856 - DNA, 25 bp, Mus musculus
atttttgaaggtgtggtactgtgta

SEQ ID NO: 291857 - DNA, 25 bp, Mus musculus
atttttgaataccattaaaactgct

SEQ ID NO: 291858 - DNA, 25 bp, Mus musculus
atttttgaatacgattaaaactgct

SEQ ID NO: 291859 - DNA, 25 bp, Mus musculus
atttttgacatgagagctgttctgt

SEQ ID NO: 291860 - DNA, 25 bp, Mus musculus
atttttgacatgtgagctgttctgt

SEQ ID NO: 291861 - DNA, 25 bp, Mus musculus
atttttgaggacaccatcagcaccc

SEQ ID NO: 291862 - DNA, 25 bp, Mus musculus
atttttgaggactccatcagcaccc

SEQ ID NO: 291863 - DNA, 25 bp, Mus musculus
atttttgaggctctggcaagactgt

SEQ ID NO: 291864 - DNA, 25 bp, Mus musculus
atttttgaggctgtggcaagactgt

SEQ ID NO: 291865 - DNA, 25 bp, Mus musculus
atttttgagtctcttgctggtgcca

SEQ ID NO: 291866 - DNA, 25 bp, Mus musculus
atttttgagtctgttgctggtgcca

SEQ ID NO: 291867 - DNA, 25 bp, Mus musculus
atttttgagttcagggcctgcctag

SEQ ID NO: 291868 - DNA, 25 bp, Mus musculus
atttttgagttctgggcctgcctag

SEQ ID NO: 291869 - DNA, 25 bp, Mus musculus
atttttgattttagtgtctcacgac

SEQ ID NO: 291870 - DNA, 25 bp, Mus musculus
atttttgatttttgtgtctcacgac

SEQ ID NO: 291871 - DNA, 25 bp, Mus musculus
atttttgcaagactcctttccttcg

SEQ ID NO: 291872 - DNA, 25 bp, Mus musculus
atttttgcaagagtcctttccttcg

SEQ ID NO: 291873 - DNA, 25 bp, Mus musculus
atttttgcaatcatgtacacctgtt

SEQ ID NO: 291874 - DNA, 25 bp, Mus musculus
atttttgcaatcctagccatactga

SEQ ID NO: 291875 - DNA, 25 bp, Mus musculus
atttttgcaatcgtagccatactga

SEQ ID NO: 291876 - DNA, 25 bp, Mus musculus
atttttgcaatcttgtacacctgtt

SEQ ID NO: 291877 - DNA, 25 bp, Mus musculus
atttttgcactaccagggaatcctg

SEQ ID NO: 291878 - DNA, 25 bp, Mus musculus
atttttgcactagcagggaatcctg

SEQ ID NO: 291879 - DNA, 25 bp, Mus musculus
atttttgcagcaatccttgtcatca

SEQ ID NO: 291880 - DNA, 25 bp, Mus musculus
atttttgcagcattccttgtcatca

SEQ ID NO: 291881 - DNA, 25 bp, Mus musculus
atttttgcatctatatttttcccta

SEQ ID NO: 291882 - DNA, 25 bp, Mus musculus
atttttgcatctttatttttcccta

SEQ ID NO: 291883 - DNA, 25 bp, Mus musculus
atttttgcccgtaagaactattcag

SEQ ID NO: 291884 - DNA, 25 bp, Mus musculus
atttttgcccgttagaactattcag

SEQ ID NO: 291885 - DNA, 25 bp, Mus musculus
atttttgcctaacccatgcatcatg

SEQ ID NO: 291886 - DNA, 25 bp, Mus musculus
atttttgcctaagccatgcatcatg

SEQ ID NO: 291887 - DNA, 25 bp, Mus musculus
atttttgccttccatcatgtgttaa

SEQ ID NO: 291888 - DNA, 25 bp, Mus musculus
atttttgccttcgatcatgtgttaa

SEQ ID NO: 291889 - DNA, 25 bp, Mus musculus
atttttgctctcctattaatatgag

SEQ ID NO: 291890 - DNA, 25 bp, Mus musculus
atttttgctctcgtattaatatgag

SEQ ID NO: 291891 - DNA, 25 bp, Mus musculus
atttttgctgctaggtagtaggata

SEQ ID NO: 291892 - DNA, 25 bp, Mus musculus
atttttgctgcttggtagtaggata

SEQ ID NO: 291893 - DNA, 25 bp, Mus musculus
atttttgctgtgacctaatgtttca

SEQ ID NO: 291894 - DNA, 25 bp, Mus musculus
atttttgctgtgtcctaatgtttca

SEQ ID NO: 291895 - DNA, 25 bp, Mus musculus
atttttgctttaagctctctggcag

SEQ ID NO: 291896 - DNA, 25 bp, Mus musculus
atttttgctttatgctctctggcag

SEQ ID NO: 291897 - DNA, 25 bp, Mus musculus
atttttggaattctgtacctgccta

SEQ ID NO: 291898 - DNA, 25 bp, Mus musculus
atttttggaattgtgtacctgccta

SEQ ID NO: 291899 - DNA, 25 bp, Mus musculus
atttttggacagaagctaatgggtc

SEQ ID NO: 291900 - DNA, 25 bp, Mus musculus
atttttggacagtagctaatgggtc

SEQ ID NO: 291901 - DNA, 25 bp, Mus musculus
atttttggatctactgtccttcagc

SEQ ID NO: 291902 - DNA, 25 bp, Mus musculus
atttttggatcttctgtccttcagc

SEQ ID NO: 291903 - DNA, 25 bp, Mus musculus
atttttggcaagatctgtcattttc

SEQ ID NO: 291904 - DNA, 25 bp, Mus musculus
atttttggcaagttctgtcattttc

SEQ ID NO: 291905 - DNA, 25 bp, Mus musculus
atttttggcacaatttttactgagc

SEQ ID NO: 291906 - DNA, 25 bp, Mus musculus
atttttggcacattttttactgagc

SEQ ID NO: 291907 - DNA, 25 bp, Mus musculus
atttttggctagattccacaggagg

SEQ ID NO: 291908 - DNA, 25 bp, Mus musculus
atttttggctagtttccacaggagg

SEQ ID NO: 291909 - DNA, 25 bp, Mus musculus
atttttggggccctcacacctgcac

SEQ ID NO: 291910 - DNA, 25 bp, Mus musculus
atttttggggccgtcacacctgcac

SEQ ID NO: 291911 - DNA, 25 bp, Mus musculus
atttttggtcacatgggtggtcacc

SEQ ID NO: 291912 - DNA, 25 bp, Mus musculus
atttttggtcacttgggtggtcacc

SEQ ID NO: 291913 - DNA, 25 bp, Mus musculus
atttttggtccccgaggcagcctgg

SEQ ID NO: 291914 - DNA, 25 bp, Mus musculus
atttttggtcccggaggcagcctgg

SEQ ID NO: 291915 - DNA, 25 bp, Mus musculus
atttttgtaaaaatgctcgtgccta

SEQ ID NO: 291916 - DNA, 25 bp, Mus musculus
atttttgtaaaattgctcgtgccta

SEQ ID NO: 291917 - DNA, 25 bp, Mus musculus
atttttgtaccacattagaatgcat

SEQ ID NO: 291918 - DNA, 25 bp, Mus musculus
atttttgtaccagattagaatgcat

SEQ ID NO: 291919 - DNA, 25 bp, Mus musculus
atttttgtagaacagactccagcct

SEQ ID NO: 291920 - DNA, 25 bp, Mus musculus
atttttgtagaagagactccagcct

SEQ ID NO: 291921 - DNA, 25 bp, Mus musculus
atttttgtagttaacagaacactgt

SEQ ID NO: 291922 - DNA, 25 bp, Mus musculus
atttttgtagtttacagaacactgt

SEQ ID NO: 291923 - DNA, 25 bp, Mus musculus
atttttgtcagtcacgtttctgtgt

SEQ ID NO: 291924 - DNA, 25 bp, Mus musculus
atttttgtcagtgacgtttctgtgt

SEQ ID NO: 291925 - DNA, 25 bp, Mus musculus
atttttgtcctacttaactacacat

SEQ ID NO: 291926 - DNA, 25 bp, Mus musculus
atttttgtcctagttaactacacat

SEQ ID NO: 291927 - DNA, 25 bp, Mus musculus
atttttgtcctgatgctcacattca

SEQ ID NO: 291928 - DNA, 25 bp, Mus musculus
atttttgtcctgttgctcacattca

SEQ ID NO: 291929 - DNA, 25 bp, Mus musculus
atttttgtctgaaatcgtgatacca

SEQ ID NO: 291930 - DNA, 25 bp, Mus musculus
atttttgtctgatatcgtgatacca

SEQ ID NO: 291931 - DNA, 25 bp, Mus musculus
atttttgtctgtcctgggatggcag

SEQ ID NO: 291932 - DNA, 25 bp, Mus musculus
atttttgtctgtgctgggatggcag

SEQ ID NO: 291933 - DNA, 25 bp, Mus musculus
atttttgtcttaattccatcatcta

SEQ ID NO: 291934 - DNA, 25 bp, Mus musculus
atttttgtcttatttccatcatcta

SEQ ID NO: 291935 - DNA, 25 bp, Mus musculus
atttttgtgactctgtgactggctt

SEQ ID NO: 291936 - DNA, 25 bp, Mus musculus
atttttgtgactgtgtgactggctt

SEQ ID NO: 291937 - DNA, 25 bp, Mus musculus
atttttgtgattccgcttgtgattc

SEQ ID NO: 291938 - DNA, 25 bp, Mus musculus
atttttgtgattgcgcttgtgattc

SEQ ID NO: 291939 - DNA, 25 bp, Mus musculus
atttttgtgctacctagtctcttct

SEQ ID NO: 291940 - DNA, 25 bp, Mus musculus
atttttgtgctagctagtctcttct

SEQ ID NO: 291941 - DNA, 25 bp, Mus musculus
atttttgtggctaactcttgtgggc

SEQ ID NO: 291942 - DNA, 25 bp, Mus musculus
atttttgtggctctgtgggacccca

SEQ ID NO: 291943 - DNA, 25 bp, Mus musculus
atttttgtggctgtgtgggacccca

SEQ ID NO: 291944 - DNA, 25 bp, Mus musculus
atttttgtggcttactcttgtgggc

SEQ ID NO: 291945 - DNA, 25 bp, Mus musculus
atttttgtgggaatgggccctgctt

SEQ ID NO: 291946 - DNA, 25 bp, Mus musculus
atttttgtgggattgggccctgctt

SEQ ID NO: 291947 - DNA, 25 bp, Mus musculus
atttttgtgggtctcaactgcagca

SEQ ID NO: 291948 - DNA, 25 bp, Mus musculus
atttttgtgggtgtcaactgcagca

SEQ ID NO: 291949 - DNA, 25 bp, Mus musculus
atttttgtgtttcgcacgggaagca

SEQ ID NO: 291950 - DNA, 25 bp, Mus musculus
atttttgtgtttggcacgggaagca

SEQ ID NO: 291951 - DNA, 25 bp, Mus musculus
atttttgtttggacatgactcgata

SEQ ID NO: 291952 - DNA, 25 bp, Mus musculus
atttttgtttggtcatgactcgata

SEQ ID NO: 291953 - DNA, 25 bp, Mus musculus
atttttgttttgatggacccactgg

SEQ ID NO: 291954 - DNA, 25 bp, Mus musculus
atttttgttttgctgctcactgacc

SEQ ID NO: 291955 - DNA, 25 bp, Mus musculus
atttttgttttggtgctcactgacc

SEQ ID NO: 291956 - DNA, 25 bp, Mus musculus
atttttgttttgttggacccactgg

SEQ ID NO: 291957 - DNA, 25 bp, Mus musculus
attttttaataccagctccatcgga

SEQ ID NO: 291958 - DNA, 25 bp, Mus musculus
attttttaatacgagctccatcgga

SEQ ID NO: 291959 - DNA, 25 bp, Mus musculus
attttttaatgtatcaccctatcca

SEQ ID NO: 291960 - DNA, 25 bp, Mus musculus
attttttaatgtttcaccctatcca

SEQ ID NO: 291961 - DNA, 25 bp, Mus musculus
attttttacatcctactaacagtag

SEQ ID NO: 291962 - DNA, 25 bp, Mus musculus
attttttacatcgtactaacagtag

SEQ ID NO: 291963 - DNA, 25 bp, Mus musculus
attttttacctgaagagacatgaaa

SEQ ID NO: 291964 - DNA, 25 bp, Mus musculus
attttttacctgtagagacatgaaa

SEQ ID NO: 291965 - DNA, 25 bp, Mus musculus
attttttatatcacactcccttcag

SEQ ID NO: 291966 - DNA, 25 bp, Mus musculus
attttttatatctcactcccttcag

SEQ ID NO: 291967 - DNA, 25 bp, Mus musculus
attttttatctaaaggattgtgact

SEQ ID NO: 291968 - DNA, 25 bp, Mus musculus
attttttatctataggattgtgact

SEQ ID NO: 291969 - DNA, 25 bp, Mus musculus
attttttatgcgatttgaggttgag

SEQ ID NO: 291970 - DNA, 25 bp, Mus musculus
attttttatgcgttttgaggttgag

SEQ ID NO: 291971 - DNA, 25 bp, Mus musculus
attttttattccatctctggcaatt

SEQ ID NO: 291972 - DNA, 25 bp, Mus musculus
attttttattccctacacactctca

SEQ ID NO: 291973 - DNA, 25 bp, Mus musculus
attttttattccgtacacactctca

SEQ ID NO: 291974 - DNA, 25 bp, Mus musculus
attttttattccttctctggcaatt

SEQ ID NO: 291975 - DNA, 25 bp, Mus musculus
attttttcactgaaggagacttcca

SEQ ID NO: 291976 - DNA, 25 bp, Mus musculus
attttttcactgtaggagacttcca

SEQ ID NO: 291977 - DNA, 25 bp, Mus musculus
attttttcatgaatgctcgctctgt

SEQ ID NO: 291978 - DNA, 25 bp, Mus musculus
attttttcatgattgctcgctctgt

SEQ ID NO: 291979 - DNA, 25 bp, Mus musculus
attttttccaaaccatccatattta

SEQ ID NO: 291980 - DNA, 25 bp, Mus musculus
attttttccaaagcatccatattta

SEQ ID NO: 291981 - DNA, 25 bp, Mus musculus
attttttccagacacaatcataggc

SEQ ID NO: 291982 - DNA, 25 bp, Mus musculus
attttttccagagacaatcataggc

SEQ ID NO: 291983 - DNA, 25 bp, Mus musculus
attttttccccaagactaccagatg

SEQ ID NO: 291984 - DNA, 25 bp, Mus musculus
attttttccccatgactaccagatg

SEQ ID NO: 291985 - DNA, 25 bp, Mus musculus
attttttccctgatcattatgcttt

SEQ ID NO: 291986 - DNA, 25 bp, Mus musculus
attttttccctgcatcctgagaaga

SEQ ID NO: 291987 - DNA, 25 bp, Mus musculus
attttttccctggatcctgagaaga

SEQ ID NO: 291988 - DNA, 25 bp, Mus musculus
attttttccctgttcattatgcttt

SEQ ID NO: 291989 - DNA, 25 bp, Mus musculus
attttttcctatagctctgtcttcc

SEQ ID NO: 291990 - DNA, 25 bp, Mus musculus
attttttcctattgctctgtcttcc

SEQ ID NO: 291991 - DNA, 25 bp, Mus musculus
attttttccttccaagcgacagatg

SEQ ID NO: 291992 - DNA, 25 bp, Mus musculus
attttttccttcgaagcgacagatg

SEQ ID NO: 291993 - DNA, 25 bp, Mus musculus
attttttccttgagagatgtattgt

SEQ ID NO: 291994 - DNA, 25 bp, Mus musculus
attttttccttgatctctatgtatc

SEQ ID NO: 291995 - DNA, 25 bp, Mus musculus
attttttccttgtgagatgtattgt

SEQ ID NO: 291996 - DNA, 25 bp, Mus musculus
attttttccttgttctctatgtatc

SEQ ID NO: 291997 - DNA, 25 bp, Mus musculus
attttttcgaaaactcacacttgac

SEQ ID NO: 291998 - DNA, 25 bp, Mus musculus
attttttcgaaatctcacacttgac

SEQ ID NO: 291999 - DNA, 25 bp, Mus musculus
attttttcttagctcatggctgtca

SEQ ID NO: 292000 - DNA, 25 bp, Mus musculus
attttttcttaggtcatggctgtca

SEQ ID NO: 292001 - DNA, 25 bp, Mus musculus
attttttcttcccatgattcacaaa

SEQ ID NO: 292002 - DNA, 25 bp, Mus musculus
attttttcttccgatgattcacaaa

SEQ ID NO: 292003 - DNA, 25 bp, Mus musculus
attttttgaagaccctctaggcatt

SEQ ID NO: 292004 - DNA, 25 bp, Mus musculus
attttttgaagagcctctaggcatt

SEQ ID NO: 292005 - DNA, 25 bp, Mus musculus
attttttgatgacgaccccatgtgc

SEQ ID NO: 292006 - DNA, 25 bp, Mus musculus
attttttgatgaggaccccatgtgc

SEQ ID NO: 292007 - DNA, 25 bp, Mus musculus
attttttgcctaagaactcctccct

SEQ ID NO: 292008 - DNA, 25 bp, Mus musculus
attttttgcctatgaactcctccct

SEQ ID NO: 292009 - DNA, 25 bp, Mus musculus
attttttgcctcattctgtttatca

SEQ ID NO: 292010 - DNA, 25 bp, Mus musculus
attttttgcctctttctgtttatca

SEQ ID NO: 292011 - DNA, 25 bp, Mus musculus
attttttggtatcccggctgtgctc

SEQ ID NO: 292012 - DNA, 25 bp, Mus musculus
attttttggtatgccggctgtgctc

SEQ ID NO: 292013 - DNA, 25 bp, Mus musculus
attttttgtacacctcaggaatcca

SEQ ID NO: 292014 - DNA, 25 bp, Mus musculus
attttttgtacagctcaggaatcca

SEQ ID NO: 292015 - DNA, 25 bp, Mus musculus
attttttgtattccatagttcctga

SEQ ID NO: 292016 - DNA, 25 bp, Mus musculus
attttttgtattgcatagttcctga

SEQ ID NO: 292017 - DNA, 25 bp, Mus musculus
attttttgtcttctgtcagataact

SEQ ID NO: 292018 - DNA, 25 bp, Mus musculus
attttttgtcttgtgtcagataact

SEQ ID NO: 292019 - DNA, 25 bp, Mus musculus
attttttgtggcagtatttgattga

SEQ ID NO: 292020 - DNA, 25 bp, Mus musculus
attttttgtggctgtatttgattga

SEQ ID NO: 292021 - DNA, 25 bp, Mus musculus
attttttgttacaagctagcttcac

SEQ ID NO: 292022 - DNA, 25 bp, Mus musculus
attttttgttactagctagcttcac

SEQ ID NO: 292023 - DNA, 25 bp, Mus musculus
attttttttttgacagcgcggatgg

SEQ ID NO: 292024 - DNA, 25 bp, Mus musculus
attttttttttgtcagcgcggatgg

SEQ ID NO: 292025 - DNA, 25 bp, Mus musculus
caaaaaaattgcattgggctggtga

SEQ ID NO: 292026 - DNA, 25 bp, Mus musculus
caaaaaaattgctttgggctggtga

SEQ ID NO: 292027 - DNA, 25 bp, Mus musculus
caaaaaacaacaccgcagacagaca

SEQ ID NO: 292028 - DNA, 25 bp, Mus musculus
caaaaaacaacagcgcagacagaca

SEQ ID NO: 292029 - DNA, 25 bp, Mus musculus
caaaaaacatgcacattctgtgaat

SEQ ID NO: 292030 - DNA, 25 bp, Mus musculus
caaaaaacatgctcattctgtgaat

SEQ ID NO: 292031 - DNA, 25 bp, Mus musculus
caaaaaacctgccattcaggttgct

SEQ ID NO: 292032 - DNA, 25 bp, Mus musculus
caaaaaacctgcgattcaggttgct

SEQ ID NO: 292033 - DNA, 25 bp, Mus musculus
caaaaaacggatcccgggcaatgct

SEQ ID NO: 292034 - DNA, 25 bp, Mus musculus
caaaaaacggatgccgggcaatgct

SEQ ID NO: 292035 - DNA, 25 bp, Mus musculus
caaaaaactctcctttgagggcctg

SEQ ID NO: 292036 - DNA, 25 bp, Mus musculus
caaaaaactctcgtttgagggcctg

SEQ ID NO: 292037 - DNA, 25 bp, Mus musculus
caaaaaatcagtcagccctgccgtg

SEQ ID NO: 292038 - DNA, 25 bp, Mus musculus
caaaaaatcagtgagccctgccgtg

SEQ ID NO: 292039 - DNA, 25 bp, Mus musculus
caaaaaatccggctatgctggcggg

SEQ ID NO: 292040 - DNA, 25 bp, Mus musculus
caaaaaatccgggtatgctggcggg

SEQ ID NO: 292041 - DNA, 25 bp, Mus musculus
caaaaaattactctgtttgtactct

SEQ ID NO: 292042 - DNA, 25 bp, Mus musculus
caaaaaattactgtgtttgtactct

SEQ ID NO: 292043 - DNA, 25 bp, Mus musculus
caaaaacaacggacactctccaatt

SEQ ID NO: 292044 - DNA, 25 bp, Mus musculus
caaaaacaacggtcactctccaatt

SEQ ID NO: 292045 - DNA, 25 bp, Mus musculus
caaaaacaagttcgcatctttcagt

SEQ ID NO: 292046 - DNA, 25 bp, Mus musculus
caaaaacaagttggcatctttcagt

SEQ ID NO: 292047 - DNA, 25 bp, Mus musculus
caaaaacacacgaaagagcccaagg

SEQ ID NO: 292048 - DNA, 25 bp, Mus musculus
caaaaacacacgtaagagcccaagg

SEQ ID NO: 292049 - DNA, 25 bp, Mus musculus
caaaaacagcagatccctgggagct

SEQ ID NO: 292050 - DNA, 25 bp, Mus musculus
caaaaacagcagttccctgggagct

SEQ ID NO: 292051 - DNA, 25 bp, Mus musculus
caaaaacagggtagtcaggccgtag

SEQ ID NO: 292052 - DNA, 25 bp, Mus musculus
caaaaacagggttgtcaggccgtag

SEQ ID NO: 292053 - DNA, 25 bp, Mus musculus
caaaaaccatgtatgcccaagtgga

SEQ ID NO: 292054 - DNA, 25 bp, Mus musculus
caaaaaccatgtttgcccaagtgga

SEQ ID NO: 292055 - DNA, 25 bp, Mus musculus
caaaaacctccaaaagtctcattag

SEQ ID NO: 292056 - DNA, 25 bp, Mus musculus
caaaaacctccataagtctcattag

SEQ ID NO: 292057 - DNA, 25 bp, Mus musculus
caaaaacctctgaagattaaccaca

SEQ ID NO: 292058 - DNA, 25 bp, Mus musculus
caaaaacctctgtagattaaccaca

SEQ ID NO: 292059 - DNA, 25 bp, Mus musculus
caaaaacctttcatagtgctggact

SEQ ID NO: 292060 - DNA, 25 bp, Mus musculus
caaaaacctttcttagtgctggact

SEQ ID NO: 292061 - DNA, 25 bp, Mus musculus
caaaaacgctgaaggctacattgac

SEQ ID NO: 292062 - DNA, 25 bp, Mus musculus
caaaaacgctgatggctacattgac

SEQ ID NO: 292063 - DNA, 25 bp, Mus musculus
caaaaactgtttccggtgtgccaag

SEQ ID NO: 292064 - DNA, 25 bp, Mus musculus
caaaaactgtttgcggtgtgccaag

SEQ ID NO: 292065 - DNA, 25 bp, Mus musculus
caaaaacttgacaccatccttagaa

SEQ ID NO: 292066 - DNA, 25 bp, Mus musculus
caaaaacttgactccatccttagaa

SEQ ID NO: 292067 - DNA, 25 bp, Mus musculus
caaaaacttggtatctgcaggatgt

SEQ ID NO: 292068 - DNA, 25 bp, Mus musculus
caaaaacttggtttctgcaggatgt

SEQ ID NO: 292069 - DNA, 25 bp, Mus musculus
caaaaacttgttcgcctccatgggt

SEQ ID NO: 292070 - DNA, 25 bp, Mus musculus
caaaaacttgttggcctccatgggt

SEQ ID NO: 292071 - DNA, 25 bp, Mus musculus
caaaaagaccccacataactgcaaa

SEQ ID NO: 292072 - DNA, 25 bp, Mus musculus
caaaaagacccctcataactgcaaa

SEQ ID NO: 292073 - DNA, 25 bp, Mus musculus
caaaaagagcttcgtgttccgtgaa

SEQ ID NO: 292074 - DNA, 25 bp, Mus musculus
caaaaagagcttggtgttccgtgaa

SEQ ID NO: 292075 - DNA, 25 bp, Mus musculus
caaaaagatggacttttcagaatcc

SEQ ID NO: 292076 - DNA, 25 bp, Mus musculus
caaaaagatggagttttcagaatcc

SEQ ID NO: 292077 - DNA, 25 bp, Mus musculus
caaaaagctactctcgtccgaggag

SEQ ID NO: 292078 - DNA, 25 bp, Mus musculus
caaaaagctactgtcgtccgaggag

SEQ ID NO: 292079 - DNA, 25 bp, Mus musculus
caaaaagctatccactatatgttaa

SEQ ID NO: 292080 - DNA, 25 bp, Mus musculus
caaaaagctatcgactatatgttaa

SEQ ID NO: 292081 - DNA, 25 bp, Mus musculus
caaaaagctgagagcttaaggcagg

SEQ ID NO: 292082 - DNA, 25 bp, Mus musculus
caaaaagctgagtgcttaaggcagg

SEQ ID NO: 292083 - DNA, 25 bp, Mus musculus
caaaaagctgcaattctgtcccaaa

SEQ ID NO: 292084 - DNA, 25 bp, Mus musculus
caaaaagctgcatttctgtcccaaa

SEQ ID NO: 292085 - DNA, 25 bp, Mus musculus
caaaaagcttggagagaagagattt

SEQ ID NO: 292086 - DNA, 25 bp, Mus musculus
caaaaagcttggtgagaagagattt

SEQ ID NO: 292087 - DNA, 25 bp, Mus musculus
caaaaaggaaccaggatacattcgg

SEQ ID NO: 292088 - DNA, 25 bp, Mus musculus
caaaaaggaacctggatacattcgg

SEQ ID NO: 292089 - DNA, 25 bp, Mus musculus
caaaaaggaggcaccacccatggag

SEQ ID NO: 292090 - DNA, 25 bp, Mus musculus
caaaaaggaggcagagcagggctca

SEQ ID NO: 292091 - DNA, 25 bp, Mus musculus
caaaaaggaggctccacccatggag

SEQ ID NO: 292092 - DNA, 25 bp, Mus musculus
caaaaaggaggctgagcagggctca

SEQ ID NO: 292093 - DNA, 25 bp, Mus musculus
caaaaaggccatagaacttctgatg

SEQ ID NO: 292094 - DNA, 25 bp, Mus musculus
caaaaaggccattgaacttctgatg

SEQ ID NO: 292095 - DNA, 25 bp, Mus musculus
caaaaagggcgaaggaagctgcaga

SEQ ID NO: 292096 - DNA, 25 bp, Mus musculus
caaaaagggcgatggaagctgcaga

SEQ ID NO: 292097 - DNA, 25 bp, Mus musculus
caaaaagtatcacccatgcccacag

SEQ ID NO: 292098 - DNA, 25 bp, Mus musculus
caaaaagtatcagccatgcccacag

SEQ ID NO: 292099 - DNA, 25 bp, Mus musculus
caaaaagttgtcagtggtaagtcac

SEQ ID NO: 292100 - DNA, 25 bp, Mus musculus
caaaaagttgtctgtggtaagtcac

SEQ ID NO: 292101 - DNA, 25 bp, Mus musculus
caaaaagtttccctgggagccagct

SEQ ID NO: 292102 - DNA, 25 bp, Mus musculus
caaaaagtttccgtgggagccagct

SEQ ID NO: 292103 - DNA, 25 bp, Mus musculus
caaaaataattcctgctgtgagtaa

SEQ ID NO: 292104 - DNA, 25 bp, Mus musculus
caaaaataattcgtgctgtgagtaa

SEQ ID NO: 292105 - DNA, 25 bp, Mus musculus
caaaaatacccactaacctgatcac

SEQ ID NO: 292106 - DNA, 25 bp, Mus musculus
caaaaatacccagtaacctgatcac

SEQ ID NO: 292107 - DNA, 25 bp, Mus musculus
caaaaatatataatgccgggctggt

SEQ ID NO: 292108 - DNA, 25 bp, Mus musculus
caaaaatatatattgccgggctggt

SEQ ID NO: 292109 - DNA, 25 bp, Mus musculus
caaaaatcaataacacgacgtggaa

SEQ ID NO: 292110 - DNA, 25 bp, Mus musculus
caaaaatcaatatcacgacgtggaa

SEQ ID NO: 292111 - DNA, 25 bp, Mus musculus
caaaaatctgatcccctggtctgga

SEQ ID NO: 292112 - DNA, 25 bp, Mus musculus
caaaaatctgatgccctggtctgga

SEQ ID NO: 292113 - DNA, 25 bp, Mus musculus
caaaaatgccagctttcctgtgcct

SEQ ID NO: 292114 - DNA, 25 bp, Mus musculus
caaaaatgccaggtttcctgtgcct

SEQ ID NO: 292115 - DNA, 25 bp, Mus musculus
caaaaatgcctcaaatctaccttcc

SEQ ID NO: 292116 - DNA, 25 bp, Mus musculus
caaaaatgcctctaatctaccttcc

SEQ ID NO: 292117 - DNA, 25 bp, Mus musculus
caaaaatgcgaaccctggcccagaa

SEQ ID NO: 292118 - DNA, 25 bp, Mus musculus
caaaaatgcgaagcctggcccagaa

SEQ ID NO: 292119 - DNA, 25 bp, Mus musculus
caaaaatggagacctggccgggcat

SEQ ID NO: 292120 - DNA, 25 bp, Mus musculus
caaaaatggagagctggccgggcat

SEQ ID NO: 292121 - DNA, 25 bp, Mus musculus
caaaaatgtactactgccccatgaa

SEQ ID NO: 292122 - DNA, 25 bp, Mus musculus
caaaaatgtacttctgccccatgaa

SEQ ID NO: 292123 - DNA, 25 bp, Mus musculus
caaaaattatggctagtcttctaaa

SEQ ID NO: 292124 - DNA, 25 bp, Mus musculus
caaaaattatgggtagtcttctaaa

SEQ ID NO: 292125 - DNA, 25 bp, Mus musculus
caaaaatttcatccagagcgtccga

SEQ ID NO: 292126 - DNA, 25 bp, Mus musculus
caaaaatttcatgcagagcgtccga

SEQ ID NO: 292127 - DNA, 25 bp, Mus musculus
caaaaatttcctatgtgtccaggag

SEQ ID NO: 292128 - DNA, 25 bp, Mus musculus
caaaaatttcctttgtgtccaggag

SEQ ID NO: 292129 - DNA, 25 bp, Mus musculus
caaaaatttcttccctaaagatgag

SEQ ID NO: 292130 - DNA, 25 bp, Mus musculus
caaaaatttcttgcctaaagatgag

SEQ ID NO: 292131 - DNA, 25 bp, Mus musculus
caaaacaaactgaagcagctcaggg

SEQ ID NO: 292132 - DNA, 25 bp, Mus musculus
caaaacaaactgtagcagctcaggg

SEQ ID NO: 292133 - DNA, 25 bp, Mus musculus
caaaacaactcaaggcctccaagta

SEQ ID NO: 292134 - DNA, 25 bp, Mus musculus
caaaacaactcatggcctccaagta

SEQ ID NO: 292135 - DNA, 25 bp, Mus musculus
caaaacaagaccatttctcttccca

SEQ ID NO: 292136 - DNA, 25 bp, Mus musculus
caaaacaagaccttttctcttccca

SEQ ID NO: 292137 - DNA, 25 bp, Mus musculus
caaaacaagtccacttctatgtgct

SEQ ID NO: 292138 - DNA, 25 bp, Mus musculus
caaaacaagtcctcttctatgtgct

SEQ ID NO: 292139 - DNA, 25 bp, Mus musculus
caaaacaatgtgctggcaagctctt

SEQ ID NO: 292140 - DNA, 25 bp, Mus musculus
caaaacaatgtggtggcaagctctt

SEQ ID NO: 292141 - DNA, 25 bp, Mus musculus
caaaacacaaagagaagccccacag

SEQ ID NO: 292142 - DNA, 25 bp, Mus musculus
caaaacacaaagtgaagccccacag

SEQ ID NO: 292143 - DNA, 25 bp, Mus musculus
caaaacacatcaataagctgggtat

SEQ ID NO: 292144 - DNA, 25 bp, Mus musculus
caaaacacatcattaagctgggtat

SEQ ID NO: 292145 - DNA, 25 bp, Mus musculus
caaaacaccagtaaggaccacctat

SEQ ID NO: 292146 - DNA, 25 bp, Mus musculus
caaaacaccagttaggaccacctat

SEQ ID NO: 292147 - DNA, 25 bp, Mus musculus
caaaacaccatcatgaaacctgata

SEQ ID NO: 292148 - DNA, 25 bp, Mus musculus
caaaacaccatcttgaaacctgata

SEQ ID NO: 292149 - DNA, 25 bp, Mus musculus
caaaacaccggaatgtcttcctcgc

SEQ ID NO: 292150 - DNA, 25 bp, Mus musculus
caaaacaccggattgtcttcctcgc

SEQ ID NO: 292151 - DNA, 25 bp, Mus musculus
caaaacacttgtcctacccttaggt

SEQ ID NO: 292152 - DNA, 25 bp, Mus musculus
caaaacacttgtgctacccttaggt

SEQ ID NO: 292153 - DNA, 25 bp, Mus musculus
caaaacagaagactctacattgtca

SEQ ID NO: 292154 - DNA, 25 bp, Mus musculus
caaaacagaagagtctacattgtca

SEQ ID NO: 292155 - DNA, 25 bp, Mus musculus
caaaacagaggcagacggccgggta

SEQ ID NO: 292156 - DNA, 25 bp, Mus musculus
caaaacagaggctgacggccgggta

SEQ ID NO: 292157 - DNA, 25 bp, Mus musculus
caaaacagatgtagcaaactatagc

SEQ ID NO: 292158 - DNA, 25 bp, Mus musculus
caaaacagatgttgcaaactatagc

SEQ ID NO: 292159 - DNA, 25 bp, Mus musculus
caaaacagccgaccttgactgggaa

SEQ ID NO: 292160 - DNA, 25 bp, Mus musculus
caaaacagccgagcttgactgggaa

SEQ ID NO: 292161 - DNA, 25 bp, Mus musculus
caaaacagctttacttctttaatat

SEQ ID NO: 292162 - DNA, 25 bp, Mus musculus
caaaacagcttttcttctttaatat

SEQ ID NO: 292163 - DNA, 25 bp, Mus musculus
caaaacaggtttcccggtgacacat

SEQ ID NO: 292164 - DNA, 25 bp, Mus musculus
caaaacaggtttgccggtgacacat

SEQ ID NO: 292165 - DNA, 25 bp, Mus musculus
caaaacagtatacggcacagcctct

SEQ ID NO: 292166 - DNA, 25 bp, Mus musculus
caaaacagtatagggcacagcctct

SEQ ID NO: 292167 - DNA, 25 bp, Mus musculus
caaaacagtgtcaagcgtcagcctt

SEQ ID NO: 292168 - DNA, 25 bp, Mus musculus
caaaacagtgtctagcgtcagcctt

SEQ ID NO: 292169 - DNA, 25 bp, Mus musculus
caaaacagtttaaacccaggcatgg

SEQ ID NO: 292170 - DNA, 25 bp, Mus musculus
caaaacagtttatacccaggcatgg

SEQ ID NO: 292171 - DNA, 25 bp, Mus musculus
caaaacatacatctgcaggcacaca

SEQ ID NO: 292172 - DNA, 25 bp, Mus musculus
caaaacatacatgtgcaggcacaca

SEQ ID NO: 292173 - DNA, 25 bp, Mus musculus
caaaacatacttactcctgggacga

SEQ ID NO: 292174 - DNA, 25 bp, Mus musculus
caaaacatactttctcctgggacga

SEQ ID NO: 292175 - DNA, 25 bp, Mus musculus
caaaacatagatattgcttgtacat

SEQ ID NO: 292176 - DNA, 25 bp, Mus musculus
caaaacatagattttgcttgtacat

SEQ ID NO: 292177 - DNA, 25 bp, Mus musculus
caaaacattcaacggctggcgagat

SEQ ID NO: 292178 - DNA, 25 bp, Mus musculus
caaaacattcaagggctggcgagat

SEQ ID NO: 292179 - DNA, 25 bp, Mus musculus
caaaacattgtccagaagatcactt

SEQ ID NO: 292180 - DNA, 25 bp, Mus musculus
caaaacattgtcgagaagatcactt

SEQ ID NO: 292181 - DNA, 25 bp, Mus musculus
caaaaccaacggcatatacttcttt

SEQ ID NO: 292182 - DNA, 25 bp, Mus musculus
caaaaccaacgggatatacttcttt

SEQ ID NO: 292183 - DNA, 25 bp, Mus musculus
caaaaccactgtacaccgtgctttt

SEQ ID NO: 292184 - DNA, 25 bp, Mus musculus
caaaaccactgttcaccgtgctttt

SEQ ID NO: 292185 - DNA, 25 bp, Mus musculus
caaaaccagaatcggcagcactcta

SEQ ID NO: 292186 - DNA, 25 bp, Mus musculus
caaaaccagaatgggcagcactcta

SEQ ID NO: 292187 - DNA, 25 bp, Mus musculus
caaaaccagtccagtacttcagaga

SEQ ID NO: 292188 - DNA, 25 bp, Mus musculus
caaaaccagtcctgtacttcagaga

SEQ ID NO: 292189 - DNA, 25 bp, Mus musculus
caaaaccagtgtcgccagactccga

SEQ ID NO: 292190 - DNA, 25 bp, Mus musculus
caaaaccagtgtggccagactccga

SEQ ID NO: 292191 - DNA, 25 bp, Mus musculus
caaaaccagttgctaggaccagagg

SEQ ID NO: 292192 - DNA, 25 bp, Mus musculus
caaaaccagttggtaggaccagagg

SEQ ID NO: 292193 - DNA, 25 bp, Mus musculus
caaaaccatgccagtgtacttctga

SEQ ID NO: 292194 - DNA, 25 bp, Mus musculus
caaaaccatgcctgtgtacttctga

SEQ ID NO: 292195 - DNA, 25 bp, Mus musculus
caaaaccattttctattacctgatt

SEQ ID NO: 292196 - DNA, 25 bp, Mus musculus
caaaaccattttgtattacctgatt

SEQ ID NO: 292197 - DNA, 25 bp, Mus musculus
caaaacccaatgagtcatcctgcac

SEQ ID NO: 292198 - DNA, 25 bp, Mus musculus
caaaacccaatgtgtcatcctgcac

SEQ ID NO: 292199 - DNA, 25 bp, Mus musculus
caaaacccatcgagggcaccttagg

SEQ ID NO: 292200 - DNA, 25 bp, Mus musculus
caaaacccatcgtgggcaccttagg

SEQ ID NO: 292201 - DNA, 25 bp, Mus musculus
caaaaccccacaatgtcacaaaact

SEQ ID NO: 292202 - DNA, 25 bp, Mus musculus
caaaaccccacattgtcacaaaact

SEQ ID NO: 292203 - DNA, 25 bp, Mus musculus
caaaacccgatgactacaagagccc

SEQ ID NO: 292204 - DNA, 25 bp, Mus musculus
caaaacccgatgtctacaagagccc

SEQ ID NO: 292205 - DNA, 25 bp, Mus musculus
caaaaccctacgactttgtgcttgt

SEQ ID NO: 292206 - DNA, 25 bp, Mus musculus
caaaaccctacgtctttgtgcttgt

SEQ ID NO: 292207 - DNA, 25 bp, Mus musculus
caaaaccctagtactcttagagtga

SEQ ID NO: 292208 - DNA, 25 bp, Mus musculus
caaaaccctagttctcttagagtga

SEQ ID NO: 292209 - DNA, 25 bp, Mus musculus
caaaaccctcggacgtgagattgta

SEQ ID NO: 292210 - DNA, 25 bp, Mus musculus
caaaaccctcggtcgtgagattgta

SEQ ID NO: 292211 - DNA, 25 bp, Mus musculus
caaaaccctggtactgatcctggtg

SEQ ID NO: 292212 - DNA, 25 bp, Mus musculus
caaaaccctggttctgatcctggtg

SEQ ID NO: 292213 - DNA, 25 bp, Mus musculus
caaaacccttagaagccatggattt

SEQ ID NO: 292214 - DNA, 25 bp, Mus musculus
caaaacccttagactgctctaatca

SEQ ID NO: 292215 - DNA, 25 bp, Mus musculus
caaaacccttagtagccatggattt

SEQ ID NO: 292216 - DNA, 25 bp, Mus musculus
caaaacccttagtctgctctaatca

SEQ ID NO: 292217 - DNA, 25 bp, Mus musculus
caaaaccggccacaatttgcatata

SEQ ID NO: 292218 - DNA, 25 bp, Mus musculus
caaaaccggccagaatttgcatata

SEQ ID NO: 292219 - DNA, 25 bp, Mus musculus
caaaaccgtaccctcatatttcatt

SEQ ID NO: 292220 - DNA, 25 bp, Mus musculus
caaaaccgtaccgtcatatttcatt

SEQ ID NO: 292221 - DNA, 25 bp, Mus musculus
caaaacctacgtagtacttgtgatt

SEQ ID NO: 292222 - DNA, 25 bp, Mus musculus
caaaacctacgttgtacttgtgatt

SEQ ID NO: 292223 - DNA, 25 bp, Mus musculus
caaaacctcaggcagcagcggtaca

SEQ ID NO: 292224 - DNA, 25 bp, Mus musculus
caaaacctcagggagcagcggtaca

SEQ ID NO: 292225 - DNA, 25 bp, Mus musculus
caaaacctcatcatattccctttta

SEQ ID NO: 292226 - DNA, 25 bp, Mus musculus
caaaacctcatcttattccctttta

SEQ ID NO: 292227 - DNA, 25 bp, Mus musculus
caaaacctccgtcttccattttctg

SEQ ID NO: 292228 - DNA, 25 bp, Mus musculus
caaaacctccgtgttccattttctg

SEQ ID NO: 292229 - DNA, 25 bp, Mus musculus
caaaacctccttcaactggttcgtg

SEQ ID NO: 292230 - DNA, 25 bp, Mus musculus
caaaacctccttgaactggttcgtg

SEQ ID NO: 292231 - DNA, 25 bp, Mus musculus
caaaacctcgctccacatgctagag

SEQ ID NO: 292232 - DNA, 25 bp, Mus musculus
caaaacctcgctgcacatgctagag

SEQ ID NO: 292233 - DNA, 25 bp, Mus musculus
caaaacctctggaagccgcgattga

SEQ ID NO: 292234 - DNA, 25 bp, Mus musculus
caaaacctctggtagccgcgattga

SEQ ID NO: 292235 - DNA, 25 bp, Mus musculus
caaaacctgaacactctgggatctc

SEQ ID NO: 292236 - DNA, 25 bp, Mus musculus
caaaacctgaactctctgggatctc

SEQ ID NO: 292237 - DNA, 25 bp, Mus musculus
caaaacctggccaggctaccaagaa

SEQ ID NO: 292238 - DNA, 25 bp, Mus musculus
caaaacctggcctggctaccaagaa

SEQ ID NO: 292239 - DNA, 25 bp, Mus musculus
caaaacctgtacagactgtagctca

SEQ ID NO: 292240 - DNA, 25 bp, Mus musculus
caaaacctgtactgactgtagctca

SEQ ID NO: 292241 - DNA, 25 bp, Mus musculus
caaaaccttattcgtctggaagttg

SEQ ID NO: 292242 - DNA, 25 bp, Mus musculus
caaaaccttattggtctggaagttg

SEQ ID NO: 292243 - DNA, 25 bp, Mus musculus
caaaacctttctcctaagtcctgtg

SEQ ID NO: 292244 - DNA, 25 bp, Mus musculus
caaaacctttctgctaagtcctgtg

SEQ ID NO: 292245 - DNA, 25 bp, Mus musculus
caaaacgcccgacgtatttgctctg

SEQ ID NO: 292246 - DNA, 25 bp, Mus musculus
caaaacgcccgaggtatttgctctg

SEQ ID NO: 292247 - DNA, 25 bp, Mus musculus
caaaacgccgacctattcgctctga

SEQ ID NO: 292248 - DNA, 25 bp, Mus musculus
caaaacgccgacgtattcgctctga

SEQ ID NO: 292249 - DNA, 25 bp, Mus musculus
caaaacgctgggaggtggtaccaat

SEQ ID NO: 292250 - DNA, 25 bp, Mus musculus
caaaacgctgggtggtggtaccaat

SEQ ID NO: 292251 - DNA, 25 bp, Mus musculus
caaaacgcttgcaactcattgtcag

SEQ ID NO: 292252 - DNA, 25 bp, Mus musculus
caaaacgcttgctactcattgtcag

SEQ ID NO: 292253 - DNA, 25 bp, Mus musculus
caaaacggcgaacgctcgtgggaca

SEQ ID NO: 292254 - DNA, 25 bp, Mus musculus
caaaacggcgaaggctcgtgggaca

SEQ ID NO: 292255 - DNA, 25 bp, Mus musculus
caaaacgtcctacacttatccttag

SEQ ID NO: 292256 - DNA, 25 bp, Mus musculus
caaaacgtcctagacttatccttag

SEQ ID NO: 292257 - DNA, 25 bp, Mus musculus
caaaacgtcttaacgcgtgtagcga

SEQ ID NO: 292258 - DNA, 25 bp, Mus musculus
caaaacgtcttatcgcgtgtagcga

SEQ ID NO: 292259 - DNA, 25 bp, Mus musculus
caaaactaaaccaatccacacaatc

SEQ ID NO: 292260 - DNA, 25 bp, Mus musculus
caaaactaaacctatccacacaatc

SEQ ID NO: 292261 - DNA, 25 bp, Mus musculus
caaaactaatcacacctctgatgct

SEQ ID NO: 292262 - DNA, 25 bp, Mus musculus
caaaactaatcagacctctgatgct

SEQ ID NO: 292263 - DNA, 25 bp, Mus musculus
caaaactacagcaagtctcattctc

SEQ ID NO: 292264 - DNA, 25 bp, Mus musculus
caaaactacagctagtctcattctc

SEQ ID NO: 292265 - DNA, 25 bp, Mus musculus
caaaactccatacgcaaagcaggaa

SEQ ID NO: 292266 - DNA, 25 bp, Mus musculus
caaaactccataggcaaagcaggaa

SEQ ID NO: 292267 - DNA, 25 bp, Mus musculus
caaaactcctctaattccttttgtg

SEQ ID NO: 292268 - DNA, 25 bp, Mus musculus
caaaactcctctataatccttgtgg

SEQ ID NO: 292269 - DNA, 25 bp, Mus musculus
caaaactcctcttattccttttgtg

SEQ ID NO: 292270 - DNA, 25 bp, Mus musculus
caaaactcctctttaatccttgtgg

SEQ ID NO: 292271 - DNA, 25 bp, Mus musculus
caaaactcttcaatttagcctcagg

SEQ ID NO: 292272 - DNA, 25 bp, Mus musculus
caaaactcttcattttagcctcagg

SEQ ID NO: 292273 - DNA, 25 bp, Mus musculus
caaaactctttcatgtgtagacaga

SEQ ID NO: 292274 - DNA, 25 bp, Mus musculus
caaaactctttcttgtgtagacaga

SEQ ID NO: 292275 - DNA, 25 bp, Mus musculus
caaaactgaaagacccagcctattc

SEQ ID NO: 292276 - DNA, 25 bp, Mus musculus
caaaactgaaagtcccagcctattc

SEQ ID NO: 292277 - DNA, 25 bp, Mus musculus
caaaactgaggcacctttgctaacc

SEQ ID NO: 292278 - DNA, 25 bp, Mus musculus
caaaactgaggctcctttgctaacc

SEQ ID NO: 292279 - DNA, 25 bp, Mus musculus
caaaactgctatcttgtcctcagat

SEQ ID NO: 292280 - DNA, 25 bp, Mus musculus
caaaactgctatgttgtcctcagat

SEQ ID NO: 292281 - DNA, 25 bp, Mus musculus
caaaactggctcagagaaatgtcct

SEQ ID NO: 292282 - DNA, 25 bp, Mus musculus
caaaactggctctgagaaatgtcct

SEQ ID NO: 292283 - DNA, 25 bp, Mus musculus
caaaactgttatatctgtgggcata

SEQ ID NO: 292284 - DNA, 25 bp, Mus musculus
caaaactgttatttctgtgggcata

SEQ ID NO: 292285 - DNA, 25 bp, Mus musculus
caaaactgtttacctcattggcaaa

SEQ ID NO: 292286 - DNA, 25 bp, Mus musculus
caaaactgtttagctcattggcaaa

SEQ ID NO: 292287 - DNA, 25 bp, Mus musculus
caaaacttagctacttggtcgatga

SEQ ID NO: 292288 - DNA, 25 bp, Mus musculus
caaaacttagcttcttggtcgatga

SEQ ID NO: 292289 - DNA, 25 bp, Mus musculus
caaaacttcccaagagagcctttct

SEQ ID NO: 292290 - DNA, 25 bp, Mus musculus
caaaacttcccatgagagcctttct

SEQ ID NO: 292291 - DNA, 25 bp, Mus musculus
caaaacttgaagcttcccagcagaa

SEQ ID NO: 292292 - DNA, 25 bp, Mus musculus
caaaacttgaaggttcccagcagaa

SEQ ID NO: 292293 - DNA, 25 bp, Mus musculus
caaaacttggcaccgatctggttgc

SEQ ID NO: 292294 - DNA, 25 bp, Mus musculus
caaaacttggcagcgatctggttgc

SEQ ID NO: 292295 - DNA, 25 bp, Mus musculus
caaaactttctcatggaaggcaatt

SEQ ID NO: 292296 - DNA, 25 bp, Mus musculus
caaaactttctcttggaaggcaatt

SEQ ID NO: 292297 - DNA, 25 bp, Mus musculus
caaaactttgagagttctccttcct

SEQ ID NO: 292298 - DNA, 25 bp, Mus musculus
caaaactttgagtgttctccttcct

SEQ ID NO: 292299 - DNA, 25 bp, Mus musculus
caaaactttgtaagtttattcctca

SEQ ID NO: 292300 - DNA, 25 bp, Mus musculus
caaaactttgtatgtttattcctca

SEQ ID NO: 292301 - DNA, 25 bp, Mus musculus
caaaactttgtccttgtcggcagta

SEQ ID NO: 292302 - DNA, 25 bp, Mus musculus
caaaactttgtcgttgtcggcagta

SEQ ID NO: 292303 - DNA, 25 bp, Mus musculus
caaaagaaaacaaccttaatgccct

SEQ ID NO: 292304 - DNA, 25 bp, Mus musculus
caaaagaaaacatccttaatgccct

SEQ ID NO: 292305 - DNA, 25 bp, Mus musculus
caaaagaacgtacctacctcctggg

SEQ ID NO: 292306 - DNA, 25 bp, Mus musculus
caaaagaacgtagctacctcctggg

SEQ ID NO: 292307 - DNA, 25 bp, Mus musculus
caaaagaatagcagctgctcagtag

SEQ ID NO: 292308 - DNA, 25 bp, Mus musculus
caaaagaatagctgctgctcagtag

SEQ ID NO: 292309 - DNA, 25 bp, Mus musculus
caaaagaatcgtccctctcttaagt

SEQ ID NO: 292310 - DNA, 25 bp, Mus musculus
caaaagaatcgtgcctctcttaagt

SEQ ID NO: 292311 - DNA, 25 bp, Mus musculus
caaaagaatggaacctctctcctcc

SEQ ID NO: 292312 - DNA, 25 bp, Mus musculus
caaaagaatggatcctctctcctcc

SEQ ID NO: 292313 - DNA, 25 bp, Mus musculus
caaaagaatgtaaacccctgttact

SEQ ID NO: 292314 - DNA, 25 bp, Mus musculus
caaaagaatgtatacccctgttact

SEQ ID NO: 292315 - DNA, 25 bp, Mus musculus
caaaagaatttcatagacattcagt

SEQ ID NO: 292316 - DNA, 25 bp, Mus musculus
caaaagaatttcttagacattcagt

SEQ ID NO: 292317 - DNA, 25 bp, Mus musculus
caaaagaccagtctgtgccacctga

SEQ ID NO: 292318 - DNA, 25 bp, Mus musculus
caaaagaccagtgtgtgccacctga

SEQ ID NO: 292319 - DNA, 25 bp, Mus musculus
caaaagacgtgtagttcttggccaa

SEQ ID NO: 292320 - DNA, 25 bp, Mus musculus
caaaagacgtgttgttcttggccaa

SEQ ID NO: 292321 - DNA, 25 bp, Mus musculus
caaaagactgcaattcacactaccc

SEQ ID NO: 292322 - DNA, 25 bp, Mus musculus
caaaagactgcatttcacactaccc

SEQ ID NO: 292323 - DNA, 25 bp, Mus musculus
caaaagagcactcgttccttttata

SEQ ID NO: 292324 - DNA, 25 bp, Mus musculus
caaaagagcactggttccttttata

SEQ ID NO: 292325 - DNA, 25 bp, Mus musculus
caaaagagtcctcgttgtcctggaa

SEQ ID NO: 292326 - DNA, 25 bp, Mus musculus
caaaagagtcctggttgtcctggaa

SEQ ID NO: 292327 - DNA, 25 bp, Mus musculus
caaaagagttttcccagcagccctt

SEQ ID NO: 292328 - DNA, 25 bp, Mus musculus
caaaagagttttgccagcagccctt

SEQ ID NO: 292329 - DNA, 25 bp, Mus musculus
caaaagatgtggacgtgctctgagg

SEQ ID NO: 292330 - DNA, 25 bp, Mus musculus
caaaagatgtggtcgtgctctgagg

SEQ ID NO: 292331 - DNA, 25 bp, Mus musculus
caaaagcaaaccctgccaaaccgtg

SEQ ID NO: 292332 - DNA, 25 bp, Mus musculus
caaaagcaaaccgtgccaaaccgtg

SEQ ID NO: 292333 - DNA, 25 bp, Mus musculus
caaaagcactgtaagggagttccct

SEQ ID NO: 292334 - DNA, 25 bp, Mus musculus
caaaagcactgtcaccctatgggtg

SEQ ID NO: 292335 - DNA, 25 bp, Mus musculus
caaaagcactgtgaccctatgggtg

SEQ ID NO: 292336 - DNA, 25 bp, Mus musculus
caaaagcactgttagggagttccct

SEQ ID NO: 292337 - DNA, 25 bp, Mus musculus
caaaagccacataacatagagaaag

SEQ ID NO: 292338 - DNA, 25 bp, Mus musculus
caaaagccacattacatagagaaag

SEQ ID NO: 292339 - DNA, 25 bp, Mus musculus
caaaagcccagactccaacagttaa

SEQ ID NO: 292340 - DNA, 25 bp, Mus musculus
caaaagcccagagtccaacagttaa

SEQ ID NO: 292341 - DNA, 25 bp, Mus musculus
caaaagcccagtcctagtttagcgt

SEQ ID NO: 292342 - DNA, 25 bp, Mus musculus
caaaagcccagtgctagtttagcgt

SEQ ID NO: 292343 - DNA, 25 bp, Mus musculus
caaaagcccattagcttttcactcc

SEQ ID NO: 292344 - DNA, 25 bp, Mus musculus
caaaagcccatttgcttttcactcc

SEQ ID NO: 292345 - DNA, 25 bp, Mus musculus
caaaagcctctcaggtgaacttaga

SEQ ID NO: 292346 - DNA, 25 bp, Mus musculus
caaaagcctctctggtgaacttaga

SEQ ID NO: 292347 - DNA, 25 bp, Mus musculus
caaaagcgaattactcctggaagag

SEQ ID NO: 292348 - DNA, 25 bp, Mus musculus
caaaagcgaatttctcctggaagag

SEQ ID NO: 292349 - DNA, 25 bp, Mus musculus
caaaagcgtcgactgctgtgtgttc

SEQ ID NO: 292350 - DNA, 25 bp, Mus musculus
caaaagcgtcgagtgctgtgtgttc

SEQ ID NO: 292351 - DNA, 25 bp, Mus musculus
caaaagcgtgagagtagagatgtta

SEQ ID NO: 292352 - DNA, 25 bp, Mus musculus
caaaagcgtgagtgtagagatgtta

SEQ ID NO: 292353 - DNA, 25 bp, Mus musculus
caaaagctatcacttggacttcaac

SEQ ID NO: 292354 - DNA, 25 bp, Mus musculus
caaaagctatcagttggacttcaac

SEQ ID NO: 292355 - DNA, 25 bp, Mus musculus
caaaagctcagtcggcgtgcgtgtt

SEQ ID NO: 292356 - DNA, 25 bp, Mus musculus
caaaagctcagtgggcgtgcgtgtt

SEQ ID NO: 292357 - DNA, 25 bp, Mus musculus
caaaagctctacaaggtcaggacct

SEQ ID NO: 292358 - DNA, 25 bp, Mus musculus
caaaagctctactaggtcaggacct

SEQ ID NO: 292359 - DNA, 25 bp, Mus musculus
caaaagctctgtaaggcaacccctc

SEQ ID NO: 292360 - DNA, 25 bp, Mus musculus
caaaagctctgttaggcaacccctc

SEQ ID NO: 292361 - DNA, 25 bp, Mus musculus
caaaagctgcggaactgggcgtctg

SEQ ID NO: 292362 - DNA, 25 bp, Mus musculus
caaaagctgcggtactgggcgtctg

SEQ ID NO: 292363 - DNA, 25 bp, Mus musculus
caaaagctgcttcagaatggtgact

SEQ ID NO: 292364 - DNA, 25 bp, Mus musculus
caaaagctgcttgagaatggtgact

SEQ ID NO: 292365 - DNA, 25 bp, Mus musculus
caaaagctggctccttgaccttttt

SEQ ID NO: 292366 - DNA, 25 bp, Mus musculus
caaaagctggctgcttgaccttttt

SEQ ID NO: 292367 - DNA, 25 bp, Mus musculus
caaaagcttcccatctgacaaacaa

SEQ ID NO: 292368 - DNA, 25 bp, Mus musculus
caaaagcttcccttctgacaaacaa

SEQ ID NO: 292369 - DNA, 25 bp, Mus musculus
caaaagcttgatctggaggagaact

SEQ ID NO: 292370 - DNA, 25 bp, Mus musculus
caaaagcttgatgtggaggagaact

SEQ ID NO: 292371 - DNA, 25 bp, Mus musculus
caaaagctttacatgtacagatgta

SEQ ID NO: 292372 - DNA, 25 bp, Mus musculus
caaaagctttacttgtacagatgta

SEQ ID NO: 292373 - DNA, 25 bp, Mus musculus
caaaaggaacttacttaagcagagt

SEQ ID NO: 292374 - DNA, 25 bp, Mus musculus
caaaaggaactttcttaagcagagt

SEQ ID NO: 292375 - DNA, 25 bp, Mus musculus
caaaaggacagtaggctcttctccc

SEQ ID NO: 292376 - DNA, 25 bp, Mus musculus
caaaaggacagttggctcttctccc

SEQ ID NO: 292377 - DNA, 25 bp, Mus musculus
caaaaggaccatccccatgtttgtg

SEQ ID NO: 292378 - DNA, 25 bp, Mus musculus
caaaaggaccatgcccatgtttgtg

SEQ ID NO: 292379 - DNA, 25 bp, Mus musculus
caaaaggacccgatgtctttctggg

SEQ ID NO: 292380 - DNA, 25 bp, Mus musculus
caaaaggacccgttgtctttctggg

SEQ ID NO: 292381 - DNA, 25 bp, Mus musculus
caaaaggatcctcaaccaccgtgat

SEQ ID NO: 292382 - DNA, 25 bp, Mus musculus
caaaaggatcctgaaccaccgtgat

SEQ ID NO: 292383 - DNA, 25 bp, Mus musculus
caaaaggatggcaaccgaaaaaatg

SEQ ID NO: 292384 - DNA, 25 bp, Mus musculus
caaaaggatggctaccgaaaaaatg

SEQ ID NO: 292385 - DNA, 25 bp, Mus musculus
caaaaggccatcagcagaaacagta

SEQ ID NO: 292386 - DNA, 25 bp, Mus musculus
caaaaggccatctgcagaaacagta

SEQ ID NO: 292387 - DNA, 25 bp, Mus musculus
caaaaggcgggcactgatgcttcac

SEQ ID NO: 292388 - DNA, 25 bp, Mus musculus
caaaaggcgggctctgatgcttcac

SEQ ID NO: 292389 - DNA, 25 bp, Mus musculus
caaaaggctcctcgaggtggcttta

SEQ ID NO: 292390 - DNA, 25 bp, Mus musculus
caaaaggctcctggaggtggcttta

SEQ ID NO: 292391 - DNA, 25 bp, Mus musculus
caaaaggctcggactgctcagttct

SEQ ID NO: 292392 - DNA, 25 bp, Mus musculus
caaaaggctcggtctgctcagttct

SEQ ID NO: 292393 - DNA, 25 bp, Mus musculus
caaaaggctttcagccctatatttt

SEQ ID NO: 292394 - DNA, 25 bp, Mus musculus
caaaaggctttctgccctatatttt

SEQ ID NO: 292395 - DNA, 25 bp, Mus musculus
caaaagggtccaatctgagaacaat

SEQ ID NO: 292396 - DNA, 25 bp, Mus musculus
caaaagggtccattctgagaacaat

SEQ ID NO: 292397 - DNA, 25 bp, Mus musculus
caaaagggtttgcagtactgagcag

SEQ ID NO: 292398 - DNA, 25 bp, Mus musculus
caaaagggtttggagtactgagcag

SEQ ID NO: 292399 - DNA, 25 bp, Mus musculus
caaaaggtacttactgttgcaatac

SEQ ID NO: 292400 - DNA, 25 bp, Mus musculus
caaaaggtactttctgttgcaatac

SEQ ID NO: 292401 - DNA, 25 bp, Mus musculus
caaaaggtcgccctctggttcaagg

SEQ ID NO: 292402 - DNA, 25 bp, Mus musculus
caaaaggtcgccgtctggttcaagg

SEQ ID NO: 292403 - DNA, 25 bp, Mus musculus
caaaaggtggctacccaatcagaaa

SEQ ID NO: 292404 - DNA, 25 bp, Mus musculus
caaaaggtggcttcccaatcagaaa

SEQ ID NO: 292405 - DNA, 25 bp, Mus musculus
caaaaggtgtgaatggcgccagcca

SEQ ID NO: 292406 - DNA, 25 bp, Mus musculus
caaaaggtgtgattggcgccagcca

SEQ ID NO: 292407 - DNA, 25 bp, Mus musculus
caaaaggttaatcggtcatctggga

SEQ ID NO: 292408 - DNA, 25 bp, Mus musculus
caaaaggttaatgggtcatctggga

SEQ ID NO: 292409 - DNA, 25 bp, Mus musculus
caaaaggttgtgctatcccgatttt

SEQ ID NO: 292410 - DNA, 25 bp, Mus musculus
caaaaggttgtggtatcccgatttt

SEQ ID NO: 292411 - DNA, 25 bp, Mus musculus
caaaaggtttcccttgctgtgtctc

SEQ ID NO: 292412 - DNA, 25 bp, Mus musculus
caaaaggtttccgttgctgtgtctc

SEQ ID NO: 292413 - DNA, 25 bp, Mus musculus
caaaagtaacctaagcgatctgcta

SEQ ID NO: 292414 - DNA, 25 bp, Mus musculus
caaaagtaaccttagcgatctgcta

SEQ ID NO: 292415 - DNA, 25 bp, Mus musculus
caaaagtatccaagtagagtttaaa

SEQ ID NO: 292416 - DNA, 25 bp, Mus musculus
caaaagtatccatgtagagtttaaa

SEQ ID NO: 292417 - DNA, 25 bp, Mus musculus
caaaagtccctgaaagccttggagc

SEQ ID NO: 292418 - DNA, 25 bp, Mus musculus
caaaagtccctgtaagccttggagc

SEQ ID NO: 292419 - DNA, 25 bp, Mus musculus
caaaagtcgccaagctctcactcag

SEQ ID NO: 292420 - DNA, 25 bp, Mus musculus
caaaagtcgccatgctctcactcag

SEQ ID NO: 292421 - DNA, 25 bp, Mus musculus
caaaagtctgtgaaaatgtctcata

SEQ ID NO: 292422 - DNA, 25 bp, Mus musculus
caaaagtctgtgtaaatgtctcata

SEQ ID NO: 292423 - DNA, 25 bp, Mus musculus
caaaagtcttgtaggattaaaatct

SEQ ID NO: 292424 - DNA, 25 bp, Mus musculus
caaaagtcttgttggattaaaatct

SEQ ID NO: 292425 - DNA, 25 bp, Mus musculus
caaaagtgaagtctggcaagcctga

SEQ ID NO: 292426 - DNA, 25 bp, Mus musculus
caaaagtgaagtgtggcaagcctga

SEQ ID NO: 292427 - DNA, 25 bp, Mus musculus
caaaagtgacttatggctctccaat

SEQ ID NO: 292428 - DNA, 25 bp, Mus musculus
caaaagtgacttttggctctccaat

SEQ ID NO: 292429 - DNA, 25 bp, Mus musculus
caaaagtgctaaccgtgcttccata

SEQ ID NO: 292430 - DNA, 25 bp, Mus musculus
caaaagtgctaagcgtgcttccata

SEQ ID NO: 292431 - DNA, 25 bp, Mus musculus
caaaagtgggtcctgtggactcaaa

SEQ ID NO: 292432 - DNA, 25 bp, Mus musculus
caaaagtgggtcgtgtggactcaaa

SEQ ID NO: 292433 - DNA, 25 bp, Mus musculus
caaaagtgtcctcctttgtttagag

SEQ ID NO: 292434 - DNA, 25 bp, Mus musculus
caaaagtgtcctgctttgtttagag

SEQ ID NO: 292435 - DNA, 25 bp, Mus musculus
caaaagtgtcttcggcttgaacctt

SEQ ID NO: 292436 - DNA, 25 bp, Mus musculus
caaaagtgtcttgggcttgaacctt

SEQ ID NO: 292437 - DNA, 25 bp, Mus musculus
caaaagtgttatcaatggagctata

SEQ ID NO: 292438 - DNA, 25 bp, Mus musculus
caaaagtgttatgaatggagctata

SEQ ID NO: 292439 - DNA, 25 bp, Mus musculus
caaaagttcattcctgagcagttgt

SEQ ID NO: 292440 - DNA, 25 bp, Mus musculus
caaaagttcattgctgagcagttgt

SEQ ID NO: 292441 - DNA, 25 bp, Mus musculus
caaaagttcggtcacctggatttct

SEQ ID NO: 292442 - DNA, 25 bp, Mus musculus
caaaagttcggtgacctggatttct

SEQ ID NO: 292443 - DNA, 25 bp, Mus musculus
caaaagttgtgcaggcctggcctgc

SEQ ID NO: 292444 - DNA, 25 bp, Mus musculus
caaaagttgtgctggcctggcctgc

SEQ ID NO: 292445 - DNA, 25 bp, Mus musculus
caaaagtttgtactctgcgttccct

SEQ ID NO: 292446 - DNA, 25 bp, Mus musculus
caaaagtttgtagtctgcgttccct

SEQ ID NO: 292447 - DNA, 25 bp, Mus musculus
caaaagttttctcccagtactggtg

SEQ ID NO: 292448 - DNA, 25 bp, Mus musculus
caaaagttttctgccagtactggtg

SEQ ID NO: 292449 - DNA, 25 bp, Mus musculus
caaaataacatcctgcctactttca

SEQ ID NO: 292450 - DNA, 25 bp, Mus musculus
caaaataacatcgtgcctactttca

SEQ ID NO: 292451 - DNA, 25 bp, Mus musculus
caaaataatcttccccgtccaagtg

SEQ ID NO: 292452 - DNA, 25 bp, Mus musculus
caaaataatcttgcccgtccaagtg

SEQ ID NO: 292453 - DNA, 25 bp, Mus musculus
caaaatacacccatgagtaggttgg

SEQ ID NO: 292454 - DNA, 25 bp, Mus musculus
caaaatacacccttgagtaggttgg

SEQ ID NO: 292455 - DNA, 25 bp, Mus musculus
caaaatacattcctgttctccactg

SEQ ID NO: 292456 - DNA, 25 bp, Mus musculus
caaaatacattcgtgttctccactg

SEQ ID NO: 292457 - DNA, 25 bp, Mus musculus
caaaatagagagactcctgccttgc

SEQ ID NO: 292458 - DNA, 25 bp, Mus musculus
caaaatagagagtctcctgccttgc

SEQ ID NO: 292459 - DNA, 25 bp, Mus musculus
caaaatagcaagaccatgttttatt

SEQ ID NO: 292460 - DNA, 25 bp, Mus musculus
caaaatagcaagtccatgttttatt

SEQ ID NO: 292461 - DNA, 25 bp, Mus musculus
caaaatagctctcttattgcctgag

SEQ ID NO: 292462 - DNA, 25 bp, Mus musculus
caaaatagctctgttattgcctgag

SEQ ID NO: 292463 - DNA, 25 bp, Mus musculus
caaaataggcaacatctgtgtgtct

SEQ ID NO: 292464 - DNA, 25 bp, Mus musculus
caaaataggcaagatctgtgtgtct

SEQ ID NO: 292465 - DNA, 25 bp, Mus musculus
caaaatatgaccctcatgccttagc

SEQ ID NO: 292466 - DNA, 25 bp, Mus musculus
caaaatatgaccgtcatgccttagc

SEQ ID NO: 292467 - DNA, 25 bp, Mus musculus
caaaatatttgccttttacaatcat

SEQ ID NO: 292468 - DNA, 25 bp, Mus musculus
caaaatatttgcgttttacaatcat

SEQ ID NO: 292469 - DNA, 25 bp, Mus musculus
caaaatcaacaaaaaaggtgccgga

SEQ ID NO: 292470 - DNA, 25 bp, Mus musculus
caaaatcaacaataaaggtgccgga

SEQ ID NO: 292471 - DNA, 25 bp, Mus musculus
caaaatcactggcaagggcaagaag

SEQ ID NO: 292472 - DNA, 25 bp, Mus musculus
caaaatcactgggaagggcaagaag

SEQ ID NO: 292473 - DNA, 25 bp, Mus musculus
caaaatcatcatcggctgcttcgtg

SEQ ID NO: 292474 - DNA, 25 bp, Mus musculus
caaaatcatcatgggctgcttcgtg

SEQ ID NO: 292475 - DNA, 25 bp, Mus musculus
caaaatccactgactatcgtgggat

SEQ ID NO: 292476 - DNA, 25 bp, Mus musculus
caaaatccactgtctatcgtgggat

SEQ ID NO: 292477 - DNA, 25 bp, Mus musculus
caaaatccctggagaaagggctgta

SEQ ID NO: 292478 - DNA, 25 bp, Mus musculus
caaaatccctggtgaaagggctgta

SEQ ID NO: 292479 - DNA, 25 bp, Mus musculus
caaaatccgtcaattcattacgaac

SEQ ID NO: 292480 - DNA, 25 bp, Mus musculus
caaaatccgtcatttcattacgaac

SEQ ID NO: 292481 - DNA, 25 bp, Mus musculus
caaaatcctattccttttctcaact

SEQ ID NO: 292482 - DNA, 25 bp, Mus musculus
caaaatcctattgcttttctcaact

SEQ ID NO: 292483 - DNA, 25 bp, Mus musculus
caaaatcgccaacttgctgaagcca

SEQ ID NO: 292484 - DNA, 25 bp, Mus musculus
caaaatcgccaagttgctgaagcca

SEQ ID NO: 292485 - DNA, 25 bp, Mus musculus
caaaatcgccctcacttatactgag

SEQ ID NO: 292486 - DNA, 25 bp, Mus musculus
caaaatcgccctgacttatactgag

SEQ ID NO: 292487 - DNA, 25 bp, Mus musculus
caaaatcggagccttcttccctggg

SEQ ID NO: 292488 - DNA, 25 bp, Mus musculus
caaaatcggagcgttcttccctggg

SEQ ID NO: 292489 - DNA, 25 bp, Mus musculus
caaaatctcaatatacccacctgta

SEQ ID NO: 292490 - DNA, 25 bp, Mus musculus
caaaatctcaatttacccacctgta

SEQ ID NO: 292491 - DNA, 25 bp, Mus musculus
caaaatctcagaaggcttctagttc

SEQ ID NO: 292492 - DNA, 25 bp, Mus musculus
caaaatctcagatggcttctagttc

SEQ ID NO: 292493 - DNA, 25 bp, Mus musculus
caaaatctctatatcctttggcttt

SEQ ID NO: 292494 - DNA, 25 bp, Mus musculus
caaaatctctatttcctttggcttt

SEQ ID NO: 292495 - DNA, 25 bp, Mus musculus
caaaatctgatcatactgtgcatta

SEQ ID NO: 292496 - DNA, 25 bp, Mus musculus
caaaatctgatcttactgtgcatta

SEQ ID NO: 292497 - DNA, 25 bp, Mus musculus
caaaatctgtgtacattgtcttata

SEQ ID NO: 292498 - DNA, 25 bp, Mus musculus
caaaatctgtgttcattgtcttata

SEQ ID NO: 292499 - DNA, 25 bp, Mus musculus
caaaatcttcccatgtttcaatagg

SEQ ID NO: 292500 - DNA, 25 bp, Mus musculus
caaaatcttcccttgtttcaatagg

SEQ ID NO: 292501 - DNA, 25 bp, Mus musculus
caaaatcttttcctcaaacacacca

SEQ ID NO: 292502 - DNA, 25 bp, Mus musculus
caaaatcttttcgtcaaacacacca

SEQ ID NO: 292503 - DNA, 25 bp, Mus musculus
caaaatgaaccaccgagacccactg

SEQ ID NO: 292504 - DNA, 25 bp, Mus musculus
caaaatgaaccagcgagacccactg

SEQ ID NO: 292505 - DNA, 25 bp, Mus musculus
caaaatgaagtcatggctgcaggca

SEQ ID NO: 292506 - DNA, 25 bp, Mus musculus
caaaatgaagtcttggctgcaggca

SEQ ID NO: 292507 - DNA, 25 bp, Mus musculus
caaaatgaccataactaccagcagt

SEQ ID NO: 292508 - DNA, 25 bp, Mus musculus
caaaatgaccattactaccagcagt

SEQ ID NO: 292509 - DNA, 25 bp, Mus musculus
caaaatgattaccttgtgcctagat

SEQ ID NO: 292510 - DNA, 25 bp, Mus musculus
caaaatgattacgttgtgcctagat

SEQ ID NO: 292511 - DNA, 25 bp, Mus musculus
caaaatggtggcaggcttggcgaac

SEQ ID NO: 292512 - DNA, 25 bp, Mus musculus
caaaatggtggctggcttggcgaac

SEQ ID NO: 292513 - DNA, 25 bp, Mus musculus
caaaatggttttaacttctgtggat

SEQ ID NO: 292514 - DNA, 25 bp, Mus musculus
caaaatggtttttacttctgtggat

SEQ ID NO: 292515 - DNA, 25 bp, Mus musculus
caaaatgtagaaacctcggctcctc

SEQ ID NO: 292516 - DNA, 25 bp, Mus musculus
caaaatgtagaatcctcggctcctc

SEQ ID NO: 292517 - DNA, 25 bp, Mus musculus
caaaatgtcaggatgcagggcatgc

SEQ ID NO: 292518 - DNA, 25 bp, Mus musculus
caaaatgtcaggttgcagggcatgc

SEQ ID NO: 292519 - DNA, 25 bp, Mus musculus
caaaatgtctgtcactgagagcaca

SEQ ID NO: 292520 - DNA, 25 bp, Mus musculus
caaaatgtctgtcggctctgtactg

SEQ ID NO: 292521 - DNA, 25 bp, Mus musculus
caaaatgtctgtgactgagagcaca

SEQ ID NO: 292522 - DNA, 25 bp, Mus musculus
caaaatgtctgtgggctctgtactg

SEQ ID NO: 292523 - DNA, 25 bp, Mus musculus
caaaatgtggacagcctgatggtga

SEQ ID NO: 292524 - DNA, 25 bp, Mus musculus
caaaatgtggactgcctgatggtga

SEQ ID NO: 292525 - DNA, 25 bp, Mus musculus
caaaatgtggctagcttttcacctc

SEQ ID NO: 292526 - DNA, 25 bp, Mus musculus
caaaatgtggcttgcttttcacctc

SEQ ID NO: 292527 - DNA, 25 bp, Mus musculus
caaaatgtgtgcagagaagtctcct

SEQ ID NO: 292528 - DNA, 25 bp, Mus musculus
caaaatgtgtgctgagaagtctcct

SEQ ID NO: 292529 - DNA, 25 bp, Mus musculus
caaaatgttcatcatctagccagtg

SEQ ID NO: 292530 - DNA, 25 bp, Mus musculus
caaaatgttcatgatctagccagtg

SEQ ID NO: 292531 - DNA, 25 bp, Mus musculus
caaaatgttcttcgttgtcagtaga

SEQ ID NO: 292532 - DNA, 25 bp, Mus musculus
caaaatgttcttggttgtcagtaga

SEQ ID NO: 292533 - DNA, 25 bp, Mus musculus
caaaatgttttaaggttcactggtt

SEQ ID NO: 292534 - DNA, 25 bp, Mus musculus
caaaatgttttatggttcactggtt

SEQ ID NO: 292535 - DNA, 25 bp, Mus musculus
caaaattacaccagggagctgcagc

SEQ ID NO: 292536 - DNA, 25 bp, Mus musculus
caaaattacacctgggagctgcagc

SEQ ID NO: 292537 - DNA, 25 bp, Mus musculus
caaaattactttctaacctgcctag

SEQ ID NO: 292538 - DNA, 25 bp, Mus musculus
caaaattactttgtaacctgcctag

SEQ ID NO: 292539 - DNA, 25 bp, Mus musculus
caaaattaggttactggctgcgatt

SEQ ID NO: 292540 - DNA, 25 bp, Mus musculus
caaaattaggtttctggctgcgatt

SEQ ID NO: 292541 - DNA, 25 bp, Mus musculus
caaaattagtcgatcttgttacttg

SEQ ID NO: 292542 - DNA, 25 bp, Mus musculus
caaaattagtcgttcttgttacttg

SEQ ID NO: 292543 - DNA, 25 bp, Mus musculus
caaaattatacacgagccatggcct

SEQ ID NO: 292544 - DNA, 25 bp, Mus musculus
caaaattatacaggagccatggcct

SEQ ID NO: 292545 - DNA, 25 bp, Mus musculus
caaaattatttcatccttcactcca

SEQ ID NO: 292546 - DNA, 25 bp, Mus musculus
caaaattatttcttccttcactcca

SEQ ID NO: 292547 - DNA, 25 bp, Mus musculus
caaaattcatcccttccagtttctt

SEQ ID NO: 292548 - DNA, 25 bp, Mus musculus
caaaattcatccgttccagtttctt

SEQ ID NO: 292549 - DNA, 25 bp, Mus musculus
caaaattctagcataaagtcgtggt

SEQ ID NO: 292550 - DNA, 25 bp, Mus musculus
caaaattctagcttaaagtcgtggt

SEQ ID NO: 292551 - DNA, 25 bp, Mus musculus
caaaattctcatccttatctgttag

SEQ ID NO: 292552 - DNA, 25 bp, Mus musculus
caaaattctcatgcttatctgttag

SEQ ID NO: 292553 - DNA, 25 bp, Mus musculus
caaaattctgatcttcccaaatccc

SEQ ID NO: 292554 - DNA, 25 bp, Mus musculus
caaaattctgatgttcccaaatccc

SEQ ID NO: 292555 - DNA, 25 bp, Mus musculus
caaaattgatttcttccattggttt

SEQ ID NO: 292556 - DNA, 25 bp, Mus musculus
caaaattgatttgttccattggttt

SEQ ID NO: 292557 - DNA, 25 bp, Mus musculus
caaaattggatcatatggaagaaca

SEQ ID NO: 292558 - DNA, 25 bp, Mus musculus
caaaattggatcttatggaagaaca

SEQ ID NO: 292559 - DNA, 25 bp, Mus musculus
caaaattggctcagaaagctccagg

SEQ ID NO: 292560 - DNA, 25 bp, Mus musculus
caaaattggctctgaaagctccagg

SEQ ID NO: 292561 - DNA, 25 bp, Mus musculus
caaaattgggatactcctacctcgg

SEQ ID NO: 292562 - DNA, 25 bp, Mus musculus
caaaattgggattctcctacctcgg

SEQ ID NO: 292563 - DNA, 25 bp, Mus musculus
caaaattgggcacacctctggcaat

SEQ ID NO: 292564 - DNA, 25 bp, Mus musculus
caaaattgggcagacctctggcaat

SEQ ID NO: 292565 - DNA, 25 bp, Mus musculus
caaaattgggtaaggtaatgaaagc

SEQ ID NO: 292566 - DNA, 25 bp, Mus musculus
caaaattgggtatggtaatgaaagc

SEQ ID NO: 292567 - DNA, 25 bp, Mus musculus
caaaattgtcagagtggtggcatca

SEQ ID NO: 292568 - DNA, 25 bp, Mus musculus
caaaattgtcagtgtggtggcatca

SEQ ID NO: 292569 - DNA, 25 bp, Mus musculus
caaaattgttccagcttccaatctg

SEQ ID NO: 292570 - DNA, 25 bp, Mus musculus
caaaattgttcctgcttccaatctg

SEQ ID NO: 292571 - DNA, 25 bp, Mus musculus
caaaattgttgcacatttatgtact

SEQ ID NO: 292572 - DNA, 25 bp, Mus musculus
caaaattgttgctcatttatgtact

SEQ ID NO: 292573 - DNA, 25 bp, Mus musculus
caaaatttcacactatagcccgggc

SEQ ID NO: 292574 - DNA, 25 bp, Mus musculus
caaaatttcacagtatagcccgggc

SEQ ID NO: 292575 - DNA, 25 bp, Mus musculus
caaaatttccaacatcctgcttttt

SEQ ID NO: 292576 - DNA, 25 bp, Mus musculus
caaaatttccaagatcctgcttttt

SEQ ID NO: 292577 - DNA, 25 bp, Mus musculus
caaaatttgctccttgtctgctttc

SEQ ID NO: 292578 - DNA, 25 bp, Mus musculus
caaaatttgctcgttgtctgctttc

SEQ ID NO: 292579 - DNA, 25 bp, Mus musculus
caaaatttgggacctggctcagcag

SEQ ID NO: 292580 - DNA, 25 bp, Mus musculus
caaaatttgggagctggctcagcag

SEQ ID NO: 292581 - DNA, 25 bp, Mus musculus
caaacaaacaatacaggctatccat

SEQ ID NO: 292582 - DNA, 25 bp, Mus musculus
caaacaaacaattcaggctatccat

SEQ ID NO: 292583 - DNA, 25 bp, Mus musculus
caaacaaacaccctaaatcttcact

SEQ ID NO: 292584 - DNA, 25 bp, Mus musculus
caaacaaacaccgtaaatcttcact

SEQ ID NO: 292585 - DNA, 25 bp, Mus musculus
caaacaaacataatacggaggagag

SEQ ID NO: 292586 - DNA, 25 bp, Mus musculus
caaacaaacatattacggaggagag

SEQ ID NO: 292587 - DNA, 25 bp, Mus musculus
caaacaaactgacggcctttggtgg

SEQ ID NO: 292588 - DNA, 25 bp, Mus musculus
caaacaaactgagggcctttggtgg

SEQ ID NO: 292589 - DNA, 25 bp, Mus musculus
caaacaaagcctccctggacaaaat

SEQ ID NO: 292590 - DNA, 25 bp, Mus musculus
caaacaaagcctgcctggacaaaat

SEQ ID NO: 292591 - DNA, 25 bp, Mus musculus
caaacaaatgccagaactccctatg

SEQ ID NO: 292592 - DNA, 25 bp, Mus musculus
caaacaaatgcctgaactccctatg

SEQ ID NO: 292593 - DNA, 25 bp, Mus musculus
caaacaacaggtacctcatgtctct

SEQ ID NO: 292594 - DNA, 25 bp, Mus musculus
caaacaacaggttcctcatgtctct

SEQ ID NO: 292595 - DNA, 25 bp, Mus musculus
caaacaaccttcacctgggcaagga

SEQ ID NO: 292596 - DNA, 25 bp, Mus musculus
caaacaaccttctcctgggcaagga

SEQ ID NO: 292597 - DNA, 25 bp, Mus musculus
caaacaactcatctgcacctgcgga

SEQ ID NO: 292598 - DNA, 25 bp, Mus musculus
caaacaactcatgtgcacctgcgga

SEQ ID NO: 292599 - DNA, 25 bp, Mus musculus
caaacaactggaagctttggtcgct

SEQ ID NO: 292600 - DNA, 25 bp, Mus musculus
caaacaactggatgctttggtcgct

SEQ ID NO: 292601 - DNA, 25 bp, Mus musculus
caaacaagagagagaaattacctat

SEQ ID NO: 292602 - DNA, 25 bp, Mus musculus
caaacaagagagtgaaattacctat

SEQ ID NO: 292603 - DNA, 25 bp, Mus musculus
caaacaaggcacatctcaggccact

SEQ ID NO: 292604 - DNA, 25 bp, Mus musculus
caaacaaggcacttctcaggccact

SEQ ID NO: 292605 - DNA, 25 bp, Mus musculus
caaacaagtaagcatcccagatcct

SEQ ID NO: 292606 - DNA, 25 bp, Mus musculus
caaacaagtaaggatcccagatcct

SEQ ID NO: 292607 - DNA, 25 bp, Mus musculus
caaacaagttgtctattttccaggc

SEQ ID NO: 292608 - DNA, 25 bp, Mus musculus
caaacaagttgtgtattttccaggc

SEQ ID NO: 292609 - DNA, 25 bp, Mus musculus
caaacaatatttacttacccattag

SEQ ID NO: 292610 - DNA, 25 bp, Mus musculus
caaacaatattttcttacccattag

SEQ ID NO: 292611 - DNA, 25 bp, Mus musculus
caaacaatggtacctggcagtgcac

SEQ ID NO: 292612 - DNA, 25 bp, Mus musculus
caaacaatggtagctggcagtgcac

SEQ ID NO: 292613 - DNA, 25 bp, Mus musculus
caaacaatggtgccttctctggccc

SEQ ID NO: 292614 - DNA, 25 bp, Mus musculus
caaacaatggtggcttctctggccc

SEQ ID NO: 292615 - DNA, 25 bp, Mus musculus
caaacaatgtgccagcttctatgtg

SEQ ID NO: 292616 - DNA, 25 bp, Mus musculus
caaacaatgtgcgagcttctatgtg

SEQ ID NO: 292617 - DNA, 25 bp, Mus musculus
caaacacaaattaacccttgatggg

SEQ ID NO: 292618 - DNA, 25 bp, Mus musculus
caaacacaaatttacccttgatggg

SEQ ID NO: 292619 - DNA, 25 bp, Mus musculus
caaacacaactgaaccctgttactt

SEQ ID NO: 292620 - DNA, 25 bp, Mus musculus
caaacacaactgtaccctgttactt

SEQ ID NO: 292621 - DNA, 25 bp, Mus musculus
caaacacaagcccacgttttctcgt

SEQ ID NO: 292622 - DNA, 25 bp, Mus musculus
caaacacaagccgacgttttctcgt

SEQ ID NO: 292623 - DNA, 25 bp, Mus musculus
caaacacacaaacgcatggaatcag

SEQ ID NO: 292624 - DNA, 25 bp, Mus musculus
caaacacacaaaggcatggaatcag

SEQ ID NO: 292625 - DNA, 25 bp, Mus musculus
caaacacacaacctggaattcccta

SEQ ID NO: 292626 - DNA, 25 bp, Mus musculus
caaacacacaacgtggaattcccta

SEQ ID NO: 292627 - DNA, 25 bp, Mus musculus
caaacacacctgcacctggaactta

SEQ ID NO: 292628 - DNA, 25 bp, Mus musculus
caaacacacctggacctggaactta

SEQ ID NO: 292629 - DNA, 25 bp, Mus musculus
caaacacattgccttcatttctatt

SEQ ID NO: 292630 - DNA, 25 bp, Mus musculus
caaacacattgcgttcatttctatt

SEQ ID NO: 292631 - DNA, 25 bp, Mus musculus
caaacacccaggacattgatggctt

SEQ ID NO: 292632 - DNA, 25 bp, Mus musculus
caaacacccaggtcattgatggctt

SEQ ID NO: 292633 - DNA, 25 bp, Mus musculus
caaacaccttctcaccacaataaaa

SEQ ID NO: 292634 - DNA, 25 bp, Mus musculus
caaacaccttctgaccacaataaaa

SEQ ID NO: 292635 - DNA, 25 bp, Mus musculus
caaacacgagccagaaaccacacag

SEQ ID NO: 292636 - DNA, 25 bp, Mus musculus
caaacacgagcctgaaaccacacag

SEQ ID NO: 292637 - DNA, 25 bp, Mus musculus
caaacacgtcgcattgctttttgtg

SEQ ID NO: 292638 - DNA, 25 bp, Mus musculus
caaacacgtcgctttgctttttgtg

SEQ ID NO: 292639 - DNA, 25 bp, Mus musculus
caaacactaaatatgggcctggcta

SEQ ID NO: 292640 - DNA, 25 bp, Mus musculus
caaacactaaatttgggcctggcta

SEQ ID NO: 292641 - DNA, 25 bp, Mus musculus
caaacactaaccatgtttatctggc

SEQ ID NO: 292642 - DNA, 25 bp, Mus musculus
caaacactaaccttgtttatctggc

SEQ ID NO: 292643 - DNA, 25 bp, Mus musculus
caaacactacagatgattggaggta

SEQ ID NO: 292644 - DNA, 25 bp, Mus musculus
caaacactacagttgattggaggta

SEQ ID NO: 292645 - DNA, 25 bp, Mus musculus
caaacactctgtctctacagtcaag

SEQ ID NO: 292646 - DNA, 25 bp, Mus musculus
caaacactctgtgtctacagtcaag

SEQ ID NO: 292647 - DNA, 25 bp, Mus musculus
caaacactgaaaattctctcccttt

SEQ ID NO: 292648 - DNA, 25 bp, Mus musculus
caaacactgaaatttctctcccttt

SEQ ID NO: 292649 - DNA, 25 bp, Mus musculus
caaacactgaagataggcgactaga

SEQ ID NO: 292650 - DNA, 25 bp, Mus musculus
caaacactgaagttaggcgactaga

SEQ ID NO: 292651 - DNA, 25 bp, Mus musculus
caaacactgccccttgaggaatgaa

SEQ ID NO: 292652 - DNA, 25 bp, Mus musculus
caaacactgcccgttgaggaatgaa

SEQ ID NO: 292653 - DNA, 25 bp, Mus musculus
caaacactgtgaagggcagaacccc

SEQ ID NO: 292654 - DNA, 25 bp, Mus musculus
caaacactgtgatgggcagaacccc

SEQ ID NO: 292655 - DNA, 25 bp, Mus musculus
caaacacttctactaactgggcata

SEQ ID NO: 292656 - DNA, 25 bp, Mus musculus
caaacacttctagtaactgggcata

SEQ ID NO: 292657 - DNA, 25 bp, Mus musculus
caaacacttgagcagctgcgtgagt

SEQ ID NO: 292658 - DNA, 25 bp, Mus musculus
caaacacttgaggagctgcgtgagt

SEQ ID NO: 292659 - DNA, 25 bp, Mus musculus
caaacagaacgtcgtaccctgaggt

SEQ ID NO: 292660 - DNA, 25 bp, Mus musculus
caaacagaacgtggtaccctgaggt

SEQ ID NO: 292661 - DNA, 25 bp, Mus musculus
caaacagaactgctgacatcatgat

SEQ ID NO: 292662 - DNA, 25 bp, Mus musculus
caaacagaactggtgacatcatgat

SEQ ID NO: 292663 - DNA, 25 bp, Mus musculus
caaacagaatcgatcccgtgggttg

SEQ ID NO: 292664 - DNA, 25 bp, Mus musculus
caaacagaatcgttcccgtgggttg

SEQ ID NO: 292665 - DNA, 25 bp, Mus musculus
caaacagacacaagactattggttt

SEQ ID NO: 292666 - DNA, 25 bp, Mus musculus
caaacagacacacccacgctatttt

SEQ ID NO: 292667 - DNA, 25 bp, Mus musculus
caaacagacacagccacgctatttt

SEQ ID NO: 292668 - DNA, 25 bp, Mus musculus
caaacagacacatgactattggttt

SEQ ID NO: 292669 - DNA, 25 bp, Mus musculus
caaacagactcacctattcagtgct

SEQ ID NO: 292670 - DNA, 25 bp, Mus musculus
caaacagactcagctattcagtgct

SEQ ID NO: 292671 - DNA, 25 bp, Mus musculus
caaacagactgtctagatgcttccc

SEQ ID NO: 292672 - DNA, 25 bp, Mus musculus
caaacagactgtgtagatgcttccc

SEQ ID NO: 292673 - DNA, 25 bp, Mus musculus
caaacagagcgtcgtgggacacacc

SEQ ID NO: 292674 - DNA, 25 bp, Mus musculus
caaacagagcgtggtgggacacacc

SEQ ID NO: 292675 - DNA, 25 bp, Mus musculus
caaacagatgttaaggtggtcggtt

SEQ ID NO: 292676 - DNA, 25 bp, Mus musculus
caaacagatgtttaggtggtcggtt

SEQ ID NO: 292677 - DNA, 25 bp, Mus musculus
caaacagcaacaatgaccttttggg

SEQ ID NO: 292678 - DNA, 25 bp, Mus musculus
caaacagcaacattgaccttttggg

SEQ ID NO: 292679 - DNA, 25 bp, Mus musculus
caaacagcagcacctggattacagg

SEQ ID NO: 292680 - DNA, 25 bp, Mus musculus
caaacagcagcagctggattacagg

SEQ ID NO: 292681 - DNA, 25 bp, Mus musculus
caaacagcagcgacgtctgcgcaga

SEQ ID NO: 292682 - DNA, 25 bp, Mus musculus
caaacagcagcgtcgtctgcgcaga

SEQ ID NO: 292683 - DNA, 25 bp, Mus musculus
caaacaggacctcgggccaaccgtg

SEQ ID NO: 292684 - DNA, 25 bp, Mus musculus
caaacaggacctggggccaaccgtg

SEQ ID NO: 292685 - DNA, 25 bp, Mus musculus
caaacaggatatccactgcaggtgt

SEQ ID NO: 292686 - DNA, 25 bp, Mus musculus
caaacaggatatgcactgcaggtgt

SEQ ID NO: 292687 - DNA, 25 bp, Mus musculus
caaacaggatctcccaaacgctatg

SEQ ID NO: 292688 - DNA, 25 bp, Mus musculus
caaacaggatctgccaaacgctatg

SEQ ID NO: 292689 - DNA, 25 bp, Mus musculus
caaacaggccgtacaaagacagcgt

SEQ ID NO: 292690 - DNA, 25 bp, Mus musculus
caaacaggccgttcaaagacagcgt

SEQ ID NO: 292691 - DNA, 25 bp, Mus musculus
caaacagggcatatctgggcccctt

SEQ ID NO: 292692 - DNA, 25 bp, Mus musculus
caaacagggcatttctgggcccctt

SEQ ID NO: 292693 - DNA, 25 bp, Mus musculus
caaacagggcttcgattttcctact

SEQ ID NO: 292694 - DNA, 25 bp, Mus musculus
caaacagggcttggattttcctact

SEQ ID NO: 292695 - DNA, 25 bp, Mus musculus
caaacaggtatgcacttgttggctt

SEQ ID NO: 292696 - DNA, 25 bp, Mus musculus
caaacaggtatggacttgttggctt

SEQ ID NO: 292697 - DNA, 25 bp, Mus musculus
caaacaggtgtacaaattgatcctt

SEQ ID NO: 292698 - DNA, 25 bp, Mus musculus
caaacaggtgtagaaattgatcctt

SEQ ID NO: 292699 - DNA, 25 bp, Mus musculus
caaacaggtgtgctccccagaaggg

SEQ ID NO: 292700 - DNA, 25 bp, Mus musculus
caaacaggtgtggtccccagaaggg

SEQ ID NO: 292701 - DNA, 25 bp, Mus musculus
caaacaggttccaacattcctcttt

SEQ ID NO: 292702 - DNA, 25 bp, Mus musculus
caaacaggttcctacattcctcttt

SEQ ID NO: 292703 - DNA, 25 bp, Mus musculus
caaacagtcgctcaagtaccacctg

SEQ ID NO: 292704 - DNA, 25 bp, Mus musculus
caaacagtcgctgaagtaccacctg

SEQ ID NO: 292705 - DNA, 25 bp, Mus musculus
caaacagtcttaactgcgtgcagcc

SEQ ID NO: 292706 - DNA, 25 bp, Mus musculus
caaacagtcttatctgcgtgcagcc

SEQ ID NO: 292707 - DNA, 25 bp, Mus musculus
caaacagtgctgcttgtctgacttc

SEQ ID NO: 292708 - DNA, 25 bp, Mus musculus
caaacagtgctggttgtctgacttc

SEQ ID NO: 292709 - DNA, 25 bp, Mus musculus
caaacagtgcttattgctaacccca

SEQ ID NO: 292710 - DNA, 25 bp, Mus musculus
caaacagtgctttttgctaacccca

SEQ ID NO: 292711 - DNA, 25 bp, Mus musculus
caaacagtgggcacatatcttatgg

SEQ ID NO: 292712 - DNA, 25 bp, Mus musculus
caaacagtgggctcatatcttatgg

SEQ ID NO: 292713 - DNA, 25 bp, Mus musculus
caaacagtggttagggctcttaata

SEQ ID NO: 292714 - DNA, 25 bp, Mus musculus
caaacagtggtttgggctcttaata

SEQ ID NO: 292715 - DNA, 25 bp, Mus musculus
caaacagttgaccaaaacgggcaag

SEQ ID NO: 292716 - DNA, 25 bp, Mus musculus
caaacagttgacgaaaacgggcaag

SEQ ID NO: 292717 - DNA, 25 bp, Mus musculus
caaacagttgggaagcaagagttag

SEQ ID NO: 292718 - DNA, 25 bp, Mus musculus
caaacagttgggtagcaagagttag

SEQ ID NO: 292719 - DNA, 25 bp, Mus musculus
caaacagttgtacccctcaggacag

SEQ ID NO: 292720 - DNA, 25 bp, Mus musculus
caaacagttgtagccctcaggacag

SEQ ID NO: 292721 - DNA, 25 bp, Mus musculus
caaacatcaccccatctgatcaaaa

SEQ ID NO: 292722 - DNA, 25 bp, Mus musculus
caaacatcacccgatctgatcaaaa

SEQ ID NO: 292723 - DNA, 25 bp, Mus musculus
caaacatcactgacccactgattaa

SEQ ID NO: 292724 - DNA, 25 bp, Mus musculus
caaacatcactgtcccactgattaa

SEQ ID NO: 292725 - DNA, 25 bp, Mus musculus
caaacatcgcgtctgtttctcattt

SEQ ID NO: 292726 - DNA, 25 bp, Mus musculus
caaacatcgcgtgtgtttctcattt

SEQ ID NO: 292727 - DNA, 25 bp, Mus musculus
caaacatgaagtcctttctggagga

SEQ ID NO: 292728 - DNA, 25 bp, Mus musculus
caaacatgaagtgctttctggagga

SEQ ID NO: 292729 - DNA, 25 bp, Mus musculus
caaacatgctgacaagacaccacca

SEQ ID NO: 292730 - DNA, 25 bp, Mus musculus
caaacatgctgagaagacaccacca

SEQ ID NO: 292731 - DNA, 25 bp, Mus musculus
caaacatgcttccttctgtgtctgt

SEQ ID NO: 292732 - DNA, 25 bp, Mus musculus
caaacatgcttcgttctgtgtctgt

SEQ ID NO: 292733 - DNA, 25 bp, Mus musculus
caaacatggctaattagtaatcaga

SEQ ID NO: 292734 - DNA, 25 bp, Mus musculus
caaacatggctatttagtaatcaga

SEQ ID NO: 292735 - DNA, 25 bp, Mus musculus
caaacatggtggaagccccggagca

SEQ ID NO: 292736 - DNA, 25 bp, Mus musculus
caaacatggtggtagccccggagca

SEQ ID NO: 292737 - DNA, 25 bp, Mus musculus
caaacatgtactagaagcagctggc

SEQ ID NO: 292738 - DNA, 25 bp, Mus musculus
caaacatgtacttgaagcagctggc

SEQ ID NO: 292739 - DNA, 25 bp, Mus musculus
caaacatgtattacttattatacgt

SEQ ID NO: 292740 - DNA, 25 bp, Mus musculus
caaacatgtattattggctccctcc

SEQ ID NO: 292741 - DNA, 25 bp, Mus musculus
caaacatgtatttcttattatacgt

SEQ ID NO: 292742 - DNA, 25 bp, Mus musculus
caaacatgtatttttggctccctcc

SEQ ID NO: 292743 - DNA, 25 bp, Mus musculus
caaacatgtcaaacagtggcttcaa

SEQ ID NO: 292744 - DNA, 25 bp, Mus musculus
caaacatgtcaatcagtggcttcaa

SEQ ID NO: 292745 - DNA, 25 bp, Mus musculus
caaacatgtgaaatcctcgggtagg

SEQ ID NO: 292746 - DNA, 25 bp, Mus musculus
caaacatgtgaattcctcgggtagg

SEQ ID NO: 292747 - DNA, 25 bp, Mus musculus
caaacatgtgtgcaaccctaaagtt

SEQ ID NO: 292748 - DNA, 25 bp, Mus musculus
caaacatgtgtggaaccctaaagtt

SEQ ID NO: 292749 - DNA, 25 bp, Mus musculus
caaacattcttcctgtctggagtat

SEQ ID NO: 292750 - DNA, 25 bp, Mus musculus
caaacattcttcgtgtctggagtat

SEQ ID NO: 292751 - DNA, 25 bp, Mus musculus
caaacatttaacacgttcttcttct

SEQ ID NO: 292752 - DNA, 25 bp, Mus musculus
caaacatttaactcgttcttcttct

SEQ ID NO: 292753 - DNA, 25 bp, Mus musculus
caaacatttacgaagtagtccttga

SEQ ID NO: 292754 - DNA, 25 bp, Mus musculus
caaacatttacgtagtagtccttga

SEQ ID NO: 292755 - DNA, 25 bp, Mus musculus
caaacatttctcattagtgcaatag

SEQ ID NO: 292756 - DNA, 25 bp, Mus musculus
caaacatttctctttagtgcaatag

SEQ ID NO: 292757 - DNA, 25 bp, Mus musculus
caaacattttagacatcgcaagcag

SEQ ID NO: 292758 - DNA, 25 bp, Mus musculus
caaacattttagtcatcgcaagcag

SEQ ID NO: 292759 - DNA, 25 bp, Mus musculus
caaacattttcccacaagtatcaga

SEQ ID NO: 292760 - DNA, 25 bp, Mus musculus
caaacattttccgacaagtatcaga

SEQ ID NO: 292761 - DNA, 25 bp, Mus musculus
caaaccaaacttaccctctctgatg

SEQ ID NO: 292762 - DNA, 25 bp, Mus musculus
caaaccaaactttccctctctgatg

SEQ ID NO: 292763 - DNA, 25 bp, Mus musculus
caaaccaaaggactgtgatagctat

SEQ ID NO: 292764 - DNA, 25 bp, Mus musculus
caaaccaaaggagtgtgatagctat

SEQ ID NO: 292765 - DNA, 25 bp, Mus musculus
caaaccaacggcaaatgctgaaaag

SEQ ID NO: 292766 - DNA, 25 bp, Mus musculus
caaaccaacggctaatgctgaaaag

SEQ ID NO: 292767 - DNA, 25 bp, Mus musculus
caaaccaactctactggcgaattta

SEQ ID NO: 292768 - DNA, 25 bp, Mus musculus
caaaccaactcttctggcgaattta

SEQ ID NO: 292769 - DNA, 25 bp, Mus musculus
caaaccaaggttattctgctcactc

SEQ ID NO: 292770 - DNA, 25 bp, Mus musculus
caaaccaaggtttttctgctcactc

SEQ ID NO: 292771 - DNA, 25 bp, Mus musculus
caaaccaatggtccgaggtgcagaa

SEQ ID NO: 292772 - DNA, 25 bp, Mus musculus
caaaccaatggtgcgaggtgcagaa

SEQ ID NO: 292773 - DNA, 25 bp, Mus musculus
caaaccacaatccatacactcattt

SEQ ID NO: 292774 - DNA, 25 bp, Mus musculus
caaaccacaatcgatacactcattt

SEQ ID NO: 292775 - DNA, 25 bp, Mus musculus
caaaccacacgcaggcatttggggt

SEQ ID NO: 292776 - DNA, 25 bp, Mus musculus
caaaccacacgctggcatttggggt

SEQ ID NO: 292777 - DNA, 25 bp, Mus musculus
caaaccacatgtctttctgctgagg

SEQ ID NO: 292778 - DNA, 25 bp, Mus musculus
caaaccacatgtgtttctgctgagg

SEQ ID NO: 292779 - DNA, 25 bp, Mus musculus
caaaccacgactattaatctatttg

SEQ ID NO: 292780 - DNA, 25 bp, Mus musculus
caaaccacgacttttaatctatttg

SEQ ID NO: 292781 - DNA, 25 bp, Mus musculus
caaaccacggtcagcatgtcagcaa

SEQ ID NO: 292782 - DNA, 25 bp, Mus musculus
caaaccacggtctgcatgtcagcaa

SEQ ID NO: 292783 - DNA, 25 bp, Mus musculus
caaaccacggtgctggcagttttga

SEQ ID NO: 292784 - DNA, 25 bp, Mus musculus
caaaccacggtggtggcagttttga

SEQ ID NO: 292785 - DNA, 25 bp, Mus musculus
caaaccactcctccgttgtgtaagg

SEQ ID NO: 292786 - DNA, 25 bp, Mus musculus
caaaccactcctgcgttgtgtaagg

SEQ ID NO: 292787 - DNA, 25 bp, Mus musculus
caaaccagacatctgtgtacttctg

SEQ ID NO: 292788 - DNA, 25 bp, Mus musculus
caaaccagacatgtgtgtacttctg

SEQ ID NO: 292789 - DNA, 25 bp, Mus musculus
caaaccagacttcccagaggctatg

SEQ ID NO: 292790 - DNA, 25 bp, Mus musculus
caaaccagacttgccagaggctatg

SEQ ID NO: 292791 - DNA, 25 bp, Mus musculus
caaaccagcaaaagacccaaggagg

SEQ ID NO: 292792 - DNA, 25 bp, Mus musculus
caaaccagcaaatgacccaaggagg

SEQ ID NO: 292793 - DNA, 25 bp, Mus musculus
caaaccagcattccccattgtaaat

SEQ ID NO: 292794 - DNA, 25 bp, Mus musculus
caaaccagcattgcccattgtaaat

SEQ ID NO: 292795 - DNA, 25 bp, Mus musculus
caaaccaggattctcaggtgctgcc

SEQ ID NO: 292796 - DNA, 25 bp, Mus musculus
caaaccaggattgtcaggtgctgcc

SEQ ID NO: 292797 - DNA, 25 bp, Mus musculus
caaaccagtctgagttgaccagtca

SEQ ID NO: 292798 - DNA, 25 bp, Mus musculus
caaaccagtctgtgttgaccagtca

SEQ ID NO: 292799 - DNA, 25 bp, Mus musculus
caaaccagtgtgacgtagacctcta

SEQ ID NO: 292800 - DNA, 25 bp, Mus musculus
caaaccagtgtgtcgtagacctcta

SEQ ID NO: 292801 - DNA, 25 bp, Mus musculus
caaaccagttccagaatgctaggat

SEQ ID NO: 292802 - DNA, 25 bp, Mus musculus
caaaccagttcctgaatgctaggat

SEQ ID NO: 292803 - DNA, 25 bp, Mus musculus
caaaccatagttctacaaggctata

SEQ ID NO: 292804 - DNA, 25 bp, Mus musculus
caaaccatagttgtacaaggctata

SEQ ID NO: 292805 - DNA, 25 bp, Mus musculus
caaaccattcagcagaaagccatgt

SEQ ID NO: 292806 - DNA, 25 bp, Mus musculus
caaaccattcaggagaaagccatgt

SEQ ID NO: 292807 - DNA, 25 bp, Mus musculus
caaaccattgggaagacatgtcagt

SEQ ID NO: 292808 - DNA, 25 bp, Mus musculus
caaaccattgggtagacatgtcagt

SEQ ID NO: 292809 - DNA, 25 bp, Mus musculus
caaaccattggtctattcttctata

SEQ ID NO: 292810 - DNA, 25 bp, Mus musculus
caaaccattggtgtattcttctata

SEQ ID NO: 292811 - DNA, 25 bp, Mus musculus
caaacccaaaggagctccttccaag

SEQ ID NO: 292812 - DNA, 25 bp, Mus musculus
caaacccaaaggtgctccttccaag

SEQ ID NO: 292813 - DNA, 25 bp, Mus musculus
caaacccaagacacaagcaaaggca

SEQ ID NO: 292814 - DNA, 25 bp, Mus musculus
caaacccaagactcaagcaaaggca

SEQ ID NO: 292815 - DNA, 25 bp, Mus musculus
caaacccaagatcactatgtgacat

SEQ ID NO: 292816 - DNA, 25 bp, Mus musculus
caaacccaagatgactatgtgacat

SEQ ID NO: 292817 - DNA, 25 bp, Mus musculus
caaacccaaggaagagtaagccaag

SEQ ID NO: 292818 - DNA, 25 bp, Mus musculus
caaacccaaggatgagtaagccaag

SEQ ID NO: 292819 - DNA, 25 bp, Mus musculus
caaacccaaggcaggccatagtggt

SEQ ID NO: 292820 - DNA, 25 bp, Mus musculus
caaacccaaggctggccatagtggt

SEQ ID NO: 292821 - DNA, 25 bp, Mus musculus
caaacccacgttcacagtctgggaa

SEQ ID NO: 292822 - DNA, 25 bp, Mus musculus
caaacccacgttgacagtctgggaa

SEQ ID NO: 292823 - DNA, 25 bp, Mus musculus
caaacccactgtaaaatgaagcatg

SEQ ID NO: 292824 - DNA, 25 bp, Mus musculus
caaacccactgttaaatgaagcatg

SEQ ID NO: 292825 - DNA, 25 bp, Mus musculus
caaacccagaagcaattaagtgtga

SEQ ID NO: 292826 - DNA, 25 bp, Mus musculus
caaacccagaaggaattaagtgtga

SEQ ID NO: 292827 - DNA, 25 bp, Mus musculus
caaacccagaccagctgcaggtgaa

SEQ ID NO: 292828 - DNA, 25 bp, Mus musculus
caaacccagacctgctgcaggtgaa

SEQ ID NO: 292829 - DNA, 25 bp, Mus musculus
caaacccaggaaagaaggcaccttg

SEQ ID NO: 292830 - DNA, 25 bp, Mus musculus
caaacccaggaatgaaggcaccttg

SEQ ID NO: 292831 - DNA, 25 bp, Mus musculus
caaacccagggcctctacaatttct

SEQ ID NO: 292832 - DNA, 25 bp, Mus musculus
caaacccagggcgtctacaatttct

SEQ ID NO: 292833 - DNA, 25 bp, Mus musculus
caaacccaggtccttggctacagca

SEQ ID NO: 292834 - DNA, 25 bp, Mus musculus
caaacccaggtcgttggctacagca

SEQ ID NO: 292835 - DNA, 25 bp, Mus musculus
caaacccataccatgaacatgcatg

SEQ ID NO: 292836 - DNA, 25 bp, Mus musculus
caaacccataccatttgttttactg

SEQ ID NO: 292837 - DNA, 25 bp, Mus musculus
caaacccataccttgaacatgcatg

SEQ ID NO: 292838 - DNA, 25 bp, Mus musculus
caaacccataccttttgttttactg

SEQ ID NO: 292839 - DNA, 25 bp, Mus musculus
caaaccccgtgtagctctgttatta

SEQ ID NO: 292840 - DNA, 25 bp, Mus musculus
caaaccccgtgttgctctgttatta

SEQ ID NO: 292841 - DNA, 25 bp, Mus musculus
caaacccgaattctggccctgaacg

SEQ ID NO: 292842 - DNA, 25 bp, Mus musculus
caaacccgaattgtggccctgaacg

SEQ ID NO: 292843 - DNA, 25 bp, Mus musculus
caaaccctaggtactcttgaagttg

SEQ ID NO: 292844 - DNA, 25 bp, Mus musculus
caaaccctaggttctcttgaagttg

SEQ ID NO: 292845 - DNA, 25 bp, Mus musculus
caaaccctatgccatgcgttggaaa

SEQ ID NO: 292846 - DNA, 25 bp, Mus musculus
caaaccctatgcgatgcgttggaaa

SEQ ID NO: 292847 - DNA, 25 bp, Mus musculus
caaaccctccctaaagttctgcttg

SEQ ID NO: 292848 - DNA, 25 bp, Mus musculus
caaaccctcccttaagttctgcttg

SEQ ID NO: 292849 - DNA, 25 bp, Mus musculus
caaaccctgaaactagcccaatcgg

SEQ ID NO: 292850 - DNA, 25 bp, Mus musculus
caaaccctgaaagtagcccaatcgg

SEQ ID NO: 292851 - DNA, 25 bp, Mus musculus
caaaccctgtctccactcagggaga

SEQ ID NO: 292852 - DNA, 25 bp, Mus musculus
caaaccctgtctgcactcagggaga

SEQ ID NO: 292853 - DNA, 25 bp, Mus musculus
caaacccttagcagtagtccagaga

SEQ ID NO: 292854 - DNA, 25 bp, Mus musculus
caaacccttagctgtagtccagaga

SEQ ID NO: 292855 - DNA, 25 bp, Mus musculus
caaacccttcaaaccatctatagta

SEQ ID NO: 292856 - DNA, 25 bp, Mus musculus
caaacccttcaaatattggacctga

SEQ ID NO: 292857 - DNA, 25 bp, Mus musculus
caaacccttcaatccatctatagta

SEQ ID NO: 292858 - DNA, 25 bp, Mus musculus
caaacccttcaattattggacctga

SEQ ID NO: 292859 - DNA, 25 bp, Mus musculus
caaacccttctaagctcaagcagac

SEQ ID NO: 292860 - DNA, 25 bp, Mus musculus
caaacccttctatgctcaagcagac

SEQ ID NO: 292861 - DNA, 25 bp, Mus musculus
caaaccctttggagctggtattaca

SEQ ID NO: 292862 - DNA, 25 bp, Mus musculus
caaaccctttggtgctggtattaca

SEQ ID NO: 292863 - DNA, 25 bp, Mus musculus
caaaccctttgtataagtggctcag

SEQ ID NO: 292864 - DNA, 25 bp, Mus musculus
caaaccctttgtttaagtggctcag

SEQ ID NO: 292865 - DNA, 25 bp, Mus musculus
caaaccgattcaacatgggacgatt

SEQ ID NO: 292866 - DNA, 25 bp, Mus musculus
caaaccgattcatcatgggacgatt

SEQ ID NO: 292867 - DNA, 25 bp, Mus musculus
caaaccggaagaagccccttcctct

SEQ ID NO: 292868 - DNA, 25 bp, Mus musculus
caaaccggaagatgccccttcctct

SEQ ID NO: 292869 - DNA, 25 bp, Mus musculus
caaaccggcaagatattaatcaacc

SEQ ID NO: 292870 - DNA, 25 bp, Mus musculus
caaaccggcaagttattaatcaacc

SEQ ID NO: 292871 - DNA, 25 bp, Mus musculus
caaaccgggataacaccacgttctg

SEQ ID NO: 292872 - DNA, 25 bp, Mus musculus
caaaccgggatatcaccacgttctg

SEQ ID NO: 292873 - DNA, 25 bp, Mus musculus
caaaccgtattcatgaactgcatgt

SEQ ID NO: 292874 - DNA, 25 bp, Mus musculus
caaaccgtattcttgaactgcatgt

SEQ ID NO: 292875 - DNA, 25 bp, Mus musculus
caaaccgttttcaatgttgtccatt

SEQ ID NO: 292876 - DNA, 25 bp, Mus musculus
caaaccgttttctatgttgtccatt

SEQ ID NO: 292877 - DNA, 25 bp, Mus musculus
caaacctaaaccaatgacctgctga

SEQ ID NO: 292878 - DNA, 25 bp, Mus musculus
caaacctaaacctatgacctgctga

SEQ ID NO: 292879 - DNA, 25 bp, Mus musculus
caaacctaaatcacatcccaggttt

SEQ ID NO: 292880 - DNA, 25 bp, Mus musculus
caaacctaaatctcatcccaggttt

SEQ ID NO: 292881 - DNA, 25 bp, Mus musculus
caaacctaactcacttgtctgtctt

SEQ ID NO: 292882 - DNA, 25 bp, Mus musculus
caaacctaactctcttgtctgtctt

SEQ ID NO: 292883 - DNA, 25 bp, Mus musculus
caaacctaaggaaagtgcccgacag

SEQ ID NO: 292884 - DNA, 25 bp, Mus musculus
caaacctaaggatagtgcccgacag

SEQ ID NO: 292885 - DNA, 25 bp, Mus musculus
caaacctacataatcaggaagctgt

SEQ ID NO: 292886 - DNA, 25 bp, Mus musculus
caaacctacatattcaggaagctgt

SEQ ID NO: 292887 - DNA, 25 bp, Mus musculus
caaacctcagtgcagtgtacaaata

SEQ ID NO: 292888 - DNA, 25 bp, Mus musculus
caaacctcagtggagtgtacaaata

SEQ ID NO: 292889 - DNA, 25 bp, Mus musculus
caaacctctactcatagtgccctgt

SEQ ID NO: 292890 - DNA, 25 bp, Mus musculus
caaacctctactgatagtgccctgt

SEQ ID NO: 292891 - DNA, 25 bp, Mus musculus
caaacctctcatacgttttgtatga

SEQ ID NO: 292892 - DNA, 25 bp, Mus musculus
caaacctctcattcgttttgtatga

SEQ ID NO: 292893 - DNA, 25 bp, Mus musculus
caaacctctttaccgctcttttaag

SEQ ID NO: 292894 - DNA, 25 bp, Mus musculus
caaacctctttagcgctcttttaag

SEQ ID NO: 292895 - DNA, 25 bp, Mus musculus
caaacctgaaatactcaacaacaac

SEQ ID NO: 292896 - DNA, 25 bp, Mus musculus
caaacctgaaatccacgtaaaatgt

SEQ ID NO: 292897 - DNA, 25 bp, Mus musculus
caaacctgaaatgcacgtaaaatgt

SEQ ID NO: 292898 - DNA, 25 bp, Mus musculus
caaacctgaaattctcaacaacaac

SEQ ID NO: 292899 - DNA, 25 bp, Mus musculus
caaacctgcagaacctaggagtaat

SEQ ID NO: 292900 - DNA, 25 bp, Mus musculus
caaacctgcagatcctaggagtaat

SEQ ID NO: 292901 - DNA, 25 bp, Mus musculus
caaacctgccgaaatgcctgttgat

SEQ ID NO: 292902 - DNA, 25 bp, Mus musculus
caaacctgccgatatgcctgttgat

SEQ ID NO: 292903 - DNA, 25 bp, Mus musculus
caaacctggtttactgtgtacgcca

SEQ ID NO: 292904 - DNA, 25 bp, Mus musculus
caaacctggttttctgtgtacgcca

SEQ ID NO: 292905 - DNA, 25 bp, Mus musculus
caaacctgtagtctatcatggagta

SEQ ID NO: 292906 - DNA, 25 bp, Mus musculus
caaacctgtagtgtatcatggagta

SEQ ID NO: 292907 - DNA, 25 bp, Mus musculus
caaacctgtggtccaaattcataca

SEQ ID NO: 292908 - DNA, 25 bp, Mus musculus
caaacctgtggtcggatgtgactcc

SEQ ID NO: 292909 - DNA, 25 bp, Mus musculus
caaacctgtggtcttaataagatag

SEQ ID NO: 292910 - DNA, 25 bp, Mus musculus
caaacctgtggtgcaaattcataca

SEQ ID NO: 292911 - DNA, 25 bp, Mus musculus
caaacctgtggtgggatgtgactcc

SEQ ID NO: 292912 - DNA, 25 bp, Mus musculus
caaacctgtggtgttaataagatag

SEQ ID NO: 292913 - DNA, 25 bp, Mus musculus
caaacctgtgtgaggcactgatgga

SEQ ID NO: 292914 - DNA, 25 bp, Mus musculus
caaacctgtgtgtggcactgatgga

SEQ ID NO: 292915 - DNA, 25 bp, Mus musculus
caaacctgttagagtgatctgtgga

SEQ ID NO: 292916 - DNA, 25 bp, Mus musculus
caaacctgttagtgtgatctgtgga

SEQ ID NO: 292917 - DNA, 25 bp, Mus musculus
caaacctgttttcacgtcgtgagtg

SEQ ID NO: 292918 - DNA, 25 bp, Mus musculus
caaacctgttttgacgtcgtgagtg

SEQ ID NO: 292919 - DNA, 25 bp, Mus musculus
caaaccttaaatatgcttggtaatt

SEQ ID NO: 292920 - DNA, 25 bp, Mus musculus
caaaccttaaatttgcttggtaatt

SEQ ID NO: 292921 - DNA, 25 bp, Mus musculus
caaaccttagtgagatcgcgtttaa

SEQ ID NO: 292922 - DNA, 25 bp, Mus musculus
caaaccttagtgtgatcgcgtttaa

SEQ ID NO: 292923 - DNA, 25 bp, Mus musculus
caaaccttatgacccacctggagtt

SEQ ID NO: 292924 - DNA, 25 bp, Mus musculus
caaaccttatgagccacctggagtt

SEQ ID NO: 292925 - DNA, 25 bp, Mus musculus
caaaccttcattactttgttcccag

SEQ ID NO: 292926 - DNA, 25 bp, Mus musculus
caaaccttcatttctttgttcccag

SEQ ID NO: 292927 - DNA, 25 bp, Mus musculus
caaaccttccagaatccggttgtca

SEQ ID NO: 292928 - DNA, 25 bp, Mus musculus
caaaccttccagtatccggttgtca

SEQ ID NO: 292929 - DNA, 25 bp, Mus musculus
caaaccttgaccactagaactctat

SEQ ID NO: 292930 - DNA, 25 bp, Mus musculus
caaaccttgacctctagaactctat

SEQ ID NO: 292931 - DNA, 25 bp, Mus musculus
caaaccttgttgattctgtcagtac

SEQ ID NO: 292932 - DNA, 25 bp, Mus musculus
caaaccttgttgtttctgtcagtac

SEQ ID NO: 292933 - DNA, 25 bp, Mus musculus
caaacctttaacatttagagtctat

SEQ ID NO: 292934 - DNA, 25 bp, Mus musculus
caaacctttaacttttagagtctat

SEQ ID NO: 292935 - DNA, 25 bp, Mus musculus
caaacctttagcattgttttggcca

SEQ ID NO: 292936 - DNA, 25 bp, Mus musculus
caaacctttagctttgttttggcca

SEQ ID NO: 292937 - DNA, 25 bp, Mus musculus
caaacctttgctattctcactgctt

SEQ ID NO: 292938 - DNA, 25 bp, Mus musculus
caaacctttgcttttctcactgctt

SEQ ID NO: 292939 - DNA, 25 bp, Mus musculus
caaacgaggagtcttgcccaagcat

SEQ ID NO: 292940 - DNA, 25 bp, Mus musculus
caaacgaggagtgttgcccaagcat

SEQ ID NO: 292941 - DNA, 25 bp, Mus musculus
caaacgcaagcactggttcagtcca

SEQ ID NO: 292942 - DNA, 25 bp, Mus musculus
caaacgcaagcagtggttcagtcca

SEQ ID NO: 292943 - DNA, 25 bp, Mus musculus
caaacgcacttcaaactttttatag

SEQ ID NO: 292944 - DNA, 25 bp, Mus musculus
caaacgcacttctaactttttatag

SEQ ID NO: 292945 - DNA, 25 bp, Mus musculus
caaacgcagactaacattggttgta

SEQ ID NO: 292946 - DNA, 25 bp, Mus musculus
caaacgcagacttacattggttgta

SEQ ID NO: 292947 - DNA, 25 bp, Mus musculus
caaacgcagcggagtcgggttccag

SEQ ID NO: 292948 - DNA, 25 bp, Mus musculus
caaacgcagcggtgtcgggttccag

SEQ ID NO: 292949 - DNA, 25 bp, Mus musculus
caaacgcaggaacacagtggccact

SEQ ID NO: 292950 - DNA, 25 bp, Mus musculus
caaacgcaggaagacagtggccact

SEQ ID NO: 292951 - DNA, 25 bp, Mus musculus
caaacgcattctcatctctgagctg

SEQ ID NO: 292952 - DNA, 25 bp, Mus musculus
caaacgcattctgatctctgagctg

SEQ ID NO: 292953 - DNA, 25 bp, Mus musculus
caaacgcatttgacagtctgagaag

SEQ ID NO: 292954 - DNA, 25 bp, Mus musculus
caaacgcatttgtcagtctgagaag

SEQ ID NO: 292955 - DNA, 25 bp, Mus musculus
caaacgccagtcaccattttacaaa

SEQ ID NO: 292956 - DNA, 25 bp, Mus musculus
caaacgccagtctccattttacaaa

SEQ ID NO: 292957 - DNA, 25 bp, Mus musculus
caaacgcccattagaaaaccaccag

SEQ ID NO: 292958 - DNA, 25 bp, Mus musculus
caaacgcccatttgaaaaccaccag

SEQ ID NO: 292959 - DNA, 25 bp, Mus musculus
caaacgcctggaaggaggctgtgcg

SEQ ID NO: 292960 - DNA, 25 bp, Mus musculus
caaacgcctggatggaggctgtgcg

SEQ ID NO: 292961 - DNA, 25 bp, Mus musculus
caaacgcctggccaatgtagttcgc

SEQ ID NO: 292962 - DNA, 25 bp, Mus musculus
caaacgcctggcgaatgtagttcgc

SEQ ID NO: 292963 - DNA, 25 bp, Mus musculus
caaacgctaattctgttgaccctgc

SEQ ID NO: 292964 - DNA, 25 bp, Mus musculus
caaacgctaattgtgttgaccctgc

SEQ ID NO: 292965 - DNA, 25 bp, Mus musculus
caaacgctgaaccttctcctcagga

SEQ ID NO: 292966 - DNA, 25 bp, Mus musculus
caaacgctgaacgttctcctcagga

SEQ ID NO: 292967 - DNA, 25 bp, Mus musculus
caaacgctgatgatgcgggcagaaa

SEQ ID NO: 292968 - DNA, 25 bp, Mus musculus
caaacgctgatgttgcgggcagaaa

SEQ ID NO: 292969 - DNA, 25 bp, Mus musculus
caaacgctgcaaatagagctctgta

SEQ ID NO: 292970 - DNA, 25 bp, Mus musculus
caaacgctgcaattagagctctgta

SEQ ID NO: 292971 - DNA, 25 bp, Mus musculus
caaacggaccgcagaagttctcgga

SEQ ID NO: 292972 - DNA, 25 bp, Mus musculus
caaacggaccgctgaagttctcgga

SEQ ID NO: 292973 - DNA, 25 bp, Mus musculus
caaacggatcgtcggtgcaatgcaa

SEQ ID NO: 292974 - DNA, 25 bp, Mus musculus
caaacggatcgtgggtgcaatgcaa

SEQ ID NO: 292975 - DNA, 25 bp, Mus musculus
caaacggccaatccttcagcggata

SEQ ID NO: 292976 - DNA, 25 bp, Mus musculus
caaacggccaatgcttcagcggata

SEQ ID NO: 292977 - DNA, 25 bp, Mus musculus
caaacgggagctatgggttgttaat

SEQ ID NO: 292978 - DNA, 25 bp, Mus musculus
caaacgggagctttgggttgttaat

SEQ ID NO: 292979 - DNA, 25 bp, Mus musculus
caaacggtcccaagagagtctcagg

SEQ ID NO: 292980 - DNA, 25 bp, Mus musculus
caaacggtcccatgagagtctcagg

SEQ ID NO: 292981 - DNA, 25 bp, Mus musculus
caaacggtgtccagagttcttctac

SEQ ID NO: 292982 - DNA, 25 bp, Mus musculus
caaacggtgtcctgagttcttctac

SEQ ID NO: 292983 - DNA, 25 bp, Mus musculus
caaacgtcgtgtattcttgaaatca

SEQ ID NO: 292984 - DNA, 25 bp, Mus musculus
caaacgtcgtgttttcttgaaatca

SEQ ID NO: 292985 - DNA, 25 bp, Mus musculus
caaacgtgagaacttggaattcatt

SEQ ID NO: 292986 - DNA, 25 bp, Mus musculus
caaacgtgagaagttggaattcatt

SEQ ID NO: 292987 - DNA, 25 bp, Mus musculus
caaacgttaaatcctgcagctccat

SEQ ID NO: 292988 - DNA, 25 bp, Mus musculus
caaacgttaaatgctgcagctccat

SEQ ID NO: 292989 - DNA, 25 bp, Mus musculus
caaacgtttgggatgaaggctgcct

SEQ ID NO: 292990 - DNA, 25 bp, Mus musculus
caaacgtttgggttgaaggctgcct

SEQ ID NO: 292991 - DNA, 25 bp, Mus musculus
caaactaacagcatgtgcctgaatt

SEQ ID NO: 292992 - DNA, 25 bp, Mus musculus
caaactaacagcttgtgcctgaatt

SEQ ID NO: 292993 - DNA, 25 bp, Mus musculus
caaactaagtctaaacttctcaagt

SEQ ID NO: 292994 - DNA, 25 bp, Mus musculus
caaactaagtcttaacttctcaagt

SEQ ID NO: 292995 - DNA, 25 bp, Mus musculus
caaactaatttgaatgatggtgaaa

SEQ ID NO: 292996 - DNA, 25 bp, Mus musculus
caaactaatttgtatgatggtgaaa

SEQ ID NO: 292997 - DNA, 25 bp, Mus musculus
caaactacaaccacaaacgtctggg

SEQ ID NO: 292998 - DNA, 25 bp, Mus musculus
caaactacaacctcaaacgtctggg

SEQ ID NO: 292999 - DNA, 25 bp, Mus musculus
caaactacagttcaggcaccgatgc

SEQ ID NO: 293000 - DNA, 25 bp, Mus musculus
caaactacagttgaggcaccgatgc

SEQ ID NO: 293001 - DNA, 25 bp, Mus musculus
caaactagacttacccttgagtgaa

SEQ ID NO: 293002 - DNA, 25 bp, Mus musculus
caaactagactttcccttgagtgaa

SEQ ID NO: 293003 - DNA, 25 bp, Mus musculus
caaactagtggcccaagagctatgg

SEQ ID NO: 293004 - DNA, 25 bp, Mus musculus
caaactagtggcgcaagagctatgg

SEQ ID NO: 293005 - DNA, 25 bp, Mus musculus
caaactagttcaatcttacctaccg

SEQ ID NO: 293006 - DNA, 25 bp, Mus musculus
caaactagttcattcttacctaccg

SEQ ID NO: 293007 - DNA, 25 bp, Mus musculus
caaactagttttagaccagcacact

SEQ ID NO: 293008 - DNA, 25 bp, Mus musculus
caaactagtttttgaccagcacact

SEQ ID NO: 293009 - DNA, 25 bp, Mus musculus
caaactataggtccgttgcttacta

SEQ ID NO: 293010 - DNA, 25 bp, Mus musculus
caaactataggtgcgttgcttacta

SEQ ID NO: 293011 - DNA, 25 bp, Mus musculus
caaactatctttccactactttatt

SEQ ID NO: 293012 - DNA, 25 bp, Mus musculus
caaactatctttgcactactttatt

SEQ ID NO: 293013 - DNA, 25 bp, Mus musculus
caaactatgctcatattagcaacac

SEQ ID NO: 293014 - DNA, 25 bp, Mus musculus
caaactatgctcttattagcaacac

SEQ ID NO: 293015 - DNA, 25 bp, Mus musculus
caaactcaaatcacctgggttcaga

SEQ ID NO: 293016 - DNA, 25 bp, Mus musculus
caaactcaaatctcctgggttcaga

SEQ ID NO: 293017 - DNA, 25 bp, Mus musculus
caaactcaactcaatcttcctcttg

SEQ ID NO: 293018 - DNA, 25 bp, Mus musculus
caaactcaactctatcttcctcttg

SEQ ID NO: 293019 - DNA, 25 bp, Mus musculus
caaactcaattcagcacttgcctga

SEQ ID NO: 293020 - DNA, 25 bp, Mus musculus
caaactcaattctgcacttgcctga

SEQ ID NO: 293021 - DNA, 25 bp, Mus musculus
caaactcagattcggattctctctc

SEQ ID NO: 293022 - DNA, 25 bp, Mus musculus
caaactcagattgggattctctctc

SEQ ID NO: 293023 - DNA, 25 bp, Mus musculus
caaactcagtatacatggctatcat

SEQ ID NO: 293024 - DNA, 25 bp, Mus musculus
caaactcagtattcatggctatcat

SEQ ID NO: 293025 - DNA, 25 bp, Mus musculus
caaactcagtccatcggtccatgga

SEQ ID NO: 293026 - DNA, 25 bp, Mus musculus
caaactcagtccttcggtccatgga

SEQ ID NO: 293027 - DNA, 25 bp, Mus musculus
caaactcagtgaattcttccttatt

SEQ ID NO: 293028 - DNA, 25 bp, Mus musculus
caaactcagtgatttcttccttatt

SEQ ID NO: 293029 - DNA, 25 bp, Mus musculus
caaactcagtttcggtgacttctta

SEQ ID NO: 293030 - DNA, 25 bp, Mus musculus
caaactcagtttgggtgacttctta

SEQ ID NO: 293031 - DNA, 25 bp, Mus musculus
caaactcataatctgtcaccgtcac

SEQ ID NO: 293032 - DNA, 25 bp, Mus musculus
caaactcataatgtgtcaccgtcac

SEQ ID NO: 293033 - DNA, 25 bp, Mus musculus
caaactcatagaactcctcctgctt

SEQ ID NO: 293034 - DNA, 25 bp, Mus musculus
caaactcatagatctcctcctgctt

SEQ ID NO: 293035 - DNA, 25 bp, Mus musculus
caaactcccagtctccatgtaaaaa

SEQ ID NO: 293036 - DNA, 25 bp, Mus musculus
caaactcccagtgtccatgtaaaaa

SEQ ID NO: 293037 - DNA, 25 bp, Mus musculus
caaactcccatgaatatcccaagat

SEQ ID NO: 293038 - DNA, 25 bp, Mus musculus
caaactcccatgtatatcccaagat

SEQ ID NO: 293039 - DNA, 25 bp, Mus musculus
caaactcccgttacctgtggatgaa

SEQ ID NO: 293040 - DNA, 25 bp, Mus musculus
caaactcccgtttcctgtggatgaa

SEQ ID NO: 293041 - DNA, 25 bp, Mus musculus
caaactccctatcaccttgaactta

SEQ ID NO: 293042 - DNA, 25 bp, Mus musculus
caaactccctatgaccttgaactta

SEQ ID NO: 293043 - DNA, 25 bp, Mus musculus
caaactccgtgaagcccctgtactg

SEQ ID NO: 293044 - DNA, 25 bp, Mus musculus
caaactccgtgatgcccctgtactg

SEQ ID NO: 293045 - DNA, 25 bp, Mus musculus
caaactcctgccatttgtgcaaaat

SEQ ID NO: 293046 - DNA, 25 bp, Mus musculus
caaactcctgccttttgtgcaaaat

SEQ ID NO: 293047 - DNA, 25 bp, Mus musculus
caaactcgcggcagagggtgaagat

SEQ ID NO: 293048 - DNA, 25 bp, Mus musculus
caaactcgcggctgagggtgaagat

SEQ ID NO: 293049 - DNA, 25 bp, Mus musculus
caaactcgctgcacaaggtcagggt

SEQ ID NO: 293050 - DNA, 25 bp, Mus musculus
caaactcgctgctcaaggtcagggt

SEQ ID NO: 293051 - DNA, 25 bp, Mus musculus
caaactcggaagcaacgtactggtg

SEQ ID NO: 293052 - DNA, 25 bp, Mus musculus
caaactcggaaggaacgtactggtg

SEQ ID NO: 293053 - DNA, 25 bp, Mus musculus
caaactcggtacaagcagcaacaat

SEQ ID NO: 293054 - DNA, 25 bp, Mus musculus
caaactcggtactagcagcaacaat

SEQ ID NO: 293055 - DNA, 25 bp, Mus musculus
caaactcgtctcctgggtcaagaat

SEQ ID NO: 293056 - DNA, 25 bp, Mus musculus
caaactcgtctcgtgggtcaagaat

SEQ ID NO: 293057 - DNA, 25 bp, Mus musculus
caaactctaaccaattcttcctgct

SEQ ID NO: 293058 - DNA, 25 bp, Mus musculus
caaactctaacctattcttcctgct

SEQ ID NO: 293059 - DNA, 25 bp, Mus musculus
caaactctatggcatgtcagacccg

SEQ ID NO: 293060 - DNA, 25 bp, Mus musculus
caaactctatgggatgtcagacccg

SEQ ID NO: 293061 - DNA, 25 bp, Mus musculus
caaactctccggagggcagaaagcc

SEQ ID NO: 293062 - DNA, 25 bp, Mus musculus
caaactctccggtgggcagaaagcc

SEQ ID NO: 293063 - DNA, 25 bp, Mus musculus
caaactctctttataattcacgcat

SEQ ID NO: 293064 - DNA, 25 bp, Mus musculus
caaactctctttttaattcacgcat

SEQ ID NO: 293065 - DNA, 25 bp, Mus musculus
caaactctgcttctcagaaagctcc

SEQ ID NO: 293066 - DNA, 25 bp, Mus musculus
caaactctgcttgtcagaaagctcc

SEQ ID NO: 293067 - DNA, 25 bp, Mus musculus
caaactctggctcttatatctttcc

SEQ ID NO: 293068 - DNA, 25 bp, Mus musculus
caaactctggctgttatatctttcc

SEQ ID NO: 293069 - DNA, 25 bp, Mus musculus
caaactctggtcattctggaccaag

SEQ ID NO: 293070 - DNA, 25 bp, Mus musculus
caaactctggtctttctggaccaag

SEQ ID NO: 293071 - DNA, 25 bp, Mus musculus
caaactcttagcatcttgtattgaa

SEQ ID NO: 293072 - DNA, 25 bp, Mus musculus
caaactcttagcttcttgtattgaa

SEQ ID NO: 293073 - DNA, 25 bp, Mus musculus
caaactcttgcgatgtgggagggtt

SEQ ID NO: 293074 - DNA, 25 bp, Mus musculus
caaactcttgcgttgtgggagggtt

SEQ ID NO: 293075 - DNA, 25 bp, Mus musculus
caaactcttgttcaactgtggccat

SEQ ID NO: 293076 - DNA, 25 bp, Mus musculus
caaactcttgttgaactgtggccat

SEQ ID NO: 293077 - DNA, 25 bp, Mus musculus
caaactgaaatcatatccaaccaaa

SEQ ID NO: 293078 - DNA, 25 bp, Mus musculus
caaactgaaatcttatccaaccaaa

SEQ ID NO: 293079 - DNA, 25 bp, Mus musculus
caaactgactataacatatgtggat

SEQ ID NO: 293080 - DNA, 25 bp, Mus musculus
caaactgactattacatatgtggat

SEQ ID NO: 293081 - DNA, 25 bp, Mus musculus
caaactgagtccctaaagttgtcct

SEQ ID NO: 293082 - DNA, 25 bp, Mus musculus
caaactgagtccgtaaagttgtcct

SEQ ID NO: 293083 - DNA, 25 bp, Mus musculus
caaactgatctaagtccttctttat

SEQ ID NO: 293084 - DNA, 25 bp, Mus musculus
caaactgatctatgtccttctttat

SEQ ID NO: 293085 - DNA, 25 bp, Mus musculus
caaactgattcaagttggtggtcat

SEQ ID NO: 293086 - DNA, 25 bp, Mus musculus
caaactgattcatgttggtggtcat

SEQ ID NO: 293087 - DNA, 25 bp, Mus musculus
caaactgatttaaatcctgtttatc

SEQ ID NO: 293088 - DNA, 25 bp, Mus musculus
caaactgatttatatcctgtttatc

SEQ ID NO: 293089 - DNA, 25 bp, Mus musculus
caaactgcaggactgaaccctggta

SEQ ID NO: 293090 - DNA, 25 bp, Mus musculus
caaactgcaggagtgaaccctggta

SEQ ID NO: 293091 - DNA, 25 bp, Mus musculus
caaactgcagttatatcccggctgg

SEQ ID NO: 293092 - DNA, 25 bp, Mus musculus
caaactgcagttttatcccggctgg

SEQ ID NO: 293093 - DNA, 25 bp, Mus musculus
caaactgccatcacgcttcattttt

SEQ ID NO: 293094 - DNA, 25 bp, Mus musculus
caaactgccatctcgcttcattttt

SEQ ID NO: 293095 - DNA, 25 bp, Mus musculus
caaactgcccaaacttatttaatgt

SEQ ID NO: 293096 - DNA, 25 bp, Mus musculus
caaactgcccaatcttatttaatgt

SEQ ID NO: 293097 - DNA, 25 bp, Mus musculus
caaactgcccatatcccagtgtaca

SEQ ID NO: 293098 - DNA, 25 bp, Mus musculus
caaactgcccatcatcgactttatt

SEQ ID NO: 293099 - DNA, 25 bp, Mus musculus
caaactgcccatgatcgactttatt

SEQ ID NO: 293100 - DNA, 25 bp, Mus musculus
caaactgcccatttcccagtgtaca

SEQ ID NO: 293101 - DNA, 25 bp, Mus musculus
caaactgcctcactattgcttacag

SEQ ID NO: 293102 - DNA, 25 bp, Mus musculus
caaactgcctcagtattgcttacag

SEQ ID NO: 293103 - DNA, 25 bp, Mus musculus
caaactgccttgagacagtgaccga

SEQ ID NO: 293104 - DNA, 25 bp, Mus musculus
caaactgccttgtgacagtgaccga

SEQ ID NO: 293105 - DNA, 25 bp, Mus musculus
caaactgctccccaaatttcattta

SEQ ID NO: 293106 - DNA, 25 bp, Mus musculus
caaactgctcccgaaatttcattta

SEQ ID NO: 293107 - DNA, 25 bp, Mus musculus
caaactgctgaccacgccgaatccg

SEQ ID NO: 293108 - DNA, 25 bp, Mus musculus
caaactgctgacgacgccgaatccg

SEQ ID NO: 293109 - DNA, 25 bp, Mus musculus
caaactgctgttccactggagggag

SEQ ID NO: 293110 - DNA, 25 bp, Mus musculus
caaactgctgttgcactggagggag

SEQ ID NO: 293111 - DNA, 25 bp, Mus musculus
caaactggacatcacactgctctct

SEQ ID NO: 293112 - DNA, 25 bp, Mus musculus
caaactggacatgacactgctctct

SEQ ID NO: 293113 - DNA, 25 bp, Mus musculus
caaactggcccgcaagttctaatct

SEQ ID NO: 293114 - DNA, 25 bp, Mus musculus
caaactggcccggaagttctaatct

SEQ ID NO: 293115 - DNA, 25 bp, Mus musculus
caaactgggaagaataagcctgatt

SEQ ID NO: 293116 - DNA, 25 bp, Mus musculus
caaactgggaagtataagcctgatt

SEQ ID NO: 293117 - DNA, 25 bp, Mus musculus
caaactgggcagcgatcatccccag

SEQ ID NO: 293118 - DNA, 25 bp, Mus musculus
caaactgggcagggatcatccccag

SEQ ID NO: 293119 - DNA, 25 bp, Mus musculus
caaactgggtctatccactgaggga

SEQ ID NO: 293120 - DNA, 25 bp, Mus musculus
caaactgggtctttccactgaggga

SEQ ID NO: 293121 - DNA, 25 bp, Mus musculus
caaactggttaccttgcagccaact

SEQ ID NO: 293122 - DNA, 25 bp, Mus musculus
caaactggttacgttgcagccaact

SEQ ID NO: 293123 - DNA, 25 bp, Mus musculus
caaactgtacccatggctgtgctgt

SEQ ID NO: 293124 - DNA, 25 bp, Mus musculus
caaactgtacccttggctgtgctgt

SEQ ID NO: 293125 - DNA, 25 bp, Mus musculus
caaactgtcaggacggtaccggcgg

SEQ ID NO: 293126 - DNA, 25 bp, Mus musculus
caaactgtcaggtcggtaccggcgg

SEQ ID NO: 293127 - DNA, 25 bp, Mus musculus
caaactgtgtctaaggtgtcctgtg

SEQ ID NO: 293128 - DNA, 25 bp, Mus musculus
caaactgtgtcttaggtgtcctgtg

SEQ ID NO: 293129 - DNA, 25 bp, Mus musculus
caaactgtgtttacgactgtgcaaa

SEQ ID NO: 293130 - DNA, 25 bp, Mus musculus
caaactgtgttttcgactgtgcaaa

SEQ ID NO: 293131 - DNA, 25 bp, Mus musculus
caaactgttagtcttgatctgcaac

SEQ ID NO: 293132 - DNA, 25 bp, Mus musculus
caaactgttagtgttgatctgcaac

SEQ ID NO: 293133 - DNA, 25 bp, Mus musculus
caaactgttattagcttagaacact

SEQ ID NO: 293134 - DNA, 25 bp, Mus musculus
caaactgttatttgcttagaacact

SEQ ID NO: 293135 - DNA, 25 bp, Mus musculus
caaactgttccgatggtgcaaccaa

SEQ ID NO: 293136 - DNA, 25 bp, Mus musculus
caaactgttccgttggtgcaaccaa

SEQ ID NO: 293137 - DNA, 25 bp, Mus musculus
caaactgttgtgaccgcttattaca

SEQ ID NO: 293138 - DNA, 25 bp, Mus musculus
caaactgttgtgtccgcttattaca

SEQ ID NO: 293139 - DNA, 25 bp, Mus musculus
caaactgtttgtccgttgcccatgc

SEQ ID NO: 293140 - DNA, 25 bp, Mus musculus
caaactgtttgtgcgttgcccatgc

SEQ ID NO: 293141 - DNA, 25 bp, Mus musculus
caaacttaaaaaatccctgctcatt

SEQ ID NO: 293142 - DNA, 25 bp, Mus musculus
caaacttaaaaattccctgctcatt

SEQ ID NO: 293143 - DNA, 25 bp, Mus musculus
caaacttaaaatcttcctgcttcca

SEQ ID NO: 293144 - DNA, 25 bp, Mus musculus
caaacttaaaatgttcctgcttcca

SEQ ID NO: 293145 - DNA, 25 bp, Mus musculus
caaacttacagacgactgggccagc

SEQ ID NO: 293146 - DNA, 25 bp, Mus musculus
caaacttacagaggactgggccagc

SEQ ID NO: 293147 - DNA, 25 bp, Mus musculus
caaacttatgttccattgggtggtg

SEQ ID NO: 293148 - DNA, 25 bp, Mus musculus
caaacttatgttgcattgggtggtg

SEQ ID NO: 293149 - DNA, 25 bp, Mus musculus
caaacttattccactgcgcagggta

SEQ ID NO: 293150 - DNA, 25 bp, Mus musculus
caaacttattcctctgcgcagggta

SEQ ID NO: 293151 - DNA, 25 bp, Mus musculus
caaacttatttgacaatggaaccag

SEQ ID NO: 293152 - DNA, 25 bp, Mus musculus
caaacttatttgtcaatggaaccag

SEQ ID NO: 293153 - DNA, 25 bp, Mus musculus
caaacttcaagcacaggtccggata

SEQ ID NO: 293154 - DNA, 25 bp, Mus musculus
caaacttcaagctcaggtccggata

SEQ ID NO: 293155 - DNA, 25 bp, Mus musculus
caaacttcacttcaccttttgtgtg

SEQ ID NO: 293156 - DNA, 25 bp, Mus musculus
caaacttcacttgaccttttgtgtg

SEQ ID NO: 293157 - DNA, 25 bp, Mus musculus
caaacttctaacagcttctggcgaa

SEQ ID NO: 293158 - DNA, 25 bp, Mus musculus
caaacttctaactgcttctggcgaa

SEQ ID NO: 293159 - DNA, 25 bp, Mus musculus
caaacttcttctactggaaatgtcc

SEQ ID NO: 293160 - DNA, 25 bp, Mus musculus
caaacttcttcttctggaaatgtcc

SEQ ID NO: 293161 - DNA, 25 bp, Mus musculus
caaacttctttgcagcggtcatatg

SEQ ID NO: 293162 - DNA, 25 bp, Mus musculus
caaacttctttggagcggtcatatg

SEQ ID NO: 293163 - DNA, 25 bp, Mus musculus
caaacttgagagctacggctgactt

SEQ ID NO: 293164 - DNA, 25 bp, Mus musculus
caaacttgagaggtacggctgactt

SEQ ID NO: 293165 - DNA, 25 bp, Mus musculus
caaacttgatctaccctttcccgag

SEQ ID NO: 293166 - DNA, 25 bp, Mus musculus
caaacttgatcttccctttcccgag

SEQ ID NO: 293167 - DNA, 25 bp, Mus musculus
caaacttgcagacaattttttagga

SEQ ID NO: 293168 - DNA, 25 bp, Mus musculus
caaacttgcagagaattttttagga

SEQ ID NO: 293169 - DNA, 25 bp, Mus musculus
caaacttgctttccttagactcggg

SEQ ID NO: 293170 - DNA, 25 bp, Mus musculus
caaacttgctttgcttagactcggg

SEQ ID NO: 293171 - DNA, 25 bp, Mus musculus
caaacttggattattcagacttcca

SEQ ID NO: 293172 - DNA, 25 bp, Mus musculus
caaacttggatttttcagacttcca

SEQ ID NO: 293173 - DNA, 25 bp, Mus musculus
caaacttggcatagctctgctttgc

SEQ ID NO: 293174 - DNA, 25 bp, Mus musculus
caaacttggcattgctctgctttgc

SEQ ID NO: 293175 - DNA, 25 bp, Mus musculus
caaacttggctgagcagtgcaactt

SEQ ID NO: 293176 - DNA, 25 bp, Mus musculus
caaacttggctgtgcagtgcaactt

SEQ ID NO: 293177 - DNA, 25 bp, Mus musculus
caaacttggcttcatcttctgtgga

SEQ ID NO: 293178 - DNA, 25 bp, Mus musculus
caaacttggcttgatcttctgtgga

SEQ ID NO: 293179 - DNA, 25 bp, Mus musculus
caaacttggtgtacgccttgcttta

SEQ ID NO: 293180 - DNA, 25 bp, Mus musculus
caaacttggtgttcgccttgcttta

SEQ ID NO: 293181 - DNA, 25 bp, Mus musculus
caaacttgtgatcaggctcaggaaa

SEQ ID NO: 293182 - DNA, 25 bp, Mus musculus
caaacttgtgatgaggctcaggaaa

SEQ ID NO: 293183 - DNA, 25 bp, Mus musculus
caaactttccagcatgccccttagg

SEQ ID NO: 293184 - DNA, 25 bp, Mus musculus
caaactttccaggatgccccttagg

SEQ ID NO: 293185 - DNA, 25 bp, Mus musculus
caaactttccccagtaatactagat

SEQ ID NO: 293186 - DNA, 25 bp, Mus musculus
caaactttcccctgtaatactagat

SEQ ID NO: 293187 - DNA, 25 bp, Mus musculus
caaactttctctattgcattctaaa

SEQ ID NO: 293188 - DNA, 25 bp, Mus musculus
caaactttctcttttgcattctaaa

SEQ ID NO: 293189 - DNA, 25 bp, Mus musculus
caaactttgaggagacaaccgggag

SEQ ID NO: 293190 - DNA, 25 bp, Mus musculus
caaactttgaggtgacaaccgggag

SEQ ID NO: 293191 - DNA, 25 bp, Mus musculus
caaactttgattattccacatccgg

SEQ ID NO: 293192 - DNA, 25 bp, Mus musculus
caaactttgatttttccacatccgg

SEQ ID NO: 293193 - DNA, 25 bp, Mus musculus
caaactttgcagaaagcggacagat

SEQ ID NO: 293194 - DNA, 25 bp, Mus musculus
caaactttgcagtaagcggacagat

SEQ ID NO: 293195 - DNA, 25 bp, Mus musculus
caaactttggctcagaccctctggc

SEQ ID NO: 293196 - DNA, 25 bp, Mus musculus
caaactttggctgagaccctctggc

SEQ ID NO: 293197 - DNA, 25 bp, Mus musculus
caaacttttactattacccctgcag

SEQ ID NO: 293198 - DNA, 25 bp, Mus musculus
caaacttttacttttacccctgcag

SEQ ID NO: 293199 - DNA, 25 bp, Mus musculus
caaacttttccacaagaatccggcg

SEQ ID NO: 293200 - DNA, 25 bp, Mus musculus
caaacttttccagaagaatccggcg

SEQ ID NO: 293201 - DNA, 25 bp, Mus musculus
caaacttttccgcaggagctgcgaa

SEQ ID NO: 293202 - DNA, 25 bp, Mus musculus
caaacttttccggaggagctgcgaa

SEQ ID NO: 293203 - DNA, 25 bp, Mus musculus
caaacttttcctacttggcatggtt

SEQ ID NO: 293204 - DNA, 25 bp, Mus musculus
caaacttttccttcttggcatggtt

SEQ ID NO: 293205 - DNA, 25 bp, Mus musculus
caaacttttgacctcagggcgtggg

SEQ ID NO: 293206 - DNA, 25 bp, Mus musculus
caaacttttgacgtcagggcgtggg

SEQ ID NO: 293207 - DNA, 25 bp, Mus musculus
caaacttttgatagtcccaccttag

SEQ ID NO: 293208 - DNA, 25 bp, Mus musculus
caaacttttgattgtcccaccttag

SEQ ID NO: 293209 - DNA, 25 bp, Mus musculus
caaagaaaaattcggcatcttgttt

SEQ ID NO: 293210 - DNA, 25 bp, Mus musculus
caaagaaaaattgggcatcttgttt

SEQ ID NO: 293211 - DNA, 25 bp, Mus musculus
caaagaaactcacgacggtcccagt

SEQ ID NO: 293212 - DNA, 25 bp, Mus musculus
caaagaaactcaggacggtcccagt

SEQ ID NO: 293213 - DNA, 25 bp, Mus musculus
caaagaaactgacttccccactgag

SEQ ID NO: 293214 - DNA, 25 bp, Mus musculus
caaagaaactgagttccccactgag

SEQ ID NO: 293215 - DNA, 25 bp, Mus musculus
caaagaaactgccttcgacatcctt

SEQ ID NO: 293216 - DNA, 25 bp, Mus musculus
caaagaaactgcgttcgacatcctt

SEQ ID NO: 293217 - DNA, 25 bp, Mus musculus
caaagaaatctcacattgagctgaa

SEQ ID NO: 293218 - DNA, 25 bp, Mus musculus
caaagaaatctctcattgagctgaa

SEQ ID NO: 293219 - DNA, 25 bp, Mus musculus
caaagaacagacagttcggtagaaa

SEQ ID NO: 293220 - DNA, 25 bp, Mus musculus
caaagaacagactgttcggtagaaa

SEQ ID NO: 293221 - DNA, 25 bp, Mus musculus
caaagaacggcacatcactgaggaa

SEQ ID NO: 293222 - DNA, 25 bp, Mus musculus
caaagaacggcagatcactgaggaa

SEQ ID NO: 293223 - DNA, 25 bp, Mus musculus
caaagaacgtttactagtgacacac

SEQ ID NO: 293224 - DNA, 25 bp, Mus musculus
caaagaacgttttctagtgacacac

SEQ ID NO: 293225 - DNA, 25 bp, Mus musculus
caaagaactcctcttctcagccatt

SEQ ID NO: 293226 - DNA, 25 bp, Mus musculus
caaagaactcctgttctcagccatt

SEQ ID NO: 293227 - DNA, 25 bp, Mus musculus
caaagaactgctcgtggaaacactg

SEQ ID NO: 293228 - DNA, 25 bp, Mus musculus
caaagaactgctggtggaaacactg

SEQ ID NO: 293229 - DNA, 25 bp, Mus musculus
caaagaactggaagcctggcccagc

SEQ ID NO: 293230 - DNA, 25 bp, Mus musculus
caaagaactggatgcctggcccagc

SEQ ID NO: 293231 - DNA, 25 bp, Mus musculus
caaagaacttttagctaagaccttg

SEQ ID NO: 293232 - DNA, 25 bp, Mus musculus
caaagaactttttgctaagaccttg

SEQ ID NO: 293233 - DNA, 25 bp, Mus musculus
caaagaagaatcctgaagctcacaa

SEQ ID NO: 293234 - DNA, 25 bp, Mus musculus
caaagaagaatcgtgaagctcacaa

SEQ ID NO: 293235 - DNA, 25 bp, Mus musculus
caaagaagatgtcccacacagccat

SEQ ID NO: 293236 - DNA, 25 bp, Mus musculus
caaagaagatgtgccacacagccat

SEQ ID NO: 293237 - DNA, 25 bp, Mus musculus
caaagaagcgacactggtctcccgt

SEQ ID NO: 293238 - DNA, 25 bp, Mus musculus
caaagaagcgactctggtctcccgt

SEQ ID NO: 293239 - DNA, 25 bp, Mus musculus
caaagaagcgccatacgttactccg

SEQ ID NO: 293240 - DNA, 25 bp, Mus musculus
caaagaagcgccttacgttactccg

SEQ ID NO: 293241 - DNA, 25 bp, Mus musculus
caaagaagctttctgactatgtggg

SEQ ID NO: 293242 - DNA, 25 bp, Mus musculus
caaagaagctttgtgactatgtggg

SEQ ID NO: 293243 - DNA, 25 bp, Mus musculus
caaagaagggctaggtcctgggaca

SEQ ID NO: 293244 - DNA, 25 bp, Mus musculus
caaagaagggcttggtcctgggaca

SEQ ID NO: 293245 - DNA, 25 bp, Mus musculus
caaagaagtgaacgagaaagcagct

SEQ ID NO: 293246 - DNA, 25 bp, Mus musculus
caaagaagtgaaggagaaagcagct

SEQ ID NO: 293247 - DNA, 25 bp, Mus musculus
caaagaagtgctccctgccttggag

SEQ ID NO: 293248 - DNA, 25 bp, Mus musculus
caaagaagtgctgcctgccttggag

SEQ ID NO: 293249 - DNA, 25 bp, Mus musculus
caaagaagttcaatgctgacctgcg

SEQ ID NO: 293250 - DNA, 25 bp, Mus musculus
caaagaagttcattgctgacctgcg

SEQ ID NO: 293251 - DNA, 25 bp, Mus musculus
caaagaagttccagtttattcctag

SEQ ID NO: 293252 - DNA, 25 bp, Mus musculus
caaagaagttcctgtttattcctag

SEQ ID NO: 293253 - DNA, 25 bp, Mus musculus
caaagaatatgaccgcctgctagaa

SEQ ID NO: 293254 - DNA, 25 bp, Mus musculus
caaagaatatgagcgcctgctagaa

SEQ ID NO: 293255 - DNA, 25 bp, Mus musculus
caaagaatcacaacttggcatccat

SEQ ID NO: 293256 - DNA, 25 bp, Mus musculus
caaagaatcacatcttggcatccat

SEQ ID NO: 293257 - DNA, 25 bp, Mus musculus
caaagaatccctctggagccactga

SEQ ID NO: 293258 - DNA, 25 bp, Mus musculus
caaagaatccctgtggagccactga

SEQ ID NO: 293259 - DNA, 25 bp, Mus musculus
caaagaatgcggctgctcttctaga

SEQ ID NO: 293260 - DNA, 25 bp, Mus musculus
caaagaatgcgggtgctcttctaga

SEQ ID NO: 293261 - DNA, 25 bp, Mus musculus
caaagaattacaactccacttccac

SEQ ID NO: 293262 - DNA, 25 bp, Mus musculus
caaagaattacatctccacttccac

SEQ ID NO: 293263 - DNA, 25 bp, Mus musculus
caaagacaagatcccgtgcctttca

SEQ ID NO: 293264 - DNA, 25 bp, Mus musculus
caaagacaagatgccgtgcctttca

SEQ ID NO: 293265 - DNA, 25 bp, Mus musculus
caaagacaagtgacgcagcctgctc

SEQ ID NO: 293266 - DNA, 25 bp, Mus musculus
caaagacaagtgtcgcagcctgctc

SEQ ID NO: 293267 - DNA, 25 bp, Mus musculus
caaagacactatcacccactggtaa

SEQ ID NO: 293268 - DNA, 25 bp, Mus musculus
caaagacactatgacccactggtaa

SEQ ID NO: 293269 - DNA, 25 bp, Mus musculus
caaagacagcggacggccttaacta

SEQ ID NO: 293270 - DNA, 25 bp, Mus musculus
caaagacagcggtcggccttaacta

SEQ ID NO: 293271 - DNA, 25 bp, Mus musculus
caaagacagggtacctttgtctctt

SEQ ID NO: 293272 - DNA, 25 bp, Mus musculus
caaagacagggttcctttgtctctt

SEQ ID NO: 293273 - DNA, 25 bp, Mus musculus
caaagacatcatatggcaagcagga

SEQ ID NO: 293274 - DNA, 25 bp, Mus musculus
caaagacatcatttggcaagcagga

SEQ ID NO: 293275 - DNA, 25 bp, Mus musculus
caaagacatggcactgtgacctttc

SEQ ID NO: 293276 - DNA, 25 bp, Mus musculus
caaagacatggctctgtgacctttc

SEQ ID NO: 293277 - DNA, 25 bp, Mus musculus
caaagacattgcactcacagttgag

SEQ ID NO: 293278 - DNA, 25 bp, Mus musculus
caaagacattgctctcacagttgag

SEQ ID NO: 293279 - DNA, 25 bp, Mus musculus
caaagaccaaggagggagggcaaat

SEQ ID NO: 293280 - DNA, 25 bp, Mus musculus
caaagaccaaggtgggagggcaaat

SEQ ID NO: 293281 - DNA, 25 bp, Mus musculus
caaagaccaagtacttgaccctggg

SEQ ID NO: 293282 - DNA, 25 bp, Mus musculus
caaagaccaagttcttgaccctggg

SEQ ID NO: 293283 - DNA, 25 bp, Mus musculus
caaagaccagacaccaaaatggaaa

SEQ ID NO: 293284 - DNA, 25 bp, Mus musculus
caaagaccagactccaaaatggaaa

SEQ ID NO: 293285 - DNA, 25 bp, Mus musculus
caaagaccagctcttcatgcaggag

SEQ ID NO: 293286 - DNA, 25 bp, Mus musculus
caaagaccagctgttcatgcaggag

SEQ ID NO: 293287 - DNA, 25 bp, Mus musculus
caaagaccatctacatgcagtgtat

SEQ ID NO: 293288 - DNA, 25 bp, Mus musculus
caaagaccatcttcatgcagtgtat

SEQ ID NO: 293289 - DNA, 25 bp, Mus musculus
caaagacccccaattagagcatgag

SEQ ID NO: 293290 - DNA, 25 bp, Mus musculus
caaagacccccatttagagcatgag

SEQ ID NO: 293291 - DNA, 25 bp, Mus musculus
caaagacccctcacagttgtttaga

SEQ ID NO: 293292 - DNA, 25 bp, Mus musculus
caaagacccctctcagttgtttaga

SEQ ID NO: 293293 - DNA, 25 bp, Mus musculus
caaagaccccttacaaatggcacag

SEQ ID NO: 293294 - DNA, 25 bp, Mus musculus
caaagacccctttcaaatggcacag

SEQ ID NO: 293295 - DNA, 25 bp, Mus musculus
caaagaccgccaatccagggacaat

SEQ ID NO: 293296 - DNA, 25 bp, Mus musculus
caaagaccgccattccagggacaat

SEQ ID NO: 293297 - DNA, 25 bp, Mus musculus
caaagacctaagatcagatccctga

SEQ ID NO: 293298 - DNA, 25 bp, Mus musculus
caaagacctaagttcagatccctga

SEQ ID NO: 293299 - DNA, 25 bp, Mus musculus
caaagacctggtacctaacaccaga

SEQ ID NO: 293300 - DNA, 25 bp, Mus musculus
caaagacctggttcctaacaccaga

SEQ ID NO: 293301 - DNA, 25 bp, Mus musculus
caaagacctgttaagctgcctagat

SEQ ID NO: 293302 - DNA, 25 bp, Mus musculus
caaagacctgttccgggaccacaag

SEQ ID NO: 293303 - DNA, 25 bp, Mus musculus
caaagacctgttgcgggaccacaag

SEQ ID NO: 293304 - DNA, 25 bp, Mus musculus
caaagacctgtttagctgcctagat

SEQ ID NO: 293305 - DNA, 25 bp, Mus musculus
caaagaccttttcaaccatgccttt

SEQ ID NO: 293306 - DNA, 25 bp, Mus musculus
caaagaccttttgaaccatgccttt

SEQ ID NO: 293307 - DNA, 25 bp, Mus musculus
caaagacgatataagctcagatgat

SEQ ID NO: 293308 - DNA, 25 bp, Mus musculus
caaagacgatattagctcagatgat

SEQ ID NO: 293309 - DNA, 25 bp, Mus musculus
caaagactagctcaaagactcggta

SEQ ID NO: 293310 - DNA, 25 bp, Mus musculus
caaagactagctgaaagactcggta

SEQ ID NO: 293311 - DNA, 25 bp, Mus musculus
caaagactcggaaccaagctgctgg

SEQ ID NO: 293312 - DNA, 25 bp, Mus musculus
caaagactcggatccaagctgctgg

SEQ ID NO: 293313 - DNA, 25 bp, Mus musculus
caaagactctccatgttgtttaaaa

SEQ ID NO: 293314 - DNA, 25 bp, Mus musculus
caaagactctccttgttgtttaaaa

SEQ ID NO: 293315 - DNA, 25 bp, Mus musculus
caaagactctttctaaggcccaacg

SEQ ID NO: 293316 - DNA, 25 bp, Mus musculus
caaagactctttgtaaggcccaacg

SEQ ID NO: 293317 - DNA, 25 bp, Mus musculus
caaagactgagtcttcctggtggat

SEQ ID NO: 293318 - DNA, 25 bp, Mus musculus
caaagactgagtgttcctggtggat

SEQ ID NO: 293319 - DNA, 25 bp, Mus musculus
caaagactgcagacggcagggctgc

SEQ ID NO: 293320 - DNA, 25 bp, Mus musculus
caaagactgcagtcggcagggctgc

SEQ ID NO: 293321 - DNA, 25 bp, Mus musculus
caaagactgcctataggaccattaa

SEQ ID NO: 293322 - DNA, 25 bp, Mus musculus
caaagactgcctttaggaccattaa

SEQ ID NO: 293323 - DNA, 25 bp, Mus musculus
caaagactgggcaattttttcatag

SEQ ID NO: 293324 - DNA, 25 bp, Mus musculus
caaagactgggctattttttcatag

SEQ ID NO: 293325 - DNA, 25 bp, Mus musculus
caaagacttacacgatgcggtcaga

SEQ ID NO: 293326 - DNA, 25 bp, Mus musculus
caaagacttacaggatgcggtcaga

SEQ ID NO: 293327 - DNA, 25 bp, Mus musculus
caaagacttataacggccctgcctt

SEQ ID NO: 293328 - DNA, 25 bp, Mus musculus
caaagacttatatcggccctgcctt

SEQ ID NO: 293329 - DNA, 25 bp, Mus musculus
caaagacttggaccctggccataga

SEQ ID NO: 293330 - DNA, 25 bp, Mus musculus
caaagacttggagcctggccataga

SEQ ID NO: 293331 - DNA, 25 bp, Mus musculus
caaagacttggtacatgagatgctg

SEQ ID NO: 293332 - DNA, 25 bp, Mus musculus
caaagacttggttcatgagatgctg

SEQ ID NO: 293333 - DNA, 25 bp, Mus musculus
caaagactttagagtgaagcccggg

SEQ ID NO: 293334 - DNA, 25 bp, Mus musculus
caaagactttagtgtgaagcccggg

SEQ ID NO: 293335 - DNA, 25 bp, Mus musculus
caaagactttccacaaacccagttg

SEQ ID NO: 293336 - DNA, 25 bp, Mus musculus
caaagactttcctcaaacccagttg

SEQ ID NO: 293337 - DNA, 25 bp, Mus musculus
caaagagaacgtacatgcatgcctg

SEQ ID NO: 293338 - DNA, 25 bp, Mus musculus
caaagagaacgttcatgcatgcctg

SEQ ID NO: 293339 - DNA, 25 bp, Mus musculus
caaagagaagatccctgctatcctg

SEQ ID NO: 293340 - DNA, 25 bp, Mus musculus
caaagagaagatgcctgctatcctg

SEQ ID NO: 293341 - DNA, 25 bp, Mus musculus
caaagagaagcgaatctgtgagtac

SEQ ID NO: 293342 - DNA, 25 bp, Mus musculus
caaagagaagcgtatctgtgagtac

SEQ ID NO: 293343 - DNA, 25 bp, Mus musculus
caaagagaccatcgcttttgcttgc

SEQ ID NO: 293344 - DNA, 25 bp, Mus musculus
caaagagaccatggcttttgcttgc

SEQ ID NO: 293345 - DNA, 25 bp, Mus musculus
caaagagactggctttcacagaggc

SEQ ID NO: 293346 - DNA, 25 bp, Mus musculus
caaagagactgggtttcacagaggc

SEQ ID NO: 293347 - DNA, 25 bp, Mus musculus
caaagagagctgagctaggagcatt

SEQ ID NO: 293348 - DNA, 25 bp, Mus musculus
caaagagagctgtgctaggagcatt

SEQ ID NO: 293349 - DNA, 25 bp, Mus musculus
caaagagagtgcagcaggaagtccg

SEQ ID NO: 293350 - DNA, 25 bp, Mus musculus
caaagagagtgctgcaggaagtccg

SEQ ID NO: 293351 - DNA, 25 bp, Mus musculus
caaagagagtgtctgttccaggata

SEQ ID NO: 293352 - DNA, 25 bp, Mus musculus
caaagagagtgtgtgttccaggata

SEQ ID NO: 293353 - DNA, 25 bp, Mus musculus
caaagagatgatcctgtttctgaga

SEQ ID NO: 293354 - DNA, 25 bp, Mus musculus
caaagagatgatgctgtttctgaga

SEQ ID NO: 293355 - DNA, 25 bp, Mus musculus
caaagagatgtcaactctccccagc

SEQ ID NO: 293356 - DNA, 25 bp, Mus musculus
caaagagatgtctactctccccagc

SEQ ID NO: 293357 - DNA, 25 bp, Mus musculus
caaagagattctcttccttgcccgg

SEQ ID NO: 293358 - DNA, 25 bp, Mus musculus
caaagagattctgttccttgcccgg

SEQ ID NO: 293359 - DNA, 25 bp, Mus musculus
caaagagcacggatcccaagacggg

SEQ ID NO: 293360 - DNA, 25 bp, Mus musculus
caaagagcacggttcccaagacggg

SEQ ID NO: 293361 - DNA, 25 bp, Mus musculus
caaagagccccaattattttctcaa

SEQ ID NO: 293362 - DNA, 25 bp, Mus musculus
caaagagccccatttattttctcaa

SEQ ID NO: 293363 - DNA, 25 bp, Mus musculus
caaagagcggaaaggccaagattgc

SEQ ID NO: 293364 - DNA, 25 bp, Mus musculus
caaagagcggaatggccaagattgc

SEQ ID NO: 293365 - DNA, 25 bp, Mus musculus
caaagagcgggacttttgtcatgta

SEQ ID NO: 293366 - DNA, 25 bp, Mus musculus
caaagagcgggagttttgtcatgta

SEQ ID NO: 293367 - DNA, 25 bp, Mus musculus
caaagagctggacacgcgggtcata

SEQ ID NO: 293368 - DNA, 25 bp, Mus musculus
caaagagctggagacgcgggtcata

SEQ ID NO: 293369 - DNA, 25 bp, Mus musculus
caaagaggacacaaccttttgaatg

SEQ ID NO: 293370 - DNA, 25 bp, Mus musculus
caaagaggacactaccttttgaatg

SEQ ID NO: 293371 - DNA, 25 bp, Mus musculus
caaagaggagcaccgtgaatcacga

SEQ ID NO: 293372 - DNA, 25 bp, Mus musculus
caaagaggagcagcgtgaatcacga

SEQ ID NO: 293373 - DNA, 25 bp, Mus musculus
caaagaggagctaagacctgccctt

SEQ ID NO: 293374 - DNA, 25 bp, Mus musculus
caaagaggagcttagacctgccctt

SEQ ID NO: 293375 - DNA, 25 bp, Mus musculus
caaagaggctcacgctgccatggaa

SEQ ID NO: 293376 - DNA, 25 bp, Mus musculus
caaagaggctcaggctgccatggaa

SEQ ID NO: 293377 - DNA, 25 bp, Mus musculus
caaagaggcttgatggcattttaca

SEQ ID NO: 293378 - DNA, 25 bp, Mus musculus
caaagaggcttgctgtactgtcaca

SEQ ID NO: 293379 - DNA, 25 bp, Mus musculus
caaagaggcttggtgtactgtcaca

SEQ ID NO: 293380 - DNA, 25 bp, Mus musculus
caaagaggcttgttggcattttaca

SEQ ID NO: 293381 - DNA, 25 bp, Mus musculus
caaagagggcaaccctggtgttact

SEQ ID NO: 293382 - DNA, 25 bp, Mus musculus
caaagagggcaagcctggtgttact

SEQ ID NO: 293383 - DNA, 25 bp, Mus musculus
caaagagggcatctttagttttcta

SEQ ID NO: 293384 - DNA, 25 bp, Mus musculus
caaagagggcatgtttagttttcta

SEQ ID NO: 293385 - DNA, 25 bp, Mus musculus
caaagaggttctcatatggctggtg

SEQ ID NO: 293386 - DNA, 25 bp, Mus musculus
caaagaggttctgatatggctggtg

SEQ ID NO: 293387 - DNA, 25 bp, Mus musculus
caaagagtaattattagtctctaat

SEQ ID NO: 293388 - DNA, 25 bp, Mus musculus
caaagagtaatttttagtctctaat

SEQ ID NO: 293389 - DNA, 25 bp, Mus musculus
caaagagtactgaggagtccctggt

SEQ ID NO: 293390 - DNA, 25 bp, Mus musculus
caaagagtactgtggagtccctggt

SEQ ID NO: 293391 - DNA, 25 bp, Mus musculus
caaagagtctctaggaattgtcaga

SEQ ID NO: 293392 - DNA, 25 bp, Mus musculus
caaagagtctcttggaattgtcaga

SEQ ID NO: 293393 - DNA, 25 bp, Mus musculus
caaagagtggtaatggttcggagat

SEQ ID NO: 293394 - DNA, 25 bp, Mus musculus
caaagagtggtattggttcggagat

SEQ ID NO: 293395 - DNA, 25 bp, Mus musculus
caaagagttcacagacctgctggct

SEQ ID NO: 293396 - DNA, 25 bp, Mus musculus
caaagagttcactgacctgctggct

SEQ ID NO: 293397 - DNA, 25 bp, Mus musculus
caaagagttcagacagtattccaga

SEQ ID NO: 293398 - DNA, 25 bp, Mus musculus
caaagagttcagtcagtattccaga

SEQ ID NO: 293399 - DNA, 25 bp, Mus musculus
caaagagttcctcaacattgatgtt

SEQ ID NO: 293400 - DNA, 25 bp, Mus musculus
caaagagttcctgaacattgatgtt

SEQ ID NO: 293401 - DNA, 25 bp, Mus musculus
caaagagttctgctatagccagggc

SEQ ID NO: 293402 - DNA, 25 bp, Mus musculus
caaagagttctggtatagccagggc

SEQ ID NO: 293403 - DNA, 25 bp, Mus musculus
caaagagttgtactgccctgtgtga

SEQ ID NO: 293404 - DNA, 25 bp, Mus musculus
caaagagttgtagtgccctgtgtga

SEQ ID NO: 293405 - DNA, 25 bp, Mus musculus
caaagagttgtgaggtcctggcccc

SEQ ID NO: 293406 - DNA, 25 bp, Mus musculus
caaagagttgtgtggtcctggcccc

SEQ ID NO: 293407 - DNA, 25 bp, Mus musculus
caaagagtttcaccatcgacagcat

SEQ ID NO: 293408 - DNA, 25 bp, Mus musculus
caaagagtttcagcatcgacagcat

SEQ ID NO: 293409 - DNA, 25 bp, Mus musculus
caaagatacggtagtctgtgcagac

SEQ ID NO: 293410 - DNA, 25 bp, Mus musculus
caaagatacggttgtctgtgcagac

SEQ ID NO: 293411 - DNA, 25 bp, Mus musculus
caaagatacttccaaatgtaacatc

SEQ ID NO: 293412 - DNA, 25 bp, Mus musculus
caaagatacttcgaaatgtaacatc

SEQ ID NO: 293413 - DNA, 25 bp, Mus musculus
caaagatatgggaggacaggactgt

SEQ ID NO: 293414 - DNA, 25 bp, Mus musculus
caaagatatgggtggacaggactgt

SEQ ID NO: 293415 - DNA, 25 bp, Mus musculus
caaagatcaaacactccagggtccc

SEQ ID NO: 293416 - DNA, 25 bp, Mus musculus
caaagatcaaactctccagggtccc

SEQ ID NO: 293417 - DNA, 25 bp, Mus musculus
caaagatcaaataactctcccagcc

SEQ ID NO: 293418 - DNA, 25 bp, Mus musculus
caaagatcaaattactctcccagcc

SEQ ID NO: 293419 - DNA, 25 bp, Mus musculus
caaagatcccagctggagcaaccct

SEQ ID NO: 293420 - DNA, 25 bp, Mus musculus
caaagatcccaggtggagcaaccct

SEQ ID NO: 293421 - DNA, 25 bp, Mus musculus
caaagatctctgattggagcaggca

SEQ ID NO: 293422 - DNA, 25 bp, Mus musculus
caaagatctctgtttggagcaggca

SEQ ID NO: 293423 - DNA, 25 bp, Mus musculus
caaagatctgtaacgggttgtccct

SEQ ID NO: 293424 - DNA, 25 bp, Mus musculus
caaagatctgtatcgggttgtccct

SEQ ID NO: 293425 - DNA, 25 bp, Mus musculus
caaagatgagtcatggtcttattgt

SEQ ID NO: 293426 - DNA, 25 bp, Mus musculus
caaagatgagtcttggtcttattgt

SEQ ID NO: 293427 - DNA, 25 bp, Mus musculus
caaagatgattgaacggcccggccg

SEQ ID NO: 293428 - DNA, 25 bp, Mus musculus
caaagatgattgtacggcccggccg

SEQ ID NO: 293429 - DNA, 25 bp, Mus musculus
caaagatgccttatctaccgtagaa

SEQ ID NO: 293430 - DNA, 25 bp, Mus musculus
caaagatgccttttctaccgtagaa

SEQ ID NO: 293431 - DNA, 25 bp, Mus musculus
caaagatgctctcaggcctcagaac

SEQ ID NO: 293432 - DNA, 25 bp, Mus musculus
caaagatgctctgaggcctcagaac

SEQ ID NO: 293433 - DNA, 25 bp, Mus musculus
caaagatggcttagctagcagcata

SEQ ID NO: 293434 - DNA, 25 bp, Mus musculus
caaagatggctttgctagcagcata

SEQ ID NO: 293435 - DNA, 25 bp, Mus musculus
caaagatgggagactctgcactgca

SEQ ID NO: 293436 - DNA, 25 bp, Mus musculus
caaagatgggagtctctgcactgca

SEQ ID NO: 293437 - DNA, 25 bp, Mus musculus
caaagatggtcgagatggtgctcat

SEQ ID NO: 293438 - DNA, 25 bp, Mus musculus
caaagatggtcgtgatggtgctcat

SEQ ID NO: 293439 - DNA, 25 bp, Mus musculus
caaagattagaacggcctccgcctc

SEQ ID NO: 293440 - DNA, 25 bp, Mus musculus
caaagattagaagggcctccgcctc

SEQ ID NO: 293441 - DNA, 25 bp, Mus musculus
caaagattatttattcagtgtatat

SEQ ID NO: 293442 - DNA, 25 bp, Mus musculus
caaagattattttttcagtgtatat

SEQ ID NO: 293443 - DNA, 25 bp, Mus musculus
caaagatttattaacccgctgagcc

SEQ ID NO: 293444 - DNA, 25 bp, Mus musculus
caaagatttatttacccgctgagcc

SEQ ID NO: 293445 - DNA, 25 bp, Mus musculus
caaagatttgaacgtcagtctggac

SEQ ID NO: 293446 - DNA, 25 bp, Mus musculus
caaagatttgaaggtcagtctggac

SEQ ID NO: 293447 - DNA, 25 bp, Mus musculus
caaagattttctactgatggattaa

SEQ ID NO: 293448 - DNA, 25 bp, Mus musculus
caaagattttcttctgatggattaa

SEQ ID NO: 293449 - DNA, 25 bp, Mus musculus
caaagcaaaattcttcttcctcttc

SEQ ID NO: 293450 - DNA, 25 bp, Mus musculus
caaagcaaaattgttcttcctcttc

SEQ ID NO: 293451 - DNA, 25 bp, Mus musculus
caaagcaacactcgccttctgatca

SEQ ID NO: 293452 - DNA, 25 bp, Mus musculus
caaagcaacactggccttctgatca

SEQ ID NO: 293453 - DNA, 25 bp, Mus musculus
caaagcaacattcgccaactatcct

SEQ ID NO: 293454 - DNA, 25 bp, Mus musculus
caaagcaacattggccaactatcct

SEQ ID NO: 293455 - DNA, 25 bp, Mus musculus
caaagcaaccttcgcaccattagaa

SEQ ID NO: 293456 - DNA, 25 bp, Mus musculus
caaagcaaccttggcaccattagaa

SEQ ID NO: 293457 - DNA, 25 bp, Mus musculus
caaagcaactttctcatcctcaaca

SEQ ID NO: 293458 - DNA, 25 bp, Mus musculus
caaagcaactttgtcatcctcaaca

SEQ ID NO: 293459 - DNA, 25 bp, Mus musculus
caaagcacaaacctgctgggctcaa

SEQ ID NO: 293460 - DNA, 25 bp, Mus musculus
caaagcacaaacgtgctgggctcaa

SEQ ID NO: 293461 - DNA, 25 bp, Mus musculus
caaagcacagatccccagcggagca

SEQ ID NO: 293462 - DNA, 25 bp, Mus musculus
caaagcacagatgcccagcggagca

SEQ ID NO: 293463 - DNA, 25 bp, Mus musculus
caaagcacagtcaccctgttttggt

SEQ ID NO: 293464 - DNA, 25 bp, Mus musculus
caaagcacagtctccctgttttggt

SEQ ID NO: 293465 - DNA, 25 bp, Mus musculus
caaagcaccagtagttgacctgaat

SEQ ID NO: 293466 - DNA, 25 bp, Mus musculus
caaagcaccagttgttgacctgaat

SEQ ID NO: 293467 - DNA, 25 bp, Mus musculus
caaagcacccaacattcagcgactt

SEQ ID NO: 293468 - DNA, 25 bp, Mus musculus
caaagcacccaacttagaggaaagg

SEQ ID NO: 293469 - DNA, 25 bp, Mus musculus
caaagcacccaagattcagcgactt

SEQ ID NO: 293470 - DNA, 25 bp, Mus musculus
caaagcacccaagttagaggaaagg

SEQ ID NO: 293471 - DNA, 25 bp, Mus musculus
caaagcacccatacatgcaagtaat

SEQ ID NO: 293472 - DNA, 25 bp, Mus musculus
caaagcacccatagtgtggacacca

SEQ ID NO: 293473 - DNA, 25 bp, Mus musculus
caaagcacccattcatgcaagtaat

SEQ ID NO: 293474 - DNA, 25 bp, Mus musculus
caaagcacccattgtgtggacacca

SEQ ID NO: 293475 - DNA, 25 bp, Mus musculus
caaagcaccttgcttgaagatgagt

SEQ ID NO: 293476 - DNA, 25 bp, Mus musculus
caaagcaccttggttgaagatgagt

SEQ ID NO: 293477 - DNA, 25 bp, Mus musculus
caaagcactcggaaactcggaattt

SEQ ID NO: 293478 - DNA, 25 bp, Mus musculus
caaagcactcggtaactcggaattt

SEQ ID NO: 293479 - DNA, 25 bp, Mus musculus
caaagcactcttatcagtggaacaa

SEQ ID NO: 293480 - DNA, 25 bp, Mus musculus
caaagcactcttttcagtggaacaa

SEQ ID NO: 293481 - DNA, 25 bp, Mus musculus
caaagcactttgcaggaggcctgcc

SEQ ID NO: 293482 - DNA, 25 bp, Mus musculus
caaagcactttggaggaggcctgcc

SEQ ID NO: 293483 - DNA, 25 bp, Mus musculus
caaagcagacatcctcctatggagg

SEQ ID NO: 293484 - DNA, 25 bp, Mus musculus
caaagcagacatgctcctatggagg

SEQ ID NO: 293485 - DNA, 25 bp, Mus musculus
caaagcagccatagtgcgaagaaag

SEQ ID NO: 293486 - DNA, 25 bp, Mus musculus
caaagcagccattgtgcgaagaaag

SEQ ID NO: 293487 - DNA, 25 bp, Mus musculus
caaagcagcccacggttctcggaga

SEQ ID NO: 293488 - DNA, 25 bp, Mus musculus
caaagcagcccagggttctcggaga

SEQ ID NO: 293489 - DNA, 25 bp, Mus musculus
caaagcagctgcaaccttattttag

SEQ ID NO: 293490 - DNA, 25 bp, Mus musculus
caaagcagctgctaccttattttag

SEQ ID NO: 293491 - DNA, 25 bp, Mus musculus
caaagcagctgtctccttgatttca

SEQ ID NO: 293492 - DNA, 25 bp, Mus musculus
caaagcagctgtgtccttgatttca

SEQ ID NO: 293493 - DNA, 25 bp, Mus musculus
caaagcaggacaaggatgcctggaa

SEQ ID NO: 293494 - DNA, 25 bp, Mus musculus
caaagcaggacatggatgcctggaa

SEQ ID NO: 293495 - DNA, 25 bp, Mus musculus
caaagcaggccccagccgcctggat

SEQ ID NO: 293496 - DNA, 25 bp, Mus musculus
caaagcaggcccgagccgcctggat

SEQ ID NO: 293497 - DNA, 25 bp, Mus musculus
caaagcaggcgtcttgaagtaaatt

SEQ ID NO: 293498 - DNA, 25 bp, Mus musculus
caaagcaggcgtgttgaagtaaatt

SEQ ID NO: 293499 - DNA, 25 bp, Mus musculus
caaagcaggtagcactcctccttat

SEQ ID NO: 293500 - DNA, 25 bp, Mus musculus
caaagcaggtaggactcctccttat

SEQ ID NO: 293501 - DNA, 25 bp, Mus musculus
caaagcagtctgctctaacatctac

SEQ ID NO: 293502 - DNA, 25 bp, Mus musculus
caaagcagtctggtctaacatctac

SEQ ID NO: 293503 - DNA, 25 bp, Mus musculus
caaagcagtgacatagaccgtatta

SEQ ID NO: 293504 - DNA, 25 bp, Mus musculus
caaagcagtgacttagaccgtatta

SEQ ID NO: 293505 - DNA, 25 bp, Mus musculus
caaagcagtgtcctgtgaggcctaa

SEQ ID NO: 293506 - DNA, 25 bp, Mus musculus
caaagcagtgtcgtgtgaggcctaa

SEQ ID NO: 293507 - DNA, 25 bp, Mus musculus
caaagcatacctaccatctttggag

SEQ ID NO: 293508 - DNA, 25 bp, Mus musculus
caaagcataccttccatctttggag

SEQ ID NO: 293509 - DNA, 25 bp, Mus musculus
caaagcataggaaagcgttcctccc

SEQ ID NO: 293510 - DNA, 25 bp, Mus musculus
caaagcataggacaaatttctttaa

SEQ ID NO: 293511 - DNA, 25 bp, Mus musculus
caaagcataggagaaatttctttaa

SEQ ID NO: 293512 - DNA, 25 bp, Mus musculus
caaagcataggatagcgttcctccc

SEQ ID NO: 293513 - DNA, 25 bp, Mus musculus
caaagcatatctctcaactctgaaa

SEQ ID NO: 293514 - DNA, 25 bp, Mus musculus
caaagcatatctgtcaactctgaaa

SEQ ID NO: 293515 - DNA, 25 bp, Mus musculus
caaagcatcaacaatgtacaggata

SEQ ID NO: 293516 - DNA, 25 bp, Mus musculus
caaagcatcaactatgtacaggata

SEQ ID NO: 293517 - DNA, 25 bp, Mus musculus
caaagcatggtgcaagtgacattaa

SEQ ID NO: 293518 - DNA, 25 bp, Mus musculus
caaagcatggtggaagtgacattaa

SEQ ID NO: 293519 - DNA, 25 bp, Mus musculus
caaagcattaccaacctgcagaata

SEQ ID NO: 293520 - DNA, 25 bp, Mus musculus
caaagcattacctacctgcagaata

SEQ ID NO: 293521 - DNA, 25 bp, Mus musculus
caaagcattcttatgcatgtcttta

SEQ ID NO: 293522 - DNA, 25 bp, Mus musculus
caaagcattcttttgcatgtcttta

SEQ ID NO: 293523 - DNA, 25 bp, Mus musculus
caaagcatttgtcccaggttccctg

SEQ ID NO: 293524 - DNA, 25 bp, Mus musculus
caaagcatttgtgccaggttccctg

SEQ ID NO: 293525 - DNA, 25 bp, Mus musculus
caaagccaaataatcactacactaa

SEQ ID NO: 293526 - DNA, 25 bp, Mus musculus
caaagccaaatattcactacactaa

SEQ ID NO: 293527 - DNA, 25 bp, Mus musculus
caaagccaagacagggattagtggt

SEQ ID NO: 293528 - DNA, 25 bp, Mus musculus
caaagccaagactgggattagtggt

SEQ ID NO: 293529 - DNA, 25 bp, Mus musculus
caaagccaagcgactagtagtgcat

SEQ ID NO: 293530 - DNA, 25 bp, Mus musculus
caaagccaagcgtctagtagtgcat

SEQ ID NO: 293531 - DNA, 25 bp, Mus musculus
caaagccacattaacggattagcat

SEQ ID NO: 293532 - DNA, 25 bp, Mus musculus
caaagccacatttacggattagcat

SEQ ID NO: 293533 - DNA, 25 bp, Mus musculus
caaagccactagagggtccaaaaga

SEQ ID NO: 293534 - DNA, 25 bp, Mus musculus
caaagccactagtgggtccaaaaga

SEQ ID NO: 293535 - DNA, 25 bp, Mus musculus
caaagccactttaaatccttgaagg

SEQ ID NO: 293536 - DNA, 25 bp, Mus musculus
caaagccacttttaatccttgaagg

SEQ ID NO: 293537 - DNA, 25 bp, Mus musculus
caaagccagactatgctgtcacttt

SEQ ID NO: 293538 - DNA, 25 bp, Mus musculus
caaagccagactttgctgtcacttt

SEQ ID NO: 293539 - DNA, 25 bp, Mus musculus
caaagccagagtctccctcagatat

SEQ ID NO: 293540 - DNA, 25 bp, Mus musculus
caaagccagagtgtccctcagatat

SEQ ID NO: 293541 - DNA, 25 bp, Mus musculus
caaagccagcctaagacataagaga

SEQ ID NO: 293542 - DNA, 25 bp, Mus musculus
caaagccagccttagacataagaga

SEQ ID NO: 293543 - DNA, 25 bp, Mus musculus
caaagccaggacacaagctcgggtg

SEQ ID NO: 293544 - DNA, 25 bp, Mus musculus
caaagccaggactcaagctcgggtg

SEQ ID NO: 293545 - DNA, 25 bp, Mus musculus
caaagccaggagcgttggaatttat

SEQ ID NO: 293546 - DNA, 25 bp, Mus musculus
caaagccaggagggttggaatttat

SEQ ID NO: 293547 - DNA, 25 bp, Mus musculus
caaagccagggcaggtaagaactga

SEQ ID NO: 293548 - DNA, 25 bp, Mus musculus
caaagccagggctggtaagaactga

SEQ ID NO: 293549 - DNA, 25 bp, Mus musculus
caaagccatataatcctgtgcctag

SEQ ID NO: 293550 - DNA, 25 bp, Mus musculus
caaagccatatattcctgtgcctag

SEQ ID NO: 293551 - DNA, 25 bp, Mus musculus
caaagcccaagaacagcggcggtct

SEQ ID NO: 293552 - DNA, 25 bp, Mus musculus
caaagcccaagatcagcggcggtct

SEQ ID NO: 293553 - DNA, 25 bp, Mus musculus
caaagcccacttctggagttcctta

SEQ ID NO: 293554 - DNA, 25 bp, Mus musculus
caaagcccacttgtggagttcctta

SEQ ID NO: 293555 - DNA, 25 bp, Mus musculus
caaagcccagacactggaccagtgg

SEQ ID NO: 293556 - DNA, 25 bp, Mus musculus
caaagcccagactctggaccagtgg

SEQ ID NO: 293557 - DNA, 25 bp, Mus musculus
caaagcccagctctttgttcagttg

SEQ ID NO: 293558 - DNA, 25 bp, Mus musculus
caaagcccagctgtttgttcagttg

SEQ ID NO: 293559 - DNA, 25 bp, Mus musculus
caaagccccaatattgagtctggtt

SEQ ID NO: 293560 - DNA, 25 bp, Mus musculus
caaagccccaattttgagtctggtt

SEQ ID NO: 293561 - DNA, 25 bp, Mus musculus
caaagccccatgaccaaagagaaag

SEQ ID NO: 293562 - DNA, 25 bp, Mus musculus
caaagccccatgtccaaagagaaag

SEQ ID NO: 293563 - DNA, 25 bp, Mus musculus
caaagccccgagatagcattcggaa

SEQ ID NO: 293564 - DNA, 25 bp, Mus musculus
caaagccccgagttagcattcggaa

SEQ ID NO: 293565 - DNA, 25 bp, Mus musculus
caaagcccctagagctgagttctca

SEQ ID NO: 293566 - DNA, 25 bp, Mus musculus
caaagcccctagtgctgagttctca

SEQ ID NO: 293567 - DNA, 25 bp, Mus musculus
caaagcccctataagcctcatgtgg

SEQ ID NO: 293568 - DNA, 25 bp, Mus musculus
caaagcccctattagcctcatgtgg

SEQ ID NO: 293569 - DNA, 25 bp, Mus musculus
caaagcccgatgaggttggtgttgc

SEQ ID NO: 293570 - DNA, 25 bp, Mus musculus
caaagcccgatgtggttggtgttgc

SEQ ID NO: 293571 - DNA, 25 bp, Mus musculus
caaagcccgccaagggaccctgaag

SEQ ID NO: 293572 - DNA, 25 bp, Mus musculus
caaagcccgccatgggaccctgaag

SEQ ID NO: 293573 - DNA, 25 bp, Mus musculus
caaagccgattactctgttcagact

SEQ ID NO: 293574 - DNA, 25 bp, Mus musculus
caaagccgattagtctgttcagact

SEQ ID NO: 293575 - DNA, 25 bp, Mus musculus
caaagccgccctacgcggtgtggcg

SEQ ID NO: 293576 - DNA, 25 bp, Mus musculus
caaagccgcccttcgcggtgtggcg

SEQ ID NO: 293577 - DNA, 25 bp, Mus musculus
caaagccgggaacgaaaatacattg

SEQ ID NO: 293578 - DNA, 25 bp, Mus musculus
caaagccgggaaggaaaatacattg

SEQ ID NO: 293579 - DNA, 25 bp, Mus musculus
caaagccgtggacaagtgggcttca

SEQ ID NO: 293580 - DNA, 25 bp, Mus musculus
caaagccgtggagaagtgggcttca

SEQ ID NO: 293581 - DNA, 25 bp, Mus musculus
caaagccgtggtccaaacgctggga

SEQ ID NO: 293582 - DNA, 25 bp, Mus musculus
caaagccgtggtgcaaacgctggga

SEQ ID NO: 293583 - DNA, 25 bp, Mus musculus
caaagcctaacacaactctcctggg

SEQ ID NO: 293584 - DNA, 25 bp, Mus musculus
caaagcctaacagaactctcctggg

SEQ ID NO: 293585 - DNA, 25 bp, Mus musculus
caaagcctaagaatatgacaaaata

SEQ ID NO: 293586 - DNA, 25 bp, Mus musculus
caaagcctaagattatgacaaaata

SEQ ID NO: 293587 - DNA, 25 bp, Mus musculus
caaagcctacagactccagagttgt

SEQ ID NO: 293588 - DNA, 25 bp, Mus musculus
caaagcctacagtctccagagttgt

SEQ ID NO: 293589 - DNA, 25 bp, Mus musculus
caaagcctaggcctcaatgacagta

SEQ ID NO: 293590 - DNA, 25 bp, Mus musculus
caaagcctaggcgtcaatgacagta

SEQ ID NO: 293591 - DNA, 25 bp, Mus musculus
caaagcctgcaccaggtgtggctgt

SEQ ID NO: 293592 - DNA, 25 bp, Mus musculus
caaagcctgcacgaggtgtggctgt

SEQ ID NO: 293593 - DNA, 25 bp, Mus musculus
caaagcctgctcatgctggttcaga

SEQ ID NO: 293594 - DNA, 25 bp, Mus musculus
caaagcctgctcttgctggttcaga

SEQ ID NO: 293595 - DNA, 25 bp, Mus musculus
caaagcctgctgagggaaggactca

SEQ ID NO: 293596 - DNA, 25 bp, Mus musculus
caaagcctgctgtgggaaggactca

SEQ ID NO: 293597 - DNA, 25 bp, Mus musculus
caaagcctggaacggactatgacag

SEQ ID NO: 293598 - DNA, 25 bp, Mus musculus
caaagcctggaagggactatgacag

SEQ ID NO: 293599 - DNA, 25 bp, Mus musculus
caaagccttagacgtacccctcagt

SEQ ID NO: 293600 - DNA, 25 bp, Mus musculus
caaagccttagaggtacccctcagt

SEQ ID NO: 293601 - DNA, 25 bp, Mus musculus
caaagccttagtcactttcctctac

SEQ ID NO: 293602 - DNA, 25 bp, Mus musculus
caaagccttagtgactttcctctac

SEQ ID NO: 293603 - DNA, 25 bp, Mus musculus
caaagccttttccagcaaagccagg

SEQ ID NO: 293604 - DNA, 25 bp, Mus musculus
caaagccttttcgagcaaagccagg

SEQ ID NO: 293605 - DNA, 25 bp, Mus musculus
caaagcgaaaagatccctggcgagg

SEQ ID NO: 293606 - DNA, 25 bp, Mus musculus
caaagcgaaaagttccctggcgagg

SEQ ID NO: 293607 - DNA, 25 bp, Mus musculus
caaagcgaaagccgcaggatcgacg

SEQ ID NO: 293608 - DNA, 25 bp, Mus musculus
caaagcgaaagcggcaggatcgacg

SEQ ID NO: 293609 - DNA, 25 bp, Mus musculus
caaagcgaagttcgttatccttgcc

SEQ ID NO: 293610 - DNA, 25 bp, Mus musculus
caaagcgaagttggttatccttgcc

SEQ ID NO: 293611 - DNA, 25 bp, Mus musculus
caaagcgatacaccaccagcgggaa

SEQ ID NO: 293612 - DNA, 25 bp, Mus musculus
caaagcgatacagcaccagcgggaa

SEQ ID NO: 293613 - DNA, 25 bp, Mus musculus
caaagcggaaacagctctatgagtt

SEQ ID NO: 293614 - DNA, 25 bp, Mus musculus
caaagcggaaactgctctatgagtt

SEQ ID NO: 293615 - DNA, 25 bp, Mus musculus
caaagcggtgtacatgagccatcta

SEQ ID NO: 293616 - DNA, 25 bp, Mus musculus
caaagcggtgtagatgagccatcta

SEQ ID NO: 293617 - DNA, 25 bp, Mus musculus
caaagcggtgttcctaatgaaataa

SEQ ID NO: 293618 - DNA, 25 bp, Mus musculus
caaagcggtgttgctaatgaaataa

SEQ ID NO: 293619 - DNA, 25 bp, Mus musculus
caaagcgtgttacagatgtgcagaa

SEQ ID NO: 293620 - DNA, 25 bp, Mus musculus
caaagcgtgttagagatgtgcagaa

SEQ ID NO: 293621 - DNA, 25 bp, Mus musculus
caaagcgtgttcaatcctatttcca

SEQ ID NO: 293622 - DNA, 25 bp, Mus musculus
caaagcgtgttctatcctatttcca

SEQ ID NO: 293623 - DNA, 25 bp, Mus musculus
caaagcgttccgctcacttggagaa

SEQ ID NO: 293624 - DNA, 25 bp, Mus musculus
caaagcgttccggtcacttggagaa

SEQ ID NO: 293625 - DNA, 25 bp, Mus musculus
caaagctaattcagcctgtggctgg

SEQ ID NO: 293626 - DNA, 25 bp, Mus musculus
caaagctaattctgcctgtggctgg

SEQ ID NO: 293627 - DNA, 25 bp, Mus musculus
caaagctaatttcagattcttaact

SEQ ID NO: 293628 - DNA, 25 bp, Mus musculus
caaagctaatttgagattcttaact

SEQ ID NO: 293629 - DNA, 25 bp, Mus musculus
caaagctacattctcctcagagtaa

SEQ ID NO: 293630 - DNA, 25 bp, Mus musculus
caaagctacattgtcctcagagtaa

SEQ ID NO: 293631 - DNA, 25 bp, Mus musculus
caaagctaccatagctggtggtggt

SEQ ID NO: 293632 - DNA, 25 bp, Mus musculus
caaagctaccattgctggtggtggt

SEQ ID NO: 293633 - DNA, 25 bp, Mus musculus
caaagctagctacggtttcctctat

SEQ ID NO: 293634 - DNA, 25 bp, Mus musculus
caaagctagctagggtttcctctat

SEQ ID NO: 293635 - DNA, 25 bp, Mus musculus
caaagctatcctatgccttcaaata

SEQ ID NO: 293636 - DNA, 25 bp, Mus musculus
caaagctatcctttgccttcaaata

SEQ ID NO: 293637 - DNA, 25 bp, Mus musculus
caaagctatcttaccagtccctgtt

SEQ ID NO: 293638 - DNA, 25 bp, Mus musculus
caaagctatctttccagtccctgtt

SEQ ID NO: 293639 - DNA, 25 bp, Mus musculus
caaagctattgaaaactcggcatca

SEQ ID NO: 293640 - DNA, 25 bp, Mus musculus
caaagctattgataactcggcatca

SEQ ID NO: 293641 - DNA, 25 bp, Mus musculus
caaagctccagaagaagacaccctc

SEQ ID NO: 293642 - DNA, 25 bp, Mus musculus
caaagctccagatgaagacaccctc

SEQ ID NO: 293643 - DNA, 25 bp, Mus musculus
caaagctcctacagtttcttcgggt

SEQ ID NO: 293644 - DNA, 25 bp, Mus musculus
caaagctcctactgtttcttcgggt

SEQ ID NO: 293645 - DNA, 25 bp, Mus musculus
caaagctctaccagcatccatgtga

SEQ ID NO: 293646 - DNA, 25 bp, Mus musculus
caaagctctacctgcatccatgtga

SEQ ID NO: 293647 - DNA, 25 bp, Mus musculus
caaagctctgatcccttgctggaga

SEQ ID NO: 293648 - DNA, 25 bp, Mus musculus
caaagctctgatctgacccttagaa

SEQ ID NO: 293649 - DNA, 25 bp, Mus musculus
caaagctctgatgccttgctggaga

SEQ ID NO: 293650 - DNA, 25 bp, Mus musculus
caaagctctgatgtgacccttagaa

SEQ ID NO: 293651 - DNA, 25 bp, Mus musculus
caaagctcttaaaacctgtggttcc

SEQ ID NO: 293652 - DNA, 25 bp, Mus musculus
caaagctcttaatacctgtggttcc

SEQ ID NO: 293653 - DNA, 25 bp, Mus musculus
caaagctctttgcaagccagaagtg

SEQ ID NO: 293654 - DNA, 25 bp, Mus musculus
caaagctctttggaagccagaagtg

SEQ ID NO: 293655 - DNA, 25 bp, Mus musculus
caaagctgccagagcatattttaaa

SEQ ID NO: 293656 - DNA, 25 bp, Mus musculus
caaagctgccagtgcatattttaaa

SEQ ID NO: 293657 - DNA, 25 bp, Mus musculus
caaagctgcctaccgtgctcacaag

SEQ ID NO: 293658 - DNA, 25 bp, Mus musculus
caaagctgcctagcgtgctcacaag

SEQ ID NO: 293659 - DNA, 25 bp, Mus musculus
caaagctgcggacccatcatagctg

SEQ ID NO: 293660 - DNA, 25 bp, Mus musculus
caaagctgcggagccatcatagctg

SEQ ID NO: 293661 - DNA, 25 bp, Mus musculus
caaagctgcgtgcatccgtaagatc

SEQ ID NO: 293662 - DNA, 25 bp, Mus musculus
caaagctgcgtggatccgtaagatc

SEQ ID NO: 293663 - DNA, 25 bp, Mus musculus
caaagctgctatcttctcaatgaaa

SEQ ID NO: 293664 - DNA, 25 bp, Mus musculus
caaagctgctatgttctcaatgaaa

SEQ ID NO: 293665 - DNA, 25 bp, Mus musculus
caaagctgctttactcaaatcgcga

SEQ ID NO: 293666 - DNA, 25 bp, Mus musculus
caaagctgcttttctcaaatcgcga

SEQ ID NO: 293667 - DNA, 25 bp, Mus musculus
caaagctggatgaatgcagtgtcga

SEQ ID NO: 293668 - DNA, 25 bp, Mus musculus
caaagctggatgctgaaaggaccac

SEQ ID NO: 293669 - DNA, 25 bp, Mus musculus
caaagctggatggtgaaaggaccac

SEQ ID NO: 293670 - DNA, 25 bp, Mus musculus
caaagctggatgtatgcagtgtcga

SEQ ID NO: 293671 - DNA, 25 bp, Mus musculus
caaagctggctcataagagagaacc

SEQ ID NO: 293672 - DNA, 25 bp, Mus musculus
caaagctggctcttaagagagaacc

SEQ ID NO: 293673 - DNA, 25 bp, Mus musculus
caaagctggtcaaggcgagggctca

SEQ ID NO: 293674 - DNA, 25 bp, Mus musculus
caaagctggtcatggcgagggctca

SEQ ID NO: 293675 - DNA, 25 bp, Mus musculus
caaagctgtgaaccgctgcgggtca

SEQ ID NO: 293676 - DNA, 25 bp, Mus musculus
caaagctgtgaagcgctgcgggtca

SEQ ID NO: 293677 - DNA, 25 bp, Mus musculus
caaagctgtgctatactcttttttc

SEQ ID NO: 293678 - DNA, 25 bp, Mus musculus
caaagctgtgctttactcttttttc

SEQ ID NO: 293679 - DNA, 25 bp, Mus musculus
caaagctgtggcagctggaacccca

SEQ ID NO: 293680 - DNA, 25 bp, Mus musculus
caaagctgtggctgctggaacccca

SEQ ID NO: 293681 - DNA, 25 bp, Mus musculus
caaagcttcaagatttctttcatca

SEQ ID NO: 293682 - DNA, 25 bp, Mus musculus
caaagcttcaagttttctttcatca

SEQ ID NO: 293683 - DNA, 25 bp, Mus musculus
caaagcttgccccaggcagtagtaa

SEQ ID NO: 293684 - DNA, 25 bp, Mus musculus
caaagcttgcccgaggcagtagtaa

SEQ ID NO: 293685 - DNA, 25 bp, Mus musculus
caaagctttatacgcattgtccaaa

SEQ ID NO: 293686 - DNA, 25 bp, Mus musculus
caaagctttataggcattgtccaaa

SEQ ID NO: 293687 - DNA, 25 bp, Mus musculus
caaagctttatgaaggacccctcaa

SEQ ID NO: 293688 - DNA, 25 bp, Mus musculus
caaagctttatgtaggacccctcaa

SEQ ID NO: 293689 - DNA, 25 bp, Mus musculus
caaagcttttctccaagttccaggg

SEQ ID NO: 293690 - DNA, 25 bp, Mus musculus
caaagcttttctgcaagttccaggg

SEQ ID NO: 293691 - DNA, 25 bp, Mus musculus
caaagctttttgatcaaacaggaca

SEQ ID NO: 293692 - DNA, 25 bp, Mus musculus
caaagctttttgttcaaacaggaca

SEQ ID NO: 293693 - DNA, 25 bp, Mus musculus
caaaggaagcctctacaacaactta

SEQ ID NO: 293694 - DNA, 25 bp, Mus musculus
caaaggaagcctgtacaacaactta

SEQ ID NO: 293695 - DNA, 25 bp, Mus musculus
caaaggaagcttacatgaccccatt

SEQ ID NO: 293696 - DNA, 25 bp, Mus musculus
caaaggaagctttcatgaccccatt

SEQ ID NO: 293697 - DNA, 25 bp, Mus musculus
caaaggaatcctcgccacatgagct

SEQ ID NO: 293698 - DNA, 25 bp, Mus musculus
caaaggaatcctggccacatgagct

SEQ ID NO: 293699 - DNA, 25 bp, Mus musculus
caaaggaatgtcaaggtgcatgata

SEQ ID NO: 293700 - DNA, 25 bp, Mus musculus
caaaggaatgtctaggtgcatgata

SEQ ID NO: 293701 - DNA, 25 bp, Mus musculus
caaaggaattgtaggttcctggaga

SEQ ID NO: 293702 - DNA, 25 bp, Mus musculus
caaaggaattgttggttcctggaga

SEQ ID NO: 293703 - DNA, 25 bp, Mus musculus
caaaggacaggaaggcagatgccct

SEQ ID NO: 293704 - DNA, 25 bp, Mus musculus
caaaggacaggatggcagatgccct

SEQ ID NO: 293705 - DNA, 25 bp, Mus musculus
caaaggaccacccacctggacttga

SEQ ID NO: 293706 - DNA, 25 bp, Mus musculus
caaaggaccaccgacctggacttga

SEQ ID NO: 293707 - DNA, 25 bp, Mus musculus
caaaggaccattaatgtattcttat

SEQ ID NO: 293708 - DNA, 25 bp, Mus musculus
caaaggaccatttatgtattcttat

SEQ ID NO: 293709 - DNA, 25 bp, Mus musculus
caaaggacccgccttggacaacaat

SEQ ID NO: 293710 - DNA, 25 bp, Mus musculus
caaaggacccgcgttggacaacaat

SEQ ID NO: 293711 - DNA, 25 bp, Mus musculus
caaaggacgttgatggatctataat

SEQ ID NO: 293712 - DNA, 25 bp, Mus musculus
caaaggacgttgttggatctataat

SEQ ID NO: 293713 - DNA, 25 bp, Mus musculus
caaaggactccaactgtcagtgaag

SEQ ID NO: 293714 - DNA, 25 bp, Mus musculus
caaaggactccatctgtcagtgaag

SEQ ID NO: 293715 - DNA, 25 bp, Mus musculus
caaaggactcggcttgtctgacatc

SEQ ID NO: 293716 - DNA, 25 bp, Mus musculus
caaaggactcgggttgtctgacatc

SEQ ID NO: 293717 - DNA, 25 bp, Mus musculus
caaaggacttttcaaaggcggtgat

SEQ ID NO: 293718 - DNA, 25 bp, Mus musculus
caaaggacttttgaaaggcggtgat

SEQ ID NO: 293719 - DNA, 25 bp, Mus musculus
caaaggaggatgatacccacttcgt

SEQ ID NO: 293720 - DNA, 25 bp, Mus musculus
caaaggaggatgttacccacttcgt

SEQ ID NO: 293721 - DNA, 25 bp, Mus musculus
caaaggaggcctcatcttcgcgggc

SEQ ID NO: 293722 - DNA, 25 bp, Mus musculus
caaaggaggcctgatcttcgcgggc

SEQ ID NO: 293723 - DNA, 25 bp, Mus musculus
caaaggaggctgagtgatttcatag

SEQ ID NO: 293724 - DNA, 25 bp, Mus musculus
caaaggaggctgtgtgatttcatag

SEQ ID NO: 293725 - DNA, 25 bp, Mus musculus
caaaggagtcaacctgtcacacagg

SEQ ID NO: 293726 - DNA, 25 bp, Mus musculus
caaaggagtcaagctgtcacacagg

SEQ ID NO: 293727 - DNA, 25 bp, Mus musculus
caaaggagtcccaattcccagcaac

SEQ ID NO: 293728 - DNA, 25 bp, Mus musculus
caaaggagtccctattcccagcaac

SEQ ID NO: 293729 - DNA, 25 bp, Mus musculus
caaaggagtcttatcttgtctgaag

SEQ ID NO: 293730 - DNA, 25 bp, Mus musculus
caaaggagtcttttcttgtctgaag

SEQ ID NO: 293731 - DNA, 25 bp, Mus musculus
caaaggagttaactgttgtgttctt

SEQ ID NO: 293732 - DNA, 25 bp, Mus musculus
caaaggagttaagtgttgtgttctt

SEQ ID NO: 293733 - DNA, 25 bp, Mus musculus
caaaggataagacttcccgccctga

SEQ ID NO: 293734 - DNA, 25 bp, Mus musculus
caaaggataagagttcccgccctga

SEQ ID NO: 293735 - DNA, 25 bp, Mus musculus
caaaggatcaaaaccagggtctgat

SEQ ID NO: 293736 - DNA, 25 bp, Mus musculus
caaaggatcaaatccagggtctgat

SEQ ID NO: 293737 - DNA, 25 bp, Mus musculus
caaaggatcctcagaacactcccta

SEQ ID NO: 293738 - DNA, 25 bp, Mus musculus
caaaggatcctctgaacactcccta

SEQ ID NO: 293739 - DNA, 25 bp, Mus musculus
caaaggatgattatacacagggaga

SEQ ID NO: 293740 - DNA, 25 bp, Mus musculus
caaaggatgattttacacagggaga

SEQ ID NO: 293741 - DNA, 25 bp, Mus musculus
caaaggatgcaacaatgaggtctct

SEQ ID NO: 293742 - DNA, 25 bp, Mus musculus
caaaggatgcaagaatgaggtctct

SEQ ID NO: 293743 - DNA, 25 bp, Mus musculus
caaaggatgcccacgaagcggtcat

SEQ ID NO: 293744 - DNA, 25 bp, Mus musculus
caaaggatgccctcgaagcggtcat

SEQ ID NO: 293745 - DNA, 25 bp, Mus musculus
caaaggatggaaagtcttctgtcat

SEQ ID NO: 293746 - DNA, 25 bp, Mus musculus
caaaggatggaatgtcttctgtcat

SEQ ID NO: 293747 - DNA, 25 bp, Mus musculus
caaaggatggagaaccggcctcttt

SEQ ID NO: 293748 - DNA, 25 bp, Mus musculus
caaaggatggagtaccggcctcttt

SEQ ID NO: 293749 - DNA, 25 bp, Mus musculus
caaaggatggtacgtttccagaagt

SEQ ID NO: 293750 - DNA, 25 bp, Mus musculus
caaaggatggtaggtttccagaagt

SEQ ID NO: 293751 - DNA, 25 bp, Mus musculus
caaaggattaccagtcttttcccat

SEQ ID NO: 293752 - DNA, 25 bp, Mus musculus
caaaggattacctgtcttttcccat

SEQ ID NO: 293753 - DNA, 25 bp, Mus musculus
caaaggattctgatctctgacctcc

SEQ ID NO: 293754 - DNA, 25 bp, Mus musculus
caaaggattctgttctctgacctcc

SEQ ID NO: 293755 - DNA, 25 bp, Mus musculus
caaaggcaaaagactgttacactag

SEQ ID NO: 293756 - DNA, 25 bp, Mus musculus
caaaggcaaaagtctgttacactag

SEQ ID NO: 293757 - DNA, 25 bp, Mus musculus
caaaggcaatgcagtgagccactga

SEQ ID NO: 293758 - DNA, 25 bp, Mus musculus
caaaggcaatgctgtgagccactga

SEQ ID NO: 293759 - DNA, 25 bp, Mus musculus
caaaggcactagctttatcctgtaa

SEQ ID NO: 293760 - DNA, 25 bp, Mus musculus
caaaggcactaggtttatcctgtaa

SEQ ID NO: 293761 - DNA, 25 bp, Mus musculus
caaaggcactggagttctgactttc

SEQ ID NO: 293762 - DNA, 25 bp, Mus musculus
caaaggcactggtgttctgactttc

SEQ ID NO: 293763 - DNA, 25 bp, Mus musculus
caaaggcagatgagtattactatgg

SEQ ID NO: 293764 - DNA, 25 bp, Mus musculus
caaaggcagatgtgtattactatgg

SEQ ID NO: 293765 - DNA, 25 bp, Mus musculus
caaaggcaggacaccagctggactt

SEQ ID NO: 293766 - DNA, 25 bp, Mus musculus
caaaggcaggactccagctggactt

SEQ ID NO: 293767 - DNA, 25 bp, Mus musculus
caaaggcaggatcctcaccgtggag

SEQ ID NO: 293768 - DNA, 25 bp, Mus musculus
caaaggcaggatgctcaccgtggag

SEQ ID NO: 293769 - DNA, 25 bp, Mus musculus
caaaggcagtcaacagtggaggaga

SEQ ID NO: 293770 - DNA, 25 bp, Mus musculus
caaaggcagtcatcagtggaggaga

SEQ ID NO: 293771 - DNA, 25 bp, Mus musculus
caaaggcagttaatcccagtggagc

SEQ ID NO: 293772 - DNA, 25 bp, Mus musculus
caaaggcagttattcccagtggagc

SEQ ID NO: 293773 - DNA, 25 bp, Mus musculus
caaaggcagtttctccatcatacgg

SEQ ID NO: 293774 - DNA, 25 bp, Mus musculus
caaaggcagtttgtccatcatacgg

SEQ ID NO: 293775 - DNA, 25 bp, Mus musculus
caaaggcataaactccgtgactgaa

SEQ ID NO: 293776 - DNA, 25 bp, Mus musculus
caaaggcataaagtccgtgactgaa

SEQ ID NO: 293777 - DNA, 25 bp, Mus musculus
caaaggcatacacgaggcagttgtg

SEQ ID NO: 293778 - DNA, 25 bp, Mus musculus
caaaggcatacaggaggcagttgtg

SEQ ID NO: 293779 - DNA, 25 bp, Mus musculus
caaaggcatccaagcagtctgcaga

SEQ ID NO: 293780 - DNA, 25 bp, Mus musculus
caaaggcatccatgcagtctgcaga

SEQ ID NO: 293781 - DNA, 25 bp, Mus musculus
caaaggcatcggacatgtcacggat

SEQ ID NO: 293782 - DNA, 25 bp, Mus musculus
caaaggcatcggtcatgtcacggat

SEQ ID NO: 293783 - DNA, 25 bp, Mus musculus
caaaggccccttccacttgaacaag

SEQ ID NO: 293784 - DNA, 25 bp, Mus musculus
caaaggccccttgcacttgaacaag

SEQ ID NO: 293785 - DNA, 25 bp, Mus musculus
caaaggcccggaaccaggcaggagc

SEQ ID NO: 293786 - DNA, 25 bp, Mus musculus
caaaggcccggatccaggcaggagc

SEQ ID NO: 293787 - DNA, 25 bp, Mus musculus
caaaggccgttactgcatgcagctg

SEQ ID NO: 293788 - DNA, 25 bp, Mus musculus
caaaggccgttagtgcatgcagctg

SEQ ID NO: 293789 - DNA, 25 bp, Mus musculus
caaaggcctgttctgctaatgcatc

SEQ ID NO: 293790 - DNA, 25 bp, Mus musculus
caaaggcctgttgtgctaatgcatc

SEQ ID NO: 293791 - DNA, 25 bp, Mus musculus
caaaggcctttcaccatctaatgag

SEQ ID NO: 293792 - DNA, 25 bp, Mus musculus
caaaggcctttctccatctaatgag

SEQ ID NO: 293793 - DNA, 25 bp, Mus musculus
caaaggcgacctcagttggatatat

SEQ ID NO: 293794 - DNA, 25 bp, Mus musculus
caaaggcgacctgagttggatatat

SEQ ID NO: 293795 - DNA, 25 bp, Mus musculus
caaaggcgctttcgccaagccgcag

SEQ ID NO: 293796 - DNA, 25 bp, Mus musculus
caaaggcgctttggccaagccgcag

SEQ ID NO: 293797 - DNA, 25 bp, Mus musculus
caaaggcgggaaagtctgcgtgcaa

SEQ ID NO: 293798 - DNA, 25 bp, Mus musculus
caaaggcgggaatgtctgcgtgcaa

SEQ ID NO: 293799 - DNA, 25 bp, Mus musculus
caaaggcggtgaaatgtctaagaat

SEQ ID NO: 293800 - DNA, 25 bp, Mus musculus
caaaggcggtgatatgtctaagaat

SEQ ID NO: 293801 - DNA, 25 bp, Mus musculus
caaaggctccctaggcatgttaaaa

SEQ ID NO: 293802 - DNA, 25 bp, Mus musculus
caaaggctcccttggcatgttaaaa

SEQ ID NO: 293803 - DNA, 25 bp, Mus musculus
caaaggctccgacgttgggatcccg

SEQ ID NO: 293804 - DNA, 25 bp, Mus musculus
caaaggctccgaggttgggatcccg

SEQ ID NO: 293805 - DNA, 25 bp, Mus musculus
caaaggctgctcactgtgctagtag

SEQ ID NO: 293806 - DNA, 25 bp, Mus musculus
caaaggctgctctctgtgctagtag

SEQ ID NO: 293807 - DNA, 25 bp, Mus musculus
caaaggcttgttcaatgtgtgtccc

SEQ ID NO: 293808 - DNA, 25 bp, Mus musculus
caaaggcttgttgaatgtgtgtccc

SEQ ID NO: 293809 - DNA, 25 bp, Mus musculus
caaaggctttacctcctggacataa

SEQ ID NO: 293810 - DNA, 25 bp, Mus musculus
caaaggctttacgtcctggacataa

SEQ ID NO: 293811 - DNA, 25 bp, Mus musculus
caaaggctttctctcattgtcttca

SEQ ID NO: 293812 - DNA, 25 bp, Mus musculus
caaaggctttctgtcattgtcttca

SEQ ID NO: 293813 - DNA, 25 bp, Mus musculus
caaagggaacctccaaagggcctgt

SEQ ID NO: 293814 - DNA, 25 bp, Mus musculus
caaagggaacctgcaaagggcctgt

SEQ ID NO: 293815 - DNA, 25 bp, Mus musculus
caaagggaagatcaaactgtgcaat

SEQ ID NO: 293816 - DNA, 25 bp, Mus musculus
caaagggaagatgaaactgtgcaat

SEQ ID NO: 293817 - DNA, 25 bp, Mus musculus
caaagggaattgctgtatgttacta

SEQ ID NO: 293818 - DNA, 25 bp, Mus musculus
caaagggaattggtgtatgttacta

SEQ ID NO: 293819 - DNA, 25 bp, Mus musculus
caaagggactgaaaagactcctcta

SEQ ID NO: 293820 - DNA, 25 bp, Mus musculus
caaagggactgataagactcctcta

SEQ ID NO: 293821 - DNA, 25 bp, Mus musculus
caaagggactttagatccatccttg

SEQ ID NO: 293822 - DNA, 25 bp, Mus musculus
caaagggacttttgatccatccttg

SEQ ID NO: 293823 - DNA, 25 bp, Mus musculus
caaagggagcgtaacggtgaagatc

SEQ ID NO: 293824 - DNA, 25 bp, Mus musculus
caaagggagcgttacggtgaagatc

SEQ ID NO: 293825 - DNA, 25 bp, Mus musculus
caaagggagcttcgtttcctgaaag

SEQ ID NO: 293826 - DNA, 25 bp, Mus musculus
caaagggagcttggtttcctgaaag

SEQ ID NO: 293827 - DNA, 25 bp, Mus musculus
caaagggaggataatgtggctgcta

SEQ ID NO: 293828 - DNA, 25 bp, Mus musculus
caaagggaggattatgtggctgcta

SEQ ID NO: 293829 - DNA, 25 bp, Mus musculus
caaagggaggtcacaatgtgtgact

SEQ ID NO: 293830 - DNA, 25 bp, Mus musculus
caaagggaggtctcaatgtgtgact

SEQ ID NO: 293831 - DNA, 25 bp, Mus musculus
caaagggattgtatcgctgaccccg

SEQ ID NO: 293832 - DNA, 25 bp, Mus musculus
caaagggattgtttcgctgaccccg

SEQ ID NO: 293833 - DNA, 25 bp, Mus musculus
caaagggcacgtacaggacagtaaa

SEQ ID NO: 293834 - DNA, 25 bp, Mus musculus
caaagggcacgttcaggacagtaaa

SEQ ID NO: 293835 - DNA, 25 bp, Mus musculus
caaagggcatgacctcagcacaggg

SEQ ID NO: 293836 - DNA, 25 bp, Mus musculus
caaagggcatgagctcagcacaggg

SEQ ID NO: 293837 - DNA, 25 bp, Mus musculus
caaagggccctgacattagagtcaa

SEQ ID NO: 293838 - DNA, 25 bp, Mus musculus
caaagggccctgtcattagagtcaa

SEQ ID NO: 293839 - DNA, 25 bp, Mus musculus
caaagggcctctcttccacagttaa

SEQ ID NO: 293840 - DNA, 25 bp, Mus musculus
caaagggcctctgttccacagttaa

SEQ ID NO: 293841 - DNA, 25 bp, Mus musculus
caaagggcctgacgcggacaatgct

SEQ ID NO: 293842 - DNA, 25 bp, Mus musculus
caaagggcctgaggcggacaatgct

SEQ ID NO: 293843 - DNA, 25 bp, Mus musculus
caaagggctagtctatgttttttct

SEQ ID NO: 293844 - DNA, 25 bp, Mus musculus
caaagggctagtgtatgttttttct

SEQ ID NO: 293845 - DNA, 25 bp, Mus musculus
caaagggctattccggcagccgcga

SEQ ID NO: 293846 - DNA, 25 bp, Mus musculus
caaagggctattgcggcagccgcga

SEQ ID NO: 293847 - DNA, 25 bp, Mus musculus
caaagggctgaaatttccaactgga

SEQ ID NO: 293848 - DNA, 25 bp, Mus musculus
caaagggctgaattttccaactgga

SEQ ID NO: 293849 - DNA, 25 bp, Mus musculus
caaagggctgtcagatctctatcta

SEQ ID NO: 293850 - DNA, 25 bp, Mus musculus
caaagggctgtctgatctctatcta

SEQ ID NO: 293851 - DNA, 25 bp, Mus musculus
caaagggcttccagagttacactct

SEQ ID NO: 293852 - DNA, 25 bp, Mus musculus
caaagggcttcctgagttacactct

SEQ ID NO: 293853 - DNA, 25 bp, Mus musculus
caaagggcttctatcctgtctaagg

SEQ ID NO: 293854 - DNA, 25 bp, Mus musculus
caaagggcttctttcctgtctaagg

SEQ ID NO: 293855 - DNA, 25 bp, Mus musculus
caaagggcttgcacacgtgtaagat

SEQ ID NO: 293856 - DNA, 25 bp, Mus musculus
caaagggcttgctcacgtgtaagat

SEQ ID NO: 293857 - DNA, 25 bp, Mus musculus
caaagggcttttcgccagaagaaga

SEQ ID NO: 293858 - DNA, 25 bp, Mus musculus
caaagggcttttggccagaagaaga

SEQ ID NO: 293859 - DNA, 25 bp, Mus musculus
caaagggtatgtatcaggtaaggcc

SEQ ID NO: 293860 - DNA, 25 bp, Mus musculus
caaagggtatgtttcaggtaaggcc

SEQ ID NO: 293861 - DNA, 25 bp, Mus musculus
caaagggtgaaaacaaaattgctgt

SEQ ID NO: 293862 - DNA, 25 bp, Mus musculus
caaagggtgaaatcaaaattgctgt

SEQ ID NO: 293863 - DNA, 25 bp, Mus musculus
caaagggtgcatcgagaccatccct

SEQ ID NO: 293864 - DNA, 25 bp, Mus musculus
caaagggtgcatggagaccatccct

SEQ ID NO: 293865 - DNA, 25 bp, Mus musculus
caaagggtgtggctactggccctaa

SEQ ID NO: 293866 - DNA, 25 bp, Mus musculus
caaagggtgtgggtactggccctaa

SEQ ID NO: 293867 - DNA, 25 bp, Mus musculus
caaagggttaggaatgtagctcaat

SEQ ID NO: 293868 - DNA, 25 bp, Mus musculus
caaagggttaggtatgtagctcaat

SEQ ID NO: 293869 - DNA, 25 bp, Mus musculus
caaagggttctgcttctggctttaa

SEQ ID NO: 293870 - DNA, 25 bp, Mus musculus
caaagggttctggttctggctttaa

SEQ ID NO: 293871 - DNA, 25 bp, Mus musculus
caaagggttttaagcagcacctcca

SEQ ID NO: 293872 - DNA, 25 bp, Mus musculus
caaagggttttatgcagcacctcca

SEQ ID NO: 293873 - DNA, 25 bp, Mus musculus
caaaggtacccaaacgaggagccca

SEQ ID NO: 293874 - DNA, 25 bp, Mus musculus
caaaggtacccatacgaggagccca

SEQ ID NO: 293875 - DNA, 25 bp, Mus musculus
caaaggtacctaagtatatgattgc

SEQ ID NO: 293876 - DNA, 25 bp, Mus musculus
caaaggtacctatgtatatgattgc

SEQ ID NO: 293877 - DNA, 25 bp, Mus musculus
caaaggtagggactataagaagcat

SEQ ID NO: 293878 - DNA, 25 bp, Mus musculus
caaaggtagggagtataagaagcat

SEQ ID NO: 293879 - DNA, 25 bp, Mus musculus
caaaggtagtatactgctttcagga

SEQ ID NO: 293880 - DNA, 25 bp, Mus musculus
caaaggtagtattctgctttcagga

SEQ ID NO: 293881 - DNA, 25 bp, Mus musculus
caaaggtattccagtactacagctt

SEQ ID NO: 293882 - DNA, 25 bp, Mus musculus
caaaggtattcctgtactacagctt

SEQ ID NO: 293883 - DNA, 25 bp, Mus musculus
caaaggtcactcaagtgtatgttct

SEQ ID NO: 293884 - DNA, 25 bp, Mus musculus
caaaggtcactctagtgtatgttct

SEQ ID NO: 293885 - DNA, 25 bp, Mus musculus
caaaggtcagaaagggcaggcagca

SEQ ID NO: 293886 - DNA, 25 bp, Mus musculus
caaaggtcagaatgggcaggcagca

SEQ ID NO: 293887 - DNA, 25 bp, Mus musculus
caaaggtcagctcccatggtgcagt

SEQ ID NO: 293888 - DNA, 25 bp, Mus musculus
caaaggtcagctgccatggtgcagt

SEQ ID NO: 293889 - DNA, 25 bp, Mus musculus
caaaggtcatgacctgctgctgttc

SEQ ID NO: 293890 - DNA, 25 bp, Mus musculus
caaaggtcatgactgctggctgctc

SEQ ID NO: 293891 - DNA, 25 bp, Mus musculus
caaaggtcatgagctgctgctgttc

SEQ ID NO: 293892 - DNA, 25 bp, Mus musculus
caaaggtcatgagtgctggctgctc

SEQ ID NO: 293893 - DNA, 25 bp, Mus musculus
caaaggtccaagctcatcactggct

SEQ ID NO: 293894 - DNA, 25 bp, Mus musculus
caaaggtccaaggtcatcactggct

SEQ ID NO: 293895 - DNA, 25 bp, Mus musculus
caaaggtccattcccagagccttgt

SEQ ID NO: 293896 - DNA, 25 bp, Mus musculus
caaaggtccattgccagagccttgt

SEQ ID NO: 293897 - DNA, 25 bp, Mus musculus
caaaggtccggcagtctcctgtctg

SEQ ID NO: 293898 - DNA, 25 bp, Mus musculus
caaaggtccggctgtctcctgtctg

SEQ ID NO: 293899 - DNA, 25 bp, Mus musculus
caaaggtcctgtctactttcttcaa

SEQ ID NO: 293900 - DNA, 25 bp, Mus musculus
caaaggtcctgtgtactttcttcaa

SEQ ID NO: 293901 - DNA, 25 bp, Mus musculus
caaaggtctaatccagtcttgagta

SEQ ID NO: 293902 - DNA, 25 bp, Mus musculus
caaaggtctaatgcagtcttgagta

SEQ ID NO: 293903 - DNA, 25 bp, Mus musculus
caaaggtctactagtcttaacaact

SEQ ID NO: 293904 - DNA, 25 bp, Mus musculus
caaaggtctacttgtcttaacaact

SEQ ID NO: 293905 - DNA, 25 bp, Mus musculus
caaaggtctcagcattgttaatgtt

SEQ ID NO: 293906 - DNA, 25 bp, Mus musculus
caaaggtctcaggattgttaatgtt

SEQ ID NO: 293907 - DNA, 25 bp, Mus musculus
caaaggtctcatccagtgtctgctg

SEQ ID NO: 293908 - DNA, 25 bp, Mus musculus
caaaggtctcatgcagtgtctgctg

SEQ ID NO: 293909 - DNA, 25 bp, Mus musculus
caaaggtctggaactccggagccgg

SEQ ID NO: 293910 - DNA, 25 bp, Mus musculus
caaaggtctggatctccggagccgg

SEQ ID NO: 293911 - DNA, 25 bp, Mus musculus
caaaggtcttacctcagcgctggaa

SEQ ID NO: 293912 - DNA, 25 bp, Mus musculus
caaaggtcttacgtcagcgctggaa

SEQ ID NO: 293913 - DNA, 25 bp, Mus musculus
caaaggtcttcaatcatgggagcat

SEQ ID NO: 293914 - DNA, 25 bp, Mus musculus
caaaggtcttcattcatgggagcat

SEQ ID NO: 293915 - DNA, 25 bp, Mus musculus
caaaggtgagtccttgctacagact

SEQ ID NO: 293916 - DNA, 25 bp, Mus musculus
caaaggtgagtcgttgctacagact

SEQ ID NO: 293917 - DNA, 25 bp, Mus musculus
caaaggtgattgctagacacactaa

SEQ ID NO: 293918 - DNA, 25 bp, Mus musculus
caaaggtgattggtagacacactaa

SEQ ID NO: 293919 - DNA, 25 bp, Mus musculus
caaaggtgcctaagagtgtagccat

SEQ ID NO: 293920 - DNA, 25 bp, Mus musculus
caaaggtgcctatgagtgtagccat

SEQ ID NO: 293921 - DNA, 25 bp, Mus musculus
caaaggtgcgcaaggtgctgcagct

SEQ ID NO: 293922 - DNA, 25 bp, Mus musculus
caaaggtgcgcatggtgctgcagct

SEQ ID NO: 293923 - DNA, 25 bp, Mus musculus
caaaggtggaggacatagagctaca

SEQ ID NO: 293924 - DNA, 25 bp, Mus musculus
caaaggtggaggtcatagagctaca

SEQ ID NO: 293925 - DNA, 25 bp, Mus musculus
caaaggtggagtcaggcttcctgaa

SEQ ID NO: 293926 - DNA, 25 bp, Mus musculus
caaaggtggagtgaggcttcctgaa

SEQ ID NO: 293927 - DNA, 25 bp, Mus musculus
caaaggtggatgatctgctgcaaga

SEQ ID NO: 293928 - DNA, 25 bp, Mus musculus
caaaggtggatgttctgctgcaaga

SEQ ID NO: 293929 - DNA, 25 bp, Mus musculus
caaaggtggcagctggttctattta

SEQ ID NO: 293930 - DNA, 25 bp, Mus musculus
caaaggtggcaggtggttctattta

SEQ ID NO: 293931 - DNA, 25 bp, Mus musculus
caaaggtggtttagcactggcgata

SEQ ID NO: 293932 - DNA, 25 bp, Mus musculus
caaaggtggttttgcactggcgata

SEQ ID NO: 293933 - DNA, 25 bp, Mus musculus
caaaggtgtctcctgtatttccctc

SEQ ID NO: 293934 - DNA, 25 bp, Mus musculus
caaaggtgtctcgtgtatttccctc

SEQ ID NO: 293935 - DNA, 25 bp, Mus musculus
caaaggtgtgtgatactgtgcccag

SEQ ID NO: 293936 - DNA, 25 bp, Mus musculus
caaaggtgtgtgttactgtgcccag

SEQ ID NO: 293937 - DNA, 25 bp, Mus musculus
caaaggttaatgacagggccactta

SEQ ID NO: 293938 - DNA, 25 bp, Mus musculus
caaaggttaatgtcagggccactta

SEQ ID NO: 293939 - DNA, 25 bp, Mus musculus
caaaggttacaaatacagctgtgct

SEQ ID NO: 293940 - DNA, 25 bp, Mus musculus
caaaggttacaattacagctgtgct

SEQ ID NO: 293941 - DNA, 25 bp, Mus musculus
caaaggttacctctttgccatagaa

SEQ ID NO: 293942 - DNA, 25 bp, Mus musculus
caaaggttacctgtttgccatagaa

SEQ ID NO: 293943 - DNA, 25 bp, Mus musculus
caaaggttattactgactgtccgta

SEQ ID NO: 293944 - DNA, 25 bp, Mus musculus
caaaggttattagtgactgtccgta

SEQ ID NO: 293945 - DNA, 25 bp, Mus musculus
caaaggttcttaaccaggctggcat

SEQ ID NO: 293946 - DNA, 25 bp, Mus musculus
caaaggttcttatccaggctggcat

SEQ ID NO: 293947 - DNA, 25 bp, Mus musculus
caaaggttgtccctgcaaaggaacg

SEQ ID NO: 293948 - DNA, 25 bp, Mus musculus
caaaggttgtccgtgcaaaggaacg

SEQ ID NO: 293949 - DNA, 25 bp, Mus musculus
caaaggtttgctagatgtcacatgc

SEQ ID NO: 293950 - DNA, 25 bp, Mus musculus
caaaggtttgcttgatgtcacatgc

SEQ ID NO: 293951 - DNA, 25 bp, Mus musculus
caaaggtttttcatggagactgctg

SEQ ID NO: 293952 - DNA, 25 bp, Mus musculus
caaaggtttttcttggagactgctg

SEQ ID NO: 293953 - DNA, 25 bp, Mus musculus
caaagtacctggatctgcgcaagca

SEQ ID NO: 293954 - DNA, 25 bp, Mus musculus
caaagtacctggttctgcgcaagca

SEQ ID NO: 293955 - DNA, 25 bp, Mus musculus
caaagtactaaacgccactcagaag

SEQ ID NO: 293956 - DNA, 25 bp, Mus musculus
caaagtactaaaggccactcagaag

SEQ ID NO: 293957 - DNA, 25 bp, Mus musculus
caaagtactgtaaaacatcttgttt

SEQ ID NO: 293958 - DNA, 25 bp, Mus musculus
caaagtactgtataacatcttgttt

SEQ ID NO: 293959 - DNA, 25 bp, Mus musculus
caaagtagctatcgggcttgtcacc

SEQ ID NO: 293960 - DNA, 25 bp, Mus musculus
caaagtagctatctgagctcgggtt

SEQ ID NO: 293961 - DNA, 25 bp, Mus musculus
caaagtagctatggggcttgtcacc

SEQ ID NO: 293962 - DNA, 25 bp, Mus musculus
caaagtagctatgtgagctcgggtt

SEQ ID NO: 293963 - DNA, 25 bp, Mus musculus
caaagtagctgactggaccccatac

SEQ ID NO: 293964 - DNA, 25 bp, Mus musculus
caaagtagctgagtggaccccatac

SEQ ID NO: 293965 - DNA, 25 bp, Mus musculus
caaagtaggctgaaaagtctagtaa

SEQ ID NO: 293966 - DNA, 25 bp, Mus musculus
caaagtaggctgtaaagtctagtaa

SEQ ID NO: 293967 - DNA, 25 bp, Mus musculus
caaagtaggcttcaagtcggctata

SEQ ID NO: 293968 - DNA, 25 bp, Mus musculus
caaagtaggcttgaagtcggctata

SEQ ID NO: 293969 - DNA, 25 bp, Mus musculus
caaagtaggtcaaatcacaaggtat

SEQ ID NO: 293970 - DNA, 25 bp, Mus musculus
caaagtaggtcatatcacaaggtat

SEQ ID NO: 293971 - DNA, 25 bp, Mus musculus
caaagtagttggaatctgagcatca

SEQ ID NO: 293972 - DNA, 25 bp, Mus musculus
caaagtagttggtatctgagcatca

SEQ ID NO: 293973 - DNA, 25 bp, Mus musculus
caaagtatacccagtggattgagaa

SEQ ID NO: 293974 - DNA, 25 bp, Mus musculus
caaagtataccctgtggattgagaa

SEQ ID NO: 293975 - DNA, 25 bp, Mus musculus
caaagtatctaaagcagagattctc

SEQ ID NO: 293976 - DNA, 25 bp, Mus musculus
caaagtatctaatgcagagattctc

SEQ ID NO: 293977 - DNA, 25 bp, Mus musculus
caaagtattaatcttgtgcacccaa

SEQ ID NO: 293978 - DNA, 25 bp, Mus musculus
caaagtattaatgttgtgcacccaa

SEQ ID NO: 293979 - DNA, 25 bp, Mus musculus
caaagtattcccataggctagtttc

SEQ ID NO: 293980 - DNA, 25 bp, Mus musculus
caaagtattcccttaggctagtttc

SEQ ID NO: 293981 - DNA, 25 bp, Mus musculus
caaagtatttatcgttctccttgct

SEQ ID NO: 293982 - DNA, 25 bp, Mus musculus
caaagtatttatggttctccttgct

SEQ ID NO: 293983 - DNA, 25 bp, Mus musculus
caaagtcaaattccatgtccagatg

SEQ ID NO: 293984 - DNA, 25 bp, Mus musculus
caaagtcaaattgcatgtccagatg

SEQ ID NO: 293985 - DNA, 25 bp, Mus musculus
caaagtcacaatactcctatctcca

SEQ ID NO: 293986 - DNA, 25 bp, Mus musculus
caaagtcacaattctcctatctcca

SEQ ID NO: 293987 - DNA, 25 bp, Mus musculus
caaagtcagaacacctgtgccttta

SEQ ID NO: 293988 - DNA, 25 bp, Mus musculus
caaagtcagaactcctgtgccttta

SEQ ID NO: 293989 - DNA, 25 bp, Mus musculus
caaagtcagcccaacagttgagctt

SEQ ID NO: 293990 - DNA, 25 bp, Mus musculus
caaagtcagccctacagttgagctt

SEQ ID NO: 293991 - DNA, 25 bp, Mus musculus
caaagtcagggcagcttgtggccaa

SEQ ID NO: 293992 - DNA, 25 bp, Mus musculus
caaagtcagggctgcttgtggccaa

SEQ ID NO: 293993 - DNA, 25 bp, Mus musculus
caaagtcatatcatcccgggaacag

SEQ ID NO: 293994 - DNA, 25 bp, Mus musculus
caaagtcatatcttcccgggaacag

SEQ ID NO: 293995 - DNA, 25 bp, Mus musculus
caaagtcatggcctttgtttcttga

SEQ ID NO: 293996 - DNA, 25 bp, Mus musculus
caaagtcatggcgtttgtttcttga

SEQ ID NO: 293997 - DNA, 25 bp, Mus musculus
caaagtcatgggatttatagttctc

SEQ ID NO: 293998 - DNA, 25 bp, Mus musculus
caaagtcatgggttttatagttctc

SEQ ID NO: 293999 - DNA, 25 bp, Mus musculus
caaagtcattggatccctcaaccaa

SEQ ID NO: 294000 - DNA, 25 bp, Mus musculus
caaagtcattggttccctcaaccaa

SEQ ID NO: 294001 - DNA, 25 bp, Mus musculus
caaagtcattttcccagccattttc

SEQ ID NO: 294002 - DNA, 25 bp, Mus musculus
caaagtcattttgccagccattttc

SEQ ID NO: 294003 - DNA, 25 bp, Mus musculus
caaagtccaaatagtgctacccaga

SEQ ID NO: 294004 - DNA, 25 bp, Mus musculus
caaagtccaaattgtgctacccaga

SEQ ID NO: 294005 - DNA, 25 bp, Mus musculus
caaagtccctacaagaactccaggc

SEQ ID NO: 294006 - DNA, 25 bp, Mus musculus
caaagtccctactagaactccaggc

SEQ ID NO: 294007 - DNA, 25 bp, Mus musculus
caaagtccctggatatggcttacag

SEQ ID NO: 294008 - DNA, 25 bp, Mus musculus
caaagtccctggttatggcttacag

SEQ ID NO: 294009 - DNA, 25 bp, Mus musculus
caaagtccgttcctttctgtggtat

SEQ ID NO: 294010 - DNA, 25 bp, Mus musculus
caaagtccgttcgtttctgtggtat

SEQ ID NO: 294011 - DNA, 25 bp, Mus musculus
caaagtcctcctaaaagtggtctga

SEQ ID NO: 294012 - DNA, 25 bp, Mus musculus
caaagtcctccttaaagtggtctga

SEQ ID NO: 294013 - DNA, 25 bp, Mus musculus
caaagtcctggactcggtcttcaca

SEQ ID NO: 294014 - DNA, 25 bp, Mus musculus
caaagtcctggagtcggtcttcaca

SEQ ID NO: 294015 - DNA, 25 bp, Mus musculus
caaagtcgcatcagtttggacttca

SEQ ID NO: 294016 - DNA, 25 bp, Mus musculus
caaagtcgcatctgtttggacttca

SEQ ID NO: 294017 - DNA, 25 bp, Mus musculus
caaagtcggttaatggtgtctattt

SEQ ID NO: 294018 - DNA, 25 bp, Mus musculus
caaagtcggttattggtgtctattt

SEQ ID NO: 294019 - DNA, 25 bp, Mus musculus
caaagtcgtcttattacgtccgatg

SEQ ID NO: 294020 - DNA, 25 bp, Mus musculus
caaagtcgtctttttacgtccgatg

SEQ ID NO: 294021 - DNA, 25 bp, Mus musculus
caaagtctagtcaccttaggcagtt

SEQ ID NO: 294022 - DNA, 25 bp, Mus musculus
caaagtctagtctccttaggcagtt

SEQ ID NO: 294023 - DNA, 25 bp, Mus musculus
caaagtctatcaactggctcagctc

SEQ ID NO: 294024 - DNA, 25 bp, Mus musculus
caaagtctatcatctggctcagctc

SEQ ID NO: 294025 - DNA, 25 bp, Mus musculus
caaagtctcctcaggtgccctgcag

SEQ ID NO: 294026 - DNA, 25 bp, Mus musculus
caaagtctcctcatttggatgtgaa

SEQ ID NO: 294027 - DNA, 25 bp, Mus musculus
caaagtctcctctggtgccctgcag

SEQ ID NO: 294028 - DNA, 25 bp, Mus musculus
caaagtctcctcttttggatgtgaa

SEQ ID NO: 294029 - DNA, 25 bp, Mus musculus
caaagtctccttatgcttaggtctt

SEQ ID NO: 294030 - DNA, 25 bp, Mus musculus
caaagtctccttttgcttaggtctt

SEQ ID NO: 294031 - DNA, 25 bp, Mus musculus
caaagtctcttcagtgtatacacaa

SEQ ID NO: 294032 - DNA, 25 bp, Mus musculus
caaagtctcttctgtgtatacacaa

SEQ ID NO: 294033 - DNA, 25 bp, Mus musculus
caaagtctgattcctcagtgccggg

SEQ ID NO: 294034 - DNA, 25 bp, Mus musculus
caaagtctgattgctcagtgccggg

SEQ ID NO: 294035 - DNA, 25 bp, Mus musculus
caaagtctgggaagctcatgtccat

SEQ ID NO: 294036 - DNA, 25 bp, Mus musculus
caaagtctgggatgctcatgtccat

SEQ ID NO: 294037 - DNA, 25 bp, Mus musculus
caaagtcttgtgatcggttccccag

SEQ ID NO: 294038 - DNA, 25 bp, Mus musculus
caaagtcttgtgttcggttccccag

SEQ ID NO: 294039 - DNA, 25 bp, Mus musculus
caaagtcttgttcaccgtcatttaa

SEQ ID NO: 294040 - DNA, 25 bp, Mus musculus
caaagtcttgttgaccgtcatttaa

SEQ ID NO: 294041 - DNA, 25 bp, Mus musculus
caaagtctttccaggctttagggct

SEQ ID NO: 294042 - DNA, 25 bp, Mus musculus
caaagtctttcctggctttagggct

SEQ ID NO: 294043 - DNA, 25 bp, Mus musculus
caaagtgacactcagtgcatgtggc

SEQ ID NO: 294044 - DNA, 25 bp, Mus musculus
caaagtgacactgagtgcatgtggc

SEQ ID NO: 294045 - DNA, 25 bp, Mus musculus
caaagtgacttccttataccctagt

SEQ ID NO: 294046 - DNA, 25 bp, Mus musculus
caaagtgacttcgttataccctagt

SEQ ID NO: 294047 - DNA, 25 bp, Mus musculus
caaagtgactttatccccactggat

SEQ ID NO: 294048 - DNA, 25 bp, Mus musculus
caaagtgactttttccccactggat

SEQ ID NO: 294049 - DNA, 25 bp, Mus musculus
caaagtgagataatttatcctcctc

SEQ ID NO: 294050 - DNA, 25 bp, Mus musculus
caaagtgagatattttatcctcctc

SEQ ID NO: 294051 - DNA, 25 bp, Mus musculus
caaagtgagggcatcggttgccttt

SEQ ID NO: 294052 - DNA, 25 bp, Mus musculus
caaagtgagggcttcggttgccttt

SEQ ID NO: 294053 - DNA, 25 bp, Mus musculus
caaagtgattctactgtggctgact

SEQ ID NO: 294054 - DNA, 25 bp, Mus musculus
caaagtgattctagtcacggaggat

SEQ ID NO: 294055 - DNA, 25 bp, Mus musculus
caaagtgattcttctgtggctgact

SEQ ID NO: 294056 - DNA, 25 bp, Mus musculus
caaagtgattcttgtcacggaggat

SEQ ID NO: 294057 - DNA, 25 bp, Mus musculus
caaagtgattgcattaatggtcaca

SEQ ID NO: 294058 - DNA, 25 bp, Mus musculus
caaagtgattgctttaatggtcaca

SEQ ID NO: 294059 - DNA, 25 bp, Mus musculus
caaagtgcaaaccagggtcccgtgg

SEQ ID NO: 294060 - DNA, 25 bp, Mus musculus
caaagtgcaaacgagggtcccgtgg

SEQ ID NO: 294061 - DNA, 25 bp, Mus musculus
caaagtgcagtgctctcttgtgaat

SEQ ID NO: 294062 - DNA, 25 bp, Mus musculus
caaagtgcagtggtctcttgtgaat

SEQ ID NO: 294063 - DNA, 25 bp, Mus musculus
caaagtgccaggctttttggctgaa

SEQ ID NO: 294064 - DNA, 25 bp, Mus musculus
caaagtgccagggtttttggctgaa

SEQ ID NO: 294065 - DNA, 25 bp, Mus musculus
caaagtgcccggagtctctggttta

SEQ ID NO: 294066 - DNA, 25 bp, Mus musculus
caaagtgcccggtgtctctggttta

SEQ ID NO: 294067 - DNA, 25 bp, Mus musculus
caaagtgctcctatctgctgaggaa

SEQ ID NO: 294068 - DNA, 25 bp, Mus musculus
caaagtgctcctttctgctgaggaa

SEQ ID NO: 294069 - DNA, 25 bp, Mus musculus
caaagtgctcttatcaggatgaagt

SEQ ID NO: 294070 - DNA, 25 bp, Mus musculus
caaagtgctcttttcaggatgaagt

SEQ ID NO: 294071 - DNA, 25 bp, Mus musculus
caaagtgctgctcggttcccgggct

SEQ ID NO: 294072 - DNA, 25 bp, Mus musculus
caaagtgctgctgggttcccgggct

SEQ ID NO: 294073 - DNA, 25 bp, Mus musculus
caaagtgctttccaattcgtgttag

SEQ ID NO: 294074 - DNA, 25 bp, Mus musculus
caaagtgctttcgaattcgtgttag

SEQ ID NO: 294075 - DNA, 25 bp, Mus musculus
caaagtggctcacatcttgggaatt

SEQ ID NO: 294076 - DNA, 25 bp, Mus musculus
caaagtggctcagatcttgggaatt

SEQ ID NO: 294077 - DNA, 25 bp, Mus musculus
caaagtgggtccacttgtgggtcag

SEQ ID NO: 294078 - DNA, 25 bp, Mus musculus
caaagtgggtcctcttgtgggtcag

SEQ ID NO: 294079 - DNA, 25 bp, Mus musculus
caaagtgggtgccagcgcatctgat

SEQ ID NO: 294080 - DNA, 25 bp, Mus musculus
caaagtgggtgcgagcgcatctgat

SEQ ID NO: 294081 - DNA, 25 bp, Mus musculus
caaagtggtattacgctgctgggaa

SEQ ID NO: 294082 - DNA, 25 bp, Mus musculus
caaagtggtatttcgctgctgggaa

SEQ ID NO: 294083 - DNA, 25 bp, Mus musculus
caaagtggttgaacgctggaacgag

SEQ ID NO: 294084 - DNA, 25 bp, Mus musculus
caaagtggttgatcgctggaacgag

SEQ ID NO: 294085 - DNA, 25 bp, Mus musculus
caaagtggttgtcatgccaggcagc

SEQ ID NO: 294086 - DNA, 25 bp, Mus musculus
caaagtggttgtgatgccaggcagc

SEQ ID NO: 294087 - DNA, 25 bp, Mus musculus
caaagtggtttaatcacaccaacag

SEQ ID NO: 294088 - DNA, 25 bp, Mus musculus
caaagtggtttattcacaccaacag

SEQ ID NO: 294089 - DNA, 25 bp, Mus musculus
caaagtgtaacaccttcacctggga

SEQ ID NO: 294090 - DNA, 25 bp, Mus musculus
caaagtgtaacagcttcacctggga

SEQ ID NO: 294091 - DNA, 25 bp, Mus musculus
caaagtgtcaagacagtagtaccca

SEQ ID NO: 294092 - DNA, 25 bp, Mus musculus
caaagtgtcaagtcagtagtaccca

SEQ ID NO: 294093 - DNA, 25 bp, Mus musculus
caaagtgtcagcaccacccacaagg

SEQ ID NO: 294094 - DNA, 25 bp, Mus musculus
caaagtgtcagctccacccacaagg

SEQ ID NO: 294095 - DNA, 25 bp, Mus musculus
caaagtgtcgaacggtatatccaaa

SEQ ID NO: 294096 - DNA, 25 bp, Mus musculus
caaagtgtcgaagggtatatccaaa

SEQ ID NO: 294097 - DNA, 25 bp, Mus musculus
caaagtgtctgaaatggcccgtgca

SEQ ID NO: 294098 - DNA, 25 bp, Mus musculus
caaagtgtctgatatggcccgtgca

SEQ ID NO: 294099 - DNA, 25 bp, Mus musculus
caaagtgtgggaaactctctgggct

SEQ ID NO: 294100 - DNA, 25 bp, Mus musculus
caaagtgtgggatactctctgggct

SEQ ID NO: 294101 - DNA, 25 bp, Mus musculus
caaagtgtgggcacctggccaaggc

SEQ ID NO: 294102 - DNA, 25 bp, Mus musculus
caaagtgtgggctcctggccaaggc

SEQ ID NO: 294103 - DNA, 25 bp, Mus musculus
caaagtgtgtatatggttccgtgct

SEQ ID NO: 294104 - DNA, 25 bp, Mus musculus
caaagtgtgtatttggttccgtgct

SEQ ID NO: 294105 - DNA, 25 bp, Mus musculus
caaagtgttctgaagactggagaga

SEQ ID NO: 294106 - DNA, 25 bp, Mus musculus
caaagtgttctgtagactggagaga

SEQ ID NO: 294107 - DNA, 25 bp, Mus musculus
caaagtgtttatcttctctaatagt

SEQ ID NO: 294108 - DNA, 25 bp, Mus musculus
caaagtgtttatgttctctaatagt

SEQ ID NO: 294109 - DNA, 25 bp, Mus musculus
caaagtgtttgcacctcatatcacc

SEQ ID NO: 294110 - DNA, 25 bp, Mus musculus
caaagtgtttgctcctcatatcacc

SEQ ID NO: 294111 - DNA, 25 bp, Mus musculus
caaagtgtttgtctgctgagtgtca

SEQ ID NO: 294112 - DNA, 25 bp, Mus musculus
caaagtgtttgtgtgctgagtgtca

SEQ ID NO: 294113 - DNA, 25 bp, Mus musculus
caaagttactttatgagcattcaaa

SEQ ID NO: 294114 - DNA, 25 bp, Mus musculus
caaagttactttttgagcattcaaa

SEQ ID NO: 294115 - DNA, 25 bp, Mus musculus
caaagttagaagaccatgttccctt

SEQ ID NO: 294116 - DNA, 25 bp, Mus musculus
caaagttagaagtccatgttccctt

SEQ ID NO: 294117 - DNA, 25 bp, Mus musculus
caaagttagactcaccgttgaggct

SEQ ID NO: 294118 - DNA, 25 bp, Mus musculus
caaagttagactgaccgttgaggct

SEQ ID NO: 294119 - DNA, 25 bp, Mus musculus
caaagttagggaaccaagaatgccg

SEQ ID NO: 294120 - DNA, 25 bp, Mus musculus
caaagttagggatccaagaatgccg

SEQ ID NO: 294121 - DNA, 25 bp, Mus musculus
caaagttagtacactgtgggctgca

SEQ ID NO: 294122 - DNA, 25 bp, Mus musculus
caaagttagtactctgtgggctgca

SEQ ID NO: 294123 - DNA, 25 bp, Mus musculus
caaagttatttgactttcccctcag

SEQ ID NO: 294124 - DNA, 25 bp, Mus musculus
caaagttatttgtctttcccctcag

SEQ ID NO: 294125 - DNA, 25 bp, Mus musculus
caaagttcagagctgcccgattgca

SEQ ID NO: 294126 - DNA, 25 bp, Mus musculus
caaagttcagaggtgcccgattgca

SEQ ID NO: 294127 - DNA, 25 bp, Mus musculus
caaagttcccagctgcagggagcaa

SEQ ID NO: 294128 - DNA, 25 bp, Mus musculus
caaagttcccaggtgcagggagcaa

SEQ ID NO: 294129 - DNA, 25 bp, Mus musculus
caaagttccccaaatctagagacta

SEQ ID NO: 294130 - DNA, 25 bp, Mus musculus
caaagttccccatatctagagacta

SEQ ID NO: 294131 - DNA, 25 bp, Mus musculus
caaagttcccgacggtgctactggt

SEQ ID NO: 294132 - DNA, 25 bp, Mus musculus
caaagttcccgagggtgctactggt

SEQ ID NO: 294133 - DNA, 25 bp, Mus musculus
caaagttccctgagacggagtcatt

SEQ ID NO: 294134 - DNA, 25 bp, Mus musculus
caaagttccctgtgacggagtcatt

SEQ ID NO: 294135 - DNA, 25 bp, Mus musculus
caaagttcttagagttctttcatag

SEQ ID NO: 294136 - DNA, 25 bp, Mus musculus
caaagttcttagtgttctttcatag

SEQ ID NO: 294137 - DNA, 25 bp, Mus musculus
caaagttgattaatccggcatgtaa

SEQ ID NO: 294138 - DNA, 25 bp, Mus musculus
caaagttgattattccggcatgtaa

SEQ ID NO: 294139 - DNA, 25 bp, Mus musculus
caaagttgccttaagccccaagtat

SEQ ID NO: 294140 - DNA, 25 bp, Mus musculus
caaagttgcctttagccccaagtat

SEQ ID NO: 294141 - DNA, 25 bp, Mus musculus
caaagttgctgacctgtatgcctct

SEQ ID NO: 294142 - DNA, 25 bp, Mus musculus
caaagttgctgagctgtatgcctct

SEQ ID NO: 294143 - DNA, 25 bp, Mus musculus
caaagtttacttactgtttcaacag

SEQ ID NO: 294144 - DNA, 25 bp, Mus musculus
caaagtttactttctgtttcaacag

SEQ ID NO: 294145 - DNA, 25 bp, Mus musculus
caaagtttatgaactgttctttgca

SEQ ID NO: 294146 - DNA, 25 bp, Mus musculus
caaagtttatgatctgttctttgca

SEQ ID NO: 294147 - DNA, 25 bp, Mus musculus
caaagtttcgtgcactgccaggcca

SEQ ID NO: 294148 - DNA, 25 bp, Mus musculus
caaagtttcgtggactgccaggcca

SEQ ID NO: 294149 - DNA, 25 bp, Mus musculus
caaagtttcttcatttctgttggct

SEQ ID NO: 294150 - DNA, 25 bp, Mus musculus
caaagtttcttcttttctgttggct

SEQ ID NO: 294151 - DNA, 25 bp, Mus musculus
caaagtttgatgactggctcctgga

SEQ ID NO: 294152 - DNA, 25 bp, Mus musculus
caaagtttgatgtctggctcctgga

SEQ ID NO: 294153 - DNA, 25 bp, Mus musculus
caaagtttgcggctgcctattgcag

SEQ ID NO: 294154 - DNA, 25 bp, Mus musculus
caaagtttgcgggtgcctattgcag

SEQ ID NO: 294155 - DNA, 25 bp, Mus musculus
caaagtttggagctttcttctgctg

SEQ ID NO: 294156 - DNA, 25 bp, Mus musculus
caaagtttggaggtttcttctgctg

SEQ ID NO: 294157 - DNA, 25 bp, Mus musculus
caaagtttgtggacaggttcgctat

SEQ ID NO: 294158 - DNA, 25 bp, Mus musculus
caaagtttgtggtcaggttcgctat

SEQ ID NO: 294159 - DNA, 25 bp, Mus musculus
caaagtttgtttatggctgctgtat

SEQ ID NO: 294160 - DNA, 25 bp, Mus musculus
caaagtttgtttttggctgctgtat

SEQ ID NO: 294161 - DNA, 25 bp, Mus musculus
caaagttttataagttgtctctata

SEQ ID NO: 294162 - DNA, 25 bp, Mus musculus
caaagttttatatgttgtctctata

SEQ ID NO: 294163 - DNA, 25 bp, Mus musculus
caaagttttcaactcccacgagcac

SEQ ID NO: 294164 - DNA, 25 bp, Mus musculus
caaagttttcaagtcccacgagcac

SEQ ID NO: 294165 - DNA, 25 bp, Mus musculus
caaagttttcttctccatttttcat

SEQ ID NO: 294166 - DNA, 25 bp, Mus musculus
caaagttttcttgtccatttttcat

SEQ ID NO: 294167 - DNA, 25 bp, Mus musculus
caaagttttgatcgatctccatcct

SEQ ID NO: 294168 - DNA, 25 bp, Mus musculus
caaagttttgatggatctccatcct

SEQ ID NO: 294169 - DNA, 25 bp, Mus musculus
caaagttttgctctctcttggaaaa

SEQ ID NO: 294170 - DNA, 25 bp, Mus musculus
caaagttttgctgtctcttggaaaa

SEQ ID NO: 294171 - DNA, 25 bp, Mus musculus
caaagttttgtacatcctgttgttt

SEQ ID NO: 294172 - DNA, 25 bp, Mus musculus
caaagttttgtagatcctgttgttt

SEQ ID NO: 294173 - DNA, 25 bp, Mus musculus
caaagttttgttcagctgaataaat

SEQ ID NO: 294174 - DNA, 25 bp, Mus musculus
caaagttttgttgagctgaataaat

SEQ ID NO: 294175 - DNA, 25 bp, Mus musculus
caaagtttttcaatacaacctagtg

SEQ ID NO: 294176 - DNA, 25 bp, Mus musculus
caaagtttttcattacaacctagtg

SEQ ID NO: 294177 - DNA, 25 bp, Mus musculus
caaataaaacttcgggcgattcgtg

SEQ ID NO: 294178 - DNA, 25 bp, Mus musculus
caaataaaacttggggcgattcgtg

SEQ ID NO: 294179 - DNA, 25 bp, Mus musculus
caaataaacccaacaacagcaacaa

SEQ ID NO: 294180 - DNA, 25 bp, Mus musculus
caaataaacccatcaacagcaacaa

SEQ ID NO: 294181 - DNA, 25 bp, Mus musculus
caaataaactacctcgtactgtctt

SEQ ID NO: 294182 - DNA, 25 bp, Mus musculus
caaataaactacgtcgtactgtctt

SEQ ID NO: 294183 - DNA, 25 bp, Mus musculus
caaataaatcaacgctgcattgcag

SEQ ID NO: 294184 - DNA, 25 bp, Mus musculus
caaataaatcaaggctgcattgcag

SEQ ID NO: 294185 - DNA, 25 bp, Mus musculus
caaataaccctgaagagcctgtccc

SEQ ID NO: 294186 - DNA, 25 bp, Mus musculus
caaataaccctgtagagcctgtccc

SEQ ID NO: 294187 - DNA, 25 bp, Mus musculus
caaataacctgtacttccttgcaca

SEQ ID NO: 294188 - DNA, 25 bp, Mus musculus
caaataacctgttcttccttgcaca

SEQ ID NO: 294189 - DNA, 25 bp, Mus musculus
caaataactgtgatcttttccccgg

SEQ ID NO: 294190 - DNA, 25 bp, Mus musculus
caaataactgtgttcttttccccgg

SEQ ID NO: 294191 - DNA, 25 bp, Mus musculus
caaataactttcaggctggcgacag

SEQ ID NO: 294192 - DNA, 25 bp, Mus musculus
caaataactttctggctggcgacag

SEQ ID NO: 294193 - DNA, 25 bp, Mus musculus
caaataagttctaggtcacaaactg

SEQ ID NO: 294194 - DNA, 25 bp, Mus musculus
caaataagttcttggtcacaaactg

SEQ ID NO: 294195 - DNA, 25 bp, Mus musculus
caaataagttttagctccagccgag

SEQ ID NO: 294196 - DNA, 25 bp, Mus musculus
caaataagtttttgctccagccgag

SEQ ID NO: 294197 - DNA, 25 bp, Mus musculus
caaataatagtcagtcttgagtcct

SEQ ID NO: 294198 - DNA, 25 bp, Mus musculus
caaataatagtcctgcagaaggtgc

SEQ ID NO: 294199 - DNA, 25 bp, Mus musculus
caaataatagtcgtgcagaaggtgc

SEQ ID NO: 294200 - DNA, 25 bp, Mus musculus
caaataatagtctgtcttgagtcct

SEQ ID NO: 294201 - DNA, 25 bp, Mus musculus
caaataatctttctactgtgcattt

SEQ ID NO: 294202 - DNA, 25 bp, Mus musculus
caaataatctttgtactgtgcattt

SEQ ID NO: 294203 - DNA, 25 bp, Mus musculus
caaataatgcttcaggcttacctcc

SEQ ID NO: 294204 - DNA, 25 bp, Mus musculus
caaataatgcttgaggcttacctcc

SEQ ID NO: 294205 - DNA, 25 bp, Mus musculus
caaataatttacactgggcctcagt

SEQ ID NO: 294206 - DNA, 25 bp, Mus musculus
caaataatttactctgggcctcagt

SEQ ID NO: 294207 - DNA, 25 bp, Mus musculus
caaatacagtcaagaggcccaccaa

SEQ ID NO: 294208 - DNA, 25 bp, Mus musculus
caaatacagtcatgaggcccaccaa

SEQ ID NO: 294209 - DNA, 25 bp, Mus musculus
caaatacagttcagtctaccccttt

SEQ ID NO: 294210 - DNA, 25 bp, Mus musculus
caaatacagttctgtctaccccttt

SEQ ID NO: 294211 - DNA, 25 bp, Mus musculus
caaatacatcatcacacacagacaa

SEQ ID NO: 294212 - DNA, 25 bp, Mus musculus
caaatacatcatgacacacagacaa

SEQ ID NO: 294213 - DNA, 25 bp, Mus musculus
caaatacatgggagtacgtgggcca

SEQ ID NO: 294214 - DNA, 25 bp, Mus musculus
caaatacatgggtgtacgtgggcca

SEQ ID NO: 294215 - DNA, 25 bp, Mus musculus
caaatacccaatcacttctgatttt

SEQ ID NO: 294216 - DNA, 25 bp, Mus musculus
caaatacccaatgacttctgatttt

SEQ ID NO: 294217 - DNA, 25 bp, Mus musculus
caaatacccattctttctgagctac

SEQ ID NO: 294218 - DNA, 25 bp, Mus musculus
caaatacccattgtttctgagctac

SEQ ID NO: 294219 - DNA, 25 bp, Mus musculus
caaatacccctgaagaaccatgcct

SEQ ID NO: 294220 - DNA, 25 bp, Mus musculus
caaatacccctgtagaaccatgcct

SEQ ID NO: 294221 - DNA, 25 bp, Mus musculus
caaatacctcgaaaaccattccgtg

SEQ ID NO: 294222 - DNA, 25 bp, Mus musculus
caaatacctcgataaccattccgtg

SEQ ID NO: 294223 - DNA, 25 bp, Mus musculus
caaataccttggcttcctttaacag

SEQ ID NO: 294224 - DNA, 25 bp, Mus musculus
caaataccttgggttcctttaacag

SEQ ID NO: 294225 - DNA, 25 bp, Mus musculus
caaataccttttctcaatacctgcc

SEQ ID NO: 294226 - DNA, 25 bp, Mus musculus
caaataccttttgtcaatacctgcc

SEQ ID NO: 294227 - DNA, 25 bp, Mus musculus
caaatacgtattattcacttccact

SEQ ID NO: 294228 - DNA, 25 bp, Mus musculus
caaatacgtatttttcacttccact

SEQ ID NO: 294229 - DNA, 25 bp, Mus musculus
caaatactgcaaatactagcttatg

SEQ ID NO: 294230 - DNA, 25 bp, Mus musculus
caaatactgcaattactagcttatg

SEQ ID NO: 294231 - DNA, 25 bp, Mus musculus
caaatactgcccccaaacgtcgcgc

SEQ ID NO: 294232 - DNA, 25 bp, Mus musculus
caaatactgcccgcaaacgtcgcgc

SEQ ID NO: 294233 - DNA, 25 bp, Mus musculus
caaatacttaccctcagccacagtg

SEQ ID NO: 294234 - DNA, 25 bp, Mus musculus
caaatacttaccgtcagccacagtg

SEQ ID NO: 294235 - DNA, 25 bp, Mus musculus
caaatacttagaactgtggctggtt

SEQ ID NO: 294236 - DNA, 25 bp, Mus musculus
caaatacttagatctgtggctggtt

SEQ ID NO: 294237 - DNA, 25 bp, Mus musculus
caaatacttggacgatttcttcttt

SEQ ID NO: 294238 - DNA, 25 bp, Mus musculus
caaatacttggaggatttcttcttt

SEQ ID NO: 294239 - DNA, 25 bp, Mus musculus
caaatacttttaactcactggcctc

SEQ ID NO: 294240 - DNA, 25 bp, Mus musculus
caaatacttttatctcactggcctc

SEQ ID NO: 294241 - DNA, 25 bp, Mus musculus
caaatagatcagagccactggcgac

SEQ ID NO: 294242 - DNA, 25 bp, Mus musculus
caaatagatcagtgccactggcgac

SEQ ID NO: 294243 - DNA, 25 bp, Mus musculus
caaatagatgtcattccccgttggg

SEQ ID NO: 294244 - DNA, 25 bp, Mus musculus
caaatagatgtctttccccgttggg

SEQ ID NO: 294245 - DNA, 25 bp, Mus musculus
caaatagcaagtatctaatttccca

SEQ ID NO: 294246 - DNA, 25 bp, Mus musculus
caaatagcaagtttctaatttccca

SEQ ID NO: 294247 - DNA, 25 bp, Mus musculus
caaatagcctttcagccttttccct

SEQ ID NO: 294248 - DNA, 25 bp, Mus musculus
caaatagcctttgagccttttccct

SEQ ID NO: 294249 - DNA, 25 bp, Mus musculus
caaatagtaatcacggtcctgcaga

SEQ ID NO: 294250 - DNA, 25 bp, Mus musculus
caaatagtaatctcggtcctgcaga

SEQ ID NO: 294251 - DNA, 25 bp, Mus musculus
caaatagtagccaggtttttatcat

SEQ ID NO: 294252 - DNA, 25 bp, Mus musculus
caaatagtagcctggtttttatcat

SEQ ID NO: 294253 - DNA, 25 bp, Mus musculus
caaatagtatgcatgcggttgggtt

SEQ ID NO: 294254 - DNA, 25 bp, Mus musculus
caaatagtatgcttgcggttgggtt

SEQ ID NO: 294255 - DNA, 25 bp, Mus musculus
caaatagtgttgatccttcctttgg

SEQ ID NO: 294256 - DNA, 25 bp, Mus musculus
caaatagtgttgttccttcctttgg

SEQ ID NO: 294257 - DNA, 25 bp, Mus musculus
caaatagttaggagtcattgtctga

SEQ ID NO: 294258 - DNA, 25 bp, Mus musculus
caaatagttaggtgtcattgtctga

SEQ ID NO: 294259 - DNA, 25 bp, Mus musculus
caaatataacgtattctaccaatgt

SEQ ID NO: 294260 - DNA, 25 bp, Mus musculus
caaatataacgttttctaccaatgt

SEQ ID NO: 294261 - DNA, 25 bp, Mus musculus
caaatatacagaaggatgggttcct

SEQ ID NO: 294262 - DNA, 25 bp, Mus musculus
caaatatacagatggatgggttcct

SEQ ID NO: 294263 - DNA, 25 bp, Mus musculus
caaatataccaccatgcattctctt

SEQ ID NO: 294264 - DNA, 25 bp, Mus musculus
caaatataccacgatgcattctctt

SEQ ID NO: 294265 - DNA, 25 bp, Mus musculus
caaatatactgtacttatggaccaa

SEQ ID NO: 294266 - DNA, 25 bp, Mus musculus
caaatatactgttcttatggaccaa

SEQ ID NO: 294267 - DNA, 25 bp, Mus musculus
caaatatatcccaccgggtccgtct

SEQ ID NO: 294268 - DNA, 25 bp, Mus musculus
caaatatatccctccgggtccgtct

SEQ ID NO: 294269 - DNA, 25 bp, Mus musculus
caaatatatctcattatgcagaagg

SEQ ID NO: 294270 - DNA, 25 bp, Mus musculus
caaatatatctctttatgcagaagg

SEQ ID NO: 294271 - DNA, 25 bp, Mus musculus
caaatatattctccagaccctgcaa

SEQ ID NO: 294272 - DNA, 25 bp, Mus musculus
caaatatattctgcagaccctgcaa

SEQ ID NO: 294273 - DNA, 25 bp, Mus musculus
caaatatcagatactcttcctcttc

SEQ ID NO: 294274 - DNA, 25 bp, Mus musculus
caaatatcagattctcttcctcttc

SEQ ID NO: 294275 - DNA, 25 bp, Mus musculus
caaatatccttgatgctgtctgcat

SEQ ID NO: 294276 - DNA, 25 bp, Mus musculus
caaatatccttgttgctgtctgcat

SEQ ID NO: 294277 - DNA, 25 bp, Mus musculus
caaatatctactctgtggttccctt

SEQ ID NO: 294278 - DNA, 25 bp, Mus musculus
caaatatctactgtgtggttccctt

SEQ ID NO: 294279 - DNA, 25 bp, Mus musculus
caaatatcttttctgttcccaacaa

SEQ ID NO: 294280 - DNA, 25 bp, Mus musculus
caaatatcttttgtgttcccaacaa

SEQ ID NO: 294281 - DNA, 25 bp, Mus musculus
caaatatgcactaagggtccttcac

SEQ ID NO: 294282 - DNA, 25 bp, Mus musculus
caaatatgcacttagggtccttcac

SEQ ID NO: 294283 - DNA, 25 bp, Mus musculus
caaatatggtgcagctggccttgga

SEQ ID NO: 294284 - DNA, 25 bp, Mus musculus
caaatatggtgctgctggccttgga

SEQ ID NO: 294285 - DNA, 25 bp, Mus musculus
caaatatgtctccttagtcttccgg

SEQ ID NO: 294286 - DNA, 25 bp, Mus musculus
caaatatgtctcgttagtcttccgg

SEQ ID NO: 294287 - DNA, 25 bp, Mus musculus
caaatatgtcttcaccccacaggtg

SEQ ID NO: 294288 - DNA, 25 bp, Mus musculus
caaatatgtcttgaccccacaggtg

SEQ ID NO: 294289 - DNA, 25 bp, Mus musculus
caaatattctacagttgcgctatat

SEQ ID NO: 294290 - DNA, 25 bp, Mus musculus
caaatattctactgttgcgctatat

SEQ ID NO: 294291 - DNA, 25 bp, Mus musculus
caaatattgtctactgtgtcaggca

SEQ ID NO: 294292 - DNA, 25 bp, Mus musculus
caaatattgtcttctgtgtcaggca

SEQ ID NO: 294293 - DNA, 25 bp, Mus musculus
caaatattttatctaccttccccat

SEQ ID NO: 294294 - DNA, 25 bp, Mus musculus
caaatattttatgtaccttccccat

SEQ ID NO: 294295 - DNA, 25 bp, Mus musculus
caaatatttttgaatgaggcatccg

SEQ ID NO: 294296 - DNA, 25 bp, Mus musculus
caaatatttttgtatgaggcatccg

SEQ ID NO: 294297 - DNA, 25 bp, Mus musculus
caaatcaaggcactaacattttgtc

SEQ ID NO: 294298 - DNA, 25 bp, Mus musculus
caaatcaaggcagtaacattttgtc

SEQ ID NO: 294299 - DNA, 25 bp, Mus musculus
caaatcaagtttccaagcaaatgtt

SEQ ID NO: 294300 - DNA, 25 bp, Mus musculus
caaatcaagtttgcaagcaaatgtt

SEQ ID NO: 294301 - DNA, 25 bp, Mus musculus
caaatcaatatacgccgaatcgggt

SEQ ID NO: 294302 - DNA, 25 bp, Mus musculus
caaatcaatataggccgaatcgggt

SEQ ID NO: 294303 - DNA, 25 bp, Mus musculus
caaatcaatgtcctctctagctgtg

SEQ ID NO: 294304 - DNA, 25 bp, Mus musculus
caaatcaatgtcgtctctagctgtg

SEQ ID NO: 294305 - DNA, 25 bp, Mus musculus
caaatcacggttagccatcaggaaa

SEQ ID NO: 294306 - DNA, 25 bp, Mus musculus
caaatcacggtttgccatcaggaaa

SEQ ID NO: 294307 - DNA, 25 bp, Mus musculus
caaatcagcttgagtgtattttgta

SEQ ID NO: 294308 - DNA, 25 bp, Mus musculus
caaatcagcttgtgtgtattttgta

SEQ ID NO: 294309 - DNA, 25 bp, Mus musculus
caaatcaggttgatgcaggcttgta

SEQ ID NO: 294310 - DNA, 25 bp, Mus musculus
caaatcaggttgttgcaggcttgta

SEQ ID NO: 294311 - DNA, 25 bp, Mus musculus
caaatcatgatccttttcccggtat

SEQ ID NO: 294312 - DNA, 25 bp, Mus musculus
caaatcatgatcgttttcccggtat

SEQ ID NO: 294313 - DNA, 25 bp, Mus musculus
caaatcatgggcattgttctcatca

SEQ ID NO: 294314 - DNA, 25 bp, Mus musculus
caaatcatgggctttgttctcatca

SEQ ID NO: 294315 - DNA, 25 bp, Mus musculus
caaatccaaacgctgttctgtttcc

SEQ ID NO: 294316 - DNA, 25 bp, Mus musculus
caaatccaaacggtgttctgtttcc

SEQ ID NO: 294317 - DNA, 25 bp, Mus musculus
caaatccaaggacctcagtcgaaag

SEQ ID NO: 294318 - DNA, 25 bp, Mus musculus
caaatccaaggagctcagtcgaaag

SEQ ID NO: 294319 - DNA, 25 bp, Mus musculus
caaatccaagtgatagccgagaatt

SEQ ID NO: 294320 - DNA, 25 bp, Mus musculus
caaatccaagtgttagccgagaatt

SEQ ID NO: 294321 - DNA, 25 bp, Mus musculus
caaatccaataaagtgatctcgttc

SEQ ID NO: 294322 - DNA, 25 bp, Mus musculus
caaatccaataatgtgatctcgttc

SEQ ID NO: 294323 - DNA, 25 bp, Mus musculus
caaatccacaaaccctactttattt

SEQ ID NO: 294324 - DNA, 25 bp, Mus musculus
caaatccacaaagcctactttattt

SEQ ID NO: 294325 - DNA, 25 bp, Mus musculus
caaatccacctaatcctcttatttt

SEQ ID NO: 294326 - DNA, 25 bp, Mus musculus
caaatccacctattcctcttatttt

SEQ ID NO: 294327 - DNA, 25 bp, Mus musculus
caaatccatcgcctttttatttatt

SEQ ID NO: 294328 - DNA, 25 bp, Mus musculus
caaatccatcgcgtttttatttatt

SEQ ID NO: 294329 - DNA, 25 bp, Mus musculus
caaatccatttcctcatctctgagg

SEQ ID NO: 294330 - DNA, 25 bp, Mus musculus
caaatccatttcgtcatctctgagg

SEQ ID NO: 294331 - DNA, 25 bp, Mus musculus
caaatcccagttagtttgtgtacta

SEQ ID NO: 294332 - DNA, 25 bp, Mus musculus
caaatcccagttcaactcagacttt

SEQ ID NO: 294333 - DNA, 25 bp, Mus musculus
caaatcccagttgaactcagacttt

SEQ ID NO: 294334 - DNA, 25 bp, Mus musculus
caaatcccagtttgtttgtgtacta

SEQ ID NO: 294335 - DNA, 25 bp, Mus musculus
caaatccccaaactagaggacaaag

SEQ ID NO: 294336 - DNA, 25 bp, Mus musculus
caaatccccaaagtagaggacaaag

SEQ ID NO: 294337 - DNA, 25 bp, Mus musculus
caaatccctaccatactgcagaaat

SEQ ID NO: 294338 - DNA, 25 bp, Mus musculus
caaatccctaccttactgcagaaat

SEQ ID NO: 294339 - DNA, 25 bp, Mus musculus
caaatccgcactcttcagttagaag

SEQ ID NO: 294340 - DNA, 25 bp, Mus musculus
caaatccgcactgttcagttagaag

SEQ ID NO: 294341 - DNA, 25 bp, Mus musculus
caaatccgcccaatggtttgaccca

SEQ ID NO: 294342 - DNA, 25 bp, Mus musculus
caaatccgcccattggtttgaccca

SEQ ID NO: 294343 - DNA, 25 bp, Mus musculus
caaatcctaaagagaagcccgccct

SEQ ID NO: 294344 - DNA, 25 bp, Mus musculus
caaatcctaaagtgaagcccgccct

SEQ ID NO: 294345 - DNA, 25 bp, Mus musculus
caaatcctaaatactgaccacatcc

SEQ ID NO: 294346 - DNA, 25 bp, Mus musculus
caaatcctaaattctgaccacatcc

SEQ ID NO: 294347 - DNA, 25 bp, Mus musculus
caaatcctcaaaacaacactatata

SEQ ID NO: 294348 - DNA, 25 bp, Mus musculus
caaatcctcaaatcaacactatata

SEQ ID NO: 294349 - DNA, 25 bp, Mus musculus
caaatcctgggtaattcatattcct

SEQ ID NO: 294350 - DNA, 25 bp, Mus musculus
caaatcctgggttattcatattcct

SEQ ID NO: 294351 - DNA, 25 bp, Mus musculus
caaatcctgtaacaacaagtgctct

SEQ ID NO: 294352 - DNA, 25 bp, Mus musculus
caaatcctgtaagaacaagtgctct

SEQ ID NO: 294353 - DNA, 25 bp, Mus musculus
caaatccttcagaatgaccttatct

SEQ ID NO: 294354 - DNA, 25 bp, Mus musculus
caaatccttcagtatgaccttatct

SEQ ID NO: 294355 - DNA, 25 bp, Mus musculus
caaatccttgcaaaccttgttcgat

SEQ ID NO: 294356 - DNA, 25 bp, Mus musculus
caaatccttgcataccttgttcgat

SEQ ID NO: 294357 - DNA, 25 bp, Mus musculus
caaatccttggacagttacgcagcc

SEQ ID NO: 294358 - DNA, 25 bp, Mus musculus
caaatccttggagagttacgcagcc

SEQ ID NO: 294359 - DNA, 25 bp, Mus musculus
caaatccttggtactattatcatgt

SEQ ID NO: 294360 - DNA, 25 bp, Mus musculus
caaatccttggttctattatcatgt

SEQ ID NO: 294361 - DNA, 25 bp, Mus musculus
caaatcctttaaagcaaacacttat

SEQ ID NO: 294362 - DNA, 25 bp, Mus musculus
caaatcctttaatgcaaacacttat

SEQ ID NO: 294363 - DNA, 25 bp, Mus musculus
caaatccttttgcaaaccctctgtt

SEQ ID NO: 294364 - DNA, 25 bp, Mus musculus
caaatccttttggaaaccctctgtt

SEQ ID NO: 294365 - DNA, 25 bp, Mus musculus
caaatcgaaaccatgctgtctttaa

SEQ ID NO: 294366 - DNA, 25 bp, Mus musculus
caaatcgaaaccttgctgtctttaa

SEQ ID NO: 294367 - DNA, 25 bp, Mus musculus
caaatcgatcggaaggacagaggtg

SEQ ID NO: 294368 - DNA, 25 bp, Mus musculus
caaatcgatcggtaggacagaggtg

SEQ ID NO: 294369 - DNA, 25 bp, Mus musculus
caaatcgatgctcggacacctgctt

SEQ ID NO: 294370 - DNA, 25 bp, Mus musculus
caaatcgatgctgggacacctgctt

SEQ ID NO: 294371 - DNA, 25 bp, Mus musculus
caaatcggctaaaagaaggaacaga

SEQ ID NO: 294372 - DNA, 25 bp, Mus musculus
caaatcggctaatagaaggaacaga

SEQ ID NO: 294373 - DNA, 25 bp, Mus musculus
caaatcgtagcgctcattggcatct

SEQ ID NO: 294374 - DNA, 25 bp, Mus musculus
caaatcgtagcggtcattggcatct

SEQ ID NO: 294375 - DNA, 25 bp, Mus musculus
caaatcgtctggcaagtgcactata

SEQ ID NO: 294376 - DNA, 25 bp, Mus musculus
caaatcgtctgggaagtgcactata

SEQ ID NO: 294377 - DNA, 25 bp, Mus musculus
caaatctagcatatttagcgttcag

SEQ ID NO: 294378 - DNA, 25 bp, Mus musculus
caaatctagcatttttagcgttcag

SEQ ID NO: 294379 - DNA, 25 bp, Mus musculus
caaatctcaggcattcaaaggttct

SEQ ID NO: 294380 - DNA, 25 bp, Mus musculus
caaatctcaggctttcaaaggttct

SEQ ID NO: 294381 - DNA, 25 bp, Mus musculus
caaatctctctcagactcttctttt

SEQ ID NO: 294382 - DNA, 25 bp, Mus musculus
caaatctctctctgactcttctttt

SEQ ID NO: 294383 - DNA, 25 bp, Mus musculus
caaatctgatatcccagttggaaga

SEQ ID NO: 294384 - DNA, 25 bp, Mus musculus
caaatctgatatgccagttggaaga

SEQ ID NO: 294385 - DNA, 25 bp, Mus musculus
caaatctgatgaacgcccttttttg

SEQ ID NO: 294386 - DNA, 25 bp, Mus musculus
caaatctgatgatcgcccttttttg

SEQ ID NO: 294387 - DNA, 25 bp, Mus musculus
caaatctgattgcaaggaaaaggct

SEQ ID NO: 294388 - DNA, 25 bp, Mus musculus
caaatctgattggaaggaaaaggct

SEQ ID NO: 294389 - DNA, 25 bp, Mus musculus
caaatctgccttagagtctcacacc

SEQ ID NO: 294390 - DNA, 25 bp, Mus musculus
caaatctgcctttgagtctcacacc

SEQ ID NO: 294391 - DNA, 25 bp, Mus musculus
caaatctggcttagcctgaagagag

SEQ ID NO: 294392 - DNA, 25 bp, Mus musculus
caaatctggctttgcctgaagagag

SEQ ID NO: 294393 - DNA, 25 bp, Mus musculus
caaatctgggctagccagggcctct

SEQ ID NO: 294394 - DNA, 25 bp, Mus musculus
caaatctgggcttgccagggcctct

SEQ ID NO: 294395 - DNA, 25 bp, Mus musculus
caaatctgggttcaagcttactgct

SEQ ID NO: 294396 - DNA, 25 bp, Mus musculus
caaatctgggttgaagcttactgct

SEQ ID NO: 294397 - DNA, 25 bp, Mus musculus
caaatcttaactaccttatcctgaa

SEQ ID NO: 294398 - DNA, 25 bp, Mus musculus
caaatcttaacttccttatcctgaa

SEQ ID NO: 294399 - DNA, 25 bp, Mus musculus
caaatcttaagcatgcaaactagag

SEQ ID NO: 294400 - DNA, 25 bp, Mus musculus
caaatcttaagcttgcaaactagag

SEQ ID NO: 294401 - DNA, 25 bp, Mus musculus
caaatcttctagatctgcttcaccc

SEQ ID NO: 294402 - DNA, 25 bp, Mus musculus
caaatcttctagttctgcttcaccc

SEQ ID NO: 294403 - DNA, 25 bp, Mus musculus
caaatcttttataaggtcttctcac

SEQ ID NO: 294404 - DNA, 25 bp, Mus musculus
caaatcttttattaggtcttctcac

SEQ ID NO: 294405 - DNA, 25 bp, Mus musculus
caaatgaaaacgagtcacttggtca

SEQ ID NO: 294406 - DNA, 25 bp, Mus musculus
caaatgaaaacgtgtcacttggtca

SEQ ID NO: 294407 - DNA, 25 bp, Mus musculus
caaatgaacaagcactcctggctta

SEQ ID NO: 294408 - DNA, 25 bp, Mus musculus
caaatgaacaaggactcctggctta

SEQ ID NO: 294409 - DNA, 25 bp, Mus musculus
caaatgaaccgtctaactgctgata

SEQ ID NO: 294410 - DNA, 25 bp, Mus musculus
caaatgaaccgtgtaactgctgata

SEQ ID NO: 294411 - DNA, 25 bp, Mus musculus
caaatgaactctccttcgatccccc

SEQ ID NO: 294412 - DNA, 25 bp, Mus musculus
caaatgaactctgcttcgatccccc

SEQ ID NO: 294413 - DNA, 25 bp, Mus musculus
caaatgaagttcagattcccctcca

SEQ ID NO: 294414 - DNA, 25 bp, Mus musculus
caaatgaagttctgattcccctcca

SEQ ID NO: 294415 - DNA, 25 bp, Mus musculus
caaatgaccaatatcttcctttctt

SEQ ID NO: 294416 - DNA, 25 bp, Mus musculus
caaatgaccaatttcttcctttctt

SEQ ID NO: 294417 - DNA, 25 bp, Mus musculus
caaatgacccgacggttgggagcct

SEQ ID NO: 294418 - DNA, 25 bp, Mus musculus
caaatgacccgagggttgggagcct

SEQ ID NO: 294419 - DNA, 25 bp, Mus musculus
caaatgacttctacatggactaaaa

SEQ ID NO: 294420 - DNA, 25 bp, Mus musculus
caaatgacttcttcatggactaaaa

SEQ ID NO: 294421 - DNA, 25 bp, Mus musculus
caaatgagacagatgccaaggcaga

SEQ ID NO: 294422 - DNA, 25 bp, Mus musculus
caaatgagacagttgccaaggcaga

SEQ ID NO: 294423 - DNA, 25 bp, Mus musculus
caaatgagacccatgaataacttta

SEQ ID NO: 294424 - DNA, 25 bp, Mus musculus
caaatgagacccttgaataacttta

SEQ ID NO: 294425 - DNA, 25 bp, Mus musculus
caaatgaggagaccccgtgcagcaa

SEQ ID NO: 294426 - DNA, 25 bp, Mus musculus
caaatgaggagagcccgtgcagcaa

SEQ ID NO: 294427 - DNA, 25 bp, Mus musculus
caaatgaggccaatactgagaactg

SEQ ID NO: 294428 - DNA, 25 bp, Mus musculus
caaatgaggccattactgagaactg

SEQ ID NO: 294429 - DNA, 25 bp, Mus musculus
caaatgagtcacactggcccagtat

SEQ ID NO: 294430 - DNA, 25 bp, Mus musculus
caaatgagtcactctggcccagtat

SEQ ID NO: 294431 - DNA, 25 bp, Mus musculus
caaatgagttttccccaaggaatct

SEQ ID NO: 294432 - DNA, 25 bp, Mus musculus
caaatgagttttgcccaaggaatct

SEQ ID NO: 294433 - DNA, 25 bp, Mus musculus
caaatgataaacagtggaattgtct

SEQ ID NO: 294434 - DNA, 25 bp, Mus musculus
caaatgataaactgtggaattgtct

SEQ ID NO: 294435 - DNA, 25 bp, Mus musculus
caaatgatactcaaacggcgcctga

SEQ ID NO: 294436 - DNA, 25 bp, Mus musculus
caaatgatactctaacggcgcctga

SEQ ID NO: 294437 - DNA, 25 bp, Mus musculus
caaatgatcttgagtcagtgggaca

SEQ ID NO: 294438 - DNA, 25 bp, Mus musculus
caaatgatcttgtgtcagtgggaca

SEQ ID NO: 294439 - DNA, 25 bp, Mus musculus
caaatgatgcttcctcttgagggcc

SEQ ID NO: 294440 - DNA, 25 bp, Mus musculus
caaatgatgcttgctcttgagggcc

SEQ ID NO: 294441 - DNA, 25 bp, Mus musculus
caaatgatttgtcctggcgtcagcc

SEQ ID NO: 294442 - DNA, 25 bp, Mus musculus
caaatgatttgtgctggcgtcagcc

SEQ ID NO: 294443 - DNA, 25 bp, Mus musculus
caaatgattttgacattggctgaag

SEQ ID NO: 294444 - DNA, 25 bp, Mus musculus
caaatgattttgtcattggctgaag

SEQ ID NO: 294445 - DNA, 25 bp, Mus musculus
caaatgcactctcagaaagcatcag

SEQ ID NO: 294446 - DNA, 25 bp, Mus musculus
caaatgcactctgagaaagcatcag

SEQ ID NO: 294447 - DNA, 25 bp, Mus musculus
caaatgcctggtattggtggctgat

SEQ ID NO: 294448 - DNA, 25 bp, Mus musculus
caaatgcctggttttggtggctgat

SEQ ID NO: 294449 - DNA, 25 bp, Mus musculus
caaatgcctgtgatctgtctgtatg

SEQ ID NO: 294450 - DNA, 25 bp, Mus musculus
caaatgcctgtgttctgtctgtatg

SEQ ID NO: 294451 - DNA, 25 bp, Mus musculus
caaatgccttaaattcctacaacaa

SEQ ID NO: 294452 - DNA, 25 bp, Mus musculus
caaatgccttaatttcctacaacaa

SEQ ID NO: 294453 - DNA, 25 bp, Mus musculus
caaatgcggagcagtgtcggtacct

SEQ ID NO: 294454 - DNA, 25 bp, Mus musculus
caaatgcggagctgtgtcggtacct

SEQ ID NO: 294455 - DNA, 25 bp, Mus musculus
caaatgctacctcgaagagttcttt

SEQ ID NO: 294456 - DNA, 25 bp, Mus musculus
caaatgctacctggaagagttcttt

SEQ ID NO: 294457 - DNA, 25 bp, Mus musculus
caaatgctagcaatatccttccact

SEQ ID NO: 294458 - DNA, 25 bp, Mus musculus
caaatgctagcattatccttccact

SEQ ID NO: 294459 - DNA, 25 bp, Mus musculus
caaatgctcatacttcttaatatag

SEQ ID NO: 294460 - DNA, 25 bp, Mus musculus
caaatgctcatagttcttaatatag

SEQ ID NO: 294461 - DNA, 25 bp, Mus musculus
caaatgctgcaactttcaaatccca

SEQ ID NO: 294462 - DNA, 25 bp, Mus musculus
caaatgctgcaagtttcaaatccca

SEQ ID NO: 294463 - DNA, 25 bp, Mus musculus
caaatgctggcaaggactggataaa

SEQ ID NO: 294464 - DNA, 25 bp, Mus musculus
caaatgctggcatggactggataaa

SEQ ID NO: 294465 - DNA, 25 bp, Mus musculus
caaatgctgggcctacactggacaa

SEQ ID NO: 294466 - DNA, 25 bp, Mus musculus
caaatgctgggcgtacactggacaa

SEQ ID NO: 294467 - DNA, 25 bp, Mus musculus
caaatgctggttcccttctgtgtaa

SEQ ID NO: 294468 - DNA, 25 bp, Mus musculus
caaatgctggttgccttctgtgtaa

SEQ ID NO: 294469 - DNA, 25 bp, Mus musculus
caaatgctgtgcactcattcagtgg

SEQ ID NO: 294470 - DNA, 25 bp, Mus musculus
caaatgctgtgctctcattcagtgg

SEQ ID NO: 294471 - DNA, 25 bp, Mus musculus
caaatgctgttgagtgtcctcgtcg

SEQ ID NO: 294472 - DNA, 25 bp, Mus musculus
caaatgctgttgtgtgtcctcgtcg

SEQ ID NO: 294473 - DNA, 25 bp, Mus musculus
caaatgcttctacgcgcactcgcgt

SEQ ID NO: 294474 - DNA, 25 bp, Mus musculus
caaatgcttctaggcgcactcgcgt

SEQ ID NO: 294475 - DNA, 25 bp, Mus musculus
caaatgcttctgatggctctcgtca

SEQ ID NO: 294476 - DNA, 25 bp, Mus musculus
caaatgcttctgttggctctcgtca

SEQ ID NO: 294477 - DNA, 25 bp, Mus musculus
caaatgcttcttcctattgagaatt

SEQ ID NO: 294478 - DNA, 25 bp, Mus musculus
caaatgcttcttgctattgagaatt

SEQ ID NO: 294479 - DNA, 25 bp, Mus musculus
caaatgcttgccacgtaagtctgag

SEQ ID NO: 294480 - DNA, 25 bp, Mus musculus
caaatgcttgcctcgtaagtctgag

SEQ ID NO: 294481 - DNA, 25 bp, Mus musculus
caaatggaatcacagctagaacacg

SEQ ID NO: 294482 - DNA, 25 bp, Mus musculus
caaatggaatcagagctagaacacg

SEQ ID NO: 294483 - DNA, 25 bp, Mus musculus
caaatggacaaaagggctgctttca

SEQ ID NO: 294484 - DNA, 25 bp, Mus musculus
caaatggacaaatgggctgctttca

SEQ ID NO: 294485 - DNA, 25 bp, Mus musculus
caaatggactcacggcccacgaaga

SEQ ID NO: 294486 - DNA, 25 bp, Mus musculus
caaatggactcagggcccacgaaga

SEQ ID NO: 294487 - DNA, 25 bp, Mus musculus
caaatggactttcgtgccacctact

SEQ ID NO: 294488 - DNA, 25 bp, Mus musculus
caaatggactttggtgccacctact

SEQ ID NO: 294489 - DNA, 25 bp, Mus musculus
caaatggaggacaacgtaatcggga

SEQ ID NO: 294490 - DNA, 25 bp, Mus musculus
caaatggaggactacgtaatcggga

SEQ ID NO: 294491 - DNA, 25 bp, Mus musculus
caaatggattgacattagcgggttt

SEQ ID NO: 294492 - DNA, 25 bp, Mus musculus
caaatggattgagattagcgggttt

SEQ ID NO: 294493 - DNA, 25 bp, Mus musculus
caaatggcaaaacactgtatctagt

SEQ ID NO: 294494 - DNA, 25 bp, Mus musculus
caaatggcaaaagactgtatctagt

SEQ ID NO: 294495 - DNA, 25 bp, Mus musculus
caaatggcattcctgtgtactgtat

SEQ ID NO: 294496 - DNA, 25 bp, Mus musculus
caaatggcattcgtgtgtactgtat

SEQ ID NO: 294497 - DNA, 25 bp, Mus musculus
caaatggccactcctgtggatttga

SEQ ID NO: 294498 - DNA, 25 bp, Mus musculus
caaatggccactgctgtggatttga

SEQ ID NO: 294499 - DNA, 25 bp, Mus musculus
caaatggccccaatgttttcctggg

SEQ ID NO: 294500 - DNA, 25 bp, Mus musculus
caaatggccccattgttttcctggg

SEQ ID NO: 294501 - DNA, 25 bp, Mus musculus
caaatggcctcgattttatgacact

SEQ ID NO: 294502 - DNA, 25 bp, Mus musculus
caaatggcctcgtttttatgacact

SEQ ID NO: 294503 - DNA, 25 bp, Mus musculus
caaatggcgctcctgatccaataaa

SEQ ID NO: 294504 - DNA, 25 bp, Mus musculus
caaatggcgctcgtgatccaataaa

SEQ ID NO: 294505 - DNA, 25 bp, Mus musculus
caaatggcgttactgtcgttaggac

SEQ ID NO: 294506 - DNA, 25 bp, Mus musculus
caaatggcgttagtgtcgttaggac

SEQ ID NO: 294507 - DNA, 25 bp, Mus musculus
caaatgggacccaagtgccagtgaa

SEQ ID NO: 294508 - DNA, 25 bp, Mus musculus
caaatgggaccctagtgccagtgaa

SEQ ID NO: 294509 - DNA, 25 bp, Mus musculus
caaatgggccgcatggctctcgggc

SEQ ID NO: 294510 - DNA, 25 bp, Mus musculus
caaatgggccgcttggctctcgggc

SEQ ID NO: 294511 - DNA, 25 bp, Mus musculus
caaatgggtcatacctgcactgaaa

SEQ ID NO: 294512 - DNA, 25 bp, Mus musculus
caaatgggtcattcctgcactgaaa

SEQ ID NO: 294513 - DNA, 25 bp, Mus musculus
caaatgggttcccttgcaaatgggt

SEQ ID NO: 294514 - DNA, 25 bp, Mus musculus
caaatgggttccgttgcaaatgggt

SEQ ID NO: 294515 - DNA, 25 bp, Mus musculus
caaatgggtttaccctctagacagg

SEQ ID NO: 294516 - DNA, 25 bp, Mus musculus
caaatgggtttagcctctagacagg

SEQ ID NO: 294517 - DNA, 25 bp, Mus musculus
caaatggtagcaattatccctgact

SEQ ID NO: 294518 - DNA, 25 bp, Mus musculus
caaatggtagcatttatccctgact

SEQ ID NO: 294519 - DNA, 25 bp, Mus musculus
caaatggtaggtcgattctagggct

SEQ ID NO: 294520 - DNA, 25 bp, Mus musculus
caaatggtaggtggattctagggct

SEQ ID NO: 294521 - DNA, 25 bp, Mus musculus
caaatggtatgtcctctgttaggta

SEQ ID NO: 294522 - DNA, 25 bp, Mus musculus
caaatggtatgtgctctgttaggta

SEQ ID NO: 294523 - DNA, 25 bp, Mus musculus
caaatggtcattacacaggcaaagt

SEQ ID NO: 294524 - DNA, 25 bp, Mus musculus
caaatggtcatttcacaggcaaagt

SEQ ID NO: 294525 - DNA, 25 bp, Mus musculus
caaatggttctgcaggcccctcggg

SEQ ID NO: 294526 - DNA, 25 bp, Mus musculus
caaatggttctggaggcccctcggg

SEQ ID NO: 294527 - DNA, 25 bp, Mus musculus
caaatgtaccccattgttttgggtg

SEQ ID NO: 294528 - DNA, 25 bp, Mus musculus
caaatgtacccctttgttttgggtg

SEQ ID NO: 294529 - DNA, 25 bp, Mus musculus
caaatgtacttaagttgaccaccaa

SEQ ID NO: 294530 - DNA, 25 bp, Mus musculus
caaatgtacttatgttgaccaccaa

SEQ ID NO: 294531 - DNA, 25 bp, Mus musculus
caaatgtagatccatcctagcatcc

SEQ ID NO: 294532 - DNA, 25 bp, Mus musculus
caaatgtagatcgatcctagcatcc

SEQ ID NO: 294533 - DNA, 25 bp, Mus musculus
caaatgtatattctcataagtgcac

SEQ ID NO: 294534 - DNA, 25 bp, Mus musculus
caaatgtatattgtcataagtgcac

SEQ ID NO: 294535 - DNA, 25 bp, Mus musculus
caaatgtatgagagtacttctgaat

SEQ ID NO: 294536 - DNA, 25 bp, Mus musculus
caaatgtatgagtgtacttctgaat

SEQ ID NO: 294537 - DNA, 25 bp, Mus musculus
caaatgtcaccccagcagactgagt

SEQ ID NO: 294538 - DNA, 25 bp, Mus musculus
caaatgtcacccgagcagactgagt

SEQ ID NO: 294539 - DNA, 25 bp, Mus musculus
caaatgtccggcctctggagtataa

SEQ ID NO: 294540 - DNA, 25 bp, Mus musculus
caaatgtccggcgtctggagtataa

SEQ ID NO: 294541 - DNA, 25 bp, Mus musculus
caaatgtcctaaactgcacagcttt

SEQ ID NO: 294542 - DNA, 25 bp, Mus musculus
caaatgtcctaatctgcacagcttt

SEQ ID NO: 294543 - DNA, 25 bp, Mus musculus
caaatgtcctccagtctggtttttt

SEQ ID NO: 294544 - DNA, 25 bp, Mus musculus
caaatgtcctcctgtctggtttttt

SEQ ID NO: 294545 - DNA, 25 bp, Mus musculus
caaatgtcctgaacacttccgtttt

SEQ ID NO: 294546 - DNA, 25 bp, Mus musculus
caaatgtcctgatcacttccgtttt

SEQ ID NO: 294547 - DNA, 25 bp, Mus musculus
caaatgtgaagaagcgttgtagttt

SEQ ID NO: 294548 - DNA, 25 bp, Mus musculus
caaatgtgaagatgcgttgtagttt

SEQ ID NO: 294549 - DNA, 25 bp, Mus musculus
caaatgtgagtgaatgctatgttat

SEQ ID NO: 294550 - DNA, 25 bp, Mus musculus
caaatgtgagtgtatgctatgttat

SEQ ID NO: 294551 - DNA, 25 bp, Mus musculus
caaatgtgcacaaagccgctagtaa

SEQ ID NO: 294552 - DNA, 25 bp, Mus musculus
caaatgtgcacatagccgctagtaa

SEQ ID NO: 294553 - DNA, 25 bp, Mus musculus
caaatgtgcttcagatgagcttttc

SEQ ID NO: 294554 - DNA, 25 bp, Mus musculus
caaatgtgcttctgatgagcttttc

SEQ ID NO: 294555 - DNA, 25 bp, Mus musculus
caaatgtgggttaggtttgctggtt

SEQ ID NO: 294556 - DNA, 25 bp, Mus musculus
caaatgtgggtttggtttgctggtt

SEQ ID NO: 294557 - DNA, 25 bp, Mus musculus
caaatgtggtttcggttctttactg

SEQ ID NO: 294558 - DNA, 25 bp, Mus musculus
caaatgtggtttgggttctttactg

SEQ ID NO: 294559 - DNA, 25 bp, Mus musculus
caaatgtgtaaacctgacctctgtt

SEQ ID NO: 294560 - DNA, 25 bp, Mus musculus
caaatgtgtaaagctgacctctgtt

SEQ ID NO: 294561 - DNA, 25 bp, Mus musculus
caaatgtgtgaacaagccctgctaa

SEQ ID NO: 294562 - DNA, 25 bp, Mus musculus
caaatgtgtgaagaagccctgctaa

SEQ ID NO: 294563 - DNA, 25 bp, Mus musculus
caaatgtgtgccagatgaattctgt

SEQ ID NO: 294564 - DNA, 25 bp, Mus musculus
caaatgtgtgcctgatgaattctgt

SEQ ID NO: 294565 - DNA, 25 bp, Mus musculus
caaatgttaatgcactcactctagt

SEQ ID NO: 294566 - DNA, 25 bp, Mus musculus
caaatgttaatggactcactctagt

SEQ ID NO: 294567 - DNA, 25 bp, Mus musculus
caaatgttacaaaaaagtggatgct

SEQ ID NO: 294568 - DNA, 25 bp, Mus musculus
caaatgttacaataaagtggatgct

SEQ ID NO: 294569 - DNA, 25 bp, Mus musculus
caaatgttagcgaccttggtataaa

SEQ ID NO: 294570 - DNA, 25 bp, Mus musculus
caaatgttagcgtccttggtataaa

SEQ ID NO: 294571 - DNA, 25 bp, Mus musculus
caaatgttctgtccggcaggagcgt

SEQ ID NO: 294572 - DNA, 25 bp, Mus musculus
caaatgttctgtgcggcaggagcgt

SEQ ID NO: 294573 - DNA, 25 bp, Mus musculus
caaatgttgaataagtacttgtgag

SEQ ID NO: 294574 - DNA, 25 bp, Mus musculus
caaatgttgaattagtacttgtgag

SEQ ID NO: 294575 - DNA, 25 bp, Mus musculus
caaatgttgtgtcctctgttgtgca

SEQ ID NO: 294576 - DNA, 25 bp, Mus musculus
caaatgttgtgtgctctgttgtgca

SEQ ID NO: 294577 - DNA, 25 bp, Mus musculus
caaatgtttagcattccttcctgtt

SEQ ID NO: 294578 - DNA, 25 bp, Mus musculus
caaatgtttagctttccttcctgtt

SEQ ID NO: 294579 - DNA, 25 bp, Mus musculus
caaatgtttgcgattctgtttttgt

SEQ ID NO: 294580 - DNA, 25 bp, Mus musculus
caaatgtttgcgtttctgtttttgt

SEQ ID NO: 294581 - DNA, 25 bp, Mus musculus
caaatgttttctcatctgtctgtca

SEQ ID NO: 294582 - DNA, 25 bp, Mus musculus
caaatgttttctgatctgtctgtca

SEQ ID NO: 294583 - DNA, 25 bp, Mus musculus
caaatgttttgtagctggtcatcaa

SEQ ID NO: 294584 - DNA, 25 bp, Mus musculus
caaatgttttgtcccgccaataaaa

SEQ ID NO: 294585 - DNA, 25 bp, Mus musculus
caaatgttttgtgccgccaataaaa

SEQ ID NO: 294586 - DNA, 25 bp, Mus musculus
caaatgttttgttgctggtcatcaa

SEQ ID NO: 294587 - DNA, 25 bp, Mus musculus
caaatgtttttcatgcgtctgcgtt

SEQ ID NO: 294588 - DNA, 25 bp, Mus musculus
caaatgtttttcttgcgtctgcgtt

SEQ ID NO: 294589 - DNA, 25 bp, Mus musculus
caaattaaggacatttcacaagtca

SEQ ID NO: 294590 - DNA, 25 bp, Mus musculus
caaattaaggacttttcacaagtca

SEQ ID NO: 294591 - DNA, 25 bp, Mus musculus
caaattaagggcatgtatgtctttt

SEQ ID NO: 294592 - DNA, 25 bp, Mus musculus
caaattaagggcttgtatgtctttt

SEQ ID NO: 294593 - DNA, 25 bp, Mus musculus
caaattaattctacggctcttcact

SEQ ID NO: 294594 - DNA, 25 bp, Mus musculus
caaattaattcttcggctcttcact

SEQ ID NO: 294595 - DNA, 25 bp, Mus musculus
caaattaccttcattgtgttcaaga

SEQ ID NO: 294596 - DNA, 25 bp, Mus musculus
caaattaccttctttgtgttcaaga

SEQ ID NO: 294597 - DNA, 25 bp, Mus musculus
caaattagaagaccggcctcacctg

SEQ ID NO: 294598 - DNA, 25 bp, Mus musculus
caaattagaagagcggcctcacctg

SEQ ID NO: 294599 - DNA, 25 bp, Mus musculus
caaattagacttcgagttggtgact

SEQ ID NO: 294600 - DNA, 25 bp, Mus musculus
caaattagacttggagttggtgact

SEQ ID NO: 294601 - DNA, 25 bp, Mus musculus
caaattatcactactttctttggtt

SEQ ID NO: 294602 - DNA, 25 bp, Mus musculus
caaattatcacttctttctttggtt

SEQ ID NO: 294603 - DNA, 25 bp, Mus musculus
caaattatcatgatgtagcattcat

SEQ ID NO: 294604 - DNA, 25 bp, Mus musculus
caaattatcatgttgtagcattcat

SEQ ID NO: 294605 - DNA, 25 bp, Mus musculus
caaattatcgttagcttttccaaat

SEQ ID NO: 294606 - DNA, 25 bp, Mus musculus
caaattatcgtttgcttttccaaat

SEQ ID NO: 294607 - DNA, 25 bp, Mus musculus
caaattatctgtccatttaaggctt

SEQ ID NO: 294608 - DNA, 25 bp, Mus musculus
caaattatctgtgcatttaaggctt

SEQ ID NO: 294609 - DNA, 25 bp, Mus musculus
caaattatgcagacgagtttcctcg

SEQ ID NO: 294610 - DNA, 25 bp, Mus musculus
caaattatgcagtcgagtttcctcg

SEQ ID NO: 294611 - DNA, 25 bp, Mus musculus
caaattattcaacatgcctacacgg

SEQ ID NO: 294612 - DNA, 25 bp, Mus musculus
caaattattcaagatgcctacacgg

SEQ ID NO: 294613 - DNA, 25 bp, Mus musculus
caaattcaactccaggtgttcggta

SEQ ID NO: 294614 - DNA, 25 bp, Mus musculus
caaattcaactcgaggtgttcggta

SEQ ID NO: 294615 - DNA, 25 bp, Mus musculus
caaattcaatacacctaaccggcca

SEQ ID NO: 294616 - DNA, 25 bp, Mus musculus
caaattcaatactcctaaccggcca

SEQ ID NO: 294617 - DNA, 25 bp, Mus musculus
caaattcaccctaccgctaaagaat

SEQ ID NO: 294618 - DNA, 25 bp, Mus musculus
caaattcacccttccgctaaagaat

SEQ ID NO: 294619 - DNA, 25 bp, Mus musculus
caaattcactccatagccaaggata

SEQ ID NO: 294620 - DNA, 25 bp, Mus musculus
caaattcactccttagccaaggata

SEQ ID NO: 294621 - DNA, 25 bp, Mus musculus
caaattcagtagctcctgaaggccc

SEQ ID NO: 294622 - DNA, 25 bp, Mus musculus
caaattcagtaggtcctgaaggccc

SEQ ID NO: 294623 - DNA, 25 bp, Mus musculus
caaattcagtggagctctctccaga

SEQ ID NO: 294624 - DNA, 25 bp, Mus musculus
caaattcagtggtgctctctccaga

SEQ ID NO: 294625 - DNA, 25 bp, Mus musculus
caaattcatcttactggtctcagca

SEQ ID NO: 294626 - DNA, 25 bp, Mus musculus
caaattcatctttctggtctcagca

SEQ ID NO: 294627 - DNA, 25 bp, Mus musculus
caaattccaagaccttgttgggact

SEQ ID NO: 294628 - DNA, 25 bp, Mus musculus
caaattccaagagcttgttgggact

SEQ ID NO: 294629 - DNA, 25 bp, Mus musculus
caaattccgctcacacgagggtgag

SEQ ID NO: 294630 - DNA, 25 bp, Mus musculus
caaattccgctctcacgagggtgag

SEQ ID NO: 294631 - DNA, 25 bp, Mus musculus
caaattcctgggaccctggagtagt

SEQ ID NO: 294632 - DNA, 25 bp, Mus musculus
caaattcctgggtccctggagtagt

SEQ ID NO: 294633 - DNA, 25 bp, Mus musculus
caaattcctggtagaagagggacca

SEQ ID NO: 294634 - DNA, 25 bp, Mus musculus
caaattcctggttgaagagggacca

SEQ ID NO: 294635 - DNA, 25 bp, Mus musculus
caaattccttccctcattattgatg

SEQ ID NO: 294636 - DNA, 25 bp, Mus musculus
caaattccttccgtcattattgatg

SEQ ID NO: 294637 - DNA, 25 bp, Mus musculus
caaattcctttacacagccgagtac

SEQ ID NO: 294638 - DNA, 25 bp, Mus musculus
caaattcctttagacagccgagtac

SEQ ID NO: 294639 - DNA, 25 bp, Mus musculus
caaattccttttcctacatgccatt

SEQ ID NO: 294640 - DNA, 25 bp, Mus musculus
caaattccttttgctacatgccatt

SEQ ID NO: 294641 - DNA, 25 bp, Mus musculus
caaattcggctgagctgttggatcc

SEQ ID NO: 294642 - DNA, 25 bp, Mus musculus
caaattcggctgtgctgttggatcc

SEQ ID NO: 294643 - DNA, 25 bp, Mus musculus
caaattctaagaaggcagagtccgt

SEQ ID NO: 294644 - DNA, 25 bp, Mus musculus
caaattctaagatggcagagtccgt

SEQ ID NO: 294645 - DNA, 25 bp, Mus musculus
caaattctctgccacaataccctaa

SEQ ID NO: 294646 - DNA, 25 bp, Mus musculus
caaattctctgcgacaataccctaa

SEQ ID NO: 294647 - DNA, 25 bp, Mus musculus
caaattctgaaacctgatgcccatc

SEQ ID NO: 294648 - DNA, 25 bp, Mus musculus
caaattctgaaagctgatgcccatc

SEQ ID NO: 294649 - DNA, 25 bp, Mus musculus
caaattctgtgacctcctgattaac

SEQ ID NO: 294650 - DNA, 25 bp, Mus musculus
caaattctgtgagctcctgattaac

SEQ ID NO: 294651 - DNA, 25 bp, Mus musculus
caaattctgtgtcatcttttttcat

SEQ ID NO: 294652 - DNA, 25 bp, Mus musculus
caaattctgtgtgatcttttttcat

SEQ ID NO: 294653 - DNA, 25 bp, Mus musculus
caaattctgttcctctgatgttata

SEQ ID NO: 294654 - DNA, 25 bp, Mus musculus
caaattctgttcgtctgatgttata

SEQ ID NO: 294655 - DNA, 25 bp, Mus musculus
caaattgaaaatccacagtccttca

SEQ ID NO: 294656 - DNA, 25 bp, Mus musculus
caaattgaaaatgcacagtccttca

SEQ ID NO: 294657 - DNA, 25 bp, Mus musculus
caaattgacatcagacttccatatg

SEQ ID NO: 294658 - DNA, 25 bp, Mus musculus
caaattgacatctgacttccatatg

SEQ ID NO: 294659 - DNA, 25 bp, Mus musculus
caaattgaccaaaaaagcctttatt

SEQ ID NO: 294660 - DNA, 25 bp, Mus musculus
caaattgaccaataaagcctttatt

SEQ ID NO: 294661 - DNA, 25 bp, Mus musculus
caaattgagactcttacccatttga

SEQ ID NO: 294662 - DNA, 25 bp, Mus musculus
caaattgagactgttacccatttga

SEQ ID NO: 294663 - DNA, 25 bp, Mus musculus
caaattgagcccaccatgtgggaag

SEQ ID NO: 294664 - DNA, 25 bp, Mus musculus
caaattgagccctccatgtgggaag

SEQ ID NO: 294665 - DNA, 25 bp, Mus musculus
caaattgaggccaccatgtgggaag

SEQ ID NO: 294666 - DNA, 25 bp, Mus musculus
caaattgaggcctccatgtgggaag

SEQ ID NO: 294667 - DNA, 25 bp, Mus musculus
caaattgatcctaggagctgggcaa

SEQ ID NO: 294668 - DNA, 25 bp, Mus musculus
caaattgatccttggagctgggcaa

SEQ ID NO: 294669 - DNA, 25 bp, Mus musculus
caaattgatgagcttcaggttcaat

SEQ ID NO: 294670 - DNA, 25 bp, Mus musculus
caaattgatgaggttcaggttcaat

SEQ ID NO: 294671 - DNA, 25 bp, Mus musculus
caaattgcacccaaggaaggacaca

SEQ ID NO: 294672 - DNA, 25 bp, Mus musculus
caaattgcaccctaggaaggacaca

SEQ ID NO: 294673 - DNA, 25 bp, Mus musculus
caaattgccctaacattaaagcaga

SEQ ID NO: 294674 - DNA, 25 bp, Mus musculus
caaattgccctatcattaaagcaga

SEQ ID NO: 294675 - DNA, 25 bp, Mus musculus
caaattgcctaccaagttcctacct

SEQ ID NO: 294676 - DNA, 25 bp, Mus musculus
caaattgcctacgaagttcctacct

SEQ ID NO: 294677 - DNA, 25 bp, Mus musculus
caaattggagtgatttacttagggt

SEQ ID NO: 294678 - DNA, 25 bp, Mus musculus
caaattggagtgttttacttagggt

SEQ ID NO: 294679 - DNA, 25 bp, Mus musculus
caaattggatctatcacctgtcacc

SEQ ID NO: 294680 - DNA, 25 bp, Mus musculus
caaattggatctttcacctgtcacc

SEQ ID NO: 294681 - DNA, 25 bp, Mus musculus
caaattggcccaaatctcatttaaa

SEQ ID NO: 294682 - DNA, 25 bp, Mus musculus
caaattggcccatatctcatttaaa

SEQ ID NO: 294683 - DNA, 25 bp, Mus musculus
caaattgggaaaagtgtgtgaccat

SEQ ID NO: 294684 - DNA, 25 bp, Mus musculus
caaattgggaaatgtgtgtgaccat

SEQ ID NO: 294685 - DNA, 25 bp, Mus musculus
caaattgggatgagtgttcctagaa

SEQ ID NO: 294686 - DNA, 25 bp, Mus musculus
caaattgggatgtgtgttcctagaa

SEQ ID NO: 294687 - DNA, 25 bp, Mus musculus
caaattgtaccacattgttaaggaa

SEQ ID NO: 294688 - DNA, 25 bp, Mus musculus
caaattgtaccagattgttaaggaa

SEQ ID NO: 294689 - DNA, 25 bp, Mus musculus
caaattgtccctctggtgtctgtag

SEQ ID NO: 294690 - DNA, 25 bp, Mus musculus
caaattgtccctgtggtgtctgtag

SEQ ID NO: 294691 - DNA, 25 bp, Mus musculus
caaattgtctggatctgggagctct

SEQ ID NO: 294692 - DNA, 25 bp, Mus musculus
caaattgtctggttctgggagctct

SEQ ID NO: 294693 - DNA, 25 bp, Mus musculus
caaattgtgcacagccagaagggcc

SEQ ID NO: 294694 - DNA, 25 bp, Mus musculus
caaattgtgcactgccagaagggcc

SEQ ID NO: 294695 - DNA, 25 bp, Mus musculus
caaattgtgggactccttcctttag

SEQ ID NO: 294696 - DNA, 25 bp, Mus musculus
caaattgtgggagtccttcctttag

SEQ ID NO: 294697 - DNA, 25 bp, Mus musculus
caaattgttactcccactgtgttat

SEQ ID NO: 294698 - DNA, 25 bp, Mus musculus
caaattgttactgccactgtgttat

SEQ ID NO: 294699 - DNA, 25 bp, Mus musculus
caaattgttcttatggttcctcact

SEQ ID NO: 294700 - DNA, 25 bp, Mus musculus
caaattgttcttttggttcctcact

SEQ ID NO: 294701 - DNA, 25 bp, Mus musculus
caaatttaaagcagcccttaccgag

SEQ ID NO: 294702 - DNA, 25 bp, Mus musculus
caaatttaaagctgcccttaccgag

SEQ ID NO: 294703 - DNA, 25 bp, Mus musculus
caaatttaattgaaccatgaagaag

SEQ ID NO: 294704 - DNA, 25 bp, Mus musculus
caaatttaattgtaccatgaagaag

SEQ ID NO: 294705 - DNA, 25 bp, Mus musculus
caaatttagccacgaaggtcaagct

SEQ ID NO: 294706 - DNA, 25 bp, Mus musculus
caaatttagccaggaaggtcaagct

SEQ ID NO: 294707 - DNA, 25 bp, Mus musculus
caaatttatgccatccgacagtcca

SEQ ID NO: 294708 - DNA, 25 bp, Mus musculus
caaatttatgccttccgacagtcca

SEQ ID NO: 294709 - DNA, 25 bp, Mus musculus
caaatttcagtaaacatgcccatta

SEQ ID NO: 294710 - DNA, 25 bp, Mus musculus
caaatttcagtatacatgcccatta

SEQ ID NO: 294711 - DNA, 25 bp, Mus musculus
caaatttctctcctttcataaaagg

SEQ ID NO: 294712 - DNA, 25 bp, Mus musculus
caaatttctctcgtttcataaaagg

SEQ ID NO: 294713 - DNA, 25 bp, Mus musculus
caaatttctgcaaagctaactgtct

SEQ ID NO: 294714 - DNA, 25 bp, Mus musculus
caaatttctgcatagctaactgtct

SEQ ID NO: 294715 - DNA, 25 bp, Mus musculus
caaatttgaacccagtacccatata

SEQ ID NO: 294716 - DNA, 25 bp, Mus musculus
caaatttgaaccgagtacccatata

SEQ ID NO: 294717 - DNA, 25 bp, Mus musculus
caaatttggagactcttactgcatc

SEQ ID NO: 294718 - DNA, 25 bp, Mus musculus
caaatttggagagtcttactgcatc

SEQ ID NO: 294719 - DNA, 25 bp, Mus musculus
caaatttggcctacaatgttcttaa

SEQ ID NO: 294720 - DNA, 25 bp, Mus musculus
caaatttggccttcaatgttcttaa

SEQ ID NO: 294721 - DNA, 25 bp, Mus musculus
caaatttgggccctttggactcttg

SEQ ID NO: 294722 - DNA, 25 bp, Mus musculus
caaatttgggccgtttggactcttg

SEQ ID NO: 294723 - DNA, 25 bp, Mus musculus
caaattttaggaactcaaagtcact

SEQ ID NO: 294724 - DNA, 25 bp, Mus musculus
caaattttaggatctcaaagtcact

SEQ ID NO: 294725 - DNA, 25 bp, Mus musculus
caaattttccttactagtcgccaga

SEQ ID NO: 294726 - DNA, 25 bp, Mus musculus
caaattttcctttctagtcgccaga

SEQ ID NO: 294727 - DNA, 25 bp, Mus musculus
caaattttgatacgctctgagtcat

SEQ ID NO: 294728 - DNA, 25 bp, Mus musculus
caaattttgataggctctgagtcat

SEQ ID NO: 294729 - DNA, 25 bp, Mus musculus
caaattttgcgtctatgtagctttt

SEQ ID NO: 294730 - DNA, 25 bp, Mus musculus
caaattttgcgtgtatgtagctttt

SEQ ID NO: 294731 - DNA, 25 bp, Mus musculus
caaattttgttgcagtatgactaga

SEQ ID NO: 294732 - DNA, 25 bp, Mus musculus
caaattttgttggagtatgactaga

SEQ ID NO: 294733 - DNA, 25 bp, Mus musculus
caaatttttatcaccagtaaagtgg

SEQ ID NO: 294734 - DNA, 25 bp, Mus musculus
caaatttttatctccagtaaagtgg

SEQ ID NO: 294735 - DNA, 25 bp, Mus musculus
caaatttttggcacattttttactg

SEQ ID NO: 294736 - DNA, 25 bp, Mus musculus
caaatttttggctcattttttactg

SEQ ID NO: 294737 - DNA, 25 bp, Mus musculus
caaatttttgtcatgagtgagtcac

SEQ ID NO: 294738 - DNA, 25 bp, Mus musculus
caaatttttgtcttgagtgagtcac

SEQ ID NO: 294739 - DNA, 25 bp, Mus musculus
caacaaaaataccatcttccctact

SEQ ID NO: 294740 - DNA, 25 bp, Mus musculus
caacaaaaatacgatcttccctact

SEQ ID NO: 294741 - DNA, 25 bp, Mus musculus
caacaaacaaacagtctgcctggtt

SEQ ID NO: 294742 - DNA, 25 bp, Mus musculus
caacaaacaaactgtctgcctggtt

SEQ ID NO: 294743 - DNA, 25 bp, Mus musculus
caacaaaccgaactgtgctttccgt

SEQ ID NO: 294744 - DNA, 25 bp, Mus musculus
caacaaaccgaagtgtgctttccgt

SEQ ID NO: 294745 - DNA, 25 bp, Mus musculus
caacaaacgttgcttttcctcagtg

SEQ ID NO: 294746 - DNA, 25 bp, Mus musculus
caacaaacgttggttttcctcagtg

SEQ ID NO: 294747 - DNA, 25 bp, Mus musculus
caacaaagagtaaaggccagatata

SEQ ID NO: 294748 - DNA, 25 bp, Mus musculus
caacaaagagtataggccagatata

SEQ ID NO: 294749 - DNA, 25 bp, Mus musculus
caacaaagattgctgtgcagtgtat

SEQ ID NO: 294750 - DNA, 25 bp, Mus musculus
caacaaagattggtgtgcagtgtat

SEQ ID NO: 294751 - DNA, 25 bp, Mus musculus
caacaaaggcttcagatgcaagtaa

SEQ ID NO: 294752 - DNA, 25 bp, Mus musculus
caacaaaggcttgagatgcaagtaa

SEQ ID NO: 294753 - DNA, 25 bp, Mus musculus
caacaaagggttatgctctctcttt

SEQ ID NO: 294754 - DNA, 25 bp, Mus musculus
caacaaagggttttgctctctcttt

SEQ ID NO: 294755 - DNA, 25 bp, Mus musculus
caacaaataggcctgatgtgttaga

SEQ ID NO: 294756 - DNA, 25 bp, Mus musculus
caacaaataggcgtgatgtgttaga

SEQ ID NO: 294757 - DNA, 25 bp, Mus musculus
caacaaatatacagtacttatggac

SEQ ID NO: 294758 - DNA, 25 bp, Mus musculus
caacaaatatactgtacttatggac

SEQ ID NO: 294759 - DNA, 25 bp, Mus musculus
caacaacaacaaccgcgtgtgcgag

SEQ ID NO: 294760 - DNA, 25 bp, Mus musculus
caacaacaacaagcgcgtgtgcgag

SEQ ID NO: 294761 - DNA, 25 bp, Mus musculus
caacaacaccacactaagtcttaaa

SEQ ID NO: 294762 - DNA, 25 bp, Mus musculus
caacaacaccactctaagtcttaaa

SEQ ID NO: 294763 - DNA, 25 bp, Mus musculus
caacaacactggacccattttcttt

SEQ ID NO: 294764 - DNA, 25 bp, Mus musculus
caacaacactggtcccattttcttt

SEQ ID NO: 294765 - DNA, 25 bp, Mus musculus
caacaacaggatacttatgcagcta

SEQ ID NO: 294766 - DNA, 25 bp, Mus musculus
caacaacaggattcttatgcagcta

SEQ ID NO: 294767 - DNA, 25 bp, Mus musculus
caacaacatctcagacccattgaaa

SEQ ID NO: 294768 - DNA, 25 bp, Mus musculus
caacaacatctctgacccattgaaa

SEQ ID NO: 294769 - DNA, 25 bp, Mus musculus
caacaacgagaacggcctgtttcgc

SEQ ID NO: 294770 - DNA, 25 bp, Mus musculus
caacaacgagaagggcctgtttcgc

SEQ ID NO: 294771 - DNA, 25 bp, Mus musculus
caacaacggtggcaacttttgattt

SEQ ID NO: 294772 - DNA, 25 bp, Mus musculus
caacaacggtgggaacttttgattt

SEQ ID NO: 294773 - DNA, 25 bp, Mus musculus
caacaactatccatcaactatgcaa

SEQ ID NO: 294774 - DNA, 25 bp, Mus musculus
caacaactatccttcaactatgcaa

SEQ ID NO: 294775 - DNA, 25 bp, Mus musculus
caacaactccttcactaatgtattg

SEQ ID NO: 294776 - DNA, 25 bp, Mus musculus
caacaactccttgactaatgtattg

SEQ ID NO: 294777 - DNA, 25 bp, Mus musculus
caacaactgagtatttatgtgattt

SEQ ID NO: 294778 - DNA, 25 bp, Mus musculus
caacaactgagtttttatgtgattt

SEQ ID NO: 294779 - DNA, 25 bp, Mus musculus
caacaactgataagctgggccatag

SEQ ID NO: 294780 - DNA, 25 bp, Mus musculus
caacaactgatatgctgggccatag

SEQ ID NO: 294781 - DNA, 25 bp, Mus musculus
caacaactgctgctgtgggtaacgg

SEQ ID NO: 294782 - DNA, 25 bp, Mus musculus
caacaactgctggtgtgggtaacgg

SEQ ID NO: 294783 - DNA, 25 bp, Mus musculus
caacaactgtgtatcttcctaccca

SEQ ID NO: 294784 - DNA, 25 bp, Mus musculus
caacaactgtgtttcttcctaccca

SEQ ID NO: 294785 - DNA, 25 bp, Mus musculus
caacaacttgacacccagctattaa

SEQ ID NO: 294786 - DNA, 25 bp, Mus musculus
caacaacttgactcccagctattaa

SEQ ID NO: 294787 - DNA, 25 bp, Mus musculus
caacaactttgacttacttccatag

SEQ ID NO: 294788 - DNA, 25 bp, Mus musculus
caacaactttgagttacttccatag

SEQ ID NO: 294789 - DNA, 25 bp, Mus musculus
caacaactttgtcacacttttttgt

SEQ ID NO: 294790 - DNA, 25 bp, Mus musculus
caacaactttgtgacacttttttgt

SEQ ID NO: 294791 - DNA, 25 bp, Mus musculus
caacaagaagttacgacaggcagaa

SEQ ID NO: 294792 - DNA, 25 bp, Mus musculus
caacaagaagtttcgacaggcagaa

SEQ ID NO: 294793 - DNA, 25 bp, Mus musculus
caacaagaatgtctggcgccccaca

SEQ ID NO: 294794 - DNA, 25 bp, Mus musculus
caacaagaatgtgtggcgccccaca

SEQ ID NO: 294795 - DNA, 25 bp, Mus musculus
caacaagattcccaaaaggcagaaa

SEQ ID NO: 294796 - DNA, 25 bp, Mus musculus
caacaagattccgaaaaggcagaaa

SEQ ID NO: 294797 - DNA, 25 bp, Mus musculus
caacaagcaggaaatcgggatgaaa

SEQ ID NO: 294798 - DNA, 25 bp, Mus musculus
caacaagcaggatatcgggatgaaa

SEQ ID NO: 294799 - DNA, 25 bp, Mus musculus
caacaagccacaatctgccaaaaga

SEQ ID NO: 294800 - DNA, 25 bp, Mus musculus
caacaagccacattctgccaaaaga

SEQ ID NO: 294801 - DNA, 25 bp, Mus musculus
caacaagccattaatcaacttccca

SEQ ID NO: 294802 - DNA, 25 bp, Mus musculus
caacaagccatttatcaacttccca

SEQ ID NO: 294803 - DNA, 25 bp, Mus musculus
caacaagcgcgtctgcgaggagatc

SEQ ID NO: 294804 - DNA, 25 bp, Mus musculus
caacaagcgcgtgtgcgaggagatc

SEQ ID NO: 294805 - DNA, 25 bp, Mus musculus
caacaagctaacacatcttaccctt

SEQ ID NO: 294806 - DNA, 25 bp, Mus musculus
caacaagctaactcatcttaccctt

SEQ ID NO: 294807 - DNA, 25 bp, Mus musculus
caacaagctcccagtgacctgctgg

SEQ ID NO: 294808 - DNA, 25 bp, Mus musculus
caacaagctccctgtgacctgctgg

SEQ ID NO: 294809 - DNA, 25 bp, Mus musculus
caacaagctgacagaggacaaggca

SEQ ID NO: 294810 - DNA, 25 bp, Mus musculus
caacaagctgactgaggacaaggca

SEQ ID NO: 294811 - DNA, 25 bp, Mus musculus
caacaagctgccaacgataggagga

SEQ ID NO: 294812 - DNA, 25 bp, Mus musculus
caacaagctgcctacgataggagga

SEQ ID NO: 294813 - DNA, 25 bp, Mus musculus
caacaagctggaaggcacatacctg

SEQ ID NO: 294814 - DNA, 25 bp, Mus musculus
caacaagctggatggcacatacctg

SEQ ID NO: 294815 - DNA, 25 bp, Mus musculus
caacaaggacaaaaagccccgttat

SEQ ID NO: 294816 - DNA, 25 bp, Mus musculus
caacaaggacaataagccccgttat

SEQ ID NO: 294817 - DNA, 25 bp, Mus musculus
caacaaggatggctcgtaccgcgtt

SEQ ID NO: 294818 - DNA, 25 bp, Mus musculus
caacaaggatgggtcgtaccgcgtt

SEQ ID NO: 294819 - DNA, 25 bp, Mus musculus
caacaaggatgtcatggcgaaggca

SEQ ID NO: 294820 - DNA, 25 bp, Mus musculus
caacaaggatgtgatggcgaaggca

SEQ ID NO: 294821 - DNA, 25 bp, Mus musculus
caacaaggcattcctccatcagggc

SEQ ID NO: 294822 - DNA, 25 bp, Mus musculus
caacaaggcattgctccatcagggc

SEQ ID NO: 294823 - DNA, 25 bp, Mus musculus
caacaagggactcaaaaccaactgt

SEQ ID NO: 294824 - DNA, 25 bp, Mus musculus
caacaagggactgaaaaccaactgt

SEQ ID NO: 294825 - DNA, 25 bp, Mus musculus
caacaagggcataaacaagatcata

SEQ ID NO: 294826 - DNA, 25 bp, Mus musculus
caacaagggcattaacaagatcata

SEQ ID NO: 294827 - DNA, 25 bp, Mus musculus
caacaaggtaatacccgggcaagca

SEQ ID NO: 294828 - DNA, 25 bp, Mus musculus
caacaaggtaattcccgggcaagca

SEQ ID NO: 294829 - DNA, 25 bp, Mus musculus
caacaaggtcatcagaagaatcaag

SEQ ID NO: 294830 - DNA, 25 bp, Mus musculus
caacaaggtcatgagaagaatcaag

SEQ ID NO: 294831 - DNA, 25 bp, Mus musculus
caacaaggtggtctgatggtttccc

SEQ ID NO: 294832 - DNA, 25 bp, Mus musculus
caacaaggtggtgtgatggtttccc

SEQ ID NO: 294833 - DNA, 25 bp, Mus musculus
caacaataaattataggcaatacgg

SEQ ID NO: 294834 - DNA, 25 bp, Mus musculus
caacaataaattttaggcaatacgg

SEQ ID NO: 294835 - DNA, 25 bp, Mus musculus
caacaataactcacacagtgaaata

SEQ ID NO: 294836 - DNA, 25 bp, Mus musculus
caacaataactctcacagtgaaata

SEQ ID NO: 294837 - DNA, 25 bp, Mus musculus
caacaataattccagttcccgggcg

SEQ ID NO: 294838 - DNA, 25 bp, Mus musculus
caacaataattcgagttcccgggcg

SEQ ID NO: 294839 - DNA, 25 bp, Mus musculus
caacaataattgaacgcatgaagga

SEQ ID NO: 294840 - DNA, 25 bp, Mus musculus
caacaataattgtacgcatgaagga

SEQ ID NO: 294841 - DNA, 25 bp, Mus musculus
caacaataccacacctggtcatata

SEQ ID NO: 294842 - DNA, 25 bp, Mus musculus
caacaataccactcctggtcatata

SEQ ID NO: 294843 - DNA, 25 bp, Mus musculus
caacaatactttcacctgtgaggtg

SEQ ID NO: 294844 - DNA, 25 bp, Mus musculus
caacaatactttgacctgtgaggtg

SEQ ID NO: 294845 - DNA, 25 bp, Mus musculus
caacaatagcctccgttcagtgcca

SEQ ID NO: 294846 - DNA, 25 bp, Mus musculus
caacaatagcctgcgttcagtgcca

SEQ ID NO: 294847 - DNA, 25 bp, Mus musculus
caacaatcatagctgataacattat

SEQ ID NO: 294848 - DNA, 25 bp, Mus musculus
caacaatcataggtgataacattat

SEQ ID NO: 294849 - DNA, 25 bp, Mus musculus
caacaatgagatccacagtgaagat

SEQ ID NO: 294850 - DNA, 25 bp, Mus musculus
caacaatgagatgcacagtgaagat

SEQ ID NO: 294851 - DNA, 25 bp, Mus musculus
caacaatggctaaaaatggtctata

SEQ ID NO: 294852 - DNA, 25 bp, Mus musculus
caacaatggctataaatggtctata

SEQ ID NO: 294853 - DNA, 25 bp, Mus musculus
caacaatgggaacggcctcctacat

SEQ ID NO: 294854 - DNA, 25 bp, Mus musculus
caacaatgggaagggcctcctacat

SEQ ID NO: 294855 - DNA, 25 bp, Mus musculus
caacaatgggacatcaaggagggca

SEQ ID NO: 294856 - DNA, 25 bp, Mus musculus
caacaatgggacttcaaggagggca

SEQ ID NO: 294857 - DNA, 25 bp, Mus musculus
caacaatgtattagatgtggaccaa

SEQ ID NO: 294858 - DNA, 25 bp, Mus musculus
caacaatgtatttgatgtggaccaa

SEQ ID NO: 294859 - DNA, 25 bp, Mus musculus
caacaatgtcgaagtgttcggcggg

SEQ ID NO: 294860 - DNA, 25 bp, Mus musculus
caacaatgtcgatgtgttcggcggg

SEQ ID NO: 294861 - DNA, 25 bp, Mus musculus
caacaattgatgatgagttctgcat

SEQ ID NO: 294862 - DNA, 25 bp, Mus musculus
caacaattgatgttgagttctgcat

SEQ ID NO: 294863 - DNA, 25 bp, Mus musculus
caacaattgtgacctctgccataat

SEQ ID NO: 294864 - DNA, 25 bp, Mus musculus
caacaattgtgagctctgccataat

SEQ ID NO: 294865 - DNA, 25 bp, Mus musculus
caacaatttgccataactttctttt

SEQ ID NO: 294866 - DNA, 25 bp, Mus musculus
caacaatttgccttaactttctttt

SEQ ID NO: 294867 - DNA, 25 bp, Mus musculus
caacaatttttaagcaaggtctgaa

SEQ ID NO: 294868 - DNA, 25 bp, Mus musculus
caacaatttttatgcaaggtctgaa

SEQ ID NO: 294869 - DNA, 25 bp, Mus musculus
caacacaacaagagtgagggcagcc

SEQ ID NO: 294870 - DNA, 25 bp, Mus musculus
caacacaacaagtgtgagggcagcc

SEQ ID NO: 294871 - DNA, 25 bp, Mus musculus
caacacaagcaacaaggccctgaaa

SEQ ID NO: 294872 - DNA, 25 bp, Mus musculus
caacacaagcaagaaggccctgaaa

SEQ ID NO: 294873 - DNA, 25 bp, Mus musculus
caacacaattataacccctgattcc

SEQ ID NO: 294874 - DNA, 25 bp, Mus musculus
caacacaattattacccctgattcc

SEQ ID NO: 294875 - DNA, 25 bp, Mus musculus
caacacacaataaaccccagttttc

SEQ ID NO: 294876 - DNA, 25 bp, Mus musculus
caacacacaatataccccagttttc

SEQ ID NO: 294877 - DNA, 25 bp, Mus musculus
caacacacatgcaaactcttcaaca

SEQ ID NO: 294878 - DNA, 25 bp, Mus musculus
caacacacatgctaactcttcaaca

SEQ ID NO: 294879 - DNA, 25 bp, Mus musculus
caacacaccttcagtaccagcaaga

SEQ ID NO: 294880 - DNA, 25 bp, Mus musculus
caacacaccttctgtaccagcaaga

SEQ ID NO: 294881 - DNA, 25 bp, Mus musculus
caacacactccgagagcacttaaat

SEQ ID NO: 294882 - DNA, 25 bp, Mus musculus
caacacactccgtgagcacttaaat

SEQ ID NO: 294883 - DNA, 25 bp, Mus musculus
caacacactcgtccgaaggttgggt

SEQ ID NO: 294884 - DNA, 25 bp, Mus musculus
caacacactcgtgcgaaggttgggt

SEQ ID NO: 294885 - DNA, 25 bp, Mus musculus
caacacactgggactcatttgtgga

SEQ ID NO: 294886 - DNA, 25 bp, Mus musculus
caacacactgggtctcatttgtgga

SEQ ID NO: 294887 - DNA, 25 bp, Mus musculus
caacacagatccagaagtggcctca

SEQ ID NO: 294888 - DNA, 25 bp, Mus musculus
caacacagatcctgaagtggcctca

SEQ ID NO: 294889 - DNA, 25 bp, Mus musculus
caacacaggctaaggctgctattta

SEQ ID NO: 294890 - DNA, 25 bp, Mus musculus
caacacaggctatggctgctattta

SEQ ID NO: 294891 - DNA, 25 bp, Mus musculus
caacacagggttaatgaattcatac

SEQ ID NO: 294892 - DNA, 25 bp, Mus musculus
caacacagggtttatgaattcatac

SEQ ID NO: 294893 - DNA, 25 bp, Mus musculus
caacacagtgagatgccataacaaa

SEQ ID NO: 294894 - DNA, 25 bp, Mus musculus
caacacagtgagttgccataacaaa

SEQ ID NO: 294895 - DNA, 25 bp, Mus musculus
caacacatgcttcccttcaaaataa

SEQ ID NO: 294896 - DNA, 25 bp, Mus musculus
caacacatgcttgccttcaaaataa

SEQ ID NO: 294897 - DNA, 25 bp, Mus musculus
caacacatgtcaacaggtttccact

SEQ ID NO: 294898 - DNA, 25 bp, Mus musculus
caacacatgtcatcaggtttccact

SEQ ID NO: 294899 - DNA, 25 bp, Mus musculus
caacacatgttcatcttgtacccac

SEQ ID NO: 294900 - DNA, 25 bp, Mus musculus
caacacatgttcttcttgtacccac

SEQ ID NO: 294901 - DNA, 25 bp, Mus musculus
caacacatttccagaggctgtgaca

SEQ ID NO: 294902 - DNA, 25 bp, Mus musculus
caacacatttcctgaggctgtgaca

SEQ ID NO: 294903 - DNA, 25 bp, Mus musculus
caacacatttgtcgtcttagaatgg

SEQ ID NO: 294904 - DNA, 25 bp, Mus musculus
caacacatttgtggtcttagaatgg

SEQ ID NO: 294905 - DNA, 25 bp, Mus musculus
caacaccaccttattgccaataagt

SEQ ID NO: 294906 - DNA, 25 bp, Mus musculus
caacaccacctttttgccaataagt

SEQ ID NO: 294907 - DNA, 25 bp, Mus musculus
caacaccatgcaactcactctgggt

SEQ ID NO: 294908 - DNA, 25 bp, Mus musculus
caacaccatgcatctcactctgggt

SEQ ID NO: 294909 - DNA, 25 bp, Mus musculus
caacacccacctatttgtgattttg

SEQ ID NO: 294910 - DNA, 25 bp, Mus musculus
caacacccacctttttgtgattttg

SEQ ID NO: 294911 - DNA, 25 bp, Mus musculus
caacacccctatacctgagtttaag

SEQ ID NO: 294912 - DNA, 25 bp, Mus musculus
caacacccctattcctgagtttaag

SEQ ID NO: 294913 - DNA, 25 bp, Mus musculus
caacacccctttactagagactttg

SEQ ID NO: 294914 - DNA, 25 bp, Mus musculus
caacaccccttttctagagactttg

SEQ ID NO: 294915 - DNA, 25 bp, Mus musculus
caacaccctggaaagtcggctgaat

SEQ ID NO: 294916 - DNA, 25 bp, Mus musculus
caacaccctggatagtcggctgaat

SEQ ID NO: 294917 - DNA, 25 bp, Mus musculus
caacaccctgtcacacaataagaag

SEQ ID NO: 294918 - DNA, 25 bp, Mus musculus
caacaccctgtctcacaataagaag

SEQ ID NO: 294919 - DNA, 25 bp, Mus musculus
caacacctaactcggatcgtattat

SEQ ID NO: 294920 - DNA, 25 bp, Mus musculus
caacacctaactgggatcgtattat

SEQ ID NO: 294921 - DNA, 25 bp, Mus musculus
caacacctagcacagttccagtaga

SEQ ID NO: 294922 - DNA, 25 bp, Mus musculus
caacacctagcagagttccagtaga

SEQ ID NO: 294923 - DNA, 25 bp, Mus musculus
caacacctatgcatcttttaactgg

SEQ ID NO: 294924 - DNA, 25 bp, Mus musculus
caacacctatgcttcttttaactgg

SEQ ID NO: 294925 - DNA, 25 bp, Mus musculus
caacacctgcctatcatactataat

SEQ ID NO: 294926 - DNA, 25 bp, Mus musculus
caacacctgcctttcatactataat

SEQ ID NO: 294927 - DNA, 25 bp, Mus musculus
caacacctgtgaaaatggactccag

SEQ ID NO: 294928 - DNA, 25 bp, Mus musculus
caacacctgtgaaggccgacagtat

SEQ ID NO: 294929 - DNA, 25 bp, Mus musculus
caacacctgtgataatggactccag

SEQ ID NO: 294930 - DNA, 25 bp, Mus musculus
caacacctgtgatggccgacagtat

SEQ ID NO: 294931 - DNA, 25 bp, Mus musculus
caacacctgtgtcgccgatgatgat

SEQ ID NO: 294932 - DNA, 25 bp, Mus musculus
caacacctgtgtggccgatgatgat

SEQ ID NO: 294933 - DNA, 25 bp, Mus musculus
caacaccttctacgctcctgtggaa

SEQ ID NO: 294934 - DNA, 25 bp, Mus musculus
caacaccttctaggctcctgtggaa

SEQ ID NO: 294935 - DNA, 25 bp, Mus musculus
caacaccttgagctttggtgtgaac

SEQ ID NO: 294936 - DNA, 25 bp, Mus musculus
caacaccttgaggtttggtgtgaac

SEQ ID NO: 294937 - DNA, 25 bp, Mus musculus
caacaccttgccagcttacatagta

SEQ ID NO: 294938 - DNA, 25 bp, Mus musculus
caacaccttgcctgcttacatagta

SEQ ID NO: 294939 - DNA, 25 bp, Mus musculus
caacaccttgtactgggagctgaac

SEQ ID NO: 294940 - DNA, 25 bp, Mus musculus
caacaccttgtagtgggagctgaac

SEQ ID NO: 294941 - DNA, 25 bp, Mus musculus
caacacgaatcaaaagtctcttttt

SEQ ID NO: 294942 - DNA, 25 bp, Mus musculus
caacacgaatcataagtctcttttt

SEQ ID NO: 294943 - DNA, 25 bp, Mus musculus
caacacgcaggcaatgattcatcaa

SEQ ID NO: 294944 - DNA, 25 bp, Mus musculus
caacacgcaggctatgattcatcaa

SEQ ID NO: 294945 - DNA, 25 bp, Mus musculus
caacacgcttgaagtttgccctgat

SEQ ID NO: 294946 - DNA, 25 bp, Mus musculus
caacacgcttgatgtttgccctgat

SEQ ID NO: 294947 - DNA, 25 bp, Mus musculus
caacacggctctattgtgactaaga

SEQ ID NO: 294948 - DNA, 25 bp, Mus musculus
caacacggctcttttgtgactaaga

SEQ ID NO: 294949 - DNA, 25 bp, Mus musculus
caacacgtgtcaaatttctcccaaa

SEQ ID NO: 294950 - DNA, 25 bp, Mus musculus
caacacgtgtcatatttctcccaaa

SEQ ID NO: 294951 - DNA, 25 bp, Mus musculus
caacacgttttgcatggttaagtta

SEQ ID NO: 294952 - DNA, 25 bp, Mus musculus
caacacgttttggatggttaagtta

SEQ ID NO: 294953 - DNA, 25 bp, Mus musculus
caacactaaccaattgccctaagat

SEQ ID NO: 294954 - DNA, 25 bp, Mus musculus
caacactaaccatttgccctaagat

SEQ ID NO: 294955 - DNA, 25 bp, Mus musculus
caacactacgttctgtcttcaaaca

SEQ ID NO: 294956 - DNA, 25 bp, Mus musculus
caacactacgttgtgtcttcaaaca

SEQ ID NO: 294957 - DNA, 25 bp, Mus musculus
caacactagtataactgcacagctt

SEQ ID NO: 294958 - DNA, 25 bp, Mus musculus
caacactagtattactgcacagctt

SEQ ID NO: 294959 - DNA, 25 bp, Mus musculus
caacactataccagggattcagccc

SEQ ID NO: 294960 - DNA, 25 bp, Mus musculus
caacactatacctgggattcagccc

SEQ ID NO: 294961 - DNA, 25 bp, Mus musculus
caacactatgggactgaagaaacac

SEQ ID NO: 294962 - DNA, 25 bp, Mus musculus
caacactatgggtctgaagaaacac

SEQ ID NO: 294963 - DNA, 25 bp, Mus musculus
caacactccattcctttttattagt

SEQ ID NO: 294964 - DNA, 25 bp, Mus musculus
caacactccattgctttttattagt

SEQ ID NO: 294965 - DNA, 25 bp, Mus musculus
caacactccgcaatcggcatttcaa

SEQ ID NO: 294966 - DNA, 25 bp, Mus musculus
caacactccgcattcggcatttcaa

SEQ ID NO: 294967 - DNA, 25 bp, Mus musculus
caacactcgtgtctctattttactg

SEQ ID NO: 294968 - DNA, 25 bp, Mus musculus
caacactcgtgtgtctattttactg

SEQ ID NO: 294969 - DNA, 25 bp, Mus musculus
caacactctctgctactgcttataa

SEQ ID NO: 294970 - DNA, 25 bp, Mus musculus
caacactctctggtactgcttataa

SEQ ID NO: 294971 - DNA, 25 bp, Mus musculus
caacactctggtctggaagtatgca

SEQ ID NO: 294972 - DNA, 25 bp, Mus musculus
caacactctggtgtggaagtatgca

SEQ ID NO: 294973 - DNA, 25 bp, Mus musculus
caacactcttacattctctaacaaa

SEQ ID NO: 294974 - DNA, 25 bp, Mus musculus
caacactcttactttctctaacaaa

SEQ ID NO: 294975 - DNA, 25 bp, Mus musculus
caacactgcaggctgggagacagct

SEQ ID NO: 294976 - DNA, 25 bp, Mus musculus
caacactgcagggtgggagacagct

SEQ ID NO: 294977 - DNA, 25 bp, Mus musculus
caacactggttgattgtgtggcgat

SEQ ID NO: 294978 - DNA, 25 bp, Mus musculus
caacactggttgtttgtgtggcgat

SEQ ID NO: 294979 - DNA, 25 bp, Mus musculus
caacactgtccaaaattggatgaaa

SEQ ID NO: 294980 - DNA, 25 bp, Mus musculus
caacactgtccataattggatgaaa

SEQ ID NO: 294981 - DNA, 25 bp, Mus musculus
caacactgtggtcccagatcagctg

SEQ ID NO: 294982 - DNA, 25 bp, Mus musculus
caacactgtggtgccagatcagctg

SEQ ID NO: 294983 - DNA, 25 bp, Mus musculus
caacacttaagtcaaagggtgactg

SEQ ID NO: 294984 - DNA, 25 bp, Mus musculus
caacacttaagtgaaagggtgactg

SEQ ID NO: 294985 - DNA, 25 bp, Mus musculus
caacacttatgcatctttctttacc

SEQ ID NO: 294986 - DNA, 25 bp, Mus musculus
caacacttatgcttctttctttacc

SEQ ID NO: 294987 - DNA, 25 bp, Mus musculus
caacacttcctgagtttaacctctg

SEQ ID NO: 294988 - DNA, 25 bp, Mus musculus
caacacttcctgtgtttaacctctg

SEQ ID NO: 294989 - DNA, 25 bp, Mus musculus
caacacttctggagtttcacttgag

SEQ ID NO: 294990 - DNA, 25 bp, Mus musculus
caacacttctggtgtttcacttgag

SEQ ID NO: 294991 - DNA, 25 bp, Mus musculus
caacacttggaacgaatgtcgaatt

SEQ ID NO: 294992 - DNA, 25 bp, Mus musculus
caacacttggaaggaatgtcgaatt

SEQ ID NO: 294993 - DNA, 25 bp, Mus musculus
caacacttgtgtacctgtgagaata

SEQ ID NO: 294994 - DNA, 25 bp, Mus musculus
caacacttgtgtccaataaacaacg

SEQ ID NO: 294995 - DNA, 25 bp, Mus musculus
caacacttgtgtgcaataaacaacg

SEQ ID NO: 294996 - DNA, 25 bp, Mus musculus
caacacttgtgttcctgtgagaata

SEQ ID NO: 294997 - DNA, 25 bp, Mus musculus
caacactttccacggtgccgctgta

SEQ ID NO: 294998 - DNA, 25 bp, Mus musculus
caacactttccagggtgccgctgta

SEQ ID NO: 294999 - DNA, 25 bp, Mus musculus
caacactttggcacagctagaggaa

SEQ ID NO: 295000 - DNA, 25 bp, Mus musculus
caacactttggctcagctagaggaa

SEQ ID NO: 295001 - DNA, 25 bp, Mus musculus
caacagaaaaatcatgactggcttt

SEQ ID NO: 295002 - DNA, 25 bp, Mus musculus
caacagaaaaatgatgactggcttt

SEQ ID NO: 295003 - DNA, 25 bp, Mus musculus
caacagaagggaccggagccgctat

SEQ ID NO: 295004 - DNA, 25 bp, Mus musculus
caacagaagggagcggagccgctat

SEQ ID NO: 295005 - DNA, 25 bp, Mus musculus
caacagaagtatccgcatgtgccta

SEQ ID NO: 295006 - DNA, 25 bp, Mus musculus
caacagaagtatgcgcatgtgccta

SEQ ID NO: 295007 - DNA, 25 bp, Mus musculus
caacagaagtgtagagtccagcgac

SEQ ID NO: 295008 - DNA, 25 bp, Mus musculus
caacagaagtgttgagtccagcgac

SEQ ID NO: 295009 - DNA, 25 bp, Mus musculus
caacagacaagtacatgtggtgccc

SEQ ID NO: 295010 - DNA, 25 bp, Mus musculus
caacagacaagttcatgtggtgccc

SEQ ID NO: 295011 - DNA, 25 bp, Mus musculus
caacagacacgcagtgttttctgtc

SEQ ID NO: 295012 - DNA, 25 bp, Mus musculus
caacagacacgctgtgttttctgtc

SEQ ID NO: 295013 - DNA, 25 bp, Mus musculus
caacagactgttactcagtgtggat

SEQ ID NO: 295014 - DNA, 25 bp, Mus musculus
caacagactgtttctcagtgtggat

SEQ ID NO: 295015 - DNA, 25 bp, Mus musculus
caacagagagccagccaatggcacc

SEQ ID NO: 295016 - DNA, 25 bp, Mus musculus
caacagagagcctgccaatggcacc

SEQ ID NO: 295017 - DNA, 25 bp, Mus musculus
caacagagattacgtctacacccgc

SEQ ID NO: 295018 - DNA, 25 bp, Mus musculus
caacagagattaggtctacacccgc

SEQ ID NO: 295019 - DNA, 25 bp, Mus musculus
caacagagcattactttagcacttt

SEQ ID NO: 295020 - DNA, 25 bp, Mus musculus
caacagagcatttctttagcacttt

SEQ ID NO: 295021 - DNA, 25 bp, Mus musculus
caacagagccatcaggagccaagat

SEQ ID NO: 295022 - DNA, 25 bp, Mus musculus
caacagagccatgaggagccaagat

SEQ ID NO: 295023 - DNA, 25 bp, Mus musculus
caacagagccgtagttggtgttgtg

SEQ ID NO: 295024 - DNA, 25 bp, Mus musculus
caacagagccgttgttggtgttgtg

SEQ ID NO: 295025 - DNA, 25 bp, Mus musculus
caacagagcggtaatggcggcaaat

SEQ ID NO: 295026 - DNA, 25 bp, Mus musculus
caacagagcggttatggcggcaaat

SEQ ID NO: 295027 - DNA, 25 bp, Mus musculus
caacagagctcactcaaatgcaact

SEQ ID NO: 295028 - DNA, 25 bp, Mus musculus
caacagagctcagtcaaatgcaact

SEQ ID NO: 295029 - DNA, 25 bp, Mus musculus
caacagatgcacattatgaactctc

SEQ ID NO: 295030 - DNA, 25 bp, Mus musculus
caacagatgcactttatgaactctc

SEQ ID NO: 295031 - DNA, 25 bp, Mus musculus
caacagattaggacagagggcacgt

SEQ ID NO: 295032 - DNA, 25 bp, Mus musculus
caacagattaggtcagagggcacgt

SEQ ID NO: 295033 - DNA, 25 bp, Mus musculus
caacagattcatacaccttctaata

SEQ ID NO: 295034 - DNA, 25 bp, Mus musculus
caacagattcattcaccttctaata

SEQ ID NO: 295035 - DNA, 25 bp, Mus musculus
caacagcaaaatcgccctatagatg

SEQ ID NO: 295036 - DNA, 25 bp, Mus musculus
caacagcaaaatggccctatagatg

SEQ ID NO: 295037 - DNA, 25 bp, Mus musculus
caacagcaacatcattctgctcggg

SEQ ID NO: 295038 - DNA, 25 bp, Mus musculus
caacagcaacatgattctgctcggg

SEQ ID NO: 295039 - DNA, 25 bp, Mus musculus
caacagcacacaccctggaggacaa

SEQ ID NO: 295040 - DNA, 25 bp, Mus musculus
caacagcacacagcctggaggacaa

SEQ ID NO: 295041 - DNA, 25 bp, Mus musculus
caacagcagccgcttccaggagtgg

SEQ ID NO: 295042 - DNA, 25 bp, Mus musculus
caacagcagccggttccaggagtgg

SEQ ID NO: 295043 - DNA, 25 bp, Mus musculus
caacagcagcgaccccgagtagtgg

SEQ ID NO: 295044 - DNA, 25 bp, Mus musculus
caacagcagcgagcccgagtagtgg

SEQ ID NO: 295045 - DNA, 25 bp, Mus musculus
caacagcagggtcttgggcaacaag

SEQ ID NO: 295046 - DNA, 25 bp, Mus musculus
caacagcagggtgttgggcaacaag

SEQ ID NO: 295047 - DNA, 25 bp, Mus musculus
caacagcagttgagggccagagcca

SEQ ID NO: 295048 - DNA, 25 bp, Mus musculus
caacagcagttgtgggccagagcca

SEQ ID NO: 295049 - DNA, 25 bp, Mus musculus
caacagcatttcctcccttcatgaa

SEQ ID NO: 295050 - DNA, 25 bp, Mus musculus
caacagcatttcgtcccttcatgaa

SEQ ID NO: 295051 - DNA, 25 bp, Mus musculus
caacagcccaacatatgtttcctta

SEQ ID NO: 295052 - DNA, 25 bp, Mus musculus
caacagcccaacttatgtttcctta

SEQ ID NO: 295053 - DNA, 25 bp, Mus musculus
caacagcctggtctttcttgtaaac

SEQ ID NO: 295054 - DNA, 25 bp, Mus musculus
caacagcctggtgtttcttgtaaac

SEQ ID NO: 295055 - DNA, 25 bp, Mus musculus
caacagccttggatgaggtgggaat

SEQ ID NO: 295056 - DNA, 25 bp, Mus musculus
caacagccttggttgaggtgggaat

SEQ ID NO: 295057 - DNA, 25 bp, Mus musculus
caacagcgactcaatggtgggctat

SEQ ID NO: 295058 - DNA, 25 bp, Mus musculus
caacagcgactctatggtgggctat

SEQ ID NO: 295059 - DNA, 25 bp, Mus musculus
caacagcgttggaaccggttatggt

SEQ ID NO: 295060 - DNA, 25 bp, Mus musculus
caacagcgttggtaccggttatggt

SEQ ID NO: 295061 - DNA, 25 bp, Mus musculus
caacagcgtttgcagatgctcttaa

SEQ ID NO: 295062 - DNA, 25 bp, Mus musculus
caacagcgtttggagatgctcttaa

SEQ ID NO: 295063 - DNA, 25 bp, Mus musculus
caacagctccagaccaggtgatatt

SEQ ID NO: 295064 - DNA, 25 bp, Mus musculus
caacagctccagtccaggtgatatt

SEQ ID NO: 295065 - DNA, 25 bp, Mus musculus
caacagctccggaagttagggaact

SEQ ID NO: 295066 - DNA, 25 bp, Mus musculus
caacagctccggtagttagggaact

SEQ ID NO: 295067 - DNA, 25 bp, Mus musculus
caacagctctccatatactcgtggc

SEQ ID NO: 295068 - DNA, 25 bp, Mus musculus
caacagctctccttatactcgtggc

SEQ ID NO: 295069 - DNA, 25 bp, Mus musculus
caacagctctgtcttctaattaaaa

SEQ ID NO: 295070 - DNA, 25 bp, Mus musculus
caacagctctgtgttctaattaaaa

SEQ ID NO: 295071 - DNA, 25 bp, Mus musculus
caacagctgcagagtattgggtggt

SEQ ID NO: 295072 - DNA, 25 bp, Mus musculus
caacagctgcagtgtattgggtggt

SEQ ID NO: 295073 - DNA, 25 bp, Mus musculus
caacagctgcgtaagcaccagatgt

SEQ ID NO: 295074 - DNA, 25 bp, Mus musculus
caacagctgcgttagcaccagatgt

SEQ ID NO: 295075 - DNA, 25 bp, Mus musculus
caacagctggacctttaaatacgga

SEQ ID NO: 295076 - DNA, 25 bp, Mus musculus
caacagctggacgtttaaatacgga

SEQ ID NO: 295077 - DNA, 25 bp, Mus musculus
caacagctgttgcagatgctcttcc

SEQ ID NO: 295078 - DNA, 25 bp, Mus musculus
caacagctgttggagatgctcttcc

SEQ ID NO: 295079 - DNA, 25 bp, Mus musculus
caacagctgtttaaagtctttgtag

SEQ ID NO: 295080 - DNA, 25 bp, Mus musculus
caacagctgttttaagtctttgtag

SEQ ID NO: 295081 - DNA, 25 bp, Mus musculus
caacagcttcctatgcagggaaaat

SEQ ID NO: 295082 - DNA, 25 bp, Mus musculus
caacagcttcctttgcagggaaaat

SEQ ID NO: 295083 - DNA, 25 bp, Mus musculus
caacagcttcggaatgtgatggaac

SEQ ID NO: 295084 - DNA, 25 bp, Mus musculus
caacagcttcggtatgtgatggaac

SEQ ID NO: 295085 - DNA, 25 bp, Mus musculus
caacagcttctaagggcaggtgagt

SEQ ID NO: 295086 - DNA, 25 bp, Mus musculus
caacagcttctatgggcaggtgagt

SEQ ID NO: 295087 - DNA, 25 bp, Mus musculus
caacagcttctgatggatggttttg

SEQ ID NO: 295088 - DNA, 25 bp, Mus musculus
caacagcttctgttggatggttttg

SEQ ID NO: 295089 - DNA, 25 bp, Mus musculus
caacagcttgtgagtctggcatggt

SEQ ID NO: 295090 - DNA, 25 bp, Mus musculus
caacagcttgtgtgtctggcatggt

SEQ ID NO: 295091 - DNA, 25 bp, Mus musculus
caacagctttctcatctaaataaat

SEQ ID NO: 295092 - DNA, 25 bp, Mus musculus
caacagctttctgatctaaataaat

SEQ ID NO: 295093 - DNA, 25 bp, Mus musculus
caacaggagcttccagaacatccat

SEQ ID NO: 295094 - DNA, 25 bp, Mus musculus
caacaggagcttgcagaacatccat

SEQ ID NO: 295095 - DNA, 25 bp, Mus musculus
caacaggaggttagagcgctaccct

SEQ ID NO: 295096 - DNA, 25 bp, Mus musculus
caacaggaggtttgagcgctaccct

SEQ ID NO: 295097 - DNA, 25 bp, Mus musculus
caacaggagtcacattttcgtgcat

SEQ ID NO: 295098 - DNA, 25 bp, Mus musculus
caacaggagtcagattttcgtgcat

SEQ ID NO: 295099 - DNA, 25 bp, Mus musculus
caacaggagtggagccgtgatcatt

SEQ ID NO: 295100 - DNA, 25 bp, Mus musculus
caacaggagtggtgccgtgatcatt

SEQ ID NO: 295101 - DNA, 25 bp, Mus musculus
caacaggatttgctcactgactcga

SEQ ID NO: 295102 - DNA, 25 bp, Mus musculus
caacaggatttggtcactgactcga

SEQ ID NO: 295103 - DNA, 25 bp, Mus musculus
caacaggcaatccagattatgccaa

SEQ ID NO: 295104 - DNA, 25 bp, Mus musculus
caacaggcaatcgagattatgccaa

SEQ ID NO: 295105 - DNA, 25 bp, Mus musculus
caacaggcaggacgtagagattcgt

SEQ ID NO: 295106 - DNA, 25 bp, Mus musculus
caacaggcaggaggtagagattcgt

SEQ ID NO: 295107 - DNA, 25 bp, Mus musculus
caacaggcattgctggaaggctgca

SEQ ID NO: 295108 - DNA, 25 bp, Mus musculus
caacaggcattggtggaaggctgca

SEQ ID NO: 295109 - DNA, 25 bp, Mus musculus
caacaggccagacgcagttggtaag

SEQ ID NO: 295110 - DNA, 25 bp, Mus musculus
caacaggccagaggcagttggtaag

SEQ ID NO: 295111 - DNA, 25 bp, Mus musculus
caacaggctatcagtgaggagtccc

SEQ ID NO: 295112 - DNA, 25 bp, Mus musculus
caacaggctatctgtgaggagtccc

SEQ ID NO: 295113 - DNA, 25 bp, Mus musculus
caacaggctgggaagtaattgagtc

SEQ ID NO: 295114 - DNA, 25 bp, Mus musculus
caacaggctgggtagtaattgagtc

SEQ ID NO: 295115 - DNA, 25 bp, Mus musculus
caacaggcttaaccaatcttcaatt

SEQ ID NO: 295116 - DNA, 25 bp, Mus musculus
caacaggcttaagcaatcttcaatt

SEQ ID NO: 295117 - DNA, 25 bp, Mus musculus
caacagggagtaccattcaggccaa

SEQ ID NO: 295118 - DNA, 25 bp, Mus musculus
caacagggagtagcattcaggccaa

SEQ ID NO: 295119 - DNA, 25 bp, Mus musculus
caacagggcactatctaccgtgggc

SEQ ID NO: 295120 - DNA, 25 bp, Mus musculus
caacagggcactttctaccgtgggc

SEQ ID NO: 295121 - DNA, 25 bp, Mus musculus
caacagggccttcggcttggactga

SEQ ID NO: 295122 - DNA, 25 bp, Mus musculus
caacagggccttgggcttggactga

SEQ ID NO: 295123 - DNA, 25 bp, Mus musculus
caacagggtcctcgtcttggacaaa

SEQ ID NO: 295124 - DNA, 25 bp, Mus musculus
caacagggtcctggtcttggacaaa

SEQ ID NO: 295125 - DNA, 25 bp, Mus musculus
caacagggttttctcgaagccaaca

SEQ ID NO: 295126 - DNA, 25 bp, Mus musculus
caacagggttttgtcgaagccaaca

SEQ ID NO: 295127 - DNA, 25 bp, Mus musculus
caacaggtacatcggacaggatatt

SEQ ID NO: 295128 - DNA, 25 bp, Mus musculus
caacaggtacatgggacaggatatt

SEQ ID NO: 295129 - DNA, 25 bp, Mus musculus
caacaggtagcactggcagacatcc

SEQ ID NO: 295130 - DNA, 25 bp, Mus musculus
caacaggtagcagtggcagacatcc

SEQ ID NO: 295131 - DNA, 25 bp, Mus musculus
caacaggtatgacttgccaagcacg

SEQ ID NO: 295132 - DNA, 25 bp, Mus musculus
caacaggtatgagttgccaagcacg

SEQ ID NO: 295133 - DNA, 25 bp, Mus musculus
caacaggtcgggctgcaggaatctc

SEQ ID NO: 295134 - DNA, 25 bp, Mus musculus
caacaggtcggggtgcaggaatctc

SEQ ID NO: 295135 - DNA, 25 bp, Mus musculus
caacaggtggacatgctggcctata

SEQ ID NO: 295136 - DNA, 25 bp, Mus musculus
caacaggtggacttgctggcctata

SEQ ID NO: 295137 - DNA, 25 bp, Mus musculus
caacaggtgttgcaagctccaggtc

SEQ ID NO: 295138 - DNA, 25 bp, Mus musculus
caacaggtgttggaagctccaggtc

SEQ ID NO: 295139 - DNA, 25 bp, Mus musculus
caacaggttgttaagcctggaggca

SEQ ID NO: 295140 - DNA, 25 bp, Mus musculus
caacaggttgtttagcctggaggca

SEQ ID NO: 295141 - DNA, 25 bp, Mus musculus
caacaggttttcattcccctttgtg

SEQ ID NO: 295142 - DNA, 25 bp, Mus musculus
caacaggttttctttcccctttgtg

SEQ ID NO: 295143 - DNA, 25 bp, Mus musculus
caacagtaaagccaagatcgttagt

SEQ ID NO: 295144 - DNA, 25 bp, Mus musculus
caacagtaaagcgaagatcgttagt

SEQ ID NO: 295145 - DNA, 25 bp, Mus musculus
caacagtaacttaagaatgccccaa

SEQ ID NO: 295146 - DNA, 25 bp, Mus musculus
caacagtaactttagaatgccccaa

SEQ ID NO: 295147 - DNA, 25 bp, Mus musculus
caacagtagtaacacccttcctcaa

SEQ ID NO: 295148 - DNA, 25 bp, Mus musculus
caacagtagtaagacccttcctcaa

SEQ ID NO: 295149 - DNA, 25 bp, Mus musculus
caacagtattgcactggctccagaa

SEQ ID NO: 295150 - DNA, 25 bp, Mus musculus
caacagtattgctctggctccagaa

SEQ ID NO: 295151 - DNA, 25 bp, Mus musculus
caacagtcaatgctggttacctggg

SEQ ID NO: 295152 - DNA, 25 bp, Mus musculus
caacagtcaatggtggttacctggg

SEQ ID NO: 295153 - DNA, 25 bp, Mus musculus
caacagtcagcgaggagtccagcga

SEQ ID NO: 295154 - DNA, 25 bp, Mus musculus
caacagtcagcgtggagtccagcga

SEQ ID NO: 295155 - DNA, 25 bp, Mus musculus
caacagtcatttcttttgctctctc

SEQ ID NO: 295156 - DNA, 25 bp, Mus musculus
caacagtcatttgttttgctctctc

SEQ ID NO: 295157 - DNA, 25 bp, Mus musculus
caacagtgacgtctccatcgacttc

SEQ ID NO: 295158 - DNA, 25 bp, Mus musculus
caacagtgacgtgtccatcgacttc

SEQ ID NO: 295159 - DNA, 25 bp, Mus musculus
caacagtgatctaggagtgagctcc

SEQ ID NO: 295160 - DNA, 25 bp, Mus musculus
caacagtgatcttggagtgagctcc

SEQ ID NO: 295161 - DNA, 25 bp, Mus musculus
caacagtgattgaagctccaggaat

SEQ ID NO: 295162 - DNA, 25 bp, Mus musculus
caacagtgattgtagctccaggaat

SEQ ID NO: 295163 - DNA, 25 bp, Mus musculus
caacagtgcagaaaggttcctatct

SEQ ID NO: 295164 - DNA, 25 bp, Mus musculus
caacagtgcagataggttcctatct

SEQ ID NO: 295165 - DNA, 25 bp, Mus musculus
caacagtgctggcaagggcttctca

SEQ ID NO: 295166 - DNA, 25 bp, Mus musculus
caacagtgctgggaagggcttctca

SEQ ID NO: 295167 - DNA, 25 bp, Mus musculus
caacagtggctcaatgggctctgat

SEQ ID NO: 295168 - DNA, 25 bp, Mus musculus
caacagtggctctatgggctctgat

SEQ ID NO: 295169 - DNA, 25 bp, Mus musculus
caacagtggctgattgtcatcaaca

SEQ ID NO: 295170 - DNA, 25 bp, Mus musculus
caacagtggctgtttgtcatcaaca

SEQ ID NO: 295171 - DNA, 25 bp, Mus musculus
caacagtggtgtattaggagcctat

SEQ ID NO: 295172 - DNA, 25 bp, Mus musculus
caacagtggtgttttaggagcctat

SEQ ID NO: 295173 - DNA, 25 bp, Mus musculus
caacagtgtcttccgatgcgtccag

SEQ ID NO: 295174 - DNA, 25 bp, Mus musculus
caacagtgtcttgcgatgcgtccag

SEQ ID NO: 295175 - DNA, 25 bp, Mus musculus
caacagtgttgtcaagacttaggca

SEQ ID NO: 295176 - DNA, 25 bp, Mus musculus
caacagtgttgtgaagacttaggca

SEQ ID NO: 295177 - DNA, 25 bp, Mus musculus
caacagttcttgataccaagtttgt

SEQ ID NO: 295178 - DNA, 25 bp, Mus musculus
caacagttcttgttaccaagtttgt

SEQ ID NO: 295179 - DNA, 25 bp, Mus musculus
caacagttgaacatcttagactggc

SEQ ID NO: 295180 - DNA, 25 bp, Mus musculus
caacagttgaacttcttagactggc

SEQ ID NO: 295181 - DNA, 25 bp, Mus musculus
caacagttgcgtagtttaacatcta

SEQ ID NO: 295182 - DNA, 25 bp, Mus musculus
caacagttgcgttgtttaacatcta

SEQ ID NO: 295183 - DNA, 25 bp, Mus musculus
caacagttgctgagaaaaggaaagg

SEQ ID NO: 295184 - DNA, 25 bp, Mus musculus
caacagttgctgattttagctataa

SEQ ID NO: 295185 - DNA, 25 bp, Mus musculus
caacagttgctgtgaaaaggaaagg

SEQ ID NO: 295186 - DNA, 25 bp, Mus musculus
caacagttgctgtttttagctataa

SEQ ID NO: 295187 - DNA, 25 bp, Mus musculus
caacagtttactacctttacattct

SEQ ID NO: 295188 - DNA, 25 bp, Mus musculus
caacagtttacttcctttacattct

SEQ ID NO: 295189 - DNA, 25 bp, Mus musculus
caacagtttctccacctaaatgatc

SEQ ID NO: 295190 - DNA, 25 bp, Mus musculus
caacagtttctcgacctaaatgatc

SEQ ID NO: 295191 - DNA, 25 bp, Mus musculus
caacagtttttgaccataggaagca

SEQ ID NO: 295192 - DNA, 25 bp, Mus musculus
caacagtttttgtccataggaagca

SEQ ID NO: 295193 - DNA, 25 bp, Mus musculus
caacatacatctcatttccttttga

SEQ ID NO: 295194 - DNA, 25 bp, Mus musculus
caacatacatctgatttccttttga

SEQ ID NO: 295195 - DNA, 25 bp, Mus musculus
caacataggtgtaccccagcttttt

SEQ ID NO: 295196 - DNA, 25 bp, Mus musculus
caacataggtgttccccagcttttt

SEQ ID NO: 295197 - DNA, 25 bp, Mus musculus
caacatatatgcatgtaacaacaat

SEQ ID NO: 295198 - DNA, 25 bp, Mus musculus
caacatatatgcttgtaacaacaat

SEQ ID NO: 295199 - DNA, 25 bp, Mus musculus
caacatatcataacagatggcagac

SEQ ID NO: 295200 - DNA, 25 bp, Mus musculus
caacatatcatatcagatggcagac

SEQ ID NO: 295201 - DNA, 25 bp, Mus musculus
caacatatctctccggatcccagaa

SEQ ID NO: 295202 - DNA, 25 bp, Mus musculus
caacatatctctgcggatcccagaa

SEQ ID NO: 295203 - DNA, 25 bp, Mus musculus
caacatatggtcatcaagattccta

SEQ ID NO: 295204 - DNA, 25 bp, Mus musculus
caacatatggtcttcaagattccta

SEQ ID NO: 295205 - DNA, 25 bp, Mus musculus
caacatatggtgctgtaatatacta

SEQ ID NO: 295206 - DNA, 25 bp, Mus musculus
caacatatggtggtgtaatatacta

SEQ ID NO: 295207 - DNA, 25 bp, Mus musculus
caacatattgatccaggccaagctg

SEQ ID NO: 295208 - DNA, 25 bp, Mus musculus
caacatattgatgcaggccaagctg

SEQ ID NO: 295209 - DNA, 25 bp, Mus musculus
caacatcaaagaccctgcaggtcct

SEQ ID NO: 295210 - DNA, 25 bp, Mus musculus
caacatcaaagagcctgcaggtcct

SEQ ID NO: 295211 - DNA, 25 bp, Mus musculus
caacatcaccttcccgagtgtaata

SEQ ID NO: 295212 - DNA, 25 bp, Mus musculus
caacatcaccttgccgagtgtaata

SEQ ID NO: 295213 - DNA, 25 bp, Mus musculus
caacatcattcacaccggacatggt

SEQ ID NO: 295214 - DNA, 25 bp, Mus musculus
caacatcattcagaccggacatggt

SEQ ID NO: 295215 - DNA, 25 bp, Mus musculus
caacatccatctacagtcatgcttt

SEQ ID NO: 295216 - DNA, 25 bp, Mus musculus
caacatccatcttcagtcatgcttt

SEQ ID NO: 295217 - DNA, 25 bp, Mus musculus
caacatccggttaagccgccacgaa

SEQ ID NO: 295218 - DNA, 25 bp, Mus musculus
caacatccggtttagccgccacgaa

SEQ ID NO: 295219 - DNA, 25 bp, Mus musculus
caacatcctccaccaagagtgggaa

SEQ ID NO: 295220 - DNA, 25 bp, Mus musculus
caacatcctccagcaagagtgggaa

SEQ ID NO: 295221 - DNA, 25 bp, Mus musculus
caacatcctttgctttagtcatcag

SEQ ID NO: 295222 - DNA, 25 bp, Mus musculus
caacatcctttggtttagtcatcag

SEQ ID NO: 295223 - DNA, 25 bp, Mus musculus
caacatctaaaacttctccagcatc

SEQ ID NO: 295224 - DNA, 25 bp, Mus musculus
caacatctaaaagttctccagcatc

SEQ ID NO: 295225 - DNA, 25 bp, Mus musculus
caacatctacaacgaaggccaggat

SEQ ID NO: 295226 - DNA, 25 bp, Mus musculus
caacatctacaaggaaggccaggat

SEQ ID NO: 295227 - DNA, 25 bp, Mus musculus
caacatctacccatagtgtttgcca

SEQ ID NO: 295228 - DNA, 25 bp, Mus musculus
caacatctacccttagtgtttgcca

SEQ ID NO: 295229 - DNA, 25 bp, Mus musculus
caacatctagaacttggctgtacaa

SEQ ID NO: 295230 - DNA, 25 bp, Mus musculus
caacatctagaagttggctgtacaa

SEQ ID NO: 295231 - DNA, 25 bp, Mus musculus
caacatctcagtacctaccatgtaa

SEQ ID NO: 295232 - DNA, 25 bp, Mus musculus
caacatctcagttcctaccatgtaa

SEQ ID NO: 295233 - DNA, 25 bp, Mus musculus
caacatctggagaagtcatgcgtga

SEQ ID NO: 295234 - DNA, 25 bp, Mus musculus
caacatctggagtagtcatgcgtga

SEQ ID NO: 295235 - DNA, 25 bp, Mus musculus
caacatctgggactcctaaaaatga

SEQ ID NO: 295236 - DNA, 25 bp, Mus musculus
caacatctgggagtcctaaaaatga

SEQ ID NO: 295237 - DNA, 25 bp, Mus musculus
caacatctgtcgacgaccccatgca

SEQ ID NO: 295238 - DNA, 25 bp, Mus musculus
caacatctgtcgtcgaccccatgca

SEQ ID NO: 295239 - DNA, 25 bp, Mus musculus
caacatctgtgaccattccaaagca

SEQ ID NO: 295240 - DNA, 25 bp, Mus musculus
caacatctgtgagcattccaaagca

SEQ ID NO: 295241 - DNA, 25 bp, Mus musculus
caacatcttgctctgacaccaaagg

SEQ ID NO: 295242 - DNA, 25 bp, Mus musculus
caacatcttgctgtgacaccaaagg

SEQ ID NO: 295243 - DNA, 25 bp, Mus musculus
caacatctttaaacttcctatcctt

SEQ ID NO: 295244 - DNA, 25 bp, Mus musculus
caacatctttaatcttcctatcctt

SEQ ID NO: 295245 - DNA, 25 bp, Mus musculus
caacatgaaggacgtctgccggcgt

SEQ ID NO: 295246 - DNA, 25 bp, Mus musculus
caacatgaaggaggtctgccggcgt

SEQ ID NO: 295247 - DNA, 25 bp, Mus musculus
caacatgaatgtactcagtgtggaa

SEQ ID NO: 295248 - DNA, 25 bp, Mus musculus
caacatgaatgttctcagtgtggaa

SEQ ID NO: 295249 - DNA, 25 bp, Mus musculus
caacatgacagacatcctttcctaa

SEQ ID NO: 295250 - DNA, 25 bp, Mus musculus
caacatgacagagatcctttcctaa

SEQ ID NO: 295251 - DNA, 25 bp, Mus musculus
caacatgaccagaaacaggcggtta

SEQ ID NO: 295252 - DNA, 25 bp, Mus musculus
caacatgaccagtaacaggcggtta

SEQ ID NO: 295253 - DNA, 25 bp, Mus musculus
caacatgagattccctcttaccatt

SEQ ID NO: 295254 - DNA, 25 bp, Mus musculus
caacatgagattgcctcttaccatt

SEQ ID NO: 295255 - DNA, 25 bp, Mus musculus
caacatgagcagaggtcccgagcct

SEQ ID NO: 295256 - DNA, 25 bp, Mus musculus
caacatgagcagtggtcccgagcct

SEQ ID NO: 295257 - DNA, 25 bp, Mus musculus
caacatgcagcacagatacatagaa

SEQ ID NO: 295258 - DNA, 25 bp, Mus musculus
caacatgcagcagagatacatagaa

SEQ ID NO: 295259 - DNA, 25 bp, Mus musculus
caacatgctggtaaagaactgttag

SEQ ID NO: 295260 - DNA, 25 bp, Mus musculus
caacatgctggttaagaactgttag

SEQ ID NO: 295261 - DNA, 25 bp, Mus musculus
caacatgcttctcgcctagagggtt

SEQ ID NO: 295262 - DNA, 25 bp, Mus musculus
caacatgcttctggcctagagggtt

SEQ ID NO: 295263 - DNA, 25 bp, Mus musculus
caacatggacttcggcatatggcat

SEQ ID NO: 295264 - DNA, 25 bp, Mus musculus
caacatggacttgggcatatggcat

SEQ ID NO: 295265 - DNA, 25 bp, Mus musculus
caacatggatggatcttttggaatt

SEQ ID NO: 295266 - DNA, 25 bp, Mus musculus
caacatggatggttcttttggaatt

SEQ ID NO: 295267 - DNA, 25 bp, Mus musculus
caacatggcagcactgttctggtat

SEQ ID NO: 295268 - DNA, 25 bp, Mus musculus
caacatggcagctctgttctggtat

SEQ ID NO: 295269 - DNA, 25 bp, Mus musculus
caacatggctgactattactatgat

SEQ ID NO: 295270 - DNA, 25 bp, Mus musculus
caacatggctgagtattactatgat

SEQ ID NO: 295271 - DNA, 25 bp, Mus musculus
caacatgggtggagcgtctggaaac

SEQ ID NO: 295272 - DNA, 25 bp, Mus musculus
caacatgggtggtgcgtctggaaac

SEQ ID NO: 295273 - DNA, 25 bp, Mus musculus
caacatggtggtcgttttctgtaac

SEQ ID NO: 295274 - DNA, 25 bp, Mus musculus
caacatggtggtggttttctgtaac

SEQ ID NO: 295275 - DNA, 25 bp, Mus musculus
caacatggttttacttaggacagca

SEQ ID NO: 295276 - DNA, 25 bp, Mus musculus
caacatggtttttcttaggacagca

SEQ ID NO: 295277 - DNA, 25 bp, Mus musculus
caacatgtacgaccaggacggcgat

SEQ ID NO: 295278 - DNA, 25 bp, Mus musculus
caacatgtacgagcaggacggcgat

SEQ ID NO: 295279 - DNA, 25 bp, Mus musculus
caacatgtatgtacacttggtgtgt

SEQ ID NO: 295280 - DNA, 25 bp, Mus musculus
caacatgtatgttcacttggtgtgt

SEQ ID NO: 295281 - DNA, 25 bp, Mus musculus
caacatgtatttcaggcctctctcc

SEQ ID NO: 295282 - DNA, 25 bp, Mus musculus
caacatgtatttgaggcctctctcc

SEQ ID NO: 295283 - DNA, 25 bp, Mus musculus
caacatgtcccaatttcttcctgta

SEQ ID NO: 295284 - DNA, 25 bp, Mus musculus
caacatgtcccattttcttcctgta

SEQ ID NO: 295285 - DNA, 25 bp, Mus musculus
caacatgtgacgaatagacgacact

SEQ ID NO: 295286 - DNA, 25 bp, Mus musculus
caacatgtgacgtatagacgacact

SEQ ID NO: 295287 - DNA, 25 bp, Mus musculus
caacatgtgcagatcgtggtgtagt

SEQ ID NO: 295288 - DNA, 25 bp, Mus musculus
caacatgtgcagttcgtggtgtagt

SEQ ID NO: 295289 - DNA, 25 bp, Mus musculus
caacatgtggacatcctgctgatgt

SEQ ID NO: 295290 - DNA, 25 bp, Mus musculus
caacatgtggacttcctgctgatgt

SEQ ID NO: 295291 - DNA, 25 bp, Mus musculus
caacatgttctactagctgtgtcat

SEQ ID NO: 295292 - DNA, 25 bp, Mus musculus
caacatgttctagtagctgtgtcat

SEQ ID NO: 295293 - DNA, 25 bp, Mus musculus
caacatgtttcaattggaagaccat

SEQ ID NO: 295294 - DNA, 25 bp, Mus musculus
caacatgtttcatttggaagaccat

SEQ ID NO: 295295 - DNA, 25 bp, Mus musculus
caacattaaaccagctgtctcgtgg

SEQ ID NO: 295296 - DNA, 25 bp, Mus musculus
caacattaaacctgctgtctcgtgg

SEQ ID NO: 295297 - DNA, 25 bp, Mus musculus
caacattagcttcagtataaaaact

SEQ ID NO: 295298 - DNA, 25 bp, Mus musculus
caacattagcttgagtataaaaact

SEQ ID NO: 295299 - DNA, 25 bp, Mus musculus
caacattcacttacttgctaaccag

SEQ ID NO: 295300 - DNA, 25 bp, Mus musculus
caacattcacttcgatttaaaaact

SEQ ID NO: 295301 - DNA, 25 bp, Mus musculus
caacattcacttctgtcctttaaac

SEQ ID NO: 295302 - DNA, 25 bp, Mus musculus
caacattcacttggatttaaaaact

SEQ ID NO: 295303 - DNA, 25 bp, Mus musculus
caacattcacttgtgtcctttaaac

SEQ ID NO: 295304 - DNA, 25 bp, Mus musculus
caacattcactttcttgctaaccag

SEQ ID NO: 295305 - DNA, 25 bp, Mus musculus
caacattcagttcgcttggcatata

SEQ ID NO: 295306 - DNA, 25 bp, Mus musculus
caacattcagttggcttggcatata

SEQ ID NO: 295307 - DNA, 25 bp, Mus musculus
caacattcatctaggacctctatgc

SEQ ID NO: 295308 - DNA, 25 bp, Mus musculus
caacattcatcttggacctctatgc

SEQ ID NO: 295309 - DNA, 25 bp, Mus musculus
caacattccaggctgctacagcaag

SEQ ID NO: 295310 - DNA, 25 bp, Mus musculus
caacattccagggtgctacagcaag

SEQ ID NO: 295311 - DNA, 25 bp, Mus musculus
caacattcccctagaaatccagaaa

SEQ ID NO: 295312 - DNA, 25 bp, Mus musculus
caacattccccttgaaatccagaaa

SEQ ID NO: 295313 - DNA, 25 bp, Mus musculus
caacattcccttcaccattattaat

SEQ ID NO: 295314 - DNA, 25 bp, Mus musculus
caacattcccttgaccattattaat

SEQ ID NO: 295315 - DNA, 25 bp, Mus musculus
caacattgacctccccaacaagaag

SEQ ID NO: 295316 - DNA, 25 bp, Mus musculus
caacattgacctgcccaacaagaag

SEQ ID NO: 295317 - DNA, 25 bp, Mus musculus
caacattgagctatttatttggccc

SEQ ID NO: 295318 - DNA, 25 bp, Mus musculus
caacattgagctttttatttggccc

SEQ ID NO: 295319 - DNA, 25 bp, Mus musculus
caacattgagtgagcgggtttctct

SEQ ID NO: 295320 - DNA, 25 bp, Mus musculus
caacattgagtgtgcgggtttctct

SEQ ID NO: 295321 - DNA, 25 bp, Mus musculus
caacattgatgtacacattttggaa

SEQ ID NO: 295322 - DNA, 25 bp, Mus musculus
caacattgatgttcacattttggaa

SEQ ID NO: 295323 - DNA, 25 bp, Mus musculus
caacattgggagaaggagcttcata

SEQ ID NO: 295324 - DNA, 25 bp, Mus musculus
caacattgggagtaggagcttcata

SEQ ID NO: 295325 - DNA, 25 bp, Mus musculus
caacattgtgttccttggaggatag

SEQ ID NO: 295326 - DNA, 25 bp, Mus musculus
caacattgtgttgcttggaggatag

SEQ ID NO: 295327 - DNA, 25 bp, Mus musculus
caacattgttgcaatttctgcattt

SEQ ID NO: 295328 - DNA, 25 bp, Mus musculus
caacattgttgctatttctgcattt

SEQ ID NO: 295329 - DNA, 25 bp, Mus musculus
caacatttagctcggatgaaggaca

SEQ ID NO: 295330 - DNA, 25 bp, Mus musculus
caacatttagctgggatgaaggaca

SEQ ID NO: 295331 - DNA, 25 bp, Mus musculus
caacatttatcaaagaccaggaata

SEQ ID NO: 295332 - DNA, 25 bp, Mus musculus
caacatttatcatagaccaggaata

SEQ ID NO: 295333 - DNA, 25 bp, Mus musculus
caacatttcagtcagtagcttagct

SEQ ID NO: 295334 - DNA, 25 bp, Mus musculus
caacatttcagtgagtagcttagct

SEQ ID NO: 295335 - DNA, 25 bp, Mus musculus
caacatttctctacctgatcttgat

SEQ ID NO: 295336 - DNA, 25 bp, Mus musculus
caacatttctcttcctgatcttgat

SEQ ID NO: 295337 - DNA, 25 bp, Mus musculus
caacatttgcataatgttcagactg

SEQ ID NO: 295338 - DNA, 25 bp, Mus musculus
caacatttgcattatgttcagactg

SEQ ID NO: 295339 - DNA, 25 bp, Mus musculus
caacatttgtatacacctcgagctc

SEQ ID NO: 295340 - DNA, 25 bp, Mus musculus
caacatttgtattcacctcgagctc

SEQ ID NO: 295341 - DNA, 25 bp, Mus musculus
caacatttgtgtacctggtgcctat

SEQ ID NO: 295342 - DNA, 25 bp, Mus musculus
caacatttgtgttcctggtgcctat

SEQ ID NO: 295343 - DNA, 25 bp, Mus musculus
caacatttgtttaaagttctggcac

SEQ ID NO: 295344 - DNA, 25 bp, Mus musculus
caacatttgttttaagttctggcac

SEQ ID NO: 295345 - DNA, 25 bp, Mus musculus
caacattttacaatccagtcttccg

SEQ ID NO: 295346 - DNA, 25 bp, Mus musculus
caacattttacacgcattagctggg

SEQ ID NO: 295347 - DNA, 25 bp, Mus musculus
caacattttacaggcattagctggg

SEQ ID NO: 295348 - DNA, 25 bp, Mus musculus
caacattttacattccagtcttccg

SEQ ID NO: 295349 - DNA, 25 bp, Mus musculus
caacatttttacattctgtacaaca

SEQ ID NO: 295350 - DNA, 25 bp, Mus musculus
caacatttttactttctgtacaaca

SEQ ID NO: 295351 - DNA, 25 bp, Mus musculus
caaccaaaccgcattcgtgtggatt

SEQ ID NO: 295352 - DNA, 25 bp, Mus musculus
caaccaaaccgctttcgtgtggatt

SEQ ID NO: 295353 - DNA, 25 bp, Mus musculus
caaccaaactggagatattcttgaa

SEQ ID NO: 295354 - DNA, 25 bp, Mus musculus
caaccaaactggtgatattcttgaa

SEQ ID NO: 295355 - DNA, 25 bp, Mus musculus
caaccaaatcccagttcaactcaga

SEQ ID NO: 295356 - DNA, 25 bp, Mus musculus
caaccaaatccctgttcaactcaga

SEQ ID NO: 295357 - DNA, 25 bp, Mus musculus
caaccaaatgatcaaacgccgggat

SEQ ID NO: 295358 - DNA, 25 bp, Mus musculus
caaccaaatgatgaaacgccgggat

SEQ ID NO: 295359 - DNA, 25 bp, Mus musculus
caaccaacaaccagatttcttactc

SEQ ID NO: 295360 - DNA, 25 bp, Mus musculus
caaccaacaacctgatttcttactc

SEQ ID NO: 295361 - DNA, 25 bp, Mus musculus
caaccaaccttacttgccttgagtt

SEQ ID NO: 295362 - DNA, 25 bp, Mus musculus
caaccaaccttagttgccttgagtt

SEQ ID NO: 295363 - DNA, 25 bp, Mus musculus
caaccaagagcaattgtcacaggaa

SEQ ID NO: 295364 - DNA, 25 bp, Mus musculus
caaccaagagcatttgtcacaggaa

SEQ ID NO: 295365 - DNA, 25 bp, Mus musculus
caaccaagagggagcatgctccatc

SEQ ID NO: 295366 - DNA, 25 bp, Mus musculus
caaccaagagggtgcatgctccatc

SEQ ID NO: 295367 - DNA, 25 bp, Mus musculus
caaccaatcaagaaaaaatccaaag

SEQ ID NO: 295368 - DNA, 25 bp, Mus musculus
caaccaatcaagtaaaaatccaaag

SEQ ID NO: 295369 - DNA, 25 bp, Mus musculus
caaccaatgaatccctgttgtgtaa

SEQ ID NO: 295370 - DNA, 25 bp, Mus musculus
caaccaatgaatgcctgttgtgtaa

SEQ ID NO: 295371 - DNA, 25 bp, Mus musculus
caaccaatgagaaccaaccaatgag

SEQ ID NO: 295372 - DNA, 25 bp, Mus musculus
caaccaatgagaaccaaccccaagg

SEQ ID NO: 295373 - DNA, 25 bp, Mus musculus
caaccaatgagatccaaccaatgag

SEQ ID NO: 295374 - DNA, 25 bp, Mus musculus
caaccaatgagatccaaccccaagg

SEQ ID NO: 295375 - DNA, 25 bp, Mus musculus
caaccaattgggaagcattactaaa

SEQ ID NO: 295376 - DNA, 25 bp, Mus musculus
caaccaattgggtagcattactaaa

SEQ ID NO: 295377 - DNA, 25 bp, Mus musculus
caaccacacagtcagatgtctcaac

SEQ ID NO: 295378 - DNA, 25 bp, Mus musculus
caaccacacagtgagatgtctcaac

SEQ ID NO: 295379 - DNA, 25 bp, Mus musculus
caaccacacgcactttgatgttcaa

SEQ ID NO: 295380 - DNA, 25 bp, Mus musculus
caaccacacgcagtttgatgttcaa

SEQ ID NO: 295381 - DNA, 25 bp, Mus musculus
caaccacaggacagtcacactttgt

SEQ ID NO: 295382 - DNA, 25 bp, Mus musculus
caaccacaggactgtcacactttgt

SEQ ID NO: 295383 - DNA, 25 bp, Mus musculus
caaccacccaaccaatgtttttgag

SEQ ID NO: 295384 - DNA, 25 bp, Mus musculus
caaccacccaacgaatgtttttgag

SEQ ID NO: 295385 - DNA, 25 bp, Mus musculus
caaccaccctgacttcaatggaaga

SEQ ID NO: 295386 - DNA, 25 bp, Mus musculus
caaccaccctgagttcaatggaaga

SEQ ID NO: 295387 - DNA, 25 bp, Mus musculus
caaccacgatgacaaggcgtttgag

SEQ ID NO: 295388 - DNA, 25 bp, Mus musculus
caaccacgatgagaaggcgtttgag

SEQ ID NO: 295389 - DNA, 25 bp, Mus musculus
caaccactccccagtgtcaagttat

SEQ ID NO: 295390 - DNA, 25 bp, Mus musculus
caaccactcccctgtgtcaagttat

SEQ ID NO: 295391 - DNA, 25 bp, Mus musculus
caaccactggctaagtaattctgtg

SEQ ID NO: 295392 - DNA, 25 bp, Mus musculus
caaccactggcttagtaattctgtg

SEQ ID NO: 295393 - DNA, 25 bp, Mus musculus
caaccactgggcaagttctgagcag

SEQ ID NO: 295394 - DNA, 25 bp, Mus musculus
caaccactgggctagttctgagcag

SEQ ID NO: 295395 - DNA, 25 bp, Mus musculus
caaccacttagaaatgcaaaaacat

SEQ ID NO: 295396 - DNA, 25 bp, Mus musculus
caaccacttagatatgcaaaaacat

SEQ ID NO: 295397 - DNA, 25 bp, Mus musculus
caaccacttgtaccttatttccatc

SEQ ID NO: 295398 - DNA, 25 bp, Mus musculus
caaccacttgtagcttatttccatc

SEQ ID NO: 295399 - DNA, 25 bp, Mus musculus
caaccactttgacttatgctatagt

SEQ ID NO: 295400 - DNA, 25 bp, Mus musculus
caaccactttgagttatgctatagt

SEQ ID NO: 295401 - DNA, 25 bp, Mus musculus
caaccactttttagcagcttttacg

SEQ ID NO: 295402 - DNA, 25 bp, Mus musculus
caaccacttttttgcagcttttacg

SEQ ID NO: 295403 - DNA, 25 bp, Mus musculus
caaccagaacctatgacccagattt

SEQ ID NO: 295404 - DNA, 25 bp, Mus musculus
caaccagaacctttgacccagattt

SEQ ID NO: 295405 - DNA, 25 bp, Mus musculus
caaccagaagaaccccatttactag

SEQ ID NO: 295406 - DNA, 25 bp, Mus musculus
caaccagaagaagcccatttactag

SEQ ID NO: 295407 - DNA, 25 bp, Mus musculus
caaccagacggccatttgatgcaat

SEQ ID NO: 295408 - DNA, 25 bp, Mus musculus
caaccagacggcgatttgatgcaat

SEQ ID NO: 295409 - DNA, 25 bp, Mus musculus
caaccagacttaattctagcctcac

SEQ ID NO: 295410 - DNA, 25 bp, Mus musculus
caaccagacttatttctagcctcac

SEQ ID NO: 295411 - DNA, 25 bp, Mus musculus
caaccagagtgtcaagtttcagcct

SEQ ID NO: 295412 - DNA, 25 bp, Mus musculus
caaccagagtgtgaagtttcagcct

SEQ ID NO: 295413 - DNA, 25 bp, Mus musculus
caaccagatccgcatgctgatggaa

SEQ ID NO: 295414 - DNA, 25 bp, Mus musculus
caaccagatccggatgctgatggaa

SEQ ID NO: 295415 - DNA, 25 bp, Mus musculus
caaccagatctcacctatactaaga

SEQ ID NO: 295416 - DNA, 25 bp, Mus musculus
caaccagatctctcctatactaaga

SEQ ID NO: 295417 - DNA, 25 bp, Mus musculus
caaccagatggtcttcaagactgaa

SEQ ID NO: 295418 - DNA, 25 bp, Mus musculus
caaccagatggtgttcaagactgaa

SEQ ID NO: 295419 - DNA, 25 bp, Mus musculus
caaccagccataccgacagagtgtt

SEQ ID NO: 295420 - DNA, 25 bp, Mus musculus
caaccagccatagcgacagagtgtt

SEQ ID NO: 295421 - DNA, 25 bp, Mus musculus
caaccagcccaaacaatgcggagaa

SEQ ID NO: 295422 - DNA, 25 bp, Mus musculus
caaccagcccaatcaatgcggagaa

SEQ ID NO: 295423 - DNA, 25 bp, Mus musculus
caaccagctattcgcctgcgaaggt

SEQ ID NO: 295424 - DNA, 25 bp, Mus musculus
caaccagctattggcctgcgaaggt

SEQ ID NO: 295425 - DNA, 25 bp, Mus musculus
caaccagctcttcactctaaggcag

SEQ ID NO: 295426 - DNA, 25 bp, Mus musculus
caaccagctcttgactctaaggcag

SEQ ID NO: 295427 - DNA, 25 bp, Mus musculus
caaccagctgcccattttgtgagat

SEQ ID NO: 295428 - DNA, 25 bp, Mus musculus
caaccagctgccgattttgtgagat

SEQ ID NO: 295429 - DNA, 25 bp, Mus musculus
caaccaggacctcgaaaccactaag

SEQ ID NO: 295430 - DNA, 25 bp, Mus musculus
caaccaggacctggaaaccactaag

SEQ ID NO: 295431 - DNA, 25 bp, Mus musculus
caaccaggacggagagtgacgatcg

SEQ ID NO: 295432 - DNA, 25 bp, Mus musculus
caaccaggacggtgagtgacgatcg

SEQ ID NO: 295433 - DNA, 25 bp, Mus musculus
caaccaggatgacgctcttcatcgc

SEQ ID NO: 295434 - DNA, 25 bp, Mus musculus
caaccaggatgaggctcttcatcgc

SEQ ID NO: 295435 - DNA, 25 bp, Mus musculus
caaccaggcattccccatattaaaa

SEQ ID NO: 295436 - DNA, 25 bp, Mus musculus
caaccaggcattgcccatattaaaa

SEQ ID NO: 295437 - DNA, 25 bp, Mus musculus
caaccaggcggcatcgggtgtatgt

SEQ ID NO: 295438 - DNA, 25 bp, Mus musculus
caaccaggcggcttcgggtgtatgt

SEQ ID NO: 295439 - DNA, 25 bp, Mus musculus
caaccagggtatcaggtgtcccagt

SEQ ID NO: 295440 - DNA, 25 bp, Mus musculus
caaccagggtatgaggtgtcccagt

SEQ ID NO: 295441 - DNA, 25 bp, Mus musculus
caaccaggtcttagcgcagtagaga

SEQ ID NO: 295442 - DNA, 25 bp, Mus musculus
caaccaggtctttgcgcagtagaga

SEQ ID NO: 295443 - DNA, 25 bp, Mus musculus
caaccagtaccgagaggcagctttc

SEQ ID NO: 295444 - DNA, 25 bp, Mus musculus
caaccagtaccgtgaggcagctttc

SEQ ID NO: 295445 - DNA, 25 bp, Mus musculus
caaccagtagaaccgttgaaaccca

SEQ ID NO: 295446 - DNA, 25 bp, Mus musculus
caaccagtagaagcgttgaaaccca

SEQ ID NO: 295447 - DNA, 25 bp, Mus musculus
caaccagtcagccttttgcagggaa

SEQ ID NO: 295448 - DNA, 25 bp, Mus musculus
caaccagtcagcgttttgcagggaa

SEQ ID NO: 295449 - DNA, 25 bp, Mus musculus
caaccagtgggtcatacgttttcct

SEQ ID NO: 295450 - DNA, 25 bp, Mus musculus
caaccagtgggtgatacgttttcct

SEQ ID NO: 295451 - DNA, 25 bp, Mus musculus
caaccagttctaagttctcatttaa

SEQ ID NO: 295452 - DNA, 25 bp, Mus musculus
caaccagttctatgttctcatttaa

SEQ ID NO: 295453 - DNA, 25 bp, Mus musculus
caaccagttttcatgcgcggcaagg

SEQ ID NO: 295454 - DNA, 25 bp, Mus musculus
caaccagttttcttgcgcggcaagg

SEQ ID NO: 295455 - DNA, 25 bp, Mus musculus
caaccataaatgagctcttgggctg

SEQ ID NO: 295456 - DNA, 25 bp, Mus musculus
caaccataaatgtgctcttgggctg

SEQ ID NO: 295457 - DNA, 25 bp, Mus musculus
caaccatatggtcgccatactgaga

SEQ ID NO: 295458 - DNA, 25 bp, Mus musculus
caaccatatggtggccatactgaga

SEQ ID NO: 295459 - DNA, 25 bp, Mus musculus
caaccatcatctcttgctgtcttac

SEQ ID NO: 295460 - DNA, 25 bp, Mus musculus
caaccatcatctgttgctgtcttac

SEQ ID NO: 295461 - DNA, 25 bp, Mus musculus
caaccatctgcaattctagagctcc

SEQ ID NO: 295462 - DNA, 25 bp, Mus musculus
caaccatctgcatttctagagctcc

SEQ ID NO: 295463 - DNA, 25 bp, Mus musculus
caaccatctgtcatctatttcaaaa

SEQ ID NO: 295464 - DNA, 25 bp, Mus musculus
caaccatctgtcttctatttcaaaa

SEQ ID NO: 295465 - DNA, 25 bp, Mus musculus
caaccatctgtgaacttcatcgtta

SEQ ID NO: 295466 - DNA, 25 bp, Mus musculus
caaccatctgtgtacttcatcgtta

SEQ ID NO: 295467 - DNA, 25 bp, Mus musculus
caaccatcttgtagcaacataccca

SEQ ID NO: 295468 - DNA, 25 bp, Mus musculus
caaccatcttgttgcaacataccca

SEQ ID NO: 295469 - DNA, 25 bp, Mus musculus
caaccatctttaactccaggtgcag

SEQ ID NO: 295470 - DNA, 25 bp, Mus musculus
caaccatctttatctccaggtgcag

SEQ ID NO: 295471 - DNA, 25 bp, Mus musculus
caaccatgacctaggcagatagcca

SEQ ID NO: 295472 - DNA, 25 bp, Mus musculus
caaccatgaccttggcagatagcca

SEQ ID NO: 295473 - DNA, 25 bp, Mus musculus
caaccatgccagctgcaggcaggat

SEQ ID NO: 295474 - DNA, 25 bp, Mus musculus
caaccatgccaggtgcaggcaggat

SEQ ID NO: 295475 - DNA, 25 bp, Mus musculus
caaccatggcccaggtggctgagct

SEQ ID NO: 295476 - DNA, 25 bp, Mus musculus
caaccatggccctggtggctgagct

SEQ ID NO: 295477 - DNA, 25 bp, Mus musculus
caaccatgtaagagctgatccgtaa

SEQ ID NO: 295478 - DNA, 25 bp, Mus musculus
caaccatgtaagtgctgatccgtaa

SEQ ID NO: 295479 - DNA, 25 bp, Mus musculus
caaccatgtcaaaagcaaaccctgc

SEQ ID NO: 295480 - DNA, 25 bp, Mus musculus
caaccatgtcaatagcaaaccctgc

SEQ ID NO: 295481 - DNA, 25 bp, Mus musculus
caaccatgtgacaggcttttcccca

SEQ ID NO: 295482 - DNA, 25 bp, Mus musculus
caaccatgtgactggcttttcccca

SEQ ID NO: 295483 - DNA, 25 bp, Mus musculus
caaccatgttaccccagttgcaggg

SEQ ID NO: 295484 - DNA, 25 bp, Mus musculus
caaccatgttacgccagttgcaggg

SEQ ID NO: 295485 - DNA, 25 bp, Mus musculus
caaccatgttagaacagctacagtt

SEQ ID NO: 295486 - DNA, 25 bp, Mus musculus
caaccatgttagtacagctacagtt

SEQ ID NO: 295487 - DNA, 25 bp, Mus musculus
caaccatgtttactttgaagcccat

SEQ ID NO: 295488 - DNA, 25 bp, Mus musculus
caaccatgtttagtttgaagcccat

SEQ ID NO: 295489 - DNA, 25 bp, Mus musculus
caaccatgtttccacttagctcagt

SEQ ID NO: 295490 - DNA, 25 bp, Mus musculus
caaccatgtttcgacttagctcagt

SEQ ID NO: 295491 - DNA, 25 bp, Mus musculus
caaccattccctactttttgatcta

SEQ ID NO: 295492 - DNA, 25 bp, Mus musculus
caaccattcccttctttttgatcta

SEQ ID NO: 295493 - DNA, 25 bp, Mus musculus
caaccatttcagcagattccacagg

SEQ ID NO: 295494 - DNA, 25 bp, Mus musculus
caaccatttcaggagattccacagg

SEQ ID NO: 295495 - DNA, 25 bp, Mus musculus
caaccatttgaaaacttagcaaggg

SEQ ID NO: 295496 - DNA, 25 bp, Mus musculus
caaccatttgaatacttagcaaggg

SEQ ID NO: 295497 - DNA, 25 bp, Mus musculus
caaccattttaaatgttgcttcaaa

SEQ ID NO: 295498 - DNA, 25 bp, Mus musculus
caaccattttaattgttgcttcaaa

SEQ ID NO: 295499 - DNA, 25 bp, Mus musculus
caaccattttggctactgtttcctc

SEQ ID NO: 295500 - DNA, 25 bp, Mus musculus
caaccattttgggtactgtttcctc

SEQ ID NO: 295501 - DNA, 25 bp, Mus musculus
caacccaaaattacaaggcccatct

SEQ ID NO: 295502 - DNA, 25 bp, Mus musculus
caacccaaaatttcaaggcccatct

SEQ ID NO: 295503 - DNA, 25 bp, Mus musculus
caacccaagaggcactcacttatgg

SEQ ID NO: 295504 - DNA, 25 bp, Mus musculus
caacccaagagggactcacttatgg

SEQ ID NO: 295505 - DNA, 25 bp, Mus musculus
caacccaatacccgccaggagcggg

SEQ ID NO: 295506 - DNA, 25 bp, Mus musculus
caacccaataccggccaggagcggg

SEQ ID NO: 295507 - DNA, 25 bp, Mus musculus
caacccaccattccgtgttaatatt

SEQ ID NO: 295508 - DNA, 25 bp, Mus musculus
caacccaccattgcgtgttaatatt

SEQ ID NO: 295509 - DNA, 25 bp, Mus musculus
caacccacgttgctggacatggaca

SEQ ID NO: 295510 - DNA, 25 bp, Mus musculus
caacccacgttggtggacatggaca

SEQ ID NO: 295511 - DNA, 25 bp, Mus musculus
caacccactcttcggatatttcgtc

SEQ ID NO: 295512 - DNA, 25 bp, Mus musculus
caacccactcttgggatatttcgtc

SEQ ID NO: 295513 - DNA, 25 bp, Mus musculus
caacccacttccattaaacttgaca

SEQ ID NO: 295514 - DNA, 25 bp, Mus musculus
caacccacttcctttaaacttgaca

SEQ ID NO: 295515 - DNA, 25 bp, Mus musculus
caacccagaggtcgtggtcgcagta

SEQ ID NO: 295516 - DNA, 25 bp, Mus musculus
caacccagaggtggtggtcgcagta

SEQ ID NO: 295517 - DNA, 25 bp, Mus musculus
caacccagcactactggtcacaggg

SEQ ID NO: 295518 - DNA, 25 bp, Mus musculus
caacccagcacttctggtcacaggg

SEQ ID NO: 295519 - DNA, 25 bp, Mus musculus
caacccagtggcctttagagtccaa

SEQ ID NO: 295520 - DNA, 25 bp, Mus musculus
caacccagtggcgtttagagtccaa

SEQ ID NO: 295521 - DNA, 25 bp, Mus musculus
caacccagttctactcgggtgataa

SEQ ID NO: 295522 - DNA, 25 bp, Mus musculus
caacccagttcttctcgggtgataa

SEQ ID NO: 295523 - DNA, 25 bp, Mus musculus
caacccatagggaacatattttgtc

SEQ ID NO: 295524 - DNA, 25 bp, Mus musculus
caacccatagggtacatattttgtc

SEQ ID NO: 295525 - DNA, 25 bp, Mus musculus
caacccatcgtcctgactatttaaa

SEQ ID NO: 295526 - DNA, 25 bp, Mus musculus
caacccatcgtcgtgactatttaaa

SEQ ID NO: 295527 - DNA, 25 bp, Mus musculus
caaccccaaaaccatgcacttggaa

SEQ ID NO: 295528 - DNA, 25 bp, Mus musculus
caaccccaaaacgatgcacttggaa

SEQ ID NO: 295529 - DNA, 25 bp, Mus musculus
caaccccaaccaagttttttgtgtg

SEQ ID NO: 295530 - DNA, 25 bp, Mus musculus
caaccccaaccatgttttttgtgtg

SEQ ID NO: 295531 - DNA, 25 bp, Mus musculus
caaccccaagaccttagcagaactg

SEQ ID NO: 295532 - DNA, 25 bp, Mus musculus
caaccccaagacgttagcagaactg

SEQ ID NO: 295533 - DNA, 25 bp, Mus musculus
caaccccacattattgggtgtgaga

SEQ ID NO: 295534 - DNA, 25 bp, Mus musculus
caaccccacatttttgggtgtgaga

SEQ ID NO: 295535 - DNA, 25 bp, Mus musculus
caaccccacttgactaaggtctatg

SEQ ID NO: 295536 - DNA, 25 bp, Mus musculus
caaccccacttgtctaaggtctatg

SEQ ID NO: 295537 - DNA, 25 bp, Mus musculus
caaccccagccaagtgaactataac

SEQ ID NO: 295538 - DNA, 25 bp, Mus musculus
caaccccagccaatatgttcatgga

SEQ ID NO: 295539 - DNA, 25 bp, Mus musculus
caaccccagccatgtgaactataac

SEQ ID NO: 295540 - DNA, 25 bp, Mus musculus
caaccccagccattatgttcatgga

SEQ ID NO: 295541 - DNA, 25 bp, Mus musculus
caaccccagcctatgtcatcattgt

SEQ ID NO: 295542 - DNA, 25 bp, Mus musculus
caaccccagcctttgtcatcattgt

SEQ ID NO: 295543 - DNA, 25 bp, Mus musculus
caaccccagctcagaaatagaaagg

SEQ ID NO: 295544 - DNA, 25 bp, Mus musculus
caaccccagctctgaaatagaaagg

SEQ ID NO: 295545 - DNA, 25 bp, Mus musculus
caaccccaggacaggcctggtacgt

SEQ ID NO: 295546 - DNA, 25 bp, Mus musculus
caaccccaggactggcctggtacgt

SEQ ID NO: 295547 - DNA, 25 bp, Mus musculus
caaccccgactgctttagagagact

SEQ ID NO: 295548 - DNA, 25 bp, Mus musculus
caaccccgactggtttagagagact

SEQ ID NO: 295549 - DNA, 25 bp, Mus musculus
caaccccgccataggtttcaaactg

SEQ ID NO: 295550 - DNA, 25 bp, Mus musculus
caaccccgccattggtttcaaactg

SEQ ID NO: 295551 - DNA, 25 bp, Mus musculus
caaccccgtgttctatgcgtttatt

SEQ ID NO: 295552 - DNA, 25 bp, Mus musculus
caaccccgtgttgtatgcgtttatt

SEQ ID NO: 295553 - DNA, 25 bp, Mus musculus
caaccccgttgtcaggacggtgaag

SEQ ID NO: 295554 - DNA, 25 bp, Mus musculus
caaccccgttgtgaggacggtgaag

SEQ ID NO: 295555 - DNA, 25 bp, Mus musculus
caacccctctctcttggatttaatt

SEQ ID NO: 295556 - DNA, 25 bp, Mus musculus
caacccctctctgttggatttaatt

SEQ ID NO: 295557 - DNA, 25 bp, Mus musculus
caacccctggtgatacctatgactt

SEQ ID NO: 295558 - DNA, 25 bp, Mus musculus
caacccctggtgttacctatgactt

SEQ ID NO: 295559 - DNA, 25 bp, Mus musculus
caacccctgtgaagcaactaaattg

SEQ ID NO: 295560 - DNA, 25 bp, Mus musculus
caacccctgtgatgcaactaaattg

SEQ ID NO: 295561 - DNA, 25 bp, Mus musculus
caaccccttcgacgatgatgccaag

SEQ ID NO: 295562 - DNA, 25 bp, Mus musculus
caaccccttcgaggatgatgccaag

SEQ ID NO: 295563 - DNA, 25 bp, Mus musculus
caaccccttctaagtgcatgcatat

SEQ ID NO: 295564 - DNA, 25 bp, Mus musculus
caaccccttctatgtgcatgcatat

SEQ ID NO: 295565 - DNA, 25 bp, Mus musculus
caaccccttgctaacatttctatga

SEQ ID NO: 295566 - DNA, 25 bp, Mus musculus
caaccccttgcttacatttctatga

SEQ ID NO: 295567 - DNA, 25 bp, Mus musculus
caaccccttgggacaaatggctgaa

SEQ ID NO: 295568 - DNA, 25 bp, Mus musculus
caaccccttgggtcaaatggctgaa

SEQ ID NO: 295569 - DNA, 25 bp, Mus musculus
caacccctttgacaacgacgaagag

SEQ ID NO: 295570 - DNA, 25 bp, Mus musculus
caacccctttgagaacgacgaagag

SEQ ID NO: 295571 - DNA, 25 bp, Mus musculus
caacccgattctaaggacattttat

SEQ ID NO: 295572 - DNA, 25 bp, Mus musculus
caacccgattcttaggacattttat

SEQ ID NO: 295573 - DNA, 25 bp, Mus musculus
caacccgcctgtacacttttgggag

SEQ ID NO: 295574 - DNA, 25 bp, Mus musculus
caacccgcctgttcacttttgggag

SEQ ID NO: 295575 - DNA, 25 bp, Mus musculus
caacccgcttgaacggctggatgag

SEQ ID NO: 295576 - DNA, 25 bp, Mus musculus
caacccgcttgatcggctggatgag

SEQ ID NO: 295577 - DNA, 25 bp, Mus musculus
caacccggatggcaagcagaagtca

SEQ ID NO: 295578 - DNA, 25 bp, Mus musculus
caacccggatgggaagcagaagtca

SEQ ID NO: 295579 - DNA, 25 bp, Mus musculus
caacccggtggaaggctcttctgga

SEQ ID NO: 295580 - DNA, 25 bp, Mus musculus
caacccggtggatggctcttctgga

SEQ ID NO: 295581 - DNA, 25 bp, Mus musculus
caacccgtctttatgatacttgtcg

SEQ ID NO: 295582 - DNA, 25 bp, Mus musculus
caacccgtctttttgatacttgtcg

SEQ ID NO: 295583 - DNA, 25 bp, Mus musculus
caaccctaagccaaagccttagaag

SEQ ID NO: 295584 - DNA, 25 bp, Mus musculus
caaccctaagcctaagccttagaag

SEQ ID NO: 295585 - DNA, 25 bp, Mus musculus
caaccctagatcattttgtagtcgg

SEQ ID NO: 295586 - DNA, 25 bp, Mus musculus
caaccctagatctttttgtagtcgg

SEQ ID NO: 295587 - DNA, 25 bp, Mus musculus
caaccctatgttcatagcaaccact

SEQ ID NO: 295588 - DNA, 25 bp, Mus musculus
caaccctatgttgatagcaaccact

SEQ ID NO: 295589 - DNA, 25 bp, Mus musculus
caaccctcaagcactcaagtggtga

SEQ ID NO: 295590 - DNA, 25 bp, Mus musculus
caaccctcaagctctcaagtggtga

SEQ ID NO: 295591 - DNA, 25 bp, Mus musculus
caaccctcaatgagtttgctgctta

SEQ ID NO: 295592 - DNA, 25 bp, Mus musculus
caaccctcaatgtgtttgctgctta

SEQ ID NO: 295593 - DNA, 25 bp, Mus musculus
caaccctcacatactttagtttctt

SEQ ID NO: 295594 - DNA, 25 bp, Mus musculus
caaccctcacattctttagtttctt

SEQ ID NO: 295595 - DNA, 25 bp, Mus musculus
caaccctcactccagatgaacaagt

SEQ ID NO: 295596 - DNA, 25 bp, Mus musculus
caaccctcactcgagatgaacaagt

SEQ ID NO: 295597 - DNA, 25 bp, Mus musculus
caaccctcaggtagacacatgagtt

SEQ ID NO: 295598 - DNA, 25 bp, Mus musculus
caaccctcaggttgacacatgagtt

SEQ ID NO: 295599 - DNA, 25 bp, Mus musculus
caaccctctgaacgtttcctggttg

SEQ ID NO: 295600 - DNA, 25 bp, Mus musculus
caaccctctgaaggtttcctggttg

SEQ ID NO: 295601 - DNA, 25 bp, Mus musculus
caaccctgcctgacttaagtgctaa

SEQ ID NO: 295602 - DNA, 25 bp, Mus musculus
caaccctgcctgtcttaagtgctaa

SEQ ID NO: 295603 - DNA, 25 bp, Mus musculus
caaccctgctttacaaaaggtgctg

SEQ ID NO: 295604 - DNA, 25 bp, Mus musculus
caaccctgcttttcaaaaggtgctg

SEQ ID NO: 295605 - DNA, 25 bp, Mus musculus
caaccctggaggatttgagcttgag

SEQ ID NO: 295606 - DNA, 25 bp, Mus musculus
caaccctggaggttttgagcttgag

SEQ ID NO: 295607 - DNA, 25 bp, Mus musculus
caaccctggatcctcaaggtctttg

SEQ ID NO: 295608 - DNA, 25 bp, Mus musculus
caaccctggatcgtcaaggtctttg

SEQ ID NO: 295609 - DNA, 25 bp, Mus musculus
caaccctggcaacctgggccaaaaa

SEQ ID NO: 295610 - DNA, 25 bp, Mus musculus
caaccctggcaagctgggccaaaaa

SEQ ID NO: 295611 - DNA, 25 bp, Mus musculus
caaccctgggatcatgtggtcagca

SEQ ID NO: 295612 - DNA, 25 bp, Mus musculus
caaccctgggatgatgtggtcagca

SEQ ID NO: 295613 - DNA, 25 bp, Mus musculus
caaccctggtttcccttgacacagt

SEQ ID NO: 295614 - DNA, 25 bp, Mus musculus
caaccctggtttgccttgacacagt

SEQ ID NO: 295615 - DNA, 25 bp, Mus musculus
caaccctgtattacaaagacggctt

SEQ ID NO: 295616 - DNA, 25 bp, Mus musculus
caaccctgtatttcaaagacggctt

SEQ ID NO: 295617 - DNA, 25 bp, Mus musculus
caaccctgtgctcattaggcccagt

SEQ ID NO: 295618 - DNA, 25 bp, Mus musculus
caaccctgtgctgattaggcccagt

SEQ ID NO: 295619 - DNA, 25 bp, Mus musculus
caaccctgtggcctcttctagaggg

SEQ ID NO: 295620 - DNA, 25 bp, Mus musculus
caaccctgtggcgtcttctagaggg

SEQ ID NO: 295621 - DNA, 25 bp, Mus musculus
caaccctgttggcttcggtgacctt

SEQ ID NO: 295622 - DNA, 25 bp, Mus musculus
caaccctgttgggttcggtgacctt

SEQ ID NO: 295623 - DNA, 25 bp, Mus musculus
caacccttaatcataatccagccaa

SEQ ID NO: 295624 - DNA, 25 bp, Mus musculus
caacccttaatcttaatccagccaa

SEQ ID NO: 295625 - DNA, 25 bp, Mus musculus
caacccttaggaccctttcattctg

SEQ ID NO: 295626 - DNA, 25 bp, Mus musculus
caacccttaggagcctttcattctg

SEQ ID NO: 295627 - DNA, 25 bp, Mus musculus
caacccttatctcactactatatca

SEQ ID NO: 295628 - DNA, 25 bp, Mus musculus
caacccttatctgactactatatca

SEQ ID NO: 295629 - DNA, 25 bp, Mus musculus
caacccttcaaacaatgggaagaca

SEQ ID NO: 295630 - DNA, 25 bp, Mus musculus
caacccttcaaagaatgggaagaca

SEQ ID NO: 295631 - DNA, 25 bp, Mus musculus
caacccttcatgcacttatggagcc

SEQ ID NO: 295632 - DNA, 25 bp, Mus musculus
caacccttcatggacttatggagcc

SEQ ID NO: 295633 - DNA, 25 bp, Mus musculus
caacccttcccaaagaaattcctag

SEQ ID NO: 295634 - DNA, 25 bp, Mus musculus
caacccttcccatagaaattcctag

SEQ ID NO: 295635 - DNA, 25 bp, Mus musculus
caacccttcgtgaacatcaaaaaat

SEQ ID NO: 295636 - DNA, 25 bp, Mus musculus
caacccttcgtgtacatcaaaaaat

SEQ ID NO: 295637 - DNA, 25 bp, Mus musculus
caacccttctatcttcaaagatcac

SEQ ID NO: 295638 - DNA, 25 bp, Mus musculus
caacccttctatgttcaaagatcac

SEQ ID NO: 295639 - DNA, 25 bp, Mus musculus
caacccttgacgctggcattgggct

SEQ ID NO: 295640 - DNA, 25 bp, Mus musculus
caacccttgacggtggcattgggct

SEQ ID NO: 295641 - DNA, 25 bp, Mus musculus
caaccctttctgatattggctaaga

SEQ ID NO: 295642 - DNA, 25 bp, Mus musculus
caaccctttctgttattggctaaga

SEQ ID NO: 295643 - DNA, 25 bp, Mus musculus
caaccctttgcccattctattctga

SEQ ID NO: 295644 - DNA, 25 bp, Mus musculus
caaccctttgccgattctattctga

SEQ ID NO: 295645 - DNA, 25 bp, Mus musculus
caaccgaaccttctgtacgtgggtg

SEQ ID NO: 295646 - DNA, 25 bp, Mus musculus
caaccgaaccttgtgtacgtgggtg

SEQ ID NO: 295647 - DNA, 25 bp, Mus musculus
caaccgaattacatcaacagtccca

SEQ ID NO: 295648 - DNA, 25 bp, Mus musculus
caaccgaattacttcaacagtccca

SEQ ID NO: 295649 - DNA, 25 bp, Mus musculus
caaccgaattcgagagcctggagaa

SEQ ID NO: 295650 - DNA, 25 bp, Mus musculus
caaccgaattcgtgagcctggagaa

SEQ ID NO: 295651 - DNA, 25 bp, Mus musculus
caaccgacccagatggtgggttctg

SEQ ID NO: 295652 - DNA, 25 bp, Mus musculus
caaccgacccagttggtgggttctg

SEQ ID NO: 295653 - DNA, 25 bp, Mus musculus
caaccgagagtactgcagcaaacat

SEQ ID NO: 295654 - DNA, 25 bp, Mus musculus
caaccgagagtagtgcagcaaacat

SEQ ID NO: 295655 - DNA, 25 bp, Mus musculus
caaccgaggccgctaagagtacaat

SEQ ID NO: 295656 - DNA, 25 bp, Mus musculus
caaccgaggccggtaagagtacaat

SEQ ID NO: 295657 - DNA, 25 bp, Mus musculus
caaccgatacttctctccaaatttt

SEQ ID NO: 295658 - DNA, 25 bp, Mus musculus
caaccgatacttgtctccaaatttt

SEQ ID NO: 295659 - DNA, 25 bp, Mus musculus
caaccgcaagtcagatatctatgtt

SEQ ID NO: 295660 - DNA, 25 bp, Mus musculus
caaccgcaagtctgatatctatgtt

SEQ ID NO: 295661 - DNA, 25 bp, Mus musculus
caaccgcacagaacggctgacctgt

SEQ ID NO: 295662 - DNA, 25 bp, Mus musculus
caaccgcacagatcggctgacctgt

SEQ ID NO: 295663 - DNA, 25 bp, Mus musculus
caaccgcagagtaacacccaaggaa

SEQ ID NO: 295664 - DNA, 25 bp, Mus musculus
caaccgcagagttacacccaaggaa

SEQ ID NO: 295665 - DNA, 25 bp, Mus musculus
caaccgcatctaccgcatgattaaa

SEQ ID NO: 295666 - DNA, 25 bp, Mus musculus
caaccgcatctagcgcatgattaaa

SEQ ID NO: 295667 - DNA, 25 bp, Mus musculus
caaccgccacctccgatttaagtta

SEQ ID NO: 295668 - DNA, 25 bp, Mus musculus
caaccgccacctgcgatttaagtta

SEQ ID NO: 295669 - DNA, 25 bp, Mus musculus
caaccgctcttcctgggctataaaa

SEQ ID NO: 295670 - DNA, 25 bp, Mus musculus
caaccgctcttcgtgggctataaaa

SEQ ID NO: 295671 - DNA, 25 bp, Mus musculus
caaccggaagtgagtcagagtgcag

SEQ ID NO: 295672 - DNA, 25 bp, Mus musculus
caaccggaagtgtgtcagagtgcag

SEQ ID NO: 295673 - DNA, 25 bp, Mus musculus
caaccggagctcctcactggtcatg

SEQ ID NO: 295674 - DNA, 25 bp, Mus musculus
caaccggagctcgtcactggtcatg

SEQ ID NO: 295675 - DNA, 25 bp, Mus musculus
caaccggaggctcggtccaagaagc

SEQ ID NO: 295676 - DNA, 25 bp, Mus musculus
caaccggaggctgggtccaagaagc

SEQ ID NO: 295677 - DNA, 25 bp, Mus musculus
caaccggatccgcagtggcatgttc

SEQ ID NO: 295678 - DNA, 25 bp, Mus musculus
caaccggatccggagtggcatgttc

SEQ ID NO: 295679 - DNA, 25 bp, Mus musculus
caaccggcggctctttgaacaaaat

SEQ ID NO: 295680 - DNA, 25 bp, Mus musculus
caaccggcggctgtttgaacaaaat

SEQ ID NO: 295681 - DNA, 25 bp, Mus musculus
caaccggcttgcaatgaagggctgt

SEQ ID NO: 295682 - DNA, 25 bp, Mus musculus
caaccggcttgctatgaagggctgt

SEQ ID NO: 295683 - DNA, 25 bp, Mus musculus
caaccggtggttacttcatgcaata

SEQ ID NO: 295684 - DNA, 25 bp, Mus musculus
caaccggtggtttcttcatgcaata

SEQ ID NO: 295685 - DNA, 25 bp, Mus musculus
caaccgtcggtaaatttacatctcc

SEQ ID NO: 295686 - DNA, 25 bp, Mus musculus
caaccgtcggtatatttacatctcc

SEQ ID NO: 295687 - DNA, 25 bp, Mus musculus
caaccgtctgtaactgtagatacag

SEQ ID NO: 295688 - DNA, 25 bp, Mus musculus
caaccgtctgtatctgtagatacag

SEQ ID NO: 295689 - DNA, 25 bp, Mus musculus
caaccgtgtataatgagctctaggg

SEQ ID NO: 295690 - DNA, 25 bp, Mus musculus
caaccgtgtatattgagctctaggg

SEQ ID NO: 295691 - DNA, 25 bp, Mus musculus
caacctaagatacttgggaccctgt

SEQ ID NO: 295692 - DNA, 25 bp, Mus musculus
caacctaagatagttgggaccctgt

SEQ ID NO: 295693 - DNA, 25 bp, Mus musculus
caacctaccccgagtggacgacgtg

SEQ ID NO: 295694 - DNA, 25 bp, Mus musculus
caacctaccccgtgtggacgacgtg

SEQ ID NO: 295695 - DNA, 25 bp, Mus musculus
caacctactctccactttcttaata

SEQ ID NO: 295696 - DNA, 25 bp, Mus musculus
caacctactctcgactttcttaata

SEQ ID NO: 295697 - DNA, 25 bp, Mus musculus
caacctactgcacaccagcagaggg

SEQ ID NO: 295698 - DNA, 25 bp, Mus musculus
caacctactgcagaccagcagaggg

SEQ ID NO: 295699 - DNA, 25 bp, Mus musculus
caacctatcagacgacataaccaag

SEQ ID NO: 295700 - DNA, 25 bp, Mus musculus
caacctatcagaggacataaccaag

SEQ ID NO: 295701 - DNA, 25 bp, Mus musculus
caacctattcatcagtgtcaactcc

SEQ ID NO: 295702 - DNA, 25 bp, Mus musculus
caacctattcatgagtgtcaactcc

SEQ ID NO: 295703 - DNA, 25 bp, Mus musculus
caacctattgccaatgagaaacatg

SEQ ID NO: 295704 - DNA, 25 bp, Mus musculus
caacctattgcctatgagaaacatg

SEQ ID NO: 295705 - DNA, 25 bp, Mus musculus
caacctcaaacccaagtttctacat

SEQ ID NO: 295706 - DNA, 25 bp, Mus musculus
caacctcaaaccgaagtttctacat

SEQ ID NO: 295707 - DNA, 25 bp, Mus musculus
caacctcaacgtccatatgtccatg

SEQ ID NO: 295708 - DNA, 25 bp, Mus musculus
caacctcaacgtgcatatgtccatg

SEQ ID NO: 295709 - DNA, 25 bp, Mus musculus
caacctcaaggactggcagctgcag

SEQ ID NO: 295710 - DNA, 25 bp, Mus musculus
caacctcaaggagtggcagctgcag

SEQ ID NO: 295711 - DNA, 25 bp, Mus musculus
caacctcaatgaagcagaggagcgc

SEQ ID NO: 295712 - DNA, 25 bp, Mus musculus
caacctcaatgatgcagaggagcgc

SEQ ID NO: 295713 - DNA, 25 bp, Mus musculus
caacctcaatgcagtgccttttggg

SEQ ID NO: 295714 - DNA, 25 bp, Mus musculus
caacctcaatgctgtgccttttggg

SEQ ID NO: 295715 - DNA, 25 bp, Mus musculus
caacctcacattagtcacggactaa

SEQ ID NO: 295716 - DNA, 25 bp, Mus musculus
caacctcacatttgtcacggactaa

SEQ ID NO: 295717 - DNA, 25 bp, Mus musculus
caacctcactgaagtcttataaaga

SEQ ID NO: 295718 - DNA, 25 bp, Mus musculus
caacctcactgatgtcttataaaga

SEQ ID NO: 295719 - DNA, 25 bp, Mus musculus
caacctcagagcaggaaccactttg

SEQ ID NO: 295720 - DNA, 25 bp, Mus musculus
caacctcagagctggaaccactttg

SEQ ID NO: 295721 - DNA, 25 bp, Mus musculus
caacctcattgcaacctggatcaga

SEQ ID NO: 295722 - DNA, 25 bp, Mus musculus
caacctcattgctacctggatcaga

SEQ ID NO: 295723 - DNA, 25 bp, Mus musculus
caacctccacttcccatattgtatg

SEQ ID NO: 295724 - DNA, 25 bp, Mus musculus
caacctccacttgccatattgtatg

SEQ ID NO: 295725 - DNA, 25 bp, Mus musculus
caacctcccaaaatgagagttctgg

SEQ ID NO: 295726 - DNA, 25 bp, Mus musculus
caacctcccaaattgagagttctgg

SEQ ID NO: 295727 - DNA, 25 bp, Mus musculus
caacctccgtggactttctggtaga

SEQ ID NO: 295728 - DNA, 25 bp, Mus musculus
caacctccgtggtctttctggtaga

SEQ ID NO: 295729 - DNA, 25 bp, Mus musculus
caacctcctgtaattctagacctag

SEQ ID NO: 295730 - DNA, 25 bp, Mus musculus
caacctcctgtaccctgggattata

SEQ ID NO: 295731 - DNA, 25 bp, Mus musculus
caacctcctgtagcctgggattata

SEQ ID NO: 295732 - DNA, 25 bp, Mus musculus
caacctcctgtatttctagacctag

SEQ ID NO: 295733 - DNA, 25 bp, Mus musculus
caacctccttacacatcaaatattc

SEQ ID NO: 295734 - DNA, 25 bp, Mus musculus
caacctccttactcatcaaatattc

SEQ ID NO: 295735 - DNA, 25 bp, Mus musculus
caacctcgaggcaacgttttgaact

SEQ ID NO: 295736 - DNA, 25 bp, Mus musculus
caacctcgaggctacgttttgaact

SEQ ID NO: 295737 - DNA, 25 bp, Mus musculus
caacctcggcgccttccagggaagg

SEQ ID NO: 295738 - DNA, 25 bp, Mus musculus
caacctcggcgcgttccagggaagg

SEQ ID NO: 295739 - DNA, 25 bp, Mus musculus
caacctctaatcaaatcccttgaga

SEQ ID NO: 295740 - DNA, 25 bp, Mus musculus
caacctctaatctaatcccttgaga

SEQ ID NO: 295741 - DNA, 25 bp, Mus musculus
caacctctatcccaatttaatatta

SEQ ID NO: 295742 - DNA, 25 bp, Mus musculus
caacctctatccgaatttaatatta

SEQ ID NO: 295743 - DNA, 25 bp, Mus musculus
caacctctatgtcttctttgtaagt

SEQ ID NO: 295744 - DNA, 25 bp, Mus musculus
caacctctatgtgttctttgtaagt

SEQ ID NO: 295745 - DNA, 25 bp, Mus musculus
caacctctgaagaaactgtgtacat

SEQ ID NO: 295746 - DNA, 25 bp, Mus musculus
caacctctgaagtaactgtgtacat

SEQ ID NO: 295747 - DNA, 25 bp, Mus musculus
caacctctgatgagatatacactgt

SEQ ID NO: 295748 - DNA, 25 bp, Mus musculus
caacctctgatgtgatatacactgt

SEQ ID NO: 295749 - DNA, 25 bp, Mus musculus
caacctctgcagcaaatgactactg

SEQ ID NO: 295750 - DNA, 25 bp, Mus musculus
caacctctgcaggaaatgactactg

SEQ ID NO: 295751 - DNA, 25 bp, Mus musculus
caacctctgtacacattacctgtaa

SEQ ID NO: 295752 - DNA, 25 bp, Mus musculus
caacctctgtactcattacctgtaa

SEQ ID NO: 295753 - DNA, 25 bp, Mus musculus
caacctctgtctcccatatgaatgt

SEQ ID NO: 295754 - DNA, 25 bp, Mus musculus
caacctctgtctgccatatgaatgt

SEQ ID NO: 295755 - DNA, 25 bp, Mus musculus
caacctcttacgagcgcctttctgc

SEQ ID NO: 295756 - DNA, 25 bp, Mus musculus
caacctcttacgtgcgcctttctgc

SEQ ID NO: 295757 - DNA, 25 bp, Mus musculus
caacctctttgcagcattatccata

SEQ ID NO: 295758 - DNA, 25 bp, Mus musculus
caacctctttgctgcattatccata

SEQ ID NO: 295759 - DNA, 25 bp, Mus musculus
caacctgaactactctgcgaatgtc

SEQ ID NO: 295760 - DNA, 25 bp, Mus musculus
caacctgaactagtctgcgaatgtc

SEQ ID NO: 295761 - DNA, 25 bp, Mus musculus
caacctgagacgagcatgtgtattc

SEQ ID NO: 295762 - DNA, 25 bp, Mus musculus
caacctgagacgtgcatgtgtattc

SEQ ID NO: 295763 - DNA, 25 bp, Mus musculus
caacctgagctaagaaagtggccaa

SEQ ID NO: 295764 - DNA, 25 bp, Mus musculus
caacctgagctatgaaagtggccaa

SEQ ID NO: 295765 - DNA, 25 bp, Mus musculus
caacctgatatcctggtgactggta

SEQ ID NO: 295766 - DNA, 25 bp, Mus musculus
caacctgatatcgtggtgactggta

SEQ ID NO: 295767 - DNA, 25 bp, Mus musculus
caacctgcaaatcgagcttctgtac

SEQ ID NO: 295768 - DNA, 25 bp, Mus musculus
caacctgcaaatggagcttctgtac

SEQ ID NO: 295769 - DNA, 25 bp, Mus musculus
caacctgccaaacctgaaaaacctg

SEQ ID NO: 295770 - DNA, 25 bp, Mus musculus
caacctgccaaagctgaaaaacctg

SEQ ID NO: 295771 - DNA, 25 bp, Mus musculus
caacctgccatcagctgtaaatcag

SEQ ID NO: 295772 - DNA, 25 bp, Mus musculus
caacctgccatctgctgtaaatcag

SEQ ID NO: 295773 - DNA, 25 bp, Mus musculus
caacctgcccaaattatatacccga

SEQ ID NO: 295774 - DNA, 25 bp, Mus musculus
caacctgcccaatttatatacccga

SEQ ID NO: 295775 - DNA, 25 bp, Mus musculus
caacctgcctctatgcacttagata

SEQ ID NO: 295776 - DNA, 25 bp, Mus musculus
caacctgcctctttgcacttagata

SEQ ID NO: 295777 - DNA, 25 bp, Mus musculus
caacctgcgcaacaactgctggaag

SEQ ID NO: 295778 - DNA, 25 bp, Mus musculus
caacctgcgcaagaactgctggaag

SEQ ID NO: 295779 - DNA, 25 bp, Mus musculus
caacctgctgctcctagaaaatgat

SEQ ID NO: 295780 - DNA, 25 bp, Mus musculus
caacctgctgctgctagaaaatgat

SEQ ID NO: 295781 - DNA, 25 bp, Mus musculus
caacctgctggcagctcaactcttg

SEQ ID NO: 295782 - DNA, 25 bp, Mus musculus
caacctgctggctgctcaactcttg

SEQ ID NO: 295783 - DNA, 25 bp, Mus musculus
caacctgctgttcttgagtgactac

SEQ ID NO: 295784 - DNA, 25 bp, Mus musculus
caacctgctgttgttgagtgactac

SEQ ID NO: 295785 - DNA, 25 bp, Mus musculus
caacctggatgtccccatgtggagg

SEQ ID NO: 295786 - DNA, 25 bp, Mus musculus
caacctggatgtgcccatgtggagg

SEQ ID NO: 295787 - DNA, 25 bp, Mus musculus
caacctggccttcagtttggatact

SEQ ID NO: 295788 - DNA, 25 bp, Mus musculus
caacctggccttgagtttggatact

SEQ ID NO: 295789 - DNA, 25 bp, Mus musculus
caacctgggctgatcattattagtt

SEQ ID NO: 295790 - DNA, 25 bp, Mus musculus
caacctgggctgttcattattagtt

SEQ ID NO: 295791 - DNA, 25 bp, Mus musculus
caacctgggtatccacataagcaag

SEQ ID NO: 295792 - DNA, 25 bp, Mus musculus
caacctgggtatgcacataagcaag

SEQ ID NO: 295793 - DNA, 25 bp, Mus musculus
caacctggtccgctattttggcgtg

SEQ ID NO: 295794 - DNA, 25 bp, Mus musculus
caacctggtccggtattttggcgtg

SEQ ID NO: 295795 - DNA, 25 bp, Mus musculus
caacctggttagaagatgcccgtca

SEQ ID NO: 295796 - DNA, 25 bp, Mus musculus
caacctggttagtagatgcccgtca

SEQ ID NO: 295797 - DNA, 25 bp, Mus musculus
caacctgtaacaaacaagtctttac

SEQ ID NO: 295798 - DNA, 25 bp, Mus musculus
caacctgtaacatacaagtctttac

SEQ ID NO: 295799 - DNA, 25 bp, Mus musculus
caacctgtaatgatccactggagat

SEQ ID NO: 295800 - DNA, 25 bp, Mus musculus
caacctgtaatgttccactggagat

SEQ ID NO: 295801 - DNA, 25 bp, Mus musculus
caacctgtaccaagtacttacgcta

SEQ ID NO: 295802 - DNA, 25 bp, Mus musculus
caacctgtaccatgtacttacgcta

SEQ ID NO: 295803 - DNA, 25 bp, Mus musculus
caacctgtactgacctgtgagctga

SEQ ID NO: 295804 - DNA, 25 bp, Mus musculus
caacctgtactgtcctgtgagctga

SEQ ID NO: 295805 - DNA, 25 bp, Mus musculus
caacctgtaggaacacatctggaat

SEQ ID NO: 295806 - DNA, 25 bp, Mus musculus
caacctgtaggatcacatctggaat

SEQ ID NO: 295807 - DNA, 25 bp, Mus musculus
caacctgtgcatactctaagcttcc

SEQ ID NO: 295808 - DNA, 25 bp, Mus musculus
caacctgtgcattctctaagcttcc

SEQ ID NO: 295809 - DNA, 25 bp, Mus musculus
caacctgtgggtagtggctccttca

SEQ ID NO: 295810 - DNA, 25 bp, Mus musculus
caacctgtgggttgtggctccttca

SEQ ID NO: 295811 - DNA, 25 bp, Mus musculus
caacctgtggttctgcttgctgagc

SEQ ID NO: 295812 - DNA, 25 bp, Mus musculus
caacctgtggttgtgcttgctgagc

SEQ ID NO: 295813 - DNA, 25 bp, Mus musculus
caacctgtgtatctcctgtagatca

SEQ ID NO: 295814 - DNA, 25 bp, Mus musculus
caacctgtgtatgtcctgtagatca

SEQ ID NO: 295815 - DNA, 25 bp, Mus musculus
caacctgttacacacttgaacttct

SEQ ID NO: 295816 - DNA, 25 bp, Mus musculus
caacctgttacagacttgaacttct

SEQ ID NO: 295817 - DNA, 25 bp, Mus musculus
caaccttaccccactgtacattaga

SEQ ID NO: 295818 - DNA, 25 bp, Mus musculus
caaccttacccctctgtacattaga

SEQ ID NO: 295819 - DNA, 25 bp, Mus musculus
caaccttagaatcatgaactgtagt

SEQ ID NO: 295820 - DNA, 25 bp, Mus musculus
caaccttagaatgatgaactgtagt

SEQ ID NO: 295821 - DNA, 25 bp, Mus musculus
caaccttcagctaccattcaatatt

SEQ ID NO: 295822 - DNA, 25 bp, Mus musculus
caaccttcagcttccattcaatatt

SEQ ID NO: 295823 - DNA, 25 bp, Mus musculus
caaccttcattgaagatcctttata

SEQ ID NO: 295824 - DNA, 25 bp, Mus musculus
caaccttcattgtagatcctttata

SEQ ID NO: 295825 - DNA, 25 bp, Mus musculus
caaccttccagtacaattcttcaaa

SEQ ID NO: 295826 - DNA, 25 bp, Mus musculus
caaccttccagttcaattcttcaaa

SEQ ID NO: 295827 - DNA, 25 bp, Mus musculus
caaccttccttccaaacagaaactg

SEQ ID NO: 295828 - DNA, 25 bp, Mus musculus
caaccttccttcgaaacagaaactg

SEQ ID NO: 295829 - DNA, 25 bp, Mus musculus
caaccttcgatgatatccttgcagc

SEQ ID NO: 295830 - DNA, 25 bp, Mus musculus
caaccttcgatgttatccttgcagc

SEQ ID NO: 295831 - DNA, 25 bp, Mus musculus
caaccttcgattaacatatgtgcac

SEQ ID NO: 295832 - DNA, 25 bp, Mus musculus
caaccttcgatttacatatgtgcac

SEQ ID NO: 295833 - DNA, 25 bp, Mus musculus
caaccttcggagacttcttgctttc

SEQ ID NO: 295834 - DNA, 25 bp, Mus musculus
caaccttcggagtcttcttgctttc

SEQ ID NO: 295835 - DNA, 25 bp, Mus musculus
caaccttcgggaaatcgtggaacag

SEQ ID NO: 295836 - DNA, 25 bp, Mus musculus
caaccttcgggatatcgtggaacag

SEQ ID NO: 295837 - DNA, 25 bp, Mus musculus
caaccttctaaactccaaggcagaa

SEQ ID NO: 295838 - DNA, 25 bp, Mus musculus
caaccttctaaagtccaaggcagaa

SEQ ID NO: 295839 - DNA, 25 bp, Mus musculus
caaccttctctcactataattacag

SEQ ID NO: 295840 - DNA, 25 bp, Mus musculus
caaccttctctctctataattacag

SEQ ID NO: 295841 - DNA, 25 bp, Mus musculus
caaccttctcttctgctatttaatt

SEQ ID NO: 295842 - DNA, 25 bp, Mus musculus
caaccttctcttgtgctatttaatt

SEQ ID NO: 295843 - DNA, 25 bp, Mus musculus
caaccttctgctctggagagacgat

SEQ ID NO: 295844 - DNA, 25 bp, Mus musculus
caaccttctgctgtggagagacgat

SEQ ID NO: 295845 - DNA, 25 bp, Mus musculus
caaccttctggaactctagctccag

SEQ ID NO: 295846 - DNA, 25 bp, Mus musculus
caaccttctggatctctagctccag

SEQ ID NO: 295847 - DNA, 25 bp, Mus musculus
caaccttgaattactcagcccacta

SEQ ID NO: 295848 - DNA, 25 bp, Mus musculus
caaccttgaatttctcagcccacta

SEQ ID NO: 295849 - DNA, 25 bp, Mus musculus
caaccttgactgatttatataatgt

SEQ ID NO: 295850 - DNA, 25 bp, Mus musculus
caaccttgactgttttatataatgt

SEQ ID NO: 295851 - DNA, 25 bp, Mus musculus
caaccttgacttacatctgctgagt

SEQ ID NO: 295852 - DNA, 25 bp, Mus musculus
caaccttgactttcatctgctgagt

SEQ ID NO: 295853 - DNA, 25 bp, Mus musculus
caaccttgatgcctcaagaaggtac

SEQ ID NO: 295854 - DNA, 25 bp, Mus musculus
caaccttgatgcgtcaagaaggtac

SEQ ID NO: 295855 - DNA, 25 bp, Mus musculus
caaccttggagccataaggctggag

SEQ ID NO: 295856 - DNA, 25 bp, Mus musculus
caaccttggagcgataaggctggag

SEQ ID NO: 295857 - DNA, 25 bp, Mus musculus
caaccttggctacttgcagtttatg

SEQ ID NO: 295858 - DNA, 25 bp, Mus musculus
caaccttggctagttgcagtttatg

SEQ ID NO: 295859 - DNA, 25 bp, Mus musculus
caaccttgggacacagctggaactg

SEQ ID NO: 295860 - DNA, 25 bp, Mus musculus
caaccttgggactcagctggaactg

SEQ ID NO: 295861 - DNA, 25 bp, Mus musculus
caaccttgtaagagtagtgagtgta

SEQ ID NO: 295862 - DNA, 25 bp, Mus musculus
caaccttgtaagtgtagtgagtgta

SEQ ID NO: 295863 - DNA, 25 bp, Mus musculus
caaccttgtggacctagctgggagt

SEQ ID NO: 295864 - DNA, 25 bp, Mus musculus
caaccttgtggagctagctgggagt

SEQ ID NO: 295865 - DNA, 25 bp, Mus musculus
caaccttgtggcagggaggacaaca

SEQ ID NO: 295866 - DNA, 25 bp, Mus musculus
caaccttgtggctgggaggacaaca

SEQ ID NO: 295867 - DNA, 25 bp, Mus musculus
caacctttaatcatggtaactgtgg

SEQ ID NO: 295868 - DNA, 25 bp, Mus musculus
caacctttaatcttggtaactgtgg

SEQ ID NO: 295869 - DNA, 25 bp, Mus musculus
caacctttcaagagctgtaaccact

SEQ ID NO: 295870 - DNA, 25 bp, Mus musculus
caacctttcaagtgctgtaaccact

SEQ ID NO: 295871 - DNA, 25 bp, Mus musculus
caacctttccctctctggtagaatt

SEQ ID NO: 295872 - DNA, 25 bp, Mus musculus
caacctttccctgtctggtagaatt

SEQ ID NO: 295873 - DNA, 25 bp, Mus musculus
caacctttctgcctcagatcagcaa

SEQ ID NO: 295874 - DNA, 25 bp, Mus musculus
caacctttctgcgtcagatcagcaa

SEQ ID NO: 295875 - DNA, 25 bp, Mus musculus
caacctttgagcatttcagattttt

SEQ ID NO: 295876 - DNA, 25 bp, Mus musculus
caacctttgagcttttcagattttt

SEQ ID NO: 295877 - DNA, 25 bp, Mus musculus
caacctttgaggcaatgactttttt

SEQ ID NO: 295878 - DNA, 25 bp, Mus musculus
caacctttgagggaatgactttttt

SEQ ID NO: 295879 - DNA, 25 bp, Mus musculus
caacctttgtaccaaactacctgct

SEQ ID NO: 295880 - DNA, 25 bp, Mus musculus
caacctttgtacgaaactacctgct

SEQ ID NO: 295881 - DNA, 25 bp, Mus musculus
caaccttttatcaggctagatgtgg

SEQ ID NO: 295882 - DNA, 25 bp, Mus musculus
caaccttttatctggctagatgtgg

SEQ ID NO: 295883 - DNA, 25 bp, Mus musculus
caaccttttattcaggatgcttgta

SEQ ID NO: 295884 - DNA, 25 bp, Mus musculus
caaccttttattgaggatgcttgta

SEQ ID NO: 295885 - DNA, 25 bp, Mus musculus
caaccttttcccaaacttgtgtgtg

SEQ ID NO: 295886 - DNA, 25 bp, Mus musculus
caaccttttccctaacttgtgtgtg

SEQ ID NO: 295887 - DNA, 25 bp, Mus musculus
caaccttttggaatagttatgtgta

SEQ ID NO: 295888 - DNA, 25 bp, Mus musculus
caaccttttggattagttatgtgta

SEQ ID NO: 295889 - DNA, 25 bp, Mus musculus
caacctttttgacaagtatgtcatt

SEQ ID NO: 295890 - DNA, 25 bp, Mus musculus
caacctttttgagaagtatgtcatt

SEQ ID NO: 295891 - DNA, 25 bp, Mus musculus
caacgaacgggcagaactggaggct

SEQ ID NO: 295892 - DNA, 25 bp, Mus musculus
caacgaacgggctgaactggaggct

SEQ ID NO: 295893 - DNA, 25 bp, Mus musculus
caacgaacggttctgtgtacttcct

SEQ ID NO: 295894 - DNA, 25 bp, Mus musculus
caacgaacggttgtgtgtacttcct

SEQ ID NO: 295895 - DNA, 25 bp, Mus musculus
caacgaagagctcgtgtccgaagat

SEQ ID NO: 295896 - DNA, 25 bp, Mus musculus
caacgaagagctggtgtccgaagat

SEQ ID NO: 295897 - DNA, 25 bp, Mus musculus
caacgaaggcttaaccacagaggag

SEQ ID NO: 295898 - DNA, 25 bp, Mus musculus
caacgaaggctttaccacagaggag

SEQ ID NO: 295899 - DNA, 25 bp, Mus musculus
caacgaagtgccagctggtaagcat

SEQ ID NO: 295900 - DNA, 25 bp, Mus musculus
caacgaagtgcctgctggtaagcat

SEQ ID NO: 295901 - DNA, 25 bp, Mus musculus
caacgacggttaatttagatgctat

SEQ ID NO: 295902 - DNA, 25 bp, Mus musculus
caacgacggttattttagatgctat

SEQ ID NO: 295903 - DNA, 25 bp, Mus musculus
caacgactattcacttgtaaaacta

SEQ ID NO: 295904 - DNA, 25 bp, Mus musculus
caacgactattctcttgtaaaacta

SEQ ID NO: 295905 - DNA, 25 bp, Mus musculus
caacgactctcccatgtggaagttt

SEQ ID NO: 295906 - DNA, 25 bp, Mus musculus
caacgactctccgatgtggaagttt

SEQ ID NO: 295907 - DNA, 25 bp, Mus musculus
caacgacttgaactctatggcgggt

SEQ ID NO: 295908 - DNA, 25 bp, Mus musculus
caacgacttgaagtctatggcgggt

SEQ ID NO: 295909 - DNA, 25 bp, Mus musculus
caacgagacttcagctgaggcatat

SEQ ID NO: 295910 - DNA, 25 bp, Mus musculus
caacgagacttctgctgaggcatat

SEQ ID NO: 295911 - DNA, 25 bp, Mus musculus
caacgagatcgacctcagaggcgaa

SEQ ID NO: 295912 - DNA, 25 bp, Mus musculus
caacgagatcgagctcagaggcgaa

SEQ ID NO: 295913 - DNA, 25 bp, Mus musculus
caacgagatgttatgagtgcctctg

SEQ ID NO: 295914 - DNA, 25 bp, Mus musculus
caacgagatgttttgagtgcctctg

SEQ ID NO: 295915 - DNA, 25 bp, Mus musculus
caacgagccaagaccaagttctctg

SEQ ID NO: 295916 - DNA, 25 bp, Mus musculus
caacgagccaagtccaagttctctg

SEQ ID NO: 295917 - DNA, 25 bp, Mus musculus
caacgagccgtcagtggccctgtac

SEQ ID NO: 295918 - DNA, 25 bp, Mus musculus
caacgagccgtctgtggccctgtac

SEQ ID NO: 295919 - DNA, 25 bp, Mus musculus
caacgagcggttccgatgccctgag

SEQ ID NO: 295920 - DNA, 25 bp, Mus musculus
caacgagcggttgcgatgccctgag

SEQ ID NO: 295921 - DNA, 25 bp, Mus musculus
caacgaggttggacagctggcagac

SEQ ID NO: 295922 - DNA, 25 bp, Mus musculus
caacgaggttggtcagctggcagac

SEQ ID NO: 295923 - DNA, 25 bp, Mus musculus
caacgagtgaccctgagaaccaggt

SEQ ID NO: 295924 - DNA, 25 bp, Mus musculus
caacgagtgaccgtgagaaccaggt

SEQ ID NO: 295925 - DNA, 25 bp, Mus musculus
caacgagtttataatcagcgaccaa

SEQ ID NO: 295926 - DNA, 25 bp, Mus musculus
caacgagtttattatcagcgaccaa

SEQ ID NO: 295927 - DNA, 25 bp, Mus musculus
caacgatacaggaccgaaggaggaa

SEQ ID NO: 295928 - DNA, 25 bp, Mus musculus
caacgatacaggtccgaaggaggaa

SEQ ID NO: 295929 - DNA, 25 bp, Mus musculus
caacgatacgaaagtcttgaggact

SEQ ID NO: 295930 - DNA, 25 bp, Mus musculus
caacgatacgaatgtcttgaggact

SEQ ID NO: 295931 - DNA, 25 bp, Mus musculus
caacgatcctatatgtaccctagac

SEQ ID NO: 295932 - DNA, 25 bp, Mus musculus
caacgatcctatttgtaccctagac

SEQ ID NO: 295933 - DNA, 25 bp, Mus musculus
caacgatcttttaagccaagctctc

SEQ ID NO: 295934 - DNA, 25 bp, Mus musculus
caacgatctttttagccaagctctc

SEQ ID NO: 295935 - DNA, 25 bp, Mus musculus
caacgatgacttcaaacttctgatc

SEQ ID NO: 295936 - DNA, 25 bp, Mus musculus
caacgatgacttgaaacttctgatc

SEQ ID NO: 295937 - DNA, 25 bp, Mus musculus
caacgatggcatcgagtactggatt

SEQ ID NO: 295938 - DNA, 25 bp, Mus musculus
caacgatggcatggagtactggatt

SEQ ID NO: 295939 - DNA, 25 bp, Mus musculus
caacgattctctactgactgcagca

SEQ ID NO: 295940 - DNA, 25 bp, Mus musculus
caacgattctcttctgactgcagca

SEQ ID NO: 295941 - DNA, 25 bp, Mus musculus
caacgcaactctcgccgcagagaat

SEQ ID NO: 295942 - DNA, 25 bp, Mus musculus
caacgcaactctggccgcagagaat

SEQ ID NO: 295943 - DNA, 25 bp, Mus musculus
caacgcatagagcagaatcttggca

SEQ ID NO: 295944 - DNA, 25 bp, Mus musculus
caacgcatagaggagaatcttggca

SEQ ID NO: 295945 - DNA, 25 bp, Mus musculus
caacgcccagtcatgcttttgtaga

SEQ ID NO: 295946 - DNA, 25 bp, Mus musculus
caacgcccagtcttgcttttgtaga

SEQ ID NO: 295947 - DNA, 25 bp, Mus musculus
caacgcgaacgtccaaggtggtttg

SEQ ID NO: 295948 - DNA, 25 bp, Mus musculus
caacgcgaacgtgcaaggtggtttg

SEQ ID NO: 295949 - DNA, 25 bp, Mus musculus
caacgcggtgaaaggaagaagtatt

SEQ ID NO: 295950 - DNA, 25 bp, Mus musculus
caacgcggtgaatggaagaagtatt

SEQ ID NO: 295951 - DNA, 25 bp, Mus musculus
caacgcggtgctccatgagaacagg

SEQ ID NO: 295952 - DNA, 25 bp, Mus musculus
caacgcggtgctgcatgagaacagg

SEQ ID NO: 295953 - DNA, 25 bp, Mus musculus
caacgcggttgtatgtaagccccag

SEQ ID NO: 295954 - DNA, 25 bp, Mus musculus
caacgcggttgtttgtaagccccag

SEQ ID NO: 295955 - DNA, 25 bp, Mus musculus
caacgcgttccgactggtcaaacgg

SEQ ID NO: 295956 - DNA, 25 bp, Mus musculus
caacgcgttccgtctggtcaaacgg

SEQ ID NO: 295957 - DNA, 25 bp, Mus musculus
caacgcgttttccacgttattcgag

SEQ ID NO: 295958 - DNA, 25 bp, Mus musculus
caacgcgttttcgacgttattcgag

SEQ ID NO: 295959 - DNA, 25 bp, Mus musculus
caacgctactctaagaaaccctgac

SEQ ID NO: 295960 - DNA, 25 bp, Mus musculus
caacgctactcttagaaaccctgac

SEQ ID NO: 295961 - DNA, 25 bp, Mus musculus
caacgctatgcaaggtctaactggt

SEQ ID NO: 295962 - DNA, 25 bp, Mus musculus
caacgctatgcatggtctaactggt

SEQ ID NO: 295963 - DNA, 25 bp, Mus musculus
caacgctcaggtctacatttaattc

SEQ ID NO: 295964 - DNA, 25 bp, Mus musculus
caacgctcaggtgtacatttaattc

SEQ ID NO: 295965 - DNA, 25 bp, Mus musculus
caacgctcgctgcagagagtgacct

SEQ ID NO: 295966 - DNA, 25 bp, Mus musculus
caacgctcgctggagagagtgacct

SEQ ID NO: 295967 - DNA, 25 bp, Mus musculus
caacgctgacagaccagggtgtgct

SEQ ID NO: 295968 - DNA, 25 bp, Mus musculus
caacgctgacagtccagggtgtgct

SEQ ID NO: 295969 - DNA, 25 bp, Mus musculus
caacgctgtcaaaaattgtctttaa

SEQ ID NO: 295970 - DNA, 25 bp, Mus musculus
caacgctgtcaataattgtctttaa

SEQ ID NO: 295971 - DNA, 25 bp, Mus musculus
caacgctgtcacattaagacggaga

SEQ ID NO: 295972 - DNA, 25 bp, Mus musculus
caacgctgtcactttaagacggaga

SEQ ID NO: 295973 - DNA, 25 bp, Mus musculus
caacgctgtctgaggaccgaggttt

SEQ ID NO: 295974 - DNA, 25 bp, Mus musculus
caacgctgtctgtggaccgaggttt

SEQ ID NO: 295975 - DNA, 25 bp, Mus musculus
caacgctttgggcacattattccat

SEQ ID NO: 295976 - DNA, 25 bp, Mus musculus
caacgctttggggacattattccat

SEQ ID NO: 295977 - DNA, 25 bp, Mus musculus
caacggagaaggacccagccagaag

SEQ ID NO: 295978 - DNA, 25 bp, Mus musculus
caacggagaaggtcccagccagaag

SEQ ID NO: 295979 - DNA, 25 bp, Mus musculus
caacggagaggcatacagactgaca

SEQ ID NO: 295980 - DNA, 25 bp, Mus musculus
caacggagaggcttacagactgaca

SEQ ID NO: 295981 - DNA, 25 bp, Mus musculus
caacggagatgaatggcttttagtt

SEQ ID NO: 295982 - DNA, 25 bp, Mus musculus
caacggagatgattggcttttagtt

SEQ ID NO: 295983 - DNA, 25 bp, Mus musculus
caacggatccggctccgaatccaaa

SEQ ID NO: 295984 - DNA, 25 bp, Mus musculus
caacggatccgggtccgaatccaaa

SEQ ID NO: 295985 - DNA, 25 bp, Mus musculus
caacggatctgaagaaggtgcccat

SEQ ID NO: 295986 - DNA, 25 bp, Mus musculus
caacggatctgatgaaggtgcccat

SEQ ID NO: 295987 - DNA, 25 bp, Mus musculus
caacggcaacataacctgggctgat

SEQ ID NO: 295988 - DNA, 25 bp, Mus musculus
caacggcaacattacctgggctgat

SEQ ID NO: 295989 - DNA, 25 bp, Mus musculus
caacggcaaggcaggcactgtgaat

SEQ ID NO: 295990 - DNA, 25 bp, Mus musculus
caacggcaaggctggcactgtgaat

SEQ ID NO: 295991 - DNA, 25 bp, Mus musculus
caacggcacagtcaaggccgagaat

SEQ ID NO: 295992 - DNA, 25 bp, Mus musculus
caacggcacagtgaaggccgagaat

SEQ ID NO: 295993 - DNA, 25 bp, Mus musculus
caacggcatggaaatttgtggagga

SEQ ID NO: 295994 - DNA, 25 bp, Mus musculus
caacggcatggatatttgtggagga

SEQ ID NO: 295995 - DNA, 25 bp, Mus musculus
caacggcggccgagcggagagggtt

SEQ ID NO: 295996 - DNA, 25 bp, Mus musculus
caacggcggccgtgcggagagggtt

SEQ ID NO: 295997 - DNA, 25 bp, Mus musculus
caacggctcagcaaggaaacatgga

SEQ ID NO: 295998 - DNA, 25 bp, Mus musculus
caacggctcagctaggaaacatgga

SEQ ID NO: 295999 - DNA, 25 bp, Mus musculus
caacggctgccacttgctgctaggg

SEQ ID NO: 296000 - DNA, 25 bp, Mus musculus
caacggctgccagttgctgctaggg

SEQ ID NO: 296001 - DNA, 25 bp, Mus musculus
caacggctggctcctggacggtcct

SEQ ID NO: 296002 - DNA, 25 bp, Mus musculus
caacggctggctgctggacggtcct

SEQ ID NO: 296003 - DNA, 25 bp, Mus musculus
caacgggaagcaacatcctagggat

SEQ ID NO: 296004 - DNA, 25 bp, Mus musculus
caacgggaagcatcatcctagggat

SEQ ID NO: 296005 - DNA, 25 bp, Mus musculus
caacgggacaaacggccagagcctc

SEQ ID NO: 296006 - DNA, 25 bp, Mus musculus
caacgggacaaagggccagagcctc

SEQ ID NO: 296007 - DNA, 25 bp, Mus musculus
caacgggccatcaaggaccccggtg

SEQ ID NO: 296008 - DNA, 25 bp, Mus musculus
caacgggccatctaggaccccggtg

SEQ ID NO: 296009 - DNA, 25 bp, Mus musculus
caacgggtggcaacatagacatggc

SEQ ID NO: 296010 - DNA, 25 bp, Mus musculus
caacgggtggcatcatagacatggc

SEQ ID NO: 296011 - DNA, 25 bp, Mus musculus
caacggtcctctaaggccaaggtga

SEQ ID NO: 296012 - DNA, 25 bp, Mus musculus
caacggtcctcttaggccaaggtga

SEQ ID NO: 296013 - DNA, 25 bp, Mus musculus
caacggtgggctcctgcatagacat

SEQ ID NO: 296014 - DNA, 25 bp, Mus musculus
caacggtgggctgctgcatagacat

SEQ ID NO: 296015 - DNA, 25 bp, Mus musculus
caacggttaatgaacgctttgctaa

SEQ ID NO: 296016 - DNA, 25 bp, Mus musculus
caacggttaatgtacgctttgctaa

SEQ ID NO: 296017 - DNA, 25 bp, Mus musculus
caacggttcatgaagctttgcacaa

SEQ ID NO: 296018 - DNA, 25 bp, Mus musculus
caacggttcatgtagctttgcacaa

SEQ ID NO: 296019 - DNA, 25 bp, Mus musculus
caacggttcccaatggcttggagga

SEQ ID NO: 296020 - DNA, 25 bp, Mus musculus
caacggttcccattggcttggagga

SEQ ID NO: 296021 - DNA, 25 bp, Mus musculus
caacggttggaaacttagtctgcaa

SEQ ID NO: 296022 - DNA, 25 bp, Mus musculus
caacggttggaatcttagtctgcaa

SEQ ID NO: 296023 - DNA, 25 bp, Mus musculus
caacgtaagtgcctttcttttctct

SEQ ID NO: 296024 - DNA, 25 bp, Mus musculus
caacgtaagtgcgtttcttttctct

SEQ ID NO: 296025 - DNA, 25 bp, Mus musculus
caacgtaccattccgcttagacttt

SEQ ID NO: 296026 - DNA, 25 bp, Mus musculus
caacgtaccattgcgcttagacttt

SEQ ID NO: 296027 - DNA, 25 bp, Mus musculus
caacgtacggacctcgaggcgtcga

SEQ ID NO: 296028 - DNA, 25 bp, Mus musculus
caacgtacggacgtcgaggcgtcga

SEQ ID NO: 296029 - DNA, 25 bp, Mus musculus
caacgtagcccacatataatagaat

SEQ ID NO: 296030 - DNA, 25 bp, Mus musculus
caacgtagcccagatataatagaat

SEQ ID NO: 296031 - DNA, 25 bp, Mus musculus
caacgtagtggtcgctgcctctggt

SEQ ID NO: 296032 - DNA, 25 bp, Mus musculus
caacgtagtggtggctgcctctggt

SEQ ID NO: 296033 - DNA, 25 bp, Mus musculus
caacgtatgttgaagtttgcacaga

SEQ ID NO: 296034 - DNA, 25 bp, Mus musculus
caacgtatgttgtagtttgcacaga

SEQ ID NO: 296035 - DNA, 25 bp, Mus musculus
caacgtattgttccctgtcttcaga

SEQ ID NO: 296036 - DNA, 25 bp, Mus musculus
caacgtattgttgcctgtcttcaga

SEQ ID NO: 296037 - DNA, 25 bp, Mus musculus
caacgtcccaggagtgtttgctgca

SEQ ID NO: 296038 - DNA, 25 bp, Mus musculus
caacgtcccaggtgtgtttgctgca

SEQ ID NO: 296039 - DNA, 25 bp, Mus musculus
caacgtccgggtaaacagcactatg

SEQ ID NO: 296040 - DNA, 25 bp, Mus musculus
caacgtccgggttaacagcactatg

SEQ ID NO: 296041 - DNA, 25 bp, Mus musculus
caacgtcctgataaacctgctaaag

SEQ ID NO: 296042 - DNA, 25 bp, Mus musculus
caacgtcctgattaacctgctaaag

SEQ ID NO: 296043 - DNA, 25 bp, Mus musculus
caacgtgacgatctatgcactcaat

SEQ ID NO: 296044 - DNA, 25 bp, Mus musculus
caacgtgacgatgtatgcactcaat

SEQ ID NO: 296045 - DNA, 25 bp, Mus musculus
caacgtgcattgctgggaagccgaa

SEQ ID NO: 296046 - DNA, 25 bp, Mus musculus
caacgtgcattggtgggaagccgaa

SEQ ID NO: 296047 - DNA, 25 bp, Mus musculus
caacgtgctggcagccatgaggaag

SEQ ID NO: 296048 - DNA, 25 bp, Mus musculus
caacgtgctggctgccatgaggaag

SEQ ID NO: 296049 - DNA, 25 bp, Mus musculus
caacgtggaagtcgccctccacttt

SEQ ID NO: 296050 - DNA, 25 bp, Mus musculus
caacgtggaagtggccctccacttt

SEQ ID NO: 296051 - DNA, 25 bp, Mus musculus
caacgtggacaacaagctagcagat

SEQ ID NO: 296052 - DNA, 25 bp, Mus musculus
caacgtggacaagaagctagcagat

SEQ ID NO: 296053 - DNA, 25 bp, Mus musculus
caacgtggccataacctgtgaaaat

SEQ ID NO: 296054 - DNA, 25 bp, Mus musculus
caacgtggccattacctgtgaaaat

SEQ ID NO: 296055 - DNA, 25 bp, Mus musculus
caacgtgtgcatcctttcggtttca

SEQ ID NO: 296056 - DNA, 25 bp, Mus musculus
caacgtgtgcatgctttcggtttca

SEQ ID NO: 296057 - DNA, 25 bp, Mus musculus
caacgtgtggccagactgctcacct

SEQ ID NO: 296058 - DNA, 25 bp, Mus musculus
caacgtgtggcctgactgctcacct

SEQ ID NO: 296059 - DNA, 25 bp, Mus musculus
caacgtgttctcattacaggataac

SEQ ID NO: 296060 - DNA, 25 bp, Mus musculus
caacgtgttctctttacaggataac

SEQ ID NO: 296061 - DNA, 25 bp, Mus musculus
caacgtgttgaacgcatttatggaa

SEQ ID NO: 296062 - DNA, 25 bp, Mus musculus
caacgtgttgaaggcatttatggaa

SEQ ID NO: 296063 - DNA, 25 bp, Mus musculus
caacgttatttcagccttggtggat

SEQ ID NO: 296064 - DNA, 25 bp, Mus musculus
caacgttatttctgccttggtggat

SEQ ID NO: 296065 - DNA, 25 bp, Mus musculus
caacgttctatgaccaagcatgtag

SEQ ID NO: 296066 - DNA, 25 bp, Mus musculus
caacgttctatgtccaagcatgtag

SEQ ID NO: 296067 - DNA, 25 bp, Mus musculus
caacgttcttgactgcgataccata

SEQ ID NO: 296068 - DNA, 25 bp, Mus musculus
caacgttcttgagtgcgataccata

SEQ ID NO: 296069 - DNA, 25 bp, Mus musculus
caacgttgctgacaacgagtcggcg

SEQ ID NO: 296070 - DNA, 25 bp, Mus musculus
caacgttgctgagaacgagtcggcg

SEQ ID NO: 296071 - DNA, 25 bp, Mus musculus
caacgttgttatcggcaggagctgt

SEQ ID NO: 296072 - DNA, 25 bp, Mus musculus
caacgttgttatgggcaggagctgt

SEQ ID NO: 296073 - DNA, 25 bp, Mus musculus
caacgtttcagcatttctgggtaca

SEQ ID NO: 296074 - DNA, 25 bp, Mus musculus
caacgtttcagcttttctgggtaca

SEQ ID NO: 296075 - DNA, 25 bp, Mus musculus
caacgtttggagacatgtgtttttc

SEQ ID NO: 296076 - DNA, 25 bp, Mus musculus
caacgtttggagtcatgtgtttttc

SEQ ID NO: 296077 - DNA, 25 bp, Mus musculus
caacgttttgagacagtgcatttca

SEQ ID NO: 296078 - DNA, 25 bp, Mus musculus
caacgttttgagtcagtgcatttca

SEQ ID NO: 296079 - DNA, 25 bp, Mus musculus
caactaaaagttcttctctgatctc

SEQ ID NO: 296080 - DNA, 25 bp, Mus musculus
caactaaaagttgttctctgatctc

SEQ ID NO: 296081 - DNA, 25 bp, Mus musculus
caactaaagggcagcaggctctgca

SEQ ID NO: 296082 - DNA, 25 bp, Mus musculus
caactaaagggctgcaggctctgca

SEQ ID NO: 296083 - DNA, 25 bp, Mus musculus
caactaacaagccattttgagggat

SEQ ID NO: 296084 - DNA, 25 bp, Mus musculus
caactaacaagcgattttgagggat

SEQ ID NO: 296085 - DNA, 25 bp, Mus musculus
caactaacttatattgcccagctgg

SEQ ID NO: 296086 - DNA, 25 bp, Mus musculus
caactaacttattttgcccagctgg

SEQ ID NO: 296087 - DNA, 25 bp, Mus musculus
caactaatatagactttgcctttaa

SEQ ID NO: 296088 - DNA, 25 bp, Mus musculus
caactaatatagtctttgcctttaa

SEQ ID NO: 296089 - DNA, 25 bp, Mus musculus
caactaatgtctccctgtcctcagg

SEQ ID NO: 296090 - DNA, 25 bp, Mus musculus
caactaatgtctgcctgtcctcagg

SEQ ID NO: 296091 - DNA, 25 bp, Mus musculus
caactacaagatcgagctgagcaag

SEQ ID NO: 296092 - DNA, 25 bp, Mus musculus
caactacaagatggagctgagcaag

SEQ ID NO: 296093 - DNA, 25 bp, Mus musculus
caactacaggaaagcaggccacttg

SEQ ID NO: 296094 - DNA, 25 bp, Mus musculus
caactacaggaatgcaggccacttg

SEQ ID NO: 296095 - DNA, 25 bp, Mus musculus
caactacatcttcacagctattcag

SEQ ID NO: 296096 - DNA, 25 bp, Mus musculus
caactacatcttgacagctattcag

SEQ ID NO: 296097 - DNA, 25 bp, Mus musculus
caactaccacatataagcacaccat

SEQ ID NO: 296098 - DNA, 25 bp, Mus musculus
caactaccacatttaagcacaccat

SEQ ID NO: 296099 - DNA, 25 bp, Mus musculus
caactacccaggaggattatcccac

SEQ ID NO: 296100 - DNA, 25 bp, Mus musculus
caactacccaggtggattatcccac

SEQ ID NO: 296101 - DNA, 25 bp, Mus musculus
caactaccggctaatttgcagcttc

SEQ ID NO: 296102 - DNA, 25 bp, Mus musculus
caactaccggcttatttgcagcttc

SEQ ID NO: 296103 - DNA, 25 bp, Mus musculus
caactacctcacatgcttacttgaa

SEQ ID NO: 296104 - DNA, 25 bp, Mus musculus
caactacctcacttgcttacttgaa

SEQ ID NO: 296105 - DNA, 25 bp, Mus musculus
caactacctccccaattgtgagtta

SEQ ID NO: 296106 - DNA, 25 bp, Mus musculus
caactacctcccgaattgtgagtta

SEQ ID NO: 296107 - DNA, 25 bp, Mus musculus
caactacctgaaccttttcggcacc

SEQ ID NO: 296108 - DNA, 25 bp, Mus musculus
caactacctgaagcttttcggcacc

SEQ ID NO: 296109 - DNA, 25 bp, Mus musculus
caactacgagctcgcctggaagtac

SEQ ID NO: 296110 - DNA, 25 bp, Mus musculus
caactacgagctggcctggaagtac

SEQ ID NO: 296111 - DNA, 25 bp, Mus musculus
caactacgcggaccgtgtgggctgc

SEQ ID NO: 296112 - DNA, 25 bp, Mus musculus
caactacgcggagcgtgtgggctgc

SEQ ID NO: 296113 - DNA, 25 bp, Mus musculus
caactactaccaccttgcagatttc

SEQ ID NO: 296114 - DNA, 25 bp, Mus musculus
caactactaccagcttgcagatttc

SEQ ID NO: 296115 - DNA, 25 bp, Mus musculus
caactactactgctctgagctaaga

SEQ ID NO: 296116 - DNA, 25 bp, Mus musculus
caactactactggtctgagctaaga

SEQ ID NO: 296117 - DNA, 25 bp, Mus musculus
caactactacttatttgtcagcgag

SEQ ID NO: 296118 - DNA, 25 bp, Mus musculus
caactactacttttttgtcagcgag

SEQ ID NO: 296119 - DNA, 25 bp, Mus musculus
caactactatgccttcttcaagctg

SEQ ID NO: 296120 - DNA, 25 bp, Mus musculus
caactactatgcgttcttcaagctg

SEQ ID NO: 296121 - DNA, 25 bp, Mus musculus
caactagagatacgctgacacggtc

SEQ ID NO: 296122 - DNA, 25 bp, Mus musculus
caactagagataggctgacacggtc

SEQ ID NO: 296123 - DNA, 25 bp, Mus musculus
caactagagtccctgcttcaaaaca

SEQ ID NO: 296124 - DNA, 25 bp, Mus musculus
caactagagtccgtgcttcaaaaca

SEQ ID NO: 296125 - DNA, 25 bp, Mus musculus
caactagatccaaggttcggctggc

SEQ ID NO: 296126 - DNA, 25 bp, Mus musculus
caactagatccatggttcggctggc

SEQ ID NO: 296127 - DNA, 25 bp, Mus musculus
caactagatgtgaccttgctcttca

SEQ ID NO: 296128 - DNA, 25 bp, Mus musculus
caactagatgtgtccttgctcttca

SEQ ID NO: 296129 - DNA, 25 bp, Mus musculus
caactagctataccctggtgtctcc

SEQ ID NO: 296130 - DNA, 25 bp, Mus musculus
caactagctatagcctggtgtctcc

SEQ ID NO: 296131 - DNA, 25 bp, Mus musculus
caactagctatcacaggtcccttag

SEQ ID NO: 296132 - DNA, 25 bp, Mus musculus
caactagctatctcaggtcccttag

SEQ ID NO: 296133 - DNA, 25 bp, Mus musculus
caactaggctggcatcactggatca

SEQ ID NO: 296134 - DNA, 25 bp, Mus musculus
caactaggctgggatcactggatca

SEQ ID NO: 296135 - DNA, 25 bp, Mus musculus
caactaggtcaaaacaggcctctct

SEQ ID NO: 296136 - DNA, 25 bp, Mus musculus
caactaggtcaatacaggcctctct

SEQ ID NO: 296137 - DNA, 25 bp, Mus musculus
caactagtccaaactttctcttctt

SEQ ID NO: 296138 - DNA, 25 bp, Mus musculus
caactagtccaatctttctcttctt

SEQ ID NO: 296139 - DNA, 25 bp, Mus musculus
caactagttaataatcttagggaga

SEQ ID NO: 296140 - DNA, 25 bp, Mus musculus
caactagttaattatcttagggaga

SEQ ID NO: 296141 - DNA, 25 bp, Mus musculus
caactatagaccaccatttaaccgc

SEQ ID NO: 296142 - DNA, 25 bp, Mus musculus
caactatagacctccatttaaccgc

SEQ ID NO: 296143 - DNA, 25 bp, Mus musculus
caactatagcaaatcccatgggaag

SEQ ID NO: 296144 - DNA, 25 bp, Mus musculus
caactatagcaattcccatgggaag

SEQ ID NO: 296145 - DNA, 25 bp, Mus musculus
caactatctataagggcatctgata

SEQ ID NO: 296146 - DNA, 25 bp, Mus musculus
caactatctatatgggcatctgata

SEQ ID NO: 296147 - DNA, 25 bp, Mus musculus
caactatgagagcaccacgccggat

SEQ ID NO: 296148 - DNA, 25 bp, Mus musculus
caactatgagaggaccacgccggat

SEQ ID NO: 296149 - DNA, 25 bp, Mus musculus
caactatgagttaccagatccagag

SEQ ID NO: 296150 - DNA, 25 bp, Mus musculus
caactatgagtttccagatccagag

SEQ ID NO: 296151 - DNA, 25 bp, Mus musculus
caactatggctcagttgacaacccc

SEQ ID NO: 296152 - DNA, 25 bp, Mus musculus
caactatggctctgttgacaacccc

SEQ ID NO: 296153 - DNA, 25 bp, Mus musculus
caactatgtgggatatggacactga

SEQ ID NO: 296154 - DNA, 25 bp, Mus musculus
caactatgtgggttatggacactga

SEQ ID NO: 296155 - DNA, 25 bp, Mus musculus
caactatttatgctggatgaactct

SEQ ID NO: 296156 - DNA, 25 bp, Mus musculus
caactatttatggtggatgaactct

SEQ ID NO: 296157 - DNA, 25 bp, Mus musculus
caactcaaactgctgaaaatcataa

SEQ ID NO: 296158 - DNA, 25 bp, Mus musculus
caactcaaactggtgaaaatcataa

SEQ ID NO: 296159 - DNA, 25 bp, Mus musculus
caactcaaagttaaggtcgcggaca

SEQ ID NO: 296160 - DNA, 25 bp, Mus musculus
caactcaaagtttaggtcgcggaca

SEQ ID NO: 296161 - DNA, 25 bp, Mus musculus
caactcaagtcaccctgaaccggga

SEQ ID NO: 296162 - DNA, 25 bp, Mus musculus
caactcaagtcagcctgaaccggga

SEQ ID NO: 296163 - DNA, 25 bp, Mus musculus
caactcacaaaacgtctatcagaaa

SEQ ID NO: 296164 - DNA, 25 bp, Mus musculus
caactcacaaaaggtctatcagaaa

SEQ ID NO: 296165 - DNA, 25 bp, Mus musculus
caactcactcacagtggttgctggc

SEQ ID NO: 296166 - DNA, 25 bp, Mus musculus
caactcactcactgtggttgctggc

SEQ ID NO: 296167 - DNA, 25 bp, Mus musculus
caactcactgatcctccaaagggat

SEQ ID NO: 296168 - DNA, 25 bp, Mus musculus
caactcactgatgctccaaagggat

SEQ ID NO: 296169 - DNA, 25 bp, Mus musculus
caactcactggcattccggatatga

SEQ ID NO: 296170 - DNA, 25 bp, Mus musculus
caactcactggctttccggatatga

SEQ ID NO: 296171 - DNA, 25 bp, Mus musculus
caactcagacatccatgtttcctta

SEQ ID NO: 296172 - DNA, 25 bp, Mus musculus
caactcagacatgcatgtttcctta

SEQ ID NO: 296173 - DNA, 25 bp, Mus musculus
caactcagagccctgtaggttagag

SEQ ID NO: 296174 - DNA, 25 bp, Mus musculus
caactcagagccgtgtaggttagag

SEQ ID NO: 296175 - DNA, 25 bp, Mus musculus
caactcagctggaggctgtggaact

SEQ ID NO: 296176 - DNA, 25 bp, Mus musculus
caactcagctggtggctgtggaact

SEQ ID NO: 296177 - DNA, 25 bp, Mus musculus
caactcagtgttccagcagggcatg

SEQ ID NO: 296178 - DNA, 25 bp, Mus musculus
caactcagtgttgcagcagggcatg

SEQ ID NO: 296179 - DNA, 25 bp, Mus musculus
caactcatagagattctccagcctc

SEQ ID NO: 296180 - DNA, 25 bp, Mus musculus
caactcatagagtttctccagcctc

SEQ ID NO: 296181 - DNA, 25 bp, Mus musculus
caactcatcttcattgctcatggta

SEQ ID NO: 296182 - DNA, 25 bp, Mus musculus
caactcatcttctttgctcatggta

SEQ ID NO: 296183 - DNA, 25 bp, Mus musculus
caactcattgtcactgcatgcacgg

SEQ ID NO: 296184 - DNA, 25 bp, Mus musculus
caactcattgtctctgcatgcacgg

SEQ ID NO: 296185 - DNA, 25 bp, Mus musculus
caactccaacctagtgaagtcacca

SEQ ID NO: 296186 - DNA, 25 bp, Mus musculus
caactccaaccttgtgaagtcacca

SEQ ID NO: 296187 - DNA, 25 bp, Mus musculus
caactccaatggactttctttcaca

SEQ ID NO: 296188 - DNA, 25 bp, Mus musculus
caactccaatggtctttctttcaca

SEQ ID NO: 296189 - DNA, 25 bp, Mus musculus
caactccactacacttaacttaact

SEQ ID NO: 296190 - DNA, 25 bp, Mus musculus
caactccactactcttaacttaact

SEQ ID NO: 296191 - DNA, 25 bp, Mus musculus
caactccagccactgtttgtgtttg

SEQ ID NO: 296192 - DNA, 25 bp, Mus musculus
caactccagccagtgtttgtgtttg

SEQ ID NO: 296193 - DNA, 25 bp, Mus musculus
caactccagggtattattgtatcct

SEQ ID NO: 296194 - DNA, 25 bp, Mus musculus
caactccagggttttattgtatcct

SEQ ID NO: 296195 - DNA, 25 bp, Mus musculus
caactccatttcacattgccattat

SEQ ID NO: 296196 - DNA, 25 bp, Mus musculus
caactccatttctcattgccattat

SEQ ID NO: 296197 - DNA, 25 bp, Mus musculus
caactcccaaagaaacccgtgtgtg

SEQ ID NO: 296198 - DNA, 25 bp, Mus musculus
caactcccaaagtaacccgtgtgtg

SEQ ID NO: 296199 - DNA, 25 bp, Mus musculus
caactcccaactcgttgtttcaagg

SEQ ID NO: 296200 - DNA, 25 bp, Mus musculus
caactcccaactggttgtttcaagg

SEQ ID NO: 296201 - DNA, 25 bp, Mus musculus
caactcccagggatcgttgctggag

SEQ ID NO: 296202 - DNA, 25 bp, Mus musculus
caactcccagggttcgttgctggag

SEQ ID NO: 296203 - DNA, 25 bp, Mus musculus
caactcccatttcgttaggtctctc

SEQ ID NO: 296204 - DNA, 25 bp, Mus musculus
caactcccatttggttaggtctctc

SEQ ID NO: 296205 - DNA, 25 bp, Mus musculus
caactccccgctagtagctttcaag

SEQ ID NO: 296206 - DNA, 25 bp, Mus musculus
caactccccgcttgtagctttcaag

SEQ ID NO: 296207 - DNA, 25 bp, Mus musculus
caactcccggccagagtggcatcaa

SEQ ID NO: 296208 - DNA, 25 bp, Mus musculus
caactcccggcctgagtggcatcaa

SEQ ID NO: 296209 - DNA, 25 bp, Mus musculus
caactccctacaatgcttatttgta

SEQ ID NO: 296210 - DNA, 25 bp, Mus musculus
caactccctacattgcttatttgta

SEQ ID NO: 296211 - DNA, 25 bp, Mus musculus
caactccctctacctgtattataaa

SEQ ID NO: 296212 - DNA, 25 bp, Mus musculus
caactccctctagctgtattataaa

SEQ ID NO: 296213 - DNA, 25 bp, Mus musculus
caactccgaagaatatatgaatcca

SEQ ID NO: 296214 - DNA, 25 bp, Mus musculus
caactccgaagattatatgaatcca

SEQ ID NO: 296215 - DNA, 25 bp, Mus musculus
caactccgatacacttaaacactag

SEQ ID NO: 296216 - DNA, 25 bp, Mus musculus
caactccgatactcttaaacactag

SEQ ID NO: 296217 - DNA, 25 bp, Mus musculus
caactccggttcaggagggtcagac

SEQ ID NO: 296218 - DNA, 25 bp, Mus musculus
caactccggttctggagggtcagac

SEQ ID NO: 296219 - DNA, 25 bp, Mus musculus
caactccgtgcgcagaaaacctagg

SEQ ID NO: 296220 - DNA, 25 bp, Mus musculus
caactccgtgcggagaaaacctagg

SEQ ID NO: 296221 - DNA, 25 bp, Mus musculus
caactcctaacacaccttcattttt

SEQ ID NO: 296222 - DNA, 25 bp, Mus musculus
caactcctaacagaccttcattttt

SEQ ID NO: 296223 - DNA, 25 bp, Mus musculus
caactcctcagcagttgaggagcct

SEQ ID NO: 296224 - DNA, 25 bp, Mus musculus
caactcctcagctgttgaggagcct

SEQ ID NO: 296225 - DNA, 25 bp, Mus musculus
caactcctcattccaagatcttatg

SEQ ID NO: 296226 - DNA, 25 bp, Mus musculus
caactcctcattgcaagatcttatg

SEQ ID NO: 296227 - DNA, 25 bp, Mus musculus
caactcctcttgaactccatgaaag

SEQ ID NO: 296228 - DNA, 25 bp, Mus musculus
caactcctcttgtactccatgaaag

SEQ ID NO: 296229 - DNA, 25 bp, Mus musculus
caactcctctttactacatcattat

SEQ ID NO: 296230 - DNA, 25 bp, Mus musculus
caactcctcttttctacatcattat

SEQ ID NO: 296231 - DNA, 25 bp, Mus musculus
caactcctgaaactgggccatggca

SEQ ID NO: 296232 - DNA, 25 bp, Mus musculus
caactcctgaaagtgggccatggca

SEQ ID NO: 296233 - DNA, 25 bp, Mus musculus
caactcctgaagataaggcctgagc

SEQ ID NO: 296234 - DNA, 25 bp, Mus musculus
caactcctgaagttaaggcctgagc

SEQ ID NO: 296235 - DNA, 25 bp, Mus musculus
caactcctggtgaccctggaagtaa

SEQ ID NO: 296236 - DNA, 25 bp, Mus musculus
caactcctggtgtccctggaagtaa

SEQ ID NO: 296237 - DNA, 25 bp, Mus musculus
caactccttatccagctgaacttgg

SEQ ID NO: 296238 - DNA, 25 bp, Mus musculus
caactccttatcgagctgaacttgg

SEQ ID NO: 296239 - DNA, 25 bp, Mus musculus
caactccttttcatatacattgcag

SEQ ID NO: 296240 - DNA, 25 bp, Mus musculus
caactccttttcttatacattgcag

SEQ ID NO: 296241 - DNA, 25 bp, Mus musculus
caactcgatatgatggtggcagccc

SEQ ID NO: 296242 - DNA, 25 bp, Mus musculus
caactcgatatgttggtggcagccc

SEQ ID NO: 296243 - DNA, 25 bp, Mus musculus
caactcggtcaaagcaggctggaat

SEQ ID NO: 296244 - DNA, 25 bp, Mus musculus
caactcggtcaatgcaggctggaat

SEQ ID NO: 296245 - DNA, 25 bp, Mus musculus
caactcgtgaatcaagcctgtggct

SEQ ID NO: 296246 - DNA, 25 bp, Mus musculus
caactcgtgaatgaagcctgtggct

SEQ ID NO: 296247 - DNA, 25 bp, Mus musculus
caactcgtggcactgctctgggaaa

SEQ ID NO: 296248 - DNA, 25 bp, Mus musculus
caactcgtggcagtgctctgggaaa

SEQ ID NO: 296249 - DNA, 25 bp, Mus musculus
caactctaaacactcaactcatact

SEQ ID NO: 296250 - DNA, 25 bp, Mus musculus
caactctaaacagtcaactcatact

SEQ ID NO: 296251 - DNA, 25 bp, Mus musculus
caactctcattgactgatgctccaa

SEQ ID NO: 296252 - DNA, 25 bp, Mus musculus
caactctcattgtctgatgctccaa

SEQ ID NO: 296253 - DNA, 25 bp, Mus musculus
caactctcccagaagattcatctct

SEQ ID NO: 296254 - DNA, 25 bp, Mus musculus
caactctcccagtagattcatctct

SEQ ID NO: 296255 - DNA, 25 bp, Mus musculus
caactctctctgactgtgggacaag

SEQ ID NO: 296256 - DNA, 25 bp, Mus musculus
caactctctctgtctgtgggacaag

SEQ ID NO: 296257 - DNA, 25 bp, Mus musculus
caactctgaagtactgcctttctaa

SEQ ID NO: 296258 - DNA, 25 bp, Mus musculus
caactctgaagttctgcctttctaa

SEQ ID NO: 296259 - DNA, 25 bp, Mus musculus
caactctgagctcgctgggtgactg

SEQ ID NO: 296260 - DNA, 25 bp, Mus musculus
caactctgagctggctgggtgactg

SEQ ID NO: 296261 - DNA, 25 bp, Mus musculus
caactctgcgtgcagccaggtgtaa

SEQ ID NO: 296262 - DNA, 25 bp, Mus musculus
caactctgcgtggagccaggtgtaa

SEQ ID NO: 296263 - DNA, 25 bp, Mus musculus
caactctgctccatttccagggcat

SEQ ID NO: 296264 - DNA, 25 bp, Mus musculus
caactctgctccttttccagggcat

SEQ ID NO: 296265 - DNA, 25 bp, Mus musculus
caactcttcttgagaccattaacct

SEQ ID NO: 296266 - DNA, 25 bp, Mus musculus
caactcttcttgtgaccattaacct

SEQ ID NO: 296267 - DNA, 25 bp, Mus musculus
caactcttctttagcctccaacttt

SEQ ID NO: 296268 - DNA, 25 bp, Mus musculus
caactcttctttctaggtctgggat

SEQ ID NO: 296269 - DNA, 25 bp, Mus musculus
caactcttctttgtaggtctgggat

SEQ ID NO: 296270 - DNA, 25 bp, Mus musculus
caactcttcttttgcctccaacttt

SEQ ID NO: 296271 - DNA, 25 bp, Mus musculus
caactcttgggacactgaatcagca

SEQ ID NO: 296272 - DNA, 25 bp, Mus musculus
caactcttgggagactgaatcagca

SEQ ID NO: 296273 - DNA, 25 bp, Mus musculus
caactctttactcagaatcacgctc

SEQ ID NO: 296274 - DNA, 25 bp, Mus musculus
caactctttactgagaatcacgctc

SEQ ID NO: 296275 - DNA, 25 bp, Mus musculus
caactctttggccttggtctacaga

SEQ ID NO: 296276 - DNA, 25 bp, Mus musculus
caactctttggcgttggtctacaga

SEQ ID NO: 296277 - DNA, 25 bp, Mus musculus
caactctttggtacaggcactcaag

SEQ ID NO: 296278 - DNA, 25 bp, Mus musculus
caactctttggttcaggcactcaag

SEQ ID NO: 296279 - DNA, 25 bp, Mus musculus
caactgaaaacgagaatgcatgata

SEQ ID NO: 296280 - DNA, 25 bp, Mus musculus
caactgaaaacgtgaatgcatgata

SEQ ID NO: 296281 - DNA, 25 bp, Mus musculus
caactgaacaaaatgtagcactgga

SEQ ID NO: 296282 - DNA, 25 bp, Mus musculus
caactgaacaaattgtagcactgga

SEQ ID NO: 296283 - DNA, 25 bp, Mus musculus
caactgaacatgacaaattctacaa

SEQ ID NO: 296284 - DNA, 25 bp, Mus musculus
caactgaacatgtcaaattctacaa

SEQ ID NO: 296285 - DNA, 25 bp, Mus musculus
caactgaacctcatatgaaaatgga

SEQ ID NO: 296286 - DNA, 25 bp, Mus musculus
caactgaacctcttatgaaaatgga

SEQ ID NO: 296287 - DNA, 25 bp, Mus musculus
caactgaactgaacggtttcttact

SEQ ID NO: 296288 - DNA, 25 bp, Mus musculus
caactgaactgatcggtttcttact

SEQ ID NO: 296289 - DNA, 25 bp, Mus musculus
caactgaaggccatgttttctttct

SEQ ID NO: 296290 - DNA, 25 bp, Mus musculus
caactgaaggccttgttttctttct

SEQ ID NO: 296291 - DNA, 25 bp, Mus musculus
caactgaataaaacgacttgttcaa

SEQ ID NO: 296292 - DNA, 25 bp, Mus musculus
caactgaataaatcgacttgttcaa

SEQ ID NO: 296293 - DNA, 25 bp, Mus musculus
caactgaatcccctgcaaacttttc

SEQ ID NO: 296294 - DNA, 25 bp, Mus musculus
caactgaatcccgtgcaaacttttc

SEQ ID NO: 296295 - DNA, 25 bp, Mus musculus
caactgaatttgaacattggttact

SEQ ID NO: 296296 - DNA, 25 bp, Mus musculus
caactgaatttgtacattggttact

SEQ ID NO: 296297 - DNA, 25 bp, Mus musculus
caactgacaccccaaaagacgtaga

SEQ ID NO: 296298 - DNA, 25 bp, Mus musculus
caactgacacccgaaaagacgtaga

SEQ ID NO: 296299 - DNA, 25 bp, Mus musculus
caactgaccatcagactgtacatag

SEQ ID NO: 296300 - DNA, 25 bp, Mus musculus
caactgaccatctgactgtacatag

SEQ ID NO: 296301 - DNA, 25 bp, Mus musculus
caactgacctcaactggaagaacca

SEQ ID NO: 296302 - DNA, 25 bp, Mus musculus
caactgacctcatctggaagaacca

SEQ ID NO: 296303 - DNA, 25 bp, Mus musculus
caactgactgtccagagccactgga

SEQ ID NO: 296304 - DNA, 25 bp, Mus musculus
caactgactgtcgagagccactgga

SEQ ID NO: 296305 - DNA, 25 bp, Mus musculus
caactgagagcgaccaggccggaga

SEQ ID NO: 296306 - DNA, 25 bp, Mus musculus
caactgagagcgtccaggccggaga

SEQ ID NO: 296307 - DNA, 25 bp, Mus musculus
caactgagggcactggccttcttga

SEQ ID NO: 296308 - DNA, 25 bp, Mus musculus
caactgagggcagtggccttcttga

SEQ ID NO: 296309 - DNA, 25 bp, Mus musculus
caactgaggttgacacttggtggca

SEQ ID NO: 296310 - DNA, 25 bp, Mus musculus
caactgaggttgtcacttggtggca

SEQ ID NO: 296311 - DNA, 25 bp, Mus musculus
caactgagtgtgaggaaactttttc

SEQ ID NO: 296312 - DNA, 25 bp, Mus musculus
caactgagtgtgtggaaactttttc

SEQ ID NO: 296313 - DNA, 25 bp, Mus musculus
caactgatcacaatgcacctgtagt

SEQ ID NO: 296314 - DNA, 25 bp, Mus musculus
caactgatcacattgcacctgtagt

SEQ ID NO: 296315 - DNA, 25 bp, Mus musculus
caactgatcagtcgccagatgagca

SEQ ID NO: 296316 - DNA, 25 bp, Mus musculus
caactgatcagtggccagatgagca

SEQ ID NO: 296317 - DNA, 25 bp, Mus musculus
caactgatctgtatccacatggaga

SEQ ID NO: 296318 - DNA, 25 bp, Mus musculus
caactgatctgtttccacatggaga

SEQ ID NO: 296319 - DNA, 25 bp, Mus musculus
caactgatgtggagctcccaccgaa

SEQ ID NO: 296320 - DNA, 25 bp, Mus musculus
caactgatgtggtgctcccaccgaa

SEQ ID NO: 296321 - DNA, 25 bp, Mus musculus
caactgcaatgacgagtggcctgcc

SEQ ID NO: 296322 - DNA, 25 bp, Mus musculus
caactgcaatgaggagtggcctgcc

SEQ ID NO: 296323 - DNA, 25 bp, Mus musculus
caactgcacagacttccagagccgc

SEQ ID NO: 296324 - DNA, 25 bp, Mus musculus
caactgcacagagttccagagccgc

SEQ ID NO: 296325 - DNA, 25 bp, Mus musculus
caactgcacccacgtgtgaaggttt

SEQ ID NO: 296326 - DNA, 25 bp, Mus musculus
caactgcacccaggtgtgaaggttt

SEQ ID NO: 296327 - DNA, 25 bp, Mus musculus
caactgccatgcactgagcctcaga

SEQ ID NO: 296328 - DNA, 25 bp, Mus musculus
caactgccatgctctgagcctcaga

SEQ ID NO: 296329 - DNA, 25 bp, Mus musculus
caactgcccagcaaaaatattattt

SEQ ID NO: 296330 - DNA, 25 bp, Mus musculus
caactgcccagctaaaatattattt

SEQ ID NO: 296331 - DNA, 25 bp, Mus musculus
caactgccccaacggtgtccagttt

SEQ ID NO: 296332 - DNA, 25 bp, Mus musculus
caactgccccaagggtgtccagttt

SEQ ID NO: 296333 - DNA, 25 bp, Mus musculus
caactgcctacaatgtttctgctta

SEQ ID NO: 296334 - DNA, 25 bp, Mus musculus
caactgcctacattgtttctgctta

SEQ ID NO: 296335 - DNA, 25 bp, Mus musculus
caactgcctattactatggtgtaaa

SEQ ID NO: 296336 - DNA, 25 bp, Mus musculus
caactgcctatttctatggtgtaaa

SEQ ID NO: 296337 - DNA, 25 bp, Mus musculus
caactgcctttactgatacttatca

SEQ ID NO: 296338 - DNA, 25 bp, Mus musculus
caactgcctttagtgatacttatca

SEQ ID NO: 296339 - DNA, 25 bp, Mus musculus
caactgccttttcggtcacagagaa

SEQ ID NO: 296340 - DNA, 25 bp, Mus musculus
caactgccttttgggtcacagagaa

SEQ ID NO: 296341 - DNA, 25 bp, Mus musculus
caactgcgggcacccattctgaaca

SEQ ID NO: 296342 - DNA, 25 bp, Mus musculus
caactgcgggcagccattctgaaca

SEQ ID NO: 296343 - DNA, 25 bp, Mus musculus
caactgcgtcctatgggcccagggt

SEQ ID NO: 296344 - DNA, 25 bp, Mus musculus
caactgcgtcctttgggcccagggt

SEQ ID NO: 296345 - DNA, 25 bp, Mus musculus
caactgctccatataccattgctgg

SEQ ID NO: 296346 - DNA, 25 bp, Mus musculus
caactgctccatttaccattgctgg

SEQ ID NO: 296347 - DNA, 25 bp, Mus musculus
caactgctgcatatgttgtattttt

SEQ ID NO: 296348 - DNA, 25 bp, Mus musculus
caactgctgcatttgttgtattttt

SEQ ID NO: 296349 - DNA, 25 bp, Mus musculus
caactgctgggcatgccttctgtta

SEQ ID NO: 296350 - DNA, 25 bp, Mus musculus
caactgctgggcttgccttctgtta

SEQ ID NO: 296351 - DNA, 25 bp, Mus musculus
caactgctggtcagaacttggaaga

SEQ ID NO: 296352 - DNA, 25 bp, Mus musculus
caactgctggtctgaacttggaaga

SEQ ID NO: 296353 - DNA, 25 bp, Mus musculus
caactgctttaactttgggacataa

SEQ ID NO: 296354 - DNA, 25 bp, Mus musculus
caactgctttaagtttgggacataa

SEQ ID NO: 296355 - DNA, 25 bp, Mus musculus
caactgctttctcgactgtacgaca

SEQ ID NO: 296356 - DNA, 25 bp, Mus musculus
caactgctttctggactgtacgaca

SEQ ID NO: 296357 - DNA, 25 bp, Mus musculus
caactgctttttactacacttccaa

SEQ ID NO: 296358 - DNA, 25 bp, Mus musculus
caactgcttttttctacacttccaa

SEQ ID NO: 296359 - DNA, 25 bp, Mus musculus
caactggacagcacttgagaaaggt

SEQ ID NO: 296360 - DNA, 25 bp, Mus musculus
caactggacagctcttgagaaaggt

SEQ ID NO: 296361 - DNA, 25 bp, Mus musculus
caactggacctgagaaagcaaagca

SEQ ID NO: 296362 - DNA, 25 bp, Mus musculus
caactggacctgtgaaagcaaagca

SEQ ID NO: 296363 - DNA, 25 bp, Mus musculus
caactggcatgcaccccagcggagt

SEQ ID NO: 296364 - DNA, 25 bp, Mus musculus
caactggcatgctccccagcggagt

SEQ ID NO: 296365 - DNA, 25 bp, Mus musculus
caactggcccctcacctagggagaa

SEQ ID NO: 296366 - DNA, 25 bp, Mus musculus
caactggcccctgacctagggagaa

SEQ ID NO: 296367 - DNA, 25 bp, Mus musculus
caactggcctagattttcaagaaac

SEQ ID NO: 296368 - DNA, 25 bp, Mus musculus
caactggcctagtttttcaagaaac

SEQ ID NO: 296369 - DNA, 25 bp, Mus musculus
caactggcctgcaagctaggctata

SEQ ID NO: 296370 - DNA, 25 bp, Mus musculus
caactggcctgctagctaggctata

SEQ ID NO: 296371 - DNA, 25 bp, Mus musculus
caactggccttgactggacttcctc

SEQ ID NO: 296372 - DNA, 25 bp, Mus musculus
caactggccttgtctggacttcctc

SEQ ID NO: 296373 - DNA, 25 bp, Mus musculus
caactggcggaaattgaaagaagct

SEQ ID NO: 296374 - DNA, 25 bp, Mus musculus
caactggcggaatttgaaagaagct

SEQ ID NO: 296375 - DNA, 25 bp, Mus musculus
caactggctcggagttcacaggctg

SEQ ID NO: 296376 - DNA, 25 bp, Mus musculus
caactggctcggtgttcacaggctg

SEQ ID NO: 296377 - DNA, 25 bp, Mus musculus
caactgggaagtaatcaaatacaac

SEQ ID NO: 296378 - DNA, 25 bp, Mus musculus
caactgggaagttatcaaatacaac

SEQ ID NO: 296379 - DNA, 25 bp, Mus musculus
caactgggacatacggcaggtggcc

SEQ ID NO: 296380 - DNA, 25 bp, Mus musculus
caactgggacattcggcaggtggcc

SEQ ID NO: 296381 - DNA, 25 bp, Mus musculus
caactgggagtacggcatcatggct

SEQ ID NO: 296382 - DNA, 25 bp, Mus musculus
caactgggagtagggcatcatggct

SEQ ID NO: 296383 - DNA, 25 bp, Mus musculus
caactgggccacatttgtgtgataa

SEQ ID NO: 296384 - DNA, 25 bp, Mus musculus
caactgggccacttttgtgtgataa

SEQ ID NO: 296385 - DNA, 25 bp, Mus musculus
caactggtgattcgcttaacggcat

SEQ ID NO: 296386 - DNA, 25 bp, Mus musculus
caactggtgattggcttaacggcat

SEQ ID NO: 296387 - DNA, 25 bp, Mus musculus
caactggtgcaacagtgatctccac

SEQ ID NO: 296388 - DNA, 25 bp, Mus musculus
caactggtgcaagagtgatctccac

SEQ ID NO: 296389 - DNA, 25 bp, Mus musculus
caactggtggagcagctacagagcc

SEQ ID NO: 296390 - DNA, 25 bp, Mus musculus
caactggtggaggagctacagagcc

SEQ ID NO: 296391 - DNA, 25 bp, Mus musculus
caactggttgcgcttgatccatgat

SEQ ID NO: 296392 - DNA, 25 bp, Mus musculus
caactggttgcggttgatccatgat

SEQ ID NO: 296393 - DNA, 25 bp, Mus musculus
caactggttggaatagaactgggcc

SEQ ID NO: 296394 - DNA, 25 bp, Mus musculus
caactggttggattagaactgggcc

SEQ ID NO: 296395 - DNA, 25 bp, Mus musculus
caactgtaacttacccctccaatat

SEQ ID NO: 296396 - DNA, 25 bp, Mus musculus
caactgtaactttcccctccaatat

SEQ ID NO: 296397 - DNA, 25 bp, Mus musculus
caactgtacattaccacgttaattt

SEQ ID NO: 296398 - DNA, 25 bp, Mus musculus
caactgtacatttccacgttaattt

SEQ ID NO: 296399 - DNA, 25 bp, Mus musculus
caactgtagcttcagatagggcctt

SEQ ID NO: 296400 - DNA, 25 bp, Mus musculus
caactgtagcttgagatagggcctt

SEQ ID NO: 296401 - DNA, 25 bp, Mus musculus
caactgtatatacctgccaattagt

SEQ ID NO: 296402 - DNA, 25 bp, Mus musculus
caactgtatatagctgccaattagt

SEQ ID NO: 296403 - DNA, 25 bp, Mus musculus
caactgtatgacactttgacacttt

SEQ ID NO: 296404 - DNA, 25 bp, Mus musculus
caactgtatgactctttgacacttt

SEQ ID NO: 296405 - DNA, 25 bp, Mus musculus
caactgtcagttatattatccataa

SEQ ID NO: 296406 - DNA, 25 bp, Mus musculus
caactgtcagttttattatccataa

SEQ ID NO: 296407 - DNA, 25 bp, Mus musculus
caactgtcatggatactctactggg

SEQ ID NO: 296408 - DNA, 25 bp, Mus musculus
caactgtcatggttactctactggg

SEQ ID NO: 296409 - DNA, 25 bp, Mus musculus
caactgtccactattgggtgctttt

SEQ ID NO: 296410 - DNA, 25 bp, Mus musculus
caactgtccacttttgggtgctttt

SEQ ID NO: 296411 - DNA, 25 bp, Mus musculus
caactgtccgggactccggttacat

SEQ ID NO: 296412 - DNA, 25 bp, Mus musculus
caactgtccgggtctccggttacat

SEQ ID NO: 296413 - DNA, 25 bp, Mus musculus
caactgtccttaaccccagtttcag

SEQ ID NO: 296414 - DNA, 25 bp, Mus musculus
caactgtccttatccccagtttcag

SEQ ID NO: 296415 - DNA, 25 bp, Mus musculus
caactgtcgggcaggccagagcacg

SEQ ID NO: 296416 - DNA, 25 bp, Mus musculus
caactgtcgggctggccagagcacg

SEQ ID NO: 296417 - DNA, 25 bp, Mus musculus
caactgtcgttgcttctgtcttgaa

SEQ ID NO: 296418 - DNA, 25 bp, Mus musculus
caactgtcgttggttctgtcttgaa

SEQ ID NO: 296419 - DNA, 25 bp, Mus musculus
caactgtctgagactgtgttcctga

SEQ ID NO: 296420 - DNA, 25 bp, Mus musculus
caactgtctgagtctgtgttcctga

SEQ ID NO: 296421 - DNA, 25 bp, Mus musculus
caactgtcttgcactctgaaaacaa

SEQ ID NO: 296422 - DNA, 25 bp, Mus musculus
caactgtcttgctctctgaaaacaa

SEQ ID NO: 296423 - DNA, 25 bp, Mus musculus
caactgtctttcatgacatgtgaaa

SEQ ID NO: 296424 - DNA, 25 bp, Mus musculus
caactgtctttcttgacatgtgaaa

SEQ ID NO: 296425 - DNA, 25 bp, Mus musculus
caactgtgacaacctggcctcagaa

SEQ ID NO: 296426 - DNA, 25 bp, Mus musculus
caactgtgacaagctggcctcagaa

SEQ ID NO: 296427 - DNA, 25 bp, Mus musculus
caactgtgagaccatgccatttttt

SEQ ID NO: 296428 - DNA, 25 bp, Mus musculus
caactgtgagacgatgccatttttt

SEQ ID NO: 296429 - DNA, 25 bp, Mus musculus
caactgtgagccaaactaaacccgt

SEQ ID NO: 296430 - DNA, 25 bp, Mus musculus
caactgtgagcctaactaaacccgt

SEQ ID NO: 296431 - DNA, 25 bp, Mus musculus
caactgtgcaacagaatcccttcca

SEQ ID NO: 296432 - DNA, 25 bp, Mus musculus
caactgtgcaactgaatcccttcca

SEQ ID NO: 296433 - DNA, 25 bp, Mus musculus
caactgtggacacagccctaggact

SEQ ID NO: 296434 - DNA, 25 bp, Mus musculus
caactgtggacagagccctaggact

SEQ ID NO: 296435 - DNA, 25 bp, Mus musculus
caactgtggcatatatggctggaca

SEQ ID NO: 296436 - DNA, 25 bp, Mus musculus
caactgtggcatttatggctggaca

SEQ ID NO: 296437 - DNA, 25 bp, Mus musculus
caactgtgtaatatctggtcggtaa

SEQ ID NO: 296438 - DNA, 25 bp, Mus musculus
caactgtgtaatttctggtcggtaa

SEQ ID NO: 296439 - DNA, 25 bp, Mus musculus
caactgtgtcttacacaattttcta

SEQ ID NO: 296440 - DNA, 25 bp, Mus musculus
caactgtgtctttcacaattttcta

SEQ ID NO: 296441 - DNA, 25 bp, Mus musculus
caactgtgttgtcggatctcctgat

SEQ ID NO: 296442 - DNA, 25 bp, Mus musculus
caactgtgttgtgggatctcctgat

SEQ ID NO: 296443 - DNA, 25 bp, Mus musculus
caactgttaaatagagctgctatca

SEQ ID NO: 296444 - DNA, 25 bp, Mus musculus
caactgttaaattgagctgctatca

SEQ ID NO: 296445 - DNA, 25 bp, Mus musculus
caactgttacagattcattgctctg

SEQ ID NO: 296446 - DNA, 25 bp, Mus musculus
caactgttacagtttcattgctctg

SEQ ID NO: 296447 - DNA, 25 bp, Mus musculus
caactgttgatcactccaattccag

SEQ ID NO: 296448 - DNA, 25 bp, Mus musculus
caactgttgatctctccaattccag

SEQ ID NO: 296449 - DNA, 25 bp, Mus musculus
caactgtttgctaagggtaccctga

SEQ ID NO: 296450 - DNA, 25 bp, Mus musculus
caactgtttgcttagggtaccctga

SEQ ID NO: 296451 - DNA, 25 bp, Mus musculus
caactgtttgtaagacttgaaggtc

SEQ ID NO: 296452 - DNA, 25 bp, Mus musculus
caactgtttgtactgaatggcaaga

SEQ ID NO: 296453 - DNA, 25 bp, Mus musculus
caactgtttgtagtgaatggcaaga

SEQ ID NO: 296454 - DNA, 25 bp, Mus musculus
caactgtttgtatgacttgaaggtc

SEQ ID NO: 296455 - DNA, 25 bp, Mus musculus
caactgttttcaacagcagcaatgt

SEQ ID NO: 296456 - DNA, 25 bp, Mus musculus
caactgttttcatcagcagcaatgt

SEQ ID NO: 296457 - DNA, 25 bp, Mus musculus
caacttaaacacctgctgcagacag

SEQ ID NO: 296458 - DNA, 25 bp, Mus musculus
caacttaaacacgtgctgcagacag

SEQ ID NO: 296459 - DNA, 25 bp, Mus musculus
caacttaacctcagtaatgtagtgg

SEQ ID NO: 296460 - DNA, 25 bp, Mus musculus
caacttaacctctgtaatgtagtgg

SEQ ID NO: 296461 - DNA, 25 bp, Mus musculus
caacttaatggtacaggaccctgag

SEQ ID NO: 296462 - DNA, 25 bp, Mus musculus
caacttaatggttcaggaccctgag

SEQ ID NO: 296463 - DNA, 25 bp, Mus musculus
caacttacctcacagggcctgtgaa

SEQ ID NO: 296464 - DNA, 25 bp, Mus musculus
caacttacctcagagggcctgtgaa

SEQ ID NO: 296465 - DNA, 25 bp, Mus musculus
caacttactttcagcttgtcgaaga

SEQ ID NO: 296466 - DNA, 25 bp, Mus musculus
caacttactttctgcttgtcgaaga

SEQ ID NO: 296467 - DNA, 25 bp, Mus musculus
caacttagggaaacagtagcatcag

SEQ ID NO: 296468 - DNA, 25 bp, Mus musculus
caacttagggaatcagtagcatcag

SEQ ID NO: 296469 - DNA, 25 bp, Mus musculus
caacttatctacaagctcctgaaag

SEQ ID NO: 296470 - DNA, 25 bp, Mus musculus
caacttatctactagctcctgaaag

SEQ ID NO: 296471 - DNA, 25 bp, Mus musculus
caacttcaaggtcggatcgtccgga

SEQ ID NO: 296472 - DNA, 25 bp, Mus musculus
caacttcaaggtgggatcgtccgga

SEQ ID NO: 296473 - DNA, 25 bp, Mus musculus
caacttcacactctgtggtctgtgc

SEQ ID NO: 296474 - DNA, 25 bp, Mus musculus
caacttcacactgtgtggtctgtgc

SEQ ID NO: 296475 - DNA, 25 bp, Mus musculus
caacttcacagtagattgcagcaaa

SEQ ID NO: 296476 - DNA, 25 bp, Mus musculus
caacttcacagttgattgcagcaaa

SEQ ID NO: 296477 - DNA, 25 bp, Mus musculus
caacttcaccagacacgggactaga

SEQ ID NO: 296478 - DNA, 25 bp, Mus musculus
caacttcaccagtcacgggactaga

SEQ ID NO: 296479 - DNA, 25 bp, Mus musculus
caacttcacctgactgtctctatgc

SEQ ID NO: 296480 - DNA, 25 bp, Mus musculus
caacttcacctgtctgtctctatgc

SEQ ID NO: 296481 - DNA, 25 bp, Mus musculus
caacttcagcagaggttatcgcaag

SEQ ID NO: 296482 - DNA, 25 bp, Mus musculus
caacttcagcagtggttatcgcaag

SEQ ID NO: 296483 - DNA, 25 bp, Mus musculus
caacttcagcgactgctggtgggac

SEQ ID NO: 296484 - DNA, 25 bp, Mus musculus
caacttcagcgagtgctggtgggac

SEQ ID NO: 296485 - DNA, 25 bp, Mus musculus
caacttcagggtcggatcttccgaa

SEQ ID NO: 296486 - DNA, 25 bp, Mus musculus
caacttcagggtcgtggatatccta

SEQ ID NO: 296487 - DNA, 25 bp, Mus musculus
caacttcagggtgggatcttccgaa

SEQ ID NO: 296488 - DNA, 25 bp, Mus musculus
caacttcagggtggtggatatccta

SEQ ID NO: 296489 - DNA, 25 bp, Mus musculus
caacttcatgttctatctttcaggg

SEQ ID NO: 296490 - DNA, 25 bp, Mus musculus
caacttcatgttgtatctttcaggg

SEQ ID NO: 296491 - DNA, 25 bp, Mus musculus
caacttccaagaacgttgttccaat

SEQ ID NO: 296492 - DNA, 25 bp, Mus musculus
caacttccaagatcgttgttccaat

SEQ ID NO: 296493 - DNA, 25 bp, Mus musculus
caacttccaagtcaatgcctgatgt

SEQ ID NO: 296494 - DNA, 25 bp, Mus musculus
caacttccaagtgaatgcctgatgt

SEQ ID NO: 296495 - DNA, 25 bp, Mus musculus
caacttccaatcagtgacaaggcta

SEQ ID NO: 296496 - DNA, 25 bp, Mus musculus
caacttccaatctgtgacaaggcta

SEQ ID NO: 296497 - DNA, 25 bp, Mus musculus
caacttccagcaacatggtgactca

SEQ ID NO: 296498 - DNA, 25 bp, Mus musculus
caacttccagcatcatggtgactca

SEQ ID NO: 296499 - DNA, 25 bp, Mus musculus
caacttccaggacagtaactcgcta

SEQ ID NO: 296500 - DNA, 25 bp, Mus musculus
caacttccaggagagtaactcgcta

SEQ ID NO: 296501 - DNA, 25 bp, Mus musculus
caacttccattcctgatcttaggca

SEQ ID NO: 296502 - DNA, 25 bp, Mus musculus
caacttccattcgtgatcttaggca

SEQ ID NO: 296503 - DNA, 25 bp, Mus musculus
caacttcccgacagtcagaaacggt

SEQ ID NO: 296504 - DNA, 25 bp, Mus musculus
caacttcccgactgtcagaaacggt

SEQ ID NO: 296505 - DNA, 25 bp, Mus musculus
caacttccctggcttatcagaagat

SEQ ID NO: 296506 - DNA, 25 bp, Mus musculus
caacttccctgggttatcagaagat

SEQ ID NO: 296507 - DNA, 25 bp, Mus musculus
caacttccctgtatctttctctaaa

SEQ ID NO: 296508 - DNA, 25 bp, Mus musculus
caacttccctgtttctttctctaaa

SEQ ID NO: 296509 - DNA, 25 bp, Mus musculus
caacttcctcgtctatatttccctg

SEQ ID NO: 296510 - DNA, 25 bp, Mus musculus
caacttcctcgtgtatatttccctg

SEQ ID NO: 296511 - DNA, 25 bp, Mus musculus
caacttcggttacactgagcacggt

SEQ ID NO: 296512 - DNA, 25 bp, Mus musculus
caacttcggttagactgagcacggt

SEQ ID NO: 296513 - DNA, 25 bp, Mus musculus
caacttctaagcagtcctctacacg

SEQ ID NO: 296514 - DNA, 25 bp, Mus musculus
caacttctaagctgtcctctacacg

SEQ ID NO: 296515 - DNA, 25 bp, Mus musculus
caacttctcactcgcggacctggag

SEQ ID NO: 296516 - DNA, 25 bp, Mus musculus
caacttctcactggcggacctggag

SEQ ID NO: 296517 - DNA, 25 bp, Mus musculus
caacttcttgctcatattcctgtat

SEQ ID NO: 296518 - DNA, 25 bp, Mus musculus
caacttcttgctgatattcctgtat

SEQ ID NO: 296519 - DNA, 25 bp, Mus musculus
caacttcttggccacttgtatggtt

SEQ ID NO: 296520 - DNA, 25 bp, Mus musculus
caacttcttggcgacttgtatggtt

SEQ ID NO: 296521 - DNA, 25 bp, Mus musculus
caacttcttgggatagctagtacta

SEQ ID NO: 296522 - DNA, 25 bp, Mus musculus
caacttcttgggttagctagtacta

SEQ ID NO: 296523 - DNA, 25 bp, Mus musculus
caacttcttggtcaaggtcttggga

SEQ ID NO: 296524 - DNA, 25 bp, Mus musculus
caacttcttggtgaaggtcttggga

SEQ ID NO: 296525 - DNA, 25 bp, Mus musculus
caacttgaacaaacgggacctgctg

SEQ ID NO: 296526 - DNA, 25 bp, Mus musculus
caacttgaacaatcgggacctgctg

SEQ ID NO: 296527 - DNA, 25 bp, Mus musculus
caacttgaactacagggcacccact

SEQ ID NO: 296528 - DNA, 25 bp, Mus musculus
caacttgaactagagggcacccact

SEQ ID NO: 296529 - DNA, 25 bp, Mus musculus
caacttgaactcagaactcccggaa

SEQ ID NO: 296530 - DNA, 25 bp, Mus musculus
caacttgaactctgaactcccggaa

SEQ ID NO: 296531 - DNA, 25 bp, Mus musculus
caacttgaagaactgtggtgacctc

SEQ ID NO: 296532 - DNA, 25 bp, Mus musculus
caacttgaagaagtgtggtgacctc

SEQ ID NO: 296533 - DNA, 25 bp, Mus musculus
caacttgaagcaaagccccagctgt

SEQ ID NO: 296534 - DNA, 25 bp, Mus musculus
caacttgaagcatagccccagctgt

SEQ ID NO: 296535 - DNA, 25 bp, Mus musculus
caacttgacccaatccttgagggaa

SEQ ID NO: 296536 - DNA, 25 bp, Mus musculus
caacttgacccattccttgagggaa

SEQ ID NO: 296537 - DNA, 25 bp, Mus musculus
caacttgatattctccattttggtt

SEQ ID NO: 296538 - DNA, 25 bp, Mus musculus
caacttgatattgtccattttggtt

SEQ ID NO: 296539 - DNA, 25 bp, Mus musculus
caacttgatgggaccttgcacattt

SEQ ID NO: 296540 - DNA, 25 bp, Mus musculus
caacttgatgggtccttgcacattt

SEQ ID NO: 296541 - DNA, 25 bp, Mus musculus
caacttgatgtgacatgcctcaggt

SEQ ID NO: 296542 - DNA, 25 bp, Mus musculus
caacttgatgtgtcatgcctcaggt

SEQ ID NO: 296543 - DNA, 25 bp, Mus musculus
caacttgattggctgcctcttggca

SEQ ID NO: 296544 - DNA, 25 bp, Mus musculus
caacttgattgggtgcctcttggca

SEQ ID NO: 296545 - DNA, 25 bp, Mus musculus
caacttgatttgagcactgtgatga

SEQ ID NO: 296546 - DNA, 25 bp, Mus musculus
caacttgatttgtgcactgtgatga

SEQ ID NO: 296547 - DNA, 25 bp, Mus musculus
caacttgcaatacctcacagagcca

SEQ ID NO: 296548 - DNA, 25 bp, Mus musculus
caacttgcaatagctcacagagcca

SEQ ID NO: 296549 - DNA, 25 bp, Mus musculus
caacttgcaatgctgttcatggaga

SEQ ID NO: 296550 - DNA, 25 bp, Mus musculus
caacttgcaatggtgttcatggaga

SEQ ID NO: 296551 - DNA, 25 bp, Mus musculus
caacttgcccatctggtctttaagt

SEQ ID NO: 296552 - DNA, 25 bp, Mus musculus
caacttgcccatgtggtctttaagt

SEQ ID NO: 296553 - DNA, 25 bp, Mus musculus
caacttgccttgcatgatcacccaa

SEQ ID NO: 296554 - DNA, 25 bp, Mus musculus
caacttgccttggatgatcacccaa

SEQ ID NO: 296555 - DNA, 25 bp, Mus musculus
caacttgcgagaatgaagggctttt

SEQ ID NO: 296556 - DNA, 25 bp, Mus musculus
caacttgcgagattgaagggctttt

SEQ ID NO: 296557 - DNA, 25 bp, Mus musculus
caacttgctctacagactaggctga

SEQ ID NO: 296558 - DNA, 25 bp, Mus musculus
caacttgctctagagactaggctga

SEQ ID NO: 296559 - DNA, 25 bp, Mus musculus
caacttgctctgatcagccttaata

SEQ ID NO: 296560 - DNA, 25 bp, Mus musculus
caacttgctctgttcagccttaata

SEQ ID NO: 296561 - DNA, 25 bp, Mus musculus
caacttgctgctctggaatccaggg

SEQ ID NO: 296562 - DNA, 25 bp, Mus musculus
caacttgctgctgtggaatccaggg

SEQ ID NO: 296563 - DNA, 25 bp, Mus musculus
caacttgctgttcgcctttaaaagc

SEQ ID NO: 296564 - DNA, 25 bp, Mus musculus
caacttgctgttggcctttaaaagc

SEQ ID NO: 296565 - DNA, 25 bp, Mus musculus
caacttgctttaaaggtgtcatcac

SEQ ID NO: 296566 - DNA, 25 bp, Mus musculus
caacttgctttataggtgtcatcac

SEQ ID NO: 296567 - DNA, 25 bp, Mus musculus
caacttggaaaacctagggtcttag

SEQ ID NO: 296568 - DNA, 25 bp, Mus musculus
caacttggaaaagctagggtcttag

SEQ ID NO: 296569 - DNA, 25 bp, Mus musculus
caacttggaagtcccaacgcgggtg

SEQ ID NO: 296570 - DNA, 25 bp, Mus musculus
caacttggaagtgccaacgcgggtg

SEQ ID NO: 296571 - DNA, 25 bp, Mus musculus
caacttggaccgatttcgctttgag

SEQ ID NO: 296572 - DNA, 25 bp, Mus musculus
caacttggaccgttttcgctttgag

SEQ ID NO: 296573 - DNA, 25 bp, Mus musculus
caacttggagtgacggacctgcttc

SEQ ID NO: 296574 - DNA, 25 bp, Mus musculus
caacttggagtgtcggacctgcttc

SEQ ID NO: 296575 - DNA, 25 bp, Mus musculus
caacttggatttctgatttaaacta

SEQ ID NO: 296576 - DNA, 25 bp, Mus musculus
caacttggatttgtgatttaaacta

SEQ ID NO: 296577 - DNA, 25 bp, Mus musculus
caacttggcaagcttttgggcaact

SEQ ID NO: 296578 - DNA, 25 bp, Mus musculus
caacttggcaaggttttgggcaact

SEQ ID NO: 296579 - DNA, 25 bp, Mus musculus
caacttggcagactggttccagcga

SEQ ID NO: 296580 - DNA, 25 bp, Mus musculus
caacttggcagagtggttccagcga

SEQ ID NO: 296581 - DNA, 25 bp, Mus musculus
caacttggcagcatttttctactgg

SEQ ID NO: 296582 - DNA, 25 bp, Mus musculus
caacttggcagcttttttctactgg

SEQ ID NO: 296583 - DNA, 25 bp, Mus musculus
caacttggcatccattcccttttta

SEQ ID NO: 296584 - DNA, 25 bp, Mus musculus
caacttggcatcgattcccttttta

SEQ ID NO: 296585 - DNA, 25 bp, Mus musculus
caacttgggagtatggctgctttca

SEQ ID NO: 296586 - DNA, 25 bp, Mus musculus
caacttgggagtttggctgctttca

SEQ ID NO: 296587 - DNA, 25 bp, Mus musculus
caacttgtcaagagtggagcttcat

SEQ ID NO: 296588 - DNA, 25 bp, Mus musculus
caacttgtcaagtgtggagcttcat

SEQ ID NO: 296589 - DNA, 25 bp, Mus musculus
caacttgtccatacagtgttacagt

SEQ ID NO: 296590 - DNA, 25 bp, Mus musculus
caacttgtccattcagtgttacagt

SEQ ID NO: 296591 - DNA, 25 bp, Mus musculus
caacttgtccctcagtctttgaaaa

SEQ ID NO: 296592 - DNA, 25 bp, Mus musculus
caacttgtccctgagtctttgaaaa

SEQ ID NO: 296593 - DNA, 25 bp, Mus musculus
caacttgtcctgaagcacttacatt

SEQ ID NO: 296594 - DNA, 25 bp, Mus musculus
caacttgtcctgtagcacttacatt

SEQ ID NO: 296595 - DNA, 25 bp, Mus musculus
caacttgtctagaccccaattgggt

SEQ ID NO: 296596 - DNA, 25 bp, Mus musculus
caacttgtctagtccccaattgggt

SEQ ID NO: 296597 - DNA, 25 bp, Mus musculus
caacttgtgattataatcttgcaga

SEQ ID NO: 296598 - DNA, 25 bp, Mus musculus
caacttgtgattttaatcttgcaga

SEQ ID NO: 296599 - DNA, 25 bp, Mus musculus
caactttaaaagatggaccagctgt

SEQ ID NO: 296600 - DNA, 25 bp, Mus musculus
caactttaaaagttggaccagctgt

SEQ ID NO: 296601 - DNA, 25 bp, Mus musculus
caactttaaagtccagtccggctga

SEQ ID NO: 296602 - DNA, 25 bp, Mus musculus
caactttaaagtgcagtccggctga

SEQ ID NO: 296603 - DNA, 25 bp, Mus musculus
caactttaccatatccaagatatag

SEQ ID NO: 296604 - DNA, 25 bp, Mus musculus
caactttaccatttccaagatatag

SEQ ID NO: 296605 - DNA, 25 bp, Mus musculus
caactttacggtagggagacaccat

SEQ ID NO: 296606 - DNA, 25 bp, Mus musculus
caactttacggttgggagacaccat

SEQ ID NO: 296607 - DNA, 25 bp, Mus musculus
caactttattgtcacttgctattaa

SEQ ID NO: 296608 - DNA, 25 bp, Mus musculus
caactttattgtcatgtgttctgta

SEQ ID NO: 296609 - DNA, 25 bp, Mus musculus
caactttattgtgacttgctattaa

SEQ ID NO: 296610 - DNA, 25 bp, Mus musculus
caactttattgtgatgtgttctgta

SEQ ID NO: 296611 - DNA, 25 bp, Mus musculus
caactttcccagcagcactggagta

SEQ ID NO: 296612 - DNA, 25 bp, Mus musculus
caactttcccaggagcactggagta

SEQ ID NO: 296613 - DNA, 25 bp, Mus musculus
caactttccgttctaatcgcttggt

SEQ ID NO: 296614 - DNA, 25 bp, Mus musculus
caactttccgttgtaatcgcttggt

SEQ ID NO: 296615 - DNA, 25 bp, Mus musculus
caactttccttacgttcgctttgca

SEQ ID NO: 296616 - DNA, 25 bp, Mus musculus
caactttccttaggttcgctttgca

SEQ ID NO: 296617 - DNA, 25 bp, Mus musculus
caactttctatcagaatccaagcct

SEQ ID NO: 296618 - DNA, 25 bp, Mus musculus
caactttctatctgaatccaagcct

SEQ ID NO: 296619 - DNA, 25 bp, Mus musculus
caactttctggtcggaatgctcttc

SEQ ID NO: 296620 - DNA, 25 bp, Mus musculus
caactttctggtcttactcatccga

SEQ ID NO: 296621 - DNA, 25 bp, Mus musculus
caactttctggtgggaatgctcttc

SEQ ID NO: 296622 - DNA, 25 bp, Mus musculus
caactttctggtgttactcatccga

SEQ ID NO: 296623 - DNA, 25 bp, Mus musculus
caactttcttgtaccctctacaata

SEQ ID NO: 296624 - DNA, 25 bp, Mus musculus
caactttcttgttccctctacaata

SEQ ID NO: 296625 - DNA, 25 bp, Mus musculus
caactttgacctagtgtgggacaca

SEQ ID NO: 296626 - DNA, 25 bp, Mus musculus
caactttgaccttgtgtgggacaca

SEQ ID NO: 296627 - DNA, 25 bp, Mus musculus
caactttgaggtatgcttcctggca

SEQ ID NO: 296628 - DNA, 25 bp, Mus musculus
caactttgaggtttgcttcctggca

SEQ ID NO: 296629 - DNA, 25 bp, Mus musculus
caactttggactcgatgggaataac

SEQ ID NO: 296630 - DNA, 25 bp, Mus musculus
caactttggactctggagccgtatt

SEQ ID NO: 296631 - DNA, 25 bp, Mus musculus
caactttggactggatgggaataac

SEQ ID NO: 296632 - DNA, 25 bp, Mus musculus
caactttggactgtggagccgtatt

SEQ ID NO: 296633 - DNA, 25 bp, Mus musculus
caactttggcatagtggaagggctc

SEQ ID NO: 296634 - DNA, 25 bp, Mus musculus
caactttggcattgtggaagggctc

SEQ ID NO: 296635 - DNA, 25 bp, Mus musculus
caactttgtcaacctcatttcctgg

SEQ ID NO: 296636 - DNA, 25 bp, Mus musculus
caactttgtcaagctcatttcctgg

SEQ ID NO: 296637 - DNA, 25 bp, Mus musculus
caactttgtcatccttatttcagca

SEQ ID NO: 296638 - DNA, 25 bp, Mus musculus
caactttgtcatgcttatttcagca

SEQ ID NO: 296639 - DNA, 25 bp, Mus musculus
caactttgtggcactttgtgataca

SEQ ID NO: 296640 - DNA, 25 bp, Mus musculus
caactttgtggctctttgtgataca

SEQ ID NO: 296641 - DNA, 25 bp, Mus musculus
caacttttaaataacatcccctgct

SEQ ID NO: 296642 - DNA, 25 bp, Mus musculus
caacttttaaattacatcccctgct

SEQ ID NO: 296643 - DNA, 25 bp, Mus musculus
caacttttaagtactgtaagcacaa

SEQ ID NO: 296644 - DNA, 25 bp, Mus musculus
caacttttaagttctgtaagcacaa

SEQ ID NO: 296645 - DNA, 25 bp, Mus musculus
caacttttagtgatagaccctatag

SEQ ID NO: 296646 - DNA, 25 bp, Mus musculus
caacttttagtgttagaccctatag

SEQ ID NO: 296647 - DNA, 25 bp, Mus musculus
caacttttccatcctcttactacaa

SEQ ID NO: 296648 - DNA, 25 bp, Mus musculus
caacttttccatgctcttactacaa

SEQ ID NO: 296649 - DNA, 25 bp, Mus musculus
caacttttcgtgacttcatgtcttt

SEQ ID NO: 296650 - DNA, 25 bp, Mus musculus
caacttttcgtgtcttcatgtcttt

SEQ ID NO: 296651 - DNA, 25 bp, Mus musculus
caacttttgtttaggcatggagccc

SEQ ID NO: 296652 - DNA, 25 bp, Mus musculus
caacttttgttttggcatggagccc

SEQ ID NO: 296653 - DNA, 25 bp, Mus musculus
caactttttatccttggctccaact

SEQ ID NO: 296654 - DNA, 25 bp, Mus musculus
caactttttatcgttggctccaact

SEQ ID NO: 296655 - DNA, 25 bp, Mus musculus
caactttttgacatcgttaacgagc

SEQ ID NO: 296656 - DNA, 25 bp, Mus musculus
caactttttgacttcgttaacgagc

SEQ ID NO: 296657 - DNA, 25 bp, Mus musculus
caactttttgccctgtatatgccaa

SEQ ID NO: 296658 - DNA, 25 bp, Mus musculus
caactttttgccgtgtatatgccaa

SEQ ID NO: 296659 - DNA, 25 bp, Mus musculus
caagaaaaagtaagacctgcagcgg

SEQ ID NO: 296660 - DNA, 25 bp, Mus musculus
caagaaaaagtatgacctgcagcgg

SEQ ID NO: 296661 - DNA, 25 bp, Mus musculus
caagaaaaagtgaatcgggctggta

SEQ ID NO: 296662 - DNA, 25 bp, Mus musculus
caagaaaaagtgtatcgggctggta

SEQ ID NO: 296663 - DNA, 25 bp, Mus musculus
caagaaaacctcaagggtcctgctt

SEQ ID NO: 296664 - DNA, 25 bp, Mus musculus
caagaaaacctctagggtcctgctt

SEQ ID NO: 296665 - DNA, 25 bp, Mus musculus
caagaaaacttaagaccgggcgatt

SEQ ID NO: 296666 - DNA, 25 bp, Mus musculus
caagaaaacttatgaccgggcgatt

SEQ ID NO: 296667 - DNA, 25 bp, Mus musculus
caagaaaatcttccagttgtcatcc

SEQ ID NO: 296668 - DNA, 25 bp, Mus musculus
caagaaaatcttgcagttgtcatcc

SEQ ID NO: 296669 - DNA, 25 bp, Mus musculus
caagaaaatgccaggacctactggg

SEQ ID NO: 296670 - DNA, 25 bp, Mus musculus
caagaaaatgcctggacctactggg

SEQ ID NO: 296671 - DNA, 25 bp, Mus musculus
caagaaacacggacagtccaagtgg

SEQ ID NO: 296672 - DNA, 25 bp, Mus musculus
caagaaacacggtcagtccaagtgg

SEQ ID NO: 296673 - DNA, 25 bp, Mus musculus
caagaaaccaatcagccaacactgt

SEQ ID NO: 296674 - DNA, 25 bp, Mus musculus
caagaaaccaatgagccaacactgt

SEQ ID NO: 296675 - DNA, 25 bp, Mus musculus
caagaaaccatcaagaaaggagact

SEQ ID NO: 296676 - DNA, 25 bp, Mus musculus
caagaaaccatctagaaaggagact

SEQ ID NO: 296677 - DNA, 25 bp, Mus musculus
caagaaacgcggagcaatgcccaag

SEQ ID NO: 296678 - DNA, 25 bp, Mus musculus
caagaaacgcggtgcaatgcccaag

SEQ ID NO: 296679 - DNA, 25 bp, Mus musculus
caagaaacgcttaggccagtggacc

SEQ ID NO: 296680 - DNA, 25 bp, Mus musculus
caagaaacgctttggccagtggacc

SEQ ID NO: 296681 - DNA, 25 bp, Mus musculus
caagaaactgttatggtcaggaggg

SEQ ID NO: 296682 - DNA, 25 bp, Mus musculus
caagaaactgttttggtcaggaggg

SEQ ID NO: 296683 - DNA, 25 bp, Mus musculus
caagaaacttgcattgaactcctga

SEQ ID NO: 296684 - DNA, 25 bp, Mus musculus
caagaaacttgctttgaactcctga

SEQ ID NO: 296685 - DNA, 25 bp, Mus musculus
caagaaagacttctatgggtccggg

SEQ ID NO: 296686 - DNA, 25 bp, Mus musculus
caagaaagacttgtatgggtccggg

SEQ ID NO: 296687 - DNA, 25 bp, Mus musculus
caagaaagatgtctccctgggcttc

SEQ ID NO: 296688 - DNA, 25 bp, Mus musculus
caagaaagatgtgtccctgggcttc

SEQ ID NO: 296689 - DNA, 25 bp, Mus musculus
caagaaagcgatacccggcctggga

SEQ ID NO: 296690 - DNA, 25 bp, Mus musculus
caagaaagcgattcccggcctggga

SEQ ID NO: 296691 - DNA, 25 bp, Mus musculus
caagaaagctttagggcagctgcaa

SEQ ID NO: 296692 - DNA, 25 bp, Mus musculus
caagaaagcttttgggcagctgcaa

SEQ ID NO: 296693 - DNA, 25 bp, Mus musculus
caagaaaggcgacggcaaccagtag

SEQ ID NO: 296694 - DNA, 25 bp, Mus musculus
caagaaaggcgagggcaaccagtag

SEQ ID NO: 296695 - DNA, 25 bp, Mus musculus
caagaaatatctatttgtagccttt

SEQ ID NO: 296696 - DNA, 25 bp, Mus musculus
caagaaatatctttttgtagccttt

SEQ ID NO: 296697 - DNA, 25 bp, Mus musculus
caagaaatcaagcttttgcttatgt

SEQ ID NO: 296698 - DNA, 25 bp, Mus musculus
caagaaatcaaggttttgcttatgt

SEQ ID NO: 296699 - DNA, 25 bp, Mus musculus
caagaaatccttcactttgccagag

SEQ ID NO: 296700 - DNA, 25 bp, Mus musculus
caagaaatccttgactttgccagag

SEQ ID NO: 296701 - DNA, 25 bp, Mus musculus
caagaaattaggagtggctgctgcc

SEQ ID NO: 296702 - DNA, 25 bp, Mus musculus
caagaaattaggtgtggctgctgcc

SEQ ID NO: 296703 - DNA, 25 bp, Mus musculus
caagaaattataacatgtcgctata

SEQ ID NO: 296704 - DNA, 25 bp, Mus musculus
caagaaattatatcatgtcgctata

SEQ ID NO: 296705 - DNA, 25 bp, Mus musculus
caagaacaacagataggtgtgcaat

SEQ ID NO: 296706 - DNA, 25 bp, Mus musculus
caagaacaacagttaggtgtgcaat

SEQ ID NO: 296707 - DNA, 25 bp, Mus musculus
caagaacaacctacgagtcaatttt

SEQ ID NO: 296708 - DNA, 25 bp, Mus musculus
caagaacaaccttcgagtcaatttt

SEQ ID NO: 296709 - DNA, 25 bp, Mus musculus
caagaacaatccatactgtgcgttg

SEQ ID NO: 296710 - DNA, 25 bp, Mus musculus
caagaacaatccttactgtgcgttg

SEQ ID NO: 296711 - DNA, 25 bp, Mus musculus
caagaacaatttatagacactggat

SEQ ID NO: 296712 - DNA, 25 bp, Mus musculus
caagaacaatttttagacactggat

SEQ ID NO: 296713 - DNA, 25 bp, Mus musculus
caagaacacattcacctgggcatca

SEQ ID NO: 296714 - DNA, 25 bp, Mus musculus
caagaacacattgacctgggcatca

SEQ ID NO: 296715 - DNA, 25 bp, Mus musculus
caagaacaggaacctacctctcggg

SEQ ID NO: 296716 - DNA, 25 bp, Mus musculus
caagaacaggaagctacctctcggg

SEQ ID NO: 296717 - DNA, 25 bp, Mus musculus
caagaacagtacacagggacccagg

SEQ ID NO: 296718 - DNA, 25 bp, Mus musculus
caagaacagtactcagggacccagg

SEQ ID NO: 296719 - DNA, 25 bp, Mus musculus
caagaacagtggctgtccctccaaa

SEQ ID NO: 296720 - DNA, 25 bp, Mus musculus
caagaacagtgggtgtccctccaaa

SEQ ID NO: 296721 - DNA, 25 bp, Mus musculus
caagaacatgggaatgggccacggg

SEQ ID NO: 296722 - DNA, 25 bp, Mus musculus
caagaacatgggtatgggccacggg

SEQ ID NO: 296723 - DNA, 25 bp, Mus musculus
caagaacatgttagccatctggcga

SEQ ID NO: 296724 - DNA, 25 bp, Mus musculus
caagaacatgtttgccatctggcga

SEQ ID NO: 296725 - DNA, 25 bp, Mus musculus
caagaaccgatgctacccacctggg

SEQ ID NO: 296726 - DNA, 25 bp, Mus musculus
caagaaccgatggtacccacctggg

SEQ ID NO: 296727 - DNA, 25 bp, Mus musculus
caagaacctagacgcccattatcct

SEQ ID NO: 296728 - DNA, 25 bp, Mus musculus
caagaacctagaggcccattatcct

SEQ ID NO: 296729 - DNA, 25 bp, Mus musculus
caagaacctgctactactaggggag

SEQ ID NO: 296730 - DNA, 25 bp, Mus musculus
caagaacctgcttctactaggggag

SEQ ID NO: 296731 - DNA, 25 bp, Mus musculus
caagaacctggccagtgaccactgt

SEQ ID NO: 296732 - DNA, 25 bp, Mus musculus
caagaacctggcgagtgaccactgt

SEQ ID NO: 296733 - DNA, 25 bp, Mus musculus
caagaacctgttatgatattataga

SEQ ID NO: 296734 - DNA, 25 bp, Mus musculus
caagaacctgttttgatattataga

SEQ ID NO: 296735 - DNA, 25 bp, Mus musculus
caagaaccttcgcagggactgaaaa

SEQ ID NO: 296736 - DNA, 25 bp, Mus musculus
caagaaccttcggagggactgaaaa

SEQ ID NO: 296737 - DNA, 25 bp, Mus musculus
caagaacgatctatactagtaacat

SEQ ID NO: 296738 - DNA, 25 bp, Mus musculus
caagaacgatctttactagtaacat

SEQ ID NO: 296739 - DNA, 25 bp, Mus musculus
caagaactcagaagcaccccgtgtc

SEQ ID NO: 296740 - DNA, 25 bp, Mus musculus
caagaactcagatgcaccccgtgtc

SEQ ID NO: 296741 - DNA, 25 bp, Mus musculus
caagaactccagatacaagagattt

SEQ ID NO: 296742 - DNA, 25 bp, Mus musculus
caagaactccagttacaagagattt

SEQ ID NO: 296743 - DNA, 25 bp, Mus musculus
caagaactctagctggtaccaagga

SEQ ID NO: 296744 - DNA, 25 bp, Mus musculus
caagaactctaggtggtaccaagga

SEQ ID NO: 296745 - DNA, 25 bp, Mus musculus
caagaacttgttccataccattgtg

SEQ ID NO: 296746 - DNA, 25 bp, Mus musculus
caagaacttgttgcataccattgtg

SEQ ID NO: 296747 - DNA, 25 bp, Mus musculus
caagaactttcactggcattggact

SEQ ID NO: 296748 - DNA, 25 bp, Mus musculus
caagaactttcagtggcattggact

SEQ ID NO: 296749 - DNA, 25 bp, Mus musculus
caagaactttctacaccaggtgcca

SEQ ID NO: 296750 - DNA, 25 bp, Mus musculus
caagaactttcttcaccaggtgcca

SEQ ID NO: 296751 - DNA, 25 bp, Mus musculus
caagaacttttgaagcttccgtagg

SEQ ID NO: 296752 - DNA, 25 bp, Mus musculus
caagaacttttgtagcttccgtagg

SEQ ID NO: 296753 - DNA, 25 bp, Mus musculus
caagaagaacaactcgcgcatgatc

SEQ ID NO: 296754 - DNA, 25 bp, Mus musculus
caagaagaacaagtcgcgcatgatc

SEQ ID NO: 296755 - DNA, 25 bp, Mus musculus
caagaagaacttaatgcggctgcag

SEQ ID NO: 296756 - DNA, 25 bp, Mus musculus
caagaagaactttatgcggctgcag

SEQ ID NO: 296757 - DNA, 25 bp, Mus musculus
caagaagaccatctgagccgggcgt

SEQ ID NO: 296758 - DNA, 25 bp, Mus musculus
caagaagaccatgtgagccgggcgt

SEQ ID NO: 296759 - DNA, 25 bp, Mus musculus
caagaagaccttccagagtaccaat

SEQ ID NO: 296760 - DNA, 25 bp, Mus musculus
caagaagaccttgcagagtaccaat

SEQ ID NO: 296761 - DNA, 25 bp, Mus musculus
caagaagagcccctggttcccgagg

SEQ ID NO: 296762 - DNA, 25 bp, Mus musculus
caagaagagcccctgtcgcttttct

SEQ ID NO: 296763 - DNA, 25 bp, Mus musculus
caagaagagcccgtggttcccgagg

SEQ ID NO: 296764 - DNA, 25 bp, Mus musculus
caagaagagcccgtgtcgcttttct

SEQ ID NO: 296765 - DNA, 25 bp, Mus musculus
caagaagagggtcggcacgcacatc

SEQ ID NO: 296766 - DNA, 25 bp, Mus musculus
caagaagagggtgggcacgcacatc

SEQ ID NO: 296767 - DNA, 25 bp, Mus musculus
caagaagatagtcgaacgcagggat

SEQ ID NO: 296768 - DNA, 25 bp, Mus musculus
caagaagatagtggaacgcagggat

SEQ ID NO: 296769 - DNA, 25 bp, Mus musculus
caagaagatcgacatatcccactga

SEQ ID NO: 296770 - DNA, 25 bp, Mus musculus
caagaagatcgagatatcccactga

SEQ ID NO: 296771 - DNA, 25 bp, Mus musculus
caagaagattctcgagctggagcgc

SEQ ID NO: 296772 - DNA, 25 bp, Mus musculus
caagaagattctggagctggagcgc

SEQ ID NO: 296773 - DNA, 25 bp, Mus musculus
caagaagcacagacagagctgcccc

SEQ ID NO: 296774 - DNA, 25 bp, Mus musculus
caagaagcacagtcagagctgcccc

SEQ ID NO: 296775 - DNA, 25 bp, Mus musculus
caagaagcatctcggctttttccgc

SEQ ID NO: 296776 - DNA, 25 bp, Mus musculus
caagaagcatctgggctttttccgc

SEQ ID NO: 296777 - DNA, 25 bp, Mus musculus
caagaagcattcagggcgccgaaaa

SEQ ID NO: 296778 - DNA, 25 bp, Mus musculus
caagaagcattctgggcgccgaaaa

SEQ ID NO: 296779 - DNA, 25 bp, Mus musculus
caagaagccgaaacagcctagcagg

SEQ ID NO: 296780 - DNA, 25 bp, Mus musculus
caagaagccgaatcagcctagcagg

SEQ ID NO: 296781 - DNA, 25 bp, Mus musculus
caagaagcgggcctccagtgctcgt

SEQ ID NO: 296782 - DNA, 25 bp, Mus musculus
caagaagcgggcgtccagtgctcgt

SEQ ID NO: 296783 - DNA, 25 bp, Mus musculus
caagaagctacgactaaagtttcct

SEQ ID NO: 296784 - DNA, 25 bp, Mus musculus
caagaagctacgtctaaagtttcct

SEQ ID NO: 296785 - DNA, 25 bp, Mus musculus
caagaagctgtgctggactttaata

SEQ ID NO: 296786 - DNA, 25 bp, Mus musculus
caagaagctgtggtggactttaata

SEQ ID NO: 296787 - DNA, 25 bp, Mus musculus
caagaaggaatgaccggcctccctt

SEQ ID NO: 296788 - DNA, 25 bp, Mus musculus
caagaaggaatgtccggcctccctt

SEQ ID NO: 296789 - DNA, 25 bp, Mus musculus
caagaaggacctccacaaagcggag

SEQ ID NO: 296790 - DNA, 25 bp, Mus musculus
caagaaggacctgcacaaagcggag

SEQ ID NO: 296791 - DNA, 25 bp, Mus musculus
caagaaggatatagatgacctggag

SEQ ID NO: 296792 - DNA, 25 bp, Mus musculus
caagaaggatattgatgacctggag

SEQ ID NO: 296793 - DNA, 25 bp, Mus musculus
caagaaggccaaacgctttctgggc

SEQ ID NO: 296794 - DNA, 25 bp, Mus musculus
caagaaggccaatcgctttctgggc

SEQ ID NO: 296795 - DNA, 25 bp, Mus musculus
caagaaggccctcaaacagtatcgg

SEQ ID NO: 296796 - DNA, 25 bp, Mus musculus
caagaaggccctgaaacagtatcgg

SEQ ID NO: 296797 - DNA, 25 bp, Mus musculus
caagaaggcttgacactgtgttaga

SEQ ID NO: 296798 - DNA, 25 bp, Mus musculus
caagaaggcttgtcactgtgttaga

SEQ ID NO: 296799 - DNA, 25 bp, Mus musculus
caagaagggtctcctcttcatgaaa

SEQ ID NO: 296800 - DNA, 25 bp, Mus musculus
caagaagggtctgctcttcatgaaa

SEQ ID NO: 296801 - DNA, 25 bp, Mus musculus
caagaaggtctcatctctgccgtgg

SEQ ID NO: 296802 - DNA, 25 bp, Mus musculus
caagaaggtctcttctctgccgtgg

SEQ ID NO: 296803 - DNA, 25 bp, Mus musculus
caagaaggtcttctacgtgatcgag

SEQ ID NO: 296804 - DNA, 25 bp, Mus musculus
caagaaggtcttgtacgtgatcgag

SEQ ID NO: 296805 - DNA, 25 bp, Mus musculus
caagaaggtgtacctttgttccaca

SEQ ID NO: 296806 - DNA, 25 bp, Mus musculus
caagaaggtgtagctttgttccaca

SEQ ID NO: 296807 - DNA, 25 bp, Mus musculus
caagaagtcggacatccccgagaaa

SEQ ID NO: 296808 - DNA, 25 bp, Mus musculus
caagaagtcggagatccccgagaaa

SEQ ID NO: 296809 - DNA, 25 bp, Mus musculus
caagaagtgaccaccagatggcagt

SEQ ID NO: 296810 - DNA, 25 bp, Mus musculus
caagaagtgacctccagatggcagt

SEQ ID NO: 296811 - DNA, 25 bp, Mus musculus
caagaagtgtcacgtcctccgcatc

SEQ ID NO: 296812 - DNA, 25 bp, Mus musculus
caagaagtgtcaggtcctccgcatc

SEQ ID NO: 296813 - DNA, 25 bp, Mus musculus
caagaagtttccacagatctgagaa

SEQ ID NO: 296814 - DNA, 25 bp, Mus musculus
caagaagtttcctcagatctgagaa

SEQ ID NO: 296815 - DNA, 25 bp, Mus musculus
caagaagttttaatgctcatcacat

SEQ ID NO: 296816 - DNA, 25 bp, Mus musculus
caagaagttttattgctcatcacat

SEQ ID NO: 296817 - DNA, 25 bp, Mus musculus
caagaagtttttcaggtttgcggct

SEQ ID NO: 296818 - DNA, 25 bp, Mus musculus
caagaagtttttgaggtttgcggct

SEQ ID NO: 296819 - DNA, 25 bp, Mus musculus
caagaataaaatccgagccattggg

SEQ ID NO: 296820 - DNA, 25 bp, Mus musculus
caagaataaaatgcgagccattggg

SEQ ID NO: 296821 - DNA, 25 bp, Mus musculus
caagaatatctcagagttcaggcca

SEQ ID NO: 296822 - DNA, 25 bp, Mus musculus
caagaatatctctgagttcaggcca

SEQ ID NO: 296823 - DNA, 25 bp, Mus musculus
caagaatattctacagagcagacaa

SEQ ID NO: 296824 - DNA, 25 bp, Mus musculus
caagaatattcttcagagcagacaa

SEQ ID NO: 296825 - DNA, 25 bp, Mus musculus
caagaatatttcactacattactag

SEQ ID NO: 296826 - DNA, 25 bp, Mus musculus
caagaatatttctctacattactag

SEQ ID NO: 296827 - DNA, 25 bp, Mus musculus
caagaatcagcccttctgtgatggc

SEQ ID NO: 296828 - DNA, 25 bp, Mus musculus
caagaatcagccgttctgtgatggc

SEQ ID NO: 296829 - DNA, 25 bp, Mus musculus
caagaatcagctatgcggcacgtgt

SEQ ID NO: 296830 - DNA, 25 bp, Mus musculus
caagaatcagctttgcggcacgtgt

SEQ ID NO: 296831 - DNA, 25 bp, Mus musculus
caagaatctcttcgcggaacgctgg

SEQ ID NO: 296832 - DNA, 25 bp, Mus musculus
caagaatctcttggcggaacgctgg

SEQ ID NO: 296833 - DNA, 25 bp, Mus musculus
caagaatcttatcacctggtgtagg

SEQ ID NO: 296834 - DNA, 25 bp, Mus musculus
caagaatcttatgacctggtgtagg

SEQ ID NO: 296835 - DNA, 25 bp, Mus musculus
caagaatgaatgctccaccatgtgg

SEQ ID NO: 296836 - DNA, 25 bp, Mus musculus
caagaatgaatggtccaccatgtgg

SEQ ID NO: 296837 - DNA, 25 bp, Mus musculus
caagaatgacttctttcccacaatg

SEQ ID NO: 296838 - DNA, 25 bp, Mus musculus
caagaatgacttgtttcccacaatg

SEQ ID NO: 296839 - DNA, 25 bp, Mus musculus
caagaatgcacgaggactatctggg

SEQ ID NO: 296840 - DNA, 25 bp, Mus musculus
caagaatgcacgtggactatctggg

SEQ ID NO: 296841 - DNA, 25 bp, Mus musculus
caagaatgggttattggataccaat

SEQ ID NO: 296842 - DNA, 25 bp, Mus musculus
caagaatgggtttttggataccaat

SEQ ID NO: 296843 - DNA, 25 bp, Mus musculus
caagaatgtcttcctcgtggtttag

SEQ ID NO: 296844 - DNA, 25 bp, Mus musculus
caagaatgtcttgctcgtggtttag

SEQ ID NO: 296845 - DNA, 25 bp, Mus musculus
caagaattaaccaacctgatcagtg

SEQ ID NO: 296846 - DNA, 25 bp, Mus musculus
caagaattaacctacctgatcagtg

SEQ ID NO: 296847 - DNA, 25 bp, Mus musculus
caagaattcttcacatgtgtggagg

SEQ ID NO: 296848 - DNA, 25 bp, Mus musculus
caagaattcttctcatgtgtggagg

SEQ ID NO: 296849 - DNA, 25 bp, Mus musculus
caagaattgcatagacccctggatt

SEQ ID NO: 296850 - DNA, 25 bp, Mus musculus
caagaattgcattgacccctggatt

SEQ ID NO: 296851 - DNA, 25 bp, Mus musculus
caagaattgctgagtaccaagcact

SEQ ID NO: 296852 - DNA, 25 bp, Mus musculus
caagaattgctgtgtaccaagcact

SEQ ID NO: 296853 - DNA, 25 bp, Mus musculus
caagaattgtagctgttcatgtcaa

SEQ ID NO: 296854 - DNA, 25 bp, Mus musculus
caagaattgtaggtgttcatgtcaa

SEQ ID NO: 296855 - DNA, 25 bp, Mus musculus
caagaatttgggacaagcctggtct

SEQ ID NO: 296856 - DNA, 25 bp, Mus musculus
caagaatttgggtcaagcctggtct

SEQ ID NO: 296857 - DNA, 25 bp, Mus musculus
caagacaaaacacgttctcccctgg

SEQ ID NO: 296858 - DNA, 25 bp, Mus musculus
caagacaaaacaggttctcccctgg

SEQ ID NO: 296859 - DNA, 25 bp, Mus musculus
caagacaaattcatccccattttct

SEQ ID NO: 296860 - DNA, 25 bp, Mus musculus
caagacaaattcttccccattttct

SEQ ID NO: 296861 - DNA, 25 bp, Mus musculus
caagacaacatacatcagctacagt

SEQ ID NO: 296862 - DNA, 25 bp, Mus musculus
caagacaacatagatcagctacagt

SEQ ID NO: 296863 - DNA, 25 bp, Mus musculus
caagacaacggacgcaccacagagt

SEQ ID NO: 296864 - DNA, 25 bp, Mus musculus
caagacaacggaggcaccacagagt

SEQ ID NO: 296865 - DNA, 25 bp, Mus musculus
caagacaagggcacaagatggcatt

SEQ ID NO: 296866 - DNA, 25 bp, Mus musculus
caagacaagggctcaagatggcatt

SEQ ID NO: 296867 - DNA, 25 bp, Mus musculus
caagacaatcaacccttctcttttt

SEQ ID NO: 296868 - DNA, 25 bp, Mus musculus
caagacaatcaagccttctcttttt

SEQ ID NO: 296869 - DNA, 25 bp, Mus musculus
caagacacaggtactgagggctctg

SEQ ID NO: 296870 - DNA, 25 bp, Mus musculus
caagacacaggttctgagggctctg

SEQ ID NO: 296871 - DNA, 25 bp, Mus musculus
caagacaccatcacaagggctgtac

SEQ ID NO: 296872 - DNA, 25 bp, Mus musculus
caagacaccatctcaagggctgtac

SEQ ID NO: 296873 - DNA, 25 bp, Mus musculus
caagacaccctcaaacttgtcaggg

SEQ ID NO: 296874 - DNA, 25 bp, Mus musculus
caagacaccctctaacttgtcaggg

SEQ ID NO: 296875 - DNA, 25 bp, Mus musculus
caagacacctatctggaaagcatct

SEQ ID NO: 296876 - DNA, 25 bp, Mus musculus
caagacacctatgtggaaagcatct

SEQ ID NO: 296877 - DNA, 25 bp, Mus musculus
caagacacgttgcagctgctggtga

SEQ ID NO: 296878 - DNA, 25 bp, Mus musculus
caagacacgttggagctgctggtga

SEQ ID NO: 296879 - DNA, 25 bp, Mus musculus
caagacactcttaggtgttctcgta

SEQ ID NO: 296880 - DNA, 25 bp, Mus musculus
caagacactctttggtgttctcgta

SEQ ID NO: 296881 - DNA, 25 bp, Mus musculus
caagacactgttagatgacccagaa

SEQ ID NO: 296882 - DNA, 25 bp, Mus musculus
caagacactgtttgatgacccagaa

SEQ ID NO: 296883 - DNA, 25 bp, Mus musculus
caagacactttgcagcctttttccc

SEQ ID NO: 296884 - DNA, 25 bp, Mus musculus
caagacactttggagcctttttccc

SEQ ID NO: 296885 - DNA, 25 bp, Mus musculus
caagacagcgcccatgcaggtgctc

SEQ ID NO: 296886 - DNA, 25 bp, Mus musculus
caagacagcgccgatgcaggtgctc

SEQ ID NO: 296887 - DNA, 25 bp, Mus musculus
caagacagggcgcttattcactccc

SEQ ID NO: 296888 - DNA, 25 bp, Mus musculus
caagacagggcggttattcactccc

SEQ ID NO: 296889 - DNA, 25 bp, Mus musculus
caagacaggtatcctcatagctgta

SEQ ID NO: 296890 - DNA, 25 bp, Mus musculus
caagacaggtatgctcatagctgta

SEQ ID NO: 296891 - DNA, 25 bp, Mus musculus
caagacaggttgctttgcaattaaa

SEQ ID NO: 296892 - DNA, 25 bp, Mus musculus
caagacaggttggtttgcaattaaa

SEQ ID NO: 296893 - DNA, 25 bp, Mus musculus
caagacagttagcatacacataggc

SEQ ID NO: 296894 - DNA, 25 bp, Mus musculus
caagacagttaggatacacataggc

SEQ ID NO: 296895 - DNA, 25 bp, Mus musculus
caagacatcaaacacacttttctga

SEQ ID NO: 296896 - DNA, 25 bp, Mus musculus
caagacatcaaagacacttttctga

SEQ ID NO: 296897 - DNA, 25 bp, Mus musculus
caagacatgacgaggcaagctaagc

SEQ ID NO: 296898 - DNA, 25 bp, Mus musculus
caagacatgacgtggcaagctaagc

SEQ ID NO: 296899 - DNA, 25 bp, Mus musculus
caagacatggctaacgtactctttg

SEQ ID NO: 296900 - DNA, 25 bp, Mus musculus
caagacatggcttacgtactctttg

SEQ ID NO: 296901 - DNA, 25 bp, Mus musculus
caagacattgccatgccctagaagt

SEQ ID NO: 296902 - DNA, 25 bp, Mus musculus
caagacattgccttgccctagaagt

SEQ ID NO: 296903 - DNA, 25 bp, Mus musculus
caagaccaacgtcccgaggtggatg

SEQ ID NO: 296904 - DNA, 25 bp, Mus musculus
caagaccaacgtgccgaggtggatg

SEQ ID NO: 296905 - DNA, 25 bp, Mus musculus
caagaccacttccaatgtttctatt

SEQ ID NO: 296906 - DNA, 25 bp, Mus musculus
caagaccacttcgaatgtttctatt

SEQ ID NO: 296907 - DNA, 25 bp, Mus musculus
caagaccagaaaaggagagggccca

SEQ ID NO: 296908 - DNA, 25 bp, Mus musculus
caagaccagaaatggagagggccca

SEQ ID NO: 296909 - DNA, 25 bp, Mus musculus
caagaccatgataagggccctgatt

SEQ ID NO: 296910 - DNA, 25 bp, Mus musculus
caagaccatgattagggccctgatt

SEQ ID NO: 296911 - DNA, 25 bp, Mus musculus
caagaccatggcagatgtgcccttc

SEQ ID NO: 296912 - DNA, 25 bp, Mus musculus
caagaccatggctgatgtgcccttc

SEQ ID NO: 296913 - DNA, 25 bp, Mus musculus
caagaccatggtagaggctcgtaat

SEQ ID NO: 296914 - DNA, 25 bp, Mus musculus
caagaccatggttgaggctcgtaat

SEQ ID NO: 296915 - DNA, 25 bp, Mus musculus
caagacccactgatataggaataaa

SEQ ID NO: 296916 - DNA, 25 bp, Mus musculus
caagacccactgttataggaataaa

SEQ ID NO: 296917 - DNA, 25 bp, Mus musculus
caagacccctggcagatgtggtaca

SEQ ID NO: 296918 - DNA, 25 bp, Mus musculus
caagacccctgggagatgtggtaca

SEQ ID NO: 296919 - DNA, 25 bp, Mus musculus
caagaccgagtcaactttttctaga

SEQ ID NO: 296920 - DNA, 25 bp, Mus musculus
caagaccgagtctactttttctaga

SEQ ID NO: 296921 - DNA, 25 bp, Mus musculus
caagaccgctatctgccatttcatt

SEQ ID NO: 296922 - DNA, 25 bp, Mus musculus
caagaccgctatgtgccatttcatt

SEQ ID NO: 296923 - DNA, 25 bp, Mus musculus
caagacctacctcggcaacataatg

SEQ ID NO: 296924 - DNA, 25 bp, Mus musculus
caagacctacctgggcaacataatg

SEQ ID NO: 296925 - DNA, 25 bp, Mus musculus
caagacctgaaaaggctttgcctat

SEQ ID NO: 296926 - DNA, 25 bp, Mus musculus
caagacctgaaatggctttgcctat

SEQ ID NO: 296927 - DNA, 25 bp, Mus musculus
caagacctggctaaccggaagtgtt

SEQ ID NO: 296928 - DNA, 25 bp, Mus musculus
caagacctggcttaccggaagtgtt

SEQ ID NO: 296929 - DNA, 25 bp, Mus musculus
caagacctgtctcttggatctgttt

SEQ ID NO: 296930 - DNA, 25 bp, Mus musculus
caagacctgtctgttggatctgttt

SEQ ID NO: 296931 - DNA, 25 bp, Mus musculus
caagaccttggcagtcaaagcagga

SEQ ID NO: 296932 - DNA, 25 bp, Mus musculus
caagaccttggctgtcaaagcagga

SEQ ID NO: 296933 - DNA, 25 bp, Mus musculus
caagaccttgtaatgcctcagtgct

SEQ ID NO: 296934 - DNA, 25 bp, Mus musculus
caagaccttgtattgcctcagtgct

SEQ ID NO: 296935 - DNA, 25 bp, Mus musculus
caagaccttgtcagtgtgggatgca

SEQ ID NO: 296936 - DNA, 25 bp, Mus musculus
caagaccttgtctgtgtgggatgca

SEQ ID NO: 296937 - DNA, 25 bp, Mus musculus
caagacctttgacagttttcattca

SEQ ID NO: 296938 - DNA, 25 bp, Mus musculus
caagacctttgagagttttcattca

SEQ ID NO: 296939 - DNA, 25 bp, Mus musculus
caagacgacgtgacaattccagaga

SEQ ID NO: 296940 - DNA, 25 bp, Mus musculus
caagacgacgtgtcaattccagaga

SEQ ID NO: 296941 - DNA, 25 bp, Mus musculus
caagacgagccacgttactgacata

SEQ ID NO: 296942 - DNA, 25 bp, Mus musculus
caagacgagccaggttactgacata

SEQ ID NO: 296943 - DNA, 25 bp, Mus musculus
caagacggccgcacctagcgggcgt

SEQ ID NO: 296944 - DNA, 25 bp, Mus musculus
caagacggccgctcctagcgggcgt

SEQ ID NO: 296945 - DNA, 25 bp, Mus musculus
caagacgtaggcaaatgagtggtaa

SEQ ID NO: 296946 - DNA, 25 bp, Mus musculus
caagacgtaggctaatgagtggtaa

SEQ ID NO: 296947 - DNA, 25 bp, Mus musculus
caagacgtccatagtgcatcaactt

SEQ ID NO: 296948 - DNA, 25 bp, Mus musculus
caagacgtccattgtgcatcaactt

SEQ ID NO: 296949 - DNA, 25 bp, Mus musculus
caagacgtgcacaacctggattact

SEQ ID NO: 296950 - DNA, 25 bp, Mus musculus
caagacgtgcactacctggattact

SEQ ID NO: 296951 - DNA, 25 bp, Mus musculus
caagactaggcacaccaggtctcag

SEQ ID NO: 296952 - DNA, 25 bp, Mus musculus
caagactaggcagaccaggtctcag

SEQ ID NO: 296953 - DNA, 25 bp, Mus musculus
caagactattcaagcctactaactc

SEQ ID NO: 296954 - DNA, 25 bp, Mus musculus
caagactattcatgcctactaactc

SEQ ID NO: 296955 - DNA, 25 bp, Mus musculus
caagactcaggcaaactctctcttc

SEQ ID NO: 296956 - DNA, 25 bp, Mus musculus
caagactcaggctaactctctcttc

SEQ ID NO: 296957 - DNA, 25 bp, Mus musculus
caagactcatttctgttctatcggg

SEQ ID NO: 296958 - DNA, 25 bp, Mus musculus
caagactcatttgtgttctatcggg

SEQ ID NO: 296959 - DNA, 25 bp, Mus musculus
caagactccatgatttaatttatgt

SEQ ID NO: 296960 - DNA, 25 bp, Mus musculus
caagactccatgttttaatttatgt

SEQ ID NO: 296961 - DNA, 25 bp, Mus musculus
caagactcccagcacaagtgtcaca

SEQ ID NO: 296962 - DNA, 25 bp, Mus musculus
caagactcccaggacaagtgtcaca

SEQ ID NO: 296963 - DNA, 25 bp, Mus musculus
caagactcgttcattacccactctt

SEQ ID NO: 296964 - DNA, 25 bp, Mus musculus
caagactcgttctttacccactctt

SEQ ID NO: 296965 - DNA, 25 bp, Mus musculus
caagactctgagctggtacttgatc

SEQ ID NO: 296966 - DNA, 25 bp, Mus musculus
caagactctgaggtggtacttgatc

SEQ ID NO: 296967 - DNA, 25 bp, Mus musculus
caagactcttccatatggtggtggt

SEQ ID NO: 296968 - DNA, 25 bp, Mus musculus
caagactcttccttatggtggtggt

SEQ ID NO: 296969 - DNA, 25 bp, Mus musculus
caagactgaactctgagggctccca

SEQ ID NO: 296970 - DNA, 25 bp, Mus musculus
caagactgaactgtgagggctccca

SEQ ID NO: 296971 - DNA, 25 bp, Mus musculus
caagactgacttaaccctacgggag

SEQ ID NO: 296972 - DNA, 25 bp, Mus musculus
caagactgactttaccctacgggag

SEQ ID NO: 296973 - DNA, 25 bp, Mus musculus
caagactgagttatcatgcctgggt

SEQ ID NO: 296974 - DNA, 25 bp, Mus musculus
caagactgagttttcatgcctgggt

SEQ ID NO: 296975 - DNA, 25 bp, Mus musculus
caagactggcaccactggatgaaca

SEQ ID NO: 296976 - DNA, 25 bp, Mus musculus
caagactggcacgactggatgaaca

SEQ ID NO: 296977 - DNA, 25 bp, Mus musculus
caagactggctcagaaatccggaag

SEQ ID NO: 296978 - DNA, 25 bp, Mus musculus
caagactggctctgaaatccggaag

SEQ ID NO: 296979 - DNA, 25 bp, Mus musculus
caagactggctgaggacttccgatc

SEQ ID NO: 296980 - DNA, 25 bp, Mus musculus
caagactggctgtggacttccgatc

SEQ ID NO: 296981 - DNA, 25 bp, Mus musculus
caagactgtcacaagcaccatgctg

SEQ ID NO: 296982 - DNA, 25 bp, Mus musculus
caagactgtcactagcaccatgctg

SEQ ID NO: 296983 - DNA, 25 bp, Mus musculus
caagacttctacaagctggagctga

SEQ ID NO: 296984 - DNA, 25 bp, Mus musculus
caagacttctactagctggagctga

SEQ ID NO: 296985 - DNA, 25 bp, Mus musculus
caagacttctatcattccacagcag

SEQ ID NO: 296986 - DNA, 25 bp, Mus musculus
caagacttctatgattccacagcag

SEQ ID NO: 296987 - DNA, 25 bp, Mus musculus
caagacttctttcctaggaatgaaa

SEQ ID NO: 296988 - DNA, 25 bp, Mus musculus
caagacttctttgctaggaatgaaa

SEQ ID NO: 296989 - DNA, 25 bp, Mus musculus
caagacttgggcaggtcactctaat

SEQ ID NO: 296990 - DNA, 25 bp, Mus musculus
caagacttgggctggtcactctaat

SEQ ID NO: 296991 - DNA, 25 bp, Mus musculus
caagactttctcaggctggctgggc

SEQ ID NO: 296992 - DNA, 25 bp, Mus musculus
caagactttctctggctggctgggc

SEQ ID NO: 296993 - DNA, 25 bp, Mus musculus
caagactttgagaatcactaccaga

SEQ ID NO: 296994 - DNA, 25 bp, Mus musculus
caagactttgagtatcactaccaga

SEQ ID NO: 296995 - DNA, 25 bp, Mus musculus
caagacttttgacaggtgccacata

SEQ ID NO: 296996 - DNA, 25 bp, Mus musculus
caagacttttgagaggtgccacata

SEQ ID NO: 296997 - DNA, 25 bp, Mus musculus
caagagaaacctatgttgttcccag

SEQ ID NO: 296998 - DNA, 25 bp, Mus musculus
caagagaaacctttgttgttcccag

SEQ ID NO: 296999 - DNA, 25 bp, Mus musculus
caagagaatacaaatccctggagtt

SEQ ID NO: 297000 - DNA, 25 bp, Mus musculus
caagagaatacatatccctggagtt

SEQ ID NO: 297001 - DNA, 25 bp, Mus musculus
caagagacacaacaggcagcctaca

SEQ ID NO: 297002 - DNA, 25 bp, Mus musculus
caagagacacaagaggcagcctaca

SEQ ID NO: 297003 - DNA, 25 bp, Mus musculus
caagagacatctcgctttggtggcc

SEQ ID NO: 297004 - DNA, 25 bp, Mus musculus
caagagacatctggctttggtggcc

SEQ ID NO: 297005 - DNA, 25 bp, Mus musculus
caagagaccagaccccggatgagaa

SEQ ID NO: 297006 - DNA, 25 bp, Mus musculus
caagagaccagagcccggatgagaa

SEQ ID NO: 297007 - DNA, 25 bp, Mus musculus
caagagaccagtcgttccgaggatc

SEQ ID NO: 297008 - DNA, 25 bp, Mus musculus
caagagaccagtggttccgaggatc

SEQ ID NO: 297009 - DNA, 25 bp, Mus musculus
caagagactctgaacctattttgta

SEQ ID NO: 297010 - DNA, 25 bp, Mus musculus
caagagactctgtacctattttgta

SEQ ID NO: 297011 - DNA, 25 bp, Mus musculus
caagagagcagtcctcctatgggca

SEQ ID NO: 297012 - DNA, 25 bp, Mus musculus
caagagagcagtgctcctatgggca

SEQ ID NO: 297013 - DNA, 25 bp, Mus musculus
caagagaggccaaggtagcccctct

SEQ ID NO: 297014 - DNA, 25 bp, Mus musculus
caagagaggccatggtagcccctct

SEQ ID NO: 297015 - DNA, 25 bp, Mus musculus
caagagagtgataaccagccggtga

SEQ ID NO: 297016 - DNA, 25 bp, Mus musculus
caagagagtgattaccagccggtga

SEQ ID NO: 297017 - DNA, 25 bp, Mus musculus
caagagagttgtagtgaaggtcaaa

SEQ ID NO: 297018 - DNA, 25 bp, Mus musculus
caagagagttgttgtgaaggtcaaa

SEQ ID NO: 297019 - DNA, 25 bp, Mus musculus
caagagatatatatgccccgtgtgc

SEQ ID NO: 297020 - DNA, 25 bp, Mus musculus
caagagatatatttgccccgtgtgc

SEQ ID NO: 297021 - DNA, 25 bp, Mus musculus
caagagatctgtctggctcctctgc

SEQ ID NO: 297022 - DNA, 25 bp, Mus musculus
caagagatctgtgtggctcctctgc

SEQ ID NO: 297023 - DNA, 25 bp, Mus musculus
caagagatgggcctgccttcacctc

SEQ ID NO: 297024 - DNA, 25 bp, Mus musculus
caagagatgggcgtgccttcacctc

SEQ ID NO: 297025 - DNA, 25 bp, Mus musculus
caagagattcccataaactcggttg

SEQ ID NO: 297026 - DNA, 25 bp, Mus musculus
caagagattcccttaaactcggttg

SEQ ID NO: 297027 - DNA, 25 bp, Mus musculus
caagagatttatccgtggtccccag

SEQ ID NO: 297028 - DNA, 25 bp, Mus musculus
caagagatttatgcgtggtccccag

SEQ ID NO: 297029 - DNA, 25 bp, Mus musculus
caagagcaacttaactctcctttaa

SEQ ID NO: 297030 - DNA, 25 bp, Mus musculus
caagagcaactttactctcctttaa

SEQ ID NO: 297031 - DNA, 25 bp, Mus musculus
caagagcaagagcaacaacggcggt

SEQ ID NO: 297032 - DNA, 25 bp, Mus musculus
caagagcaagaggaacaacggcggt

SEQ ID NO: 297033 - DNA, 25 bp, Mus musculus
caagagcaagccacaggacgacttg

SEQ ID NO: 297034 - DNA, 25 bp, Mus musculus
caagagcaagcctcaggacgacttg

SEQ ID NO: 297035 - DNA, 25 bp, Mus musculus
caagagcaagctactatggaaacat

SEQ ID NO: 297036 - DNA, 25 bp, Mus musculus
caagagcaagcttctatggaaacat

SEQ ID NO: 297037 - DNA, 25 bp, Mus musculus
caagagcaaggcacattcggcacat

SEQ ID NO: 297038 - DNA, 25 bp, Mus musculus
caagagcaaggctcattcggcacat

SEQ ID NO: 297039 - DNA, 25 bp, Mus musculus
caagagcatcggattgctttgctgt

SEQ ID NO: 297040 - DNA, 25 bp, Mus musculus
caagagcatcggtttgctttgctgt

SEQ ID NO: 297041 - DNA, 25 bp, Mus musculus
caagagcatcttacctgggcgatat

SEQ ID NO: 297042 - DNA, 25 bp, Mus musculus
caagagcatctttcctgggcgatat

SEQ ID NO: 297043 - DNA, 25 bp, Mus musculus
caagagcatgcaattagtaactata

SEQ ID NO: 297044 - DNA, 25 bp, Mus musculus
caagagcatgcatttagtaactata

SEQ ID NO: 297045 - DNA, 25 bp, Mus musculus
caagagcatgtgcagtatgggatca

SEQ ID NO: 297046 - DNA, 25 bp, Mus musculus
caagagcatgtggagtatgggatca

SEQ ID NO: 297047 - DNA, 25 bp, Mus musculus
caagagccagcaacctagaggagga

SEQ ID NO: 297048 - DNA, 25 bp, Mus musculus
caagagccagcatcctagaggagga

SEQ ID NO: 297049 - DNA, 25 bp, Mus musculus
caagagcccaggatctgtgggttca

SEQ ID NO: 297050 - DNA, 25 bp, Mus musculus
caagagcccaggttctgtgggttca

SEQ ID NO: 297051 - DNA, 25 bp, Mus musculus
caagagccgttgaaatagtttaatg

SEQ ID NO: 297052 - DNA, 25 bp, Mus musculus
caagagccgttgtaatagtttaatg

SEQ ID NO: 297053 - DNA, 25 bp, Mus musculus
caagagcctagtcaacctggctaga

SEQ ID NO: 297054 - DNA, 25 bp, Mus musculus
caagagcctagtgaacctggctaga

SEQ ID NO: 297055 - DNA, 25 bp, Mus musculus
caagagcctggcaataatgactgag

SEQ ID NO: 297056 - DNA, 25 bp, Mus musculus
caagagcctggctataatgactgag

SEQ ID NO: 297057 - DNA, 25 bp, Mus musculus
caagagcctttacccgcagagccat

SEQ ID NO: 297058 - DNA, 25 bp, Mus musculus
caagagcctttagccgcagagccat

SEQ ID NO: 297059 - DNA, 25 bp, Mus musculus
caagagcgccaaaggcgggaccttt

SEQ ID NO: 297060 - DNA, 25 bp, Mus musculus
caagagcgccaatggcgggaccttt

SEQ ID NO: 297061 - DNA, 25 bp, Mus musculus
caagagcggaggcagatggttacta

SEQ ID NO: 297062 - DNA, 25 bp, Mus musculus
caagagcggagggagatggttacta

SEQ ID NO: 297063 - DNA, 25 bp, Mus musculus
caagagcggtaactttaaagcacac

SEQ ID NO: 297064 - DNA, 25 bp, Mus musculus
caagagcggtaagtttaaagcacac

SEQ ID NO: 297065 - DNA, 25 bp, Mus musculus
caagagcgtgccaaggagacagaga

SEQ ID NO: 297066 - DNA, 25 bp, Mus musculus
caagagcgtgcctaggagacagaga

SEQ ID NO: 297067 - DNA, 25 bp, Mus musculus
caagagcgtgcgactggtccagctg

SEQ ID NO: 297068 - DNA, 25 bp, Mus musculus
caagagcgtgcgtctggtccagctg

SEQ ID NO: 297069 - DNA, 25 bp, Mus musculus
caagagcgtggtagctagcgaaagc

SEQ ID NO: 297070 - DNA, 25 bp, Mus musculus
caagagcgtggttgctagcgaaagc

SEQ ID NO: 297071 - DNA, 25 bp, Mus musculus
caagagctacagaaggatcaccagt

SEQ ID NO: 297072 - DNA, 25 bp, Mus musculus
caagagctacagtaggatcaccagt

SEQ ID NO: 297073 - DNA, 25 bp, Mus musculus
caagagctactcaaagtgttgcata

SEQ ID NO: 297074 - DNA, 25 bp, Mus musculus
caagagctactctaagtgttgcata

SEQ ID NO: 297075 - DNA, 25 bp, Mus musculus
caagagctagctatagttgttggat

SEQ ID NO: 297076 - DNA, 25 bp, Mus musculus
caagagctagctttagttgttggat

SEQ ID NO: 297077 - DNA, 25 bp, Mus musculus
caagagctgggtcccttgtgtgccc

SEQ ID NO: 297078 - DNA, 25 bp, Mus musculus
caagagctgggtgccttgtgtgccc

SEQ ID NO: 297079 - DNA, 25 bp, Mus musculus
caagagctgttaccacatttgtgct

SEQ ID NO: 297080 - DNA, 25 bp, Mus musculus
caagagctgttagcacatttgtgct

SEQ ID NO: 297081 - DNA, 25 bp, Mus musculus
caagagcttattcgagggtctcagt

SEQ ID NO: 297082 - DNA, 25 bp, Mus musculus
caagagcttattggagggtctcagt

SEQ ID NO: 297083 - DNA, 25 bp, Mus musculus
caagagcttctcattgatgtccatc

SEQ ID NO: 297084 - DNA, 25 bp, Mus musculus
caagagcttctctttgatgtccatc

SEQ ID NO: 297085 - DNA, 25 bp, Mus musculus
caagagcttgctcaaaagggacatt

SEQ ID NO: 297086 - DNA, 25 bp, Mus musculus
caagagcttgctgaaaagggacatt

SEQ ID NO: 297087 - DNA, 25 bp, Mus musculus
caagagcttggaaatttgtcaccct

SEQ ID NO: 297088 - DNA, 25 bp, Mus musculus
caagagcttggatatttgtcaccct

SEQ ID NO: 297089 - DNA, 25 bp, Mus musculus
caagagcttgttagtgagggacaca

SEQ ID NO: 297090 - DNA, 25 bp, Mus musculus
caagagcttgtttgtgagggacaca

SEQ ID NO: 297091 - DNA, 25 bp, Mus musculus
caagaggaacacagtcaggactagg

SEQ ID NO: 297092 - DNA, 25 bp, Mus musculus
caagaggaacactgtcaggactagg

SEQ ID NO: 297093 - DNA, 25 bp, Mus musculus
caagaggacatgaactgccaggtta

SEQ ID NO: 297094 - DNA, 25 bp, Mus musculus
caagaggacatgtactgccaggtta

SEQ ID NO: 297095 - DNA, 25 bp, Mus musculus
caagaggaccggcttctccaccagt

SEQ ID NO: 297096 - DNA, 25 bp, Mus musculus
caagaggaccgggttctccaccagt

SEQ ID NO: 297097 - DNA, 25 bp, Mus musculus
caagaggaccttcgtgccactggct

SEQ ID NO: 297098 - DNA, 25 bp, Mus musculus
caagaggaccttggtgccactggct

SEQ ID NO: 297099 - DNA, 25 bp, Mus musculus
caagaggagcccctcggtgacactt

SEQ ID NO: 297100 - DNA, 25 bp, Mus musculus
caagaggagcccgtcggtgacactt

SEQ ID NO: 297101 - DNA, 25 bp, Mus musculus
caagaggaggatcaactcccaaggt

SEQ ID NO: 297102 - DNA, 25 bp, Mus musculus
caagaggaggatgaactcccaaggt

SEQ ID NO: 297103 - DNA, 25 bp, Mus musculus
caagaggaggccagtcagtgtcagt

SEQ ID NO: 297104 - DNA, 25 bp, Mus musculus
caagaggaggcctgtcagtgtcagt

SEQ ID NO: 297105 - DNA, 25 bp, Mus musculus
caagaggatgagacgctctaacggg

SEQ ID NO: 297106 - DNA, 25 bp, Mus musculus
caagaggatgagtcgctctaacggg

SEQ ID NO: 297107 - DNA, 25 bp, Mus musculus
caagaggattgcactggagtgtgca

SEQ ID NO: 297108 - DNA, 25 bp, Mus musculus
caagaggattgctctggagtgtgca

SEQ ID NO: 297109 - DNA, 25 bp, Mus musculus
caagaggcactcaggtgtgggctcc

SEQ ID NO: 297110 - DNA, 25 bp, Mus musculus
caagaggcactctggtgtgggctcc

SEQ ID NO: 297111 - DNA, 25 bp, Mus musculus
caagaggcagcaagtgccctggtga

SEQ ID NO: 297112 - DNA, 25 bp, Mus musculus
caagaggcagcatgtgccctggtga

SEQ ID NO: 297113 - DNA, 25 bp, Mus musculus
caagaggcagctcttcgggagatta

SEQ ID NO: 297114 - DNA, 25 bp, Mus musculus
caagaggcagctgttcgggagatta

SEQ ID NO: 297115 - DNA, 25 bp, Mus musculus
caagaggcagggaatcccagcactt

SEQ ID NO: 297116 - DNA, 25 bp, Mus musculus
caagaggcagggtatcccagcactt

SEQ ID NO: 297117 - DNA, 25 bp, Mus musculus
caagaggcatccatccaggtagggc

SEQ ID NO: 297118 - DNA, 25 bp, Mus musculus
caagaggcatccttccaggtagggc

SEQ ID NO: 297119 - DNA, 25 bp, Mus musculus
caagaggctcgacttggagtgctca

SEQ ID NO: 297120 - DNA, 25 bp, Mus musculus
caagaggctcgagttggagtgctca

SEQ ID NO: 297121 - DNA, 25 bp, Mus musculus
caagaggctcttaagggaccatgct

SEQ ID NO: 297122 - DNA, 25 bp, Mus musculus
caagaggctcttcctgtctggagag

SEQ ID NO: 297123 - DNA, 25 bp, Mus musculus
caagaggctcttgctgtctggagag

SEQ ID NO: 297124 - DNA, 25 bp, Mus musculus
caagaggctctttagggaccatgct

SEQ ID NO: 297125 - DNA, 25 bp, Mus musculus
caagagggacacctccagttggctt

SEQ ID NO: 297126 - DNA, 25 bp, Mus musculus
caagagggacacgtccagttggctt

SEQ ID NO: 297127 - DNA, 25 bp, Mus musculus
caagagggcctcatgggcattggac

SEQ ID NO: 297128 - DNA, 25 bp, Mus musculus
caagagggcctcttgggcattggac

SEQ ID NO: 297129 - DNA, 25 bp, Mus musculus
caagagggccttcacagtcctggaa

SEQ ID NO: 297130 - DNA, 25 bp, Mus musculus
caagagggccttgacagtcctggaa

SEQ ID NO: 297131 - DNA, 25 bp, Mus musculus
caagagggctttagtacactggtat

SEQ ID NO: 297132 - DNA, 25 bp, Mus musculus
caagagggcttttgtacactggtat

SEQ ID NO: 297133 - DNA, 25 bp, Mus musculus
caagagggtcccaaaatgccgacag

SEQ ID NO: 297134 - DNA, 25 bp, Mus musculus
caagagggtccctaaatgccgacag

SEQ ID NO: 297135 - DNA, 25 bp, Mus musculus
caagagggtcttccatgcaactgaa

SEQ ID NO: 297136 - DNA, 25 bp, Mus musculus
caagagggtcttgcatgcaactgaa

SEQ ID NO: 297137 - DNA, 25 bp, Mus musculus
caagaggtaggtactcccagagacc

SEQ ID NO: 297138 - DNA, 25 bp, Mus musculus
caagaggtaggttctcccagagacc

SEQ ID NO: 297139 - DNA, 25 bp, Mus musculus
caagaggtccccacgataggcgaga

SEQ ID NO: 297140 - DNA, 25 bp, Mus musculus
caagaggtcccctcgataggcgaga

SEQ ID NO: 297141 - DNA, 25 bp, Mus musculus
caagaggtcctaactgggttgctat

SEQ ID NO: 297142 - DNA, 25 bp, Mus musculus
caagaggtcctatctgggttgctat

SEQ ID NO: 297143 - DNA, 25 bp, Mus musculus
caagaggtctctatcccacttttga

SEQ ID NO: 297144 - DNA, 25 bp, Mus musculus
caagaggtctctcagtcggagtcca

SEQ ID NO: 297145 - DNA, 25 bp, Mus musculus
caagaggtctctgagtcggagtcca

SEQ ID NO: 297146 - DNA, 25 bp, Mus musculus
caagaggtctctttcccacttttga

SEQ ID NO: 297147 - DNA, 25 bp, Mus musculus
caagaggtgctccacagttgtcagt

SEQ ID NO: 297148 - DNA, 25 bp, Mus musculus
caagaggtgctcgacagttgtcagt

SEQ ID NO: 297149 - DNA, 25 bp, Mus musculus
caagaggtggcacttcccgctcaga

SEQ ID NO: 297150 - DNA, 25 bp, Mus musculus
caagaggtggcagttcccgctcaga

SEQ ID NO: 297151 - DNA, 25 bp, Mus musculus
caagaggtggccagttcaggtgcta

SEQ ID NO: 297152 - DNA, 25 bp, Mus musculus
caagaggtggcctgttcaggtgcta

SEQ ID NO: 297153 - DNA, 25 bp, Mus musculus
caagaggtgggaaccccaaacccag

SEQ ID NO: 297154 - DNA, 25 bp, Mus musculus
caagaggtgggatccccaaacccag

SEQ ID NO: 297155 - DNA, 25 bp, Mus musculus
caagagtaaagacaggagacagcta

SEQ ID NO: 297156 - DNA, 25 bp, Mus musculus
caagagtaaagagaggagacagcta

SEQ ID NO: 297157 - DNA, 25 bp, Mus musculus
caagagtactcactgtttcatgatt

SEQ ID NO: 297158 - DNA, 25 bp, Mus musculus
caagagtactcagtgtttcatgatt

SEQ ID NO: 297159 - DNA, 25 bp, Mus musculus
caagagtcaatcactgcgcagcttt

SEQ ID NO: 297160 - DNA, 25 bp, Mus musculus
caagagtcaatctctgcgcagcttt

SEQ ID NO: 297161 - DNA, 25 bp, Mus musculus
caagagtgactactgcaacctgcca

SEQ ID NO: 297162 - DNA, 25 bp, Mus musculus
caagagtgactagtgcaacctgcca

SEQ ID NO: 297163 - DNA, 25 bp, Mus musculus
caagagtgacttcctgtgggaacag

SEQ ID NO: 297164 - DNA, 25 bp, Mus musculus
caagagtgacttgctgtgggaacag

SEQ ID NO: 297165 - DNA, 25 bp, Mus musculus
caagagtgagacatgtgctgaggca

SEQ ID NO: 297166 - DNA, 25 bp, Mus musculus
caagagtgagacttgtgctgaggca

SEQ ID NO: 297167 - DNA, 25 bp, Mus musculus
caagagtgagtaaagcagctgtgtc

SEQ ID NO: 297168 - DNA, 25 bp, Mus musculus
caagagtgagtatagcagctgtgtc

SEQ ID NO: 297169 - DNA, 25 bp, Mus musculus
caagagtgatgtatgctactttgcc

SEQ ID NO: 297170 - DNA, 25 bp, Mus musculus
caagagtgatgtttgctactttgcc

SEQ ID NO: 297171 - DNA, 25 bp, Mus musculus
caagagtgcctgctgcatccggtga

SEQ ID NO: 297172 - DNA, 25 bp, Mus musculus
caagagtgcctggtgcatccggtga

SEQ ID NO: 297173 - DNA, 25 bp, Mus musculus
caagagtgggaaccctggccgaact

SEQ ID NO: 297174 - DNA, 25 bp, Mus musculus
caagagtgggaagcctggccgaact

SEQ ID NO: 297175 - DNA, 25 bp, Mus musculus
caagagtgggatatcttccgttggg

SEQ ID NO: 297176 - DNA, 25 bp, Mus musculus
caagagtgggatttcttccgttggg

SEQ ID NO: 297177 - DNA, 25 bp, Mus musculus
caagagtgtctgagaggctgacttt

SEQ ID NO: 297178 - DNA, 25 bp, Mus musculus
caagagtgtctgtgaggctgacttt

SEQ ID NO: 297179 - DNA, 25 bp, Mus musculus
caagagttatgcatggtgttcccat

SEQ ID NO: 297180 - DNA, 25 bp, Mus musculus
caagagttatgcttggtgttcccat

SEQ ID NO: 297181 - DNA, 25 bp, Mus musculus
caagagttcacacgagcccataggg

SEQ ID NO: 297182 - DNA, 25 bp, Mus musculus
caagagttcacaggagcccataggg

SEQ ID NO: 297183 - DNA, 25 bp, Mus musculus
caagagttcagcattgtggtgaatc

SEQ ID NO: 297184 - DNA, 25 bp, Mus musculus
caagagttcagctttgtggtgaatc

SEQ ID NO: 297185 - DNA, 25 bp, Mus musculus
caagagttcccgctgcgccctgtgg

SEQ ID NO: 297186 - DNA, 25 bp, Mus musculus
caagagttcccggtgcgccctgtgg

SEQ ID NO: 297187 - DNA, 25 bp, Mus musculus
caagagttctttccccacagatgag

SEQ ID NO: 297188 - DNA, 25 bp, Mus musculus
caagagttctttgcccacagatgag

SEQ ID NO: 297189 - DNA, 25 bp, Mus musculus
caagataaacttcggccctggcctg

SEQ ID NO: 297190 - DNA, 25 bp, Mus musculus
caagataaacttgggccctggcctg

SEQ ID NO: 297191 - DNA, 25 bp, Mus musculus
caagataaatccctggcatccatta

SEQ ID NO: 297192 - DNA, 25 bp, Mus musculus
caagataaatccgtggcatccatta

SEQ ID NO: 297193 - DNA, 25 bp, Mus musculus
caagataacttcagggatacacatg

SEQ ID NO: 297194 - DNA, 25 bp, Mus musculus
caagataacttctgggatacacatg

SEQ ID NO: 297195 - DNA, 25 bp, Mus musculus
caagataccacacttttatttttat

SEQ ID NO: 297196 - DNA, 25 bp, Mus musculus
caagataccacagttttatttttat

SEQ ID NO: 297197 - DNA, 25 bp, Mus musculus
caagataccgtaaataaactgcacc

SEQ ID NO: 297198 - DNA, 25 bp, Mus musculus
caagataccgtatataaactgcacc

SEQ ID NO: 297199 - DNA, 25 bp, Mus musculus
caagatagccagctggttggttcca

SEQ ID NO: 297200 - DNA, 25 bp, Mus musculus
caagatagccaggtggttggttcca

SEQ ID NO: 297201 - DNA, 25 bp, Mus musculus
caagatagccggctatgtcacgcat

SEQ ID NO: 297202 - DNA, 25 bp, Mus musculus
caagatagccgggtatgtcacgcat

SEQ ID NO: 297203 - DNA, 25 bp, Mus musculus
caagatattcttcaagactttaaat

SEQ ID NO: 297204 - DNA, 25 bp, Mus musculus
caagatattcttgaagactttaaat

SEQ ID NO: 297205 - DNA, 25 bp, Mus musculus
caagatattggtaagtgctactgta

SEQ ID NO: 297206 - DNA, 25 bp, Mus musculus
caagatattggttagtgctactgta

SEQ ID NO: 297207 - DNA, 25 bp, Mus musculus
caagatatttgtccacctcctgcct

SEQ ID NO: 297208 - DNA, 25 bp, Mus musculus
caagatatttgtgcacctcctgcct

SEQ ID NO: 297209 - DNA, 25 bp, Mus musculus
caagatattttgcaggagcgaggat

SEQ ID NO: 297210 - DNA, 25 bp, Mus musculus
caagatattttggaggagcgaggat

SEQ ID NO: 297211 - DNA, 25 bp, Mus musculus
caagatcaacctctggtccacctgg

SEQ ID NO: 297212 - DNA, 25 bp, Mus musculus
caagatcaacctgtggtccacctgg

SEQ ID NO: 297213 - DNA, 25 bp, Mus musculus
caagatcaaggcctttctgtcctcc

SEQ ID NO: 297214 - DNA, 25 bp, Mus musculus
caagatcaaggcgtttctgtcctcc

SEQ ID NO: 297215 - DNA, 25 bp, Mus musculus
caagatcaagtaagccttcccaggc

SEQ ID NO: 297216 - DNA, 25 bp, Mus musculus
caagatcaagtatgccttcccaggc

SEQ ID NO: 297217 - DNA, 25 bp, Mus musculus
caagatcaagtgcttggtccacaca

SEQ ID NO: 297218 - DNA, 25 bp, Mus musculus
caagatcaagtggttggtccacaca

SEQ ID NO: 297219 - DNA, 25 bp, Mus musculus
caagatcacagcatcctcagacaga

SEQ ID NO: 297220 - DNA, 25 bp, Mus musculus
caagatcacagcttcctcagacaga

SEQ ID NO: 297221 - DNA, 25 bp, Mus musculus
caagatcacgtgcttgtgccaggtt

SEQ ID NO: 297222 - DNA, 25 bp, Mus musculus
caagatcacgtggttgtgccaggtt

SEQ ID NO: 297223 - DNA, 25 bp, Mus musculus
caagatcactggctgtgtgtctcag

SEQ ID NO: 297224 - DNA, 25 bp, Mus musculus
caagatcactgggtgtgtgtctcag

SEQ ID NO: 297225 - DNA, 25 bp, Mus musculus
caagatccaattatacctgttcttc

SEQ ID NO: 297226 - DNA, 25 bp, Mus musculus
caagatccaattttacctgttcttc

SEQ ID NO: 297227 - DNA, 25 bp, Mus musculus
caagatccacaaaaaccagttcctg

SEQ ID NO: 297228 - DNA, 25 bp, Mus musculus
caagatccacaataaccagttcctg

SEQ ID NO: 297229 - DNA, 25 bp, Mus musculus
caagatccaggaaaaagagggcatc

SEQ ID NO: 297230 - DNA, 25 bp, Mus musculus
caagatccaggataaagagggcatc

SEQ ID NO: 297231 - DNA, 25 bp, Mus musculus
caagatccaggcattcatcaagaga

SEQ ID NO: 297232 - DNA, 25 bp, Mus musculus
caagatccaggctttcatcaagaga

SEQ ID NO: 297233 - DNA, 25 bp, Mus musculus
caagatccccttaagtcacttgagg

SEQ ID NO: 297234 - DNA, 25 bp, Mus musculus
caagatcccctttagtcacttgagg

SEQ ID NO: 297235 - DNA, 25 bp, Mus musculus
caagatccgggaagtgcttcgtagg

SEQ ID NO: 297236 - DNA, 25 bp, Mus musculus
caagatccgggatgtgcttcgtagg

SEQ ID NO: 297237 - DNA, 25 bp, Mus musculus
caagatcctgctatgacatcccata

SEQ ID NO: 297238 - DNA, 25 bp, Mus musculus
caagatcctgctttgacatcccata

SEQ ID NO: 297239 - DNA, 25 bp, Mus musculus
caagatcctggaatccatttccagc

SEQ ID NO: 297240 - DNA, 25 bp, Mus musculus
caagatcctggattccatttccagc

SEQ ID NO: 297241 - DNA, 25 bp, Mus musculus
caagatccttccagatcgccaaagg

SEQ ID NO: 297242 - DNA, 25 bp, Mus musculus
caagatccttcctgatcgccaaagg

SEQ ID NO: 297243 - DNA, 25 bp, Mus musculus
caagatcgaggccttggttagcaac

SEQ ID NO: 297244 - DNA, 25 bp, Mus musculus
caagatcgaggcgttggttagcaac

SEQ ID NO: 297245 - DNA, 25 bp, Mus musculus
caagatcggtaaccaggtcttcagg

SEQ ID NO: 297246 - DNA, 25 bp, Mus musculus
caagatcggtaagcaggtcttcagg

SEQ ID NO: 297247 - DNA, 25 bp, Mus musculus
caagatctacctcgccatcgaaagt

SEQ ID NO: 297248 - DNA, 25 bp, Mus musculus
caagatctacctggccatcgaaagt

SEQ ID NO: 297249 - DNA, 25 bp, Mus musculus
caagatctagttcggtttgtttctt

SEQ ID NO: 297250 - DNA, 25 bp, Mus musculus
caagatctagttgggtttgtttctt

SEQ ID NO: 297251 - DNA, 25 bp, Mus musculus
caagatctattcctgaggacaggaa

SEQ ID NO: 297252 - DNA, 25 bp, Mus musculus
caagatctattcgtgaggacaggaa

SEQ ID NO: 297253 - DNA, 25 bp, Mus musculus
caagatctatttcctggtttcccag

SEQ ID NO: 297254 - DNA, 25 bp, Mus musculus
caagatctatttgctggtttcccag

SEQ ID NO: 297255 - DNA, 25 bp, Mus musculus
caagatctccgacgctgccgggaag

SEQ ID NO: 297256 - DNA, 25 bp, Mus musculus
caagatctccgaggctgccgggaag

SEQ ID NO: 297257 - DNA, 25 bp, Mus musculus
caagatctgcctcggcaactgagtt

SEQ ID NO: 297258 - DNA, 25 bp, Mus musculus
caagatctgcctgggcaactgagtt

SEQ ID NO: 297259 - DNA, 25 bp, Mus musculus
caagatcttgacacagggtttaact

SEQ ID NO: 297260 - DNA, 25 bp, Mus musculus
caagatcttgactcagggtttaact

SEQ ID NO: 297261 - DNA, 25 bp, Mus musculus
caagatcttggtacttatgggtcag

SEQ ID NO: 297262 - DNA, 25 bp, Mus musculus
caagatcttggttcttatgggtcag

SEQ ID NO: 297263 - DNA, 25 bp, Mus musculus
caagatcttgtactccagtgttcag

SEQ ID NO: 297264 - DNA, 25 bp, Mus musculus
caagatcttgtagtccagtgttcag

SEQ ID NO: 297265 - DNA, 25 bp, Mus musculus
caagatctttggattcgtggccaag

SEQ ID NO: 297266 - DNA, 25 bp, Mus musculus
caagatctttggtttcgtggccaag

SEQ ID NO: 297267 - DNA, 25 bp, Mus musculus
caagatctttgtacagggcatcatg

SEQ ID NO: 297268 - DNA, 25 bp, Mus musculus
caagatctttgttcagggcatcatg

SEQ ID NO: 297269 - DNA, 25 bp, Mus musculus
caagatgaaaatctttaaccctaag

SEQ ID NO: 297270 - DNA, 25 bp, Mus musculus
caagatgaaaatgtttaaccctaag

SEQ ID NO: 297271 - DNA, 25 bp, Mus musculus
caagatgaacaaagatgcgcagatg

SEQ ID NO: 297272 - DNA, 25 bp, Mus musculus
caagatgaacaatgatgcgcagatg

SEQ ID NO: 297273 - DNA, 25 bp, Mus musculus
caagatgaacttatccacgctgagg

SEQ ID NO: 297274 - DNA, 25 bp, Mus musculus
caagatgaacttttccacgctgagg

SEQ ID NO: 297275 - DNA, 25 bp, Mus musculus
caagatgaagaaccccatcaccagg

SEQ ID NO: 297276 - DNA, 25 bp, Mus musculus
caagatgaagaagcccatcaccagg

SEQ ID NO: 297277 - DNA, 25 bp, Mus musculus
caagatgaagtgaccggccagctca

SEQ ID NO: 297278 - DNA, 25 bp, Mus musculus
caagatgaagtgtccggccagctca

SEQ ID NO: 297279 - DNA, 25 bp, Mus musculus
caagatgacctgaaactatttttaa

SEQ ID NO: 297280 - DNA, 25 bp, Mus musculus
caagatgacctgtaactatttttaa

SEQ ID NO: 297281 - DNA, 25 bp, Mus musculus
caagatgactctcacttctgggatc

SEQ ID NO: 297282 - DNA, 25 bp, Mus musculus
caagatgactctgacttctgggatc

SEQ ID NO: 297283 - DNA, 25 bp, Mus musculus
caagatgatattacttagttctgaa

SEQ ID NO: 297284 - DNA, 25 bp, Mus musculus
caagatgatatttcttagttctgaa

SEQ ID NO: 297285 - DNA, 25 bp, Mus musculus
caagatgatcaaaaggtaaaggcca

SEQ ID NO: 297286 - DNA, 25 bp, Mus musculus
caagatgatcaataggtaaaggcca

SEQ ID NO: 297287 - DNA, 25 bp, Mus musculus
caagatgatggtcgcctaccatggg

SEQ ID NO: 297288 - DNA, 25 bp, Mus musculus
caagatgatggtggcctaccatggg

SEQ ID NO: 297289 - DNA, 25 bp, Mus musculus
caagatgatgtgaggcgcgccatct

SEQ ID NO: 297290 - DNA, 25 bp, Mus musculus
caagatgatgtgtggcgcgccatct

SEQ ID NO: 297291 - DNA, 25 bp, Mus musculus
caagatgcactgctgggaaccgtat

SEQ ID NO: 297292 - DNA, 25 bp, Mus musculus
caagatgcactggtgggaaccgtat

SEQ ID NO: 297293 - DNA, 25 bp, Mus musculus
caagatgcagcacccataagaaggg

SEQ ID NO: 297294 - DNA, 25 bp, Mus musculus
caagatgcagcagccataagaaggg

SEQ ID NO: 297295 - DNA, 25 bp, Mus musculus
caagatgccttcactgattaaggca

SEQ ID NO: 297296 - DNA, 25 bp, Mus musculus
caagatgccttctctgattaaggca

SEQ ID NO: 297297 - DNA, 25 bp, Mus musculus
caagatgcgcaaccgcttgatgcgg

SEQ ID NO: 297298 - DNA, 25 bp, Mus musculus
caagatgcgcaacctggagacgcag

SEQ ID NO: 297299 - DNA, 25 bp, Mus musculus
caagatgcgcaagcgcttgatgcgg

SEQ ID NO: 297300 - DNA, 25 bp, Mus musculus
caagatgcgcaagctggagacgcag

SEQ ID NO: 297301 - DNA, 16 bp, Mus musculus
caagatgctaccgttc

SEQ ID NO: 297302 - DNA, 25 bp, Mus musculus
caagatgctcagctttgtggatgac

SEQ ID NO: 297303 - DNA, 25 bp, Mus musculus
caagatgctcaggtttgtggatgac

SEQ ID NO: 297304 - DNA, 25 bp, Mus musculus
caagatgctgcccaggataatcctc

SEQ ID NO: 297305 - DNA, 25 bp, Mus musculus
caagatgctgccgaggataatcctc

SEQ ID NO: 297306 - DNA, 25 bp, Mus musculus
caagatgctgctcgttttctggtgc

SEQ ID NO: 297307 - DNA, 25 bp, Mus musculus
caagatgctgctggttttctggtgc

SEQ ID NO: 297308 - DNA, 25 bp, Mus musculus
caagatggaaagatgccttttgtgc

SEQ ID NO: 297309 - DNA, 25 bp, Mus musculus
caagatggaaagttgccttttgtgc

SEQ ID NO: 297310 - DNA, 25 bp, Mus musculus
caagatggacatccagggtgacccc

SEQ ID NO: 297311 - DNA, 25 bp, Mus musculus
caagatggacatgcagggtgacccc

SEQ ID NO: 297312 - DNA, 25 bp, Mus musculus
caagatggaggtcaacggccagttc

SEQ ID NO: 297313 - DNA, 25 bp, Mus musculus
caagatggaggtgaacggccagttc

SEQ ID NO: 297314 - DNA, 25 bp, Mus musculus
caagatggagtaccccttagcagtg

SEQ ID NO: 297315 - DNA, 25 bp, Mus musculus
caagatggagtagcccttagcagtg

SEQ ID NO: 297316 - DNA, 25 bp, Mus musculus
caagatggcttgagggaagccgccc

SEQ ID NO: 297317 - DNA, 25 bp, Mus musculus
caagatggcttgtgggaagccgccc

SEQ ID NO: 297318 - DNA, 25 bp, Mus musculus
caagatgggcaaccgcttacagata

SEQ ID NO: 297319 - DNA, 25 bp, Mus musculus
caagatgggcaagcgcttacagata

SEQ ID NO: 297320 - DNA, 25 bp, Mus musculus
caagatgggcacagaccggcagcat

SEQ ID NO: 297321 - DNA, 25 bp, Mus musculus
caagatgggcactgaccggcagcat

SEQ ID NO: 297322 - DNA, 25 bp, Mus musculus
caagatgggcgacgtcttcacggac

SEQ ID NO: 297323 - DNA, 25 bp, Mus musculus
caagatgggcgaggtcttcacggac

SEQ ID NO: 297324 - DNA, 25 bp, Mus musculus
caagatggtcagagaattcctgata

SEQ ID NO: 297325 - DNA, 25 bp, Mus musculus
caagatggtcagtgaattcctgata

SEQ ID NO: 297326 - DNA, 25 bp, Mus musculus
caagatggtgctccagccacaggct

SEQ ID NO: 297327 - DNA, 25 bp, Mus musculus
caagatggtgctgcagccacaggct

SEQ ID NO: 297328 - DNA, 25 bp, Mus musculus
caagatggttcgctactctcttgac

SEQ ID NO: 297329 - DNA, 25 bp, Mus musculus
caagatggttcggtactctcttgac

SEQ ID NO: 297330 - DNA, 25 bp, Mus musculus
caagatgtagatccccaactcagtc

SEQ ID NO: 297331 - DNA, 25 bp, Mus musculus
caagatgtagatgcccaactcagtc

SEQ ID NO: 297332 - DNA, 25 bp, Mus musculus
caagatgtaggtaactgccagctta

SEQ ID NO: 297333 - DNA, 25 bp, Mus musculus
caagatgtaggttactgccagctta

SEQ ID NO: 297334 - DNA, 25 bp, Mus musculus
caagatgtctgaaggacggaaaacc

SEQ ID NO: 297335 - DNA, 25 bp, Mus musculus
caagatgtctgatggacggaaaacc

SEQ ID NO: 297336 - DNA, 25 bp, Mus musculus
caagatgtgccaagccacatgcggg

SEQ ID NO: 297337 - DNA, 25 bp, Mus musculus
caagatgtgccatgccacatgcggg

SEQ ID NO: 297338 - DNA, 25 bp, Mus musculus
caagatgtggaacaggactgccagt

SEQ ID NO: 297339 - DNA, 25 bp, Mus musculus
caagatgtggaagaggactgccagt

SEQ ID NO: 297340 - DNA, 25 bp, Mus musculus
caagatgtggttacttttccctcgg

SEQ ID NO: 297341 - DNA, 25 bp, Mus musculus
caagatgtggtttcttttccctcgg

SEQ ID NO: 297342 - DNA, 25 bp, Mus musculus
caagatgtgtacctgctacccaaga

SEQ ID NO: 297343 - DNA, 25 bp, Mus musculus
caagatgtgtacgtgctacccaaga

SEQ ID NO: 297344 - DNA, 25 bp, Mus musculus
caagatgttatcagatcccatgagc

SEQ ID NO: 297345 - DNA, 25 bp, Mus musculus
caagatgttatctgatcccatgagc

SEQ ID NO: 297346 - DNA, 25 bp, Mus musculus
caagatgttcgtactggatgaagca

SEQ ID NO: 297347 - DNA, 25 bp, Mus musculus
caagatgttcgttctggatgaagca

SEQ ID NO: 297348 - DNA, 25 bp, Mus musculus
caagattatggaaaccggactgctc

SEQ ID NO: 297349 - DNA, 25 bp, Mus musculus
caagattatggataccggactgctc

SEQ ID NO: 297350 - DNA, 25 bp, Mus musculus
caagattatggtacagtttccccgt

SEQ ID NO: 297351 - DNA, 25 bp, Mus musculus
caagattatggtagctgccctgggc

SEQ ID NO: 297352 - DNA, 25 bp, Mus musculus
caagattatggttcagtttccccgt

SEQ ID NO: 297353 - DNA, 25 bp, Mus musculus
caagattatggttgctgccctgggc

SEQ ID NO: 297354 - DNA, 25 bp, Mus musculus
caagattcacttcgagccctggcct

SEQ ID NO: 297355 - DNA, 25 bp, Mus musculus
caagattcacttggagccctggcct

SEQ ID NO: 297356 - DNA, 25 bp, Mus musculus
caagattcagaaatatgagtgcatc

SEQ ID NO: 297357 - DNA, 25 bp, Mus musculus
caagattcagaattatgagtgcatc

SEQ ID NO: 297358 - DNA, 25 bp, Mus musculus
caagattcagccctgagttcccaga

SEQ ID NO: 297359 - DNA, 25 bp, Mus musculus
caagattcagccgtgagttcccaga

SEQ ID NO: 297360 - DNA, 25 bp, Mus musculus
caagattccccacttggtacacttt

SEQ ID NO: 297361 - DNA, 25 bp, Mus musculus
caagattccccagttggtacacttt

SEQ ID NO: 297362 - DNA, 25 bp, Mus musculus
caagattcctcccttggatctttga

SEQ ID NO: 297363 - DNA, 25 bp, Mus musculus
caagattcctccgttggatctttga

SEQ ID NO: 297364 - DNA, 25 bp, Mus musculus
caagattcctgtcgagcactgtaga

SEQ ID NO: 297365 - DNA, 25 bp, Mus musculus
caagattcctgtggagcactgtaga

SEQ ID NO: 297366 - DNA, 25 bp, Mus musculus
caagattcgctgaaacaaccacaca

SEQ ID NO: 297367 - DNA, 25 bp, Mus musculus
caagattcgctgtaacaaccacaca

SEQ ID NO: 297368 - DNA, 25 bp, Mus musculus
caagattctgggatgctgtctagcc

SEQ ID NO: 297369 - DNA, 25 bp, Mus musculus
caagattctgggttgctgtctagcc

SEQ ID NO: 297370 - DNA, 25 bp, Mus musculus
caagattctgtccttgaaccaggaa

SEQ ID NO: 297371 - DNA, 25 bp, Mus musculus
caagattctgtcgttgaaccaggaa

SEQ ID NO: 297372 - DNA, 25 bp, Mus musculus
caagattcttatatcgctcagatta

SEQ ID NO: 297373 - DNA, 25 bp, Mus musculus
caagattcttatttcgctcagatta

SEQ ID NO: 297374 - DNA, 25 bp, Mus musculus
caagattgaaagaagctgcacacga

SEQ ID NO: 297375 - DNA, 25 bp, Mus musculus
caagattgaaagtagctgcacacga

SEQ ID NO: 297376 - DNA, 25 bp, Mus musculus
caagattgcactatggacactcctg

SEQ ID NO: 297377 - DNA, 25 bp, Mus musculus
caagattgcactttggacactcctg

SEQ ID NO: 297378 - DNA, 25 bp, Mus musculus
caagattgcattatcaacacatagg

SEQ ID NO: 297379 - DNA, 25 bp, Mus musculus
caagattgcattttcaacacatagg

SEQ ID NO: 297380 - DNA, 25 bp, Mus musculus
caagatttcagaatgtctcactcaa

SEQ ID NO: 297381 - DNA, 25 bp, Mus musculus
caagatttcagattgtctcactcaa

SEQ ID NO: 297382 - DNA, 25 bp, Mus musculus
caagatttcatgatcgtaaatgcca

SEQ ID NO: 297383 - DNA, 25 bp, Mus musculus
caagatttcatgttcgtaaatgcca

SEQ ID NO: 297384 - DNA, 25 bp, Mus musculus
caagatttctcgaggtattttgaac

SEQ ID NO: 297385 - DNA, 25 bp, Mus musculus
caagatttctcgtggtattttgaac

SEQ ID NO: 297386 - DNA, 25 bp, Mus musculus
caagatttgcctatcaagtgctctt

SEQ ID NO: 297387 - DNA, 25 bp, Mus musculus
caagatttgcctttcaagtgctctt

SEQ ID NO: 297388 - DNA, 25 bp, Mus musculus
caagattttcacactgacttctgat

SEQ ID NO: 297389 - DNA, 25 bp, Mus musculus
caagattttcactctgacttctgat

SEQ ID NO: 297390 - DNA, 25 bp, Mus musculus
caagattttgccacagctccagagc

SEQ ID NO: 297391 - DNA, 25 bp, Mus musculus
caagattttgcctcagctccagagc

SEQ ID NO: 297392 - DNA, 25 bp, Mus musculus
caagattttttcaatcccatggccg

SEQ ID NO: 297393 - DNA, 25 bp, Mus musculus
caagattttttctatcccatggccg

SEQ ID NO: 297394 - DNA, 25 bp, Mus musculus
caagcaaaagcaatcgaggtctaat

SEQ ID NO: 297395 - DNA, 25 bp, Mus musculus
caagcaaaagcattcgaggtctaat

SEQ ID NO: 297396 - DNA, 25 bp, Mus musculus
caagcaaaccttccagagagcctga

SEQ ID NO: 297397 - DNA, 25 bp, Mus musculus
caagcaaaccttgcagagagcctga

SEQ ID NO: 297398 - DNA, 25 bp, Mus musculus
caagcaaatggaaggtcagcactgt

SEQ ID NO: 297399 - DNA, 25 bp, Mus musculus
caagcaaatggatggtcagcactgt

SEQ ID NO: 297400 - DNA, 25 bp, Mus musculus
caagcaaatggcaaattagggtaca

SEQ ID NO: 297401 - DNA, 25 bp, Mus musculus
caagcaaatggctaattagggtaca

SEQ ID NO: 297402 - DNA, 25 bp, Mus musculus
caagcaacctctattgactttctgt

SEQ ID NO: 297403 - DNA, 25 bp, Mus musculus
caagcaacctcttttgactttctgt

SEQ ID NO: 297404 - DNA, 25 bp, Mus musculus
caagcaaccttaattttcattccat

SEQ ID NO: 297405 - DNA, 25 bp, Mus musculus
caagcaaccttatttttcattccat

SEQ ID NO: 297406 - DNA, 25 bp, Mus musculus
caagcaactgccatcttggtagttc

SEQ ID NO: 297407 - DNA, 25 bp, Mus musculus
caagcaactgccttcttggtagttc

SEQ ID NO: 297408 - DNA, 25 bp, Mus musculus
caagcaacttacactggtttgacag

SEQ ID NO: 297409 - DNA, 25 bp, Mus musculus
caagcaacttactctggtttgacag

SEQ ID NO: 297410 - DNA, 25 bp, Mus musculus
caagcaacttctcgattctctaatt

SEQ ID NO: 297411 - DNA, 25 bp, Mus musculus
caagcaacttctggattctctaatt

SEQ ID NO: 297412 - DNA, 25 bp, Mus musculus
caagcaagaaagaaatccctcaaca

SEQ ID NO: 297413 - DNA, 25 bp, Mus musculus
caagcaagaaagtaatccctcaaca

SEQ ID NO: 297414 - DNA, 25 bp, Mus musculus
caagcaagcgctagaggacctggag

SEQ ID NO: 297415 - DNA, 25 bp, Mus musculus
caagcaagcgcttgaggacctggag

SEQ ID NO: 297416 - DNA, 25 bp, Mus musculus
caagcaagctatattaactgacccc

SEQ ID NO: 297417 - DNA, 25 bp, Mus musculus
caagcaagctattttaactgacccc

SEQ ID NO: 297418 - DNA, 25 bp, Mus musculus
caagcaaggaggcaaggcccgcgcc

SEQ ID NO: 297419 - DNA, 25 bp, Mus musculus
caagcaaggagggaaggcccgcgcc

SEQ ID NO: 297420 - DNA, 25 bp, Mus musculus
caagcaaggctacttagggattagt

SEQ ID NO: 297421 - DNA, 25 bp, Mus musculus
caagcaaggctagttagggattagt

SEQ ID NO: 297422 - DNA, 25 bp, Mus musculus
caagcaagggatacacagttcagac

SEQ ID NO: 297423 - DNA, 25 bp, Mus musculus
caagcaagggattcacagttcagac

SEQ ID NO: 297424 - DNA, 25 bp, Mus musculus
caagcaaggtatcgtggcacgcatc

SEQ ID NO: 297425 - DNA, 25 bp, Mus musculus
caagcaaggtatggtggcacgcatc

SEQ ID NO: 297426 - DNA, 25 bp, Mus musculus
caagcaagtgctctaccatggagtt

SEQ ID NO: 297427 - DNA, 25 bp, Mus musculus
caagcaagtgctgtaccatggagtt

SEQ ID NO: 297428 - DNA, 25 bp, Mus musculus
caagcaatacatccccatctgttgg

SEQ ID NO: 297429 - DNA, 25 bp, Mus musculus
caagcaatacatgcccatctgttgg

SEQ ID NO: 297430 - DNA, 25 bp, Mus musculus
caagcaatccagattgagaaattcc

SEQ ID NO: 297431 - DNA, 25 bp, Mus musculus
caagcaatccagtttgagaaattcc

SEQ ID NO: 297432 - DNA, 25 bp, Mus musculus
caagcaatgcaaatccaagaacaga

SEQ ID NO: 297433 - DNA, 25 bp, Mus musculus
caagcaatgcaattccaagaacaga

SEQ ID NO: 297434 - DNA, 25 bp, Mus musculus
caagcaatttgcactacctagagat

SEQ ID NO: 297435 - DNA, 25 bp, Mus musculus
caagcaatttgctctacctagagat

SEQ ID NO: 297436 - DNA, 25 bp, Mus musculus
caagcaatttgtccacatcaccaag

SEQ ID NO: 297437 - DNA, 25 bp, Mus musculus
caagcaatttgtgcacatcaccaag

SEQ ID NO: 297438 - DNA, 25 bp, Mus musculus
caagcacaaagtaatattccattct

SEQ ID NO: 297439 - DNA, 25 bp, Mus musculus
caagcacaaagttatattccattct

SEQ ID NO: 297440 - DNA, 25 bp, Mus musculus
caagcacaactgaccatatgattac

SEQ ID NO: 297441 - DNA, 25 bp, Mus musculus
caagcacaactgtccatatgattac

SEQ ID NO: 297442 - DNA, 25 bp, Mus musculus
caagcacacacaaggcctcgtagtc

SEQ ID NO: 297443 - DNA, 25 bp, Mus musculus
caagcacacacatggcctcgtagtc

SEQ ID NO: 297444 - DNA, 25 bp, Mus musculus
caagcacacaggagggtctccccga

SEQ ID NO: 297445 - DNA, 25 bp, Mus musculus
caagcacacaggtgggtctccccga

SEQ ID NO: 297446 - DNA, 25 bp, Mus musculus
caagcacaccaaaagcatcaccagt

SEQ ID NO: 297447 - DNA, 25 bp, Mus musculus
caagcacaccaatagcatcaccagt

SEQ ID NO: 297448 - DNA, 25 bp, Mus musculus
caagcacactttatagctgtgttaa

SEQ ID NO: 297449 - DNA, 25 bp, Mus musculus
caagcacactttttagctgtgttaa

SEQ ID NO: 297450 - DNA, 25 bp, Mus musculus
caagcacagcttctttaccagttgt

SEQ ID NO: 297451 - DNA, 25 bp, Mus musculus
caagcacagcttgtttaccagttgt

SEQ ID NO: 297452 - DNA, 25 bp, Mus musculus
caagcacatcccagcagtggtaatt

SEQ ID NO: 297453 - DNA, 25 bp, Mus musculus
caagcacatccctgcagtggtaatt

SEQ ID NO: 297454 - DNA, 25 bp, Mus musculus
caagcacatggcaactggagtcagc

SEQ ID NO: 297455 - DNA, 25 bp, Mus musculus
caagcacatggctactggagtcagc

SEQ ID NO: 297456 - DNA, 25 bp, Mus musculus
caagcacatgggataggaatctgaa

SEQ ID NO: 297457 - DNA, 25 bp, Mus musculus
caagcacatgggttaggaatctgaa

SEQ ID NO: 297458 - DNA, 25 bp, Mus musculus
caagcacattctatggttgagtcat

SEQ ID NO: 297459 - DNA, 25 bp, Mus musculus
caagcacattctttggttgagtcat

SEQ ID NO: 297460 - DNA, 25 bp, Mus musculus
caagcacatttcagctttgtttgca

SEQ ID NO: 297461 - DNA, 25 bp, Mus musculus
caagcacatttctgctttgtttgca

SEQ ID NO: 297462 - DNA, 25 bp, Mus musculus
caagcaccaggcctacatgtggtac

SEQ ID NO: 297463 - DNA, 25 bp, Mus musculus
caagcaccaggcgtacatgtggtac

SEQ ID NO: 297464 - DNA, 25 bp, Mus musculus
caagcacccggcatctagaatgtag

SEQ ID NO: 297465 - DNA, 25 bp, Mus musculus
caagcacccggcttctagaatgtag

SEQ ID NO: 297466 - DNA, 25 bp, Mus musculus
caagcaccgttcattgacagcggta

SEQ ID NO: 297467 - DNA, 25 bp, Mus musculus
caagcaccgttctttgacagcggta

SEQ ID NO: 297468 - DNA, 25 bp, Mus musculus
caagcacgcctaacatgagagcaaa

SEQ ID NO: 297469 - DNA, 25 bp, Mus musculus
caagcacgcctatcatgagagcaaa

SEQ ID NO: 297470 - DNA, 25 bp, Mus musculus
caagcacggtgtactgaatggccca

SEQ ID NO: 297471 - DNA, 25 bp, Mus musculus
caagcacggtgttctgaatggccca

SEQ ID NO: 297472 - DNA, 25 bp, Mus musculus
caagcactctaaaagtttgtgcatt

SEQ ID NO: 297473 - DNA, 25 bp, Mus musculus
caagcactctaatagtttgtgcatt

SEQ ID NO: 297474 - DNA, 25 bp, Mus musculus
caagcagaaaatccccttggagtgg

SEQ ID NO: 297475 - DNA, 25 bp, Mus musculus
caagcagaaaatgcccttggagtgg

SEQ ID NO: 297476 - DNA, 25 bp, Mus musculus
caagcagacaacaggccctgatggt

SEQ ID NO: 297477 - DNA, 25 bp, Mus musculus
caagcagacaacattgtgctgacac

SEQ ID NO: 297478 - DNA, 25 bp, Mus musculus
caagcagacaactggccctgatggt

SEQ ID NO: 297479 - DNA, 25 bp, Mus musculus
caagcagacaactttgtgctgacac

SEQ ID NO: 297480 - DNA, 25 bp, Mus musculus
caagcagagactccggaatgacccc

SEQ ID NO: 297481 - DNA, 25 bp, Mus musculus
caagcagagactgcggaatgacccc

SEQ ID NO: 297482 - DNA, 25 bp, Mus musculus
caagcagagttcctaaaaattcaat

SEQ ID NO: 297483 - DNA, 25 bp, Mus musculus
caagcagagttcgtaaaaattcaat

SEQ ID NO: 297484 - DNA, 25 bp, Mus musculus
caagcagatctaattgttgttgcct

SEQ ID NO: 297485 - DNA, 25 bp, Mus musculus
caagcagatctatttgttgttgcct

SEQ ID NO: 297486 - DNA, 25 bp, Mus musculus
caagcagatctgaggtcatattcaa

SEQ ID NO: 297487 - DNA, 25 bp, Mus musculus
caagcagatctgtggtcatattcaa

SEQ ID NO: 297488 - DNA, 25 bp, Mus musculus
caagcagattgacctgagcacagtg

SEQ ID NO: 297489 - DNA, 25 bp, Mus musculus
caagcagattgagctgagcacagtg

SEQ ID NO: 297490 - DNA, 25 bp, Mus musculus
caagcagcatccatatacggcgcat

SEQ ID NO: 297491 - DNA, 25 bp, Mus musculus
caagcagcatccttatacggcgcat

SEQ ID NO: 297492 - DNA, 25 bp, Mus musculus
caagcagcatggagtgaatgtcagt

SEQ ID NO: 297493 - DNA, 25 bp, Mus musculus
caagcagcatggtgtgaatgtcagt

SEQ ID NO: 297494 - DNA, 25 bp, Mus musculus
caagcagccagaccccaggaataca

SEQ ID NO: 297495 - DNA, 25 bp, Mus musculus
caagcagccagagcccaggaataca

SEQ ID NO: 297496 - DNA, 25 bp, Mus musculus
caagcagccatcaaataagtttcca

SEQ ID NO: 297497 - DNA, 25 bp, Mus musculus
caagcagccatctaataagtttcca

SEQ ID NO: 297498 - DNA, 25 bp, Mus musculus
caagcagcctagagtattgtacatt

SEQ ID NO: 297499 - DNA, 25 bp, Mus musculus
caagcagcctagtgtattgtacatt

SEQ ID NO: 297500 - DNA, 25 bp, Mus musculus
caagcagcctgaaggatcccggatt

SEQ ID NO: 297501 - DNA, 25 bp, Mus musculus
caagcagcctgatggatcccggatt

SEQ ID NO: 297502 - DNA, 25 bp, Mus musculus
caagcagcggctcaaatgattcagt

SEQ ID NO: 297503 - DNA, 25 bp, Mus musculus
caagcagcggctgaaatgattcagt

SEQ ID NO: 297504 - DNA, 25 bp, Mus musculus
caagcagcggttagatactagtggg

SEQ ID NO: 297505 - DNA, 25 bp, Mus musculus
caagcagcggtttgatactagtggg

SEQ ID NO: 297506 - DNA, 25 bp, Mus musculus
caagcagctcctatgtgagtaggct

SEQ ID NO: 297507 - DNA, 25 bp, Mus musculus
caagcagctcctttgtgagtaggct

SEQ ID NO: 297508 - DNA, 25 bp, Mus musculus
caagcagctgctcagtttattgtta

SEQ ID NO: 297509 - DNA, 25 bp, Mus musculus
caagcagctgctgagtttattgtta

SEQ ID NO: 297510 - DNA, 25 bp, Mus musculus
caagcaggaagcaaaggatggtgtt

SEQ ID NO: 297511 - DNA, 25 bp, Mus musculus
caagcaggaagctaaggatggtgtt

SEQ ID NO: 297512 - DNA, 25 bp, Mus musculus
caagcaggacatcgctcggcagcta

SEQ ID NO: 297513 - DNA, 25 bp, Mus musculus
caagcaggacatggctcggcagcta

SEQ ID NO: 297514 - DNA, 25 bp, Mus musculus
caagcaggagttagtttgcaaatga

SEQ ID NO: 297515 - DNA, 25 bp, Mus musculus
caagcaggagtttgtttgcaaatga

SEQ ID NO: 297516 - DNA, 25 bp, Mus musculus
caagcaggcttcaaattctctgtat

SEQ ID NO: 297517 - DNA, 25 bp, Mus musculus
caagcaggcttctaattctctgtat

SEQ ID NO: 297518 - DNA, 25 bp, Mus musculus
caagcaggctttattcactacttct

SEQ ID NO: 297519 - DNA, 25 bp, Mus musculus
caagcaggcttttttcactacttct

SEQ ID NO: 297520 - DNA, 25 bp, Mus musculus
caagcagggactagctccagggagt

SEQ ID NO: 297521 - DNA, 25 bp, Mus musculus
caagcagggacttgctccagggagt

SEQ ID NO: 297522 - DNA, 25 bp, Mus musculus
caagcagggcctaccagagcgagca

SEQ ID NO: 297523 - DNA, 25 bp, Mus musculus
caagcagggccttccagagcgagca

SEQ ID NO: 297524 - DNA, 25 bp, Mus musculus
caagcagggctgagtcttatccatg

SEQ ID NO: 297525 - DNA, 25 bp, Mus musculus
caagcagggctgatgccgtatccaa

SEQ ID NO: 297526 - DNA, 25 bp, Mus musculus
caagcagggctgtgtcttatccatg

SEQ ID NO: 297527 - DNA, 25 bp, Mus musculus
caagcagggctgttgccgtatccaa

SEQ ID NO: 297528 - DNA, 25 bp, Mus musculus
caagcaggtcttccatggtgggtca

SEQ ID NO: 297529 - DNA, 25 bp, Mus musculus
caagcaggtcttgcatggtgggtca

SEQ ID NO: 297530 - DNA, 25 bp, Mus musculus
caagcaggtgtcatcaaatagtcga

SEQ ID NO: 297531 - DNA, 25 bp, Mus musculus
caagcaggtgtcttcaaatagtcga

SEQ ID NO: 297532 - DNA, 25 bp, Mus musculus
caagcagtaaccatcctgatgtgac

SEQ ID NO: 297533 - DNA, 25 bp, Mus musculus
caagcagtaaccttcctgatgtgac

SEQ ID NO: 297534 - DNA, 25 bp, Mus musculus
caagcagtaattcgccagcttcctt

SEQ ID NO: 297535 - DNA, 25 bp, Mus musculus
caagcagtaattggccagcttcctt

SEQ ID NO: 297536 - DNA, 25 bp, Mus musculus
caagcagtacatatcacccatgggc

SEQ ID NO: 297537 - DNA, 25 bp, Mus musculus
caagcagtacatttcacccatgggc

SEQ ID NO: 297538 - DNA, 25 bp, Mus musculus
caagcagtacgacagtgaccattct

SEQ ID NO: 297539 - DNA, 25 bp, Mus musculus
caagcagtacgagagtgaccattct

SEQ ID NO: 297540 - DNA, 25 bp, Mus musculus
caagcagtattgaggagttcccggt

SEQ ID NO: 297541 - DNA, 25 bp, Mus musculus
caagcagtattgtggagttcccggt

SEQ ID NO: 297542 - DNA, 25 bp, Mus musculus
caagcagtccacatacagaagcgat

SEQ ID NO: 297543 - DNA, 25 bp, Mus musculus
caagcagtccacttacagaagcgat

SEQ ID NO: 297544 - DNA, 25 bp, Mus musculus
caagcagtctccatacttactattt

SEQ ID NO: 297545 - DNA, 25 bp, Mus musculus
caagcagtctccttacttactattt

SEQ ID NO: 297546 - DNA, 25 bp, Mus musculus
caagcagtgactcggcaaagctaaa

SEQ ID NO: 297547 - DNA, 25 bp, Mus musculus
caagcagtgactgggcaaagctaaa

SEQ ID NO: 297548 - DNA, 25 bp, Mus musculus
caagcagtgtccatgcaggtaaaaa

SEQ ID NO: 297549 - DNA, 25 bp, Mus musculus
caagcagtgtccttgcaggtaaaaa

SEQ ID NO: 297550 - DNA, 25 bp, Mus musculus
caagcagtgttaccctgagctctgt

SEQ ID NO: 297551 - DNA, 25 bp, Mus musculus
caagcagtgttagcctgagctctgt

SEQ ID NO: 297552 - DNA, 25 bp, Mus musculus
caagcagtgttcaggaggactccag

SEQ ID NO: 297553 - DNA, 25 bp, Mus musculus
caagcagtgttctggaggactccag

SEQ ID NO: 297554 - DNA, 25 bp, Mus musculus
caagcagttcaacagagtgtccagt

SEQ ID NO: 297555 - DNA, 25 bp, Mus musculus
caagcagttcaagagagtgtccagt

SEQ ID NO: 297556 - DNA, 25 bp, Mus musculus
caagcagttggtcctgaggccatcc

SEQ ID NO: 297557 - DNA, 25 bp, Mus musculus
caagcagttggtgctgaggccatcc

SEQ ID NO: 297558 - DNA, 25 bp, Mus musculus
caagcagttttgcttacagccctct

SEQ ID NO: 297559 - DNA, 25 bp, Mus musculus
caagcagttttggttacagccctct

SEQ ID NO: 297560 - DNA, 25 bp, Mus musculus
caagcataaaagctcttcacattat

SEQ ID NO: 297561 - DNA, 25 bp, Mus musculus
caagcataaaaggtcttcacattat

SEQ ID NO: 297562 - DNA, 25 bp, Mus musculus
caagcatacaccaaatgttgggttt

SEQ ID NO: 297563 - DNA, 25 bp, Mus musculus
caagcatacacctaatgttgggttt

SEQ ID NO: 297564 - DNA, 25 bp, Mus musculus
caagcatactttaggatcctcctct

SEQ ID NO: 297565 - DNA, 25 bp, Mus musculus
caagcatacttttggatcctcctct

SEQ ID NO: 297566 - DNA, 25 bp, Mus musculus
caagcataggtgacactgttcgctt

SEQ ID NO: 297567 - DNA, 25 bp, Mus musculus
caagcataggtgtcactgttcgctt

SEQ ID NO: 297568 - DNA, 25 bp, Mus musculus
caagcatataaaatcaccttctatg

SEQ ID NO: 297569 - DNA, 25 bp, Mus musculus
caagcatataaattcaccttctatg

SEQ ID NO: 297570 - DNA, 25 bp, Mus musculus
caagcatataatcctcttgcagagg

SEQ ID NO: 297571 - DNA, 25 bp, Mus musculus
caagcatataatgctcttgcagagg

SEQ ID NO: 297572 - DNA, 25 bp, Mus musculus
caagcatatctcctattatggatct

SEQ ID NO: 297573 - DNA, 25 bp, Mus musculus
caagcatatctcgtattatggatct

SEQ ID NO: 297574 - DNA, 25 bp, Mus musculus
caagcatcaaggagagtttagcccc

SEQ ID NO: 297575 - DNA, 25 bp, Mus musculus
caagcatcaaggtgagtttagcccc

SEQ ID NO: 297576 - DNA, 25 bp, Mus musculus
caagcatccaagaccacagcttcag

SEQ ID NO: 297577 - DNA, 25 bp, Mus musculus
caagcatccaagtccacagcttcag

SEQ ID NO: 297578 - DNA, 25 bp, Mus musculus
caagcatccatccatttccaaagga

SEQ ID NO: 297579 - DNA, 25 bp, Mus musculus
caagcatccatcgatttccaaagga

SEQ ID NO: 297580 - DNA, 25 bp, Mus musculus
caagcatcgtgcagtcaatcaggaa

SEQ ID NO: 297581 - DNA, 25 bp, Mus musculus
caagcatcgtgctgtcaatcaggaa

SEQ ID NO: 297582 - DNA, 25 bp, Mus musculus
caagcatctataactacaatccgag

SEQ ID NO: 297583 - DNA, 25 bp, Mus musculus
caagcatctatatctacaatccgag

SEQ ID NO: 297584 - DNA, 25 bp, Mus musculus
caagcatcttggagggacagcagga

SEQ ID NO: 297585 - DNA, 25 bp, Mus musculus
caagcatcttggtgggacagcagga

SEQ ID NO: 297586 - DNA, 25 bp, Mus musculus
caagcatgccttagagatcatccac

SEQ ID NO: 297587 - DNA, 25 bp, Mus musculus
caagcatgcctttgagatcatccac

SEQ ID NO: 297588 - DNA, 25 bp, Mus musculus
caagcatggcctacccgagaagtaa

SEQ ID NO: 297589 - DNA, 25 bp, Mus musculus
caagcatggccttcccgagaagtaa

SEQ ID NO: 297590 - DNA, 25 bp, Mus musculus
caagcatggtagcaaacactggtaa

SEQ ID NO: 297591 - DNA, 25 bp, Mus musculus
caagcatggtaggaaacactggtaa

SEQ ID NO: 297592 - DNA, 25 bp, Mus musculus
caagcatgtcatcagatttgccagg

SEQ ID NO: 297593 - DNA, 25 bp, Mus musculus
caagcatgtcatgagatttgccagg

SEQ ID NO: 297594 - DNA, 25 bp, Mus musculus
caagcatgtcttagtggtcacttca

SEQ ID NO: 297595 - DNA, 25 bp, Mus musculus
caagcatgtctttgtggtcacttca

SEQ ID NO: 297596 - DNA, 25 bp, Mus musculus
caagcatgttgaagggtttcctggg

SEQ ID NO: 297597 - DNA, 25 bp, Mus musculus
caagcatgttgatgggtttcctggg

SEQ ID NO: 297598 - DNA, 25 bp, Mus musculus
caagcatgttttcgttttcttctaa

SEQ ID NO: 297599 - DNA, 25 bp, Mus musculus
caagcatgttttggttttcttctaa

SEQ ID NO: 297600 - DNA, 25 bp, Mus musculus
caagcattaactaagcatagaggtt

SEQ ID NO: 297601 - DNA, 25 bp, Mus musculus
caagcattaacttagcatagaggtt

SEQ ID NO: 297602 - DNA, 25 bp, Mus musculus
caagcattaccaactgtcagctctc

SEQ ID NO: 297603 - DNA, 25 bp, Mus musculus
caagcattaccatctgtcagctctc

SEQ ID NO: 297604 - DNA, 25 bp, Mus musculus
caagcattcagaccttcaccacaga

SEQ ID NO: 297605 - DNA, 25 bp, Mus musculus
caagcattcagagcttcaccacaga

SEQ ID NO: 297606 - DNA, 25 bp, Mus musculus
caagcattcatcaaggaagcctcgt

SEQ ID NO: 297607 - DNA, 25 bp, Mus musculus
caagcattcatctaggaagcctcgt

SEQ ID NO: 297608 - DNA, 25 bp, Mus musculus
caagcattccgaatttgttatttat

SEQ ID NO: 297609 - DNA, 25 bp, Mus musculus
caagcattccgattttgttatttat

SEQ ID NO: 297610 - DNA, 25 bp, Mus musculus
caagcattctagattcccttcattt

SEQ ID NO: 297611 - DNA, 25 bp, Mus musculus
caagcattctagtttcccttcattt

SEQ ID NO: 297612 - DNA, 25 bp, Mus musculus
caagcattctggaggcattgcctat

SEQ ID NO: 297613 - DNA, 25 bp, Mus musculus
caagcattctggtggcattgcctat

SEQ ID NO: 297614 - DNA, 25 bp, Mus musculus
caagcattgagcaccttcctattca

SEQ ID NO: 297615 - DNA, 25 bp, Mus musculus
caagcattgagctccttcctattca

SEQ ID NO: 297616 - DNA, 25 bp, Mus musculus
caagcattgctgatatgtctcagaa

SEQ ID NO: 297617 - DNA, 25 bp, Mus musculus
caagcattgctgttatgtctcagaa

SEQ ID NO: 297618 - DNA, 25 bp, Mus musculus
caagcattggccaggtcttgaaaga

SEQ ID NO: 297619 - DNA, 25 bp, Mus musculus
caagcattggcctggtcttgaaaga

SEQ ID NO: 297620 - DNA, 25 bp, Mus musculus
caagcattgggcagtggtagccaaa

SEQ ID NO: 297621 - DNA, 25 bp, Mus musculus
caagcattgggctgtggtagccaaa

SEQ ID NO: 297622 - DNA, 25 bp, Mus musculus
caagcatttagaagccaggcgtgtt

SEQ ID NO: 297623 - DNA, 25 bp, Mus musculus
caagcatttagatgccaggcgtgtt

SEQ ID NO: 297624 - DNA, 25 bp, Mus musculus
caagcatttctgcacggctgagagc

SEQ ID NO: 297625 - DNA, 25 bp, Mus musculus
caagcatttctggacggctgagagc

SEQ ID NO: 297626 - DNA, 25 bp, Mus musculus
caagcatttgtacttgaataggatt

SEQ ID NO: 297627 - DNA, 25 bp, Mus musculus
caagcatttgtagttgaataggatt

SEQ ID NO: 297628 - DNA, 25 bp, Mus musculus
caagcatttgttactctgatacatg

SEQ ID NO: 297629 - DNA, 25 bp, Mus musculus
caagcatttgtttctctgatacatg

SEQ ID NO: 297630 - DNA, 25 bp, Mus musculus
caagcattttctcagcatctgttaa

SEQ ID NO: 297631 - DNA, 25 bp, Mus musculus
caagcattttctgagcatctgttaa

SEQ ID NO: 297632 - DNA, 25 bp, Mus musculus
caagcattttgactttcatggctaa

SEQ ID NO: 297633 - DNA, 25 bp, Mus musculus
caagcattttgagtttcatggctaa

SEQ ID NO: 297634 - DNA, 25 bp, Mus musculus
caagccaacagaaaagggtaggaac

SEQ ID NO: 297635 - DNA, 25 bp, Mus musculus
caagccaacagataagggtaggaac

SEQ ID NO: 297636 - DNA, 25 bp, Mus musculus
caagccaagagactcttttctgtat

SEQ ID NO: 297637 - DNA, 25 bp, Mus musculus
caagccaagagagtcttttctgtat

SEQ ID NO: 297638 - DNA, 25 bp, Mus musculus
caagccaagtatcttttctctgcct

SEQ ID NO: 297639 - DNA, 25 bp, Mus musculus
caagccaagtatgttttctctgcct

SEQ ID NO: 297640 - DNA, 25 bp, Mus musculus
caagccaagtgactgcagcatcctt

SEQ ID NO: 297641 - DNA, 25 bp, Mus musculus
caagccaagtgagtgcagcatcctt

SEQ ID NO: 297642 - DNA, 25 bp, Mus musculus
caagccaatggactagtctgatcta

SEQ ID NO: 297643 - DNA, 25 bp, Mus musculus
caagccaatggagtagtctgatcta

SEQ ID NO: 297644 - DNA, 25 bp, Mus musculus
caagccaattcgcaaaggttccaag

SEQ ID NO: 297645 - DNA, 25 bp, Mus musculus
caagccaattcggaaaggttccaag

SEQ ID NO: 297646 - DNA, 25 bp, Mus musculus
caagccacagtacccatgaggagat

SEQ ID NO: 297647 - DNA, 25 bp, Mus musculus
caagccacagtagccatgaggagat

SEQ ID NO: 297648 - DNA, 25 bp, Mus musculus
caagccacagtgcaggcagccaagc

SEQ ID NO: 297649 - DNA, 25 bp, Mus musculus
caagccacagtggaggcagccaagc

SEQ ID NO: 297650 - DNA, 25 bp, Mus musculus
caagccactgctactcatgtggttg

SEQ ID NO: 297651 - DNA, 25 bp, Mus musculus
caagccactgcttctcatgtggttg

SEQ ID NO: 297652 - DNA, 25 bp, Mus musculus
caagccacttcccattcattccttt

SEQ ID NO: 297653 - DNA, 25 bp, Mus musculus
caagccacttccgattcattccttt

SEQ ID NO: 297654 - DNA, 25 bp, Mus musculus
caagccagaagaccccgtagtaatg

SEQ ID NO: 297655 - DNA, 25 bp, Mus musculus
caagccagaagagcccgtagtaatg

SEQ ID NO: 297656 - DNA, 25 bp, Mus musculus
caagccagaagtcccagtccgaggt

SEQ ID NO: 297657 - DNA, 25 bp, Mus musculus
caagccagaagtgccagtccgaggt

SEQ ID NO: 297658 - DNA, 25 bp, Mus musculus
caagccagccctagcattgttattg

SEQ ID NO: 297659 - DNA, 25 bp, Mus musculus
caagccagcccttgcattgttattg

SEQ ID NO: 297660 - DNA, 25 bp, Mus musculus
caagccagggacaatgctgtgcagt

SEQ ID NO: 297661 - DNA, 25 bp, Mus musculus
caagccagggactatgctgtgcagt

SEQ ID NO: 297662 - DNA, 25 bp, Mus musculus
caagccagggctagtttggactggt

SEQ ID NO: 297663 - DNA, 25 bp, Mus musculus
caagccagggcttgtttggactggt

SEQ ID NO: 297664 - DNA, 25 bp, Mus musculus
caagccagtctgaaaccttgttagt

SEQ ID NO: 297665 - DNA, 25 bp, Mus musculus
caagccagtctgtaaccttgttagt

SEQ ID NO: 297666 - DNA, 25 bp, Mus musculus
caagccagttcaaaatgtcctcgtt

SEQ ID NO: 297667 - DNA, 25 bp, Mus musculus
caagccagttcataatgtcctcgtt

SEQ ID NO: 297668 - DNA, 25 bp, Mus musculus
caagccagttctaaaagtggagtta

SEQ ID NO: 297669 - DNA, 25 bp, Mus musculus
caagccagttcttaaagtggagtta

SEQ ID NO: 297670 - DNA, 25 bp, Mus musculus
caagccagttggatactatggaaat

SEQ ID NO: 297671 - DNA, 25 bp, Mus musculus
caagccagttggttactatggaaat

SEQ ID NO: 297672 - DNA, 25 bp, Mus musculus
caagccataaggatctggtggtcaa

SEQ ID NO: 297673 - DNA, 25 bp, Mus musculus
caagccataaggttctggtggtcaa

SEQ ID NO: 297674 - DNA, 25 bp, Mus musculus
caagccatagggagctctattggga

SEQ ID NO: 297675 - DNA, 25 bp, Mus musculus
caagccatagggtgctctattggga

SEQ ID NO: 297676 - DNA, 25 bp, Mus musculus
caagccatattgattcctgacagaa

SEQ ID NO: 297677 - DNA, 25 bp, Mus musculus
caagccatattgtttcctgacagaa

SEQ ID NO: 297678 - DNA, 25 bp, Mus musculus
caagccatcgatccagtgaagcctg

SEQ ID NO: 297679 - DNA, 25 bp, Mus musculus
caagccatcgatgcagtgaagcctg

SEQ ID NO: 297680 - DNA, 25 bp, Mus musculus
caagccatcgtgagaagacttcccc

SEQ ID NO: 297681 - DNA, 25 bp, Mus musculus
caagccatcgtgtgaagacttcccc

SEQ ID NO: 297682 - DNA, 25 bp, Mus musculus
caagccatcttcaagtaacaccgag

SEQ ID NO: 297683 - DNA, 25 bp, Mus musculus
caagccatcttctagtaacaccgag

SEQ ID NO: 297684 - DNA, 25 bp, Mus musculus
caagccatgttgctgggtgaccctc

SEQ ID NO: 297685 - DNA, 25 bp, Mus musculus
caagccatgttggtgggtgaccctc

SEQ ID NO: 297686 - DNA, 25 bp, Mus musculus
caagccattcaaataaacccctacg

SEQ ID NO: 297687 - DNA, 25 bp, Mus musculus
caagccattcaattaaacccctacg

SEQ ID NO: 297688 - DNA, 25 bp, Mus musculus
caagccattcagacattcacatctc

SEQ ID NO: 297689 - DNA, 25 bp, Mus musculus
caagccattcagtcattcacatctc

SEQ ID NO: 297690 - DNA, 25 bp, Mus musculus
caagccattctgactgctgagggtt

SEQ ID NO: 297691 - DNA, 25 bp, Mus musculus
caagccattctgtctgctgagggtt

SEQ ID NO: 297692 - DNA, 25 bp, Mus musculus
caagcccaagcccaggtaaacggtg

SEQ ID NO: 297693 - DNA, 25 bp, Mus musculus
caagcccaagccgaggtaaacggtg

SEQ ID NO: 297694 - DNA, 25 bp, Mus musculus
caagcccaaggcacctgagggtgag

SEQ ID NO: 297695 - DNA, 25 bp, Mus musculus
caagcccaaggccattgatcaagac

SEQ ID NO: 297696 - DNA, 25 bp, Mus musculus
caagcccaaggcgattgatcaagac

SEQ ID NO: 297697 - DNA, 25 bp, Mus musculus
caagcccaaggctcctgagggtgag

SEQ ID NO: 297698 - DNA, 25 bp, Mus musculus
caagcccaagtcagtaaagcaggct

SEQ ID NO: 297699 - DNA, 25 bp, Mus musculus
caagcccaagtctgtaaagcaggct

SEQ ID NO: 297700 - DNA, 25 bp, Mus musculus
caagcccaatgccattagcactgga

SEQ ID NO: 297701 - DNA, 25 bp, Mus musculus
caagcccaatgcgattagcactgga

SEQ ID NO: 297702 - DNA, 25 bp, Mus musculus
caagcccaccagagctacaaagtga

SEQ ID NO: 297703 - DNA, 25 bp, Mus musculus
caagcccaccagtgctacaaagtga

SEQ ID NO: 297704 - DNA, 25 bp, Mus musculus
caagcccacctaagatgagatcttc

SEQ ID NO: 297705 - DNA, 25 bp, Mus musculus
caagcccacctatgatgagatcttc

SEQ ID NO: 297706 - DNA, 25 bp, Mus musculus
caagcccacgttattcaaacaagat

SEQ ID NO: 297707 - DNA, 25 bp, Mus musculus
caagcccacgtttttcaaacaagat

SEQ ID NO: 297708 - DNA, 25 bp, Mus musculus
caagcccagatgctgcttaactgta

SEQ ID NO: 297709 - DNA, 25 bp, Mus musculus
caagcccagatggtgcttaactgta

SEQ ID NO: 297710 - DNA, 25 bp, Mus musculus
caagcccatgttctccaggatggag

SEQ ID NO: 297711 - DNA, 25 bp, Mus musculus
caagcccatgttgtccaggatggag

SEQ ID NO: 297712 - DNA, 25 bp, Mus musculus
caagccccaatgacttatctgtgga

SEQ ID NO: 297713 - DNA, 25 bp, Mus musculus
caagccccaatgtcttatctgtgga

SEQ ID NO: 297714 - DNA, 25 bp, Mus musculus
caagccccagagacaggtcctggat

SEQ ID NO: 297715 - DNA, 25 bp, Mus musculus
caagccccagagtcaggtcctggat

SEQ ID NO: 297716 - DNA, 25 bp, Mus musculus
caagccccaggtaaagacattttca

SEQ ID NO: 297717 - DNA, 25 bp, Mus musculus
caagccccaggtcatattaaaatcg

SEQ ID NO: 297718 - DNA, 25 bp, Mus musculus
caagccccaggtgatattaaaatcg

SEQ ID NO: 297719 - DNA, 25 bp, Mus musculus
caagccccaggttaagacattttca

SEQ ID NO: 297720 - DNA, 25 bp, Mus musculus
caagccccggtgatagagctttata

SEQ ID NO: 297721 - DNA, 25 bp, Mus musculus
caagccccggtgttagagctttata

SEQ ID NO: 297722 - DNA, 25 bp, Mus musculus
caagccccgtccagaaaggttccag

SEQ ID NO: 297723 - DNA, 25 bp, Mus musculus
caagccccgtcctgaaaggttccag

SEQ ID NO: 297724 - DNA, 25 bp, Mus musculus
caagcccctccacatgtagaggata

SEQ ID NO: 297725 - DNA, 25 bp, Mus musculus
caagcccctccagatgtagaggata

SEQ ID NO: 297726 - DNA, 25 bp, Mus musculus
caagcccctgaacagatgccttaaa

SEQ ID NO: 297727 - DNA, 25 bp, Mus musculus
caagcccctgaagagatgccttaaa

SEQ ID NO: 297728 - DNA, 25 bp, Mus musculus
caagcccgacctcgaggatgggtca

SEQ ID NO: 297729 - DNA, 25 bp, Mus musculus
caagcccgacctggaggatgggtca

SEQ ID NO: 297730 - DNA, 25 bp, Mus musculus
caagcccgctggaacagggttctat

SEQ ID NO: 297731 - DNA, 25 bp, Mus musculus
caagcccgctggtacagggttctat

SEQ ID NO: 297732 - DNA, 25 bp, Mus musculus
caagcccgtgagagtcaaggtgtat

SEQ ID NO: 297733 - DNA, 25 bp, Mus musculus
caagcccgtgagtgtcaaggtgtat

SEQ ID NO: 297734 - DNA, 25 bp, Mus musculus
caagcccgttcccttggctgtggtt

SEQ ID NO: 297735 - DNA, 25 bp, Mus musculus
caagcccgttccgttggctgtggtt

SEQ ID NO: 297736 - DNA, 25 bp, Mus musculus
caagccctagttcggagtccagcta

SEQ ID NO: 297737 - DNA, 25 bp, Mus musculus
caagccctagttgggagtccagcta

SEQ ID NO: 297738 - DNA, 25 bp, Mus musculus
caagccctccttatgaactggattt

SEQ ID NO: 297739 - DNA, 25 bp, Mus musculus
caagccctccttcggtttgtctctt

SEQ ID NO: 297740 - DNA, 25 bp, Mus musculus
caagccctccttgggtttgtctctt

SEQ ID NO: 297741 - DNA, 25 bp, Mus musculus
caagccctccttttgaactggattt

SEQ ID NO: 297742 - DNA, 25 bp, Mus musculus
caagccctctttctgagctgggaaa

SEQ ID NO: 297743 - DNA, 25 bp, Mus musculus
caagccctctttgtgagctgggaaa

SEQ ID NO: 297744 - DNA, 25 bp, Mus musculus
caagccctgaccagggcgctaggga

SEQ ID NO: 297745 - DNA, 25 bp, Mus musculus
caagccctgacctgggcgctaggga

SEQ ID NO: 297746 - DNA, 25 bp, Mus musculus
caagccctgtttcatgcacagacta

SEQ ID NO: 297747 - DNA, 25 bp, Mus musculus
caagccctgtttctttgcacatcat

SEQ ID NO: 297748 - DNA, 25 bp, Mus musculus
caagccctgtttgatgcacagacta

SEQ ID NO: 297749 - DNA, 25 bp, Mus musculus
caagccctgtttgtttgcacatcat

SEQ ID NO: 297750 - DNA, 25 bp, Mus musculus
caagcccttttgatcatgagttcca

SEQ ID NO: 297751 - DNA, 25 bp, Mus musculus
caagcccttttgttcatgagttcca

SEQ ID NO: 297752 - DNA, 25 bp, Mus musculus
caagccgatacacaccgcacattgg

SEQ ID NO: 297753 - DNA, 25 bp, Mus musculus
caagccgatacagaccgcacattgg

SEQ ID NO: 297754 - DNA, 25 bp, Mus musculus
caagccgcaaagccagcaggctacc

SEQ ID NO: 297755 - DNA, 25 bp, Mus musculus
caagccgcaaaggcagcaggctacc

SEQ ID NO: 297756 - DNA, 25 bp, Mus musculus
caagccgctcttccgcatctttgag

SEQ ID NO: 297757 - DNA, 25 bp, Mus musculus
caagccgctcttgcgcatctttgag

SEQ ID NO: 297758 - DNA, 25 bp, Mus musculus
caagccggaaggacggctgcacgcc

SEQ ID NO: 297759 - DNA, 25 bp, Mus musculus
caagccggaaggtcggctgcacgcc

SEQ ID NO: 297760 - DNA, 25 bp, Mus musculus
caagccggcagcctccggtcaagga

SEQ ID NO: 297761 - DNA, 25 bp, Mus musculus
caagccggcagcgtccggtcaagga

SEQ ID NO: 297762 - DNA, 25 bp, Mus musculus
caagccgggcggaagaagtcgattc

SEQ ID NO: 297763 - DNA, 25 bp, Mus musculus
caagccgggcggtagaagtcgattc

SEQ ID NO: 297764 - DNA, 25 bp, Mus musculus
caagccgggcttaatgggctgatca

SEQ ID NO: 297765 - DNA, 25 bp, Mus musculus
caagccgggctttatgggctgatca

SEQ ID NO: 297766 - DNA, 25 bp, Mus musculus
caagccggttgtcagtgacgatgac

SEQ ID NO: 297767 - DNA, 25 bp, Mus musculus
caagccggttgtgagtgacgatgac

SEQ ID NO: 297768 - DNA, 25 bp, Mus musculus
caagccgtgcccagtttaaaggaga

SEQ ID NO: 297769 - DNA, 25 bp, Mus musculus
caagccgtgccctgtttaaaggaga

SEQ ID NO: 297770 - DNA, 25 bp, Mus musculus
caagccgttctactgctgtgtcaga

SEQ ID NO: 297771 - DNA, 25 bp, Mus musculus
caagccgttctagtgctgtgtcaga

SEQ ID NO: 297772 - DNA, 25 bp, Mus musculus
caagccgtttgccagtattttcttt

SEQ ID NO: 297773 - DNA, 25 bp, Mus musculus
caagccgtttgcgagtattttcttt

SEQ ID NO: 297774 - DNA, 25 bp, Mus musculus
caagcctaacaaaccatagcctggc

SEQ ID NO: 297775 - DNA, 25 bp, Mus musculus
caagcctaacaatccatagcctggc

SEQ ID NO: 297776 - DNA, 25 bp, Mus musculus
caagcctaacagactgagctcaatc

SEQ ID NO: 297777 - DNA, 25 bp, Mus musculus
caagcctaacagtctgagctcaatc

SEQ ID NO: 297778 - DNA, 25 bp, Mus musculus
caagcctaccttaaagtgccagcat

SEQ ID NO: 297779 - DNA, 25 bp, Mus musculus
caagcctacctttaagtgccagcat

SEQ ID NO: 297780 - DNA, 25 bp, Mus musculus
caagcctactaccatcatcgagaag

SEQ ID NO: 297781 - DNA, 25 bp, Mus musculus
caagcctactacgatcatcgagaag

SEQ ID NO: 297782 - DNA, 25 bp, Mus musculus
caagcctagcaacagcagctgcgat

SEQ ID NO: 297783 - DNA, 25 bp, Mus musculus
caagcctagcaagagcagctgcgat

SEQ ID NO: 297784 - DNA, 25 bp, Mus musculus
caagcctagctaaccatatccagag

SEQ ID NO: 297785 - DNA, 25 bp, Mus musculus
caagcctagctatccatatccagag

SEQ ID NO: 297786 - DNA, 25 bp, Mus musculus
caagcctcaacgatgctaagtagca

SEQ ID NO: 297787 - DNA, 25 bp, Mus musculus
caagcctcaacgttgctaagtagca

SEQ ID NO: 297788 - DNA, 25 bp, Mus musculus
caagcctcaactcttgcacaagaat

SEQ ID NO: 297789 - DNA, 25 bp, Mus musculus
caagcctcaactgttgcacaagaat

SEQ ID NO: 297790 - DNA, 25 bp, Mus musculus
caagcctcaaggatgcccattttga

SEQ ID NO: 297791 - DNA, 25 bp, Mus musculus
caagcctcaaggttgcccattttga

SEQ ID NO: 297792 - DNA, 25 bp, Mus musculus
caagcctcacaaaacataccgactg

SEQ ID NO: 297793 - DNA, 25 bp, Mus musculus
caagcctcacaatacataccgactg

SEQ ID NO: 297794 - DNA, 25 bp, Mus musculus
caagcctcaggcaccggatggcagc

SEQ ID NO: 297795 - DNA, 25 bp, Mus musculus
caagcctcaggctccggatggcagc

SEQ ID NO: 297796 - DNA, 25 bp, Mus musculus
caagcctcatcaaagttttctcact

SEQ ID NO: 297797 - DNA, 25 bp, Mus musculus
caagcctcatcatagttttctcact

SEQ ID NO: 297798 - DNA, 25 bp, Mus musculus
caagcctcattgcagtggtttccct

SEQ ID NO: 297799 - DNA, 25 bp, Mus musculus
caagcctcattggagtggtttccct

SEQ ID NO: 297800 - DNA, 25 bp, Mus musculus
caagcctcctttatcactgggagga

SEQ ID NO: 297801 - DNA, 25 bp, Mus musculus
caagcctcctttttcactgggagga

SEQ ID NO: 297802 - DNA, 25 bp, Mus musculus
caagcctgaaggatgactgttgtca

SEQ ID NO: 297803 - DNA, 25 bp, Mus musculus
caagcctgaaggttgactgttgtca

SEQ ID NO: 297804 - DNA, 25 bp, Mus musculus
caagcctgagcaatgtagtgggact

SEQ ID NO: 297805 - DNA, 25 bp, Mus musculus
caagcctgagcattgtagtgggact

SEQ ID NO: 297806 - DNA, 25 bp, Mus musculus
caagcctgcttgagctacagagtgt

SEQ ID NO: 297807 - DNA, 25 bp, Mus musculus
caagcctgcttgtgctacagagtgt

SEQ ID NO: 297808 - DNA, 25 bp, Mus musculus
caagcctggatgaagctgatgctgt

SEQ ID NO: 297809 - DNA, 25 bp, Mus musculus
caagcctggatgtagctgatgctgt

SEQ ID NO: 297810 - DNA, 25 bp, Mus musculus
caagcctgggcacaggttcatgcat

SEQ ID NO: 297811 - DNA, 25 bp, Mus musculus
caagcctgggcagaggttcatgcat

SEQ ID NO: 297812 - DNA, 25 bp, Mus musculus
caagcctgtgtgatgggtctgaccc

SEQ ID NO: 297813 - DNA, 25 bp, Mus musculus
caagcctgtgtgttgggtctgaccc

SEQ ID NO: 297814 - DNA, 25 bp, Mus musculus
caagccttagggagtcgtcatagat

SEQ ID NO: 297815 - DNA, 25 bp, Mus musculus
caagccttagggtgtcgtcatagat

SEQ ID NO: 297816 - DNA, 25 bp, Mus musculus
caagccttcaggaatgatgccacag

SEQ ID NO: 297817 - DNA, 25 bp, Mus musculus
caagccttcaggtatgatgccacag

SEQ ID NO: 297818 - DNA, 20 bp, Mus musculus
caagccttccatagaaatca

SEQ ID NO: 297819 - DNA, 20 bp, Mus musculus
caagccttccctagaaatca

SEQ ID NO: 297820 - DNA, 20 bp, Mus musculus
caagccttccgtagaaatca

SEQ ID NO: 297821 - DNA, 20 bp, Mus musculus
caagccttccttagaaatca

SEQ ID NO: 297822 - DNA, 25 bp, Mus musculus
caagccttctttccctgtgttagaa

SEQ ID NO: 297823 - DNA, 25 bp, Mus musculus
caagccttctttgcctgtgttagaa

SEQ ID NO: 297824 - DNA, 25 bp, Mus musculus
caagccttggatacttattgtctca

SEQ ID NO: 297825 - DNA, 25 bp, Mus musculus
caagccttggattcttattgtctca

SEQ ID NO: 297826 - DNA, 25 bp, Mus musculus
caagccttggcaagtgttggtgctg

SEQ ID NO: 297827 - DNA, 25 bp, Mus musculus
caagccttggcatgtgttggtgctg

SEQ ID NO: 297828 - DNA, 25 bp, Mus musculus
caagcctttaacactttctgagaaa

SEQ ID NO: 297829 - DNA, 25 bp, Mus musculus
caagcctttaactctttctgagaaa

SEQ ID NO: 297830 - DNA, 25 bp, Mus musculus
caagcctttcccaggtggtattaat

SEQ ID NO: 297831 - DNA, 25 bp, Mus musculus
caagcctttccctggtggtattaat

SEQ ID NO: 297832 - DNA, 25 bp, Mus musculus
caagcgaccagacccaaagccttaa

SEQ ID NO: 297833 - DNA, 25 bp, Mus musculus
caagcgaccagagccaaagccttaa

SEQ ID NO: 297834 - DNA, 25 bp, Mus musculus
caagcgaggcccaactgatggtgcg

SEQ ID NO: 297835 - DNA, 25 bp, Mus musculus
caagcgaggccctactgatggtgcg

SEQ ID NO: 297836 - DNA, 25 bp, Mus musculus
caagcgatgcctacacttggtgaaa

SEQ ID NO: 297837 - DNA, 25 bp, Mus musculus
caagcgatgccttcacttggtgaaa

SEQ ID NO: 297838 - DNA, 25 bp, Mus musculus
caagcgatggctagtttcggcaacg

SEQ ID NO: 297839 - DNA, 25 bp, Mus musculus
caagcgatggcttgtttcggcaacg

SEQ ID NO: 297840 - DNA, 25 bp, Mus musculus
caagcgattcaacgttaactacctt

SEQ ID NO: 297841 - DNA, 25 bp, Mus musculus
caagcgattcaaggttaactacctt

SEQ ID NO: 297842 - DNA, 25 bp, Mus musculus
caagcgcaagcgagaggcccctgac

SEQ ID NO: 297843 - DNA, 25 bp, Mus musculus
caagcgcaagcgtgaggcccctgac

SEQ ID NO: 297844 - DNA, 25 bp, Mus musculus
caagcgcaagttagcccgagtttcc

SEQ ID NO: 297845 - DNA, 25 bp, Mus musculus
caagcgcaagtttgcccgagtttcc

SEQ ID NO: 297846 - DNA, 25 bp, Mus musculus
caagcgcattgtcttgtgctaaaca

SEQ ID NO: 297847 - DNA, 25 bp, Mus musculus
caagcgcattgtgttgtgctaaaca

SEQ ID NO: 297848 - DNA, 25 bp, Mus musculus
caagcgccctttacctagggattgt

SEQ ID NO: 297849 - DNA, 25 bp, Mus musculus
caagcgcccttttcctagggattgt

SEQ ID NO: 297850 - DNA, 25 bp, Mus musculus
caagcgcctgcgaagttcacagtgg

SEQ ID NO: 297851 - DNA, 25 bp, Mus musculus
caagcgcctgcgtagttcacagtgg

SEQ ID NO: 297852 - DNA, 25 bp, Mus musculus
caagcgctttacacagagctccaac

SEQ ID NO: 297853 - DNA, 25 bp, Mus musculus
caagcgctttactcagagctccaac

SEQ ID NO: 297854 - DNA, 25 bp, Mus musculus
caagcggaactgcgcttaaaacagc

SEQ ID NO: 297855 - DNA, 25 bp, Mus musculus
caagcggaactgggcttaaaacagc

SEQ ID NO: 297856 - DNA, 25 bp, Mus musculus
caagcggacccgaggttcaaaagtg

SEQ ID NO: 297857 - DNA, 25 bp, Mus musculus
caagcggacccgtggttcaaaagtg

SEQ ID NO: 297858 - DNA, 25 bp, Mus musculus
caagcggagtccctagttgctaatt

SEQ ID NO: 297859 - DNA, 25 bp, Mus musculus
caagcggagtccgtagttgctaatt

SEQ ID NO: 297860 - DNA, 25 bp, Mus musculus
caagcggatctcacttcgagcgaaa

SEQ ID NO: 297861 - DNA, 25 bp, Mus musculus
caagcggatctctcttcgagcgaaa

SEQ ID NO: 297862 - DNA, 25 bp, Mus musculus
caagcggatgagagcccaggcaagc

SEQ ID NO: 297863 - DNA, 25 bp, Mus musculus
caagcggatgagtgcccaggcaagc

SEQ ID NO: 297864 - DNA, 25 bp, Mus musculus
caagcggcaggtattctcagcatga

SEQ ID NO: 297865 - DNA, 25 bp, Mus musculus
caagcggcaggttttctcagcatga

SEQ ID NO: 297866 - DNA, 25 bp, Mus musculus
caagcggctcaacgcagagcctgca

SEQ ID NO: 297867 - DNA, 25 bp, Mus musculus
caagcggctcaaggcagagcctgca

SEQ ID NO: 297868 - DNA, 25 bp, Mus musculus
caagcgggagcaagtttgatacaca

SEQ ID NO: 297869 - DNA, 25 bp, Mus musculus
caagcgggagcatgtttgatacaca

SEQ ID NO: 297870 - DNA, 25 bp, Mus musculus
caagcgggccctccaggaacttgtg

SEQ ID NO: 297871 - DNA, 25 bp, Mus musculus
caagcgggccctgcaggaacttgtg

SEQ ID NO: 297872 - DNA, 25 bp, Mus musculus
caagcgggggccagtgttaccagct

SEQ ID NO: 297873 - DNA, 25 bp, Mus musculus
caagcgggggcctgtgttaccagct

SEQ ID NO: 297874 - DNA, 25 bp, Mus musculus
caagcggtgtgtctatccctattca

SEQ ID NO: 297875 - DNA, 25 bp, Mus musculus
caagcggtgtgtgtatccctattca

SEQ ID NO: 297876 - DNA, 25 bp, Mus musculus
caagcggtgtttaagggacttctgc

SEQ ID NO: 297877 - DNA, 25 bp, Mus musculus
caagcggtgttttagggacttctgc

SEQ ID NO: 297878 - DNA, 25 bp, Mus musculus
caagcgtaatgacctggtcatccgt

SEQ ID NO: 297879 - DNA, 25 bp, Mus musculus
caagcgtaatgagctggtcatccgt

SEQ ID NO: 297880 - DNA, 25 bp, Mus musculus
caagcgtcagctccggaatcggact

SEQ ID NO: 297881 - DNA, 25 bp, Mus musculus
caagcgtcagctgcggaatcggact

SEQ ID NO: 297882 - DNA, 25 bp, Mus musculus
caagcgtgtgcaagacaggttgtgt

SEQ ID NO: 297883 - DNA, 25 bp, Mus musculus
caagcgtgtgcatgacaggttgtgt

SEQ ID NO: 297884 - DNA, 25 bp, Mus musculus
caagcgtgtgggattccttcggaat

SEQ ID NO: 297885 - DNA, 25 bp, Mus musculus
caagcgtgtgggtttccttcggaat

SEQ ID NO: 297886 - DNA, 25 bp, Mus musculus
caagcgtgtgtacgtcaccggagct

SEQ ID NO: 297887 - DNA, 25 bp, Mus musculus
caagcgtgtgtaggtcaccggagct

SEQ ID NO: 297888 - DNA, 25 bp, Mus musculus
caagcgtttaaactggatcctgtgg

SEQ ID NO: 297889 - DNA, 25 bp, Mus musculus
caagcgtttaaagtggatcctgtgg

SEQ ID NO: 297890 - DNA, 25 bp, Mus musculus
caagcgtttctgagcatacatgcat

SEQ ID NO: 297891 - DNA, 25 bp, Mus musculus
caagcgtttctgtgcatacatgcat

SEQ ID NO: 297892 - DNA, 25 bp, Mus musculus
caagctaaatacactccattttccc

SEQ ID NO: 297893 - DNA, 25 bp, Mus musculus
caagctaaatactctccattttccc

SEQ ID NO: 297894 - DNA, 25 bp, Mus musculus
caagctaacactatgggttgcctcc

SEQ ID NO: 297895 - DNA, 25 bp, Mus musculus
caagctaacactttgggttgcctcc

SEQ ID NO: 297896 - DNA, 25 bp, Mus musculus
caagctaaccatcatgccatcctta

SEQ ID NO: 297897 - DNA, 25 bp, Mus musculus
caagctaaccatgatgccatcctta

SEQ ID NO: 297898 - DNA, 25 bp, Mus musculus
caagctaagcccacctcagtgagtg

SEQ ID NO: 297899 - DNA, 25 bp, Mus musculus
caagctaagccctcctcagtgagtg

SEQ ID NO: 297900 - DNA, 25 bp, Mus musculus
caagctaatctaacaggttcactgg

SEQ ID NO: 297901 - DNA, 25 bp, Mus musculus
caagctaatctatcaggttcactgg

SEQ ID NO: 297902 - DNA, 25 bp, Mus musculus
caagctaatctgaagggctggacct

SEQ ID NO: 297903 - DNA, 25 bp, Mus musculus
caagctaatctgtagggctggacct

SEQ ID NO: 297904 - DNA, 25 bp, Mus musculus
caagctaatcttaccaggttccaaa

SEQ ID NO: 297905 - DNA, 25 bp, Mus musculus
caagctaatctttccaggttccaaa

SEQ ID NO: 297906 - DNA, 25 bp, Mus musculus
caagctacaattacgttttatgaag

SEQ ID NO: 297907 - DNA, 25 bp, Mus musculus
caagctacaatttcgttttatgaag

SEQ ID NO: 297908 - DNA, 25 bp, Mus musculus
caagctacatcaaaggttacctgtg

SEQ ID NO: 297909 - DNA, 25 bp, Mus musculus
caagctacatcaatttgacataaat

SEQ ID NO: 297910 - DNA, 25 bp, Mus musculus
caagctacatcataggttacctgtg

SEQ ID NO: 297911 - DNA, 25 bp, Mus musculus
caagctacatcattttgacataaat

SEQ ID NO: 297912 - DNA, 25 bp, Mus musculus
caagctacatgcatacatgttgtaa

SEQ ID NO: 297913 - DNA, 25 bp, Mus musculus
caagctacatgcttacatgttgtaa

SEQ ID NO: 297914 - DNA, 25 bp, Mus musculus
caagctactaataaaactctgtcag

SEQ ID NO: 297915 - DNA, 25 bp, Mus musculus
caagctactaattaaactctgtcag

SEQ ID NO: 297916 - DNA, 25 bp, Mus musculus
caagctactacaaggccctgaattt

SEQ ID NO: 297917 - DNA, 25 bp, Mus musculus
caagctactacatggccctgaattt

SEQ ID NO: 297918 - DNA, 25 bp, Mus musculus
caagctactgtgagtttttctaaag

SEQ ID NO: 297919 - DNA, 25 bp, Mus musculus
caagctactgtgtgtttttctaaag

SEQ ID NO: 297920 - DNA, 25 bp, Mus musculus
caagctagaagcatggagtcctgta

SEQ ID NO: 297921 - DNA, 25 bp, Mus musculus
caagctagaagcttggagtcctgta

SEQ ID NO: 297922 - DNA, 25 bp, Mus musculus
caagctagcagtagcatttgcagat

SEQ ID NO: 297923 - DNA, 25 bp, Mus musculus
caagctagcagttgcatttgcagat

SEQ ID NO: 297924 - DNA, 25 bp, Mus musculus
caagctaggttcatcctgcatctga

SEQ ID NO: 297925 - DNA, 25 bp, Mus musculus
caagctaggttcttcctgcatctga

SEQ ID NO: 297926 - DNA, 25 bp, Mus musculus
caagctaggtttaggagtgtcgcaa

SEQ ID NO: 297927 - DNA, 25 bp, Mus musculus
caagctaggttttggagtgtcgcaa

SEQ ID NO: 297928 - DNA, 25 bp, Mus musculus
caagctagtactcacactgtcacac

SEQ ID NO: 297929 - DNA, 25 bp, Mus musculus
caagctagtactgacactgtcacac

SEQ ID NO: 297930 - DNA, 25 bp, Mus musculus
caagctatctgtaaaatgatctgaa

SEQ ID NO: 297931 - DNA, 25 bp, Mus musculus
caagctatctgttaaatgatctgaa

SEQ ID NO: 297932 - DNA, 25 bp, Mus musculus
caagctatgcaaccaccattgtgcc

SEQ ID NO: 297933 - DNA, 25 bp, Mus musculus
caagctatgcaagcaccattgtgcc

SEQ ID NO: 297934 - DNA, 25 bp, Mus musculus
caagctatgtgcacgggaaaactct

SEQ ID NO: 297935 - DNA, 25 bp, Mus musculus
caagctatgtgctcgggaaaactct

SEQ ID NO: 297936 - DNA, 25 bp, Mus musculus
caagctcaagccctacgttaattac

SEQ ID NO: 297937 - DNA, 25 bp, Mus musculus
caagctcaagccgtacgttaattac

SEQ ID NO: 297938 - DNA, 25 bp, Mus musculus
caagctcaagggagactagggcctc

SEQ ID NO: 297939 - DNA, 25 bp, Mus musculus
caagctcaagggtgactagggcctc

SEQ ID NO: 297940 - DNA, 25 bp, Mus musculus
caagctcacagcagttcaggaccat

SEQ ID NO: 297941 - DNA, 25 bp, Mus musculus
caagctcacagctgttcaggaccat

SEQ ID NO: 297942 - DNA, 25 bp, Mus musculus
caagctcagcttaagggataacata

SEQ ID NO: 297943 - DNA, 25 bp, Mus musculus
caagctcagcttctgcagggttttt

SEQ ID NO: 297944 - DNA, 25 bp, Mus musculus
caagctcagcttgtgcagggttttt

SEQ ID NO: 297945 - DNA, 25 bp, Mus musculus
caagctcagctttagggataacata

SEQ ID NO: 297946 - DNA, 25 bp, Mus musculus
caagctcaggtccttatgcttggac

SEQ ID NO: 297947 - DNA, 25 bp, Mus musculus
caagctcaggtcgttatgcttggac

SEQ ID NO: 297948 - DNA, 25 bp, Mus musculus
caagctcaggtgactgtatctcctt

SEQ ID NO: 297949 - DNA, 25 bp, Mus musculus
caagctcaggtgtctgtatctcctt

SEQ ID NO: 297950 - DNA, 25 bp, Mus musculus
caagctcagtgtcggtatttctctt

SEQ ID NO: 297951 - DNA, 25 bp, Mus musculus
caagctcagtgtgggtatttctctt

SEQ ID NO: 297952 - DNA, 25 bp, Mus musculus
caagctccaaagctccaaaggcaat

SEQ ID NO: 297953 - DNA, 25 bp, Mus musculus
caagctccaaaggtccaaaggcaat

SEQ ID NO: 297954 - DNA, 25 bp, Mus musculus
caagctccaactcgtcgtctatctg

SEQ ID NO: 297955 - DNA, 25 bp, Mus musculus
caagctccaactggtcgtctatctg

SEQ ID NO: 297956 - DNA, 25 bp, Mus musculus
caagctccaataaacgtactaggaa

SEQ ID NO: 297957 - DNA, 25 bp, Mus musculus
caagctccaatatacgtactaggaa

SEQ ID NO: 297958 - DNA, 25 bp, Mus musculus
caagctccacacagagtctctggca

SEQ ID NO: 297959 - DNA, 25 bp, Mus musculus
caagctccacactgagtctctggca

SEQ ID NO: 297960 - DNA, 25 bp, Mus musculus
caagctcccgtcatttgaatgagta

SEQ ID NO: 297961 - DNA, 25 bp, Mus musculus
caagctcccgtcttttgaatgagta

SEQ ID NO: 297962 - DNA, 25 bp, Mus musculus
caagctccctgaatagagtctgttt

SEQ ID NO: 297963 - DNA, 25 bp, Mus musculus
caagctccctgattagagtctgttt

SEQ ID NO: 297964 - DNA, 25 bp, Mus musculus
caagctccctggaattgcaaggtga

SEQ ID NO: 297965 - DNA, 25 bp, Mus musculus
caagctccctggtattgcaaggtga

SEQ ID NO: 297966 - DNA, 25 bp, Mus musculus
caagctccgggtaggctgtgcctgc

SEQ ID NO: 297967 - DNA, 25 bp, Mus musculus
caagctccgggttggctgtgcctgc

SEQ ID NO: 297968 - DNA, 25 bp, Mus musculus
caagctcggcccacgtttgaggaag

SEQ ID NO: 297969 - DNA, 25 bp, Mus musculus
caagctcggccctcgtttgaggaag

SEQ ID NO: 297970 - DNA, 25 bp, Mus musculus
caagctcggtgtcggatatttggtt

SEQ ID NO: 297971 - DNA, 25 bp, Mus musculus
caagctcggtgtgggatatttggtt

SEQ ID NO: 297972 - DNA, 25 bp, Mus musculus
caagctctacgacgccgacatggac

SEQ ID NO: 297973 - DNA, 25 bp, Mus musculus
caagctctacgaggccgacatggac

SEQ ID NO: 297974 - DNA, 25 bp, Mus musculus
caagctctatagatagaagttgcta

SEQ ID NO: 297975 - DNA, 25 bp, Mus musculus
caagctctatagttagaagttgcta

SEQ ID NO: 297976 - DNA, 25 bp, Mus musculus
caagctctccgtctgaggagggagc

SEQ ID NO: 297977 - DNA, 25 bp, Mus musculus
caagctctccgtgtgaggagggagc

SEQ ID NO: 297978 - DNA, 25 bp, Mus musculus
caagctctgagcaggagtgccctgt

SEQ ID NO: 297979 - DNA, 25 bp, Mus musculus
caagctctgagctggagtgccctgt

SEQ ID NO: 297980 - DNA, 25 bp, Mus musculus
caagctctgcccagtaaggagagac

SEQ ID NO: 297981 - DNA, 25 bp, Mus musculus
caagctctgccctgtaaggagagac

SEQ ID NO: 297982 - DNA, 25 bp, Mus musculus
caagctctgtcaatgctaatggaat

SEQ ID NO: 297983 - DNA, 25 bp, Mus musculus
caagctctgtcattgctaatggaat

SEQ ID NO: 297984 - DNA, 25 bp, Mus musculus
caagctcttaacagccgggccatct

SEQ ID NO: 297985 - DNA, 25 bp, Mus musculus
caagctcttaactgccgggccatct

SEQ ID NO: 297986 - DNA, 25 bp, Mus musculus
caagctcttccaaaagctcgtgctg

SEQ ID NO: 297987 - DNA, 25 bp, Mus musculus
caagctcttccataagctcgtgctg

SEQ ID NO: 297988 - DNA, 25 bp, Mus musculus
caagctgaacctcttttccctgtgg

SEQ ID NO: 297989 - DNA, 25 bp, Mus musculus
caagctgaacctgttttccctgtgg

SEQ ID NO: 297990 - DNA, 25 bp, Mus musculus
caagctgacggtcccggctgagaaa

SEQ ID NO: 297991 - DNA, 25 bp, Mus musculus
caagctgacggtgccggctgagaaa

SEQ ID NO: 297992 - DNA, 25 bp, Mus musculus
caagctgactcgacctcattaactg

SEQ ID NO: 297993 - DNA, 25 bp, Mus musculus
caagctgactcgtcctcattaactg

SEQ ID NO: 297994 - DNA, 25 bp, Mus musculus
caagctgacttgaccggagttcatg

SEQ ID NO: 297995 - DNA, 25 bp, Mus musculus
caagctgacttgtccggagttcatg

SEQ ID NO: 297996 - DNA, 25 bp, Mus musculus
caagctgagcacctgtgacatgtgt

SEQ ID NO: 297997 - DNA, 25 bp, Mus musculus
caagctgagcacgtgtgacatgtgt

SEQ ID NO: 297998 - DNA, 25 bp, Mus musculus
caagctgaggacactcaagggccca

SEQ ID NO: 297999 - DNA, 25 bp, Mus musculus
caagctgaggactctcaagggccca

SEQ ID NO: 298000 - DNA, 25 bp, Mus musculus
caagctgaggctacgggagacgcaa

SEQ ID NO: 298001 - DNA, 25 bp, Mus musculus
caagctgaggcttcgggagacgcaa

SEQ ID NO: 298002 - DNA, 25 bp, Mus musculus
caagctgattccatccggcgcaggc

SEQ ID NO: 298003 - DNA, 25 bp, Mus musculus
caagctgattccttccggcgcaggc

SEQ ID NO: 298004 - DNA, 25 bp, Mus musculus
caagctgcactgagaaacccgggca

SEQ ID NO: 298005 - DNA, 25 bp, Mus musculus
caagctgcactgtgaaacccgggca

SEQ ID NO: 298006 - DNA, 25 bp, Mus musculus
caagctgcagcaaactcttccaaag

SEQ ID NO: 298007 - DNA, 25 bp, Mus musculus
caagctgcagcatactcttccaaag

SEQ ID NO: 298008 - DNA, 25 bp, Mus musculus
caagctgccaggagaccacttttat

SEQ ID NO: 298009 - DNA, 25 bp, Mus musculus
caagctgccaggtgaccacttttat

SEQ ID NO: 298010 - DNA, 25 bp, Mus musculus
caagctgccataaaattaacatgtt

SEQ ID NO: 298011 - DNA, 25 bp, Mus musculus
caagctgccatataattaacatgtt

SEQ ID NO: 298012 - DNA, 25 bp, Mus musculus
caagctgcccaacttgaagtttctg

SEQ ID NO: 298013 - DNA, 25 bp, Mus musculus
caagctgcccaagttgaagtttctg

SEQ ID NO: 298014 - DNA, 25 bp, Mus musculus
caagctgcccacatgtttatgcaga

SEQ ID NO: 298015 - DNA, 25 bp, Mus musculus
caagctgcccacttgtttatgcaga

SEQ ID NO: 298016 - DNA, 25 bp, Mus musculus
caagctgcccagagctaagacagtt

SEQ ID NO: 298017 - DNA, 25 bp, Mus musculus
caagctgcccagtgctaagacagtt

SEQ ID NO: 298018 - DNA, 25 bp, Mus musculus
caagctgcctgactgcgttatcaat

SEQ ID NO: 298019 - DNA, 25 bp, Mus musculus
caagctgcctgagtgcgttatcaat

SEQ ID NO: 298020 - DNA, 25 bp, Mus musculus
caagctgcctggatcacttggctga

SEQ ID NO: 298021 - DNA, 25 bp, Mus musculus
caagctgcctggttcacttggctga

SEQ ID NO: 298022 - DNA, 25 bp, Mus musculus
caagctgcgcatcggtgcacagtgt

SEQ ID NO: 298023 - DNA, 25 bp, Mus musculus
caagctgcgcatgggtgcacagtgt

SEQ ID NO: 298024 - DNA, 25 bp, Mus musculus
caagctgcgcctagttccaagatag

SEQ ID NO: 298025 - DNA, 25 bp, Mus musculus
caagctgcgccttgttccaagatag

SEQ ID NO: 298026 - DNA, 25 bp, Mus musculus
caagctgcggatatctgtttctata

SEQ ID NO: 298027 - DNA, 25 bp, Mus musculus
caagctgcggatttctgtttctata

SEQ ID NO: 298028 - DNA, 25 bp, Mus musculus
caagctgcgggcactcatggcacag

SEQ ID NO: 298029 - DNA, 25 bp, Mus musculus
caagctgcgggctctcatggcacag

SEQ ID NO: 298030 - DNA, 25 bp, Mus musculus
caagctgctaaacacctgcgagggc

SEQ ID NO: 298031 - DNA, 25 bp, Mus musculus
caagctgctaaagacctgcgagggc

SEQ ID NO: 298032 - DNA, 25 bp, Mus musculus
caagctgctcatatccctattctgt

SEQ ID NO: 298033 - DNA, 25 bp, Mus musculus
caagctgctcatttccctattctgt

SEQ ID NO: 298034 - DNA, 25 bp, Mus musculus
caagctgctgaactggtctgtccaa

SEQ ID NO: 298035 - DNA, 25 bp, Mus musculus
caagctgctgaagtggtctgtccaa

SEQ ID NO: 298036 - DNA, 25 bp, Mus musculus
caagctgctgaccaaaattcatgat

SEQ ID NO: 298037 - DNA, 25 bp, Mus musculus
caagctgctgacgaaaattcatgat

SEQ ID NO: 298038 - DNA, 25 bp, Mus musculus
caagctgctgctaaatactggtatt

SEQ ID NO: 298039 - DNA, 25 bp, Mus musculus
caagctgctgcttaatactggtatt

SEQ ID NO: 298040 - DNA, 25 bp, Mus musculus
caagctgcttggaaggtctggacat

SEQ ID NO: 298041 - DNA, 25 bp, Mus musculus
caagctgcttggtaggtctggacat

SEQ ID NO: 298042 - DNA, 25 bp, Mus musculus
caagctgctttaaaatccaggaata

SEQ ID NO: 298043 - DNA, 25 bp, Mus musculus
caagctgctttataatccaggaata

SEQ ID NO: 298044 - DNA, 25 bp, Mus musculus
caagctggaataaaggttggctcta

SEQ ID NO: 298045 - DNA, 25 bp, Mus musculus
caagctggaatataggttggctcta

SEQ ID NO: 298046 - DNA, 25 bp, Mus musculus
caagctggaatgatatcccaacctc

SEQ ID NO: 298047 - DNA, 25 bp, Mus musculus
caagctggaatgttatcccaacctc

SEQ ID NO: 298048 - DNA, 25 bp, Mus musculus
caagctggacaacctgaccttgatg

SEQ ID NO: 298049 - DNA, 25 bp, Mus musculus
caagctggacaagctgaccttgatg

SEQ ID NO: 298050 - DNA, 25 bp, Mus musculus
caagctggacgacctctttgagcag

SEQ ID NO: 298051 - DNA, 25 bp, Mus musculus
caagctggacgagctctttgagcag

SEQ ID NO: 298052 - DNA, 25 bp, Mus musculus
caagctggcattaaactctgggttt

SEQ ID NO: 298053 - DNA, 25 bp, Mus musculus
caagctggcatttaactctgggttt

SEQ ID NO: 298054 - DNA, 25 bp, Mus musculus
caagctggctagcaagtgcctgtgt

SEQ ID NO: 298055 - DNA, 25 bp, Mus musculus
caagctggctaggaagtgcctgtgt

SEQ ID NO: 298056 - DNA, 25 bp, Mus musculus
caagctgggcttctggtttgattca

SEQ ID NO: 298057 - DNA, 25 bp, Mus musculus
caagctgggcttgtggtttgattca

SEQ ID NO: 298058 - DNA, 25 bp, Mus musculus
caagctggtacacggcccaactatt

SEQ ID NO: 298059 - DNA, 25 bp, Mus musculus
caagctggtacagggcccaactatt

SEQ ID NO: 298060 - DNA, 25 bp, Mus musculus
caagctggtgaccaccctcgcaggg

SEQ ID NO: 298061 - DNA, 25 bp, Mus musculus
caagctggtgacgaccctcgcaggg

SEQ ID NO: 298062 - DNA, 25 bp, Mus musculus
caagctggtggacgcactttgtgct

SEQ ID NO: 298063 - DNA, 25 bp, Mus musculus
caagctggtggaggcactttgtgct

SEQ ID NO: 298064 - DNA, 25 bp, Mus musculus
caagctggtggccattcttaggaat

SEQ ID NO: 298065 - DNA, 25 bp, Mus musculus
caagctggtggcgattcttaggaat

SEQ ID NO: 298066 - DNA, 25 bp, Mus musculus
caagctggtttccttctagatttaa

SEQ ID NO: 298067 - DNA, 25 bp, Mus musculus
caagctggtttcgttctagatttaa

SEQ ID NO: 298068 - DNA, 25 bp, Mus musculus
caagctgtagaactgggtccatttt

SEQ ID NO: 298069 - DNA, 25 bp, Mus musculus
caagctgtagaagtgggtccatttt

SEQ ID NO: 298070 - DNA, 25 bp, Mus musculus
caagctgtaggaatagaagggtttt

SEQ ID NO: 298071 - DNA, 25 bp, Mus musculus
caagctgtaggattagaagggtttt

SEQ ID NO: 298072 - DNA, 25 bp, Mus musculus
caagctgtagttctccatagccaac

SEQ ID NO: 298073 - DNA, 25 bp, Mus musculus
caagctgtagttgtccatagccaac

SEQ ID NO: 298074 - DNA, 25 bp, Mus musculus
caagctgtatgtagagactgagtgt

SEQ ID NO: 298075 - DNA, 25 bp, Mus musculus
caagctgtatgttgagactgagtgt

SEQ ID NO: 298076 - DNA, 25 bp, Mus musculus
caagctgtattacctttgctgctat

SEQ ID NO: 298077 - DNA, 25 bp, Mus musculus
caagctgtattagctttgctgctat

SEQ ID NO: 298078 - DNA, 25 bp, Mus musculus
caagctgtcaacagaattccattcc

SEQ ID NO: 298079 - DNA, 25 bp, Mus musculus
caagctgtcaactgaattccattcc

SEQ ID NO: 298080 - DNA, 25 bp, Mus musculus
caagctgtcgctcgaggagttcatc

SEQ ID NO: 298081 - DNA, 25 bp, Mus musculus
caagctgtcgctggaggagttcatc

SEQ ID NO: 298082 - DNA, 25 bp, Mus musculus
caagctgtctgcaaaacactcccta

SEQ ID NO: 298083 - DNA, 25 bp, Mus musculus
caagctgtctgctaaacactcccta

SEQ ID NO: 298084 - DNA, 25 bp, Mus musculus
caagctgtcttgctgagacttgcta

SEQ ID NO: 298085 - DNA, 25 bp, Mus musculus
caagctgtcttggtgagacttgcta

SEQ ID NO: 298086 - DNA, 25 bp, Mus musculus
caagctgtgctcagtgttagtaaaa

SEQ ID NO: 298087 - DNA, 25 bp, Mus musculus
caagctgtgctctgtgttagtaaaa

SEQ ID NO: 298088 - DNA, 25 bp, Mus musculus
caagctgtgggccatgaagccatca

SEQ ID NO: 298089 - DNA, 25 bp, Mus musculus
caagctgtgggcgatgaagccatca

SEQ ID NO: 298090 - DNA, 25 bp, Mus musculus
caagctgtggttaattagacactaa

SEQ ID NO: 298091 - DNA, 25 bp, Mus musculus
caagctgtggtttattagacactaa

SEQ ID NO: 298092 - DNA, 25 bp, Mus musculus
caagctgtgtagaactttgtgcatt

SEQ ID NO: 298093 - DNA, 25 bp, Mus musculus
caagctgtgtagtactttgtgcatt

SEQ ID NO: 298094 - DNA, 25 bp, Mus musculus
caagctgtgtgaccagctgttgcca

SEQ ID NO: 298095 - DNA, 25 bp, Mus musculus
caagctgtgtgagcagctgttgcca

SEQ ID NO: 298096 - DNA, 25 bp, Mus musculus
caagctgtgtgcagaggactgcaga

SEQ ID NO: 298097 - DNA, 25 bp, Mus musculus
caagctgtgtgctgaggactgcaga

SEQ ID NO: 298098 - DNA, 25 bp, Mus musculus
caagctgttatacatgaagcatagt

SEQ ID NO: 298099 - DNA, 25 bp, Mus musculus
caagctgttatagatgaagcatagt

SEQ ID NO: 298100 - DNA, 25 bp, Mus musculus
caagctgttgcgagactggctttgg

SEQ ID NO: 298101 - DNA, 25 bp, Mus musculus
caagctgttgcgtgactggctttgg

SEQ ID NO: 298102 - DNA, 25 bp, Mus musculus
caagctgtttctagagatcgaacga

SEQ ID NO: 298103 - DNA, 25 bp, Mus musculus
caagctgtttcttgagatcgaacga

SEQ ID NO: 298104 - DNA, 25 bp, Mus musculus
caagcttacaaaccaccggcatgct

SEQ ID NO: 298105 - DNA, 25 bp, Mus musculus
caagcttacaaagcaccggcatgct

SEQ ID NO: 298106 - DNA, 25 bp, Mus musculus
caagcttactggcttgctggtgagc

SEQ ID NO: 298107 - DNA, 25 bp, Mus musculus
caagcttactgggttgctggtgagc

SEQ ID NO: 298108 - DNA, 25 bp, Mus musculus
caagcttagcaacctgggtggatca

SEQ ID NO: 298109 - DNA, 25 bp, Mus musculus
caagcttagcaagctgggtggatca

SEQ ID NO: 298110 - DNA, 25 bp, Mus musculus
caagcttagcagacaaggccatgtt

SEQ ID NO: 298111 - DNA, 25 bp, Mus musculus
caagcttagcagtcaaggccatgtt

SEQ ID NO: 298112 - DNA, 25 bp, Mus musculus
caagcttaggacattccctacttgg

SEQ ID NO: 298113 - DNA, 25 bp, Mus musculus
caagcttaggactttccctacttgg

SEQ ID NO: 298114 - DNA, 25 bp, Mus musculus
caagcttaggctctggccttggatc

SEQ ID NO: 298115 - DNA, 25 bp, Mus musculus
caagcttaggctgtggccttggatc

SEQ ID NO: 298116 - DNA, 25 bp, Mus musculus
caagcttataggactttggctgtca

SEQ ID NO: 298117 - DNA, 25 bp, Mus musculus
caagcttataggtctttggctgtca

SEQ ID NO: 298118 - DNA, 25 bp, Mus musculus
caagcttcaaagctctgcctgtgtg

SEQ ID NO: 298119 - DNA, 25 bp, Mus musculus
caagcttcaaaggtctgcctgtgtg

SEQ ID NO: 298120 - DNA, 25 bp, Mus musculus
caagcttcaactactgggtattggt

SEQ ID NO: 298121 - DNA, 25 bp, Mus musculus
caagcttcaacttctgggtattggt

SEQ ID NO: 298122 - DNA, 25 bp, Mus musculus
caagcttcaattcttacctgactaa

SEQ ID NO: 298123 - DNA, 25 bp, Mus musculus
caagcttcaattgttacctgactaa

SEQ ID NO: 298124 - DNA, 25 bp, Mus musculus
caagcttcacctaatcagaggacaa

SEQ ID NO: 298125 - DNA, 25 bp, Mus musculus
caagcttcaccttatcagaggacaa

SEQ ID NO: 298126 - DNA, 25 bp, Mus musculus
caagcttcaggacccttggatttcc

SEQ ID NO: 298127 - DNA, 25 bp, Mus musculus
caagcttcaggagccttggatttcc

SEQ ID NO: 298128 - DNA, 25 bp, Mus musculus
caagcttcccgacacagtgagctgg

SEQ ID NO: 298129 - DNA, 25 bp, Mus musculus
caagcttcccgagacagtgagctgg

SEQ ID NO: 298130 - DNA, 25 bp, Mus musculus
caagcttccctgactgtttatgtaa

SEQ ID NO: 298131 - DNA, 25 bp, Mus musculus
caagcttccctgtctgtttatgtaa

SEQ ID NO: 298132 - DNA, 25 bp, Mus musculus
caagcttccgaccattagtcagaga

SEQ ID NO: 298133 - DNA, 25 bp, Mus musculus
caagcttccgacgattagtcagaga

SEQ ID NO: 298134 - DNA, 25 bp, Mus musculus
caagcttccgtgatgatagtacagt

SEQ ID NO: 298135 - DNA, 25 bp, Mus musculus
caagcttccgtgttgatagtacagt

SEQ ID NO: 298136 - DNA, 25 bp, Mus musculus
caagcttctaggagaactggagagt

SEQ ID NO: 298137 - DNA, 25 bp, Mus musculus
caagcttctaggtgaactggagagt

SEQ ID NO: 298138 - DNA, 25 bp, Mus musculus
caagcttcttccaaatcacctaaag

SEQ ID NO: 298139 - DNA, 25 bp, Mus musculus
caagcttcttcctaatcacctaaag

SEQ ID NO: 298140 - DNA, 25 bp, Mus musculus
caagcttcttctcatcgttgtgggt

SEQ ID NO: 298141 - DNA, 25 bp, Mus musculus
caagcttcttctgatcgttgtgggt

SEQ ID NO: 298142 - DNA, 25 bp, Mus musculus
caagcttcttttcccagttagacat

SEQ ID NO: 298143 - DNA, 25 bp, Mus musculus
caagcttcttttgccagttagacat

SEQ ID NO: 298144 - DNA, 25 bp, Mus musculus
caagcttgaacaccgatttttgtct

SEQ ID NO: 298145 - DNA, 25 bp, Mus musculus
caagcttgaacagcgatttttgtct

SEQ ID NO: 298146 - DNA, 25 bp, Mus musculus
caagcttgaaggaggcgtggcctat

SEQ ID NO: 298147 - DNA, 25 bp, Mus musculus
caagcttgaaggtggcgtggcctat

SEQ ID NO: 298148 - DNA, 25 bp, Mus musculus
caagcttgcatacttcctgttgaac

SEQ ID NO: 298149 - DNA, 25 bp, Mus musculus
caagcttgcatagttcctgttgaac

SEQ ID NO: 298150 - DNA, 25 bp, Mus musculus
caagcttgccgtcagatgaaggcct

SEQ ID NO: 298151 - DNA, 25 bp, Mus musculus
caagcttgccgtgagatgaaggcct

SEQ ID NO: 298152 - DNA, 25 bp, Mus musculus
caagcttgctttcattgcgttgaaa

SEQ ID NO: 298153 - DNA, 25 bp, Mus musculus
caagcttgctttgattgcgttgaaa

SEQ ID NO: 298154 - DNA, 25 bp, Mus musculus
caagcttggactctgaatttcttga

SEQ ID NO: 298155 - DNA, 25 bp, Mus musculus
caagcttggactgtgaatttcttga

SEQ ID NO: 298156 - DNA, 25 bp, Mus musculus
caagcttggcccctggaaagctgta

SEQ ID NO: 298157 - DNA, 25 bp, Mus musculus
caagcttggcccgtggaaagctgta

SEQ ID NO: 298158 - DNA, 25 bp, Mus musculus
caagcttggcttatcttccttaaga

SEQ ID NO: 298159 - DNA, 25 bp, Mus musculus
caagcttggcttcaatgcacattat

SEQ ID NO: 298160 - DNA, 25 bp, Mus musculus
caagcttggcttgaatgcacattat

SEQ ID NO: 298161 - DNA, 25 bp, Mus musculus
caagcttggcttttcttccttaaga

SEQ ID NO: 298162 - DNA, 25 bp, Mus musculus
caagcttgggaactttggttgcaaa

SEQ ID NO: 298163 - DNA, 25 bp, Mus musculus
caagcttgggaagtttggttgcaaa

SEQ ID NO: 298164 - DNA, 25 bp, Mus musculus
caagcttggtggcttacatcagtaa

SEQ ID NO: 298165 - DNA, 25 bp, Mus musculus
caagcttggtgggttacatcagtaa

SEQ ID NO: 298166 - DNA, 25 bp, Mus musculus
caagcttggttcatgcttgcctgtt

SEQ ID NO: 298167 - DNA, 25 bp, Mus musculus
caagcttggttcttgcttgcctgtt

SEQ ID NO: 298168 - DNA, 25 bp, Mus musculus
caagcttgtattaagtgggctattt

SEQ ID NO: 298169 - DNA, 25 bp, Mus musculus
caagcttgtatttagtgggctattt

SEQ ID NO: 298170 - DNA, 25 bp, Mus musculus
caagcttgtcagatgaggtaccggt

SEQ ID NO: 298171 - DNA, 25 bp, Mus musculus
caagcttgtcagttgaggtaccggt

SEQ ID NO: 298172 - DNA, 25 bp, Mus musculus
caagcttgtgagacagaggccgtta

SEQ ID NO: 298173 - DNA, 25 bp, Mus musculus
caagcttgtgagtcagaggccgtta

SEQ ID NO: 298174 - DNA, 25 bp, Mus musculus
caagcttgtgcgatgatgttatgtt

SEQ ID NO: 298175 - DNA, 25 bp, Mus musculus
caagcttgtgcgttgatgttatgtt

SEQ ID NO: 298176 - DNA, 25 bp, Mus musculus
caagctttaactcatgtctgcctat

SEQ ID NO: 298177 - DNA, 25 bp, Mus musculus
caagctttaactgatgtctgcctat

SEQ ID NO: 298178 - DNA, 25 bp, Mus musculus
caagctttaagacgcctgtatcccc

SEQ ID NO: 298179 - DNA, 25 bp, Mus musculus
caagctttaagaggcctgtatcccc

SEQ ID NO: 298180 - DNA, 25 bp, Mus musculus
caagctttatggagcttccagcaac

SEQ ID NO: 298181 - DNA, 25 bp, Mus musculus
caagctttatggtgcttccagcaac

SEQ ID NO: 298182 - DNA, 25 bp, Mus musculus
caagctttcaacctgagtttggtcc

SEQ ID NO: 298183 - DNA, 25 bp, Mus musculus
caagctttcaacgtgagtttggtcc

SEQ ID NO: 298184 - DNA, 25 bp, Mus musculus
caagctttcattcccacaggtgagg

SEQ ID NO: 298185 - DNA, 25 bp, Mus musculus
caagctttcattgccacaggtgagg

SEQ ID NO: 298186 - DNA, 25 bp, Mus musculus
caagctttccagatatgtcctgcta

SEQ ID NO: 298187 - DNA, 25 bp, Mus musculus
caagctttccagttatgtcctgcta

SEQ ID NO: 298188 - DNA, 25 bp, Mus musculus
caagctttcctcaagttgttttctt

SEQ ID NO: 298189 - DNA, 25 bp, Mus musculus
caagctttcctctagttgttttctt

SEQ ID NO: 298190 - DNA, 25 bp, Mus musculus
caagctttcctgcaggctgttgctg

SEQ ID NO: 298191 - DNA, 25 bp, Mus musculus
caagctttcctggaggctgttgctg

SEQ ID NO: 298192 - DNA, 25 bp, Mus musculus
caagctttgacccattggagtagga

SEQ ID NO: 298193 - DNA, 25 bp, Mus musculus
caagctttgaccgattggagtagga

SEQ ID NO: 298194 - DNA, 25 bp, Mus musculus
caagctttgcatatctttgtaacag

SEQ ID NO: 298195 - DNA, 25 bp, Mus musculus
caagctttgcatttctttgtaacag

SEQ ID NO: 298196 - DNA, 25 bp, Mus musculus
caagctttgccacgagacacgtgat

SEQ ID NO: 298197 - DNA, 25 bp, Mus musculus
caagctttgccaggagacacgtgat

SEQ ID NO: 298198 - DNA, 25 bp, Mus musculus
caagctttgtccatctttgagatca

SEQ ID NO: 298199 - DNA, 25 bp, Mus musculus
caagctttgtccttctttgagatca

SEQ ID NO: 298200 - DNA, 25 bp, Mus musculus
caagctttgtgaagcaattctaggc

SEQ ID NO: 298201 - DNA, 25 bp, Mus musculus
caagctttgtgatgcaattctaggc

SEQ ID NO: 298202 - DNA, 25 bp, Mus musculus
caagcttttccaaacttccagatga

SEQ ID NO: 298203 - DNA, 25 bp, Mus musculus
caagcttttccatacttccagatga

SEQ ID NO: 298204 - DNA, 25 bp, Mus musculus
caagcttttctcataaatcagatgt

SEQ ID NO: 298205 - DNA, 25 bp, Mus musculus
caagcttttctcttaaatcagatgt

SEQ ID NO: 298206 - DNA, 25 bp, Mus musculus
caagctttttacaactgatccattg

SEQ ID NO: 298207 - DNA, 25 bp, Mus musculus
caagctttttactactgatccattg

SEQ ID NO: 298208 - DNA, 25 bp, Mus musculus
caagctttttctccgtgtacccagg

SEQ ID NO: 298209 - DNA, 25 bp, Mus musculus
caagctttttctgcgtgtacccagg

SEQ ID NO: 298210 - DNA, 25 bp, Mus musculus
caaggaaaatccagagtgccctgtt

SEQ ID NO: 298211 - DNA, 25 bp, Mus musculus
caaggaaaatccctctttggcttct

SEQ ID NO: 298212 - DNA, 25 bp, Mus musculus
caaggaaaatccgtctttggcttct

SEQ ID NO: 298213 - DNA, 25 bp, Mus musculus
caaggaaaatcctgagtgccctgtt

SEQ ID NO: 298214 - DNA, 25 bp, Mus musculus
caaggaaagacaagcccggaactaa

SEQ ID NO: 298215 - DNA, 25 bp, Mus musculus
caaggaaagacatgcccggaactaa

SEQ ID NO: 298216 - DNA, 25 bp, Mus musculus
caaggaaagtacaggtcaagactat

SEQ ID NO: 298217 - DNA, 25 bp, Mus musculus
caaggaaagtactggtcaagactat

SEQ ID NO: 298218 - DNA, 25 bp, Mus musculus
caaggaaatcctaacgatgctgatg

SEQ ID NO: 298219 - DNA, 25 bp, Mus musculus
caaggaaatccttacgatgctgatg

SEQ ID NO: 298220 - DNA, 25 bp, Mus musculus
caaggaaatctcatggttctagatt

SEQ ID NO: 298221 - DNA, 25 bp, Mus musculus
caaggaaatctcttggttctagatt

SEQ ID NO: 298222 - DNA, 25 bp, Mus musculus
caaggaacaccaaggaacgccaacg

SEQ ID NO: 298223 - DNA, 25 bp, Mus musculus
caaggaacaccatggaacgccaacg

SEQ ID NO: 298224 - DNA, 25 bp, Mus musculus
caaggaacatgaccgtctgcagatt

SEQ ID NO: 298225 - DNA, 25 bp, Mus musculus
caaggaacatgagcgtctgcagatt

SEQ ID NO: 298226 - DNA, 25 bp, Mus musculus
caaggaaccagcatggcggtaccgc

SEQ ID NO: 298227 - DNA, 25 bp, Mus musculus
caaggaaccagcttggcggtaccgc

SEQ ID NO: 298228 - DNA, 25 bp, Mus musculus
caaggaacccatatcattcttgcct

SEQ ID NO: 298229 - DNA, 25 bp, Mus musculus
caaggaacccatttcattcttgcct

SEQ ID NO: 298230 - DNA, 25 bp, Mus musculus
caaggaacccctatgctaggttgca

SEQ ID NO: 298231 - DNA, 25 bp, Mus musculus
caaggaacccctttgctaggttgca

SEQ ID NO: 298232 - DNA, 25 bp, Mus musculus
caaggaaccctgacatgcataagag

SEQ ID NO: 298233 - DNA, 25 bp, Mus musculus
caaggaaccctgtcatgcataagag

SEQ ID NO: 298234 - DNA, 25 bp, Mus musculus
caaggaacccttacctagcaacaga

SEQ ID NO: 298235 - DNA, 25 bp, Mus musculus
caaggaaccctttcctagcaacaga

SEQ ID NO: 298236 - DNA, 25 bp, Mus musculus
caaggaacggacagtggctcagata

SEQ ID NO: 298237 - DNA, 25 bp, Mus musculus
caaggaacggactgtggctcagata

SEQ ID NO: 298238 - DNA, 25 bp, Mus musculus
caaggaagagtaagctgaattcagc

SEQ ID NO: 298239 - DNA, 25 bp, Mus musculus
caaggaagagtatgctgaattcagc

SEQ ID NO: 298240 - DNA, 25 bp, Mus musculus
caaggaagagttaactaccctccag

SEQ ID NO: 298241 - DNA, 25 bp, Mus musculus
caaggaagagtttactaccctccag

SEQ ID NO: 298242 - DNA, 25 bp, Mus musculus
caaggaagctatcccggaaggctga

SEQ ID NO: 298243 - DNA, 25 bp, Mus musculus
caaggaagctatgccggaaggctga

SEQ ID NO: 298244 - DNA, 25 bp, Mus musculus
caaggaagctttctccctattcgat

SEQ ID NO: 298245 - DNA, 25 bp, Mus musculus
caaggaagctttgtccctattcgat

SEQ ID NO: 298246 - DNA, 25 bp, Mus musculus
caaggaaggatccagaagctaaaac

SEQ ID NO: 298247 - DNA, 25 bp, Mus musculus
caaggaaggatcgagaagctaaaac

SEQ ID NO: 298248 - DNA, 25 bp, Mus musculus
caaggaaggctgatctttttatctt

SEQ ID NO: 298249 - DNA, 25 bp, Mus musculus
caaggaaggctgttctttttatctt

SEQ ID NO: 298250 - DNA, 25 bp, Mus musculus
caaggaaggcttagtgtctgtctgt

SEQ ID NO: 298251 - DNA, 25 bp, Mus musculus
caaggaaggctttgtgtctgtctgt

SEQ ID NO: 298252 - DNA, 25 bp, Mus musculus
caaggaaggtgcaacgccttcatta

SEQ ID NO: 298253 - DNA, 25 bp, Mus musculus
caaggaaggtgctacgccttcatta

SEQ ID NO: 298254 - DNA, 25 bp, Mus musculus
caaggaagttcacgctctcacgcgt

SEQ ID NO: 298255 - DNA, 25 bp, Mus musculus
caaggaagttcaggctctcacgcgt

SEQ ID NO: 298256 - DNA, 25 bp, Mus musculus
caaggaagttgtaatctggcagagg

SEQ ID NO: 298257 - DNA, 25 bp, Mus musculus
caaggaagttgttatctggcagagg

SEQ ID NO: 298258 - DNA, 25 bp, Mus musculus
caaggaatatgtcacttgtcacaca

SEQ ID NO: 298259 - DNA, 25 bp, Mus musculus
caaggaatatgtgacttgtcacaca

SEQ ID NO: 298260 - DNA, 25 bp, Mus musculus
caaggaatctctcgtaaagtagggt

SEQ ID NO: 298261 - DNA, 25 bp, Mus musculus
caaggaatctctggtaaagtagggt

SEQ ID NO: 298262 - DNA, 25 bp, Mus musculus
caaggaatggtaccccattgggttg

SEQ ID NO: 298263 - DNA, 25 bp, Mus musculus
caaggaatggtagcccattgggttg

SEQ ID NO: 298264 - DNA, 25 bp, Mus musculus
caaggaattatcagcgcgctggaat

SEQ ID NO: 298265 - DNA, 25 bp, Mus musculus
caaggaattatctgcgcgctggaat

SEQ ID NO: 298266 - DNA, 25 bp, Mus musculus
caaggaattgttcgctgtatttacc

SEQ ID NO: 298267 - DNA, 25 bp, Mus musculus
caaggaattgttggctgtatttacc

SEQ ID NO: 298268 - DNA, 25 bp, Mus musculus
caaggaatttccacattggcagatt

SEQ ID NO: 298269 - DNA, 25 bp, Mus musculus
caaggaatttcctcattggcagatt

SEQ ID NO: 298270 - DNA, 25 bp, Mus musculus
caaggacaacacatcctgagggaga

SEQ ID NO: 298271 - DNA, 25 bp, Mus musculus
caaggacaacacttcctgagggaga

SEQ ID NO: 298272 - DNA, 25 bp, Mus musculus
caaggacaagatccggttcctcttc

SEQ ID NO: 298273 - DNA, 25 bp, Mus musculus
caaggacaagatgcggttcctcttc

SEQ ID NO: 298274 - DNA, 25 bp, Mus musculus
caaggacaatggaggatgccagcaa

SEQ ID NO: 298275 - DNA, 25 bp, Mus musculus
caaggacaatggtggatgccagcaa

SEQ ID NO: 298276 - DNA, 25 bp, Mus musculus
caaggacacatgcaactcatacagg

SEQ ID NO: 298277 - DNA, 25 bp, Mus musculus
caaggacacatggaactcatacagg

SEQ ID NO: 298278 - DNA, 25 bp, Mus musculus
caaggacacccaccagaggagagct

SEQ ID NO: 298279 - DNA, 25 bp, Mus musculus
caaggacacccagcagaggagagct

SEQ ID NO: 298280 - DNA, 25 bp, Mus musculus
caaggacagctgagggcataggaca

SEQ ID NO: 298281 - DNA, 25 bp, Mus musculus
caaggacagctgtgggcataggaca

SEQ ID NO: 298282 - DNA, 25 bp, Mus musculus
caaggacatactccgcaaagccgtg

SEQ ID NO: 298283 - DNA, 25 bp, Mus musculus
caaggacatactgcgcaaagccgtg

SEQ ID NO: 298284 - DNA, 25 bp, Mus musculus
caaggacatcctacagcaagctgca

SEQ ID NO: 298285 - DNA, 25 bp, Mus musculus
caaggacatccttcagcaagctgca

SEQ ID NO: 298286 - DNA, 25 bp, Mus musculus
caaggacatcttattctaagaggaa

SEQ ID NO: 298287 - DNA, 25 bp, Mus musculus
caaggacatctttttctaagaggaa

SEQ ID NO: 298288 - DNA, 25 bp, Mus musculus
caaggaccaccacgctgtttcagct

SEQ ID NO: 298289 - DNA, 25 bp, Mus musculus
caaggaccaccaggctgtttcagct

SEQ ID NO: 298290 - DNA, 25 bp, Mus musculus
caaggaccacccattgacctgtgat

SEQ ID NO: 298291 - DNA, 25 bp, Mus musculus
caaggaccaccctttgacctgtgat

SEQ ID NO: 298292 - DNA, 25 bp, Mus musculus
caaggaccccaaagcacccaagagg

SEQ ID NO: 298293 - DNA, 25 bp, Mus musculus
caaggaccccaacctgttcagtata

SEQ ID NO: 298294 - DNA, 25 bp, Mus musculus
caaggaccccaagctgttcagtata

SEQ ID NO: 298295 - DNA, 25 bp, Mus musculus
caaggaccccaatgcacccaagagg

SEQ ID NO: 298296 - DNA, 25 bp, Mus musculus
caaggacctagaaacccacacttag

SEQ ID NO: 298297 - DNA, 25 bp, Mus musculus
caaggacctagatacccacacttag

SEQ ID NO: 298298 - DNA, 25 bp, Mus musculus
caaggacctcctagtgaacaaaatt

SEQ ID NO: 298299 - DNA, 25 bp, Mus musculus
caaggacctccttgtgaacaaaatt

SEQ ID NO: 298300 - DNA, 25 bp, Mus musculus
caaggacctgagaggctgtggccaa

SEQ ID NO: 298301 - DNA, 25 bp, Mus musculus
caaggacctgagtggctgtggccaa

SEQ ID NO: 298302 - DNA, 25 bp, Mus musculus
caaggacctgatagtgtctcagatg

SEQ ID NO: 298303 - DNA, 25 bp, Mus musculus
caaggacctgattgtgtctcagatg

SEQ ID NO: 298304 - DNA, 25 bp, Mus musculus
caaggacctttactcacggagccat

SEQ ID NO: 298305 - DNA, 25 bp, Mus musculus
caaggacctttagtcacggagccat

SEQ ID NO: 298306 - DNA, 25 bp, Mus musculus
caaggacctttgcaccagacaagaa

SEQ ID NO: 298307 - DNA, 25 bp, Mus musculus
caaggacctttggaccagacaagaa

SEQ ID NO: 298308 - DNA, 25 bp, Mus musculus
caaggaccttttcaaagccaccctg

SEQ ID NO: 298309 - DNA, 25 bp, Mus musculus
caaggaccttttgaaagccaccctg

SEQ ID NO: 298310 - DNA, 25 bp, Mus musculus
caaggacgccatagtgcaagctgtg

SEQ ID NO: 298311 - DNA, 25 bp, Mus musculus
caaggacgccattgtgcaagctgtg

SEQ ID NO: 298312 - DNA, 25 bp, Mus musculus
caaggacggcacagaggccatgctt

SEQ ID NO: 298313 - DNA, 25 bp, Mus musculus
caaggacggcactgaggccatgctt

SEQ ID NO: 298314 - DNA, 25 bp, Mus musculus
caaggacggtacctgggcacacaac

SEQ ID NO: 298315 - DNA, 25 bp, Mus musculus
caaggacggtacgtgggcacacaac

SEQ ID NO: 298316 - DNA, 25 bp, Mus musculus
caaggacgtgagcatcgagccctgt

SEQ ID NO: 298317 - DNA, 25 bp, Mus musculus
caaggacgtgaggatcgagccctgt

SEQ ID NO: 298318 - DNA, 25 bp, Mus musculus
caaggacgtgtgattgtccaaatag

SEQ ID NO: 298319 - DNA, 25 bp, Mus musculus
caaggacgtgtgtttgtccaaatag

SEQ ID NO: 298320 - DNA, 25 bp, Mus musculus
caaggacgttggcacagactgtgta

SEQ ID NO: 298321 - DNA, 25 bp, Mus musculus
caaggacgttgggacagactgtgta

SEQ ID NO: 298322 - DNA, 25 bp, Mus musculus
caaggactaagaccactttcaggaa

SEQ ID NO: 298323 - DNA, 25 bp, Mus musculus
caaggactaagagcactttcaggaa

SEQ ID NO: 298324 - DNA, 25 bp, Mus musculus
caaggactaccaagtagcaacttta

SEQ ID NO: 298325 - DNA, 25 bp, Mus musculus
caaggactaccatgtagcaacttta

SEQ ID NO: 298326 - DNA, 25 bp, Mus musculus
caaggactagctctggttcaacaaa

SEQ ID NO: 298327 - DNA, 25 bp, Mus musculus
caaggactagctgtggttcaacaaa

SEQ ID NO: 298328 - DNA, 25 bp, Mus musculus
caaggactagtgctctcacccagag

SEQ ID NO: 298329 - DNA, 25 bp, Mus musculus
caaggactagtggtctcacccagag

SEQ ID NO: 298330 - DNA, 25 bp, Mus musculus
caaggactatgtccgtgaccgtgct

SEQ ID NO: 298331 - DNA, 25 bp, Mus musculus
caaggactatgtgcgtgaccgtgct

SEQ ID NO: 298332 - DNA, 25 bp, Mus musculus
caaggactcattcacttcatcaaaa

SEQ ID NO: 298333 - DNA, 25 bp, Mus musculus
caaggactcattgacttcatcaaaa

SEQ ID NO: 298334 - DNA, 25 bp, Mus musculus
caaggactctgaaggtgtggacatc

SEQ ID NO: 298335 - DNA, 25 bp, Mus musculus
caaggactctgatggtgtggacatc

SEQ ID NO: 298336 - DNA, 25 bp, Mus musculus
caaggactgcatccaaattccaaat

SEQ ID NO: 298337 - DNA, 25 bp, Mus musculus
caaggactgcatgcaaattccaaat

SEQ ID NO: 298338 - DNA, 25 bp, Mus musculus
caaggactgtctcaacgtgctgaac

SEQ ID NO: 298339 - DNA, 25 bp, Mus musculus
caaggactgtctgaacgtgctgaac

SEQ ID NO: 298340 - DNA, 25 bp, Mus musculus
caaggactgtgtctgcaaaggtgaa

SEQ ID NO: 298341 - DNA, 25 bp, Mus musculus
caaggactgtgtgtgcaaaggtgaa

SEQ ID NO: 298342 - DNA, 25 bp, Mus musculus
caaggacttacgaccgtcatggagt

SEQ ID NO: 298343 - DNA, 25 bp, Mus musculus
caaggacttacgtccgtcatggagt

SEQ ID NO: 298344 - DNA, 25 bp, Mus musculus
caaggacttggtcccgatttagaga

SEQ ID NO: 298345 - DNA, 25 bp, Mus musculus
caaggacttggtgccgatttagaga

SEQ ID NO: 298346 - DNA, 25 bp, Mus musculus
caaggactttgtccctaacctttca

SEQ ID NO: 298347 - DNA, 25 bp, Mus musculus
caaggactttgtgcctaacctttca

SEQ ID NO: 298348 - DNA, 25 bp, Mus musculus
caaggagaacctaattcttacaccg

SEQ ID NO: 298349 - DNA, 25 bp, Mus musculus
caaggagaaccttattcttacaccg

SEQ ID NO: 298350 - DNA, 25 bp, Mus musculus
caaggagaagctatctgggcgctct

SEQ ID NO: 298351 - DNA, 25 bp, Mus musculus
caaggagaagctttctgggcgctct

SEQ ID NO: 298352 - DNA, 25 bp, Mus musculus
caaggagacagaataaggagccagt

SEQ ID NO: 298353 - DNA, 25 bp, Mus musculus
caaggagacagattaaggagccagt

SEQ ID NO: 298354 - DNA, 25 bp, Mus musculus
caaggagacagcagccttcccagag

SEQ ID NO: 298355 - DNA, 25 bp, Mus musculus
caaggagacagctgccttcccagag

SEQ ID NO: 298356 - DNA, 25 bp, Mus musculus
caaggagacagtcactcagcgccct

SEQ ID NO: 298357 - DNA, 25 bp, Mus musculus
caaggagacagtgactcagcgccct

SEQ ID NO: 298358 - DNA, 25 bp, Mus musculus
caaggagactatcaggcatgccctc

SEQ ID NO: 298359 - DNA, 25 bp, Mus musculus
caaggagactatgaggcatgccctc

SEQ ID NO: 298360 - DNA, 25 bp, Mus musculus
caaggagactggattctgcggcttc

SEQ ID NO: 298361 - DNA, 25 bp, Mus musculus
caaggagactggtttctgcggcttc

SEQ ID NO: 298362 - DNA, 25 bp, Mus musculus
caaggagagctcagtcatgctgcag

SEQ ID NO: 298363 - DNA, 25 bp, Mus musculus
caaggagagctctgtcatgctgcag

SEQ ID NO: 298364 - DNA, 25 bp, Mus musculus
caaggagagcttaagtgttcggagt

SEQ ID NO: 298365 - DNA, 25 bp, Mus musculus
caaggagagctttagtgttcggagt

SEQ ID NO: 298366 - DNA, 25 bp, Mus musculus
caaggagaggcgcacattcattcac

SEQ ID NO: 298367 - DNA, 25 bp, Mus musculus
caaggagaggcggacattcattcac

SEQ ID NO: 298368 - DNA, 25 bp, Mus musculus
caaggagaggctctttcacttctaa

SEQ ID NO: 298369 - DNA, 25 bp, Mus musculus
caaggagaggctgtttcacttctaa

SEQ ID NO: 298370 - DNA, 25 bp, Mus musculus
caaggagagtgacccaactgtgcca

SEQ ID NO: 298371 - DNA, 25 bp, Mus musculus
caaggagagtgagccaactgtgcca

SEQ ID NO: 298372 - DNA, 25 bp, Mus musculus
caaggagatctaaactgtggtgtga

SEQ ID NO: 298373 - DNA, 25 bp, Mus musculus
caaggagatctatactgtggtgtga

SEQ ID NO: 298374 - DNA, 25 bp, Mus musculus
caaggagatctgcataaagaggaaa

SEQ ID NO: 298375 - DNA, 25 bp, Mus musculus
caaggagatctggataaagaggaaa

SEQ ID NO: 298376 - DNA, 25 bp, Mus musculus
caaggagatggtcattccttacccc

SEQ ID NO: 298377 - DNA, 25 bp, Mus musculus
caaggagatggtgattccttacccc

SEQ ID NO: 298378 - DNA, 25 bp, Mus musculus
caaggagatgtgattctggaggtat

SEQ ID NO: 298379 - DNA, 25 bp, Mus musculus
caaggagatgtgtttctggaggtat

SEQ ID NO: 298380 - DNA, 25 bp, Mus musculus
caaggagcatgaattccggacggct

SEQ ID NO: 298381 - DNA, 25 bp, Mus musculus
caaggagcatgatttccggacggct

SEQ ID NO: 298382 - DNA, 25 bp, Mus musculus
caaggagccatgaaccacagggccc

SEQ ID NO: 298383 - DNA, 25 bp, Mus musculus
caaggagccatgtaccacagggccc

SEQ ID NO: 298384 - DNA, 25 bp, Mus musculus
caaggagcccctacatgttgatgag

SEQ ID NO: 298385 - DNA, 25 bp, Mus musculus
caaggagccccttcatgttgatgag

SEQ ID NO: 298386 - DNA, 25 bp, Mus musculus
caaggagccttactctaggaagaca

SEQ ID NO: 298387 - DNA, 25 bp, Mus musculus
caaggagccttagtctaggaagaca

SEQ ID NO: 298388 - DNA, 25 bp, Mus musculus
caaggagccttccatcttcagagaa

SEQ ID NO: 298389 - DNA, 25 bp, Mus musculus
caaggagccttcgatcttcagagaa

SEQ ID NO: 298390 - DNA, 25 bp, Mus musculus
caaggagcgcatctcgtagtgcatc

SEQ ID NO: 298391 - DNA, 25 bp, Mus musculus
caaggagcgcatgtcgtagtgcatc

SEQ ID NO: 298392 - DNA, 25 bp, Mus musculus
caaggagcgccaccctggaacagca

SEQ ID NO: 298393 - DNA, 25 bp, Mus musculus
caaggagcgccagcctggaacagca

SEQ ID NO: 298394 - DNA, 25 bp, Mus musculus
caaggagctatcactttgcattaga

SEQ ID NO: 298395 - DNA, 25 bp, Mus musculus
caaggagctatctctttgcattaga

SEQ ID NO: 298396 - DNA, 25 bp, Mus musculus
caaggagctcagaagattatcattt

SEQ ID NO: 298397 - DNA, 25 bp, Mus musculus
caaggagctcagtagattatcattt

SEQ ID NO: 298398 - DNA, 25 bp, Mus musculus
caaggagctcttcggcctgtggata

SEQ ID NO: 298399 - DNA, 25 bp, Mus musculus
caaggagctcttgggcctgtggata

SEQ ID NO: 298400 - DNA, 25 bp, Mus musculus
caaggagctgcgcttcatcatctat

SEQ ID NO: 298401 - DNA, 25 bp, Mus musculus
caaggagctgcggttcatcatctat

SEQ ID NO: 298402 - DNA, 25 bp, Mus musculus
caaggaggaattacagcggcttcag

SEQ ID NO: 298403 - DNA, 25 bp, Mus musculus
caaggaggaatttcagcggcttcag

SEQ ID NO: 298404 - DNA, 25 bp, Mus musculus
caaggaggacaacaacggacacgat

SEQ ID NO: 298405 - DNA, 25 bp, Mus musculus
caaggaggacaagaacggacacgat

SEQ ID NO: 298406 - DNA, 25 bp, Mus musculus
caaggaggacacaggccatgatttg

SEQ ID NO: 298407 - DNA, 25 bp, Mus musculus
caaggaggacactggccatgatttg

SEQ ID NO: 298408 - DNA, 25 bp, Mus musculus
caaggaggacataaaaccaatcttt

SEQ ID NO: 298409 - DNA, 25 bp, Mus musculus
caaggaggacattaaaccaatcttt

SEQ ID NO: 298410 - DNA, 25 bp, Mus musculus
caaggaggagacacccgcctccggt

SEQ ID NO: 298411 - DNA, 25 bp, Mus musculus
caaggaggagactcccgcctccggt

SEQ ID NO: 298412 - DNA, 25 bp, Mus musculus
caaggaggcattccggcagctgtcc

SEQ ID NO: 298413 - DNA, 25 bp, Mus musculus
caaggaggcattgcggcagctgtcc

SEQ ID NO: 298414 - DNA, 25 bp, Mus musculus
caaggaggccttctgtcccttttgg

SEQ ID NO: 298415 - DNA, 25 bp, Mus musculus
caaggaggccttgtgtcccttttgg

SEQ ID NO: 298416 - DNA, 25 bp, Mus musculus
caaggaggcgccagagccaaggcct

SEQ ID NO: 298417 - DNA, 25 bp, Mus musculus
caaggaggcgcctgagccaaggcct

SEQ ID NO: 298418 - DNA, 25 bp, Mus musculus
caaggaggctcacctgcctgtgatt

SEQ ID NO: 298419 - DNA, 25 bp, Mus musculus
caaggaggctcagctgcctgtgatt

SEQ ID NO: 298420 - DNA, 25 bp, Mus musculus
caaggaggctgaaggtaccactact

SEQ ID NO: 298421 - DNA, 25 bp, Mus musculus
caaggaggctgatggtaccactact

SEQ ID NO: 298422 - DNA, 25 bp, Mus musculus
caaggaggtatcaggcactgtcttc

SEQ ID NO: 298423 - DNA, 25 bp, Mus musculus
caaggaggtatctggcactgtcttc

SEQ ID NO: 298424 - DNA, 25 bp, Mus musculus
caaggaggtggtcctttacgtcaaa

SEQ ID NO: 298425 - DNA, 25 bp, Mus musculus
caaggaggtggtgctttacgtcaaa

SEQ ID NO: 298426 - DNA, 25 bp, Mus musculus
caaggaggtgtaattcgctgagcga

SEQ ID NO: 298427 - DNA, 25 bp, Mus musculus
caaggaggtgtatttcgctgagcga

SEQ ID NO: 298428 - DNA, 25 bp, Mus musculus
caaggaggtgtcatcagccaggaga

SEQ ID NO: 298429 - DNA, 25 bp, Mus musculus
caaggaggtgtcttcagccaggaga

SEQ ID NO: 298430 - DNA, 25 bp, Mus musculus
caaggaggttctacgggacgcttct

SEQ ID NO: 298431 - DNA, 25 bp, Mus musculus
caaggaggttcttcgggacgcttct

SEQ ID NO: 298432 - DNA, 25 bp, Mus musculus
caaggagtacagaccaatgacgatg

SEQ ID NO: 298433 - DNA, 25 bp, Mus musculus
caaggagtacagtccaatgacgatg

SEQ ID NO: 298434 - DNA, 25 bp, Mus musculus
caaggagtcaccaacgcatttcagc

SEQ ID NO: 298435 - DNA, 25 bp, Mus musculus
caaggagtcacctacgcatttcagc

SEQ ID NO: 298436 - DNA, 25 bp, Mus musculus
caaggagtcattagagtctttttat

SEQ ID NO: 298437 - DNA, 25 bp, Mus musculus
caaggagtcatttgagtctttttat

SEQ ID NO: 298438 - DNA, 25 bp, Mus musculus
caaggagtctaactctgtctacatc

SEQ ID NO: 298439 - DNA, 25 bp, Mus musculus
caaggagtctaagtctgtctacatc

SEQ ID NO: 298440 - DNA, 25 bp, Mus musculus
caaggagtctacatggtactgggta

SEQ ID NO: 298441 - DNA, 25 bp, Mus musculus
caaggagtctacttggtactgggta

SEQ ID NO: 298442 - DNA, 25 bp, Mus musculus
caaggagtgtccacagaatggcgtt

SEQ ID NO: 298443 - DNA, 25 bp, Mus musculus
caaggagtgtcctcagaatggcgtt

SEQ ID NO: 298444 - DNA, 25 bp, Mus musculus
caaggagttatgatgacacccaaag

SEQ ID NO: 298445 - DNA, 25 bp, Mus musculus
caaggagttatgttgacacccaaag

SEQ ID NO: 298446 - DNA, 25 bp, Mus musculus
caaggagttcagatcaccatggtag

SEQ ID NO: 298447 - DNA, 25 bp, Mus musculus
caaggagttcagttcaccatggtag

SEQ ID NO: 298448 - DNA, 25 bp, Mus musculus
caaggagttcatatctctgtagact

SEQ ID NO: 298449 - DNA, 25 bp, Mus musculus
caaggagttcatttctctgtagact

SEQ ID NO: 298450 - DNA, 25 bp, Mus musculus
caaggagtttttcgacaatgagaaa

SEQ ID NO: 298451 - DNA, 25 bp, Mus musculus
caaggagtttttggacaatgagaaa

SEQ ID NO: 298452 - DNA, 25 bp, Mus musculus
caaggataccacatgcccattactt

SEQ ID NO: 298453 - DNA, 25 bp, Mus musculus
caaggataccacttgcccattactt

SEQ ID NO: 298454 - DNA, 25 bp, Mus musculus
caaggatactgtattgcccaaggca

SEQ ID NO: 298455 - DNA, 25 bp, Mus musculus
caaggatactgttttgcccaaggca

SEQ ID NO: 298456 - DNA, 25 bp, Mus musculus
caaggatactttaggatttactata

SEQ ID NO: 298457 - DNA, 25 bp, Mus musculus
caaggatacttttggatttactata

SEQ ID NO: 298458 - DNA, 25 bp, Mus musculus
caaggatagttgaacctacctcata

SEQ ID NO: 298459 - DNA, 25 bp, Mus musculus
caaggatagttgtacctacctcata

SEQ ID NO: 298460 - DNA, 25 bp, Mus musculus
caaggatattctcggcaacaaagtc

SEQ ID NO: 298461 - DNA, 25 bp, Mus musculus
caaggatattctgggcaacaaagtc

SEQ ID NO: 298462 - DNA, 25 bp, Mus musculus
caaggatattgcctttgttacaaac

SEQ ID NO: 298463 - DNA, 25 bp, Mus musculus
caaggatattgcgtttgttacaaac

SEQ ID NO: 298464 - DNA, 25 bp, Mus musculus
caaggatcaagtaatgctcctccca

SEQ ID NO: 298465 - DNA, 25 bp, Mus musculus
caaggatcaagttatgctcctccca

SEQ ID NO: 298466 - DNA, 25 bp, Mus musculus
caaggatcctccaagtttacagttt

SEQ ID NO: 298467 - DNA, 25 bp, Mus musculus
caaggatcctcctagtttacagttt

SEQ ID NO: 298468 - DNA, 25 bp, Mus musculus
caaggatccttcaaacacaaacgct

SEQ ID NO: 298469 - DNA, 25 bp, Mus musculus
caaggatccttctaacacaaacgct

SEQ ID NO: 298470 - DNA, 25 bp, Mus musculus
caaggatctgctattccactgtgga

SEQ ID NO: 298471 - DNA, 25 bp, Mus musculus
caaggatctgcttttccactgtgga

SEQ ID NO: 298472 - DNA, 25 bp, Mus musculus
caaggatgacctctaactttgatca

SEQ ID NO: 298473 - DNA, 25 bp, Mus musculus
caaggatgacctgtaactttgatca

SEQ ID NO: 298474 - DNA, 25 bp, Mus musculus
caaggatgctctagcctgtagttta

SEQ ID NO: 298475 - DNA, 25 bp, Mus musculus
caaggatgctcttgcctgtagttta

SEQ ID NO: 298476 - DNA, 25 bp, Mus musculus
caaggatggcgacgtttactgcatt

SEQ ID NO: 298477 - DNA, 25 bp, Mus musculus
caaggatggcgaggtttactgcatt

SEQ ID NO: 298478 - DNA, 25 bp, Mus musculus
caaggatgtatcacagatgctgctg

SEQ ID NO: 298479 - DNA, 25 bp, Mus musculus
caaggatgtatctcagatgctgctg

SEQ ID NO: 298480 - DNA, 25 bp, Mus musculus
caaggattaggtctgtcttccctcc

SEQ ID NO: 298481 - DNA, 25 bp, Mus musculus
caaggattaggtgtgtcttccctcc

SEQ ID NO: 298482 - DNA, 25 bp, Mus musculus
caaggattcaagcttggcctcgtga

SEQ ID NO: 298483 - DNA, 25 bp, Mus musculus
caaggattcaaggttggcctcgtga

SEQ ID NO: 298484 - DNA, 25 bp, Mus musculus
caaggattcggtatctgcaatttta

SEQ ID NO: 298485 - DNA, 25 bp, Mus musculus
caaggattcggtttctgcaatttta

SEQ ID NO: 298486 - DNA, 25 bp, Mus musculus
caaggattgctcagtattctacttt

SEQ ID NO: 298487 - DNA, 25 bp, Mus musculus
caaggattgctctgtattctacttt

SEQ ID NO: 298488 - DNA, 25 bp, Mus musculus
caaggattgggacccaaggtctcca

SEQ ID NO: 298489 - DNA, 25 bp, Mus musculus
caaggattgggagccaaggtctcca

SEQ ID NO: 298490 - DNA, 25 bp, Mus musculus
caaggatttctacgaccatggagaa

SEQ ID NO: 298491 - DNA, 25 bp, Mus musculus
caaggatttctaggaccatggagaa

SEQ ID NO: 298492 - DNA, 25 bp, Mus musculus
caaggatttgaacttctttccacgt

SEQ ID NO: 298493 - DNA, 25 bp, Mus musculus
caaggatttgaagttctttccacgt

SEQ ID NO: 298494 - DNA, 25 bp, Mus musculus
caaggatttttgctaaccccatcta

SEQ ID NO: 298495 - DNA, 25 bp, Mus musculus
caaggatttttggtaaccccatcta

SEQ ID NO: 298496 - DNA, 25 bp, Mus musculus
caaggcaaaatcagcttcatccctc

SEQ ID NO: 298497 - DNA, 25 bp, Mus musculus
caaggcaaaatctgcttcatccctc

SEQ ID NO: 298498 - DNA, 25 bp, Mus musculus
caaggcaaagatccaggacaaggag

SEQ ID NO: 298499 - DNA, 25 bp, Mus musculus
caaggcaaagatgcaggacaaggag

SEQ ID NO: 298500 - DNA, 25 bp, Mus musculus
caaggcaaaggcaatcggaaaggtt

SEQ ID NO: 298501 - DNA, 25 bp, Mus musculus
caaggcaaaggctatcggaaaggtt

SEQ ID NO: 298502 - DNA, 25 bp, Mus musculus
caaggcaacttaccaaaggcagagt

SEQ ID NO: 298503 - DNA, 25 bp, Mus musculus
caaggcaacttagcaaaggcagagt

SEQ ID NO: 298504 - DNA, 25 bp, Mus musculus
caaggcaagcacatttccaattgtg

SEQ ID NO: 298505 - DNA, 25 bp, Mus musculus
caaggcaagcacttttccaattgtg

SEQ ID NO: 298506 - DNA, 25 bp, Mus musculus
caaggcaagcatcaagagttttcat

SEQ ID NO: 298507 - DNA, 25 bp, Mus musculus
caaggcaagcatgaagagttttcat

SEQ ID NO: 298508 - DNA, 25 bp, Mus musculus
caaggcacacctcatgcattttgtg

SEQ ID NO: 298509 - DNA, 25 bp, Mus musculus
caaggcacacctgatgcattttgtg

SEQ ID NO: 298510 - DNA, 25 bp, Mus musculus
caaggcacattcaaggcttcctgtt

SEQ ID NO: 298511 - DNA, 25 bp, Mus musculus
caaggcacattctaggcttcctgtt

SEQ ID NO: 298512 - DNA, 25 bp, Mus musculus
caaggcacccagctaagtggtcaaa

SEQ ID NO: 298513 - DNA, 25 bp, Mus musculus
caaggcacccaggtaagtggtcaaa

SEQ ID NO: 298514 - DNA, 25 bp, Mus musculus
caaggcaccttacacagacccaaaa

SEQ ID NO: 298515 - DNA, 25 bp, Mus musculus
caaggcaccttagacagacccaaaa

SEQ ID NO: 298516 - DNA, 25 bp, Mus musculus
caaggcacgaggactgtcctctgga

SEQ ID NO: 298517 - DNA, 25 bp, Mus musculus
caaggcacgaggtctgtcctctgga

SEQ ID NO: 298518 - DNA, 25 bp, Mus musculus
caaggcacgattagctgctctggat

SEQ ID NO: 298519 - DNA, 25 bp, Mus musculus
caaggcacgatttgctgctctggat

SEQ ID NO: 298520 - DNA, 25 bp, Mus musculus
caaggcacgcggattctgtgagtta

SEQ ID NO: 298521 - DNA, 25 bp, Mus musculus
caaggcacgcggtttctgtgagtta

SEQ ID NO: 298522 - DNA, 25 bp, Mus musculus
caaggcacggatacatcggctgcat

SEQ ID NO: 298523 - DNA, 25 bp, Mus musculus
caaggcacggattcatcggctgcat

SEQ ID NO: 298524 - DNA, 25 bp, Mus musculus
caaggcactggaacgtagtcttcaa

SEQ ID NO: 298525 - DNA, 25 bp, Mus musculus
caaggcactggatcgtagtcttcaa

SEQ ID NO: 298526 - DNA, 25 bp, Mus musculus
caaggcacttttcaattgtattggt

SEQ ID NO: 298527 - DNA, 25 bp, Mus musculus
caaggcacttttgaattgtattggt

SEQ ID NO: 298528 - DNA, 25 bp, Mus musculus
caaggcagaacacaaacagttcctg

SEQ ID NO: 298529 - DNA, 25 bp, Mus musculus
caaggcagaacagaaacagttcctg

SEQ ID NO: 298530 - DNA, 25 bp, Mus musculus
caaggcagagtcactctcgttctga

SEQ ID NO: 298531 - DNA, 25 bp, Mus musculus
caaggcagagtctctctcgttctga

SEQ ID NO: 298532 - DNA, 25 bp, Mus musculus
caaggcagccagattgtgttctttt

SEQ ID NO: 298533 - DNA, 25 bp, Mus musculus
caaggcagccagtttgtgttctttt

SEQ ID NO: 298534 - DNA, 25 bp, Mus musculus
caaggcagccttccgtcggtgcaga

SEQ ID NO: 298535 - DNA, 25 bp, Mus musculus
caaggcagccttgcgtcggtgcaga

SEQ ID NO: 298536 - DNA, 25 bp, Mus musculus
caaggcagctaactgctttctgttt

SEQ ID NO: 298537 - DNA, 25 bp, Mus musculus
caaggcagctaagtgctttctgttt

SEQ ID NO: 298538 - DNA, 25 bp, Mus musculus
caaggcagctcccatgtttacatca

SEQ ID NO: 298539 - DNA, 25 bp, Mus musculus
caaggcagctccgatgtttacatca

SEQ ID NO: 298540 - DNA, 25 bp, Mus musculus
caaggcagtgtacagttttatgtct

SEQ ID NO: 298541 - DNA, 25 bp, Mus musculus
caaggcagtgtagagttttatgtct

SEQ ID NO: 298542 - DNA, 25 bp, Mus musculus
caaggcatgcctcagttggtagaga

SEQ ID NO: 298543 - DNA, 25 bp, Mus musculus
caaggcatgcctgagttggtagaga

SEQ ID NO: 298544 - DNA, 25 bp, Mus musculus
caaggcattatgcagttgttgggaa

SEQ ID NO: 298545 - DNA, 25 bp, Mus musculus
caaggcattatggagttgttgggaa

SEQ ID NO: 298546 - DNA, 25 bp, Mus musculus
caaggcatttgcataattgaggctc

SEQ ID NO: 298547 - DNA, 25 bp, Mus musculus
caaggcatttgcttaattgaggctc

SEQ ID NO: 298548 - DNA, 25 bp, Mus musculus
caaggcattttgatatggctcctcc

SEQ ID NO: 298549 - DNA, 25 bp, Mus musculus
caaggcattttgttatggctcctcc

SEQ ID NO: 298550 - DNA, 25 bp, Mus musculus
caaggccaacctcaggtaatagtaa

SEQ ID NO: 298551 - DNA, 25 bp, Mus musculus
caaggccaacctgaggtaatagtaa

SEQ ID NO: 298552 - DNA, 25 bp, Mus musculus
caaggccaagaacacggtggacaag

SEQ ID NO: 298553 - DNA, 25 bp, Mus musculus
caaggccaagaagacggtggacaag

SEQ ID NO: 298554 - DNA, 25 bp, Mus musculus
caaggccaagatccaagacaaggaa

SEQ ID NO: 298555 - DNA, 25 bp, Mus musculus
caaggccaagatgcaagacaaggaa

SEQ ID NO: 298556 - DNA, 25 bp, Mus musculus
caaggccaaggcagccggtgatgac

SEQ ID NO: 298557 - DNA, 25 bp, Mus musculus
caaggccaaggctgccggtgatgac

SEQ ID NO: 298558 - DNA, 25 bp, Mus musculus
caaggccaagggaaaataagaccag

SEQ ID NO: 298559 - DNA, 25 bp, Mus musculus
caaggccaagggtaaataagaccag

SEQ ID NO: 298560 - DNA, 25 bp, Mus musculus
caaggccaaggtcaccgcgaaagct

SEQ ID NO: 298561 - DNA, 25 bp, Mus musculus
caaggccaaggtgaccgcgaaagct

SEQ ID NO: 298562 - DNA, 25 bp, Mus musculus
caaggccaagtacttgaaaggacat

SEQ ID NO: 298563 - DNA, 25 bp, Mus musculus
caaggccaagtagttgaaaggacat

SEQ ID NO: 298564 - DNA, 25 bp, Mus musculus
caaggccaagttcacagtggagact

SEQ ID NO: 298565 - DNA, 25 bp, Mus musculus
caaggccaagttgacagtggagact

SEQ ID NO: 298566 - DNA, 25 bp, Mus musculus
caaggccactttacaccacaaacta

SEQ ID NO: 298567 - DNA, 25 bp, Mus musculus
caaggccacttttcaccacaaacta

SEQ ID NO: 298568 - DNA, 25 bp, Mus musculus
caaggccaggatcctgtcacagcag

SEQ ID NO: 298569 - DNA, 25 bp, Mus musculus
caaggccaggatgctgtcacagcag

SEQ ID NO: 298570 - DNA, 25 bp, Mus musculus
caaggccagggaacaggtgcgtatc

SEQ ID NO: 298571 - DNA, 25 bp, Mus musculus
caaggccagggatcaggtgcgtatc

SEQ ID NO: 298572 - DNA, 25 bp, Mus musculus
caaggccagggcaatcatgaaggaa

SEQ ID NO: 298573 - DNA, 25 bp, Mus musculus
caaggccagggctatcatgaaggaa

SEQ ID NO: 298574 - DNA, 25 bp, Mus musculus
caaggccaggtcagctgtattcaaa

SEQ ID NO: 298575 - DNA, 25 bp, Mus musculus
caaggccaggtctgctgtattcaaa

SEQ ID NO: 298576 - DNA, 25 bp, Mus musculus
caaggccagtcaacattttctccaa

SEQ ID NO: 298577 - DNA, 25 bp, Mus musculus
caaggccagtcatcattttctccaa

SEQ ID NO: 298578 - DNA, 25 bp, Mus musculus
caaggccagtgacctggtacacctg

SEQ ID NO: 298579 - DNA, 25 bp, Mus musculus
caaggccagtgactttgttctgtga

SEQ ID NO: 298580 - DNA, 25 bp, Mus musculus
caaggccagtgagctggtacacctg

SEQ ID NO: 298581 - DNA, 25 bp, Mus musculus
caaggccagtgagtttgttctgtga

SEQ ID NO: 298582 - DNA, 25 bp, Mus musculus
caaggccagtgtatccccagtttgt

SEQ ID NO: 298583 - DNA, 25 bp, Mus musculus
caaggccagtgtttccccagtttgt

SEQ ID NO: 298584 - DNA, 25 bp, Mus musculus
caaggccatatccatgcgaactcct

SEQ ID NO: 298585 - DNA, 25 bp, Mus musculus
caaggccatatcgatgcgaactcct

SEQ ID NO: 298586 - DNA, 25 bp, Mus musculus
caaggccatgctccaactggatgaa

SEQ ID NO: 298587 - DNA, 25 bp, Mus musculus
caaggccatgctgcaactggatgaa

SEQ ID NO: 298588 - DNA, 25 bp, Mus musculus
caaggccattctcggcttcaacagt

SEQ ID NO: 298589 - DNA, 25 bp, Mus musculus
caaggccattctgggcttcaacagt

SEQ ID NO: 298590 - DNA, 25 bp, Mus musculus
caaggccattgaacaagacaagttt

SEQ ID NO: 298591 - DNA, 25 bp, Mus musculus
caaggccattgatcaagacaagttt

SEQ ID NO: 298592 - DNA, 25 bp, Mus musculus
caaggccatttgcttctcacaaaaa

SEQ ID NO: 298593 - DNA, 25 bp, Mus musculus
caaggccatttggttctcacaaaaa

SEQ ID NO: 298594 - DNA, 25 bp, Mus musculus
caaggcccaagtcttttatgagcgt

SEQ ID NO: 298595 - DNA, 25 bp, Mus musculus
caaggcccaagtgttttatgagcgt

SEQ ID NO: 298596 - DNA, 25 bp, Mus musculus
caaggcccagcactgtactacagtc

SEQ ID NO: 298597 - DNA, 25 bp, Mus musculus
caaggcccagcagtgtactacagtc

SEQ ID NO: 298598 - DNA, 25 bp, Mus musculus
caaggcccaggacagtacgtatgtt

SEQ ID NO: 298599 - DNA, 25 bp, Mus musculus
caaggcccaggagagtacgtatgtt

SEQ ID NO: 298600 - DNA, 25 bp, Mus musculus
caaggcccagtaatggacttccttc

SEQ ID NO: 298601 - DNA, 25 bp, Mus musculus
caaggcccagtattggacttccttc

SEQ ID NO: 298602 - DNA, 25 bp, Mus musculus
caaggcccatatctcaacctgtcta

SEQ ID NO: 298603 - DNA, 25 bp, Mus musculus
caaggcccatatgtcaacctgtcta

SEQ ID NO: 298604 - DNA, 25 bp, Mus musculus
caaggccccgtgcagaaggtgtaca

SEQ ID NO: 298605 - DNA, 25 bp, Mus musculus
caaggccccgtggagaaggtgtaca

SEQ ID NO: 298606 - DNA, 25 bp, Mus musculus
caaggcccctgtatagtttgcaaga

SEQ ID NO: 298607 - DNA, 25 bp, Mus musculus
caaggcccctgtttagtttgcaaga

SEQ ID NO: 298608 - DNA, 25 bp, Mus musculus
caaggccccttgagtgcttctgtga

SEQ ID NO: 298609 - DNA, 25 bp, Mus musculus
caaggccccttgtgtgcttctgtga

SEQ ID NO: 298610 - DNA, 25 bp, Mus musculus
caaggccctatgactaagtactaga

SEQ ID NO: 298611 - DNA, 25 bp, Mus musculus
caaggccctatgtctaagtactaga

SEQ ID NO: 298612 - DNA, 25 bp, Mus musculus
caaggccctgtcacgggaaatcgct

SEQ ID NO: 298613 - DNA, 25 bp, Mus musculus
caaggccctgtctcgggaaatcgct

SEQ ID NO: 298614 - DNA, 25 bp, Mus musculus
caaggcccttccaatatgtttacgt

SEQ ID NO: 298615 - DNA, 25 bp, Mus musculus
caaggcccttcctatatgtttacgt

SEQ ID NO: 298616 - DNA, 25 bp, Mus musculus
caaggccctttacttattagtcata

SEQ ID NO: 298617 - DNA, 25 bp, Mus musculus
caaggccctttagttattagtcata

SEQ ID NO: 298618 - DNA, 25 bp, Mus musculus
caaggccgacctatctatcaatggt

SEQ ID NO: 298619 - DNA, 25 bp, Mus musculus
caaggccgacctttctatcaatggt

SEQ ID NO: 298620 - DNA, 25 bp, Mus musculus
caaggccggccacatcgatgcgaga

SEQ ID NO: 298621 - DNA, 25 bp, Mus musculus
caaggccggccagatcgatgcgaga

SEQ ID NO: 298622 - DNA, 25 bp, Mus musculus
caaggccgtggaagaattttattcc

SEQ ID NO: 298623 - DNA, 25 bp, Mus musculus
caaggccgtggatgaattttattcc

SEQ ID NO: 298624 - DNA, 25 bp, Mus musculus
caaggccgtgtcatggagagaccca

SEQ ID NO: 298625 - DNA, 25 bp, Mus musculus
caaggccgtgtcttggagagaccca

SEQ ID NO: 298626 - DNA, 25 bp, Mus musculus
caaggcctatatccactgatgaaga

SEQ ID NO: 298627 - DNA, 25 bp, Mus musculus
caaggcctatatgcactgatgaaga

SEQ ID NO: 298628 - DNA, 25 bp, Mus musculus
caaggcctcaagacaccactgaggc

SEQ ID NO: 298629 - DNA, 25 bp, Mus musculus
caaggcctcaagtcaccactgaggc

SEQ ID NO: 298630 - DNA, 25 bp, Mus musculus
caaggcctgcctaggctgtagaaag

SEQ ID NO: 298631 - DNA, 25 bp, Mus musculus
caaggcctgccttggctgtagaaag

SEQ ID NO: 298632 - DNA, 25 bp, Mus musculus
caaggcctggatcatgcttaatcaa

SEQ ID NO: 298633 - DNA, 25 bp, Mus musculus
caaggcctggatgatgcttaatcaa

SEQ ID NO: 298634 - DNA, 25 bp, Mus musculus
caaggccttagaaccctcctgtagg

SEQ ID NO: 298635 - DNA, 25 bp, Mus musculus
caaggccttagatccctcctgtagg

SEQ ID NO: 298636 - DNA, 25 bp, Mus musculus
caaggccttatcaggaatgggacat

SEQ ID NO: 298637 - DNA, 25 bp, Mus musculus
caaggccttatctggaatgggacat

SEQ ID NO: 298638 - DNA, 25 bp, Mus musculus
caaggccttcctagctatataggga

SEQ ID NO: 298639 - DNA, 25 bp, Mus musculus
caaggccttccttgctatataggga

SEQ ID NO: 298640 - DNA, 25 bp, Mus musculus
caaggccttcgtctgtgccgggcaa

SEQ ID NO: 298641 - DNA, 25 bp, Mus musculus
caaggccttcgtgtgtgccgggcaa

SEQ ID NO: 298642 - DNA, 25 bp, Mus musculus
caaggccttggacagtgcgctgaaa

SEQ ID NO: 298643 - DNA, 25 bp, Mus musculus
caaggccttggacttcctgctgtgg

SEQ ID NO: 298644 - DNA, 25 bp, Mus musculus
caaggccttggagagtgcgctgaaa

SEQ ID NO: 298645 - DNA, 25 bp, Mus musculus
caaggccttggagttcctgctgtgg

SEQ ID NO: 298646 - DNA, 25 bp, Mus musculus
caaggccttgggactcgtgtgttaa

SEQ ID NO: 298647 - DNA, 25 bp, Mus musculus
caaggccttgggtctcgtgtgttaa

SEQ ID NO: 298648 - DNA, 25 bp, Mus musculus
caaggcctttgcaatgttgggagca

SEQ ID NO: 298649 - DNA, 25 bp, Mus musculus
caaggcctttgctatgttgggagca

SEQ ID NO: 298650 - DNA, 25 bp, Mus musculus
caaggcgagcggactttgggcttct

SEQ ID NO: 298651 - DNA, 25 bp, Mus musculus
caaggcgagcggtctttgggcttct

SEQ ID NO: 298652 - DNA, 25 bp, Mus musculus
caaggcgattgcattggcagctggt

SEQ ID NO: 298653 - DNA, 25 bp, Mus musculus
caaggcgattgctttggcagctggt

SEQ ID NO: 298654 - DNA, 25 bp, Mus musculus
caaggcggataacaaggcagctcag

SEQ ID NO: 298655 - DNA, 25 bp, Mus musculus
caaggcggataagaaggcagctcag

SEQ ID NO: 298656 - DNA, 25 bp, Mus musculus
caaggcgtagccactaaatgcgaga

SEQ ID NO: 298657 - DNA, 25 bp, Mus musculus
caaggcgtagcctctaaatgcgaga

SEQ ID NO: 298658 - DNA, 25 bp, Mus musculus
caaggcgtccggacttgaggctgct

SEQ ID NO: 298659 - DNA, 25 bp, Mus musculus
caaggcgtccggtcttgaggctgct

SEQ ID NO: 298660 - DNA, 25 bp, Mus musculus
caaggcgtgcacagagcaacaccat

SEQ ID NO: 298661 - DNA, 25 bp, Mus musculus
caaggcgtgcactgagcaacaccat

SEQ ID NO: 298662 - DNA, 25 bp, Mus musculus
caaggctaacccataactcctgagg

SEQ ID NO: 298663 - DNA, 25 bp, Mus musculus
caaggctaacccttaactcctgagg

SEQ ID NO: 298664 - DNA, 25 bp, Mus musculus
caaggctaatgtactgacccttctc

SEQ ID NO: 298665 - DNA, 25 bp, Mus musculus
caaggctaatgttctgacccttctc

SEQ ID NO: 298666 - DNA, 25 bp, Mus musculus
caaggctacatgatgagaccctacc

SEQ ID NO: 298667 - DNA, 25 bp, Mus musculus
caaggctacatgttgagaccctacc

SEQ ID NO: 298668 - DNA, 25 bp, Mus musculus
caaggctaccttcggcttcagatga

SEQ ID NO: 298669 - DNA, 25 bp, Mus musculus
caaggctaccttgggcttcagatga

SEQ ID NO: 298670 - DNA, 25 bp, Mus musculus
caaggctagcgcagacggtcatgac

SEQ ID NO: 298671 - DNA, 25 bp, Mus musculus
caaggctagcgctgacggtcatgac

SEQ ID NO: 298672 - DNA, 25 bp, Mus musculus
caaggctagctcctatcagagttat

SEQ ID NO: 298673 - DNA, 25 bp, Mus musculus
caaggctagctcgtatcagagttat

SEQ ID NO: 298674 - DNA, 25 bp, Mus musculus
caaggctaggccacatagtaagtat

SEQ ID NO: 298675 - DNA, 25 bp, Mus musculus
caaggctaggcctcatagtaagtat

SEQ ID NO: 298676 - DNA, 25 bp, Mus musculus
caaggctagtgtcgctgctgtcagt

SEQ ID NO: 298677 - DNA, 25 bp, Mus musculus
caaggctagtgtggctgctgtcagt

SEQ ID NO: 298678 - DNA, 25 bp, Mus musculus
caaggctatcgcagtcgggactgtg

SEQ ID NO: 298679 - DNA, 25 bp, Mus musculus
caaggctatcgctgtcgggactgtg

SEQ ID NO: 298680 - DNA, 25 bp, Mus musculus
caaggctatggcactaatatacaaa

SEQ ID NO: 298681 - DNA, 25 bp, Mus musculus
caaggctatggctctaatatacaaa

SEQ ID NO: 298682 - DNA, 25 bp, Mus musculus
caaggctatttaaaaagctcggtaa

SEQ ID NO: 298683 - DNA, 25 bp, Mus musculus
caaggctatttataaagctcggtaa

SEQ ID NO: 298684 - DNA, 25 bp, Mus musculus
caaggctcacttcaaacatttcaca

SEQ ID NO: 298685 - DNA, 25 bp, Mus musculus
caaggctcacttgaaacatttcaca

SEQ ID NO: 298686 - DNA, 25 bp, Mus musculus
caaggctcatggcatgctctgtgta

SEQ ID NO: 298687 - DNA, 25 bp, Mus musculus
caaggctcatgggatgctctgtgta

SEQ ID NO: 298688 - DNA, 25 bp, Mus musculus
caaggctcccacaatgtcatatatt

SEQ ID NO: 298689 - DNA, 25 bp, Mus musculus
caaggctcccactatgtcatatatt

SEQ ID NO: 298690 - DNA, 25 bp, Mus musculus
caaggctccttccaaattctagatg

SEQ ID NO: 298691 - DNA, 25 bp, Mus musculus
caaggctccttcgaaattctagatg

SEQ ID NO: 298692 - DNA, 25 bp, Mus musculus
caaggctccttgaagtttgtaatgt

SEQ ID NO: 298693 - DNA, 25 bp, Mus musculus
caaggctccttgtagtttgtaatgt

SEQ ID NO: 298694 - DNA, 25 bp, Mus musculus
caaggctctaacaactttgcttttt

SEQ ID NO: 298695 - DNA, 25 bp, Mus musculus
caaggctctaactactttgcttttt

SEQ ID NO: 298696 - DNA, 25 bp, Mus musculus
caaggctctagtactagcgtttgat

SEQ ID NO: 298697 - DNA, 25 bp, Mus musculus
caaggctctagtcctcagataccat

SEQ ID NO: 298698 - DNA, 25 bp, Mus musculus
caaggctctagtgctcagataccat

SEQ ID NO: 298699 - DNA, 25 bp, Mus musculus
caaggctctagttctagcgtttgat

SEQ ID NO: 298700 - DNA, 25 bp, Mus musculus
caaggctgaattaattacctgaaat

SEQ ID NO: 298701 - DNA, 25 bp, Mus musculus
caaggctgaatttattacctgaaat

SEQ ID NO: 298702 - DNA, 25 bp, Mus musculus
caaggctgagacatagtagcacttt

SEQ ID NO: 298703 - DNA, 25 bp, Mus musculus
caaggctgagacttagtagcacttt

SEQ ID NO: 298704 - DNA, 25 bp, Mus musculus
caaggctgagcacaggtttcccttt

SEQ ID NO: 298705 - DNA, 25 bp, Mus musculus
caaggctgagcagaggtttcccttt

SEQ ID NO: 298706 - DNA, 25 bp, Mus musculus
caaggctgagtgaggttttcatttt

SEQ ID NO: 298707 - DNA, 25 bp, Mus musculus
caaggctgagtgtggttttcatttt

SEQ ID NO: 298708 - DNA, 25 bp, Mus musculus
caaggctgatccacccttagagaaa

SEQ ID NO: 298709 - DNA, 25 bp, Mus musculus
caaggctgatcctcccttagagaaa

SEQ ID NO: 298710 - DNA, 25 bp, Mus musculus
caaggctgcaataagaatgctaaga

SEQ ID NO: 298711 - DNA, 25 bp, Mus musculus
caaggctgcaattagaatgctaaga

SEQ ID NO: 298712 - DNA, 25 bp, Mus musculus
caaggctgcattaagttgatatgta

SEQ ID NO: 298713 - DNA, 25 bp, Mus musculus
caaggctgcatttagttgatatgta

SEQ ID NO: 298714 - DNA, 25 bp, Mus musculus
caaggctgctggagtaagtgtccca

SEQ ID NO: 298715 - DNA, 25 bp, Mus musculus
caaggctgctggagtgtaggtttct

SEQ ID NO: 298716 - DNA, 25 bp, Mus musculus
caaggctgctggattttcaaggctt

SEQ ID NO: 298717 - DNA, 25 bp, Mus musculus
caaggctgctggtgtaagtgtccca

SEQ ID NO: 298718 - DNA, 25 bp, Mus musculus
caaggctgctggtgtgtaggtttct

SEQ ID NO: 298719 - DNA, 25 bp, Mus musculus
caaggctgctggtttttcaaggctt

SEQ ID NO: 298720 - DNA, 25 bp, Mus musculus
caaggctggaatcagtgaaagtgac

SEQ ID NO: 298721 - DNA, 25 bp, Mus musculus
caaggctggaatgagtgaaagtgac

SEQ ID NO: 298722 - DNA, 25 bp, Mus musculus
caaggctggagaagccagtagccaa

SEQ ID NO: 298723 - DNA, 25 bp, Mus musculus
caaggctggagatgccagtagccaa

SEQ ID NO: 298724 - DNA, 25 bp, Mus musculus
caaggctggatgcatcacactcggc

SEQ ID NO: 298725 - DNA, 25 bp, Mus musculus
caaggctggatggatcacactcggc

SEQ ID NO: 298726 - DNA, 25 bp, Mus musculus
caaggctggcctctttaggtccaag

SEQ ID NO: 298727 - DNA, 25 bp, Mus musculus
caaggctggcctgtttaggtccaag

SEQ ID NO: 298728 - DNA, 25 bp, Mus musculus
caaggctggtatactggagatggca

SEQ ID NO: 298729 - DNA, 25 bp, Mus musculus
caaggctggtattctggagatggca

SEQ ID NO: 298730 - DNA, 25 bp, Mus musculus
caaggctgtatgattctcaagaaac

SEQ ID NO: 298731 - DNA, 25 bp, Mus musculus
caaggctgtatgtttctcaagaaac

SEQ ID NO: 298732 - DNA, 25 bp, Mus musculus
caaggctgtattctaactttagtat

SEQ ID NO: 298733 - DNA, 25 bp, Mus musculus
caaggctgtattgtaactttagtat

SEQ ID NO: 298734 - DNA, 25 bp, Mus musculus
caaggctgtcccctacagggaagct

SEQ ID NO: 298735 - DNA, 25 bp, Mus musculus
caaggctgtcccgtacagggaagct

SEQ ID NO: 298736 - DNA, 25 bp, Mus musculus
caaggctgtctaacagtgttgtgat

SEQ ID NO: 298737 - DNA, 25 bp, Mus musculus
caaggctgtctatcagtgttgtgat

SEQ ID NO: 298738 - DNA, 25 bp, Mus musculus
caaggctgttggctcacatttgcaa

SEQ ID NO: 298739 - DNA, 25 bp, Mus musculus
caaggctgttgggtcacatttgcaa

SEQ ID NO: 298740 - DNA, 25 bp, Mus musculus
caaggctgtttgacagagcccagcc

SEQ ID NO: 298741 - DNA, 25 bp, Mus musculus
caaggctgtttgtcagagcccagcc

SEQ ID NO: 298742 - DNA, 25 bp, Mus musculus
caaggcttcagtcaccatctttttc

SEQ ID NO: 298743 - DNA, 25 bp, Mus musculus
caaggcttcagtgaccatctttttc

SEQ ID NO: 298744 - DNA, 25 bp, Mus musculus
caaggcttcatgaacacgttgttta

SEQ ID NO: 298745 - DNA, 25 bp, Mus musculus
caaggcttcatgaattctgggcaag

SEQ ID NO: 298746 - DNA, 25 bp, Mus musculus
caaggcttcatgtacacgttgttta

SEQ ID NO: 298747 - DNA, 25 bp, Mus musculus
caaggcttcatgtattctgggcaag

SEQ ID NO: 298748 - DNA, 25 bp, Mus musculus
caaggcttctggagacggcgagtac

SEQ ID NO: 298749 - DNA, 25 bp, Mus musculus
caaggcttctggtgacggcgagtac

SEQ ID NO: 298750 - DNA, 25 bp, Mus musculus
caaggcttgaacaaaccctcgacaa

SEQ ID NO: 298751 - DNA, 25 bp, Mus musculus
caaggcttgaactaaccctcgacaa

SEQ ID NO: 298752 - DNA, 25 bp, Mus musculus
caaggcttgagtaaaagtccacact

SEQ ID NO: 298753 - DNA, 25 bp, Mus musculus
caaggcttgagttaaagtccacact

SEQ ID NO: 298754 - DNA, 25 bp, Mus musculus
caaggcttgctgacggagggaaccc

SEQ ID NO: 298755 - DNA, 25 bp, Mus musculus
caaggcttgctgtcggagggaaccc

SEQ ID NO: 298756 - DNA, 25 bp, Mus musculus
caaggcttggttcaaagacaggagt

SEQ ID NO: 298757 - DNA, 25 bp, Mus musculus
caaggcttggttgaaagacaggagt

SEQ ID NO: 298758 - DNA, 25 bp, Mus musculus
caaggcttgtagaagtcactttgtt

SEQ ID NO: 298759 - DNA, 25 bp, Mus musculus
caaggcttgtagtagtcactttgtt

SEQ ID NO: 298760 - DNA, 25 bp, Mus musculus
caaggcttgtgaatccatgtagagt

SEQ ID NO: 298761 - DNA, 25 bp, Mus musculus
caaggcttgtgattccatgtagagt

SEQ ID NO: 298762 - DNA, 25 bp, Mus musculus
caaggctttcagcatatcatttcat

SEQ ID NO: 298763 - DNA, 25 bp, Mus musculus
caaggctttcaggatatcatttcat

SEQ ID NO: 298764 - DNA, 25 bp, Mus musculus
caaggctttcttccatattcccaat

SEQ ID NO: 298765 - DNA, 25 bp, Mus musculus
caaggctttcttgcatattcccaat

SEQ ID NO: 298766 - DNA, 25 bp, Mus musculus
caaggctttgatcaggcctggaaga

SEQ ID NO: 298767 - DNA, 25 bp, Mus musculus
caaggctttgatgaggcctggaaga

SEQ ID NO: 298768 - DNA, 25 bp, Mus musculus
caaggctttggaagccattgagaaa

SEQ ID NO: 298769 - DNA, 25 bp, Mus musculus
caaggctttggatgccattgagaaa

SEQ ID NO: 298770 - DNA, 25 bp, Mus musculus
caaggctttgtaagtgcgctattct

SEQ ID NO: 298771 - DNA, 25 bp, Mus musculus
caaggctttgtatgtgcgctattct

SEQ ID NO: 298772 - DNA, 25 bp, Mus musculus
caaggcttttcaagaggtcctggag

SEQ ID NO: 298773 - DNA, 25 bp, Mus musculus
caaggcttttcatgaggtcctggag

SEQ ID NO: 298774 - DNA, 25 bp, Mus musculus
caaggcttttggatctccgtaaaga

SEQ ID NO: 298775 - DNA, 25 bp, Mus musculus
caaggcttttggttctccgtaaaga

SEQ ID NO: 298776 - DNA, 25 bp, Mus musculus
caagggaaacatcacgggctgcgta

SEQ ID NO: 298777 - DNA, 25 bp, Mus musculus
caagggaaacatgacgggctgcgta

SEQ ID NO: 298778 - DNA, 25 bp, Mus musculus
caagggaaccctcaggagtaatgaa

SEQ ID NO: 298779 - DNA, 25 bp, Mus musculus
caagggaaccctgaggagtaatgaa

SEQ ID NO: 298780 - DNA, 25 bp, Mus musculus
caagggaacggtaggctatgcgact

SEQ ID NO: 298781 - DNA, 25 bp, Mus musculus
caagggaacggttggctatgcgact

SEQ ID NO: 298782 - DNA, 25 bp, Mus musculus
caagggaactaccaggtgctcctga

SEQ ID NO: 298783 - DNA, 25 bp, Mus musculus
caagggaactacgaggtgctcctga

SEQ ID NO: 298784 - DNA, 25 bp, Mus musculus
caagggaactgaactcggagcacgt

SEQ ID NO: 298785 - DNA, 25 bp, Mus musculus
caagggaactgatctcggagcacgt

SEQ ID NO: 298786 - DNA, 25 bp, Mus musculus
caagggaaggttccactttggattt

SEQ ID NO: 298787 - DNA, 25 bp, Mus musculus
caagggaaggttgcactttggattt

SEQ ID NO: 298788 - DNA, 25 bp, Mus musculus
caagggaattaacattcctaatcct

SEQ ID NO: 298789 - DNA, 25 bp, Mus musculus
caagggaattaagattcctaatcct

SEQ ID NO: 298790 - DNA, 25 bp, Mus musculus
caagggaccttcaatgcccgggaga

SEQ ID NO: 298791 - DNA, 25 bp, Mus musculus
caagggaccttctatgcccgggaga

SEQ ID NO: 298792 - DNA, 25 bp, Mus musculus
caagggacttcgcactgtgtttcaa

SEQ ID NO: 298793 - DNA, 25 bp, Mus musculus
caagggacttcggactgtgtttcaa

SEQ ID NO: 298794 - DNA, 25 bp, Mus musculus
caagggagacgaacagggttcgctt

SEQ ID NO: 298795 - DNA, 25 bp, Mus musculus
caagggagacgatcagggttcgctt

SEQ ID NO: 298796 - DNA, 25 bp, Mus musculus
caagggagacttcgattcctctgct

SEQ ID NO: 298797 - DNA, 25 bp, Mus musculus
caagggagacttggattcctctgct

SEQ ID NO: 298798 - DNA, 25 bp, Mus musculus
caagggagaggaatcatgttccata

SEQ ID NO: 298799 - DNA, 25 bp, Mus musculus
caagggagaggattcatgttccata

SEQ ID NO: 298800 - DNA, 25 bp, Mus musculus
caagggagagggaattatgcctaac

SEQ ID NO: 298801 - DNA, 25 bp, Mus musculus
caagggagagggtattatgcctaac

SEQ ID NO: 298802 - DNA, 25 bp, Mus musculus
caagggagcatgctattaggttttt

SEQ ID NO: 298803 - DNA, 25 bp, Mus musculus
caagggagcatggtattaggttttt

SEQ ID NO: 298804 - DNA, 25 bp, Mus musculus
caagggagccatcagttgtgtaaat

SEQ ID NO: 298805 - DNA, 25 bp, Mus musculus
caagggagccatgagttgtgtaaat

SEQ ID NO: 298806 - DNA, 25 bp, Mus musculus
caagggagcgctaccagcagggcaa

SEQ ID NO: 298807 - DNA, 25 bp, Mus musculus
caagggagcgcttccagcagggcaa

SEQ ID NO: 298808 - DNA, 25 bp, Mus musculus
caagggagggccaaaaagcacttgt

SEQ ID NO: 298809 - DNA, 25 bp, Mus musculus
caagggagggcctaaaagcacttgt

SEQ ID NO: 298810 - DNA, 25 bp, Mus musculus
caagggagtcatctatcttcaatac

SEQ ID NO: 298811 - DNA, 25 bp, Mus musculus
caagggagtcatgtatcttcaatac

SEQ ID NO: 298812 - DNA, 25 bp, Mus musculus
caagggagtgtgagccaaccggtac

SEQ ID NO: 298813 - DNA, 25 bp, Mus musculus
caagggagtgtgtgccaaccggtac

SEQ ID NO: 298814 - DNA, 25 bp, Mus musculus
caagggatatagcaccctcttctgg

SEQ ID NO: 298815 - DNA, 25 bp, Mus musculus
caagggatataggaccctcttctgg

SEQ ID NO: 298816 - DNA, 25 bp, Mus musculus
caagggatgattcttactggctaca

SEQ ID NO: 298817 - DNA, 25 bp, Mus musculus
caagggatgattgttactggctaca

SEQ ID NO: 298818 - DNA, 25 bp, Mus musculus
caagggattcagaagttgcattact

SEQ ID NO: 298819 - DNA, 25 bp, Mus musculus
caagggattcagtagttgcattact

SEQ ID NO: 298820 - DNA, 25 bp, Mus musculus
caagggcaaagcaacctggtatcca

SEQ ID NO: 298821 - DNA, 25 bp, Mus musculus
caagggcaaagctacctggtatcca

SEQ ID NO: 298822 - DNA, 25 bp, Mus musculus
caagggcaacctcaatgtccatttc

SEQ ID NO: 298823 - DNA, 25 bp, Mus musculus
caagggcaacctgaatgtccatttc

SEQ ID NO: 298824 - DNA, 25 bp, Mus musculus
caagggcaatggagtatccctccca

SEQ ID NO: 298825 - DNA, 25 bp, Mus musculus
caagggcaatggtgtatccctccca

SEQ ID NO: 298826 - DNA, 25 bp, Mus musculus
caagggcaccacagacaggaactat

SEQ ID NO: 298827 - DNA, 25 bp, Mus musculus
caagggcaccactgacaggaactat

SEQ ID NO: 298828 - DNA, 25 bp, Mus musculus
caagggcagagcattggcttccata

SEQ ID NO: 298829 - DNA, 25 bp, Mus musculus
caagggcagagctttggcttccata

SEQ ID NO: 298830 - DNA, 25 bp, Mus musculus
caagggcagatgctccaaagacaga

SEQ ID NO: 298831 - DNA, 25 bp, Mus musculus
caagggcagatggtccaaagacaga

SEQ ID NO: 298832 - DNA, 25 bp, Mus musculus
caagggcagcagattttcatatgta

SEQ ID NO: 298833 - DNA, 25 bp, Mus musculus
caagggcagcagtttttcatatgta

SEQ ID NO: 298834 - DNA, 25 bp, Mus musculus
caagggcagcatctgtagtcattaa

SEQ ID NO: 298835 - DNA, 25 bp, Mus musculus
caagggcagcatgtgtagtcattaa

SEQ ID NO: 298836 - DNA, 25 bp, Mus musculus
caagggcagctcagtcctcatgaga

SEQ ID NO: 298837 - DNA, 25 bp, Mus musculus
caagggcagctctgtcctcatgaga

SEQ ID NO: 298838 - DNA, 25 bp, Mus musculus
caagggcaggatacactggagatca

SEQ ID NO: 298839 - DNA, 25 bp, Mus musculus
caagggcaggattcactggagatca

SEQ ID NO: 298840 - DNA, 25 bp, Mus musculus
caagggcaggttcagttcattgtaa

SEQ ID NO: 298841 - DNA, 25 bp, Mus musculus
caagggcaggttgagttcattgtaa

SEQ ID NO: 298842 - DNA, 25 bp, Mus musculus
caagggcatgatccgcaaacagtag

SEQ ID NO: 298843 - DNA, 25 bp, Mus musculus
caagggcatgatgcgcaaacagtag

SEQ ID NO: 298844 - DNA, 25 bp, Mus musculus
caagggcatgcacattgctcggagt

SEQ ID NO: 298845 - DNA, 25 bp, Mus musculus
caagggcatgcagattgctcggagt

SEQ ID NO: 298846 - DNA, 25 bp, Mus musculus
caagggcattcaccctgacgggtta

SEQ ID NO: 298847 - DNA, 25 bp, Mus musculus
caagggcattcagcctgacgggtta

SEQ ID NO: 298848 - DNA, 25 bp, Mus musculus
caagggccaagacttgccgcatcac

SEQ ID NO: 298849 - DNA, 25 bp, Mus musculus
caagggccaagagttgccgcatcac

SEQ ID NO: 298850 - DNA, 25 bp, Mus musculus
caagggccagctatctggtctttat

SEQ ID NO: 298851 - DNA, 25 bp, Mus musculus
caagggccagctcggacatcgtgtc

SEQ ID NO: 298852 - DNA, 25 bp, Mus musculus
caagggccagctgggacatcgtgtc

SEQ ID NO: 298853 - DNA, 25 bp, Mus musculus
caagggccagctttctggtctttat

SEQ ID NO: 298854 - DNA, 25 bp, Mus musculus
caagggccagggacggcttgattct

SEQ ID NO: 298855 - DNA, 25 bp, Mus musculus
caagggccagggagaccatgtcagt

SEQ ID NO: 298856 - DNA, 25 bp, Mus musculus
caagggccagggagcttttaacatt

SEQ ID NO: 298857 - DNA, 25 bp, Mus musculus
caagggccagggtcggcttgattct

SEQ ID NO: 298858 - DNA, 25 bp, Mus musculus
caagggccagggtgaccatgtcagt

SEQ ID NO: 298859 - DNA, 25 bp, Mus musculus
caagggccagggtgcttttaacatt

SEQ ID NO: 298860 - DNA, 25 bp, Mus musculus
caagggccatcaccgtaagtctgta

SEQ ID NO: 298861 - DNA, 25 bp, Mus musculus
caagggccatcagcgtaagtctgta

SEQ ID NO: 298862 - DNA, 25 bp, Mus musculus
caagggccctggctttgtatagagt

SEQ ID NO: 298863 - DNA, 25 bp, Mus musculus
caagggccctgggtttgtatagagt

SEQ ID NO: 298864 - DNA, 25 bp, Mus musculus
caagggcctcttcgtggagtctgac

SEQ ID NO: 298865 - DNA, 25 bp, Mus musculus
caagggcctcttggtggagtctgac

SEQ ID NO: 298866 - DNA, 25 bp, Mus musculus
caagggcctgaacctgttgcaactt

SEQ ID NO: 298867 - DNA, 25 bp, Mus musculus
caagggcctgaagctgttgcaactt

SEQ ID NO: 298868 - DNA, 25 bp, Mus musculus
caagggcctttgaaggtgcccagat

SEQ ID NO: 298869 - DNA, 25 bp, Mus musculus
caagggcctttgtaggtgcccagat

SEQ ID NO: 298870 - DNA, 25 bp, Mus musculus
caagggctacttatgattttctact

SEQ ID NO: 298871 - DNA, 25 bp, Mus musculus
caagggctacttttgattttctact

SEQ ID NO: 298872 - DNA, 25 bp, Mus musculus
caagggctaggaatgaccgtggtca

SEQ ID NO: 298873 - DNA, 25 bp, Mus musculus
caagggctaggattgaccgtggtca

SEQ ID NO: 298874 - DNA, 25 bp, Mus musculus
caagggctcaatccatagtctggat

SEQ ID NO: 298875 - DNA, 25 bp, Mus musculus
caagggctcaatgcatagtctggat

SEQ ID NO: 298876 - DNA, 25 bp, Mus musculus
caagggctccagctgccggtaataa

SEQ ID NO: 298877 - DNA, 25 bp, Mus musculus
caagggctccaggtgccggtaataa

SEQ ID NO: 298878 - DNA, 25 bp, Mus musculus
caagggctccttccaagaagctggt

SEQ ID NO: 298879 - DNA, 25 bp, Mus musculus
caagggctccttgcaagaagctggt

SEQ ID NO: 298880 - DNA, 25 bp, Mus musculus
caagggctgagcaccaagtctaaat

SEQ ID NO: 298881 - DNA, 25 bp, Mus musculus
caagggctgagctccaagtctaaat

SEQ ID NO: 298882 - DNA, 25 bp, Mus musculus
caagggctgattagcattgagacca

SEQ ID NO: 298883 - DNA, 25 bp, Mus musculus
caagggctgatttgcattgagacca

SEQ ID NO: 298884 - DNA, 25 bp, Mus musculus
caagggctgcggacttcttctgaga

SEQ ID NO: 298885 - DNA, 25 bp, Mus musculus
caagggctgcggtcttcttctgaga

SEQ ID NO: 298886 - DNA, 25 bp, Mus musculus
caagggctggatccgtgtaaaaact

SEQ ID NO: 298887 - DNA, 25 bp, Mus musculus
caagggctggatgcgtgtaaaaact

SEQ ID NO: 298888 - DNA, 25 bp, Mus musculus
caagggcttcccctgcctcaagaag

SEQ ID NO: 298889 - DNA, 25 bp, Mus musculus
caagggcttcccgtgcctcaagaag

SEQ ID NO: 298890 - DNA, 25 bp, Mus musculus
caagggcttgaaacttctggcatca

SEQ ID NO: 298891 - DNA, 25 bp, Mus musculus
caagggcttgaatcttctggcatca

SEQ ID NO: 298892 - DNA, 25 bp, Mus musculus
caagggcttgttaattccggatggg

SEQ ID NO: 298893 - DNA, 25 bp, Mus musculus
caagggcttgtttattccggatggg

SEQ ID NO: 298894 - DNA, 25 bp, Mus musculus
caagggctttcacggtacaatgact

SEQ ID NO: 298895 - DNA, 25 bp, Mus musculus
caagggctttcagggtacaatgact

SEQ ID NO: 298896 - DNA, 25 bp, Mus musculus
caagggcttttgctcactaaccttc

SEQ ID NO: 298897 - DNA, 25 bp, Mus musculus
caagggcttttggtcactaaccttc

SEQ ID NO: 298898 - DNA, 25 bp, Mus musculus
caagggggctcactcgtcctgacga

SEQ ID NO: 298899 - DNA, 25 bp, Mus musculus
caagggggctcagtcgtcctgacga

SEQ ID NO: 298900 - DNA, 25 bp, Mus musculus
caagggtaaagcaccccgtgtacag

SEQ ID NO: 298901 - DNA, 25 bp, Mus musculus
caagggtaaagctccccgtgtacag

SEQ ID NO: 298902 - DNA, 25 bp, Mus musculus
caagggtaaccacatgtagcgagcc

SEQ ID NO: 298903 - DNA, 25 bp, Mus musculus
caagggtaaccagatgtagcgagcc

SEQ ID NO: 298904 - DNA, 25 bp, Mus musculus
caagggtacatcaaatccgtgcatt

SEQ ID NO: 298905 - DNA, 25 bp, Mus musculus
caagggtacatctaatccgtgcatt

SEQ ID NO: 298906 - DNA, 25 bp, Mus musculus
caagggtacattacccggcgagtga

SEQ ID NO: 298907 - DNA, 25 bp, Mus musculus
caagggtacatttcccggcgagtga

SEQ ID NO: 298908 - DNA, 25 bp, Mus musculus
caagggtagcagagtaatggcattt

SEQ ID NO: 298909 - DNA, 25 bp, Mus musculus
caagggtagcagtgtaatggcattt

SEQ ID NO: 298910 - DNA, 25 bp, Mus musculus
caagggtatcacagtgtgccaatca

SEQ ID NO: 298911 - DNA, 25 bp, Mus musculus
caagggtatcactgtgtgccaatca

SEQ ID NO: 298912 - DNA, 25 bp, Mus musculus
caagggtatcggagaagcccctgct

SEQ ID NO: 298913 - DNA, 25 bp, Mus musculus
caagggtatcggtgaagcccctgct

SEQ ID NO: 298914 - DNA, 25 bp, Mus musculus
caagggtatgaacgcttctggcttt

SEQ ID NO: 298915 - DNA, 25 bp, Mus musculus
caagggtatgaaggcttctggcttt

SEQ ID NO: 298916 - DNA, 25 bp, Mus musculus
caagggtcaaagatctgagcagcat

SEQ ID NO: 298917 - DNA, 25 bp, Mus musculus
caagggtcaaagttctgagcagcat

SEQ ID NO: 298918 - DNA, 25 bp, Mus musculus
caagggtcactaagttacagttact

SEQ ID NO: 298919 - DNA, 25 bp, Mus musculus
caagggtcactatgttacagttact

SEQ ID NO: 298920 - DNA, 25 bp, Mus musculus
caagggtcagcgcagtgccacgtct

SEQ ID NO: 298921 - DNA, 25 bp, Mus musculus
caagggtcagcggagtgccacgtct

SEQ ID NO: 298922 - DNA, 25 bp, Mus musculus
caagggtcagggacttgtcctggta

SEQ ID NO: 298923 - DNA, 25 bp, Mus musculus
caagggtcagggtcttgtcctggta

SEQ ID NO: 298924 - DNA, 25 bp, Mus musculus
caagggtccccgattgtggcccgcg

SEQ ID NO: 298925 - DNA, 25 bp, Mus musculus
caagggtccccgtttgtggcccgcg

SEQ ID NO: 298926 - DNA, 25 bp, Mus musculus
caagggtgacgtacgggagccattc

SEQ ID NO: 298927 - DNA, 25 bp, Mus musculus
caagggtgacgttcgggagccattc

SEQ ID NO: 298928 - DNA, 25 bp, Mus musculus
caagggtgaggacactcgccagcct

SEQ ID NO: 298929 - DNA, 25 bp, Mus musculus
caagggtgaggagactcgccagcct

SEQ ID NO: 298930 - DNA, 25 bp, Mus musculus
caagggtgccaaatgcggccatggt

SEQ ID NO: 298931 - DNA, 25 bp, Mus musculus
caagggtgccaattgcggccatggt

SEQ ID NO: 298932 - DNA, 25 bp, Mus musculus
caagggtgggccatcctaggattga

SEQ ID NO: 298933 - DNA, 25 bp, Mus musculus
caagggtgggccttcctaggattga

SEQ ID NO: 298934 - DNA, 25 bp, Mus musculus
caagggtggtacatctagggactct

SEQ ID NO: 298935 - DNA, 25 bp, Mus musculus
caagggtggtacttctagggactct

SEQ ID NO: 298936 - DNA, 25 bp, Mus musculus
caagggtgtccactttcgctgttgg

SEQ ID NO: 298937 - DNA, 25 bp, Mus musculus
caagggtgtccagtttcgctgttgg

SEQ ID NO: 298938 - DNA, 25 bp, Mus musculus
caagggtgtcccctcccagtctggt

SEQ ID NO: 298939 - DNA, 25 bp, Mus musculus
caagggtgtcccgtcccagtctggt

SEQ ID NO: 298940 - DNA, 25 bp, Mus musculus
caagggtgtctgagtgtgctgaatt

SEQ ID NO: 298941 - DNA, 25 bp, Mus musculus
caagggtgtctgtgtgtgctgaatt

SEQ ID NO: 298942 - DNA, 25 bp, Mus musculus
caagggtgtgtaacatcaggcccat

SEQ ID NO: 298943 - DNA, 25 bp, Mus musculus
caagggtgtgtatcatcaggcccat

SEQ ID NO: 298944 - DNA, 25 bp, Mus musculus
caagggtgtgttccagtagcctaaa

SEQ ID NO: 298945 - DNA, 25 bp, Mus musculus
caagggtgtgttgcagtagcctaaa

SEQ ID NO: 298946 - DNA, 25 bp, Mus musculus
caagggttagggatttctcttctct

SEQ ID NO: 298947 - DNA, 25 bp, Mus musculus
caagggttagggttttctcttctct

SEQ ID NO: 298948 - DNA, 25 bp, Mus musculus
caagggttgaggaagatgttacaca

SEQ ID NO: 298949 - DNA, 25 bp, Mus musculus
caagggttgaggtagatgttacaca

SEQ ID NO: 298950 - DNA, 25 bp, Mus musculus
caagggttgtgaagaggccagcact

SEQ ID NO: 298951 - DNA, 25 bp, Mus musculus
caagggttgtgatgaggccagcact

SEQ ID NO: 298952 - DNA, 25 bp, Mus musculus
caagggtttattaatgctgcctatt

SEQ ID NO: 298953 - DNA, 25 bp, Mus musculus
caagggtttatttatgctgcctatt

SEQ ID NO: 298954 - DNA, 25 bp, Mus musculus
caagggtttcagcaggcccgtgcca

SEQ ID NO: 298955 - DNA, 25 bp, Mus musculus
caagggtttcaggaggcccgtgcca

SEQ ID NO: 298956 - DNA, 25 bp, Mus musculus
caagggtttcccaagttccatctgt

SEQ ID NO: 298957 - DNA, 25 bp, Mus musculus
caagggtttccctagttccatctgt

SEQ ID NO: 298958 - DNA, 25 bp, Mus musculus
caagggtttctgagcaatgcgatgt

SEQ ID NO: 298959 - DNA, 25 bp, Mus musculus
caagggtttctgtgcaatgcgatgt

SEQ ID NO: 298960 - DNA, 25 bp, Mus musculus
caaggtaaaggcctctctgtggtcc

SEQ ID NO: 298961 - DNA, 25 bp, Mus musculus
caaggtaaaggcgtctctgtggtcc

SEQ ID NO: 298962 - DNA, 25 bp, Mus musculus
caaggtaaatgaagctgtcagctga

SEQ ID NO: 298963 - DNA, 25 bp, Mus musculus
caaggtaaatgatgctgtcagctga

SEQ ID NO: 298964 - DNA, 25 bp, Mus musculus
caaggtaatgtgaaaactcgactct

SEQ ID NO: 298965 - DNA, 25 bp, Mus musculus
caaggtaatgtgtaaactcgactct

SEQ ID NO: 298966 - DNA, 25 bp, Mus musculus
caaggtaatgttcctgcagcgcaga

SEQ ID NO: 298967 - DNA, 25 bp, Mus musculus
caaggtaatgttgctgcagcgcaga

SEQ ID NO: 298968 - DNA, 25 bp, Mus musculus
caaggtaattcaatccctttccaga

SEQ ID NO: 298969 - DNA, 25 bp, Mus musculus
caaggtaattcattccctttccaga

SEQ ID NO: 298970 - DNA, 25 bp, Mus musculus
caaggtacagaccagtccaaaatgt

SEQ ID NO: 298971 - DNA, 25 bp, Mus musculus
caaggtacagacgagtccaaaatgt

SEQ ID NO: 298972 - DNA, 25 bp, Mus musculus
caaggtacagagaatgggcatctta

SEQ ID NO: 298973 - DNA, 25 bp, Mus musculus
caaggtacagagtatgggcatctta

SEQ ID NO: 298974 - DNA, 25 bp, Mus musculus
caaggtaccactcctgaagtgctac

SEQ ID NO: 298975 - DNA, 25 bp, Mus musculus
caaggtaccactgctgaagtgctac

SEQ ID NO: 298976 - DNA, 25 bp, Mus musculus
caaggtacccagactgagtctatct

SEQ ID NO: 298977 - DNA, 25 bp, Mus musculus
caaggtacccagtctgagtctatct

SEQ ID NO: 298978 - DNA, 25 bp, Mus musculus
caaggtacggacacgagacatggga

SEQ ID NO: 298979 - DNA, 25 bp, Mus musculus
caaggtacggactcgagacatggga

SEQ ID NO: 298980 - DNA, 25 bp, Mus musculus
caaggtactaaacctctctgttctc

SEQ ID NO: 298981 - DNA, 25 bp, Mus musculus
caaggtactaaagctctctgttctc

SEQ ID NO: 298982 - DNA, 25 bp, Mus musculus
caaggtagacacaggcatctgccac

SEQ ID NO: 298983 - DNA, 25 bp, Mus musculus
caaggtagacactggcatctgccac

SEQ ID NO: 298984 - DNA, 25 bp, Mus musculus
caaggtagacatacagcgtggtgta

SEQ ID NO: 298985 - DNA, 25 bp, Mus musculus
caaggtagacattcagcgtggtgta

SEQ ID NO: 298986 - DNA, 25 bp, Mus musculus
caaggtagcctgacttctggaatag

SEQ ID NO: 298987 - DNA, 25 bp, Mus musculus
caaggtagcctgtcttctggaatag

SEQ ID NO: 298988 - DNA, 25 bp, Mus musculus
caaggtagtgcacaaccacctgtaa

SEQ ID NO: 298989 - DNA, 25 bp, Mus musculus
caaggtagtgcagaaccacctgtaa

SEQ ID NO: 298990 - DNA, 25 bp, Mus musculus
caaggtataatcactaatgaagcgc

SEQ ID NO: 298991 - DNA, 25 bp, Mus musculus
caaggtataatctctaatgaagcgc

SEQ ID NO: 298992 - DNA, 25 bp, Mus musculus
caaggtatctaacgccctcctttgg

SEQ ID NO: 298993 - DNA, 25 bp, Mus musculus
caaggtatctaaggccctcctttgg

SEQ ID NO: 298994 - DNA, 25 bp, Mus musculus
caaggtatgcgtcttggctcccgga

SEQ ID NO: 298995 - DNA, 25 bp, Mus musculus
caaggtatgcgtgttggctcccgga

SEQ ID NO: 298996 - DNA, 25 bp, Mus musculus
caaggtatgtttctgcagcccagga

SEQ ID NO: 298997 - DNA, 25 bp, Mus musculus
caaggtatgtttgtgcagcccagga

SEQ ID NO: 298998 - DNA, 25 bp, Mus musculus
caaggtatttccatctcccagtttt

SEQ ID NO: 298999 - DNA, 25 bp, Mus musculus
caaggtatttccttctcccagtttt

SEQ ID NO: 299000 - DNA, 25 bp, Mus musculus
caaggtatttgcacccgccccagag

SEQ ID NO: 299001 - DNA, 25 bp, Mus musculus
caaggtatttgctcccgccccagag

SEQ ID NO: 299002 - DNA, 25 bp, Mus musculus
caaggtcaacttatggtgtttgcct

SEQ ID NO: 299003 - DNA, 25 bp, Mus musculus
caaggtcaacttttggtgtttgcct

SEQ ID NO: 299004 - DNA, 25 bp, Mus musculus
caaggtcacagcagtgcgcaggtga

SEQ ID NO: 299005 - DNA, 25 bp, Mus musculus
caaggtcacagctgtgcgcaggtga

SEQ ID NO: 299006 - DNA, 25 bp, Mus musculus
caaggtcaccacaaaagtgctctgt

SEQ ID NO: 299007 - DNA, 25 bp, Mus musculus
caaggtcaccactaaagtgctctgt

SEQ ID NO: 299008 - DNA, 25 bp, Mus musculus
caaggtcaccgtccttgctcgtcgg

SEQ ID NO: 299009 - DNA, 25 bp, Mus musculus
caaggtcaccgtgcttgctcgtcgg

SEQ ID NO: 299010 - DNA, 25 bp, Mus musculus
caaggtcacttgcttggctagccga

SEQ ID NO: 299011 - DNA, 25 bp, Mus musculus
caaggtcacttggttggctagccga

SEQ ID NO: 299012 - DNA, 25 bp, Mus musculus
caaggtcactttccgtgtgtcataa

SEQ ID NO: 299013 - DNA, 25 bp, Mus musculus
caaggtcactttgcgtgtgtcataa

SEQ ID NO: 299014 - DNA, 25 bp, Mus musculus
caaggtcagccgagtatggtagtgc

SEQ ID NO: 299015 - DNA, 25 bp, Mus musculus
caaggtcagccgtgtatggtagtgc

SEQ ID NO: 299016 - DNA, 25 bp, Mus musculus
caaggtcaggtcaggtctctgctgc

SEQ ID NO: 299017 - DNA, 25 bp, Mus musculus
caaggtcaggtctggtctctgctgc

SEQ ID NO: 299018 - DNA, 25 bp, Mus musculus
caaggtcatctaacccggtgtgatt

SEQ ID NO: 299019 - DNA, 25 bp, Mus musculus
caaggtcatctacatggctcgcaac

SEQ ID NO: 299020 - DNA, 25 bp, Mus musculus
caaggtcatctagatggctcgcaac

SEQ ID NO: 299021 - DNA, 25 bp, Mus musculus
caaggtcatctatcccggtgtgatt

SEQ ID NO: 299022 - DNA, 25 bp, Mus musculus
caaggtcatcttaggttatatagcc

SEQ ID NO: 299023 - DNA, 25 bp, Mus musculus
caaggtcatcttcaactacatcgtt

SEQ ID NO: 299024 - DNA, 25 bp, Mus musculus
caaggtcatcttgaactacatcgtt

SEQ ID NO: 299025 - DNA, 25 bp, Mus musculus
caaggtcatctttggttatatagcc

SEQ ID NO: 299026 - DNA, 25 bp, Mus musculus
caaggtcattgcacacggcaaagac

SEQ ID NO: 299027 - DNA, 25 bp, Mus musculus
caaggtcattgctcacggcaaagac

SEQ ID NO: 299028 - DNA, 25 bp, Mus musculus
caaggtcatttgaggctacacaaga

SEQ ID NO: 299029 - DNA, 25 bp, Mus musculus
caaggtcatttgtggctacacaaga

SEQ ID NO: 299030 - DNA, 25 bp, Mus musculus
caaggtccaccacgcctatgaggca

SEQ ID NO: 299031 - DNA, 25 bp, Mus musculus
caaggtccaccaggcctatgaggca

SEQ ID NO: 299032 - DNA, 25 bp, Mus musculus
caaggtccagggagccttggcagct

SEQ ID NO: 299033 - DNA, 25 bp, Mus musculus
caaggtccagggtgccttggcagct

SEQ ID NO: 299034 - DNA, 25 bp, Mus musculus
caaggtccatctcggaagcgggatt

SEQ ID NO: 299035 - DNA, 25 bp, Mus musculus
caaggtccatctgggaagcgggatt

SEQ ID NO: 299036 - DNA, 25 bp, Mus musculus
caaggtcccctaacaaagtattgaa

SEQ ID NO: 299037 - DNA, 25 bp, Mus musculus
caaggtcccctatcaaagtattgaa

SEQ ID NO: 299038 - DNA, 25 bp, Mus musculus
caaggtcccgacacagatcatttgg

SEQ ID NO: 299039 - DNA, 25 bp, Mus musculus
caaggtcccgactcagatcatttgg

SEQ ID NO: 299040 - DNA, 25 bp, Mus musculus
caaggtccctaaaatgtgatgcagt

SEQ ID NO: 299041 - DNA, 25 bp, Mus musculus
caaggtccctaatatgtgatgcagt

SEQ ID NO: 299042 - DNA, 25 bp, Mus musculus
caaggtccctgtcaacaagctggca

SEQ ID NO: 299043 - DNA, 25 bp, Mus musculus
caaggtccctgtgaacaagctggca

SEQ ID NO: 299044 - DNA, 25 bp, Mus musculus
caaggtcctcatccattcagagtgc

SEQ ID NO: 299045 - DNA, 25 bp, Mus musculus
caaggtcctcatgcattcagagtgc

SEQ ID NO: 299046 - DNA, 25 bp, Mus musculus
caaggtcctggaaactgttgtacaa

SEQ ID NO: 299047 - DNA, 25 bp, Mus musculus
caaggtcctggatactgttgtacaa

SEQ ID NO: 299048 - DNA, 25 bp, Mus musculus
caaggtccttataaaacctgactgt

SEQ ID NO: 299049 - DNA, 25 bp, Mus musculus
caaggtccttattaaacctgactgt

SEQ ID NO: 299050 - DNA, 25 bp, Mus musculus
caaggtccttgaatgtcacagtatt

SEQ ID NO: 299051 - DNA, 25 bp, Mus musculus
caaggtccttgattgtcacagtatt

SEQ ID NO: 299052 - DNA, 25 bp, Mus musculus
caaggtcgtcctcggtcaaagacaa

SEQ ID NO: 299053 - DNA, 25 bp, Mus musculus
caaggtcgtcctgggtcaaagacaa

SEQ ID NO: 299054 - DNA, 25 bp, Mus musculus
caaggtctacacaatgtatgtgaga

SEQ ID NO: 299055 - DNA, 25 bp, Mus musculus
caaggtctacactatgtatgtgaga

SEQ ID NO: 299056 - DNA, 25 bp, Mus musculus
caaggtctactcatggaatggattc

SEQ ID NO: 299057 - DNA, 25 bp, Mus musculus
caaggtctactcttggaatggattc

SEQ ID NO: 299058 - DNA, 25 bp, Mus musculus
caaggtctacttaatggttagccat

SEQ ID NO: 299059 - DNA, 25 bp, Mus musculus
caaggtctactttatggttagccat

SEQ ID NO: 299060 - DNA, 25 bp, Mus musculus
caaggtctcacgagggatcctacat

SEQ ID NO: 299061 - DNA, 25 bp, Mus musculus
caaggtctcacgtgggatcctacat

SEQ ID NO: 299062 - DNA, 25 bp, Mus musculus
caaggtctctcaacggagccgaagt

SEQ ID NO: 299063 - DNA, 25 bp, Mus musculus
caaggtctctcatcggagccgaagt

SEQ ID NO: 299064 - DNA, 25 bp, Mus musculus
caaggtctctggattaccaaaccag

SEQ ID NO: 299065 - DNA, 25 bp, Mus musculus
caaggtctctggtttaccaaaccag

SEQ ID NO: 299066 - DNA, 25 bp, Mus musculus
caaggtctgaacagggaacgtacgt

SEQ ID NO: 299067 - DNA, 25 bp, Mus musculus
caaggtctgaactgggaacgtacgt

SEQ ID NO: 299068 - DNA, 25 bp, Mus musculus
caaggtctgagcaaactcagcccct

SEQ ID NO: 299069 - DNA, 25 bp, Mus musculus
caaggtctgagctaactcagcccct

SEQ ID NO: 299070 - DNA, 25 bp, Mus musculus
caaggtctggccagtgcaaaacggg

SEQ ID NO: 299071 - DNA, 25 bp, Mus musculus
caaggtctggcctgtgcaaaacggg

SEQ ID NO: 299072 - DNA, 25 bp, Mus musculus
caaggtctgggaaagagtgctcaca

SEQ ID NO: 299073 - DNA, 25 bp, Mus musculus
caaggtctgggatagagtgctcaca

SEQ ID NO: 299074 - DNA, 25 bp, Mus musculus
caaggtcttaacctgataatctggt

SEQ ID NO: 299075 - DNA, 25 bp, Mus musculus
caaggtcttaacgtgataatctggt

SEQ ID NO: 299076 - DNA, 25 bp, Mus musculus
caaggtcttcctaggctatttaggg

SEQ ID NO: 299077 - DNA, 25 bp, Mus musculus
caaggtcttccttggctatttaggg

SEQ ID NO: 299078 - DNA, 25 bp, Mus musculus
caaggtcttcttcccctattaagga

SEQ ID NO: 299079 - DNA, 25 bp, Mus musculus
caaggtcttcttgccctattaagga

SEQ ID NO: 299080 - DNA, 25 bp, Mus musculus
caaggtcttgatccctaccagaagt

SEQ ID NO: 299081 - DNA, 25 bp, Mus musculus
caaggtcttgatgcctaccagaagt

SEQ ID NO: 299082 - DNA, 25 bp, Mus musculus
caaggtcttgctagtctatctcaag

SEQ ID NO: 299083 - DNA, 25 bp, Mus musculus
caaggtcttgcttgtctatctcaag

SEQ ID NO: 299084 - DNA, 25 bp, Mus musculus
caaggtcttgtacatgctagggtct

SEQ ID NO: 299085 - DNA, 25 bp, Mus musculus
caaggtcttgtagatgctagggtct

SEQ ID NO: 299086 - DNA, 25 bp, Mus musculus
caaggtcttgttccctctggtgcag

SEQ ID NO: 299087 - DNA, 25 bp, Mus musculus
caaggtcttgttgcctctggtgcag

SEQ ID NO: 299088 - DNA, 25 bp, Mus musculus
caaggtctttatcaaatgcttctga

SEQ ID NO: 299089 - DNA, 25 bp, Mus musculus
caaggtctttatgaaatgcttctga

SEQ ID NO: 299090 - DNA, 25 bp, Mus musculus
caaggtctttggcactaactagcat

SEQ ID NO: 299091 - DNA, 25 bp, Mus musculus
caaggtctttgggactaactagcat

SEQ ID NO: 299092 - DNA, 25 bp, Mus musculus
caaggtgaacaaaaccaggtgtggt

SEQ ID NO: 299093 - DNA, 25 bp, Mus musculus
caaggtgaacaataccaggtgtggt

SEQ ID NO: 299094 - DNA, 25 bp, Mus musculus
caaggtgaacctcatcaagcaggat

SEQ ID NO: 299095 - DNA, 25 bp, Mus musculus
caaggtgaacctgatcaagcaggat

SEQ ID NO: 299096 - DNA, 25 bp, Mus musculus
caaggtgaataacaaggagctgctc

SEQ ID NO: 299097 - DNA, 25 bp, Mus musculus
caaggtgaataagaaggagctgctc

SEQ ID NO: 299098 - DNA, 25 bp, Mus musculus
caaggtgaattactggaactccaac

SEQ ID NO: 299099 - DNA, 25 bp, Mus musculus
caaggtgaattagtggaactccaac

SEQ ID NO: 299100 - DNA, 25 bp, Mus musculus
caaggtgacacgaagctggcaggaa

SEQ ID NO: 299101 - DNA, 25 bp, Mus musculus
caaggtgacacgtagctggcaggaa

SEQ ID NO: 299102 - DNA, 25 bp, Mus musculus
caaggtgacatcacagcatgctgct

SEQ ID NO: 299103 - DNA, 25 bp, Mus musculus
caaggtgacatctcagcatgctgct

SEQ ID NO: 299104 - DNA, 25 bp, Mus musculus
caaggtgactatacctggccagaga

SEQ ID NO: 299105 - DNA, 25 bp, Mus musculus
caaggtgactattcctggccagaga

SEQ ID NO: 299106 - DNA, 25 bp, Mus musculus
caaggtgataggacatctgccattt

SEQ ID NO: 299107 - DNA, 25 bp, Mus musculus
caaggtgataggtcatctgccattt

SEQ ID NO: 299108 - DNA, 25 bp, Mus musculus
caaggtgatatgacccgggctggaa

SEQ ID NO: 299109 - DNA, 25 bp, Mus musculus
caaggtgatatgtcccgggctggaa

SEQ ID NO: 299110 - DNA, 25 bp, Mus musculus
caaggtgatctgagtcctcgctgtg

SEQ ID NO: 299111 - DNA, 25 bp, Mus musculus
caaggtgatctgtgtcctcgctgtg

SEQ ID NO: 299112 - DNA, 25 bp, Mus musculus
caaggtgatggcagttcctttccaa

SEQ ID NO: 299113 - DNA, 25 bp, Mus musculus
caaggtgatggctgttcctttccaa

SEQ ID NO: 299114 - DNA, 25 bp, Mus musculus
caaggtgcaacgaggttgccaaata

SEQ ID NO: 299115 - DNA, 25 bp, Mus musculus
caaggtgcaacgtggttgccaaata

SEQ ID NO: 299116 - DNA, 25 bp, Mus musculus
caaggtgccaatcatgcgggccgac

SEQ ID NO: 299117 - DNA, 25 bp, Mus musculus
caaggtgccaatgatgcgggccgac

SEQ ID NO: 299118 - DNA, 25 bp, Mus musculus
caaggtgcccaacggccgcaagtga

SEQ ID NO: 299119 - DNA, 25 bp, Mus musculus
caaggtgcccaagggccgcaagtga

SEQ ID NO: 299120 - DNA, 25 bp, Mus musculus
caaggtgccccgctcttgaatagag

SEQ ID NO: 299121 - DNA, 25 bp, Mus musculus
caaggtgccccggtcttgaatagag

SEQ ID NO: 299122 - DNA, 25 bp, Mus musculus
caaggtgcggctctgatttccatga

SEQ ID NO: 299123 - DNA, 25 bp, Mus musculus
caaggtgcggctgtgatttccatga

SEQ ID NO: 299124 - DNA, 25 bp, Mus musculus
caaggtgctaagaagaatgctgtca

SEQ ID NO: 299125 - DNA, 25 bp, Mus musculus
caaggtgctaagtagaatgctgtca

SEQ ID NO: 299126 - DNA, 25 bp, Mus musculus
caaggtgctcagagactgtgacttc

SEQ ID NO: 299127 - DNA, 25 bp, Mus musculus
caaggtgctcagtgactgtgacttc

SEQ ID NO: 299128 - DNA, 25 bp, Mus musculus
caaggtgctgatcgccctctgtgag

SEQ ID NO: 299129 - DNA, 25 bp, Mus musculus
caaggtgctgatggccctctgtgag

SEQ ID NO: 299130 - DNA, 25 bp, Mus musculus
caaggtgctggaaggttccccaata

SEQ ID NO: 299131 - DNA, 25 bp, Mus musculus
caaggtgctggatggttccccaata

SEQ ID NO: 299132 - DNA, 25 bp, Mus musculus
caaggtgcttcacaacaaacaggct

SEQ ID NO: 299133 - DNA, 25 bp, Mus musculus
caaggtgcttcagaacaaacaggct

SEQ ID NO: 299134 - DNA, 25 bp, Mus musculus
caaggtggcaacaggcttcctagtt

SEQ ID NO: 299135 - DNA, 25 bp, Mus musculus
caaggtggcaactggcttcctagtt

SEQ ID NO: 299136 - DNA, 25 bp, Mus musculus
caaggtggcccacgcacgcgagaag

SEQ ID NO: 299137 - DNA, 25 bp, Mus musculus
caaggtggcccaggcacgcgagaag

SEQ ID NO: 299138 - DNA, 25 bp, Mus musculus
caaggtggctatcgcggttccagca

SEQ ID NO: 299139 - DNA, 25 bp, Mus musculus
caaggtggctatggcggttccagca

SEQ ID NO: 299140 - DNA, 25 bp, Mus musculus
caaggtggctcaattatttcaacat

SEQ ID NO: 299141 - DNA, 25 bp, Mus musculus
caaggtggctcatttatttcaacat

SEQ ID NO: 299142 - DNA, 25 bp, Mus musculus
caaggtgggatcctccggagacata

SEQ ID NO: 299143 - DNA, 25 bp, Mus musculus
caaggtgggatcgtccggagacata

SEQ ID NO: 299144 - DNA, 25 bp, Mus musculus
caaggtgggtcccattccaggcata

SEQ ID NO: 299145 - DNA, 25 bp, Mus musculus
caaggtgggtccgattccaggcata

SEQ ID NO: 299146 - DNA, 25 bp, Mus musculus
caaggtggtaacaccgtgtgttcaa

SEQ ID NO: 299147 - DNA, 25 bp, Mus musculus
caaggtggtaactccgtgtgttcaa

SEQ ID NO: 299148 - DNA, 25 bp, Mus musculus
caaggtggtctgaggtacgactcat

SEQ ID NO: 299149 - DNA, 25 bp, Mus musculus
caaggtggtctgcagtcgagggtca

SEQ ID NO: 299150 - DNA, 25 bp, Mus musculus
caaggtggtctggagtcgagggtca

SEQ ID NO: 299151 - DNA, 25 bp, Mus musculus
caaggtggtctgtggtacgactcat

SEQ ID NO: 299152 - DNA, 25 bp, Mus musculus
caaggtggtttcagctaagtgtcta

SEQ ID NO: 299153 - DNA, 25 bp, Mus musculus
caaggtggtttctgctaagtgtcta

SEQ ID NO: 299154 - DNA, 25 bp, Mus musculus
caaggtgtagctatggcagaccatt

SEQ ID NO: 299155 - DNA, 25 bp, Mus musculus
caaggtgtagctttggcagaccatt

SEQ ID NO: 299156 - DNA, 25 bp, Mus musculus
caaggtgtcctacgtgaaagctatt

SEQ ID NO: 299157 - DNA, 25 bp, Mus musculus
caaggtgtcctaggtgaaagctatt

SEQ ID NO: 299158 - DNA, 25 bp, Mus musculus
caaggtgtctacattccagccctga

SEQ ID NO: 299159 - DNA, 25 bp, Mus musculus
caaggtgtctactttccagccctga

SEQ ID NO: 299160 - DNA, 25 bp, Mus musculus
caaggtgtgagaccactcctgaggc

SEQ ID NO: 299161 - DNA, 25 bp, Mus musculus
caaggtgtgagagcactcctgaggc

SEQ ID NO: 299162 - DNA, 25 bp, Mus musculus
caaggtgtggaactagcgctggcgc

SEQ ID NO: 299163 - DNA, 25 bp, Mus musculus
caaggtgtggaagtagcgctggcgc

SEQ ID NO: 299164 - DNA, 25 bp, Mus musculus
caaggtgtggagatttgctttgaac

SEQ ID NO: 299165 - DNA, 25 bp, Mus musculus
caaggtgtggagttttgctttgaac

SEQ ID NO: 299166 - DNA, 25 bp, Mus musculus
caaggtgtggtaagtgacatactca

SEQ ID NO: 299167 - DNA, 25 bp, Mus musculus
caaggtgtggtatgtgacatactca

SEQ ID NO: 299168 - DNA, 25 bp, Mus musculus
caaggtgtggtgaggatgctaccca

SEQ ID NO: 299169 - DNA, 25 bp, Mus musculus
caaggtgtggtgtggatgctaccca

SEQ ID NO: 299170 - DNA, 25 bp, Mus musculus
caaggtgtgtaaacaattctttagt

SEQ ID NO: 299171 - DNA, 25 bp, Mus musculus
caaggtgtgtaatcaattctttagt

SEQ ID NO: 299172 - DNA, 25 bp, Mus musculus
caaggtgtgtatacagtcagatcaa

SEQ ID NO: 299173 - DNA, 25 bp, Mus musculus
caaggtgtgtattcagtcagatcaa

SEQ ID NO: 299174 - DNA, 25 bp, Mus musculus
caaggtgttcgcagagacgctgtgt

SEQ ID NO: 299175 - DNA, 25 bp, Mus musculus
caaggtgttcgctgagacgctgtgt

SEQ ID NO: 299176 - DNA, 25 bp, Mus musculus
caaggtgttgagacagtttccacaa

SEQ ID NO: 299177 - DNA, 25 bp, Mus musculus
caaggtgttgagtcagtttccacaa

SEQ ID NO: 299178 - DNA, 25 bp, Mus musculus
caaggttaagaaacaggactctggg

SEQ ID NO: 299179 - DNA, 25 bp, Mus musculus
caaggttaagaatcaggactctggg

SEQ ID NO: 299180 - DNA, 25 bp, Mus musculus
caaggttaatacacatttgtctcct

SEQ ID NO: 299181 - DNA, 25 bp, Mus musculus
caaggttaatactcatttgtctcct

SEQ ID NO: 299182 - DNA, 25 bp, Mus musculus
caaggttaatgacgccatcttgggc

SEQ ID NO: 299183 - DNA, 25 bp, Mus musculus
caaggttaatgaggccatcttgggc

SEQ ID NO: 299184 - DNA, 25 bp, Mus musculus
caaggttacagaagccaggccacac

SEQ ID NO: 299185 - DNA, 25 bp, Mus musculus
caaggttacagatgccaggccacac

SEQ ID NO: 299186 - DNA, 25 bp, Mus musculus
caaggttacatacaccctctcttaa

SEQ ID NO: 299187 - DNA, 25 bp, Mus musculus
caaggttacatagaccctctcttaa

SEQ ID NO: 299188 - DNA, 25 bp, Mus musculus
caaggttactacagtgttcaatgaa

SEQ ID NO: 299189 - DNA, 25 bp, Mus musculus
caaggttactactgtgttcaatgaa

SEQ ID NO: 299190 - DNA, 25 bp, Mus musculus
caaggttagtccaccctctttgaga

SEQ ID NO: 299191 - DNA, 25 bp, Mus musculus
caaggttagtcctccctctttgaga

SEQ ID NO: 299192 - DNA, 25 bp, Mus musculus
caaggttatattctagggagaccct

SEQ ID NO: 299193 - DNA, 25 bp, Mus musculus
caaggttatattgtagggagaccct

SEQ ID NO: 299194 - DNA, 25 bp, Mus musculus
caaggttatcctcaactatatagta

SEQ ID NO: 299195 - DNA, 25 bp, Mus musculus
caaggttatcctgaactatatagta

SEQ ID NO: 299196 - DNA, 25 bp, Mus musculus
caaggttattcacccagcagggata

SEQ ID NO: 299197 - DNA, 25 bp, Mus musculus
caaggttattcagccagcagggata

SEQ ID NO: 299198 - DNA, 25 bp, Mus musculus
caaggttattttcggctgtgttcca

SEQ ID NO: 299199 - DNA, 25 bp, Mus musculus
caaggttattttgggctgtgttcca

SEQ ID NO: 299200 - DNA, 25 bp, Mus musculus
caaggttcactcattggccagaaag

SEQ ID NO: 299201 - DNA, 25 bp, Mus musculus
caaggttcactctttggccagaaag

SEQ ID NO: 299202 - DNA, 25 bp, Mus musculus
caaggttcacttactgggcagcatg

SEQ ID NO: 299203 - DNA, 25 bp, Mus musculus
caaggttcactttctgggcagcatg

SEQ ID NO: 299204 - DNA, 25 bp, Mus musculus
caaggttcctatagctgtttcccta

SEQ ID NO: 299205 - DNA, 25 bp, Mus musculus
caaggttcctattgctgtttcccta

SEQ ID NO: 299206 - DNA, 25 bp, Mus musculus
caaggttctcagcagttatccactc

SEQ ID NO: 299207 - DNA, 25 bp, Mus musculus
caaggttctcaggagttatccactc

SEQ ID NO: 299208 - DNA, 25 bp, Mus musculus
caaggttctcgtcgctgacaaggac

SEQ ID NO: 299209 - DNA, 25 bp, Mus musculus
caaggttctcgtggctgacaaggac

SEQ ID NO: 299210 - DNA, 25 bp, Mus musculus
caaggttctgtcagcctgaatggct

SEQ ID NO: 299211 - DNA, 25 bp, Mus musculus
caaggttctgtctgcctgaatggct

SEQ ID NO: 299212 - DNA, 25 bp, Mus musculus
caaggttcttaaaaccgccagcgtt

SEQ ID NO: 299213 - DNA, 25 bp, Mus musculus
caaggttcttaataccgccagcgtt

SEQ ID NO: 299214 - DNA, 25 bp, Mus musculus
caaggttgacaaactgccctgcaag

SEQ ID NO: 299215 - DNA, 25 bp, Mus musculus
caaggttgacaatctgccctgcaag

SEQ ID NO: 299216 - DNA, 25 bp, Mus musculus
caaggttgcaacagtccagcctttg

SEQ ID NO: 299217 - DNA, 25 bp, Mus musculus
caaggttgcaactgtccagcctttg

SEQ ID NO: 299218 - DNA, 25 bp, Mus musculus
caaggttggataacgcatggctact

SEQ ID NO: 299219 - DNA, 25 bp, Mus musculus
caaggttggatatcgcatggctact

SEQ ID NO: 299220 - DNA, 25 bp, Mus musculus
caaggttggcagaggtcgctgctct

SEQ ID NO: 299221 - DNA, 25 bp, Mus musculus
caaggttggcagtggtcgctgctct

SEQ ID NO: 299222 - DNA, 25 bp, Mus musculus
caaggttggtgacggctgcattttc

SEQ ID NO: 299223 - DNA, 25 bp, Mus musculus
caaggttggtgagggctgcattttc

SEQ ID NO: 299224 - DNA, 25 bp, Mus musculus
caaggttggtgtccagctcactgga

SEQ ID NO: 299225 - DNA, 25 bp, Mus musculus
caaggttggtgtgcagctcactgga

SEQ ID NO: 299226 - DNA, 25 bp, Mus musculus
caaggttgtccgagatcactcagat

SEQ ID NO: 299227 - DNA, 25 bp, Mus musculus
caaggttgtccgtgatcactcagat

SEQ ID NO: 299228 - DNA, 25 bp, Mus musculus
caaggttgtggcacctgctgatgca

SEQ ID NO: 299229 - DNA, 25 bp, Mus musculus
caaggttgtggctcctgctgatgca

SEQ ID NO: 299230 - DNA, 25 bp, Mus musculus
caaggtttacaactccagggtcatc

SEQ ID NO: 299231 - DNA, 25 bp, Mus musculus
caaggtttacaagtccagggtcatc

SEQ ID NO: 299232 - DNA, 25 bp, Mus musculus
caaggtttagcccacaaacttccat

SEQ ID NO: 299233 - DNA, 25 bp, Mus musculus
caaggtttagccgacaaacttccat

SEQ ID NO: 299234 - DNA, 25 bp, Mus musculus
caaggtttcataattttagccccag

SEQ ID NO: 299235 - DNA, 25 bp, Mus musculus
caaggtttcatatttttagccccag

SEQ ID NO: 299236 - DNA, 25 bp, Mus musculus
caaggtttcctgatgactgggcaca

SEQ ID NO: 299237 - DNA, 25 bp, Mus musculus
caaggtttcctgttgactgggcaca

SEQ ID NO: 299238 - DNA, 25 bp, Mus musculus
caaggtttctctatcaacccttggg

SEQ ID NO: 299239 - DNA, 25 bp, Mus musculus
caaggtttctctttcaacccttggg

SEQ ID NO: 299240 - DNA, 25 bp, Mus musculus
caaggtttctgtccatgtcagatct

SEQ ID NO: 299241 - DNA, 25 bp, Mus musculus
caaggtttctgtgcatgtcagatct

SEQ ID NO: 299242 - DNA, 25 bp, Mus musculus
caaggtttcttgagactgttggtct

SEQ ID NO: 299243 - DNA, 25 bp, Mus musculus
caaggtttcttgtgactgttggtct

SEQ ID NO: 299244 - DNA, 25 bp, Mus musculus
caaggtttgaatatagcagctgcag

SEQ ID NO: 299245 - DNA, 25 bp, Mus musculus
caaggtttgaatttagcagctgcag

SEQ ID NO: 299246 - DNA, 25 bp, Mus musculus
caaggttttctaaagcagcttcagt

SEQ ID NO: 299247 - DNA, 25 bp, Mus musculus
caaggttttctatagcagcttcagt

SEQ ID NO: 299248 - DNA, 25 bp, Mus musculus
caaggttttgtgacaatgtcaactc

SEQ ID NO: 299249 - DNA, 25 bp, Mus musculus
caaggttttgtgtcaatgtcaactc

SEQ ID NO: 299250 - DNA, 25 bp, Mus musculus
caaggtttttatactcctgtgtaat

SEQ ID NO: 299251 - DNA, 25 bp, Mus musculus
caaggtttttattctcctgtgtaat

SEQ ID NO: 299252 - DNA, 25 bp, Mus musculus
caaggttttttgcatgagtctatat

SEQ ID NO: 299253 - DNA, 25 bp, Mus musculus
caaggttttttggatgagtctatat

SEQ ID NO: 299254 - DNA, 25 bp, Mus musculus
caagtaaactcaatttccacagtgt

SEQ ID NO: 299255 - DNA, 25 bp, Mus musculus
caagtaaactcattttccacagtgt

SEQ ID NO: 299256 - DNA, 25 bp, Mus musculus
caagtaaatggcacagccgggctgg

SEQ ID NO: 299257 - DNA, 25 bp, Mus musculus
caagtaaatggctcagccgggctgg

SEQ ID NO: 299258 - DNA, 25 bp, Mus musculus
caagtaacctacatcttgacttctt

SEQ ID NO: 299259 - DNA, 25 bp, Mus musculus
caagtaacctacttcttgacttctt

SEQ ID NO: 299260 - DNA, 25 bp, Mus musculus
caagtaaggattctttccaccccag

SEQ ID NO: 299261 - DNA, 25 bp, Mus musculus
caagtaaggattgtttccaccccag

SEQ ID NO: 299262 - DNA, 25 bp, Mus musculus
caagtaagtcgtcctatgaccttca

SEQ ID NO: 299263 - DNA, 25 bp, Mus musculus
caagtaagtcgtgctatgaccttca

SEQ ID NO: 299264 - DNA, 25 bp, Mus musculus
caagtaatactcagcgtacccaaac

SEQ ID NO: 299265 - DNA, 25 bp, Mus musculus
caagtaatactctgcgtacccaaac

SEQ ID NO: 299266 - DNA, 25 bp, Mus musculus
caagtaatgtgcctatgccagctaa

SEQ ID NO: 299267 - DNA, 25 bp, Mus musculus
caagtaatgtgcgtatgccagctaa

SEQ ID NO: 299268 - DNA, 25 bp, Mus musculus
caagtaatttagagtcattttcaaa

SEQ ID NO: 299269 - DNA, 25 bp, Mus musculus
caagtaatttagtgtcattttcaaa

SEQ ID NO: 299270 - DNA, 25 bp, Mus musculus
caagtacagtttcctgttattcaac

SEQ ID NO: 299271 - DNA, 25 bp, Mus musculus
caagtacagtttgctgttattcaac

SEQ ID NO: 299272 - DNA, 25 bp, Mus musculus
caagtacattgaaatgcgtgggaat

SEQ ID NO: 299273 - DNA, 25 bp, Mus musculus
caagtacattgatatgcgtgggaat

SEQ ID NO: 299274 - DNA, 25 bp, Mus musculus
caagtacatttcagggcagacccca

SEQ ID NO: 299275 - DNA, 25 bp, Mus musculus
caagtacatttctgggcagacccca

SEQ ID NO: 299276 - DNA, 25 bp, Mus musculus
caagtaccacacatttctgcgctgc

SEQ ID NO: 299277 - DNA, 25 bp, Mus musculus
caagtaccacacttttctgcgctgc

SEQ ID NO: 299278 - DNA, 25 bp, Mus musculus
caagtaccagatccgcttgcctgga

SEQ ID NO: 299279 - DNA, 25 bp, Mus musculus
caagtaccagatgcgcttgcctgga

SEQ ID NO: 299280 - DNA, 25 bp, Mus musculus
caagtaccctatactgcagctatga

SEQ ID NO: 299281 - DNA, 25 bp, Mus musculus
caagtaccctattctgcagctatga

SEQ ID NO: 299282 - DNA, 25 bp, Mus musculus
caagtaccggcactgcaagtgggat

SEQ ID NO: 299283 - DNA, 25 bp, Mus musculus
caagtaccggcagtgcaagtgggat

SEQ ID NO: 299284 - DNA, 25 bp, Mus musculus
caagtaccgggaccgctgcaaggac

SEQ ID NO: 299285 - DNA, 25 bp, Mus musculus
caagtaccgggagcgctgcaaggac

SEQ ID NO: 299286 - DNA, 25 bp, Mus musculus
caagtacctcatccatgtagccatc

SEQ ID NO: 299287 - DNA, 25 bp, Mus musculus
caagtacctcatgcatgtagccatc

SEQ ID NO: 299288 - DNA, 25 bp, Mus musculus
caagtacctgcgcagacggttctcc

SEQ ID NO: 299289 - DNA, 25 bp, Mus musculus
caagtacctgcggagacggttctcc

SEQ ID NO: 299290 - DNA, 25 bp, Mus musculus
caagtacttaaaccacgttccccag

SEQ ID NO: 299291 - DNA, 25 bp, Mus musculus
caagtacttaaagcacgttccccag

SEQ ID NO: 299292 - DNA, 25 bp, Mus musculus
caagtacttcttatgtgtgaacagc

SEQ ID NO: 299293 - DNA, 25 bp, Mus musculus
caagtacttcttcgcagagctgctg

SEQ ID NO: 299294 - DNA, 25 bp, Mus musculus
caagtacttcttggcagagctgctg

SEQ ID NO: 299295 - DNA, 25 bp, Mus musculus
caagtacttcttttgtgtgaacagc

SEQ ID NO: 299296 - DNA, 25 bp, Mus musculus
caagtacttgccagttgagtgaagc

SEQ ID NO: 299297 - DNA, 25 bp, Mus musculus
caagtacttgcctgttgagtgaagc

SEQ ID NO: 299298 - DNA, 25 bp, Mus musculus
caagtactttgacgtcttcggagac

SEQ ID NO: 299299 - DNA, 25 bp, Mus musculus
caagtactttgaggtcttcggagac

SEQ ID NO: 299300 - DNA, 25 bp, Mus musculus
caagtactttgtacaggtccaggag

SEQ ID NO: 299301 - DNA, 25 bp, Mus musculus
caagtactttgttcaggtccaggag

SEQ ID NO: 299302 - DNA, 25 bp, Mus musculus
caagtagagttgaatccatgttaac

SEQ ID NO: 299303 - DNA, 25 bp, Mus musculus
caagtagagttgtatccatgttaac

SEQ ID NO: 299304 - DNA, 25 bp, Mus musculus
caagtagcaggaatggcgcagtcct

SEQ ID NO: 299305 - DNA, 25 bp, Mus musculus
caagtagcaggattggcgcagtcct

SEQ ID NO: 299306 - DNA, 25 bp, Mus musculus
caagtagccagaccgtctttatgcc

SEQ ID NO: 299307 - DNA, 25 bp, Mus musculus
caagtagccagagcgtctttatgcc

SEQ ID NO: 299308 - DNA, 25 bp, Mus musculus
caagtagcctttagctcttattata

SEQ ID NO: 299309 - DNA, 25 bp, Mus musculus
caagtagccttttgctcttattata

SEQ ID NO: 299310 - DNA, 25 bp, Mus musculus
caagtagcgccactccagtgaaggg

SEQ ID NO: 299311 - DNA, 25 bp, Mus musculus
caagtagcgccagtccagtgaaggg

SEQ ID NO: 299312 - DNA, 25 bp, Mus musculus
caagtagctagtacgtgtgcgtcta

SEQ ID NO: 299313 - DNA, 25 bp, Mus musculus
caagtagctagttcgtgtgcgtcta

SEQ ID NO: 299314 - DNA, 25 bp, Mus musculus
caagtagctatgactgcacacgaaa

SEQ ID NO: 299315 - DNA, 25 bp, Mus musculus
caagtagctatgtctgcacacgaaa

SEQ ID NO: 299316 - DNA, 25 bp, Mus musculus
caagtagcttgcatctctcttaatc

SEQ ID NO: 299317 - DNA, 25 bp, Mus musculus
caagtagcttgcttctctcttaatc

SEQ ID NO: 299318 - DNA, 25 bp, Mus musculus
caagtaggagttcccatatgccatt

SEQ ID NO: 299319 - DNA, 25 bp, Mus musculus
caagtaggagttgccatatgccatt

SEQ ID NO: 299320 - DNA, 25 bp, Mus musculus
caagtaggccggaccccactgtgtt

SEQ ID NO: 299321 - DNA, 25 bp, Mus musculus
caagtaggccggtccccactgtgtt

SEQ ID NO: 299322 - DNA, 25 bp, Mus musculus
caagtaggcggcagccatggtccag

SEQ ID NO: 299323 - DNA, 25 bp, Mus musculus
caagtaggcggctgccatggtccag

SEQ ID NO: 299324 - DNA, 25 bp, Mus musculus
caagtaggtcttccagaatcgtctt

SEQ ID NO: 299325 - DNA, 25 bp, Mus musculus
caagtaggtcttgcagaatcgtctt

SEQ ID NO: 299326 - DNA, 25 bp, Mus musculus
caagtaggttctaactggtgcgtga

SEQ ID NO: 299327 - DNA, 25 bp, Mus musculus
caagtaggttcttactggtgcgtga

SEQ ID NO: 299328 - DNA, 25 bp, Mus musculus
caagtagtatgtatcttcctggcag

SEQ ID NO: 299329 - DNA, 25 bp, Mus musculus
caagtagtatgtttcttcctggcag

SEQ ID NO: 299330 - DNA, 25 bp, Mus musculus
caagtagtgggcactggactgctga

SEQ ID NO: 299331 - DNA, 25 bp, Mus musculus
caagtagtgggctctggactgctga

SEQ ID NO: 299332 - DNA, 25 bp, Mus musculus
caagtagtgtgaccagtcttttgtt

SEQ ID NO: 299333 - DNA, 25 bp, Mus musculus
caagtagtgtgagcagtcttttgtt

SEQ ID NO: 299334 - DNA, 25 bp, Mus musculus
caagtagtgttcatggctaacggta

SEQ ID NO: 299335 - DNA, 25 bp, Mus musculus
caagtagtgttcttggctaacggta

SEQ ID NO: 299336 - DNA, 25 bp, Mus musculus
caagtagttgctccggacctctgaa

SEQ ID NO: 299337 - DNA, 25 bp, Mus musculus
caagtagttgctgcggacctctgaa

SEQ ID NO: 299338 - DNA, 25 bp, Mus musculus
caagtagtttagatgctgcctctga

SEQ ID NO: 299339 - DNA, 25 bp, Mus musculus
caagtagtttagttgctgcctctga

SEQ ID NO: 299340 - DNA, 25 bp, Mus musculus
caagtagttttcacaactcctcttc

SEQ ID NO: 299341 - DNA, 25 bp, Mus musculus
caagtagttttctcaactcctcttc

SEQ ID NO: 299342 - DNA, 25 bp, Mus musculus
caagtatccacactgaagcatatgt

SEQ ID NO: 299343 - DNA, 25 bp, Mus musculus
caagtatccacagtgaagcatatgt

SEQ ID NO: 299344 - DNA, 25 bp, Mus musculus
caagtatccatcatcgtcgtagttg

SEQ ID NO: 299345 - DNA, 25 bp, Mus musculus
caagtatccatcttcgtcgtagttg

SEQ ID NO: 299346 - DNA, 25 bp, Mus musculus
caagtatccttacttgtcatcagag

SEQ ID NO: 299347 - DNA, 25 bp, Mus musculus
caagtatccttagttgtcatcagag

SEQ ID NO: 299348 - DNA, 25 bp, Mus musculus
caagtatctcttacaagcctcaaga

SEQ ID NO: 299349 - DNA, 25 bp, Mus musculus
caagtatctctttcaagcctcaaga

SEQ ID NO: 299350 - DNA, 25 bp, Mus musculus
caagtatgaggtagacgacattgat

SEQ ID NO: 299351 - DNA, 25 bp, Mus musculus
caagtatgaggttgacgacattgat

SEQ ID NO: 299352 - DNA, 25 bp, Mus musculus
caagtatgcattccgcgtttaagga

SEQ ID NO: 299353 - DNA, 25 bp, Mus musculus
caagtatgcattgcgcgtttaagga

SEQ ID NO: 299354 - DNA, 25 bp, Mus musculus
caagtatgctggcagtgccctgcag

SEQ ID NO: 299355 - DNA, 25 bp, Mus musculus
caagtatgctgggagtgccctgcag

SEQ ID NO: 299356 - DNA, 25 bp, Mus musculus
caagtatgcttgaccatttgtaaaa

SEQ ID NO: 299357 - DNA, 25 bp, Mus musculus
caagtatgcttgtccatttgtaaaa

SEQ ID NO: 299358 - DNA, 25 bp, Mus musculus
caagtattactacagtgaggtctct

SEQ ID NO: 299359 - DNA, 25 bp, Mus musculus
caagtattactagagtgaggtctct

SEQ ID NO: 299360 - DNA, 25 bp, Mus musculus
caagtattctaccattgcctacagc

SEQ ID NO: 299361 - DNA, 25 bp, Mus musculus
caagtattctacgattgcctacagc

SEQ ID NO: 299362 - DNA, 25 bp, Mus musculus
caagtattctagaatctgctgggac

SEQ ID NO: 299363 - DNA, 25 bp, Mus musculus
caagtattctagtatctgctgggac

SEQ ID NO: 299364 - DNA, 25 bp, Mus musculus
caagtattgagacttctgtatgttt

SEQ ID NO: 299365 - DNA, 25 bp, Mus musculus
caagtattgagagttctgtatgttt

SEQ ID NO: 299366 - DNA, 25 bp, Mus musculus
caagtattggttacttgtttcaaga

SEQ ID NO: 299367 - DNA, 25 bp, Mus musculus
caagtattggtttcttgtttcaaga

SEQ ID NO: 299368 - DNA, 25 bp, Mus musculus
caagtatttcatcccggagggcgat

SEQ ID NO: 299369 - DNA, 25 bp, Mus musculus
caagtatttcatgccggagggcgat

SEQ ID NO: 299370 - DNA, 25 bp, Mus musculus
caagtcaataaaccattatctcccc

SEQ ID NO: 299371 - DNA, 25 bp, Mus musculus
caagtcaataaagcattatctcccc

SEQ ID NO: 299372 - DNA, 25 bp, Mus musculus
caagtcaatcatccctctgggtata

SEQ ID NO: 299373 - DNA, 25 bp, Mus musculus
caagtcaatcatgcctctgggtata

SEQ ID NO: 299374 - DNA, 25 bp, Mus musculus
caagtcaccaatatgtttgcaacat

SEQ ID NO: 299375 - DNA, 25 bp, Mus musculus
caagtcaccaatttgtttgcaacat

SEQ ID NO: 299376 - DNA, 25 bp, Mus musculus
caagtcaccttcagatccagtggaa

SEQ ID NO: 299377 - DNA, 25 bp, Mus musculus
caagtcaccttctgatccagtggaa

SEQ ID NO: 299378 - DNA, 25 bp, Mus musculus
caagtcacggtaattttctggttca

SEQ ID NO: 299379 - DNA, 25 bp, Mus musculus
caagtcacggtatttttctggttca

SEQ ID NO: 299380 - DNA, 25 bp, Mus musculus
caagtcactgagcacaatgtccaat

SEQ ID NO: 299381 - DNA, 25 bp, Mus musculus
caagtcactgaggacaatgtccaat

SEQ ID NO: 299382 - DNA, 25 bp, Mus musculus
caagtcacttaactttctacctgga

SEQ ID NO: 299383 - DNA, 25 bp, Mus musculus
caagtcacttaagtttctacctgga

SEQ ID NO: 299384 - DNA, 25 bp, Mus musculus
caagtcagagatcgaacgtcttcat

SEQ ID NO: 299385 - DNA, 25 bp, Mus musculus
caagtcagagatggaacgtcttcat

SEQ ID NO: 299386 - DNA, 25 bp, Mus musculus
caagtcagcaggatccaagtctagt

SEQ ID NO: 299387 - DNA, 25 bp, Mus musculus
caagtcagcaggttccaagtctagt

SEQ ID NO: 299388 - DNA, 25 bp, Mus musculus
caagtcagctctccgggactggatg

SEQ ID NO: 299389 - DNA, 25 bp, Mus musculus
caagtcagctctgcgggactggatg

SEQ ID NO: 299390 - DNA, 25 bp, Mus musculus
caagtcagcttgacaatcacctaga

SEQ ID NO: 299391 - DNA, 25 bp, Mus musculus
caagtcagcttgtcaatcacctaga

SEQ ID NO: 299392 - DNA, 25 bp, Mus musculus
caagtcaggccgactactgtgtgga

SEQ ID NO: 299393 - DNA, 25 bp, Mus musculus
caagtcaggccgtctactgtgtgga

SEQ ID NO: 299394 - DNA, 25 bp, Mus musculus
caagtcagggacactggtagctcac

SEQ ID NO: 299395 - DNA, 25 bp, Mus musculus
caagtcagggactctggtagctcac

SEQ ID NO: 299396 - DNA, 25 bp, Mus musculus
caagtcagggatatggcccaggatc

SEQ ID NO: 299397 - DNA, 25 bp, Mus musculus
caagtcagggatttggcccaggatc

SEQ ID NO: 299398 - DNA, 25 bp, Mus musculus
caagtcaggttacggtctgctggca

SEQ ID NO: 299399 - DNA, 25 bp, Mus musculus
caagtcaggttagggtctgctggca

SEQ ID NO: 299400 - DNA, 25 bp, Mus musculus
caagtcagtagccacctactcccag

SEQ ID NO: 299401 - DNA, 25 bp, Mus musculus
caagtcagtagcgacctactcccag

SEQ ID NO: 299402 - DNA, 25 bp, Mus musculus
caagtcagtcagatacctgtgttta

SEQ ID NO: 299403 - DNA, 25 bp, Mus musculus
caagtcagtcagttacctgtgttta

SEQ ID NO: 299404 - DNA, 25 bp, Mus musculus
caagtcagtgagaatcagaggtgtt

SEQ ID NO: 299405 - DNA, 25 bp, Mus musculus
caagtcagtgagtatcagaggtgtt

SEQ ID NO: 299406 - DNA, 25 bp, Mus musculus
caagtcatccatctcattccttagg

SEQ ID NO: 299407 - DNA, 25 bp, Mus musculus
caagtcatccatgtcattccttagg

SEQ ID NO: 299408 - DNA, 25 bp, Mus musculus
caagtcatgggaccggagcctccat

SEQ ID NO: 299409 - DNA, 25 bp, Mus musculus
caagtcatgggagcggagcctccat

SEQ ID NO: 299410 - DNA, 25 bp, Mus musculus
caagtcattaggctcagagctgctt

SEQ ID NO: 299411 - DNA, 25 bp, Mus musculus
caagtcattagggtcagagctgctt

SEQ ID NO: 299412 - DNA, 25 bp, Mus musculus
caagtcattgttcgtgcctaatcac

SEQ ID NO: 299413 - DNA, 25 bp, Mus musculus
caagtcattgttggtgcctaatcac

SEQ ID NO: 299414 - DNA, 25 bp, Mus musculus
caagtcattttacatgttgctcagg

SEQ ID NO: 299415 - DNA, 25 bp, Mus musculus
caagtcattttagatgttgctcagg

SEQ ID NO: 299416 - DNA, 25 bp, Mus musculus
caagtccaaatcctggaggcagcct

SEQ ID NO: 299417 - DNA, 25 bp, Mus musculus
caagtccaaatcgtggaggcagcct

SEQ ID NO: 299418 - DNA, 25 bp, Mus musculus
caagtccaacagaagcatggctctt

SEQ ID NO: 299419 - DNA, 25 bp, Mus musculus
caagtccaacagtagcatggctctt

SEQ ID NO: 299420 - DNA, 25 bp, Mus musculus
caagtccagagacagccgcgggcct

SEQ ID NO: 299421 - DNA, 25 bp, Mus musculus
caagtccagagagagccgcgggcct

SEQ ID NO: 299422 - DNA, 25 bp, Mus musculus
caagtccagcagctctttaccagta

SEQ ID NO: 299423 - DNA, 25 bp, Mus musculus
caagtccagcaggtctttaccagta

SEQ ID NO: 299424 - DNA, 25 bp, Mus musculus
caagtccagcgtctctttgtattaa

SEQ ID NO: 299425 - DNA, 25 bp, Mus musculus
caagtccagcgtgtctttgtattaa

SEQ ID NO: 299426 - DNA, 25 bp, Mus musculus
caagtccaggcaagtccatccagga

SEQ ID NO: 299427 - DNA, 25 bp, Mus musculus
caagtccaggcatgtccatccagga

SEQ ID NO: 299428 - DNA, 25 bp, Mus musculus
caagtccagtagacaggttcctaga

SEQ ID NO: 299429 - DNA, 25 bp, Mus musculus
caagtccagtagtcaggttcctaga

SEQ ID NO: 299430 - DNA, 25 bp, Mus musculus
caagtccatatcatgttgtttgtga

SEQ ID NO: 299431 - DNA, 25 bp, Mus musculus
caagtccatatcttgttgtttgtga

SEQ ID NO: 299432 - DNA, 25 bp, Mus musculus
caagtccatcttagttgttccttag

SEQ ID NO: 299433 - DNA, 25 bp, Mus musculus
caagtccatctttgttgttccttag

SEQ ID NO: 299434 - DNA, 25 bp, Mus musculus
caagtccatggaacaatcacaggtg

SEQ ID NO: 299435 - DNA, 25 bp, Mus musculus
caagtccatggatcaatcacaggtg

SEQ ID NO: 299436 - DNA, 25 bp, Mus musculus
caagtccatgtgagaatgatttaaa

SEQ ID NO: 299437 - DNA, 25 bp, Mus musculus
caagtccatgtgtgaatgatttaaa

SEQ ID NO: 299438 - DNA, 25 bp, Mus musculus
caagtcccacaaaaggtgctccctt

SEQ ID NO: 299439 - DNA, 25 bp, Mus musculus
caagtcccacaataggtgctccctt

SEQ ID NO: 299440 - DNA, 25 bp, Mus musculus
caagtcccatgtcatagataggtat

SEQ ID NO: 299441 - DNA, 25 bp, Mus musculus
caagtcccatgtgatagataggtat

SEQ ID NO: 299442 - DNA, 25 bp, Mus musculus
caagtccccatgcacactagaaaag

SEQ ID NO: 299443 - DNA, 25 bp, Mus musculus
caagtccccatggacactagaaaag

SEQ ID NO: 299444 - DNA, 25 bp, Mus musculus
caagtccccgagacagagcctgcgt

SEQ ID NO: 299445 - DNA, 25 bp, Mus musculus
caagtccccgagtcagagcctgcgt

SEQ ID NO: 299446 - DNA, 25 bp, Mus musculus
caagtcccgcgtcctgcatgagaag

SEQ ID NO: 299447 - DNA, 25 bp, Mus musculus
caagtcccgcgtgctgcatgagaag

SEQ ID NO: 299448 - DNA, 25 bp, Mus musculus
caagtcccgctgagagctgagagaa

SEQ ID NO: 299449 - DNA, 25 bp, Mus musculus
caagtcccgctgtgagctgagagaa

SEQ ID NO: 299450 - DNA, 25 bp, Mus musculus
caagtcccgggcaacttatagtatc

SEQ ID NO: 299451 - DNA, 25 bp, Mus musculus
caagtcccgggctacttatagtatc

SEQ ID NO: 299452 - DNA, 25 bp, Mus musculus
caagtcccgtgtcgtctagtctgac

SEQ ID NO: 299453 - DNA, 25 bp, Mus musculus
caagtcccgtgtggtctagtctgac

SEQ ID NO: 299454 - DNA, 25 bp, Mus musculus
caagtccctcggctaaccctgaaat

SEQ ID NO: 299455 - DNA, 25 bp, Mus musculus
caagtccctcgggtaaccctgaaat

SEQ ID NO: 299456 - DNA, 25 bp, Mus musculus
caagtccctgaactctggtgatgca

SEQ ID NO: 299457 - DNA, 25 bp, Mus musculus
caagtccctgaagtctggtgatgca

SEQ ID NO: 299458 - DNA, 25 bp, Mus musculus
caagtccctgatatgcagatagcat

SEQ ID NO: 299459 - DNA, 25 bp, Mus musculus
caagtccctgatttgcagatagcat

SEQ ID NO: 299460 - DNA, 25 bp, Mus musculus
caagtccctgggaggctaagtgatt

SEQ ID NO: 299461 - DNA, 25 bp, Mus musculus
caagtccctgggtggctaagtgatt

SEQ ID NO: 299462 - DNA, 25 bp, Mus musculus
caagtcccttgtattgtcggtcctg

SEQ ID NO: 299463 - DNA, 25 bp, Mus musculus
caagtcccttgttttgtcggtcctg

SEQ ID NO: 299464 - DNA, 25 bp, Mus musculus
caagtccgagtgagtaatgctgaaa

SEQ ID NO: 299465 - DNA, 25 bp, Mus musculus
caagtccgagtgtgtaatgctgaaa

SEQ ID NO: 299466 - DNA, 25 bp, Mus musculus
caagtccgcttgcttctttacttca

SEQ ID NO: 299467 - DNA, 25 bp, Mus musculus
caagtccgcttggttctttacttca

SEQ ID NO: 299468 - DNA, 25 bp, Mus musculus
caagtcctaagcagatgcccgctat

SEQ ID NO: 299469 - DNA, 25 bp, Mus musculus
caagtcctaagctgatgcccgctat

SEQ ID NO: 299470 - DNA, 25 bp, Mus musculus
caagtcctaattaccgttggtgata

SEQ ID NO: 299471 - DNA, 25 bp, Mus musculus
caagtcctaatttccgttggtgata

SEQ ID NO: 299472 - DNA, 25 bp, Mus musculus
caagtcctagtgcatgtctctgaat

SEQ ID NO: 299473 - DNA, 25 bp, Mus musculus
caagtcctagtggatgtctctgaat

SEQ ID NO: 299474 - DNA, 25 bp, Mus musculus
caagtcctcccgagaagattttaca

SEQ ID NO: 299475 - DNA, 25 bp, Mus musculus
caagtcctcccgtgaagattttaca

SEQ ID NO: 299476 - DNA, 25 bp, Mus musculus
caagtcctccggagttttccttcag

SEQ ID NO: 299477 - DNA, 25 bp, Mus musculus
caagtcctccggtgttttccttcag

SEQ ID NO: 299478 - DNA, 25 bp, Mus musculus
caagtcctgactaagccacatggct

SEQ ID NO: 299479 - DNA, 25 bp, Mus musculus
caagtcctgacttagccacatggct

SEQ ID NO: 299480 - DNA, 25 bp, Mus musculus
caagtcctgagtatctgtcctgtga

SEQ ID NO: 299481 - DNA, 25 bp, Mus musculus
caagtcctgagtcggcttcctaaat

SEQ ID NO: 299482 - DNA, 25 bp, Mus musculus
caagtcctgagtgggcttcctaaat

SEQ ID NO: 299483 - DNA, 25 bp, Mus musculus
caagtcctgagtttctgtcctgtga

SEQ ID NO: 299484 - DNA, 25 bp, Mus musculus
caagtcctgggaaacccacgtccgt

SEQ ID NO: 299485 - DNA, 25 bp, Mus musculus
caagtcctgggaagatgatgtgtac

SEQ ID NO: 299486 - DNA, 25 bp, Mus musculus
caagtcctgggatacccacgtccgt

SEQ ID NO: 299487 - DNA, 25 bp, Mus musculus
caagtcctgggatgatgatgtgtac

SEQ ID NO: 299488 - DNA, 25 bp, Mus musculus
caagtcctgtaaagttcacccgtga

SEQ ID NO: 299489 - DNA, 25 bp, Mus musculus
caagtcctgtaatgttcacccgtga

SEQ ID NO: 299490 - DNA, 25 bp, Mus musculus
caagtccttgaaccagttgttgaat

SEQ ID NO: 299491 - DNA, 25 bp, Mus musculus
caagtccttgaagcagttgttgaat

SEQ ID NO: 299492 - DNA, 25 bp, Mus musculus
caagtccttggtagcaaatgtacac

SEQ ID NO: 299493 - DNA, 25 bp, Mus musculus
caagtccttggttgcaaatgtacac

SEQ ID NO: 299494 - DNA, 25 bp, Mus musculus
caagtcgagtggaacctggtgcttc

SEQ ID NO: 299495 - DNA, 25 bp, Mus musculus
caagtcgagtggtacctggtgcttc

SEQ ID NO: 299496 - DNA, 25 bp, Mus musculus
caagtcgcacccagggccggtatta

SEQ ID NO: 299497 - DNA, 25 bp, Mus musculus
caagtcgcaccctgggccggtatta

SEQ ID NO: 299498 - DNA, 25 bp, Mus musculus
caagtcgctgttcgttttaagaatt

SEQ ID NO: 299499 - DNA, 25 bp, Mus musculus
caagtcgctgttggttttaagaatt

SEQ ID NO: 299500 - DNA, 25 bp, Mus musculus
caagtcggaaatcgagatggctcat

SEQ ID NO: 299501 - DNA, 25 bp, Mus musculus
caagtcggaaatggagatggctcat

SEQ ID NO: 299502 - DNA, 25 bp, Mus musculus
caagtcggccatcagtggcaagaga

SEQ ID NO: 299503 - DNA, 25 bp, Mus musculus
caagtcggccatgagtggcaagaga

SEQ ID NO: 299504 - DNA, 25 bp, Mus musculus
caagtcggcggcctaagggtctcta

SEQ ID NO: 299505 - DNA, 25 bp, Mus musculus
caagtcggcggcgtaagggtctcta

SEQ ID NO: 299506 - DNA, 25 bp, Mus musculus
caagtcggctttctaaggctgcaat

SEQ ID NO: 299507 - DNA, 25 bp, Mus musculus
caagtcggctttgtaaggctgcaat

SEQ ID NO: 299508 - DNA, 25 bp, Mus musculus
caagtcgggtttcagtggccgccat

SEQ ID NO: 299509 - DNA, 25 bp, Mus musculus
caagtcgggtttgagtggccgccat

SEQ ID NO: 299510 - DNA, 25 bp, Mus musculus
caagtcgtggacagcagttctaaag

SEQ ID NO: 299511 - DNA, 25 bp, Mus musculus
caagtcgtggactgcagttctaaag

SEQ ID NO: 299512 - DNA, 25 bp, Mus musculus
caagtctacataactgaagctgcag

SEQ ID NO: 299513 - DNA, 25 bp, Mus musculus
caagtctacatatctgaagctgcag

SEQ ID NO: 299514 - DNA, 25 bp, Mus musculus
caagtctcaatcagagcctgttctc

SEQ ID NO: 299515 - DNA, 25 bp, Mus musculus
caagtctcaatctgagcctgttctc

SEQ ID NO: 299516 - DNA, 25 bp, Mus musculus
caagtctcagagatgtgttcaatcc

SEQ ID NO: 299517 - DNA, 25 bp, Mus musculus
caagtctcagagttgtgttcaatcc

SEQ ID NO: 299518 - DNA, 25 bp, Mus musculus
caagtctcagctataccactaacta

SEQ ID NO: 299519 - DNA, 25 bp, Mus musculus
caagtctcagctttaccactaacta

SEQ ID NO: 299520 - DNA, 25 bp, Mus musculus
caagtctcatcaagtctgacaggat

SEQ ID NO: 299521 - DNA, 25 bp, Mus musculus
caagtctcatcatgtctgacaggat

SEQ ID NO: 299522 - DNA, 25 bp, Mus musculus
caagtctcatgtaagagctattctt

SEQ ID NO: 299523 - DNA, 25 bp, Mus musculus
caagtctcatgttagagctattctt

SEQ ID NO: 299524 - DNA, 25 bp, Mus musculus
caagtctccaaaagcatttaaaaat

SEQ ID NO: 299525 - DNA, 25 bp, Mus musculus
caagtctccaaatgcatttaaaaat

SEQ ID NO: 299526 - DNA, 25 bp, Mus musculus
caagtctcccctacctggcaatgag

SEQ ID NO: 299527 - DNA, 25 bp, Mus musculus
caagtctccccttcctggcaatgag

SEQ ID NO: 299528 - DNA, 25 bp, Mus musculus
caagtctccgaacagccatttggac

SEQ ID NO: 299529 - DNA, 25 bp, Mus musculus
caagtctccgaagagccatttggac

SEQ ID NO: 299530 - DNA, 25 bp, Mus musculus
caagtctctataagcagttcagaat

SEQ ID NO: 299531 - DNA, 25 bp, Mus musculus
caagtctctatatgcagttcagaat

SEQ ID NO: 299532 - DNA, 25 bp, Mus musculus
caagtctcttgtcggagcttcagga

SEQ ID NO: 299533 - DNA, 25 bp, Mus musculus
caagtctcttgtgggagcttcagga

SEQ ID NO: 299534 - DNA, 25 bp, Mus musculus
caagtctgaaagagcctagtcaggc

SEQ ID NO: 299535 - DNA, 25 bp, Mus musculus
caagtctgaaagtgcctagtcaggc

SEQ ID NO: 299536 - DNA, 25 bp, Mus musculus
caagtctgccagactctgagatcag

SEQ ID NO: 299537 - DNA, 25 bp, Mus musculus
caagtctgccagtctctgagatcag

SEQ ID NO: 299538 - DNA, 25 bp, Mus musculus
caagtctgccttctaacttggaaaa

SEQ ID NO: 299539 - DNA, 25 bp, Mus musculus
caagtctgccttgtaacttggaaaa

SEQ ID NO: 299540 - DNA, 25 bp, Mus musculus
caagtctggcgcactgaactattta

SEQ ID NO: 299541 - DNA, 25 bp, Mus musculus
caagtctggcgctctgaactattta

SEQ ID NO: 299542 - DNA, 25 bp, Mus musculus
caagtctgtattatactgttccatg

SEQ ID NO: 299543 - DNA, 25 bp, Mus musculus
caagtctgtattttactgttccatg

SEQ ID NO: 299544 - DNA, 25 bp, Mus musculus
caagtctgtcatctctgggttctgt

SEQ ID NO: 299545 - DNA, 25 bp, Mus musculus
caagtctgtcatgtctgggttctgt

SEQ ID NO: 299546 - DNA, 25 bp, Mus musculus
caagtctgtgatcaaaaccgggcga

SEQ ID NO: 299547 - DNA, 25 bp, Mus musculus
caagtctgtgatgaaaaccgggcga

SEQ ID NO: 299548 - DNA, 25 bp, Mus musculus
caagtctgtgctcttgccaagaagg

SEQ ID NO: 299549 - DNA, 25 bp, Mus musculus
caagtctgtgctgttgccaagaagg

SEQ ID NO: 299550 - DNA, 25 bp, Mus musculus
caagtctgttcgaggatgcattgtg

SEQ ID NO: 299551 - DNA, 25 bp, Mus musculus
caagtctgttcgtggatgcattgtg

SEQ ID NO: 299552 - DNA, 25 bp, Mus musculus
caagtcttaaaaagtggctgagcac

SEQ ID NO: 299553 - DNA, 25 bp, Mus musculus
caagtcttaaaatgtggctgagcac

SEQ ID NO: 299554 - DNA, 25 bp, Mus musculus
caagtcttctatccacagctactga

SEQ ID NO: 299555 - DNA, 25 bp, Mus musculus
caagtcttctatgcacagctactga

SEQ ID NO: 299556 - DNA, 25 bp, Mus musculus
caagtcttgagaatggcagttgtct

SEQ ID NO: 299557 - DNA, 25 bp, Mus musculus
caagtcttgagattggcagttgtct

SEQ ID NO: 299558 - DNA, 25 bp, Mus musculus
caagtcttgatgctttgtctaacaa

SEQ ID NO: 299559 - DNA, 25 bp, Mus musculus
caagtcttgatggtttgtctaacaa

SEQ ID NO: 299560 - DNA, 25 bp, Mus musculus
caagtcttgtatattctaccttgaa

SEQ ID NO: 299561 - DNA, 25 bp, Mus musculus
caagtcttgtattttctaccttgaa

SEQ ID NO: 299562 - DNA, 25 bp, Mus musculus
caagtctttagaatagctccgcctc

SEQ ID NO: 299563 - DNA, 25 bp, Mus musculus
caagtctttagattagctccgcctc

SEQ ID NO: 299564 - DNA, 25 bp, Mus musculus
caagtctttatcagcatataggcta

SEQ ID NO: 299565 - DNA, 25 bp, Mus musculus
caagtctttatctgcatataggcta

SEQ ID NO: 299566 - DNA, 25 bp, Mus musculus
caagtctttctacgtgcagggctgt

SEQ ID NO: 299567 - DNA, 25 bp, Mus musculus
caagtctttctaggtgcagggctgt

SEQ ID NO: 299568 - DNA, 25 bp, Mus musculus
caagtctttcttccattttagcctc

SEQ ID NO: 299569 - DNA, 25 bp, Mus musculus
caagtctttcttgcattttagcctc

SEQ ID NO: 299570 - DNA, 25 bp, Mus musculus
caagtgaacactaccggtcttatcc

SEQ ID NO: 299571 - DNA, 25 bp, Mus musculus
caagtgaacacttccggtcttatcc

SEQ ID NO: 299572 - DNA, 25 bp, Mus musculus
caagtgaacagacccttgtgcatta

SEQ ID NO: 299573 - DNA, 25 bp, Mus musculus
caagtgaacagagccttgtgcatta

SEQ ID NO: 299574 - DNA, 25 bp, Mus musculus
caagtgaacctaaagctccccaagt

SEQ ID NO: 299575 - DNA, 25 bp, Mus musculus
caagtgaacctatagctccccaagt

SEQ ID NO: 299576 - DNA, 25 bp, Mus musculus
caagtgacaagactggcagcggtga

SEQ ID NO: 299577 - DNA, 25 bp, Mus musculus
caagtgacaagagtggcagcggtga

SEQ ID NO: 299578 - DNA, 25 bp, Mus musculus
caagtgacactgaggacctcggtca

SEQ ID NO: 299579 - DNA, 25 bp, Mus musculus
caagtgacactgtggacctcggtca

SEQ ID NO: 299580 - DNA, 25 bp, Mus musculus
caagtgacatgcctgtcagtgtcaa

SEQ ID NO: 299581 - DNA, 25 bp, Mus musculus
caagtgacatgcgtgtcagtgtcaa

SEQ ID NO: 299582 - DNA, 25 bp, Mus musculus
caagtgacatttcaggcccttcagt

SEQ ID NO: 299583 - DNA, 25 bp, Mus musculus
caagtgacatttgaggcccttcagt

SEQ ID NO: 299584 - DNA, 25 bp, Mus musculus
caagtgaccgacagacgtgcgtgag

SEQ ID NO: 299585 - DNA, 25 bp, Mus musculus
caagtgaccgactgacgtgcgtgag

SEQ ID NO: 299586 - DNA, 25 bp, Mus musculus
caagtgacttcaccctggacaagga

SEQ ID NO: 299587 - DNA, 25 bp, Mus musculus
caagtgacttcagcctggacaagga

SEQ ID NO: 299588 - DNA, 25 bp, Mus musculus
caagtgacttctcggcccagttctg

SEQ ID NO: 299589 - DNA, 25 bp, Mus musculus
caagtgacttctgggcccagttctg

SEQ ID NO: 299590 - DNA, 25 bp, Mus musculus
caagtgactttgcaggtgtaatttt

SEQ ID NO: 299591 - DNA, 25 bp, Mus musculus
caagtgactttggaggtgtaatttt

SEQ ID NO: 299592 - DNA, 25 bp, Mus musculus
caagtgagacgtccagcggctgtaa

SEQ ID NO: 299593 - DNA, 25 bp, Mus musculus
caagtgagacgtgcagcggctgtaa

SEQ ID NO: 299594 - DNA, 25 bp, Mus musculus
caagtgagacttcatgtagttttat

SEQ ID NO: 299595 - DNA, 25 bp, Mus musculus
caagtgagacttgatgtagttttat

SEQ ID NO: 299596 - DNA, 25 bp, Mus musculus
caagtgagagttacagagcacgctc

SEQ ID NO: 299597 - DNA, 25 bp, Mus musculus
caagtgagagtttcagagcacgctc

SEQ ID NO: 299598 - DNA, 25 bp, Mus musculus
caagtgagcattatcagtgcagtga

SEQ ID NO: 299599 - DNA, 25 bp, Mus musculus
caagtgagcattttcagtgcagtga

SEQ ID NO: 299600 - DNA, 25 bp, Mus musculus
caagtgaggtcgacaaacctgcccc

SEQ ID NO: 299601 - DNA, 25 bp, Mus musculus
caagtgaggtcgtcaaacctgcccc

SEQ ID NO: 299602 - DNA, 25 bp, Mus musculus
caagtgaggtgtccgctggcccctt

SEQ ID NO: 299603 - DNA, 25 bp, Mus musculus
caagtgaggtgtgcgctggcccctt

SEQ ID NO: 299604 - DNA, 25 bp, Mus musculus
caagtgagtttaaactctggtctct

SEQ ID NO: 299605 - DNA, 25 bp, Mus musculus
caagtgagtttatactctggtctct

SEQ ID NO: 299606 - DNA, 25 bp, Mus musculus
caagtgattgtacccattttctcca

SEQ ID NO: 299607 - DNA, 25 bp, Mus musculus
caagtgattgtagccattttctcca

SEQ ID NO: 299608 - DNA, 25 bp, Mus musculus
caagtgatttttaccttgtcatgag

SEQ ID NO: 299609 - DNA, 25 bp, Mus musculus
caagtgattttttccttgtcatgag

SEQ ID NO: 299610 - DNA, 25 bp, Mus musculus
caagtgcaaaatcagcagtgaggct

SEQ ID NO: 299611 - DNA, 25 bp, Mus musculus
caagtgcaaaatgagcagtgaggct

SEQ ID NO: 299612 - DNA, 25 bp, Mus musculus
caagtgcaaaccacgtagcgttcag

SEQ ID NO: 299613 - DNA, 25 bp, Mus musculus
caagtgcaaacctcgtagcgttcag

SEQ ID NO: 299614 - DNA, 25 bp, Mus musculus
caagtgcaagaacgctgcagccggc

SEQ ID NO: 299615 - DNA, 25 bp, Mus musculus
caagtgcaagaaggctgcagccggc

SEQ ID NO: 299616 - DNA, 25 bp, Mus musculus
caagtgcaagggacacggctggcca

SEQ ID NO: 299617 - DNA, 25 bp, Mus musculus
caagtgcaagggtcacggctggcca

SEQ ID NO: 299618 - DNA, 25 bp, Mus musculus
caagtgcagcagagcaggacccaga

SEQ ID NO: 299619 - DNA, 25 bp, Mus musculus
caagtgcagcagtgcaggacccaga

SEQ ID NO: 299620 - DNA, 25 bp, Mus musculus
caagtgcagtacaacaactgttgga

SEQ ID NO: 299621 - DNA, 25 bp, Mus musculus
caagtgcagtactacaactgttgga

SEQ ID NO: 299622 - DNA, 25 bp, Mus musculus
caagtgcatgccctgcagcagaagc

SEQ ID NO: 299623 - DNA, 25 bp, Mus musculus
caagtgcatgccgtgcagcagaagc

SEQ ID NO: 299624 - DNA, 25 bp, Mus musculus
caagtgcatgtaaccttccagctcc

SEQ ID NO: 299625 - DNA, 25 bp, Mus musculus
caagtgcatgtatccttccagctcc

SEQ ID NO: 299626 - DNA, 25 bp, Mus musculus
caagtgcattaacccaagagaccat

SEQ ID NO: 299627 - DNA, 25 bp, Mus musculus
caagtgcattaagccaagagaccat

SEQ ID NO: 299628 - DNA, 25 bp, Mus musculus
caagtgcatttgattacgatacaga

SEQ ID NO: 299629 - DNA, 25 bp, Mus musculus
caagtgcatttgtttacgatacaga

SEQ ID NO: 299630 - DNA, 25 bp, Mus musculus
caagtgccactaccctcgaagtata

SEQ ID NO: 299631 - DNA, 25 bp, Mus musculus
caagtgccactagcctcgaagtata

SEQ ID NO: 299632 - DNA, 25 bp, Mus musculus
caagtgccatttaccttagcaggtc

SEQ ID NO: 299633 - DNA, 25 bp, Mus musculus
caagtgccattttccttagcaggtc

SEQ ID NO: 299634 - DNA, 25 bp, Mus musculus
caagtgccccgtctgtaacaaggcc

SEQ ID NO: 299635 - DNA, 25 bp, Mus musculus
caagtgccccgtgtgtaacaaggcc

SEQ ID NO: 299636 - DNA, 25 bp, Mus musculus
caagtgcccgcaacagtcatgaaag

SEQ ID NO: 299637 - DNA, 25 bp, Mus musculus
caagtgcccgcatcagtcatgaaag

SEQ ID NO: 299638 - DNA, 25 bp, Mus musculus
caagtgcctttcagatggtagccag

SEQ ID NO: 299639 - DNA, 25 bp, Mus musculus
caagtgcctttctgatggtagccag

SEQ ID NO: 299640 - DNA, 25 bp, Mus musculus
caagtgcgcctgaatgatgccagca

SEQ ID NO: 299641 - DNA, 25 bp, Mus musculus
caagtgcgcctgtatgatgccagca

SEQ ID NO: 299642 - DNA, 25 bp, Mus musculus
caagtgctagttctcccaagtacca

SEQ ID NO: 299643 - DNA, 25 bp, Mus musculus
caagtgctagttgtcccaagtacca

SEQ ID NO: 299644 - DNA, 25 bp, Mus musculus
caagtgctgagaattggtgcagaca

SEQ ID NO: 299645 - DNA, 25 bp, Mus musculus
caagtgctgagatttggtgcagaca

SEQ ID NO: 299646 - DNA, 25 bp, Mus musculus
caagtgctgagcagtatgtaaatca

SEQ ID NO: 299647 - DNA, 25 bp, Mus musculus
caagtgctgagctgtatgtaaatca

SEQ ID NO: 299648 - DNA, 25 bp, Mus musculus
caagtgctgattagggagtttctca

SEQ ID NO: 299649 - DNA, 25 bp, Mus musculus
caagtgctgatttgggagtttctca

SEQ ID NO: 299650 - DNA, 25 bp, Mus musculus
caagtgctggatacagatgtaaccg

SEQ ID NO: 299651 - DNA, 25 bp, Mus musculus
caagtgctggattcagatgtaaccg

SEQ ID NO: 299652 - DNA, 25 bp, Mus musculus
caagtgctggcaaaccctctaaaaa

SEQ ID NO: 299653 - DNA, 25 bp, Mus musculus
caagtgctggcataccctctaaaaa

SEQ ID NO: 299654 - DNA, 25 bp, Mus musculus
caagtgctgggacatgatgcttgaa

SEQ ID NO: 299655 - DNA, 25 bp, Mus musculus
caagtgctgggagatgatgcttgaa

SEQ ID NO: 299656 - DNA, 25 bp, Mus musculus
caagtgctgggcaattttgttaatt

SEQ ID NO: 299657 - DNA, 25 bp, Mus musculus
caagtgctgggctattttgttaatt

SEQ ID NO: 299658 - DNA, 25 bp, Mus musculus
caagtgctgtagaggatccctggtg

SEQ ID NO: 299659 - DNA, 25 bp, Mus musculus
caagtgctgtagtggatccctggtg

SEQ ID NO: 299660 - DNA, 25 bp, Mus musculus
caagtgctgtatcggattttcatcc

SEQ ID NO: 299661 - DNA, 25 bp, Mus musculus
caagtgctgtatgggattttcatcc

SEQ ID NO: 299662 - DNA, 25 bp, Mus musculus
caagtgcttataagctcagtgtaat

SEQ ID NO: 299663 - DNA, 25 bp, Mus musculus
caagtgcttatatgctcagtgtaat

SEQ ID NO: 299664 - DNA, 25 bp, Mus musculus
caagtgcttccgctacaaacagtcg

SEQ ID NO: 299665 - DNA, 25 bp, Mus musculus
caagtgcttccggtacaaacagtcg

SEQ ID NO: 299666 - DNA, 25 bp, Mus musculus
caagtgcttctgactgggtaactct

SEQ ID NO: 299667 - DNA, 25 bp, Mus musculus
caagtgcttctgtctgggtaactct

SEQ ID NO: 299668 - DNA, 25 bp, Mus musculus
caagtgcttggcagatggtgcagat

SEQ ID NO: 299669 - DNA, 25 bp, Mus musculus
caagtgcttggctgatggtgcagat

SEQ ID NO: 299670 - DNA, 25 bp, Mus musculus
caagtggaaaggctgtcattatttt

SEQ ID NO: 299671 - DNA, 25 bp, Mus musculus
caagtggaaagggtgtcattatttt

SEQ ID NO: 299672 - DNA, 25 bp, Mus musculus
caagtggaaggacgcctctcgtgaa

SEQ ID NO: 299673 - DNA, 25 bp, Mus musculus
caagtggaaggaggcctctcgtgaa

SEQ ID NO: 299674 - DNA, 25 bp, Mus musculus
caagtggaagtacaggctgcctaaa

SEQ ID NO: 299675 - DNA, 25 bp, Mus musculus
caagtggaagtagaggctgcctaaa

SEQ ID NO: 299676 - DNA, 25 bp, Mus musculus
caagtggaatgcattttgtgagtgt

SEQ ID NO: 299677 - DNA, 25 bp, Mus musculus
caagtggaatgctttttgtgagtgt

SEQ ID NO: 299678 - DNA, 25 bp, Mus musculus
caagtggactatacccatggattgt

SEQ ID NO: 299679 - DNA, 25 bp, Mus musculus
caagtggactattcccatggattgt

SEQ ID NO: 299680 - DNA, 25 bp, Mus musculus
caagtggactgtcccagtatagtac

SEQ ID NO: 299681 - DNA, 25 bp, Mus musculus
caagtggactgtgccagtatagtac

SEQ ID NO: 299682 - DNA, 25 bp, Mus musculus
caagtggagctgaagttgaatttga

SEQ ID NO: 299683 - DNA, 25 bp, Mus musculus
caagtggagctgtagttgaatttga

SEQ ID NO: 299684 - DNA, 25 bp, Mus musculus
caagtggagtggcattccggccctt

SEQ ID NO: 299685 - DNA, 25 bp, Mus musculus
caagtggagtgggattccggccctt

SEQ ID NO: 299686 - DNA, 25 bp, Mus musculus
caagtggatatgaggctgtgcagac

SEQ ID NO: 299687 - DNA, 25 bp, Mus musculus
caagtggatatgtggctgtgcagac

SEQ ID NO: 299688 - DNA, 25 bp, Mus musculus
caagtggcaggacagaccctgactc

SEQ ID NO: 299689 - DNA, 25 bp, Mus musculus
caagtggcaggagagaccctgactc

SEQ ID NO: 299690 - DNA, 25 bp, Mus musculus
caagtggccagtatggagccgcagc

SEQ ID NO: 299691 - DNA, 25 bp, Mus musculus
caagtggccagtttggagccgcagc

SEQ ID NO: 299692 - DNA, 25 bp, Mus musculus
caagtggcccgcacaatagtgatga

SEQ ID NO: 299693 - DNA, 25 bp, Mus musculus
caagtggcccgctcaatagtgatga

SEQ ID NO: 299694 - DNA, 25 bp, Mus musculus
caagtgggacctatgtctgtttatc

SEQ ID NO: 299695 - DNA, 25 bp, Mus musculus
caagtgggacctcaacaaatgtaca

SEQ ID NO: 299696 - DNA, 25 bp, Mus musculus
caagtgggacctgaacaaatgtaca

SEQ ID NO: 299697 - DNA, 25 bp, Mus musculus
caagtgggacctttgtctgtttatc

SEQ ID NO: 299698 - DNA, 25 bp, Mus musculus
caagtgggactgcaaccttgacaga

SEQ ID NO: 299699 - DNA, 25 bp, Mus musculus
caagtgggactggaaccttgacaga

SEQ ID NO: 299700 - DNA, 25 bp, Mus musculus
caagtgggagaaatctttcatgtat

SEQ ID NO: 299701 - DNA, 25 bp, Mus musculus
caagtgggagaattctttcatgtat

SEQ ID NO: 299702 - DNA, 25 bp, Mus musculus
caagtgggattacggattccatctc

SEQ ID NO: 299703 - DNA, 25 bp, Mus musculus
caagtgggattagggattccatctc

SEQ ID NO: 299704 - DNA, 25 bp, Mus musculus
caagtgggccttcaatctctatgac

SEQ ID NO: 299705 - DNA, 25 bp, Mus musculus
caagtgggccttgaatctctatgac

SEQ ID NO: 299706 - DNA, 25 bp, Mus musculus
caagtgggtcccacagagtaaactc

SEQ ID NO: 299707 - DNA, 25 bp, Mus musculus
caagtgggtcccagtttatgaagac

SEQ ID NO: 299708 - DNA, 25 bp, Mus musculus
caagtgggtccctcagagtaaactc

SEQ ID NO: 299709 - DNA, 25 bp, Mus musculus
caagtgggtccctgtttatgaagac

SEQ ID NO: 299710 - DNA, 25 bp, Mus musculus
caagtgggtgccaatcggtgtcgca

SEQ ID NO: 299711 - DNA, 25 bp, Mus musculus
caagtgggtgcctatcggtgtcgca

SEQ ID NO: 299712 - DNA, 25 bp, Mus musculus
caagtgggttccatctgcagtggtt

SEQ ID NO: 299713 - DNA, 25 bp, Mus musculus
caagtgggttccttctgcagtggtt

SEQ ID NO: 299714 - DNA, 25 bp, Mus musculus
caagtggtaattcccatagtccaag

SEQ ID NO: 299715 - DNA, 25 bp, Mus musculus
caagtggtaattgccatagtccaag

SEQ ID NO: 299716 - DNA, 25 bp, Mus musculus
caagtggtacacagccgacagatta

SEQ ID NO: 299717 - DNA, 25 bp, Mus musculus
caagtggtacactgccgacagatta

SEQ ID NO: 299718 - DNA, 25 bp, Mus musculus
caagtggtatgaaggccctacccca

SEQ ID NO: 299719 - DNA, 25 bp, Mus musculus
caagtggtatgatggccctacccca

SEQ ID NO: 299720 - DNA, 25 bp, Mus musculus
caagtggtcaatcccctggaagagt

SEQ ID NO: 299721 - DNA, 25 bp, Mus musculus
caagtggtcaatgccctggaagagt

SEQ ID NO: 299722 - DNA, 25 bp, Mus musculus
caagtggtcactagccacaaagcac

SEQ ID NO: 299723 - DNA, 25 bp, Mus musculus
caagtggtcacttgccacaaagcac

SEQ ID NO: 299724 - DNA, 25 bp, Mus musculus
caagtggtcttgaatcgctaacaac

SEQ ID NO: 299725 - DNA, 25 bp, Mus musculus
caagtggtcttgtatcgctaacaac

SEQ ID NO: 299726 - DNA, 25 bp, Mus musculus
caagtggtggctccgctctctgcag

SEQ ID NO: 299727 - DNA, 25 bp, Mus musculus
caagtggtggctgcgctctctgcag

SEQ ID NO: 299728 - DNA, 25 bp, Mus musculus
caagtggtgtacactcacacagaca

SEQ ID NO: 299729 - DNA, 25 bp, Mus musculus
caagtggtgtactctcacacagaca

SEQ ID NO: 299730 - DNA, 25 bp, Mus musculus
caagtggtttccacgtgcattcata

SEQ ID NO: 299731 - DNA, 25 bp, Mus musculus
caagtggtttcctcgtgcattcata

SEQ ID NO: 299732 - DNA, 25 bp, Mus musculus
caagtgtaacttaagctggtagctc

SEQ ID NO: 299733 - DNA, 25 bp, Mus musculus
caagtgtaactttagctggtagctc

SEQ ID NO: 299734 - DNA, 25 bp, Mus musculus
caagtgtaatcccagtgtggctgac

SEQ ID NO: 299735 - DNA, 25 bp, Mus musculus
caagtgtaatccgagtgtggctgac

SEQ ID NO: 299736 - DNA, 25 bp, Mus musculus
caagtgtacaagagtgatcctgcag

SEQ ID NO: 299737 - DNA, 25 bp, Mus musculus
caagtgtacaagtgtgatcctgcag

SEQ ID NO: 299738 - DNA, 25 bp, Mus musculus
caagtgtagacacacccggaaggaa

SEQ ID NO: 299739 - DNA, 25 bp, Mus musculus
caagtgtagacagacccggaaggaa

SEQ ID NO: 299740 - DNA, 25 bp, Mus musculus
caagtgtatccaagcgtgcacccac

SEQ ID NO: 299741 - DNA, 25 bp, Mus musculus
caagtgtatccatgcgtgcacccac

SEQ ID NO: 299742 - DNA, 25 bp, Mus musculus
caagtgtatgccagtagttgctgct

SEQ ID NO: 299743 - DNA, 25 bp, Mus musculus
caagtgtatgcctgtagttgctgct

SEQ ID NO: 299744 - DNA, 25 bp, Mus musculus
caagtgtatgttaaatgtcctcagt

SEQ ID NO: 299745 - DNA, 25 bp, Mus musculus
caagtgtatgtttaatgtcctcagt

SEQ ID NO: 299746 - DNA, 25 bp, Mus musculus
caagtgtcaggacaccgaagtccct

SEQ ID NO: 299747 - DNA, 25 bp, Mus musculus
caagtgtcaggagaccgaagtccct

SEQ ID NO: 299748 - DNA, 25 bp, Mus musculus
caagtgtcccggcttagggctaaat

SEQ ID NO: 299749 - DNA, 25 bp, Mus musculus
caagtgtcccgggttagggctaaat

SEQ ID NO: 299750 - DNA, 25 bp, Mus musculus
caagtgtccctcaccaaagtgctcc

SEQ ID NO: 299751 - DNA, 25 bp, Mus musculus
caagtgtccctctccaaagtgctcc

SEQ ID NO: 299752 - DNA, 25 bp, Mus musculus
caagtgtcggttatgttctgggtct

SEQ ID NO: 299753 - DNA, 25 bp, Mus musculus
caagtgtcggttttgttctgggtct

SEQ ID NO: 299754 - DNA, 25 bp, Mus musculus
caagtgtctaccaggtagctgcctt

SEQ ID NO: 299755 - DNA, 25 bp, Mus musculus
caagtgtctacctggtagctgcctt

SEQ ID NO: 299756 - DNA, 25 bp, Mus musculus
caagtgtctacgactttcgctaaga

SEQ ID NO: 299757 - DNA, 25 bp, Mus musculus
caagtgtctacgtctttcgctaaga

SEQ ID NO: 299758 - DNA, 25 bp, Mus musculus
caagtgtctgttcagagccacggat

SEQ ID NO: 299759 - DNA, 25 bp, Mus musculus
caagtgtctgttgagagccacggat

SEQ ID NO: 299760 - DNA, 25 bp, Mus musculus
caagtgtgagccatcggatgtggat

SEQ ID NO: 299761 - DNA, 25 bp, Mus musculus
caagtgtgagccttcggatgtggat

SEQ ID NO: 299762 - DNA, 25 bp, Mus musculus
caagtgtgcaagatctgtaagaccc

SEQ ID NO: 299763 - DNA, 25 bp, Mus musculus
caagtgtgcaagttctgtaagaccc

SEQ ID NO: 299764 - DNA, 25 bp, Mus musculus
caagtgtgcaggattgtgtacatac

SEQ ID NO: 299765 - DNA, 25 bp, Mus musculus
caagtgtgcaggtttgtgtacatac

SEQ ID NO: 299766 - DNA, 25 bp, Mus musculus
caagtgtggccaccccgagttgtga

SEQ ID NO: 299767 - DNA, 25 bp, Mus musculus
caagtgtggccagcccgagttgtga

SEQ ID NO: 299768 - DNA, 25 bp, Mus musculus
caagtgtggttgaaaaagcaagccc

SEQ ID NO: 299769 - DNA, 25 bp, Mus musculus
caagtgtggttgtaaaagcaagccc

SEQ ID NO: 299770 - DNA, 25 bp, Mus musculus
caagtgtgtactcaggttcctccag

SEQ ID NO: 299771 - DNA, 25 bp, Mus musculus
caagtgtgtactgaggttcctccag

SEQ ID NO: 299772 - DNA, 25 bp, Mus musculus
caagtgtgtcagcaaggaatggcct

SEQ ID NO: 299773 - DNA, 25 bp, Mus musculus
caagtgtgtcaggaaggaatggcct

SEQ ID NO: 299774 - DNA, 25 bp, Mus musculus
caagtgtgtcgtctgtcaagctgat

SEQ ID NO: 299775 - DNA, 25 bp, Mus musculus
caagtgtgtcgtgtgtcaagctgat

SEQ ID NO: 299776 - DNA, 25 bp, Mus musculus
caagtgtgtgatctctttgcagtca

SEQ ID NO: 299777 - DNA, 25 bp, Mus musculus
caagtgtgtgatgtctttgcagtca

SEQ ID NO: 299778 - DNA, 25 bp, Mus musculus
caagtgtgttttagaactgaggccc

SEQ ID NO: 299779 - DNA, 25 bp, Mus musculus
caagtgtgtttttgaactgaggccc

SEQ ID NO: 299780 - DNA, 25 bp, Mus musculus
caagtgttacatatggctttgtaca

SEQ ID NO: 299781 - DNA, 25 bp, Mus musculus
caagtgttacatttggctttgtaca

SEQ ID NO: 299782 - DNA, 25 bp, Mus musculus
caagtgttagaaccaagagggctga

SEQ ID NO: 299783 - DNA, 25 bp, Mus musculus
caagtgttagaagcaagagggctga

SEQ ID NO: 299784 - DNA, 25 bp, Mus musculus
caagtgttatttcagctgcttatta

SEQ ID NO: 299785 - DNA, 25 bp, Mus musculus
caagtgttatttgagctgcttatta

SEQ ID NO: 299786 - DNA, 25 bp, Mus musculus
caagtgttcagtactcactttagtt

SEQ ID NO: 299787 - DNA, 25 bp, Mus musculus
caagtgttcagttctcactttagtt

SEQ ID NO: 299788 - DNA, 25 bp, Mus musculus
caagtgttcattcatctgccaggat

SEQ ID NO: 299789 - DNA, 25 bp, Mus musculus
caagtgttcattgatctgccaggat

SEQ ID NO: 299790 - DNA, 25 bp, Mus musculus
caagtgttctggctcctctgataat

SEQ ID NO: 299791 - DNA, 25 bp, Mus musculus
caagtgttctgggtcctctgataat

SEQ ID NO: 299792 - DNA, 25 bp, Mus musculus
caagtgttggctacggtgtggcatc

SEQ ID NO: 299793 - DNA, 25 bp, Mus musculus
caagtgttggcttcggtgtggcatc

SEQ ID NO: 299794 - DNA, 25 bp, Mus musculus
caagtgtttacaatgctgagcagat

SEQ ID NO: 299795 - DNA, 25 bp, Mus musculus
caagtgtttacattgctgagcagat

SEQ ID NO: 299796 - DNA, 25 bp, Mus musculus
caagtgtttgacatgtaactggcac

SEQ ID NO: 299797 - DNA, 25 bp, Mus musculus
caagtgtttgacttgtaactggcac

SEQ ID NO: 299798 - DNA, 25 bp, Mus musculus
caagttaaagccaagccttctgtgt

SEQ ID NO: 299799 - DNA, 25 bp, Mus musculus
caagttaaagcctagccttctgtgt

SEQ ID NO: 299800 - DNA, 25 bp, Mus musculus
caagttaacattcccatatgaccca

SEQ ID NO: 299801 - DNA, 25 bp, Mus musculus
caagttaacattgccatatgaccca

SEQ ID NO: 299802 - DNA, 25 bp, Mus musculus
caagttacatttactgcagactttc

SEQ ID NO: 299803 - DNA, 25 bp, Mus musculus
caagttacattttctgcagactttc

SEQ ID NO: 299804 - DNA, 25 bp, Mus musculus
caagttactgataaatgacctgaag

SEQ ID NO: 299805 - DNA, 25 bp, Mus musculus
caagttactgattaatgacctgaag

SEQ ID NO: 299806 - DNA, 25 bp, Mus musculus
caagttagcaagaccttattcccca

SEQ ID NO: 299807 - DNA, 25 bp, Mus musculus
caagttagcaagtccttattcccca

SEQ ID NO: 299808 - DNA, 25 bp, Mus musculus
caagttagccatattcagtttagtt

SEQ ID NO: 299809 - DNA, 25 bp, Mus musculus
caagttagccattttcagtttagtt

SEQ ID NO: 299810 - DNA, 25 bp, Mus musculus
caagttatgagtacttagttttttg

SEQ ID NO: 299811 - DNA, 25 bp, Mus musculus
caagttatgagttcttagttttttg

SEQ ID NO: 299812 - DNA, 25 bp, Mus musculus
caagttatttctcagtgtggcaagt

SEQ ID NO: 299813 - DNA, 25 bp, Mus musculus
caagttatttctgagtgtggcaagt

SEQ ID NO: 299814 - DNA, 25 bp, Mus musculus
caagttatttggcattgtgtaccta

SEQ ID NO: 299815 - DNA, 25 bp, Mus musculus
caagttatttgggattgtgtaccta

SEQ ID NO: 299816 - DNA, 25 bp, Mus musculus
caagttcaaaccaccagcttgtgaa

SEQ ID NO: 299817 - DNA, 25 bp, Mus musculus
caagttcaaaccactacgccataga

SEQ ID NO: 299818 - DNA, 25 bp, Mus musculus
caagttcaaacctccagcttgtgaa

SEQ ID NO: 299819 - DNA, 25 bp, Mus musculus
caagttcaaacctctacgccataga

SEQ ID NO: 299820 - DNA, 25 bp, Mus musculus
caagttcagtgacagaggttgtctt

SEQ ID NO: 299821 - DNA, 25 bp, Mus musculus
caagttcagtgagagaggttgtctt

SEQ ID NO: 299822 - DNA, 25 bp, Mus musculus
caagttcagtttagtctgtccgttt

SEQ ID NO: 299823 - DNA, 25 bp, Mus musculus
caagttcagttttgtctgtccgttt

SEQ ID NO: 299824 - DNA, 25 bp, Mus musculus
caagttcatattaagcccagaggct

SEQ ID NO: 299825 - DNA, 25 bp, Mus musculus
caagttcatatttagcccagaggct

SEQ ID NO: 299826 - DNA, 25 bp, Mus musculus
caagttcatcagaaattgttgtcag

SEQ ID NO: 299827 - DNA, 25 bp, Mus musculus
caagttcatcagtaattgttgtcag

SEQ ID NO: 299828 - DNA, 25 bp, Mus musculus
caagttcatgaaccccattattcct

SEQ ID NO: 299829 - DNA, 25 bp, Mus musculus
caagttcatgaagcccattattcct

SEQ ID NO: 299830 - DNA, 25 bp, Mus musculus
caagttcatgccaggcaactgtact

SEQ ID NO: 299831 - DNA, 25 bp, Mus musculus
caagttcatgcctggcaactgtact

SEQ ID NO: 299832 - DNA, 25 bp, Mus musculus
caagttccagccactaactgcagaa

SEQ ID NO: 299833 - DNA, 25 bp, Mus musculus
caagttccagcctctaactgcagaa

SEQ ID NO: 299834 - DNA, 25 bp, Mus musculus
caagttccccagacattgagtctga

SEQ ID NO: 299835 - DNA, 25 bp, Mus musculus
caagttccccagtcattgagtctga

SEQ ID NO: 299836 - DNA, 25 bp, Mus musculus
caagttcccgtaatgaatgctgtta

SEQ ID NO: 299837 - DNA, 25 bp, Mus musculus
caagttcccgtattgaatgctgtta

SEQ ID NO: 299838 - DNA, 25 bp, Mus musculus
caagttccctagcaagctgccaaac

SEQ ID NO: 299839 - DNA, 25 bp, Mus musculus
caagttccctaggaagctgccaaac

SEQ ID NO: 299840 - DNA, 25 bp, Mus musculus
caagttcccttgcttcttattgaat

SEQ ID NO: 299841 - DNA, 25 bp, Mus musculus
caagttcccttggttcttattgaat

SEQ ID NO: 299842 - DNA, 25 bp, Mus musculus
caagttcctgtgagtcacacaagga

SEQ ID NO: 299843 - DNA, 25 bp, Mus musculus
caagttcctgtgagttgagggccat

SEQ ID NO: 299844 - DNA, 25 bp, Mus musculus
caagttcctgtgtgtcacacaagga

SEQ ID NO: 299845 - DNA, 25 bp, Mus musculus
caagttcctgtgtgttgagggccat

SEQ ID NO: 299846 - DNA, 25 bp, Mus musculus
caagttcctgttacggttctctgac

SEQ ID NO: 299847 - DNA, 25 bp, Mus musculus
caagttcctgtttcggttctctgac

SEQ ID NO: 299848 - DNA, 25 bp, Mus musculus
caagttccttggcctagatttccct

SEQ ID NO: 299849 - DNA, 25 bp, Mus musculus
caagttccttgggctagatttccct

SEQ ID NO: 299850 - DNA, 25 bp, Mus musculus
caagttccttgtacccattttgtgt

SEQ ID NO: 299851 - DNA, 25 bp, Mus musculus
caagttccttgttcccattttgtgt

SEQ ID NO: 299852 - DNA, 25 bp, Mus musculus
caagttcgtaggattgcacgtcacc

SEQ ID NO: 299853 - DNA, 25 bp, Mus musculus
caagttcgtaggtttgcacgtcacc

SEQ ID NO: 299854 - DNA, 25 bp, Mus musculus
caagttctaaaactgtcccaatgac

SEQ ID NO: 299855 - DNA, 25 bp, Mus musculus
caagttctaaaagtgtcccaatgac

SEQ ID NO: 299856 - DNA, 25 bp, Mus musculus
caagttctaactcccttagttgctt

SEQ ID NO: 299857 - DNA, 25 bp, Mus musculus
caagttctaactgccttagttgctt

SEQ ID NO: 299858 - DNA, 25 bp, Mus musculus
caagttctaattctgtcactcacca

SEQ ID NO: 299859 - DNA, 25 bp, Mus musculus
caagttctaattgtgtcactcacca

SEQ ID NO: 299860 - DNA, 25 bp, Mus musculus
caagttctacatatgcaggccaggc

SEQ ID NO: 299861 - DNA, 25 bp, Mus musculus
caagttctacatttgcaggccaggc

SEQ ID NO: 299862 - DNA, 25 bp, Mus musculus
caagttctactgcatgtctgatgca

SEQ ID NO: 299863 - DNA, 25 bp, Mus musculus
caagttctactggatgtctgatgca

SEQ ID NO: 299864 - DNA, 25 bp, Mus musculus
caagttctatttaagaggcctcaac

SEQ ID NO: 299865 - DNA, 25 bp, Mus musculus
caagttctattttagaggcctcaac

SEQ ID NO: 299866 - DNA, 25 bp, Mus musculus
caagttctctaacatattgtgattg

SEQ ID NO: 299867 - DNA, 25 bp, Mus musculus
caagttctctaagatattgtgattg

SEQ ID NO: 299868 - DNA, 25 bp, Mus musculus
caagttctctctctgcagcagcaaa

SEQ ID NO: 299869 - DNA, 25 bp, Mus musculus
caagttctctctgtgcagcagcaaa

SEQ ID NO: 299870 - DNA, 25 bp, Mus musculus
caagttctgaaaatgcccacgtggg

SEQ ID NO: 299871 - DNA, 25 bp, Mus musculus
caagttctgaaattgcccacgtggg

SEQ ID NO: 299872 - DNA, 25 bp, Mus musculus
caagttctgataccccatggtccca

SEQ ID NO: 299873 - DNA, 25 bp, Mus musculus
caagttctgatagcccatggtccca

SEQ ID NO: 299874 - DNA, 25 bp, Mus musculus
caagttcttagacacagcggcaaat

SEQ ID NO: 299875 - DNA, 25 bp, Mus musculus
caagttcttagagacagcggcaaat

SEQ ID NO: 299876 - DNA, 25 bp, Mus musculus
caagttcttctcatggcatttagca

SEQ ID NO: 299877 - DNA, 25 bp, Mus musculus
caagttcttctcttggcatttagca

SEQ ID NO: 299878 - DNA, 25 bp, Mus musculus
caagttcttgatagccttttgggaa

SEQ ID NO: 299879 - DNA, 25 bp, Mus musculus
caagttcttgattgccttttgggaa

SEQ ID NO: 299880 - DNA, 25 bp, Mus musculus
caagttcttgtcaatccctcataca

SEQ ID NO: 299881 - DNA, 25 bp, Mus musculus
caagttcttgtctatccctcataca

SEQ ID NO: 299882 - DNA, 25 bp, Mus musculus
caagttcttgtgctgatttaccgta

SEQ ID NO: 299883 - DNA, 25 bp, Mus musculus
caagttcttgtggtgatttaccgta

SEQ ID NO: 299884 - DNA, 25 bp, Mus musculus
caagttctttgcatatgtgttttca

SEQ ID NO: 299885 - DNA, 25 bp, Mus musculus
caagttctttgcttatgtgttttca

SEQ ID NO: 299886 - DNA, 25 bp, Mus musculus
caagttctttgtacgaatccagcgc

SEQ ID NO: 299887 - DNA, 25 bp, Mus musculus
caagttctttgttcgaatccagcgc

SEQ ID NO: 299888 - DNA, 25 bp, Mus musculus
caagttgaagtcatcgtcttcatct

SEQ ID NO: 299889 - DNA, 25 bp, Mus musculus
caagttgaagtcttcgtcttcatct

SEQ ID NO: 299890 - DNA, 25 bp, Mus musculus
caagttgacaatacactggtatttt

SEQ ID NO: 299891 - DNA, 25 bp, Mus musculus
caagttgacaattcactggtatttt

SEQ ID NO: 299892 - DNA, 25 bp, Mus musculus
caagttgacaggcaattcccacact

SEQ ID NO: 299893 - DNA, 25 bp, Mus musculus
caagttgacagggaattcccacact

SEQ ID NO: 299894 - DNA, 25 bp, Mus musculus
caagttgagcttaatattggtcaca

SEQ ID NO: 299895 - DNA, 25 bp, Mus musculus
caagttgagctttatattggtcaca

SEQ ID NO: 299896 - DNA, 25 bp, Mus musculus
caagttgagtaaaggtgacagtgct

SEQ ID NO: 299897 - DNA, 25 bp, Mus musculus
caagttgagtaatggtgacagtgct

SEQ ID NO: 299898 - DNA, 25 bp, Mus musculus
caagttgatgagataaggcgattct

SEQ ID NO: 299899 - DNA, 25 bp, Mus musculus
caagttgatgagctttaggtccagg

SEQ ID NO: 299900 - DNA, 25 bp, Mus musculus
caagttgatgaggtttaggtccagg

SEQ ID NO: 299901 - DNA, 25 bp, Mus musculus
caagttgatgagttaaggcgattct

SEQ ID NO: 299902 - DNA, 25 bp, Mus musculus
caagttgattctctacctggtaaaa

SEQ ID NO: 299903 - DNA, 25 bp, Mus musculus
caagttgattctgtacctggtaaaa

SEQ ID NO: 299904 - DNA, 25 bp, Mus musculus
caagttgcaagtctacttccagagc

SEQ ID NO: 299905 - DNA, 25 bp, Mus musculus
caagttgcaagtgtacttccagagc

SEQ ID NO: 299906 - DNA, 25 bp, Mus musculus
caagttgcacaaacggcagatgttt

SEQ ID NO: 299907 - DNA, 25 bp, Mus musculus
caagttgcacaatcggcagatgttt

SEQ ID NO: 299908 - DNA, 25 bp, Mus musculus
caagttgcagaacctcaaggcccag

SEQ ID NO: 299909 - DNA, 25 bp, Mus musculus
caagttgcagaagctcaaggcccag

SEQ ID NO: 299910 - DNA, 25 bp, Mus musculus
caagttgcctacaaagggttccgtg

SEQ ID NO: 299911 - DNA, 25 bp, Mus musculus
caagttgcctactaagggttccgtg

SEQ ID NO: 299912 - DNA, 25 bp, Mus musculus
caagttgctagaccaaaatattaaa

SEQ ID NO: 299913 - DNA, 25 bp, Mus musculus
caagttgctagagcaaaatattaaa

SEQ ID NO: 299914 - DNA, 25 bp, Mus musculus
caagttgctgtgatggcgtgtctcc

SEQ ID NO: 299915 - DNA, 25 bp, Mus musculus
caagttgctgtgttggcgtgtctcc

SEQ ID NO: 299916 - DNA, 25 bp, Mus musculus
caagttgcttagcatctcagggcca

SEQ ID NO: 299917 - DNA, 25 bp, Mus musculus
caagttgcttaggatctcagggcca

SEQ ID NO: 299918 - DNA, 25 bp, Mus musculus
caagttggacatacaaagccgtaat

SEQ ID NO: 299919 - DNA, 25 bp, Mus musculus
caagttggacattcaaagccgtaat

SEQ ID NO: 299920 - DNA, 25 bp, Mus musculus
caagttggcaggactctgggagttt

SEQ ID NO: 299921 - DNA, 25 bp, Mus musculus
caagttggcaggtctctgggagttt

SEQ ID NO: 299922 - DNA, 25 bp, Mus musculus
caagttggccatacgagggtggccc

SEQ ID NO: 299923 - DNA, 25 bp, Mus musculus
caagttggccattcgagggtggccc

SEQ ID NO: 299924 - DNA, 25 bp, Mus musculus
caagttggccctccggtgttcaggt

SEQ ID NO: 299925 - DNA, 25 bp, Mus musculus
caagttggccctgcggtgttcaggt

SEQ ID NO: 299926 - DNA, 25 bp, Mus musculus
caagttggccttatgtatcagcaga

SEQ ID NO: 299927 - DNA, 25 bp, Mus musculus
caagttggccttttgtatcagcaga

SEQ ID NO: 299928 - DNA, 25 bp, Mus musculus
caagttggctcaatccttagggaca

SEQ ID NO: 299929 - DNA, 25 bp, Mus musculus
caagttggctcattccttagggaca

SEQ ID NO: 299930 - DNA, 25 bp, Mus musculus
caagttgggtttcccgagagccaga

SEQ ID NO: 299931 - DNA, 25 bp, Mus musculus
caagttgggtttgccgagagccaga

SEQ ID NO: 299932 - DNA, 25 bp, Mus musculus
caagttgtagtgagctgggtcttcc

SEQ ID NO: 299933 - DNA, 25 bp, Mus musculus
caagttgtagtgtgctgggtcttcc

SEQ ID NO: 299934 - DNA, 25 bp, Mus musculus
caagttgtccacatttatccactgt

SEQ ID NO: 299935 - DNA, 25 bp, Mus musculus
caagttgtccacttttatccactgt

SEQ ID NO: 299936 - DNA, 25 bp, Mus musculus
caagttgtccatcagaccagaggta

SEQ ID NO: 299937 - DNA, 25 bp, Mus musculus
caagttgtccatgagaccagaggta

SEQ ID NO: 299938 - DNA, 25 bp, Mus musculus
caagttgtcctaagatttccatcgg

SEQ ID NO: 299939 - DNA, 25 bp, Mus musculus
caagttgtcctatgatttccatcgg

SEQ ID NO: 299940 - DNA, 25 bp, Mus musculus
caagttgtcttcaaggctccagatg

SEQ ID NO: 299941 - DNA, 25 bp, Mus musculus
caagttgtcttctaggctccagatg

SEQ ID NO: 299942 - DNA, 25 bp, Mus musculus
caagttgtgttgatgcctcgggaaa

SEQ ID NO: 299943 - DNA, 25 bp, Mus musculus
caagttgtgttgttgcctcgggaaa

SEQ ID NO: 299944 - DNA, 25 bp, Mus musculus
caagttgttgtaaagtgagcggttc

SEQ ID NO: 299945 - DNA, 25 bp, Mus musculus
caagttgttgtatagtgagcggttc

SEQ ID NO: 299946 - DNA, 25 bp, Mus musculus
caagttgtttggaatttctttgtat

SEQ ID NO: 299947 - DNA, 25 bp, Mus musculus
caagttgtttggtatttctttgtat

SEQ ID NO: 299948 - DNA, 25 bp, Mus musculus
caagttgttttcctagctgaagtag

SEQ ID NO: 299949 - DNA, 25 bp, Mus musculus
caagttgttttcgtagctgaagtag

SEQ ID NO: 299950 - DNA, 25 bp, Mus musculus
caagttgttttgctgtaggcttaac

SEQ ID NO: 299951 - DNA, 25 bp, Mus musculus
caagttgttttggtgtaggcttaac

SEQ ID NO: 299952 - DNA, 25 bp, Mus musculus
caagtttaagagacccactgggaca

SEQ ID NO: 299953 - DNA, 25 bp, Mus musculus
caagtttaagagtcccactgggaca

SEQ ID NO: 299954 - DNA, 25 bp, Mus musculus
caagtttaccctcaaagttatgctt

SEQ ID NO: 299955 - DNA, 25 bp, Mus musculus
caagtttaccctgaaagttatgctt

SEQ ID NO: 299956 - DNA, 25 bp, Mus musculus
caagtttagtacatcactccttagt

SEQ ID NO: 299957 - DNA, 25 bp, Mus musculus
caagtttagtacttcactccttagt

SEQ ID NO: 299958 - DNA, 25 bp, Mus musculus
caagtttatctcagggtatgtagta

SEQ ID NO: 299959 - DNA, 25 bp, Mus musculus
caagtttatctctgggtatgtagta

SEQ ID NO: 299960 - DNA, 25 bp, Mus musculus
caagtttcaaacagctcaagtggga

SEQ ID NO: 299961 - DNA, 25 bp, Mus musculus
caagtttcaaactgctcaagtggga

SEQ ID NO: 299962 - DNA, 25 bp, Mus musculus
caagtttcagatcatgtcagaccag

SEQ ID NO: 299963 - DNA, 25 bp, Mus musculus
caagtttcagatgatgtcagaccag

SEQ ID NO: 299964 - DNA, 25 bp, Mus musculus
caagtttcatccctgtacttttcct

SEQ ID NO: 299965 - DNA, 25 bp, Mus musculus
caagtttcatccgtgtacttttcct

SEQ ID NO: 299966 - DNA, 25 bp, Mus musculus
caagtttccttgagcccttgtgtaa

SEQ ID NO: 299967 - DNA, 25 bp, Mus musculus
caagtttccttgtgcccttgtgtaa

SEQ ID NO: 299968 - DNA, 25 bp, Mus musculus
caagtttctatcatacctgttccaa

SEQ ID NO: 299969 - DNA, 25 bp, Mus musculus
caagtttctatcttacctgttccaa

SEQ ID NO: 299970 - DNA, 25 bp, Mus musculus
caagtttgaatcactctgtggcaat

SEQ ID NO: 299971 - DNA, 25 bp, Mus musculus
caagtttgaatctctctgtggcaat

SEQ ID NO: 299972 - DNA, 25 bp, Mus musculus
caagtttgacttctgactctggtat

SEQ ID NO: 299973 - DNA, 25 bp, Mus musculus
caagtttgacttgtgactctggtat

SEQ ID NO: 299974 - DNA, 25 bp, Mus musculus
caagtttgagagactgtagatggaa

SEQ ID NO: 299975 - DNA, 25 bp, Mus musculus
caagtttgagagtctgtagatggaa

SEQ ID NO: 299976 - DNA, 25 bp, Mus musculus
caagtttgaggtcaaccctttggtg

SEQ ID NO: 299977 - DNA, 25 bp, Mus musculus
caagtttgaggtgaaccctttggtg

SEQ ID NO: 299978 - DNA, 25 bp, Mus musculus
caagtttgcactaacatgggctgtt

SEQ ID NO: 299979 - DNA, 25 bp, Mus musculus
caagtttgcacttacatgggctgtt

SEQ ID NO: 299980 - DNA, 25 bp, Mus musculus
caagtttgcagtcgttctaagtgaa

SEQ ID NO: 299981 - DNA, 25 bp, Mus musculus
caagtttgcagtggttctaagtgaa

SEQ ID NO: 299982 - DNA, 25 bp, Mus musculus
caagtttgctccaggccagtacatc

SEQ ID NO: 299983 - DNA, 25 bp, Mus musculus
caagtttgctcctggccagtacatc

SEQ ID NO: 299984 - DNA, 25 bp, Mus musculus
caagtttgctgacctctctgaggct

SEQ ID NO: 299985 - DNA, 25 bp, Mus musculus
caagtttgctgagctctctgaggct

SEQ ID NO: 299986 - DNA, 25 bp, Mus musculus
caagtttgctggcaggtccttcagg

SEQ ID NO: 299987 - DNA, 25 bp, Mus musculus
caagtttgctgggaggtccttcagg

SEQ ID NO: 299988 - DNA, 25 bp, Mus musculus
caagtttgtaacctgtcgctcctac

SEQ ID NO: 299989 - DNA, 25 bp, Mus musculus
caagtttgtaacgtgtcgctcctac

SEQ ID NO: 299990 - DNA, 25 bp, Mus musculus
caagtttgtattcccagcacatcgg

SEQ ID NO: 299991 - DNA, 25 bp, Mus musculus
caagtttgtattgccagcacatcgg

SEQ ID NO: 299992 - DNA, 25 bp, Mus musculus
caagtttgtgaaatcctgtaatgaa

SEQ ID NO: 299993 - DNA, 25 bp, Mus musculus
caagtttgtgaattcctgtaatgaa

SEQ ID NO: 299994 - DNA, 25 bp, Mus musculus
caagttttagtgaggctgcattgat

SEQ ID NO: 299995 - DNA, 25 bp, Mus musculus
caagttttagtgtggctgcattgat

SEQ ID NO: 299996 - DNA, 25 bp, Mus musculus
caagttttcagaatgtctccttaaa

SEQ ID NO: 299997 - DNA, 25 bp, Mus musculus
caagttttcagattgtctccttaaa

SEQ ID NO: 299998 - DNA, 25 bp, Mus musculus
caagttttccagataacggcggcgt

SEQ ID NO: 299999 - DNA, 25 bp, Mus musculus
caagttttccagttaacggcggcgt

SEQ ID NO: 300000 - DNA, 25 bp, Mus musculus
caagttttccatcctgctgttaagt

SEQ ID NO: 300001 - DNA, 25 bp, Mus musculus
caagttttccatgctgctgttaagt

SEQ ID NO: 300002 - DNA, 25 bp, Mus musculus
caagttttccctaacaatcctgagt

SEQ ID NO: 300003 - DNA, 25 bp, Mus musculus
caagttttcccttacaatcctgagt

SEQ ID NO: 300004 - DNA, 25 bp, Mus musculus
caagttttcctacttattaagagtg

SEQ ID NO: 300005 - DNA, 25 bp, Mus musculus
caagttttcctagttattaagagtg

SEQ ID NO: 300006 - DNA, 25 bp, Mus musculus
caagttttccttaagttgtcacgag

SEQ ID NO: 300007 - DNA, 25 bp, Mus musculus
caagttttcctttagttgtcacgag

SEQ ID NO: 300008 - DNA, 25 bp, Mus musculus
caagttttctgtattgagggacctt

SEQ ID NO: 300009 - DNA, 25 bp, Mus musculus
caagttttctgttttgagggacctt

SEQ ID NO: 300010 - DNA, 25 bp, Mus musculus
caagtttttaatccctctgttcatg

SEQ ID NO: 300011 - DNA, 25 bp, Mus musculus
caagtttttaatgcctctgttcatg

SEQ ID NO: 300012 - DNA, 25 bp, Mus musculus
caagtttttcagagcctaccaaaat

SEQ ID NO: 300013 - DNA, 25 bp, Mus musculus
caagtttttcagtgcctaccaaaat

SEQ ID NO: 300014 - DNA, 25 bp, Mus musculus
caagtttttctaatctcaatgagaa

SEQ ID NO: 300015 - DNA, 25 bp, Mus musculus
caagtttttctattctcaatgagaa

SEQ ID NO: 300016 - DNA, 25 bp, Mus musculus
caagtttttgaaccccagcacctga

SEQ ID NO: 300017 - DNA, 25 bp, Mus musculus
caagtttttgaagcccagcacctga

SEQ ID NO: 300018 - DNA, 25 bp, Mus musculus
caagtttttgataactcatgtctga

SEQ ID NO: 300019 - DNA, 25 bp, Mus musculus
caagtttttgattactcatgtctga

SEQ ID NO: 300020 - DNA, 25 bp, Mus musculus
caataaaaactcactactgctttgt

SEQ ID NO: 300021 - DNA, 25 bp, Mus musculus
caataaaaactctctactgctttgt

SEQ ID NO: 300022 - DNA, 25 bp, Mus musculus
caataaaagtctcggtcggtcggat

SEQ ID NO: 300023 - DNA, 25 bp, Mus musculus
caataaaagtctgggtcggtcggat

SEQ ID NO: 300024 - DNA, 25 bp, Mus musculus
caataaacagtacgagtccctccaa

SEQ ID NO: 300025 - DNA, 25 bp, Mus musculus
caataaacagtaggagtccctccaa

SEQ ID NO: 300026 - DNA, 25 bp, Mus musculus
caataaaccagtattgtggctgcca

SEQ ID NO: 300027 - DNA, 25 bp, Mus musculus
caataaaccagttttgtggctgcca

SEQ ID NO: 300028 - DNA, 25 bp, Mus musculus
caataaacccatccacagagcatac

SEQ ID NO: 300029 - DNA, 25 bp, Mus musculus
caataaacccatgcacagagcatac

SEQ ID NO: 300030 - DNA, 25 bp, Mus musculus
caataaacgatcatcccgttggccg

SEQ ID NO: 300031 - DNA, 25 bp, Mus musculus
caataaacgatcttcccgttggccg

SEQ ID NO: 300032 - DNA, 25 bp, Mus musculus
caataaagcaatacactgagttggg

SEQ ID NO: 300033 - DNA, 25 bp, Mus musculus
caataaagcaattcactgagttggg

SEQ ID NO: 300034 - DNA, 25 bp, Mus musculus
caataaagcaccaatgcccacagtg

SEQ ID NO: 300035 - DNA, 25 bp, Mus musculus
caataaagcacctatgcccacagtg

SEQ ID NO: 300036 - DNA, 25 bp, Mus musculus
caataaagctatctatggcctggat

SEQ ID NO: 300037 - DNA, 25 bp, Mus musculus
caataaagctatgtatggcctggat

SEQ ID NO: 300038 - DNA, 25 bp, Mus musculus
caataaagctgtccattcaattcca

SEQ ID NO: 300039 - DNA, 25 bp, Mus musculus
caataaagctgtgcattcaattcca

SEQ ID NO: 300040 - DNA, 25 bp, Mus musculus
caataaaggagcactccccacaagt

SEQ ID NO: 300041 - DNA, 25 bp, Mus musculus
caataaaggagctctccccacaagt

SEQ ID NO: 300042 - DNA, 25 bp, Mus musculus
caataaagtctgcatttgttctgcc

SEQ ID NO: 300043 - DNA, 25 bp, Mus musculus
caataaagtctggatttgttctgcc

SEQ ID NO: 300044 - DNA, 25 bp, Mus musculus
caataaatacatagtcctgacaaac

SEQ ID NO: 300045 - DNA, 25 bp, Mus musculus
caataaatacattgtcctgacaaac

SEQ ID NO: 300046 - DNA, 25 bp, Mus musculus
caataacacggcatattctcgtcat

SEQ ID NO: 300047 - DNA, 25 bp, Mus musculus
caataacacggcttattctcgtcat

SEQ ID NO: 300048 - DNA, 25 bp, Mus musculus
caataacagcgtcttgggagctgga

SEQ ID NO: 300049 - DNA, 25 bp, Mus musculus
caataacagcgtgttgggagctgga

SEQ ID NO: 300050 - DNA, 25 bp, Mus musculus
caataacattgtagcagatgtgcat

SEQ ID NO: 300051 - DNA, 25 bp, Mus musculus
caataacattgttgcagatgtgcat

SEQ ID NO: 300052 - DNA, 25 bp, Mus musculus
caataacccggcagccaactggcta

SEQ ID NO: 300053 - DNA, 25 bp, Mus musculus
caataacccggctgccaactggcta

SEQ ID NO: 300054 - DNA, 25 bp, Mus musculus
caataacctgctattgaacacctcc

SEQ ID NO: 300055 - DNA, 25 bp, Mus musculus
caataacctgcttttgaacacctcc

SEQ ID NO: 300056 - DNA, 25 bp, Mus musculus
caataacctggtaggctctggagtc

SEQ ID NO: 300057 - DNA, 25 bp, Mus musculus
caataacctggttggctctggagtc

SEQ ID NO: 300058 - DNA, 25 bp, Mus musculus
caataaccttttccttgaggacgtg

SEQ ID NO: 300059 - DNA, 25 bp, Mus musculus
caataaccttttgcttgaggacgtg

SEQ ID NO: 300060 - DNA, 25 bp, Mus musculus
caataactccacaaagtatctgatt

SEQ ID NO: 300061 - DNA, 25 bp, Mus musculus
caataactccactaagtatctgatt

SEQ ID NO: 300062 - DNA, 25 bp, Mus musculus
caataactctcaatggtttaacgag

SEQ ID NO: 300063 - DNA, 25 bp, Mus musculus
caataactctcattggtttaacgag

SEQ ID NO: 300064 - DNA, 25 bp, Mus musculus
caataactgcctatggctgactctg

SEQ ID NO: 300065 - DNA, 25 bp, Mus musculus
caataactgcctttggctgactctg

SEQ ID NO: 300066 - DNA, 25 bp, Mus musculus
caataagaacgtcttctggccccac

SEQ ID NO: 300067 - DNA, 25 bp, Mus musculus
caataagaacgtgttctggccccac

SEQ ID NO: 300068 - DNA, 25 bp, Mus musculus
caataagaagagctccccaaagggt

SEQ ID NO: 300069 - DNA, 25 bp, Mus musculus
caataagaagaggtccccaaagggt

SEQ ID NO: 300070 - DNA, 25 bp, Mus musculus
caataagagcccctggtgccgcaat

SEQ ID NO: 300071 - DNA, 25 bp, Mus musculus
caataagagcccgtggtgccgcaat

SEQ ID NO: 300072 - DNA, 25 bp, Mus musculus
caataagcaaccaactgaacttgac

SEQ ID NO: 300073 - DNA, 25 bp, Mus musculus
caataagcaacctactgaacttgac

SEQ ID NO: 300074 - DNA, 25 bp, Mus musculus
caataagcccaaactgccagtggtg

SEQ ID NO: 300075 - DNA, 25 bp, Mus musculus
caataagcccaatctgccagtggtg

SEQ ID NO: 300076 - DNA, 25 bp, Mus musculus
caataagtctgcatggcgccattac

SEQ ID NO: 300077 - DNA, 25 bp, Mus musculus
caataagtctgcttggcgccattac

SEQ ID NO: 300078 - DNA, 25 bp, Mus musculus
caataataatttctctcccattcac

SEQ ID NO: 300079 - DNA, 25 bp, Mus musculus
caataataatttgtctcccattcac

SEQ ID NO: 300080 - DNA, 25 bp, Mus musculus
caataatagcccatttgtgttagta

SEQ ID NO: 300081 - DNA, 25 bp, Mus musculus
caataatagcccttttgtgttagta

SEQ ID NO: 300082 - DNA, 25 bp, Mus musculus
caataatatactctgtgtgcgtgca

SEQ ID NO: 300083 - DNA, 25 bp, Mus musculus
caataatatactgtgtgtgcgtgca

SEQ ID NO: 300084 - DNA, 25 bp, Mus musculus
caataatctgtcactgtggactcag

SEQ ID NO: 300085 - DNA, 25 bp, Mus musculus
caataatctgtctctgtggactcag

SEQ ID NO: 300086 - DNA, 25 bp, Mus musculus
caataatctttcactgtggactcag

SEQ ID NO: 300087 - DNA, 25 bp, Mus musculus
caataatctttctctgtggactcag

SEQ ID NO: 300088 - DNA, 25 bp, Mus musculus
caataatgaccgcattctcgtgcgt

SEQ ID NO: 300089 - DNA, 25 bp, Mus musculus
caataatgaccggattctcgtgcgt

SEQ ID NO: 300090 - DNA, 25 bp, Mus musculus
caataatgatggcacatctaattat

SEQ ID NO: 300091 - DNA, 25 bp, Mus musculus
caataatgatgggacatctaattat

SEQ ID NO: 300092 - DNA, 25 bp, Mus musculus
caataatgcctactgtgtgacctgt

SEQ ID NO: 300093 - DNA, 25 bp, Mus musculus
caataatgcctagtgtgtgacctgt

SEQ ID NO: 300094 - DNA, 25 bp, Mus musculus
caataatggtttcaacccacggtgg

SEQ ID NO: 300095 - DNA, 25 bp, Mus musculus
caataatggtttgaacccacggtgg

SEQ ID NO: 300096 - DNA, 25 bp, Mus musculus
caataatgtgctctggctgcattac

SEQ ID NO: 300097 - DNA, 25 bp, Mus musculus
caataatgtgctgtggctgcattac

SEQ ID NO: 300098 - DNA, 25 bp, Mus musculus
caataattactgagatcaatcatta

SEQ ID NO: 300099 - DNA, 25 bp, Mus musculus
caataattactgtgatcaatcatta

SEQ ID NO: 300100 - DNA, 25 bp, Mus musculus
caataattctgaaccggatcccttc

SEQ ID NO: 300101 - DNA, 25 bp, Mus musculus
caataattctgatccggatcccttc

SEQ ID NO: 300102 - DNA, 25 bp, Mus musculus
caataattgtagagggagactttaa

SEQ ID NO: 300103 - DNA, 25 bp, Mus musculus
caataattgtagtgggagactttaa

SEQ ID NO: 300104 - DNA, 25 bp, Mus musculus
caataatttctaactggtccctgcc

SEQ ID NO: 300105 - DNA, 25 bp, Mus musculus
caataatttctatctggtccctgcc

SEQ ID NO: 300106 - DNA, 25 bp, Mus musculus
caataatttctgaatgtgatcaaga

SEQ ID NO: 300107 - DNA, 25 bp, Mus musculus
caataatttctgtatgtgatcaaga

SEQ ID NO: 300108 - DNA, 25 bp, Mus musculus
caatacaagagccagggattcctac

SEQ ID NO: 300109 - DNA, 25 bp, Mus musculus
caatacaagagcgagggattcctac

SEQ ID NO: 300110 - DNA, 25 bp, Mus musculus
caatacaatatacctcctccataaa

SEQ ID NO: 300111 - DNA, 25 bp, Mus musculus
caatacaatatagctcctccataaa

SEQ ID NO: 300112 - DNA, 25 bp, Mus musculus
caatacaatcggataaggtagacct

SEQ ID NO: 300113 - DNA, 25 bp, Mus musculus
caatacaatcggttaaggtagacct

SEQ ID NO: 300114 - DNA, 25 bp, Mus musculus
caatacacctctcttccagattaat

SEQ ID NO: 300115 - DNA, 25 bp, Mus musculus
caatacacctctgttccagattaat

SEQ ID NO: 300116 - DNA, 25 bp, Mus musculus
caatacagccttagtctacgtaaag

SEQ ID NO: 300117 - DNA, 25 bp, Mus musculus
caatacagcctttgtctacgtaaag

SEQ ID NO: 300118 - DNA, 25 bp, Mus musculus
caatacaggttcaaagccctctgct

SEQ ID NO: 300119 - DNA, 25 bp, Mus musculus
caatacaggttctaagccctctgct

SEQ ID NO: 300120 - DNA, 25 bp, Mus musculus
caatacagtagaattcagaatgctc

SEQ ID NO: 300121 - DNA, 25 bp, Mus musculus
caatacagtagatttcagaatgctc

SEQ ID NO: 300122 - DNA, 25 bp, Mus musculus
caatacagtattagcttcattgtgt

SEQ ID NO: 300123 - DNA, 25 bp, Mus musculus
caatacagtatttgcttcattgtgt

SEQ ID NO: 300124 - DNA, 25 bp, Mus musculus
caatacagtgacatgcttcagaggc

SEQ ID NO: 300125 - DNA, 25 bp, Mus musculus
caatacagtgacttgcttcagaggc

SEQ ID NO: 300126 - DNA, 25 bp, Mus musculus
caataccaagtgactggctgagcca

SEQ ID NO: 300127 - DNA, 25 bp, Mus musculus
caataccaagtgtctggctgagcca

SEQ ID NO: 300128 - DNA, 25 bp, Mus musculus
caataccaccggactagttagcctt

SEQ ID NO: 300129 - DNA, 25 bp, Mus musculus
caataccaccggtctagttagcctt

SEQ ID NO: 300130 - DNA, 25 bp, Mus musculus
caataccactaaaaaaccagtttag

SEQ ID NO: 300131 - DNA, 25 bp, Mus musculus
caataccactaataaaccagtttag

SEQ ID NO: 300132 - DNA, 25 bp, Mus musculus
caataccagcttccgagaggaatcg

SEQ ID NO: 300133 - DNA, 25 bp, Mus musculus
caataccagcttgcgagaggaatcg

SEQ ID NO: 300134 - DNA, 25 bp, Mus musculus
caataccagttcagctatcgagccg

SEQ ID NO: 300135 - DNA, 25 bp, Mus musculus
caataccagttctgctatcgagccg

SEQ ID NO: 300136 - DNA, 25 bp, Mus musculus
caataccagtttaagggattgcctg

SEQ ID NO: 300137 - DNA, 25 bp, Mus musculus
caataccagttttagggattgcctg

SEQ ID NO: 300138 - DNA, 25 bp, Mus musculus
caataccatgacattgggcgacatt

SEQ ID NO: 300139 - DNA, 25 bp, Mus musculus
caataccatgactttgggcgacatt

SEQ ID NO: 300140 - DNA, 25 bp, Mus musculus
caataccatgctacttgcctaatat

SEQ ID NO: 300141 - DNA, 25 bp, Mus musculus
caataccatgcttcttgcctaatat

SEQ ID NO: 300142 - DNA, 25 bp, Mus musculus
caataccatggtcatggcaatcagt

SEQ ID NO: 300143 - DNA, 25 bp, Mus musculus
caataccatggtgatggcaatcagt

SEQ ID NO: 300144 - DNA, 25 bp, Mus musculus
caataccattctctttcgagggaat

SEQ ID NO: 300145 - DNA, 25 bp, Mus musculus
caataccattctgtttcgagggaat

SEQ ID NO: 300146 - DNA, 25 bp, Mus musculus
caataccatttcataccctctaatc

SEQ ID NO: 300147 - DNA, 25 bp, Mus musculus
caataccatttcttaccctctaatc

SEQ ID NO: 300148 - DNA, 25 bp, Mus musculus
caatacccgaaaatccctcctctct

SEQ ID NO: 300149 - DNA, 25 bp, Mus musculus
caatacccgaaattccctcctctct

SEQ ID NO: 300150 - DNA, 25 bp, Mus musculus
caataccctgccagaagttgcttat

SEQ ID NO: 300151 - DNA, 25 bp, Mus musculus
caataccctgcctgaagttgcttat

SEQ ID NO: 300152 - DNA, 25 bp, Mus musculus
caatacccttgtaaattgcccgttg

SEQ ID NO: 300153 - DNA, 25 bp, Mus musculus
caatacccttgttaattgcccgttg

SEQ ID NO: 300154 - DNA, 25 bp, Mus musculus
caatacgaggaacgcctggaccctt

SEQ ID NO: 300155 - DNA, 25 bp, Mus musculus
caatacgaggaaggcctggaccctt

SEQ ID NO: 300156 - DNA, 25 bp, Mus musculus
caatacgctcctaccatcagtcatg

SEQ ID NO: 300157 - DNA, 25 bp, Mus musculus
caatacgctccttccatcagtcatg

SEQ ID NO: 300158 - DNA, 25 bp, Mus musculus
caatactatcttagtgacggccctc

SEQ ID NO: 300159 - DNA, 25 bp, Mus musculus
caatactatctttgtgacggccctc

SEQ ID NO: 300160 - DNA, 25 bp, Mus musculus
caatactcatgtctgtgggcaaaaa

SEQ ID NO: 300161 - DNA, 25 bp, Mus musculus
caatactcatgtgtgtgggcaaaaa

SEQ ID NO: 300162 - DNA, 25 bp, Mus musculus
caatactcgaggcattgtttttgtt

SEQ ID NO: 300163 - DNA, 25 bp, Mus musculus
caatactcgagggattgtttttgtt

SEQ ID NO: 300164 - DNA, 25 bp, Mus musculus
caatactctgtgctcttgtgactgg

SEQ ID NO: 300165 - DNA, 25 bp, Mus musculus
caatactctgtggtcttgtgactgg

SEQ ID NO: 300166 - DNA, 25 bp, Mus musculus
caatactggtgtcatcggtcattcc

SEQ ID NO: 300167 - DNA, 25 bp, Mus musculus
caatactggtgtgatcggtcattcc

SEQ ID NO: 300168 - DNA, 25 bp, Mus musculus
caatactgttgcaatttcccactaa

SEQ ID NO: 300169 - DNA, 25 bp, Mus musculus
caatactgttgctatttcccactaa

SEQ ID NO: 300170 - DNA, 25 bp, Mus musculus
caatacttccttacctacttacagt

SEQ ID NO: 300171 - DNA, 25 bp, Mus musculus
caatacttcctttcctacttacagt

SEQ ID NO: 300172 - DNA, 25 bp, Mus musculus
caatacttgggtcgagccatctcct

SEQ ID NO: 300173 - DNA, 25 bp, Mus musculus
caatacttgggtggagccatctcct

SEQ ID NO: 300174 - DNA, 25 bp, Mus musculus
caatacttgtgtcctagcttctgtt

SEQ ID NO: 300175 - DNA, 25 bp, Mus musculus
caatacttgtgtgctagcttctgtt

SEQ ID NO: 300176 - DNA, 25 bp, Mus musculus
caatagaaatcccacgttcacatct

SEQ ID NO: 300177 - DNA, 25 bp, Mus musculus
caatagaaatccgacgttcacatct

SEQ ID NO: 300178 - DNA, 25 bp, Mus musculus
caatagagatgacaactgtctgcct

SEQ ID NO: 300179 - DNA, 25 bp, Mus musculus
caatagagatgagaactgtctgcct

SEQ ID NO: 300180 - DNA, 25 bp, Mus musculus
caatagagtaccaggctcactggct

SEQ ID NO: 300181 - DNA, 25 bp, Mus musculus
caatagagtacctggctcactggct

SEQ ID NO: 300182 - DNA, 25 bp, Mus musculus
caatagatagccagggtcccattaa

SEQ ID NO: 300183 - DNA, 25 bp, Mus musculus
caatagatagcctgggtcccattaa

SEQ ID NO: 300184 - DNA, 25 bp, Mus musculus
caatagatagtgagttgggcttaac

SEQ ID NO: 300185 - DNA, 25 bp, Mus musculus
caatagatagtgtgttgggcttaac

SEQ ID NO: 300186 - DNA, 25 bp, Mus musculus
caatagatgctactgggccaaggag

SEQ ID NO: 300187 - DNA, 25 bp, Mus musculus
caatagatgctagtgggccaaggag

SEQ ID NO: 300188 - DNA, 25 bp, Mus musculus
caatagatgttgctttcttctccgg

SEQ ID NO: 300189 - DNA, 25 bp, Mus musculus
caatagatgttggtttcttctccgg

SEQ ID NO: 300190 - DNA, 25 bp, Mus musculus
caatagcacatgattgctctcaaat

SEQ ID NO: 300191 - DNA, 25 bp, Mus musculus
caatagcacatgtttgctctcaaat

SEQ ID NO: 300192 - DNA, 25 bp, Mus musculus
caatagcactctcagcgtggcggga

SEQ ID NO: 300193 - DNA, 25 bp, Mus musculus
caatagcactctgagcgtggcggga

SEQ ID NO: 300194 - DNA, 25 bp, Mus musculus
caatagcagacacctttgcgagggt

SEQ ID NO: 300195 - DNA, 25 bp, Mus musculus
caatagcagacagctttgcgagggt

SEQ ID NO: 300196 - DNA, 25 bp, Mus musculus
caatagcagcaacaaagttccttga

SEQ ID NO: 300197 - DNA, 25 bp, Mus musculus
caatagcagcaagaaagttccttga

SEQ ID NO: 300198 - DNA, 25 bp, Mus musculus
caatagcaggataaacttgactgta

SEQ ID NO: 300199 - DNA, 25 bp, Mus musculus
caatagcaggattaacttgactgta

SEQ ID NO: 300200 - DNA, 25 bp, Mus musculus
caatagcatgccatcggctctgtga

SEQ ID NO: 300201 - DNA, 25 bp, Mus musculus
caatagcatgccttcggctctgtga

SEQ ID NO: 300202 - DNA, 25 bp, Mus musculus
caatagccatgcatcttcagccaaa

SEQ ID NO: 300203 - DNA, 25 bp, Mus musculus
caatagccatgcttcttcagccaaa

SEQ ID NO: 300204 - DNA, 25 bp, Mus musculus
caatagccgaaaaagtgtacaccac

SEQ ID NO: 300205 - DNA, 25 bp, Mus musculus
caatagccgaaatagtgtacaccac

SEQ ID NO: 300206 - DNA, 25 bp, Mus musculus
caatagcctgtgagaagttaagact

SEQ ID NO: 300207 - DNA, 25 bp, Mus musculus
caatagcctgtgtgaagttaagact

SEQ ID NO: 300208 - DNA, 25 bp, Mus musculus
caatagccttatcagctgggaataa

SEQ ID NO: 300209 - DNA, 25 bp, Mus musculus
caatagccttatgagctgggaataa

SEQ ID NO: 300210 - DNA, 25 bp, Mus musculus
caatagccttcccatgtcttatata

SEQ ID NO: 300211 - DNA, 25 bp, Mus musculus
caatagccttccgatgtcttatata

SEQ ID NO: 300212 - DNA, 25 bp, Mus musculus
caatagcgtgttaggatatgcatca

SEQ ID NO: 300213 - DNA, 25 bp, Mus musculus
caatagcgtgtttggatatgcatca

SEQ ID NO: 300214 - DNA, 25 bp, Mus musculus
caatagcgttgcatgcatgccacaa

SEQ ID NO: 300215 - DNA, 25 bp, Mus musculus
caatagcgttgcttgcatgccacaa

SEQ ID NO: 300216 - DNA, 25 bp, Mus musculus
caatagctaattcgctcttagggta

SEQ ID NO: 300217 - DNA, 25 bp, Mus musculus
caatagctaattggctcttagggta

SEQ ID NO: 300218 - DNA, 25 bp, Mus musculus
caataggcagtacgctcttgggaca

SEQ ID NO: 300219 - DNA, 25 bp, Mus musculus
caataggcagtaggctcttgggaca

SEQ ID NO: 300220 - DNA, 25 bp, Mus musculus
caataggtaataatctccctttgaa

SEQ ID NO: 300221 - DNA, 25 bp, Mus musculus
caataggtaatattctccctttgaa

SEQ ID NO: 300222 - DNA, 25 bp, Mus musculus
caataggtatccactgtttacagag

SEQ ID NO: 300223 - DNA, 25 bp, Mus musculus
caataggtatcctctgtttacagag

SEQ ID NO: 300224 - DNA, 25 bp, Mus musculus
caatagtagacaatcgagctcccct

SEQ ID NO: 300225 - DNA, 25 bp, Mus musculus
caatagtagacattcgagctcccct

SEQ ID NO: 300226 - DNA, 25 bp, Mus musculus
caatagtgttgcatcagttagctga

SEQ ID NO: 300227 - DNA, 25 bp, Mus musculus
caatagtgttgcttcagttagctga

SEQ ID NO: 300228 - DNA, 25 bp, Mus musculus
caatagttttcacgtgttgcccaca

SEQ ID NO: 300229 - DNA, 25 bp, Mus musculus
caatagttttcaggtgttgcccaca

SEQ ID NO: 300230 - DNA, 25 bp, Mus musculus
caatataacacgcagtcgtcaatca

SEQ ID NO: 300231 - DNA, 25 bp, Mus musculus
caatataacacggagtcgtcaatca

SEQ ID NO: 300232 - DNA, 25 bp, Mus musculus
caatataagaggcaatctgcatgta

SEQ ID NO: 300233 - DNA, 25 bp, Mus musculus
caatataagagggaatctgcatgta

SEQ ID NO: 300234 - DNA, 25 bp, Mus musculus
caatataaggtgcagggcttcccta

SEQ ID NO: 300235 - DNA, 25 bp, Mus musculus
caatataaggtggagggcttcccta

SEQ ID NO: 300236 - DNA, 25 bp, Mus musculus
caatatacaatgagagcaaggagga

SEQ ID NO: 300237 - DNA, 25 bp, Mus musculus
caatatacaatgtgagcaaggagga

SEQ ID NO: 300238 - DNA, 25 bp, Mus musculus
caatataccgttacctgctgagagg

SEQ ID NO: 300239 - DNA, 25 bp, Mus musculus
caatataccgtttcctgctgagagg

SEQ ID NO: 300240 - DNA, 25 bp, Mus musculus
caatataggccgaatcgggtaccgc

SEQ ID NO: 300241 - DNA, 25 bp, Mus musculus
caatataggccgtatcgggtaccgc

SEQ ID NO: 300242 - DNA, 25 bp, Mus musculus
caatatagtaacattgtatggcaat

SEQ ID NO: 300243 - DNA, 25 bp, Mus musculus
caatatagtaactttgtatggcaat

SEQ ID NO: 300244 - DNA, 25 bp, Mus musculus
caatatattttgaagggcaggagtc

SEQ ID NO: 300245 - DNA, 25 bp, Mus musculus
caatatattttgtagggcaggagtc

SEQ ID NO: 300246 - DNA, 25 bp, Mus musculus
caatatcactgtcaggtccctctaa

SEQ ID NO: 300247 - DNA, 25 bp, Mus musculus
caatatcactgtgaggtccctctaa

SEQ ID NO: 300248 - DNA, 25 bp, Mus musculus
caatatcataccattccttgcctgg

SEQ ID NO: 300249 - DNA, 25 bp, Mus musculus
caatatcatacctttccttgcctgg

SEQ ID NO: 300250 - DNA, 25 bp, Mus musculus
caatatcatcaacttaagacaatag

SEQ ID NO: 300251 - DNA, 25 bp, Mus musculus
caatatcatcaagttaagacaatag

SEQ ID NO: 300252 - DNA, 25 bp, Mus musculus
caatatccccagaccctagtttagg

SEQ ID NO: 300253 - DNA, 25 bp, Mus musculus
caatatccccagtccctagtttagg

SEQ ID NO: 300254 - DNA, 25 bp, Mus musculus
caatatcccctcatctatcaaggat

SEQ ID NO: 300255 - DNA, 25 bp, Mus musculus
caatatcccctcttctatcaaggat

SEQ ID NO: 300256 - DNA, 25 bp, Mus musculus
caatatcctgctaccttaaattttt

SEQ ID NO: 300257 - DNA, 25 bp, Mus musculus
caatatcctgcttccttaaattttt

SEQ ID NO: 300258 - DNA, 25 bp, Mus musculus
caatatcgtctcagtggcatctaga

SEQ ID NO: 300259 - DNA, 25 bp, Mus musculus
caatatcgtctctgtggcatctaga

SEQ ID NO: 300260 - DNA, 25 bp, Mus musculus
caatatctctatctggcccaagctg

SEQ ID NO: 300261 - DNA, 25 bp, Mus musculus
caatatctctatgtggcccaagctg

SEQ ID NO: 300262 - DNA, 25 bp, Mus musculus
caatatgaagtgagcctgactggag

SEQ ID NO: 300263 - DNA, 25 bp, Mus musculus
caatatgaagtgtgcctgactggag

SEQ ID NO: 300264 - DNA, 25 bp, Mus musculus
caatatgccgtacccaccggtgtat

SEQ ID NO: 300265 - DNA, 25 bp, Mus musculus
caatatgccgtagccaccggtgtat

SEQ ID NO: 300266 - DNA, 25 bp, Mus musculus
caatatgcgagacaacaaccctgaa

SEQ ID NO: 300267 - DNA, 25 bp, Mus musculus
caatatgcgagagaacaaccctgaa

SEQ ID NO: 300268 - DNA, 25 bp, Mus musculus
caatatgctggacatgtgactcatg

SEQ ID NO: 300269 - DNA, 25 bp, Mus musculus
caatatgctggagatgtgactcatg

SEQ ID NO: 300270 - DNA, 25 bp, Mus musculus
caatatggagtaacaggcctatgcc

SEQ ID NO: 300271 - DNA, 25 bp, Mus musculus
caatatggagtatcaggcctatgcc

SEQ ID NO: 300272 - DNA, 25 bp, Mus musculus
caatatggcgtcactgtggaatgtt

SEQ ID NO: 300273 - DNA, 25 bp, Mus musculus
caatatggcgtctctgtggaatgtt

SEQ ID NO: 300274 - DNA, 25 bp, Mus musculus
caatatgggaacacagtgtgcctgg

SEQ ID NO: 300275 - DNA, 25 bp, Mus musculus
caatatgggaactcagtgtgcctgg

SEQ ID NO: 300276 - DNA, 25 bp, Mus musculus
caatatggttgtaaagatcacattc

SEQ ID NO: 300277 - DNA, 25 bp, Mus musculus
caatatggttgttaagatcacattc

SEQ ID NO: 300278 - DNA, 25 bp, Mus musculus
caatatggttttcagggccctggct

SEQ ID NO: 300279 - DNA, 25 bp, Mus musculus
caatatggttttgagggccctggct

SEQ ID NO: 300280 - DNA, 25 bp, Mus musculus
caatatgtaccaagggctccaaacc

SEQ ID NO: 300281 - DNA, 25 bp, Mus musculus
caatatgtaccatgggctccaaacc

SEQ ID NO: 300282 - DNA, 25 bp, Mus musculus
caatatgtatttatgtccctgctga

SEQ ID NO: 300283 - DNA, 25 bp, Mus musculus
caatatgtatttttgtccctgctga

SEQ ID NO: 300284 - DNA, 25 bp, Mus musculus
caatatgtctgcatccttactgata

SEQ ID NO: 300285 - DNA, 25 bp, Mus musculus
caatatgtctgcttccttactgata

SEQ ID NO: 300286 - DNA, 25 bp, Mus musculus
caatatgtggcaaggctggtctcga

SEQ ID NO: 300287 - DNA, 25 bp, Mus musculus
caatatgtggcatggctggtctcga

SEQ ID NO: 300288 - DNA, 25 bp, Mus musculus
caatatgttgtcagtgagtcacctc

SEQ ID NO: 300289 - DNA, 25 bp, Mus musculus
caatatgttgtctgtgagtcacctc

SEQ ID NO: 300290 - DNA, 25 bp, Mus musculus
caatattaccacctaggatcccgga

SEQ ID NO: 300291 - DNA, 25 bp, Mus musculus
caatattaccacgtaggatcccgga

SEQ ID NO: 300292 - DNA, 25 bp, Mus musculus
caatattacgccctgcttcattctg

SEQ ID NO: 300293 - DNA, 25 bp, Mus musculus
caatattacgccgtgcttcattctg

SEQ ID NO: 300294 - DNA, 25 bp, Mus musculus
caatattatattccctgagattcaa

SEQ ID NO: 300295 - DNA, 25 bp, Mus musculus
caatattatattgcctgagattcaa

SEQ ID NO: 300296 - DNA, 25 bp, Mus musculus
caatattcaacgaagcctgtgctgt

SEQ ID NO: 300297 - DNA, 25 bp, Mus musculus
caatattcaacgtagcctgtgctgt

SEQ ID NO: 300298 - DNA, 25 bp, Mus musculus
caatattcctctacagttgctctat

SEQ ID NO: 300299 - DNA, 25 bp, Mus musculus
caatattcctcttcagttgctctat

SEQ ID NO: 300300 - DNA, 25 bp, Mus musculus
caatattgacgcagaggactttatc

SEQ ID NO: 300301 - DNA, 25 bp, Mus musculus
caatattgacgctgaggactttatc

SEQ ID NO: 300302 - DNA, 25 bp, Mus musculus
caatattgataaccatttctcggtg

SEQ ID NO: 300303 - DNA, 25 bp, Mus musculus
caatattgataagcatttctcggtg

SEQ ID NO: 300304 - DNA, 25 bp, Mus musculus
caatattgccttctcttctgagctc

SEQ ID NO: 300305 - DNA, 25 bp, Mus musculus
caatattgccttgtcttctgagctc

SEQ ID NO: 300306 - DNA, 25 bp, Mus musculus
caatattgtgttagtagttttacag

SEQ ID NO: 300307 - DNA, 25 bp, Mus musculus
caatattgtgtttgtagttttacag

SEQ ID NO: 300308 - DNA, 25 bp, Mus musculus
caatattgttctcggtaactccttt

SEQ ID NO: 300309 - DNA, 25 bp, Mus musculus
caatattgttctgggtaactccttt

SEQ ID NO: 300310 - DNA, 25 bp, Mus musculus
caatatttaaaacgcacatcccctt

SEQ ID NO: 300311 - DNA, 25 bp, Mus musculus
caatatttaaaaggcacatcccctt

SEQ ID NO: 300312 - DNA, 25 bp, Mus musculus
caatatttccttacacctggttggg

SEQ ID NO: 300313 - DNA, 25 bp, Mus musculus
caatatttcctttcacctggttggg

SEQ ID NO: 300314 - DNA, 25 bp, Mus musculus
caatatttgacccattcttatttca

SEQ ID NO: 300315 - DNA, 25 bp, Mus musculus
caatatttgaccgattcttatttca

SEQ ID NO: 300316 - DNA, 25 bp, Mus musculus
caatattttagaagcaaagctgtca

SEQ ID NO: 300317 - DNA, 25 bp, Mus musculus
caatattttagatgcaaagctgtca

SEQ ID NO: 300318 - DNA, 25 bp, Mus musculus
caatattttatcatccaaccttgca

SEQ ID NO: 300319 - DNA, 25 bp, Mus musculus
caatattttatcttccaaccttgca

SEQ ID NO: 300320 - DNA, 25 bp, Mus musculus
caatatttttaacttgtggcaagag

SEQ ID NO: 300321 - DNA, 25 bp, Mus musculus
caatatttttaagttgtggcaagag

SEQ ID NO: 300322 - DNA, 25 bp, Mus musculus
caatatttttcacgcatttccacca

SEQ ID NO: 300323 - DNA, 25 bp, Mus musculus
caatatttttcaggcatttccacca

SEQ ID NO: 300324 - DNA, 25 bp, Mus musculus
caatcaaaacttcagggtgacccct

SEQ ID NO: 300325 - DNA, 25 bp, Mus musculus
caatcaaaacttgagggtgacccct

SEQ ID NO: 300326 - DNA, 25 bp, Mus musculus
caatcaacaaaacctcaccacatac

SEQ ID NO: 300327 - DNA, 25 bp, Mus musculus
caatcaacaaaagctcaccacatac

SEQ ID NO: 300328 - DNA, 25 bp, Mus musculus
caatcaacaggacgccgtctacttt

SEQ ID NO: 300329 - DNA, 25 bp, Mus musculus
caatcaacaggaggccgtctacttt

SEQ ID NO: 300330 - DNA, 25 bp, Mus musculus
caatcaacatgcaggtgaaggtgaa

SEQ ID NO: 300331 - DNA, 25 bp, Mus musculus
caatcaacatgctggtgaaggtgaa

SEQ ID NO: 300332 - DNA, 25 bp, Mus musculus
caatcaacctgccaagacgctgcag

SEQ ID NO: 300333 - DNA, 25 bp, Mus musculus
caatcaacctgcgaagacgctgcag

SEQ ID NO: 300334 - DNA, 25 bp, Mus musculus
caatcaactcgacggccgatctggc

SEQ ID NO: 300335 - DNA, 25 bp, Mus musculus
caatcaactcgagggccgatctggc

SEQ ID NO: 300336 - DNA, 25 bp, Mus musculus
caatcaagcctcataattctctcta

SEQ ID NO: 300337 - DNA, 25 bp, Mus musculus
caatcaagcctcttaattctctcta

SEQ ID NO: 300338 - DNA, 25 bp, Mus musculus
caatcaagctacacagactttccac

SEQ ID NO: 300339 - DNA, 25 bp, Mus musculus
caatcaagctactcagactttccac

SEQ ID NO: 300340 - DNA, 25 bp, Mus musculus
caatcaagtggcataggttcttcaa

SEQ ID NO: 300341 - DNA, 25 bp, Mus musculus
caatcaagtggcttaggttcttcaa

SEQ ID NO: 300342 - DNA, 25 bp, Mus musculus
caatcaatattgctcttctctttat

SEQ ID NO: 300343 - DNA, 25 bp, Mus musculus
caatcaatattggtcttctctttat

SEQ ID NO: 300344 - DNA, 25 bp, Mus musculus
caatcacacaggctgttgagaggat

SEQ ID NO: 300345 - DNA, 25 bp, Mus musculus
caatcacacagggtgttgagaggat

SEQ ID NO: 300346 - DNA, 25 bp, Mus musculus
caatcacagggtaccagactcatac

SEQ ID NO: 300347 - DNA, 25 bp, Mus musculus
caatcacagggttccagactcatac

SEQ ID NO: 300348 - DNA, 25 bp, Mus musculus
caatcacagtcaagcacactcatta

SEQ ID NO: 300349 - DNA, 25 bp, Mus musculus
caatcacagtcatgcacactcatta

SEQ ID NO: 300350 - DNA, 25 bp, Mus musculus
caatcacatgaacgttcccaaccat

SEQ ID NO: 300351 - DNA, 25 bp, Mus musculus
caatcacatgaaggttcccaaccat

SEQ ID NO: 300352 - DNA, 25 bp, Mus musculus
caatcacatggtcaacctcaagatt

SEQ ID NO: 300353 - DNA, 25 bp, Mus musculus
caatcacatggtgaacctcaagatt

SEQ ID NO: 300354 - DNA, 25 bp, Mus musculus
caatcacattgtcaccctggtgaat

SEQ ID NO: 300355 - DNA, 25 bp, Mus musculus
caatcacattgtgaccctggtgaat

SEQ ID NO: 300356 - DNA, 25 bp, Mus musculus
caatcaccatagctacgagatgaga

SEQ ID NO: 300357 - DNA, 25 bp, Mus musculus
caatcaccataggtacgagatgaga

SEQ ID NO: 300358 - DNA, 25 bp, Mus musculus
caatcaccctgtcgctggagttttg

SEQ ID NO: 300359 - DNA, 25 bp, Mus musculus
caatcaccctgtggctggagttttg

SEQ ID NO: 300360 - DNA, 25 bp, Mus musculus
caatcacctggaattcttgagagat

SEQ ID NO: 300361 - DNA, 25 bp, Mus musculus
caatcacctggatttcttgagagat

SEQ ID NO: 300362 - DNA, 25 bp, Mus musculus
caatcacctggccatatagtattta

SEQ ID NO: 300363 - DNA, 25 bp, Mus musculus
caatcacctggcgatatagtattta

SEQ ID NO: 300364 - DNA, 25 bp, Mus musculus
caatcaccttagaagacctttccta

SEQ ID NO: 300365 - DNA, 25 bp, Mus musculus
caatcaccttagtagacctttccta

SEQ ID NO: 300366 - DNA, 25 bp, Mus musculus
caatcaccttcccacaagaactaat

SEQ ID NO: 300367 - DNA, 25 bp, Mus musculus
caatcaccttccgacaagaactaat

SEQ ID NO: 300368 - DNA, 25 bp, Mus musculus
caatcacgcgcacagttttggaaaa

SEQ ID NO: 300369 - DNA, 25 bp, Mus musculus
caatcacgcgcagagttttggaaaa

SEQ ID NO: 300370 - DNA, 25 bp, Mus musculus
caatcactaaccatgatcaccaggc

SEQ ID NO: 300371 - DNA, 25 bp, Mus musculus
caatcactaaccttgatcaccaggc

SEQ ID NO: 300372 - DNA, 25 bp, Mus musculus
caatcactatgtatatgggagggtc

SEQ ID NO: 300373 - DNA, 25 bp, Mus musculus
caatcactatgtttatgggagggtc

SEQ ID NO: 300374 - DNA, 25 bp, Mus musculus
caatcactcattctaagtaagcaat

SEQ ID NO: 300375 - DNA, 25 bp, Mus musculus
caatcactcattgtaagtaagcaat

SEQ ID NO: 300376 - DNA, 25 bp, Mus musculus
caatcactccatattagaacaggca

SEQ ID NO: 300377 - DNA, 25 bp, Mus musculus
caatcactccattttagaacaggca

SEQ ID NO: 300378 - DNA, 25 bp, Mus musculus
caatcactgagccatgtctacagct

SEQ ID NO: 300379 - DNA, 25 bp, Mus musculus
caatcactgagcgatgtctacagct

SEQ ID NO: 300380 - DNA, 25 bp, Mus musculus
caatcactgatcacagttcttttta

SEQ ID NO: 300381 - DNA, 25 bp, Mus musculus
caatcactgatctcagttcttttta

SEQ ID NO: 300382 - DNA, 25 bp, Mus musculus
caatcactggatccctttgaaatgt

SEQ ID NO: 300383 - DNA, 25 bp, Mus musculus
caatcactggatgcctttgaaatgt

SEQ ID NO: 300384 - DNA, 25 bp, Mus musculus
caatcactgggtccgatgatgctcc

SEQ ID NO: 300385 - DNA, 25 bp, Mus musculus
caatcactgggtgcgatgatgctcc

SEQ ID NO: 300386 - DNA, 25 bp, Mus musculus
caatcactggtcacgggattttccc

SEQ ID NO: 300387 - DNA, 25 bp, Mus musculus
caatcactggtctcgggattttccc

SEQ ID NO: 300388 - DNA, 25 bp, Mus musculus
caatcactttccacttgatcaagca

SEQ ID NO: 300389 - DNA, 25 bp, Mus musculus
caatcactttcctcttgatcaagca

SEQ ID NO: 300390 - DNA, 25 bp, Mus musculus
caatcactttgcagtgcaccatgat

SEQ ID NO: 300391 - DNA, 25 bp, Mus musculus
caatcactttgcattcttccaggta

SEQ ID NO: 300392 - DNA, 25 bp, Mus musculus
caatcactttgctgtgcaccatgat

SEQ ID NO: 300393 - DNA, 25 bp, Mus musculus
caatcactttgctttcttccaggta

SEQ ID NO: 300394 - DNA, 25 bp, Mus musculus
caatcagactcacccaatgcttaag

SEQ ID NO: 300395 - DNA, 25 bp, Mus musculus
caatcagactcagccaatgcttaag

SEQ ID NO: 300396 - DNA, 25 bp, Mus musculus
caatcagagtcgcttgaggtggaat

SEQ ID NO: 300397 - DNA, 25 bp, Mus musculus
caatcagagtcggttgaggtggaat

SEQ ID NO: 300398 - DNA, 25 bp, Mus musculus
caatcagcagttcaaagcatcattc

SEQ ID NO: 300399 - DNA, 25 bp, Mus musculus
caatcagcagttgaaagcatcattc

SEQ ID NO: 300400 - DNA, 25 bp, Mus musculus
caatcagccagacctcttcaaagac

SEQ ID NO: 300401 - DNA, 25 bp, Mus musculus
caatcagccagagctcttcaaagac

SEQ ID NO: 300402 - DNA, 25 bp, Mus musculus
caatcagcccatattttccaacatt

SEQ ID NO: 300403 - DNA, 25 bp, Mus musculus
caatcagcccattttttccaacatt

SEQ ID NO: 300404 - DNA, 25 bp, Mus musculus
caatcagctcatactttgggtggta

SEQ ID NO: 300405 - DNA, 25 bp, Mus musculus
caatcagctcattctttgggtggta

SEQ ID NO: 300406 - DNA, 25 bp, Mus musculus
caatcagctctaatacagtccacag

SEQ ID NO: 300407 - DNA, 25 bp, Mus musculus
caatcagctctattacagtccacag

SEQ ID NO: 300408 - DNA, 25 bp, Mus musculus
caatcagctggaaaatgctttatag

SEQ ID NO: 300409 - DNA, 25 bp, Mus musculus
caatcagctggataatgctttatag

SEQ ID NO: 300410 - DNA, 25 bp, Mus musculus
caatcagggcgaattacatttttct

SEQ ID NO: 300411 - DNA, 25 bp, Mus musculus
caatcagggcgacgcacgtctccaa

SEQ ID NO: 300412 - DNA, 25 bp, Mus musculus
caatcagggcgaggcacgtctccaa

SEQ ID NO: 300413 - DNA, 25 bp, Mus musculus
caatcagggcgatttacatttttct

SEQ ID NO: 300414 - DNA, 25 bp, Mus musculus
caatcagtattaacaataaagttca

SEQ ID NO: 300415 - DNA, 25 bp, Mus musculus
caatcagtattatcaataaagttca

SEQ ID NO: 300416 - DNA, 25 bp, Mus musculus
caatcagtcctaccagatggatttc

SEQ ID NO: 300417 - DNA, 25 bp, Mus musculus
caatcagtcctagcagatggatttc

SEQ ID NO: 300418 - DNA, 25 bp, Mus musculus
caatcagttcggacaccaggagaat

SEQ ID NO: 300419 - DNA, 25 bp, Mus musculus
caatcagttcggtcaccaggagaat

SEQ ID NO: 300420 - DNA, 25 bp, Mus musculus
caatcatactagaaacatgcaggat

SEQ ID NO: 300421 - DNA, 25 bp, Mus musculus
caatcatactagtaacatgcaggat

SEQ ID NO: 300422 - DNA, 25 bp, Mus musculus
caatcatagcaccacttcagaagag

SEQ ID NO: 300423 - DNA, 25 bp, Mus musculus
caatcatagcacgacttcagaagag

SEQ ID NO: 300424 - DNA, 25 bp, Mus musculus
caatcatagcttcctgagcactgga

SEQ ID NO: 300425 - DNA, 25 bp, Mus musculus
caatcatagcttgctgagcactgga

SEQ ID NO: 300426 - DNA, 25 bp, Mus musculus
caatcatatgcgactccattttggg

SEQ ID NO: 300427 - DNA, 25 bp, Mus musculus
caatcatatgcgtctccattttggg

SEQ ID NO: 300428 - DNA, 25 bp, Mus musculus
caatcatcagatctgggccctagaa

SEQ ID NO: 300429 - DNA, 25 bp, Mus musculus
caatcatcagatgtgggccctagaa

SEQ ID NO: 300430 - DNA, 25 bp, Mus musculus
caatcatcagtgaccctgtgaagga

SEQ ID NO: 300431 - DNA, 25 bp, Mus musculus
caatcatcagtgtccctgtgaagga

SEQ ID NO: 300432 - DNA, 25 bp, Mus musculus
caatcatccctaattctttccagaa

SEQ ID NO: 300433 - DNA, 25 bp, Mus musculus
caatcatccctatttctttccagaa

SEQ ID NO: 300434 - DNA, 25 bp, Mus musculus
caatcatccgccagtcacaaatttg

SEQ ID NO: 300435 - DNA, 25 bp, Mus musculus
caatcatccgcctgtcacaaatttg

SEQ ID NO: 300436 - DNA, 25 bp, Mus musculus
caatcatgaggaagctttaagctgc

SEQ ID NO: 300437 - DNA, 25 bp, Mus musculus
caatcatgaggatgctttaagctgc

SEQ ID NO: 300438 - DNA, 25 bp, Mus musculus
caatcatgccatccagccaaggaat

SEQ ID NO: 300439 - DNA, 25 bp, Mus musculus
caatcatgccatgcagccaaggaat

SEQ ID NO: 300440 - DNA, 25 bp, Mus musculus
caatcatgctttcgtggcttcttgt

SEQ ID NO: 300441 - DNA, 25 bp, Mus musculus
caatcatgctttggtggcttcttgt

SEQ ID NO: 300442 - DNA, 25 bp, Mus musculus
caatcatggcctctggtctggtcgc

SEQ ID NO: 300443 - DNA, 25 bp, Mus musculus
caatcatggcctgtggtctggtcgc

SEQ ID NO: 300444 - DNA, 25 bp, Mus musculus
caatcatgggatactacttaaggga

SEQ ID NO: 300445 - DNA, 25 bp, Mus musculus
caatcatgggattctacttaaggga

SEQ ID NO: 300446 - DNA, 25 bp, Mus musculus
caatcatggtggatttgcctggcat

SEQ ID NO: 300447 - DNA, 25 bp, Mus musculus
caatcatggtggttttgcctggcat

SEQ ID NO: 300448 - DNA, 25 bp, Mus musculus
caatcatgtgagagaaaccagaaca

SEQ ID NO: 300449 - DNA, 25 bp, Mus musculus
caatcatgtgagtgaaaccagaaca

SEQ ID NO: 300450 - DNA, 25 bp, Mus musculus
caatcattacttctgtggctacgta

SEQ ID NO: 300451 - DNA, 25 bp, Mus musculus
caatcattacttgtgtggctacgta

SEQ ID NO: 300452 - DNA, 25 bp, Mus musculus
caatcattatccaccttttggtcta

SEQ ID NO: 300453 - DNA, 25 bp, Mus musculus
caatcattatcctccttttggtcta

SEQ ID NO: 300454 - DNA, 25 bp, Mus musculus
caatcattgaccaactaaactcagt

SEQ ID NO: 300455 - DNA, 25 bp, Mus musculus
caatcattgacctactaaactcagt

SEQ ID NO: 300456 - DNA, 25 bp, Mus musculus
caatcatttgtcatattcctactaa

SEQ ID NO: 300457 - DNA, 25 bp, Mus musculus
caatcatttgtcttattcctactaa

SEQ ID NO: 300458 - DNA, 25 bp, Mus musculus
caatccaaccaaactgaccagctat

SEQ ID NO: 300459 - DNA, 25 bp, Mus musculus
caatccaaccaatctgaccagctat

SEQ ID NO: 300460 - DNA, 25 bp, Mus musculus
caatccaagtggctagctcctgaga

SEQ ID NO: 300461 - DNA, 25 bp, Mus musculus
caatccaagtgggtagctcctgaga

SEQ ID NO: 300462 - DNA, 25 bp, Mus musculus
caatccaatcaactcgagggccgat

SEQ ID NO: 300463 - DNA, 25 bp, Mus musculus
caatccaatcaagtcgagggccgat

SEQ ID NO: 300464 - DNA, 25 bp, Mus musculus
caatccaccctcatactttgtaata

SEQ ID NO: 300465 - DNA, 25 bp, Mus musculus
caatccaccctcttactttgtaata

SEQ ID NO: 300466 - DNA, 25 bp, Mus musculus
caatccactggtcctgctgttggat

SEQ ID NO: 300467 - DNA, 25 bp, Mus musculus
caatccactggtgctgctgttggat

SEQ ID NO: 300468 - DNA, 25 bp, Mus musculus
caatccagaaatacccaggagggct

SEQ ID NO: 300469 - DNA, 25 bp, Mus musculus
caatccagaaattcccaggagggct

SEQ ID NO: 300470 - DNA, 25 bp, Mus musculus
caatccagatgcctacttgtgagta

SEQ ID NO: 300471 - DNA, 25 bp, Mus musculus
caatccagatgcgtacttgtgagta

SEQ ID NO: 300472 - DNA, 25 bp, Mus musculus
caatccagcaagcagaggacctctc

SEQ ID NO: 300473 - DNA, 25 bp, Mus musculus
caatccagcaaggagaggacctctc

SEQ ID NO: 300474 - DNA, 25 bp, Mus musculus
caatccagcgaacctcaacagagtg

SEQ ID NO: 300475 - DNA, 25 bp, Mus musculus
caatccagcgaagctcaacagagtg

SEQ ID NO: 300476 - DNA, 25 bp, Mus musculus
caatccagtaagaacatgtgtgcct

SEQ ID NO: 300477 - DNA, 25 bp, Mus musculus
caatccagtaagatgctgtatgatt

SEQ ID NO: 300478 - DNA, 25 bp, Mus musculus
caatccagtaagatgtttgaggaaa

SEQ ID NO: 300479 - DNA, 25 bp, Mus musculus
caatccagtaagtacatgtgtgcct

SEQ ID NO: 300480 - DNA, 25 bp, Mus musculus
caatccagtaagttgctgtatgatt

SEQ ID NO: 300481 - DNA, 25 bp, Mus musculus
caatccagtaagttgtttgaggaaa

SEQ ID NO: 300482 - DNA, 25 bp, Mus musculus
caatccatagttccttccagtgttt

SEQ ID NO: 300483 - DNA, 25 bp, Mus musculus
caatccatagttgcttccagtgttt

SEQ ID NO: 300484 - DNA, 25 bp, Mus musculus
caatccatctttctcaactaccatg

SEQ ID NO: 300485 - DNA, 25 bp, Mus musculus
caatccatctttgtcaactaccatg

SEQ ID NO: 300486 - DNA, 25 bp, Mus musculus
caatcccaaactacctgttctgtgg

SEQ ID NO: 300487 - DNA, 25 bp, Mus musculus
caatcccaaacttcctgttctgtgg

SEQ ID NO: 300488 - DNA, 25 bp, Mus musculus
caatcccagatcatcagttttgctg

SEQ ID NO: 300489 - DNA, 25 bp, Mus musculus
caatcccagatcttcagttttgctg

SEQ ID NO: 300490 - DNA, 25 bp, Mus musculus
caatcccagtgcaagaattctatat

SEQ ID NO: 300491 - DNA, 25 bp, Mus musculus
caatcccagtgctagaattctatat

SEQ ID NO: 300492 - DNA, 25 bp, Mus musculus
caatccccgagacacaaaacagcta

SEQ ID NO: 300493 - DNA, 25 bp, Mus musculus
caatccccgagagacaaaacagcta

SEQ ID NO: 300494 - DNA, 25 bp, Mus musculus
caatccccttctcctgcttggatgg

SEQ ID NO: 300495 - DNA, 25 bp, Mus musculus
caatccccttctgctgcttggatgg

SEQ ID NO: 300496 - DNA, 25 bp, Mus musculus
caatcccgagataccctaggcaagg

SEQ ID NO: 300497 - DNA, 25 bp, Mus musculus
caatcccgagattccctaggcaagg

SEQ ID NO: 300498 - DNA, 25 bp, Mus musculus
caatcccgcagcatgcaaaggcaaa

SEQ ID NO: 300499 - DNA, 25 bp, Mus musculus
caatcccgcagcttgcaaaggcaaa

SEQ ID NO: 300500 - DNA, 25 bp, Mus musculus
caatcccgcagtatgtatgtgacac

SEQ ID NO: 300501 - DNA, 25 bp, Mus musculus
caatcccgcagtttgtatgtgacac

SEQ ID NO: 300502 - DNA, 25 bp, Mus musculus
caatcccggataacaggacgtgttt

SEQ ID NO: 300503 - DNA, 25 bp, Mus musculus
caatcccggatatcaggacgtgttt

SEQ ID NO: 300504 - DNA, 25 bp, Mus musculus
caatcccgtcttcggctgctgagag

SEQ ID NO: 300505 - DNA, 25 bp, Mus musculus
caatcccgtcttgggctgctgagag

SEQ ID NO: 300506 - DNA, 25 bp, Mus musculus
caatccctgctaactgatgacatat

SEQ ID NO: 300507 - DNA, 25 bp, Mus musculus
caatccctgctatctgatgacatat

SEQ ID NO: 300508 - DNA, 25 bp, Mus musculus
caatccctgggacctttatggtaga

SEQ ID NO: 300509 - DNA, 25 bp, Mus musculus
caatccctgggagctttatggtaga

SEQ ID NO: 300510 - DNA, 25 bp, Mus musculus
caatcccttcttctgtatcaggtta

SEQ ID NO: 300511 - DNA, 25 bp, Mus musculus
caatcccttcttgtgtatcaggtta

SEQ ID NO: 300512 - DNA, 25 bp, Mus musculus
caatcccttttcagtttaagtgtct

SEQ ID NO: 300513 - DNA, 25 bp, Mus musculus
caatcccttttctgtttaagtgtct

SEQ ID NO: 300514 - DNA, 25 bp, Mus musculus
caatccgggaggagagccttacgaa

SEQ ID NO: 300515 - DNA, 25 bp, Mus musculus
caatccgggaggtgagccttacgaa

SEQ ID NO: 300516 - DNA, 25 bp, Mus musculus
caatccggtcacactgagaggtcaa

SEQ ID NO: 300517 - DNA, 25 bp, Mus musculus
caatccggtcactctgagaggtcaa

SEQ ID NO: 300518 - DNA, 25 bp, Mus musculus
caatccgttcacagtttctttgtct

SEQ ID NO: 300519 - DNA, 25 bp, Mus musculus
caatccgttcactgtttctttgtct

SEQ ID NO: 300520 - DNA, 25 bp, Mus musculus
caatccgttgaacaatttatactgg

SEQ ID NO: 300521 - DNA, 25 bp, Mus musculus
caatccgttgaagaatttatactgg

SEQ ID NO: 300522 - DNA, 25 bp, Mus musculus
caatcctaagtgattgggtgtattt

SEQ ID NO: 300523 - DNA, 25 bp, Mus musculus
caatcctaagtgtttgggtgtattt

SEQ ID NO: 300524 - DNA, 25 bp, Mus musculus
caatcctaggacacgttgtgatgcg

SEQ ID NO: 300525 - DNA, 25 bp, Mus musculus
caatcctaggactcgttgtgatgcg

SEQ ID NO: 300526 - DNA, 25 bp, Mus musculus
caatcctatgttccgtctccattta

SEQ ID NO: 300527 - DNA, 25 bp, Mus musculus
caatcctatgttgcgtctccattta

SEQ ID NO: 300528 - DNA, 25 bp, Mus musculus
caatcctatttcatccgtgtcttaa

SEQ ID NO: 300529 - DNA, 25 bp, Mus musculus
caatcctatttcttccgtgtcttaa

SEQ ID NO: 300530 - DNA, 25 bp, Mus musculus
caatcctcacaactgggttcgacat

SEQ ID NO: 300531 - DNA, 25 bp, Mus musculus
caatcctcacaagtgggttcgacat

SEQ ID NO: 300532 - DNA, 25 bp, Mus musculus
caatcctcccttatagtttcctgag

SEQ ID NO: 300533 - DNA, 25 bp, Mus musculus
caatcctcccttttagtttcctgag

SEQ ID NO: 300534 - DNA, 25 bp, Mus musculus
caatcctcgggaccaggttttgcac

SEQ ID NO: 300535 - DNA, 25 bp, Mus musculus
caatcctcgggagcaggttttgcac

SEQ ID NO: 300536 - DNA, 25 bp, Mus musculus
caatcctctcataacaatcttttcc

SEQ ID NO: 300537 - DNA, 25 bp, Mus musculus
caatcctctcattacaatcttttcc

SEQ ID NO: 300538 - DNA, 25 bp, Mus musculus
caatcctgatgacccgaatttaatc

SEQ ID NO: 300539 - DNA, 25 bp, Mus musculus
caatcctgatgagccgaatttaatc

SEQ ID NO: 300540 - DNA, 25 bp, Mus musculus
caatcctgctttcttaacctttgag

SEQ ID NO: 300541 - DNA, 25 bp, Mus musculus
caatcctgctttgttaacctttgag

SEQ ID NO: 300542 - DNA, 25 bp, Mus musculus
caatcctggattacaagatgctgtt

SEQ ID NO: 300543 - DNA, 25 bp, Mus musculus
caatcctggatttcaagatgctgtt

SEQ ID NO: 300544 - DNA, 25 bp, Mus musculus
caatcctgtacaaatttgctaagtg

SEQ ID NO: 300545 - DNA, 25 bp, Mus musculus
caatcctgtacatatttgctaagtg

SEQ ID NO: 300546 - DNA, 25 bp, Mus musculus
caatccttctgtccccattcttaat

SEQ ID NO: 300547 - DNA, 25 bp, Mus musculus
caatccttctgtgcccattcttaat

SEQ ID NO: 300548 - DNA, 25 bp, Mus musculus
caatccttgtgtccagaatcccaga

SEQ ID NO: 300549 - DNA, 25 bp, Mus musculus
caatccttgtgtgcagaatcccaga

SEQ ID NO: 300550 - DNA, 25 bp, Mus musculus
caatcctttcatccctgctgagtga

SEQ ID NO: 300551 - DNA, 25 bp, Mus musculus
caatcctttcatgcctgctgagtga

SEQ ID NO: 300552 - DNA, 25 bp, Mus musculus
caatccttttttccaagaccgtctg

SEQ ID NO: 300553 - DNA, 25 bp, Mus musculus
caatccttttttgcaagaccgtctg

SEQ ID NO: 300554 - DNA, 25 bp, Mus musculus
caatcgaaaggcacgggcagtgtac

SEQ ID NO: 300555 - DNA, 25 bp, Mus musculus
caatcgaaaggctcgggcagtgtac

SEQ ID NO: 300556 - DNA, 25 bp, Mus musculus
caatcgaccagtactctaagctaag

SEQ ID NO: 300557 - DNA, 25 bp, Mus musculus
caatcgaccagttctctaagctaag

SEQ ID NO: 300558 - DNA, 25 bp, Mus musculus
caatcgagcacaccctgatgaagtc

SEQ ID NO: 300559 - DNA, 25 bp, Mus musculus
caatcgagcacagcctgatgaagtc

SEQ ID NO: 300560 - DNA, 25 bp, Mus musculus
caatcgcggcagagcaactgctgat

SEQ ID NO: 300561 - DNA, 25 bp, Mus musculus
caatcgcggcagtgcaactgctgat

SEQ ID NO: 300562 - DNA, 25 bp, Mus musculus
caatcgctcctcagaaaagtccact

SEQ ID NO: 300563 - DNA, 25 bp, Mus musculus
caatcgctcctctgaaaagtccact

SEQ ID NO: 300564 - DNA, 25 bp, Mus musculus
caatcgctctgtctcttctaaaagc

SEQ ID NO: 300565 - DNA, 25 bp, Mus musculus
caatcgctctgtgtcttctaaaagc

SEQ ID NO: 300566 - DNA, 25 bp, Mus musculus
caatcggaacctctttgaagtgcag

SEQ ID NO: 300567 - DNA, 25 bp, Mus musculus
caatcggaacctgtttgaagtgcag

SEQ ID NO: 300568 - DNA, 25 bp, Mus musculus
caatcggaatggaggcgggcacttc

SEQ ID NO: 300569 - DNA, 25 bp, Mus musculus
caatcggaatggtggcgggcacttc

SEQ ID NO: 300570 - DNA, 25 bp, Mus musculus
caatcggcatttacctaaaccctgg

SEQ ID NO: 300571 - DNA, 25 bp, Mus musculus
caatcggcattttcctaaaccctgg

SEQ ID NO: 300572 - DNA, 25 bp, Mus musculus
caatcgggaatgaatatagtcaaat

SEQ ID NO: 300573 - DNA, 25 bp, Mus musculus
caatcgggaatgtatatagtcaaat

SEQ ID NO: 300574 - DNA, 25 bp, Mus musculus
caatcgggacacacacttaacggaa

SEQ ID NO: 300575 - DNA, 25 bp, Mus musculus
caatcgggacactcacttaacggaa

SEQ ID NO: 300576 - DNA, 25 bp, Mus musculus
caatcgggctggagcacaatgggca

SEQ ID NO: 300577 - DNA, 25 bp, Mus musculus
caatcgggctggtgcacaatgggca

SEQ ID NO: 300578 - DNA, 25 bp, Mus musculus
caatcgggtgttatatctgtacaga

SEQ ID NO: 300579 - DNA, 25 bp, Mus musculus
caatcgggtgttttatctgtacaga

SEQ ID NO: 300580 - DNA, 25 bp, Mus musculus
caatcggtacacacgcaggtgtgtt

SEQ ID NO: 300581 - DNA, 25 bp, Mus musculus
caatcggtacactcgcaggtgtgtt

SEQ ID NO: 300582 - DNA, 25 bp, Mus musculus
caatcggtatctactcggcagagga

SEQ ID NO: 300583 - DNA, 25 bp, Mus musculus
caatcggtatcttctcggcagagga

SEQ ID NO: 300584 - DNA, 25 bp, Mus musculus
caatcggtcctcagagatgctctct

SEQ ID NO: 300585 - DNA, 25 bp, Mus musculus
caatcggtcctctgagatgctctct

SEQ ID NO: 300586 - DNA, 25 bp, Mus musculus
caatcggtgtgcagggttaatggct

SEQ ID NO: 300587 - DNA, 25 bp, Mus musculus
caatcggtgtgctgggttaatggct

SEQ ID NO: 300588 - DNA, 25 bp, Mus musculus
caatcgtaactgacactgtgctgct

SEQ ID NO: 300589 - DNA, 25 bp, Mus musculus
caatcgtaactgtcactgtgctgct

SEQ ID NO: 300590 - DNA, 25 bp, Mus musculus
caatcgtcaacaacctccgctttgt

SEQ ID NO: 300591 - DNA, 25 bp, Mus musculus
caatcgtcaacatcctccgctttgt

SEQ ID NO: 300592 - DNA, 25 bp, Mus musculus
caatcgtcagatcctgccccaagaa

SEQ ID NO: 300593 - DNA, 25 bp, Mus musculus
caatcgtcagatgctgccccaagaa

SEQ ID NO: 300594 - DNA, 25 bp, Mus musculus
caatcgtctctccttattaggtagg

SEQ ID NO: 300595 - DNA, 25 bp, Mus musculus
caatcgtctctcgttattaggtagg

SEQ ID NO: 300596 - DNA, 25 bp, Mus musculus
caatcgtgcccgctgtgagagtgaa

SEQ ID NO: 300597 - DNA, 25 bp, Mus musculus
caatcgtgcccggtgtgagagtgaa

SEQ ID NO: 300598 - DNA, 25 bp, Mus musculus
caatcgtgttggattatgttcttct

SEQ ID NO: 300599 - DNA, 25 bp, Mus musculus
caatcgtgttggtttatgttcttct

SEQ ID NO: 300600 - DNA, 25 bp, Mus musculus
caatcgttttggaacccgtgaggcg

SEQ ID NO: 300601 - DNA, 25 bp, Mus musculus
caatcgttttggtacccgtgaggcg

SEQ ID NO: 300602 - DNA, 25 bp, Mus musculus
caatcgtttttgctgggtagtaaag

SEQ ID NO: 300603 - DNA, 25 bp, Mus musculus
caatcgtttttggtgggtagtaaag

SEQ ID NO: 300604 - DNA, 25 bp, Mus musculus
caatctacagctattttgtgggttc

SEQ ID NO: 300605 - DNA, 25 bp, Mus musculus
caatctacagcttttttgtgggttc

SEQ ID NO: 300606 - DNA, 25 bp, Mus musculus
caatctactctcagttaataacgtg

SEQ ID NO: 300607 - DNA, 25 bp, Mus musculus
caatctactctctgttaataacgtg

SEQ ID NO: 300608 - DNA, 25 bp, Mus musculus
caatctagccagaagtgccgcagac

SEQ ID NO: 300609 - DNA, 25 bp, Mus musculus
caatctagccagtagtgccgcagac

SEQ ID NO: 300610 - DNA, 25 bp, Mus musculus
caatctatgggcctagcatgtgcat

SEQ ID NO: 300611 - DNA, 25 bp, Mus musculus
caatctatgggcgtagcatgtgcat

SEQ ID NO: 300612 - DNA, 25 bp, Mus musculus
caatctcactttacggtagcctatt

SEQ ID NO: 300613 - DNA, 25 bp, Mus musculus
caatctcacttttcggtagcctatt

SEQ ID NO: 300614 - DNA, 25 bp, Mus musculus
caatctcagttgacctttttaccca

SEQ ID NO: 300615 - DNA, 25 bp, Mus musculus
caatctcagttgtcctttttaccca

SEQ ID NO: 300616 - DNA, 25 bp, Mus musculus
caatctcatcttagtatttctcatt

SEQ ID NO: 300617 - DNA, 25 bp, Mus musculus
caatctcatctttgtatttctcatt

SEQ ID NO: 300618 - DNA, 25 bp, Mus musculus
caatctcattcaaacttcctttatc

SEQ ID NO: 300619 - DNA, 25 bp, Mus musculus
caatctcattcatacttcctttatc

SEQ ID NO: 300620 - DNA, 25 bp, Mus musculus
caatctcattggactgaggcttcac

SEQ ID NO: 300621 - DNA, 25 bp, Mus musculus
caatctcattggtctgaggcttcac

SEQ ID NO: 300622 - DNA, 25 bp, Mus musculus
caatctccagctaaccgctgagtgt

SEQ ID NO: 300623 - DNA, 25 bp, Mus musculus
caatctccagcttaccgctgagtgt

SEQ ID NO: 300624 - DNA, 25 bp, Mus musculus
caatctccgcaacgcatcgatacta

SEQ ID NO: 300625 - DNA, 25 bp, Mus musculus
caatctccgcaaggcatcgatacta

SEQ ID NO: 300626 - DNA, 25 bp, Mus musculus
caatctcctcttatcggaaatatat

SEQ ID NO: 300627 - DNA, 25 bp, Mus musculus
caatctcctcttttcggaaatatat

SEQ ID NO: 300628 - DNA, 25 bp, Mus musculus
caatctcctgacctgtatattacca

SEQ ID NO: 300629 - DNA, 25 bp, Mus musculus
caatctcctgacgtgtatattacca

SEQ ID NO: 300630 - DNA, 25 bp, Mus musculus
caatctcctgtacccatttcaaagt

SEQ ID NO: 300631 - DNA, 25 bp, Mus musculus
caatctcctgtagccatttcaaagt

SEQ ID NO: 300632 - DNA, 25 bp, Mus musculus
caatctcgcagtccagtggtgcggt

SEQ ID NO: 300633 - DNA, 25 bp, Mus musculus
caatctcgcagtgcagtggtgcggt

SEQ ID NO: 300634 - DNA, 25 bp, Mus musculus
caatctcggcttagaatcatttgtg

SEQ ID NO: 300635 - DNA, 25 bp, Mus musculus
caatctcggctttgaatcatttgtg

SEQ ID NO: 300636 - DNA, 25 bp, Mus musculus
caatctctccacatagaaccctatt

SEQ ID NO: 300637 - DNA, 25 bp, Mus musculus
caatctctccacttagaaccctatt

SEQ ID NO: 300638 - DNA, 25 bp, Mus musculus
caatctctcctgatagattccaaaa

SEQ ID NO: 300639 - DNA, 25 bp, Mus musculus
caatctctcctgttagattccaaaa

SEQ ID NO: 300640 - DNA, 25 bp, Mus musculus
caatctctctcaacagcagactgtg

SEQ ID NO: 300641 - DNA, 25 bp, Mus musculus
caatctctctcatcagcagactgtg

SEQ ID NO: 300642 - DNA, 25 bp, Mus musculus
caatctctctcgctgcagtgggata

SEQ ID NO: 300643 - DNA, 25 bp, Mus musculus
caatctctctcggtgcagtgggata

SEQ ID NO: 300644 - DNA, 25 bp, Mus musculus
caatctctgaaaagtggtgttttac

SEQ ID NO: 300645 - DNA, 25 bp, Mus musculus
caatctctgaaatgtggtgttttac

SEQ ID NO: 300646 - DNA, 25 bp, Mus musculus
caatctctgtgacagttaccctgga

SEQ ID NO: 300647 - DNA, 25 bp, Mus musculus
caatctctgtgacgcaccatatccg

SEQ ID NO: 300648 - DNA, 25 bp, Mus musculus
caatctctgtgagagttaccctgga

SEQ ID NO: 300649 - DNA, 25 bp, Mus musculus
caatctctgtgaggcaccatatccg

SEQ ID NO: 300650 - DNA, 25 bp, Mus musculus
caatctcttctgcaggagagcgggc

SEQ ID NO: 300651 - DNA, 25 bp, Mus musculus
caatctcttctggaggagagcgggc

SEQ ID NO: 300652 - DNA, 25 bp, Mus musculus
caatctcttggcaccttttgaggaa

SEQ ID NO: 300653 - DNA, 25 bp, Mus musculus
caatctcttggctccttttgaggaa

SEQ ID NO: 300654 - DNA, 25 bp, Mus musculus
caatctgaatttaagtgtggcgtta

SEQ ID NO: 300655 - DNA, 25 bp, Mus musculus
caatctgaattttagtgtggcgtta

SEQ ID NO: 300656 - DNA, 25 bp, Mus musculus
caatctgaccttagacagcaacaat

SEQ ID NO: 300657 - DNA, 25 bp, Mus musculus
caatctgacctttgacagcaacaat

SEQ ID NO: 300658 - DNA, 25 bp, Mus musculus
caatctgactggatgtggcactgca

SEQ ID NO: 300659 - DNA, 25 bp, Mus musculus
caatctgactggttgtggcactgca

SEQ ID NO: 300660 - DNA, 25 bp, Mus musculus
caatctgatcttcaacttgttctcc

SEQ ID NO: 300661 - DNA, 25 bp, Mus musculus
caatctgatcttgaacttgttctcc

SEQ ID NO: 300662 - DNA, 25 bp, Mus musculus
caatctgcaagacttagaggagtac

SEQ ID NO: 300663 - DNA, 25 bp, Mus musculus
caatctgcaagagttagaggagtac

SEQ ID NO: 300664 - DNA, 25 bp, Mus musculus
caatctgcatgcatatcaccgaggc

SEQ ID NO: 300665 - DNA, 25 bp, Mus musculus
caatctgcatgcttatcaccgaggc

SEQ ID NO: 300666 - DNA, 25 bp, Mus musculus
caatctgccagccagggagtcctgt

SEQ ID NO: 300667 - DNA, 25 bp, Mus musculus
caatctgccagcgagggagtcctgt

SEQ ID NO: 300668 - DNA, 25 bp, Mus musculus
caatctgcgcacctaccatgacggg

SEQ ID NO: 300669 - DNA, 25 bp, Mus musculus
caatctgcgcacgtaccatgacggg

SEQ ID NO: 300670 - DNA, 25 bp, Mus musculus
caatctgctattagactaatttgta

SEQ ID NO: 300671 - DNA, 25 bp, Mus musculus
caatctgctatttgactaatttgta

SEQ ID NO: 300672 - DNA, 25 bp, Mus musculus
caatctgctttaatctctgtgggtt

SEQ ID NO: 300673 - DNA, 25 bp, Mus musculus
caatctgctttattctctgtgggtt

SEQ ID NO: 300674 - DNA, 25 bp, Mus musculus
caatctggacttaggcccttctagt

SEQ ID NO: 300675 - DNA, 25 bp, Mus musculus
caatctggactttggcccttctagt

SEQ ID NO: 300676 - DNA, 25 bp, Mus musculus
caatctggagctcggatggagttac

SEQ ID NO: 300677 - DNA, 25 bp, Mus musculus
caatctggagctgggatggagttac

SEQ ID NO: 300678 - DNA, 25 bp, Mus musculus
caatctggatgtccccaccatttta

SEQ ID NO: 300679 - DNA, 25 bp, Mus musculus
caatctggatgtgcccaccatttta

SEQ ID NO: 300680 - DNA, 25 bp, Mus musculus
caatctggcctcactagaactggga

SEQ ID NO: 300681 - DNA, 25 bp, Mus musculus
caatctggcctctctagaactggga

SEQ ID NO: 300682 - DNA, 25 bp, Mus musculus
caatctgggcctcgttatgcagttc

SEQ ID NO: 300683 - DNA, 25 bp, Mus musculus
caatctgggcctggttatgcagttc

SEQ ID NO: 300684 - DNA, 25 bp, Mus musculus
caatctgggtccacagcaacaatgg

SEQ ID NO: 300685 - DNA, 25 bp, Mus musculus
caatctgggtcctcagcaacaatgg

SEQ ID NO: 300686 - DNA, 25 bp, Mus musculus
caatctgggtttcctggtcttgaac

SEQ ID NO: 300687 - DNA, 25 bp, Mus musculus
caatctgggtttgctggtcttgaac

SEQ ID NO: 300688 - DNA, 25 bp, Mus musculus
caatctggtatcatggtttggtgca

SEQ ID NO: 300689 - DNA, 25 bp, Mus musculus
caatctggtatcttggtttggtgca

SEQ ID NO: 300690 - DNA, 25 bp, Mus musculus
caatctggtcgacagaagccttttc

SEQ ID NO: 300691 - DNA, 25 bp, Mus musculus
caatctggtcgagagaagccttttc

SEQ ID NO: 300692 - DNA, 25 bp, Mus musculus
caatctggtcttcaaatcgagtcca

SEQ ID NO: 300693 - DNA, 25 bp, Mus musculus
caatctggtcttgaaatcgagtcca

SEQ ID NO: 300694 - DNA, 25 bp, Mus musculus
caatctggtgttatataagggcgca

SEQ ID NO: 300695 - DNA, 25 bp, Mus musculus
caatctggtgttttataagggcgca

SEQ ID NO: 300696 - DNA, 25 bp, Mus musculus
caatctgtacagaagctggcttgat

SEQ ID NO: 300697 - DNA, 25 bp, Mus musculus
caatctgtacagtagctggcttgat

SEQ ID NO: 300698 - DNA, 25 bp, Mus musculus
caatctgtcgaaatggcgacctaat

SEQ ID NO: 300699 - DNA, 25 bp, Mus musculus
caatctgtcgaattggcgacctaat

SEQ ID NO: 300700 - DNA, 25 bp, Mus musculus
caatctgtgaccagttgggagctaa

SEQ ID NO: 300701 - DNA, 25 bp, Mus musculus
caatctgtgacctgttgggagctaa

SEQ ID NO: 300702 - DNA, 25 bp, Mus musculus
caatctgtgatcagttgctgcctat

SEQ ID NO: 300703 - DNA, 25 bp, Mus musculus
caatctgtgatctgttgctgcctat

SEQ ID NO: 300704 - DNA, 25 bp, Mus musculus
caatctgttccaactcagagtcgaa

SEQ ID NO: 300705 - DNA, 25 bp, Mus musculus
caatctgttccatctcagagtcgaa

SEQ ID NO: 300706 - DNA, 25 bp, Mus musculus
caatctgttgaacgagggctgtgca

SEQ ID NO: 300707 - DNA, 25 bp, Mus musculus
caatctgttgaaggagggctgtgca

SEQ ID NO: 300708 - DNA, 25 bp, Mus musculus
caatctgtttgtatttggcaactaa

SEQ ID NO: 300709 - DNA, 25 bp, Mus musculus
caatctgtttgtttttggcaactaa

SEQ ID NO: 300710 - DNA, 25 bp, Mus musculus
caatcttaacccattctaccagata

SEQ ID NO: 300711 - DNA, 25 bp, Mus musculus
caatcttaaccctttctaccagata

SEQ ID NO: 300712 - DNA, 25 bp, Mus musculus
caatcttaagctatcctttcttctt

SEQ ID NO: 300713 - DNA, 25 bp, Mus musculus
caatcttaagctttcctttcttctt

SEQ ID NO: 300714 - DNA, 25 bp, Mus musculus
caatcttaccctcttcatagactta

SEQ ID NO: 300715 - DNA, 25 bp, Mus musculus
caatcttaccctgttcatagactta

SEQ ID NO: 300716 - DNA, 25 bp, Mus musculus
caatcttaggcacttactgtccatt

SEQ ID NO: 300717 - DNA, 25 bp, Mus musculus
caatcttaggcagttactgtccatt

SEQ ID NO: 300718 - DNA, 25 bp, Mus musculus
caatcttataatctagtgggcccaa

SEQ ID NO: 300719 - DNA, 25 bp, Mus musculus
caatcttataatgtagtgggcccaa

SEQ ID NO: 300720 - DNA, 25 bp, Mus musculus
caatcttcaaataggccttctgcac

SEQ ID NO: 300721 - DNA, 25 bp, Mus musculus
caatcttcaaattggccttctgcac

SEQ ID NO: 300722 - DNA, 25 bp, Mus musculus
caatcttccacacttatgcagcgct

SEQ ID NO: 300723 - DNA, 25 bp, Mus musculus
caatcttccacagttatgcagcgct

SEQ ID NO: 300724 - DNA, 25 bp, Mus musculus
caatcttgcagtcgtgtttgtcact

SEQ ID NO: 300725 - DNA, 25 bp, Mus musculus
caatcttgcagtggtgtttgtcact

SEQ ID NO: 300726 - DNA, 25 bp, Mus musculus
caatcttgcctaatgtttggccaac

SEQ ID NO: 300727 - DNA, 25 bp, Mus musculus
caatcttgcctattgtttggccaac

SEQ ID NO: 300728 - DNA, 25 bp, Mus musculus
caatcttggttgctggaaaggctgt

SEQ ID NO: 300729 - DNA, 25 bp, Mus musculus
caatcttggttggtggaaaggctgt

SEQ ID NO: 300730 - DNA, 25 bp, Mus musculus
caatcttgtcataaaatcccacctc

SEQ ID NO: 300731 - DNA, 25 bp, Mus musculus
caatcttgtcattaaatcccacctc

SEQ ID NO: 300732 - DNA, 25 bp, Mus musculus
caatcttgtcctctttcatttttac

SEQ ID NO: 300733 - DNA, 25 bp, Mus musculus
caatcttgtcctgtttcatttttac

SEQ ID NO: 300734 - DNA, 25 bp, Mus musculus
caatcttgtgccctagtcttttaaa

SEQ ID NO: 300735 - DNA, 25 bp, Mus musculus
caatcttgtgccgtagtcttttaaa

SEQ ID NO: 300736 - DNA, 25 bp, Mus musculus
caatctttcagccacgcttttgtac

SEQ ID NO: 300737 - DNA, 25 bp, Mus musculus
caatctttcagcgacgcttttgtac

SEQ ID NO: 300738 - DNA, 25 bp, Mus musculus
caatctttcctcaatattcacagct

SEQ ID NO: 300739 - DNA, 25 bp, Mus musculus
caatctttcctctatattcacagct

SEQ ID NO: 300740 - DNA, 25 bp, Mus musculus
caatctttgatcactgtatttatac

SEQ ID NO: 300741 - DNA, 25 bp, Mus musculus
caatctttgatctctgtatttatac

SEQ ID NO: 300742 - DNA, 25 bp, Mus musculus
caatctttggccaattagtgtggac

SEQ ID NO: 300743 - DNA, 25 bp, Mus musculus
caatctttggcctattagtgtggac

SEQ ID NO: 300744 - DNA, 25 bp, Mus musculus
caatctttgtgcctcaacatactgt

SEQ ID NO: 300745 - DNA, 25 bp, Mus musculus
caatctttgtgcgtcaacatactgt

SEQ ID NO: 300746 - DNA, 25 bp, Mus musculus
caatcttttccgaggtcaggaggac

SEQ ID NO: 300747 - DNA, 25 bp, Mus musculus
caatcttttccgtggtcaggaggac

SEQ ID NO: 300748 - DNA, 25 bp, Mus musculus
caatcttttcttaatgttcatgcct

SEQ ID NO: 300749 - DNA, 25 bp, Mus musculus
caatcttttctttatgttcatgcct

SEQ ID NO: 300750 - DNA, 25 bp, Mus musculus
caatgaaaacttagagctacctgtt

SEQ ID NO: 300751 - DNA, 25 bp, Mus musculus
caatgaaaactttgagctacctgtt

SEQ ID NO: 300752 - DNA, 25 bp, Mus musculus
caatgaaaagtcacgaggagctggg

SEQ ID NO: 300753 - DNA, 25 bp, Mus musculus
caatgaaaagtctcgaggagctggg

SEQ ID NO: 300754 - DNA, 25 bp, Mus musculus
caatgaaactttaccaaggagctac

SEQ ID NO: 300755 - DNA, 25 bp, Mus musculus
caatgaaacttttccaaggagctac

SEQ ID NO: 300756 - DNA, 25 bp, Mus musculus
caatgaaagttcctagagcaggcat

SEQ ID NO: 300757 - DNA, 25 bp, Mus musculus
caatgaaagttcgtagagcaggcat

SEQ ID NO: 300758 - DNA, 25 bp, Mus musculus
caatgaaatcttccctcaggaacag

SEQ ID NO: 300759 - DNA, 25 bp, Mus musculus
caatgaaatcttgcctcaggaacag

SEQ ID NO: 300760 - DNA, 25 bp, Mus musculus
caatgaaattgtctcctatggaagt

SEQ ID NO: 300761 - DNA, 25 bp, Mus musculus
caatgaaattgtgtcctatggaagt

SEQ ID NO: 300762 - DNA, 25 bp, Mus musculus
caatgaacacccatacttttgaatt

SEQ ID NO: 300763 - DNA, 25 bp, Mus musculus
caatgaacacccttacttttgaatt

SEQ ID NO: 300764 - DNA, 25 bp, Mus musculus
caatgaacccaaacccttatgaagt

SEQ ID NO: 300765 - DNA, 25 bp, Mus musculus
caatgaacccaatcccttatgaagt

SEQ ID NO: 300766 - DNA, 25 bp, Mus musculus
caatgaactaagctaataattacta

SEQ ID NO: 300767 - DNA, 25 bp, Mus musculus
caatgaactaaggtaataattacta

SEQ ID NO: 300768 - DNA, 25 bp, Mus musculus
caatgaaggaggaatcctgacctgc

SEQ ID NO: 300769 - DNA, 25 bp, Mus musculus
caatgaaggaggtatcctgacctgc

SEQ ID NO: 300770 - DNA, 25 bp, Mus musculus
caatgaaggtggctgtcatctttct

SEQ ID NO: 300771 - DNA, 25 bp, Mus musculus
caatgaaggtgggtgtcatctttct

SEQ ID NO: 300772 - DNA, 25 bp, Mus musculus
caatgaagtccaacagcagctcaat

SEQ ID NO: 300773 - DNA, 25 bp, Mus musculus
caatgaagtccatcagcagctcaat

SEQ ID NO: 300774 - DNA, 25 bp, Mus musculus
caatgaagtggtccgtccatgctac

SEQ ID NO: 300775 - DNA, 25 bp, Mus musculus
caatgaagtggtgcgtccatgctac

SEQ ID NO: 300776 - DNA, 25 bp, Mus musculus
caatgaagttatcatttttgctctc

SEQ ID NO: 300777 - DNA, 25 bp, Mus musculus
caatgaagttatgatttttgctctc

SEQ ID NO: 300778 - DNA, 25 bp, Mus musculus
caatgaatccccacacaaacaaaaa

SEQ ID NO: 300779 - DNA, 25 bp, Mus musculus
caatgaatcccctcacaaacaaaaa

SEQ ID NO: 300780 - DNA, 25 bp, Mus musculus
caatgaatccttcgtcttgctcaac

SEQ ID NO: 300781 - DNA, 25 bp, Mus musculus
caatgaatccttggtcttgctcaac

SEQ ID NO: 300782 - DNA, 25 bp, Mus musculus
caatgaatggacactggactcggca

SEQ ID NO: 300783 - DNA, 25 bp, Mus musculus
caatgaatggactctggactcggca

SEQ ID NO: 300784 - DNA, 25 bp, Mus musculus
caatgaatgtagaaggtccctgctc

SEQ ID NO: 300785 - DNA, 25 bp, Mus musculus
caatgaatgtagtaggtccctgctc

SEQ ID NO: 300786 - DNA, 25 bp, Mus musculus
caatgaatgtggacctctcttgatt

SEQ ID NO: 300787 - DNA, 25 bp, Mus musculus
caatgaatgtggtcctctcttgatt

SEQ ID NO: 300788 - DNA, 25 bp, Mus musculus
caatgaatgtttacagactggctgt

SEQ ID NO: 300789 - DNA, 25 bp, Mus musculus
caatgaatgttttcagactggctgt

SEQ ID NO: 300790 - DNA, 25 bp, Mus musculus
caatgaattgtaactagcatgttgt

SEQ ID NO: 300791 - DNA, 25 bp, Mus musculus
caatgaattgtatctagcatgttgt

SEQ ID NO: 300792 - DNA, 25 bp, Mus musculus
caatgacaacttagtcaagctcatt

SEQ ID NO: 300793 - DNA, 25 bp, Mus musculus
caatgacaactttgtcaagctcatt

SEQ ID NO: 300794 - DNA, 25 bp, Mus musculus
caatgacaagtacttgggtctctat

SEQ ID NO: 300795 - DNA, 25 bp, Mus musculus
caatgacaagtagttgggtctctat

SEQ ID NO: 300796 - DNA, 25 bp, Mus musculus
caatgacacatgactgtgatcccag

SEQ ID NO: 300797 - DNA, 25 bp, Mus musculus
caatgacacatgtctgtgatcccag

SEQ ID NO: 300798 - DNA, 25 bp, Mus musculus
caatgacaggtcaaacgaggcacaa

SEQ ID NO: 300799 - DNA, 25 bp, Mus musculus
caatgacaggtctaacgaggcacaa

SEQ ID NO: 300800 - DNA, 25 bp, Mus musculus
caatgacagtatccggaccaccatc

SEQ ID NO: 300801 - DNA, 25 bp, Mus musculus
caatgacagtatgcggaccaccatc

SEQ ID NO: 300802 - DNA, 25 bp, Mus musculus
caatgacagtgaattgccaggatgt

SEQ ID NO: 300803 - DNA, 25 bp, Mus musculus
caatgacagtgatttgccaggatgt

SEQ ID NO: 300804 - DNA, 25 bp, Mus musculus
caatgacatgatctctctgtgtgtg

SEQ ID NO: 300805 - DNA, 25 bp, Mus musculus
caatgacatgatgtctctgtgtgtg

SEQ ID NO: 300806 - DNA, 25 bp, Mus musculus
caatgacatgttcaggcttgccctg

SEQ ID NO: 300807 - DNA, 25 bp, Mus musculus
caatgacatgttgaggcttgccctg

SEQ ID NO: 300808 - DNA, 25 bp, Mus musculus
caatgaccaccaagcaagcacaaga

SEQ ID NO: 300809 - DNA, 25 bp, Mus musculus
caatgaccaccatgcaagcacaaga

SEQ ID NO: 300810 - DNA, 25 bp, Mus musculus
caatgaccatttaaccctttgttat

SEQ ID NO: 300811 - DNA, 25 bp, Mus musculus
caatgaccattttaccctttgttat

SEQ ID NO: 300812 - DNA, 25 bp, Mus musculus
caatgacccaagatcgagtccctgg

SEQ ID NO: 300813 - DNA, 25 bp, Mus musculus
caatgacccaagttcgagtccctgg

SEQ ID NO: 300814 - DNA, 25 bp, Mus musculus
caatgaccccaaaccgaatgacccc

SEQ ID NO: 300815 - DNA, 25 bp, Mus musculus
caatgaccccaatccgaatgacccc

SEQ ID NO: 300816 - DNA, 25 bp, Mus musculus
caatgaccctctattgttttgtgtt

SEQ ID NO: 300817 - DNA, 25 bp, Mus musculus
caatgaccctcttttgttttgtgtt

SEQ ID NO: 300818 - DNA, 25 bp, Mus musculus
caatgaccttccaatggacagccaa

SEQ ID NO: 300819 - DNA, 25 bp, Mus musculus
caatgaccttccatcctggagtttc

SEQ ID NO: 300820 - DNA, 25 bp, Mus musculus
caatgaccttcctatggacagccaa

SEQ ID NO: 300821 - DNA, 25 bp, Mus musculus
caatgaccttccttcctggagtttc

SEQ ID NO: 300822 - DNA, 25 bp, Mus musculus
caatgacgttctcattctccggagc

SEQ ID NO: 300823 - DNA, 25 bp, Mus musculus
caatgacgttctgattctccggagc

SEQ ID NO: 300824 - DNA, 25 bp, Mus musculus
caatgactaccgagtggtcgtgttc

SEQ ID NO: 300825 - DNA, 25 bp, Mus musculus
caatgactaccgtgtggtcgtgttc

SEQ ID NO: 300826 - DNA, 25 bp, Mus musculus
caatgactatggagctgggactgag

SEQ ID NO: 300827 - DNA, 25 bp, Mus musculus
caatgactatggtgctgggactgag

SEQ ID NO: 300828 - DNA, 25 bp, Mus musculus
caatgactcctaactgcaaacacac

SEQ ID NO: 300829 - DNA, 25 bp, Mus musculus
caatgactcctatctgcaaacacac

SEQ ID NO: 300830 - DNA, 25 bp, Mus musculus
caatgactcctgaattcttatgaat

SEQ ID NO: 300831 - DNA, 25 bp, Mus musculus
caatgactcctgtattcttatgaat

SEQ ID NO: 300832 - DNA, 25 bp, Mus musculus
caatgactgaagacaacctgctctc

SEQ ID NO: 300833 - DNA, 25 bp, Mus musculus
caatgactgaagtcaacctgctctc

SEQ ID NO: 300834 - DNA, 25 bp, Mus musculus
caatgactgctaactccgattcaaa

SEQ ID NO: 300835 - DNA, 25 bp, Mus musculus
caatgactgctatctccgattcaaa

SEQ ID NO: 300836 - DNA, 25 bp, Mus musculus
caatgactggagatgctgaaccttg

SEQ ID NO: 300837 - DNA, 25 bp, Mus musculus
caatgactggagttgctgaaccttg

SEQ ID NO: 300838 - DNA, 25 bp, Mus musculus
caatgactggcaactctgtggttgt

SEQ ID NO: 300839 - DNA, 25 bp, Mus musculus
caatgactggcatctctgtggttgt

SEQ ID NO: 300840 - DNA, 25 bp, Mus musculus
caatgactgggtaatctgtgtgtga

SEQ ID NO: 300841 - DNA, 25 bp, Mus musculus
caatgactgggttatctgtgtgtga

SEQ ID NO: 300842 - DNA, 25 bp, Mus musculus
caatgactgtctcccaccggaagac

SEQ ID NO: 300843 - DNA, 25 bp, Mus musculus
caatgactgtctgccaccggaagac

SEQ ID NO: 300844 - DNA, 25 bp, Mus musculus
caatgactgtgacccccaatttgac

SEQ ID NO: 300845 - DNA, 25 bp, Mus musculus
caatgactgtgagccccaatttgac

SEQ ID NO: 300846 - DNA, 25 bp, Mus musculus
caatgacttatgcatagctccactt

SEQ ID NO: 300847 - DNA, 25 bp, Mus musculus
caatgacttatggatagctccactt

SEQ ID NO: 300848 - DNA, 25 bp, Mus musculus
caatgacttctgcttagactatggt

SEQ ID NO: 300849 - DNA, 25 bp, Mus musculus
caatgacttctggttagactatggt

SEQ ID NO: 300850 - DNA, 25 bp, Mus musculus
caatgactttccctcacttgagaaa

SEQ ID NO: 300851 - DNA, 25 bp, Mus musculus
caatgactttccgtcacttgagaaa

SEQ ID NO: 300852 - DNA, 25 bp, Mus musculus
caatgagaacataaggccccagcaa

SEQ ID NO: 300853 - DNA, 25 bp, Mus musculus
caatgagaacattaggccccagcaa

SEQ ID NO: 300854 - DNA, 25 bp, Mus musculus
caatgagaaccaaccccaaggaaca

SEQ ID NO: 300855 - DNA, 25 bp, Mus musculus
caatgagaaccatccccaaggaaca

SEQ ID NO: 300856 - DNA, 25 bp, Mus musculus
caatgagaattcatcaggcgatgta

SEQ ID NO: 300857 - DNA, 25 bp, Mus musculus
caatgagaattcttcaggcgatgta

SEQ ID NO: 300858 - DNA, 25 bp, Mus musculus
caatgagacagaatccttaccacct

SEQ ID NO: 300859 - DNA, 25 bp, Mus musculus
caatgagacagattccttaccacct

SEQ ID NO: 300860 - DNA, 25 bp, Mus musculus
caatgagagcctagggctttgatgt

SEQ ID NO: 300861 - DNA, 25 bp, Mus musculus
caatgagagccttgggctttgatgt

SEQ ID NO: 300862 - DNA, 25 bp, Mus musculus
caatgagattacatcttggatgaga

SEQ ID NO: 300863 - DNA, 25 bp, Mus musculus
caatgagattacttcttggatgaga

SEQ ID NO: 300864 - DNA, 25 bp, Mus musculus
caatgagcgtttccgttgcccggag

SEQ ID NO: 300865 - DNA, 25 bp, Mus musculus
caatgagcgtttgcgttgcccggag

SEQ ID NO: 300866 - DNA, 25 bp, Mus musculus
caatgagctctgatggttccgaatg

SEQ ID NO: 300867 - DNA, 25 bp, Mus musculus
caatgagctctgttggttccgaatg

SEQ ID NO: 300868 - DNA, 25 bp, Mus musculus
caatgagcttgacggcaatctggcc

SEQ ID NO: 300869 - DNA, 25 bp, Mus musculus
caatgagcttgagggcaatctggcc

SEQ ID NO: 300870 - DNA, 25 bp, Mus musculus
caatgagcttggaacacttctttct

SEQ ID NO: 300871 - DNA, 25 bp, Mus musculus
caatgagcttggtacacttctttct

SEQ ID NO: 300872 - DNA, 25 bp, Mus musculus
caatgagctttacttagttggtatt

SEQ ID NO: 300873 - DNA, 25 bp, Mus musculus
caatgagctttagttagttggtatt

SEQ ID NO: 300874 - DNA, 25 bp, Mus musculus
caatgaggaggcacgagtgacagct

SEQ ID NO: 300875 - DNA, 25 bp, Mus musculus
caatgaggaggctcgagtgacagct

SEQ ID NO: 300876 - DNA, 25 bp, Mus musculus
caatgagggcggacatttgaggcta

SEQ ID NO: 300877 - DNA, 25 bp, Mus musculus
caatgagggcggtcatttgaggcta

SEQ ID NO: 300878 - DNA, 25 bp, Mus musculus
caatgaggtagtctgttagcaggac

SEQ ID NO: 300879 - DNA, 25 bp, Mus musculus
caatgaggtagtgtgttagcaggac

SEQ ID NO: 300880 - DNA, 25 bp, Mus musculus
caatgagtaacaatctcaggatttc

SEQ ID NO: 300881 - DNA, 25 bp, Mus musculus
caatgagtaacattctcaggatttc

SEQ ID NO: 300882 - DNA, 25 bp, Mus musculus
caatgagtgcttcagtagacccaaa

SEQ ID NO: 300883 - DNA, 25 bp, Mus musculus
caatgagtgcttgagtagacccaaa

SEQ ID NO: 300884 - DNA, 25 bp, Mus musculus
caatgatacataaacccgggtttac

SEQ ID NO: 300885 - DNA, 25 bp, Mus musculus
caatgatacatatacccgggtttac

SEQ ID NO: 300886 - DNA, 25 bp, Mus musculus
caatgatacttcacatttgttgact

SEQ ID NO: 300887 - DNA, 25 bp, Mus musculus
caatgatacttctcatttgttgact

SEQ ID NO: 300888 - DNA, 25 bp, Mus musculus
caatgatcagttaacctcgtctagt

SEQ ID NO: 300889 - DNA, 25 bp, Mus musculus
caatgatcagtttacctcgtctagt

SEQ ID NO: 300890 - DNA, 25 bp, Mus musculus
caatgatcattcagaccttactaaa

SEQ ID NO: 300891 - DNA, 25 bp, Mus musculus
caatgatcattctgaccttactaaa

SEQ ID NO: 300892 - DNA, 25 bp, Mus musculus
caatgatccatcagtagctcttatt

SEQ ID NO: 300893 - DNA, 25 bp, Mus musculus
caatgatccatctgtagctcttatt

SEQ ID NO: 300894 - DNA, 25 bp, Mus musculus
caatgatgcttcactgaacctctgc

SEQ ID NO: 300895 - DNA, 25 bp, Mus musculus
caatgatgcttctctgaacctctgc

SEQ ID NO: 300896 - DNA, 25 bp, Mus musculus
caatgatggcatacgactgtctgga

SEQ ID NO: 300897 - DNA, 25 bp, Mus musculus
caatgatggcattcgactgtctgga

SEQ ID NO: 300898 - DNA, 25 bp, Mus musculus
caatgatgggacagagcctttttgc

SEQ ID NO: 300899 - DNA, 25 bp, Mus musculus
caatgatgggactgagcctttttgc

SEQ ID NO: 300900 - DNA, 25 bp, Mus musculus
caatgattacggctgtgatggtgat

SEQ ID NO: 300901 - DNA, 25 bp, Mus musculus
caatgattacgggtgtgatggtgat

SEQ ID NO: 300902 - DNA, 25 bp, Mus musculus
caatgattcatacccgatccctgga

SEQ ID NO: 300903 - DNA, 25 bp, Mus musculus
caatgattcatagccgatccctgga

SEQ ID NO: 300904 - DNA, 25 bp, Mus musculus
caatgattccgtaaccttctggagt

SEQ ID NO: 300905 - DNA, 25 bp, Mus musculus
caatgattccgttaccttctggagt

SEQ ID NO: 300906 - DNA, 25 bp, Mus musculus
caatgattcttgcaggttccccaac

SEQ ID NO: 300907 - DNA, 25 bp, Mus musculus
caatgattcttggaggttccccaac

SEQ ID NO: 300908 - DNA, 25 bp, Mus musculus
caatgattggctagtttctttaaca

SEQ ID NO: 300909 - DNA, 25 bp, Mus musculus
caatgattggcttgtttctttaaca

SEQ ID NO: 300910 - DNA, 25 bp, Mus musculus
caatgatttgccctgagtgactcca

SEQ ID NO: 300911 - DNA, 25 bp, Mus musculus
caatgatttgccgtgagtgactcca

SEQ ID NO: 300912 - DNA, 25 bp, Mus musculus
caatgattttaactaaagtcggctt

SEQ ID NO: 300913 - DNA, 25 bp, Mus musculus
caatgattttaagtaaagtcggctt

SEQ ID NO: 300914 - DNA, 25 bp, Mus musculus
caatgattttcaatcaggccgcctg

SEQ ID NO: 300915 - DNA, 25 bp, Mus musculus
caatgattttcattcaggccgcctg

SEQ ID NO: 300916 - DNA, 25 bp, Mus musculus
caatgcaataaaaagccaggagttc

SEQ ID NO: 300917 - DNA, 25 bp, Mus musculus
caatgcaataaatagccaggagttc

SEQ ID NO: 300918 - DNA, 25 bp, Mus musculus
caatgcaatgtacctgtaggtagat

SEQ ID NO: 300919 - DNA, 25 bp, Mus musculus
caatgcaatgtagctgtaggtagat

SEQ ID NO: 300920 - DNA, 25 bp, Mus musculus
caatgcaattttatactccttccaa

SEQ ID NO: 300921 - DNA, 25 bp, Mus musculus
caatgcaattttttactccttccaa

SEQ ID NO: 300922 - DNA, 25 bp, Mus musculus
caatgcactgaccagaaggcggcat

SEQ ID NO: 300923 - DNA, 25 bp, Mus musculus
caatgcactgacgagaaggcggcat

SEQ ID NO: 300924 - DNA, 25 bp, Mus musculus
caatgcacttccaagtaaaccatgg

SEQ ID NO: 300925 - DNA, 25 bp, Mus musculus
caatgcacttcctagtaaaccatgg

SEQ ID NO: 300926 - DNA, 25 bp, Mus musculus
caatgcagaattcatgctacccagt

SEQ ID NO: 300927 - DNA, 25 bp, Mus musculus
caatgcagaattgatgctacccagt

SEQ ID NO: 300928 - DNA, 25 bp, Mus musculus
caatgcagacgtacaggagcgcctg

SEQ ID NO: 300929 - DNA, 25 bp, Mus musculus
caatgcagacgttcaggagcgcctg

SEQ ID NO: 300930 - DNA, 25 bp, Mus musculus
caatgcagatggcagctagaaaagt

SEQ ID NO: 300931 - DNA, 25 bp, Mus musculus
caatgcagatgggagctagaaaagt

SEQ ID NO: 300932 - DNA, 25 bp, Mus musculus
caatgcagattgatggaccttcaga

SEQ ID NO: 300933 - DNA, 25 bp, Mus musculus
caatgcagattgttggaccttcaga

SEQ ID NO: 300934 - DNA, 25 bp, Mus musculus
caatgcagcattatcatcttgttct

SEQ ID NO: 300935 - DNA, 25 bp, Mus musculus
caatgcagcattttcatcttgttct

SEQ ID NO: 300936 - DNA, 25 bp, Mus musculus
caatgcagccatacgaagtgtcatg

SEQ ID NO: 300937 - DNA, 25 bp, Mus musculus
caatgcagccattcgaagtgtcatg

SEQ ID NO: 300938 - DNA, 25 bp, Mus musculus
caatgcagcttgagaatttccaggc

SEQ ID NO: 300939 - DNA, 25 bp, Mus musculus
caatgcagcttgtgaatttccaggc

SEQ ID NO: 300940 - DNA, 25 bp, Mus musculus
caatgcagttgaccacgtcctggaa

SEQ ID NO: 300941 - DNA, 25 bp, Mus musculus
caatgcagttgagcacgtcctggaa

SEQ ID NO: 300942 - DNA, 25 bp, Mus musculus
caatgcatcttacggtgacctgtat

SEQ ID NO: 300943 - DNA, 25 bp, Mus musculus
caatgcatcttagggtgacctgtat

SEQ ID NO: 300944 - DNA, 25 bp, Mus musculus
caatgcatgaccagtgaaacagaca

SEQ ID NO: 300945 - DNA, 25 bp, Mus musculus
caatgcatgacctgtgaaacagaca

SEQ ID NO: 300946 - DNA, 25 bp, Mus musculus
caatgcatgccaccactaggctgga

SEQ ID NO: 300947 - DNA, 25 bp, Mus musculus
caatgcatgccagcactaggctgga

SEQ ID NO: 300948 - DNA, 25 bp, Mus musculus
caatgcatggctacttgttatagaa

SEQ ID NO: 300949 - DNA, 25 bp, Mus musculus
caatgcatggcttcttgttatagaa

SEQ ID NO: 300950 - DNA, 25 bp, Mus musculus
caatgcattattctgtagccacagt

SEQ ID NO: 300951 - DNA, 25 bp, Mus musculus
caatgcattattgtgtagccacagt

SEQ ID NO: 300952 - DNA, 25 bp, Mus musculus
caatgcattgttctatatttggttt

SEQ ID NO: 300953 - DNA, 25 bp, Mus musculus
caatgcattgttgtatatttggttt

SEQ ID NO: 300954 - DNA, 25 bp, Mus musculus
caatgccatcataacctagctcttc

SEQ ID NO: 300955 - DNA, 25 bp, Mus musculus
caatgccatcattacctagctcttc

SEQ ID NO: 300956 - DNA, 25 bp, Mus musculus
caatgcccatttccctctttgttat

SEQ ID NO: 300957 - DNA, 25 bp, Mus musculus
caatgcccatttgcctctttgttat

SEQ ID NO: 300958 - DNA, 25 bp, Mus musculus
caatgccccgttagtagatttggac

SEQ ID NO: 300959 - DNA, 25 bp, Mus musculus
caatgccccgtttgtagatttggac

SEQ ID NO: 300960 - DNA, 25 bp, Mus musculus
caatgccctaatatgtctgtgtcca

SEQ ID NO: 300961 - DNA, 25 bp, Mus musculus
caatgccctaatttgtctgtgtcca

SEQ ID NO: 300962 - DNA, 25 bp, Mus musculus
caatgcccttggctggcctgagcag

SEQ ID NO: 300963 - DNA, 25 bp, Mus musculus
caatgcccttgggtggcctgagcag

SEQ ID NO: 300964 - DNA, 25 bp, Mus musculus
caatgcctacaaaagtggctagcac

SEQ ID NO: 300965 - DNA, 25 bp, Mus musculus
caatgcctacaatagtggctagcac

SEQ ID NO: 300966 - DNA, 25 bp, Mus musculus
caatgcctacctatctatcagatat

SEQ ID NO: 300967 - DNA, 25 bp, Mus musculus
caatgcctacctttctatcagatat

SEQ ID NO: 300968 - DNA, 25 bp, Mus musculus
caatgcctatggctacaacgcctac

SEQ ID NO: 300969 - DNA, 25 bp, Mus musculus
caatgcctatgggtacaacgcctac

SEQ ID NO: 300970 - DNA, 25 bp, Mus musculus
caatgcctgcctccaaatttcaggt

SEQ ID NO: 300971 - DNA, 25 bp, Mus musculus
caatgcctgcctgcaaatttcaggt

SEQ ID NO: 300972 - DNA, 25 bp, Mus musculus
caatgcctgctaaaatacttaagaa

SEQ ID NO: 300973 - DNA, 25 bp, Mus musculus
caatgcctgctataatacttaagaa

SEQ ID NO: 300974 - DNA, 25 bp, Mus musculus
caatgcctggaccattagcaaccat

SEQ ID NO: 300975 - DNA, 25 bp, Mus musculus
caatgcctggacgattagcaaccat

SEQ ID NO: 300976 - DNA, 25 bp, Mus musculus
caatgcctgtaaacatgtagtttac

SEQ ID NO: 300977 - DNA, 25 bp, Mus musculus
caatgcctgtaatcatgtagtttac

SEQ ID NO: 300978 - DNA, 25 bp, Mus musculus
caatgccttccaaatttcttttaag

SEQ ID NO: 300979 - DNA, 25 bp, Mus musculus
caatgccttccatatttcttttaag

SEQ ID NO: 300980 - DNA, 25 bp, Mus musculus
caatgccttgttagtgacgtgctgc

SEQ ID NO: 300981 - DNA, 25 bp, Mus musculus
caatgccttgtttgtgacgtgctgc

SEQ ID NO: 300982 - DNA, 25 bp, Mus musculus
caatgcgcccgccagcaggctgtag

SEQ ID NO: 300983 - DNA, 25 bp, Mus musculus
caatgcgcccgcgagcaggctgtag

SEQ ID NO: 300984 - DNA, 25 bp, Mus musculus
caatgcgctggtcgtcggactgcac

SEQ ID NO: 300985 - DNA, 25 bp, Mus musculus
caatgcgctggtggtcggactgcac

SEQ ID NO: 300986 - DNA, 25 bp, Mus musculus
caatgcgcttatccggcctctgcgt

SEQ ID NO: 300987 - DNA, 25 bp, Mus musculus
caatgcgcttatgcggcctctgcgt

SEQ ID NO: 300988 - DNA, 25 bp, Mus musculus
caatgcggccatagaaaggttgctg

SEQ ID NO: 300989 - DNA, 25 bp, Mus musculus
caatgcggccattgaaaggttgctg

SEQ ID NO: 300990 - DNA, 25 bp, Mus musculus
caatgcggctatcagcttgggctat

SEQ ID NO: 300991 - DNA, 25 bp, Mus musculus
caatgcggctatgagcttgggctat

SEQ ID NO: 300992 - DNA, 25 bp, Mus musculus
caatgcgggcacacgctcttacagt

SEQ ID NO: 300993 - DNA, 25 bp, Mus musculus
caatgcgggcactcgctcttacagt

SEQ ID NO: 300994 - DNA, 25 bp, Mus musculus
caatgcggtggcagacatgttgcgt

SEQ ID NO: 300995 - DNA, 25 bp, Mus musculus
caatgcggtggctgacatgttgcgt

SEQ ID NO: 300996 - DNA, 25 bp, Mus musculus
caatgcggttgccacactagagaaa

SEQ ID NO: 300997 - DNA, 25 bp, Mus musculus
caatgcggttgcgacactagagaaa

SEQ ID NO: 300998 - DNA, 25 bp, Mus musculus
caatgcgtgcatctctgaggaacta

SEQ ID NO: 300999 - DNA, 25 bp, Mus musculus
caatgcgtgcatgtctgaggaacta

SEQ ID NO: 301000 - DNA, 25 bp, Mus musculus
caatgctactgccaagggccagaaa

SEQ ID NO: 301001 - DNA, 25 bp, Mus musculus
caatgctactgcgaagggccagaaa

SEQ ID NO: 301002 - DNA, 25 bp, Mus musculus
caatgctatcaacaagtgccccctg

SEQ ID NO: 301003 - DNA, 25 bp, Mus musculus
caatgctatcaagaagtgccccctg

SEQ ID NO: 301004 - DNA, 25 bp, Mus musculus
caatgctctttacctagcttagtgt

SEQ ID NO: 301005 - DNA, 25 bp, Mus musculus
caatgctctttagctagcttagtgt

SEQ ID NO: 301006 - DNA, 25 bp, Mus musculus
caatgctgacaacttttatcactaa

SEQ ID NO: 301007 - DNA, 25 bp, Mus musculus
caatgctgacaagttttatcactaa

SEQ ID NO: 301008 - DNA, 25 bp, Mus musculus
caatgctgaggcagttaaagggtta

SEQ ID NO: 301009 - DNA, 25 bp, Mus musculus
caatgctgaggctgttaaagggtta

SEQ ID NO: 301010 - DNA, 25 bp, Mus musculus
caatgctgccccatcaggaagagag

SEQ ID NO: 301011 - DNA, 25 bp, Mus musculus
caatgctgccccttcaggaagagag

SEQ ID NO: 301012 - DNA, 25 bp, Mus musculus
caatgctgctccagaccaagggaga

SEQ ID NO: 301013 - DNA, 25 bp, Mus musculus
caatgctgctcctgaccaagggaga

SEQ ID NO: 301014 - DNA, 25 bp, Mus musculus
caatgctgtgaacttgcactgccta

SEQ ID NO: 301015 - DNA, 25 bp, Mus musculus
caatgctgtgaagttgcactgccta

SEQ ID NO: 301016 - DNA, 25 bp, Mus musculus
caatgctgttctaatcctccgaggg

SEQ ID NO: 301017 - DNA, 25 bp, Mus musculus
caatgctgttcttatcctccgaggg

SEQ ID NO: 301018 - DNA, 25 bp, Mus musculus
caatgctgttttaagatagcgtaca

SEQ ID NO: 301019 - DNA, 25 bp, Mus musculus
caatgctgtttttagatagcgtaca

SEQ ID NO: 301020 - DNA, 25 bp, Mus musculus
caatgcttacttctcactaatcaga

SEQ ID NO: 301021 - DNA, 25 bp, Mus musculus
caatgcttacttgtcactaatcaga

SEQ ID NO: 301022 - DNA, 25 bp, Mus musculus
caatgcttagggatgcaggatcaca

SEQ ID NO: 301023 - DNA, 25 bp, Mus musculus
caatgcttagggttgcaggatcaca

SEQ ID NO: 301024 - DNA, 25 bp, Mus musculus
caatgcttaggtaatgtggtctgaa

SEQ ID NO: 301025 - DNA, 25 bp, Mus musculus
caatgcttaggttatgtggtctgaa

SEQ ID NO: 301026 - DNA, 25 bp, Mus musculus
caatgcttcaacagatgcggttata

SEQ ID NO: 301027 - DNA, 25 bp, Mus musculus
caatgcttcaactgatgcggttata

SEQ ID NO: 301028 - DNA, 25 bp, Mus musculus
caatgcttcgagcaccaggtttact

SEQ ID NO: 301029 - DNA, 25 bp, Mus musculus
caatgcttcgaggaccaggtttact

SEQ ID NO: 301030 - DNA, 25 bp, Mus musculus
caatgcttgaagacccttgggctgg

SEQ ID NO: 301031 - DNA, 25 bp, Mus musculus
caatgcttgaagtcccttgggctgg

SEQ ID NO: 301032 - DNA, 25 bp, Mus musculus
caatgcttgaggaggatttcagaag

SEQ ID NO: 301033 - DNA, 25 bp, Mus musculus
caatgcttgaggtggatttcagaag

SEQ ID NO: 301034 - DNA, 25 bp, Mus musculus
caatgcttgcttcgagccagccaat

SEQ ID NO: 301035 - DNA, 25 bp, Mus musculus
caatgcttgcttggagccagccaat

SEQ ID NO: 301036 - DNA, 25 bp, Mus musculus
caatgcttggcgagggaagaaagac

SEQ ID NO: 301037 - DNA, 25 bp, Mus musculus
caatgcttggcgtgggaagaaagac

SEQ ID NO: 301038 - DNA, 25 bp, Mus musculus
caatgcttgttaatgggtgcagaaa

SEQ ID NO: 301039 - DNA, 25 bp, Mus musculus
caatgcttgttattgggtgcagaaa

SEQ ID NO: 301040 - DNA, 25 bp, Mus musculus
caatgctttattccctccatacaac

SEQ ID NO: 301041 - DNA, 25 bp, Mus musculus
caatgctttattgcctccatacaac

SEQ ID NO: 301042 - DNA, 25 bp, Mus musculus
caatgctttcctaataatgggtgct

SEQ ID NO: 301043 - DNA, 25 bp, Mus musculus
caatgctttccttataatgggtgct

SEQ ID NO: 301044 - DNA, 25 bp, Mus musculus
caatgctttcttccagctctgggag

SEQ ID NO: 301045 - DNA, 25 bp, Mus musculus
caatgctttcttgcagctctgggag

SEQ ID NO: 301046 - DNA, 25 bp, Mus musculus
caatgcttttccactctagggagac

SEQ ID NO: 301047 - DNA, 25 bp, Mus musculus
caatgcttttcctctctagggagac

SEQ ID NO: 301048 - DNA, 25 bp, Mus musculus
caatgctttttcatgggttctctaa

SEQ ID NO: 301049 - DNA, 25 bp, Mus musculus
caatgctttttcttgggttctctaa

SEQ ID NO: 301050 - DNA, 25 bp, Mus musculus
caatggaaacgtacttcacttgttt

SEQ ID NO: 301051 - DNA, 25 bp, Mus musculus
caatggaaacgttcttcacttgttt

SEQ ID NO: 301052 - DNA, 25 bp, Mus musculus
caatggaaagtcctggctgccggaa

SEQ ID NO: 301053 - DNA, 25 bp, Mus musculus
caatggaaagtcgtggctgccggaa

SEQ ID NO: 301054 - DNA, 25 bp, Mus musculus
caatggaacctacttggtctatggc

SEQ ID NO: 301055 - DNA, 25 bp, Mus musculus
caatggaacctagttggtctatggc

SEQ ID NO: 301056 - DNA, 25 bp, Mus musculus
caatggacagagcaacttctaatga

SEQ ID NO: 301057 - DNA, 25 bp, Mus musculus
caatggacagaggaacttctaatga

SEQ ID NO: 301058 - DNA, 25 bp, Mus musculus
caatggacccacactgacgatgtat

SEQ ID NO: 301059 - DNA, 25 bp, Mus musculus
caatggacccactctgacgatgtat

SEQ ID NO: 301060 - DNA, 25 bp, Mus musculus
caatggactataacctggaactgtg

SEQ ID NO: 301061 - DNA, 25 bp, Mus musculus
caatggactatatcctggaactgtg

SEQ ID NO: 301062 - DNA, 25 bp, Mus musculus
caatggaggctgctcagacaatcta

SEQ ID NO: 301063 - DNA, 25 bp, Mus musculus
caatggaggctggtcagacaatcta

SEQ ID NO: 301064 - DNA, 25 bp, Mus musculus
caatggagtgtaactgtcttatcaa

SEQ ID NO: 301065 - DNA, 25 bp, Mus musculus
caatggagtgtatctgtcttatcaa

SEQ ID NO: 301066 - DNA, 25 bp, Mus musculus
caatggataaagacactggcttcaa

SEQ ID NO: 301067 - DNA, 25 bp, Mus musculus
caatggataaagtcactggcttcaa

SEQ ID NO: 301068 - DNA, 25 bp, Mus musculus
caatggataaccatgctttgtgtaa

SEQ ID NO: 301069 - DNA, 25 bp, Mus musculus
caatggataaccttgctttgtgtaa

SEQ ID NO: 301070 - DNA, 25 bp, Mus musculus
caatggataacgagtgggtggtata

SEQ ID NO: 301071 - DNA, 25 bp, Mus musculus
caatggataacgtgtgggtggtata

SEQ ID NO: 301072 - DNA, 25 bp, Mus musculus
caatggatacagcaccttggagaaa

SEQ ID NO: 301073 - DNA, 25 bp, Mus musculus
caatggatacaggaccttggagaaa

SEQ ID NO: 301074 - DNA, 25 bp, Mus musculus
caatggatacttagatgaccccaca

SEQ ID NO: 301075 - DNA, 25 bp, Mus musculus
caatggatactttgatgaccccaca

SEQ ID NO: 301076 - DNA, 25 bp, Mus musculus
caatggatgaagagcgagagttcga

SEQ ID NO: 301077 - DNA, 25 bp, Mus musculus
caatggatgaagtgcgagagttcga

SEQ ID NO: 301078 - DNA, 25 bp, Mus musculus
caatggatgagaatgatggccctgg

SEQ ID NO: 301079 - DNA, 25 bp, Mus musculus
caatggatgagattgatggccctgg

SEQ ID NO: 301080 - DNA, 25 bp, Mus musculus
caatggcacctcagtaggttgcagc

SEQ ID NO: 301081 - DNA, 25 bp, Mus musculus
caatggcacctctgtaggttgcagc

SEQ ID NO: 301082 - DNA, 25 bp, Mus musculus
caatggcagctaattcgacagaggt

SEQ ID NO: 301083 - DNA, 25 bp, Mus musculus
caatggcagctatttcgacagaggt

SEQ ID NO: 301084 - DNA, 25 bp, Mus musculus
caatggcagcttactagtttgcttt

SEQ ID NO: 301085 - DNA, 25 bp, Mus musculus
caatggcagctttctagtttgcttt

SEQ ID NO: 301086 - DNA, 25 bp, Mus musculus
caatggcattgcctgtgtgtgctgt

SEQ ID NO: 301087 - DNA, 25 bp, Mus musculus
caatggcattgcgtgtgtgtgctgt

SEQ ID NO: 301088 - DNA, 25 bp, Mus musculus
caatggccatagcaagtctgaacgg

SEQ ID NO: 301089 - DNA, 25 bp, Mus musculus
caatggccataggaagtctgaacgg

SEQ ID NO: 301090 - DNA, 25 bp, Mus musculus
caatggccgaggcactaacttgttt

SEQ ID NO: 301091 - DNA, 25 bp, Mus musculus
caatggccgagggactaacttgttt

SEQ ID NO: 301092 - DNA, 25 bp, Mus musculus
caatggccgcaactgccaagacatt

SEQ ID NO: 301093 - DNA, 25 bp, Mus musculus
caatggccgcaagtgccaagacatt

SEQ ID NO: 301094 - DNA, 25 bp, Mus musculus
caatggcctcatccaagctagtgta

SEQ ID NO: 301095 - DNA, 25 bp, Mus musculus
caatggcctcatgcaagctagtgta

SEQ ID NO: 301096 - DNA, 25 bp, Mus musculus
caatggcctcgtaggcttcttgctg

SEQ ID NO: 301097 - DNA, 25 bp, Mus musculus
caatggcctcgttggcttcttgctg

SEQ ID NO: 301098 - DNA, 25 bp, Mus musculus
caatggcctgggacctaaaggtgaa

SEQ ID NO: 301099 - DNA, 25 bp, Mus musculus
caatggcctgggtcctaaaggtgaa

SEQ ID NO: 301100 - DNA, 25 bp, Mus musculus
caatggcctgtgagattagtctgga

SEQ ID NO: 301101 - DNA, 25 bp, Mus musculus
caatggcctgtgtgattagtctgga

SEQ ID NO: 301102 - DNA, 25 bp, Mus musculus
caatggcctttcacctcaggtaatg

SEQ ID NO: 301103 - DNA, 25 bp, Mus musculus
caatggcctttctcctcaggtaatg

SEQ ID NO: 301104 - DNA, 25 bp, Mus musculus
caatggcctttgatctgggaaatga

SEQ ID NO: 301105 - DNA, 25 bp, Mus musculus
caatggcctttgttctgggaaatga

SEQ ID NO: 301106 - DNA, 25 bp, Mus musculus
caatggcgtgatcccatctgaggat

SEQ ID NO: 301107 - DNA, 25 bp, Mus musculus
caatggcgtgatgccatctgaggat

SEQ ID NO: 301108 - DNA, 25 bp, Mus musculus
caatggctatagcaatggtcagctt

SEQ ID NO: 301109 - DNA, 25 bp, Mus musculus
caatggctataggaatggtcagctt

SEQ ID NO: 301110 - DNA, 25 bp, Mus musculus
caatggctccagcactagttagaga

SEQ ID NO: 301111 - DNA, 25 bp, Mus musculus
caatggctccaggactagttagaga

SEQ ID NO: 301112 - DNA, 25 bp, Mus musculus
caatggctctgtccctggacataaa

SEQ ID NO: 301113 - DNA, 25 bp, Mus musculus
caatggctctgtgcctggacataaa

SEQ ID NO: 301114 - DNA, 25 bp, Mus musculus
caatggctgatgaatgggtctgttt

SEQ ID NO: 301115 - DNA, 25 bp, Mus musculus
caatggctgatgtatgggtctgttt

SEQ ID NO: 301116 - DNA, 25 bp, Mus musculus
caatggctgccaactttaagatcgc

SEQ ID NO: 301117 - DNA, 25 bp, Mus musculus
caatggctgccatctttaagatcgc

SEQ ID NO: 301118 - DNA, 25 bp, Mus musculus
caatggctgcctagtcggagtgagt

SEQ ID NO: 301119 - DNA, 25 bp, Mus musculus
caatggctgccttgtcggagtgagt

SEQ ID NO: 301120 - DNA, 25 bp, Mus musculus
caatggctggttctagttagttcat

SEQ ID NO: 301121 - DNA, 25 bp, Mus musculus
caatggctggttgtagttagttcat

SEQ ID NO: 301122 - DNA, 25 bp, Mus musculus
caatggctgtctctccatggtagaa

SEQ ID NO: 301123 - DNA, 25 bp, Mus musculus
caatggctgtctgtccatggtagaa

SEQ ID NO: 301124 - DNA, 25 bp, Mus musculus
caatggcttgagagtcctgtgctgg

SEQ ID NO: 301125 - DNA, 25 bp, Mus musculus
caatggcttgagtgtcctgtgctgg

SEQ ID NO: 301126 - DNA, 25 bp, Mus musculus
caatgggaaccactgtttcaagatg

SEQ ID NO: 301127 - DNA, 25 bp, Mus musculus
caatgggaaccagtgtttcaagatg

SEQ ID NO: 301128 - DNA, 25 bp, Mus musculus
caatgggaacttacctaatttcata

SEQ ID NO: 301129 - DNA, 25 bp, Mus musculus
caatgggaactttcctaatttcata

SEQ ID NO: 301130 - DNA, 25 bp, Mus musculus
caatgggaagcaacagctggagact

SEQ ID NO: 301131 - DNA, 25 bp, Mus musculus
caatgggaagcatcagctggagact

SEQ ID NO: 301132 - DNA, 25 bp, Mus musculus
caatgggaattgatggatttcgcat

SEQ ID NO: 301133 - DNA, 25 bp, Mus musculus
caatgggaattgttggatttcgcat

SEQ ID NO: 301134 - DNA, 25 bp, Mus musculus
caatgggacatcaaattatagcctc

SEQ ID NO: 301135 - DNA, 25 bp, Mus musculus
caatgggacatctaattatagcctc

SEQ ID NO: 301136 - DNA, 25 bp, Mus musculus
caatgggactgtcctcgagaaatct

SEQ ID NO: 301137 - DNA, 25 bp, Mus musculus
caatgggactgtgctcgagaaatct

SEQ ID NO: 301138 - DNA, 25 bp, Mus musculus
caatgggagcttaagtagatggcga

SEQ ID NO: 301139 - DNA, 25 bp, Mus musculus
caatgggagctttagtagatggcga

SEQ ID NO: 301140 - DNA, 25 bp, Mus musculus
caatgggatcgcaggctaatcgtct

SEQ ID NO: 301141 - DNA, 25 bp, Mus musculus
caatgggatcgctggctaatcgtct

SEQ ID NO: 301142 - DNA, 25 bp, Mus musculus
caatgggcccggaaaggagctttgt

SEQ ID NO: 301143 - DNA, 25 bp, Mus musculus
caatgggcccggtaaggagctttgt

SEQ ID NO: 301144 - DNA, 25 bp, Mus musculus
caatgggcgggtcaggtctacttta

SEQ ID NO: 301145 - DNA, 25 bp, Mus musculus
caatgggcgggtgaggtctacttta

SEQ ID NO: 301146 - DNA, 25 bp, Mus musculus
caatgggctcacataacactatttt

SEQ ID NO: 301147 - DNA, 25 bp, Mus musculus
caatgggctcacttaacactatttt

SEQ ID NO: 301148 - DNA, 25 bp, Mus musculus
caatgggctcctcggtgaccagggc

SEQ ID NO: 301149 - DNA, 25 bp, Mus musculus
caatgggctcctgggtgaccagggc

SEQ ID NO: 301150 - DNA, 25 bp, Mus musculus
caatgggctggaagtcgtgcatgct

SEQ ID NO: 301151 - DNA, 25 bp, Mus musculus
caatgggctggatgtcgtgcatgct

SEQ ID NO: 301152 - DNA, 25 bp, Mus musculus
caatgggctggcactgtggcaggct

SEQ ID NO: 301153 - DNA, 25 bp, Mus musculus
caatgggctggctctgtggcaggct

SEQ ID NO: 301154 - DNA, 25 bp, Mus musculus
caatgggcttccagtttcttcatct

SEQ ID NO: 301155 - DNA, 25 bp, Mus musculus
caatgggcttcctgtttcttcatct

SEQ ID NO: 301156 - DNA, 25 bp, Mus musculus
caatgggcttggaaacactcacctc

SEQ ID NO: 301157 - DNA, 25 bp, Mus musculus
caatgggcttggatctttcagttgc

SEQ ID NO: 301158 - DNA, 25 bp, Mus musculus
caatgggcttggtaacactcacctc

SEQ ID NO: 301159 - DNA, 25 bp, Mus musculus
caatgggcttggttctttcagttgc

SEQ ID NO: 301160 - DNA, 25 bp, Mus musculus
caatgggcttgtaaactgtctgtta

SEQ ID NO: 301161 - DNA, 25 bp, Mus musculus
caatgggcttgttaactgtctgtta

SEQ ID NO: 301162 - DNA, 25 bp, Mus musculus
caatggggccttaccacggaggaga

SEQ ID NO: 301163 - DNA, 25 bp, Mus musculus
caatggggcctttccacggaggaga

SEQ ID NO: 301164 - DNA, 25 bp, Mus musculus
caatgggtatttattctggccacat

SEQ ID NO: 301165 - DNA, 25 bp, Mus musculus
caatgggtattttttctggccacat

SEQ ID NO: 301166 - DNA, 25 bp, Mus musculus
caatgggtctcaaaaaacggtctca

SEQ ID NO: 301167 - DNA, 25 bp, Mus musculus
caatgggtctcaccgcacgacgagg

SEQ ID NO: 301168 - DNA, 25 bp, Mus musculus
caatgggtctcagcgcacgacgagg

SEQ ID NO: 301169 - DNA, 25 bp, Mus musculus
caatgggtctcataaaacggtctca

SEQ ID NO: 301170 - DNA, 25 bp, Mus musculus
caatgggtgcttctgagtctgctca

SEQ ID NO: 301171 - DNA, 25 bp, Mus musculus
caatgggtgcttgtgagtctgctca

SEQ ID NO: 301172 - DNA, 25 bp, Mus musculus
caatgggtgtggacagttttctagt

SEQ ID NO: 301173 - DNA, 25 bp, Mus musculus
caatgggtgtggtcagttttctagt

SEQ ID NO: 301174 - DNA, 25 bp, Mus musculus
caatgggttccaattgttgttccaa

SEQ ID NO: 301175 - DNA, 25 bp, Mus musculus
caatgggttccatttgttgttccaa

SEQ ID NO: 301176 - DNA, 25 bp, Mus musculus
caatgggttcccatccaggaagagg

SEQ ID NO: 301177 - DNA, 25 bp, Mus musculus
caatgggttcccttccaggaagagg

SEQ ID NO: 301178 - DNA, 25 bp, Mus musculus
caatggtaaccaagctttatttcgg

SEQ ID NO: 301179 - DNA, 25 bp, Mus musculus
caatggtaaccatgctttatttcgg

SEQ ID NO: 301180 - DNA, 25 bp, Mus musculus
caatggtagcagctttgttgaacct

SEQ ID NO: 301181 - DNA, 25 bp, Mus musculus
caatggtagcaggtttgttgaacct

SEQ ID NO: 301182 - DNA, 25 bp, Mus musculus
caatggtagcatagtggcttctagg

SEQ ID NO: 301183 - DNA, 25 bp, Mus musculus
caatggtagcattgtggcttctagg

SEQ ID NO: 301184 - DNA, 25 bp, Mus musculus
caatggtagttactccagcacccta

SEQ ID NO: 301185 - DNA, 25 bp, Mus musculus
caatggtagttagtccagcacccta

SEQ ID NO: 301186 - DNA, 25 bp, Mus musculus
caatggtataccctggaagttgctt

SEQ ID NO: 301187 - DNA, 25 bp, Mus musculus
caatggtataccgtggaagttgctt

SEQ ID NO: 301188 - DNA, 25 bp, Mus musculus
caatggtcagtaccgcattcggact

SEQ ID NO: 301189 - DNA, 25 bp, Mus musculus
caatggtcagtagcgcattcggact

SEQ ID NO: 301190 - DNA, 25 bp, Mus musculus
caatggtccagaagccaactcacca

SEQ ID NO: 301191 - DNA, 25 bp, Mus musculus
caatggtccagatgccaactcacca

SEQ ID NO: 301192 - DNA, 25 bp, Mus musculus
caatggtccctgagctgtaggtgca

SEQ ID NO: 301193 - DNA, 25 bp, Mus musculus
caatggtccctgtgctgtaggtgca

SEQ ID NO: 301194 - DNA, 25 bp, Mus musculus
caatggtcttgaaacatcatccaga

SEQ ID NO: 301195 - DNA, 25 bp, Mus musculus
caatggtcttgatacatcatccaga

SEQ ID NO: 301196 - DNA, 25 bp, Mus musculus
caatggtcttttagtccttaggtga

SEQ ID NO: 301197 - DNA, 25 bp, Mus musculus
caatggtctttttgtccttaggtga

SEQ ID NO: 301198 - DNA, 25 bp, Mus musculus
caatggtgaagtcgtggcttgtcaa

SEQ ID NO: 301199 - DNA, 25 bp, Mus musculus
caatggtgaagtggtggcttgtcaa

SEQ ID NO: 301200 - DNA, 25 bp, Mus musculus
caatggtgaggacacccactgccac

SEQ ID NO: 301201 - DNA, 25 bp, Mus musculus
caatggtgaggagacccactgccac

SEQ ID NO: 301202 - DNA, 25 bp, Mus musculus
caatggtgcctaatattttttgttt

SEQ ID NO: 301203 - DNA, 25 bp, Mus musculus
caatggtgcctattattttttgttt

SEQ ID NO: 301204 - DNA, 25 bp, Mus musculus
caatggtgcggtcggtagggaacaa

SEQ ID NO: 301205 - DNA, 25 bp, Mus musculus
caatggtgcggtgggtagggaacaa

SEQ ID NO: 301206 - DNA, 25 bp, Mus musculus
caatggtgctgcattgtggcaaagt

SEQ ID NO: 301207 - DNA, 25 bp, Mus musculus
caatggtgctgctttgtggcaaagt

SEQ ID NO: 301208 - DNA, 25 bp, Mus musculus
caatggtggagacatacttgaccca

SEQ ID NO: 301209 - DNA, 25 bp, Mus musculus
caatggtggagagatacttgaccca

SEQ ID NO: 301210 - DNA, 25 bp, Mus musculus
caatggtggcccagtgcgttgtgat

SEQ ID NO: 301211 - DNA, 25 bp, Mus musculus
caatggtggccctgtgcgttgtgat

SEQ ID NO: 301212 - DNA, 25 bp, Mus musculus
caatggtggttgctactggcttgtt

SEQ ID NO: 301213 - DNA, 25 bp, Mus musculus
caatggtggttggtactggcttgtt

SEQ ID NO: 301214 - DNA, 25 bp, Mus musculus
caatggttcaagagttctcggctgt

SEQ ID NO: 301215 - DNA, 25 bp, Mus musculus
caatggttcaagtgttctcggctgt

SEQ ID NO: 301216 - DNA, 25 bp, Mus musculus
caatggttctcactgttgcgttaac

SEQ ID NO: 301217 - DNA, 25 bp, Mus musculus
caatggttctcagtgttgcgttaac

SEQ ID NO: 301218 - DNA, 25 bp, Mus musculus
caatggttgagccactttgtcagtg

SEQ ID NO: 301219 - DNA, 25 bp, Mus musculus
caatggttgagcgactttgtcagtg

SEQ ID NO: 301220 - DNA, 25 bp, Mus musculus
caatggttgctaatttacatctact

SEQ ID NO: 301221 - DNA, 25 bp, Mus musculus
caatggttgctattttacatctact

SEQ ID NO: 301222 - DNA, 25 bp, Mus musculus
caatggtttagtatcaggtactagt

SEQ ID NO: 301223 - DNA, 25 bp, Mus musculus
caatggtttagtttcaggtactagt

SEQ ID NO: 301224 - DNA, 25 bp, Mus musculus
caatggttttgcaagccaaggtttt

SEQ ID NO: 301225 - DNA, 25 bp, Mus musculus
caatggttttgctagccaaggtttt

SEQ ID NO: 301226 - DNA, 25 bp, Mus musculus
caatgtaacactagagatctttctg

SEQ ID NO: 301227 - DNA, 25 bp, Mus musculus
caatgtaacacttgagatctttctg

SEQ ID NO: 301228 - DNA, 25 bp, Mus musculus
caatgtaacattctagagctagaaa

SEQ ID NO: 301229 - DNA, 25 bp, Mus musculus
caatgtaacattgtagagctagaaa

SEQ ID NO: 301230 - DNA, 25 bp, Mus musculus
caatgtaagcctcggtcctggtgtg

SEQ ID NO: 301231 - DNA, 25 bp, Mus musculus
caatgtaagcctgggtcctggtgtg

SEQ ID NO: 301232 - DNA, 25 bp, Mus musculus
caatgtacattgagtgtgtagccat

SEQ ID NO: 301233 - DNA, 25 bp, Mus musculus
caatgtacattgtgtgtgtagccat

SEQ ID NO: 301234 - DNA, 25 bp, Mus musculus
caatgtacccatacgctttactaag

SEQ ID NO: 301235 - DNA, 25 bp, Mus musculus
caatgtacccattcgctttactaag

SEQ ID NO: 301236 - DNA, 25 bp, Mus musculus
caatgtacctgaatctgggctggca

SEQ ID NO: 301237 - DNA, 25 bp, Mus musculus
caatgtacctgattctgggctggca

SEQ ID NO: 301238 - DNA, 25 bp, Mus musculus
caatgtagatgactagcccaaggct

SEQ ID NO: 301239 - DNA, 25 bp, Mus musculus
caatgtagatgagtagcccaaggct

SEQ ID NO: 301240 - DNA, 25 bp, Mus musculus
caatgtagatttcaagtacagtggt

SEQ ID NO: 301241 - DNA, 25 bp, Mus musculus
caatgtagatttgaagtacagtggt

SEQ ID NO: 301242 - DNA, 25 bp, Mus musculus
caatgtagcactcccaactgacagt

SEQ ID NO: 301243 - DNA, 25 bp, Mus musculus
caatgtagcactgccaactgacagt

SEQ ID NO: 301244 - DNA, 25 bp, Mus musculus
caatgtagtcccatgatttattggg

SEQ ID NO: 301245 - DNA, 25 bp, Mus musculus
caatgtagtcccttgatttattggg

SEQ ID NO: 301246 - DNA, 25 bp, Mus musculus
caatgtagtcttcattctcgggcac

SEQ ID NO: 301247 - DNA, 25 bp, Mus musculus
caatgtagtcttgattctcgggcac

SEQ ID NO: 301248 - DNA, 25 bp, Mus musculus
caatgtagtgttacctgagtgcaga

SEQ ID NO: 301249 - DNA, 25 bp, Mus musculus
caatgtagtgtttcctgagtgcaga

SEQ ID NO: 301250 - DNA, 25 bp, Mus musculus
caatgtatcattctaacttcaacca

SEQ ID NO: 301251 - DNA, 25 bp, Mus musculus
caatgtatcattgtaacttcaacca

SEQ ID NO: 301252 - DNA, 25 bp, Mus musculus
caatgtatctccatgaggatttttt

SEQ ID NO: 301253 - DNA, 25 bp, Mus musculus
caatgtatctccttgaggatttttt

SEQ ID NO: 301254 - DNA, 25 bp, Mus musculus
caatgtatctggagcccacttggga

SEQ ID NO: 301255 - DNA, 25 bp, Mus musculus
caatgtatctggtgcccacttggga

SEQ ID NO: 301256 - DNA, 25 bp, Mus musculus
caatgtattcatacactattcactg

SEQ ID NO: 301257 - DNA, 25 bp, Mus musculus
caatgtattcattcactattcactg

SEQ ID NO: 301258 - DNA, 25 bp, Mus musculus
caatgtattgctcgctggtcacttc

SEQ ID NO: 301259 - DNA, 25 bp, Mus musculus
caatgtattgctggctggtcacttc

SEQ ID NO: 301260 - DNA, 25 bp, Mus musculus
caatgtattgggatcgtctacggtt

SEQ ID NO: 301261 - DNA, 25 bp, Mus musculus
caatgtattgggttcgtctacggtt

SEQ ID NO: 301262 - DNA, 25 bp, Mus musculus
caatgtcaacgaagcctgttccaaa

SEQ ID NO: 301263 - DNA, 25 bp, Mus musculus
caatgtcaacgatgcctgttccaaa

SEQ ID NO: 301264 - DNA, 25 bp, Mus musculus
caatgtcacacgacacctgtctgca

SEQ ID NO: 301265 - DNA, 25 bp, Mus musculus
caatgtcacacgtcacctgtctgca

SEQ ID NO: 301266 - DNA, 25 bp, Mus musculus
caatgtcaccaaagctggtttgctg

SEQ ID NO: 301267 - DNA, 25 bp, Mus musculus
caatgtcaccaatgctggtttgctg

SEQ ID NO: 301268 - DNA, 25 bp, Mus musculus
caatgtcagagcattggcgctcctg

SEQ ID NO: 301269 - DNA, 25 bp, Mus musculus
caatgtcagagctttggcgctcctg

SEQ ID NO: 301270 - DNA, 25 bp, Mus musculus
caatgtcagagtcggcgtggtcttt

SEQ ID NO: 301271 - DNA, 25 bp, Mus musculus
caatgtcagagtgggcgtggtcttt

SEQ ID NO: 301272 - DNA, 25 bp, Mus musculus
caatgtcagtatatgaacttggcac

SEQ ID NO: 301273 - DNA, 25 bp, Mus musculus
caatgtcagtatttgaacttggcac

SEQ ID NO: 301274 - DNA, 25 bp, Mus musculus
caatgtcatctgatagtattttaaa

SEQ ID NO: 301275 - DNA, 25 bp, Mus musculus
caatgtcatctgttagtattttaaa

SEQ ID NO: 301276 - DNA, 25 bp, Mus musculus
caatgtcatggtccctctcagggta

SEQ ID NO: 301277 - DNA, 25 bp, Mus musculus
caatgtcatggtgcctctcagggta

SEQ ID NO: 301278 - DNA, 25 bp, Mus musculus
caatgtccaagtctgtaagttcctg

SEQ ID NO: 301279 - DNA, 25 bp, Mus musculus
caatgtccaagtgtgtaagttcctg

SEQ ID NO: 301280 - DNA, 25 bp, Mus musculus
caatgtccacatagtccgagatgac

SEQ ID NO: 301281 - DNA, 25 bp, Mus musculus
caatgtccacattgtccgagatgac

SEQ ID NO: 301282 - DNA, 25 bp, Mus musculus
caatgtccactaacactgctcaggg

SEQ ID NO: 301283 - DNA, 25 bp, Mus musculus
caatgtccactatcactgctcaggg

SEQ ID NO: 301284 - DNA, 25 bp, Mus musculus
caatgtccatagatagaatttctct

SEQ ID NO: 301285 - DNA, 25 bp, Mus musculus
caatgtccatagttagaatttctct

SEQ ID NO: 301286 - DNA, 25 bp, Mus musculus
caatgtcccataaccttctagtaag

SEQ ID NO: 301287 - DNA, 25 bp, Mus musculus
caatgtcccatatccttctagtaag

SEQ ID NO: 301288 - DNA, 25 bp, Mus musculus
caatgtcccgcactatgccaaaaat

SEQ ID NO: 301289 - DNA, 25 bp, Mus musculus
caatgtcccgcagtatgccaaaaat

SEQ ID NO: 301290 - DNA, 25 bp, Mus musculus
caatgtcctatgctggtctgagtga

SEQ ID NO: 301291 - DNA, 25 bp, Mus musculus
caatgtcctatggtggtctgagtga

SEQ ID NO: 301292 - DNA, 25 bp, Mus musculus
caatgtcctattacttctcaggagg

SEQ ID NO: 301293 - DNA, 25 bp, Mus musculus
caatgtcctatttcttctcaggagg

SEQ ID NO: 301294 - DNA, 25 bp, Mus musculus
caatgtcctgttagtctgggataca

SEQ ID NO: 301295 - DNA, 25 bp, Mus musculus
caatgtcctgtttgtctgggataca

SEQ ID NO: 301296 - DNA, 25 bp, Mus musculus
caatgtccttgaacataagtaccta

SEQ ID NO: 301297 - DNA, 25 bp, Mus musculus
caatgtccttgatcataagtaccta

SEQ ID NO: 301298 - DNA, 25 bp, Mus musculus
caatgtcctttcatcagtgtctaga

SEQ ID NO: 301299 - DNA, 25 bp, Mus musculus
caatgtcctttcttcagtgtctaga

SEQ ID NO: 301300 - DNA, 25 bp, Mus musculus
caatgtctaataatcaagtaatcac

SEQ ID NO: 301301 - DNA, 25 bp, Mus musculus
caatgtctaatattcaagtaatcac

SEQ ID NO: 301302 - DNA, 25 bp, Mus musculus
caatgtctaatgaactgacttatta

SEQ ID NO: 301303 - DNA, 25 bp, Mus musculus
caatgtctaatgtactgacttatta

SEQ ID NO: 301304 - DNA, 25 bp, Mus musculus
caatgtctactcaagttgccatgca

SEQ ID NO: 301305 - DNA, 25 bp, Mus musculus
caatgtctactctagttgccatgca

SEQ ID NO: 301306 - DNA, 25 bp, Mus musculus
caatgtctcaagagaatttgttttg

SEQ ID NO: 301307 - DNA, 25 bp, Mus musculus
caatgtctcaagtgaatttgttttg

SEQ ID NO: 301308 - DNA, 25 bp, Mus musculus
caatgtctgctgattacaatcaaga

SEQ ID NO: 301309 - DNA, 25 bp, Mus musculus
caatgtctgctgtttacaatcaaga

SEQ ID NO: 301310 - DNA, 25 bp, Mus musculus
caatgtctgtagcaggtttccctgt

SEQ ID NO: 301311 - DNA, 25 bp, Mus musculus
caatgtctgtaggaggtttccctgt

SEQ ID NO: 301312 - DNA, 25 bp, Mus musculus
caatgtcttattctatactgtcagt

SEQ ID NO: 301313 - DNA, 25 bp, Mus musculus
caatgtcttattgtatactgtcagt

SEQ ID NO: 301314 - DNA, 25 bp, Mus musculus
caatgtcttcatacttttggtctaa

SEQ ID NO: 301315 - DNA, 25 bp, Mus musculus
caatgtcttcattcttttggtctaa

SEQ ID NO: 301316 - DNA, 25 bp, Mus musculus
caatgtgaagctaccggaggcagac

SEQ ID NO: 301317 - DNA, 25 bp, Mus musculus
caatgtgaagcttccggaggcagac

SEQ ID NO: 301318 - DNA, 25 bp, Mus musculus
caatgtgaagtgattctatctaata

SEQ ID NO: 301319 - DNA, 25 bp, Mus musculus
caatgtgaagtgtttctatctaata

SEQ ID NO: 301320 - DNA, 25 bp, Mus musculus
caatgtgaatcactctatggaaatc

SEQ ID NO: 301321 - DNA, 25 bp, Mus musculus
caatgtgaatcagtctatggaaatc

SEQ ID NO: 301322 - DNA, 25 bp, Mus musculus
caatgtgaatctacgggctgtcatc

SEQ ID NO: 301323 - DNA, 25 bp, Mus musculus
caatgtgaatcttcgggctgtcatc

SEQ ID NO: 301324 - DNA, 25 bp, Mus musculus
caatgtgaatgaacctgaggctgaa

SEQ ID NO: 301325 - DNA, 25 bp, Mus musculus
caatgtgaatgatcctgaggctgaa

SEQ ID NO: 301326 - DNA, 25 bp, Mus musculus
caatgtgaatgtagttttccctcat

SEQ ID NO: 301327 - DNA, 25 bp, Mus musculus
caatgtgaatgttgttttccctcat

SEQ ID NO: 301328 - DNA, 25 bp, Mus musculus
caatgtgagcttatcgttcttatac

SEQ ID NO: 301329 - DNA, 25 bp, Mus musculus
caatgtgagcttttcgttcttatac

SEQ ID NO: 301330 - DNA, 25 bp, Mus musculus
caatgtgagtgaactgtgtggtcgc

SEQ ID NO: 301331 - DNA, 25 bp, Mus musculus
caatgtgagtgatctgtgtggtcgc

SEQ ID NO: 301332 - DNA, 25 bp, Mus musculus
caatgtgatccactcaactcttcaa

SEQ ID NO: 301333 - DNA, 25 bp, Mus musculus
caatgtgatccagtcaactcttcaa

SEQ ID NO: 301334 - DNA, 25 bp, Mus musculus
caatgtgcaagtcgccaccacggac

SEQ ID NO: 301335 - DNA, 25 bp, Mus musculus
caatgtgcaagtggccaccacggac

SEQ ID NO: 301336 - DNA, 25 bp, Mus musculus
caatgtgcaataacgtggtgtcgcg

SEQ ID NO: 301337 - DNA, 25 bp, Mus musculus
caatgtgcaatatcgtggtgtcgcg

SEQ ID NO: 301338 - DNA, 25 bp, Mus musculus
caatgtgcagacagcgtgttcgcct

SEQ ID NO: 301339 - DNA, 25 bp, Mus musculus
caatgtgcagactgcgtgttcgcct

SEQ ID NO: 301340 - DNA, 25 bp, Mus musculus
caatgtgccaatctgcattccctgg

SEQ ID NO: 301341 - DNA, 25 bp, Mus musculus
caatgtgccaatgtgcattccctgg

SEQ ID NO: 301342 - DNA, 25 bp, Mus musculus
caatgtgcgtgaagttgtactcccc

SEQ ID NO: 301343 - DNA, 25 bp, Mus musculus
caatgtgcgtgatgttgtactcccc

SEQ ID NO: 301344 - DNA, 25 bp, Mus musculus
caatgtgctcagctgtgttgtttat

SEQ ID NO: 301345 - DNA, 25 bp, Mus musculus
caatgtgctcaggtgtgttgtttat

SEQ ID NO: 301346 - DNA, 25 bp, Mus musculus
caatgtgctctcatgggcatccaga

SEQ ID NO: 301347 - DNA, 25 bp, Mus musculus
caatgtgctctcttgggcatccaga

SEQ ID NO: 301348 - DNA, 25 bp, Mus musculus
caatgtgcttctattaaggccccgt

SEQ ID NO: 301349 - DNA, 25 bp, Mus musculus
caatgtgcttcttttaaggccccgt

SEQ ID NO: 301350 - DNA, 25 bp, Mus musculus
caatgtggatgacaactaatcgctg

SEQ ID NO: 301351 - DNA, 25 bp, Mus musculus
caatgtggatgagaactaatcgctg

SEQ ID NO: 301352 - DNA, 25 bp, Mus musculus
caatgtggcgccatcttgcttgtat

SEQ ID NO: 301353 - DNA, 25 bp, Mus musculus
caatgtggcgccttcttgcttgtat

SEQ ID NO: 301354 - DNA, 25 bp, Mus musculus
caatgtggcttaacatactctggat

SEQ ID NO: 301355 - DNA, 25 bp, Mus musculus
caatgtggcttatcatactctggat

SEQ ID NO: 301356 - DNA, 25 bp, Mus musculus
caatgtggcttgaagaaagaaagac

SEQ ID NO: 301357 - DNA, 25 bp, Mus musculus
caatgtggcttgtagaaagaaagac

SEQ ID NO: 301358 - DNA, 25 bp, Mus musculus
caatgtggtggcacactgctttgaa

SEQ ID NO: 301359 - DNA, 25 bp, Mus musculus
caatgtggtggcagtcacgatggct

SEQ ID NO: 301360 - DNA, 25 bp, Mus musculus
caatgtggtggctcactgctttgaa

SEQ ID NO: 301361 - DNA, 25 bp, Mus musculus
caatgtggtggctgtcacgatggct

SEQ ID NO: 301362 - DNA, 25 bp, Mus musculus
caatgtggttagatggatcggccta

SEQ ID NO: 301363 - DNA, 25 bp, Mus musculus
caatgtggttagttggatcggccta

SEQ ID NO: 301364 - DNA, 25 bp, Mus musculus
caatgtggttttacagttgtaaaat

SEQ ID NO: 301365 - DNA, 25 bp, Mus musculus
caatgtggtttttcagttgtaaaat

SEQ ID NO: 301366 - DNA, 25 bp, Mus musculus
caatgtgtaattagatgtcattacc

SEQ ID NO: 301367 - DNA, 25 bp, Mus musculus
caatgtgtaatttgatgtcattacc

SEQ ID NO: 301368 - DNA, 25 bp, Mus musculus
caatgtgtacaaaccttctgccggg

SEQ ID NO: 301369 - DNA, 25 bp, Mus musculus
caatgtgtacaatccttctgccggg

SEQ ID NO: 301370 - DNA, 25 bp, Mus musculus
caatgtgtctggctacatctgctga

SEQ ID NO: 301371 - DNA, 25 bp, Mus musculus
caatgtgtctgggtacatctgctga

SEQ ID NO: 301372 - DNA, 25 bp, Mus musculus
caatgtgtgcgcagtgttagcatct

SEQ ID NO: 301373 - DNA, 25 bp, Mus musculus
caatgtgtgcgctgtgttagcatct

SEQ ID NO: 301374 - DNA, 25 bp, Mus musculus
caatgtgtgtgaaatggcttacctc

SEQ ID NO: 301375 - DNA, 25 bp, Mus musculus
caatgtgtgtgatatggcttacctc

SEQ ID NO: 301376 - DNA, 25 bp, Mus musculus
caatgtgttactactcacaaacaga

SEQ ID NO: 301377 - DNA, 25 bp, Mus musculus
caatgtgttacttctcacaaacaga

SEQ ID NO: 301378 - DNA, 25 bp, Mus musculus
caatgtgttcccacacttctacagc

SEQ ID NO: 301379 - DNA, 25 bp, Mus musculus
caatgtgttccctcacttctacagc

SEQ ID NO: 301380 - DNA, 25 bp, Mus musculus
caatgttaacctctggctgctacca

SEQ ID NO: 301381 - DNA, 25 bp, Mus musculus
caatgttaacctgtggctgctacca

SEQ ID NO: 301382 - DNA, 25 bp, Mus musculus
caatgttacttccttagcctagcaa

SEQ ID NO: 301383 - DNA, 25 bp, Mus musculus
caatgttacttcgttagcctagcaa

SEQ ID NO: 301384 - DNA, 25 bp, Mus musculus
caatgttagcttactaattccacac

SEQ ID NO: 301385 - DNA, 25 bp, Mus musculus
caatgttagctttctaattccacac

SEQ ID NO: 301386 - DNA, 25 bp, Mus musculus
caatgttatgctcgcttgcctagct

SEQ ID NO: 301387 - DNA, 25 bp, Mus musculus
caatgttatgctggcttgcctagct

SEQ ID NO: 301388 - DNA, 25 bp, Mus musculus
caatgttccagcaacgtgtgtatgt

SEQ ID NO: 301389 - DNA, 25 bp, Mus musculus
caatgttccagctacgtgtgtatgt

SEQ ID NO: 301390 - DNA, 25 bp, Mus musculus
caatgttcttttaggccatgacaat

SEQ ID NO: 301391 - DNA, 25 bp, Mus musculus
caatgttctttttggccatgacaat

SEQ ID NO: 301392 - DNA, 25 bp, Mus musculus
caatgttgatgtaattatcacttat

SEQ ID NO: 301393 - DNA, 25 bp, Mus musculus
caatgttgatgttattatcacttat

SEQ ID NO: 301394 - DNA, 25 bp, Mus musculus
caatgttgccatattgtgggagtaa

SEQ ID NO: 301395 - DNA, 25 bp, Mus musculus
caatgttgccattttgtgggagtaa

SEQ ID NO: 301396 - DNA, 25 bp, Mus musculus
caatgttggcatatatggttcagaa

SEQ ID NO: 301397 - DNA, 25 bp, Mus musculus
caatgttggcatttatggttcagaa

SEQ ID NO: 301398 - DNA, 25 bp, Mus musculus
caatgttggcctatgaaccccaagg

SEQ ID NO: 301399 - DNA, 25 bp, Mus musculus
caatgttggcctttgaaccccaagg

SEQ ID NO: 301400 - DNA, 25 bp, Mus musculus
caatgttgtagtagacacagaggta

SEQ ID NO: 301401 - DNA, 25 bp, Mus musculus
caatgttgtagttgacacagaggta

SEQ ID NO: 301402 - DNA, 25 bp, Mus musculus
caatgttgtatcaatattccacatg

SEQ ID NO: 301403 - DNA, 25 bp, Mus musculus
caatgttgtatctatattccacatg

SEQ ID NO: 301404 - DNA, 25 bp, Mus musculus
caatgttgtgcaaggccttcaccct

SEQ ID NO: 301405 - DNA, 25 bp, Mus musculus
caatgttgtgcatggccttcaccct

SEQ ID NO: 301406 - DNA, 25 bp, Mus musculus
caatgttgtggcaacaactcacttt

SEQ ID NO: 301407 - DNA, 25 bp, Mus musculus
caatgttgtggctacaactcacttt

SEQ ID NO: 301408 - DNA, 25 bp, Mus musculus
caatgtttactgagtgcaagggtgt

SEQ ID NO: 301409 - DNA, 25 bp, Mus musculus
caatgtttactgtgtgcaagggtgt

SEQ ID NO: 301410 - DNA, 25 bp, Mus musculus
caatgtttatagatggttgcacagc

SEQ ID NO: 301411 - DNA, 25 bp, Mus musculus
caatgtttatagttggttgcacagc

SEQ ID NO: 301412 - DNA, 25 bp, Mus musculus
caatgtttatttacccccaatgcct

SEQ ID NO: 301413 - DNA, 25 bp, Mus musculus
caatgtttattttcccccaatgcct

SEQ ID NO: 301414 - DNA, 25 bp, Mus musculus
caatgtttcagtaaaccttggtgac

SEQ ID NO: 301415 - DNA, 25 bp, Mus musculus
caatgtttcagttaaccttggtgac

SEQ ID NO: 301416 - DNA, 25 bp, Mus musculus
caatgtttcatcattatcaagcctg

SEQ ID NO: 301417 - DNA, 25 bp, Mus musculus
caatgtttcatctttatcaagcctg

SEQ ID NO: 301418 - DNA, 25 bp, Mus musculus
caatgtttccggaagtcacgtgacc

SEQ ID NO: 301419 - DNA, 25 bp, Mus musculus
caatgtttccggtagtcacgtgacc

SEQ ID NO: 301420 - DNA, 25 bp, Mus musculus
caatgtttctcaagtggttggccag

SEQ ID NO: 301421 - DNA, 25 bp, Mus musculus
caatgtttctcatgtggttggccag

SEQ ID NO: 301422 - DNA, 25 bp, Mus musculus
caatgtttgaaaccctttgcgtgca

SEQ ID NO: 301423 - DNA, 25 bp, Mus musculus
caatgtttgaaagcctttgcgtgca

SEQ ID NO: 301424 - DNA, 25 bp, Mus musculus
caatgtttgaatcagcttcctccag

SEQ ID NO: 301425 - DNA, 25 bp, Mus musculus
caatgtttgaatgagcttcctccag

SEQ ID NO: 301426 - DNA, 25 bp, Mus musculus
caatgtttgctactcaaccacacaa

SEQ ID NO: 301427 - DNA, 25 bp, Mus musculus
caatgtttgctagtcaaccacacaa

SEQ ID NO: 301428 - DNA, 25 bp, Mus musculus
caatgtttggtgacacctctctgca

SEQ ID NO: 301429 - DNA, 25 bp, Mus musculus
caatgtttggtgtcacctctctgca

SEQ ID NO: 301430 - DNA, 25 bp, Mus musculus
caatgttttccaccaacctggagaa

SEQ ID NO: 301431 - DNA, 25 bp, Mus musculus
caatgttttccacgtaccactttca

SEQ ID NO: 301432 - DNA, 25 bp, Mus musculus
caatgttttccagcaacctggagaa

SEQ ID NO: 301433 - DNA, 25 bp, Mus musculus
caatgttttccaggtaccactttca

SEQ ID NO: 301434 - DNA, 25 bp, Mus musculus
caatgttttctaaatgccacgttaa

SEQ ID NO: 301435 - DNA, 25 bp, Mus musculus
caatgttttctatatgccacgttaa

SEQ ID NO: 301436 - DNA, 25 bp, Mus musculus
caatgttttgcaattctatgcttct

SEQ ID NO: 301437 - DNA, 25 bp, Mus musculus
caatgttttgcatttctatgcttct

SEQ ID NO: 301438 - DNA, 25 bp, Mus musculus
caatgttttggtccattctctttgt

SEQ ID NO: 301439 - DNA, 25 bp, Mus musculus
caatgttttggtgcattctctttgt

SEQ ID NO: 301440 - DNA, 25 bp, Mus musculus
caatgttttgtacagctatatgatc

SEQ ID NO: 301441 - DNA, 25 bp, Mus musculus
caatgttttgtagagctatatgatc

SEQ ID NO: 301442 - DNA, 25 bp, Mus musculus
caatgtttttgcaagtctgggtgac

SEQ ID NO: 301443 - DNA, 25 bp, Mus musculus
caatgtttttgctagtctgggtgac

SEQ ID NO: 301444 - DNA, 25 bp, Mus musculus
caattaaagctaacccagttctctc

SEQ ID NO: 301445 - DNA, 25 bp, Mus musculus
caattaaagctatcccagttctctc

SEQ ID NO: 301446 - DNA, 25 bp, Mus musculus
caattaaatgtcatgcttacagtgg

SEQ ID NO: 301447 - DNA, 25 bp, Mus musculus
caattaaatgtcttgcttacagtgg

SEQ ID NO: 301448 - DNA, 25 bp, Mus musculus
caattaaccattcttcacaggcaaa

SEQ ID NO: 301449 - DNA, 25 bp, Mus musculus
caattaaccattgttcacaggcaaa

SEQ ID NO: 301450 - DNA, 25 bp, Mus musculus
caattaagcactccctttcgtcttt

SEQ ID NO: 301451 - DNA, 25 bp, Mus musculus
caattaagcactgcctttcgtcttt

SEQ ID NO: 301452 - DNA, 25 bp, Mus musculus
caattaagtcgaagtgtgatgtgga

SEQ ID NO: 301453 - DNA, 25 bp, Mus musculus
caattaagtcgatgtgtgatgtgga

SEQ ID NO: 301454 - DNA, 25 bp, Mus musculus
caattaagtgtcattcaggctggag

SEQ ID NO: 301455 - DNA, 25 bp, Mus musculus
caattaagtgtctttcaggctggag

SEQ ID NO: 301456 - DNA, 25 bp, Mus musculus
caattaataattctggatgcctggt

SEQ ID NO: 301457 - DNA, 25 bp, Mus musculus
caattaataattgtggatgcctggt

SEQ ID NO: 301458 - DNA, 25 bp, Mus musculus
caattacacatacactcaaccatac

SEQ ID NO: 301459 - DNA, 25 bp, Mus musculus
caattacacatagactcaaccatac

SEQ ID NO: 301460 - DNA, 25 bp, Mus musculus
caattacatgctaggcctggagaga

SEQ ID NO: 301461 - DNA, 25 bp, Mus musculus
caattacatgctcacgtgctctgcc

SEQ ID NO: 301462 - DNA, 25 bp, Mus musculus
caattacatgctgacgtgctctgcc

SEQ ID NO: 301463 - DNA, 25 bp, Mus musculus
caattacatgcttggcctggagaga

SEQ ID NO: 301464 - DNA, 25 bp, Mus musculus
caattaccagcgatcccttgggact

SEQ ID NO: 301465 - DNA, 25 bp, Mus musculus
caattaccagcgttcccttgggact

SEQ ID NO: 301466 - DNA, 25 bp, Mus musculus
caattacgtttgcatgcatgtgcac

SEQ ID NO: 301467 - DNA, 25 bp, Mus musculus
caattacgtttggatgcatgtgcac

SEQ ID NO: 301468 - DNA, 25 bp, Mus musculus
caattactacaacttggcctgtgac

SEQ ID NO: 301469 - DNA, 25 bp, Mus musculus
caattactacaagttggcctgtgac

SEQ ID NO: 301470 - DNA, 25 bp, Mus musculus
caattactatctccctatggtagag

SEQ ID NO: 301471 - DNA, 25 bp, Mus musculus
caattactatctgcctatggtagag

SEQ ID NO: 301472 - DNA, 25 bp, Mus musculus
caattactctgaatgtggatgctgt

SEQ ID NO: 301473 - DNA, 25 bp, Mus musculus
caattactctgattgtggatgctgt

SEQ ID NO: 301474 - DNA, 25 bp, Mus musculus
caattacttgggatttttggcacct

SEQ ID NO: 301475 - DNA, 25 bp, Mus musculus
caattacttgggttttttggcacct

SEQ ID NO: 301476 - DNA, 25 bp, Mus musculus
caattactttccatgttaccatggt

SEQ ID NO: 301477 - DNA, 25 bp, Mus musculus
caattactttccttgttaccatggt

SEQ ID NO: 301478 - DNA, 25 bp, Mus musculus
caattagaatttaaggtcccaggat

SEQ ID NO: 301479 - DNA, 25 bp, Mus musculus
caattagaattttaggtcccaggat

SEQ ID NO: 301480 - DNA, 25 bp, Mus musculus
caattagatcctcattcacaagcaa

SEQ ID NO: 301481 - DNA, 25 bp, Mus musculus
caattagatcctgattcacaagcaa

SEQ ID NO: 301482 - DNA, 25 bp, Mus musculus
caattagcagaaacagtgtggactg

SEQ ID NO: 301483 - DNA, 25 bp, Mus musculus
caattagcagaatcagtgtggactg

SEQ ID NO: 301484 - DNA, 25 bp, Mus musculus
caattagggttgagtcctagcccag

SEQ ID NO: 301485 - DNA, 25 bp, Mus musculus
caattagggttgtgtcctagcccag

SEQ ID NO: 301486 - DNA, 25 bp, Mus musculus
caattagtcctaccaatatgcagtt

SEQ ID NO: 301487 - DNA, 25 bp, Mus musculus
caattagtcctagcaatatgcagtt

SEQ ID NO: 301488 - DNA, 25 bp, Mus musculus
caattagtgtccacttctcttcttg

SEQ ID NO: 301489 - DNA, 25 bp, Mus musculus
caattagtgtcctcttctcttcttg

SEQ ID NO: 301490 - DNA, 25 bp, Mus musculus
caattagttgcgctgtttggaacaa

SEQ ID NO: 301491 - DNA, 25 bp, Mus musculus
caattagttgcggtgtttggaacaa

SEQ ID NO: 301492 - DNA, 25 bp, Mus musculus
caattataagggaaggctcactgga

SEQ ID NO: 301493 - DNA, 25 bp, Mus musculus
caattataagggtaggctcactgga

SEQ ID NO: 301494 - DNA, 25 bp, Mus musculus
caattatacccaaccctgtgaattc

SEQ ID NO: 301495 - DNA, 25 bp, Mus musculus
caattatacccatccctgtgaattc

SEQ ID NO: 301496 - DNA, 25 bp, Mus musculus
caattatactgcagcaggaactgcc

SEQ ID NO: 301497 - DNA, 25 bp, Mus musculus
caattatactgctgcaggaactgcc

SEQ ID NO: 301498 - DNA, 25 bp, Mus musculus
caattatactggcatctgatgcttc

SEQ ID NO: 301499 - DNA, 25 bp, Mus musculus
caattatactgggatctgatgcttc

SEQ ID NO: 301500 - DNA, 25 bp, Mus musculus
caattatattccctgtctctctgga

SEQ ID NO: 301501 - DNA, 25 bp, Mus musculus
caattatattccgtgtctctctgga

SEQ ID NO: 301502 - DNA, 25 bp, Mus musculus
caattatcaaaactggcctgggcga

SEQ ID NO: 301503 - DNA, 25 bp, Mus musculus
caattatcaaaagtggcctgggcga

SEQ ID NO: 301504 - DNA, 25 bp, Mus musculus
caattatcactgcatgtcatctcct

SEQ ID NO: 301505 - DNA, 25 bp, Mus musculus
caattatcactggatgtcatctcct

SEQ ID NO: 301506 - DNA, 25 bp, Mus musculus
caattatctaatcccttccacaagg

SEQ ID NO: 301507 - DNA, 25 bp, Mus musculus
caattatctaatgccttccacaagg

SEQ ID NO: 301508 - DNA, 25 bp, Mus musculus
caattatctcagacactcctagtgg

SEQ ID NO: 301509 - DNA, 25 bp, Mus musculus
caattatctcagtcactcctagtgg

SEQ ID NO: 301510 - DNA, 25 bp, Mus musculus
caattatggtggacctattacccta

SEQ ID NO: 301511 - DNA, 25 bp, Mus musculus
caattatggtggtcctattacccta

SEQ ID NO: 301512 - DNA, 25 bp, Mus musculus
caattatggtgtatctgttcagtga

SEQ ID NO: 301513 - DNA, 25 bp, Mus musculus
caattatggtgtttctgttcagtga

SEQ ID NO: 301514 - DNA, 25 bp, Mus musculus
caattattctttatgtctgggaggt

SEQ ID NO: 301515 - DNA, 25 bp, Mus musculus
caattattctttttgtctgggaggt

SEQ ID NO: 301516 - DNA, 25 bp, Mus musculus
caattattgcttcaaccgccagtag

SEQ ID NO: 301517 - DNA, 25 bp, Mus musculus
caattattgcttgaaccgccagtag

SEQ ID NO: 301518 - DNA, 25 bp, Mus musculus
caattcaacaatctgagagagaaaa

SEQ ID NO: 301519 - DNA, 25 bp, Mus musculus
caattcaacaatgtgagagagaaaa

SEQ ID NO: 301520 - DNA, 25 bp, Mus musculus
caattcaagaacaaggcgggtcctc

SEQ ID NO: 301521 - DNA, 25 bp, Mus musculus
caattcaagaactaggcgggtcctc

SEQ ID NO: 301522 - DNA, 25 bp, Mus musculus
caattcacatttcttggcttcttca

SEQ ID NO: 301523 - DNA, 25 bp, Mus musculus
caattcacatttgttggcttcttca

SEQ ID NO: 301524 - DNA, 25 bp, Mus musculus
caattcagaaacatccccactcaga

SEQ ID NO: 301525 - DNA, 25 bp, Mus musculus
caattcagaaacttccccactcaga

SEQ ID NO: 301526 - DNA, 25 bp, Mus musculus
caattcagtcttccgattcctggtt

SEQ ID NO: 301527 - DNA, 25 bp, Mus musculus
caattcagtcttgcgattcctggtt

SEQ ID NO: 301528 - DNA, 25 bp, Mus musculus
caattcataagccaatcgagccgga

SEQ ID NO: 301529 - DNA, 25 bp, Mus musculus
caattcataagcgaatcgagccgga

SEQ ID NO: 301530 - DNA, 25 bp, Mus musculus
caattcatagttagtgtggtgccca

SEQ ID NO: 301531 - DNA, 25 bp, Mus musculus
caattcatagtttgtgtggtgccca

SEQ ID NO: 301532 - DNA, 25 bp, Mus musculus
caattcatcttaaaatgactggagt

SEQ ID NO: 301533 - DNA, 25 bp, Mus musculus
caattcatcttataatgactggagt

SEQ ID NO: 301534 - DNA, 25 bp, Mus musculus
caattcatttgcagtcagaccccaa

SEQ ID NO: 301535 - DNA, 25 bp, Mus musculus
caattcatttgctgtcagaccccaa

SEQ ID NO: 301536 - DNA, 25 bp, Mus musculus
caattcattttcctacagactaccc

SEQ ID NO: 301537 - DNA, 25 bp, Mus musculus
caattcattttcgtacagactaccc

SEQ ID NO: 301538 - DNA, 25 bp, Mus musculus
caattccaacagattaatgaagatc

SEQ ID NO: 301539 - DNA, 25 bp, Mus musculus
caattccaacagtttaatgaagatc

SEQ ID NO: 301540 - DNA, 25 bp, Mus musculus
caattccatgttactgctactttct

SEQ ID NO: 301541 - DNA, 25 bp, Mus musculus
caattccatgtttctgctactttct

SEQ ID NO: 301542 - DNA, 25 bp, Mus musculus
caattcccatatctggatataccat

SEQ ID NO: 301543 - DNA, 25 bp, Mus musculus
caattcccatatgtggatataccat

SEQ ID NO: 301544 - DNA, 25 bp, Mus musculus
caattcccctggacagagctgaatg

SEQ ID NO: 301545 - DNA, 25 bp, Mus musculus
caattcccctggtcagagctgaatg

SEQ ID NO: 301546 - DNA, 25 bp, Mus musculus
caattcccgaatattactgaggcaa

SEQ ID NO: 301547 - DNA, 25 bp, Mus musculus
caattcccgaattttactgaggcaa

SEQ ID NO: 301548 - DNA, 25 bp, Mus musculus
caattccctcttacattattcatgt

SEQ ID NO: 301549 - DNA, 25 bp, Mus musculus
caattccctctttcattattcatgt

SEQ ID NO: 301550 - DNA, 25 bp, Mus musculus
caattcctactgactgacacataca

SEQ ID NO: 301551 - DNA, 25 bp, Mus musculus
caattcctactgtctgacacataca

SEQ ID NO: 301552 - DNA, 25 bp, Mus musculus
caattcctagagacctagagaccca

SEQ ID NO: 301553 - DNA, 25 bp, Mus musculus
caattcctagagtcctagagaccca

SEQ ID NO: 301554 - DNA, 25 bp, Mus musculus
caattcctatttagtgggtgggatc

SEQ ID NO: 301555 - DNA, 25 bp, Mus musculus
caattcctattttgtgggtgggatc

SEQ ID NO: 301556 - DNA, 25 bp, Mus musculus
caattcctcacactggtaattaaat

SEQ ID NO: 301557 - DNA, 25 bp, Mus musculus
caattcctcacagtggtaattaaat

SEQ ID NO: 301558 - DNA, 25 bp, Mus musculus
caattccttcaaatagcttgcttaa

SEQ ID NO: 301559 - DNA, 25 bp, Mus musculus
caattccttcaattagcttgcttaa

SEQ ID NO: 301560 - DNA, 25 bp, Mus musculus
caattccttcagaacactagccaga

SEQ ID NO: 301561 - DNA, 25 bp, Mus musculus
caattccttcagtacactagccaga

SEQ ID NO: 301562 - DNA, 25 bp, Mus musculus
caattccttgagactttgtagaagt

SEQ ID NO: 301563 - DNA, 25 bp, Mus musculus
caattccttgagtctttgtagaagt

SEQ ID NO: 301564 - DNA, 25 bp, Mus musculus
caattccttgttcacatctctgagg

SEQ ID NO: 301565 - DNA, 25 bp, Mus musculus
caattccttgttgacatctctgagg

SEQ ID NO: 301566 - DNA, 25 bp, Mus musculus
caattcctttggctgctaaacaccc

SEQ ID NO: 301567 - DNA, 25 bp, Mus musculus
caattcctttgggtgctaaacaccc

SEQ ID NO: 301568 - DNA, 25 bp, Mus musculus
caattcggaatcctgctcttttcaa

SEQ ID NO: 301569 - DNA, 25 bp, Mus musculus
caattcggaatcgtgctcttttcaa

SEQ ID NO: 301570 - DNA, 25 bp, Mus musculus
caattcggtcaaatgtcactgtcat

SEQ ID NO: 301571 - DNA, 25 bp, Mus musculus
caattcggtcaattgtcactgtcat

SEQ ID NO: 301572 - DNA, 25 bp, Mus musculus
caattcggtgaaattccctgagcca

SEQ ID NO: 301573 - DNA, 25 bp, Mus musculus
caattcggtgaatttccctgagcca

SEQ ID NO: 301574 - DNA, 25 bp, Mus musculus
caattcggtgataacttgcttttcc

SEQ ID NO: 301575 - DNA, 25 bp, Mus musculus
caattcggtgattacttgcttttcc

SEQ ID NO: 301576 - DNA, 25 bp, Mus musculus
caattcggtgtcagagagcctatca

SEQ ID NO: 301577 - DNA, 25 bp, Mus musculus
caattcggtgtctgagagcctatca

SEQ ID NO: 301578 - DNA, 25 bp, Mus musculus
caattcgtgatactctctcttggtg

SEQ ID NO: 301579 - DNA, 25 bp, Mus musculus
caattcgtgatagtctctcttggtg

SEQ ID NO: 301580 - DNA, 25 bp, Mus musculus
caattcgtttgtaaatccctttctg

SEQ ID NO: 301581 - DNA, 25 bp, Mus musculus
caattcgtttgttaatccctttctg

SEQ ID NO: 301582 - DNA, 25 bp, Mus musculus
caattctaatgtatgtttactcaaa

SEQ ID NO: 301583 - DNA, 25 bp, Mus musculus
caattctaatgtttgtttactcaaa

SEQ ID NO: 301584 - DNA, 25 bp, Mus musculus
caattctacatcacactacaggcag

SEQ ID NO: 301585 - DNA, 25 bp, Mus musculus
caattctacatctcactacaggcag

SEQ ID NO: 301586 - DNA, 25 bp, Mus musculus
caattctagcacaacatggtgctca

SEQ ID NO: 301587 - DNA, 25 bp, Mus musculus
caattctagcactacatggtgctca

SEQ ID NO: 301588 - DNA, 25 bp, Mus musculus
caattctagcttacttttgtgcaat

SEQ ID NO: 301589 - DNA, 25 bp, Mus musculus
caattctagctttcttttgtgcaat

SEQ ID NO: 301590 - DNA, 25 bp, Mus musculus
caattctagtttagcccctactggt

SEQ ID NO: 301591 - DNA, 25 bp, Mus musculus
caattctagttttgcccctactggt

SEQ ID NO: 301592 - DNA, 25 bp, Mus musculus
caattctattggcacacccttggac

SEQ ID NO: 301593 - DNA, 25 bp, Mus musculus
caattctattgggacacccttggac

SEQ ID NO: 301594 - DNA, 25 bp, Mus musculus
caattctcagcacccgcatacatgg

SEQ ID NO: 301595 - DNA, 25 bp, Mus musculus
caattctcagcagccgcatacatgg

SEQ ID NO: 301596 - DNA, 25 bp, Mus musculus
caattctcatcccattctctgggag

SEQ ID NO: 301597 - DNA, 25 bp, Mus musculus
caattctcatccgattctctgggag

SEQ ID NO: 301598 - DNA, 25 bp, Mus musculus
caattctcccatatccctaattgaa

SEQ ID NO: 301599 - DNA, 25 bp, Mus musculus
caattctcccatttccctaattgaa

SEQ ID NO: 301600 - DNA, 25 bp, Mus musculus
caattctgcattaaaattctcatgt

SEQ ID NO: 301601 - DNA, 25 bp, Mus musculus
caattctgcatttaaattctcatgt

SEQ ID NO: 301602 - DNA, 25 bp, Mus musculus
caattctggagaagcgtaaaataac

SEQ ID NO: 301603 - DNA, 25 bp, Mus musculus
caattctggagatgcgtaaaataac

SEQ ID NO: 301604 - DNA, 25 bp, Mus musculus
caattctggattctctgggctgaag

SEQ ID NO: 301605 - DNA, 25 bp, Mus musculus
caattctggattgtctgggctgaag

SEQ ID NO: 301606 - DNA, 25 bp, Mus musculus
caattctggcagcagatttacatga

SEQ ID NO: 301607 - DNA, 25 bp, Mus musculus
caattctggcaggagatttacatga

SEQ ID NO: 301608 - DNA, 25 bp, Mus musculus
caattctgggtgcagacggaaacca

SEQ ID NO: 301609 - DNA, 25 bp, Mus musculus
caattctgggtggagacggaaacca

SEQ ID NO: 301610 - DNA, 25 bp, Mus musculus
caattctgtaaaatttgtgctactt

SEQ ID NO: 301611 - DNA, 25 bp, Mus musculus
caattctgtaaattttgtgctactt

SEQ ID NO: 301612 - DNA, 25 bp, Mus musculus
caattctgtgtgctgatggagccat

SEQ ID NO: 301613 - DNA, 25 bp, Mus musculus
caattctgtgtggtgatggagccat

SEQ ID NO: 301614 - DNA, 25 bp, Mus musculus
caattcttaatgatgccagcaggta

SEQ ID NO: 301615 - DNA, 25 bp, Mus musculus
caattcttaatgttgccagcaggta

SEQ ID NO: 301616 - DNA, 25 bp, Mus musculus
caattcttagtcaagtgtttgaagt

SEQ ID NO: 301617 - DNA, 25 bp, Mus musculus
caattcttagtctagtgtttgaagt

SEQ ID NO: 301618 - DNA, 25 bp, Mus musculus
caattcttagttccctacccagtat

SEQ ID NO: 301619 - DNA, 25 bp, Mus musculus
caattcttagttgcctacccagtat

SEQ ID NO: 301620 - DNA, 25 bp, Mus musculus
caattcttattgatgtctgtcttaa

SEQ ID NO: 301621 - DNA, 25 bp, Mus musculus
caattcttattgttgtctgtcttaa

SEQ ID NO: 301622 - DNA, 25 bp, Mus musculus
caattcttcccacagctgctatagg

SEQ ID NO: 301623 - DNA, 25 bp, Mus musculus
caattcttcccacttagttgctaac

SEQ ID NO: 301624 - DNA, 25 bp, Mus musculus
caattcttcccagagctgctatagg

SEQ ID NO: 301625 - DNA, 25 bp, Mus musculus
caattcttcccagttagttgctaac

SEQ ID NO: 301626 - DNA, 25 bp, Mus musculus
caattcttccctaatcagaacgaaa

SEQ ID NO: 301627 - DNA, 25 bp, Mus musculus
caattcttcccttatcagaacgaaa

SEQ ID NO: 301628 - DNA, 25 bp, Mus musculus
caattcttcttccttcattaaatag

SEQ ID NO: 301629 - DNA, 25 bp, Mus musculus
caattcttcttcgttcattaaatag

SEQ ID NO: 301630 - DNA, 25 bp, Mus musculus
caattcttgaacacagtggctatct

SEQ ID NO: 301631 - DNA, 25 bp, Mus musculus
caattcttgaactcagtggctatct

SEQ ID NO: 301632 - DNA, 25 bp, Mus musculus
caattcttgactaaacttcaccctt

SEQ ID NO: 301633 - DNA, 25 bp, Mus musculus
caattcttgacttaacttcaccctt

SEQ ID NO: 301634 - DNA, 25 bp, Mus musculus
caattctttctcagcgggtgagtga

SEQ ID NO: 301635 - DNA, 25 bp, Mus musculus
caattctttctctgcgggtgagtga

SEQ ID NO: 301636 - DNA, 25 bp, Mus musculus
caattctttgtacagatgctccaag

SEQ ID NO: 301637 - DNA, 25 bp, Mus musculus
caattctttgtagagatgctccaag

SEQ ID NO: 301638 - DNA, 25 bp, Mus musculus
caattcttttaacggcactcttcaa

SEQ ID NO: 301639 - DNA, 25 bp, Mus musculus
caattcttttaagggcactcttcaa

SEQ ID NO: 301640 - DNA, 25 bp, Mus musculus
caattctttttaaactgctggattt

SEQ ID NO: 301641 - DNA, 25 bp, Mus musculus
caattctttttatactgctggattt

SEQ ID NO: 301642 - DNA, 25 bp, Mus musculus
caattgataagcaggacctctcacc

SEQ ID NO: 301643 - DNA, 25 bp, Mus musculus
caattgataagctggacctctcacc

SEQ ID NO: 301644 - DNA, 25 bp, Mus musculus
caattgcactgcatatgttatagaa

SEQ ID NO: 301645 - DNA, 25 bp, Mus musculus
caattgcactgcttatgttatagaa

SEQ ID NO: 301646 - DNA, 25 bp, Mus musculus
caattgcagctcatgtccgtgggtg

SEQ ID NO: 301647 - DNA, 25 bp, Mus musculus
caattgcagctcttgtccgtgggtg

SEQ ID NO: 301648 - DNA, 25 bp, Mus musculus
caattgcagtggaggtattgccaac

SEQ ID NO: 301649 - DNA, 25 bp, Mus musculus
caattgcagtggtggtattgccaac

SEQ ID NO: 301650 - DNA, 25 bp, Mus musculus
caattgcctttgaatcttcgtatga

SEQ ID NO: 301651 - DNA, 25 bp, Mus musculus
caattgcctttgtatcttcgtatga

SEQ ID NO: 301652 - DNA, 25 bp, Mus musculus
caattgcgggcacttgagtttaatt

SEQ ID NO: 301653 - DNA, 25 bp, Mus musculus
caattgcgggcagttgagtttaatt

SEQ ID NO: 301654 - DNA, 25 bp, Mus musculus
caattgcgggttactttaggttcag

SEQ ID NO: 301655 - DNA, 25 bp, Mus musculus
caattgcgggtttctttaggttcag

SEQ ID NO: 301656 - DNA, 25 bp, Mus musculus
caattgctggtgcaagcttaatcag

SEQ ID NO: 301657 - DNA, 25 bp, Mus musculus
caattgctggtggaagcttaatcag

SEQ ID NO: 301658 - DNA, 25 bp, Mus musculus
caattgctttttagtctgtgagaca

SEQ ID NO: 301659 - DNA, 25 bp, Mus musculus
caattgcttttttgtctgtgagaca

SEQ ID NO: 301660 - DNA, 25 bp, Mus musculus
caattggaagtgaactggtattttg

SEQ ID NO: 301661 - DNA, 25 bp, Mus musculus
caattggaagtgtactggtattttg

SEQ ID NO: 301662 - DNA, 25 bp, Mus musculus
caattggaggatcggctgcacctgt

SEQ ID NO: 301663 - DNA, 25 bp, Mus musculus
caattggaggatgggctgcacctgt

SEQ ID NO: 301664 - DNA, 25 bp, Mus musculus
caattggatcccatacctggatgga

SEQ ID NO: 301665 - DNA, 25 bp, Mus musculus
caattggatcccttacctggatgga

SEQ ID NO: 301666 - DNA, 25 bp, Mus musculus
caattggcaagcaagacgttcccat

SEQ ID NO: 301667 - DNA, 25 bp, Mus musculus
caattggcaagctagacgttcccat

SEQ ID NO: 301668 - DNA, 25 bp, Mus musculus
caattggcatctagacattcagctg

SEQ ID NO: 301669 - DNA, 25 bp, Mus musculus
caattggcatcttgacattcagctg

SEQ ID NO: 301670 - DNA, 25 bp, Mus musculus
caattggcccttagctagctgctgg

SEQ ID NO: 301671 - DNA, 25 bp, Mus musculus
caattggccctttgctagctgctgg

SEQ ID NO: 301672 - DNA, 25 bp, Mus musculus
caattggctttgacacgcagtgttg

SEQ ID NO: 301673 - DNA, 25 bp, Mus musculus
caattggctttgtcacgcagtgttg

SEQ ID NO: 301674 - DNA, 25 bp, Mus musculus
caattgggaccaagcttttttggca

SEQ ID NO: 301675 - DNA, 25 bp, Mus musculus
caattgggaccatgcttttttggca

SEQ ID NO: 301676 - DNA, 25 bp, Mus musculus
caattgggtattatcttcgtgcaaa

SEQ ID NO: 301677 - DNA, 25 bp, Mus musculus
caattgggtattttcttcgtgcaaa

SEQ ID NO: 301678 - DNA, 25 bp, Mus musculus
caattgggtcctccccatgtggtgt

SEQ ID NO: 301679 - DNA, 25 bp, Mus musculus
caattgggtcctgcccatgtggtgt

SEQ ID NO: 301680 - DNA, 25 bp, Mus musculus
caattggtacagattcatggagtct

SEQ ID NO: 301681 - DNA, 25 bp, Mus musculus
caattggtacagtttcatggagtct

SEQ ID NO: 301682 - DNA, 25 bp, Mus musculus
caattggtacccacaactgaagagc

SEQ ID NO: 301683 - DNA, 25 bp, Mus musculus
caattggtaccctcaactgaagagc

SEQ ID NO: 301684 - DNA, 25 bp, Mus musculus
caattggtgtttatccgtctcaggt

SEQ ID NO: 301685 - DNA, 25 bp, Mus musculus
caattggtgtttttccgtctcaggt

SEQ ID NO: 301686 - DNA, 25 bp, Mus musculus
caattgtagatgagcgttccgggtg

SEQ ID NO: 301687 - DNA, 25 bp, Mus musculus
caattgtagatgtgcgttccgggtg

SEQ ID NO: 301688 - DNA, 25 bp, Mus musculus
caattgtatacaactcacgaaacca

SEQ ID NO: 301689 - DNA, 25 bp, Mus musculus
caattgtatacatctcacgaaacca

SEQ ID NO: 301690 - DNA, 25 bp, Mus musculus
caattgtcaaaacttcctcagtgtt

SEQ ID NO: 301691 - DNA, 25 bp, Mus musculus
caattgtcaaaagttcctcagtgtt

SEQ ID NO: 301692 - DNA, 25 bp, Mus musculus
caattgtcataaccttggtggtctg

SEQ ID NO: 301693 - DNA, 25 bp, Mus musculus
caattgtcataagcttggtggtctg

SEQ ID NO: 301694 - DNA, 25 bp, Mus musculus
caattgtcatgaattctgtgcaggg

SEQ ID NO: 301695 - DNA, 25 bp, Mus musculus
caattgtcatgatttctgtgcaggg

SEQ ID NO: 301696 - DNA, 25 bp, Mus musculus
caattgtgacacatgctctagaggc

SEQ ID NO: 301697 - DNA, 25 bp, Mus musculus
caattgtgacacttgctctagaggc

SEQ ID NO: 301698 - DNA, 25 bp, Mus musculus
caattgtgatctccctttcatacct

SEQ ID NO: 301699 - DNA, 25 bp, Mus musculus
caattgtgatctgcctttcatacct

SEQ ID NO: 301700 - DNA, 25 bp, Mus musculus
caattgtgccttcgcgccttgtctg

SEQ ID NO: 301701 - DNA, 25 bp, Mus musculus
caattgtgccttggcgccttgtctg

SEQ ID NO: 301702 - DNA, 25 bp, Mus musculus
caattgtgctggctggatggctaca

SEQ ID NO: 301703 - DNA, 25 bp, Mus musculus
caattgtgctgggtggatggctaca

SEQ ID NO: 301704 - DNA, 25 bp, Mus musculus
caattgtgtgatatccaggctgcct

SEQ ID NO: 301705 - DNA, 25 bp, Mus musculus
caattgtgtgatttccaggctgcct

SEQ ID NO: 301706 - DNA, 25 bp, Mus musculus
caattgttagccactgaattccagt

SEQ ID NO: 301707 - DNA, 25 bp, Mus musculus
caattgttagcctctgaattccagt

SEQ ID NO: 301708 - DNA, 25 bp, Mus musculus
caatttaaacacacattgggctgct

SEQ ID NO: 301709 - DNA, 25 bp, Mus musculus
caatttaaacactcattgggctgct

SEQ ID NO: 301710 - DNA, 25 bp, Mus musculus
caatttacattgacccttttcagtg

SEQ ID NO: 301711 - DNA, 25 bp, Mus musculus
caatttacattgtcccttttcagtg

SEQ ID NO: 301712 - DNA, 25 bp, Mus musculus
caatttaccgtaacactgacatagt

SEQ ID NO: 301713 - DNA, 25 bp, Mus musculus
caatttaccgtatcactgacatagt

SEQ ID NO: 301714 - DNA, 25 bp, Mus musculus
caatttacggccacaacgctttctt

SEQ ID NO: 301715 - DNA, 25 bp, Mus musculus
caatttacggcctcaacgctttctt

SEQ ID NO: 301716 - DNA, 25 bp, Mus musculus
caatttagaagcctttggtcctgta

SEQ ID NO: 301717 - DNA, 25 bp, Mus musculus
caatttagaagcgtttggtcctgta

SEQ ID NO: 301718 - DNA, 25 bp, Mus musculus
caatttaggctgcaagttcagaggt

SEQ ID NO: 301719 - DNA, 25 bp, Mus musculus
caatttaggctggaagttcagaggt

SEQ ID NO: 301720 - DNA, 25 bp, Mus musculus
caatttagtgacatgactccagaag

SEQ ID NO: 301721 - DNA, 25 bp, Mus musculus
caatttagtgacttgactccagaag

SEQ ID NO: 301722 - DNA, 25 bp, Mus musculus
caatttatggttcttttctcctctg

SEQ ID NO: 301723 - DNA, 25 bp, Mus musculus
caatttatggttgttttctcctctg

SEQ ID NO: 301724 - DNA, 25 bp, Mus musculus
caatttattatacgtgtcaggacag

SEQ ID NO: 301725 - DNA, 25 bp, Mus musculus
caatttattataggtgtcaggacag

SEQ ID NO: 301726 - DNA, 25 bp, Mus musculus
caatttcaaagcctccatcaatcaa

SEQ ID NO: 301727 - DNA, 25 bp, Mus musculus
caatttcaaagcgtccatcaatcaa

SEQ ID NO: 301728 - DNA, 25 bp, Mus musculus
caatttcacatacatcttttctgga

SEQ ID NO: 301729 - DNA, 25 bp, Mus musculus
caatttcacatagatcttttctgga

SEQ ID NO: 301730 - DNA, 25 bp, Mus musculus
caatttcactgacctttgctttcaa

SEQ ID NO: 301731 - DNA, 25 bp, Mus musculus
caatttcactgagctttgctttcaa

SEQ ID NO: 301732 - DNA, 25 bp, Mus musculus
caatttccaaatcgctgcctgatgc

SEQ ID NO: 301733 - DNA, 25 bp, Mus musculus
caatttccaaatggctgcctgatgc

SEQ ID NO: 301734 - DNA, 25 bp, Mus musculus
caatttccagaccagttttctcatt

SEQ ID NO: 301735 - DNA, 25 bp, Mus musculus
caatttccagacgagttttctcatt

SEQ ID NO: 301736 - DNA, 25 bp, Mus musculus
caatttccagtcacatgcagcatta

SEQ ID NO: 301737 - DNA, 25 bp, Mus musculus
caatttccagtctcatgcagcatta

SEQ ID NO: 301738 - DNA, 25 bp, Mus musculus
caatttccccaaactttgtgatata

SEQ ID NO: 301739 - DNA, 25 bp, Mus musculus
caatttccccaatctttgtgatata

SEQ ID NO: 301740 - DNA, 25 bp, Mus musculus
caatttccccacaaacacgatgaga

SEQ ID NO: 301741 - DNA, 25 bp, Mus musculus
caatttccccactaacacgatgaga

SEQ ID NO: 301742 - DNA, 25 bp, Mus musculus
caatttcctctcacagatccaagga

SEQ ID NO: 301743 - DNA, 25 bp, Mus musculus
caatttcctctctcagatccaagga

SEQ ID NO: 301744 - DNA, 25 bp, Mus musculus
caatttctactgattattcccatct

SEQ ID NO: 301745 - DNA, 25 bp, Mus musculus
caatttctactgtttattcccatct

SEQ ID NO: 301746 - DNA, 25 bp, Mus musculus
caatttctagcacccgtctgtaact

SEQ ID NO: 301747 - DNA, 25 bp, Mus musculus
caatttctagcagccgtctgtaact

SEQ ID NO: 301748 - DNA, 25 bp, Mus musculus
caatttctagttacacaggagcgtg

SEQ ID NO: 301749 - DNA, 25 bp, Mus musculus
caatttctagtttcacaggagcgtg

SEQ ID NO: 301750 - DNA, 25 bp, Mus musculus
caatttctcaaaagcatgggcaggt

SEQ ID NO: 301751 - DNA, 25 bp, Mus musculus
caatttctcaaatgcatgggcaggt

SEQ ID NO: 301752 - DNA, 25 bp, Mus musculus
caatttctcattcgatttctcagga

SEQ ID NO: 301753 - DNA, 25 bp, Mus musculus
caatttctcattctcaggttgaaca

SEQ ID NO: 301754 - DNA, 25 bp, Mus musculus
caatttctcattggatttctcagga

SEQ ID NO: 301755 - DNA, 25 bp, Mus musculus
caatttctcattgtcaggttgaaca

SEQ ID NO: 301756 - DNA, 25 bp, Mus musculus
caatttctgcaacttctctctaact

SEQ ID NO: 301757 - DNA, 25 bp, Mus musculus
caatttctgcaagttctctctaact

SEQ ID NO: 301758 - DNA, 25 bp, Mus musculus
caatttctggttactggaggcacta

SEQ ID NO: 301759 - DNA, 25 bp, Mus musculus
caatttctggtttctggaggcacta

SEQ ID NO: 301760 - DNA, 25 bp, Mus musculus
caatttcttagtccatttgggcctc

SEQ ID NO: 301761 - DNA, 25 bp, Mus musculus
caatttcttagtgcatttgggcctc

SEQ ID NO: 301762 - DNA, 25 bp, Mus musculus
caatttcttgccatttattgtaaat

SEQ ID NO: 301763 - DNA, 25 bp, Mus musculus
caatttcttgccttttattgtaaat

SEQ ID NO: 301764 - DNA, 25 bp, Mus musculus
caatttcttttgacaactcctcaga

SEQ ID NO: 301765 - DNA, 25 bp, Mus musculus
caatttcttttgtcaactcctcaga

SEQ ID NO: 301766 - DNA, 25 bp, Mus musculus
caatttgaacccatcaaccatttga

SEQ ID NO: 301767 - DNA, 25 bp, Mus musculus
caatttgaacccttcaaccatttga

SEQ ID NO: 301768 - DNA, 25 bp, Mus musculus
caatttgcaaccaagattcttccag

SEQ ID NO: 301769 - DNA, 25 bp, Mus musculus
caatttgcaacctagattcttccag

SEQ ID NO: 301770 - DNA, 25 bp, Mus musculus
caatttgcagggatttatgtcagcc

SEQ ID NO: 301771 - DNA, 25 bp, Mus musculus
caatttgcagggttttatgtcagcc

SEQ ID NO: 301772 - DNA, 25 bp, Mus musculus
caatttgccgagctgatgcttcaga

SEQ ID NO: 301773 - DNA, 25 bp, Mus musculus
caatttgccgaggtgatgcttcaga

SEQ ID NO: 301774 - DNA, 25 bp, Mus musculus
caatttggatcaacatggtttcaga

SEQ ID NO: 301775 - DNA, 25 bp, Mus musculus
caatttggatcatcatggtttcaga

SEQ ID NO: 301776 - DNA, 25 bp, Mus musculus
caatttggctgcatcctcagggaaa

SEQ ID NO: 301777 - DNA, 25 bp, Mus musculus
caatttggctgcttcctcagggaaa

SEQ ID NO: 301778 - DNA, 25 bp, Mus musculus
caatttgggaaaaatctgctgagag

SEQ ID NO: 301779 - DNA, 25 bp, Mus musculus
caatttgggaaatatctgctgagag

SEQ ID NO: 301780 - DNA, 25 bp, Mus musculus
caatttgggattcctcctgagggca

SEQ ID NO: 301781 - DNA, 25 bp, Mus musculus
caatttgggattgctcctgagggca

SEQ ID NO: 301782 - DNA, 25 bp, Mus musculus
caatttgggcttacagctctgtgca

SEQ ID NO: 301783 - DNA, 25 bp, Mus musculus
caatttgggctttcagctctgtgca

SEQ ID NO: 301784 - DNA, 25 bp, Mus musculus
caatttggtgtcatgcttctggctc

SEQ ID NO: 301785 - DNA, 25 bp, Mus musculus
caatttggtgtcttgcttctggctc

SEQ ID NO: 301786 - DNA, 25 bp, Mus musculus
caatttgtatctctattgggaggga

SEQ ID NO: 301787 - DNA, 25 bp, Mus musculus
caatttgtatctgtattgggaggga

SEQ ID NO: 301788 - DNA, 25 bp, Mus musculus
caatttgtcacaatttagagccctt

SEQ ID NO: 301789 - DNA, 25 bp, Mus musculus
caatttgtcacattttagagccctt

SEQ ID NO: 301790 - DNA, 25 bp, Mus musculus
caatttgtccccatgattaaaggtg

SEQ ID NO: 301791 - DNA, 25 bp, Mus musculus
caatttgtccccttgattaaaggtg

SEQ ID NO: 301792 - DNA, 25 bp, Mus musculus
caatttgtggaacatatgggaggca

SEQ ID NO: 301793 - DNA, 25 bp, Mus musculus
caatttgtggaagatatgggaggca

SEQ ID NO: 301794 - DNA, 25 bp, Mus musculus
caatttgtgttcaccttttttcata

SEQ ID NO: 301795 - DNA, 25 bp, Mus musculus
caatttgtgttctccttttttcata

SEQ ID NO: 301796 - DNA, 25 bp, Mus musculus
caattttacaatattctacttccgt

SEQ ID NO: 301797 - DNA, 25 bp, Mus musculus
caattttacaattttctacttccgt

SEQ ID NO: 301798 - DNA, 25 bp, Mus musculus
caattttacaccagtctggcatgga

SEQ ID NO: 301799 - DNA, 25 bp, Mus musculus
caattttacacctgtctggcatgga

SEQ ID NO: 301800 - DNA, 25 bp, Mus musculus
caattttaccttcctcttgtagcga

SEQ ID NO: 301801 - DNA, 25 bp, Mus musculus
caattttaccttgctcttgtagcga

SEQ ID NO: 301802 - DNA, 25 bp, Mus musculus
caattttactttctgctttgtgcac

SEQ ID NO: 301803 - DNA, 25 bp, Mus musculus
caattttactttgtgctttgtgcac

SEQ ID NO: 301804 - DNA, 25 bp, Mus musculus
caattttagcgtatttgtgatcatt

SEQ ID NO: 301805 - DNA, 25 bp, Mus musculus
caattttagcgtttttgtgatcatt

SEQ ID NO: 301806 - DNA, 25 bp, Mus musculus
caattttaggaactcacatgatgaa

SEQ ID NO: 301807 - DNA, 25 bp, Mus musculus
caattttaggaagtcacatgatgaa

SEQ ID NO: 301808 - DNA, 25 bp, Mus musculus
caattttcaagcactgtcattgaga

SEQ ID NO: 301809 - DNA, 25 bp, Mus musculus
caattttcaagctctgtcattgaga

SEQ ID NO: 301810 - DNA, 25 bp, Mus musculus
caattttcatttcgcttgtgttcat

SEQ ID NO: 301811 - DNA, 25 bp, Mus musculus
caattttcatttggcttgtgttcat

SEQ ID NO: 301812 - DNA, 25 bp, Mus musculus
caattttccttacactacctagtgg

SEQ ID NO: 301813 - DNA, 25 bp, Mus musculus
caattttccttagactacctagtgg

SEQ ID NO: 301814 - DNA, 25 bp, Mus musculus
caattttccttgagagctctttaga

SEQ ID NO: 301815 - DNA, 25 bp, Mus musculus
caattttccttgtgagctctttaga

SEQ ID NO: 301816 - DNA, 25 bp, Mus musculus
caattttcttccaagggccttcaca

SEQ ID NO: 301817 - DNA, 25 bp, Mus musculus
caattttcttcctagggccttcaca

SEQ ID NO: 301818 - DNA, 25 bp, Mus musculus
caattttgactaccttttgtgaggc

SEQ ID NO: 301819 - DNA, 25 bp, Mus musculus
caattttgactagcttttgtgaggc

SEQ ID NO: 301820 - DNA, 25 bp, Mus musculus
caattttgctacagtgagtctcaca

SEQ ID NO: 301821 - DNA, 25 bp, Mus musculus
caattttgctactgtgagtctcaca

SEQ ID NO: 301822 - DNA, 25 bp, Mus musculus
caattttgtacgcaagacattcttc

SEQ ID NO: 301823 - DNA, 25 bp, Mus musculus
caattttgtacggaagacattcttc

SEQ ID NO: 301824 - DNA, 25 bp, Mus musculus
caattttgtcctcgtgctgtctgct

SEQ ID NO: 301825 - DNA, 25 bp, Mus musculus
caattttgtcctggtgctgtctgct

SEQ ID NO: 301826 - DNA, 25 bp, Mus musculus
caattttgttctcggtgggcacatt

SEQ ID NO: 301827 - DNA, 25 bp, Mus musculus
caattttgttctgggtgggcacatt

SEQ ID NO: 301828 - DNA, 25 bp, Mus musculus
caatttttctgtagattataaatgc

SEQ ID NO: 301829 - DNA, 25 bp, Mus musculus
caatttttctgttgattataaatgc

SEQ ID NO: 301830 - DNA, 25 bp, Mus musculus
caattttttcttagcatgggtgttt

SEQ ID NO: 301831 - DNA, 25 bp, Mus musculus
caattttttctttgcatgggtgttt

SEQ ID NO: 301832 - DNA, 25 bp, Mus musculus
caattttttgatcgtcttcatttgt

SEQ ID NO: 301833 - DNA, 25 bp, Mus musculus
caattttttgatggtcttcatttgt

SEQ ID NO: 301834 - DNA, 25 bp, Mus musculus
caattttttgggatgttctggagac

SEQ ID NO: 301835 - DNA, 25 bp, Mus musculus
caattttttgggttgttctggagac

SEQ ID NO: 301836 - DNA, 25 bp, Mus musculus
cacaaaaatgcaactccagtgactt

SEQ ID NO: 301837 - DNA, 25 bp, Mus musculus
cacaaaaatgcatctccagtgactt

SEQ ID NO: 301838 - DNA, 25 bp, Mus musculus
cacaaaaatttcatcagggtcccag

SEQ ID NO: 301839 - DNA, 25 bp, Mus musculus
cacaaaaatttcttcagggtcccag

SEQ ID NO: 301840 - DNA, 25 bp, Mus musculus
cacaaaacaatcagctttgttggag

SEQ ID NO: 301841 - DNA, 25 bp, Mus musculus
cacaaaacaatctgctttgttggag

SEQ ID NO: 301842 - DNA, 25 bp, Mus musculus
cacaaaacagatatttcacctggga

SEQ ID NO: 301843 - DNA, 25 bp, Mus musculus
cacaaaacagatttttcacctggga

SEQ ID NO: 301844 - DNA, 25 bp, Mus musculus
cacaaaacaggtcgagtgggcggga

SEQ ID NO: 301845 - DNA, 25 bp, Mus musculus
cacaaaacaggtggagtgggcggga

SEQ ID NO: 301846 - DNA, 25 bp, Mus musculus
cacaaaacagtcatcttcataagca

SEQ ID NO: 301847 - DNA, 25 bp, Mus musculus
cacaaaacagtcttcttcataagca

SEQ ID NO: 301848 - DNA, 25 bp, Mus musculus
cacaaaacgtctatcagaaatgatt

SEQ ID NO: 301849 - DNA, 25 bp, Mus musculus
cacaaaacgtctttcagaaatgatt

SEQ ID NO: 301850 - DNA, 25 bp, Mus musculus
cacaaaactcttcaccttaaacact

SEQ ID NO: 301851 - DNA, 25 bp, Mus musculus
cacaaaactcttgaccttaaacact

SEQ ID NO: 301852 - DNA, 25 bp, Mus musculus
cacaaaacttgaaagggctctgcct

SEQ ID NO: 301853 - DNA, 25 bp, Mus musculus
cacaaaacttgatagggctctgcct

SEQ ID NO: 301854 - DNA, 25 bp, Mus musculus
cacaaaaggaaaccggtcctgccaa

SEQ ID NO: 301855 - DNA, 25 bp, Mus musculus
cacaaaaggaaagcggtcctgccaa

SEQ ID NO: 301856 - DNA, 25 bp, Mus musculus
cacaaaataccaaatcccaaatgat

SEQ ID NO: 301857 - DNA, 25 bp, Mus musculus
cacaaaataccatatcccaaatgat

SEQ ID NO: 301858 - DNA, 25 bp, Mus musculus
cacaaacaacctacacctgggcaag

SEQ ID NO: 301859 - DNA, 25 bp, Mus musculus
cacaaacaaccttcacctgggcaag

SEQ ID NO: 301860 - DNA, 25 bp, Mus musculus
cacaaacacccgctttctatagaag

SEQ ID NO: 301861 - DNA, 25 bp, Mus musculus
cacaaacacccggtttctatagaag

SEQ ID NO: 301862 - DNA, 25 bp, Mus musculus
cacaaaccatttcacctttcggagc

SEQ ID NO: 301863 - DNA, 25 bp, Mus musculus
cacaaaccatttgacctttcggagc

SEQ ID NO: 301864 - DNA, 25 bp, Mus musculus
cacaaaccccatcgagtcagagtct

SEQ ID NO: 301865 - DNA, 25 bp, Mus musculus
cacaaaccccatggagtcagagtct

SEQ ID NO: 301866 - DNA, 25 bp, Mus musculus
cacaaaccgggcaggatggctttat

SEQ ID NO: 301867 - DNA, 25 bp, Mus musculus
cacaaaccgggctggatggctttat

SEQ ID NO: 301868 - DNA, 25 bp, Mus musculus
cacaaaccttagagtgatcgcgttt

SEQ ID NO: 301869 - DNA, 25 bp, Mus musculus
cacaaaccttagtgtgatcgcgttt

SEQ ID NO: 301870 - DNA, 25 bp, Mus musculus
cacaaaccttgtattaagaacctag

SEQ ID NO: 301871 - DNA, 25 bp, Mus musculus
cacaaaccttgttttaagaacctag

SEQ ID NO: 301872 - DNA, 25 bp, Mus musculus
cacaaacgaaacctgactaccctgt

SEQ ID NO: 301873 - DNA, 25 bp, Mus musculus
cacaaacgaaacgtgactaccctgt

SEQ ID NO: 301874 - DNA, 25 bp, Mus musculus
cacaaacgacgcagatggaaatgat

SEQ ID NO: 301875 - DNA, 25 bp, Mus musculus
cacaaacgacgctgatggaaatgat

SEQ ID NO: 301876 - DNA, 25 bp, Mus musculus
cacaaacgccgacgtattgctctga

SEQ ID NO: 301877 - DNA, 25 bp, Mus musculus
cacaaacgccgaggtattgctctga

SEQ ID NO: 301878 - DNA, 25 bp, Mus musculus
cacaaactcagtccatcggtccatg

SEQ ID NO: 301879 - DNA, 25 bp, Mus musculus
cacaaactcagtgcatcggtccatg

SEQ ID NO: 301880 - DNA, 25 bp, Mus musculus
cacaaactggctactgacaagaatg

SEQ ID NO: 301881 - DNA, 25 bp, Mus musculus
cacaaactggcttctgacaagaatg

SEQ ID NO: 301882 - DNA, 25 bp, Mus musculus
cacaaactgtagagttccaagacct

SEQ ID NO: 301883 - DNA, 25 bp, Mus musculus
cacaaactgtagtgttccaagacct

SEQ ID NO: 301884 - DNA, 25 bp, Mus musculus
cacaaacttactagcgggtcggcgg

SEQ ID NO: 301885 - DNA, 25 bp, Mus musculus
cacaaacttacttgcgggtcggcgg

SEQ ID NO: 301886 - DNA, 25 bp, Mus musculus
cacaaacttcagcttttcatcaaaa

SEQ ID NO: 301887 - DNA, 25 bp, Mus musculus
cacaaacttcaggttttcatcaaaa

SEQ ID NO: 301888 - DNA, 25 bp, Mus musculus
cacaaagacctgattagctgcctag

SEQ ID NO: 301889 - DNA, 25 bp, Mus musculus
cacaaagacctgtttagctgcctag

SEQ ID NO: 301890 - DNA, 25 bp, Mus musculus
cacaaagatcccatctcgcaaaaat

SEQ ID NO: 301891 - DNA, 25 bp, Mus musculus
cacaaagatcccttctcgcaaaaat

SEQ ID NO: 301892 - DNA, 25 bp, Mus musculus
cacaaagatgtgatctgttcaactt

SEQ ID NO: 301893 - DNA, 25 bp, Mus musculus
cacaaagatgtgttctgttcaactt

SEQ ID NO: 301894 - DNA, 25 bp, Mus musculus
cacaaagattcgagctggagaatgg

SEQ ID NO: 301895 - DNA, 25 bp, Mus musculus
cacaaagattcgtgctggagaatgg

SEQ ID NO: 301896 - DNA, 25 bp, Mus musculus
cacaaagcaactactgggaattcag

SEQ ID NO: 301897 - DNA, 25 bp, Mus musculus
cacaaagcaacttctgggaattcag

SEQ ID NO: 301898 - DNA, 25 bp, Mus musculus
cacaaagccatgctattccttgagt

SEQ ID NO: 301899 - DNA, 25 bp, Mus musculus
cacaaagccatggtattccttgagt

SEQ ID NO: 301900 - DNA, 25 bp, Mus musculus
cacaaagccgctcccaaagtttatt

SEQ ID NO: 301901 - DNA, 25 bp, Mus musculus
cacaaagccgctgccaaagtttatt

SEQ ID NO: 301902 - DNA, 25 bp, Mus musculus
cacaaagctggtcacataaccgaat

SEQ ID NO: 301903 - DNA, 25 bp, Mus musculus
cacaaagctggtgacataaccgaat

SEQ ID NO: 301904 - DNA, 25 bp, Mus musculus
cacaaaggctcacggtgtgctgcag

SEQ ID NO: 301905 - DNA, 25 bp, Mus musculus
cacaaaggctcagggtgtgctgcag

SEQ ID NO: 301906 - DNA, 25 bp, Mus musculus
cacaaaggcttcagtttatgctgca

SEQ ID NO: 301907 - DNA, 25 bp, Mus musculus
cacaaaggcttctgtttatgctgca

SEQ ID NO: 301908 - DNA, 25 bp, Mus musculus
cacaaagggctccacccaagaggaa

SEQ ID NO: 301909 - DNA, 25 bp, Mus musculus
cacaaagggctcgacccaagaggaa

SEQ ID NO: 301910 - DNA, 25 bp, Mus musculus
cacaaaggtagcagctgtgcagctt

SEQ ID NO: 301911 - DNA, 25 bp, Mus musculus
cacaaaggtagctgctgtgcagctt

SEQ ID NO: 301912 - DNA, 25 bp, Mus musculus
cacaaagtcttgaagcagaacagat

SEQ ID NO: 301913 - DNA, 25 bp, Mus musculus
cacaaagtcttgtagcagaacagat

SEQ ID NO: 301914 - DNA, 25 bp, Mus musculus
cacaaagtgaatctttatcctggtg

SEQ ID NO: 301915 - DNA, 25 bp, Mus musculus
cacaaagtgaatgtttatcctggtg

SEQ ID NO: 301916 - DNA, 25 bp, Mus musculus
cacaaagtgatgaattcctggagat

SEQ ID NO: 301917 - DNA, 25 bp, Mus musculus
cacaaagtgatgtattcctggagat

SEQ ID NO: 301918 - DNA, 25 bp, Mus musculus
cacaaatactgtaagctgtcctgct

SEQ ID NO: 301919 - DNA, 25 bp, Mus musculus
cacaaatactgttagctgtcctgct

SEQ ID NO: 301920 - DNA, 25 bp, Mus musculus
cacaaatcattgctttctaaaattt

SEQ ID NO: 301921 - DNA, 25 bp, Mus musculus
cacaaatcattggtttctaaaattt

SEQ ID NO: 301922 - DNA, 25 bp, Mus musculus
cacaaatctctgccaccaaagggga

SEQ ID NO: 301923 - DNA, 25 bp, Mus musculus
cacaaatctctggcaccaaagggga

SEQ ID NO: 301924 - DNA, 25 bp, Mus musculus
cacaaatgcatccaaggacaggcgt

SEQ ID NO: 301925 - DNA, 25 bp, Mus musculus
cacaaatgcatcgaaggacaggcgt

SEQ ID NO: 301926 - DNA, 25 bp, Mus musculus
cacaaatgctccagctatgtaacag

SEQ ID NO: 301927 - DNA, 25 bp, Mus musculus
cacaaatgctcctgctatgtaacag

SEQ ID NO: 301928 - DNA, 25 bp, Mus musculus
cacaaatggagcagccagggccttg

SEQ ID NO: 301929 - DNA, 25 bp, Mus musculus
cacaaatggagcctttagagagcaa

SEQ ID NO: 301930 - DNA, 25 bp, Mus musculus
cacaaatggagcgtttagagagcaa

SEQ ID NO: 301931 - DNA, 25 bp, Mus musculus
cacaaatggagctgccagggccttg

SEQ ID NO: 301932 - DNA, 25 bp, Mus musculus
cacaaatgggatctacttttaaaca

SEQ ID NO: 301933 - DNA, 25 bp, Mus musculus
cacaaatgggatgtacttttaaaca

SEQ ID NO: 301934 - DNA, 25 bp, Mus musculus
cacaaatgggcactgagaggaagat

SEQ ID NO: 301935 - DNA, 25 bp, Mus musculus
cacaaatgggcagtgagaggaagat

SEQ ID NO: 301936 - DNA, 25 bp, Mus musculus
cacaaatgtaacctttcaacttggg

SEQ ID NO: 301937 - DNA, 25 bp, Mus musculus
cacaaatgtaacgtttcaacttggg

SEQ ID NO: 301938 - DNA, 25 bp, Mus musculus
cacaaatgtcccatattccgtggtt

SEQ ID NO: 301939 - DNA, 25 bp, Mus musculus
cacaaatgtcccttattccgtggtt

SEQ ID NO: 301940 - DNA, 25 bp, Mus musculus
cacaaatgtgttccttgctcaaggt

SEQ ID NO: 301941 - DNA, 25 bp, Mus musculus
cacaaatgtgttgcttgctcaaggt

SEQ ID NO: 301942 - DNA, 25 bp, Mus musculus
cacaaattatgcactgggaacgaca

SEQ ID NO: 301943 - DNA, 25 bp, Mus musculus
cacaaattatgctctgggaacgaca

SEQ ID NO: 301944 - DNA, 25 bp, Mus musculus
cacaaattcatcatttgaaatcttc

SEQ ID NO: 301945 - DNA, 25 bp, Mus musculus
cacaaattcatcttttgaaatcttc

SEQ ID NO: 301946 - DNA, 25 bp, Mus musculus
cacaacaacactacagccactaggg

SEQ ID NO: 301947 - DNA, 25 bp, Mus musculus
cacaacaacacttcagccactaggg

SEQ ID NO: 301948 - DNA, 25 bp, Mus musculus
cacaacaatgatacccagcacatct

SEQ ID NO: 301949 - DNA, 25 bp, Mus musculus
cacaacaatgattcccagcacatct

SEQ ID NO: 301950 - DNA, 25 bp, Mus musculus
cacaacaattccaatgcctaaaacc

SEQ ID NO: 301951 - DNA, 25 bp, Mus musculus
cacaacaattcctatgcctaaaacc

SEQ ID NO: 301952 - DNA, 25 bp, Mus musculus
cacaacaattgcagtcagggaagcc

SEQ ID NO: 301953 - DNA, 25 bp, Mus musculus
cacaacaattgctgtcagggaagcc

SEQ ID NO: 301954 - DNA, 25 bp, Mus musculus
cacaacagctgtattaggcactaac

SEQ ID NO: 301955 - DNA, 25 bp, Mus musculus
cacaacagctgttttaggcactaac

SEQ ID NO: 301956 - DNA, 25 bp, Mus musculus
cacaacaggttcacatacttcaagg

SEQ ID NO: 301957 - DNA, 25 bp, Mus musculus
cacaacaggttctcatacttcaagg

SEQ ID NO: 301958 - DNA, 25 bp, Mus musculus
cacaacagtatgctggctgaggaat

SEQ ID NO: 301959 - DNA, 25 bp, Mus musculus
cacaacagtatggtggctgaggaat

SEQ ID NO: 301960 - DNA, 25 bp, Mus musculus
cacaacagtctacggctggcgagat

SEQ ID NO: 301961 - DNA, 25 bp, Mus musculus
cacaacagtctagggctggcgagat

SEQ ID NO: 301962 - DNA, 25 bp, Mus musculus
cacaacatccggctatttgaaaaac

SEQ ID NO: 301963 - DNA, 25 bp, Mus musculus
cacaacatccgggtatttgaaaaac

SEQ ID NO: 301964 - DNA, 25 bp, Mus musculus
cacaacatgcacatagatcctacac

SEQ ID NO: 301965 - DNA, 25 bp, Mus musculus
cacaacatgcacttagatcctacac

SEQ ID NO: 301966 - DNA, 25 bp, Mus musculus
cacaacatgcccaacagtcaatacg

SEQ ID NO: 301967 - DNA, 25 bp, Mus musculus
cacaacatgccctacagtcaatacg

SEQ ID NO: 301968 - DNA, 25 bp, Mus musculus
cacaacattctgaagtttttcggcc

SEQ ID NO: 301969 - DNA, 25 bp, Mus musculus
cacaacattctgtagtttttcggcc

SEQ ID NO: 301970 - DNA, 25 bp, Mus musculus
cacaaccaaacaaacttcagctcat

SEQ ID NO: 301971 - DNA, 25 bp, Mus musculus
cacaaccaaacatacttcagctcat

SEQ ID NO: 301972 - DNA, 25 bp, Mus musculus
cacaaccaacacaatttgccctgat

SEQ ID NO: 301973 - DNA, 25 bp, Mus musculus
cacaaccaacactatttgccctgat

SEQ ID NO: 301974 - DNA, 25 bp, Mus musculus
cacaaccaatcaagtaggagctctg

SEQ ID NO: 301975 - DNA, 25 bp, Mus musculus
cacaaccaatcatgtaggagctctg

SEQ ID NO: 301976 - DNA, 25 bp, Mus musculus
cacaaccacataaagaactctgccg

SEQ ID NO: 301977 - DNA, 25 bp, Mus musculus
cacaaccacatatagaactctgccg

SEQ ID NO: 301978 - DNA, 25 bp, Mus musculus
cacaaccagaacctttggcctaagt

SEQ ID NO: 301979 - DNA, 25 bp, Mus musculus
cacaaccagaacgtttggcctaagt

SEQ ID NO: 301980 - DNA, 25 bp, Mus musculus
cacaaccagagaaccagagccaaag

SEQ ID NO: 301981 - DNA, 25 bp, Mus musculus
cacaaccagagatccagagccaaag

SEQ ID NO: 301982 - DNA, 25 bp, Mus musculus
cacaaccccactactaggagtattt

SEQ ID NO: 301983 - DNA, 25 bp, Mus musculus
cacaaccccacttctaggagtattt

SEQ ID NO: 301984 - DNA, 25 bp, Mus musculus
cacaacctagaaacacctggaattt

SEQ ID NO: 301985 - DNA, 25 bp, Mus musculus
cacaacctagaaaggcacccttttg

SEQ ID NO: 301986 - DNA, 25 bp, Mus musculus
cacaacctagaatcacctggaattt

SEQ ID NO: 301987 - DNA, 25 bp, Mus musculus
cacaacctagaatggcacccttttg

SEQ ID NO: 301988 - DNA, 25 bp, Mus musculus
cacaacctggatatccttcaccttt

SEQ ID NO: 301989 - DNA, 25 bp, Mus musculus
cacaacctggatttccttcaccttt

SEQ ID NO: 301990 - DNA, 25 bp, Mus musculus
cacaacctgtagagcactagcaatt

SEQ ID NO: 301991 - DNA, 25 bp, Mus musculus
cacaacctgtagtgcactagcaatt

SEQ ID NO: 301992 - DNA, 25 bp, Mus musculus
cacaacctgttaaccaactctacat

SEQ ID NO: 301993 - DNA, 25 bp, Mus musculus
cacaacctgttatccaactctacat

SEQ ID NO: 301994 - DNA, 25 bp, Mus musculus
cacaacctgttcaacttgacctcag

SEQ ID NO: 301995 - DNA, 25 bp, Mus musculus
cacaacctgttctacttgacctcag

SEQ ID NO: 301996 - DNA, 25 bp, Mus musculus
cacaaccttctaaaactgtggtccc

SEQ ID NO: 301997 - DNA, 25 bp, Mus musculus
cacaaccttctataactgtggtccc

SEQ ID NO: 301998 - DNA, 25 bp, Mus musculus
cacaaccttttgatcctggagcatg

SEQ ID NO: 301999 - DNA, 25 bp, Mus musculus
cacaaccttttgttcctggagcatg

SEQ ID NO: 302000 - DNA, 25 bp, Mus musculus
cacaacggtaccatcagaactgctt

SEQ ID NO: 302001 - DNA, 25 bp, Mus musculus
cacaacggtaccttcagaactgctt

SEQ ID NO: 302002 - DNA, 25 bp, Mus musculus
cacaacggtgacaggtagctgggac

SEQ ID NO: 302003 - DNA, 25 bp, Mus musculus
cacaacggtgactggtagctgggac

SEQ ID NO: 302004 - DNA, 25 bp, Mus musculus
cacaactaaaagctccagtgccagg

SEQ ID NO: 302005 - DNA, 25 bp, Mus musculus
cacaactaaaaggtccagtgccagg

SEQ ID NO: 302006 - DNA, 25 bp, Mus musculus
cacaactcctaaagctgtcagctaa

SEQ ID NO: 302007 - DNA, 25 bp, Mus musculus
cacaactcctaatgctgtcagctaa

SEQ ID NO: 302008 - DNA, 25 bp, Mus musculus
cacaactctctcagtggtcattgga

SEQ ID NO: 302009 - DNA, 25 bp, Mus musculus
cacaactctctctgtggtcattgga

SEQ ID NO: 302010 - DNA, 25 bp, Mus musculus
cacaactgaaccagcagctggatta

SEQ ID NO: 302011 - DNA, 25 bp, Mus musculus
cacaactgaacctgcagctggatta

SEQ ID NO: 302012 - DNA, 25 bp, Mus musculus
cacaactgaatgaactccaacgagt

SEQ ID NO: 302013 - DNA, 25 bp, Mus musculus
cacaactgaatgtactccaacgagt

SEQ ID NO: 302014 - DNA, 25 bp, Mus musculus
cacaactgagaaccactacattagt

SEQ ID NO: 302015 - DNA, 25 bp, Mus musculus
cacaactgagaagcactacattagt

SEQ ID NO: 302016 - DNA, 25 bp, Mus musculus
cacaactggaaaagctcaagaacca

SEQ ID NO: 302017 - DNA, 25 bp, Mus musculus
cacaactggaaatgctcaagaacca

SEQ ID NO: 302018 - DNA, 25 bp, Mus musculus
cacaactggtgacagagaagccctt

SEQ ID NO: 302019 - DNA, 25 bp, Mus musculus
cacaactggtgagagagaagccctt

SEQ ID NO: 302020 - DNA, 25 bp, Mus musculus
cacaactgttcgagaatttaagttt

SEQ ID NO: 302021 - DNA, 25 bp, Mus musculus
cacaactgttcgtgaatttaagttt

SEQ ID NO: 302022 - DNA, 25 bp, Mus musculus
cacaacttgcctacatcattttctt

SEQ ID NO: 302023 - DNA, 25 bp, Mus musculus
cacaacttgccttcatcattttctt

SEQ ID NO: 302024 - DNA, 25 bp, Mus musculus
cacaacttggttcatatgcctaaaa

SEQ ID NO: 302025 - DNA, 25 bp, Mus musculus
cacaacttggttgatatgcctaaaa

SEQ ID NO: 302026 - DNA, 25 bp, Mus musculus
cacaacttttgcagaggtgggaaga

SEQ ID NO: 302027 - DNA, 25 bp, Mus musculus
cacaacttttgctgaggtgggaaga

SEQ ID NO: 302028 - DNA, 25 bp, Mus musculus
cacaagaagcagccctgggatcttc

SEQ ID NO: 302029 - DNA, 25 bp, Mus musculus
cacaagaagcaggcctgggatcttc

SEQ ID NO: 302030 - DNA, 25 bp, Mus musculus
cacaagacagtgatgggccgacaga

SEQ ID NO: 302031 - DNA, 25 bp, Mus musculus
cacaagacagtgttgggccgacaga

SEQ ID NO: 302032 - DNA, 25 bp, Mus musculus
cacaagacgacacccaagtgaccaa

SEQ ID NO: 302033 - DNA, 25 bp, Mus musculus
cacaagacgacagccaagtgaccaa

SEQ ID NO: 302034 - DNA, 25 bp, Mus musculus
cacaagacttctcgtgacattgaac

SEQ ID NO: 302035 - DNA, 25 bp, Mus musculus
cacaagacttctggtgacattgaac

SEQ ID NO: 302036 - DNA, 25 bp, Mus musculus
cacaagagacctcgctttggagaaa

SEQ ID NO: 302037 - DNA, 25 bp, Mus musculus
cacaagagacctggctttggagaaa

SEQ ID NO: 302038 - DNA, 25 bp, Mus musculus
cacaagagactaatcctggagagag

SEQ ID NO: 302039 - DNA, 25 bp, Mus musculus
cacaagagactattcctggagagag

SEQ ID NO: 302040 - DNA, 25 bp, Mus musculus
cacaagagagttatcatgctgcccc

SEQ ID NO: 302041 - DNA, 25 bp, Mus musculus
cacaagagagttttcatgctgcccc

SEQ ID NO: 302042 - DNA, 25 bp, Mus musculus
cacaagagatttatgctcagcctct

SEQ ID NO: 302043 - DNA, 25 bp, Mus musculus
cacaagagatttttgctcagcctct

SEQ ID NO: 302044 - DNA, 25 bp, Mus musculus
cacaagagcctactgaacctggcta

SEQ ID NO: 302045 - DNA, 25 bp, Mus musculus
cacaagagcctagtgaacctggcta

SEQ ID NO: 302046 - DNA, 25 bp, Mus musculus
cacaagagctgtcgtcaaggctaca

SEQ ID NO: 302047 - DNA, 25 bp, Mus musculus
cacaagagctgtggtcaaggctaca

SEQ ID NO: 302048 - DNA, 25 bp, Mus musculus
cacaagaggccacactggatggaga

SEQ ID NO: 302049 - DNA, 25 bp, Mus musculus
cacaagaggccagactggatggaga

SEQ ID NO: 302050 - DNA, 25 bp, Mus musculus
cacaagagggaccttcagaggtaag

SEQ ID NO: 302051 - DNA, 25 bp, Mus musculus
cacaagagggacgttcagaggtaag

SEQ ID NO: 302052 - DNA, 25 bp, Mus musculus
cacaagatgctcatcagttcttcca

SEQ ID NO: 302053 - DNA, 25 bp, Mus musculus
cacaagatgctcttcagttcttcca

SEQ ID NO: 302054 - DNA, 25 bp, Mus musculus
cacaagcaaggcactgtaccactga

SEQ ID NO: 302055 - DNA, 25 bp, Mus musculus
cacaagcaaggctctgtaccactga

SEQ ID NO: 302056 - DNA, 25 bp, Mus musculus
cacaagcacaggaacgtcagtttga

SEQ ID NO: 302057 - DNA, 25 bp, Mus musculus
cacaagcacaggtacgtcagtttga

SEQ ID NO: 302058 - DNA, 25 bp, Mus musculus
cacaagcagacacagggttgtttgt

SEQ ID NO: 302059 - DNA, 25 bp, Mus musculus
cacaagcagacagagggttgtttgt

SEQ ID NO: 302060 - DNA, 25 bp, Mus musculus
cacaagcataaactactcacctaca

SEQ ID NO: 302061 - DNA, 25 bp, Mus musculus
cacaagcataaagtactcacctaca

SEQ ID NO: 302062 - DNA, 25 bp, Mus musculus
cacaagcccgagaggaggtactgga

SEQ ID NO: 302063 - DNA, 25 bp, Mus musculus
cacaagcccgagtggaggtactgga

SEQ ID NO: 302064 - DNA, 25 bp, Mus musculus
cacaagccgtgtcagatcccagtag

SEQ ID NO: 302065 - DNA, 25 bp, Mus musculus
cacaagccgtgtcgttgaggagaca

SEQ ID NO: 302066 - DNA, 25 bp, Mus musculus
cacaagccgtgtgagatcccagtag

SEQ ID NO: 302067 - DNA, 25 bp, Mus musculus
cacaagccgtgtggttgaggagaca

SEQ ID NO: 302068 - DNA, 25 bp, Mus musculus
cacaagcctttgaccctgttagtaa

SEQ ID NO: 302069 - DNA, 25 bp, Mus musculus
cacaagcctttgtccctgttagtaa

SEQ ID NO: 302070 - DNA, 25 bp, Mus musculus
cacaagcgacctaccactgttgcgg

SEQ ID NO: 302071 - DNA, 25 bp, Mus musculus
cacaagcgaccttccactgttgcgg

SEQ ID NO: 302072 - DNA, 25 bp, Mus musculus
cacaagcgactcattgatttacata

SEQ ID NO: 302073 - DNA, 25 bp, Mus musculus
cacaagcgactctttgatttacata

SEQ ID NO: 302074 - DNA, 25 bp, Mus musculus
cacaagcgcaacctattcttggaac

SEQ ID NO: 302075 - DNA, 25 bp, Mus musculus
cacaagcgcaacgtattcttggaac

SEQ ID NO: 302076 - DNA, 25 bp, Mus musculus
cacaagctttacctccaatctgaaa

SEQ ID NO: 302077 - DNA, 25 bp, Mus musculus
cacaagctttacgtccaatctgaaa

SEQ ID NO: 302078 - DNA, 25 bp, Mus musculus
cacaaggaaggactcgcccgtgttt

SEQ ID NO: 302079 - DNA, 25 bp, Mus musculus
cacaaggaaggagtcgcccgtgttt

SEQ ID NO: 302080 - DNA, 25 bp, Mus musculus
cacaaggaggacctgtgcagcagct

SEQ ID NO: 302081 - DNA, 25 bp, Mus musculus
cacaaggaggacgtgtgcagcagct

SEQ ID NO: 302082 - DNA, 25 bp, Mus musculus
cacaaggaggatccaggtgttccct

SEQ ID NO: 302083 - DNA, 25 bp, Mus musculus
cacaaggaggatgcaggtgttccct

SEQ ID NO: 302084 - DNA, 25 bp, Mus musculus
cacaaggatggtacgggctgacaca

SEQ ID NO: 302085 - DNA, 25 bp, Mus musculus
cacaaggatggttcgggctgacaca

SEQ ID NO: 302086 - DNA, 25 bp, Mus musculus
cacaaggccctgctaatactttctt

SEQ ID NO: 302087 - DNA, 25 bp, Mus musculus
cacaaggccctggtaatactttctt

SEQ ID NO: 302088 - DNA, 25 bp, Mus musculus
cacaaggcctagactggaagcgtat

SEQ ID NO: 302089 - DNA, 25 bp, Mus musculus
cacaaggcctagtctggaagcgtat

SEQ ID NO: 302090 - DNA, 25 bp, Mus musculus
cacaaggcctccacttttaacaagg

SEQ ID NO: 302091 - DNA, 25 bp, Mus musculus
cacaaggcctcctcttttaacaagg

SEQ ID NO: 302092 - DNA, 25 bp, Mus musculus
cacaaggccttgactagtgtcacaa

SEQ ID NO: 302093 - DNA, 25 bp, Mus musculus
cacaaggccttgtctagtgtcacaa

SEQ ID NO: 302094 - DNA, 25 bp, Mus musculus
cacaaggctgtcctggtcttggaga

SEQ ID NO: 302095 - DNA, 25 bp, Mus musculus
cacaaggctgtcgtggtcttggaga

SEQ ID NO: 302096 - DNA, 25 bp, Mus musculus
cacaaggcttgacctgctttttcaa

SEQ ID NO: 302097 - DNA, 25 bp, Mus musculus
cacaaggcttgagctgctttttcaa

SEQ ID NO: 302098 - DNA, 25 bp, Mus musculus
cacaaggctttacggtgctggtgac

SEQ ID NO: 302099 - DNA, 25 bp, Mus musculus
cacaaggctttagggtgctggtgac

SEQ ID NO: 302100 - DNA, 25 bp, Mus musculus
cacaagggaccacgcgaaagataat

SEQ ID NO: 302101 - DNA, 25 bp, Mus musculus
cacaagggaccaggcgaaagataat

SEQ ID NO: 302102 - DNA, 25 bp, Mus musculus
cacaagggccacaataaacaagact

SEQ ID NO: 302103 - DNA, 25 bp, Mus musculus
cacaagggccactataaacaagact

SEQ ID NO: 302104 - DNA, 25 bp, Mus musculus
cacaagggccctaacatgtattttt

SEQ ID NO: 302105 - DNA, 25 bp, Mus musculus
cacaagggcccttacatgtattttt

SEQ ID NO: 302106 - DNA, 25 bp, Mus musculus
cacaagggtgtgctctcaagtttac

SEQ ID NO: 302107 - DNA, 25 bp, Mus musculus
cacaagggtgtggtctcaagtttac

SEQ ID NO: 302108 - DNA, 25 bp, Mus musculus
cacaaggtaaccctgttcacagtat

SEQ ID NO: 302109 - DNA, 25 bp, Mus musculus
cacaaggtaaccgtgttcacagtat

SEQ ID NO: 302110 - DNA, 25 bp, Mus musculus
cacaaggtgatcagtgtcctcgctg

SEQ ID NO: 302111 - DNA, 25 bp, Mus musculus
cacaaggtgatctgtgtcctcgctg

SEQ ID NO: 302112 - DNA, 25 bp, Mus musculus
cacaaggttaagctagccccgctag

SEQ ID NO: 302113 - DNA, 25 bp, Mus musculus
cacaaggttaaggtagccccgctag

SEQ ID NO: 302114 - DNA, 25 bp, Mus musculus
cacaaggttaggctgctcaactcct

SEQ ID NO: 302115 - DNA, 25 bp, Mus musculus
cacaaggttagggtgctcaactcct

SEQ ID NO: 302116 - DNA, 25 bp, Mus musculus
cacaaggttggtacattcaggttct

SEQ ID NO: 302117 - DNA, 25 bp, Mus musculus
cacaaggttggttcattcaggttct

SEQ ID NO: 302118 - DNA, 25 bp, Mus musculus
cacaagtactgtagggttttctaag

SEQ ID NO: 302119 - DNA, 25 bp, Mus musculus
cacaagtactgttgggttttctaag

SEQ ID NO: 302120 - DNA, 25 bp, Mus musculus
cacaagtagcacagagggaccctca

SEQ ID NO: 302121 - DNA, 25 bp, Mus musculus
cacaagtagcactgagggaccctca

SEQ ID NO: 302122 - DNA, 25 bp, Mus musculus
cacaagtcacttcggttcagagagg

SEQ ID NO: 302123 - DNA, 25 bp, Mus musculus
cacaagtcacttgggttcagagagg

SEQ ID NO: 302124 - DNA, 25 bp, Mus musculus
cacaagtccaatattggcctctgga

SEQ ID NO: 302125 - DNA, 25 bp, Mus musculus
cacaagtccaattttggcctctgga

SEQ ID NO: 302126 - DNA, 25 bp, Mus musculus
cacaagtcccttaatgtgttttctt

SEQ ID NO: 302127 - DNA, 25 bp, Mus musculus
cacaagtccctttatgtgttttctt

SEQ ID NO: 302128 - DNA, 25 bp, Mus musculus
cacaagtccgtaagccttcatttta

SEQ ID NO: 302129 - DNA, 25 bp, Mus musculus
cacaagtccgtatgccttcatttta

SEQ ID NO: 302130 - DNA, 25 bp, Mus musculus
cacaagtcctctagttctggaacta

SEQ ID NO: 302131 - DNA, 25 bp, Mus musculus
cacaagtcctcttgttctggaacta

SEQ ID NO: 302132 - DNA, 25 bp, Mus musculus
cacaagtgcgaaactgtccaaggct

SEQ ID NO: 302133 - DNA, 25 bp, Mus musculus
cacaagtgcgaatctgtccaaggct

SEQ ID NO: 302134 - DNA, 25 bp, Mus musculus
cacaagtggcttcacttttttagaa

SEQ ID NO: 302135 - DNA, 25 bp, Mus musculus
cacaagtggcttgacttttttagaa

SEQ ID NO: 302136 - DNA, 25 bp, Mus musculus
cacaagtgtggtattcttgttgttt

SEQ ID NO: 302137 - DNA, 25 bp, Mus musculus
cacaagtgtggttttcttgttgttt

SEQ ID NO: 302138 - DNA, 25 bp, Mus musculus
cacaagtgttaccatggcaaaactg

SEQ ID NO: 302139 - DNA, 25 bp, Mus musculus
cacaagtgttacgatggcaaaactg

SEQ ID NO: 302140 - DNA, 25 bp, Mus musculus
cacaagttaaacagcccagtactgt

SEQ ID NO: 302141 - DNA, 25 bp, Mus musculus
cacaagttaaactgcccagtactgt

SEQ ID NO: 302142 - DNA, 25 bp, Mus musculus
cacaagttctctcccttcatcaaga

SEQ ID NO: 302143 - DNA, 25 bp, Mus musculus
cacaagttctctgccttcatcaaga

SEQ ID NO: 302144 - DNA, 25 bp, Mus musculus
cacaagttgactagcgtcagatgtt

SEQ ID NO: 302145 - DNA, 25 bp, Mus musculus
cacaagttgacttgcgtcagatgtt

SEQ ID NO: 302146 - DNA, 25 bp, Mus musculus
cacaagttgtacatctgagcctggg

SEQ ID NO: 302147 - DNA, 25 bp, Mus musculus
cacaagttgtacttctgagcctggg

SEQ ID NO: 302148 - DNA, 25 bp, Mus musculus
cacaataaaacacttcaaactcccg

SEQ ID NO: 302149 - DNA, 25 bp, Mus musculus
cacaataaaacagttcaaactcccg

SEQ ID NO: 302150 - DNA, 25 bp, Mus musculus
cacaataatcacaaacttgcagaga

SEQ ID NO: 302151 - DNA, 25 bp, Mus musculus
cacaataatcactaacttgcagaga

SEQ ID NO: 302152 - DNA, 25 bp, Mus musculus
cacaatacctttactggaatccaga

SEQ ID NO: 302153 - DNA, 25 bp, Mus musculus
cacaataccttttctggaatccaga

SEQ ID NO: 302154 - DNA, 25 bp, Mus musculus
cacaatagctccacccagggtttta

SEQ ID NO: 302155 - DNA, 25 bp, Mus musculus
cacaatagctcctcccagggtttta

SEQ ID NO: 302156 - DNA, 25 bp, Mus musculus
cacaatagtacaaacctgacagggc

SEQ ID NO: 302157 - DNA, 25 bp, Mus musculus
cacaatagtacatacctgacagggc

SEQ ID NO: 302158 - DNA, 25 bp, Mus musculus
cacaatagttacataaaggtcactt

SEQ ID NO: 302159 - DNA, 25 bp, Mus musculus
cacaatagttacttaaaggtcactt

SEQ ID NO: 302160 - DNA, 25 bp, Mus musculus
cacaatatgactattcaaccctcca

SEQ ID NO: 302161 - DNA, 25 bp, Mus musculus
cacaatatgacttttcaaccctcca

SEQ ID NO: 302162 - DNA, 25 bp, Mus musculus
cacaatcactggctgtaccgtacac

SEQ ID NO: 302163 - DNA, 25 bp, Mus musculus
cacaatcactgggtgtaccgtacac

SEQ ID NO: 302164 - DNA, 25 bp, Mus musculus
cacaatcagttcctcacggtggaag

SEQ ID NO: 302165 - DNA, 25 bp, Mus musculus
cacaatcagttcgtcacggtggaag

SEQ ID NO: 302166 - DNA, 25 bp, Mus musculus
cacaatccttgtctcttcacaggta

SEQ ID NO: 302167 - DNA, 25 bp, Mus musculus
cacaatccttgtgtcttcacaggta

SEQ ID NO: 302168 - DNA, 25 bp, Mus musculus
cacaatccttttccacaagggctaa

SEQ ID NO: 302169 - DNA, 25 bp, Mus musculus
cacaatccttttgcacaagggctaa

SEQ ID NO: 302170 - DNA, 25 bp, Mus musculus
cacaatcgacctacagcatctgaat

SEQ ID NO: 302171 - DNA, 25 bp, Mus musculus
cacaatcgaccttcagcatctgaat

SEQ ID NO: 302172 - DNA, 25 bp, Mus musculus
cacaatctacgcacaacttaaccat

SEQ ID NO: 302173 - DNA, 25 bp, Mus musculus
cacaatctacgctcaacttaaccat

SEQ ID NO: 302174 - DNA, 25 bp, Mus musculus
cacaatctctacaaatcgatcttgg

SEQ ID NO: 302175 - DNA, 25 bp, Mus musculus
cacaatctctactaatcgatcttgg

SEQ ID NO: 302176 - DNA, 25 bp, Mus musculus
cacaatctgcatcattcacctgaga

SEQ ID NO: 302177 - DNA, 25 bp, Mus musculus
cacaatctgcatgattcacctgaga

SEQ ID NO: 302178 - DNA, 25 bp, Mus musculus
cacaatcttgttcggactgctcaga

SEQ ID NO: 302179 - DNA, 25 bp, Mus musculus
cacaatcttgttgggactgctcaga

SEQ ID NO: 302180 - DNA, 25 bp, Mus musculus
cacaatctttgtccaaggacttggg

SEQ ID NO: 302181 - DNA, 25 bp, Mus musculus
cacaatctttgtgcaaggacttggg

SEQ ID NO: 302182 - DNA, 25 bp, Mus musculus
cacaatgagggacgaactgctttcc

SEQ ID NO: 302183 - DNA, 25 bp, Mus musculus
cacaatgagggaggaactgctttcc

SEQ ID NO: 302184 - DNA, 25 bp, Mus musculus
cacaatgccagcaacagtctcagag

SEQ ID NO: 302185 - DNA, 25 bp, Mus musculus
cacaatgccagctacagtctcagag

SEQ ID NO: 302186 - DNA, 25 bp, Mus musculus
cacaatgcctcacactattggatgt

SEQ ID NO: 302187 - DNA, 25 bp, Mus musculus
cacaatgcctcagactattggatgt

SEQ ID NO: 302188 - DNA, 25 bp, Mus musculus
cacaatggaaacaacaactgccttt

SEQ ID NO: 302189 - DNA, 25 bp, Mus musculus
cacaatggaaactacaactgccttt

SEQ ID NO: 302190 - DNA, 25 bp, Mus musculus
cacaatggacatcccatccttgggt

SEQ ID NO: 302191 - DNA, 25 bp, Mus musculus
cacaatggacatgccatccttgggt

SEQ ID NO: 302192 - DNA, 25 bp, Mus musculus
cacaatggactcagtcaggtctgga

SEQ ID NO: 302193 - DNA, 25 bp, Mus musculus
cacaatggactctgtcaggtctgga

SEQ ID NO: 302194 - DNA, 25 bp, Mus musculus
cacaatggcaaaatctggatggtct

SEQ ID NO: 302195 - DNA, 25 bp, Mus musculus
cacaatggcaaattctggatggtct

SEQ ID NO: 302196 - DNA, 25 bp, Mus musculus
cacaatggcaccactgtaggttgca

SEQ ID NO: 302197 - DNA, 25 bp, Mus musculus
cacaatggcacctctgtaggttgca

SEQ ID NO: 302198 - DNA, 25 bp, Mus musculus
cacaatggctgtaatctctcttctg

SEQ ID NO: 302199 - DNA, 25 bp, Mus musculus
cacaatggctgttatctctcttctg

SEQ ID NO: 302200 - DNA, 25 bp, Mus musculus
cacaatgggacgagttaggagtaac

SEQ ID NO: 302201 - DNA, 25 bp, Mus musculus
cacaatgggacgtgttaggagtaac

SEQ ID NO: 302202 - DNA, 25 bp, Mus musculus
cacaatgggcagacatggcatgaga

SEQ ID NO: 302203 - DNA, 25 bp, Mus musculus
cacaatgggcagtcatggcatgaga

SEQ ID NO: 302204 - DNA, 25 bp, Mus musculus
cacaatggtgagaggttctacgctt

SEQ ID NO: 302205 - DNA, 25 bp, Mus musculus
cacaatggtgagtggttctacgctt

SEQ ID NO: 302206 - DNA, 25 bp, Mus musculus
cacaatggtgtgagtgctcctccac

SEQ ID NO: 302207 - DNA, 25 bp, Mus musculus
cacaatggtgtgtgtgctcctccac

SEQ ID NO: 302208 - DNA, 25 bp, Mus musculus
cacaatggttggacttcttcctaaa

SEQ ID NO: 302209 - DNA, 25 bp, Mus musculus
cacaatggttggtcttcttcctaaa

SEQ ID NO: 302210 - DNA, 25 bp, Mus musculus
cacaatgtcacaaaacttcaaaatg

SEQ ID NO: 302211 - DNA, 25 bp, Mus musculus
cacaatgtcacataacttcaaaatg

SEQ ID NO: 302212 - DNA, 25 bp, Mus musculus
cacaatgtgaaaagtctgcctgccc

SEQ ID NO: 302213 - DNA, 25 bp, Mus musculus
cacaatgtgaaatgtctgcctgccc

SEQ ID NO: 302214 - DNA, 25 bp, Mus musculus
cacaatgtgtcaagagtggaacaat

SEQ ID NO: 302215 - DNA, 25 bp, Mus musculus
cacaatgtgtcatgagtggaacaat

SEQ ID NO: 302216 - DNA, 25 bp, Mus musculus
cacaattatctaaaacttcgagcta

SEQ ID NO: 302217 - DNA, 25 bp, Mus musculus
cacaattatctataacttcgagcta

SEQ ID NO: 302218 - DNA, 25 bp, Mus musculus
cacaattatggcagtggtccaataa

SEQ ID NO: 302219 - DNA, 25 bp, Mus musculus
cacaattatggctgtggtccaataa

SEQ ID NO: 302220 - DNA, 25 bp, Mus musculus
cacaattctctcactccatgatgtt

SEQ ID NO: 302221 - DNA, 25 bp, Mus musculus
cacaattctctctctccatgatgtt

SEQ ID NO: 302222 - DNA, 25 bp, Mus musculus
cacaattcttttaatactgctggat

SEQ ID NO: 302223 - DNA, 25 bp, Mus musculus
cacaattctttttatactgctggat

SEQ ID NO: 302224 - DNA, 25 bp, Mus musculus
cacaattgacggcaaaacagcaaat

SEQ ID NO: 302225 - DNA, 25 bp, Mus musculus
cacaattgacgggaaaacagcaaat

SEQ ID NO: 302226 - DNA, 25 bp, Mus musculus
cacaatttcatccacggcttggcga

SEQ ID NO: 302227 - DNA, 25 bp, Mus musculus
cacaatttcatcgacggcttggcga

SEQ ID NO: 302228 - DNA, 25 bp, Mus musculus
cacaatttctggcttggatttttaa

SEQ ID NO: 302229 - DNA, 25 bp, Mus musculus
cacaatttctgggttggatttttaa

SEQ ID NO: 302230 - DNA, 25 bp, Mus musculus
cacaatttgcagagatgaggcgggt

SEQ ID NO: 302231 - DNA, 25 bp, Mus musculus
cacaatttgcagtgatgaggcgggt

SEQ ID NO: 302232 - DNA, 25 bp, Mus musculus
cacaatttgcccagataattatcaa

SEQ ID NO: 302233 - DNA, 25 bp, Mus musculus
cacaatttgccctgataattatcaa

SEQ ID NO: 302234 - DNA, 25 bp, Mus musculus
cacacaaaacgaaccctcgagttct

SEQ ID NO: 302235 - DNA, 25 bp, Mus musculus
cacacaaaacgatccctcgagttct

SEQ ID NO: 302236 - DNA, 25 bp, Mus musculus
cacacaaatgtcagcttctggtttg

SEQ ID NO: 302237 - DNA, 25 bp, Mus musculus
cacacaaatgtctgcttctggtttg

SEQ ID NO: 302238 - DNA, 25 bp, Mus musculus
cacacaacatgcacttagatcctac

SEQ ID NO: 302239 - DNA, 25 bp, Mus musculus
cacacaacatgctcttagatcctac

SEQ ID NO: 302240 - DNA, 25 bp, Mus musculus
cacacaacatggctcagctaaaaag

SEQ ID NO: 302241 - DNA, 25 bp, Mus musculus
cacacaacatgggtcagctaaaaag

SEQ ID NO: 302242 - DNA, 25 bp, Mus musculus
cacacaagctttacaccagaaagag

SEQ ID NO: 302243 - DNA, 25 bp, Mus musculus
cacacaagcttttcaccagaaagag

SEQ ID NO: 302244 - DNA, 25 bp, Mus musculus
cacacaaggctaacattgactccag

SEQ ID NO: 302245 - DNA, 25 bp, Mus musculus
cacacaaggctatcattgactccag

SEQ ID NO: 302246 - DNA, 25 bp, Mus musculus
cacacaagtaggcaactggtttaag

SEQ ID NO: 302247 - DNA, 25 bp, Mus musculus
cacacaagtagggaactggtttaag

SEQ ID NO: 302248 - DNA, 25 bp, Mus musculus
cacacaagtgcaagggcccgagctt

SEQ ID NO: 302249 - DNA, 25 bp, Mus musculus
cacacaagtgcatgggcccgagctt

SEQ ID NO: 302250 - DNA, 25 bp, Mus musculus
cacacaatgtttaatctcccagttt

SEQ ID NO: 302251 - DNA, 25 bp, Mus musculus
cacacaatgttttatctcccagttt

SEQ ID NO: 302252 - DNA, 25 bp, Mus musculus
cacacaattaggagggcaaggttat

SEQ ID NO: 302253 - DNA, 25 bp, Mus musculus
cacacaattaggtgggcaaggttat

SEQ ID NO: 302254 - DNA, 25 bp, Mus musculus
cacacaattctaaaaaacgggtctt

SEQ ID NO: 302255 - DNA, 25 bp, Mus musculus
cacacaattctataaaacgggtctt

SEQ ID NO: 302256 - DNA, 25 bp, Mus musculus
cacacacaaaggaaggtctccccgg

SEQ ID NO: 302257 - DNA, 25 bp, Mus musculus
cacacacaaaggtaggtctccccgg

SEQ ID NO: 302258 - DNA, 25 bp, Mus musculus
cacacacaagcacgccaggcataga

SEQ ID NO: 302259 - DNA, 25 bp, Mus musculus
cacacacaagcaggccaggcataga

SEQ ID NO: 302260 - DNA, 25 bp, Mus musculus
cacacacaaggactctggaagtatc

SEQ ID NO: 302261 - DNA, 25 bp, Mus musculus
cacacacaaggagtctggaagtatc

SEQ ID NO: 302262 - DNA, 25 bp, Mus musculus
cacacacaatacacagggctggctg

SEQ ID NO: 302263 - DNA, 25 bp, Mus musculus
cacacacaatactcagggctggctg

SEQ ID NO: 302264 - DNA, 25 bp, Mus musculus
cacacacacactcgaggttcagatc

SEQ ID NO: 302265 - DNA, 25 bp, Mus musculus
cacacacacactggaggttcagatc

SEQ ID NO: 302266 - DNA, 25 bp, Mus musculus
cacacacacagacatctatcatgta

SEQ ID NO: 302267 - DNA, 25 bp, Mus musculus
cacacacacagagatctatcatgta

SEQ ID NO: 302268 - DNA, 25 bp, Mus musculus
cacacacaccagagttaatggatgt

SEQ ID NO: 302269 - DNA, 25 bp, Mus musculus
cacacacaccagtgttaatggatgt

SEQ ID NO: 302270 - DNA, 25 bp, Mus musculus
cacacacactccaagctcaagaaat

SEQ ID NO: 302271 - DNA, 25 bp, Mus musculus
cacacacactcctagctcaagaaat

SEQ ID NO: 302272 - DNA, 25 bp, Mus musculus
cacacacagcttcatttccagagag

SEQ ID NO: 302273 - DNA, 25 bp, Mus musculus
cacacacagcttgatttccagagag

SEQ ID NO: 302274 - DNA, 25 bp, Mus musculus
cacacacatcatcctctggtttaaa

SEQ ID NO: 302275 - DNA, 25 bp, Mus musculus
cacacacatcatgctctggtttaaa

SEQ ID NO: 302276 - DNA, 25 bp, Mus musculus
cacacacatgagatggcgagatccc

SEQ ID NO: 302277 - DNA, 25 bp, Mus musculus
cacacacatgagttggcgagatccc

SEQ ID NO: 302278 - DNA, 25 bp, Mus musculus
cacacacatgccagagggaagacgg

SEQ ID NO: 302279 - DNA, 25 bp, Mus musculus
cacacacatgcctgagggaagacgg

SEQ ID NO: 302280 - DNA, 25 bp, Mus musculus
cacacacatttgaggcttcagccag

SEQ ID NO: 302281 - DNA, 25 bp, Mus musculus
cacacacatttgtggcttcagccag

SEQ ID NO: 302282 - DNA, 25 bp, Mus musculus
cacacacattttatgctttttctga

SEQ ID NO: 302283 - DNA, 25 bp, Mus musculus
cacacacattttttgctttttctga

SEQ ID NO: 302284 - DNA, 25 bp, Mus musculus
cacacaccacacagtgcataacata

SEQ ID NO: 302285 - DNA, 25 bp, Mus musculus
cacacaccacactgtgcataacata

SEQ ID NO: 302286 - DNA, 25 bp, Mus musculus
cacacaccagagatcgaggaggcct

SEQ ID NO: 302287 - DNA, 25 bp, Mus musculus
cacacaccagagttcgaggaggcct

SEQ ID NO: 302288 - DNA, 25 bp, Mus musculus
cacacaccagtacctaatctcaatg

SEQ ID NO: 302289 - DNA, 25 bp, Mus musculus
cacacaccagtagctaatctcaatg

SEQ ID NO: 302290 - DNA, 25 bp, Mus musculus
cacacaccatgcctcagggaattaa

SEQ ID NO: 302291 - DNA, 25 bp, Mus musculus
cacacaccatgcgtcagggaattaa

SEQ ID NO: 302292 - DNA, 25 bp, Mus musculus
cacacacccaaaacaactagcaaat

SEQ ID NO: 302293 - DNA, 25 bp, Mus musculus
cacacacccaaatcaactagcaaat

SEQ ID NO: 302294 - DNA, 25 bp, Mus musculus
cacacacccacaaaagcattacatt

SEQ ID NO: 302295 - DNA, 25 bp, Mus musculus
cacacacccacataagcattacatt

SEQ ID NO: 302296 - DNA, 25 bp, Mus musculus
cacacaccctgtccagagctaagga

SEQ ID NO: 302297 - DNA, 25 bp, Mus musculus
cacacaccctgtgcagagctaagga

SEQ ID NO: 302298 - DNA, 25 bp, Mus musculus
cacacacccttaccgtagagtagta

SEQ ID NO: 302299 - DNA, 25 bp, Mus musculus
cacacacccttagcgtagagtagta

SEQ ID NO: 302300 - DNA, 25 bp, Mus musculus
cacacaccgctgaaatgtaatgcat

SEQ ID NO: 302301 - DNA, 25 bp, Mus musculus
cacacaccgctgtaatgtaatgcat

SEQ ID NO: 302302 - DNA, 25 bp, Mus musculus
cacacacctattatcacagagatcc

SEQ ID NO: 302303 - DNA, 25 bp, Mus musculus
cacacacctattttcacagagatcc

SEQ ID NO: 302304 - DNA, 25 bp, Mus musculus
cacacacctctgaagatgttgtcta

SEQ ID NO: 302305 - DNA, 25 bp, Mus musculus
cacacacctctgtagatgttgtcta

SEQ ID NO: 302306 - DNA, 25 bp, Mus musculus
cacacacctgcgcaagatgcgcaag

SEQ ID NO: 302307 - DNA, 25 bp, Mus musculus
cacacacctgcggaagatgcgcaag

SEQ ID NO: 302308 - DNA, 25 bp, Mus musculus
cacacacctgtaatggaaactggag

SEQ ID NO: 302309 - DNA, 25 bp, Mus musculus
cacacacctgtattggaaactggag

SEQ ID NO: 302310 - DNA, 25 bp, Mus musculus
cacacaccttggctagaaacggaga

SEQ ID NO: 302311 - DNA, 25 bp, Mus musculus
cacacaccttgggtagaaacggaga

SEQ ID NO: 302312 - DNA, 25 bp, Mus musculus
cacacacctttaatacactactcag

SEQ ID NO: 302313 - DNA, 25 bp, Mus musculus
cacacacctttattacactactcag

SEQ ID NO: 302314 - DNA, 25 bp, Mus musculus
cacacacctttcagctatataatga

SEQ ID NO: 302315 - DNA, 25 bp, Mus musculus
cacacacctttctgctatataatga

SEQ ID NO: 302316 - DNA, 25 bp, Mus musculus
cacacacggcagactgacactaaaa

SEQ ID NO: 302317 - DNA, 25 bp, Mus musculus
cacacacggcagtctgacactaaaa

SEQ ID NO: 302318 - DNA, 25 bp, Mus musculus
cacacacgggtgactcttttttatt

SEQ ID NO: 302319 - DNA, 25 bp, Mus musculus
cacacacgggtgtctcttttttatt

SEQ ID NO: 302320 - DNA, 25 bp, Mus musculus
cacacacggtctcgttaagagcact

SEQ ID NO: 302321 - DNA, 25 bp, Mus musculus
cacacacggtctggttaagagcact

SEQ ID NO: 302322 - DNA, 25 bp, Mus musculus
cacacacgtagaagcggacgccgtg

SEQ ID NO: 302323 - DNA, 25 bp, Mus musculus
cacacacgtagatgcggacgccgtg

SEQ ID NO: 302324 - DNA, 25 bp, Mus musculus
cacacacgtgcgcagaaacataaat

SEQ ID NO: 302325 - DNA, 25 bp, Mus musculus
cacacacgtgcggagaaacataaat

SEQ ID NO: 302326 - DNA, 25 bp, Mus musculus
cacacactaattcgaagcaaagggt

SEQ ID NO: 302327 - DNA, 25 bp, Mus musculus
cacacactaattggaagcaaagggt

SEQ ID NO: 302328 - DNA, 25 bp, Mus musculus
cacacactacgaacacgttctgatt

SEQ ID NO: 302329 - DNA, 25 bp, Mus musculus
cacacactacgatcacgttctgatt

SEQ ID NO: 302330 - DNA, 25 bp, Mus musculus
cacacactcatgcatcctgaggttg

SEQ ID NO: 302331 - DNA, 25 bp, Mus musculus
cacacactcatggatcctgaggttg

SEQ ID NO: 302332 - DNA, 25 bp, Mus musculus
cacacactcttaatgcatctaggaa

SEQ ID NO: 302333 - DNA, 25 bp, Mus musculus
cacacactcttattgcatctaggaa

SEQ ID NO: 302334 - DNA, 25 bp, Mus musculus
cacacactgacaagcgagattcggt

SEQ ID NO: 302335 - DNA, 25 bp, Mus musculus
cacacactgacatgcgagattcggt

SEQ ID NO: 302336 - DNA, 25 bp, Mus musculus
cacacactgctcatggcagagggag

SEQ ID NO: 302337 - DNA, 25 bp, Mus musculus
cacacactgctcattatctgggaac

SEQ ID NO: 302338 - DNA, 25 bp, Mus musculus
cacacactgctcttggcagagggag

SEQ ID NO: 302339 - DNA, 25 bp, Mus musculus
cacacactgctctttatctgggaac

SEQ ID NO: 302340 - DNA, 25 bp, Mus musculus
cacacactggtcacaatttatggat

SEQ ID NO: 302341 - DNA, 25 bp, Mus musculus
cacacactggtctcaatttatggat

SEQ ID NO: 302342 - DNA, 25 bp, Mus musculus
cacacactgtagagaggttgcttct

SEQ ID NO: 302343 - DNA, 25 bp, Mus musculus
cacacactgtagtgaggttgcttct

SEQ ID NO: 302344 - DNA, 25 bp, Mus musculus
cacacactgtggactgctaatctac

SEQ ID NO: 302345 - DNA, 25 bp, Mus musculus
cacacactgtggtctgctaatctac

SEQ ID NO: 302346 - DNA, 25 bp, Mus musculus
cacacacttaaaatcacagccctgg

SEQ ID NO: 302347 - DNA, 25 bp, Mus musculus
cacacacttaaattcacagccctgg

SEQ ID NO: 302348 - DNA, 25 bp, Mus musculus
cacacacttactattgagggcctat

SEQ ID NO: 302349 - DNA, 25 bp, Mus musculus
cacacacttacttttgagggcctat

SEQ ID NO: 302350 - DNA, 25 bp, Mus musculus
cacacacttcacctcacagtgtaaa

SEQ ID NO: 302351 - DNA, 25 bp, Mus musculus
cacacacttcacgtcacagtgtaaa

SEQ ID NO: 302352 - DNA, 25 bp, Mus musculus
cacacacttcatattagctttgact

SEQ ID NO: 302353 - DNA, 25 bp, Mus musculus
cacacacttcattttagctttgact

SEQ ID NO: 302354 - DNA, 25 bp, Mus musculus
cacacacttgaacatctttctgcaa

SEQ ID NO: 302355 - DNA, 25 bp, Mus musculus
cacacacttgaagatctttctgcaa

SEQ ID NO: 302356 - DNA, 25 bp, Mus musculus
cacacacttgatataccacagaaga

SEQ ID NO: 302357 - DNA, 25 bp, Mus musculus
cacacacttgatttaccacagaaga

SEQ ID NO: 302358 - DNA, 25 bp, Mus musculus
cacacacttgtaaaggcatcacata

SEQ ID NO: 302359 - DNA, 25 bp, Mus musculus
cacacacttgtataggcatcacata

SEQ ID NO: 302360 - DNA, 25 bp, Mus musculus
cacacacttgtgagtaaacttgtct

SEQ ID NO: 302361 - DNA, 25 bp, Mus musculus
cacacacttgtgtgtaaacttgtct

SEQ ID NO: 302362 - DNA, 25 bp, Mus musculus
cacacactttgacaggttgcaccac

SEQ ID NO: 302363 - DNA, 25 bp, Mus musculus
cacacactttgagaggttgcaccac

SEQ ID NO: 302364 - DNA, 25 bp, Mus musculus
cacacactttttctatagcaagggt

SEQ ID NO: 302365 - DNA, 25 bp, Mus musculus
cacacactttttgtatagcaagggt

SEQ ID NO: 302366 - DNA, 25 bp, Mus musculus
cacacagaacctcgcagatttcttt

SEQ ID NO: 302367 - DNA, 25 bp, Mus musculus
cacacagaacctggcagatttcttt

SEQ ID NO: 302368 - DNA, 25 bp, Mus musculus
cacacagaactgctgcgaggacctg

SEQ ID NO: 302369 - DNA, 25 bp, Mus musculus
cacacagaactggtgcgaggacctg

SEQ ID NO: 302370 - DNA, 25 bp, Mus musculus
cacacagaataaccacggctcaaag

SEQ ID NO: 302371 - DNA, 25 bp, Mus musculus
cacacagaataagcacggctcaaag

SEQ ID NO: 302372 - DNA, 25 bp, Mus musculus
cacacagaatcacggtaggttaggc

SEQ ID NO: 302373 - DNA, 25 bp, Mus musculus
cacacagaatcagggtaggttaggc

SEQ ID NO: 302374 - DNA, 25 bp, Mus musculus
cacacagacacgagaatgcattcag

SEQ ID NO: 302375 - DNA, 25 bp, Mus musculus
cacacagacacgtgaatgcattcag

SEQ ID NO: 302376 - DNA, 25 bp, Mus musculus
cacacagacagcaggctttgtgggt

SEQ ID NO: 302377 - DNA, 25 bp, Mus musculus
cacacagacagctggctttgtgggt

SEQ ID NO: 302378 - DNA, 25 bp, Mus musculus
cacacagacatcaatcatgtactgg

SEQ ID NO: 302379 - DNA, 25 bp, Mus musculus
cacacagacatctatcatgtactgg

SEQ ID NO: 302380 - DNA, 25 bp, Mus musculus
cacacagaccttcttagcatcctag

SEQ ID NO: 302381 - DNA, 25 bp, Mus musculus
cacacagaccttgttagcatcctag

SEQ ID NO: 302382 - DNA, 25 bp, Mus musculus
cacacagagaggacagtgcctgaca

SEQ ID NO: 302383 - DNA, 25 bp, Mus musculus
cacacagagaggaccgggtttttgt

SEQ ID NO: 302384 - DNA, 25 bp, Mus musculus
cacacagagaggtcagtgcctgaca

SEQ ID NO: 302385 - DNA, 25 bp, Mus musculus
cacacagagaggtccgggtttttgt

SEQ ID NO: 302386 - DNA, 25 bp, Mus musculus
cacacagagcaactagaattatgtt

SEQ ID NO: 302387 - DNA, 25 bp, Mus musculus
cacacagagcaagtagaattatgtt

SEQ ID NO: 302388 - DNA, 25 bp, Mus musculus
cacacagagctgatggtggtcctat

SEQ ID NO: 302389 - DNA, 25 bp, Mus musculus
cacacagagctgttggtggtcctat

SEQ ID NO: 302390 - DNA, 25 bp, Mus musculus
cacacagagtccattgcctagataa

SEQ ID NO: 302391 - DNA, 25 bp, Mus musculus
cacacagagtcctttgcctagataa

SEQ ID NO: 302392 - DNA, 25 bp, Mus musculus
cacacagagtgcacatgcagttaaa

SEQ ID NO: 302393 - DNA, 25 bp, Mus musculus
cacacagagtgctcatgcagttaaa

SEQ ID NO: 302394 - DNA, 25 bp, Mus musculus
cacacagatgacacaagcttgaagt

SEQ ID NO: 302395 - DNA, 25 bp, Mus musculus
cacacagatgactcaagcttgaagt

SEQ ID NO: 302396 - DNA, 25 bp, Mus musculus
cacacagatgtgagaccactgcata

SEQ ID NO: 302397 - DNA, 25 bp, Mus musculus
cacacagatgtgtgaccactgcata

SEQ ID NO: 302398 - DNA, 25 bp, Mus musculus
cacacagcagggaatcatggcccat

SEQ ID NO: 302399 - DNA, 25 bp, Mus musculus
cacacagcagggtatcatggcccat

SEQ ID NO: 302400 - DNA, 25 bp, Mus musculus
cacacagccgccatgtgagatgaga

SEQ ID NO: 302401 - DNA, 25 bp, Mus musculus
cacacagccgcccatgggctggaaa

SEQ ID NO: 302402 - DNA, 25 bp, Mus musculus
cacacagccgccgatgggctggaaa

SEQ ID NO: 302403 - DNA, 25 bp, Mus musculus
cacacagccgccttgtgagatgaga

SEQ ID NO: 302404 - DNA, 25 bp, Mus musculus
cacacagctccgacatagttggata

SEQ ID NO: 302405 - DNA, 25 bp, Mus musculus
cacacagctccgtcatagttggata

SEQ ID NO: 302406 - DNA, 25 bp, Mus musculus
cacacagctgcacattggttcttag

SEQ ID NO: 302407 - DNA, 25 bp, Mus musculus
cacacagctgcagattggttcttag

SEQ ID NO: 302408 - DNA, 25 bp, Mus musculus
cacacagctggtcgcacctggatgg

SEQ ID NO: 302409 - DNA, 25 bp, Mus musculus
cacacagctggtggcacctggatgg

SEQ ID NO: 302410 - DNA, 25 bp, Mus musculus
cacacagctgtaagtgaggactcta

SEQ ID NO: 302411 - DNA, 25 bp, Mus musculus
cacacagctgtatgtgaggactcta

SEQ ID NO: 302412 - DNA, 25 bp, Mus musculus
cacacagctgtgctttaagcagtaa

SEQ ID NO: 302413 - DNA, 25 bp, Mus musculus
cacacagctgtggtttaagcagtaa

SEQ ID NO: 302414 - DNA, 25 bp, Mus musculus
cacacaggaggtctgtctcgcatct

SEQ ID NO: 302415 - DNA, 25 bp, Mus musculus
cacacaggaggtgtgtctcgcatct

SEQ ID NO: 302416 - DNA, 25 bp, Mus musculus
cacacaggagttaacggccttggat

SEQ ID NO: 302417 - DNA, 25 bp, Mus musculus
cacacaggagtttacggccttggat

SEQ ID NO: 302418 - DNA, 25 bp, Mus musculus
cacacaggatggatgctagcatgga

SEQ ID NO: 302419 - DNA, 25 bp, Mus musculus
cacacaggatggttgctagcatgga

SEQ ID NO: 302420 - DNA, 25 bp, Mus musculus
cacacaggcctaagttagctatcag

SEQ ID NO: 302421 - DNA, 25 bp, Mus musculus
cacacaggcctatgttagctatcag

SEQ ID NO: 302422 - DNA, 25 bp, Mus musculus
cacacagggagacctggaggagatc

SEQ ID NO: 302423 - DNA, 25 bp, Mus musculus
cacacagggagagctggaggagatc

SEQ ID NO: 302424 - DNA, 25 bp, Mus musculus
cacacagggctgaacagtccagaaa

SEQ ID NO: 302425 - DNA, 25 bp, Mus musculus
cacacagggctgtacagtccagaaa

SEQ ID NO: 302426 - DNA, 25 bp, Mus musculus
cacacagggtcccaatgtgccttgg

SEQ ID NO: 302427 - DNA, 25 bp, Mus musculus
cacacagggtccgaatgtgccttgg

SEQ ID NO: 302428 - DNA, 25 bp, Mus musculus
cacacaggtgtgagcttctgagctt

SEQ ID NO: 302429 - DNA, 25 bp, Mus musculus
cacacaggtgtgtgcttctgagctt

SEQ ID NO: 302430 - DNA, 25 bp, Mus musculus
cacacagtaacacatgccttcagtc

SEQ ID NO: 302431 - DNA, 25 bp, Mus musculus
cacacagtaacagatgccttcagtc

SEQ ID NO: 302432 - DNA, 25 bp, Mus musculus
cacacagtgaatcaagctaggctct

SEQ ID NO: 302433 - DNA, 25 bp, Mus musculus
cacacagtgaatgaagctaggctct

SEQ ID NO: 302434 - DNA, 25 bp, Mus musculus
cacacagtgacaatgggaggtcttt

SEQ ID NO: 302435 - DNA, 25 bp, Mus musculus
cacacagtgacattgggaggtcttt

SEQ ID NO: 302436 - DNA, 25 bp, Mus musculus
cacacagtgcatagtttttctacct

SEQ ID NO: 302437 - DNA, 25 bp, Mus musculus
cacacagtgcattgtttttctacct

SEQ ID NO: 302438 - DNA, 25 bp, Mus musculus
cacacagtgcccagtttgatatact

SEQ ID NO: 302439 - DNA, 25 bp, Mus musculus
cacacagtgccctgtttgatatact

SEQ ID NO: 302440 - DNA, 25 bp, Mus musculus
cacacagtggcactataagatcttt

SEQ ID NO: 302441 - DNA, 25 bp, Mus musculus
cacacagtggcagtataagatcttt

SEQ ID NO: 302442 - DNA, 25 bp, Mus musculus
cacacagtgtggcataatcactatt

SEQ ID NO: 302443 - DNA, 25 bp, Mus musculus
cacacagtgtgggataatcactatt

SEQ ID NO: 302444 - DNA, 25 bp, Mus musculus
cacacagttcagatgtatcagttta

SEQ ID NO: 302445 - DNA, 25 bp, Mus musculus
cacacagttcagttgtatcagttta

SEQ ID NO: 302446 - DNA, 25 bp, Mus musculus
cacacagttcctcgctttcagtaat

SEQ ID NO: 302447 - DNA, 25 bp, Mus musculus
cacacagttcctggctttcagtaat

SEQ ID NO: 302448 - DNA, 25 bp, Mus musculus
cacacagttgggagaacaaaggaag

SEQ ID NO: 302449 - DNA, 25 bp, Mus musculus
cacacagttgggtgaacaaaggaag

SEQ ID NO: 302450 - DNA, 25 bp, Mus musculus
cacacataaagcctcaagtctggaa

SEQ ID NO: 302451 - DNA, 25 bp, Mus musculus
cacacataaagcgtcaagtctggaa

SEQ ID NO: 302452 - DNA, 25 bp, Mus musculus
cacacatacaccacccataagatgt

SEQ ID NO: 302453 - DNA, 25 bp, Mus musculus
cacacatacacctcccataagatgt

SEQ ID NO: 302454 - DNA, 25 bp, Mus musculus
cacacatacgagcagagcaaacaga

SEQ ID NO: 302455 - DNA, 25 bp, Mus musculus
cacacatacgaggagagcaaacaga

SEQ ID NO: 302456 - DNA, 25 bp, Mus musculus
cacacatatgtaacggctgccagct

SEQ ID NO: 302457 - DNA, 25 bp, Mus musculus
cacacatatgtatcggctgccagct

SEQ ID NO: 302458 - DNA, 25 bp, Mus musculus
cacacatatgtgagcatctctgtct

SEQ ID NO: 302459 - DNA, 25 bp, Mus musculus
cacacatatgtgtgcatctctgtct

SEQ ID NO: 302460 - DNA, 25 bp, Mus musculus
cacacatatgttatgaagtggaaca

SEQ ID NO: 302461 - DNA, 25 bp, Mus musculus
cacacatatgttttgaagtggaaca

SEQ ID NO: 302462 - DNA, 25 bp, Mus musculus
cacacatatttaagtccctagcacc

SEQ ID NO: 302463 - DNA, 25 bp, Mus musculus
cacacatatttatgtccctagcacc

SEQ ID NO: 302464 - DNA, 25 bp, Mus musculus
cacacatatttgaccctaaacactt

SEQ ID NO: 302465 - DNA, 25 bp, Mus musculus
cacacatatttgtccctaaacactt

SEQ ID NO: 302466 - DNA, 25 bp, Mus musculus
cacacatcagagcttcactgaacca

SEQ ID NO: 302467 - DNA, 25 bp, Mus musculus
cacacatcagaggttcactgaacca

SEQ ID NO: 302468 - DNA, 25 bp, Mus musculus
cacacatcatctagctttttcattc

SEQ ID NO: 302469 - DNA, 25 bp, Mus musculus
cacacatcatcttgctttttcattc

SEQ ID NO: 302470 - DNA, 25 bp, Mus musculus
cacacatccatcatggtacccctag

SEQ ID NO: 302471 - DNA, 25 bp, Mus musculus
cacacatccatcttggtacccctag

SEQ ID NO: 302472 - DNA, 25 bp, Mus musculus
cacacatccatgaagtgcgcataag

SEQ ID NO: 302473 - DNA, 25 bp, Mus musculus
cacacatccatgtagtgcgcataag

SEQ ID NO: 302474 - DNA, 25 bp, Mus musculus
cacacatcctaacatctgattcaca

SEQ ID NO: 302475 - DNA, 25 bp, Mus musculus
cacacatcctaagatctgattcaca

SEQ ID NO: 302476 - DNA, 25 bp, Mus musculus
cacacatcctgcatgtcagatatct

SEQ ID NO: 302477 - DNA, 25 bp, Mus musculus
cacacatcctgcttgtcagatatct

SEQ ID NO: 302478 - DNA, 25 bp, Mus musculus
cacacatcgctcactgcagaaaggg

SEQ ID NO: 302479 - DNA, 25 bp, Mus musculus
cacacatcgctctctgcagaaaggg

SEQ ID NO: 302480 - DNA, 25 bp, Mus musculus
cacacatcggtgattggagaagtca

SEQ ID NO: 302481 - DNA, 25 bp, Mus musculus
cacacatcggtgtttggagaagtca

SEQ ID NO: 302482 - DNA, 25 bp, Mus musculus
cacacatctcacaagtctatctctt

SEQ ID NO: 302483 - DNA, 25 bp, Mus musculus
cacacatctcactagtctatctctt

SEQ ID NO: 302484 - DNA, 25 bp, Mus musculus
cacacatctcagctttacacttttg

SEQ ID NO: 302485 - DNA, 25 bp, Mus musculus
cacacatctcaggtttacacttttg

SEQ ID NO: 302486 - DNA, 25 bp, Mus musculus
cacacatctgatatgctttgctgct

SEQ ID NO: 302487 - DNA, 25 bp, Mus musculus
cacacatctgatttgctttgctgct

SEQ ID NO: 302488 - DNA, 25 bp, Mus musculus
cacacatctggtcccctgactgttt

SEQ ID NO: 302489 - DNA, 25 bp, Mus musculus
cacacatctggtgccctgactgttt

SEQ ID NO: 302490 - DNA, 25 bp, Mus musculus
cacacatcttgcattggacacaatg

SEQ ID NO: 302491 - DNA, 25 bp, Mus musculus
cacacatcttgctttggacacaatg

SEQ ID NO: 302492 - DNA, 25 bp, Mus musculus
cacacatgacaaaggttggcttctt

SEQ ID NO: 302493 - DNA, 25 bp, Mus musculus
cacacatgacaatggttggcttctt

SEQ ID NO: 302494 - DNA, 25 bp, Mus musculus
cacacatgcaagcacctggtatcag

SEQ ID NO: 302495 - DNA, 25 bp, Mus musculus
cacacatgcaaggacctggtatcag

SEQ ID NO: 302496 - DNA, 25 bp, Mus musculus
cacacatggattctctctgcttgga

SEQ ID NO: 302497 - DNA, 25 bp, Mus musculus
cacacatggattgtctctgcttgga

SEQ ID NO: 302498 - DNA, 25 bp, Mus musculus
cacacatggcagagctggtgagcaa

SEQ ID NO: 302499 - DNA, 25 bp, Mus musculus
cacacatggcagtgctggtgagcaa

SEQ ID NO: 302500 - DNA, 25 bp, Mus musculus
cacacatgtcccaagagttctcagg

SEQ ID NO: 302501 - DNA, 25 bp, Mus musculus
cacacatgtccctagagttctcagg

SEQ ID NO: 302502 - DNA, 25 bp, Mus musculus
cacacatgttctagctatacattta

SEQ ID NO: 302503 - DNA, 25 bp, Mus musculus
cacacatgttcttgctatacattta

SEQ ID NO: 302504 - DNA, 25 bp, Mus musculus
cacacattctagcatgaccttgggt

SEQ ID NO: 302505 - DNA, 25 bp, Mus musculus
cacacattctaggatgaccttgggt

SEQ ID NO: 302506 - DNA, 25 bp, Mus musculus
cacacattgctcaacattctagggt

SEQ ID NO: 302507 - DNA, 25 bp, Mus musculus
cacacattgctctacattctagggt

SEQ ID NO: 302508 - DNA, 25 bp, Mus musculus
cacacattggttcgtgccctgggtg

SEQ ID NO: 302509 - DNA, 25 bp, Mus musculus
cacacattggttggtgccctgggtg

SEQ ID NO: 302510 - DNA, 25 bp, Mus musculus
cacacatttacaccctggtgtaatt

SEQ ID NO: 302511 - DNA, 25 bp, Mus musculus
cacacatttacagcctggtgtaatt

SEQ ID NO: 302512 - DNA, 25 bp, Mus musculus
cacacatttacgcaagttgatcttt

SEQ ID NO: 302513 - DNA, 25 bp, Mus musculus
cacacatttacggaagttgatcttt

SEQ ID NO: 302514 - DNA, 25 bp, Mus musculus
cacacatttcaactggttggccatg

SEQ ID NO: 302515 - DNA, 25 bp, Mus musculus
cacacatttcaagtggttggccatg

SEQ ID NO: 302516 - DNA, 25 bp, Mus musculus
cacacatttccccaaggcttcttaa

SEQ ID NO: 302517 - DNA, 25 bp, Mus musculus
cacacatttcccgaaggcttcttaa

SEQ ID NO: 302518 - DNA, 25 bp, Mus musculus
cacacatttgtgaaggtctttgtga

SEQ ID NO: 302519 - DNA, 25 bp, Mus musculus
cacacatttgtgctgtgtacatctg

SEQ ID NO: 302520 - DNA, 25 bp, Mus musculus
cacacatttgtggtgtgtacatctg

SEQ ID NO: 302521 - DNA, 25 bp, Mus musculus
cacacatttgtgtaggtctttgtga

SEQ ID NO: 302522 - DNA, 25 bp, Mus musculus
cacaccaaaaaaccctgcctgaaga

SEQ ID NO: 302523 - DNA, 25 bp, Mus musculus
cacaccaaaaaagcctgcctgaaga

SEQ ID NO: 302524 - DNA, 25 bp, Mus musculus
cacaccaaaaacacctattccaatt

SEQ ID NO: 302525 - DNA, 25 bp, Mus musculus
cacaccaaaaactcctattccaatt

SEQ ID NO: 302526 - DNA, 25 bp, Mus musculus
cacaccaaagctattaaccatatat

SEQ ID NO: 302527 - DNA, 25 bp, Mus musculus
cacaccaaagcttttaaccatatat

SEQ ID NO: 302528 - DNA, 25 bp, Mus musculus
cacaccaactgaacatctacttcgg

SEQ ID NO: 302529 - DNA, 25 bp, Mus musculus
cacaccaactgatcatctacttcgg

SEQ ID NO: 302530 - DNA, 25 bp, Mus musculus
cacaccaagttaaccctgagcctaa

SEQ ID NO: 302531 - DNA, 25 bp, Mus musculus
cacaccaagttatccctgagcctaa

SEQ ID NO: 302532 - DNA, 25 bp, Mus musculus
cacaccaagttcctgcgggacatga

SEQ ID NO: 302533 - DNA, 25 bp, Mus musculus
cacaccaagttcgtgcgggacatga

SEQ ID NO: 302534 - DNA, 25 bp, Mus musculus
cacaccacagacacactacagattt

SEQ ID NO: 302535 - DNA, 25 bp, Mus musculus
cacaccacagactcactacagattt

SEQ ID NO: 302536 - DNA, 25 bp, Mus musculus
cacaccacatgcagagtacgctgga

SEQ ID NO: 302537 - DNA, 25 bp, Mus musculus
cacaccacatgctgagtacgctgga

SEQ ID NO: 302538 - DNA, 25 bp, Mus musculus
cacaccaccactaagctatagcttt

SEQ ID NO: 302539 - DNA, 25 bp, Mus musculus
cacaccaccacttagctatagcttt

SEQ ID NO: 302540 - DNA, 25 bp, Mus musculus
cacaccacccttcataggatgctat

SEQ ID NO: 302541 - DNA, 25 bp, Mus musculus
cacaccacccttgataggatgctat

SEQ ID NO: 302542 - DNA, 25 bp, Mus musculus
cacaccactcaacccttagagggtt

SEQ ID NO: 302543 - DNA, 25 bp, Mus musculus
cacaccactcaagccttagagggtt

SEQ ID NO: 302544 - DNA, 25 bp, Mus musculus
cacaccagggttcatccattttaaa

SEQ ID NO: 302545 - DNA, 25 bp, Mus musculus
cacaccagggttgatccattttaaa

SEQ ID NO: 302546 - DNA, 25 bp, Mus musculus
cacaccaggtggctcataacaacct

SEQ ID NO: 302547 - DNA, 25 bp, Mus musculus
cacaccaggtgggtcataacaacct

SEQ ID NO: 302548 - DNA, 25 bp, Mus musculus
cacaccatatatattcccacattag

SEQ ID NO: 302549 - DNA, 25 bp, Mus musculus
cacaccatatattttcccacattag

SEQ ID NO: 302550 - DNA, 25 bp, Mus musculus
cacaccatgactacagagtggagct

SEQ ID NO: 302551 - DNA, 25 bp, Mus musculus
cacaccatgacttcagagtggagct

SEQ ID NO: 302552 - DNA, 25 bp, Mus musculus
cacaccattaatcccgatgtaggag

SEQ ID NO: 302553 - DNA, 25 bp, Mus musculus
cacaccattaatgccgatgtaggag

SEQ ID NO: 302554 - DNA, 25 bp, Mus musculus
cacaccattcagatcagttcactga

SEQ ID NO: 302555 - DNA, 25 bp, Mus musculus
cacaccattcagttcagttcactga

SEQ ID NO: 302556 - DNA, 25 bp, Mus musculus
cacaccattttcctccattggtata

SEQ ID NO: 302557 - DNA, 25 bp, Mus musculus
cacaccattttcgtccattggtata

SEQ ID NO: 302558 - DNA, 25 bp, Mus musculus
cacaccatttttcctgtttttaagt

SEQ ID NO: 302559 - DNA, 25 bp, Mus musculus
cacaccatttttgctgtttttaagt

SEQ ID NO: 302560 - DNA, 25 bp, Mus musculus
cacacccaagataccacttcattat

SEQ ID NO: 302561 - DNA, 25 bp, Mus musculus
cacacccaagattccacttcattat

SEQ ID NO: 302562 - DNA, 25 bp, Mus musculus
cacacccaatttatacaccctattt

SEQ ID NO: 302563 - DNA, 25 bp, Mus musculus
cacacccaatttttacaccctattt

SEQ ID NO: 302564 - DNA, 25 bp, Mus musculus
cacacccactgcattgaaatctgat

SEQ ID NO: 302565 - DNA, 25 bp, Mus musculus
cacacccactgctttgaaatctgat

SEQ ID NO: 302566 - DNA, 25 bp, Mus musculus
cacacccagattcaacttattcaca

SEQ ID NO: 302567 - DNA, 25 bp, Mus musculus
cacacccagattgaacttattcaca

SEQ ID NO: 302568 - DNA, 25 bp, Mus musculus
cacacccagctaagtacgtgtggga

SEQ ID NO: 302569 - DNA, 25 bp, Mus musculus
cacacccagctatgtacgtgtggga

SEQ ID NO: 302570 - DNA, 25 bp, Mus musculus
cacacccaggctactgatttacttg

SEQ ID NO: 302571 - DNA, 25 bp, Mus musculus
cacacccaggctattgaaatcaggc

SEQ ID NO: 302572 - DNA, 25 bp, Mus musculus
cacacccaggcttctgatttacttg

SEQ ID NO: 302573 - DNA, 25 bp, Mus musculus
cacacccaggcttttgaaatcaggc

SEQ ID NO: 302574 - DNA, 25 bp, Mus musculus
cacacccagtccatcattataagtt

SEQ ID NO: 302575 - DNA, 25 bp, Mus musculus
cacacccagtccttcattataagtt

SEQ ID NO: 302576 - DNA, 25 bp, Mus musculus
cacacccataacactgactcagaga

SEQ ID NO: 302577 - DNA, 25 bp, Mus musculus
cacacccataactctgactcagaga

SEQ ID NO: 302578 - DNA, 25 bp, Mus musculus
cacacccatgtgacaagcttctctg

SEQ ID NO: 302579 - DNA, 25 bp, Mus musculus
cacacccatgtgtcaagcttctctg

SEQ ID NO: 302580 - DNA, 25 bp, Mus musculus
cacacccatttccaaaagccgtgag

SEQ ID NO: 302581 - DNA, 25 bp, Mus musculus
cacacccatttcgaaaagccgtgag

SEQ ID NO: 302582 - DNA, 25 bp, Mus musculus
cacaccccatctctgaagatgagct

SEQ ID NO: 302583 - DNA, 25 bp, Mus musculus
cacaccccatctgtgaagatgagct

SEQ ID NO: 302584 - DNA, 25 bp, Mus musculus
cacaccccgtgaagatggtacacat

SEQ ID NO: 302585 - DNA, 25 bp, Mus musculus
cacaccccgtgatgatggtacacat

SEQ ID NO: 302586 - DNA, 25 bp, Mus musculus
cacacccctcctaaaaatacttatg

SEQ ID NO: 302587 - DNA, 25 bp, Mus musculus
cacacccctccttaaaatacttatg

SEQ ID NO: 302588 - DNA, 25 bp, Mus musculus
cacaccccttggcaaggagaagcta

SEQ ID NO: 302589 - DNA, 25 bp, Mus musculus
cacaccccttgggaaggagaagcta

SEQ ID NO: 302590 - DNA, 25 bp, Mus musculus
cacacccgaaacaaggaggctcaca

SEQ ID NO: 302591 - DNA, 25 bp, Mus musculus
cacacccgaaactaggaggctcaca

SEQ ID NO: 302592 - DNA, 25 bp, Mus musculus
cacacccgaggcaactgaattttgg

SEQ ID NO: 302593 - DNA, 25 bp, Mus musculus
cacacccgaggctactgaattttgg

SEQ ID NO: 302594 - DNA, 25 bp, Mus musculus
cacacccggctaacgtaaatttctg

SEQ ID NO: 302595 - DNA, 25 bp, Mus musculus
cacacccggctatcgtaaatttctg

SEQ ID NO: 302596 - DNA, 25 bp, Mus musculus
cacacccggctcaaattactacttt

SEQ ID NO: 302597 - DNA, 25 bp, Mus musculus
cacacccggctctaattactacttt

SEQ ID NO: 302598 - DNA, 25 bp, Mus musculus
cacaccctaaatatggccaacttgc

SEQ ID NO: 302599 - DNA, 25 bp, Mus musculus
cacaccctaaatttggccaacttgc

SEQ ID NO: 302600 - DNA, 25 bp, Mus musculus
cacaccctaaggcattattattcta

SEQ ID NO: 302601 - DNA, 25 bp, Mus musculus
cacaccctaagggattattattcta

SEQ ID NO: 302602 - DNA, 25 bp, Mus musculus
cacaccctgaatcacttaactcatt

SEQ ID NO: 302603 - DNA, 25 bp, Mus musculus
cacaccctgaatgacttaactcatt

SEQ ID NO: 302604 - DNA, 25 bp, Mus musculus
cacaccctgactattcattctttta

SEQ ID NO: 302605 - DNA, 25 bp, Mus musculus
cacaccctgacttttcattctttta

SEQ ID NO: 302606 - DNA, 25 bp, Mus musculus
cacaccctgctacccattttaaata

SEQ ID NO: 302607 - DNA, 25 bp, Mus musculus
cacaccctgctagccattttaaata

SEQ ID NO: 302608 - DNA, 25 bp, Mus musculus
cacaccctgggaattcagttcttgg

SEQ ID NO: 302609 - DNA, 25 bp, Mus musculus
cacaccctgggatttcagttcttgg

SEQ ID NO: 302610 - DNA, 25 bp, Mus musculus
cacaccctggtgaagtacgcgatct

SEQ ID NO: 302611 - DNA, 25 bp, Mus musculus
cacaccctggtgtagtacgcgatct

SEQ ID NO: 302612 - DNA, 25 bp, Mus musculus
cacacccttccaaaacagttctgat

SEQ ID NO: 302613 - DNA, 25 bp, Mus musculus
cacacccttccataacagttctgat

SEQ ID NO: 302614 - DNA, 25 bp, Mus musculus
cacacccttggaatttttccctgat

SEQ ID NO: 302615 - DNA, 25 bp, Mus musculus
cacacccttggattttttccctgat

SEQ ID NO: 302616 - DNA, 25 bp, Mus musculus
cacacccttgggagccccttctgat

SEQ ID NO: 302617 - DNA, 25 bp, Mus musculus
cacacccttgggtgccccttctgat

SEQ ID NO: 302618 - DNA, 25 bp, Mus musculus
cacaccctttatcccacacagtttt

SEQ ID NO: 302619 - DNA, 25 bp, Mus musculus
cacaccctttatgccacacagtttt

SEQ ID NO: 302620 - DNA, 25 bp, Mus musculus
cacaccgacatgctcggtgccgtgt

SEQ ID NO: 302621 - DNA, 25 bp, Mus musculus
cacaccgacatggtcggtgccgtgt

SEQ ID NO: 302622 - DNA, 25 bp, Mus musculus
cacaccgacttcactctgtgtaaat

SEQ ID NO: 302623 - DNA, 25 bp, Mus musculus
cacaccgacttctctctgtgtaaat

SEQ ID NO: 302624 - DNA, 25 bp, Mus musculus
cacaccgattatatctgcagtttat

SEQ ID NO: 302625 - DNA, 25 bp, Mus musculus
cacaccgattatttctgcagtttat

SEQ ID NO: 302626 - DNA, 25 bp, Mus musculus
cacaccgctggaccagggactttga

SEQ ID NO: 302627 - DNA, 25 bp, Mus musculus
cacaccgctggagcagggactttga

SEQ ID NO: 302628 - DNA, 25 bp, Mus musculus
cacaccggatggcagcacaagcttc

SEQ ID NO: 302629 - DNA, 25 bp, Mus musculus
cacaccggatgggagcacaagcttc

SEQ ID NO: 302630 - DNA, 25 bp, Mus musculus
cacaccggattcatataacgtttgt

SEQ ID NO: 302631 - DNA, 25 bp, Mus musculus
cacaccggattcttataacgtttgt

SEQ ID NO: 302632 - DNA, 25 bp, Mus musculus
cacaccgggataattcttgtttaat

SEQ ID NO: 302633 - DNA, 25 bp, Mus musculus
cacaccgggatatttcttgtttaat

SEQ ID NO: 302634 - DNA, 25 bp, Mus musculus
cacaccggtagccatcagggaaacc

SEQ ID NO: 302635 - DNA, 25 bp, Mus musculus
cacaccggtagcgatcagggaaacc

SEQ ID NO: 302636 - DNA, 25 bp, Mus musculus
cacaccgtagcaccgctttaaagga

SEQ ID NO: 302637 - DNA, 25 bp, Mus musculus
cacaccgtagcagcgctttaaagga

SEQ ID NO: 302638 - DNA, 25 bp, Mus musculus
cacaccgtcctgctttagtggatgg

SEQ ID NO: 302639 - DNA, 25 bp, Mus musculus
cacaccgtcctggtttagtggatgg

SEQ ID NO: 302640 - DNA, 25 bp, Mus musculus
cacaccgtctctaaatactttctgt

SEQ ID NO: 302641 - DNA, 25 bp, Mus musculus
cacaccgtctcttaatactttctgt

SEQ ID NO: 302642 - DNA, 25 bp, Mus musculus
cacaccgtggaacagcctgaattta

SEQ ID NO: 302643 - DNA, 25 bp, Mus musculus
cacaccgtggaagagcctgaattta

SEQ ID NO: 302644 - DNA, 25 bp, Mus musculus
cacaccgtgtagcacatgcaggcag

SEQ ID NO: 302645 - DNA, 25 bp, Mus musculus
cacaccgtgtaggacatgcaggcag

SEQ ID NO: 302646 - DNA, 25 bp, Mus musculus
cacaccgttcttatgtcacataagc

SEQ ID NO: 302647 - DNA, 25 bp, Mus musculus
cacaccgttcttttgtcacataagc

SEQ ID NO: 302648 - DNA, 25 bp, Mus musculus
cacacctaacttcatggatatatat

SEQ ID NO: 302649 - DNA, 25 bp, Mus musculus
cacacctaacttgatggatatatat

SEQ ID NO: 302650 - DNA, 25 bp, Mus musculus
cacacctaatggctttgcaagagaa

SEQ ID NO: 302651 - DNA, 25 bp, Mus musculus
cacacctaatgggtttgcaagagaa

SEQ ID NO: 302652 - DNA, 25 bp, Mus musculus
cacacctaccataagtcaagaaaag

SEQ ID NO: 302653 - DNA, 25 bp, Mus musculus
cacacctaccattagtcaagaaaag

SEQ ID NO: 302654 - DNA, 25 bp, Mus musculus
cacacctagctacctacttttgagt

SEQ ID NO: 302655 - DNA, 25 bp, Mus musculus
cacacctagctagctacttttgagt

SEQ ID NO: 302656 - DNA, 25 bp, Mus musculus
cacacctagctgcagacaatctgga

SEQ ID NO: 302657 - DNA, 25 bp, Mus musculus
cacacctagctgctgcaatgacaat

SEQ ID NO: 302658 - DNA, 25 bp, Mus musculus
cacacctagctggagacaatctgga

SEQ ID NO: 302659 - DNA, 25 bp, Mus musculus
cacacctagctggtgcaatgacaat

SEQ ID NO: 302660 - DNA, 25 bp, Mus musculus
cacacctagttcacagattctgact

SEQ ID NO: 302661 - DNA, 25 bp, Mus musculus
cacacctagttctcagattctgact

SEQ ID NO: 302662 - DNA, 25 bp, Mus musculus
cacacctatgccctgagtaactagt

SEQ ID NO: 302663 - DNA, 25 bp, Mus musculus
cacacctatgccgtgagtaactagt

SEQ ID NO: 302664 - DNA, 25 bp, Mus musculus
cacacctattcaccctaagactaag

SEQ ID NO: 302665 - DNA, 25 bp, Mus musculus
cacacctattcagcctaagactaag

SEQ ID NO: 302666 - DNA, 25 bp, Mus musculus
cacacctcagagacattgtttccat

SEQ ID NO: 302667 - DNA, 25 bp, Mus musculus
cacacctcagagtcattgtttccat

SEQ ID NO: 302668 - DNA, 25 bp, Mus musculus
cacacctcagcaatgcatatattat

SEQ ID NO: 302669 - DNA, 25 bp, Mus musculus
cacacctcagcaccctatatttatt

SEQ ID NO: 302670 - DNA, 25 bp, Mus musculus
cacacctcagcagcctatatttatt

SEQ ID NO: 302671 - DNA, 25 bp, Mus musculus
cacacctcagcattgcatatattat

SEQ ID NO: 302672 - DNA, 25 bp, Mus musculus
cacacctcagtaatggtcccagaat

SEQ ID NO: 302673 - DNA, 25 bp, Mus musculus
cacacctcagtattggtcccagaat

SEQ ID NO: 302674 - DNA, 25 bp, Mus musculus
cacacctcagtgatcgatcatcgag

SEQ ID NO: 302675 - DNA, 25 bp, Mus musculus
cacacctcagtgttcgatcatcgag

SEQ ID NO: 302676 - DNA, 25 bp, Mus musculus
cacacctcatccatttctggtgaga

SEQ ID NO: 302677 - DNA, 25 bp, Mus musculus
cacacctcatccttttctggtgaga

SEQ ID NO: 302678 - DNA, 25 bp, Mus musculus
cacacctctgtgatttcattcttct

SEQ ID NO: 302679 - DNA, 25 bp, Mus musculus
cacacctctgtgttttcattcttct

SEQ ID NO: 302680 - DNA, 25 bp, Mus musculus
cacacctctgttagcaaattctctg

SEQ ID NO: 302681 - DNA, 25 bp, Mus musculus
cacacctctgtttgcaaattctctg

SEQ ID NO: 302682 - DNA, 25 bp, Mus musculus
cacacctgactgaatttgcatcagt

SEQ ID NO: 302683 - DNA, 25 bp, Mus musculus
cacacctgactgtatttgcatcagt

SEQ ID NO: 302684 - DNA, 25 bp, Mus musculus
cacacctgatcacatttctggaacg

SEQ ID NO: 302685 - DNA, 25 bp, Mus musculus
cacacctgatcagatttctggaacg

SEQ ID NO: 302686 - DNA, 25 bp, Mus musculus
cacacctgcaccaccatcttctggg

SEQ ID NO: 302687 - DNA, 25 bp, Mus musculus
cacacctgcacctccatcttctggg

SEQ ID NO: 302688 - DNA, 25 bp, Mus musculus
cacacctgcaggcagcaggaggcat

SEQ ID NO: 302689 - DNA, 25 bp, Mus musculus
cacacctgcagggagcaggaggcat

SEQ ID NO: 302690 - DNA, 25 bp, Mus musculus
cacacctgcattaaatgaatgattt

SEQ ID NO: 302691 - DNA, 25 bp, Mus musculus
cacacctgcatttaatgaatgattt

SEQ ID NO: 302692 - DNA, 25 bp, Mus musculus
cacacctgcgtgaaagggatgtttt

SEQ ID NO: 302693 - DNA, 25 bp, Mus musculus
cacacctgcgtgtaagggatgtttt

SEQ ID NO: 302694 - DNA, 25 bp, Mus musculus
cacacctggctacctagcatcatag

SEQ ID NO: 302695 - DNA, 25 bp, Mus musculus
cacacctggctagctagcatcatag

SEQ ID NO: 302696 - DNA, 25 bp, Mus musculus
cacacctggttaatctgggctggag

SEQ ID NO: 302697 - DNA, 25 bp, Mus musculus
cacacctggttattctgggctggag

SEQ ID NO: 302698 - DNA, 25 bp, Mus musculus
cacacctgtcttcttgaagggcaaa

SEQ ID NO: 302699 - DNA, 25 bp, Mus musculus
cacacctgtcttgttgaagggcaaa

SEQ ID NO: 302700 - DNA, 25 bp, Mus musculus
cacaccttaactatcatgacccttt

SEQ ID NO: 302701 - DNA, 25 bp, Mus musculus
cacaccttaactttcatgacccttt

SEQ ID NO: 302702 - DNA, 25 bp, Mus musculus
cacaccttcacacctttcatattat

SEQ ID NO: 302703 - DNA, 25 bp, Mus musculus
cacaccttcacagctttcatattat

SEQ ID NO: 302704 - DNA, 25 bp, Mus musculus
cacaccttcactcagcaagtaagca

SEQ ID NO: 302705 - DNA, 25 bp, Mus musculus
cacaccttcactgagcaagtaagca

SEQ ID NO: 302706 - DNA, 25 bp, Mus musculus
cacaccttcaggatagctgttctta

SEQ ID NO: 302707 - DNA, 25 bp, Mus musculus
cacaccttcaggattcagagatcag

SEQ ID NO: 302708 - DNA, 25 bp, Mus musculus
cacaccttcaggttagctgttctta

SEQ ID NO: 302709 - DNA, 25 bp, Mus musculus
cacaccttcaggtttcagagatcag

SEQ ID NO: 302710 - DNA, 25 bp, Mus musculus
cacaccttccttacaatgcaatgca

SEQ ID NO: 302711 - DNA, 25 bp, Mus musculus
cacaccttcctttcaatgcaatgca

SEQ ID NO: 302712 - DNA, 25 bp, Mus musculus
cacaccttgactctcaagttggcag

SEQ ID NO: 302713 - DNA, 25 bp, Mus musculus
cacaccttgactgtcaagttggcag

SEQ ID NO: 302714 - DNA, 25 bp, Mus musculus
cacaccttgctaagtttatgaccag

SEQ ID NO: 302715 - DNA, 25 bp, Mus musculus
cacaccttgctatgtttatgaccag

SEQ ID NO: 302716 - DNA, 25 bp, Mus musculus
cacaccttggcgacagtggccttgt

SEQ ID NO: 302717 - DNA, 25 bp, Mus musculus
cacaccttggcgtcagtggccttgt

SEQ ID NO: 302718 - DNA, 25 bp, Mus musculus
cacaccttgtataacccaaatgccg

SEQ ID NO: 302719 - DNA, 25 bp, Mus musculus
cacaccttgtattacccaaatgccg

SEQ ID NO: 302720 - DNA, 25 bp, Mus musculus
cacacctttaaaactggcattcagg

SEQ ID NO: 302721 - DNA, 25 bp, Mus musculus
cacacctttaaatctggcattcagg

SEQ ID NO: 302722 - DNA, 25 bp, Mus musculus
cacaccttttaacattagcctggat

SEQ ID NO: 302723 - DNA, 25 bp, Mus musculus
cacaccttttaagattagcctggat

SEQ ID NO: 302724 - DNA, 25 bp, Mus musculus
cacacgaactctaactctcttgtaa

SEQ ID NO: 302725 - DNA, 25 bp, Mus musculus
cacacgaactcttactctcttgtaa

SEQ ID NO: 302726 - DNA, 25 bp, Mus musculus
cacacgaagagtaggagagctggac

SEQ ID NO: 302727 - DNA, 25 bp, Mus musculus
cacacgaagagttggagagctggac

SEQ ID NO: 302728 - DNA, 25 bp, Mus musculus
cacacgaagttgaaagctgcttata

SEQ ID NO: 302729 - DNA, 25 bp, Mus musculus
cacacgaagttgtaagctgcttata

SEQ ID NO: 302730 - DNA, 25 bp, Mus musculus
cacacgaattggagcctgagaagga

SEQ ID NO: 302731 - DNA, 25 bp, Mus musculus
cacacgaattggtgcctgagaagga

SEQ ID NO: 302732 - DNA, 25 bp, Mus musculus
cacacgacgaatcccagacacggat

SEQ ID NO: 302733 - DNA, 25 bp, Mus musculus
cacacgacgaatgccagacacggat

SEQ ID NO: 302734 - DNA, 25 bp, Mus musculus
cacacgagtcacctaaggacgacat

SEQ ID NO: 302735 - DNA, 25 bp, Mus musculus
cacacgagtcacgtaaggacgacat

SEQ ID NO: 302736 - DNA, 25 bp, Mus musculus
cacacgatgaggatggcagctggtc

SEQ ID NO: 302737 - DNA, 25 bp, Mus musculus
cacacgatgaggttggcagctggtc

SEQ ID NO: 302738 - DNA, 25 bp, Mus musculus
cacacgatggcccagtatccttggt

SEQ ID NO: 302739 - DNA, 25 bp, Mus musculus
cacacgatggccgagtatccttggt

SEQ ID NO: 302740 - DNA, 25 bp, Mus musculus
cacacgcaactgactggtgggtcag

SEQ ID NO: 302741 - DNA, 25 bp, Mus musculus
cacacgcaactgtctggtgggtcag

SEQ ID NO: 302742 - DNA, 25 bp, Mus musculus
cacacgcaagtaactcgtggactgt

SEQ ID NO: 302743 - DNA, 25 bp, Mus musculus
cacacgcaagtatctcgtggactgt

SEQ ID NO: 302744 - DNA, 25 bp, Mus musculus
cacacgcactttcggaagcttctac

SEQ ID NO: 302745 - DNA, 25 bp, Mus musculus
cacacgcactttgggaagcttctac

SEQ ID NO: 302746 - DNA, 25 bp, Mus musculus
cacacgccagtgagtgagaccacac

SEQ ID NO: 302747 - DNA, 25 bp, Mus musculus
cacacgccagtgtgtgagaccacac

SEQ ID NO: 302748 - DNA, 25 bp, Mus musculus
cacacgccattgatctatgccttaa

SEQ ID NO: 302749 - DNA, 25 bp, Mus musculus
cacacgccattgttctatgccttaa

SEQ ID NO: 302750 - DNA, 25 bp, Mus musculus
cacacgctgctccaacaatcaaaag

SEQ ID NO: 302751 - DNA, 25 bp, Mus musculus
cacacgctgctcgaacaatcaaaag

SEQ ID NO: 302752 - DNA, 25 bp, Mus musculus
cacacgctttgtatggacgcggagt

SEQ ID NO: 302753 - DNA, 25 bp, Mus musculus
cacacgctttgtttggacgcggagt

SEQ ID NO: 302754 - DNA, 25 bp, Mus musculus
cacacggactgtccgccaggtgttc

SEQ ID NO: 302755 - DNA, 25 bp, Mus musculus
cacacggactgtgcgccaggtgttc

SEQ ID NO: 302756 - DNA, 25 bp, Mus musculus
cacacggcaaatcgacacttttcaa

SEQ ID NO: 302757 - DNA, 25 bp, Mus musculus
cacacggcaaatggacacttttcaa

SEQ ID NO: 302758 - DNA, 25 bp, Mus musculus
cacacggccggaaatttcatctggt

SEQ ID NO: 302759 - DNA, 25 bp, Mus musculus
cacacggccggatatttcatctggt

SEQ ID NO: 302760 - DNA, 25 bp, Mus musculus
cacacggctggtactcgagaaagtt

SEQ ID NO: 302761 - DNA, 25 bp, Mus musculus
cacacggctggttctcgagaaagtt

SEQ ID NO: 302762 - DNA, 25 bp, Mus musculus
cacacgggcacgcttggaaactggc

SEQ ID NO: 302763 - DNA, 25 bp, Mus musculus
cacacgggcacggttggaaactggc

SEQ ID NO: 302764 - DNA, 25 bp, Mus musculus
cacacgggcgagaagaagttcagct

SEQ ID NO: 302765 - DNA, 25 bp, Mus musculus
cacacgggcgagtagaagttcagct

SEQ ID NO: 302766 - DNA, 25 bp, Mus musculus
cacacgggctccactgggatgcgaa

SEQ ID NO: 302767 - DNA, 25 bp, Mus musculus
cacacgggctcctctgggatgcgaa

SEQ ID NO: 302768 - DNA, 25 bp, Mus musculus
cacacggtcgtgaactcgtgcagtg

SEQ ID NO: 302769 - DNA, 25 bp, Mus musculus
cacacggtcgtgtactcgtgcagtg

SEQ ID NO: 302770 - DNA, 25 bp, Mus musculus
cacacggttctgagttggttccttt

SEQ ID NO: 302771 - DNA, 25 bp, Mus musculus
cacacggttctgtgttggttccttt

SEQ ID NO: 302772 - DNA, 25 bp, Mus musculus
cacacggtttctagtactttacgag

SEQ ID NO: 302773 - DNA, 25 bp, Mus musculus
cacacggtttcttgtactttacgag

SEQ ID NO: 302774 - DNA, 25 bp, Mus musculus
cacacgtaagcacggagccgcaggt

SEQ ID NO: 302775 - DNA, 25 bp, Mus musculus
cacacgtaagcagggagccgcaggt

SEQ ID NO: 302776 - DNA, 25 bp, Mus musculus
cacacgtcctctaaatgcttggtta

SEQ ID NO: 302777 - DNA, 25 bp, Mus musculus
cacacgtcctcttaatgcttggtta

SEQ ID NO: 302778 - DNA, 25 bp, Mus musculus
cacacgtggcaactgaattcacaca

SEQ ID NO: 302779 - DNA, 25 bp, Mus musculus
cacacgtggcaagtgaattcacaca

SEQ ID NO: 302780 - DNA, 25 bp, Mus musculus
cacacgtggcctccatgttgctgct

SEQ ID NO: 302781 - DNA, 25 bp, Mus musculus
cacacgtggcctgcatgttgctgct

SEQ ID NO: 302782 - DNA, 25 bp, Mus musculus
cacacgtgtgtaactcaagggactt

SEQ ID NO: 302783 - DNA, 25 bp, Mus musculus
cacacgtgtgtatctcaagggactt

SEQ ID NO: 302784 - DNA, 25 bp, Mus musculus
cacacgtgtgtccatactcaaacat

SEQ ID NO: 302785 - DNA, 25 bp, Mus musculus
cacacgtgtgtcgatactcaaacat

SEQ ID NO: 302786 - DNA, 25 bp, Mus musculus
cacacgttgcaaacagtgggactgt

SEQ ID NO: 302787 - DNA, 25 bp, Mus musculus
cacacgttgcaatcagtgggactgt

SEQ ID NO: 302788 - DNA, 25 bp, Mus musculus
cacacgtttatacggatttcggatt

SEQ ID NO: 302789 - DNA, 25 bp, Mus musculus
cacacgtttatagggatttcggatt

SEQ ID NO: 302790 - DNA, 25 bp, Mus musculus
cacacgtttcagactccttttttgg

SEQ ID NO: 302791 - DNA, 25 bp, Mus musculus
cacacgtttcagtctccttttttgg

SEQ ID NO: 302792 - DNA, 25 bp, Mus musculus
cacacgtttgagaccactgcagcta

SEQ ID NO: 302793 - DNA, 25 bp, Mus musculus
cacacgtttgagtccactgcagcta

SEQ ID NO: 302794 - DNA, 25 bp, Mus musculus
cacacgtttggcatgctgggttcaa

SEQ ID NO: 302795 - DNA, 25 bp, Mus musculus
cacacgtttggcttgctgggttcaa

SEQ ID NO: 302796 - DNA, 25 bp, Mus musculus
cacactaaatcacagcacagcggtt

SEQ ID NO: 302797 - DNA, 25 bp, Mus musculus
cacactaaatcagagcacagcggtt

SEQ ID NO: 302798 - DNA, 25 bp, Mus musculus
cacactacacttattggcagttcga

SEQ ID NO: 302799 - DNA, 25 bp, Mus musculus
cacactacactttttggcagttcga

SEQ ID NO: 302800 - DNA, 25 bp, Mus musculus
cacactacagggagagggcctgagt

SEQ ID NO: 302801 - DNA, 25 bp, Mus musculus
cacactacagggatcttgttggcct

SEQ ID NO: 302802 - DNA, 25 bp, Mus musculus
cacactacagggtgagggcctgagt

SEQ ID NO: 302803 - DNA, 25 bp, Mus musculus
cacactacagggttcttgttggcct

SEQ ID NO: 302804 - DNA, 25 bp, Mus musculus
cacactacagtcctatggcactggg

SEQ ID NO: 302805 - DNA, 25 bp, Mus musculus
cacactacagtcgtatggcactggg

SEQ ID NO: 302806 - DNA, 25 bp, Mus musculus
cacactaccaacacatctgatacag

SEQ ID NO: 302807 - DNA, 25 bp, Mus musculus
cacactaccaactcatctgatacag

SEQ ID NO: 302808 - DNA, 25 bp, Mus musculus
cacactacggaccttaagtttctct

SEQ ID NO: 302809 - DNA, 25 bp, Mus musculus
cacactacggacgttaagtttctct

SEQ ID NO: 302810 - DNA, 25 bp, Mus musculus
cacactactccaagatggtcttcga

SEQ ID NO: 302811 - DNA, 25 bp, Mus musculus
cacactactccatgatggtcttcga

SEQ ID NO: 302812 - DNA, 25 bp, Mus musculus
cacactagtggaagacgtcgggtct

SEQ ID NO: 302813 - DNA, 25 bp, Mus musculus
cacactagtggatgacgtcgggtct

SEQ ID NO: 302814 - DNA, 25 bp, Mus musculus
cacactataagaattgtgtcctggg

SEQ ID NO: 302815 - DNA, 25 bp, Mus musculus
cacactataagatttgtgtcctggg

SEQ ID NO: 302816 - DNA, 25 bp, Mus musculus
cacactatactgcagggatatcatt

SEQ ID NO: 302817 - DNA, 25 bp, Mus musculus
cacactatactggagggatatcatt

SEQ ID NO: 302818 - DNA, 25 bp, Mus musculus
cacactattcctcttgatttctttc

SEQ ID NO: 302819 - DNA, 25 bp, Mus musculus
cacactattcctgttgatttctttc

SEQ ID NO: 302820 - DNA, 25 bp, Mus musculus
cacactatttcccacatgtatatct

SEQ ID NO: 302821 - DNA, 25 bp, Mus musculus
cacactatttccgacatgtatatct

SEQ ID NO: 302822 - DNA, 25 bp, Mus musculus
cacactcacctgattatacacaact

SEQ ID NO: 302823 - DNA, 25 bp, Mus musculus
cacactcacctgtttatacacaact

SEQ ID NO: 302824 - DNA, 25 bp, Mus musculus
cacactcacgttccagagacagctg

SEQ ID NO: 302825 - DNA, 25 bp, Mus musculus
cacactcacgttgcagagacagctg

SEQ ID NO: 302826 - DNA, 25 bp, Mus musculus
cacactcactctaaggaggtccagt

SEQ ID NO: 302827 - DNA, 25 bp, Mus musculus
cacactcactcttaggaggtccagt

SEQ ID NO: 302828 - DNA, 25 bp, Mus musculus
cacactcactgacttacctgtagaa

SEQ ID NO: 302829 - DNA, 25 bp, Mus musculus
cacactcactgagttacctgtagaa

SEQ ID NO: 302830 - DNA, 25 bp, Mus musculus
cacactcagtacaaattcggtcaca

SEQ ID NO: 302831 - DNA, 25 bp, Mus musculus
cacactcagtactaattcggtcaca

SEQ ID NO: 302832 - DNA, 25 bp, Mus musculus
cacactcataaactgcttgcgcaat

SEQ ID NO: 302833 - DNA, 25 bp, Mus musculus
cacactcataaagtgcttgcgcaat

SEQ ID NO: 302834 - DNA, 25 bp, Mus musculus
cacactccaaataacaaaaatcctt

SEQ ID NO: 302835 - DNA, 25 bp, Mus musculus
cacactccaaattacaaaaatcctt

SEQ ID NO: 302836 - DNA, 25 bp, Mus musculus
cacactccactcactgatttgctgt

SEQ ID NO: 302837 - DNA, 25 bp, Mus musculus
cacactccactctctgatttgctgt

SEQ ID NO: 302838 - DNA, 25 bp, Mus musculus
cacactccagagaccattaacaaca

SEQ ID NO: 302839 - DNA, 25 bp, Mus musculus
cacactccagagtccattaacaaca

SEQ ID NO: 302840 - DNA, 25 bp, Mus musculus
cacactccagatctgcagcagcaat

SEQ ID NO: 302841 - DNA, 25 bp, Mus musculus
cacactccagatgtgcagcagcaat

SEQ ID NO: 302842 - DNA, 25 bp, Mus musculus
cacactcctaatacttctttcagac

SEQ ID NO: 302843 - DNA, 25 bp, Mus musculus
cacactcctaattcttctttcagac

SEQ ID NO: 302844 - DNA, 25 bp, Mus musculus
cacactcctcgtacttattcttggg

SEQ ID NO: 302845 - DNA, 25 bp, Mus musculus
cacactcctcgttcttattcttggg

SEQ ID NO: 302846 - DNA, 25 bp, Mus musculus
cacactccttggagatagcgcgaga

SEQ ID NO: 302847 - DNA, 25 bp, Mus musculus
cacactccttggtgatagcgcgaga

SEQ ID NO: 302848 - DNA, 25 bp, Mus musculus
cacactcgggagatcttgacttcat

SEQ ID NO: 302849 - DNA, 25 bp, Mus musculus
cacactcgggagttcttgacttcat

SEQ ID NO: 302850 - DNA, 25 bp, Mus musculus
cacactcgttggaatctttcccagg

SEQ ID NO: 302851 - DNA, 25 bp, Mus musculus
cacactcgttggtatctttcccagg

SEQ ID NO: 302852 - DNA, 25 bp, Mus musculus
cacactctactcacaaccagatatt

SEQ ID NO: 302853 - DNA, 25 bp, Mus musculus
cacactctactctcaaccagatatt

SEQ ID NO: 302854 - DNA, 25 bp, Mus musculus
cacactctcctcaggatagtgataa

SEQ ID NO: 302855 - DNA, 25 bp, Mus musculus
cacactctcctctggatagtgataa

SEQ ID NO: 302856 - DNA, 25 bp, Mus musculus
cacactctctgaaagggacacacat

SEQ ID NO: 302857 - DNA, 25 bp, Mus musculus
cacactctctgatagggacacacat

SEQ ID NO: 302858 - DNA, 25 bp, Mus musculus
cacactctgcatctgactggtcaga

SEQ ID NO: 302859 - DNA, 25 bp, Mus musculus
cacactctgcatgtgactggtcaga

SEQ ID NO: 302860 - DNA, 25 bp, Mus musculus
cacactgaacatatagctgtacttt

SEQ ID NO: 302861 - DNA, 25 bp, Mus musculus
cacactgaacatttagctgtacttt

SEQ ID NO: 302862 - DNA, 25 bp, Mus musculus
cacactgaagtgcaagcctgtctat

SEQ ID NO: 302863 - DNA, 25 bp, Mus musculus
cacactgaagtggaagcctgtctat

SEQ ID NO: 302864 - DNA, 25 bp, Mus musculus
cacactgagcaacgtcatcttttaa

SEQ ID NO: 302865 - DNA, 25 bp, Mus musculus
cacactgagcaaggtcatcttttaa

SEQ ID NO: 302866 - DNA, 25 bp, Mus musculus
cacactgagtgacctggcgagcgac

SEQ ID NO: 302867 - DNA, 25 bp, Mus musculus
cacactgagtgagctggcgagcgac

SEQ ID NO: 302868 - DNA, 25 bp, Mus musculus
cacactgagtggaaacttttctgaa

SEQ ID NO: 302869 - DNA, 25 bp, Mus musculus
cacactgagtggtaacttttctgaa

SEQ ID NO: 302870 - DNA, 25 bp, Mus musculus
cacactgatagtccagagggcctga

SEQ ID NO: 302871 - DNA, 25 bp, Mus musculus
cacactgatagtgcagagggcctga

SEQ ID NO: 302872 - DNA, 25 bp, Mus musculus
cacactgcaaacagggacttccaga

SEQ ID NO: 302873 - DNA, 25 bp, Mus musculus
cacactgcaaactgggacttccaga

SEQ ID NO: 302874 - DNA, 25 bp, Mus musculus
cacactgcagcactgagacacgagt

SEQ ID NO: 302875 - DNA, 25 bp, Mus musculus
cacactgcagcagtgagacacgagt

SEQ ID NO: 302876 - DNA, 25 bp, Mus musculus
cacactgccaggaccattggtgagg

SEQ ID NO: 302877 - DNA, 25 bp, Mus musculus
cacactgccaggtccattggtgagg

SEQ ID NO: 302878 - DNA, 25 bp, Mus musculus
cacactgctcctcttagggaactat

SEQ ID NO: 302879 - DNA, 25 bp, Mus musculus
cacactgctcctgttagggaactat

SEQ ID NO: 302880 - DNA, 25 bp, Mus musculus
cacactgctgaaaccttcaggttac

SEQ ID NO: 302881 - DNA, 25 bp, Mus musculus
cacactgctgaatccttcaggttac

SEQ ID NO: 302882 - DNA, 25 bp, Mus musculus
cacactgctgtcattaccatcaaag

SEQ ID NO: 302883 - DNA, 25 bp, Mus musculus
cacactgctgtctttaccatcaaag

SEQ ID NO: 302884 - DNA, 25 bp, Mus musculus
cacactgctgtgagagtgggttaac

SEQ ID NO: 302885 - DNA, 25 bp, Mus musculus
cacactgctgtgtgagtgggttaac

SEQ ID NO: 302886 - DNA, 25 bp, Mus musculus
cacactgcttgtaactgactactct

SEQ ID NO: 302887 - DNA, 25 bp, Mus musculus
cacactgcttgttactgactactct

SEQ ID NO: 302888 - DNA, 25 bp, Mus musculus
cacactggaaatagtacattttttt

SEQ ID NO: 302889 - DNA, 25 bp, Mus musculus
cacactggaaattgtacattttttt

SEQ ID NO: 302890 - DNA, 25 bp, Mus musculus
cacactggacacactgctttttatc

SEQ ID NO: 302891 - DNA, 25 bp, Mus musculus
cacactggacactctgctttttatc

SEQ ID NO: 302892 - DNA, 25 bp, Mus musculus
cacactggaggtatagccttctgaa

SEQ ID NO: 302893 - DNA, 25 bp, Mus musculus
cacactggaggtttagccttctgaa

SEQ ID NO: 302894 - DNA, 25 bp, Mus musculus
cacactggcataactgtgcacatgt

SEQ ID NO: 302895 - DNA, 25 bp, Mus musculus
cacactggcatatctgtgcacatgt

SEQ ID NO: 302896 - DNA, 25 bp, Mus musculus
cacactggctacacgggattttgca

SEQ ID NO: 302897 - DNA, 25 bp, Mus musculus
cacactggctactcgggattttgca

SEQ ID NO: 302898 - DNA, 25 bp, Mus musculus
cacactgggctgacttttcagagag

SEQ ID NO: 302899 - DNA, 25 bp, Mus musculus
cacactgggctgtcttttcagagag

SEQ ID NO: 302900 - DNA, 25 bp, Mus musculus
cacactgggtaacggcagctatggg

SEQ ID NO: 302901 - DNA, 25 bp, Mus musculus
cacactgggtaagggcagctatggg

SEQ ID NO: 302902 - DNA, 25 bp, Mus musculus
cacactgggtttatcgctggttggt

SEQ ID NO: 302903 - DNA, 25 bp, Mus musculus
cacactgggtttttcgctggttggt

SEQ ID NO: 302904 - DNA, 25 bp, Mus musculus
cacactggtcagcagtcgtatgtct

SEQ ID NO: 302905 - DNA, 25 bp, Mus musculus
cacactggtcaggagtcgtatgtct

SEQ ID NO: 302906 - DNA, 25 bp, Mus musculus
cacactggtgaaaatatttcccgta

SEQ ID NO: 302907 - DNA, 25 bp, Mus musculus
cacactggtgaacacggtggttgaa

SEQ ID NO: 302908 - DNA, 25 bp, Mus musculus
cacactggtgaagacggtggttgaa

SEQ ID NO: 302909 - DNA, 25 bp, Mus musculus
cacactggtgaatatatttcccgta

SEQ ID NO: 302910 - DNA, 25 bp, Mus musculus
cacactggtgagactatgggaaggc

SEQ ID NO: 302911 - DNA, 25 bp, Mus musculus
cacactggtgagtctatgggaaggc

SEQ ID NO: 302912 - DNA, 25 bp, Mus musculus
cacactggtgtgactgatttccaac

SEQ ID NO: 302913 - DNA, 25 bp, Mus musculus
cacactggtgtgtctgatttccaac

SEQ ID NO: 302914 - DNA, 25 bp, Mus musculus
cacactggtttcatgtgggcatggt

SEQ ID NO: 302915 - DNA, 25 bp, Mus musculus
cacactggtttcttgtgggcatggt

SEQ ID NO: 302916 - DNA, 25 bp, Mus musculus
cacactgtaaacccctgggtaactg

SEQ ID NO: 302917 - DNA, 25 bp, Mus musculus
cacactgtaaacgcctgggtaactg

SEQ ID NO: 302918 - DNA, 25 bp, Mus musculus
cacactgtacaaactgagacaccta

SEQ ID NO: 302919 - DNA, 25 bp, Mus musculus
cacactgtacaatctgagacaccta

SEQ ID NO: 302920 - DNA, 25 bp, Mus musculus
cacactgtagtcacggtttctggga

SEQ ID NO: 302921 - DNA, 25 bp, Mus musculus
cacactgtagtcatcaccttgattg

SEQ ID NO: 302922 - DNA, 25 bp, Mus musculus
cacactgtagtctcggtttctggga

SEQ ID NO: 302923 - DNA, 25 bp, Mus musculus
cacactgtagtcttcaccttgattg

SEQ ID NO: 302924 - DNA, 25 bp, Mus musculus
cacactgtatgcaccatatgccata

SEQ ID NO: 302925 - DNA, 25 bp, Mus musculus
cacactgtatgctccatatgccata

SEQ ID NO: 302926 - DNA, 25 bp, Mus musculus
cacactgtctgtcagttactcttct

SEQ ID NO: 302927 - DNA, 25 bp, Mus musculus
cacactgtctgtgagttactcttct

SEQ ID NO: 302928 - DNA, 25 bp, Mus musculus
cacactgtcttgaatcatggctgga

SEQ ID NO: 302929 - DNA, 25 bp, Mus musculus
cacactgtcttgcttgtagagcaca

SEQ ID NO: 302930 - DNA, 25 bp, Mus musculus
cacactgtcttggttgtagagcaca

SEQ ID NO: 302931 - DNA, 25 bp, Mus musculus
cacactgtcttgtatcatggctgga

SEQ ID NO: 302932 - DNA, 25 bp, Mus musculus
cacactgtgagcaaggatgcctgac

SEQ ID NO: 302933 - DNA, 25 bp, Mus musculus
cacactgtgagctaggatgcctgac

SEQ ID NO: 302934 - DNA, 25 bp, Mus musculus
cacactgtgctacggtgggtgctca

SEQ ID NO: 302935 - DNA, 25 bp, Mus musculus
cacactgtgctagggtgggtgctca

SEQ ID NO: 302936 - DNA, 25 bp, Mus musculus
cacactgtgtccaatagtatgaagc

SEQ ID NO: 302937 - DNA, 25 bp, Mus musculus
cacactgtgtcctatagtatgaagc

SEQ ID NO: 302938 - DNA, 25 bp, Mus musculus
cacactgtgtttatgttctgccttt

SEQ ID NO: 302939 - DNA, 25 bp, Mus musculus
cacactgtgtttttgttctgccttt

SEQ ID NO: 302940 - DNA, 25 bp, Mus musculus
cacactgttcgtagtcatctttatc

SEQ ID NO: 302941 - DNA, 25 bp, Mus musculus
cacactgttcgttgtcatctttatc

SEQ ID NO: 302942 - DNA, 25 bp, Mus musculus
cacactgttctcacagactacatgc

SEQ ID NO: 302943 - DNA, 25 bp, Mus musculus
cacactgttctctcagactacatgc

SEQ ID NO: 302944 - DNA, 25 bp, Mus musculus
cacactgttgagatggacacactgt

SEQ ID NO: 302945 - DNA, 25 bp, Mus musculus
cacactgttgagttggacacactgt

SEQ ID NO: 302946 - DNA, 25 bp, Mus musculus
cacactgttgctcttggtcttcaag

SEQ ID NO: 302947 - DNA, 25 bp, Mus musculus
cacactgttgctgttggtcttcaag

SEQ ID NO: 302948 - DNA, 25 bp, Mus musculus
cacactgttgtgcttcgggtgaact

SEQ ID NO: 302949 - DNA, 25 bp, Mus musculus
cacactgttgtggttcgggtgaact

SEQ ID NO: 302950 - DNA, 25 bp, Mus musculus
cacactgttttcaatttagggatga

SEQ ID NO: 302951 - DNA, 25 bp, Mus musculus
cacactgttttctatttagggatga

SEQ ID NO: 302952 - DNA, 25 bp, Mus musculus
cacacttaaagaagaaagatgcctt

SEQ ID NO: 302953 - DNA, 25 bp, Mus musculus
cacacttaaagatgaaagatgcctt

SEQ ID NO: 302954 - DNA, 25 bp, Mus musculus
cacacttaagtcaatggcgggatca

SEQ ID NO: 302955 - DNA, 25 bp, Mus musculus
cacacttaagtctatggcgggatca

SEQ ID NO: 302956 - DNA, 25 bp, Mus musculus
cacacttaatgcctgccttgaagac

SEQ ID NO: 302957 - DNA, 25 bp, Mus musculus
cacacttaatgcgtgccttgaagac

SEQ ID NO: 302958 - DNA, 25 bp, Mus musculus
cacacttagaagcagatcccacatc

SEQ ID NO: 302959 - DNA, 25 bp, Mus musculus
cacacttagaaggagatcccacatc

SEQ ID NO: 302960 - DNA, 25 bp, Mus musculus
cacacttagggcatctagtcagttg

SEQ ID NO: 302961 - DNA, 25 bp, Mus musculus
cacacttagggcttctagtcagttg

SEQ ID NO: 302962 - DNA, 25 bp, Mus musculus
cacacttcctatcgcctcttcaaac

SEQ ID NO: 302963 - DNA, 25 bp, Mus musculus
cacacttcctatggcctcttcaaac

SEQ ID NO: 302964 - DNA, 25 bp, Mus musculus
cacacttcctgaaaaccgttcaaag

SEQ ID NO: 302965 - DNA, 25 bp, Mus musculus
cacacttcctgataaccgttcaaag

SEQ ID NO: 302966 - DNA, 25 bp, Mus musculus
cacacttcctgtcattggcttatac

SEQ ID NO: 302967 - DNA, 25 bp, Mus musculus
cacacttcctgtgattggcttatac

SEQ ID NO: 302968 - DNA, 25 bp, Mus musculus
cacacttcgagcacagaaaggagtt

SEQ ID NO: 302969 - DNA, 25 bp, Mus musculus
cacacttcgagctcagaaaggagtt

SEQ ID NO: 302970 - DNA, 25 bp, Mus musculus
cacacttctcccatttatttagcag

SEQ ID NO: 302971 - DNA, 25 bp, Mus musculus
cacacttctcccttttatttagcag

SEQ ID NO: 302972 - DNA, 25 bp, Mus musculus
cacacttgctgcatctagttgtcaa

SEQ ID NO: 302973 - DNA, 25 bp, Mus musculus
cacacttgctgcttctagttgtcaa

SEQ ID NO: 302974 - DNA, 25 bp, Mus musculus
cacacttgctttacagttactcatg

SEQ ID NO: 302975 - DNA, 25 bp, Mus musculus
cacacttgcttttcagttactcatg

SEQ ID NO: 302976 - DNA, 25 bp, Mus musculus
cacacttggcatcggccgtctgatt

SEQ ID NO: 302977 - DNA, 25 bp, Mus musculus
cacacttggcatgggccgtctgatt

SEQ ID NO: 302978 - DNA, 25 bp, Mus musculus
cacacttggtaaacagacatgcatg

SEQ ID NO: 302979 - DNA, 25 bp, Mus musculus
cacacttggtaatcagacatgcatg

SEQ ID NO: 302980 - DNA, 25 bp, Mus musculus
cacacttggtggctgagtactttat

SEQ ID NO: 302981 - DNA, 25 bp, Mus musculus
cacacttggtggctgcacgcagagc

SEQ ID NO: 302982 - DNA, 25 bp, Mus musculus
cacacttggtgggtgagtactttat

SEQ ID NO: 302983 - DNA, 25 bp, Mus musculus
cacacttggtgggtgcacgcagagc

SEQ ID NO: 302984 - DNA, 25 bp, Mus musculus
cacacttgtgtgatcaggttccgac

SEQ ID NO: 302985 - DNA, 25 bp, Mus musculus
cacacttgtgtgttcaggttccgac

SEQ ID NO: 302986 - DNA, 25 bp, Mus musculus
cacacttgtgttaccagcactgaac

SEQ ID NO: 302987 - DNA, 25 bp, Mus musculus
cacacttgtgtttccagcactgaac

SEQ ID NO: 302988 - DNA, 25 bp, Mus musculus
cacacttgttgtagttttggccctg

SEQ ID NO: 302989 - DNA, 25 bp, Mus musculus
cacacttgttgttgttttggccctg

SEQ ID NO: 302990 - DNA, 25 bp, Mus musculus
cacactttcgtaactctgtaattga

SEQ ID NO: 302991 - DNA, 25 bp, Mus musculus
cacactttcgtatctctgtaattga

SEQ ID NO: 302992 - DNA, 25 bp, Mus musculus
cacactttcttgacctctgatatta

SEQ ID NO: 302993 - DNA, 25 bp, Mus musculus
cacactttcttgtcctctgatatta

SEQ ID NO: 302994 - DNA, 25 bp, Mus musculus
cacactttgaggctccgaaggtatt

SEQ ID NO: 302995 - DNA, 25 bp, Mus musculus
cacactttgagggtccgaaggtatt

SEQ ID NO: 302996 - DNA, 25 bp, Mus musculus
cacactttggatagagtcatttcta

SEQ ID NO: 302997 - DNA, 25 bp, Mus musculus
cacactttggattgagtcatttcta

SEQ ID NO: 302998 - DNA, 25 bp, Mus musculus
cacacttttattatgggacgcttcc

SEQ ID NO: 302999 - DNA, 25 bp, Mus musculus
cacacttttattttgggacgcttcc

SEQ ID NO: 303000 - DNA, 25 bp, Mus musculus
cacacttttcataccctgagctatt

SEQ ID NO: 303001 - DNA, 25 bp, Mus musculus
cacacttttcatatcagcagtcagt

SEQ ID NO: 303002 - DNA, 25 bp, Mus musculus
cacacttttcattccctgagctatt

SEQ ID NO: 303003 - DNA, 25 bp, Mus musculus
cacacttttcatttcagcagtcagt

SEQ ID NO: 303004 - DNA, 25 bp, Mus musculus
cacacttttctgacccttcttaaag

SEQ ID NO: 303005 - DNA, 25 bp, Mus musculus
cacacttttctgtcccttcttaaag

SEQ ID NO: 303006 - DNA, 25 bp, Mus musculus
cacagaaaacaacctgttaattctt

SEQ ID NO: 303007 - DNA, 25 bp, Mus musculus
cacagaaaacaagctgttaattctt

SEQ ID NO: 303008 - DNA, 25 bp, Mus musculus
cacagaaacgtgcttaatgtattaa

SEQ ID NO: 303009 - DNA, 25 bp, Mus musculus
cacagaaacgtggttaatgtattaa

SEQ ID NO: 303010 - DNA, 25 bp, Mus musculus
cacagaaactctatgcaactccact

SEQ ID NO: 303011 - DNA, 25 bp, Mus musculus
cacagaaactctttgcaactccact

SEQ ID NO: 303012 - DNA, 25 bp, Mus musculus
cacagaaatcttcgcagtggcttca

SEQ ID NO: 303013 - DNA, 25 bp, Mus musculus
cacagaaatcttggcagtggcttca

SEQ ID NO: 303014 - DNA, 25 bp, Mus musculus
cacagaacacagagccccaaggatt

SEQ ID NO: 303015 - DNA, 25 bp, Mus musculus
cacagaacacagtgccccaaggatt

SEQ ID NO: 303016 - DNA, 25 bp, Mus musculus
cacagaaccattcttacgctttgta

SEQ ID NO: 303017 - DNA, 25 bp, Mus musculus
cacagaaccattgttacgctttgta

SEQ ID NO: 303018 - DNA, 25 bp, Mus musculus
cacagaacccacagcttgatataag

SEQ ID NO: 303019 - DNA, 25 bp, Mus musculus
cacagaacccactgcttgatataag

SEQ ID NO: 303020 - DNA, 25 bp, Mus musculus
cacagaacgcttccatttctacaaa

SEQ ID NO: 303021 - DNA, 25 bp, Mus musculus
cacagaacgcttgcatttctacaaa

SEQ ID NO: 303022 - DNA, 25 bp, Mus musculus
cacagaactgagctgtcactcctaa

SEQ ID NO: 303023 - DNA, 25 bp, Mus musculus
cacagaactgaggtgtcactcctaa

SEQ ID NO: 303024 - DNA, 25 bp, Mus musculus
cacagaagactgatcaacccactct

SEQ ID NO: 303025 - DNA, 25 bp, Mus musculus
cacagaagactgttcaacccactct

SEQ ID NO: 303026 - DNA, 25 bp, Mus musculus
cacagaagatgcaaagatactacag

SEQ ID NO: 303027 - DNA, 25 bp, Mus musculus
cacagaagatgctaagatactacag

SEQ ID NO: 303028 - DNA, 25 bp, Mus musculus
cacagaagccttctactggcctttg

SEQ ID NO: 303029 - DNA, 25 bp, Mus musculus
cacagaagccttctggcgaagcaaa

SEQ ID NO: 303030 - DNA, 25 bp, Mus musculus
cacagaagccttgtactggcctttg

SEQ ID NO: 303031 - DNA, 25 bp, Mus musculus
cacagaagccttgtggcgaagcaaa

SEQ ID NO: 303032 - DNA, 25 bp, Mus musculus
cacagaaggctgactcgcaaggtaa

SEQ ID NO: 303033 - DNA, 25 bp, Mus musculus
cacagaaggctgtctcgcaaggtaa

SEQ ID NO: 303034 - DNA, 25 bp, Mus musculus
cacagaaggcttacctggctggcaa

SEQ ID NO: 303035 - DNA, 25 bp, Mus musculus
cacagaaggctttcctggctggcaa

SEQ ID NO: 303036 - DNA, 25 bp, Mus musculus
cacagaagggaaatccagggacgct

SEQ ID NO: 303037 - DNA, 25 bp, Mus musculus
cacagaagggaattccagggacgct

SEQ ID NO: 303038 - DNA, 25 bp, Mus musculus
cacagaagggacaggacccatacaa

SEQ ID NO: 303039 - DNA, 25 bp, Mus musculus
cacagaagggactggacccatacaa

SEQ ID NO: 303040 - DNA, 25 bp, Mus musculus
cacagaatacaacctatatgtctta

SEQ ID NO: 303041 - DNA, 25 bp, Mus musculus
cacagaatacaagctatatgtctta

SEQ ID NO: 303042 - DNA, 25 bp, Mus musculus
cacagaatcaacaagccagggttta

SEQ ID NO: 303043 - DNA, 25 bp, Mus musculus
cacagaatcaactagccagggttta

SEQ ID NO: 303044 - DNA, 25 bp, Mus musculus
cacagaatcgctacagatgaactat

SEQ ID NO: 303045 - DNA, 25 bp, Mus musculus
cacagaatcgcttcagatgaactat

SEQ ID NO: 303046 - DNA, 25 bp, Mus musculus
cacagaatgctgaaaacctgattaa

SEQ ID NO: 303047 - DNA, 25 bp, Mus musculus
cacagaatgctgtaaacctgattaa

SEQ ID NO: 303048 - DNA, 25 bp, Mus musculus
cacagaatgtttcaacaggccagat

SEQ ID NO: 303049 - DNA, 25 bp, Mus musculus
cacagaatgtttgaacaggccagat

SEQ ID NO: 303050 - DNA, 25 bp, Mus musculus
cacagaattagtatggaacttttga

SEQ ID NO: 303051 - DNA, 25 bp, Mus musculus
cacagaattagtttggaacttttga

SEQ ID NO: 303052 - DNA, 25 bp, Mus musculus
cacagacaagctcgaagggagccca

SEQ ID NO: 303053 - DNA, 25 bp, Mus musculus
cacagacaagctggaagggagccca

SEQ ID NO: 303054 - DNA, 25 bp, Mus musculus
cacagacacactattgaagctaggt

SEQ ID NO: 303055 - DNA, 25 bp, Mus musculus
cacagacacacttttgaagctaggt

SEQ ID NO: 303056 - DNA, 25 bp, Mus musculus
cacagacacgggagtggatctgagc

SEQ ID NO: 303057 - DNA, 25 bp, Mus musculus
cacagacacgggtgtggatctgagc

SEQ ID NO: 303058 - DNA, 25 bp, Mus musculus
cacagacagaaacccatttacttgg

SEQ ID NO: 303059 - DNA, 25 bp, Mus musculus
cacagacagaaagccatttacttgg

SEQ ID NO: 303060 - DNA, 25 bp, Mus musculus
cacagacattccagcctaaacttaa

SEQ ID NO: 303061 - DNA, 25 bp, Mus musculus
cacagacattcctgcctaaacttaa

SEQ ID NO: 303062 - DNA, 25 bp, Mus musculus
cacagaccagtgacgagcagccaga

SEQ ID NO: 303063 - DNA, 25 bp, Mus musculus
cacagaccagtgtcgagcagccaga

SEQ ID NO: 303064 - DNA, 25 bp, Mus musculus
cacagacccggccttcctgatttag

SEQ ID NO: 303065 - DNA, 25 bp, Mus musculus
cacagacccggcgttcctgatttag

SEQ ID NO: 303066 - DNA, 25 bp, Mus musculus
cacagacctcagagatgtgagcact

SEQ ID NO: 303067 - DNA, 25 bp, Mus musculus
cacagacctcagtgatgtgagcact

SEQ ID NO: 303068 - DNA, 25 bp, Mus musculus
cacagacctggtaccgaagacactt

SEQ ID NO: 303069 - DNA, 25 bp, Mus musculus
cacagacctggttccgaagacactt

SEQ ID NO: 303070 - DNA, 25 bp, Mus musculus
cacagacgaaggaagccagtcacaa

SEQ ID NO: 303071 - DNA, 25 bp, Mus musculus
cacagacgaaggtagccagtcacaa

SEQ ID NO: 303072 - DNA, 25 bp, Mus musculus
cacagacgactgcaggccgtgaaca

SEQ ID NO: 303073 - DNA, 25 bp, Mus musculus
cacagacgactggaggccgtgaaca

SEQ ID NO: 303074 - DNA, 25 bp, Mus musculus
cacagactacatccctcagattctt

SEQ ID NO: 303075 - DNA, 25 bp, Mus musculus
cacagactacatgcctcagattctt

SEQ ID NO: 303076 - DNA, 25 bp, Mus musculus
cacagactcagcatctctgatccat

SEQ ID NO: 303077 - DNA, 25 bp, Mus musculus
cacagactcagcttctctgatccat

SEQ ID NO: 303078 - DNA, 25 bp, Mus musculus
cacagactgcttccttttgctggaa

SEQ ID NO: 303079 - DNA, 25 bp, Mus musculus
cacagactgcttgcttttgctggaa

SEQ ID NO: 303080 - DNA, 25 bp, Mus musculus
cacagactggaaaacaattgggaca

SEQ ID NO: 303081 - DNA, 25 bp, Mus musculus
cacagactggaatacaattgggaca

SEQ ID NO: 303082 - DNA, 25 bp, Mus musculus
cacagactgggcactctgtctgtcc

SEQ ID NO: 303083 - DNA, 25 bp, Mus musculus
cacagactgggctctctgtctgtcc

SEQ ID NO: 303084 - DNA, 25 bp, Mus musculus
cacagactgtttacacttcctatgt

SEQ ID NO: 303085 - DNA, 25 bp, Mus musculus
cacagactgttttcacttcctatgt

SEQ ID NO: 303086 - DNA, 25 bp, Mus musculus
cacagacttcccactgtacggttgt

SEQ ID NO: 303087 - DNA, 25 bp, Mus musculus
cacagacttccctctgtacggttgt

SEQ ID NO: 303088 - DNA, 25 bp, Mus musculus
cacagacttcctaccaggtttgaac

SEQ ID NO: 303089 - DNA, 25 bp, Mus musculus
cacagacttccttccaggtttgaac

SEQ ID NO: 303090 - DNA, 25 bp, Mus musculus
cacagacttcttcgcatttggccat

SEQ ID NO: 303091 - DNA, 25 bp, Mus musculus
cacagacttcttggcatttggccat

SEQ ID NO: 303092 - DNA, 25 bp, Mus musculus
cacagagaaagcacgggacccttca

SEQ ID NO: 303093 - DNA, 25 bp, Mus musculus
cacagagaaagctcgggacccttca

SEQ ID NO: 303094 - DNA, 25 bp, Mus musculus
cacagagaatcccttattttgaaaa

SEQ ID NO: 303095 - DNA, 25 bp, Mus musculus
cacagagaatccgttattttgaaaa

SEQ ID NO: 303096 - DNA, 25 bp, Mus musculus
cacagagacacaccttgacacaatg

SEQ ID NO: 303097 - DNA, 25 bp, Mus musculus
cacagagacacagcttgacacaatg

SEQ ID NO: 303098 - DNA, 25 bp, Mus musculus
cacagagacactatgccacatctga

SEQ ID NO: 303099 - DNA, 25 bp, Mus musculus
cacagagacactttgccacatctga

SEQ ID NO: 303100 - DNA, 25 bp, Mus musculus
cacagagacctcactggacaccagt

SEQ ID NO: 303101 - DNA, 25 bp, Mus musculus
cacagagacctctctggacaccagt

SEQ ID NO: 303102 - DNA, 25 bp, Mus musculus
cacagagactgtagctcagcagcat

SEQ ID NO: 303103 - DNA, 25 bp, Mus musculus
cacagagactgttgctcagcagcat

SEQ ID NO: 303104 - DNA, 25 bp, Mus musculus
cacagagactttaaggtgggactgt

SEQ ID NO: 303105 - DNA, 25 bp, Mus musculus
cacagagacttttaggtgggactgt

SEQ ID NO: 303106 - DNA, 25 bp, Mus musculus
cacagagagcctcctggagctacag

SEQ ID NO: 303107 - DNA, 25 bp, Mus musculus
cacagagagcctgctggagctacag

SEQ ID NO: 303108 - DNA, 25 bp, Mus musculus
cacagagaggaaacccttctgccaa

SEQ ID NO: 303109 - DNA, 25 bp, Mus musculus
cacagagaggaatcccttctgccaa

SEQ ID NO: 303110 - DNA, 25 bp, Mus musculus
cacagagaggtgctgccaagatgtt

SEQ ID NO: 303111 - DNA, 25 bp, Mus musculus
cacagagaggtggtgccaagatgtt

SEQ ID NO: 303112 - DNA, 25 bp, Mus musculus
cacagagatatgattgcctcagcct

SEQ ID NO: 303113 - DNA, 25 bp, Mus musculus
cacagagatatgtttgcctcagcct

SEQ ID NO: 303114 - DNA, 25 bp, Mus musculus
cacagagatattacgtcaggcattt

SEQ ID NO: 303115 - DNA, 25 bp, Mus musculus
cacagagatatttcgtcaggcattt

SEQ ID NO: 303116 - DNA, 25 bp, Mus musculus
cacagagcacaacgtcgacagaaaa

SEQ ID NO: 303117 - DNA, 25 bp, Mus musculus
cacagagcacaaggtcgacagaaaa

SEQ ID NO: 303118 - DNA, 25 bp, Mus musculus
cacagagcacgcaagtttggacggt

SEQ ID NO: 303119 - DNA, 25 bp, Mus musculus
cacagagcacgctagtttggacggt

SEQ ID NO: 303120 - DNA, 25 bp, Mus musculus
cacagagcactgagttgcctggcct

SEQ ID NO: 303121 - DNA, 25 bp, Mus musculus
cacagagcactgtgttgcctggcct

SEQ ID NO: 303122 - DNA, 25 bp, Mus musculus
cacagagcagctagtctccccagag

SEQ ID NO: 303123 - DNA, 25 bp, Mus musculus
cacagagcagcttgtctccccagag

SEQ ID NO: 303124 - DNA, 25 bp, Mus musculus
cacagagcataaacagaggcggcat

SEQ ID NO: 303125 - DNA, 25 bp, Mus musculus
cacagagcataatcagaggcggcat

SEQ ID NO: 303126 - DNA, 25 bp, Mus musculus
cacagagccctgaggacattctaag

SEQ ID NO: 303127 - DNA, 25 bp, Mus musculus
cacagagccctgtggacattctaag

SEQ ID NO: 303128 - DNA, 25 bp, Mus musculus
cacagagcctgccattgtcaaaaca

SEQ ID NO: 303129 - DNA, 25 bp, Mus musculus
cacagagcctgccttgaagagttgt

SEQ ID NO: 303130 - DNA, 25 bp, Mus musculus
cacagagcctgcgattgtcaaaaca

SEQ ID NO: 303131 - DNA, 25 bp, Mus musculus
cacagagcctgcgttgaagagttgt

SEQ ID NO: 303132 - DNA, 25 bp, Mus musculus
cacagagctataaaggccaccacga

SEQ ID NO: 303133 - DNA, 25 bp, Mus musculus
cacagagctatataggccaccacga

SEQ ID NO: 303134 - DNA, 25 bp, Mus musculus
cacagagctcaacgcacagctggat

SEQ ID NO: 303135 - DNA, 25 bp, Mus musculus
cacagagctcaaggcacagctggat

SEQ ID NO: 303136 - DNA, 25 bp, Mus musculus
cacagagctcagatttaggcagtaa

SEQ ID NO: 303137 - DNA, 25 bp, Mus musculus
cacagagctcagttttaggcagtaa

SEQ ID NO: 303138 - DNA, 25 bp, Mus musculus
cacagagctctgatcataacgttat

SEQ ID NO: 303139 - DNA, 25 bp, Mus musculus
cacagagctctgttcataacgttat

SEQ ID NO: 303140 - DNA, 25 bp, Mus musculus
cacagagctgctccggaggatccag

SEQ ID NO: 303141 - DNA, 25 bp, Mus musculus
cacagagctgctgcggaggatccag

SEQ ID NO: 303142 - DNA, 25 bp, Mus musculus
cacagagctgggacaatggtctttt

SEQ ID NO: 303143 - DNA, 25 bp, Mus musculus
cacagagctgggtcaatggtctttt

SEQ ID NO: 303144 - DNA, 25 bp, Mus musculus
cacagagctgtcatgatgccagaaa

SEQ ID NO: 303145 - DNA, 25 bp, Mus musculus
cacagagctgtcttgatgccagaaa

SEQ ID NO: 303146 - DNA, 25 bp, Mus musculus
cacagagctgttaccatcatggact

SEQ ID NO: 303147 - DNA, 25 bp, Mus musculus
cacagagctgtttccatcatggact

SEQ ID NO: 303148 - DNA, 25 bp, Mus musculus
cacagagcttcacaatcttggagaa

SEQ ID NO: 303149 - DNA, 25 bp, Mus musculus
cacagagcttcagaatcttggagaa

SEQ ID NO: 303150 - DNA, 25 bp, Mus musculus
cacagagcttgtaatggcatacaca

SEQ ID NO: 303151 - DNA, 25 bp, Mus musculus
cacagagcttgtatactgcaagaca

SEQ ID NO: 303152 - DNA, 25 bp, Mus musculus
cacagagcttgttatggcatacaca

SEQ ID NO: 303153 - DNA, 25 bp, Mus musculus
cacagagcttgtttactgcaagaca

SEQ ID NO: 303154 - DNA, 25 bp, Mus musculus
cacagagctttcctcatttggagaa

SEQ ID NO: 303155 - DNA, 25 bp, Mus musculus
cacagagctttcgtcatttggagaa

SEQ ID NO: 303156 - DNA, 25 bp, Mus musculus
cacagaggacctatgggctcatgct

SEQ ID NO: 303157 - DNA, 25 bp, Mus musculus
cacagaggacctttgggctcatgct

SEQ ID NO: 303158 - DNA, 25 bp, Mus musculus
cacagaggccagaaacgggtcgtaa

SEQ ID NO: 303159 - DNA, 25 bp, Mus musculus
cacagaggccagtaacgggtcgtaa

SEQ ID NO: 303160 - DNA, 25 bp, Mus musculus
cacagaggctctatagcaggaggca

SEQ ID NO: 303161 - DNA, 25 bp, Mus musculus
cacagaggctctttagcaggaggca

SEQ ID NO: 303162 - DNA, 25 bp, Mus musculus
cacagagggacactggcacctatga

SEQ ID NO: 303163 - DNA, 25 bp, Mus musculus
cacagagggacagtggcacctatga

SEQ ID NO: 303164 - DNA, 25 bp, Mus musculus
cacagagggataattatttcactaa

SEQ ID NO: 303165 - DNA, 25 bp, Mus musculus
cacagagggatatttatttcactaa

SEQ ID NO: 303166 - DNA, 25 bp, Mus musculus
cacagagggattaaaattggcaaac

SEQ ID NO: 303167 - DNA, 25 bp, Mus musculus
cacagagggatttaaattggcaaac

SEQ ID NO: 303168 - DNA, 25 bp, Mus musculus
cacagagggccacgtcatgaataat

SEQ ID NO: 303169 - DNA, 25 bp, Mus musculus
cacagagggccaggtcatgaataat

SEQ ID NO: 303170 - DNA, 25 bp, Mus musculus
cacagagggcctccagtcttcagtg

SEQ ID NO: 303171 - DNA, 25 bp, Mus musculus
cacagagggcctgcagtcttcagtg

SEQ ID NO: 303172 - DNA, 25 bp, Mus musculus
cacagaggtcatcccagggcttgga

SEQ ID NO: 303173 - DNA, 25 bp, Mus musculus
cacagaggtcatgccagggcttgga

SEQ ID NO: 303174 - DNA, 25 bp, Mus musculus
cacagaggtccaccaggacggacag

SEQ ID NO: 303175 - DNA, 25 bp, Mus musculus
cacagaggtccagcaggacggacag

SEQ ID NO: 303176 - DNA, 25 bp, Mus musculus
cacagaggtcctcaagaccaacgga

SEQ ID NO: 303177 - DNA, 25 bp, Mus musculus
cacagaggtcctgaagaccaacgga

SEQ ID NO: 303178 - DNA, 25 bp, Mus musculus
cacagagtccagagtttataacttt

SEQ ID NO: 303179 - DNA, 25 bp, Mus musculus
cacagagtccagtgtttataacttt

SEQ ID NO: 303180 - DNA, 25 bp, Mus musculus
cacagagtcgtcagatgtcaggctg

SEQ ID NO: 303181 - DNA, 25 bp, Mus musculus
cacagagtcgtctgatgtcaggctg

SEQ ID NO: 303182 - DNA, 25 bp, Mus musculus
cacagagtctgactctagccttgga

SEQ ID NO: 303183 - DNA, 25 bp, Mus musculus
cacagagtctgagtctagccttgga

SEQ ID NO: 303184 - DNA, 25 bp, Mus musculus
cacagagtctgtctcatgcattcca

SEQ ID NO: 303185 - DNA, 25 bp, Mus musculus
cacagagtctgtgtcatgcattcca

SEQ ID NO: 303186 - DNA, 25 bp, Mus musculus
cacagagtcttaagttactccagaa

SEQ ID NO: 303187 - DNA, 25 bp, Mus musculus
cacagagtcttatgttactccagaa

SEQ ID NO: 303188 - DNA, 25 bp, Mus musculus
cacagagtgggaccatgtctcaaaa

SEQ ID NO: 303189 - DNA, 25 bp, Mus musculus
cacagagtgggagcatgtctcaaaa

SEQ ID NO: 303190 - DNA, 25 bp, Mus musculus
cacagagttcatccaagacccggat

SEQ ID NO: 303191 - DNA, 25 bp, Mus musculus
cacagagttcatgcaagacccggat

SEQ ID NO: 303192 - DNA, 25 bp, Mus musculus
cacagagttcttaggcttaaaggga

SEQ ID NO: 303193 - DNA, 25 bp, Mus musculus
cacagagttctttggcttaaaggga

SEQ ID NO: 303194 - DNA, 25 bp, Mus musculus
cacagagttggtaggtagttttatt

SEQ ID NO: 303195 - DNA, 25 bp, Mus musculus
cacagagttggttggtagttttatt

SEQ ID NO: 303196 - DNA, 25 bp, Mus musculus
cacagataatatacatcagagttgg

SEQ ID NO: 303197 - DNA, 25 bp, Mus musculus
cacagataatattcatcagagttgg

SEQ ID NO: 303198 - DNA, 25 bp, Mus musculus
cacagataccaaaggacgcctcatt

SEQ ID NO: 303199 - DNA, 25 bp, Mus musculus
cacagataccaatggacgcctcatt

SEQ ID NO: 303200 - DNA, 25 bp, Mus musculus
cacagatagctaattctctcgtatt

SEQ ID NO: 303201 - DNA, 25 bp, Mus musculus
cacagatagctatttctctcgtatt

SEQ ID NO: 303202 - DNA, 25 bp, Mus musculus
cacagatataggcttgcagatctat

SEQ ID NO: 303203 - DNA, 25 bp, Mus musculus
cacagatatagggttgcagatctat

SEQ ID NO: 303204 - DNA, 25 bp, Mus musculus
cacagatatcagacccagatggatc

SEQ ID NO: 303205 - DNA, 25 bp, Mus musculus
cacagatatcagtcccagatggatc

SEQ ID NO: 303206 - DNA, 25 bp, Mus musculus
cacagatatgacatgcgctctccac

SEQ ID NO: 303207 - DNA, 25 bp, Mus musculus
cacagatatgacttgcgctctccac

SEQ ID NO: 303208 - DNA, 25 bp, Mus musculus
cacagatcccaaagacgattccaac

SEQ ID NO: 303209 - DNA, 25 bp, Mus musculus
cacagatcccaatgacgattccaac

SEQ ID NO: 303210 - DNA, 25 bp, Mus musculus
cacagatcctccctacacagaatta

SEQ ID NO: 303211 - DNA, 25 bp, Mus musculus
cacagatcctccgtacacagaatta

SEQ ID NO: 303212 - DNA, 25 bp, Mus musculus
cacagatctgtactttggcttttta

SEQ ID NO: 303213 - DNA, 25 bp, Mus musculus
cacagatctgtagtttggcttttta

SEQ ID NO: 303214 - DNA, 25 bp, Mus musculus
cacagatgacagatgccaatgggaa

SEQ ID NO: 303215 - DNA, 25 bp, Mus musculus
cacagatgacagttgccaatgggaa

SEQ ID NO: 303216 - DNA, 25 bp, Mus musculus
cacagatgactcctgtgatcatttt

SEQ ID NO: 303217 - DNA, 25 bp, Mus musculus
cacagatgactcgtgtgatcatttt

SEQ ID NO: 303218 - DNA, 25 bp, Mus musculus
cacagatgacttaaccaggaatgcc

SEQ ID NO: 303219 - DNA, 25 bp, Mus musculus
cacagatgactttaccaggaatgcc

SEQ ID NO: 303220 - DNA, 25 bp, Mus musculus
cacagatgcaacatgagaataaaat

SEQ ID NO: 303221 - DNA, 25 bp, Mus musculus
cacagatgcaacttgagaataaaat

SEQ ID NO: 303222 - DNA, 25 bp, Mus musculus
cacagatgcctacacttgggtttat

SEQ ID NO: 303223 - DNA, 25 bp, Mus musculus
cacagatgcctagacttgggtttat

SEQ ID NO: 303224 - DNA, 25 bp, Mus musculus
cacagatgccttaagtcacaggtta

SEQ ID NO: 303225 - DNA, 25 bp, Mus musculus
cacagatgcctttagtcacaggtta

SEQ ID NO: 303226 - DNA, 25 bp, Mus musculus
cacagatggcgtcaaatcaggaaca

SEQ ID NO: 303227 - DNA, 25 bp, Mus musculus
cacagatggcgtgaaatcaggaaca

SEQ ID NO: 303228 - DNA, 25 bp, Mus musculus
cacagatggtcgcctgattggaagc

SEQ ID NO: 303229 - DNA, 25 bp, Mus musculus
cacagatggtcggctgattggaagc

SEQ ID NO: 303230 - DNA, 25 bp, Mus musculus
cacagatgtcatcgctcacgtggct

SEQ ID NO: 303231 - DNA, 25 bp, Mus musculus
cacagatgtcatggctcacgtggct

SEQ ID NO: 303232 - DNA, 25 bp, Mus musculus
cacagatgtggcacgaagtgagaag

SEQ ID NO: 303233 - DNA, 25 bp, Mus musculus
cacagatgtggctcgaagtgagaag

SEQ ID NO: 303234 - DNA, 25 bp, Mus musculus
cacagatgtgggaggcagcttgctt

SEQ ID NO: 303235 - DNA, 25 bp, Mus musculus
cacagatgtgggtggcagcttgctt

SEQ ID NO: 303236 - DNA, 25 bp, Mus musculus
cacagatgttttagaactcaccaca

SEQ ID NO: 303237 - DNA, 25 bp, Mus musculus
cacagatgtttttgaactcaccaca

SEQ ID NO: 303238 - DNA, 25 bp, Mus musculus
cacagattacttctcttatgaacat

SEQ ID NO: 303239 - DNA, 25 bp, Mus musculus
cacagattacttgtcttatgaacat

SEQ ID NO: 303240 - DNA, 25 bp, Mus musculus
cacagattagctcaatatttaaatt

SEQ ID NO: 303241 - DNA, 25 bp, Mus musculus
cacagattagctgaatatttaaatt

SEQ ID NO: 303242 - DNA, 25 bp, Mus musculus
cacagattatgcatgtatacgtaaa

SEQ ID NO: 303243 - DNA, 25 bp, Mus musculus
cacagattatgcttgtatacgtaaa

SEQ ID NO: 303244 - DNA, 25 bp, Mus musculus
cacagattccatatcaagttaataa

SEQ ID NO: 303245 - DNA, 25 bp, Mus musculus
cacagattccatttcaagttaataa

SEQ ID NO: 303246 - DNA, 25 bp, Mus musculus
cacagattcccaaagcaccttattt

SEQ ID NO: 303247 - DNA, 25 bp, Mus musculus
cacagattcccatagcaccttattt

SEQ ID NO: 303248 - DNA, 25 bp, Mus musculus
cacagattgcaaaggactcagtttt

SEQ ID NO: 303249 - DNA, 25 bp, Mus musculus
cacagattgcaatggactcagtttt

SEQ ID NO: 303250 - DNA, 25 bp, Mus musculus
cacagatttaggaggcagcgccgaa

SEQ ID NO: 303251 - DNA, 25 bp, Mus musculus
cacagatttaggtggcagcgccgaa

SEQ ID NO: 303252 - DNA, 25 bp, Mus musculus
cacagatttgcaaacatttgatttc

SEQ ID NO: 303253 - DNA, 25 bp, Mus musculus
cacagatttgcatacatttgatttc

SEQ ID NO: 303254 - DNA, 25 bp, Mus musculus
cacagatttggtagctagtgttcac

SEQ ID NO: 303255 - DNA, 25 bp, Mus musculus
cacagatttggttgctagtgttcac

SEQ ID NO: 303256 - DNA, 25 bp, Mus musculus
cacagattttctcaagccctgcaac

SEQ ID NO: 303257 - DNA, 25 bp, Mus musculus
cacagattttctgaagccctgcaac

SEQ ID NO: 303258 - DNA, 25 bp, Mus musculus
cacagcaacagaaccagtatttaaa

SEQ ID NO: 303259 - DNA, 25 bp, Mus musculus
cacagcaacagatccagtatttaaa

SEQ ID NO: 303260 - DNA, 25 bp, Mus musculus
cacagcaacctgaaacgggtggatt

SEQ ID NO: 303261 - DNA, 25 bp, Mus musculus
cacagcaacctgtaacgggtggatt

SEQ ID NO: 303262 - DNA, 25 bp, Mus musculus
cacagcaagccgacacatgaagatt

SEQ ID NO: 303263 - DNA, 25 bp, Mus musculus
cacagcaagccgtcacatgaagatt

SEQ ID NO: 303264 - DNA, 25 bp, Mus musculus
cacagcaatccaacaatgaagccat

SEQ ID NO: 303265 - DNA, 25 bp, Mus musculus
cacagcaatccatcaatgaagccat

SEQ ID NO: 303266 - DNA, 25 bp, Mus musculus
cacagcaattatagtccagttccag

SEQ ID NO: 303267 - DNA, 25 bp, Mus musculus
cacagcaattattgtccagttccag

SEQ ID NO: 303268 - DNA, 25 bp, Mus musculus
cacagcaattcgcaacttcttacta

SEQ ID NO: 303269 - DNA, 25 bp, Mus musculus
cacagcaattcggaacttcttacta

SEQ ID NO: 303270 - DNA, 25 bp, Mus musculus
cacagcacacagctgttcacaaaag

SEQ ID NO: 303271 - DNA, 25 bp, Mus musculus
cacagcacacaggtgttcacaaaag

SEQ ID NO: 303272 - DNA, 25 bp, Mus musculus
cacagcacaggcatttgcaggcatt

SEQ ID NO: 303273 - DNA, 25 bp, Mus musculus
cacagcacaggcttttgcaggcatt

SEQ ID NO: 303274 - DNA, 25 bp, Mus musculus
cacagcaccatgaggtcgcggttag

SEQ ID NO: 303275 - DNA, 25 bp, Mus musculus
cacagcaccatgtggtcgcggttag

SEQ ID NO: 303276 - DNA, 25 bp, Mus musculus
cacagcaccattacagtctcaagat

SEQ ID NO: 303277 - DNA, 25 bp, Mus musculus
cacagcaccatttcagtctcaagat

SEQ ID NO: 303278 - DNA, 25 bp, Mus musculus
cacagcaccctgactttaattaata

SEQ ID NO: 303279 - DNA, 25 bp, Mus musculus
cacagcaccctgtctttaattaata

SEQ ID NO: 303280 - DNA, 25 bp, Mus musculus
cacagcaccgtgaaaagtcccagat

SEQ ID NO: 303281 - DNA, 25 bp, Mus musculus
cacagcaccgtgtaaagtcccagat

SEQ ID NO: 303282 - DNA, 25 bp, Mus musculus
cacagcacgcaacatttagaatttt

SEQ ID NO: 303283 - DNA, 25 bp, Mus musculus
cacagcacgcaagatttagaatttt

SEQ ID NO: 303284 - DNA, 25 bp, Mus musculus
cacagcactcctaagtttctaacag

SEQ ID NO: 303285 - DNA, 25 bp, Mus musculus
cacagcactccttagtttctaacag

SEQ ID NO: 303286 - DNA, 25 bp, Mus musculus
cacagcactgcaaggtaccccatgg

SEQ ID NO: 303287 - DNA, 25 bp, Mus musculus
cacagcactgcatggtaccccatgg

SEQ ID NO: 303288 - DNA, 25 bp, Mus musculus
cacagcactgccaatcttaaagcat

SEQ ID NO: 303289 - DNA, 25 bp, Mus musculus
cacagcactgcctatcttaaagcat

SEQ ID NO: 303290 - DNA, 25 bp, Mus musculus
cacagcacttgtattccagcatggt

SEQ ID NO: 303291 - DNA, 25 bp, Mus musculus
cacagcacttgttttccagcatggt

SEQ ID NO: 303292 - DNA, 25 bp, Mus musculus
cacagcactttgactgcctcccagg

SEQ ID NO: 303293 - DNA, 25 bp, Mus musculus
cacagcactttgtctgcctcccagg

SEQ ID NO: 303294 - DNA, 25 bp, Mus musculus
cacagcagcaccaacttttgtctaa

SEQ ID NO: 303295 - DNA, 25 bp, Mus musculus
cacagcagcacctacttttgtctaa

SEQ ID NO: 303296 - DNA, 25 bp, Mus musculus
cacagcaggctcctactctatcttg

SEQ ID NO: 303297 - DNA, 25 bp, Mus musculus
cacagcaggctcgtactctatcttg

SEQ ID NO: 303298 - DNA, 25 bp, Mus musculus
cacagcaggtgcatgggagtcgtca

SEQ ID NO: 303299 - DNA, 25 bp, Mus musculus
cacagcaggtgcttgggagtcgtca

SEQ ID NO: 303300 - DNA, 25 bp, Mus musculus
cacagcagtagcaagaagcatccct

SEQ ID NO: 303301 - DNA, 25 bp, Mus musculus
cacagcagtagctagaagcatccct

SEQ ID NO: 303302 - DNA, 25 bp, Mus musculus
cacagcagtctgagggctacagaat

SEQ ID NO: 303303 - DNA, 25 bp, Mus musculus
cacagcagtctgtgggctacagaat

SEQ ID NO: 303304 - DNA, 25 bp, Mus musculus
cacagcagtgccaatgatgtctcat

SEQ ID NO: 303305 - DNA, 25 bp, Mus musculus
cacagcagtgcctatgatgtctcat

SEQ ID NO: 303306 - DNA, 25 bp, Mus musculus
cacagcagtgcgcaggtgatagact

SEQ ID NO: 303307 - DNA, 25 bp, Mus musculus
cacagcagtgcggaggtgatagact

SEQ ID NO: 303308 - DNA, 25 bp, Mus musculus
cacagcagtgctcggcaatcaggta

SEQ ID NO: 303309 - DNA, 25 bp, Mus musculus
cacagcagtgctgggcaatcaggta

SEQ ID NO: 303310 - DNA, 25 bp, Mus musculus
cacagcagttgtacatgatttcatg

SEQ ID NO: 303311 - DNA, 25 bp, Mus musculus
cacagcagttgttcatgatttcatg

SEQ ID NO: 303312 - DNA, 25 bp, Mus musculus
cacagcatacatctctatactagaa

SEQ ID NO: 303313 - DNA, 25 bp, Mus musculus
cacagcatacatgtctatactagaa

SEQ ID NO: 303314 - DNA, 25 bp, Mus musculus
cacagcatacctagtgaaggtcaag

SEQ ID NO: 303315 - DNA, 25 bp, Mus musculus
cacagcataccttgtgaaggtcaag

SEQ ID NO: 303316 - DNA, 25 bp, Mus musculus
cacagcatcatgctgagaatcagga

SEQ ID NO: 303317 - DNA, 25 bp, Mus musculus
cacagcatcatggtgagaatcagga

SEQ ID NO: 303318 - DNA, 25 bp, Mus musculus
cacagcatcgccaggagcattgaga

SEQ ID NO: 303319 - DNA, 25 bp, Mus musculus
cacagcatcgcctggagcattgaga

SEQ ID NO: 303320 - DNA, 25 bp, Mus musculus
cacagcatctgaacacaccgggtag

SEQ ID NO: 303321 - DNA, 25 bp, Mus musculus
cacagcatctgacctgtagatggag

SEQ ID NO: 303322 - DNA, 25 bp, Mus musculus
cacagcatctgagctgtagatggag

SEQ ID NO: 303323 - DNA, 25 bp, Mus musculus
cacagcatctgatcacaccgggtag

SEQ ID NO: 303324 - DNA, 25 bp, Mus musculus
cacagcatgggcaatgtttctacag

SEQ ID NO: 303325 - DNA, 25 bp, Mus musculus
cacagcatgggctatgtttctacag

SEQ ID NO: 303326 - DNA, 25 bp, Mus musculus
cacagcatggttcccttcattcata

SEQ ID NO: 303327 - DNA, 25 bp, Mus musculus
cacagcatggttgccttcattcata

SEQ ID NO: 303328 - DNA, 25 bp, Mus musculus
cacagcattcacaacctgaggactt

SEQ ID NO: 303329 - DNA, 25 bp, Mus musculus
cacagcattcactacctgaggactt

SEQ ID NO: 303330 - DNA, 25 bp, Mus musculus
cacagccaaaccctattttgtttga

SEQ ID NO: 303331 - DNA, 25 bp, Mus musculus
cacagccaaaccgtattttgtttga

SEQ ID NO: 303332 - DNA, 25 bp, Mus musculus
cacagccaacttatccttcttcttt

SEQ ID NO: 303333 - DNA, 25 bp, Mus musculus
cacagccaacttttccttcttcttt

SEQ ID NO: 303334 - DNA, 25 bp, Mus musculus
cacagccacattaactttacacagc

SEQ ID NO: 303335 - DNA, 25 bp, Mus musculus
cacagccacatttactttacacagc

SEQ ID NO: 303336 - DNA, 25 bp, Mus musculus
cacagccacctaactttgatttaat

SEQ ID NO: 303337 - DNA, 25 bp, Mus musculus
cacagccacctatctttgatttaat

SEQ ID NO: 303338 - DNA, 25 bp, Mus musculus
cacagccacgtactgcgaagggaga

SEQ ID NO: 303339 - DNA, 25 bp, Mus musculus
cacagccacgtagtgcgaagggaga

SEQ ID NO: 303340 - DNA, 25 bp, Mus musculus
cacagccactgtatgccagtgttgg

SEQ ID NO: 303341 - DNA, 25 bp, Mus musculus
cacagccactgtttgccagtgttgg

SEQ ID NO: 303342 - DNA, 25 bp, Mus musculus
cacagccagagactcagattgataa

SEQ ID NO: 303343 - DNA, 25 bp, Mus musculus
cacagccagagagtcagattgataa

SEQ ID NO: 303344 - DNA, 25 bp, Mus musculus
cacagccaggctagattttcagaag

SEQ ID NO: 303345 - DNA, 25 bp, Mus musculus
cacagccaggcttgattttcagaag

SEQ ID NO: 303346 - DNA, 25 bp, Mus musculus
cacagccagggaaagagtctcactc

SEQ ID NO: 303347 - DNA, 25 bp, Mus musculus
cacagccagggatagagtctcactc

SEQ ID NO: 303348 - DNA, 25 bp, Mus musculus
cacagccagggcaggttacactgag

SEQ ID NO: 303349 - DNA, 25 bp, Mus musculus
cacagccagggctggttacactgag

SEQ ID NO: 303350 - DNA, 25 bp, Mus musculus
cacagccagtatagcaggagcccca

SEQ ID NO: 303351 - DNA, 25 bp, Mus musculus
cacagccagtattgcaggagcccca

SEQ ID NO: 303352 - DNA, 25 bp, Mus musculus
cacagccatcccatgatatcagtgg

SEQ ID NO: 303353 - DNA, 25 bp, Mus musculus
cacagccatcccttgatatcagtgg

SEQ ID NO: 303354 - DNA, 25 bp, Mus musculus
cacagccatgagcaaccatcctcag

SEQ ID NO: 303355 - DNA, 25 bp, Mus musculus
cacagccatgaggaaccatcctcag

SEQ ID NO: 303356 - DNA, 25 bp, Mus musculus
cacagcccaccaattgccaaggtgg

SEQ ID NO: 303357 - DNA, 25 bp, Mus musculus
cacagcccaccatttgccaaggtgg

SEQ ID NO: 303358 - DNA, 25 bp, Mus musculus
cacagcccaggtattgatggagcta

SEQ ID NO: 303359 - DNA, 25 bp, Mus musculus
cacagcccaggttttgatggagcta

SEQ ID NO: 303360 - DNA, 25 bp, Mus musculus
cacagcccatacattgtatttccct

SEQ ID NO: 303361 - DNA, 25 bp, Mus musculus
cacagcccatactttgtatttccct

SEQ ID NO: 303362 - DNA, 25 bp, Mus musculus
cacagcccatgtctctggaagagtt

SEQ ID NO: 303363 - DNA, 25 bp, Mus musculus
cacagcccatgtgtctggaagagtt

SEQ ID NO: 303364 - DNA, 25 bp, Mus musculus
cacagccccactctataaacagatt

SEQ ID NO: 303365 - DNA, 25 bp, Mus musculus
cacagccccactgtataaacagatt

SEQ ID NO: 303366 - DNA, 25 bp, Mus musculus
cacagccctgctcttttgtgactgt

SEQ ID NO: 303367 - DNA, 25 bp, Mus musculus
cacagccctgctgttttgtgactgt

SEQ ID NO: 303368 - DNA, 25 bp, Mus musculus
cacagcccttaccatcatggtgatg

SEQ ID NO: 303369 - DNA, 25 bp, Mus musculus
cacagcccttacgatcatggtgatg

SEQ ID NO: 303370 - DNA, 25 bp, Mus musculus
cacagcccttggctggttgggacct

SEQ ID NO: 303371 - DNA, 25 bp, Mus musculus
cacagcccttgggtggttgggacct

SEQ ID NO: 303372 - DNA, 25 bp, Mus musculus
cacagcccttttactagtcaatgat

SEQ ID NO: 303373 - DNA, 25 bp, Mus musculus
cacagccctttttctagtcaatgat

SEQ ID NO: 303374 - DNA, 25 bp, Mus musculus
cacagccgcggacatactatgatat

SEQ ID NO: 303375 - DNA, 25 bp, Mus musculus
cacagccgcggagatactatgatat

SEQ ID NO: 303376 - DNA, 25 bp, Mus musculus
cacagccgtctcagggagttagttt

SEQ ID NO: 303377 - DNA, 25 bp, Mus musculus
cacagccgtctctgggagttagttt

SEQ ID NO: 303378 - DNA, 25 bp, Mus musculus
cacagccgtgcacacctgggtcagg

SEQ ID NO: 303379 - DNA, 25 bp, Mus musculus
cacagccgtgcagacctgggtcagg

SEQ ID NO: 303380 - DNA, 25 bp, Mus musculus
cacagcctaaatctgatctttggga

SEQ ID NO: 303381 - DNA, 25 bp, Mus musculus
cacagcctaaatgtgatctttggga

SEQ ID NO: 303382 - DNA, 25 bp, Mus musculus
cacagcctagctattttcagtttta

SEQ ID NO: 303383 - DNA, 25 bp, Mus musculus
cacagcctagcttttttcagtttta

SEQ ID NO: 303384 - DNA, 25 bp, Mus musculus
cacagcctccatacgtacgagaaac

SEQ ID NO: 303385 - DNA, 25 bp, Mus musculus
cacagcctccattcgtacgagaaac

SEQ ID NO: 303386 - DNA, 25 bp, Mus musculus
cacagcctctgtccttagtggagtg

SEQ ID NO: 303387 - DNA, 25 bp, Mus musculus
cacagcctctgtgcttagtggagtg

SEQ ID NO: 303388 - DNA, 25 bp, Mus musculus
cacagcctgctgaagttctacttga

SEQ ID NO: 303389 - DNA, 25 bp, Mus musculus
cacagcctgctgtagttctacttga

SEQ ID NO: 303390 - DNA, 25 bp, Mus musculus
cacagcctggctacatagagaggac

SEQ ID NO: 303391 - DNA, 25 bp, Mus musculus
cacagcctggctcttaagattgtca

SEQ ID NO: 303392 - DNA, 25 bp, Mus musculus
cacagcctggctgttaagattgtca

SEQ ID NO: 303393 - DNA, 25 bp, Mus musculus
cacagcctggcttcatagagaggac

SEQ ID NO: 303394 - DNA, 25 bp, Mus musculus
cacagccttctcaggtttcagataa

SEQ ID NO: 303395 - DNA, 25 bp, Mus musculus
cacagccttctctggtttcagataa

SEQ ID NO: 303396 - DNA, 25 bp, Mus musculus
cacagccttgccagatgacatcatc

SEQ ID NO: 303397 - DNA, 25 bp, Mus musculus
cacagccttgcctgatgacatcatc

SEQ ID NO: 303398 - DNA, 25 bp, Mus musculus
cacagccttggcagacaagtaccac

SEQ ID NO: 303399 - DNA, 25 bp, Mus musculus
cacagccttggctgacaagtaccac

SEQ ID NO: 303400 - DNA, 25 bp, Mus musculus
cacagccttgtgagtttaaaaccca

SEQ ID NO: 303401 - DNA, 25 bp, Mus musculus
cacagccttgtgtgtttaaaaccca

SEQ ID NO: 303402 - DNA, 25 bp, Mus musculus
cacagcctttttatttcaagccagg

SEQ ID NO: 303403 - DNA, 25 bp, Mus musculus
cacagcctttttttttcaagccagg

SEQ ID NO: 303404 - DNA, 25 bp, Mus musculus
cacagcgagaacctgatgaagctat

SEQ ID NO: 303405 - DNA, 25 bp, Mus musculus
cacagcgagaacgtgatgaagctat

SEQ ID NO: 303406 - DNA, 25 bp, Mus musculus
cacagcgaggcgagtgcttctggta

SEQ ID NO: 303407 - DNA, 25 bp, Mus musculus
cacagcgaggcgtgtgcttctggta

SEQ ID NO: 303408 - DNA, 25 bp, Mus musculus
cacagcgatagccatcagggaagcc

SEQ ID NO: 303409 - DNA, 25 bp, Mus musculus
cacagcgatagcgatcagggaagcc

SEQ ID NO: 303410 - DNA, 25 bp, Mus musculus
cacagcgcaagcatccacaggagag

SEQ ID NO: 303411 - DNA, 25 bp, Mus musculus
cacagcgcaagcttccacaggagag

SEQ ID NO: 303412 - DNA, 25 bp, Mus musculus
cacagcgcaggccactgagtgggtt

SEQ ID NO: 303413 - DNA, 25 bp, Mus musculus
cacagcgcaggcgactgagtgggtt

SEQ ID NO: 303414 - DNA, 25 bp, Mus musculus
cacagcgccagcagggcacagaggt

SEQ ID NO: 303415 - DNA, 25 bp, Mus musculus
cacagcgccagctgggcacagaggt

SEQ ID NO: 303416 - DNA, 25 bp, Mus musculus
cacagcgcccttctcagtgaagagg

SEQ ID NO: 303417 - DNA, 25 bp, Mus musculus
cacagcgcccttgtcagtgaagagg

SEQ ID NO: 303418 - DNA, 25 bp, Mus musculus
cacagcgccgggatgcctcgcagag

SEQ ID NO: 303419 - DNA, 25 bp, Mus musculus
cacagcgccgggttgcctcgcagag

SEQ ID NO: 303420 - DNA, 25 bp, Mus musculus
cacagcgctctgatgaaggttggat

SEQ ID NO: 303421 - DNA, 25 bp, Mus musculus
cacagcgctctgttgaaggttggat

SEQ ID NO: 303422 - DNA, 25 bp, Mus musculus
cacagcgctgcaagttgataccact

SEQ ID NO: 303423 - DNA, 25 bp, Mus musculus
cacagcgctgcatgttgataccact

SEQ ID NO: 303424 - DNA, 25 bp, Mus musculus
cacagcggagcaccacccttgatgg

SEQ ID NO: 303425 - DNA, 25 bp, Mus musculus
cacagcggagcagcacccttgatgg

SEQ ID NO: 303426 - DNA, 25 bp, Mus musculus
cacagcgtgaggatcaggacaggca

SEQ ID NO: 303427 - DNA, 25 bp, Mus musculus
cacagcgtgaggttcaggacaggca

SEQ ID NO: 303428 - DNA, 25 bp, Mus musculus
cacagcgtgcgtacatctgaatcat

SEQ ID NO: 303429 - DNA, 25 bp, Mus musculus
cacagcgtgcgttcatctgaatcat

SEQ ID NO: 303430 - DNA, 25 bp, Mus musculus
cacagcgtggttctcataaggcagt

SEQ ID NO: 303431 - DNA, 25 bp, Mus musculus
cacagcgtggttgtcataaggcagt

SEQ ID NO: 303432 - DNA, 25 bp, Mus musculus
cacagcgtgtggacttgttctggac

SEQ ID NO: 303433 - DNA, 25 bp, Mus musculus
cacagcgtgtggtcttgttctggac

SEQ ID NO: 303434 - DNA, 25 bp, Mus musculus
cacagctaactgatgggcctcttaa

SEQ ID NO: 303435 - DNA, 25 bp, Mus musculus
cacagctaactgttgggcctcttaa

SEQ ID NO: 303436 - DNA, 25 bp, Mus musculus
cacagctaacttctgcatcactgaa

SEQ ID NO: 303437 - DNA, 25 bp, Mus musculus
cacagctaacttgtgcatcactgaa

SEQ ID NO: 303438 - DNA, 25 bp, Mus musculus
cacagctaagaaacctaagtatttt

SEQ ID NO: 303439 - DNA, 25 bp, Mus musculus
cacagctaagaatcctaagtatttt

SEQ ID NO: 303440 - DNA, 25 bp, Mus musculus
cacagctaagtgacagatagttcca

SEQ ID NO: 303441 - DNA, 25 bp, Mus musculus
cacagctaagtgtcagatagttcca

SEQ ID NO: 303442 - DNA, 25 bp, Mus musculus
cacagctagatgaccttacagacag

SEQ ID NO: 303443 - DNA, 25 bp, Mus musculus
cacagctagatgtccttacagacag

SEQ ID NO: 303444 - DNA, 25 bp, Mus musculus
cacagctagcaacggtcacggtgta

SEQ ID NO: 303445 - DNA, 25 bp, Mus musculus
cacagctagcaagggtcacggtgta

SEQ ID NO: 303446 - DNA, 25 bp, Mus musculus
cacagctaggcactaactttccttt

SEQ ID NO: 303447 - DNA, 25 bp, Mus musculus
cacagctaggcagtaactttccttt

SEQ ID NO: 303448 - DNA, 25 bp, Mus musculus
cacagctaggttaggagtgcccgct

SEQ ID NO: 303449 - DNA, 25 bp, Mus musculus
cacagctaggtttggagtgcccgct

SEQ ID NO: 303450 - DNA, 25 bp, Mus musculus
cacagctattacctatctctttaca

SEQ ID NO: 303451 - DNA, 25 bp, Mus musculus
cacagctattacgtatctctttaca

SEQ ID NO: 303452 - DNA, 25 bp, Mus musculus
cacagctcagggacacctgttggga

SEQ ID NO: 303453 - DNA, 25 bp, Mus musculus
cacagctcagggtcacctgttggga

SEQ ID NO: 303454 - DNA, 25 bp, Mus musculus
cacagctccagtcggattcactgaa

SEQ ID NO: 303455 - DNA, 25 bp, Mus musculus
cacagctccagtgggattcactgaa

SEQ ID NO: 303456 - DNA, 25 bp, Mus musculus
cacagctcccaacatccttttagag

SEQ ID NO: 303457 - DNA, 25 bp, Mus musculus
cacagctcccaagatccttttagag

SEQ ID NO: 303458 - DNA, 25 bp, Mus musculus
cacagctcccgtactagggaatctg

SEQ ID NO: 303459 - DNA, 25 bp, Mus musculus
cacagctcccgttctagggaatctg

SEQ ID NO: 303460 - DNA, 25 bp, Mus musculus
cacagctctaggagcgggaagaaat

SEQ ID NO: 303461 - DNA, 25 bp, Mus musculus
cacagctctaggtgcgggaagaaat

SEQ ID NO: 303462 - DNA, 25 bp, Mus musculus
cacagctctcatcaagtaaaacttc

SEQ ID NO: 303463 - DNA, 25 bp, Mus musculus
cacagctctcatgaagtaaaacttc

SEQ ID NO: 303464 - DNA, 25 bp, Mus musculus
cacagctctgtaaagtaggtaccat

SEQ ID NO: 303465 - DNA, 25 bp, Mus musculus
cacagctctgtatagtaggtaccat

SEQ ID NO: 303466 - DNA, 25 bp, Mus musculus
cacagctgatctcgtcgtgtttgct

SEQ ID NO: 303467 - DNA, 25 bp, Mus musculus
cacagctgatctggtcgtgtttgct

SEQ ID NO: 303468 - DNA, 25 bp, Mus musculus
cacagctgatgtatgagttctagac

SEQ ID NO: 303469 - DNA, 25 bp, Mus musculus
cacagctgatgtttgagttctagac

SEQ ID NO: 303470 - DNA, 25 bp, Mus musculus
cacagctgatttataccgtattggg

SEQ ID NO: 303471 - DNA, 25 bp, Mus musculus
cacagctgatttttaccgtattggg

SEQ ID NO: 303472 - DNA, 25 bp, Mus musculus
cacagctgctaaatgccactaatca

SEQ ID NO: 303473 - DNA, 25 bp, Mus musculus
cacagctgctaattgccactaatca

SEQ ID NO: 303474 - DNA, 25 bp, Mus musculus
cacagctgggtaagctcaagaacca

SEQ ID NO: 303475 - DNA, 25 bp, Mus musculus
cacagctgggtatgctcaagaacca

SEQ ID NO: 303476 - DNA, 25 bp, Mus musculus
cacagctgtactaatgtaggagaca

SEQ ID NO: 303477 - DNA, 25 bp, Mus musculus
cacagctgtacttatgtaggagaca

SEQ ID NO: 303478 - DNA, 25 bp, Mus musculus
cacagctgtatcattgactttctag

SEQ ID NO: 303479 - DNA, 25 bp, Mus musculus
cacagctgtatctttgactttctag

SEQ ID NO: 303480 - DNA, 25 bp, Mus musculus
cacagctgtcagcagaagggtcaag

SEQ ID NO: 303481 - DNA, 25 bp, Mus musculus
cacagctgtcaggagaagggtcaag

SEQ ID NO: 303482 - DNA, 25 bp, Mus musculus
cacagctgtcatccctcatgtggtc

SEQ ID NO: 303483 - DNA, 25 bp, Mus musculus
cacagctgtcatgcctcatgtggtc

SEQ ID NO: 303484 - DNA, 25 bp, Mus musculus
cacagctgtgagaagccatcttgca

SEQ ID NO: 303485 - DNA, 25 bp, Mus musculus
cacagctgtgagtagccatcttgca

SEQ ID NO: 303486 - DNA, 25 bp, Mus musculus
cacagctgtgatcaggccttttaac

SEQ ID NO: 303487 - DNA, 25 bp, Mus musculus
cacagctgtgatgaggccttttaac

SEQ ID NO: 303488 - DNA, 25 bp, Mus musculus
cacagcttaagtaggtttcctggtt

SEQ ID NO: 303489 - DNA, 25 bp, Mus musculus
cacagcttaagttggtttcctggtt

SEQ ID NO: 303490 - DNA, 25 bp, Mus musculus
cacagcttccacattcctaagaaag

SEQ ID NO: 303491 - DNA, 25 bp, Mus musculus
cacagcttccactttcctaagaaag

SEQ ID NO: 303492 - DNA, 25 bp, Mus musculus
cacagcttctaaaccttccaaacag

SEQ ID NO: 303493 - DNA, 25 bp, Mus musculus
cacagcttctaatccttccaaacag

SEQ ID NO: 303494 - DNA, 25 bp, Mus musculus
cacagcttctttaggcttccaagta

SEQ ID NO: 303495 - DNA, 25 bp, Mus musculus
cacagcttcttttggcttccaagta

SEQ ID NO: 303496 - DNA, 25 bp, Mus musculus
cacagcttggaaacggtgagcactt

SEQ ID NO: 303497 - DNA, 25 bp, Mus musculus
cacagcttggaatcggtgagcactt

SEQ ID NO: 303498 - DNA, 25 bp, Mus musculus
cacagcttgtctccccgaacaaagt

SEQ ID NO: 303499 - DNA, 25 bp, Mus musculus
cacagcttgtctgcccgaacaaagt

SEQ ID NO: 303500 - DNA, 25 bp, Mus musculus
cacagctttctaacacggaccatgt

SEQ ID NO: 303501 - DNA, 25 bp, Mus musculus
cacagctttctatcacggaccatgt

SEQ ID NO: 303502 - DNA, 25 bp, Mus musculus
cacagctttctccaatcagttagga

SEQ ID NO: 303503 - DNA, 25 bp, Mus musculus
cacagctttctcgaatcagttagga

SEQ ID NO: 303504 - DNA, 25 bp, Mus musculus
cacagctttgctatatggacatatt

SEQ ID NO: 303505 - DNA, 25 bp, Mus musculus
cacagctttgctttatggacatatt

SEQ ID NO: 303506 - DNA, 25 bp, Mus musculus
cacagctttgggagtctcttgcagt

SEQ ID NO: 303507 - DNA, 25 bp, Mus musculus
cacagctttgggtgtctcttgcagt

SEQ ID NO: 303508 - DNA, 25 bp, Mus musculus
cacagcttttctagataggcctagt

SEQ ID NO: 303509 - DNA, 25 bp, Mus musculus
cacagcttttcttgataggcctagt

SEQ ID NO: 303510 - DNA, 25 bp, Mus musculus
cacagctttttaatctactcaggtc

SEQ ID NO: 303511 - DNA, 25 bp, Mus musculus
cacagctttttattctactcaggtc

SEQ ID NO: 303512 - DNA, 25 bp, Mus musculus
cacaggaaagccctatattttatta

SEQ ID NO: 303513 - DNA, 25 bp, Mus musculus
cacaggaaagccgtatattttatta

SEQ ID NO: 303514 - DNA, 25 bp, Mus musculus
cacaggaatgcgacgggcccgtagc

SEQ ID NO: 303515 - DNA, 25 bp, Mus musculus
cacaggaatgcgtcgggcccgtagc

SEQ ID NO: 303516 - DNA, 25 bp, Mus musculus
cacaggacacctaagacacagtttg

SEQ ID NO: 303517 - DNA, 25 bp, Mus musculus
cacaggacaccttagacacagtttg

SEQ ID NO: 303518 - DNA, 25 bp, Mus musculus
cacaggacagatcagagacacagga

SEQ ID NO: 303519 - DNA, 25 bp, Mus musculus
cacaggacagatgagagacacagga

SEQ ID NO: 303520 - DNA, 25 bp, Mus musculus
cacaggacagctcgcctttggttgt

SEQ ID NO: 303521 - DNA, 25 bp, Mus musculus
cacaggacagctggcctttggttgt

SEQ ID NO: 303522 - DNA, 25 bp, Mus musculus
cacaggaccattcgctaaggaggat

SEQ ID NO: 303523 - DNA, 25 bp, Mus musculus
cacaggaccattggctaaggaggat

SEQ ID NO: 303524 - DNA, 25 bp, Mus musculus
cacaggacgggtcccagtgctgaaa

SEQ ID NO: 303525 - DNA, 25 bp, Mus musculus
cacaggacgggtgccagtgctgaaa

SEQ ID NO: 303526 - DNA, 25 bp, Mus musculus
cacaggactcacagattgcttgttc

SEQ ID NO: 303527 - DNA, 25 bp, Mus musculus
cacaggactcactgattgcttgttc

SEQ ID NO: 303528 - DNA, 25 bp, Mus musculus
cacaggactgtgacagctcagagca

SEQ ID NO: 303529 - DNA, 25 bp, Mus musculus
cacaggactgtgtcagctcagagca

SEQ ID NO: 303530 - DNA, 25 bp, Mus musculus
cacaggactttaactgaccagtgtt

SEQ ID NO: 303531 - DNA, 25 bp, Mus musculus
cacaggactttactggctaccatgt

SEQ ID NO: 303532 - DNA, 25 bp, Mus musculus
cacaggactttagtggctaccatgt

SEQ ID NO: 303533 - DNA, 25 bp, Mus musculus
cacaggactttatctgaccagtgtt

SEQ ID NO: 303534 - DNA, 25 bp, Mus musculus
cacaggagactaccctacttttggg

SEQ ID NO: 303535 - DNA, 25 bp, Mus musculus
cacaggagactagcctacttttggg

SEQ ID NO: 303536 - DNA, 25 bp, Mus musculus
cacaggagagatatccaggagtttt

SEQ ID NO: 303537 - DNA, 25 bp, Mus musculus
cacaggagagatttccaggagtttt

SEQ ID NO: 303538 - DNA, 25 bp, Mus musculus
cacaggagagtgaagcgccatcaga

SEQ ID NO: 303539 - DNA, 25 bp, Mus musculus
cacaggagagtgtagcgccatcaga

SEQ ID NO: 303540 - DNA, 25 bp, Mus musculus
cacaggatatgactctttggttgag

SEQ ID NO: 303541 - DNA, 25 bp, Mus musculus
cacaggatatgagtctttggttgag

SEQ ID NO: 303542 - DNA, 25 bp, Mus musculus
cacaggatcatccaagctgttgtaa

SEQ ID NO: 303543 - DNA, 25 bp, Mus musculus
cacaggatcatcgaagctgttgtaa

SEQ ID NO: 303544 - DNA, 25 bp, Mus musculus
cacaggatccagaccccaaaagagg

SEQ ID NO: 303545 - DNA, 25 bp, Mus musculus
cacaggatccagtccccaaaagagg

SEQ ID NO: 303546 - DNA, 25 bp, Mus musculus
cacaggatctagctggctattggga

SEQ ID NO: 303547 - DNA, 25 bp, Mus musculus
cacaggatctaggtggctattggga

SEQ ID NO: 303548 - DNA, 25 bp, Mus musculus
cacaggatcttgctatcactgtaac

SEQ ID NO: 303549 - DNA, 25 bp, Mus musculus
cacaggatcttggtatcactgtaac

SEQ ID NO: 303550 - DNA, 25 bp, Mus musculus
cacaggatggttcctttgctgtcct

SEQ ID NO: 303551 - DNA, 25 bp, Mus musculus
cacaggatggttgctttgctgtcct

SEQ ID NO: 303552 - DNA, 25 bp, Mus musculus
cacaggattacaaagggccaagaga

SEQ ID NO: 303553 - DNA, 25 bp, Mus musculus
cacaggattacatagggccaagaga

SEQ ID NO: 303554 - DNA, 25 bp, Mus musculus
cacaggattgagctgacctctgacc

SEQ ID NO: 303555 - DNA, 25 bp, Mus musculus
cacaggattgaggtgacctctgacc

SEQ ID NO: 303556 - DNA, 25 bp, Mus musculus
cacaggcaaaccacggccagtaagt

SEQ ID NO: 303557 - DNA, 25 bp, Mus musculus
cacaggcaaacctcggccagtaagt

SEQ ID NO: 303558 - DNA, 25 bp, Mus musculus
cacaggcaaagcattcatcacataa

SEQ ID NO: 303559 - DNA, 25 bp, Mus musculus
cacaggcaaagctttcatcacataa

SEQ ID NO: 303560 - DNA, 25 bp, Mus musculus
cacaggcaccaaccatgaatgtaat

SEQ ID NO: 303561 - DNA, 25 bp, Mus musculus
cacaggcaccaagcatgaatgtaat

SEQ ID NO: 303562 - DNA, 25 bp, Mus musculus
cacaggcagggaccattgctctgaa

SEQ ID NO: 303563 - DNA, 25 bp, Mus musculus
cacaggcagggagcattgctctgaa

SEQ ID NO: 303564 - DNA, 25 bp, Mus musculus
cacaggcagtgcaagtatctttata

SEQ ID NO: 303565 - DNA, 25 bp, Mus musculus
cacaggcagtgctagtatctttata

SEQ ID NO: 303566 - DNA, 25 bp, Mus musculus
cacaggcagtttagaacttcccttc

SEQ ID NO: 303567 - DNA, 25 bp, Mus musculus
cacaggcagttttgaacttcccttc

SEQ ID NO: 303568 - DNA, 25 bp, Mus musculus
cacaggcatcaaccaaatactctct

SEQ ID NO: 303569 - DNA, 25 bp, Mus musculus
cacaggcatcaagcaaatactctct

SEQ ID NO: 303570 - DNA, 25 bp, Mus musculus
cacaggcatcctaggctataagaag

SEQ ID NO: 303571 - DNA, 25 bp, Mus musculus
cacaggcatccttggctataagaag

SEQ ID NO: 303572 - DNA, 25 bp, Mus musculus
cacaggcattttctggtctggaagt

SEQ ID NO: 303573 - DNA, 25 bp, Mus musculus
cacaggcattttgtggtctggaagt

SEQ ID NO: 303574 - DNA, 25 bp, Mus musculus
cacaggccacatcagtgattctcaa

SEQ ID NO: 303575 - DNA, 25 bp, Mus musculus
cacaggccacatgagtgattctcaa

SEQ ID NO: 303576 - DNA, 25 bp, Mus musculus
cacaggccaggtctttgatttgtct

SEQ ID NO: 303577 - DNA, 25 bp, Mus musculus
cacaggccaggtgtttgatttgtct

SEQ ID NO: 303578 - DNA, 25 bp, Mus musculus
cacaggcccacactttatacatctt

SEQ ID NO: 303579 - DNA, 25 bp, Mus musculus
cacaggcccacagtttatacatctt

SEQ ID NO: 303580 - DNA, 25 bp, Mus musculus
cacaggccccacatagaagttcata

SEQ ID NO: 303581 - DNA, 25 bp, Mus musculus
cacaggccccacttagaagttcata

SEQ ID NO: 303582 - DNA, 25 bp, Mus musculus
cacaggccctacagcagtgggtgga

SEQ ID NO: 303583 - DNA, 25 bp, Mus musculus
cacaggccctactgcagtgggtgga

SEQ ID NO: 303584 - DNA, 25 bp, Mus musculus
cacaggccggtgcagagaacactat

SEQ ID NO: 303585 - DNA, 25 bp, Mus musculus
cacaggccggtggagagaacactat

SEQ ID NO: 303586 - DNA, 25 bp, Mus musculus
cacaggccgtgcaagggccacgtgt

SEQ ID NO: 303587 - DNA, 25 bp, Mus musculus
cacaggccgtgctagggccacgtgt

SEQ ID NO: 303588 - DNA, 25 bp, Mus musculus
cacaggcctacacaaagagctacag

SEQ ID NO: 303589 - DNA, 25 bp, Mus musculus
cacaggcctacagaaagagctacag

SEQ ID NO: 303590 - DNA, 25 bp, Mus musculus
cacaggcctggcaatctagatttta

SEQ ID NO: 303591 - DNA, 25 bp, Mus musculus
cacaggcctggctatctagatttta

SEQ ID NO: 303592 - DNA, 25 bp, Mus musculus
cacaggcgaccgctttcagatgttc

SEQ ID NO: 303593 - DNA, 25 bp, Mus musculus
cacaggcgaccggtttcagatgttc

SEQ ID NO: 303594 - DNA, 25 bp, Mus musculus
cacaggcgatgcagttcttaatgaa

SEQ ID NO: 303595 - DNA, 25 bp, Mus musculus
cacaggcgatgctgttcttaatgaa

SEQ ID NO: 303596 - DNA, 25 bp, Mus musculus
cacaggcgctggagctttggttttc

SEQ ID NO: 303597 - DNA, 25 bp, Mus musculus
cacaggcgctggtgctttggttttc

SEQ ID NO: 303598 - DNA, 25 bp, Mus musculus
cacaggcgttgtcttttactaatta

SEQ ID NO: 303599 - DNA, 25 bp, Mus musculus
cacaggcgttgtgttttactaatta

SEQ ID NO: 303600 - DNA, 25 bp, Mus musculus
cacaggcgtttcagcagttgatggg

SEQ ID NO: 303601 - DNA, 25 bp, Mus musculus
cacaggcgtttctgcagttgatggg

SEQ ID NO: 303602 - DNA, 25 bp, Mus musculus
cacaggctaccactatgggcagtat

SEQ ID NO: 303603 - DNA, 25 bp, Mus musculus
cacaggctaccagtatgggcagtat

SEQ ID NO: 303604 - DNA, 25 bp, Mus musculus
cacaggctcacacgacatttgggat

SEQ ID NO: 303605 - DNA, 25 bp, Mus musculus
cacaggctcacaggacatttgggat

SEQ ID NO: 303606 - DNA, 25 bp, Mus musculus
cacaggctcagaaataagacgcttt

SEQ ID NO: 303607 - DNA, 25 bp, Mus musculus
cacaggctcagactccttaggacac

SEQ ID NO: 303608 - DNA, 25 bp, Mus musculus
cacaggctcagagtccttaggacac

SEQ ID NO: 303609 - DNA, 25 bp, Mus musculus
cacaggctcagatataagacgcttt

SEQ ID NO: 303610 - DNA, 25 bp, Mus musculus
cacaggctcaggacatggaggtgcc

SEQ ID NO: 303611 - DNA, 25 bp, Mus musculus
cacaggctcaggcaaaccaggtgtt

SEQ ID NO: 303612 - DNA, 25 bp, Mus musculus
cacaggctcagggaaaccaggtgtt

SEQ ID NO: 303613 - DNA, 25 bp, Mus musculus
cacaggctcaggtcatggaggtgcc

SEQ ID NO: 303614 - DNA, 25 bp, Mus musculus
cacaggctgttgagaggatgaactt

SEQ ID NO: 303615 - DNA, 25 bp, Mus musculus
cacaggctgttgtgaggatgaactt

SEQ ID NO: 303616 - DNA, 25 bp, Mus musculus
cacaggcttataagacctttccctc

SEQ ID NO: 303617 - DNA, 25 bp, Mus musculus
cacaggcttatatgacctttccctc

SEQ ID NO: 303618 - DNA, 25 bp, Mus musculus
cacaggcttgggaggtgcagaccat

SEQ ID NO: 303619 - DNA, 25 bp, Mus musculus
cacaggcttgggtggtgcagaccat

SEQ ID NO: 303620 - DNA, 25 bp, Mus musculus
cacaggcttttaaacctagcattcg

SEQ ID NO: 303621 - DNA, 25 bp, Mus musculus
cacaggcttttatacctagcattcg

SEQ ID NO: 303622 - DNA, 25 bp, Mus musculus
cacaggcttttgaaatcggttaatc

SEQ ID NO: 303623 - DNA, 25 bp, Mus musculus
cacaggcttttgtaatcggttaatc

SEQ ID NO: 303624 - DNA, 25 bp, Mus musculus
cacagggaaacccagtcttggtgaa

SEQ ID NO: 303625 - DNA, 25 bp, Mus musculus
cacagggaaaccgagtcttggtgaa

SEQ ID NO: 303626 - DNA, 25 bp, Mus musculus
cacagggaaattatgctccggactt

SEQ ID NO: 303627 - DNA, 25 bp, Mus musculus
cacagggaaattctgtagcagctgt

SEQ ID NO: 303628 - DNA, 25 bp, Mus musculus
cacagggaaattgtgtagcagctgt

SEQ ID NO: 303629 - DNA, 25 bp, Mus musculus
cacagggaaattttgctccggactt

SEQ ID NO: 303630 - DNA, 25 bp, Mus musculus
cacagggaccctccttgaggttgtc

SEQ ID NO: 303631 - DNA, 25 bp, Mus musculus
cacagggaccctgcttgaggttgtc

SEQ ID NO: 303632 - DNA, 25 bp, Mus musculus
cacagggactcaagcctctcaagac

SEQ ID NO: 303633 - DNA, 25 bp, Mus musculus
cacagggactcatgcctctcaagac

SEQ ID NO: 303634 - DNA, 25 bp, Mus musculus
cacagggacttgaagttgtcactaa

SEQ ID NO: 303635 - DNA, 25 bp, Mus musculus
cacagggacttgtagttgtcactaa

SEQ ID NO: 303636 - DNA, 25 bp, Mus musculus
cacagggagaccaccatggtgcatg

SEQ ID NO: 303637 - DNA, 25 bp, Mus musculus
cacagggagacctccatggtgcatg

SEQ ID NO: 303638 - DNA, 25 bp, Mus musculus
cacagggagcctcgccattaatacc

SEQ ID NO: 303639 - DNA, 25 bp, Mus musculus
cacagggagcctggccattaatacc

SEQ ID NO: 303640 - DNA, 25 bp, Mus musculus
cacagggagcgtacatgcattgcaa

SEQ ID NO: 303641 - DNA, 25 bp, Mus musculus
cacagggagcgttcatgcattgcaa

SEQ ID NO: 303642 - DNA, 25 bp, Mus musculus
cacagggagggcatctgtcaagtgt

SEQ ID NO: 303643 - DNA, 25 bp, Mus musculus
cacagggagggcttctgtcaagtgt

SEQ ID NO: 303644 - DNA, 25 bp, Mus musculus
cacagggagtatcgctttagcctgg

SEQ ID NO: 303645 - DNA, 25 bp, Mus musculus
cacagggagtatggctttagcctgg

SEQ ID NO: 303646 - DNA, 25 bp, Mus musculus
cacagggataggaagcgcacacctt

SEQ ID NO: 303647 - DNA, 25 bp, Mus musculus
cacagggataggtagcgcacacctt

SEQ ID NO: 303648 - DNA, 25 bp, Mus musculus
cacagggatccacaggccagatggt

SEQ ID NO: 303649 - DNA, 25 bp, Mus musculus
cacagggatccagaggccagatggt

SEQ ID NO: 303650 - DNA, 25 bp, Mus musculus
cacagggatctccaatgtctcacat

SEQ ID NO: 303651 - DNA, 25 bp, Mus musculus
cacagggatctcgaatgtctcacat

SEQ ID NO: 303652 - DNA, 25 bp, Mus musculus
cacagggcaaccaagtgtaaaccgg

SEQ ID NO: 303653 - DNA, 25 bp, Mus musculus
cacagggcaacctagtgtaaaccgg

SEQ ID NO: 303654 - DNA, 25 bp, Mus musculus
cacagggcactgagctaagcaagca

SEQ ID NO: 303655 - DNA, 25 bp, Mus musculus
cacagggcactgtgctaagcaagca

SEQ ID NO: 303656 - DNA, 25 bp, Mus musculus
cacagggcagccctatgaacagtat

SEQ ID NO: 303657 - DNA, 25 bp, Mus musculus
cacagggcagccgtatgaacagtat

SEQ ID NO: 303658 - DNA, 25 bp, Mus musculus
cacagggcagtgaactggcctacag

SEQ ID NO: 303659 - DNA, 25 bp, Mus musculus
cacagggcagtgcttccgttaatgg

SEQ ID NO: 303660 - DNA, 25 bp, Mus musculus
cacagggcagtggttccgttaatgg

SEQ ID NO: 303661 - DNA, 25 bp, Mus musculus
cacagggcagtgtactggcctacag

SEQ ID NO: 303662 - DNA, 25 bp, Mus musculus
cacagggcatacattcctattaggt

SEQ ID NO: 303663 - DNA, 25 bp, Mus musculus
cacagggcatactttcctattaggt

SEQ ID NO: 303664 - DNA, 25 bp, Mus musculus
cacagggcatggcttgaattagttt

SEQ ID NO: 303665 - DNA, 25 bp, Mus musculus
cacagggcatgggttgaattagttt

SEQ ID NO: 303666 - DNA, 25 bp, Mus musculus
cacagggcccacctttggttcctag

SEQ ID NO: 303667 - DNA, 25 bp, Mus musculus
cacagggcccacgtttggttcctag

SEQ ID NO: 303668 - DNA, 25 bp, Mus musculus
cacagggcctgtcaaacacttaaaa

SEQ ID NO: 303669 - DNA, 25 bp, Mus musculus
cacagggcctgtgaaacacttaaaa

SEQ ID NO: 303670 - DNA, 25 bp, Mus musculus
cacagggccttgctgctggaagaac

SEQ ID NO: 303671 - DNA, 25 bp, Mus musculus
cacagggccttggtgctggaagaac

SEQ ID NO: 303672 - DNA, 25 bp, Mus musculus
cacagggctgctatgaggaacaaat

SEQ ID NO: 303673 - DNA, 25 bp, Mus musculus
cacagggctgctttgaggaacaaat

SEQ ID NO: 303674 - DNA, 25 bp, Mus musculus
cacagggctgtaacagggctgcaga

SEQ ID NO: 303675 - DNA, 25 bp, Mus musculus
cacagggctgtatcagggctgcaga

SEQ ID NO: 303676 - DNA, 25 bp, Mus musculus
cacagggcttgaccaattataaaac

SEQ ID NO: 303677 - DNA, 25 bp, Mus musculus
cacagggcttgagcaattataaaac

SEQ ID NO: 303678 - DNA, 25 bp, Mus musculus
cacagggtcagaaagcaatgcacag

SEQ ID NO: 303679 - DNA, 25 bp, Mus musculus
cacagggtcagatagcaatgcacag

SEQ ID NO: 303680 - DNA, 25 bp, Mus musculus
cacagggtctctctccagctacaga

SEQ ID NO: 303681 - DNA, 25 bp, Mus musculus
cacagggtctctgtccagctacaga

SEQ ID NO: 303682 - DNA, 25 bp, Mus musculus
cacagggtctttctcatttgagcag

SEQ ID NO: 303683 - DNA, 25 bp, Mus musculus
cacagggtctttgtcatttgagcag

SEQ ID NO: 303684 - DNA, 25 bp, Mus musculus
cacagggtgcacagtataatatttt

SEQ ID NO: 303685 - DNA, 25 bp, Mus musculus
cacagggtgcactgtataatatttt

SEQ ID NO: 303686 - DNA, 25 bp, Mus musculus
cacagggtgctccttagtggttttc

SEQ ID NO: 303687 - DNA, 25 bp, Mus musculus
cacagggtgctcgttagtggttttc

SEQ ID NO: 303688 - DNA, 25 bp, Mus musculus
cacagggttccaaacctaaacaagg

SEQ ID NO: 303689 - DNA, 25 bp, Mus musculus
cacagggttccatacctaaacaagg

SEQ ID NO: 303690 - DNA, 25 bp, Mus musculus
cacagggttgttagtcgtggcagcc

SEQ ID NO: 303691 - DNA, 25 bp, Mus musculus
cacagggttgtttgtcgtggcagcc

SEQ ID NO: 303692 - DNA, 25 bp, Mus musculus
cacagggttttaacacatttcccag

SEQ ID NO: 303693 - DNA, 25 bp, Mus musculus
cacagggttttatcacatttcccag

SEQ ID NO: 303694 - DNA, 25 bp, Mus musculus
cacaggtaaagccttgggatattaa

SEQ ID NO: 303695 - DNA, 25 bp, Mus musculus
cacaggtaaagcgttgggatattaa

SEQ ID NO: 303696 - DNA, 25 bp, Mus musculus
cacaggtaaatgctgtctgagcaga

SEQ ID NO: 303697 - DNA, 25 bp, Mus musculus
cacaggtaaatggtgtctgagcaga

SEQ ID NO: 303698 - DNA, 25 bp, Mus musculus
cacaggtaatacaacacgccggact

SEQ ID NO: 303699 - DNA, 25 bp, Mus musculus
cacaggtaatactacacgccggact

SEQ ID NO: 303700 - DNA, 25 bp, Mus musculus
cacaggtaccctacagcattcaagt

SEQ ID NO: 303701 - DNA, 25 bp, Mus musculus
cacaggtacccttcagcattcaagt

SEQ ID NO: 303702 - DNA, 25 bp, Mus musculus
cacaggtacgtcagtttgattccta

SEQ ID NO: 303703 - DNA, 25 bp, Mus musculus
cacaggtacgtctgtttgattccta

SEQ ID NO: 303704 - DNA, 25 bp, Mus musculus
cacaggtagagtagaactgcccggt

SEQ ID NO: 303705 - DNA, 25 bp, Mus musculus
cacaggtagagttgaactgcccggt

SEQ ID NO: 303706 - DNA, 25 bp, Mus musculus
cacaggtatagcaactgctcgttta

SEQ ID NO: 303707 - DNA, 25 bp, Mus musculus
cacaggtatagccttgggcagcgca

SEQ ID NO: 303708 - DNA, 25 bp, Mus musculus
cacaggtatagcgttgggcagcgca

SEQ ID NO: 303709 - DNA, 25 bp, Mus musculus
cacaggtatagctactgctcgttta

SEQ ID NO: 303710 - DNA, 25 bp, Mus musculus
cacaggtcaagtactgatttaaagt

SEQ ID NO: 303711 - DNA, 25 bp, Mus musculus
cacaggtcaagttctgatttaaagt

SEQ ID NO: 303712 - DNA, 25 bp, Mus musculus
cacaggtcaccgacggcttagggta

SEQ ID NO: 303713 - DNA, 25 bp, Mus musculus
cacaggtcaccgtcggcttagggta

SEQ ID NO: 303714 - DNA, 25 bp, Mus musculus
cacaggtcacttcctgcttaatagc

SEQ ID NO: 303715 - DNA, 25 bp, Mus musculus
cacaggtcacttgctgcttaatagc

SEQ ID NO: 303716 - DNA, 25 bp, Mus musculus
cacaggtcaggacacttctggccat

SEQ ID NO: 303717 - DNA, 25 bp, Mus musculus
cacaggtcaggagacttctggccat

SEQ ID NO: 303718 - DNA, 25 bp, Mus musculus
cacaggtcatcactcctgaggagat

SEQ ID NO: 303719 - DNA, 25 bp, Mus musculus
cacaggtcatcagtcctgaggagat

SEQ ID NO: 303720 - DNA, 25 bp, Mus musculus
cacaggtcgtcccagtaggaaccaa

SEQ ID NO: 303721 - DNA, 25 bp, Mus musculus
cacaggtcgtccgagtaggaaccaa

SEQ ID NO: 303722 - DNA, 25 bp, Mus musculus
cacaggtctaccagggtccaaaggt

SEQ ID NO: 303723 - DNA, 25 bp, Mus musculus
cacaggtctacctgggtccaaaggt

SEQ ID NO: 303724 - DNA, 25 bp, Mus musculus
cacaggtctcataatgttgatgggt

SEQ ID NO: 303725 - DNA, 25 bp, Mus musculus
cacaggtctcattatgttgatgggt

SEQ ID NO: 303726 - DNA, 25 bp, Mus musculus
cacaggtctgaaatcaagcacttga

SEQ ID NO: 303727 - DNA, 25 bp, Mus musculus
cacaggtctgaattcaagcacttga

SEQ ID NO: 303728 - DNA, 25 bp, Mus musculus
cacaggtctgacaggctaatgtcca

SEQ ID NO: 303729 - DNA, 25 bp, Mus musculus
cacaggtctgactggctaatgtcca

SEQ ID NO: 303730 - DNA, 25 bp, Mus musculus
cacaggtctggacggcataccacca

SEQ ID NO: 303731 - DNA, 25 bp, Mus musculus
cacaggtctggagggcataccacca

SEQ ID NO: 303732 - DNA, 25 bp, Mus musculus
cacaggtgacaaccaagagtcccct

SEQ ID NO: 303733 - DNA, 25 bp, Mus musculus
cacaggtgacaagcaagagtcccct

SEQ ID NO: 303734 - DNA, 25 bp, Mus musculus
cacaggtgacgcagtgcgccccggt

SEQ ID NO: 303735 - DNA, 25 bp, Mus musculus
cacaggtgacgctgtgcgccccggt

SEQ ID NO: 303736 - DNA, 25 bp, Mus musculus
cacaggtgcacaagcctgtgggaga

SEQ ID NO: 303737 - DNA, 25 bp, Mus musculus
cacaggtgcacacgtagatttggtt

SEQ ID NO: 303738 - DNA, 25 bp, Mus musculus
cacaggtgcacaggtagatttggtt

SEQ ID NO: 303739 - DNA, 25 bp, Mus musculus
cacaggtgcacatgcctgtgggaga

SEQ ID NO: 303740 - DNA, 25 bp, Mus musculus
cacaggtgccttcgcctcggcagtg

SEQ ID NO: 303741 - DNA, 25 bp, Mus musculus
cacaggtgccttggcctcggcagtg

SEQ ID NO: 303742 - DNA, 25 bp, Mus musculus
cacaggtggcctcgctgagaagcaa

SEQ ID NO: 303743 - DNA, 25 bp, Mus musculus
cacaggtggcctggctgagaagcaa

SEQ ID NO: 303744 - DNA, 25 bp, Mus musculus
cacaggtgtattctgcgggcactaa

SEQ ID NO: 303745 - DNA, 25 bp, Mus musculus
cacaggtgtattgtgcgggcactaa

SEQ ID NO: 303746 - DNA, 25 bp, Mus musculus
cacaggttacacatgcagaagaaag

SEQ ID NO: 303747 - DNA, 25 bp, Mus musculus
cacaggttacacttgcagaagaaag

SEQ ID NO: 303748 - DNA, 25 bp, Mus musculus
cacaggttcacccatgtctaatttg

SEQ ID NO: 303749 - DNA, 25 bp, Mus musculus
cacaggttcaccgatgtctaatttg

SEQ ID NO: 303750 - DNA, 25 bp, Mus musculus
cacaggttctggcaggaaagaatgt

SEQ ID NO: 303751 - DNA, 25 bp, Mus musculus
cacaggttctgggaggaaagaatgt

SEQ ID NO: 303752 - DNA, 25 bp, Mus musculus
cacaggttgcagagtgctcagtcct

SEQ ID NO: 303753 - DNA, 25 bp, Mus musculus
cacaggttgcagtgtgctcagtcct

SEQ ID NO: 303754 - DNA, 25 bp, Mus musculus
cacaggttggctcgctcgacccagg

SEQ ID NO: 303755 - DNA, 25 bp, Mus musculus
cacaggttggctggctcgacccagg

SEQ ID NO: 303756 - DNA, 25 bp, Mus musculus
cacaggttgggaaaacacaattgct

SEQ ID NO: 303757 - DNA, 25 bp, Mus musculus
cacaggttgggataacacaattgct

SEQ ID NO: 303758 - DNA, 25 bp, Mus musculus
cacaggttgtctcctaagtgtcaga

SEQ ID NO: 303759 - DNA, 25 bp, Mus musculus
cacaggttgtctgctaagtgtcaga

SEQ ID NO: 303760 - DNA, 25 bp, Mus musculus
cacaggttgttcaggcttttcctca

SEQ ID NO: 303761 - DNA, 25 bp, Mus musculus
cacaggttgttctggcttttcctca

SEQ ID NO: 303762 - DNA, 25 bp, Mus musculus
cacaggtttcccaacagagcatcta

SEQ ID NO: 303763 - DNA, 25 bp, Mus musculus
cacaggtttccctacagagcatcta

SEQ ID NO: 303764 - DNA, 25 bp, Mus musculus
cacaggtttcctacttgtcacctaa

SEQ ID NO: 303765 - DNA, 25 bp, Mus musculus
cacaggtttccttcttgtcacctaa

SEQ ID NO: 303766 - DNA, 25 bp, Mus musculus
cacagtaaaagcaaatcccagctct

SEQ ID NO: 303767 - DNA, 25 bp, Mus musculus
cacagtaaaagctaatcccagctct

SEQ ID NO: 303768 - DNA, 25 bp, Mus musculus
cacagtaacactaccaacattaaaa

SEQ ID NO: 303769 - DNA, 25 bp, Mus musculus
cacagtaacacttccaacattaaaa

SEQ ID NO: 303770 - DNA, 25 bp, Mus musculus
cacagtaacatgagtggactggaga

SEQ ID NO: 303771 - DNA, 25 bp, Mus musculus
cacagtaacatgtgtggactggaga

SEQ ID NO: 303772 - DNA, 25 bp, Mus musculus
cacagtaacccaaagtagcccatag

SEQ ID NO: 303773 - DNA, 25 bp, Mus musculus
cacagtaacccatagtagcccatag

SEQ ID NO: 303774 - DNA, 25 bp, Mus musculus
cacagtaactgaagtaacttgggct

SEQ ID NO: 303775 - DNA, 25 bp, Mus musculus
cacagtaactgatgtaacttgggct

SEQ ID NO: 303776 - DNA, 25 bp, Mus musculus
cacagtaagctcactatcggctgag

SEQ ID NO: 303777 - DNA, 25 bp, Mus musculus
cacagtaagctcagggttcccgggt

SEQ ID NO: 303778 - DNA, 25 bp, Mus musculus
cacagtaagctctctatcggctgag

SEQ ID NO: 303779 - DNA, 25 bp, Mus musculus
cacagtaagctctgggttcccgggt

SEQ ID NO: 303780 - DNA, 25 bp, Mus musculus
cacagtaagtggctttcttccctcc

SEQ ID NO: 303781 - DNA, 25 bp, Mus musculus
cacagtaagtgggtttcttccctcc

SEQ ID NO: 303782 - DNA, 25 bp, Mus musculus
cacagtaatacccagtttcgagaaa

SEQ ID NO: 303783 - DNA, 25 bp, Mus musculus
cacagtaataccgagtttcgagaaa

SEQ ID NO: 303784 - DNA, 25 bp, Mus musculus
cacagtaattttctatgactcatca

SEQ ID NO: 303785 - DNA, 25 bp, Mus musculus
cacagtaattttgtatgactcatca

SEQ ID NO: 303786 - DNA, 25 bp, Mus musculus
cacagtacacttcgccctgggtaaa

SEQ ID NO: 303787 - DNA, 25 bp, Mus musculus
cacagtacacttggccctgggtaaa

SEQ ID NO: 303788 - DNA, 25 bp, Mus musculus
cacagtaccggtcgcatgtttttct

SEQ ID NO: 303789 - DNA, 25 bp, Mus musculus
cacagtaccggtggcatgtttttct

SEQ ID NO: 303790 - DNA, 25 bp, Mus musculus
cacagtacgccccagagattttaaa

SEQ ID NO: 303791 - DNA, 25 bp, Mus musculus
cacagtacgcccgagagattttaaa

SEQ ID NO: 303792 - DNA, 25 bp, Mus musculus
cacagtacgctgaaatcctcgccga

SEQ ID NO: 303793 - DNA, 25 bp, Mus musculus
cacagtacgctgtaatcctcgccga

SEQ ID NO: 303794 - DNA, 25 bp, Mus musculus
cacagtacggaaactttacacccat

SEQ ID NO: 303795 - DNA, 25 bp, Mus musculus
cacagtacggaatctttacacccat

SEQ ID NO: 303796 - DNA, 25 bp, Mus musculus
cacagtactgaaatcaatgcttaga

SEQ ID NO: 303797 - DNA, 25 bp, Mus musculus
cacagtactgaacggcggaatgaag

SEQ ID NO: 303798 - DNA, 25 bp, Mus musculus
cacagtactgaagggcggaatgaag

SEQ ID NO: 303799 - DNA, 25 bp, Mus musculus
cacagtactgaattcaatgcttaga

SEQ ID NO: 303800 - DNA, 25 bp, Mus musculus
cacagtactttgagttcgagtttga

SEQ ID NO: 303801 - DNA, 25 bp, Mus musculus
cacagtactttgtgttcgagtttga

SEQ ID NO: 303802 - DNA, 25 bp, Mus musculus
cacagtagggctcaatcaacgacga

SEQ ID NO: 303803 - DNA, 25 bp, Mus musculus
cacagtagggctgaatcaacgacga

SEQ ID NO: 303804 - DNA, 25 bp, Mus musculus
cacagtagtactcttgacacctgcc

SEQ ID NO: 303805 - DNA, 25 bp, Mus musculus
cacagtagtactgttgacacctgcc

SEQ ID NO: 303806 - DNA, 25 bp, Mus musculus
cacagtagtttacttgaccaggaaa

SEQ ID NO: 303807 - DNA, 25 bp, Mus musculus
cacagtagtttagttgaccaggaaa

SEQ ID NO: 303808 - DNA, 25 bp, Mus musculus
cacagtatcggtcttgagtttccat

SEQ ID NO: 303809 - DNA, 25 bp, Mus musculus
cacagtatcggtgttgagtttccat

SEQ ID NO: 303810 - DNA, 25 bp, Mus musculus
cacagtatctgaattcaagtcatat

SEQ ID NO: 303811 - DNA, 25 bp, Mus musculus
cacagtatctgatttcaagtcatat

SEQ ID NO: 303812 - DNA, 25 bp, Mus musculus
cacagtatctgcaagagctttcgaa

SEQ ID NO: 303813 - DNA, 25 bp, Mus musculus
cacagtatctgctagagctttcgaa

SEQ ID NO: 303814 - DNA, 25 bp, Mus musculus
cacagtatggcacggaatcgggttt

SEQ ID NO: 303815 - DNA, 25 bp, Mus musculus
cacagtatggcagggaatcgggttt

SEQ ID NO: 303816 - DNA, 25 bp, Mus musculus
cacagtatgtgcctaaagggttcag

SEQ ID NO: 303817 - DNA, 25 bp, Mus musculus
cacagtatgtgcgtaaagggttcag

SEQ ID NO: 303818 - DNA, 25 bp, Mus musculus
cacagtattcccacaagatcaacag

SEQ ID NO: 303819 - DNA, 25 bp, Mus musculus
cacagtattccctcaagatcaacag

SEQ ID NO: 303820 - DNA, 25 bp, Mus musculus
cacagtattgctaggtttatttgac

SEQ ID NO: 303821 - DNA, 25 bp, Mus musculus
cacagtattgcttggtttatttgac

SEQ ID NO: 303822 - DNA, 25 bp, Mus musculus
cacagtatttatcgccatcggcgct

SEQ ID NO: 303823 - DNA, 25 bp, Mus musculus
cacagtatttatggccatcggcgct

SEQ ID NO: 303824 - DNA, 25 bp, Mus musculus
cacagtcaacatatcaaagccccat

SEQ ID NO: 303825 - DNA, 25 bp, Mus musculus
cacagtcaacatttcaaagccccat

SEQ ID NO: 303826 - DNA, 25 bp, Mus musculus
cacagtcaaggcagcgctgattagt

SEQ ID NO: 303827 - DNA, 25 bp, Mus musculus
cacagtcaaggctgcgctgattagt

SEQ ID NO: 303828 - DNA, 25 bp, Mus musculus
cacagtcacagtcagaggcacaggt

SEQ ID NO: 303829 - DNA, 25 bp, Mus musculus
cacagtcacagtgagaggcacaggt

SEQ ID NO: 303830 - DNA, 25 bp, Mus musculus
cacagtcacgggaggctgtggcttt

SEQ ID NO: 303831 - DNA, 25 bp, Mus musculus
cacagtcacgggtggctgtggcttt

SEQ ID NO: 303832 - DNA, 25 bp, Mus musculus
cacagtcactggctataagcaagaa

SEQ ID NO: 303833 - DNA, 25 bp, Mus musculus
cacagtcactgggtataagcaagaa

SEQ ID NO: 303834 - DNA, 25 bp, Mus musculus
cacagtcacttgacaggttggcact

SEQ ID NO: 303835 - DNA, 25 bp, Mus musculus
cacagtcacttgtcaggttggcact

SEQ ID NO: 303836 - DNA, 25 bp, Mus musculus
cacagtcagtgcctgttgtgctgaa

SEQ ID NO: 303837 - DNA, 25 bp, Mus musculus
cacagtcagtgcgtgttgtgctgaa

SEQ ID NO: 303838 - DNA, 25 bp, Mus musculus
cacagtcagttgctgtatctcctat

SEQ ID NO: 303839 - DNA, 25 bp, Mus musculus
cacagtcagttggtgtatctcctat

SEQ ID NO: 303840 - DNA, 25 bp, Mus musculus
cacagtcataaaaaacagggttcat

SEQ ID NO: 303841 - DNA, 25 bp, Mus musculus
cacagtcataaataacagggttcat

SEQ ID NO: 303842 - DNA, 25 bp, Mus musculus
cacagtcataacctgtaacaactta

SEQ ID NO: 303843 - DNA, 25 bp, Mus musculus
cacagtcataacgtgtaacaactta

SEQ ID NO: 303844 - DNA, 25 bp, Mus musculus
cacagtcatctgattgtatgcccca

SEQ ID NO: 303845 - DNA, 25 bp, Mus musculus
cacagtcatctgtttgtatgcccca

SEQ ID NO: 303846 - DNA, 25 bp, Mus musculus
cacagtcatgtgcaatagcatggtt

SEQ ID NO: 303847 - DNA, 25 bp, Mus musculus
cacagtcatgtggaatagcatggtt

SEQ ID NO: 303848 - DNA, 25 bp, Mus musculus
cacagtcattgtagtgggcctgatt

SEQ ID NO: 303849 - DNA, 25 bp, Mus musculus
cacagtcattgtcgtgaatgtccat

SEQ ID NO: 303850 - DNA, 25 bp, Mus musculus
cacagtcattgtggtgaatgtccat

SEQ ID NO: 303851 - DNA, 25 bp, Mus musculus
cacagtcattgttgtgggcctgatt

SEQ ID NO: 303852 - DNA, 25 bp, Mus musculus
cacagtccaagacgaatggtatctt

SEQ ID NO: 303853 - DNA, 25 bp, Mus musculus
cacagtccaagaggaatggtatctt

SEQ ID NO: 303854 - DNA, 25 bp, Mus musculus
cacagtccatggcagactctcaaat

SEQ ID NO: 303855 - DNA, 25 bp, Mus musculus
cacagtccatgggagactctcaaat

SEQ ID NO: 303856 - DNA, 25 bp, Mus musculus
cacagtcccagacggtatgccagga

SEQ ID NO: 303857 - DNA, 25 bp, Mus musculus
cacagtcccagagggtatgccagga

SEQ ID NO: 303858 - DNA, 25 bp, Mus musculus
cacagtcctgacaactggtttgttt

SEQ ID NO: 303859 - DNA, 25 bp, Mus musculus
cacagtcctgactactggtttgttt

SEQ ID NO: 303860 - DNA, 25 bp, Mus musculus
cacagtcctgtgatctctttcaaat

SEQ ID NO: 303861 - DNA, 25 bp, Mus musculus
cacagtcctgtgttctctttcaaat

SEQ ID NO: 303862 - DNA, 25 bp, Mus musculus
cacagtcggcagagttttattgaag

SEQ ID NO: 303863 - DNA, 25 bp, Mus musculus
cacagtcggcagtgttttattgaag

SEQ ID NO: 303864 - DNA, 25 bp, Mus musculus
cacagtcggctgactcttgaacaga

SEQ ID NO: 303865 - DNA, 25 bp, Mus musculus
cacagtcggctgtctcttgaacaga

SEQ ID NO: 303866 - DNA, 25 bp, Mus musculus
cacagtcggtggagctacgtgttct

SEQ ID NO: 303867 - DNA, 25 bp, Mus musculus
cacagtcggtggtgctacgtgttct

SEQ ID NO: 303868 - DNA, 25 bp, Mus musculus
cacagtctatccagggtgatatggt

SEQ ID NO: 303869 - DNA, 25 bp, Mus musculus
cacagtctatcctgggtgatatggt

SEQ ID NO: 303870 - DNA, 25 bp, Mus musculus
cacagtctcagaccgcagggtggaa

SEQ ID NO: 303871 - DNA, 25 bp, Mus musculus
cacagtctcagagcgcagggtggaa

SEQ ID NO: 303872 - DNA, 25 bp, Mus musculus
cacagtctcagccacagagaacaag

SEQ ID NO: 303873 - DNA, 25 bp, Mus musculus
cacagtctcagcgacagagaacaag

SEQ ID NO: 303874 - DNA, 25 bp, Mus musculus
cacagtctcgtgctttactgacagt

SEQ ID NO: 303875 - DNA, 25 bp, Mus musculus
cacagtctcgtggtttactgacagt

SEQ ID NO: 303876 - DNA, 25 bp, Mus musculus
cacagtctgcttagggagtcactaa

SEQ ID NO: 303877 - DNA, 25 bp, Mus musculus
cacagtctgctttgggagtcactaa

SEQ ID NO: 303878 - DNA, 25 bp, Mus musculus
cacagtctggtgacagggacttcaa

SEQ ID NO: 303879 - DNA, 25 bp, Mus musculus
cacagtctggtgtcagggacttcaa

SEQ ID NO: 303880 - DNA, 25 bp, Mus musculus
cacagtgaacataatcctaaatcct

SEQ ID NO: 303881 - DNA, 25 bp, Mus musculus
cacagtgaacattatcctaaatcct

SEQ ID NO: 303882 - DNA, 25 bp, Mus musculus
cacagtgaagaaataccttgccatc

SEQ ID NO: 303883 - DNA, 25 bp, Mus musculus
cacagtgaagaattaccttgccatc

SEQ ID NO: 303884 - DNA, 25 bp, Mus musculus
cacagtgaagtgctctagatttatt

SEQ ID NO: 303885 - DNA, 25 bp, Mus musculus
cacagtgaagtggtctagatttatt

SEQ ID NO: 303886 - DNA, 25 bp, Mus musculus
cacagtgacctaaattcaagcccta

SEQ ID NO: 303887 - DNA, 25 bp, Mus musculus
cacagtgacctatattcaagcccta

SEQ ID NO: 303888 - DNA, 25 bp, Mus musculus
cacagtgactatataatgcctttat

SEQ ID NO: 303889 - DNA, 25 bp, Mus musculus
cacagtgactatttaatgcctttat

SEQ ID NO: 303890 - DNA, 25 bp, Mus musculus
cacagtgactctatacgtatggatg

SEQ ID NO: 303891 - DNA, 25 bp, Mus musculus
cacagtgactctttacgtatggatg

SEQ ID NO: 303892 - DNA, 25 bp, Mus musculus
cacagtgactgcatcattggagtgc

SEQ ID NO: 303893 - DNA, 25 bp, Mus musculus
cacagtgactgcttcattggagtgc

SEQ ID NO: 303894 - DNA, 25 bp, Mus musculus
cacagtgagcaaatgtgctctggga

SEQ ID NO: 303895 - DNA, 25 bp, Mus musculus
cacagtgagcaattgtgctctggga

SEQ ID NO: 303896 - DNA, 25 bp, Mus musculus
cacagtgatgatctcgagatcggaa

SEQ ID NO: 303897 - DNA, 25 bp, Mus musculus
cacagtgatgatgtcgagatcggaa

SEQ ID NO: 303898 - DNA, 25 bp, Mus musculus
cacagtgatgtcactttaagctcag

SEQ ID NO: 303899 - DNA, 25 bp, Mus musculus
cacagtgatgtctctttaagctcag

SEQ ID NO: 303900 - DNA, 25 bp, Mus musculus
cacagtgattgccacacagacatct

SEQ ID NO: 303901 - DNA, 25 bp, Mus musculus
cacagtgattgcgacacagacatct

SEQ ID NO: 303902 - DNA, 25 bp, Mus musculus
cacagtgcaatcattgtccctctag

SEQ ID NO: 303903 - DNA, 25 bp, Mus musculus
cacagtgcaatctttgtccctctag

SEQ ID NO: 303904 - DNA, 25 bp, Mus musculus
cacagtgcacgactcttcagagggt

SEQ ID NO: 303905 - DNA, 25 bp, Mus musculus
cacagtgcacgagtcttcagagggt

SEQ ID NO: 303906 - DNA, 25 bp, Mus musculus
cacagtgcacgcagatggtgtcaga

SEQ ID NO: 303907 - DNA, 25 bp, Mus musculus
cacagtgcacgctgatggtgtcaga

SEQ ID NO: 303908 - DNA, 25 bp, Mus musculus
cacagtgccatcattatcgtaggga

SEQ ID NO: 303909 - DNA, 25 bp, Mus musculus
cacagtgccatctttatcgtaggga

SEQ ID NO: 303910 - DNA, 25 bp, Mus musculus
cacagtgcccagaagacactcatga

SEQ ID NO: 303911 - DNA, 25 bp, Mus musculus
cacagtgcccagaatccgaaataac

SEQ ID NO: 303912 - DNA, 25 bp, Mus musculus
cacagtgcccagtagacactcatga

SEQ ID NO: 303913 - DNA, 25 bp, Mus musculus
cacagtgcccagtatccgaaataac

SEQ ID NO: 303914 - DNA, 25 bp, Mus musculus
cacagtgccttgcttagcaattgtt

SEQ ID NO: 303915 - DNA, 25 bp, Mus musculus
cacagtgccttggttagcaattgtt

SEQ ID NO: 303916 - DNA, 25 bp, Mus musculus
cacagtgcgcgtacattttatcata

SEQ ID NO: 303917 - DNA, 25 bp, Mus musculus
cacagtgcgcgttcattttatcata

SEQ ID NO: 303918 - DNA, 25 bp, Mus musculus
cacagtgcggctagagtttattttc

SEQ ID NO: 303919 - DNA, 25 bp, Mus musculus
cacagtgcggcttgagtttattttc

SEQ ID NO: 303920 - DNA, 25 bp, Mus musculus
cacagtgctctaccagctcaagttc

SEQ ID NO: 303921 - DNA, 25 bp, Mus musculus
cacagtgctctagcagctcaagttc

SEQ ID NO: 303922 - DNA, 25 bp, Mus musculus
cacagtgctctccaaattatttgaa

SEQ ID NO: 303923 - DNA, 25 bp, Mus musculus
cacagtgctctcgaaattatttgaa

SEQ ID NO: 303924 - DNA, 25 bp, Mus musculus
cacagtgctctgaacatgggttatt

SEQ ID NO: 303925 - DNA, 25 bp, Mus musculus
cacagtgctctgtacatgggttatt

SEQ ID NO: 303926 - DNA, 25 bp, Mus musculus
cacagtgctgtacagatctctgtct

SEQ ID NO: 303927 - DNA, 25 bp, Mus musculus
cacagtgctgtagagatctctgtct

SEQ ID NO: 303928 - DNA, 25 bp, Mus musculus
cacagtgctgtgattccagttctag

SEQ ID NO: 303929 - DNA, 25 bp, Mus musculus
cacagtgctgtgtttccagttctag

SEQ ID NO: 303930 - DNA, 25 bp, Mus musculus
cacagtgcttcaacagcagtgcatt

SEQ ID NO: 303931 - DNA, 25 bp, Mus musculus
cacagtgcttcatcagcagtgcatt

SEQ ID NO: 303932 - DNA, 25 bp, Mus musculus
cacagtggaaatccctctcccgaag

SEQ ID NO: 303933 - DNA, 25 bp, Mus musculus
cacagtggaaatgcctctcccgaag

SEQ ID NO: 303934 - DNA, 25 bp, Mus musculus
cacagtggactaatatcagttctgt

SEQ ID NO: 303935 - DNA, 25 bp, Mus musculus
cacagtggactacagcatgggctat

SEQ ID NO: 303936 - DNA, 25 bp, Mus musculus
cacagtggactagagcatgggctat

SEQ ID NO: 303937 - DNA, 25 bp, Mus musculus
cacagtggactattatcagttctgt

SEQ ID NO: 303938 - DNA, 25 bp, Mus musculus
cacagtggatacatgcttcccatgg

SEQ ID NO: 303939 - DNA, 25 bp, Mus musculus
cacagtggatacttgcttcccatgg

SEQ ID NO: 303940 - DNA, 25 bp, Mus musculus
cacagtggcatcaccagcagctgat

SEQ ID NO: 303941 - DNA, 25 bp, Mus musculus
cacagtggcatctccagcagctgat

SEQ ID NO: 303942 - DNA, 25 bp, Mus musculus
cacagtggcggtagccttttcaaaa

SEQ ID NO: 303943 - DNA, 25 bp, Mus musculus
cacagtggcggttgccttttcaaaa

SEQ ID NO: 303944 - DNA, 25 bp, Mus musculus
cacagtggctgaccggagtgactct

SEQ ID NO: 303945 - DNA, 25 bp, Mus musculus
cacagtggctgagcggagtgactct

SEQ ID NO: 303946 - DNA, 25 bp, Mus musculus
cacagtgggaccactttgcaggaag

SEQ ID NO: 303947 - DNA, 25 bp, Mus musculus
cacagtgggacctctttgcaggaag

SEQ ID NO: 303948 - DNA, 25 bp, Mus musculus
cacagtgggtcacgtgaaaatcagt

SEQ ID NO: 303949 - DNA, 25 bp, Mus musculus
cacagtgggtcaggtgaaaatcagt

SEQ ID NO: 303950 - DNA, 25 bp, Mus musculus
cacagtgggttacgcacttcccagt

SEQ ID NO: 303951 - DNA, 25 bp, Mus musculus
cacagtgggttaggcacttcccagt

SEQ ID NO: 303952 - DNA, 25 bp, Mus musculus
cacagtggtagcagtcgggttgacc

SEQ ID NO: 303953 - DNA, 25 bp, Mus musculus
cacagtggtagctgtcgggttgacc

SEQ ID NO: 303954 - DNA, 25 bp, Mus musculus
cacagtggttgtacccctcctaggc

SEQ ID NO: 303955 - DNA, 25 bp, Mus musculus
cacagtggttgttcccctcctaggc

SEQ ID NO: 303956 - DNA, 25 bp, Mus musculus
cacagtgtagctattcacaacagtt

SEQ ID NO: 303957 - DNA, 25 bp, Mus musculus
cacagtgtagcttttcacaacagtt

SEQ ID NO: 303958 - DNA, 25 bp, Mus musculus
cacagtgtatacatggcttctccat

SEQ ID NO: 303959 - DNA, 25 bp, Mus musculus
cacagtgtatacttggcttctccat

SEQ ID NO: 303960 - DNA, 25 bp, Mus musculus
cacagtgtgactatggttgctcctc

SEQ ID NO: 303961 - DNA, 25 bp, Mus musculus
cacagtgtgactttggttgctcctc

SEQ ID NO: 303962 - DNA, 25 bp, Mus musculus
cacagtgtgaggaggcgtcagctct

SEQ ID NO: 303963 - DNA, 25 bp, Mus musculus
cacagtgtgaggtggcgtcagctct

SEQ ID NO: 303964 - DNA, 25 bp, Mus musculus
cacagtgtgatcatcctgcatgttt

SEQ ID NO: 303965 - DNA, 25 bp, Mus musculus
cacagtgtgatcttcctgcatgttt

SEQ ID NO: 303966 - DNA, 25 bp, Mus musculus
cacagtgtgcaaaggtggccccgtg

SEQ ID NO: 303967 - DNA, 25 bp, Mus musculus
cacagtgtgcaatggtggccccgtg

SEQ ID NO: 303968 - DNA, 25 bp, Mus musculus
cacagtgtgcatactgaggtatcac

SEQ ID NO: 303969 - DNA, 25 bp, Mus musculus
cacagtgtgcatcctcgtgggaact

SEQ ID NO: 303970 - DNA, 25 bp, Mus musculus
cacagtgtgcatgctcgtgggaact

SEQ ID NO: 303971 - DNA, 25 bp, Mus musculus
cacagtgtgcattctgaggtatcac

SEQ ID NO: 303972 - DNA, 25 bp, Mus musculus
cacagtgtgcgtctaaaaggtgctg

SEQ ID NO: 303973 - DNA, 25 bp, Mus musculus
cacagtgtgcgtgtaaaaggtgctg

SEQ ID NO: 303974 - DNA, 25 bp, Mus musculus
cacagtgtgctgaactctcacttaa

SEQ ID NO: 303975 - DNA, 25 bp, Mus musculus
cacagtgtgctgtactctcacttaa

SEQ ID NO: 303976 - DNA, 25 bp, Mus musculus
cacagtgtgttaaatacaggcccat

SEQ ID NO: 303977 - DNA, 25 bp, Mus musculus
cacagtgtgttatatacaggcccat

SEQ ID NO: 303978 - DNA, 25 bp, Mus musculus
cacagtgtgtttccaactcgggaag

SEQ ID NO: 303979 - DNA, 25 bp, Mus musculus
cacagtgtgtttgcaactcgggaag

SEQ ID NO: 303980 - DNA, 25 bp, Mus musculus
cacagtgttcatccagtgaaagtaa

SEQ ID NO: 303981 - DNA, 25 bp, Mus musculus
cacagtgttcatgcagtgaaagtaa

SEQ ID NO: 303982 - DNA, 25 bp, Mus musculus
cacagtgttggcaggactctgactc

SEQ ID NO: 303983 - DNA, 25 bp, Mus musculus
cacagtgttggctggactctgactc

SEQ ID NO: 303984 - DNA, 25 bp, Mus musculus
cacagtgttgtcaggtggtaccacc

SEQ ID NO: 303985 - DNA, 25 bp, Mus musculus
cacagtgttgtctggtggtaccacc

SEQ ID NO: 303986 - DNA, 25 bp, Mus musculus
cacagtgtttttcttcagccacata

SEQ ID NO: 303987 - DNA, 25 bp, Mus musculus
cacagtgtttttgttcagccacata

SEQ ID NO: 303988 - DNA, 25 bp, Mus musculus
cacagttaacacatggatttacatg

SEQ ID NO: 303989 - DNA, 25 bp, Mus musculus
cacagttaacacttggatttacatg

SEQ ID NO: 303990 - DNA, 25 bp, Mus musculus
cacagttaagtcaacctcttggtcc

SEQ ID NO: 303991 - DNA, 25 bp, Mus musculus
cacagttaagtctacctcttggtcc

SEQ ID NO: 303992 - DNA, 25 bp, Mus musculus
cacagttaccagcacatggccagat

SEQ ID NO: 303993 - DNA, 25 bp, Mus musculus
cacagttaccaggacatggccagat

SEQ ID NO: 303994 - DNA, 25 bp, Mus musculus
cacagttacctcagttaccatttct

SEQ ID NO: 303995 - DNA, 25 bp, Mus musculus
cacagttacctctgttaccatttct

SEQ ID NO: 303996 - DNA, 25 bp, Mus musculus
cacagttactctatgaccaaggcaa

SEQ ID NO: 303997 - DNA, 25 bp, Mus musculus
cacagttactctttgaccaaggcaa

SEQ ID NO: 303998 - DNA, 25 bp, Mus musculus
cacagttagacaatccatggtttaa

SEQ ID NO: 303999 - DNA, 25 bp, Mus musculus
cacagttagacattccatggtttaa

SEQ ID NO: 304000 - DNA, 25 bp, Mus musculus
cacagttattgtaggcgtagtacgc

SEQ ID NO: 304001 - DNA, 25 bp, Mus musculus
cacagttattgttggcgtagtacgc

SEQ ID NO: 304002 - DNA, 25 bp, Mus musculus
cacagttcaaagatcatccaacgtt

SEQ ID NO: 304003 - DNA, 25 bp, Mus musculus
cacagttcaaagttcatccaacgtt

SEQ ID NO: 304004 - DNA, 25 bp, Mus musculus
cacagttcaaggctgggaaacttgg

SEQ ID NO: 304005 - DNA, 25 bp, Mus musculus
cacagttcaagggtgggaaacttgg

SEQ ID NO: 304006 - DNA, 25 bp, Mus musculus
cacagttcaagtctctttctagtgt

SEQ ID NO: 304007 - DNA, 25 bp, Mus musculus
cacagttcaagtgtctttctagtgt

SEQ ID NO: 304008 - DNA, 25 bp, Mus musculus
cacagttcactgacccgcagggtgg

SEQ ID NO: 304009 - DNA, 25 bp, Mus musculus
cacagttcactgtcccgcagggtgg

SEQ ID NO: 304010 - DNA, 25 bp, Mus musculus
cacagttcagttctatcagtttaat

SEQ ID NO: 304011 - DNA, 25 bp, Mus musculus
cacagttcagttgtatcagtttaat

SEQ ID NO: 304012 - DNA, 25 bp, Mus musculus
cacagttcatttaagagtacaaact

SEQ ID NO: 304013 - DNA, 25 bp, Mus musculus
cacagttcattttagagtacaaact

SEQ ID NO: 304014 - DNA, 25 bp, Mus musculus
cacagttccatactgacagtcacaa

SEQ ID NO: 304015 - DNA, 25 bp, Mus musculus
cacagttccatagtgacagtcacaa

SEQ ID NO: 304016 - DNA, 25 bp, Mus musculus
cacagttccctgagcttttaaacac

SEQ ID NO: 304017 - DNA, 25 bp, Mus musculus
cacagttccctgtgcttttaaacac

SEQ ID NO: 304018 - DNA, 25 bp, Mus musculus
cacagttcctgtcgtagacttttca

SEQ ID NO: 304019 - DNA, 25 bp, Mus musculus
cacagttcctgtggtagacttttca

SEQ ID NO: 304020 - DNA, 25 bp, Mus musculus
cacagttccttactttgcatttagt

SEQ ID NO: 304021 - DNA, 25 bp, Mus musculus
cacagttccttagtttgcatttagt

SEQ ID NO: 304022 - DNA, 25 bp, Mus musculus
cacagttcgccaccctattgggagc

SEQ ID NO: 304023 - DNA, 25 bp, Mus musculus
cacagttcgccagcctattgggagc

SEQ ID NO: 304024 - DNA, 25 bp, Mus musculus
cacagttctggaagctaggagtcct

SEQ ID NO: 304025 - DNA, 25 bp, Mus musculus
cacagttctggatgctaggagtcct

SEQ ID NO: 304026 - DNA, 25 bp, Mus musculus
cacagttctgggactccgagatttg

SEQ ID NO: 304027 - DNA, 25 bp, Mus musculus
cacagttctgggtctccgagatttg

SEQ ID NO: 304028 - DNA, 25 bp, Mus musculus
cacagttctgtgctatggactccaa

SEQ ID NO: 304029 - DNA, 25 bp, Mus musculus
cacagttctgtggtatggactccaa

SEQ ID NO: 304030 - DNA, 25 bp, Mus musculus
cacagttcttctatccatgattggg

SEQ ID NO: 304031 - DNA, 25 bp, Mus musculus
cacagttcttctttccatgattggg

SEQ ID NO: 304032 - DNA, 25 bp, Mus musculus
cacagttcttggaagggatccctga

SEQ ID NO: 304033 - DNA, 25 bp, Mus musculus
cacagttcttggtagggatccctga

SEQ ID NO: 304034 - DNA, 25 bp, Mus musculus
cacagttcttgtctaccgtaccaaa

SEQ ID NO: 304035 - DNA, 25 bp, Mus musculus
cacagttcttgtgtaccgtaccaaa

SEQ ID NO: 304036 - DNA, 25 bp, Mus musculus
cacagttgctcaatcttagtcacat

SEQ ID NO: 304037 - DNA, 25 bp, Mus musculus
cacagttgctcattcttagtcacat

SEQ ID NO: 304038 - DNA, 25 bp, Mus musculus
cacagttgggttcgcaacggctgct

SEQ ID NO: 304039 - DNA, 25 bp, Mus musculus
cacagttgggttggcaacggctgct

SEQ ID NO: 304040 - DNA, 25 bp, Mus musculus
cacagttgtcctatgtctcggttga

SEQ ID NO: 304041 - DNA, 25 bp, Mus musculus
cacagttgtcctttgtctcggttga

SEQ ID NO: 304042 - DNA, 25 bp, Mus musculus
cacagttgtgccatacagaaattgt

SEQ ID NO: 304043 - DNA, 25 bp, Mus musculus
cacagttgtgccttacagaaattgt

SEQ ID NO: 304044 - DNA, 25 bp, Mus musculus
cacagttgtgttacatggcatgaca

SEQ ID NO: 304045 - DNA, 25 bp, Mus musculus
cacagttgtgttcgcaggagtccct

SEQ ID NO: 304046 - DNA, 25 bp, Mus musculus
cacagttgtgttggcaggagtccct

SEQ ID NO: 304047 - DNA, 25 bp, Mus musculus
cacagttgtgtttcatggcatgaca

SEQ ID NO: 304048 - DNA, 25 bp, Mus musculus
cacagttgtttcctttcgatattta

SEQ ID NO: 304049 - DNA, 25 bp, Mus musculus
cacagttgtttcgtttcgatattta

SEQ ID NO: 304050 - DNA, 25 bp, Mus musculus
cacagtttaacaactgaggcaggag

SEQ ID NO: 304051 - DNA, 25 bp, Mus musculus
cacagtttaacatctgaggcaggag

SEQ ID NO: 304052 - DNA, 25 bp, Mus musculus
cacagtttaatgagttgctttccct

SEQ ID NO: 304053 - DNA, 25 bp, Mus musculus
cacagtttaatgtgttgctttccct

SEQ ID NO: 304054 - DNA, 25 bp, Mus musculus
cacagtttaattaccttcaacgtgt

SEQ ID NO: 304055 - DNA, 25 bp, Mus musculus
cacagtttaatttccttcaacgtgt

SEQ ID NO: 304056 - DNA, 25 bp, Mus musculus
cacagtttacaaatctggtgctaat

SEQ ID NO: 304057 - DNA, 25 bp, Mus musculus
cacagtttacaactttctctttgga

SEQ ID NO: 304058 - DNA, 25 bp, Mus musculus
cacagtttacaagtttctctttgga

SEQ ID NO: 304059 - DNA, 25 bp, Mus musculus
cacagtttacaattctggtgctaat

SEQ ID NO: 304060 - DNA, 25 bp, Mus musculus
cacagtttataaatgaacaggacat

SEQ ID NO: 304061 - DNA, 25 bp, Mus musculus
cacagtttataattgaacaggacat

SEQ ID NO: 304062 - DNA, 25 bp, Mus musculus
cacagtttatacatcttggtttagg

SEQ ID NO: 304063 - DNA, 25 bp, Mus musculus
cacagtttatacttcttggtttagg

SEQ ID NO: 304064 - DNA, 25 bp, Mus musculus
cacagtttattgcatgggcactggg

SEQ ID NO: 304065 - DNA, 25 bp, Mus musculus
cacagtttattggatgggcactggg

SEQ ID NO: 304066 - DNA, 25 bp, Mus musculus
cacagtttcagtcttaacttcggaa

SEQ ID NO: 304067 - DNA, 25 bp, Mus musculus
cacagtttcagtgttaacttcggaa

SEQ ID NO: 304068 - DNA, 25 bp, Mus musculus
cacagtttccctcatggtaattttt

SEQ ID NO: 304069 - DNA, 25 bp, Mus musculus
cacagtttccctgatggtaattttt

SEQ ID NO: 304070 - DNA, 25 bp, Mus musculus
cacagtttcgtcaagatcaaggtca

SEQ ID NO: 304071 - DNA, 25 bp, Mus musculus
cacagtttcgtctagatcaaggtca

SEQ ID NO: 304072 - DNA, 25 bp, Mus musculus
cacagtttctcacacctgggaagga

SEQ ID NO: 304073 - DNA, 25 bp, Mus musculus
cacagtttctcagacctgggaagga

SEQ ID NO: 304074 - DNA, 25 bp, Mus musculus
cacagtttctgtctttgacacccac

SEQ ID NO: 304075 - DNA, 25 bp, Mus musculus
cacagtttctgtgtttgacacccac

SEQ ID NO: 304076 - DNA, 25 bp, Mus musculus
cacagtttctttctctttaggttct

SEQ ID NO: 304077 - DNA, 25 bp, Mus musculus
cacagtttctttgtctttaggttct

SEQ ID NO: 304078 - DNA, 25 bp, Mus musculus
cacagtttgtgtctcgcgagtgcaa

SEQ ID NO: 304079 - DNA, 25 bp, Mus musculus
cacagtttgtgtgtcgcgagtgcaa

SEQ ID NO: 304080 - DNA, 25 bp, Mus musculus
cacagttttcatataactcttttca

SEQ ID NO: 304081 - DNA, 25 bp, Mus musculus
cacagttttcatttaactcttttca

SEQ ID NO: 304082 - DNA, 25 bp, Mus musculus
cacagttttccacgaaaaccatgaa

SEQ ID NO: 304083 - DNA, 25 bp, Mus musculus
cacagttttccaggaaaaccatgaa

SEQ ID NO: 304084 - DNA, 25 bp, Mus musculus
cacataaaaggtagatactgggact

SEQ ID NO: 304085 - DNA, 25 bp, Mus musculus
cacataaaaggttgatactgggact

SEQ ID NO: 304086 - DNA, 25 bp, Mus musculus
cacataaacacacatgggcatgctt

SEQ ID NO: 304087 - DNA, 25 bp, Mus musculus
cacataaacacagatgggcatgctt

SEQ ID NO: 304088 - DNA, 25 bp, Mus musculus
cacataaatccaactttccttcaag

SEQ ID NO: 304089 - DNA, 25 bp, Mus musculus
cacataaatccatctttccttcaag

SEQ ID NO: 304090 - DNA, 25 bp, Mus musculus
cacataaccagaccttcctttagaa

SEQ ID NO: 304091 - DNA, 25 bp, Mus musculus
cacataaccagagcttcctttagaa

SEQ ID NO: 304092 - DNA, 25 bp, Mus musculus
cacataactgctctagtacaggcta

SEQ ID NO: 304093 - DNA, 25 bp, Mus musculus
cacataactgctgtagtacaggcta

SEQ ID NO: 304094 - DNA, 25 bp, Mus musculus
cacataactgtcaccttaaccattg

SEQ ID NO: 304095 - DNA, 25 bp, Mus musculus
cacataactgtctccttaaccattg

SEQ ID NO: 304096 - DNA, 25 bp, Mus musculus
cacataaggatgctcacttgggttc

SEQ ID NO: 304097 - DNA, 25 bp, Mus musculus
cacataaggatggtcacttgggttc

SEQ ID NO: 304098 - DNA, 25 bp, Mus musculus
cacataatcccaatttcagctgatg

SEQ ID NO: 304099 - DNA, 25 bp, Mus musculus
cacataatcccattttcagctgatg

SEQ ID NO: 304100 - DNA, 25 bp, Mus musculus
cacataatctgcagttacgggtact

SEQ ID NO: 304101 - DNA, 25 bp, Mus musculus
cacataatctgctgttacgggtact

SEQ ID NO: 304102 - DNA, 25 bp, Mus musculus
cacatacacactaaccctattgtac

SEQ ID NO: 304103 - DNA, 25 bp, Mus musculus
cacatacacacttaccctattgtac

SEQ ID NO: 304104 - DNA, 25 bp, Mus musculus
cacatacacatacattctttctcac

SEQ ID NO: 304105 - DNA, 25 bp, Mus musculus
cacatacacatagattctttctcac

SEQ ID NO: 304106 - DNA, 25 bp, Mus musculus
cacatacacccgaggcagggagtgt

SEQ ID NO: 304107 - DNA, 25 bp, Mus musculus
cacatacacccgtggcagggagtgt

SEQ ID NO: 304108 - DNA, 25 bp, Mus musculus
cacatacagcttcccttaacagaat

SEQ ID NO: 304109 - DNA, 25 bp, Mus musculus
cacatacagcttgccttaacagaat

SEQ ID NO: 304110 - DNA, 25 bp, Mus musculus
cacatacatccccactacagagaaa

SEQ ID NO: 304111 - DNA, 25 bp, Mus musculus
cacatacatcccgactacagagaaa

SEQ ID NO: 304112 - DNA, 25 bp, Mus musculus
cacatacatgcgaatctacaagaag

SEQ ID NO: 304113 - DNA, 25 bp, Mus musculus
cacatacatgcgtatctacaagaag

SEQ ID NO: 304114 - DNA, 25 bp, Mus musculus
cacatacatgtcagttgcctataca

SEQ ID NO: 304115 - DNA, 25 bp, Mus musculus
cacatacatgtctgttgcctataca

SEQ ID NO: 304116 - DNA, 25 bp, Mus musculus
cacataccatagccttcccggattt

SEQ ID NO: 304117 - DNA, 25 bp, Mus musculus
cacataccataggcttcccggattt

SEQ ID NO: 304118 - DNA, 25 bp, Mus musculus
cacataccatgtctctattgattct

SEQ ID NO: 304119 - DNA, 25 bp, Mus musculus
cacataccatgtgtctattgattct

SEQ ID NO: 304120 - DNA, 25 bp, Mus musculus
cacatacccagtccatgcgactaat

SEQ ID NO: 304121 - DNA, 25 bp, Mus musculus
cacatacccagtgcatgcgactaat

SEQ ID NO: 304122 - DNA, 25 bp, Mus musculus
cacataccccagatctcctgaggtt

SEQ ID NO: 304123 - DNA, 25 bp, Mus musculus
cacataccccagttctcctgaggtt

SEQ ID NO: 304124 - DNA, 25 bp, Mus musculus
cacataccctgaaattcctcctggg

SEQ ID NO: 304125 - DNA, 25 bp, Mus musculus
cacataccctgatattcctcctggg

SEQ ID NO: 304126 - DNA, 25 bp, Mus musculus
cacatacctcatccggaaccgaatg

SEQ ID NO: 304127 - DNA, 25 bp, Mus musculus
cacatacctcatgcggaaccgaatg

SEQ ID NO: 304128 - DNA, 25 bp, Mus musculus
cacatacggtgcagttgcttttgaa

SEQ ID NO: 304129 - DNA, 25 bp, Mus musculus
cacatacggtgctgttgcttttgaa

SEQ ID NO: 304130 - DNA, 25 bp, Mus musculus
cacatacttctgaaataggacaata

SEQ ID NO: 304131 - DNA, 25 bp, Mus musculus
cacatacttctgtaataggacaata

SEQ ID NO: 304132 - DNA, 25 bp, Mus musculus
cacatagatctacacacacataaat

SEQ ID NO: 304133 - DNA, 25 bp, Mus musculus
cacatagatctagacacacataaat

SEQ ID NO: 304134 - DNA, 25 bp, Mus musculus
cacatagcaaagcttgtctgctgtt

SEQ ID NO: 304135 - DNA, 25 bp, Mus musculus
cacatagcaaaggttgtctgctgtt

SEQ ID NO: 304136 - DNA, 25 bp, Mus musculus
cacataggaggtcttggcttctgac

SEQ ID NO: 304137 - DNA, 25 bp, Mus musculus
cacataggaggtgttggcttctgac

SEQ ID NO: 304138 - DNA, 25 bp, Mus musculus
cacataggagttagtaactgctttt

SEQ ID NO: 304139 - DNA, 25 bp, Mus musculus
cacataggagtttgtaactgctttt

SEQ ID NO: 304140 - DNA, 25 bp, Mus musculus
cacataggtgaaatactgtatacat

SEQ ID NO: 304141 - DNA, 25 bp, Mus musculus
cacataggtgaattactgtatacat

SEQ ID NO: 304142 - DNA, 25 bp, Mus musculus
cacatagtactactgctgtctctaa

SEQ ID NO: 304143 - DNA, 25 bp, Mus musculus
cacatagtactagtgctgtctctaa

SEQ ID NO: 304144 - DNA, 25 bp, Mus musculus
cacatagtcaaacctggccttggat

SEQ ID NO: 304145 - DNA, 25 bp, Mus musculus
cacatagtcaaagctggccttggat

SEQ ID NO: 304146 - DNA, 25 bp, Mus musculus
cacatagtccttcgattctgtgcca

SEQ ID NO: 304147 - DNA, 25 bp, Mus musculus
cacatagtccttggattctgtgcca

SEQ ID NO: 304148 - DNA, 25 bp, Mus musculus
cacatagtgatgaccttcttctaaa

SEQ ID NO: 304149 - DNA, 25 bp, Mus musculus
cacatagtgatgcttgcctttaatc

SEQ ID NO: 304150 - DNA, 25 bp, Mus musculus
cacatagtgatggttgcctttaatc

SEQ ID NO: 304151 - DNA, 25 bp, Mus musculus
cacatagtgatgtccttcttctaaa

SEQ ID NO: 304152 - DNA, 25 bp, Mus musculus
cacatagttcctctttattacccac

SEQ ID NO: 304153 - DNA, 25 bp, Mus musculus
cacatagttcctgtttattacccac

SEQ ID NO: 304154 - DNA, 25 bp, Mus musculus
cacatagtttttctccttttagatt

SEQ ID NO: 304155 - DNA, 25 bp, Mus musculus
cacatagtttttgtccttttagatt

SEQ ID NO: 304156 - DNA, 25 bp, Mus musculus
cacatatactctcaagcgctgctta

SEQ ID NO: 304157 - DNA, 25 bp, Mus musculus
cacatatactctgaagcgctgctta

SEQ ID NO: 304158 - DNA, 25 bp, Mus musculus
cacatatatgcacaccaaacacatg

SEQ ID NO: 304159 - DNA, 25 bp, Mus musculus
cacatatatgcagaccaaacacatg

SEQ ID NO: 304160 - DNA, 25 bp, Mus musculus
cacatatcagggagcacatactaca

SEQ ID NO: 304161 - DNA, 25 bp, Mus musculus
cacatatcagggtgcacatactaca

SEQ ID NO: 304162 - DNA, 25 bp, Mus musculus
cacatatggtggaggacagagaaca

SEQ ID NO: 304163 - DNA, 25 bp, Mus musculus
cacatatggtggtggacagagaaca

SEQ ID NO: 304164 - DNA, 25 bp, Mus musculus
cacatatgttttctggctgacatta

SEQ ID NO: 304165 - DNA, 25 bp, Mus musculus
cacatatgttttgtggctgacatta

SEQ ID NO: 304166 - DNA, 25 bp, Mus musculus
cacatattacacatagggcctccat

SEQ ID NO: 304167 - DNA, 25 bp, Mus musculus
cacatattacacttagggcctccat

SEQ ID NO: 304168 - DNA, 25 bp, Mus musculus
cacatattcatcacttgccaaataa

SEQ ID NO: 304169 - DNA, 25 bp, Mus musculus
cacatattcatctcttgccaaataa

SEQ ID NO: 304170 - DNA, 25 bp, Mus musculus
cacatattcgtgcttgggttttctc

SEQ ID NO: 304171 - DNA, 25 bp, Mus musculus
cacatattcgtggttgggttttctc

SEQ ID NO: 304172 - DNA, 25 bp, Mus musculus
cacatatttatcaccctggatgctt

SEQ ID NO: 304173 - DNA, 25 bp, Mus musculus
cacatatttatctccctggatgctt

SEQ ID NO: 304174 - DNA, 25 bp, Mus musculus
cacatatttcttacggtcctaactt

SEQ ID NO: 304175 - DNA, 25 bp, Mus musculus
cacatatttctttcggtcctaactt

SEQ ID NO: 304176 - DNA, 25 bp, Mus musculus
cacatattttgaagactaaacgtgg

SEQ ID NO: 304177 - DNA, 25 bp, Mus musculus
cacatattttgatgactaaacgtgg

SEQ ID NO: 304178 - DNA, 25 bp, Mus musculus
cacatcaaggatcaccccgatggca

SEQ ID NO: 304179 - DNA, 25 bp, Mus musculus
cacatcaaggatgaccccgatggca

SEQ ID NO: 304180 - DNA, 25 bp, Mus musculus
cacatcaatccaacaccgtttataa

SEQ ID NO: 304181 - DNA, 25 bp, Mus musculus
cacatcaatccatcaccgtttataa

SEQ ID NO: 304182 - DNA, 25 bp, Mus musculus
cacatcacagatcgacctatggata

SEQ ID NO: 304183 - DNA, 25 bp, Mus musculus
cacatcacagatggacctatggata

SEQ ID NO: 304184 - DNA, 25 bp, Mus musculus
cacatcacagtgcaaatgcagcgga

SEQ ID NO: 304185 - DNA, 25 bp, Mus musculus
cacatcacagtggaaatgcagcgga

SEQ ID NO: 304186 - DNA, 25 bp, Mus musculus
cacatcaccatgatccttgttaaca

SEQ ID NO: 304187 - DNA, 25 bp, Mus musculus
cacatcaccatgttccttgttaaca

SEQ ID NO: 304188 - DNA, 25 bp, Mus musculus
cacatcaccgtacatgaattgtgtg

SEQ ID NO: 304189 - DNA, 25 bp, Mus musculus
cacatcaccgtagatgaattgtgtg

SEQ ID NO: 304190 - DNA, 25 bp, Mus musculus
cacatcagatgactgtcttgccatg

SEQ ID NO: 304191 - DNA, 25 bp, Mus musculus
cacatcagatgagtgtcttgccatg

SEQ ID NO: 304192 - DNA, 25 bp, Mus musculus
cacatcaggcccacgaggaggaaga

SEQ ID NO: 304193 - DNA, 25 bp, Mus musculus
cacatcaggccctcgaggaggaaga

SEQ ID NO: 304194 - DNA, 25 bp, Mus musculus
cacatcaggtgtattcagtgtgact

SEQ ID NO: 304195 - DNA, 25 bp, Mus musculus
cacatcaggtgttttcagtgtgact

SEQ ID NO: 304196 - DNA, 25 bp, Mus musculus
cacatcataggacacacaggccgat

SEQ ID NO: 304197 - DNA, 25 bp, Mus musculus
cacatcataggagacacaggccgat

SEQ ID NO: 304198 - DNA, 25 bp, Mus musculus
cacatcatctctctagctggctggg

SEQ ID NO: 304199 - DNA, 25 bp, Mus musculus
cacatcatctctgtagctggctggg

SEQ ID NO: 304200 - DNA, 25 bp, Mus musculus
cacatcattacccctttgtgtgtgg

SEQ ID NO: 304201 - DNA, 25 bp, Mus musculus
cacatcattaccgctttgtgtgtgg

SEQ ID NO: 304202 - DNA, 25 bp, Mus musculus
cacatcattctaaatttcgtattgc

SEQ ID NO: 304203 - DNA, 25 bp, Mus musculus
cacatcattctatatttcgtattgc

SEQ ID NO: 304204 - DNA, 25 bp, Mus musculus
cacatcattttaacctcaagctgca

SEQ ID NO: 304205 - DNA, 25 bp, Mus musculus
cacatcattttatcctcaagctgca

SEQ ID NO: 304206 - DNA, 25 bp, Mus musculus
cacatccacctgcatgtgcctgagg

SEQ ID NO: 304207 - DNA, 25 bp, Mus musculus
cacatccacctggatgtgcctgagg

SEQ ID NO: 304208 - DNA, 25 bp, Mus musculus
cacatccaccttcaaaactgcaggg

SEQ ID NO: 304209 - DNA, 25 bp, Mus musculus
cacatccaccttgaaaactgcaggg

SEQ ID NO: 304210 - DNA, 25 bp, Mus musculus
cacatccacggaccccaaaggtttg

SEQ ID NO: 304211 - DNA, 25 bp, Mus musculus
cacatccacggagcccaaaggtttg

SEQ ID NO: 304212 - DNA, 25 bp, Mus musculus
cacatccagaacaagaattgactcc

SEQ ID NO: 304213 - DNA, 25 bp, Mus musculus
cacatccagaactagaattgactcc

SEQ ID NO: 304214 - DNA, 25 bp, Mus musculus
cacatccagggaactcagaacaggg

SEQ ID NO: 304215 - DNA, 25 bp, Mus musculus
cacatccagggatctcagaacaggg

SEQ ID NO: 304216 - DNA, 25 bp, Mus musculus
cacatccattaaagagtttgacctc

SEQ ID NO: 304217 - DNA, 25 bp, Mus musculus
cacatccattaatgagtttgacctc

SEQ ID NO: 304218 - DNA, 25 bp, Mus musculus
cacatcccacaaagcttttctttat

SEQ ID NO: 304219 - DNA, 25 bp, Mus musculus
cacatcccacaatgcttttctttat

SEQ ID NO: 304220 - DNA, 25 bp, Mus musculus
cacatcccgtgtcccgatgaatggg

SEQ ID NO: 304221 - DNA, 25 bp, Mus musculus
cacatcccgtgtgccgatgaatggg

SEQ ID NO: 304222 - DNA, 25 bp, Mus musculus
cacatccctgttacttttaagggag

SEQ ID NO: 304223 - DNA, 25 bp, Mus musculus
cacatccctgtttcttttaagggag

SEQ ID NO: 304224 - DNA, 25 bp, Mus musculus
cacatcccttagactgtattctgag

SEQ ID NO: 304225 - DNA, 25 bp, Mus musculus
cacatcccttagtctgtattctgag

SEQ ID NO: 304226 - DNA, 25 bp, Mus musculus
cacatccgccttcacagaagagctg

SEQ ID NO: 304227 - DNA, 25 bp, Mus musculus
cacatccgccttgacagaagagctg

SEQ ID NO: 304228 - DNA, 25 bp, Mus musculus
cacatccggcttaagttgtttctat

SEQ ID NO: 304229 - DNA, 25 bp, Mus musculus
cacatccggctttagttgtttctat

SEQ ID NO: 304230 - DNA, 25 bp, Mus musculus
cacatcctatagcttcagtatccag

SEQ ID NO: 304231 - DNA, 25 bp, Mus musculus
cacatcctataggttcagtatccag

SEQ ID NO: 304232 - DNA, 25 bp, Mus musculus
cacatcctcagtagggcacactcat

SEQ ID NO: 304233 - DNA, 25 bp, Mus musculus
cacatcctcagttgggcacactcat

SEQ ID NO: 304234 - DNA, 25 bp, Mus musculus
cacatcctccttcctaacttatatg

SEQ ID NO: 304235 - DNA, 25 bp, Mus musculus
cacatcctccttgctaacttatatg

SEQ ID NO: 304236 - DNA, 25 bp, Mus musculus
cacatcctctagaatgtctgggcca

SEQ ID NO: 304237 - DNA, 25 bp, Mus musculus
cacatcctctagtatgtctgggcca

SEQ ID NO: 304238 - DNA, 25 bp, Mus musculus
cacatcctgtttaatctgtcagtgg

SEQ ID NO: 304239 - DNA, 25 bp, Mus musculus
cacatcctgttttatctgtcagtgg

SEQ ID NO: 304240 - DNA, 25 bp, Mus musculus
cacatccttcataacatcacacgtt

SEQ ID NO: 304241 - DNA, 25 bp, Mus musculus
cacatccttcattacatcacacgtt

SEQ ID NO: 304242 - DNA, 25 bp, Mus musculus
cacatccttggtcggcgggacgaac

SEQ ID NO: 304243 - DNA, 25 bp, Mus musculus
cacatccttggtgggcgggacgaac

SEQ ID NO: 304244 - DNA, 25 bp, Mus musculus
cacatcctttgcaagcacgtgtaca

SEQ ID NO: 304245 - DNA, 25 bp, Mus musculus
cacatcctttgctagcacgtgtaca

SEQ ID NO: 304246 - DNA, 25 bp, Mus musculus
cacatcgacttcactcacgctgtgt

SEQ ID NO: 304247 - DNA, 25 bp, Mus musculus
cacatcgacttctctcacgctgtgt

SEQ ID NO: 304248 - DNA, 25 bp, Mus musculus
cacatcgagtgcactaccatggcca

SEQ ID NO: 304249 - DNA, 25 bp, Mus musculus
cacatcgagtgctctaccatggcca

SEQ ID NO: 304250 - DNA, 25 bp, Mus musculus
cacatcggagctccgtgtgaaatgg

SEQ ID NO: 304251 - DNA, 25 bp, Mus musculus
cacatcggagctgcgtgtgaaatgg

SEQ ID NO: 304252 - DNA, 25 bp, Mus musculus
cacatcggtgatcccttcagcgaag

SEQ ID NO: 304253 - DNA, 25 bp, Mus musculus
cacatcggtgatgccttcagcgaag

SEQ ID NO: 304254 - DNA, 25 bp, Mus musculus
cacatcggtgttaggagaagtcaca

SEQ ID NO: 304255 - DNA, 25 bp, Mus musculus
cacatcggtgtttggagaagtcaca

SEQ ID NO: 304256 - DNA, 25 bp, Mus musculus
cacatcgtcatgaagtccaaagtta

SEQ ID NO: 304257 - DNA, 25 bp, Mus musculus
cacatcgtcatgcagaagcaacaat

SEQ ID NO: 304258 - DNA, 25 bp, Mus musculus
cacatcgtcatggagaagcaacaat

SEQ ID NO: 304259 - DNA, 25 bp, Mus musculus
cacatcgtcatgtagtccaaagtta

SEQ ID NO: 304260 - DNA, 25 bp, Mus musculus
cacatcgtgctcatcgactttgggc

SEQ ID NO: 304261 - DNA, 25 bp, Mus musculus
cacatcgtgctcttcgactttgggc

SEQ ID NO: 304262 - DNA, 25 bp, Mus musculus
cacatcgttgggatgatcgtgttca

SEQ ID NO: 304263 - DNA, 25 bp, Mus musculus
cacatcgttgggttgatcgtgttca

SEQ ID NO: 304264 - DNA, 25 bp, Mus musculus
cacatctaccacatgagacagccat

SEQ ID NO: 304265 - DNA, 25 bp, Mus musculus
cacatctaccacttgagacagccat

SEQ ID NO: 304266 - DNA, 25 bp, Mus musculus
cacatctaccccattctgaatactg

SEQ ID NO: 304267 - DNA, 25 bp, Mus musculus
cacatctacccctttctgaatactg

SEQ ID NO: 304268 - DNA, 25 bp, Mus musculus
cacatctagactccttgtgctgtca

SEQ ID NO: 304269 - DNA, 25 bp, Mus musculus
cacatctagactgcttgtgctgtca

SEQ ID NO: 304270 - DNA, 25 bp, Mus musculus
cacatctatggtcccgctgttgttg

SEQ ID NO: 304271 - DNA, 25 bp, Mus musculus
cacatctatggtgccgctgttgttg

SEQ ID NO: 304272 - DNA, 25 bp, Mus musculus
cacatctcatttcgttctcgggtac

SEQ ID NO: 304273 - DNA, 25 bp, Mus musculus
cacatctcatttggttctcgggtac

SEQ ID NO: 304274 - DNA, 25 bp, Mus musculus
cacatctcctgactgcgaacatggg

SEQ ID NO: 304275 - DNA, 25 bp, Mus musculus
cacatctcctgagtgcgaacatggg

SEQ ID NO: 304276 - DNA, 25 bp, Mus musculus
cacatctcggagaaggtgtcccctt

SEQ ID NO: 304277 - DNA, 25 bp, Mus musculus
cacatctcggagtaggtgtcccctt

SEQ ID NO: 304278 - DNA, 25 bp, Mus musculus
cacatctctgtaacttgctggaaag

SEQ ID NO: 304279 - DNA, 25 bp, Mus musculus
cacatctctgtatcttgctggaaag

SEQ ID NO: 304280 - DNA, 25 bp, Mus musculus
cacatctgactgaggatgccctgtg

SEQ ID NO: 304281 - DNA, 25 bp, Mus musculus
cacatctgactgtggatgccctgtg

SEQ ID NO: 304282 - DNA, 25 bp, Mus musculus
cacatctgagacaattcagtacagg

SEQ ID NO: 304283 - DNA, 25 bp, Mus musculus
cacatctgagactattcagtacagg

SEQ ID NO: 304284 - DNA, 25 bp, Mus musculus
cacatctgatgaacagaaccacctg

SEQ ID NO: 304285 - DNA, 25 bp, Mus musculus
cacatctgatgatcagaaccacctg

SEQ ID NO: 304286 - DNA, 25 bp, Mus musculus
cacatctgcattcaacacatctgca

SEQ ID NO: 304287 - DNA, 25 bp, Mus musculus
cacatctgcattgaacacatctgca

SEQ ID NO: 304288 - DNA, 25 bp, Mus musculus
cacatctgcttcatgttgcctataa

SEQ ID NO: 304289 - DNA, 25 bp, Mus musculus
cacatctgcttcttgttgcctataa

SEQ ID NO: 304290 - DNA, 25 bp, Mus musculus
cacatctggccacttcagaaggatt

SEQ ID NO: 304291 - DNA, 25 bp, Mus musculus
cacatctggccagttcagaaggatt

SEQ ID NO: 304292 - DNA, 25 bp, Mus musculus
cacatctggcggactggaagaacca

SEQ ID NO: 304293 - DNA, 25 bp, Mus musculus
cacatctggcggtctggaagaacca

SEQ ID NO: 304294 - DNA, 25 bp, Mus musculus
cacatctggtgtctttcctagaaaa

SEQ ID NO: 304295 - DNA, 25 bp, Mus musculus
cacatctggtgtgtttcctagaaaa

SEQ ID NO: 304296 - DNA, 25 bp, Mus musculus
cacatctgtacaaagggcgttccca

SEQ ID NO: 304297 - DNA, 25 bp, Mus musculus
cacatctgtacatagggcgttccca

SEQ ID NO: 304298 - DNA, 25 bp, Mus musculus
cacatctgtcaaaactacatttatg

SEQ ID NO: 304299 - DNA, 25 bp, Mus musculus
cacatctgtcaatactacatttatg

SEQ ID NO: 304300 - DNA, 25 bp, Mus musculus
cacatctgtctgaaccactctaaaa

SEQ ID NO: 304301 - DNA, 25 bp, Mus musculus
cacatctgtctgtaccactctaaaa

SEQ ID NO: 304302 - DNA, 25 bp, Mus musculus
cacatctgtggcatttgggtataaa

SEQ ID NO: 304303 - DNA, 25 bp, Mus musculus
cacatctgtggcttttgggtataaa

SEQ ID NO: 304304 - DNA, 25 bp, Mus musculus
cacatctgttgcagccgcttacaag

SEQ ID NO: 304305 - DNA, 25 bp, Mus musculus
cacatctgttgctgccgcttacaag

SEQ ID NO: 304306 - DNA, 25 bp, Mus musculus
cacatcttacccatctcagtgtatg

SEQ ID NO: 304307 - DNA, 25 bp, Mus musculus
cacatcttacccttctcagtgtatg

SEQ ID NO: 304308 - DNA, 25 bp, Mus musculus
cacatcttactcctggatctttcta

SEQ ID NO: 304309 - DNA, 25 bp, Mus musculus
cacatcttactcgtggatctttcta

SEQ ID NO: 304310 - DNA, 25 bp, Mus musculus
cacatcttccgaatctaccgggaat

SEQ ID NO: 304311 - DNA, 25 bp, Mus musculus
cacatcttccgattctaccgggaat

SEQ ID NO: 304312 - DNA, 25 bp, Mus musculus
cacatcttccttatgctgctagaga

SEQ ID NO: 304313 - DNA, 25 bp, Mus musculus
cacatcttccttttgctgctagaga

SEQ ID NO: 304314 - DNA, 25 bp, Mus musculus
cacatcttgaagattgagctgggca

SEQ ID NO: 304315 - DNA, 25 bp, Mus musculus
cacatcttgaagtttgagctgggca

SEQ ID NO: 304316 - DNA, 25 bp, Mus musculus
cacatctttcttcccagtactcaag

SEQ ID NO: 304317 - DNA, 25 bp, Mus musculus
cacatctttcttgccagtactcaag

SEQ ID NO: 304318 - DNA, 25 bp, Mus musculus
cacatcttttcaataatagtactaa

SEQ ID NO: 304319 - DNA, 25 bp, Mus musculus
cacatcttttcattaatagtactaa

SEQ ID NO: 304320 - DNA, 25 bp, Mus musculus
cacatcttttcgatgctgtttcata

SEQ ID NO: 304321 - DNA, 25 bp, Mus musculus
cacatcttttcgttgctgtttcata

SEQ ID NO: 304322 - DNA, 25 bp, Mus musculus
cacatgaacccgattacctcagtaa

SEQ ID NO: 304323 - DNA, 25 bp, Mus musculus
cacatgaacccgtttacctcagtaa

SEQ ID NO: 304324 - DNA, 25 bp, Mus musculus
cacatgaaggagagtttccttaaag

SEQ ID NO: 304325 - DNA, 25 bp, Mus musculus
cacatgaaggagtgtttccttaaag

SEQ ID NO: 304326 - DNA, 25 bp, Mus musculus
cacatgaaggttcccaaccatctat

SEQ ID NO: 304327 - DNA, 25 bp, Mus musculus
cacatgaaggttgccaaccatctat

SEQ ID NO: 304328 - DNA, 25 bp, Mus musculus
cacatgaatactcgactgttccttg

SEQ ID NO: 304329 - DNA, 25 bp, Mus musculus
cacatgaatactggactgttccttg

SEQ ID NO: 304330 - DNA, 25 bp, Mus musculus
cacatgacagtcaccacgaggagag

SEQ ID NO: 304331 - DNA, 25 bp, Mus musculus
cacatgacagtctccacgaggagag

SEQ ID NO: 304332 - DNA, 25 bp, Mus musculus
cacatgaccacaccattgcagtatt

SEQ ID NO: 304333 - DNA, 25 bp, Mus musculus
cacatgaccacagcattgcagtatt

SEQ ID NO: 304334 - DNA, 25 bp, Mus musculus
cacatgaccgtgaaagaagaaccaa

SEQ ID NO: 304335 - DNA, 25 bp, Mus musculus
cacatgaccgtgtaagaagaaccaa

SEQ ID NO: 304336 - DNA, 25 bp, Mus musculus
cacatgacctgaattagaagacaat

SEQ ID NO: 304337 - DNA, 25 bp, Mus musculus
cacatgacctgatttagaagacaat

SEQ ID NO: 304338 - DNA, 25 bp, Mus musculus
cacatgactgctattcctccttgga

SEQ ID NO: 304339 - DNA, 25 bp, Mus musculus
cacatgactgcttttcctccttgga

SEQ ID NO: 304340 - DNA, 25 bp, Mus musculus
cacatgacttacagattttctccct

SEQ ID NO: 304341 - DNA, 25 bp, Mus musculus
cacatgacttactgattttctccct

SEQ ID NO: 304342 - DNA, 25 bp, Mus musculus
cacatgagcttgcagcattggttct

SEQ ID NO: 304343 - DNA, 25 bp, Mus musculus
cacatgagcttggagcattggttct

SEQ ID NO: 304344 - DNA, 25 bp, Mus musculus
cacatgatgctacttggccctggta

SEQ ID NO: 304345 - DNA, 25 bp, Mus musculus
cacatgatgctagttggccctggta

SEQ ID NO: 304346 - DNA, 25 bp, Mus musculus
cacatgatgttgctgatgcgctgct

SEQ ID NO: 304347 - DNA, 25 bp, Mus musculus
cacatgatgttggtgatgcgctgct

SEQ ID NO: 304348 - DNA, 25 bp, Mus musculus
cacatgattaggcaaaaaatagact

SEQ ID NO: 304349 - DNA, 25 bp, Mus musculus
cacatgattagggaaaaaatagact

SEQ ID NO: 304350 - DNA, 25 bp, Mus musculus
cacatgattccaacagacccttaga

SEQ ID NO: 304351 - DNA, 25 bp, Mus musculus
cacatgattccatcagacccttaga

SEQ ID NO: 304352 - DNA, 25 bp, Mus musculus
cacatgatttggcaaacagcagttg

SEQ ID NO: 304353 - DNA, 25 bp, Mus musculus
cacatgatttgggaaacagcagttg

SEQ ID NO: 304354 - DNA, 25 bp, Mus musculus
cacatgcaacacaggctgtccagac

SEQ ID NO: 304355 - DNA, 25 bp, Mus musculus
cacatgcaacactggctgtccagac

SEQ ID NO: 304356 - DNA, 25 bp, Mus musculus
cacatgcacacaattactggcttaa

SEQ ID NO: 304357 - DNA, 25 bp, Mus musculus
cacatgcacacatttactggcttaa

SEQ ID NO: 304358 - DNA, 25 bp, Mus musculus
cacatgcatgacatctccaaacaat

SEQ ID NO: 304359 - DNA, 25 bp, Mus musculus
cacatgcatgacttctccaaacaat

SEQ ID NO: 304360 - DNA, 25 bp, Mus musculus
cacatgcatgcactcacaggtatat

SEQ ID NO: 304361 - DNA, 25 bp, Mus musculus
cacatgcatgcagtcacaggtatat

SEQ ID NO: 304362 - DNA, 25 bp, Mus musculus
cacatgccaagtatcaggaggattg

SEQ ID NO: 304363 - DNA, 25 bp, Mus musculus
cacatgccaagtttcaggaggattg

SEQ ID NO: 304364 - DNA, 25 bp, Mus musculus
cacatgccagccattaattcagtta

SEQ ID NO: 304365 - DNA, 25 bp, Mus musculus
cacatgccagcctttaattcagtta

SEQ ID NO: 304366 - DNA, 25 bp, Mus musculus
cacatgccagctagccagcatctaa

SEQ ID NO: 304367 - DNA, 25 bp, Mus musculus
cacatgccagcttgccagcatctaa

SEQ ID NO: 304368 - DNA, 25 bp, Mus musculus
cacatgcccaatcgcccaataaagg

SEQ ID NO: 304369 - DNA, 25 bp, Mus musculus
cacatgcccaatggcccaataaagg

SEQ ID NO: 304370 - DNA, 25 bp, Mus musculus
cacatgcccatgatcttaaacatga

SEQ ID NO: 304371 - DNA, 25 bp, Mus musculus
cacatgcccatgttcttaaacatga

SEQ ID NO: 304372 - DNA, 25 bp, Mus musculus
cacatgcctcatatagactatctcc

SEQ ID NO: 304373 - DNA, 25 bp, Mus musculus
cacatgcctcatttagactatctcc

SEQ ID NO: 304374 - DNA, 25 bp, Mus musculus
cacatgcctcttctggctgattagg

SEQ ID NO: 304375 - DNA, 25 bp, Mus musculus
cacatgcctcttgtggctgattagg

SEQ ID NO: 304376 - DNA, 25 bp, Mus musculus
cacatgcgtgccagaggcctaagga

SEQ ID NO: 304377 - DNA, 25 bp, Mus musculus
cacatgcgtgcctgaggcctaagga

SEQ ID NO: 304378 - DNA, 25 bp, Mus musculus
cacatgctacctctttttctgatat

SEQ ID NO: 304379 - DNA, 25 bp, Mus musculus
cacatgctacctgtttttctgatat

SEQ ID NO: 304380 - DNA, 25 bp, Mus musculus
cacatgctcgatcgcaggttcattt

SEQ ID NO: 304381 - DNA, 25 bp, Mus musculus
cacatgctcgatggcaggttcattt

SEQ ID NO: 304382 - DNA, 25 bp, Mus musculus
cacatgctgcttagtgctgtacagt

SEQ ID NO: 304383 - DNA, 25 bp, Mus musculus
cacatgctgctttgtgctgtacagt

SEQ ID NO: 304384 - DNA, 25 bp, Mus musculus
cacatgctgtgtagtctggagtata

SEQ ID NO: 304385 - DNA, 25 bp, Mus musculus
cacatgctgtgttgtctggagtata

SEQ ID NO: 304386 - DNA, 25 bp, Mus musculus
cacatgctttctaacacgactgaga

SEQ ID NO: 304387 - DNA, 25 bp, Mus musculus
cacatgctttcttacacgactgaga

SEQ ID NO: 304388 - DNA, 25 bp, Mus musculus
cacatggaaatgctgcccaatcttc

SEQ ID NO: 304389 - DNA, 25 bp, Mus musculus
cacatggaaatggtgcccaatcttc

SEQ ID NO: 304390 - DNA, 25 bp, Mus musculus
cacatggacaaaacagtatcacctg

SEQ ID NO: 304391 - DNA, 25 bp, Mus musculus
cacatggacaaatcagtatcacctg

SEQ ID NO: 304392 - DNA, 25 bp, Mus musculus
cacatggacagtatgctgcttgcag

SEQ ID NO: 304393 - DNA, 25 bp, Mus musculus
cacatggacagtttgctgcttgcag

SEQ ID NO: 304394 - DNA, 25 bp, Mus musculus
cacatggactgccaggtaacctttt

SEQ ID NO: 304395 - DNA, 25 bp, Mus musculus
cacatggactgcgaggtaacctttt

SEQ ID NO: 304396 - DNA, 25 bp, Mus musculus
cacatggagccactttcttcacttg

SEQ ID NO: 304397 - DNA, 25 bp, Mus musculus
cacatggagccagtttcttcacttg

SEQ ID NO: 304398 - DNA, 25 bp, Mus musculus
cacatggcagttcggctcagcaatt

SEQ ID NO: 304399 - DNA, 25 bp, Mus musculus
cacatggcagttgggctcagcaatt

SEQ ID NO: 304400 - DNA, 25 bp, Mus musculus
cacatggcatagacctgaggctcag

SEQ ID NO: 304401 - DNA, 25 bp, Mus musculus
cacatggcatagtcctgaggctcag

SEQ ID NO: 304402 - DNA, 25 bp, Mus musculus
cacatggccattattgacttcttca

SEQ ID NO: 304403 - DNA, 25 bp, Mus musculus
cacatggccatttttgacttcttca

SEQ ID NO: 304404 - DNA, 25 bp, Mus musculus
cacatggccttgcagtcagagaagt

SEQ ID NO: 304405 - DNA, 25 bp, Mus musculus
cacatggccttggagtcagagaagt

SEQ ID NO: 304406 - DNA, 25 bp, Mus musculus
cacatggctgttaactcttagtcaa

SEQ ID NO: 304407 - DNA, 25 bp, Mus musculus
cacatggctgtttactcttagtcaa

SEQ ID NO: 304408 - DNA, 25 bp, Mus musculus
cacatgggtaggatcacatctgcct

SEQ ID NO: 304409 - DNA, 25 bp, Mus musculus
cacatgggtaggttcacatctgcct

SEQ ID NO: 304410 - DNA, 25 bp, Mus musculus
cacatgggtataaagattcgggcgg

SEQ ID NO: 304411 - DNA, 25 bp, Mus musculus
cacatgggtatatagattcgggcgg

SEQ ID NO: 304412 - DNA, 25 bp, Mus musculus
cacatgggtcatctgcattcaaaga

SEQ ID NO: 304413 - DNA, 25 bp, Mus musculus
cacatgggtcatgtgcattcaaaga

SEQ ID NO: 304414 - DNA, 25 bp, Mus musculus
cacatgggtgtgatttgatttaaga

SEQ ID NO: 304415 - DNA, 25 bp, Mus musculus
cacatgggtgtgttttgatttaaga

SEQ ID NO: 304416 - DNA, 25 bp, Mus musculus
cacatggtaatgattttaggtgtca

SEQ ID NO: 304417 - DNA, 25 bp, Mus musculus
cacatggtaatgtttttaggtgtca

SEQ ID NO: 304418 - DNA, 25 bp, Mus musculus
cacatggtacaacctcatgctgtca

SEQ ID NO: 304419 - DNA, 25 bp, Mus musculus
cacatggtacaagctcatgctgtca

SEQ ID NO: 304420 - DNA, 25 bp, Mus musculus
cacatggtagctaacccttttgggt

SEQ ID NO: 304421 - DNA, 25 bp, Mus musculus
cacatggtagctcaccagtatttat

SEQ ID NO: 304422 - DNA, 25 bp, Mus musculus
cacatggtagctgaccagtatttat

SEQ ID NO: 304423 - DNA, 25 bp, Mus musculus
cacatggtagcttacccttttgggt

SEQ ID NO: 304424 - DNA, 25 bp, Mus musculus
cacatggtagttcctttcttggagg

SEQ ID NO: 304425 - DNA, 25 bp, Mus musculus
cacatggtagttgctttcttggagg

SEQ ID NO: 304426 - DNA, 25 bp, Mus musculus
cacatggtcagaacaccttgcgtgt

SEQ ID NO: 304427 - DNA, 25 bp, Mus musculus
cacatggtcagatcaccttgcgtgt

SEQ ID NO: 304428 - DNA, 25 bp, Mus musculus
cacatggtcagtcccatgggcctgg

SEQ ID NO: 304429 - DNA, 25 bp, Mus musculus
cacatggtcagtgccatgggcctgg

SEQ ID NO: 304430 - DNA, 25 bp, Mus musculus
cacatggtctccattgtctacaaaa

SEQ ID NO: 304431 - DNA, 25 bp, Mus musculus
cacatggtctcctttgtctacaaaa

SEQ ID NO: 304432 - DNA, 25 bp, Mus musculus
cacatgtaaaccatcaatttgctat

SEQ ID NO: 304433 - DNA, 25 bp, Mus musculus
cacatgtaaaccttcaatttgctat

SEQ ID NO: 304434 - DNA, 25 bp, Mus musculus
cacatgtaagttaagggctgggatc

SEQ ID NO: 304435 - DNA, 25 bp, Mus musculus
cacatgtaagtttagggctgggatc

SEQ ID NO: 304436 - DNA, 25 bp, Mus musculus
cacatgtacgcaccccttggttgtt

SEQ ID NO: 304437 - DNA, 25 bp, Mus musculus
cacatgtacgcagcccttggttgtt

SEQ ID NO: 304438 - DNA, 25 bp, Mus musculus
cacatgtagcagataaggagctgta

SEQ ID NO: 304439 - DNA, 25 bp, Mus musculus
cacatgtagcagttaaggagctgta

SEQ ID NO: 304440 - DNA, 25 bp, Mus musculus
cacatgtatagaccgcttttccacc

SEQ ID NO: 304441 - DNA, 25 bp, Mus musculus
cacatgtatagagcgcttttccacc

SEQ ID NO: 304442 - DNA, 25 bp, Mus musculus
cacatgtattttcagcttgctattt

SEQ ID NO: 304443 - DNA, 25 bp, Mus musculus
cacatgtattttgagcttgctattt

SEQ ID NO: 304444 - DNA, 25 bp, Mus musculus
cacatgtcataaatacttctgagat

SEQ ID NO: 304445 - DNA, 25 bp, Mus musculus
cacatgtcataattacttctgagat

SEQ ID NO: 304446 - DNA, 25 bp, Mus musculus
cacatgtctctcacgctatgaggat

SEQ ID NO: 304447 - DNA, 25 bp, Mus musculus
cacatgtctctctcgctatgaggat

SEQ ID NO: 304448 - DNA, 25 bp, Mus musculus
cacatgtgagtactgcggcaaggtc

SEQ ID NO: 304449 - DNA, 25 bp, Mus musculus
cacatgtgagtagtgcggcaaggtc

SEQ ID NO: 304450 - DNA, 25 bp, Mus musculus
cacatgtgcatcaccacttatacac

SEQ ID NO: 304451 - DNA, 25 bp, Mus musculus
cacatgtgcatctccacttatacac

SEQ ID NO: 304452 - DNA, 25 bp, Mus musculus
cacatgtgcattacagtgacgccat

SEQ ID NO: 304453 - DNA, 25 bp, Mus musculus
cacatgtgcatttcagtgacgccat

SEQ ID NO: 304454 - DNA, 25 bp, Mus musculus
cacatgtggacactttcagggtggt

SEQ ID NO: 304455 - DNA, 25 bp, Mus musculus
cacatgtggacagtttcagggtggt

SEQ ID NO: 304456 - DNA, 25 bp, Mus musculus
cacatgtggttcattttgggcagtt

SEQ ID NO: 304457 - DNA, 25 bp, Mus musculus
cacatgtggttctttttgggcagtt

SEQ ID NO: 304458 - DNA, 25 bp, Mus musculus
cacatgtgtatgcaggctgatggac

SEQ ID NO: 304459 - DNA, 25 bp, Mus musculus
cacatgtgtatggaggctgatggac

SEQ ID NO: 304460 - DNA, 25 bp, Mus musculus
cacatgtgtgcgaagtgcctatgaa

SEQ ID NO: 304461 - DNA, 25 bp, Mus musculus
cacatgtgtgcgtagtgcctatgaa

SEQ ID NO: 304462 - DNA, 25 bp, Mus musculus
cacatgttcaggatggtgacatcca

SEQ ID NO: 304463 - DNA, 25 bp, Mus musculus
cacatgttcaggttggtgacatcca

SEQ ID NO: 304464 - DNA, 25 bp, Mus musculus
cacatgttccccaagatgctgatga

SEQ ID NO: 304465 - DNA, 25 bp, Mus musculus
cacatgttcccctagatgctgatga

SEQ ID NO: 304466 - DNA, 25 bp, Mus musculus
cacatgttccttaatgctgacttta

SEQ ID NO: 304467 - DNA, 25 bp, Mus musculus
cacatgttcctttatgctgacttta

SEQ ID NO: 304468 - DNA, 25 bp, Mus musculus
cacatgttctgtcgcacgtgaaaac

SEQ ID NO: 304469 - DNA, 25 bp, Mus musculus
cacatgttctgtggcacgtgaaaac

SEQ ID NO: 304470 - DNA, 25 bp, Mus musculus
cacatgttttatcgaattgttcaca

SEQ ID NO: 304471 - DNA, 25 bp, Mus musculus
cacatgttttatggaattgttcaca

SEQ ID NO: 304472 - DNA, 25 bp, Mus musculus
cacattaagaccaatgagattctgt

SEQ ID NO: 304473 - DNA, 25 bp, Mus musculus
cacattaagacctatgagattctgt

SEQ ID NO: 304474 - DNA, 25 bp, Mus musculus
cacattacgttgcactcttttcccg

SEQ ID NO: 304475 - DNA, 25 bp, Mus musculus
cacattacgttggactcttttcccg

SEQ ID NO: 304476 - DNA, 25 bp, Mus musculus
cacattagttttagtgttcacttat

SEQ ID NO: 304477 - DNA, 25 bp, Mus musculus
cacattagtttttgtgttcacttat

SEQ ID NO: 304478 - DNA, 25 bp, Mus musculus
cacattatacatatttccccagcac

SEQ ID NO: 304479 - DNA, 25 bp, Mus musculus
cacattatacatttttccccagcac

SEQ ID NO: 304480 - DNA, 25 bp, Mus musculus
cacattatagtcaggcagggcccgt

SEQ ID NO: 304481 - DNA, 25 bp, Mus musculus
cacattatagtctggcagggcccgt

SEQ ID NO: 304482 - DNA, 25 bp, Mus musculus
cacattatatttcgtctggaagcta

SEQ ID NO: 304483 - DNA, 25 bp, Mus musculus
cacattatatttggtctggaagcta

SEQ ID NO: 304484 - DNA, 25 bp, Mus musculus
cacattattgctatgaattgatgag

SEQ ID NO: 304485 - DNA, 25 bp, Mus musculus
cacattattgctttgaattgatgag

SEQ ID NO: 304486 - DNA, 25 bp, Mus musculus
cacattcaagaaccccggcatggag

SEQ ID NO: 304487 - DNA, 25 bp, Mus musculus
cacattcaagaagcccggcatggag

SEQ ID NO: 304488 - DNA, 25 bp, Mus musculus
cacattcacaatcgaagggcccttg

SEQ ID NO: 304489 - DNA, 25 bp, Mus musculus
cacattcacaatggaagggcccttg

SEQ ID NO: 304490 - DNA, 25 bp, Mus musculus
cacattcacacgcacgttaataagt

SEQ ID NO: 304491 - DNA, 25 bp, Mus musculus
cacattcacacggacgttaataagt

SEQ ID NO: 304492 - DNA, 25 bp, Mus musculus
cacattcacatgagccaggcgttag

SEQ ID NO: 304493 - DNA, 25 bp, Mus musculus
cacattcacatgtgccaggcgttag

SEQ ID NO: 304494 - DNA, 25 bp, Mus musculus
cacattcactacatttcctcgcatc

SEQ ID NO: 304495 - DNA, 25 bp, Mus musculus
cacattcactacttttcctcgcatc

SEQ ID NO: 304496 - DNA, 25 bp, Mus musculus
cacattccacgcagctaagtgcagg

SEQ ID NO: 304497 - DNA, 25 bp, Mus musculus
cacattccacgctgctaagtgcagg

SEQ ID NO: 304498 - DNA, 25 bp, Mus musculus
cacattccaggacaggcaccatact

SEQ ID NO: 304499 - DNA, 25 bp, Mus musculus
cacattccaggagaggcaccatact

SEQ ID NO: 304500 - DNA, 25 bp, Mus musculus
cacattccatctcttgtcacagggt

SEQ ID NO: 304501 - DNA, 25 bp, Mus musculus
cacattccatctgttgtcacagggt

SEQ ID NO: 304502 - DNA, 25 bp, Mus musculus
cacattccctctactcaggaaacaa

SEQ ID NO: 304503 - DNA, 25 bp, Mus musculus
cacattccctcttctcaggaaacaa

SEQ ID NO: 304504 - DNA, 25 bp, Mus musculus
cacattcctatgcaaaacgatttta

SEQ ID NO: 304505 - DNA, 25 bp, Mus musculus
cacattcctatggaaaacgatttta

SEQ ID NO: 304506 - DNA, 25 bp, Mus musculus
cacattcctgggaatctgaggtagc

SEQ ID NO: 304507 - DNA, 25 bp, Mus musculus
cacattcctgggagtggttttattt

SEQ ID NO: 304508 - DNA, 25 bp, Mus musculus
cacattcctgggtatctgaggtagc

SEQ ID NO: 304509 - DNA, 25 bp, Mus musculus
cacattcctgggtgtggttttattt

SEQ ID NO: 304510 - DNA, 25 bp, Mus musculus
cacattcgttctcaagatccacagt

SEQ ID NO: 304511 - DNA, 25 bp, Mus musculus
cacattcgttctgaagatccacagt

SEQ ID NO: 304512 - DNA, 25 bp, Mus musculus
cacattctaataccattgccgcata

SEQ ID NO: 304513 - DNA, 25 bp, Mus musculus
cacattctaatagcattgccgcata

SEQ ID NO: 304514 - DNA, 25 bp, Mus musculus
cacattctcaggctgtatttgctaa

SEQ ID NO: 304515 - DNA, 25 bp, Mus musculus
cacattctcagggtgtatttgctaa

SEQ ID NO: 304516 - DNA, 25 bp, Mus musculus
cacattctgacgagcagaatattat

SEQ ID NO: 304517 - DNA, 25 bp, Mus musculus
cacattctgacgcgggctagcctga

SEQ ID NO: 304518 - DNA, 25 bp, Mus musculus
cacattctgacgggggctagcctga

SEQ ID NO: 304519 - DNA, 25 bp, Mus musculus
cacattctgacgtgcagaatattat

SEQ ID NO: 304520 - DNA, 25 bp, Mus musculus
cacattctgatgagtggactgcaca

SEQ ID NO: 304521 - DNA, 25 bp, Mus musculus
cacattctgatgtgtggactgcaca

SEQ ID NO: 304522 - DNA, 25 bp, Mus musculus
cacattctgcctactgagaggaaag

SEQ ID NO: 304523 - DNA, 25 bp, Mus musculus
cacattctgccttctgagaggaaag

SEQ ID NO: 304524 - DNA, 25 bp, Mus musculus
cacattctggtgctgagcgagctga

SEQ ID NO: 304525 - DNA, 25 bp, Mus musculus
cacattctggtggtgagcgagctga

SEQ ID NO: 304526 - DNA, 25 bp, Mus musculus
cacattcttgtcattttcgttgtaa

SEQ ID NO: 304527 - DNA, 25 bp, Mus musculus
cacattcttgtctttttcgttgtaa

SEQ ID NO: 304528 - DNA, 25 bp, Mus musculus
cacattctttgtccctatcatcttt

SEQ ID NO: 304529 - DNA, 25 bp, Mus musculus
cacattctttgtgcctatcatcttt

SEQ ID NO: 304530 - DNA, 25 bp, Mus musculus
cacattcttttacacacactcatac

SEQ ID NO: 304531 - DNA, 25 bp, Mus musculus
cacattcttttagacacactcatac

SEQ ID NO: 304532 - DNA, 25 bp, Mus musculus
cacattgaaacccactgctctaaag

SEQ ID NO: 304533 - DNA, 25 bp, Mus musculus
cacattgaaaccgactgctctaaag

SEQ ID NO: 304534 - DNA, 25 bp, Mus musculus
cacattgaacgcctgaagaataaaa

SEQ ID NO: 304535 - DNA, 25 bp, Mus musculus
cacattgaacgcgtgaagaataaaa

SEQ ID NO: 304536 - DNA, 25 bp, Mus musculus
cacattgaacttccaggccagacct

SEQ ID NO: 304537 - DNA, 25 bp, Mus musculus
cacattgaacttgcaggccagacct

SEQ ID NO: 304538 - DNA, 25 bp, Mus musculus
cacattgaatttactacctgttcgt

SEQ ID NO: 304539 - DNA, 25 bp, Mus musculus
cacattgaattttctacctgttcgt

SEQ ID NO: 304540 - DNA, 25 bp, Mus musculus
cacattgaccggcttggtgacaagg

SEQ ID NO: 304541 - DNA, 25 bp, Mus musculus
cacattgaccgggttggtgacaagg

SEQ ID NO: 304542 - DNA, 25 bp, Mus musculus
cacattgacgttcgtagagtagttc

SEQ ID NO: 304543 - DNA, 25 bp, Mus musculus
cacattgacgttggtagagtagttc

SEQ ID NO: 304544 - DNA, 25 bp, Mus musculus
cacattgattttaaagaactcagtt

SEQ ID NO: 304545 - DNA, 25 bp, Mus musculus
cacattgatttttaagaactcagtt

SEQ ID NO: 304546 - DNA, 25 bp, Mus musculus
cacattgcacagaggagtggtcccc

SEQ ID NO: 304547 - DNA, 25 bp, Mus musculus
cacattgcacagtggagtggtcccc

SEQ ID NO: 304548 - DNA, 25 bp, Mus musculus
cacattgccaagaacctgatgacct

SEQ ID NO: 304549 - DNA, 25 bp, Mus musculus
cacattgccaagtacctgatgacct

SEQ ID NO: 304550 - DNA, 25 bp, Mus musculus
cacattgcccctcggagcagaaggt

SEQ ID NO: 304551 - DNA, 25 bp, Mus musculus
cacattgcccctgggagcagaaggt

SEQ ID NO: 304552 - DNA, 25 bp, Mus musculus
cacattgcctatccctccatggaga

SEQ ID NO: 304553 - DNA, 25 bp, Mus musculus
cacattgcctatgcctccatggaga

SEQ ID NO: 304554 - DNA, 25 bp, Mus musculus
cacattgcgggacaagccaactgat

SEQ ID NO: 304555 - DNA, 25 bp, Mus musculus
cacattgcgggagaagccaactgat

SEQ ID NO: 304556 - DNA, 25 bp, Mus musculus
cacattgcttagcaactgccagtgt

SEQ ID NO: 304557 - DNA, 25 bp, Mus musculus
cacattgcttaggaactgccagtgt

SEQ ID NO: 304558 - DNA, 25 bp, Mus musculus
cacattgcttgacattccttgttgt

SEQ ID NO: 304559 - DNA, 25 bp, Mus musculus
cacattgcttgagattccttgttgt

SEQ ID NO: 304560 - DNA, 25 bp, Mus musculus
cacattggacatagacaagctgcat

SEQ ID NO: 304561 - DNA, 25 bp, Mus musculus
cacattggacattgacaagctgcat

SEQ ID NO: 304562 - DNA, 25 bp, Mus musculus
cacattggaggcctcccagacaaat

SEQ ID NO: 304563 - DNA, 25 bp, Mus musculus
cacattggaggcgtcccagacaaat

SEQ ID NO: 304564 - DNA, 25 bp, Mus musculus
cacattggcaccaggctgttggaca

SEQ ID NO: 304565 - DNA, 25 bp, Mus musculus
cacattggcacctggctgttggaca

SEQ ID NO: 304566 - DNA, 25 bp, Mus musculus
cacattggcttcctggaagggctga

SEQ ID NO: 304567 - DNA, 25 bp, Mus musculus
cacattggcttcgtggaagggctga

SEQ ID NO: 304568 - DNA, 25 bp, Mus musculus
cacattggttaaactcttgcagagt

SEQ ID NO: 304569 - DNA, 25 bp, Mus musculus
cacattggttaatctcttgcagagt

SEQ ID NO: 304570 - DNA, 25 bp, Mus musculus
cacattgtactgatctgccttgaaa

SEQ ID NO: 304571 - DNA, 25 bp, Mus musculus
cacattgtactgttctgccttgaaa

SEQ ID NO: 304572 - DNA, 25 bp, Mus musculus
cacattgtcaaaacagtgccaggcc

SEQ ID NO: 304573 - DNA, 25 bp, Mus musculus
cacattgtcaaatcagtgccaggcc

SEQ ID NO: 304574 - DNA, 25 bp, Mus musculus
cacattgtcattacttactatgcca

SEQ ID NO: 304575 - DNA, 25 bp, Mus musculus
cacattgtcatttcttactatgcca

SEQ ID NO: 304576 - DNA, 25 bp, Mus musculus
cacattgtgcccagtaggagtgaac

SEQ ID NO: 304577 - DNA, 25 bp, Mus musculus
cacattgtgccctgtaggagtgaac

SEQ ID NO: 304578 - DNA, 25 bp, Mus musculus
cacattgtggataccgtgtgtgcac

SEQ ID NO: 304579 - DNA, 25 bp, Mus musculus
cacattgtggattccgtgtgtgcac

SEQ ID NO: 304580 - DNA, 25 bp, Mus musculus
cacattgtgggtcgctgtatccaaa

SEQ ID NO: 304581 - DNA, 25 bp, Mus musculus
cacattgtgggtggctgtatccaaa

SEQ ID NO: 304582 - DNA, 25 bp, Mus musculus
cacattgtgtctatctgtatggatc

SEQ ID NO: 304583 - DNA, 25 bp, Mus musculus
cacattgtgtctttctgtatggatc

SEQ ID NO: 304584 - DNA, 25 bp, Mus musculus
cacattgttcaacgcacaggttcca

SEQ ID NO: 304585 - DNA, 25 bp, Mus musculus
cacattgttcaaggcacaggttcca

SEQ ID NO: 304586 - DNA, 25 bp, Mus musculus
cacattgtttgtcaactggagtttc

SEQ ID NO: 304587 - DNA, 25 bp, Mus musculus
cacattgtttgtcgcttgaaataaa

SEQ ID NO: 304588 - DNA, 25 bp, Mus musculus
cacattgtttgtgaactggagtttc

SEQ ID NO: 304589 - DNA, 25 bp, Mus musculus
cacattgtttgtggcttgaaataaa

SEQ ID NO: 304590 - DNA, 25 bp, Mus musculus
cacatttaagagctgatttgccctt

SEQ ID NO: 304591 - DNA, 25 bp, Mus musculus
cacatttaagaggtgatttgccctt

SEQ ID NO: 304592 - DNA, 25 bp, Mus musculus
cacatttacctaacttgatggctta

SEQ ID NO: 304593 - DNA, 25 bp, Mus musculus
cacatttacctatcttgatggctta

SEQ ID NO: 304594 - DNA, 25 bp, Mus musculus
cacatttacgtgacagacctccatt

SEQ ID NO: 304595 - DNA, 25 bp, Mus musculus
cacatttacgtgtcagacctccatt

SEQ ID NO: 304596 - DNA, 25 bp, Mus musculus
cacatttactctcgattgtcagctc

SEQ ID NO: 304597 - DNA, 25 bp, Mus musculus
cacatttactctggattgtcagctc

SEQ ID NO: 304598 - DNA, 25 bp, Mus musculus
cacatttagacaccggaagtgctat

SEQ ID NO: 304599 - DNA, 25 bp, Mus musculus
cacatttagacagcggaagtgctat

SEQ ID NO: 304600 - DNA, 25 bp, Mus musculus
cacatttattccactgtaggttccc

SEQ ID NO: 304601 - DNA, 25 bp, Mus musculus
cacatttattcctctgtaggttccc

SEQ ID NO: 304602 - DNA, 25 bp, Mus musculus
cacatttattttctttattcctagt

SEQ ID NO: 304603 - DNA, 25 bp, Mus musculus
cacatttattttgtttattcctagt

SEQ ID NO: 304604 - DNA, 25 bp, Mus musculus
cacatttcaaacacagactgtccca

SEQ ID NO: 304605 - DNA, 25 bp, Mus musculus
cacatttcaaactcagactgtccca

SEQ ID NO: 304606 - DNA, 25 bp, Mus musculus
cacatttcagaacctcacaacaaga

SEQ ID NO: 304607 - DNA, 25 bp, Mus musculus
cacatttcagaagctcacaacaaga

SEQ ID NO: 304608 - DNA, 25 bp, Mus musculus
cacatttccatgaggaggctctagg

SEQ ID NO: 304609 - DNA, 25 bp, Mus musculus
cacatttccatgtggaggctctagg

SEQ ID NO: 304610 - DNA, 25 bp, Mus musculus
cacatttccattcatattgctcatc

SEQ ID NO: 304611 - DNA, 25 bp, Mus musculus
cacatttccattgatattgctcatc

SEQ ID NO: 304612 - DNA, 25 bp, Mus musculus
cacatttcctgcctgagacaataat

SEQ ID NO: 304613 - DNA, 25 bp, Mus musculus
cacatttcctgcgtgagacaataat

SEQ ID NO: 304614 - DNA, 25 bp, Mus musculus
cacatttcctgtcatcattgttaat

SEQ ID NO: 304615 - DNA, 25 bp, Mus musculus
cacatttcctgtgatcattgttaat

SEQ ID NO: 304616 - DNA, 25 bp, Mus musculus
cacatttcggatccgatagacctta

SEQ ID NO: 304617 - DNA, 25 bp, Mus musculus
cacatttcggatgcgatagacctta

SEQ ID NO: 304618 - DNA, 25 bp, Mus musculus
cacatttctctacatgcctgctgga

SEQ ID NO: 304619 - DNA, 25 bp, Mus musculus
cacatttctctagatgcctgctgga

SEQ ID NO: 304620 - DNA, 25 bp, Mus musculus
cacatttcttcccatatctatttct

SEQ ID NO: 304621 - DNA, 25 bp, Mus musculus
cacatttcttccgatatctatttct

SEQ ID NO: 304622 - DNA, 25 bp, Mus musculus
cacatttgaaggctgttttctacta

SEQ ID NO: 304623 - DNA, 25 bp, Mus musculus
cacatttgaagggtgttttctacta

SEQ ID NO: 304624 - DNA, 25 bp, Mus musculus
cacatttgcactagtctgtttgact

SEQ ID NO: 304625 - DNA, 25 bp, Mus musculus
cacatttgcacttgtctgtttgact

SEQ ID NO: 304626 - DNA, 25 bp, Mus musculus
cacatttgtagacgccagaatcctt

SEQ ID NO: 304627 - DNA, 25 bp, Mus musculus
cacatttgtagaggccagaatcctt

SEQ ID NO: 304628 - DNA, 25 bp, Mus musculus
cacatttgtagcaccttttatttca

SEQ ID NO: 304629 - DNA, 25 bp, Mus musculus
cacatttgtagcaggaatgccctcc

SEQ ID NO: 304630 - DNA, 25 bp, Mus musculus
cacatttgtagctccttttatttca

SEQ ID NO: 304631 - DNA, 25 bp, Mus musculus
cacatttgtagctggaatgccctcc

SEQ ID NO: 304632 - DNA, 25 bp, Mus musculus
cacatttgtcggctgagtcgtgtat

SEQ ID NO: 304633 - DNA, 25 bp, Mus musculus
cacatttgtcgggtgagtcgtgtat

SEQ ID NO: 304634 - DNA, 25 bp, Mus musculus
cacatttgttttcccgatttgcaca

SEQ ID NO: 304635 - DNA, 25 bp, Mus musculus
cacatttgttttgccgatttgcaca

SEQ ID NO: 304636 - DNA, 25 bp, Mus musculus
cacattttaaccaagcttgctgcag

SEQ ID NO: 304637 - DNA, 25 bp, Mus musculus
cacattttaacctagcttgctgcag

SEQ ID NO: 304638 - DNA, 25 bp, Mus musculus
cacattttcataagcacacacaaga

SEQ ID NO: 304639 - DNA, 25 bp, Mus musculus
cacattttcatatgcacacacaaga

SEQ ID NO: 304640 - DNA, 25 bp, Mus musculus
cacattttcttcaaagggcagcaat

SEQ ID NO: 304641 - DNA, 25 bp, Mus musculus
cacattttcttctaagggcagcaat

SEQ ID NO: 304642 - DNA, 25 bp, Mus musculus
cacattttctttactacacatgccc

SEQ ID NO: 304643 - DNA, 25 bp, Mus musculus
cacattttcttttctacacatgccc

SEQ ID NO: 304644 - DNA, 25 bp, Mus musculus
cacattttgagaaacataatcctgt

SEQ ID NO: 304645 - DNA, 25 bp, Mus musculus
cacattttgagatacataatcctgt

SEQ ID NO: 304646 - DNA, 25 bp, Mus musculus
cacattttgcctattacccagagaa

SEQ ID NO: 304647 - DNA, 25 bp, Mus musculus
cacattttgccttttacccagagaa

SEQ ID NO: 304648 - DNA, 25 bp, Mus musculus
cacattttggccagggacgggatga

SEQ ID NO: 304649 - DNA, 25 bp, Mus musculus
cacattttggcctgggacgggatga

SEQ ID NO: 304650 - DNA, 25 bp, Mus musculus
cacatttttacaaagacactgtcat

SEQ ID NO: 304651 - DNA, 25 bp, Mus musculus
cacatttttacatagacactgtcat

SEQ ID NO: 304652 - DNA, 25 bp, Mus musculus
cacatttttgagaggcttgttagaa

SEQ ID NO: 304653 - DNA, 25 bp, Mus musculus
cacatttttgagtggcttgttagaa

SEQ ID NO: 304654 - DNA, 25 bp, Mus musculus
cacatttttgtgcttggatagacga

SEQ ID NO: 304655 - DNA, 25 bp, Mus musculus
cacatttttgtggttggatagacga

SEQ ID NO: 304656 - DNA, 25 bp, Mus musculus
cacatttttgttcggcatggctaac

SEQ ID NO: 304657 - DNA, 25 bp, Mus musculus
cacatttttgttgggcatggctaac

SEQ ID NO: 304658 - DNA, 25 bp, Mus musculus
caccaaacaaagaacgaagctgctt

SEQ ID NO: 304659 - DNA, 25 bp, Mus musculus
caccaaacaaagtacgaagctgctt

SEQ ID NO: 304660 - DNA, 25 bp, Mus musculus
caccaaacacatcaagttacaaaca

SEQ ID NO: 304661 - DNA, 25 bp, Mus musculus
caccaaacacatgaagttacaaaca

SEQ ID NO: 304662 - DNA, 25 bp, Mus musculus
caccaaacatatctcaggcttcttt

SEQ ID NO: 304663 - DNA, 25 bp, Mus musculus
caccaaacatatgtcaggcttcttt

SEQ ID NO: 304664 - DNA, 25 bp, Mus musculus
caccaaacccagactctatggaaga

SEQ ID NO: 304665 - DNA, 25 bp, Mus musculus
caccaaacccagtctctatggaaga

SEQ ID NO: 304666 - DNA, 25 bp, Mus musculus
caccaaacccttacaacacttgtag

SEQ ID NO: 304667 - DNA, 25 bp, Mus musculus
caccaaaccctttcaacacttgtag

SEQ ID NO: 304668 - DNA, 25 bp, Mus musculus
caccaaagaggacaaatacgaagaa

SEQ ID NO: 304669 - DNA, 25 bp, Mus musculus
caccaaagaggagaaatacgaagaa

SEQ ID NO: 304670 - DNA, 25 bp, Mus musculus
caccaaagttctactgggccagagg

SEQ ID NO: 304671 - DNA, 25 bp, Mus musculus
caccaaagttcttctgggccagagg

SEQ ID NO: 304672 - DNA, 25 bp, Mus musculus
caccaaatatgacctctatgggaag

SEQ ID NO: 304673 - DNA, 25 bp, Mus musculus
caccaaatatgagctctatgggaag

SEQ ID NO: 304674 - DNA, 25 bp, Mus musculus
caccaaatgcctatcggtgcctgat

SEQ ID NO: 304675 - DNA, 25 bp, Mus musculus
caccaaatgcctttcggtgcctgat

SEQ ID NO: 304676 - DNA, 25 bp, Mus musculus
caccaaatggtactggattctctga

SEQ ID NO: 304677 - DNA, 25 bp, Mus musculus
caccaaatggtagtggattctctga

SEQ ID NO: 304678 - DNA, 25 bp, Mus musculus
caccaaattatgacgcacagccaac

SEQ ID NO: 304679 - DNA, 25 bp, Mus musculus
caccaaattatgtcgcacagccaac

SEQ ID NO: 304680 - DNA, 25 bp, Mus musculus
caccaacaccatatccaattctaat

SEQ ID NO: 304681 - DNA, 25 bp, Mus musculus
caccaacaccatttccaattctaat

SEQ ID NO: 304682 - DNA, 25 bp, Mus musculus
caccaacacctgaatttcaagctgt

SEQ ID NO: 304683 - DNA, 25 bp, Mus musculus
caccaacacctgtatttcaagctgt

SEQ ID NO: 304684 - DNA, 25 bp, Mus musculus
caccaacaggagagtcagggaccag

SEQ ID NO: 304685 - DNA, 25 bp, Mus musculus
caccaacaggagtgtcagggaccag

SEQ ID NO: 304686 - DNA, 25 bp, Mus musculus
caccaacaggtaccagtggcagaca

SEQ ID NO: 304687 - DNA, 25 bp, Mus musculus
caccaacaggtagcagtggcagaca

SEQ ID NO: 304688 - DNA, 25 bp, Mus musculus
caccaacccacgaacttgaagaact

SEQ ID NO: 304689 - DNA, 25 bp, Mus musculus
caccaacccacgtacttgaagaact

SEQ ID NO: 304690 - DNA, 25 bp, Mus musculus
caccaacctgtgagagttcgttaag

SEQ ID NO: 304691 - DNA, 25 bp, Mus musculus
caccaacctgtgtgagttcgttaag

SEQ ID NO: 304692 - DNA, 25 bp, Mus musculus
caccaacctgttaataggcagtgaa

SEQ ID NO: 304693 - DNA, 25 bp, Mus musculus
caccaacctgtttataggcagtgaa

SEQ ID NO: 304694 - DNA, 25 bp, Mus musculus
caccaacgattcagctacctataga

SEQ ID NO: 304695 - DNA, 25 bp, Mus musculus
caccaacgattctgctacctataga

SEQ ID NO: 304696 - DNA, 25 bp, Mus musculus
caccaacgtttcatcaaaatcatcc

SEQ ID NO: 304697 - DNA, 25 bp, Mus musculus
caccaacgtttcttcaaaatcatcc

SEQ ID NO: 304698 - DNA, 25 bp, Mus musculus
caccaactctcacttcatcagggtt

SEQ ID NO: 304699 - DNA, 25 bp, Mus musculus
caccaactctcagttcatcagggtt

SEQ ID NO: 304700 - DNA, 25 bp, Mus musculus
caccaactgcaccaatgaactgtac

SEQ ID NO: 304701 - DNA, 25 bp, Mus musculus
caccaactgcacgaatgaactgtac

SEQ ID NO: 304702 - DNA, 25 bp, Mus musculus
caccaactgcttactgggatctctg

SEQ ID NO: 304703 - DNA, 25 bp, Mus musculus
caccaactgctttctgggatctctg

SEQ ID NO: 304704 - DNA, 25 bp, Mus musculus
caccaactgtcaacgccaggatttt

SEQ ID NO: 304705 - DNA, 25 bp, Mus musculus
caccaactgtcatcgccaggatttt

SEQ ID NO: 304706 - DNA, 25 bp, Mus musculus
caccaacttacaccataagacaggt

SEQ ID NO: 304707 - DNA, 25 bp, Mus musculus
caccaacttacagcataagacaggt

SEQ ID NO: 304708 - DNA, 25 bp, Mus musculus
caccaacttggtcgagccttttgag

SEQ ID NO: 304709 - DNA, 25 bp, Mus musculus
caccaacttggtggagccttttgag

SEQ ID NO: 304710 - DNA, 25 bp, Mus musculus
caccaagaaggtcaaggcaaagatc

SEQ ID NO: 304711 - DNA, 25 bp, Mus musculus
caccaagaaggtgaaggcaaagatc

SEQ ID NO: 304712 - DNA, 25 bp, Mus musculus
caccaagacacaattcccagagaat

SEQ ID NO: 304713 - DNA, 25 bp, Mus musculus
caccaagacacatttcccagagaat

SEQ ID NO: 304714 - DNA, 25 bp, Mus musculus
caccaagaccacctgctaatgggag

SEQ ID NO: 304715 - DNA, 25 bp, Mus musculus
caccaagaccacgtgctaatgggag

SEQ ID NO: 304716 - DNA, 25 bp, Mus musculus
caccaagaccttcatagatacaatt

SEQ ID NO: 304717 - DNA, 25 bp, Mus musculus
caccaagaccttgatagatacaatt

SEQ ID NO: 304718 - DNA, 25 bp, Mus musculus
caccaagagatcaccaaggtttgta

SEQ ID NO: 304719 - DNA, 25 bp, Mus musculus
caccaagagatctccaaggtttgta

SEQ ID NO: 304720 - DNA, 25 bp, Mus musculus
caccaagcacgacgagaagctgaag

SEQ ID NO: 304721 - DNA, 25 bp, Mus musculus
caccaagcacgaggagaagctgaag

SEQ ID NO: 304722 - DNA, 25 bp, Mus musculus
caccaagccccaagaaagtatgcaa

SEQ ID NO: 304723 - DNA, 25 bp, Mus musculus
caccaagccccatgaaagtatgcaa

SEQ ID NO: 304724 - DNA, 25 bp, Mus musculus
caccaagcctaacagtctgagctca

SEQ ID NO: 304725 - DNA, 25 bp, Mus musculus
caccaagcctaagagtctgagctca

SEQ ID NO: 304726 - DNA, 25 bp, Mus musculus
caccaagccttacgtctatcagaaa

SEQ ID NO: 304727 - DNA, 25 bp, Mus musculus
caccaagccttaggtctatcagaaa

SEQ ID NO: 304728 - DNA, 25 bp, Mus musculus
caccaagctagcactggaccagaag

SEQ ID NO: 304729 - DNA, 25 bp, Mus musculus
caccaagctagctctggaccagaag

SEQ ID NO: 304730 - DNA, 25 bp, Mus musculus
caccaaggaacgccaacgggcctag

SEQ ID NO: 304731 - DNA, 25 bp, Mus musculus
caccaaggaacggcaacgggcctag

SEQ ID NO: 304732 - DNA, 25 bp, Mus musculus
caccaaggactgcacatttatttat

SEQ ID NO: 304733 - DNA, 25 bp, Mus musculus
caccaaggactggacatttatttat

SEQ ID NO: 304734 - DNA, 25 bp, Mus musculus
caccaaggagatcgctgtgcagtat

SEQ ID NO: 304735 - DNA, 25 bp, Mus musculus
caccaaggagatggctgtgcagtat

SEQ ID NO: 304736 - DNA, 25 bp, Mus musculus
caccaaggcagcaggaaggaccaac

SEQ ID NO: 304737 - DNA, 25 bp, Mus musculus
caccaaggcagcagtcgggatggct

SEQ ID NO: 304738 - DNA, 25 bp, Mus musculus
caccaaggcagctggaaggaccaac

SEQ ID NO: 304739 - DNA, 25 bp, Mus musculus
caccaaggcagctgtcgggatggct

SEQ ID NO: 304740 - DNA, 25 bp, Mus musculus
caccaaggcgtaaggagatagaata

SEQ ID NO: 304741 - DNA, 25 bp, Mus musculus
caccaaggcgtatggagatagaata

SEQ ID NO: 304742 - DNA, 25 bp, Mus musculus
caccaaggtgtcatccacaggatgg

SEQ ID NO: 304743 - DNA, 25 bp, Mus musculus
caccaaggtgtcttccacaggatgg

SEQ ID NO: 304744 - DNA, 25 bp, Mus musculus
caccaaggttgtctcagacctgcat

SEQ ID NO: 304745 - DNA, 25 bp, Mus musculus
caccaaggttgtgtcagacctgcat

SEQ ID NO: 304746 - DNA, 25 bp, Mus musculus
caccaagtatagagagatccctggg

SEQ ID NO: 304747 - DNA, 25 bp, Mus musculus
caccaagtatagtgagatccctggg

SEQ ID NO: 304748 - DNA, 25 bp, Mus musculus
caccaagtctcaaaggtgcctcttg

SEQ ID NO: 304749 - DNA, 25 bp, Mus musculus
caccaagtctcataggtgcctcttg

SEQ ID NO: 304750 - DNA, 25 bp, Mus musculus
caccaagtcttgcatcactgctctg

SEQ ID NO: 304751 - DNA, 25 bp, Mus musculus
caccaagtcttggatcactgctctg

SEQ ID NO: 304752 - DNA, 25 bp, Mus musculus
caccaagtgtcaccccaggtagtga

SEQ ID NO: 304753 - DNA, 25 bp, Mus musculus
caccaagtgtcagcccaggtagtga

SEQ ID NO: 304754 - DNA, 25 bp, Mus musculus
caccaagttcgtccgggacatgatc

SEQ ID NO: 304755 - DNA, 25 bp, Mus musculus
caccaagttcgtgcgggacatgatc

SEQ ID NO: 304756 - DNA, 25 bp, Mus musculus
caccaagttttcatgtgccgtacat

SEQ ID NO: 304757 - DNA, 25 bp, Mus musculus
caccaagttttcttgtgccgtacat

SEQ ID NO: 304758 - DNA, 25 bp, Mus musculus
caccaatacacaaaagttacataat

SEQ ID NO: 304759 - DNA, 25 bp, Mus musculus
caccaatacacataagttacataat

SEQ ID NO: 304760 - DNA, 25 bp, Mus musculus
caccaatagagacaatgcctgcatt

SEQ ID NO: 304761 - DNA, 25 bp, Mus musculus
caccaatagagagaatgcctgcatt

SEQ ID NO: 304762 - DNA, 25 bp, Mus musculus
caccaatagctgagagttgtggaac

SEQ ID NO: 304763 - DNA, 25 bp, Mus musculus
caccaatagctgtgagttgtggaac

SEQ ID NO: 304764 - DNA, 25 bp, Mus musculus
caccaatatgagaagggcttccttt

SEQ ID NO: 304765 - DNA, 25 bp, Mus musculus
caccaatatgagtagggcttccttt

SEQ ID NO: 304766 - DNA, 25 bp, Mus musculus
caccaatcaaatagctgggaagagt

SEQ ID NO: 304767 - DNA, 25 bp, Mus musculus
caccaatcaaattgctgggaagagt

SEQ ID NO: 304768 - DNA, 25 bp, Mus musculus
caccaatcaggacggccctgtctgt

SEQ ID NO: 304769 - DNA, 25 bp, Mus musculus
caccaatcaggagggccctgtctgt

SEQ ID NO: 304770 - DNA, 25 bp, Mus musculus
caccaatctggtcttcaaatcgagt

SEQ ID NO: 304771 - DNA, 25 bp, Mus musculus
caccaatctggtgttcaaatcgagt

SEQ ID NO: 304772 - DNA, 25 bp, Mus musculus
caccaatgacaacggccgcttgagt

SEQ ID NO: 304773 - DNA, 25 bp, Mus musculus
caccaatgacaagggccgcttgagt

SEQ ID NO: 304774 - DNA, 25 bp, Mus musculus
caccaatgagagattttcctgatca

SEQ ID NO: 304775 - DNA, 25 bp, Mus musculus
caccaatgagagtttttcctgatca

SEQ ID NO: 304776 - DNA, 25 bp, Mus musculus
caccaatggaccactgccagacaag

SEQ ID NO: 304777 - DNA, 25 bp, Mus musculus
caccaatggacctctgccagacaag

SEQ ID NO: 304778 - DNA, 25 bp, Mus musculus
caccaatgtggtcgaatttcctttt

SEQ ID NO: 304779 - DNA, 25 bp, Mus musculus
caccaatgtggtggaatttcctttt

SEQ ID NO: 304780 - DNA, 25 bp, Mus musculus
caccaatttaagctcaacaagccct

SEQ ID NO: 304781 - DNA, 25 bp, Mus musculus
caccaatttaaggtcaacaagccct

SEQ ID NO: 304782 - DNA, 25 bp, Mus musculus
caccaatttgtgaaacttagaacca

SEQ ID NO: 304783 - DNA, 25 bp, Mus musculus
caccaatttgtgtaacttagaacca

SEQ ID NO: 304784 - DNA, 25 bp, Mus musculus
caccaattttagcgtttttgtgatc

SEQ ID NO: 304785 - DNA, 25 bp, Mus musculus
caccaattttagggtttttgtgatc

SEQ ID NO: 304786 - DNA, 25 bp, Mus musculus
caccacaaaagtaaccacagaaggt

SEQ ID NO: 304787 - DNA, 25 bp, Mus musculus
caccacaaaagttaccacagaaggt

SEQ ID NO: 304788 - DNA, 25 bp, Mus musculus
caccacaaggagctgcccgtttttg

SEQ ID NO: 304789 - DNA, 25 bp, Mus musculus
caccacaaggaggtgcccgtttttg

SEQ ID NO: 304790 - DNA, 25 bp, Mus musculus
caccacaagtggacctgataagtgt

SEQ ID NO: 304791 - DNA, 25 bp, Mus musculus
caccacaagtggtcctgataagtgt

SEQ ID NO: 304792 - DNA, 25 bp, Mus musculus
caccacacatggaaaagtctaaagg

SEQ ID NO: 304793 - DNA, 25 bp, Mus musculus
caccacacatggtaaagtctaaagg

SEQ ID NO: 304794 - DNA, 25 bp, Mus musculus
caccacacccagatactttaaaatt

SEQ ID NO: 304795 - DNA, 25 bp, Mus musculus
caccacacccagcaactaagagatt

SEQ ID NO: 304796 - DNA, 25 bp, Mus musculus
caccacacccaggaactaagagatt

SEQ ID NO: 304797 - DNA, 25 bp, Mus musculus
caccacacccagttactttaaaatt

SEQ ID NO: 304798 - DNA, 25 bp, Mus musculus
caccacactagcatgcaggcatatt

SEQ ID NO: 304799 - DNA, 25 bp, Mus musculus
caccacactagcttgcaggcatatt

SEQ ID NO: 304800 - DNA, 25 bp, Mus musculus
caccacagagcacgctagtttggac

SEQ ID NO: 304801 - DNA, 25 bp, Mus musculus
caccacagagcaggctagtttggac

SEQ ID NO: 304802 - DNA, 25 bp, Mus musculus
caccacagatgtcccaactatttga

SEQ ID NO: 304803 - DNA, 25 bp, Mus musculus
caccacagatgtgccaactatttga

SEQ ID NO: 304804 - DNA, 25 bp, Mus musculus
caccacagcttcaggaattcatact

SEQ ID NO: 304805 - DNA, 25 bp, Mus musculus
caccacagcttctggaattcatact

SEQ ID NO: 304806 - DNA, 25 bp, Mus musculus
caccacagtagcagcggaggcagta

SEQ ID NO: 304807 - DNA, 25 bp, Mus musculus
caccacagtagctgcggaggcagta

SEQ ID NO: 304808 - DNA, 25 bp, Mus musculus
caccacagttccctcttaatataaa

SEQ ID NO: 304809 - DNA, 25 bp, Mus musculus
caccacagttccgtcttaatataaa

SEQ ID NO: 304810 - DNA, 25 bp, Mus musculus
caccacatcaagatttcctaactct

SEQ ID NO: 304811 - DNA, 25 bp, Mus musculus
caccacatcaagttttcctaactct

SEQ ID NO: 304812 - DNA, 25 bp, Mus musculus
caccacatcctgactactacagtat

SEQ ID NO: 304813 - DNA, 25 bp, Mus musculus
caccacatcctgtctactacagtat

SEQ ID NO: 304814 - DNA, 25 bp, Mus musculus
caccacatctggcttgaattaactt

SEQ ID NO: 304815 - DNA, 25 bp, Mus musculus
caccacatctgggttgaattaactt

SEQ ID NO: 304816 - DNA, 25 bp, Mus musculus
caccacatgccactcttgtttttga

SEQ ID NO: 304817 - DNA, 25 bp, Mus musculus
caccacatgccagtcttgtttttga

SEQ ID NO: 304818 - DNA, 25 bp, Mus musculus
caccacattgctactttgtcagagt

SEQ ID NO: 304819 - DNA, 25 bp, Mus musculus
caccacattgcttctttgtcagagt

SEQ ID NO: 304820 - DNA, 25 bp, Mus musculus
caccacattttgatctcccattgat

SEQ ID NO: 304821 - DNA, 25 bp, Mus musculus
caccacattttgttctcccattgat

SEQ ID NO: 304822 - DNA, 25 bp, Mus musculus
caccaccaacccagtcttttattat

SEQ ID NO: 304823 - DNA, 25 bp, Mus musculus
caccaccaaccctgtcttttattat

SEQ ID NO: 304824 - DNA, 25 bp, Mus musculus
caccaccaagccaggatgatttatt

SEQ ID NO: 304825 - DNA, 25 bp, Mus musculus
caccaccaagcctggatgatttatt

SEQ ID NO: 304826 - DNA, 25 bp, Mus musculus
caccaccaatcaaggcagctgttat

SEQ ID NO: 304827 - DNA, 25 bp, Mus musculus
caccaccaatcatggcagctgttat

SEQ ID NO: 304828 - DNA, 25 bp, Mus musculus
caccaccacaaccacgatgagaagg

SEQ ID NO: 304829 - DNA, 25 bp, Mus musculus
caccaccacaacgacgatgagaagg

SEQ ID NO: 304830 - DNA, 25 bp, Mus musculus
caccaccacaagaaaagttggaagt

SEQ ID NO: 304831 - DNA, 25 bp, Mus musculus
caccaccacaagtaaagttggaagt

SEQ ID NO: 304832 - DNA, 25 bp, Mus musculus
caccaccaccttcattttattgttg

SEQ ID NO: 304833 - DNA, 25 bp, Mus musculus
caccaccaccttgattttattgttg

SEQ ID NO: 304834 - DNA, 25 bp, Mus musculus
caccaccacggtctgtttacacaga

SEQ ID NO: 304835 - DNA, 25 bp, Mus musculus
caccaccacggtgtgtttacacaga

SEQ ID NO: 304836 - DNA, 25 bp, Mus musculus
caccaccagcacagtggctgacaaa

SEQ ID NO: 304837 - DNA, 25 bp, Mus musculus
caccaccagcactgtggctgacaaa

SEQ ID NO: 304838 - DNA, 25 bp, Mus musculus
caccaccatcaacgtttttagaaat

SEQ ID NO: 304839 - DNA, 25 bp, Mus musculus
caccaccatcaaggtttttagaaat

SEQ ID NO: 304840 - DNA, 25 bp, Mus musculus
caccaccatctactgcagagcagag

SEQ ID NO: 304841 - DNA, 25 bp, Mus musculus
caccaccatctagtgcagagcagag

SEQ ID NO: 304842 - DNA, 25 bp, Mus musculus
caccaccattccaaccattggtttt

SEQ ID NO: 304843 - DNA, 25 bp, Mus musculus
caccaccattcctaccattggtttt

SEQ ID NO: 304844 - DNA, 25 bp, Mus musculus
caccacccaatgcagatgttctgaa

SEQ ID NO: 304845 - DNA, 25 bp, Mus musculus
caccacccaatggagatgttctgaa

SEQ ID NO: 304846 - DNA, 25 bp, Mus musculus
caccacccagtactgtggccaggaa

SEQ ID NO: 304847 - DNA, 25 bp, Mus musculus
caccacccagtagtgtggccaggaa

SEQ ID NO: 304848 - DNA, 25 bp, Mus musculus
caccacccagtgatgagcatcattg

SEQ ID NO: 304849 - DNA, 25 bp, Mus musculus
caccacccagtgttgagcatcattg

SEQ ID NO: 304850 - DNA, 25 bp, Mus musculus
caccacccatggagaagcctgaggt

SEQ ID NO: 304851 - DNA, 25 bp, Mus musculus
caccacccatggtgaagcctgaggt

SEQ ID NO: 304852 - DNA, 25 bp, Mus musculus
caccacccccatcgggaggcacata

SEQ ID NO: 304853 - DNA, 25 bp, Mus musculus
caccacccccatggggaggcacata

SEQ ID NO: 304854 - DNA, 25 bp, Mus musculus
caccacccctgcaaaggaaaatttg

SEQ ID NO: 304855 - DNA, 25 bp, Mus musculus
caccacccctgctaaggaaaatttg

SEQ ID NO: 304856 - DNA, 25 bp, Mus musculus
caccaccctaggaactagagatgca

SEQ ID NO: 304857 - DNA, 25 bp, Mus musculus
caccaccctaggtactagagatgca

SEQ ID NO: 304858 - DNA, 25 bp, Mus musculus
caccaccgcccgacaggaggaaagt

SEQ ID NO: 304859 - DNA, 25 bp, Mus musculus
caccaccgcccgtcaggaggaaagt

SEQ ID NO: 304860 - DNA, 25 bp, Mus musculus
caccaccgtgtgatttgctttacag

SEQ ID NO: 304861 - DNA, 25 bp, Mus musculus
caccaccgtgtgttttgctttacag

SEQ ID NO: 304862 - DNA, 25 bp, Mus musculus
caccaccgtgttcaatgcccatgaa

SEQ ID NO: 304863 - DNA, 25 bp, Mus musculus
caccaccgtgttgaatgcccatgaa

SEQ ID NO: 304864 - DNA, 25 bp, Mus musculus
caccacctatagaagcacactttgt

SEQ ID NO: 304865 - DNA, 25 bp, Mus musculus
caccacctatagtagcacactttgt

SEQ ID NO: 304866 - DNA, 25 bp, Mus musculus
caccacctccttcaacaaagaatga

SEQ ID NO: 304867 - DNA, 25 bp, Mus musculus
caccacctccttgaacaaagaatga

SEQ ID NO: 304868 - DNA, 25 bp, Mus musculus
caccacctctttcagggacatgaag

SEQ ID NO: 304869 - DNA, 25 bp, Mus musculus
caccacctctttgagggacatgaag

SEQ ID NO: 304870 - DNA, 25 bp, Mus musculus
caccacctgaatagccacaactgga

SEQ ID NO: 304871 - DNA, 25 bp, Mus musculus
caccacctgaattgccacaactgga

SEQ ID NO: 304872 - DNA, 25 bp, Mus musculus
caccacctgctaagcttcaataaag

SEQ ID NO: 304873 - DNA, 25 bp, Mus musculus
caccacctgctatgcttcaataaag

SEQ ID NO: 304874 - DNA, 25 bp, Mus musculus
caccacctggctatattcttaaact

SEQ ID NO: 304875 - DNA, 25 bp, Mus musculus
caccacctggctttattcttaaact

SEQ ID NO: 304876 - DNA, 25 bp, Mus musculus
caccacctgtgcatgcttaaaactt

SEQ ID NO: 304877 - DNA, 25 bp, Mus musculus
caccacctgtgcttgcttaaaactt

SEQ ID NO: 304878 - DNA, 25 bp, Mus musculus
caccaccttatgagttctgtaacta

SEQ ID NO: 304879 - DNA, 25 bp, Mus musculus
caccaccttatgtgttctgtaacta

SEQ ID NO: 304880 - DNA, 25 bp, Mus musculus
caccaccttcaacatgtacacgagg

SEQ ID NO: 304881 - DNA, 25 bp, Mus musculus
caccaccttcaagatgtacacgagg

SEQ ID NO: 304882 - DNA, 25 bp, Mus musculus
caccaccttctgatggtgcaacata

SEQ ID NO: 304883 - DNA, 25 bp, Mus musculus
caccaccttctgttggtgcaacata

SEQ ID NO: 304884 - DNA, 25 bp, Mus musculus
caccaccttggcatatctgaaacgt

SEQ ID NO: 304885 - DNA, 25 bp, Mus musculus
caccaccttggcttatctgaaacgt

SEQ ID NO: 304886 - DNA, 25 bp, Mus musculus
caccacctttatccttatctaaact

SEQ ID NO: 304887 - DNA, 25 bp, Mus musculus
caccacctttatgcttatctaaact

SEQ ID NO: 304888 - DNA, 25 bp, Mus musculus
caccacgagaaaccgtgtgattttt

SEQ ID NO: 304889 - DNA, 25 bp, Mus musculus
caccacgagaaagcgtgtgattttt

SEQ ID NO: 304890 - DNA, 25 bp, Mus musculus
caccacgagcatagttcctaatttt

SEQ ID NO: 304891 - DNA, 25 bp, Mus musculus
caccacgagcattgttcctaatttt

SEQ ID NO: 304892 - DNA, 25 bp, Mus musculus
caccacgcctagctttaattcctag

SEQ ID NO: 304893 - DNA, 25 bp, Mus musculus
caccacgcctaggtttaattcctag

SEQ ID NO: 304894 - DNA, 25 bp, Mus musculus
caccacgcggtgagctgtttattta

SEQ ID NO: 304895 - DNA, 25 bp, Mus musculus
caccacgcggtgtgctgtttattta

SEQ ID NO: 304896 - DNA, 25 bp, Mus musculus
caccacgggagactggaggaccttt

SEQ ID NO: 304897 - DNA, 25 bp, Mus musculus
caccacgggagagtggaggaccttt

SEQ ID NO: 304898 - DNA, 25 bp, Mus musculus
caccacgggcctcttttatgtacta

SEQ ID NO: 304899 - DNA, 25 bp, Mus musculus
caccacgggcctgttttatgtacta

SEQ ID NO: 304900 - DNA, 25 bp, Mus musculus
caccacgggtggctaagccggacaa

SEQ ID NO: 304901 - DNA, 25 bp, Mus musculus
caccacgggtgggtaagccggacaa

SEQ ID NO: 304902 - DNA, 25 bp, Mus musculus
caccacgtcgtcctaaacactgtag

SEQ ID NO: 304903 - DNA, 25 bp, Mus musculus
caccacgtcgtcgtaaacactgtag

SEQ ID NO: 304904 - DNA, 25 bp, Mus musculus
caccacgtgggtactgagcatagaa

SEQ ID NO: 304905 - DNA, 25 bp, Mus musculus
caccacgtgggtcatgggaaccaac

SEQ ID NO: 304906 - DNA, 25 bp, Mus musculus
caccacgtgggtgatgggaaccaac

SEQ ID NO: 304907 - DNA, 25 bp, Mus musculus
caccacgtgggttctgagcatagaa

SEQ ID NO: 304908 - DNA, 25 bp, Mus musculus
caccactacacacacttacaaaaga

SEQ ID NO: 304909 - DNA, 25 bp, Mus musculus
caccactacacagacttacaaaaga

SEQ ID NO: 304910 - DNA, 25 bp, Mus musculus
caccactacattaactaaagacaga

SEQ ID NO: 304911 - DNA, 25 bp, Mus musculus
caccactacatttactaaagacaga

SEQ ID NO: 304912 - DNA, 25 bp, Mus musculus
caccactactgaccgagatgtctta

SEQ ID NO: 304913 - DNA, 25 bp, Mus musculus
caccactactgagcgagatgtctta

SEQ ID NO: 304914 - DNA, 25 bp, Mus musculus
caccactaggcgaaagagaatatgc

SEQ ID NO: 304915 - DNA, 25 bp, Mus musculus
caccactaggcgtaagagaatatgc

SEQ ID NO: 304916 - DNA, 25 bp, Mus musculus
caccactccgtgacagacacaaggt

SEQ ID NO: 304917 - DNA, 25 bp, Mus musculus
caccactccgtgtcagacacaaggt

SEQ ID NO: 304918 - DNA, 25 bp, Mus musculus
caccactctggacaccggtgagtga

SEQ ID NO: 304919 - DNA, 25 bp, Mus musculus
caccactctggagaccggtgagtga

SEQ ID NO: 304920 - DNA, 25 bp, Mus musculus
caccactctttgagcttttgggttt

SEQ ID NO: 304921 - DNA, 25 bp, Mus musculus
caccactctttgtgcttttgggttt

SEQ ID NO: 304922 - DNA, 25 bp, Mus musculus
caccactgaggcaggaaagggctgc

SEQ ID NO: 304923 - DNA, 25 bp, Mus musculus
caccactgaggctggaaagggctgc

SEQ ID NO: 304924 - DNA, 25 bp, Mus musculus
caccactgatttacctaccagaatg

SEQ ID NO: 304925 - DNA, 25 bp, Mus musculus
caccactgattttcctaccagaatg

SEQ ID NO: 304926 - DNA, 25 bp, Mus musculus
caccactgcagacgactgcctgtgg

SEQ ID NO: 304927 - DNA, 25 bp, Mus musculus
caccactgcagaggactgcctgtgg

SEQ ID NO: 304928 - DNA, 25 bp, Mus musculus
caccactgcccgctttatcatatta

SEQ ID NO: 304929 - DNA, 25 bp, Mus musculus
caccactgcccggtttatcatatta

SEQ ID NO: 304930 - DNA, 25 bp, Mus musculus
caccactgcctaccttagactggca

SEQ ID NO: 304931 - DNA, 25 bp, Mus musculus
caccactgcctactgtgaacagaga

SEQ ID NO: 304932 - DNA, 25 bp, Mus musculus
caccactgcctagcttagactggca

SEQ ID NO: 304933 - DNA, 25 bp, Mus musculus
caccactgcctagtgtgaacagaga

SEQ ID NO: 304934 - DNA, 25 bp, Mus musculus
caccactgcctcatatctagttggg

SEQ ID NO: 304935 - DNA, 25 bp, Mus musculus
caccactgcctcttatctagttggg

SEQ ID NO: 304936 - DNA, 25 bp, Mus musculus
caccactgctaacaacaacattctt

SEQ ID NO: 304937 - DNA, 25 bp, Mus musculus
caccactgctaagaacaacattctt

SEQ ID NO: 304938 - DNA, 25 bp, Mus musculus
caccactgctcaacgagcatctggg

SEQ ID NO: 304939 - DNA, 25 bp, Mus musculus
caccactgctcacctcagaagaatc

SEQ ID NO: 304940 - DNA, 25 bp, Mus musculus
caccactgctcagctcagaagaatc

SEQ ID NO: 304941 - DNA, 25 bp, Mus musculus
caccactgctcatcgagcatctggg

SEQ ID NO: 304942 - DNA, 25 bp, Mus musculus
caccactggacaaggcctgtgcaga

SEQ ID NO: 304943 - DNA, 25 bp, Mus musculus
caccactggacatggcctgtgcaga

SEQ ID NO: 304944 - DNA, 25 bp, Mus musculus
caccactgggcaagatgacgaaatt

SEQ ID NO: 304945 - DNA, 25 bp, Mus musculus
caccactgggcatgatgacgaaatt

SEQ ID NO: 304946 - DNA, 25 bp, Mus musculus
caccactgggctattgtacatttca

SEQ ID NO: 304947 - DNA, 25 bp, Mus musculus
caccactgggcttttgtacatttca

SEQ ID NO: 304948 - DNA, 25 bp, Mus musculus
caccactgtggacatcttcttgacg

SEQ ID NO: 304949 - DNA, 25 bp, Mus musculus
caccactgtggagatcttcttgacg

SEQ ID NO: 304950 - DNA, 25 bp, Mus musculus
caccactgttccatccatgggaata

SEQ ID NO: 304951 - DNA, 25 bp, Mus musculus
caccactgttccttccatgggaata

SEQ ID NO: 304952 - DNA, 25 bp, Mus musculus
caccacttagctcaattgaaaatca

SEQ ID NO: 304953 - DNA, 25 bp, Mus musculus
caccacttagctgaattgaaaatca

SEQ ID NO: 304954 - DNA, 25 bp, Mus musculus
caccacttatttagtcctcatttca

SEQ ID NO: 304955 - DNA, 25 bp, Mus musculus
caccacttattttgtcctcatttca

SEQ ID NO: 304956 - DNA, 25 bp, Mus musculus
caccacttcccaactgcaatataaa

SEQ ID NO: 304957 - DNA, 25 bp, Mus musculus
caccacttcccatctgcaatataaa

SEQ ID NO: 304958 - DNA, 25 bp, Mus musculus
caccacttgcttatagtgttgaggt

SEQ ID NO: 304959 - DNA, 25 bp, Mus musculus
caccacttgcttttagtgttgaggt

SEQ ID NO: 304960 - DNA, 25 bp, Mus musculus
caccacttgtatctatgacctcact

SEQ ID NO: 304961 - DNA, 25 bp, Mus musculus
caccacttgtatgtatgacctcact

SEQ ID NO: 304962 - DNA, 25 bp, Mus musculus
caccactttgacacagttcctaatg

SEQ ID NO: 304963 - DNA, 25 bp, Mus musculus
caccactttgactcagttcctaatg

SEQ ID NO: 304964 - DNA, 25 bp, Mus musculus
caccagaaagacaagagggaagctc

SEQ ID NO: 304965 - DNA, 25 bp, Mus musculus
caccagaaagactagagggaagctc

SEQ ID NO: 304966 - DNA, 25 bp, Mus musculus
caccagaactcaaccttttgttttc

SEQ ID NO: 304967 - DNA, 25 bp, Mus musculus
caccagaactcatccttttgttttc

SEQ ID NO: 304968 - DNA, 25 bp, Mus musculus
caccagaagacgcatcaagtgtcca

SEQ ID NO: 304969 - DNA, 25 bp, Mus musculus
caccagaagacggatcaagtgtcca

SEQ ID NO: 304970 - DNA, 25 bp, Mus musculus
caccagaagactaggttttcaccat

SEQ ID NO: 304971 - DNA, 25 bp, Mus musculus
caccagaagacttggttttcaccat

SEQ ID NO: 304972 - DNA, 25 bp, Mus musculus
caccagaagctacgtttgagaaaca

SEQ ID NO: 304973 - DNA, 25 bp, Mus musculus
caccagaagctaggtttgagaaaca

SEQ ID NO: 304974 - DNA, 25 bp, Mus musculus
caccagaatttgattgccacctaca

SEQ ID NO: 304975 - DNA, 25 bp, Mus musculus
caccagaatttgtttgccacctaca

SEQ ID NO: 304976 - DNA, 25 bp, Mus musculus
caccagacacgtatcttgtggtaaa

SEQ ID NO: 304977 - DNA, 25 bp, Mus musculus
caccagacacgtttcttgtggtaaa

SEQ ID NO: 304978 - DNA, 25 bp, Mus musculus
caccagactctgagtgcggtctctg

SEQ ID NO: 304979 - DNA, 25 bp, Mus musculus
caccagactctgtgtgcggtctctg

SEQ ID NO: 304980 - DNA, 25 bp, Mus musculus
caccagactgaaccacatgtaatat

SEQ ID NO: 304981 - DNA, 25 bp, Mus musculus
caccagactgaagcacatgtaatat

SEQ ID NO: 304982 - DNA, 25 bp, Mus musculus
caccagagactgatcccatgtagaa

SEQ ID NO: 304983 - DNA, 25 bp, Mus musculus
caccagagactgttcccatgtagaa

SEQ ID NO: 304984 - DNA, 25 bp, Mus musculus
caccagagctctcattctgtttttt

SEQ ID NO: 304985 - DNA, 25 bp, Mus musculus
caccagagctctgattctgtttttt

SEQ ID NO: 304986 - DNA, 25 bp, Mus musculus
caccagaggtgacccctatttttag

SEQ ID NO: 304987 - DNA, 25 bp, Mus musculus
caccagaggtgagccctatttttag

SEQ ID NO: 304988 - DNA, 25 bp, Mus musculus
caccagagtatgaaatagcttccgg

SEQ ID NO: 304989 - DNA, 25 bp, Mus musculus
caccagagtatgtaatagcttccgg

SEQ ID NO: 304990 - DNA, 25 bp, Mus musculus
caccagatctgcatttaatatagct

SEQ ID NO: 304991 - DNA, 25 bp, Mus musculus
caccagatctgcttttaatatagct

SEQ ID NO: 304992 - DNA, 25 bp, Mus musculus
caccagatgttaacacttagtacct

SEQ ID NO: 304993 - DNA, 25 bp, Mus musculus
caccagatgttatcacttagtacct

SEQ ID NO: 304994 - DNA, 25 bp, Mus musculus
caccagattcacctttttatgctcc

SEQ ID NO: 304995 - DNA, 25 bp, Mus musculus
caccagattcacgtttttatgctcc

SEQ ID NO: 304996 - DNA, 25 bp, Mus musculus
caccagattctgcttccatttaata

SEQ ID NO: 304997 - DNA, 25 bp, Mus musculus
caccagattctggttccatttaata

SEQ ID NO: 304998 - DNA, 25 bp, Mus musculus
caccagcactggcttttgtctgttt

SEQ ID NO: 304999 - DNA, 25 bp, Mus musculus
caccagcactgggttttgtctgttt

SEQ ID NO: 305000 - DNA, 25 bp, Mus musculus
caccagcagagcagttgtccaggaa

SEQ ID NO: 305001 - DNA, 25 bp, Mus musculus
caccagcagagctgttgtccaggaa

SEQ ID NO: 305002 - DNA, 25 bp, Mus musculus
caccagcagagtctgcagcggcgaa

SEQ ID NO: 305003 - DNA, 25 bp, Mus musculus
caccagcagagtgtgcagcggcgaa

SEQ ID NO: 305004 - DNA, 25 bp, Mus musculus
caccagcagggtcacctaaagaatt

SEQ ID NO: 305005 - DNA, 25 bp, Mus musculus
caccagcagggtgacctaaagaatt

SEQ ID NO: 305006 - DNA, 25 bp, Mus musculus
caccagcagtgtagggataggagca

SEQ ID NO: 305007 - DNA, 25 bp, Mus musculus
caccagcagtgttgggataggagca

SEQ ID NO: 305008 - DNA, 25 bp, Mus musculus
caccagcatcagctccacaatgtgg

SEQ ID NO: 305009 - DNA, 25 bp, Mus musculus
caccagcatcaggtccacaatgtgg

SEQ ID NO: 305010 - DNA, 25 bp, Mus musculus
caccagcatctgagttcttataata

SEQ ID NO: 305011 - DNA, 25 bp, Mus musculus
caccagcatctgtgttcttataata

SEQ ID NO: 305012 - DNA, 25 bp, Mus musculus
caccagccagccaagggatgatggg

SEQ ID NO: 305013 - DNA, 25 bp, Mus musculus
caccagccagcctagggatgatggg

SEQ ID NO: 305014 - DNA, 25 bp, Mus musculus
caccagccatgcagtttcagggaga

SEQ ID NO: 305015 - DNA, 25 bp, Mus musculus
caccagccatgctgtttcagggaga

SEQ ID NO: 305016 - DNA, 25 bp, Mus musculus
caccagccccagctaggcagtttta

SEQ ID NO: 305017 - DNA, 25 bp, Mus musculus
caccagccccaggtaggcagtttta

SEQ ID NO: 305018 - DNA, 25 bp, Mus musculus
caccagcccttgatggtttataatt

SEQ ID NO: 305019 - DNA, 25 bp, Mus musculus
caccagcccttgttggtttataatt

SEQ ID NO: 305020 - DNA, 25 bp, Mus musculus
caccagcctcatcaattattaacca

SEQ ID NO: 305021 - DNA, 25 bp, Mus musculus
caccagcctcatgaattattaacca

SEQ ID NO: 305022 - DNA, 25 bp, Mus musculus
caccagccttgtctcattccttgaa

SEQ ID NO: 305023 - DNA, 25 bp, Mus musculus
caccagccttgtgtcattccttgaa

SEQ ID NO: 305024 - DNA, 25 bp, Mus musculus
caccagcgaacgaaacttttgtatg

SEQ ID NO: 305025 - DNA, 25 bp, Mus musculus
caccagcgaacgtaacttttgtatg

SEQ ID NO: 305026 - DNA, 25 bp, Mus musculus
caccagctcattcgaaactgtcatt

SEQ ID NO: 305027 - DNA, 25 bp, Mus musculus
caccagctcattggaaactgtcatt

SEQ ID NO: 305028 - DNA, 25 bp, Mus musculus
caccagctgggcatccttttaagaa

SEQ ID NO: 305029 - DNA, 25 bp, Mus musculus
caccagctgggcttccttttaagaa

SEQ ID NO: 305030 - DNA, 25 bp, Mus musculus
caccagctgtagaaggtcctttgta

SEQ ID NO: 305031 - DNA, 25 bp, Mus musculus
caccagctgtagtaggtcctttgta

SEQ ID NO: 305032 - DNA, 25 bp, Mus musculus
caccagcttgaccttagacttctgc

SEQ ID NO: 305033 - DNA, 25 bp, Mus musculus
caccagcttgacgttagacttctgc

SEQ ID NO: 305034 - DNA, 25 bp, Mus musculus
caccagcttgagactaagttcccaa

SEQ ID NO: 305035 - DNA, 25 bp, Mus musculus
caccagcttgagtctaagttcccaa

SEQ ID NO: 305036 - DNA, 25 bp, Mus musculus
caccagcttttaataccaactcgag

SEQ ID NO: 305037 - DNA, 25 bp, Mus musculus
caccagcttttattaccaactcgag

SEQ ID NO: 305038 - DNA, 25 bp, Mus musculus
caccaggaaaaccattgccacagtc

SEQ ID NO: 305039 - DNA, 25 bp, Mus musculus
caccaggaaaacgattgccacagtc

SEQ ID NO: 305040 - DNA, 25 bp, Mus musculus
caccaggacaatccaaaggataaga

SEQ ID NO: 305041 - DNA, 25 bp, Mus musculus
caccaggacaatgcaaaggataaga

SEQ ID NO: 305042 - DNA, 25 bp, Mus musculus
caccaggaccctagacacttaataa

SEQ ID NO: 305043 - DNA, 25 bp, Mus musculus
caccaggacccttgacacttaataa

SEQ ID NO: 305044 - DNA, 25 bp, Mus musculus
caccaggacgctcaaggcccggatg

SEQ ID NO: 305045 - DNA, 25 bp, Mus musculus
caccaggacgctgaaggcccggatg

SEQ ID NO: 305046 - DNA, 25 bp, Mus musculus
caccaggagcctaacatgtctaaac

SEQ ID NO: 305047 - DNA, 25 bp, Mus musculus
caccaggagccttacatgtctaaac

SEQ ID NO: 305048 - DNA, 25 bp, Mus musculus
caccaggagctgattaaacaaaaga

SEQ ID NO: 305049 - DNA, 25 bp, Mus musculus
caccaggagctgtttaaacaaaaga

SEQ ID NO: 305050 - DNA, 25 bp, Mus musculus
caccaggaggcaactgtctattctt

SEQ ID NO: 305051 - DNA, 25 bp, Mus musculus
caccaggaggcatctgtctattctt

SEQ ID NO: 305052 - DNA, 25 bp, Mus musculus
caccaggatcatactgcaatcgaga

SEQ ID NO: 305053 - DNA, 25 bp, Mus musculus
caccaggatcattctgcaatcgaga

SEQ ID NO: 305054 - DNA, 25 bp, Mus musculus
caccaggatgaacataggcagtcaa

SEQ ID NO: 305055 - DNA, 25 bp, Mus musculus
caccaggatgaagataggcagtcaa

SEQ ID NO: 305056 - DNA, 25 bp, Mus musculus
caccaggatgacactatctttctag

SEQ ID NO: 305057 - DNA, 25 bp, Mus musculus
caccaggatgactctatctttctag

SEQ ID NO: 305058 - DNA, 25 bp, Mus musculus
caccaggcacccatctgtgctaagg

SEQ ID NO: 305059 - DNA, 25 bp, Mus musculus
caccaggcacccttctgtgctaagg

SEQ ID NO: 305060 - DNA, 25 bp, Mus musculus
caccaggcactgcagagcttccaag

SEQ ID NO: 305061 - DNA, 25 bp, Mus musculus
caccaggcactggagagcttccaag

SEQ ID NO: 305062 - DNA, 25 bp, Mus musculus
caccaggcagagctctacagggtaa

SEQ ID NO: 305063 - DNA, 25 bp, Mus musculus
caccaggcagaggtctacagggtaa

SEQ ID NO: 305064 - DNA, 25 bp, Mus musculus
caccaggcatgtcagaattcatact

SEQ ID NO: 305065 - DNA, 25 bp, Mus musculus
caccaggcatgtgagaattcatact

SEQ ID NO: 305066 - DNA, 25 bp, Mus musculus
caccaggcctgacgagaagcacaag

SEQ ID NO: 305067 - DNA, 25 bp, Mus musculus
caccaggcctgaggagaagcacaag

SEQ ID NO: 305068 - DNA, 25 bp, Mus musculus
caccaggcggtgagtcttgaaagga

SEQ ID NO: 305069 - DNA, 25 bp, Mus musculus
caccaggcggtgtgtcttgaaagga

SEQ ID NO: 305070 - DNA, 25 bp, Mus musculus
caccaggctgggaaatcctgttgtt

SEQ ID NO: 305071 - DNA, 25 bp, Mus musculus
caccaggctgggtaatcctgttgtt

SEQ ID NO: 305072 - DNA, 25 bp, Mus musculus
caccaggctttccatctattgagta

SEQ ID NO: 305073 - DNA, 25 bp, Mus musculus
caccaggctttcgatctattgagta

SEQ ID NO: 305074 - DNA, 25 bp, Mus musculus
caccagggacgtatccctctgacaa

SEQ ID NO: 305075 - DNA, 25 bp, Mus musculus
caccagggacgtttccctctgacaa

SEQ ID NO: 305076 - DNA, 25 bp, Mus musculus
caccagggctgtaggtggctgtgaa

SEQ ID NO: 305077 - DNA, 25 bp, Mus musculus
caccagggctgttggtggctgtgaa

SEQ ID NO: 305078 - DNA, 25 bp, Mus musculus
caccagggtgatatgctgctggctt

SEQ ID NO: 305079 - DNA, 25 bp, Mus musculus
caccagggtgatttgctgctggctt

SEQ ID NO: 305080 - DNA, 25 bp, Mus musculus
caccaggtacaaattggcatgtaga

SEQ ID NO: 305081 - DNA, 25 bp, Mus musculus
caccaggtacaatttggcatgtaga

SEQ ID NO: 305082 - DNA, 25 bp, Mus musculus
caccaggtacggatctcaacacaga

SEQ ID NO: 305083 - DNA, 25 bp, Mus musculus
caccaggtacggttctcaacacaga

SEQ ID NO: 305084 - DNA, 25 bp, Mus musculus
caccaggtaggtaagggtggtcagt

SEQ ID NO: 305085 - DNA, 25 bp, Mus musculus
caccaggtaggttagggtggtcagt

SEQ ID NO: 305086 - DNA, 25 bp, Mus musculus
caccaggtctagatgtagcttagct

SEQ ID NO: 305087 - DNA, 25 bp, Mus musculus
caccaggtctagttgtagcttagct

SEQ ID NO: 305088 - DNA, 25 bp, Mus musculus
caccaggtcttactggcatgctttg

SEQ ID NO: 305089 - DNA, 25 bp, Mus musculus
caccaggtcttagtggcatgctttg

SEQ ID NO: 305090 - DNA, 25 bp, Mus musculus
caccaggtgggcatactaactaggt

SEQ ID NO: 305091 - DNA, 25 bp, Mus musculus
caccaggtgggcttactaactaggt

SEQ ID NO: 305092 - DNA, 25 bp, Mus musculus
caccaggtgtcaattcaggaacgag

SEQ ID NO: 305093 - DNA, 25 bp, Mus musculus
caccaggtgtcatttcaggaacgag

SEQ ID NO: 305094 - DNA, 25 bp, Mus musculus
caccaggtgtgtaagttaatcttac

SEQ ID NO: 305095 - DNA, 25 bp, Mus musculus
caccaggtgtgttagttaatcttac

SEQ ID NO: 305096 - DNA, 25 bp, Mus musculus
caccaggttaccaccatgtaatttt

SEQ ID NO: 305097 - DNA, 25 bp, Mus musculus
caccaggttacctccatgtaatttt

SEQ ID NO: 305098 - DNA, 25 bp, Mus musculus
caccaggttctacggtttctcaggt

SEQ ID NO: 305099 - DNA, 25 bp, Mus musculus
caccaggttctagggtttctcaggt

SEQ ID NO: 305100 - DNA, 25 bp, Mus musculus
caccaggttgccaatgggcagtctc

SEQ ID NO: 305101 - DNA, 25 bp, Mus musculus
caccaggttgcctatgggcagtctc

SEQ ID NO: 305102 - DNA, 25 bp, Mus musculus
caccaggtttggcttactagcatta

SEQ ID NO: 305103 - DNA, 25 bp, Mus musculus
caccaggtttgggttactagcatta

SEQ ID NO: 305104 - DNA, 25 bp, Mus musculus
caccagtaacccaaagtttgagcca

SEQ ID NO: 305105 - DNA, 25 bp, Mus musculus
caccagtaaccctaagtttgagcca

SEQ ID NO: 305106 - DNA, 25 bp, Mus musculus
caccagtaccagagactcgtcagag

SEQ ID NO: 305107 - DNA, 25 bp, Mus musculus
caccagtaccagtgactcgtcagag

SEQ ID NO: 305108 - DNA, 25 bp, Mus musculus
caccagtacttcctgagacgtggag

SEQ ID NO: 305109 - DNA, 25 bp, Mus musculus
caccagtacttcgtgagacgtggag

SEQ ID NO: 305110 - DNA, 25 bp, Mus musculus
caccagtatcgaattcacagaagga

SEQ ID NO: 305111 - DNA, 25 bp, Mus musculus
caccagtatcgatttcacagaagga

SEQ ID NO: 305112 - DNA, 25 bp, Mus musculus
caccagtattacacccattctttaa

SEQ ID NO: 305113 - DNA, 25 bp, Mus musculus
caccagtattactcccattctttaa

SEQ ID NO: 305114 - DNA, 25 bp, Mus musculus
caccagtcctcacaagtcactgtta

SEQ ID NO: 305115 - DNA, 25 bp, Mus musculus
caccagtcctcagaagtcactgtta

SEQ ID NO: 305116 - DNA, 25 bp, Mus musculus
caccagtccttcaaacagcagttta

SEQ ID NO: 305117 - DNA, 25 bp, Mus musculus
caccagtccttctaacagcagttta

SEQ ID NO: 305118 - DNA, 25 bp, Mus musculus
caccagtcggagcagaataccttat

SEQ ID NO: 305119 - DNA, 25 bp, Mus musculus
caccagtcggaggagaataccttat

SEQ ID NO: 305120 - DNA, 25 bp, Mus musculus
caccagtcgggcaacaaattatacc

SEQ ID NO: 305121 - DNA, 25 bp, Mus musculus
caccagtcgggctacaaattatacc

SEQ ID NO: 305122 - DNA, 25 bp, Mus musculus
caccagtctgggacaaagagctaaa

SEQ ID NO: 305123 - DNA, 25 bp, Mus musculus
caccagtctgggtcaaagagctaaa

SEQ ID NO: 305124 - DNA, 25 bp, Mus musculus
caccagtgactgatgtaaggaccta

SEQ ID NO: 305125 - DNA, 25 bp, Mus musculus
caccagtgactgttgtaaggaccta

SEQ ID NO: 305126 - DNA, 25 bp, Mus musculus
caccagtgcatgctttctcttgcaa

SEQ ID NO: 305127 - DNA, 25 bp, Mus musculus
caccagtgcatggtttctcttgcaa

SEQ ID NO: 305128 - DNA, 25 bp, Mus musculus
caccagtgccaccttagtgttgaaa

SEQ ID NO: 305129 - DNA, 25 bp, Mus musculus
caccagtgccacgttagtgttgaaa

SEQ ID NO: 305130 - DNA, 25 bp, Mus musculus
caccagtggttgatggagaactcta

SEQ ID NO: 305131 - DNA, 25 bp, Mus musculus
caccagtggttgttggagaactcta

SEQ ID NO: 305132 - DNA, 25 bp, Mus musculus
caccagtggtttcgagcctctgtga

SEQ ID NO: 305133 - DNA, 25 bp, Mus musculus
caccagtggtttggagcctctgtga

SEQ ID NO: 305134 - DNA, 25 bp, Mus musculus
caccagtgtggaatggagtctccat

SEQ ID NO: 305135 - DNA, 25 bp, Mus musculus
caccagtgtggattggagtctccat

SEQ ID NO: 305136 - DNA, 25 bp, Mus musculus
caccagttacttaggacttcttcca

SEQ ID NO: 305137 - DNA, 25 bp, Mus musculus
caccagttactttggacttcttcca

SEQ ID NO: 305138 - DNA, 25 bp, Mus musculus
caccagttgcttattattggccttg

SEQ ID NO: 305139 - DNA, 25 bp, Mus musculus
caccagttgctttttattggccttg

SEQ ID NO: 305140 - DNA, 25 bp, Mus musculus
caccagttggtgagttttgaagaaa

SEQ ID NO: 305141 - DNA, 25 bp, Mus musculus
caccagttggtgtgttttgaagaaa

SEQ ID NO: 305142 - DNA, 25 bp, Mus musculus
caccagttgtctccttttgaggact

SEQ ID NO: 305143 - DNA, 25 bp, Mus musculus
caccagttgtctgcttttgaggact

SEQ ID NO: 305144 - DNA, 25 bp, Mus musculus
caccagttgtgactccctgcaatgt

SEQ ID NO: 305145 - DNA, 25 bp, Mus musculus
caccagttgtgagtccctgcaatgt

SEQ ID NO: 305146 - DNA, 25 bp, Mus musculus
caccagtttagacctgcccaggaaa

SEQ ID NO: 305147 - DNA, 25 bp, Mus musculus
caccagtttagagctgcccaggaaa

SEQ ID NO: 305148 - DNA, 25 bp, Mus musculus
caccataacgttattcataggcaag

SEQ ID NO: 305149 - DNA, 25 bp, Mus musculus
caccataacgtttttcataggcaag

SEQ ID NO: 305150 - DNA, 25 bp, Mus musculus
caccataagcagaggttgttcttaa

SEQ ID NO: 305151 - DNA, 25 bp, Mus musculus
caccataagcagtggttgttcttaa

SEQ ID NO: 305152 - DNA, 25 bp, Mus musculus
caccataccaagcacagttgttaga

SEQ ID NO: 305153 - DNA, 25 bp, Mus musculus
caccataccaaggacagttgttaga

SEQ ID NO: 305154 - DNA, 25 bp, Mus musculus
caccatacctggcaattgtttttgt

SEQ ID NO: 305155 - DNA, 25 bp, Mus musculus
caccatacctgggaattgtttttgt

SEQ ID NO: 305156 - DNA, 25 bp, Mus musculus
caccatacgatcctatccggatgga

SEQ ID NO: 305157 - DNA, 25 bp, Mus musculus
caccatacgatcgtatccggatgga

SEQ ID NO: 305158 - DNA, 25 bp, Mus musculus
caccatactctgcatatcttgaatt

SEQ ID NO: 305159 - DNA, 25 bp, Mus musculus
caccatactctggatatcttgaatt

SEQ ID NO: 305160 - DNA, 25 bp, Mus musculus
caccatacttacaatgtccagcagc

SEQ ID NO: 305161 - DNA, 25 bp, Mus musculus
caccatacttactatgtccagcagc

SEQ ID NO: 305162 - DNA, 25 bp, Mus musculus
caccatacttcaatccttgtgaaag

SEQ ID NO: 305163 - DNA, 25 bp, Mus musculus
caccatacttcattccttgtgaaag

SEQ ID NO: 305164 - DNA, 25 bp, Mus musculus
caccatagctaccagatgagatttt

SEQ ID NO: 305165 - DNA, 25 bp, Mus musculus
caccatagctacgagatgagatttt

SEQ ID NO: 305166 - DNA, 25 bp, Mus musculus
caccatagctcactattttcatcat

SEQ ID NO: 305167 - DNA, 25 bp, Mus musculus
caccatagctcagtattttcatcat

SEQ ID NO: 305168 - DNA, 25 bp, Mus musculus
caccatagctgcactaagggactgg

SEQ ID NO: 305169 - DNA, 25 bp, Mus musculus
caccatagctgctctaagggactgg

SEQ ID NO: 305170 - DNA, 25 bp, Mus musculus
caccataggtggaaaggatcatttt

SEQ ID NO: 305171 - DNA, 25 bp, Mus musculus
caccataggtggtaaggatcatttt

SEQ ID NO: 305172 - DNA, 25 bp, Mus musculus
caccatatagcgcattatactcatt

SEQ ID NO: 305173 - DNA, 25 bp, Mus musculus
caccatatagcggattatactcatt

SEQ ID NO: 305174 - DNA, 25 bp, Mus musculus
caccatatcgtacgctgggtctctg

SEQ ID NO: 305175 - DNA, 25 bp, Mus musculus
caccatatcgtaggctgggtctctg

SEQ ID NO: 305176 - DNA, 25 bp, Mus musculus
caccatatcttgatgagtttcagga

SEQ ID NO: 305177 - DNA, 25 bp, Mus musculus
caccatatcttgttgagtttcagga

SEQ ID NO: 305178 - DNA, 25 bp, Mus musculus
caccatatggttactcttacagcaa

SEQ ID NO: 305179 - DNA, 25 bp, Mus musculus
caccatatggtttctcttacagcaa

SEQ ID NO: 305180 - DNA, 25 bp, Mus musculus
caccatattatgcaaacactgtctt

SEQ ID NO: 305181 - DNA, 25 bp, Mus musculus
caccatattatggaaacactgtctt

SEQ ID NO: 305182 - DNA, 25 bp, Mus musculus
caccatattttgattgtacaccaat

SEQ ID NO: 305183 - DNA, 25 bp, Mus musculus
caccatattttgtttgtacaccaat

SEQ ID NO: 305184 - DNA, 25 bp, Mus musculus
caccatcaacttccaagtgttcatc

SEQ ID NO: 305185 - DNA, 25 bp, Mus musculus
caccatcaacttgcaagtgttcatc

SEQ ID NO: 305186 - DNA, 25 bp, Mus musculus
caccatcaagcccaatgtggatgac

SEQ ID NO: 305187 - DNA, 25 bp, Mus musculus
caccatcaagccgaatgtggatgac

SEQ ID NO: 305188 - DNA, 25 bp, Mus musculus
caccatcaagtcaacaaggcaagga

SEQ ID NO: 305189 - DNA, 25 bp, Mus musculus
caccatcaagtctacaaggcaagga

SEQ ID NO: 305190 - DNA, 25 bp, Mus musculus
caccatcacctgatttaaatgcagt

SEQ ID NO: 305191 - DNA, 25 bp, Mus musculus
caccatcacctgttttaaatgcagt

SEQ ID NO: 305192 - DNA, 25 bp, Mus musculus
caccatcagcagattcattccggaa

SEQ ID NO: 305193 - DNA, 25 bp, Mus musculus
caccatcagcagtttcattccggaa

SEQ ID NO: 305194 - DNA, 25 bp, Mus musculus
caccatcagtcgattcctctaaaga

SEQ ID NO: 305195 - DNA, 25 bp, Mus musculus
caccatcagtcgtttcctctaaaga

SEQ ID NO: 305196 - DNA, 25 bp, Mus musculus
caccatcatctaccagtactttgag

SEQ ID NO: 305197 - DNA, 25 bp, Mus musculus
caccatcatctagcagtactttgag

SEQ ID NO: 305198 - DNA, 25 bp, Mus musculus
caccatcatgttcgcctgcatttaa

SEQ ID NO: 305199 - DNA, 25 bp, Mus musculus
caccatcatgttggcctgcatttaa

SEQ ID NO: 305200 - DNA, 25 bp, Mus musculus
caccatccactccaaatgagaacaa

SEQ ID NO: 305201 - DNA, 25 bp, Mus musculus
caccatccactcgaaatgagaacaa

SEQ ID NO: 305202 - DNA, 25 bp, Mus musculus
caccatcccaggaactgtttatcat

SEQ ID NO: 305203 - DNA, 25 bp, Mus musculus
caccatcccaggtactgtttatcat

SEQ ID NO: 305204 - DNA, 25 bp, Mus musculus
caccatccctgacaatttgactttg

SEQ ID NO: 305205 - DNA, 25 bp, Mus musculus
caccatccctgagaatttgactttg

SEQ ID NO: 305206 - DNA, 25 bp, Mus musculus
caccatccggaactttttagtgatg

SEQ ID NO: 305207 - DNA, 25 bp, Mus musculus
caccatccggaagtttttagtgatg

SEQ ID NO: 305208 - DNA, 25 bp, Mus musculus
caccatccggctacatataatttct

SEQ ID NO: 305209 - DNA, 25 bp, Mus musculus
caccatccggcttcatataatttct

SEQ ID NO: 305210 - DNA, 25 bp, Mus musculus
caccatcctgttctgagtctgaaga

SEQ ID NO: 305211 - DNA, 25 bp, Mus musculus
caccatcctgttgtgagtctgaaga

SEQ ID NO: 305212 - DNA, 25 bp, Mus musculus
caccatcgggctcaggcagggctca

SEQ ID NO: 305213 - DNA, 25 bp, Mus musculus
caccatcgggctgaggcagggctca

SEQ ID NO: 305214 - DNA, 25 bp, Mus musculus
caccatcggtgtattcttgacagat

SEQ ID NO: 305215 - DNA, 25 bp, Mus musculus
caccatcggtgttttcttgacagat

SEQ ID NO: 305216 - DNA, 25 bp, Mus musculus
caccatcggttcacttggcagagaa

SEQ ID NO: 305217 - DNA, 25 bp, Mus musculus
caccatcggttctcttggcagagaa

SEQ ID NO: 305218 - DNA, 25 bp, Mus musculus
caccatcggttgatagttgccttga

SEQ ID NO: 305219 - DNA, 25 bp, Mus musculus
caccatcggttgttagttgccttga

SEQ ID NO: 305220 - DNA, 25 bp, Mus musculus
caccatctatccatcttgacgtagg

SEQ ID NO: 305221 - DNA, 25 bp, Mus musculus
caccatctatccttcttgacgtagg

SEQ ID NO: 305222 - DNA, 25 bp, Mus musculus
caccatctatttactgttttactcg

SEQ ID NO: 305223 - DNA, 25 bp, Mus musculus
caccatctattttctgttttactcg

SEQ ID NO: 305224 - DNA, 25 bp, Mus musculus
caccatctcattcctttaatctcag

SEQ ID NO: 305225 - DNA, 25 bp, Mus musculus
caccatctcattgctttaatctcag

SEQ ID NO: 305226 - DNA, 25 bp, Mus musculus
caccatctgaatcctacagcgggat

SEQ ID NO: 305227 - DNA, 25 bp, Mus musculus
caccatctgaatgctacagcgggat

SEQ ID NO: 305228 - DNA, 25 bp, Mus musculus
caccatctgctaattccatattcta

SEQ ID NO: 305229 - DNA, 25 bp, Mus musculus
caccatctgctatttccatattcta

SEQ ID NO: 305230 - DNA, 25 bp, Mus musculus
caccatctggaaataagtgacatgc

SEQ ID NO: 305231 - DNA, 25 bp, Mus musculus
caccatctggaattaagtgacatgc

SEQ ID NO: 305232 - DNA, 25 bp, Mus musculus
caccatctgtagaaggcatttccaa

SEQ ID NO: 305233 - DNA, 25 bp, Mus musculus
caccatctgtagtaggcatttccaa

SEQ ID NO: 305234 - DNA, 25 bp, Mus musculus
caccatctgtttatccatgttcaag

SEQ ID NO: 305235 - DNA, 25 bp, Mus musculus
caccatctgtttttccatgttcaag

SEQ ID NO: 305236 - DNA, 25 bp, Mus musculus
caccatcttccacgagcgagacccc

SEQ ID NO: 305237 - DNA, 25 bp, Mus musculus
caccatcttccaggagcgagacccc

SEQ ID NO: 305238 - DNA, 25 bp, Mus musculus
caccatcttggtcaacagcatgagg

SEQ ID NO: 305239 - DNA, 25 bp, Mus musculus
caccatcttggtgaacagcatgagg

SEQ ID NO: 305240 - DNA, 25 bp, Mus musculus
caccatcttttgaatgtgacatcta

SEQ ID NO: 305241 - DNA, 25 bp, Mus musculus
caccatcttttgtatgtgacatcta

SEQ ID NO: 305242 - DNA, 25 bp, Mus musculus
caccatgaaagtaggcctcgggtcc

SEQ ID NO: 305243 - DNA, 25 bp, Mus musculus
caccatgaaagttggcctcgggtcc

SEQ ID NO: 305244 - DNA, 25 bp, Mus musculus
caccatgaatgtacttcttgggaaa

SEQ ID NO: 305245 - DNA, 25 bp, Mus musculus
caccatgaatgttcttcttgggaaa

SEQ ID NO: 305246 - DNA, 25 bp, Mus musculus
caccatgacagaatccatccaggga

SEQ ID NO: 305247 - DNA, 25 bp, Mus musculus
caccatgacagattccatccaggga

SEQ ID NO: 305248 - DNA, 25 bp, Mus musculus
caccatgaccgaaaggtaacctagg

SEQ ID NO: 305249 - DNA, 25 bp, Mus musculus
caccatgaccgataggtaacctagg

SEQ ID NO: 305250 - DNA, 25 bp, Mus musculus
caccatgactatatgcctttacaca

SEQ ID NO: 305251 - DNA, 25 bp, Mus musculus
caccatgactatttgcctttacaca

SEQ ID NO: 305252 - DNA, 25 bp, Mus musculus
caccatgagaagcacctcggaggct

SEQ ID NO: 305253 - DNA, 25 bp, Mus musculus
caccatgagaaggacctcggaggct

SEQ ID NO: 305254 - DNA, 25 bp, Mus musculus
caccatgagagtcgtctgagcagag

SEQ ID NO: 305255 - DNA, 25 bp, Mus musculus
caccatgagagtggtctgagcagag

SEQ ID NO: 305256 - DNA, 25 bp, Mus musculus
caccatgatccccagacagtagaag

SEQ ID NO: 305257 - DNA, 25 bp, Mus musculus
caccatgatcccgagacagtagaag

SEQ ID NO: 305258 - DNA, 25 bp, Mus musculus
caccatgatcgtagatctctttcta

SEQ ID NO: 305259 - DNA, 25 bp, Mus musculus
caccatgatcgttgatctctttcta

SEQ ID NO: 305260 - DNA, 25 bp, Mus musculus
caccatgcacagctcagggctcaaa

SEQ ID NO: 305261 - DNA, 25 bp, Mus musculus
caccatgcacaggtcagggctcaaa

SEQ ID NO: 305262 - DNA, 25 bp, Mus musculus
caccatgcagtgagcccaaggctct

SEQ ID NO: 305263 - DNA, 25 bp, Mus musculus
caccatgcagtgtgcccaaggctct

SEQ ID NO: 305264 - DNA, 25 bp, Mus musculus
caccatgcatgtattaggccagtgg

SEQ ID NO: 305265 - DNA, 25 bp, Mus musculus
caccatgcatgttttaggccagtgg

SEQ ID NO: 305266 - DNA, 25 bp, Mus musculus
caccatgccagcctacatgttatgt

SEQ ID NO: 305267 - DNA, 25 bp, Mus musculus
caccatgccagcgtacatgttatgt

SEQ ID NO: 305268 - DNA, 25 bp, Mus musculus
caccatgccatacttctgatcgtat

SEQ ID NO: 305269 - DNA, 25 bp, Mus musculus
caccatgccatagttctgatcgtat

SEQ ID NO: 305270 - DNA, 25 bp, Mus musculus
caccatgcccatcgcgggtagaagg

SEQ ID NO: 305271 - DNA, 25 bp, Mus musculus
caccatgcccatggcgggtagaagg

SEQ ID NO: 305272 - DNA, 25 bp, Mus musculus
caccatgcccgacatgcagttggtg

SEQ ID NO: 305273 - DNA, 25 bp, Mus musculus
caccatgcccgagatgcagttggtg

SEQ ID NO: 305274 - DNA, 25 bp, Mus musculus
caccatgccgtgacatgtgtgcaaa

SEQ ID NO: 305275 - DNA, 25 bp, Mus musculus
caccatgccgtgtcatgtgtgcaaa

SEQ ID NO: 305276 - DNA, 25 bp, Mus musculus
caccatgcctaacttcagaacaatt

SEQ ID NO: 305277 - DNA, 25 bp, Mus musculus
caccatgcctaagttcagaacaatt

SEQ ID NO: 305278 - DNA, 25 bp, Mus musculus
caccatgcctatcttcatcgtgaac

SEQ ID NO: 305279 - DNA, 25 bp, Mus musculus
caccatgcctatgttcatcgtgaac

SEQ ID NO: 305280 - DNA, 25 bp, Mus musculus
caccatgcgagacatcgtgcacatt

SEQ ID NO: 305281 - DNA, 25 bp, Mus musculus
caccatgcgagagatcgtgcacatt

SEQ ID NO: 305282 - DNA, 25 bp, Mus musculus
caccatgctcagcttttgtttttaa

SEQ ID NO: 305283 - DNA, 25 bp, Mus musculus
caccatgctcaggttttgtttttaa

SEQ ID NO: 305284 - DNA, 25 bp, Mus musculus
caccatgctggccaactttgtgagg

SEQ ID NO: 305285 - DNA, 25 bp, Mus musculus
caccatgctggcgaactttgtgagg

SEQ ID NO: 305286 - DNA, 25 bp, Mus musculus
caccatgcttggctttctccaaaat

SEQ ID NO: 305287 - DNA, 25 bp, Mus musculus
caccatgcttgggtttctccaaaat

SEQ ID NO: 305288 - DNA, 25 bp, Mus musculus
caccatggcccacagtattgaaaga

SEQ ID NO: 305289 - DNA, 25 bp, Mus musculus
caccatggcccagagtattgaaaga

SEQ ID NO: 305290 - DNA, 25 bp, Mus musculus
caccatggcctgaatgttgttatta

SEQ ID NO: 305291 - DNA, 25 bp, Mus musculus
caccatggcctgtatgttgttatta

SEQ ID NO: 305292 - DNA, 25 bp, Mus musculus
caccatggctcccttgagcaaatgg

SEQ ID NO: 305293 - DNA, 25 bp, Mus musculus
caccatggctccgttgagcaaatgg

SEQ ID NO: 305294 - DNA, 25 bp, Mus musculus
caccatggcttcactgcttgatcga

SEQ ID NO: 305295 - DNA, 25 bp, Mus musculus
caccatggcttctctgcttgatcga

SEQ ID NO: 305296 - DNA, 25 bp, Mus musculus
caccatgggtatatccatcctcaat

SEQ ID NO: 305297 - DNA, 25 bp, Mus musculus
caccatgggtatttccatcctcaat

SEQ ID NO: 305298 - DNA, 25 bp, Mus musculus
caccatgggtcacaagaggttccaa

SEQ ID NO: 305299 - DNA, 25 bp, Mus musculus
caccatgggtcagaagaggttccaa

SEQ ID NO: 305300 - DNA, 25 bp, Mus musculus
caccatgggtggcattgccgccaga

SEQ ID NO: 305301 - DNA, 25 bp, Mus musculus
caccatgggtgggattgccgccaga

SEQ ID NO: 305302 - DNA, 25 bp, Mus musculus
caccatggtagacaagctgctgagc

SEQ ID NO: 305303 - DNA, 25 bp, Mus musculus
caccatggtagagaagctgctgagc

SEQ ID NO: 305304 - DNA, 25 bp, Mus musculus
caccatgtccagaattttacccaga

SEQ ID NO: 305305 - DNA, 25 bp, Mus musculus
caccatgtccagcatgttccattaa

SEQ ID NO: 305306 - DNA, 25 bp, Mus musculus
caccatgtccaggatgttccattaa

SEQ ID NO: 305307 - DNA, 25 bp, Mus musculus
caccatgtccagtattttacccaga

SEQ ID NO: 305308 - DNA, 25 bp, Mus musculus
caccatgtccccaaggagagtgact

SEQ ID NO: 305309 - DNA, 25 bp, Mus musculus
caccatgtccccaataaacacaggt

SEQ ID NO: 305310 - DNA, 25 bp, Mus musculus
caccatgtcccctaggagagtgact

SEQ ID NO: 305311 - DNA, 25 bp, Mus musculus
caccatgtcccctataaacacaggt

SEQ ID NO: 305312 - DNA, 25 bp, Mus musculus
caccatgtcgctaggattgaggctg

SEQ ID NO: 305313 - DNA, 25 bp, Mus musculus
caccatgtcgcttggattgaggctg

SEQ ID NO: 305314 - DNA, 25 bp, Mus musculus
caccatgtgattcctccagaggacc

SEQ ID NO: 305315 - DNA, 25 bp, Mus musculus
caccatgtgattgctccagaggacc

SEQ ID NO: 305316 - DNA, 25 bp, Mus musculus
caccatgtgggcactagaggttgaa

SEQ ID NO: 305317 - DNA, 25 bp, Mus musculus
caccatgtgggctctagaggttgaa

SEQ ID NO: 305318 - DNA, 25 bp, Mus musculus
caccatgtgggtacaaagcctgtgg

SEQ ID NO: 305319 - DNA, 25 bp, Mus musculus
caccatgtgggttcaaagcctgtgg

SEQ ID NO: 305320 - DNA, 25 bp, Mus musculus
caccatgttcccaacaatatgtttt

SEQ ID NO: 305321 - DNA, 25 bp, Mus musculus
caccatgttccctacaatatgtttt

SEQ ID NO: 305322 - DNA, 25 bp, Mus musculus
caccatgttggccacagctgataag

SEQ ID NO: 305323 - DNA, 25 bp, Mus musculus
caccatgttggcgacagctgataag

SEQ ID NO: 305324 - DNA, 25 bp, Mus musculus
caccatgtttctctcaagtttaaaa

SEQ ID NO: 305325 - DNA, 25 bp, Mus musculus
caccatgtttctgtcaagtttaaaa

SEQ ID NO: 305326 - DNA, 25 bp, Mus musculus
caccattaatatagtctcgggcatc

SEQ ID NO: 305327 - DNA, 25 bp, Mus musculus
caccattaatattgtctcgggcatc

SEQ ID NO: 305328 - DNA, 25 bp, Mus musculus
caccattacaaacgtccctttcagg

SEQ ID NO: 305329 - DNA, 25 bp, Mus musculus
caccattacaaaggtccctttcagg

SEQ ID NO: 305330 - DNA, 25 bp, Mus musculus
caccattacaatcctaactctttac

SEQ ID NO: 305331 - DNA, 25 bp, Mus musculus
caccattacaatgctaactctttac

SEQ ID NO: 305332 - DNA, 25 bp, Mus musculus
caccattagggtctattttgtcaat

SEQ ID NO: 305333 - DNA, 25 bp, Mus musculus
caccattagggtgtattttgtcaat

SEQ ID NO: 305334 - DNA, 25 bp, Mus musculus
caccattcaatgagatcctggatat

SEQ ID NO: 305335 - DNA, 25 bp, Mus musculus
caccattcaatgtgatcctggatat

SEQ ID NO: 305336 - DNA, 25 bp, Mus musculus
caccattcagtgaacccagaagtat

SEQ ID NO: 305337 - DNA, 25 bp, Mus musculus
caccattcagtgtacccagaagtat

SEQ ID NO: 305338 - DNA, 25 bp, Mus musculus
caccattccaccaagcttcttttta

SEQ ID NO: 305339 - DNA, 25 bp, Mus musculus
caccattccacctagcttcttttta

SEQ ID NO: 305340 - DNA, 25 bp, Mus musculus
caccattcctgactcttcgaagtga

SEQ ID NO: 305341 - DNA, 25 bp, Mus musculus
caccattcctgagtcttcgaagtga

SEQ ID NO: 305342 - DNA, 25 bp, Mus musculus
caccattcgcctacttagagtttta

SEQ ID NO: 305343 - DNA, 25 bp, Mus musculus
caccattcgccttcttagagtttta

SEQ ID NO: 305344 - DNA, 25 bp, Mus musculus
caccattctatgcaacaggtttgag

SEQ ID NO: 305345 - DNA, 25 bp, Mus musculus
caccattctatggaacaggtttgag

SEQ ID NO: 305346 - DNA, 25 bp, Mus musculus
caccattctcaaaatccagatttct

SEQ ID NO: 305347 - DNA, 25 bp, Mus musculus
caccattctcaatatccagatttct

SEQ ID NO: 305348 - DNA, 25 bp, Mus musculus
caccattctttcattgtacttacga

SEQ ID NO: 305349 - DNA, 25 bp, Mus musculus
caccattctttctttgtacttacga

SEQ ID NO: 305350 - DNA, 25 bp, Mus musculus
caccattgaatgattgtttcatgag

SEQ ID NO: 305351 - DNA, 25 bp, Mus musculus
caccattgaatgtttgtttcatgag

SEQ ID NO: 305352 - DNA, 25 bp, Mus musculus
caccattgacggcatgacaagtctt

SEQ ID NO: 305353 - DNA, 25 bp, Mus musculus
caccattgacgggatgacaagtctt

SEQ ID NO: 305354 - DNA, 25 bp, Mus musculus
caccattgcagaagcctaagacaac

SEQ ID NO: 305355 - DNA, 25 bp, Mus musculus
caccattgcagatgcctaagacaac

SEQ ID NO: 305356 - DNA, 25 bp, Mus musculus
caccattgccccaggagttgttatg

SEQ ID NO: 305357 - DNA, 25 bp, Mus musculus
caccattgcccctggagttgttatg

SEQ ID NO: 305358 - DNA, 25 bp, Mus musculus
caccattggtttaccatctcctatt

SEQ ID NO: 305359 - DNA, 25 bp, Mus musculus
caccattggtttccttgcttcttga

SEQ ID NO: 305360 - DNA, 25 bp, Mus musculus
caccattggtttgcttgcttcttga

SEQ ID NO: 305361 - DNA, 25 bp, Mus musculus
caccattggttttccatctcctatt

SEQ ID NO: 305362 - DNA, 25 bp, Mus musculus
caccattgtcctctgtgctataaca

SEQ ID NO: 305363 - DNA, 25 bp, Mus musculus
caccattgtcctgtgtgctataaca

SEQ ID NO: 305364 - DNA, 25 bp, Mus musculus
caccatttatttattcactcacctg

SEQ ID NO: 305365 - DNA, 25 bp, Mus musculus
caccatttattttttcactcacctg

SEQ ID NO: 305366 - DNA, 25 bp, Mus musculus
caccatttgctgaccagttacacag

SEQ ID NO: 305367 - DNA, 25 bp, Mus musculus
caccatttgctgtccagttacacag

SEQ ID NO: 305368 - DNA, 25 bp, Mus musculus
caccattttgataggagtcgccatt

SEQ ID NO: 305369 - DNA, 25 bp, Mus musculus
caccattttgattggagtcgccatt

SEQ ID NO: 305370 - DNA, 25 bp, Mus musculus
cacccaacattcatgtgggctctgg

SEQ ID NO: 305371 - DNA, 25 bp, Mus musculus
cacccaacattcttgtgggctctgg

SEQ ID NO: 305372 - DNA, 25 bp, Mus musculus
cacccaactctgaaacggacatttt

SEQ ID NO: 305373 - DNA, 25 bp, Mus musculus
cacccaactctgtaacggacatttt

SEQ ID NO: 305374 - DNA, 25 bp, Mus musculus
cacccaactgtccagaaatgtccta

SEQ ID NO: 305375 - DNA, 25 bp, Mus musculus
cacccaactgtcctgatgaggttta

SEQ ID NO: 305376 - DNA, 25 bp, Mus musculus
cacccaactgtcgagaaatgtccta

SEQ ID NO: 305377 - DNA, 25 bp, Mus musculus
cacccaactgtcgtgatgaggttta

SEQ ID NO: 305378 - DNA, 25 bp, Mus musculus
cacccaagaaagcacccaagaagat

SEQ ID NO: 305379 - DNA, 25 bp, Mus musculus
cacccaagaaaggacccaagaagat

SEQ ID NO: 305380 - DNA, 25 bp, Mus musculus
cacccaagactcctgcaatgcaaaa

SEQ ID NO: 305381 - DNA, 25 bp, Mus musculus
cacccaagactcgtgcaatgcaaaa

SEQ ID NO: 305382 - DNA, 25 bp, Mus musculus
cacccaagattgagcagggctacaa

SEQ ID NO: 305383 - DNA, 25 bp, Mus musculus
cacccaagattgtgcagggctacaa

SEQ ID NO: 305384 - DNA, 25 bp, Mus musculus
cacccaagggatcgtttcagggact

SEQ ID NO: 305385 - DNA, 25 bp, Mus musculus
cacccaagggatggtttcagggact

SEQ ID NO: 305386 - DNA, 25 bp, Mus musculus
cacccaattgccatgttcaggtggt

SEQ ID NO: 305387 - DNA, 25 bp, Mus musculus
cacccaattgccttgttcaggtggt

SEQ ID NO: 305388 - DNA, 25 bp, Mus musculus
cacccacacagacggtctgctgata

SEQ ID NO: 305389 - DNA, 25 bp, Mus musculus
cacccacacagagggtctgctgata

SEQ ID NO: 305390 - DNA, 25 bp, Mus musculus
cacccacacctcctatgtgaagaga

SEQ ID NO: 305391 - DNA, 25 bp, Mus musculus
cacccacacctcgtatgtgaagaga

SEQ ID NO: 305392 - DNA, 25 bp, Mus musculus
cacccacacgaaatggagcctgaga

SEQ ID NO: 305393 - DNA, 25 bp, Mus musculus
cacccacacgaattggagcctgaga

SEQ ID NO: 305394 - DNA, 25 bp, Mus musculus
cacccacacggccttgagtaaataa

SEQ ID NO: 305395 - DNA, 25 bp, Mus musculus
cacccacacggcgttgagtaaataa

SEQ ID NO: 305396 - DNA, 25 bp, Mus musculus
cacccacagatcaatttcttcttga

SEQ ID NO: 305397 - DNA, 25 bp, Mus musculus
cacccacagatctatttcttcttga

SEQ ID NO: 305398 - DNA, 25 bp, Mus musculus
cacccacagattaggttcggtttgg

SEQ ID NO: 305399 - DNA, 25 bp, Mus musculus
cacccacagatttggttcggtttgg

SEQ ID NO: 305400 - DNA, 25 bp, Mus musculus
cacccacatagtacagctacaactg

SEQ ID NO: 305401 - DNA, 25 bp, Mus musculus
cacccacatagttcagctacaactg

SEQ ID NO: 305402 - DNA, 25 bp, Mus musculus
cacccacatcagagtagcctatgta

SEQ ID NO: 305403 - DNA, 25 bp, Mus musculus
cacccacatcagtgtagcctatgta

SEQ ID NO: 305404 - DNA, 25 bp, Mus musculus
cacccacatcatagagattctcatt

SEQ ID NO: 305405 - DNA, 25 bp, Mus musculus
cacccacatcattgagattctcatt

SEQ ID NO: 305406 - DNA, 25 bp, Mus musculus
cacccaccaaggaattgcagacggt

SEQ ID NO: 305407 - DNA, 25 bp, Mus musculus
cacccaccaaggtattgcagacggt

SEQ ID NO: 305408 - DNA, 25 bp, Mus musculus
cacccaccacgtcatgagttcaagg

SEQ ID NO: 305409 - DNA, 25 bp, Mus musculus
cacccaccacgtgatgagttcaagg

SEQ ID NO: 305410 - DNA, 25 bp, Mus musculus
cacccaccactaagactgatactga

SEQ ID NO: 305411 - DNA, 25 bp, Mus musculus
cacccaccactatgactgatactga

SEQ ID NO: 305412 - DNA, 25 bp, Mus musculus
cacccaccagagaccccccttcaga

SEQ ID NO: 305413 - DNA, 25 bp, Mus musculus
cacccaccagagtccccccttcaga

SEQ ID NO: 305414 - DNA, 25 bp, Mus musculus
cacccaccagttaaggccattgtaa

SEQ ID NO: 305415 - DNA, 25 bp, Mus musculus
cacccaccagtttaggccattgtaa

SEQ ID NO: 305416 - DNA, 25 bp, Mus musculus
cacccaccatgcagtgcaggaagaa

SEQ ID NO: 305417 - DNA, 25 bp, Mus musculus
cacccaccatgctgtgcaggaagaa

SEQ ID NO: 305418 - DNA, 25 bp, Mus musculus
cacccacccgttatcaatttatgtt

SEQ ID NO: 305419 - DNA, 25 bp, Mus musculus
cacccacccgttttcaatttatgtt

SEQ ID NO: 305420 - DNA, 25 bp, Mus musculus
cacccaccctctatgtttttgtaga

SEQ ID NO: 305421 - DNA, 25 bp, Mus musculus
cacccaccctctttgtttttgtaga

SEQ ID NO: 305422 - DNA, 25 bp, Mus musculus
cacccacctgaccaagtaccctatt

SEQ ID NO: 305423 - DNA, 25 bp, Mus musculus
cacccacctgacgaagtaccctatt

SEQ ID NO: 305424 - DNA, 25 bp, Mus musculus
cacccacgcatcactagttggtttg

SEQ ID NO: 305425 - DNA, 25 bp, Mus musculus
cacccacgcatctctagttggtttg

SEQ ID NO: 305426 - DNA, 25 bp, Mus musculus
cacccacgcggactgcagtgtgaca

SEQ ID NO: 305427 - DNA, 25 bp, Mus musculus
cacccacgcggagtgcagtgtgaca

SEQ ID NO: 305428 - DNA, 25 bp, Mus musculus
cacccacgggtacatttgaggccag

SEQ ID NO: 305429 - DNA, 25 bp, Mus musculus
cacccacgggtagatttgaggccag

SEQ ID NO: 305430 - DNA, 25 bp, Mus musculus
cacccactatgaccgtttgaacttt

SEQ ID NO: 305431 - DNA, 25 bp, Mus musculus
cacccactatgagcgtttgaacttt

SEQ ID NO: 305432 - DNA, 25 bp, Mus musculus
cacccactatggaggaaatactaaa

SEQ ID NO: 305433 - DNA, 25 bp, Mus musculus
cacccactatggtggaaatactaaa

SEQ ID NO: 305434 - DNA, 25 bp, Mus musculus
cacccactcatgactctaagtttgt

SEQ ID NO: 305435 - DNA, 25 bp, Mus musculus
cacccactcatgtctctaagtttgt

SEQ ID NO: 305436 - DNA, 25 bp, Mus musculus
cacccactgctgaggatttgaacgt

SEQ ID NO: 305437 - DNA, 25 bp, Mus musculus
cacccactgctgtggatttgaacgt

SEQ ID NO: 305438 - DNA, 25 bp, Mus musculus
cacccactgggtcgttcaggagaga

SEQ ID NO: 305439 - DNA, 25 bp, Mus musculus
cacccactgggtggttcaggagaga

SEQ ID NO: 305440 - DNA, 25 bp, Mus musculus
cacccactggtgacctatgaagaac

SEQ ID NO: 305441 - DNA, 25 bp, Mus musculus
cacccactggtgtcctatgaagaac

SEQ ID NO: 305442 - DNA, 25 bp, Mus musculus
cacccactgttcctgataatcttga

SEQ ID NO: 305443 - DNA, 25 bp, Mus musculus
cacccactgttcgtgataatcttga

SEQ ID NO: 305444 - DNA, 25 bp, Mus musculus
cacccacttagtatgcaactcaaca

SEQ ID NO: 305445 - DNA, 25 bp, Mus musculus
cacccacttagtttgcaactcaaca

SEQ ID NO: 305446 - DNA, 25 bp, Mus musculus
cacccactttctagactatactact

SEQ ID NO: 305447 - DNA, 25 bp, Mus musculus
cacccactttcttgactatactact

SEQ ID NO: 305448 - DNA, 25 bp, Mus musculus
cacccacttttgctgtgtcagaaaa

SEQ ID NO: 305449 - DNA, 25 bp, Mus musculus
cacccacttttggtgtgtcagaaaa

SEQ ID NO: 305450 - DNA, 25 bp, Mus musculus
cacccagaagtacgtgggacctctt

SEQ ID NO: 305451 - DNA, 25 bp, Mus musculus
cacccagaagtaggtgggacctctt

SEQ ID NO: 305452 - DNA, 25 bp, Mus musculus
cacccagagctgaaggaccctttgg

SEQ ID NO: 305453 - DNA, 25 bp, Mus musculus
cacccagagctgactcggaggagga

SEQ ID NO: 305454 - DNA, 25 bp, Mus musculus
cacccagagctgtaggaccctttgg

SEQ ID NO: 305455 - DNA, 25 bp, Mus musculus
cacccagagctgtctcggaggagga

SEQ ID NO: 305456 - DNA, 25 bp, Mus musculus
cacccagagcttatctttgcaggag

SEQ ID NO: 305457 - DNA, 25 bp, Mus musculus
cacccagagcttttctttgcaggag

SEQ ID NO: 305458 - DNA, 25 bp, Mus musculus
cacccagagggacatccttgttttc

SEQ ID NO: 305459 - DNA, 25 bp, Mus musculus
cacccagagggagatccttgttttc

SEQ ID NO: 305460 - DNA, 25 bp, Mus musculus
cacccagagtggcattggcatgtgt

SEQ ID NO: 305461 - DNA, 25 bp, Mus musculus
cacccagagtgggattggcatgtgt

SEQ ID NO: 305462 - DNA, 25 bp, Mus musculus
cacccagatcgaccctgtgtgatgg

SEQ ID NO: 305463 - DNA, 25 bp, Mus musculus
cacccagatcgagcctgtgtgatgg

SEQ ID NO: 305464 - DNA, 25 bp, Mus musculus
cacccagatgctccacttttgggtt

SEQ ID NO: 305465 - DNA, 25 bp, Mus musculus
cacccagatgctgcacttttgggtt

SEQ ID NO: 305466 - DNA, 25 bp, Mus musculus
cacccagcaagacggagtgctgctt

SEQ ID NO: 305467 - DNA, 25 bp, Mus musculus
cacccagcaagagggagtgctgctt

SEQ ID NO: 305468 - DNA, 25 bp, Mus musculus
cacccagcacaaattgcagagatga

SEQ ID NO: 305469 - DNA, 25 bp, Mus musculus
cacccagcacaatttgcagagatga

SEQ ID NO: 305470 - DNA, 25 bp, Mus musculus
cacccagcagctcttgaaatgcata

SEQ ID NO: 305471 - DNA, 25 bp, Mus musculus
cacccagcagctgttgaaatgcata

SEQ ID NO: 305472 - DNA, 25 bp, Mus musculus
cacccagcaggtctgacaaattcca

SEQ ID NO: 305473 - DNA, 25 bp, Mus musculus
cacccagcaggtgtgacaaattcca

SEQ ID NO: 305474 - DNA, 25 bp, Mus musculus
cacccagctattattcattcccagg

SEQ ID NO: 305475 - DNA, 25 bp, Mus musculus
cacccagctatttttcattcccagg

SEQ ID NO: 305476 - DNA, 25 bp, Mus musculus
cacccaggagcgcaggatgcctcag

SEQ ID NO: 305477 - DNA, 25 bp, Mus musculus
cacccaggagcggaggatgcctcag

SEQ ID NO: 305478 - DNA, 25 bp, Mus musculus
cacccaggattcatctattggtctt

SEQ ID NO: 305479 - DNA, 25 bp, Mus musculus
cacccaggattcttctattggtctt

SEQ ID NO: 305480 - DNA, 25 bp, Mus musculus
cacccaggcttacttaggcatgaaa

SEQ ID NO: 305481 - DNA, 25 bp, Mus musculus
cacccaggcttagttaggcatgaaa

SEQ ID NO: 305482 - DNA, 25 bp, Mus musculus
cacccagggtgacagcgttagtact

SEQ ID NO: 305483 - DNA, 25 bp, Mus musculus
cacccagggtgagagcgttagtact

SEQ ID NO: 305484 - DNA, 25 bp, Mus musculus
cacccagggtgcagatagcaaattt

SEQ ID NO: 305485 - DNA, 25 bp, Mus musculus
cacccagggtgctgatagcaaattt

SEQ ID NO: 305486 - DNA, 25 bp, Mus musculus
cacccagtacctacttctttgtata

SEQ ID NO: 305487 - DNA, 25 bp, Mus musculus
cacccagtaccttcttctttgtata

SEQ ID NO: 305488 - DNA, 25 bp, Mus musculus
cacccagtccatcatgtgtgttaat

SEQ ID NO: 305489 - DNA, 25 bp, Mus musculus
cacccagtccatgatgtgtgttaat

SEQ ID NO: 305490 - DNA, 25 bp, Mus musculus
cacccagtggacctgacttaatcag

SEQ ID NO: 305491 - DNA, 25 bp, Mus musculus
cacccagtggacgtgacttaatcag

SEQ ID NO: 305492 - DNA, 25 bp, Mus musculus
cacccatatctcatcgagttacttc

SEQ ID NO: 305493 - DNA, 25 bp, Mus musculus
cacccatatctcttcgagttacttc

SEQ ID NO: 305494 - DNA, 25 bp, Mus musculus
cacccatatggtcatgattcaggac

SEQ ID NO: 305495 - DNA, 25 bp, Mus musculus
cacccatatggtgatgattcaggac

SEQ ID NO: 305496 - DNA, 25 bp, Mus musculus
cacccatcatacatactttggctgt

SEQ ID NO: 305497 - DNA, 25 bp, Mus musculus
cacccatcatacttactttggctgt

SEQ ID NO: 305498 - DNA, 25 bp, Mus musculus
cacccatcattgctgagttcttgat

SEQ ID NO: 305499 - DNA, 25 bp, Mus musculus
cacccatcattggtgagttcttgat

SEQ ID NO: 305500 - DNA, 25 bp, Mus musculus
cacccatccaagatgttaatcctct

SEQ ID NO: 305501 - DNA, 25 bp, Mus musculus
cacccatccaagttgttaatcctct

SEQ ID NO: 305502 - DNA, 25 bp, Mus musculus
cacccatcgctgacatctatgaaca

SEQ ID NO: 305503 - DNA, 25 bp, Mus musculus
cacccatcgctgtcatctatgaaca

SEQ ID NO: 305504 - DNA, 25 bp, Mus musculus
cacccatctaagctaatcccataat

SEQ ID NO: 305505 - DNA, 25 bp, Mus musculus
cacccatctaaggtaatcccataat

SEQ ID NO: 305506 - DNA, 25 bp, Mus musculus
cacccatggagaaggctttgagcat

SEQ ID NO: 305507 - DNA, 25 bp, Mus musculus
cacccatggagatggctttgagcat

SEQ ID NO: 305508 - DNA, 25 bp, Mus musculus
cacccatggatgcatagtgagactc

SEQ ID NO: 305509 - DNA, 25 bp, Mus musculus
cacccatggatggatagtgagactc

SEQ ID NO: 305510 - DNA, 25 bp, Mus musculus
cacccatggtcaataccacttttta

SEQ ID NO: 305511 - DNA, 25 bp, Mus musculus
cacccatggtcattaccacttttta

SEQ ID NO: 305512 - DNA, 25 bp, Mus musculus
cacccatgtaccaggctacagtata

SEQ ID NO: 305513 - DNA, 25 bp, Mus musculus
cacccatgtacctggctacagtata

SEQ ID NO: 305514 - DNA, 25 bp, Mus musculus
cacccatgtcttcttccaagtaaga

SEQ ID NO: 305515 - DNA, 25 bp, Mus musculus
cacccatgtcttgttccaagtaaga

SEQ ID NO: 305516 - DNA, 25 bp, Mus musculus
cacccatgtgtgcaacagctttttt

SEQ ID NO: 305517 - DNA, 25 bp, Mus musculus
cacccatgtgtggaacagctttttt

SEQ ID NO: 305518 - DNA, 25 bp, Mus musculus
cacccattcctaaaattgtatgaga

SEQ ID NO: 305519 - DNA, 25 bp, Mus musculus
cacccattcctataattgtatgaga

SEQ ID NO: 305520 - DNA, 25 bp, Mus musculus
cacccattgataagaagggcaactt

SEQ ID NO: 305521 - DNA, 25 bp, Mus musculus
cacccattgatatgaagggcaactt

SEQ ID NO: 305522 - DNA, 25 bp, Mus musculus
cacccatttagactagtttaagtat

SEQ ID NO: 305523 - DNA, 25 bp, Mus musculus
cacccatttagagtagtttaagtat

SEQ ID NO: 305524 - DNA, 25 bp, Mus musculus
cacccattttcacacgtgtctaaaa

SEQ ID NO: 305525 - DNA, 25 bp, Mus musculus
cacccattttcagacgtgtctaaaa

SEQ ID NO: 305526 - DNA, 25 bp, Mus musculus
cacccattttccactaagttcaagg

SEQ ID NO: 305527 - DNA, 25 bp, Mus musculus
cacccattttcctctaagttcaagg

SEQ ID NO: 305528 - DNA, 25 bp, Mus musculus
caccccaaatctatcggacacaatg

SEQ ID NO: 305529 - DNA, 25 bp, Mus musculus
caccccaaatctttcggacacaatg

SEQ ID NO: 305530 - DNA, 25 bp, Mus musculus
caccccaaatgcagcaggtcatgta

SEQ ID NO: 305531 - DNA, 25 bp, Mus musculus
caccccaaatgctgcaggtcatgta

SEQ ID NO: 305532 - DNA, 25 bp, Mus musculus
caccccaaggagaagagtcctcaga

SEQ ID NO: 305533 - DNA, 25 bp, Mus musculus
caccccaaggagtagagtcctcaga

SEQ ID NO: 305534 - DNA, 25 bp, Mus musculus
caccccaatcccagtaaatagagtc

SEQ ID NO: 305535 - DNA, 25 bp, Mus musculus
caccccaatccctgtaaatagagtc

SEQ ID NO: 305536 - DNA, 25 bp, Mus musculus
caccccaatgaaagtagcctcttaa

SEQ ID NO: 305537 - DNA, 25 bp, Mus musculus
caccccaatgaatgtagcctcttaa

SEQ ID NO: 305538 - DNA, 25 bp, Mus musculus
caccccacagtaacctgagatctaa

SEQ ID NO: 305539 - DNA, 25 bp, Mus musculus
caccccacagtatcctgagatctaa

SEQ ID NO: 305540 - DNA, 25 bp, Mus musculus
caccccacccagattatgtgaggaa

SEQ ID NO: 305541 - DNA, 25 bp, Mus musculus
caccccacccagtttatgtgaggaa

SEQ ID NO: 305542 - DNA, 25 bp, Mus musculus
caccccacccatatgcatttaaaaa

SEQ ID NO: 305543 - DNA, 25 bp, Mus musculus
caccccacccatttgcatttaaaaa

SEQ ID NO: 305544 - DNA, 25 bp, Mus musculus
caccccaccttgatcagagtattgt

SEQ ID NO: 305545 - DNA, 25 bp, Mus musculus
caccccaccttgttcagagtattgt

SEQ ID NO: 305546 - DNA, 25 bp, Mus musculus
caccccacgttaacactgtgtgata

SEQ ID NO: 305547 - DNA, 25 bp, Mus musculus
caccccacgttatcactgtgtgata

SEQ ID NO: 305548 - DNA, 25 bp, Mus musculus
caccccactgaacgatattaagagg

SEQ ID NO: 305549 - DNA, 25 bp, Mus musculus
caccccactgaaggatattaagagg

SEQ ID NO: 305550 - DNA, 25 bp, Mus musculus
caccccagagtcctgaagtatattt

SEQ ID NO: 305551 - DNA, 25 bp, Mus musculus
caccccagagtcgtgaagtatattt

SEQ ID NO: 305552 - DNA, 25 bp, Mus musculus
caccccagcgttactacctttgtgt

SEQ ID NO: 305553 - DNA, 25 bp, Mus musculus
caccccagcgtttctacctttgtgt

SEQ ID NO: 305554 - DNA, 25 bp, Mus musculus
caccccaggactctaaattattggg

SEQ ID NO: 305555 - DNA, 25 bp, Mus musculus
caccccaggactgtaaattattggg

SEQ ID NO: 305556 - DNA, 25 bp, Mus musculus
caccccagggacagaagatctttta

SEQ ID NO: 305557 - DNA, 25 bp, Mus musculus
caccccagggactgaagatctttta

SEQ ID NO: 305558 - DNA, 25 bp, Mus musculus
caccccagggtacgcttatactcaa

SEQ ID NO: 305559 - DNA, 25 bp, Mus musculus
caccccagggtaggcttatactcaa

SEQ ID NO: 305560 - DNA, 25 bp, Mus musculus
caccccagtgtcacaatatcttaac

SEQ ID NO: 305561 - DNA, 25 bp, Mus musculus
caccccagtgtctcaatatcttaac

SEQ ID NO: 305562 - DNA, 25 bp, Mus musculus
caccccatagtgcattgcttgttga

SEQ ID NO: 305563 - DNA, 25 bp, Mus musculus
caccccatagtggattgcttgttga

SEQ ID NO: 305564 - DNA, 25 bp, Mus musculus
caccccatcataatcgtgggcgacg

SEQ ID NO: 305565 - DNA, 25 bp, Mus musculus
caccccatcatattcgtgggcgacg

SEQ ID NO: 305566 - DNA, 25 bp, Mus musculus
caccccatcgtaactaacagtatct

SEQ ID NO: 305567 - DNA, 25 bp, Mus musculus
caccccatcgtatctaacagtatct

SEQ ID NO: 305568 - DNA, 25 bp, Mus musculus
caccccatcgtgcaggacaaatgtt

SEQ ID NO: 305569 - DNA, 25 bp, Mus musculus
caccccatcgtggaggacaaatgtt

SEQ ID NO: 305570 - DNA, 25 bp, Mus musculus
caccccatctcaagttatacagatc

SEQ ID NO: 305571 - DNA, 25 bp, Mus musculus
caccccatctcatgttatacagatc

SEQ ID NO: 305572 - DNA, 25 bp, Mus musculus
cacccccgtctgacatatgtagcag

SEQ ID NO: 305573 - DNA, 25 bp, Mus musculus
cacccccgtctgtcatatgtagcag

SEQ ID NO: 305574 - DNA, 25 bp, Mus musculus
caccccctgttgagggagaagctct

SEQ ID NO: 305575 - DNA, 25 bp, Mus musculus
caccccctgttgtgggagaagctct

SEQ ID NO: 305576 - DNA, 25 bp, Mus musculus
caccccgactctatagacttaattg

SEQ ID NO: 305577 - DNA, 25 bp, Mus musculus
caccccgactctttagacttaattg

SEQ ID NO: 305578 - DNA, 25 bp, Mus musculus
caccccgagaccattttgacatgaa

SEQ ID NO: 305579 - DNA, 25 bp, Mus musculus
caccccgagacctttttgacatgaa

SEQ ID NO: 305580 - DNA, 25 bp, Mus musculus
caccccgcaagccttagaagaggcg

SEQ ID NO: 305581 - DNA, 25 bp, Mus musculus
caccccgcaagcgttagaagaggcg

SEQ ID NO: 305582 - DNA, 25 bp, Mus musculus
caccccgcccaacatagatttttgt

SEQ ID NO: 305583 - DNA, 25 bp, Mus musculus
caccccgcccaagatagatttttgt

SEQ ID NO: 305584 - DNA, 25 bp, Mus musculus
caccccgctaataaattcttgtgga

SEQ ID NO: 305585 - DNA, 25 bp, Mus musculus
caccccgctaattaattcttgtgga

SEQ ID NO: 305586 - DNA, 25 bp, Mus musculus
caccccgctgggatcgtcgatgcgg

SEQ ID NO: 305587 - DNA, 25 bp, Mus musculus
caccccgctgggttcgtcgatgcgg

SEQ ID NO: 305588 - DNA, 25 bp, Mus musculus
caccccgggtgtaagaatgttatag

SEQ ID NO: 305589 - DNA, 25 bp, Mus musculus
caccccgggtgttagaatgttatag

SEQ ID NO: 305590 - DNA, 25 bp, Mus musculus
caccccgtcactatgtatccaataa

SEQ ID NO: 305591 - DNA, 25 bp, Mus musculus
caccccgtcactttgtatccaataa

SEQ ID NO: 305592 - DNA, 25 bp, Mus musculus
caccccgtgaacctgcaatggagaa

SEQ ID NO: 305593 - DNA, 25 bp, Mus musculus
caccccgtgaacgtgcaatggagaa

SEQ ID NO: 305594 - DNA, 25 bp, Mus musculus
caccccgtgggaaatagcagctttt

SEQ ID NO: 305595 - DNA, 25 bp, Mus musculus
caccccgtgggatatagcagctttt

SEQ ID NO: 305596 - DNA, 25 bp, Mus musculus
caccccgttataaacactcagcaag

SEQ ID NO: 305597 - DNA, 25 bp, Mus musculus
caccccgttatatacactcagcaag

SEQ ID NO: 305598 - DNA, 25 bp, Mus musculus
cacccctaaatgcactggactatat

SEQ ID NO: 305599 - DNA, 25 bp, Mus musculus
cacccctaaatggactggactatat

SEQ ID NO: 305600 - DNA, 25 bp, Mus musculus
cacccctacatgagctgagccagat

SEQ ID NO: 305601 - DNA, 25 bp, Mus musculus
cacccctacatgtgctgagccagat

SEQ ID NO: 305602 - DNA, 25 bp, Mus musculus
cacccctagggtctctcctaagtga

SEQ ID NO: 305603 - DNA, 25 bp, Mus musculus
cacccctagggtgtctcctaagtga

SEQ ID NO: 305604 - DNA, 25 bp, Mus musculus
cacccctagtgacagagttctccaa

SEQ ID NO: 305605 - DNA, 25 bp, Mus musculus
cacccctagtgagagagttctccaa

SEQ ID NO: 305606 - DNA, 25 bp, Mus musculus
cacccctatcacattttcttgtttg

SEQ ID NO: 305607 - DNA, 25 bp, Mus musculus
cacccctatcactttttcttgtttg

SEQ ID NO: 305608 - DNA, 25 bp, Mus musculus
cacccctgatcccagagatgctgga

SEQ ID NO: 305609 - DNA, 25 bp, Mus musculus
cacccctgatccgagagatgctgga

SEQ ID NO: 305610 - DNA, 25 bp, Mus musculus
cacccctgcaccatgttcttgagat

SEQ ID NO: 305611 - DNA, 25 bp, Mus musculus
cacccctgcaccttgttcttgagat

SEQ ID NO: 305612 - DNA, 25 bp, Mus musculus
cacccctgcattacaacatgctgaa

SEQ ID NO: 305613 - DNA, 25 bp, Mus musculus
cacccctgcatttcaacatgctgaa

SEQ ID NO: 305614 - DNA, 25 bp, Mus musculus
cacccctgtacaacatcaaactgat

SEQ ID NO: 305615 - DNA, 25 bp, Mus musculus
cacccctgtacatcatcaaactgat

SEQ ID NO: 305616 - DNA, 25 bp, Mus musculus
caccccttaactagtgatccagagg

SEQ ID NO: 305617 - DNA, 25 bp, Mus musculus
caccccttaacttgtgatccagagg

SEQ ID NO: 305618 - DNA, 25 bp, Mus musculus
caccccttgggaagtactactgaga

SEQ ID NO: 305619 - DNA, 25 bp, Mus musculus
caccccttgggatgtactactgaga

SEQ ID NO: 305620 - DNA, 25 bp, Mus musculus
caccccttggtcattatgcatgaag

SEQ ID NO: 305621 - DNA, 25 bp, Mus musculus
caccccttggtctttatgcatgaag

SEQ ID NO: 305622 - DNA, 25 bp, Mus musculus
cacccctttcacatgtcagtatgtt

SEQ ID NO: 305623 - DNA, 25 bp, Mus musculus
cacccctttcacttgtcagtatgtt

SEQ ID NO: 305624 - DNA, 25 bp, Mus musculus
cacccgaaatgtccttctacttatt

SEQ ID NO: 305625 - DNA, 25 bp, Mus musculus
cacccgaaatgtgcttctacttatt

SEQ ID NO: 305626 - DNA, 25 bp, Mus musculus
cacccgaagctgatcatcgcaggga

SEQ ID NO: 305627 - DNA, 25 bp, Mus musculus
cacccgaagctgttcatcgcaggga

SEQ ID NO: 305628 - DNA, 25 bp, Mus musculus
cacccgaccatgaggagtcaatctt

SEQ ID NO: 305629 - DNA, 25 bp, Mus musculus
cacccgaccatgtggagtcaatctt

SEQ ID NO: 305630 - DNA, 25 bp, Mus musculus
cacccgacgaagcagtctgagctga

SEQ ID NO: 305631 - DNA, 25 bp, Mus musculus
cacccgacgaaggagtctgagctga

SEQ ID NO: 305632 - DNA, 25 bp, Mus musculus
cacccgactctaattcttacaatgt

SEQ ID NO: 305633 - DNA, 25 bp, Mus musculus
cacccgactctatttcttacaatgt

SEQ ID NO: 305634 - DNA, 25 bp, Mus musculus
cacccgactctgacaggaagcaata

SEQ ID NO: 305635 - DNA, 25 bp, Mus musculus
cacccgactctgtcaggaagcaata

SEQ ID NO: 305636 - DNA, 25 bp, Mus musculus
cacccgactgacaaaatgttcttaa

SEQ ID NO: 305637 - DNA, 25 bp, Mus musculus
cacccgactgactaaatgttcttaa

SEQ ID NO: 305638 - DNA, 25 bp, Mus musculus
cacccgacttttctgttactgaagt

SEQ ID NO: 305639 - DNA, 25 bp, Mus musculus
cacccgacttttgtgttactgaagt

SEQ ID NO: 305640 - DNA, 25 bp, Mus musculus
cacccgagccttcttgtaatcatag

SEQ ID NO: 305641 - DNA, 25 bp, Mus musculus
cacccgagccttgttgtaatcatag

SEQ ID NO: 305642 - DNA, 25 bp, Mus musculus
cacccgagggcaactactttaaact

SEQ ID NO: 305643 - DNA, 25 bp, Mus musculus
cacccgagggcatctactttaaact

SEQ ID NO: 305644 - DNA, 25 bp, Mus musculus
cacccgagggtcactgatggacatg

SEQ ID NO: 305645 - DNA, 25 bp, Mus musculus
cacccgagggtctctgatggacatg

SEQ ID NO: 305646 - DNA, 25 bp, Mus musculus
cacccgaggtttcgaggagagctca

SEQ ID NO: 305647 - DNA, 25 bp, Mus musculus
cacccgaggtttggaggagagctca

SEQ ID NO: 305648 - DNA, 25 bp, Mus musculus
cacccgcatcctaggaataaattct

SEQ ID NO: 305649 - DNA, 25 bp, Mus musculus
cacccgcatccttggaataaattct

SEQ ID NO: 305650 - DNA, 25 bp, Mus musculus
cacccgccgcggacaagatgtatgt

SEQ ID NO: 305651 - DNA, 25 bp, Mus musculus
cacccgccgcggtcaagatgtatgt

SEQ ID NO: 305652 - DNA, 25 bp, Mus musculus
cacccgcctttcaatgtgggaccgg

SEQ ID NO: 305653 - DNA, 25 bp, Mus musculus
cacccgcctttctatgtgggaccgg

SEQ ID NO: 305654 - DNA, 25 bp, Mus musculus
cacccgctgtacatgttgaacatgt

SEQ ID NO: 305655 - DNA, 25 bp, Mus musculus
cacccgctgtacttgttgaacatgt

SEQ ID NO: 305656 - DNA, 25 bp, Mus musculus
cacccggaaaagcaaatacactgag

SEQ ID NO: 305657 - DNA, 25 bp, Mus musculus
cacccggaaaaggaaatacactgag

SEQ ID NO: 305658 - DNA, 25 bp, Mus musculus
cacccggaatggatcaacgtctaca

SEQ ID NO: 305659 - DNA, 25 bp, Mus musculus
cacccggaatggttcaacgtctaca

SEQ ID NO: 305660 - DNA, 25 bp, Mus musculus
cacccggacgatacttgtatacttt

SEQ ID NO: 305661 - DNA, 25 bp, Mus musculus
cacccggacgattcttgtatacttt

SEQ ID NO: 305662 - DNA, 25 bp, Mus musculus
cacccggatcctaaagcttaactat

SEQ ID NO: 305663 - DNA, 25 bp, Mus musculus
cacccggatccttaagcttaactat

SEQ ID NO: 305664 - DNA, 25 bp, Mus musculus
cacccggatttactgtaacatttgg

SEQ ID NO: 305665 - DNA, 25 bp, Mus musculus
cacccggatttagtgtaacatttgg

SEQ ID NO: 305666 - DNA, 25 bp, Mus musculus
cacccggccatgagactgaagtttt

SEQ ID NO: 305667 - DNA, 25 bp, Mus musculus
cacccggccatgtgactgaagtttt

SEQ ID NO: 305668 - DNA, 25 bp, Mus musculus
cacccggctcctattgtctaattct

SEQ ID NO: 305669 - DNA, 25 bp, Mus musculus
cacccggctccttttgtctaattct

SEQ ID NO: 305670 - DNA, 25 bp, Mus musculus
cacccgggagttcaggtcacgttgt

SEQ ID NO: 305671 - DNA, 25 bp, Mus musculus
cacccgggagttgaggtcacgttgt

SEQ ID NO: 305672 - DNA, 25 bp, Mus musculus
cacccgtctgccagtaaaacacaga

SEQ ID NO: 305673 - DNA, 25 bp, Mus musculus
cacccgtctgcctgtaaaacacaga

SEQ ID NO: 305674 - DNA, 25 bp, Mus musculus
cacccgtctgctatctggaaaagta

SEQ ID NO: 305675 - DNA, 25 bp, Mus musculus
cacccgtctgctttctggaaaagta

SEQ ID NO: 305676 - DNA, 25 bp, Mus musculus
cacccgtgaccaccctgtaccagtc

SEQ ID NO: 305677 - DNA, 25 bp, Mus musculus
cacccgtgaccagcctgtaccagtc

SEQ ID NO: 305678 - DNA, 25 bp, Mus musculus
cacccgttagatctcgagggcatca

SEQ ID NO: 305679 - DNA, 25 bp, Mus musculus
cacccgttagatgtcgagggcatca

SEQ ID NO: 305680 - DNA, 25 bp, Mus musculus
caccctaatcctcgtactgaagcta

SEQ ID NO: 305681 - DNA, 25 bp, Mus musculus
caccctaatcctggtactgaagcta

SEQ ID NO: 305682 - DNA, 25 bp, Mus musculus
caccctaatcgtctttggccttaga

SEQ ID NO: 305683 - DNA, 25 bp, Mus musculus
caccctaatcgtgtttggccttaga

SEQ ID NO: 305684 - DNA, 25 bp, Mus musculus
caccctacacacagataatatggat

SEQ ID NO: 305685 - DNA, 25 bp, Mus musculus
caccctacacactgataatatggat

SEQ ID NO: 305686 - DNA, 25 bp, Mus musculus
caccctaccaggagatcatagcaga

SEQ ID NO: 305687 - DNA, 25 bp, Mus musculus
caccctaccaggtgatcatagcaga

SEQ ID NO: 305688 - DNA, 25 bp, Mus musculus
caccctacccagatccaatatagat

SEQ ID NO: 305689 - DNA, 25 bp, Mus musculus
caccctacccagttccaatatagat

SEQ ID NO: 305690 - DNA, 25 bp, Mus musculus
caccctaccttgcacctgtatgaaa

SEQ ID NO: 305691 - DNA, 25 bp, Mus musculus
caccctaccttggacctgtatgaaa

SEQ ID NO: 305692 - DNA, 25 bp, Mus musculus
caccctactagactggcagtcagag

SEQ ID NO: 305693 - DNA, 25 bp, Mus musculus
caccctactagagtggcagtcagag

SEQ ID NO: 305694 - DNA, 25 bp, Mus musculus
caccctactttcatgcatatggaga

SEQ ID NO: 305695 - DNA, 25 bp, Mus musculus
caccctactttcttgcatatggaga

SEQ ID NO: 305696 - DNA, 25 bp, Mus musculus
caccctagatctcgcatggttggtg

SEQ ID NO: 305697 - DNA, 25 bp, Mus musculus
caccctagatctggcatggttggtg

SEQ ID NO: 305698 - DNA, 25 bp, Mus musculus
caccctagcaaaccgtactgtgtag

SEQ ID NO: 305699 - DNA, 25 bp, Mus musculus
caccctagcaaagcgtactgtgtag

SEQ ID NO: 305700 - DNA, 25 bp, Mus musculus
caccctaggccactgtggcgtagag

SEQ ID NO: 305701 - DNA, 25 bp, Mus musculus
caccctaggccagtgtggcgtagag

SEQ ID NO: 305702 - DNA, 25 bp, Mus musculus
caccctaggtacaagagatgcacta

SEQ ID NO: 305703 - DNA, 25 bp, Mus musculus
caccctaggtactagagatgcacta

SEQ ID NO: 305704 - DNA, 25 bp, Mus musculus
caccctagtcacctagagcaggaag

SEQ ID NO: 305705 - DNA, 25 bp, Mus musculus
caccctagtcacgtagagcaggaag

SEQ ID NO: 305706 - DNA, 25 bp, Mus musculus
caccctagtgacacgggccatgaaa

SEQ ID NO: 305707 - DNA, 25 bp, Mus musculus
caccctagtgactcgggccatgaaa

SEQ ID NO: 305708 - DNA, 25 bp, Mus musculus
caccctagtgagcttcctgtgcttc

SEQ ID NO: 305709 - DNA, 25 bp, Mus musculus
caccctagtgaggttcctgtgcttc

SEQ ID NO: 305710 - DNA, 25 bp, Mus musculus
caccctatacacactgacagagaca

SEQ ID NO: 305711 - DNA, 25 bp, Mus musculus
caccctatacactctgacagagaca

SEQ ID NO: 305712 - DNA, 25 bp, Mus musculus
caccctatcgatctacacctttatt

SEQ ID NO: 305713 - DNA, 25 bp, Mus musculus
caccctatcgatgtacacctttatt

SEQ ID NO: 305714 - DNA, 25 bp, Mus musculus
caccctattggactcagaaagagaa

SEQ ID NO: 305715 - DNA, 25 bp, Mus musculus
caccctattggagtcagaaagagaa

SEQ ID NO: 305716 - DNA, 25 bp, Mus musculus
caccctcaagctcatttgattgctg

SEQ ID NO: 305717 - DNA, 25 bp, Mus musculus
caccctcaagctgatttgattgctg

SEQ ID NO: 305718 - DNA, 25 bp, Mus musculus
caccctcacagtactaacttagcaa

SEQ ID NO: 305719 - DNA, 25 bp, Mus musculus
caccctcacagttctaacttagcaa

SEQ ID NO: 305720 - DNA, 25 bp, Mus musculus
caccctcacccactgaaggtgtaaa

SEQ ID NO: 305721 - DNA, 25 bp, Mus musculus
caccctcacccagtgaaggtgtaaa

SEQ ID NO: 305722 - DNA, 25 bp, Mus musculus
caccctcactacactacaatagatg

SEQ ID NO: 305723 - DNA, 25 bp, Mus musculus
caccctcactactctacaatagatg

SEQ ID NO: 305724 - DNA, 25 bp, Mus musculus
caccctcagtgacggatgtgagaaa

SEQ ID NO: 305725 - DNA, 25 bp, Mus musculus
caccctcagtgagggatgtgagaaa

SEQ ID NO: 305726 - DNA, 25 bp, Mus musculus
caccctcatgggaagctgctgggag

SEQ ID NO: 305727 - DNA, 25 bp, Mus musculus
caccctcatgggtagctgctgggag

SEQ ID NO: 305728 - DNA, 25 bp, Mus musculus
caccctccagttcgacagtgaagag

SEQ ID NO: 305729 - DNA, 25 bp, Mus musculus
caccctccagttggacagtgaagag

SEQ ID NO: 305730 - DNA, 25 bp, Mus musculus
caccctcccgagctgaagaagttta

SEQ ID NO: 305731 - DNA, 25 bp, Mus musculus
caccctcccgaggtgaagaagttta

SEQ ID NO: 305732 - DNA, 25 bp, Mus musculus
caccctccgtgtcccaaaatagtgt

SEQ ID NO: 305733 - DNA, 25 bp, Mus musculus
caccctccgtgtgccaaaatagtgt

SEQ ID NO: 305734 - DNA, 25 bp, Mus musculus
caccctcgcactcgagttgtgagag

SEQ ID NO: 305735 - DNA, 25 bp, Mus musculus
caccctcgcactggagttgtgagag

SEQ ID NO: 305736 - DNA, 25 bp, Mus musculus
caccctctctgaatggaagtagtgg

SEQ ID NO: 305737 - DNA, 25 bp, Mus musculus
caccctctctgattggaagtagtgg

SEQ ID NO: 305738 - DNA, 25 bp, Mus musculus
caccctctgacaaacattgaatact

SEQ ID NO: 305739 - DNA, 25 bp, Mus musculus
caccctctgacatacattgaatact

SEQ ID NO: 305740 - DNA, 25 bp, Mus musculus
caccctctggctaatgggatggttg

SEQ ID NO: 305741 - DNA, 25 bp, Mus musculus
caccctctggcttatgggatggttg

SEQ ID NO: 305742 - DNA, 25 bp, Mus musculus
caccctctgtgaacttcaagtacga

SEQ ID NO: 305743 - DNA, 25 bp, Mus musculus
caccctctgtgatcttcaagtacga

SEQ ID NO: 305744 - DNA, 25 bp, Mus musculus
caccctctgtgcctcgaagcctggg

SEQ ID NO: 305745 - DNA, 25 bp, Mus musculus
caccctctgtgcgtcgaagcctggg

SEQ ID NO: 305746 - DNA, 25 bp, Mus musculus
caccctctgtggaagtgcacttgta

SEQ ID NO: 305747 - DNA, 25 bp, Mus musculus
caccctctgtggtagtgcacttgta

SEQ ID NO: 305748 - DNA, 25 bp, Mus musculus
caccctcttagccaatctaacaaga

SEQ ID NO: 305749 - DNA, 25 bp, Mus musculus
caccctcttagcgaatctaacaaga

SEQ ID NO: 305750 - DNA, 25 bp, Mus musculus
caccctctttgcctaataagcttgg

SEQ ID NO: 305751 - DNA, 25 bp, Mus musculus
caccctctttgcgtaataagcttgg

SEQ ID NO: 305752 - DNA, 25 bp, Mus musculus
caccctgaagagagttcctctgaag

SEQ ID NO: 305753 - DNA, 25 bp, Mus musculus
caccctgaagagtgttcctctgaag

SEQ ID NO: 305754 - DNA, 25 bp, Mus musculus
caccctgaaggacctcacggtgcgg

SEQ ID NO: 305755 - DNA, 25 bp, Mus musculus
caccctgaaggagctcacggtgcgg

SEQ ID NO: 305756 - DNA, 25 bp, Mus musculus
caccctgaatctatagtcttagtaa

SEQ ID NO: 305757 - DNA, 25 bp, Mus musculus
caccctgaatctttagtcttagtaa

SEQ ID NO: 305758 - DNA, 25 bp, Mus musculus
caccctgacagccactgaggcaaat

SEQ ID NO: 305759 - DNA, 25 bp, Mus musculus
caccctgacagcgactgaggcaaat

SEQ ID NO: 305760 - DNA, 25 bp, Mus musculus
caccctgaccaaccaaaagctgaat

SEQ ID NO: 305761 - DNA, 25 bp, Mus musculus
caccctgaccaagcaaaagctgaat

SEQ ID NO: 305762 - DNA, 25 bp, Mus musculus
caccctgactctctatctatgcaaa

SEQ ID NO: 305763 - DNA, 25 bp, Mus musculus
caccctgactctgtatctatgcaaa

SEQ ID NO: 305764 - DNA, 25 bp, Mus musculus
caccctgagaggaggcttgaacaag

SEQ ID NO: 305765 - DNA, 25 bp, Mus musculus
caccctgagaggtggcttgaacaag

SEQ ID NO: 305766 - DNA, 25 bp, Mus musculus
caccctgagatcatgttccatcggg

SEQ ID NO: 305767 - DNA, 25 bp, Mus musculus
caccctgagatcttgttccatcggg

SEQ ID NO: 305768 - DNA, 25 bp, Mus musculus
caccctgattttcgtttatttgcat

SEQ ID NO: 305769 - DNA, 25 bp, Mus musculus
caccctgattttggtttatttgcat

SEQ ID NO: 305770 - DNA, 25 bp, Mus musculus
caccctgcataaaataaaccgtttg

SEQ ID NO: 305771 - DNA, 25 bp, Mus musculus
caccctgcataatataaaccgtttg

SEQ ID NO: 305772 - DNA, 25 bp, Mus musculus
caccctgcatggaagcttgttaaga

SEQ ID NO: 305773 - DNA, 25 bp, Mus musculus
caccctgcatggtagcttgttaaga

SEQ ID NO: 305774 - DNA, 25 bp, Mus musculus
caccctgccatgatccagtaatgga

SEQ ID NO: 305775 - DNA, 25 bp, Mus musculus
caccctgccatgttccagtaatgga

SEQ ID NO: 305776 - DNA, 25 bp, Mus musculus
caccctgcccatatttgtaaaactg

SEQ ID NO: 305777 - DNA, 25 bp, Mus musculus
caccctgcccatttttgtaaaactg

SEQ ID NO: 305778 - DNA, 25 bp, Mus musculus
caccctgccctgaattaggaagcat

SEQ ID NO: 305779 - DNA, 25 bp, Mus musculus
caccctgccctgtattaggaagcat

SEQ ID NO: 305780 - DNA, 25 bp, Mus musculus
caccctgcctctacttaaaagtatt

SEQ ID NO: 305781 - DNA, 25 bp, Mus musculus
caccctgcctcttcttaaaagtatt

SEQ ID NO: 305782 - DNA, 25 bp, Mus musculus
caccctgcctgcattgttaggtaga

SEQ ID NO: 305783 - DNA, 25 bp, Mus musculus
caccctgcctgctttgttaggtaga

SEQ ID NO: 305784 - DNA, 25 bp, Mus musculus
caccctgctgacagacactaacttt

SEQ ID NO: 305785 - DNA, 25 bp, Mus musculus
caccctgctgactgacactaacttt

SEQ ID NO: 305786 - DNA, 25 bp, Mus musculus
caccctgcttggcttcaagttattc

SEQ ID NO: 305787 - DNA, 25 bp, Mus musculus
caccctgcttgggttcaagttattc

SEQ ID NO: 305788 - DNA, 25 bp, Mus musculus
caccctggacttataatgttcattc

SEQ ID NO: 305789 - DNA, 25 bp, Mus musculus
caccctggacttttaatgttcattc

SEQ ID NO: 305790 - DNA, 25 bp, Mus musculus
caccctgggattcgtagtccgttcg

SEQ ID NO: 305791 - DNA, 25 bp, Mus musculus
caccctgggattggtagtccgttcg

SEQ ID NO: 305792 - DNA, 25 bp, Mus musculus
caccctgggcctcagtgaaggagta

SEQ ID NO: 305793 - DNA, 25 bp, Mus musculus
caccctgggcctgagtgaaggagta

SEQ ID NO: 305794 - DNA, 25 bp, Mus musculus
caccctgtatctatgtttccttttt

SEQ ID NO: 305795 - DNA, 25 bp, Mus musculus
caccctgtatctttgtttccttttt

SEQ ID NO: 305796 - DNA, 25 bp, Mus musculus
caccctgtcggtatcttcagttaaa

SEQ ID NO: 305797 - DNA, 25 bp, Mus musculus
caccctgtcggtttcttcagttaaa

SEQ ID NO: 305798 - DNA, 25 bp, Mus musculus
caccctgtggaacgagcctattgaa

SEQ ID NO: 305799 - DNA, 25 bp, Mus musculus
caccctgtggaaggagcctattgaa

SEQ ID NO: 305800 - DNA, 25 bp, Mus musculus
caccctgtgtgtacaaaccgttcag

SEQ ID NO: 305801 - DNA, 25 bp, Mus musculus
caccctgtgtgttcaaaccgttcag

SEQ ID NO: 305802 - DNA, 25 bp, Mus musculus
caccctgtgttgagggaactgagaa

SEQ ID NO: 305803 - DNA, 25 bp, Mus musculus
caccctgtgttgtgggaactgagaa

SEQ ID NO: 305804 - DNA, 25 bp, Mus musculus
caccctgttaatcccacttcagagt

SEQ ID NO: 305805 - DNA, 25 bp, Mus musculus
caccctgttaatgccacttcagagt

SEQ ID NO: 305806 - DNA, 25 bp, Mus musculus
caccctgttatgatttcctgtacta

SEQ ID NO: 305807 - DNA, 25 bp, Mus musculus
caccctgttatgttttcctgtacta

SEQ ID NO: 305808 - DNA, 25 bp, Mus musculus
caccctgttcagcatggttggaata

SEQ ID NO: 305809 - DNA, 25 bp, Mus musculus
caccctgttcaggatggttggaata

SEQ ID NO: 305810 - DNA, 25 bp, Mus musculus
cacccttaaatcagcgagacccaga

SEQ ID NO: 305811 - DNA, 25 bp, Mus musculus
cacccttaaatctgcgagacccaga

SEQ ID NO: 305812 - DNA, 25 bp, Mus musculus
cacccttagaaccatgaccagagca

SEQ ID NO: 305813 - DNA, 25 bp, Mus musculus
cacccttagaacgatgaccagagca

SEQ ID NO: 305814 - DNA, 25 bp, Mus musculus
cacccttagtccaagaaactcctgt

SEQ ID NO: 305815 - DNA, 25 bp, Mus musculus
cacccttagtcctagaaactcctgt

SEQ ID NO: 305816 - DNA, 25 bp, Mus musculus
cacccttagtgaacttctgttgtcc

SEQ ID NO: 305817 - DNA, 25 bp, Mus musculus
cacccttagtgatcttctgttgtcc

SEQ ID NO: 305818 - DNA, 25 bp, Mus musculus
cacccttagttcaagaagtttctgt

SEQ ID NO: 305819 - DNA, 25 bp, Mus musculus
cacccttagttctagaagtttctgt

SEQ ID NO: 305820 - DNA, 25 bp, Mus musculus
cacccttcacatagaacctgaaatc

SEQ ID NO: 305821 - DNA, 25 bp, Mus musculus
cacccttcacattgaacctgaaatc

SEQ ID NO: 305822 - DNA, 25 bp, Mus musculus
cacccttcataaagatcccctgaaa

SEQ ID NO: 305823 - DNA, 25 bp, Mus musculus
cacccttcataatgatcccctgaaa

SEQ ID NO: 305824 - DNA, 25 bp, Mus musculus
cacccttcatcgcactttcttggtt

SEQ ID NO: 305825 - DNA, 25 bp, Mus musculus
cacccttcatcggactttcttggtt

SEQ ID NO: 305826 - DNA, 25 bp, Mus musculus
cacccttcccagaatgcagcagaac

SEQ ID NO: 305827 - DNA, 25 bp, Mus musculus
cacccttcccagtatgcagcagaac

SEQ ID NO: 305828 - DNA, 25 bp, Mus musculus
cacccttcccatcgtttgagtggtt

SEQ ID NO: 305829 - DNA, 25 bp, Mus musculus
cacccttcccatggtttgagtggtt

SEQ ID NO: 305830 - DNA, 25 bp, Mus musculus
cacccttccgcaaaatagtggagaa

SEQ ID NO: 305831 - DNA, 25 bp, Mus musculus
cacccttccgcataatagtggagaa

SEQ ID NO: 305832 - DNA, 25 bp, Mus musculus
cacccttccttaaagatcagataaa

SEQ ID NO: 305833 - DNA, 25 bp, Mus musculus
cacccttccttatagatcagataaa

SEQ ID NO: 305834 - DNA, 25 bp, Mus musculus
cacccttccttgagtcatcagttaa

SEQ ID NO: 305835 - DNA, 25 bp, Mus musculus
cacccttccttgtgtcatcagttaa

SEQ ID NO: 305836 - DNA, 25 bp, Mus musculus
cacccttctaccatgctgaaagtat

SEQ ID NO: 305837 - DNA, 25 bp, Mus musculus
cacccttctaccttgctgaaagtat

SEQ ID NO: 305838 - DNA, 25 bp, Mus musculus
cacccttctgggactatttgatgct

SEQ ID NO: 305839 - DNA, 25 bp, Mus musculus
cacccttctgggtctatttgatgct

SEQ ID NO: 305840 - DNA, 25 bp, Mus musculus
cacccttctggtcttggagcagagt

SEQ ID NO: 305841 - DNA, 25 bp, Mus musculus
cacccttctggtgttggagcagagt

SEQ ID NO: 305842 - DNA, 25 bp, Mus musculus
cacccttcttcccaagtgttgatta

SEQ ID NO: 305843 - DNA, 25 bp, Mus musculus
cacccttcttccgaagtgttgatta

SEQ ID NO: 305844 - DNA, 25 bp, Mus musculus
cacccttcttgcatggatatgacca

SEQ ID NO: 305845 - DNA, 25 bp, Mus musculus
cacccttcttgcttggatatgacca

SEQ ID NO: 305846 - DNA, 25 bp, Mus musculus
cacccttggcaaaggacccaggatt

SEQ ID NO: 305847 - DNA, 25 bp, Mus musculus
cacccttggcaatggacccaggatt

SEQ ID NO: 305848 - DNA, 25 bp, Mus musculus
cacccttgggagattcggctagttg

SEQ ID NO: 305849 - DNA, 25 bp, Mus musculus
cacccttgggagtttcggctagttg

SEQ ID NO: 305850 - DNA, 25 bp, Mus musculus
cacccttgtaacctggacatgggca

SEQ ID NO: 305851 - DNA, 25 bp, Mus musculus
cacccttgtaacgtggacatgggca

SEQ ID NO: 305852 - DNA, 25 bp, Mus musculus
cacccttgtggtctaaacttgctac

SEQ ID NO: 305853 - DNA, 25 bp, Mus musculus
cacccttgtggtgtaaacttgctac

SEQ ID NO: 305854 - DNA, 25 bp, Mus musculus
caccctttacctagcactgtgatac

SEQ ID NO: 305855 - DNA, 25 bp, Mus musculus
caccctttaccttgcactgtgatac

SEQ ID NO: 305856 - DNA, 25 bp, Mus musculus
caccctttagtcacttctgatcaga

SEQ ID NO: 305857 - DNA, 25 bp, Mus musculus
caccctttagtctcttctgatcaga

SEQ ID NO: 305858 - DNA, 25 bp, Mus musculus
caccctttcactactcagaagtaca

SEQ ID NO: 305859 - DNA, 25 bp, Mus musculus
caccctttcacttctcagaagtaca

SEQ ID NO: 305860 - DNA, 25 bp, Mus musculus
caccctttccctaatggtagacatg

SEQ ID NO: 305861 - DNA, 25 bp, Mus musculus
caccctttcccttatggtagacatg

SEQ ID NO: 305862 - DNA, 25 bp, Mus musculus
caccctttcctaacacttgtatttg

SEQ ID NO: 305863 - DNA, 25 bp, Mus musculus
caccctttcctatcacttgtatttg

SEQ ID NO: 305864 - DNA, 25 bp, Mus musculus
caccctttgcatattccggatttat

SEQ ID NO: 305865 - DNA, 25 bp, Mus musculus
caccctttgcattttccggatttat

SEQ ID NO: 305866 - DNA, 25 bp, Mus musculus
caccctttggacaggaggctctttt

SEQ ID NO: 305867 - DNA, 25 bp, Mus musculus
caccctttggactggaggctctttt

SEQ ID NO: 305868 - DNA, 25 bp, Mus musculus
caccctttttgtcctgttggccttg

SEQ ID NO: 305869 - DNA, 25 bp, Mus musculus
caccctttttgtgctgttggccttg

SEQ ID NO: 305870 - DNA, 25 bp, Mus musculus
caccgaaagagaccgcctatctcat

SEQ ID NO: 305871 - DNA, 25 bp, Mus musculus
caccgaaagagagcgcctatctcat

SEQ ID NO: 305872 - DNA, 25 bp, Mus musculus
caccgaagaatgcaacgtcctgatt

SEQ ID NO: 305873 - DNA, 25 bp, Mus musculus
caccgaagaatggaacgtcctgatt

SEQ ID NO: 305874 - DNA, 25 bp, Mus musculus
caccgaagacagatctcatggcctt

SEQ ID NO: 305875 - DNA, 25 bp, Mus musculus
caccgaagacagttctcatggcctt

SEQ ID NO: 305876 - DNA, 25 bp, Mus musculus
caccgacaccaacaacgtgcagttt

SEQ ID NO: 305877 - DNA, 25 bp, Mus musculus
caccgacaccaagaacgtgcagttt

SEQ ID NO: 305878 - DNA, 25 bp, Mus musculus
caccgacagctgcaggtataccaca

SEQ ID NO: 305879 - DNA, 25 bp, Mus musculus
caccgacagctggaggtataccaca

SEQ ID NO: 305880 - DNA, 25 bp, Mus musculus
caccgacatgtccaaagcgatcatc

SEQ ID NO: 305881 - DNA, 25 bp, Mus musculus
caccgacatgtcgaaagcgatcatc

SEQ ID NO: 305882 - DNA, 25 bp, Mus musculus
caccgacctggtagccaagttaaga

SEQ ID NO: 305883 - DNA, 25 bp, Mus musculus
caccgacctggttgccaagttaaga

SEQ ID NO: 305884 - DNA, 25 bp, Mus musculus
caccgacgggctcgcattaggtgct

SEQ ID NO: 305885 - DNA, 25 bp, Mus musculus
caccgacgggctggcattaggtgct

SEQ ID NO: 305886 - DNA, 25 bp, Mus musculus
caccgacttgctctgctttaagaaa

SEQ ID NO: 305887 - DNA, 25 bp, Mus musculus
caccgacttgctgtgctttaagaaa

SEQ ID NO: 305888 - DNA, 25 bp, Mus musculus
caccgacttggtcttcatcgaggag

SEQ ID NO: 305889 - DNA, 25 bp, Mus musculus
caccgacttggtgttcatcgaggag

SEQ ID NO: 305890 - DNA, 25 bp, Mus musculus
caccgagacacaatgctggcagctg

SEQ ID NO: 305891 - DNA, 25 bp, Mus musculus
caccgagacacattgctggcagctg

SEQ ID NO: 305892 - DNA, 25 bp, Mus musculus
caccgagaccggatttgaccatgtt

SEQ ID NO: 305893 - DNA, 25 bp, Mus musculus
caccgagaccggttttgaccatgtt

SEQ ID NO: 305894 - DNA, 25 bp, Mus musculus
caccgagacggacacctaggttgtt

SEQ ID NO: 305895 - DNA, 25 bp, Mus musculus
caccgagacggagacctaggttgtt

SEQ ID NO: 305896 - DNA, 25 bp, Mus musculus
caccgagcagaactgccttacatga

SEQ ID NO: 305897 - DNA, 25 bp, Mus musculus
caccgagcagaagtgccttacatga

SEQ ID NO: 305898 - DNA, 25 bp, Mus musculus
caccgagcccagctggcgaacaaag

SEQ ID NO: 305899 - DNA, 25 bp, Mus musculus
caccgagcccaggtggcgaacaaag

SEQ ID NO: 305900 - DNA, 25 bp, Mus musculus
caccgaggaggactcttttttagct

SEQ ID NO: 305901 - DNA, 25 bp, Mus musculus
caccgaggaggagtcttttttagct

SEQ ID NO: 305902 - DNA, 25 bp, Mus musculus
caccgaggctcgatcaccactgtat

SEQ ID NO: 305903 - DNA, 25 bp, Mus musculus
caccgaggctcgttcaccactgtat

SEQ ID NO: 305904 - DNA, 25 bp, Mus musculus
caccgagggcttcgaatgttattcc

SEQ ID NO: 305905 - DNA, 25 bp, Mus musculus
caccgagggcttggaatgttattcc

SEQ ID NO: 305906 - DNA, 25 bp, Mus musculus
caccgaggtagcaccacgctaagct

SEQ ID NO: 305907 - DNA, 25 bp, Mus musculus
caccgaggtagctccacgctaagct

SEQ ID NO: 305908 - DNA, 25 bp, Mus musculus
caccgagtcaatccctagaactgaa

SEQ ID NO: 305909 - DNA, 25 bp, Mus musculus
caccgagtcaatgcctagaactgaa

SEQ ID NO: 305910 - DNA, 25 bp, Mus musculus
caccgagtcagaagtgatcttaact

SEQ ID NO: 305911 - DNA, 25 bp, Mus musculus
caccgagtcagatgtgatcttaact

SEQ ID NO: 305912 - DNA, 25 bp, Mus musculus
caccgattggtcagcaaaagcttcc

SEQ ID NO: 305913 - DNA, 25 bp, Mus musculus
caccgattggtctgcaaaagcttcc

SEQ ID NO: 305914 - DNA, 25 bp, Mus musculus
caccgcaagttgaggtggtgcagtt

SEQ ID NO: 305915 - DNA, 25 bp, Mus musculus
caccgcaagttgtggtggtgcagtt

SEQ ID NO: 305916 - DNA, 25 bp, Mus musculus
caccgcaataataagccctgaccaa

SEQ ID NO: 305917 - DNA, 25 bp, Mus musculus
caccgcaataattagccctgaccaa

SEQ ID NO: 305918 - DNA, 25 bp, Mus musculus
caccgcacgcggagctatgactgcg

SEQ ID NO: 305919 - DNA, 25 bp, Mus musculus
caccgcacgcggtgctatgactgcg

SEQ ID NO: 305920 - DNA, 25 bp, Mus musculus
caccgcactctgaactattactaac

SEQ ID NO: 305921 - DNA, 25 bp, Mus musculus
caccgcactctgtactattactaac

SEQ ID NO: 305922 - DNA, 25 bp, Mus musculus
caccgcagcaggacttaacaccagt

SEQ ID NO: 305923 - DNA, 25 bp, Mus musculus
caccgcagcaggtcttaacaccagt

SEQ ID NO: 305924 - DNA, 25 bp, Mus musculus
caccgcagggctccgctgtagctgt

SEQ ID NO: 305925 - DNA, 25 bp, Mus musculus
caccgcagggctgcgctgtagctgt

SEQ ID NO: 305926 - DNA, 25 bp, Mus musculus
caccgcaggtgtagagaaggcactt

SEQ ID NO: 305927 - DNA, 25 bp, Mus musculus
caccgcaggtgttgagaaggcactt

SEQ ID NO: 305928 - DNA, 25 bp, Mus musculus
caccgcatatccactgcagataaac

SEQ ID NO: 305929 - DNA, 25 bp, Mus musculus
caccgcatatcctctgcagataaac

SEQ ID NO: 305930 - DNA, 25 bp, Mus musculus
caccgccaagtccacaaaactagag

SEQ ID NO: 305931 - DNA, 25 bp, Mus musculus
caccgccaagtcgacaaaactagag

SEQ ID NO: 305932 - DNA, 25 bp, Mus musculus
caccgccacttcatttgcaagttta

SEQ ID NO: 305933 - DNA, 25 bp, Mus musculus
caccgccacttcttttgcaagttta

SEQ ID NO: 305934 - DNA, 25 bp, Mus musculus
caccgccatcttctcagtggaaaaa

SEQ ID NO: 305935 - DNA, 25 bp, Mus musculus
caccgccatcttgtcagtggaaaaa

SEQ ID NO: 305936 - DNA, 25 bp, Mus musculus
caccgcccacttcagcaataaaaag

SEQ ID NO: 305937 - DNA, 25 bp, Mus musculus
caccgcccacttgagcaataaaaag

SEQ ID NO: 305938 - DNA, 25 bp, Mus musculus
caccgcccagcaactgaactatatt

SEQ ID NO: 305939 - DNA, 25 bp, Mus musculus
caccgcccagcatctgaactatatt

SEQ ID NO: 305940 - DNA, 25 bp, Mus musculus
caccgccgagttacaatttgctagc

SEQ ID NO: 305941 - DNA, 25 bp, Mus musculus
caccgccgagtttcaatttgctagc

SEQ ID NO: 305942 - DNA, 25 bp, Mus musculus
caccgcgagtgcaggtgaggccacc

SEQ ID NO: 305943 - DNA, 25 bp, Mus musculus
caccgcgagtgctggtgaggccacc

SEQ ID NO: 305944 - DNA, 25 bp, Mus musculus
caccgcgtggatccagggaattgaa

SEQ ID NO: 305945 - DNA, 25 bp, Mus musculus
caccgcgtggatgcagggaattgaa

SEQ ID NO: 305946 - DNA, 25 bp, Mus musculus
caccgctatagtattagtgtttcta

SEQ ID NO: 305947 - DNA, 25 bp, Mus musculus
caccgctatagttttagtgtttcta

SEQ ID NO: 305948 - DNA, 25 bp, Mus musculus
caccgctattcacgagctgttcaaa

SEQ ID NO: 305949 - DNA, 25 bp, Mus musculus
caccgctattcaggagctgttcaaa

SEQ ID NO: 305950 - DNA, 25 bp, Mus musculus
caccgctctaggcacatgggtcgag

SEQ ID NO: 305951 - DNA, 25 bp, Mus musculus
caccgctctagggacatgggtcgag

SEQ ID NO: 305952 - DNA, 25 bp, Mus musculus
caccgctctgtcaaagggtcaagaa

SEQ ID NO: 305953 - DNA, 25 bp, Mus musculus
caccgctctgtctaagggtcaagaa

SEQ ID NO: 305954 - DNA, 25 bp, Mus musculus
caccgctggaccatggtcagggacg

SEQ ID NO: 305955 - DNA, 25 bp, Mus musculus
caccgctggaccttggtcagggacg

SEQ ID NO: 305956 - DNA, 25 bp, Mus musculus
caccgctttggtcgcacaaattgat

SEQ ID NO: 305957 - DNA, 25 bp, Mus musculus
caccgctttggtggcacaaattgat

SEQ ID NO: 305958 - DNA, 25 bp, Mus musculus
caccggaagaaacagtagtcattgg

SEQ ID NO: 305959 - DNA, 25 bp, Mus musculus
caccggaagaaagagtagtcattgg

SEQ ID NO: 305960 - DNA, 25 bp, Mus musculus
caccggaaggcacgccatgggtctt

SEQ ID NO: 305961 - DNA, 25 bp, Mus musculus
caccggaaggcaggccatgggtctt

SEQ ID NO: 305962 - DNA, 25 bp, Mus musculus
caccggaagtgcaattttatatgct

SEQ ID NO: 305963 - DNA, 25 bp, Mus musculus
caccggaagtgctattttatatgct

SEQ ID NO: 305964 - DNA, 25 bp, Mus musculus
caccggacagcaatcacaacgacag

SEQ ID NO: 305965 - DNA, 25 bp, Mus musculus
caccggacagcattcacaacgacag

SEQ ID NO: 305966 - DNA, 25 bp, Mus musculus
caccggagtctcatttgtatatcaa

SEQ ID NO: 305967 - DNA, 25 bp, Mus musculus
caccggagtctccagtcttgaggat

SEQ ID NO: 305968 - DNA, 25 bp, Mus musculus
caccggagtctcgagtcttgaggat

SEQ ID NO: 305969 - DNA, 25 bp, Mus musculus
caccggagtctcttttgtatatcaa

SEQ ID NO: 305970 - DNA, 25 bp, Mus musculus
caccggatcagtcgctttctaagag

SEQ ID NO: 305971 - DNA, 25 bp, Mus musculus
caccggatcagtggctttctaagag

SEQ ID NO: 305972 - DNA, 25 bp, Mus musculus
caccggatggccaggaaggcttcat

SEQ ID NO: 305973 - DNA, 25 bp, Mus musculus
caccggatggcctggaaggcttcat

SEQ ID NO: 305974 - DNA, 25 bp, Mus musculus
caccggattcctaatcagtcaggtt

SEQ ID NO: 305975 - DNA, 25 bp, Mus musculus
caccggattccttatcagtcaggtt

SEQ ID NO: 305976 - DNA, 25 bp, Mus musculus
caccggcaaaacaagggaagattca

SEQ ID NO: 305977 - DNA, 25 bp, Mus musculus
caccggcaaaactagggaagattca

SEQ ID NO: 305978 - DNA, 25 bp, Mus musculus
caccggccgaacctggagctgtgtc

SEQ ID NO: 305979 - DNA, 25 bp, Mus musculus
caccggccgaacgtggagctgtgtc

SEQ ID NO: 305980 - DNA, 25 bp, Mus musculus
caccggcctggtctagaacctaaga

SEQ ID NO: 305981 - DNA, 25 bp, Mus musculus
caccggcctggtgtagaacctaaga

SEQ ID NO: 305982 - DNA, 25 bp, Mus musculus
caccggctcaacacgggaagcaata

SEQ ID NO: 305983 - DNA, 25 bp, Mus musculus
caccggctcaactcgggaagcaata

SEQ ID NO: 305984 - DNA, 25 bp, Mus musculus
caccggctgtaaacgatgcattgaa

SEQ ID NO: 305985 - DNA, 25 bp, Mus musculus
caccggctgtaatcgatgcattgaa

SEQ ID NO: 305986 - DNA, 25 bp, Mus musculus
caccgggaatcaatgcctggacatt

SEQ ID NO: 305987 - DNA, 25 bp, Mus musculus
caccgggaatcattgcctggacatt

SEQ ID NO: 305988 - DNA, 25 bp, Mus musculus
caccgggacaccaacgtggccctgc

SEQ ID NO: 305989 - DNA, 25 bp, Mus musculus
caccgggacacctacgtggccctgc

SEQ ID NO: 305990 - DNA, 25 bp, Mus musculus
caccgggcactcacatggtacatgt

SEQ ID NO: 305991 - DNA, 25 bp, Mus musculus
caccgggcactctcatggtacatgt

SEQ ID NO: 305992 - DNA, 25 bp, Mus musculus
caccgggcgctgagcttagaatagc

SEQ ID NO: 305993 - DNA, 25 bp, Mus musculus
caccgggcgctgtgcttagaatagc

SEQ ID NO: 305994 - DNA, 25 bp, Mus musculus
caccgggggttcaatgatatttgta

SEQ ID NO: 305995 - DNA, 25 bp, Mus musculus
caccgggggttctatgatatttgta

SEQ ID NO: 305996 - DNA, 25 bp, Mus musculus
caccgggtcaggagaccagaaggca

SEQ ID NO: 305997 - DNA, 25 bp, Mus musculus
caccgggtcaggtgaccagaaggca

SEQ ID NO: 305998 - DNA, 25 bp, Mus musculus
caccgggtgggccacagtacaaaga

SEQ ID NO: 305999 - DNA, 25 bp, Mus musculus
caccgggtgggcgacagtacaaaga

SEQ ID NO: 306000 - DNA, 25 bp, Mus musculus
caccgggttgcaacggagacaacag

SEQ ID NO: 306001 - DNA, 25 bp, Mus musculus
caccgggttgcatcggagacaacag

SEQ ID NO: 306002 - DNA, 25 bp, Mus musculus
caccggtacaatacctgtgatgtat

SEQ ID NO: 306003 - DNA, 25 bp, Mus musculus
caccggtacaattcctgtgatgtat

SEQ ID NO: 306004 - DNA, 25 bp, Mus musculus
caccggtccggtccaggcgactaag

SEQ ID NO: 306005 - DNA, 25 bp, Mus musculus
caccggtccggtgcaggcgactaag

SEQ ID NO: 306006 - DNA, 25 bp, Mus musculus
caccggtcctttagctgtgagaaaa

SEQ ID NO: 306007 - DNA, 25 bp, Mus musculus
caccggtccttttgctgtgagaaaa

SEQ ID NO: 306008 - DNA, 25 bp, Mus musculus
caccggtcggttcagccttttctgg

SEQ ID NO: 306009 - DNA, 25 bp, Mus musculus
caccggtcggttgagccttttctgg

SEQ ID NO: 306010 - DNA, 25 bp, Mus musculus
caccggtgctacaactttgaaacat

SEQ ID NO: 306011 - DNA, 25 bp, Mus musculus
caccggtgctactactttgaaacat

SEQ ID NO: 306012 - DNA, 25 bp, Mus musculus
caccggtgtatactgacttggcatc

SEQ ID NO: 306013 - DNA, 25 bp, Mus musculus
caccggtgtatagtgacttggcatc

SEQ ID NO: 306014 - DNA, 25 bp, Mus musculus
caccggtgtgacatatgtttaggtc

SEQ ID NO: 306015 - DNA, 25 bp, Mus musculus
caccggtgtgacttatgtttaggtc

SEQ ID NO: 306016 - DNA, 25 bp, Mus musculus
caccggtttcctctaactagcattg

SEQ ID NO: 306017 - DNA, 25 bp, Mus musculus
caccggtttcctgtaactagcattg

SEQ ID NO: 306018 - DNA, 25 bp, Mus musculus
caccggtttgggacaagccagatta

SEQ ID NO: 306019 - DNA, 25 bp, Mus musculus
caccggtttgggtcaagccagatta

SEQ ID NO: 306020 - DNA, 25 bp, Mus musculus
caccgtcatgtgagctgcattatta

SEQ ID NO: 306021 - DNA, 25 bp, Mus musculus
caccgtcatgtgtgctgcattatta

SEQ ID NO: 306022 - DNA, 25 bp, Mus musculus
caccgtcccctgagttgaagaggta

SEQ ID NO: 306023 - DNA, 25 bp, Mus musculus
caccgtcccctgtgttgaagaggta

SEQ ID NO: 306024 - DNA, 25 bp, Mus musculus
caccgtcccgttcggcttgaggata

SEQ ID NO: 306025 - DNA, 25 bp, Mus musculus
caccgtcccgttgggcttgaggata

SEQ ID NO: 306026 - DNA, 25 bp, Mus musculus
caccgtccttataaatagcctgcaa

SEQ ID NO: 306027 - DNA, 25 bp, Mus musculus
caccgtccttattaatagcctgcaa

SEQ ID NO: 306028 - DNA, 25 bp, Mus musculus
caccgtctaattattgatcatgaac

SEQ ID NO: 306029 - DNA, 25 bp, Mus musculus
caccgtctaatttttgatcatgaac

SEQ ID NO: 306030 - DNA, 25 bp, Mus musculus
caccgtctgcctacattattgaaac

SEQ ID NO: 306031 - DNA, 25 bp, Mus musculus
caccgtctgccttcattattgaaac

SEQ ID NO: 306032 - DNA, 25 bp, Mus musculus
caccgtcttattcctttcatagtta

SEQ ID NO: 306033 - DNA, 25 bp, Mus musculus
caccgtcttattgctttcatagtta

SEQ ID NO: 306034 - DNA, 25 bp, Mus musculus
caccgtcttttacccaagcgatgga

SEQ ID NO: 306035 - DNA, 25 bp, Mus musculus
caccgtcttttagccaagcgatgga

SEQ ID NO: 306036 - DNA, 25 bp, Mus musculus
caccgtgagttaattattggcagca

SEQ ID NO: 306037 - DNA, 25 bp, Mus musculus
caccgtgagttatttattggcagca

SEQ ID NO: 306038 - DNA, 25 bp, Mus musculus
caccgtgccaccctgaagtgggaaa

SEQ ID NO: 306039 - DNA, 25 bp, Mus musculus
caccgtgccaccgtgaagtgggaaa

SEQ ID NO: 306040 - DNA, 25 bp, Mus musculus
caccgtgcccagctgtattaagaat

SEQ ID NO: 306041 - DNA, 25 bp, Mus musculus
caccgtgcccaggtgtattaagaat

SEQ ID NO: 306042 - DNA, 25 bp, Mus musculus
caccgtgctcaactactatgtatgg

SEQ ID NO: 306043 - DNA, 25 bp, Mus musculus
caccgtgctcaagtactatgtatgg

SEQ ID NO: 306044 - DNA, 25 bp, Mus musculus
caccgtggaagaccctgaatttaaa

SEQ ID NO: 306045 - DNA, 25 bp, Mus musculus
caccgtggaagagcctgaatttaaa

SEQ ID NO: 306046 - DNA, 25 bp, Mus musculus
caccgtgggtgtcggatgccttctt

SEQ ID NO: 306047 - DNA, 25 bp, Mus musculus
caccgtgggtgtgggatgccttctt

SEQ ID NO: 306048 - DNA, 25 bp, Mus musculus
caccgtggtgacactggtggacatg

SEQ ID NO: 306049 - DNA, 25 bp, Mus musculus
caccgtggtgactctggtggacatg

SEQ ID NO: 306050 - DNA, 25 bp, Mus musculus
caccgtggtttcacagttgtttgtt

SEQ ID NO: 306051 - DNA, 25 bp, Mus musculus
caccgtggtttctcagttgtttgtt

SEQ ID NO: 306052 - DNA, 25 bp, Mus musculus
caccgtgtacttcagctccatagta

SEQ ID NO: 306053 - DNA, 25 bp, Mus musculus
caccgtgtacttgagctccatagta

SEQ ID NO: 306054 - DNA, 25 bp, Mus musculus
caccgtgtctctaaaagtcaaccct

SEQ ID NO: 306055 - DNA, 25 bp, Mus musculus
caccgtgtctcttaaagtcaaccct

SEQ ID NO: 306056 - DNA, 25 bp, Mus musculus
caccgtgtgcatctaatggccaaga

SEQ ID NO: 306057 - DNA, 25 bp, Mus musculus
caccgtgtgcatgtaatggccaaga

SEQ ID NO: 306058 - DNA, 25 bp, Mus musculus
caccgtgtggcgctgggacaaggac

SEQ ID NO: 306059 - DNA, 25 bp, Mus musculus
caccgtgtggcggtgggacaaggac

SEQ ID NO: 306060 - DNA, 25 bp, Mus musculus
caccgtgtgtttcgcagcagagtac

SEQ ID NO: 306061 - DNA, 25 bp, Mus musculus
caccgtgtgtttggcagcagagtac

SEQ ID NO: 306062 - DNA, 25 bp, Mus musculus
caccgtgttgatagtctgacttctg

SEQ ID NO: 306063 - DNA, 25 bp, Mus musculus
caccgtgttgattgtctgacttctg

SEQ ID NO: 306064 - DNA, 25 bp, Mus musculus
caccgtgtttgtcactactacagca

SEQ ID NO: 306065 - DNA, 25 bp, Mus musculus
caccgtgtttgtgactactacagca

SEQ ID NO: 306066 - DNA, 25 bp, Mus musculus
caccgttatctaatcctgggtcaga

SEQ ID NO: 306067 - DNA, 25 bp, Mus musculus
caccgttatctattcctgggtcaga

SEQ ID NO: 306068 - DNA, 25 bp, Mus musculus
caccgttcctctcttttgaaactct

SEQ ID NO: 306069 - DNA, 25 bp, Mus musculus
caccgttcctctgttttgaaactct

SEQ ID NO: 306070 - DNA, 25 bp, Mus musculus
caccgttggtttcatgtcatcttcc

SEQ ID NO: 306071 - DNA, 25 bp, Mus musculus
caccgttggtttgatgtcatcttcc

SEQ ID NO: 306072 - DNA, 25 bp, Mus musculus
caccgtttcagaatcctatcaggac

SEQ ID NO: 306073 - DNA, 25 bp, Mus musculus
caccgtttcagattcctatcaggac

SEQ ID NO: 306074 - DNA, 25 bp, Mus musculus
caccgtttcccaaagtacacatgta

SEQ ID NO: 306075 - DNA, 25 bp, Mus musculus
caccgtttcccatagtacacatgta

SEQ ID NO: 306076 - DNA, 25 bp, Mus musculus
cacctaaaccagctgggacacacgg

SEQ ID NO: 306077 - DNA, 25 bp, Mus musculus
cacctaaaccaggtgggacacacgg

SEQ ID NO: 306078 - DNA, 25 bp, Mus musculus
cacctaaactgtctttcttactggc

SEQ ID NO: 306079 - DNA, 25 bp, Mus musculus
cacctaaactgtgtttcttactggc

SEQ ID NO: 306080 - DNA, 25 bp, Mus musculus
cacctaaagagaagcaatggctcct

SEQ ID NO: 306081 - DNA, 25 bp, Mus musculus
cacctaaagagatgcaatggctcct

SEQ ID NO: 306082 - DNA, 25 bp, Mus musculus
cacctaaatgaaactgatgagttct

SEQ ID NO: 306083 - DNA, 25 bp, Mus musculus
cacctaaatgaatctgatgagttct

SEQ ID NO: 306084 - DNA, 25 bp, Mus musculus
cacctaacactccatatgtggcaga

SEQ ID NO: 306085 - DNA, 25 bp, Mus musculus
cacctaacactcgatatgtggcaga

SEQ ID NO: 306086 - DNA, 25 bp, Mus musculus
cacctaacgtcacctactgtacatt

SEQ ID NO: 306087 - DNA, 25 bp, Mus musculus
cacctaacgtcagctactgtacatt

SEQ ID NO: 306088 - DNA, 25 bp, Mus musculus
cacctaagctgaactcatattgtta

SEQ ID NO: 306089 - DNA, 25 bp, Mus musculus
cacctaagctgatctcatattgtta

SEQ ID NO: 306090 - DNA, 25 bp, Mus musculus
cacctaaggcatatgatgttcatgt

SEQ ID NO: 306091 - DNA, 25 bp, Mus musculus
cacctaaggcatttgatgttcatgt

SEQ ID NO: 306092 - DNA, 25 bp, Mus musculus
cacctaagggtaattgggtagcaca

SEQ ID NO: 306093 - DNA, 25 bp, Mus musculus
cacctaagggtatttgggtagcaca

SEQ ID NO: 306094 - DNA, 25 bp, Mus musculus
cacctacaatgaattctcaccctac

SEQ ID NO: 306095 - DNA, 25 bp, Mus musculus
cacctacaatgatttctcaccctac

SEQ ID NO: 306096 - DNA, 25 bp, Mus musculus
cacctacacgtgcttcacaaacatt

SEQ ID NO: 306097 - DNA, 25 bp, Mus musculus
cacctacacgtggttcacaaacatt

SEQ ID NO: 306098 - DNA, 25 bp, Mus musculus
cacctacacttgagtgctttaaaag

SEQ ID NO: 306099 - DNA, 25 bp, Mus musculus
cacctacacttgtgtgctttaaaag

SEQ ID NO: 306100 - DNA, 25 bp, Mus musculus
cacctacagatccctatttccgatg

SEQ ID NO: 306101 - DNA, 25 bp, Mus musculus
cacctacagatcgctatttccgatg

SEQ ID NO: 306102 - DNA, 25 bp, Mus musculus
cacctacatctccatgaccatggtg

SEQ ID NO: 306103 - DNA, 25 bp, Mus musculus
cacctacatctcgatgaccatggtg

SEQ ID NO: 306104 - DNA, 25 bp, Mus musculus
cacctacattttacctctctaaatc

SEQ ID NO: 306105 - DNA, 25 bp, Mus musculus
cacctacatttttcctctctaaatc

SEQ ID NO: 306106 - DNA, 25 bp, Mus musculus
cacctaccagagactaccagtgtaa

SEQ ID NO: 306107 - DNA, 25 bp, Mus musculus
cacctaccagagtctaccagtgtaa

SEQ ID NO: 306108 - DNA, 25 bp, Mus musculus
cacctaccagtgattacggaatcct

SEQ ID NO: 306109 - DNA, 25 bp, Mus musculus
cacctaccagtgtttacggaatcct

SEQ ID NO: 306110 - DNA, 25 bp, Mus musculus
cacctacctcccaagagttaagatt

SEQ ID NO: 306111 - DNA, 25 bp, Mus musculus
cacctacctccctagagttaagatt

SEQ ID NO: 306112 - DNA, 25 bp, Mus musculus
cacctaccttgcacggattgaggag

SEQ ID NO: 306113 - DNA, 25 bp, Mus musculus
cacctaccttgctcggattgaggag

SEQ ID NO: 306114 - DNA, 25 bp, Mus musculus
cacctacgcgttagagagtctgtgc

SEQ ID NO: 306115 - DNA, 25 bp, Mus musculus
cacctacgcgtttgagagtctgtgc

SEQ ID NO: 306116 - DNA, 25 bp, Mus musculus
cacctacgtgtgcactttcaatctg

SEQ ID NO: 306117 - DNA, 25 bp, Mus musculus
cacctacgtgtggactttcaatctg

SEQ ID NO: 306118 - DNA, 25 bp, Mus musculus
cacctactgactagcaatttaaggg

SEQ ID NO: 306119 - DNA, 25 bp, Mus musculus
cacctactgacttgcaatttaaggg

SEQ ID NO: 306120 - DNA, 25 bp, Mus musculus
cacctactgtctcttatttgctttt

SEQ ID NO: 306121 - DNA, 25 bp, Mus musculus
cacctactgtctgttatttgctttt

SEQ ID NO: 306122 - DNA, 25 bp, Mus musculus
cacctacttcccagaggtagaacag

SEQ ID NO: 306123 - DNA, 25 bp, Mus musculus
cacctacttccctgaggtagaacag

SEQ ID NO: 306124 - DNA, 25 bp, Mus musculus
cacctactttatctcttaatttcaa

SEQ ID NO: 306125 - DNA, 25 bp, Mus musculus
cacctactttatgtcttaatttcaa

SEQ ID NO: 306126 - DNA, 25 bp, Mus musculus
cacctagaacaacaaccctgggatt

SEQ ID NO: 306127 - DNA, 25 bp, Mus musculus
cacctagaacaagaaccctgggatt

SEQ ID NO: 306128 - DNA, 25 bp, Mus musculus
cacctagaagttatagcctggacat

SEQ ID NO: 306129 - DNA, 25 bp, Mus musculus
cacctagaagttttagcctggacat

SEQ ID NO: 306130 - DNA, 25 bp, Mus musculus
cacctagaggagctcctgcgcaaaa

SEQ ID NO: 306131 - DNA, 25 bp, Mus musculus
cacctagaggaggtcctgcgcaaaa

SEQ ID NO: 306132 - DNA, 25 bp, Mus musculus
cacctagctgaaagtttttctaaag

SEQ ID NO: 306133 - DNA, 25 bp, Mus musculus
cacctagctgaatgtttttctaaag

SEQ ID NO: 306134 - DNA, 25 bp, Mus musculus
cacctagcttccctgttggtaagaa

SEQ ID NO: 306135 - DNA, 25 bp, Mus musculus
cacctagcttccgtgttggtaagaa

SEQ ID NO: 306136 - DNA, 25 bp, Mus musculus
cacctagctttgctttctcaaccag

SEQ ID NO: 306137 - DNA, 25 bp, Mus musculus
cacctagctttggtttctcaaccag

SEQ ID NO: 306138 - DNA, 25 bp, Mus musculus
cacctaggcagtcccactgaggctg

SEQ ID NO: 306139 - DNA, 25 bp, Mus musculus
cacctaggcagtgccactgaggctg

SEQ ID NO: 306140 - DNA, 25 bp, Mus musculus
cacctagggttgatatgattttaat

SEQ ID NO: 306141 - DNA, 25 bp, Mus musculus
cacctagggttgttatgattttaat

SEQ ID NO: 306142 - DNA, 25 bp, Mus musculus
cacctaggtcctcagtcaaagaaaa

SEQ ID NO: 306143 - DNA, 25 bp, Mus musculus
cacctaggtcctgagtcaaagaaaa

SEQ ID NO: 306144 - DNA, 25 bp, Mus musculus
cacctagtcactcagtggcttgata

SEQ ID NO: 306145 - DNA, 25 bp, Mus musculus
cacctagtcactgagtggcttgata

SEQ ID NO: 306146 - DNA, 25 bp, Mus musculus
cacctataggtgcttttgcccgaat

SEQ ID NO: 306147 - DNA, 25 bp, Mus musculus
cacctataggtggttttgcccgaat

SEQ ID NO: 306148 - DNA, 25 bp, Mus musculus
cacctatcagccatctggagtgtga

SEQ ID NO: 306149 - DNA, 25 bp, Mus musculus
cacctatcagcccagatacttgcta

SEQ ID NO: 306150 - DNA, 25 bp, Mus musculus
cacctatcagccgagatacttgcta

SEQ ID NO: 306151 - DNA, 25 bp, Mus musculus
cacctatcagccttctggagtgtga

SEQ ID NO: 306152 - DNA, 25 bp, Mus musculus
cacctatgaccgcaaggacattgag

SEQ ID NO: 306153 - DNA, 25 bp, Mus musculus
cacctatgaccggaaggacattgag

SEQ ID NO: 306154 - DNA, 25 bp, Mus musculus
cacctatgaggtacgcatgcggaca

SEQ ID NO: 306155 - DNA, 25 bp, Mus musculus
cacctatgaggttcgcatgcggaca

SEQ ID NO: 306156 - DNA, 25 bp, Mus musculus
cacctatggataacctcaggcagat

SEQ ID NO: 306157 - DNA, 25 bp, Mus musculus
cacctatggatatcctcaggcagat

SEQ ID NO: 306158 - DNA, 25 bp, Mus musculus
cacctattgctgctttgaatgtgat

SEQ ID NO: 306159 - DNA, 25 bp, Mus musculus
cacctattgctggtttgaatgtgat

SEQ ID NO: 306160 - DNA, 25 bp, Mus musculus
cacctatttactacgcacaggcccc

SEQ ID NO: 306161 - DNA, 25 bp, Mus musculus
cacctatttacttcgcacaggcccc

SEQ ID NO: 306162 - DNA, 25 bp, Mus musculus
cacctatttattagtggctcccaaa

SEQ ID NO: 306163 - DNA, 25 bp, Mus musculus
cacctatttatttgtggctcccaaa

SEQ ID NO: 306164 - DNA, 25 bp, Mus musculus
cacctcaactctacacacaaatata

SEQ ID NO: 306165 - DNA, 25 bp, Mus musculus
cacctcaactcttcacacaaatata

SEQ ID NO: 306166 - DNA, 25 bp, Mus musculus
cacctcaagtccaagctggtagatg

SEQ ID NO: 306167 - DNA, 25 bp, Mus musculus
cacctcaagtcctagctggtagatg

SEQ ID NO: 306168 - DNA, 25 bp, Mus musculus
cacctcacaccgctttatagtaagg

SEQ ID NO: 306169 - DNA, 25 bp, Mus musculus
cacctcacaccggtttatagtaagg

SEQ ID NO: 306170 - DNA, 25 bp, Mus musculus
cacctcacaggaactagctggctat

SEQ ID NO: 306171 - DNA, 25 bp, Mus musculus
cacctcacaggatctagctggctat

SEQ ID NO: 306172 - DNA, 25 bp, Mus musculus
cacctcaccagcattatggctttat

SEQ ID NO: 306173 - DNA, 25 bp, Mus musculus
cacctcaccagctttatggctttat

SEQ ID NO: 306174 - DNA, 25 bp, Mus musculus
cacctcacctacacttgcaagaagg

SEQ ID NO: 306175 - DNA, 25 bp, Mus musculus
cacctcacctactcttgcaagaagg

SEQ ID NO: 306176 - DNA, 25 bp, Mus musculus
cacctcactcatctaaacctttgat

SEQ ID NO: 306177 - DNA, 25 bp, Mus musculus
cacctcactcatgtaaacctttgat

SEQ ID NO: 306178 - DNA, 25 bp, Mus musculus
cacctcactgtccttttatgtaact

SEQ ID NO: 306179 - DNA, 25 bp, Mus musculus
cacctcactgtcgttttatgtaact

SEQ ID NO: 306180 - DNA, 25 bp, Mus musculus
cacctcactgttactgggattctgt

SEQ ID NO: 306181 - DNA, 25 bp, Mus musculus
cacctcactgtttctgggattctgt

SEQ ID NO: 306182 - DNA, 25 bp, Mus musculus
cacctcagagagctctgtgttggga

SEQ ID NO: 306183 - DNA, 25 bp, Mus musculus
cacctcagagaggtctgtgttggga

SEQ ID NO: 306184 - DNA, 25 bp, Mus musculus
cacctcagagctctgattttatcta

SEQ ID NO: 306185 - DNA, 25 bp, Mus musculus
cacctcagagctgtgattttatcta

SEQ ID NO: 306186 - DNA, 25 bp, Mus musculus
cacctcaggagcaccttaggcaata

SEQ ID NO: 306187 - DNA, 25 bp, Mus musculus
cacctcaggagctccttaggcaata

SEQ ID NO: 306188 - DNA, 25 bp, Mus musculus
cacctcaggaggagcagtgcttcac

SEQ ID NO: 306189 - DNA, 25 bp, Mus musculus
cacctcaggaggtgcagtgcttcac

SEQ ID NO: 306190 - DNA, 25 bp, Mus musculus
cacctcagtcaaaattccctacaaa

SEQ ID NO: 306191 - DNA, 25 bp, Mus musculus
cacctcagtcaatattccctacaaa

SEQ ID NO: 306192 - DNA, 25 bp, Mus musculus
cacctcagtctacccttttgttaaa

SEQ ID NO: 306193 - DNA, 25 bp, Mus musculus
cacctcagtctagccttttgttaaa

SEQ ID NO: 306194 - DNA, 25 bp, Mus musculus
cacctcagtggacctctggatggtt

SEQ ID NO: 306195 - DNA, 25 bp, Mus musculus
cacctcagtggagctctggatggtt

SEQ ID NO: 306196 - DNA, 25 bp, Mus musculus
cacctcataggtagctgagattaca

SEQ ID NO: 306197 - DNA, 25 bp, Mus musculus
cacctcataggttgctgagattaca

SEQ ID NO: 306198 - DNA, 25 bp, Mus musculus
cacctcatcaggattgtgcctgctg

SEQ ID NO: 306199 - DNA, 25 bp, Mus musculus
cacctcatcaggtttgtgcctgctg

SEQ ID NO: 306200 - DNA, 25 bp, Mus musculus
cacctcatccttatctggtgagacc

SEQ ID NO: 306201 - DNA, 25 bp, Mus musculus
cacctcatccttttctggtgagacc

SEQ ID NO: 306202 - DNA, 25 bp, Mus musculus
cacctcatctcacccaagagtattt

SEQ ID NO: 306203 - DNA, 25 bp, Mus musculus
cacctcatctcagccaagagtattt

SEQ ID NO: 306204 - DNA, 25 bp, Mus musculus
cacctcatggcaccattttctttaa

SEQ ID NO: 306205 - DNA, 25 bp, Mus musculus
cacctcatggcagcattttctttaa

SEQ ID NO: 306206 - DNA, 25 bp, Mus musculus
cacctcattaggcagctgctttgaa

SEQ ID NO: 306207 - DNA, 25 bp, Mus musculus
cacctcattagggagctgctttgaa

SEQ ID NO: 306208 - DNA, 25 bp, Mus musculus
cacctccacaatagggtcacacaat

SEQ ID NO: 306209 - DNA, 25 bp, Mus musculus
cacctccacaattgggtcacacaat

SEQ ID NO: 306210 - DNA, 25 bp, Mus musculus
cacctccacatcacaattgctatga

SEQ ID NO: 306211 - DNA, 25 bp, Mus musculus
cacctccacatctcaattgctatga

SEQ ID NO: 306212 - DNA, 25 bp, Mus musculus
cacctccactctactataacttagt

SEQ ID NO: 306213 - DNA, 25 bp, Mus musculus
cacctccactcttctataacttagt

SEQ ID NO: 306214 - DNA, 25 bp, Mus musculus
cacctccagttccacacatagaagt

SEQ ID NO: 306215 - DNA, 25 bp, Mus musculus
cacctccagttcgacacatagaagt

SEQ ID NO: 306216 - DNA, 25 bp, Mus musculus
cacctccatgacaagaagcttctgc

SEQ ID NO: 306217 - DNA, 25 bp, Mus musculus
cacctccatgactagaagcttctgc

SEQ ID NO: 306218 - DNA, 25 bp, Mus musculus
cacctccatgtcacagcagtttata

SEQ ID NO: 306219 - DNA, 25 bp, Mus musculus
cacctccatgtctcagcagtttata

SEQ ID NO: 306220 - DNA, 25 bp, Mus musculus
cacctccattttccattttcaatta

SEQ ID NO: 306221 - DNA, 25 bp, Mus musculus
cacctccattttcctatgactgtta

SEQ ID NO: 306222 - DNA, 25 bp, Mus musculus
cacctccattttgcattttcaatta

SEQ ID NO: 306223 - DNA, 25 bp, Mus musculus
cacctccattttgctatgactgtta

SEQ ID NO: 306224 - DNA, 25 bp, Mus musculus
cacctcccagagcagctcagctaga

SEQ ID NO: 306225 - DNA, 25 bp, Mus musculus
cacctcccagaggagctcagctaga

SEQ ID NO: 306226 - DNA, 25 bp, Mus musculus
cacctcccatcaagtacacgtatat

SEQ ID NO: 306227 - DNA, 25 bp, Mus musculus
cacctcccatcatgtacacgtatat

SEQ ID NO: 306228 - DNA, 25 bp, Mus musculus
cacctcccctttaaaatgcttgatt

SEQ ID NO: 306229 - DNA, 25 bp, Mus musculus
cacctccccttttaaatgcttgatt

SEQ ID NO: 306230 - DNA, 25 bp, Mus musculus
cacctccctgagacttacttttgaa

SEQ ID NO: 306231 - DNA, 25 bp, Mus musculus
cacctccctgagtcttacttttgaa

SEQ ID NO: 306232 - DNA, 25 bp, Mus musculus
cacctccctgcacagctttggaata

SEQ ID NO: 306233 - DNA, 25 bp, Mus musculus
cacctccctgcagagctttggaata

SEQ ID NO: 306234 - DNA, 25 bp, Mus musculus
cacctccctggtacctactttgatt

SEQ ID NO: 306235 - DNA, 25 bp, Mus musculus
cacctccctggttcctactttgatt

SEQ ID NO: 306236 - DNA, 25 bp, Mus musculus
cacctccggaggcaactaatgttct

SEQ ID NO: 306237 - DNA, 25 bp, Mus musculus
cacctccggagggaactaatgttct

SEQ ID NO: 306238 - DNA, 25 bp, Mus musculus
cacctcctaatccatctcaaataga

SEQ ID NO: 306239 - DNA, 25 bp, Mus musculus
cacctcctaatcgatctcaaataga

SEQ ID NO: 306240 - DNA, 25 bp, Mus musculus
cacctcctcagaagctagagggcta

SEQ ID NO: 306241 - DNA, 25 bp, Mus musculus
cacctcctcagatgctagagggcta

SEQ ID NO: 306242 - DNA, 25 bp, Mus musculus
cacctcctgatcctttctaaacatt

SEQ ID NO: 306243 - DNA, 25 bp, Mus musculus
cacctcctgatcgtttctaaacatt

SEQ ID NO: 306244 - DNA, 25 bp, Mus musculus
cacctcctgcagctctaatgtaaat

SEQ ID NO: 306245 - DNA, 25 bp, Mus musculus
cacctcctgcaggtctaatgtaaat

SEQ ID NO: 306246 - DNA, 25 bp, Mus musculus
cacctcctgctaaaggtcagaaggg

SEQ ID NO: 306247 - DNA, 25 bp, Mus musculus
cacctcctgctataggtcagaaggg

SEQ ID NO: 306248 - DNA, 25 bp, Mus musculus
cacctcctgtagaactcgcaatttt

SEQ ID NO: 306249 - DNA, 25 bp, Mus musculus
cacctcctgtagtactcgcaatttt

SEQ ID NO: 306250 - DNA, 25 bp, Mus musculus
cacctcctgttaaaggtcagaaggg

SEQ ID NO: 306251 - DNA, 25 bp, Mus musculus
cacctcctgttataggtcagaaggg

SEQ ID NO: 306252 - DNA, 25 bp, Mus musculus
cacctccttccgctatttgtacata

SEQ ID NO: 306253 - DNA, 25 bp, Mus musculus
cacctccttccggtatttgtacata

SEQ ID NO: 306254 - DNA, 25 bp, Mus musculus
cacctcctttagagtctgggctaag

SEQ ID NO: 306255 - DNA, 25 bp, Mus musculus
cacctcctttagtgtctgggctaag

SEQ ID NO: 306256 - DNA, 25 bp, Mus musculus
cacctcggaccgagtctatgagaaa

SEQ ID NO: 306257 - DNA, 25 bp, Mus musculus
cacctcggaccgtgtctatgagaaa

SEQ ID NO: 306258 - DNA, 25 bp, Mus musculus
cacctcggtgctcaacaggtatttt

SEQ ID NO: 306259 - DNA, 25 bp, Mus musculus
cacctcggtgctgaacaggtatttt

SEQ ID NO: 306260 - DNA, 25 bp, Mus musculus
cacctcggtggaaacctgtcagaga

SEQ ID NO: 306261 - DNA, 25 bp, Mus musculus
cacctcggtggatacctgtcagaga

SEQ ID NO: 306262 - DNA, 25 bp, Mus musculus
cacctcggtttgcttaactttagat

SEQ ID NO: 306263 - DNA, 25 bp, Mus musculus
cacctcggtttggttaactttagat

SEQ ID NO: 306264 - DNA, 25 bp, Mus musculus
cacctcgtagaaagcttactcaata

SEQ ID NO: 306265 - DNA, 25 bp, Mus musculus
cacctcgtagaatgcttactcaata

SEQ ID NO: 306266 - DNA, 25 bp, Mus musculus
cacctctaagctccacttaatctta

SEQ ID NO: 306267 - DNA, 25 bp, Mus musculus
cacctctaagctgcacttaatctta

SEQ ID NO: 306268 - DNA, 25 bp, Mus musculus
cacctctcaaagaactcttgaatga

SEQ ID NO: 306269 - DNA, 25 bp, Mus musculus
cacctctcaaagtactcttgaatga

SEQ ID NO: 306270 - DNA, 25 bp, Mus musculus
cacctctcaacccttgtcaaaagaa

SEQ ID NO: 306271 - DNA, 25 bp, Mus musculus
cacctctcaaccgttgtcaaaagaa

SEQ ID NO: 306272 - DNA, 25 bp, Mus musculus
cacctctcctggaactaacagaagt

SEQ ID NO: 306273 - DNA, 25 bp, Mus musculus
cacctctcctggaagtcatactaaa

SEQ ID NO: 306274 - DNA, 25 bp, Mus musculus
cacctctcctggtactaacagaagt

SEQ ID NO: 306275 - DNA, 25 bp, Mus musculus
cacctctcctggtagtcatactaaa

SEQ ID NO: 306276 - DNA, 25 bp, Mus musculus
cacctctcgaataatggatcccaac

SEQ ID NO: 306277 - DNA, 25 bp, Mus musculus
cacctctcgaattatggatcccaac

SEQ ID NO: 306278 - DNA, 25 bp, Mus musculus
cacctctcgattcagctgattggca

SEQ ID NO: 306279 - DNA, 25 bp, Mus musculus
cacctctcgattgagctgattggca

SEQ ID NO: 306280 - DNA, 25 bp, Mus musculus
cacctctcgctcatgcattttaaga

SEQ ID NO: 306281 - DNA, 25 bp, Mus musculus
cacctctcgctcttgcattttaaga

SEQ ID NO: 306282 - DNA, 25 bp, Mus musculus
cacctctcggctcagaatatagaag

SEQ ID NO: 306283 - DNA, 25 bp, Mus musculus
cacctctcggctgagaatatagaag

SEQ ID NO: 306284 - DNA, 25 bp, Mus musculus
cacctctctacacacgtggattata

SEQ ID NO: 306285 - DNA, 25 bp, Mus musculus
cacctctctacagacgtggattata

SEQ ID NO: 306286 - DNA, 25 bp, Mus musculus
cacctctcttgccagtgactgaagg

SEQ ID NO: 306287 - DNA, 25 bp, Mus musculus
cacctctcttgcgagtgactgaagg

SEQ ID NO: 306288 - DNA, 25 bp, Mus musculus
cacctctgactcacagtttcatgaa

SEQ ID NO: 306289 - DNA, 25 bp, Mus musculus
cacctctgactctcagtttcatgaa

SEQ ID NO: 306290 - DNA, 25 bp, Mus musculus
cacctctgctacacttattgtcaaa

SEQ ID NO: 306291 - DNA, 25 bp, Mus musculus
cacctctgctactcttattgtcaaa

SEQ ID NO: 306292 - DNA, 25 bp, Mus musculus
cacctctgctagcatgccatcagta

SEQ ID NO: 306293 - DNA, 25 bp, Mus musculus
cacctctgctaggatgccatcagta

SEQ ID NO: 306294 - DNA, 25 bp, Mus musculus
cacctctggtgtagggagaacatat

SEQ ID NO: 306295 - DNA, 25 bp, Mus musculus
cacctctggtgttgggagaacatat

SEQ ID NO: 306296 - DNA, 25 bp, Mus musculus
cacctctgtaggagtcaccttgtta

SEQ ID NO: 306297 - DNA, 25 bp, Mus musculus
cacctctgtaggtgtcaccttgtta

SEQ ID NO: 306298 - DNA, 25 bp, Mus musculus
cacctctgtatcatgcagttaaaat

SEQ ID NO: 306299 - DNA, 25 bp, Mus musculus
cacctctgtatcttgcagttaaaat

SEQ ID NO: 306300 - DNA, 25 bp, Mus musculus
cacctcttaattcagctacgtcaaa

SEQ ID NO: 306301 - DNA, 25 bp, Mus musculus
cacctcttaattgagctacgtcaaa

SEQ ID NO: 306302 - DNA, 25 bp, Mus musculus
cacctcttagcccatttgttttctc

SEQ ID NO: 306303 - DNA, 25 bp, Mus musculus
cacctcttagccgatttgttttctc

SEQ ID NO: 306304 - DNA, 25 bp, Mus musculus
cacctcttaggcaccattgtaatca

SEQ ID NO: 306305 - DNA, 25 bp, Mus musculus
cacctcttaggctccattgtaatca

SEQ ID NO: 306306 - DNA, 25 bp, Mus musculus
cacctcttccttatattgtctctga

SEQ ID NO: 306307 - DNA, 25 bp, Mus musculus
cacctcttccttttattgtctctga

SEQ ID NO: 306308 - DNA, 25 bp, Mus musculus
cacctcttcgtcaccggagaaaaat

SEQ ID NO: 306309 - DNA, 25 bp, Mus musculus
cacctcttcgtctccggagaaaaat

SEQ ID NO: 306310 - DNA, 25 bp, Mus musculus
cacctcttctgcattcacctgaaaa

SEQ ID NO: 306311 - DNA, 25 bp, Mus musculus
cacctcttctgctttcacctgaaaa

SEQ ID NO: 306312 - DNA, 25 bp, Mus musculus
cacctctttaatcttggctctgatt

SEQ ID NO: 306313 - DNA, 25 bp, Mus musculus
cacctctttaatgttggctctgatt

SEQ ID NO: 306314 - DNA, 25 bp, Mus musculus
cacctctttacgaatatgatgtggc

SEQ ID NO: 306315 - DNA, 25 bp, Mus musculus
cacctctttacgtatatgatgtggc

SEQ ID NO: 306316 - DNA, 25 bp, Mus musculus
cacctctttatgctgtagtttcaca

SEQ ID NO: 306317 - DNA, 25 bp, Mus musculus
cacctctttatggtgtagtttcaca

SEQ ID NO: 306318 - DNA, 25 bp, Mus musculus
cacctctttcccctcatggtatgat

SEQ ID NO: 306319 - DNA, 25 bp, Mus musculus
cacctctttcccgtcatggtatgat

SEQ ID NO: 306320 - DNA, 25 bp, Mus musculus
cacctctttcctaatcagggataag

SEQ ID NO: 306321 - DNA, 25 bp, Mus musculus
cacctctttccttatcagggataag

SEQ ID NO: 306322 - DNA, 25 bp, Mus musculus
cacctctttggtctacatttgtaca

SEQ ID NO: 306323 - DNA, 25 bp, Mus musculus
cacctctttggtgtacatttgtaca

SEQ ID NO: 306324 - DNA, 25 bp, Mus musculus
cacctctttgttacagtgctgtgga

SEQ ID NO: 306325 - DNA, 25 bp, Mus musculus
cacctctttgtttcagtgctgtgga

SEQ ID NO: 306326 - DNA, 25 bp, Mus musculus
cacctgaaacagctattccatactt

SEQ ID NO: 306327 - DNA, 25 bp, Mus musculus
cacctgaaacaggtattccatactt

SEQ ID NO: 306328 - DNA, 25 bp, Mus musculus
cacctgaattcaaacccctggagat

SEQ ID NO: 306329 - DNA, 25 bp, Mus musculus
cacctgaattcatacccctggagat

SEQ ID NO: 306330 - DNA, 25 bp, Mus musculus
cacctgacctggctgtagacagctg

SEQ ID NO: 306331 - DNA, 25 bp, Mus musculus
cacctgacctgggtgtagacagctg

SEQ ID NO: 306332 - DNA, 25 bp, Mus musculus
cacctgactatcagaatgccttgag

SEQ ID NO: 306333 - DNA, 25 bp, Mus musculus
cacctgactatctgaatgccttgag

SEQ ID NO: 306334 - DNA, 25 bp, Mus musculus
cacctgactctgagttatgtctaac

SEQ ID NO: 306335 - DNA, 25 bp, Mus musculus
cacctgactctgtgttatgtctaac

SEQ ID NO: 306336 - DNA, 25 bp, Mus musculus
cacctgagaagccttgatatcaaaa

SEQ ID NO: 306337 - DNA, 25 bp, Mus musculus
cacctgagaagcgttgatatcaaaa

SEQ ID NO: 306338 - DNA, 25 bp, Mus musculus
cacctgaggaagactacggactgat

SEQ ID NO: 306339 - DNA, 25 bp, Mus musculus
cacctgaggaagtctacggactgat

SEQ ID NO: 306340 - DNA, 25 bp, Mus musculus
cacctgaggaggacatccttgctta

SEQ ID NO: 306341 - DNA, 25 bp, Mus musculus
cacctgaggaggtcatccttgctta

SEQ ID NO: 306342 - DNA, 25 bp, Mus musculus
cacctgaggcttaggttgtagcaca

SEQ ID NO: 306343 - DNA, 25 bp, Mus musculus
cacctgaggctttggttgtagcaca

SEQ ID NO: 306344 - DNA, 25 bp, Mus musculus
cacctgagggtgagcgactcctgta

SEQ ID NO: 306345 - DNA, 25 bp, Mus musculus
cacctgagggtgtgcgactcctgta

SEQ ID NO: 306346 - DNA, 25 bp, Mus musculus
cacctgaggtcccttcgtgagaaga

SEQ ID NO: 306347 - DNA, 25 bp, Mus musculus
cacctgaggtccgttcgtgagaaga

SEQ ID NO: 306348 - DNA, 25 bp, Mus musculus
cacctgagtcagagctgttcaaaca

SEQ ID NO: 306349 - DNA, 25 bp, Mus musculus
cacctgagtcagtgctgttcaaaca

SEQ ID NO: 306350 - DNA, 25 bp, Mus musculus
cacctgagttcaatttagtggtccc

SEQ ID NO: 306351 - DNA, 25 bp, Mus musculus
cacctgagttcattttagtggtccc

SEQ ID NO: 306352 - DNA, 25 bp, Mus musculus
cacctgattttaatccttgagtctg

SEQ ID NO: 306353 - DNA, 25 bp, Mus musculus
cacctgattttattccttgagtctg

SEQ ID NO: 306354 - DNA, 25 bp, Mus musculus
cacctgcacaagacttcgtgcagag

SEQ ID NO: 306355 - DNA, 25 bp, Mus musculus
cacctgcacaagtcttcgtgcagag

SEQ ID NO: 306356 - DNA, 25 bp, Mus musculus
cacctgcacagtattcttgggagat

SEQ ID NO: 306357 - DNA, 25 bp, Mus musculus
cacctgcacagttttcttgggagat

SEQ ID NO: 306358 - DNA, 25 bp, Mus musculus
cacctgcaccagaaacatacgaaga

SEQ ID NO: 306359 - DNA, 25 bp, Mus musculus
cacctgcaccagtaacatacgaaga

SEQ ID NO: 306360 - DNA, 25 bp, Mus musculus
cacctgcagcgccaaaaacaacaaa

SEQ ID NO: 306361 - DNA, 25 bp, Mus musculus
cacctgcagcgcgaaaaacaacaaa

SEQ ID NO: 306362 - DNA, 25 bp, Mus musculus
cacctgcagctgagtgatctgaaca

SEQ ID NO: 306363 - DNA, 25 bp, Mus musculus
cacctgcagctgtgtgatctgaaca

SEQ ID NO: 306364 - DNA, 25 bp, Mus musculus
cacctgcagtggcagtatcatatct

SEQ ID NO: 306365 - DNA, 25 bp, Mus musculus
cacctgcagtgggagtatcatatct

SEQ ID NO: 306366 - DNA, 25 bp, Mus musculus
cacctgcatgttattactagcctct

SEQ ID NO: 306367 - DNA, 25 bp, Mus musculus
cacctgcatgtttttactagcctct

SEQ ID NO: 306368 - DNA, 25 bp, Mus musculus
cacctgccaactaggttggtccaag

SEQ ID NO: 306369 - DNA, 25 bp, Mus musculus
cacctgccaacttggttggtccaag

SEQ ID NO: 306370 - DNA, 25 bp, Mus musculus
cacctgccagagagtgaggttggaa

SEQ ID NO: 306371 - DNA, 25 bp, Mus musculus
cacctgccagagtgtgaggttggaa

SEQ ID NO: 306372 - DNA, 25 bp, Mus musculus
cacctgccattgctgtcacagataa

SEQ ID NO: 306373 - DNA, 25 bp, Mus musculus
cacctgccattggtgtcacagataa

SEQ ID NO: 306374 - DNA, 25 bp, Mus musculus
cacctgccctgacatgcacaggtag

SEQ ID NO: 306375 - DNA, 25 bp, Mus musculus
cacctgccctgagatgcacaggtag

SEQ ID NO: 306376 - DNA, 25 bp, Mus musculus
cacctgcctcaacgagtgctagtgt

SEQ ID NO: 306377 - DNA, 25 bp, Mus musculus
cacctgcctcaaggagtgctagtgt

SEQ ID NO: 306378 - DNA, 25 bp, Mus musculus
cacctgcggacactttgtgttcaaa

SEQ ID NO: 306379 - DNA, 25 bp, Mus musculus
cacctgcggacagtttgtgttcaaa

SEQ ID NO: 306380 - DNA, 25 bp, Mus musculus
cacctgcgtgtaagggtcattagca

SEQ ID NO: 306381 - DNA, 25 bp, Mus musculus
cacctgcgtgtatgggtcattagca

SEQ ID NO: 306382 - DNA, 25 bp, Mus musculus
cacctgctaccaattctgaagccaa

SEQ ID NO: 306383 - DNA, 25 bp, Mus musculus
cacctgctaccatttctgaagccaa

SEQ ID NO: 306384 - DNA, 25 bp, Mus musculus
cacctgctagctctgcaaacttagg

SEQ ID NO: 306385 - DNA, 25 bp, Mus musculus
cacctgctagctgtgcaaacttagg

SEQ ID NO: 306386 - DNA, 25 bp, Mus musculus
cacctgctcctcaaattttgatgtg

SEQ ID NO: 306387 - DNA, 25 bp, Mus musculus
cacctgctcctctaattttgatgtg

SEQ ID NO: 306388 - DNA, 25 bp, Mus musculus
cacctgctcgtcatcgacagagagg

SEQ ID NO: 306389 - DNA, 25 bp, Mus musculus
cacctgctcgtcttcgacagagagg

SEQ ID NO: 306390 - DNA, 25 bp, Mus musculus
cacctgctctagatatacacctttg

SEQ ID NO: 306391 - DNA, 25 bp, Mus musculus
cacctgctctagttatacacctttg

SEQ ID NO: 306392 - DNA, 25 bp, Mus musculus
cacctgctgaatacctagggttgga

SEQ ID NO: 306393 - DNA, 25 bp, Mus musculus
cacctgctgaattcctagggttgga

SEQ ID NO: 306394 - DNA, 25 bp, Mus musculus
cacctgctgaccatatgctgagtgg

SEQ ID NO: 306395 - DNA, 25 bp, Mus musculus
cacctgctgaccttatgctgagtgg

SEQ ID NO: 306396 - DNA, 25 bp, Mus musculus
cacctgctgccgattatttacaaag

SEQ ID NO: 306397 - DNA, 25 bp, Mus musculus
cacctgctgccgtttatttacaaag

SEQ ID NO: 306398 - DNA, 25 bp, Mus musculus
cacctgctggacaatggactatcat

SEQ ID NO: 306399 - DNA, 25 bp, Mus musculus
cacctgctggactatggactatcat

SEQ ID NO: 306400 - DNA, 25 bp, Mus musculus
cacctgctggtcagatctagggtca

SEQ ID NO: 306401 - DNA, 25 bp, Mus musculus
cacctgctggtctgatctagggtca

SEQ ID NO: 306402 - DNA, 25 bp, Mus musculus
cacctgcttctcaacctgagagatg

SEQ ID NO: 306403 - DNA, 25 bp, Mus musculus
cacctgcttctctacctgagagatg

SEQ ID NO: 306404 - DNA, 25 bp, Mus musculus
cacctgcttgcacgtataggtgcag

SEQ ID NO: 306405 - DNA, 25 bp, Mus musculus
cacctgcttgcaggtataggtgcag

SEQ ID NO: 306406 - DNA, 25 bp, Mus musculus
cacctgcttgcgaactatacctgag

SEQ ID NO: 306407 - DNA, 25 bp, Mus musculus
cacctgcttgcgtactatacctgag

SEQ ID NO: 306408 - DNA, 25 bp, Mus musculus
cacctgcttgtcacggatactatag

SEQ ID NO: 306409 - DNA, 25 bp, Mus musculus
cacctgcttgtctcggatactatag

SEQ ID NO: 306410 - DNA, 25 bp, Mus musculus
cacctgctttaccattattgtatat

SEQ ID NO: 306411 - DNA, 25 bp, Mus musculus
cacctgctttacgattattgtatat

SEQ ID NO: 306412 - DNA, 25 bp, Mus musculus
cacctggacctgcaacttaaatctt

SEQ ID NO: 306413 - DNA, 25 bp, Mus musculus
cacctggacctggaacttaaatctt

SEQ ID NO: 306414 - DNA, 25 bp, Mus musculus
cacctggacttaactttctttacag

SEQ ID NO: 306415 - DNA, 25 bp, Mus musculus
cacctggacttatctttctttacag

SEQ ID NO: 306416 - DNA, 25 bp, Mus musculus
cacctggagacacaagcaatctctt

SEQ ID NO: 306417 - DNA, 25 bp, Mus musculus
cacctggagacagaagcaatctctt

SEQ ID NO: 306418 - DNA, 25 bp, Mus musculus
cacctggaggtaactgttattcgac

SEQ ID NO: 306419 - DNA, 25 bp, Mus musculus
cacctggaggtatctgttattcgac

SEQ ID NO: 306420 - DNA, 25 bp, Mus musculus
cacctggcatgtagatcttagcatt

SEQ ID NO: 306421 - DNA, 25 bp, Mus musculus
cacctggcatgttgatcttagcatt

SEQ ID NO: 306422 - DNA, 25 bp, Mus musculus
cacctggctaataatcagtcttaat

SEQ ID NO: 306423 - DNA, 25 bp, Mus musculus
cacctggctaattatcagtcttaat

SEQ ID NO: 306424 - DNA, 25 bp, Mus musculus
cacctggctggtatggacaagatgt

SEQ ID NO: 306425 - DNA, 25 bp, Mus musculus
cacctggctggtttggacaagatgt

SEQ ID NO: 306426 - DNA, 25 bp, Mus musculus
cacctggcttccaagttgcttgaac

SEQ ID NO: 306427 - DNA, 25 bp, Mus musculus
cacctggcttcctagttgcttgaac

SEQ ID NO: 306428 - DNA, 25 bp, Mus musculus
cacctggcttggcaacctagttttg

SEQ ID NO: 306429 - DNA, 25 bp, Mus musculus
cacctggcttgggaacctagttttg

SEQ ID NO: 306430 - DNA, 25 bp, Mus musculus
cacctggcttttaattcttgataga

SEQ ID NO: 306431 - DNA, 25 bp, Mus musculus
cacctggctttttattcttgataga

SEQ ID NO: 306432 - DNA, 25 bp, Mus musculus
cacctgggaaaaaatttggctgcct

SEQ ID NO: 306433 - DNA, 25 bp, Mus musculus
cacctgggaaaatatttggctgcct

SEQ ID NO: 306434 - DNA, 25 bp, Mus musculus
cacctgggtatgagtggagacagtt

SEQ ID NO: 306435 - DNA, 25 bp, Mus musculus
cacctgggtatgtgtggagacagtt

SEQ ID NO: 306436 - DNA, 25 bp, Mus musculus
cacctgggtgaccattctttgcatg

SEQ ID NO: 306437 - DNA, 25 bp, Mus musculus
cacctgggtgacgattctttgcatg

SEQ ID NO: 306438 - DNA, 25 bp, Mus musculus
cacctggtccacaaaattcaactca

SEQ ID NO: 306439 - DNA, 25 bp, Mus musculus
cacctggtccactaaattcaactca

SEQ ID NO: 306440 - DNA, 25 bp, Mus musculus
cacctggtctgacaacttatccata

SEQ ID NO: 306441 - DNA, 25 bp, Mus musculus
cacctggtctgagaacttatccata

SEQ ID NO: 306442 - DNA, 25 bp, Mus musculus
cacctggtgctccagtaggattgca

SEQ ID NO: 306443 - DNA, 25 bp, Mus musculus
cacctggtgctcgagtaggattgca

SEQ ID NO: 306444 - DNA, 25 bp, Mus musculus
cacctggtggaacagctgagctgtt

SEQ ID NO: 306445 - DNA, 25 bp, Mus musculus
cacctggtggaagagctgagctgtt

SEQ ID NO: 306446 - DNA, 25 bp, Mus musculus
cacctggtggccactgagcctggtg

SEQ ID NO: 306447 - DNA, 25 bp, Mus musculus
cacctggtggcctctgagcctggtg

SEQ ID NO: 306448 - DNA, 25 bp, Mus musculus
cacctggtggctaacagcatgtaac

SEQ ID NO: 306449 - DNA, 25 bp, Mus musculus
cacctggtggcttacagcatgtaac

SEQ ID NO: 306450 - DNA, 25 bp, Mus musculus
cacctggtggtgcttcaatgtcaca

SEQ ID NO: 306451 - DNA, 25 bp, Mus musculus
cacctggtggtggttcaatgtcaca

SEQ ID NO: 306452 - DNA, 25 bp, Mus musculus
cacctggttggtagtcggaatgact

SEQ ID NO: 306453 - DNA, 25 bp, Mus musculus
cacctggttggttgtcggaatgact

SEQ ID NO: 306454 - DNA, 25 bp, Mus musculus
cacctggttttcagtggatttcgaa

SEQ ID NO: 306455 - DNA, 25 bp, Mus musculus
cacctggttttctgtggatttcgaa

SEQ ID NO: 306456 - DNA, 25 bp, Mus musculus
cacctgtaatctaagcttttatgag

SEQ ID NO: 306457 - DNA, 25 bp, Mus musculus
cacctgtaatcttagcttttatgag

SEQ ID NO: 306458 - DNA, 25 bp, Mus musculus
cacctgtaggcacagcaaccccacc

SEQ ID NO: 306459 - DNA, 25 bp, Mus musculus
cacctgtaggcagagcaaccccacc

SEQ ID NO: 306460 - DNA, 25 bp, Mus musculus
cacctgtatgtccagctccaaggta

SEQ ID NO: 306461 - DNA, 25 bp, Mus musculus
cacctgtatgtcgagctccaaggta

SEQ ID NO: 306462 - DNA, 25 bp, Mus musculus
cacctgtcacctcacttggataaat

SEQ ID NO: 306463 - DNA, 25 bp, Mus musculus
cacctgtcacctgacttggataaat

SEQ ID NO: 306464 - DNA, 25 bp, Mus musculus
cacctgtccagcagtaatgtctgtg

SEQ ID NO: 306465 - DNA, 25 bp, Mus musculus
cacctgtccagctgtaatgtctgtg

SEQ ID NO: 306466 - DNA, 25 bp, Mus musculus
cacctgtcccagcaaaacaatggat

SEQ ID NO: 306467 - DNA, 25 bp, Mus musculus
cacctgtcccagctaggatgctaaa

SEQ ID NO: 306468 - DNA, 25 bp, Mus musculus
cacctgtcccaggaaaacaatggat

SEQ ID NO: 306469 - DNA, 25 bp, Mus musculus
cacctgtcccaggtaggatgctaaa

SEQ ID NO: 306470 - DNA, 25 bp, Mus musculus
cacctgtctaagcttttccaaggac

SEQ ID NO: 306471 - DNA, 25 bp, Mus musculus
cacctgtctaaggttttccaaggac

SEQ ID NO: 306472 - DNA, 25 bp, Mus musculus
cacctgtctcaaccgttgtttagga

SEQ ID NO: 306473 - DNA, 25 bp, Mus musculus
cacctgtctcaagcgttgtttagga

SEQ ID NO: 306474 - DNA, 25 bp, Mus musculus
cacctgtgagatcgaaagtatgcat

SEQ ID NO: 306475 - DNA, 25 bp, Mus musculus
cacctgtgagatggaaagtatgcat

SEQ ID NO: 306476 - DNA, 25 bp, Mus musculus
cacctgtgcactaggaaaaagatga

SEQ ID NO: 306477 - DNA, 25 bp, Mus musculus
cacctgtgcacttggaaaaagatga

SEQ ID NO: 306478 - DNA, 25 bp, Mus musculus
cacctgtgctggcatgaacgttaat

SEQ ID NO: 306479 - DNA, 25 bp, Mus musculus
cacctgtgctgggatgaacgttaat

SEQ ID NO: 306480 - DNA, 25 bp, Mus musculus
cacctgtgcttgacggccctgggag

SEQ ID NO: 306481 - DNA, 25 bp, Mus musculus
cacctgtgcttgtcggccctgggag

SEQ ID NO: 306482 - DNA, 25 bp, Mus musculus
cacctgtggactagggatgctgtca

SEQ ID NO: 306483 - DNA, 25 bp, Mus musculus
cacctgtggacttgggatgctgtca

SEQ ID NO: 306484 - DNA, 25 bp, Mus musculus
cacctgtggatcatcatcgggaaaa

SEQ ID NO: 306485 - DNA, 25 bp, Mus musculus
cacctgtggatcttcatcgggaaaa

SEQ ID NO: 306486 - DNA, 25 bp, Mus musculus
cacctgtggatgagctcggccctag

SEQ ID NO: 306487 - DNA, 25 bp, Mus musculus
cacctgtggatgtgctcggccctag

SEQ ID NO: 306488 - DNA, 25 bp, Mus musculus
cacctgtggccacggagccggcaaa

SEQ ID NO: 306489 - DNA, 25 bp, Mus musculus
cacctgtggccagggagccggcaaa

SEQ ID NO: 306490 - DNA, 25 bp, Mus musculus
cacctgtggcccatattttacacaa

SEQ ID NO: 306491 - DNA, 25 bp, Mus musculus
cacctgtggcccttattttacacaa

SEQ ID NO: 306492 - DNA, 25 bp, Mus musculus
cacctgtgggacacaatgttgccta

SEQ ID NO: 306493 - DNA, 25 bp, Mus musculus
cacctgtgggactcaatgttgccta

SEQ ID NO: 306494 - DNA, 25 bp, Mus musculus
cacctgtgtaccagcaacaatttgg

SEQ ID NO: 306495 - DNA, 25 bp, Mus musculus
cacctgtgtacctgcaacaatttgg

SEQ ID NO: 306496 - DNA, 25 bp, Mus musculus
cacctgtgtagacggcaccattcca

SEQ ID NO: 306497 - DNA, 25 bp, Mus musculus
cacctgtgtagagggcaccattcca

SEQ ID NO: 306498 - DNA, 25 bp, Mus musculus
cacctgtgttatcagaggtgggttt

SEQ ID NO: 306499 - DNA, 25 bp, Mus musculus
cacctgtgttatgagaggtgggttt

SEQ ID NO: 306500 - DNA, 25 bp, Mus musculus
cacctgttaccgacttctagtttag

SEQ ID NO: 306501 - DNA, 25 bp, Mus musculus
cacctgttaccgtcttctagtttag

SEQ ID NO: 306502 - DNA, 25 bp, Mus musculus
cacctgttatataatgcatgtttgt

SEQ ID NO: 306503 - DNA, 25 bp, Mus musculus
cacctgttatattatgcatgtttgt

SEQ ID NO: 306504 - DNA, 25 bp, Mus musculus
cacctgttcagcagaccagacatgt

SEQ ID NO: 306505 - DNA, 25 bp, Mus musculus
cacctgttcagctgaccagacatgt

SEQ ID NO: 306506 - DNA, 25 bp, Mus musculus
cacctgttcaggacaggccccctgg

SEQ ID NO: 306507 - DNA, 25 bp, Mus musculus
cacctgttcaggtcaggccccctgg

SEQ ID NO: 306508 - DNA, 25 bp, Mus musculus
cacctgttgcacctggcatgtggag

SEQ ID NO: 306509 - DNA, 25 bp, Mus musculus
cacctgttgcacgtggcatgtggag

SEQ ID NO: 306510 - DNA, 25 bp, Mus musculus
cacctgttgggcatgcttctcagag

SEQ ID NO: 306511 - DNA, 25 bp, Mus musculus
cacctgttgggcttgcttctcagag

SEQ ID NO: 306512 - DNA, 25 bp, Mus musculus
cacctgttggtgatgcatctcgagc

SEQ ID NO: 306513 - DNA, 25 bp, Mus musculus
cacctgttggtgttgcatctcgagc

SEQ ID NO: 306514 - DNA, 25 bp, Mus musculus
cacctgttttccctaatagccagat

SEQ ID NO: 306515 - DNA, 25 bp, Mus musculus
cacctgttttccgtaatagccagat

SEQ ID NO: 306516 - DNA, 25 bp, Mus musculus
caccttaaaggtcgagacttctgca

SEQ ID NO: 306517 - DNA, 25 bp, Mus musculus
caccttaaaggtggagacttctgca

SEQ ID NO: 306518 - DNA, 25 bp, Mus musculus
caccttaagaccatactctggaggg

SEQ ID NO: 306519 - DNA, 25 bp, Mus musculus
caccttaagaccttactctggaggg

SEQ ID NO: 306520 - DNA, 25 bp, Mus musculus
caccttaagaggactgtttacgcaa

SEQ ID NO: 306521 - DNA, 25 bp, Mus musculus
caccttaagaggtctgtttacgcaa

SEQ ID NO: 306522 - DNA, 25 bp, Mus musculus
caccttaattgcaatgaggatggaa

SEQ ID NO: 306523 - DNA, 25 bp, Mus musculus
caccttaattgctatgaggatggaa

SEQ ID NO: 306524 - DNA, 25 bp, Mus musculus
caccttacagtcatgaagtgtttca

SEQ ID NO: 306525 - DNA, 25 bp, Mus musculus
caccttacagtcttgaagtgtttca

SEQ ID NO: 306526 - DNA, 25 bp, Mus musculus
caccttacatgtcgcttgtttgcaa

SEQ ID NO: 306527 - DNA, 25 bp, Mus musculus
caccttacatgtggcttgtttgcaa

SEQ ID NO: 306528 - DNA, 25 bp, Mus musculus
caccttacccctatttgttatgaag

SEQ ID NO: 306529 - DNA, 25 bp, Mus musculus
caccttacccctttttgttatgaag

SEQ ID NO: 306530 - DNA, 25 bp, Mus musculus
caccttacctcaccgagagggtgca

SEQ ID NO: 306531 - DNA, 25 bp, Mus musculus
caccttacctcagcgagagggtgca

SEQ ID NO: 306532 - DNA, 25 bp, Mus musculus
caccttactgtacaaatcatactta

SEQ ID NO: 306533 - DNA, 25 bp, Mus musculus
caccttactgtagaaatcatactta

SEQ ID NO: 306534 - DNA, 25 bp, Mus musculus
caccttactttaagccatcatcttt

SEQ ID NO: 306535 - DNA, 25 bp, Mus musculus
caccttactttatgccatcatcttt

SEQ ID NO: 306536 - DNA, 25 bp, Mus musculus
caccttagactactgtgtataatac

SEQ ID NO: 306537 - DNA, 25 bp, Mus musculus
caccttagactagtgtgtataatac

SEQ ID NO: 306538 - DNA, 25 bp, Mus musculus
caccttagcacaattataatgccta

SEQ ID NO: 306539 - DNA, 25 bp, Mus musculus
caccttagcacatttataatgccta

SEQ ID NO: 306540 - DNA, 25 bp, Mus musculus
caccttagggaccaatgtcaggccc

SEQ ID NO: 306541 - DNA, 25 bp, Mus musculus
caccttagggacgaatgtcaggccc

SEQ ID NO: 306542 - DNA, 25 bp, Mus musculus
caccttatggtacccttgtctttaa

SEQ ID NO: 306543 - DNA, 25 bp, Mus musculus
caccttatggtagccttgtctttaa

SEQ ID NO: 306544 - DNA, 25 bp, Mus musculus
caccttcaaggtacttttgaacatt

SEQ ID NO: 306545 - DNA, 25 bp, Mus musculus
caccttcaaggttcttttgaacatt

SEQ ID NO: 306546 - DNA, 25 bp, Mus musculus
caccttcacggactagtgccaacaa

SEQ ID NO: 306547 - DNA, 25 bp, Mus musculus
caccttcacggagtagtgccaacaa

SEQ ID NO: 306548 - DNA, 25 bp, Mus musculus
caccttcactcaatgggattcagac

SEQ ID NO: 306549 - DNA, 25 bp, Mus musculus
caccttcactcattgggattcagac

SEQ ID NO: 306550 - DNA, 25 bp, Mus musculus
caccttcagaacctggatcagtgat

SEQ ID NO: 306551 - DNA, 25 bp, Mus musculus
caccttcagaacgtggatcagtgat

SEQ ID NO: 306552 - DNA, 25 bp, Mus musculus
caccttcagtttacttgatctaaaa

SEQ ID NO: 306553 - DNA, 25 bp, Mus musculus
caccttcagtttatgtgctttggga

SEQ ID NO: 306554 - DNA, 25 bp, Mus musculus
caccttcagttttcttgatctaaaa

SEQ ID NO: 306555 - DNA, 25 bp, Mus musculus
caccttcagtttttgtgctttggga

SEQ ID NO: 306556 - DNA, 25 bp, Mus musculus
caccttcatatcatgtttcttgtta

SEQ ID NO: 306557 - DNA, 25 bp, Mus musculus
caccttcatatcttgtttcttgtta

SEQ ID NO: 306558 - DNA, 25 bp, Mus musculus
caccttcattctcgtagagcaccta

SEQ ID NO: 306559 - DNA, 25 bp, Mus musculus
caccttcattctggtagagcaccta

SEQ ID NO: 306560 - DNA, 25 bp, Mus musculus
caccttcatttgcagactctcaatg

SEQ ID NO: 306561 - DNA, 25 bp, Mus musculus
caccttcatttggagactctcaatg

SEQ ID NO: 306562 - DNA, 25 bp, Mus musculus
caccttccaagtataaagggctgat

SEQ ID NO: 306563 - DNA, 25 bp, Mus musculus
caccttccaagtttaaagggctgat

SEQ ID NO: 306564 - DNA, 25 bp, Mus musculus
caccttccccaaaggaaccaggaag

SEQ ID NO: 306565 - DNA, 25 bp, Mus musculus
caccttccccaatggaaccaggaag

SEQ ID NO: 306566 - DNA, 25 bp, Mus musculus
caccttcctcttataactgctatta

SEQ ID NO: 306567 - DNA, 25 bp, Mus musculus
caccttcctcttttaactgctatta

SEQ ID NO: 306568 - DNA, 25 bp, Mus musculus
caccttcctgccctgatggattgaa

SEQ ID NO: 306569 - DNA, 25 bp, Mus musculus
caccttcctgccgtgatggattgaa

SEQ ID NO: 306570 - DNA, 25 bp, Mus musculus
caccttcctgtactgactttgttaa

SEQ ID NO: 306571 - DNA, 25 bp, Mus musculus
caccttcctgtagtgactttgttaa

SEQ ID NO: 306572 - DNA, 25 bp, Mus musculus
caccttcctgtgatacttctatgga

SEQ ID NO: 306573 - DNA, 25 bp, Mus musculus
caccttcctgtgcttgtgcaaacat

SEQ ID NO: 306574 - DNA, 25 bp, Mus musculus
caccttcctgtggttgtgcaaacat

SEQ ID NO: 306575 - DNA, 25 bp, Mus musculus
caccttcctgtgttacttctatgga

SEQ ID NO: 306576 - DNA, 25 bp, Mus musculus
caccttccttcactgctagaacaga

SEQ ID NO: 306577 - DNA, 25 bp, Mus musculus
caccttccttcagtgctagaacaga

SEQ ID NO: 306578 - DNA, 25 bp, Mus musculus
caccttcgaaaaaagctagtatgga

SEQ ID NO: 306579 - DNA, 25 bp, Mus musculus
caccttcgaaaatagctagtatgga

SEQ ID NO: 306580 - DNA, 25 bp, Mus musculus
caccttcgattgacctctgtgtgaa

SEQ ID NO: 306581 - DNA, 25 bp, Mus musculus
caccttcgattgtcctctgtgtgaa

SEQ ID NO: 306582 - DNA, 25 bp, Mus musculus
caccttcgtggtactgtggtttaga

SEQ ID NO: 306583 - DNA, 25 bp, Mus musculus
caccttcgtggttctgtggtttaga

SEQ ID NO: 306584 - DNA, 25 bp, Mus musculus
caccttcgtgttcgcggtggtcatg

SEQ ID NO: 306585 - DNA, 25 bp, Mus musculus
caccttcgtgttggcggtggtcatg

SEQ ID NO: 306586 - DNA, 25 bp, Mus musculus
caccttctaaacacttgacttgatt

SEQ ID NO: 306587 - DNA, 25 bp, Mus musculus
caccttctaaactcttgacttgatt

SEQ ID NO: 306588 - DNA, 25 bp, Mus musculus
caccttctaggtactcaattgtagg

SEQ ID NO: 306589 - DNA, 25 bp, Mus musculus
caccttctaggttctcaattgtagg

SEQ ID NO: 306590 - DNA, 25 bp, Mus musculus
caccttctatggagctgacttgtaa

SEQ ID NO: 306591 - DNA, 25 bp, Mus musculus
caccttctatggtgctgacttgtaa

SEQ ID NO: 306592 - DNA, 25 bp, Mus musculus
caccttctattaattatctgacatc

SEQ ID NO: 306593 - DNA, 25 bp, Mus musculus
caccttctattatttatctgacatc

SEQ ID NO: 306594 - DNA, 25 bp, Mus musculus
caccttctcccgataataatgacca

SEQ ID NO: 306595 - DNA, 25 bp, Mus musculus
caccttctcccgttaataatgacca

SEQ ID NO: 306596 - DNA, 25 bp, Mus musculus
caccttctcttgctcgttatttatt

SEQ ID NO: 306597 - DNA, 25 bp, Mus musculus
caccttctcttggtcgttatttatt

SEQ ID NO: 306598 - DNA, 25 bp, Mus musculus
caccttctggttccctaatgctttc

SEQ ID NO: 306599 - DNA, 25 bp, Mus musculus
caccttctggttgcctaatgctttc

SEQ ID NO: 306600 - DNA, 25 bp, Mus musculus
caccttctgtcaagtcaagggaaca

SEQ ID NO: 306601 - DNA, 25 bp, Mus musculus
caccttctgtcatgtcaagggaaca

SEQ ID NO: 306602 - DNA, 25 bp, Mus musculus
caccttctgtttatgtgaccaccaa

SEQ ID NO: 306603 - DNA, 25 bp, Mus musculus
caccttctgtttttgtgaccaccaa

SEQ ID NO: 306604 - DNA, 25 bp, Mus musculus
caccttcttgctattcgagttcaaa

SEQ ID NO: 306605 - DNA, 25 bp, Mus musculus
caccttcttgcttttcgagttcaaa

SEQ ID NO: 306606 - DNA, 25 bp, Mus musculus
caccttcttttcattcctcatgttc

SEQ ID NO: 306607 - DNA, 25 bp, Mus musculus
caccttcttttctttcctcatgttc

SEQ ID NO: 306608 - DNA, 25 bp, Mus musculus
caccttgacataattgtgcacacaa

SEQ ID NO: 306609 - DNA, 25 bp, Mus musculus
caccttgacatatttgtgcacacaa

SEQ ID NO: 306610 - DNA, 25 bp, Mus musculus
caccttgagggcaaccatgggactg

SEQ ID NO: 306611 - DNA, 25 bp, Mus musculus
caccttgagggctaccatgggactg

SEQ ID NO: 306612 - DNA, 25 bp, Mus musculus
caccttgcaagactgtctccagtca

SEQ ID NO: 306613 - DNA, 25 bp, Mus musculus
caccttgcaagagtgtctccagtca

SEQ ID NO: 306614 - DNA, 25 bp, Mus musculus
caccttgcctgcaggtagagtgggt

SEQ ID NO: 306615 - DNA, 25 bp, Mus musculus
caccttgcctgctggtagagtgggt

SEQ ID NO: 306616 - DNA, 25 bp, Mus musculus
caccttgctatgatgtatcccttaa

SEQ ID NO: 306617 - DNA, 25 bp, Mus musculus
caccttgctatgttgtatcccttaa

SEQ ID NO: 306618 - DNA, 25 bp, Mus musculus
caccttgctgctcagatttcctgag

SEQ ID NO: 306619 - DNA, 25 bp, Mus musculus
caccttgctgctgagatttcctgag

SEQ ID NO: 306620 - DNA, 25 bp, Mus musculus
caccttgctggactctgtatacttt

SEQ ID NO: 306621 - DNA, 25 bp, Mus musculus
caccttgctggagtctgtatacttt

SEQ ID NO: 306622 - DNA, 25 bp, Mus musculus
caccttgctggccttttattaattt

SEQ ID NO: 306623 - DNA, 25 bp, Mus musculus
caccttgctggcgttttattaattt

SEQ ID NO: 306624 - DNA, 25 bp, Mus musculus
caccttgcttacacctgtttctttg

SEQ ID NO: 306625 - DNA, 25 bp, Mus musculus
caccttgcttactcctgtttctttg

SEQ ID NO: 306626 - DNA, 25 bp, Mus musculus
caccttgcttttcacctatattgaa

SEQ ID NO: 306627 - DNA, 25 bp, Mus musculus
caccttgcttttccaaactcatgag

SEQ ID NO: 306628 - DNA, 25 bp, Mus musculus
caccttgcttttgacctatattgaa

SEQ ID NO: 306629 - DNA, 25 bp, Mus musculus
caccttgcttttgcaaactcatgag

SEQ ID NO: 306630 - DNA, 25 bp, Mus musculus
caccttggaggtcgtcgaagagcat

SEQ ID NO: 306631 - DNA, 25 bp, Mus musculus
caccttggaggtggtcgaagagcat

SEQ ID NO: 306632 - DNA, 25 bp, Mus musculus
caccttggagttattcctttaacag

SEQ ID NO: 306633 - DNA, 25 bp, Mus musculus
caccttggagtttttcctttaacag

SEQ ID NO: 306634 - DNA, 25 bp, Mus musculus
caccttgggcaccagggagtgccat

SEQ ID NO: 306635 - DNA, 25 bp, Mus musculus
caccttgggcacgagggagtgccat

SEQ ID NO: 306636 - DNA, 25 bp, Mus musculus
caccttggtgctatccttttgaaac

SEQ ID NO: 306637 - DNA, 25 bp, Mus musculus
caccttggtgctttccttttgaaac

SEQ ID NO: 306638 - DNA, 25 bp, Mus musculus
caccttgtagttccaacttctttgg

SEQ ID NO: 306639 - DNA, 25 bp, Mus musculus
caccttgtagttgcaacttctttgg

SEQ ID NO: 306640 - DNA, 25 bp, Mus musculus
caccttgtcatgatcagccgcatac

SEQ ID NO: 306641 - DNA, 25 bp, Mus musculus
caccttgtcatgttcagccgcatac

SEQ ID NO: 306642 - DNA, 25 bp, Mus musculus
caccttgtcctaatttagtgcctct

SEQ ID NO: 306643 - DNA, 25 bp, Mus musculus
caccttgtcctattttagtgcctct

SEQ ID NO: 306644 - DNA, 25 bp, Mus musculus
caccttgtgtggcagacgtggccat

SEQ ID NO: 306645 - DNA, 25 bp, Mus musculus
caccttgtgtgggagacgtggccat

SEQ ID NO: 306646 - DNA, 25 bp, Mus musculus
caccttgtgttaagccaggcccgag

SEQ ID NO: 306647 - DNA, 25 bp, Mus musculus
caccttgtgttatgccaggcccgag

SEQ ID NO: 306648 - DNA, 25 bp, Mus musculus
caccttgtgtttctgtcaatgtttc

SEQ ID NO: 306649 - DNA, 25 bp, Mus musculus
caccttgtgtttgtgtcaatgtttc

SEQ ID NO: 306650 - DNA, 25 bp, Mus musculus
caccttgtttgacttttgttgcttg

SEQ ID NO: 306651 - DNA, 25 bp, Mus musculus
caccttgtttgagttttgttgcttg

SEQ ID NO: 306652 - DNA, 25 bp, Mus musculus
cacctttaaaggcaagtgaagctgt

SEQ ID NO: 306653 - DNA, 25 bp, Mus musculus
cacctttaaagggaagtgaagctgt

SEQ ID NO: 306654 - DNA, 25 bp, Mus musculus
cacctttaagctagaattagactat

SEQ ID NO: 306655 - DNA, 25 bp, Mus musculus
cacctttaagcttgaattagactat

SEQ ID NO: 306656 - DNA, 25 bp, Mus musculus
cacctttactgtagggagggaggat

SEQ ID NO: 306657 - DNA, 25 bp, Mus musculus
cacctttactgttgggagggaggat

SEQ ID NO: 306658 - DNA, 25 bp, Mus musculus
cacctttagcagagttttccaggag

SEQ ID NO: 306659 - DNA, 25 bp, Mus musculus
cacctttagcagtgttttccaggag

SEQ ID NO: 306660 - DNA, 25 bp, Mus musculus
cacctttagggcagtggtagcactc

SEQ ID NO: 306661 - DNA, 25 bp, Mus musculus
cacctttagggctgtggtagcactc

SEQ ID NO: 306662 - DNA, 25 bp, Mus musculus
cacctttagttcatcagcaacacca

SEQ ID NO: 306663 - DNA, 25 bp, Mus musculus
cacctttagttcttcagcaacacca

SEQ ID NO: 306664 - DNA, 25 bp, Mus musculus
cacctttatgacactctgcggagaa

SEQ ID NO: 306665 - DNA, 25 bp, Mus musculus
cacctttatgactctctgcggagaa

SEQ ID NO: 306666 - DNA, 25 bp, Mus musculus
cacctttcatttactctactatttc

SEQ ID NO: 306667 - DNA, 25 bp, Mus musculus
cacctttcattttctctactatttc

SEQ ID NO: 306668 - DNA, 25 bp, Mus musculus
cacctttcctgcccgcaatggtggg

SEQ ID NO: 306669 - DNA, 25 bp, Mus musculus
cacctttcctgcgcgcaatggtggg

SEQ ID NO: 306670 - DNA, 25 bp, Mus musculus
cacctttctaacaactcagctaaac

SEQ ID NO: 306671 - DNA, 25 bp, Mus musculus
cacctttctaactactcagctaaac

SEQ ID NO: 306672 - DNA, 25 bp, Mus musculus
cacctttctgctctgatatcaattt

SEQ ID NO: 306673 - DNA, 25 bp, Mus musculus
cacctttctgctgtgatatcaattt

SEQ ID NO: 306674 - DNA, 25 bp, Mus musculus
cacctttgagcactggacggagcac

SEQ ID NO: 306675 - DNA, 25 bp, Mus musculus
cacctttgagcagtggacggagcac

SEQ ID NO: 306676 - DNA, 25 bp, Mus musculus
cacctttgagtaccgctacctggag

SEQ ID NO: 306677 - DNA, 25 bp, Mus musculus
cacctttgagtagcgctacctggag

SEQ ID NO: 306678 - DNA, 25 bp, Mus musculus
cacctttgattccagtgtgaactgt

SEQ ID NO: 306679 - DNA, 25 bp, Mus musculus
cacctttgattcgagtgtgaactgt

SEQ ID NO: 306680 - DNA, 25 bp, Mus musculus
cacctttgccccagttttgtacgat

SEQ ID NO: 306681 - DNA, 25 bp, Mus musculus
cacctttgcccctgttttgtacgat

SEQ ID NO: 306682 - DNA, 25 bp, Mus musculus
cacctttgcctcaaaccacttagtt

SEQ ID NO: 306683 - DNA, 25 bp, Mus musculus
cacctttgcctctaaccacttagtt

SEQ ID NO: 306684 - DNA, 25 bp, Mus musculus
cacctttgctgcactttcgttgaaa

SEQ ID NO: 306685 - DNA, 25 bp, Mus musculus
cacctttgctgctctttcgttgaaa

SEQ ID NO: 306686 - DNA, 25 bp, Mus musculus
cacctttgttctctcagggtacaga

SEQ ID NO: 306687 - DNA, 25 bp, Mus musculus
cacctttgttctgtcagggtacaga

SEQ ID NO: 306688 - DNA, 25 bp, Mus musculus
cacctttgttttcttccactagatg

SEQ ID NO: 306689 - DNA, 25 bp, Mus musculus
cacctttgttttgttccactagatg

SEQ ID NO: 306690 - DNA, 25 bp, Mus musculus
caccttttcagcattttaccagtca

SEQ ID NO: 306691 - DNA, 25 bp, Mus musculus
caccttttcagctttttaccagtca

SEQ ID NO: 306692 - DNA, 25 bp, Mus musculus
caccttttcccgatagtgtcaatcg

SEQ ID NO: 306693 - DNA, 25 bp, Mus musculus
caccttttcccgttagtgtcaatcg

SEQ ID NO: 306694 - DNA, 25 bp, Mus musculus
caccttttcctgatcatcagttaga

SEQ ID NO: 306695 - DNA, 25 bp, Mus musculus
caccttttcctgttcatcagttaga

SEQ ID NO: 306696 - DNA, 25 bp, Mus musculus
caccttttggctaccctcggatatt

SEQ ID NO: 306697 - DNA, 25 bp, Mus musculus
caccttttggcttccctcggatatt

SEQ ID NO: 306698 - DNA, 25 bp, Mus musculus
caccttttgggaagggaggcagcat

SEQ ID NO: 306699 - DNA, 25 bp, Mus musculus
caccttttgggatgggaggcagcat

SEQ ID NO: 306700 - DNA, 25 bp, Mus musculus
cacctttttgcactcggaggatggg

SEQ ID NO: 306701 - DNA, 25 bp, Mus musculus
cacctttttgcagtcggaggatggg

SEQ ID NO: 306702 - DNA, 25 bp, Mus musculus
cacctttttgccaagtcacagaacg

SEQ ID NO: 306703 - DNA, 25 bp, Mus musculus
cacctttttgcctagtcacagaacg

SEQ ID NO: 306704 - DNA, 25 bp, Mus musculus
cacgaaatctttctaccatgttgat

SEQ ID NO: 306705 - DNA, 25 bp, Mus musculus
cacgaaatctttgtaccatgttgat

SEQ ID NO: 306706 - DNA, 25 bp, Mus musculus
cacgaacatattctgcacatcttta

SEQ ID NO: 306707 - DNA, 25 bp, Mus musculus
cacgaacatattgtgcacatcttta

SEQ ID NO: 306708 - DNA, 25 bp, Mus musculus
cacgaacgctttccttttgagatag

SEQ ID NO: 306709 - DNA, 25 bp, Mus musculus
cacgaacgctttgcttttgagatag

SEQ ID NO: 306710 - DNA, 25 bp, Mus musculus
cacgaacgtgggaaattaccactat

SEQ ID NO: 306711 - DNA, 25 bp, Mus musculus
cacgaacgtgggtaattaccactat

SEQ ID NO: 306712 - DNA, 25 bp, Mus musculus
cacgaactctagcttctccaaagaa

SEQ ID NO: 306713 - DNA, 25 bp, Mus musculus
cacgaactctaggttctccaaagaa

SEQ ID NO: 306714 - DNA, 25 bp, Mus musculus
cacgaagcaatcactgccatactta

SEQ ID NO: 306715 - DNA, 25 bp, Mus musculus
cacgaagcaatctctgccatactta

SEQ ID NO: 306716 - DNA, 25 bp, Mus musculus
cacgaagccccaattcagtcttcag

SEQ ID NO: 306717 - DNA, 25 bp, Mus musculus
cacgaagccccatttcagtcttcag

SEQ ID NO: 306718 - DNA, 25 bp, Mus musculus
cacgaaggccttcagctagctaatg

SEQ ID NO: 306719 - DNA, 25 bp, Mus musculus
cacgaaggccttgagctagctaatg

SEQ ID NO: 306720 - DNA, 25 bp, Mus musculus
cacgaaggtggactggttcctgttt

SEQ ID NO: 306721 - DNA, 25 bp, Mus musculus
cacgaaggtggagtggttcctgttt

SEQ ID NO: 306722 - DNA, 25 bp, Mus musculus
cacgaagtacacagggagacctgca

SEQ ID NO: 306723 - DNA, 25 bp, Mus musculus
cacgaagtacactgggagacctgca

SEQ ID NO: 306724 - DNA, 25 bp, Mus musculus
cacgaagtctagctttgcgattgtt

SEQ ID NO: 306725 - DNA, 25 bp, Mus musculus
cacgaagtctaggtttgcgattgtt

SEQ ID NO: 306726 - DNA, 25 bp, Mus musculus
cacgaagttcttccgttcatcaaat

SEQ ID NO: 306727 - DNA, 25 bp, Mus musculus
cacgaagttcttgcgttcatcaaat

SEQ ID NO: 306728 - DNA, 25 bp, Mus musculus
cacgaatactcgagaagcaggcatt

SEQ ID NO: 306729 - DNA, 25 bp, Mus musculus
cacgaatactcgtgaagcaggcatt

SEQ ID NO: 306730 - DNA, 25 bp, Mus musculus
cacgaatccaccatttgttacttct

SEQ ID NO: 306731 - DNA, 25 bp, Mus musculus
cacgaatccaccttttgttacttct

SEQ ID NO: 306732 - DNA, 25 bp, Mus musculus
cacgaatgacgtcgtgcagaatttt

SEQ ID NO: 306733 - DNA, 25 bp, Mus musculus
cacgaatgacgtggtgcagaatttt

SEQ ID NO: 306734 - DNA, 25 bp, Mus musculus
cacgaatggaagctaggttccagca

SEQ ID NO: 306735 - DNA, 25 bp, Mus musculus
cacgaatggaaggtaggttccagca

SEQ ID NO: 306736 - DNA, 25 bp, Mus musculus
cacgaattgtgtatggttgaaagac

SEQ ID NO: 306737 - DNA, 25 bp, Mus musculus
cacgaattgtgtttggttgaaagac

SEQ ID NO: 306738 - DNA, 25 bp, Mus musculus
cacgacaaatatcagcccagggagt

SEQ ID NO: 306739 - DNA, 25 bp, Mus musculus
cacgacaaatatgagcccagggagt

SEQ ID NO: 306740 - DNA, 25 bp, Mus musculus
cacgacacccacagtgtggttttta

SEQ ID NO: 306741 - DNA, 25 bp, Mus musculus
cacgacacccactgtgtggttttta

SEQ ID NO: 306742 - DNA, 25 bp, Mus musculus
cacgacacgtttaatttttattgtg

SEQ ID NO: 306743 - DNA, 25 bp, Mus musculus
cacgacacgttttatttttattgtg

SEQ ID NO: 306744 - DNA, 25 bp, Mus musculus
cacgacactcttcaggcacaaaggt

SEQ ID NO: 306745 - DNA, 25 bp, Mus musculus
cacgacactcttgaggcacaaaggt

SEQ ID NO: 306746 - DNA, 25 bp, Mus musculus
cacgacagttttaccaagcgaaaga

SEQ ID NO: 306747 - DNA, 25 bp, Mus musculus
cacgacagtttttccaagcgaaaga

SEQ ID NO: 306748 - DNA, 25 bp, Mus musculus
cacgacatccagacttagctgggtt

SEQ ID NO: 306749 - DNA, 25 bp, Mus musculus
cacgacatccagtcttagctgggtt

SEQ ID NO: 306750 - DNA, 25 bp, Mus musculus
cacgaccaggccagtgtggcagagc

SEQ ID NO: 306751 - DNA, 25 bp, Mus musculus
cacgaccaggcctgtgtggcagagc

SEQ ID NO: 306752 - DNA, 25 bp, Mus musculus
cacgaccttgccagagaatgcactg

SEQ ID NO: 306753 - DNA, 25 bp, Mus musculus
cacgaccttgcctgagaatgcactg

SEQ ID NO: 306754 - DNA, 25 bp, Mus musculus
cacgacgaatgccagacacggatga

SEQ ID NO: 306755 - DNA, 25 bp, Mus musculus
cacgacgaatgcgagacacggatga

SEQ ID NO: 306756 - DNA, 25 bp, Mus musculus
cacgacgcagttcgtgcagatgctg

SEQ ID NO: 306757 - DNA, 25 bp, Mus musculus
cacgacgcagttggtgcagatgctg

SEQ ID NO: 306758 - DNA, 25 bp, Mus musculus
cacgacgcttgtcgctagcgtgtgt

SEQ ID NO: 306759 - DNA, 25 bp, Mus musculus
cacgacgcttgtggctagcgtgtgt

SEQ ID NO: 306760 - DNA, 25 bp, Mus musculus
cacgacgtctaccagacttactgag

SEQ ID NO: 306761 - DNA, 25 bp, Mus musculus
cacgacgtctacgagacttactgag

SEQ ID NO: 306762 - DNA, 25 bp, Mus musculus
cacgactgagagacatggacaatca

SEQ ID NO: 306763 - DNA, 25 bp, Mus musculus
cacgactgagagtcatggacaatca

SEQ ID NO: 306764 - DNA, 25 bp, Mus musculus
cacgactgcgatcctgggacatgct

SEQ ID NO: 306765 - DNA, 25 bp, Mus musculus
cacgactgcgatgctgggacatgct

SEQ ID NO: 306766 - DNA, 25 bp, Mus musculus
cacgactttagcaccatgcgatgaa

SEQ ID NO: 306767 - DNA, 25 bp, Mus musculus
cacgactttagctccatgcgatgaa

SEQ ID NO: 306768 - DNA, 25 bp, Mus musculus
cacgagaaaccgagtgatttttatt

SEQ ID NO: 306769 - DNA, 25 bp, Mus musculus
cacgagaaaccgtgtgatttttatt

SEQ ID NO: 306770 - DNA, 25 bp, Mus musculus
cacgagacggacatgttcaaccaaa

SEQ ID NO: 306771 - DNA, 25 bp, Mus musculus
cacgagacggacttgttcaaccaaa

SEQ ID NO: 306772 - DNA, 25 bp, Mus musculus
cacgagactgatagccagagcacct

SEQ ID NO: 306773 - DNA, 25 bp, Mus musculus
cacgagactgattgccagagcacct

SEQ ID NO: 306774 - DNA, 25 bp, Mus musculus
cacgagagatggcattagaagacct

SEQ ID NO: 306775 - DNA, 25 bp, Mus musculus
cacgagagatgggattagaagacct

SEQ ID NO: 306776 - DNA, 25 bp, Mus musculus
cacgagatcccgctttactggacaa

SEQ ID NO: 306777 - DNA, 25 bp, Mus musculus
cacgagatcccggtttactggacaa

SEQ ID NO: 306778 - DNA, 25 bp, Mus musculus
cacgagcaatgcatgtaccaacagg

SEQ ID NO: 306779 - DNA, 25 bp, Mus musculus
cacgagcaatgcttgtaccaacagg

SEQ ID NO: 306780 - DNA, 25 bp, Mus musculus
cacgagcacccaccagacaggaggt

SEQ ID NO: 306781 - DNA, 25 bp, Mus musculus
cacgagcacccagcagacaggaggt

SEQ ID NO: 306782 - DNA, 25 bp, Mus musculus
cacgagcattgtacctaattttttc

SEQ ID NO: 306783 - DNA, 25 bp, Mus musculus
cacgagcattgttcctaattttttc

SEQ ID NO: 306784 - DNA, 25 bp, Mus musculus
cacgagctggatcatgccgaggaac

SEQ ID NO: 306785 - DNA, 25 bp, Mus musculus
cacgagctggatgatgccgaggaac

SEQ ID NO: 306786 - DNA, 25 bp, Mus musculus
cacgaggaatccagcaacgatgacc

SEQ ID NO: 306787 - DNA, 25 bp, Mus musculus
cacgaggaatcctgcaacgatgacc

SEQ ID NO: 306788 - DNA, 25 bp, Mus musculus
cacgaggacctcagagacaacattt

SEQ ID NO: 306789 - DNA, 25 bp, Mus musculus
cacgaggacctctgagacaacattt

SEQ ID NO: 306790 - DNA, 25 bp, Mus musculus
cacgaggaggacaatgccctgggta

SEQ ID NO: 306791 - DNA, 25 bp, Mus musculus
cacgaggaggactatgccctgggta

SEQ ID NO: 306792 - DNA, 25 bp, Mus musculus
cacgaggatcagaacgaaagttcta

SEQ ID NO: 306793 - DNA, 25 bp, Mus musculus
cacgaggatcagtacgaaagttcta

SEQ ID NO: 306794 - DNA, 25 bp, Mus musculus
cacgaggcaaccatggtgtgtacca

SEQ ID NO: 306795 - DNA, 25 bp, Mus musculus
cacgaggcaaccttggtgtgtacca

SEQ ID NO: 306796 - DNA, 25 bp, Mus musculus
cacgaggcgggaatgggcattacct

SEQ ID NO: 306797 - DNA, 25 bp, Mus musculus
cacgaggcgggattgggcattacct

SEQ ID NO: 306798 - DNA, 25 bp, Mus musculus
cacgaggctctgactcatgaaactt

SEQ ID NO: 306799 - DNA, 25 bp, Mus musculus
cacgaggctctgtctcatgaaactt

SEQ ID NO: 306800 - DNA, 25 bp, Mus musculus
cacgaggctgctctaagttgggaca

SEQ ID NO: 306801 - DNA, 25 bp, Mus musculus
cacgaggctgctgtaagttgggaca

SEQ ID NO: 306802 - DNA, 25 bp, Mus musculus
cacgaggctgttcatgcagtggcat

SEQ ID NO: 306803 - DNA, 25 bp, Mus musculus
cacgaggctgttgatgcagtggcat

SEQ ID NO: 306804 - DNA, 25 bp, Mus musculus
cacgagggctcacagatgactttgc

SEQ ID NO: 306805 - DNA, 25 bp, Mus musculus
cacgagggctcagagatgactttgc

SEQ ID NO: 306806 - DNA, 25 bp, Mus musculus
cacgaggtagttcaaactggagtta

SEQ ID NO: 306807 - DNA, 25 bp, Mus musculus
cacgaggtagttgaaactggagtta

SEQ ID NO: 306808 - DNA, 25 bp, Mus musculus
cacgagtcgcttctgatggatctta

SEQ ID NO: 306809 - DNA, 25 bp, Mus musculus
cacgagtcgcttgtgatggatctta

SEQ ID NO: 306810 - DNA, 25 bp, Mus musculus
cacgagtgtctgcatgtagcttcta

SEQ ID NO: 306811 - DNA, 25 bp, Mus musculus
cacgagtgtctggatgtagcttcta

SEQ ID NO: 306812 - DNA, 25 bp, Mus musculus
cacgagtgtgaccaatgtgggcccc

SEQ ID NO: 306813 - DNA, 25 bp, Mus musculus
cacgagtgtgacgaatgtgggcccc

SEQ ID NO: 306814 - DNA, 25 bp, Mus musculus
cacgagtgtgcgctcatttccaggg

SEQ ID NO: 306815 - DNA, 25 bp, Mus musculus
cacgagtgtgcggtcatttccaggg

SEQ ID NO: 306816 - DNA, 25 bp, Mus musculus
cacgagttagttattctgggctgcc

SEQ ID NO: 306817 - DNA, 25 bp, Mus musculus
cacgagttagtttttctgggctgcc

SEQ ID NO: 306818 - DNA, 25 bp, Mus musculus
cacgagttcaagcaggcctgccagt

SEQ ID NO: 306819 - DNA, 25 bp, Mus musculus
cacgagttcaaggaggcctgccagt

SEQ ID NO: 306820 - DNA, 25 bp, Mus musculus
cacgatactcaaatttcacccatgg

SEQ ID NO: 306821 - DNA, 25 bp, Mus musculus
cacgatactcaattttcacccatgg

SEQ ID NO: 306822 - DNA, 25 bp, Mus musculus
cacgatatgcgtagtcctaagtccc

SEQ ID NO: 306823 - DNA, 25 bp, Mus musculus
cacgatatgcgttgtcctaagtccc

SEQ ID NO: 306824 - DNA, 25 bp, Mus musculus
cacgatatgggtccggtgtaataaa

SEQ ID NO: 306825 - DNA, 25 bp, Mus musculus
cacgatatgggtgcggtgtaataaa

SEQ ID NO: 306826 - DNA, 25 bp, Mus musculus
cacgatcctagacgccacagagcag

SEQ ID NO: 306827 - DNA, 25 bp, Mus musculus
cacgatcctagaggccacagagcag

SEQ ID NO: 306828 - DNA, 25 bp, Mus musculus
cacgatctccagaacaaaatattct

SEQ ID NO: 306829 - DNA, 25 bp, Mus musculus
cacgatctccagtacaaaatattct

SEQ ID NO: 306830 - DNA, 25 bp, Mus musculus
cacgatcttccacagtgacctgtaa

SEQ ID NO: 306831 - DNA, 25 bp, Mus musculus
cacgatcttccagagtgacctgtaa

SEQ ID NO: 306832 - DNA, 25 bp, Mus musculus
cacgatgacgtgagctacctgaaga

SEQ ID NO: 306833 - DNA, 25 bp, Mus musculus
cacgatgacgtgtgctacctgaaga

SEQ ID NO: 306834 - DNA, 25 bp, Mus musculus
cacgatgagagtctggttctacaca

SEQ ID NO: 306835 - DNA, 25 bp, Mus musculus
cacgatgagagtgtggttctacaca

SEQ ID NO: 306836 - DNA, 25 bp, Mus musculus
cacgatgcagcacttcctacagaaa

SEQ ID NO: 306837 - DNA, 25 bp, Mus musculus
cacgatgcagcagttcctacagaaa

SEQ ID NO: 306838 - DNA, 25 bp, Mus musculus
cacgatgcaggaagcagggtcgcca

SEQ ID NO: 306839 - DNA, 25 bp, Mus musculus
cacgatgcaggatgcagggtcgcca

SEQ ID NO: 306840 - DNA, 25 bp, Mus musculus
cacgatgcgtggaactatgtgctca

SEQ ID NO: 306841 - DNA, 25 bp, Mus musculus
cacgatgcgtggtactatgtgctca

SEQ ID NO: 306842 - DNA, 25 bp, Mus musculus
cacgatggatgacatggctgtagat

SEQ ID NO: 306843 - DNA, 25 bp, Mus musculus
cacgatggatgagatggctgtagat

SEQ ID NO: 306844 - DNA, 25 bp, Mus musculus
cacgatggtgctactctgggtcttc

SEQ ID NO: 306845 - DNA, 25 bp, Mus musculus
cacgatggtgcttctctgggtcttc

SEQ ID NO: 306846 - DNA, 25 bp, Mus musculus
cacgatgttttgaaaccactttcta

SEQ ID NO: 306847 - DNA, 25 bp, Mus musculus
cacgatgttttgtaaccactttcta

SEQ ID NO: 306848 - DNA, 25 bp, Mus musculus
cacgattactttagcaatttcctta

SEQ ID NO: 306849 - DNA, 25 bp, Mus musculus
cacgattacttttgcaatttcctta

SEQ ID NO: 306850 - DNA, 25 bp, Mus musculus
cacgattctgaacctgtgccaataa

SEQ ID NO: 306851 - DNA, 25 bp, Mus musculus
cacgattctgaagctgtgccaataa

SEQ ID NO: 306852 - DNA, 25 bp, Mus musculus
cacgatttgcttagatacagggtat

SEQ ID NO: 306853 - DNA, 25 bp, Mus musculus
cacgatttgctttgatacagggtat

SEQ ID NO: 306854 - DNA, 25 bp, Mus musculus
cacgcaaattccatgatgcttctca

SEQ ID NO: 306855 - DNA, 25 bp, Mus musculus
cacgcaaattccttgatgcttctca

SEQ ID NO: 306856 - DNA, 25 bp, Mus musculus
cacgcaaccccaacaaggtgttctt

SEQ ID NO: 306857 - DNA, 25 bp, Mus musculus
cacgcaaccccatcaaggtgttctt

SEQ ID NO: 306858 - DNA, 25 bp, Mus musculus
cacgcaacctgaaaatggcattctt

SEQ ID NO: 306859 - DNA, 25 bp, Mus musculus
cacgcaacctgataatggcattctt

SEQ ID NO: 306860 - DNA, 25 bp, Mus musculus
cacgcaaccttgcatccggatgaag

SEQ ID NO: 306861 - DNA, 25 bp, Mus musculus
cacgcaaccttggatccggatgaag

SEQ ID NO: 306862 - DNA, 25 bp, Mus musculus
cacgcaactaatccaataaaagccg

SEQ ID NO: 306863 - DNA, 25 bp, Mus musculus
cacgcaactaatgcaataaaagccg

SEQ ID NO: 306864 - DNA, 25 bp, Mus musculus
cacgcaaggatgaggatgtagacaa

SEQ ID NO: 306865 - DNA, 25 bp, Mus musculus
cacgcaaggatgtggatgtagacaa

SEQ ID NO: 306866 - DNA, 25 bp, Mus musculus
cacgcaaggcaaagagactacccat

SEQ ID NO: 306867 - DNA, 25 bp, Mus musculus
cacgcaaggcaatgagactacccat

SEQ ID NO: 306868 - DNA, 25 bp, Mus musculus
cacgcacacatgcatttgtttgttt

SEQ ID NO: 306869 - DNA, 25 bp, Mus musculus
cacgcacacatggatttgtttgttt

SEQ ID NO: 306870 - DNA, 25 bp, Mus musculus
cacgcacactagacatgccatctaa

SEQ ID NO: 306871 - DNA, 25 bp, Mus musculus
cacgcacactagtcatgccatctaa

SEQ ID NO: 306872 - DNA, 25 bp, Mus musculus
cacgcacagcacatttgacacatga

SEQ ID NO: 306873 - DNA, 25 bp, Mus musculus
cacgcacagcacttttgacacatga

SEQ ID NO: 306874 - DNA, 25 bp, Mus musculus
cacgcacaggtgcttgagttacaaa

SEQ ID NO: 306875 - DNA, 25 bp, Mus musculus
cacgcacaggtggttgagttacaaa

SEQ ID NO: 306876 - DNA, 25 bp, Mus musculus
cacgcacatacacactttaactaaa

SEQ ID NO: 306877 - DNA, 25 bp, Mus musculus
cacgcacatacagactttaactaaa

SEQ ID NO: 306878 - DNA, 25 bp, Mus musculus
cacgcactgtgaccgccacagggaa

SEQ ID NO: 306879 - DNA, 25 bp, Mus musculus
cacgcactgtgagcgccacagggaa

SEQ ID NO: 306880 - DNA, 25 bp, Mus musculus
cacgcacttatcaggaacgcctcga

SEQ ID NO: 306881 - DNA, 25 bp, Mus musculus
cacgcacttatctggaacgcctcga

SEQ ID NO: 306882 - DNA, 25 bp, Mus musculus
cacgcagccagcacaagcatagtta

SEQ ID NO: 306883 - DNA, 25 bp, Mus musculus
cacgcagccagctcaagcatagtta

SEQ ID NO: 306884 - DNA, 25 bp, Mus musculus
cacgcagccatgaaatatatatttt

SEQ ID NO: 306885 - DNA, 25 bp, Mus musculus
cacgcagccatgtaatatatatttt

SEQ ID NO: 306886 - DNA, 25 bp, Mus musculus
cacgcagcgagtcaagggagttttc

SEQ ID NO: 306887 - DNA, 25 bp, Mus musculus
cacgcagcgagtgaagggagttttc

SEQ ID NO: 306888 - DNA, 25 bp, Mus musculus
cacgcaggcagacccaggcaagact

SEQ ID NO: 306889 - DNA, 25 bp, Mus musculus
cacgcaggcagagccaggcaagact

SEQ ID NO: 306890 - DNA, 25 bp, Mus musculus
cacgcaggccgtatgtacgtcagaa

SEQ ID NO: 306891 - DNA, 25 bp, Mus musculus
cacgcaggccgtttgtacgtcagaa

SEQ ID NO: 306892 - DNA, 25 bp, Mus musculus
cacgcaggctagaggcattgtgtgt

SEQ ID NO: 306893 - DNA, 25 bp, Mus musculus
cacgcaggctagtggcattgtgtgt

SEQ ID NO: 306894 - DNA, 25 bp, Mus musculus
cacgcagtcttcaggccaggatggc

SEQ ID NO: 306895 - DNA, 25 bp, Mus musculus
cacgcagtcttctggccaggatggc

SEQ ID NO: 306896 - DNA, 25 bp, Mus musculus
cacgcagttgggacttctacagact

SEQ ID NO: 306897 - DNA, 25 bp, Mus musculus
cacgcagttgggtcttctacagact

SEQ ID NO: 306898 - DNA, 25 bp, Mus musculus
cacgcataactacctgactgaagag

SEQ ID NO: 306899 - DNA, 25 bp, Mus musculus
cacgcataactagctgactgaagag

SEQ ID NO: 306900 - DNA, 25 bp, Mus musculus
cacgcataggtgatgggacttgtag

SEQ ID NO: 306901 - DNA, 25 bp, Mus musculus
cacgcataggtgttgggacttgtag

SEQ ID NO: 306902 - DNA, 25 bp, Mus musculus
cacgcatctgtgacctagcatttag

SEQ ID NO: 306903 - DNA, 25 bp, Mus musculus
cacgcatctgtgtcctagcatttag

SEQ ID NO: 306904 - DNA, 25 bp, Mus musculus
cacgcatgggctaaactctgggttt

SEQ ID NO: 306905 - DNA, 25 bp, Mus musculus
cacgcatgggcttaactctgggttt

SEQ ID NO: 306906 - DNA, 25 bp, Mus musculus
cacgccaagctgaatgtgagtgaca

SEQ ID NO: 306907 - DNA, 25 bp, Mus musculus
cacgccaagctgtatgtgagtgaca

SEQ ID NO: 306908 - DNA, 25 bp, Mus musculus
cacgccaccaatagcactgattaga

SEQ ID NO: 306909 - DNA, 25 bp, Mus musculus
cacgccaccaattgcactgattaga

SEQ ID NO: 306910 - DNA, 25 bp, Mus musculus
cacgccacgtttagaaatttcggag

SEQ ID NO: 306911 - DNA, 25 bp, Mus musculus
cacgccacgttttgaaatttcggag

SEQ ID NO: 306912 - DNA, 25 bp, Mus musculus
cacgccagcagtcggctcaatgagc

SEQ ID NO: 306913 - DNA, 25 bp, Mus musculus
cacgccagcagtgggctcaatgagc

SEQ ID NO: 306914 - DNA, 25 bp, Mus musculus
cacgccaggcaccaagggtatttga

SEQ ID NO: 306915 - DNA, 25 bp, Mus musculus
cacgccaggcacgaagggtatttga

SEQ ID NO: 306916 - DNA, 25 bp, Mus musculus
cacgccatgtgccatgaacctggac

SEQ ID NO: 306917 - DNA, 25 bp, Mus musculus
cacgccatgtgcgatgaacctggac

SEQ ID NO: 306918 - DNA, 25 bp, Mus musculus
cacgccattgtcactgtgaacggca

SEQ ID NO: 306919 - DNA, 25 bp, Mus musculus
cacgccattgtctctgtgaacggca

SEQ ID NO: 306920 - DNA, 25 bp, Mus musculus
cacgcccacgttaccattttaagat

SEQ ID NO: 306921 - DNA, 25 bp, Mus musculus
cacgcccacgtttccattttaagat

SEQ ID NO: 306922 - DNA, 25 bp, Mus musculus
cacgcccagcttcctataaagtttt

SEQ ID NO: 306923 - DNA, 25 bp, Mus musculus
cacgcccagcttgctataaagtttt

SEQ ID NO: 306924 - DNA, 25 bp, Mus musculus
cacgccccagtaatggttctggaat

SEQ ID NO: 306925 - DNA, 25 bp, Mus musculus
cacgccccagtattggttctggaat

SEQ ID NO: 306926 - DNA, 25 bp, Mus musculus
cacgccccattgcatagacgtttgg

SEQ ID NO: 306927 - DNA, 25 bp, Mus musculus
cacgccccattggatagacgtttgg

SEQ ID NO: 306928 - DNA, 25 bp, Mus musculus
cacgcccggcgaaaataaatattct

SEQ ID NO: 306929 - DNA, 25 bp, Mus musculus
cacgcccggcgataataaatattct

SEQ ID NO: 306930 - DNA, 25 bp, Mus musculus
cacgcccggcttcaacaatatattt

SEQ ID NO: 306931 - DNA, 25 bp, Mus musculus
cacgcccggcttgaacaatatattt

SEQ ID NO: 306932 - DNA, 25 bp, Mus musculus
cacgccgcaaggagctcgagaatgt

SEQ ID NO: 306933 - DNA, 25 bp, Mus musculus
cacgccgcaaggtgctcgagaatgt

SEQ ID NO: 306934 - DNA, 25 bp, Mus musculus
cacgccgggcagatttctgtattaa

SEQ ID NO: 306935 - DNA, 25 bp, Mus musculus
cacgccgggcagttttctgtattaa

SEQ ID NO: 306936 - DNA, 25 bp, Mus musculus
cacgccgtttggagcgttcttgcgg

SEQ ID NO: 306937 - DNA, 25 bp, Mus musculus
cacgccgtttggtgcgttcttgcgg

SEQ ID NO: 306938 - DNA, 25 bp, Mus musculus
cacgcctagtttatgcaatcctgaa

SEQ ID NO: 306939 - DNA, 25 bp, Mus musculus
cacgcctagtttttgcaatcctgaa

SEQ ID NO: 306940 - DNA, 25 bp, Mus musculus
cacgcctcaagaaggtggctctgaa

SEQ ID NO: 306941 - DNA, 25 bp, Mus musculus
cacgcctcaagatggtggctctgaa

SEQ ID NO: 306942 - DNA, 25 bp, Mus musculus
cacgcctgacttatgacccagactt

SEQ ID NO: 306943 - DNA, 25 bp, Mus musculus
cacgcctgacttttgacccagactt

SEQ ID NO: 306944 - DNA, 25 bp, Mus musculus
cacgcctggatgacaacgtcagcaa

SEQ ID NO: 306945 - DNA, 25 bp, Mus musculus
cacgcctggatgtcaacgtcagcaa

SEQ ID NO: 306946 - DNA, 25 bp, Mus musculus
cacgcctggttcacgtttactgttt

SEQ ID NO: 306947 - DNA, 25 bp, Mus musculus
cacgcctggttctcgtttactgttt

SEQ ID NO: 306948 - DNA, 25 bp, Mus musculus
cacgcctgtggcaactgatgggaac

SEQ ID NO: 306949 - DNA, 25 bp, Mus musculus
cacgcctgtggctactgatgggaac

SEQ ID NO: 306950 - DNA, 25 bp, Mus musculus
cacgccttgataaattgtttctgat

SEQ ID NO: 306951 - DNA, 25 bp, Mus musculus
cacgccttgatatattgtttctgat

SEQ ID NO: 306952 - DNA, 25 bp, Mus musculus
cacgcctttagcaagatgccaagct

SEQ ID NO: 306953 - DNA, 25 bp, Mus musculus
cacgcctttagctagatgccaagct

SEQ ID NO: 306954 - DNA, 25 bp, Mus musculus
cacgcgagtcggaggagttacccta

SEQ ID NO: 306955 - DNA, 25 bp, Mus musculus
cacgcgagtcggtggagttacccta

SEQ ID NO: 306956 - DNA, 25 bp, Mus musculus
cacgcgatcatacattgggctacat

SEQ ID NO: 306957 - DNA, 25 bp, Mus musculus
cacgcgatcatagattgggctacat

SEQ ID NO: 306958 - DNA, 25 bp, Mus musculus
cacgcggatcctccagatggaggag

SEQ ID NO: 306959 - DNA, 25 bp, Mus musculus
cacgcggatcctgcagatggaggag

SEQ ID NO: 306960 - DNA, 25 bp, Mus musculus
cacgcggatctcaacttcgagagca

SEQ ID NO: 306961 - DNA, 25 bp, Mus musculus
cacgcggatctctacttcgagagca

SEQ ID NO: 306962 - DNA, 25 bp, Mus musculus
cacgcggattccagtacaccttgat

SEQ ID NO: 306963 - DNA, 25 bp, Mus musculus
cacgcggattcctgtacaccttgat

SEQ ID NO: 306964 - DNA, 25 bp, Mus musculus
cacgcggctggcaatttggagatta

SEQ ID NO: 306965 - DNA, 25 bp, Mus musculus
cacgcggctggctatttggagatta

SEQ ID NO: 306966 - DNA, 25 bp, Mus musculus
cacgcgtcgctgaagagagcgctgt

SEQ ID NO: 306967 - DNA, 25 bp, Mus musculus
cacgcgtcgctgtagagagcgctgt

SEQ ID NO: 306968 - DNA, 25 bp, Mus musculus
cacgcgtggtgccagcggctacctt

SEQ ID NO: 306969 - DNA, 25 bp, Mus musculus
cacgcgtggtgcgagcggctacctt

SEQ ID NO: 306970 - DNA, 25 bp, Mus musculus
cacgcgtgtctcatgtttgtgcatg

SEQ ID NO: 306971 - DNA, 25 bp, Mus musculus
cacgcgtgtctcttgtttgtgcatg

SEQ ID NO: 306972 - DNA, 25 bp, Mus musculus
cacgcgttagacagctgatccgggt

SEQ ID NO: 306973 - DNA, 25 bp, Mus musculus
cacgcgttagactgctgatccgggt

SEQ ID NO: 306974 - DNA, 25 bp, Mus musculus
cacgcgttcccaatgtgtagacgga

SEQ ID NO: 306975 - DNA, 25 bp, Mus musculus
cacgcgttcccattgtgtagacgga

SEQ ID NO: 306976 - DNA, 25 bp, Mus musculus
cacgcgttgaacactgcagggctgg

SEQ ID NO: 306977 - DNA, 25 bp, Mus musculus
cacgcgttgaactctgcagggctgg

SEQ ID NO: 306978 - DNA, 25 bp, Mus musculus
cacgctacactcagtggttctgcat

SEQ ID NO: 306979 - DNA, 25 bp, Mus musculus
cacgctacactctgtggttctgcat

SEQ ID NO: 306980 - DNA, 25 bp, Mus musculus
cacgctaggccaagagtgcttaaaa

SEQ ID NO: 306981 - DNA, 25 bp, Mus musculus
cacgctaggccatgagtgcttaaaa

SEQ ID NO: 306982 - DNA, 25 bp, Mus musculus
cacgctagtcagatgctggagagca

SEQ ID NO: 306983 - DNA, 25 bp, Mus musculus
cacgctagtcagttgctggagagca

SEQ ID NO: 306984 - DNA, 25 bp, Mus musculus
cacgctatacctccctgtaaatatg

SEQ ID NO: 306985 - DNA, 25 bp, Mus musculus
cacgctatacctgcctgtaaatatg

SEQ ID NO: 306986 - DNA, 25 bp, Mus musculus
cacgctatgacaacgacatgaccaa

SEQ ID NO: 306987 - DNA, 25 bp, Mus musculus
cacgctatgacatcgacatgaccaa

SEQ ID NO: 306988 - DNA, 25 bp, Mus musculus
cacgctcacgtgcatgtgtaagtca

SEQ ID NO: 306989 - DNA, 25 bp, Mus musculus
cacgctcacgtggatgtgtaagtca

SEQ ID NO: 306990 - DNA, 25 bp, Mus musculus
cacgctcagaggcagatgctgtctc

SEQ ID NO: 306991 - DNA, 25 bp, Mus musculus
cacgctcagagggagatgctgtctc

SEQ ID NO: 306992 - DNA, 25 bp, Mus musculus
cacgctcaggatcggcagggaaatc

SEQ ID NO: 306993 - DNA, 25 bp, Mus musculus
cacgctcaggatgggcagggaaatc

SEQ ID NO: 306994 - DNA, 25 bp, Mus musculus
cacgctcatccacgcggtgtggaag

SEQ ID NO: 306995 - DNA, 25 bp, Mus musculus
cacgctcatccaggcggtgtggaag

SEQ ID NO: 306996 - DNA, 25 bp, Mus musculus
cacgctccaagaacctaactggtga

SEQ ID NO: 306997 - DNA, 25 bp, Mus musculus
cacgctccaagatcctaactggtga

SEQ ID NO: 306998 - DNA, 25 bp, Mus musculus
cacgctcccgggatcgtcgacggag

SEQ ID NO: 306999 - DNA, 25 bp, Mus musculus
cacgctcccgggttcgtcgacggag

SEQ ID NO: 307000 - DNA, 25 bp, Mus musculus
cacgctccgaccagtgttgggaaag

SEQ ID NO: 307001 - DNA, 25 bp, Mus musculus
cacgctccgacctgtgttgggaaag

SEQ ID NO: 307002 - DNA, 25 bp, Mus musculus
cacgctcctctacggaaggaactgt

SEQ ID NO: 307003 - DNA, 25 bp, Mus musculus
cacgctcctctagggaaggaactgt

SEQ ID NO: 307004 - DNA, 25 bp, Mus musculus
cacgctcgggcactagtcagagagt

SEQ ID NO: 307005 - DNA, 25 bp, Mus musculus
cacgctcgggcagtagtcagagagt

SEQ ID NO: 307006 - DNA, 25 bp, Mus musculus
cacgctctagctattcctagttgtc

SEQ ID NO: 307007 - DNA, 25 bp, Mus musculus
cacgctctagcttttcctagttgtc

SEQ ID NO: 307008 - DNA, 25 bp, Mus musculus
cacgctctcttgagtgaggtggcct

SEQ ID NO: 307009 - DNA, 25 bp, Mus musculus
cacgctctcttgtgtgaggtggcct

SEQ ID NO: 307010 - DNA, 25 bp, Mus musculus
cacgctgaaacaagctggtctgaca

SEQ ID NO: 307011 - DNA, 25 bp, Mus musculus
cacgctgaaacatgctggtctgaca

SEQ ID NO: 307012 - DNA, 25 bp, Mus musculus
cacgctgagatgctgatgtcttgga

SEQ ID NO: 307013 - DNA, 25 bp, Mus musculus
cacgctgagatggtgatgtcttgga

SEQ ID NO: 307014 - DNA, 25 bp, Mus musculus
cacgctgagcacatttcggaactat

SEQ ID NO: 307015 - DNA, 25 bp, Mus musculus
cacgctgagcacttttcggaactat

SEQ ID NO: 307016 - DNA, 25 bp, Mus musculus
cacgctgataatatcccgcttaaaa

SEQ ID NO: 307017 - DNA, 25 bp, Mus musculus
cacgctgataatttcccgcttaaaa

SEQ ID NO: 307018 - DNA, 25 bp, Mus musculus
cacgctgattgccatcttcaaggag

SEQ ID NO: 307019 - DNA, 25 bp, Mus musculus
cacgctgattgcgatcttcaaggag

SEQ ID NO: 307020 - DNA, 25 bp, Mus musculus
cacgctgatttccatgctggcagtc

SEQ ID NO: 307021 - DNA, 25 bp, Mus musculus
cacgctgatttcgatgctggcagtc

SEQ ID NO: 307022 - DNA, 25 bp, Mus musculus
cacgctgcccagctatggtataata

SEQ ID NO: 307023 - DNA, 25 bp, Mus musculus
cacgctgcccaggtatggtataata

SEQ ID NO: 307024 - DNA, 25 bp, Mus musculus
cacgctgctactcctgacagcaatt

SEQ ID NO: 307025 - DNA, 25 bp, Mus musculus
cacgctgctactgctgacagcaatt

SEQ ID NO: 307026 - DNA, 25 bp, Mus musculus
cacgctgctgagctgcgcaggaaca

SEQ ID NO: 307027 - DNA, 25 bp, Mus musculus
cacgctgctgaggtgcgcaggaaca

SEQ ID NO: 307028 - DNA, 25 bp, Mus musculus
cacgctgctttacgttttggtcttc

SEQ ID NO: 307029 - DNA, 25 bp, Mus musculus
cacgctgctttaggttttggtcttc

SEQ ID NO: 307030 - DNA, 25 bp, Mus musculus
cacgctggcttacgctttttgttaa

SEQ ID NO: 307031 - DNA, 25 bp, Mus musculus
cacgctggcttaggctttttgttaa

SEQ ID NO: 307032 - DNA, 25 bp, Mus musculus
cacgctggctttcactcaattattt

SEQ ID NO: 307033 - DNA, 25 bp, Mus musculus
cacgctggctttgactcaattattt

SEQ ID NO: 307034 - DNA, 25 bp, Mus musculus
cacgctgggatcagtttgtggcaga

SEQ ID NO: 307035 - DNA, 25 bp, Mus musculus
cacgctgggatctgtttgtggcaga

SEQ ID NO: 307036 - DNA, 25 bp, Mus musculus
cacgctggtaacatacgtgcctgtt

SEQ ID NO: 307037 - DNA, 25 bp, Mus musculus
cacgctggtaacttacgtgcctgtt

SEQ ID NO: 307038 - DNA, 25 bp, Mus musculus
cacgctgtcctgaggtcttgagatt

SEQ ID NO: 307039 - DNA, 25 bp, Mus musculus
cacgctgtcctgtggtcttgagatt

SEQ ID NO: 307040 - DNA, 25 bp, Mus musculus
cacgctgtccttcctgtgagcagga

SEQ ID NO: 307041 - DNA, 25 bp, Mus musculus
cacgctgtccttgctgtgagcagga

SEQ ID NO: 307042 - DNA, 25 bp, Mus musculus
cacgctgtcttaactactcttcaac

SEQ ID NO: 307043 - DNA, 25 bp, Mus musculus
cacgctgtcttatctactcttcaac

SEQ ID NO: 307044 - DNA, 25 bp, Mus musculus
cacgctgtggttagatgatgcgctc

SEQ ID NO: 307045 - DNA, 25 bp, Mus musculus
cacgctgtggtttgatgatgcgctc

SEQ ID NO: 307046 - DNA, 25 bp, Mus musculus
cacgctgtgttcattttgccaaata

SEQ ID NO: 307047 - DNA, 25 bp, Mus musculus
cacgctgtgttctttttgccaaata

SEQ ID NO: 307048 - DNA, 25 bp, Mus musculus
cacgctgttcccacttttattttgt

SEQ ID NO: 307049 - DNA, 25 bp, Mus musculus
cacgctgttccctcttttattttgt

SEQ ID NO: 307050 - DNA, 25 bp, Mus musculus
cacgcttactaacaggtcagaccat

SEQ ID NO: 307051 - DNA, 25 bp, Mus musculus
cacgcttactaagaggtcagaccat

SEQ ID NO: 307052 - DNA, 25 bp, Mus musculus
cacgcttccatgcacttgtggtgag

SEQ ID NO: 307053 - DNA, 25 bp, Mus musculus
cacgcttccatggacttgtggtgag

SEQ ID NO: 307054 - DNA, 25 bp, Mus musculus
cacgcttcctacatcattggaggga

SEQ ID NO: 307055 - DNA, 25 bp, Mus musculus
cacgcttcctacttcattggaggga

SEQ ID NO: 307056 - DNA, 25 bp, Mus musculus
cacgcttgagcgatggatctgacaa

SEQ ID NO: 307057 - DNA, 25 bp, Mus musculus
cacgcttgagcgttggatctgacaa

SEQ ID NO: 307058 - DNA, 25 bp, Mus musculus
cacgctttcattatccctatttaat

SEQ ID NO: 307059 - DNA, 25 bp, Mus musculus
cacgctttcattttccctatttaat

SEQ ID NO: 307060 - DNA, 25 bp, Mus musculus
cacgctttgtatatgggaccttcag

SEQ ID NO: 307061 - DNA, 25 bp, Mus musculus
cacgctttgtatttgggaccttcag

SEQ ID NO: 307062 - DNA, 25 bp, Mus musculus
cacgcttttacccactagagcaaga

SEQ ID NO: 307063 - DNA, 25 bp, Mus musculus
cacgcttttaccgactagagcaaga

SEQ ID NO: 307064 - DNA, 25 bp, Mus musculus
cacggaaaactaatgtacaactata

SEQ ID NO: 307065 - DNA, 25 bp, Mus musculus
cacggaaaactattgtacaactata

SEQ ID NO: 307066 - DNA, 25 bp, Mus musculus
cacggaaagggtatacttctcattt

SEQ ID NO: 307067 - DNA, 25 bp, Mus musculus
cacggaaagggtttacttctcattt

SEQ ID NO: 307068 - DNA, 25 bp, Mus musculus
cacggaaattctagttggctgcccc

SEQ ID NO: 307069 - DNA, 25 bp, Mus musculus
cacggaaattcttgttggctgcccc

SEQ ID NO: 307070 - DNA, 25 bp, Mus musculus
cacggaaccagtcacccaattttgg

SEQ ID NO: 307071 - DNA, 25 bp, Mus musculus
cacggaaccagtgacccaattttgg

SEQ ID NO: 307072 - DNA, 25 bp, Mus musculus
cacggaacccccaaacaattgacat

SEQ ID NO: 307073 - DNA, 25 bp, Mus musculus
cacggaaccccctaacaattgacat

SEQ ID NO: 307074 - DNA, 25 bp, Mus musculus
cacggaactgtgagctagctggaat

SEQ ID NO: 307075 - DNA, 25 bp, Mus musculus
cacggaactgtgatatactgccaag

SEQ ID NO: 307076 - DNA, 25 bp, Mus musculus
cacggaactgtgtgctagctggaat

SEQ ID NO: 307077 - DNA, 25 bp, Mus musculus
cacggaactgtgttatactgccaag

SEQ ID NO: 307078 - DNA, 25 bp, Mus musculus
cacggaactttacactcagtggtta

SEQ ID NO: 307079 - DNA, 25 bp, Mus musculus
cacggaactttagactcagtggtta

SEQ ID NO: 307080 - DNA, 25 bp, Mus musculus
cacggaagggctcacactggacagt

SEQ ID NO: 307081 - DNA, 25 bp, Mus musculus
cacggaagggctgacactggacagt

SEQ ID NO: 307082 - DNA, 25 bp, Mus musculus
cacggaagtgagcttttcagagcat

SEQ ID NO: 307083 - DNA, 25 bp, Mus musculus
cacggaagtgaggttttcagagcat

SEQ ID NO: 307084 - DNA, 25 bp, Mus musculus
cacggaatagctatttattccgctc

SEQ ID NO: 307085 - DNA, 25 bp, Mus musculus
cacggaatagctttttattccgctc

SEQ ID NO: 307086 - DNA, 25 bp, Mus musculus
cacggacaagagaggcagctgccat

SEQ ID NO: 307087 - DNA, 25 bp, Mus musculus
cacggacaagagtggcagctgccat

SEQ ID NO: 307088 - DNA, 25 bp, Mus musculus
cacggacctgtgaatggaactcatg

SEQ ID NO: 307089 - DNA, 25 bp, Mus musculus
cacggacctgtgtatggaactcatg

SEQ ID NO: 307090 - DNA, 25 bp, Mus musculus
cacggacgacgacgacttttacact

SEQ ID NO: 307091 - DNA, 25 bp, Mus musculus
cacggacgacgaggacttttacact

SEQ ID NO: 307092 - DNA, 25 bp, Mus musculus
cacggacggccacggcgaagatcca

SEQ ID NO: 307093 - DNA, 25 bp, Mus musculus
cacggacggccagggcgaagatcca

SEQ ID NO: 307094 - DNA, 25 bp, Mus musculus
cacggactcgagctcgtcatcaaga

SEQ ID NO: 307095 - DNA, 25 bp, Mus musculus
cacggactcgaggtcgtcatcaaga

SEQ ID NO: 307096 - DNA, 25 bp, Mus musculus
cacggactgatcattctgttgccaa

SEQ ID NO: 307097 - DNA, 25 bp, Mus musculus
cacggactgatctttctgttgccaa

SEQ ID NO: 307098 - DNA, 25 bp, Mus musculus
cacggagagctcacagtaacactgt

SEQ ID NO: 307099 - DNA, 25 bp, Mus musculus
cacggagagctctcagtaacactgt

SEQ ID NO: 307100 - DNA, 25 bp, Mus musculus
cacggagcagtacatgcactcgctg

SEQ ID NO: 307101 - DNA, 25 bp, Mus musculus
cacggagcagtagatgcactcgctg

SEQ ID NO: 307102 - DNA, 25 bp, Mus musculus
cacggagccaggcatcttggtctga

SEQ ID NO: 307103 - DNA, 25 bp, Mus musculus
cacggagccagggatcttggtctga

SEQ ID NO: 307104 - DNA, 25 bp, Mus musculus
cacggagccagtaagaagacatgaa

SEQ ID NO: 307105 - DNA, 25 bp, Mus musculus
cacggagccagttagaagacatgaa

SEQ ID NO: 307106 - DNA, 25 bp, Mus musculus
cacggagcccagacgctgtgagtac

SEQ ID NO: 307107 - DNA, 25 bp, Mus musculus
cacggagcccagtcgctgtgagtac

SEQ ID NO: 307108 - DNA, 25 bp, Mus musculus
cacggagcgttaaccacaccttact

SEQ ID NO: 307109 - DNA, 25 bp, Mus musculus
cacggagcgttatccacaccttact

SEQ ID NO: 307110 - DNA, 25 bp, Mus musculus
cacggagctgcgagcctaacaggaa

SEQ ID NO: 307111 - DNA, 25 bp, Mus musculus
cacggagctgcgtgcctaacaggaa

SEQ ID NO: 307112 - DNA, 25 bp, Mus musculus
cacggaggaactccttgatcatacc

SEQ ID NO: 307113 - DNA, 25 bp, Mus musculus
cacggaggaactgcttgatcatacc

SEQ ID NO: 307114 - DNA, 25 bp, Mus musculus
cacggaggagaaatccaattttagg

SEQ ID NO: 307115 - DNA, 25 bp, Mus musculus
cacggaggagaattccaattttagg

SEQ ID NO: 307116 - DNA, 25 bp, Mus musculus
cacggaggatggatgagttcgcctt

SEQ ID NO: 307117 - DNA, 25 bp, Mus musculus
cacggaggatggttgagttcgcctt

SEQ ID NO: 307118 - DNA, 25 bp, Mus musculus
cacggaggtcagagatagtctttaa

SEQ ID NO: 307119 - DNA, 25 bp, Mus musculus
cacggaggtcagtgatagtctttaa

SEQ ID NO: 307120 - DNA, 25 bp, Mus musculus
cacggagtcagccatgaagaaaata

SEQ ID NO: 307121 - DNA, 25 bp, Mus musculus
cacggagtcagcgatgaagaaaata

SEQ ID NO: 307122 - DNA, 25 bp, Mus musculus
cacggagtctcaaacctgcaggaat

SEQ ID NO: 307123 - DNA, 25 bp, Mus musculus
cacggagtctcatacctgcaggaat

SEQ ID NO: 307124 - DNA, 25 bp, Mus musculus
cacggagtgtatcgccacaagcagc

SEQ ID NO: 307125 - DNA, 25 bp, Mus musculus
cacggagtgtatggccacaagcagc

SEQ ID NO: 307126 - DNA, 25 bp, Mus musculus
cacggataacaacatcctggtgtta

SEQ ID NO: 307127 - DNA, 25 bp, Mus musculus
cacggataacaagatcctggtgtta

SEQ ID NO: 307128 - DNA, 25 bp, Mus musculus
cacggataatggagatgccctccat

SEQ ID NO: 307129 - DNA, 25 bp, Mus musculus
cacggataatggtgatgccctccat

SEQ ID NO: 307130 - DNA, 25 bp, Mus musculus
cacggatccttgctcttaatgttga

SEQ ID NO: 307131 - DNA, 25 bp, Mus musculus
cacggatccttggtcttaatgttga

SEQ ID NO: 307132 - DNA, 25 bp, Mus musculus
cacggatcggctactgtcagaacta

SEQ ID NO: 307133 - DNA, 25 bp, Mus musculus
cacggatcggcttctgtcagaacta

SEQ ID NO: 307134 - DNA, 25 bp, Mus musculus
cacggatgacatcgatcttcctggg

SEQ ID NO: 307135 - DNA, 25 bp, Mus musculus
cacggatgacatggatcttcctggg

SEQ ID NO: 307136 - DNA, 25 bp, Mus musculus
cacggatgctgacgcagtgtcctat

SEQ ID NO: 307137 - DNA, 25 bp, Mus musculus
cacggatgctgaggcagtgtcctat

SEQ ID NO: 307138 - DNA, 25 bp, Mus musculus
cacggatgttggctatgacagacag

SEQ ID NO: 307139 - DNA, 25 bp, Mus musculus
cacggatgttgggtatgacagacag

SEQ ID NO: 307140 - DNA, 25 bp, Mus musculus
cacggattcccaagcgatcacagga

SEQ ID NO: 307141 - DNA, 25 bp, Mus musculus
cacggattcccatgcgatcacagga

SEQ ID NO: 307142 - DNA, 25 bp, Mus musculus
cacggattgtacacttatgggtaaa

SEQ ID NO: 307143 - DNA, 25 bp, Mus musculus
cacggattgtactcttatgggtaaa

SEQ ID NO: 307144 - DNA, 25 bp, Mus musculus
cacggattttctcgctttcaaggag

SEQ ID NO: 307145 - DNA, 25 bp, Mus musculus
cacggattttctggctttcaaggag

SEQ ID NO: 307146 - DNA, 25 bp, Mus musculus
cacggatttttcctcccaacagtgg

SEQ ID NO: 307147 - DNA, 25 bp, Mus musculus
cacggatttttcgtcccaacagtgg

SEQ ID NO: 307148 - DNA, 25 bp, Mus musculus
cacggcaaccgacagatgaccttga

SEQ ID NO: 307149 - DNA, 25 bp, Mus musculus
cacggcaaccgagagatgaccttga

SEQ ID NO: 307150 - DNA, 25 bp, Mus musculus
cacggcaagaacctctgcagtgtgt

SEQ ID NO: 307151 - DNA, 25 bp, Mus musculus
cacggcaagaacgtctgcagtgtgt

SEQ ID NO: 307152 - DNA, 25 bp, Mus musculus
cacggcactcaactcagatacacag

SEQ ID NO: 307153 - DNA, 25 bp, Mus musculus
cacggcactcaagtcagatacacag

SEQ ID NO: 307154 - DNA, 25 bp, Mus musculus
cacggcactccgcgagctgtatcgg

SEQ ID NO: 307155 - DNA, 25 bp, Mus musculus
cacggcactccgggagctgtatcgg

SEQ ID NO: 307156 - DNA, 25 bp, Mus musculus
cacggcactgtaaggcgagagcgac

SEQ ID NO: 307157 - DNA, 25 bp, Mus musculus
cacggcactgtatggcgagagcgac

SEQ ID NO: 307158 - DNA, 25 bp, Mus musculus
cacggcagaggacctgtattatgta

SEQ ID NO: 307159 - DNA, 25 bp, Mus musculus
cacggcagaggagctgtattatgta

SEQ ID NO: 307160 - DNA, 25 bp, Mus musculus
cacggcagcctgattattgattgac

SEQ ID NO: 307161 - DNA, 25 bp, Mus musculus
cacggcagcctgtttattgattgac

SEQ ID NO: 307162 - DNA, 25 bp, Mus musculus
cacggcagctgcagtagtcctggca

SEQ ID NO: 307163 - DNA, 25 bp, Mus musculus
cacggcagctgctgtagtcctggca

SEQ ID NO: 307164 - DNA, 25 bp, Mus musculus
cacggcagctgtacctgtcggtgaa

SEQ ID NO: 307165 - DNA, 25 bp, Mus musculus
cacggcagctgttcctgtcggtgaa

SEQ ID NO: 307166 - DNA, 25 bp, Mus musculus
cacggcagggatatgtaccgctgtg

SEQ ID NO: 307167 - DNA, 25 bp, Mus musculus
cacggcagggatttgtaccgctgtg

SEQ ID NO: 307168 - DNA, 25 bp, Mus musculus
cacggccatgtcatgagggctttga

SEQ ID NO: 307169 - DNA, 25 bp, Mus musculus
cacggccatgtcttgagggctttga

SEQ ID NO: 307170 - DNA, 25 bp, Mus musculus
cacggcccagcacgcgatgagacag

SEQ ID NO: 307171 - DNA, 25 bp, Mus musculus
cacggcccagcaggcgatgagacag

SEQ ID NO: 307172 - DNA, 25 bp, Mus musculus
cacggccccttcaatgaggtaacaa

SEQ ID NO: 307173 - DNA, 25 bp, Mus musculus
cacggccccttctatgaggtaacaa

SEQ ID NO: 307174 - DNA, 25 bp, Mus musculus
cacggccgctaccatgcaaagcaaa

SEQ ID NO: 307175 - DNA, 25 bp, Mus musculus
cacggccgctacgatgcaaagcaaa

SEQ ID NO: 307176 - DNA, 25 bp, Mus musculus
cacggcctatttcttgatgtaagtt

SEQ ID NO: 307177 - DNA, 25 bp, Mus musculus
cacggcctatttgttgatgtaagtt

SEQ ID NO: 307178 - DNA, 25 bp, Mus musculus
cacggcctcatgacttggtgtctga

SEQ ID NO: 307179 - DNA, 25 bp, Mus musculus
cacggcctcatgtcttggtgtctga

SEQ ID NO: 307180 - DNA, 25 bp, Mus musculus
cacggcctggcgcatggagagcgct

SEQ ID NO: 307181 - DNA, 25 bp, Mus musculus
cacggcctggcggatggagagcgct

SEQ ID NO: 307182 - DNA, 25 bp, Mus musculus
cacggccttatcctgtcttcaaagg

SEQ ID NO: 307183 - DNA, 25 bp, Mus musculus
cacggccttatcgtgtcttcaaagg

SEQ ID NO: 307184 - DNA, 25 bp, Mus musculus
cacggcgccaagcacaaggacgact

SEQ ID NO: 307185 - DNA, 25 bp, Mus musculus
cacggcgccaaggacaaggacgact

SEQ ID NO: 307186 - DNA, 25 bp, Mus musculus
cacggcggcgccaacaagaagctga

SEQ ID NO: 307187 - DNA, 25 bp, Mus musculus
cacggcggcgcctacaagaagctga

SEQ ID NO: 307188 - DNA, 25 bp, Mus musculus
cacggctatggtagtttggctatga

SEQ ID NO: 307189 - DNA, 25 bp, Mus musculus
cacggctatggttgtttggctatga

SEQ ID NO: 307190 - DNA, 25 bp, Mus musculus
cacggctcaacgctggaatcagttt

SEQ ID NO: 307191 - DNA, 25 bp, Mus musculus
cacggctcaacggtggaatcagttt

SEQ ID NO: 307192 - DNA, 25 bp, Mus musculus
cacggctcccagcaggtccagtgga

SEQ ID NO: 307193 - DNA, 25 bp, Mus musculus
cacggctcccaggaggtccagtgga

SEQ ID NO: 307194 - DNA, 25 bp, Mus musculus
cacggctcggtgcatgctatgacag

SEQ ID NO: 307195 - DNA, 25 bp, Mus musculus
cacggctcggtggatgctatgacag

SEQ ID NO: 307196 - DNA, 25 bp, Mus musculus
cacggctctggacaacttgcacatg

SEQ ID NO: 307197 - DNA, 25 bp, Mus musculus
cacggctctggagaacttgcacatg

SEQ ID NO: 307198 - DNA, 25 bp, Mus musculus
cacggctgaagcagcatctgatgaa

SEQ ID NO: 307199 - DNA, 25 bp, Mus musculus
cacggctgaagctgcatctgatgaa

SEQ ID NO: 307200 - DNA, 25 bp, Mus musculus
cacggctgaattatcctaatttcta

SEQ ID NO: 307201 - DNA, 25 bp, Mus musculus
cacggctgaattttcctaatttcta

SEQ ID NO: 307202 - DNA, 25 bp, Mus musculus
cacggctgagcaagggtttcccaga

SEQ ID NO: 307203 - DNA, 25 bp, Mus musculus
cacggctgagcatgggtttcccaga

SEQ ID NO: 307204 - DNA, 25 bp, Mus musculus
cacggctgattcctattttaaagac

SEQ ID NO: 307205 - DNA, 25 bp, Mus musculus
cacggctgattcgtattttaaagac

SEQ ID NO: 307206 - DNA, 25 bp, Mus musculus
cacggctggagcactttgtggtgct

SEQ ID NO: 307207 - DNA, 25 bp, Mus musculus
cacggctggagctctttgtggtgct

SEQ ID NO: 307208 - DNA, 25 bp, Mus musculus
cacggctgtcccaaactggaggaaa

SEQ ID NO: 307209 - DNA, 25 bp, Mus musculus
cacggctgtccctaactggaggaaa

SEQ ID NO: 307210 - DNA, 25 bp, Mus musculus
cacggcttcattcgagccctaaagt

SEQ ID NO: 307211 - DNA, 25 bp, Mus musculus
cacggcttcattggagccctaaagt

SEQ ID NO: 307212 - DNA, 25 bp, Mus musculus
cacggcttctctcggaggtgtttgc

SEQ ID NO: 307213 - DNA, 25 bp, Mus musculus
cacggcttctctgggaggtgtttgc

SEQ ID NO: 307214 - DNA, 25 bp, Mus musculus
cacggctttgatactcgccaagaga

SEQ ID NO: 307215 - DNA, 25 bp, Mus musculus
cacggctttgattctcgccaagaga

SEQ ID NO: 307216 - DNA, 25 bp, Mus musculus
cacgggaaagagcttattaacttca

SEQ ID NO: 307217 - DNA, 25 bp, Mus musculus
cacgggaaagaggttattaacttca

SEQ ID NO: 307218 - DNA, 25 bp, Mus musculus
cacgggaagcccagccttgaggaga

SEQ ID NO: 307219 - DNA, 25 bp, Mus musculus
cacgggaagccctgccttgaggaga

SEQ ID NO: 307220 - DNA, 25 bp, Mus musculus
cacgggaagctacttgctttcttga

SEQ ID NO: 307221 - DNA, 25 bp, Mus musculus
cacgggaagctagttgctttcttga

SEQ ID NO: 307222 - DNA, 25 bp, Mus musculus
cacgggaatggaatgccgagatttc

SEQ ID NO: 307223 - DNA, 25 bp, Mus musculus
cacgggaatggattgccgagatttc

SEQ ID NO: 307224 - DNA, 25 bp, Mus musculus
cacgggaccattctgcacattaggt

SEQ ID NO: 307225 - DNA, 25 bp, Mus musculus
cacgggaccattgtgcacattaggt

SEQ ID NO: 307226 - DNA, 25 bp, Mus musculus
cacgggacgctgctatgtatgtata

SEQ ID NO: 307227 - DNA, 25 bp, Mus musculus
cacgggacgctggtatgtatgtata

SEQ ID NO: 307228 - DNA, 25 bp, Mus musculus
cacgggagaagccagcacaggcaga

SEQ ID NO: 307229 - DNA, 25 bp, Mus musculus
cacgggagaagcgagcacaggcaga

SEQ ID NO: 307230 - DNA, 25 bp, Mus musculus
cacgggaggagcatagttcaggatt

SEQ ID NO: 307231 - DNA, 25 bp, Mus musculus
cacgggaggagcttagttcaggatt

SEQ ID NO: 307232 - DNA, 25 bp, Mus musculus
cacgggagtaagaggccggatccaa

SEQ ID NO: 307233 - DNA, 25 bp, Mus musculus
cacgggagtaagtggccggatccaa

SEQ ID NO: 307234 - DNA, 25 bp, Mus musculus
cacgggagtactcgcccgcgtgcaa

SEQ ID NO: 307235 - DNA, 25 bp, Mus musculus
cacgggagtactggcccgcgtgcaa

SEQ ID NO: 307236 - DNA, 25 bp, Mus musculus
cacgggataggactcttgtctgcaa

SEQ ID NO: 307237 - DNA, 25 bp, Mus musculus
cacgggataggagtcttgtctgcaa

SEQ ID NO: 307238 - DNA, 25 bp, Mus musculus
cacgggattagtattgcaagcagtt

SEQ ID NO: 307239 - DNA, 25 bp, Mus musculus
cacgggattagttttgcaagcagtt

SEQ ID NO: 307240 - DNA, 25 bp, Mus musculus
cacgggcagtcgcttctagaatgta

SEQ ID NO: 307241 - DNA, 25 bp, Mus musculus
cacgggcagtcggttctagaatgta

SEQ ID NO: 307242 - DNA, 25 bp, Mus musculus
cacgggcatttcctcagatgagcat

SEQ ID NO: 307243 - DNA, 25 bp, Mus musculus
cacgggcatttcgtcagatgagcat

SEQ ID NO: 307244 - DNA, 25 bp, Mus musculus
cacgggcatttgcatgactgagatt

SEQ ID NO: 307245 - DNA, 25 bp, Mus musculus
cacgggcatttggatgactgagatt

SEQ ID NO: 307246 - DNA, 25 bp, Mus musculus
cacgggcctcgtattgtaatggaag

SEQ ID NO: 307247 - DNA, 25 bp, Mus musculus
cacgggcctcgttttgtaatggaag

SEQ ID NO: 307248 - DNA, 25 bp, Mus musculus
cacgggcgccatccttaagcaattc

SEQ ID NO: 307249 - DNA, 25 bp, Mus musculus
cacgggcgccatgcttaagcaattc

SEQ ID NO: 307250 - DNA, 25 bp, Mus musculus
cacgggctatccctatatactttag

SEQ ID NO: 307251 - DNA, 25 bp, Mus musculus
cacgggctatccgtatatactttag

SEQ ID NO: 307252 - DNA, 25 bp, Mus musculus
cacgggctgcgtatacagtcaacaa

SEQ ID NO: 307253 - DNA, 25 bp, Mus musculus
cacgggctgcgtttacagtcaacaa

SEQ ID NO: 307254 - DNA, 25 bp, Mus musculus
cacgggctgggcatacaggtgtacc

SEQ ID NO: 307255 - DNA, 25 bp, Mus musculus
cacgggctgggcttacaggtgtacc

SEQ ID NO: 307256 - DNA, 25 bp, Mus musculus
cacgggtaagatccctcctgaaagc

SEQ ID NO: 307257 - DNA, 25 bp, Mus musculus
cacgggtaagatgcctcctgaaagc

SEQ ID NO: 307258 - DNA, 25 bp, Mus musculus
cacgggtagcccaaggccagggaga

SEQ ID NO: 307259 - DNA, 25 bp, Mus musculus
cacgggtagccctaggccagggaga

SEQ ID NO: 307260 - DNA, 25 bp, Mus musculus
cacgggtcagacagtaggtgctcaa

SEQ ID NO: 307261 - DNA, 25 bp, Mus musculus
cacgggtcagactgtaggtgctcaa

SEQ ID NO: 307262 - DNA, 25 bp, Mus musculus
cacgggtgcactcttaggtctcaaa

SEQ ID NO: 307263 - DNA, 25 bp, Mus musculus
cacgggtgcactgttaggtctcaaa

SEQ ID NO: 307264 - DNA, 25 bp, Mus musculus
cacgggtgcttaatgctggtctgga

SEQ ID NO: 307265 - DNA, 25 bp, Mus musculus
cacgggtgcttattgctggtctgga

SEQ ID NO: 307266 - DNA, 25 bp, Mus musculus
cacgggtggcgcaacagggaacact

SEQ ID NO: 307267 - DNA, 25 bp, Mus musculus
cacgggtggcgctacagggaacact

SEQ ID NO: 307268 - DNA, 25 bp, Mus musculus
cacgggttcccaattctcacaaagg

SEQ ID NO: 307269 - DNA, 25 bp, Mus musculus
cacgggttcccatttctcacaaagg

SEQ ID NO: 307270 - DNA, 25 bp, Mus musculus
cacgggttgcctcgacgttatcttt

SEQ ID NO: 307271 - DNA, 25 bp, Mus musculus
cacgggttgcctggacgttatcttt

SEQ ID NO: 307272 - DNA, 25 bp, Mus musculus
cacgggtttactctgcctctggcat

SEQ ID NO: 307273 - DNA, 25 bp, Mus musculus
cacgggtttactgtgcctctggcat

SEQ ID NO: 307274 - DNA, 25 bp, Mus musculus
cacgggtttcctcaaaattctcaat

SEQ ID NO: 307275 - DNA, 25 bp, Mus musculus
cacgggtttcctgaaaattctcaat

SEQ ID NO: 307276 - DNA, 25 bp, Mus musculus
cacggtacacaaacatacacgcaaa

SEQ ID NO: 307277 - DNA, 25 bp, Mus musculus
cacggtacacaatcatacacgcaaa

SEQ ID NO: 307278 - DNA, 25 bp, Mus musculus
cacggtacagttagcctcagagaca

SEQ ID NO: 307279 - DNA, 25 bp, Mus musculus
cacggtacagtttgcctcagagaca

SEQ ID NO: 307280 - DNA, 25 bp, Mus musculus
cacggtacctttctgtcaagctggg

SEQ ID NO: 307281 - DNA, 25 bp, Mus musculus
cacggtacctttgtgtcaagctggg

SEQ ID NO: 307282 - DNA, 25 bp, Mus musculus
cacggtactgatcgcagctctatca

SEQ ID NO: 307283 - DNA, 25 bp, Mus musculus
cacggtactgatggcagctctatca

SEQ ID NO: 307284 - DNA, 25 bp, Mus musculus
cacggtagcaggcttctcttgagaa

SEQ ID NO: 307285 - DNA, 25 bp, Mus musculus
cacggtagcagggttctcttgagaa

SEQ ID NO: 307286 - DNA, 25 bp, Mus musculus
cacggtagtcttatgatcttcctga

SEQ ID NO: 307287 - DNA, 25 bp, Mus musculus
cacggtagtcttttgatcttcctga

SEQ ID NO: 307288 - DNA, 25 bp, Mus musculus
cacggtagtgtaacctcagctgaaa

SEQ ID NO: 307289 - DNA, 25 bp, Mus musculus
cacggtagtgtatcctcagctgaaa

SEQ ID NO: 307290 - DNA, 25 bp, Mus musculus
cacggtatatacattaaagcagctt

SEQ ID NO: 307291 - DNA, 25 bp, Mus musculus
cacggtatatactttaaagcagctt

SEQ ID NO: 307292 - DNA, 25 bp, Mus musculus
cacggtatgctcaaggtgctgtacg

SEQ ID NO: 307293 - DNA, 25 bp, Mus musculus
cacggtatgctctaggtgctgtacg

SEQ ID NO: 307294 - DNA, 25 bp, Mus musculus
cacggtattccacaacacagggttt

SEQ ID NO: 307295 - DNA, 25 bp, Mus musculus
cacggtattccagaacacagggttt

SEQ ID NO: 307296 - DNA, 25 bp, Mus musculus
cacggtattcttcaactgtagagga

SEQ ID NO: 307297 - DNA, 25 bp, Mus musculus
cacggtattcttgaactgtagagga

SEQ ID NO: 307298 - DNA, 25 bp, Mus musculus
cacggtatttctaccttcacaagtc

SEQ ID NO: 307299 - DNA, 25 bp, Mus musculus
cacggtatttcttccttcacaagtc

SEQ ID NO: 307300 - DNA, 25 bp, Mus musculus
cacggtcagggaatttgtaatatac

SEQ ID NO: 307301 - DNA, 25 bp, Mus musculus
cacggtcagggattttgtaatatac

SEQ ID NO: 307302 - DNA, 25 bp, Mus musculus
cacggtcatgacaaagggctctgga

SEQ ID NO: 307303 - DNA, 25 bp, Mus musculus
cacggtcatgactaagggctctgga

SEQ ID NO: 307304 - DNA, 25 bp, Mus musculus
cacggtccaccccttgtttctgtgt

SEQ ID NO: 307305 - DNA, 25 bp, Mus musculus
cacggtccacccgttgtttctgtgt

SEQ ID NO: 307306 - DNA, 25 bp, Mus musculus
cacggtccatagagcattctcagtt

SEQ ID NO: 307307 - DNA, 25 bp, Mus musculus
cacggtccatagtgcattctcagtt

SEQ ID NO: 307308 - DNA, 25 bp, Mus musculus
cacggtcctgctctggtcaataaag

SEQ ID NO: 307309 - DNA, 25 bp, Mus musculus
cacggtcctgctgtggtcaataaag

SEQ ID NO: 307310 - DNA, 25 bp, Mus musculus
cacggtcctgggatagcatgggata

SEQ ID NO: 307311 - DNA, 25 bp, Mus musculus
cacggtcctgggttagcatgggata

SEQ ID NO: 307312 - DNA, 25 bp, Mus musculus
cacggtcgcctcagtgtacaaaggg

SEQ ID NO: 307313 - DNA, 25 bp, Mus musculus
cacggtcgcctctgtgtacaaaggg

SEQ ID NO: 307314 - DNA, 25 bp, Mus musculus
cacggtctctaaagttcctattcaa

SEQ ID NO: 307315 - DNA, 25 bp, Mus musculus
cacggtctctaatgttcctattcaa

SEQ ID NO: 307316 - DNA, 25 bp, Mus musculus
cacggtctctggcatttggatacat

SEQ ID NO: 307317 - DNA, 25 bp, Mus musculus
cacggtctctgggatttggatacat

SEQ ID NO: 307318 - DNA, 25 bp, Mus musculus
cacggtctgttgagttgaccaggct

SEQ ID NO: 307319 - DNA, 25 bp, Mus musculus
cacggtctgttgtgttgaccaggct

SEQ ID NO: 307320 - DNA, 25 bp, Mus musculus
cacggtctgtttaccttaagtagct

SEQ ID NO: 307321 - DNA, 25 bp, Mus musculus
cacggtctgttttccttaagtagct

SEQ ID NO: 307322 - DNA, 25 bp, Mus musculus
cacggtcttgagaatccagatttca

SEQ ID NO: 307323 - DNA, 25 bp, Mus musculus
cacggtcttgagtatccagatttca

SEQ ID NO: 307324 - DNA, 25 bp, Mus musculus
cacggtcttggtattgatcatgctt

SEQ ID NO: 307325 - DNA, 25 bp, Mus musculus
cacggtcttggttttgatcatgctt

SEQ ID NO: 307326 - DNA, 25 bp, Mus musculus
cacggtcttttacccctgcgtggtg

SEQ ID NO: 307327 - DNA, 25 bp, Mus musculus
cacggtcttttagccctgcgtggtg

SEQ ID NO: 307328 - DNA, 25 bp, Mus musculus
cacggtgacatcagtctgtggtcct

SEQ ID NO: 307329 - DNA, 25 bp, Mus musculus
cacggtgacatctgtctgtggtcct

SEQ ID NO: 307330 - DNA, 25 bp, Mus musculus
cacggtgacttgattacagctgggt

SEQ ID NO: 307331 - DNA, 25 bp, Mus musculus
cacggtgacttgtttacagctgggt

SEQ ID NO: 307332 - DNA, 25 bp, Mus musculus
cacggtgatggaaaatgctcttgaa

SEQ ID NO: 307333 - DNA, 25 bp, Mus musculus
cacggtgatggataatgctcttgaa

SEQ ID NO: 307334 - DNA, 25 bp, Mus musculus
cacggtgcctttcacagacatatgt

SEQ ID NO: 307335 - DNA, 25 bp, Mus musculus
cacggtgcctttgacagacatatgt

SEQ ID NO: 307336 - DNA, 25 bp, Mus musculus
cacggtgcgggactatctgtcctga

SEQ ID NO: 307337 - DNA, 25 bp, Mus musculus
cacggtgcgggagtatctgtcctga

SEQ ID NO: 307338 - DNA, 25 bp, Mus musculus
cacggtggctctactctactggggt

SEQ ID NO: 307339 - DNA, 25 bp, Mus musculus
cacggtggctcttctctactggggt

SEQ ID NO: 307340 - DNA, 25 bp, Mus musculus
cacggtggtggaccactttttctgt

SEQ ID NO: 307341 - DNA, 25 bp, Mus musculus
cacggtggtggagcactttttctgt

SEQ ID NO: 307342 - DNA, 25 bp, Mus musculus
cacggtgtacatacactcaggtaca

SEQ ID NO: 307343 - DNA, 25 bp, Mus musculus
cacggtgtacattcactcaggtaca

SEQ ID NO: 307344 - DNA, 25 bp, Mus musculus
cacggtgtagctaccctggctggag

SEQ ID NO: 307345 - DNA, 25 bp, Mus musculus
cacggtgtagcttccctggctggag

SEQ ID NO: 307346 - DNA, 25 bp, Mus musculus
cacggtgtagtaatggtacccactg

SEQ ID NO: 307347 - DNA, 25 bp, Mus musculus
cacggtgtagtattggtacccactg

SEQ ID NO: 307348 - DNA, 25 bp, Mus musculus
cacggtgtctgtccaggatcctgaa

SEQ ID NO: 307349 - DNA, 25 bp, Mus musculus
cacggtgtctgtgcaggatcctgaa

SEQ ID NO: 307350 - DNA, 25 bp, Mus musculus
cacggtgtgaccattcaaattaaca

SEQ ID NO: 307351 - DNA, 25 bp, Mus musculus
cacggtgtgacctttcaaattaaca

SEQ ID NO: 307352 - DNA, 25 bp, Mus musculus
cacggtgtgggacctcaagcgcatc

SEQ ID NO: 307353 - DNA, 25 bp, Mus musculus
cacggtgtgggagctcaagcgcatc

SEQ ID NO: 307354 - DNA, 25 bp, Mus musculus
cacggtgttgtgacatgcctgaggc

SEQ ID NO: 307355 - DNA, 25 bp, Mus musculus
cacggtgttgtgtcatgcctgaggc

SEQ ID NO: 307356 - DNA, 25 bp, Mus musculus
cacggtgtttgtagaagagcccctt

SEQ ID NO: 307357 - DNA, 25 bp, Mus musculus
cacggtgtttgttgaagagcccctt

SEQ ID NO: 307358 - DNA, 25 bp, Mus musculus
cacggttacctcattagctaattca

SEQ ID NO: 307359 - DNA, 25 bp, Mus musculus
cacggttacctctttagctaattca

SEQ ID NO: 307360 - DNA, 25 bp, Mus musculus
cacggttcaatgctagattcgctgt

SEQ ID NO: 307361 - DNA, 25 bp, Mus musculus
cacggttcaatggtagattcgctgt

SEQ ID NO: 307362 - DNA, 25 bp, Mus musculus
cacggttcagctattcttcggagat

SEQ ID NO: 307363 - DNA, 25 bp, Mus musculus
cacggttcagcttttcttcggagat

SEQ ID NO: 307364 - DNA, 25 bp, Mus musculus
cacggttcatggactagtgacctaa

SEQ ID NO: 307365 - DNA, 25 bp, Mus musculus
cacggttcatggtctagtgacctaa

SEQ ID NO: 307366 - DNA, 25 bp, Mus musculus
cacggttcatgtctcaaatcctgga

SEQ ID NO: 307367 - DNA, 25 bp, Mus musculus
cacggttcatgtgtcaaatcctgga

SEQ ID NO: 307368 - DNA, 25 bp, Mus musculus
cacggttccatgcttcgaatcaatg

SEQ ID NO: 307369 - DNA, 25 bp, Mus musculus
cacggttccatggttcgaatcaatg

SEQ ID NO: 307370 - DNA, 25 bp, Mus musculus
cacggttccgggacctggctaagcg

SEQ ID NO: 307371 - DNA, 25 bp, Mus musculus
cacggttccgggtcctggctaagcg

SEQ ID NO: 307372 - DNA, 25 bp, Mus musculus
cacggttcgccgacgtatgatgatg

SEQ ID NO: 307373 - DNA, 25 bp, Mus musculus
cacggttcgccgtcgtatgatgatg

SEQ ID NO: 307374 - DNA, 25 bp, Mus musculus
cacggttctcctatcattaatgcaa

SEQ ID NO: 307375 - DNA, 25 bp, Mus musculus
cacggttctcctttcattaatgcaa

SEQ ID NO: 307376 - DNA, 25 bp, Mus musculus
cacggttctgttacttttggtctgt

SEQ ID NO: 307377 - DNA, 25 bp, Mus musculus
cacggttctgtttcttttggtctgt

SEQ ID NO: 307378 - DNA, 25 bp, Mus musculus
cacggtttccttcagacttctaaat

SEQ ID NO: 307379 - DNA, 25 bp, Mus musculus
cacggtttccttgagacttctaaat

SEQ ID NO: 307380 - DNA, 25 bp, Mus musculus
cacggtttgtggctgaatcttagag

SEQ ID NO: 307381 - DNA, 25 bp, Mus musculus
cacggtttgtgggtgaatcttagag

SEQ ID NO: 307382 - DNA, 25 bp, Mus musculus
cacgtaaacatgacttggccttctt

SEQ ID NO: 307383 - DNA, 25 bp, Mus musculus
cacgtaaacatgtcttggccttctt

SEQ ID NO: 307384 - DNA, 25 bp, Mus musculus
cacgtaaagcgcctgaatttatttt

SEQ ID NO: 307385 - DNA, 25 bp, Mus musculus
cacgtaaagcgcgtgaatttatttt

SEQ ID NO: 307386 - DNA, 25 bp, Mus musculus
cacgtacacattatactatatgcta

SEQ ID NO: 307387 - DNA, 25 bp, Mus musculus
cacgtacacattttactatatgcta

SEQ ID NO: 307388 - DNA, 25 bp, Mus musculus
cacgtacattacacagttcgagatt

SEQ ID NO: 307389 - DNA, 25 bp, Mus musculus
cacgtacattactcagttcgagatt

SEQ ID NO: 307390 - DNA, 25 bp, Mus musculus
cacgtaccagcgctacgatgtggat

SEQ ID NO: 307391 - DNA, 25 bp, Mus musculus
cacgtaccagcggtacgatgtggat

SEQ ID NO: 307392 - DNA, 25 bp, Mus musculus
cacgtaccgagtcacttcaagcatc

SEQ ID NO: 307393 - DNA, 25 bp, Mus musculus
cacgtaccgagtgacttcaagcatc

SEQ ID NO: 307394 - DNA, 25 bp, Mus musculus
cacgtactggaaccgggcgagcacc

SEQ ID NO: 307395 - DNA, 25 bp, Mus musculus
cacgtactggaagcgggcgagcacc

SEQ ID NO: 307396 - DNA, 25 bp, Mus musculus
cacgtactggagcaactggtgcaat

SEQ ID NO: 307397 - DNA, 25 bp, Mus musculus
cacgtactggaggaactggtgcaat

SEQ ID NO: 307398 - DNA, 25 bp, Mus musculus
cacgtacttcagattcatagcctgg

SEQ ID NO: 307399 - DNA, 25 bp, Mus musculus
cacgtacttcagtttcatagcctgg

SEQ ID NO: 307400 - DNA, 25 bp, Mus musculus
cacgtagctttccagaccatgggat

SEQ ID NO: 307401 - DNA, 25 bp, Mus musculus
cacgtagctttcgagaccatgggat

SEQ ID NO: 307402 - DNA, 25 bp, Mus musculus
cacgtagtcccactgaatgttgtgt

SEQ ID NO: 307403 - DNA, 25 bp, Mus musculus
cacgtagtcccagtgaatgttgtgt

SEQ ID NO: 307404 - DNA, 25 bp, Mus musculus
cacgtatacagtccatctttagata

SEQ ID NO: 307405 - DNA, 25 bp, Mus musculus
cacgtatacagtgcatctttagata

SEQ ID NO: 307406 - DNA, 25 bp, Mus musculus
cacgtatcgatgcttccagacttat

SEQ ID NO: 307407 - DNA, 25 bp, Mus musculus
cacgtatcgatggttccagacttat

SEQ ID NO: 307408 - DNA, 25 bp, Mus musculus
cacgtatgctaacagaatctcttga

SEQ ID NO: 307409 - DNA, 25 bp, Mus musculus
cacgtatgctaagagaatctcttga

SEQ ID NO: 307410 - DNA, 25 bp, Mus musculus
cacgtatgtgcacttgactgtatgt

SEQ ID NO: 307411 - DNA, 25 bp, Mus musculus
cacgtatgtgcagttgactgtatgt

SEQ ID NO: 307412 - DNA, 25 bp, Mus musculus
cacgtatttatgcaccctgctgtaa

SEQ ID NO: 307413 - DNA, 25 bp, Mus musculus
cacgtatttatggaccctgctgtaa

SEQ ID NO: 307414 - DNA, 25 bp, Mus musculus
cacgtcaatcaacgtatacatcatg

SEQ ID NO: 307415 - DNA, 25 bp, Mus musculus
cacgtcaatcaaggtatacatcatg

SEQ ID NO: 307416 - DNA, 25 bp, Mus musculus
cacgtcacaaggcaaccttctaact

SEQ ID NO: 307417 - DNA, 25 bp, Mus musculus
cacgtcacaagggaaccttctaact

SEQ ID NO: 307418 - DNA, 25 bp, Mus musculus
cacgtcactcacaagtttctgtttc

SEQ ID NO: 307419 - DNA, 25 bp, Mus musculus
cacgtcactcactagtttctgtttc

SEQ ID NO: 307420 - DNA, 25 bp, Mus musculus
cacgtcactgcacgacacacttggg

SEQ ID NO: 307421 - DNA, 25 bp, Mus musculus
cacgtcactgcaggacacacttggg

SEQ ID NO: 307422 - DNA, 25 bp, Mus musculus
cacgtcatctttaccctactttgga

SEQ ID NO: 307423 - DNA, 25 bp, Mus musculus
cacgtcatcttttccctactttgga

SEQ ID NO: 307424 - DNA, 25 bp, Mus musculus
cacgtccagggcatatgcagagtat

SEQ ID NO: 307425 - DNA, 25 bp, Mus musculus
cacgtccagggcttatgcagagtat

SEQ ID NO: 307426 - DNA, 25 bp, Mus musculus
cacgtcctacggaataacaaggcgt

SEQ ID NO: 307427 - DNA, 25 bp, Mus musculus
cacgtcctacggtataacaaggcgt

SEQ ID NO: 307428 - DNA, 25 bp, Mus musculus
cacgtcctagctcttctgtgaagat

SEQ ID NO: 307429 - DNA, 25 bp, Mus musculus
cacgtcctagctgttctgtgaagat

SEQ ID NO: 307430 - DNA, 25 bp, Mus musculus
cacgtcctgcagacagttggcattt

SEQ ID NO: 307431 - DNA, 25 bp, Mus musculus
cacgtcctgcagtcagttggcattt

SEQ ID NO: 307432 - DNA, 25 bp, Mus musculus
cacgtcctggagcagctattgtcaa

SEQ ID NO: 307433 - DNA, 25 bp, Mus musculus
cacgtcctggaggagctattgtcaa

SEQ ID NO: 307434 - DNA, 25 bp, Mus musculus
cacgtcgggccacatccggcagaag

SEQ ID NO: 307435 - DNA, 25 bp, Mus musculus
cacgtcgggccagatccggcagaag

SEQ ID NO: 307436 - DNA, 25 bp, Mus musculus
cacgtcggtggtacctacagcatgg

SEQ ID NO: 307437 - DNA, 25 bp, Mus musculus
cacgtcggtggttcctacagcatgg

SEQ ID NO: 307438 - DNA, 25 bp, Mus musculus
cacgtctatgctaaaccaccatttt

SEQ ID NO: 307439 - DNA, 25 bp, Mus musculus
cacgtctatgcttaaccaccatttt

SEQ ID NO: 307440 - DNA, 25 bp, Mus musculus
cacgtctatggacttaacttttcct

SEQ ID NO: 307441 - DNA, 25 bp, Mus musculus
cacgtctatggagttaacttttcct

SEQ ID NO: 307442 - DNA, 25 bp, Mus musculus
cacgtctctgagatgatctgaacaa

SEQ ID NO: 307443 - DNA, 25 bp, Mus musculus
cacgtctctgagttgatctgaacaa

SEQ ID NO: 307444 - DNA, 25 bp, Mus musculus
cacgtctgaataagtctggatgttt

SEQ ID NO: 307445 - DNA, 25 bp, Mus musculus
cacgtctgaatatgtctggatgttt

SEQ ID NO: 307446 - DNA, 25 bp, Mus musculus
cacgtctgtagacacatggctttga

SEQ ID NO: 307447 - DNA, 25 bp, Mus musculus
cacgtctgtagagacatggctttga

SEQ ID NO: 307448 - DNA, 25 bp, Mus musculus
cacgtcttctgcaagtgattttgaa

SEQ ID NO: 307449 - DNA, 25 bp, Mus musculus
cacgtcttctgctagtgattttgaa

SEQ ID NO: 307450 - DNA, 25 bp, Mus musculus
cacgtcttgtttcctgctcagtaaa

SEQ ID NO: 307451 - DNA, 25 bp, Mus musculus
cacgtcttgtttgctgctcagtaaa

SEQ ID NO: 307452 - DNA, 25 bp, Mus musculus
cacgtgaacggaaccctgggctcgg

SEQ ID NO: 307453 - DNA, 25 bp, Mus musculus
cacgtgaacggatccctgggctcgg

SEQ ID NO: 307454 - DNA, 25 bp, Mus musculus
cacgtgacaacgagggcggccacaa

SEQ ID NO: 307455 - DNA, 25 bp, Mus musculus
cacgtgacaacgtgggcggccacaa

SEQ ID NO: 307456 - DNA, 25 bp, Mus musculus
cacgtgaccatcaggctaaaggaaa

SEQ ID NO: 307457 - DNA, 25 bp, Mus musculus
cacgtgaccatctggctaaaggaaa

SEQ ID NO: 307458 - DNA, 25 bp, Mus musculus
cacgtgacctcaaatgtttccatag

SEQ ID NO: 307459 - DNA, 25 bp, Mus musculus
cacgtgacctcatatgtttccatag

SEQ ID NO: 307460 - DNA, 25 bp, Mus musculus
cacgtgactgttccgttccctgtgt

SEQ ID NO: 307461 - DNA, 25 bp, Mus musculus
cacgtgactgttgcgttccctgtgt

SEQ ID NO: 307462 - DNA, 25 bp, Mus musculus
cacgtgagctcacaaggcccaagaa

SEQ ID NO: 307463 - DNA, 25 bp, Mus musculus
cacgtgagctcagaaggcccaagaa

SEQ ID NO: 307464 - DNA, 25 bp, Mus musculus
cacgtgagttcgattgtactttata

SEQ ID NO: 307465 - DNA, 25 bp, Mus musculus
cacgtgagttcgtttgtactttata

SEQ ID NO: 307466 - DNA, 25 bp, Mus musculus
cacgtgatgagaacagtgagctcaa

SEQ ID NO: 307467 - DNA, 25 bp, Mus musculus
cacgtgatgagatcagtgagctcaa

SEQ ID NO: 307468 - DNA, 25 bp, Mus musculus
cacgtgattggcatagtgatcgcta

SEQ ID NO: 307469 - DNA, 25 bp, Mus musculus
cacgtgattggcttagtgatcgcta

SEQ ID NO: 307470 - DNA, 25 bp, Mus musculus
cacgtgcacagacagcccaatgagt

SEQ ID NO: 307471 - DNA, 25 bp, Mus musculus
cacgtgcacagagagcccaatgagt

SEQ ID NO: 307472 - DNA, 25 bp, Mus musculus
cacgtgcagagtacctattatttaa

SEQ ID NO: 307473 - DNA, 25 bp, Mus musculus
cacgtgcagagttcctattatttaa

SEQ ID NO: 307474 - DNA, 25 bp, Mus musculus
cacgtgccaaatcccaattctgttg

SEQ ID NO: 307475 - DNA, 25 bp, Mus musculus
cacgtgccaaatgccaattctgttg

SEQ ID NO: 307476 - DNA, 25 bp, Mus musculus
cacgtgccagttcattgtttgccag

SEQ ID NO: 307477 - DNA, 25 bp, Mus musculus
cacgtgccagttgattgtttgccag

SEQ ID NO: 307478 - DNA, 25 bp, Mus musculus
cacgtgcccactagatagtcattgg

SEQ ID NO: 307479 - DNA, 25 bp, Mus musculus
cacgtgcccacttgatagtcattgg

SEQ ID NO: 307480 - DNA, 25 bp, Mus musculus
cacgtgccctacagtgatgtgggtt

SEQ ID NO: 307481 - DNA, 25 bp, Mus musculus
cacgtgccctactgtgatgtgggtt

SEQ ID NO: 307482 - DNA, 25 bp, Mus musculus
cacgtgcctttacccatagtggaac

SEQ ID NO: 307483 - DNA, 25 bp, Mus musculus
cacgtgcctttagccatagtggaac

SEQ ID NO: 307484 - DNA, 25 bp, Mus musculus
cacgtgcggccaagcatggtctgtg

SEQ ID NO: 307485 - DNA, 25 bp, Mus musculus
cacgtgcggccatgcatggtctgtg

SEQ ID NO: 307486 - DNA, 25 bp, Mus musculus
cacgtgcttaggatttcttcagtca

SEQ ID NO: 307487 - DNA, 25 bp, Mus musculus
cacgtgcttaggttttcttcagtca

SEQ ID NO: 307488 - DNA, 25 bp, Mus musculus
cacgtgcttcagactcatttgcgag

SEQ ID NO: 307489 - DNA, 25 bp, Mus musculus
cacgtgcttcagtctcatttgcgag

SEQ ID NO: 307490 - DNA, 25 bp, Mus musculus
cacgtggaaagtactgacggctcta

SEQ ID NO: 307491 - DNA, 25 bp, Mus musculus
cacgtggaaagttctgacggctcta

SEQ ID NO: 307492 - DNA, 25 bp, Mus musculus
cacgtggaagctaccagatgtgtgt

SEQ ID NO: 307493 - DNA, 25 bp, Mus musculus
cacgtggaagcttccagatgtgtgt

SEQ ID NO: 307494 - DNA, 25 bp, Mus musculus
cacgtggacaggctttcgaggacct

SEQ ID NO: 307495 - DNA, 25 bp, Mus musculus
cacgtggacagggtttcgaggacct

SEQ ID NO: 307496 - DNA, 25 bp, Mus musculus
cacgtggagcatacacagaagtata

SEQ ID NO: 307497 - DNA, 25 bp, Mus musculus
cacgtggagcattcacagaagtata

SEQ ID NO: 307498 - DNA, 25 bp, Mus musculus
cacgtggagtggcttaatgcattaa

SEQ ID NO: 307499 - DNA, 25 bp, Mus musculus
cacgtggagtgggttaatgcattaa

SEQ ID NO: 307500 - DNA, 25 bp, Mus musculus
cacgtggatatccttaaagcaggct

SEQ ID NO: 307501 - DNA, 25 bp, Mus musculus
cacgtggatatcgttaaagcaggct

SEQ ID NO: 307502 - DNA, 25 bp, Mus musculus
cacgtggcaggtcacaaccgtctgt

SEQ ID NO: 307503 - DNA, 25 bp, Mus musculus
cacgtggcaggtgacaaccgtctgt

SEQ ID NO: 307504 - DNA, 25 bp, Mus musculus
cacgtggcccaaatacagtgaccca

SEQ ID NO: 307505 - DNA, 25 bp, Mus musculus
cacgtggcccaattacagtgaccca

SEQ ID NO: 307506 - DNA, 25 bp, Mus musculus
cacgtggcctgaacttacatcgaat

SEQ ID NO: 307507 - DNA, 25 bp, Mus musculus
cacgtggcctgatcttacatcgaat

SEQ ID NO: 307508 - DNA, 25 bp, Mus musculus
cacgtggctctcatgtacttttaaa

SEQ ID NO: 307509 - DNA, 25 bp, Mus musculus
cacgtggctctcttgtacttttaaa

SEQ ID NO: 307510 - DNA, 25 bp, Mus musculus
cacgtggctgaacttgacgtctgac

SEQ ID NO: 307511 - DNA, 25 bp, Mus musculus
cacgtggctgaagttgacgtctgac

SEQ ID NO: 307512 - DNA, 25 bp, Mus musculus
cacgtggctgagatgggtctgttca

SEQ ID NO: 307513 - DNA, 25 bp, Mus musculus
cacgtggctgagttgggtctgttca

SEQ ID NO: 307514 - DNA, 25 bp, Mus musculus
cacgtggcttgcaatgtggacccca

SEQ ID NO: 307515 - DNA, 25 bp, Mus musculus
cacgtggcttgctatgtggacccca

SEQ ID NO: 307516 - DNA, 25 bp, Mus musculus
cacgtgggagcacttggcacatcaa

SEQ ID NO: 307517 - DNA, 25 bp, Mus musculus
cacgtgggagcagttggcacatcaa

SEQ ID NO: 307518 - DNA, 25 bp, Mus musculus
cacgtgggcagccttgcttccagag

SEQ ID NO: 307519 - DNA, 25 bp, Mus musculus
cacgtgggcagcgttgcttccagag

SEQ ID NO: 307520 - DNA, 25 bp, Mus musculus
cacgtgggtgacctaccccaagctt

SEQ ID NO: 307521 - DNA, 25 bp, Mus musculus
cacgtgggtgacgtaccccaagctt

SEQ ID NO: 307522 - DNA, 25 bp, Mus musculus
cacgtggtcttcattgctcagagga

SEQ ID NO: 307523 - DNA, 25 bp, Mus musculus
cacgtggtcttctttgctcagagga

SEQ ID NO: 307524 - DNA, 25 bp, Mus musculus
cacgtggtggacatggaggccaggc

SEQ ID NO: 307525 - DNA, 25 bp, Mus musculus
cacgtggtggacttggaggccaggc

SEQ ID NO: 307526 - DNA, 25 bp, Mus musculus
cacgtggtgtttcctgaggacatgt

SEQ ID NO: 307527 - DNA, 25 bp, Mus musculus
cacgtggtgtttgctgaggacatgt

SEQ ID NO: 307528 - DNA, 25 bp, Mus musculus
cacgtggttcccacctatggaggat

SEQ ID NO: 307529 - DNA, 25 bp, Mus musculus
cacgtggttccctcctatggaggat

SEQ ID NO: 307530 - DNA, 25 bp, Mus musculus
cacgtggttggtcggctaggcagat

SEQ ID NO: 307531 - DNA, 25 bp, Mus musculus
cacgtggttggtgggctaggcagat

SEQ ID NO: 307532 - DNA, 25 bp, Mus musculus
cacgtgtacacacaaggatgcatgt

SEQ ID NO: 307533 - DNA, 25 bp, Mus musculus
cacgtgtacacagaaggatgcatgt

SEQ ID NO: 307534 - DNA, 25 bp, Mus musculus
cacgtgtactgcctgggtcctgtcg

SEQ ID NO: 307535 - DNA, 25 bp, Mus musculus
cacgtgtactgcgtgggtcctgtcg

SEQ ID NO: 307536 - DNA, 25 bp, Mus musculus
cacgtgtagcggattatactttcgg

SEQ ID NO: 307537 - DNA, 25 bp, Mus musculus
cacgtgtagcggtttatactttcgg

SEQ ID NO: 307538 - DNA, 25 bp, Mus musculus
cacgtgtcacgtattataatctatg

SEQ ID NO: 307539 - DNA, 25 bp, Mus musculus
cacgtgtcacgttttataatctatg

SEQ ID NO: 307540 - DNA, 25 bp, Mus musculus
cacgtgtcagctatggttcttgtga

SEQ ID NO: 307541 - DNA, 25 bp, Mus musculus
cacgtgtcagctttggttcttgtga

SEQ ID NO: 307542 - DNA, 25 bp, Mus musculus
cacgtgtctcagcacatgtgtggca

SEQ ID NO: 307543 - DNA, 25 bp, Mus musculus
cacgtgtctcaggacatgtgtggca

SEQ ID NO: 307544 - DNA, 25 bp, Mus musculus
cacgtgtctcccatttctgaaaaga

SEQ ID NO: 307545 - DNA, 25 bp, Mus musculus
cacgtgtctcccttttctgaaaaga

SEQ ID NO: 307546 - DNA, 25 bp, Mus musculus
cacgtgtctgtgcattagttgctat

SEQ ID NO: 307547 - DNA, 25 bp, Mus musculus
cacgtgtctgtggattagttgctat

SEQ ID NO: 307548 - DNA, 25 bp, Mus musculus
cacgtgtctgttaactggcaaaagc

SEQ ID NO: 307549 - DNA, 25 bp, Mus musculus
cacgtgtctgtttactggcaaaagc

SEQ ID NO: 307550 - DNA, 25 bp, Mus musculus
cacgtgtgacctctgaggacataat

SEQ ID NO: 307551 - DNA, 25 bp, Mus musculus
cacgtgtgacctgtgaggacataat

SEQ ID NO: 307552 - DNA, 25 bp, Mus musculus
cacgtgtgcttgataatttcccttt

SEQ ID NO: 307553 - DNA, 25 bp, Mus musculus
cacgtgtgcttgttaatttcccttt

SEQ ID NO: 307554 - DNA, 25 bp, Mus musculus
cacgtgtggctcctggctgccagat

SEQ ID NO: 307555 - DNA, 25 bp, Mus musculus
cacgtgtggctcgtggctgccagat

SEQ ID NO: 307556 - DNA, 25 bp, Mus musculus
cacgtgtggttgattggtccttcct

SEQ ID NO: 307557 - DNA, 25 bp, Mus musculus
cacgtgtggttgtttggtccttcct

SEQ ID NO: 307558 - DNA, 25 bp, Mus musculus
cacgtgtgttctcgaatgggtgatc

SEQ ID NO: 307559 - DNA, 25 bp, Mus musculus
cacgtgtgttctggaatgggtgatc

SEQ ID NO: 307560 - DNA, 25 bp, Mus musculus
cacgtgttcaccataagcaggctgt

SEQ ID NO: 307561 - DNA, 25 bp, Mus musculus
cacgtgttcaccttaagcaggctgt

SEQ ID NO: 307562 - DNA, 25 bp, Mus musculus
cacgtgttcctcactagaagaaaat

SEQ ID NO: 307563 - DNA, 25 bp, Mus musculus
cacgtgttcctctctagaagaaaat

SEQ ID NO: 307564 - DNA, 25 bp, Mus musculus
cacgtgttctctagcaggtgtgaaa

SEQ ID NO: 307565 - DNA, 25 bp, Mus musculus
cacgtgttctcttgcaggtgtgaaa

SEQ ID NO: 307566 - DNA, 25 bp, Mus musculus
cacgtgtttgtaatttgatcaagaa

SEQ ID NO: 307567 - DNA, 25 bp, Mus musculus
cacgtgtttgtattttgatcaagaa

SEQ ID NO: 307568 - DNA, 25 bp, Mus musculus
cacgttaatcagacacacaaacttt

SEQ ID NO: 307569 - DNA, 25 bp, Mus musculus
cacgttaatcagtcacacaaacttt

SEQ ID NO: 307570 - DNA, 25 bp, Mus musculus
cacgttacttttatgcgatctcaga

SEQ ID NO: 307571 - DNA, 25 bp, Mus musculus
cacgttacttttttgcgatctcaga

SEQ ID NO: 307572 - DNA, 25 bp, Mus musculus
cacgttagtcaacgaggcatgtctg

SEQ ID NO: 307573 - DNA, 25 bp, Mus musculus
cacgttagtcaaggaggcatgtctg

SEQ ID NO: 307574 - DNA, 25 bp, Mus musculus
cacgttcaaaaacacaaaaccatat

SEQ ID NO: 307575 - DNA, 25 bp, Mus musculus
cacgttcaaaaagacaaaaccatat

SEQ ID NO: 307576 - DNA, 25 bp, Mus musculus
cacgttcaacagcacagctctgaaa

SEQ ID NO: 307577 - DNA, 25 bp, Mus musculus
cacgttcaacaggacagctctgaaa

SEQ ID NO: 307578 - DNA, 25 bp, Mus musculus
cacgttcaccttacttgttcttatt

SEQ ID NO: 307579 - DNA, 25 bp, Mus musculus
cacgttcacctttcttgttcttatt

SEQ ID NO: 307580 - DNA, 25 bp, Mus musculus
cacgttcagtccatggcaagaccaa

SEQ ID NO: 307581 - DNA, 25 bp, Mus musculus
cacgttcagtccttggcaagaccaa

SEQ ID NO: 307582 - DNA, 25 bp, Mus musculus
cacgttctaggtctgttgtttatct

SEQ ID NO: 307583 - DNA, 25 bp, Mus musculus
cacgttctaggtgtgttgtttatct

SEQ ID NO: 307584 - DNA, 25 bp, Mus musculus
cacgttcttatgatcccagggactg

SEQ ID NO: 307585 - DNA, 25 bp, Mus musculus
cacgttcttatgttcccagggactg

SEQ ID NO: 307586 - DNA, 25 bp, Mus musculus
cacgttgatcagagtctcctatgga

SEQ ID NO: 307587 - DNA, 25 bp, Mus musculus
cacgttgatcagtgtctcctatgga

SEQ ID NO: 307588 - DNA, 25 bp, Mus musculus
cacgttgccccaagtgtcttgtaaa

SEQ ID NO: 307589 - DNA, 25 bp, Mus musculus
cacgttgccccatgtgtcttgtaaa

SEQ ID NO: 307590 - DNA, 25 bp, Mus musculus
cacgttgctgatcggaggtctcacc

SEQ ID NO: 307591 - DNA, 25 bp, Mus musculus
cacgttgctgatgggaggtctcacc

SEQ ID NO: 307592 - DNA, 25 bp, Mus musculus
cacgttgctttcaatctttgatttt

SEQ ID NO: 307593 - DNA, 25 bp, Mus musculus
cacgttgctttctatctttgatttt

SEQ ID NO: 307594 - DNA, 25 bp, Mus musculus
cacgttggatgtatctgtaccctta

SEQ ID NO: 307595 - DNA, 25 bp, Mus musculus
cacgttggatgtttctgtaccctta

SEQ ID NO: 307596 - DNA, 25 bp, Mus musculus
cacgttggctgtagtccttctgtgt

SEQ ID NO: 307597 - DNA, 25 bp, Mus musculus
cacgttggctgttgtccttctgtgt

SEQ ID NO: 307598 - DNA, 25 bp, Mus musculus
cacgttgggcctatgtgggctatat

SEQ ID NO: 307599 - DNA, 25 bp, Mus musculus
cacgttgggcctttgtgggctatat

SEQ ID NO: 307600 - DNA, 25 bp, Mus musculus
cacgttgtcacccagagagcagtaa

SEQ ID NO: 307601 - DNA, 25 bp, Mus musculus
cacgttgtcaccgagagagcagtaa

SEQ ID NO: 307602 - DNA, 25 bp, Mus musculus
cacgttgtggtgaacactgtgactc

SEQ ID NO: 307603 - DNA, 25 bp, Mus musculus
cacgttgtggtgtacactgtgactc

SEQ ID NO: 307604 - DNA, 25 bp, Mus musculus
cacgttgttgatagcgtcctagcaa

SEQ ID NO: 307605 - DNA, 25 bp, Mus musculus
cacgttgttgattgcgtcctagcaa

SEQ ID NO: 307606 - DNA, 25 bp, Mus musculus
cacgtttccgaacatgatgggctca

SEQ ID NO: 307607 - DNA, 25 bp, Mus musculus
cacgtttccgaagatgatgggctca

SEQ ID NO: 307608 - DNA, 25 bp, Mus musculus
cacgtttctaagagacaagatcaca

SEQ ID NO: 307609 - DNA, 25 bp, Mus musculus
cacgtttctaagtgacaagatcaca

SEQ ID NO: 307610 - DNA, 25 bp, Mus musculus
cacgtttgactaccttcggagtgtt

SEQ ID NO: 307611 - DNA, 25 bp, Mus musculus
cacgtttgactagcttcggagtgtt

SEQ ID NO: 307612 - DNA, 25 bp, Mus musculus
cacgtttgctgccagttccaaaagc

SEQ ID NO: 307613 - DNA, 25 bp, Mus musculus
cacgtttgctgcgagttccaaaagc

SEQ ID NO: 307614 - DNA, 25 bp, Mus musculus
cacgtttggattcatgtcagcagat

SEQ ID NO: 307615 - DNA, 25 bp, Mus musculus
cacgtttggattgatgtcagcagat

SEQ ID NO: 307616 - DNA, 25 bp, Mus musculus
cacgtttggtcacgctgcatccctt

SEQ ID NO: 307617 - DNA, 25 bp, Mus musculus
cacgtttggtcaggctgcatccctt

SEQ ID NO: 307618 - DNA, 25 bp, Mus musculus
cacgtttgtggcactgctccaagaa

SEQ ID NO: 307619 - DNA, 25 bp, Mus musculus
cacgtttgtggctctgctccaagaa

SEQ ID NO: 307620 - DNA, 25 bp, Mus musculus
cacgttttcctacgtgtgtgtgtgc

SEQ ID NO: 307621 - DNA, 25 bp, Mus musculus
cacgttttcctaggtgtgtgtgtgc

SEQ ID NO: 307622 - DNA, 25 bp, Mus musculus
cacgttttgcatcgttaagttaaag

SEQ ID NO: 307623 - DNA, 25 bp, Mus musculus
cacgttttgcatggttaagttaaag

SEQ ID NO: 307624 - DNA, 25 bp, Mus musculus
cactaaaaatttcccactatgaaat

SEQ ID NO: 307625 - DNA, 25 bp, Mus musculus
cactaaaaatttgccactatgaaat

SEQ ID NO: 307626 - DNA, 25 bp, Mus musculus
cactaaaagcttcctgcttactaga

SEQ ID NO: 307627 - DNA, 25 bp, Mus musculus
cactaaaagcttgctgcttactaga

SEQ ID NO: 307628 - DNA, 25 bp, Mus musculus
cactaaaccgctccggacatttgag

SEQ ID NO: 307629 - DNA, 25 bp, Mus musculus
cactaaaccgctgcggacatttgag

SEQ ID NO: 307630 - DNA, 25 bp, Mus musculus
cactaaagtgctcctcatggtaatc

SEQ ID NO: 307631 - DNA, 25 bp, Mus musculus
cactaaagtgctgctcatggtaatc

SEQ ID NO: 307632 - DNA, 25 bp, Mus musculus
cactaaagtttgatctggcacattc

SEQ ID NO: 307633 - DNA, 25 bp, Mus musculus
cactaaagtttgttctggcacattc

SEQ ID NO: 307634 - DNA, 25 bp, Mus musculus
cactaaatactgctggaagctcggg

SEQ ID NO: 307635 - DNA, 25 bp, Mus musculus
cactaaatactggtggaagctcggg

SEQ ID NO: 307636 - DNA, 25 bp, Mus musculus
cactaaatgtgtcagtaacctaatt

SEQ ID NO: 307637 - DNA, 25 bp, Mus musculus
cactaaatgtgtgagtaacctaatt

SEQ ID NO: 307638 - DNA, 25 bp, Mus musculus
cactaacaccccagaacggaagaag

SEQ ID NO: 307639 - DNA, 25 bp, Mus musculus
cactaacacccctgaacggaagaag

SEQ ID NO: 307640 - DNA, 25 bp, Mus musculus
cactaaccttgacctggtggcaggt

SEQ ID NO: 307641 - DNA, 25 bp, Mus musculus
cactaaccttgagctggtggcaggt

SEQ ID NO: 307642 - DNA, 25 bp, Mus musculus
cactaacggctgagtttgtgcgttt

SEQ ID NO: 307643 - DNA, 25 bp, Mus musculus
cactaacggctgtgtttgtgcgttt

SEQ ID NO: 307644 - DNA, 25 bp, Mus musculus
cactaactacctcatattcagccaa

SEQ ID NO: 307645 - DNA, 25 bp, Mus musculus
cactaactacctgatattcagccaa

SEQ ID NO: 307646 - DNA, 25 bp, Mus musculus
cactaactctcccttttgggattgt

SEQ ID NO: 307647 - DNA, 25 bp, Mus musculus
cactaactctccgttttgggattgt

SEQ ID NO: 307648 - DNA, 25 bp, Mus musculus
cactaagaagggatgatttggaggt

SEQ ID NO: 307649 - DNA, 25 bp, Mus musculus
cactaagaagggttgatttggaggt

SEQ ID NO: 307650 - DNA, 25 bp, Mus musculus
cactaagactagcaatgatgggact

SEQ ID NO: 307651 - DNA, 25 bp, Mus musculus
cactaagactaggaatgatgggact

SEQ ID NO: 307652 - DNA, 25 bp, Mus musculus
cactaagagttgctttctctcgttt

SEQ ID NO: 307653 - DNA, 25 bp, Mus musculus
cactaagagttggtttctctcgttt

SEQ ID NO: 307654 - DNA, 25 bp, Mus musculus
cactaagatctgaataaggcctaag

SEQ ID NO: 307655 - DNA, 25 bp, Mus musculus
cactaagatctgtataaggcctaag

SEQ ID NO: 307656 - DNA, 25 bp, Mus musculus
cactaagccgtcaacacgttgttta

SEQ ID NO: 307657 - DNA, 25 bp, Mus musculus
cactaagccgtcactgtgttattta

SEQ ID NO: 307658 - DNA, 25 bp, Mus musculus
cactaagccgtctacacgttgttta

SEQ ID NO: 307659 - DNA, 25 bp, Mus musculus
cactaagccgtctctgtgttattta

SEQ ID NO: 307660 - DNA, 25 bp, Mus musculus
cactaagcgaggaacactaacccaa

SEQ ID NO: 307661 - DNA, 25 bp, Mus musculus
cactaagcgaggtacactaacccaa

SEQ ID NO: 307662 - DNA, 25 bp, Mus musculus
cactaagctattcttccagatgcat

SEQ ID NO: 307663 - DNA, 25 bp, Mus musculus
cactaagctattgttccagatgcat

SEQ ID NO: 307664 - DNA, 25 bp, Mus musculus
cactaagctcatactcaacctgaaa

SEQ ID NO: 307665 - DNA, 25 bp, Mus musculus
cactaagctcattctcaacctgaaa

SEQ ID NO: 307666 - DNA, 25 bp, Mus musculus
cactaaggagtcaccagatcatctg

SEQ ID NO: 307667 - DNA, 25 bp, Mus musculus
cactaaggagtctccagatcatctg

SEQ ID NO: 307668 - DNA, 25 bp, Mus musculus
cactaaggcggcagaggagcgctct

SEQ ID NO: 307669 - DNA, 25 bp, Mus musculus
cactaaggcggctgaggagcgctct

SEQ ID NO: 307670 - DNA, 25 bp, Mus musculus
cactaagggcatctctcactcagac

SEQ ID NO: 307671 - DNA, 25 bp, Mus musculus
cactaagggcatgtctcactcagac

SEQ ID NO: 307672 - DNA, 25 bp, Mus musculus
cactaaggtttacgtcactttgtat

SEQ ID NO: 307673 - DNA, 25 bp, Mus musculus
cactaaggtttaggtcactttgtat

SEQ ID NO: 307674 - DNA, 25 bp, Mus musculus
cactaagtcaagagactgtgcagta

SEQ ID NO: 307675 - DNA, 25 bp, Mus musculus
cactaagtcaagtgactgtgcagta

SEQ ID NO: 307676 - DNA, 25 bp, Mus musculus
cactaagtcttaccccaactcagaa

SEQ ID NO: 307677 - DNA, 25 bp, Mus musculus
cactaagtcttagcccaactcagaa

SEQ ID NO: 307678 - DNA, 25 bp, Mus musculus
cactaagtgcttattctgttcagag

SEQ ID NO: 307679 - DNA, 25 bp, Mus musculus
cactaagtgctttttctgttcagag

SEQ ID NO: 307680 - DNA, 25 bp, Mus musculus
cactaagttataaaattgcatgcag

SEQ ID NO: 307681 - DNA, 25 bp, Mus musculus
cactaagttatataattgcatgcag

SEQ ID NO: 307682 - DNA, 25 bp, Mus musculus
cactaatatatcatttggatcctat

SEQ ID NO: 307683 - DNA, 25 bp, Mus musculus
cactaatatatcttttggatcctat

SEQ ID NO: 307684 - DNA, 25 bp, Mus musculus
cactaatatatgcacctagcttaag

SEQ ID NO: 307685 - DNA, 25 bp, Mus musculus
cactaatatatggacctagcttaag

SEQ ID NO: 307686 - DNA, 25 bp, Mus musculus
cactaatcggacagccaaatttcac

SEQ ID NO: 307687 - DNA, 25 bp, Mus musculus
cactaatcggactgccaaatttcac

SEQ ID NO: 307688 - DNA, 25 bp, Mus musculus
cactaatctgccaatgttgcctggg

SEQ ID NO: 307689 - DNA, 25 bp, Mus musculus
cactaatctgcctatgttgcctggg

SEQ ID NO: 307690 - DNA, 25 bp, Mus musculus
cactaatggcatctgtgagactgct

SEQ ID NO: 307691 - DNA, 25 bp, Mus musculus
cactaatggcatgtgtgagactgct

SEQ ID NO: 307692 - DNA, 25 bp, Mus musculus
cactaatgtgacaaacttgaaattc

SEQ ID NO: 307693 - DNA, 25 bp, Mus musculus
cactaatgtgactaacttgaaattc

SEQ ID NO: 307694 - DNA, 25 bp, Mus musculus
cactaatgttgcactttttggctta

SEQ ID NO: 307695 - DNA, 25 bp, Mus musculus
cactaatgttgctctttttggctta

SEQ ID NO: 307696 - DNA, 25 bp, Mus musculus
cactaattccagacatgctctgtag

SEQ ID NO: 307697 - DNA, 25 bp, Mus musculus
cactaattccagtcatgctctgtag

SEQ ID NO: 307698 - DNA, 25 bp, Mus musculus
cactaattggagacagtgggttatc

SEQ ID NO: 307699 - DNA, 25 bp, Mus musculus
cactaattggagtcagtgggttatc

SEQ ID NO: 307700 - DNA, 25 bp, Mus musculus
cactaattttcccaataaagtccat

SEQ ID NO: 307701 - DNA, 25 bp, Mus musculus
cactaattttccgaataaagtccat

SEQ ID NO: 307702 - DNA, 25 bp, Mus musculus
cactacaatgggacagagcttggcc

SEQ ID NO: 307703 - DNA, 25 bp, Mus musculus
cactacaatgggtcagagcttggcc

SEQ ID NO: 307704 - DNA, 25 bp, Mus musculus
cactacaatgtgatttggtcctggt

SEQ ID NO: 307705 - DNA, 25 bp, Mus musculus
cactacaatgtgttttggtcctggt

SEQ ID NO: 307706 - DNA, 25 bp, Mus musculus
cactacacgtttagaataagaagga

SEQ ID NO: 307707 - DNA, 25 bp, Mus musculus
cactacacgttttgaataagaagga

SEQ ID NO: 307708 - DNA, 25 bp, Mus musculus
cactacagcagcaactatggaggcc

SEQ ID NO: 307709 - DNA, 25 bp, Mus musculus
cactacagcagctactatggaggcc

SEQ ID NO: 307710 - DNA, 25 bp, Mus musculus
cactacagcttccagtcaaacaatt

SEQ ID NO: 307711 - DNA, 25 bp, Mus musculus
cactacagcttcgagtcaaacaatt

SEQ ID NO: 307712 - DNA, 25 bp, Mus musculus
cactacatctttcgagctctgtcta

SEQ ID NO: 307713 - DNA, 25 bp, Mus musculus
cactacatctttggagctctgtcta

SEQ ID NO: 307714 - DNA, 25 bp, Mus musculus
cactacatgcacagcctttgggagt

SEQ ID NO: 307715 - DNA, 25 bp, Mus musculus
cactacatgcactgcctttgggagt

SEQ ID NO: 307716 - DNA, 25 bp, Mus musculus
cactacatttctctttgactccaac

SEQ ID NO: 307717 - DNA, 25 bp, Mus musculus
cactacatttctgtttgactccaac

SEQ ID NO: 307718 - DNA, 25 bp, Mus musculus
cactaccattgtatctgtgtccagc

SEQ ID NO: 307719 - DNA, 25 bp, Mus musculus
cactaccattgtttctgtgtccagc

SEQ ID NO: 307720 - DNA, 25 bp, Mus musculus
cactaccccagcatgaaggaggcaa

SEQ ID NO: 307721 - DNA, 25 bp, Mus musculus
cactaccccagcttgaaggaggcaa

SEQ ID NO: 307722 - DNA, 25 bp, Mus musculus
cactaccctcttcacacttttccat

SEQ ID NO: 307723 - DNA, 25 bp, Mus musculus
cactaccctcttgacacttttccat

SEQ ID NO: 307724 - DNA, 25 bp, Mus musculus
cactaccgccctatgttgaaagagc

SEQ ID NO: 307725 - DNA, 25 bp, Mus musculus
cactaccgccctttgttgaaagagc

SEQ ID NO: 307726 - DNA, 25 bp, Mus musculus
cactaccgtatcagaactggtgaaa

SEQ ID NO: 307727 - DNA, 25 bp, Mus musculus
cactaccgtatctgaactggtgaaa

SEQ ID NO: 307728 - DNA, 25 bp, Mus musculus
cactacctacatcttgctgttgaag

SEQ ID NO: 307729 - DNA, 25 bp, Mus musculus
cactacctacatgttgctgttgaag

SEQ ID NO: 307730 - DNA, 25 bp, Mus musculus
cactacctaccacgctgtgtgattc

SEQ ID NO: 307731 - DNA, 25 bp, Mus musculus
cactacctaccaggctgtgtgattc

SEQ ID NO: 307732 - DNA, 25 bp, Mus musculus
cactacctatacatacagagccgag

SEQ ID NO: 307733 - DNA, 25 bp, Mus musculus
cactacctatacttacagagccgag

SEQ ID NO: 307734 - DNA, 25 bp, Mus musculus
cactacctcgtgattctcagttttt

SEQ ID NO: 307735 - DNA, 25 bp, Mus musculus
cactacctcgtgtttctcagttttt

SEQ ID NO: 307736 - DNA, 25 bp, Mus musculus
cactacctcgttctccttagatagg

SEQ ID NO: 307737 - DNA, 25 bp, Mus musculus
cactacctcgttgtccttagatagg

SEQ ID NO: 307738 - DNA, 25 bp, Mus musculus
cactacctcttcaggattgtgagca

SEQ ID NO: 307739 - DNA, 25 bp, Mus musculus
cactacctcttctggattgtgagca

SEQ ID NO: 307740 - DNA, 25 bp, Mus musculus
cactacgaaccaaaacgattttgag

SEQ ID NO: 307741 - DNA, 25 bp, Mus musculus
cactacgaaccataacgattttgag

SEQ ID NO: 307742 - DNA, 25 bp, Mus musculus
cactacgagaacaaccgggtactca

SEQ ID NO: 307743 - DNA, 25 bp, Mus musculus
cactacgagaactaccgggtactca

SEQ ID NO: 307744 - DNA, 25 bp, Mus musculus
cactactatatcaatgcgtctcata

SEQ ID NO: 307745 - DNA, 25 bp, Mus musculus
cactactatatctatgcgtctcata

SEQ ID NO: 307746 - DNA, 25 bp, Mus musculus
cactactcagagatgctggtgcaag

SEQ ID NO: 307747 - DNA, 25 bp, Mus musculus
cactactcagagttgctggtgcaag

SEQ ID NO: 307748 - DNA, 25 bp, Mus musculus
cactactcctacaaggttgccgaga

SEQ ID NO: 307749 - DNA, 25 bp, Mus musculus
cactactcctactaggttgccgaga

SEQ ID NO: 307750 - DNA, 25 bp, Mus musculus
cactactctggtcactaagatggga

SEQ ID NO: 307751 - DNA, 25 bp, Mus musculus
cactactctggtgactaagatggga

SEQ ID NO: 307752 - DNA, 25 bp, Mus musculus
cactactgacaacggtggccagcaa

SEQ ID NO: 307753 - DNA, 25 bp, Mus musculus
cactactgacaagggtggccagcaa

SEQ ID NO: 307754 - DNA, 25 bp, Mus musculus
cactactgatagcatcatgtaaatg

SEQ ID NO: 307755 - DNA, 25 bp, Mus musculus
cactactgataggatcatgtaaatg

SEQ ID NO: 307756 - DNA, 25 bp, Mus musculus
cactactgcaggcacatgaagaaat

SEQ ID NO: 307757 - DNA, 25 bp, Mus musculus
cactactgcagggacatgaagaaat

SEQ ID NO: 307758 - DNA, 25 bp, Mus musculus
cactactgcgagcttttcctgcacg

SEQ ID NO: 307759 - DNA, 25 bp, Mus musculus
cactactgcgaggttttcctgcacg

SEQ ID NO: 307760 - DNA, 25 bp, Mus musculus
cactactgctaaagctttttattgt

SEQ ID NO: 307761 - DNA, 25 bp, Mus musculus
cactactgctaatgctttttattgt

SEQ ID NO: 307762 - DNA, 25 bp, Mus musculus
cactactgtaatcttccatttgtaa

SEQ ID NO: 307763 - DNA, 25 bp, Mus musculus
cactactgtaatgttccatttgtaa

SEQ ID NO: 307764 - DNA, 25 bp, Mus musculus
cactactgtcgtagggttttgttgt

SEQ ID NO: 307765 - DNA, 25 bp, Mus musculus
cactactgtcgttgggttttgttgt

SEQ ID NO: 307766 - DNA, 25 bp, Mus musculus
cactactgtgatatcgactttttct

SEQ ID NO: 307767 - DNA, 25 bp, Mus musculus
cactactgtgatttcgactttttct

SEQ ID NO: 307768 - DNA, 25 bp, Mus musculus
cactactgtgtgctctgttgatatt

SEQ ID NO: 307769 - DNA, 25 bp, Mus musculus
cactactgtgtggtctgttgatatt

SEQ ID NO: 307770 - DNA, 25 bp, Mus musculus
cactacttcctgctttcagcttatt

SEQ ID NO: 307771 - DNA, 25 bp, Mus musculus
cactacttcctggtttcagcttatt

SEQ ID NO: 307772 - DNA, 25 bp, Mus musculus
cactacttctggattgctgttatca

SEQ ID NO: 307773 - DNA, 25 bp, Mus musculus
cactacttctggtttgctgttatca

SEQ ID NO: 307774 - DNA, 25 bp, Mus musculus
cactacttcttaagctgtggtttca

SEQ ID NO: 307775 - DNA, 25 bp, Mus musculus
cactacttcttatgctgtggtttca

SEQ ID NO: 307776 - DNA, 25 bp, Mus musculus
cactacttgagaatggtactcccaa

SEQ ID NO: 307777 - DNA, 25 bp, Mus musculus
cactacttgagattggtactcccaa

SEQ ID NO: 307778 - DNA, 25 bp, Mus musculus
cactactttataatgcctcctaacc

SEQ ID NO: 307779 - DNA, 25 bp, Mus musculus
cactactttatattgcctcctaacc

SEQ ID NO: 307780 - DNA, 25 bp, Mus musculus
cactactttgtgctgctgacaagtt

SEQ ID NO: 307781 - DNA, 25 bp, Mus musculus
cactactttgtggtgctgacaagtt

SEQ ID NO: 307782 - DNA, 25 bp, Mus musculus
cactagaaattgacctgtcagaaat

SEQ ID NO: 307783 - DNA, 25 bp, Mus musculus
cactagaaattgtcctgtcagaaat

SEQ ID NO: 307784 - DNA, 25 bp, Mus musculus
cactagaagattatgtcctccacgc

SEQ ID NO: 307785 - DNA, 25 bp, Mus musculus
cactagaagattttgtcctccacgc

SEQ ID NO: 307786 - DNA, 25 bp, Mus musculus
cactagaagcccacgctgtgcagca

SEQ ID NO: 307787 - DNA, 25 bp, Mus musculus
cactagaagccctcgctgtgcagca

SEQ ID NO: 307788 - DNA, 25 bp, Mus musculus
cactagaatgcaatccacaggaaaa

SEQ ID NO: 307789 - DNA, 25 bp, Mus musculus
cactagaatgcattccacaggaaaa

SEQ ID NO: 307790 - DNA, 25 bp, Mus musculus
cactagagaagcaggcagcgtgttt

SEQ ID NO: 307791 - DNA, 25 bp, Mus musculus
cactagagaagctggcagcgtgttt

SEQ ID NO: 307792 - DNA, 25 bp, Mus musculus
cactagagccagagcgccatatact

SEQ ID NO: 307793 - DNA, 25 bp, Mus musculus
cactagagccagtgcgccatatact

SEQ ID NO: 307794 - DNA, 25 bp, Mus musculus
cactagaggcagagcgtgtccggct

SEQ ID NO: 307795 - DNA, 25 bp, Mus musculus
cactagaggcagtgcgtgtccggct

SEQ ID NO: 307796 - DNA, 25 bp, Mus musculus
cactagatgctgctggtagcctgta

SEQ ID NO: 307797 - DNA, 25 bp, Mus musculus
cactagatgctggtggtagcctgta

SEQ ID NO: 307798 - DNA, 25 bp, Mus musculus
cactagattaacacccgattccatg

SEQ ID NO: 307799 - DNA, 25 bp, Mus musculus
cactagattaactcccgattccatg

SEQ ID NO: 307800 - DNA, 25 bp, Mus musculus
cactagcaagccaaggcatctttat

SEQ ID NO: 307801 - DNA, 25 bp, Mus musculus
cactagcaagcctaggcatctttat

SEQ ID NO: 307802 - DNA, 25 bp, Mus musculus
cactagcaagttctctggatgattt

SEQ ID NO: 307803 - DNA, 25 bp, Mus musculus
cactagcaagttgtctggatgattt

SEQ ID NO: 307804 - DNA, 25 bp, Mus musculus
cactagcacctcacatgagccagaa

SEQ ID NO: 307805 - DNA, 25 bp, Mus musculus
cactagcacctctcatgagccagaa

SEQ ID NO: 307806 - DNA, 25 bp, Mus musculus
cactagccaaagatgagaggaccct

SEQ ID NO: 307807 - DNA, 25 bp, Mus musculus
cactagccaaagttgagaggaccct

SEQ ID NO: 307808 - DNA, 25 bp, Mus musculus
cactagccagaaacttctccatgga

SEQ ID NO: 307809 - DNA, 25 bp, Mus musculus
cactagccagaatcttctccatgga

SEQ ID NO: 307810 - DNA, 25 bp, Mus musculus
cactagccaggtcttggtgatacac

SEQ ID NO: 307811 - DNA, 25 bp, Mus musculus
cactagccaggtgttggtgatacac

SEQ ID NO: 307812 - DNA, 25 bp, Mus musculus
cactagccattcagcaggagacggt

SEQ ID NO: 307813 - DNA, 25 bp, Mus musculus
cactagccattctgcaggagacggt

SEQ ID NO: 307814 - DNA, 25 bp, Mus musculus
cactagccccagctttggtgtttat

SEQ ID NO: 307815 - DNA, 25 bp, Mus musculus
cactagccccaggtttggtgtttat

SEQ ID NO: 307816 - DNA, 25 bp, Mus musculus
cactagccggtgaaggaattctcta

SEQ ID NO: 307817 - DNA, 25 bp, Mus musculus
cactagccggtgtaggaattctcta

SEQ ID NO: 307818 - DNA, 25 bp, Mus musculus
cactagcctggcaggttgtggagca

SEQ ID NO: 307819 - DNA, 25 bp, Mus musculus
cactagcctggctggttgtggagca

SEQ ID NO: 307820 - DNA, 25 bp, Mus musculus
cactagcggcacattcagagaaact

SEQ ID NO: 307821 - DNA, 25 bp, Mus musculus
cactagcggcactttcagagaaact

SEQ ID NO: 307822 - DNA, 25 bp, Mus musculus
cactagctacatcgcaagttcaagg

SEQ ID NO: 307823 - DNA, 25 bp, Mus musculus
cactagctacatggcaagttcaagg

SEQ ID NO: 307824 - DNA, 25 bp, Mus musculus
cactagctacgtctgattgcctttg

SEQ ID NO: 307825 - DNA, 25 bp, Mus musculus
cactagctacgtgtgattgcctttg

SEQ ID NO: 307826 - DNA, 25 bp, Mus musculus
cactagctccatagtcttttatttt

SEQ ID NO: 307827 - DNA, 25 bp, Mus musculus
cactagctccattgtcttttatttt

SEQ ID NO: 307828 - DNA, 25 bp, Mus musculus
cactagctccttctctactttcatt

SEQ ID NO: 307829 - DNA, 25 bp, Mus musculus
cactagctccttgtctactttcatt

SEQ ID NO: 307830 - DNA, 25 bp, Mus musculus
cactagctctagctcaggtccagag

SEQ ID NO: 307831 - DNA, 25 bp, Mus musculus
cactagctctaggtcaggtccagag

SEQ ID NO: 307832 - DNA, 25 bp, Mus musculus
cactagctgatgatttattctccaa

SEQ ID NO: 307833 - DNA, 25 bp, Mus musculus
cactagctgatgttttattctccaa

SEQ ID NO: 307834 - DNA, 25 bp, Mus musculus
cactagctggaacgttttgttcatt

SEQ ID NO: 307835 - DNA, 25 bp, Mus musculus
cactagctggaaggttttgttcatt

SEQ ID NO: 307836 - DNA, 25 bp, Mus musculus
cactagctggctccctgtattgtca

SEQ ID NO: 307837 - DNA, 25 bp, Mus musculus
cactagctggctgcctgtattgtca

SEQ ID NO: 307838 - DNA, 25 bp, Mus musculus
cactagctgtgtagctcctaacaga

SEQ ID NO: 307839 - DNA, 25 bp, Mus musculus
cactagctgtgttgctcctaacaga

SEQ ID NO: 307840 - DNA, 25 bp, Mus musculus
cactagcttagtcaggccacatgta

SEQ ID NO: 307841 - DNA, 25 bp, Mus musculus
cactagcttagtgaggccacatgta

SEQ ID NO: 307842 - DNA, 25 bp, Mus musculus
cactaggaaactctctgcggtacat

SEQ ID NO: 307843 - DNA, 25 bp, Mus musculus
cactaggaaactgtctgcggtacat

SEQ ID NO: 307844 - DNA, 25 bp, Mus musculus
cactaggactctccccagaggctgt

SEQ ID NO: 307845 - DNA, 25 bp, Mus musculus
cactaggactctgcccagaggctgt

SEQ ID NO: 307846 - DNA, 25 bp, Mus musculus
cactaggagtggagagctgagcacc

SEQ ID NO: 307847 - DNA, 25 bp, Mus musculus
cactaggagtggtgagctgagcacc

SEQ ID NO: 307848 - DNA, 25 bp, Mus musculus
cactaggcaaccaggatgtgcccat

SEQ ID NO: 307849 - DNA, 25 bp, Mus musculus
cactaggcaacctggatgtgcccat

SEQ ID NO: 307850 - DNA, 25 bp, Mus musculus
cactaggcaagcactcagacactga

SEQ ID NO: 307851 - DNA, 25 bp, Mus musculus
cactaggcaagcagaagcaggatct

SEQ ID NO: 307852 - DNA, 25 bp, Mus musculus
cactaggcaagctctcagacactga

SEQ ID NO: 307853 - DNA, 25 bp, Mus musculus
cactaggcaagctgaagcaggatct

SEQ ID NO: 307854 - DNA, 25 bp, Mus musculus
cactaggcatgcatgtgatatatag

SEQ ID NO: 307855 - DNA, 25 bp, Mus musculus
cactaggcatgcttgtgatatatag

SEQ ID NO: 307856 - DNA, 25 bp, Mus musculus
cactaggctggaaagtaccgggact

SEQ ID NO: 307857 - DNA, 25 bp, Mus musculus
cactaggctggatagtaccgggact

SEQ ID NO: 307858 - DNA, 25 bp, Mus musculus
cactaggctgtcagattaaggttaa

SEQ ID NO: 307859 - DNA, 25 bp, Mus musculus
cactaggctgtctgattaaggttaa

SEQ ID NO: 307860 - DNA, 25 bp, Mus musculus
cactagggtttgattgtcctctggg

SEQ ID NO: 307861 - DNA, 25 bp, Mus musculus
cactagggtttgtttgtcctctggg

SEQ ID NO: 307862 - DNA, 25 bp, Mus musculus
cactaggtccttcgcatgttttcta

SEQ ID NO: 307863 - DNA, 25 bp, Mus musculus
cactaggtccttggcatgttttcta

SEQ ID NO: 307864 - DNA, 25 bp, Mus musculus
cactaggtgctgacagttactgggt

SEQ ID NO: 307865 - DNA, 25 bp, Mus musculus
cactaggtgctgtcagttactgggt

SEQ ID NO: 307866 - DNA, 25 bp, Mus musculus
cactagtaacctaaccttggtcatc

SEQ ID NO: 307867 - DNA, 25 bp, Mus musculus
cactagtaaccttaccttggtcatc

SEQ ID NO: 307868 - DNA, 25 bp, Mus musculus
cactagtactgacaacttgcgggaa

SEQ ID NO: 307869 - DNA, 25 bp, Mus musculus
cactagtactgagaacttgcgggaa

SEQ ID NO: 307870 - DNA, 25 bp, Mus musculus
cactagtagtggcatctggcacctt

SEQ ID NO: 307871 - DNA, 25 bp, Mus musculus
cactagtagtgggatctggcacctt

SEQ ID NO: 307872 - DNA, 25 bp, Mus musculus
cactagtatatgagacttgtccatg

SEQ ID NO: 307873 - DNA, 25 bp, Mus musculus
cactagtatatgtgacttgtccatg

SEQ ID NO: 307874 - DNA, 25 bp, Mus musculus
cactagtcacaaatgctactttttt

SEQ ID NO: 307875 - DNA, 25 bp, Mus musculus
cactagtcacaattgctactttttt

SEQ ID NO: 307876 - DNA, 25 bp, Mus musculus
cactagtccttaatttgttacctct

SEQ ID NO: 307877 - DNA, 25 bp, Mus musculus
cactagtccttattttgttacctct

SEQ ID NO: 307878 - DNA, 25 bp, Mus musculus
cactagtctgcccatgatcataaag

SEQ ID NO: 307879 - DNA, 25 bp, Mus musculus
cactagtctgccgatgatcataaag

SEQ ID NO: 307880 - DNA, 25 bp, Mus musculus
cactagtctgtgatactgctgtata

SEQ ID NO: 307881 - DNA, 25 bp, Mus musculus
cactagtctgtgttactgctgtata

SEQ ID NO: 307882 - DNA, 25 bp, Mus musculus
cactagtgggcgaagcgactgtgct

SEQ ID NO: 307883 - DNA, 25 bp, Mus musculus
cactagtgggcgtagcgactgtgct

SEQ ID NO: 307884 - DNA, 25 bp, Mus musculus
cactagtgtcacctcttctggcaga

SEQ ID NO: 307885 - DNA, 25 bp, Mus musculus
cactagtgtcacgtcttctggcaga

SEQ ID NO: 307886 - DNA, 25 bp, Mus musculus
cactagttaactcacatgcatgcag

SEQ ID NO: 307887 - DNA, 25 bp, Mus musculus
cactagttaactgacatgcatgcag

SEQ ID NO: 307888 - DNA, 25 bp, Mus musculus
cactagttcataacttggagcagct

SEQ ID NO: 307889 - DNA, 25 bp, Mus musculus
cactagttcatatcttggagcagct

SEQ ID NO: 307890 - DNA, 25 bp, Mus musculus
cactataagagtcacccctttgcag

SEQ ID NO: 307891 - DNA, 25 bp, Mus musculus
cactataagagtgacccctttgcag

SEQ ID NO: 307892 - DNA, 25 bp, Mus musculus
cactataagtcgctttctggctgag

SEQ ID NO: 307893 - DNA, 25 bp, Mus musculus
cactataagtcggtttctggctgag

SEQ ID NO: 307894 - DNA, 25 bp, Mus musculus
cactatacaatgctttaggtgcagt

SEQ ID NO: 307895 - DNA, 25 bp, Mus musculus
cactatacaatggtttaggtgcagt

SEQ ID NO: 307896 - DNA, 25 bp, Mus musculus
cactatactagacagttcagaaccc

SEQ ID NO: 307897 - DNA, 25 bp, Mus musculus
cactatactagagagttcagaaccc

SEQ ID NO: 307898 - DNA, 25 bp, Mus musculus
cactatactgctcaggtatgtcctc

SEQ ID NO: 307899 - DNA, 25 bp, Mus musculus
cactatactgctgaggtatgtcctc

SEQ ID NO: 307900 - DNA, 25 bp, Mus musculus
cactatacttttagaggatttattt

SEQ ID NO: 307901 - DNA, 25 bp, Mus musculus
cactatactttttgaggatttattt

SEQ ID NO: 307902 - DNA, 25 bp, Mus musculus
cactatataatgagctgtgcttgaa

SEQ ID NO: 307903 - DNA, 25 bp, Mus musculus
cactatataatgtgctgtgcttgaa

SEQ ID NO: 307904 - DNA, 25 bp, Mus musculus
cactatatactcaggcttatgtgat

SEQ ID NO: 307905 - DNA, 25 bp, Mus musculus
cactatatactctggcttatgtgat

SEQ ID NO: 307906 - DNA, 25 bp, Mus musculus
cactatatagcacaggatgacgaca

SEQ ID NO: 307907 - DNA, 25 bp, Mus musculus
cactatatagcagaggatgacgaca

SEQ ID NO: 307908 - DNA, 25 bp, Mus musculus
cactatcaaaacaactcttctccat

SEQ ID NO: 307909 - DNA, 25 bp, Mus musculus
cactatcaaaactactcttctccat

SEQ ID NO: 307910 - DNA, 25 bp, Mus musculus
cactatcacgcaatacctgtcaaga

SEQ ID NO: 307911 - DNA, 25 bp, Mus musculus
cactatcacgcattacctgtcaaga

SEQ ID NO: 307912 - DNA, 25 bp, Mus musculus
cactatcactctaggccatgtaatt

SEQ ID NO: 307913 - DNA, 25 bp, Mus musculus
cactatcactcttggccatgtaatt

SEQ ID NO: 307914 - DNA, 25 bp, Mus musculus
cactatcatcacagcgggctaacgg

SEQ ID NO: 307915 - DNA, 25 bp, Mus musculus
cactatcatcactgcgggctaacgg

SEQ ID NO: 307916 - DNA, 25 bp, Mus musculus
cactatccatatccgataccgggag

SEQ ID NO: 307917 - DNA, 25 bp, Mus musculus
cactatccatatgcgataccgggag

SEQ ID NO: 307918 - DNA, 25 bp, Mus musculus
cactatcctggaacttcctctataa

SEQ ID NO: 307919 - DNA, 25 bp, Mus musculus
cactatcctggatcttcctctataa

SEQ ID NO: 307920 - DNA, 25 bp, Mus musculus
cactatctacatatctctatcttaa

SEQ ID NO: 307921 - DNA, 25 bp, Mus musculus
cactatctacatttctctatcttaa

SEQ ID NO: 307922 - DNA, 25 bp, Mus musculus
cactatctattgaaacctgcctggt

SEQ ID NO: 307923 - DNA, 25 bp, Mus musculus
cactatctattgtaacctgcctggt

SEQ ID NO: 307924 - DNA, 25 bp, Mus musculus
cactatgaatttactgcccaggagg

SEQ ID NO: 307925 - DNA, 25 bp, Mus musculus
cactatgaattttctgcccaggagg

SEQ ID NO: 307926 - DNA, 25 bp, Mus musculus
cactatgacatacaacagctttctg

SEQ ID NO: 307927 - DNA, 25 bp, Mus musculus
cactatgacatagaacagctttctg

SEQ ID NO: 307928 - DNA, 25 bp, Mus musculus
cactatgagagaagcactggacgat

SEQ ID NO: 307929 - DNA, 25 bp, Mus musculus
cactatgagagatgcactggacgat

SEQ ID NO: 307930 - DNA, 25 bp, Mus musculus
cactatgagtttcttgtcccgttga

SEQ ID NO: 307931 - DNA, 25 bp, Mus musculus
cactatgagtttgttgtcccgttga

SEQ ID NO: 307932 - DNA, 25 bp, Mus musculus
cactatgatatcagaggaggcttga

SEQ ID NO: 307933 - DNA, 25 bp, Mus musculus
cactatgatatctgaggaggcttga

SEQ ID NO: 307934 - DNA, 25 bp, Mus musculus
cactatgcatatctatctggcttta

SEQ ID NO: 307935 - DNA, 25 bp, Mus musculus
cactatgcatatgtatctggcttta

SEQ ID NO: 307936 - DNA, 25 bp, Mus musculus
cactatgccctgaagacaaatgcca

SEQ ID NO: 307937 - DNA, 25 bp, Mus musculus
cactatgccctgtagacaaatgcca

SEQ ID NO: 307938 - DNA, 25 bp, Mus musculus
cactatggaaacaggcacaggcctc

SEQ ID NO: 307939 - DNA, 25 bp, Mus musculus
cactatggaaactggcacaggcctc

SEQ ID NO: 307940 - DNA, 25 bp, Mus musculus
cactatggagagacttggctgattc

SEQ ID NO: 307941 - DNA, 25 bp, Mus musculus
cactatggagagtcttggctgattc

SEQ ID NO: 307942 - DNA, 25 bp, Mus musculus
cactatggagctccgtgcccaaggt

SEQ ID NO: 307943 - DNA, 25 bp, Mus musculus
cactatggagctgcgtgcccaaggt

SEQ ID NO: 307944 - DNA, 25 bp, Mus musculus
cactatggccacacttacaaaggaa

SEQ ID NO: 307945 - DNA, 25 bp, Mus musculus
cactatggccactcttacaaaggaa

SEQ ID NO: 307946 - DNA, 25 bp, Mus musculus
cactatggctcacgttttcttgtca

SEQ ID NO: 307947 - DNA, 25 bp, Mus musculus
cactatggctcaggttttcttgtca

SEQ ID NO: 307948 - DNA, 25 bp, Mus musculus
cactatgtaaagagcctccagcagc

SEQ ID NO: 307949 - DNA, 25 bp, Mus musculus
cactatgtaaagtgcctccagcagc

SEQ ID NO: 307950 - DNA, 25 bp, Mus musculus
cactatgtagaacaaggctggaccc

SEQ ID NO: 307951 - DNA, 25 bp, Mus musculus
cactatgtagaagaaggctggaccc

SEQ ID NO: 307952 - DNA, 25 bp, Mus musculus
cactatgtagatatggttggcttgg

SEQ ID NO: 307953 - DNA, 25 bp, Mus musculus
cactatgtagatttggttggcttgg

SEQ ID NO: 307954 - DNA, 25 bp, Mus musculus
cactatgtccagagtgtaagctcta

SEQ ID NO: 307955 - DNA, 25 bp, Mus musculus
cactatgtccagtgtgtaagctcta

SEQ ID NO: 307956 - DNA, 25 bp, Mus musculus
cactatgtcctccagtcaagtctac

SEQ ID NO: 307957 - DNA, 25 bp, Mus musculus
cactatgtcctcgagtcaagtctac

SEQ ID NO: 307958 - DNA, 25 bp, Mus musculus
cactatgtcttaagctcctcaactt

SEQ ID NO: 307959 - DNA, 25 bp, Mus musculus
cactatgtcttatgctcctcaactt

SEQ ID NO: 307960 - DNA, 25 bp, Mus musculus
cactatgtcttgcttctttggtttt

SEQ ID NO: 307961 - DNA, 25 bp, Mus musculus
cactatgtcttggttctttggtttt

SEQ ID NO: 307962 - DNA, 25 bp, Mus musculus
cactatgtgactcctgttgttgaca

SEQ ID NO: 307963 - DNA, 25 bp, Mus musculus
cactatgtgactgctgttgttgaca

SEQ ID NO: 307964 - DNA, 25 bp, Mus musculus
cactatgtgcctatcaattcctgag

SEQ ID NO: 307965 - DNA, 25 bp, Mus musculus
cactatgtgcctttcaattcctgag

SEQ ID NO: 307966 - DNA, 25 bp, Mus musculus
cactatgtttacaagaactgtgctt

SEQ ID NO: 307967 - DNA, 25 bp, Mus musculus
cactatgtttactagaactgtgctt

SEQ ID NO: 307968 - DNA, 25 bp, Mus musculus
cactatgtttatcggagggtcgatc

SEQ ID NO: 307969 - DNA, 25 bp, Mus musculus
cactatgtttatgggagggtcgatc

SEQ ID NO: 307970 - DNA, 25 bp, Mus musculus
cactattaattcaaactgtcggatg

SEQ ID NO: 307971 - DNA, 25 bp, Mus musculus
cactattaattctaactgtcggatg

SEQ ID NO: 307972 - DNA, 25 bp, Mus musculus
cactattatagaaatctggtgtctt

SEQ ID NO: 307973 - DNA, 25 bp, Mus musculus
cactattatagatatctggtgtctt

SEQ ID NO: 307974 - DNA, 25 bp, Mus musculus
cactattatgtgctggagtgtccag

SEQ ID NO: 307975 - DNA, 25 bp, Mus musculus
cactattatgtggtggagtgtccag

SEQ ID NO: 307976 - DNA, 25 bp, Mus musculus
cactattattgaactgctgacagag

SEQ ID NO: 307977 - DNA, 25 bp, Mus musculus
cactattattgatctgctgacagag

SEQ ID NO: 307978 - DNA, 25 bp, Mus musculus
cactattccactaatcctcattgtt

SEQ ID NO: 307979 - DNA, 25 bp, Mus musculus
cactattccacttatcctcattgtt

SEQ ID NO: 307980 - DNA, 25 bp, Mus musculus
cactattcgataaaacctgcacttt

SEQ ID NO: 307981 - DNA, 25 bp, Mus musculus
cactattcgatataacctgcacttt

SEQ ID NO: 307982 - DNA, 25 bp, Mus musculus
cactattcgcaaccctgacttgaaa

SEQ ID NO: 307983 - DNA, 25 bp, Mus musculus
cactattcgcaagcctgacttgaaa

SEQ ID NO: 307984 - DNA, 25 bp, Mus musculus
cactattgatttatccaatcatttg

SEQ ID NO: 307985 - DNA, 25 bp, Mus musculus
cactattgatttttccaatcatttg

SEQ ID NO: 307986 - DNA, 25 bp, Mus musculus
cactattgtattaagcctccgctag

SEQ ID NO: 307987 - DNA, 25 bp, Mus musculus
cactattgtatttagcctccgctag

SEQ ID NO: 307988 - DNA, 25 bp, Mus musculus
cactatttacccctttggcctagtg

SEQ ID NO: 307989 - DNA, 25 bp, Mus musculus
cactatttacccgtttggcctagtg

SEQ ID NO: 307990 - DNA, 25 bp, Mus musculus
cactatttcattctcttgccttcac

SEQ ID NO: 307991 - DNA, 25 bp, Mus musculus
cactatttcattgtcttgccttcac

SEQ ID NO: 307992 - DNA, 25 bp, Mus musculus
cactatttctcacacttgcaaaagt

SEQ ID NO: 307993 - DNA, 25 bp, Mus musculus
cactatttctcagacttgcaaaagt

SEQ ID NO: 307994 - DNA, 25 bp, Mus musculus
cactatttctcccagggtctgataa

SEQ ID NO: 307995 - DNA, 25 bp, Mus musculus
cactatttctccgagggtctgataa

SEQ ID NO: 307996 - DNA, 25 bp, Mus musculus
cactattttcacaggctgaccttga

SEQ ID NO: 307997 - DNA, 25 bp, Mus musculus
cactattttcactggctgaccttga

SEQ ID NO: 307998 - DNA, 25 bp, Mus musculus
cactcaaaacggattcctgggctgt

SEQ ID NO: 307999 - DNA, 25 bp, Mus musculus
cactcaaaacggtttcctgggctgt

SEQ ID NO: 308000 - DNA, 25 bp, Mus musculus
cactcaaaacttcgtcttctctaga

SEQ ID NO: 308001 - DNA, 25 bp, Mus musculus
cactcaaaacttggtcttctctaga

SEQ ID NO: 308002 - DNA, 25 bp, Mus musculus
cactcaaagaatatgggcggccctt

SEQ ID NO: 308003 - DNA, 25 bp, Mus musculus
cactcaaagaatttgggcggccctt

SEQ ID NO: 308004 - DNA, 25 bp, Mus musculus
cactcaaatttaactgctcatgcct

SEQ ID NO: 308005 - DNA, 25 bp, Mus musculus
cactcaaatttatctgctcatgcct

SEQ ID NO: 308006 - DNA, 25 bp, Mus musculus
cactcaacaggaaggcaagctgggc

SEQ ID NO: 308007 - DNA, 25 bp, Mus musculus
cactcaacaggatggcaagctgggc

SEQ ID NO: 308008 - DNA, 25 bp, Mus musculus
cactcaagacacactccagatacaa

SEQ ID NO: 308009 - DNA, 25 bp, Mus musculus
cactcaagacactctccagatacaa

SEQ ID NO: 308010 - DNA, 25 bp, Mus musculus
cactcaagagaacaggcagttgtcc

SEQ ID NO: 308011 - DNA, 25 bp, Mus musculus
cactcaagagaagaggcagttgtcc

SEQ ID NO: 308012 - DNA, 25 bp, Mus musculus
cactcaaggcttatggtgatcgcgt

SEQ ID NO: 308013 - DNA, 25 bp, Mus musculus
cactcaaggcttttggtgatcgcgt

SEQ ID NO: 308014 - DNA, 25 bp, Mus musculus
cactcaaggtaaaggtggctgcccc

SEQ ID NO: 308015 - DNA, 25 bp, Mus musculus
cactcaaggtaatggtggctgcccc

SEQ ID NO: 308016 - DNA, 25 bp, Mus musculus
cactcaatctccacttttcggaaat

SEQ ID NO: 308017 - DNA, 25 bp, Mus musculus
cactcaatctcctcttttcggaaat

SEQ ID NO: 308018 - DNA, 25 bp, Mus musculus
cactcaatgcttctaacttcgttcc

SEQ ID NO: 308019 - DNA, 25 bp, Mus musculus
cactcaatgcttgtaacttcgttcc

SEQ ID NO: 308020 - DNA, 25 bp, Mus musculus
cactcaattaatctttccttgcctg

SEQ ID NO: 308021 - DNA, 25 bp, Mus musculus
cactcaattaatgtttccttgcctg

SEQ ID NO: 308022 - DNA, 25 bp, Mus musculus
cactcacaacttcacatccaaatta

SEQ ID NO: 308023 - DNA, 25 bp, Mus musculus
cactcacaacttgacatccaaatta

SEQ ID NO: 308024 - DNA, 25 bp, Mus musculus
cactcacacaatagagcctgcctgg

SEQ ID NO: 308025 - DNA, 25 bp, Mus musculus
cactcacacaattgagcctgcctgg

SEQ ID NO: 308026 - DNA, 25 bp, Mus musculus
cactcacaggatcttgctatcactg

SEQ ID NO: 308027 - DNA, 25 bp, Mus musculus
cactcacaggatgttgctatcactg

SEQ ID NO: 308028 - DNA, 25 bp, Mus musculus
cactcacccaacaaagcttttgtgt

SEQ ID NO: 308029 - DNA, 25 bp, Mus musculus
cactcacccaactaagcttttgtgt

SEQ ID NO: 308030 - DNA, 25 bp, Mus musculus
cactcaccccagcaagatttcttgt

SEQ ID NO: 308031 - DNA, 25 bp, Mus musculus
cactcaccccaggaagatttcttgt

SEQ ID NO: 308032 - DNA, 25 bp, Mus musculus
cactcacccctaactaaagctttga

SEQ ID NO: 308033 - DNA, 25 bp, Mus musculus
cactcacccctatctaaagctttga

SEQ ID NO: 308034 - DNA, 25 bp, Mus musculus
cactcacccttgattgtactgcaag

SEQ ID NO: 308035 - DNA, 25 bp, Mus musculus
cactcacccttgtttgtactgcaag

SEQ ID NO: 308036 - DNA, 25 bp, Mus musculus
cactcacctactctaatgggcagat

SEQ ID NO: 308037 - DNA, 25 bp, Mus musculus
cactcacctactgtaatgggcagat

SEQ ID NO: 308038 - DNA, 25 bp, Mus musculus
cactcacctatgcagctgtggaaaa

SEQ ID NO: 308039 - DNA, 25 bp, Mus musculus
cactcacctatggagctgtggaaaa

SEQ ID NO: 308040 - DNA, 25 bp, Mus musculus
cactcacctctaaactgggatcaga

SEQ ID NO: 308041 - DNA, 25 bp, Mus musculus
cactcacctctatactgggatcaga

SEQ ID NO: 308042 - DNA, 25 bp, Mus musculus
cactcaccttgtacactgtcaagaa

SEQ ID NO: 308043 - DNA, 25 bp, Mus musculus
cactcaccttgttcactgtcaagaa

SEQ ID NO: 308044 - DNA, 25 bp, Mus musculus
cactcacgaagtccgcctctcgcta

SEQ ID NO: 308045 - DNA, 25 bp, Mus musculus
cactcacgaagtgcgcctctcgcta

SEQ ID NO: 308046 - DNA, 25 bp, Mus musculus
cactcactatgcaactcctggtggg

SEQ ID NO: 308047 - DNA, 25 bp, Mus musculus
cactcactatgctactcctggtggg

SEQ ID NO: 308048 - DNA, 25 bp, Mus musculus
cactcactccaaaaaatacctctaa

SEQ ID NO: 308049 - DNA, 25 bp, Mus musculus
cactcactccaataaatacctctaa

SEQ ID NO: 308050 - DNA, 25 bp, Mus musculus
cactcactctggctttaggtatctg

SEQ ID NO: 308051 - DNA, 25 bp, Mus musculus
cactcactctgggtttaggtatctg

SEQ ID NO: 308052 - DNA, 25 bp, Mus musculus
cactcactcttcattctaggcaaga

SEQ ID NO: 308053 - DNA, 25 bp, Mus musculus
cactcactcttctttctaggcaaga

SEQ ID NO: 308054 - DNA, 25 bp, Mus musculus
cactcactgctaaccacatggtaca

SEQ ID NO: 308055 - DNA, 25 bp, Mus musculus
cactcactgctatccacatggtaca

SEQ ID NO: 308056 - DNA, 25 bp, Mus musculus
cactcactgggaagtttgctggcaa

SEQ ID NO: 308057 - DNA, 25 bp, Mus musculus
cactcactgggatgtttgctggcaa

SEQ ID NO: 308058 - DNA, 25 bp, Mus musculus
cactcactgtgtaactttcttgctg

SEQ ID NO: 308059 - DNA, 25 bp, Mus musculus
cactcactgtgttactttcttgctg

SEQ ID NO: 308060 - DNA, 25 bp, Mus musculus
cactcacttctcaccagatgatgga

SEQ ID NO: 308061 - DNA, 25 bp, Mus musculus
cactcacttctctccagatgatgga

SEQ ID NO: 308062 - DNA, 25 bp, Mus musculus
cactcacttgaacccggtgctctgt

SEQ ID NO: 308063 - DNA, 25 bp, Mus musculus
cactcacttgaagccggtgctctgt

SEQ ID NO: 308064 - DNA, 25 bp, Mus musculus
cactcacttgctaccaattctattt

SEQ ID NO: 308065 - DNA, 25 bp, Mus musculus
cactcacttgcttccaattctattt

SEQ ID NO: 308066 - DNA, 25 bp, Mus musculus
cactcacttgtgagggcacgtggaa

SEQ ID NO: 308067 - DNA, 25 bp, Mus musculus
cactcacttgtgtgggcacgtggaa

SEQ ID NO: 308068 - DNA, 25 bp, Mus musculus
cactcagaagcacttgcccttgttc

SEQ ID NO: 308069 - DNA, 25 bp, Mus musculus
cactcagaagcagttgcccttgttc

SEQ ID NO: 308070 - DNA, 25 bp, Mus musculus
cactcagaattcacacattactcca

SEQ ID NO: 308071 - DNA, 25 bp, Mus musculus
cactcagaattctcacattactcca

SEQ ID NO: 308072 - DNA, 25 bp, Mus musculus
cactcagaccacacatattcacagt

SEQ ID NO: 308073 - DNA, 25 bp, Mus musculus
cactcagaccactcatattcacagt

SEQ ID NO: 308074 - DNA, 25 bp, Mus musculus
cactcagagcctcgttattgccaat

SEQ ID NO: 308075 - DNA, 25 bp, Mus musculus
cactcagagcctggttattgccaat

SEQ ID NO: 308076 - DNA, 25 bp, Mus musculus
cactcagcaaaaacttactcccggg

SEQ ID NO: 308077 - DNA, 25 bp, Mus musculus
cactcagcaaaatcttactcccggg

SEQ ID NO: 308078 - DNA, 25 bp, Mus musculus
cactcagcagttaacgtctttagaa

SEQ ID NO: 308079 - DNA, 25 bp, Mus musculus
cactcagcagtttacgtctttagaa

SEQ ID NO: 308080 - DNA, 25 bp, Mus musculus
cactcagccagacaagcaagccagg

SEQ ID NO: 308081 - DNA, 25 bp, Mus musculus
cactcagccagagaagcaagccagg

SEQ ID NO: 308082 - DNA, 25 bp, Mus musculus
cactcagcccacagtcgagtagaaa

SEQ ID NO: 308083 - DNA, 25 bp, Mus musculus
cactcagcccactgtcgagtagaaa

SEQ ID NO: 308084 - DNA, 25 bp, Mus musculus
cactcagctccaaagtgagtttgag

SEQ ID NO: 308085 - DNA, 25 bp, Mus musculus
cactcagctccatagtgagtttgag

SEQ ID NO: 308086 - DNA, 25 bp, Mus musculus
cactcagcttgaccgaaggctgtgt

SEQ ID NO: 308087 - DNA, 25 bp, Mus musculus
cactcagcttgagcgaaggctgtgt

SEQ ID NO: 308088 - DNA, 25 bp, Mus musculus
cactcagcttttccttgctttccat

SEQ ID NO: 308089 - DNA, 25 bp, Mus musculus
cactcagcttttgcttgctttccat

SEQ ID NO: 308090 - DNA, 25 bp, Mus musculus
cactcaggaagccaccaacaagaag

SEQ ID NO: 308091 - DNA, 25 bp, Mus musculus
cactcaggaagcgaccaacaagaag

SEQ ID NO: 308092 - DNA, 25 bp, Mus musculus
cactcaggagatactccctttggat

SEQ ID NO: 308093 - DNA, 25 bp, Mus musculus
cactcaggagattctccctttggat

SEQ ID NO: 308094 - DNA, 25 bp, Mus musculus
cactcaggaggtcagggtaaatttc

SEQ ID NO: 308095 - DNA, 25 bp, Mus musculus
cactcaggaggtgagggtaaatttc

SEQ ID NO: 308096 - DNA, 25 bp, Mus musculus
cactcaggcctacatggtgatgatt

SEQ ID NO: 308097 - DNA, 25 bp, Mus musculus
cactcaggcctagatggtgatgatt

SEQ ID NO: 308098 - DNA, 25 bp, Mus musculus
cactcaggctgtatacaattaatga

SEQ ID NO: 308099 - DNA, 25 bp, Mus musculus
cactcaggctgtttacaattaatga

SEQ ID NO: 308100 - DNA, 25 bp, Mus musculus
cactcagggtcacactcttttttcc

SEQ ID NO: 308101 - DNA, 25 bp, Mus musculus
cactcagggtcagactcttttttcc

SEQ ID NO: 308102 - DNA, 25 bp, Mus musculus
cactcaggtgaactcgggtgaagta

SEQ ID NO: 308103 - DNA, 25 bp, Mus musculus
cactcaggtgaagtcgggtgaagta

SEQ ID NO: 308104 - DNA, 25 bp, Mus musculus
cactcagtacggcatttccccaaat

SEQ ID NO: 308105 - DNA, 25 bp, Mus musculus
cactcagtacgggatttccccaaat

SEQ ID NO: 308106 - DNA, 25 bp, Mus musculus
cactcagtactacctggagcagcag

SEQ ID NO: 308107 - DNA, 25 bp, Mus musculus
cactcagtactagctggagcagcag

SEQ ID NO: 308108 - DNA, 25 bp, Mus musculus
cactcagtcccaaacttcatatttg

SEQ ID NO: 308109 - DNA, 25 bp, Mus musculus
cactcagtcccatacttcatatttg

SEQ ID NO: 308110 - DNA, 25 bp, Mus musculus
cactcagtccttctttctccaggtt

SEQ ID NO: 308111 - DNA, 25 bp, Mus musculus
cactcagtccttgtttctccaggtt

SEQ ID NO: 308112 - DNA, 25 bp, Mus musculus
cactcagtggatccttatttttgta

SEQ ID NO: 308113 - DNA, 25 bp, Mus musculus
cactcagtggatgcttatttttgta

SEQ ID NO: 308114 - DNA, 25 bp, Mus musculus
cactcagtggccacttttggatgtt

SEQ ID NO: 308115 - DNA, 25 bp, Mus musculus
cactcagtggcctcttttggatgtt

SEQ ID NO: 308116 - DNA, 25 bp, Mus musculus
cactcagtgggtcttgacatagttt

SEQ ID NO: 308117 - DNA, 25 bp, Mus musculus
cactcagtgggtgttgacatagttt

SEQ ID NO: 308118 - DNA, 25 bp, Mus musculus
cactcagtggtgcagctaaggaaac

SEQ ID NO: 308119 - DNA, 25 bp, Mus musculus
cactcagtggtggagctaaggaaac

SEQ ID NO: 308120 - DNA, 25 bp, Mus musculus
cactcagtgtggaaagagcttctca

SEQ ID NO: 308121 - DNA, 25 bp, Mus musculus
cactcagtgtggtaagagcttctca

SEQ ID NO: 308122 - DNA, 25 bp, Mus musculus
cactcagttagccaaggcttccatg

SEQ ID NO: 308123 - DNA, 25 bp, Mus musculus
cactcagttagcgaaggcttccatg

SEQ ID NO: 308124 - DNA, 25 bp, Mus musculus
cactcagttcccaccaataggaaag

SEQ ID NO: 308125 - DNA, 25 bp, Mus musculus
cactcagttccctccaataggaaag

SEQ ID NO: 308126 - DNA, 25 bp, Mus musculus
cactcagtttccattgcagttacag

SEQ ID NO: 308127 - DNA, 25 bp, Mus musculus
cactcagtttcctttgcagttacag

SEQ ID NO: 308128 - DNA, 25 bp, Mus musculus
cactcatattttcgctgtaactctt

SEQ ID NO: 308129 - DNA, 25 bp, Mus musculus
cactcatattttggctgtaactctt

SEQ ID NO: 308130 - DNA, 25 bp, Mus musculus
cactcatcagaaatgctggctcatg

SEQ ID NO: 308131 - DNA, 25 bp, Mus musculus
cactcatcagaattgctggctcatg

SEQ ID NO: 308132 - DNA, 25 bp, Mus musculus
cactcatccacacggaggtctacga

SEQ ID NO: 308133 - DNA, 25 bp, Mus musculus
cactcatccacagggaggtctacga

SEQ ID NO: 308134 - DNA, 25 bp, Mus musculus
cactcatctacacagcattcaacag

SEQ ID NO: 308135 - DNA, 25 bp, Mus musculus
cactcatctacagagcattcaacag

SEQ ID NO: 308136 - DNA, 25 bp, Mus musculus
cactcatctactcatgctgcggagc

SEQ ID NO: 308137 - DNA, 25 bp, Mus musculus
cactcatctactgatgctgcggagc

SEQ ID NO: 308138 - DNA, 25 bp, Mus musculus
cactcatctaggaatccagagagag

SEQ ID NO: 308139 - DNA, 25 bp, Mus musculus
cactcatctaggtatccagagagag

SEQ ID NO: 308140 - DNA, 25 bp, Mus musculus
cactcatctccaagtacatgaaaga

SEQ ID NO: 308141 - DNA, 25 bp, Mus musculus
cactcatctccatgtacatgaaaga

SEQ ID NO: 308142 - DNA, 25 bp, Mus musculus
cactcatgactcaaagtttgttgta

SEQ ID NO: 308143 - DNA, 25 bp, Mus musculus
cactcatgactctaagtttgttgta

SEQ ID NO: 308144 - DNA, 25 bp, Mus musculus
cactcatgactgaatttgaatattt

SEQ ID NO: 308145 - DNA, 25 bp, Mus musculus
cactcatgactgtatttgaatattt

SEQ ID NO: 308146 - DNA, 25 bp, Mus musculus
cactcatggcttaagaattcagtac

SEQ ID NO: 308147 - DNA, 25 bp, Mus musculus
cactcatggctttagaattcagtac

SEQ ID NO: 308148 - DNA, 25 bp, Mus musculus
cactcatgtgacataactctctgtt

SEQ ID NO: 308149 - DNA, 25 bp, Mus musculus
cactcatgtgacttaactctctgtt

SEQ ID NO: 308150 - DNA, 25 bp, Mus musculus
cactcattattaccaggcttgcgat

SEQ ID NO: 308151 - DNA, 25 bp, Mus musculus
cactcattattagcaggcttgcgat

SEQ ID NO: 308152 - DNA, 25 bp, Mus musculus
cactcattcacaccatggtgagcaa

SEQ ID NO: 308153 - DNA, 25 bp, Mus musculus
cactcattcacagcatggtgagcaa

SEQ ID NO: 308154 - DNA, 25 bp, Mus musculus
cactcattcaccatggcacagagga

SEQ ID NO: 308155 - DNA, 25 bp, Mus musculus
cactcattcaccttggcacagagga

SEQ ID NO: 308156 - DNA, 25 bp, Mus musculus
cactcattgaagaagcctgcaccgt

SEQ ID NO: 308157 - DNA, 25 bp, Mus musculus
cactcattgaagtagcctgcaccgt

SEQ ID NO: 308158 - DNA, 25 bp, Mus musculus
cactcattggagctgttatatctct

SEQ ID NO: 308159 - DNA, 25 bp, Mus musculus
cactcattggaggtgttatatctct

SEQ ID NO: 308160 - DNA, 25 bp, Mus musculus
cactccaaaatcatctccagaacag

SEQ ID NO: 308161 - DNA, 25 bp, Mus musculus
cactccaaaatcttctccagaacag

SEQ ID NO: 308162 - DNA, 25 bp, Mus musculus
cactccaaacagacacatgactatt

SEQ ID NO: 308163 - DNA, 25 bp, Mus musculus
cactccaaacagtcacatgactatt

SEQ ID NO: 308164 - DNA, 25 bp, Mus musculus
cactccaactttagtctctaatcta

SEQ ID NO: 308165 - DNA, 25 bp, Mus musculus
cactccaacttttgtctctaatcta

SEQ ID NO: 308166 - DNA, 25 bp, Mus musculus
cactccaaggccaccaatggaaggt

SEQ ID NO: 308167 - DNA, 25 bp, Mus musculus
cactccaaggcctccaatggaaggt

SEQ ID NO: 308168 - DNA, 25 bp, Mus musculus
cactccaccttcatagatcttgaaa

SEQ ID NO: 308169 - DNA, 25 bp, Mus musculus
cactccaccttcttagatcttgaaa

SEQ ID NO: 308170 - DNA, 25 bp, Mus musculus
cactccactgtgcaaagtgacactt

SEQ ID NO: 308171 - DNA, 25 bp, Mus musculus
cactccactgtgctgttgttatgat

SEQ ID NO: 308172 - DNA, 25 bp, Mus musculus
cactccactgtggaaagtgacactt

SEQ ID NO: 308173 - DNA, 25 bp, Mus musculus
cactccactgtggtgttgttatgat

SEQ ID NO: 308174 - DNA, 25 bp, Mus musculus
cactccagcagaagaagatttgcat

SEQ ID NO: 308175 - DNA, 25 bp, Mus musculus
cactccagcagatgaagatttgcat

SEQ ID NO: 308176 - DNA, 25 bp, Mus musculus
cactccagccatcccatgtgttttt

SEQ ID NO: 308177 - DNA, 25 bp, Mus musculus
cactccagccatgccatgtgttttt

SEQ ID NO: 308178 - DNA, 25 bp, Mus musculus
cactccaggccaaggataagaggct

SEQ ID NO: 308179 - DNA, 25 bp, Mus musculus
cactccaggccatggataagaggct

SEQ ID NO: 308180 - DNA, 25 bp, Mus musculus
cactccagttcgctgctaaagggca

SEQ ID NO: 308181 - DNA, 25 bp, Mus musculus
cactccagttcggtgctaaagggca

SEQ ID NO: 308182 - DNA, 25 bp, Mus musculus
cactccagtttgctgtgctgaatca

SEQ ID NO: 308183 - DNA, 25 bp, Mus musculus
cactccagtttggtgtgctgaatca

SEQ ID NO: 308184 - DNA, 25 bp, Mus musculus
cactccatacatctggtgcagacat

SEQ ID NO: 308185 - DNA, 25 bp, Mus musculus
cactccatacatgtggtgcagacat

SEQ ID NO: 308186 - DNA, 25 bp, Mus musculus
cactccatatgcaggtcagaacgta

SEQ ID NO: 308187 - DNA, 25 bp, Mus musculus
cactccatatgctggtcagaacgta

SEQ ID NO: 308188 - DNA, 25 bp, Mus musculus
cactccatctgcacttaccgggatt

SEQ ID NO: 308189 - DNA, 25 bp, Mus musculus
cactccatctgctcttaccgggatt

SEQ ID NO: 308190 - DNA, 25 bp, Mus musculus
cactccatctggctgtatgatatgt

SEQ ID NO: 308191 - DNA, 25 bp, Mus musculus
cactccatctgggtgtatgatatgt

SEQ ID NO: 308192 - DNA, 25 bp, Mus musculus
cactccatgactctgtatactatga

SEQ ID NO: 308193 - DNA, 25 bp, Mus musculus
cactccatgactgtgtatactatga

SEQ ID NO: 308194 - DNA, 25 bp, Mus musculus
cactccatggtactgctgcaaggac

SEQ ID NO: 308195 - DNA, 25 bp, Mus musculus
cactccatggtagtgctgcaaggac

SEQ ID NO: 308196 - DNA, 25 bp, Mus musculus
cactccatggtgaaagcggttatgt

SEQ ID NO: 308197 - DNA, 25 bp, Mus musculus
cactccatggtgtaagcggttatgt

SEQ ID NO: 308198 - DNA, 25 bp, Mus musculus
cactccatggttcaggaaggcctta

SEQ ID NO: 308199 - DNA, 25 bp, Mus musculus
cactccatggttgaggaaggcctta

SEQ ID NO: 308200 - DNA, 25 bp, Mus musculus
cactccatgtaacatggtggcacat

SEQ ID NO: 308201 - DNA, 25 bp, Mus musculus
cactccatgtaagatggtggcacat

SEQ ID NO: 308202 - DNA, 25 bp, Mus musculus
cactccattctacgccaaatcagga

SEQ ID NO: 308203 - DNA, 25 bp, Mus musculus
cactccattctaggccaaatcagga

SEQ ID NO: 308204 - DNA, 25 bp, Mus musculus
cactcccaaggaaagacatgcccgg

SEQ ID NO: 308205 - DNA, 25 bp, Mus musculus
cactcccaaggatagacatgcccgg

SEQ ID NO: 308206 - DNA, 25 bp, Mus musculus
cactcccagaccatttactatattt

SEQ ID NO: 308207 - DNA, 25 bp, Mus musculus
cactcccagaccttttactatattt

SEQ ID NO: 308208 - DNA, 25 bp, Mus musculus
cactcccagcttcaactgcaattgt

SEQ ID NO: 308209 - DNA, 25 bp, Mus musculus
cactcccagcttgaactgcaattgt

SEQ ID NO: 308210 - DNA, 25 bp, Mus musculus
cactcccagggtagacatggcttga

SEQ ID NO: 308211 - DNA, 25 bp, Mus musculus
cactcccagggttgacatggcttga

SEQ ID NO: 308212 - DNA, 25 bp, Mus musculus
cactcccagtgacgcgtccaggaag

SEQ ID NO: 308213 - DNA, 25 bp, Mus musculus
cactcccagtgaggcgtccaggaag

SEQ ID NO: 308214 - DNA, 25 bp, Mus musculus
cactcccatcgaagacctggatggg

SEQ ID NO: 308215 - DNA, 25 bp, Mus musculus
cactcccatcgatgacctggatggg

SEQ ID NO: 308216 - DNA, 25 bp, Mus musculus
cactcccatggaagtctaggctttg

SEQ ID NO: 308217 - DNA, 25 bp, Mus musculus
cactcccatggatgtctaggctttg

SEQ ID NO: 308218 - DNA, 25 bp, Mus musculus
cactcccatttaactgcacagaaca

SEQ ID NO: 308219 - DNA, 25 bp, Mus musculus
cactcccatttatctgcacagaaca

SEQ ID NO: 308220 - DNA, 25 bp, Mus musculus
cactcccatttgcaaaggtttctca

SEQ ID NO: 308221 - DNA, 25 bp, Mus musculus
cactcccatttggaaaggtttctca

SEQ ID NO: 308222 - DNA, 25 bp, Mus musculus
cactccccatacataacggtttgca

SEQ ID NO: 308223 - DNA, 25 bp, Mus musculus
cactccccatacttaacggtttgca

SEQ ID NO: 308224 - DNA, 25 bp, Mus musculus
cactccccgttgctgggattataga

SEQ ID NO: 308225 - DNA, 25 bp, Mus musculus
cactccccgttggtgggattataga

SEQ ID NO: 308226 - DNA, 25 bp, Mus musculus
cactccccttctctagatctaactc

SEQ ID NO: 308227 - DNA, 25 bp, Mus musculus
cactccccttctgtagatctaactc

SEQ ID NO: 308228 - DNA, 25 bp, Mus musculus
cactcccgatagcatcagcatggta

SEQ ID NO: 308229 - DNA, 25 bp, Mus musculus
cactcccgataggatcagcatggta

SEQ ID NO: 308230 - DNA, 25 bp, Mus musculus
cactccctagctacctgtgggtcag

SEQ ID NO: 308231 - DNA, 25 bp, Mus musculus
cactccctagcttcctgtgggtcag

SEQ ID NO: 308232 - DNA, 25 bp, Mus musculus
cactccctccatcttgtgatggaaa

SEQ ID NO: 308233 - DNA, 25 bp, Mus musculus
cactccctccatgttgtgatggaaa

SEQ ID NO: 308234 - DNA, 25 bp, Mus musculus
cactccctcctactgagagttgaaa

SEQ ID NO: 308235 - DNA, 25 bp, Mus musculus
cactccctcctagtgagagttgaaa

SEQ ID NO: 308236 - DNA, 25 bp, Mus musculus
cactccctgaacaggcagtggttta

SEQ ID NO: 308237 - DNA, 25 bp, Mus musculus
cactccctgaactggcagtggttta

SEQ ID NO: 308238 - DNA, 25 bp, Mus musculus
cactccctggaaagtaattgttaac

SEQ ID NO: 308239 - DNA, 25 bp, Mus musculus
cactccctggaatgtaattgttaac

SEQ ID NO: 308240 - DNA, 25 bp, Mus musculus
cactccctggtaaggatattccact

SEQ ID NO: 308241 - DNA, 25 bp, Mus musculus
cactccctggtatggatattccact

SEQ ID NO: 308242 - DNA, 25 bp, Mus musculus
cactccctggtgacttaatattgaa

SEQ ID NO: 308243 - DNA, 25 bp, Mus musculus
cactccctggtgtcttaatattgaa

SEQ ID NO: 308244 - DNA, 25 bp, Mus musculus
cactccctggttcaacacaggtaaa

SEQ ID NO: 308245 - DNA, 25 bp, Mus musculus
cactccctggttgaacacaggtaaa

SEQ ID NO: 308246 - DNA, 25 bp, Mus musculus
cactcccttgcaatatttctttgtt

SEQ ID NO: 308247 - DNA, 25 bp, Mus musculus
cactcccttgcattatttctttgtt

SEQ ID NO: 308248 - DNA, 25 bp, Mus musculus
cactccgcccttatctggattggtg

SEQ ID NO: 308249 - DNA, 25 bp, Mus musculus
cactccgcccttttctggattggtg

SEQ ID NO: 308250 - DNA, 25 bp, Mus musculus
cactccgcgaggaggccccaaggga

SEQ ID NO: 308251 - DNA, 25 bp, Mus musculus
cactccgcgaggtggccccaaggga

SEQ ID NO: 308252 - DNA, 25 bp, Mus musculus
cactccggagcgacagtgttgagtt

SEQ ID NO: 308253 - DNA, 25 bp, Mus musculus
cactccggagcgtcagtgttgagtt

SEQ ID NO: 308254 - DNA, 25 bp, Mus musculus
cactccggtcctcggaaaatgggca

SEQ ID NO: 308255 - DNA, 25 bp, Mus musculus
cactccggtcctgggaaaatgggca

SEQ ID NO: 308256 - DNA, 25 bp, Mus musculus
cactccgtaggaagtgatacccaca

SEQ ID NO: 308257 - DNA, 25 bp, Mus musculus
cactccgtaggatgtgatacccaca

SEQ ID NO: 308258 - DNA, 25 bp, Mus musculus
cactccgtagtcctagggtgtcttt

SEQ ID NO: 308259 - DNA, 25 bp, Mus musculus
cactccgtagtcgtagggtgtcttt

SEQ ID NO: 308260 - DNA, 25 bp, Mus musculus
cactccgtgtacatattttctctgc

SEQ ID NO: 308261 - DNA, 25 bp, Mus musculus
cactccgtgtacttattttctctgc

SEQ ID NO: 308262 - DNA, 25 bp, Mus musculus
cactcctaaaccaagtcctgattta

SEQ ID NO: 308263 - DNA, 25 bp, Mus musculus
cactcctaaacctagtcctgattta

SEQ ID NO: 308264 - DNA, 25 bp, Mus musculus
cactcctaaagtccacttcagaaca

SEQ ID NO: 308265 - DNA, 25 bp, Mus musculus
cactcctaaagtgcacttcagaaca

SEQ ID NO: 308266 - DNA, 25 bp, Mus musculus
cactcctaatcaactgctttttctc

SEQ ID NO: 308267 - DNA, 25 bp, Mus musculus
cactcctaatcatctgctttttctc

SEQ ID NO: 308268 - DNA, 25 bp, Mus musculus
cactcctacactatgactgcattca

SEQ ID NO: 308269 - DNA, 25 bp, Mus musculus
cactcctacactttgactgcattca

SEQ ID NO: 308270 - DNA, 25 bp, Mus musculus
cactcctaggcgaagaagttgttct

SEQ ID NO: 308271 - DNA, 25 bp, Mus musculus
cactcctaggcgtagaagttgttct

SEQ ID NO: 308272 - DNA, 25 bp, Mus musculus
cactcctcacgtagtagactgggaa

SEQ ID NO: 308273 - DNA, 25 bp, Mus musculus
cactcctcacgttgtagactgggaa

SEQ ID NO: 308274 - DNA, 25 bp, Mus musculus
cactcctccaaaacaggtggtttgc

SEQ ID NO: 308275 - DNA, 25 bp, Mus musculus
cactcctccaaatcaggtggtttgc

SEQ ID NO: 308276 - DNA, 25 bp, Mus musculus
cactcctcccgaccagtttgagaag

SEQ ID NO: 308277 - DNA, 25 bp, Mus musculus
cactcctcccgagcagtttgagaag

SEQ ID NO: 308278 - DNA, 25 bp, Mus musculus
cactcctcctgtcttaataacattg

SEQ ID NO: 308279 - DNA, 25 bp, Mus musculus
cactcctcctgtgttaataacattg

SEQ ID NO: 308280 - DNA, 25 bp, Mus musculus
cactcctgagatcctgttgtacgga

SEQ ID NO: 308281 - DNA, 25 bp, Mus musculus
cactcctgagatgctgttgtacgga

SEQ ID NO: 308282 - DNA, 25 bp, Mus musculus
cactcctgagccaagaggtgtgact

SEQ ID NO: 308283 - DNA, 25 bp, Mus musculus
cactcctgagcctagaggtgtgact

SEQ ID NO: 308284 - DNA, 25 bp, Mus musculus
cactcctgaggaagcgactcccgag

SEQ ID NO: 308285 - DNA, 25 bp, Mus musculus
cactcctgaggatgcgactcccgag

SEQ ID NO: 308286 - DNA, 25 bp, Mus musculus
cactcctgcaggacattgtggtgta

SEQ ID NO: 308287 - DNA, 25 bp, Mus musculus
cactcctgcaggtcattgtggtgta

SEQ ID NO: 308288 - DNA, 25 bp, Mus musculus
cactcctgcattcgtcatcatttta

SEQ ID NO: 308289 - DNA, 25 bp, Mus musculus
cactcctgcattggtcatcatttta

SEQ ID NO: 308290 - DNA, 25 bp, Mus musculus
cactcctgcctcactatttatttat

SEQ ID NO: 308291 - DNA, 25 bp, Mus musculus
cactcctgcctctctatttatttat

SEQ ID NO: 308292 - DNA, 25 bp, Mus musculus
cactcctgctggaggatttgctgca

SEQ ID NO: 308293 - DNA, 25 bp, Mus musculus
cactcctgctggtggatttgctgca

SEQ ID NO: 308294 - DNA, 25 bp, Mus musculus
cactcctggacgagatggatcggta

SEQ ID NO: 308295 - DNA, 25 bp, Mus musculus
cactcctggacgtgatggatcggta

SEQ ID NO: 308296 - DNA, 25 bp, Mus musculus
cactcctggccaatggatctgtgat

SEQ ID NO: 308297 - DNA, 25 bp, Mus musculus
cactcctggccattggatctgtgat

SEQ ID NO: 308298 - DNA, 25 bp, Mus musculus
cactcctggccgatgtttatgttta

SEQ ID NO: 308299 - DNA, 25 bp, Mus musculus
cactcctggccgttgtttatgttta

SEQ ID NO: 308300 - DNA, 25 bp, Mus musculus
cactcctggctgccaactgtcagaa

SEQ ID NO: 308301 - DNA, 25 bp, Mus musculus
cactcctggctggcaactgtcagaa

SEQ ID NO: 308302 - DNA, 25 bp, Mus musculus
cactcctgggtaagtggtcctggac

SEQ ID NO: 308303 - DNA, 25 bp, Mus musculus
cactcctgggtatgtggtcctggac

SEQ ID NO: 308304 - DNA, 25 bp, Mus musculus
cactcctgtggcaaggcattgtttt

SEQ ID NO: 308305 - DNA, 25 bp, Mus musculus
cactcctgtggctaggcattgtttt

SEQ ID NO: 308306 - DNA, 25 bp, Mus musculus
cactcctgttccaggacacggtgat

SEQ ID NO: 308307 - DNA, 25 bp, Mus musculus
cactcctgttcctggacacggtgat

SEQ ID NO: 308308 - DNA, 25 bp, Mus musculus
cactccttagttctgagaagccgtc

SEQ ID NO: 308309 - DNA, 25 bp, Mus musculus
cactccttagttgtgagaagccgtc

SEQ ID NO: 308310 - DNA, 25 bp, Mus musculus
cactcctttcaacaaaaaaccagct

SEQ ID NO: 308311 - DNA, 25 bp, Mus musculus
cactcctttcaagaaaaaaccagct

SEQ ID NO: 308312 - DNA, 25 bp, Mus musculus
cactccttttatatctcagctctaa

SEQ ID NO: 308313 - DNA, 25 bp, Mus musculus
cactccttttatttctcagctctaa

SEQ ID NO: 308314 - DNA, 25 bp, Mus musculus
cactcgaattcacatgggcatgctt

SEQ ID NO: 308315 - DNA, 25 bp, Mus musculus
cactcgaattcagatgggcatgctt

SEQ ID NO: 308316 - DNA, 25 bp, Mus musculus
cactcgagcaggctttcgtttacaa

SEQ ID NO: 308317 - DNA, 25 bp, Mus musculus
cactcgagcagggtttcgtttacaa

SEQ ID NO: 308318 - DNA, 25 bp, Mus musculus
cactcgagtgatactgcattgacca

SEQ ID NO: 308319 - DNA, 25 bp, Mus musculus
cactcgagtgattctgcattgacca

SEQ ID NO: 308320 - DNA, 25 bp, Mus musculus
cactcgataattcaaggcacttgct

SEQ ID NO: 308321 - DNA, 25 bp, Mus musculus
cactcgataattgaaggcacttgct

SEQ ID NO: 308322 - DNA, 25 bp, Mus musculus
cactcgatatttagcttcatttact

SEQ ID NO: 308323 - DNA, 25 bp, Mus musculus
cactcgatattttgcttcatttact

SEQ ID NO: 308324 - DNA, 25 bp, Mus musculus
cactcgatcctgactctgtgagaat

SEQ ID NO: 308325 - DNA, 25 bp, Mus musculus
cactcgatcctgtctctgtgagaat

SEQ ID NO: 308326 - DNA, 25 bp, Mus musculus
cactcgattgttactatgttgctat

SEQ ID NO: 308327 - DNA, 25 bp, Mus musculus
cactcgattgtttctatgttgctat

SEQ ID NO: 308328 - DNA, 25 bp, Mus musculus
cactcgcatgggactgcttgtgtga

SEQ ID NO: 308329 - DNA, 25 bp, Mus musculus
cactcgcatgggtctgcttgtgtga

SEQ ID NO: 308330 - DNA, 25 bp, Mus musculus
cactcgccattgaattttatgttct

SEQ ID NO: 308331 - DNA, 25 bp, Mus musculus
cactcgccattgtattttatgttct

SEQ ID NO: 308332 - DNA, 25 bp, Mus musculus
cactcgccctgcatttggatctaga

SEQ ID NO: 308333 - DNA, 25 bp, Mus musculus
cactcgccctgcttttggatctaga

SEQ ID NO: 308334 - DNA, 25 bp, Mus musculus
cactcgctctggattccatttgggt

SEQ ID NO: 308335 - DNA, 25 bp, Mus musculus
cactcgctctggtttccatttgggt

SEQ ID NO: 308336 - DNA, 25 bp, Mus musculus
cactcgctgcagcatatgccagaag

SEQ ID NO: 308337 - DNA, 25 bp, Mus musculus
cactcgctgcaggatatgccagaag

SEQ ID NO: 308338 - DNA, 25 bp, Mus musculus
cactcggacctcattatttcaatag

SEQ ID NO: 308339 - DNA, 25 bp, Mus musculus
cactcggacctctttatttcaatag

SEQ ID NO: 308340 - DNA, 25 bp, Mus musculus
cactcggatcttatccacacagttg

SEQ ID NO: 308341 - DNA, 25 bp, Mus musculus
cactcggatcttttccacacagttg

SEQ ID NO: 308342 - DNA, 25 bp, Mus musculus
cactcggctctgagttatatcttca

SEQ ID NO: 308343 - DNA, 25 bp, Mus musculus
cactcggctctgtgttatatcttca

SEQ ID NO: 308344 - DNA, 25 bp, Mus musculus
cactcgggagatcaaagcagtcaga

SEQ ID NO: 308345 - DNA, 25 bp, Mus musculus
cactcgggagatgaaagcagtcaga

SEQ ID NO: 308346 - DNA, 25 bp, Mus musculus
cactcgggagtaattaagatcgcag

SEQ ID NO: 308347 - DNA, 25 bp, Mus musculus
cactcgggagtatttaagatcgcag

SEQ ID NO: 308348 - DNA, 25 bp, Mus musculus
cactcggtgcttccctggagttggt

SEQ ID NO: 308349 - DNA, 25 bp, Mus musculus
cactcggtgcttgcctggagttggt

SEQ ID NO: 308350 - DNA, 25 bp, Mus musculus
cactcgtcaattaccaactctgtgg

SEQ ID NO: 308351 - DNA, 25 bp, Mus musculus
cactcgtcaatttccaactctgtgg

SEQ ID NO: 308352 - DNA, 25 bp, Mus musculus
cactcgtcactgctctgagtttgaa

SEQ ID NO: 308353 - DNA, 25 bp, Mus musculus
cactcgtcactggtctgagtttgaa

SEQ ID NO: 308354 - DNA, 25 bp, Mus musculus
cactcgtgagatactgctgctgttg

SEQ ID NO: 308355 - DNA, 25 bp, Mus musculus
cactcgtgagattctgctgctgttg

SEQ ID NO: 308356 - DNA, 25 bp, Mus musculus
cactcgtgcacaatagctaacagtt

SEQ ID NO: 308357 - DNA, 25 bp, Mus musculus
cactcgtgcacattagctaacagtt

SEQ ID NO: 308358 - DNA, 25 bp, Mus musculus
cactcgtggatgctgttcatgtgaa

SEQ ID NO: 308359 - DNA, 25 bp, Mus musculus
cactcgtggatggtgttcatgtgaa

SEQ ID NO: 308360 - DNA, 25 bp, Mus musculus
cactcgtggtgcagactcttgttac

SEQ ID NO: 308361 - DNA, 25 bp, Mus musculus
cactcgtggtgctgactcttgttac

SEQ ID NO: 308362 - DNA, 25 bp, Mus musculus
cactcgttagagataatgtacccat

SEQ ID NO: 308363 - DNA, 25 bp, Mus musculus
cactcgttagagttaatgtacccat

SEQ ID NO: 308364 - DNA, 25 bp, Mus musculus
cactcgttggaaactttcccaggcc

SEQ ID NO: 308365 - DNA, 25 bp, Mus musculus
cactcgttggaatctttcccaggcc

SEQ ID NO: 308366 - DNA, 25 bp, Mus musculus
cactctaaaaggcagatctggtcta

SEQ ID NO: 308367 - DNA, 25 bp, Mus musculus
cactctaaaagggagatctggtcta

SEQ ID NO: 308368 - DNA, 25 bp, Mus musculus
cactctaaacttcggttgataagga

SEQ ID NO: 308369 - DNA, 25 bp, Mus musculus
cactctaaacttgggttgataagga

SEQ ID NO: 308370 - DNA, 25 bp, Mus musculus
cactctaagaacaactggcccatga

SEQ ID NO: 308371 - DNA, 25 bp, Mus musculus
cactctaagaactactggcccatga

SEQ ID NO: 308372 - DNA, 25 bp, Mus musculus
cactctaagagccttgttatttcag

SEQ ID NO: 308373 - DNA, 25 bp, Mus musculus
cactctaagagcgttgttatttcag

SEQ ID NO: 308374 - DNA, 25 bp, Mus musculus
cactctaatattacctcttgttttt

SEQ ID NO: 308375 - DNA, 25 bp, Mus musculus
cactctaatatttcctcttgttttt

SEQ ID NO: 308376 - DNA, 25 bp, Mus musculus
cactctacagaactttgcccgaaag

SEQ ID NO: 308377 - DNA, 25 bp, Mus musculus
cactctacagaagtttgcccgaaag

SEQ ID NO: 308378 - DNA, 25 bp, Mus musculus
cactctacattcatggttgctgggt

SEQ ID NO: 308379 - DNA, 25 bp, Mus musculus
cactctacattcttggttgctgggt

SEQ ID NO: 308380 - DNA, 25 bp, Mus musculus
cactctacgcatcagaaagcgggca

SEQ ID NO: 308381 - DNA, 25 bp, Mus musculus
cactctacgcatgagaaagcgggca

SEQ ID NO: 308382 - DNA, 25 bp, Mus musculus
cactctactatcagccataccattt

SEQ ID NO: 308383 - DNA, 25 bp, Mus musculus
cactctactatctgccataccattt

SEQ ID NO: 308384 - DNA, 25 bp, Mus musculus
cactctactcagctacaacaggaac

SEQ ID NO: 308385 - DNA, 25 bp, Mus musculus
cactctactcaggtacaacaggaac

SEQ ID NO: 308386 - DNA, 25 bp, Mus musculus
cactctactctgcaagactttacac

SEQ ID NO: 308387 - DNA, 25 bp, Mus musculus
cactctactctggaagactttacac

SEQ ID NO: 308388 - DNA, 25 bp, Mus musculus
cactctagagacatggttgcctttg

SEQ ID NO: 308389 - DNA, 25 bp, Mus musculus
cactctagagacttggttgcctttg

SEQ ID NO: 308390 - DNA, 25 bp, Mus musculus
cactctaggtccattgcctttgcat

SEQ ID NO: 308391 - DNA, 25 bp, Mus musculus
cactctaggtcctttgcctttgcat

SEQ ID NO: 308392 - DNA, 25 bp, Mus musculus
cactctatagacaatggtacattat

SEQ ID NO: 308393 - DNA, 25 bp, Mus musculus
cactctatagactatggtacattat

SEQ ID NO: 308394 - DNA, 25 bp, Mus musculus
cactctatagagcaggttggcctta

SEQ ID NO: 308395 - DNA, 25 bp, Mus musculus
cactctatagaggaggttggcctta

SEQ ID NO: 308396 - DNA, 25 bp, Mus musculus
cactctatagccaatatgaccttta

SEQ ID NO: 308397 - DNA, 25 bp, Mus musculus
cactctatagcctatatgaccttta

SEQ ID NO: 308398 - DNA, 25 bp, Mus musculus
cactctatctctctttattgtgcca

SEQ ID NO: 308399 - DNA, 25 bp, Mus musculus
cactctatctctgtttattgtgcca

SEQ ID NO: 308400 - DNA, 25 bp, Mus musculus
cactctatcttcagcacagccttgt

SEQ ID NO: 308401 - DNA, 25 bp, Mus musculus
cactctatcttctgcacagccttgt

SEQ ID NO: 308402 - DNA, 25 bp, Mus musculus
cactctatgggcattttagcaacga

SEQ ID NO: 308403 - DNA, 25 bp, Mus musculus
cactctatgggctttttagcaacga

SEQ ID NO: 308404 - DNA, 25 bp, Mus musculus
cactctcaacgaagtgactttttta

SEQ ID NO: 308405 - DNA, 25 bp, Mus musculus
cactctcaacgatgtgactttttta

SEQ ID NO: 308406 - DNA, 25 bp, Mus musculus
cactctcaactcattttcttttgtc

SEQ ID NO: 308407 - DNA, 25 bp, Mus musculus
cactctcaactctttttcttttgtc

SEQ ID NO: 308408 - DNA, 25 bp, Mus musculus
cactctcacaatagacgggaaaaca

SEQ ID NO: 308409 - DNA, 25 bp, Mus musculus
cactctcacaattgacgggaaaaca

SEQ ID NO: 308410 - DNA, 25 bp, Mus musculus
cactctcacctgaagatgttactgc

SEQ ID NO: 308411 - DNA, 25 bp, Mus musculus
cactctcacctgtagatgttactgc

SEQ ID NO: 308412 - DNA, 25 bp, Mus musculus
cactctcacgccctatttagactaa

SEQ ID NO: 308413 - DNA, 25 bp, Mus musculus
cactctcacgccgtatttagactaa

SEQ ID NO: 308414 - DNA, 25 bp, Mus musculus
cactctcagcacagttgggaaaggg

SEQ ID NO: 308415 - DNA, 25 bp, Mus musculus
cactctcagcactgttgggaaaggg

SEQ ID NO: 308416 - DNA, 25 bp, Mus musculus
cactctcatgacatatttatgtggg

SEQ ID NO: 308417 - DNA, 25 bp, Mus musculus
cactctcatgacttatttatgtggg

SEQ ID NO: 308418 - DNA, 25 bp, Mus musculus
cactctcatgtgaaggagacgcccc

SEQ ID NO: 308419 - DNA, 25 bp, Mus musculus
cactctcatgtgtaggagacgcccc

SEQ ID NO: 308420 - DNA, 25 bp, Mus musculus
cactctcattcaaaccaatatacaa

SEQ ID NO: 308421 - DNA, 25 bp, Mus musculus
cactctcattcataccaatatacaa

SEQ ID NO: 308422 - DNA, 25 bp, Mus musculus
cactctccagtgaagatatcagcat

SEQ ID NO: 308423 - DNA, 25 bp, Mus musculus
cactctccagtgtagatatcagcat

SEQ ID NO: 308424 - DNA, 25 bp, Mus musculus
cactctccatttagccttcagataa

SEQ ID NO: 308425 - DNA, 25 bp, Mus musculus
cactctccatttcctggaaggagga

SEQ ID NO: 308426 - DNA, 25 bp, Mus musculus
cactctccatttgctggaaggagga

SEQ ID NO: 308427 - DNA, 25 bp, Mus musculus
cactctccattttgccttcagataa

SEQ ID NO: 308428 - DNA, 25 bp, Mus musculus
cactctccggcacggtctcaaggga

SEQ ID NO: 308429 - DNA, 25 bp, Mus musculus
cactctccggcagggtctcaaggga

SEQ ID NO: 308430 - DNA, 25 bp, Mus musculus
cactctccgggcatttctgagttag

SEQ ID NO: 308431 - DNA, 25 bp, Mus musculus
cactctccgggcttttctgagttag

SEQ ID NO: 308432 - DNA, 25 bp, Mus musculus
cactctcctgggctattagaccttt

SEQ ID NO: 308433 - DNA, 25 bp, Mus musculus
cactctcctggggtattagaccttt

SEQ ID NO: 308434 - DNA, 25 bp, Mus musculus
cactctcctgtgcttatttatcgca

SEQ ID NO: 308435 - DNA, 25 bp, Mus musculus
cactctcctgtggttatttatcgca

SEQ ID NO: 308436 - DNA, 25 bp, Mus musculus
cactctcgaagcctcagggatttgc

SEQ ID NO: 308437 - DNA, 25 bp, Mus musculus
cactctcgaagcgtcagggatttgc

SEQ ID NO: 308438 - DNA, 25 bp, Mus musculus
cactctcgtggaatcgtacggtgga

SEQ ID NO: 308439 - DNA, 25 bp, Mus musculus
cactctcgtggattcgtacggtgga

SEQ ID NO: 308440 - DNA, 25 bp, Mus musculus
cactctctaaaaccacaactcaaaa

SEQ ID NO: 308441 - DNA, 25 bp, Mus musculus
cactctctaaaagcacaactcaaaa

SEQ ID NO: 308442 - DNA, 25 bp, Mus musculus
cactctctactgatgttgtcacaag

SEQ ID NO: 308443 - DNA, 25 bp, Mus musculus
cactctctactgttgttgtcacaag

SEQ ID NO: 308444 - DNA, 25 bp, Mus musculus
cactctctagctataatctttttgc

SEQ ID NO: 308445 - DNA, 25 bp, Mus musculus
cactctctagctttaatctttttgc

SEQ ID NO: 308446 - DNA, 25 bp, Mus musculus
cactctctatgtattccttattatt

SEQ ID NO: 308447 - DNA, 25 bp, Mus musculus
cactctctatgttttccttattatt

SEQ ID NO: 308448 - DNA, 25 bp, Mus musculus
cactctctcacaaagcactttagga

SEQ ID NO: 308449 - DNA, 25 bp, Mus musculus
cactctctcacatagcactttagga

SEQ ID NO: 308450 - DNA, 25 bp, Mus musculus
cactctctcccgaatatacattttt

SEQ ID NO: 308451 - DNA, 25 bp, Mus musculus
cactctctcccgtatatacattttt

SEQ ID NO: 308452 - DNA, 25 bp, Mus musculus
cactctctctgaatacaacatccag

SEQ ID NO: 308453 - DNA, 25 bp, Mus musculus
cactctctctgattacaacatccag

SEQ ID NO: 308454 - DNA, 25 bp, Mus musculus
cactctctgcttctttgagattcaa

SEQ ID NO: 308455 - DNA, 25 bp, Mus musculus
cactctctgcttgtttgagattcaa

SEQ ID NO: 308456 - DNA, 25 bp, Mus musculus
cactctcttatgcttggacagctag

SEQ ID NO: 308457 - DNA, 25 bp, Mus musculus
cactctcttatggttggacagctag

SEQ ID NO: 308458 - DNA, 25 bp, Mus musculus
cactctcttattaattgcattcccc

SEQ ID NO: 308459 - DNA, 25 bp, Mus musculus
cactctcttatttattgcattcccc

SEQ ID NO: 308460 - DNA, 25 bp, Mus musculus
cactctcttcaaaatgtccacatag

SEQ ID NO: 308461 - DNA, 25 bp, Mus musculus
cactctcttcaatatgtccacatag

SEQ ID NO: 308462 - DNA, 25 bp, Mus musculus
cactctcttcccacttattttatgt

SEQ ID NO: 308463 - DNA, 25 bp, Mus musculus
cactctcttccctcttattttatgt

SEQ ID NO: 308464 - DNA, 25 bp, Mus musculus
cactctcttgagaaaacatgtatga

SEQ ID NO: 308465 - DNA, 25 bp, Mus musculus
cactctcttgagtaaacatgtatga

SEQ ID NO: 308466 - DNA, 25 bp, Mus musculus
cactctgaaatccactaccttgttt

SEQ ID NO: 308467 - DNA, 25 bp, Mus musculus
cactctgaaatcgactaccttgttt

SEQ ID NO: 308468 - DNA, 25 bp, Mus musculus
cactctgaagatatttggcacctca

SEQ ID NO: 308469 - DNA, 25 bp, Mus musculus
cactctgaagatttttggcacctca

SEQ ID NO: 308470 - DNA, 25 bp, Mus musculus
cactctgaccaactgagccaggtgt

SEQ ID NO: 308471 - DNA, 25 bp, Mus musculus
cactctgaccaagtgagccaggtgt

SEQ ID NO: 308472 - DNA, 25 bp, Mus musculus
cactctgaccatcccacatgtgtat

SEQ ID NO: 308473 - DNA, 25 bp, Mus musculus
cactctgaccatgccacatgtgtat

SEQ ID NO: 308474 - DNA, 25 bp, Mus musculus
cactctgacttgatgtcatccgaga

SEQ ID NO: 308475 - DNA, 25 bp, Mus musculus
cactctgacttgttgtcatccgaga

SEQ ID NO: 308476 - DNA, 25 bp, Mus musculus
cactctgagatgaatcttgtggcct

SEQ ID NO: 308477 - DNA, 25 bp, Mus musculus
cactctgagatgtatcttgtggcct

SEQ ID NO: 308478 - DNA, 25 bp, Mus musculus
cactctgaggcgactagaacacaca

SEQ ID NO: 308479 - DNA, 25 bp, Mus musculus
cactctgaggcgtctagaacacaca

SEQ ID NO: 308480 - DNA, 25 bp, Mus musculus
cactctgatgaaacctaacactctc

SEQ ID NO: 308481 - DNA, 25 bp, Mus musculus
cactctgatgaatcctaacactctc

SEQ ID NO: 308482 - DNA, 25 bp, Mus musculus
cactctgcatcaagcttattcctaa

SEQ ID NO: 308483 - DNA, 25 bp, Mus musculus
cactctgcatcatgcttattcctaa

SEQ ID NO: 308484 - DNA, 25 bp, Mus musculus
cactctgcccagcaagagagcgtga

SEQ ID NO: 308485 - DNA, 25 bp, Mus musculus
cactctgcccaggaagagagcgtga

SEQ ID NO: 308486 - DNA, 25 bp, Mus musculus
cactctgcccgacgctggacaagaa

SEQ ID NO: 308487 - DNA, 25 bp, Mus musculus
cactctgcccgaggctggacaagaa

SEQ ID NO: 308488 - DNA, 25 bp, Mus musculus
cactctgcgcagatttatctgagaa

SEQ ID NO: 308489 - DNA, 25 bp, Mus musculus
cactctgcgcagttttatctgagaa

SEQ ID NO: 308490 - DNA, 25 bp, Mus musculus
cactctgcgggaccatcaagctgga

SEQ ID NO: 308491 - DNA, 25 bp, Mus musculus
cactctgcgggagcatcaagctgga

SEQ ID NO: 308492 - DNA, 25 bp, Mus musculus
cactctgctacccaggcagtgggac

SEQ ID NO: 308493 - DNA, 25 bp, Mus musculus
cactctgctaccgaggcagtgggac

SEQ ID NO: 308494 - DNA, 25 bp, Mus musculus
cactctgctaggagccagctgtccc

SEQ ID NO: 308495 - DNA, 25 bp, Mus musculus
cactctgctaggtgccagctgtccc

SEQ ID NO: 308496 - DNA, 25 bp, Mus musculus
cactctgctgagcttcaaggagggc

SEQ ID NO: 308497 - DNA, 25 bp, Mus musculus
cactctgctgaggttcaaggagggc

SEQ ID NO: 308498 - DNA, 25 bp, Mus musculus
cactctgctgcactgattgattacg

SEQ ID NO: 308499 - DNA, 25 bp, Mus musculus
cactctgctgcagtgattgattacg

SEQ ID NO: 308500 - DNA, 25 bp, Mus musculus
cactctggaatcagtggatcctcat

SEQ ID NO: 308501 - DNA, 25 bp, Mus musculus
cactctggaatctgtggatcctcat

SEQ ID NO: 308502 - DNA, 25 bp, Mus musculus
cactctggacctcaggttcggcaga

SEQ ID NO: 308503 - DNA, 25 bp, Mus musculus
cactctggacctgaggttcggcaga

SEQ ID NO: 308504 - DNA, 25 bp, Mus musculus
cactctggagatacacacttcactg

SEQ ID NO: 308505 - DNA, 25 bp, Mus musculus
cactctggagattcacacttcactg

SEQ ID NO: 308506 - DNA, 25 bp, Mus musculus
cactctggagcccttgatgactgat

SEQ ID NO: 308507 - DNA, 25 bp, Mus musculus
cactctggagccgttgatgactgat

SEQ ID NO: 308508 - DNA, 25 bp, Mus musculus
cactctggataaaacccttggcttc

SEQ ID NO: 308509 - DNA, 25 bp, Mus musculus
cactctggataatacccttggcttc

SEQ ID NO: 308510 - DNA, 25 bp, Mus musculus
cactctggcaaacctcttgtacaca

SEQ ID NO: 308511 - DNA, 25 bp, Mus musculus
cactctggcaaagctcttgtacaca

SEQ ID NO: 308512 - DNA, 25 bp, Mus musculus
cactctggcttcaaaggtggaccag

SEQ ID NO: 308513 - DNA, 25 bp, Mus musculus
cactctggcttctaaggtggaccag

SEQ ID NO: 308514 - DNA, 25 bp, Mus musculus
cactctggcttgacctcatcaactt

SEQ ID NO: 308515 - DNA, 25 bp, Mus musculus
cactctggcttgtcctcatcaactt

SEQ ID NO: 308516 - DNA, 25 bp, Mus musculus
cactctgggaacaggtaggacacct

SEQ ID NO: 308517 - DNA, 25 bp, Mus musculus
cactctgggaactggtaggacacct

SEQ ID NO: 308518 - DNA, 25 bp, Mus musculus
cactctgggacacttcatgtgcgaa

SEQ ID NO: 308519 - DNA, 25 bp, Mus musculus
cactctgggacagttcatgtgcgaa

SEQ ID NO: 308520 - DNA, 25 bp, Mus musculus
cactctgggattatgcttgtttgct

SEQ ID NO: 308521 - DNA, 25 bp, Mus musculus
cactctgggattttgcttgtttgct

SEQ ID NO: 308522 - DNA, 25 bp, Mus musculus
cactctgggcagatcctactttcag

SEQ ID NO: 308523 - DNA, 25 bp, Mus musculus
cactctgggcagttcctactttcag

SEQ ID NO: 308524 - DNA, 25 bp, Mus musculus
cactctgggtacctgggtgttcgct

SEQ ID NO: 308525 - DNA, 25 bp, Mus musculus
cactctgggtacgtgggtgttcgct

SEQ ID NO: 308526 - DNA, 25 bp, Mus musculus
cactctgggtccacaagagctggat

SEQ ID NO: 308527 - DNA, 25 bp, Mus musculus
cactctgggtcctcaagagctggat

SEQ ID NO: 308528 - DNA, 25 bp, Mus musculus
cactctgggttcatgtaatgatgtt

SEQ ID NO: 308529 - DNA, 25 bp, Mus musculus
cactctgggttcttgtaatgatgtt

SEQ ID NO: 308530 - DNA, 25 bp, Mus musculus
cactctggtaacagtgaggttgccc

SEQ ID NO: 308531 - DNA, 25 bp, Mus musculus
cactctggtaactgtgaggttgccc

SEQ ID NO: 308532 - DNA, 25 bp, Mus musculus
cactctggtgagctgcattggtcaa

SEQ ID NO: 308533 - DNA, 25 bp, Mus musculus
cactctggtgaggtgcattggtcaa

SEQ ID NO: 308534 - DNA, 25 bp, Mus musculus
cactctggtgtcagagcggcctgaa

SEQ ID NO: 308535 - DNA, 25 bp, Mus musculus
cactctggtgtctgagcggcctgaa

SEQ ID NO: 308536 - DNA, 25 bp, Mus musculus
cactctgtaaccaagctccttaggt

SEQ ID NO: 308537 - DNA, 25 bp, Mus musculus
cactctgtaacctagctccttaggt

SEQ ID NO: 308538 - DNA, 25 bp, Mus musculus
cactctgtaagccaggctcacatgg

SEQ ID NO: 308539 - DNA, 25 bp, Mus musculus
cactctgtaagcgaggctcacatgg

SEQ ID NO: 308540 - DNA, 25 bp, Mus musculus
cactctgtaattctggcttgataca

SEQ ID NO: 308541 - DNA, 25 bp, Mus musculus
cactctgtaattgtggcttgataca

SEQ ID NO: 308542 - DNA, 25 bp, Mus musculus
cactctgtacatctgaggccaaata

SEQ ID NO: 308543 - DNA, 25 bp, Mus musculus
cactctgtacatgtgaggccaaata

SEQ ID NO: 308544 - DNA, 25 bp, Mus musculus
cactctgtaccccaaagcttaaatc

SEQ ID NO: 308545 - DNA, 25 bp, Mus musculus
cactctgtacccgaaagcttaaatc

SEQ ID NO: 308546 - DNA, 25 bp, Mus musculus
cactctgtagataagtcagaccttg

SEQ ID NO: 308547 - DNA, 25 bp, Mus musculus
cactctgtagattagtcagaccttg

SEQ ID NO: 308548 - DNA, 25 bp, Mus musculus
cactctgtagttcttaatgactgca

SEQ ID NO: 308549 - DNA, 25 bp, Mus musculus
cactctgtagttgttaatgactgca

SEQ ID NO: 308550 - DNA, 25 bp, Mus musculus
cactctgtatatcccaccttttatg

SEQ ID NO: 308551 - DNA, 25 bp, Mus musculus
cactctgtatatgccaccttttatg

SEQ ID NO: 308552 - DNA, 25 bp, Mus musculus
cactctgtatctctgcattgtttga

SEQ ID NO: 308553 - DNA, 25 bp, Mus musculus
cactctgtatctgtgcattgtttga

SEQ ID NO: 308554 - DNA, 25 bp, Mus musculus
cactctgtcacactgtgcctaagaa

SEQ ID NO: 308555 - DNA, 25 bp, Mus musculus
cactctgtcacagtgtgcctaagaa

SEQ ID NO: 308556 - DNA, 25 bp, Mus musculus
cactctgtcagccaattcttttaaa

SEQ ID NO: 308557 - DNA, 25 bp, Mus musculus
cactctgtcagcgaattcttttaaa

SEQ ID NO: 308558 - DNA, 25 bp, Mus musculus
cactctgtgccaccgatgtgagcaa

SEQ ID NO: 308559 - DNA, 25 bp, Mus musculus
cactctgtgccagcgatgtgagcaa

SEQ ID NO: 308560 - DNA, 25 bp, Mus musculus
cactctgtgcgaagtctgtgtgaca

SEQ ID NO: 308561 - DNA, 25 bp, Mus musculus
cactctgtgcgatgtctgtgtgaca

SEQ ID NO: 308562 - DNA, 25 bp, Mus musculus
cactctgtggaaaagttagtttgcc

SEQ ID NO: 308563 - DNA, 25 bp, Mus musculus
cactctgtggaatagttagtttgcc

SEQ ID NO: 308564 - DNA, 25 bp, Mus musculus
cactctgtgggtaaaattagctgca

SEQ ID NO: 308565 - DNA, 25 bp, Mus musculus
cactctgtgggttaaattagctgca

SEQ ID NO: 308566 - DNA, 25 bp, Mus musculus
cactctgttgtgacctttgggtggt

SEQ ID NO: 308567 - DNA, 25 bp, Mus musculus
cactctgttgtgtcctttgggtggt

SEQ ID NO: 308568 - DNA, 25 bp, Mus musculus
cactctgtttctaggattgcatggg

SEQ ID NO: 308569 - DNA, 25 bp, Mus musculus
cactctgtttcttggattgcatggg

SEQ ID NO: 308570 - DNA, 25 bp, Mus musculus
cactctgttttacactgctcagtgt

SEQ ID NO: 308571 - DNA, 25 bp, Mus musculus
cactctgttttagactgctcagtgt

SEQ ID NO: 308572 - DNA, 25 bp, Mus musculus
cactcttaagtcattgacccttgtt

SEQ ID NO: 308573 - DNA, 25 bp, Mus musculus
cactcttaagtctttgacccttgtt

SEQ ID NO: 308574 - DNA, 25 bp, Mus musculus
cactcttaagtgaacatcagggaag

SEQ ID NO: 308575 - DNA, 25 bp, Mus musculus
cactcttaagtgtacatcagggaag

SEQ ID NO: 308576 - DNA, 25 bp, Mus musculus
cactcttagagtagatgacgcatta

SEQ ID NO: 308577 - DNA, 25 bp, Mus musculus
cactcttagagttgatgacgcatta

SEQ ID NO: 308578 - DNA, 25 bp, Mus musculus
cactcttatggccatcagggaaacc

SEQ ID NO: 308579 - DNA, 25 bp, Mus musculus
cactcttatggcgatcagggaaacc

SEQ ID NO: 308580 - DNA, 25 bp, Mus musculus
cactcttatgggagatatctgtctc

SEQ ID NO: 308581 - DNA, 25 bp, Mus musculus
cactcttatgggtgatatctgtctc

SEQ ID NO: 308582 - DNA, 25 bp, Mus musculus
cactcttcaccaattgtatattaat

SEQ ID NO: 308583 - DNA, 25 bp, Mus musculus
cactcttcaccatttgtatattaat

SEQ ID NO: 308584 - DNA, 25 bp, Mus musculus
cactcttcactgcgttttccataca

SEQ ID NO: 308585 - DNA, 25 bp, Mus musculus
cactcttcactgggttttccataca

SEQ ID NO: 308586 - DNA, 25 bp, Mus musculus
cactcttcagttagaagcaatcagc

SEQ ID NO: 308587 - DNA, 25 bp, Mus musculus
cactcttcagtttgaagcaatcagc

SEQ ID NO: 308588 - DNA, 25 bp, Mus musculus
cactcttccctaaacaagctctaaa

SEQ ID NO: 308589 - DNA, 25 bp, Mus musculus
cactcttccctatacaagctctaaa

SEQ ID NO: 308590 - DNA, 25 bp, Mus musculus
cactcttcctagatcccagaataaa

SEQ ID NO: 308591 - DNA, 25 bp, Mus musculus
cactcttcctagttcccagaataaa

SEQ ID NO: 308592 - DNA, 25 bp, Mus musculus
cactcttcctgcagttaggtaactg

SEQ ID NO: 308593 - DNA, 25 bp, Mus musculus
cactcttcctgctgttaggtaactg

SEQ ID NO: 308594 - DNA, 25 bp, Mus musculus
cactcttctggtacttcaacatcta

SEQ ID NO: 308595 - DNA, 25 bp, Mus musculus
cactcttctggttcttcaacatcta

SEQ ID NO: 308596 - DNA, 25 bp, Mus musculus
cactcttcttagctttttctactga

SEQ ID NO: 308597 - DNA, 25 bp, Mus musculus
cactcttcttaggtttttctactga

SEQ ID NO: 308598 - DNA, 25 bp, Mus musculus
cactcttggtgcatgataaatgtta

SEQ ID NO: 308599 - DNA, 25 bp, Mus musculus
cactcttggtgcttgataaatgtta

SEQ ID NO: 308600 - DNA, 25 bp, Mus musculus
cactcttgtcaacacaggatgaata

SEQ ID NO: 308601 - DNA, 25 bp, Mus musculus
cactcttgtcaagacaggatgaata

SEQ ID NO: 308602 - DNA, 25 bp, Mus musculus
cactcttgtcccagatgttccttgg

SEQ ID NO: 308603 - DNA, 25 bp, Mus musculus
cactcttgtccctgatgttccttgg

SEQ ID NO: 308604 - DNA, 25 bp, Mus musculus
cactctttcaaaccattcattatcc

SEQ ID NO: 308605 - DNA, 25 bp, Mus musculus
cactctttcaaagcattcattatcc

SEQ ID NO: 308606 - DNA, 25 bp, Mus musculus
cactctttcatcacagaagaccact

SEQ ID NO: 308607 - DNA, 25 bp, Mus musculus
cactctttcatctcagaagaccact

SEQ ID NO: 308608 - DNA, 25 bp, Mus musculus
cactctttccacacttattcaatat

SEQ ID NO: 308609 - DNA, 25 bp, Mus musculus
cactctttccactcttattcaatat

SEQ ID NO: 308610 - DNA, 25 bp, Mus musculus
cactctttgtctcctttcaatgtga

SEQ ID NO: 308611 - DNA, 25 bp, Mus musculus
cactctttgtctgctttcaatgtga

SEQ ID NO: 308612 - DNA, 25 bp, Mus musculus
cactctttgttgaggtggcagttca

SEQ ID NO: 308613 - DNA, 25 bp, Mus musculus
cactctttgttgtggtggcagttca

SEQ ID NO: 308614 - DNA, 25 bp, Mus musculus
cactcttttcaccatctttgcattt

SEQ ID NO: 308615 - DNA, 25 bp, Mus musculus
cactcttttcacctacttctagtac

SEQ ID NO: 308616 - DNA, 25 bp, Mus musculus
cactcttttcacgatctttgcattt

SEQ ID NO: 308617 - DNA, 25 bp, Mus musculus
cactcttttcacgtacttctagtac

SEQ ID NO: 308618 - DNA, 25 bp, Mus musculus
cactcttttcctcgtcaaacaacaa

SEQ ID NO: 308619 - DNA, 25 bp, Mus musculus
cactcttttcctggtcaaacaacaa

SEQ ID NO: 308620 - DNA, 25 bp, Mus musculus
cactctttttgccaacatgttctga

SEQ ID NO: 308621 - DNA, 25 bp, Mus musculus
cactctttttgcgaacatgttctga

SEQ ID NO: 308622 - DNA, 25 bp, Mus musculus
cactctttttggcagcaacagctac

SEQ ID NO: 308623 - DNA, 25 bp, Mus musculus
cactctttttgggagcaacagctac

SEQ ID NO: 308624 - DNA, 25 bp, Mus musculus
cactgaaaaccaagcgtctggagtt

SEQ ID NO: 308625 - DNA, 25 bp, Mus musculus
cactgaaaaccatgcgtctggagtt

SEQ ID NO: 308626 - DNA, 25 bp, Mus musculus
cactgaaaacggcagatcacagcat

SEQ ID NO: 308627 - DNA, 25 bp, Mus musculus
cactgaaaacgggagatcacagcat

SEQ ID NO: 308628 - DNA, 25 bp, Mus musculus
cactgaaaagcgaataactaatttt

SEQ ID NO: 308629 - DNA, 25 bp, Mus musculus
cactgaaaagcgtataactaatttt

SEQ ID NO: 308630 - DNA, 25 bp, Mus musculus
cactgaaaccctatgcttatcgtca

SEQ ID NO: 308631 - DNA, 25 bp, Mus musculus
cactgaaaccctttgcttatcgtca

SEQ ID NO: 308632 - DNA, 25 bp, Mus musculus
cactgaaagcccctgattgaagatg

SEQ ID NO: 308633 - DNA, 25 bp, Mus musculus
cactgaaagcccgtgattgaagatg

SEQ ID NO: 308634 - DNA, 25 bp, Mus musculus
cactgaaagccgagaggtgacattt

SEQ ID NO: 308635 - DNA, 25 bp, Mus musculus
cactgaaagccgtgaggtgacattt

SEQ ID NO: 308636 - DNA, 25 bp, Mus musculus
cactgaaatgatctccttttaataa

SEQ ID NO: 308637 - DNA, 25 bp, Mus musculus
cactgaaatgatgtccttttaataa

SEQ ID NO: 308638 - DNA, 25 bp, Mus musculus
cactgaaattgtctgtcctgaggag

SEQ ID NO: 308639 - DNA, 25 bp, Mus musculus
cactgaaattgtgtgtcctgaggag

SEQ ID NO: 308640 - DNA, 25 bp, Mus musculus
cactgaaatttgcaaagggatcaag

SEQ ID NO: 308641 - DNA, 25 bp, Mus musculus
cactgaaatttggaaagggatcaag

SEQ ID NO: 308642 - DNA, 25 bp, Mus musculus
cactgaacaaagcaggcagccacag

SEQ ID NO: 308643 - DNA, 25 bp, Mus musculus
cactgaacaaaggaggcagccacag

SEQ ID NO: 308644 - DNA, 25 bp, Mus musculus
cactgaacagtcacatcttagggtt

SEQ ID NO: 308645 - DNA, 25 bp, Mus musculus
cactgaacagtctcatcttagggtt

SEQ ID NO: 308646 - DNA, 25 bp, Mus musculus
cactgaacatgtctaagattggtta

SEQ ID NO: 308647 - DNA, 25 bp, Mus musculus
cactgaacatgtgtaagattggtta

SEQ ID NO: 308648 - DNA, 25 bp, Mus musculus
cactgaaccacaatgctcttagctt

SEQ ID NO: 308649 - DNA, 25 bp, Mus musculus
cactgaaccacattgctcttagctt

SEQ ID NO: 308650 - DNA, 25 bp, Mus musculus
cactgaacctaaacagcctgaattt

SEQ ID NO: 308651 - DNA, 25 bp, Mus musculus
cactgaacctaatcagcctgaattt

SEQ ID NO: 308652 - DNA, 25 bp, Mus musculus
cactgaacttaaccttggcgatttt

SEQ ID NO: 308653 - DNA, 25 bp, Mus musculus
cactgaacttaagcttggcgatttt

SEQ ID NO: 308654 - DNA, 25 bp, Mus musculus
cactgaacttggaaaagacgtcctt

SEQ ID NO: 308655 - DNA, 25 bp, Mus musculus
cactgaacttggtaaagacgtcctt

SEQ ID NO: 308656 - DNA, 25 bp, Mus musculus
cactgaactttcacataagactgaa

SEQ ID NO: 308657 - DNA, 25 bp, Mus musculus
cactgaactttctcataagactgaa

SEQ ID NO: 308658 - DNA, 25 bp, Mus musculus
cactgaagacaaaatcaaggaccaa

SEQ ID NO: 308659 - DNA, 25 bp, Mus musculus
cactgaagacaatatcaaggaccaa

SEQ ID NO: 308660 - DNA, 25 bp, Mus musculus
cactgaagacatcaagtcctctttt

SEQ ID NO: 308661 - DNA, 25 bp, Mus musculus
cactgaagacatgaagtcctctttt

SEQ ID NO: 308662 - DNA, 25 bp, Mus musculus
cactgaagaccaagccacctaattt

SEQ ID NO: 308663 - DNA, 25 bp, Mus musculus
cactgaagaccatgccacctaattt

SEQ ID NO: 308664 - DNA, 25 bp, Mus musculus
cactgaagacctccctgaagtttaa

SEQ ID NO: 308665 - DNA, 25 bp, Mus musculus
cactgaagacctgcctgaagtttaa

SEQ ID NO: 308666 - DNA, 25 bp, Mus musculus
cactgaagcataattccagcccagg

SEQ ID NO: 308667 - DNA, 25 bp, Mus musculus
cactgaagcatatttccagcccagg

SEQ ID NO: 308668 - DNA, 25 bp, Mus musculus
cactgaaggactaaggttgtttatt

SEQ ID NO: 308669 - DNA, 25 bp, Mus musculus
cactgaaggacttaggttgtttatt

SEQ ID NO: 308670 - DNA, 25 bp, Mus musculus
cactgaagggcaacttgggctacac

SEQ ID NO: 308671 - DNA, 25 bp, Mus musculus
cactgaagggcacatgctcttgggt

SEQ ID NO: 308672 - DNA, 25 bp, Mus musculus
cactgaagggcagatgctcttgggt

SEQ ID NO: 308673 - DNA, 25 bp, Mus musculus
cactgaagggcatcttgggctacac

SEQ ID NO: 308674 - DNA, 25 bp, Mus musculus
cactgaagtgtaacatgatttgtat

SEQ ID NO: 308675 - DNA, 25 bp, Mus musculus
cactgaagtgtatcatgatttgtat

SEQ ID NO: 308676 - DNA, 25 bp, Mus musculus
cactgaataatgctgtcccctggtg

SEQ ID NO: 308677 - DNA, 25 bp, Mus musculus
cactgaataatggtgtcccctggtg

SEQ ID NO: 308678 - DNA, 25 bp, Mus musculus
cactgaatattcacctgttgcacca

SEQ ID NO: 308679 - DNA, 25 bp, Mus musculus
cactgaatattctcctgttgcacca

SEQ ID NO: 308680 - DNA, 25 bp, Mus musculus
cactgaatctctaggaactggaatt

SEQ ID NO: 308681 - DNA, 25 bp, Mus musculus
cactgaatctcttggaactggaatt

SEQ ID NO: 308682 - DNA, 25 bp, Mus musculus
cactgaatctgactggcttttattt

SEQ ID NO: 308683 - DNA, 25 bp, Mus musculus
cactgaatctgagtggcttttattt

SEQ ID NO: 308684 - DNA, 25 bp, Mus musculus
cactgacaaagtcacaggcaccttt

SEQ ID NO: 308685 - DNA, 25 bp, Mus musculus
cactgacaaagtgacaggcaccttt

SEQ ID NO: 308686 - DNA, 25 bp, Mus musculus
cactgacaagctctccgtgtgagga

SEQ ID NO: 308687 - DNA, 25 bp, Mus musculus
cactgacaagctgtccgtgtgagga

SEQ ID NO: 308688 - DNA, 25 bp, Mus musculus
cactgacaccttaaatgatacatct

SEQ ID NO: 308689 - DNA, 25 bp, Mus musculus
cactgacacctttaatgatacatct

SEQ ID NO: 308690 - DNA, 25 bp, Mus musculus
cactgacacgctctgtgtgtttagt

SEQ ID NO: 308691 - DNA, 25 bp, Mus musculus
cactgacacgctgtgtgtgtttagt

SEQ ID NO: 308692 - DNA, 25 bp, Mus musculus
cactgacagagtatgggcctatgat

SEQ ID NO: 308693 - DNA, 25 bp, Mus musculus
cactgacagagtttgggcctatgat

SEQ ID NO: 308694 - DNA, 25 bp, Mus musculus
cactgacatatgacactacttgaac

SEQ ID NO: 308695 - DNA, 25 bp, Mus musculus
cactgacatatgtcactacttgaac

SEQ ID NO: 308696 - DNA, 25 bp, Mus musculus
cactgacatgtgctctcactggaca

SEQ ID NO: 308697 - DNA, 25 bp, Mus musculus
cactgacatgtggtctcactggaca

SEQ ID NO: 308698 - DNA, 25 bp, Mus musculus
cactgaccatggagacactgactaa

SEQ ID NO: 308699 - DNA, 25 bp, Mus musculus
cactgaccatggtgacactgactaa

SEQ ID NO: 308700 - DNA, 25 bp, Mus musculus
cactgacccaaacgtgcttgtaatg

SEQ ID NO: 308701 - DNA, 25 bp, Mus musculus
cactgacccaaaggtgcttgtaatg

SEQ ID NO: 308702 - DNA, 25 bp, Mus musculus
cactgacctcacacccttttaaagt

SEQ ID NO: 308703 - DNA, 25 bp, Mus musculus
cactgacctcactcccttttaaagt

SEQ ID NO: 308704 - DNA, 25 bp, Mus musculus
cactgacctctgcagagcacagaaa

SEQ ID NO: 308705 - DNA, 25 bp, Mus musculus
cactgacctctggagagcacagaaa

SEQ ID NO: 308706 - DNA, 25 bp, Mus musculus
cactgaccttggcattatggctggg

SEQ ID NO: 308707 - DNA, 25 bp, Mus musculus
cactgaccttgggattatggctggg

SEQ ID NO: 308708 - DNA, 25 bp, Mus musculus
cactgacctttgatttccgtttagc

SEQ ID NO: 308709 - DNA, 25 bp, Mus musculus
cactgacctttgttttccgtttagc

SEQ ID NO: 308710 - DNA, 25 bp, Mus musculus
cactgacggcagacacttcctctaa

SEQ ID NO: 308711 - DNA, 25 bp, Mus musculus
cactgacggcagtcacttcctctaa

SEQ ID NO: 308712 - DNA, 25 bp, Mus musculus
cactgactcaatcctgatggccagg

SEQ ID NO: 308713 - DNA, 25 bp, Mus musculus
cactgactcaatgctgatggccagg

SEQ ID NO: 308714 - DNA, 25 bp, Mus musculus
cactgactgctcatgtgaagggtgt

SEQ ID NO: 308715 - DNA, 25 bp, Mus musculus
cactgactgctcttgtgaagggtgt

SEQ ID NO: 308716 - DNA, 25 bp, Mus musculus
cactgactggttaggactctgtata

SEQ ID NO: 308717 - DNA, 25 bp, Mus musculus
cactgactggtttggactctgtata

SEQ ID NO: 308718 - DNA, 25 bp, Mus musculus
cactgactgtctattgtaacttaag

SEQ ID NO: 308719 - DNA, 25 bp, Mus musculus
cactgactgtcttttgtaacttaag

SEQ ID NO: 308720 - DNA, 25 bp, Mus musculus
cactgactgtgacatgaacagcccc

SEQ ID NO: 308721 - DNA, 25 bp, Mus musculus
cactgactgtgagatgaacagcccc

SEQ ID NO: 308722 - DNA, 25 bp, Mus musculus
cactgacttggacatatgctgggac

SEQ ID NO: 308723 - DNA, 25 bp, Mus musculus
cactgacttggagatatgctgggac

SEQ ID NO: 308724 - DNA, 25 bp, Mus musculus
cactgacttgtaatgatttctttta

SEQ ID NO: 308725 - DNA, 25 bp, Mus musculus
cactgacttgtattgatttctttta

SEQ ID NO: 308726 - DNA, 25 bp, Mus musculus
cactgagaaccaaagattgcccctg

SEQ ID NO: 308727 - DNA, 25 bp, Mus musculus
cactgagaaccatagattgcccctg

SEQ ID NO: 308728 - DNA, 25 bp, Mus musculus
cactgagaggccaggattagggtcc

SEQ ID NO: 308729 - DNA, 25 bp, Mus musculus
cactgagaggcctggattagggtcc

SEQ ID NO: 308730 - DNA, 25 bp, Mus musculus
cactgagatgcacaggctgacctga

SEQ ID NO: 308731 - DNA, 25 bp, Mus musculus
cactgagatgcagaggctgacctga

SEQ ID NO: 308732 - DNA, 25 bp, Mus musculus
cactgagatgtgcttcgtggtgctt

SEQ ID NO: 308733 - DNA, 25 bp, Mus musculus
cactgagatgtggttcgtggtgctt

SEQ ID NO: 308734 - DNA, 25 bp, Mus musculus
cactgagcaataagttttcgttata

SEQ ID NO: 308735 - DNA, 25 bp, Mus musculus
cactgagcaatatgttttcgttata

SEQ ID NO: 308736 - DNA, 25 bp, Mus musculus
cactgagcacacagggtcctgataa

SEQ ID NO: 308737 - DNA, 25 bp, Mus musculus
cactgagcacactgggtcctgataa

SEQ ID NO: 308738 - DNA, 25 bp, Mus musculus
cactgagcacctcggaagaggacct

SEQ ID NO: 308739 - DNA, 25 bp, Mus musculus
cactgagcacctgggaagaggacct

SEQ ID NO: 308740 - DNA, 25 bp, Mus musculus
cactgagcaggcagactgggttaca

SEQ ID NO: 308741 - DNA, 25 bp, Mus musculus
cactgagcaggctgactgggttaca

SEQ ID NO: 308742 - DNA, 25 bp, Mus musculus
cactgagcagtccagctctatggga

SEQ ID NO: 308743 - DNA, 25 bp, Mus musculus
cactgagcagtcgagctctatggga

SEQ ID NO: 308744 - DNA, 25 bp, Mus musculus
cactgagccactccccatatatgga

SEQ ID NO: 308745 - DNA, 25 bp, Mus musculus
cactgagccactgcccatatatgga

SEQ ID NO: 308746 - DNA, 25 bp, Mus musculus
cactgagcctggagacctcaatggg

SEQ ID NO: 308747 - DNA, 25 bp, Mus musculus
cactgagcctggtgacctcaatggg

SEQ ID NO: 308748 - DNA, 25 bp, Mus musculus
cactgagcgagtaggcgggtcttct

SEQ ID NO: 308749 - DNA, 25 bp, Mus musculus
cactgagcgagttggcgggtcttct

SEQ ID NO: 308750 - DNA, 25 bp, Mus musculus
cactgagcggttcgttttcatcttt

SEQ ID NO: 308751 - DNA, 25 bp, Mus musculus
cactgagcggttggttttcatcttt

SEQ ID NO: 308752 - DNA, 25 bp, Mus musculus
cactgagcgtagagattctgcctgt

SEQ ID NO: 308753 - DNA, 25 bp, Mus musculus
cactgagcgtagtgattctgcctgt

SEQ ID NO: 308754 - DNA, 25 bp, Mus musculus
cactgagctccgaagagctaatact

SEQ ID NO: 308755 - DNA, 25 bp, Mus musculus
cactgagctccgtagagctaatact

SEQ ID NO: 308756 - DNA, 25 bp, Mus musculus
cactgagctctgaggccagtggcag

SEQ ID NO: 308757 - DNA, 25 bp, Mus musculus
cactgagctctgtggccagtggcag

SEQ ID NO: 308758 - DNA, 25 bp, Mus musculus
cactgagctgcccataagtcgtttt

SEQ ID NO: 308759 - DNA, 25 bp, Mus musculus
cactgagctgccgataagtcgtttt

SEQ ID NO: 308760 - DNA, 25 bp, Mus musculus
cactgagctggaaagtctgggactt

SEQ ID NO: 308761 - DNA, 25 bp, Mus musculus
cactgagctggatagtctgggactt

SEQ ID NO: 308762 - DNA, 25 bp, Mus musculus
cactgagctgtaatagaagcccaaa

SEQ ID NO: 308763 - DNA, 25 bp, Mus musculus
cactgagctgtattagaagcccaaa

SEQ ID NO: 308764 - DNA, 25 bp, Mus musculus
cactgagcttctctgtgaactattt

SEQ ID NO: 308765 - DNA, 25 bp, Mus musculus
cactgagcttctgtgtgaactattt

SEQ ID NO: 308766 - DNA, 25 bp, Mus musculus
cactgagcttgaaggacccgctgaa

SEQ ID NO: 308767 - DNA, 25 bp, Mus musculus
cactgagcttgatggacccgctgaa

SEQ ID NO: 308768 - DNA, 25 bp, Mus musculus
cactgagctttcctacctgttaaag

SEQ ID NO: 308769 - DNA, 25 bp, Mus musculus
cactgagctttcgtacctgttaaag

SEQ ID NO: 308770 - DNA, 25 bp, Mus musculus
cactgagcttttagctgggtgcctt

SEQ ID NO: 308771 - DNA, 25 bp, Mus musculus
cactgagctttttgctgggtgcctt

SEQ ID NO: 308772 - DNA, 25 bp, Mus musculus
cactgaggagcaacctcaggaatca

SEQ ID NO: 308773 - DNA, 25 bp, Mus musculus
cactgaggagcaactgactggccaa

SEQ ID NO: 308774 - DNA, 25 bp, Mus musculus
cactgaggagcatcctcaggaatca

SEQ ID NO: 308775 - DNA, 25 bp, Mus musculus
cactgaggagcatctgactggccaa

SEQ ID NO: 308776 - DNA, 25 bp, Mus musculus
cactgaggcagcaatgggcacgaga

SEQ ID NO: 308777 - DNA, 25 bp, Mus musculus
cactgaggcagctatgggcacgaga

SEQ ID NO: 308778 - DNA, 25 bp, Mus musculus
cactgaggccaacgagtcaagcttg

SEQ ID NO: 308779 - DNA, 25 bp, Mus musculus
cactgaggccaaggagtcaagcttg

SEQ ID NO: 308780 - DNA, 25 bp, Mus musculus
cactgaggcctgaccgtggcagtgg

SEQ ID NO: 308781 - DNA, 25 bp, Mus musculus
cactgaggcctgtccgtggcagtgg

SEQ ID NO: 308782 - DNA, 25 bp, Mus musculus
cactgaggctctcgcagcgacagcg

SEQ ID NO: 308783 - DNA, 25 bp, Mus musculus
cactgaggctctggcagcgacagcg

SEQ ID NO: 308784 - DNA, 25 bp, Mus musculus
cactgaggcttgcttgctggtttgt

SEQ ID NO: 308785 - DNA, 25 bp, Mus musculus
cactgaggcttggttgctggtttgt

SEQ ID NO: 308786 - DNA, 25 bp, Mus musculus
cactgagggagacctgtgcctgatt

SEQ ID NO: 308787 - DNA, 25 bp, Mus musculus
cactgagggagagctgtgcctgatt

SEQ ID NO: 308788 - DNA, 25 bp, Mus musculus
cactgagggccgcttttgagattta

SEQ ID NO: 308789 - DNA, 25 bp, Mus musculus
cactgagggccggttttgagattta

SEQ ID NO: 308790 - DNA, 25 bp, Mus musculus
cactgagggctcatgggagctcttt

SEQ ID NO: 308791 - DNA, 25 bp, Mus musculus
cactgagggctcttgggagctcttt

SEQ ID NO: 308792 - DNA, 25 bp, Mus musculus
cactgagggtcacgcgaacttttca

SEQ ID NO: 308793 - DNA, 25 bp, Mus musculus
cactgagggtcaggcgaacttttca

SEQ ID NO: 308794 - DNA, 25 bp, Mus musculus
cactgagtagcactgcagttctgaa

SEQ ID NO: 308795 - DNA, 25 bp, Mus musculus
cactgagtagcagtgcagttctgaa

SEQ ID NO: 308796 - DNA, 25 bp, Mus musculus
cactgagtgactcctggaccacagc

SEQ ID NO: 308797 - DNA, 25 bp, Mus musculus
cactgagtgactgctggaccacagc

SEQ ID NO: 308798 - DNA, 25 bp, Mus musculus
cactgagtggccatgcgtcctgggt

SEQ ID NO: 308799 - DNA, 25 bp, Mus musculus
cactgagtggccttgcgtcctgggt

SEQ ID NO: 308800 - DNA, 25 bp, Mus musculus
cactgagtggttccctggaaggcac

SEQ ID NO: 308801 - DNA, 25 bp, Mus musculus
cactgagtggttgcctggaaggcac

SEQ ID NO: 308802 - DNA, 25 bp, Mus musculus
cactgagtgtggagagtcgctgtca

SEQ ID NO: 308803 - DNA, 25 bp, Mus musculus
cactgagtgtggtgagtcgctgtca

SEQ ID NO: 308804 - DNA, 25 bp, Mus musculus
cactgagttgccaggccttgggacg

SEQ ID NO: 308805 - DNA, 25 bp, Mus musculus
cactgagttgcctggccttgggacg

SEQ ID NO: 308806 - DNA, 25 bp, Mus musculus
cactgagtttttcatgcaccttgtt

SEQ ID NO: 308807 - DNA, 25 bp, Mus musculus
cactgagtttttgatgcaccttgtt

SEQ ID NO: 308808 - DNA, 25 bp, Mus musculus
cactgataccagatgtcaagctcat

SEQ ID NO: 308809 - DNA, 25 bp, Mus musculus
cactgataccagttgtcaagctcat

SEQ ID NO: 308810 - DNA, 25 bp, Mus musculus
cactgatagattccgaagacagctc

SEQ ID NO: 308811 - DNA, 25 bp, Mus musculus
cactgatagattgcgaagacagctc

SEQ ID NO: 308812 - DNA, 25 bp, Mus musculus
cactgatagcttatcattggctctt

SEQ ID NO: 308813 - DNA, 25 bp, Mus musculus
cactgatagcttttcattggctctt

SEQ ID NO: 308814 - DNA, 25 bp, Mus musculus
cactgatattgtaggctgagctctc

SEQ ID NO: 308815 - DNA, 25 bp, Mus musculus
cactgatattgttggctgagctctc

SEQ ID NO: 308816 - DNA, 25 bp, Mus musculus
cactgatcaaaacacctgtgccaca

SEQ ID NO: 308817 - DNA, 25 bp, Mus musculus
cactgatcaaaagacctgtgccaca

SEQ ID NO: 308818 - DNA, 25 bp, Mus musculus
cactgatcacatcgcctctggagag

SEQ ID NO: 308819 - DNA, 25 bp, Mus musculus
cactgatcacatggcctctggagag

SEQ ID NO: 308820 - DNA, 25 bp, Mus musculus
cactgatcactgcttgagggcacaa

SEQ ID NO: 308821 - DNA, 25 bp, Mus musculus
cactgatcactggttgagggcacaa

SEQ ID NO: 308822 - DNA, 25 bp, Mus musculus
cactgatcaggaatgtgtgcagcag

SEQ ID NO: 308823 - DNA, 25 bp, Mus musculus
cactgatcaggattgtgtgcagcag

SEQ ID NO: 308824 - DNA, 25 bp, Mus musculus
cactgatcctctctgtatggtctca

SEQ ID NO: 308825 - DNA, 25 bp, Mus musculus
cactgatcctctgtgtatggtctca

SEQ ID NO: 308826 - DNA, 25 bp, Mus musculus
cactgatctaccacttcagacaggg

SEQ ID NO: 308827 - DNA, 25 bp, Mus musculus
cactgatctacctcttcagacaggg

SEQ ID NO: 308828 - DNA, 25 bp, Mus musculus
cactgatctgtactagcactctctc

SEQ ID NO: 308829 - DNA, 25 bp, Mus musculus
cactgatctgtagtagcactctctc

SEQ ID NO: 308830 - DNA, 25 bp, Mus musculus
cactgatgactgctgaagccacgca

SEQ ID NO: 308831 - DNA, 25 bp, Mus musculus
cactgatgactggtgaagccacgca

SEQ ID NO: 308832 - DNA, 25 bp, Mus musculus
cactgatgatgtcgtggcatgctca

SEQ ID NO: 308833 - DNA, 25 bp, Mus musculus
cactgatgatgtggtggcatgctca

SEQ ID NO: 308834 - DNA, 25 bp, Mus musculus
cactgatgcctgagtggatttctca

SEQ ID NO: 308835 - DNA, 25 bp, Mus musculus
cactgatgcctgtgtggatttctca

SEQ ID NO: 308836 - DNA, 25 bp, Mus musculus
cactgatggctcagtaggcagtact

SEQ ID NO: 308837 - DNA, 25 bp, Mus musculus
cactgatggctctgtaggcagtact

SEQ ID NO: 308838 - DNA, 25 bp, Mus musculus
cactgatgtgcaccgccttgtcatg

SEQ ID NO: 308839 - DNA, 25 bp, Mus musculus
cactgatgtgcagcgccttgtcatg

SEQ ID NO: 308840 - DNA, 25 bp, Mus musculus
cactgatgttcacgatgtgctttga

SEQ ID NO: 308841 - DNA, 25 bp, Mus musculus
cactgatgttcaggatgtgctttga

SEQ ID NO: 308842 - DNA, 25 bp, Mus musculus
cactgatgttctccttttatcaata

SEQ ID NO: 308843 - DNA, 25 bp, Mus musculus
cactgatgttctgcttttatcaata

SEQ ID NO: 308844 - DNA, 25 bp, Mus musculus
cactgattctgaaggactctcgaat

SEQ ID NO: 308845 - DNA, 25 bp, Mus musculus
cactgattctgatggactctcgaat

SEQ ID NO: 308846 - DNA, 25 bp, Mus musculus
cactgattctgtagtctgcctatat

SEQ ID NO: 308847 - DNA, 25 bp, Mus musculus
cactgattctgttgtctgcctatat

SEQ ID NO: 308848 - DNA, 25 bp, Mus musculus
cactgattgggcattgtgccctgaa

SEQ ID NO: 308849 - DNA, 25 bp, Mus musculus
cactgattgggctttgtgccctgaa

SEQ ID NO: 308850 - DNA, 25 bp, Mus musculus
cactgattgtgaatcctgtgggaca

SEQ ID NO: 308851 - DNA, 25 bp, Mus musculus
cactgattgtgattcctgtgggaca

SEQ ID NO: 308852 - DNA, 25 bp, Mus musculus
cactgattgtggacaaacctggcag

SEQ ID NO: 308853 - DNA, 25 bp, Mus musculus
cactgattgtggtcaaacctggcag

SEQ ID NO: 308854 - DNA, 25 bp, Mus musculus
cactgcacacgcagagaaatagaat

SEQ ID NO: 308855 - DNA, 25 bp, Mus musculus
cactgcacacgctgagaaatagaat

SEQ ID NO: 308856 - DNA, 25 bp, Mus musculus
cactgcacagcgcaggatgaccttg

SEQ ID NO: 308857 - DNA, 25 bp, Mus musculus
cactgcacagcggaggatgaccttg

SEQ ID NO: 308858 - DNA, 25 bp, Mus musculus
cactgcacatacaagctctgaggat

SEQ ID NO: 308859 - DNA, 25 bp, Mus musculus
cactgcacatactagctctgaggat

SEQ ID NO: 308860 - DNA, 25 bp, Mus musculus
cactgcaccagtattgcccaaaagt

SEQ ID NO: 308861 - DNA, 25 bp, Mus musculus
cactgcaccagttttgcccaaaagt

SEQ ID NO: 308862 - DNA, 25 bp, Mus musculus
cactgcaccttcaggattgtatcca

SEQ ID NO: 308863 - DNA, 25 bp, Mus musculus
cactgcaccttctggattgtatcca

SEQ ID NO: 308864 - DNA, 25 bp, Mus musculus
cactgcacgaccatgagagctttat

SEQ ID NO: 308865 - DNA, 25 bp, Mus musculus
cactgcacgaccttgagagctttat

SEQ ID NO: 308866 - DNA, 25 bp, Mus musculus
cactgcactgaccttagtggataat

SEQ ID NO: 308867 - DNA, 25 bp, Mus musculus
cactgcactgacgttagtggataat

SEQ ID NO: 308868 - DNA, 25 bp, Mus musculus
cactgcagagatctcactactccat

SEQ ID NO: 308869 - DNA, 25 bp, Mus musculus
cactgcagagatgtcactactccat

SEQ ID NO: 308870 - DNA, 25 bp, Mus musculus
cactgcagcctgaccacttgggaaa

SEQ ID NO: 308871 - DNA, 25 bp, Mus musculus
cactgcagcctgtccacttgggaaa

SEQ ID NO: 308872 - DNA, 25 bp, Mus musculus
cactgcagggtgatgctggatgttt

SEQ ID NO: 308873 - DNA, 25 bp, Mus musculus
cactgcagggtgttgctggatgttt

SEQ ID NO: 308874 - DNA, 25 bp, Mus musculus
cactgcagtgtgcatgggagtttct

SEQ ID NO: 308875 - DNA, 25 bp, Mus musculus
cactgcagtgtggatgggagtttct

SEQ ID NO: 308876 - DNA, 25 bp, Mus musculus
cactgcagtttcctaaccactttaa

SEQ ID NO: 308877 - DNA, 25 bp, Mus musculus
cactgcagtttcgtaaccactttaa

SEQ ID NO: 308878 - DNA, 25 bp, Mus musculus
cactgcatacttaggtgacctgatc

SEQ ID NO: 308879 - DNA, 25 bp, Mus musculus
cactgcatactttggtgacctgatc

SEQ ID NO: 308880 - DNA, 25 bp, Mus musculus
cactgcatgacaccaggcactcggt

SEQ ID NO: 308881 - DNA, 25 bp, Mus musculus
cactgcatgacagcaggcactcggt

SEQ ID NO: 308882 - DNA, 25 bp, Mus musculus
cactgcatgccgagattgtggagtt

SEQ ID NO: 308883 - DNA, 25 bp, Mus musculus
cactgcatgccgtgattgtggagtt

SEQ ID NO: 308884 - DNA, 25 bp, Mus musculus
cactgcatggagctcattcggctaa

SEQ ID NO: 308885 - DNA, 25 bp, Mus musculus
cactgcatggaggtcattcggctaa

SEQ ID NO: 308886 - DNA, 25 bp, Mus musculus
cactgcatgtttagaactagttgct

SEQ ID NO: 308887 - DNA, 25 bp, Mus musculus
cactgcatgttttgaactagttgct

SEQ ID NO: 308888 - DNA, 25 bp, Mus musculus
cactgccaaatgagttccttgaaga

SEQ ID NO: 308889 - DNA, 25 bp, Mus musculus
cactgccaaatgtgttccttgaaga

SEQ ID NO: 308890 - DNA, 25 bp, Mus musculus
cactgccacaccaatggagggtact

SEQ ID NO: 308891 - DNA, 25 bp, Mus musculus
cactgccacacctatggagggtact

SEQ ID NO: 308892 - DNA, 25 bp, Mus musculus
cactgccagggtcgtggatcttcag

SEQ ID NO: 308893 - DNA, 25 bp, Mus musculus
cactgccagggtggtggatcttcag

SEQ ID NO: 308894 - DNA, 25 bp, Mus musculus
cactgccaggtcagactggtgtttt

SEQ ID NO: 308895 - DNA, 25 bp, Mus musculus
cactgccaggtctgactggtgtttt

SEQ ID NO: 308896 - DNA, 25 bp, Mus musculus
cactgccagtggctcatctttaaca

SEQ ID NO: 308897 - DNA, 25 bp, Mus musculus
cactgccagtgggtcatctttaaca

SEQ ID NO: 308898 - DNA, 25 bp, Mus musculus
cactgccatatgatttgtagggaga

SEQ ID NO: 308899 - DNA, 25 bp, Mus musculus
cactgccatatgttttgtagggaga

SEQ ID NO: 308900 - DNA, 25 bp, Mus musculus
cactgccatccaaacttgttatatc

SEQ ID NO: 308901 - DNA, 25 bp, Mus musculus
cactgccatccatacttgttatatc

SEQ ID NO: 308902 - DNA, 25 bp, Mus musculus
cactgccatgtcatatctttatggg

SEQ ID NO: 308903 - DNA, 25 bp, Mus musculus
cactgccatgtcttatctttatggg

SEQ ID NO: 308904 - DNA, 25 bp, Mus musculus
cactgcccagctcgattttatattt

SEQ ID NO: 308905 - DNA, 25 bp, Mus musculus
cactgcccagctggattttatattt

SEQ ID NO: 308906 - DNA, 25 bp, Mus musculus
cactgcccggcaaggttacaatttt

SEQ ID NO: 308907 - DNA, 25 bp, Mus musculus
cactgcccggcatggttacaatttt

SEQ ID NO: 308908 - DNA, 25 bp, Mus musculus
cactgcccggctacaatatttatat

SEQ ID NO: 308909 - DNA, 25 bp, Mus musculus
cactgcccggctaggtaccatttca

SEQ ID NO: 308910 - DNA, 25 bp, Mus musculus
cactgcccggcttcaatatttatat

SEQ ID NO: 308911 - DNA, 25 bp, Mus musculus
cactgcccggcttggtaccatttca

SEQ ID NO: 308912 - DNA, 25 bp, Mus musculus
cactgcccgggaactttatgattgt

SEQ ID NO: 308913 - DNA, 25 bp, Mus musculus
cactgcccgggatctttatgattgt

SEQ ID NO: 308914 - DNA, 25 bp, Mus musculus
cactgccctgctagtggacactaat

SEQ ID NO: 308915 - DNA, 25 bp, Mus musculus
cactgccctgcttgtggacactaat

SEQ ID NO: 308916 - DNA, 25 bp, Mus musculus
cactgccctggcattttaaacatgg

SEQ ID NO: 308917 - DNA, 25 bp, Mus musculus
cactgccctggctttttaaacatgg

SEQ ID NO: 308918 - DNA, 25 bp, Mus musculus
cactgccctgttagtttgtcttggt

SEQ ID NO: 308919 - DNA, 25 bp, Mus musculus
cactgccctgtttgtttgtcttggt

SEQ ID NO: 308920 - DNA, 25 bp, Mus musculus
cactgccgaggcaatgatatgctac

SEQ ID NO: 308921 - DNA, 25 bp, Mus musculus
cactgccgaggctatgatatgctac

SEQ ID NO: 308922 - DNA, 25 bp, Mus musculus
cactgccgatggctccagatatgga

SEQ ID NO: 308923 - DNA, 25 bp, Mus musculus
cactgccgatgggtccagatatgga

SEQ ID NO: 308924 - DNA, 25 bp, Mus musculus
cactgccgctgtattggcaaggttg

SEQ ID NO: 308925 - DNA, 25 bp, Mus musculus
cactgccgctgttttggcaaggttg

SEQ ID NO: 308926 - DNA, 25 bp, Mus musculus
cactgccgtttcatagccattagaa

SEQ ID NO: 308927 - DNA, 25 bp, Mus musculus
cactgccgtttcttagccattagaa

SEQ ID NO: 308928 - DNA, 25 bp, Mus musculus
cactgcctaagtacccctttggagt

SEQ ID NO: 308929 - DNA, 25 bp, Mus musculus
cactgcctaagttcccctttggagt

SEQ ID NO: 308930 - DNA, 25 bp, Mus musculus
cactgcctactgattttcttggaga

SEQ ID NO: 308931 - DNA, 25 bp, Mus musculus
cactgcctactgtttttcttggaga

SEQ ID NO: 308932 - DNA, 25 bp, Mus musculus
cactgcctctatccgggtattctga

SEQ ID NO: 308933 - DNA, 25 bp, Mus musculus
cactgcctctatgcgggtattctga

SEQ ID NO: 308934 - DNA, 25 bp, Mus musculus
cactgcctctccagggtggcgggct

SEQ ID NO: 308935 - DNA, 25 bp, Mus musculus
cactgcctctcctgggtggcgggct

SEQ ID NO: 308936 - DNA, 25 bp, Mus musculus
cactgcctctctctaattgtggttg

SEQ ID NO: 308937 - DNA, 25 bp, Mus musculus
cactgcctctctgtaattgtggttg

SEQ ID NO: 308938 - DNA, 25 bp, Mus musculus
cactgcctcttgcttatgtcttgaa

SEQ ID NO: 308939 - DNA, 25 bp, Mus musculus
cactgcctcttggttatgtcttgaa

SEQ ID NO: 308940 - DNA, 25 bp, Mus musculus
cactgcctgactatggagtaccaag

SEQ ID NO: 308941 - DNA, 25 bp, Mus musculus
cactgcctgactttggagtaccaag

SEQ ID NO: 308942 - DNA, 25 bp, Mus musculus
cactgcctgcatctctggtttagat

SEQ ID NO: 308943 - DNA, 25 bp, Mus musculus
cactgcctgcatgtctggtttagat

SEQ ID NO: 308944 - DNA, 25 bp, Mus musculus
cactgcctgctgattttattgctta

SEQ ID NO: 308945 - DNA, 25 bp, Mus musculus
cactgcctgctgtttttattgctta

SEQ ID NO: 308946 - DNA, 25 bp, Mus musculus
cactgcctggaaaacacctgagagt

SEQ ID NO: 308947 - DNA, 25 bp, Mus musculus
cactgcctggaatacacctgagagt

SEQ ID NO: 308948 - DNA, 25 bp, Mus musculus
cactgcctgttcatgagcattggac

SEQ ID NO: 308949 - DNA, 25 bp, Mus musculus
cactgcctgttcttgagcattggac

SEQ ID NO: 308950 - DNA, 25 bp, Mus musculus
cactgcctgtttctccataggcaaa

SEQ ID NO: 308951 - DNA, 25 bp, Mus musculus
cactgcctgtttgtccataggcaaa

SEQ ID NO: 308952 - DNA, 25 bp, Mus musculus
cactgccttccgcatcaagaacaag

SEQ ID NO: 308953 - DNA, 25 bp, Mus musculus
cactgccttccggatcaagaacaag

SEQ ID NO: 308954 - DNA, 25 bp, Mus musculus
cactgccttgccatatattttcttc

SEQ ID NO: 308955 - DNA, 25 bp, Mus musculus
cactgccttgccttatattttcttc

SEQ ID NO: 308956 - DNA, 25 bp, Mus musculus
cactgcgaagctcgagataaaggta

SEQ ID NO: 308957 - DNA, 25 bp, Mus musculus
cactgcgaagctggagataaaggta

SEQ ID NO: 308958 - DNA, 25 bp, Mus musculus
cactgcgagcggctatcatgctgaa

SEQ ID NO: 308959 - DNA, 25 bp, Mus musculus
cactgcgagcgggtatcatgctgaa

SEQ ID NO: 308960 - DNA, 25 bp, Mus musculus
cactgcgtcagcagaggctgtgttt

SEQ ID NO: 308961 - DNA, 25 bp, Mus musculus
cactgcgtcagctgaggctgtgttt

SEQ ID NO: 308962 - DNA, 25 bp, Mus musculus
cactgcgtgccgagtgcaaggatgt

SEQ ID NO: 308963 - DNA, 25 bp, Mus musculus
cactgcgtgccgtgtgcaaggatgt

SEQ ID NO: 308964 - DNA, 25 bp, Mus musculus
cactgcgtgctacgtgtacaactaa

SEQ ID NO: 308965 - DNA, 25 bp, Mus musculus
cactgcgtgctaggtgtacaactaa

SEQ ID NO: 308966 - DNA, 25 bp, Mus musculus
cactgctaaaagatatttgcactat

SEQ ID NO: 308967 - DNA, 25 bp, Mus musculus
cactgctaaaagttatttgcactat

SEQ ID NO: 308968 - DNA, 25 bp, Mus musculus
cactgctaaagtccactgccaggtg

SEQ ID NO: 308969 - DNA, 25 bp, Mus musculus
cactgctaaagtgcactgccaggtg

SEQ ID NO: 308970 - DNA, 25 bp, Mus musculus
cactgctaacgacctacggctgtac

SEQ ID NO: 308971 - DNA, 25 bp, Mus musculus
cactgctaacgagctacggctgtac

SEQ ID NO: 308972 - DNA, 25 bp, Mus musculus
cactgctaatcaatccaagcttggg

SEQ ID NO: 308973 - DNA, 25 bp, Mus musculus
cactgctaatcattccaagcttggg

SEQ ID NO: 308974 - DNA, 25 bp, Mus musculus
cactgctacacacctaaacttcatg

SEQ ID NO: 308975 - DNA, 25 bp, Mus musculus
cactgctacacagctaaacttcatg

SEQ ID NO: 308976 - DNA, 25 bp, Mus musculus
cactgctaccctaatgaggccgtaa

SEQ ID NO: 308977 - DNA, 25 bp, Mus musculus
cactgctacccttatgaggccgtaa

SEQ ID NO: 308978 - DNA, 25 bp, Mus musculus
cactgctacttgcttcccacagttt

SEQ ID NO: 308979 - DNA, 25 bp, Mus musculus
cactgctacttggttcccacagttt

SEQ ID NO: 308980 - DNA, 25 bp, Mus musculus
cactgctagagcagagtccaactta

SEQ ID NO: 308981 - DNA, 25 bp, Mus musculus
cactgctagagctgagtccaactta

SEQ ID NO: 308982 - DNA, 25 bp, Mus musculus
cactgctcaaacattctgctactgg

SEQ ID NO: 308983 - DNA, 25 bp, Mus musculus
cactgctcaaactttctgctactgg

SEQ ID NO: 308984 - DNA, 25 bp, Mus musculus
cactgctcaacgctggaagagcaga

SEQ ID NO: 308985 - DNA, 25 bp, Mus musculus
cactgctcaacggtggaagagcaga

SEQ ID NO: 308986 - DNA, 25 bp, Mus musculus
cactgctcagtgctgatctgtgtaa

SEQ ID NO: 308987 - DNA, 25 bp, Mus musculus
cactgctcagtggtgatctgtgtaa

SEQ ID NO: 308988 - DNA, 25 bp, Mus musculus
cactgctccaggcatgcccttagag

SEQ ID NO: 308989 - DNA, 25 bp, Mus musculus
cactgctccagggatgcccttagag

SEQ ID NO: 308990 - DNA, 25 bp, Mus musculus
cactgctccataattgtccatttca

SEQ ID NO: 308991 - DNA, 25 bp, Mus musculus
cactgctccatatttgtccatttca

SEQ ID NO: 308992 - DNA, 25 bp, Mus musculus
cactgctccatcaggttttcataag

SEQ ID NO: 308993 - DNA, 25 bp, Mus musculus
cactgctccatctggttttcataag

SEQ ID NO: 308994 - DNA, 25 bp, Mus musculus
cactgctcccaacgtgacaggaact

SEQ ID NO: 308995 - DNA, 25 bp, Mus musculus
cactgctcccaaggtgacaggaact

SEQ ID NO: 308996 - DNA, 25 bp, Mus musculus
cactgctccccgaaaagatcaatag

SEQ ID NO: 308997 - DNA, 25 bp, Mus musculus
cactgctccccgtaaagatcaatag

SEQ ID NO: 308998 - DNA, 25 bp, Mus musculus
cactgctcctaccaaatgatgttac

SEQ ID NO: 308999 - DNA, 25 bp, Mus musculus
cactgctcctacgaaatgatgttac

SEQ ID NO: 309000 - DNA, 25 bp, Mus musculus
cactgctcgggtatgcagggagaac

SEQ ID NO: 309001 - DNA, 25 bp, Mus musculus
cactgctcgggtttgcagggagaac

SEQ ID NO: 309002 - DNA, 25 bp, Mus musculus
cactgctctgccatatgagtactgg

SEQ ID NO: 309003 - DNA, 25 bp, Mus musculus
cactgctctgccttatgagtactgg

SEQ ID NO: 309004 - DNA, 25 bp, Mus musculus
cactgctctgtgagtgatttcttca

SEQ ID NO: 309005 - DNA, 25 bp, Mus musculus
cactgctctgtgtgtgatttcttca

SEQ ID NO: 309006 - DNA, 25 bp, Mus musculus
cactgctcttttactctgagggttt

SEQ ID NO: 309007 - DNA, 25 bp, Mus musculus
cactgctctttttctctgagggttt

SEQ ID NO: 309008 - DNA, 25 bp, Mus musculus
cactgctgacagatgggacgatgag

SEQ ID NO: 309009 - DNA, 25 bp, Mus musculus
cactgctgacagttgggacgatgag

SEQ ID NO: 309010 - DNA, 25 bp, Mus musculus
cactgctgcttgctacttggcaaat

SEQ ID NO: 309011 - DNA, 25 bp, Mus musculus
cactgctgcttggtacttggcaaat

SEQ ID NO: 309012 - DNA, 25 bp, Mus musculus
cactgctgctttcaggacttgcatt

SEQ ID NO: 309013 - DNA, 25 bp, Mus musculus
cactgctgctttgaggacttgcatt

SEQ ID NO: 309014 - DNA, 25 bp, Mus musculus
cactgctggagaccctgagccgtga

SEQ ID NO: 309015 - DNA, 25 bp, Mus musculus
cactgctggagagcctgagccgtga

SEQ ID NO: 309016 - DNA, 25 bp, Mus musculus
cactgctggtagcattgcaagctgg

SEQ ID NO: 309017 - DNA, 25 bp, Mus musculus
cactgctggtaggattgcaagctgg

SEQ ID NO: 309018 - DNA, 25 bp, Mus musculus
cactgctgtataaaagccccatctt

SEQ ID NO: 309019 - DNA, 25 bp, Mus musculus
cactgctgtatataagccccatctt

SEQ ID NO: 309020 - DNA, 25 bp, Mus musculus
cactgctgtatgatgtaggttctgc

SEQ ID NO: 309021 - DNA, 25 bp, Mus musculus
cactgctgtatgttgtaggttctgc

SEQ ID NO: 309022 - DNA, 25 bp, Mus musculus
cactgctgtattccagatgctgccc

SEQ ID NO: 309023 - DNA, 25 bp, Mus musculus
cactgctgtattgcagatgctgccc

SEQ ID NO: 309024 - DNA, 25 bp, Mus musculus
cactgctgtctacccaaaacatcag

SEQ ID NO: 309025 - DNA, 25 bp, Mus musculus
cactgctgtctagccaaaacatcag

SEQ ID NO: 309026 - DNA, 25 bp, Mus musculus
cactgctgtgcacggagctacaacg

SEQ ID NO: 309027 - DNA, 25 bp, Mus musculus
cactgctgtgcagggagctacaacg

SEQ ID NO: 309028 - DNA, 25 bp, Mus musculus
cactgctgtgccaatgattcaaacc

SEQ ID NO: 309029 - DNA, 25 bp, Mus musculus
cactgctgtgcctatgattcaaacc

SEQ ID NO: 309030 - DNA, 25 bp, Mus musculus
cactgctgtggaatcgaggtatgac

SEQ ID NO: 309031 - DNA, 25 bp, Mus musculus
cactgctgtggattcgaggtatgac

SEQ ID NO: 309032 - DNA, 25 bp, Mus musculus
cactgctgtgtcaactaaactcata

SEQ ID NO: 309033 - DNA, 25 bp, Mus musculus
cactgctgtgtctactaaactcata

SEQ ID NO: 309034 - DNA, 25 bp, Mus musculus
cactgctgttcactgtcctatagaa

SEQ ID NO: 309035 - DNA, 25 bp, Mus musculus
cactgctgttcagtgtcctatagaa

SEQ ID NO: 309036 - DNA, 25 bp, Mus musculus
cactgctgttgcattgctaaatgga

SEQ ID NO: 309037 - DNA, 25 bp, Mus musculus
cactgctgttgctttgctaaatgga

SEQ ID NO: 309038 - DNA, 25 bp, Mus musculus
cactgctgtttacatgggcatttta

SEQ ID NO: 309039 - DNA, 25 bp, Mus musculus
cactgctgtttagatgggcatttta

SEQ ID NO: 309040 - DNA, 25 bp, Mus musculus
cactgctgtttcacacatacaggta

SEQ ID NO: 309041 - DNA, 25 bp, Mus musculus
cactgctgtttctcacatacaggta

SEQ ID NO: 309042 - DNA, 25 bp, Mus musculus
cactgcttagatacttttagagttg

SEQ ID NO: 309043 - DNA, 25 bp, Mus musculus
cactgcttagattcttttagagttg

SEQ ID NO: 309044 - DNA, 25 bp, Mus musculus
cactgcttcccaagctaacattcag

SEQ ID NO: 309045 - DNA, 25 bp, Mus musculus
cactgcttcccatgctaacattcag

SEQ ID NO: 309046 - DNA, 25 bp, Mus musculus
cactgcttccttagtgatggaatta

SEQ ID NO: 309047 - DNA, 25 bp, Mus musculus
cactgcttcctttgtgatggaatta

SEQ ID NO: 309048 - DNA, 25 bp, Mus musculus
cactgcttctagatgtgcctgggca

SEQ ID NO: 309049 - DNA, 25 bp, Mus musculus
cactgcttctagttgtgcctgggca

SEQ ID NO: 309050 - DNA, 25 bp, Mus musculus
cactgcttgagaagttgaccgctaa

SEQ ID NO: 309051 - DNA, 25 bp, Mus musculus
cactgcttgagatgttgaccgctaa

SEQ ID NO: 309052 - DNA, 25 bp, Mus musculus
cactgcttgcatatgtactgtaaac

SEQ ID NO: 309053 - DNA, 25 bp, Mus musculus
cactgcttgcatttgtactgtaaac

SEQ ID NO: 309054 - DNA, 25 bp, Mus musculus
cactgcttgcttcagagaaactttc

SEQ ID NO: 309055 - DNA, 25 bp, Mus musculus
cactgcttgcttgagagaaactttc

SEQ ID NO: 309056 - DNA, 25 bp, Mus musculus
cactgcttggaaacatgattgtagt

SEQ ID NO: 309057 - DNA, 25 bp, Mus musculus
cactgcttggaatcatgattgtagt

SEQ ID NO: 309058 - DNA, 25 bp, Mus musculus
cactgcttggtaagctgaggcagga

SEQ ID NO: 309059 - DNA, 25 bp, Mus musculus
cactgcttggtatgctgaggcagga

SEQ ID NO: 309060 - DNA, 25 bp, Mus musculus
cactgctttctaactggtggacaga

SEQ ID NO: 309061 - DNA, 25 bp, Mus musculus
cactgctttctatctggtggacaga

SEQ ID NO: 309062 - DNA, 25 bp, Mus musculus
cactgcttttgaatctgtttgtact

SEQ ID NO: 309063 - DNA, 25 bp, Mus musculus
cactgcttttgattctgtttgtact

SEQ ID NO: 309064 - DNA, 25 bp, Mus musculus
cactgctttttacctcccggccttg

SEQ ID NO: 309065 - DNA, 25 bp, Mus musculus
cactgctttttagctcccggccttg

SEQ ID NO: 309066 - DNA, 25 bp, Mus musculus
cactggaaaagcaagattctaattt

SEQ ID NO: 309067 - DNA, 25 bp, Mus musculus
cactggaaaagctagattctaattt

SEQ ID NO: 309068 - DNA, 25 bp, Mus musculus
cactggaaagtgctgtaatgacaat

SEQ ID NO: 309069 - DNA, 25 bp, Mus musculus
cactggaaagtggtgtaatgacaat

SEQ ID NO: 309070 - DNA, 25 bp, Mus musculus
cactggaacactaatcagctgataa

SEQ ID NO: 309071 - DNA, 25 bp, Mus musculus
cactggaacacttatcagctgataa

SEQ ID NO: 309072 - DNA, 25 bp, Mus musculus
cactggaacgccacttgggtaacaa

SEQ ID NO: 309073 - DNA, 25 bp, Mus musculus
cactggaacgcctcttgggtaacaa

SEQ ID NO: 309074 - DNA, 25 bp, Mus musculus
cactggaagcatattgtctgaatga

SEQ ID NO: 309075 - DNA, 25 bp, Mus musculus
cactggaagcattttgtctgaatga

SEQ ID NO: 309076 - DNA, 25 bp, Mus musculus
cactggaaggagattgtagagattt

SEQ ID NO: 309077 - DNA, 25 bp, Mus musculus
cactggaaggagtttgtagagattt

SEQ ID NO: 309078 - DNA, 25 bp, Mus musculus
cactggaagggcacgcttggctcag

SEQ ID NO: 309079 - DNA, 25 bp, Mus musculus
cactggaagggctcgcttggctcag

SEQ ID NO: 309080 - DNA, 25 bp, Mus musculus
cactggaaggtgcattaggctgtca

SEQ ID NO: 309081 - DNA, 25 bp, Mus musculus
cactggaaggtggattaggctgtca

SEQ ID NO: 309082 - DNA, 25 bp, Mus musculus
cactggaatcacctgccattgaagt

SEQ ID NO: 309083 - DNA, 25 bp, Mus musculus
cactggaatcacgtgccattgaagt

SEQ ID NO: 309084 - DNA, 25 bp, Mus musculus
cactggaatgttcggtctgggttct

SEQ ID NO: 309085 - DNA, 25 bp, Mus musculus
cactggaatgttgggtctgggttct

SEQ ID NO: 309086 - DNA, 25 bp, Mus musculus
cactggacaagcacctgcggcagaa

SEQ ID NO: 309087 - DNA, 25 bp, Mus musculus
cactggacaagctcctgcggcagaa

SEQ ID NO: 309088 - DNA, 25 bp, Mus musculus
cactggacacacagctttttatcca

SEQ ID NO: 309089 - DNA, 25 bp, Mus musculus
cactggacacactgctttttatcca

SEQ ID NO: 309090 - DNA, 25 bp, Mus musculus
cactggacacttactgagcaacaaa

SEQ ID NO: 309091 - DNA, 25 bp, Mus musculus
cactggacactttctgagcaacaaa

SEQ ID NO: 309092 - DNA, 25 bp, Mus musculus
cactggacatgcaggctttgtgtaa

SEQ ID NO: 309093 - DNA, 25 bp, Mus musculus
cactggacatgctggctttgtgtaa

SEQ ID NO: 309094 - DNA, 25 bp, Mus musculus
cactggactctacggactgggatca

SEQ ID NO: 309095 - DNA, 25 bp, Mus musculus
cactggactctagggactgggatca

SEQ ID NO: 309096 - DNA, 25 bp, Mus musculus
cactggactgacatcactggtacca

SEQ ID NO: 309097 - DNA, 25 bp, Mus musculus
cactggactgacttcactggtacca

SEQ ID NO: 309098 - DNA, 25 bp, Mus musculus
cactggactgagagccctggagact

SEQ ID NO: 309099 - DNA, 25 bp, Mus musculus
cactggactgagtgccctggagact

SEQ ID NO: 309100 - DNA, 25 bp, Mus musculus
cactggactgtcctgatgaccgaag

SEQ ID NO: 309101 - DNA, 25 bp, Mus musculus
cactggactgtcgtgatgaccgaag

SEQ ID NO: 309102 - DNA, 25 bp, Mus musculus
cactggacttcaacttccacagaaa

SEQ ID NO: 309103 - DNA, 25 bp, Mus musculus
cactggacttcatcttccacagaaa

SEQ ID NO: 309104 - DNA, 25 bp, Mus musculus
cactggacttggaggacatctttaa

SEQ ID NO: 309105 - DNA, 25 bp, Mus musculus
cactggacttggtggacatctttaa

SEQ ID NO: 309106 - DNA, 25 bp, Mus musculus
cactggagaaaaaagtcccctctat

SEQ ID NO: 309107 - DNA, 25 bp, Mus musculus
cactggagaaaatagtcccctctat

SEQ ID NO: 309108 - DNA, 25 bp, Mus musculus
cactggagaagtctgggtccgcttt

SEQ ID NO: 309109 - DNA, 25 bp, Mus musculus
cactggagaagtgtgggtccgcttt

SEQ ID NO: 309110 - DNA, 25 bp, Mus musculus
cactggagacttctagcattcattt

SEQ ID NO: 309111 - DNA, 25 bp, Mus musculus
cactggagacttgtagcattcattt

SEQ ID NO: 309112 - DNA, 25 bp, Mus musculus
cactggagagttcttattcccgcat

SEQ ID NO: 309113 - DNA, 25 bp, Mus musculus
cactggagagttcttccgagaccaa

SEQ ID NO: 309114 - DNA, 25 bp, Mus musculus
cactggagagttgttattcccgcat

SEQ ID NO: 309115 - DNA, 25 bp, Mus musculus
cactggagagttgttccgagaccaa

SEQ ID NO: 309116 - DNA, 25 bp, Mus musculus
cactggagatgcaaccgttctattt

SEQ ID NO: 309117 - DNA, 25 bp, Mus musculus
cactggagatgctaccgttctattt

SEQ ID NO: 309118 - DNA, 25 bp, Mus musculus
cactggagatggcacctaagaaagc

SEQ ID NO: 309119 - DNA, 25 bp, Mus musculus
cactggagatgggacctaagaaagc

SEQ ID NO: 309120 - DNA, 25 bp, Mus musculus
cactggagcaatcggcagcctggct

SEQ ID NO: 309121 - DNA, 25 bp, Mus musculus
cactggagcaatgggcagcctggct

SEQ ID NO: 309122 - DNA, 25 bp, Mus musculus
cactggagcatgctagagttttgac

SEQ ID NO: 309123 - DNA, 25 bp, Mus musculus
cactggagcatggtagagttttgac

SEQ ID NO: 309124 - DNA, 25 bp, Mus musculus
cactggagcggacggcaaaagtaat

SEQ ID NO: 309125 - DNA, 25 bp, Mus musculus
cactggagcggagggcaaaagtaat

SEQ ID NO: 309126 - DNA, 25 bp, Mus musculus
cactggagctcgatgagctggctgc

SEQ ID NO: 309127 - DNA, 25 bp, Mus musculus
cactggagctcgttgagctggctgc

SEQ ID NO: 309128 - DNA, 25 bp, Mus musculus
cactggataaccattgagagcctta

SEQ ID NO: 309129 - DNA, 25 bp, Mus musculus
cactggataacctttgagagcctta

SEQ ID NO: 309130 - DNA, 25 bp, Mus musculus
cactggatactgaccgacaacggat

SEQ ID NO: 309131 - DNA, 25 bp, Mus musculus
cactggatactgtccgacaacggat

SEQ ID NO: 309132 - DNA, 25 bp, Mus musculus
cactggatatgaatacgaccctctc

SEQ ID NO: 309133 - DNA, 25 bp, Mus musculus
cactggatatgattacgaccctctc

SEQ ID NO: 309134 - DNA, 25 bp, Mus musculus
cactggatcaccatactgtacaaat

SEQ ID NO: 309135 - DNA, 25 bp, Mus musculus
cactggatcaccttactgtacaaat

SEQ ID NO: 309136 - DNA, 25 bp, Mus musculus
cactggatcgcaacctggtggaaac

SEQ ID NO: 309137 - DNA, 25 bp, Mus musculus
cactggatcgcatcctggtggaaac

SEQ ID NO: 309138 - DNA, 25 bp, Mus musculus
cactggatcgtgacttcatgacttt

SEQ ID NO: 309139 - DNA, 25 bp, Mus musculus
cactggatcgtgtcttcatgacttt

SEQ ID NO: 309140 - DNA, 25 bp, Mus musculus
cactggatctatctaaatgccgatt

SEQ ID NO: 309141 - DNA, 25 bp, Mus musculus
cactggatctatgtaaatgccgatt

SEQ ID NO: 309142 - DNA, 25 bp, Mus musculus
cactggatctgtcaaacccattaaa

SEQ ID NO: 309143 - DNA, 25 bp, Mus musculus
cactggatctgtgaaacccattaaa

SEQ ID NO: 309144 - DNA, 25 bp, Mus musculus
cactggatcttgcagttggttgcct

SEQ ID NO: 309145 - DNA, 25 bp, Mus musculus
cactggatcttggagttggttgcct

SEQ ID NO: 309146 - DNA, 25 bp, Mus musculus
cactggatgcagctgtatagtttta

SEQ ID NO: 309147 - DNA, 25 bp, Mus musculus
cactggatgcaggtgtatagtttta

SEQ ID NO: 309148 - DNA, 25 bp, Mus musculus
cactggatgctcagtttgggatgat

SEQ ID NO: 309149 - DNA, 25 bp, Mus musculus
cactggatgctctgtttgggatgat

SEQ ID NO: 309150 - DNA, 25 bp, Mus musculus
cactggatggtgacttgctttgttt

SEQ ID NO: 309151 - DNA, 25 bp, Mus musculus
cactggatggtgtcttgctttgttt

SEQ ID NO: 309152 - DNA, 25 bp, Mus musculus
cactggattctgacttggtattttt

SEQ ID NO: 309153 - DNA, 25 bp, Mus musculus
cactggattctgctaactctatggg

SEQ ID NO: 309154 - DNA, 25 bp, Mus musculus
cactggattctggtaactctatggg

SEQ ID NO: 309155 - DNA, 25 bp, Mus musculus
cactggattctgtcttggtattttt

SEQ ID NO: 309156 - DNA, 25 bp, Mus musculus
cactggcaaatcatgcattggatgt

SEQ ID NO: 309157 - DNA, 25 bp, Mus musculus
cactggcaaatcttgcattggatgt

SEQ ID NO: 309158 - DNA, 25 bp, Mus musculus
cactggcaattgattctgaaggctc

SEQ ID NO: 309159 - DNA, 25 bp, Mus musculus
cactggcaattgtttctgaaggctc

SEQ ID NO: 309160 - DNA, 25 bp, Mus musculus
cactggcacagcagatcaagatcaa

SEQ ID NO: 309161 - DNA, 25 bp, Mus musculus
cactggcacagctgatcaagatcaa

SEQ ID NO: 309162 - DNA, 25 bp, Mus musculus
cactggcactccatggtggaggtaa

SEQ ID NO: 309163 - DNA, 25 bp, Mus musculus
cactggcactccttggtggaggtaa

SEQ ID NO: 309164 - DNA, 25 bp, Mus musculus
cactggcagatcatggatgggaatc

SEQ ID NO: 309165 - DNA, 25 bp, Mus musculus
cactggcagatcttggatgggaatc

SEQ ID NO: 309166 - DNA, 25 bp, Mus musculus
cactggcagctcactactgtctata

SEQ ID NO: 309167 - DNA, 25 bp, Mus musculus
cactggcagctctctactgtctata

SEQ ID NO: 309168 - DNA, 25 bp, Mus musculus
cactggcatagacaggtgcagcagc

SEQ ID NO: 309169 - DNA, 25 bp, Mus musculus
cactggcatagagaggtgcagcagc

SEQ ID NO: 309170 - DNA, 25 bp, Mus musculus
cactggcatctccaggttttttgta

SEQ ID NO: 309171 - DNA, 25 bp, Mus musculus
cactggcatctcgaggttttttgta

SEQ ID NO: 309172 - DNA, 25 bp, Mus musculus
cactggcatgctcttgaacaccaag

SEQ ID NO: 309173 - DNA, 25 bp, Mus musculus
cactggcatgctgttgaacaccaag

SEQ ID NO: 309174 - DNA, 25 bp, Mus musculus
cactggccacagcagcagtttggat

SEQ ID NO: 309175 - DNA, 25 bp, Mus musculus
cactggccacaggagcagtttggat

SEQ ID NO: 309176 - DNA, 25 bp, Mus musculus
cactggcctagcctgaacctagatc

SEQ ID NO: 309177 - DNA, 25 bp, Mus musculus
cactggcctagcgtgaacctagatc

SEQ ID NO: 309178 - DNA, 25 bp, Mus musculus
cactggccttgaccatgaatcctga

SEQ ID NO: 309179 - DNA, 25 bp, Mus musculus
cactggccttgagcatgaatcctga

SEQ ID NO: 309180 - DNA, 25 bp, Mus musculus
cactggcgccgtcttataatttaga

SEQ ID NO: 309181 - DNA, 25 bp, Mus musculus
cactggcgccgtgttataatttaga

SEQ ID NO: 309182 - DNA, 25 bp, Mus musculus
cactggcggccaaacagagaactct

SEQ ID NO: 309183 - DNA, 25 bp, Mus musculus
cactggcggccatacagagaactct

SEQ ID NO: 309184 - DNA, 25 bp, Mus musculus
cactggcgtaagaaatggcgagcat

SEQ ID NO: 309185 - DNA, 25 bp, Mus musculus
cactggcgtaagtaatggcgagcat

SEQ ID NO: 309186 - DNA, 25 bp, Mus musculus
cactggctaccaagataaccctgat

SEQ ID NO: 309187 - DNA, 25 bp, Mus musculus
cactggctaccatgataaccctgat

SEQ ID NO: 309188 - DNA, 25 bp, Mus musculus
cactggctagacatggcaatggaga

SEQ ID NO: 309189 - DNA, 25 bp, Mus musculus
cactggctagacttggcaatggaga

SEQ ID NO: 309190 - DNA, 25 bp, Mus musculus
cactggctagtgcttgacttgggaa

SEQ ID NO: 309191 - DNA, 25 bp, Mus musculus
cactggctagtggttgacttgggaa

SEQ ID NO: 309192 - DNA, 25 bp, Mus musculus
cactggctctttctgtgatcaggga

SEQ ID NO: 309193 - DNA, 25 bp, Mus musculus
cactggctctttgtgtgatcaggga

SEQ ID NO: 309194 - DNA, 25 bp, Mus musculus
cactggctgacaacactttgtatta

SEQ ID NO: 309195 - DNA, 25 bp, Mus musculus
cactggctgacatcactttgtatta

SEQ ID NO: 309196 - DNA, 25 bp, Mus musculus
cactggctgactagggtcttattta

SEQ ID NO: 309197 - DNA, 25 bp, Mus musculus
cactggctgacttgggtcttattta

SEQ ID NO: 309198 - DNA, 25 bp, Mus musculus
cactggctgctgagagtatctgcgt

SEQ ID NO: 309199 - DNA, 25 bp, Mus musculus
cactggctgctgtgagtatctgcgt

SEQ ID NO: 309200 - DNA, 25 bp, Mus musculus
cactggcttagcataggatgagtca

SEQ ID NO: 309201 - DNA, 25 bp, Mus musculus
cactggcttagcttaggatgagtca

SEQ ID NO: 309202 - DNA, 25 bp, Mus musculus
cactggcttccaacctaagaatgag

SEQ ID NO: 309203 - DNA, 25 bp, Mus musculus
cactggcttccatcctaagaatgag

SEQ ID NO: 309204 - DNA, 25 bp, Mus musculus
cactggcttgggaaccggacttgga

SEQ ID NO: 309205 - DNA, 25 bp, Mus musculus
cactggcttgggtaccggacttgga

SEQ ID NO: 309206 - DNA, 25 bp, Mus musculus
cactggctttctcctatctatgaaa

SEQ ID NO: 309207 - DNA, 25 bp, Mus musculus
cactggctttctgctatctatgaaa

SEQ ID NO: 309208 - DNA, 25 bp, Mus musculus
cactggcttttcaaacactgtcaat

SEQ ID NO: 309209 - DNA, 25 bp, Mus musculus
cactggcttttctaacactgtcaat

SEQ ID NO: 309210 - DNA, 25 bp, Mus musculus
cactggcttttgacacgtggaaaga

SEQ ID NO: 309211 - DNA, 25 bp, Mus musculus
cactggcttttgtcacgtggaaaga

SEQ ID NO: 309212 - DNA, 25 bp, Mus musculus
cactggctttttctgtagatgactg

SEQ ID NO: 309213 - DNA, 25 bp, Mus musculus
cactggctttttgtgtagatgactg

SEQ ID NO: 309214 - DNA, 25 bp, Mus musculus
cactgggaaataatgcaactcttgc

SEQ ID NO: 309215 - DNA, 25 bp, Mus musculus
cactgggaaatattgcaactcttgc

SEQ ID NO: 309216 - DNA, 25 bp, Mus musculus
cactgggaacctctgtatggtgact

SEQ ID NO: 309217 - DNA, 25 bp, Mus musculus
cactgggaacctgtgtatggtgact

SEQ ID NO: 309218 - DNA, 25 bp, Mus musculus
cactgggaaggaacaggagccatca

SEQ ID NO: 309219 - DNA, 25 bp, Mus musculus
cactgggaaggatcaggagccatca

SEQ ID NO: 309220 - DNA, 25 bp, Mus musculus
cactgggaattcacggtgctatagc

SEQ ID NO: 309221 - DNA, 25 bp, Mus musculus
cactgggaattctcggtgctatagc

SEQ ID NO: 309222 - DNA, 25 bp, Mus musculus
cactgggacaagaattctgaggtca

SEQ ID NO: 309223 - DNA, 25 bp, Mus musculus
cactgggacaagtattctgaggtca

SEQ ID NO: 309224 - DNA, 25 bp, Mus musculus
cactgggacaggcattgcagctgcc

SEQ ID NO: 309225 - DNA, 25 bp, Mus musculus
cactgggacagggattgcagctgcc

SEQ ID NO: 309226 - DNA, 25 bp, Mus musculus
cactgggacatacaacttagcgtat

SEQ ID NO: 309227 - DNA, 25 bp, Mus musculus
cactgggacatagaacttagcgtat

SEQ ID NO: 309228 - DNA, 25 bp, Mus musculus
cactgggactcaattgtggagacgg

SEQ ID NO: 309229 - DNA, 25 bp, Mus musculus
cactgggactcatttgtggagacgg

SEQ ID NO: 309230 - DNA, 25 bp, Mus musculus
cactgggagcacagctcagaggatt

SEQ ID NO: 309231 - DNA, 25 bp, Mus musculus
cactgggagcactgctcagaggatt

SEQ ID NO: 309232 - DNA, 25 bp, Mus musculus
cactgggagcgcacctgggtaagcc

SEQ ID NO: 309233 - DNA, 25 bp, Mus musculus
cactgggagcgctcctgggtaagcc

SEQ ID NO: 309234 - DNA, 25 bp, Mus musculus
cactgggagtgtacttcgcaggtct

SEQ ID NO: 309235 - DNA, 25 bp, Mus musculus
cactgggagtgttcttcgcaggtct

SEQ ID NO: 309236 - DNA, 25 bp, Mus musculus
cactgggatcttcaacacctatggt

SEQ ID NO: 309237 - DNA, 25 bp, Mus musculus
cactgggatcttgaacacctatggt

SEQ ID NO: 309238 - DNA, 25 bp, Mus musculus
cactgggatgatagacacgttggag

SEQ ID NO: 309239 - DNA, 25 bp, Mus musculus
cactgggatgattgacacgttggag

SEQ ID NO: 309240 - DNA, 25 bp, Mus musculus
cactgggatgtcagcgatcctcaga

SEQ ID NO: 309241 - DNA, 25 bp, Mus musculus
cactgggatgtctgcgatcctcaga

SEQ ID NO: 309242 - DNA, 25 bp, Mus musculus
cactgggattcgcagctgggtcatc

SEQ ID NO: 309243 - DNA, 25 bp, Mus musculus
cactgggattcggagctgggtcatc

SEQ ID NO: 309244 - DNA, 25 bp, Mus musculus
cactgggattctaaaaggttcttca

SEQ ID NO: 309245 - DNA, 25 bp, Mus musculus
cactgggattcttaaaggttcttca

SEQ ID NO: 309246 - DNA, 25 bp, Mus musculus
cactgggcagtactggtcggttttt

SEQ ID NO: 309247 - DNA, 25 bp, Mus musculus
cactgggcagtagtggtcggttttt

SEQ ID NO: 309248 - DNA, 25 bp, Mus musculus
cactgggcatagctgtgacctatac

SEQ ID NO: 309249 - DNA, 25 bp, Mus musculus
cactgggcataggtgtgacctatac

SEQ ID NO: 309250 - DNA, 25 bp, Mus musculus
cactgggccagtctttggtttattt

SEQ ID NO: 309251 - DNA, 25 bp, Mus musculus
cactgggccagtgtttggtttattt

SEQ ID NO: 309252 - DNA, 25 bp, Mus musculus
cactgggcgtgcagatctatgagat

SEQ ID NO: 309253 - DNA, 25 bp, Mus musculus
cactgggcgtgctgatctatgagat

SEQ ID NO: 309254 - DNA, 25 bp, Mus musculus
cactgggctgacaagggttcctatg

SEQ ID NO: 309255 - DNA, 25 bp, Mus musculus
cactgggctgactagggttcctatg

SEQ ID NO: 309256 - DNA, 25 bp, Mus musculus
cactgggctgcactgtattttaata

SEQ ID NO: 309257 - DNA, 25 bp, Mus musculus
cactgggctgcagtgtattttaata

SEQ ID NO: 309258 - DNA, 25 bp, Mus musculus
cactgggcttccaaccactggagag

SEQ ID NO: 309259 - DNA, 25 bp, Mus musculus
cactgggcttcctaccactggagag

SEQ ID NO: 309260 - DNA, 25 bp, Mus musculus
cactgggctttgcagtacaataaag

SEQ ID NO: 309261 - DNA, 25 bp, Mus musculus
cactgggctttggagtacaataaag

SEQ ID NO: 309262 - DNA, 25 bp, Mus musculus
cactggggggaactcattatctata

SEQ ID NO: 309263 - DNA, 25 bp, Mus musculus
cactggggggaagtcattatctata

SEQ ID NO: 309264 - DNA, 25 bp, Mus musculus
cactgggtataaactatttttctag

SEQ ID NO: 309265 - DNA, 25 bp, Mus musculus
cactgggtataatctatttttctag

SEQ ID NO: 309266 - DNA, 25 bp, Mus musculus
cactgggtatttcctgaggtccaca

SEQ ID NO: 309267 - DNA, 25 bp, Mus musculus
cactgggtatttgctgaggtccaca

SEQ ID NO: 309268 - DNA, 25 bp, Mus musculus
cactgggtccaaagagggcggacat

SEQ ID NO: 309269 - DNA, 25 bp, Mus musculus
cactgggtccaatgagggcggacat

SEQ ID NO: 309270 - DNA, 25 bp, Mus musculus
cactgggtcgccaaattatctatga

SEQ ID NO: 309271 - DNA, 25 bp, Mus musculus
cactgggtcgcctaattatctatga

SEQ ID NO: 309272 - DNA, 25 bp, Mus musculus
cactgggtgaacatgcgattgcttt

SEQ ID NO: 309273 - DNA, 25 bp, Mus musculus
cactgggtgaacttgcgattgcttt

SEQ ID NO: 309274 - DNA, 25 bp, Mus musculus
cactgggtgatcacagtagcgttca

SEQ ID NO: 309275 - DNA, 25 bp, Mus musculus
cactgggtgatctcagtagcgttca

SEQ ID NO: 309276 - DNA, 25 bp, Mus musculus
cactgggtgggtctgaactgcaaaa

SEQ ID NO: 309277 - DNA, 25 bp, Mus musculus
cactgggtgggtgtgaactgcaaaa

SEQ ID NO: 309278 - DNA, 25 bp, Mus musculus
cactgggttcggcatgttactgtat

SEQ ID NO: 309279 - DNA, 25 bp, Mus musculus
cactgggttcgggatgttactgtat

SEQ ID NO: 309280 - DNA, 25 bp, Mus musculus
cactgggttcttccggttcgatgaa

SEQ ID NO: 309281 - DNA, 25 bp, Mus musculus
cactgggttcttgcggttcgatgaa

SEQ ID NO: 309282 - DNA, 25 bp, Mus musculus
cactgggttgcaatggtttgtcctt

SEQ ID NO: 309283 - DNA, 25 bp, Mus musculus
cactgggttgcattggtttgtcctt

SEQ ID NO: 309284 - DNA, 25 bp, Mus musculus
cactgggttgctatcaggtaggata

SEQ ID NO: 309285 - DNA, 25 bp, Mus musculus
cactgggttgctttcaggtaggata

SEQ ID NO: 309286 - DNA, 25 bp, Mus musculus
cactgggttttcctcttgtggttgc

SEQ ID NO: 309287 - DNA, 25 bp, Mus musculus
cactgggttttcgtcttgtggttgc

SEQ ID NO: 309288 - DNA, 25 bp, Mus musculus
cactggtactcacccttgttggtga

SEQ ID NO: 309289 - DNA, 25 bp, Mus musculus
cactggtactcagccttgttggtga

SEQ ID NO: 309290 - DNA, 25 bp, Mus musculus
cactggtactgaaattcctcttgag

SEQ ID NO: 309291 - DNA, 25 bp, Mus musculus
cactggtactgatattcctcttgag

SEQ ID NO: 309292 - DNA, 25 bp, Mus musculus
cactggtagctaagtgtttgcacac

SEQ ID NO: 309293 - DNA, 25 bp, Mus musculus
cactggtagctatgtgtttgcacac

SEQ ID NO: 309294 - DNA, 25 bp, Mus musculus
cactggtagcttagcatacactgct

SEQ ID NO: 309295 - DNA, 25 bp, Mus musculus
cactggtagctttgcatacactgct

SEQ ID NO: 309296 - DNA, 25 bp, Mus musculus
cactggtatctcattattgcttatg

SEQ ID NO: 309297 - DNA, 25 bp, Mus musculus
cactggtatctctttattgcttatg

SEQ ID NO: 309298 - DNA, 25 bp, Mus musculus
cactggtatctgatatcagaggata

SEQ ID NO: 309299 - DNA, 25 bp, Mus musculus
cactggtatctgttatcagaggata

SEQ ID NO: 309300 - DNA, 25 bp, Mus musculus
cactggtattagcactgacatcttt

SEQ ID NO: 309301 - DNA, 25 bp, Mus musculus
cactggtattaggactgacatcttt

SEQ ID NO: 309302 - DNA, 25 bp, Mus musculus
cactggtctaggacagaggttctca

SEQ ID NO: 309303 - DNA, 25 bp, Mus musculus
cactggtctaggtcagaggttctca

SEQ ID NO: 309304 - DNA, 25 bp, Mus musculus
cactggtgactacctatttgagccc

SEQ ID NO: 309305 - DNA, 25 bp, Mus musculus
cactggtgactagctatttgagccc

SEQ ID NO: 309306 - DNA, 25 bp, Mus musculus
cactggtgatctcaatctcattccc

SEQ ID NO: 309307 - DNA, 25 bp, Mus musculus
cactggtgatctgaatctcattccc

SEQ ID NO: 309308 - DNA, 25 bp, Mus musculus
cactggtgcccacctttgaggtttt

SEQ ID NO: 309309 - DNA, 25 bp, Mus musculus
cactggtgcccagctttgaggtttt

SEQ ID NO: 309310 - DNA, 25 bp, Mus musculus
cactggtgcctgatgtatgaataga

SEQ ID NO: 309311 - DNA, 25 bp, Mus musculus
cactggtgcctgttgtatgaataga

SEQ ID NO: 309312 - DNA, 25 bp, Mus musculus
cactggtgcttccaacttttcaaga

SEQ ID NO: 309313 - DNA, 25 bp, Mus musculus
cactggtgcttcgaacttttcaaga

SEQ ID NO: 309314 - DNA, 25 bp, Mus musculus
cactggtggcatagggacattactt

SEQ ID NO: 309315 - DNA, 25 bp, Mus musculus
cactggtggcattgggacattactt

SEQ ID NO: 309316 - DNA, 25 bp, Mus musculus
cactggtggccaacattggtgagca

SEQ ID NO: 309317 - DNA, 25 bp, Mus musculus
cactggtggccatcattggtgagca

SEQ ID NO: 309318 - DNA, 25 bp, Mus musculus
cactggtggctcatagggtttcttc

SEQ ID NO: 309319 - DNA, 25 bp, Mus musculus
cactggtggctcttagggtttcttc

SEQ ID NO: 309320 - DNA, 25 bp, Mus musculus
cactggtgggtgatagccgcttcca

SEQ ID NO: 309321 - DNA, 25 bp, Mus musculus
cactggtgggtgttagccgcttcca

SEQ ID NO: 309322 - DNA, 25 bp, Mus musculus
cactggtggtagctctcatgtcaac

SEQ ID NO: 309323 - DNA, 25 bp, Mus musculus
cactggtggtaggtctcatgtcaac

SEQ ID NO: 309324 - DNA, 25 bp, Mus musculus
cactggtgtcagaatgcatccacag

SEQ ID NO: 309325 - DNA, 25 bp, Mus musculus
cactggtgtcagtatgcatccacag

SEQ ID NO: 309326 - DNA, 25 bp, Mus musculus
cactggtgtgctctcattgatagga

SEQ ID NO: 309327 - DNA, 25 bp, Mus musculus
cactggtgtgctgtcattgatagga

SEQ ID NO: 309328 - DNA, 25 bp, Mus musculus
cactggtgtgtcagatttccaactt

SEQ ID NO: 309329 - DNA, 25 bp, Mus musculus
cactggtgtgtctgatttccaactt

SEQ ID NO: 309330 - DNA, 25 bp, Mus musculus
cactggttccagatacatcatgtag

SEQ ID NO: 309331 - DNA, 25 bp, Mus musculus
cactggttccagttacatcatgtag

SEQ ID NO: 309332 - DNA, 25 bp, Mus musculus
cactggttccatcgttcattgtcag

SEQ ID NO: 309333 - DNA, 25 bp, Mus musculus
cactggttccatggttcattgtcag

SEQ ID NO: 309334 - DNA, 25 bp, Mus musculus
cactggttctatatatcctggacat

SEQ ID NO: 309335 - DNA, 25 bp, Mus musculus
cactggttctatttatcctggacat

SEQ ID NO: 309336 - DNA, 25 bp, Mus musculus
cactggttgcggaagccctcaagag

SEQ ID NO: 309337 - DNA, 25 bp, Mus musculus
cactggttgcggtagccctcaagag

SEQ ID NO: 309338 - DNA, 25 bp, Mus musculus
cactggttgggaacaagggctgaat

SEQ ID NO: 309339 - DNA, 25 bp, Mus musculus
cactggttgggatcaagggctgaat

SEQ ID NO: 309340 - DNA, 25 bp, Mus musculus
cactggttggtgacattaaacacaa

SEQ ID NO: 309341 - DNA, 25 bp, Mus musculus
cactggttggtgtcattaaacacaa

SEQ ID NO: 309342 - DNA, 25 bp, Mus musculus
cactggtttcgaagtaggccttttc

SEQ ID NO: 309343 - DNA, 25 bp, Mus musculus
cactggtttcgatgtaggccttttc

SEQ ID NO: 309344 - DNA, 25 bp, Mus musculus
cactggtttctgattgttggactta

SEQ ID NO: 309345 - DNA, 25 bp, Mus musculus
cactggtttctgtttgttggactta

SEQ ID NO: 309346 - DNA, 25 bp, Mus musculus
cactggtttggtcgttatctgaaca

SEQ ID NO: 309347 - DNA, 25 bp, Mus musculus
cactggtttggtggttatctgaaca

SEQ ID NO: 309348 - DNA, 25 bp, Mus musculus
cactgtaaaaccatctcacagatgg

SEQ ID NO: 309349 - DNA, 25 bp, Mus musculus
cactgtaaaaccttctcacagatgg

SEQ ID NO: 309350 - DNA, 25 bp, Mus musculus
cactgtaaactcactggacgagagc

SEQ ID NO: 309351 - DNA, 25 bp, Mus musculus
cactgtaaactcagcttactcagat

SEQ ID NO: 309352 - DNA, 25 bp, Mus musculus
cactgtaaactctctggacgagagc

SEQ ID NO: 309353 - DNA, 25 bp, Mus musculus
cactgtaaactctgcttactcagat

SEQ ID NO: 309354 - DNA, 25 bp, Mus musculus
cactgtaaagtcacctgtttttctt

SEQ ID NO: 309355 - DNA, 25 bp, Mus musculus
cactgtaaagtctcctgtttttctt

SEQ ID NO: 309356 - DNA, 25 bp, Mus musculus
cactgtaaccgaatgcaatttggga

SEQ ID NO: 309357 - DNA, 25 bp, Mus musculus
cactgtaaccgattgcaatttggga

SEQ ID NO: 309358 - DNA, 25 bp, Mus musculus
cactgtacaaccctgggaattagtt

SEQ ID NO: 309359 - DNA, 25 bp, Mus musculus
cactgtacaaccgtgggaattagtt

SEQ ID NO: 309360 - DNA, 25 bp, Mus musculus
cactgtacacctcggaaatctctgt

SEQ ID NO: 309361 - DNA, 25 bp, Mus musculus
cactgtacacctgggaaatctctgt

SEQ ID NO: 309362 - DNA, 25 bp, Mus musculus
cactgtaccactcctgtgggtggac

SEQ ID NO: 309363 - DNA, 25 bp, Mus musculus
cactgtaccactgctgtgggtggac

SEQ ID NO: 309364 - DNA, 25 bp, Mus musculus
cactgtacctctacaacacatgaac

SEQ ID NO: 309365 - DNA, 25 bp, Mus musculus
cactgtacctcttcaacacatgaac

SEQ ID NO: 309366 - DNA, 25 bp, Mus musculus
cactgtacgtgaaatgccttgccgt

SEQ ID NO: 309367 - DNA, 25 bp, Mus musculus
cactgtacgtgatatgccttgccgt

SEQ ID NO: 309368 - DNA, 25 bp, Mus musculus
cactgtactatcacttccaaagctt

SEQ ID NO: 309369 - DNA, 25 bp, Mus musculus
cactgtactatctcttccaaagctt

SEQ ID NO: 309370 - DNA, 25 bp, Mus musculus
cactgtactccccaaggatacattt

SEQ ID NO: 309371 - DNA, 25 bp, Mus musculus
cactgtactcccgaaggatacattt

SEQ ID NO: 309372 - DNA, 25 bp, Mus musculus
cactgtacttagaggcctccgagaa

SEQ ID NO: 309373 - DNA, 25 bp, Mus musculus
cactgtacttagtggcctccgagaa

SEQ ID NO: 309374 - DNA, 25 bp, Mus musculus
cactgtagcagcattggtttttcaa

SEQ ID NO: 309375 - DNA, 25 bp, Mus musculus
cactgtagcagctttggtttttcaa

SEQ ID NO: 309376 - DNA, 25 bp, Mus musculus
cactgtagccaaaacactcttctgc

SEQ ID NO: 309377 - DNA, 25 bp, Mus musculus
cactgtagccaatacactcttctgc

SEQ ID NO: 309378 - DNA, 25 bp, Mus musculus
cactgtagcgttaccaagagcaaaa

SEQ ID NO: 309379 - DNA, 25 bp, Mus musculus
cactgtagcgtttccaagagcaaaa

SEQ ID NO: 309380 - DNA, 25 bp, Mus musculus
cactgtagctgtactattgtacaga

SEQ ID NO: 309381 - DNA, 25 bp, Mus musculus
cactgtagctgttctattgtacaga

SEQ ID NO: 309382 - DNA, 25 bp, Mus musculus
cactgtaggcacagcctggctataa

SEQ ID NO: 309383 - DNA, 25 bp, Mus musculus
cactgtaggcactgcctggctataa

SEQ ID NO: 309384 - DNA, 25 bp, Mus musculus
cactgtaggtcaacccatggcagaa

SEQ ID NO: 309385 - DNA, 25 bp, Mus musculus
cactgtaggtcatcccatggcagaa

SEQ ID NO: 309386 - DNA, 25 bp, Mus musculus
cactgtagtattactgtgcctgcac

SEQ ID NO: 309387 - DNA, 25 bp, Mus musculus
cactgtagtatttctgtgcctgcac

SEQ ID NO: 309388 - DNA, 25 bp, Mus musculus
cactgtagttacattactggccctt

SEQ ID NO: 309389 - DNA, 25 bp, Mus musculus
cactgtagttactttactggccctt

SEQ ID NO: 309390 - DNA, 25 bp, Mus musculus
cactgtataaccctcctgaattcat

SEQ ID NO: 309391 - DNA, 25 bp, Mus musculus
cactgtataaccgtcctgaattcat

SEQ ID NO: 309392 - DNA, 25 bp, Mus musculus
cactgtataagaagaaactgcgaat

SEQ ID NO: 309393 - DNA, 25 bp, Mus musculus
cactgtataagatgaaactgcgaat

SEQ ID NO: 309394 - DNA, 25 bp, Mus musculus
cactgtataagcatgatcctggtaa

SEQ ID NO: 309395 - DNA, 25 bp, Mus musculus
cactgtataagcttgatcctggtaa

SEQ ID NO: 309396 - DNA, 25 bp, Mus musculus
cactgtatcaaaataggtcatgtca

SEQ ID NO: 309397 - DNA, 25 bp, Mus musculus
cactgtatcaaattaggtcatgtca

SEQ ID NO: 309398 - DNA, 25 bp, Mus musculus
cactgtatcaggactcagatgtggt

SEQ ID NO: 309399 - DNA, 25 bp, Mus musculus
cactgtatcaggtctcagatgtggt

SEQ ID NO: 309400 - DNA, 25 bp, Mus musculus
cactgtatccctcctgtaatctgaa

SEQ ID NO: 309401 - DNA, 25 bp, Mus musculus
cactgtatccctgctgtaatctgaa

SEQ ID NO: 309402 - DNA, 25 bp, Mus musculus
cactgtatcctcaagcgttgttacg

SEQ ID NO: 309403 - DNA, 25 bp, Mus musculus
cactgtatcctctagcgttgttacg

SEQ ID NO: 309404 - DNA, 25 bp, Mus musculus
cactgtatcgagatgacgtcttaat

SEQ ID NO: 309405 - DNA, 25 bp, Mus musculus
cactgtatcgagttgacgtcttaat

SEQ ID NO: 309406 - DNA, 25 bp, Mus musculus
cactgtatgcagatgttcccctaaa

SEQ ID NO: 309407 - DNA, 25 bp, Mus musculus
cactgtatgcagttgttcccctaaa

SEQ ID NO: 309408 - DNA, 25 bp, Mus musculus
cactgtatgtggaatgcttcagcat

SEQ ID NO: 309409 - DNA, 25 bp, Mus musculus
cactgtatgtggtatgcttcagcat

SEQ ID NO: 309410 - DNA, 25 bp, Mus musculus
cactgtattggacaccgcaggcata

SEQ ID NO: 309411 - DNA, 25 bp, Mus musculus
cactgtattggagaccgcaggcata

SEQ ID NO: 309412 - DNA, 25 bp, Mus musculus
cactgtatttcacaggctgtccttg

SEQ ID NO: 309413 - DNA, 25 bp, Mus musculus
cactgtatttcagaggctgtccttg

SEQ ID NO: 309414 - DNA, 25 bp, Mus musculus
cactgtcaaaccactgccatattaa

SEQ ID NO: 309415 - DNA, 25 bp, Mus musculus
cactgtcaaacctctgccatattaa

SEQ ID NO: 309416 - DNA, 25 bp, Mus musculus
cactgtcaaactatggttccaccat

SEQ ID NO: 309417 - DNA, 25 bp, Mus musculus
cactgtcaaactttggttccaccat

SEQ ID NO: 309418 - DNA, 25 bp, Mus musculus
cactgtcaacctctagctgatatca

SEQ ID NO: 309419 - DNA, 25 bp, Mus musculus
cactgtcaacctgtagctgatatca

SEQ ID NO: 309420 - DNA, 25 bp, Mus musculus
cactgtcaacgacagggctgccaac

SEQ ID NO: 309421 - DNA, 25 bp, Mus musculus
cactgtcaacgagagggctgccaac

SEQ ID NO: 309422 - DNA, 25 bp, Mus musculus
cactgtcacacgcatagatctatac

SEQ ID NO: 309423 - DNA, 25 bp, Mus musculus
cactgtcacacggatagatctatac

SEQ ID NO: 309424 - DNA, 25 bp, Mus musculus
cactgtcacactatcttcataggtt

SEQ ID NO: 309425 - DNA, 25 bp, Mus musculus
cactgtcacactttcttcataggtt

SEQ ID NO: 309426 - DNA, 25 bp, Mus musculus
cactgtcacggtctgtgtgtggcag

SEQ ID NO: 309427 - DNA, 25 bp, Mus musculus
cactgtcacggtgtgtgtgtggcag

SEQ ID NO: 309428 - DNA, 25 bp, Mus musculus
cactgtcagcgccagaacacaatga

SEQ ID NO: 309429 - DNA, 25 bp, Mus musculus
cactgtcagcgcgagaacacaatga

SEQ ID NO: 309430 - DNA, 25 bp, Mus musculus
cactgtcagggtcggtacggctcat

SEQ ID NO: 309431 - DNA, 25 bp, Mus musculus
cactgtcagggtgggtacggctcat

SEQ ID NO: 309432 - DNA, 25 bp, Mus musculus
cactgtcatcccctgggagagtaaa

SEQ ID NO: 309433 - DNA, 25 bp, Mus musculus
cactgtcatcccgtgggagagtaaa

SEQ ID NO: 309434 - DNA, 25 bp, Mus musculus
cactgtccaacacgcattgcttgag

SEQ ID NO: 309435 - DNA, 25 bp, Mus musculus
cactgtccaacaggcattgcttgag

SEQ ID NO: 309436 - DNA, 25 bp, Mus musculus
cactgtccacagaatttcttggtaa

SEQ ID NO: 309437 - DNA, 25 bp, Mus musculus
cactgtccacagtatttcttggtaa

SEQ ID NO: 309438 - DNA, 25 bp, Mus musculus
cactgtccagccagagataatctgt

SEQ ID NO: 309439 - DNA, 25 bp, Mus musculus
cactgtccagcctgagataatctgt

SEQ ID NO: 309440 - DNA, 25 bp, Mus musculus
cactgtccaggtcaacttctacggg

SEQ ID NO: 309441 - DNA, 25 bp, Mus musculus
cactgtccaggtgaacttctacggg

SEQ ID NO: 309442 - DNA, 25 bp, Mus musculus
cactgtccagttatagccagtttta

SEQ ID NO: 309443 - DNA, 25 bp, Mus musculus
cactgtccagttttagccagtttta

SEQ ID NO: 309444 - DNA, 25 bp, Mus musculus
cactgtcctgctagtataactcttg

SEQ ID NO: 309445 - DNA, 25 bp, Mus musculus
cactgtcctgcttgtataactcttg

SEQ ID NO: 309446 - DNA, 25 bp, Mus musculus
cactgtcctgtgattgactacgtgc

SEQ ID NO: 309447 - DNA, 25 bp, Mus musculus
cactgtcctgtgtttgactacgtgc

SEQ ID NO: 309448 - DNA, 25 bp, Mus musculus
cactgtcgctctcccaagatcttgt

SEQ ID NO: 309449 - DNA, 25 bp, Mus musculus
cactgtcgctctgccaagatcttgt

SEQ ID NO: 309450 - DNA, 25 bp, Mus musculus
cactgtcggtcaaccgaggatgctt

SEQ ID NO: 309451 - DNA, 25 bp, Mus musculus
cactgtcggtcatccgaggatgctt

SEQ ID NO: 309452 - DNA, 25 bp, Mus musculus
cactgtctaattctctccgatgtca

SEQ ID NO: 309453 - DNA, 25 bp, Mus musculus
cactgtctaattgtctccgatgtca

SEQ ID NO: 309454 - DNA, 25 bp, Mus musculus
cactgtctagtactttggaggcttc

SEQ ID NO: 309455 - DNA, 25 bp, Mus musculus
cactgtctagtagtttggaggcttc

SEQ ID NO: 309456 - DNA, 25 bp, Mus musculus
cactgtctatcactacgtcggcaat

SEQ ID NO: 309457 - DNA, 25 bp, Mus musculus
cactgtctatcagtacgtcggcaat

SEQ ID NO: 309458 - DNA, 25 bp, Mus musculus
cactgtctccacatcacaatatttg

SEQ ID NO: 309459 - DNA, 25 bp, Mus musculus
cactgtctccacttcacaatatttg

SEQ ID NO: 309460 - DNA, 25 bp, Mus musculus
cactgtctccttctgaaagtcatga

SEQ ID NO: 309461 - DNA, 25 bp, Mus musculus
cactgtctccttgtgaaagtcatga

SEQ ID NO: 309462 - DNA, 25 bp, Mus musculus
cactgtctggatatctgcaggcaaa

SEQ ID NO: 309463 - DNA, 25 bp, Mus musculus
cactgtctggatttctgcaggcaaa

SEQ ID NO: 309464 - DNA, 25 bp, Mus musculus
cactgtctggtgctctggtttaaag

SEQ ID NO: 309465 - DNA, 25 bp, Mus musculus
cactgtctggtggtctggtttaaag

SEQ ID NO: 309466 - DNA, 25 bp, Mus musculus
cactgtcttagtaacgtttttatga

SEQ ID NO: 309467 - DNA, 25 bp, Mus musculus
cactgtcttagttacgtttttatga

SEQ ID NO: 309468 - DNA, 25 bp, Mus musculus
cactgtcttctgaggagtttggttc

SEQ ID NO: 309469 - DNA, 25 bp, Mus musculus
cactgtcttctgtggagtttggttc

SEQ ID NO: 309470 - DNA, 25 bp, Mus musculus
cactgtcttcttcggcatgttaaac

SEQ ID NO: 309471 - DNA, 25 bp, Mus musculus
cactgtcttcttgggcatgttaaac

SEQ ID NO: 309472 - DNA, 25 bp, Mus musculus
cactgtcttgtcaccaaagaccatg

SEQ ID NO: 309473 - DNA, 25 bp, Mus musculus
cactgtcttgtctccaaagaccatg

SEQ ID NO: 309474 - DNA, 25 bp, Mus musculus
cactgtcttgtgagtgagtttgttg

SEQ ID NO: 309475 - DNA, 25 bp, Mus musculus
cactgtcttgtgtgtgagtttgttg

SEQ ID NO: 309476 - DNA, 25 bp, Mus musculus
cactgtctttgccactctatacaaa

SEQ ID NO: 309477 - DNA, 25 bp, Mus musculus
cactgtctttgcgactctatacaaa

SEQ ID NO: 309478 - DNA, 25 bp, Mus musculus
cactgtctttggctagaaagctgaa

SEQ ID NO: 309479 - DNA, 25 bp, Mus musculus
cactgtctttgggtagaaagctgaa

SEQ ID NO: 309480 - DNA, 25 bp, Mus musculus
cactgtgaaagacagctgcacctcc

SEQ ID NO: 309481 - DNA, 25 bp, Mus musculus
cactgtgaaagagagctgcacctcc

SEQ ID NO: 309482 - DNA, 25 bp, Mus musculus
cactgtgaattgaggcctggtcgca

SEQ ID NO: 309483 - DNA, 25 bp, Mus musculus
cactgtgaattgtggcctggtcgca

SEQ ID NO: 309484 - DNA, 25 bp, Mus musculus
cactgtgacactagtaaccctctaa

SEQ ID NO: 309485 - DNA, 25 bp, Mus musculus
cactgtgacacttgtaaccctctaa

SEQ ID NO: 309486 - DNA, 25 bp, Mus musculus
cactgtgacagacacgttaaaagga

SEQ ID NO: 309487 - DNA, 25 bp, Mus musculus
cactgtgacagagacgttaaaagga

SEQ ID NO: 309488 - DNA, 25 bp, Mus musculus
cactgtgagagtccttgctctgtat

SEQ ID NO: 309489 - DNA, 25 bp, Mus musculus
cactgtgagagtgcttgctctgtat

SEQ ID NO: 309490 - DNA, 25 bp, Mus musculus
cactgtgagatgcttatcctgtttg

SEQ ID NO: 309491 - DNA, 25 bp, Mus musculus
cactgtgagatggttatcctgtttg

SEQ ID NO: 309492 - DNA, 25 bp, Mus musculus
cactgtgagcgccacagggaacctc

SEQ ID NO: 309493 - DNA, 25 bp, Mus musculus
cactgtgagcgcgacagggaacctc

SEQ ID NO: 309494 - DNA, 25 bp, Mus musculus
cactgtgatagtctggccccaggac

SEQ ID NO: 309495 - DNA, 25 bp, Mus musculus
cactgtgatagtgtggccccaggac

SEQ ID NO: 309496 - DNA, 25 bp, Mus musculus
cactgtgatgtgaggaccgccatat

SEQ ID NO: 309497 - DNA, 25 bp, Mus musculus
cactgtgatgtgtggaccgccatat

SEQ ID NO: 309498 - DNA, 25 bp, Mus musculus
cactgtgatttactgcactgcaggc

SEQ ID NO: 309499 - DNA, 25 bp, Mus musculus
cactgtgatttagtgcactgcaggc

SEQ ID NO: 309500 - DNA, 25 bp, Mus musculus
cactgtgcaaggagtggtagcgcac

SEQ ID NO: 309501 - DNA, 25 bp, Mus musculus
cactgtgcaaggtgtggtagcgcac

SEQ ID NO: 309502 - DNA, 25 bp, Mus musculus
cactgtgcaattccttcattggccc

SEQ ID NO: 309503 - DNA, 25 bp, Mus musculus
cactgtgcaattgcttcattggccc

SEQ ID NO: 309504 - DNA, 25 bp, Mus musculus
cactgtgcacccagaattctgaaca

SEQ ID NO: 309505 - DNA, 25 bp, Mus musculus
cactgtgcaccctgaattctgaaca

SEQ ID NO: 309506 - DNA, 25 bp, Mus musculus
cactgtgcacgaaggacactagaac

SEQ ID NO: 309507 - DNA, 25 bp, Mus musculus
cactgtgcacgatggacactagaac

SEQ ID NO: 309508 - DNA, 25 bp, Mus musculus
cactgtgcacttcatgttaccatat

SEQ ID NO: 309509 - DNA, 25 bp, Mus musculus
cactgtgcacttgatgttaccatat

SEQ ID NO: 309510 - DNA, 25 bp, Mus musculus
cactgtgcaggtcgcaagtgagact

SEQ ID NO: 309511 - DNA, 25 bp, Mus musculus
cactgtgcaggtggcaagtgagact

SEQ ID NO: 309512 - DNA, 25 bp, Mus musculus
cactgtgcataacctgagccgcatc

SEQ ID NO: 309513 - DNA, 25 bp, Mus musculus
cactgtgcataagctgagccgcatc

SEQ ID NO: 309514 - DNA, 25 bp, Mus musculus
cactgtgcatcaagtgtagttggtt

SEQ ID NO: 309515 - DNA, 25 bp, Mus musculus
cactgtgcatcatgtgtagttggtt

SEQ ID NO: 309516 - DNA, 25 bp, Mus musculus
cactgtgcatttcctgtcctgtgtc

SEQ ID NO: 309517 - DNA, 25 bp, Mus musculus
cactgtgcatttgctgtcctgtgtc

SEQ ID NO: 309518 - DNA, 25 bp, Mus musculus
cactgtgctagtatgggctggttaa

SEQ ID NO: 309519 - DNA, 25 bp, Mus musculus
cactgtgctagtttgggctggttaa

SEQ ID NO: 309520 - DNA, 25 bp, Mus musculus
cactgtgctattcgttcttgatttt

SEQ ID NO: 309521 - DNA, 25 bp, Mus musculus
cactgtgctattggttcttgatttt

SEQ ID NO: 309522 - DNA, 25 bp, Mus musculus
cactgtgctcccatcgtaaagtgaa

SEQ ID NO: 309523 - DNA, 25 bp, Mus musculus
cactgtgctcccttcgtaaagtgaa

SEQ ID NO: 309524 - DNA, 25 bp, Mus musculus
cactgtgctcctacagaatgtggga

SEQ ID NO: 309525 - DNA, 25 bp, Mus musculus
cactgtgctccttcagaatgtggga

SEQ ID NO: 309526 - DNA, 25 bp, Mus musculus
cactgtgctgtcagtgagaggacga

SEQ ID NO: 309527 - DNA, 25 bp, Mus musculus
cactgtgctgtcatgtttaggctga

SEQ ID NO: 309528 - DNA, 25 bp, Mus musculus
cactgtgctgtctgtgagaggacga

SEQ ID NO: 309529 - DNA, 25 bp, Mus musculus
cactgtgctgtcttgtttaggctga

SEQ ID NO: 309530 - DNA, 25 bp, Mus musculus
cactgtggaaagaacatctttatac

SEQ ID NO: 309531 - DNA, 25 bp, Mus musculus
cactgtggaaagtacatctttatac

SEQ ID NO: 309532 - DNA, 25 bp, Mus musculus
cactgtggacggcactttcaatggc

SEQ ID NO: 309533 - DNA, 25 bp, Mus musculus
cactgtggacgggactttcaatggc

SEQ ID NO: 309534 - DNA, 25 bp, Mus musculus
cactgtggactaactgtggattctg

SEQ ID NO: 309535 - DNA, 25 bp, Mus musculus
cactgtggactatctgtggattctg

SEQ ID NO: 309536 - DNA, 25 bp, Mus musculus
cactgtggactgatacatcgcccga

SEQ ID NO: 309537 - DNA, 25 bp, Mus musculus
cactgtggactgttacatcgcccga

SEQ ID NO: 309538 - DNA, 25 bp, Mus musculus
cactgtggaggacggctcacggatt

SEQ ID NO: 309539 - DNA, 25 bp, Mus musculus
cactgtggaggagggctcacggatt

SEQ ID NO: 309540 - DNA, 25 bp, Mus musculus
cactgtggatgcagacttttttcag

SEQ ID NO: 309541 - DNA, 25 bp, Mus musculus
cactgtggatgctgacttttttcag

SEQ ID NO: 309542 - DNA, 25 bp, Mus musculus
cactgtggattaattgctctgtaag

SEQ ID NO: 309543 - DNA, 25 bp, Mus musculus
cactgtggattatttgctctgtaag

SEQ ID NO: 309544 - DNA, 25 bp, Mus musculus
cactgtggcacaattgactctctaa

SEQ ID NO: 309545 - DNA, 25 bp, Mus musculus
cactgtggcacatttgactctctaa

SEQ ID NO: 309546 - DNA, 25 bp, Mus musculus
cactgtggccagatcctagagcaat

SEQ ID NO: 309547 - DNA, 25 bp, Mus musculus
cactgtggccagttcctagagcaat

SEQ ID NO: 309548 - DNA, 25 bp, Mus musculus
cactgtggccggaccatcagcaggg

SEQ ID NO: 309549 - DNA, 25 bp, Mus musculus
cactgtggccggtccatcagcaggg

SEQ ID NO: 309550 - DNA, 25 bp, Mus musculus
cactgtggccgtaatgatgagctgg

SEQ ID NO: 309551 - DNA, 25 bp, Mus musculus
cactgtggccgttatgatgagctgg

SEQ ID NO: 309552 - DNA, 25 bp, Mus musculus
cactgtggctgtatatttcaaggga

SEQ ID NO: 309553 - DNA, 25 bp, Mus musculus
cactgtggctgtttatttcaaggga

SEQ ID NO: 309554 - DNA, 25 bp, Mus musculus
cactgtggcttccttggaggtttac

SEQ ID NO: 309555 - DNA, 25 bp, Mus musculus
cactgtggcttcgttggaggtttac

SEQ ID NO: 309556 - DNA, 25 bp, Mus musculus
cactgtggcttgagactagcctcat

SEQ ID NO: 309557 - DNA, 25 bp, Mus musculus
cactgtggcttgtgactagcctcat

SEQ ID NO: 309558 - DNA, 25 bp, Mus musculus
cactgtgggcccagcgtatgggcaa

SEQ ID NO: 309559 - DNA, 25 bp, Mus musculus
cactgtgggccctgcgtatgggcaa

SEQ ID NO: 309560 - DNA, 25 bp, Mus musculus
cactgtgggcttcctccaggaagaa

SEQ ID NO: 309561 - DNA, 25 bp, Mus musculus
cactgtgggcttgctccaggaagaa

SEQ ID NO: 309562 - DNA, 25 bp, Mus musculus
cactgtggtacaaataagcaacttg

SEQ ID NO: 309563 - DNA, 25 bp, Mus musculus
cactgtggtacatataagcaacttg

SEQ ID NO: 309564 - DNA, 25 bp, Mus musculus
cactgtggtcagattgacccaacaa

SEQ ID NO: 309565 - DNA, 25 bp, Mus musculus
cactgtggtcagtttgacccaacaa

SEQ ID NO: 309566 - DNA, 25 bp, Mus musculus
cactgtggtccactgcctaaatggg

SEQ ID NO: 309567 - DNA, 25 bp, Mus musculus
cactgtggtccagtgcctaaatggg

SEQ ID NO: 309568 - DNA, 25 bp, Mus musculus
cactgtggtggtcttcgaacagtag

SEQ ID NO: 309569 - DNA, 25 bp, Mus musculus
cactgtggtggtgttcgaacagtag

SEQ ID NO: 309570 - DNA, 25 bp, Mus musculus
cactgtggtgttactgactggttga

SEQ ID NO: 309571 - DNA, 25 bp, Mus musculus
cactgtggtgtttctgactggttga

SEQ ID NO: 309572 - DNA, 25 bp, Mus musculus
cactgtggttggctttctaaaaaat

SEQ ID NO: 309573 - DNA, 25 bp, Mus musculus
cactgtggttgggtttctaaaaaat

SEQ ID NO: 309574 - DNA, 25 bp, Mus musculus
cactgtggtttcacatccttgaagt

SEQ ID NO: 309575 - DNA, 25 bp, Mus musculus
cactgtggtttctcatccttgaagt

SEQ ID NO: 309576 - DNA, 25 bp, Mus musculus
cactgtgtacccaggttgtgactac

SEQ ID NO: 309577 - DNA, 25 bp, Mus musculus
cactgtgtaccctggttgtgactac

SEQ ID NO: 309578 - DNA, 25 bp, Mus musculus
cactgtgtaggtaggccagcctgat

SEQ ID NO: 309579 - DNA, 25 bp, Mus musculus
cactgtgtaggttggccagcctgat

SEQ ID NO: 309580 - DNA, 25 bp, Mus musculus
cactgtgtatataacctgtgaaata

SEQ ID NO: 309581 - DNA, 25 bp, Mus musculus
cactgtgtatattacctgtgaaata

SEQ ID NO: 309582 - DNA, 25 bp, Mus musculus
cactgtgtccagctttatattgatt

SEQ ID NO: 309583 - DNA, 25 bp, Mus musculus
cactgtgtccaggtttatattgatt

SEQ ID NO: 309584 - DNA, 25 bp, Mus musculus
cactgtgtccgccaagaacgaagca

SEQ ID NO: 309585 - DNA, 25 bp, Mus musculus
cactgtgtccgcgaagaacgaagca

SEQ ID NO: 309586 - DNA, 25 bp, Mus musculus
cactgtgtcttgagtcttgtgagtc

SEQ ID NO: 309587 - DNA, 25 bp, Mus musculus
cactgtgtcttgtgtcttgtgagtc

SEQ ID NO: 309588 - DNA, 25 bp, Mus musculus
cactgtgtgactcctgaggctcgtg

SEQ ID NO: 309589 - DNA, 25 bp, Mus musculus
cactgtgtgactgctgaggctcgtg

SEQ ID NO: 309590 - DNA, 25 bp, Mus musculus
cactgtgtgctaatccactgtgtaa

SEQ ID NO: 309591 - DNA, 25 bp, Mus musculus
cactgtgtgctattccactgtgtaa

SEQ ID NO: 309592 - DNA, 25 bp, Mus musculus
cactgtgtggtaattggtctcggac

SEQ ID NO: 309593 - DNA, 25 bp, Mus musculus
cactgtgtggtatttggtctcggac

SEQ ID NO: 309594 - DNA, 25 bp, Mus musculus
cactgtgtggttccttcttcaaacc

SEQ ID NO: 309595 - DNA, 25 bp, Mus musculus
cactgtgtggttgcttcttcaaacc

SEQ ID NO: 309596 - DNA, 25 bp, Mus musculus
cactgtgtgtgaaatgacctgggac

SEQ ID NO: 309597 - DNA, 25 bp, Mus musculus
cactgtgtgtgatatgacctgggac

SEQ ID NO: 309598 - DNA, 25 bp, Mus musculus
cactgtgtgttgatagcacttccca

SEQ ID NO: 309599 - DNA, 25 bp, Mus musculus
cactgtgtgttgttagcacttccca

SEQ ID NO: 309600 - DNA, 25 bp, Mus musculus
cactgtgttctgatatccttcagga

SEQ ID NO: 309601 - DNA, 25 bp, Mus musculus
cactgtgttctgttatccttcagga

SEQ ID NO: 309602 - DNA, 25 bp, Mus musculus
cactgtgtttcaattcaagcactta

SEQ ID NO: 309603 - DNA, 25 bp, Mus musculus
cactgtgtttcatttcaagcactta

SEQ ID NO: 309604 - DNA, 25 bp, Mus musculus
cactgtgtttgcagcagtcaccacg

SEQ ID NO: 309605 - DNA, 25 bp, Mus musculus
cactgtgtttgctgcagtcaccacg

SEQ ID NO: 309606 - DNA, 25 bp, Mus musculus
cactgttacagaccctaatgatgcc

SEQ ID NO: 309607 - DNA, 25 bp, Mus musculus
cactgttacagagcctaatgatgcc

SEQ ID NO: 309608 - DNA, 25 bp, Mus musculus
cactgttaccatagcttccaggagc

SEQ ID NO: 309609 - DNA, 25 bp, Mus musculus
cactgttaccattgcttccaggagc

SEQ ID NO: 309610 - DNA, 25 bp, Mus musculus
cactgttactgacccatggtactgt

SEQ ID NO: 309611 - DNA, 25 bp, Mus musculus
cactgttactgagccatggtactgt

SEQ ID NO: 309612 - DNA, 25 bp, Mus musculus
cactgttatcagatttgttcactaa

SEQ ID NO: 309613 - DNA, 25 bp, Mus musculus
cactgttatcagttttgttcactaa

SEQ ID NO: 309614 - DNA, 25 bp, Mus musculus
cactgttcacgaagggccagacaga

SEQ ID NO: 309615 - DNA, 25 bp, Mus musculus
cactgttcacgatgggccagacaga

SEQ ID NO: 309616 - DNA, 25 bp, Mus musculus
cactgttcactgataactgacaaag

SEQ ID NO: 309617 - DNA, 25 bp, Mus musculus
cactgttcactgttaactgacaaag

SEQ ID NO: 309618 - DNA, 25 bp, Mus musculus
cactgttcattaacctgtcttctgt

SEQ ID NO: 309619 - DNA, 25 bp, Mus musculus
cactgttcattatcctgtcttctgt

SEQ ID NO: 309620 - DNA, 25 bp, Mus musculus
cactgttcccttatggttgttatat

SEQ ID NO: 309621 - DNA, 25 bp, Mus musculus
cactgttcccttttggttgttatat

SEQ ID NO: 309622 - DNA, 25 bp, Mus musculus
cactgttcgatacactcactgattt

SEQ ID NO: 309623 - DNA, 25 bp, Mus musculus
cactgttcgatagactcactgattt

SEQ ID NO: 309624 - DNA, 25 bp, Mus musculus
cactgttcgcttaccttgatgagaa

SEQ ID NO: 309625 - DNA, 25 bp, Mus musculus
cactgttcgctttccttgatgagaa

SEQ ID NO: 309626 - DNA, 25 bp, Mus musculus
cactgttcggcaaggaggcggacaa

SEQ ID NO: 309627 - DNA, 25 bp, Mus musculus
cactgttcggcatggaggcggacaa

SEQ ID NO: 309628 - DNA, 25 bp, Mus musculus
cactgttctaaaagtgcccgtcatt

SEQ ID NO: 309629 - DNA, 25 bp, Mus musculus
cactgttctaaatgtgcccgtcatt

SEQ ID NO: 309630 - DNA, 25 bp, Mus musculus
cactgttctactagtggcatttgaa

SEQ ID NO: 309631 - DNA, 25 bp, Mus musculus
cactgttctacttgtggcatttgaa

SEQ ID NO: 309632 - DNA, 25 bp, Mus musculus
cactgttctgctaatagccttaaca

SEQ ID NO: 309633 - DNA, 25 bp, Mus musculus
cactgttctgcttatagccttaaca

SEQ ID NO: 309634 - DNA, 25 bp, Mus musculus
cactgttctgttagagttgtatcca

SEQ ID NO: 309635 - DNA, 25 bp, Mus musculus
cactgttctgtttgagttgtatcca

SEQ ID NO: 309636 - DNA, 25 bp, Mus musculus
cactgttgagatcgacacactgtaa

SEQ ID NO: 309637 - DNA, 25 bp, Mus musculus
cactgttgagatggacacactgtaa

SEQ ID NO: 309638 - DNA, 25 bp, Mus musculus
cactgttgagccaactctgagctgg

SEQ ID NO: 309639 - DNA, 25 bp, Mus musculus
cactgttgagcctactctgagctgg

SEQ ID NO: 309640 - DNA, 25 bp, Mus musculus
cactgttgcagaaatgtagagtcaa

SEQ ID NO: 309641 - DNA, 25 bp, Mus musculus
cactgttgcagatatgtagagtcaa

SEQ ID NO: 309642 - DNA, 25 bp, Mus musculus
cactgttgctccaatattgactgta

SEQ ID NO: 309643 - DNA, 25 bp, Mus musculus
cactgttgctcctatattgactgta

SEQ ID NO: 309644 - DNA, 25 bp, Mus musculus
cactgttggagacggctacggttac

SEQ ID NO: 309645 - DNA, 25 bp, Mus musculus
cactgttggagagggctacggttac

SEQ ID NO: 309646 - DNA, 25 bp, Mus musculus
cactgttggcatatactatattcac

SEQ ID NO: 309647 - DNA, 25 bp, Mus musculus
cactgttggcatttactatattcac

SEQ ID NO: 309648 - DNA, 25 bp, Mus musculus
cactgttggctgcttcctagttgga

SEQ ID NO: 309649 - DNA, 25 bp, Mus musculus
cactgttggctggttcctagttgga

SEQ ID NO: 309650 - DNA, 25 bp, Mus musculus
cactgttgggagatgcatgctgcaa

SEQ ID NO: 309651 - DNA, 25 bp, Mus musculus
cactgttgggagttgcatgctgcaa

SEQ ID NO: 309652 - DNA, 25 bp, Mus musculus
cactgttggtcaatctggcatagat

SEQ ID NO: 309653 - DNA, 25 bp, Mus musculus
cactgttggtcattctggcatagat

SEQ ID NO: 309654 - DNA, 25 bp, Mus musculus
cactgttgtctcaggagtccacctg

SEQ ID NO: 309655 - DNA, 25 bp, Mus musculus
cactgttgtctctggagtccacctg

SEQ ID NO: 309656 - DNA, 25 bp, Mus musculus
cactgttgttggcaatcgcttgcaa

SEQ ID NO: 309657 - DNA, 25 bp, Mus musculus
cactgttgttgggaatcgcttgcaa

SEQ ID NO: 309658 - DNA, 25 bp, Mus musculus
cactgtttacatatgctggctttaa

SEQ ID NO: 309659 - DNA, 25 bp, Mus musculus
cactgtttacatttgctggctttaa

SEQ ID NO: 309660 - DNA, 25 bp, Mus musculus
cactgtttataccaaggtggatttc

SEQ ID NO: 309661 - DNA, 25 bp, Mus musculus
cactgtttatacgaaggtggatttc

SEQ ID NO: 309662 - DNA, 25 bp, Mus musculus
cactgtttcaggagatgtgacattt

SEQ ID NO: 309663 - DNA, 25 bp, Mus musculus
cactgtttcaggtgatgtgacattt

SEQ ID NO: 309664 - DNA, 25 bp, Mus musculus
cactgtttccccaagagagatgtca

SEQ ID NO: 309665 - DNA, 25 bp, Mus musculus
cactgtttcccctagagagatgtca

SEQ ID NO: 309666 - DNA, 25 bp, Mus musculus
cactgtttcccgagtatagatacaa

SEQ ID NO: 309667 - DNA, 25 bp, Mus musculus
cactgtttcccgtgtatagatacaa

SEQ ID NO: 309668 - DNA, 25 bp, Mus musculus
cactgtttgaagaaagttgctacaa

SEQ ID NO: 309669 - DNA, 25 bp, Mus musculus
cactgtttgaagtaagttgctacaa

SEQ ID NO: 309670 - DNA, 25 bp, Mus musculus
cactgtttgcctagaaagccagaag

SEQ ID NO: 309671 - DNA, 25 bp, Mus musculus
cactgtttgccttgaaagccagaag

SEQ ID NO: 309672 - DNA, 25 bp, Mus musculus
cactgtttggagatccttctgttgg

SEQ ID NO: 309673 - DNA, 25 bp, Mus musculus
cactgtttggagttccttctgttgg

SEQ ID NO: 309674 - DNA, 25 bp, Mus musculus
cactgtttggatcctgaccgtgaaa

SEQ ID NO: 309675 - DNA, 25 bp, Mus musculus
cactgtttggatgctgaccgtgaaa

SEQ ID NO: 309676 - DNA, 25 bp, Mus musculus
cactgttttaaccatgaccacctta

SEQ ID NO: 309677 - DNA, 25 bp, Mus musculus
cactgttttaacgatgaccacctta

SEQ ID NO: 309678 - DNA, 25 bp, Mus musculus
cactgttttgataatgctgatttcc

SEQ ID NO: 309679 - DNA, 25 bp, Mus musculus
cactgttttgattatgctgatttcc

SEQ ID NO: 309680 - DNA, 25 bp, Mus musculus
cactgttttgcaagcttgtttgttt

SEQ ID NO: 309681 - DNA, 25 bp, Mus musculus
cactgttttgcatgcttgtttgttt

SEQ ID NO: 309682 - DNA, 25 bp, Mus musculus
cactgttttgttaactcttactgag

SEQ ID NO: 309683 - DNA, 25 bp, Mus musculus
cactgttttgtttactcttactgag

SEQ ID NO: 309684 - DNA, 25 bp, Mus musculus
cactgtttttctatagtacctccca

SEQ ID NO: 309685 - DNA, 25 bp, Mus musculus
cactgtttttctttagtacctccca

SEQ ID NO: 309686 - DNA, 25 bp, Mus musculus
cacttaaaacctctttccattcgct

SEQ ID NO: 309687 - DNA, 25 bp, Mus musculus
cacttaaaacctgtttccattcgct

SEQ ID NO: 309688 - DNA, 25 bp, Mus musculus
cacttaaaagatccagcctgggcta

SEQ ID NO: 309689 - DNA, 25 bp, Mus musculus
cacttaaaagatgcagcctgggcta

SEQ ID NO: 309690 - DNA, 25 bp, Mus musculus
cacttaaacccactgacttcaggtt

SEQ ID NO: 309691 - DNA, 25 bp, Mus musculus
cacttaaacccagtgacttcaggtt

SEQ ID NO: 309692 - DNA, 25 bp, Mus musculus
cacttaaactgcacttctattcctg

SEQ ID NO: 309693 - DNA, 25 bp, Mus musculus
cacttaaactgctcttctattcctg

SEQ ID NO: 309694 - DNA, 25 bp, Mus musculus
cacttaacagagacagactgcctgt

SEQ ID NO: 309695 - DNA, 25 bp, Mus musculus
cacttaacagagtcagactgcctgt

SEQ ID NO: 309696 - DNA, 25 bp, Mus musculus
cacttaacatctccaggtcacattt

SEQ ID NO: 309697 - DNA, 25 bp, Mus musculus
cacttaacatctgcaggtcacattt

SEQ ID NO: 309698 - DNA, 25 bp, Mus musculus
cacttaagaagcatgtctgcaataa

SEQ ID NO: 309699 - DNA, 25 bp, Mus musculus
cacttaagaagcttgtctgcaataa

SEQ ID NO: 309700 - DNA, 25 bp, Mus musculus
cacttaagagtcacggcactgcctg

SEQ ID NO: 309701 - DNA, 25 bp, Mus musculus
cacttaagagtctcggcactgcctg

SEQ ID NO: 309702 - DNA, 25 bp, Mus musculus
cacttaagctcactcatgtgaccgc

SEQ ID NO: 309703 - DNA, 25 bp, Mus musculus
cacttaagctcagtcatgtgaccgc

SEQ ID NO: 309704 - DNA, 25 bp, Mus musculus
cacttaagtgaaagggtgactgtat

SEQ ID NO: 309705 - DNA, 25 bp, Mus musculus
cacttaagtgaatgggtgactgtat

SEQ ID NO: 309706 - DNA, 25 bp, Mus musculus
cacttaatgcttacagaggatctca

SEQ ID NO: 309707 - DNA, 25 bp, Mus musculus
cacttaatgctttcagaggatctca

SEQ ID NO: 309708 - DNA, 25 bp, Mus musculus
cacttacaccttcctattagagaat

SEQ ID NO: 309709 - DNA, 25 bp, Mus musculus
cacttacaccttgctattagagaat

SEQ ID NO: 309710 - DNA, 25 bp, Mus musculus
cacttacatatgagcatgcgcatgc

SEQ ID NO: 309711 - DNA, 25 bp, Mus musculus
cacttacatatgtgcatgcgcatgc

SEQ ID NO: 309712 - DNA, 25 bp, Mus musculus
cacttacatctcactgtgctgtttt

SEQ ID NO: 309713 - DNA, 25 bp, Mus musculus
cacttacatctctctgtgctgtttt

SEQ ID NO: 309714 - DNA, 25 bp, Mus musculus
cacttaccactgcaagtccttgagt

SEQ ID NO: 309715 - DNA, 25 bp, Mus musculus
cacttaccactggaagtccttgagt

SEQ ID NO: 309716 - DNA, 25 bp, Mus musculus
cacttaccagttacttcccgtgaat

SEQ ID NO: 309717 - DNA, 25 bp, Mus musculus
cacttaccagtttcttcccgtgaat

SEQ ID NO: 309718 - DNA, 25 bp, Mus musculus
cacttacccactctgaacgaacgga

SEQ ID NO: 309719 - DNA, 25 bp, Mus musculus
cacttacccactgtgaacgaacgga

SEQ ID NO: 309720 - DNA, 25 bp, Mus musculus
cacttacccagacgccttggttcaa

SEQ ID NO: 309721 - DNA, 25 bp, Mus musculus
cacttacccagaggccttggttcaa

SEQ ID NO: 309722 - DNA, 25 bp, Mus musculus
cacttaccttttctttgcgtttgat

SEQ ID NO: 309723 - DNA, 25 bp, Mus musculus
cacttaccttttgtttgcgtttgat

SEQ ID NO: 309724 - DNA, 25 bp, Mus musculus
cacttactgaagctgggcacatcca

SEQ ID NO: 309725 - DNA, 25 bp, Mus musculus
cacttactgaaggtgggcacatcca

SEQ ID NO: 309726 - DNA, 25 bp, Mus musculus
cacttactgagtaggttcttttcct

SEQ ID NO: 309727 - DNA, 25 bp, Mus musculus
cacttactgagttggttcttttcct

SEQ ID NO: 309728 - DNA, 25 bp, Mus musculus
cacttactgcctaatgctaccaaga

SEQ ID NO: 309729 - DNA, 25 bp, Mus musculus
cacttactgccttatgctaccaaga

SEQ ID NO: 309730 - DNA, 25 bp, Mus musculus
cacttactggatattactttcttgg

SEQ ID NO: 309731 - DNA, 25 bp, Mus musculus
cacttactggattttactttcttgg

SEQ ID NO: 309732 - DNA, 25 bp, Mus musculus
cacttacttgctcgcttgggctcgt

SEQ ID NO: 309733 - DNA, 25 bp, Mus musculus
cacttacttgctggcttgggctcgt

SEQ ID NO: 309734 - DNA, 25 bp, Mus musculus
cacttagaacagctttgaccctggg

SEQ ID NO: 309735 - DNA, 25 bp, Mus musculus
cacttagaacaggtttgaccctggg

SEQ ID NO: 309736 - DNA, 25 bp, Mus musculus
cacttagacaccactgtgtgggcgg

SEQ ID NO: 309737 - DNA, 25 bp, Mus musculus
cacttagacacctctgtgtgggcgg

SEQ ID NO: 309738 - DNA, 25 bp, Mus musculus
cacttagagggacaaactgaacact

SEQ ID NO: 309739 - DNA, 25 bp, Mus musculus
cacttagagggagaaactgaacact

SEQ ID NO: 309740 - DNA, 25 bp, Mus musculus
cacttagataatcctcttctgggcc

SEQ ID NO: 309741 - DNA, 25 bp, Mus musculus
cacttagataatgctcttctgggcc

SEQ ID NO: 309742 - DNA, 25 bp, Mus musculus
cacttagctattaatccctgggatc

SEQ ID NO: 309743 - DNA, 25 bp, Mus musculus
cacttagctatttatccctgggatc

SEQ ID NO: 309744 - DNA, 25 bp, Mus musculus
cacttagcttcaaggaccctcattc

SEQ ID NO: 309745 - DNA, 25 bp, Mus musculus
cacttagcttcatggaccctcattc

SEQ ID NO: 309746 - DNA, 25 bp, Mus musculus
cacttaggttctcattttctcttcc

SEQ ID NO: 309747 - DNA, 25 bp, Mus musculus
cacttaggttctgattttctcttcc

SEQ ID NO: 309748 - DNA, 25 bp, Mus musculus
cacttagtaactccgccttcataat

SEQ ID NO: 309749 - DNA, 25 bp, Mus musculus
cacttagtaactgcgccttcataat

SEQ ID NO: 309750 - DNA, 25 bp, Mus musculus
cacttagtaagtatgcttcttttca

SEQ ID NO: 309751 - DNA, 25 bp, Mus musculus
cacttagtaagtttgcttcttttca

SEQ ID NO: 309752 - DNA, 25 bp, Mus musculus
cacttagtgaacatccaattcagaa

SEQ ID NO: 309753 - DNA, 25 bp, Mus musculus
cacttagtgaacttccaattcagaa

SEQ ID NO: 309754 - DNA, 25 bp, Mus musculus
cacttagtgtttccaactcgtgact

SEQ ID NO: 309755 - DNA, 25 bp, Mus musculus
cacttagtgtttgcaactcgtgact

SEQ ID NO: 309756 - DNA, 25 bp, Mus musculus
cacttagtttctcctctggatcaaa

SEQ ID NO: 309757 - DNA, 25 bp, Mus musculus
cacttagtttctgctctggatcaaa

SEQ ID NO: 309758 - DNA, 25 bp, Mus musculus
cacttagttttgaatgatatgctca

SEQ ID NO: 309759 - DNA, 25 bp, Mus musculus
cacttagttttgtatgatatgctca

SEQ ID NO: 309760 - DNA, 25 bp, Mus musculus
cacttatacaccctcttgacgaact

SEQ ID NO: 309761 - DNA, 25 bp, Mus musculus
cacttatacaccgtcttgacgaact

SEQ ID NO: 309762 - DNA, 25 bp, Mus musculus
cacttatattccatttgatttctag

SEQ ID NO: 309763 - DNA, 25 bp, Mus musculus
cacttatattccttttgatttctag

SEQ ID NO: 309764 - DNA, 25 bp, Mus musculus
cacttatcaaacaccaattccctta

SEQ ID NO: 309765 - DNA, 25 bp, Mus musculus
cacttatcaaactccaattccctta

SEQ ID NO: 309766 - DNA, 25 bp, Mus musculus
cacttatctgtgagcacggcagtat

SEQ ID NO: 309767 - DNA, 25 bp, Mus musculus
cacttatctgtgtgcacggcagtat

SEQ ID NO: 309768 - DNA, 25 bp, Mus musculus
cacttatgaggtcggctcctggatt

SEQ ID NO: 309769 - DNA, 25 bp, Mus musculus
cacttatgaggtgggctcctggatt

SEQ ID NO: 309770 - DNA, 25 bp, Mus musculus
cacttatgtgccagggtgagaaaga

SEQ ID NO: 309771 - DNA, 25 bp, Mus musculus
cacttatgtgcctgggtgagaaaga

SEQ ID NO: 309772 - DNA, 25 bp, Mus musculus
cacttatgtgttctacatggtctga

SEQ ID NO: 309773 - DNA, 25 bp, Mus musculus
cacttatgtgttgtacatggtctga

SEQ ID NO: 309774 - DNA, 25 bp, Mus musculus
cacttattaaaaaccccatcaccat

SEQ ID NO: 309775 - DNA, 25 bp, Mus musculus
cacttattaaaatccccatcaccat

SEQ ID NO: 309776 - DNA, 25 bp, Mus musculus
cacttattcctgaaaccctgtgggt

SEQ ID NO: 309777 - DNA, 25 bp, Mus musculus
cacttattcctgtaaccctgtgggt

SEQ ID NO: 309778 - DNA, 25 bp, Mus musculus
cacttattctctctactctgacttg

SEQ ID NO: 309779 - DNA, 25 bp, Mus musculus
cacttattctctgtactctgacttg

SEQ ID NO: 309780 - DNA, 25 bp, Mus musculus
cacttattgattatgtagaggacct

SEQ ID NO: 309781 - DNA, 25 bp, Mus musculus
cacttattgattttgtagaggacct

SEQ ID NO: 309782 - DNA, 25 bp, Mus musculus
cacttatttatgagagaccaaactg

SEQ ID NO: 309783 - DNA, 25 bp, Mus musculus
cacttatttatgtgagaccaaactg

SEQ ID NO: 309784 - DNA, 25 bp, Mus musculus
cacttatttgttcttggtctctgta

SEQ ID NO: 309785 - DNA, 25 bp, Mus musculus
cacttatttgttgttggtctctgta

SEQ ID NO: 309786 - DNA, 25 bp, Mus musculus
cacttcaacactaatgcatctttct

SEQ ID NO: 309787 - DNA, 25 bp, Mus musculus
cacttcaacacttatgcatctttct

SEQ ID NO: 309788 - DNA, 25 bp, Mus musculus
cacttcaaccctcatgaaggaggtg

SEQ ID NO: 309789 - DNA, 25 bp, Mus musculus
cacttcaaccctgatgaaggaggtg

SEQ ID NO: 309790 - DNA, 25 bp, Mus musculus
cacttcaagaagacactgtcagaga

SEQ ID NO: 309791 - DNA, 25 bp, Mus musculus
cacttcaagaagtcactgtcagaga

SEQ ID NO: 309792 - DNA, 25 bp, Mus musculus
cacttcaagactctccttcttttca

SEQ ID NO: 309793 - DNA, 25 bp, Mus musculus
cacttcaagactgtccttcttttca

SEQ ID NO: 309794 - DNA, 25 bp, Mus musculus
cacttcaagcctctgactcaaaagc

SEQ ID NO: 309795 - DNA, 25 bp, Mus musculus
cacttcaagcctgtgactcaaaagc

SEQ ID NO: 309796 - DNA, 25 bp, Mus musculus
cacttcaaggagctgccaccacata

SEQ ID NO: 309797 - DNA, 25 bp, Mus musculus
cacttcaaggaggtgccaccacata

SEQ ID NO: 309798 - DNA, 25 bp, Mus musculus
cacttcaagtagctttcatgaggag

SEQ ID NO: 309799 - DNA, 25 bp, Mus musculus
cacttcaagtaggtttcatgaggag

SEQ ID NO: 309800 - DNA, 25 bp, Mus musculus
cacttcaatgtgaggatgacttcct

SEQ ID NO: 309801 - DNA, 25 bp, Mus musculus
cacttcaatgtgtggatgacttcct

SEQ ID NO: 309802 - DNA, 25 bp, Mus musculus
cacttcacaaagatattctctgacc

SEQ ID NO: 309803 - DNA, 25 bp, Mus musculus
cacttcacaaagttattctctgacc

SEQ ID NO: 309804 - DNA, 25 bp, Mus musculus
cacttcacagctcaggagaaggcag

SEQ ID NO: 309805 - DNA, 25 bp, Mus musculus
cacttcacagctgaggagaaggcag

SEQ ID NO: 309806 - DNA, 25 bp, Mus musculus
cacttcaccaagcagggcacactga

SEQ ID NO: 309807 - DNA, 25 bp, Mus musculus
cacttcaccaaggagggcacactga

SEQ ID NO: 309808 - DNA, 25 bp, Mus musculus
cacttcactgtaaaacttcatgttt

SEQ ID NO: 309809 - DNA, 25 bp, Mus musculus
cacttcactgtataacttcatgttt

SEQ ID NO: 309810 - DNA, 25 bp, Mus musculus
cacttcactttgaaactgtcctgaa

SEQ ID NO: 309811 - DNA, 25 bp, Mus musculus
cacttcactttgtaactgtcctgaa

SEQ ID NO: 309812 - DNA, 25 bp, Mus musculus
cacttcagaagtcaccgaccggtag

SEQ ID NO: 309813 - DNA, 25 bp, Mus musculus
cacttcagaagtgaccgaccggtag

SEQ ID NO: 309814 - DNA, 25 bp, Mus musculus
cacttcaggagtagctcagtggata

SEQ ID NO: 309815 - DNA, 25 bp, Mus musculus
cacttcaggagttgctcagtggata

SEQ ID NO: 309816 - DNA, 25 bp, Mus musculus
cacttcatcaccctgaatgggagta

SEQ ID NO: 309817 - DNA, 25 bp, Mus musculus
cacttcatcaccgtgaatgggagta

SEQ ID NO: 309818 - DNA, 25 bp, Mus musculus
cacttcatcacgcttgtctctgcag

SEQ ID NO: 309819 - DNA, 25 bp, Mus musculus
cacttcatcacggttgtctctgcag

SEQ ID NO: 309820 - DNA, 25 bp, Mus musculus
cacttcatccacagttgtttatatg

SEQ ID NO: 309821 - DNA, 25 bp, Mus musculus
cacttcatccactgttgtttatatg

SEQ ID NO: 309822 - DNA, 25 bp, Mus musculus
cacttcatctgcatgtacatctgta

SEQ ID NO: 309823 - DNA, 25 bp, Mus musculus
cacttcatctgcttgtacatctgta

SEQ ID NO: 309824 - DNA, 25 bp, Mus musculus
cacttcatgcagaccaataagaggc

SEQ ID NO: 309825 - DNA, 25 bp, Mus musculus
cacttcatgcagtccaataagaggc

SEQ ID NO: 309826 - DNA, 25 bp, Mus musculus
cacttcatgccgcactggaacaaga

SEQ ID NO: 309827 - DNA, 25 bp, Mus musculus
cacttcatgccggactggaacaaga

SEQ ID NO: 309828 - DNA, 25 bp, Mus musculus
cacttcatggtgagatctcggcatt

SEQ ID NO: 309829 - DNA, 25 bp, Mus musculus
cacttcatggtgtgatctcggcatt

SEQ ID NO: 309830 - DNA, 25 bp, Mus musculus
cacttcattgaacctctctacagag

SEQ ID NO: 309831 - DNA, 25 bp, Mus musculus
cacttcattgaagctctctacagag

SEQ ID NO: 309832 - DNA, 25 bp, Mus musculus
cacttccagcttcactcctttttat

SEQ ID NO: 309833 - DNA, 25 bp, Mus musculus
cacttccagcttgactcctttttat

SEQ ID NO: 309834 - DNA, 25 bp, Mus musculus
cacttccaggaacggagactggctc

SEQ ID NO: 309835 - DNA, 25 bp, Mus musculus
cacttccaggaagggagactggctc

SEQ ID NO: 309836 - DNA, 25 bp, Mus musculus
cacttccagggaccaggttttacca

SEQ ID NO: 309837 - DNA, 25 bp, Mus musculus
cacttccagggagcaggttttacca

SEQ ID NO: 309838 - DNA, 25 bp, Mus musculus
cacttccaggtgacaactttattct

SEQ ID NO: 309839 - DNA, 25 bp, Mus musculus
cacttccaggtgtcaactttattct

SEQ ID NO: 309840 - DNA, 25 bp, Mus musculus
cacttccagtgacgagagctctact

SEQ ID NO: 309841 - DNA, 25 bp, Mus musculus
cacttccagtgaggagagctctact

SEQ ID NO: 309842 - DNA, 25 bp, Mus musculus
cacttccagtggagagaatgagcca

SEQ ID NO: 309843 - DNA, 25 bp, Mus musculus
cacttccagtggtgagaatgagcca

SEQ ID NO: 309844 - DNA, 25 bp, Mus musculus
cacttccatcgcacagcaggagttc

SEQ ID NO: 309845 - DNA, 25 bp, Mus musculus
cacttccatcgctcagcaggagttc

SEQ ID NO: 309846 - DNA, 25 bp, Mus musculus
cacttcccaagacctggtattccag

SEQ ID NO: 309847 - DNA, 25 bp, Mus musculus
cacttcccaagagctggtattccag

SEQ ID NO: 309848 - DNA, 25 bp, Mus musculus
cacttcccaagtctatcatggcaaa

SEQ ID NO: 309849 - DNA, 25 bp, Mus musculus
cacttcccaagtgtatcatggcaaa

SEQ ID NO: 309850 - DNA, 25 bp, Mus musculus
cacttcccagaacccctgagggaga

SEQ ID NO: 309851 - DNA, 25 bp, Mus musculus
cacttcccagaagccctgagggaga

SEQ ID NO: 309852 - DNA, 25 bp, Mus musculus
cacttcccaggaatcaagcctaaaa

SEQ ID NO: 309853 - DNA, 25 bp, Mus musculus
cacttcccaggattcaagcctaaaa

SEQ ID NO: 309854 - DNA, 25 bp, Mus musculus
cacttccccaagctccaagtaatga

SEQ ID NO: 309855 - DNA, 25 bp, Mus musculus
cacttccccaaggtccaagtaatga

SEQ ID NO: 309856 - DNA, 25 bp, Mus musculus
cacttccccaggatagatgtggtgc

SEQ ID NO: 309857 - DNA, 25 bp, Mus musculus
cacttccccaggttagatgtggtgc

SEQ ID NO: 309858 - DNA, 25 bp, Mus musculus
cacttccccgcacataaatacattt

SEQ ID NO: 309859 - DNA, 25 bp, Mus musculus
cacttccccgcagataaatacattt

SEQ ID NO: 309860 - DNA, 25 bp, Mus musculus
cacttccccgctatcagctatgttt

SEQ ID NO: 309861 - DNA, 25 bp, Mus musculus
cacttccccgctttcagctatgttt

SEQ ID NO: 309862 - DNA, 25 bp, Mus musculus
cacttccctcagagcacctggtggg

SEQ ID NO: 309863 - DNA, 25 bp, Mus musculus
cacttccctcagtgcacctggtggg

SEQ ID NO: 309864 - DNA, 25 bp, Mus musculus
cacttccctggcagcggtgacagac

SEQ ID NO: 309865 - DNA, 25 bp, Mus musculus
cacttccctggctgcggtgacagac

SEQ ID NO: 309866 - DNA, 25 bp, Mus musculus
cacttccgagatattcattcacttc

SEQ ID NO: 309867 - DNA, 25 bp, Mus musculus
cacttccgagattttcattcacttc

SEQ ID NO: 309868 - DNA, 25 bp, Mus musculus
cacttccgctgcaagctgaataaca

SEQ ID NO: 309869 - DNA, 25 bp, Mus musculus
cacttccgctgcagcggcagcatat

SEQ ID NO: 309870 - DNA, 25 bp, Mus musculus
cacttccgctgctagctgaataaca

SEQ ID NO: 309871 - DNA, 25 bp, Mus musculus
cacttccgctgctgcggcagcatat

SEQ ID NO: 309872 - DNA, 25 bp, Mus musculus
cacttccggtacatgggctttggct

SEQ ID NO: 309873 - DNA, 25 bp, Mus musculus
cacttccggtacttgggctttggct

SEQ ID NO: 309874 - DNA, 25 bp, Mus musculus
cacttcctaacacggcaatagctga

SEQ ID NO: 309875 - DNA, 25 bp, Mus musculus
cacttcctaacagggcaatagctga

SEQ ID NO: 309876 - DNA, 25 bp, Mus musculus
cacttcctaatgcttgtatgcccag

SEQ ID NO: 309877 - DNA, 25 bp, Mus musculus
cacttcctaatggttgtatgcccag

SEQ ID NO: 309878 - DNA, 25 bp, Mus musculus
cacttcctaccactttgctgaagaa

SEQ ID NO: 309879 - DNA, 25 bp, Mus musculus
cacttcctaccagtttgctgaagaa

SEQ ID NO: 309880 - DNA, 25 bp, Mus musculus
cacttcctcctaagggaaccagaag

SEQ ID NO: 309881 - DNA, 25 bp, Mus musculus
cacttcctcctatgggaaccagaag

SEQ ID NO: 309882 - DNA, 25 bp, Mus musculus
cacttcctcctcctgtttgttttct

SEQ ID NO: 309883 - DNA, 25 bp, Mus musculus
cacttcctcctcgtgtttgttttct

SEQ ID NO: 309884 - DNA, 25 bp, Mus musculus
cacttcctcgagctgttactgcctg

SEQ ID NO: 309885 - DNA, 25 bp, Mus musculus
cacttcctcgaggtgttactgcctg

SEQ ID NO: 309886 - DNA, 25 bp, Mus musculus
cacttcctctctagctattgtgaat

SEQ ID NO: 309887 - DNA, 25 bp, Mus musculus
cacttcctctcttgctattgtgaat

SEQ ID NO: 309888 - DNA, 25 bp, Mus musculus
cacttcctcttcagggatttcatag

SEQ ID NO: 309889 - DNA, 25 bp, Mus musculus
cacttcctcttctgggatttcatag

SEQ ID NO: 309890 - DNA, 25 bp, Mus musculus
cacttcctgaccctggtattcctct

SEQ ID NO: 309891 - DNA, 25 bp, Mus musculus
cacttcctgaccgtggtattcctct

SEQ ID NO: 309892 - DNA, 25 bp, Mus musculus
cacttcctgcgaaaggctggtttgt

SEQ ID NO: 309893 - DNA, 25 bp, Mus musculus
cacttcctgcgataggctggtttgt

SEQ ID NO: 309894 - DNA, 25 bp, Mus musculus
cacttcctgctacacaaggtggaga

SEQ ID NO: 309895 - DNA, 25 bp, Mus musculus
cacttcctgctagacaaggtggaga

SEQ ID NO: 309896 - DNA, 25 bp, Mus musculus
cacttcctgctgcagttcctgagaa

SEQ ID NO: 309897 - DNA, 25 bp, Mus musculus
cacttcctgctggagttcctgagaa

SEQ ID NO: 309898 - DNA, 25 bp, Mus musculus
cacttcctgggcaaacatcatagat

SEQ ID NO: 309899 - DNA, 25 bp, Mus musculus
cacttcctgggctaacatcatagat

SEQ ID NO: 309900 - DNA, 25 bp, Mus musculus
cacttccttcttcgctgacgttgat

SEQ ID NO: 309901 - DNA, 25 bp, Mus musculus
cacttccttcttggctgacgttgat

SEQ ID NO: 309902 - DNA, 25 bp, Mus musculus
cacttccttggtatccatttctatg

SEQ ID NO: 309903 - DNA, 25 bp, Mus musculus
cacttccttggtttccatttctatg

SEQ ID NO: 309904 - DNA, 25 bp, Mus musculus
cacttcctttagagcccagaatcta

SEQ ID NO: 309905 - DNA, 25 bp, Mus musculus
cacttcctttagtgcccagaatcta

SEQ ID NO: 309906 - DNA, 25 bp, Mus musculus
cacttccttttacaacttttcacag

SEQ ID NO: 309907 - DNA, 25 bp, Mus musculus
cacttccttttagaacttttcacag

SEQ ID NO: 309908 - DNA, 25 bp, Mus musculus
cacttccttttcaggactgtatcta

SEQ ID NO: 309909 - DNA, 25 bp, Mus musculus
cacttccttttctggactgtatcta

SEQ ID NO: 309910 - DNA, 25 bp, Mus musculus
cacttcgcacccaatgtgggctggg

SEQ ID NO: 309911 - DNA, 25 bp, Mus musculus
cacttcgcaccctatgtgggctggg

SEQ ID NO: 309912 - DNA, 25 bp, Mus musculus
cacttcggagcaaacgcagcagaat

SEQ ID NO: 309913 - DNA, 25 bp, Mus musculus
cacttcggagcatacgcagcagaat

SEQ ID NO: 309914 - DNA, 25 bp, Mus musculus
cacttcggagtcctgaatgtctgcc

SEQ ID NO: 309915 - DNA, 25 bp, Mus musculus
cacttcggagtcgtgaatgtctgcc

SEQ ID NO: 309916 - DNA, 25 bp, Mus musculus
cacttcgggcttcgttttcacaggg

SEQ ID NO: 309917 - DNA, 25 bp, Mus musculus
cacttcgggcttggttttcacaggg

SEQ ID NO: 309918 - DNA, 25 bp, Mus musculus
cacttcggtgttcggatctgaggtc

SEQ ID NO: 309919 - DNA, 25 bp, Mus musculus
cacttcggtgttgggatctgaggtc

SEQ ID NO: 309920 - DNA, 25 bp, Mus musculus
cacttcgttctactgactggaatga

SEQ ID NO: 309921 - DNA, 25 bp, Mus musculus
cacttcgttctagtgactggaatga

SEQ ID NO: 309922 - DNA, 25 bp, Mus musculus
cacttctacatccactgtgtttcag

SEQ ID NO: 309923 - DNA, 25 bp, Mus musculus
cacttctacatcgactgtgtttcag

SEQ ID NO: 309924 - DNA, 25 bp, Mus musculus
cacttctaccctatgaaaaactctg

SEQ ID NO: 309925 - DNA, 25 bp, Mus musculus
cacttctaccctttgaaaaactctg

SEQ ID NO: 309926 - DNA, 25 bp, Mus musculus
cacttctagtctacggcatcatcaa

SEQ ID NO: 309927 - DNA, 25 bp, Mus musculus
cacttctagtcttcggcatcatcaa

SEQ ID NO: 309928 - DNA, 25 bp, Mus musculus
cacttctataggagcagatgcattc

SEQ ID NO: 309929 - DNA, 25 bp, Mus musculus
cacttctataggtgcagatgcattc

SEQ ID NO: 309930 - DNA, 25 bp, Mus musculus
cacttctcccagacttttcattcat

SEQ ID NO: 309931 - DNA, 25 bp, Mus musculus
cacttctcccagtcttttcattcat

SEQ ID NO: 309932 - DNA, 25 bp, Mus musculus
cacttctccgcacccagaaccccca

SEQ ID NO: 309933 - DNA, 25 bp, Mus musculus
cacttctccgcagccagaaccccca

SEQ ID NO: 309934 - DNA, 25 bp, Mus musculus
cacttctctgttaccgactctcact

SEQ ID NO: 309935 - DNA, 25 bp, Mus musculus
cacttctctgtttccgactctcact

SEQ ID NO: 309936 - DNA, 25 bp, Mus musculus
cacttctcttccatttattctgaac

SEQ ID NO: 309937 - DNA, 25 bp, Mus musculus
cacttctcttccttttattctgaac

SEQ ID NO: 309938 - DNA, 25 bp, Mus musculus
cacttctgatgtcatgagtctggaa

SEQ ID NO: 309939 - DNA, 25 bp, Mus musculus
cacttctgatgtgatgagtctggaa

SEQ ID NO: 309940 - DNA, 25 bp, Mus musculus
cacttctgcagcaacgcactaaaag

SEQ ID NO: 309941 - DNA, 25 bp, Mus musculus
cacttctgcagctacgcactaaaag

SEQ ID NO: 309942 - DNA, 25 bp, Mus musculus
cacttctgcagtcggacttggagta

SEQ ID NO: 309943 - DNA, 25 bp, Mus musculus
cacttctgcagtgggacttggagta

SEQ ID NO: 309944 - DNA, 25 bp, Mus musculus
cacttctgcttcagagtaggtgagt

SEQ ID NO: 309945 - DNA, 25 bp, Mus musculus
cacttctgcttctgagtaggtgagt

SEQ ID NO: 309946 - DNA, 25 bp, Mus musculus
cacttctgctttcgccaagcacagt

SEQ ID NO: 309947 - DNA, 25 bp, Mus musculus
cacttctgctttggccaagcacagt

SEQ ID NO: 309948 - DNA, 25 bp, Mus musculus
cacttctgggacctttagctgagag

SEQ ID NO: 309949 - DNA, 25 bp, Mus musculus
cacttctgggacgtttagctgagag

SEQ ID NO: 309950 - DNA, 25 bp, Mus musculus
cacttctgggtgattcattcatggt

SEQ ID NO: 309951 - DNA, 25 bp, Mus musculus
cacttctgggtgtttcattcatggt

SEQ ID NO: 309952 - DNA, 25 bp, Mus musculus
cacttctggtttagcttgcctttag

SEQ ID NO: 309953 - DNA, 25 bp, Mus musculus
cacttctggttttgcttgcctttag

SEQ ID NO: 309954 - DNA, 25 bp, Mus musculus
cacttctgtagcaagaaacttatgt

SEQ ID NO: 309955 - DNA, 25 bp, Mus musculus
cacttctgtagctagaaacttatgt

SEQ ID NO: 309956 - DNA, 25 bp, Mus musculus
cacttctgtgagagagctcactttg

SEQ ID NO: 309957 - DNA, 25 bp, Mus musculus
cacttctgtgagtgagctcactttg

SEQ ID NO: 309958 - DNA, 25 bp, Mus musculus
cacttctgtgttatatcccagcaat

SEQ ID NO: 309959 - DNA, 25 bp, Mus musculus
cacttctgtgttttatcccagcaat

SEQ ID NO: 309960 - DNA, 25 bp, Mus musculus
cacttctgttcaactaccctataag

SEQ ID NO: 309961 - DNA, 25 bp, Mus musculus
cacttctgttcatctaccctataag

SEQ ID NO: 309962 - DNA, 25 bp, Mus musculus
cacttcttcacgcaagtctttcaag

SEQ ID NO: 309963 - DNA, 25 bp, Mus musculus
cacttcttcacggaagtctttcaag

SEQ ID NO: 309964 - DNA, 25 bp, Mus musculus
cacttcttcatgctcagggtaactt

SEQ ID NO: 309965 - DNA, 25 bp, Mus musculus
cacttcttcatggtcagggtaactt

SEQ ID NO: 309966 - DNA, 25 bp, Mus musculus
cacttcttcggcaggttttgggata

SEQ ID NO: 309967 - DNA, 25 bp, Mus musculus
cacttcttcggctggttttgggata

SEQ ID NO: 309968 - DNA, 25 bp, Mus musculus
cacttcttctcgattgcaatctgat

SEQ ID NO: 309969 - DNA, 25 bp, Mus musculus
cacttcttctcgtttgcaatctgat

SEQ ID NO: 309970 - DNA, 25 bp, Mus musculus
cacttcttgctacactcgggttgaa

SEQ ID NO: 309971 - DNA, 25 bp, Mus musculus
cacttcttgctagactcgggttgaa

SEQ ID NO: 309972 - DNA, 25 bp, Mus musculus
cacttcttgctcatgcaaggaggcc

SEQ ID NO: 309973 - DNA, 25 bp, Mus musculus
cacttcttgctcttgcaaggaggcc

SEQ ID NO: 309974 - DNA, 25 bp, Mus musculus
cacttcttggttacttgctcctggg

SEQ ID NO: 309975 - DNA, 25 bp, Mus musculus
cacttcttggtttcttgctcctggg

SEQ ID NO: 309976 - DNA, 25 bp, Mus musculus
cacttctttccgcttgtttctggaa

SEQ ID NO: 309977 - DNA, 25 bp, Mus musculus
cacttctttccggttgtttctggaa

SEQ ID NO: 309978 - DNA, 25 bp, Mus musculus
cacttctttcttaccatatgatgtt

SEQ ID NO: 309979 - DNA, 25 bp, Mus musculus
cacttctttcttacttacttctgga

SEQ ID NO: 309980 - DNA, 25 bp, Mus musculus
cacttctttctttccatatgatgtt

SEQ ID NO: 309981 - DNA, 25 bp, Mus musculus
cacttctttctttcttacttctgga

SEQ ID NO: 309982 - DNA, 25 bp, Mus musculus
cacttctttgttcttagttgatccc

SEQ ID NO: 309983 - DNA, 25 bp, Mus musculus
cacttctttgttgttagttgatccc

SEQ ID NO: 309984 - DNA, 25 bp, Mus musculus
cacttcttttccacggctatacata

SEQ ID NO: 309985 - DNA, 25 bp, Mus musculus
cacttcttttcccatcaataaatgt

SEQ ID NO: 309986 - DNA, 25 bp, Mus musculus
cacttcttttccgatcaataaatgt

SEQ ID NO: 309987 - DNA, 25 bp, Mus musculus
cacttcttttcctcggctatacata

SEQ ID NO: 309988 - DNA, 25 bp, Mus musculus
cacttgaaaagtctgtctagattta

SEQ ID NO: 309989 - DNA, 25 bp, Mus musculus
cacttgaaaagtgtgtctagattta

SEQ ID NO: 309990 - DNA, 25 bp, Mus musculus
cacttgaaccctcagaactttcaga

SEQ ID NO: 309991 - DNA, 25 bp, Mus musculus
cacttgaaccctgagaactttcaga

SEQ ID NO: 309992 - DNA, 25 bp, Mus musculus
cacttgaagctgaggtgtcctgagc

SEQ ID NO: 309993 - DNA, 25 bp, Mus musculus
cacttgaagctgcaagcatttgttt

SEQ ID NO: 309994 - DNA, 25 bp, Mus musculus
cacttgaagctggaagcatttgttt

SEQ ID NO: 309995 - DNA, 25 bp, Mus musculus
cacttgaagctgtggtgtcctgagc

SEQ ID NO: 309996 - DNA, 25 bp, Mus musculus
cacttgaattgacctgttttggacc

SEQ ID NO: 309997 - DNA, 25 bp, Mus musculus
cacttgaattgagctgttttggacc

SEQ ID NO: 309998 - DNA, 25 bp, Mus musculus
cacttgacaaacacagttcaccaca

SEQ ID NO: 309999 - DNA, 25 bp, Mus musculus
cacttgacaaactcagttcaccaca

SEQ ID NO: 310000 - DNA, 25 bp, Mus musculus
cacttgactcctattcccaagaaat

SEQ ID NO: 310001 - DNA, 25 bp, Mus musculus
cacttgactccttttcccaagaaat

SEQ ID NO: 310002 - DNA, 25 bp, Mus musculus
cacttgactttaatttgtactggga

SEQ ID NO: 310003 - DNA, 25 bp, Mus musculus
cacttgactttattttgtactggga

SEQ ID NO: 310004 - DNA, 25 bp, Mus musculus
cacttgactttgctattctttttat

SEQ ID NO: 310005 - DNA, 25 bp, Mus musculus
cacttgactttggtattctttttat

SEQ ID NO: 310006 - DNA, 25 bp, Mus musculus
cacttgagactgaatgttgctcttc

SEQ ID NO: 310007 - DNA, 25 bp, Mus musculus
cacttgagactgtatgttgctcttc

SEQ ID NO: 310008 - DNA, 25 bp, Mus musculus
cacttgagagctctgagccagcatt

SEQ ID NO: 310009 - DNA, 25 bp, Mus musculus
cacttgagagctgtgagccagcatt

SEQ ID NO: 310010 - DNA, 25 bp, Mus musculus
cacttgagcttgaggtgagcctttc

SEQ ID NO: 310011 - DNA, 25 bp, Mus musculus
cacttgagcttgtggtgagcctttc

SEQ ID NO: 310012 - DNA, 25 bp, Mus musculus
cacttgaggtttatccaggcgacgg

SEQ ID NO: 310013 - DNA, 25 bp, Mus musculus
cacttgaggtttttccaggcgacgg

SEQ ID NO: 310014 - DNA, 25 bp, Mus musculus
cacttgagtttcagcagagatagcc

SEQ ID NO: 310015 - DNA, 25 bp, Mus musculus
cacttgagtttcagcgtcattattc

SEQ ID NO: 310016 - DNA, 25 bp, Mus musculus
cacttgagtttctgcagagatagcc

SEQ ID NO: 310017 - DNA, 25 bp, Mus musculus
cacttgagtttctgcgtcattattc

SEQ ID NO: 310018 - DNA, 25 bp, Mus musculus
cacttgatggtactgccttgagaac

SEQ ID NO: 310019 - DNA, 25 bp, Mus musculus
cacttgatggtagtgccttgagaac

SEQ ID NO: 310020 - DNA, 25 bp, Mus musculus
cacttgatttacatggtgctgggaa

SEQ ID NO: 310021 - DNA, 25 bp, Mus musculus
cacttgatttacttggtgctgggaa

SEQ ID NO: 310022 - DNA, 25 bp, Mus musculus
cacttgatttgcaggattttggaaa

SEQ ID NO: 310023 - DNA, 25 bp, Mus musculus
cacttgatttgctggattttggaaa

SEQ ID NO: 310024 - DNA, 25 bp, Mus musculus
cacttgcaagtaaaactgaccagag

SEQ ID NO: 310025 - DNA, 25 bp, Mus musculus
cacttgcaagtataactgaccagag

SEQ ID NO: 310026 - DNA, 25 bp, Mus musculus
cacttgcagcctatacccaaattat

SEQ ID NO: 310027 - DNA, 25 bp, Mus musculus
cacttgcagcctttacccaaattat

SEQ ID NO: 310028 - DNA, 25 bp, Mus musculus
cacttgcatgagagacattgtcaca

SEQ ID NO: 310029 - DNA, 25 bp, Mus musculus
cacttgcatgagtgacattgtcaca

SEQ ID NO: 310030 - DNA, 25 bp, Mus musculus
cacttgcatgttatataatacccag

SEQ ID NO: 310031 - DNA, 25 bp, Mus musculus
cacttgcatgttttataatacccag

SEQ ID NO: 310032 - DNA, 25 bp, Mus musculus
cacttgcattagagcttacatacgg

SEQ ID NO: 310033 - DNA, 25 bp, Mus musculus
cacttgcattagtgcttacatacgg

SEQ ID NO: 310034 - DNA, 25 bp, Mus musculus
cacttgccacacatacagatggaag

SEQ ID NO: 310035 - DNA, 25 bp, Mus musculus
cacttgccacacttacagatggaag

SEQ ID NO: 310036 - DNA, 25 bp, Mus musculus
cacttgccctacaaatactcagctg

SEQ ID NO: 310037 - DNA, 25 bp, Mus musculus
cacttgccctactaatactcagctg

SEQ ID NO: 310038 - DNA, 25 bp, Mus musculus
cacttgccctggaggatgagcctga

SEQ ID NO: 310039 - DNA, 25 bp, Mus musculus
cacttgccctggtggatgagcctga

SEQ ID NO: 310040 - DNA, 25 bp, Mus musculus
cacttgcctagacatgtatacttgt

SEQ ID NO: 310041 - DNA, 25 bp, Mus musculus
cacttgcctagagatgtatacttgt

SEQ ID NO: 310042 - DNA, 25 bp, Mus musculus
cacttgcctggaacactttcagtta

SEQ ID NO: 310043 - DNA, 25 bp, Mus musculus
cacttgcctggatcactttcagtta

SEQ ID NO: 310044 - DNA, 25 bp, Mus musculus
cacttgcctgggagcctgaaagcgg

SEQ ID NO: 310045 - DNA, 25 bp, Mus musculus
cacttgcctgggtgcctgaaagcgg

SEQ ID NO: 310046 - DNA, 25 bp, Mus musculus
cacttgccttgtattgactttgtgg

SEQ ID NO: 310047 - DNA, 25 bp, Mus musculus
cacttgccttgttttgactttgtgg

SEQ ID NO: 310048 - DNA, 25 bp, Mus musculus
cacttgcggcaaaggtttttgcaga

SEQ ID NO: 310049 - DNA, 25 bp, Mus musculus
cacttgcggcaatggtttttgcaga

SEQ ID NO: 310050 - DNA, 25 bp, Mus musculus
cacttgctatggctgttgtatctga

SEQ ID NO: 310051 - DNA, 25 bp, Mus musculus
cacttgctatgggtgttgtatctga

SEQ ID NO: 310052 - DNA, 25 bp, Mus musculus
cacttgctcactactgtccttggtg

SEQ ID NO: 310053 - DNA, 25 bp, Mus musculus
cacttgctcacttctgtccttggtg

SEQ ID NO: 310054 - DNA, 25 bp, Mus musculus
cacttgctcgtccatccctcaagag

SEQ ID NO: 310055 - DNA, 25 bp, Mus musculus
cacttgctcgtcgatccctcaagag

SEQ ID NO: 310056 - DNA, 25 bp, Mus musculus
cacttgctgctcacgggaagaactg

SEQ ID NO: 310057 - DNA, 25 bp, Mus musculus
cacttgctgctctcgggaagaactg

SEQ ID NO: 310058 - DNA, 25 bp, Mus musculus
cacttgcttcgaagatgtcaccaaa

SEQ ID NO: 310059 - DNA, 25 bp, Mus musculus
cacttgcttcgatgatgtcaccaaa

SEQ ID NO: 310060 - DNA, 25 bp, Mus musculus
cacttgcttgtgaaacgtgtaccag

SEQ ID NO: 310061 - DNA, 25 bp, Mus musculus
cacttgcttgtgtaacgtgtaccag

SEQ ID NO: 310062 - DNA, 25 bp, Mus musculus
cacttggaaatactccttctacagg

SEQ ID NO: 310063 - DNA, 25 bp, Mus musculus
cacttggaaatagtccttctacagg

SEQ ID NO: 310064 - DNA, 25 bp, Mus musculus
cacttggaaccaacctgaggcattg

SEQ ID NO: 310065 - DNA, 25 bp, Mus musculus
cacttggaaccacagggacgataag

SEQ ID NO: 310066 - DNA, 25 bp, Mus musculus
cacttggaaccagagggacgataag

SEQ ID NO: 310067 - DNA, 25 bp, Mus musculus
cacttggaaccatcctgaggcattg

SEQ ID NO: 310068 - DNA, 25 bp, Mus musculus
cacttggaaggaatgtcgaattgat

SEQ ID NO: 310069 - DNA, 25 bp, Mus musculus
cacttggaaggattgtcgaattgat

SEQ ID NO: 310070 - DNA, 25 bp, Mus musculus
cacttggaaggcaggctagcctggt

SEQ ID NO: 310071 - DNA, 25 bp, Mus musculus
cacttggaaggctggctagcctggt

SEQ ID NO: 310072 - DNA, 25 bp, Mus musculus
cacttggaagtcattcaccctttta

SEQ ID NO: 310073 - DNA, 25 bp, Mus musculus
cacttggaagtctttcaccctttta

SEQ ID NO: 310074 - DNA, 25 bp, Mus musculus
cacttggaagtgctctttttaaagg

SEQ ID NO: 310075 - DNA, 25 bp, Mus musculus
cacttggaagtggtctttttaaagg

SEQ ID NO: 310076 - DNA, 25 bp, Mus musculus
cacttggagtcaatttcaccgaaca

SEQ ID NO: 310077 - DNA, 25 bp, Mus musculus
cacttggagtcattttcaccgaaca

SEQ ID NO: 310078 - DNA, 25 bp, Mus musculus
cacttggcagccatttggattgaaa

SEQ ID NO: 310079 - DNA, 25 bp, Mus musculus
cacttggcagccttttggattgaaa

SEQ ID NO: 310080 - DNA, 25 bp, Mus musculus
cacttggcatgtcccgagcacacag

SEQ ID NO: 310081 - DNA, 25 bp, Mus musculus
cacttggcatgtgccgagcacacag

SEQ ID NO: 310082 - DNA, 25 bp, Mus musculus
cacttggccaggagttttgtggaac

SEQ ID NO: 310083 - DNA, 25 bp, Mus musculus
cacttggccaggtgttttgtggaac

SEQ ID NO: 310084 - DNA, 25 bp, Mus musculus
cacttggcccctcaaaatgtatcta

SEQ ID NO: 310085 - DNA, 25 bp, Mus musculus
cacttggcccctgaaaatgtatcta

SEQ ID NO: 310086 - DNA, 25 bp, Mus musculus
cacttggccttaagctgttgaaata

SEQ ID NO: 310087 - DNA, 25 bp, Mus musculus
cacttggccttatgctgttgaaata

SEQ ID NO: 310088 - DNA, 25 bp, Mus musculus
cacttggcggtgactttgtagagat

SEQ ID NO: 310089 - DNA, 25 bp, Mus musculus
cacttggcggtgtctttgtagagat

SEQ ID NO: 310090 - DNA, 25 bp, Mus musculus
cacttggctcttagctggataatcc

SEQ ID NO: 310091 - DNA, 25 bp, Mus musculus
cacttggctctttgctggataatcc

SEQ ID NO: 310092 - DNA, 25 bp, Mus musculus
cacttgggactaatgacattggtct

SEQ ID NO: 310093 - DNA, 25 bp, Mus musculus
cacttgggactattgacattggtct

SEQ ID NO: 310094 - DNA, 25 bp, Mus musculus
cacttgggacttactccagttggaa

SEQ ID NO: 310095 - DNA, 25 bp, Mus musculus
cacttgggactttctccagttggaa

SEQ ID NO: 310096 - DNA, 25 bp, Mus musculus
cacttgggagccatgaggtcacgtt

SEQ ID NO: 310097 - DNA, 25 bp, Mus musculus
cacttgggagccttgaggtcacgtt

SEQ ID NO: 310098 - DNA, 25 bp, Mus musculus
cacttgggaggcacaagcatggtat

SEQ ID NO: 310099 - DNA, 25 bp, Mus musculus
cacttgggaggctcaagcatggtat

SEQ ID NO: 310100 - DNA, 25 bp, Mus musculus
cacttgggattcaaataaatattaa

SEQ ID NO: 310101 - DNA, 25 bp, Mus musculus
cacttgggattctaataaatattaa

SEQ ID NO: 310102 - DNA, 25 bp, Mus musculus
cacttgggtattatcactgcgttgt

SEQ ID NO: 310103 - DNA, 25 bp, Mus musculus
cacttgggtattttcactgcgttgt

SEQ ID NO: 310104 - DNA, 25 bp, Mus musculus
cacttgggtcttctcttcctgagag

SEQ ID NO: 310105 - DNA, 25 bp, Mus musculus
cacttgggtcttgtcttcctgagag

SEQ ID NO: 310106 - DNA, 25 bp, Mus musculus
cacttgggtgcacgtgagcactcag

SEQ ID NO: 310107 - DNA, 25 bp, Mus musculus
cacttgggtgcaggtgagcactcag

SEQ ID NO: 310108 - DNA, 25 bp, Mus musculus
cacttggtagctcatagcagtctgt

SEQ ID NO: 310109 - DNA, 25 bp, Mus musculus
cacttggtagctgatagcagtctgt

SEQ ID NO: 310110 - DNA, 25 bp, Mus musculus
cacttggtcattctcagtccatgat

SEQ ID NO: 310111 - DNA, 25 bp, Mus musculus
cacttggtcattgtcagtccatgat

SEQ ID NO: 310112 - DNA, 25 bp, Mus musculus
cacttggtgctcatgggaactgctg

SEQ ID NO: 310113 - DNA, 25 bp, Mus musculus
cacttggtgctcttgggaactgctg

SEQ ID NO: 310114 - DNA, 25 bp, Mus musculus
cacttgtaactactgttcctctgag

SEQ ID NO: 310115 - DNA, 25 bp, Mus musculus
cacttgtaactagtgttcctctgag

SEQ ID NO: 310116 - DNA, 25 bp, Mus musculus
cacttgtaatccactatcttcattc

SEQ ID NO: 310117 - DNA, 25 bp, Mus musculus
cacttgtaatcctctatcttcattc

SEQ ID NO: 310118 - DNA, 25 bp, Mus musculus
cacttgtacaagagagtccctgctt

SEQ ID NO: 310119 - DNA, 25 bp, Mus musculus
cacttgtacaagtgagtccctgctt

SEQ ID NO: 310120 - DNA, 25 bp, Mus musculus
cacttgtacgtgaggtgtattctca

SEQ ID NO: 310121 - DNA, 25 bp, Mus musculus
cacttgtacgtgtggtgtattctca

SEQ ID NO: 310122 - DNA, 25 bp, Mus musculus
cacttgtcctttaacatgttagcga

SEQ ID NO: 310123 - DNA, 25 bp, Mus musculus
cacttgtcctttaagatgctttccc

SEQ ID NO: 310124 - DNA, 25 bp, Mus musculus
cacttgtccttttacatgttagcga

SEQ ID NO: 310125 - DNA, 25 bp, Mus musculus
cacttgtccttttagatgctttccc

SEQ ID NO: 310126 - DNA, 25 bp, Mus musculus
cacttgtcttccatcatatacgaaa

SEQ ID NO: 310127 - DNA, 25 bp, Mus musculus
cacttgtcttccttcatatacgaaa

SEQ ID NO: 310128 - DNA, 25 bp, Mus musculus
cacttgtgaatcattgtgtctcagc

SEQ ID NO: 310129 - DNA, 25 bp, Mus musculus
cacttgtgaatctttgtgtctcagc

SEQ ID NO: 310130 - DNA, 25 bp, Mus musculus
cacttgtgccgtagagcctaaggaa

SEQ ID NO: 310131 - DNA, 25 bp, Mus musculus
cacttgtgccgttgagcctaaggaa

SEQ ID NO: 310132 - DNA, 25 bp, Mus musculus
cacttgtgtagcctgctgtgtagac

SEQ ID NO: 310133 - DNA, 25 bp, Mus musculus
cacttgtgtagcgtgctgtgtagac

SEQ ID NO: 310134 - DNA, 25 bp, Mus musculus
cacttgtgtatccaaattgccccaa

SEQ ID NO: 310135 - DNA, 25 bp, Mus musculus
cacttgtgtatcgaaattgccccaa

SEQ ID NO: 310136 - DNA, 25 bp, Mus musculus
cacttgttaatactgctgtttctgg

SEQ ID NO: 310137 - DNA, 25 bp, Mus musculus
cacttgttaatagtgctgtttctgg

SEQ ID NO: 310138 - DNA, 25 bp, Mus musculus
cacttgttagtgactttgatgcctt

SEQ ID NO: 310139 - DNA, 25 bp, Mus musculus
cacttgttagtgcaccatgtgccaa

SEQ ID NO: 310140 - DNA, 25 bp, Mus musculus
cacttgttagtggaccatgtgccaa

SEQ ID NO: 310141 - DNA, 25 bp, Mus musculus
cacttgttagtgtctttgatgcctt

SEQ ID NO: 310142 - DNA, 25 bp, Mus musculus
cacttgttatctactggctcagctg

SEQ ID NO: 310143 - DNA, 25 bp, Mus musculus
cacttgttatcttctggctcagctg

SEQ ID NO: 310144 - DNA, 25 bp, Mus musculus
cacttgttattgagaaatgcttcga

SEQ ID NO: 310145 - DNA, 25 bp, Mus musculus
cacttgttattgtgaaatgcttcga

SEQ ID NO: 310146 - DNA, 25 bp, Mus musculus
cacttgttcatgattatctaccaga

SEQ ID NO: 310147 - DNA, 25 bp, Mus musculus
cacttgttcatgtttatctaccaga

SEQ ID NO: 310148 - DNA, 25 bp, Mus musculus
cacttgttgagtctttgggaacttg

SEQ ID NO: 310149 - DNA, 25 bp, Mus musculus
cacttgttgagtgtttgggaacttg

SEQ ID NO: 310150 - DNA, 25 bp, Mus musculus
cacttgtttctgaatattcctttta

SEQ ID NO: 310151 - DNA, 25 bp, Mus musculus
cacttgtttctgtatattcctttta

SEQ ID NO: 310152 - DNA, 25 bp, Mus musculus
cactttaaaaggattgttctcagga

SEQ ID NO: 310153 - DNA, 25 bp, Mus musculus
cactttaaaaggtttgttctcagga

SEQ ID NO: 310154 - DNA, 25 bp, Mus musculus
cactttaaagccattgtttcccaat

SEQ ID NO: 310155 - DNA, 25 bp, Mus musculus
cactttaaagcctttgtttcccaat

SEQ ID NO: 310156 - DNA, 25 bp, Mus musculus
cactttaaatcacctctaatcctac

SEQ ID NO: 310157 - DNA, 25 bp, Mus musculus
cactttaaatcagctctaatcctac

SEQ ID NO: 310158 - DNA, 25 bp, Mus musculus
cactttaacagcagttcccgaaagg

SEQ ID NO: 310159 - DNA, 25 bp, Mus musculus
cactttaacagctgttcccgaaagg

SEQ ID NO: 310160 - DNA, 25 bp, Mus musculus
cactttaacgctataatgccttgga

SEQ ID NO: 310161 - DNA, 25 bp, Mus musculus
cactttaacgctttaatgccttgga

SEQ ID NO: 310162 - DNA, 25 bp, Mus musculus
cactttaagctgaatttcatcctac

SEQ ID NO: 310163 - DNA, 25 bp, Mus musculus
cactttaagctgtatttcatcctac

SEQ ID NO: 310164 - DNA, 25 bp, Mus musculus
cactttacagagcacagtggcctga

SEQ ID NO: 310165 - DNA, 25 bp, Mus musculus
cactttacagaggacagtggcctga

SEQ ID NO: 310166 - DNA, 25 bp, Mus musculus
cactttacagctcatgcggccttgc

SEQ ID NO: 310167 - DNA, 25 bp, Mus musculus
cactttacagctgatgcggccttgc

SEQ ID NO: 310168 - DNA, 25 bp, Mus musculus
cactttacagtgatagatctggtga

SEQ ID NO: 310169 - DNA, 25 bp, Mus musculus
cactttacagtgttagatctggtga

SEQ ID NO: 310170 - DNA, 25 bp, Mus musculus
cactttaccatcagggacagattaa

SEQ ID NO: 310171 - DNA, 25 bp, Mus musculus
cactttaccatctgggacagattaa

SEQ ID NO: 310172 - DNA, 25 bp, Mus musculus
cactttacccctagctgtagggaat

SEQ ID NO: 310173 - DNA, 25 bp, Mus musculus
cactttaccccttgctgtagggaat

SEQ ID NO: 310174 - DNA, 25 bp, Mus musculus
cactttacctctccagtatgcaaat

SEQ ID NO: 310175 - DNA, 25 bp, Mus musculus
cactttacctctgcagtatgcaaat

SEQ ID NO: 310176 - DNA, 25 bp, Mus musculus
cactttactgaacgtgttgccagca

SEQ ID NO: 310177 - DNA, 25 bp, Mus musculus
cactttactgaaggtgttgccagca

SEQ ID NO: 310178 - DNA, 25 bp, Mus musculus
cactttagacaaaccattcaggaga

SEQ ID NO: 310179 - DNA, 25 bp, Mus musculus
cactttagacaatccattcaggaga

SEQ ID NO: 310180 - DNA, 25 bp, Mus musculus
cactttagcgtcctcaaactttgat

SEQ ID NO: 310181 - DNA, 25 bp, Mus musculus
cactttagcgtcgtcaaactttgat

SEQ ID NO: 310182 - DNA, 25 bp, Mus musculus
cactttagcttcaaggaacttggca

SEQ ID NO: 310183 - DNA, 25 bp, Mus musculus
cactttagcttctaggaacttggca

SEQ ID NO: 310184 - DNA, 25 bp, Mus musculus
cactttaggaatccagcagtgcaga

SEQ ID NO: 310185 - DNA, 25 bp, Mus musculus
cactttaggaatgcagcagtgcaga

SEQ ID NO: 310186 - DNA, 25 bp, Mus musculus
cactttaggcagagcaggctgatct

SEQ ID NO: 310187 - DNA, 25 bp, Mus musculus
cactttaggcagtgcaggctgatct

SEQ ID NO: 310188 - DNA, 25 bp, Mus musculus
cactttatcccacaacccattttat

SEQ ID NO: 310189 - DNA, 25 bp, Mus musculus
cactttatcccagaacccattttat

SEQ ID NO: 310190 - DNA, 25 bp, Mus musculus
cactttatgaaacctgtacagggca

SEQ ID NO: 310191 - DNA, 25 bp, Mus musculus
cactttatgaaagctgtacagggca

SEQ ID NO: 310192 - DNA, 25 bp, Mus musculus
cactttatttatacggttcttgctt

SEQ ID NO: 310193 - DNA, 25 bp, Mus musculus
cactttatttattcggttcttgctt

SEQ ID NO: 310194 - DNA, 25 bp, Mus musculus
cactttatttctactatgtagcagc

SEQ ID NO: 310195 - DNA, 25 bp, Mus musculus
cactttatttcttctatgtagcagc

SEQ ID NO: 310196 - DNA, 25 bp, Mus musculus
cactttcagtgtcccaaatggccta

SEQ ID NO: 310197 - DNA, 25 bp, Mus musculus
cactttcagtgtcttgatctccaga

SEQ ID NO: 310198 - DNA, 25 bp, Mus musculus
cactttcagtgtgccaaatggccta

SEQ ID NO: 310199 - DNA, 25 bp, Mus musculus
cactttcagtgtgttgatctccaga

SEQ ID NO: 310200 - DNA, 25 bp, Mus musculus
cactttcatgtaattttcgtgtgac

SEQ ID NO: 310201 - DNA, 25 bp, Mus musculus
cactttcatgtatttttcgtgtgac

SEQ ID NO: 310202 - DNA, 25 bp, Mus musculus
cactttccaaagcacaaaacagttt

SEQ ID NO: 310203 - DNA, 25 bp, Mus musculus
cactttccaaaggacaaaacagttt

SEQ ID NO: 310204 - DNA, 25 bp, Mus musculus
cactttccacacagcccagggtaaa

SEQ ID NO: 310205 - DNA, 25 bp, Mus musculus
cactttccacactgcccagggtaaa

SEQ ID NO: 310206 - DNA, 25 bp, Mus musculus
cactttccacagatggacgtggtgt

SEQ ID NO: 310207 - DNA, 25 bp, Mus musculus
cactttccacagttggacgtggtgt

SEQ ID NO: 310208 - DNA, 25 bp, Mus musculus
cactttccatatcatttgtttttgt

SEQ ID NO: 310209 - DNA, 25 bp, Mus musculus
cactttccatatgatttgtttttgt

SEQ ID NO: 310210 - DNA, 25 bp, Mus musculus
cactttccatgaccgtcacaaacat

SEQ ID NO: 310211 - DNA, 25 bp, Mus musculus
cactttccatgagcgtcacaaacat

SEQ ID NO: 310212 - DNA, 25 bp, Mus musculus
cactttcccagcacataatgtcaga

SEQ ID NO: 310213 - DNA, 25 bp, Mus musculus
cactttcccagctcataatgtcaga

SEQ ID NO: 310214 - DNA, 25 bp, Mus musculus
cactttcctcttctcttattaaact

SEQ ID NO: 310215 - DNA, 25 bp, Mus musculus
cactttcctcttgtcttattaaact

SEQ ID NO: 310216 - DNA, 25 bp, Mus musculus
cactttcctgacctgacgttatatt

SEQ ID NO: 310217 - DNA, 25 bp, Mus musculus
cactttcctgacgtgacgttatatt

SEQ ID NO: 310218 - DNA, 25 bp, Mus musculus
cactttcctgtaccatattgcttat

SEQ ID NO: 310219 - DNA, 25 bp, Mus musculus
cactttcctgtagcatattgcttat

SEQ ID NO: 310220 - DNA, 25 bp, Mus musculus
cactttccttccctaccagtgaaat

SEQ ID NO: 310221 - DNA, 25 bp, Mus musculus
cactttccttccgtaccagtgaaat

SEQ ID NO: 310222 - DNA, 25 bp, Mus musculus
cactttcgttttccacatcaatcct

SEQ ID NO: 310223 - DNA, 25 bp, Mus musculus
cactttcgttttgcacatcaatcct

SEQ ID NO: 310224 - DNA, 25 bp, Mus musculus
cactttctaccactgttctcagata

SEQ ID NO: 310225 - DNA, 25 bp, Mus musculus
cactttctaccagtgttctcagata

SEQ ID NO: 310226 - DNA, 25 bp, Mus musculus
cactttctagacaatactactaacg

SEQ ID NO: 310227 - DNA, 25 bp, Mus musculus
cactttctagactatactactaacg

SEQ ID NO: 310228 - DNA, 25 bp, Mus musculus
cactttctcagtatcgatttggttt

SEQ ID NO: 310229 - DNA, 25 bp, Mus musculus
cactttctcagtttcgatttggttt

SEQ ID NO: 310230 - DNA, 25 bp, Mus musculus
cactttctctcaacactgaggtaat

SEQ ID NO: 310231 - DNA, 25 bp, Mus musculus
cactttctctcatcactgaggtaat

SEQ ID NO: 310232 - DNA, 25 bp, Mus musculus
cactttctgacacgtgtgtgcgcct

SEQ ID NO: 310233 - DNA, 25 bp, Mus musculus
cactttctgacaggtgtgtgcgcct

SEQ ID NO: 310234 - DNA, 25 bp, Mus musculus
cactttctggacagactgatactat

SEQ ID NO: 310235 - DNA, 25 bp, Mus musculus
cactttctggactgactgatactat

SEQ ID NO: 310236 - DNA, 25 bp, Mus musculus
cactttcttgaacccagaaccaggg

SEQ ID NO: 310237 - DNA, 25 bp, Mus musculus
cactttcttgaagccagaaccaggg

SEQ ID NO: 310238 - DNA, 25 bp, Mus musculus
cactttcttgacaggtatttcatag

SEQ ID NO: 310239 - DNA, 25 bp, Mus musculus
cactttcttgactggtatttcatag

SEQ ID NO: 310240 - DNA, 25 bp, Mus musculus
cactttgaacacagtcgggagctgc

SEQ ID NO: 310241 - DNA, 25 bp, Mus musculus
cactttgaacactgtcgggagctgc

SEQ ID NO: 310242 - DNA, 25 bp, Mus musculus
cactttgaaccgcagaggctaacct

SEQ ID NO: 310243 - DNA, 25 bp, Mus musculus
cactttgaaccggagaggctaacct

SEQ ID NO: 310244 - DNA, 25 bp, Mus musculus
cactttgacacacttcctaatgctt

SEQ ID NO: 310245 - DNA, 25 bp, Mus musculus
cactttgacacagttcctaatgctt

SEQ ID NO: 310246 - DNA, 25 bp, Mus musculus
cactttgaccaaatattccctggat

SEQ ID NO: 310247 - DNA, 25 bp, Mus musculus
cactttgaccaattattccctggat

SEQ ID NO: 310248 - DNA, 25 bp, Mus musculus
cactttgaccagcagagcagcaata

SEQ ID NO: 310249 - DNA, 25 bp, Mus musculus
cactttgaccaggagagcagcaata

SEQ ID NO: 310250 - DNA, 25 bp, Mus musculus
cactttgagagcacataattcagag

SEQ ID NO: 310251 - DNA, 25 bp, Mus musculus
cactttgagagctcataattcagag

SEQ ID NO: 310252 - DNA, 25 bp, Mus musculus
cactttgaggcgctggattttaaga

SEQ ID NO: 310253 - DNA, 25 bp, Mus musculus
cactttgaggcggtggattttaaga

SEQ ID NO: 310254 - DNA, 25 bp, Mus musculus
cactttgagggcacataaatactag

SEQ ID NO: 310255 - DNA, 25 bp, Mus musculus
cactttgagggctcataaatactag

SEQ ID NO: 310256 - DNA, 25 bp, Mus musculus
cactttgagtgtccggagcagcaga

SEQ ID NO: 310257 - DNA, 25 bp, Mus musculus
cactttgagtgtgcggagcagcaga

SEQ ID NO: 310258 - DNA, 25 bp, Mus musculus
cactttgatgtaagccacggctctg

SEQ ID NO: 310259 - DNA, 25 bp, Mus musculus
cactttgatgtatgccacggctctg

SEQ ID NO: 310260 - DNA, 25 bp, Mus musculus
cactttgatttcattaactcttagg

SEQ ID NO: 310261 - DNA, 25 bp, Mus musculus
cactttgatttctttaactcttagg

SEQ ID NO: 310262 - DNA, 25 bp, Mus musculus
cactttgcagtgatcgttccttttc

SEQ ID NO: 310263 - DNA, 25 bp, Mus musculus
cactttgcagtgttcgttccttttc

SEQ ID NO: 310264 - DNA, 25 bp, Mus musculus
cactttgccggtcctaaacaggaga

SEQ ID NO: 310265 - DNA, 25 bp, Mus musculus
cactttgccggtgctaaacaggaga

SEQ ID NO: 310266 - DNA, 25 bp, Mus musculus
cactttgctccaagtcacccagatg

SEQ ID NO: 310267 - DNA, 25 bp, Mus musculus
cactttgctccatgtcacccagatg

SEQ ID NO: 310268 - DNA, 25 bp, Mus musculus
cactttgctcccagcgttgaaaaag

SEQ ID NO: 310269 - DNA, 25 bp, Mus musculus
cactttgctccctgcgttgaaaaag

SEQ ID NO: 310270 - DNA, 25 bp, Mus musculus
cactttgctctgacatctttgtaga

SEQ ID NO: 310271 - DNA, 25 bp, Mus musculus
cactttgctctgtcatctttgtaga

SEQ ID NO: 310272 - DNA, 25 bp, Mus musculus
cactttgctgctcactacagttatt

SEQ ID NO: 310273 - DNA, 25 bp, Mus musculus
cactttgctgctgactacagttatt

SEQ ID NO: 310274 - DNA, 25 bp, Mus musculus
cactttgctttgctaggagctttca

SEQ ID NO: 310275 - DNA, 25 bp, Mus musculus
cactttgctttggtaggagctttca

SEQ ID NO: 310276 - DNA, 25 bp, Mus musculus
cactttggccatagtctatttgaca

SEQ ID NO: 310277 - DNA, 25 bp, Mus musculus
cactttggccattgtctatttgaca

SEQ ID NO: 310278 - DNA, 25 bp, Mus musculus
cactttggtgaactttcatgtgctt

SEQ ID NO: 310279 - DNA, 25 bp, Mus musculus
cactttggtgaagtttcatgtgctt

SEQ ID NO: 310280 - DNA, 25 bp, Mus musculus
cactttggtggaatcgtttcccgag

SEQ ID NO: 310281 - DNA, 25 bp, Mus musculus
cactttggtggattcgtttcccgag

SEQ ID NO: 310282 - DNA, 25 bp, Mus musculus
cactttgtaaccctacatatgaaaa

SEQ ID NO: 310283 - DNA, 25 bp, Mus musculus
cactttgtaaccgtacatatgaaaa

SEQ ID NO: 310284 - DNA, 25 bp, Mus musculus
cactttgtaactaaggctgccttaa

SEQ ID NO: 310285 - DNA, 25 bp, Mus musculus
cactttgtaacttaggctgccttaa

SEQ ID NO: 310286 - DNA, 25 bp, Mus musculus
cactttgtatgtatcaaatcaggta

SEQ ID NO: 310287 - DNA, 25 bp, Mus musculus
cactttgtatgtttcaaatcaggta

SEQ ID NO: 310288 - DNA, 25 bp, Mus musculus
cactttgtcctgaccatttatcata

SEQ ID NO: 310289 - DNA, 25 bp, Mus musculus
cactttgtcctgtccatttatcata

SEQ ID NO: 310290 - DNA, 25 bp, Mus musculus
cactttgtggccatatggtgtcaga

SEQ ID NO: 310291 - DNA, 25 bp, Mus musculus
cactttgtggccctggaagattatt

SEQ ID NO: 310292 - DNA, 25 bp, Mus musculus
cactttgtggccgtggaagattatt

SEQ ID NO: 310293 - DNA, 25 bp, Mus musculus
cactttgtggccttatggtgtcaga

SEQ ID NO: 310294 - DNA, 25 bp, Mus musculus
cactttgtggttaatgctgtttctt

SEQ ID NO: 310295 - DNA, 25 bp, Mus musculus
cactttgtggttcacacttttccct

SEQ ID NO: 310296 - DNA, 25 bp, Mus musculus
cactttgtggttgacacttttccct

SEQ ID NO: 310297 - DNA, 25 bp, Mus musculus
cactttgtggtttatgctgtttctt

SEQ ID NO: 310298 - DNA, 25 bp, Mus musculus
cactttgtgtgtctccttgattcaa

SEQ ID NO: 310299 - DNA, 25 bp, Mus musculus
cactttgtgtgtgtccttgattcaa

SEQ ID NO: 310300 - DNA, 25 bp, Mus musculus
cactttgttcaacttcttcggtggg

SEQ ID NO: 310301 - DNA, 25 bp, Mus musculus
cactttgttcaagttcttcggtggg

SEQ ID NO: 310302 - DNA, 25 bp, Mus musculus
cactttgttccccagagacctggaa

SEQ ID NO: 310303 - DNA, 25 bp, Mus musculus
cactttgttcccgagagacctggaa

SEQ ID NO: 310304 - DNA, 25 bp, Mus musculus
cactttgttgttataccccaggact

SEQ ID NO: 310305 - DNA, 25 bp, Mus musculus
cactttgttgttttaccccaggact

SEQ ID NO: 310306 - DNA, 25 bp, Mus musculus
cactttgtttacctacctgcagcat

SEQ ID NO: 310307 - DNA, 25 bp, Mus musculus
cactttgtttacgtacctgcagcat

SEQ ID NO: 310308 - DNA, 25 bp, Mus musculus
cactttgtttgtcccaggagtaaca

SEQ ID NO: 310309 - DNA, 25 bp, Mus musculus
cactttgtttgtgccaggagtaaca

SEQ ID NO: 310310 - DNA, 25 bp, Mus musculus
cacttttacaagccgcaaaggcagc

SEQ ID NO: 310311 - DNA, 25 bp, Mus musculus
cacttttacaaggcgcaaaggcagc

SEQ ID NO: 310312 - DNA, 25 bp, Mus musculus
cacttttacttcattccctgacagg

SEQ ID NO: 310313 - DNA, 25 bp, Mus musculus
cacttttacttctttccctgacagg

SEQ ID NO: 310314 - DNA, 25 bp, Mus musculus
cacttttagaagaaaatacgtagct

SEQ ID NO: 310315 - DNA, 25 bp, Mus musculus
cacttttagaagtaaatacgtagct

SEQ ID NO: 310316 - DNA, 25 bp, Mus musculus
cacttttaggataactagccctgga

SEQ ID NO: 310317 - DNA, 25 bp, Mus musculus
cacttttaggattactagccctgga

SEQ ID NO: 310318 - DNA, 25 bp, Mus musculus
cacttttatctgatggaaccgaaca

SEQ ID NO: 310319 - DNA, 25 bp, Mus musculus
cacttttatctgttggaaccgaaca

SEQ ID NO: 310320 - DNA, 25 bp, Mus musculus
cacttttcattcatcagaggtttat

SEQ ID NO: 310321 - DNA, 25 bp, Mus musculus
cacttttcattcttcagaggtttat

SEQ ID NO: 310322 - DNA, 25 bp, Mus musculus
cacttttccataactgcttctgtaa

SEQ ID NO: 310323 - DNA, 25 bp, Mus musculus
cacttttccatatctgcttctgtaa

SEQ ID NO: 310324 - DNA, 25 bp, Mus musculus
cacttttccatcaaattgagtcaaa

SEQ ID NO: 310325 - DNA, 25 bp, Mus musculus
cacttttccatctaattgagtcaaa

SEQ ID NO: 310326 - DNA, 25 bp, Mus musculus
cacttttccctgaattcttagtggg

SEQ ID NO: 310327 - DNA, 25 bp, Mus musculus
cacttttccctgtattcttagtggg

SEQ ID NO: 310328 - DNA, 25 bp, Mus musculus
cacttttcgctgacattgggttttc

SEQ ID NO: 310329 - DNA, 25 bp, Mus musculus
cacttttcgctgtcattgggttttc

SEQ ID NO: 310330 - DNA, 25 bp, Mus musculus
cacttttctactatgggctctgggt

SEQ ID NO: 310331 - DNA, 25 bp, Mus musculus
cacttttctactttgggctctgggt

SEQ ID NO: 310332 - DNA, 25 bp, Mus musculus
cacttttctctgcagctcatcgaac

SEQ ID NO: 310333 - DNA, 25 bp, Mus musculus
cacttttctctggagctcatcgaac

SEQ ID NO: 310334 - DNA, 25 bp, Mus musculus
cacttttctgtgcttcttttattgt

SEQ ID NO: 310335 - DNA, 25 bp, Mus musculus
cacttttctgtggttcttttattgt

SEQ ID NO: 310336 - DNA, 25 bp, Mus musculus
cacttttgaagacagggtgggctca

SEQ ID NO: 310337 - DNA, 25 bp, Mus musculus
cacttttgaagagagggtgggctca

SEQ ID NO: 310338 - DNA, 25 bp, Mus musculus
cacttttgaattcccctgcaggttt

SEQ ID NO: 310339 - DNA, 25 bp, Mus musculus
cacttttgaattgccctgcaggttt

SEQ ID NO: 310340 - DNA, 25 bp, Mus musculus
cacttttgacttacctgttgaagag

SEQ ID NO: 310341 - DNA, 25 bp, Mus musculus
cacttttgactttcctgttgaagag

SEQ ID NO: 310342 - DNA, 25 bp, Mus musculus
cacttttgagctcttaatgtgaaac

SEQ ID NO: 310343 - DNA, 25 bp, Mus musculus
cacttttgagctgttaatgtgaaac

SEQ ID NO: 310344 - DNA, 25 bp, Mus musculus
cacttttgataacctacgtacgaga

SEQ ID NO: 310345 - DNA, 25 bp, Mus musculus
cacttttgataagctacgtacgaga

SEQ ID NO: 310346 - DNA, 25 bp, Mus musculus
cacttttgatctcggtgggcatgag

SEQ ID NO: 310347 - DNA, 25 bp, Mus musculus
cacttttgatctgggtgggcatgag

SEQ ID NO: 310348 - DNA, 25 bp, Mus musculus
cacttttggtttcccaccggaggag

SEQ ID NO: 310349 - DNA, 25 bp, Mus musculus
cacttttggtttgccaccggaggag

SEQ ID NO: 310350 - DNA, 25 bp, Mus musculus
cacttttgtagtcctttccgttctg

SEQ ID NO: 310351 - DNA, 25 bp, Mus musculus
cacttttgtagtgctttccgttctg

SEQ ID NO: 310352 - DNA, 25 bp, Mus musculus
cacttttgtattccgttttctcact

SEQ ID NO: 310353 - DNA, 25 bp, Mus musculus
cacttttgtattgcgttttctcact

SEQ ID NO: 310354 - DNA, 25 bp, Mus musculus
cacttttgtccactgagctttggaa

SEQ ID NO: 310355 - DNA, 25 bp, Mus musculus
cacttttgtccagtgagctttggaa

SEQ ID NO: 310356 - DNA, 25 bp, Mus musculus
cacttttgtgaaaaccgccctactg

SEQ ID NO: 310357 - DNA, 25 bp, Mus musculus
cacttttgtgaataccgccctactg

SEQ ID NO: 310358 - DNA, 25 bp, Mus musculus
cacttttgttacagttggctgcaag

SEQ ID NO: 310359 - DNA, 25 bp, Mus musculus
cacttttgttactgttggctgcaag

SEQ ID NO: 310360 - DNA, 25 bp, Mus musculus
cactttttaaacatgggcttgccga

SEQ ID NO: 310361 - DNA, 25 bp, Mus musculus
cactttttaaacttgggcttgccga

SEQ ID NO: 310362 - DNA, 25 bp, Mus musculus
cactttttatccctcccaggaatat

SEQ ID NO: 310363 - DNA, 25 bp, Mus musculus
cactttttatccgtcccaggaatat

SEQ ID NO: 310364 - DNA, 25 bp, Mus musculus
cactttttcaatccctgctagagag

SEQ ID NO: 310365 - DNA, 25 bp, Mus musculus
cactttttcaatgcctgctagagag

SEQ ID NO: 310366 - DNA, 25 bp, Mus musculus
cactttttcagcatgctataacccc

SEQ ID NO: 310367 - DNA, 25 bp, Mus musculus
cactttttcagcttgctataacccc

SEQ ID NO: 310368 - DNA, 25 bp, Mus musculus
cactttttctggacagccccaaaag

SEQ ID NO: 310369 - DNA, 25 bp, Mus musculus
cactttttctggtcagccccaaaag

SEQ ID NO: 310370 - DNA, 25 bp, Mus musculus
cactttttgacaaagctcacataga

SEQ ID NO: 310371 - DNA, 25 bp, Mus musculus
cactttttgacatagctcacataga

SEQ ID NO: 310372 - DNA, 25 bp, Mus musculus
cactttttgaggatgcctgccagca

SEQ ID NO: 310373 - DNA, 25 bp, Mus musculus
cactttttgaggttgcctgccagca

SEQ ID NO: 310374 - DNA, 25 bp, Mus musculus
cactttttgccactttattcccatt

SEQ ID NO: 310375 - DNA, 25 bp, Mus musculus
cactttttgccagtttattcccatt

SEQ ID NO: 310376 - DNA, 25 bp, Mus musculus
cactttttgcttccctgctctaaat

SEQ ID NO: 310377 - DNA, 25 bp, Mus musculus
cactttttgcttgcctgctctaaat

SEQ ID NO: 310378 - DNA, 25 bp, Mus musculus
cactttttgtgccttgtattatcag

SEQ ID NO: 310379 - DNA, 25 bp, Mus musculus
cactttttgtgcgttgtattatcag

SEQ ID NO: 310380 - DNA, 25 bp, Mus musculus
cactttttgtggcactactgcagca

SEQ ID NO: 310381 - DNA, 25 bp, Mus musculus
cactttttgtgggactactgcagca

SEQ ID NO: 310382 - DNA, 25 bp, Mus musculus
cagaaaaacttaaggctgaagcctg

SEQ ID NO: 310383 - DNA, 25 bp, Mus musculus
cagaaaaacttatggctgaagcctg

SEQ ID NO: 310384 - DNA, 25 bp, Mus musculus
cagaaaaatacaagttgtcccaaca

SEQ ID NO: 310385 - DNA, 25 bp, Mus musculus
cagaaaaatacatgttgtcccaaca

SEQ ID NO: 310386 - DNA, 25 bp, Mus musculus
cagaaaaatcctccaggactacaaa

SEQ ID NO: 310387 - DNA, 25 bp, Mus musculus
cagaaaaatcctgcaggactacaaa

SEQ ID NO: 310388 - DNA, 25 bp, Mus musculus
cagaaaacaggtcctgcctagggct

SEQ ID NO: 310389 - DNA, 25 bp, Mus musculus
cagaaaacaggtgctgcctagggct

SEQ ID NO: 310390 - DNA, 25 bp, Mus musculus
cagaaaacagtactaacagctcctc

SEQ ID NO: 310391 - DNA, 25 bp, Mus musculus
cagaaaacagtagtaacagctcctc

SEQ ID NO: 310392 - DNA, 25 bp, Mus musculus
cagaaaaccaaacttcaggacagac

SEQ ID NO: 310393 - DNA, 25 bp, Mus musculus
cagaaaaccaaagttcaggacagac

SEQ ID NO: 310394 - DNA, 25 bp, Mus musculus
cagaaaaccattaacaaccacctct

SEQ ID NO: 310395 - DNA, 25 bp, Mus musculus
cagaaaaccatttacaaccacctct

SEQ ID NO: 310396 - DNA, 25 bp, Mus musculus
cagaaaacccacctggaagaagcaa

SEQ ID NO: 310397 - DNA, 25 bp, Mus musculus
cagaaaacccacgtggaagaagcaa

SEQ ID NO: 310398 - DNA, 25 bp, Mus musculus
cagaaaacccagatataacagtgtt

SEQ ID NO: 310399 - DNA, 25 bp, Mus musculus
cagaaaacccagttataacagtgtt

SEQ ID NO: 310400 - DNA, 25 bp, Mus musculus
cagaaaacgctcatcaacgtttatt

SEQ ID NO: 310401 - DNA, 25 bp, Mus musculus
cagaaaacgctcttcaacgtttatt

SEQ ID NO: 310402 - DNA, 25 bp, Mus musculus
cagaaaacgtggctcttcttggata

SEQ ID NO: 310403 - DNA, 25 bp, Mus musculus
cagaaaacgtgggtcttcttggata

SEQ ID NO: 310404 - DNA, 25 bp, Mus musculus
cagaaaactctgctctgcattttaa

SEQ ID NO: 310405 - DNA, 25 bp, Mus musculus
cagaaaactctggtctgcattttaa

SEQ ID NO: 310406 - DNA, 25 bp, Mus musculus
cagaaaactgagcttacggtgacta

SEQ ID NO: 310407 - DNA, 25 bp, Mus musculus
cagaaaactgaggttacggtgacta

SEQ ID NO: 310408 - DNA, 25 bp, Mus musculus
cagaaaacttgtcccctaaattata

SEQ ID NO: 310409 - DNA, 25 bp, Mus musculus
cagaaaacttgtgccctaaattata

SEQ ID NO: 310410 - DNA, 25 bp, Mus musculus
cagaaaagatgacctccccaccata

SEQ ID NO: 310411 - DNA, 25 bp, Mus musculus
cagaaaagatgagctccccaccata

SEQ ID NO: 310412 - DNA, 25 bp, Mus musculus
cagaaaaggcccagggaacccgcat

SEQ ID NO: 310413 - DNA, 25 bp, Mus musculus
cagaaaaggccctgggaacccgcat

SEQ ID NO: 310414 - DNA, 25 bp, Mus musculus
cagaaaaggcggaccagggcctgat

SEQ ID NO: 310415 - DNA, 25 bp, Mus musculus
cagaaaaggcggtccagggcctgat

SEQ ID NO: 310416 - DNA, 25 bp, Mus musculus
cagaaaagggctcctgtaaccttcc

SEQ ID NO: 310417 - DNA, 25 bp, Mus musculus
cagaaaagggctgctgtaaccttcc

SEQ ID NO: 310418 - DNA, 25 bp, Mus musculus
cagaaaatccaacagggccgagttt

SEQ ID NO: 310419 - DNA, 25 bp, Mus musculus
cagaaaatccaagagggccgagttt

SEQ ID NO: 310420 - DNA, 25 bp, Mus musculus
cagaaaatctgtcttctaggcttcc

SEQ ID NO: 310421 - DNA, 25 bp, Mus musculus
cagaaaatctgtgttctaggcttcc

SEQ ID NO: 310422 - DNA, 25 bp, Mus musculus
cagaaaatgaatccagggctggcga

SEQ ID NO: 310423 - DNA, 25 bp, Mus musculus
cagaaaatgaatgcagggctggcga

SEQ ID NO: 310424 - DNA, 25 bp, Mus musculus
cagaaaatgagcaccgcgctgcgga

SEQ ID NO: 310425 - DNA, 25 bp, Mus musculus
cagaaaatgagctccgcgctgcgga

SEQ ID NO: 310426 - DNA, 25 bp, Mus musculus
cagaaaatgttgatgctaacccacc

SEQ ID NO: 310427 - DNA, 25 bp, Mus musculus
cagaaaatgttgttgctaacccacc

SEQ ID NO: 310428 - DNA, 25 bp, Mus musculus
cagaaaattgaaagccccagggccc

SEQ ID NO: 310429 - DNA, 25 bp, Mus musculus
cagaaaattgaatgccccagggccc

SEQ ID NO: 310430 - DNA, 25 bp, Mus musculus
cagaaacaatgcagccaagctgatt

SEQ ID NO: 310431 - DNA, 25 bp, Mus musculus
cagaaacaatgctgccaagctgatt

SEQ ID NO: 310432 - DNA, 25 bp, Mus musculus
cagaaacacacacccctattggtca

SEQ ID NO: 310433 - DNA, 25 bp, Mus musculus
cagaaacacacagccctattggtca

SEQ ID NO: 310434 - DNA, 25 bp, Mus musculus
cagaaacacagcatggacaccattt

SEQ ID NO: 310435 - DNA, 25 bp, Mus musculus
cagaaacacagcttggacaccattt

SEQ ID NO: 310436 - DNA, 25 bp, Mus musculus
cagaaacactcgattttacgctgtt

SEQ ID NO: 310437 - DNA, 25 bp, Mus musculus
cagaaacactcgtttttacgctgtt

SEQ ID NO: 310438 - DNA, 25 bp, Mus musculus
cagaaacagcagatccaggttccac

SEQ ID NO: 310439 - DNA, 25 bp, Mus musculus
cagaaacagcagttccaggttccac

SEQ ID NO: 310440 - DNA, 25 bp, Mus musculus
cagaaacaggctacatcttcaccgc

SEQ ID NO: 310441 - DNA, 25 bp, Mus musculus
cagaaacaggcttcatcttcaccgc

SEQ ID NO: 310442 - DNA, 25 bp, Mus musculus
cagaaacatccaccgccacgtgata

SEQ ID NO: 310443 - DNA, 25 bp, Mus musculus
cagaaacatccagcgccacgtgata

SEQ ID NO: 310444 - DNA, 25 bp, Mus musculus
cagaaacatcgaaaggacaaagccc

SEQ ID NO: 310445 - DNA, 25 bp, Mus musculus
cagaaacatcgataggacaaagccc

SEQ ID NO: 310446 - DNA, 25 bp, Mus musculus
cagaaacatggccaaatgaagacac

SEQ ID NO: 310447 - DNA, 25 bp, Mus musculus
cagaaacatggcgaaatgaagacac

SEQ ID NO: 310448 - DNA, 25 bp, Mus musculus
cagaaaccacctagctgtcccaaat

SEQ ID NO: 310449 - DNA, 25 bp, Mus musculus
cagaaaccaccttgctgtcccaaat

SEQ ID NO: 310450 - DNA, 25 bp, Mus musculus
cagaaaccagcaaccttctcagaag

SEQ ID NO: 310451 - DNA, 25 bp, Mus musculus
cagaaaccagcatccttctcagaag

SEQ ID NO: 310452 - DNA, 25 bp, Mus musculus
cagaaaccagggaacccgagagcaa

SEQ ID NO: 310453 - DNA, 25 bp, Mus musculus
cagaaaccagggtacccgagagcaa

SEQ ID NO: 310454 - DNA, 25 bp, Mus musculus
cagaaacccagccagtccatagagg

SEQ ID NO: 310455 - DNA, 25 bp, Mus musculus
cagaaacccagcgagtccatagagg

SEQ ID NO: 310456 - DNA, 25 bp, Mus musculus
cagaaaccccttagactccgtgtgt

SEQ ID NO: 310457 - DNA, 25 bp, Mus musculus
cagaaacccctttgactccgtgtgt

SEQ ID NO: 310458 - DNA, 25 bp, Mus musculus
cagaaaccctgtccttcctttttga

SEQ ID NO: 310459 - DNA, 25 bp, Mus musculus
cagaaaccctgtgcttcctttttga

SEQ ID NO: 310460 - DNA, 25 bp, Mus musculus
cagaaacctcctagatcttccagag

SEQ ID NO: 310461 - DNA, 25 bp, Mus musculus
cagaaacctccttgatcttccagag

SEQ ID NO: 310462 - DNA, 25 bp, Mus musculus
cagaaacctctgactgactttttgg

SEQ ID NO: 310463 - DNA, 25 bp, Mus musculus
cagaaacctctgtctgactttttgg

SEQ ID NO: 310464 - DNA, 25 bp, Mus musculus
cagaaacctggtatttacaatgaga

SEQ ID NO: 310465 - DNA, 25 bp, Mus musculus
cagaaacctggtttttacaatgaga

SEQ ID NO: 310466 - DNA, 25 bp, Mus musculus
cagaaacgatgtacccactttcaac

SEQ ID NO: 310467 - DNA, 25 bp, Mus musculus
cagaaacgatgttcccactttcaac

SEQ ID NO: 310468 - DNA, 25 bp, Mus musculus
cagaaacgctgcattggtaggatag

SEQ ID NO: 310469 - DNA, 25 bp, Mus musculus
cagaaacgctgctttggtaggatag

SEQ ID NO: 310470 - DNA, 25 bp, Mus musculus
cagaaacggtttcagttgtgattta

SEQ ID NO: 310471 - DNA, 25 bp, Mus musculus
cagaaacggtttgagttgtgattta

SEQ ID NO: 310472 - DNA, 25 bp, Mus musculus
cagaaacgtcaaattaactgcaaag

SEQ ID NO: 310473 - DNA, 25 bp, Mus musculus
cagaaacgtcaatttaactgcaaag

SEQ ID NO: 310474 - DNA, 25 bp, Mus musculus
cagaaacgtcgaagaagtggcagaa

SEQ ID NO: 310475 - DNA, 25 bp, Mus musculus
cagaaacgtcgatgaagtggcagaa

SEQ ID NO: 310476 - DNA, 25 bp, Mus musculus
cagaaactagaccttttagtccatc

SEQ ID NO: 310477 - DNA, 25 bp, Mus musculus
cagaaactagacgttttagtccatc

SEQ ID NO: 310478 - DNA, 25 bp, Mus musculus
cagaaactaggtatggagttgggca

SEQ ID NO: 310479 - DNA, 25 bp, Mus musculus
cagaaactaggtttggagttgggca

SEQ ID NO: 310480 - DNA, 25 bp, Mus musculus
cagaaactcacaaactaaactcctt

SEQ ID NO: 310481 - DNA, 25 bp, Mus musculus
cagaaactcacatactaaactcctt

SEQ ID NO: 310482 - DNA, 25 bp, Mus musculus
cagaaactcctgaaggtaaaacctg

SEQ ID NO: 310483 - DNA, 25 bp, Mus musculus
cagaaactcctgtaggtaaaacctg

SEQ ID NO: 310484 - DNA, 25 bp, Mus musculus
cagaaactgcagatggtgctggccc

SEQ ID NO: 310485 - DNA, 25 bp, Mus musculus
cagaaactgcagttggtgctggccc

SEQ ID NO: 310486 - DNA, 25 bp, Mus musculus
cagaaacttcttagacagcagtcac

SEQ ID NO: 310487 - DNA, 25 bp, Mus musculus
cagaaacttctttgacagcagtcac

SEQ ID NO: 310488 - DNA, 25 bp, Mus musculus
cagaaacttgggacactgattttaa

SEQ ID NO: 310489 - DNA, 25 bp, Mus musculus
cagaaacttgggtcactgattttaa

SEQ ID NO: 310490 - DNA, 25 bp, Mus musculus
cagaaagaagtaagtgcgagttgtt

SEQ ID NO: 310491 - DNA, 25 bp, Mus musculus
cagaaagaagtatgtgcgagttgtt

SEQ ID NO: 310492 - DNA, 25 bp, Mus musculus
cagaaagacaacatattggagtcat

SEQ ID NO: 310493 - DNA, 25 bp, Mus musculus
cagaaagacaacttattggagtcat

SEQ ID NO: 310494 - DNA, 25 bp, Mus musculus
cagaaagacagactcccttagtgat

SEQ ID NO: 310495 - DNA, 25 bp, Mus musculus
cagaaagacagagtcccttagtgat

SEQ ID NO: 310496 - DNA, 25 bp, Mus musculus
cagaaagaccttatactaaccatgt

SEQ ID NO: 310497 - DNA, 25 bp, Mus musculus
cagaaagaccttttactaaccatgt

SEQ ID NO: 310498 - DNA, 25 bp, Mus musculus
cagaaagagggtccacgctcacttt

SEQ ID NO: 310499 - DNA, 25 bp, Mus musculus
cagaaagagggtgcacgctcacttt

SEQ ID NO: 310500 - DNA, 25 bp, Mus musculus
cagaaagaggtgacctttgctgtgc

SEQ ID NO: 310501 - DNA, 25 bp, Mus musculus
cagaaagaggtgtcctttgctgtgc

SEQ ID NO: 310502 - DNA, 25 bp, Mus musculus
cagaaagcagctaaactaaaggaga

SEQ ID NO: 310503 - DNA, 25 bp, Mus musculus
cagaaagcagcttaactaaaggaga

SEQ ID NO: 310504 - DNA, 25 bp, Mus musculus
cagaaagcaggcaactggagttcaa

SEQ ID NO: 310505 - DNA, 25 bp, Mus musculus
cagaaagcaggctactggagttcaa

SEQ ID NO: 310506 - DNA, 25 bp, Mus musculus
cagaaagcagtacatgaagtcaggt

SEQ ID NO: 310507 - DNA, 25 bp, Mus musculus
cagaaagcagtagatgaagtcaggt

SEQ ID NO: 310508 - DNA, 25 bp, Mus musculus
cagaaagcggccatgcatgccatgt

SEQ ID NO: 310509 - DNA, 25 bp, Mus musculus
cagaaagcggccttgcatgccatgt

SEQ ID NO: 310510 - DNA, 25 bp, Mus musculus
cagaaagctctaaaatggcctacaa

SEQ ID NO: 310511 - DNA, 25 bp, Mus musculus
cagaaagctctataatggcctacaa

SEQ ID NO: 310512 - DNA, 25 bp, Mus musculus
cagaaagcttagagaccatctccgt

SEQ ID NO: 310513 - DNA, 25 bp, Mus musculus
cagaaagcttagtgaccatctccgt

SEQ ID NO: 310514 - DNA, 25 bp, Mus musculus
cagaaagctttgctcattgcccaca

SEQ ID NO: 310515 - DNA, 25 bp, Mus musculus
cagaaagctttggtcattgcccaca

SEQ ID NO: 310516 - DNA, 25 bp, Mus musculus
cagaaaggactcattctccctgagt

SEQ ID NO: 310517 - DNA, 25 bp, Mus musculus
cagaaaggactctttctccctgagt

SEQ ID NO: 310518 - DNA, 25 bp, Mus musculus
cagaaaggcacaatatttttggttt

SEQ ID NO: 310519 - DNA, 25 bp, Mus musculus
cagaaaggcacattatttttggttt

SEQ ID NO: 310520 - DNA, 25 bp, Mus musculus
cagaaaggccgaattcttacctatt

SEQ ID NO: 310521 - DNA, 25 bp, Mus musculus
cagaaaggccgatttcttacctatt

SEQ ID NO: 310522 - DNA, 25 bp, Mus musculus
cagaaaggcctgctgcccgcgtgct

SEQ ID NO: 310523 - DNA, 25 bp, Mus musculus
cagaaaggcctggtgcccgcgtgct

SEQ ID NO: 310524 - DNA, 25 bp, Mus musculus
cagaaaggcttgagaagttcattaa

SEQ ID NO: 310525 - DNA, 25 bp, Mus musculus
cagaaaggcttgtgaagttcattaa

SEQ ID NO: 310526 - DNA, 25 bp, Mus musculus
cagaaagggcgcacggtgccagccc

SEQ ID NO: 310527 - DNA, 25 bp, Mus musculus
cagaaagggcgctcggtgccagccc

SEQ ID NO: 310528 - DNA, 25 bp, Mus musculus
cagaaaggtagaccggtctctgctt

SEQ ID NO: 310529 - DNA, 25 bp, Mus musculus
cagaaaggtagagcggtctctgctt

SEQ ID NO: 310530 - DNA, 25 bp, Mus musculus
cagaaaggtcaaagtctggctcagc

SEQ ID NO: 310531 - DNA, 25 bp, Mus musculus
cagaaaggtcaatgtctggctcagc

SEQ ID NO: 310532 - DNA, 25 bp, Mus musculus
cagaaaggtcacctgccaagggaga

SEQ ID NO: 310533 - DNA, 25 bp, Mus musculus
cagaaaggtcacgtgccaagggaga

SEQ ID NO: 310534 - DNA, 25 bp, Mus musculus
cagaaagtacagctggtttttaccg

SEQ ID NO: 310535 - DNA, 25 bp, Mus musculus
cagaaagtacaggtggtttttaccg

SEQ ID NO: 310536 - DNA, 25 bp, Mus musculus
cagaaagtacccctgatttctagtt

SEQ ID NO: 310537 - DNA, 25 bp, Mus musculus
cagaaagtacccgtgatttctagtt

SEQ ID NO: 310538 - DNA, 25 bp, Mus musculus
cagaaagtacctctggctctgactc

SEQ ID NO: 310539 - DNA, 25 bp, Mus musculus
cagaaagtacctgtggctctgactc

SEQ ID NO: 310540 - DNA, 25 bp, Mus musculus
cagaaagtagtccggctttccccag

SEQ ID NO: 310541 - DNA, 25 bp, Mus musculus
cagaaagtagtcgggctttccccag

SEQ ID NO: 310542 - DNA, 25 bp, Mus musculus
cagaaagtcactaagatcaccgaag

SEQ ID NO: 310543 - DNA, 25 bp, Mus musculus
cagaaagtcacttagatcaccgaag

SEQ ID NO: 310544 - DNA, 25 bp, Mus musculus
cagaaagtctagcagccgagggcaa

SEQ ID NO: 310545 - DNA, 25 bp, Mus musculus
cagaaagtctaggagccgagggcaa

SEQ ID NO: 310546 - DNA, 25 bp, Mus musculus
cagaaagtgcagactgtcggtcaga

SEQ ID NO: 310547 - DNA, 25 bp, Mus musculus
cagaaagtgcagtctgtcggtcaga

SEQ ID NO: 310548 - DNA, 25 bp, Mus musculus
cagaaagtggagagcgttttgcaga

SEQ ID NO: 310549 - DNA, 25 bp, Mus musculus
cagaaagtggagtgcgttttgcaga

SEQ ID NO: 310550 - DNA, 25 bp, Mus musculus
cagaaagtggctagaattctaccta

SEQ ID NO: 310551 - DNA, 25 bp, Mus musculus
cagaaagtggcttgaattctaccta

SEQ ID NO: 310552 - DNA, 25 bp, Mus musculus
cagaaagtggttacactactggcac

SEQ ID NO: 310553 - DNA, 25 bp, Mus musculus
cagaaagtggtttcactactggcac

SEQ ID NO: 310554 - DNA, 25 bp, Mus musculus
cagaaagtgttcatggcccaggctc

SEQ ID NO: 310555 - DNA, 25 bp, Mus musculus
cagaaagtgttcttggcccaggctc

SEQ ID NO: 310556 - DNA, 25 bp, Mus musculus
cagaaatataaaacctccacaccgt

SEQ ID NO: 310557 - DNA, 25 bp, Mus musculus
cagaaatataaatcctccacaccgt

SEQ ID NO: 310558 - DNA, 25 bp, Mus musculus
cagaaatatactatgccgtgcaaat

SEQ ID NO: 310559 - DNA, 25 bp, Mus musculus
cagaaatatactttgccgtgcaaat

SEQ ID NO: 310560 - DNA, 25 bp, Mus musculus
cagaaatatatgctggcaaaacatt

SEQ ID NO: 310561 - DNA, 25 bp, Mus musculus
cagaaatatatggtggcaaaacatt

SEQ ID NO: 310562 - DNA, 25 bp, Mus musculus
cagaaatattaaactgtgggccgaa

SEQ ID NO: 310563 - DNA, 25 bp, Mus musculus
cagaaatattaatctgtgggccgaa

SEQ ID NO: 310564 - DNA, 25 bp, Mus musculus
cagaaatcacgtagtagaaggtaga

SEQ ID NO: 310565 - DNA, 25 bp, Mus musculus
cagaaatcacgttgtagaaggtaga

SEQ ID NO: 310566 - DNA, 25 bp, Mus musculus
cagaaatcactcacctgtttactat

SEQ ID NO: 310567 - DNA, 25 bp, Mus musculus
cagaaatcactctcctgtttactat

SEQ ID NO: 310568 - DNA, 25 bp, Mus musculus
cagaaatcacttcggccttgagcct

SEQ ID NO: 310569 - DNA, 25 bp, Mus musculus
cagaaatcacttgggccttgagcct

SEQ ID NO: 310570 - DNA, 25 bp, Mus musculus
cagaaatcagataacaggttacttg

SEQ ID NO: 310571 - DNA, 25 bp, Mus musculus
cagaaatcagattacaggttacttg

SEQ ID NO: 310572 - DNA, 25 bp, Mus musculus
cagaaatcccatcactccagttgag

SEQ ID NO: 310573 - DNA, 25 bp, Mus musculus
cagaaatcccatgactccagttgag

SEQ ID NO: 310574 - DNA, 25 bp, Mus musculus
cagaaatccctcctggaccctttat

SEQ ID NO: 310575 - DNA, 25 bp, Mus musculus
cagaaatccctcgtggaccctttat

SEQ ID NO: 310576 - DNA, 25 bp, Mus musculus
cagaaatcctgccaccagaagatta

SEQ ID NO: 310577 - DNA, 25 bp, Mus musculus
cagaaatcctgcgaccagaagatta

SEQ ID NO: 310578 - DNA, 25 bp, Mus musculus
cagaaatcgaaacgcccatgactac

SEQ ID NO: 310579 - DNA, 25 bp, Mus musculus
cagaaatcgaaaggcccatgactac

SEQ ID NO: 310580 - DNA, 25 bp, Mus musculus
cagaaatcgagaactggatccagaa

SEQ ID NO: 310581 - DNA, 25 bp, Mus musculus
cagaaatcgagatctggatccagaa

SEQ ID NO: 310582 - DNA, 25 bp, Mus musculus
cagaaatctctgaggaactatgact

SEQ ID NO: 310583 - DNA, 25 bp, Mus musculus
cagaaatctctgtggaactatgact

SEQ ID NO: 310584 - DNA, 25 bp, Mus musculus
cagaaatctcttatctttgcacccc

SEQ ID NO: 310585 - DNA, 25 bp, Mus musculus
cagaaatctcttttctttgcacccc

SEQ ID NO: 310586 - DNA, 25 bp, Mus musculus
cagaaatctgaacatcgaaccgaag

SEQ ID NO: 310587 - DNA, 25 bp, Mus musculus
cagaaatctgaagatcgaaccgaag

SEQ ID NO: 310588 - DNA, 25 bp, Mus musculus
cagaaatctgcacctcttctgctgt

SEQ ID NO: 310589 - DNA, 25 bp, Mus musculus
cagaaatctgcagctcttctgctgt

SEQ ID NO: 310590 - DNA, 25 bp, Mus musculus
cagaaatctggtagtgcggaagtcc

SEQ ID NO: 310591 - DNA, 25 bp, Mus musculus
cagaaatctggttgtgcggaagtcc

SEQ ID NO: 310592 - DNA, 25 bp, Mus musculus
cagaaatcttgtcacctgtgtgggt

SEQ ID NO: 310593 - DNA, 25 bp, Mus musculus
cagaaatcttgtgacctgtgtgggt

SEQ ID NO: 310594 - DNA, 25 bp, Mus musculus
cagaaatgacatcctctggagctga

SEQ ID NO: 310595 - DNA, 25 bp, Mus musculus
cagaaatgacatgctctggagctga

SEQ ID NO: 310596 - DNA, 25 bp, Mus musculus
cagaaatgagagctgccccctaagg

SEQ ID NO: 310597 - DNA, 25 bp, Mus musculus
cagaaatgagaggtgccccctaagg

SEQ ID NO: 310598 - DNA, 25 bp, Mus musculus
cagaaatgagctctgctggctcctt

SEQ ID NO: 310599 - DNA, 25 bp, Mus musculus
cagaaatgagctgtgctggctcctt

SEQ ID NO: 310600 - DNA, 25 bp, Mus musculus
cagaaatgagtacctttttaaatgt

SEQ ID NO: 310601 - DNA, 25 bp, Mus musculus
cagaaatgagtagctttttaaatgt

SEQ ID NO: 310602 - DNA, 25 bp, Mus musculus
cagaaatgagttaaagaccctaatt

SEQ ID NO: 310603 - DNA, 25 bp, Mus musculus
cagaaatgagtttaagaccctaatt

SEQ ID NO: 310604 - DNA, 25 bp, Mus musculus
cagaaatggcctcgcttttcctgag

SEQ ID NO: 310605 - DNA, 25 bp, Mus musculus
cagaaatggcctggcttttcctgag

SEQ ID NO: 310606 - DNA, 25 bp, Mus musculus
cagaaatgtcatcaagctcagagca

SEQ ID NO: 310607 - DNA, 25 bp, Mus musculus
cagaaatgtcatgaagctcagagca

SEQ ID NO: 310608 - DNA, 25 bp, Mus musculus
cagaaatgtgtaatgacctcagaaa

SEQ ID NO: 310609 - DNA, 25 bp, Mus musculus
cagaaatgtgtattgacctcagaaa

SEQ ID NO: 310610 - DNA, 25 bp, Mus musculus
cagaaatgtgtgcagccagatggct

SEQ ID NO: 310611 - DNA, 25 bp, Mus musculus
cagaaatgtgtggagccagatggct

SEQ ID NO: 310612 - DNA, 25 bp, Mus musculus
cagaaatgtttcccaaagagtgatt

SEQ ID NO: 310613 - DNA, 25 bp, Mus musculus
cagaaatgtttcgcaaagagtgatt

SEQ ID NO: 310614 - DNA, 25 bp, Mus musculus
cagaaattaaatacacagcccggga

SEQ ID NO: 310615 - DNA, 25 bp, Mus musculus
cagaaattaaattcacagcccggga

SEQ ID NO: 310616 - DNA, 25 bp, Mus musculus
cagaaattaggcaattctagattta

SEQ ID NO: 310617 - DNA, 25 bp, Mus musculus
cagaaattaggctattctagattta

SEQ ID NO: 310618 - DNA, 25 bp, Mus musculus
cagaaattcacgaccattggtcaaa

SEQ ID NO: 310619 - DNA, 25 bp, Mus musculus
cagaaattcacgtccattggtcaaa

SEQ ID NO: 310620 - DNA, 25 bp, Mus musculus
cagaaattcaggagattgctgacaa

SEQ ID NO: 310621 - DNA, 25 bp, Mus musculus
cagaaattcaggtgattgctgacaa

SEQ ID NO: 310622 - DNA, 25 bp, Mus musculus
cagaaatttaacaggctgttggaaa

SEQ ID NO: 310623 - DNA, 25 bp, Mus musculus
cagaaatttaactggctgttggaaa

SEQ ID NO: 310624 - DNA, 25 bp, Mus musculus
cagaaatttcttcccgtccatgttt

SEQ ID NO: 310625 - DNA, 25 bp, Mus musculus
cagaaatttcttgccgtccatgttt

SEQ ID NO: 310626 - DNA, 25 bp, Mus musculus
cagaaatttttgaccttggcccaca

SEQ ID NO: 310627 - DNA, 25 bp, Mus musculus
cagaaatttttgtccttggcccaca

SEQ ID NO: 310628 - DNA, 25 bp, Mus musculus
cagaacaaatgactcaagcccaggg

SEQ ID NO: 310629 - DNA, 25 bp, Mus musculus
cagaacaaatgagtcaagcccaggg

SEQ ID NO: 310630 - DNA, 25 bp, Mus musculus
cagaacaaccccacagttgggactt

SEQ ID NO: 310631 - DNA, 25 bp, Mus musculus
cagaacaacccctcagttgggactt

SEQ ID NO: 310632 - DNA, 25 bp, Mus musculus
cagaacaactgtctacccggaatat

SEQ ID NO: 310633 - DNA, 25 bp, Mus musculus
cagaacaactgtgtacccggaatat

SEQ ID NO: 310634 - DNA, 25 bp, Mus musculus
cagaacaaggcaccctgctactgtc

SEQ ID NO: 310635 - DNA, 25 bp, Mus musculus
cagaacaaggcagcctgctactgtc

SEQ ID NO: 310636 - DNA, 25 bp, Mus musculus
cagaacacacagatgtaaaatgatt

SEQ ID NO: 310637 - DNA, 25 bp, Mus musculus
cagaacacacagttgtaaaatgatt

SEQ ID NO: 310638 - DNA, 25 bp, Mus musculus
cagaacacatggaggccacgtatgt

SEQ ID NO: 310639 - DNA, 25 bp, Mus musculus
cagaacacatggtggccacgtatgt

SEQ ID NO: 310640 - DNA, 25 bp, Mus musculus
cagaacagaccacgacatgcccggg

SEQ ID NO: 310641 - DNA, 25 bp, Mus musculus
cagaacagaccaggacatgcccggg

SEQ ID NO: 310642 - DNA, 25 bp, Mus musculus
cagaacagataaatccttacccttt

SEQ ID NO: 310643 - DNA, 25 bp, Mus musculus
cagaacagataattccttacccttt

SEQ ID NO: 310644 - DNA, 25 bp, Mus musculus
cagaacagcacacagccaggtctaa

SEQ ID NO: 310645 - DNA, 25 bp, Mus musculus
cagaacagcacagagccaggtctaa

SEQ ID NO: 310646 - DNA, 25 bp, Mus musculus
cagaacaggcctcctgcggcgaaga

SEQ ID NO: 310647 - DNA, 25 bp, Mus musculus
cagaacaggcctgctgcggcgaaga

SEQ ID NO: 310648 - DNA, 25 bp, Mus musculus
cagaacagtgatactcttaagggag

SEQ ID NO: 310649 - DNA, 25 bp, Mus musculus
cagaacagtgattctcttaagggag

SEQ ID NO: 310650 - DNA, 25 bp, Mus musculus
cagaacatcattagcgggacaagga

SEQ ID NO: 310651 - DNA, 25 bp, Mus musculus
cagaacatcatttgcgggacaagga

SEQ ID NO: 310652 - DNA, 25 bp, Mus musculus
cagaacatccttcttttacccgagg

SEQ ID NO: 310653 - DNA, 25 bp, Mus musculus
cagaacatccttgttttacccgagg

SEQ ID NO: 310654 - DNA, 25 bp, Mus musculus
cagaacatggatccctcgcacattg

SEQ ID NO: 310655 - DNA, 25 bp, Mus musculus
cagaacatggatgcctcgcacattg

SEQ ID NO: 310656 - DNA, 25 bp, Mus musculus
cagaacatggtgacgattttcccag

SEQ ID NO: 310657 - DNA, 25 bp, Mus musculus
cagaacatggtgtcgattttcccag

SEQ ID NO: 310658 - DNA, 25 bp, Mus musculus
cagaacattggaacctcgctgggat

SEQ ID NO: 310659 - DNA, 25 bp, Mus musculus
cagaacattggatcctcgctgggat

SEQ ID NO: 310660 - DNA, 25 bp, Mus musculus
cagaaccaaaaactgtctctaaggt

SEQ ID NO: 310661 - DNA, 25 bp, Mus musculus
cagaaccaaaaagtgtctctaaggt

SEQ ID NO: 310662 - DNA, 25 bp, Mus musculus
cagaaccacatgagtatgcctggaa

SEQ ID NO: 310663 - DNA, 25 bp, Mus musculus
cagaaccacatgtgtatgcctggaa

SEQ ID NO: 310664 - DNA, 25 bp, Mus musculus
cagaaccaggttcttgcgcgtctat

SEQ ID NO: 310665 - DNA, 25 bp, Mus musculus
cagaaccaggttgttgcgcgtctat

SEQ ID NO: 310666 - DNA, 25 bp, Mus musculus
cagaaccagttaactctttattttt

SEQ ID NO: 310667 - DNA, 25 bp, Mus musculus
cagaaccagttatctctttattttt

SEQ ID NO: 310668 - DNA, 25 bp, Mus musculus
cagaaccagtttccattggcccctg

SEQ ID NO: 310669 - DNA, 25 bp, Mus musculus
cagaaccagtttgcattggcccctg

SEQ ID NO: 310670 - DNA, 25 bp, Mus musculus
cagaacccacttctaactcatttat

SEQ ID NO: 310671 - DNA, 25 bp, Mus musculus
cagaacccacttgtaactcatttat

SEQ ID NO: 310672 - DNA, 25 bp, Mus musculus
cagaacccaggaagcacatgtagga

SEQ ID NO: 310673 - DNA, 25 bp, Mus musculus
cagaacccaggatgcacatgtagga

SEQ ID NO: 310674 - DNA, 25 bp, Mus musculus
cagaacccaggccaattggaggaaa

SEQ ID NO: 310675 - DNA, 25 bp, Mus musculus
cagaacccaggcgaattggaggaaa

SEQ ID NO: 310676 - DNA, 25 bp, Mus musculus
cagaaccccatgataacagaagcag

SEQ ID NO: 310677 - DNA, 25 bp, Mus musculus
cagaaccccatgttaacagaagcag

SEQ ID NO: 310678 - DNA, 25 bp, Mus musculus
cagaaccccgatcacaacgagtgat

SEQ ID NO: 310679 - DNA, 25 bp, Mus musculus
cagaaccccgatgacaacgagtgat

SEQ ID NO: 310680 - DNA, 25 bp, Mus musculus
cagaacccctggatgcagagggctt

SEQ ID NO: 310681 - DNA, 25 bp, Mus musculus
cagaacccctggttgcagagggctt

SEQ ID NO: 310682 - DNA, 25 bp, Mus musculus
cagaacccggaaccaaggagattca

SEQ ID NO: 310683 - DNA, 25 bp, Mus musculus
cagaacccggaagcaaggagattca

SEQ ID NO: 310684 - DNA, 25 bp, Mus musculus
cagaacccggagcatatcacagagg

SEQ ID NO: 310685 - DNA, 25 bp, Mus musculus
cagaacccggaggatatcacagagg

SEQ ID NO: 310686 - DNA, 25 bp, Mus musculus
cagaacccgggaccctgtcagaaaa

SEQ ID NO: 310687 - DNA, 25 bp, Mus musculus
cagaacccgggagcctgtcagaaaa

SEQ ID NO: 310688 - DNA, 25 bp, Mus musculus
cagaacccggtcaccacagtaaaag

SEQ ID NO: 310689 - DNA, 25 bp, Mus musculus
cagaacccggtctccacagtaaaag

SEQ ID NO: 310690 - DNA, 25 bp, Mus musculus
cagaaccgccggctcaaggagaaga

SEQ ID NO: 310691 - DNA, 25 bp, Mus musculus
cagaaccgccgggtcaaggagaaga

SEQ ID NO: 310692 - DNA, 25 bp, Mus musculus
cagaaccggctgatttaactccact

SEQ ID NO: 310693 - DNA, 25 bp, Mus musculus
cagaaccggctgttttaactccact

SEQ ID NO: 310694 - DNA, 25 bp, Mus musculus
cagaaccgtatcattttctcacctg

SEQ ID NO: 310695 - DNA, 25 bp, Mus musculus
cagaaccgtatctttttctcacctg

SEQ ID NO: 310696 - DNA, 25 bp, Mus musculus
cagaacctaatgaaaggaccacgtt

SEQ ID NO: 310697 - DNA, 25 bp, Mus musculus
cagaacctaatgtaaggaccacgtt

SEQ ID NO: 310698 - DNA, 25 bp, Mus musculus
cagaacctcgtgagtgacatcaagg

SEQ ID NO: 310699 - DNA, 25 bp, Mus musculus
cagaacctcgtgtgtgacatcaagg

SEQ ID NO: 310700 - DNA, 25 bp, Mus musculus
cagaacctctcccacaatatgggct

SEQ ID NO: 310701 - DNA, 25 bp, Mus musculus
cagaacctctccgacaatatgggct

SEQ ID NO: 310702 - DNA, 25 bp, Mus musculus
cagaacctctgcctaagatcagtta

SEQ ID NO: 310703 - DNA, 25 bp, Mus musculus
cagaacctctgcgtaagatcagtta

SEQ ID NO: 310704 - DNA, 25 bp, Mus musculus
cagaacctctgtcgccctgtgggaa

SEQ ID NO: 310705 - DNA, 25 bp, Mus musculus
cagaacctctgtggccctgtgggaa

SEQ ID NO: 310706 - DNA, 25 bp, Mus musculus
cagaacctgaagaactccaggcgag

SEQ ID NO: 310707 - DNA, 25 bp, Mus musculus
cagaacctgaagtactccaggcgag

SEQ ID NO: 310708 - DNA, 25 bp, Mus musculus
cagaacctgagaattttgccctaaa

SEQ ID NO: 310709 - DNA, 25 bp, Mus musculus
cagaacctgagatttttgccctaaa

SEQ ID NO: 310710 - DNA, 25 bp, Mus musculus
cagaacctgagtccatctgagggcc

SEQ ID NO: 310711 - DNA, 25 bp, Mus musculus
cagaacctgagtgcatctgagggcc

SEQ ID NO: 310712 - DNA, 25 bp, Mus musculus
cagaaccttgcgctatgctattcaa

SEQ ID NO: 310713 - DNA, 25 bp, Mus musculus
cagaaccttgcggtatgctattcaa

SEQ ID NO: 310714 - DNA, 25 bp, Mus musculus
cagaaccttggtagatgttttccct

SEQ ID NO: 310715 - DNA, 25 bp, Mus musculus
cagaaccttggttgatgttttccct

SEQ ID NO: 310716 - DNA, 25 bp, Mus musculus
cagaacctttctctggagagagacc

SEQ ID NO: 310717 - DNA, 25 bp, Mus musculus
cagaacctttctgtggagagagacc

SEQ ID NO: 310718 - DNA, 25 bp, Mus musculus
cagaacctttggacatgccagcgac

SEQ ID NO: 310719 - DNA, 25 bp, Mus musculus
cagaacctttggtcatgccagcgac

SEQ ID NO: 310720 - DNA, 25 bp, Mus musculus
cagaaccttttgctttctcttggat

SEQ ID NO: 310721 - DNA, 25 bp, Mus musculus
cagaaccttttggtttctcttggat

SEQ ID NO: 310722 - DNA, 25 bp, Mus musculus
cagaacgacgcgctggaagacacca

SEQ ID NO: 310723 - DNA, 25 bp, Mus musculus
cagaacgacgcggtggaagacacca

SEQ ID NO: 310724 - DNA, 25 bp, Mus musculus
cagaacgccagtaatttttaggttg

SEQ ID NO: 310725 - DNA, 25 bp, Mus musculus
cagaacgccagttatttttaggttg

SEQ ID NO: 310726 - DNA, 25 bp, Mus musculus
cagaacgccattcacattgactttg

SEQ ID NO: 310727 - DNA, 25 bp, Mus musculus
cagaacgccattgacattgactttg

SEQ ID NO: 310728 - DNA, 25 bp, Mus musculus
cagaacgctctaaggccaagtggca

SEQ ID NO: 310729 - DNA, 25 bp, Mus musculus
cagaacgctctatggccaagtggca

SEQ ID NO: 310730 - DNA, 25 bp, Mus musculus
cagaacgctctgctgtgtatacaca

SEQ ID NO: 310731 - DNA, 25 bp, Mus musculus
cagaacgctctggtgtgtatacaca

SEQ ID NO: 310732 - DNA, 25 bp, Mus musculus
cagaacgggtggctcgagccttcct

SEQ ID NO: 310733 - DNA, 25 bp, Mus musculus
cagaacgggtgggtcgagccttcct

SEQ ID NO: 310734 - DNA, 25 bp, Mus musculus
cagaacgtagtactatgtgtaggaa

SEQ ID NO: 310735 - DNA, 25 bp, Mus musculus
cagaacgtagtagtatgtgtaggaa

SEQ ID NO: 310736 - DNA, 25 bp, Mus musculus
cagaacgtccatcgccttgcgggct

SEQ ID NO: 310737 - DNA, 25 bp, Mus musculus
cagaacgtccatggccttgcgggct

SEQ ID NO: 310738 - DNA, 25 bp, Mus musculus
cagaactaaaatattgggaccatgg

SEQ ID NO: 310739 - DNA, 25 bp, Mus musculus
cagaactaaaattttgggaccatgg

SEQ ID NO: 310740 - DNA, 25 bp, Mus musculus
cagaactaagttagctaaggacata

SEQ ID NO: 310741 - DNA, 25 bp, Mus musculus
cagaactaagtttgctaaggacata

SEQ ID NO: 310742 - DNA, 25 bp, Mus musculus
cagaactaatttcccagggccctgt

SEQ ID NO: 310743 - DNA, 25 bp, Mus musculus
cagaactaatttgccagggccctgt

SEQ ID NO: 310744 - DNA, 25 bp, Mus musculus
cagaactactgtcatcaacatgccc

SEQ ID NO: 310745 - DNA, 25 bp, Mus musculus
cagaactactgtgatcaacatgccc

SEQ ID NO: 310746 - DNA, 25 bp, Mus musculus
cagaactagatgactccaggagcag

SEQ ID NO: 310747 - DNA, 25 bp, Mus musculus
cagaactagatgtctccaggagcag

SEQ ID NO: 310748 - DNA, 25 bp, Mus musculus
cagaactatctgcaagcatttactt

SEQ ID NO: 310749 - DNA, 25 bp, Mus musculus
cagaactatctggaagcatttactt

SEQ ID NO: 310750 - DNA, 25 bp, Mus musculus
cagaactatgaaaaactactctggg

SEQ ID NO: 310751 - DNA, 25 bp, Mus musculus
cagaactatgaataactactctggg

SEQ ID NO: 310752 - DNA, 25 bp, Mus musculus
cagaactatgtaaagaggaccaaaa

SEQ ID NO: 310753 - DNA, 25 bp, Mus musculus
cagaactatgtacctcagggtcata

SEQ ID NO: 310754 - DNA, 25 bp, Mus musculus
cagaactatgtagctcagggtcata

SEQ ID NO: 310755 - DNA, 25 bp, Mus musculus
cagaactatgtatagaggaccaaaa

SEQ ID NO: 310756 - DNA, 25 bp, Mus musculus
cagaactattctatcagccatacac

SEQ ID NO: 310757 - DNA, 25 bp, Mus musculus
cagaactattctttcagccatacac

SEQ ID NO: 310758 - DNA, 25 bp, Mus musculus
cagaactcacagcacagggattgct

SEQ ID NO: 310759 - DNA, 25 bp, Mus musculus
cagaactcacaggacagggattgct

SEQ ID NO: 310760 - DNA, 25 bp, Mus musculus
cagaactcatgtaacttgtagctat

SEQ ID NO: 310761 - DNA, 25 bp, Mus musculus
cagaactcatgttacttgtagctat

SEQ ID NO: 310762 - DNA, 25 bp, Mus musculus
cagaactcatttactactgtcaaat

SEQ ID NO: 310763 - DNA, 25 bp, Mus musculus
cagaactcattttctactgtcaaat

SEQ ID NO: 310764 - DNA, 25 bp, Mus musculus
cagaactcctagaatcaaatgcttt

SEQ ID NO: 310765 - DNA, 25 bp, Mus musculus
cagaactcctagtatcaaatgcttt

SEQ ID NO: 310766 - DNA, 25 bp, Mus musculus
cagaactcggtgacgctgtccgccg

SEQ ID NO: 310767 - DNA, 25 bp, Mus musculus
cagaactcggtgtcgctgtccgccg

SEQ ID NO: 310768 - DNA, 25 bp, Mus musculus
cagaactctcagctgtgtttgcacc

SEQ ID NO: 310769 - DNA, 25 bp, Mus musculus
cagaactctcaggtgtgtttgcacc

SEQ ID NO: 310770 - DNA, 25 bp, Mus musculus
cagaactgaagtaggtcatcgacca

SEQ ID NO: 310771 - DNA, 25 bp, Mus musculus
cagaactgaagttggtcatcgacca

SEQ ID NO: 310772 - DNA, 25 bp, Mus musculus
cagaactgaattatgaggtggattt

SEQ ID NO: 310773 - DNA, 25 bp, Mus musculus
cagaactgaattttgaggtggattt

SEQ ID NO: 310774 - DNA, 25 bp, Mus musculus
cagaactgactcattgctcggaatg

SEQ ID NO: 310775 - DNA, 25 bp, Mus musculus
cagaactgactctttgctcggaatg

SEQ ID NO: 310776 - DNA, 25 bp, Mus musculus
cagaactgcccaagaggcggcaaga

SEQ ID NO: 310777 - DNA, 25 bp, Mus musculus
cagaactgcccatgaggcggcaaga

SEQ ID NO: 310778 - DNA, 25 bp, Mus musculus
cagaactgctggaaaaaccctgttt

SEQ ID NO: 310779 - DNA, 25 bp, Mus musculus
cagaactgctggtaaaaccctgttt

SEQ ID NO: 310780 - DNA, 25 bp, Mus musculus
cagaactggaggcctttagacccgg

SEQ ID NO: 310781 - DNA, 25 bp, Mus musculus
cagaactggagggctttagacccgg

SEQ ID NO: 310782 - DNA, 25 bp, Mus musculus
cagaactggccccagtgcagattaa

SEQ ID NO: 310783 - DNA, 25 bp, Mus musculus
cagaactggcccgagtgcagattaa

SEQ ID NO: 310784 - DNA, 25 bp, Mus musculus
cagaactggctgacggtccctttta

SEQ ID NO: 310785 - DNA, 25 bp, Mus musculus
cagaactggctgtcggtccctttta

SEQ ID NO: 310786 - DNA, 25 bp, Mus musculus
cagaactgggtcactgtgctatgaa

SEQ ID NO: 310787 - DNA, 25 bp, Mus musculus
cagaactgggtctctgtgctatgaa

SEQ ID NO: 310788 - DNA, 25 bp, Mus musculus
cagaactgtaagattcacccctaca

SEQ ID NO: 310789 - DNA, 25 bp, Mus musculus
cagaactgtaagtttcacccctaca

SEQ ID NO: 310790 - DNA, 25 bp, Mus musculus
cagaactgtgacctgatacattcac

SEQ ID NO: 310791 - DNA, 25 bp, Mus musculus
cagaactgtgacgtgatacattcac

SEQ ID NO: 310792 - DNA, 25 bp, Mus musculus
cagaactgtggacctggcctaaaca

SEQ ID NO: 310793 - DNA, 25 bp, Mus musculus
cagaactgtggagctggcctaaaca

SEQ ID NO: 310794 - DNA, 25 bp, Mus musculus
cagaacttagctcgcatcactggct

SEQ ID NO: 310795 - DNA, 25 bp, Mus musculus
cagaacttagctggcatcactggct

SEQ ID NO: 310796 - DNA, 25 bp, Mus musculus
cagaacttcaaaagggcaagatctt

SEQ ID NO: 310797 - DNA, 25 bp, Mus musculus
cagaacttcaaatgggcaagatctt

SEQ ID NO: 310798 - DNA, 25 bp, Mus musculus
cagaacttccctaaaacaccaagcg

SEQ ID NO: 310799 - DNA, 25 bp, Mus musculus
cagaacttcccttaaacaccaagcg

SEQ ID NO: 310800 - DNA, 25 bp, Mus musculus
cagaacttcttgcaggaccgtgctc

SEQ ID NO: 310801 - DNA, 25 bp, Mus musculus
cagaacttcttggaggaccgtgctc

SEQ ID NO: 310802 - DNA, 25 bp, Mus musculus
cagaacttgcagctccatacaggga

SEQ ID NO: 310803 - DNA, 25 bp, Mus musculus
cagaacttgcaggtccatacaggga

SEQ ID NO: 310804 - DNA, 25 bp, Mus musculus
cagaacttgcgtatccaggttattt

SEQ ID NO: 310805 - DNA, 25 bp, Mus musculus
cagaacttgcgtttccaggttattt

SEQ ID NO: 310806 - DNA, 25 bp, Mus musculus
cagaacttgggcacgctcaggaagt

SEQ ID NO: 310807 - DNA, 25 bp, Mus musculus
cagaacttgggccatttgggctctc

SEQ ID NO: 310808 - DNA, 25 bp, Mus musculus
cagaacttgggcgatttgggctctc

SEQ ID NO: 310809 - DNA, 25 bp, Mus musculus
cagaacttgggctcgctcaggaagt

SEQ ID NO: 310810 - DNA, 25 bp, Mus musculus
cagaactttacccatagctatgcca

SEQ ID NO: 310811 - DNA, 25 bp, Mus musculus
cagaactttaccgatagctatgcca

SEQ ID NO: 310812 - DNA, 25 bp, Mus musculus
cagaactttcagattcattttgtga

SEQ ID NO: 310813 - DNA, 25 bp, Mus musculus
cagaactttcagtttcattttgtga

SEQ ID NO: 310814 - DNA, 25 bp, Mus musculus
cagaactttcccattatctgtaggg

SEQ ID NO: 310815 - DNA, 25 bp, Mus musculus
cagaactttccctttatctgtaggg

SEQ ID NO: 310816 - DNA, 25 bp, Mus musculus
cagaactttctaacctaactggttt

SEQ ID NO: 310817 - DNA, 25 bp, Mus musculus
cagaactttctatcctaactggttt

SEQ ID NO: 310818 - DNA, 25 bp, Mus musculus
cagaactttcttacgagaagtaatt

SEQ ID NO: 310819 - DNA, 25 bp, Mus musculus
cagaactttctttcgagaagtaatt

SEQ ID NO: 310820 - DNA, 25 bp, Mus musculus
cagaacttttcgcaggtttgccctg

SEQ ID NO: 310821 - DNA, 25 bp, Mus musculus
cagaacttttcggaggtttgccctg

SEQ ID NO: 310822 - DNA, 25 bp, Mus musculus
cagaacttttgcattcatggcgaat

SEQ ID NO: 310823 - DNA, 25 bp, Mus musculus
cagaacttttgctttcatggcgaat

SEQ ID NO: 310824 - DNA, 25 bp, Mus musculus
cagaactttttacaccttaccagct

SEQ ID NO: 310825 - DNA, 25 bp, Mus musculus
cagaactttttagaccttaccagct

SEQ ID NO: 310826 - DNA, 25 bp, Mus musculus
cagaagaaaatgcagctgcgtttgc

SEQ ID NO: 310827 - DNA, 25 bp, Mus musculus
cagaagaaaatggagctgcgtttgc

SEQ ID NO: 310828 - DNA, 25 bp, Mus musculus
cagaagaaagccacaacgggaccta

SEQ ID NO: 310829 - DNA, 25 bp, Mus musculus
cagaagaaagcctcaacgggaccta

SEQ ID NO: 310830 - DNA, 25 bp, Mus musculus
cagaagaaataaacggccaggccca

SEQ ID NO: 310831 - DNA, 25 bp, Mus musculus
cagaagaaataatcggccaggccca

SEQ ID NO: 310832 - DNA, 25 bp, Mus musculus
cagaagaaccagactttattgccct

SEQ ID NO: 310833 - DNA, 25 bp, Mus musculus
cagaagaaccagtctttattgccct

SEQ ID NO: 310834 - DNA, 25 bp, Mus musculus
cagaagaacccgatggagcaccatt

SEQ ID NO: 310835 - DNA, 25 bp, Mus musculus
cagaagaacccgttggagcaccatt

SEQ ID NO: 310836 - DNA, 25 bp, Mus musculus
cagaagaacctccagggtaagcgga

SEQ ID NO: 310837 - DNA, 25 bp, Mus musculus
cagaagaacctcgagggtaagcgga

SEQ ID NO: 310838 - DNA, 25 bp, Mus musculus
cagaagaacctgcagccatagttat

SEQ ID NO: 310839 - DNA, 25 bp, Mus musculus
cagaagaacctggagccatagttat

SEQ ID NO: 310840 - DNA, 25 bp, Mus musculus
cagaagaactggacaaggctatgta

SEQ ID NO: 310841 - DNA, 25 bp, Mus musculus
cagaagaactggtcaaggctatgta

SEQ ID NO: 310842 - DNA, 25 bp, Mus musculus
cagaagaactgtacccttcccagga

SEQ ID NO: 310843 - DNA, 25 bp, Mus musculus
cagaagaactgttcccttcccagga

SEQ ID NO: 310844 - DNA, 25 bp, Mus musculus
cagaagaacttcctggatccaatca

SEQ ID NO: 310845 - DNA, 25 bp, Mus musculus
cagaagaacttcgtggatccaatca

SEQ ID NO: 310846 - DNA, 25 bp, Mus musculus
cagaagaagcccactgtaactcagt

SEQ ID NO: 310847 - DNA, 25 bp, Mus musculus
cagaagaagccctctgtaactcagt

SEQ ID NO: 310848 - DNA, 25 bp, Mus musculus
cagaagaagcttcctgcccgagggc

SEQ ID NO: 310849 - DNA, 25 bp, Mus musculus
cagaagaagcttgctgcccgagggc

SEQ ID NO: 310850 - DNA, 25 bp, Mus musculus
cagaagaatgacatttgaccctgca

SEQ ID NO: 310851 - DNA, 25 bp, Mus musculus
cagaagaatgacttttgaccctgca

SEQ ID NO: 310852 - DNA, 25 bp, Mus musculus
cagaagaatgctatggcccacagga

SEQ ID NO: 310853 - DNA, 25 bp, Mus musculus
cagaagaatgctttggcccacagga

SEQ ID NO: 310854 - DNA, 25 bp, Mus musculus
cagaagaattttcccaggacccact

SEQ ID NO: 310855 - DNA, 25 bp, Mus musculus
cagaagaattttgccaggacccact

SEQ ID NO: 310856 - DNA, 25 bp, Mus musculus
cagaagacaaagacagggctgttgt

SEQ ID NO: 310857 - DNA, 25 bp, Mus musculus
cagaagacaaagtcagggctgttgt

SEQ ID NO: 310858 - DNA, 25 bp, Mus musculus
cagaagacactgctgagccctgaag

SEQ ID NO: 310859 - DNA, 25 bp, Mus musculus
cagaagacactggtgagccctgaag

SEQ ID NO: 310860 - DNA, 25 bp, Mus musculus
cagaagacaggcatggcgagccaaa

SEQ ID NO: 310861 - DNA, 25 bp, Mus musculus
cagaagacaggccacatgaagagag

SEQ ID NO: 310862 - DNA, 25 bp, Mus musculus
cagaagacaggcgacatgaagagag

SEQ ID NO: 310863 - DNA, 25 bp, Mus musculus
cagaagacaggcttggcgagccaaa

SEQ ID NO: 310864 - DNA, 25 bp, Mus musculus
cagaagacatcgaggatgggcatga

SEQ ID NO: 310865 - DNA, 25 bp, Mus musculus
cagaagacatcgtggatgggcatga

SEQ ID NO: 310866 - DNA, 25 bp, Mus musculus
cagaagaccagactgatttccagca

SEQ ID NO: 310867 - DNA, 25 bp, Mus musculus
cagaagaccagagtgatttccagca

SEQ ID NO: 310868 - DNA, 25 bp, Mus musculus
cagaagaccagtcgcgtttctctgc

SEQ ID NO: 310869 - DNA, 25 bp, Mus musculus
cagaagaccagtggcgtttctctgc

SEQ ID NO: 310870 - DNA, 25 bp, Mus musculus
cagaagaccgtaacagatttcatta

SEQ ID NO: 310871 - DNA, 25 bp, Mus musculus
cagaagaccgtatcagatttcatta

SEQ ID NO: 310872 - DNA, 25 bp, Mus musculus
cagaagacgactcgcctcgagaggt

SEQ ID NO: 310873 - DNA, 25 bp, Mus musculus
cagaagacgactggcctcgagaggt

SEQ ID NO: 310874 - DNA, 25 bp, Mus musculus
cagaagacgggaacacctgggattt

SEQ ID NO: 310875 - DNA, 25 bp, Mus musculus
cagaagacgggatcacctgggattt

SEQ ID NO: 310876 - DNA, 25 bp, Mus musculus
cagaagacgtggactcctttgagat

SEQ ID NO: 310877 - DNA, 25 bp, Mus musculus
cagaagacgtggtctcctttgagat

SEQ ID NO: 310878 - DNA, 25 bp, Mus musculus
cagaagactctgaaggcccctaatt

SEQ ID NO: 310879 - DNA, 25 bp, Mus musculus
cagaagactctgtaggcccctaatt

SEQ ID NO: 310880 - DNA, 25 bp, Mus musculus
cagaagactgttctggtatccttgg

SEQ ID NO: 310881 - DNA, 25 bp, Mus musculus
cagaagactgttgtggtatccttgg

SEQ ID NO: 310882 - DNA, 25 bp, Mus musculus
cagaagactttcacccttaaggcct

SEQ ID NO: 310883 - DNA, 25 bp, Mus musculus
cagaagactttctcccttaaggcct

SEQ ID NO: 310884 - DNA, 25 bp, Mus musculus
cagaagagacaacctctggtccgga

SEQ ID NO: 310885 - DNA, 25 bp, Mus musculus
cagaagagacaagctctggtccgga

SEQ ID NO: 310886 - DNA, 25 bp, Mus musculus
cagaagagaccacgagacccttttt

SEQ ID NO: 310887 - DNA, 25 bp, Mus musculus
cagaagagaccaggagacccttttt

SEQ ID NO: 310888 - DNA, 25 bp, Mus musculus
cagaagagactcaaaagtgccgaaa

SEQ ID NO: 310889 - DNA, 25 bp, Mus musculus
cagaagagactctaaagtgccgaaa

SEQ ID NO: 310890 - DNA, 25 bp, Mus musculus
cagaagagagcaacgcacttggccc

SEQ ID NO: 310891 - DNA, 25 bp, Mus musculus
cagaagagagcatcgcacttggccc

SEQ ID NO: 310892 - DNA, 25 bp, Mus musculus
cagaagagattcaagctgctaggat

SEQ ID NO: 310893 - DNA, 25 bp, Mus musculus
cagaagagattctagctgctaggat

SEQ ID NO: 310894 - DNA, 25 bp, Mus musculus
cagaagagcagcagggtggcatccc

SEQ ID NO: 310895 - DNA, 25 bp, Mus musculus
cagaagagcagctgggtggcatccc

SEQ ID NO: 310896 - DNA, 25 bp, Mus musculus
cagaagagccacatttcgagagcat

SEQ ID NO: 310897 - DNA, 25 bp, Mus musculus
cagaagagccacttttcgagagcat

SEQ ID NO: 310898 - DNA, 25 bp, Mus musculus
cagaagagcctgaacggaatggagt

SEQ ID NO: 310899 - DNA, 25 bp, Mus musculus
cagaagagcctgaccggaaaacaca

SEQ ID NO: 310900 - DNA, 25 bp, Mus musculus
cagaagagcctgtacggaatggagt

SEQ ID NO: 310901 - DNA, 25 bp, Mus musculus
cagaagagcctgtccggaaaacaca

SEQ ID NO: 310902 - DNA, 25 bp, Mus musculus
cagaagaggattagtctgctttgtt

SEQ ID NO: 310903 - DNA, 25 bp, Mus musculus
cagaagaggatttgtctgctttgtt

SEQ ID NO: 310904 - DNA, 25 bp, Mus musculus
cagaagagtacccatgcctacaagg

SEQ ID NO: 310905 - DNA, 25 bp, Mus musculus
cagaagagtaccgatgcctacaagg

SEQ ID NO: 310906 - DNA, 25 bp, Mus musculus
cagaagagtacgaagggcagaacat

SEQ ID NO: 310907 - DNA, 25 bp, Mus musculus
cagaagagtacgtagggcagaacat

SEQ ID NO: 310908 - DNA, 25 bp, Mus musculus
cagaagataattcctgtcctgattt

SEQ ID NO: 310909 - DNA, 25 bp, Mus musculus
cagaagataattgctgtcctgattt

SEQ ID NO: 310910 - DNA, 25 bp, Mus musculus
cagaagatcgtacagctagctcaca

SEQ ID NO: 310911 - DNA, 25 bp, Mus musculus
cagaagatcgtagagctagctcaca

SEQ ID NO: 310912 - DNA, 25 bp, Mus musculus
cagaagatctagaagcttacgttta

SEQ ID NO: 310913 - DNA, 25 bp, Mus musculus
cagaagatctagtagcttacgttta

SEQ ID NO: 310914 - DNA, 25 bp, Mus musculus
cagaagatctatcacctccgtggca

SEQ ID NO: 310915 - DNA, 25 bp, Mus musculus
cagaagatctatgacctccgtggca

SEQ ID NO: 310916 - DNA, 25 bp, Mus musculus
cagaagatgggcagctgggcattaa

SEQ ID NO: 310917 - DNA, 25 bp, Mus musculus
cagaagatgggctgctgggcattaa

SEQ ID NO: 310918 - DNA, 25 bp, Mus musculus
cagaagatgtgcacagggccctgaa

SEQ ID NO: 310919 - DNA, 25 bp, Mus musculus
cagaagatgtgctcagggccctgaa

SEQ ID NO: 310920 - DNA, 25 bp, Mus musculus
cagaagattctccattgcccaatgt

SEQ ID NO: 310921 - DNA, 25 bp, Mus musculus
cagaagattctcgattgcccaatgt

SEQ ID NO: 310922 - DNA, 25 bp, Mus musculus
cagaagcaagttccagggtaaccaa

SEQ ID NO: 310923 - DNA, 25 bp, Mus musculus
cagaagcaagttgcagggtaaccaa

SEQ ID NO: 310924 - DNA, 25 bp, Mus musculus
cagaagcaatctcggccatacttat

SEQ ID NO: 310925 - DNA, 25 bp, Mus musculus
cagaagcaatctgggccatacttat

SEQ ID NO: 310926 - DNA, 25 bp, Mus musculus
cagaagcacctactattcttgaata

SEQ ID NO: 310927 - DNA, 25 bp, Mus musculus
cagaagcacctagtattcttgaata

SEQ ID NO: 310928 - DNA, 25 bp, Mus musculus
cagaagcactatacccggtgggagc

SEQ ID NO: 310929 - DNA, 25 bp, Mus musculus
cagaagcactattcccggtgggagc

SEQ ID NO: 310930 - DNA, 25 bp, Mus musculus
cagaagcactcaagtcacagggcat

SEQ ID NO: 310931 - DNA, 25 bp, Mus musculus
cagaagcactcatgtcacagggcat

SEQ ID NO: 310932 - DNA, 25 bp, Mus musculus
cagaagcagggtaccgccggtgcta

SEQ ID NO: 310933 - DNA, 25 bp, Mus musculus
cagaagcagggttccgccggtgcta

SEQ ID NO: 310934 - DNA, 25 bp, Mus musculus
cagaagcaggtaaccggtcccaggg

SEQ ID NO: 310935 - DNA, 25 bp, Mus musculus
cagaagcaggtatccggtcccaggg

SEQ ID NO: 310936 - DNA, 25 bp, Mus musculus
cagaagcagtccatcctagcaataa

SEQ ID NO: 310937 - DNA, 25 bp, Mus musculus
cagaagcagtccttcctagcaataa

SEQ ID NO: 310938 - DNA, 25 bp, Mus musculus
cagaagcatttgcagctccatgact

SEQ ID NO: 310939 - DNA, 25 bp, Mus musculus
cagaagcatttggagctccatgact

SEQ ID NO: 310940 - DNA, 25 bp, Mus musculus
cagaagcattttactcctcatcaga

SEQ ID NO: 310941 - DNA, 25 bp, Mus musculus
cagaagcattttcactggacagttc

SEQ ID NO: 310942 - DNA, 25 bp, Mus musculus
cagaagcattttgactggacagttc

SEQ ID NO: 310943 - DNA, 25 bp, Mus musculus
cagaagcatttttctcctcatcaga

SEQ ID NO: 310944 - DNA, 25 bp, Mus musculus
cagaagccacttagaaaaccgtgtg

SEQ ID NO: 310945 - DNA, 25 bp, Mus musculus
cagaagccactttgaaaaccgtgtg

SEQ ID NO: 310946 - DNA, 25 bp, Mus musculus
cagaagccagagacaggcgattttt

SEQ ID NO: 310947 - DNA, 25 bp, Mus musculus
cagaagccagagtcaggcgattttt

SEQ ID NO: 310948 - DNA, 25 bp, Mus musculus
cagaagccccatcagaccctgtggt

SEQ ID NO: 310949 - DNA, 25 bp, Mus musculus
cagaagccccatgagaccctgtggt

SEQ ID NO: 310950 - DNA, 25 bp, Mus musculus
cagaagccctcacaagacgacgatt

SEQ ID NO: 310951 - DNA, 25 bp, Mus musculus
cagaagccctcagaagacgacgatt

SEQ ID NO: 310952 - DNA, 25 bp, Mus musculus
cagaagccgcagcagttggccagaa

SEQ ID NO: 310953 - DNA, 25 bp, Mus musculus
cagaagccgcaggagttggccagaa

SEQ ID NO: 310954 - DNA, 25 bp, Mus musculus
cagaagccgggtactttgtgatctt

SEQ ID NO: 310955 - DNA, 25 bp, Mus musculus
cagaagccgggttctttgtgatctt

SEQ ID NO: 310956 - DNA, 25 bp, Mus musculus
cagaagccgttcctgagccgtgagt

SEQ ID NO: 310957 - DNA, 25 bp, Mus musculus
cagaagccgttcgtgagccgtgagt

SEQ ID NO: 310958 - DNA, 25 bp, Mus musculus
cagaagcctcgcctgtgatgcctag

SEQ ID NO: 310959 - DNA, 25 bp, Mus musculus
cagaagcctcgcgtgtgatgcctag

SEQ ID NO: 310960 - DNA, 25 bp, Mus musculus
cagaagcctgacacaagcctcactc

SEQ ID NO: 310961 - DNA, 25 bp, Mus musculus
cagaagcctgactcaagcctcactc

SEQ ID NO: 310962 - DNA, 25 bp, Mus musculus
cagaagcctggacactttggatacc

SEQ ID NO: 310963 - DNA, 25 bp, Mus musculus
cagaagcctggagactttggatacc

SEQ ID NO: 310964 - DNA, 25 bp, Mus musculus
cagaagccttagacatgggtgtgag

SEQ ID NO: 310965 - DNA, 25 bp, Mus musculus
cagaagccttagtcatgggtgtgag

SEQ ID NO: 310966 - DNA, 25 bp, Mus musculus
cagaagcctttcatcgtgttaaact

SEQ ID NO: 310967 - DNA, 25 bp, Mus musculus
cagaagcctttcttcgtgttaaact

SEQ ID NO: 310968 - DNA, 25 bp, Mus musculus
cagaagcggaagaatcccctggacc

SEQ ID NO: 310969 - DNA, 25 bp, Mus musculus
cagaagcggaagtatcccctggacc

SEQ ID NO: 310970 - DNA, 25 bp, Mus musculus
cagaagcgggcccacacagatgaac

SEQ ID NO: 310971 - DNA, 25 bp, Mus musculus
cagaagcgggccgacacagatgaac

SEQ ID NO: 310972 - DNA, 25 bp, Mus musculus
cagaagcgggttcagttttagagtc

SEQ ID NO: 310973 - DNA, 25 bp, Mus musculus
cagaagcgggttcccagggaggtgc

SEQ ID NO: 310974 - DNA, 25 bp, Mus musculus
cagaagcgggttgagttttagagtc

SEQ ID NO: 310975 - DNA, 25 bp, Mus musculus
cagaagcgggttgccagggaggtgc

SEQ ID NO: 310976 - DNA, 25 bp, Mus musculus
cagaagcgtccacaagagctgcctt

SEQ ID NO: 310977 - DNA, 25 bp, Mus musculus
cagaagcgtccagaagagctgcctt

SEQ ID NO: 310978 - DNA, 25 bp, Mus musculus
cagaagcgtgctattccatgtgtgc

SEQ ID NO: 310979 - DNA, 25 bp, Mus musculus
cagaagcgtgcttttccatgtgtgc

SEQ ID NO: 310980 - DNA, 25 bp, Mus musculus
cagaagctacacatggcagagaatg

SEQ ID NO: 310981 - DNA, 25 bp, Mus musculus
cagaagctacacttggcagagaatg

SEQ ID NO: 310982 - DNA, 25 bp, Mus musculus
cagaagctccctaagctgggagtga

SEQ ID NO: 310983 - DNA, 25 bp, Mus musculus
cagaagctcccttagctgggagtga

SEQ ID NO: 310984 - DNA, 25 bp, Mus musculus
cagaagctccggaggtagctgtgaa

SEQ ID NO: 310985 - DNA, 25 bp, Mus musculus
cagaagctccggtggtagctgtgaa

SEQ ID NO: 310986 - DNA, 25 bp, Mus musculus
cagaagctcctgctttctctggctg

SEQ ID NO: 310987 - DNA, 25 bp, Mus musculus
cagaagctcctggtttctctggctg

SEQ ID NO: 310988 - DNA, 25 bp, Mus musculus
cagaagctgagtccccgaccgagtg

SEQ ID NO: 310989 - DNA, 25 bp, Mus musculus
cagaagctgagtgcccgaccgagtg

SEQ ID NO: 310990 - DNA, 25 bp, Mus musculus
cagaagctgggcataatgttcctgt

SEQ ID NO: 310991 - DNA, 25 bp, Mus musculus
cagaagctgggcttaatgttcctgt

SEQ ID NO: 310992 - DNA, 25 bp, Mus musculus
cagaagctgtcaatttggcgagtgc

SEQ ID NO: 310993 - DNA, 25 bp, Mus musculus
cagaagctgtcattttggcgagtgc

SEQ ID NO: 310994 - DNA, 25 bp, Mus musculus
cagaagcttctgaatggcagcatgt

SEQ ID NO: 310995 - DNA, 25 bp, Mus musculus
cagaagcttctgtatggcagcatgt

SEQ ID NO: 310996 - DNA, 25 bp, Mus musculus
cagaagctttgaatcgctgcgtcaa

SEQ ID NO: 310997 - DNA, 25 bp, Mus musculus
cagaagctttgattcgctgcgtcaa

SEQ ID NO: 310998 - DNA, 25 bp, Mus musculus
cagaaggaaagtatgtaaccacgta

SEQ ID NO: 310999 - DNA, 25 bp, Mus musculus
cagaaggaaagtttgtaaccacgta

SEQ ID NO: 311000 - DNA, 25 bp, Mus musculus
cagaaggaacagcacagtgacctgg

SEQ ID NO: 311001 - DNA, 25 bp, Mus musculus
cagaaggaacaggacagtgacctgg

SEQ ID NO: 311002 - DNA, 25 bp, Mus musculus
cagaaggacccactattcggttact

SEQ ID NO: 311003 - DNA, 25 bp, Mus musculus
cagaaggacccagtattcggttact

SEQ ID NO: 311004 - DNA, 25 bp, Mus musculus
cagaaggacctacaccacgaaaatc

SEQ ID NO: 311005 - DNA, 25 bp, Mus musculus
cagaaggacctagaccacgaaaatc

SEQ ID NO: 311006 - DNA, 25 bp, Mus musculus
cagaaggagtcacgatgttgcacat

SEQ ID NO: 311007 - DNA, 25 bp, Mus musculus
cagaaggagtcaggatgttgcacat

SEQ ID NO: 311008 - DNA, 25 bp, Mus musculus
cagaaggagttgacatttctttaca

SEQ ID NO: 311009 - DNA, 25 bp, Mus musculus
cagaaggagttgtcatttctttaca

SEQ ID NO: 311010 - DNA, 25 bp, Mus musculus
cagaaggatcagaaggtcgaggcta

SEQ ID NO: 311011 - DNA, 25 bp, Mus musculus
cagaaggatcagtaggtcgaggcta

SEQ ID NO: 311012 - DNA, 25 bp, Mus musculus
cagaaggatcctcgcttggtataga

SEQ ID NO: 311013 - DNA, 25 bp, Mus musculus
cagaaggatcctggcttggtataga

SEQ ID NO: 311014 - DNA, 25 bp, Mus musculus
cagaaggatgtcagttgcctggtgt

SEQ ID NO: 311015 - DNA, 25 bp, Mus musculus
cagaaggatgtctgttgcctggtgt

SEQ ID NO: 311016 - DNA, 25 bp, Mus musculus
cagaaggcagaaccactgtggactt

SEQ ID NO: 311017 - DNA, 25 bp, Mus musculus
cagaaggcagaagcactgtggactt

SEQ ID NO: 311018 - DNA, 25 bp, Mus musculus
cagaaggcaggcaccagctttggat

SEQ ID NO: 311019 - DNA, 25 bp, Mus musculus
cagaaggcaggctccagctttggat

SEQ ID NO: 311020 - DNA, 25 bp, Mus musculus
cagaaggcagggaccctctgactat

SEQ ID NO: 311021 - DNA, 25 bp, Mus musculus
cagaaggcagggtccctctgactat

SEQ ID NO: 311022 - DNA, 25 bp, Mus musculus
cagaaggcagtccttcctccaaaga

SEQ ID NO: 311023 - DNA, 25 bp, Mus musculus
cagaaggcagtcgttcctccaaaga

SEQ ID NO: 311024 - DNA, 25 bp, Mus musculus
cagaaggcatctatgtagagtcatt

SEQ ID NO: 311025 - DNA, 25 bp, Mus musculus
cagaaggcatctttgtagagtcatt

SEQ ID NO: 311026 - DNA, 25 bp, Mus musculus
cagaaggccacaaagcacccattgt

SEQ ID NO: 311027 - DNA, 25 bp, Mus musculus
cagaaggccacatagcacccattgt

SEQ ID NO: 311028 - DNA, 25 bp, Mus musculus
cagaaggccccacccttggatgtag

SEQ ID NO: 311029 - DNA, 25 bp, Mus musculus
cagaaggccccagccttggatgtag

SEQ ID NO: 311030 - DNA, 25 bp, Mus musculus
cagaaggccctacattctcaagagg

SEQ ID NO: 311031 - DNA, 25 bp, Mus musculus
cagaaggccctagattctcaagagg

SEQ ID NO: 311032 - DNA, 25 bp, Mus musculus
cagaaggcctggcttttctttccag

SEQ ID NO: 311033 - DNA, 25 bp, Mus musculus
cagaaggcctgggttttctttccag

SEQ ID NO: 311034 - DNA, 25 bp, Mus musculus
cagaaggcgcagactccagtttggg

SEQ ID NO: 311035 - DNA, 25 bp, Mus musculus
cagaaggcgcagtctccagtttggg

SEQ ID NO: 311036 - DNA, 25 bp, Mus musculus
cagaaggcggagaagatcccctaaa

SEQ ID NO: 311037 - DNA, 25 bp, Mus musculus
cagaaggcggagtagatcccctaaa

SEQ ID NO: 311038 - DNA, 25 bp, Mus musculus
cagaaggctccaccgcagagtccaa

SEQ ID NO: 311039 - DNA, 25 bp, Mus musculus
cagaaggctccagcgcagagtccaa

SEQ ID NO: 311040 - DNA, 25 bp, Mus musculus
cagaaggctggaatgtttggtttca

SEQ ID NO: 311041 - DNA, 25 bp, Mus musculus
cagaaggctggattgtttggtttca

SEQ ID NO: 311042 - DNA, 25 bp, Mus musculus
cagaaggctgttagcgtaaccacat

SEQ ID NO: 311043 - DNA, 25 bp, Mus musculus
cagaaggctgtttgcgtaaccacat

SEQ ID NO: 311044 - DNA, 25 bp, Mus musculus
cagaaggcttgtctattggtgatga

SEQ ID NO: 311045 - DNA, 25 bp, Mus musculus
cagaaggcttgtgtattggtgatga

SEQ ID NO: 311046 - DNA, 25 bp, Mus musculus
cagaagggaagcacttctgggtgtc

SEQ ID NO: 311047 - DNA, 25 bp, Mus musculus
cagaagggaagctcttctgggtgtc

SEQ ID NO: 311048 - DNA, 25 bp, Mus musculus
cagaagggactgctagcttgaactt

SEQ ID NO: 311049 - DNA, 25 bp, Mus musculus
cagaagggactggtagcttgaactt

SEQ ID NO: 311050 - DNA, 25 bp, Mus musculus
cagaagggctccacggtgcgcatgc

SEQ ID NO: 311051 - DNA, 25 bp, Mus musculus
cagaagggctcctcggtgcgcatgc

SEQ ID NO: 311052 - DNA, 25 bp, Mus musculus
cagaaggtagtcactgcccgctgag

SEQ ID NO: 311053 - DNA, 25 bp, Mus musculus
cagaaggtagtctctgcccgctgag

SEQ ID NO: 311054 - DNA, 25 bp, Mus musculus
cagaaggtcgagatgcctgctctat

SEQ ID NO: 311055 - DNA, 25 bp, Mus musculus
cagaaggtcgagttgcctgctctat

SEQ ID NO: 311056 - DNA, 25 bp, Mus musculus
cagaaggtctgtcgtcttgaccgat

SEQ ID NO: 311057 - DNA, 25 bp, Mus musculus
cagaaggtctgtggtcttgaccgat

SEQ ID NO: 311058 - DNA, 25 bp, Mus musculus
cagaaggtgattctccggttcggta

SEQ ID NO: 311059 - DNA, 25 bp, Mus musculus
cagaaggtgattgtccggttcggta

SEQ ID NO: 311060 - DNA, 25 bp, Mus musculus
cagaaggtggataagattgtcaaga

SEQ ID NO: 311061 - DNA, 25 bp, Mus musculus
cagaaggtggattagattgtcaaga

SEQ ID NO: 311062 - DNA, 25 bp, Mus musculus
cagaaggtgggactggctctccctc

SEQ ID NO: 311063 - DNA, 25 bp, Mus musculus
cagaaggtgggagtggctctccctc

SEQ ID NO: 311064 - DNA, 25 bp, Mus musculus
cagaaggttctgcagcaaattgggc

SEQ ID NO: 311065 - DNA, 25 bp, Mus musculus
cagaaggttctggagcaaattgggc

SEQ ID NO: 311066 - DNA, 25 bp, Mus musculus
cagaaggttcttcctagggtggcct

SEQ ID NO: 311067 - DNA, 25 bp, Mus musculus
cagaaggttcttgctagggtggcct

SEQ ID NO: 311068 - DNA, 25 bp, Mus musculus
cagaaggttgagatacagatacagt

SEQ ID NO: 311069 - DNA, 25 bp, Mus musculus
cagaaggttgagttacagatacagt

SEQ ID NO: 311070 - DNA, 25 bp, Mus musculus
cagaagtaaattagactccttagtt

SEQ ID NO: 311071 - DNA, 25 bp, Mus musculus
cagaagtaaatttgactccttagtt

SEQ ID NO: 311072 - DNA, 25 bp, Mus musculus
cagaagtaatgaagtaatgtgccca

SEQ ID NO: 311073 - DNA, 25 bp, Mus musculus
cagaagtaatgatgtaatgtgccca

SEQ ID NO: 311074 - DNA, 25 bp, Mus musculus
cagaagtactgtctttggtaccagc

SEQ ID NO: 311075 - DNA, 25 bp, Mus musculus
cagaagtactgtgtttggtaccagc

SEQ ID NO: 311076 - DNA, 25 bp, Mus musculus
cagaagtagtgactgtttcctatcc

SEQ ID NO: 311077 - DNA, 25 bp, Mus musculus
cagaagtagtgagtgtttcctatcc

SEQ ID NO: 311078 - DNA, 25 bp, Mus musculus
cagaagtataatctttgccagctgg

SEQ ID NO: 311079 - DNA, 25 bp, Mus musculus
cagaagtataatgtttgccagctgg

SEQ ID NO: 311080 - DNA, 25 bp, Mus musculus
cagaagtcacacaccaaacctgatt

SEQ ID NO: 311081 - DNA, 25 bp, Mus musculus
cagaagtcacactccaaacctgatt

SEQ ID NO: 311082 - DNA, 25 bp, Mus musculus
cagaagtcatggaccagccagagcc

SEQ ID NO: 311083 - DNA, 25 bp, Mus musculus
cagaagtcatggtccagccagagcc

SEQ ID NO: 311084 - DNA, 25 bp, Mus musculus
cagaagtcccttccttgtttgtaat

SEQ ID NO: 311085 - DNA, 25 bp, Mus musculus
cagaagtcccttgcttgtttgtaat

SEQ ID NO: 311086 - DNA, 25 bp, Mus musculus
cagaagtccgggactcggtgttctt

SEQ ID NO: 311087 - DNA, 25 bp, Mus musculus
cagaagtccgggtctcggtgttctt

SEQ ID NO: 311088 - DNA, 25 bp, Mus musculus
cagaagtcctatctcctgtcaaact

SEQ ID NO: 311089 - DNA, 25 bp, Mus musculus
cagaagtcctatgtcctgtcaaact

SEQ ID NO: 311090 - DNA, 25 bp, Mus musculus
cagaagtgattgacttttgtactct

SEQ ID NO: 311091 - DNA, 25 bp, Mus musculus
cagaagtgattgtcttttgtactct

SEQ ID NO: 311092 - DNA, 25 bp, Mus musculus
cagaagtggatgattacgacgaaga

SEQ ID NO: 311093 - DNA, 25 bp, Mus musculus
cagaagtggatgtttacgacgaaga

SEQ ID NO: 311094 - DNA, 25 bp, Mus musculus
cagaagtggctcactgatgctcaga

SEQ ID NO: 311095 - DNA, 25 bp, Mus musculus
cagaagtggctctctgatgctcaga

SEQ ID NO: 311096 - DNA, 25 bp, Mus musculus
cagaagtggttccttgactgtccca

SEQ ID NO: 311097 - DNA, 25 bp, Mus musculus
cagaagtggttcgttgactgtccca

SEQ ID NO: 311098 - DNA, 25 bp, Mus musculus
cagaagtggtttatgtctctgcgtg

SEQ ID NO: 311099 - DNA, 25 bp, Mus musculus
cagaagtggtttttgtctctgcgtg

SEQ ID NO: 311100 - DNA, 25 bp, Mus musculus
cagaagtgttgtccgactgggctct

SEQ ID NO: 311101 - DNA, 25 bp, Mus musculus
cagaagtgttgtgcgactgggctct

SEQ ID NO: 311102 - DNA, 25 bp, Mus musculus
cagaagttattgagcctccgggtca

SEQ ID NO: 311103 - DNA, 25 bp, Mus musculus
cagaagttattgtgcctccgggtca

SEQ ID NO: 311104 - DNA, 25 bp, Mus musculus
cagaagttcacacccaacctgggat

SEQ ID NO: 311105 - DNA, 25 bp, Mus musculus
cagaagttcacagccaacctgggat

SEQ ID NO: 311106 - DNA, 25 bp, Mus musculus
cagaagttgttccagctaagagcat

SEQ ID NO: 311107 - DNA, 25 bp, Mus musculus
cagaagttgttcgagctaagagcat

SEQ ID NO: 311108 - DNA, 25 bp, Mus musculus
cagaagtttcttcagccaccattgc

SEQ ID NO: 311109 - DNA, 25 bp, Mus musculus
cagaagtttcttgagccaccattgc

SEQ ID NO: 311110 - DNA, 25 bp, Mus musculus
cagaagtttgtcaagggcctttgtt

SEQ ID NO: 311111 - DNA, 25 bp, Mus musculus
cagaagtttgtctagggcctttgtt

SEQ ID NO: 311112 - DNA, 25 bp, Mus musculus
cagaataacgtgcaggtgaaactca

SEQ ID NO: 311113 - DNA, 25 bp, Mus musculus
cagaataacgtggaggtgaaactca

SEQ ID NO: 311114 - DNA, 25 bp, Mus musculus
cagaatacaaagctcacctgctggg

SEQ ID NO: 311115 - DNA, 25 bp, Mus musculus
cagaatacaaaggtcacctgctggg

SEQ ID NO: 311116 - DNA, 25 bp, Mus musculus
cagaatacatgcattctgctcctga

SEQ ID NO: 311117 - DNA, 25 bp, Mus musculus
cagaatacatgctttctgctcctga

SEQ ID NO: 311118 - DNA, 25 bp, Mus musculus
cagaatacctcactggcttatgcca

SEQ ID NO: 311119 - DNA, 25 bp, Mus musculus
cagaatacctcagtggcttatgcca

SEQ ID NO: 311120 - DNA, 25 bp, Mus musculus
cagaatactccccattgtcgttttt

SEQ ID NO: 311121 - DNA, 25 bp, Mus musculus
cagaatactcccgattgtcgttttt

SEQ ID NO: 311122 - DNA, 25 bp, Mus musculus
cagaatagcagcattctcctggtgg

SEQ ID NO: 311123 - DNA, 25 bp, Mus musculus
cagaatagcagctttctcctggtgg

SEQ ID NO: 311124 - DNA, 25 bp, Mus musculus
cagaatagccatcttcataggcatg

SEQ ID NO: 311125 - DNA, 25 bp, Mus musculus
cagaatagccatgttcataggcatg

SEQ ID NO: 311126 - DNA, 25 bp, Mus musculus
cagaatatccaacgacttaagtgaa

SEQ ID NO: 311127 - DNA, 25 bp, Mus musculus
cagaatatccaacggctggagccca

SEQ ID NO: 311128 - DNA, 25 bp, Mus musculus
cagaatatccaaggacttaagtgaa

SEQ ID NO: 311129 - DNA, 25 bp, Mus musculus
cagaatatccaagggctggagccca

SEQ ID NO: 311130 - DNA, 25 bp, Mus musculus
cagaatatctttcataggtgtgcct

SEQ ID NO: 311131 - DNA, 25 bp, Mus musculus
cagaatatctttgataggtgtgcct

SEQ ID NO: 311132 - DNA, 25 bp, Mus musculus
cagaatattaagaagtcttcccaca

SEQ ID NO: 311133 - DNA, 25 bp, Mus musculus
cagaatattaagtagtcttcccaca

SEQ ID NO: 311134 - DNA, 25 bp, Mus musculus
cagaatcacaggattggttttggta

SEQ ID NO: 311135 - DNA, 25 bp, Mus musculus
cagaatcacaggtttggttttggta

SEQ ID NO: 311136 - DNA, 25 bp, Mus musculus
cagaatcaggaaatccagaggtgga

SEQ ID NO: 311137 - DNA, 25 bp, Mus musculus
cagaatcaggaattccagaggtgga

SEQ ID NO: 311138 - DNA, 25 bp, Mus musculus
cagaatccatatagtgcgtcacaac

SEQ ID NO: 311139 - DNA, 25 bp, Mus musculus
cagaatccatattgtgcgtcacaac

SEQ ID NO: 311140 - DNA, 25 bp, Mus musculus
cagaatccatccaccatgatgtata

SEQ ID NO: 311141 - DNA, 25 bp, Mus musculus
cagaatccatcctccatgatgtata

SEQ ID NO: 311142 - DNA, 25 bp, Mus musculus
cagaatcccttgagaataaacccat

SEQ ID NO: 311143 - DNA, 25 bp, Mus musculus
cagaatcccttgtgaataaacccat

SEQ ID NO: 311144 - DNA, 25 bp, Mus musculus
cagaatcctgatctggctggctcag

SEQ ID NO: 311145 - DNA, 25 bp, Mus musculus
cagaatcctgatgtggctggctcag

SEQ ID NO: 311146 - DNA, 25 bp, Mus musculus
cagaatccttttcagggaggccaca

SEQ ID NO: 311147 - DNA, 25 bp, Mus musculus
cagaatccttttgagggaggccaca

SEQ ID NO: 311148 - DNA, 25 bp, Mus musculus
cagaatcgaagtatccatgcacgga

SEQ ID NO: 311149 - DNA, 25 bp, Mus musculus
cagaatcgaagtttccatgcacgga

SEQ ID NO: 311150 - DNA, 25 bp, Mus musculus
cagaatcgtttgctgcgtcttgtgt

SEQ ID NO: 311151 - DNA, 25 bp, Mus musculus
cagaatcgtttggtgcgtcttgtgt

SEQ ID NO: 311152 - DNA, 25 bp, Mus musculus
cagaatctaatacttcccctgggat

SEQ ID NO: 311153 - DNA, 25 bp, Mus musculus
cagaatctaatagttcccctgggat

SEQ ID NO: 311154 - DNA, 25 bp, Mus musculus
cagaatctacacacaatgacaaaat

SEQ ID NO: 311155 - DNA, 25 bp, Mus musculus
cagaatctacactcaatgacaaaat

SEQ ID NO: 311156 - DNA, 25 bp, Mus musculus
cagaatctactcctcggacagtgat

SEQ ID NO: 311157 - DNA, 25 bp, Mus musculus
cagaatctactcgtcggacagtgat

SEQ ID NO: 311158 - DNA, 25 bp, Mus musculus
cagaatctccctcccttaaatttaa

SEQ ID NO: 311159 - DNA, 25 bp, Mus musculus
cagaatctccctgccttaaatttaa

SEQ ID NO: 311160 - DNA, 25 bp, Mus musculus
cagaatctctgcaatgacgtgggtc

SEQ ID NO: 311161 - DNA, 25 bp, Mus musculus
cagaatctctgctatgacgtgggtc

SEQ ID NO: 311162 - DNA, 25 bp, Mus musculus
cagaatctcttgaaaccttgggttc

SEQ ID NO: 311163 - DNA, 25 bp, Mus musculus
cagaatctcttgtaaccttgggttc

SEQ ID NO: 311164 - DNA, 25 bp, Mus musculus
cagaatctgagcacatgcgtgtgca

SEQ ID NO: 311165 - DNA, 25 bp, Mus musculus
cagaatctgagctcatgcgtgtgca

SEQ ID NO: 311166 - DNA, 25 bp, Mus musculus
cagaatctggtcctcttttccccat

SEQ ID NO: 311167 - DNA, 25 bp, Mus musculus
cagaatctggtcgtcttttccccat

SEQ ID NO: 311168 - DNA, 25 bp, Mus musculus
cagaatctgttcactttctagggaa

SEQ ID NO: 311169 - DNA, 25 bp, Mus musculus
cagaatctgttctctttctagggaa

SEQ ID NO: 311170 - DNA, 25 bp, Mus musculus
cagaatcttacacctcgtactttta

SEQ ID NO: 311171 - DNA, 25 bp, Mus musculus
cagaatcttacagctcgtactttta

SEQ ID NO: 311172 - DNA, 25 bp, Mus musculus
cagaatcttctaaagcagcaccgct

SEQ ID NO: 311173 - DNA, 25 bp, Mus musculus
cagaatcttctacgtcttcagcaga

SEQ ID NO: 311174 - DNA, 25 bp, Mus musculus
cagaatcttctaggtcttcagcaga

SEQ ID NO: 311175 - DNA, 25 bp, Mus musculus
cagaatcttctatagcagcaccgct

SEQ ID NO: 311176 - DNA, 25 bp, Mus musculus
cagaatcttctcagtgtctatgact

SEQ ID NO: 311177 - DNA, 25 bp, Mus musculus
cagaatcttctctgtgtctatgact

SEQ ID NO: 311178 - DNA, 25 bp, Mus musculus
cagaatcttgatcctttttcccaaa

SEQ ID NO: 311179 - DNA, 25 bp, Mus musculus
cagaatcttgatgctttttcccaaa

SEQ ID NO: 311180 - DNA, 25 bp, Mus musculus
cagaatgaaatgatttgaccactct

SEQ ID NO: 311181 - DNA, 25 bp, Mus musculus
cagaatgaaatgttttgaccactct

SEQ ID NO: 311182 - DNA, 25 bp, Mus musculus
cagaatgaagttcgatgaccccata

SEQ ID NO: 311183 - DNA, 25 bp, Mus musculus
cagaatgaagttggatgaccccata

SEQ ID NO: 311184 - DNA, 25 bp, Mus musculus
cagaatgaatatccgttgtagtaat

SEQ ID NO: 311185 - DNA, 25 bp, Mus musculus
cagaatgaatatgcgttgtagtaat

SEQ ID NO: 311186 - DNA, 25 bp, Mus musculus
cagaatgacgagctggcagcttttt

SEQ ID NO: 311187 - DNA, 25 bp, Mus musculus
cagaatgacgaggtggcagcttttt

SEQ ID NO: 311188 - DNA, 25 bp, Mus musculus
cagaatgagcatacacaggctatgt

SEQ ID NO: 311189 - DNA, 25 bp, Mus musculus
cagaatgagcattcacaggctatgt

SEQ ID NO: 311190 - DNA, 25 bp, Mus musculus
cagaatgcaagcactttgctgttgc

SEQ ID NO: 311191 - DNA, 25 bp, Mus musculus
cagaatgcaagctctttgctgttgc

SEQ ID NO: 311192 - DNA, 25 bp, Mus musculus
cagaatgcctccatccaatggataa

SEQ ID NO: 311193 - DNA, 25 bp, Mus musculus
cagaatgcctccttccaatggataa

SEQ ID NO: 311194 - DNA, 25 bp, Mus musculus
cagaatgctcagactgcaagaaaac

SEQ ID NO: 311195 - DNA, 25 bp, Mus musculus
cagaatgctcagtctgcaagaaaac

SEQ ID NO: 311196 - DNA, 25 bp, Mus musculus
cagaatgctgagatacggctaagat

SEQ ID NO: 311197 - DNA, 25 bp, Mus musculus
cagaatgctgagttacggctaagat

SEQ ID NO: 311198 - DNA, 25 bp, Mus musculus
cagaatgctggtccactagtgggat

SEQ ID NO: 311199 - DNA, 25 bp, Mus musculus
cagaatgctggtgcactagtgggat

SEQ ID NO: 311200 - DNA, 25 bp, Mus musculus
cagaatgcttttcctcatgtagtag

SEQ ID NO: 311201 - DNA, 25 bp, Mus musculus
cagaatgcttttgctcatgtagtag

SEQ ID NO: 311202 - DNA, 25 bp, Mus musculus
cagaatggaattcttcattgctgaa

SEQ ID NO: 311203 - DNA, 25 bp, Mus musculus
cagaatggaattgttcattgctgaa

SEQ ID NO: 311204 - DNA, 25 bp, Mus musculus
cagaatggctccagtgagggctgca

SEQ ID NO: 311205 - DNA, 25 bp, Mus musculus
cagaatggctcctgtgagggctgca

SEQ ID NO: 311206 - DNA, 25 bp, Mus musculus
cagaatgggaacaacgcctcggagg

SEQ ID NO: 311207 - DNA, 25 bp, Mus musculus
cagaatgggaactacgcctcggagg

SEQ ID NO: 311208 - DNA, 25 bp, Mus musculus
cagaatgggactagaccgtgcttca

SEQ ID NO: 311209 - DNA, 25 bp, Mus musculus
cagaatgggacttgaccgtgcttca

SEQ ID NO: 311210 - DNA, 25 bp, Mus musculus
cagaatggtatgcagttagtgataa

SEQ ID NO: 311211 - DNA, 25 bp, Mus musculus
cagaatggtatggagttagtgataa

SEQ ID NO: 311212 - DNA, 25 bp, Mus musculus
cagaatggtggcaccggacccggac

SEQ ID NO: 311213 - DNA, 25 bp, Mus musculus
cagaatggtggctccggacccggac

SEQ ID NO: 311214 - DNA, 25 bp, Mus musculus
cagaatgtacacaacgctagctgcc

SEQ ID NO: 311215 - DNA, 25 bp, Mus musculus
cagaatgtacactacgctagctgcc

SEQ ID NO: 311216 - DNA, 25 bp, Mus musculus
cagaatgtagtcacctgctagtgga

SEQ ID NO: 311217 - DNA, 25 bp, Mus musculus
cagaatgtagtctcctgctagtgga

SEQ ID NO: 311218 - DNA, 25 bp, Mus musculus
cagaatgtcttccagttgacagctg

SEQ ID NO: 311219 - DNA, 25 bp, Mus musculus
cagaatgtcttcgagttgacagctg

SEQ ID NO: 311220 - DNA, 25 bp, Mus musculus
cagaatgtgacaattttgatccaga

SEQ ID NO: 311221 - DNA, 25 bp, Mus musculus
cagaatgtgacatttttgatccaga

SEQ ID NO: 311222 - DNA, 25 bp, Mus musculus
cagaatgtgatgctggatcttacta

SEQ ID NO: 311223 - DNA, 25 bp, Mus musculus
cagaatgtgatggtggatcttacta

SEQ ID NO: 311224 - DNA, 25 bp, Mus musculus
cagaatgtttatccctgctcgacaa

SEQ ID NO: 311225 - DNA, 25 bp, Mus musculus
cagaatgtttatgcctgctcgacaa

SEQ ID NO: 311226 - DNA, 25 bp, Mus musculus
cagaatgtttgaaggccgcccggga

SEQ ID NO: 311227 - DNA, 25 bp, Mus musculus
cagaatgtttgatggccgcccggga

SEQ ID NO: 311228 - DNA, 25 bp, Mus musculus
cagaattaacttatgtcatggttta

SEQ ID NO: 311229 - DNA, 25 bp, Mus musculus
cagaattaacttttgtcatggttta

SEQ ID NO: 311230 - DNA, 25 bp, Mus musculus
cagaattaccccaattcagaaatta

SEQ ID NO: 311231 - DNA, 25 bp, Mus musculus
cagaattacccctattcagaaatta

SEQ ID NO: 311232 - DNA, 25 bp, Mus musculus
cagaattatagaatgggagatgcca

SEQ ID NO: 311233 - DNA, 25 bp, Mus musculus
cagaattatagattgggagatgcca

SEQ ID NO: 311234 - DNA, 25 bp, Mus musculus
cagaattatgtaaactgtgattgtg

SEQ ID NO: 311235 - DNA, 25 bp, Mus musculus
cagaattatgtatactgtgattgtg

SEQ ID NO: 311236 - DNA, 25 bp, Mus musculus
cagaattcagtaatgtattgacatc

SEQ ID NO: 311237 - DNA, 25 bp, Mus musculus
cagaattcagtattgtattgacatc

SEQ ID NO: 311238 - DNA, 25 bp, Mus musculus
cagaattcccaaatgagaagtgtgt

SEQ ID NO: 311239 - DNA, 25 bp, Mus musculus
cagaattcccaattgagaagtgtgt

SEQ ID NO: 311240 - DNA, 25 bp, Mus musculus
cagaattctcggacttcaccatcta

SEQ ID NO: 311241 - DNA, 25 bp, Mus musculus
cagaattctcggtcttcaccatcta

SEQ ID NO: 311242 - DNA, 25 bp, Mus musculus
cagaattctggactgtgggaactca

SEQ ID NO: 311243 - DNA, 25 bp, Mus musculus
cagaattctggagtgtgggaactca

SEQ ID NO: 311244 - DNA, 25 bp, Mus musculus
cagaattctgtaaccgccaagtttt

SEQ ID NO: 311245 - DNA, 25 bp, Mus musculus
cagaattctgtatccgccaagtttt

SEQ ID NO: 311246 - DNA, 25 bp, Mus musculus
cagaattcttcactgcaggcaggtg

SEQ ID NO: 311247 - DNA, 25 bp, Mus musculus
cagaattcttcagtgcaggcaggtg

SEQ ID NO: 311248 - DNA, 25 bp, Mus musculus
cagaattgaagcagggttccccagc

SEQ ID NO: 311249 - DNA, 25 bp, Mus musculus
cagaattgaagctgggttccccagc

SEQ ID NO: 311250 - DNA, 25 bp, Mus musculus
cagaattgactgctggttagaactt

SEQ ID NO: 311251 - DNA, 25 bp, Mus musculus
cagaattgactggtggttagaactt

SEQ ID NO: 311252 - DNA, 25 bp, Mus musculus
cagaattgaggcagagaccgtggaa

SEQ ID NO: 311253 - DNA, 25 bp, Mus musculus
cagaattgaggctgagaccgtggaa

SEQ ID NO: 311254 - DNA, 25 bp, Mus musculus
cagaattgtcttcccattgtgatga

SEQ ID NO: 311255 - DNA, 25 bp, Mus musculus
cagaattgtcttgccattgtgatga

SEQ ID NO: 311256 - DNA, 25 bp, Mus musculus
cagaattgtgtgaagctttgagttg

SEQ ID NO: 311257 - DNA, 25 bp, Mus musculus
cagaattgtgtgtagctttgagttg

SEQ ID NO: 311258 - DNA, 25 bp, Mus musculus
cagaattgttctccggtagctttgc

SEQ ID NO: 311259 - DNA, 25 bp, Mus musculus
cagaattgttctgcggtagctttgc

SEQ ID NO: 311260 - DNA, 25 bp, Mus musculus
cagaatttacttaggctaatctttt

SEQ ID NO: 311261 - DNA, 25 bp, Mus musculus
cagaatttactttggctaatctttt

SEQ ID NO: 311262 - DNA, 25 bp, Mus musculus
cagaatttcccaaagcagtgcatgc

SEQ ID NO: 311263 - DNA, 25 bp, Mus musculus
cagaatttcccatagcagtgcatgc

SEQ ID NO: 311264 - DNA, 25 bp, Mus musculus
cagaatttccttaaacgcagatcaa

SEQ ID NO: 311265 - DNA, 25 bp, Mus musculus
cagaatttcctttaacgcagatcaa

SEQ ID NO: 311266 - DNA, 25 bp, Mus musculus
cagaatttctgtcagcctgcattat

SEQ ID NO: 311267 - DNA, 25 bp, Mus musculus
cagaatttctgtgagcctgcattat

SEQ ID NO: 311268 - DNA, 25 bp, Mus musculus
cagacaaaacagcttatattttcac

SEQ ID NO: 311269 - DNA, 25 bp, Mus musculus
cagacaaaacaggttatattttcac

SEQ ID NO: 311270 - DNA, 25 bp, Mus musculus
cagacaaacggaaagcttgcgatga

SEQ ID NO: 311271 - DNA, 25 bp, Mus musculus
cagacaaacggatagcttgcgatga

SEQ ID NO: 311272 - DNA, 25 bp, Mus musculus
cagacaaactaaaacccggcacgag

SEQ ID NO: 311273 - DNA, 25 bp, Mus musculus
cagacaaactaatacccggcacgag

SEQ ID NO: 311274 - DNA, 25 bp, Mus musculus
cagacaaagcaaatcttctgttgca

SEQ ID NO: 311275 - DNA, 25 bp, Mus musculus
cagacaaagcaattcttctgttgca

SEQ ID NO: 311276 - DNA, 25 bp, Mus musculus
cagacaaatctcaagctggctgtga

SEQ ID NO: 311277 - DNA, 25 bp, Mus musculus
cagacaaatctctagctggctgtga

SEQ ID NO: 311278 - DNA, 25 bp, Mus musculus
cagacaaatgctaaatgttttcttt

SEQ ID NO: 311279 - DNA, 25 bp, Mus musculus
cagacaaatgcttaatgttttcttt

SEQ ID NO: 311280 - DNA, 25 bp, Mus musculus
cagacaacagcaaagcgtgggttct

SEQ ID NO: 311281 - DNA, 25 bp, Mus musculus
cagacaacagcatagcgtgggttct

SEQ ID NO: 311282 - DNA, 25 bp, Mus musculus
cagacaacagccagggagggcagat

SEQ ID NO: 311283 - DNA, 25 bp, Mus musculus
cagacaacagcctgggagggcagat

SEQ ID NO: 311284 - DNA, 25 bp, Mus musculus
cagacaaccaccactcaggaggaaa

SEQ ID NO: 311285 - DNA, 25 bp, Mus musculus
cagacaaccacctctcaggaggaaa

SEQ ID NO: 311286 - DNA, 25 bp, Mus musculus
cagacaactacaatgggccaacaag

SEQ ID NO: 311287 - DNA, 25 bp, Mus musculus
cagacaactacattgggccaacaag

SEQ ID NO: 311288 - DNA, 25 bp, Mus musculus
cagacaactgtgaggtcgggatcca

SEQ ID NO: 311289 - DNA, 25 bp, Mus musculus
cagacaactgtgtggtcgggatcca

SEQ ID NO: 311290 - DNA, 25 bp, Mus musculus
cagacaagatagcagcccagcttcg

SEQ ID NO: 311291 - DNA, 25 bp, Mus musculus
cagacaagataggagcccagcttcg

SEQ ID NO: 311292 - DNA, 25 bp, Mus musculus
cagacaagcattaggtacatatacc

SEQ ID NO: 311293 - DNA, 25 bp, Mus musculus
cagacaagcatttggtacatatacc

SEQ ID NO: 311294 - DNA, 25 bp, Mus musculus
cagacaaggcagatcaggctcatgt

SEQ ID NO: 311295 - DNA, 25 bp, Mus musculus
cagacaaggcagttcaggctcatgt

SEQ ID NO: 311296 - DNA, 25 bp, Mus musculus
cagacaagtgagctgcagagagaca

SEQ ID NO: 311297 - DNA, 25 bp, Mus musculus
cagacaagtgaggtgcagagagaca

SEQ ID NO: 311298 - DNA, 25 bp, Mus musculus
cagacaataccaccgctggagttaa

SEQ ID NO: 311299 - DNA, 25 bp, Mus musculus
cagacaataccagcgctggagttaa

SEQ ID NO: 311300 - DNA, 25 bp, Mus musculus
cagacaatccggagagcttgtgtac

SEQ ID NO: 311301 - DNA, 25 bp, Mus musculus
cagacaatccggtgagcttgtgtac

SEQ ID NO: 311302 - DNA, 25 bp, Mus musculus
cagacaatcggtacacacgcaggtg

SEQ ID NO: 311303 - DNA, 25 bp, Mus musculus
cagacaatcggttcacacgcaggtg

SEQ ID NO: 311304 - DNA, 25 bp, Mus musculus
cagacaatgcgacgcgctgaactcc

SEQ ID NO: 311305 - DNA, 25 bp, Mus musculus
cagacaatgcgaggcgctgaactcc

SEQ ID NO: 311306 - DNA, 25 bp, Mus musculus
cagacaatggctaggcacctcgagt

SEQ ID NO: 311307 - DNA, 25 bp, Mus musculus
cagacaatggcttggcacctcgagt

SEQ ID NO: 311308 - DNA, 25 bp, Mus musculus
cagacacaagttctttctaccactg

SEQ ID NO: 311309 - DNA, 25 bp, Mus musculus
cagacacaagttgtttctaccactg

SEQ ID NO: 311310 - DNA, 25 bp, Mus musculus
cagacacacgtgatttcactgtggt

SEQ ID NO: 311311 - DNA, 25 bp, Mus musculus
cagacacacgtgttttcactgtggt

SEQ ID NO: 311312 - DNA, 25 bp, Mus musculus
cagacacagaggctggcatcatatt

SEQ ID NO: 311313 - DNA, 25 bp, Mus musculus
cagacacagagggtggcatcatatt

SEQ ID NO: 311314 - DNA, 25 bp, Mus musculus
cagacacagcagactctcctctttg

SEQ ID NO: 311315 - DNA, 25 bp, Mus musculus
cagacacagcagtctctcctctttg

SEQ ID NO: 311316 - DNA, 25 bp, Mus musculus
cagacacaggtgagaggacgcttga

SEQ ID NO: 311317 - DNA, 25 bp, Mus musculus
cagacacaggtgtgaggacgcttga

SEQ ID NO: 311318 - DNA, 25 bp, Mus musculus
cagacacagttcacctttttatgcc

SEQ ID NO: 311319 - DNA, 25 bp, Mus musculus
cagacacagttctcctttttatgcc

SEQ ID NO: 311320 - DNA, 25 bp, Mus musculus
cagacacatctgcaagacgccctgt

SEQ ID NO: 311321 - DNA, 25 bp, Mus musculus
cagacacatctggaagacgccctgt

SEQ ID NO: 311322 - DNA, 25 bp, Mus musculus
cagacacatggcaaatccctgctgc

SEQ ID NO: 311323 - DNA, 25 bp, Mus musculus
cagacacatggctaatccctgctgc

SEQ ID NO: 311324 - DNA, 25 bp, Mus musculus
cagacaccaaccatatgctgcttca

SEQ ID NO: 311325 - DNA, 25 bp, Mus musculus
cagacaccaaccttatgctgcttca

SEQ ID NO: 311326 - DNA, 25 bp, Mus musculus
cagacaccaacgatcccatttatgt

SEQ ID NO: 311327 - DNA, 25 bp, Mus musculus
cagacaccaacgttcccatttatgt

SEQ ID NO: 311328 - DNA, 25 bp, Mus musculus
cagacaccagatattaggctttgaa

SEQ ID NO: 311329 - DNA, 25 bp, Mus musculus
cagacaccagattttaggctttgaa

SEQ ID NO: 311330 - DNA, 25 bp, Mus musculus
cagacacccagtatagcctaataca

SEQ ID NO: 311331 - DNA, 25 bp, Mus musculus
cagacacccagtttagcctaataca

SEQ ID NO: 311332 - DNA, 25 bp, Mus musculus
cagacaccgcacaccctaaaaccgg

SEQ ID NO: 311333 - DNA, 25 bp, Mus musculus
cagacaccgcactccctaaaaccgg

SEQ ID NO: 311334 - DNA, 25 bp, Mus musculus
cagacaccgcttaccttgaagtaat

SEQ ID NO: 311335 - DNA, 25 bp, Mus musculus
cagacaccgctttccttgaagtaat

SEQ ID NO: 311336 - DNA, 25 bp, Mus musculus
cagacacctcctagcttgaggtagt

SEQ ID NO: 311337 - DNA, 25 bp, Mus musculus
cagacacctccttgcttgaggtagt

SEQ ID NO: 311338 - DNA, 25 bp, Mus musculus
cagacacctgtaagtgacctggatt

SEQ ID NO: 311339 - DNA, 25 bp, Mus musculus
cagacacctgtatgtgacctggatt

SEQ ID NO: 311340 - DNA, 25 bp, Mus musculus
cagacacctgttctacttgcatcaa

SEQ ID NO: 311341 - DNA, 25 bp, Mus musculus
cagacacctgttgtacttgcatcaa

SEQ ID NO: 311342 - DNA, 25 bp, Mus musculus
cagacacgagtcctggcagagatgc

SEQ ID NO: 311343 - DNA, 25 bp, Mus musculus
cagacacgagtcgtggcagagatgc

SEQ ID NO: 311344 - DNA, 25 bp, Mus musculus
cagacacggacacgtgcccgaggat

SEQ ID NO: 311345 - DNA, 25 bp, Mus musculus
cagacacggacaggtgcccgaggat

SEQ ID NO: 311346 - DNA, 25 bp, Mus musculus
cagacacggtgccttcatttttgta

SEQ ID NO: 311347 - DNA, 25 bp, Mus musculus
cagacacggtgcgttcatttttgta

SEQ ID NO: 311348 - DNA, 25 bp, Mus musculus
cagacacggtttacccaagcgaagg

SEQ ID NO: 311349 - DNA, 25 bp, Mus musculus
cagacacggttttcccaagcgaagg

SEQ ID NO: 311350 - DNA, 25 bp, Mus musculus
cagacactccatcgcagactagggt

SEQ ID NO: 311351 - DNA, 25 bp, Mus musculus
cagacactccatggcagactagggt

SEQ ID NO: 311352 - DNA, 25 bp, Mus musculus
cagacactccgtctgactgtaacat

SEQ ID NO: 311353 - DNA, 25 bp, Mus musculus
cagacactccgtgtgactgtaacat

SEQ ID NO: 311354 - DNA, 25 bp, Mus musculus
cagacactcctgactgctaagctgt

SEQ ID NO: 311355 - DNA, 25 bp, Mus musculus
cagacactcctgtctgctaagctgt

SEQ ID NO: 311356 - DNA, 25 bp, Mus musculus
cagacactcgccattgaattttatg

SEQ ID NO: 311357 - DNA, 25 bp, Mus musculus
cagacactcgcctttgaattttatg

SEQ ID NO: 311358 - DNA, 25 bp, Mus musculus
cagacactctggctattcggataat

SEQ ID NO: 311359 - DNA, 25 bp, Mus musculus
cagacactctgggtattcggataat

SEQ ID NO: 311360 - DNA, 25 bp, Mus musculus
cagacactctgtccctaagccttga

SEQ ID NO: 311361 - DNA, 25 bp, Mus musculus
cagacactctgtgcctaagccttga

SEQ ID NO: 311362 - DNA, 25 bp, Mus musculus
cagacactgaagatcctgccaagtt

SEQ ID NO: 311363 - DNA, 25 bp, Mus musculus
cagacactgaagttcctgccaagtt

SEQ ID NO: 311364 - DNA, 25 bp, Mus musculus
cagacactgatcacagggagggaag

SEQ ID NO: 311365 - DNA, 25 bp, Mus musculus
cagacactgatctcagggagggaag

SEQ ID NO: 311366 - DNA, 25 bp, Mus musculus
cagacactgccactgttcaaggaag

SEQ ID NO: 311367 - DNA, 25 bp, Mus musculus
cagacactgccagtgttcaaggaag

SEQ ID NO: 311368 - DNA, 25 bp, Mus musculus
cagacactgggacctggtaaaatag

SEQ ID NO: 311369 - DNA, 25 bp, Mus musculus
cagacactgggagctggtaaaatag

SEQ ID NO: 311370 - DNA, 25 bp, Mus musculus
cagacactgtcaactcatcagcaga

SEQ ID NO: 311371 - DNA, 25 bp, Mus musculus
cagacactgtcatctcatcagcaga

SEQ ID NO: 311372 - DNA, 25 bp, Mus musculus
cagacactgtgtaaggtagagaaat

SEQ ID NO: 311373 - DNA, 25 bp, Mus musculus
cagacactgtgttaggtagagaaat

SEQ ID NO: 311374 - DNA, 25 bp, Mus musculus
cagacacttcaaccactcagatggg

SEQ ID NO: 311375 - DNA, 25 bp, Mus musculus
cagacacttcaagcactcagatggg

SEQ ID NO: 311376 - DNA, 25 bp, Mus musculus
cagacacttccaattccaaggcatt

SEQ ID NO: 311377 - DNA, 25 bp, Mus musculus
cagacacttccatttccaaggcatt

SEQ ID NO: 311378 - DNA, 25 bp, Mus musculus
cagacactttctagctgagcactaa

SEQ ID NO: 311379 - DNA, 25 bp, Mus musculus
cagacactttcttgctgagcactaa

SEQ ID NO: 311380 - DNA, 25 bp, Mus musculus
cagacagaaaggacaagtggctaga

SEQ ID NO: 311381 - DNA, 25 bp, Mus musculus
cagacagaaaggtcaagtggctaga

SEQ ID NO: 311382 - DNA, 25 bp, Mus musculus
cagacagacaatcgagcggtgtgct

SEQ ID NO: 311383 - DNA, 25 bp, Mus musculus
cagacagacaatggagcggtgtgct

SEQ ID NO: 311384 - DNA, 25 bp, Mus musculus
cagacagacagtccagtcacccata

SEQ ID NO: 311385 - DNA, 25 bp, Mus musculus
cagacagacagtgcagtcacccata

SEQ ID NO: 311386 - DNA, 25 bp, Mus musculus
cagacagactatccaagacgggaaa

SEQ ID NO: 311387 - DNA, 25 bp, Mus musculus
cagacagactatgcaagacgggaaa

SEQ ID NO: 311388 - DNA, 25 bp, Mus musculus
cagacagactgacgcaccacagagg

SEQ ID NO: 311389 - DNA, 25 bp, Mus musculus
cagacagactgaggcaccacagagg

SEQ ID NO: 311390 - DNA, 25 bp, Mus musculus
cagacagagaccatggaggcggcaa

SEQ ID NO: 311391 - DNA, 25 bp, Mus musculus
cagacagagaccttggaggcggcaa

SEQ ID NO: 311392 - DNA, 25 bp, Mus musculus
cagacagaggaaacagcttgctttt

SEQ ID NO: 311393 - DNA, 25 bp, Mus musculus
cagacagaggaatcagcttgctttt

SEQ ID NO: 311394 - DNA, 25 bp, Mus musculus
cagacagatcggaccctggaatcaa

SEQ ID NO: 311395 - DNA, 25 bp, Mus musculus
cagacagatcggtccctggaatcaa

SEQ ID NO: 311396 - DNA, 25 bp, Mus musculus
cagacagatctgcagctcaaggtta

SEQ ID NO: 311397 - DNA, 25 bp, Mus musculus
cagacagatctggagctcaaggtta

SEQ ID NO: 311398 - DNA, 25 bp, Mus musculus
cagacagatgttattcggcttggat

SEQ ID NO: 311399 - DNA, 25 bp, Mus musculus
cagacagatgtttttcggcttggat

SEQ ID NO: 311400 - DNA, 25 bp, Mus musculus
cagacagcaggacgtcaggtgccat

SEQ ID NO: 311401 - DNA, 25 bp, Mus musculus
cagacagcaggaggtcaggtgccat

SEQ ID NO: 311402 - DNA, 25 bp, Mus musculus
cagacagcaggccacagcattcttg

SEQ ID NO: 311403 - DNA, 25 bp, Mus musculus
cagacagcaggcgacagcattcttg

SEQ ID NO: 311404 - DNA, 25 bp, Mus musculus
cagacagccctgatcagagagtacc

SEQ ID NO: 311405 - DNA, 25 bp, Mus musculus
cagacagccctgctttgtgtcgcca

SEQ ID NO: 311406 - DNA, 25 bp, Mus musculus
cagacagccctggtttgtgtcgcca

SEQ ID NO: 311407 - DNA, 25 bp, Mus musculus
cagacagccctgttcagagagtacc

SEQ ID NO: 311408 - DNA, 25 bp, Mus musculus
cagacagcctgaagccatgaagagt

SEQ ID NO: 311409 - DNA, 25 bp, Mus musculus
cagacagcctgatgccatgaagagt

SEQ ID NO: 311410 - DNA, 25 bp, Mus musculus
cagacagcctttcgccctgaatgtg

SEQ ID NO: 311411 - DNA, 25 bp, Mus musculus
cagacagcctttggccctgaatgtg

SEQ ID NO: 311412 - DNA, 25 bp, Mus musculus
cagacagcgcagctgcagtatggct

SEQ ID NO: 311413 - DNA, 25 bp, Mus musculus
cagacagcgcaggtgcagtatggct

SEQ ID NO: 311414 - DNA, 25 bp, Mus musculus
cagacagctaggacccagaggccag

SEQ ID NO: 311415 - DNA, 25 bp, Mus musculus
cagacagctaggtcccagaggccag

SEQ ID NO: 311416 - DNA, 25 bp, Mus musculus
cagacagctctgcttggaaacagtt

SEQ ID NO: 311417 - DNA, 25 bp, Mus musculus
cagacagctctggttggaaacagtt

SEQ ID NO: 311418 - DNA, 25 bp, Mus musculus
cagacagctggcctggaggctaata

SEQ ID NO: 311419 - DNA, 25 bp, Mus musculus
cagacagctggcgtggaggctaata

SEQ ID NO: 311420 - DNA, 25 bp, Mus musculus
cagacagctgggaacctgggtgcca

SEQ ID NO: 311421 - DNA, 25 bp, Mus musculus
cagacagctgggtacctgggtgcca

SEQ ID NO: 311422 - DNA, 25 bp, Mus musculus
cagacagctttcctttttgtaacta

SEQ ID NO: 311423 - DNA, 25 bp, Mus musculus
cagacagctttcgtttttgtaacta

SEQ ID NO: 311424 - DNA, 25 bp, Mus musculus
cagacagcttttctgatgtttcaaa

SEQ ID NO: 311425 - DNA, 25 bp, Mus musculus
cagacagcttttgtgatgtttcaaa

SEQ ID NO: 311426 - DNA, 25 bp, Mus musculus
cagacaggagagcaccagcaggact

SEQ ID NO: 311427 - DNA, 25 bp, Mus musculus
cagacaggagaggaccagcaggact

SEQ ID NO: 311428 - DNA, 25 bp, Mus musculus
cagacaggatttacaagctaaccac

SEQ ID NO: 311429 - DNA, 25 bp, Mus musculus
cagacaggattttcaagctaaccac

SEQ ID NO: 311430 - DNA, 25 bp, Mus musculus
cagacaggcaacaaggcttattagt

SEQ ID NO: 311431 - DNA, 25 bp, Mus musculus
cagacaggcaactaggcttattagt

SEQ ID NO: 311432 - DNA, 25 bp, Mus musculus
cagacaggcagacaggtaaaacact

SEQ ID NO: 311433 - DNA, 25 bp, Mus musculus
cagacaggcagagaggtaaaacact

SEQ ID NO: 311434 - DNA, 25 bp, Mus musculus
cagacaggccggagaccagcagtgt

SEQ ID NO: 311435 - DNA, 25 bp, Mus musculus
cagacaggccggtgaccagcagtgt

SEQ ID NO: 311436 - DNA, 25 bp, Mus musculus
cagacaggctgaaatttaacatagt

SEQ ID NO: 311437 - DNA, 25 bp, Mus musculus
cagacaggctgatatttaacatagt

SEQ ID NO: 311438 - DNA, 25 bp, Mus musculus
cagacaggctgtatgatttcatcaa

SEQ ID NO: 311439 - DNA, 25 bp, Mus musculus
cagacaggctgtcaacagttacaca

SEQ ID NO: 311440 - DNA, 25 bp, Mus musculus
cagacaggctgtgaacagttacaca

SEQ ID NO: 311441 - DNA, 25 bp, Mus musculus
cagacaggctgtttgatttcatcaa

SEQ ID NO: 311442 - DNA, 25 bp, Mus musculus
cagacaggcttacctactacctagt

SEQ ID NO: 311443 - DNA, 25 bp, Mus musculus
cagacaggcttagctactacctagt

SEQ ID NO: 311444 - DNA, 25 bp, Mus musculus
cagacaggtcttatactagtttccg

SEQ ID NO: 311445 - DNA, 25 bp, Mus musculus
cagacaggtcttttactagtttccg

SEQ ID NO: 311446 - DNA, 25 bp, Mus musculus
cagacaggtttcagtctttctttgt

SEQ ID NO: 311447 - DNA, 25 bp, Mus musculus
cagacaggtttctgtctttctttgt

SEQ ID NO: 311448 - DNA, 25 bp, Mus musculus
cagacagtcaggcttccaagccaga

SEQ ID NO: 311449 - DNA, 25 bp, Mus musculus
cagacagtcagggttccaagccaga

SEQ ID NO: 311450 - DNA, 25 bp, Mus musculus
cagacagtcctgaggaacgacgaga

SEQ ID NO: 311451 - DNA, 25 bp, Mus musculus
cagacagtcctgtggaacgacgaga

SEQ ID NO: 311452 - DNA, 25 bp, Mus musculus
cagacagtgagcacggtggagacaa

SEQ ID NO: 311453 - DNA, 25 bp, Mus musculus
cagacagtgagcagcagggagcaat

SEQ ID NO: 311454 - DNA, 25 bp, Mus musculus
cagacagtgagctcggtggagacaa

SEQ ID NO: 311455 - DNA, 25 bp, Mus musculus
cagacagtgagctgcagggagcaat

SEQ ID NO: 311456 - DNA, 25 bp, Mus musculus
cagacagtgagtcctctgtgcatgc

SEQ ID NO: 311457 - DNA, 25 bp, Mus musculus
cagacagtgagtgctctgtgcatgc

SEQ ID NO: 311458 - DNA, 25 bp, Mus musculus
cagacagtgcaaatgggaaagaaac

SEQ ID NO: 311459 - DNA, 25 bp, Mus musculus
cagacagtgcaattgggaaagaaac

SEQ ID NO: 311460 - DNA, 25 bp, Mus musculus
cagacagtgtgaccccattgtccct

SEQ ID NO: 311461 - DNA, 25 bp, Mus musculus
cagacagtgtgagcccattgtccct

SEQ ID NO: 311462 - DNA, 25 bp, Mus musculus
cagacagtgtggagcactcacttga

SEQ ID NO: 311463 - DNA, 25 bp, Mus musculus
cagacagtgtggtgcactcacttga

SEQ ID NO: 311464 - DNA, 25 bp, Mus musculus
cagacagttaagagtggccatgaaa

SEQ ID NO: 311465 - DNA, 25 bp, Mus musculus
cagacagttaagtgtggccatgaaa

SEQ ID NO: 311466 - DNA, 25 bp, Mus musculus
cagacagttcctatgattccattgc

SEQ ID NO: 311467 - DNA, 25 bp, Mus musculus
cagacagttcctttgattccattgc

SEQ ID NO: 311468 - DNA, 25 bp, Mus musculus
cagacagttctgcagcctggccgct

SEQ ID NO: 311469 - DNA, 25 bp, Mus musculus
cagacagttctggagcctggccgct

SEQ ID NO: 311470 - DNA, 25 bp, Mus musculus
cagacagtttaaagtgcggccacac

SEQ ID NO: 311471 - DNA, 25 bp, Mus musculus
cagacagtttaatgtgcggccacac

SEQ ID NO: 311472 - DNA, 25 bp, Mus musculus
cagacataacttatggcggcggatt

SEQ ID NO: 311473 - DNA, 25 bp, Mus musculus
cagacataacttttggcggcggatt

SEQ ID NO: 311474 - DNA, 25 bp, Mus musculus
cagacatacatgagcaggcctttaa

SEQ ID NO: 311475 - DNA, 25 bp, Mus musculus
cagacatacatgtgcaggcctttaa

SEQ ID NO: 311476 - DNA, 25 bp, Mus musculus
cagacatactggacggctttttcca

SEQ ID NO: 311477 - DNA, 25 bp, Mus musculus
cagacatactggtcggctttttcca

SEQ ID NO: 311478 - DNA, 25 bp, Mus musculus
cagacatactgtcaaaggatctttt

SEQ ID NO: 311479 - DNA, 25 bp, Mus musculus
cagacatactgtgaaaggatctttt

SEQ ID NO: 311480 - DNA, 25 bp, Mus musculus
cagacatatcacctgttcaggacag

SEQ ID NO: 311481 - DNA, 25 bp, Mus musculus
cagacatatcacgtgttcaggacag

SEQ ID NO: 311482 - DNA, 25 bp, Mus musculus
cagacatcatagatcttggaagcta

SEQ ID NO: 311483 - DNA, 25 bp, Mus musculus
cagacatcatagttcttggaagcta

SEQ ID NO: 311484 - DNA, 25 bp, Mus musculus
cagacatcccagcatattacatcag

SEQ ID NO: 311485 - DNA, 25 bp, Mus musculus
cagacatcccaggatattacatcag

SEQ ID NO: 311486 - DNA, 25 bp, Mus musculus
cagacatcctgactctcccagagga

SEQ ID NO: 311487 - DNA, 25 bp, Mus musculus
cagacatcctgagtctcccagagga

SEQ ID NO: 311488 - DNA, 25 bp, Mus musculus
cagacatcctgtcttctcagagaag

SEQ ID NO: 311489 - DNA, 25 bp, Mus musculus
cagacatcctgtgttctcagagaag

SEQ ID NO: 311490 - DNA, 25 bp, Mus musculus
cagacatcggtcactagcattggga

SEQ ID NO: 311491 - DNA, 25 bp, Mus musculus
cagacatcggtctctagcattggga

SEQ ID NO: 311492 - DNA, 25 bp, Mus musculus
cagacatctgctactctttagcata

SEQ ID NO: 311493 - DNA, 25 bp, Mus musculus
cagacatctgcttctctttagcata

SEQ ID NO: 311494 - DNA, 25 bp, Mus musculus
cagacatctgggacgtgagccataa

SEQ ID NO: 311495 - DNA, 25 bp, Mus musculus
cagacatctgggtcgtgagccataa

SEQ ID NO: 311496 - DNA, 25 bp, Mus musculus
cagacatgcaggaccagattttggg

SEQ ID NO: 311497 - DNA, 25 bp, Mus musculus
cagacatgcaggtccagattttggg

SEQ ID NO: 311498 - DNA, 25 bp, Mus musculus
cagacatgcggtatagcgtcggtgt

SEQ ID NO: 311499 - DNA, 25 bp, Mus musculus
cagacatgcggtttagcgtcggtgt

SEQ ID NO: 311500 - DNA, 25 bp, Mus musculus
cagacatggagaccaggacccagga

SEQ ID NO: 311501 - DNA, 25 bp, Mus musculus
cagacatggagagcaggacccagga

SEQ ID NO: 311502 - DNA, 25 bp, Mus musculus
cagacatgtacccagtccataatgg

SEQ ID NO: 311503 - DNA, 25 bp, Mus musculus
cagacatgtaccgagtccataatgg

SEQ ID NO: 311504 - DNA, 25 bp, Mus musculus
cagacatgtatgctgcgtgctgttg

SEQ ID NO: 311505 - DNA, 25 bp, Mus musculus
cagacatgtatggtgcgtgctgttg

SEQ ID NO: 311506 - DNA, 25 bp, Mus musculus
cagacatgtcaaactgtgccactgt

SEQ ID NO: 311507 - DNA, 25 bp, Mus musculus
cagacatgtcaatctgtgccactgt

SEQ ID NO: 311508 - DNA, 25 bp, Mus musculus
cagacatgtccacccagggtaggag

SEQ ID NO: 311509 - DNA, 25 bp, Mus musculus
cagacatgtccagccagggtaggag

SEQ ID NO: 311510 - DNA, 25 bp, Mus musculus
cagacatgtttacgagtcagttccc

SEQ ID NO: 311511 - DNA, 25 bp, Mus musculus
cagacatgtttaggagtcagttccc

SEQ ID NO: 311512 - DNA, 25 bp, Mus musculus
cagacattcaagaatcgctgttcac

SEQ ID NO: 311513 - DNA, 25 bp, Mus musculus
cagacattcaagtatcgctgttcac

SEQ ID NO: 311514 - DNA, 25 bp, Mus musculus
cagacattccctcccatatatgaag

SEQ ID NO: 311515 - DNA, 25 bp, Mus musculus
cagacattccctgccatatatgaag

SEQ ID NO: 311516 - DNA, 25 bp, Mus musculus
cagacattctccatctaaacatctt

SEQ ID NO: 311517 - DNA, 25 bp, Mus musculus
cagacattctccttctaaacatctt

SEQ ID NO: 311518 - DNA, 25 bp, Mus musculus
cagacattgaccctgttccagagga

SEQ ID NO: 311519 - DNA, 25 bp, Mus musculus
cagacattgaccgtgttccagagga

SEQ ID NO: 311520 - DNA, 25 bp, Mus musculus
cagacattgatgacttactttttat

SEQ ID NO: 311521 - DNA, 25 bp, Mus musculus
cagacattgatgtcttactttttat

SEQ ID NO: 311522 - DNA, 25 bp, Mus musculus
cagacattggctctatgtgaggcct

SEQ ID NO: 311523 - DNA, 25 bp, Mus musculus
cagacattggctgtatgtgaggcct

SEQ ID NO: 311524 - DNA, 25 bp, Mus musculus
cagacatttactattcacgcgatgg

SEQ ID NO: 311525 - DNA, 25 bp, Mus musculus
cagacatttacttttcacgcgatgg

SEQ ID NO: 311526 - DNA, 25 bp, Mus musculus
cagacatttttcaccaagaaggaca

SEQ ID NO: 311527 - DNA, 25 bp, Mus musculus
cagacatttttcacggctcattttt

SEQ ID NO: 311528 - DNA, 25 bp, Mus musculus
cagacatttttctccaagaaggaca

SEQ ID NO: 311529 - DNA, 25 bp, Mus musculus
cagacatttttctcggctcattttt

SEQ ID NO: 311530 - DNA, 25 bp, Mus musculus
cagaccaaccacctatgtaataatt

SEQ ID NO: 311531 - DNA, 25 bp, Mus musculus
cagaccaaccacgtatgtaataatt

SEQ ID NO: 311532 - DNA, 25 bp, Mus musculus
cagaccaactctaaagatagacttt

SEQ ID NO: 311533 - DNA, 25 bp, Mus musculus
cagaccaactcttaagatagacttt

SEQ ID NO: 311534 - DNA, 25 bp, Mus musculus
cagaccaagacaccggcaagtgtga

SEQ ID NO: 311535 - DNA, 25 bp, Mus musculus
cagaccaagacagcggcaagtgtga

SEQ ID NO: 311536 - DNA, 25 bp, Mus musculus
cagaccaagagacacaagcaccgag

SEQ ID NO: 311537 - DNA, 25 bp, Mus musculus
cagaccaagagagacaagcaccgag

SEQ ID NO: 311538 - DNA, 25 bp, Mus musculus
cagaccaagtctaaagcccgttcgt

SEQ ID NO: 311539 - DNA, 25 bp, Mus musculus
cagaccaagtcttaagcccgttcgt

SEQ ID NO: 311540 - DNA, 25 bp, Mus musculus
cagaccaatggtagctgacagtcat

SEQ ID NO: 311541 - DNA, 25 bp, Mus musculus
cagaccaatggttgctgacagtcat

SEQ ID NO: 311542 - DNA, 25 bp, Mus musculus
cagaccacacagattattttatggt

SEQ ID NO: 311543 - DNA, 25 bp, Mus musculus
cagaccacacagtttattttatggt

SEQ ID NO: 311544 - DNA, 25 bp, Mus musculus
cagaccacaccccaatggagattgt

SEQ ID NO: 311545 - DNA, 25 bp, Mus musculus
cagaccacacccgaatggagattgt

SEQ ID NO: 311546 - DNA, 25 bp, Mus musculus
cagaccacgtgtatcaggtttctat

SEQ ID NO: 311547 - DNA, 25 bp, Mus musculus
cagaccacgtgtttcaggtttctat

SEQ ID NO: 311548 - DNA, 25 bp, Mus musculus
cagaccactgtccttttgttcagta

SEQ ID NO: 311549 - DNA, 25 bp, Mus musculus
cagaccactgtcgttttgttcagta

SEQ ID NO: 311550 - DNA, 25 bp, Mus musculus
cagaccagaaggaggcaggctgact

SEQ ID NO: 311551 - DNA, 25 bp, Mus musculus
cagaccagaaggtggcaggctgact

SEQ ID NO: 311552 - DNA, 25 bp, Mus musculus
cagaccagatagcaggtgtgcagct

SEQ ID NO: 311553 - DNA, 25 bp, Mus musculus
cagaccagataggaggtgtgcagct

SEQ ID NO: 311554 - DNA, 25 bp, Mus musculus
cagaccagcagtaggagttcttcag

SEQ ID NO: 311555 - DNA, 25 bp, Mus musculus
cagaccagcagttggagttcttcag

SEQ ID NO: 311556 - DNA, 25 bp, Mus musculus
cagaccagccctagaactttatcaa

SEQ ID NO: 311557 - DNA, 25 bp, Mus musculus
cagaccagcccttgaactttatcaa

SEQ ID NO: 311558 - DNA, 25 bp, Mus musculus
cagaccaggacaagcccgggcaagc

SEQ ID NO: 311559 - DNA, 25 bp, Mus musculus
cagaccaggacatgcccgggcaagc

SEQ ID NO: 311560 - DNA, 25 bp, Mus musculus
cagaccaggctcagcaacacattga

SEQ ID NO: 311561 - DNA, 25 bp, Mus musculus
cagaccaggctctgcaacacattga

SEQ ID NO: 311562 - DNA, 25 bp, Mus musculus
cagaccagggtgcagtgggcaggct

SEQ ID NO: 311563 - DNA, 25 bp, Mus musculus
cagaccagggtggagtgggcaggct

SEQ ID NO: 311564 - DNA, 25 bp, Mus musculus
cagaccaggtcaaaatatcatatta

SEQ ID NO: 311565 - DNA, 25 bp, Mus musculus
cagaccaggtcataatatcatatta

SEQ ID NO: 311566 - DNA, 25 bp, Mus musculus
cagaccagtgctaatttgtgtacaa

SEQ ID NO: 311567 - DNA, 25 bp, Mus musculus
cagaccagtgctcggtgtgacttga

SEQ ID NO: 311568 - DNA, 25 bp, Mus musculus
cagaccagtgctgggtgtgacttga

SEQ ID NO: 311569 - DNA, 25 bp, Mus musculus
cagaccagtgcttatttgtgtacaa

SEQ ID NO: 311570 - DNA, 25 bp, Mus musculus
cagaccatacctcactatttcttat

SEQ ID NO: 311571 - DNA, 25 bp, Mus musculus
cagaccatacctgactatttcttat

SEQ ID NO: 311572 - DNA, 25 bp, Mus musculus
cagaccatagttctgaagcttccaa

SEQ ID NO: 311573 - DNA, 25 bp, Mus musculus
cagaccatagttgtgaagcttccaa

SEQ ID NO: 311574 - DNA, 25 bp, Mus musculus
cagaccatctacacatgcagttgtg

SEQ ID NO: 311575 - DNA, 25 bp, Mus musculus
cagaccatctactcatgcagttgtg

SEQ ID NO: 311576 - DNA, 25 bp, Mus musculus
cagaccatgataccaccacgtgtta

SEQ ID NO: 311577 - DNA, 25 bp, Mus musculus
cagaccatgatagcaccacgtgtta

SEQ ID NO: 311578 - DNA, 25 bp, Mus musculus
cagaccatggtgatgacgttgcctt

SEQ ID NO: 311579 - DNA, 25 bp, Mus musculus
cagaccatggtgttgacgttgcctt

SEQ ID NO: 311580 - DNA, 25 bp, Mus musculus
cagaccatgtctctagtatgcaagt

SEQ ID NO: 311581 - DNA, 25 bp, Mus musculus
cagaccatgtctgtagtatgcaagt

SEQ ID NO: 311582 - DNA, 25 bp, Mus musculus
cagaccatttacacggaccatcaga

SEQ ID NO: 311583 - DNA, 25 bp, Mus musculus
cagaccatttactcggaccatcaga

SEQ ID NO: 311584 - DNA, 25 bp, Mus musculus
cagaccatttcaagttcaagcccag

SEQ ID NO: 311585 - DNA, 25 bp, Mus musculus
cagaccatttcatgttcaagcccag

SEQ ID NO: 311586 - DNA, 25 bp, Mus musculus
cagacccaacaaagcgtcgcatgtg

SEQ ID NO: 311587 - DNA, 25 bp, Mus musculus
cagacccaacaatgcgtcgcatgtg

SEQ ID NO: 311588 - DNA, 25 bp, Mus musculus
cagacccaatgtaatcattgctgga

SEQ ID NO: 311589 - DNA, 25 bp, Mus musculus
cagacccaatgttatcattgctgga

SEQ ID NO: 311590 - DNA, 25 bp, Mus musculus
cagacccacagcattaccagggaaa

SEQ ID NO: 311591 - DNA, 25 bp, Mus musculus
cagacccacagctttaccagggaaa

SEQ ID NO: 311592 - DNA, 25 bp, Mus musculus
cagacccaccacaagcaaagtgtga

SEQ ID NO: 311593 - DNA, 25 bp, Mus musculus
cagacccaccactagcaaagtgtga

SEQ ID NO: 311594 - DNA, 25 bp, Mus musculus
cagacccaccgacccgtgatggaaa

SEQ ID NO: 311595 - DNA, 25 bp, Mus musculus
cagacccaccgagccgtgatggaaa

SEQ ID NO: 311596 - DNA, 25 bp, Mus musculus
cagacccacgttacccatagttctt

SEQ ID NO: 311597 - DNA, 25 bp, Mus musculus
cagacccacgtttcccatagttctt

SEQ ID NO: 311598 - DNA, 25 bp, Mus musculus
cagacccagaaaccttgcacggaga

SEQ ID NO: 311599 - DNA, 25 bp, Mus musculus
cagacccagaaagcttgcacggaga

SEQ ID NO: 311600 - DNA, 25 bp, Mus musculus
cagacccagacaaagagccaggact

SEQ ID NO: 311601 - DNA, 25 bp, Mus musculus
cagacccagacatagagccaggact

SEQ ID NO: 311602 - DNA, 25 bp, Mus musculus
cagacccagaccacacattcaggaa

SEQ ID NO: 311603 - DNA, 25 bp, Mus musculus
cagacccagacctcacattcaggaa

SEQ ID NO: 311604 - DNA, 25 bp, Mus musculus
cagacccaggtgctctttgggatga

SEQ ID NO: 311605 - DNA, 25 bp, Mus musculus
cagacccaggtggtctttgggatga

SEQ ID NO: 311606 - DNA, 25 bp, Mus musculus
cagaccccaacgcattttctaatag

SEQ ID NO: 311607 - DNA, 25 bp, Mus musculus
cagaccccaacggattttctaatag

SEQ ID NO: 311608 - DNA, 25 bp, Mus musculus
cagaccccaagacgcagaagacaga

SEQ ID NO: 311609 - DNA, 25 bp, Mus musculus
cagaccccaagaggcagaagacaga

SEQ ID NO: 311610 - DNA, 25 bp, Mus musculus
cagaccccagtcacttaaatgttat

SEQ ID NO: 311611 - DNA, 25 bp, Mus musculus
cagaccccagtctcttaaatgttat

SEQ ID NO: 311612 - DNA, 25 bp, Mus musculus
cagaccccagttaacctcaaggaga

SEQ ID NO: 311613 - DNA, 25 bp, Mus musculus
cagaccccagtttacctcaaggaga

SEQ ID NO: 311614 - DNA, 25 bp, Mus musculus
cagaccccatggctcagatatgtgg

SEQ ID NO: 311615 - DNA, 25 bp, Mus musculus
cagaccccatgggtcagatatgtgg

SEQ ID NO: 311616 - DNA, 25 bp, Mus musculus
cagaccccctgcaaaattggaagtg

SEQ ID NO: 311617 - DNA, 25 bp, Mus musculus
cagaccccctgctaaattggaagtg

SEQ ID NO: 311618 - DNA, 25 bp, Mus musculus
cagaccccgggacgtgcttttacag

SEQ ID NO: 311619 - DNA, 25 bp, Mus musculus
cagaccccgggaggtgcttttacag

SEQ ID NO: 311620 - DNA, 25 bp, Mus musculus
cagacccctgggacagaatacaatg

SEQ ID NO: 311621 - DNA, 25 bp, Mus musculus
cagacccctgggtcagaatacaatg

SEQ ID NO: 311622 - DNA, 25 bp, Mus musculus
cagaccccttgcaactgatagagga

SEQ ID NO: 311623 - DNA, 25 bp, Mus musculus
cagaccccttgctactgatagagga

SEQ ID NO: 311624 - DNA, 25 bp, Mus musculus
cagacccgccatagtgttcagaata

SEQ ID NO: 311625 - DNA, 25 bp, Mus musculus
cagacccgccattgtgttcagaata

SEQ ID NO: 311626 - DNA, 25 bp, Mus musculus
cagacccgccctaagattggaaatt

SEQ ID NO: 311627 - DNA, 25 bp, Mus musculus
cagacccgcccttagattggaaatt

SEQ ID NO: 311628 - DNA, 25 bp, Mus musculus
cagacccgcctgaagatattcgagc

SEQ ID NO: 311629 - DNA, 25 bp, Mus musculus
cagacccgcctgtagatattcgagc

SEQ ID NO: 311630 - DNA, 25 bp, Mus musculus
cagacccggaaaccttgcctatgga

SEQ ID NO: 311631 - DNA, 25 bp, Mus musculus
cagacccggaaagcttgcctatgga

SEQ ID NO: 311632 - DNA, 25 bp, Mus musculus
cagacccggcctacctgatttagtc

SEQ ID NO: 311633 - DNA, 25 bp, Mus musculus
cagacccggcctcggattggcagca

SEQ ID NO: 311634 - DNA, 25 bp, Mus musculus
cagacccggcctgggattggcagca

SEQ ID NO: 311635 - DNA, 25 bp, Mus musculus
cagacccggccttcctgatttagtc

SEQ ID NO: 311636 - DNA, 25 bp, Mus musculus
cagacccggctgcatgagagaacga

SEQ ID NO: 311637 - DNA, 25 bp, Mus musculus
cagacccggctggatgagagaacga

SEQ ID NO: 311638 - DNA, 25 bp, Mus musculus
cagaccctaatacctggttctcaaa

SEQ ID NO: 311639 - DNA, 25 bp, Mus musculus
cagaccctaatagctggttctcaaa

SEQ ID NO: 311640 - DNA, 25 bp, Mus musculus
cagaccctagctcagacatttttgt

SEQ ID NO: 311641 - DNA, 25 bp, Mus musculus
cagaccctagctgagacatttttgt

SEQ ID NO: 311642 - DNA, 25 bp, Mus musculus
cagaccctcacccttttcaagggct

SEQ ID NO: 311643 - DNA, 25 bp, Mus musculus
cagaccctcaccgttttcaagggct

SEQ ID NO: 311644 - DNA, 25 bp, Mus musculus
cagaccctcttcatgtttgccaaag

SEQ ID NO: 311645 - DNA, 25 bp, Mus musculus
cagaccctcttcttgtttgccaaag

SEQ ID NO: 311646 - DNA, 25 bp, Mus musculus
cagaccctgaacagaagacagagtt

SEQ ID NO: 311647 - DNA, 25 bp, Mus musculus
cagaccctgaactgaagacagagtt

SEQ ID NO: 311648 - DNA, 25 bp, Mus musculus
cagaccctgacacggcagacacctt

SEQ ID NO: 311649 - DNA, 25 bp, Mus musculus
cagaccctgacagggcagacacctt

SEQ ID NO: 311650 - DNA, 25 bp, Mus musculus
cagaccctgagaaataccctcacat

SEQ ID NO: 311651 - DNA, 25 bp, Mus musculus
cagaccctgagatataccctcacat

SEQ ID NO: 311652 - DNA, 25 bp, Mus musculus
cagaccctgcgaactctgagcttac

SEQ ID NO: 311653 - DNA, 25 bp, Mus musculus
cagaccctgcgatctctgagcttac

SEQ ID NO: 311654 - DNA, 25 bp, Mus musculus
cagaccctggatcacaccgagagag

SEQ ID NO: 311655 - DNA, 25 bp, Mus musculus
cagaccctggatgacaccgagagag

SEQ ID NO: 311656 - DNA, 25 bp, Mus musculus
cagaccctgggcctagtaaagaaca

SEQ ID NO: 311657 - DNA, 25 bp, Mus musculus
cagaccctgggcgtagtaaagaaca

SEQ ID NO: 311658 - DNA, 25 bp, Mus musculus
cagaccctgggtacgagagtacttt

SEQ ID NO: 311659 - DNA, 25 bp, Mus musculus
cagaccctgggtcctataattagat

SEQ ID NO: 311660 - DNA, 25 bp, Mus musculus
cagaccctgggtgctataattagat

SEQ ID NO: 311661 - DNA, 25 bp, Mus musculus
cagaccctgggttcgagagtacttt

SEQ ID NO: 311662 - DNA, 25 bp, Mus musculus
cagaccctgtccagtcataatatca

SEQ ID NO: 311663 - DNA, 25 bp, Mus musculus
cagaccctgtcctgtcataatatca

SEQ ID NO: 311664 - DNA, 25 bp, Mus musculus
cagaccctgtgtcggtttggcccct

SEQ ID NO: 311665 - DNA, 25 bp, Mus musculus
cagaccctgtgtgggtttggcccct

SEQ ID NO: 311666 - DNA, 25 bp, Mus musculus
cagaccctgtttaccagtcagatga

SEQ ID NO: 311667 - DNA, 25 bp, Mus musculus
cagaccctgttttccagtcagatga

SEQ ID NO: 311668 - DNA, 25 bp, Mus musculus
cagacccttaacataactagcaaat

SEQ ID NO: 311669 - DNA, 25 bp, Mus musculus
cagacccttaacttaactagcaaat

SEQ ID NO: 311670 - DNA, 25 bp, Mus musculus
cagacccttcatcaccattcagttt

SEQ ID NO: 311671 - DNA, 25 bp, Mus musculus
cagacccttcatgaccattcagttt

SEQ ID NO: 311672 - DNA, 25 bp, Mus musculus
cagacccttctaaagcagcctctga

SEQ ID NO: 311673 - DNA, 25 bp, Mus musculus
cagacccttctatagcagcctctga

SEQ ID NO: 311674 - DNA, 25 bp, Mus musculus
cagaccctttataaggagtagacca

SEQ ID NO: 311675 - DNA, 25 bp, Mus musculus
cagaccctttattaggagtagacca

SEQ ID NO: 311676 - DNA, 25 bp, Mus musculus
cagaccgaactgagtgaggcctgcg

SEQ ID NO: 311677 - DNA, 25 bp, Mus musculus
cagaccgaactgtgtgaggcctgcg

SEQ ID NO: 311678 - DNA, 25 bp, Mus musculus
cagaccgcagatcggccggtttcat

SEQ ID NO: 311679 - DNA, 25 bp, Mus musculus
cagaccgcagatgggccggtttcat

SEQ ID NO: 311680 - DNA, 25 bp, Mus musculus
cagaccgccagcatggaagagttgc

SEQ ID NO: 311681 - DNA, 25 bp, Mus musculus
cagaccgccagcttggaagagttgc

SEQ ID NO: 311682 - DNA, 25 bp, Mus musculus
cagaccgggcacactgaagtcattt

SEQ ID NO: 311683 - DNA, 25 bp, Mus musculus
cagaccgggcactctgaagtcattt

SEQ ID NO: 311684 - DNA, 25 bp, Mus musculus
cagaccgggtgtacatctggagcgt

SEQ ID NO: 311685 - DNA, 25 bp, Mus musculus
cagaccgggtgttcatctggagcgt

SEQ ID NO: 311686 - DNA, 25 bp, Mus musculus
cagaccgtactgcacattttatgtt

SEQ ID NO: 311687 - DNA, 25 bp, Mus musculus
cagaccgtactggacattttatgtt

SEQ ID NO: 311688 - DNA, 25 bp, Mus musculus
cagaccgtcctgcaggctgtgatcc

SEQ ID NO: 311689 - DNA, 25 bp, Mus musculus
cagaccgtcctggaggctgtgatcc

SEQ ID NO: 311690 - DNA, 25 bp, Mus musculus
cagaccgtggatcggagaccctgta

SEQ ID NO: 311691 - DNA, 25 bp, Mus musculus
cagaccgtggatgggagaccctgta

SEQ ID NO: 311692 - DNA, 25 bp, Mus musculus
cagaccgtgggcagtgtatagagca

SEQ ID NO: 311693 - DNA, 25 bp, Mus musculus
cagaccgtgggctgtgtatagagca

SEQ ID NO: 311694 - DNA, 25 bp, Mus musculus
cagaccgttccactggttgcatact

SEQ ID NO: 311695 - DNA, 25 bp, Mus musculus
cagaccgttccagtggttgcatact

SEQ ID NO: 311696 - DNA, 25 bp, Mus musculus
cagacctacaccagctgccagatga

SEQ ID NO: 311697 - DNA, 25 bp, Mus musculus
cagacctacacctgctgccagatga

SEQ ID NO: 311698 - DNA, 25 bp, Mus musculus
cagacctacccacggcgtctatcca

SEQ ID NO: 311699 - DNA, 25 bp, Mus musculus
cagacctacccagggcgtctatcca

SEQ ID NO: 311700 - DNA, 25 bp, Mus musculus
cagacctatattctttattccctac

SEQ ID NO: 311701 - DNA, 25 bp, Mus musculus
cagacctatattgtttattccctac

SEQ ID NO: 311702 - DNA, 25 bp, Mus musculus
cagacctatgctaggatgcagagaa

SEQ ID NO: 311703 - DNA, 25 bp, Mus musculus
cagacctatgcttggatgcagagaa

SEQ ID NO: 311704 - DNA, 25 bp, Mus musculus
cagacctcacttctggagttgcaga

SEQ ID NO: 311705 - DNA, 25 bp, Mus musculus
cagacctcacttgtggagttgcaga

SEQ ID NO: 311706 - DNA, 25 bp, Mus musculus
cagacctcatgcaaatgctgaaata

SEQ ID NO: 311707 - DNA, 25 bp, Mus musculus
cagacctcatgctaatgctgaaata

SEQ ID NO: 311708 - DNA, 25 bp, Mus musculus
cagacctccatgcagtagactttta

SEQ ID NO: 311709 - DNA, 25 bp, Mus musculus
cagacctccatggagtagactttta

SEQ ID NO: 311710 - DNA, 25 bp, Mus musculus
cagacctcctgtattcatttctttt

SEQ ID NO: 311711 - DNA, 25 bp, Mus musculus
cagacctcctgttttcatttctttt

SEQ ID NO: 311712 - DNA, 25 bp, Mus musculus
cagacctctatcaagctcagcttaa

SEQ ID NO: 311713 - DNA, 25 bp, Mus musculus
cagacctctatctagctcagcttaa

SEQ ID NO: 311714 - DNA, 25 bp, Mus musculus
cagacctctcttcgaaatagttatt

SEQ ID NO: 311715 - DNA, 25 bp, Mus musculus
cagacctctcttggaaatagttatt

SEQ ID NO: 311716 - DNA, 25 bp, Mus musculus
cagacctctttcagctgactgactc

SEQ ID NO: 311717 - DNA, 25 bp, Mus musculus
cagacctctttctgctgactgactc

SEQ ID NO: 311718 - DNA, 25 bp, Mus musculus
cagacctgagctactatgatgccaa

SEQ ID NO: 311719 - DNA, 25 bp, Mus musculus
cagacctgagcttctatgatgccaa

SEQ ID NO: 311720 - DNA, 25 bp, Mus musculus
cagacctgaggtagctacttttggc

SEQ ID NO: 311721 - DNA, 25 bp, Mus musculus
cagacctgaggttgctacttttggc

SEQ ID NO: 311722 - DNA, 25 bp, Mus musculus
cagacctgagttatgttccgaattg

SEQ ID NO: 311723 - DNA, 25 bp, Mus musculus
cagacctgagttttgttccgaattg

SEQ ID NO: 311724 - DNA, 25 bp, Mus musculus
cagacctgcctactgattgaagatg

SEQ ID NO: 311725 - DNA, 25 bp, Mus musculus
cagacctgcctagtgattgaagatg

SEQ ID NO: 311726 - DNA, 25 bp, Mus musculus
cagacctgctgccaagtgagcctga

SEQ ID NO: 311727 - DNA, 25 bp, Mus musculus
cagacctgctgcgaagtgagcctga

SEQ ID NO: 311728 - DNA, 25 bp, Mus musculus
cagacctggacccatgaagtcttca

SEQ ID NO: 311729 - DNA, 25 bp, Mus musculus
cagacctggaccgatgaagtcttca

SEQ ID NO: 311730 - DNA, 25 bp, Mus musculus
cagacctggtgtaagggagttttat

SEQ ID NO: 311731 - DNA, 25 bp, Mus musculus
cagacctggtgttagggagttttat

SEQ ID NO: 311732 - DNA, 25 bp, Mus musculus
cagacctgttgcatggtttccttat

SEQ ID NO: 311733 - DNA, 25 bp, Mus musculus
cagacctgttgcttggtttccttat

SEQ ID NO: 311734 - DNA, 25 bp, Mus musculus
cagacctgtttgattaaccggatgg

SEQ ID NO: 311735 - DNA, 25 bp, Mus musculus
cagacctgtttgtttaaccggatgg

SEQ ID NO: 311736 - DNA, 25 bp, Mus musculus
cagacctgttttctactgagttatt

SEQ ID NO: 311737 - DNA, 25 bp, Mus musculus
cagacctgttttgtactgagttatt

SEQ ID NO: 311738 - DNA, 25 bp, Mus musculus
cagaccttagcgattttccataaaa

SEQ ID NO: 311739 - DNA, 25 bp, Mus musculus
cagaccttagcgtttttccataaaa

SEQ ID NO: 311740 - DNA, 25 bp, Mus musculus
cagaccttcaaaactgtggcctgaa

SEQ ID NO: 311741 - DNA, 25 bp, Mus musculus
cagaccttcaaatctgtggcctgaa

SEQ ID NO: 311742 - DNA, 25 bp, Mus musculus
cagaccttcaagatccgcatggaac

SEQ ID NO: 311743 - DNA, 25 bp, Mus musculus
cagaccttcaagttccgcatggaac

SEQ ID NO: 311744 - DNA, 25 bp, Mus musculus
cagaccttcaatacgatgcaatccc

SEQ ID NO: 311745 - DNA, 25 bp, Mus musculus
cagaccttcaattcgatgcaatccc

SEQ ID NO: 311746 - DNA, 25 bp, Mus musculus
cagaccttcacacgcctcagagtag

SEQ ID NO: 311747 - DNA, 25 bp, Mus musculus
cagaccttcacaggcctcagagtag

SEQ ID NO: 311748 - DNA, 25 bp, Mus musculus
cagaccttccggcagtactgtggag

SEQ ID NO: 311749 - DNA, 25 bp, Mus musculus
cagaccttccgggagtactgtggag

SEQ ID NO: 311750 - DNA, 25 bp, Mus musculus
cagaccttgcccatcttgttttgtt

SEQ ID NO: 311751 - DNA, 25 bp, Mus musculus
cagaccttgcccttcttgttttgtt

SEQ ID NO: 311752 - DNA, 25 bp, Mus musculus
cagaccttgctcacccaggatgtga

SEQ ID NO: 311753 - DNA, 25 bp, Mus musculus
cagaccttgctctcccaggatgtga

SEQ ID NO: 311754 - DNA, 25 bp, Mus musculus
cagaccttgctgactgtttaagaaa

SEQ ID NO: 311755 - DNA, 25 bp, Mus musculus
cagaccttgctgtctgtttaagaaa

SEQ ID NO: 311756 - DNA, 25 bp, Mus musculus
cagaccttggagattgacttggact

SEQ ID NO: 311757 - DNA, 25 bp, Mus musculus
cagaccttggagtttgacttggact

SEQ ID NO: 311758 - DNA, 25 bp, Mus musculus
cagacctttacacatcatgtgatca

SEQ ID NO: 311759 - DNA, 25 bp, Mus musculus
cagacctttacagatcatgtgatca

SEQ ID NO: 311760 - DNA, 25 bp, Mus musculus
cagacctttctgaggctttttggta

SEQ ID NO: 311761 - DNA, 25 bp, Mus musculus
cagacctttctgtggctttttggta

SEQ ID NO: 311762 - DNA, 25 bp, Mus musculus
cagaccttttagcaaactcggatca

SEQ ID NO: 311763 - DNA, 25 bp, Mus musculus
cagaccttttaggaaactcggatca

SEQ ID NO: 311764 - DNA, 25 bp, Mus musculus
cagaccttttccaaggccagcaggt

SEQ ID NO: 311765 - DNA, 25 bp, Mus musculus
cagaccttttcctaggccagcaggt

SEQ ID NO: 311766 - DNA, 25 bp, Mus musculus
cagacgaaggctcttgttgcttgac

SEQ ID NO: 311767 - DNA, 25 bp, Mus musculus
cagacgaaggctgttgttgcttgac

SEQ ID NO: 311768 - DNA, 25 bp, Mus musculus
cagacgaaggtacccagtcacaagg

SEQ ID NO: 311769 - DNA, 25 bp, Mus musculus
cagacgaaggtagccagtcacaagg

SEQ ID NO: 311770 - DNA, 25 bp, Mus musculus
cagacgacctgaatttgcttcccag

SEQ ID NO: 311771 - DNA, 25 bp, Mus musculus
cagacgacctgattttgcttcccag

SEQ ID NO: 311772 - DNA, 25 bp, Mus musculus
cagacgaggatactttaaggcccca

SEQ ID NO: 311773 - DNA, 25 bp, Mus musculus
cagacgaggatagtttaaggcccca

SEQ ID NO: 311774 - DNA, 25 bp, Mus musculus
cagacgagggttccctccgatactt

SEQ ID NO: 311775 - DNA, 25 bp, Mus musculus
cagacgagggttgcctccgatactt

SEQ ID NO: 311776 - DNA, 25 bp, Mus musculus
cagacgagtgccattggattgtggt

SEQ ID NO: 311777 - DNA, 25 bp, Mus musculus
cagacgagtgcctttggattgtggt

SEQ ID NO: 311778 - DNA, 25 bp, Mus musculus
cagacgatgagacaacacccgatgt

SEQ ID NO: 311779 - DNA, 25 bp, Mus musculus
cagacgatgagagaacacccgatgt

SEQ ID NO: 311780 - DNA, 25 bp, Mus musculus
cagacgatgcaaaacccttagggat

SEQ ID NO: 311781 - DNA, 25 bp, Mus musculus
cagacgatgcaatacccttagggat

SEQ ID NO: 311782 - DNA, 25 bp, Mus musculus
cagacgatgttgagccgccaaagcc

SEQ ID NO: 311783 - DNA, 25 bp, Mus musculus
cagacgatgttgtgccgccaaagcc

SEQ ID NO: 311784 - DNA, 25 bp, Mus musculus
cagacgcatgtgcacacctgaatat

SEQ ID NO: 311785 - DNA, 25 bp, Mus musculus
cagacgcatgtggacacctgaatat

SEQ ID NO: 311786 - DNA, 25 bp, Mus musculus
cagacgcccctgagtgaagaacatg

SEQ ID NO: 311787 - DNA, 25 bp, Mus musculus
cagacgcccctgtgtgaagaacatg

SEQ ID NO: 311788 - DNA, 25 bp, Mus musculus
cagacgcctgccacagttttgattt

SEQ ID NO: 311789 - DNA, 25 bp, Mus musculus
cagacgcctgcctcagttttgattt

SEQ ID NO: 311790 - DNA, 25 bp, Mus musculus
cagacgctcagcagacatgtggagt

SEQ ID NO: 311791 - DNA, 25 bp, Mus musculus
cagacgctcagctgacatgtggagt

SEQ ID NO: 311792 - DNA, 25 bp, Mus musculus
cagacgctcctcatggtgaagggaa

SEQ ID NO: 311793 - DNA, 25 bp, Mus musculus
cagacgctcctcttggtgaagggaa

SEQ ID NO: 311794 - DNA, 25 bp, Mus musculus
cagacgctcttgacacgaggtcaca

SEQ ID NO: 311795 - DNA, 25 bp, Mus musculus
cagacgctcttgtcacgaggtcaca

SEQ ID NO: 311796 - DNA, 25 bp, Mus musculus
cagacgcttcgtcagtttgtaactg

SEQ ID NO: 311797 - DNA, 25 bp, Mus musculus
cagacgcttcgtgagtttgtaactg

SEQ ID NO: 311798 - DNA, 25 bp, Mus musculus
cagacggaaacgaatgaagacttta

SEQ ID NO: 311799 - DNA, 25 bp, Mus musculus
cagacggaaacgtatgaagacttta

SEQ ID NO: 311800 - DNA, 25 bp, Mus musculus
cagacggactgcagtgacacacctc

SEQ ID NO: 311801 - DNA, 25 bp, Mus musculus
cagacggactgctgtgacacacctc

SEQ ID NO: 311802 - DNA, 25 bp, Mus musculus
cagacggactgtaatggccttcaaa

SEQ ID NO: 311803 - DNA, 25 bp, Mus musculus
cagacggactgttatggccttcaaa

SEQ ID NO: 311804 - DNA, 25 bp, Mus musculus
cagacggcatggatggcctgactct

SEQ ID NO: 311805 - DNA, 25 bp, Mus musculus
cagacggcatggttggcctgactct

SEQ ID NO: 311806 - DNA, 25 bp, Mus musculus
cagacggcctctccaatgggagagt

SEQ ID NO: 311807 - DNA, 25 bp, Mus musculus
cagacggcctctgcaatgggagagt

SEQ ID NO: 311808 - DNA, 25 bp, Mus musculus
cagacggctatgagctcgaaggcaa

SEQ ID NO: 311809 - DNA, 25 bp, Mus musculus
cagacggctatgtgctcgaaggcaa

SEQ ID NO: 311810 - DNA, 25 bp, Mus musculus
cagacgggcacaagcagcacgctgt

SEQ ID NO: 311811 - DNA, 25 bp, Mus musculus
cagacgggcacatgcagcacgctgt

SEQ ID NO: 311812 - DNA, 25 bp, Mus musculus
cagacgggcctgacgatgagtacat

SEQ ID NO: 311813 - DNA, 25 bp, Mus musculus
cagacgggcctgtcgatgagtacat

SEQ ID NO: 311814 - DNA, 25 bp, Mus musculus
cagacgggcttgctttccagatcag

SEQ ID NO: 311815 - DNA, 25 bp, Mus musculus
cagacgggcttggtttccagatcag

SEQ ID NO: 311816 - DNA, 25 bp, Mus musculus
cagacgggtcggagagtgtgttgtt

SEQ ID NO: 311817 - DNA, 25 bp, Mus musculus
cagacgggtcggtgagtgtgttgtt

SEQ ID NO: 311818 - DNA, 25 bp, Mus musculus
cagacggtcatcattcacttagtga

SEQ ID NO: 311819 - DNA, 25 bp, Mus musculus
cagacggtcatctttcacttagtga

SEQ ID NO: 311820 - DNA, 25 bp, Mus musculus
cagacggtctggacaccgccgcagg

SEQ ID NO: 311821 - DNA, 25 bp, Mus musculus
cagacggtctggtcaccgccgcagg

SEQ ID NO: 311822 - DNA, 25 bp, Mus musculus
cagacggttgcaaactgttgttgtt

SEQ ID NO: 311823 - DNA, 25 bp, Mus musculus
cagacggttgcatactgttgttgtt

SEQ ID NO: 311824 - DNA, 25 bp, Mus musculus
cagacggttttgatgtgagcatcaa

SEQ ID NO: 311825 - DNA, 25 bp, Mus musculus
cagacggttttgttgtgagcatcaa

SEQ ID NO: 311826 - DNA, 25 bp, Mus musculus
cagacgtcaagcacacagagggaat

SEQ ID NO: 311827 - DNA, 25 bp, Mus musculus
cagacgtcaagctcacagagggaat

SEQ ID NO: 311828 - DNA, 25 bp, Mus musculus
cagacgtgaaagactggccccttca

SEQ ID NO: 311829 - DNA, 25 bp, Mus musculus
cagacgtgaaagtctggccccttca

SEQ ID NO: 311830 - DNA, 25 bp, Mus musculus
cagacgtgaactacagcactgcctt

SEQ ID NO: 311831 - DNA, 25 bp, Mus musculus
cagacgtgaactaggtgaacgctaa

SEQ ID NO: 311832 - DNA, 25 bp, Mus musculus
cagacgtgaacttcagcactgcctt

SEQ ID NO: 311833 - DNA, 25 bp, Mus musculus
cagacgtgaacttggtgaacgctaa

SEQ ID NO: 311834 - DNA, 25 bp, Mus musculus
cagacgtgcgggatgttgacctgtg

SEQ ID NO: 311835 - DNA, 25 bp, Mus musculus
cagacgtgcgggttgttgacctgtg

SEQ ID NO: 311836 - DNA, 25 bp, Mus musculus
cagacgtgttcaccggtacctcgta

SEQ ID NO: 311837 - DNA, 25 bp, Mus musculus
cagacgtgttcagcggtacctcgta

SEQ ID NO: 311838 - DNA, 25 bp, Mus musculus
cagacgttacttcgaagcttttcta

SEQ ID NO: 311839 - DNA, 25 bp, Mus musculus
cagacgttacttggaagcttttcta

SEQ ID NO: 311840 - DNA, 25 bp, Mus musculus
cagacgttagttagagtgtatttat

SEQ ID NO: 311841 - DNA, 25 bp, Mus musculus
cagacgttagtttgagtgtatttat

SEQ ID NO: 311842 - DNA, 25 bp, Mus musculus
cagacgtttgttcccgtgcgaccag

SEQ ID NO: 311843 - DNA, 25 bp, Mus musculus
cagacgtttgttgccgtgcgaccag

SEQ ID NO: 311844 - DNA, 25 bp, Mus musculus
cagactaaattcacattggcagcaa

SEQ ID NO: 311845 - DNA, 25 bp, Mus musculus
cagactaaattctcattggcagcaa

SEQ ID NO: 311846 - DNA, 25 bp, Mus musculus
cagactaagctgatggactccgggt

SEQ ID NO: 311847 - DNA, 25 bp, Mus musculus
cagactaagctgttggactccgggt

SEQ ID NO: 311848 - DNA, 25 bp, Mus musculus
cagactaaggctcatcttcaataac

SEQ ID NO: 311849 - DNA, 25 bp, Mus musculus
cagactaaggctgatcttcaataac

SEQ ID NO: 311850 - DNA, 25 bp, Mus musculus
cagactacacaactccatacttaaa

SEQ ID NO: 311851 - DNA, 25 bp, Mus musculus
cagactacacaagtccatacttaaa

SEQ ID NO: 311852 - DNA, 25 bp, Mus musculus
cagactacatagatgcctcctcggg

SEQ ID NO: 311853 - DNA, 25 bp, Mus musculus
cagactacatagttgcctcctcggg

SEQ ID NO: 311854 - DNA, 25 bp, Mus musculus
cagactacccagatgaagtttgata

SEQ ID NO: 311855 - DNA, 25 bp, Mus musculus
cagactacccagttgaagtttgata

SEQ ID NO: 311856 - DNA, 25 bp, Mus musculus
cagactactctcattatagccaaaa

SEQ ID NO: 311857 - DNA, 25 bp, Mus musculus
cagactactctctttatagccaaaa

SEQ ID NO: 311858 - DNA, 25 bp, Mus musculus
cagactagaatccatggctcctgct

SEQ ID NO: 311859 - DNA, 25 bp, Mus musculus
cagactagaatcgatggctcctgct

SEQ ID NO: 311860 - DNA, 25 bp, Mus musculus
cagactagccctcaatgctgggatt

SEQ ID NO: 311861 - DNA, 25 bp, Mus musculus
cagactagccctgaatgctgggatt

SEQ ID NO: 311862 - DNA, 25 bp, Mus musculus
cagactagggacaggtcagactgat

SEQ ID NO: 311863 - DNA, 25 bp, Mus musculus
cagactagggactggtcagactgat

SEQ ID NO: 311864 - DNA, 25 bp, Mus musculus
cagactaggttcctcctaggaggtt

SEQ ID NO: 311865 - DNA, 25 bp, Mus musculus
cagactaggttcgtcctaggaggtt

SEQ ID NO: 311866 - DNA, 25 bp, Mus musculus
cagactatacgtcgaaagggtcgtt

SEQ ID NO: 311867 - DNA, 25 bp, Mus musculus
cagactatacgtggaaagggtcgtt

SEQ ID NO: 311868 - DNA, 25 bp, Mus musculus
cagactatataaaggcttggaaatg

SEQ ID NO: 311869 - DNA, 25 bp, Mus musculus
cagactatataatggcttggaaatg

SEQ ID NO: 311870 - DNA, 25 bp, Mus musculus
cagactatatacatgatgcctaaaa

SEQ ID NO: 311871 - DNA, 25 bp, Mus musculus
cagactatatacttgatgcctaaaa

SEQ ID NO: 311872 - DNA, 25 bp, Mus musculus
cagactatatatatgccttccactc

SEQ ID NO: 311873 - DNA, 25 bp, Mus musculus
cagactatatatttgccttccactc

SEQ ID NO: 311874 - DNA, 25 bp, Mus musculus
cagactatcttaccctttcataacc

SEQ ID NO: 311875 - DNA, 25 bp, Mus musculus
cagactatcttagcctttcataacc

SEQ ID NO: 311876 - DNA, 25 bp, Mus musculus
cagactatgaaactggacgggccat

SEQ ID NO: 311877 - DNA, 25 bp, Mus musculus
cagactatgaaagtggacgggccat

SEQ ID NO: 311878 - DNA, 25 bp, Mus musculus
cagactatgagtaccagctctccaa

SEQ ID NO: 311879 - DNA, 25 bp, Mus musculus
cagactatgagttccagctctccaa

SEQ ID NO: 311880 - DNA, 25 bp, Mus musculus
cagactatgcctctggaacttaaag

SEQ ID NO: 311881 - DNA, 25 bp, Mus musculus
cagactatgcctgtggaacttaaag

SEQ ID NO: 311882 - DNA, 25 bp, Mus musculus
cagactattagtctattcatcatgt

SEQ ID NO: 311883 - DNA, 25 bp, Mus musculus
cagactattagtgtattcatcatgt

SEQ ID NO: 311884 - DNA, 25 bp, Mus musculus
cagactattctaaggctagggcaat

SEQ ID NO: 311885 - DNA, 25 bp, Mus musculus
cagactattctatggctagggcaat

SEQ ID NO: 311886 - DNA, 25 bp, Mus musculus
cagactcaacatcgatgacgacgat

SEQ ID NO: 311887 - DNA, 25 bp, Mus musculus
cagactcaacatggatgacgacgat

SEQ ID NO: 311888 - DNA, 25 bp, Mus musculus
cagactcaacgtcctgccttggctg

SEQ ID NO: 311889 - DNA, 25 bp, Mus musculus
cagactcaacgtgctgccttggctg

SEQ ID NO: 311890 - DNA, 25 bp, Mus musculus
cagactcaacttctaattttctcac

SEQ ID NO: 311891 - DNA, 25 bp, Mus musculus
cagactcaacttgtaattttctcac

SEQ ID NO: 311892 - DNA, 25 bp, Mus musculus
cagactcacaacagcccagaagaat

SEQ ID NO: 311893 - DNA, 25 bp, Mus musculus
cagactcacaactgcccagaagaat

SEQ ID NO: 311894 - DNA, 25 bp, Mus musculus
cagactcacttgcagttttactaaa

SEQ ID NO: 311895 - DNA, 25 bp, Mus musculus
cagactcacttggagttttactaaa

SEQ ID NO: 311896 - DNA, 25 bp, Mus musculus
cagactcagcttactgacatctact

SEQ ID NO: 311897 - DNA, 25 bp, Mus musculus
cagactcagctttctgacatctact

SEQ ID NO: 311898 - DNA, 25 bp, Mus musculus
cagactcaggcacagctgcgatgtg

SEQ ID NO: 311899 - DNA, 25 bp, Mus musculus
cagactcaggcagagctgcgatgtg

SEQ ID NO: 311900 - DNA, 25 bp, Mus musculus
cagactcaggctactgttgtgagaa

SEQ ID NO: 311901 - DNA, 25 bp, Mus musculus
cagactcaggcttctgttgtgagaa

SEQ ID NO: 311902 - DNA, 25 bp, Mus musculus
cagactcagtgtacagggacagctt

SEQ ID NO: 311903 - DNA, 25 bp, Mus musculus
cagactcagtgttcagggacagctt

SEQ ID NO: 311904 - DNA, 25 bp, Mus musculus
cagactccaactcggcaggctggat

SEQ ID NO: 311905 - DNA, 25 bp, Mus musculus
cagactccaactgggcaggctggat

SEQ ID NO: 311906 - DNA, 25 bp, Mus musculus
cagactccagcaatttttgttgtat

SEQ ID NO: 311907 - DNA, 25 bp, Mus musculus
cagactccagcattttttgttgtat

SEQ ID NO: 311908 - DNA, 25 bp, Mus musculus
cagactccatcacttcttgggcaaa

SEQ ID NO: 311909 - DNA, 25 bp, Mus musculus
cagactccatcagttcttgggcaaa

SEQ ID NO: 311910 - DNA, 25 bp, Mus musculus
cagactcccgttaaaattcttcttg

SEQ ID NO: 311911 - DNA, 25 bp, Mus musculus
cagactcccgtttaaattcttcttg

SEQ ID NO: 311912 - DNA, 25 bp, Mus musculus
cagactccctctattaagctttaag

SEQ ID NO: 311913 - DNA, 25 bp, Mus musculus
cagactccctcttttaagctttaag

SEQ ID NO: 311914 - DNA, 25 bp, Mus musculus
cagactcccttaatgcctgaagtgc

SEQ ID NO: 311915 - DNA, 25 bp, Mus musculus
cagactcccttattgcctgaagtgc

SEQ ID NO: 311916 - DNA, 25 bp, Mus musculus
cagactcccttgcttaaggtgaaga

SEQ ID NO: 311917 - DNA, 25 bp, Mus musculus
cagactcccttggttaaggtgaaga

SEQ ID NO: 311918 - DNA, 25 bp, Mus musculus
cagactccgaggcatgctctggaga

SEQ ID NO: 311919 - DNA, 25 bp, Mus musculus
cagactccgagggatgctctggaga

SEQ ID NO: 311920 - DNA, 25 bp, Mus musculus
cagactccgcacagtgagatgctta

SEQ ID NO: 311921 - DNA, 25 bp, Mus musculus
cagactccgcactgtgagatgctta

SEQ ID NO: 311922 - DNA, 25 bp, Mus musculus
cagactccgctgaccttcatatgtg

SEQ ID NO: 311923 - DNA, 25 bp, Mus musculus
cagactccgctgtccttcatatgtg

SEQ ID NO: 311924 - DNA, 25 bp, Mus musculus
cagactcctggcactgtggaagcag

SEQ ID NO: 311925 - DNA, 25 bp, Mus musculus
cagactcctggctctgtggaagcag

SEQ ID NO: 311926 - DNA, 25 bp, Mus musculus
cagactcctgggagtctgcgggcct

SEQ ID NO: 311927 - DNA, 25 bp, Mus musculus
cagactcctgggtgtctgcgggcct

SEQ ID NO: 311928 - DNA, 25 bp, Mus musculus
cagactcctgtgaaggcacagctac

SEQ ID NO: 311929 - DNA, 25 bp, Mus musculus
cagactcctgtgtaggcacagctac

SEQ ID NO: 311930 - DNA, 25 bp, Mus musculus
cagactcggctcctgttagaaggga

SEQ ID NO: 311931 - DNA, 25 bp, Mus musculus
cagactcggctcgtgttagaaggga

SEQ ID NO: 311932 - DNA, 25 bp, Mus musculus
cagactcgtggcaaattatctttga

SEQ ID NO: 311933 - DNA, 25 bp, Mus musculus
cagactcgtggctaattatctttga

SEQ ID NO: 311934 - DNA, 25 bp, Mus musculus
cagactctacttcccagacataatt

SEQ ID NO: 311935 - DNA, 25 bp, Mus musculus
cagactctacttgccagacataatt

SEQ ID NO: 311936 - DNA, 25 bp, Mus musculus
cagactctaggtcccttgcagaggt

SEQ ID NO: 311937 - DNA, 25 bp, Mus musculus
cagactctaggtgccttgcagaggt

SEQ ID NO: 311938 - DNA, 25 bp, Mus musculus
cagactctcatgaggtgcaataagc

SEQ ID NO: 311939 - DNA, 25 bp, Mus musculus
cagactctcatgcagttggttgtaa

SEQ ID NO: 311940 - DNA, 25 bp, Mus musculus
cagactctcatggagttggttgtaa

SEQ ID NO: 311941 - DNA, 25 bp, Mus musculus
cagactctcatgtggtgcaataagc

SEQ ID NO: 311942 - DNA, 25 bp, Mus musculus
cagactctgatcagctcaaaccagc

SEQ ID NO: 311943 - DNA, 25 bp, Mus musculus
cagactctgatcaggacccttttaa

SEQ ID NO: 311944 - DNA, 25 bp, Mus musculus
cagactctgatctgctcaaaccagc

SEQ ID NO: 311945 - DNA, 25 bp, Mus musculus
cagactctgatctggacccttttaa

SEQ ID NO: 311946 - DNA, 25 bp, Mus musculus
cagactctgctgcacagtttgagct

SEQ ID NO: 311947 - DNA, 25 bp, Mus musculus
cagactctgctggacagtttgagct

SEQ ID NO: 311948 - DNA, 25 bp, Mus musculus
cagactctggatcggcccatcaaga

SEQ ID NO: 311949 - DNA, 25 bp, Mus musculus
cagactctggatgggcccatcaaga

SEQ ID NO: 311950 - DNA, 25 bp, Mus musculus
cagactctgtaaccaattgtcaaga

SEQ ID NO: 311951 - DNA, 25 bp, Mus musculus
cagactctgtaagcaattgtcaaga

SEQ ID NO: 311952 - DNA, 25 bp, Mus musculus
cagactctgtccatagttcctattg

SEQ ID NO: 311953 - DNA, 25 bp, Mus musculus
cagactctgtccttagttcctattg

SEQ ID NO: 311954 - DNA, 25 bp, Mus musculus
cagactcttcacacaactgactgta

SEQ ID NO: 311955 - DNA, 25 bp, Mus musculus
cagactcttcactcaactgactgta

SEQ ID NO: 311956 - DNA, 25 bp, Mus musculus
cagactcttctccttgcagtaatat

SEQ ID NO: 311957 - DNA, 25 bp, Mus musculus
cagactcttctcgttgcagtaatat

SEQ ID NO: 311958 - DNA, 25 bp, Mus musculus
cagactcttctgcatggcaaacata

SEQ ID NO: 311959 - DNA, 25 bp, Mus musculus
cagactcttctggatggcaaacata

SEQ ID NO: 311960 - DNA, 25 bp, Mus musculus
cagactcttgccagatacttgcctc

SEQ ID NO: 311961 - DNA, 25 bp, Mus musculus
cagactcttgcctgatacttgcctc

SEQ ID NO: 311962 - DNA, 25 bp, Mus musculus
cagactctttctagccttagttaac

SEQ ID NO: 311963 - DNA, 25 bp, Mus musculus
cagactctttcttgccttagttaac

SEQ ID NO: 311964 - DNA, 25 bp, Mus musculus
cagactgaaaaacccaagtagcact

SEQ ID NO: 311965 - DNA, 25 bp, Mus musculus
cagactgaaaaagccaagtagcact

SEQ ID NO: 311966 - DNA, 25 bp, Mus musculus
cagactgaccttagccacatgagaa

SEQ ID NO: 311967 - DNA, 25 bp, Mus musculus
cagactgacctttgccacatgagaa

SEQ ID NO: 311968 - DNA, 25 bp, Mus musculus
cagactgagcagaggctgtacccaa

SEQ ID NO: 311969 - DNA, 25 bp, Mus musculus
cagactgagcagtggctgtacccaa

SEQ ID NO: 311970 - DNA, 25 bp, Mus musculus
cagactgaggagaggctctccatct

SEQ ID NO: 311971 - DNA, 25 bp, Mus musculus
cagactgaggagtggctctccatct

SEQ ID NO: 311972 - DNA, 25 bp, Mus musculus
cagactgagtctattgccaacatcc

SEQ ID NO: 311973 - DNA, 25 bp, Mus musculus
cagactgagtcttttgccaacatcc

SEQ ID NO: 311974 - DNA, 25 bp, Mus musculus
cagactgatgacaatgcactagtgt

SEQ ID NO: 311975 - DNA, 25 bp, Mus musculus
cagactgatgacctgcactgaaagg

SEQ ID NO: 311976 - DNA, 25 bp, Mus musculus
cagactgatgacgtgcactgaaagg

SEQ ID NO: 311977 - DNA, 25 bp, Mus musculus
cagactgatgactatgcactagtgt

SEQ ID NO: 311978 - DNA, 25 bp, Mus musculus
cagactgatggccatgatagactca

SEQ ID NO: 311979 - DNA, 25 bp, Mus musculus
cagactgatggcgatgatagactca

SEQ ID NO: 311980 - DNA, 25 bp, Mus musculus
cagactgcaaccaatagccttaagt

SEQ ID NO: 311981 - DNA, 25 bp, Mus musculus
cagactgcaacctatagccttaagt

SEQ ID NO: 311982 - DNA, 25 bp, Mus musculus
cagactgcactcagatggaatgatg

SEQ ID NO: 311983 - DNA, 25 bp, Mus musculus
cagactgcactctgatggaatgatg

SEQ ID NO: 311984 - DNA, 25 bp, Mus musculus
cagactgcagacaagccgagaaggg

SEQ ID NO: 311985 - DNA, 25 bp, Mus musculus
cagactgcagactagccgagaaggg

SEQ ID NO: 311986 - DNA, 25 bp, Mus musculus
cagactgcagagaaggaagaatttg

SEQ ID NO: 311987 - DNA, 25 bp, Mus musculus
cagactgcagagtaggaagaatttg

SEQ ID NO: 311988 - DNA, 25 bp, Mus musculus
cagactgcatttcccgtcccatttt

SEQ ID NO: 311989 - DNA, 25 bp, Mus musculus
cagactgcatttgccgtcccatttt

SEQ ID NO: 311990 - DNA, 25 bp, Mus musculus
cagactgcctccagacattattgga

SEQ ID NO: 311991 - DNA, 25 bp, Mus musculus
cagactgcctcctgacattattgga

SEQ ID NO: 311992 - DNA, 25 bp, Mus musculus
cagactgcgaggaggaaagtcacct

SEQ ID NO: 311993 - DNA, 25 bp, Mus musculus
cagactgcgaggtggaaagtcacct

SEQ ID NO: 311994 - DNA, 25 bp, Mus musculus
cagactgctagtattttgttggaga

SEQ ID NO: 311995 - DNA, 25 bp, Mus musculus
cagactgctagttttttgttggaga

SEQ ID NO: 311996 - DNA, 25 bp, Mus musculus
cagactgctgatattcacacttagt

SEQ ID NO: 311997 - DNA, 25 bp, Mus musculus
cagactgctgattttcacacttagt

SEQ ID NO: 311998 - DNA, 25 bp, Mus musculus
cagactgctgcaagatatcggaaca

SEQ ID NO: 311999 - DNA, 25 bp, Mus musculus
cagactgctgcatgatatcggaaca

SEQ ID NO: 312000 - DNA, 25 bp, Mus musculus
cagactgctgcgaatctcaagccag

SEQ ID NO: 312001 - DNA, 25 bp, Mus musculus
cagactgctgcgtatctcaagccag

SEQ ID NO: 312002 - DNA, 25 bp, Mus musculus
cagactgctggcacagacaacaaga

SEQ ID NO: 312003 - DNA, 25 bp, Mus musculus
cagactgctggcataccacaggaca

SEQ ID NO: 312004 - DNA, 25 bp, Mus musculus
cagactgctggctcagacaacaaga

SEQ ID NO: 312005 - DNA, 25 bp, Mus musculus
cagactgctggcttaccacaggaca

SEQ ID NO: 312006 - DNA, 25 bp, Mus musculus
cagactggaagtatgatgccttctt

SEQ ID NO: 312007 - DNA, 25 bp, Mus musculus
cagactggaagtttgatgccttctt

SEQ ID NO: 312008 - DNA, 25 bp, Mus musculus
cagactggactcagtgatctgcctc

SEQ ID NO: 312009 - DNA, 25 bp, Mus musculus
cagactggactctgtgatctgcctc

SEQ ID NO: 312010 - DNA, 25 bp, Mus musculus
cagactggagttccatcctatgtcc

SEQ ID NO: 312011 - DNA, 25 bp, Mus musculus
cagactggagttgcatcctatgtcc

SEQ ID NO: 312012 - DNA, 25 bp, Mus musculus
cagactggcaaactaggccgggttt

SEQ ID NO: 312013 - DNA, 25 bp, Mus musculus
cagactggcaaagtaggccgggttt

SEQ ID NO: 312014 - DNA, 25 bp, Mus musculus
cagactggcagaagcagatctatgt

SEQ ID NO: 312015 - DNA, 25 bp, Mus musculus
cagactggcagatgcagatctatgt

SEQ ID NO: 312016 - DNA, 25 bp, Mus musculus
cagactggcctcaatttggtgattt

SEQ ID NO: 312017 - DNA, 25 bp, Mus musculus
cagactggcctctatttggtgattt

SEQ ID NO: 312018 - DNA, 25 bp, Mus musculus
cagactggcctgacggagtgaagac

SEQ ID NO: 312019 - DNA, 25 bp, Mus musculus
cagactggcctgtcggagtgaagac

SEQ ID NO: 312020 - DNA, 25 bp, Mus musculus
cagactggccttcaaaacttttttg

SEQ ID NO: 312021 - DNA, 25 bp, Mus musculus
cagactggccttgaaaacttttttg

SEQ ID NO: 312022 - DNA, 25 bp, Mus musculus
cagactggctctcgaaagtcctata

SEQ ID NO: 312023 - DNA, 25 bp, Mus musculus
cagactggctctggaaagtcctata

SEQ ID NO: 312024 - DNA, 25 bp, Mus musculus
cagactggctggaccactggctgca

SEQ ID NO: 312025 - DNA, 25 bp, Mus musculus
cagactggctggtccactggctgca

SEQ ID NO: 312026 - DNA, 25 bp, Mus musculus
cagactgggctaaggttgtggcttt

SEQ ID NO: 312027 - DNA, 25 bp, Mus musculus
cagactgggctatggttgtggcttt

SEQ ID NO: 312028 - DNA, 25 bp, Mus musculus
cagactgggtgcagaacatcacaaa

SEQ ID NO: 312029 - DNA, 25 bp, Mus musculus
cagactgggtgctgaacatcacaaa

SEQ ID NO: 312030 - DNA, 25 bp, Mus musculus
cagactgggtttctcatgtgtcgac

SEQ ID NO: 312031 - DNA, 25 bp, Mus musculus
cagactgggtttgtcatgtgtcgac

SEQ ID NO: 312032 - DNA, 25 bp, Mus musculus
cagactggtttgctaaatgctaaat

SEQ ID NO: 312033 - DNA, 25 bp, Mus musculus
cagactggtttggtaaatgctaaat

SEQ ID NO: 312034 - DNA, 25 bp, Mus musculus
cagactgtaaacacagcacttggga

SEQ ID NO: 312035 - DNA, 25 bp, Mus musculus
cagactgtaaactcagcacttggga

SEQ ID NO: 312036 - DNA, 25 bp, Mus musculus
cagactgtagcgaggctgagaagaa

SEQ ID NO: 312037 - DNA, 25 bp, Mus musculus
cagactgtagcgtggctgagaagaa

SEQ ID NO: 312038 - DNA, 25 bp, Mus musculus
cagactgtcaggaagcacacgtgca

SEQ ID NO: 312039 - DNA, 25 bp, Mus musculus
cagactgtcaggtagcacacgtgca

SEQ ID NO: 312040 - DNA, 25 bp, Mus musculus
cagactgtgcaactagcgctttcta

SEQ ID NO: 312041 - DNA, 25 bp, Mus musculus
cagactgtgcaagtagcgctttcta

SEQ ID NO: 312042 - DNA, 25 bp, Mus musculus
cagactgtgcagaggacccttcttt

SEQ ID NO: 312043 - DNA, 25 bp, Mus musculus
cagactgtgcagtggacccttcttt

SEQ ID NO: 312044 - DNA, 25 bp, Mus musculus
cagactgtgcctctgaagcagtcat

SEQ ID NO: 312045 - DNA, 25 bp, Mus musculus
cagactgtgcctgtgaagcagtcat

SEQ ID NO: 312046 - DNA, 25 bp, Mus musculus
cagactgtgcttcacgttgtgcaat

SEQ ID NO: 312047 - DNA, 25 bp, Mus musculus
cagactgtgcttgacgttgtgcaat

SEQ ID NO: 312048 - DNA, 25 bp, Mus musculus
cagactgtggacctgccttccggag

SEQ ID NO: 312049 - DNA, 25 bp, Mus musculus
cagactgtggacgtgccttccggag

SEQ ID NO: 312050 - DNA, 25 bp, Mus musculus
cagactgtgtgaccagaggagactt

SEQ ID NO: 312051 - DNA, 25 bp, Mus musculus
cagactgtgtgagcagaggagactt

SEQ ID NO: 312052 - DNA, 25 bp, Mus musculus
cagactgttaagacgtggctgggca

SEQ ID NO: 312053 - DNA, 25 bp, Mus musculus
cagactgttaagtcgtggctgggca

SEQ ID NO: 312054 - DNA, 25 bp, Mus musculus
cagactgttagactttggatgaaat

SEQ ID NO: 312055 - DNA, 25 bp, Mus musculus
cagactgttagagtttggatgaaat

SEQ ID NO: 312056 - DNA, 25 bp, Mus musculus
cagactgttcctattcagatacaaa

SEQ ID NO: 312057 - DNA, 25 bp, Mus musculus
cagactgttccttttcagatacaaa

SEQ ID NO: 312058 - DNA, 25 bp, Mus musculus
cagactgttctgaggtgctccttaa

SEQ ID NO: 312059 - DNA, 25 bp, Mus musculus
cagactgttctgtggtgctccttaa

SEQ ID NO: 312060 - DNA, 25 bp, Mus musculus
cagactgttgagaagcgacacaacc

SEQ ID NO: 312061 - DNA, 25 bp, Mus musculus
cagactgttgagtagcgacacaacc

SEQ ID NO: 312062 - DNA, 25 bp, Mus musculus
cagactgttgctcgctgagagcatt

SEQ ID NO: 312063 - DNA, 25 bp, Mus musculus
cagactgttgctggctgagagcatt

SEQ ID NO: 312064 - DNA, 25 bp, Mus musculus
cagactgttgggatctttgccattt

SEQ ID NO: 312065 - DNA, 25 bp, Mus musculus
cagactgttgggttctttgccattt

SEQ ID NO: 312066 - DNA, 25 bp, Mus musculus
cagacttaaaacaccaggcacctaa

SEQ ID NO: 312067 - DNA, 25 bp, Mus musculus
cagacttaaaactccaggcacctaa

SEQ ID NO: 312068 - DNA, 25 bp, Mus musculus
cagacttatgcactaaaaacccctt

SEQ ID NO: 312069 - DNA, 25 bp, Mus musculus
cagacttatgcagtaaaaacccctt

SEQ ID NO: 312070 - DNA, 25 bp, Mus musculus
cagacttcagttaccttcacataga

SEQ ID NO: 312071 - DNA, 25 bp, Mus musculus
cagacttcagtttccttcacataga

SEQ ID NO: 312072 - DNA, 25 bp, Mus musculus
cagacttcatgtcgtcctgaggtat

SEQ ID NO: 312073 - DNA, 25 bp, Mus musculus
cagacttcatgtggtcctgaggtat

SEQ ID NO: 312074 - DNA, 25 bp, Mus musculus
cagacttccaggagtttgtgaataa

SEQ ID NO: 312075 - DNA, 25 bp, Mus musculus
cagacttccaggtgtttgtgaataa

SEQ ID NO: 312076 - DNA, 25 bp, Mus musculus
cagacttcccagctaggttctagaa

SEQ ID NO: 312077 - DNA, 25 bp, Mus musculus
cagacttcccaggtaggttctagaa

SEQ ID NO: 312078 - DNA, 25 bp, Mus musculus
cagacttccgtgagtcagagctaag

SEQ ID NO: 312079 - DNA, 25 bp, Mus musculus
cagacttccgtgtgtcagagctaag

SEQ ID NO: 312080 - DNA, 25 bp, Mus musculus
cagacttccttcaggcctatgcttg

SEQ ID NO: 312081 - DNA, 25 bp, Mus musculus
cagacttccttctggcctatgcttg

SEQ ID NO: 312082 - DNA, 25 bp, Mus musculus
cagacttcctttattgctatattcc

SEQ ID NO: 312083 - DNA, 25 bp, Mus musculus
cagacttccttttttgctatattcc

SEQ ID NO: 312084 - DNA, 25 bp, Mus musculus
cagacttctctcatgtttggtatca

SEQ ID NO: 312085 - DNA, 25 bp, Mus musculus
cagacttctctcttgtttggtatca

SEQ ID NO: 312086 - DNA, 25 bp, Mus musculus
cagacttctgaaaaggtaaccttat

SEQ ID NO: 312087 - DNA, 25 bp, Mus musculus
cagacttctgaataggtaaccttat

SEQ ID NO: 312088 - DNA, 25 bp, Mus musculus
cagacttctgtccacttttgtttca

SEQ ID NO: 312089 - DNA, 25 bp, Mus musculus
cagacttctgtcgacttttgtttca

SEQ ID NO: 312090 - DNA, 25 bp, Mus musculus
cagacttgagatacacttttacatg

SEQ ID NO: 312091 - DNA, 25 bp, Mus musculus
cagacttgagattcacttttacatg

SEQ ID NO: 312092 - DNA, 25 bp, Mus musculus
cagacttgagtcacaggagaataaa

SEQ ID NO: 312093 - DNA, 25 bp, Mus musculus
cagacttgagtctcaggagaataaa

SEQ ID NO: 312094 - DNA, 25 bp, Mus musculus
cagacttgatctagaactcgtttca

SEQ ID NO: 312095 - DNA, 25 bp, Mus musculus
cagacttgatcttgaactcgtttca

SEQ ID NO: 312096 - DNA, 25 bp, Mus musculus
cagacttggagaagccagtgtgagt

SEQ ID NO: 312097 - DNA, 25 bp, Mus musculus
cagacttggagatgccagtgtgagt

SEQ ID NO: 312098 - DNA, 25 bp, Mus musculus
cagacttggcaacgcctggcatggt

SEQ ID NO: 312099 - DNA, 25 bp, Mus musculus
cagacttggcaaggcctggcatggt

SEQ ID NO: 312100 - DNA, 25 bp, Mus musculus
cagacttggtagcaagtacatttat

SEQ ID NO: 312101 - DNA, 25 bp, Mus musculus
cagacttggtaggaagtacatttat

SEQ ID NO: 312102 - DNA, 25 bp, Mus musculus
cagacttggtctaggcttgctggtg

SEQ ID NO: 312103 - DNA, 25 bp, Mus musculus
cagacttggtcttggcttgctggtg

SEQ ID NO: 312104 - DNA, 25 bp, Mus musculus
cagacttgtaggactgacctgtata

SEQ ID NO: 312105 - DNA, 25 bp, Mus musculus
cagacttgtaggtctgacctgtata

SEQ ID NO: 312106 - DNA, 25 bp, Mus musculus
cagacttgtatacccaggacagagc

SEQ ID NO: 312107 - DNA, 25 bp, Mus musculus
cagacttgtatagccaggacagagc

SEQ ID NO: 312108 - DNA, 25 bp, Mus musculus
cagacttgtctgctaatactcattt

SEQ ID NO: 312109 - DNA, 25 bp, Mus musculus
cagacttgtctggtaatactcattt

SEQ ID NO: 312110 - DNA, 25 bp, Mus musculus
cagacttgtgctccgtgcttataga

SEQ ID NO: 312111 - DNA, 25 bp, Mus musculus
cagacttgtgctgcgtgcttataga

SEQ ID NO: 312112 - DNA, 25 bp, Mus musculus
cagacttgtggactttgaggtacct

SEQ ID NO: 312113 - DNA, 25 bp, Mus musculus
cagacttgtggagtttgaggtacct

SEQ ID NO: 312114 - DNA, 25 bp, Mus musculus
cagacttgttatatagcagaacact

SEQ ID NO: 312115 - DNA, 25 bp, Mus musculus
cagacttgttatatttaatgcgtaa

SEQ ID NO: 312116 - DNA, 25 bp, Mus musculus
cagacttgttatttagcagaacact

SEQ ID NO: 312117 - DNA, 25 bp, Mus musculus
cagacttgttatttttaatgcgtaa

SEQ ID NO: 312118 - DNA, 25 bp, Mus musculus
cagactttacttctggtgtgaccat

SEQ ID NO: 312119 - DNA, 25 bp, Mus musculus
cagactttacttgtggtgtgaccat

SEQ ID NO: 312120 - DNA, 25 bp, Mus musculus
cagactttagaaagtttgtgtaacc

SEQ ID NO: 312121 - DNA, 25 bp, Mus musculus
cagactttagaatgtttgtgtaacc

SEQ ID NO: 312122 - DNA, 25 bp, Mus musculus
cagactttcatgcataattcacttt

SEQ ID NO: 312123 - DNA, 25 bp, Mus musculus
cagactttcatggataattcacttt

SEQ ID NO: 312124 - DNA, 25 bp, Mus musculus
cagactttccccagggagtagtctc

SEQ ID NO: 312125 - DNA, 25 bp, Mus musculus
cagactttcccctgggagtagtctc

SEQ ID NO: 312126 - DNA, 25 bp, Mus musculus
cagactttctctcggtgctgagcta

SEQ ID NO: 312127 - DNA, 25 bp, Mus musculus
cagactttctctgggtgctgagcta

SEQ ID NO: 312128 - DNA, 25 bp, Mus musculus
cagactttctttccaaggctggtga

SEQ ID NO: 312129 - DNA, 25 bp, Mus musculus
cagactttctttgcaaggctggtga

SEQ ID NO: 312130 - DNA, 25 bp, Mus musculus
cagactttgcgtcactttgagggca

SEQ ID NO: 312131 - DNA, 25 bp, Mus musculus
cagactttgcgtgactttgagggca

SEQ ID NO: 312132 - DNA, 25 bp, Mus musculus
cagacttttcatacatccaatactc

SEQ ID NO: 312133 - DNA, 25 bp, Mus musculus
cagacttttcattcatccaatactc

SEQ ID NO: 312134 - DNA, 25 bp, Mus musculus
cagacttttcccagattaggccaca

SEQ ID NO: 312135 - DNA, 25 bp, Mus musculus
cagacttttccctgattaggccaca

SEQ ID NO: 312136 - DNA, 25 bp, Mus musculus
cagacttttctaaatcaaggccaag

SEQ ID NO: 312137 - DNA, 25 bp, Mus musculus
cagacttttctatatcaaggccaag

SEQ ID NO: 312138 - DNA, 25 bp, Mus musculus
cagacttttgttaagcttcggatat

SEQ ID NO: 312139 - DNA, 25 bp, Mus musculus
cagacttttgtttagcttcggatat

SEQ ID NO: 312140 - DNA, 25 bp, Mus musculus
cagagaaaaacaccacttggagccc

SEQ ID NO: 312141 - DNA, 25 bp, Mus musculus
cagagaaaaacagcacttggagccc

SEQ ID NO: 312142 - DNA, 25 bp, Mus musculus
cagagaaaccagacttggccccggg

SEQ ID NO: 312143 - DNA, 25 bp, Mus musculus
cagagaaaccagtcttggccccggg

SEQ ID NO: 312144 - DNA, 25 bp, Mus musculus
cagagaaacgatcgctacttatcaa

SEQ ID NO: 312145 - DNA, 25 bp, Mus musculus
cagagaaacgatggctacttatcaa

SEQ ID NO: 312146 - DNA, 25 bp, Mus musculus
cagagaaacttaagtcttcttcctt

SEQ ID NO: 312147 - DNA, 25 bp, Mus musculus
cagagaaacttatgtcttcttcctt

SEQ ID NO: 312148 - DNA, 25 bp, Mus musculus
cagagaaatgagctcctgtgctttt

SEQ ID NO: 312149 - DNA, 25 bp, Mus musculus
cagagaaatgaggtcctgtgctttt

SEQ ID NO: 312150 - DNA, 25 bp, Mus musculus
cagagaacacctagcaggaatgttt

SEQ ID NO: 312151 - DNA, 25 bp, Mus musculus
cagagaacaccttgcaggaatgttt

SEQ ID NO: 312152 - DNA, 25 bp, Mus musculus
cagagaacccagcttgtttacatgc

SEQ ID NO: 312153 - DNA, 25 bp, Mus musculus
cagagaacccaggttgtttacatgc

SEQ ID NO: 312154 - DNA, 25 bp, Mus musculus
cagagaacccatcccagtgagaagt

SEQ ID NO: 312155 - DNA, 25 bp, Mus musculus
cagagaacccatgccagtgagaagt

SEQ ID NO: 312156 - DNA, 25 bp, Mus musculus
cagagaacctggcactaggccagaa

SEQ ID NO: 312157 - DNA, 25 bp, Mus musculus
cagagaacctgggactaggccagaa

SEQ ID NO: 312158 - DNA, 25 bp, Mus musculus
cagagaacctgtcggccgtgagcat

SEQ ID NO: 312159 - DNA, 25 bp, Mus musculus
cagagaacctgtgggccgtgagcat

SEQ ID NO: 312160 - DNA, 25 bp, Mus musculus
cagagaacgccgagaggaacgagaa

SEQ ID NO: 312161 - DNA, 25 bp, Mus musculus
cagagaacgccgtgaggaacgagaa

SEQ ID NO: 312162 - DNA, 25 bp, Mus musculus
cagagaacggtgagtcctcccggat

SEQ ID NO: 312163 - DNA, 25 bp, Mus musculus
cagagaacggtgtgtcctcccggat

SEQ ID NO: 312164 - DNA, 25 bp, Mus musculus
cagagaacgttcatcagtttccctg

SEQ ID NO: 312165 - DNA, 25 bp, Mus musculus
cagagaacgttcttcagtttccctg

SEQ ID NO: 312166 - DNA, 25 bp, Mus musculus
cagagaactcggaacatgtgtatgt

SEQ ID NO: 312167 - DNA, 25 bp, Mus musculus
cagagaactcggtacatgtgtatgt

SEQ ID NO: 312168 - DNA, 25 bp, Mus musculus
cagagaactctaatttggattgcag

SEQ ID NO: 312169 - DNA, 25 bp, Mus musculus
cagagaactctattttggattgcag

SEQ ID NO: 312170 - DNA, 25 bp, Mus musculus
cagagaactctgctcaataagtcaa

SEQ ID NO: 312171 - DNA, 25 bp, Mus musculus
cagagaactctggtcaataagtcaa

SEQ ID NO: 312172 - DNA, 25 bp, Mus musculus
cagagaactttacgcaattctgcac

SEQ ID NO: 312173 - DNA, 25 bp, Mus musculus
cagagaactttaggcaattctgcac

SEQ ID NO: 312174 - DNA, 25 bp, Mus musculus
cagagaagcaggctgaacagacgaa

SEQ ID NO: 312175 - DNA, 25 bp, Mus musculus
cagagaagcagggtgaacagacgaa

SEQ ID NO: 312176 - DNA, 25 bp, Mus musculus
cagagaagccagcttgtttacatgc

SEQ ID NO: 312177 - DNA, 25 bp, Mus musculus
cagagaagccaggttgtttacatgc

SEQ ID NO: 312178 - DNA, 25 bp, Mus musculus
cagagaagcctgcttcacctgtaaa

SEQ ID NO: 312179 - DNA, 25 bp, Mus musculus
cagagaagcctggttcacctgtaaa

SEQ ID NO: 312180 - DNA, 25 bp, Mus musculus
cagagaagggctcgacgatcccatt

SEQ ID NO: 312181 - DNA, 25 bp, Mus musculus
cagagaagggctggacgatcccatt

SEQ ID NO: 312182 - DNA, 25 bp, Mus musculus
cagagaaggtccattactccctggc

SEQ ID NO: 312183 - DNA, 25 bp, Mus musculus
cagagaaggtcctttactccctggc

SEQ ID NO: 312184 - DNA, 25 bp, Mus musculus
cagagaagtgcacgcctctggacct

SEQ ID NO: 312185 - DNA, 25 bp, Mus musculus
cagagaagtgcaggcctctggacct

SEQ ID NO: 312186 - DNA, 25 bp, Mus musculus
cagagaatcatccttttaatcacag

SEQ ID NO: 312187 - DNA, 25 bp, Mus musculus
cagagaatcatcgttttaatcacag

SEQ ID NO: 312188 - DNA, 25 bp, Mus musculus
cagagaatctgaaccctttttctgg

SEQ ID NO: 312189 - DNA, 25 bp, Mus musculus
cagagaatctgatccctttttctgg

SEQ ID NO: 312190 - DNA, 25 bp, Mus musculus
cagagaatctggcaccttctcgcct

SEQ ID NO: 312191 - DNA, 25 bp, Mus musculus
cagagaatctgggaccttctcgcct

SEQ ID NO: 312192 - DNA, 25 bp, Mus musculus
cagagaatgatgctgttcgacacca

SEQ ID NO: 312193 - DNA, 25 bp, Mus musculus
cagagaatgatggtgttcgacacca

SEQ ID NO: 312194 - DNA, 25 bp, Mus musculus
cagagaatgtctcctctccaggaga

SEQ ID NO: 312195 - DNA, 25 bp, Mus musculus
cagagaatgtctgctctccaggaga

SEQ ID NO: 312196 - DNA, 25 bp, Mus musculus
cagagaatgttcctcagagccgtga

SEQ ID NO: 312197 - DNA, 25 bp, Mus musculus
cagagaatgttcgtcagagccgtga

SEQ ID NO: 312198 - DNA, 25 bp, Mus musculus
cagagaatttccacccgcactgtgc

SEQ ID NO: 312199 - DNA, 25 bp, Mus musculus
cagagaatttcctcccgcactgtgc

SEQ ID NO: 312200 - DNA, 25 bp, Mus musculus
cagagaattttcatatgcccaccac

SEQ ID NO: 312201 - DNA, 25 bp, Mus musculus
cagagaattttcttatgcccaccac

SEQ ID NO: 312202 - DNA, 25 bp, Mus musculus
cagagacaccagaacacctgtgagg

SEQ ID NO: 312203 - DNA, 25 bp, Mus musculus
cagagacaccagtacacctgtgagg

SEQ ID NO: 312204 - DNA, 25 bp, Mus musculus
cagagacacctacagaaggagcgct

SEQ ID NO: 312205 - DNA, 25 bp, Mus musculus
cagagacacctagagaaggagcgct

SEQ ID NO: 312206 - DNA, 25 bp, Mus musculus
cagagacacttcctggagatccagg

SEQ ID NO: 312207 - DNA, 25 bp, Mus musculus
cagagacacttcgtggagatccagg

SEQ ID NO: 312208 - DNA, 25 bp, Mus musculus
cagagacagagcagctgttcttgcg

SEQ ID NO: 312209 - DNA, 25 bp, Mus musculus
cagagacagagctgctgttcttgcg

SEQ ID NO: 312210 - DNA, 25 bp, Mus musculus
cagagacagcccaccatgtttgagc

SEQ ID NO: 312211 - DNA, 25 bp, Mus musculus
cagagacagccctccatgtttgagc

SEQ ID NO: 312212 - DNA, 25 bp, Mus musculus
cagagacagctgctgtgtctggcaa

SEQ ID NO: 312213 - DNA, 25 bp, Mus musculus
cagagacagctggtgtgtctggcaa

SEQ ID NO: 312214 - DNA, 25 bp, Mus musculus
cagagacaggccaatgtatggaaga

SEQ ID NO: 312215 - DNA, 25 bp, Mus musculus
cagagacaggcctatgtatggaaga

SEQ ID NO: 312216 - DNA, 25 bp, Mus musculus
cagagacaggtacatatccttgagt

SEQ ID NO: 312217 - DNA, 25 bp, Mus musculus
cagagacaggtagatatccttgagt

SEQ ID NO: 312218 - DNA, 25 bp, Mus musculus
cagagacagtccaaacatctgggaa

SEQ ID NO: 312219 - DNA, 25 bp, Mus musculus
cagagacagtcctaacatctgggaa

SEQ ID NO: 312220 - DNA, 25 bp, Mus musculus
cagagacagtctccttcatatacct

SEQ ID NO: 312221 - DNA, 25 bp, Mus musculus
cagagacagtctgcttcatatacct

SEQ ID NO: 312222 - DNA, 25 bp, Mus musculus
cagagacagtgtacaattcaaccat

SEQ ID NO: 312223 - DNA, 25 bp, Mus musculus
cagagacagtgttcaattcaaccat

SEQ ID NO: 312224 - DNA, 25 bp, Mus musculus
cagagacattctaccctgctgtgac

SEQ ID NO: 312225 - DNA, 25 bp, Mus musculus
cagagacattcttccctgctgtgac

SEQ ID NO: 312226 - DNA, 25 bp, Mus musculus
cagagacattgtatccatttggatg

SEQ ID NO: 312227 - DNA, 25 bp, Mus musculus
cagagacattgtttccatttggatg

SEQ ID NO: 312228 - DNA, 25 bp, Mus musculus
cagagaccagggaacaggcagtcag

SEQ ID NO: 312229 - DNA, 25 bp, Mus musculus
cagagaccagggtacaggcagtcag

SEQ ID NO: 312230 - DNA, 25 bp, Mus musculus
cagagaccatggcttgacctttaaa

SEQ ID NO: 312231 - DNA, 25 bp, Mus musculus
cagagaccatgggttgacctttaaa

SEQ ID NO: 312232 - DNA, 25 bp, Mus musculus
cagagaccccaacgccagatgttat

SEQ ID NO: 312233 - DNA, 25 bp, Mus musculus
cagagaccccaaggccagatgttat

SEQ ID NO: 312234 - DNA, 25 bp, Mus musculus
cagagaccccctatttgtgataatg

SEQ ID NO: 312235 - DNA, 25 bp, Mus musculus
cagagaccccctttttgtgataatg

SEQ ID NO: 312236 - DNA, 25 bp, Mus musculus
cagagaccctacagcgtggccgttc

SEQ ID NO: 312237 - DNA, 25 bp, Mus musculus
cagagaccctactgcgtggccgttc

SEQ ID NO: 312238 - DNA, 25 bp, Mus musculus
cagagaccctggaagcaacagccaa

SEQ ID NO: 312239 - DNA, 25 bp, Mus musculus
cagagaccctggtagcaacagccaa

SEQ ID NO: 312240 - DNA, 25 bp, Mus musculus
cagagaccgactatggagttcccaa

SEQ ID NO: 312241 - DNA, 25 bp, Mus musculus
cagagaccgactttggagttcccaa

SEQ ID NO: 312242 - DNA, 25 bp, Mus musculus
cagagaccgtgcacaggtgactgat

SEQ ID NO: 312243 - DNA, 25 bp, Mus musculus
cagagaccgtgctcaggtgactgat

SEQ ID NO: 312244 - DNA, 25 bp, Mus musculus
cagagacctgcgatgctttcttctg

SEQ ID NO: 312245 - DNA, 25 bp, Mus musculus
cagagacctgcgttgctttcttctg

SEQ ID NO: 312246 - DNA, 25 bp, Mus musculus
cagagacctggtactactgtgtagg

SEQ ID NO: 312247 - DNA, 25 bp, Mus musculus
cagagacctggttctactgtgtagg

SEQ ID NO: 312248 - DNA, 25 bp, Mus musculus
cagagacctttacacactggaccag

SEQ ID NO: 312249 - DNA, 25 bp, Mus musculus
cagagacctttagacactggaccag

SEQ ID NO: 312250 - DNA, 25 bp, Mus musculus
cagagacggcagacatgattggcgt

SEQ ID NO: 312251 - DNA, 25 bp, Mus musculus
cagagacggcagtcatgattggcgt

SEQ ID NO: 312252 - DNA, 25 bp, Mus musculus
cagagactactaaaccacccttaga

SEQ ID NO: 312253 - DNA, 25 bp, Mus musculus
cagagactactataccacccttaga

SEQ ID NO: 312254 - DNA, 25 bp, Mus musculus
cagagactagccagattatgatggg

SEQ ID NO: 312255 - DNA, 25 bp, Mus musculus
cagagactagcctgattatgatggg

SEQ ID NO: 312256 - DNA, 25 bp, Mus musculus
cagagactatgcatgtggtccacat

SEQ ID NO: 312257 - DNA, 25 bp, Mus musculus
cagagactatgcttgtggtccacat

SEQ ID NO: 312258 - DNA, 25 bp, Mus musculus
cagagactcaaacaccacctaaggt

SEQ ID NO: 312259 - DNA, 25 bp, Mus musculus
cagagactcaaagaccacctaaggt

SEQ ID NO: 312260 - DNA, 25 bp, Mus musculus
cagagactcagccacaagtgacagt

SEQ ID NO: 312261 - DNA, 25 bp, Mus musculus
cagagactcagcgacaagtgacagt

SEQ ID NO: 312262 - DNA, 25 bp, Mus musculus
cagagactcatgcattttcaggaat

SEQ ID NO: 312263 - DNA, 25 bp, Mus musculus
cagagactcatggattttcaggaat

SEQ ID NO: 312264 - DNA, 25 bp, Mus musculus
cagagactcgcaaggcactgtttgc

SEQ ID NO: 312265 - DNA, 25 bp, Mus musculus
cagagactcgcatggcactgtttgc

SEQ ID NO: 312266 - DNA, 25 bp, Mus musculus
cagagactctaaacattgggttttt

SEQ ID NO: 312267 - DNA, 25 bp, Mus musculus
cagagactctaatcattgggttttt

SEQ ID NO: 312268 - DNA, 25 bp, Mus musculus
cagagactctgtactgcccaagctt

SEQ ID NO: 312269 - DNA, 25 bp, Mus musculus
cagagactctgtagaggccctctag

SEQ ID NO: 312270 - DNA, 25 bp, Mus musculus
cagagactctgttctgcccaagctt

SEQ ID NO: 312271 - DNA, 25 bp, Mus musculus
cagagactctgttgaggccctctag

SEQ ID NO: 312272 - DNA, 25 bp, Mus musculus
cagagactgagacctatacagaagt

SEQ ID NO: 312273 - DNA, 25 bp, Mus musculus
cagagactgagagctatacagaagt

SEQ ID NO: 312274 - DNA, 25 bp, Mus musculus
cagagactgcaacttgtggcttatt

SEQ ID NO: 312275 - DNA, 25 bp, Mus musculus
cagagactgcaagttgtggcttatt

SEQ ID NO: 312276 - DNA, 25 bp, Mus musculus
cagagactgcacaccctcggaggga

SEQ ID NO: 312277 - DNA, 25 bp, Mus musculus
cagagactgcactccctcggaggga

SEQ ID NO: 312278 - DNA, 25 bp, Mus musculus
cagagactgcagagagggcacctga

SEQ ID NO: 312279 - DNA, 25 bp, Mus musculus
cagagactgcagtgagggcacctga

SEQ ID NO: 312280 - DNA, 25 bp, Mus musculus
cagagactgcttactcagcaccgca

SEQ ID NO: 312281 - DNA, 25 bp, Mus musculus
cagagactgctttctcagcaccgca

SEQ ID NO: 312282 - DNA, 25 bp, Mus musculus
cagagactgggacccgtgatgtgcc

SEQ ID NO: 312283 - DNA, 25 bp, Mus musculus
cagagactgggagccgtgatgtgcc

SEQ ID NO: 312284 - DNA, 25 bp, Mus musculus
cagagactggtacggcttcagcctc

SEQ ID NO: 312285 - DNA, 25 bp, Mus musculus
cagagactggtagggcttcagcctc

SEQ ID NO: 312286 - DNA, 25 bp, Mus musculus
cagagactgtcccatatacagagac

SEQ ID NO: 312287 - DNA, 25 bp, Mus musculus
cagagactgtccgatatacagagac

SEQ ID NO: 312288 - DNA, 25 bp, Mus musculus
cagagactgtggagccctagggcat

SEQ ID NO: 312289 - DNA, 25 bp, Mus musculus
cagagactgtggtgccctagggcat

SEQ ID NO: 312290 - DNA, 25 bp, Mus musculus
cagagacttcacatctccagatgag

SEQ ID NO: 312291 - DNA, 25 bp, Mus musculus
cagagacttcacttctccagatgag

SEQ ID NO: 312292 - DNA, 25 bp, Mus musculus
cagagacttcgtcccagaattgctt

SEQ ID NO: 312293 - DNA, 25 bp, Mus musculus
cagagacttcgtgccagaattgctt

SEQ ID NO: 312294 - DNA, 25 bp, Mus musculus
cagagactttatatcttccaggcac

SEQ ID NO: 312295 - DNA, 25 bp, Mus musculus
cagagactttatttcttccaggcac

SEQ ID NO: 312296 - DNA, 25 bp, Mus musculus
cagagactttctccccagggcggta

SEQ ID NO: 312297 - DNA, 25 bp, Mus musculus
cagagactttctgcccagggcggta

SEQ ID NO: 312298 - DNA, 25 bp, Mus musculus
cagagactttttcccataactatta

SEQ ID NO: 312299 - DNA, 25 bp, Mus musculus
cagagactttttgccataactatta

SEQ ID NO: 312300 - DNA, 25 bp, Mus musculus
cagagagaaagcattggctcgggac

SEQ ID NO: 312301 - DNA, 25 bp, Mus musculus
cagagagaaagctttggctcgggac

SEQ ID NO: 312302 - DNA, 25 bp, Mus musculus
cagagagaccacaggctggcagcag

SEQ ID NO: 312303 - DNA, 25 bp, Mus musculus
cagagagaccactggctggcagcag

SEQ ID NO: 312304 - DNA, 25 bp, Mus musculus
cagagagaccctagccttccttctg

SEQ ID NO: 312305 - DNA, 25 bp, Mus musculus
cagagagacccttgccttccttctg

SEQ ID NO: 312306 - DNA, 25 bp, Mus musculus
cagagagacggcagtggtccagttt

SEQ ID NO: 312307 - DNA, 25 bp, Mus musculus
cagagagacggctgtggtccagttt

SEQ ID NO: 312308 - DNA, 25 bp, Mus musculus
cagagagagcttaaggaaccacttt

SEQ ID NO: 312309 - DNA, 25 bp, Mus musculus
cagagagagctttaggaaccacttt

SEQ ID NO: 312310 - DNA, 25 bp, Mus musculus
cagagagagggaaatcatggccata

SEQ ID NO: 312311 - DNA, 25 bp, Mus musculus
cagagagagggatatcatggccata

SEQ ID NO: 312312 - DNA, 25 bp, Mus musculus
cagagagaggtgaccaaagcgtgtt

SEQ ID NO: 312313 - DNA, 25 bp, Mus musculus
cagagagaggtgtccaaagcgtgtt

SEQ ID NO: 312314 - DNA, 25 bp, Mus musculus
cagagagatcacctgatagctttca

SEQ ID NO: 312315 - DNA, 25 bp, Mus musculus
cagagagatcacgtgatagctttca

SEQ ID NO: 312316 - DNA, 25 bp, Mus musculus
cagagagatctcacctggttgcaaa

SEQ ID NO: 312317 - DNA, 25 bp, Mus musculus
cagagagatctctcctggttgcaaa

SEQ ID NO: 312318 - DNA, 25 bp, Mus musculus
cagagagatgtcatggaacagatcc

SEQ ID NO: 312319 - DNA, 25 bp, Mus musculus
cagagagatgtcttggaacagatcc

SEQ ID NO: 312320 - DNA, 25 bp, Mus musculus
cagagagcaacaccgccacagtgga

SEQ ID NO: 312321 - DNA, 25 bp, Mus musculus
cagagagcaacagcgccacagtgga

SEQ ID NO: 312322 - DNA, 25 bp, Mus musculus
cagagagcagcaatcattcatggcc

SEQ ID NO: 312323 - DNA, 25 bp, Mus musculus
cagagagcagcattcattcatggcc

SEQ ID NO: 312324 - DNA, 25 bp, Mus musculus
cagagagcagctatggtttgcacac

SEQ ID NO: 312325 - DNA, 25 bp, Mus musculus
cagagagcagctttggtttgcacac

SEQ ID NO: 312326 - DNA, 25 bp, Mus musculus
cagagagcaggaaaatgcccagctg

SEQ ID NO: 312327 - DNA, 25 bp, Mus musculus
cagagagcaggataatgcccagctg

SEQ ID NO: 312328 - DNA, 25 bp, Mus musculus
cagagagcagtcaaggacacctcaa

SEQ ID NO: 312329 - DNA, 25 bp, Mus musculus
cagagagcagtcattatgttttgaa

SEQ ID NO: 312330 - DNA, 25 bp, Mus musculus
cagagagcagtctaggacacctcaa

SEQ ID NO: 312331 - DNA, 25 bp, Mus musculus
cagagagcagtctttatgttttgaa

SEQ ID NO: 312332 - DNA, 25 bp, Mus musculus
cagagagcagttctcatacaccaac

SEQ ID NO: 312333 - DNA, 25 bp, Mus musculus
cagagagcagttgtcatacaccaac

SEQ ID NO: 312334 - DNA, 25 bp, Mus musculus
cagagagcatccactcctttatagt

SEQ ID NO: 312335 - DNA, 25 bp, Mus musculus
cagagagcatcctctcctttatagt

SEQ ID NO: 312336 - DNA, 25 bp, Mus musculus
cagagagcccaacgtctgcgtttgg

SEQ ID NO: 312337 - DNA, 25 bp, Mus musculus
cagagagcccaaggtctgcgtttgg

SEQ ID NO: 312338 - DNA, 25 bp, Mus musculus
cagagagcccgaagcttgtctgaat

SEQ ID NO: 312339 - DNA, 25 bp, Mus musculus
cagagagcccgatgcttgtctgaat

SEQ ID NO: 312340 - DNA, 25 bp, Mus musculus
cagagagccgccaacagctgtgctg

SEQ ID NO: 312341 - DNA, 25 bp, Mus musculus
cagagagccgcctacagctgtgctg

SEQ ID NO: 312342 - DNA, 25 bp, Mus musculus
cagagagcctttccgcctgcggtga

SEQ ID NO: 312343 - DNA, 25 bp, Mus musculus
cagagagcctttgcgcctgcggtga

SEQ ID NO: 312344 - DNA, 25 bp, Mus musculus
cagagagctctaccatttaccagtg

SEQ ID NO: 312345 - DNA, 25 bp, Mus musculus
cagagagctctagcatttaccagtg

SEQ ID NO: 312346 - DNA, 25 bp, Mus musculus
cagagagctctcatgtaaatgacaa

SEQ ID NO: 312347 - DNA, 25 bp, Mus musculus
cagagagctctcttgtaaatgacaa

SEQ ID NO: 312348 - DNA, 25 bp, Mus musculus
cagagagctgtgaaccatcttgcca

SEQ ID NO: 312349 - DNA, 25 bp, Mus musculus
cagagagctgtgtaccatcttgcca

SEQ ID NO: 312350 - DNA, 25 bp, Mus musculus
cagagaggaacaaagtggtcacaac

SEQ ID NO: 312351 - DNA, 25 bp, Mus musculus
cagagaggaacatagtggtcacaac

SEQ ID NO: 312352 - DNA, 25 bp, Mus musculus
cagagaggaccaaacctaccttaaa

SEQ ID NO: 312353 - DNA, 25 bp, Mus musculus
cagagaggaccatacctaccttaaa

SEQ ID NO: 312354 - DNA, 25 bp, Mus musculus
cagagaggactcagctgcgagccag

SEQ ID NO: 312355 - DNA, 25 bp, Mus musculus
cagagaggactctgctgcgagccag

SEQ ID NO: 312356 - DNA, 25 bp, Mus musculus
cagagaggagaacaactaatgggaa

SEQ ID NO: 312357 - DNA, 25 bp, Mus musculus
cagagaggagaagaactaatgggaa

SEQ ID NO: 312358 - DNA, 25 bp, Mus musculus
cagagaggagaccaccacattcagt

SEQ ID NO: 312359 - DNA, 25 bp, Mus musculus
cagagaggagacgaccacattcagt

SEQ ID NO: 312360 - DNA, 25 bp, Mus musculus
cagagaggaggtcgccttccatgcc

SEQ ID NO: 312361 - DNA, 25 bp, Mus musculus
cagagaggaggtggccttccatgcc

SEQ ID NO: 312362 - DNA, 25 bp, Mus musculus
cagagaggccacctgattgctgtgt

SEQ ID NO: 312363 - DNA, 25 bp, Mus musculus
cagagaggccacgtgattgctgtgt

SEQ ID NO: 312364 - DNA, 25 bp, Mus musculus
cagagaggccctagtgaaacaccgt

SEQ ID NO: 312365 - DNA, 25 bp, Mus musculus
cagagaggcccttgtgaaacaccgt

SEQ ID NO: 312366 - DNA, 25 bp, Mus musculus
cagagaggcggtccctccaggtcct

SEQ ID NO: 312367 - DNA, 25 bp, Mus musculus
cagagaggcggtgcctccaggtcct

SEQ ID NO: 312368 - DNA, 25 bp, Mus musculus
cagagaggctgacaggctggccaag

SEQ ID NO: 312369 - DNA, 25 bp, Mus musculus
cagagaggctgagaggctggccaag

SEQ ID NO: 312370 - DNA, 25 bp, Mus musculus
cagagaggctgtacagaagttcacg

SEQ ID NO: 312371 - DNA, 25 bp, Mus musculus
cagagaggctgttcagaagttcacg

SEQ ID NO: 312372 - DNA, 25 bp, Mus musculus
cagagaggcttcacagtgtcctggg

SEQ ID NO: 312373 - DNA, 25 bp, Mus musculus
cagagaggcttctcagtgtcctggg

SEQ ID NO: 312374 - DNA, 25 bp, Mus musculus
cagagagggtgtccagtccctacgt

SEQ ID NO: 312375 - DNA, 25 bp, Mus musculus
cagagagggtgtgcagtccctacgt

SEQ ID NO: 312376 - DNA, 25 bp, Mus musculus
cagagaggtacaagtttgctaaatt

SEQ ID NO: 312377 - DNA, 25 bp, Mus musculus
cagagaggtacatgtttgctaaatt

SEQ ID NO: 312378 - DNA, 25 bp, Mus musculus
cagagaggtgcaccccgtcgagcaa

SEQ ID NO: 312379 - DNA, 25 bp, Mus musculus
cagagaggtgcagcccgtcgagcaa

SEQ ID NO: 312380 - DNA, 25 bp, Mus musculus
cagagagtactccttactgcagagc

SEQ ID NO: 312381 - DNA, 25 bp, Mus musculus
cagagagtactcgttactgcagagc

SEQ ID NO: 312382 - DNA, 25 bp, Mus musculus
cagagagtatgcctttctacttgct

SEQ ID NO: 312383 - DNA, 25 bp, Mus musculus
cagagagtatgcgtttctacttgct

SEQ ID NO: 312384 - DNA, 25 bp, Mus musculus
cagagagtcagtcctctcggctggt

SEQ ID NO: 312385 - DNA, 25 bp, Mus musculus
cagagagtcagtgctctcggctggt

SEQ ID NO: 312386 - DNA, 25 bp, Mus musculus
cagagagtccatcatccagcttttt

SEQ ID NO: 312387 - DNA, 25 bp, Mus musculus
cagagagtccatgatccagcttttt

SEQ ID NO: 312388 - DNA, 25 bp, Mus musculus
cagagagtccctacgggctgtctgg

SEQ ID NO: 312389 - DNA, 25 bp, Mus musculus
cagagagtcccttcgggctgtctgg

SEQ ID NO: 312390 - DNA, 25 bp, Mus musculus
cagagagtcttcatggctatcccaa

SEQ ID NO: 312391 - DNA, 25 bp, Mus musculus
cagagagtcttcttggctatcccaa

SEQ ID NO: 312392 - DNA, 25 bp, Mus musculus
cagagagtggacaccagcgcattct

SEQ ID NO: 312393 - DNA, 25 bp, Mus musculus
cagagagtggactccagcgcattct

SEQ ID NO: 312394 - DNA, 25 bp, Mus musculus
cagagagtggccataaaagcataga

SEQ ID NO: 312395 - DNA, 25 bp, Mus musculus
cagagagtggccttaaaagcataga

SEQ ID NO: 312396 - DNA, 25 bp, Mus musculus
cagagagttcataatggcagcagct

SEQ ID NO: 312397 - DNA, 25 bp, Mus musculus
cagagagttcattatggcagcagct

SEQ ID NO: 312398 - DNA, 25 bp, Mus musculus
cagagataaagtcctgtcttccact

SEQ ID NO: 312399 - DNA, 25 bp, Mus musculus
cagagataaagtgctgtcttccact

SEQ ID NO: 312400 - DNA, 25 bp, Mus musculus
cagagataagaactgccctcttgct

SEQ ID NO: 312401 - DNA, 25 bp, Mus musculus
cagagataagaagtgccctcttgct

SEQ ID NO: 312402 - DNA, 25 bp, Mus musculus
cagagataagacccaaagtgcccac

SEQ ID NO: 312403 - DNA, 25 bp, Mus musculus
cagagataagacgcaaagtgcccac

SEQ ID NO: 312404 - DNA, 25 bp, Mus musculus
cagagatacacgaacacttaccaag

SEQ ID NO: 312405 - DNA, 25 bp, Mus musculus
cagagatacacgtacacttaccaag

SEQ ID NO: 312406 - DNA, 25 bp, Mus musculus
cagagataccaaccaagagctccag

SEQ ID NO: 312407 - DNA, 25 bp, Mus musculus
cagagataccaagcaagagctccag

SEQ ID NO: 312408 - DNA, 25 bp, Mus musculus
cagagatacctccatttatattttg

SEQ ID NO: 312409 - DNA, 25 bp, Mus musculus
cagagatacctcgatttatattttg

SEQ ID NO: 312410 - DNA, 25 bp, Mus musculus
cagagatcaacactacggtgccagt

SEQ ID NO: 312411 - DNA, 25 bp, Mus musculus
cagagatcaacagtacggtgccagt

SEQ ID NO: 312412 - DNA, 25 bp, Mus musculus
cagagatcaattaccagctgggaga

SEQ ID NO: 312413 - DNA, 25 bp, Mus musculus
cagagatcaatttccagctgggaga

SEQ ID NO: 312414 - DNA, 25 bp, Mus musculus
cagagatcatcccagggccatcagc

SEQ ID NO: 312415 - DNA, 25 bp, Mus musculus
cagagatcatccgagggccatcagc

SEQ ID NO: 312416 - DNA, 25 bp, Mus musculus
cagagatccctgactttacatttga

SEQ ID NO: 312417 - DNA, 25 bp, Mus musculus
cagagatccctgtctttacatttga

SEQ ID NO: 312418 - DNA, 25 bp, Mus musculus
cagagatgacaaagcctctttgcat

SEQ ID NO: 312419 - DNA, 25 bp, Mus musculus
cagagatgacaatgcctctttgcat

SEQ ID NO: 312420 - DNA, 25 bp, Mus musculus
cagagatgagttacctggccaccag

SEQ ID NO: 312421 - DNA, 25 bp, Mus musculus
cagagatgagtttcctggccaccag

SEQ ID NO: 312422 - DNA, 25 bp, Mus musculus
cagagatgatcccagtgggcttcgt

SEQ ID NO: 312423 - DNA, 25 bp, Mus musculus
cagagatgatccgagtgggcttcgt

SEQ ID NO: 312424 - DNA, 25 bp, Mus musculus
cagagatgatgaaggctttgcctat

SEQ ID NO: 312425 - DNA, 25 bp, Mus musculus
cagagatgatgatggctttgcctat

SEQ ID NO: 312426 - DNA, 25 bp, Mus musculus
cagagatgccagagttaaacaacag

SEQ ID NO: 312427 - DNA, 25 bp, Mus musculus
cagagatgccagtgttaaacaacag

SEQ ID NO: 312428 - DNA, 25 bp, Mus musculus
cagagatgctggaccttattttaaa

SEQ ID NO: 312429 - DNA, 25 bp, Mus musculus
cagagatgctggtccttattttaaa

SEQ ID NO: 312430 - DNA, 25 bp, Mus musculus
cagagatgctttccccgctgtcgtt

SEQ ID NO: 312431 - DNA, 25 bp, Mus musculus
cagagatgctttgcccgctgtcgtt

SEQ ID NO: 312432 - DNA, 25 bp, Mus musculus
cagagatggctgacagacccagcaa

SEQ ID NO: 312433 - DNA, 25 bp, Mus musculus
cagagatggctgtcagacccagcaa

SEQ ID NO: 312434 - DNA, 25 bp, Mus musculus
cagagatgtcgcatagtttgtacta

SEQ ID NO: 312435 - DNA, 25 bp, Mus musculus
cagagatgtcgcttagtttgtacta

SEQ ID NO: 312436 - DNA, 25 bp, Mus musculus
cagagatgtctgagccacttgttga

SEQ ID NO: 312437 - DNA, 25 bp, Mus musculus
cagagatgtctgtgccacttgttga

SEQ ID NO: 312438 - DNA, 25 bp, Mus musculus
cagagatgttcaagcacctgcagaa

SEQ ID NO: 312439 - DNA, 25 bp, Mus musculus
cagagatgttcatgcacctgcagaa

SEQ ID NO: 312440 - DNA, 25 bp, Mus musculus
cagagattcagcacatagagaagtt

SEQ ID NO: 312441 - DNA, 25 bp, Mus musculus
cagagattcagctcatagagaagtt

SEQ ID NO: 312442 - DNA, 25 bp, Mus musculus
cagagattcctccacggtcaccaga

SEQ ID NO: 312443 - DNA, 25 bp, Mus musculus
cagagattcctcgacggtcaccaga

SEQ ID NO: 312444 - DNA, 25 bp, Mus musculus
cagagattgcggaggaaccctgaac

SEQ ID NO: 312445 - DNA, 25 bp, Mus musculus
cagagattgcggtggaaccctgaac

SEQ ID NO: 312446 - DNA, 25 bp, Mus musculus
cagagattgtacacagggctgtcta

SEQ ID NO: 312447 - DNA, 25 bp, Mus musculus
cagagattgtactcagggctgtcta

SEQ ID NO: 312448 - DNA, 25 bp, Mus musculus
cagagatttcataggttgcatcata

SEQ ID NO: 312449 - DNA, 25 bp, Mus musculus
cagagatttcattggttgcatcata

SEQ ID NO: 312450 - DNA, 25 bp, Mus musculus
cagagatttcctcctggacagtgga

SEQ ID NO: 312451 - DNA, 25 bp, Mus musculus
cagagatttcctgctggacagtgga

SEQ ID NO: 312452 - DNA, 25 bp, Mus musculus
cagagcaaccgtcccgtagtttgga

SEQ ID NO: 312453 - DNA, 25 bp, Mus musculus
cagagcaaccgtgccgtagtttgga

SEQ ID NO: 312454 - DNA, 25 bp, Mus musculus
cagagcaacctgctgagtgtggcct

SEQ ID NO: 312455 - DNA, 25 bp, Mus musculus
cagagcaacctggtgagtgtggcct

SEQ ID NO: 312456 - DNA, 25 bp, Mus musculus
cagagcaagatgctggctcctacct

SEQ ID NO: 312457 - DNA, 25 bp, Mus musculus
cagagcaagatggtggctcctacct

SEQ ID NO: 312458 - DNA, 25 bp, Mus musculus
cagagcaagcaaagccaggacggag

SEQ ID NO: 312459 - DNA, 25 bp, Mus musculus
cagagcaagcaatgccaggacggag

SEQ ID NO: 312460 - DNA, 25 bp, Mus musculus
cagagcaagggccattccccaaagg

SEQ ID NO: 312461 - DNA, 25 bp, Mus musculus
cagagcaagggcgattccccaaagg

SEQ ID NO: 312462 - DNA, 25 bp, Mus musculus
cagagcaagttaagccttctctctt

SEQ ID NO: 312463 - DNA, 25 bp, Mus musculus
cagagcaagttatgccttctctctt

SEQ ID NO: 312464 - DNA, 25 bp, Mus musculus
cagagcaatacgatccttattccac

SEQ ID NO: 312465 - DNA, 25 bp, Mus musculus
cagagcaatacgttccttattccac

SEQ ID NO: 312466 - DNA, 25 bp, Mus musculus
cagagcaattacaaacttcccaacc

SEQ ID NO: 312467 - DNA, 25 bp, Mus musculus
cagagcaattactaacttcccaacc

SEQ ID NO: 312468 - DNA, 25 bp, Mus musculus
cagagcacaggaagtctccttaaaa

SEQ ID NO: 312469 - DNA, 25 bp, Mus musculus
cagagcacaggatgtctccttaaaa

SEQ ID NO: 312470 - DNA, 25 bp, Mus musculus
cagagcaccaggcttgctcagcaag

SEQ ID NO: 312471 - DNA, 25 bp, Mus musculus
cagagcaccagggttgctcagcaag

SEQ ID NO: 312472 - DNA, 25 bp, Mus musculus
cagagcaccctgctcattggctgag

SEQ ID NO: 312473 - DNA, 25 bp, Mus musculus
cagagcaccctggtcattggctgag

SEQ ID NO: 312474 - DNA, 25 bp, Mus musculus
cagagcacgctactttggacggttt

SEQ ID NO: 312475 - DNA, 25 bp, Mus musculus
cagagcacgctagtttggacggttt

SEQ ID NO: 312476 - DNA, 25 bp, Mus musculus
cagagcactacgatgatgaggaaga

SEQ ID NO: 312477 - DNA, 25 bp, Mus musculus
cagagcactacgttgatgaggaaga

SEQ ID NO: 312478 - DNA, 25 bp, Mus musculus
cagagcactcttccaagacgggaga

SEQ ID NO: 312479 - DNA, 25 bp, Mus musculus
cagagcactcttcgctcttgtctga

SEQ ID NO: 312480 - DNA, 25 bp, Mus musculus
cagagcactcttgcaagacgggaga

SEQ ID NO: 312481 - DNA, 25 bp, Mus musculus
cagagcactcttggctcttgtctga

SEQ ID NO: 312482 - DNA, 25 bp, Mus musculus
cagagcactggcacctaacgaggat

SEQ ID NO: 312483 - DNA, 25 bp, Mus musculus
cagagcactggctcctaacgaggat

SEQ ID NO: 312484 - DNA, 25 bp, Mus musculus
cagagcagaagaagcctttgaaggc

SEQ ID NO: 312485 - DNA, 25 bp, Mus musculus
cagagcagaagatgcctttgaaggc

SEQ ID NO: 312486 - DNA, 25 bp, Mus musculus
cagagcagacaacaccgcagctgaa

SEQ ID NO: 312487 - DNA, 25 bp, Mus musculus
cagagcagacaagaccgcagctgaa

SEQ ID NO: 312488 - DNA, 25 bp, Mus musculus
cagagcagacggctatgtgctcgaa

SEQ ID NO: 312489 - DNA, 25 bp, Mus musculus
cagagcagacgggtatgtgctcgaa

SEQ ID NO: 312490 - DNA, 25 bp, Mus musculus
cagagcagactgatccattgtggat

SEQ ID NO: 312491 - DNA, 25 bp, Mus musculus
cagagcagactgttccattgtggat

SEQ ID NO: 312492 - DNA, 25 bp, Mus musculus
cagagcagatgtcggcaagtttgac

SEQ ID NO: 312493 - DNA, 25 bp, Mus musculus
cagagcagatgtgggcaagtttgac

SEQ ID NO: 312494 - DNA, 25 bp, Mus musculus
cagagcagcaacaccaaccagatgg

SEQ ID NO: 312495 - DNA, 25 bp, Mus musculus
cagagcagcaactccaaccagatgg

SEQ ID NO: 312496 - DNA, 25 bp, Mus musculus
cagagcagccgccagagaaatgtct

SEQ ID NO: 312497 - DNA, 25 bp, Mus musculus
cagagcagccgcgagagaaatgtct

SEQ ID NO: 312498 - DNA, 25 bp, Mus musculus
cagagcagcgagaaccgtccaggat

SEQ ID NO: 312499 - DNA, 25 bp, Mus musculus
cagagcagcgagtaccgtccaggat

SEQ ID NO: 312500 - DNA, 25 bp, Mus musculus
cagagcagctacagctagggccttg

SEQ ID NO: 312501 - DNA, 25 bp, Mus musculus
cagagcagctactgctagggccttg

SEQ ID NO: 312502 - DNA, 25 bp, Mus musculus
cagagcagctgccagaagcgtgccc

SEQ ID NO: 312503 - DNA, 25 bp, Mus musculus
cagagcagctgcgagaagcgtgccc

SEQ ID NO: 312504 - DNA, 25 bp, Mus musculus
cagagcaggcaaccgcactgttaag

SEQ ID NO: 312505 - DNA, 25 bp, Mus musculus
cagagcaggcaagcgcactgttaag

SEQ ID NO: 312506 - DNA, 25 bp, Mus musculus
cagagcaggtgtcttagctggacac

SEQ ID NO: 312507 - DNA, 25 bp, Mus musculus
cagagcaggtgtgttagctggacac

SEQ ID NO: 312508 - DNA, 25 bp, Mus musculus
cagagcagtgctacaaggtgaccaa

SEQ ID NO: 312509 - DNA, 25 bp, Mus musculus
cagagcagtgcttcaaggtgaccaa

SEQ ID NO: 312510 - DNA, 25 bp, Mus musculus
cagagcatccgccttgcatgtatga

SEQ ID NO: 312511 - DNA, 25 bp, Mus musculus
cagagcatccgcgttgcatgtatga

SEQ ID NO: 312512 - DNA, 25 bp, Mus musculus
cagagcatcctgatttccactgaag

SEQ ID NO: 312513 - DNA, 25 bp, Mus musculus
cagagcatcctgttttccactgaag

SEQ ID NO: 312514 - DNA, 25 bp, Mus musculus
cagagcatctagacatgtggccttt

SEQ ID NO: 312515 - DNA, 25 bp, Mus musculus
cagagcatctagtcatgtggccttt

SEQ ID NO: 312516 - DNA, 25 bp, Mus musculus
cagagcatctttaaagaggattctt

SEQ ID NO: 312517 - DNA, 25 bp, Mus musculus
cagagcatcttttaagaggattctt

SEQ ID NO: 312518 - DNA, 25 bp, Mus musculus
cagagcatgacaccccctttagata

SEQ ID NO: 312519 - DNA, 25 bp, Mus musculus
cagagcatgacagcccctttagata

SEQ ID NO: 312520 - DNA, 25 bp, Mus musculus
cagagcatgcgtataaagcccttaa

SEQ ID NO: 312521 - DNA, 25 bp, Mus musculus
cagagcatgcgtttaaagcccttaa

SEQ ID NO: 312522 - DNA, 25 bp, Mus musculus
cagagcatggagctcactgaggcct

SEQ ID NO: 312523 - DNA, 25 bp, Mus musculus
cagagcatggaggtcactgaggcct

SEQ ID NO: 312524 - DNA, 25 bp, Mus musculus
cagagcatggccatcactggagatg

SEQ ID NO: 312525 - DNA, 25 bp, Mus musculus
cagagcatggccttcactggagatg

SEQ ID NO: 312526 - DNA, 25 bp, Mus musculus
cagagcatggctacagtttgcatca

SEQ ID NO: 312527 - DNA, 25 bp, Mus musculus
cagagcatggcttcagtttgcatca

SEQ ID NO: 312528 - DNA, 25 bp, Mus musculus
cagagccaagcacttacgcctggtg

SEQ ID NO: 312529 - DNA, 25 bp, Mus musculus
cagagccaagcagttacgcctggtg

SEQ ID NO: 312530 - DNA, 25 bp, Mus musculus
cagagccaagtaaccgcacgaagtg

SEQ ID NO: 312531 - DNA, 25 bp, Mus musculus
cagagccaagtatccgcacgaagtg

SEQ ID NO: 312532 - DNA, 25 bp, Mus musculus
cagagccaagtgctccttttggtta

SEQ ID NO: 312533 - DNA, 25 bp, Mus musculus
cagagccaagtggtccttttggtta

SEQ ID NO: 312534 - DNA, 25 bp, Mus musculus
cagagccaagttccattcctggagt

SEQ ID NO: 312535 - DNA, 25 bp, Mus musculus
cagagccaagttgcattcctggagt

SEQ ID NO: 312536 - DNA, 25 bp, Mus musculus
cagagccacacacgaggtcaggcag

SEQ ID NO: 312537 - DNA, 25 bp, Mus musculus
cagagccacacaggaggtcaggcag

SEQ ID NO: 312538 - DNA, 25 bp, Mus musculus
cagagccacccactgaatcagataa

SEQ ID NO: 312539 - DNA, 25 bp, Mus musculus
cagagccacccagtgaatcagataa

SEQ ID NO: 312540 - DNA, 25 bp, Mus musculus
cagagccactggaacatagggtgct

SEQ ID NO: 312541 - DNA, 25 bp, Mus musculus
cagagccactggtacatagggtgct

SEQ ID NO: 312542 - DNA, 25 bp, Mus musculus
cagagccagcgcagaagtctccttt

SEQ ID NO: 312543 - DNA, 25 bp, Mus musculus
cagagccagcgctgaagtctccttt

SEQ ID NO: 312544 - DNA, 25 bp, Mus musculus
cagagccagtgtatgacgagtgtga

SEQ ID NO: 312545 - DNA, 25 bp, Mus musculus
cagagccagtgtttgacgagtgtga

SEQ ID NO: 312546 - DNA, 25 bp, Mus musculus
cagagccagtttccagcgttagaac

SEQ ID NO: 312547 - DNA, 25 bp, Mus musculus
cagagccagtttgcagcgttagaac

SEQ ID NO: 312548 - DNA, 25 bp, Mus musculus
cagagccatgctattttgaccttta

SEQ ID NO: 312549 - DNA, 25 bp, Mus musculus
cagagccatgcttttttgaccttta

SEQ ID NO: 312550 - DNA, 25 bp, Mus musculus
cagagcccaaccctgtgattgaagg

SEQ ID NO: 312551 - DNA, 25 bp, Mus musculus
cagagcccaaccgtgtgattgaagg

SEQ ID NO: 312552 - DNA, 25 bp, Mus musculus
cagagcccaagtcatcatggcaaga

SEQ ID NO: 312553 - DNA, 25 bp, Mus musculus
cagagcccaagtgatcatggcaaga

SEQ ID NO: 312554 - DNA, 25 bp, Mus musculus
cagagcccacctactgcttaaatag

SEQ ID NO: 312555 - DNA, 25 bp, Mus musculus
cagagcccaccttctgcttaaatag

SEQ ID NO: 312556 - DNA, 25 bp, Mus musculus
cagagcccagtgacaagggcgaccc

SEQ ID NO: 312557 - DNA, 25 bp, Mus musculus
cagagcccagtgtcaagggcgaccc

SEQ ID NO: 312558 - DNA, 25 bp, Mus musculus
cagagcccatctccggctaagatag

SEQ ID NO: 312559 - DNA, 25 bp, Mus musculus
cagagcccatctgcggctaagatag

SEQ ID NO: 312560 - DNA, 25 bp, Mus musculus
cagagccccaggatttcttagggat

SEQ ID NO: 312561 - DNA, 25 bp, Mus musculus
cagagccccaggttttcttagggat

SEQ ID NO: 312562 - DNA, 25 bp, Mus musculus
cagagccccagtcattgttattcat

SEQ ID NO: 312563 - DNA, 25 bp, Mus musculus
cagagccccagtgattgttattcat

SEQ ID NO: 312564 - DNA, 25 bp, Mus musculus
cagagccccgacatggagagctgtg

SEQ ID NO: 312565 - DNA, 25 bp, Mus musculus
cagagccccgacttggagagctgtg

SEQ ID NO: 312566 - DNA, 25 bp, Mus musculus
cagagccccggcaggtggctttctg

SEQ ID NO: 312567 - DNA, 25 bp, Mus musculus
cagagccccggctggtggctttctg

SEQ ID NO: 312568 - DNA, 25 bp, Mus musculus
cagagcccctggaacctttggtagg

SEQ ID NO: 312569 - DNA, 25 bp, Mus musculus
cagagcccctggtacctttggtagg

SEQ ID NO: 312570 - DNA, 25 bp, Mus musculus
cagagcccgaagaccatgatattga

SEQ ID NO: 312571 - DNA, 25 bp, Mus musculus
cagagcccgaagtccatgatattga

SEQ ID NO: 312572 - DNA, 25 bp, Mus musculus
cagagccctaacaggtttgtcccag

SEQ ID NO: 312573 - DNA, 25 bp, Mus musculus
cagagccctaactggtttgtcccag

SEQ ID NO: 312574 - DNA, 25 bp, Mus musculus
cagagccctattcagttcctaggat

SEQ ID NO: 312575 - DNA, 25 bp, Mus musculus
cagagccctattgagttcctaggat

SEQ ID NO: 312576 - DNA, 25 bp, Mus musculus
cagagccctggaagccaagtagcta

SEQ ID NO: 312577 - DNA, 25 bp, Mus musculus
cagagccctggacaagttgcttagt

SEQ ID NO: 312578 - DNA, 25 bp, Mus musculus
cagagccctggagaagttgcttagt

SEQ ID NO: 312579 - DNA, 25 bp, Mus musculus
cagagccctggatgccaagtagcta

SEQ ID NO: 312580 - DNA, 25 bp, Mus musculus
cagagccctggtatgtggtagtgct

SEQ ID NO: 312581 - DNA, 25 bp, Mus musculus
cagagccctggtttgtggtagtgct

SEQ ID NO: 312582 - DNA, 25 bp, Mus musculus
cagagccctgttcttttatatgtat

SEQ ID NO: 312583 - DNA, 25 bp, Mus musculus
cagagccctgttgttttatatgtat

SEQ ID NO: 312584 - DNA, 25 bp, Mus musculus
cagagccgaggtccctgctgcagca

SEQ ID NO: 312585 - DNA, 25 bp, Mus musculus
cagagccgaggtgcctgctgcagca

SEQ ID NO: 312586 - DNA, 25 bp, Mus musculus
cagagccgcatcaagtcatcatcag

SEQ ID NO: 312587 - DNA, 25 bp, Mus musculus
cagagccgcatctagtcatcatcag

SEQ ID NO: 312588 - DNA, 25 bp, Mus musculus
cagagccggtccaacgaggtgctgc

SEQ ID NO: 312589 - DNA, 25 bp, Mus musculus
cagagccggtcctacgaggtgctgc

SEQ ID NO: 312590 - DNA, 25 bp, Mus musculus
cagagccggtgtcacatgacagaac

SEQ ID NO: 312591 - DNA, 25 bp, Mus musculus
cagagccggtgtgacatgacagaac

SEQ ID NO: 312592 - DNA, 25 bp, Mus musculus
cagagcctaatgacctcaggtgatc

SEQ ID NO: 312593 - DNA, 25 bp, Mus musculus
cagagcctaatgtcctcaggtgatc

SEQ ID NO: 312594 - DNA, 25 bp, Mus musculus
cagagcctagaacatggaattatgc

SEQ ID NO: 312595 - DNA, 25 bp, Mus musculus
cagagcctagaagatggaattatgc

SEQ ID NO: 312596 - DNA, 25 bp, Mus musculus
cagagcctcaagacctgcaagtcag

SEQ ID NO: 312597 - DNA, 25 bp, Mus musculus
cagagcctcaagtcctgcaagtcag

SEQ ID NO: 312598 - DNA, 25 bp, Mus musculus
cagagcctcaggaacacggaaggtg

SEQ ID NO: 312599 - DNA, 25 bp, Mus musculus
cagagcctcaggtacacggaaggtg

SEQ ID NO: 312600 - DNA, 25 bp, Mus musculus
cagagcctccatccaagtacagtga

SEQ ID NO: 312601 - DNA, 25 bp, Mus musculus
cagagcctccatgcaagtacagtga

SEQ ID NO: 312602 - DNA, 25 bp, Mus musculus
cagagcctgctgagactttgtgtac

SEQ ID NO: 312603 - DNA, 25 bp, Mus musculus
cagagcctgctgtgactttgtgtac

SEQ ID NO: 312604 - DNA, 25 bp, Mus musculus
cagagcctggagactgcgctaatga

SEQ ID NO: 312605 - DNA, 25 bp, Mus musculus
cagagcctggagtctgcgctaatga

SEQ ID NO: 312606 - DNA, 25 bp, Mus musculus
cagagcctgggaagtggaccatgct

SEQ ID NO: 312607 - DNA, 25 bp, Mus musculus
cagagcctgggatgtggaccatgct

SEQ ID NO: 312608 - DNA, 25 bp, Mus musculus
cagagcctggtaccctgtagcactc

SEQ ID NO: 312609 - DNA, 25 bp, Mus musculus
cagagcctggtagcctgtagcactc

SEQ ID NO: 312610 - DNA, 25 bp, Mus musculus
cagagcctgtgcatgggataataac

SEQ ID NO: 312611 - DNA, 25 bp, Mus musculus
cagagcctgtgcttgggataataac

SEQ ID NO: 312612 - DNA, 25 bp, Mus musculus
cagagcctgtttcgtagacatggtg

SEQ ID NO: 312613 - DNA, 25 bp, Mus musculus
cagagcctgtttggtagacatggtg

SEQ ID NO: 312614 - DNA, 25 bp, Mus musculus
cagagccttctacttggaagcagaa

SEQ ID NO: 312615 - DNA, 25 bp, Mus musculus
cagagccttctagttggaagcagaa

SEQ ID NO: 312616 - DNA, 25 bp, Mus musculus
cagagccttgagaacacttgagata

SEQ ID NO: 312617 - DNA, 25 bp, Mus musculus
cagagccttgagtacacttgagata

SEQ ID NO: 312618 - DNA, 25 bp, Mus musculus
cagagcctttaccacttcactaatg

SEQ ID NO: 312619 - DNA, 25 bp, Mus musculus
cagagcctttacgacttcactaatg

SEQ ID NO: 312620 - DNA, 25 bp, Mus musculus
cagagcgaccttccggccttacagg

SEQ ID NO: 312621 - DNA, 25 bp, Mus musculus
cagagcgaccttgcggccttacagg

SEQ ID NO: 312622 - DNA, 25 bp, Mus musculus
cagagcgcaccaccggtagttggcc

SEQ ID NO: 312623 - DNA, 25 bp, Mus musculus
cagagcgcaccagcggtagttggcc

SEQ ID NO: 312624 - DNA, 25 bp, Mus musculus
cagagcgcagaacctaccggaagat

SEQ ID NO: 312625 - DNA, 25 bp, Mus musculus
cagagcgcagaagctaccggaagat

SEQ ID NO: 312626 - DNA, 25 bp, Mus musculus
cagagcgcctgcagttggcaggatt

SEQ ID NO: 312627 - DNA, 25 bp, Mus musculus
cagagcgcctgctgttggcaggatt

SEQ ID NO: 312628 - DNA, 25 bp, Mus musculus
cagagcgcttatctgtcctaactat

SEQ ID NO: 312629 - DNA, 25 bp, Mus musculus
cagagcgcttatgtgtcctaactat

SEQ ID NO: 312630 - DNA, 25 bp, Mus musculus
cagagcggaaagatgccttaatttt

SEQ ID NO: 312631 - DNA, 25 bp, Mus musculus
cagagcggaaagttgccttaatttt

SEQ ID NO: 312632 - DNA, 25 bp, Mus musculus
cagagcggactcaaggccctggagt

SEQ ID NO: 312633 - DNA, 25 bp, Mus musculus
cagagcggactctaggccctggagt

SEQ ID NO: 312634 - DNA, 25 bp, Mus musculus
cagagcggcgcgagtccagaaatat

SEQ ID NO: 312635 - DNA, 25 bp, Mus musculus
cagagcggcgcgtgtccagaaatat

SEQ ID NO: 312636 - DNA, 25 bp, Mus musculus
cagagcggcgtgctctcttacctgt

SEQ ID NO: 312637 - DNA, 25 bp, Mus musculus
cagagcggcgtggtctcttacctgt

SEQ ID NO: 312638 - DNA, 25 bp, Mus musculus
cagagcgggctactggcgagatttc

SEQ ID NO: 312639 - DNA, 25 bp, Mus musculus
cagagcgggctagtggcgagatttc

SEQ ID NO: 312640 - DNA, 25 bp, Mus musculus
cagagcgggctgcaggtcccttcct

SEQ ID NO: 312641 - DNA, 25 bp, Mus musculus
cagagcgggctggaggtcccttcct

SEQ ID NO: 312642 - DNA, 25 bp, Mus musculus
cagagcgtgcagaaggtgatcatca

SEQ ID NO: 312643 - DNA, 25 bp, Mus musculus
cagagcgtgcagtaggtgatcatca

SEQ ID NO: 312644 - DNA, 25 bp, Mus musculus
cagagcgttccgcagtatacagttc

SEQ ID NO: 312645 - DNA, 25 bp, Mus musculus
cagagcgttccggagtatacagttc

SEQ ID NO: 312646 - DNA, 25 bp, Mus musculus
cagagcgttctgatgatttgtaagt

SEQ ID NO: 312647 - DNA, 25 bp, Mus musculus
cagagcgttctgttgatttgtaagt

SEQ ID NO: 312648 - DNA, 25 bp, Mus musculus
cagagcgttggtatctttatggcaa

SEQ ID NO: 312649 - DNA, 25 bp, Mus musculus
cagagcgttggtttctttatggcaa

SEQ ID NO: 312650 - DNA, 25 bp, Mus musculus
cagagctaaataaaagccccgtatc

SEQ ID NO: 312651 - DNA, 25 bp, Mus musculus
cagagctaaatataagccccgtatc

SEQ ID NO: 312652 - DNA, 25 bp, Mus musculus
cagagctacagcatggtacgtttct

SEQ ID NO: 312653 - DNA, 25 bp, Mus musculus
cagagctacagcttggtacgtttct

SEQ ID NO: 312654 - DNA, 25 bp, Mus musculus
cagagctacatgactcatactgaaa

SEQ ID NO: 312655 - DNA, 25 bp, Mus musculus
cagagctacatgtctcatactgaaa

SEQ ID NO: 312656 - DNA, 25 bp, Mus musculus
cagagctaccagaatgtcatttcac

SEQ ID NO: 312657 - DNA, 25 bp, Mus musculus
cagagctaccagtatgtcatttcac

SEQ ID NO: 312658 - DNA, 25 bp, Mus musculus
cagagctaccttacaggagcacatc

SEQ ID NO: 312659 - DNA, 25 bp, Mus musculus
cagagctaccttccagttcttttaa

SEQ ID NO: 312660 - DNA, 25 bp, Mus musculus
cagagctaccttgcagttcttttaa

SEQ ID NO: 312661 - DNA, 25 bp, Mus musculus
cagagctacctttcaggagcacatc

SEQ ID NO: 312662 - DNA, 25 bp, Mus musculus
cagagctactcgagcaggtgtttta

SEQ ID NO: 312663 - DNA, 25 bp, Mus musculus
cagagctactcgtgcaggtgtttta

SEQ ID NO: 312664 - DNA, 25 bp, Mus musculus
cagagctaggacagctgaccttaat

SEQ ID NO: 312665 - DNA, 25 bp, Mus musculus
cagagctaggactgctgaccttaat

SEQ ID NO: 312666 - DNA, 25 bp, Mus musculus
cagagctaggagattgcatttgtta

SEQ ID NO: 312667 - DNA, 25 bp, Mus musculus
cagagctaggagtttgcatttgtta

SEQ ID NO: 312668 - DNA, 25 bp, Mus musculus
cagagctagggtatagttggtttct

SEQ ID NO: 312669 - DNA, 25 bp, Mus musculus
cagagctagggtttagttggtttct

SEQ ID NO: 312670 - DNA, 25 bp, Mus musculus
cagagctagtgaacgagtttgcagt

SEQ ID NO: 312671 - DNA, 25 bp, Mus musculus
cagagctagtgatcgagtttgcagt

SEQ ID NO: 312672 - DNA, 25 bp, Mus musculus
cagagctagtgcagagaggcctaaa

SEQ ID NO: 312673 - DNA, 25 bp, Mus musculus
cagagctagtgctgagaggcctaaa

SEQ ID NO: 312674 - DNA, 25 bp, Mus musculus
cagagctatgttactactattctta

SEQ ID NO: 312675 - DNA, 25 bp, Mus musculus
cagagctatgtttctactattctta

SEQ ID NO: 312676 - DNA, 25 bp, Mus musculus
cagagctcaagtcacgctactccat

SEQ ID NO: 312677 - DNA, 25 bp, Mus musculus
cagagctcaagtgacgctactccat

SEQ ID NO: 312678 - DNA, 25 bp, Mus musculus
cagagctcactgctgtgcgaatgat

SEQ ID NO: 312679 - DNA, 25 bp, Mus musculus
cagagctcactggtgtgcgaatgat

SEQ ID NO: 312680 - DNA, 25 bp, Mus musculus
cagagctcagaacccccaattctgt

SEQ ID NO: 312681 - DNA, 25 bp, Mus musculus
cagagctcagaagccccaattctgt

SEQ ID NO: 312682 - DNA, 25 bp, Mus musculus
cagagctcagcaacgatgtcaggga

SEQ ID NO: 312683 - DNA, 25 bp, Mus musculus
cagagctcagcatcgatgtcaggga

SEQ ID NO: 312684 - DNA, 25 bp, Mus musculus
cagagctcagctcttagaccttcaa

SEQ ID NO: 312685 - DNA, 25 bp, Mus musculus
cagagctcagctgttagaccttcaa

SEQ ID NO: 312686 - DNA, 25 bp, Mus musculus
cagagctcaggcacttatttttgta

SEQ ID NO: 312687 - DNA, 25 bp, Mus musculus
cagagctcaggctcttatttttgta

SEQ ID NO: 312688 - DNA, 25 bp, Mus musculus
cagagctcatgcacactaattggga

SEQ ID NO: 312689 - DNA, 25 bp, Mus musculus
cagagctcatgctcactaattggga

SEQ ID NO: 312690 - DNA, 25 bp, Mus musculus
cagagctcatgtaaagtcttcagac

SEQ ID NO: 312691 - DNA, 25 bp, Mus musculus
cagagctcatgttaagtcttcagac

SEQ ID NO: 312692 - DNA, 25 bp, Mus musculus
cagagctcccagcaaacagactgac

SEQ ID NO: 312693 - DNA, 25 bp, Mus musculus
cagagctcccaggaaacagactgac

SEQ ID NO: 312694 - DNA, 25 bp, Mus musculus
cagagctccgggatgacccaatcat

SEQ ID NO: 312695 - DNA, 25 bp, Mus musculus
cagagctccgggttgacccaatcat

SEQ ID NO: 312696 - DNA, 25 bp, Mus musculus
cagagctcgaacacccgtcgttcat

SEQ ID NO: 312697 - DNA, 25 bp, Mus musculus
cagagctcgaactcccgtcgttcat

SEQ ID NO: 312698 - DNA, 25 bp, Mus musculus
cagagctcgataatttgaagtccct

SEQ ID NO: 312699 - DNA, 25 bp, Mus musculus
cagagctcgatattttgaagtccct

SEQ ID NO: 312700 - DNA, 25 bp, Mus musculus
cagagctctgaaccgactacggcaa

SEQ ID NO: 312701 - DNA, 25 bp, Mus musculus
cagagctctgaagcgactacggcaa

SEQ ID NO: 312702 - DNA, 25 bp, Mus musculus
cagagctcttccagggcgcttggcg

SEQ ID NO: 312703 - DNA, 25 bp, Mus musculus
cagagctcttcctgggcgcttggcg

SEQ ID NO: 312704 - DNA, 25 bp, Mus musculus
cagagctgaactaaggctgctccat

SEQ ID NO: 312705 - DNA, 25 bp, Mus musculus
cagagctgaacttaggctgctccat

SEQ ID NO: 312706 - DNA, 25 bp, Mus musculus
cagagctgaatgacatttctcgtct

SEQ ID NO: 312707 - DNA, 25 bp, Mus musculus
cagagctgaatgtcatttctcgtct

SEQ ID NO: 312708 - DNA, 25 bp, Mus musculus
cagagctgaccaattccaagatcgt

SEQ ID NO: 312709 - DNA, 25 bp, Mus musculus
cagagctgaccatttccaagatcgt

SEQ ID NO: 312710 - DNA, 25 bp, Mus musculus
cagagctgacctacaattggcttat

SEQ ID NO: 312711 - DNA, 25 bp, Mus musculus
cagagctgaccttcaattggcttat

SEQ ID NO: 312712 - DNA, 25 bp, Mus musculus
cagagctgactaatcctagggtaga

SEQ ID NO: 312713 - DNA, 25 bp, Mus musculus
cagagctgactattcctagggtaga

SEQ ID NO: 312714 - DNA, 25 bp, Mus musculus
cagagctgcaagagaccttagggat

SEQ ID NO: 312715 - DNA, 25 bp, Mus musculus
cagagctgcaagtgaccttagggat

SEQ ID NO: 312716 - DNA, 25 bp, Mus musculus
cagagctgcacccagtagaactaaa

SEQ ID NO: 312717 - DNA, 25 bp, Mus musculus
cagagctgcaccgagtagaactaaa

SEQ ID NO: 312718 - DNA, 25 bp, Mus musculus
cagagctgcgaaacctgtcccctga

SEQ ID NO: 312719 - DNA, 25 bp, Mus musculus
cagagctgcgaatcctgtcccctga

SEQ ID NO: 312720 - DNA, 25 bp, Mus musculus
cagagctgctgacgctgattttaat

SEQ ID NO: 312721 - DNA, 25 bp, Mus musculus
cagagctgctgaggctgattttaat

SEQ ID NO: 312722 - DNA, 25 bp, Mus musculus
cagagctgctgcactgagatttggg

SEQ ID NO: 312723 - DNA, 25 bp, Mus musculus
cagagctgctgctctgagatttggg

SEQ ID NO: 312724 - DNA, 25 bp, Mus musculus
cagagctggagaaccggtaccccga

SEQ ID NO: 312725 - DNA, 25 bp, Mus musculus
cagagctggagatccggtaccccga

SEQ ID NO: 312726 - DNA, 25 bp, Mus musculus
cagagctggagtctccaaagggtat

SEQ ID NO: 312727 - DNA, 25 bp, Mus musculus
cagagctggagtgtccaaagggtat

SEQ ID NO: 312728 - DNA, 25 bp, Mus musculus
cagagctggctccataatattgggt

SEQ ID NO: 312729 - DNA, 25 bp, Mus musculus
cagagctggctcgataatattgggt

SEQ ID NO: 312730 - DNA, 25 bp, Mus musculus
cagagctgggcaccgggctggagtt

SEQ ID NO: 312731 - DNA, 25 bp, Mus musculus
cagagctgggcagcgggctggagtt

SEQ ID NO: 312732 - DNA, 25 bp, Mus musculus
cagagctgggccacagaggtttgta

SEQ ID NO: 312733 - DNA, 25 bp, Mus musculus
cagagctgggcctcagaggtttgta

SEQ ID NO: 312734 - DNA, 25 bp, Mus musculus
cagagctgtgccacgctgtggaaag

SEQ ID NO: 312735 - DNA, 25 bp, Mus musculus
cagagctgtgccctgatgcggtctt

SEQ ID NO: 312736 - DNA, 25 bp, Mus musculus
cagagctgtgccgtgatgcggtctt

SEQ ID NO: 312737 - DNA, 25 bp, Mus musculus
cagagctgtgcctcgctgtggaaag

SEQ ID NO: 312738 - DNA, 25 bp, Mus musculus
cagagctgtggccattagggtttta

SEQ ID NO: 312739 - DNA, 25 bp, Mus musculus
cagagctgtggcgattagggtttta

SEQ ID NO: 312740 - DNA, 25 bp, Mus musculus
cagagctgttgcagttgtcagtcga

SEQ ID NO: 312741 - DNA, 25 bp, Mus musculus
cagagctgttgctgttgtcagtcga

SEQ ID NO: 312742 - DNA, 25 bp, Mus musculus
cagagcttacatcacgtacggacgt

SEQ ID NO: 312743 - DNA, 25 bp, Mus musculus
cagagcttacatgacgtacggacgt

SEQ ID NO: 312744 - DNA, 25 bp, Mus musculus
cagagcttactaagaatctttgttt

SEQ ID NO: 312745 - DNA, 25 bp, Mus musculus
cagagcttactatgaatctttgttt

SEQ ID NO: 312746 - DNA, 25 bp, Mus musculus
cagagcttataactgttgtgacaca

SEQ ID NO: 312747 - DNA, 25 bp, Mus musculus
cagagcttataagtgttgtgacaca

SEQ ID NO: 312748 - DNA, 25 bp, Mus musculus
cagagcttcagtccctggatgctgc

SEQ ID NO: 312749 - DNA, 25 bp, Mus musculus
cagagcttcagtgcctggatgctgc

SEQ ID NO: 312750 - DNA, 25 bp, Mus musculus
cagagcttctcgctgtggatcatat

SEQ ID NO: 312751 - DNA, 25 bp, Mus musculus
cagagcttctcggtgtggatcatat

SEQ ID NO: 312752 - DNA, 25 bp, Mus musculus
cagagcttctggctcatccaagaag

SEQ ID NO: 312753 - DNA, 25 bp, Mus musculus
cagagcttctgggtcatccaagaag

SEQ ID NO: 312754 - DNA, 25 bp, Mus musculus
cagagcttgatccacagtggaagaa

SEQ ID NO: 312755 - DNA, 25 bp, Mus musculus
cagagcttgatcgacagtggaagaa

SEQ ID NO: 312756 - DNA, 25 bp, Mus musculus
cagagcttgcttcttagttgttcac

SEQ ID NO: 312757 - DNA, 25 bp, Mus musculus
cagagcttgcttgttagttgttcac

SEQ ID NO: 312758 - DNA, 25 bp, Mus musculus
cagagcttggacacgcggccactgc

SEQ ID NO: 312759 - DNA, 25 bp, Mus musculus
cagagcttggactcgcggccactgc

SEQ ID NO: 312760 - DNA, 25 bp, Mus musculus
cagagcttggtgctttatcttttcc

SEQ ID NO: 312761 - DNA, 25 bp, Mus musculus
cagagcttggtggtttatcttttcc

SEQ ID NO: 312762 - DNA, 25 bp, Mus musculus
cagagctttacccatgctgatgaat

SEQ ID NO: 312763 - DNA, 25 bp, Mus musculus
cagagctttaccgatgctgatgaat

SEQ ID NO: 312764 - DNA, 25 bp, Mus musculus
cagagcttttatcacccatggtgga

SEQ ID NO: 312765 - DNA, 25 bp, Mus musculus
cagagcttttatgacccatggtgga

SEQ ID NO: 312766 - DNA, 25 bp, Mus musculus
cagaggaaattccttataaccaaat

SEQ ID NO: 312767 - DNA, 25 bp, Mus musculus
cagaggaaattcgttataaccaaat

SEQ ID NO: 312768 - DNA, 25 bp, Mus musculus
cagaggaactcgagaaacgcagtct

SEQ ID NO: 312769 - DNA, 25 bp, Mus musculus
cagaggaactcgtgaaacgcagtct

SEQ ID NO: 312770 - DNA, 25 bp, Mus musculus
cagaggaacttgacccagggaggtt

SEQ ID NO: 312771 - DNA, 25 bp, Mus musculus
cagaggaacttgtcccagggaggtt

SEQ ID NO: 312772 - DNA, 25 bp, Mus musculus
cagaggaagccaagcgtgccattga

SEQ ID NO: 312773 - DNA, 25 bp, Mus musculus
cagaggaagccaagtttggaagacc

SEQ ID NO: 312774 - DNA, 25 bp, Mus musculus
cagaggaagccatgcgtgccattga

SEQ ID NO: 312775 - DNA, 25 bp, Mus musculus
cagaggaagccatgtttggaagacc

SEQ ID NO: 312776 - DNA, 25 bp, Mus musculus
cagaggaatccactttcaccatatg

SEQ ID NO: 312777 - DNA, 25 bp, Mus musculus
cagaggaatccagtttcaccatatg

SEQ ID NO: 312778 - DNA, 25 bp, Mus musculus
cagaggaattgacaagccttgcttc

SEQ ID NO: 312779 - DNA, 25 bp, Mus musculus
cagaggaattgagaagccttgcttc

SEQ ID NO: 312780 - DNA, 25 bp, Mus musculus
cagaggacaactctgtgtcagtctg

SEQ ID NO: 312781 - DNA, 25 bp, Mus musculus
cagaggacaactgtgtgtcagtctg

SEQ ID NO: 312782 - DNA, 25 bp, Mus musculus
cagaggacaagaagaccatgagtac

SEQ ID NO: 312783 - DNA, 25 bp, Mus musculus
cagaggacaagatgaccatgagtac

SEQ ID NO: 312784 - DNA, 25 bp, Mus musculus
cagaggacagccagcctgtatgaca

SEQ ID NO: 312785 - DNA, 25 bp, Mus musculus
cagaggacagcctgcctgtatgaca

SEQ ID NO: 312786 - DNA, 25 bp, Mus musculus
cagaggacaggcagattgacaccag

SEQ ID NO: 312787 - DNA, 25 bp, Mus musculus
cagaggacaggctgattgacaccag

SEQ ID NO: 312788 - DNA, 25 bp, Mus musculus
cagaggacagtgagcaatgttatat

SEQ ID NO: 312789 - DNA, 25 bp, Mus musculus
cagaggacagtgtgcaatgttatat

SEQ ID NO: 312790 - DNA, 25 bp, Mus musculus
cagaggaccacgattgagaatcagt

SEQ ID NO: 312791 - DNA, 25 bp, Mus musculus
cagaggaccacgtttgagaatcagt

SEQ ID NO: 312792 - DNA, 25 bp, Mus musculus
cagaggaccatccagagggctcagt

SEQ ID NO: 312793 - DNA, 25 bp, Mus musculus
cagaggaccatcgagagggctcagt

SEQ ID NO: 312794 - DNA, 25 bp, Mus musculus
cagaggacccagcttagattgccaa

SEQ ID NO: 312795 - DNA, 25 bp, Mus musculus
cagaggacccaggttagattgccaa

SEQ ID NO: 312796 - DNA, 25 bp, Mus musculus
cagaggaccccaactgagtttggat

SEQ ID NO: 312797 - DNA, 25 bp, Mus musculus
cagaggaccccatctgagtttggat

SEQ ID NO: 312798 - DNA, 25 bp, Mus musculus
cagaggactcggcaatgggctaata

SEQ ID NO: 312799 - DNA, 25 bp, Mus musculus
cagaggactcgggaatgggctaata

SEQ ID NO: 312800 - DNA, 25 bp, Mus musculus
cagaggagacgcaggctcaggcctt

SEQ ID NO: 312801 - DNA, 25 bp, Mus musculus
cagaggagacgctggctcaggcctt

SEQ ID NO: 312802 - DNA, 25 bp, Mus musculus
cagaggagagctatgctagccctgg

SEQ ID NO: 312803 - DNA, 25 bp, Mus musculus
cagaggagagctttgctagccctgg

SEQ ID NO: 312804 - DNA, 25 bp, Mus musculus
cagaggagatccaactatgtatgta

SEQ ID NO: 312805 - DNA, 25 bp, Mus musculus
cagaggagatcctactatgtatgta

SEQ ID NO: 312806 - DNA, 25 bp, Mus musculus
cagaggagcacaaatggatacccat

SEQ ID NO: 312807 - DNA, 25 bp, Mus musculus
cagaggagcacatatggatacccat

SEQ ID NO: 312808 - DNA, 25 bp, Mus musculus
cagaggagcataacatcccttcaga

SEQ ID NO: 312809 - DNA, 25 bp, Mus musculus
cagaggagcatatcatcccttcaga

SEQ ID NO: 312810 - DNA, 25 bp, Mus musculus
cagaggagccatcggtactggagga

SEQ ID NO: 312811 - DNA, 25 bp, Mus musculus
cagaggagccatgggtactggagga

SEQ ID NO: 312812 - DNA, 25 bp, Mus musculus
cagaggagctggagtatttgtatga

SEQ ID NO: 312813 - DNA, 25 bp, Mus musculus
cagaggagctggtgtatttgtatga

SEQ ID NO: 312814 - DNA, 25 bp, Mus musculus
cagaggagctgtatgccgtgcaagt

SEQ ID NO: 312815 - DNA, 25 bp, Mus musculus
cagaggagctgtttgccgtgcaagt

SEQ ID NO: 312816 - DNA, 25 bp, Mus musculus
cagaggaggatgaccttctgcccca

SEQ ID NO: 312817 - DNA, 25 bp, Mus musculus
cagaggaggatgtccttctgcccca

SEQ ID NO: 312818 - DNA, 25 bp, Mus musculus
cagaggaggcatatcctgcagaggt

SEQ ID NO: 312819 - DNA, 25 bp, Mus musculus
cagaggaggcatttcctgcagaggt

SEQ ID NO: 312820 - DNA, 25 bp, Mus musculus
cagaggaggtttatggccgcttgac

SEQ ID NO: 312821 - DNA, 25 bp, Mus musculus
cagaggaggtttttggccgcttgac

SEQ ID NO: 312822 - DNA, 25 bp, Mus musculus
cagaggataggcagcaggtacacta

SEQ ID NO: 312823 - DNA, 25 bp, Mus musculus
cagaggataggctgcaggtacacta

SEQ ID NO: 312824 - DNA, 25 bp, Mus musculus
cagaggatgcagatcttcggacgcc

SEQ ID NO: 312825 - DNA, 25 bp, Mus musculus
cagaggatgcagttcttcggacgcc

SEQ ID NO: 312826 - DNA, 25 bp, Mus musculus
cagaggatgcggaaacctgacggct

SEQ ID NO: 312827 - DNA, 25 bp, Mus musculus
cagaggatgcggtaacctgacggct

SEQ ID NO: 312828 - DNA, 25 bp, Mus musculus
cagaggatgctaccactgggcacct

SEQ ID NO: 312829 - DNA, 25 bp, Mus musculus
cagaggatgctagcactgggcacct

SEQ ID NO: 312830 - DNA, 25 bp, Mus musculus
cagaggatgctcatcatcatgggat

SEQ ID NO: 312831 - DNA, 25 bp, Mus musculus
cagaggatgctcttcatcatgggat

SEQ ID NO: 312832 - DNA, 25 bp, Mus musculus
cagaggatgcttcccggttcagctt

SEQ ID NO: 312833 - DNA, 25 bp, Mus musculus
cagaggatgcttgccggttcagctt

SEQ ID NO: 312834 - DNA, 25 bp, Mus musculus
cagaggattatgcacagctcgataa

SEQ ID NO: 312835 - DNA, 25 bp, Mus musculus
cagaggattatggacagctcgataa

SEQ ID NO: 312836 - DNA, 25 bp, Mus musculus
cagaggattcaaccccttgaaaatc

SEQ ID NO: 312837 - DNA, 25 bp, Mus musculus
cagaggattcaagcccttgaaaatc

SEQ ID NO: 312838 - DNA, 25 bp, Mus musculus
cagaggcaacaacttatggaatcag

SEQ ID NO: 312839 - DNA, 25 bp, Mus musculus
cagaggcaacaagttatggaatcag

SEQ ID NO: 312840 - DNA, 25 bp, Mus musculus
cagaggcacagcaggagaagcacca

SEQ ID NO: 312841 - DNA, 25 bp, Mus musculus
cagaggcacagctggagaagcacca

SEQ ID NO: 312842 - DNA, 25 bp, Mus musculus
cagaggcaccatcggaatgacttgt

SEQ ID NO: 312843 - DNA, 25 bp, Mus musculus
cagaggcaccatgggaatgacttgt

SEQ ID NO: 312844 - DNA, 25 bp, Mus musculus
cagaggcacctcctagatgtggaca

SEQ ID NO: 312845 - DNA, 25 bp, Mus musculus
cagaggcacctcgtagatgtggaca

SEQ ID NO: 312846 - DNA, 25 bp, Mus musculus
cagaggcactttcttaggcatggtt

SEQ ID NO: 312847 - DNA, 25 bp, Mus musculus
cagaggcactttgttaggcatggtt

SEQ ID NO: 312848 - DNA, 25 bp, Mus musculus
cagaggcagcacacaaaaagggaac

SEQ ID NO: 312849 - DNA, 25 bp, Mus musculus
cagaggcagcactcaaaaagggaac

SEQ ID NO: 312850 - DNA, 25 bp, Mus musculus
cagaggcagcgcagatttttatcca

SEQ ID NO: 312851 - DNA, 25 bp, Mus musculus
cagaggcagcgctgatttttatcca

SEQ ID NO: 312852 - DNA, 25 bp, Mus musculus
cagaggcaggaaaatccggacttgg

SEQ ID NO: 312853 - DNA, 25 bp, Mus musculus
cagaggcaggaatatccggacttgg

SEQ ID NO: 312854 - DNA, 25 bp, Mus musculus
cagaggcaggttaaatcttgacttt

SEQ ID NO: 312855 - DNA, 25 bp, Mus musculus
cagaggcaggttagcacccgaagtt

SEQ ID NO: 312856 - DNA, 25 bp, Mus musculus
cagaggcaggtttaatcttgacttt

SEQ ID NO: 312857 - DNA, 25 bp, Mus musculus
cagaggcaggtttgcacccgaagtt

SEQ ID NO: 312858 - DNA, 25 bp, Mus musculus
cagaggcagtgcagcgacctctcta

SEQ ID NO: 312859 - DNA, 25 bp, Mus musculus
cagaggcagtgctgcgacctctcta

SEQ ID NO: 312860 - DNA, 25 bp, Mus musculus
cagaggcatcggacaccttaccaac

SEQ ID NO: 312861 - DNA, 25 bp, Mus musculus
cagaggcatcggtcaccttaccaac

SEQ ID NO: 312862 - DNA, 25 bp, Mus musculus
cagaggccaacacgtaagggctaag

SEQ ID NO: 312863 - DNA, 25 bp, Mus musculus
cagaggccaacaggtaagggctaag

SEQ ID NO: 312864 - DNA, 25 bp, Mus musculus
cagaggccaactacccagagtacaa

SEQ ID NO: 312865 - DNA, 25 bp, Mus musculus
cagaggccaacttcccagagtacaa

SEQ ID NO: 312866 - DNA, 25 bp, Mus musculus
cagaggccagaaccccaaatcaaag

SEQ ID NO: 312867 - DNA, 25 bp, Mus musculus
cagaggccagaagcccaaatcaaag

SEQ ID NO: 312868 - DNA, 25 bp, Mus musculus
cagaggccagggatgtgtttgcctt

SEQ ID NO: 312869 - DNA, 25 bp, Mus musculus
cagaggccagggttgtgtttgcctt

SEQ ID NO: 312870 - DNA, 25 bp, Mus musculus
cagaggccaggtcaagtgtcagcac

SEQ ID NO: 312871 - DNA, 25 bp, Mus musculus
cagaggccaggtgaagtgtcagcac

SEQ ID NO: 312872 - DNA, 25 bp, Mus musculus
cagaggcccacgcagaggtcatgaa

SEQ ID NO: 312873 - DNA, 25 bp, Mus musculus
cagaggcccacggagaggtcatgaa

SEQ ID NO: 312874 - DNA, 25 bp, Mus musculus
cagaggcccccaaataagaaacgat

SEQ ID NO: 312875 - DNA, 25 bp, Mus musculus
cagaggcccccatataagaaacgat

SEQ ID NO: 312876 - DNA, 25 bp, Mus musculus
cagaggccccgactaagattaacat

SEQ ID NO: 312877 - DNA, 25 bp, Mus musculus
cagaggccccgagtaagattaacat

SEQ ID NO: 312878 - DNA, 25 bp, Mus musculus
cagaggccctgacctaaataaccag

SEQ ID NO: 312879 - DNA, 25 bp, Mus musculus
cagaggccctgagctaaataaccag

SEQ ID NO: 312880 - DNA, 25 bp, Mus musculus
cagaggccctggctccagctgatag

SEQ ID NO: 312881 - DNA, 25 bp, Mus musculus
cagaggccctgggtccagctgatag

SEQ ID NO: 312882 - DNA, 25 bp, Mus musculus
cagaggccctttatgaccgagtcta

SEQ ID NO: 312883 - DNA, 25 bp, Mus musculus
cagaggccctttccggaaggcatga

SEQ ID NO: 312884 - DNA, 25 bp, Mus musculus
cagaggccctttgcggaaggcatga

SEQ ID NO: 312885 - DNA, 25 bp, Mus musculus
cagaggccctttttgaccgagtcta

SEQ ID NO: 312886 - DNA, 25 bp, Mus musculus
cagaggcctcatcgctcacgaagga

SEQ ID NO: 312887 - DNA, 25 bp, Mus musculus
cagaggcctcatggctcacgaagga

SEQ ID NO: 312888 - DNA, 25 bp, Mus musculus
cagaggcctctgaattttgcagctg

SEQ ID NO: 312889 - DNA, 25 bp, Mus musculus
cagaggcctctgcaaatgtactagt

SEQ ID NO: 312890 - DNA, 25 bp, Mus musculus
cagaggcctctggaaatgtactagt

SEQ ID NO: 312891 - DNA, 25 bp, Mus musculus
cagaggcctctgtattttgcagctg

SEQ ID NO: 312892 - DNA, 25 bp, Mus musculus
cagaggccttcacctaattatatat

SEQ ID NO: 312893 - DNA, 25 bp, Mus musculus
cagaggccttcagctaattatatat

SEQ ID NO: 312894 - DNA, 25 bp, Mus musculus
cagaggcgacatcgcttctgtttgt

SEQ ID NO: 312895 - DNA, 25 bp, Mus musculus
cagaggcgacatggcttctgtttgt

SEQ ID NO: 312896 - DNA, 25 bp, Mus musculus
cagaggcgcaccaggttgctagctg

SEQ ID NO: 312897 - DNA, 25 bp, Mus musculus
cagaggcgcacctggttgctagctg

SEQ ID NO: 312898 - DNA, 25 bp, Mus musculus
cagaggcgccccagaggacactgag

SEQ ID NO: 312899 - DNA, 25 bp, Mus musculus
cagaggcgcccctgaggacactgag

SEQ ID NO: 312900 - DNA, 25 bp, Mus musculus
cagaggcggccgattctgacgatgt

SEQ ID NO: 312901 - DNA, 25 bp, Mus musculus
cagaggcggccgtttctgacgatgt

SEQ ID NO: 312902 - DNA, 25 bp, Mus musculus
cagaggcggctcagattgttcaaag

SEQ ID NO: 312903 - DNA, 25 bp, Mus musculus
cagaggcggctctgattgttcaaag

SEQ ID NO: 312904 - DNA, 25 bp, Mus musculus
cagaggcgtgttcttctctctgtat

SEQ ID NO: 312905 - DNA, 25 bp, Mus musculus
cagaggcgtgttgttctctctgtat

SEQ ID NO: 312906 - DNA, 25 bp, Mus musculus
cagaggctaagcagacacagtgtcc

SEQ ID NO: 312907 - DNA, 25 bp, Mus musculus
cagaggctaagctgacacagtgtcc

SEQ ID NO: 312908 - DNA, 25 bp, Mus musculus
cagaggctaaggcttaggtcctgaa

SEQ ID NO: 312909 - DNA, 25 bp, Mus musculus
cagaggctaagggttaggtcctgaa

SEQ ID NO: 312910 - DNA, 25 bp, Mus musculus
cagaggctacaaaaactaaccctgg

SEQ ID NO: 312911 - DNA, 25 bp, Mus musculus
cagaggctacaataactaaccctgg

SEQ ID NO: 312912 - DNA, 25 bp, Mus musculus
cagaggctacccagtatcatggagg

SEQ ID NO: 312913 - DNA, 25 bp, Mus musculus
cagaggctaccctgtatcatggagg

SEQ ID NO: 312914 - DNA, 25 bp, Mus musculus
cagaggctacgcagactatgtcttt

SEQ ID NO: 312915 - DNA, 25 bp, Mus musculus
cagaggctacgctgactatgtcttt

SEQ ID NO: 312916 - DNA, 25 bp, Mus musculus
cagaggctcacaaggactgggtaca

SEQ ID NO: 312917 - DNA, 25 bp, Mus musculus
cagaggctcacatggactgggtaca

SEQ ID NO: 312918 - DNA, 25 bp, Mus musculus
cagaggctccagaagcaaagttcaa

SEQ ID NO: 312919 - DNA, 25 bp, Mus musculus
cagaggctccagtagcaaagttcaa

SEQ ID NO: 312920 - DNA, 25 bp, Mus musculus
cagaggctccgcaacctagactaca

SEQ ID NO: 312921 - DNA, 25 bp, Mus musculus
cagaggctccgctacctagactaca

SEQ ID NO: 312922 - DNA, 25 bp, Mus musculus
cagaggctcctgatgcacttggagt

SEQ ID NO: 312923 - DNA, 25 bp, Mus musculus
cagaggctcctgatggacctgtgag

SEQ ID NO: 312924 - DNA, 25 bp, Mus musculus
cagaggctcctgttgcacttggagt

SEQ ID NO: 312925 - DNA, 25 bp, Mus musculus
cagaggctcctgttggacctgtgag

SEQ ID NO: 312926 - DNA, 25 bp, Mus musculus
cagaggctctgacatttggttagct

SEQ ID NO: 312927 - DNA, 25 bp, Mus musculus
cagaggctctgagatttggttagct

SEQ ID NO: 312928 - DNA, 25 bp, Mus musculus
cagaggctgagaccacaggaatcct

SEQ ID NO: 312929 - DNA, 25 bp, Mus musculus
cagaggctgagagcacaggaatcct

SEQ ID NO: 312930 - DNA, 25 bp, Mus musculus
cagaggctgcatccccagacagtgt

SEQ ID NO: 312931 - DNA, 25 bp, Mus musculus
cagaggctgcatgcccagacagtgt

SEQ ID NO: 312932 - DNA, 25 bp, Mus musculus
cagaggctgctgattgaggcatgct

SEQ ID NO: 312933 - DNA, 25 bp, Mus musculus
cagaggctgctgtttgaggcatgct

SEQ ID NO: 312934 - DNA, 25 bp, Mus musculus
cagaggctggcaacatattatatga

SEQ ID NO: 312935 - DNA, 25 bp, Mus musculus
cagaggctggcatcatattatatga

SEQ ID NO: 312936 - DNA, 25 bp, Mus musculus
cagaggctgggcagtgcattgcatt

SEQ ID NO: 312937 - DNA, 25 bp, Mus musculus
cagaggctgggctgtgcattgcatt

SEQ ID NO: 312938 - DNA, 25 bp, Mus musculus
cagaggctgggtatgaccccaggaa

SEQ ID NO: 312939 - DNA, 25 bp, Mus musculus
cagaggctgggtttgaccccaggaa

SEQ ID NO: 312940 - DNA, 25 bp, Mus musculus
cagaggctggtaatcgacggtaaac

SEQ ID NO: 312941 - DNA, 25 bp, Mus musculus
cagaggctggtattcgacggtaaac

SEQ ID NO: 312942 - DNA, 25 bp, Mus musculus
cagaggctgttaccctgaacagaag

SEQ ID NO: 312943 - DNA, 25 bp, Mus musculus
cagaggctgttagcctgaacagaag

SEQ ID NO: 312944 - DNA, 25 bp, Mus musculus
cagaggcttaggagcgccatccatt

SEQ ID NO: 312945 - DNA, 25 bp, Mus musculus
cagaggcttaggtgcgccatccatt

SEQ ID NO: 312946 - DNA, 25 bp, Mus musculus
cagaggcttataccaccctcagcta

SEQ ID NO: 312947 - DNA, 25 bp, Mus musculus
cagaggcttatagcaccctcagcta

SEQ ID NO: 312948 - DNA, 25 bp, Mus musculus
cagaggcttccacccgatagactga

SEQ ID NO: 312949 - DNA, 25 bp, Mus musculus
cagaggcttccagccgatagactga

SEQ ID NO: 312950 - DNA, 25 bp, Mus musculus
cagaggcttcccattataaagatta

SEQ ID NO: 312951 - DNA, 25 bp, Mus musculus
cagaggcttccctttataaagatta

SEQ ID NO: 312952 - DNA, 25 bp, Mus musculus
cagaggcttgggagctgctttaaaa

SEQ ID NO: 312953 - DNA, 25 bp, Mus musculus
cagaggcttgggtgctgctttaaaa

SEQ ID NO: 312954 - DNA, 25 bp, Mus musculus
cagaggcttggtagcattactgaag

SEQ ID NO: 312955 - DNA, 25 bp, Mus musculus
cagaggcttggttgcattactgaag

SEQ ID NO: 312956 - DNA, 25 bp, Mus musculus
cagaggctttcccatgtgtgtggct

SEQ ID NO: 312957 - DNA, 25 bp, Mus musculus
cagaggctttccgatgtgtgtggct

SEQ ID NO: 312958 - DNA, 25 bp, Mus musculus
cagaggctttggaataggatcagaa

SEQ ID NO: 312959 - DNA, 25 bp, Mus musculus
cagaggctttggtataggatcagaa

SEQ ID NO: 312960 - DNA, 25 bp, Mus musculus
cagagggacaagatgccacttcctt

SEQ ID NO: 312961 - DNA, 25 bp, Mus musculus
cagagggacaagttgccacttcctt

SEQ ID NO: 312962 - DNA, 25 bp, Mus musculus
cagagggacagccagggagagtgca

SEQ ID NO: 312963 - DNA, 25 bp, Mus musculus
cagagggacagcgagggagagtgca

SEQ ID NO: 312964 - DNA, 25 bp, Mus musculus
cagagggacatgactttctttcagc

SEQ ID NO: 312965 - DNA, 25 bp, Mus musculus
cagagggacatgtctttctttcagc

SEQ ID NO: 312966 - DNA, 25 bp, Mus musculus
cagagggacctaaggccagatgcca

SEQ ID NO: 312967 - DNA, 25 bp, Mus musculus
cagagggacctatggccagatgcca

SEQ ID NO: 312968 - DNA, 25 bp, Mus musculus
cagagggacttaccaactttctgaa

SEQ ID NO: 312969 - DNA, 25 bp, Mus musculus
cagagggacttagcaactttctgaa

SEQ ID NO: 312970 - DNA, 25 bp, Mus musculus
cagagggagactaatggctgtgttc

SEQ ID NO: 312971 - DNA, 25 bp, Mus musculus
cagagggagacttatggctgtgttc

SEQ ID NO: 312972 - DNA, 25 bp, Mus musculus
cagagggagagaatcagtggtcatt

SEQ ID NO: 312973 - DNA, 25 bp, Mus musculus
cagagggagagattcagtggtcatt

SEQ ID NO: 312974 - DNA, 25 bp, Mus musculus
cagagggagatccttgttttccttc

SEQ ID NO: 312975 - DNA, 25 bp, Mus musculus
cagagggagatcgttgttttccttc

SEQ ID NO: 312976 - DNA, 25 bp, Mus musculus
cagagggagtgcagtccatattcag

SEQ ID NO: 312977 - DNA, 25 bp, Mus musculus
cagagggagtgctgtccatattcag

SEQ ID NO: 312978 - DNA, 25 bp, Mus musculus
cagagggagttcacctccgagagaa

SEQ ID NO: 312979 - DNA, 25 bp, Mus musculus
cagagggagttctcctccgagagaa

SEQ ID NO: 312980 - DNA, 25 bp, Mus musculus
cagagggagtttagtctcccgccct

SEQ ID NO: 312981 - DNA, 25 bp, Mus musculus
cagagggagttttgtctcccgccct

SEQ ID NO: 312982 - DNA, 25 bp, Mus musculus
cagagggataacaatttgtcactaa

SEQ ID NO: 312983 - DNA, 25 bp, Mus musculus
cagagggataactatttgtcactaa

SEQ ID NO: 312984 - DNA, 25 bp, Mus musculus
cagagggcaggtacgtgcgccttaa

SEQ ID NO: 312985 - DNA, 25 bp, Mus musculus
cagagggcaggttcgtgcgccttaa

SEQ ID NO: 312986 - DNA, 25 bp, Mus musculus
cagagggccaaacacgacacaaagt

SEQ ID NO: 312987 - DNA, 25 bp, Mus musculus
cagagggccaaagacgacacaaagt

SEQ ID NO: 312988 - DNA, 25 bp, Mus musculus
cagagggccagcatgaggtacagac

SEQ ID NO: 312989 - DNA, 25 bp, Mus musculus
cagagggccagcttgaggtacagac

SEQ ID NO: 312990 - DNA, 25 bp, Mus musculus
cagagggccataattgtttccaaat

SEQ ID NO: 312991 - DNA, 25 bp, Mus musculus
cagagggccatatttgtttccaaat

SEQ ID NO: 312992 - DNA, 25 bp, Mus musculus
cagagggccctgatgtgaacgctaa

SEQ ID NO: 312993 - DNA, 25 bp, Mus musculus
cagagggccctgttgtgaacgctaa

SEQ ID NO: 312994 - DNA, 25 bp, Mus musculus
cagagggccgtgacagtgtagattc

SEQ ID NO: 312995 - DNA, 25 bp, Mus musculus
cagagggccgtgtcagtgtagattc

SEQ ID NO: 312996 - DNA, 25 bp, Mus musculus
cagagggcctaaatggacacacata

SEQ ID NO: 312997 - DNA, 25 bp, Mus musculus
cagagggcctaattggacacacata

SEQ ID NO: 312998 - DNA, 25 bp, Mus musculus
cagagggcctccaaatagactggga

SEQ ID NO: 312999 - DNA, 25 bp, Mus musculus
cagagggcctcctaatagactggga

SEQ ID NO: 313000 - DNA, 25 bp, Mus musculus
cagagggctcccaaggacattttta

SEQ ID NO: 313001 - DNA, 25 bp, Mus musculus
cagagggctccctaggacattttta

SEQ ID NO: 313002 - DNA, 25 bp, Mus musculus
cagagggctcttattcctcgggcat

SEQ ID NO: 313003 - DNA, 25 bp, Mus musculus
cagagggctctttttcctcgggcat

SEQ ID NO: 313004 - DNA, 25 bp, Mus musculus
cagagggctgagacaccaggatttt

SEQ ID NO: 313005 - DNA, 25 bp, Mus musculus
cagagggctgagtcaccaggatttt

SEQ ID NO: 313006 - DNA, 25 bp, Mus musculus
cagagggcttgcagagtagaaagat

SEQ ID NO: 313007 - DNA, 25 bp, Mus musculus
cagagggcttgctgagtagaaagat

SEQ ID NO: 313008 - DNA, 25 bp, Mus musculus
cagagggtagtaatttggcacagca

SEQ ID NO: 313009 - DNA, 25 bp, Mus musculus
cagagggtagtattttggcacagca

SEQ ID NO: 313010 - DNA, 25 bp, Mus musculus
cagagggtccacactatatagagac

SEQ ID NO: 313011 - DNA, 25 bp, Mus musculus
cagagggtccactctatatagagac

SEQ ID NO: 313012 - DNA, 25 bp, Mus musculus
cagagggtccagactcgctttgaat

SEQ ID NO: 313013 - DNA, 25 bp, Mus musculus
cagagggtccagagcgaaataggca

SEQ ID NO: 313014 - DNA, 25 bp, Mus musculus
cagagggtccagtctcgctttgaat

SEQ ID NO: 313015 - DNA, 25 bp, Mus musculus
cagagggtccagtgcgaaataggca

SEQ ID NO: 313016 - DNA, 25 bp, Mus musculus
cagagggtccatctatttatgcaaa

SEQ ID NO: 313017 - DNA, 25 bp, Mus musculus
cagagggtccatgtatttatgcaaa

SEQ ID NO: 313018 - DNA, 25 bp, Mus musculus
cagagggtctggatcgattgccagt

SEQ ID NO: 313019 - DNA, 25 bp, Mus musculus
cagagggtctggttcgattgccagt

SEQ ID NO: 313020 - DNA, 25 bp, Mus musculus
cagagggtgggactcccccttcagg

SEQ ID NO: 313021 - DNA, 25 bp, Mus musculus
cagagggtgggagtcccccttcagg

SEQ ID NO: 313022 - DNA, 25 bp, Mus musculus
cagagggtgtctccacttcgagagc

SEQ ID NO: 313023 - DNA, 25 bp, Mus musculus
cagagggtgtctctcaggtcaagtt

SEQ ID NO: 313024 - DNA, 25 bp, Mus musculus
cagagggtgtctgcacttcgagagc

SEQ ID NO: 313025 - DNA, 25 bp, Mus musculus
cagagggtgtctgtcaggtcaagtt

SEQ ID NO: 313026 - DNA, 25 bp, Mus musculus
cagagggttgtgaactcaaagccag

SEQ ID NO: 313027 - DNA, 25 bp, Mus musculus
cagagggttgtgtactcaaagccag

SEQ ID NO: 313028 - DNA, 25 bp, Mus musculus
cagagggttgttccacaccagaaca

SEQ ID NO: 313029 - DNA, 25 bp, Mus musculus
cagagggttgttgcacaccagaaca

SEQ ID NO: 313030 - DNA, 25 bp, Mus musculus
cagaggtaccccagtgcttggtgta

SEQ ID NO: 313031 - DNA, 25 bp, Mus musculus
cagaggtacccctgtgcttggtgta

SEQ ID NO: 313032 - DNA, 25 bp, Mus musculus
cagaggtagccaacgtcggctgagt

SEQ ID NO: 313033 - DNA, 25 bp, Mus musculus
cagaggtagccatcgtcggctgagt

SEQ ID NO: 313034 - DNA, 25 bp, Mus musculus
cagaggtagctcctttaatatccag

SEQ ID NO: 313035 - DNA, 25 bp, Mus musculus
cagaggtagctcgtttaatatccag

SEQ ID NO: 313036 - DNA, 25 bp, Mus musculus
cagaggtaggccagtctctgagttt

SEQ ID NO: 313037 - DNA, 25 bp, Mus musculus
cagaggtaggcctgtctctgagttt

SEQ ID NO: 313038 - DNA, 25 bp, Mus musculus
cagaggtagggtatggcttggtgtt

SEQ ID NO: 313039 - DNA, 25 bp, Mus musculus
cagaggtagggtttggcttggtgtt

SEQ ID NO: 313040 - DNA, 25 bp, Mus musculus
cagaggtatgctaggtccctcaagt

SEQ ID NO: 313041 - DNA, 25 bp, Mus musculus
cagaggtatgcttggtccctcaagt

SEQ ID NO: 313042 - DNA, 25 bp, Mus musculus
cagaggtattagaaattccattttt

SEQ ID NO: 313043 - DNA, 25 bp, Mus musculus
cagaggtattagtaattccattttt

SEQ ID NO: 313044 - DNA, 25 bp, Mus musculus
cagaggtatttgatgatgcattgtt

SEQ ID NO: 313045 - DNA, 25 bp, Mus musculus
cagaggtatttgttgatgcattgtt

SEQ ID NO: 313046 - DNA, 25 bp, Mus musculus
cagaggtattttcaggagcttgatt

SEQ ID NO: 313047 - DNA, 25 bp, Mus musculus
cagaggtattttgaggagcttgatt

SEQ ID NO: 313048 - DNA, 25 bp, Mus musculus
cagaggtcatctccccgtggagaaa

SEQ ID NO: 313049 - DNA, 25 bp, Mus musculus
cagaggtcatctgcccgtggagaaa

SEQ ID NO: 313050 - DNA, 25 bp, Mus musculus
cagaggtcattcacggcatgggcta

SEQ ID NO: 313051 - DNA, 25 bp, Mus musculus
cagaggtcattctcggcatgggcta

SEQ ID NO: 313052 - DNA, 25 bp, Mus musculus
cagaggtccaccatggccatcattc

SEQ ID NO: 313053 - DNA, 25 bp, Mus musculus
cagaggtccaccttggccatcattc

SEQ ID NO: 313054 - DNA, 25 bp, Mus musculus
cagaggtcccatctccttggcagtg

SEQ ID NO: 313055 - DNA, 25 bp, Mus musculus
cagaggtcccatgtccttggcagtg

SEQ ID NO: 313056 - DNA, 25 bp, Mus musculus
cagaggtctcagacccgagtgaaag

SEQ ID NO: 313057 - DNA, 25 bp, Mus musculus
cagaggtctcagtcccgagtgaaag

SEQ ID NO: 313058 - DNA, 25 bp, Mus musculus
cagaggtctgggacctggtataatt

SEQ ID NO: 313059 - DNA, 25 bp, Mus musculus
cagaggtctgggtcctggtataatt

SEQ ID NO: 313060 - DNA, 25 bp, Mus musculus
cagaggtcttgtagtgatatgggca

SEQ ID NO: 313061 - DNA, 25 bp, Mus musculus
cagaggtcttgttgtgatatgggca

SEQ ID NO: 313062 - DNA, 25 bp, Mus musculus
cagaggtgacagatgtttatgagat

SEQ ID NO: 313063 - DNA, 25 bp, Mus musculus
cagaggtgacagttgtttatgagat

SEQ ID NO: 313064 - DNA, 25 bp, Mus musculus
cagaggtgacggacctactgcgagc

SEQ ID NO: 313065 - DNA, 25 bp, Mus musculus
cagaggtgacggtcctactgcgagc

SEQ ID NO: 313066 - DNA, 25 bp, Mus musculus
cagaggtgactccttttgcctgctg

SEQ ID NO: 313067 - DNA, 25 bp, Mus musculus
cagaggtgactcgttttgcctgctg

SEQ ID NO: 313068 - DNA, 25 bp, Mus musculus
cagaggtgatcactgtctgtgacta

SEQ ID NO: 313069 - DNA, 25 bp, Mus musculus
cagaggtgatcagtgtctgtgacta

SEQ ID NO: 313070 - DNA, 25 bp, Mus musculus
cagaggtgatccagcgagtggacaa

SEQ ID NO: 313071 - DNA, 25 bp, Mus musculus
cagaggtgatcctgcgagtggacaa

SEQ ID NO: 313072 - DNA, 25 bp, Mus musculus
cagaggtgcaagcagttgggcatca

SEQ ID NO: 313073 - DNA, 25 bp, Mus musculus
cagaggtgcaaggagttgggcatca

SEQ ID NO: 313074 - DNA, 25 bp, Mus musculus
cagaggtgcacacgtatttattccc

SEQ ID NO: 313075 - DNA, 25 bp, Mus musculus
cagaggtgcacaggtatttattccc

SEQ ID NO: 313076 - DNA, 25 bp, Mus musculus
cagaggtgcaggagaccaaatgcct

SEQ ID NO: 313077 - DNA, 25 bp, Mus musculus
cagaggtgcaggtgaccaaatgcct

SEQ ID NO: 313078 - DNA, 25 bp, Mus musculus
cagaggtgccaccatgataaggagt

SEQ ID NO: 313079 - DNA, 25 bp, Mus musculus
cagaggtgccacgatgataaggagt

SEQ ID NO: 313080 - DNA, 25 bp, Mus musculus
cagaggtgcctactttgtggataaa

SEQ ID NO: 313081 - DNA, 25 bp, Mus musculus
cagaggtgcctagtttgtggataaa

SEQ ID NO: 313082 - DNA, 25 bp, Mus musculus
cagaggtgctagacagctggagctt

SEQ ID NO: 313083 - DNA, 25 bp, Mus musculus
cagaggtgctagtcagctggagctt

SEQ ID NO: 313084 - DNA, 25 bp, Mus musculus
cagaggtgcttgaactgtgaacttt

SEQ ID NO: 313085 - DNA, 25 bp, Mus musculus
cagaggtgcttgtactgtgaacttt

SEQ ID NO: 313086 - DNA, 25 bp, Mus musculus
cagaggtggagtcccgctatgccac

SEQ ID NO: 313087 - DNA, 25 bp, Mus musculus
cagaggtggagtgccgctatgccac

SEQ ID NO: 313088 - DNA, 25 bp, Mus musculus
cagaggtggcgcaggactccacaga

SEQ ID NO: 313089 - DNA, 25 bp, Mus musculus
cagaggtggcgcaggatcctacacg

SEQ ID NO: 313090 - DNA, 25 bp, Mus musculus
cagaggtggcgctggactccacaga

SEQ ID NO: 313091 - DNA, 25 bp, Mus musculus
cagaggtggcgctggatcctacacg

SEQ ID NO: 313092 - DNA, 25 bp, Mus musculus
cagaggtggttcatcaaggagcgca

SEQ ID NO: 313093 - DNA, 25 bp, Mus musculus
cagaggtggttcttcaaggagcgca

SEQ ID NO: 313094 - DNA, 25 bp, Mus musculus
cagaggtgtactcctgctgtagaaa

SEQ ID NO: 313095 - DNA, 25 bp, Mus musculus
cagaggtgtactgctgctgtagaaa

SEQ ID NO: 313096 - DNA, 25 bp, Mus musculus
cagaggtgtcggatagtcacatttt

SEQ ID NO: 313097 - DNA, 25 bp, Mus musculus
cagaggtgtcggttagtcacatttt

SEQ ID NO: 313098 - DNA, 25 bp, Mus musculus
cagaggtgtggcagactgcatgtaa

SEQ ID NO: 313099 - DNA, 25 bp, Mus musculus
cagaggtgtggctgactgcatgtaa

SEQ ID NO: 313100 - DNA, 25 bp, Mus musculus
cagaggtgttagctacacagctcaa

SEQ ID NO: 313101 - DNA, 25 bp, Mus musculus
cagaggtgttaggtacacagctcaa

SEQ ID NO: 313102 - DNA, 25 bp, Mus musculus
cagaggtgttgactaaatgtatcca

SEQ ID NO: 313103 - DNA, 25 bp, Mus musculus
cagaggtgttgagtaaatgtatcca

SEQ ID NO: 313104 - DNA, 25 bp, Mus musculus
cagaggttgtaaagtcctgcctgta

SEQ ID NO: 313105 - DNA, 25 bp, Mus musculus
cagaggttgtaatgtcctgcctgta

SEQ ID NO: 313106 - DNA, 25 bp, Mus musculus
cagaggttgtatatcaagcaccaca

SEQ ID NO: 313107 - DNA, 25 bp, Mus musculus
cagaggttgtatttcaagcaccaca

SEQ ID NO: 313108 - DNA, 25 bp, Mus musculus
cagaggtttcccagcaataataaaa

SEQ ID NO: 313109 - DNA, 25 bp, Mus musculus
cagaggtttccctgcaataataaaa

SEQ ID NO: 313110 - DNA, 25 bp, Mus musculus
cagaggtttctaaggtactaaaatt

SEQ ID NO: 313111 - DNA, 25 bp, Mus musculus
cagaggtttctatggtactaaaatt

SEQ ID NO: 313112 - DNA, 25 bp, Mus musculus
cagaggttttaactctactcagcaa

SEQ ID NO: 313113 - DNA, 25 bp, Mus musculus
cagaggttttaagtctactcagcaa

SEQ ID NO: 313114 - DNA, 25 bp, Mus musculus
cagaggttttagagccagtgagaca

SEQ ID NO: 313115 - DNA, 25 bp, Mus musculus
cagaggttttagtgccagtgagaca

SEQ ID NO: 313116 - DNA, 25 bp, Mus musculus
cagaggttttcaactgtcttcagga

SEQ ID NO: 313117 - DNA, 25 bp, Mus musculus
cagaggttttcatctgtcttcagga

SEQ ID NO: 313118 - DNA, 25 bp, Mus musculus
cagaggttttgtctctagacggccc

SEQ ID NO: 313119 - DNA, 25 bp, Mus musculus
cagaggttttgtgtctagacggccc

SEQ ID NO: 313120 - DNA, 25 bp, Mus musculus
cagaggtttttgctagaattaggct

SEQ ID NO: 313121 - DNA, 25 bp, Mus musculus
cagaggtttttggtagaattaggct

SEQ ID NO: 313122 - DNA, 25 bp, Mus musculus
cagagtaaagagctctaccagctat

SEQ ID NO: 313123 - DNA, 25 bp, Mus musculus
cagagtaaagaggtctaccagctat

SEQ ID NO: 313124 - DNA, 25 bp, Mus musculus
cagagtaagaatctggttccccatt

SEQ ID NO: 313125 - DNA, 25 bp, Mus musculus
cagagtaagaatgtggttccccatt

SEQ ID NO: 313126 - DNA, 25 bp, Mus musculus
cagagtaagctcaagactgacctga

SEQ ID NO: 313127 - DNA, 25 bp, Mus musculus
cagagtaagctctagactgacctga

SEQ ID NO: 313128 - DNA, 25 bp, Mus musculus
cagagtaatagtcccttcctcagag

SEQ ID NO: 313129 - DNA, 25 bp, Mus musculus
cagagtaatagtgccttcctcagag

SEQ ID NO: 313130 - DNA, 25 bp, Mus musculus
cagagtaatggcacggtttcttccc

SEQ ID NO: 313131 - DNA, 25 bp, Mus musculus
cagagtaatggctcggtttcttccc

SEQ ID NO: 313132 - DNA, 25 bp, Mus musculus
cagagtaatttcaggtttggagctg

SEQ ID NO: 313133 - DNA, 25 bp, Mus musculus
cagagtaatttctggtttggagctg

SEQ ID NO: 313134 - DNA, 25 bp, Mus musculus
cagagtacaaaacagcacttgggaa

SEQ ID NO: 313135 - DNA, 25 bp, Mus musculus
cagagtacaaaagagcacttgggaa

SEQ ID NO: 313136 - DNA, 25 bp, Mus musculus
cagagtacagggaccagaatccatc

SEQ ID NO: 313137 - DNA, 25 bp, Mus musculus
cagagtacagggtccagaatccatc

SEQ ID NO: 313138 - DNA, 25 bp, Mus musculus
cagagtacggccatggcatttacat

SEQ ID NO: 313139 - DNA, 25 bp, Mus musculus
cagagtacggccttggcatttacat

SEQ ID NO: 313140 - DNA, 25 bp, Mus musculus
cagagtacggtgctgcagaatagca

SEQ ID NO: 313141 - DNA, 25 bp, Mus musculus
cagagtacggtggtgcagaatagca

SEQ ID NO: 313142 - DNA, 25 bp, Mus musculus
cagagtagagcacttggattgccaa

SEQ ID NO: 313143 - DNA, 25 bp, Mus musculus
cagagtagagcagttggattgccaa

SEQ ID NO: 313144 - DNA, 25 bp, Mus musculus
cagagtagtactaaacatgattttg

SEQ ID NO: 313145 - DNA, 25 bp, Mus musculus
cagagtagtacttaacatgattttg

SEQ ID NO: 313146 - DNA, 25 bp, Mus musculus
cagagtatacagagtcccttatgga

SEQ ID NO: 313147 - DNA, 25 bp, Mus musculus
cagagtatacagtgtcccttatgga

SEQ ID NO: 313148 - DNA, 25 bp, Mus musculus
cagagtatcctacggtgtgtgtcca

SEQ ID NO: 313149 - DNA, 25 bp, Mus musculus
cagagtatcctagggtgtgtgtcca

SEQ ID NO: 313150 - DNA, 25 bp, Mus musculus
cagagtatgaaaaagcttccgggtt

SEQ ID NO: 313151 - DNA, 25 bp, Mus musculus
cagagtatgaaatagcttccgggtt

SEQ ID NO: 313152 - DNA, 25 bp, Mus musculus
cagagtatgaagagagcatgcgcag

SEQ ID NO: 313153 - DNA, 25 bp, Mus musculus
cagagtatgaagtgagcatgcgcag

SEQ ID NO: 313154 - DNA, 25 bp, Mus musculus
cagagtattgagctcctgggtcagc

SEQ ID NO: 313155 - DNA, 25 bp, Mus musculus
cagagtattgaggtcctgggtcagc

SEQ ID NO: 313156 - DNA, 25 bp, Mus musculus
cagagtatttctctcagcaatataa

SEQ ID NO: 313157 - DNA, 25 bp, Mus musculus
cagagtatttctgtcagcaatataa

SEQ ID NO: 313158 - DNA, 25 bp, Mus musculus
cagagtattttcattactccctaaa

SEQ ID NO: 313159 - DNA, 25 bp, Mus musculus
cagagtattttctttactccctaaa

SEQ ID NO: 313160 - DNA, 25 bp, Mus musculus
cagagtcaaaggatgcttcagccgt

SEQ ID NO: 313161 - DNA, 25 bp, Mus musculus
cagagtcaaaggttgcttcagccgt

SEQ ID NO: 313162 - DNA, 25 bp, Mus musculus
cagagtcacaggcagttccccagga

SEQ ID NO: 313163 - DNA, 25 bp, Mus musculus
cagagtcacagggagttccccagga

SEQ ID NO: 313164 - DNA, 25 bp, Mus musculus
cagagtcacctaacctggacccttg

SEQ ID NO: 313165 - DNA, 25 bp, Mus musculus
cagagtcacctatcctggacccttg

SEQ ID NO: 313166 - DNA, 25 bp, Mus musculus
cagagtcactctactcagtggctta

SEQ ID NO: 313167 - DNA, 25 bp, Mus musculus
cagagtcactcttctcagtggctta

SEQ ID NO: 313168 - DNA, 25 bp, Mus musculus
cagagtcacttaagccatgtcccgg

SEQ ID NO: 313169 - DNA, 25 bp, Mus musculus
cagagtcacttatgccatgtcccgg

SEQ ID NO: 313170 - DNA, 25 bp, Mus musculus
cagagtcagaacaatgccggtttat

SEQ ID NO: 313171 - DNA, 25 bp, Mus musculus
cagagtcagaactatgccggtttat

SEQ ID NO: 313172 - DNA, 25 bp, Mus musculus
cagagtcagaccctggtgctttgtt

SEQ ID NO: 313173 - DNA, 25 bp, Mus musculus
cagagtcagaccgtggtgctttgtt

SEQ ID NO: 313174 - DNA, 25 bp, Mus musculus
cagagtcagataccccagagttgtc

SEQ ID NO: 313175 - DNA, 25 bp, Mus musculus
cagagtcagatagcccagagttgtc

SEQ ID NO: 313176 - DNA, 25 bp, Mus musculus
cagagtcaggtgaacagcccaagct

SEQ ID NO: 313177 - DNA, 25 bp, Mus musculus
cagagtcaggtgtacagcccaagct

SEQ ID NO: 313178 - DNA, 25 bp, Mus musculus
cagagtcagtgcagttgccagggaa

SEQ ID NO: 313179 - DNA, 25 bp, Mus musculus
cagagtcagtgctgttgccagggaa

SEQ ID NO: 313180 - DNA, 25 bp, Mus musculus
cagagtcatatacacctcgcaggat

SEQ ID NO: 313181 - DNA, 25 bp, Mus musculus
cagagtcatatagacctcgcaggat

SEQ ID NO: 313182 - DNA, 25 bp, Mus musculus
cagagtcattgaaaacccacaggat

SEQ ID NO: 313183 - DNA, 25 bp, Mus musculus
cagagtcattgataacccacaggat

SEQ ID NO: 313184 - DNA, 25 bp, Mus musculus
cagagtcattggcatgttttccctt

SEQ ID NO: 313185 - DNA, 25 bp, Mus musculus
cagagtcattgggatgttttccctt

SEQ ID NO: 313186 - DNA, 25 bp, Mus musculus
cagagtccaaacatcagttgcaata

SEQ ID NO: 313187 - DNA, 25 bp, Mus musculus
cagagtccaaacttcagttgcaata

SEQ ID NO: 313188 - DNA, 25 bp, Mus musculus
cagagtccaacgaagggcctgtcaa

SEQ ID NO: 313189 - DNA, 25 bp, Mus musculus
cagagtccaacgtagggcctgtcaa

SEQ ID NO: 313190 - DNA, 25 bp, Mus musculus
cagagtccagcacacggtcattgag

SEQ ID NO: 313191 - DNA, 25 bp, Mus musculus
cagagtccagcacgcagccctgttg

SEQ ID NO: 313192 - DNA, 25 bp, Mus musculus
cagagtccagcagacggtcattgag

SEQ ID NO: 313193 - DNA, 25 bp, Mus musculus
cagagtccagcaggcagccctgttg

SEQ ID NO: 313194 - DNA, 25 bp, Mus musculus
cagagtccattcatagctttttcca

SEQ ID NO: 313195 - DNA, 25 bp, Mus musculus
cagagtccattcttagctttttcca

SEQ ID NO: 313196 - DNA, 25 bp, Mus musculus
cagagtccccagaaaagacaaagga

SEQ ID NO: 313197 - DNA, 25 bp, Mus musculus
cagagtccccagtaaagacaaagga

SEQ ID NO: 313198 - DNA, 25 bp, Mus musculus
cagagtcccttcagtacccgtttgt

SEQ ID NO: 313199 - DNA, 25 bp, Mus musculus
cagagtcccttctgtacccgtttgt

SEQ ID NO: 313200 - DNA, 25 bp, Mus musculus
cagagtccggctcattccagcaaga

SEQ ID NO: 313201 - DNA, 25 bp, Mus musculus
cagagtccggctgattccagcaaga

SEQ ID NO: 313202 - DNA, 25 bp, Mus musculus
cagagtccgtaaaggaacccaagca

SEQ ID NO: 313203 - DNA, 25 bp, Mus musculus
cagagtccgtaatggaacccaagca

SEQ ID NO: 313204 - DNA, 25 bp, Mus musculus
cagagtcctcagagtgcctcttctc

SEQ ID NO: 313205 - DNA, 25 bp, Mus musculus
cagagtcctcagtgtgcctcttctc

SEQ ID NO: 313206 - DNA, 25 bp, Mus musculus
cagagtcctggacggaaatatctta

SEQ ID NO: 313207 - DNA, 25 bp, Mus musculus
cagagtcctggagggaaatatctta

SEQ ID NO: 313208 - DNA, 25 bp, Mus musculus
cagagtccttgcaatgttggccata

SEQ ID NO: 313209 - DNA, 25 bp, Mus musculus
cagagtccttgctatgttggccata

SEQ ID NO: 313210 - DNA, 25 bp, Mus musculus
cagagtcgacttagtagctttttcc

SEQ ID NO: 313211 - DNA, 25 bp, Mus musculus
cagagtcgactttgtagctttttcc

SEQ ID NO: 313212 - DNA, 25 bp, Mus musculus
cagagtcgtgtgctgacaaggccct

SEQ ID NO: 313213 - DNA, 25 bp, Mus musculus
cagagtcgtgtggtgacaaggccct

SEQ ID NO: 313214 - DNA, 25 bp, Mus musculus
cagagtctcagtagcatgcagtgca

SEQ ID NO: 313215 - DNA, 25 bp, Mus musculus
cagagtctcagttgcatgcagtgca

SEQ ID NO: 313216 - DNA, 25 bp, Mus musculus
cagagtctctaactgaacctgtcac

SEQ ID NO: 313217 - DNA, 25 bp, Mus musculus
cagagtctctaagtgaacctgtcac

SEQ ID NO: 313218 - DNA, 25 bp, Mus musculus
cagagtctctgaagaccccatccaa

SEQ ID NO: 313219 - DNA, 25 bp, Mus musculus
cagagtctctgacttgaaacatctc

SEQ ID NO: 313220 - DNA, 25 bp, Mus musculus
cagagtctctgagttgaaacatctc

SEQ ID NO: 313221 - DNA, 25 bp, Mus musculus
cagagtctctgatgaccccatccaa

SEQ ID NO: 313222 - DNA, 25 bp, Mus musculus
cagagtctcttgctttggtgtggtt

SEQ ID NO: 313223 - DNA, 25 bp, Mus musculus
cagagtctcttggtttggtgtggtt

SEQ ID NO: 313224 - DNA, 25 bp, Mus musculus
cagagtctgactagaatttccataa

SEQ ID NO: 313225 - DNA, 25 bp, Mus musculus
cagagtctgacttgaatttccataa

SEQ ID NO: 313226 - DNA, 25 bp, Mus musculus
cagagtctgagtccagctttctgga

SEQ ID NO: 313227 - DNA, 25 bp, Mus musculus
cagagtctgagtgcagctttctgga

SEQ ID NO: 313228 - DNA, 25 bp, Mus musculus
cagagtcttactaggatgggaagga

SEQ ID NO: 313229 - DNA, 25 bp, Mus musculus
cagagtcttacttggatgggaagga

SEQ ID NO: 313230 - DNA, 25 bp, Mus musculus
cagagtcttcctattgtgagtgtct

SEQ ID NO: 313231 - DNA, 25 bp, Mus musculus
cagagtcttccttttgtgagtgtct

SEQ ID NO: 313232 - DNA, 25 bp, Mus musculus
cagagtcttgacagctttgagctac

SEQ ID NO: 313233 - DNA, 25 bp, Mus musculus
cagagtcttgactgctttgagctac

SEQ ID NO: 313234 - DNA, 25 bp, Mus musculus
cagagtcttgtgaacctggttggca

SEQ ID NO: 313235 - DNA, 25 bp, Mus musculus
cagagtcttgtgtacctggttggca

SEQ ID NO: 313236 - DNA, 25 bp, Mus musculus
cagagtgaaaacatccatgattgca

SEQ ID NO: 313237 - DNA, 25 bp, Mus musculus
cagagtgaaaacttccatgattgca

SEQ ID NO: 313238 - DNA, 25 bp, Mus musculus
cagagtgaacctcgctgcagtccct

SEQ ID NO: 313239 - DNA, 25 bp, Mus musculus
cagagtgaacctggctgcagtccct

SEQ ID NO: 313240 - DNA, 25 bp, Mus musculus
cagagtgaactcatgcctgcgggtt

SEQ ID NO: 313241 - DNA, 25 bp, Mus musculus
cagagtgaactcttgcctgcgggtt

SEQ ID NO: 313242 - DNA, 25 bp, Mus musculus
cagagtgaagggacatcatcagcta

SEQ ID NO: 313243 - DNA, 25 bp, Mus musculus
cagagtgaagggtcatcatcagcta

SEQ ID NO: 313244 - DNA, 25 bp, Mus musculus
cagagtgacctcaagttcagttctc

SEQ ID NO: 313245 - DNA, 25 bp, Mus musculus
cagagtgacctctagttcagttctc

SEQ ID NO: 313246 - DNA, 25 bp, Mus musculus
cagagtgaccttaccgggtgtattg

SEQ ID NO: 313247 - DNA, 25 bp, Mus musculus
cagagtgacctttccgggtgtattg

SEQ ID NO: 313248 - DNA, 25 bp, Mus musculus
cagagtgagactatacttacgacgt

SEQ ID NO: 313249 - DNA, 25 bp, Mus musculus
cagagtgagactttacttacgacgt

SEQ ID NO: 313250 - DNA, 25 bp, Mus musculus
cagagtgagctaaatcctgctcctc

SEQ ID NO: 313251 - DNA, 25 bp, Mus musculus
cagagtgagctatatcctgctcctc

SEQ ID NO: 313252 - DNA, 25 bp, Mus musculus
cagagtgagctcatgagtgtgtcga

SEQ ID NO: 313253 - DNA, 25 bp, Mus musculus
cagagtgagctcttgagtgtgtcga

SEQ ID NO: 313254 - DNA, 25 bp, Mus musculus
cagagtgagcttattggaggtaaca

SEQ ID NO: 313255 - DNA, 25 bp, Mus musculus
cagagtgagctttttggaggtaaca

SEQ ID NO: 313256 - DNA, 25 bp, Mus musculus
cagagtgagtacaacggtcccggag

SEQ ID NO: 313257 - DNA, 25 bp, Mus musculus
cagagtgagtactacggtcccggag

SEQ ID NO: 313258 - DNA, 25 bp, Mus musculus
cagagtgagtctcggtctgctcttc

SEQ ID NO: 313259 - DNA, 25 bp, Mus musculus
cagagtgagtctgggtctgctcttc

SEQ ID NO: 313260 - DNA, 25 bp, Mus musculus
cagagtgatctgcagcaaaagagac

SEQ ID NO: 313261 - DNA, 25 bp, Mus musculus
cagagtgatctggagcaaaagagac

SEQ ID NO: 313262 - DNA, 25 bp, Mus musculus
cagagtgatcttccagtgcttggct

SEQ ID NO: 313263 - DNA, 25 bp, Mus musculus
cagagtgatcttgcagtgcttggct

SEQ ID NO: 313264 - DNA, 25 bp, Mus musculus
cagagtgcacagagccctgggctgc

SEQ ID NO: 313265 - DNA, 25 bp, Mus musculus
cagagtgcacagtgccctgggctgc

SEQ ID NO: 313266 - DNA, 25 bp, Mus musculus
cagagtgcaccacggaacacggtca

SEQ ID NO: 313267 - DNA, 25 bp, Mus musculus
cagagtgcaccagggaacacggtca

SEQ ID NO: 313268 - DNA, 25 bp, Mus musculus
cagagtgcacgcagagatcttccaa

SEQ ID NO: 313269 - DNA, 25 bp, Mus musculus
cagagtgcacgctgagatcttccaa

SEQ ID NO: 313270 - DNA, 25 bp, Mus musculus
cagagtgcatgtcttttcggctaaa

SEQ ID NO: 313271 - DNA, 25 bp, Mus musculus
cagagtgcatgtgttttcggctaaa

SEQ ID NO: 313272 - DNA, 25 bp, Mus musculus
cagagtgccaaaccgtgctgtgttc

SEQ ID NO: 313273 - DNA, 25 bp, Mus musculus
cagagtgccaaagcgtgctgtgttc

SEQ ID NO: 313274 - DNA, 25 bp, Mus musculus
cagagtgccaatcgtgggatcagca

SEQ ID NO: 313275 - DNA, 25 bp, Mus musculus
cagagtgccaatggtgggatcagca

SEQ ID NO: 313276 - DNA, 25 bp, Mus musculus
cagagtgctctgatgtggaatgcca

SEQ ID NO: 313277 - DNA, 25 bp, Mus musculus
cagagtgctctgttgtggaatgcca

SEQ ID NO: 313278 - DNA, 25 bp, Mus musculus
cagagtgctgggatgtgcaaccatg

SEQ ID NO: 313279 - DNA, 25 bp, Mus musculus
cagagtgctgggttgtgcaaccatg

SEQ ID NO: 313280 - DNA, 25 bp, Mus musculus
cagagtgctgtgaaagttgtgaacc

SEQ ID NO: 313281 - DNA, 25 bp, Mus musculus
cagagtgctgtgtaagttgtgaacc

SEQ ID NO: 313282 - DNA, 25 bp, Mus musculus
cagagtgcttggcaacacgattgaa

SEQ ID NO: 313283 - DNA, 25 bp, Mus musculus
cagagtgcttgggaacacgattgaa

SEQ ID NO: 313284 - DNA, 25 bp, Mus musculus
cagagtggatacatgtttctgctgt

SEQ ID NO: 313285 - DNA, 25 bp, Mus musculus
cagagtggatacttgtttctgctgt

SEQ ID NO: 313286 - DNA, 25 bp, Mus musculus
cagagtggcagtccttgaaaaccaa

SEQ ID NO: 313287 - DNA, 25 bp, Mus musculus
cagagtggcagtgcttgaaaaccaa

SEQ ID NO: 313288 - DNA, 25 bp, Mus musculus
cagagtggccaacctcagcacggag

SEQ ID NO: 313289 - DNA, 25 bp, Mus musculus
cagagtggccaagctcagcacggag

SEQ ID NO: 313290 - DNA, 25 bp, Mus musculus
cagagtggcccactgaagaaggttc

SEQ ID NO: 313291 - DNA, 25 bp, Mus musculus
cagagtggcccagtgaagaaggttc

SEQ ID NO: 313292 - DNA, 25 bp, Mus musculus
cagagtggcggcacgtttggcactt

SEQ ID NO: 313293 - DNA, 25 bp, Mus musculus
cagagtggcggctcgtttggcactt

SEQ ID NO: 313294 - DNA, 25 bp, Mus musculus
cagagtggcgggacccctctggaca

SEQ ID NO: 313295 - DNA, 25 bp, Mus musculus
cagagtggcgggtcccctctggaca

SEQ ID NO: 313296 - DNA, 25 bp, Mus musculus
cagagtgggaccatttgcctaagta

SEQ ID NO: 313297 - DNA, 25 bp, Mus musculus
cagagtgggaccttttgcctaagta

SEQ ID NO: 313298 - DNA, 25 bp, Mus musculus
cagagtgggactcacccctgaagaa

SEQ ID NO: 313299 - DNA, 25 bp, Mus musculus
cagagtgggactgacccctgaagaa

SEQ ID NO: 313300 - DNA, 25 bp, Mus musculus
cagagtgggcccagtctatgaggaa

SEQ ID NO: 313301 - DNA, 25 bp, Mus musculus
cagagtgggccctgtctatgaggaa

SEQ ID NO: 313302 - DNA, 25 bp, Mus musculus
cagagtgggtacagcctgtttagcc

SEQ ID NO: 313303 - DNA, 25 bp, Mus musculus
cagagtgggtactgcctgtttagcc

SEQ ID NO: 313304 - DNA, 25 bp, Mus musculus
cagagtgggtttagcagctgcacca

SEQ ID NO: 313305 - DNA, 25 bp, Mus musculus
cagagtgggttttgcagctgcacca

SEQ ID NO: 313306 - DNA, 25 bp, Mus musculus
cagagtggtcacagggcatgtcgct

SEQ ID NO: 313307 - DNA, 25 bp, Mus musculus
cagagtggtcactgggcatgtcgct

SEQ ID NO: 313308 - DNA, 25 bp, Mus musculus
cagagtggtctgagctgtccggaaa

SEQ ID NO: 313309 - DNA, 25 bp, Mus musculus
cagagtggtctgtgctgtccggaaa

SEQ ID NO: 313310 - DNA, 25 bp, Mus musculus
cagagtggtgtaatgctttttcata

SEQ ID NO: 313311 - DNA, 25 bp, Mus musculus
cagagtggtgtattgctttttcata

SEQ ID NO: 313312 - DNA, 25 bp, Mus musculus
cagagtggttcaattgtcaggtaaa

SEQ ID NO: 313313 - DNA, 25 bp, Mus musculus
cagagtggttcatttgtcaggtaaa

SEQ ID NO: 313314 - DNA, 25 bp, Mus musculus
cagagtgtaagcatccaaggtaatt

SEQ ID NO: 313315 - DNA, 25 bp, Mus musculus
cagagtgtaagcttccaaggtaatt

SEQ ID NO: 313316 - DNA, 25 bp, Mus musculus
cagagtgtaccacctgctgtgttcg

SEQ ID NO: 313317 - DNA, 25 bp, Mus musculus
cagagtgtaccagctgctgtgttcg

SEQ ID NO: 313318 - DNA, 25 bp, Mus musculus
cagagtgtcactccttagccagtgt

SEQ ID NO: 313319 - DNA, 25 bp, Mus musculus
cagagtgtcactgcttagccagtgt

SEQ ID NO: 313320 - DNA, 25 bp, Mus musculus
cagagtgtcaggaatcaatgtggct

SEQ ID NO: 313321 - DNA, 25 bp, Mus musculus
cagagtgtcaggtatcaatgtggct

SEQ ID NO: 313322 - DNA, 25 bp, Mus musculus
cagagtgtcagtaaaatcgccccag

SEQ ID NO: 313323 - DNA, 25 bp, Mus musculus
cagagtgtcagttaaatcgccccag

SEQ ID NO: 313324 - DNA, 25 bp, Mus musculus
cagagtgtctatcccctgtgacatc

SEQ ID NO: 313325 - DNA, 25 bp, Mus musculus
cagagtgtctatgccctgtgacatc

SEQ ID NO: 313326 - DNA, 25 bp, Mus musculus
cagagtgtctctagggcctgagaat

SEQ ID NO: 313327 - DNA, 25 bp, Mus musculus
cagagtgtctcttgggcctgagaat

SEQ ID NO: 313328 - DNA, 25 bp, Mus musculus
cagagtgtctgtcagcttcatgttt

SEQ ID NO: 313329 - DNA, 25 bp, Mus musculus
cagagtgtctgtgagcttcatgttt

SEQ ID NO: 313330 - DNA, 25 bp, Mus musculus
cagagtgtgattcggacagctgtct

SEQ ID NO: 313331 - DNA, 25 bp, Mus musculus
cagagtgtgattgggacagctgtct

SEQ ID NO: 313332 - DNA, 25 bp, Mus musculus
cagagtgtggacagcatcccgagag

SEQ ID NO: 313333 - DNA, 25 bp, Mus musculus
cagagtgtggactgcatcccgagag

SEQ ID NO: 313334 - DNA, 25 bp, Mus musculus
cagagtgtggctcggcttcatttac

SEQ ID NO: 313335 - DNA, 25 bp, Mus musculus
cagagtgtggctgggcttcatttac

SEQ ID NO: 313336 - DNA, 25 bp, Mus musculus
cagagtgtggtgaacctgatgccca

SEQ ID NO: 313337 - DNA, 25 bp, Mus musculus
cagagtgtggtgcacatttatgtaa

SEQ ID NO: 313338 - DNA, 25 bp, Mus musculus
cagagtgtggtggacatttatgtaa

SEQ ID NO: 313339 - DNA, 25 bp, Mus musculus
cagagtgtggtgtacctgatgccca

SEQ ID NO: 313340 - DNA, 25 bp, Mus musculus
cagagtgtgtcaccctgggctactg

SEQ ID NO: 313341 - DNA, 25 bp, Mus musculus
cagagtgtgtcagcctgggctactg

SEQ ID NO: 313342 - DNA, 25 bp, Mus musculus
cagagtgtgtttcccaacaacgacc

SEQ ID NO: 313343 - DNA, 25 bp, Mus musculus
cagagtgtgtttgccaacaacgacc

SEQ ID NO: 313344 - DNA, 25 bp, Mus musculus
cagagtgttagcaaggaaattaggt

SEQ ID NO: 313345 - DNA, 25 bp, Mus musculus
cagagtgttagctaggaaattaggt

SEQ ID NO: 313346 - DNA, 25 bp, Mus musculus
cagagtgttcatcgccagtgttgct

SEQ ID NO: 313347 - DNA, 25 bp, Mus musculus
cagagtgttcatggccagtgttgct

SEQ ID NO: 313348 - DNA, 25 bp, Mus musculus
cagagtgttccaacattgcaatcga

SEQ ID NO: 313349 - DNA, 25 bp, Mus musculus
cagagtgttccatcattgcaatcga

SEQ ID NO: 313350 - DNA, 25 bp, Mus musculus
cagagtgttcctctatgtggcctga

SEQ ID NO: 313351 - DNA, 25 bp, Mus musculus
cagagtgttcctgtatgtggcctga

SEQ ID NO: 313352 - DNA, 25 bp, Mus musculus
cagagtgttggtaatatagagctaa

SEQ ID NO: 313353 - DNA, 25 bp, Mus musculus
cagagtgttggttatatagagctaa

SEQ ID NO: 313354 - DNA, 25 bp, Mus musculus
cagagttaactgatgatacccaata

SEQ ID NO: 313355 - DNA, 25 bp, Mus musculus
cagagttaactgattgtgaactttt

SEQ ID NO: 313356 - DNA, 25 bp, Mus musculus
cagagttaactgttgatacccaata

SEQ ID NO: 313357 - DNA, 25 bp, Mus musculus
cagagttaactgtttgtgaactttt

SEQ ID NO: 313358 - DNA, 25 bp, Mus musculus
cagagttaaggtcctgttacccctc

SEQ ID NO: 313359 - DNA, 25 bp, Mus musculus
cagagttaaggtgctgttacccctc

SEQ ID NO: 313360 - DNA, 25 bp, Mus musculus
cagagttaagtgagttttctaaatt

SEQ ID NO: 313361 - DNA, 25 bp, Mus musculus
cagagttaagtgtgttttctaaatt

SEQ ID NO: 313362 - DNA, 25 bp, Mus musculus
cagagttaatggatgtgactggctt

SEQ ID NO: 313363 - DNA, 25 bp, Mus musculus
cagagttaatggttgtgactggctt

SEQ ID NO: 313364 - DNA, 25 bp, Mus musculus
cagagttacatgactagcctgctcc

SEQ ID NO: 313365 - DNA, 25 bp, Mus musculus
cagagttacatgtctagcctgctcc

SEQ ID NO: 313366 - DNA, 25 bp, Mus musculus
cagagttactgcagtccgaggagga

SEQ ID NO: 313367 - DNA, 25 bp, Mus musculus
cagagttactgctgtccgaggagga

SEQ ID NO: 313368 - DNA, 25 bp, Mus musculus
cagagttactggcacatgggcgcaa

SEQ ID NO: 313369 - DNA, 25 bp, Mus musculus
cagagttactgggacatgggcgcaa

SEQ ID NO: 313370 - DNA, 25 bp, Mus musculus
cagagttagctcactgaggtctgct

SEQ ID NO: 313371 - DNA, 25 bp, Mus musculus
cagagttagctctctgaggtctgct

SEQ ID NO: 313372 - DNA, 25 bp, Mus musculus
cagagttattaccaatctactttaa

SEQ ID NO: 313373 - DNA, 25 bp, Mus musculus
cagagttattacgaatctactttaa

SEQ ID NO: 313374 - DNA, 25 bp, Mus musculus
cagagttcaaatcccagcaaccaca

SEQ ID NO: 313375 - DNA, 25 bp, Mus musculus
cagagttcaaatgccagcaaccaca

SEQ ID NO: 313376 - DNA, 25 bp, Mus musculus
cagagttcaacactagcctgttcta

SEQ ID NO: 313377 - DNA, 25 bp, Mus musculus
cagagttcaacagtagcctgttcta

SEQ ID NO: 313378 - DNA, 25 bp, Mus musculus
cagagttcaactcacagcctcgaaa

SEQ ID NO: 313379 - DNA, 25 bp, Mus musculus
cagagttcaactgacagcctcgaaa

SEQ ID NO: 313380 - DNA, 25 bp, Mus musculus
cagagttcaagaacctgtcactgca

SEQ ID NO: 313381 - DNA, 25 bp, Mus musculus
cagagttcaagatcctgtcactgca

SEQ ID NO: 313382 - DNA, 25 bp, Mus musculus
cagagttcagaacaagtccactttc

SEQ ID NO: 313383 - DNA, 25 bp, Mus musculus
cagagttcagaagaagtccactttc

SEQ ID NO: 313384 - DNA, 25 bp, Mus musculus
cagagttcagtcatgatgtgttcta

SEQ ID NO: 313385 - DNA, 25 bp, Mus musculus
cagagttcagtcttgatgtgttcta

SEQ ID NO: 313386 - DNA, 25 bp, Mus musculus
cagagttcagtgatcccaggaggga

SEQ ID NO: 313387 - DNA, 25 bp, Mus musculus
cagagttcagtgttcccaggaggga

SEQ ID NO: 313388 - DNA, 25 bp, Mus musculus
cagagttcagttccctgcatatctg

SEQ ID NO: 313389 - DNA, 25 bp, Mus musculus
cagagttcagttgcctgcatatctg

SEQ ID NO: 313390 - DNA, 25 bp, Mus musculus
cagagttccacgaaaacctgaggtt

SEQ ID NO: 313391 - DNA, 25 bp, Mus musculus
cagagttccacgtaaacctgaggtt

SEQ ID NO: 313392 - DNA, 25 bp, Mus musculus
cagagttccccaactggtacatcag

SEQ ID NO: 313393 - DNA, 25 bp, Mus musculus
cagagttccccatctggtacatcag

SEQ ID NO: 313394 - DNA, 25 bp, Mus musculus
cagagttccctgaggaggctgcagc

SEQ ID NO: 313395 - DNA, 25 bp, Mus musculus
cagagttccctgtggaggctgcagc

SEQ ID NO: 313396 - DNA, 25 bp, Mus musculus
cagagttctcagcactgtggataaa

SEQ ID NO: 313397 - DNA, 25 bp, Mus musculus
cagagttctcaggactgtggataaa

SEQ ID NO: 313398 - DNA, 25 bp, Mus musculus
cagagttctggcctcttctagaaca

SEQ ID NO: 313399 - DNA, 25 bp, Mus musculus
cagagttctggcgtcttctagaaca

SEQ ID NO: 313400 - DNA, 25 bp, Mus musculus
cagagttcttaacatgcccatgcgt

SEQ ID NO: 313401 - DNA, 25 bp, Mus musculus
cagagttcttaactggcccagttgt

SEQ ID NO: 313402 - DNA, 25 bp, Mus musculus
cagagttcttaagatgcccatgcgt

SEQ ID NO: 313403 - DNA, 25 bp, Mus musculus
cagagttcttaagtggcccagttgt

SEQ ID NO: 313404 - DNA, 25 bp, Mus musculus
cagagttgacatagcacttgctata

SEQ ID NO: 313405 - DNA, 25 bp, Mus musculus
cagagttgacattgcacttgctata

SEQ ID NO: 313406 - DNA, 25 bp, Mus musculus
cagagttgagtgctgccgagtatca

SEQ ID NO: 313407 - DNA, 25 bp, Mus musculus
cagagttgagtggtgccgagtatca

SEQ ID NO: 313408 - DNA, 25 bp, Mus musculus
cagagttgcacccagctagctaata

SEQ ID NO: 313409 - DNA, 25 bp, Mus musculus
cagagttgcaccgagctagctaata

SEQ ID NO: 313410 - DNA, 25 bp, Mus musculus
cagagttggtggctacgatgctcaa

SEQ ID NO: 313411 - DNA, 25 bp, Mus musculus
cagagttggtgggtacgatgctcaa

SEQ ID NO: 313412 - DNA, 25 bp, Mus musculus
cagagttggttccttgttgtgcttc

SEQ ID NO: 313413 - DNA, 25 bp, Mus musculus
cagagttggttcgttgttgtgcttc

SEQ ID NO: 313414 - DNA, 25 bp, Mus musculus
cagagttgtaatcttttcttggttt

SEQ ID NO: 313415 - DNA, 25 bp, Mus musculus
cagagttgtaatgttttcttggttt

SEQ ID NO: 313416 - DNA, 25 bp, Mus musculus
cagagttgttggacggtggctatca

SEQ ID NO: 313417 - DNA, 25 bp, Mus musculus
cagagttgttggtcggtggctatca

SEQ ID NO: 313418 - DNA, 25 bp, Mus musculus
cagagtttacttcccctaacactgc

SEQ ID NO: 313419 - DNA, 25 bp, Mus musculus
cagagtttacttcccgaggtagagc

SEQ ID NO: 313420 - DNA, 25 bp, Mus musculus
cagagtttacttctggcttagacct

SEQ ID NO: 313421 - DNA, 25 bp, Mus musculus
cagagtttacttgccctaacactgc

SEQ ID NO: 313422 - DNA, 25 bp, Mus musculus
cagagtttacttgccgaggtagagc

SEQ ID NO: 313423 - DNA, 25 bp, Mus musculus
cagagtttacttgtggcttagacct

SEQ ID NO: 313424 - DNA, 25 bp, Mus musculus
cagagtttatcacctgcttattaaa

SEQ ID NO: 313425 - DNA, 25 bp, Mus musculus
cagagtttatcacttgccttgacct

SEQ ID NO: 313426 - DNA, 25 bp, Mus musculus
cagagtttatcagctgcttattaaa

SEQ ID NO: 313427 - DNA, 25 bp, Mus musculus
cagagtttatcagttgccttgacct

SEQ ID NO: 313428 - DNA, 25 bp, Mus musculus
cagagtttatttccgggctgctcgc

SEQ ID NO: 313429 - DNA, 25 bp, Mus musculus
cagagtttatttgcgggctgctcgc

SEQ ID NO: 313430 - DNA, 25 bp, Mus musculus
cagagtttcaggaagtgtggcagca

SEQ ID NO: 313431 - DNA, 25 bp, Mus musculus
cagagtttcaggtagtgtggcagca

SEQ ID NO: 313432 - DNA, 25 bp, Mus musculus
cagagtttcagtagagtttcacagc

SEQ ID NO: 313433 - DNA, 25 bp, Mus musculus
cagagtttcagttgagtttcacagc

SEQ ID NO: 313434 - DNA, 25 bp, Mus musculus
cagagtttccagaagggctcccaga

SEQ ID NO: 313435 - DNA, 25 bp, Mus musculus
cagagtttccagtagggctcccaga

SEQ ID NO: 313436 - DNA, 25 bp, Mus musculus
cagagtttcctcactgtctggatat

SEQ ID NO: 313437 - DNA, 25 bp, Mus musculus
cagagtttcctctctgtctggatat

SEQ ID NO: 313438 - DNA, 25 bp, Mus musculus
cagagtttcttgattgaaggtctat

SEQ ID NO: 313439 - DNA, 25 bp, Mus musculus
cagagtttcttgtttgaaggtctat

SEQ ID NO: 313440 - DNA, 25 bp, Mus musculus
cagagtttgagcatactgggcctta

SEQ ID NO: 313441 - DNA, 25 bp, Mus musculus
cagagtttgagcatacttccacctc

SEQ ID NO: 313442 - DNA, 25 bp, Mus musculus
cagagtttgagcttactgggcctta

SEQ ID NO: 313443 - DNA, 25 bp, Mus musculus
cagagtttgagcttacttccacctc

SEQ ID NO: 313444 - DNA, 25 bp, Mus musculus
cagagtttgccccaatcatgagcat

SEQ ID NO: 313445 - DNA, 25 bp, Mus musculus
cagagtttgcccgaatcatgagcat

SEQ ID NO: 313446 - DNA, 25 bp, Mus musculus
cagagtttgctacctttgccatagg

SEQ ID NO: 313447 - DNA, 25 bp, Mus musculus
cagagtttgctagctttgccatagg

SEQ ID NO: 313448 - DNA, 25 bp, Mus musculus
cagagtttgggtacgtgaacacagt

SEQ ID NO: 313449 - DNA, 25 bp, Mus musculus
cagagtttgggttcgtgaacacagt

SEQ ID NO: 313450 - DNA, 25 bp, Mus musculus
cagagtttggtcatcctggtgtaaa

SEQ ID NO: 313451 - DNA, 25 bp, Mus musculus
cagagtttggtcttcctggtgtaaa

SEQ ID NO: 313452 - DNA, 25 bp, Mus musculus
cagagtttgttgatagagcttcaga

SEQ ID NO: 313453 - DNA, 25 bp, Mus musculus
cagagtttgttgttagagcttcaga

SEQ ID NO: 313454 - DNA, 25 bp, Mus musculus
cagagtttgtttccggcagttcaca

SEQ ID NO: 313455 - DNA, 25 bp, Mus musculus
cagagtttgtttgcggcagttcaca

SEQ ID NO: 313456 - DNA, 25 bp, Mus musculus
cagagttttcagagttttctggttc

SEQ ID NO: 313457 - DNA, 25 bp, Mus musculus
cagagttttcagtgttttctggttc

SEQ ID NO: 313458 - DNA, 25 bp, Mus musculus
cagagttttctccagcagccgtcag

SEQ ID NO: 313459 - DNA, 25 bp, Mus musculus
cagagttttctcgagcagccgtcag

SEQ ID NO: 313460 - DNA, 25 bp, Mus musculus
cagagttttcttacgggacagggag

SEQ ID NO: 313461 - DNA, 25 bp, Mus musculus
cagagttttcttcgcattctggtgt

SEQ ID NO: 313462 - DNA, 25 bp, Mus musculus
cagagttttcttggcattctggtgt

SEQ ID NO: 313463 - DNA, 25 bp, Mus musculus
cagagttttctttcgggacagggag

SEQ ID NO: 313464 - DNA, 25 bp, Mus musculus
cagagtttttggctgagtgaatata

SEQ ID NO: 313465 - DNA, 25 bp, Mus musculus
cagagtttttgggtgagtgaatata

SEQ ID NO: 313466 - DNA, 25 bp, Mus musculus
cagataaagaccactgtgaagcgaa

SEQ ID NO: 313467 - DNA, 25 bp, Mus musculus
cagataaagacctctgtgaagcgaa

SEQ ID NO: 313468 - DNA, 25 bp, Mus musculus
cagataaatattaacaccgcctttt

SEQ ID NO: 313469 - DNA, 25 bp, Mus musculus
cagataaatatttacaccgcctttt

SEQ ID NO: 313470 - DNA, 25 bp, Mus musculus
cagataaatcataggccctggccat

SEQ ID NO: 313471 - DNA, 25 bp, Mus musculus
cagataaatcattggccctggccat

SEQ ID NO: 313472 - DNA, 25 bp, Mus musculus
cagataacctgaactaccaagtggc

SEQ ID NO: 313473 - DNA, 25 bp, Mus musculus
cagataacctgatctaccaagtggc

SEQ ID NO: 313474 - DNA, 25 bp, Mus musculus
cagataactggtacggacacggact

SEQ ID NO: 313475 - DNA, 25 bp, Mus musculus
cagataactggttcggacacggact

SEQ ID NO: 313476 - DNA, 25 bp, Mus musculus
cagataagaatcatcctccccagtt

SEQ ID NO: 313477 - DNA, 25 bp, Mus musculus
cagataagaatcttcctccccagtt

SEQ ID NO: 313478 - DNA, 25 bp, Mus musculus
cagataagccttacctacagggctg

SEQ ID NO: 313479 - DNA, 25 bp, Mus musculus
cagataagcctttcctacagggctg

SEQ ID NO: 313480 - DNA, 25 bp, Mus musculus
cagataaggctccagtcacctgctg

SEQ ID NO: 313481 - DNA, 25 bp, Mus musculus
cagataaggctcgagtcacctgctg

SEQ ID NO: 313482 - DNA, 25 bp, Mus musculus
cagataataatccttacttcccttt

SEQ ID NO: 313483 - DNA, 25 bp, Mus musculus
cagataataatcgttacttcccttt

SEQ ID NO: 313484 - DNA, 25 bp, Mus musculus
cagataatacccatagatcaactat

SEQ ID NO: 313485 - DNA, 25 bp, Mus musculus
cagataatacccttagatcaactat

SEQ ID NO: 313486 - DNA, 25 bp, Mus musculus
cagataatggtcctgactgactgcc

SEQ ID NO: 313487 - DNA, 25 bp, Mus musculus
cagataatggtcgtgactgactgcc

SEQ ID NO: 313488 - DNA, 25 bp, Mus musculus
cagatacaggagcatagcgtgtcta

SEQ ID NO: 313489 - DNA, 25 bp, Mus musculus
cagatacaggaggatagcgtgtcta

SEQ ID NO: 313490 - DNA, 25 bp, Mus musculus
cagatacatagcaatcctttccagt

SEQ ID NO: 313491 - DNA, 25 bp, Mus musculus
cagatacatagctatcctttccagt

SEQ ID NO: 313492 - DNA, 25 bp, Mus musculus
cagatacatttaaaggattccatga

SEQ ID NO: 313493 - DNA, 25 bp, Mus musculus
cagatacatttataggattccatga

SEQ ID NO: 313494 - DNA, 25 bp, Mus musculus
cagataccaatgatgttggcactca

SEQ ID NO: 313495 - DNA, 25 bp, Mus musculus
cagataccaatgttgttggcactca

SEQ ID NO: 313496 - DNA, 25 bp, Mus musculus
cagataccagtgaagtgcatatggt

SEQ ID NO: 313497 - DNA, 25 bp, Mus musculus
cagataccagtgtagtgcatatggt

SEQ ID NO: 313498 - DNA, 25 bp, Mus musculus
cagataccatctcggccagcacgga

SEQ ID NO: 313499 - DNA, 25 bp, Mus musculus
cagataccatctgggccagcacgga

SEQ ID NO: 313500 - DNA, 25 bp, Mus musculus
cagatacccctccaactttgtttga

SEQ ID NO: 313501 - DNA, 25 bp, Mus musculus
cagatacccctcgaactttgtttga

SEQ ID NO: 313502 - DNA, 25 bp, Mus musculus
cagatacctgaaattttatgaaaat

SEQ ID NO: 313503 - DNA, 25 bp, Mus musculus
cagatacctgaatttttatgaaaat

SEQ ID NO: 313504 - DNA, 25 bp, Mus musculus
cagatacctggcagagagcgcagat

SEQ ID NO: 313505 - DNA, 25 bp, Mus musculus
cagatacctggctgagagcgcagat

SEQ ID NO: 313506 - DNA, 25 bp, Mus musculus
cagataccttgtcgttttgtattac

SEQ ID NO: 313507 - DNA, 25 bp, Mus musculus
cagataccttgtggttttgtattac

SEQ ID NO: 313508 - DNA, 25 bp, Mus musculus
cagatacggaaaacaatctcagtcc

SEQ ID NO: 313509 - DNA, 25 bp, Mus musculus
cagatacggaaatcaatctcagtcc

SEQ ID NO: 313510 - DNA, 25 bp, Mus musculus
cagatacgtggtacattctcaggac

SEQ ID NO: 313511 - DNA, 25 bp, Mus musculus
cagatacgtggttcattctcaggac

SEQ ID NO: 313512 - DNA, 25 bp, Mus musculus
cagatacgttgtcgttttgtattac

SEQ ID NO: 313513 - DNA, 25 bp, Mus musculus
cagatacgttgtggttttgtattac

SEQ ID NO: 313514 - DNA, 25 bp, Mus musculus
cagatactcaagacaaactgtgaag

SEQ ID NO: 313515 - DNA, 25 bp, Mus musculus
cagatactcaagtcaaactgtgaag

SEQ ID NO: 313516 - DNA, 25 bp, Mus musculus
cagatactccaaagagggcgtcaga

SEQ ID NO: 313517 - DNA, 25 bp, Mus musculus
cagatactccaatgagggcgtcaga

SEQ ID NO: 313518 - DNA, 25 bp, Mus musculus
cagatactcttgagctgtgcagcag

SEQ ID NO: 313519 - DNA, 25 bp, Mus musculus
cagatactcttgtgctgtgcagcag

SEQ ID NO: 313520 - DNA, 25 bp, Mus musculus
cagatactgtatacctcttggaggg

SEQ ID NO: 313521 - DNA, 25 bp, Mus musculus
cagatactgtattcctcttggaggg

SEQ ID NO: 313522 - DNA, 25 bp, Mus musculus
cagatacttaagatcgtgggtactt

SEQ ID NO: 313523 - DNA, 25 bp, Mus musculus
cagatacttaagttcgtgggtactt

SEQ ID NO: 313524 - DNA, 25 bp, Mus musculus
cagatacttcagctgtgagtgaaag

SEQ ID NO: 313525 - DNA, 25 bp, Mus musculus
cagatacttcaggtgtgagtgaaag

SEQ ID NO: 313526 - DNA, 25 bp, Mus musculus
cagatagaatctcatgacgctgtat

SEQ ID NO: 313527 - DNA, 25 bp, Mus musculus
cagatagaatctgatgacgctgtat

SEQ ID NO: 313528 - DNA, 25 bp, Mus musculus
cagatagacaatctcctgttgcctc

SEQ ID NO: 313529 - DNA, 25 bp, Mus musculus
cagatagacaatgtcctgttgcctc

SEQ ID NO: 313530 - DNA, 25 bp, Mus musculus
cagatagaccttaaagccttagaat

SEQ ID NO: 313531 - DNA, 25 bp, Mus musculus
cagatagacctttaagccttagaat

SEQ ID NO: 313532 - DNA, 25 bp, Mus musculus
cagatagacgtccagtgtcaggagc

SEQ ID NO: 313533 - DNA, 25 bp, Mus musculus
cagatagacgtcgagtgtcaggagc

SEQ ID NO: 313534 - DNA, 25 bp, Mus musculus
cagatagagtcaattgccaacaaac

SEQ ID NO: 313535 - DNA, 25 bp, Mus musculus
cagatagagtcatttgccaacaaac

SEQ ID NO: 313536 - DNA, 25 bp, Mus musculus
cagatagccaaactcctggacctaa

SEQ ID NO: 313537 - DNA, 25 bp, Mus musculus
cagatagccaaagtcctggacctaa

SEQ ID NO: 313538 - DNA, 25 bp, Mus musculus
cagatagccagcatcaggttcagtg

SEQ ID NO: 313539 - DNA, 25 bp, Mus musculus
cagatagccagcttcaggttcagtg

SEQ ID NO: 313540 - DNA, 25 bp, Mus musculus
cagatagctgaactcgctgtggcca

SEQ ID NO: 313541 - DNA, 25 bp, Mus musculus
cagatagctgaagtcgctgtggcca

SEQ ID NO: 313542 - DNA, 25 bp, Mus musculus
cagataggattgagggccatcggaa

SEQ ID NO: 313543 - DNA, 25 bp, Mus musculus
cagataggattgtgggccatcggaa

SEQ ID NO: 313544 - DNA, 25 bp, Mus musculus
cagataggcccactgaggcacctga

SEQ ID NO: 313545 - DNA, 25 bp, Mus musculus
cagataggcccagtgaggcacctga

SEQ ID NO: 313546 - DNA, 25 bp, Mus musculus
cagataggcctcactgtacatcagg

SEQ ID NO: 313547 - DNA, 25 bp, Mus musculus
cagataggcctctctgtacatcagg

SEQ ID NO: 313548 - DNA, 25 bp, Mus musculus
cagataggttttctacattgcagac

SEQ ID NO: 313549 - DNA, 25 bp, Mus musculus
cagataggttttgtacattgcagac

SEQ ID NO: 313550 - DNA, 25 bp, Mus musculus
cagatagtactgaactgagtgctct

SEQ ID NO: 313551 - DNA, 25 bp, Mus musculus
cagatagtactgtactgagtgctct

SEQ ID NO: 313552 - DNA, 25 bp, Mus musculus
cagatagtcactcggattccttcag

SEQ ID NO: 313553 - DNA, 25 bp, Mus musculus
cagatagtcactgggattccttcag

SEQ ID NO: 313554 - DNA, 25 bp, Mus musculus
cagatagttttcacacagggcggta

SEQ ID NO: 313555 - DNA, 25 bp, Mus musculus
cagatagttttctcacagggcggta

SEQ ID NO: 313556 - DNA, 25 bp, Mus musculus
cagatatacacacctctcacataca

SEQ ID NO: 313557 - DNA, 25 bp, Mus musculus
cagatatacacagctctcacataca

SEQ ID NO: 313558 - DNA, 25 bp, Mus musculus
cagatatacagtcagcacgtggctc

SEQ ID NO: 313559 - DNA, 25 bp, Mus musculus
cagatatacagtgagcacgtggctc

SEQ ID NO: 313560 - DNA, 25 bp, Mus musculus
cagatatacctgagactagatgtca

SEQ ID NO: 313561 - DNA, 25 bp, Mus musculus
cagatatacctgtgactagatgtca

SEQ ID NO: 313562 - DNA, 25 bp, Mus musculus
cagatatattctcttcttaacttta

SEQ ID NO: 313563 - DNA, 25 bp, Mus musculus
cagatatattctgttcttaacttta

SEQ ID NO: 313564 - DNA, 25 bp, Mus musculus
cagatatctcttatggttccgaata

SEQ ID NO: 313565 - DNA, 25 bp, Mus musculus
cagatatctcttttggttccgaata

SEQ ID NO: 313566 - DNA, 25 bp, Mus musculus
cagatatgcataatccctccagatg

SEQ ID NO: 313567 - DNA, 25 bp, Mus musculus
cagatatgcatattccctccagatg

SEQ ID NO: 313568 - DNA, 25 bp, Mus musculus
cagatatggtgcctggtatgtagta

SEQ ID NO: 313569 - DNA, 25 bp, Mus musculus
cagatatggtgcgtggtatgtagta

SEQ ID NO: 313570 - DNA, 25 bp, Mus musculus
cagatatgtactatgccagcagcgg

SEQ ID NO: 313571 - DNA, 25 bp, Mus musculus
cagatatgtactttgccagcagcgg

SEQ ID NO: 313572 - DNA, 25 bp, Mus musculus
cagatattctagcttccagagggaa

SEQ ID NO: 313573 - DNA, 25 bp, Mus musculus
cagatattctaggttccagagggaa

SEQ ID NO: 313574 - DNA, 25 bp, Mus musculus
cagatattgaacaatttgtttctca

SEQ ID NO: 313575 - DNA, 25 bp, Mus musculus
cagatattgaactatttgtttctca

SEQ ID NO: 313576 - DNA, 25 bp, Mus musculus
cagatatttaatctcttctcaaagg

SEQ ID NO: 313577 - DNA, 25 bp, Mus musculus
cagatatttaatgtcttctcaaagg

SEQ ID NO: 313578 - DNA, 25 bp, Mus musculus
cagatatttcagatggctctcggta

SEQ ID NO: 313579 - DNA, 25 bp, Mus musculus
cagatatttcagttggctctcggta

SEQ ID NO: 313580 - DNA, 25 bp, Mus musculus
cagatatttgaacctgaccgtcttt

SEQ ID NO: 313581 - DNA, 25 bp, Mus musculus
cagatatttgaagctgaccgtcttt

SEQ ID NO: 313582 - DNA, 25 bp, Mus musculus
cagatcaacagtcctggcagcgacc

SEQ ID NO: 313583 - DNA, 25 bp, Mus musculus
cagatcaacagtgctggcagcgacc

SEQ ID NO: 313584 - DNA, 25 bp, Mus musculus
cagatcaaccccaagcaaaggctta

SEQ ID NO: 313585 - DNA, 25 bp, Mus musculus
cagatcaacccctagcaaaggctta

SEQ ID NO: 313586 - DNA, 25 bp, Mus musculus
cagatcaagggtccggtcactgctt

SEQ ID NO: 313587 - DNA, 25 bp, Mus musculus
cagatcaagggtgcggtcactgctt

SEQ ID NO: 313588 - DNA, 25 bp, Mus musculus
cagatcacaaagactacagcagtta

SEQ ID NO: 313589 - DNA, 25 bp, Mus musculus
cagatcacaaagtctacagcagtta

SEQ ID NO: 313590 - DNA, 25 bp, Mus musculus
cagatcacagctacagctcccatga

SEQ ID NO: 313591 - DNA, 25 bp, Mus musculus
cagatcacagcttcagctcccatga

SEQ ID NO: 313592 - DNA, 25 bp, Mus musculus
cagatcacatttatcggtggcttaa

SEQ ID NO: 313593 - DNA, 25 bp, Mus musculus
cagatcacatttttcggtggcttaa

SEQ ID NO: 313594 - DNA, 25 bp, Mus musculus
cagatcaccaggacccagtgggaag

SEQ ID NO: 313595 - DNA, 25 bp, Mus musculus
cagatcaccaggtcccagtgggaag

SEQ ID NO: 313596 - DNA, 25 bp, Mus musculus
cagatcaccttgaaagtaatttaca

SEQ ID NO: 313597 - DNA, 25 bp, Mus musculus
cagatcaccttgtaagtaatttaca

SEQ ID NO: 313598 - DNA, 25 bp, Mus musculus
cagatcacgctaagggcaggaggtt

SEQ ID NO: 313599 - DNA, 25 bp, Mus musculus
cagatcacgctatgggcaggaggtt

SEQ ID NO: 313600 - DNA, 25 bp, Mus musculus
cagatcactcttcatttcagcttaa

SEQ ID NO: 313601 - DNA, 25 bp, Mus musculus
cagatcactcttgatttcagcttaa

SEQ ID NO: 313602 - DNA, 25 bp, Mus musculus
cagatcactgtcatttaacatacat

SEQ ID NO: 313603 - DNA, 25 bp, Mus musculus
cagatcactgtcttttaacatacat

SEQ ID NO: 313604 - DNA, 25 bp, Mus musculus
cagatcagaagccattttcttccct

SEQ ID NO: 313605 - DNA, 25 bp, Mus musculus
cagatcagaagcgattttcttccct

SEQ ID NO: 313606 - DNA, 25 bp, Mus musculus
cagatcagactcaccaggcaaagat

SEQ ID NO: 313607 - DNA, 25 bp, Mus musculus
cagatcagactctccaggcaaagat

SEQ ID NO: 313608 - DNA, 25 bp, Mus musculus
cagatcagatcacagctacagctcc

SEQ ID NO: 313609 - DNA, 25 bp, Mus musculus
cagatcagatcagagctacagctcc

SEQ ID NO: 313610 - DNA, 25 bp, Mus musculus
cagatcagcaggacatccatcaaaa

SEQ ID NO: 313611 - DNA, 25 bp, Mus musculus
cagatcagcaggtcatccatcaaaa

SEQ ID NO: 313612 - DNA, 25 bp, Mus musculus
cagatcaggacccttaggaaatgtg

SEQ ID NO: 313613 - DNA, 25 bp, Mus musculus
cagatcaggaccgttaggaaatgtg

SEQ ID NO: 313614 - DNA, 25 bp, Mus musculus
cagatcaggatccttgcactttaaa

SEQ ID NO: 313615 - DNA, 25 bp, Mus musculus
cagatcaggatcgttgcactttaaa

SEQ ID NO: 313616 - DNA, 25 bp, Mus musculus
cagatcagggtgagcttggtgttca

SEQ ID NO: 313617 - DNA, 25 bp, Mus musculus
cagatcagggtgtgcttggtgttca

SEQ ID NO: 313618 - DNA, 25 bp, Mus musculus
cagatcatagtgcagccgcgtggcc

SEQ ID NO: 313619 - DNA, 25 bp, Mus musculus
cagatcatagtggagccgcgtggcc

SEQ ID NO: 313620 - DNA, 25 bp, Mus musculus
cagatcatcaacctcctcaacaagg

SEQ ID NO: 313621 - DNA, 25 bp, Mus musculus
cagatcatcaacgtcctcaacaagg

SEQ ID NO: 313622 - DNA, 25 bp, Mus musculus
cagatcatccatcactagctacatg

SEQ ID NO: 313623 - DNA, 25 bp, Mus musculus
cagatcatccatgactagctacatg

SEQ ID NO: 313624 - DNA, 25 bp, Mus musculus
cagatcatgctgattcccactttgg

SEQ ID NO: 313625 - DNA, 25 bp, Mus musculus
cagatcatgctgtttcccactttgg

SEQ ID NO: 313626 - DNA, 25 bp, Mus musculus
cagatcattcacacacgtatccatt

SEQ ID NO: 313627 - DNA, 25 bp, Mus musculus
cagatcattcactcacgtatccatt

SEQ ID NO: 313628 - DNA, 25 bp, Mus musculus
cagatccaaagcattcccatttgtt

SEQ ID NO: 313629 - DNA, 25 bp, Mus musculus
cagatccaaagctttcccatttgtt

SEQ ID NO: 313630 - DNA, 25 bp, Mus musculus
cagatccaaataatcctttctcagt

SEQ ID NO: 313631 - DNA, 25 bp, Mus musculus
cagatccaaatattcctttctcagt

SEQ ID NO: 313632 - DNA, 25 bp, Mus musculus
cagatccaccttatcaactttctaa

SEQ ID NO: 313633 - DNA, 25 bp, Mus musculus
cagatccaccttttcaactttctaa

SEQ ID NO: 313634 - DNA, 25 bp, Mus musculus
cagatccacttcagggcccaagtga

SEQ ID NO: 313635 - DNA, 25 bp, Mus musculus
cagatccacttctgggcccaagtga

SEQ ID NO: 313636 - DNA, 25 bp, Mus musculus
cagatccagcttcctccacaaaaaa

SEQ ID NO: 313637 - DNA, 25 bp, Mus musculus
cagatccagcttgctccacaaaaaa

SEQ ID NO: 313638 - DNA, 25 bp, Mus musculus
cagatccagtttagggaaaggattt

SEQ ID NO: 313639 - DNA, 25 bp, Mus musculus
cagatccagttttgggaaaggattt

SEQ ID NO: 313640 - DNA, 25 bp, Mus musculus
cagatccatagcaaatgtgtggagt

SEQ ID NO: 313641 - DNA, 25 bp, Mus musculus
cagatccatagctaatgtgtggagt

SEQ ID NO: 313642 - DNA, 25 bp, Mus musculus
cagatcccaaacctcactacagaaa

SEQ ID NO: 313643 - DNA, 25 bp, Mus musculus
cagatcccaaacgtcactacagaaa

SEQ ID NO: 313644 - DNA, 25 bp, Mus musculus
cagatccccacaccaagagcttggg

SEQ ID NO: 313645 - DNA, 25 bp, Mus musculus
cagatccccacagcaagagcttggg

SEQ ID NO: 313646 - DNA, 25 bp, Mus musculus
cagatccccatgctggcacagaagg

SEQ ID NO: 313647 - DNA, 25 bp, Mus musculus
cagatccccatggtggcacagaagg

SEQ ID NO: 313648 - DNA, 25 bp, Mus musculus
cagatcccctggagacgcctggtgt

SEQ ID NO: 313649 - DNA, 25 bp, Mus musculus
cagatcccctggtgacgcctggtgt

SEQ ID NO: 313650 - DNA, 25 bp, Mus musculus
cagatcccgataaatgcttgcaaaa

SEQ ID NO: 313651 - DNA, 25 bp, Mus musculus
cagatcccgatatatgcttgcaaaa

SEQ ID NO: 313652 - DNA, 25 bp, Mus musculus
cagatccctcctagtgagcagctgg

SEQ ID NO: 313653 - DNA, 25 bp, Mus musculus
cagatccctccttgtgagcagctgg

SEQ ID NO: 313654 - DNA, 25 bp, Mus musculus
cagatccctcgtcggccaatggtag

SEQ ID NO: 313655 - DNA, 25 bp, Mus musculus
cagatccctcgtgggccaatggtag

SEQ ID NO: 313656 - DNA, 25 bp, Mus musculus
cagatccctggaatagaaagcacat

SEQ ID NO: 313657 - DNA, 25 bp, Mus musculus
cagatccctggacgctggagagcca

SEQ ID NO: 313658 - DNA, 25 bp, Mus musculus
cagatccctggaggctggagagcca

SEQ ID NO: 313659 - DNA, 25 bp, Mus musculus
cagatccctggattagaaagcacat

SEQ ID NO: 313660 - DNA, 25 bp, Mus musculus
cagatccgccaactgctgtgaagat

SEQ ID NO: 313661 - DNA, 25 bp, Mus musculus
cagatccgccaagtgctgtgaagat

SEQ ID NO: 313662 - DNA, 25 bp, Mus musculus
cagatccggagcactcattatcacc

SEQ ID NO: 313663 - DNA, 25 bp, Mus musculus
cagatccggagctctcattatcacc

SEQ ID NO: 313664 - DNA, 25 bp, Mus musculus
cagatccggcagaggttcattgagt

SEQ ID NO: 313665 - DNA, 25 bp, Mus musculus
cagatccggcagtggttcattgagt

SEQ ID NO: 313666 - DNA, 25 bp, Mus musculus
cagatcctaaggaacaaccccaagg

SEQ ID NO: 313667 - DNA, 25 bp, Mus musculus
cagatcctaaggtacaaccccaagg

SEQ ID NO: 313668 - DNA, 25 bp, Mus musculus
cagatcctcaataacctaagcaaga

SEQ ID NO: 313669 - DNA, 25 bp, Mus musculus
cagatcctcaattacctaagcaaga

SEQ ID NO: 313670 - DNA, 25 bp, Mus musculus
cagatcctcaggattgtgttgcaag

SEQ ID NO: 313671 - DNA, 25 bp, Mus musculus
cagatcctcaggtttgtgttgcaag

SEQ ID NO: 313672 - DNA, 25 bp, Mus musculus
cagatcctcccgagattgagatcaa

SEQ ID NO: 313673 - DNA, 25 bp, Mus musculus
cagatcctcccgtgattgagatcaa

SEQ ID NO: 313674 - DNA, 25 bp, Mus musculus
cagatcctcctaaaagccacaaagt

SEQ ID NO: 313675 - DNA, 25 bp, Mus musculus
cagatcctcctataagccacaaagt

SEQ ID NO: 313676 - DNA, 25 bp, Mus musculus
cagatcctctttaggctgctgaaaa

SEQ ID NO: 313677 - DNA, 25 bp, Mus musculus
cagatcctcttttggctgctgaaaa

SEQ ID NO: 313678 - DNA, 25 bp, Mus musculus
cagatcctgctcatctctgactact

SEQ ID NO: 313679 - DNA, 25 bp, Mus musculus
cagatcctgctcttctctgactact

SEQ ID NO: 313680 - DNA, 25 bp, Mus musculus
cagatcctggttatatttgactttt

SEQ ID NO: 313681 - DNA, 25 bp, Mus musculus
cagatcctggttcgcagatgtggct

SEQ ID NO: 313682 - DNA, 25 bp, Mus musculus
cagatcctggttggcagatgtggct

SEQ ID NO: 313683 - DNA, 25 bp, Mus musculus
cagatcctggttttatttgactttt

SEQ ID NO: 313684 - DNA, 25 bp, Mus musculus
cagatcctgtagatacctatttata

SEQ ID NO: 313685 - DNA, 25 bp, Mus musculus
cagatcctgtagttacctatttata

SEQ ID NO: 313686 - DNA, 25 bp, Mus musculus
cagatcctgtcaatttcatgtgacc

SEQ ID NO: 313687 - DNA, 25 bp, Mus musculus
cagatcctgtcattttcatgtgacc

SEQ ID NO: 313688 - DNA, 25 bp, Mus musculus
cagatccttaagaattccttcattg

SEQ ID NO: 313689 - DNA, 25 bp, Mus musculus
cagatccttaagtattccttcattg

SEQ ID NO: 313690 - DNA, 25 bp, Mus musculus
cagatccttcaaccgggcttcagca

SEQ ID NO: 313691 - DNA, 25 bp, Mus musculus
cagatccttcaagcgggcttcagca

SEQ ID NO: 313692 - DNA, 25 bp, Mus musculus
cagatcgagtggatccgtgcaggca

SEQ ID NO: 313693 - DNA, 25 bp, Mus musculus
cagatcgagtggttccgtgcaggca

SEQ ID NO: 313694 - DNA, 25 bp, Mus musculus
cagatcgctcagatcctggaaggtg

SEQ ID NO: 313695 - DNA, 25 bp, Mus musculus
cagatcgctcagttcctggaaggtg

SEQ ID NO: 313696 - DNA, 25 bp, Mus musculus
cagatcggttctcattttccatgaa

SEQ ID NO: 313697 - DNA, 25 bp, Mus musculus
cagatcggttctgattttccatgaa

SEQ ID NO: 313698 - DNA, 25 bp, Mus musculus
cagatcgtattgcatgtgcctgtaa

SEQ ID NO: 313699 - DNA, 25 bp, Mus musculus
cagatcgtattggatgtgcctgtaa

SEQ ID NO: 313700 - DNA, 25 bp, Mus musculus
cagatcgtgacaatgtgggccagaa

SEQ ID NO: 313701 - DNA, 25 bp, Mus musculus
cagatcgtgacattgtgggccagaa

SEQ ID NO: 313702 - DNA, 25 bp, Mus musculus
cagatctagatgagagccaggccac

SEQ ID NO: 313703 - DNA, 25 bp, Mus musculus
cagatctagatgtgagccaggccac

SEQ ID NO: 313704 - DNA, 25 bp, Mus musculus
cagatctcagctcgtgaacactaaa

SEQ ID NO: 313705 - DNA, 25 bp, Mus musculus
cagatctcagctggtgaacactaaa

SEQ ID NO: 313706 - DNA, 25 bp, Mus musculus
cagatctcgctcacgtacataagat

SEQ ID NO: 313707 - DNA, 25 bp, Mus musculus
cagatctcgctctcgtacataagat

SEQ ID NO: 313708 - DNA, 25 bp, Mus musculus
cagatctctagaagtgtcagcggga

SEQ ID NO: 313709 - DNA, 25 bp, Mus musculus
cagatctctagatgtgtcagcggga

SEQ ID NO: 313710 - DNA, 25 bp, Mus musculus
cagatctcttcaaggcaagcagggc

SEQ ID NO: 313711 - DNA, 25 bp, Mus musculus
cagatctcttcatggcaagcagggc

SEQ ID NO: 313712 - DNA, 25 bp, Mus musculus
cagatctgagtaaccttgcttaggg

SEQ ID NO: 313713 - DNA, 25 bp, Mus musculus
cagatctgagtatccttgcttaggg

SEQ ID NO: 313714 - DNA, 25 bp, Mus musculus
cagatctgcattcgctcactggtgc

SEQ ID NO: 313715 - DNA, 25 bp, Mus musculus
cagatctgcattggctcactggtgc

SEQ ID NO: 313716 - DNA, 25 bp, Mus musculus
cagatctgccgtcgaattggtatcg

SEQ ID NO: 313717 - DNA, 25 bp, Mus musculus
cagatctgccgtggaattggtatcg

SEQ ID NO: 313718 - DNA, 25 bp, Mus musculus
cagatctgctggctgacacagtaat

SEQ ID NO: 313719 - DNA, 25 bp, Mus musculus
cagatctgctgggtgacacagtaat

SEQ ID NO: 313720 - DNA, 25 bp, Mus musculus
cagatctggagacccctcatgcttc

SEQ ID NO: 313721 - DNA, 25 bp, Mus musculus
cagatctggagagccctcatgcttc

SEQ ID NO: 313722 - DNA, 25 bp, Mus musculus
cagatctggcacaagaaatgaggca

SEQ ID NO: 313723 - DNA, 25 bp, Mus musculus
cagatctggcactagaaatgaggca

SEQ ID NO: 313724 - DNA, 25 bp, Mus musculus
cagatctgtcatcgccacttaagtg

SEQ ID NO: 313725 - DNA, 25 bp, Mus musculus
cagatctgtcatggccacttaagtg

SEQ ID NO: 313726 - DNA, 25 bp, Mus musculus
cagatctgtccaattttctacaaac

SEQ ID NO: 313727 - DNA, 25 bp, Mus musculus
cagatctgtccatttttctacaaac

SEQ ID NO: 313728 - DNA, 25 bp, Mus musculus
cagatctgtgatccccggacaactg

SEQ ID NO: 313729 - DNA, 25 bp, Mus musculus
cagatctgtgatgcccggacaactg

SEQ ID NO: 313730 - DNA, 25 bp, Mus musculus
cagatctgttatctaccttgtttgt

SEQ ID NO: 313731 - DNA, 25 bp, Mus musculus
cagatctgttatgtaccttgtttgt

SEQ ID NO: 313732 - DNA, 25 bp, Mus musculus
cagatctgttgaccgaggcggttca

SEQ ID NO: 313733 - DNA, 25 bp, Mus musculus
cagatctgttgagcgaggcggttca

SEQ ID NO: 313734 - DNA, 25 bp, Mus musculus
cagatcttacttctttgacaacccc

SEQ ID NO: 313735 - DNA, 25 bp, Mus musculus
cagatcttacttgtttgacaacccc

SEQ ID NO: 313736 - DNA, 25 bp, Mus musculus
cagatcttcaccagcatccatgttc

SEQ ID NO: 313737 - DNA, 25 bp, Mus musculus
cagatcttcacctgcatccatgttc

SEQ ID NO: 313738 - DNA, 25 bp, Mus musculus
cagatcttctctcagcggcgcagta

SEQ ID NO: 313739 - DNA, 25 bp, Mus musculus
cagatcttctctgagcggcgcagta

SEQ ID NO: 313740 - DNA, 25 bp, Mus musculus
cagatcttgaggatgtttgatgctt

SEQ ID NO: 313741 - DNA, 25 bp, Mus musculus
cagatcttgaggttgtttgatgctt

SEQ ID NO: 313742 - DNA, 25 bp, Mus musculus
cagatctttagcagggacaactcca

SEQ ID NO: 313743 - DNA, 25 bp, Mus musculus
cagatctttagctgggacaactcca

SEQ ID NO: 313744 - DNA, 25 bp, Mus musculus
cagatctttctcataagccaaatgt

SEQ ID NO: 313745 - DNA, 25 bp, Mus musculus
cagatctttctcttaagccaaatgt

SEQ ID NO: 313746 - DNA, 25 bp, Mus musculus
cagatctttctgacatcgtacagga

SEQ ID NO: 313747 - DNA, 25 bp, Mus musculus
cagatctttctgtcatcgtacagga

SEQ ID NO: 313748 - DNA, 25 bp, Mus musculus
cagatcttttcactgtttttcttca

SEQ ID NO: 313749 - DNA, 25 bp, Mus musculus
cagatcttttcagtgtttttcttca

SEQ ID NO: 313750 - DNA, 25 bp, Mus musculus
cagatcttttgtcggttatatgcta

SEQ ID NO: 313751 - DNA, 25 bp, Mus musculus
cagatcttttgtgggttatatgcta

SEQ ID NO: 313752 - DNA, 25 bp, Mus musculus
cagatgaaattccagtccccggcca

SEQ ID NO: 313753 - DNA, 25 bp, Mus musculus
cagatgaaattcgagtccccggcca

SEQ ID NO: 313754 - DNA, 25 bp, Mus musculus
cagatgaagaaactgggctctccag

SEQ ID NO: 313755 - DNA, 25 bp, Mus musculus
cagatgaagaaagtgggctctccag

SEQ ID NO: 313756 - DNA, 25 bp, Mus musculus
cagatgaagggtatccaccaagggt

SEQ ID NO: 313757 - DNA, 25 bp, Mus musculus
cagatgaagggtttccaccaagggt

SEQ ID NO: 313758 - DNA, 25 bp, Mus musculus
cagatgaaggtgcactttttccgta

SEQ ID NO: 313759 - DNA, 25 bp, Mus musculus
cagatgaaggtggactttttccgta

SEQ ID NO: 313760 - DNA, 25 bp, Mus musculus
cagatgaagtgacctacgctggaga

SEQ ID NO: 313761 - DNA, 25 bp, Mus musculus
cagatgaagtgagctacgctggaga

SEQ ID NO: 313762 - DNA, 25 bp, Mus musculus
cagatgaatgcccacagaatcagtc

SEQ ID NO: 313763 - DNA, 25 bp, Mus musculus
cagatgaatgccgacagaatcagtc

SEQ ID NO: 313764 - DNA, 25 bp, Mus musculus
cagatgacacctcctgttttgtagt

SEQ ID NO: 313765 - DNA, 25 bp, Mus musculus
cagatgacacctgctgttttgtagt

SEQ ID NO: 313766 - DNA, 25 bp, Mus musculus
cagatgacagtgattactcagttac

SEQ ID NO: 313767 - DNA, 25 bp, Mus musculus
cagatgacagtgtttactcagttac

SEQ ID NO: 313768 - DNA, 25 bp, Mus musculus
cagatgactcggacagtgactctga

SEQ ID NO: 313769 - DNA, 25 bp, Mus musculus
cagatgactcggtcagtgactctga

SEQ ID NO: 313770 - DNA, 25 bp, Mus musculus
cagatgactcttctagatcacatta

SEQ ID NO: 313771 - DNA, 25 bp, Mus musculus
cagatgactcttgtagatcacatta

SEQ ID NO: 313772 - DNA, 25 bp, Mus musculus
cagatgactggacttcatttttaaa

SEQ ID NO: 313773 - DNA, 25 bp, Mus musculus
cagatgactggagttcatttttaaa

SEQ ID NO: 313774 - DNA, 25 bp, Mus musculus
cagatgactgtcatgccatgagaaa

SEQ ID NO: 313775 - DNA, 25 bp, Mus musculus
cagatgactgtcttgccatgagaaa

SEQ ID NO: 313776 - DNA, 25 bp, Mus musculus
cagatgacttcaatatcatcctata

SEQ ID NO: 313777 - DNA, 25 bp, Mus musculus
cagatgacttcattatcatcctata

SEQ ID NO: 313778 - DNA, 25 bp, Mus musculus
cagatgagaagacgtcatcacatcc

SEQ ID NO: 313779 - DNA, 25 bp, Mus musculus
cagatgagaagaggtcatcacatcc

SEQ ID NO: 313780 - DNA, 25 bp, Mus musculus
cagatgagactgaacttgcaaggca

SEQ ID NO: 313781 - DNA, 25 bp, Mus musculus
cagatgagactgtacttgcaaggca

SEQ ID NO: 313782 - DNA, 25 bp, Mus musculus
cagatgagagagacaaactgatttt

SEQ ID NO: 313783 - DNA, 25 bp, Mus musculus
cagatgagagagtcaaactgatttt

SEQ ID NO: 313784 - DNA, 25 bp, Mus musculus
cagatgagagctacctataggcaca

SEQ ID NO: 313785 - DNA, 25 bp, Mus musculus
cagatgagagcttcctataggcaca

SEQ ID NO: 313786 - DNA, 25 bp, Mus musculus
cagatgagcatcatgggtcctccat

SEQ ID NO: 313787 - DNA, 25 bp, Mus musculus
cagatgagcatcttgggtcctccat

SEQ ID NO: 313788 - DNA, 25 bp, Mus musculus
cagatgaggctgctgttctcagaga

SEQ ID NO: 313789 - DNA, 25 bp, Mus musculus
cagatgaggctggtgttctcagaga

SEQ ID NO: 313790 - DNA, 25 bp, Mus musculus
cagatgatccctaggagttcgtgat

SEQ ID NO: 313791 - DNA, 25 bp, Mus musculus
cagatgatcccttggagttcgtgat

SEQ ID NO: 313792 - DNA, 25 bp, Mus musculus
cagatgatcctcacgggccagaact

SEQ ID NO: 313793 - DNA, 25 bp, Mus musculus
cagatgatcctctcgggccagaact

SEQ ID NO: 313794 - DNA, 25 bp, Mus musculus
cagatgatgaacatcttcgtggaga

SEQ ID NO: 313795 - DNA, 25 bp, Mus musculus
cagatgatgaacttcttcgtggaga

SEQ ID NO: 313796 - DNA, 25 bp, Mus musculus
cagatgatgagcagctgtacctacc

SEQ ID NO: 313797 - DNA, 25 bp, Mus musculus
cagatgatgagctgctgtacctacc

SEQ ID NO: 313798 - DNA, 25 bp, Mus musculus
cagatgatggaaaggccgtggctac

SEQ ID NO: 313799 - DNA, 25 bp, Mus musculus
cagatgatggaatggccgtggctac

SEQ ID NO: 313800 - DNA, 25 bp, Mus musculus
cagatgattactcagcctagctgat

SEQ ID NO: 313801 - DNA, 25 bp, Mus musculus
cagatgattactgagcctagctgat

SEQ ID NO: 313802 - DNA, 25 bp, Mus musculus
cagatgattctaatctccgattggc

SEQ ID NO: 313803 - DNA, 25 bp, Mus musculus
cagatgattctattctccgattggc

SEQ ID NO: 313804 - DNA, 25 bp, Mus musculus
cagatgattttcacctggcttacat

SEQ ID NO: 313805 - DNA, 25 bp, Mus musculus
cagatgattttctcctggcttacat

SEQ ID NO: 313806 - DNA, 25 bp, Mus musculus
cagatgcaaggcctacacagtttgg

SEQ ID NO: 313807 - DNA, 25 bp, Mus musculus
cagatgcaaggcgtacacagtttgg

SEQ ID NO: 313808 - DNA, 25 bp, Mus musculus
cagatgcaccaacgccacgggcagt

SEQ ID NO: 313809 - DNA, 25 bp, Mus musculus
cagatgcaccaaggccacgggcagt

SEQ ID NO: 313810 - DNA, 25 bp, Mus musculus
cagatgcagatcaatgttagttcaa

SEQ ID NO: 313811 - DNA, 25 bp, Mus musculus
cagatgcagatctatgttagttcaa

SEQ ID NO: 313812 - DNA, 25 bp, Mus musculus
cagatgcagggcaacttcaagtcag

SEQ ID NO: 313813 - DNA, 25 bp, Mus musculus
cagatgcagggctacttcaagtcag

SEQ ID NO: 313814 - DNA, 25 bp, Mus musculus
cagatgcatgccctgtgttctaatg

SEQ ID NO: 313815 - DNA, 25 bp, Mus musculus
cagatgcatgccgtgtgttctaatg

SEQ ID NO: 313816 - DNA, 25 bp, Mus musculus
cagatgccactaccctcagagttca

SEQ ID NO: 313817 - DNA, 25 bp, Mus musculus
cagatgccactagcctcagagttca

SEQ ID NO: 313818 - DNA, 25 bp, Mus musculus
cagatgccaggaagcacttggagct

SEQ ID NO: 313819 - DNA, 25 bp, Mus musculus
cagatgccaggatgcacttggagct

SEQ ID NO: 313820 - DNA, 25 bp, Mus musculus
cagatgccaggtacagaacacagtt

SEQ ID NO: 313821 - DNA, 25 bp, Mus musculus
cagatgccaggttcagaacacagtt

SEQ ID NO: 313822 - DNA, 25 bp, Mus musculus
cagatgccatgaagcaggcgctgct

SEQ ID NO: 313823 - DNA, 25 bp, Mus musculus
cagatgccatgatgcaggcgctgct

SEQ ID NO: 313824 - DNA, 25 bp, Mus musculus
cagatgcccgtgaacaatgccatgt

SEQ ID NO: 313825 - DNA, 25 bp, Mus musculus
cagatgcccgtgtacaatgccatgt

SEQ ID NO: 313826 - DNA, 25 bp, Mus musculus
cagatgccctctcccgaatgtatct

SEQ ID NO: 313827 - DNA, 25 bp, Mus musculus
cagatgccctctgccgaatgtatct

SEQ ID NO: 313828 - DNA, 25 bp, Mus musculus
cagatgccgggtctattccttgtga

SEQ ID NO: 313829 - DNA, 25 bp, Mus musculus
cagatgccgggtgtattccttgtga

SEQ ID NO: 313830 - DNA, 25 bp, Mus musculus
cagatgcctcccctatcggagctgt

SEQ ID NO: 313831 - DNA, 25 bp, Mus musculus
cagatgcctcccgtatcggagctgt

SEQ ID NO: 313832 - DNA, 25 bp, Mus musculus
cagatgcctctaaaagccgcatgta

SEQ ID NO: 313833 - DNA, 25 bp, Mus musculus
cagatgcctctataagccgcatgta

SEQ ID NO: 313834 - DNA, 25 bp, Mus musculus
cagatgcctctcatccggaagaaga

SEQ ID NO: 313835 - DNA, 25 bp, Mus musculus
cagatgcctctccaaagtggttttt

SEQ ID NO: 313836 - DNA, 25 bp, Mus musculus
cagatgcctctcgaaagtggttttt

SEQ ID NO: 313837 - DNA, 25 bp, Mus musculus
cagatgcctctcttccggaagaaga

SEQ ID NO: 313838 - DNA, 25 bp, Mus musculus
cagatgcctgcactagtgacttaaa

SEQ ID NO: 313839 - DNA, 25 bp, Mus musculus
cagatgcctgcagtagtgacttaaa

SEQ ID NO: 313840 - DNA, 25 bp, Mus musculus
cagatgcgctgaatgtgacacagtt

SEQ ID NO: 313841 - DNA, 25 bp, Mus musculus
cagatgcgctgattgtgacacagtt

SEQ ID NO: 313842 - DNA, 25 bp, Mus musculus
cagatgcggcagacttctagggctc

SEQ ID NO: 313843 - DNA, 25 bp, Mus musculus
cagatgcggcagtcttctagggctc

SEQ ID NO: 313844 - DNA, 25 bp, Mus musculus
cagatgcgttctcttgttcttggga

SEQ ID NO: 313845 - DNA, 25 bp, Mus musculus
cagatgcgttctgttgttcttggga

SEQ ID NO: 313846 - DNA, 25 bp, Mus musculus
cagatgctactaaaattcaatggag

SEQ ID NO: 313847 - DNA, 25 bp, Mus musculus
cagatgctactataattcaatggag

SEQ ID NO: 313848 - DNA, 25 bp, Mus musculus
cagatgctactgaacttgaatggtt

SEQ ID NO: 313849 - DNA, 25 bp, Mus musculus
cagatgctactgtacttgaatggtt

SEQ ID NO: 313850 - DNA, 25 bp, Mus musculus
cagatgctatagatgtgttgacaca

SEQ ID NO: 313851 - DNA, 25 bp, Mus musculus
cagatgctatagttgtgttgacaca

SEQ ID NO: 313852 - DNA, 25 bp, Mus musculus
cagatgctcaaccgagctgtcttca

SEQ ID NO: 313853 - DNA, 25 bp, Mus musculus
cagatgctcaacggagctgtcttca

SEQ ID NO: 313854 - DNA, 25 bp, Mus musculus
cagatgctcctgctgtatacaccaa

SEQ ID NO: 313855 - DNA, 25 bp, Mus musculus
cagatgctcctggtgtatacaccaa

SEQ ID NO: 313856 - DNA, 25 bp, Mus musculus
cagatgctgctgacatctcacagaa

SEQ ID NO: 313857 - DNA, 25 bp, Mus musculus
cagatgctgctgctaacagtggcaa

SEQ ID NO: 313858 - DNA, 25 bp, Mus musculus
cagatgctgctgctatagagcctaa

SEQ ID NO: 313859 - DNA, 25 bp, Mus musculus
cagatgctgctggtaacagtggcaa

SEQ ID NO: 313860 - DNA, 25 bp, Mus musculus
cagatgctgctggtatagagcctaa

SEQ ID NO: 313861 - DNA, 25 bp, Mus musculus
cagatgctgctgtcatctcacagaa

SEQ ID NO: 313862 - DNA, 25 bp, Mus musculus
cagatgctggaaacgcctccacggg

SEQ ID NO: 313863 - DNA, 25 bp, Mus musculus
cagatgctggaatcgcctccacggg

SEQ ID NO: 313864 - DNA, 25 bp, Mus musculus
cagatgctggcgactgctttgcttg

SEQ ID NO: 313865 - DNA, 25 bp, Mus musculus
cagatgctggcgtctgctttgcttg

SEQ ID NO: 313866 - DNA, 25 bp, Mus musculus
cagatgctgtcgcaagtgtgctcac

SEQ ID NO: 313867 - DNA, 25 bp, Mus musculus
cagatgctgtcggaagtgtgctcac

SEQ ID NO: 313868 - DNA, 25 bp, Mus musculus
cagatgcttccacggtcgtcctgaa

SEQ ID NO: 313869 - DNA, 25 bp, Mus musculus
cagatgcttccagggtcgtcctgaa

SEQ ID NO: 313870 - DNA, 25 bp, Mus musculus
cagatgcttcgaccgttgaagacaa

SEQ ID NO: 313871 - DNA, 25 bp, Mus musculus
cagatgcttcgagcgttgaagacaa

SEQ ID NO: 313872 - DNA, 25 bp, Mus musculus
cagatgctttagatgccatatttta

SEQ ID NO: 313873 - DNA, 25 bp, Mus musculus
cagatgctttagttgccatatttta

SEQ ID NO: 313874 - DNA, 25 bp, Mus musculus
cagatgctttgtctgatattttcat

SEQ ID NO: 313875 - DNA, 25 bp, Mus musculus
cagatgctttgtgtgatattttcat

SEQ ID NO: 313876 - DNA, 25 bp, Mus musculus
cagatggaaaagcacccttcgctct

SEQ ID NO: 313877 - DNA, 25 bp, Mus musculus
cagatggaaaaggacccttcgctct

SEQ ID NO: 313878 - DNA, 25 bp, Mus musculus
cagatggaacatcgcccagggacag

SEQ ID NO: 313879 - DNA, 25 bp, Mus musculus
cagatggaacatggcccagggacag

SEQ ID NO: 313880 - DNA, 25 bp, Mus musculus
cagatggaacttctcaggccggtga

SEQ ID NO: 313881 - DNA, 25 bp, Mus musculus
cagatggaacttgtcaggccggtga

SEQ ID NO: 313882 - DNA, 25 bp, Mus musculus
cagatggattgcagagttccggacc

SEQ ID NO: 313883 - DNA, 25 bp, Mus musculus
cagatggattgctgagttccggacc

SEQ ID NO: 313884 - DNA, 25 bp, Mus musculus
cagatggcaagacgcgggcacaaga

SEQ ID NO: 313885 - DNA, 25 bp, Mus musculus
cagatggcaagaggcgggcacaaga

SEQ ID NO: 313886 - DNA, 25 bp, Mus musculus
cagatggcagccagtcagttgtgga

SEQ ID NO: 313887 - DNA, 25 bp, Mus musculus
cagatggcagcctgtcagttgtgga

SEQ ID NO: 313888 - DNA, 25 bp, Mus musculus
cagatggcatacatctctacacaaa

SEQ ID NO: 313889 - DNA, 25 bp, Mus musculus
cagatggcatacttctctacacaaa

SEQ ID NO: 313890 - DNA, 25 bp, Mus musculus
cagatggcatgccttcccctggagg

SEQ ID NO: 313891 - DNA, 25 bp, Mus musculus
cagatggcatgcgttcccctggagg

SEQ ID NO: 313892 - DNA, 25 bp, Mus musculus
cagatggccgaacagtccacactgt

SEQ ID NO: 313893 - DNA, 25 bp, Mus musculus
cagatggccgaagagtccacactgt

SEQ ID NO: 313894 - DNA, 25 bp, Mus musculus
cagatggcgcggcaactgaaaatcc

SEQ ID NO: 313895 - DNA, 25 bp, Mus musculus
cagatggcgcgggaactgaaaatcc

SEQ ID NO: 313896 - DNA, 25 bp, Mus musculus
cagatggcggccatacctatagact

SEQ ID NO: 313897 - DNA, 25 bp, Mus musculus
cagatggcggccttacctatagact

SEQ ID NO: 313898 - DNA, 25 bp, Mus musculus
cagatggctaccaccgcggccggtg

SEQ ID NO: 313899 - DNA, 25 bp, Mus musculus
cagatggctacctccgcggccggtg

SEQ ID NO: 313900 - DNA, 25 bp, Mus musculus
cagatggctccaacctgatgtctac

SEQ ID NO: 313901 - DNA, 25 bp, Mus musculus
cagatggctccatcctgatgtctac

SEQ ID NO: 313902 - DNA, 25 bp, Mus musculus
cagatggctgccacagtacacagag

SEQ ID NO: 313903 - DNA, 25 bp, Mus musculus
cagatggctgcctcagtacacagag

SEQ ID NO: 313904 - DNA, 25 bp, Mus musculus
cagatggctttcacggtagggtgtc

SEQ ID NO: 313905 - DNA, 25 bp, Mus musculus
cagatggctttctcggtagggtgtc

SEQ ID NO: 313906 - DNA, 25 bp, Mus musculus
cagatggctttgaggatgctcgtct

SEQ ID NO: 313907 - DNA, 25 bp, Mus musculus
cagatggctttgtggatgctcgtct

SEQ ID NO: 313908 - DNA, 25 bp, Mus musculus
cagatgggaccaaatacacatttta

SEQ ID NO: 313909 - DNA, 25 bp, Mus musculus
cagatgggaccatatacacatttta

SEQ ID NO: 313910 - DNA, 25 bp, Mus musculus
cagatgggactgctgccaggctcac

SEQ ID NO: 313911 - DNA, 25 bp, Mus musculus
cagatgggactggtgccaggctcac

SEQ ID NO: 313912 - DNA, 25 bp, Mus musculus
cagatgggcgtcctttcatagttcc

SEQ ID NO: 313913 - DNA, 25 bp, Mus musculus
cagatgggcgtcgtttcatagttcc

SEQ ID NO: 313914 - DNA, 25 bp, Mus musculus
cagatgggctgactagctcttctcc

SEQ ID NO: 313915 - DNA, 25 bp, Mus musculus
cagatgggctgagtagctcttctcc

SEQ ID NO: 313916 - DNA, 25 bp, Mus musculus
cagatggtgcagacccctggctcag

SEQ ID NO: 313917 - DNA, 25 bp, Mus musculus
cagatggtgcagtcccctggctcag

SEQ ID NO: 313918 - DNA, 25 bp, Mus musculus
cagatggtgcctaagtagttattac

SEQ ID NO: 313919 - DNA, 25 bp, Mus musculus
cagatggtgccttagtagttattac

SEQ ID NO: 313920 - DNA, 25 bp, Mus musculus
cagatggtgttgatctcttctctag

SEQ ID NO: 313921 - DNA, 25 bp, Mus musculus
cagatggtgttgttctcttctctag

SEQ ID NO: 313922 - DNA, 25 bp, Mus musculus
cagatggttgaacgaaatcagtctc

SEQ ID NO: 313923 - DNA, 25 bp, Mus musculus
cagatggttgaaggaaatcagtctc

SEQ ID NO: 313924 - DNA, 25 bp, Mus musculus
cagatggtttagatacttacagcaa

SEQ ID NO: 313925 - DNA, 25 bp, Mus musculus
cagatggtttagttacttacagcaa

SEQ ID NO: 313926 - DNA, 25 bp, Mus musculus
cagatgtaaaatctgtgccccaata

SEQ ID NO: 313927 - DNA, 25 bp, Mus musculus
cagatgtaaaatgtgtgccccaata

SEQ ID NO: 313928 - DNA, 25 bp, Mus musculus
cagatgtaaacactggaaccattaa

SEQ ID NO: 313929 - DNA, 25 bp, Mus musculus
cagatgtaaacagtggaaccattaa

SEQ ID NO: 313930 - DNA, 25 bp, Mus musculus
cagatgtaaattcggacggcaggat

SEQ ID NO: 313931 - DNA, 25 bp, Mus musculus
cagatgtaaattgggacggcaggat

SEQ ID NO: 313932 - DNA, 25 bp, Mus musculus
cagatgtacatcaatggatccagcc

SEQ ID NO: 313933 - DNA, 25 bp, Mus musculus
cagatgtacatcacctaagtgattt

SEQ ID NO: 313934 - DNA, 25 bp, Mus musculus
cagatgtacatctatggatccagcc

SEQ ID NO: 313935 - DNA, 25 bp, Mus musculus
cagatgtacatctcctaagtgattt

SEQ ID NO: 313936 - DNA, 25 bp, Mus musculus
cagatgtacctgagctttcttattt

SEQ ID NO: 313937 - DNA, 25 bp, Mus musculus
cagatgtacctgagcttttttatgt

SEQ ID NO: 313938 - DNA, 25 bp, Mus musculus
cagatgtacctgtgctttcttattt

SEQ ID NO: 313939 - DNA, 25 bp, Mus musculus
cagatgtacctgtgcttttttatgt

SEQ ID NO: 313940 - DNA, 25 bp, Mus musculus
cagatgtagagtcgcgctggcaccc

SEQ ID NO: 313941 - DNA, 25 bp, Mus musculus
cagatgtagagtggcgctggcaccc

SEQ ID NO: 313942 - DNA, 25 bp, Mus musculus
cagatgtatctcaccttcatattca

SEQ ID NO: 313943 - DNA, 25 bp, Mus musculus
cagatgtatctctccttcatattca

SEQ ID NO: 313944 - DNA, 25 bp, Mus musculus
cagatgtcaattcaaggtttcgcaa

SEQ ID NO: 313945 - DNA, 25 bp, Mus musculus
cagatgtcaattgaaggtttcgcaa

SEQ ID NO: 313946 - DNA, 25 bp, Mus musculus
cagatgtcacatcgcactttccatt

SEQ ID NO: 313947 - DNA, 25 bp, Mus musculus
cagatgtcacatggcactttccatt

SEQ ID NO: 313948 - DNA, 25 bp, Mus musculus
cagatgtcacgtcccttcagagtat

SEQ ID NO: 313949 - DNA, 25 bp, Mus musculus
cagatgtcacgtgccttcagagtat

SEQ ID NO: 313950 - DNA, 25 bp, Mus musculus
cagatgtccagcatctgctaggaac

SEQ ID NO: 313951 - DNA, 25 bp, Mus musculus
cagatgtccagcttctgctaggaac

SEQ ID NO: 313952 - DNA, 25 bp, Mus musculus
cagatgtccccacccaaggcgaggg

SEQ ID NO: 313953 - DNA, 25 bp, Mus musculus
cagatgtccccagccaaggcgaggg

SEQ ID NO: 313954 - DNA, 25 bp, Mus musculus
cagatgtcctacagttcgggtggga

SEQ ID NO: 313955 - DNA, 25 bp, Mus musculus
cagatgtcctactgttcgggtggga

SEQ ID NO: 313956 - DNA, 25 bp, Mus musculus
cagatgtctaacattttgaggtacc

SEQ ID NO: 313957 - DNA, 25 bp, Mus musculus
cagatgtctaactttttgaggtacc

SEQ ID NO: 313958 - DNA, 25 bp, Mus musculus
cagatgtctcagcttctgttgaaaa

SEQ ID NO: 313959 - DNA, 25 bp, Mus musculus
cagatgtctcaggttctgttgaaaa

SEQ ID NO: 313960 - DNA, 25 bp, Mus musculus
cagatgtgaactcccctgtgagcca

SEQ ID NO: 313961 - DNA, 25 bp, Mus musculus
cagatgtgaactgccctgtgagcca

SEQ ID NO: 313962 - DNA, 25 bp, Mus musculus
cagatgtgaatgctacctgggtcat

SEQ ID NO: 313963 - DNA, 25 bp, Mus musculus
cagatgtgaatggtacctgggtcat

SEQ ID NO: 313964 - DNA, 25 bp, Mus musculus
cagatgtgcccaaggagtactctgt

SEQ ID NO: 313965 - DNA, 25 bp, Mus musculus
cagatgtgcccatggagtactctgt

SEQ ID NO: 313966 - DNA, 25 bp, Mus musculus
cagatgtgcccgctgtcatttaaaa

SEQ ID NO: 313967 - DNA, 25 bp, Mus musculus
cagatgtgcccggtgtcatttaaaa

SEQ ID NO: 313968 - DNA, 25 bp, Mus musculus
cagatgtgctgtctggatacgccca

SEQ ID NO: 313969 - DNA, 25 bp, Mus musculus
cagatgtgctgtgtggatacgccca

SEQ ID NO: 313970 - DNA, 25 bp, Mus musculus
cagatgtggaagagtgggactcata

SEQ ID NO: 313971 - DNA, 25 bp, Mus musculus
cagatgtggaagtgtgggactcata

SEQ ID NO: 313972 - DNA, 25 bp, Mus musculus
cagatgtgggatcccatttagctat

SEQ ID NO: 313973 - DNA, 25 bp, Mus musculus
cagatgtgggatgccatttagctat

SEQ ID NO: 313974 - DNA, 25 bp, Mus musculus
cagatgtgtacaacttccatgctct

SEQ ID NO: 313975 - DNA, 25 bp, Mus musculus
cagatgtgtacatcttccatgctct

SEQ ID NO: 313976 - DNA, 25 bp, Mus musculus
cagatgttagaaaccaccccatggg

SEQ ID NO: 313977 - DNA, 25 bp, Mus musculus
cagatgttagaatccaccccatggg

SEQ ID NO: 313978 - DNA, 25 bp, Mus musculus
cagatgttcactccagcagagtggg

SEQ ID NO: 313979 - DNA, 25 bp, Mus musculus
cagatgttcactgcagcagagtggg

SEQ ID NO: 313980 - DNA, 25 bp, Mus musculus
cagatgttctgccaactgagacaca

SEQ ID NO: 313981 - DNA, 25 bp, Mus musculus
cagatgttctgcgaactgagacaca

SEQ ID NO: 313982 - DNA, 25 bp, Mus musculus
cagatgtttcacaggttgggatcaa

SEQ ID NO: 313983 - DNA, 25 bp, Mus musculus
cagatgtttcactggttgggatcaa

SEQ ID NO: 313984 - DNA, 25 bp, Mus musculus
cagatgtttctgagagataccgaac

SEQ ID NO: 313985 - DNA, 25 bp, Mus musculus
cagatgtttctgtgagataccgaac

SEQ ID NO: 313986 - DNA, 25 bp, Mus musculus
cagattaacacgcagtctccgtggg

SEQ ID NO: 313987 - DNA, 25 bp, Mus musculus
cagattaacacggagtctccgtggg

SEQ ID NO: 313988 - DNA, 25 bp, Mus musculus
cagattaaccctcgtgatcagtggg

SEQ ID NO: 313989 - DNA, 25 bp, Mus musculus
cagattaaccctggtgatcagtggg

SEQ ID NO: 313990 - DNA, 25 bp, Mus musculus
cagattaacgaacctttgaaagaac

SEQ ID NO: 313991 - DNA, 25 bp, Mus musculus
cagattaacgaagctttgaaagaac

SEQ ID NO: 313992 - DNA, 25 bp, Mus musculus
cagattaactttctgctggattcag

SEQ ID NO: 313993 - DNA, 25 bp, Mus musculus
cagattaactttgtgctggattcag

SEQ ID NO: 313994 - DNA, 25 bp, Mus musculus
cagattaagccaccagtgaccataa

SEQ ID NO: 313995 - DNA, 25 bp, Mus musculus
cagattaagccagcagtgaccataa

SEQ ID NO: 313996 - DNA, 25 bp, Mus musculus
cagattaaggtgcagcccatctcag

SEQ ID NO: 313997 - DNA, 25 bp, Mus musculus
cagattaaggtggagcccatctcag

SEQ ID NO: 313998 - DNA, 25 bp, Mus musculus
cagattaagttcctctctccaatcc

SEQ ID NO: 313999 - DNA, 25 bp, Mus musculus
cagattaagttcgtctctccaatcc

SEQ ID NO: 314000 - DNA, 25 bp, Mus musculus
cagattaatgacagactcgccagat

SEQ ID NO: 314001 - DNA, 25 bp, Mus musculus
cagattaatgactgactcgccagat

SEQ ID NO: 314002 - DNA, 25 bp, Mus musculus
cagattaatgtcagcctctgtcaga

SEQ ID NO: 314003 - DNA, 25 bp, Mus musculus
cagattaatgtctgcctctgtcaga

SEQ ID NO: 314004 - DNA, 25 bp, Mus musculus
cagattatacctcacttgtggttag

SEQ ID NO: 314005 - DNA, 25 bp, Mus musculus
cagattatacctgacttgtggttag

SEQ ID NO: 314006 - DNA, 25 bp, Mus musculus
cagattatacgcacatacccagtta

SEQ ID NO: 314007 - DNA, 25 bp, Mus musculus
cagattatacgctcatacccagtta

SEQ ID NO: 314008 - DNA, 25 bp, Mus musculus
cagattatctatcctggccagcatc

SEQ ID NO: 314009 - DNA, 25 bp, Mus musculus
cagattatctatgctggccagcatc

SEQ ID NO: 314010 - DNA, 25 bp, Mus musculus
cagattatgtgcctggtagagacac

SEQ ID NO: 314011 - DNA, 25 bp, Mus musculus
cagattatgtgcgtggtagagacac

SEQ ID NO: 314012 - DNA, 25 bp, Mus musculus
cagattattggcatttagtttccta

SEQ ID NO: 314013 - DNA, 25 bp, Mus musculus
cagattattggcttttagtttccta

SEQ ID NO: 314014 - DNA, 25 bp, Mus musculus
cagattcaacctccccaaaagaaga

SEQ ID NO: 314015 - DNA, 25 bp, Mus musculus
cagattcaacctgcccaaaagaaga

SEQ ID NO: 314016 - DNA, 25 bp, Mus musculus
cagattcaaggtcccaaggcagcgg

SEQ ID NO: 314017 - DNA, 25 bp, Mus musculus
cagattcaaggtgccaaggcagcgg

SEQ ID NO: 314018 - DNA, 25 bp, Mus musculus
cagattcacaacacactgtgtagtg

SEQ ID NO: 314019 - DNA, 25 bp, Mus musculus
cagattcacaactcactgtgtagtg

SEQ ID NO: 314020 - DNA, 25 bp, Mus musculus
cagattcacagacacttttcatacc

SEQ ID NO: 314021 - DNA, 25 bp, Mus musculus
cagattcacagagacttttcatacc

SEQ ID NO: 314022 - DNA, 25 bp, Mus musculus
cagattcagaatagtctgccctcca

SEQ ID NO: 314023 - DNA, 25 bp, Mus musculus
cagattcagaattgtctgccctcca

SEQ ID NO: 314024 - DNA, 25 bp, Mus musculus
cagattcagccacccaaagacttgt

SEQ ID NO: 314025 - DNA, 25 bp, Mus musculus
cagattcagccagccaaagacttgt

SEQ ID NO: 314026 - DNA, 25 bp, Mus musculus
cagattcagtatattgtacctgtga

SEQ ID NO: 314027 - DNA, 25 bp, Mus musculus
cagattcagtattttgtacctgtga

SEQ ID NO: 314028 - DNA, 25 bp, Mus musculus
cagattcagtctagtggcacatgtt

SEQ ID NO: 314029 - DNA, 25 bp, Mus musculus
cagattcagtcttgtggcacatgtt

SEQ ID NO: 314030 - DNA, 25 bp, Mus musculus
cagattcagttgctgctgttcgcac

SEQ ID NO: 314031 - DNA, 25 bp, Mus musculus
cagattcagttggtgctgttcgcac

SEQ ID NO: 314032 - DNA, 25 bp, Mus musculus
cagattcagtttctacgatggaggt

SEQ ID NO: 314033 - DNA, 25 bp, Mus musculus
cagattcagtttgtacgatggaggt

SEQ ID NO: 314034 - DNA, 25 bp, Mus musculus
cagattcatctaaaataccaacttt

SEQ ID NO: 314035 - DNA, 25 bp, Mus musculus
cagattcatctataataccaacttt

SEQ ID NO: 314036 - DNA, 25 bp, Mus musculus
cagattcatctgctagttgtggcat

SEQ ID NO: 314037 - DNA, 25 bp, Mus musculus
cagattcatctggtagttgtggcat

SEQ ID NO: 314038 - DNA, 25 bp, Mus musculus
cagattcattgcatatcccatgata

SEQ ID NO: 314039 - DNA, 25 bp, Mus musculus
cagattcattgcttatcccatgata

SEQ ID NO: 314040 - DNA, 25 bp, Mus musculus
cagattcccaggcaatggtgaagat

SEQ ID NO: 314041 - DNA, 25 bp, Mus musculus
cagattcccagggaatggtgaagat

SEQ ID NO: 314042 - DNA, 25 bp, Mus musculus
cagattccctgactgtgagggaccc

SEQ ID NO: 314043 - DNA, 25 bp, Mus musculus
cagattccctgagtgtgagggaccc

SEQ ID NO: 314044 - DNA, 25 bp, Mus musculus
cagattccctgcagtatgtgttgat

SEQ ID NO: 314045 - DNA, 25 bp, Mus musculus
cagattccctgctgtatgtgttgat

SEQ ID NO: 314046 - DNA, 25 bp, Mus musculus
cagattcctacccatgactatcaga

SEQ ID NO: 314047 - DNA, 25 bp, Mus musculus
cagattcctaccgatgactatcaga

SEQ ID NO: 314048 - DNA, 25 bp, Mus musculus
cagattcctagaacatttgtcccca

SEQ ID NO: 314049 - DNA, 25 bp, Mus musculus
cagattcctagatcatttgtcccca

SEQ ID NO: 314050 - DNA, 25 bp, Mus musculus
cagattctaagaccaactattgaca

SEQ ID NO: 314051 - DNA, 25 bp, Mus musculus
cagattctaagagcaactattgaca

SEQ ID NO: 314052 - DNA, 25 bp, Mus musculus
cagattctaagcatactttctcccc

SEQ ID NO: 314053 - DNA, 25 bp, Mus musculus
cagattctaagcttactttctcccc

SEQ ID NO: 314054 - DNA, 25 bp, Mus musculus
cagattctagtgagggatcctggct

SEQ ID NO: 314055 - DNA, 25 bp, Mus musculus
cagattctagtgtgggatcctggct

SEQ ID NO: 314056 - DNA, 25 bp, Mus musculus
cagattctcaacagttatcatgaaa

SEQ ID NO: 314057 - DNA, 25 bp, Mus musculus
cagattctcaactgttatcatgaaa

SEQ ID NO: 314058 - DNA, 25 bp, Mus musculus
cagattctccttatccagcttagga

SEQ ID NO: 314059 - DNA, 25 bp, Mus musculus
cagattctccttttccagcttagga

SEQ ID NO: 314060 - DNA, 25 bp, Mus musculus
cagattctcgatcggtattttagtt

SEQ ID NO: 314061 - DNA, 25 bp, Mus musculus
cagattctcgatgggtattttagtt

SEQ ID NO: 314062 - DNA, 25 bp, Mus musculus
cagattctgtttccactgagtgctt

SEQ ID NO: 314063 - DNA, 25 bp, Mus musculus
cagattctgtttgcactgagtgctt

SEQ ID NO: 314064 - DNA, 25 bp, Mus musculus
cagattgaagcaccatcaccctttg

SEQ ID NO: 314065 - DNA, 25 bp, Mus musculus
cagattgaagcagcatcaccctttg

SEQ ID NO: 314066 - DNA, 25 bp, Mus musculus
cagattgaatagctgtaagcagttc

SEQ ID NO: 314067 - DNA, 25 bp, Mus musculus
cagattgaataggtgtaagcagttc

SEQ ID NO: 314068 - DNA, 25 bp, Mus musculus
cagattgacggacattggatgcact

SEQ ID NO: 314069 - DNA, 25 bp, Mus musculus
cagattgacggagattggatgcact

SEQ ID NO: 314070 - DNA, 25 bp, Mus musculus
cagattgagtagaaggattttcccc

SEQ ID NO: 314071 - DNA, 25 bp, Mus musculus
cagattgagtagtaggattttcccc

SEQ ID NO: 314072 - DNA, 25 bp, Mus musculus
cagattgatctcaaaagcagctttt

SEQ ID NO: 314073 - DNA, 25 bp, Mus musculus
cagattgatctctaaagcagctttt

SEQ ID NO: 314074 - DNA, 25 bp, Mus musculus
cagattgcaagacagcttacacggt

SEQ ID NO: 314075 - DNA, 25 bp, Mus musculus
cagattgcaagagagcttacacggt

SEQ ID NO: 314076 - DNA, 25 bp, Mus musculus
cagattgcccgtctggtgccaagag

SEQ ID NO: 314077 - DNA, 25 bp, Mus musculus
cagattgcccgtgtggtgccaagag

SEQ ID NO: 314078 - DNA, 25 bp, Mus musculus
cagattgccgaaaggttcctttgct

SEQ ID NO: 314079 - DNA, 25 bp, Mus musculus
cagattgccgaatggttcctttgct

SEQ ID NO: 314080 - DNA, 25 bp, Mus musculus
cagattgctcttacactcacagcaa

SEQ ID NO: 314081 - DNA, 25 bp, Mus musculus
cagattgctctttcactcacagcaa

SEQ ID NO: 314082 - DNA, 25 bp, Mus musculus
cagattggacaccttaaccaacata

SEQ ID NO: 314083 - DNA, 25 bp, Mus musculus
cagattggacacgttaaccaacata

SEQ ID NO: 314084 - DNA, 25 bp, Mus musculus
cagattggacttctggaatccactg

SEQ ID NO: 314085 - DNA, 25 bp, Mus musculus
cagattggacttgtggaatccactg

SEQ ID NO: 314086 - DNA, 25 bp, Mus musculus
cagattggaggtatccaggaggccc

SEQ ID NO: 314087 - DNA, 25 bp, Mus musculus
cagattggaggtttccaggaggccc

SEQ ID NO: 314088 - DNA, 25 bp, Mus musculus
cagattggcgggaggcaccacccgc

SEQ ID NO: 314089 - DNA, 25 bp, Mus musculus
cagattggcgggtggcaccacccgc

SEQ ID NO: 314090 - DNA, 25 bp, Mus musculus
cagattggctctcgctttgtgttta

SEQ ID NO: 314091 - DNA, 25 bp, Mus musculus
cagattggctctggctttgtgttta

SEQ ID NO: 314092 - DNA, 25 bp, Mus musculus
cagattggcttaagggcaaacctgt

SEQ ID NO: 314093 - DNA, 25 bp, Mus musculus
cagattggcttatgggcaaacctgt

SEQ ID NO: 314094 - DNA, 25 bp, Mus musculus
cagattggctttaaggcaacctgat

SEQ ID NO: 314095 - DNA, 25 bp, Mus musculus
cagattggcttttaggcaacctgat

SEQ ID NO: 314096 - DNA, 25 bp, Mus musculus
cagattgggatactggcagcagcat

SEQ ID NO: 314097 - DNA, 25 bp, Mus musculus
cagattgggatagtggcagcagcat

SEQ ID NO: 314098 - DNA, 25 bp, Mus musculus
cagattgtagctcaagtccttgtac

SEQ ID NO: 314099 - DNA, 25 bp, Mus musculus
cagattgtagctgaagtccttgtac

SEQ ID NO: 314100 - DNA, 25 bp, Mus musculus
cagattgtatatagcgtcattttta

SEQ ID NO: 314101 - DNA, 25 bp, Mus musculus
cagattgtatattgcgtcattttta

SEQ ID NO: 314102 - DNA, 25 bp, Mus musculus
cagattgtcccacttagctttaaga

SEQ ID NO: 314103 - DNA, 25 bp, Mus musculus
cagattgtcccagttagctttaaga

SEQ ID NO: 314104 - DNA, 25 bp, Mus musculus
cagattgtcctgagcgtgtgtgagc

SEQ ID NO: 314105 - DNA, 25 bp, Mus musculus
cagattgtcctgtgcgtgtgtgagc

SEQ ID NO: 314106 - DNA, 25 bp, Mus musculus
cagattgtctagcacttccagcaaa

SEQ ID NO: 314107 - DNA, 25 bp, Mus musculus
cagattgtctaggacttccagcaaa

SEQ ID NO: 314108 - DNA, 25 bp, Mus musculus
cagattgtcttacttgggctgtaaa

SEQ ID NO: 314109 - DNA, 25 bp, Mus musculus
cagattgtcttagttgggctgtaaa

SEQ ID NO: 314110 - DNA, 25 bp, Mus musculus
cagattgtgttgattgacccttcct

SEQ ID NO: 314111 - DNA, 25 bp, Mus musculus
cagattgtgttgtttgacccttcct

SEQ ID NO: 314112 - DNA, 25 bp, Mus musculus
cagatttaccatccctctcaagaat

SEQ ID NO: 314113 - DNA, 25 bp, Mus musculus
cagatttaccatgcctctcaagaat

SEQ ID NO: 314114 - DNA, 25 bp, Mus musculus
cagatttaccctcaaactcttattt

SEQ ID NO: 314115 - DNA, 25 bp, Mus musculus
cagatttaccctgaaactcttattt

SEQ ID NO: 314116 - DNA, 25 bp, Mus musculus
cagatttagagacctgggattactt

SEQ ID NO: 314117 - DNA, 25 bp, Mus musculus
cagatttagagagctgggattactt

SEQ ID NO: 314118 - DNA, 25 bp, Mus musculus
cagatttagatacagcccgggcagg

SEQ ID NO: 314119 - DNA, 25 bp, Mus musculus
cagatttagatagagcccgggcagg

SEQ ID NO: 314120 - DNA, 25 bp, Mus musculus
cagatttatcgcaaactttttgtaa

SEQ ID NO: 314121 - DNA, 25 bp, Mus musculus
cagatttatcgctaactttttgtaa

SEQ ID NO: 314122 - DNA, 25 bp, Mus musculus
cagatttatgtgaccatcccctcca

SEQ ID NO: 314123 - DNA, 25 bp, Mus musculus
cagatttatgtgtccatcccctcca

SEQ ID NO: 314124 - DNA, 25 bp, Mus musculus
cagatttattttccagtcaaccttc

SEQ ID NO: 314125 - DNA, 25 bp, Mus musculus
cagatttattttgcagtcaaccttc

SEQ ID NO: 314126 - DNA, 25 bp, Mus musculus
cagatttcactcacagtatcaacag

SEQ ID NO: 314127 - DNA, 25 bp, Mus musculus
cagatttcactctcagtatcaacag

SEQ ID NO: 314128 - DNA, 25 bp, Mus musculus
cagatttcagaacccctcctttaca

SEQ ID NO: 314129 - DNA, 25 bp, Mus musculus
cagatttcagaagccctcctttaca

SEQ ID NO: 314130 - DNA, 25 bp, Mus musculus
cagatttcagtacacccagcagacc

SEQ ID NO: 314131 - DNA, 25 bp, Mus musculus
cagatttcagtagacccagcagacc

SEQ ID NO: 314132 - DNA, 25 bp, Mus musculus
cagatttccccaaatttactcacct

SEQ ID NO: 314133 - DNA, 25 bp, Mus musculus
cagatttccccatatttactcacct

SEQ ID NO: 314134 - DNA, 25 bp, Mus musculus
cagatttcctgtatgtggttgtaaa

SEQ ID NO: 314135 - DNA, 25 bp, Mus musculus
cagatttcctgtttgtggttgtaaa

SEQ ID NO: 314136 - DNA, 25 bp, Mus musculus
cagatttctctacctacattttctg

SEQ ID NO: 314137 - DNA, 25 bp, Mus musculus
cagatttctctagctacattttctg

SEQ ID NO: 314138 - DNA, 25 bp, Mus musculus
cagatttctgcacgttccagtcaga

SEQ ID NO: 314139 - DNA, 25 bp, Mus musculus
cagatttctgcaggttccagtcaga

SEQ ID NO: 314140 - DNA, 25 bp, Mus musculus
cagatttctgtgagatgctgctgtt

SEQ ID NO: 314141 - DNA, 25 bp, Mus musculus
cagatttctgtgtgatgctgctgtt

SEQ ID NO: 314142 - DNA, 25 bp, Mus musculus
cagatttcttacaaccttgctagct

SEQ ID NO: 314143 - DNA, 25 bp, Mus musculus
cagatttcttactaccttgctagct

SEQ ID NO: 314144 - DNA, 25 bp, Mus musculus
cagatttcttctccccgtgcaagtg

SEQ ID NO: 314145 - DNA, 25 bp, Mus musculus
cagatttcttctgcccgtgcaagtg

SEQ ID NO: 314146 - DNA, 25 bp, Mus musculus
cagatttgacatcactgactacttt

SEQ ID NO: 314147 - DNA, 25 bp, Mus musculus
cagatttgacatgactgactacttt

SEQ ID NO: 314148 - DNA, 25 bp, Mus musculus
cagatttgaggtaggcttggattac

SEQ ID NO: 314149 - DNA, 25 bp, Mus musculus
cagatttgaggttggcttggattac

SEQ ID NO: 314150 - DNA, 25 bp, Mus musculus
cagatttgatacacttccggtttcc

SEQ ID NO: 314151 - DNA, 25 bp, Mus musculus
cagatttgatactcttccggtttcc

SEQ ID NO: 314152 - DNA, 25 bp, Mus musculus
cagatttgatggagctactttaaga

SEQ ID NO: 314153 - DNA, 25 bp, Mus musculus
cagatttgatggtgctactttaaga

SEQ ID NO: 314154 - DNA, 25 bp, Mus musculus
cagatttgcactattctaagttagc

SEQ ID NO: 314155 - DNA, 25 bp, Mus musculus
cagatttgcacttttctaagttagc

SEQ ID NO: 314156 - DNA, 25 bp, Mus musculus
cagatttgccccaacaacctagtgg

SEQ ID NO: 314157 - DNA, 25 bp, Mus musculus
cagatttgcccctacaacctagtgg

SEQ ID NO: 314158 - DNA, 25 bp, Mus musculus
cagatttgctttaggatatcccagt

SEQ ID NO: 314159 - DNA, 25 bp, Mus musculus
cagatttgcttttggatatcccagt

SEQ ID NO: 314160 - DNA, 25 bp, Mus musculus
cagatttgtttgatcagtgactcaa

SEQ ID NO: 314161 - DNA, 25 bp, Mus musculus
cagatttgtttgttcagtgactcaa

SEQ ID NO: 314162 - DNA, 25 bp, Mus musculus
cagattttaaccagatttgtagtaa

SEQ ID NO: 314163 - DNA, 25 bp, Mus musculus
cagattttaacctgatttgtagtaa

SEQ ID NO: 314164 - DNA, 25 bp, Mus musculus
cagattttatgtccacgagtgttta

SEQ ID NO: 314165 - DNA, 25 bp, Mus musculus
cagattttatgtgcacgagtgttta

SEQ ID NO: 314166 - DNA, 25 bp, Mus musculus
cagattttattgaatttgcagagta

SEQ ID NO: 314167 - DNA, 25 bp, Mus musculus
cagattttattgtatttgcagagta

SEQ ID NO: 314168 - DNA, 25 bp, Mus musculus
cagattttccacagatgtaccaatg

SEQ ID NO: 314169 - DNA, 25 bp, Mus musculus
cagattttccactgatgtaccaatg

SEQ ID NO: 314170 - DNA, 25 bp, Mus musculus
cagattttccctaacaccttatcta

SEQ ID NO: 314171 - DNA, 25 bp, Mus musculus
cagattttcccttacaccttatcta

SEQ ID NO: 314172 - DNA, 25 bp, Mus musculus
cagattttcctccttttagaatgga

SEQ ID NO: 314173 - DNA, 25 bp, Mus musculus
cagattttcctcgttttagaatgga

SEQ ID NO: 314174 - DNA, 25 bp, Mus musculus
cagattttctccagcaagtactgcc

SEQ ID NO: 314175 - DNA, 25 bp, Mus musculus
cagattttctcctgcaagtactgcc

SEQ ID NO: 314176 - DNA, 25 bp, Mus musculus
cagattttcttgctgtttaagtaaa

SEQ ID NO: 314177 - DNA, 25 bp, Mus musculus
cagattttcttggtgtttaagtaaa

SEQ ID NO: 314178 - DNA, 25 bp, Mus musculus
cagattttggctcaggctctgacct

SEQ ID NO: 314179 - DNA, 25 bp, Mus musculus
cagattttggctgaggctctgacct

SEQ ID NO: 314180 - DNA, 25 bp, Mus musculus
cagattttgttgcaactttagctat

SEQ ID NO: 314181 - DNA, 25 bp, Mus musculus
cagattttgttggaactttagctat

SEQ ID NO: 314182 - DNA, 25 bp, Mus musculus
cagatttttgggacacaggccattc

SEQ ID NO: 314183 - DNA, 25 bp, Mus musculus
cagatttttgggtcacaggccattc

SEQ ID NO: 314184 - DNA, 25 bp, Mus musculus
cagcaaaaagcactagtctcctaag

SEQ ID NO: 314185 - DNA, 25 bp, Mus musculus
cagcaaaaagcagtagtctcctaag

SEQ ID NO: 314186 - DNA, 25 bp, Mus musculus
cagcaaaagtgtattaccttcacca

SEQ ID NO: 314187 - DNA, 25 bp, Mus musculus
cagcaaaagtgttttaccttcacca

SEQ ID NO: 314188 - DNA, 25 bp, Mus musculus
cagcaaaatcggaggcattctggcc

SEQ ID NO: 314189 - DNA, 25 bp, Mus musculus
cagcaaaatcggtggcattctggcc

SEQ ID NO: 314190 - DNA, 25 bp, Mus musculus
cagcaaaatgctcggtcctgtttac

SEQ ID NO: 314191 - DNA, 25 bp, Mus musculus
cagcaaaatgctgggtcctgtttac

SEQ ID NO: 314192 - DNA, 25 bp, Mus musculus
cagcaaacactaaggaacccttcac

SEQ ID NO: 314193 - DNA, 25 bp, Mus musculus
cagcaaacactatggaacccttcac

SEQ ID NO: 314194 - DNA, 25 bp, Mus musculus
cagcaaaccgcaaacctctaaggta

SEQ ID NO: 314195 - DNA, 25 bp, Mus musculus
cagcaaaccgcatacctctaaggta

SEQ ID NO: 314196 - DNA, 25 bp, Mus musculus
cagcaaactgtacggaccggcggta

SEQ ID NO: 314197 - DNA, 25 bp, Mus musculus
cagcaaactgtagggaccggcggta

SEQ ID NO: 314198 - DNA, 25 bp, Mus musculus
cagcaaagagcaaagccactgctct

SEQ ID NO: 314199 - DNA, 25 bp, Mus musculus
cagcaaagagcatagccactgctct

SEQ ID NO: 314200 - DNA, 25 bp, Mus musculus
cagcaaagcaccatgattttaatca

SEQ ID NO: 314201 - DNA, 25 bp, Mus musculus
cagcaaagcaccttgattttaatca

SEQ ID NO: 314202 - DNA, 25 bp, Mus musculus
cagcaaagcctgatttattcttagg

SEQ ID NO: 314203 - DNA, 25 bp, Mus musculus
cagcaaagcctgttttattcttagg

SEQ ID NO: 314204 - DNA, 25 bp, Mus musculus
cagcaaaggattacgttggcatcaa

SEQ ID NO: 314205 - DNA, 25 bp, Mus musculus
cagcaaaggatttcgttggcatcaa

SEQ ID NO: 314206 - DNA, 25 bp, Mus musculus
cagcaaagtccaaagtcaagttttt

SEQ ID NO: 314207 - DNA, 25 bp, Mus musculus
cagcaaagtccatagtcaagttttt

SEQ ID NO: 314208 - DNA, 25 bp, Mus musculus
cagcaaagtggactttgttggtaat

SEQ ID NO: 314209 - DNA, 25 bp, Mus musculus
cagcaaagtggagtttgttggtaat

SEQ ID NO: 314210 - DNA, 25 bp, Mus musculus
cagcaaagtttgacaatcagctcaa

SEQ ID NO: 314211 - DNA, 25 bp, Mus musculus
cagcaaagtttgtcaatcagctcaa

SEQ ID NO: 314212 - DNA, 25 bp, Mus musculus
cagcaaatatttaacccaccgagtc

SEQ ID NO: 314213 - DNA, 25 bp, Mus musculus
cagcaaatattttacccaccgagtc

SEQ ID NO: 314214 - DNA, 25 bp, Mus musculus
cagcaaatggcaatcaagggacaat

SEQ ID NO: 314215 - DNA, 25 bp, Mus musculus
cagcaaatggcattcaagggacaat

SEQ ID NO: 314216 - DNA, 25 bp, Mus musculus
cagcaaatgttgcttgttgtaattt

SEQ ID NO: 314217 - DNA, 25 bp, Mus musculus
cagcaaatgttggttgttgtaattt

SEQ ID NO: 314218 - DNA, 25 bp, Mus musculus
cagcaaattagaattcagccacctc

SEQ ID NO: 314219 - DNA, 25 bp, Mus musculus
cagcaaattagatttcagccacctc

SEQ ID NO: 314220 - DNA, 25 bp, Mus musculus
cagcaaattctactggacgtttcaa

SEQ ID NO: 314221 - DNA, 25 bp, Mus musculus
cagcaaattctagtggacgtttcaa

SEQ ID NO: 314222 - DNA, 25 bp, Mus musculus
cagcaaatttttcagttctattgtc

SEQ ID NO: 314223 - DNA, 25 bp, Mus musculus
cagcaaatttttgagttctattgtc

SEQ ID NO: 314224 - DNA, 25 bp, Mus musculus
cagcaacacattcagtcttgggttc

SEQ ID NO: 314225 - DNA, 25 bp, Mus musculus
cagcaacacattgagtcttgggttc

SEQ ID NO: 314226 - DNA, 25 bp, Mus musculus
cagcaacactgtccatgaagatgtt

SEQ ID NO: 314227 - DNA, 25 bp, Mus musculus
cagcaacactgtcgtagaagccagg

SEQ ID NO: 314228 - DNA, 25 bp, Mus musculus
cagcaacactgtgcatgaagatgtt

SEQ ID NO: 314229 - DNA, 25 bp, Mus musculus
cagcaacactgtggtagaagccagg

SEQ ID NO: 314230 - DNA, 25 bp, Mus musculus
cagcaacactttatctgtcctgtct

SEQ ID NO: 314231 - DNA, 25 bp, Mus musculus
cagcaacactttttctgtcctgtct

SEQ ID NO: 314232 - DNA, 25 bp, Mus musculus
cagcaacatttcaccttaaaccatg

SEQ ID NO: 314233 - DNA, 25 bp, Mus musculus
cagcaacatttctccttaaaccatg

SEQ ID NO: 314234 - DNA, 25 bp, Mus musculus
cagcaaccaatgatgccagttcctg

SEQ ID NO: 314235 - DNA, 25 bp, Mus musculus
cagcaaccaatgttgccagttcctg

SEQ ID NO: 314236 - DNA, 25 bp, Mus musculus
cagcaaccacatcgtggctcacaac

SEQ ID NO: 314237 - DNA, 25 bp, Mus musculus
cagcaaccacatggtggctcacaac

SEQ ID NO: 314238 - DNA, 25 bp, Mus musculus
cagcaaccagaacccggacacagat

SEQ ID NO: 314239 - DNA, 25 bp, Mus musculus
cagcaaccagaagccggacacagat

SEQ ID NO: 314240 - DNA, 25 bp, Mus musculus
cagcaacccggtctttgagagcaat

SEQ ID NO: 314241 - DNA, 25 bp, Mus musculus
cagcaacccggtgtttgagagcaat

SEQ ID NO: 314242 - DNA, 25 bp, Mus musculus
cagcaacccttacgagcctttcatt

SEQ ID NO: 314243 - DNA, 25 bp, Mus musculus
cagcaacccttaggagcctttcatt

SEQ ID NO: 314244 - DNA, 25 bp, Mus musculus
cagcaacgacgaagtgggcagccct

SEQ ID NO: 314245 - DNA, 25 bp, Mus musculus
cagcaacgacgatgtgggcagccct

SEQ ID NO: 314246 - DNA, 25 bp, Mus musculus
cagcaactccggaaaaagcagcaga

SEQ ID NO: 314247 - DNA, 25 bp, Mus musculus
cagcaactccggtaaaagcagcaga

SEQ ID NO: 314248 - DNA, 25 bp, Mus musculus
cagcaactgggcatttctctcagca

SEQ ID NO: 314249 - DNA, 25 bp, Mus musculus
cagcaactgggcttttctctcagca

SEQ ID NO: 314250 - DNA, 25 bp, Mus musculus
cagcaacttccccatatttttaaga

SEQ ID NO: 314251 - DNA, 25 bp, Mus musculus
cagcaacttcccgatatttttaaga

SEQ ID NO: 314252 - DNA, 25 bp, Mus musculus
cagcaacttctgagtccctctttgc

SEQ ID NO: 314253 - DNA, 25 bp, Mus musculus
cagcaacttctgtgtccctctttgc

SEQ ID NO: 314254 - DNA, 25 bp, Mus musculus
cagcaactttttaagttccatgcag

SEQ ID NO: 314255 - DNA, 25 bp, Mus musculus
cagcaacttttttagttccatgcag

SEQ ID NO: 314256 - DNA, 25 bp, Mus musculus
cagcaagaaattaatcctcattttt

SEQ ID NO: 314257 - DNA, 25 bp, Mus musculus
cagcaagaaatttatcctcattttt

SEQ ID NO: 314258 - DNA, 25 bp, Mus musculus
cagcaagaacaccggcagctgcttg

SEQ ID NO: 314259 - DNA, 25 bp, Mus musculus
cagcaagaacacgggcagctgcttg

SEQ ID NO: 314260 - DNA, 25 bp, Mus musculus
cagcaagaagctaaccaggcaccat

SEQ ID NO: 314261 - DNA, 25 bp, Mus musculus
cagcaagaagcttaccaggcaccat

SEQ ID NO: 314262 - DNA, 25 bp, Mus musculus
cagcaagacttcagccaggagtggg

SEQ ID NO: 314263 - DNA, 25 bp, Mus musculus
cagcaagacttctgccaggagtggg

SEQ ID NO: 314264 - DNA, 25 bp, Mus musculus
cagcaagagggaatgtttcagtgta

SEQ ID NO: 314265 - DNA, 25 bp, Mus musculus
cagcaagagggactgctgcttatga

SEQ ID NO: 314266 - DNA, 25 bp, Mus musculus
cagcaagagggagtgctgcttatga

SEQ ID NO: 314267 - DNA, 25 bp, Mus musculus
cagcaagagggattgtttcagtgta

SEQ ID NO: 314268 - DNA, 25 bp, Mus musculus
cagcaagatccacttaccagaagat

SEQ ID NO: 314269 - DNA, 25 bp, Mus musculus
cagcaagatccagttaccagaagat

SEQ ID NO: 314270 - DNA, 25 bp, Mus musculus
cagcaagatcctctcctctaaagta

SEQ ID NO: 314271 - DNA, 25 bp, Mus musculus
cagcaagatcctgtcctctaaagta

SEQ ID NO: 314272 - DNA, 25 bp, Mus musculus
cagcaagatgcgcaggagttcctga

SEQ ID NO: 314273 - DNA, 25 bp, Mus musculus
cagcaagatgcggaggagttcctga

SEQ ID NO: 314274 - DNA, 25 bp, Mus musculus
cagcaagatgctcagtctcctgaaa

SEQ ID NO: 314275 - DNA, 25 bp, Mus musculus
cagcaagatgctgagtctcctgaaa

SEQ ID NO: 314276 - DNA, 25 bp, Mus musculus
cagcaagattttcttccgctttttt

SEQ ID NO: 314277 - DNA, 25 bp, Mus musculus
cagcaagattttgttccgctttttt

SEQ ID NO: 314278 - DNA, 25 bp, Mus musculus
cagcaagcaactccaacttgctagt

SEQ ID NO: 314279 - DNA, 25 bp, Mus musculus
cagcaagcaactgcaacttgctagt

SEQ ID NO: 314280 - DNA, 25 bp, Mus musculus
cagcaagcacacaggcacggcggag

SEQ ID NO: 314281 - DNA, 25 bp, Mus musculus
cagcaagcacactggcacggcggag

SEQ ID NO: 314282 - DNA, 25 bp, Mus musculus
cagcaagcagttcaacctgtgcgaa

SEQ ID NO: 314283 - DNA, 25 bp, Mus musculus
cagcaagcagttgaacctgtgcgaa

SEQ ID NO: 314284 - DNA, 25 bp, Mus musculus
cagcaagcccagacattccgagaag

SEQ ID NO: 314285 - DNA, 25 bp, Mus musculus
cagcaagcccagtcattccgagaag

SEQ ID NO: 314286 - DNA, 25 bp, Mus musculus
cagcaagcctgcagaggactagggc

SEQ ID NO: 314287 - DNA, 25 bp, Mus musculus
cagcaagcctgctgaggactagggc

SEQ ID NO: 314288 - DNA, 25 bp, Mus musculus
cagcaagcgatgactgactcacata

SEQ ID NO: 314289 - DNA, 25 bp, Mus musculus
cagcaagcgatgtctgactcacata

SEQ ID NO: 314290 - DNA, 25 bp, Mus musculus
cagcaagctgagcagaagttttgga

SEQ ID NO: 314291 - DNA, 25 bp, Mus musculus
cagcaagctgaggagaagttttgga

SEQ ID NO: 314292 - DNA, 25 bp, Mus musculus
cagcaagcttagagctctgtgtgtt

SEQ ID NO: 314293 - DNA, 25 bp, Mus musculus
cagcaagcttagtgctctgtgtgtt

SEQ ID NO: 314294 - DNA, 25 bp, Mus musculus
cagcaagcttatatgtttgactgaa

SEQ ID NO: 314295 - DNA, 25 bp, Mus musculus
cagcaagcttatttgtttgactgaa

SEQ ID NO: 314296 - DNA, 25 bp, Mus musculus
cagcaagcttgacaggaacgtggaa

SEQ ID NO: 314297 - DNA, 25 bp, Mus musculus
cagcaagcttgagaggaacgtggaa

SEQ ID NO: 314298 - DNA, 25 bp, Mus musculus
cagcaaggacgccaagtgaagtcat

SEQ ID NO: 314299 - DNA, 25 bp, Mus musculus
cagcaaggacgcgaagtgaagtcat

SEQ ID NO: 314300 - DNA, 25 bp, Mus musculus
cagcaaggcgccagatcaccatgga

SEQ ID NO: 314301 - DNA, 25 bp, Mus musculus
cagcaaggcgcctgatcaccatgga

SEQ ID NO: 314302 - DNA, 25 bp, Mus musculus
cagcaaggcttgcagatgcacttca

SEQ ID NO: 314303 - DNA, 25 bp, Mus musculus
cagcaaggcttggagatgcacttca

SEQ ID NO: 314304 - DNA, 25 bp, Mus musculus
cagcaaggctttagggttccgagac

SEQ ID NO: 314305 - DNA, 25 bp, Mus musculus
cagcaaggcttttgggttccgagac

SEQ ID NO: 314306 - DNA, 25 bp, Mus musculus
cagcaagtacaccatgtctggtcgt

SEQ ID NO: 314307 - DNA, 25 bp, Mus musculus
cagcaagtacacgatgtctggtcgt

SEQ ID NO: 314308 - DNA, 25 bp, Mus musculus
cagcaagtagtcattttattctaat

SEQ ID NO: 314309 - DNA, 25 bp, Mus musculus
cagcaagtagtctttttattctaat

SEQ ID NO: 314310 - DNA, 25 bp, Mus musculus
cagcaagtccccattttattgagaa

SEQ ID NO: 314311 - DNA, 25 bp, Mus musculus
cagcaagtcccctttttattgagaa

SEQ ID NO: 314312 - DNA, 25 bp, Mus musculus
cagcaagtctatctatcactcctgg

SEQ ID NO: 314313 - DNA, 25 bp, Mus musculus
cagcaagtctatgtatcactcctgg

SEQ ID NO: 314314 - DNA, 25 bp, Mus musculus
cagcaagtctgcctgggagaagcct

SEQ ID NO: 314315 - DNA, 25 bp, Mus musculus
cagcaagtctgcgtgggagaagcct

SEQ ID NO: 314316 - DNA, 25 bp, Mus musculus
cagcaagtgcatccaaacctgtagt

SEQ ID NO: 314317 - DNA, 25 bp, Mus musculus
cagcaagtgcatgcaaacctgtagt

SEQ ID NO: 314318 - DNA, 25 bp, Mus musculus
cagcaagtgctgcagtactgaacca

SEQ ID NO: 314319 - DNA, 25 bp, Mus musculus
cagcaagtgctggagtactgaacca

SEQ ID NO: 314320 - DNA, 25 bp, Mus musculus
cagcaagtggccaatcaacagatgt

SEQ ID NO: 314321 - DNA, 25 bp, Mus musculus
cagcaagtggcctatcaacagatgt

SEQ ID NO: 314322 - DNA, 25 bp, Mus musculus
cagcaagtgttcatagcacccagtt

SEQ ID NO: 314323 - DNA, 25 bp, Mus musculus
cagcaagtgttcttagcacccagtt

SEQ ID NO: 314324 - DNA, 25 bp, Mus musculus
cagcaagttccaacgtgtcatcaag

SEQ ID NO: 314325 - DNA, 25 bp, Mus musculus
cagcaagttccatcgtgtcatcaag

SEQ ID NO: 314326 - DNA, 25 bp, Mus musculus
cagcaagttcctatccagatggtga

SEQ ID NO: 314327 - DNA, 25 bp, Mus musculus
cagcaagttcctttccagatggtga

SEQ ID NO: 314328 - DNA, 25 bp, Mus musculus
cagcaagttcttcggtcttgatgaa

SEQ ID NO: 314329 - DNA, 25 bp, Mus musculus
cagcaagttcttgggtcttgatgaa

SEQ ID NO: 314330 - DNA, 25 bp, Mus musculus
cagcaagtttgacgacggcttttct

SEQ ID NO: 314331 - DNA, 25 bp, Mus musculus
cagcaagtttgaggacggcttttct

SEQ ID NO: 314332 - DNA, 25 bp, Mus musculus
cagcaataactcattcatctggtat

SEQ ID NO: 314333 - DNA, 25 bp, Mus musculus
cagcaataactctttcatctggtat

SEQ ID NO: 314334 - DNA, 25 bp, Mus musculus
cagcaataatgtccccgctactggg

SEQ ID NO: 314335 - DNA, 25 bp, Mus musculus
cagcaataatgtgcccgctactggg

SEQ ID NO: 314336 - DNA, 25 bp, Mus musculus
cagcaatactgtctggatacatggg

SEQ ID NO: 314337 - DNA, 25 bp, Mus musculus
cagcaatactgtgtggatacatggg

SEQ ID NO: 314338 - DNA, 25 bp, Mus musculus
cagcaatataacagctatcctctca

SEQ ID NO: 314339 - DNA, 25 bp, Mus musculus
cagcaatataactgctatcctctca

SEQ ID NO: 314340 - DNA, 25 bp, Mus musculus
cagcaatatgcccagatctctaatt

SEQ ID NO: 314341 - DNA, 25 bp, Mus musculus
cagcaatatgccgagatctctaatt

SEQ ID NO: 314342 - DNA, 25 bp, Mus musculus
cagcaatccttcaccttgtagtgta

SEQ ID NO: 314343 - DNA, 25 bp, Mus musculus
cagcaatccttctccttgtagtgta

SEQ ID NO: 314344 - DNA, 25 bp, Mus musculus
cagcaatctgcccaccatgcaagga

SEQ ID NO: 314345 - DNA, 25 bp, Mus musculus
cagcaatctgccgaccatgcaagga

SEQ ID NO: 314346 - DNA, 25 bp, Mus musculus
cagcaatgacctctttatgtgttga

SEQ ID NO: 314347 - DNA, 25 bp, Mus musculus
cagcaatgacctgtttatgtgttga

SEQ ID NO: 314348 - DNA, 25 bp, Mus musculus
cagcaatgaggacacagctaatggg

SEQ ID NO: 314349 - DNA, 25 bp, Mus musculus
cagcaatgaggagacagctaatggg

SEQ ID NO: 314350 - DNA, 25 bp, Mus musculus
cagcaatggcctcggacctaaaggt

SEQ ID NO: 314351 - DNA, 25 bp, Mus musculus
cagcaatggcctgggacctaaaggt

SEQ ID NO: 314352 - DNA, 25 bp, Mus musculus
cagcaatggctcagctaggtcagct

SEQ ID NO: 314353 - DNA, 25 bp, Mus musculus
cagcaatggctctgctaggtcagct

SEQ ID NO: 314354 - DNA, 25 bp, Mus musculus
cagcaatgtgcaaaacccaaggtta

SEQ ID NO: 314355 - DNA, 25 bp, Mus musculus
cagcaatgtgcataacccaaggtta

SEQ ID NO: 314356 - DNA, 25 bp, Mus musculus
cagcaatgtgcccagtgttcatttt

SEQ ID NO: 314357 - DNA, 25 bp, Mus musculus
cagcaatgtgccgagtgttcatttt

SEQ ID NO: 314358 - DNA, 25 bp, Mus musculus
cagcaattatagaccagttccaggg

SEQ ID NO: 314359 - DNA, 25 bp, Mus musculus
cagcaattatagtccagttccaggg

SEQ ID NO: 314360 - DNA, 25 bp, Mus musculus
cagcaattcctgattatgactcttg

SEQ ID NO: 314361 - DNA, 25 bp, Mus musculus
cagcaattcctgtttatgactcttg

SEQ ID NO: 314362 - DNA, 25 bp, Mus musculus
cagcaattgggaacctcgggcagtt

SEQ ID NO: 314363 - DNA, 25 bp, Mus musculus
cagcaattgggatcctcgggcagtt

SEQ ID NO: 314364 - DNA, 25 bp, Mus musculus
cagcaatttaggcactgtcactttt

SEQ ID NO: 314365 - DNA, 25 bp, Mus musculus
cagcaatttagggactgtcactttt

SEQ ID NO: 314366 - DNA, 25 bp, Mus musculus
cagcaatttccgagagttttactat

SEQ ID NO: 314367 - DNA, 25 bp, Mus musculus
cagcaatttccgtgagttttactat

SEQ ID NO: 314368 - DNA, 25 bp, Mus musculus
cagcacaaaggcctatgtttattct

SEQ ID NO: 314369 - DNA, 25 bp, Mus musculus
cagcacaaaggcgtatgtttattct

SEQ ID NO: 314370 - DNA, 25 bp, Mus musculus
cagcacaactgtaattcggtcaccg

SEQ ID NO: 314371 - DNA, 25 bp, Mus musculus
cagcacaactgttattcggtcaccg

SEQ ID NO: 314372 - DNA, 25 bp, Mus musculus
cagcacaaggctaacccagagggat

SEQ ID NO: 314373 - DNA, 25 bp, Mus musculus
cagcacaaggctagatgttgttttc

SEQ ID NO: 314374 - DNA, 25 bp, Mus musculus
cagcacaaggcttacccagagggat

SEQ ID NO: 314375 - DNA, 25 bp, Mus musculus
cagcacaaggcttgatgttgttttc

SEQ ID NO: 314376 - DNA, 25 bp, Mus musculus
cagcacacacagcacggatgagcgt

SEQ ID NO: 314377 - DNA, 25 bp, Mus musculus
cagcacacacaggacggatgagcgt

SEQ ID NO: 314378 - DNA, 25 bp, Mus musculus
cagcacacacatcctgtgggaagat

SEQ ID NO: 314379 - DNA, 25 bp, Mus musculus
cagcacacacatgctgtgggaagat

SEQ ID NO: 314380 - DNA, 25 bp, Mus musculus
cagcacacacctcgcagttcacagc

SEQ ID NO: 314381 - DNA, 25 bp, Mus musculus
cagcacacacctggcagttcacagc

SEQ ID NO: 314382 - DNA, 25 bp, Mus musculus
cagcacacagagatccatctaaaac

SEQ ID NO: 314383 - DNA, 25 bp, Mus musculus
cagcacacagagttccatctaaaac

SEQ ID NO: 314384 - DNA, 25 bp, Mus musculus
cagcacacagtgaacctagaaggat

SEQ ID NO: 314385 - DNA, 25 bp, Mus musculus
cagcacacagtgtacctagaaggat

SEQ ID NO: 314386 - DNA, 25 bp, Mus musculus
cagcacacatttcaccttagacaag

SEQ ID NO: 314387 - DNA, 25 bp, Mus musculus
cagcacacatttgaccttagacaag

SEQ ID NO: 314388 - DNA, 25 bp, Mus musculus
cagcacaccaccagcaatacagaat

SEQ ID NO: 314389 - DNA, 25 bp, Mus musculus
cagcacaccacctgcaatacagaat

SEQ ID NO: 314390 - DNA, 25 bp, Mus musculus
cagcacacctccatacaagttgaag

SEQ ID NO: 314391 - DNA, 25 bp, Mus musculus
cagcacacctccttacaagttgaag

SEQ ID NO: 314392 - DNA, 25 bp, Mus musculus
cagcacactggcaaagtacacttaa

SEQ ID NO: 314393 - DNA, 25 bp, Mus musculus
cagcacactggctaagtacacttaa

SEQ ID NO: 314394 - DNA, 25 bp, Mus musculus
cagcacagaactcggcatgtaccag

SEQ ID NO: 314395 - DNA, 25 bp, Mus musculus
cagcacagaactgggcatgtaccag

SEQ ID NO: 314396 - DNA, 25 bp, Mus musculus
cagcacagagcacacggtagtctct

SEQ ID NO: 314397 - DNA, 25 bp, Mus musculus
cagcacagagcagacggtagtctct

SEQ ID NO: 314398 - DNA, 25 bp, Mus musculus
cagcacagcaggatttggagttcat

SEQ ID NO: 314399 - DNA, 25 bp, Mus musculus
cagcacagcaggttttggagttcat

SEQ ID NO: 314400 - DNA, 25 bp, Mus musculus
cagcacagctgccaagtcctttgag

SEQ ID NO: 314401 - DNA, 25 bp, Mus musculus
cagcacagctgcgaagtcctttgag

SEQ ID NO: 314402 - DNA, 25 bp, Mus musculus
cagcacagtaggcagcttccgctca

SEQ ID NO: 314403 - DNA, 25 bp, Mus musculus
cagcacagtagggagcttccgctca

SEQ ID NO: 314404 - DNA, 25 bp, Mus musculus
cagcacagtgtcaagggtctcgatt

SEQ ID NO: 314405 - DNA, 25 bp, Mus musculus
cagcacagtgtctagggtctcgatt

SEQ ID NO: 314406 - DNA, 25 bp, Mus musculus
cagcacagttttagagtccaccatt

SEQ ID NO: 314407 - DNA, 25 bp, Mus musculus
cagcacagtttttgagtccaccatt

SEQ ID NO: 314408 - DNA, 25 bp, Mus musculus
cagcacatcattacccctttgtgtg

SEQ ID NO: 314409 - DNA, 25 bp, Mus musculus
cagcacatcatttcccctttgtgtg

SEQ ID NO: 314410 - DNA, 25 bp, Mus musculus
cagcacatccaaaactaccactaga

SEQ ID NO: 314411 - DNA, 25 bp, Mus musculus
cagcacatccaatactaccactaga

SEQ ID NO: 314412 - DNA, 25 bp, Mus musculus
cagcacatccctcaagagcactggg

SEQ ID NO: 314413 - DNA, 25 bp, Mus musculus
cagcacatccctgaagagcactggg

SEQ ID NO: 314414 - DNA, 25 bp, Mus musculus
cagcacatcggtctcaaatgaggaa

SEQ ID NO: 314415 - DNA, 25 bp, Mus musculus
cagcacatcggtgtcaaatgaggaa

SEQ ID NO: 314416 - DNA, 25 bp, Mus musculus
cagcacatgccaagtttcaggagga

SEQ ID NO: 314417 - DNA, 25 bp, Mus musculus
cagcacatgccatgtttcaggagga

SEQ ID NO: 314418 - DNA, 25 bp, Mus musculus
cagcacatgcttagactatgacttt

SEQ ID NO: 314419 - DNA, 25 bp, Mus musculus
cagcacatgctttgactatgacttt

SEQ ID NO: 314420 - DNA, 25 bp, Mus musculus
cagcacatggcgctcctgaggagtc

SEQ ID NO: 314421 - DNA, 25 bp, Mus musculus
cagcacatggcggtcctgaggagtc

SEQ ID NO: 314422 - DNA, 25 bp, Mus musculus
cagcacattagtaagatcctcagat

SEQ ID NO: 314423 - DNA, 25 bp, Mus musculus
cagcacattagttagatcctcagat

SEQ ID NO: 314424 - DNA, 25 bp, Mus musculus
cagcacattctcagtacccagtgct

SEQ ID NO: 314425 - DNA, 25 bp, Mus musculus
cagcacattctctgtacccagtgct

SEQ ID NO: 314426 - DNA, 25 bp, Mus musculus
cagcacattgtacatattccaggca

SEQ ID NO: 314427 - DNA, 25 bp, Mus musculus
cagcacattgtagatattccaggca

SEQ ID NO: 314428 - DNA, 25 bp, Mus musculus
cagcacatttgtaacatggttttta

SEQ ID NO: 314429 - DNA, 25 bp, Mus musculus
cagcacatttgttacatggttttta

SEQ ID NO: 314430 - DNA, 25 bp, Mus musculus
cagcacattttgactgaatacttga

SEQ ID NO: 314431 - DNA, 25 bp, Mus musculus
cagcacattttgtctgaatacttga

SEQ ID NO: 314432 - DNA, 25 bp, Mus musculus
cagcacatttttcgctgggatgcca

SEQ ID NO: 314433 - DNA, 25 bp, Mus musculus
cagcacatttttggctgggatgcca

SEQ ID NO: 314434 - DNA, 25 bp, Mus musculus
cagcaccaactccacggaggtggat

SEQ ID NO: 314435 - DNA, 25 bp, Mus musculus
cagcaccaactcgacggaggtggat

SEQ ID NO: 314436 - DNA, 25 bp, Mus musculus
cagcaccaatgtcaagaggctccct

SEQ ID NO: 314437 - DNA, 25 bp, Mus musculus
cagcaccaatgtgaagaggctccct

SEQ ID NO: 314438 - DNA, 25 bp, Mus musculus
cagcaccacgtaagatggcaccagt

SEQ ID NO: 314439 - DNA, 25 bp, Mus musculus
cagcaccacgtatgatggcaccagt

SEQ ID NO: 314440 - DNA, 25 bp, Mus musculus
cagcaccactcaagaccaaatggaa

SEQ ID NO: 314441 - DNA, 25 bp, Mus musculus
cagcaccactcatgaccaaatggaa

SEQ ID NO: 314442 - DNA, 25 bp, Mus musculus
cagcaccagaatcccagcttggtga

SEQ ID NO: 314443 - DNA, 25 bp, Mus musculus
cagcaccagaatgccagcttggtga

SEQ ID NO: 314444 - DNA, 25 bp, Mus musculus
cagcaccagagactgcagtttccct

SEQ ID NO: 314445 - DNA, 25 bp, Mus musculus
cagcaccagagagtgcagtttccct

SEQ ID NO: 314446 - DNA, 25 bp, Mus musculus
cagcaccaggtgactctggaacatt

SEQ ID NO: 314447 - DNA, 25 bp, Mus musculus
cagcaccaggtgtctctggaacatt

SEQ ID NO: 314448 - DNA, 25 bp, Mus musculus
cagcaccagtggatccagacaatcc

SEQ ID NO: 314449 - DNA, 25 bp, Mus musculus
cagcaccagtggttccagacaatcc

SEQ ID NO: 314450 - DNA, 25 bp, Mus musculus
cagcaccatagcattgcgcttaaga

SEQ ID NO: 314451 - DNA, 25 bp, Mus musculus
cagcaccatagctttgcgcttaaga

SEQ ID NO: 314452 - DNA, 25 bp, Mus musculus
cagcacccacggatccatggcttgt

SEQ ID NO: 314453 - DNA, 25 bp, Mus musculus
cagcacccacggttccatggcttgt

SEQ ID NO: 314454 - DNA, 25 bp, Mus musculus
cagcacccaggtactttgctgatga

SEQ ID NO: 314455 - DNA, 25 bp, Mus musculus
cagcacccaggttctttgctgatga

SEQ ID NO: 314456 - DNA, 25 bp, Mus musculus
cagcaccccagtaaggagactgatg

SEQ ID NO: 314457 - DNA, 25 bp, Mus musculus
cagcaccccagttaggagactgatg

SEQ ID NO: 314458 - DNA, 25 bp, Mus musculus
cagcacccggctacctgaggacatg

SEQ ID NO: 314459 - DNA, 25 bp, Mus musculus
cagcacccggcttcctgaggacatg

SEQ ID NO: 314460 - DNA, 25 bp, Mus musculus
cagcaccctgcgcaacttgttcaag

SEQ ID NO: 314461 - DNA, 25 bp, Mus musculus
cagcaccctgcggaacttgttcaag

SEQ ID NO: 314462 - DNA, 25 bp, Mus musculus
cagcaccctgctagtggaaatagaa

SEQ ID NO: 314463 - DNA, 25 bp, Mus musculus
cagcaccctgcttgtggaaatagaa

SEQ ID NO: 314464 - DNA, 25 bp, Mus musculus
cagcaccctgtaaggcttttcagag

SEQ ID NO: 314465 - DNA, 25 bp, Mus musculus
cagcaccctgtatggcttttcagag

SEQ ID NO: 314466 - DNA, 25 bp, Mus musculus
cagcaccgatggcattccctttgcc

SEQ ID NO: 314467 - DNA, 25 bp, Mus musculus
cagcaccgatgggattccctttgcc

SEQ ID NO: 314468 - DNA, 25 bp, Mus musculus
cagcaccgattgctcagcaaaagct

SEQ ID NO: 314469 - DNA, 25 bp, Mus musculus
cagcaccgattggtcagcaaaagct

SEQ ID NO: 314470 - DNA, 25 bp, Mus musculus
cagcaccgcaccaaatgctaagtga

SEQ ID NO: 314471 - DNA, 25 bp, Mus musculus
cagcaccgcacctaatgctaagtga

SEQ ID NO: 314472 - DNA, 25 bp, Mus musculus
cagcaccgcctgaagttactaatgt

SEQ ID NO: 314473 - DNA, 25 bp, Mus musculus
cagcaccgcctgtagttactaatgt

SEQ ID NO: 314474 - DNA, 25 bp, Mus musculus
cagcaccgctcaaaagttggacatt

SEQ ID NO: 314475 - DNA, 25 bp, Mus musculus
cagcaccgctcataagttggacatt

SEQ ID NO: 314476 - DNA, 25 bp, Mus musculus
cagcaccgctcgcagtattttgagg

SEQ ID NO: 314477 - DNA, 25 bp, Mus musculus
cagcaccgctcggagtattttgagg

SEQ ID NO: 314478 - DNA, 25 bp, Mus musculus
cagcaccggaagctcactgggatga

SEQ ID NO: 314479 - DNA, 25 bp, Mus musculus
cagcaccggaaggtcactgggatga

SEQ ID NO: 314480 - DNA, 25 bp, Mus musculus
cagcaccgggatattgtgtgtacct

SEQ ID NO: 314481 - DNA, 25 bp, Mus musculus
cagcaccgggattttgtgtgtacct

SEQ ID NO: 314482 - DNA, 25 bp, Mus musculus
cagcaccgtggtcagctccaaagaa

SEQ ID NO: 314483 - DNA, 25 bp, Mus musculus
cagcaccgtggtgagctccaaagaa

SEQ ID NO: 314484 - DNA, 25 bp, Mus musculus
cagcacctactcaatcttgtgtgat

SEQ ID NO: 314485 - DNA, 25 bp, Mus musculus
cagcacctactctatcttgtgtgat

SEQ ID NO: 314486 - DNA, 25 bp, Mus musculus
cagcacctactgagggcttagtgat

SEQ ID NO: 314487 - DNA, 25 bp, Mus musculus
cagcacctactgtgggcttagtgat

SEQ ID NO: 314488 - DNA, 25 bp, Mus musculus
cagcacctcatgcattcaagatcaa

SEQ ID NO: 314489 - DNA, 25 bp, Mus musculus
cagcacctcatggattcaagatcaa

SEQ ID NO: 314490 - DNA, 25 bp, Mus musculus
cagcacctggtgactggtaatgaag

SEQ ID NO: 314491 - DNA, 25 bp, Mus musculus
cagcacctggtgtctggtaatgaag

SEQ ID NO: 314492 - DNA, 25 bp, Mus musculus
cagcaccttcacagcctgaaaatag

SEQ ID NO: 314493 - DNA, 25 bp, Mus musculus
cagcaccttcactgcctgaaaatag

SEQ ID NO: 314494 - DNA, 25 bp, Mus musculus
cagcaccttccccttctagcataca

SEQ ID NO: 314495 - DNA, 25 bp, Mus musculus
cagcaccttcccgttctagcataca

SEQ ID NO: 314496 - DNA, 25 bp, Mus musculus
cagcaccttctaaagggcagcaagc

SEQ ID NO: 314497 - DNA, 25 bp, Mus musculus
cagcaccttctatagggcagcaagc

SEQ ID NO: 314498 - DNA, 25 bp, Mus musculus
cagcaccttgaactctctggaagag

SEQ ID NO: 314499 - DNA, 25 bp, Mus musculus
cagcaccttgaagtctctggaagag

SEQ ID NO: 314500 - DNA, 25 bp, Mus musculus
cagcacgacccaaagtgacattggt

SEQ ID NO: 314501 - DNA, 25 bp, Mus musculus
cagcacgacccatagtgacattggt

SEQ ID NO: 314502 - DNA, 25 bp, Mus musculus
cagcacgatcgtccccaggagcaga

SEQ ID NO: 314503 - DNA, 25 bp, Mus musculus
cagcacgatcgtgcccaggagcaga

SEQ ID NO: 314504 - DNA, 25 bp, Mus musculus
cagcacgcatatcggcagcagagtt

SEQ ID NO: 314505 - DNA, 25 bp, Mus musculus
cagcacgcatatgggcagcagagtt

SEQ ID NO: 314506 - DNA, 25 bp, Mus musculus
cagcacggtcctaccgggagaagca

SEQ ID NO: 314507 - DNA, 25 bp, Mus musculus
cagcacggtccttccgggagaagca

SEQ ID NO: 314508 - DNA, 25 bp, Mus musculus
cagcacggttggcatcgatttcaaa

SEQ ID NO: 314509 - DNA, 25 bp, Mus musculus
cagcacggttgggatcgatttcaaa

SEQ ID NO: 314510 - DNA, 25 bp, Mus musculus
cagcacgtatctaggttatggtttc

SEQ ID NO: 314511 - DNA, 25 bp, Mus musculus
cagcacgtatcttggttatggtttc

SEQ ID NO: 314512 - DNA, 25 bp, Mus musculus
cagcacgtgtacattttcctttggg

SEQ ID NO: 314513 - DNA, 25 bp, Mus musculus
cagcacgtgtactttttcctttggg

SEQ ID NO: 314514 - DNA, 25 bp, Mus musculus
cagcacgtgtctccagaaaagcgtg

SEQ ID NO: 314515 - DNA, 25 bp, Mus musculus
cagcacgtgtctgcagaaaagcgtg

SEQ ID NO: 314516 - DNA, 25 bp, Mus musculus
cagcacgtgttcctcactagaagaa

SEQ ID NO: 314517 - DNA, 25 bp, Mus musculus
cagcacgtgttcgtcactagaagaa

SEQ ID NO: 314518 - DNA, 25 bp, Mus musculus
cagcacgttgctctcgattaagacc

SEQ ID NO: 314519 - DNA, 25 bp, Mus musculus
cagcacgttgctgtcgattaagacc

SEQ ID NO: 314520 - DNA, 25 bp, Mus musculus
cagcactaatacactactttctaaa

SEQ ID NO: 314521 - DNA, 25 bp, Mus musculus
cagcactaatactctactttctaaa

SEQ ID NO: 314522 - DNA, 25 bp, Mus musculus
cagcactacacccatcaagttcaaa

SEQ ID NO: 314523 - DNA, 25 bp, Mus musculus
cagcactacaccgatcaagttcaaa

SEQ ID NO: 314524 - DNA, 25 bp, Mus musculus
cagcactagcaactgtgtgttttta

SEQ ID NO: 314525 - DNA, 25 bp, Mus musculus
cagcactagcaagtgtgtgttttta

SEQ ID NO: 314526 - DNA, 25 bp, Mus musculus
cagcactagggtatgtttgtcctct

SEQ ID NO: 314527 - DNA, 25 bp, Mus musculus
cagcactagggtttgtttgtcctct

SEQ ID NO: 314528 - DNA, 25 bp, Mus musculus
cagcactcacaaagctgagactggc

SEQ ID NO: 314529 - DNA, 25 bp, Mus musculus
cagcactcacaatgctgagactggc

SEQ ID NO: 314530 - DNA, 25 bp, Mus musculus
cagcactccccaattgatatattgg

SEQ ID NO: 314531 - DNA, 25 bp, Mus musculus
cagcactccccatttgatatattgg

SEQ ID NO: 314532 - DNA, 25 bp, Mus musculus
cagcactcctagcacagaagggcga

SEQ ID NO: 314533 - DNA, 25 bp, Mus musculus
cagcactcctaggacagaagggcga

SEQ ID NO: 314534 - DNA, 25 bp, Mus musculus
cagcactctgctcactcttatagaa

SEQ ID NO: 314535 - DNA, 25 bp, Mus musculus
cagcactctgctgactcttatagaa

SEQ ID NO: 314536 - DNA, 25 bp, Mus musculus
cagcactgactgaaaggcatgttta

SEQ ID NO: 314537 - DNA, 25 bp, Mus musculus
cagcactgactgtaaggcatgttta

SEQ ID NO: 314538 - DNA, 25 bp, Mus musculus
cagcactgagctcactgcatgtata

SEQ ID NO: 314539 - DNA, 25 bp, Mus musculus
cagcactgagctgactgcatgtata

SEQ ID NO: 314540 - DNA, 25 bp, Mus musculus
cagcactgaggtcattccatttagg

SEQ ID NO: 314541 - DNA, 25 bp, Mus musculus
cagcactgaggtgattccatttagg

SEQ ID NO: 314542 - DNA, 25 bp, Mus musculus
cagcactgcatgagcttcaaagtgt

SEQ ID NO: 314543 - DNA, 25 bp, Mus musculus
cagcactgcatgtgcttcaaagtgt

SEQ ID NO: 314544 - DNA, 25 bp, Mus musculus
cagcactgcggtctgcaggttgatt

SEQ ID NO: 314545 - DNA, 25 bp, Mus musculus
cagcactgcggtgtgcaggttgatt

SEQ ID NO: 314546 - DNA, 25 bp, Mus musculus
cagcactgctacataactacctata

SEQ ID NO: 314547 - DNA, 25 bp, Mus musculus
cagcactgctacttaactacctata

SEQ ID NO: 314548 - DNA, 25 bp, Mus musculus
cagcactgctccctacagtaggaca

SEQ ID NO: 314549 - DNA, 25 bp, Mus musculus
cagcactgctccgtacagtaggaca

SEQ ID NO: 314550 - DNA, 25 bp, Mus musculus
cagcactggcacaaaggatgacctt

SEQ ID NO: 314551 - DNA, 25 bp, Mus musculus
cagcactggcactaaggatgacctt

SEQ ID NO: 314552 - DNA, 25 bp, Mus musculus
cagcactggctcctgaagaattggg

SEQ ID NO: 314553 - DNA, 25 bp, Mus musculus
cagcactggctcgtgaagaattggg

SEQ ID NO: 314554 - DNA, 25 bp, Mus musculus
cagcactgggtaccgaggacaatag

SEQ ID NO: 314555 - DNA, 25 bp, Mus musculus
cagcactgggtagcgaggacaatag

SEQ ID NO: 314556 - DNA, 25 bp, Mus musculus
cagcactggtttcggccacagtctt

SEQ ID NO: 314557 - DNA, 25 bp, Mus musculus
cagcactggtttgggccacagtctt

SEQ ID NO: 314558 - DNA, 25 bp, Mus musculus
cagcactgtgttctgcagagttcaa

SEQ ID NO: 314559 - DNA, 25 bp, Mus musculus
cagcactgtgttgtgcagagttcaa

SEQ ID NO: 314560 - DNA, 25 bp, Mus musculus
cagcactgttctcaggctgctcttg

SEQ ID NO: 314561 - DNA, 25 bp, Mus musculus
cagcactgttctgaggctgctcttg

SEQ ID NO: 314562 - DNA, 25 bp, Mus musculus
cagcactgttgcattgtttctgttg

SEQ ID NO: 314563 - DNA, 25 bp, Mus musculus
cagcactgttgctttgtttctgttg

SEQ ID NO: 314564 - DNA, 25 bp, Mus musculus
cagcacttcaacactgtagtctgtt

SEQ ID NO: 314565 - DNA, 25 bp, Mus musculus
cagcacttcaactctgtagtctgtt

SEQ ID NO: 314566 - DNA, 25 bp, Mus musculus
cagcacttctgtccctggaagagat

SEQ ID NO: 314567 - DNA, 25 bp, Mus musculus
cagcacttctgtgcctggaagagat

SEQ ID NO: 314568 - DNA, 25 bp, Mus musculus
cagcacttgagcaggaggaacgcag

SEQ ID NO: 314569 - DNA, 25 bp, Mus musculus
cagcacttgagctggaggaacgcag

SEQ ID NO: 314570 - DNA, 25 bp, Mus musculus
cagcacttgctgaagatcatcatgt

SEQ ID NO: 314571 - DNA, 25 bp, Mus musculus
cagcacttgctgtagatcatcatgt

SEQ ID NO: 314572 - DNA, 25 bp, Mus musculus
cagcacttggagaatgcaggcaaag

SEQ ID NO: 314573 - DNA, 25 bp, Mus musculus
cagcacttggagtatgcaggcaaag

SEQ ID NO: 314574 - DNA, 25 bp, Mus musculus
cagcacttgggacatcgatgctgga

SEQ ID NO: 314575 - DNA, 25 bp, Mus musculus
cagcacttgggagatcgatgctgga

SEQ ID NO: 314576 - DNA, 25 bp, Mus musculus
cagcactttattaccgccatgagtg

SEQ ID NO: 314577 - DNA, 25 bp, Mus musculus
cagcactttatttccgccatgagtg

SEQ ID NO: 314578 - DNA, 25 bp, Mus musculus
cagcactttcttctctatgtatgtg

SEQ ID NO: 314579 - DNA, 25 bp, Mus musculus
cagcactttcttgtctatgtatgtg

SEQ ID NO: 314580 - DNA, 25 bp, Mus musculus
cagcactttgcgctcaatggacttt

SEQ ID NO: 314581 - DNA, 25 bp, Mus musculus
cagcactttgcggtcaatggacttt

SEQ ID NO: 314582 - DNA, 25 bp, Mus musculus
cagcactttggtccagcaagggcag

SEQ ID NO: 314583 - DNA, 25 bp, Mus musculus
cagcactttggtgcagcaagggcag

SEQ ID NO: 314584 - DNA, 25 bp, Mus musculus
cagcactttttaaccctcccaggaa

SEQ ID NO: 314585 - DNA, 25 bp, Mus musculus
cagcactttttatccctcccaggaa

SEQ ID NO: 314586 - DNA, 25 bp, Mus musculus
cagcagaaacttatgagtcagggac

SEQ ID NO: 314587 - DNA, 25 bp, Mus musculus
cagcagaaacttttgagtcagggac

SEQ ID NO: 314588 - DNA, 25 bp, Mus musculus
cagcagaaatatcggctgctccctt

SEQ ID NO: 314589 - DNA, 25 bp, Mus musculus
cagcagaaatatgggctgctccctt

SEQ ID NO: 314590 - DNA, 25 bp, Mus musculus
cagcagaaatgtccatccaaaagca

SEQ ID NO: 314591 - DNA, 25 bp, Mus musculus
cagcagaaatgtgcatccaaaagca

SEQ ID NO: 314592 - DNA, 25 bp, Mus musculus
cagcagaacgttagtgagtctcaca

SEQ ID NO: 314593 - DNA, 25 bp, Mus musculus
cagcagaacgtttgtgagtctcaca

SEQ ID NO: 314594 - DNA, 25 bp, Mus musculus
cagcagaagattcccttcctgggag

SEQ ID NO: 314595 - DNA, 25 bp, Mus musculus
cagcagaagattgccttcctgggag

SEQ ID NO: 314596 - DNA, 25 bp, Mus musculus
cagcagaagctgcagttcgatcact

SEQ ID NO: 314597 - DNA, 25 bp, Mus musculus
cagcagaagctggagttcgatcact

SEQ ID NO: 314598 - DNA, 25 bp, Mus musculus
cagcagaagtctcatggaacccaga

SEQ ID NO: 314599 - DNA, 25 bp, Mus musculus
cagcagaagtctgatggaacccaga

SEQ ID NO: 314600 - DNA, 25 bp, Mus musculus
cagcagacatagacattgacccatc

SEQ ID NO: 314601 - DNA, 25 bp, Mus musculus
cagcagacatagtcattgacccatc

SEQ ID NO: 314602 - DNA, 25 bp, Mus musculus
cagcagacatctcaagtttccagca

SEQ ID NO: 314603 - DNA, 25 bp, Mus musculus
cagcagacatctgaagtttccagca

SEQ ID NO: 314604 - DNA, 25 bp, Mus musculus
cagcagaccatgagttcgcgggatg

SEQ ID NO: 314605 - DNA, 25 bp, Mus musculus
cagcagaccatgtgttcgcgggatg

SEQ ID NO: 314606 - DNA, 25 bp, Mus musculus
cagcagacgacacgctcctggtcag

SEQ ID NO: 314607 - DNA, 25 bp, Mus musculus
cagcagacgacaggctcctggtcag

SEQ ID NO: 314608 - DNA, 25 bp, Mus musculus
cagcagacgtgcagtgctaagatca

SEQ ID NO: 314609 - DNA, 25 bp, Mus musculus
cagcagacgtgctgtgctaagatca

SEQ ID NO: 314610 - DNA, 25 bp, Mus musculus
cagcagagaccaccgggccttcttt

SEQ ID NO: 314611 - DNA, 25 bp, Mus musculus
cagcagagaccagcgggccttcttt

SEQ ID NO: 314612 - DNA, 25 bp, Mus musculus
cagcagagaggcaccttggagctta

SEQ ID NO: 314613 - DNA, 25 bp, Mus musculus
cagcagagaggctccttggagctta

SEQ ID NO: 314614 - DNA, 25 bp, Mus musculus
cagcagagatgtcggcgaggctgat

SEQ ID NO: 314615 - DNA, 25 bp, Mus musculus
cagcagagatgtgggcgaggctgat

SEQ ID NO: 314616 - DNA, 25 bp, Mus musculus
cagcagagccagcttggaaggcagt

SEQ ID NO: 314617 - DNA, 25 bp, Mus musculus
cagcagagccaggttggaaggcagt

SEQ ID NO: 314618 - DNA, 25 bp, Mus musculus
cagcagagcgtaaacaggcttttat

SEQ ID NO: 314619 - DNA, 25 bp, Mus musculus
cagcagagcgtatacaggcttttat

SEQ ID NO: 314620 - DNA, 25 bp, Mus musculus
cagcagaggaccatctgtgctgtga

SEQ ID NO: 314621 - DNA, 25 bp, Mus musculus
cagcagaggaccttctgtgctgtga

SEQ ID NO: 314622 - DNA, 25 bp, Mus musculus
cagcagaggcagcttttcctcaccc

SEQ ID NO: 314623 - DNA, 25 bp, Mus musculus
cagcagaggcaggttttcctcaccc

SEQ ID NO: 314624 - DNA, 25 bp, Mus musculus
cagcagagtgagcatctttggagaa

SEQ ID NO: 314625 - DNA, 25 bp, Mus musculus
cagcagagtgaggatctttggagaa

SEQ ID NO: 314626 - DNA, 25 bp, Mus musculus
cagcagagttagagagacaccaggc

SEQ ID NO: 314627 - DNA, 25 bp, Mus musculus
cagcagagttagtgagacaccaggc

SEQ ID NO: 314628 - DNA, 25 bp, Mus musculus
cagcagatacagcatgtcacagtta

SEQ ID NO: 314629 - DNA, 25 bp, Mus musculus
cagcagatacaggatgtcacagtta

SEQ ID NO: 314630 - DNA, 25 bp, Mus musculus
cagcagatattaaaggacagtctta

SEQ ID NO: 314631 - DNA, 25 bp, Mus musculus
cagcagatattataggacagtctta

SEQ ID NO: 314632 - DNA, 25 bp, Mus musculus
cagcagatccacctgcaggagaaga

SEQ ID NO: 314633 - DNA, 25 bp, Mus musculus
cagcagatccacgtgcaggagaaga

SEQ ID NO: 314634 - DNA, 25 bp, Mus musculus
cagcagatgcatatccttgcagttt

SEQ ID NO: 314635 - DNA, 25 bp, Mus musculus
cagcagatgcatttccttgcagttt

SEQ ID NO: 314636 - DNA, 25 bp, Mus musculus
cagcagatgggaagacgtactatta

SEQ ID NO: 314637 - DNA, 25 bp, Mus musculus
cagcagatgggatgacgtactatta

SEQ ID NO: 314638 - DNA, 25 bp, Mus musculus
cagcagattccacaatatggcccag

SEQ ID NO: 314639 - DNA, 25 bp, Mus musculus
cagcagattccagaatatggcccag

SEQ ID NO: 314640 - DNA, 25 bp, Mus musculus
cagcagattcgcctacagcagcagg

SEQ ID NO: 314641 - DNA, 25 bp, Mus musculus
cagcagattcgcgtacagcagcagg

SEQ ID NO: 314642 - DNA, 25 bp, Mus musculus
cagcagattcggagatgaaccgcct

SEQ ID NO: 314643 - DNA, 25 bp, Mus musculus
cagcagattcggtgatgaaccgcct

SEQ ID NO: 314644 - DNA, 25 bp, Mus musculus
cagcagcaaaccatgatgagacccc

SEQ ID NO: 314645 - DNA, 25 bp, Mus musculus
cagcagcaaaccttgatgagacccc

SEQ ID NO: 314646 - DNA, 25 bp, Mus musculus
cagcagcaacacaggcactggtggg

SEQ ID NO: 314647 - DNA, 25 bp, Mus musculus
cagcagcaacactggcactggtggg

SEQ ID NO: 314648 - DNA, 25 bp, Mus musculus
cagcagcaagctcggagtgacgtaa

SEQ ID NO: 314649 - DNA, 25 bp, Mus musculus
cagcagcaagctgggagtgacgtaa

SEQ ID NO: 314650 - DNA, 25 bp, Mus musculus
cagcagcaaggccaggagcagtacc

SEQ ID NO: 314651 - DNA, 25 bp, Mus musculus
cagcagcaaggcgaggagcagtacc

SEQ ID NO: 314652 - DNA, 25 bp, Mus musculus
cagcagcaagttatccgtgggtttt

SEQ ID NO: 314653 - DNA, 25 bp, Mus musculus
cagcagcaagttttccgtgggtttt

SEQ ID NO: 314654 - DNA, 25 bp, Mus musculus
cagcagcaatggcatgatccaaaga

SEQ ID NO: 314655 - DNA, 25 bp, Mus musculus
cagcagcaatgggatgatccaaaga

SEQ ID NO: 314656 - DNA, 25 bp, Mus musculus
cagcagcacaaaaaggcccctagac

SEQ ID NO: 314657 - DNA, 25 bp, Mus musculus
cagcagcacaaataggcccctagac

SEQ ID NO: 314658 - DNA, 25 bp, Mus musculus
cagcagcacagtaacttagaattgg

SEQ ID NO: 314659 - DNA, 25 bp, Mus musculus
cagcagcacagttacttagaattgg

SEQ ID NO: 314660 - DNA, 25 bp, Mus musculus
cagcagcacctgagagagtaggaaa

SEQ ID NO: 314661 - DNA, 25 bp, Mus musculus
cagcagcacctgtgagagtaggaaa

SEQ ID NO: 314662 - DNA, 25 bp, Mus musculus
cagcagcactaccaccctgaggtgt

SEQ ID NO: 314663 - DNA, 25 bp, Mus musculus
cagcagcactacgaccctgaggtgt

SEQ ID NO: 314664 - DNA, 25 bp, Mus musculus
cagcagcagatgcaaagcctaagct

SEQ ID NO: 314665 - DNA, 25 bp, Mus musculus
cagcagcagatggaaagcctaagct

SEQ ID NO: 314666 - DNA, 25 bp, Mus musculus
cagcagcagcgcatgcttcgggagc

SEQ ID NO: 314667 - DNA, 25 bp, Mus musculus
cagcagcagcgcttgcttcgggagc

SEQ ID NO: 314668 - DNA, 25 bp, Mus musculus
cagcagcagcggctgacagaacaat

SEQ ID NO: 314669 - DNA, 25 bp, Mus musculus
cagcagcagcgggtgacagaacaat

SEQ ID NO: 314670 - DNA, 25 bp, Mus musculus
cagcagcaggatcttgaccagccgc

SEQ ID NO: 314671 - DNA, 25 bp, Mus musculus
cagcagcaggatgttgaccagccgc

SEQ ID NO: 314672 - DNA, 25 bp, Mus musculus
cagcagcaggctatgtggttctctc

SEQ ID NO: 314673 - DNA, 25 bp, Mus musculus
cagcagcaggctttgtggttctctc

SEQ ID NO: 314674 - DNA, 25 bp, Mus musculus
cagcagcagggcattacatcgagcc

SEQ ID NO: 314675 - DNA, 25 bp, Mus musculus
cagcagcagggctttacatcgagcc

SEQ ID NO: 314676 - DNA, 25 bp, Mus musculus
cagcagcagtacatcttccagcagt

SEQ ID NO: 314677 - DNA, 25 bp, Mus musculus
cagcagcagtacttcttccagcagt

SEQ ID NO: 314678 - DNA, 25 bp, Mus musculus
cagcagcatacgcacgggccgatga

SEQ ID NO: 314679 - DNA, 25 bp, Mus musculus
cagcagcatacggacgggccgatga

SEQ ID NO: 314680 - DNA, 25 bp, Mus musculus
cagcagcatcctaacttattcagca

SEQ ID NO: 314681 - DNA, 25 bp, Mus musculus
cagcagcatccttacttattcagca

SEQ ID NO: 314682 - DNA, 25 bp, Mus musculus
cagcagcatgcaccatagtaagcta

SEQ ID NO: 314683 - DNA, 25 bp, Mus musculus
cagcagcatgcagcatagtaagcta

SEQ ID NO: 314684 - DNA, 25 bp, Mus musculus
cagcagcatggcaagacgttcttaa

SEQ ID NO: 314685 - DNA, 25 bp, Mus musculus
cagcagcatggctagacgttcttaa

SEQ ID NO: 314686 - DNA, 25 bp, Mus musculus
cagcagcatgtccagatgttattat

SEQ ID NO: 314687 - DNA, 25 bp, Mus musculus
cagcagcatgtcgagatgttattat

SEQ ID NO: 314688 - DNA, 25 bp, Mus musculus
cagcagcattcccaacctgtggttg

SEQ ID NO: 314689 - DNA, 25 bp, Mus musculus
cagcagcattccgaacctgtggttg

SEQ ID NO: 314690 - DNA, 25 bp, Mus musculus
cagcagcattttacacctattcctg

SEQ ID NO: 314691 - DNA, 25 bp, Mus musculus
cagcagcatttttcacctattcctg

SEQ ID NO: 314692 - DNA, 25 bp, Mus musculus
cagcagccaatcagtctatggagat

SEQ ID NO: 314693 - DNA, 25 bp, Mus musculus
cagcagccaatcatactggagctta

SEQ ID NO: 314694 - DNA, 25 bp, Mus musculus
cagcagccaatctgtctatggagat

SEQ ID NO: 314695 - DNA, 25 bp, Mus musculus
cagcagccaatcttactggagctta

SEQ ID NO: 314696 - DNA, 25 bp, Mus musculus
cagcagccatttcttcaggtgtgta

SEQ ID NO: 314697 - DNA, 25 bp, Mus musculus
cagcagccatttgttcaggtgtgta

SEQ ID NO: 314698 - DNA, 25 bp, Mus musculus
cagcagccccgacgtactgagaagg

SEQ ID NO: 314699 - DNA, 25 bp, Mus musculus
cagcagccccgaggtactgagaagg

SEQ ID NO: 314700 - DNA, 25 bp, Mus musculus
cagcagccctgtctgaaggtggttt

SEQ ID NO: 314701 - DNA, 25 bp, Mus musculus
cagcagccctgtgtgaaggtggttt

SEQ ID NO: 314702 - DNA, 25 bp, Mus musculus
cagcagccctttattcctagaggaa

SEQ ID NO: 314703 - DNA, 25 bp, Mus musculus
cagcagcccttttttcctagaggaa

SEQ ID NO: 314704 - DNA, 25 bp, Mus musculus
cagcagccggttacctgtttgtgag

SEQ ID NO: 314705 - DNA, 25 bp, Mus musculus
cagcagccggtttcctgtttgtgag

SEQ ID NO: 314706 - DNA, 25 bp, Mus musculus
cagcagccgttcctgggtagtttat

SEQ ID NO: 314707 - DNA, 25 bp, Mus musculus
cagcagccgttcgtgggtagtttat

SEQ ID NO: 314708 - DNA, 25 bp, Mus musculus
cagcagcctacacccaggaggagcg

SEQ ID NO: 314709 - DNA, 25 bp, Mus musculus
cagcagcctacagccaggaggagcg

SEQ ID NO: 314710 - DNA, 25 bp, Mus musculus
cagcagcctcttcaagtcatcttat

SEQ ID NO: 314711 - DNA, 25 bp, Mus musculus
cagcagcctcttgaagtcatcttat

SEQ ID NO: 314712 - DNA, 25 bp, Mus musculus
cagcagcctgcacctggattacgca

SEQ ID NO: 314713 - DNA, 25 bp, Mus musculus
cagcagcctgcagctggattacgca

SEQ ID NO: 314714 - DNA, 25 bp, Mus musculus
cagcagcctggtcacgatcattact

SEQ ID NO: 314715 - DNA, 25 bp, Mus musculus
cagcagcctggtgacgatcattact

SEQ ID NO: 314716 - DNA, 25 bp, Mus musculus
cagcagccttacagattaattgatt

SEQ ID NO: 314717 - DNA, 25 bp, Mus musculus
cagcagccttactgattaattgatt

SEQ ID NO: 314718 - DNA, 25 bp, Mus musculus
cagcagcgaggtatgcatcttctta

SEQ ID NO: 314719 - DNA, 25 bp, Mus musculus
cagcagcgaggtttgcatcttctta

SEQ ID NO: 314720 - DNA, 25 bp, Mus musculus
cagcagcgagtaagttgtccgaaat

SEQ ID NO: 314721 - DNA, 25 bp, Mus musculus
cagcagcgagtatgttgtccgaaat

SEQ ID NO: 314722 - DNA, 25 bp, Mus musculus
cagcagcggtgaagtccaggtgaca

SEQ ID NO: 314723 - DNA, 25 bp, Mus musculus
cagcagcggtgatgtccaggtgaca

SEQ ID NO: 314724 - DNA, 25 bp, Mus musculus
cagcagcgtttccagtgtgtgaacc

SEQ ID NO: 314725 - DNA, 25 bp, Mus musculus
cagcagcgtttcgagtgtgtgaacc

SEQ ID NO: 314726 - DNA, 25 bp, Mus musculus
cagcagctaactagggcctctgaat

SEQ ID NO: 314727 - DNA, 25 bp, Mus musculus
cagcagctaacttgggcctctgaat

SEQ ID NO: 314728 - DNA, 25 bp, Mus musculus
cagcagctaagcaggattttgacat

SEQ ID NO: 314729 - DNA, 25 bp, Mus musculus
cagcagctaagctggattttgacat

SEQ ID NO: 314730 - DNA, 25 bp, Mus musculus
cagcagctacagcaattatggctta

SEQ ID NO: 314731 - DNA, 25 bp, Mus musculus
cagcagctacaggaattatggctta

SEQ ID NO: 314732 - DNA, 25 bp, Mus musculus
cagcagctacatacaaggaccgagt

SEQ ID NO: 314733 - DNA, 25 bp, Mus musculus
cagcagctacattcaaggaccgagt

SEQ ID NO: 314734 - DNA, 25 bp, Mus musculus
cagcagctaccaactgtgacttatg

SEQ ID NO: 314735 - DNA, 25 bp, Mus musculus
cagcagctaccatctgtgacttatg

SEQ ID NO: 314736 - DNA, 25 bp, Mus musculus
cagcagctcacgagatggctacggt

SEQ ID NO: 314737 - DNA, 25 bp, Mus musculus
cagcagctcacgtgatggctacggt

SEQ ID NO: 314738 - DNA, 25 bp, Mus musculus
cagcagctcagccttgctgcgggta

SEQ ID NO: 314739 - DNA, 25 bp, Mus musculus
cagcagctcagcgttgctgcgggta

SEQ ID NO: 314740 - DNA, 25 bp, Mus musculus
cagcagctccaacaagaaggcttag

SEQ ID NO: 314741 - DNA, 25 bp, Mus musculus
cagcagctccaagaagaaggcttag

SEQ ID NO: 314742 - DNA, 25 bp, Mus musculus
cagcagctccatagccatcaaaaaa

SEQ ID NO: 314743 - DNA, 25 bp, Mus musculus
cagcagctccattgccatcaaaaaa

SEQ ID NO: 314744 - DNA, 25 bp, Mus musculus
cagcagctccggaagatgggttata

SEQ ID NO: 314745 - DNA, 25 bp, Mus musculus
cagcagctccggtagatgggttata

SEQ ID NO: 314746 - DNA, 25 bp, Mus musculus
cagcagctcctgataccaagtttgt

SEQ ID NO: 314747 - DNA, 25 bp, Mus musculus
cagcagctcctgttaccaagtttgt

SEQ ID NO: 314748 - DNA, 25 bp, Mus musculus
cagcagctctacattatgtgaacat

SEQ ID NO: 314749 - DNA, 25 bp, Mus musculus
cagcagctctactttatgtgaacat

SEQ ID NO: 314750 - DNA, 25 bp, Mus musculus
cagcagctgaatcaactgggttttc

SEQ ID NO: 314751 - DNA, 25 bp, Mus musculus
cagcagctgaatgaactgggttttc

SEQ ID NO: 314752 - DNA, 25 bp, Mus musculus
cagcagctgagcaccaaatatatca

SEQ ID NO: 314753 - DNA, 25 bp, Mus musculus
cagcagctgagctccaaatatatca

SEQ ID NO: 314754 - DNA, 25 bp, Mus musculus
cagcagctgatgagggttgttgatt

SEQ ID NO: 314755 - DNA, 25 bp, Mus musculus
cagcagctgatgtgggttgttgatt

SEQ ID NO: 314756 - DNA, 25 bp, Mus musculus
cagcagctgcagagactcaatggtc

SEQ ID NO: 314757 - DNA, 25 bp, Mus musculus
cagcagctgcagtgactcaatggtc

SEQ ID NO: 314758 - DNA, 25 bp, Mus musculus
cagcagctgccaaaggtgcctatgt

SEQ ID NO: 314759 - DNA, 25 bp, Mus musculus
cagcagctgccataggtgcctatgt

SEQ ID NO: 314760 - DNA, 25 bp, Mus musculus
cagcagctgcgccatctgcagttgg

SEQ ID NO: 314761 - DNA, 25 bp, Mus musculus
cagcagctgcgcgatctgcagttgg

SEQ ID NO: 314762 - DNA, 25 bp, Mus musculus
cagcagctgctactgtggagtttcc

SEQ ID NO: 314763 - DNA, 25 bp, Mus musculus
cagcagctgctagtgtggagtttcc

SEQ ID NO: 314764 - DNA, 25 bp, Mus musculus
cagcagctggagacaattgcctgta

SEQ ID NO: 314765 - DNA, 25 bp, Mus musculus
cagcagctggagtcaattgcctgta

SEQ ID NO: 314766 - DNA, 25 bp, Mus musculus
cagcagctgggcaacgtcactctgt

SEQ ID NO: 314767 - DNA, 25 bp, Mus musculus
cagcagctgggctacgtcactctgt

SEQ ID NO: 314768 - DNA, 25 bp, Mus musculus
cagcagctgtgaagtggaacggacc

SEQ ID NO: 314769 - DNA, 25 bp, Mus musculus
cagcagctgtgatgtggaacggacc

SEQ ID NO: 314770 - DNA, 25 bp, Mus musculus
cagcagcttcctaaaatctccaact

SEQ ID NO: 314771 - DNA, 25 bp, Mus musculus
cagcagcttccttaaatctccaact

SEQ ID NO: 314772 - DNA, 25 bp, Mus musculus
cagcagctttaaaggcttttatgaa

SEQ ID NO: 314773 - DNA, 25 bp, Mus musculus
cagcagctttaatggcttttatgaa

SEQ ID NO: 314774 - DNA, 25 bp, Mus musculus
cagcaggaaaaacactctagccagg

SEQ ID NO: 314775 - DNA, 25 bp, Mus musculus
cagcaggaaaaagactctagccagg

SEQ ID NO: 314776 - DNA, 25 bp, Mus musculus
cagcaggaactactctggtgaactt

SEQ ID NO: 314777 - DNA, 25 bp, Mus musculus
cagcaggaactagtctggtgaactt

SEQ ID NO: 314778 - DNA, 25 bp, Mus musculus
cagcaggaagtacagaattttgaag

SEQ ID NO: 314779 - DNA, 25 bp, Mus musculus
cagcaggaagtagagaattttgaag

SEQ ID NO: 314780 - DNA, 25 bp, Mus musculus
cagcaggactggattctttatgtca

SEQ ID NO: 314781 - DNA, 25 bp, Mus musculus
cagcaggactggtttctttatgtca

SEQ ID NO: 314782 - DNA, 25 bp, Mus musculus
cagcaggaggcaagcagactggact

SEQ ID NO: 314783 - DNA, 25 bp, Mus musculus
cagcaggaggcatgcagactggact

SEQ ID NO: 314784 - DNA, 25 bp, Mus musculus
cagcaggcacatacctttgaagaga

SEQ ID NO: 314785 - DNA, 25 bp, Mus musculus
cagcaggcacattcctttgaagaga

SEQ ID NO: 314786 - DNA, 25 bp, Mus musculus
cagcaggcaccaattgtttaaaagc

SEQ ID NO: 314787 - DNA, 25 bp, Mus musculus
cagcaggcaccatttgtttaaaagc

SEQ ID NO: 314788 - DNA, 25 bp, Mus musculus
cagcaggccacgcaacagatgggaa

SEQ ID NO: 314789 - DNA, 25 bp, Mus musculus
cagcaggccacggaacagatgggaa

SEQ ID NO: 314790 - DNA, 25 bp, Mus musculus
cagcaggccagcaggatgaggacac

SEQ ID NO: 314791 - DNA, 25 bp, Mus musculus
cagcaggccagctggatgaggacac

SEQ ID NO: 314792 - DNA, 25 bp, Mus musculus
cagcaggccagtctagccgaaacag

SEQ ID NO: 314793 - DNA, 25 bp, Mus musculus
cagcaggccagtgtagccgaaacag

SEQ ID NO: 314794 - DNA, 25 bp, Mus musculus
cagcaggcccctagagtggttgaga

SEQ ID NO: 314795 - DNA, 25 bp, Mus musculus
cagcaggccccttgagtggttgaga

SEQ ID NO: 314796 - DNA, 25 bp, Mus musculus
cagcaggctaccatgtttccatctt

SEQ ID NO: 314797 - DNA, 25 bp, Mus musculus
cagcaggctaccttgtttccatctt

SEQ ID NO: 314798 - DNA, 25 bp, Mus musculus
cagcaggctatgcaccgaaagattg

SEQ ID NO: 314799 - DNA, 25 bp, Mus musculus
cagcaggctatggaccgaaagattg

SEQ ID NO: 314800 - DNA, 25 bp, Mus musculus
cagcaggctcaaaataggagtcagc

SEQ ID NO: 314801 - DNA, 25 bp, Mus musculus
cagcaggctcaatataggagtcagc

SEQ ID NO: 314802 - DNA, 25 bp, Mus musculus
cagcaggctgctagtttgtgtcttg

SEQ ID NO: 314803 - DNA, 25 bp, Mus musculus
cagcaggctgctctgtacccaggga

SEQ ID NO: 314804 - DNA, 25 bp, Mus musculus
cagcaggctgctgtgtacccaggga

SEQ ID NO: 314805 - DNA, 25 bp, Mus musculus
cagcaggctgcttgtttgtgtcttg

SEQ ID NO: 314806 - DNA, 25 bp, Mus musculus
cagcaggcttacactctggatgtga

SEQ ID NO: 314807 - DNA, 25 bp, Mus musculus
cagcaggcttactctctggatgtga

SEQ ID NO: 314808 - DNA, 25 bp, Mus musculus
cagcaggcttcaccaggcttcagga

SEQ ID NO: 314809 - DNA, 25 bp, Mus musculus
cagcaggcttcagcaggcttcagga

SEQ ID NO: 314810 - DNA, 25 bp, Mus musculus
cagcaggcttgtccggatggaacac

SEQ ID NO: 314811 - DNA, 25 bp, Mus musculus
cagcaggcttgtgcggatggaacac

SEQ ID NO: 314812 - DNA, 25 bp, Mus musculus
cagcaggctttgaaaagacccttca

SEQ ID NO: 314813 - DNA, 25 bp, Mus musculus
cagcaggctttgtaaagacccttca

SEQ ID NO: 314814 - DNA, 25 bp, Mus musculus
cagcagggacccattgagtcttgtc

SEQ ID NO: 314815 - DNA, 25 bp, Mus musculus
cagcagggaccctttgagtcttgtc

SEQ ID NO: 314816 - DNA, 25 bp, Mus musculus
cagcagggacctcagtttaggacaa

SEQ ID NO: 314817 - DNA, 25 bp, Mus musculus
cagcagggacctgagtttaggacaa

SEQ ID NO: 314818 - DNA, 25 bp, Mus musculus
cagcagggagagagtcgtgcctcta

SEQ ID NO: 314819 - DNA, 25 bp, Mus musculus
cagcagggagagtgtcgtgcctcta

SEQ ID NO: 314820 - DNA, 25 bp, Mus musculus
cagcagggatatcactttggacaac

SEQ ID NO: 314821 - DNA, 25 bp, Mus musculus
cagcagggatatgactttggacaac

SEQ ID NO: 314822 - DNA, 25 bp, Mus musculus
cagcagggcagcatagctatgttct

SEQ ID NO: 314823 - DNA, 25 bp, Mus musculus
cagcagggcagcttagctatgttct

SEQ ID NO: 314824 - DNA, 25 bp, Mus musculus
cagcagggtactcgctaaataaatc

SEQ ID NO: 314825 - DNA, 25 bp, Mus musculus
cagcagggtactggctaaataaatc

SEQ ID NO: 314826 - DNA, 25 bp, Mus musculus
cagcagggtcgtagccattttggca

SEQ ID NO: 314827 - DNA, 25 bp, Mus musculus
cagcagggtcgttgccattttggca

SEQ ID NO: 314828 - DNA, 25 bp, Mus musculus
cagcagggttcacacacgggtttac

SEQ ID NO: 314829 - DNA, 25 bp, Mus musculus
cagcagggttcagacacgggtttac

SEQ ID NO: 314830 - DNA, 25 bp, Mus musculus
cagcagggttggagacaatctactt

SEQ ID NO: 314831 - DNA, 25 bp, Mus musculus
cagcagggttggtgacaatctactt

SEQ ID NO: 314832 - DNA, 25 bp, Mus musculus
cagcagggttttcgactcccatttc

SEQ ID NO: 314833 - DNA, 25 bp, Mus musculus
cagcagggttttggactcccatttc

SEQ ID NO: 314834 - DNA, 25 bp, Mus musculus
cagcaggtagctcgatccaaaggtt

SEQ ID NO: 314835 - DNA, 25 bp, Mus musculus
cagcaggtagctggatccaaaggtt

SEQ ID NO: 314836 - DNA, 25 bp, Mus musculus
cagcaggtattaacagacactcact

SEQ ID NO: 314837 - DNA, 25 bp, Mus musculus
cagcaggtattatcagacactcact

SEQ ID NO: 314838 - DNA, 25 bp, Mus musculus
cagcaggtcctgatggagatgatat

SEQ ID NO: 314839 - DNA, 25 bp, Mus musculus
cagcaggtcctgttggagatgatat

SEQ ID NO: 314840 - DNA, 25 bp, Mus musculus
cagcaggtctgtcggagactctctc

SEQ ID NO: 314841 - DNA, 25 bp, Mus musculus
cagcaggtctgtgggagactctctc

SEQ ID NO: 314842 - DNA, 25 bp, Mus musculus
cagcaggtctttcatgatcctctga

SEQ ID NO: 314843 - DNA, 25 bp, Mus musculus
cagcaggtctttgatgatcctctga

SEQ ID NO: 314844 - DNA, 25 bp, Mus musculus
cagcaggtgtgacgccagagaaaac

SEQ ID NO: 314845 - DNA, 25 bp, Mus musculus
cagcaggtgtgaggccagagaaaac

SEQ ID NO: 314846 - DNA, 25 bp, Mus musculus
cagcaggtgtttcacaacggcagca

SEQ ID NO: 314847 - DNA, 25 bp, Mus musculus
cagcaggtgtttgacaacggcagca

SEQ ID NO: 314848 - DNA, 25 bp, Mus musculus
cagcaggttaatcttgggttggcaa

SEQ ID NO: 314849 - DNA, 25 bp, Mus musculus
cagcaggttaatgttgggttggcaa

SEQ ID NO: 314850 - DNA, 25 bp, Mus musculus
cagcaggttatgcagacctctcatt

SEQ ID NO: 314851 - DNA, 25 bp, Mus musculus
cagcaggttatggagacctctcatt

SEQ ID NO: 314852 - DNA, 25 bp, Mus musculus
cagcaggttgatagccaaagcatat

SEQ ID NO: 314853 - DNA, 25 bp, Mus musculus
cagcaggttgattgccaaagcatat

SEQ ID NO: 314854 - DNA, 25 bp, Mus musculus
cagcagtaaagcctgtaaccccagc

SEQ ID NO: 314855 - DNA, 25 bp, Mus musculus
cagcagtaaagcgtgtaaccccagc

SEQ ID NO: 314856 - DNA, 25 bp, Mus musculus
cagcagtacctccgtttgtttggtt

SEQ ID NO: 314857 - DNA, 25 bp, Mus musculus
cagcagtacctcggtttgtttggtt

SEQ ID NO: 314858 - DNA, 25 bp, Mus musculus
cagcagtactcaagtgaaccacctt

SEQ ID NO: 314859 - DNA, 25 bp, Mus musculus
cagcagtactcatgtgaaccacctt

SEQ ID NO: 314860 - DNA, 25 bp, Mus musculus
cagcagtacttaataaccaacggaa

SEQ ID NO: 314861 - DNA, 25 bp, Mus musculus
cagcagtacttattaaccaacggaa

SEQ ID NO: 314862 - DNA, 25 bp, Mus musculus
cagcagtagcagcaccaacagtgga

SEQ ID NO: 314863 - DNA, 25 bp, Mus musculus
cagcagtagcaggaccaacagtgga

SEQ ID NO: 314864 - DNA, 25 bp, Mus musculus
cagcagtatgcacttcttggtagca

SEQ ID NO: 314865 - DNA, 25 bp, Mus musculus
cagcagtatgcagttcttggtagca

SEQ ID NO: 314866 - DNA, 25 bp, Mus musculus
cagcagtatttcaggccccataatt

SEQ ID NO: 314867 - DNA, 25 bp, Mus musculus
cagcagtatttctggccccataatt

SEQ ID NO: 314868 - DNA, 25 bp, Mus musculus
cagcagtcaattacctcctcagtag

SEQ ID NO: 314869 - DNA, 25 bp, Mus musculus
cagcagtcaatttcctcctcagtag

SEQ ID NO: 314870 - DNA, 25 bp, Mus musculus
cagcagtcactgacatggttgtcca

SEQ ID NO: 314871 - DNA, 25 bp, Mus musculus
cagcagtcactgtcatggttgtcca

SEQ ID NO: 314872 - DNA, 25 bp, Mus musculus
cagcagtcacttattagtatcaatg

SEQ ID NO: 314873 - DNA, 25 bp, Mus musculus
cagcagtcactttttagtatcaatg

SEQ ID NO: 314874 - DNA, 25 bp, Mus musculus
cagcagtcagcacttacatacataa

SEQ ID NO: 314875 - DNA, 25 bp, Mus musculus
cagcagtcagcagttacatacataa

SEQ ID NO: 314876 - DNA, 25 bp, Mus musculus
cagcagtcatggctgtctttctagc

SEQ ID NO: 314877 - DNA, 25 bp, Mus musculus
cagcagtcatgggtgtctttctagc

SEQ ID NO: 314878 - DNA, 25 bp, Mus musculus
cagcagtcgatgaaccccacccgtc

SEQ ID NO: 314879 - DNA, 25 bp, Mus musculus
cagcagtcgatgtaccccacccgtc

SEQ ID NO: 314880 - DNA, 25 bp, Mus musculus
cagcagtctccgcacgaggaaggat

SEQ ID NO: 314881 - DNA, 25 bp, Mus musculus
cagcagtctccggacgaggaaggat

SEQ ID NO: 314882 - DNA, 25 bp, Mus musculus
cagcagtctgtaagtctaaatgagt

SEQ ID NO: 314883 - DNA, 25 bp, Mus musculus
cagcagtctgtatgtctaaatgagt

SEQ ID NO: 314884 - DNA, 25 bp, Mus musculus
cagcagtcttcacggtagcatcatt

SEQ ID NO: 314885 - DNA, 25 bp, Mus musculus
cagcagtcttcacttccttatatat

SEQ ID NO: 314886 - DNA, 25 bp, Mus musculus
cagcagtcttcagggtagcatcatt

SEQ ID NO: 314887 - DNA, 25 bp, Mus musculus
cagcagtcttcagttccttatatat

SEQ ID NO: 314888 - DNA, 25 bp, Mus musculus
cagcagtcttgcataggcagtagaa

SEQ ID NO: 314889 - DNA, 25 bp, Mus musculus
cagcagtcttgcttaggcagtagaa

SEQ ID NO: 314890 - DNA, 25 bp, Mus musculus
cagcagtgacacactggccaagtat

SEQ ID NO: 314891 - DNA, 25 bp, Mus musculus
cagcagtgacactctggccaagtat

SEQ ID NO: 314892 - DNA, 25 bp, Mus musculus
cagcagtgaccccaaaagccgggaa

SEQ ID NO: 314893 - DNA, 25 bp, Mus musculus
cagcagtgacccgaaaagccgggaa

SEQ ID NO: 314894 - DNA, 25 bp, Mus musculus
cagcagtgactcctttggagcccct

SEQ ID NO: 314895 - DNA, 25 bp, Mus musculus
cagcagtgactcgtttggagcccct

SEQ ID NO: 314896 - DNA, 25 bp, Mus musculus
cagcagtgactgctgacagcgtgca

SEQ ID NO: 314897 - DNA, 25 bp, Mus musculus
cagcagtgactggtgacagcgtgca

SEQ ID NO: 314898 - DNA, 25 bp, Mus musculus
cagcagtgaggccatgaagtcatta

SEQ ID NO: 314899 - DNA, 25 bp, Mus musculus
cagcagtgaggcgatgaagtcatta

SEQ ID NO: 314900 - DNA, 25 bp, Mus musculus
cagcagtgataccttgagttttcca

SEQ ID NO: 314901 - DNA, 25 bp, Mus musculus
cagcagtgatacgttgagttttcca

SEQ ID NO: 314902 - DNA, 25 bp, Mus musculus
cagcagtgatgactctcaacagtgt

SEQ ID NO: 314903 - DNA, 25 bp, Mus musculus
cagcagtgatgagtctcaacagtgt

SEQ ID NO: 314904 - DNA, 25 bp, Mus musculus
cagcagtgattgacctgtttccgaa

SEQ ID NO: 314905 - DNA, 25 bp, Mus musculus
cagcagtgattgtcctgtttccgaa

SEQ ID NO: 314906 - DNA, 25 bp, Mus musculus
cagcagtgcactctgatttggtgaa

SEQ ID NO: 314907 - DNA, 25 bp, Mus musculus
cagcagtgcactgtgatttggtgaa

SEQ ID NO: 314908 - DNA, 25 bp, Mus musculus
cagcagtgccaaccaggagtgacgt

SEQ ID NO: 314909 - DNA, 25 bp, Mus musculus
cagcagtgccaagcaggagtgacgt

SEQ ID NO: 314910 - DNA, 25 bp, Mus musculus
cagcagtgccctcagagtctcttga

SEQ ID NO: 314911 - DNA, 25 bp, Mus musculus
cagcagtgccctgagagtctcttga

SEQ ID NO: 314912 - DNA, 25 bp, Mus musculus
cagcagtggcaacaactgtatgaca

SEQ ID NO: 314913 - DNA, 25 bp, Mus musculus
cagcagtggcaagaactgtatgaca

SEQ ID NO: 314914 - DNA, 25 bp, Mus musculus
cagcagtggcttcgagtgaaagttc

SEQ ID NO: 314915 - DNA, 25 bp, Mus musculus
cagcagtggcttggagtgaaagttc

SEQ ID NO: 314916 - DNA, 25 bp, Mus musculus
cagcagtgggtgcactttgtagacc

SEQ ID NO: 314917 - DNA, 25 bp, Mus musculus
cagcagtgggtggactttgtagacc

SEQ ID NO: 314918 - DNA, 25 bp, Mus musculus
cagcagtggtatccccagcagcatg

SEQ ID NO: 314919 - DNA, 25 bp, Mus musculus
cagcagtggtatgcccagcagcatg

SEQ ID NO: 314920 - DNA, 25 bp, Mus musculus
cagcagtggtgtcgttacccattca

SEQ ID NO: 314921 - DNA, 25 bp, Mus musculus
cagcagtggtgtggttacccattca

SEQ ID NO: 314922 - DNA, 25 bp, Mus musculus
cagcagtgtcttcccttgtcaatgt

SEQ ID NO: 314923 - DNA, 25 bp, Mus musculus
cagcagtgtcttgccttgtcaatgt

SEQ ID NO: 314924 - DNA, 25 bp, Mus musculus
cagcagttaagtcaccctggtaatg

SEQ ID NO: 314925 - DNA, 25 bp, Mus musculus
cagcagttaagtgaccctggtaatg

SEQ ID NO: 314926 - DNA, 25 bp, Mus musculus
cagcagttacagacttacaaatggt

SEQ ID NO: 314927 - DNA, 25 bp, Mus musculus
cagcagttacagtcttacaaatggt

SEQ ID NO: 314928 - DNA, 25 bp, Mus musculus
cagcagttgcatcggacatccgtta

SEQ ID NO: 314929 - DNA, 25 bp, Mus musculus
cagcagttgcatgggacatccgtta

SEQ ID NO: 314930 - DNA, 25 bp, Mus musculus
cagcagttgccacaacacatcaagg

SEQ ID NO: 314931 - DNA, 25 bp, Mus musculus
cagcagttgccagaacacatcaagg

SEQ ID NO: 314932 - DNA, 25 bp, Mus musculus
cagcagttgctaacctgagatttct

SEQ ID NO: 314933 - DNA, 25 bp, Mus musculus
cagcagttgctatcctgagatttct

SEQ ID NO: 314934 - DNA, 25 bp, Mus musculus
cagcagttgtaacctgtcgtgggta

SEQ ID NO: 314935 - DNA, 25 bp, Mus musculus
cagcagttgtaagctgtcgtgggta

SEQ ID NO: 314936 - DNA, 25 bp, Mus musculus
cagcagttgtttcagccagtcagat

SEQ ID NO: 314937 - DNA, 25 bp, Mus musculus
cagcagttgtttgagccagtcagat

SEQ ID NO: 314938 - DNA, 25 bp, Mus musculus
cagcagtttgttcgtaaggtgactt

SEQ ID NO: 314939 - DNA, 25 bp, Mus musculus
cagcagtttgttggtaaggtgactt

SEQ ID NO: 314940 - DNA, 25 bp, Mus musculus
cagcagttttctcttttcctgtgtg

SEQ ID NO: 314941 - DNA, 25 bp, Mus musculus
cagcagttttctgttttcctgtgtg

SEQ ID NO: 314942 - DNA, 25 bp, Mus musculus
cagcagttttggagggtgactccat

SEQ ID NO: 314943 - DNA, 25 bp, Mus musculus
cagcagttttggtgggtgactccat

SEQ ID NO: 314944 - DNA, 25 bp, Mus musculus
cagcataaagatctctgccctccat

SEQ ID NO: 314945 - DNA, 25 bp, Mus musculus
cagcataaagatgtctgccctccat

SEQ ID NO: 314946 - DNA, 25 bp, Mus musculus
cagcataatcctcccattagacaag

SEQ ID NO: 314947 - DNA, 25 bp, Mus musculus
cagcataatcctgccattagacaag

SEQ ID NO: 314948 - DNA, 25 bp, Mus musculus
cagcatacatgtctatactagaatc

SEQ ID NO: 314949 - DNA, 25 bp, Mus musculus
cagcatacatgtgtatactagaatc

SEQ ID NO: 314950 - DNA, 25 bp, Mus musculus
cagcatacctggcagttttcatcat

SEQ ID NO: 314951 - DNA, 25 bp, Mus musculus
cagcatacctgggagttttcatcat

SEQ ID NO: 314952 - DNA, 25 bp, Mus musculus
cagcatactcacaatctgcctaaga

SEQ ID NO: 314953 - DNA, 25 bp, Mus musculus
cagcatactcactatctgcctaaga

SEQ ID NO: 314954 - DNA, 25 bp, Mus musculus
cagcatactcgtccttacaaagcaa

SEQ ID NO: 314955 - DNA, 25 bp, Mus musculus
cagcatactcgtgcttacaaagcaa

SEQ ID NO: 314956 - DNA, 25 bp, Mus musculus
cagcatagctgtcttcatcacacta

SEQ ID NO: 314957 - DNA, 25 bp, Mus musculus
cagcatagctgtgttcatcacacta

SEQ ID NO: 314958 - DNA, 25 bp, Mus musculus
cagcatatcattcgccattcccaaa

SEQ ID NO: 314959 - DNA, 25 bp, Mus musculus
cagcatatcattggccattcccaaa

SEQ ID NO: 314960 - DNA, 25 bp, Mus musculus
cagcatatccagcaggaccgcatgt

SEQ ID NO: 314961 - DNA, 25 bp, Mus musculus
cagcatatccaggaggaccgcatgt

SEQ ID NO: 314962 - DNA, 25 bp, Mus musculus
cagcatatcctgctggcggtgttac

SEQ ID NO: 314963 - DNA, 25 bp, Mus musculus
cagcatatcctggtggcggtgttac

SEQ ID NO: 314964 - DNA, 25 bp, Mus musculus
cagcatatgatgctccttaccctgg

SEQ ID NO: 314965 - DNA, 25 bp, Mus musculus
cagcatatgatggtccttaccctgg

SEQ ID NO: 314966 - DNA, 25 bp, Mus musculus
cagcatcaagtaaccatggactgaa

SEQ ID NO: 314967 - DNA, 25 bp, Mus musculus
cagcatcaagtatccatggactgaa

SEQ ID NO: 314968 - DNA, 25 bp, Mus musculus
cagcatcacataagcctggtgtggt

SEQ ID NO: 314969 - DNA, 25 bp, Mus musculus
cagcatcacatatgcctggtgtggt

SEQ ID NO: 314970 - DNA, 25 bp, Mus musculus
cagcatcactaacacatggactgat

SEQ ID NO: 314971 - DNA, 25 bp, Mus musculus
cagcatcactaagacatggactgat

SEQ ID NO: 314972 - DNA, 25 bp, Mus musculus
cagcatcagcagcagtaatcaagct

SEQ ID NO: 314973 - DNA, 25 bp, Mus musculus
cagcatcagcaggagtaatcaagct

SEQ ID NO: 314974 - DNA, 25 bp, Mus musculus
cagcatcagcttacacatgcctgta

SEQ ID NO: 314975 - DNA, 25 bp, Mus musculus
cagcatcagctttcacatgcctgta

SEQ ID NO: 314976 - DNA, 25 bp, Mus musculus
cagcatcatgggacttactccaggg

SEQ ID NO: 314977 - DNA, 25 bp, Mus musculus
cagcatcatgggtcttactccaggg

SEQ ID NO: 314978 - DNA, 25 bp, Mus musculus
cagcatcatgtcagctttgactgac

SEQ ID NO: 314979 - DNA, 25 bp, Mus musculus
cagcatcatgtctgctttgactgac

SEQ ID NO: 314980 - DNA, 25 bp, Mus musculus
cagcatcattttctctttgtagaag

SEQ ID NO: 314981 - DNA, 25 bp, Mus musculus
cagcatcattttgtctttgtagaag

SEQ ID NO: 314982 - DNA, 25 bp, Mus musculus
cagcatccaaggcacgcatgtcata

SEQ ID NO: 314983 - DNA, 25 bp, Mus musculus
cagcatccaagggacgcatgtcata

SEQ ID NO: 314984 - DNA, 25 bp, Mus musculus
cagcatccacatcatagcttgaaat

SEQ ID NO: 314985 - DNA, 25 bp, Mus musculus
cagcatccacatgatagcttgaaat

SEQ ID NO: 314986 - DNA, 25 bp, Mus musculus
cagcatccagcactcatggtatact

SEQ ID NO: 314987 - DNA, 25 bp, Mus musculus
cagcatccagcagtcatggtatact

SEQ ID NO: 314988 - DNA, 25 bp, Mus musculus
cagcatccagttctctcattttaga

SEQ ID NO: 314989 - DNA, 25 bp, Mus musculus
cagcatccagttgtctcattttaga

SEQ ID NO: 314990 - DNA, 25 bp, Mus musculus
cagcatccatatcatctgtgaactg

SEQ ID NO: 314991 - DNA, 25 bp, Mus musculus
cagcatccatatgatctgtgaactg

SEQ ID NO: 314992 - DNA, 25 bp, Mus musculus
cagcatccctttcacactgtggtgt

SEQ ID NO: 314993 - DNA, 25 bp, Mus musculus
cagcatccctttgacactgtggtgt

SEQ ID NO: 314994 - DNA, 25 bp, Mus musculus
cagcatcctcatagtagttgtctac

SEQ ID NO: 314995 - DNA, 25 bp, Mus musculus
cagcatcctcattgtagttgtctac

SEQ ID NO: 314996 - DNA, 25 bp, Mus musculus
cagcatccttctaaccactataaaa

SEQ ID NO: 314997 - DNA, 25 bp, Mus musculus
cagcatccttcttaccactataaaa

SEQ ID NO: 314998 - DNA, 25 bp, Mus musculus
cagcatccttgtatgaagggaagct

SEQ ID NO: 314999 - DNA, 25 bp, Mus musculus
cagcatccttgtttgaagggaagct

SEQ ID NO: 315000 - DNA, 25 bp, Mus musculus
cagcatccttttcggtagacaccat

SEQ ID NO: 315001 - DNA, 25 bp, Mus musculus
cagcatccttttgggtagacaccat

SEQ ID NO: 315002 - DNA, 25 bp, Mus musculus
cagcatctcagaacactcgtttatg

SEQ ID NO: 315003 - DNA, 25 bp, Mus musculus
cagcatctcagatcactcgtttatg

SEQ ID NO: 315004 - DNA, 25 bp, Mus musculus
cagcatctgaacacaccgggtagtg

SEQ ID NO: 315005 - DNA, 25 bp, Mus musculus
cagcatctgaactcaccgggtagtg

SEQ ID NO: 315006 - DNA, 25 bp, Mus musculus
cagcatctgatgctgtggaaattgt

SEQ ID NO: 315007 - DNA, 25 bp, Mus musculus
cagcatctgatggtgtggaaattgt

SEQ ID NO: 315008 - DNA, 25 bp, Mus musculus
cagcatctgctcatagggtatttat

SEQ ID NO: 315009 - DNA, 25 bp, Mus musculus
cagcatctgctcttagggtatttat

SEQ ID NO: 315010 - DNA, 25 bp, Mus musculus
cagcatctgctgcaaggtacactta

SEQ ID NO: 315011 - DNA, 25 bp, Mus musculus
cagcatctgctggaaggtacactta

SEQ ID NO: 315012 - DNA, 25 bp, Mus musculus
cagcatctggaacccacttgctatt

SEQ ID NO: 315013 - DNA, 25 bp, Mus musculus
cagcatctggaagccacttgctatt

SEQ ID NO: 315014 - DNA, 25 bp, Mus musculus
cagcatctgggacataacattgact

SEQ ID NO: 315015 - DNA, 25 bp, Mus musculus
cagcatctgggagataacattgact

SEQ ID NO: 315016 - DNA, 25 bp, Mus musculus
cagcatctgtctccttgtttaaaca

SEQ ID NO: 315017 - DNA, 25 bp, Mus musculus
cagcatctgtctgcttgtttaaaca

SEQ ID NO: 315018 - DNA, 25 bp, Mus musculus
cagcatcttctaccagttagcactg

SEQ ID NO: 315019 - DNA, 25 bp, Mus musculus
cagcatcttctactaggtatccact

SEQ ID NO: 315020 - DNA, 25 bp, Mus musculus
cagcatcttctagcagttagcactg

SEQ ID NO: 315021 - DNA, 25 bp, Mus musculus
cagcatcttctagtaggtatccact

SEQ ID NO: 315022 - DNA, 25 bp, Mus musculus
cagcatcttggtctttggtctttaa

SEQ ID NO: 315023 - DNA, 25 bp, Mus musculus
cagcatcttggtgtttggtctttaa

SEQ ID NO: 315024 - DNA, 25 bp, Mus musculus
cagcatgaaagcatctctggagggc

SEQ ID NO: 315025 - DNA, 25 bp, Mus musculus
cagcatgaaagcttctctggagggc

SEQ ID NO: 315026 - DNA, 25 bp, Mus musculus
cagcatgaacctctttcactgttaa

SEQ ID NO: 315027 - DNA, 25 bp, Mus musculus
cagcatgaacctgtttcactgttaa

SEQ ID NO: 315028 - DNA, 25 bp, Mus musculus
cagcatgacggtcatggaagcccag

SEQ ID NO: 315029 - DNA, 25 bp, Mus musculus
cagcatgacggtgatggaagcccag

SEQ ID NO: 315030 - DNA, 25 bp, Mus musculus
cagcatgactgaatcgctcatttta

SEQ ID NO: 315031 - DNA, 25 bp, Mus musculus
cagcatgactgattcgctcatttta

SEQ ID NO: 315032 - DNA, 25 bp, Mus musculus
cagcatgacttgatccagggttgta

SEQ ID NO: 315033 - DNA, 25 bp, Mus musculus
cagcatgacttgttccagggttgta

SEQ ID NO: 315034 - DNA, 25 bp, Mus musculus
cagcatgatcaaacccatgttcaga

SEQ ID NO: 315035 - DNA, 25 bp, Mus musculus
cagcatgatcaatcccatgttcaga

SEQ ID NO: 315036 - DNA, 25 bp, Mus musculus
cagcatgcaaatctcctctaaaagg

SEQ ID NO: 315037 - DNA, 25 bp, Mus musculus
cagcatgcaaatgtcctctaaaagg

SEQ ID NO: 315038 - DNA, 25 bp, Mus musculus
cagcatgcaatgctcaggaggaaat

SEQ ID NO: 315039 - DNA, 25 bp, Mus musculus
cagcatgcaatggtcaggaggaaat

SEQ ID NO: 315040 - DNA, 25 bp, Mus musculus
cagcatgcaccccatcacaaataag

SEQ ID NO: 315041 - DNA, 25 bp, Mus musculus
cagcatgcacccgatcacaaataag

SEQ ID NO: 315042 - DNA, 25 bp, Mus musculus
cagcatgcagaaagtagtcaccttc

SEQ ID NO: 315043 - DNA, 25 bp, Mus musculus
cagcatgcagaatgtagtcaccttc

SEQ ID NO: 315044 - DNA, 25 bp, Mus musculus
cagcatgccaatacagagcctcgaa

SEQ ID NO: 315045 - DNA, 25 bp, Mus musculus
cagcatgccaattcagagcctcgaa

SEQ ID NO: 315046 - DNA, 25 bp, Mus musculus
cagcatgcgaggagtgcttgtgcat

SEQ ID NO: 315047 - DNA, 25 bp, Mus musculus
cagcatgcgaggtgtgcttgtgcat

SEQ ID NO: 315048 - DNA, 25 bp, Mus musculus
cagcatgcgctgagatctaggagaa

SEQ ID NO: 315049 - DNA, 25 bp, Mus musculus
cagcatgcgctgtgatctaggagaa

SEQ ID NO: 315050 - DNA, 25 bp, Mus musculus
cagcatgcggttacatcatggagtt

SEQ ID NO: 315051 - DNA, 25 bp, Mus musculus
cagcatgcggtttcatcatggagtt

SEQ ID NO: 315052 - DNA, 25 bp, Mus musculus
cagcatgcgtaaagtccttttaagg

SEQ ID NO: 315053 - DNA, 25 bp, Mus musculus
cagcatgcgtaatgtccttttaagg

SEQ ID NO: 315054 - DNA, 25 bp, Mus musculus
cagcatgctctcagcagcaagttat

SEQ ID NO: 315055 - DNA, 25 bp, Mus musculus
cagcatgctctctgcagcaagttat

SEQ ID NO: 315056 - DNA, 25 bp, Mus musculus
cagcatgctgagctcaaccattttt

SEQ ID NO: 315057 - DNA, 25 bp, Mus musculus
cagcatgctgaggtcaaccattttt

SEQ ID NO: 315058 - DNA, 25 bp, Mus musculus
cagcatgctttcagcgggacaaact

SEQ ID NO: 315059 - DNA, 25 bp, Mus musculus
cagcatgctttctgcgggacaaact

SEQ ID NO: 315060 - DNA, 25 bp, Mus musculus
cagcatggacagacttcctaacagt

SEQ ID NO: 315061 - DNA, 25 bp, Mus musculus
cagcatggacagtcttcctaacagt

SEQ ID NO: 315062 - DNA, 25 bp, Mus musculus
cagcatggatcacggaacgaggccc

SEQ ID NO: 315063 - DNA, 25 bp, Mus musculus
cagcatggatcagggaacgaggccc

SEQ ID NO: 315064 - DNA, 25 bp, Mus musculus
cagcatggcgggaacatcacagcat

SEQ ID NO: 315065 - DNA, 25 bp, Mus musculus
cagcatggcgggtacatcacagcat

SEQ ID NO: 315066 - DNA, 25 bp, Mus musculus
cagcatgggatgactattaataact

SEQ ID NO: 315067 - DNA, 25 bp, Mus musculus
cagcatgggatgtctattaataact

SEQ ID NO: 315068 - DNA, 25 bp, Mus musculus
cagcatgggcatcgccttggagcat

SEQ ID NO: 315069 - DNA, 25 bp, Mus musculus
cagcatgggcatggccttggagcat

SEQ ID NO: 315070 - DNA, 25 bp, Mus musculus
cagcatgggttcagggctacaattc

SEQ ID NO: 315071 - DNA, 25 bp, Mus musculus
cagcatgggttctgggctacaattc

SEQ ID NO: 315072 - DNA, 25 bp, Mus musculus
cagcatggttgtaattttttcccca

SEQ ID NO: 315073 - DNA, 25 bp, Mus musculus
cagcatggttgttattttttcccca

SEQ ID NO: 315074 - DNA, 25 bp, Mus musculus
cagcatgtaacaaagtccagcgact

SEQ ID NO: 315075 - DNA, 25 bp, Mus musculus
cagcatgtaacatagtccagcgact

SEQ ID NO: 315076 - DNA, 25 bp, Mus musculus
cagcatgtactactgcacggtttta

SEQ ID NO: 315077 - DNA, 25 bp, Mus musculus
cagcatgtactagtgcacggtttta

SEQ ID NO: 315078 - DNA, 25 bp, Mus musculus
cagcatgtattacgctctaggttac

SEQ ID NO: 315079 - DNA, 25 bp, Mus musculus
cagcatgtattaggctctaggttac

SEQ ID NO: 315080 - DNA, 25 bp, Mus musculus
cagcatgtgcaaacacagggtgcta

SEQ ID NO: 315081 - DNA, 25 bp, Mus musculus
cagcatgtgcaatcacagggtgcta

SEQ ID NO: 315082 - DNA, 25 bp, Mus musculus
cagcatgtggctcgctgacattctg

SEQ ID NO: 315083 - DNA, 25 bp, Mus musculus
cagcatgtggctggctgacattctg

SEQ ID NO: 315084 - DNA, 25 bp, Mus musculus
cagcatgtgtcacttctacctgggc

SEQ ID NO: 315085 - DNA, 25 bp, Mus musculus
cagcatgtgtcagttctacctgggc

SEQ ID NO: 315086 - DNA, 25 bp, Mus musculus
cagcatgttttgagggtttgtggac

SEQ ID NO: 315087 - DNA, 25 bp, Mus musculus
cagcatgttttgtgggtttgtggac

SEQ ID NO: 315088 - DNA, 25 bp, Mus musculus
cagcattactgaactgttttgatgg

SEQ ID NO: 315089 - DNA, 25 bp, Mus musculus
cagcattactgatctgttttgatgg

SEQ ID NO: 315090 - DNA, 25 bp, Mus musculus
cagcattagctgcagacataagtgt

SEQ ID NO: 315091 - DNA, 25 bp, Mus musculus
cagcattagctggagacataagtgt

SEQ ID NO: 315092 - DNA, 25 bp, Mus musculus
cagcattaggtcagttggttctgtt

SEQ ID NO: 315093 - DNA, 25 bp, Mus musculus
cagcattaggtctgttggttctgtt

SEQ ID NO: 315094 - DNA, 25 bp, Mus musculus
cagcattattttcggcgtggctgag

SEQ ID NO: 315095 - DNA, 25 bp, Mus musculus
cagcattattttgggcgtggctgag

SEQ ID NO: 315096 - DNA, 25 bp, Mus musculus
cagcattcagaacagcctggctttt

SEQ ID NO: 315097 - DNA, 25 bp, Mus musculus
cagcattcagaagagcctggctttt

SEQ ID NO: 315098 - DNA, 25 bp, Mus musculus
cagcattcagtcctgattctctaca

SEQ ID NO: 315099 - DNA, 25 bp, Mus musculus
cagcattcagtcgtgattctctaca

SEQ ID NO: 315100 - DNA, 25 bp, Mus musculus
cagcattccagcaatgatcatgttg

SEQ ID NO: 315101 - DNA, 25 bp, Mus musculus
cagcattccagctatgatcatgttg

SEQ ID NO: 315102 - DNA, 25 bp, Mus musculus
cagcattcccagacaccagaggcag

SEQ ID NO: 315103 - DNA, 25 bp, Mus musculus
cagcattcccagtcaccagaggcag

SEQ ID NO: 315104 - DNA, 25 bp, Mus musculus
cagcattccccaaaattccagtgaa

SEQ ID NO: 315105 - DNA, 25 bp, Mus musculus
cagcattccccataattccagtgaa

SEQ ID NO: 315106 - DNA, 25 bp, Mus musculus
cagcattccctcctcaaatcaatgt

SEQ ID NO: 315107 - DNA, 25 bp, Mus musculus
cagcattccctcgtcaaatcaatgt

SEQ ID NO: 315108 - DNA, 25 bp, Mus musculus
cagcattcctacaaagacctagtaa

SEQ ID NO: 315109 - DNA, 25 bp, Mus musculus
cagcattcctactaagacctagtaa

SEQ ID NO: 315110 - DNA, 25 bp, Mus musculus
cagcattcctccctataaatataaa

SEQ ID NO: 315111 - DNA, 25 bp, Mus musculus
cagcattcctccgtataaatataaa

SEQ ID NO: 315112 - DNA, 25 bp, Mus musculus
cagcattccttccatacagcttata

SEQ ID NO: 315113 - DNA, 25 bp, Mus musculus
cagcattccttcgatacagcttata

SEQ ID NO: 315114 - DNA, 25 bp, Mus musculus
cagcattcggctattcatctgcctt

SEQ ID NO: 315115 - DNA, 25 bp, Mus musculus
cagcattcggcttttcatctgcctt

SEQ ID NO: 315116 - DNA, 25 bp, Mus musculus
cagcattctccaacaattcttcaat

SEQ ID NO: 315117 - DNA, 25 bp, Mus musculus
cagcattctccatcaattcttcaat

SEQ ID NO: 315118 - DNA, 25 bp, Mus musculus
cagcattctgtgatggtctgcatca

SEQ ID NO: 315119 - DNA, 25 bp, Mus musculus
cagcattctgtgttggtctgcatca

SEQ ID NO: 315120 - DNA, 25 bp, Mus musculus
cagcattcttaacagctccgacaat

SEQ ID NO: 315121 - DNA, 25 bp, Mus musculus
cagcattcttaagagctccgacaat

SEQ ID NO: 315122 - DNA, 25 bp, Mus musculus
cagcattgacatcccgaggactttt

SEQ ID NO: 315123 - DNA, 25 bp, Mus musculus
cagcattgacatgccgaggactttt

SEQ ID NO: 315124 - DNA, 25 bp, Mus musculus
cagcattgccacagtgatataggat

SEQ ID NO: 315125 - DNA, 25 bp, Mus musculus
cagcattgccactgtgatataggat

SEQ ID NO: 315126 - DNA, 25 bp, Mus musculus
cagcattgcccacttgttagtgtcg

SEQ ID NO: 315127 - DNA, 25 bp, Mus musculus
cagcattgcccagttgttagtgtcg

SEQ ID NO: 315128 - DNA, 25 bp, Mus musculus
cagcattgccttcggccaaacgtaa

SEQ ID NO: 315129 - DNA, 25 bp, Mus musculus
cagcattgccttgggccaaacgtaa

SEQ ID NO: 315130 - DNA, 25 bp, Mus musculus
cagcattgctgccattatggagaga

SEQ ID NO: 315131 - DNA, 25 bp, Mus musculus
cagcattgctgcgattatggagaga

SEQ ID NO: 315132 - DNA, 25 bp, Mus musculus
cagcattgctgtatatccggttaat

SEQ ID NO: 315133 - DNA, 25 bp, Mus musculus
cagcattgctgtttatccggttaat

SEQ ID NO: 315134 - DNA, 25 bp, Mus musculus
cagcattgcttcagtgtaaattatg

SEQ ID NO: 315135 - DNA, 25 bp, Mus musculus
cagcattgcttctgtgtaaattatg

SEQ ID NO: 315136 - DNA, 25 bp, Mus musculus
cagcattgctttataacatagcctt

SEQ ID NO: 315137 - DNA, 25 bp, Mus musculus
cagcattgctttttaacatagcctt

SEQ ID NO: 315138 - DNA, 25 bp, Mus musculus
cagcattggcagactcattgggatt

SEQ ID NO: 315139 - DNA, 25 bp, Mus musculus
cagcattggcagtctcattgggatt

SEQ ID NO: 315140 - DNA, 25 bp, Mus musculus
cagcattggtgaccctggtgcgcac

SEQ ID NO: 315141 - DNA, 25 bp, Mus musculus
cagcattggtgagcctggtgcgcac

SEQ ID NO: 315142 - DNA, 25 bp, Mus musculus
cagcattgtcagagtaacggcctac

SEQ ID NO: 315143 - DNA, 25 bp, Mus musculus
cagcattgtcagtgtaacggcctac

SEQ ID NO: 315144 - DNA, 25 bp, Mus musculus
cagcatttactaactggcagctttc

SEQ ID NO: 315145 - DNA, 25 bp, Mus musculus
cagcatttactatctggcagctttc

SEQ ID NO: 315146 - DNA, 25 bp, Mus musculus
cagcatttatcactctctggctaat

SEQ ID NO: 315147 - DNA, 25 bp, Mus musculus
cagcatttatcagtctctggctaat

SEQ ID NO: 315148 - DNA, 25 bp, Mus musculus
cagcatttcattctgttacccttga

SEQ ID NO: 315149 - DNA, 25 bp, Mus musculus
cagcatttcattgtgttacccttga

SEQ ID NO: 315150 - DNA, 25 bp, Mus musculus
cagcatttcctacactggctcagag

SEQ ID NO: 315151 - DNA, 25 bp, Mus musculus
cagcatttcctagactggctcagag

SEQ ID NO: 315152 - DNA, 25 bp, Mus musculus
cagcatttggacaggatctacattt

SEQ ID NO: 315153 - DNA, 25 bp, Mus musculus
cagcatttggactggatctacattt

SEQ ID NO: 315154 - DNA, 25 bp, Mus musculus
cagcatttggagatggtctctctga

SEQ ID NO: 315155 - DNA, 25 bp, Mus musculus
cagcatttggagttggtctctctga

SEQ ID NO: 315156 - DNA, 25 bp, Mus musculus
cagcatttggataattggcacaggg

SEQ ID NO: 315157 - DNA, 25 bp, Mus musculus
cagcatttggattattggcacaggg

SEQ ID NO: 315158 - DNA, 25 bp, Mus musculus
cagcatttttgccacactagtagaa

SEQ ID NO: 315159 - DNA, 25 bp, Mus musculus
cagcatttttgcgacactagtagaa

SEQ ID NO: 315160 - DNA, 25 bp, Mus musculus
cagcattttttcaaagagcccacca

SEQ ID NO: 315161 - DNA, 25 bp, Mus musculus
cagcattttttcagtctaggccaat

SEQ ID NO: 315162 - DNA, 25 bp, Mus musculus
cagcattttttctaagagcccacca

SEQ ID NO: 315163 - DNA, 25 bp, Mus musculus
cagcattttttctgtctaggccaat

SEQ ID NO: 315164 - DNA, 25 bp, Mus musculus
cagccaaaaaatatgtatagggtta

SEQ ID NO: 315165 - DNA, 25 bp, Mus musculus
cagccaaaaaatttgtatagggtta

SEQ ID NO: 315166 - DNA, 25 bp, Mus musculus
cagccaaaacacacggatgtccact

SEQ ID NO: 315167 - DNA, 25 bp, Mus musculus
cagccaaaacactcggatgtccact

SEQ ID NO: 315168 - DNA, 25 bp, Mus musculus
cagccaaaccttactgcttttacaa

SEQ ID NO: 315169 - DNA, 25 bp, Mus musculus
cagccaaacctttctgcttttacaa

SEQ ID NO: 315170 - DNA, 25 bp, Mus musculus
cagccaaagagcaggactgcctgcc

SEQ ID NO: 315171 - DNA, 25 bp, Mus musculus
cagccaaagagctggactgcctgcc

SEQ ID NO: 315172 - DNA, 25 bp, Mus musculus
cagccaacatctcggctgctgcagg

SEQ ID NO: 315173 - DNA, 25 bp, Mus musculus
cagccaacatctgggctgctgcagg

SEQ ID NO: 315174 - DNA, 25 bp, Mus musculus
cagccaacatggacacgtgcacaat

SEQ ID NO: 315175 - DNA, 25 bp, Mus musculus
cagccaacatggtcacgtgcacaat

SEQ ID NO: 315176 - DNA, 25 bp, Mus musculus
cagccaaccaaccagcagtttaaga

SEQ ID NO: 315177 - DNA, 25 bp, Mus musculus
cagccaaccaacgagcagtttaaga

SEQ ID NO: 315178 - DNA, 25 bp, Mus musculus
cagccaacttcaacaagccaggtaa

SEQ ID NO: 315179 - DNA, 25 bp, Mus musculus
cagccaacttcatcaagccaggtaa

SEQ ID NO: 315180 - DNA, 25 bp, Mus musculus
cagccaacttggctcctggatcagt

SEQ ID NO: 315181 - DNA, 25 bp, Mus musculus
cagccaacttgggtcctggatcagt

SEQ ID NO: 315182 - DNA, 25 bp, Mus musculus
cagccaacttttaccctgaaacgtg

SEQ ID NO: 315183 - DNA, 25 bp, Mus musculus
cagccaactttttccctgaaacgtg

SEQ ID NO: 315184 - DNA, 25 bp, Mus musculus
cagccaagcctgatcatgatgatgt

SEQ ID NO: 315185 - DNA, 25 bp, Mus musculus
cagccaagcctgatgccgtgagttt

SEQ ID NO: 315186 - DNA, 25 bp, Mus musculus
cagccaagcctgttcatgatgatgt

SEQ ID NO: 315187 - DNA, 25 bp, Mus musculus
cagccaagcctgttgccgtgagttt

SEQ ID NO: 315188 - DNA, 25 bp, Mus musculus
cagccaagctgacagtgtgtatttt

SEQ ID NO: 315189 - DNA, 25 bp, Mus musculus
cagccaagctgagagtgtgtatttt

SEQ ID NO: 315190 - DNA, 25 bp, Mus musculus
cagccaagcttgagcacttctggta

SEQ ID NO: 315191 - DNA, 25 bp, Mus musculus
cagccaagcttgtgcacttctggta

SEQ ID NO: 315192 - DNA, 25 bp, Mus musculus
cagccaaggaccagtgcctctgacc

SEQ ID NO: 315193 - DNA, 25 bp, Mus musculus
cagccaaggacctgtgcctctgacc

SEQ ID NO: 315194 - DNA, 25 bp, Mus musculus
cagccaaggcctcaggtttccagaa

SEQ ID NO: 315195 - DNA, 25 bp, Mus musculus
cagccaaggcctgaggtttccagaa

SEQ ID NO: 315196 - DNA, 25 bp, Mus musculus
cagccaagggctacaccagtgacgt

SEQ ID NO: 315197 - DNA, 25 bp, Mus musculus
cagccaagggcttcaccagtgacgt

SEQ ID NO: 315198 - DNA, 25 bp, Mus musculus
cagccaaggtttacctcctggagcc

SEQ ID NO: 315199 - DNA, 25 bp, Mus musculus
cagccaaggttttcctcctggagcc

SEQ ID NO: 315200 - DNA, 25 bp, Mus musculus
cagccaagtcagctgccaatgtctt

SEQ ID NO: 315201 - DNA, 25 bp, Mus musculus
cagccaagtcaggtgccaatgtctt

SEQ ID NO: 315202 - DNA, 25 bp, Mus musculus
cagccaagttttatatggttcccag

SEQ ID NO: 315203 - DNA, 25 bp, Mus musculus
cagccaagttttttatggttcccag

SEQ ID NO: 315204 - DNA, 25 bp, Mus musculus
cagccaataatgagagcccctatat

SEQ ID NO: 315205 - DNA, 25 bp, Mus musculus
cagccaataatgtgagcccctatat

SEQ ID NO: 315206 - DNA, 25 bp, Mus musculus
cagccaatcaacctggttagagtaa

SEQ ID NO: 315207 - DNA, 25 bp, Mus musculus
cagccaatcaacgtggttagagtaa

SEQ ID NO: 315208 - DNA, 25 bp, Mus musculus
cagccaatctaaaagatgttacgga

SEQ ID NO: 315209 - DNA, 25 bp, Mus musculus
cagccaatctaatagatgttacgga

SEQ ID NO: 315210 - DNA, 25 bp, Mus musculus
cagccaatctgtcagcaccagcttt

SEQ ID NO: 315211 - DNA, 25 bp, Mus musculus
cagccaatctgtgagcaccagcttt

SEQ ID NO: 315212 - DNA, 25 bp, Mus musculus
cagccaatctttatgcacgttctat

SEQ ID NO: 315213 - DNA, 25 bp, Mus musculus
cagccaatctttttgcacgttctat

SEQ ID NO: 315214 - DNA, 25 bp, Mus musculus
cagccaatgatcactttcaaatttg

SEQ ID NO: 315215 - DNA, 25 bp, Mus musculus
cagccaatgatctctttcaaatttg

SEQ ID NO: 315216 - DNA, 25 bp, Mus musculus
cagccaatgctacgtagagagagac

SEQ ID NO: 315217 - DNA, 25 bp, Mus musculus
cagccaatgctaggtagagagagac

SEQ ID NO: 315218 - DNA, 25 bp, Mus musculus
cagccaatgtctcggaattctgctt

SEQ ID NO: 315219 - DNA, 25 bp, Mus musculus
cagccaatgtctgggaattctgctt

SEQ ID NO: 315220 - DNA, 25 bp, Mus musculus
cagccaattagactctgccttatta

SEQ ID NO: 315221 - DNA, 25 bp, Mus musculus
cagccaattagagtctgccttatta

SEQ ID NO: 315222 - DNA, 25 bp, Mus musculus
cagccacaacctcccggttaaagat

SEQ ID NO: 315223 - DNA, 25 bp, Mus musculus
cagccacaacctgccggttaaagat

SEQ ID NO: 315224 - DNA, 25 bp, Mus musculus
cagccacaagcaatactaccacagg

SEQ ID NO: 315225 - DNA, 25 bp, Mus musculus
cagccacaagcattactaccacagg

SEQ ID NO: 315226 - DNA, 25 bp, Mus musculus
cagccacaccctagtacattatttt

SEQ ID NO: 315227 - DNA, 25 bp, Mus musculus
cagccacacccttgtacattatttt

SEQ ID NO: 315228 - DNA, 25 bp, Mus musculus
cagccacacgtaagttacaggcggt

SEQ ID NO: 315229 - DNA, 25 bp, Mus musculus
cagccacacgtatgttacaggcggt

SEQ ID NO: 315230 - DNA, 25 bp, Mus musculus
cagccacacgtgagacctgtgagga

SEQ ID NO: 315231 - DNA, 25 bp, Mus musculus
cagccacacgtgtgacctgtgagga

SEQ ID NO: 315232 - DNA, 25 bp, Mus musculus
cagccacagcctcatgacagttttc

SEQ ID NO: 315233 - DNA, 25 bp, Mus musculus
cagccacagcctgatgacagttttc

SEQ ID NO: 315234 - DNA, 25 bp, Mus musculus
cagccacaggttactattctgagtt

SEQ ID NO: 315235 - DNA, 25 bp, Mus musculus
cagccacaggtttctattctgagtt

SEQ ID NO: 315236 - DNA, 25 bp, Mus musculus
cagccacagtctatgaagccgttcc

SEQ ID NO: 315237 - DNA, 25 bp, Mus musculus
cagccacagtctttgaagccgttcc

SEQ ID NO: 315238 - DNA, 25 bp, Mus musculus
cagccacagtgaccaggaatgtgac

SEQ ID NO: 315239 - DNA, 25 bp, Mus musculus
cagccacagtgagcaggaatgtgac

SEQ ID NO: 315240 - DNA, 25 bp, Mus musculus
cagccacattctacctggactgagg

SEQ ID NO: 315241 - DNA, 25 bp, Mus musculus
cagccacattcttcctggactgagg

SEQ ID NO: 315242 - DNA, 25 bp, Mus musculus
cagccaccaagcagttgtctgtgtc

SEQ ID NO: 315243 - DNA, 25 bp, Mus musculus
cagccaccaagctgttgtctgtgtc

SEQ ID NO: 315244 - DNA, 25 bp, Mus musculus
cagccaccatgaaaagcgccagcag

SEQ ID NO: 315245 - DNA, 25 bp, Mus musculus
cagccaccatgataagcgccagcag

SEQ ID NO: 315246 - DNA, 25 bp, Mus musculus
cagccacccagtcgctggtctggaa

SEQ ID NO: 315247 - DNA, 25 bp, Mus musculus
cagccacccagtggctggtctggaa

SEQ ID NO: 315248 - DNA, 25 bp, Mus musculus
cagccaccgaagactacttttagta

SEQ ID NO: 315249 - DNA, 25 bp, Mus musculus
cagccaccgaagtctacttttagta

SEQ ID NO: 315250 - DNA, 25 bp, Mus musculus
cagccacctatcctacttgttaagt

SEQ ID NO: 315251 - DNA, 25 bp, Mus musculus
cagccacctatcgtacttgttaagt

SEQ ID NO: 315252 - DNA, 25 bp, Mus musculus
cagccacctcagcagaattgtttaa

SEQ ID NO: 315253 - DNA, 25 bp, Mus musculus
cagccacctcaggagaattgtttaa

SEQ ID NO: 315254 - DNA, 25 bp, Mus musculus
cagccacctctgaattacactttaa

SEQ ID NO: 315255 - DNA, 25 bp, Mus musculus
cagccacctctgtattacactttaa

SEQ ID NO: 315256 - DNA, 25 bp, Mus musculus
cagccacgagtgatgacgcgaacta

SEQ ID NO: 315257 - DNA, 25 bp, Mus musculus
cagccacgagtgttgacgcgaacta

SEQ ID NO: 315258 - DNA, 25 bp, Mus musculus
cagccacgcgggactcctgaggtct

SEQ ID NO: 315259 - DNA, 25 bp, Mus musculus
cagccacgcgggtctcctgaggtct

SEQ ID NO: 315260 - DNA, 25 bp, Mus musculus
cagccacggccaagttttcgaggaa

SEQ ID NO: 315261 - DNA, 25 bp, Mus musculus
cagccacggccatgttttcgaggaa

SEQ ID NO: 315262 - DNA, 25 bp, Mus musculus
cagccacgggtgcacatcataaaga

SEQ ID NO: 315263 - DNA, 25 bp, Mus musculus
cagccacgggtggacatcataaaga

SEQ ID NO: 315264 - DNA, 25 bp, Mus musculus
cagccacggtggaaatctagagaca

SEQ ID NO: 315265 - DNA, 25 bp, Mus musculus
cagccacggtggtaatctagagaca

SEQ ID NO: 315266 - DNA, 25 bp, Mus musculus
cagccactaagtcatgcctggactt

SEQ ID NO: 315267 - DNA, 25 bp, Mus musculus
cagccactaagtgatgcctggactt

SEQ ID NO: 315268 - DNA, 25 bp, Mus musculus
cagccactaggtaccgccagaagaa

SEQ ID NO: 315269 - DNA, 25 bp, Mus musculus
cagccactaggttccgccagaagaa

SEQ ID NO: 315270 - DNA, 25 bp, Mus musculus
cagccactcactccagtgtggcagg

SEQ ID NO: 315271 - DNA, 25 bp, Mus musculus
cagccactcactgcagtgtggcagg

SEQ ID NO: 315272 - DNA, 25 bp, Mus musculus
cagccactccctagattggatttga

SEQ ID NO: 315273 - DNA, 25 bp, Mus musculus
cagccactcccttgattggatttga

SEQ ID NO: 315274 - DNA, 25 bp, Mus musculus
cagccactcgtgcttccgtctagaa

SEQ ID NO: 315275 - DNA, 25 bp, Mus musculus
cagccactcgtggttccgtctagaa

SEQ ID NO: 315276 - DNA, 25 bp, Mus musculus
cagccactctgtcggtggtttctga

SEQ ID NO: 315277 - DNA, 25 bp, Mus musculus
cagccactctgtgggtggtttctga

SEQ ID NO: 315278 - DNA, 25 bp, Mus musculus
cagccactgagacccgtagagacat

SEQ ID NO: 315279 - DNA, 25 bp, Mus musculus
cagccactgagagccgtagagacat

SEQ ID NO: 315280 - DNA, 25 bp, Mus musculus
cagccactggacacagcttgtggag

SEQ ID NO: 315281 - DNA, 25 bp, Mus musculus
cagccactggactcagcttgtggag

SEQ ID NO: 315282 - DNA, 25 bp, Mus musculus
cagccactggagatcctgcggacat

SEQ ID NO: 315283 - DNA, 25 bp, Mus musculus
cagccactggagttcctgcggacat

SEQ ID NO: 315284 - DNA, 25 bp, Mus musculus
cagccactggcaaagtgatgcccat

SEQ ID NO: 315285 - DNA, 25 bp, Mus musculus
cagccactggcatagtgatgcccat

SEQ ID NO: 315286 - DNA, 25 bp, Mus musculus
cagccactggctctcagatttttat

SEQ ID NO: 315287 - DNA, 25 bp, Mus musculus
cagccactggctgtcagatttttat

SEQ ID NO: 315288 - DNA, 25 bp, Mus musculus
cagccactgtagcatacccaagagg

SEQ ID NO: 315289 - DNA, 25 bp, Mus musculus
cagccactgtaggatacccaagagg

SEQ ID NO: 315290 - DNA, 25 bp, Mus musculus
cagccacttgtgcaggaccaggtac

SEQ ID NO: 315291 - DNA, 25 bp, Mus musculus
cagccacttgtggaggaccaggtac

SEQ ID NO: 315292 - DNA, 25 bp, Mus musculus
cagccacttttcatgtacaactacg

SEQ ID NO: 315293 - DNA, 25 bp, Mus musculus
cagccacttttcttgtacaactacg

SEQ ID NO: 315294 - DNA, 25 bp, Mus musculus
cagccagaacagcactccatgtgga

SEQ ID NO: 315295 - DNA, 25 bp, Mus musculus
cagccagaacaggactccatgtgga

SEQ ID NO: 315296 - DNA, 25 bp, Mus musculus
cagccagaaccacataacccagaaa

SEQ ID NO: 315297 - DNA, 25 bp, Mus musculus
cagccagaaccagataacccagaaa

SEQ ID NO: 315298 - DNA, 25 bp, Mus musculus
cagccagaagttacagccgaccttg

SEQ ID NO: 315299 - DNA, 25 bp, Mus musculus
cagccagaagtttcagccgaccttg

SEQ ID NO: 315300 - DNA, 25 bp, Mus musculus
cagccagacaagcaagccaggcggc

SEQ ID NO: 315301 - DNA, 25 bp, Mus musculus
cagccagacaaggaagccaggcggc

SEQ ID NO: 315302 - DNA, 25 bp, Mus musculus
cagccagacacaccaaggatgtttt

SEQ ID NO: 315303 - DNA, 25 bp, Mus musculus
cagccagacacagcaaggatgtttt

SEQ ID NO: 315304 - DNA, 25 bp, Mus musculus
cagccagacagcagagttaagaaaa

SEQ ID NO: 315305 - DNA, 25 bp, Mus musculus
cagccagacagctgagttaagaaaa

SEQ ID NO: 315306 - DNA, 25 bp, Mus musculus
cagccagacctactattgcttcaat

SEQ ID NO: 315307 - DNA, 25 bp, Mus musculus
cagccagacctagtattgcttcaat

SEQ ID NO: 315308 - DNA, 25 bp, Mus musculus
cagccagacctcaagacttgggaga

SEQ ID NO: 315309 - DNA, 25 bp, Mus musculus
cagccagacctctagacttgggaga

SEQ ID NO: 315310 - DNA, 25 bp, Mus musculus
cagccagagacacctcgaacatcta

SEQ ID NO: 315311 - DNA, 25 bp, Mus musculus
cagccagagacagctcgaacatcta

SEQ ID NO: 315312 - DNA, 25 bp, Mus musculus
cagccagagagtcactacagcagat

SEQ ID NO: 315313 - DNA, 25 bp, Mus musculus
cagccagagagtgactacagcagat

SEQ ID NO: 315314 - DNA, 25 bp, Mus musculus
cagccagagcccatgtgtggaggaa

SEQ ID NO: 315315 - DNA, 25 bp, Mus musculus
cagccagagcccttgtgtggaggaa

SEQ ID NO: 315316 - DNA, 25 bp, Mus musculus
cagccagagtgactcggtctccgga

SEQ ID NO: 315317 - DNA, 25 bp, Mus musculus
cagccagagtgagtcggtctccgga

SEQ ID NO: 315318 - DNA, 25 bp, Mus musculus
cagccagagtgcaagcctgattcaa

SEQ ID NO: 315319 - DNA, 25 bp, Mus musculus
cagccagagtgctagcctgattcaa

SEQ ID NO: 315320 - DNA, 25 bp, Mus musculus
cagccagatccaccctgtagctaag

SEQ ID NO: 315321 - DNA, 25 bp, Mus musculus
cagccagatccagcctgtagctaag

SEQ ID NO: 315322 - DNA, 25 bp, Mus musculus
cagccagatgaactcaccttggaga

SEQ ID NO: 315323 - DNA, 25 bp, Mus musculus
cagccagatgaagtcaccttggaga

SEQ ID NO: 315324 - DNA, 25 bp, Mus musculus
cagccagatgatcatgcccaatgtc

SEQ ID NO: 315325 - DNA, 25 bp, Mus musculus
cagccagatgatgatgcccaatgtc

SEQ ID NO: 315326 - DNA, 25 bp, Mus musculus
cagccagatgcaaggagtttctcct

SEQ ID NO: 315327 - DNA, 25 bp, Mus musculus
cagccagatgcatggagtttctcct

SEQ ID NO: 315328 - DNA, 25 bp, Mus musculus
cagccagatgctcctggtgtataca

SEQ ID NO: 315329 - DNA, 25 bp, Mus musculus
cagccagatgctgctggtgtataca

SEQ ID NO: 315330 - DNA, 25 bp, Mus musculus
cagccagatggcagtgcggccatgt

SEQ ID NO: 315331 - DNA, 25 bp, Mus musculus
cagccagatggctgtgcggccatgt

SEQ ID NO: 315332 - DNA, 25 bp, Mus musculus
cagccagcaactcacttaggttttt

SEQ ID NO: 315333 - DNA, 25 bp, Mus musculus
cagccagcaactgacttaggttttt

SEQ ID NO: 315334 - DNA, 25 bp, Mus musculus
cagccagcaattcagagcagtttta

SEQ ID NO: 315335 - DNA, 25 bp, Mus musculus
cagccagcaattgagagcagtttta

SEQ ID NO: 315336 - DNA, 25 bp, Mus musculus
cagccagcaggccagtgcaatgtaa

SEQ ID NO: 315337 - DNA, 25 bp, Mus musculus
cagccagcaggcgagtgcaatgtaa

SEQ ID NO: 315338 - DNA, 25 bp, Mus musculus
cagccagcagttatgagacagccat

SEQ ID NO: 315339 - DNA, 25 bp, Mus musculus
cagccagcagttctagaatgctatt

SEQ ID NO: 315340 - DNA, 25 bp, Mus musculus
cagccagcagttgtagaatgctatt

SEQ ID NO: 315341 - DNA, 25 bp, Mus musculus
cagccagcagttttgagacagccat

SEQ ID NO: 315342 - DNA, 25 bp, Mus musculus
cagccagcatctacttcattgagag

SEQ ID NO: 315343 - DNA, 25 bp, Mus musculus
cagccagcatcttcttcattgagag

SEQ ID NO: 315344 - DNA, 25 bp, Mus musculus
cagccagcatggcttgtgagctcaa

SEQ ID NO: 315345 - DNA, 25 bp, Mus musculus
cagccagcatgggttgtgagctcaa

SEQ ID NO: 315346 - DNA, 25 bp, Mus musculus
cagccagccacacggttgagagcag

SEQ ID NO: 315347 - DNA, 25 bp, Mus musculus
cagccagccacagggttgagagcag

SEQ ID NO: 315348 - DNA, 25 bp, Mus musculus
cagccagccactctgtgttatggtt

SEQ ID NO: 315349 - DNA, 25 bp, Mus musculus
cagccagccactgtgtgttatggtt

SEQ ID NO: 315350 - DNA, 25 bp, Mus musculus
cagccagcccatctgttaaaacata

SEQ ID NO: 315351 - DNA, 25 bp, Mus musculus
cagccagcccatgtgttaaaacata

SEQ ID NO: 315352 - DNA, 25 bp, Mus musculus
cagccagcctgtagttatctgtgta

SEQ ID NO: 315353 - DNA, 25 bp, Mus musculus
cagccagcctgttgttatctgtgta

SEQ ID NO: 315354 - DNA, 25 bp, Mus musculus
cagccagcctttagtgtgttcatga

SEQ ID NO: 315355 - DNA, 25 bp, Mus musculus
cagccagccttttgtgtgttcatga

SEQ ID NO: 315356 - DNA, 25 bp, Mus musculus
cagccagcgctaaacttttgcttag

SEQ ID NO: 315357 - DNA, 25 bp, Mus musculus
cagccagcgctatacttttgcttag

SEQ ID NO: 315358 - DNA, 25 bp, Mus musculus
cagccagcgctgcatagagaaatcc

SEQ ID NO: 315359 - DNA, 25 bp, Mus musculus
cagccagcgctggatagagaaatcc

SEQ ID NO: 315360 - DNA, 25 bp, Mus musculus
cagccagctaatattccagagggaa

SEQ ID NO: 315361 - DNA, 25 bp, Mus musculus
cagccagctaattttccagagggaa

SEQ ID NO: 315362 - DNA, 25 bp, Mus musculus
cagccagctaccattttagtcaaga

SEQ ID NO: 315363 - DNA, 25 bp, Mus musculus
cagccagctacctttttagtcaaga

SEQ ID NO: 315364 - DNA, 25 bp, Mus musculus
cagccagctattcccggcagaggat

SEQ ID NO: 315365 - DNA, 25 bp, Mus musculus
cagccagctattgccggcagaggat

SEQ ID NO: 315366 - DNA, 25 bp, Mus musculus
cagccagctcccaaaatgaaaagac

SEQ ID NO: 315367 - DNA, 25 bp, Mus musculus
cagccagctccctaaatgaaaagac

SEQ ID NO: 315368 - DNA, 25 bp, Mus musculus
cagccagctggaagactttactaat

SEQ ID NO: 315369 - DNA, 25 bp, Mus musculus
cagccagctggatgactttactaat

SEQ ID NO: 315370 - DNA, 25 bp, Mus musculus
cagccagctggcagaatgcaggtta

SEQ ID NO: 315371 - DNA, 25 bp, Mus musculus
cagccagctggctgaatgcaggtta

SEQ ID NO: 315372 - DNA, 25 bp, Mus musculus
cagccagctgttatgtagtagttat

SEQ ID NO: 315373 - DNA, 25 bp, Mus musculus
cagccagctgttttgtagtagttat

SEQ ID NO: 315374 - DNA, 25 bp, Mus musculus
cagccaggactcaggcctttcaaac

SEQ ID NO: 315375 - DNA, 25 bp, Mus musculus
cagccaggactctggcctttcaaac

SEQ ID NO: 315376 - DNA, 25 bp, Mus musculus
cagccaggagctagacgtgaaacga

SEQ ID NO: 315377 - DNA, 25 bp, Mus musculus
cagccaggagcttgacgtgaaacga

SEQ ID NO: 315378 - DNA, 25 bp, Mus musculus
cagccaggagtcacggcagcacaag

SEQ ID NO: 315379 - DNA, 25 bp, Mus musculus
cagccaggagtctcggcagcacaag

SEQ ID NO: 315380 - DNA, 25 bp, Mus musculus
cagccaggcaatcactctgaactct

SEQ ID NO: 315381 - DNA, 25 bp, Mus musculus
cagccaggcaatgactctgaactct

SEQ ID NO: 315382 - DNA, 25 bp, Mus musculus
cagccaggcagtatttcagcatttt

SEQ ID NO: 315383 - DNA, 25 bp, Mus musculus
cagccaggcagtttttcagcatttt

SEQ ID NO: 315384 - DNA, 25 bp, Mus musculus
cagccaggcattatggtggacatca

SEQ ID NO: 315385 - DNA, 25 bp, Mus musculus
cagccaggcattttggtggacatca

SEQ ID NO: 315386 - DNA, 25 bp, Mus musculus
cagccaggcccaataaacactttaa

SEQ ID NO: 315387 - DNA, 25 bp, Mus musculus
cagccaggcccattaaacactttaa

SEQ ID NO: 315388 - DNA, 25 bp, Mus musculus
cagccaggcctcatgggttagtgat

SEQ ID NO: 315389 - DNA, 25 bp, Mus musculus
cagccaggcctcttgggttagtgat

SEQ ID NO: 315390 - DNA, 25 bp, Mus musculus
cagccaggctaaagttgctttccaa

SEQ ID NO: 315391 - DNA, 25 bp, Mus musculus
cagccaggctaatgttgctttccaa

SEQ ID NO: 315392 - DNA, 25 bp, Mus musculus
cagccaggctagaggagtgccagca

SEQ ID NO: 315393 - DNA, 25 bp, Mus musculus
cagccaggctagtggagtgccagca

SEQ ID NO: 315394 - DNA, 25 bp, Mus musculus
cagccagggaatcacaaattcaagc

SEQ ID NO: 315395 - DNA, 25 bp, Mus musculus
cagccagggaatgacaaattcaagc

SEQ ID NO: 315396 - DNA, 25 bp, Mus musculus
cagccagggctacgtcatagtttat

SEQ ID NO: 315397 - DNA, 25 bp, Mus musculus
cagccagggctaggtcatagtttat

SEQ ID NO: 315398 - DNA, 25 bp, Mus musculus
cagccaggtcataccctgtggaggt

SEQ ID NO: 315399 - DNA, 25 bp, Mus musculus
cagccaggtcattccctgtggaggt

SEQ ID NO: 315400 - DNA, 25 bp, Mus musculus
cagccaggttaaacctgaccttaag

SEQ ID NO: 315401 - DNA, 25 bp, Mus musculus
cagccaggttaatcctgaccttaag

SEQ ID NO: 315402 - DNA, 25 bp, Mus musculus
cagccagtacaacatctatacatag

SEQ ID NO: 315403 - DNA, 25 bp, Mus musculus
cagccagtacaagatctatacatag

SEQ ID NO: 315404 - DNA, 25 bp, Mus musculus
cagccagtagagcatcagagttttg

SEQ ID NO: 315405 - DNA, 25 bp, Mus musculus
cagccagtagaggatcagagttttg

SEQ ID NO: 315406 - DNA, 25 bp, Mus musculus
cagccagtatccctgaagcaatctt

SEQ ID NO: 315407 - DNA, 25 bp, Mus musculus
cagccagtatccgtgaagcaatctt

SEQ ID NO: 315408 - DNA, 25 bp, Mus musculus
cagccagtcacgagaggtttcgttt

SEQ ID NO: 315409 - DNA, 25 bp, Mus musculus
cagccagtcacgtgaggtttcgttt

SEQ ID NO: 315410 - DNA, 25 bp, Mus musculus
cagccagtcataatgttcttgtctt

SEQ ID NO: 315411 - DNA, 25 bp, Mus musculus
cagccagtcatattgttcttgtctt

SEQ ID NO: 315412 - DNA, 25 bp, Mus musculus
cagccagtcctaatttacctttatt

SEQ ID NO: 315413 - DNA, 25 bp, Mus musculus
cagccagtcctattttacctttatt

SEQ ID NO: 315414 - DNA, 25 bp, Mus musculus
cagccagtctctcattcagttatat

SEQ ID NO: 315415 - DNA, 25 bp, Mus musculus
cagccagtctctgattcagttatat

SEQ ID NO: 315416 - DNA, 25 bp, Mus musculus
cagccagtgattaatctttgttcta

SEQ ID NO: 315417 - DNA, 25 bp, Mus musculus
cagccagtgatttatctttgttcta

SEQ ID NO: 315418 - DNA, 25 bp, Mus musculus
cagccagtgcagctcaccaaagaga

SEQ ID NO: 315419 - DNA, 25 bp, Mus musculus
cagccagtgcaggtcaccaaagaga

SEQ ID NO: 315420 - DNA, 25 bp, Mus musculus
cagccagtgcctctggtgatttaat

SEQ ID NO: 315421 - DNA, 25 bp, Mus musculus
cagccagtgcctgtggtgatttaat

SEQ ID NO: 315422 - DNA, 25 bp, Mus musculus
cagccagtgctcatgtgcaccgagc

SEQ ID NO: 315423 - DNA, 25 bp, Mus musculus
cagccagtgctcttgtgcaccgagc

SEQ ID NO: 315424 - DNA, 25 bp, Mus musculus
cagccagtgcttacatcatgaccta

SEQ ID NO: 315425 - DNA, 25 bp, Mus musculus
cagccagtgctttcatcatgaccta

SEQ ID NO: 315426 - DNA, 25 bp, Mus musculus
cagccagtggtgaggccctgaccgt

SEQ ID NO: 315427 - DNA, 25 bp, Mus musculus
cagccagtggtgtggccctgaccgt

SEQ ID NO: 315428 - DNA, 25 bp, Mus musculus
cagccagtgtatccttagggaatat

SEQ ID NO: 315429 - DNA, 25 bp, Mus musculus
cagccagtgtatgcttagggaatat

SEQ ID NO: 315430 - DNA, 25 bp, Mus musculus
cagccagttaaacttgtaagccagt

SEQ ID NO: 315431 - DNA, 25 bp, Mus musculus
cagccagttaaagttgtaagccagt

SEQ ID NO: 315432 - DNA, 25 bp, Mus musculus
cagccagttcatctgtcctgagcag

SEQ ID NO: 315433 - DNA, 25 bp, Mus musculus
cagccagttcatgtgtcctgagcag

SEQ ID NO: 315434 - DNA, 25 bp, Mus musculus
cagccagtttgacaatattgcatac

SEQ ID NO: 315435 - DNA, 25 bp, Mus musculus
cagccagtttgagaatattgcatac

SEQ ID NO: 315436 - DNA, 25 bp, Mus musculus
cagccataactacacagtgggccct

SEQ ID NO: 315437 - DNA, 25 bp, Mus musculus
cagccataactagacagtgggccct

SEQ ID NO: 315438 - DNA, 25 bp, Mus musculus
cagccataactgcttctttgctaaa

SEQ ID NO: 315439 - DNA, 25 bp, Mus musculus
cagccataactggttctttgctaaa

SEQ ID NO: 315440 - DNA, 25 bp, Mus musculus
cagccataagacctactagccagtt

SEQ ID NO: 315441 - DNA, 25 bp, Mus musculus
cagccataagacgtactagccagtt

SEQ ID NO: 315442 - DNA, 25 bp, Mus musculus
cagccataatccctattgtgtgtaa

SEQ ID NO: 315443 - DNA, 25 bp, Mus musculus
cagccataatccgtattgtgtgtaa

SEQ ID NO: 315444 - DNA, 25 bp, Mus musculus
cagccataattcaacctttgtctat

SEQ ID NO: 315445 - DNA, 25 bp, Mus musculus
cagccataattccactcatattata

SEQ ID NO: 315446 - DNA, 25 bp, Mus musculus
cagccataattcgactcatattata

SEQ ID NO: 315447 - DNA, 25 bp, Mus musculus
cagccataattctacctttgtctat

SEQ ID NO: 315448 - DNA, 25 bp, Mus musculus
cagccatactggcttggacttttgg

SEQ ID NO: 315449 - DNA, 25 bp, Mus musculus
cagccatactgggttggacttttgg

SEQ ID NO: 315450 - DNA, 25 bp, Mus musculus
cagccatagctacttttgctactgt

SEQ ID NO: 315451 - DNA, 25 bp, Mus musculus
cagccatagctagttttgctactgt

SEQ ID NO: 315452 - DNA, 25 bp, Mus musculus
cagccatagctgacttcatagggat

SEQ ID NO: 315453 - DNA, 25 bp, Mus musculus
cagccatagctgtcttcatagggat

SEQ ID NO: 315454 - DNA, 25 bp, Mus musculus
cagccatatactacactgtgggtta

SEQ ID NO: 315455 - DNA, 25 bp, Mus musculus
cagccatatacttcactgtgggtta

SEQ ID NO: 315456 - DNA, 25 bp, Mus musculus
cagccatatggcagatactgattgt

SEQ ID NO: 315457 - DNA, 25 bp, Mus musculus
cagccatatggctgatactgattgt

SEQ ID NO: 315458 - DNA, 25 bp, Mus musculus
cagccatcagtcatgaagtagcgtg

SEQ ID NO: 315459 - DNA, 25 bp, Mus musculus
cagccatcagtcttgaagtagcgtg

SEQ ID NO: 315460 - DNA, 25 bp, Mus musculus
cagccatccccaagtgttaaacaag

SEQ ID NO: 315461 - DNA, 25 bp, Mus musculus
cagccatccccatgtgttaaacaag

SEQ ID NO: 315462 - DNA, 25 bp, Mus musculus
cagccatcctgaccggctggaggac

SEQ ID NO: 315463 - DNA, 25 bp, Mus musculus
cagccatcctgagcggctggaggac

SEQ ID NO: 315464 - DNA, 25 bp, Mus musculus
cagccatcctgtagtgtgtctagtc

SEQ ID NO: 315465 - DNA, 25 bp, Mus musculus
cagccatcctgttgtgtgtctagtc

SEQ ID NO: 315466 - DNA, 25 bp, Mus musculus
cagccatcgcagagcagctgtcaga

SEQ ID NO: 315467 - DNA, 25 bp, Mus musculus
cagccatcgcagtgcagctgtcaga

SEQ ID NO: 315468 - DNA, 25 bp, Mus musculus
cagccatcgcttcccatttaggata

SEQ ID NO: 315469 - DNA, 25 bp, Mus musculus
cagccatcgcttgccatttaggata

SEQ ID NO: 315470 - DNA, 25 bp, Mus musculus
cagccatctgccatagacagcagga

SEQ ID NO: 315471 - DNA, 25 bp, Mus musculus
cagccatctgccttagacagcagga

SEQ ID NO: 315472 - DNA, 25 bp, Mus musculus
cagccatctgtaacatcctctattg

SEQ ID NO: 315473 - DNA, 25 bp, Mus musculus
cagccatctgtaacggccagaggtg

SEQ ID NO: 315474 - DNA, 25 bp, Mus musculus
cagccatctgtaagccacttttcta

SEQ ID NO: 315475 - DNA, 25 bp, Mus musculus
cagccatctgtatcatcctctattg

SEQ ID NO: 315476 - DNA, 25 bp, Mus musculus
cagccatctgtatcggccagaggtg

SEQ ID NO: 315477 - DNA, 25 bp, Mus musculus
cagccatctgtatgccacttttcta

SEQ ID NO: 315478 - DNA, 25 bp, Mus musculus
cagccatctgttctgtcttcggaag

SEQ ID NO: 315479 - DNA, 25 bp, Mus musculus
cagccatctgttgtgtcttcggaag

SEQ ID NO: 315480 - DNA, 25 bp, Mus musculus
cagccatcttggcagtcacagagtt

SEQ ID NO: 315481 - DNA, 25 bp, Mus musculus
cagccatcttgggagtcacagagtt

SEQ ID NO: 315482 - DNA, 25 bp, Mus musculus
cagccatgaagacactaatcctcct

SEQ ID NO: 315483 - DNA, 25 bp, Mus musculus
cagccatgaagagactaatcctcct

SEQ ID NO: 315484 - DNA, 25 bp, Mus musculus
cagccatgaaggcagctacctgctg

SEQ ID NO: 315485 - DNA, 25 bp, Mus musculus
cagccatgaagggagctacctgctg

SEQ ID NO: 315486 - DNA, 25 bp, Mus musculus
cagccatgcacaaggctaccaagct

SEQ ID NO: 315487 - DNA, 25 bp, Mus musculus
cagccatgcacacctattcatgtgt

SEQ ID NO: 315488 - DNA, 25 bp, Mus musculus
cagccatgcacagctattcatgtgt

SEQ ID NO: 315489 - DNA, 25 bp, Mus musculus
cagccatgcacatggctaccaagct

SEQ ID NO: 315490 - DNA, 25 bp, Mus musculus
cagccatgcgttctttcctaataaa

SEQ ID NO: 315491 - DNA, 25 bp, Mus musculus
cagccatgcgttgtttcctaataaa

SEQ ID NO: 315492 - DNA, 25 bp, Mus musculus
cagccatggaagaccgtgaaccttg

SEQ ID NO: 315493 - DNA, 25 bp, Mus musculus
cagccatggaagtccgtgaaccttg

SEQ ID NO: 315494 - DNA, 25 bp, Mus musculus
cagccatggcctagtggaaattttc

SEQ ID NO: 315495 - DNA, 25 bp, Mus musculus
cagccatggccttgtggaaattttc

SEQ ID NO: 315496 - DNA, 25 bp, Mus musculus
cagccatgggctcactcgagagaaa

SEQ ID NO: 315497 - DNA, 25 bp, Mus musculus
cagccatgggctctaagtctgtgct

SEQ ID NO: 315498 - DNA, 25 bp, Mus musculus
cagccatgggctgactcgagagaaa

SEQ ID NO: 315499 - DNA, 25 bp, Mus musculus
cagccatgggctgtaagtctgtgct

SEQ ID NO: 315500 - DNA, 25 bp, Mus musculus
cagccatggttacctaggcctttaa

SEQ ID NO: 315501 - DNA, 25 bp, Mus musculus
cagccatggttagctaggcctttaa

SEQ ID NO: 315502 - DNA, 25 bp, Mus musculus
cagccatgtgtaacagggtgtgcct

SEQ ID NO: 315503 - DNA, 25 bp, Mus musculus
cagccatgtgtatcagggtgtgcct

SEQ ID NO: 315504 - DNA, 25 bp, Mus musculus
cagccattacctagaggccctggga

SEQ ID NO: 315505 - DNA, 25 bp, Mus musculus
cagccattaccttgaggccctggga

SEQ ID NO: 315506 - DNA, 25 bp, Mus musculus
cagccattactcacaaccaaaactt

SEQ ID NO: 315507 - DNA, 25 bp, Mus musculus
cagccattactctcaaccaaaactt

SEQ ID NO: 315508 - DNA, 25 bp, Mus musculus
cagccattatgacaagcccttttaa

SEQ ID NO: 315509 - DNA, 25 bp, Mus musculus
cagccattatgagaagcccttttaa

SEQ ID NO: 315510 - DNA, 25 bp, Mus musculus
cagccattcaccaagtacattcgta

SEQ ID NO: 315511 - DNA, 25 bp, Mus musculus
cagccattcacctagtacattcgta

SEQ ID NO: 315512 - DNA, 25 bp, Mus musculus
cagccattctccactgggaaaacag

SEQ ID NO: 315513 - DNA, 25 bp, Mus musculus
cagccattctcctctgggaaaacag

SEQ ID NO: 315514 - DNA, 25 bp, Mus musculus
cagccattgctaaccatcgtggaat

SEQ ID NO: 315515 - DNA, 25 bp, Mus musculus
cagccattgctatccatcgtggaat

SEQ ID NO: 315516 - DNA, 25 bp, Mus musculus
cagccattggacacagttctggatg

SEQ ID NO: 315517 - DNA, 25 bp, Mus musculus
cagccattggactcagttctggatg

SEQ ID NO: 315518 - DNA, 25 bp, Mus musculus
cagccattgttcataactgctaagg

SEQ ID NO: 315519 - DNA, 25 bp, Mus musculus
cagccattgttcttaactgctaagg

SEQ ID NO: 315520 - DNA, 25 bp, Mus musculus
cagccatttctaacaaaagaccagt

SEQ ID NO: 315521 - DNA, 25 bp, Mus musculus
cagccatttctatcaaaagaccagt

SEQ ID NO: 315522 - DNA, 25 bp, Mus musculus
cagccatttgtacctttaggtccag

SEQ ID NO: 315523 - DNA, 25 bp, Mus musculus
cagccatttgtagctttaggtccag

SEQ ID NO: 315524 - DNA, 25 bp, Mus musculus
cagcccaaaatgcagttctttcaat

SEQ ID NO: 315525 - DNA, 25 bp, Mus musculus
cagcccaaaatggagttctttcaat

SEQ ID NO: 315526 - DNA, 25 bp, Mus musculus
cagcccaaagagctgtatcagcaac

SEQ ID NO: 315527 - DNA, 25 bp, Mus musculus
cagcccaaagaggtgtatcagcaac

SEQ ID NO: 315528 - DNA, 25 bp, Mus musculus
cagcccaaagatcgcttcctggtgg

SEQ ID NO: 315529 - DNA, 25 bp, Mus musculus
cagcccaaagatggcttcctggtgg

SEQ ID NO: 315530 - DNA, 25 bp, Mus musculus
cagcccaaccgcctaagggtggatg

SEQ ID NO: 315531 - DNA, 25 bp, Mus musculus
cagcccaaccgcgtaagggtggatg

SEQ ID NO: 315532 - DNA, 25 bp, Mus musculus
cagcccaacgctagccttttaggaa

SEQ ID NO: 315533 - DNA, 25 bp, Mus musculus
cagcccaacgcttgccttttaggaa

SEQ ID NO: 315534 - DNA, 25 bp, Mus musculus
cagcccaagaaaaaccaattctcaa

SEQ ID NO: 315535 - DNA, 25 bp, Mus musculus
cagcccaagaaataccaattctcaa

SEQ ID NO: 315536 - DNA, 25 bp, Mus musculus
cagcccaagcttagggcccgctatg

SEQ ID NO: 315537 - DNA, 25 bp, Mus musculus
cagcccaagctttgggcccgctatg

SEQ ID NO: 315538 - DNA, 25 bp, Mus musculus
cagcccaaggccacgtattatttac

SEQ ID NO: 315539 - DNA, 25 bp, Mus musculus
cagcccaaggcctcgtattatttac

SEQ ID NO: 315540 - DNA, 25 bp, Mus musculus
cagcccaaggggattagatgtcaat

SEQ ID NO: 315541 - DNA, 25 bp, Mus musculus
cagcccaaggggtttagatgtcaat

SEQ ID NO: 315542 - DNA, 25 bp, Mus musculus
cagcccacagaaccaactaaacagg

SEQ ID NO: 315543 - DNA, 25 bp, Mus musculus
cagcccacagaagcaactaaacagg

SEQ ID NO: 315544 - DNA, 25 bp, Mus musculus
cagcccacagtccatagatttcagc

SEQ ID NO: 315545 - DNA, 25 bp, Mus musculus
cagcccacagtcgatagatttcagc

SEQ ID NO: 315546 - DNA, 25 bp, Mus musculus
cagcccacatgtagaaatcctttgc

SEQ ID NO: 315547 - DNA, 25 bp, Mus musculus
cagcccacatgttgaaatcctttgc

SEQ ID NO: 315548 - DNA, 25 bp, Mus musculus
cagcccaccgggatggtgatgtagt

SEQ ID NO: 315549 - DNA, 25 bp, Mus musculus
cagcccaccgggttggtgatgtagt

SEQ ID NO: 315550 - DNA, 25 bp, Mus musculus
cagcccacctgaagtttacgtgtgt

SEQ ID NO: 315551 - DNA, 25 bp, Mus musculus
cagcccacctgatgtttacgtgtgt

SEQ ID NO: 315552 - DNA, 25 bp, Mus musculus
cagcccacgggcagagtttacttaa

SEQ ID NO: 315553 - DNA, 25 bp, Mus musculus
cagcccacgggctgagtttacttaa

SEQ ID NO: 315554 - DNA, 25 bp, Mus musculus
cagcccacggtcaagaccaaaggac

SEQ ID NO: 315555 - DNA, 25 bp, Mus musculus
cagcccacggtctagaccaaaggac

SEQ ID NO: 315556 - DNA, 25 bp, Mus musculus
cagcccactgggacacttgtaaaga

SEQ ID NO: 315557 - DNA, 25 bp, Mus musculus
cagcccactgggtcacttgtaaaga

SEQ ID NO: 315558 - DNA, 25 bp, Mus musculus
cagcccactgtgatgtaggtttttt

SEQ ID NO: 315559 - DNA, 25 bp, Mus musculus
cagcccactgtgttgtaggtttttt

SEQ ID NO: 315560 - DNA, 25 bp, Mus musculus
cagcccagaactctgatcgacagtc

SEQ ID NO: 315561 - DNA, 25 bp, Mus musculus
cagcccagaactgtgatcgacagtc

SEQ ID NO: 315562 - DNA, 25 bp, Mus musculus
cagcccagaagtaccattcccggag

SEQ ID NO: 315563 - DNA, 25 bp, Mus musculus
cagcccagaagttccattcccggag

SEQ ID NO: 315564 - DNA, 25 bp, Mus musculus
cagcccagaccacgagtagctcagt

SEQ ID NO: 315565 - DNA, 25 bp, Mus musculus
cagcccagaccaggagtagctcagt

SEQ ID NO: 315566 - DNA, 25 bp, Mus musculus
cagcccagactgcaggaaccatgag

SEQ ID NO: 315567 - DNA, 25 bp, Mus musculus
cagcccagactggaggaaccatgag

SEQ ID NO: 315568 - DNA, 25 bp, Mus musculus
cagcccagacttcttcggaagggtt

SEQ ID NO: 315569 - DNA, 25 bp, Mus musculus
cagcccagacttgttcggaagggtt

SEQ ID NO: 315570 - DNA, 25 bp, Mus musculus
cagcccagaggcatgtttctatggt

SEQ ID NO: 315571 - DNA, 25 bp, Mus musculus
cagcccagaggcttgtttctatggt

SEQ ID NO: 315572 - DNA, 25 bp, Mus musculus
cagcccagcaacactggagtctatg

SEQ ID NO: 315573 - DNA, 25 bp, Mus musculus
cagcccagcaactctggagtctatg

SEQ ID NO: 315574 - DNA, 25 bp, Mus musculus
cagcccagcatcagtggtgtggatc

SEQ ID NO: 315575 - DNA, 25 bp, Mus musculus
cagcccagcatctgtggtgtggatc

SEQ ID NO: 315576 - DNA, 25 bp, Mus musculus
cagcccagccataggtgcagggcac

SEQ ID NO: 315577 - DNA, 25 bp, Mus musculus
cagcccagccattggtgcagggcac

SEQ ID NO: 315578 - DNA, 25 bp, Mus musculus
cagcccagccctaagtgtgaatagt

SEQ ID NO: 315579 - DNA, 25 bp, Mus musculus
cagcccagcccttagtgtgaatagt

SEQ ID NO: 315580 - DNA, 25 bp, Mus musculus
cagcccagcctgacgggaatgaatg

SEQ ID NO: 315581 - DNA, 25 bp, Mus musculus
cagcccagcctgtcgggaatgaatg

SEQ ID NO: 315582 - DNA, 25 bp, Mus musculus
cagcccaggaaacgtccctaggtag

SEQ ID NO: 315583 - DNA, 25 bp, Mus musculus
cagcccaggaaaggtccctaggtag

SEQ ID NO: 315584 - DNA, 25 bp, Mus musculus
cagcccaggaacagggtggcttttt

SEQ ID NO: 315585 - DNA, 25 bp, Mus musculus
cagcccaggaactgggtggcttttt

SEQ ID NO: 315586 - DNA, 25 bp, Mus musculus
cagcccaggagaacgtcggtgtgat

SEQ ID NO: 315587 - DNA, 25 bp, Mus musculus
cagcccaggagatcgtcggtgtgat

SEQ ID NO: 315588 - DNA, 25 bp, Mus musculus
cagcccaggagtccaaggccttgag

SEQ ID NO: 315589 - DNA, 25 bp, Mus musculus
cagcccaggagtgcaaggccttgag

SEQ ID NO: 315590 - DNA, 25 bp, Mus musculus
cagcccaggattatcttttaggtat

SEQ ID NO: 315591 - DNA, 25 bp, Mus musculus
cagcccaggattttcttttaggtat

SEQ ID NO: 315592 - DNA, 25 bp, Mus musculus
cagcccaggctgaatagattcaaga

SEQ ID NO: 315593 - DNA, 25 bp, Mus musculus
cagcccaggctgtatagattcaaga

SEQ ID NO: 315594 - DNA, 25 bp, Mus musculus
cagcccagggcacaacaaagaagag

SEQ ID NO: 315595 - DNA, 25 bp, Mus musculus
cagcccagggcagaacaaagaagag

SEQ ID NO: 315596 - DNA, 25 bp, Mus musculus
cagcccagtccccaatgttttgaga

SEQ ID NO: 315597 - DNA, 25 bp, Mus musculus
cagcccagtcccgaatgttttgaga

SEQ ID NO: 315598 - DNA, 25 bp, Mus musculus
cagcccagtgttccctaaggcatga

SEQ ID NO: 315599 - DNA, 25 bp, Mus musculus
cagcccagtgttgcctaaggcatga

SEQ ID NO: 315600 - DNA, 25 bp, Mus musculus
cagcccagttgcatgtacttgatag

SEQ ID NO: 315601 - DNA, 25 bp, Mus musculus
cagcccagttgcttgtacttgatag

SEQ ID NO: 315602 - DNA, 25 bp, Mus musculus
cagcccatatcaaggtggtgtattc

SEQ ID NO: 315603 - DNA, 25 bp, Mus musculus
cagcccatatcatggtggtgtattc

SEQ ID NO: 315604 - DNA, 25 bp, Mus musculus
cagcccatcactactacattaaaac

SEQ ID NO: 315605 - DNA, 25 bp, Mus musculus
cagcccatcacttctacattaaaac

SEQ ID NO: 315606 - DNA, 25 bp, Mus musculus
cagcccatcctgatggtgatagaga

SEQ ID NO: 315607 - DNA, 25 bp, Mus musculus
cagcccatcctgttggtgatagaga

SEQ ID NO: 315608 - DNA, 25 bp, Mus musculus
cagcccatgacacattatttaaaat

SEQ ID NO: 315609 - DNA, 25 bp, Mus musculus
cagcccatgacagattatttaaaat

SEQ ID NO: 315610 - DNA, 25 bp, Mus musculus
cagcccatgctcagtgtggatgatt

SEQ ID NO: 315611 - DNA, 25 bp, Mus musculus
cagcccatgctctgtgtggatgatt

SEQ ID NO: 315612 - DNA, 25 bp, Mus musculus
cagcccatgcttagatgaacggaat

SEQ ID NO: 315613 - DNA, 25 bp, Mus musculus
cagcccatgctttgatgaacggaat

SEQ ID NO: 315614 - DNA, 25 bp, Mus musculus
cagcccatggcaccttaacagaatt

SEQ ID NO: 315615 - DNA, 25 bp, Mus musculus
cagcccatggcagcttaacagaatt

SEQ ID NO: 315616 - DNA, 25 bp, Mus musculus
cagcccatggctacaataaacgttt

SEQ ID NO: 315617 - DNA, 25 bp, Mus musculus
cagcccatggcttcaataaacgttt

SEQ ID NO: 315618 - DNA, 25 bp, Mus musculus
cagcccattaccagacttctctgga

SEQ ID NO: 315619 - DNA, 25 bp, Mus musculus
cagcccattacctgacttctctgga

SEQ ID NO: 315620 - DNA, 25 bp, Mus musculus
cagcccattctgaaggtgcattgaa

SEQ ID NO: 315621 - DNA, 25 bp, Mus musculus
cagcccattctgtaggtgcattgaa

SEQ ID NO: 315622 - DNA, 25 bp, Mus musculus
cagcccatttaaccatcacagatac

SEQ ID NO: 315623 - DNA, 25 bp, Mus musculus
cagcccatttaagcatcacagatac

SEQ ID NO: 315624 - DNA, 25 bp, Mus musculus
cagccccaagtacaattgctccttt

SEQ ID NO: 315625 - DNA, 25 bp, Mus musculus
cagccccaagtagaattgctccttt

SEQ ID NO: 315626 - DNA, 25 bp, Mus musculus
cagccccaatacatctgtaatcctt

SEQ ID NO: 315627 - DNA, 25 bp, Mus musculus
cagccccaatacttctgtaatcctt

SEQ ID NO: 315628 - DNA, 25 bp, Mus musculus
cagccccaatctatctggtgctgag

SEQ ID NO: 315629 - DNA, 25 bp, Mus musculus
cagccccaatctttctggtgctgag

SEQ ID NO: 315630 - DNA, 25 bp, Mus musculus
cagccccacgagaagaggtttattg

SEQ ID NO: 315631 - DNA, 25 bp, Mus musculus
cagccccacgagtagaggtttattg

SEQ ID NO: 315632 - DNA, 25 bp, Mus musculus
cagccccacggcagtaatagttttt

SEQ ID NO: 315633 - DNA, 25 bp, Mus musculus
cagccccacggctgtaatagttttt

SEQ ID NO: 315634 - DNA, 25 bp, Mus musculus
cagccccactatagccatgtaaaag

SEQ ID NO: 315635 - DNA, 25 bp, Mus musculus
cagccccactattgccatgtaaaag

SEQ ID NO: 315636 - DNA, 25 bp, Mus musculus
cagccccagaatactgccattatta

SEQ ID NO: 315637 - DNA, 25 bp, Mus musculus
cagccccagaattctgccattatta

SEQ ID NO: 315638 - DNA, 25 bp, Mus musculus
cagccccagctcaagcagtgaatga

SEQ ID NO: 315639 - DNA, 25 bp, Mus musculus
cagccccagctctagcagtgaatga

SEQ ID NO: 315640 - DNA, 25 bp, Mus musculus
cagccccaggcaactgttaatgttt

SEQ ID NO: 315641 - DNA, 25 bp, Mus musculus
cagccccaggcatctgttaatgttt

SEQ ID NO: 315642 - DNA, 25 bp, Mus musculus
cagccccagtgtagaagtctatact

SEQ ID NO: 315643 - DNA, 25 bp, Mus musculus
cagccccagtgttgaagtctatact

SEQ ID NO: 315644 - DNA, 25 bp, Mus musculus
cagccccataaccagtttcttggtt

SEQ ID NO: 315645 - DNA, 25 bp, Mus musculus
cagccccataacgagtttcttggtt

SEQ ID NO: 315646 - DNA, 25 bp, Mus musculus
cagccccgacccatgtacatagaaa

SEQ ID NO: 315647 - DNA, 25 bp, Mus musculus
cagccccgacccttgtacatagaaa

SEQ ID NO: 315648 - DNA, 25 bp, Mus musculus
cagccccgtctcattaattttgaga

SEQ ID NO: 315649 - DNA, 25 bp, Mus musculus
cagccccgtctctttaattttgaga

SEQ ID NO: 315650 - DNA, 25 bp, Mus musculus
cagccccgtgagctccaggaattga

SEQ ID NO: 315651 - DNA, 25 bp, Mus musculus
cagccccgtgaggtccaggaattga

SEQ ID NO: 315652 - DNA, 25 bp, Mus musculus
cagccccgttggagcaccaagcatt

SEQ ID NO: 315653 - DNA, 25 bp, Mus musculus
cagccccgttggtgcaccaagcatt

SEQ ID NO: 315654 - DNA, 25 bp, Mus musculus
cagcccctaaaaccacgtcttgaat

SEQ ID NO: 315655 - DNA, 25 bp, Mus musculus
cagcccctaaaagcacgtcttgaat

SEQ ID NO: 315656 - DNA, 25 bp, Mus musculus
cagcccctaagtccaatgtctagag

SEQ ID NO: 315657 - DNA, 25 bp, Mus musculus
cagcccctaagtgcaatgtctagag

SEQ ID NO: 315658 - DNA, 25 bp, Mus musculus
cagcccctatccaattttattttat

SEQ ID NO: 315659 - DNA, 25 bp, Mus musculus
cagcccctatcctattttattttat

SEQ ID NO: 315660 - DNA, 25 bp, Mus musculus
cagcccctccatccaaagaaagcgc

SEQ ID NO: 315661 - DNA, 25 bp, Mus musculus
cagcccctccatgcaaagaaagcgc

SEQ ID NO: 315662 - DNA, 25 bp, Mus musculus
cagcccctcggtccgtgagatgaca

SEQ ID NO: 315663 - DNA, 25 bp, Mus musculus
cagcccctcggtgcgtgagatgaca

SEQ ID NO: 315664 - DNA, 25 bp, Mus musculus
cagcccctctttatgagatctgtaa

SEQ ID NO: 315665 - DNA, 25 bp, Mus musculus
cagcccctctttttgagatctgtaa

SEQ ID NO: 315666 - DNA, 25 bp, Mus musculus
cagcccctgcagatagagacctgtg

SEQ ID NO: 315667 - DNA, 25 bp, Mus musculus
cagcccctgcagttagagacctgtg

SEQ ID NO: 315668 - DNA, 25 bp, Mus musculus
cagcccctgggacaagggctttgat

SEQ ID NO: 315669 - DNA, 25 bp, Mus musculus
cagcccctgggagaagggctttgat

SEQ ID NO: 315670 - DNA, 25 bp, Mus musculus
cagcccctgtgcacacagagagatg

SEQ ID NO: 315671 - DNA, 25 bp, Mus musculus
cagcccctgtgctcacagagagatg

SEQ ID NO: 315672 - DNA, 25 bp, Mus musculus
cagcccctgtgtcagtttgtatact

SEQ ID NO: 315673 - DNA, 25 bp, Mus musculus
cagcccctgtgtgagtttgtatact

SEQ ID NO: 315674 - DNA, 25 bp, Mus musculus
cagccccttagacgcctgggttgga

SEQ ID NO: 315675 - DNA, 25 bp, Mus musculus
cagccccttagaggcctgggttgga

SEQ ID NO: 315676 - DNA, 25 bp, Mus musculus
cagccccttagcacattcctggatt

SEQ ID NO: 315677 - DNA, 25 bp, Mus musculus
cagccccttagctcattcctggatt

SEQ ID NO: 315678 - DNA, 25 bp, Mus musculus
cagccccttctcagcacatttttgg

SEQ ID NO: 315679 - DNA, 25 bp, Mus musculus
cagccccttctctgcacatttttgg

SEQ ID NO: 315680 - DNA, 25 bp, Mus musculus
cagccccttggacgagtcagccagg

SEQ ID NO: 315681 - DNA, 25 bp, Mus musculus
cagccccttggaggagtcagccagg

SEQ ID NO: 315682 - DNA, 25 bp, Mus musculus
cagcccctttttacaacaagcaagc

SEQ ID NO: 315683 - DNA, 25 bp, Mus musculus
cagccccttttttcaacaagcaagc

SEQ ID NO: 315684 - DNA, 25 bp, Mus musculus
cagcccgaacatccgagcagtgaag

SEQ ID NO: 315685 - DNA, 25 bp, Mus musculus
cagcccgaacatgcgagcagtgaag

SEQ ID NO: 315686 - DNA, 25 bp, Mus musculus
cagcccgaagcacagatatttttta

SEQ ID NO: 315687 - DNA, 25 bp, Mus musculus
cagcccgaagcagagatatttttta

SEQ ID NO: 315688 - DNA, 25 bp, Mus musculus
cagcccgaaggaacctcaacgagga

SEQ ID NO: 315689 - DNA, 25 bp, Mus musculus
cagcccgaaggatcctcaacgagga

SEQ ID NO: 315690 - DNA, 25 bp, Mus musculus
cagcccgaggctaggaaaacagttt

SEQ ID NO: 315691 - DNA, 25 bp, Mus musculus
cagcccgaggcttggaaaacagttt

SEQ ID NO: 315692 - DNA, 25 bp, Mus musculus
cagcccgagtcgcaggtaaacaagg

SEQ ID NO: 315693 - DNA, 25 bp, Mus musculus
cagcccgagtcggaggtaaacaagg

SEQ ID NO: 315694 - DNA, 25 bp, Mus musculus
cagcccggaaggaggccacggacat

SEQ ID NO: 315695 - DNA, 25 bp, Mus musculus
cagcccggaaggtggccacggacat

SEQ ID NO: 315696 - DNA, 25 bp, Mus musculus
cagcccgggaatcgagaaaatcaat

SEQ ID NO: 315697 - DNA, 25 bp, Mus musculus
cagcccgggaatggagaaaatcaat

SEQ ID NO: 315698 - DNA, 25 bp, Mus musculus
cagcccgggccacattaagtaactt

SEQ ID NO: 315699 - DNA, 25 bp, Mus musculus
cagcccgggccagattaagtaactt

SEQ ID NO: 315700 - DNA, 25 bp, Mus musculus
cagcccggtgccacggtcacatggg

SEQ ID NO: 315701 - DNA, 25 bp, Mus musculus
cagcccggtgcctcggtcacatggg

SEQ ID NO: 315702 - DNA, 25 bp, Mus musculus
cagcccgtgctaacatgaaatgcat

SEQ ID NO: 315703 - DNA, 25 bp, Mus musculus
cagcccgtgctatcatgaaatgcat

SEQ ID NO: 315704 - DNA, 25 bp, Mus musculus
cagccctaactaataagcctttgcc

SEQ ID NO: 315705 - DNA, 25 bp, Mus musculus
cagccctaactattaagcctttgcc

SEQ ID NO: 315706 - DNA, 25 bp, Mus musculus
cagccctaaggactacttttggaca

SEQ ID NO: 315707 - DNA, 25 bp, Mus musculus
cagccctaaggagtacttttggaca

SEQ ID NO: 315708 - DNA, 25 bp, Mus musculus
cagccctaaggcaacagtgtgtttt

SEQ ID NO: 315709 - DNA, 25 bp, Mus musculus
cagccctaaggctacagtgtgtttt

SEQ ID NO: 315710 - DNA, 25 bp, Mus musculus
cagccctaggatctattcttcacaa

SEQ ID NO: 315711 - DNA, 25 bp, Mus musculus
cagccctaggatgtattcttcacaa

SEQ ID NO: 315712 - DNA, 25 bp, Mus musculus
cagccctatgcaacagaccagttca

SEQ ID NO: 315713 - DNA, 25 bp, Mus musculus
cagccctatgcatcagaccagttca

SEQ ID NO: 315714 - DNA, 25 bp, Mus musculus
cagccctatttcagggatcccagag

SEQ ID NO: 315715 - DNA, 25 bp, Mus musculus
cagccctatttctgggatcccagag

SEQ ID NO: 315716 - DNA, 25 bp, Mus musculus
cagccctcaaggcttgactgagtgt

SEQ ID NO: 315717 - DNA, 25 bp, Mus musculus
cagccctcaagggttgactgagtgt

SEQ ID NO: 315718 - DNA, 25 bp, Mus musculus
cagccctcaggtcgttcttaatgga

SEQ ID NO: 315719 - DNA, 25 bp, Mus musculus
cagccctcaggtggttcttaatgga

SEQ ID NO: 315720 - DNA, 25 bp, Mus musculus
cagccctcagtacgagcacgtatta

SEQ ID NO: 315721 - DNA, 25 bp, Mus musculus
cagccctcagtaggagcacgtatta

SEQ ID NO: 315722 - DNA, 25 bp, Mus musculus
cagccctcatgaattgaaatggcaa

SEQ ID NO: 315723 - DNA, 25 bp, Mus musculus
cagccctcatgatttgaaatggcaa

SEQ ID NO: 315724 - DNA, 25 bp, Mus musculus
cagccctcatgcaagtttttacagg

SEQ ID NO: 315725 - DNA, 25 bp, Mus musculus
cagccctcatgctagtttttacagg

SEQ ID NO: 315726 - DNA, 25 bp, Mus musculus
cagccctcattcagtgtgtaagtca

SEQ ID NO: 315727 - DNA, 25 bp, Mus musculus
cagccctcattctgtgtgtaagtca

SEQ ID NO: 315728 - DNA, 25 bp, Mus musculus
cagccctccattattcttaaaactg

SEQ ID NO: 315729 - DNA, 25 bp, Mus musculus
cagccctccatttttcttaaaactg

SEQ ID NO: 315730 - DNA, 25 bp, Mus musculus
cagccctcgtgtcagtgagtgaaga

SEQ ID NO: 315731 - DNA, 25 bp, Mus musculus
cagccctcgtgtgagtgagtgaaga

SEQ ID NO: 315732 - DNA, 25 bp, Mus musculus
cagccctctttcattggtatggaat

SEQ ID NO: 315733 - DNA, 25 bp, Mus musculus
cagccctctttctttggtatggaat

SEQ ID NO: 315734 - DNA, 25 bp, Mus musculus
cagccctgaatgcttgagaagcatt

SEQ ID NO: 315735 - DNA, 25 bp, Mus musculus
cagccctgaatggttgagaagcatt

SEQ ID NO: 315736 - DNA, 25 bp, Mus musculus
cagccctgacctactggacaagaag

SEQ ID NO: 315737 - DNA, 25 bp, Mus musculus
cagccctgaccttctggacaagaag

SEQ ID NO: 315738 - DNA, 25 bp, Mus musculus
cagccctgagagacctgtgacagaa

SEQ ID NO: 315739 - DNA, 25 bp, Mus musculus
cagccctgagagtcctgtgacagaa

SEQ ID NO: 315740 - DNA, 25 bp, Mus musculus
cagccctgaggactttacccatgat

SEQ ID NO: 315741 - DNA, 25 bp, Mus musculus
cagccctgaggagtttacccatgat

SEQ ID NO: 315742 - DNA, 25 bp, Mus musculus
cagccctgagtgaccattcacagtt

SEQ ID NO: 315743 - DNA, 25 bp, Mus musculus
cagccctgagtgtccattcacagtt

SEQ ID NO: 315744 - DNA, 25 bp, Mus musculus
cagccctgatatatgaggccactca

SEQ ID NO: 315745 - DNA, 25 bp, Mus musculus
cagccctgatatttgaggccactca

SEQ ID NO: 315746 - DNA, 25 bp, Mus musculus
cagccctgatgtattgggataaaac

SEQ ID NO: 315747 - DNA, 25 bp, Mus musculus
cagccctgatgttttgggataaaac

SEQ ID NO: 315748 - DNA, 25 bp, Mus musculus
cagccctgcaaccatgacatcaata

SEQ ID NO: 315749 - DNA, 25 bp, Mus musculus
cagccctgcaacgatgacatcaata

SEQ ID NO: 315750 - DNA, 25 bp, Mus musculus
cagccctgcacccaattattgaagt

SEQ ID NO: 315751 - DNA, 25 bp, Mus musculus
cagccctgcaccgaattattgaagt

SEQ ID NO: 315752 - DNA, 25 bp, Mus musculus
cagccctgcgcgagaagaagaccat

SEQ ID NO: 315753 - DNA, 25 bp, Mus musculus
cagccctgcgcgtgaagaagaccat

SEQ ID NO: 315754 - DNA, 25 bp, Mus musculus
cagccctgctaactacttcttacaa

SEQ ID NO: 315755 - DNA, 25 bp, Mus musculus
cagccctgctaagtacttcttacaa

SEQ ID NO: 315756 - DNA, 25 bp, Mus musculus
cagccctgctatatctatctgatag

SEQ ID NO: 315757 - DNA, 25 bp, Mus musculus
cagccctgctatttctatctgatag

SEQ ID NO: 315758 - DNA, 25 bp, Mus musculus
cagccctggaagcaatatgtggcca

SEQ ID NO: 315759 - DNA, 25 bp, Mus musculus
cagccctggaaggaatatgtggcca

SEQ ID NO: 315760 - DNA, 25 bp, Mus musculus
cagccctggaatccttgcatgggtt

SEQ ID NO: 315761 - DNA, 25 bp, Mus musculus
cagccctggaatgcttgcatgggtt

SEQ ID NO: 315762 - DNA, 25 bp, Mus musculus
cagccctggactaccttggaaagga

SEQ ID NO: 315763 - DNA, 25 bp, Mus musculus
cagccctggacttccttggaaagga

SEQ ID NO: 315764 - DNA, 25 bp, Mus musculus
cagccctggctgagttaaaattgca

SEQ ID NO: 315765 - DNA, 25 bp, Mus musculus
cagccctggctgtgttaaaattgca

SEQ ID NO: 315766 - DNA, 25 bp, Mus musculus
cagccctggtgacattctgtcagca

SEQ ID NO: 315767 - DNA, 25 bp, Mus musculus
cagccctggtgagattctgtcagca

SEQ ID NO: 315768 - DNA, 25 bp, Mus musculus
cagccctgtgagaaacctcagcaac

SEQ ID NO: 315769 - DNA, 25 bp, Mus musculus
cagccctgtgagtaacctcagcaac

SEQ ID NO: 315770 - DNA, 25 bp, Mus musculus
cagccctgtttcaatccacttttaa

SEQ ID NO: 315771 - DNA, 25 bp, Mus musculus
cagccctgtttctatccacttttaa

SEQ ID NO: 315772 - DNA, 25 bp, Mus musculus
cagcccttactaccagattcatcaa

SEQ ID NO: 315773 - DNA, 25 bp, Mus musculus
cagcccttactagcagattcatcaa

SEQ ID NO: 315774 - DNA, 25 bp, Mus musculus
cagcccttattcctttagagttact

SEQ ID NO: 315775 - DNA, 25 bp, Mus musculus
cagcccttattcgtttagagttact

SEQ ID NO: 315776 - DNA, 25 bp, Mus musculus
cagcccttctccaagagcttgaaga

SEQ ID NO: 315777 - DNA, 25 bp, Mus musculus
cagcccttctcctagagcttgaaga

SEQ ID NO: 315778 - DNA, 25 bp, Mus musculus
cagcccttgatgctttataattttt

SEQ ID NO: 315779 - DNA, 25 bp, Mus musculus
cagcccttgatggtttataattttt

SEQ ID NO: 315780 - DNA, 25 bp, Mus musculus
cagcccttggcaaaaatttctctgg

SEQ ID NO: 315781 - DNA, 25 bp, Mus musculus
cagcccttggcataaatttctctgg

SEQ ID NO: 315782 - DNA, 25 bp, Mus musculus
cagcccttgggcagctatcaagtaa

SEQ ID NO: 315783 - DNA, 25 bp, Mus musculus
cagcccttgggctgctatcaagtaa

SEQ ID NO: 315784 - DNA, 25 bp, Mus musculus
cagcccttgtgcacctgggtaggga

SEQ ID NO: 315785 - DNA, 25 bp, Mus musculus
cagcccttgtgctcctgggtaggga

SEQ ID NO: 315786 - DNA, 25 bp, Mus musculus
cagccctttccaacacagagtgttg

SEQ ID NO: 315787 - DNA, 25 bp, Mus musculus
cagccctttccatcacagagtgttg

SEQ ID NO: 315788 - DNA, 25 bp, Mus musculus
cagccctttgtcactaggacgttgg

SEQ ID NO: 315789 - DNA, 25 bp, Mus musculus
cagccctttgtctctaggacgttgg

SEQ ID NO: 315790 - DNA, 25 bp, Mus musculus
cagccctttttaagttggtttagca

SEQ ID NO: 315791 - DNA, 25 bp, Mus musculus
cagccctttttatgttggtttagca

SEQ ID NO: 315792 - DNA, 25 bp, Mus musculus
cagccgaatgtgcagctgaaccagc

SEQ ID NO: 315793 - DNA, 25 bp, Mus musculus
cagccgaatgtggagctgaaccagc

SEQ ID NO: 315794 - DNA, 25 bp, Mus musculus
cagccgacgtttatggtgatattcc

SEQ ID NO: 315795 - DNA, 25 bp, Mus musculus
cagccgacgtttttggtgatattcc

SEQ ID NO: 315796 - DNA, 25 bp, Mus musculus
cagccgactcttcccaggatggaaa

SEQ ID NO: 315797 - DNA, 25 bp, Mus musculus
cagccgactcttgccaggatggaaa

SEQ ID NO: 315798 - DNA, 25 bp, Mus musculus
cagccgagggcaagcaaggatccgt

SEQ ID NO: 315799 - DNA, 25 bp, Mus musculus
cagccgagggcatgcaaggatccgt

SEQ ID NO: 315800 - DNA, 25 bp, Mus musculus
cagccgagtcagagtcctgaggaaa

SEQ ID NO: 315801 - DNA, 25 bp, Mus musculus
cagccgagtcagtgtcctgaggaaa

SEQ ID NO: 315802 - DNA, 25 bp, Mus musculus
cagccgatcgttacctcaagggagt

SEQ ID NO: 315803 - DNA, 25 bp, Mus musculus
cagccgatcgtttcctcaagggagt

SEQ ID NO: 315804 - DNA, 25 bp, Mus musculus
cagccgatctgaagcctgtgatgat

SEQ ID NO: 315805 - DNA, 25 bp, Mus musculus
cagccgatctgatgcctgtgatgat

SEQ ID NO: 315806 - DNA, 25 bp, Mus musculus
cagccgattctgattacatgttgtt

SEQ ID NO: 315807 - DNA, 25 bp, Mus musculus
cagccgattctgtttacatgttgtt

SEQ ID NO: 315808 - DNA, 25 bp, Mus musculus
cagccgattgaacagcctatgcgag

SEQ ID NO: 315809 - DNA, 25 bp, Mus musculus
cagccgattgaagagcctatgcgag

SEQ ID NO: 315810 - DNA, 25 bp, Mus musculus
cagccgcagcgtcaggatcaaagga

SEQ ID NO: 315811 - DNA, 25 bp, Mus musculus
cagccgcagcgtgaggatcaaagga

SEQ ID NO: 315812 - DNA, 25 bp, Mus musculus
cagccgccgggaaggacgtgtttct

SEQ ID NO: 315813 - DNA, 25 bp, Mus musculus
cagccgccgggatggacgtgtttct

SEQ ID NO: 315814 - DNA, 25 bp, Mus musculus
cagccgcgccatacaggtggtgaga

SEQ ID NO: 315815 - DNA, 25 bp, Mus musculus
cagccgcgccattcaggtggtgaga

SEQ ID NO: 315816 - DNA, 25 bp, Mus musculus
cagccgctcgtgctctgaagtggaa

SEQ ID NO: 315817 - DNA, 25 bp, Mus musculus
cagccgctcgtggtctgaagtggaa

SEQ ID NO: 315818 - DNA, 25 bp, Mus musculus
cagccgctgtccaacaagttagaac

SEQ ID NO: 315819 - DNA, 25 bp, Mus musculus
cagccgctgtcctacaagttagaac

SEQ ID NO: 315820 - DNA, 25 bp, Mus musculus
cagccgcttcttattggcttagttg

SEQ ID NO: 315821 - DNA, 25 bp, Mus musculus
cagccgcttctttttggcttagttg

SEQ ID NO: 315822 - DNA, 25 bp, Mus musculus
cagccggaacgtccaatcgtgtcca

SEQ ID NO: 315823 - DNA, 25 bp, Mus musculus
cagccggaacgtgcaatcgtgtcca

SEQ ID NO: 315824 - DNA, 25 bp, Mus musculus
cagccggaggatatgtttttgagtt

SEQ ID NO: 315825 - DNA, 25 bp, Mus musculus
cagccggaggatttgtttttgagtt

SEQ ID NO: 315826 - DNA, 25 bp, Mus musculus
cagccggaggctattttgtagtgca

SEQ ID NO: 315827 - DNA, 25 bp, Mus musculus
cagccggaggcttttttgtagtgca

SEQ ID NO: 315828 - DNA, 25 bp, Mus musculus
cagccggatgcaaaagccttcttgt

SEQ ID NO: 315829 - DNA, 25 bp, Mus musculus
cagccggatgcataagccttcttgt

SEQ ID NO: 315830 - DNA, 25 bp, Mus musculus
cagccggcaggacacttcggttcag

SEQ ID NO: 315831 - DNA, 25 bp, Mus musculus
cagccggcaggagacttcggttcag

SEQ ID NO: 315832 - DNA, 25 bp, Mus musculus
cagccggcctccagcggtcagaagg

SEQ ID NO: 315833 - DNA, 25 bp, Mus musculus
cagccggcctcctgcggtcagaagg

SEQ ID NO: 315834 - DNA, 25 bp, Mus musculus
cagccggctacaacgtcaagtttga

SEQ ID NO: 315835 - DNA, 25 bp, Mus musculus
cagccggctacatcgtcaagtttga

SEQ ID NO: 315836 - DNA, 25 bp, Mus musculus
cagccgggacaacccactgaaggat

SEQ ID NO: 315837 - DNA, 25 bp, Mus musculus
cagccgggacaagccactgaaggat

SEQ ID NO: 315838 - DNA, 25 bp, Mus musculus
cagccgggcgctacgttcgtgagaa

SEQ ID NO: 315839 - DNA, 25 bp, Mus musculus
cagccgggcgcttcgttcgtgagaa

SEQ ID NO: 315840 - DNA, 25 bp, Mus musculus
cagccgggtcaaaccggagttgcta

SEQ ID NO: 315841 - DNA, 25 bp, Mus musculus
cagccgggtcaatccggagttgcta

SEQ ID NO: 315842 - DNA, 25 bp, Mus musculus
cagccgggtgggacatgtcttcaga

SEQ ID NO: 315843 - DNA, 25 bp, Mus musculus
cagccgggtgggtcatgtcttcaga

SEQ ID NO: 315844 - DNA, 25 bp, Mus musculus
cagccggtaatgcttggtttggcat

SEQ ID NO: 315845 - DNA, 25 bp, Mus musculus
cagccggtaatggttggtttggcat

SEQ ID NO: 315846 - DNA, 25 bp, Mus musculus
cagccggtctaactttccaatgggt

SEQ ID NO: 315847 - DNA, 25 bp, Mus musculus
cagccggtctaagtttccaatgggt

SEQ ID NO: 315848 - DNA, 25 bp, Mus musculus
cagccgtcccctacaagtggtggag

SEQ ID NO: 315849 - DNA, 25 bp, Mus musculus
cagccgtccccttcaagtggtggag

SEQ ID NO: 315850 - DNA, 25 bp, Mus musculus
cagccgtctaaaagctgggataatc

SEQ ID NO: 315851 - DNA, 25 bp, Mus musculus
cagccgtctaaatgctgggataatc

SEQ ID NO: 315852 - DNA, 25 bp, Mus musculus
cagccgtctatcagtctgttaacag

SEQ ID NO: 315853 - DNA, 25 bp, Mus musculus
cagccgtctatctgtctgttaacag

SEQ ID NO: 315854 - DNA, 25 bp, Mus musculus
cagccgtctgaaactcttagcataa

SEQ ID NO: 315855 - DNA, 25 bp, Mus musculus
cagccgtctgaatctcttagcataa

SEQ ID NO: 315856 - DNA, 25 bp, Mus musculus
cagccgtctgtactacaccagattc

SEQ ID NO: 315857 - DNA, 25 bp, Mus musculus
cagccgtctgtagtacaccagattc

SEQ ID NO: 315858 - DNA, 25 bp, Mus musculus
cagccgtgaactagccatcaatttg

SEQ ID NO: 315859 - DNA, 25 bp, Mus musculus
cagccgtgaacttgccatcaatttg

SEQ ID NO: 315860 - DNA, 25 bp, Mus musculus
cagccgtgaggtctatcctgactaa

SEQ ID NO: 315861 - DNA, 25 bp, Mus musculus
cagccgtgaggtgtatcctgactaa

SEQ ID NO: 315862 - DNA, 25 bp, Mus musculus
cagccgtgcacgacagaggaggtac

SEQ ID NO: 315863 - DNA, 25 bp, Mus musculus
cagccgtgcacgtcagaggaggtac

SEQ ID NO: 315864 - DNA, 25 bp, Mus musculus
cagccgtgcattattcgagttttca

SEQ ID NO: 315865 - DNA, 25 bp, Mus musculus
cagccgtgcatttttcgagttttca

SEQ ID NO: 315866 - DNA, 25 bp, Mus musculus
cagccgtgcgaactctcaagaccaa

SEQ ID NO: 315867 - DNA, 25 bp, Mus musculus
cagccgtgcgaagtctcaagaccaa

SEQ ID NO: 315868 - DNA, 25 bp, Mus musculus
cagccgtgcttacggtcccttctga

SEQ ID NO: 315869 - DNA, 25 bp, Mus musculus
cagccgtgcttagggtcccttctga

SEQ ID NO: 315870 - DNA, 25 bp, Mus musculus
cagccgtggcaccagttaactgtgt

SEQ ID NO: 315871 - DNA, 25 bp, Mus musculus
cagccgtggcacgagttaactgtgt

SEQ ID NO: 315872 - DNA, 25 bp, Mus musculus
cagccgtggtgcatagacctgcaca

SEQ ID NO: 315873 - DNA, 25 bp, Mus musculus
cagccgtggtgcttagacctgcaca

SEQ ID NO: 315874 - DNA, 25 bp, Mus musculus
cagccgtggtggatttttcatcagg

SEQ ID NO: 315875 - DNA, 25 bp, Mus musculus
cagccgtggtggttttttcatcagg

SEQ ID NO: 315876 - DNA, 25 bp, Mus musculus
cagccgtgtggactcttgctttgca

SEQ ID NO: 315877 - DNA, 25 bp, Mus musculus
cagccgtgtggagtcttgctttgca

SEQ ID NO: 315878 - DNA, 25 bp, Mus musculus
cagccgtgttgtaacctgttttcaa

SEQ ID NO: 315879 - DNA, 25 bp, Mus musculus
cagccgtgttgttacctgttttcaa

SEQ ID NO: 315880 - DNA, 25 bp, Mus musculus
cagccgttaagtacactgactgttc

SEQ ID NO: 315881 - DNA, 25 bp, Mus musculus
cagccgttaagttcactgactgttc

SEQ ID NO: 315882 - DNA, 25 bp, Mus musculus
cagcctaaaactcttgccaggtcat

SEQ ID NO: 315883 - DNA, 25 bp, Mus musculus
cagcctaaaactgttgccaggtcat

SEQ ID NO: 315884 - DNA, 25 bp, Mus musculus
cagcctaaataactgaccccttact

SEQ ID NO: 315885 - DNA, 25 bp, Mus musculus
cagcctaaataagtgaccccttact

SEQ ID NO: 315886 - DNA, 25 bp, Mus musculus
cagcctaagagtccctatgtgtcat

SEQ ID NO: 315887 - DNA, 25 bp, Mus musculus
cagcctaagagtgcctatgtgtcat

SEQ ID NO: 315888 - DNA, 25 bp, Mus musculus
cagcctaagctaagcctctctgcag

SEQ ID NO: 315889 - DNA, 25 bp, Mus musculus
cagcctaagctatgcctctctgcag

SEQ ID NO: 315890 - DNA, 25 bp, Mus musculus
cagcctaagctccataccacagaaa

SEQ ID NO: 315891 - DNA, 25 bp, Mus musculus
cagcctaagctcgataccacagaaa

SEQ ID NO: 315892 - DNA, 25 bp, Mus musculus
cagcctaaggagagcagcaggtgct

SEQ ID NO: 315893 - DNA, 25 bp, Mus musculus
cagcctaaggagtgcagcaggtgct

SEQ ID NO: 315894 - DNA, 25 bp, Mus musculus
cagcctaagtgccatttgaagtcag

SEQ ID NO: 315895 - DNA, 25 bp, Mus musculus
cagcctaagtgcgatttgaagtcag

SEQ ID NO: 315896 - DNA, 25 bp, Mus musculus
cagcctaagttaagtggatgcccta

SEQ ID NO: 315897 - DNA, 25 bp, Mus musculus
cagcctaagttatgtggatgcccta

SEQ ID NO: 315898 - DNA, 25 bp, Mus musculus
cagcctacaggaaggcgctggacct

SEQ ID NO: 315899 - DNA, 25 bp, Mus musculus
cagcctacaggatggcgctggacct

SEQ ID NO: 315900 - DNA, 25 bp, Mus musculus
cagcctacagtgaacctgaacttaa

SEQ ID NO: 315901 - DNA, 25 bp, Mus musculus
cagcctacagtgtacctgaacttaa

SEQ ID NO: 315902 - DNA, 25 bp, Mus musculus
cagcctacagttcgcatgaatttca

SEQ ID NO: 315903 - DNA, 25 bp, Mus musculus
cagcctacagttggcatgaatttca

SEQ ID NO: 315904 - DNA, 25 bp, Mus musculus
cagcctaccctactgaatgagtttc

SEQ ID NO: 315905 - DNA, 25 bp, Mus musculus
cagcctaccctagtgaatgagtttc

SEQ ID NO: 315906 - DNA, 25 bp, Mus musculus
cagcctacgacacaggacacttgta

SEQ ID NO: 315907 - DNA, 25 bp, Mus musculus
cagcctacgacagaggacacttgta

SEQ ID NO: 315908 - DNA, 25 bp, Mus musculus
cagcctactgtcagtgaccacaaga

SEQ ID NO: 315909 - DNA, 25 bp, Mus musculus
cagcctactgtctgtgaccacaaga

SEQ ID NO: 315910 - DNA, 25 bp, Mus musculus
cagcctacttccacatagaatgcag

SEQ ID NO: 315911 - DNA, 25 bp, Mus musculus
cagcctacttcctcatagaatgcag

SEQ ID NO: 315912 - DNA, 25 bp, Mus musculus
cagcctagacacagtttgaggagtt

SEQ ID NO: 315913 - DNA, 25 bp, Mus musculus
cagcctagacactgtttgaggagtt

SEQ ID NO: 315914 - DNA, 25 bp, Mus musculus
cagcctagccgtcggattgatgtct

SEQ ID NO: 315915 - DNA, 25 bp, Mus musculus
cagcctagccgtgggattgatgtct

SEQ ID NO: 315916 - DNA, 25 bp, Mus musculus
cagcctagccttaaccaagatgttg

SEQ ID NO: 315917 - DNA, 25 bp, Mus musculus
cagcctagcctttaccaagatgttg

SEQ ID NO: 315918 - DNA, 25 bp, Mus musculus
cagcctaggaccaagtgagcacttt

SEQ ID NO: 315919 - DNA, 25 bp, Mus musculus
cagcctaggacctagtgagcacttt

SEQ ID NO: 315920 - DNA, 25 bp, Mus musculus
cagcctaggagcagtttgggttcac

SEQ ID NO: 315921 - DNA, 25 bp, Mus musculus
cagcctaggagctgtttgggttcac

SEQ ID NO: 315922 - DNA, 25 bp, Mus musculus
cagcctaggcagagaagcgagatct

SEQ ID NO: 315923 - DNA, 25 bp, Mus musculus
cagcctaggcagtgaagcgagatct

SEQ ID NO: 315924 - DNA, 25 bp, Mus musculus
cagcctaggcgaactacttaccaac

SEQ ID NO: 315925 - DNA, 25 bp, Mus musculus
cagcctaggcgatctacttaccaac

SEQ ID NO: 315926 - DNA, 25 bp, Mus musculus
cagcctatcaccctgtagtgaggaa

SEQ ID NO: 315927 - DNA, 25 bp, Mus musculus
cagcctatcaccgtgtagtgaggaa

SEQ ID NO: 315928 - DNA, 25 bp, Mus musculus
cagcctatgagtagctacgttccaa

SEQ ID NO: 315929 - DNA, 25 bp, Mus musculus
cagcctatgagttgctacgttccaa

SEQ ID NO: 315930 - DNA, 25 bp, Mus musculus
cagcctatgctgacactattacagt

SEQ ID NO: 315931 - DNA, 25 bp, Mus musculus
cagcctatgctgtcactattacagt

SEQ ID NO: 315932 - DNA, 25 bp, Mus musculus
cagcctatggtgaggatttcctggt

SEQ ID NO: 315933 - DNA, 25 bp, Mus musculus
cagcctatggtgtggatttcctggt

SEQ ID NO: 315934 - DNA, 25 bp, Mus musculus
cagcctatgtggactatgaggacat

SEQ ID NO: 315935 - DNA, 25 bp, Mus musculus
cagcctatgtggtctatgaggacat

SEQ ID NO: 315936 - DNA, 25 bp, Mus musculus
cagcctatgttgaagggcttgcata

SEQ ID NO: 315937 - DNA, 25 bp, Mus musculus
cagcctatgttgtagggcttgcata

SEQ ID NO: 315938 - DNA, 25 bp, Mus musculus
cagcctattacacatgtagcagtta

SEQ ID NO: 315939 - DNA, 25 bp, Mus musculus
cagcctattacagatgtagcagtta

SEQ ID NO: 315940 - DNA, 25 bp, Mus musculus
cagcctattccccttcgagaaagaa

SEQ ID NO: 315941 - DNA, 25 bp, Mus musculus
cagcctattcccgttcgagaaagaa

SEQ ID NO: 315942 - DNA, 25 bp, Mus musculus
cagcctcaaaacagtggaacggaat

SEQ ID NO: 315943 - DNA, 25 bp, Mus musculus
cagcctcaaaactgtggaacggaat

SEQ ID NO: 315944 - DNA, 25 bp, Mus musculus
cagcctcaaaggcaagcctgccatg

SEQ ID NO: 315945 - DNA, 25 bp, Mus musculus
cagcctcaaagggaagcctgccatg

SEQ ID NO: 315946 - DNA, 25 bp, Mus musculus
cagcctcaagatcttctgatgtcac

SEQ ID NO: 315947 - DNA, 25 bp, Mus musculus
cagcctcaagatgttctgatgtcac

SEQ ID NO: 315948 - DNA, 25 bp, Mus musculus
cagcctcaatgtctctataagtaat

SEQ ID NO: 315949 - DNA, 25 bp, Mus musculus
cagcctcaatgtgtctataagtaat

SEQ ID NO: 315950 - DNA, 25 bp, Mus musculus
cagcctcacaggcattgaagaccaa

SEQ ID NO: 315951 - DNA, 25 bp, Mus musculus
cagcctcacagggattgaagaccaa

SEQ ID NO: 315952 - DNA, 25 bp, Mus musculus
cagcctcacccacaggagaggagat

SEQ ID NO: 315953 - DNA, 25 bp, Mus musculus
cagcctcacccagaggagaggagat

SEQ ID NO: 315954 - DNA, 25 bp, Mus musculus
cagcctcaccgaccctgtagagtag

SEQ ID NO: 315955 - DNA, 25 bp, Mus musculus
cagcctcaccgagcctgtagagtag

SEQ ID NO: 315956 - DNA, 25 bp, Mus musculus
cagcctcagaccattaatcgtgtat

SEQ ID NO: 315957 - DNA, 25 bp, Mus musculus
cagcctcagacctttaatcgtgtat

SEQ ID NO: 315958 - DNA, 25 bp, Mus musculus
cagcctcagattagaatgctaccaa

SEQ ID NO: 315959 - DNA, 25 bp, Mus musculus
cagcctcagatttgaatgctaccaa

SEQ ID NO: 315960 - DNA, 25 bp, Mus musculus
cagcctcagcagaagctgtgtttgc

SEQ ID NO: 315961 - DNA, 25 bp, Mus musculus
cagcctcagcagtagctgtgtttgc

SEQ ID NO: 315962 - DNA, 25 bp, Mus musculus
cagcctcaggtgaacgcagggtgac

SEQ ID NO: 315963 - DNA, 25 bp, Mus musculus
cagcctcaggtgtacgcagggtgac

SEQ ID NO: 315964 - DNA, 25 bp, Mus musculus
cagcctcagtgaacccattttaaat

SEQ ID NO: 315965 - DNA, 25 bp, Mus musculus
cagcctcagtgatcccattttaaat

SEQ ID NO: 315966 - DNA, 25 bp, Mus musculus
cagcctcagttcacaactttcagga

SEQ ID NO: 315967 - DNA, 25 bp, Mus musculus
cagcctcagttcacagctgaacctg

SEQ ID NO: 315968 - DNA, 25 bp, Mus musculus
cagcctcagttctcaactttcagga

SEQ ID NO: 315969 - DNA, 25 bp, Mus musculus
cagcctcagttctcagctgaacctg

SEQ ID NO: 315970 - DNA, 25 bp, Mus musculus
cagcctcatgcaccagaccagaata

SEQ ID NO: 315971 - DNA, 25 bp, Mus musculus
cagcctcatgcagcagaccagaata

SEQ ID NO: 315972 - DNA, 25 bp, Mus musculus
cagcctcatgcgcttaatttgaagt

SEQ ID NO: 315973 - DNA, 25 bp, Mus musculus
cagcctcatgcggttaatttgaagt

SEQ ID NO: 315974 - DNA, 25 bp, Mus musculus
cagcctccaaagacagcgccaaagt

SEQ ID NO: 315975 - DNA, 25 bp, Mus musculus
cagcctccaaagtcagcgccaaagt

SEQ ID NO: 315976 - DNA, 25 bp, Mus musculus
cagcctccaattatctctttgttga

SEQ ID NO: 315977 - DNA, 25 bp, Mus musculus
cagcctccaattttctctttgttga

SEQ ID NO: 315978 - DNA, 25 bp, Mus musculus
cagcctccaccgaactgggcagaag

SEQ ID NO: 315979 - DNA, 25 bp, Mus musculus
cagcctccaccgtactgggcagaag

SEQ ID NO: 315980 - DNA, 25 bp, Mus musculus
cagcctccagatacataagccaagc

SEQ ID NO: 315981 - DNA, 25 bp, Mus musculus
cagcctccagattcataagccaagc

SEQ ID NO: 315982 - DNA, 25 bp, Mus musculus
cagcctccattcctacgagaaacgg

SEQ ID NO: 315983 - DNA, 25 bp, Mus musculus
cagcctccattcgtacgagaaacgg

SEQ ID NO: 315984 - DNA, 25 bp, Mus musculus
cagcctccccagagattagtgtgtt

SEQ ID NO: 315985 - DNA, 25 bp, Mus musculus
cagcctccccagtgattagtgtgtt

SEQ ID NO: 315986 - DNA, 25 bp, Mus musculus
cagcctccctacattctttattttg

SEQ ID NO: 315987 - DNA, 25 bp, Mus musculus
cagcctccctactttctttattttg

SEQ ID NO: 315988 - DNA, 25 bp, Mus musculus
cagcctcccttcatgttaaacaata

SEQ ID NO: 315989 - DNA, 25 bp, Mus musculus
cagcctcccttcttgttaaacaata

SEQ ID NO: 315990 - DNA, 25 bp, Mus musculus
cagcctccgcatctttcagaatagg

SEQ ID NO: 315991 - DNA, 25 bp, Mus musculus
cagcctccgcatgtttcagaatagg

SEQ ID NO: 315992 - DNA, 25 bp, Mus musculus
cagcctccggtacctagggatcaaa

SEQ ID NO: 315993 - DNA, 25 bp, Mus musculus
cagcctccggtagctagggatcaaa

SEQ ID NO: 315994 - DNA, 25 bp, Mus musculus
cagcctcctatgatggtcaagacgg

SEQ ID NO: 315995 - DNA, 25 bp, Mus musculus
cagcctcctatgttggtcaagacgg

SEQ ID NO: 315996 - DNA, 25 bp, Mus musculus
cagcctcctattctctggagtatgg

SEQ ID NO: 315997 - DNA, 25 bp, Mus musculus
cagcctcctattgtctggagtatgg

SEQ ID NO: 315998 - DNA, 25 bp, Mus musculus
cagcctcctcacagatggtgggtaa

SEQ ID NO: 315999 - DNA, 25 bp, Mus musculus
cagcctcctcactgatggtgggtaa

SEQ ID NO: 316000 - DNA, 25 bp, Mus musculus
cagcctcctcatctttaagcattgt

SEQ ID NO: 316001 - DNA, 25 bp, Mus musculus
cagcctcctcatgtttaagcattgt

SEQ ID NO: 316002 - DNA, 25 bp, Mus musculus
cagcctcctctaatggtttcagaaa

SEQ ID NO: 316003 - DNA, 25 bp, Mus musculus
cagcctcctctattggtttcagaaa

SEQ ID NO: 316004 - DNA, 25 bp, Mus musculus
cagcctcctctgatttaatgagttc

SEQ ID NO: 316005 - DNA, 25 bp, Mus musculus
cagcctcctctgttttaatgagttc

SEQ ID NO: 316006 - DNA, 25 bp, Mus musculus
cagcctcctgaaaggtcactttaac

SEQ ID NO: 316007 - DNA, 25 bp, Mus musculus
cagcctcctgaaccaggcttcaagt

SEQ ID NO: 316008 - DNA, 25 bp, Mus musculus
cagcctcctgaagcaggcttcaagt

SEQ ID NO: 316009 - DNA, 25 bp, Mus musculus
cagcctcctgaatggtcactttaac

SEQ ID NO: 316010 - DNA, 25 bp, Mus musculus
cagcctcctggaccgagaatataag

SEQ ID NO: 316011 - DNA, 25 bp, Mus musculus
cagcctcctggagcgagaatataag

SEQ ID NO: 316012 - DNA, 25 bp, Mus musculus
cagcctcgaatgatgccaatacagc

SEQ ID NO: 316013 - DNA, 25 bp, Mus musculus
cagcctcgaatgttgccaatacagc

SEQ ID NO: 316014 - DNA, 25 bp, Mus musculus
cagcctcgaccacaaatttaacttc

SEQ ID NO: 316015 - DNA, 25 bp, Mus musculus
cagcctcgaccagaaatttaacttc

SEQ ID NO: 316016 - DNA, 25 bp, Mus musculus
cagcctcgcttgacaaggaaagtat

SEQ ID NO: 316017 - DNA, 25 bp, Mus musculus
cagcctcgcttgtcaaggaaagtat

SEQ ID NO: 316018 - DNA, 25 bp, Mus musculus
cagcctctaaccactctttaataat

SEQ ID NO: 316019 - DNA, 25 bp, Mus musculus
cagcctctaacctctctttaataat

SEQ ID NO: 316020 - DNA, 25 bp, Mus musculus
cagcctctagccaagtctttgacaa

SEQ ID NO: 316021 - DNA, 25 bp, Mus musculus
cagcctctagccacttttataaaca

SEQ ID NO: 316022 - DNA, 25 bp, Mus musculus
cagcctctagcctagtctttgacaa

SEQ ID NO: 316023 - DNA, 25 bp, Mus musculus
cagcctctagcctcttttataaaca

SEQ ID NO: 316024 - DNA, 25 bp, Mus musculus
cagcctctattccagggtttggaga

SEQ ID NO: 316025 - DNA, 25 bp, Mus musculus
cagcctctattcgagggtttggaga

SEQ ID NO: 316026 - DNA, 25 bp, Mus musculus
cagcctctcagccattaacagatgg

SEQ ID NO: 316027 - DNA, 25 bp, Mus musculus
cagcctctcagcgattaacagatgg

SEQ ID NO: 316028 - DNA, 25 bp, Mus musculus
cagcctctccagagttatttgactt

SEQ ID NO: 316029 - DNA, 25 bp, Mus musculus
cagcctctccagtgttatttgactt

SEQ ID NO: 316030 - DNA, 25 bp, Mus musculus
cagcctctgaccagggaaatacaaa

SEQ ID NO: 316031 - DNA, 25 bp, Mus musculus
cagcctctgacctgggaaatacaaa

SEQ ID NO: 316032 - DNA, 25 bp, Mus musculus
cagcctctgattcccatacaagtta

SEQ ID NO: 316033 - DNA, 25 bp, Mus musculus
cagcctctgattgccatacaagtta

SEQ ID NO: 316034 - DNA, 25 bp, Mus musculus
cagcctctgcagctatgcttactct

SEQ ID NO: 316035 - DNA, 25 bp, Mus musculus
cagcctctgcaggtatgcttactct

SEQ ID NO: 316036 - DNA, 25 bp, Mus musculus
cagcctctggctcctaggaaatatg

SEQ ID NO: 316037 - DNA, 25 bp, Mus musculus
cagcctctggctgctaggaaatatg

SEQ ID NO: 316038 - DNA, 25 bp, Mus musculus
cagcctctgggacttagttttccaa

SEQ ID NO: 316039 - DNA, 25 bp, Mus musculus
cagcctctgggagttagttttccaa

SEQ ID NO: 316040 - DNA, 25 bp, Mus musculus
cagcctctgtctcgtccgagatgac

SEQ ID NO: 316041 - DNA, 25 bp, Mus musculus
cagcctctgtctggtccgagatgac

SEQ ID NO: 316042 - DNA, 25 bp, Mus musculus
cagcctcttaacagaaatcgtccct

SEQ ID NO: 316043 - DNA, 25 bp, Mus musculus
cagcctcttaacagagtaggttctt

SEQ ID NO: 316044 - DNA, 25 bp, Mus musculus
cagcctcttaactgaaatcgtccct

SEQ ID NO: 316045 - DNA, 25 bp, Mus musculus
cagcctcttaactgagtaggttctt

SEQ ID NO: 316046 - DNA, 25 bp, Mus musculus
cagcctcttagccttggtttgttgg

SEQ ID NO: 316047 - DNA, 25 bp, Mus musculus
cagcctcttagcgttggtttgttgg

SEQ ID NO: 316048 - DNA, 25 bp, Mus musculus
cagcctcttctgaccagtctataga

SEQ ID NO: 316049 - DNA, 25 bp, Mus musculus
cagcctcttctgcataatgtgtgta

SEQ ID NO: 316050 - DNA, 25 bp, Mus musculus
cagcctcttctggataatgtgtgta

SEQ ID NO: 316051 - DNA, 25 bp, Mus musculus
cagcctcttctgtccagtctataga

SEQ ID NO: 316052 - DNA, 25 bp, Mus musculus
cagcctcttgaacactggcatcaca

SEQ ID NO: 316053 - DNA, 25 bp, Mus musculus
cagcctcttgaagactggcatcaca

SEQ ID NO: 316054 - DNA, 25 bp, Mus musculus
cagcctcttggcacgatgagatgga

SEQ ID NO: 316055 - DNA, 25 bp, Mus musculus
cagcctcttggctcgatgagatgga

SEQ ID NO: 316056 - DNA, 25 bp, Mus musculus
cagcctcttgtgcagctctttaaaa

SEQ ID NO: 316057 - DNA, 25 bp, Mus musculus
cagcctcttgtggagctctttaaaa

SEQ ID NO: 316058 - DNA, 25 bp, Mus musculus
cagcctctttagagctagaatccca

SEQ ID NO: 316059 - DNA, 25 bp, Mus musculus
cagcctctttagatagccactgaga

SEQ ID NO: 316060 - DNA, 25 bp, Mus musculus
cagcctctttagtgctagaatccca

SEQ ID NO: 316061 - DNA, 25 bp, Mus musculus
cagcctctttagttagccactgaga

SEQ ID NO: 316062 - DNA, 25 bp, Mus musculus
cagcctctttcaagttgaggatgtt

SEQ ID NO: 316063 - DNA, 25 bp, Mus musculus
cagcctctttcatgttgaggatgtt

SEQ ID NO: 316064 - DNA, 25 bp, Mus musculus
cagcctcttttaaccagctttgtaa

SEQ ID NO: 316065 - DNA, 25 bp, Mus musculus
cagcctcttttatccagctttgtaa

SEQ ID NO: 316066 - DNA, 25 bp, Mus musculus
cagcctgaagctacttttagtctca

SEQ ID NO: 316067 - DNA, 25 bp, Mus musculus
cagcctgaagctccggaagtcacaa

SEQ ID NO: 316068 - DNA, 25 bp, Mus musculus
cagcctgaagctgcggaagtcacaa

SEQ ID NO: 316069 - DNA, 25 bp, Mus musculus
cagcctgaagcttcttttagtctca

SEQ ID NO: 316070 - DNA, 25 bp, Mus musculus
cagcctgaagtacagctctgacatt

SEQ ID NO: 316071 - DNA, 25 bp, Mus musculus
cagcctgaagtagagctctgacatt

SEQ ID NO: 316072 - DNA, 25 bp, Mus musculus
cagcctgacaggaacatgtgtaaac

SEQ ID NO: 316073 - DNA, 25 bp, Mus musculus
cagcctgacaggtacatgtgtaaac

SEQ ID NO: 316074 - DNA, 25 bp, Mus musculus
cagcctgaccatagaagaacgagat

SEQ ID NO: 316075 - DNA, 25 bp, Mus musculus
cagcctgaccattgaagaacgagat

SEQ ID NO: 316076 - DNA, 25 bp, Mus musculus
cagcctgacgaacggactgttctca

SEQ ID NO: 316077 - DNA, 25 bp, Mus musculus
cagcctgacgaagggactgttctca

SEQ ID NO: 316078 - DNA, 25 bp, Mus musculus
cagcctgactgtaattttttacctt

SEQ ID NO: 316079 - DNA, 25 bp, Mus musculus
cagcctgactgttattttttacctt

SEQ ID NO: 316080 - DNA, 25 bp, Mus musculus
cagcctgacttgaacctggaacaca

SEQ ID NO: 316081 - DNA, 25 bp, Mus musculus
cagcctgacttgtacctggaacaca

SEQ ID NO: 316082 - DNA, 25 bp, Mus musculus
cagcctgagaggcacttctttggac

SEQ ID NO: 316083 - DNA, 25 bp, Mus musculus
cagcctgagagggacttctttggac

SEQ ID NO: 316084 - DNA, 25 bp, Mus musculus
cagcctgagccacgttatagaatgg

SEQ ID NO: 316085 - DNA, 25 bp, Mus musculus
cagcctgagccaggttatagaatgg

SEQ ID NO: 316086 - DNA, 25 bp, Mus musculus
cagcctgagcgacacagcagacctt

SEQ ID NO: 316087 - DNA, 25 bp, Mus musculus
cagcctgagcgagacagcagacctt

SEQ ID NO: 316088 - DNA, 25 bp, Mus musculus
cagcctgagtgtatgatcccacggg

SEQ ID NO: 316089 - DNA, 25 bp, Mus musculus
cagcctgagtgtttgatcccacggg

SEQ ID NO: 316090 - DNA, 25 bp, Mus musculus
cagcctgagtttcatgtctggcagc

SEQ ID NO: 316091 - DNA, 25 bp, Mus musculus
cagcctgagtttgatgtctggcagc

SEQ ID NO: 316092 - DNA, 25 bp, Mus musculus
cagcctgatttcctgcaaatgaggg

SEQ ID NO: 316093 - DNA, 25 bp, Mus musculus
cagcctgatttcgtgcaaatgaggg

SEQ ID NO: 316094 - DNA, 25 bp, Mus musculus
cagcctgcacaaaagtcgctctaga

SEQ ID NO: 316095 - DNA, 25 bp, Mus musculus
cagcctgcacaatagtcgctctaga

SEQ ID NO: 316096 - DNA, 25 bp, Mus musculus
cagcctgcaggactcatcttggaag

SEQ ID NO: 316097 - DNA, 25 bp, Mus musculus
cagcctgcaggagtcatcttggaag

SEQ ID NO: 316098 - DNA, 25 bp, Mus musculus
cagcctgcagggatctctcgatagc

SEQ ID NO: 316099 - DNA, 25 bp, Mus musculus
cagcctgcagggttctctcgatagc

SEQ ID NO: 316100 - DNA, 25 bp, Mus musculus
cagcctgcatagagccccgggaaaa

SEQ ID NO: 316101 - DNA, 25 bp, Mus musculus
cagcctgcatagtgccccgggaaaa

SEQ ID NO: 316102 - DNA, 25 bp, Mus musculus
cagcctgccatgagggtttgaggac

SEQ ID NO: 316103 - DNA, 25 bp, Mus musculus
cagcctgccatgtgggtttgaggac

SEQ ID NO: 316104 - DNA, 25 bp, Mus musculus
cagcctgccattatctccatcttgg

SEQ ID NO: 316105 - DNA, 25 bp, Mus musculus
cagcctgccattccctggtgtgttt

SEQ ID NO: 316106 - DNA, 25 bp, Mus musculus
cagcctgccattgcctggtgtgttt

SEQ ID NO: 316107 - DNA, 25 bp, Mus musculus
cagcctgccattttctccatcttgg

SEQ ID NO: 316108 - DNA, 25 bp, Mus musculus
cagcctgcggtcaggacactggagt

SEQ ID NO: 316109 - DNA, 25 bp, Mus musculus
cagcctgcggtctggacactggagt

SEQ ID NO: 316110 - DNA, 25 bp, Mus musculus
cagcctgctactccagtgaagatgg

SEQ ID NO: 316111 - DNA, 25 bp, Mus musculus
cagcctgctactgcagtgaagatgg

SEQ ID NO: 316112 - DNA, 25 bp, Mus musculus
cagcctgctagacggccaggatgct

SEQ ID NO: 316113 - DNA, 25 bp, Mus musculus
cagcctgctagagggccaggatgct

SEQ ID NO: 316114 - DNA, 25 bp, Mus musculus
cagcctgctagcaagctcaactatt

SEQ ID NO: 316115 - DNA, 25 bp, Mus musculus
cagcctgctagctagctcaactatt

SEQ ID NO: 316116 - DNA, 25 bp, Mus musculus
cagcctgctcctcggtcatataaag

SEQ ID NO: 316117 - DNA, 25 bp, Mus musculus
cagcctgctcctgggtcatataaag

SEQ ID NO: 316118 - DNA, 25 bp, Mus musculus
cagcctgctctacctagagtatttc

SEQ ID NO: 316119 - DNA, 25 bp, Mus musculus
cagcctgctctagctagagtatttc

SEQ ID NO: 316120 - DNA, 25 bp, Mus musculus
cagcctgctgctagtttttgtaaat

SEQ ID NO: 316121 - DNA, 25 bp, Mus musculus
cagcctgctgcttgtttttgtaaat

SEQ ID NO: 316122 - DNA, 25 bp, Mus musculus
cagcctgctgtcaacctggaagacc

SEQ ID NO: 316123 - DNA, 25 bp, Mus musculus
cagcctgctgtccaaggagatcata

SEQ ID NO: 316124 - DNA, 25 bp, Mus musculus
cagcctgctgtcgaaggagatcata

SEQ ID NO: 316125 - DNA, 25 bp, Mus musculus
cagcctgctgtctacctggaagacc

SEQ ID NO: 316126 - DNA, 25 bp, Mus musculus
cagcctggaagacagtcagactgta

SEQ ID NO: 316127 - DNA, 25 bp, Mus musculus
cagcctggaagagagtcagactgta

SEQ ID NO: 316128 - DNA, 25 bp, Mus musculus
cagcctggacaactagatcctatct

SEQ ID NO: 316129 - DNA, 25 bp, Mus musculus
cagcctggacaagtagatcctatct

SEQ ID NO: 316130 - DNA, 25 bp, Mus musculus
cagcctggacgcacacactgtgctg

SEQ ID NO: 316131 - DNA, 25 bp, Mus musculus
cagcctggacgcacggacggagacc

SEQ ID NO: 316132 - DNA, 25 bp, Mus musculus
cagcctggacgctcacactgtgctg

SEQ ID NO: 316133 - DNA, 25 bp, Mus musculus
cagcctggacgctcggacggagacc

SEQ ID NO: 316134 - DNA, 25 bp, Mus musculus
cagcctggactgcatttgcattttt

SEQ ID NO: 316135 - DNA, 25 bp, Mus musculus
cagcctggactggatttgcattttt

SEQ ID NO: 316136 - DNA, 25 bp, Mus musculus
cagcctggagaaatgttttcagcag

SEQ ID NO: 316137 - DNA, 25 bp, Mus musculus
cagcctggagaattgttttcagcag

SEQ ID NO: 316138 - DNA, 25 bp, Mus musculus
cagcctggaggacttactgacttca

SEQ ID NO: 316139 - DNA, 25 bp, Mus musculus
cagcctggaggagttactgacttca

SEQ ID NO: 316140 - DNA, 25 bp, Mus musculus
cagcctggaggcacaatgggaacca

SEQ ID NO: 316141 - DNA, 25 bp, Mus musculus
cagcctggaggctcaatgggaacca

SEQ ID NO: 316142 - DNA, 25 bp, Mus musculus
cagcctggcattatccgtgtaaatc

SEQ ID NO: 316143 - DNA, 25 bp, Mus musculus
cagcctggcattttccgtgtaaatc

SEQ ID NO: 316144 - DNA, 25 bp, Mus musculus
cagcctggcctacagtgtctgactg

SEQ ID NO: 316145 - DNA, 25 bp, Mus musculus
cagcctggcctagagtgtctgactg

SEQ ID NO: 316146 - DNA, 25 bp, Mus musculus
cagcctggccttcggaattgctgta

SEQ ID NO: 316147 - DNA, 25 bp, Mus musculus
cagcctggccttgggaattgctgta

SEQ ID NO: 316148 - DNA, 25 bp, Mus musculus
cagcctggctacatacaaaactttg

SEQ ID NO: 316149 - DNA, 25 bp, Mus musculus
cagcctggctacttacaaaactttg

SEQ ID NO: 316150 - DNA, 25 bp, Mus musculus
cagcctggctgcaaggtagagacct

SEQ ID NO: 316151 - DNA, 25 bp, Mus musculus
cagcctggctgctaggtagagacct

SEQ ID NO: 316152 - DNA, 25 bp, Mus musculus
cagcctgggaacacatattctgttg

SEQ ID NO: 316153 - DNA, 25 bp, Mus musculus
cagcctgggaactcatattctgttg

SEQ ID NO: 316154 - DNA, 25 bp, Mus musculus
cagcctgggaagaagggaattgtct

SEQ ID NO: 316155 - DNA, 25 bp, Mus musculus
cagcctgggaagatccttccattct

SEQ ID NO: 316156 - DNA, 25 bp, Mus musculus
cagcctgggaagtagggaattgtct

SEQ ID NO: 316157 - DNA, 25 bp, Mus musculus
cagcctgggaagttccttccattct

SEQ ID NO: 316158 - DNA, 25 bp, Mus musculus
cagcctgggagacctttaagaagaa

SEQ ID NO: 316159 - DNA, 25 bp, Mus musculus
cagcctgggagagctttaagaagaa

SEQ ID NO: 316160 - DNA, 25 bp, Mus musculus
cagcctgggcacagtgagatctttt

SEQ ID NO: 316161 - DNA, 25 bp, Mus musculus
cagcctgggcactgtgagatctttt

SEQ ID NO: 316162 - DNA, 25 bp, Mus musculus
cagcctgggctacatgggacatcct

SEQ ID NO: 316163 - DNA, 25 bp, Mus musculus
cagcctgggctagatgggacatcct

SEQ ID NO: 316164 - DNA, 25 bp, Mus musculus
cagcctgggctgagtactatagaca

SEQ ID NO: 316165 - DNA, 25 bp, Mus musculus
cagcctgggctgtgtactatagaca

SEQ ID NO: 316166 - DNA, 25 bp, Mus musculus
cagcctgggttgctggagcatcatt

SEQ ID NO: 316167 - DNA, 25 bp, Mus musculus
cagcctgggttggtggagcatcatt

SEQ ID NO: 316168 - DNA, 25 bp, Mus musculus
cagcctggtaggctggatcagccat

SEQ ID NO: 316169 - DNA, 25 bp, Mus musculus
cagcctggtagggtggatcagccat

SEQ ID NO: 316170 - DNA, 25 bp, Mus musculus
cagcctggtgggacttcgggaacaa

SEQ ID NO: 316171 - DNA, 25 bp, Mus musculus
cagcctggtgggtcttcgggaacaa

SEQ ID NO: 316172 - DNA, 25 bp, Mus musculus
cagcctgtactgcaagagcctattt

SEQ ID NO: 316173 - DNA, 25 bp, Mus musculus
cagcctgtactgcagagtgggcatc

SEQ ID NO: 316174 - DNA, 25 bp, Mus musculus
cagcctgtactggaagagcctattt

SEQ ID NO: 316175 - DNA, 25 bp, Mus musculus
cagcctgtactggagagtgggcatc

SEQ ID NO: 316176 - DNA, 25 bp, Mus musculus
cagcctgtagcaaccaacatgtatt

SEQ ID NO: 316177 - DNA, 25 bp, Mus musculus
cagcctgtagcatccaacatgtatt

SEQ ID NO: 316178 - DNA, 25 bp, Mus musculus
cagcctgtaggcatcacaagccagg

SEQ ID NO: 316179 - DNA, 25 bp, Mus musculus
cagcctgtaggcttcacaagccagg

SEQ ID NO: 316180 - DNA, 25 bp, Mus musculus
cagcctgtatatctgctttaggaca

SEQ ID NO: 316181 - DNA, 25 bp, Mus musculus
cagcctgtatatgtgctttaggaca

SEQ ID NO: 316182 - DNA, 25 bp, Mus musculus
cagcctgtctgaaccttggaggatc

SEQ ID NO: 316183 - DNA, 25 bp, Mus musculus
cagcctgtctgatccttggaggatc

SEQ ID NO: 316184 - DNA, 25 bp, Mus musculus
cagcctgtgcagaacttctgtcagt

SEQ ID NO: 316185 - DNA, 25 bp, Mus musculus
cagcctgtgcagataaatggaccta

SEQ ID NO: 316186 - DNA, 25 bp, Mus musculus
cagcctgtgcagtacttctgtcagt

SEQ ID NO: 316187 - DNA, 25 bp, Mus musculus
cagcctgtgcagttaaatggaccta

SEQ ID NO: 316188 - DNA, 25 bp, Mus musculus
cagcctgtgctaaatgagacttctt

SEQ ID NO: 316189 - DNA, 25 bp, Mus musculus
cagcctgtgctatatgagacttctt

SEQ ID NO: 316190 - DNA, 25 bp, Mus musculus
cagcctgtgcttatgttctagtaaa

SEQ ID NO: 316191 - DNA, 25 bp, Mus musculus
cagcctgtgcttttgttctagtaaa

SEQ ID NO: 316192 - DNA, 25 bp, Mus musculus
cagcctgtggacctatcagtgaaat

SEQ ID NO: 316193 - DNA, 25 bp, Mus musculus
cagcctgtggacgtatcagtgaaat

SEQ ID NO: 316194 - DNA, 25 bp, Mus musculus
cagcctgtgtctattgagccatttt

SEQ ID NO: 316195 - DNA, 25 bp, Mus musculus
cagcctgtgtcttttgagccatttt

SEQ ID NO: 316196 - DNA, 25 bp, Mus musculus
cagcctgtgtgaacggcctgcggaa

SEQ ID NO: 316197 - DNA, 25 bp, Mus musculus
cagcctgtgtgatcggcctgcggaa

SEQ ID NO: 316198 - DNA, 25 bp, Mus musculus
cagcctgttgctcacggcggcatgt

SEQ ID NO: 316199 - DNA, 25 bp, Mus musculus
cagcctgttgctgacggcggcatgt

SEQ ID NO: 316200 - DNA, 25 bp, Mus musculus
cagcctgttggcatagcaagttcta

SEQ ID NO: 316201 - DNA, 25 bp, Mus musculus
cagcctgttggcttagcaagttcta

SEQ ID NO: 316202 - DNA, 25 bp, Mus musculus
cagcctgttgttagatggcggaaga

SEQ ID NO: 316203 - DNA, 25 bp, Mus musculus
cagcctgttgtttgatggcggaaga

SEQ ID NO: 316204 - DNA, 25 bp, Mus musculus
cagccttaaacccacattccctggg

SEQ ID NO: 316205 - DNA, 25 bp, Mus musculus
cagccttaaaccgacattccctggg

SEQ ID NO: 316206 - DNA, 25 bp, Mus musculus
cagccttaagtcagactttagatgg

SEQ ID NO: 316207 - DNA, 25 bp, Mus musculus
cagccttaagtctgactttagatgg

SEQ ID NO: 316208 - DNA, 25 bp, Mus musculus
cagccttagggtatgtttttctcta

SEQ ID NO: 316209 - DNA, 25 bp, Mus musculus
cagccttagggtttgtttttctcta

SEQ ID NO: 316210 - DNA, 25 bp, Mus musculus
cagccttcaaggagaaaattgttca

SEQ ID NO: 316211 - DNA, 25 bp, Mus musculus
cagccttcaaggtgaaaattgttca

SEQ ID NO: 316212 - DNA, 25 bp, Mus musculus
cagccttcacaaagaacccagatgc

SEQ ID NO: 316213 - DNA, 25 bp, Mus musculus
cagccttcacaatgaacccagatgc

SEQ ID NO: 316214 - DNA, 25 bp, Mus musculus
cagccttccactactggtataatgg

SEQ ID NO: 316215 - DNA, 25 bp, Mus musculus
cagccttccacttctggtataatgg

SEQ ID NO: 316216 - DNA, 25 bp, Mus musculus
cagccttccagtagccgaatgaaaa

SEQ ID NO: 316217 - DNA, 25 bp, Mus musculus
cagccttccagttgccgaatgaaaa

SEQ ID NO: 316218 - DNA, 25 bp, Mus musculus
cagccttccatcactttaaggcagg

SEQ ID NO: 316219 - DNA, 25 bp, Mus musculus
cagccttccatctctttaaggcagg

SEQ ID NO: 316220 - DNA, 25 bp, Mus musculus
cagccttccctaacttctaattatt

SEQ ID NO: 316221 - DNA, 25 bp, Mus musculus
cagccttccctatcttctaattatt

SEQ ID NO: 316222 - DNA, 25 bp, Mus musculus
cagccttccgtacctaccttaaaag

SEQ ID NO: 316223 - DNA, 25 bp, Mus musculus
cagccttccgtagctaccttaaaag

SEQ ID NO: 316224 - DNA, 25 bp, Mus musculus
cagccttccgttccacaaacagtga

SEQ ID NO: 316225 - DNA, 25 bp, Mus musculus
cagccttccgttgcacaaacagtga

SEQ ID NO: 316226 - DNA, 25 bp, Mus musculus
cagccttcctttagcttgactttaa

SEQ ID NO: 316227 - DNA, 25 bp, Mus musculus
cagccttccttttgcttgactttaa

SEQ ID NO: 316228 - DNA, 25 bp, Mus musculus
cagccttcggttatggtccagagaa

SEQ ID NO: 316229 - DNA, 25 bp, Mus musculus
cagccttcggttttggtccagagaa

SEQ ID NO: 316230 - DNA, 25 bp, Mus musculus
cagccttctactatgatgtcttttt

SEQ ID NO: 316231 - DNA, 25 bp, Mus musculus
cagccttctactttgatgtcttttt

SEQ ID NO: 316232 - DNA, 25 bp, Mus musculus
cagccttctagaccctatgggttcg

SEQ ID NO: 316233 - DNA, 25 bp, Mus musculus
cagccttctagagcctatgggttcg

SEQ ID NO: 316234 - DNA, 25 bp, Mus musculus
cagccttctcaaagtcagtggcaga

SEQ ID NO: 316235 - DNA, 25 bp, Mus musculus
cagccttctcaatgtcagtggcaga

SEQ ID NO: 316236 - DNA, 25 bp, Mus musculus
cagccttctctgcaggactgataca

SEQ ID NO: 316237 - DNA, 25 bp, Mus musculus
cagccttctctggaggactgataca

SEQ ID NO: 316238 - DNA, 25 bp, Mus musculus
cagccttctgagctgcccttcaaag

SEQ ID NO: 316239 - DNA, 25 bp, Mus musculus
cagccttctgaggtgcccttcaaag

SEQ ID NO: 316240 - DNA, 25 bp, Mus musculus
cagccttctgctatgcattgggaac

SEQ ID NO: 316241 - DNA, 25 bp, Mus musculus
cagccttctgctttgcattgggaac

SEQ ID NO: 316242 - DNA, 25 bp, Mus musculus
cagccttgaatgatgccttggtgca

SEQ ID NO: 316243 - DNA, 25 bp, Mus musculus
cagccttgaatgttgccttggtgca

SEQ ID NO: 316244 - DNA, 25 bp, Mus musculus
cagccttgactgctcctgggaagag

SEQ ID NO: 316245 - DNA, 25 bp, Mus musculus
cagccttgactggtcctgggaagag

SEQ ID NO: 316246 - DNA, 25 bp, Mus musculus
cagccttgagatctactatgcagac

SEQ ID NO: 316247 - DNA, 25 bp, Mus musculus
cagccttgagatgtactatgcagac

SEQ ID NO: 316248 - DNA, 25 bp, Mus musculus
cagccttgagcaataactgccgggt

SEQ ID NO: 316249 - DNA, 25 bp, Mus musculus
cagccttgagcattaactgccgggt

SEQ ID NO: 316250 - DNA, 25 bp, Mus musculus
cagccttgagggattgggccccgca

SEQ ID NO: 316251 - DNA, 25 bp, Mus musculus
cagccttgagggtttgggccccgca

SEQ ID NO: 316252 - DNA, 25 bp, Mus musculus
cagccttgagtgctcatcactacag

SEQ ID NO: 316253 - DNA, 25 bp, Mus musculus
cagccttgagtggtcatcactacag

SEQ ID NO: 316254 - DNA, 25 bp, Mus musculus
cagccttgatgtcagcctagtctta

SEQ ID NO: 316255 - DNA, 25 bp, Mus musculus
cagccttgatgtgagcctagtctta

SEQ ID NO: 316256 - DNA, 25 bp, Mus musculus
cagccttgcaaaaactgggccattt

SEQ ID NO: 316257 - DNA, 25 bp, Mus musculus
cagccttgcaaatactgggccattt

SEQ ID NO: 316258 - DNA, 25 bp, Mus musculus
cagccttgcatcatacatgtcatta

SEQ ID NO: 316259 - DNA, 25 bp, Mus musculus
cagccttgcatcttacatgtcatta

SEQ ID NO: 316260 - DNA, 25 bp, Mus musculus
cagccttgccaaatcaagtgtgctt

SEQ ID NO: 316261 - DNA, 25 bp, Mus musculus
cagccttgccaattcaagtgtgctt

SEQ ID NO: 316262 - DNA, 25 bp, Mus musculus
cagccttgctgaaaacccacagctt

SEQ ID NO: 316263 - DNA, 25 bp, Mus musculus
cagccttgctgataacccacagctt

SEQ ID NO: 316264 - DNA, 25 bp, Mus musculus
cagccttggacaattcttttccagg

SEQ ID NO: 316265 - DNA, 25 bp, Mus musculus
cagccttggacatttcttttccagg

SEQ ID NO: 316266 - DNA, 25 bp, Mus musculus
cagccttggagcatggattcctatg

SEQ ID NO: 316267 - DNA, 25 bp, Mus musculus
cagccttggagcttggattcctatg

SEQ ID NO: 316268 - DNA, 25 bp, Mus musculus
cagccttggagtatggcattaagca

SEQ ID NO: 316269 - DNA, 25 bp, Mus musculus
cagccttggagtttggcattaagca

SEQ ID NO: 316270 - DNA, 25 bp, Mus musculus
cagccttggatgaagtgaccggcct

SEQ ID NO: 316271 - DNA, 25 bp, Mus musculus
cagccttggatgaggcattggctat

SEQ ID NO: 316272 - DNA, 25 bp, Mus musculus
cagccttggatgtagtgaccggcct

SEQ ID NO: 316273 - DNA, 25 bp, Mus musculus
cagccttggatgtggcattggctat

SEQ ID NO: 316274 - DNA, 25 bp, Mus musculus
cagccttggctgacaagtaccacta

SEQ ID NO: 316275 - DNA, 25 bp, Mus musculus
cagccttggctgtcaagtaccacta

SEQ ID NO: 316276 - DNA, 25 bp, Mus musculus
cagccttgtactcttgaaactcagc

SEQ ID NO: 316277 - DNA, 25 bp, Mus musculus
cagccttgtactgttgaaactcagc

SEQ ID NO: 316278 - DNA, 25 bp, Mus musculus
cagccttgtgatcttcctcatttac

SEQ ID NO: 316279 - DNA, 25 bp, Mus musculus
cagccttgtgatgttcctcatttac

SEQ ID NO: 316280 - DNA, 25 bp, Mus musculus
cagccttgtgtacctcccggtctgg

SEQ ID NO: 316281 - DNA, 25 bp, Mus musculus
cagccttgtgtagctcccggtctgg

SEQ ID NO: 316282 - DNA, 25 bp, Mus musculus
cagccttgtgttaccagacgtaact

SEQ ID NO: 316283 - DNA, 25 bp, Mus musculus
cagccttgtgtttccagacgtaact

SEQ ID NO: 316284 - DNA, 25 bp, Mus musculus
cagcctttacttcctctggactgag

SEQ ID NO: 316285 - DNA, 25 bp, Mus musculus
cagcctttacttgctctggactgag

SEQ ID NO: 316286 - DNA, 25 bp, Mus musculus
cagcctttagagaaagactctgggt

SEQ ID NO: 316287 - DNA, 25 bp, Mus musculus
cagcctttagagctggtggcctaaa

SEQ ID NO: 316288 - DNA, 25 bp, Mus musculus
cagcctttagaggtggtggcctaaa

SEQ ID NO: 316289 - DNA, 25 bp, Mus musculus
cagcctttagagtaagactctgggt

SEQ ID NO: 316290 - DNA, 25 bp, Mus musculus
cagcctttagataatttgggatcct

SEQ ID NO: 316291 - DNA, 25 bp, Mus musculus
cagcctttagattatttgggatcct

SEQ ID NO: 316292 - DNA, 25 bp, Mus musculus
cagcctttatgtcaacggtttgcaa

SEQ ID NO: 316293 - DNA, 25 bp, Mus musculus
cagcctttatgtgaacggtttgcaa

SEQ ID NO: 316294 - DNA, 25 bp, Mus musculus
cagcctttcaaacagctatttcaaa

SEQ ID NO: 316295 - DNA, 25 bp, Mus musculus
cagcctttcaaagagctatttcaaa

SEQ ID NO: 316296 - DNA, 25 bp, Mus musculus
cagcctttccagcaggttttagtgc

SEQ ID NO: 316297 - DNA, 25 bp, Mus musculus
cagcctttccaggaggttttagtgc

SEQ ID NO: 316298 - DNA, 25 bp, Mus musculus
cagcctttctaacttggatgttggt

SEQ ID NO: 316299 - DNA, 25 bp, Mus musculus
cagcctttctaagttggatgttggt

SEQ ID NO: 316300 - DNA, 25 bp, Mus musculus
cagcctttctgtacccataaattca

SEQ ID NO: 316301 - DNA, 25 bp, Mus musculus
cagcctttctgttcccataaattca

SEQ ID NO: 316302 - DNA, 25 bp, Mus musculus
cagcctttctttagttccacagtta

SEQ ID NO: 316303 - DNA, 25 bp, Mus musculus
cagcctttctttcactagctgtgaa

SEQ ID NO: 316304 - DNA, 25 bp, Mus musculus
cagcctttctttgactagctgtgaa

SEQ ID NO: 316305 - DNA, 25 bp, Mus musculus
cagcctttcttttgttccacagtta

SEQ ID NO: 316306 - DNA, 25 bp, Mus musculus
cagcctttgagaatcagtgcgcgat

SEQ ID NO: 316307 - DNA, 25 bp, Mus musculus
cagcctttgagattcagtgcgcgat

SEQ ID NO: 316308 - DNA, 25 bp, Mus musculus
cagcctttgagcctagtgggaggcc

SEQ ID NO: 316309 - DNA, 25 bp, Mus musculus
cagcctttgagcgtagtgggaggcc

SEQ ID NO: 316310 - DNA, 25 bp, Mus musculus
cagcctttgagtatctctggattag

SEQ ID NO: 316311 - DNA, 25 bp, Mus musculus
cagcctttgagtcgacgagtcacta

SEQ ID NO: 316312 - DNA, 25 bp, Mus musculus
cagcctttgagtggacgagtcacta

SEQ ID NO: 316313 - DNA, 25 bp, Mus musculus
cagcctttgagtttctctggattag

SEQ ID NO: 316314 - DNA, 25 bp, Mus musculus
cagcctttggtcatcggcagggcca

SEQ ID NO: 316315 - DNA, 25 bp, Mus musculus
cagcctttggtcttcggcagggcca

SEQ ID NO: 316316 - DNA, 25 bp, Mus musculus
cagcctttgtacaatcgcttctgag

SEQ ID NO: 316317 - DNA, 25 bp, Mus musculus
cagcctttgtactatcgcttctgag

SEQ ID NO: 316318 - DNA, 25 bp, Mus musculus
cagcctttgtctactcagtgtaagt

SEQ ID NO: 316319 - DNA, 25 bp, Mus musculus
cagcctttgtctcggtctgggactg

SEQ ID NO: 316320 - DNA, 25 bp, Mus musculus
cagcctttgtctgggtctgggactg

SEQ ID NO: 316321 - DNA, 25 bp, Mus musculus
cagcctttgtcttctcagtgtaagt

SEQ ID NO: 316322 - DNA, 25 bp, Mus musculus
cagcctttgttgcttagtggcatac

SEQ ID NO: 316323 - DNA, 25 bp, Mus musculus
cagcctttgttggttagtggcatac

SEQ ID NO: 316324 - DNA, 25 bp, Mus musculus
cagccttttcccattgcaatggatg

SEQ ID NO: 316325 - DNA, 25 bp, Mus musculus
cagccttttccctttgcaatggatg

SEQ ID NO: 316326 - DNA, 25 bp, Mus musculus
cagcctttttatattgcctgccaaa

SEQ ID NO: 316327 - DNA, 25 bp, Mus musculus
cagcctttttattttgcctgccaaa

SEQ ID NO: 316328 - DNA, 25 bp, Mus musculus
cagcgaaagtttactcgtgacccgt

SEQ ID NO: 316329 - DNA, 25 bp, Mus musculus
cagcgaaagttttctcgtgacccgt

SEQ ID NO: 316330 - DNA, 25 bp, Mus musculus
cagcgaacctgtcccctggaaagtt

SEQ ID NO: 316331 - DNA, 25 bp, Mus musculus
cagcgaacctgtgccctggaaagtt

SEQ ID NO: 316332 - DNA, 25 bp, Mus musculus
cagcgaagaatcagtcagcagtaat

SEQ ID NO: 316333 - DNA, 25 bp, Mus musculus
cagcgaagaatctgtcagcagtaat

SEQ ID NO: 316334 - DNA, 25 bp, Mus musculus
cagcgaagtccccatgtattttatc

SEQ ID NO: 316335 - DNA, 25 bp, Mus musculus
cagcgaagtcccgatgtattttatc

SEQ ID NO: 316336 - DNA, 25 bp, Mus musculus
cagcgaatagctccatgggcttcct

SEQ ID NO: 316337 - DNA, 25 bp, Mus musculus
cagcgaatagctgcatgggcttcct

SEQ ID NO: 316338 - DNA, 25 bp, Mus musculus
cagcgaatgctgaacgtgtgggcac

SEQ ID NO: 316339 - DNA, 25 bp, Mus musculus
cagcgaatgctgtacgtgtgggcac

SEQ ID NO: 316340 - DNA, 25 bp, Mus musculus
cagcgacacgtacatgccatcttca

SEQ ID NO: 316341 - DNA, 25 bp, Mus musculus
cagcgacacgtagatgccatcttca

SEQ ID NO: 316342 - DNA, 25 bp, Mus musculus
cagcgaccaggacattgacttcaag

SEQ ID NO: 316343 - DNA, 25 bp, Mus musculus
cagcgaccaggagattgacttcaag

SEQ ID NO: 316344 - DNA, 25 bp, Mus musculus
cagcgacctaccagggtgatgtcta

SEQ ID NO: 316345 - DNA, 25 bp, Mus musculus
cagcgacctacctgggtgatgtcta

SEQ ID NO: 316346 - DNA, 25 bp, Mus musculus
cagcgacgcttccttcttaaagggt

SEQ ID NO: 316347 - DNA, 25 bp, Mus musculus
cagcgacgcttcgttcttaaagggt

SEQ ID NO: 316348 - DNA, 25 bp, Mus musculus
cagcgacgtcatctgtgtgtggact

SEQ ID NO: 316349 - DNA, 25 bp, Mus musculus
cagcgacgtcatgtgtgtgtggact

SEQ ID NO: 316350 - DNA, 25 bp, Mus musculus
cagcgactactaccgcattagcgag

SEQ ID NO: 316351 - DNA, 25 bp, Mus musculus
cagcgactactagcgcattagcgag

SEQ ID NO: 316352 - DNA, 25 bp, Mus musculus
cagcgactccagcaggccggagtca

SEQ ID NO: 316353 - DNA, 25 bp, Mus musculus
cagcgactccaggaggccggagtca

SEQ ID NO: 316354 - DNA, 25 bp, Mus musculus
cagcgacttttcacaggtgctgcag

SEQ ID NO: 316355 - DNA, 25 bp, Mus musculus
cagcgacttttctcaggtgctgcag

SEQ ID NO: 316356 - DNA, 25 bp, Mus musculus
cagcgagagcacatctttcagggaa

SEQ ID NO: 316357 - DNA, 25 bp, Mus musculus
cagcgagagcacttctttcagggaa

SEQ ID NO: 316358 - DNA, 25 bp, Mus musculus
cagcgagagcttctcacttttctga

SEQ ID NO: 316359 - DNA, 25 bp, Mus musculus
cagcgagagcttgtcacttttctga

SEQ ID NO: 316360 - DNA, 25 bp, Mus musculus
cagcgagaggctcacatccagaatt

SEQ ID NO: 316361 - DNA, 25 bp, Mus musculus
cagcgagaggctgacatccagaatt

SEQ ID NO: 316362 - DNA, 25 bp, Mus musculus
cagcgagatatacgaaaagcttata

SEQ ID NO: 316363 - DNA, 25 bp, Mus musculus
cagcgagatataggaaaagcttata

SEQ ID NO: 316364 - DNA, 25 bp, Mus musculus
cagcgagcaggaccccagagcggag

SEQ ID NO: 316365 - DNA, 25 bp, Mus musculus
cagcgagcaggagcccagagcggag

SEQ ID NO: 316366 - DNA, 25 bp, Mus musculus
cagcgagcccaacaaagtttccggt

SEQ ID NO: 316367 - DNA, 25 bp, Mus musculus
cagcgagcccaagaaagtttccggt

SEQ ID NO: 316368 - DNA, 25 bp, Mus musculus
cagcgagcgagccagttgagactta

SEQ ID NO: 316369 - DNA, 25 bp, Mus musculus
cagcgagcgagcgagttgagactta

SEQ ID NO: 316370 - DNA, 25 bp, Mus musculus
cagcgagcggctccaaagcttcagc

SEQ ID NO: 316371 - DNA, 25 bp, Mus musculus
cagcgagcggctgcaaagcttcagc

SEQ ID NO: 316372 - DNA, 25 bp, Mus musculus
cagcgagcttcacttctgtggacat

SEQ ID NO: 316373 - DNA, 25 bp, Mus musculus
cagcgagcttcagttctgtggacat

SEQ ID NO: 316374 - DNA, 25 bp, Mus musculus
cagcgagcttccatcattcagagat

SEQ ID NO: 316375 - DNA, 25 bp, Mus musculus
cagcgagcttccttcattcagagat

SEQ ID NO: 316376 - DNA, 25 bp, Mus musculus
cagcgaggacgcatatgactcctat

SEQ ID NO: 316377 - DNA, 25 bp, Mus musculus
cagcgaggacgcttatgactcctat

SEQ ID NO: 316378 - DNA, 25 bp, Mus musculus
cagcgaggagctccttctgtcgaga

SEQ ID NO: 316379 - DNA, 25 bp, Mus musculus
cagcgaggagctgcttctgtcgaga

SEQ ID NO: 316380 - DNA, 25 bp, Mus musculus
cagcgaggaggcactagctcagtat

SEQ ID NO: 316381 - DNA, 25 bp, Mus musculus
cagcgaggaggctctagctcagtat

SEQ ID NO: 316382 - DNA, 25 bp, Mus musculus
cagcgaggatgaacactctggaagt

SEQ ID NO: 316383 - DNA, 25 bp, Mus musculus
cagcgaggatgatcactctggaagt

SEQ ID NO: 316384 - DNA, 25 bp, Mus musculus
cagcgagggcaaactgcagatccat

SEQ ID NO: 316385 - DNA, 25 bp, Mus musculus
cagcgagggcaatctgcagatccat

SEQ ID NO: 316386 - DNA, 25 bp, Mus musculus
cagcgaggtttgagtgactttcttt

SEQ ID NO: 316387 - DNA, 25 bp, Mus musculus
cagcgaggtttgtgtgactttcttt

SEQ ID NO: 316388 - DNA, 25 bp, Mus musculus
cagcgagtaattacgggatgcaggt

SEQ ID NO: 316389 - DNA, 25 bp, Mus musculus
cagcgagtaatttcgggatgcaggt

SEQ ID NO: 316390 - DNA, 25 bp, Mus musculus
cagcgagtatggacgccttgataca

SEQ ID NO: 316391 - DNA, 25 bp, Mus musculus
cagcgagtatggtcgccttgataca

SEQ ID NO: 316392 - DNA, 25 bp, Mus musculus
cagcgagtctgtcccaggagccctg

SEQ ID NO: 316393 - DNA, 25 bp, Mus musculus
cagcgagtctgtgccaggagccctg

SEQ ID NO: 316394 - DNA, 25 bp, Mus musculus
cagcgagtttatagccagattttaa

SEQ ID NO: 316395 - DNA, 25 bp, Mus musculus
cagcgagtttattgccagattttaa

SEQ ID NO: 316396 - DNA, 25 bp, Mus musculus
cagcgatacgctacttgatttgaac

SEQ ID NO: 316397 - DNA, 25 bp, Mus musculus
cagcgatacgcttcttgatttgaac

SEQ ID NO: 316398 - DNA, 25 bp, Mus musculus
cagcgatatattcctgaggctttaa

SEQ ID NO: 316399 - DNA, 25 bp, Mus musculus
cagcgatatattgctgaggctttaa

SEQ ID NO: 316400 - DNA, 25 bp, Mus musculus
cagcgatcagtgcacccgagagaga

SEQ ID NO: 316401 - DNA, 25 bp, Mus musculus
cagcgatcagtggacccgagagaga

SEQ ID NO: 316402 - DNA, 25 bp, Mus musculus
cagcgatgagctaggaccaccaaag

SEQ ID NO: 316403 - DNA, 25 bp, Mus musculus
cagcgatgagcttggaccaccaaag

SEQ ID NO: 316404 - DNA, 25 bp, Mus musculus
cagcgatgcactactgcagcaggca

SEQ ID NO: 316405 - DNA, 25 bp, Mus musculus
cagcgatgcacttctgcagcaggca

SEQ ID NO: 316406 - DNA, 25 bp, Mus musculus
cagcgatgcaggctttgtcccagat

SEQ ID NO: 316407 - DNA, 25 bp, Mus musculus
cagcgatgcagggtttgtcccagat

SEQ ID NO: 316408 - DNA, 25 bp, Mus musculus
cagcgatgggtgattcagcctggta

SEQ ID NO: 316409 - DNA, 25 bp, Mus musculus
cagcgatgggtgtttcagcctggta

SEQ ID NO: 316410 - DNA, 25 bp, Mus musculus
cagcgatgtggactcagaccctcga

SEQ ID NO: 316411 - DNA, 25 bp, Mus musculus
cagcgatgtggagtcagaccctcga

SEQ ID NO: 316412 - DNA, 25 bp, Mus musculus
cagcgatgttatcttgaccgtagag

SEQ ID NO: 316413 - DNA, 25 bp, Mus musculus
cagcgatgttatgttgaccgtagag

SEQ ID NO: 316414 - DNA, 25 bp, Mus musculus
cagcgattcttccaggtactgcttc

SEQ ID NO: 316415 - DNA, 25 bp, Mus musculus
cagcgattcttcgaggtactgcttc

SEQ ID NO: 316416 - DNA, 25 bp, Mus musculus
cagcgattgcaactggcctggccgc

SEQ ID NO: 316417 - DNA, 25 bp, Mus musculus
cagcgattgcaagtggcctggccgc

SEQ ID NO: 316418 - DNA, 25 bp, Mus musculus
cagcgattgtccagtgggagccacg

SEQ ID NO: 316419 - DNA, 25 bp, Mus musculus
cagcgattgtcctgtgggagccacg

SEQ ID NO: 316420 - DNA, 25 bp, Mus musculus
cagcgcaaagcgaccaaaggcttta

SEQ ID NO: 316421 - DNA, 25 bp, Mus musculus
cagcgcaaagcgtccaaaggcttta

SEQ ID NO: 316422 - DNA, 25 bp, Mus musculus
cagcgcaccctgaaaaccttgtaga

SEQ ID NO: 316423 - DNA, 25 bp, Mus musculus
cagcgcaccctgtaaaccttgtaga

SEQ ID NO: 316424 - DNA, 25 bp, Mus musculus
cagcgcacggacagatctgtagtct

SEQ ID NO: 316425 - DNA, 25 bp, Mus musculus
cagcgcacggactgatctgtagtct

SEQ ID NO: 316426 - DNA, 25 bp, Mus musculus
cagcgcagatacacagagaaaggat

SEQ ID NO: 316427 - DNA, 25 bp, Mus musculus
cagcgcagatactcagagaaaggat

SEQ ID NO: 316428 - DNA, 25 bp, Mus musculus
cagcgcagcgtgagacttaaactat

SEQ ID NO: 316429 - DNA, 25 bp, Mus musculus
cagcgcagcgtgtgacttaaactat

SEQ ID NO: 316430 - DNA, 25 bp, Mus musculus
cagcgcagctgcagtatggctggac

SEQ ID NO: 316431 - DNA, 25 bp, Mus musculus
cagcgcagctgctgtatggctggac

SEQ ID NO: 316432 - DNA, 25 bp, Mus musculus
cagcgcaggtggacagaatctgagt

SEQ ID NO: 316433 - DNA, 25 bp, Mus musculus
cagcgcaggtggtcagaatctgagt

SEQ ID NO: 316434 - DNA, 25 bp, Mus musculus
cagcgccacagcatgctggttatgg

SEQ ID NO: 316435 - DNA, 25 bp, Mus musculus
cagcgccacagcttgctggttatgg

SEQ ID NO: 316436 - DNA, 25 bp, Mus musculus
cagcgccatgcccagaaaatacaaa

SEQ ID NO: 316437 - DNA, 25 bp, Mus musculus
cagcgccatgccgagaaaatacaaa

SEQ ID NO: 316438 - DNA, 25 bp, Mus musculus
cagcgcccagatcgcagactgattc

SEQ ID NO: 316439 - DNA, 25 bp, Mus musculus
cagcgcccagatggcagactgattc

SEQ ID NO: 316440 - DNA, 25 bp, Mus musculus
cagcgcccatcgcttgttcatcgtg

SEQ ID NO: 316441 - DNA, 25 bp, Mus musculus
cagcgcccatcggttgttcatcgtg

SEQ ID NO: 316442 - DNA, 25 bp, Mus musculus
cagcgccctgtgattttctgaggat

SEQ ID NO: 316443 - DNA, 25 bp, Mus musculus
cagcgccctgtgtttttctgaggat

SEQ ID NO: 316444 - DNA, 25 bp, Mus musculus
cagcgccgctacattggagtgatga

SEQ ID NO: 316445 - DNA, 25 bp, Mus musculus
cagcgccgctactttggagtgatga

SEQ ID NO: 316446 - DNA, 25 bp, Mus musculus
cagcgccgggagataatagcaatat

SEQ ID NO: 316447 - DNA, 25 bp, Mus musculus
cagcgccgggagttaatagcaatat

SEQ ID NO: 316448 - DNA, 25 bp, Mus musculus
cagcgcctcaagatttgggacatga

SEQ ID NO: 316449 - DNA, 25 bp, Mus musculus
cagcgcctcaagttttgggacatga

SEQ ID NO: 316450 - DNA, 25 bp, Mus musculus
cagcgcctcatacaagggattggat

SEQ ID NO: 316451 - DNA, 25 bp, Mus musculus
cagcgcctcatagaagggattggat

SEQ ID NO: 316452 - DNA, 25 bp, Mus musculus
cagcgcctgcgcaaggatgagcaac

SEQ ID NO: 316453 - DNA, 25 bp, Mus musculus
cagcgcctgcgctaggatgagcaac

SEQ ID NO: 316454 - DNA, 25 bp, Mus musculus
cagcgcctgtgtactgtgttagaaa

SEQ ID NO: 316455 - DNA, 25 bp, Mus musculus
cagcgcctgtgttctgtgttagaaa

SEQ ID NO: 316456 - DNA, 25 bp, Mus musculus
cagcgcctgtttattcctactttaa

SEQ ID NO: 316457 - DNA, 25 bp, Mus musculus
cagcgcctgttttttcctactttaa

SEQ ID NO: 316458 - DNA, 25 bp, Mus musculus
cagcgcgaaagacttgtggttaata

SEQ ID NO: 316459 - DNA, 25 bp, Mus musculus
cagcgcgaaagagttgtggttaata

SEQ ID NO: 316460 - DNA, 25 bp, Mus musculus
cagcgcgagcgaaccgagagtctat

SEQ ID NO: 316461 - DNA, 25 bp, Mus musculus
cagcgcgagcgatccgagagtctat

SEQ ID NO: 316462 - DNA, 25 bp, Mus musculus
cagcgcgaggacatcacgcacaaca

SEQ ID NO: 316463 - DNA, 25 bp, Mus musculus
cagcgcgaggacttcacgcacaaca

SEQ ID NO: 316464 - DNA, 25 bp, Mus musculus
cagcgcggatctatggcagaagtcc

SEQ ID NO: 316465 - DNA, 25 bp, Mus musculus
cagcgcggatctttggcagaagtcc

SEQ ID NO: 316466 - DNA, 25 bp, Mus musculus
cagcgcgtatagaggcaaagcctgc

SEQ ID NO: 316467 - DNA, 25 bp, Mus musculus
cagcgcgtatagtggcaaagcctgc

SEQ ID NO: 316468 - DNA, 25 bp, Mus musculus
cagcgcgttgaactctatcgtatga

SEQ ID NO: 316469 - DNA, 25 bp, Mus musculus
cagcgcgttgaagtctatcgtatga

SEQ ID NO: 316470 - DNA, 25 bp, Mus musculus
cagcgctaggatcacacttgcaaaa

SEQ ID NO: 316471 - DNA, 25 bp, Mus musculus
cagcgctaggatgacacttgcaaaa

SEQ ID NO: 316472 - DNA, 25 bp, Mus musculus
cagcgctcacttattgtatttaaat

SEQ ID NO: 316473 - DNA, 25 bp, Mus musculus
cagcgctcactttttgtatttaaat

SEQ ID NO: 316474 - DNA, 25 bp, Mus musculus
cagcgctcagagatctgacacggta

SEQ ID NO: 316475 - DNA, 25 bp, Mus musculus
cagcgctcagagttctgacacggta

SEQ ID NO: 316476 - DNA, 25 bp, Mus musculus
cagcgctcagggaccttggtgaaaa

SEQ ID NO: 316477 - DNA, 25 bp, Mus musculus
cagcgctcagggtccttggtgaaaa

SEQ ID NO: 316478 - DNA, 25 bp, Mus musculus
cagcgctcaggtaccttgtgaagaa

SEQ ID NO: 316479 - DNA, 25 bp, Mus musculus
cagcgctcaggtacgggctcactag

SEQ ID NO: 316480 - DNA, 25 bp, Mus musculus
cagcgctcaggttccttgtgaagaa

SEQ ID NO: 316481 - DNA, 25 bp, Mus musculus
cagcgctcaggttcgggctcactag

SEQ ID NO: 316482 - DNA, 25 bp, Mus musculus
cagcgctcgggcaaatcaaggtgtc

SEQ ID NO: 316483 - DNA, 25 bp, Mus musculus
cagcgctcgggctaatcaaggtgtc

SEQ ID NO: 316484 - DNA, 25 bp, Mus musculus
cagcgctgcaacacttgggatggca

SEQ ID NO: 316485 - DNA, 25 bp, Mus musculus
cagcgctgcaactcttgggatggca

SEQ ID NO: 316486 - DNA, 25 bp, Mus musculus
cagcgctgcataactcgtggcttca

SEQ ID NO: 316487 - DNA, 25 bp, Mus musculus
cagcgctgcatatctcgtggcttca

SEQ ID NO: 316488 - DNA, 25 bp, Mus musculus
cagcgctgcttcagcacctctggga

SEQ ID NO: 316489 - DNA, 25 bp, Mus musculus
cagcgctgcttctgcacctctggga

SEQ ID NO: 316490 - DNA, 25 bp, Mus musculus
cagcgctggcaaagcaccttctaaa

SEQ ID NO: 316491 - DNA, 25 bp, Mus musculus
cagcgctggcaatgcaccttctaaa

SEQ ID NO: 316492 - DNA, 25 bp, Mus musculus
cagcgctgtgttcatatgtccatac

SEQ ID NO: 316493 - DNA, 25 bp, Mus musculus
cagcgctgtgttgatatgtccatac

SEQ ID NO: 316494 - DNA, 25 bp, Mus musculus
cagcgctgttctccacaccttggtt

SEQ ID NO: 316495 - DNA, 25 bp, Mus musculus
cagcgctgttctgcacaccttggtt

SEQ ID NO: 316496 - DNA, 25 bp, Mus musculus
cagcgctgttggattcttggccttt

SEQ ID NO: 316497 - DNA, 25 bp, Mus musculus
cagcgctgttggtttcttggccttt

SEQ ID NO: 316498 - DNA, 25 bp, Mus musculus
cagcggaaagtgatctgcatcccca

SEQ ID NO: 316499 - DNA, 25 bp, Mus musculus
cagcggaaagtgttctgcatcccca

SEQ ID NO: 316500 - DNA, 25 bp, Mus musculus
cagcggaaccgcacagaacggttgt

SEQ ID NO: 316501 - DNA, 25 bp, Mus musculus
cagcggaaccgctcagaacggttgt

SEQ ID NO: 316502 - DNA, 25 bp, Mus musculus
cagcggacatgcctgcatcttcaag

SEQ ID NO: 316503 - DNA, 25 bp, Mus musculus
cagcggacatgcgtgcatcttcaag

SEQ ID NO: 316504 - DNA, 25 bp, Mus musculus
cagcggacccagagattgtgaaaac

SEQ ID NO: 316505 - DNA, 25 bp, Mus musculus
cagcggacccagtgattgtgaaaac

SEQ ID NO: 316506 - DNA, 25 bp, Mus musculus
cagcggacccggcttctgaataaat

SEQ ID NO: 316507 - DNA, 25 bp, Mus musculus
cagcggacccgggttctgaataaat

SEQ ID NO: 316508 - DNA, 25 bp, Mus musculus
cagcggactctgctatccatgtgta

SEQ ID NO: 316509 - DNA, 25 bp, Mus musculus
cagcggactctggtatccatgtgta

SEQ ID NO: 316510 - DNA, 25 bp, Mus musculus
cagcggagaggacgccaaactaaag

SEQ ID NO: 316511 - DNA, 25 bp, Mus musculus
cagcggagaggaggccaaactaaag

SEQ ID NO: 316512 - DNA, 25 bp, Mus musculus
cagcggaggcggaaacttgacactt

SEQ ID NO: 316513 - DNA, 25 bp, Mus musculus
cagcggaggcggtaacttgacactt

SEQ ID NO: 316514 - DNA, 25 bp, Mus musculus
cagcggagtccaaggttgtgttcat

SEQ ID NO: 316515 - DNA, 25 bp, Mus musculus
cagcggagtccatggttgtgttcat

SEQ ID NO: 316516 - DNA, 25 bp, Mus musculus
cagcggcatagtctgccttgttctt

SEQ ID NO: 316517 - DNA, 25 bp, Mus musculus
cagcggcatagtgtgccttgttctt

SEQ ID NO: 316518 - DNA, 25 bp, Mus musculus
cagcggcatccaagtcattttagta

SEQ ID NO: 316519 - DNA, 25 bp, Mus musculus
cagcggcatccatgtcattttagta

SEQ ID NO: 316520 - DNA, 25 bp, Mus musculus
cagcggcatggaaggtcctagctct

SEQ ID NO: 316521 - DNA, 25 bp, Mus musculus
cagcggcatggatggtcctagctct

SEQ ID NO: 316522 - DNA, 25 bp, Mus musculus
cagcggcatgtacagtgactagcaa

SEQ ID NO: 316523 - DNA, 25 bp, Mus musculus
cagcggcatgtagagtgactagcaa

SEQ ID NO: 316524 - DNA, 25 bp, Mus musculus
cagcggcatttgctcgggcagccgc

SEQ ID NO: 316525 - DNA, 25 bp, Mus musculus
cagcggcatttggtcgggcagccgc

SEQ ID NO: 316526 - DNA, 25 bp, Mus musculus
cagcggccagagaacattcctagaa

SEQ ID NO: 316527 - DNA, 25 bp, Mus musculus
cagcggccagagtacattcctagaa

SEQ ID NO: 316528 - DNA, 25 bp, Mus musculus
cagcggccatgtccagacagacctg

SEQ ID NO: 316529 - DNA, 25 bp, Mus musculus
cagcggccatgtgcagacagacctg

SEQ ID NO: 316530 - DNA, 25 bp, Mus musculus
cagcggcccggaccccaaagagaat

SEQ ID NO: 316531 - DNA, 25 bp, Mus musculus
cagcggcccggagcccaaagagaat

SEQ ID NO: 316532 - DNA, 25 bp, Mus musculus
cagcggccgagaccgggaggatgcc

SEQ ID NO: 316533 - DNA, 25 bp, Mus musculus
cagcggccgagagcgggaggatgcc

SEQ ID NO: 316534 - DNA, 25 bp, Mus musculus
cagcggccggtcatggagttattaa

SEQ ID NO: 316535 - DNA, 25 bp, Mus musculus
cagcggccggtcttggagttattaa

SEQ ID NO: 316536 - DNA, 25 bp, Mus musculus
cagcggcggagtcggcggctagcgg

SEQ ID NO: 316537 - DNA, 25 bp, Mus musculus
cagcggcggagtgggcggctagcgg

SEQ ID NO: 316538 - DNA, 25 bp, Mus musculus
cagcggctccccaaaaggttccaag

SEQ ID NO: 316539 - DNA, 25 bp, Mus musculus
cagcggctccccagctagggaagcg

SEQ ID NO: 316540 - DNA, 25 bp, Mus musculus
cagcggctcccctaaaggttccaag

SEQ ID NO: 316541 - DNA, 25 bp, Mus musculus
cagcggctcccctgctagggaagcg

SEQ ID NO: 316542 - DNA, 25 bp, Mus musculus
cagcggctctgcagtttctctaagg

SEQ ID NO: 316543 - DNA, 25 bp, Mus musculus
cagcggctctgctgtttctctaagg

SEQ ID NO: 316544 - DNA, 25 bp, Mus musculus
cagcggctgaggaagctttctcttc

SEQ ID NO: 316545 - DNA, 25 bp, Mus musculus
cagcggctgaggtagctttctcttc

SEQ ID NO: 316546 - DNA, 25 bp, Mus musculus
cagcggctgttactgttacggagta

SEQ ID NO: 316547 - DNA, 25 bp, Mus musculus
cagcggctgttagtgttacggagta

SEQ ID NO: 316548 - DNA, 25 bp, Mus musculus
cagcgggaaagcactcggttgaatt

SEQ ID NO: 316549 - DNA, 25 bp, Mus musculus
cagcgggaaagctctcggttgaatt

SEQ ID NO: 316550 - DNA, 25 bp, Mus musculus
cagcgggaccagaccgccgagacgt

SEQ ID NO: 316551 - DNA, 25 bp, Mus musculus
cagcgggaccagtccgccgagacgt

SEQ ID NO: 316552 - DNA, 25 bp, Mus musculus
cagcgggagaacagcgcgttctacg

SEQ ID NO: 316553 - DNA, 25 bp, Mus musculus
cagcgggagaactgcgcgttctacg

SEQ ID NO: 316554 - DNA, 25 bp, Mus musculus
cagcgggagctgaacgtgattctca

SEQ ID NO: 316555 - DNA, 25 bp, Mus musculus
cagcgggagctgtacgtgattctca

SEQ ID NO: 316556 - DNA, 25 bp, Mus musculus
cagcgggagtccatcctaggaagct

SEQ ID NO: 316557 - DNA, 25 bp, Mus musculus
cagcgggagtccttcctaggaagct

SEQ ID NO: 316558 - DNA, 25 bp, Mus musculus
cagcgggagtttcacaggagattct

SEQ ID NO: 316559 - DNA, 25 bp, Mus musculus
cagcgggagtttgacaggagattct

SEQ ID NO: 316560 - DNA, 25 bp, Mus musculus
cagcgggcaatgacatcttccacaa

SEQ ID NO: 316561 - DNA, 25 bp, Mus musculus
cagcgggcaatgtcatcttccacaa

SEQ ID NO: 316562 - DNA, 25 bp, Mus musculus
cagcgggcatggctttgtatgttca

SEQ ID NO: 316563 - DNA, 25 bp, Mus musculus
cagcgggcatgggtttgtatgttca

SEQ ID NO: 316564 - DNA, 25 bp, Mus musculus
cagcgggctctgaggagaactgctc

SEQ ID NO: 316565 - DNA, 25 bp, Mus musculus
cagcgggctctgtggagaactgctc

SEQ ID NO: 316566 - DNA, 25 bp, Mus musculus
cagcgggctgcgcacttggctttct

SEQ ID NO: 316567 - DNA, 25 bp, Mus musculus
cagcgggctgcggacttggctttct

SEQ ID NO: 316568 - DNA, 25 bp, Mus musculus
cagcgggtcacacctgtggttgctc

SEQ ID NO: 316569 - DNA, 25 bp, Mus musculus
cagcgggtcacagctgtggttgctc

SEQ ID NO: 316570 - DNA, 25 bp, Mus musculus
cagcgggtctggatctgaaggccta

SEQ ID NO: 316571 - DNA, 25 bp, Mus musculus
cagcgggtctggttctgaaggccta

SEQ ID NO: 316572 - DNA, 25 bp, Mus musculus
cagcgggttcctattgtgcttcctt

SEQ ID NO: 316573 - DNA, 25 bp, Mus musculus
cagcgggttccttttgtgcttcctt

SEQ ID NO: 316574 - DNA, 25 bp, Mus musculus
cagcggtaagttacactctttattc

SEQ ID NO: 316575 - DNA, 25 bp, Mus musculus
cagcggtaagtttcactctttattc

SEQ ID NO: 316576 - DNA, 25 bp, Mus musculus
cagcggtactacattgagggcatca

SEQ ID NO: 316577 - DNA, 25 bp, Mus musculus
cagcggtactactttgagggcatca

SEQ ID NO: 316578 - DNA, 25 bp, Mus musculus
cagcggtcatcaagctcgtgggtga

SEQ ID NO: 316579 - DNA, 25 bp, Mus musculus
cagcggtcatcatgctcgtgggtga

SEQ ID NO: 316580 - DNA, 25 bp, Mus musculus
cagcggtctgccagagaatacatca

SEQ ID NO: 316581 - DNA, 25 bp, Mus musculus
cagcggtctgcctgagaatacatca

SEQ ID NO: 316582 - DNA, 25 bp, Mus musculus
cagcggtgcagcactgcggtgccct

SEQ ID NO: 316583 - DNA, 25 bp, Mus musculus
cagcggtgcagctctgcggtgccct

SEQ ID NO: 316584 - DNA, 25 bp, Mus musculus
cagcggtgctggagtctcccattac

SEQ ID NO: 316585 - DNA, 25 bp, Mus musculus
cagcggtgctggtgtctcccattac

SEQ ID NO: 316586 - DNA, 25 bp, Mus musculus
cagcggttagccaggacgccccgga

SEQ ID NO: 316587 - DNA, 25 bp, Mus musculus
cagcggttagcctggacgccccgga

SEQ ID NO: 316588 - DNA, 25 bp, Mus musculus
cagcggttaggaccatttgctgttc

SEQ ID NO: 316589 - DNA, 25 bp, Mus musculus
cagcggttaggagcatttgctgttc

SEQ ID NO: 316590 - DNA, 25 bp, Mus musculus
cagcggttgttacaagggctttctt

SEQ ID NO: 316591 - DNA, 25 bp, Mus musculus
cagcggttgttagaagggctttctt

SEQ ID NO: 316592 - DNA, 25 bp, Mus musculus
cagcgtacaaatcccactcagattc

SEQ ID NO: 316593 - DNA, 25 bp, Mus musculus
cagcgtacaaatgccactcagattc

SEQ ID NO: 316594 - DNA, 25 bp, Mus musculus
cagcgtacgctgcttaggcaacaaa

SEQ ID NO: 316595 - DNA, 25 bp, Mus musculus
cagcgtacgctggttaggcaacaaa

SEQ ID NO: 316596 - DNA, 25 bp, Mus musculus
cagcgtacgtgacgctctggcttca

SEQ ID NO: 316597 - DNA, 25 bp, Mus musculus
cagcgtacgtgaggctctggcttca

SEQ ID NO: 316598 - DNA, 25 bp, Mus musculus
cagcgtagacgaatatgggatggac

SEQ ID NO: 316599 - DNA, 25 bp, Mus musculus
cagcgtagacgattatgggatggac

SEQ ID NO: 316600 - DNA, 25 bp, Mus musculus
cagcgtagactgatgctcatctgat

SEQ ID NO: 316601 - DNA, 25 bp, Mus musculus
cagcgtagactgttgctcatctgat

SEQ ID NO: 316602 - DNA, 25 bp, Mus musculus
cagcgtatgcacaggcactgggaag

SEQ ID NO: 316603 - DNA, 25 bp, Mus musculus
cagcgtatgcactggcactgggaag

SEQ ID NO: 316604 - DNA, 25 bp, Mus musculus
cagcgtatgtgtctcagcaggttca

SEQ ID NO: 316605 - DNA, 25 bp, Mus musculus
cagcgtatgtgtgtcagcaggttca

SEQ ID NO: 316606 - DNA, 25 bp, Mus musculus
cagcgtattactcggcaggcagaag

SEQ ID NO: 316607 - DNA, 25 bp, Mus musculus
cagcgtattactgggcaggcagaag

SEQ ID NO: 316608 - DNA, 25 bp, Mus musculus
cagcgtattcggcattaggcaggat

SEQ ID NO: 316609 - DNA, 25 bp, Mus musculus
cagcgtattcgggattaggcaggat

SEQ ID NO: 316610 - DNA, 25 bp, Mus musculus
cagcgtcaaggaaaggctccggcct

SEQ ID NO: 316611 - DNA, 25 bp, Mus musculus
cagcgtcaaggataggctccggcct

SEQ ID NO: 316612 - DNA, 25 bp, Mus musculus
cagcgtcacattccaggtgctagtg

SEQ ID NO: 316613 - DNA, 25 bp, Mus musculus
cagcgtcacattgcaggtgctagtg

SEQ ID NO: 316614 - DNA, 25 bp, Mus musculus
cagcgtcccctcctgaagaaattgg

SEQ ID NO: 316615 - DNA, 25 bp, Mus musculus
cagcgtcccctcgtgaagaaattgg

SEQ ID NO: 316616 - DNA, 25 bp, Mus musculus
cagcgtccgacaaggtggtatttat

SEQ ID NO: 316617 - DNA, 25 bp, Mus musculus
cagcgtccgacatggtggtatttat

SEQ ID NO: 316618 - DNA, 25 bp, Mus musculus
cagcgtccggaaccgagattgtttc

SEQ ID NO: 316619 - DNA, 25 bp, Mus musculus
cagcgtccggaagcgagattgtttc

SEQ ID NO: 316620 - DNA, 25 bp, Mus musculus
cagcgtccgtagcatggactgctgt

SEQ ID NO: 316621 - DNA, 25 bp, Mus musculus
cagcgtccgtaggatggactgctgt

SEQ ID NO: 316622 - DNA, 25 bp, Mus musculus
cagcgtcctggccaaccatgggaag

SEQ ID NO: 316623 - DNA, 25 bp, Mus musculus
cagcgtcctggcgaaccatgggaag

SEQ ID NO: 316624 - DNA, 25 bp, Mus musculus
cagcgtccttcgcagcggaaggaat

SEQ ID NO: 316625 - DNA, 25 bp, Mus musculus
cagcgtccttcggagcggaaggaat

SEQ ID NO: 316626 - DNA, 25 bp, Mus musculus
cagcgtcgtcacctagtagatgtca

SEQ ID NO: 316627 - DNA, 25 bp, Mus musculus
cagcgtcgtcacgtagtagatgtca

SEQ ID NO: 316628 - DNA, 25 bp, Mus musculus
cagcgtctaataactcaagccctat

SEQ ID NO: 316629 - DNA, 25 bp, Mus musculus
cagcgtctaatatctcaagccctat

SEQ ID NO: 316630 - DNA, 25 bp, Mus musculus
cagcgtctcaagatccgactgaact

SEQ ID NO: 316631 - DNA, 25 bp, Mus musculus
cagcgtctcaagttccgactgaact

SEQ ID NO: 316632 - DNA, 25 bp, Mus musculus
cagcgtcttatcatcgctccaaaga

SEQ ID NO: 316633 - DNA, 25 bp, Mus musculus
cagcgtcttatcttcgctccaaaga

SEQ ID NO: 316634 - DNA, 25 bp, Mus musculus
cagcgtcttattccctgatgggaat

SEQ ID NO: 316635 - DNA, 25 bp, Mus musculus
cagcgtcttattgcctgatgggaat

SEQ ID NO: 316636 - DNA, 25 bp, Mus musculus
cagcgtgactgcctttttaagaatg

SEQ ID NO: 316637 - DNA, 25 bp, Mus musculus
cagcgtgactgcgtttttaagaatg

SEQ ID NO: 316638 - DNA, 25 bp, Mus musculus
cagcgtgagatgactctccacacag

SEQ ID NO: 316639 - DNA, 25 bp, Mus musculus
cagcgtgagatgtctctccacacag

SEQ ID NO: 316640 - DNA, 25 bp, Mus musculus
cagcgtgagtgtcttactttcacag

SEQ ID NO: 316641 - DNA, 25 bp, Mus musculus
cagcgtgagtgtgttactttcacag

SEQ ID NO: 316642 - DNA, 25 bp, Mus musculus
cagcgtgcaggtatggcgtatgaaa

SEQ ID NO: 316643 - DNA, 25 bp, Mus musculus
cagcgtgcaggtttggcgtatgaaa

SEQ ID NO: 316644 - DNA, 25 bp, Mus musculus
cagcgtgcatggagttggcagcaac

SEQ ID NO: 316645 - DNA, 25 bp, Mus musculus
cagcgtgcatggtgttggcagcaac

SEQ ID NO: 316646 - DNA, 25 bp, Mus musculus
cagcgtgctggaacttctcctgaaa

SEQ ID NO: 316647 - DNA, 25 bp, Mus musculus
cagcgtgctggatcttctcctgaaa

SEQ ID NO: 316648 - DNA, 25 bp, Mus musculus
cagcgtgctgtcacggaacaagtcg

SEQ ID NO: 316649 - DNA, 25 bp, Mus musculus
cagcgtgctgtctcggaacaagtcg

SEQ ID NO: 316650 - DNA, 25 bp, Mus musculus
cagcgtggagctccagcccttggat

SEQ ID NO: 316651 - DNA, 25 bp, Mus musculus
cagcgtggagctgcagcccttggat

SEQ ID NO: 316652 - DNA, 25 bp, Mus musculus
cagcgtgggattctggtcctcaaca

SEQ ID NO: 316653 - DNA, 25 bp, Mus musculus
cagcgtgggattgtggtcctcaaca

SEQ ID NO: 316654 - DNA, 25 bp, Mus musculus
cagcgtggtggtaccttatgagcca

SEQ ID NO: 316655 - DNA, 25 bp, Mus musculus
cagcgtggtggttccttatgagcca

SEQ ID NO: 316656 - DNA, 25 bp, Mus musculus
cagcgtggttgtctttctcagtgtg

SEQ ID NO: 316657 - DNA, 25 bp, Mus musculus
cagcgtggttgtgtttctcagtgtg

SEQ ID NO: 316658 - DNA, 25 bp, Mus musculus
cagcgtggttttcactgtggtccga

SEQ ID NO: 316659 - DNA, 25 bp, Mus musculus
cagcgtggttttgactgtggtccga

SEQ ID NO: 316660 - DNA, 25 bp, Mus musculus
cagcgtgtcctcatagagaccaaca

SEQ ID NO: 316661 - DNA, 25 bp, Mus musculus
cagcgtgtcctcatttccacctgtg

SEQ ID NO: 316662 - DNA, 25 bp, Mus musculus
cagcgtgtcctcttagagaccaaca

SEQ ID NO: 316663 - DNA, 25 bp, Mus musculus
cagcgtgtcctcttttccacctgtg

SEQ ID NO: 316664 - DNA, 25 bp, Mus musculus
cagcgtgtcgtacaggcacacatat

SEQ ID NO: 316665 - DNA, 25 bp, Mus musculus
cagcgtgtcgtagaggcacacatat

SEQ ID NO: 316666 - DNA, 25 bp, Mus musculus
cagcgtgtctgtcacctaagctaga

SEQ ID NO: 316667 - DNA, 25 bp, Mus musculus
cagcgtgtctgtgacctaagctaga

SEQ ID NO: 316668 - DNA, 25 bp, Mus musculus
cagcgtgtcttcagagtcaaccgaa

SEQ ID NO: 316669 - DNA, 25 bp, Mus musculus
cagcgtgtcttctgagtcaaccgaa

SEQ ID NO: 316670 - DNA, 25 bp, Mus musculus
cagcgtgtgcttccccgagaatata

SEQ ID NO: 316671 - DNA, 25 bp, Mus musculus
cagcgtgtgcttgcccgagaatata

SEQ ID NO: 316672 - DNA, 25 bp, Mus musculus
cagcgtgttacacaggcacatgtct

SEQ ID NO: 316673 - DNA, 25 bp, Mus musculus
cagcgtgttacagaggcacatgtct

SEQ ID NO: 316674 - DNA, 25 bp, Mus musculus
cagcgtgtttgccaccaaatgggtt

SEQ ID NO: 316675 - DNA, 25 bp, Mus musculus
cagcgtgtttgcgaccaaatgggtt

SEQ ID NO: 316676 - DNA, 25 bp, Mus musculus
cagcgttaagtgactttcctttatt

SEQ ID NO: 316677 - DNA, 25 bp, Mus musculus
cagcgttaagtgtctttcctttatt

SEQ ID NO: 316678 - DNA, 25 bp, Mus musculus
cagcgttcatcacctggagttcctc

SEQ ID NO: 316679 - DNA, 25 bp, Mus musculus
cagcgttcatcagctggagttcctc

SEQ ID NO: 316680 - DNA, 25 bp, Mus musculus
cagcgttcccaaagtatttccaaag

SEQ ID NO: 316681 - DNA, 25 bp, Mus musculus
cagcgttcccaatgtatttccaaag

SEQ ID NO: 316682 - DNA, 25 bp, Mus musculus
cagcgttctagactatgttctacga

SEQ ID NO: 316683 - DNA, 25 bp, Mus musculus
cagcgttctagagtatgttctacga

SEQ ID NO: 316684 - DNA, 25 bp, Mus musculus
cagcgttctgaaagcagtgtcagga

SEQ ID NO: 316685 - DNA, 25 bp, Mus musculus
cagcgttctgaatgcagtgtcagga

SEQ ID NO: 316686 - DNA, 25 bp, Mus musculus
cagcgttctgtgcagtggacaagtt

SEQ ID NO: 316687 - DNA, 25 bp, Mus musculus
cagcgttctgtggagtggacaagtt

SEQ ID NO: 316688 - DNA, 25 bp, Mus musculus
cagcgttgaacacttccttgctttt

SEQ ID NO: 316689 - DNA, 25 bp, Mus musculus
cagcgttgaacagttccttgctttt

SEQ ID NO: 316690 - DNA, 25 bp, Mus musculus
cagcgttgccaaatagcttctaatc

SEQ ID NO: 316691 - DNA, 25 bp, Mus musculus
cagcgttgccaattagcttctaatc

SEQ ID NO: 316692 - DNA, 25 bp, Mus musculus
cagcgttggaggatcacagcaaggt

SEQ ID NO: 316693 - DNA, 25 bp, Mus musculus
cagcgttggaggttcacagcaaggt

SEQ ID NO: 316694 - DNA, 25 bp, Mus musculus
cagcgtttccagcttagcagctata

SEQ ID NO: 316695 - DNA, 25 bp, Mus musculus
cagcgtttccaggttagcagctata

SEQ ID NO: 316696 - DNA, 25 bp, Mus musculus
cagcgtttcttacttcttcactaat

SEQ ID NO: 316697 - DNA, 25 bp, Mus musculus
cagcgtttcttagttcttcactaat

SEQ ID NO: 316698 - DNA, 25 bp, Mus musculus
cagcgtttgcagatgctcttaacaa

SEQ ID NO: 316699 - DNA, 25 bp, Mus musculus
cagcgtttgcagttgctcttaacaa

SEQ ID NO: 316700 - DNA, 25 bp, Mus musculus
cagcgttttaatcaattggaggtta

SEQ ID NO: 316701 - DNA, 25 bp, Mus musculus
cagcgttttaatgaattggaggtta

SEQ ID NO: 316702 - DNA, 25 bp, Mus musculus
cagcgttttaccaggccgagttgac

SEQ ID NO: 316703 - DNA, 25 bp, Mus musculus
cagcgttttacctggccgagttgac

SEQ ID NO: 316704 - DNA, 25 bp, Mus musculus
cagctaaccttccattgtgggattt

SEQ ID NO: 316705 - DNA, 25 bp, Mus musculus
cagctaaccttcgattgtgggattt

SEQ ID NO: 316706 - DNA, 25 bp, Mus musculus
cagctaacctttagccccatgacag

SEQ ID NO: 316707 - DNA, 25 bp, Mus musculus
cagctaaccttttgccccatgacag

SEQ ID NO: 316708 - DNA, 25 bp, Mus musculus
cagctaactgcactaaccccatctt

SEQ ID NO: 316709 - DNA, 25 bp, Mus musculus
cagctaactgcagtaaccccatctt

SEQ ID NO: 316710 - DNA, 25 bp, Mus musculus
cagctaagaccccaggcgtatgcca

SEQ ID NO: 316711 - DNA, 25 bp, Mus musculus
cagctaagacccgaggcgtatgcca

SEQ ID NO: 316712 - DNA, 25 bp, Mus musculus
cagctaagccagcattgcccaggaa

SEQ ID NO: 316713 - DNA, 25 bp, Mus musculus
cagctaagccaggattgcccaggaa

SEQ ID NO: 316714 - DNA, 25 bp, Mus musculus
cagctaagcctgacacctttatggg

SEQ ID NO: 316715 - DNA, 25 bp, Mus musculus
cagctaagcctgtcacctttatggg

SEQ ID NO: 316716 - DNA, 25 bp, Mus musculus
cagctaaggatgatttggttttcac

SEQ ID NO: 316717 - DNA, 25 bp, Mus musculus
cagctaaggatgttttggttttcac

SEQ ID NO: 316718 - DNA, 25 bp, Mus musculus
cagctaagtgcccaacacatgtgct

SEQ ID NO: 316719 - DNA, 25 bp, Mus musculus
cagctaagtgccgaacacatgtgct

SEQ ID NO: 316720 - DNA, 25 bp, Mus musculus
cagctacaacctcaacattgctgtg

SEQ ID NO: 316721 - DNA, 25 bp, Mus musculus
cagctacaacctgaacattgctgtg

SEQ ID NO: 316722 - DNA, 25 bp, Mus musculus
cagctacaagtacgtgcatgatgac

SEQ ID NO: 316723 - DNA, 25 bp, Mus musculus
cagctacaagtaggtgcatgatgac

SEQ ID NO: 316724 - DNA, 25 bp, Mus musculus
cagctacaccgacggttacctgcag

SEQ ID NO: 316725 - DNA, 25 bp, Mus musculus
cagctacaccgagggttacctgcag

SEQ ID NO: 316726 - DNA, 25 bp, Mus musculus
cagctacagacaaacacgcacagat

SEQ ID NO: 316727 - DNA, 25 bp, Mus musculus
cagctacagacatacacgcacagat

SEQ ID NO: 316728 - DNA, 25 bp, Mus musculus
cagctacagcggaggctacggtgct

SEQ ID NO: 316729 - DNA, 25 bp, Mus musculus
cagctacagcggtggctacggtgct

SEQ ID NO: 316730 - DNA, 25 bp, Mus musculus
cagctacagcgtacagaccatggag

SEQ ID NO: 316731 - DNA, 25 bp, Mus musculus
cagctacagcgttcagaccatggag

SEQ ID NO: 316732 - DNA, 25 bp, Mus musculus
cagctacagttgaggcctgaaggag

SEQ ID NO: 316733 - DNA, 25 bp, Mus musculus
cagctacagttgtggcctgaaggag

SEQ ID NO: 316734 - DNA, 25 bp, Mus musculus
cagctacatataagcctccttttac

SEQ ID NO: 316735 - DNA, 25 bp, Mus musculus
cagctacatatatgcctccttttac

SEQ ID NO: 316736 - DNA, 25 bp, Mus musculus
cagctacatatgcaaggcactaggt

SEQ ID NO: 316737 - DNA, 25 bp, Mus musculus
cagctacatatggaaggcactaggt

SEQ ID NO: 316738 - DNA, 25 bp, Mus musculus
cagctacatcgcctacctcatggat

SEQ ID NO: 316739 - DNA, 25 bp, Mus musculus
cagctacatcgcgtacctcatggat

SEQ ID NO: 316740 - DNA, 25 bp, Mus musculus
cagctaccaccaatgattactcata

SEQ ID NO: 316741 - DNA, 25 bp, Mus musculus
cagctaccaccattgattactcata

SEQ ID NO: 316742 - DNA, 25 bp, Mus musculus
cagctaccagggactgtttggaact

SEQ ID NO: 316743 - DNA, 25 bp, Mus musculus
cagctaccagggtctgtttggaact

SEQ ID NO: 316744 - DNA, 25 bp, Mus musculus
cagctacccatgaacttaccaagag

SEQ ID NO: 316745 - DNA, 25 bp, Mus musculus
cagctacccatgtacttaccaagag

SEQ ID NO: 316746 - DNA, 25 bp, Mus musculus
cagctacctacgacttcaagatggc

SEQ ID NO: 316747 - DNA, 25 bp, Mus musculus
cagctacctacgtcttcaagatggc

SEQ ID NO: 316748 - DNA, 25 bp, Mus musculus
cagctacctttgcacatttggcagg

SEQ ID NO: 316749 - DNA, 25 bp, Mus musculus
cagctacctttggacatttggcagg

SEQ ID NO: 316750 - DNA, 25 bp, Mus musculus
cagctactaatgaagcagagtcggg

SEQ ID NO: 316751 - DNA, 25 bp, Mus musculus
cagctactaatgtagcagagtcggg

SEQ ID NO: 316752 - DNA, 25 bp, Mus musculus
cagctactactgactgtcaaggcag

SEQ ID NO: 316753 - DNA, 25 bp, Mus musculus
cagctactactgtctgtcaaggcag

SEQ ID NO: 316754 - DNA, 25 bp, Mus musculus
cagctactctcaacgctaaggcagg

SEQ ID NO: 316755 - DNA, 25 bp, Mus musculus
cagctactctcatcgctaaggcagg

SEQ ID NO: 316756 - DNA, 25 bp, Mus musculus
cagctactgtttcactacattttag

SEQ ID NO: 316757 - DNA, 25 bp, Mus musculus
cagctactgtttgactacattttag

SEQ ID NO: 316758 - DNA, 25 bp, Mus musculus
cagctacttctaaacttttcaccaa

SEQ ID NO: 316759 - DNA, 25 bp, Mus musculus
cagctacttctatacttttcaccaa

SEQ ID NO: 316760 - DNA, 25 bp, Mus musculus
cagctacttgagacccgtgtgagag

SEQ ID NO: 316761 - DNA, 25 bp, Mus musculus
cagctacttgagtcccgtgtgagag

SEQ ID NO: 316762 - DNA, 25 bp, Mus musculus
cagctactttctataaaaacatccg

SEQ ID NO: 316763 - DNA, 25 bp, Mus musculus
cagctactttctttaaaaacatccg

SEQ ID NO: 316764 - DNA, 25 bp, Mus musculus
cagctagaagctcctgaacagatcc

SEQ ID NO: 316765 - DNA, 25 bp, Mus musculus
cagctagaagctgctgaacagatcc

SEQ ID NO: 316766 - DNA, 25 bp, Mus musculus
cagctagaagttcaaagtggataat

SEQ ID NO: 316767 - DNA, 25 bp, Mus musculus
cagctagaagttgaaagtggataat

SEQ ID NO: 316768 - DNA, 25 bp, Mus musculus
cagctagacctgagcaaagactccc

SEQ ID NO: 316769 - DNA, 25 bp, Mus musculus
cagctagacctgtgcaaagactccc

SEQ ID NO: 316770 - DNA, 25 bp, Mus musculus
cagctagacttgatagactatgttc

SEQ ID NO: 316771 - DNA, 25 bp, Mus musculus
cagctagacttgttagactatgttc

SEQ ID NO: 316772 - DNA, 25 bp, Mus musculus
cagctagagccaactaccacaaaag

SEQ ID NO: 316773 - DNA, 25 bp, Mus musculus
cagctagagccatctaccacaaaag

SEQ ID NO: 316774 - DNA, 25 bp, Mus musculus
cagctagagcctacattctgtgtac

SEQ ID NO: 316775 - DNA, 25 bp, Mus musculus
cagctagagccttcattctgtgtac

SEQ ID NO: 316776 - DNA, 25 bp, Mus musculus
cagctagagcgcagcgacaaagaga

SEQ ID NO: 316777 - DNA, 25 bp, Mus musculus
cagctagagcgctgcgacaaagaga

SEQ ID NO: 316778 - DNA, 25 bp, Mus musculus
cagctagagcttcatttttatacca

SEQ ID NO: 316779 - DNA, 25 bp, Mus musculus
cagctagagcttgatttttatacca

SEQ ID NO: 316780 - DNA, 25 bp, Mus musculus
cagctagcaacacttcctaacaggg

SEQ ID NO: 316781 - DNA, 25 bp, Mus musculus
cagctagcaacagttcctaacaggg

SEQ ID NO: 316782 - DNA, 25 bp, Mus musculus
cagctagcatctcaccttggaacta

SEQ ID NO: 316783 - DNA, 25 bp, Mus musculus
cagctagcatctgaccttggaacta

SEQ ID NO: 316784 - DNA, 25 bp, Mus musculus
cagctagccaacagcctgtaaatca

SEQ ID NO: 316785 - DNA, 25 bp, Mus musculus
cagctagccaactgcctgtaaatca

SEQ ID NO: 316786 - DNA, 25 bp, Mus musculus
cagctagctctaaattctctctgtg

SEQ ID NO: 316787 - DNA, 25 bp, Mus musculus
cagctagctctatattctctctgtg

SEQ ID NO: 316788 - DNA, 25 bp, Mus musculus
cagctaggacaacactggcttgcag

SEQ ID NO: 316789 - DNA, 25 bp, Mus musculus
cagctaggacaagactggcttgcag

SEQ ID NO: 316790 - DNA, 25 bp, Mus musculus
cagctaggattgatttatctctaac

SEQ ID NO: 316791 - DNA, 25 bp, Mus musculus
cagctaggattgttttatctctaac

SEQ ID NO: 316792 - DNA, 25 bp, Mus musculus
cagctagggattccggcactttctg

SEQ ID NO: 316793 - DNA, 25 bp, Mus musculus
cagctagggattgcggcactttctg

SEQ ID NO: 316794 - DNA, 25 bp, Mus musculus
cagctagggctgaccatggcctatg

SEQ ID NO: 316795 - DNA, 25 bp, Mus musculus
cagctagggctgtccatggcctatg

SEQ ID NO: 316796 - DNA, 25 bp, Mus musculus
cagctaggtagcaccagggactggt

SEQ ID NO: 316797 - DNA, 25 bp, Mus musculus
cagctaggtagctccagggactggt

SEQ ID NO: 316798 - DNA, 25 bp, Mus musculus
cagctagtagtacatttctgagata

SEQ ID NO: 316799 - DNA, 25 bp, Mus musculus
cagctagtagtagatttctgagata

SEQ ID NO: 316800 - DNA, 25 bp, Mus musculus
cagctagtcagtcgctgagctatga

SEQ ID NO: 316801 - DNA, 25 bp, Mus musculus
cagctagtcagtggctgagctatga

SEQ ID NO: 316802 - DNA, 25 bp, Mus musculus
cagctagtgaatccccaacataaaa

SEQ ID NO: 316803 - DNA, 25 bp, Mus musculus
cagctagtgaatgcccaacataaaa

SEQ ID NO: 316804 - DNA, 25 bp, Mus musculus
cagctagtgactcggatgcctattc

SEQ ID NO: 316805 - DNA, 25 bp, Mus musculus
cagctagtgactgggatgcctattc

SEQ ID NO: 316806 - DNA, 25 bp, Mus musculus
cagctagtgatacacctgggccagg

SEQ ID NO: 316807 - DNA, 25 bp, Mus musculus
cagctagtgatagacctgggccagg

SEQ ID NO: 316808 - DNA, 25 bp, Mus musculus
cagctagtgctgaacaatttcattc

SEQ ID NO: 316809 - DNA, 25 bp, Mus musculus
cagctagtgctgtacaatttcattc

SEQ ID NO: 316810 - DNA, 25 bp, Mus musculus
cagctagtgtctacaaggccaggtc

SEQ ID NO: 316811 - DNA, 25 bp, Mus musculus
cagctagtgtctcgagccctcggaa

SEQ ID NO: 316812 - DNA, 25 bp, Mus musculus
cagctagtgtctggagccctcggaa

SEQ ID NO: 316813 - DNA, 25 bp, Mus musculus
cagctagtgtcttcaaggccaggtc

SEQ ID NO: 316814 - DNA, 25 bp, Mus musculus
cagctagtgtggataatcttggcaa

SEQ ID NO: 316815 - DNA, 25 bp, Mus musculus
cagctagtgtggttaatcttggcaa

SEQ ID NO: 316816 - DNA, 25 bp, Mus musculus
cagctagtgttacttcaccagtttt

SEQ ID NO: 316817 - DNA, 25 bp, Mus musculus
cagctagtgttagttcaccagtttt

SEQ ID NO: 316818 - DNA, 25 bp, Mus musculus
cagctagttactatggctattgaca

SEQ ID NO: 316819 - DNA, 25 bp, Mus musculus
cagctagttactttggctattgaca

SEQ ID NO: 316820 - DNA, 25 bp, Mus musculus
cagctagttcaaaagcaggccacat

SEQ ID NO: 316821 - DNA, 25 bp, Mus musculus
cagctagttcaactcagagcacaca

SEQ ID NO: 316822 - DNA, 25 bp, Mus musculus
cagctagttcaagtcagagcacaca

SEQ ID NO: 316823 - DNA, 25 bp, Mus musculus
cagctagttcaatagcaggccacat

SEQ ID NO: 316824 - DNA, 25 bp, Mus musculus
cagctataagctatctgggcagaga

SEQ ID NO: 316825 - DNA, 25 bp, Mus musculus
cagctataagctttctgggcagaga

SEQ ID NO: 316826 - DNA, 25 bp, Mus musculus
cagctataccctcggagggcactca

SEQ ID NO: 316827 - DNA, 25 bp, Mus musculus
cagctataccctgggagggcactca

SEQ ID NO: 316828 - DNA, 25 bp, Mus musculus
cagctatacgtcctcagagctgggt

SEQ ID NO: 316829 - DNA, 25 bp, Mus musculus
cagctatacgtcgtcagagctgggt

SEQ ID NO: 316830 - DNA, 25 bp, Mus musculus
cagctatagctgcatgatggagaaa

SEQ ID NO: 316831 - DNA, 25 bp, Mus musculus
cagctatagctggatgatggagaaa

SEQ ID NO: 316832 - DNA, 25 bp, Mus musculus
cagctatagtgaatcctggtcttat

SEQ ID NO: 316833 - DNA, 25 bp, Mus musculus
cagctatagtgattcctggtcttat

SEQ ID NO: 316834 - DNA, 25 bp, Mus musculus
cagctatatctaccctggaggccaa

SEQ ID NO: 316835 - DNA, 25 bp, Mus musculus
cagctatatctagcctggaggccaa

SEQ ID NO: 316836 - DNA, 25 bp, Mus musculus
cagctatccgtacacgttccgaggg

SEQ ID NO: 316837 - DNA, 25 bp, Mus musculus
cagctatccgtagacgttccgaggg

SEQ ID NO: 316838 - DNA, 25 bp, Mus musculus
cagctatctcaaattttattgtttg

SEQ ID NO: 316839 - DNA, 25 bp, Mus musculus
cagctatctcaatttttattgtttg

SEQ ID NO: 316840 - DNA, 25 bp, Mus musculus
cagctatctccgcaacagggcagtt

SEQ ID NO: 316841 - DNA, 25 bp, Mus musculus
cagctatctccggaacagggcagtt

SEQ ID NO: 316842 - DNA, 25 bp, Mus musculus
cagctatgctgaagtgaccttcctt

SEQ ID NO: 316843 - DNA, 25 bp, Mus musculus
cagctatgctgatgtgaccttcctt

SEQ ID NO: 316844 - DNA, 25 bp, Mus musculus
cagctatgctgcagcagagggcaca

SEQ ID NO: 316845 - DNA, 25 bp, Mus musculus
cagctatgctgctgcagagggcaca

SEQ ID NO: 316846 - DNA, 25 bp, Mus musculus
cagctatgtgtgcacgccgtgtgat

SEQ ID NO: 316847 - DNA, 25 bp, Mus musculus
cagctatgtgtggacgccgtgtgat

SEQ ID NO: 316848 - DNA, 25 bp, Mus musculus
cagctattgacactgatgcagtatg

SEQ ID NO: 316849 - DNA, 25 bp, Mus musculus
cagctattgacagtgatgcagtatg

SEQ ID NO: 316850 - DNA, 25 bp, Mus musculus
cagctattgcttagtgatcaggagt

SEQ ID NO: 316851 - DNA, 25 bp, Mus musculus
cagctattgctttgtgatcaggagt

SEQ ID NO: 316852 - DNA, 25 bp, Mus musculus
cagctattggctactggagagaggc

SEQ ID NO: 316853 - DNA, 25 bp, Mus musculus
cagctattggcttctggagagaggc

SEQ ID NO: 316854 - DNA, 25 bp, Mus musculus
cagctatttgtaacccttcctcagc

SEQ ID NO: 316855 - DNA, 25 bp, Mus musculus
cagctatttgtatcccttcctcagc

SEQ ID NO: 316856 - DNA, 25 bp, Mus musculus
cagctatttttgaacataggtaata

SEQ ID NO: 316857 - DNA, 25 bp, Mus musculus
cagctatttttgcactgtcaatttt

SEQ ID NO: 316858 - DNA, 25 bp, Mus musculus
cagctatttttggactgtcaatttt

SEQ ID NO: 316859 - DNA, 25 bp, Mus musculus
cagctatttttgtacataggtaata

SEQ ID NO: 316860 - DNA, 25 bp, Mus musculus
cagctcaaagagcaccttaggtggt

SEQ ID NO: 316861 - DNA, 25 bp, Mus musculus
cagctcaaagaggaccttaggtggt

SEQ ID NO: 316862 - DNA, 25 bp, Mus musculus
cagctcaaagccatgtcttactggg

SEQ ID NO: 316863 - DNA, 25 bp, Mus musculus
cagctcaaagccttgtcttactggg

SEQ ID NO: 316864 - DNA, 25 bp, Mus musculus
cagctcaaagctaatcttgccacac

SEQ ID NO: 316865 - DNA, 25 bp, Mus musculus
cagctcaaagcttatcttgccacac

SEQ ID NO: 316866 - DNA, 25 bp, Mus musculus
cagctcaactccagttttcagtgta

SEQ ID NO: 316867 - DNA, 25 bp, Mus musculus
cagctcaactcctgttttcagtgta

SEQ ID NO: 316868 - DNA, 25 bp, Mus musculus
cagctcaagctgcagatgtagttct

SEQ ID NO: 316869 - DNA, 25 bp, Mus musculus
cagctcaagctggagatgtagttct

SEQ ID NO: 316870 - DNA, 25 bp, Mus musculus
cagctcaaggagcatgtgcaaagtc

SEQ ID NO: 316871 - DNA, 25 bp, Mus musculus
cagctcaaggaggatgtgcaaagtc

SEQ ID NO: 316872 - DNA, 25 bp, Mus musculus
cagctcaaggcgagaccaggaattt

SEQ ID NO: 316873 - DNA, 25 bp, Mus musculus
cagctcaaggcgtgaccaggaattt

SEQ ID NO: 316874 - DNA, 25 bp, Mus musculus
cagctcaaggtaccagtgccactgt

SEQ ID NO: 316875 - DNA, 25 bp, Mus musculus
cagctcaaggtagcagtgccactgt

SEQ ID NO: 316876 - DNA, 25 bp, Mus musculus
cagctcaatgaaaggtgtccctttt

SEQ ID NO: 316877 - DNA, 25 bp, Mus musculus
cagctcaatgaatggtgtccctttt

SEQ ID NO: 316878 - DNA, 25 bp, Mus musculus
cagctcacaaacacattagccatct

SEQ ID NO: 316879 - DNA, 25 bp, Mus musculus
cagctcacaaacacgggcagttgca

SEQ ID NO: 316880 - DNA, 25 bp, Mus musculus
cagctcacaaactcattagccatct

SEQ ID NO: 316881 - DNA, 25 bp, Mus musculus
cagctcacaaactcgggcagttgca

SEQ ID NO: 316882 - DNA, 25 bp, Mus musculus
cagctcacagcgctatgatgggtat

SEQ ID NO: 316883 - DNA, 25 bp, Mus musculus
cagctcacagcggtatgatgggtat

SEQ ID NO: 316884 - DNA, 25 bp, Mus musculus
cagctcacagtccttgaaccagaac

SEQ ID NO: 316885 - DNA, 25 bp, Mus musculus
cagctcacagtcgttgaaccagaac

SEQ ID NO: 316886 - DNA, 25 bp, Mus musculus
cagctcacccgacccttgttgtaat

SEQ ID NO: 316887 - DNA, 25 bp, Mus musculus
cagctcacccgagccttgttgtaat

SEQ ID NO: 316888 - DNA, 25 bp, Mus musculus
cagctcactcggcaggaaatcgttg

SEQ ID NO: 316889 - DNA, 25 bp, Mus musculus
cagctcactcgggaggaaatcgttg

SEQ ID NO: 316890 - DNA, 25 bp, Mus musculus
cagctcactgagagtcatatgtgga

SEQ ID NO: 316891 - DNA, 25 bp, Mus musculus
cagctcactgagtgtcatatgtgga

SEQ ID NO: 316892 - DNA, 25 bp, Mus musculus
cagctcagacttaactgaagaattc

SEQ ID NO: 316893 - DNA, 25 bp, Mus musculus
cagctcagactttactgaagaattc

SEQ ID NO: 316894 - DNA, 25 bp, Mus musculus
cagctcagccttatgtgtctcacag

SEQ ID NO: 316895 - DNA, 25 bp, Mus musculus
cagctcagccttttgtgtctcacag

SEQ ID NO: 316896 - DNA, 25 bp, Mus musculus
cagctcaggatcactgttacctttt

SEQ ID NO: 316897 - DNA, 25 bp, Mus musculus
cagctcaggatccacctcggaatca

SEQ ID NO: 316898 - DNA, 25 bp, Mus musculus
cagctcaggatcgacctcggaatca

SEQ ID NO: 316899 - DNA, 25 bp, Mus musculus
cagctcaggatctctgttacctttt

SEQ ID NO: 316900 - DNA, 25 bp, Mus musculus
cagctcaggcctcttcattatactg

SEQ ID NO: 316901 - DNA, 25 bp, Mus musculus
cagctcaggcctgttcattatactg

SEQ ID NO: 316902 - DNA, 25 bp, Mus musculus
cagctcagggacacctgttgggatt

SEQ ID NO: 316903 - DNA, 25 bp, Mus musculus
cagctcagggactcctgttgggatt

SEQ ID NO: 316904 - DNA, 25 bp, Mus musculus
cagctcatagccaccctgaagaatg

SEQ ID NO: 316905 - DNA, 25 bp, Mus musculus
cagctcatagcctccctgaagaatg

SEQ ID NO: 316906 - DNA, 25 bp, Mus musculus
cagctcatatataataacgttccta

SEQ ID NO: 316907 - DNA, 25 bp, Mus musculus
cagctcatatattataacgttccta

SEQ ID NO: 316908 - DNA, 25 bp, Mus musculus
cagctcatcacaatgggtccacagg

SEQ ID NO: 316909 - DNA, 25 bp, Mus musculus
cagctcatcacattgggtccacagg

SEQ ID NO: 316910 - DNA, 25 bp, Mus musculus
cagctcatctgcacttaggttatcg

SEQ ID NO: 316911 - DNA, 25 bp, Mus musculus
cagctcatctgctcttaggttatcg

SEQ ID NO: 316912 - DNA, 25 bp, Mus musculus
cagctcatgtttcctgttcacaggg

SEQ ID NO: 316913 - DNA, 25 bp, Mus musculus
cagctcatgtttgctgttcacaggg

SEQ ID NO: 316914 - DNA, 25 bp, Mus musculus
cagctccaaaatcctgtggaacaaa

SEQ ID NO: 316915 - DNA, 25 bp, Mus musculus
cagctccaaaatgctgtggaacaaa

SEQ ID NO: 316916 - DNA, 25 bp, Mus musculus
cagctccaagataatcagaaaaagg

SEQ ID NO: 316917 - DNA, 25 bp, Mus musculus
cagctccaagattatcagaaaaagg

SEQ ID NO: 316918 - DNA, 25 bp, Mus musculus
cagctccaagtgcacagaccttaaa

SEQ ID NO: 316919 - DNA, 25 bp, Mus musculus
cagctccaagtgcaggcggaacaag

SEQ ID NO: 316920 - DNA, 25 bp, Mus musculus
cagctccaagtggacagaccttaaa

SEQ ID NO: 316921 - DNA, 25 bp, Mus musculus
cagctccaagtggaggcggaacaag

SEQ ID NO: 316922 - DNA, 25 bp, Mus musculus
cagctccacatgattctagttaata

SEQ ID NO: 316923 - DNA, 25 bp, Mus musculus
cagctccacatgtttctagttaata

SEQ ID NO: 316924 - DNA, 25 bp, Mus musculus
cagctccacccgaatttaaaatcag

SEQ ID NO: 316925 - DNA, 25 bp, Mus musculus
cagctccacccgtatttaaaatcag

SEQ ID NO: 316926 - DNA, 25 bp, Mus musculus
cagctccagaatagggtgattccca

SEQ ID NO: 316927 - DNA, 25 bp, Mus musculus
cagctccagaattgggtgattccca

SEQ ID NO: 316928 - DNA, 25 bp, Mus musculus
cagctccagagtacgtctttgaaca

SEQ ID NO: 316929 - DNA, 25 bp, Mus musculus
cagctccagagttcgtctttgaaca

SEQ ID NO: 316930 - DNA, 25 bp, Mus musculus
cagctccagatgacaggcagtgcgt

SEQ ID NO: 316931 - DNA, 25 bp, Mus musculus
cagctccagatgtcaggcagtgcgt

SEQ ID NO: 316932 - DNA, 25 bp, Mus musculus
cagctccagggcctctgagagctct

SEQ ID NO: 316933 - DNA, 25 bp, Mus musculus
cagctccagggcgtctgagagctct

SEQ ID NO: 316934 - DNA, 25 bp, Mus musculus
cagctccaggtgaaactcctttaga

SEQ ID NO: 316935 - DNA, 25 bp, Mus musculus
cagctccaggtgtaactcctttaga

SEQ ID NO: 316936 - DNA, 25 bp, Mus musculus
cagctccagtggcagagggacacat

SEQ ID NO: 316937 - DNA, 25 bp, Mus musculus
cagctccagtgggagagggacacat

SEQ ID NO: 316938 - DNA, 25 bp, Mus musculus
cagctccattacaggcagagagggc

SEQ ID NO: 316939 - DNA, 25 bp, Mus musculus
cagctccattactggcagagagggc

SEQ ID NO: 316940 - DNA, 25 bp, Mus musculus
cagctccattctcagttgtgaaggg

SEQ ID NO: 316941 - DNA, 25 bp, Mus musculus
cagctccattctgagttgtgaaggg

SEQ ID NO: 316942 - DNA, 25 bp, Mus musculus
cagctcccagacacgtactaagtgc

SEQ ID NO: 316943 - DNA, 25 bp, Mus musculus
cagctcccagactcgtactaagtgc

SEQ ID NO: 316944 - DNA, 25 bp, Mus musculus
cagctcccagggatatttttctaag

SEQ ID NO: 316945 - DNA, 25 bp, Mus musculus
cagctcccagggttatttttctaag

SEQ ID NO: 316946 - DNA, 25 bp, Mus musculus
cagctcccagtgaactgctaggaag

SEQ ID NO: 316947 - DNA, 25 bp, Mus musculus
cagctcccagtgtactgctaggaag

SEQ ID NO: 316948 - DNA, 25 bp, Mus musculus
cagctcccatcaaaccaacgtgaat

SEQ ID NO: 316949 - DNA, 25 bp, Mus musculus
cagctcccatcataccaacgtgaat

SEQ ID NO: 316950 - DNA, 25 bp, Mus musculus
cagctcccatggatggtaccggtgg

SEQ ID NO: 316951 - DNA, 25 bp, Mus musculus
cagctcccatggttggtaccggtgg

SEQ ID NO: 316952 - DNA, 25 bp, Mus musculus
cagctcccctgaattctctgctgta

SEQ ID NO: 316953 - DNA, 25 bp, Mus musculus
cagctcccctgatttctctgctgta

SEQ ID NO: 316954 - DNA, 25 bp, Mus musculus
cagctcccgggaagttttcattgtg

SEQ ID NO: 316955 - DNA, 25 bp, Mus musculus
cagctcccgggatgttttcattgtg

SEQ ID NO: 316956 - DNA, 25 bp, Mus musculus
cagctcccgtgtcaacagtttgtgt

SEQ ID NO: 316957 - DNA, 25 bp, Mus musculus
cagctcccgtgtgaacagtttgtgt

SEQ ID NO: 316958 - DNA, 25 bp, Mus musculus
cagctccctctgatgctagtaataa

SEQ ID NO: 316959 - DNA, 25 bp, Mus musculus
cagctccctctgttgctagtaataa

SEQ ID NO: 316960 - DNA, 25 bp, Mus musculus
cagctccctgtgctagtccagattc

SEQ ID NO: 316961 - DNA, 25 bp, Mus musculus
cagctccctgtggtagtccagattc

SEQ ID NO: 316962 - DNA, 25 bp, Mus musculus
cagctccgcactcttcattatatgt

SEQ ID NO: 316963 - DNA, 25 bp, Mus musculus
cagctccgcactgttcattatatgt

SEQ ID NO: 316964 - DNA, 25 bp, Mus musculus
cagctccggattcattcctttttta

SEQ ID NO: 316965 - DNA, 25 bp, Mus musculus
cagctccggattgattcctttttta

SEQ ID NO: 316966 - DNA, 25 bp, Mus musculus
cagctccggtgtagtgtgtatttct

SEQ ID NO: 316967 - DNA, 25 bp, Mus musculus
cagctccggtgttgtgtgtatttct

SEQ ID NO: 316968 - DNA, 25 bp, Mus musculus
cagctccgtttacaactctaacaga

SEQ ID NO: 316969 - DNA, 25 bp, Mus musculus
cagctccgtttagaactctaacaga

SEQ ID NO: 316970 - DNA, 25 bp, Mus musculus
cagctcctaatgaaatggtttacag

SEQ ID NO: 316971 - DNA, 25 bp, Mus musculus
cagctcctaatgtaatggtttacag

SEQ ID NO: 316972 - DNA, 25 bp, Mus musculus
cagctcctacccaagttctttaatt

SEQ ID NO: 316973 - DNA, 25 bp, Mus musculus
cagctcctaccctagttctttaatt

SEQ ID NO: 316974 - DNA, 25 bp, Mus musculus
cagctcctaggccttctataaggaa

SEQ ID NO: 316975 - DNA, 25 bp, Mus musculus
cagctcctaggcgttctataaggaa

SEQ ID NO: 316976 - DNA, 25 bp, Mus musculus
cagctcctagttcatatatttgata

SEQ ID NO: 316977 - DNA, 25 bp, Mus musculus
cagctcctagttgatatatttgata

SEQ ID NO: 316978 - DNA, 25 bp, Mus musculus
cagctcctatatatgtttccccttt

SEQ ID NO: 316979 - DNA, 25 bp, Mus musculus
cagctcctatatttgtttccccttt

SEQ ID NO: 316980 - DNA, 25 bp, Mus musculus
cagctcctcaccaggctcgggagtt

SEQ ID NO: 316981 - DNA, 25 bp, Mus musculus
cagctcctcacctggctcgggagtt

SEQ ID NO: 316982 - DNA, 25 bp, Mus musculus
cagctcctccggaagagcagcagtg

SEQ ID NO: 316983 - DNA, 25 bp, Mus musculus
cagctcctccggtagagcagcagtg

SEQ ID NO: 316984 - DNA, 25 bp, Mus musculus
cagctcctcctgagtaaacaaactt

SEQ ID NO: 316985 - DNA, 25 bp, Mus musculus
cagctcctcctgtgtaaacaaactt

SEQ ID NO: 316986 - DNA, 25 bp, Mus musculus
cagctcctgatcacaagaacactaa

SEQ ID NO: 316987 - DNA, 25 bp, Mus musculus
cagctcctgatctcaagaacactaa

SEQ ID NO: 316988 - DNA, 25 bp, Mus musculus
cagctcctgcagcacaaggattcct

SEQ ID NO: 316989 - DNA, 25 bp, Mus musculus
cagctcctgcaggacaaggattcct

SEQ ID NO: 316990 - DNA, 25 bp, Mus musculus
cagctcctgccaaaactgtagcatt

SEQ ID NO: 316991 - DNA, 25 bp, Mus musculus
cagctcctgccataactgtagcatt

SEQ ID NO: 316992 - DNA, 25 bp, Mus musculus
cagctcctgcgcatctatatattat

SEQ ID NO: 316993 - DNA, 25 bp, Mus musculus
cagctcctgcgcttctatatattat

SEQ ID NO: 316994 - DNA, 25 bp, Mus musculus
cagctcctggtcaataatgcaaaaa

SEQ ID NO: 316995 - DNA, 25 bp, Mus musculus
cagctcctggtcaatgctgcaacaa

SEQ ID NO: 316996 - DNA, 25 bp, Mus musculus
cagctcctggtctataatgcaaaaa

SEQ ID NO: 316997 - DNA, 25 bp, Mus musculus
cagctcctggtctatgctgcaacaa

SEQ ID NO: 316998 - DNA, 25 bp, Mus musculus
cagctcctgtctcccaactatatag

SEQ ID NO: 316999 - DNA, 25 bp, Mus musculus
cagctcctgtctgccaactatatag

SEQ ID NO: 317000 - DNA, 25 bp, Mus musculus
cagctcctgtgtctggttacagtgc

SEQ ID NO: 317001 - DNA, 25 bp, Mus musculus
cagctcctgtgtgtggttacagtgc

SEQ ID NO: 317002 - DNA, 25 bp, Mus musculus
cagctccttactatacctggataaa

SEQ ID NO: 317003 - DNA, 25 bp, Mus musculus
cagctccttactctagcatctgtga

SEQ ID NO: 317004 - DNA, 25 bp, Mus musculus
cagctccttactgtagcatctgtga

SEQ ID NO: 317005 - DNA, 25 bp, Mus musculus
cagctccttactttacctggataaa

SEQ ID NO: 317006 - DNA, 25 bp, Mus musculus
cagctccttagcattgagaggcagc

SEQ ID NO: 317007 - DNA, 25 bp, Mus musculus
cagctccttagctttgagaggcagc

SEQ ID NO: 317008 - DNA, 25 bp, Mus musculus
cagctccttcagaacgtgggagcaa

SEQ ID NO: 317009 - DNA, 25 bp, Mus musculus
cagctccttcagtacgtgggagcaa

SEQ ID NO: 317010 - DNA, 25 bp, Mus musculus
cagctccttgaacaccttcgaaaaa

SEQ ID NO: 317011 - DNA, 25 bp, Mus musculus
cagctccttgaagaccttcgaaaaa

SEQ ID NO: 317012 - DNA, 25 bp, Mus musculus
cagctccttgacctgtttatggttt

SEQ ID NO: 317013 - DNA, 25 bp, Mus musculus
cagctccttgacgtgtttatggttt

SEQ ID NO: 317014 - DNA, 25 bp, Mus musculus
cagctccttgagacatacttttaaa

SEQ ID NO: 317015 - DNA, 25 bp, Mus musculus
cagctccttgagtcatacttttaaa

SEQ ID NO: 317016 - DNA, 25 bp, Mus musculus
cagctccttgctcgaacacgggagt

SEQ ID NO: 317017 - DNA, 25 bp, Mus musculus
cagctccttgctggaacacgggagt

SEQ ID NO: 317018 - DNA, 25 bp, Mus musculus
cagctccttgtcaccgagagataga

SEQ ID NO: 317019 - DNA, 25 bp, Mus musculus
cagctccttgtctccgagagataga

SEQ ID NO: 317020 - DNA, 25 bp, Mus musculus
cagctccttgtgctctgatgattgt

SEQ ID NO: 317021 - DNA, 25 bp, Mus musculus
cagctccttgtggtctgatgattgt

SEQ ID NO: 317022 - DNA, 25 bp, Mus musculus
cagctcgaaacaaacttagaaatct

SEQ ID NO: 317023 - DNA, 25 bp, Mus musculus
cagctcgaaacatacttagaaatct

SEQ ID NO: 317024 - DNA, 25 bp, Mus musculus
cagctcgaaatacctactatgtttg

SEQ ID NO: 317025 - DNA, 25 bp, Mus musculus
cagctcgaaatagctactatgtttg

SEQ ID NO: 317026 - DNA, 25 bp, Mus musculus
cagctcgacggcaacgggagcaaca

SEQ ID NO: 317027 - DNA, 25 bp, Mus musculus
cagctcgacggctacgggagcaaca

SEQ ID NO: 317028 - DNA, 25 bp, Mus musculus
cagctcgagagcctgcatctaaaat

SEQ ID NO: 317029 - DNA, 25 bp, Mus musculus
cagctcgagagcgtgcatctaaaat

SEQ ID NO: 317030 - DNA, 25 bp, Mus musculus
cagctcgagcgaagaatgtggaccc

SEQ ID NO: 317031 - DNA, 25 bp, Mus musculus
cagctcgagcgatgaatgtggaccc

SEQ ID NO: 317032 - DNA, 25 bp, Mus musculus
cagctcgagcgccaagatcgtgaag

SEQ ID NO: 317033 - DNA, 25 bp, Mus musculus
cagctcgagcgcgaagatcgtgaag

SEQ ID NO: 317034 - DNA, 25 bp, Mus musculus
cagctcgctggtatgtgtgcaacaa

SEQ ID NO: 317035 - DNA, 25 bp, Mus musculus
cagctcgctggtttgtgtgcaacaa

SEQ ID NO: 317036 - DNA, 25 bp, Mus musculus
cagctcgggactcagtgcaagtaca

SEQ ID NO: 317037 - DNA, 25 bp, Mus musculus
cagctcgggactgagtgcaagtaca

SEQ ID NO: 317038 - DNA, 25 bp, Mus musculus
cagctcgggagacagaaagcccagt

SEQ ID NO: 317039 - DNA, 25 bp, Mus musculus
cagctcgggagagagaaagcccagt

SEQ ID NO: 317040 - DNA, 25 bp, Mus musculus
cagctcgggctgagagaccatacaa

SEQ ID NO: 317041 - DNA, 25 bp, Mus musculus
cagctcgggctgtgagaccatacaa

SEQ ID NO: 317042 - DNA, 25 bp, Mus musculus
cagctcgtcaccatgaactcccttc

SEQ ID NO: 317043 - DNA, 25 bp, Mus musculus
cagctcgtcaccttgaactcccttc

SEQ ID NO: 317044 - DNA, 25 bp, Mus musculus
cagctcgtcgtcctcggaagatgaa

SEQ ID NO: 317045 - DNA, 25 bp, Mus musculus
cagctcgtcgtcgtcggaagatgaa

SEQ ID NO: 317046 - DNA, 25 bp, Mus musculus
cagctcgtgcaaactggttacacag

SEQ ID NO: 317047 - DNA, 25 bp, Mus musculus
cagctcgtgcaatctggttacacag

SEQ ID NO: 317048 - DNA, 25 bp, Mus musculus
cagctcgtggatagtctctttctaa

SEQ ID NO: 317049 - DNA, 25 bp, Mus musculus
cagctcgtggattgtctctttctaa

SEQ ID NO: 317050 - DNA, 25 bp, Mus musculus
cagctcgtggctcgagtgaactatt

SEQ ID NO: 317051 - DNA, 25 bp, Mus musculus
cagctcgtggctggagtgaactatt

SEQ ID NO: 317052 - DNA, 25 bp, Mus musculus
cagctctaagacagttctaggccac

SEQ ID NO: 317053 - DNA, 25 bp, Mus musculus
cagctctaagactgttctaggccac

SEQ ID NO: 317054 - DNA, 25 bp, Mus musculus
cagctctactgtcatcctaatgcgt

SEQ ID NO: 317055 - DNA, 25 bp, Mus musculus
cagctctactgtgatcctaatgcgt

SEQ ID NO: 317056 - DNA, 25 bp, Mus musculus
cagctctatcatactggaatcctgg

SEQ ID NO: 317057 - DNA, 25 bp, Mus musculus
cagctctatcattctggaatcctgg

SEQ ID NO: 317058 - DNA, 25 bp, Mus musculus
cagctctatctcatcaactcattga

SEQ ID NO: 317059 - DNA, 25 bp, Mus musculus
cagctctatctcttcaactcattga

SEQ ID NO: 317060 - DNA, 25 bp, Mus musculus
cagctctattgtcttgttcctatga

SEQ ID NO: 317061 - DNA, 25 bp, Mus musculus
cagctctattgtgttgttcctatga

SEQ ID NO: 317062 - DNA, 25 bp, Mus musculus
cagctctcaaagaacagtggcatct

SEQ ID NO: 317063 - DNA, 25 bp, Mus musculus
cagctctcaaagactgcttttcagt

SEQ ID NO: 317064 - DNA, 25 bp, Mus musculus
cagctctcaaagtacagtggcatct

SEQ ID NO: 317065 - DNA, 25 bp, Mus musculus
cagctctcaaagtctgcttttcagt

SEQ ID NO: 317066 - DNA, 25 bp, Mus musculus
cagctctcaactctgttcatcaaac

SEQ ID NO: 317067 - DNA, 25 bp, Mus musculus
cagctctcaactgtgttcatcaaac

SEQ ID NO: 317068 - DNA, 25 bp, Mus musculus
cagctctcagaaatcctcagaaatc

SEQ ID NO: 317069 - DNA, 25 bp, Mus musculus
cagctctcagaattcctcagaaatc

SEQ ID NO: 317070 - DNA, 25 bp, Mus musculus
cagctctcatgaaggttgtggctta

SEQ ID NO: 317071 - DNA, 25 bp, Mus musculus
cagctctcatgatggttgtggctta

SEQ ID NO: 317072 - DNA, 25 bp, Mus musculus
cagctctccaagctgggtcagtttt

SEQ ID NO: 317073 - DNA, 25 bp, Mus musculus
cagctctccaaggtgggtcagtttt

SEQ ID NO: 317074 - DNA, 25 bp, Mus musculus
cagctctcctaacttattcatgtgg

SEQ ID NO: 317075 - DNA, 25 bp, Mus musculus
cagctctcctaagttattcatgtgg

SEQ ID NO: 317076 - DNA, 25 bp, Mus musculus
cagctctcctacaatgtgttaacaa

SEQ ID NO: 317077 - DNA, 25 bp, Mus musculus
cagctctcctactatgtgttaacaa

SEQ ID NO: 317078 - DNA, 25 bp, Mus musculus
cagctctctagaagcttcttatgag

SEQ ID NO: 317079 - DNA, 25 bp, Mus musculus
cagctctctagatgcttcttatgag

SEQ ID NO: 317080 - DNA, 25 bp, Mus musculus
cagctctctgctcagttggtgaaca

SEQ ID NO: 317081 - DNA, 25 bp, Mus musculus
cagctctctgctgagttggtgaaca

SEQ ID NO: 317082 - DNA, 25 bp, Mus musculus
cagctctcttcaagtactgggagct

SEQ ID NO: 317083 - DNA, 25 bp, Mus musculus
cagctctcttcatgtactgggagct

SEQ ID NO: 317084 - DNA, 25 bp, Mus musculus
cagctctgaaatccccatggaggca

SEQ ID NO: 317085 - DNA, 25 bp, Mus musculus
cagctctgaaatgcccatggaggca

SEQ ID NO: 317086 - DNA, 25 bp, Mus musculus
cagctctgaacacagttgctctcag

SEQ ID NO: 317087 - DNA, 25 bp, Mus musculus
cagctctgaacagagttgctctcag

SEQ ID NO: 317088 - DNA, 25 bp, Mus musculus
cagctctgaggacatcagtcctaca

SEQ ID NO: 317089 - DNA, 25 bp, Mus musculus
cagctctgaggagatcagtcctaca

SEQ ID NO: 317090 - DNA, 25 bp, Mus musculus
cagctctgcacgcaggactggagca

SEQ ID NO: 317091 - DNA, 25 bp, Mus musculus
cagctctgcacggaggactggagca

SEQ ID NO: 317092 - DNA, 25 bp, Mus musculus
cagctctgcaggaaactccccaggg

SEQ ID NO: 317093 - DNA, 25 bp, Mus musculus
cagctctgcaggtaactccccaggg

SEQ ID NO: 317094 - DNA, 25 bp, Mus musculus
cagctctgcccgctgtggaagaagc

SEQ ID NO: 317095 - DNA, 25 bp, Mus musculus
cagctctgcccggtgtggaagaagc

SEQ ID NO: 317096 - DNA, 25 bp, Mus musculus
cagctctgccttacagaggttgcat

SEQ ID NO: 317097 - DNA, 25 bp, Mus musculus
cagctctgcctttcagaggttgcat

SEQ ID NO: 317098 - DNA, 25 bp, Mus musculus
cagctctgcgtacctggaatggaca

SEQ ID NO: 317099 - DNA, 25 bp, Mus musculus
cagctctgcgtagctggaatggaca

SEQ ID NO: 317100 - DNA, 25 bp, Mus musculus
cagctctgcgtgaccatcgaggagt

SEQ ID NO: 317101 - DNA, 25 bp, Mus musculus
cagctctgcgtgtccatcgaggagt

SEQ ID NO: 317102 - DNA, 25 bp, Mus musculus
cagctctggatcataatggcatcta

SEQ ID NO: 317103 - DNA, 25 bp, Mus musculus
cagctctggatcttaatggcatcta

SEQ ID NO: 317104 - DNA, 25 bp, Mus musculus
cagctctggctgcttactttgtatg

SEQ ID NO: 317105 - DNA, 25 bp, Mus musculus
cagctctggctggttactttgtatg

SEQ ID NO: 317106 - DNA, 25 bp, Mus musculus
cagctctgggagaggacatcgtgaa

SEQ ID NO: 317107 - DNA, 25 bp, Mus musculus
cagctctgggagtggacatcgtgaa

SEQ ID NO: 317108 - DNA, 25 bp, Mus musculus
cagctctgggttaggtgagaagcac

SEQ ID NO: 317109 - DNA, 25 bp, Mus musculus
cagctctgggtttggtgagaagcac

SEQ ID NO: 317110 - DNA, 25 bp, Mus musculus
cagctctggtctctgtattttcacc

SEQ ID NO: 317111 - DNA, 25 bp, Mus musculus
cagctctggtctgtgtattttcacc

SEQ ID NO: 317112 - DNA, 25 bp, Mus musculus
cagctctgtactcaggtcttgcact

SEQ ID NO: 317113 - DNA, 25 bp, Mus musculus
cagctctgtactgaggtcttgcact

SEQ ID NO: 317114 - DNA, 25 bp, Mus musculus
cagctctgtagcatggtggagtcct

SEQ ID NO: 317115 - DNA, 25 bp, Mus musculus
cagctctgtagcttggtggagtcct

SEQ ID NO: 317116 - DNA, 25 bp, Mus musculus
cagctctgtaggaggagaaggactc

SEQ ID NO: 317117 - DNA, 25 bp, Mus musculus
cagctctgtaggtggagaaggactc

SEQ ID NO: 317118 - DNA, 25 bp, Mus musculus
cagctctgtgatccattattgaatt

SEQ ID NO: 317119 - DNA, 25 bp, Mus musculus
cagctctgtgatgcattattgaatt

SEQ ID NO: 317120 - DNA, 25 bp, Mus musculus
cagctctgtgctctggtacgagacc

SEQ ID NO: 317121 - DNA, 25 bp, Mus musculus
cagctctgtgctgtggtacgagacc

SEQ ID NO: 317122 - DNA, 25 bp, Mus musculus
cagctctgtttgacttgaggacaca

SEQ ID NO: 317123 - DNA, 25 bp, Mus musculus
cagctctgtttgtcttgaggacaca

SEQ ID NO: 317124 - DNA, 25 bp, Mus musculus
cagctcttactgacatgtctttgtt

SEQ ID NO: 317125 - DNA, 25 bp, Mus musculus
cagctcttactgtcatgtctttgtt

SEQ ID NO: 317126 - DNA, 25 bp, Mus musculus
cagctcttacttcttttgacttgaa

SEQ ID NO: 317127 - DNA, 25 bp, Mus musculus
cagctcttacttgttttgacttgaa

SEQ ID NO: 317128 - DNA, 25 bp, Mus musculus
cagctcttagctatcttttgggatt

SEQ ID NO: 317129 - DNA, 25 bp, Mus musculus
cagctcttagctttcttttgggatt

SEQ ID NO: 317130 - DNA, 25 bp, Mus musculus
cagctcttagtgaccttgtatggca

SEQ ID NO: 317131 - DNA, 25 bp, Mus musculus
cagctcttagtgtccttgtatggca

SEQ ID NO: 317132 - DNA, 25 bp, Mus musculus
cagctcttagttacttagactcaga

SEQ ID NO: 317133 - DNA, 25 bp, Mus musculus
cagctcttagttatcatgttggcaa

SEQ ID NO: 317134 - DNA, 25 bp, Mus musculus
cagctcttagtttcttagactcaga

SEQ ID NO: 317135 - DNA, 25 bp, Mus musculus
cagctcttagttttcatgttggcaa

SEQ ID NO: 317136 - DNA, 25 bp, Mus musculus
cagctcttcgaacacagagactatt

SEQ ID NO: 317137 - DNA, 25 bp, Mus musculus
cagctcttcgaagacagagactatt

SEQ ID NO: 317138 - DNA, 25 bp, Mus musculus
cagctcttgactctggtgctacaaa

SEQ ID NO: 317139 - DNA, 25 bp, Mus musculus
cagctcttgactgtggtgctacaaa

SEQ ID NO: 317140 - DNA, 25 bp, Mus musculus
cagctcttgatcatcactggcgctt

SEQ ID NO: 317141 - DNA, 25 bp, Mus musculus
cagctcttgatcttcactggcgctt

SEQ ID NO: 317142 - DNA, 25 bp, Mus musculus
cagctcttggacatcattctggctg

SEQ ID NO: 317143 - DNA, 25 bp, Mus musculus
cagctcttggacttcattctggctg

SEQ ID NO: 317144 - DNA, 25 bp, Mus musculus
cagctcttggagcatatcagggaac

SEQ ID NO: 317145 - DNA, 25 bp, Mus musculus
cagctcttggaggatatcagggaac

SEQ ID NO: 317146 - DNA, 25 bp, Mus musculus
cagctcttggctattatatcttctt

SEQ ID NO: 317147 - DNA, 25 bp, Mus musculus
cagctcttggcttttatatcttctt

SEQ ID NO: 317148 - DNA, 25 bp, Mus musculus
cagctcttgggtaacttcctcagga

SEQ ID NO: 317149 - DNA, 25 bp, Mus musculus
cagctcttgggtcccacagtcgcgt

SEQ ID NO: 317150 - DNA, 25 bp, Mus musculus
cagctcttgggtgccacagtcgcgt

SEQ ID NO: 317151 - DNA, 25 bp, Mus musculus
cagctcttgggttacttcctcagga

SEQ ID NO: 317152 - DNA, 25 bp, Mus musculus
cagctcttggtgatgaccgtggcca

SEQ ID NO: 317153 - DNA, 25 bp, Mus musculus
cagctcttggtgttgaccgtggcca

SEQ ID NO: 317154 - DNA, 25 bp, Mus musculus
cagctctttccaagactgtcagtta

SEQ ID NO: 317155 - DNA, 25 bp, Mus musculus
cagctctttccactacaaagtcagt

SEQ ID NO: 317156 - DNA, 25 bp, Mus musculus
cagctctttccagtacaaagtcagt

SEQ ID NO: 317157 - DNA, 25 bp, Mus musculus
cagctctttccatgactgtcagtta

SEQ ID NO: 317158 - DNA, 25 bp, Mus musculus
cagctctttccccagatgagtctgg

SEQ ID NO: 317159 - DNA, 25 bp, Mus musculus
cagctctttcccgagatgagtctgg

SEQ ID NO: 317160 - DNA, 25 bp, Mus musculus
cagctctttctaaccaaactaccta

SEQ ID NO: 317161 - DNA, 25 bp, Mus musculus
cagctctttctatccaaactaccta

SEQ ID NO: 317162 - DNA, 25 bp, Mus musculus
cagctctttgagaagttgagaccta

SEQ ID NO: 317163 - DNA, 25 bp, Mus musculus
cagctctttgagtagttgagaccta

SEQ ID NO: 317164 - DNA, 25 bp, Mus musculus
cagctcttttgcactcagacagaaa

SEQ ID NO: 317165 - DNA, 25 bp, Mus musculus
cagctcttttgctctcagacagaaa

SEQ ID NO: 317166 - DNA, 25 bp, Mus musculus
cagctgaaatacattctgccctatg

SEQ ID NO: 317167 - DNA, 25 bp, Mus musculus
cagctgaaatactttctgccctatg

SEQ ID NO: 317168 - DNA, 25 bp, Mus musculus
cagctgaaatttccccgaagccttc

SEQ ID NO: 317169 - DNA, 25 bp, Mus musculus
cagctgaaatttgcccgaagccttc

SEQ ID NO: 317170 - DNA, 25 bp, Mus musculus
cagctgaagactctggttaggaaga

SEQ ID NO: 317171 - DNA, 25 bp, Mus musculus
cagctgaagactgtggttaggaaga

SEQ ID NO: 317172 - DNA, 25 bp, Mus musculus
cagctgaagatcatgcttggtcata

SEQ ID NO: 317173 - DNA, 25 bp, Mus musculus
cagctgaagatcttgcttggtcata

SEQ ID NO: 317174 - DNA, 25 bp, Mus musculus
cagctgaagcagatgttgttaacac

SEQ ID NO: 317175 - DNA, 25 bp, Mus musculus
cagctgaagcagttgttgttaacac

SEQ ID NO: 317176 - DNA, 25 bp, Mus musculus
cagctgaaggcaaactgtgaggttt

SEQ ID NO: 317177 - DNA, 25 bp, Mus musculus
cagctgaaggcatactgtgaggttt

SEQ ID NO: 317178 - DNA, 25 bp, Mus musculus
cagctgaaggtgactcctgggtgct

SEQ ID NO: 317179 - DNA, 25 bp, Mus musculus
cagctgaaggtgtctcctgggtgct

SEQ ID NO: 317180 - DNA, 25 bp, Mus musculus
cagctgaagtcactggagcaatttg

SEQ ID NO: 317181 - DNA, 25 bp, Mus musculus
cagctgaagtcagtggagcaatttg

SEQ ID NO: 317182 - DNA, 25 bp, Mus musculus
cagctgaatgagaggatctagacta

SEQ ID NO: 317183 - DNA, 25 bp, Mus musculus
cagctgaatgagtggatctagacta

SEQ ID NO: 317184 - DNA, 25 bp, Mus musculus
cagctgacaccaaatgagaacctat

SEQ ID NO: 317185 - DNA, 25 bp, Mus musculus
cagctgacaccatatgagaacctat

SEQ ID NO: 317186 - DNA, 25 bp, Mus musculus
cagctgacacccagccttctgtggg

SEQ ID NO: 317187 - DNA, 25 bp, Mus musculus
cagctgacaccctgccttctgtggg

SEQ ID NO: 317188 - DNA, 25 bp, Mus musculus
cagctgacatgcctactccaacaag

SEQ ID NO: 317189 - DNA, 25 bp, Mus musculus
cagctgacatgcgtactccaacaag

SEQ ID NO: 317190 - DNA, 25 bp, Mus musculus
cagctgacatggaagaactcggaga

SEQ ID NO: 317191 - DNA, 25 bp, Mus musculus
cagctgacatggtagaactcggaga

SEQ ID NO: 317192 - DNA, 25 bp, Mus musculus
cagctgaccacactttattggatgg

SEQ ID NO: 317193 - DNA, 25 bp, Mus musculus
cagctgaccacagtttattggatgg

SEQ ID NO: 317194 - DNA, 25 bp, Mus musculus
cagctgacggctcttcaccatcgag

SEQ ID NO: 317195 - DNA, 25 bp, Mus musculus
cagctgacggctgttcaccatcgag

SEQ ID NO: 317196 - DNA, 25 bp, Mus musculus
cagctgactatgaaccctacgtggt

SEQ ID NO: 317197 - DNA, 25 bp, Mus musculus
cagctgactatgtaccctacgtggt

SEQ ID NO: 317198 - DNA, 25 bp, Mus musculus
cagctgactctgcaatggcaatggt

SEQ ID NO: 317199 - DNA, 25 bp, Mus musculus
cagctgactctggaatggcaatggt

SEQ ID NO: 317200 - DNA, 25 bp, Mus musculus
cagctgactgtccaagattgtgtga

SEQ ID NO: 317201 - DNA, 25 bp, Mus musculus
cagctgactgtcgaagattgtgtga

SEQ ID NO: 317202 - DNA, 25 bp, Mus musculus
cagctgagagatctactaattcatt

SEQ ID NO: 317203 - DNA, 25 bp, Mus musculus
cagctgagagatgtactaattcatt

SEQ ID NO: 317204 - DNA, 25 bp, Mus musculus
cagctgagatcaacgtcccctatgt

SEQ ID NO: 317205 - DNA, 25 bp, Mus musculus
cagctgagatcatcgtcccctatgt

SEQ ID NO: 317206 - DNA, 25 bp, Mus musculus
cagctgagattgactccctgtggga

SEQ ID NO: 317207 - DNA, 25 bp, Mus musculus
cagctgagattgtctccctgtggga

SEQ ID NO: 317208 - DNA, 25 bp, Mus musculus
cagctgagcgccagcagctgattgc

SEQ ID NO: 317209 - DNA, 25 bp, Mus musculus
cagctgagcgcctgcagctgattgc

SEQ ID NO: 317210 - DNA, 25 bp, Mus musculus
cagctgagctatcctgagctatgct

SEQ ID NO: 317211 - DNA, 25 bp, Mus musculus
cagctgagctatgctgagctatgct

SEQ ID NO: 317212 - DNA, 25 bp, Mus musculus
cagctgagctgcatgtccagacctg

SEQ ID NO: 317213 - DNA, 25 bp, Mus musculus
cagctgagctgcttgtccagacctg

SEQ ID NO: 317214 - DNA, 25 bp, Mus musculus
cagctgaggactaaaagatgtctca

SEQ ID NO: 317215 - DNA, 25 bp, Mus musculus
cagctgaggacttaaagatgtctca

SEQ ID NO: 317216 - DNA, 25 bp, Mus musculus
cagctgaggcacagggttggtaaaa

SEQ ID NO: 317217 - DNA, 25 bp, Mus musculus
cagctgaggcactgggttggtaaaa

SEQ ID NO: 317218 - DNA, 25 bp, Mus musculus
cagctgaggctaacctgcaggacag

SEQ ID NO: 317219 - DNA, 25 bp, Mus musculus
cagctgaggctatcctgcaggacag

SEQ ID NO: 317220 - DNA, 25 bp, Mus musculus
cagctgagtgtgagcagcagcgcct

SEQ ID NO: 317221 - DNA, 25 bp, Mus musculus
cagctgagtgtgtgcagcagcgcct

SEQ ID NO: 317222 - DNA, 25 bp, Mus musculus
cagctgagtgttaaatcttcccatc

SEQ ID NO: 317223 - DNA, 25 bp, Mus musculus
cagctgagtgtttaatcttcccatc

SEQ ID NO: 317224 - DNA, 25 bp, Mus musculus
cagctgagttttcagttttagaggt

SEQ ID NO: 317225 - DNA, 25 bp, Mus musculus
cagctgagttttgagttttagaggt

SEQ ID NO: 317226 - DNA, 25 bp, Mus musculus
cagctgatagttacttgtagaagga

SEQ ID NO: 317227 - DNA, 25 bp, Mus musculus
cagctgatagtttcttgtagaagga

SEQ ID NO: 317228 - DNA, 25 bp, Mus musculus
cagctgatatttccacatgactttc

SEQ ID NO: 317229 - DNA, 25 bp, Mus musculus
cagctgatatttgcacatgactttc

SEQ ID NO: 317230 - DNA, 25 bp, Mus musculus
cagctgatctggcacgtgaacaaaa

SEQ ID NO: 317231 - DNA, 25 bp, Mus musculus
cagctgatctgggacgtgaacaaaa

SEQ ID NO: 317232 - DNA, 25 bp, Mus musculus
cagctgatctgtaggccttttctat

SEQ ID NO: 317233 - DNA, 25 bp, Mus musculus
cagctgatctgttggccttttctat

SEQ ID NO: 317234 - DNA, 25 bp, Mus musculus
cagctgatgatgagattgtttaaag

SEQ ID NO: 317235 - DNA, 25 bp, Mus musculus
cagctgatgatgatttagagaaaca

SEQ ID NO: 317236 - DNA, 25 bp, Mus musculus
cagctgatgatgtgattgtttaaag

SEQ ID NO: 317237 - DNA, 25 bp, Mus musculus
cagctgatgatgttttagagaaaca

SEQ ID NO: 317238 - DNA, 25 bp, Mus musculus
cagctgatggacaagtatctgagcc

SEQ ID NO: 317239 - DNA, 25 bp, Mus musculus
cagctgatggactagtatctgagcc

SEQ ID NO: 317240 - DNA, 25 bp, Mus musculus
cagctgatggctactaactggatcc

SEQ ID NO: 317241 - DNA, 25 bp, Mus musculus
cagctgatggcttctaactggatcc

SEQ ID NO: 317242 - DNA, 25 bp, Mus musculus
cagctgatgtgtctactggcattta

SEQ ID NO: 317243 - DNA, 25 bp, Mus musculus
cagctgatgtgtgtactggcattta

SEQ ID NO: 317244 - DNA, 25 bp, Mus musculus
cagctgattcgcagtgtgaccttga

SEQ ID NO: 317245 - DNA, 25 bp, Mus musculus
cagctgattcgctgtgtgaccttga

SEQ ID NO: 317246 - DNA, 25 bp, Mus musculus
cagctgattctgatccggaaaaaga

SEQ ID NO: 317247 - DNA, 25 bp, Mus musculus
cagctgattctgttccggaaaaaga

SEQ ID NO: 317248 - DNA, 25 bp, Mus musculus
cagctgattcttaataccagacttt

SEQ ID NO: 317249 - DNA, 25 bp, Mus musculus
cagctgattctttataccagacttt

SEQ ID NO: 317250 - DNA, 25 bp, Mus musculus
cagctgattgttactccttttgcaa

SEQ ID NO: 317251 - DNA, 25 bp, Mus musculus
cagctgattgtttctccttttgcaa

SEQ ID NO: 317252 - DNA, 25 bp, Mus musculus
cagctgatttcactgtggcaggaat

SEQ ID NO: 317253 - DNA, 25 bp, Mus musculus
cagctgatttcagtgtggcaggaat

SEQ ID NO: 317254 - DNA, 25 bp, Mus musculus
cagctgcagcgactactctgtaaag

SEQ ID NO: 317255 - DNA, 25 bp, Mus musculus
cagctgcagcgagtactctgtaaag

SEQ ID NO: 317256 - DNA, 25 bp, Mus musculus
cagctgcagcttacatttacagtga

SEQ ID NO: 317257 - DNA, 25 bp, Mus musculus
cagctgcagctttcatttacagtga

SEQ ID NO: 317258 - DNA, 25 bp, Mus musculus
cagctgcaggagacttgggtccatg

SEQ ID NO: 317259 - DNA, 25 bp, Mus musculus
cagctgcaggagtcttgggtccatg

SEQ ID NO: 317260 - DNA, 25 bp, Mus musculus
cagctgcagtaacaccatggaccca

SEQ ID NO: 317261 - DNA, 25 bp, Mus musculus
cagctgcagtaagaccatggaccca

SEQ ID NO: 317262 - DNA, 25 bp, Mus musculus
cagctgcatgccctgcaccctggga

SEQ ID NO: 317263 - DNA, 25 bp, Mus musculus
cagctgcatgccgtgcaccctggga

SEQ ID NO: 317264 - DNA, 25 bp, Mus musculus
cagctgcatgttaagaacttgggtt

SEQ ID NO: 317265 - DNA, 25 bp, Mus musculus
cagctgcatgtttagaacttgggtt

SEQ ID NO: 317266 - DNA, 25 bp, Mus musculus
cagctgccagctctatgagcacagt

SEQ ID NO: 317267 - DNA, 25 bp, Mus musculus
cagctgccagctgtatgagcacagt

SEQ ID NO: 317268 - DNA, 25 bp, Mus musculus
cagctgccaggaagcaacgcactct

SEQ ID NO: 317269 - DNA, 25 bp, Mus musculus
cagctgccaggatgcaacgcactct

SEQ ID NO: 317270 - DNA, 25 bp, Mus musculus
cagctgccatctaagaatttgggag

SEQ ID NO: 317271 - DNA, 25 bp, Mus musculus
cagctgccatcttagaatttgggag

SEQ ID NO: 317272 - DNA, 25 bp, Mus musculus
cagctgcccattatgtgagattttt

SEQ ID NO: 317273 - DNA, 25 bp, Mus musculus
cagctgcccattttgtgagattttt

SEQ ID NO: 317274 - DNA, 25 bp, Mus musculus
cagctgcccgctctaggagcagtga

SEQ ID NO: 317275 - DNA, 25 bp, Mus musculus
cagctgcccgctgtaggagcagtga

SEQ ID NO: 317276 - DNA, 25 bp, Mus musculus
cagctgcccgggagcgattgcaaga

SEQ ID NO: 317277 - DNA, 25 bp, Mus musculus
cagctgcccgggtgcgattgcaaga

SEQ ID NO: 317278 - DNA, 25 bp, Mus musculus
cagctgccctggaatgtggatcaga

SEQ ID NO: 317279 - DNA, 25 bp, Mus musculus
cagctgccctggtatgtggatcaga

SEQ ID NO: 317280 - DNA, 25 bp, Mus musculus
cagctgcctgctcggtgatgctctg

SEQ ID NO: 317281 - DNA, 25 bp, Mus musculus
cagctgcctgctgggtgatgctctg

SEQ ID NO: 317282 - DNA, 25 bp, Mus musculus
cagctgcctggtatgacgtattatc

SEQ ID NO: 317283 - DNA, 25 bp, Mus musculus
cagctgcctggtttgacgtattatc

SEQ ID NO: 317284 - DNA, 25 bp, Mus musculus
cagctgcctgtgagtgtgtacaatg

SEQ ID NO: 317285 - DNA, 25 bp, Mus musculus
cagctgcctgtgataagtgggaagt

SEQ ID NO: 317286 - DNA, 25 bp, Mus musculus
cagctgcctgtgtgtgtgtacaatg

SEQ ID NO: 317287 - DNA, 25 bp, Mus musculus
cagctgcctgtgttaagtgggaagt

SEQ ID NO: 317288 - DNA, 25 bp, Mus musculus
cagctgccttttacacttcttaaag

SEQ ID NO: 317289 - DNA, 25 bp, Mus musculus
cagctgcctttttcacttcttaaag

SEQ ID NO: 317290 - DNA, 25 bp, Mus musculus
cagctgcgagagcatagcaagccaa

SEQ ID NO: 317291 - DNA, 25 bp, Mus musculus
cagctgcgagaggatagcaagccaa

SEQ ID NO: 317292 - DNA, 25 bp, Mus musculus
cagctgcgctggctgaaacaaacaa

SEQ ID NO: 317293 - DNA, 25 bp, Mus musculus
cagctgcgctgggtgaaacaaacaa

SEQ ID NO: 317294 - DNA, 25 bp, Mus musculus
cagctgcggcacatcagactggaga

SEQ ID NO: 317295 - DNA, 25 bp, Mus musculus
cagctgcggcacttcagactggaga

SEQ ID NO: 317296 - DNA, 25 bp, Mus musculus
cagctgcgggacaaggaccccaagt

SEQ ID NO: 317297 - DNA, 25 bp, Mus musculus
cagctgcgggactaggaccccaagt

SEQ ID NO: 317298 - DNA, 25 bp, Mus musculus
cagctgctatagaccctgaagcgca

SEQ ID NO: 317299 - DNA, 25 bp, Mus musculus
cagctgctatagtccctgaagcgca

SEQ ID NO: 317300 - DNA, 25 bp, Mus musculus
cagctgctcacaaccgttatgaatg

SEQ ID NO: 317301 - DNA, 25 bp, Mus musculus
cagctgctcacatccgttatgaatg

SEQ ID NO: 317302 - DNA, 25 bp, Mus musculus
cagctgctccaaatgagtaaaatga

SEQ ID NO: 317303 - DNA, 25 bp, Mus musculus
cagctgctccaattgagtaaaatga

SEQ ID NO: 317304 - DNA, 25 bp, Mus musculus
cagctgctccgtctggaatacattt

SEQ ID NO: 317305 - DNA, 25 bp, Mus musculus
cagctgctccgtgtggaatacattt

SEQ ID NO: 317306 - DNA, 25 bp, Mus musculus
cagctgctcctaaaatagtttcaga

SEQ ID NO: 317307 - DNA, 25 bp, Mus musculus
cagctgctcctataatagtttcaga

SEQ ID NO: 317308 - DNA, 25 bp, Mus musculus
cagctgctctacaatcctagggtaa

SEQ ID NO: 317309 - DNA, 25 bp, Mus musculus
cagctgctctactatcctagggtaa

SEQ ID NO: 317310 - DNA, 25 bp, Mus musculus
cagctgctctgaatgtttgtacaca

SEQ ID NO: 317311 - DNA, 25 bp, Mus musculus
cagctgctctgattgtttgtacaca

SEQ ID NO: 317312 - DNA, 25 bp, Mus musculus
cagctgctctggaacagtcagtgaa

SEQ ID NO: 317313 - DNA, 25 bp, Mus musculus
cagctgctctggtacagtcagtgaa

SEQ ID NO: 317314 - DNA, 25 bp, Mus musculus
cagctgctgcgcagtaagcgtgcat

SEQ ID NO: 317315 - DNA, 25 bp, Mus musculus
cagctgctgcgctgtaagcgtgcat

SEQ ID NO: 317316 - DNA, 25 bp, Mus musculus
cagctgctgctcatgaatgattgag

SEQ ID NO: 317317 - DNA, 25 bp, Mus musculus
cagctgctgctcttgaatgattgag

SEQ ID NO: 317318 - DNA, 25 bp, Mus musculus
cagctgctgcttactatgtaatcca

SEQ ID NO: 317319 - DNA, 25 bp, Mus musculus
cagctgctgctttctatgtaatcca

SEQ ID NO: 317320 - DNA, 25 bp, Mus musculus
cagctgctggtaagatcatgtatgc

SEQ ID NO: 317321 - DNA, 25 bp, Mus musculus
cagctgctggtatgatcatgtatgc

SEQ ID NO: 317322 - DNA, 25 bp, Mus musculus
cagctgctggtgaggttatttctca

SEQ ID NO: 317323 - DNA, 25 bp, Mus musculus
cagctgctggtgtggttatttctca

SEQ ID NO: 317324 - DNA, 25 bp, Mus musculus
cagctgctgtgtacgctgcagaata

SEQ ID NO: 317325 - DNA, 25 bp, Mus musculus
cagctgctgtgtacgggagcctaaa

SEQ ID NO: 317326 - DNA, 25 bp, Mus musculus
cagctgctgtgttcgctgcagaata

SEQ ID NO: 317327 - DNA, 25 bp, Mus musculus
cagctgctgtgttcgggagcctaaa

SEQ ID NO: 317328 - DNA, 25 bp, Mus musculus
cagctgctgttactagacataatca

SEQ ID NO: 317329 - DNA, 25 bp, Mus musculus
cagctgctgttagtagacataatca

SEQ ID NO: 317330 - DNA, 25 bp, Mus musculus
cagctgcttagcaatgtgggtcata

SEQ ID NO: 317331 - DNA, 25 bp, Mus musculus
cagctgcttagctatgtgggtcata

SEQ ID NO: 317332 - DNA, 25 bp, Mus musculus
cagctgcttccacttctggtgattg

SEQ ID NO: 317333 - DNA, 25 bp, Mus musculus
cagctgcttccagttctggtgattg

SEQ ID NO: 317334 - DNA, 25 bp, Mus musculus
cagctgcttctgagaacacctgctt

SEQ ID NO: 317335 - DNA, 25 bp, Mus musculus
cagctgcttctgtgaacacctgctt

SEQ ID NO: 317336 - DNA, 25 bp, Mus musculus
cagctgcttgcacagatggatgtta

SEQ ID NO: 317337 - DNA, 25 bp, Mus musculus
cagctgcttgcagagatggatgtta

SEQ ID NO: 317338 - DNA, 25 bp, Mus musculus
cagctgcttggtcaacgttgttttg

SEQ ID NO: 317339 - DNA, 25 bp, Mus musculus
cagctgcttggtgaacgttgttttg

SEQ ID NO: 317340 - DNA, 25 bp, Mus musculus
cagctgctttggctttgtattgtgt

SEQ ID NO: 317341 - DNA, 25 bp, Mus musculus
cagctgctttgggtttgtattgtgt

SEQ ID NO: 317342 - DNA, 25 bp, Mus musculus
cagctggaaccaagaccgggatgtt

SEQ ID NO: 317343 - DNA, 25 bp, Mus musculus
cagctggaaccatgaccgggatgtt

SEQ ID NO: 317344 - DNA, 25 bp, Mus musculus
cagctggaagctatcctttctgaat

SEQ ID NO: 317345 - DNA, 25 bp, Mus musculus
cagctggaagctttcctttctgaat

SEQ ID NO: 317346 - DNA, 25 bp, Mus musculus
cagctggacaggatgattatacaaa

SEQ ID NO: 317347 - DNA, 25 bp, Mus musculus
cagctggacaggttgattatacaaa

SEQ ID NO: 317348 - DNA, 25 bp, Mus musculus
cagctggaccagagaccctttgcgg

SEQ ID NO: 317349 - DNA, 25 bp, Mus musculus
cagctggaccagtgaccctttgcgg

SEQ ID NO: 317350 - DNA, 25 bp, Mus musculus
cagctggacctgatagttttgatag

SEQ ID NO: 317351 - DNA, 25 bp, Mus musculus
cagctggacctgttagttttgatag

SEQ ID NO: 317352 - DNA, 25 bp, Mus musculus
cagctggacgtgcacatcttataat

SEQ ID NO: 317353 - DNA, 25 bp, Mus musculus
cagctggacgtggacatcttataat

SEQ ID NO: 317354 - DNA, 25 bp, Mus musculus
cagctggactgacctcgtacaaaaa

SEQ ID NO: 317355 - DNA, 25 bp, Mus musculus
cagctggactgagctcgtacaaaaa

SEQ ID NO: 317356 - DNA, 25 bp, Mus musculus
cagctggactttcaggatctgctct

SEQ ID NO: 317357 - DNA, 25 bp, Mus musculus
cagctggactttgaggatctgctct

SEQ ID NO: 317358 - DNA, 25 bp, Mus musculus
cagctggagaagagtgtaaaggccc

SEQ ID NO: 317359 - DNA, 25 bp, Mus musculus
cagctggagaagtgtgtaaaggccc

SEQ ID NO: 317360 - DNA, 25 bp, Mus musculus
cagctggaggaacttgagtttgtca

SEQ ID NO: 317361 - DNA, 25 bp, Mus musculus
cagctggaggaagttgagtttgtca

SEQ ID NO: 317362 - DNA, 25 bp, Mus musculus
cagctggagtacacctcttggatgc

SEQ ID NO: 317363 - DNA, 25 bp, Mus musculus
cagctggagtactcctcttggatgc

SEQ ID NO: 317364 - DNA, 25 bp, Mus musculus
cagctggatgctaacaatgcaagga

SEQ ID NO: 317365 - DNA, 25 bp, Mus musculus
cagctggatgcttacaatgcaagga

SEQ ID NO: 317366 - DNA, 25 bp, Mus musculus
cagctggcaggcacaccagtgattt

SEQ ID NO: 317367 - DNA, 25 bp, Mus musculus
cagctggcaggctcaccagtgattt

SEQ ID NO: 317368 - DNA, 25 bp, Mus musculus
cagctggcctagagcctgagagcct

SEQ ID NO: 317369 - DNA, 25 bp, Mus musculus
cagctggcctagtgcctgagagcct

SEQ ID NO: 317370 - DNA, 25 bp, Mus musculus
cagctggctaacaatggtacggatg

SEQ ID NO: 317371 - DNA, 25 bp, Mus musculus
cagctggctaactatggtacggatg

SEQ ID NO: 317372 - DNA, 25 bp, Mus musculus
cagctggctacgaccatgtgaacag

SEQ ID NO: 317373 - DNA, 25 bp, Mus musculus
cagctggctacgtccatgtgaacag

SEQ ID NO: 317374 - DNA, 25 bp, Mus musculus
cagctggctgacagcttccaagagt

SEQ ID NO: 317375 - DNA, 25 bp, Mus musculus
cagctggctgactgcttccaagagt

SEQ ID NO: 317376 - DNA, 25 bp, Mus musculus
cagctggctggaagaccactcctgc

SEQ ID NO: 317377 - DNA, 25 bp, Mus musculus
cagctggctggatgaccactcctgc

SEQ ID NO: 317378 - DNA, 25 bp, Mus musculus
cagctggctgggaaagtcctgcctc

SEQ ID NO: 317379 - DNA, 25 bp, Mus musculus
cagctggctgggtaagtcctgcctc

SEQ ID NO: 317380 - DNA, 25 bp, Mus musculus
cagctggctttaaggctagaatacg

SEQ ID NO: 317381 - DNA, 25 bp, Mus musculus
cagctggctttatggctagaatacg

SEQ ID NO: 317382 - DNA, 25 bp, Mus musculus
cagctgggaagcagatgcagaactc

SEQ ID NO: 317383 - DNA, 25 bp, Mus musculus
cagctgggaagctgatgcagaactc

SEQ ID NO: 317384 - DNA, 25 bp, Mus musculus
cagctgggattgacttgctgcagag

SEQ ID NO: 317385 - DNA, 25 bp, Mus musculus
cagctgggattgtcttgctgcagag

SEQ ID NO: 317386 - DNA, 25 bp, Mus musculus
cagctgggccctaataacatattca

SEQ ID NO: 317387 - DNA, 25 bp, Mus musculus
cagctgggcccttataacatattca

SEQ ID NO: 317388 - DNA, 25 bp, Mus musculus
cagctgggctccctttgtcagagtc

SEQ ID NO: 317389 - DNA, 25 bp, Mus musculus
cagctgggctccgtttgtcagagtc

SEQ ID NO: 317390 - DNA, 25 bp, Mus musculus
cagctgggtgacagaggctcctgta

SEQ ID NO: 317391 - DNA, 25 bp, Mus musculus
cagctgggtgactgaggctcctgta

SEQ ID NO: 317392 - DNA, 25 bp, Mus musculus
cagctgggtgagctataggccctta

SEQ ID NO: 317393 - DNA, 25 bp, Mus musculus
cagctgggtgaggtataggccctta

SEQ ID NO: 317394 - DNA, 25 bp, Mus musculus
cagctgggtgtgactcagtaaagtg

SEQ ID NO: 317395 - DNA, 25 bp, Mus musculus
cagctgggtgtgtctcagtaaagtg

SEQ ID NO: 317396 - DNA, 25 bp, Mus musculus
cagctgggttgactctgcaggtcca

SEQ ID NO: 317397 - DNA, 25 bp, Mus musculus
cagctgggttgagtctgcaggtcca

SEQ ID NO: 317398 - DNA, 25 bp, Mus musculus
cagctggtcagtcgcggtcttccca

SEQ ID NO: 317399 - DNA, 25 bp, Mus musculus
cagctggtcagtggcggtcttccca

SEQ ID NO: 317400 - DNA, 25 bp, Mus musculus
cagctggtccctagattccgagtat

SEQ ID NO: 317401 - DNA, 25 bp, Mus musculus
cagctggtcccttgattccgagtat

SEQ ID NO: 317402 - DNA, 25 bp, Mus musculus
cagctggtctccaacctgaagaaag

SEQ ID NO: 317403 - DNA, 25 bp, Mus musculus
cagctggtctcctacctgaagaaag

SEQ ID NO: 317404 - DNA, 25 bp, Mus musculus
cagctggtcttcattggtagaaatt

SEQ ID NO: 317405 - DNA, 25 bp, Mus musculus
cagctggtcttctttggtagaaatt

SEQ ID NO: 317406 - DNA, 25 bp, Mus musculus
cagctggtgaggcttggcacttacc

SEQ ID NO: 317407 - DNA, 25 bp, Mus musculus
cagctggtgagggttggcacttacc

SEQ ID NO: 317408 - DNA, 25 bp, Mus musculus
cagctggtgcagcagatacattcgt

SEQ ID NO: 317409 - DNA, 25 bp, Mus musculus
cagctggtgcaggagatacattcgt

SEQ ID NO: 317410 - DNA, 25 bp, Mus musculus
cagctggtggatcgtgacttttgaa

SEQ ID NO: 317411 - DNA, 25 bp, Mus musculus
cagctggtggatggtgacttttgaa

SEQ ID NO: 317412 - DNA, 25 bp, Mus musculus
cagctggtgtgaagtgcctccacgg

SEQ ID NO: 317413 - DNA, 25 bp, Mus musculus
cagctggtgtgatgtgcctccacgg

SEQ ID NO: 317414 - DNA, 25 bp, Mus musculus
cagctggtgtggagtttgaagaaaa

SEQ ID NO: 317415 - DNA, 25 bp, Mus musculus
cagctggtgtggtgtttgaagaaaa

SEQ ID NO: 317416 - DNA, 25 bp, Mus musculus
cagctggtgtttctaccctgtattg

SEQ ID NO: 317417 - DNA, 25 bp, Mus musculus
cagctggtgtttgtaccctgtattg

SEQ ID NO: 317418 - DNA, 25 bp, Mus musculus
cagctggtttacacgtacttaccca

SEQ ID NO: 317419 - DNA, 25 bp, Mus musculus
cagctggtttactcgtacttaccca

SEQ ID NO: 317420 - DNA, 25 bp, Mus musculus
cagctgtaaaatagttcctaagtgc

SEQ ID NO: 317421 - DNA, 25 bp, Mus musculus
cagctgtaaaattgttcctaagtgc

SEQ ID NO: 317422 - DNA, 25 bp, Mus musculus
cagctgtacggtctctgacctcatt

SEQ ID NO: 317423 - DNA, 25 bp, Mus musculus
cagctgtacggtgtctgacctcatt

SEQ ID NO: 317424 - DNA, 25 bp, Mus musculus
cagctgtaggttcgttttgtttttg

SEQ ID NO: 317425 - DNA, 25 bp, Mus musculus
cagctgtaggttggttttgtttttg

SEQ ID NO: 317426 - DNA, 25 bp, Mus musculus
cagctgtagttgaacctgccacggg

SEQ ID NO: 317427 - DNA, 25 bp, Mus musculus
cagctgtagttgtacctgccacggg

SEQ ID NO: 317428 - DNA, 25 bp, Mus musculus
cagctgtatactcacttcaaggcca

SEQ ID NO: 317429 - DNA, 25 bp, Mus musculus
cagctgtatactgacttcaaggcca

SEQ ID NO: 317430 - DNA, 25 bp, Mus musculus
cagctgtatcagatgtggaggtttt

SEQ ID NO: 317431 - DNA, 25 bp, Mus musculus
cagctgtatcagctgagcaatctta

SEQ ID NO: 317432 - DNA, 25 bp, Mus musculus
cagctgtatcaggtgagcaatctta

SEQ ID NO: 317433 - DNA, 25 bp, Mus musculus
cagctgtatcagttgtggaggtttt

SEQ ID NO: 317434 - DNA, 25 bp, Mus musculus
cagctgtatttccttggtttcttca

SEQ ID NO: 317435 - DNA, 25 bp, Mus musculus
cagctgtatttcgttggtttcttca

SEQ ID NO: 317436 - DNA, 25 bp, Mus musculus
cagctgtcacttagcagtcacaggt

SEQ ID NO: 317437 - DNA, 25 bp, Mus musculus
cagctgtcacttcgatcatttgttt

SEQ ID NO: 317438 - DNA, 25 bp, Mus musculus
cagctgtcacttggatcatttgttt

SEQ ID NO: 317439 - DNA, 25 bp, Mus musculus
cagctgtcactttgcagtcacaggt

SEQ ID NO: 317440 - DNA, 25 bp, Mus musculus
cagctgtcagatcgaggtcctagaa

SEQ ID NO: 317441 - DNA, 25 bp, Mus musculus
cagctgtcagatggaggtcctagaa

SEQ ID NO: 317442 - DNA, 25 bp, Mus musculus
cagctgtcagcgcagaggatgcctc

SEQ ID NO: 317443 - DNA, 25 bp, Mus musculus
cagctgtcagcggagaggatgcctc

SEQ ID NO: 317444 - DNA, 25 bp, Mus musculus
cagctgtcagtacccatcagttgaa

SEQ ID NO: 317445 - DNA, 25 bp, Mus musculus
cagctgtcagtagccatcagttgaa

SEQ ID NO: 317446 - DNA, 25 bp, Mus musculus
cagctgtcctacactgggagggtga

SEQ ID NO: 317447 - DNA, 25 bp, Mus musculus
cagctgtcctactctgggagggtga

SEQ ID NO: 317448 - DNA, 25 bp, Mus musculus
cagctgtccttcagaacgggtttca

SEQ ID NO: 317449 - DNA, 25 bp, Mus musculus
cagctgtccttctgaacgggtttca

SEQ ID NO: 317450 - DNA, 25 bp, Mus musculus
cagctgtctatgaggacccacaaga

SEQ ID NO: 317451 - DNA, 25 bp, Mus musculus
cagctgtctatgtggacccacaaga

SEQ ID NO: 317452 - DNA, 25 bp, Mus musculus
cagctgtctcttccctagtaaaact

SEQ ID NO: 317453 - DNA, 25 bp, Mus musculus
cagctgtctcttgcctagtaaaact

SEQ ID NO: 317454 - DNA, 25 bp, Mus musculus
cagctgtctgccatgattattagag

SEQ ID NO: 317455 - DNA, 25 bp, Mus musculus
cagctgtctgccttgattattagag

SEQ ID NO: 317456 - DNA, 25 bp, Mus musculus
cagctgtctgctcttcatgggaaaa

SEQ ID NO: 317457 - DNA, 25 bp, Mus musculus
cagctgtctgctgttcatgggaaaa

SEQ ID NO: 317458 - DNA, 25 bp, Mus musculus
cagctgtctgtaaggttcctgggcc

SEQ ID NO: 317459 - DNA, 25 bp, Mus musculus
cagctgtctgtatggttcctgggcc

SEQ ID NO: 317460 - DNA, 25 bp, Mus musculus
cagctgtctgtgctcttatttagtc

SEQ ID NO: 317461 - DNA, 25 bp, Mus musculus
cagctgtctgtggtcttatttagtc

SEQ ID NO: 317462 - DNA, 25 bp, Mus musculus
cagctgtctttaaatgtgtgcttct

SEQ ID NO: 317463 - DNA, 25 bp, Mus musculus
cagctgtctttatatgtgtgcttct

SEQ ID NO: 317464 - DNA, 25 bp, Mus musculus
cagctgtgaataagcagatgacaaa

SEQ ID NO: 317465 - DNA, 25 bp, Mus musculus
cagctgtgaatatgcagatgacaaa

SEQ ID NO: 317466 - DNA, 25 bp, Mus musculus
cagctgtgacatacagtgcacaact

SEQ ID NO: 317467 - DNA, 25 bp, Mus musculus
cagctgtgacattcagtgcacaact

SEQ ID NO: 317468 - DNA, 25 bp, Mus musculus
cagctgtgatcacttcatttctaag

SEQ ID NO: 317469 - DNA, 25 bp, Mus musculus
cagctgtgatcagttcatttctaag

SEQ ID NO: 317470 - DNA, 25 bp, Mus musculus
cagctgtgcctcctgttaaactgga

SEQ ID NO: 317471 - DNA, 25 bp, Mus musculus
cagctgtgcctcgtgttaaactgga

SEQ ID NO: 317472 - DNA, 25 bp, Mus musculus
cagctgtgctgcacaggacccgtga

SEQ ID NO: 317473 - DNA, 25 bp, Mus musculus
cagctgtgctgctcaggacccgtga

SEQ ID NO: 317474 - DNA, 25 bp, Mus musculus
cagctgtgctttcagattctttcca

SEQ ID NO: 317475 - DNA, 25 bp, Mus musculus
cagctgtgctttgagattctttcca

SEQ ID NO: 317476 - DNA, 25 bp, Mus musculus
cagctgtggcggattacggaaatac

SEQ ID NO: 317477 - DNA, 25 bp, Mus musculus
cagctgtggcggtttacggaaatac

SEQ ID NO: 317478 - DNA, 25 bp, Mus musculus
cagctgtggtagaggcagtaccaga

SEQ ID NO: 317479 - DNA, 25 bp, Mus musculus
cagctgtggtagtggcagtaccaga

SEQ ID NO: 317480 - DNA, 25 bp, Mus musculus
cagctgtggtgaagacaaggcctac

SEQ ID NO: 317481 - DNA, 25 bp, Mus musculus
cagctgtggtgatgacaaggcctac

SEQ ID NO: 317482 - DNA, 25 bp, Mus musculus
cagctgtgtgcgatggtgtgtttct

SEQ ID NO: 317483 - DNA, 25 bp, Mus musculus
cagctgtgtgcgttggtgtgtttct

SEQ ID NO: 317484 - DNA, 25 bp, Mus musculus
cagctgtgtgttcgtctggtcccag

SEQ ID NO: 317485 - DNA, 25 bp, Mus musculus
cagctgtgtgttggtctggtcccag

SEQ ID NO: 317486 - DNA, 25 bp, Mus musculus
cagctgtgttatagatgatgtcact

SEQ ID NO: 317487 - DNA, 25 bp, Mus musculus
cagctgtgttattgatgatgtcact

SEQ ID NO: 317488 - DNA, 25 bp, Mus musculus
cagctgttattgaattgtttgaatt

SEQ ID NO: 317489 - DNA, 25 bp, Mus musculus
cagctgttattgtattgtttgaatt

SEQ ID NO: 317490 - DNA, 25 bp, Mus musculus
cagctgttatttcttctgtattcat

SEQ ID NO: 317491 - DNA, 25 bp, Mus musculus
cagctgttatttgttctgtattcat

SEQ ID NO: 317492 - DNA, 25 bp, Mus musculus
cagctgttccagagtagatgtttac

SEQ ID NO: 317493 - DNA, 25 bp, Mus musculus
cagctgttccagtgtagatgtttac

SEQ ID NO: 317494 - DNA, 25 bp, Mus musculus
cagctgttcctgaacaccaggactt

SEQ ID NO: 317495 - DNA, 25 bp, Mus musculus
cagctgttcctgtacaccaggactt

SEQ ID NO: 317496 - DNA, 25 bp, Mus musculus
cagctgttcgttcttgcccagaaaa

SEQ ID NO: 317497 - DNA, 25 bp, Mus musculus
cagctgttcgttgttgcccagaaaa

SEQ ID NO: 317498 - DNA, 25 bp, Mus musculus
cagctgttgaaaagcataccatgag

SEQ ID NO: 317499 - DNA, 25 bp, Mus musculus
cagctgttgaaatgcataccatgag

SEQ ID NO: 317500 - DNA, 25 bp, Mus musculus
cagctgttggaacacttagaaagaa

SEQ ID NO: 317501 - DNA, 25 bp, Mus musculus
cagctgttggaagacttagaaagaa

SEQ ID NO: 317502 - DNA, 25 bp, Mus musculus
cagctgttggtgatgggattcgact

SEQ ID NO: 317503 - DNA, 25 bp, Mus musculus
cagctgttggtgttgggattcgact

SEQ ID NO: 317504 - DNA, 25 bp, Mus musculus
cagctgttgtgtcagtgtgctactt

SEQ ID NO: 317505 - DNA, 25 bp, Mus musculus
cagctgttgtgtgagtgtgctactt

SEQ ID NO: 317506 - DNA, 25 bp, Mus musculus
cagctgtttaggcattgtttggttt

SEQ ID NO: 317507 - DNA, 25 bp, Mus musculus
cagctgtttagggattgtttggttt

SEQ ID NO: 317508 - DNA, 25 bp, Mus musculus
cagctgtttatcatttgcctctaac

SEQ ID NO: 317509 - DNA, 25 bp, Mus musculus
cagctgtttatcttttgcctctaac

SEQ ID NO: 317510 - DNA, 25 bp, Mus musculus
cagctgtttccactttcactggtgt

SEQ ID NO: 317511 - DNA, 25 bp, Mus musculus
cagctgtttccagtttcactggtgt

SEQ ID NO: 317512 - DNA, 25 bp, Mus musculus
cagctgtttctaagtttcgaaaggc

SEQ ID NO: 317513 - DNA, 25 bp, Mus musculus
cagctgtttctatgtttcgaaaggc

SEQ ID NO: 317514 - DNA, 25 bp, Mus musculus
cagctgtttgagattatcgaccgga

SEQ ID NO: 317515 - DNA, 25 bp, Mus musculus
cagctgtttgagtttatcgaccgga

SEQ ID NO: 317516 - DNA, 25 bp, Mus musculus
cagctgtttgtaaatgtgtgagaca

SEQ ID NO: 317517 - DNA, 25 bp, Mus musculus
cagctgtttgtatatgtgtgagaca

SEQ ID NO: 317518 - DNA, 25 bp, Mus musculus
cagctgttttccacaaagcatcaaa

SEQ ID NO: 317519 - DNA, 25 bp, Mus musculus
cagctgttttcctcaaagcatcaaa

SEQ ID NO: 317520 - DNA, 25 bp, Mus musculus
cagcttaacaacaggctcctatttt

SEQ ID NO: 317521 - DNA, 25 bp, Mus musculus
cagcttaacaactggctcctatttt

SEQ ID NO: 317522 - DNA, 25 bp, Mus musculus
cagcttaacctgaaatacaattgat

SEQ ID NO: 317523 - DNA, 25 bp, Mus musculus
cagcttaacctgtaatacaattgat

SEQ ID NO: 317524 - DNA, 25 bp, Mus musculus
cagcttaacttgacatccatgtgta

SEQ ID NO: 317525 - DNA, 25 bp, Mus musculus
cagcttaacttgtcatccatgtgta

SEQ ID NO: 317526 - DNA, 25 bp, Mus musculus
cagcttaagcagcagcccagggcat

SEQ ID NO: 317527 - DNA, 25 bp, Mus musculus
cagcttaagcaggagcccagggcat

SEQ ID NO: 317528 - DNA, 25 bp, Mus musculus
cagcttacctacaggcattctgtta

SEQ ID NO: 317529 - DNA, 25 bp, Mus musculus
cagcttacctactggcattctgtta

SEQ ID NO: 317530 - DNA, 25 bp, Mus musculus
cagcttacctctcctgtagaaacag

SEQ ID NO: 317531 - DNA, 25 bp, Mus musculus
cagcttacctctgctgtagaaacag

SEQ ID NO: 317532 - DNA, 25 bp, Mus musculus
cagcttacggagcagtctggcatgc

SEQ ID NO: 317533 - DNA, 25 bp, Mus musculus
cagcttacggaggagtctggcatgc

SEQ ID NO: 317534 - DNA, 25 bp, Mus musculus
cagcttacttttagttcagtgcaca

SEQ ID NO: 317535 - DNA, 25 bp, Mus musculus
cagcttactttttgttcagtgcaca

SEQ ID NO: 317536 - DNA, 25 bp, Mus musculus
cagcttagatgacaggtccgcccat

SEQ ID NO: 317537 - DNA, 25 bp, Mus musculus
cagcttagatgagaggtccgcccat

SEQ ID NO: 317538 - DNA, 25 bp, Mus musculus
cagcttagggccactgcgcaggaac

SEQ ID NO: 317539 - DNA, 25 bp, Mus musculus
cagcttagggcctctgcgcaggaac

SEQ ID NO: 317540 - DNA, 25 bp, Mus musculus
cagcttagtgataataccctggtcc

SEQ ID NO: 317541 - DNA, 25 bp, Mus musculus
cagcttagtgattataccctggtcc

SEQ ID NO: 317542 - DNA, 25 bp, Mus musculus
cagcttagtgcccagcagtgcatta

SEQ ID NO: 317543 - DNA, 25 bp, Mus musculus
cagcttagtgccgagcagtgcatta

SEQ ID NO: 317544 - DNA, 25 bp, Mus musculus
cagcttataaggagcatcattattt

SEQ ID NO: 317545 - DNA, 25 bp, Mus musculus
cagcttataaggtgcatcattattt

SEQ ID NO: 317546 - DNA, 25 bp, Mus musculus
cagcttatactgctaaccacaatgt

SEQ ID NO: 317547 - DNA, 25 bp, Mus musculus
cagcttatactggtaaccacaatgt

SEQ ID NO: 317548 - DNA, 25 bp, Mus musculus
cagcttatgaatcagggttgtttct

SEQ ID NO: 317549 - DNA, 25 bp, Mus musculus
cagcttatgaatgagggttgtttct

SEQ ID NO: 317550 - DNA, 25 bp, Mus musculus
cagcttatggaaaggctaaagcaga

SEQ ID NO: 317551 - DNA, 25 bp, Mus musculus
cagcttatggaatggctaaagcaga

SEQ ID NO: 317552 - DNA, 25 bp, Mus musculus
cagcttattcatacctgaaatagag

SEQ ID NO: 317553 - DNA, 25 bp, Mus musculus
cagcttattcattcctgaaatagag

SEQ ID NO: 317554 - DNA, 25 bp, Mus musculus
cagcttattctgagtggtggcagca

SEQ ID NO: 317555 - DNA, 25 bp, Mus musculus
cagcttattctgtgtggtggcagca

SEQ ID NO: 317556 - DNA, 25 bp, Mus musculus
cagcttcaaacccataccttgaaca

SEQ ID NO: 317557 - DNA, 25 bp, Mus musculus
cagcttcaaaccgataccttgaaca

SEQ ID NO: 317558 - DNA, 25 bp, Mus musculus
cagcttcaagcaactctggatttgg

SEQ ID NO: 317559 - DNA, 25 bp, Mus musculus
cagcttcaagcatctctggatttgg

SEQ ID NO: 317560 - DNA, 25 bp, Mus musculus
cagcttcaagtcaatcactacaacc

SEQ ID NO: 317561 - DNA, 25 bp, Mus musculus
cagcttcaagtctatcactacaacc

SEQ ID NO: 317562 - DNA, 25 bp, Mus musculus
cagcttcacactcagacggcattga

SEQ ID NO: 317563 - DNA, 25 bp, Mus musculus
cagcttcacactgagacggcattga

SEQ ID NO: 317564 - DNA, 25 bp, Mus musculus
cagcttcaccctaccttgagctgtt

SEQ ID NO: 317565 - DNA, 25 bp, Mus musculus
cagcttcacccttccttgagctgtt

SEQ ID NO: 317566 - DNA, 25 bp, Mus musculus
cagcttcaccttctagctctttata

SEQ ID NO: 317567 - DNA, 25 bp, Mus musculus
cagcttcaccttgtagctctttata

SEQ ID NO: 317568 - DNA, 25 bp, Mus musculus
cagcttcactggctacagttaccat

SEQ ID NO: 317569 - DNA, 25 bp, Mus musculus
cagcttcactgggtacagttaccat

SEQ ID NO: 317570 - DNA, 25 bp, Mus musculus
cagcttcagagcaatgagagcacca

SEQ ID NO: 317571 - DNA, 25 bp, Mus musculus
cagcttcagagctatgagagcacca

SEQ ID NO: 317572 - DNA, 25 bp, Mus musculus
cagcttcaggccatagttgtgcgag

SEQ ID NO: 317573 - DNA, 25 bp, Mus musculus
cagcttcaggccttagttgtgcgag

SEQ ID NO: 317574 - DNA, 25 bp, Mus musculus
cagcttcaggctagttttctcttaa

SEQ ID NO: 317575 - DNA, 25 bp, Mus musculus
cagcttcaggcttgttttctcttaa

SEQ ID NO: 317576 - DNA, 25 bp, Mus musculus
cagcttcaggtcacaccattatgaa

SEQ ID NO: 317577 - DNA, 25 bp, Mus musculus
cagcttcaggtctcaccattatgaa

SEQ ID NO: 317578 - DNA, 25 bp, Mus musculus
cagcttcagtgacgtccggcgtttt

SEQ ID NO: 317579 - DNA, 25 bp, Mus musculus
cagcttcagtgaggtccggcgtttt

SEQ ID NO: 317580 - DNA, 25 bp, Mus musculus
cagcttcatacgagtaacaattttc

SEQ ID NO: 317581 - DNA, 25 bp, Mus musculus
cagcttcatacgtgtaacaattttc

SEQ ID NO: 317582 - DNA, 25 bp, Mus musculus
cagcttcatagaaggaggtctcctt

SEQ ID NO: 317583 - DNA, 25 bp, Mus musculus
cagcttcatagatggaggtctcctt

SEQ ID NO: 317584 - DNA, 25 bp, Mus musculus
cagcttcatcccatcatggatttca

SEQ ID NO: 317585 - DNA, 25 bp, Mus musculus
cagcttcatcccttcatggatttca

SEQ ID NO: 317586 - DNA, 25 bp, Mus musculus
cagcttcattccaggtatgcttgcg

SEQ ID NO: 317587 - DNA, 25 bp, Mus musculus
cagcttcattcctggtatgcttgcg

SEQ ID NO: 317588 - DNA, 25 bp, Mus musculus
cagcttcattgcatgtaatgtagac

SEQ ID NO: 317589 - DNA, 25 bp, Mus musculus
cagcttcattgcttgtaatgtagac

SEQ ID NO: 317590 - DNA, 25 bp, Mus musculus
cagcttcattttactaaactacaaa

SEQ ID NO: 317591 - DNA, 25 bp, Mus musculus
cagcttcatttttctaaactacaaa

SEQ ID NO: 317592 - DNA, 25 bp, Mus musculus
cagcttccaccacaaacgttgttgg

SEQ ID NO: 317593 - DNA, 25 bp, Mus musculus
cagcttccaccagaaacgttgttgg

SEQ ID NO: 317594 - DNA, 25 bp, Mus musculus
cagcttccagaacgatgcttaccaa

SEQ ID NO: 317595 - DNA, 25 bp, Mus musculus
cagcttccagaaggatgcttaccaa

SEQ ID NO: 317596 - DNA, 25 bp, Mus musculus
cagcttccagatatgctggctcaga

SEQ ID NO: 317597 - DNA, 25 bp, Mus musculus
cagcttccagatccgagactatgtg

SEQ ID NO: 317598 - DNA, 25 bp, Mus musculus
cagcttccagatgcgagactatgtg

SEQ ID NO: 317599 - DNA, 25 bp, Mus musculus
cagcttccagatttgctggctcaga

SEQ ID NO: 317600 - DNA, 25 bp, Mus musculus
cagcttccagctacctaattgaaaa

SEQ ID NO: 317601 - DNA, 25 bp, Mus musculus
cagcttccagctagcaatgattgct

SEQ ID NO: 317602 - DNA, 25 bp, Mus musculus
cagcttccagcttcctaattgaaaa

SEQ ID NO: 317603 - DNA, 25 bp, Mus musculus
cagcttccagcttgcaatgattgct

SEQ ID NO: 317604 - DNA, 25 bp, Mus musculus
cagcttccaggacagggcgccaaag

SEQ ID NO: 317605 - DNA, 25 bp, Mus musculus
cagcttccaggagagggcgccaaag

SEQ ID NO: 317606 - DNA, 25 bp, Mus musculus
cagcttccaggcattgtagggagac

SEQ ID NO: 317607 - DNA, 25 bp, Mus musculus
cagcttccaggctttgtagggagac

SEQ ID NO: 317608 - DNA, 25 bp, Mus musculus
cagcttcccaagaaacgtggattac

SEQ ID NO: 317609 - DNA, 25 bp, Mus musculus
cagcttcccaagtaacgtggattac

SEQ ID NO: 317610 - DNA, 25 bp, Mus musculus
cagcttccccagatgtgatactcaa

SEQ ID NO: 317611 - DNA, 25 bp, Mus musculus
cagcttccccagttgtgatactcaa

SEQ ID NO: 317612 - DNA, 25 bp, Mus musculus
cagcttcccctgagtgtttgtttat

SEQ ID NO: 317613 - DNA, 25 bp, Mus musculus
cagcttcccctgtgtgtttgtttat

SEQ ID NO: 317614 - DNA, 25 bp, Mus musculus
cagcttccctagcaagtcggtggct

SEQ ID NO: 317615 - DNA, 25 bp, Mus musculus
cagcttccctaggaagtcggtggct

SEQ ID NO: 317616 - DNA, 25 bp, Mus musculus
cagcttcctcgtcgcagagcaaaag

SEQ ID NO: 317617 - DNA, 25 bp, Mus musculus
cagcttcctcgtcggccataggtga

SEQ ID NO: 317618 - DNA, 25 bp, Mus musculus
cagcttcctcgtggcagagcaaaag

SEQ ID NO: 317619 - DNA, 25 bp, Mus musculus
cagcttcctcgtgggccataggtga

SEQ ID NO: 317620 - DNA, 25 bp, Mus musculus
cagcttcctgagagaggtgattgca

SEQ ID NO: 317621 - DNA, 25 bp, Mus musculus
cagcttcctgagatttcccaaggat

SEQ ID NO: 317622 - DNA, 25 bp, Mus musculus
cagcttcctgagtgaggtgattgca

SEQ ID NO: 317623 - DNA, 25 bp, Mus musculus
cagcttcctgagttttcccaaggat

SEQ ID NO: 317624 - DNA, 25 bp, Mus musculus
cagcttcctggcatttttctgtgtt

SEQ ID NO: 317625 - DNA, 25 bp, Mus musculus
cagcttcctggcttttttctgtgtt

SEQ ID NO: 317626 - DNA, 25 bp, Mus musculus
cagcttcctgtgctaccaaggagtt

SEQ ID NO: 317627 - DNA, 25 bp, Mus musculus
cagcttcctgtggtaccaaggagtt

SEQ ID NO: 317628 - DNA, 25 bp, Mus musculus
cagcttccttcaatgaacttgctat

SEQ ID NO: 317629 - DNA, 25 bp, Mus musculus
cagcttccttcattgaacttgctat

SEQ ID NO: 317630 - DNA, 25 bp, Mus musculus
cagcttcgagtgcagaagccagcga

SEQ ID NO: 317631 - DNA, 25 bp, Mus musculus
cagcttcgagtggagaagccagcga

SEQ ID NO: 317632 - DNA, 25 bp, Mus musculus
cagcttcgcgcacggtggacagata

SEQ ID NO: 317633 - DNA, 25 bp, Mus musculus
cagcttcgcgcagggtggacagata

SEQ ID NO: 317634 - DNA, 25 bp, Mus musculus
cagcttcgcggcatatattttgttt

SEQ ID NO: 317635 - DNA, 25 bp, Mus musculus
cagcttcgcggcttatattttgttt

SEQ ID NO: 317636 - DNA, 25 bp, Mus musculus
cagcttcggcttcttttattgtcca

SEQ ID NO: 317637 - DNA, 25 bp, Mus musculus
cagcttcggcttgttttattgtcca

SEQ ID NO: 317638 - DNA, 25 bp, Mus musculus
cagcttcgtcatcgagaggatccga

SEQ ID NO: 317639 - DNA, 25 bp, Mus musculus
cagcttcgtcatggagaggatccga

SEQ ID NO: 317640 - DNA, 25 bp, Mus musculus
cagcttcgtcgaagacctcagcagg

SEQ ID NO: 317641 - DNA, 25 bp, Mus musculus
cagcttcgtcgatgacctcagcagg

SEQ ID NO: 317642 - DNA, 25 bp, Mus musculus
cagcttctcaacagaagacttgcag

SEQ ID NO: 317643 - DNA, 25 bp, Mus musculus
cagcttctcaactgaagacttgcag

SEQ ID NO: 317644 - DNA, 25 bp, Mus musculus
cagcttctcataatgtcactggaaa

SEQ ID NO: 317645 - DNA, 25 bp, Mus musculus
cagcttctcatattgtcactggaaa

SEQ ID NO: 317646 - DNA, 25 bp, Mus musculus
cagcttctccaactgtgctcagaaa

SEQ ID NO: 317647 - DNA, 25 bp, Mus musculus
cagcttctccaagtgtgctcagaaa

SEQ ID NO: 317648 - DNA, 25 bp, Mus musculus
cagcttctcgctcgcagaagatgag

SEQ ID NO: 317649 - DNA, 25 bp, Mus musculus
cagcttctcgctggcagaagatgag

SEQ ID NO: 317650 - DNA, 25 bp, Mus musculus
cagcttctctctcatttcaaataca

SEQ ID NO: 317651 - DNA, 25 bp, Mus musculus
cagcttctctctgatttcaaataca

SEQ ID NO: 317652 - DNA, 25 bp, Mus musculus
cagcttctgatacccagaccaggaa

SEQ ID NO: 317653 - DNA, 25 bp, Mus musculus
cagcttctgatagccagaccaggaa

SEQ ID NO: 317654 - DNA, 25 bp, Mus musculus
cagcttctgcagaacaggatgtgtg

SEQ ID NO: 317655 - DNA, 25 bp, Mus musculus
cagcttctgcagtacaggatgtgtg

SEQ ID NO: 317656 - DNA, 25 bp, Mus musculus
cagcttctggaaatggcccgcaaaa

SEQ ID NO: 317657 - DNA, 25 bp, Mus musculus
cagcttctggaattggcccgcaaaa

SEQ ID NO: 317658 - DNA, 25 bp, Mus musculus
cagcttctgtaaaatgcatactaca

SEQ ID NO: 317659 - DNA, 25 bp, Mus musculus
cagcttctgtaatatgcatactaca

SEQ ID NO: 317660 - DNA, 25 bp, Mus musculus
cagcttctgttgagattctcaaact

SEQ ID NO: 317661 - DNA, 25 bp, Mus musculus
cagcttctgttgtgattctcaaact

SEQ ID NO: 317662 - DNA, 25 bp, Mus musculus
cagcttctgtttcttttggagggtg

SEQ ID NO: 317663 - DNA, 25 bp, Mus musculus
cagcttctgtttgttttggagggtg

SEQ ID NO: 317664 - DNA, 25 bp, Mus musculus
cagcttcttcgacggtatcttgcgc

SEQ ID NO: 317665 - DNA, 25 bp, Mus musculus
cagcttcttcgagggtatcttgcgc

SEQ ID NO: 317666 - DNA, 25 bp, Mus musculus
cagcttcttcgcagctttgatggaa

SEQ ID NO: 317667 - DNA, 25 bp, Mus musculus
cagcttcttcgctgctttgatggaa

SEQ ID NO: 317668 - DNA, 25 bp, Mus musculus
cagcttcttcgtcttcttttttgta

SEQ ID NO: 317669 - DNA, 25 bp, Mus musculus
cagcttcttcgtgttcttttttgta

SEQ ID NO: 317670 - DNA, 25 bp, Mus musculus
cagcttcttgtcactttatactaaa

SEQ ID NO: 317671 - DNA, 25 bp, Mus musculus
cagcttcttgtctctttatactaaa

SEQ ID NO: 317672 - DNA, 25 bp, Mus musculus
cagcttcttgtgatttcgagcggct

SEQ ID NO: 317673 - DNA, 25 bp, Mus musculus
cagcttcttgtgttttcgagcggct

SEQ ID NO: 317674 - DNA, 25 bp, Mus musculus
cagcttgacaaacggcatccatcca

SEQ ID NO: 317675 - DNA, 25 bp, Mus musculus
cagcttgacaaagggcatccatcca

SEQ ID NO: 317676 - DNA, 25 bp, Mus musculus
cagcttgaccgaaggctgtgtgtga

SEQ ID NO: 317677 - DNA, 25 bp, Mus musculus
cagcttgaccgatggctgtgtgtga

SEQ ID NO: 317678 - DNA, 25 bp, Mus musculus
cagcttgactctcgttggatgttca

SEQ ID NO: 317679 - DNA, 25 bp, Mus musculus
cagcttgactctggttggatgttca

SEQ ID NO: 317680 - DNA, 25 bp, Mus musculus
cagcttgagatccttgtgcctcagt

SEQ ID NO: 317681 - DNA, 25 bp, Mus musculus
cagcttgagatcgttgtgcctcagt

SEQ ID NO: 317682 - DNA, 25 bp, Mus musculus
cagcttgatgggacaactccaattt

SEQ ID NO: 317683 - DNA, 25 bp, Mus musculus
cagcttgatgggtcaactccaattt

SEQ ID NO: 317684 - DNA, 25 bp, Mus musculus
cagcttgcctgacctgaaacattca

SEQ ID NO: 317685 - DNA, 25 bp, Mus musculus
cagcttgcctgagctgaaacattca

SEQ ID NO: 317686 - DNA, 25 bp, Mus musculus
cagcttgcctgtacaaatggtttac

SEQ ID NO: 317687 - DNA, 25 bp, Mus musculus
cagcttgcctgttcaaatggtttac

SEQ ID NO: 317688 - DNA, 25 bp, Mus musculus
cagcttgctaggaagagttcttgcc

SEQ ID NO: 317689 - DNA, 25 bp, Mus musculus
cagcttgctaggtagagttcttgcc

SEQ ID NO: 317690 - DNA, 25 bp, Mus musculus
cagcttgctgtactttaatgtgaga

SEQ ID NO: 317691 - DNA, 25 bp, Mus musculus
cagcttgctgtagtttaatgtgaga

SEQ ID NO: 317692 - DNA, 25 bp, Mus musculus
cagcttgctgtcaccatgaacctct

SEQ ID NO: 317693 - DNA, 25 bp, Mus musculus
cagcttgctgtctccatgaacctct

SEQ ID NO: 317694 - DNA, 25 bp, Mus musculus
cagcttgcttcaagttctgatacaa

SEQ ID NO: 317695 - DNA, 25 bp, Mus musculus
cagcttgcttcatgttctgatacaa

SEQ ID NO: 317696 - DNA, 25 bp, Mus musculus
cagcttgcttgacagcgactgttct

SEQ ID NO: 317697 - DNA, 25 bp, Mus musculus
cagcttgcttgagagcgactgttct

SEQ ID NO: 317698 - DNA, 25 bp, Mus musculus
cagcttgcttggaggcccaagtatt

SEQ ID NO: 317699 - DNA, 25 bp, Mus musculus
cagcttgcttggtggcccaagtatt

SEQ ID NO: 317700 - DNA, 25 bp, Mus musculus
cagcttgctttcctctttcagtgga

SEQ ID NO: 317701 - DNA, 25 bp, Mus musculus
cagcttgctttcgtctttcagtgga

SEQ ID NO: 317702 - DNA, 25 bp, Mus musculus
cagcttggaaggcttgactctgcaa

SEQ ID NO: 317703 - DNA, 25 bp, Mus musculus
cagcttggaagggttgactctgcaa

SEQ ID NO: 317704 - DNA, 25 bp, Mus musculus
cagcttggacacacgttatcagtta

SEQ ID NO: 317705 - DNA, 25 bp, Mus musculus
cagcttggacactcgttatcagtta

SEQ ID NO: 317706 - DNA, 25 bp, Mus musculus
cagcttggacctatctctctttttt

SEQ ID NO: 317707 - DNA, 25 bp, Mus musculus
cagcttggacctttctctctttttt

SEQ ID NO: 317708 - DNA, 25 bp, Mus musculus
cagcttggatttattagatgggaac

SEQ ID NO: 317709 - DNA, 25 bp, Mus musculus
cagcttggattttttagatgggaac

SEQ ID NO: 317710 - DNA, 25 bp, Mus musculus
cagcttggcaatatcccgggagtga

SEQ ID NO: 317711 - DNA, 25 bp, Mus musculus
cagcttggcaatttcccgggagtga

SEQ ID NO: 317712 - DNA, 25 bp, Mus musculus
cagcttggcatcatgctaaaggcgt

SEQ ID NO: 317713 - DNA, 25 bp, Mus musculus
cagcttggcatcttgctaaaggcgt

SEQ ID NO: 317714 - DNA, 25 bp, Mus musculus
cagcttggccaccagtgattggata

SEQ ID NO: 317715 - DNA, 25 bp, Mus musculus
cagcttggccacgagtgattggata

SEQ ID NO: 317716 - DNA, 25 bp, Mus musculus
cagcttggcgacagcactgtagcaa

SEQ ID NO: 317717 - DNA, 25 bp, Mus musculus
cagcttggcgactgcactgtagcaa

SEQ ID NO: 317718 - DNA, 25 bp, Mus musculus
cagcttggctacataggtggacata

SEQ ID NO: 317719 - DNA, 25 bp, Mus musculus
cagcttggctacttaggtggacata

SEQ ID NO: 317720 - DNA, 25 bp, Mus musculus
cagcttggctccaggtcggtgtgat

SEQ ID NO: 317721 - DNA, 25 bp, Mus musculus
cagcttggctcctggtcggtgtgat

SEQ ID NO: 317722 - DNA, 25 bp, Mus musculus
cagcttggctctcctgagaacagac

SEQ ID NO: 317723 - DNA, 25 bp, Mus musculus
cagcttggctctgctgagaacagac

SEQ ID NO: 317724 - DNA, 25 bp, Mus musculus
cagcttgggaggaattcataatgaa

SEQ ID NO: 317725 - DNA, 25 bp, Mus musculus
cagcttgggaggtattcataatgaa

SEQ ID NO: 317726 - DNA, 25 bp, Mus musculus
cagcttgggttaaattgactttcta

SEQ ID NO: 317727 - DNA, 25 bp, Mus musculus
cagcttgggttaagatattggcaac

SEQ ID NO: 317728 - DNA, 25 bp, Mus musculus
cagcttgggttatattgactttcta

SEQ ID NO: 317729 - DNA, 25 bp, Mus musculus
cagcttgggttatgatattggcaac

SEQ ID NO: 317730 - DNA, 25 bp, Mus musculus
cagcttggtgttcggtgcttgatta

SEQ ID NO: 317731 - DNA, 25 bp, Mus musculus
cagcttggtgttgggtgcttgatta

SEQ ID NO: 317732 - DNA, 25 bp, Mus musculus
cagcttggttggacttgccccgttc

SEQ ID NO: 317733 - DNA, 25 bp, Mus musculus
cagcttggttggtcttgccccgttc

SEQ ID NO: 317734 - DNA, 25 bp, Mus musculus
cagcttgtacaacttctgggttcaa

SEQ ID NO: 317735 - DNA, 25 bp, Mus musculus
cagcttgtacaagttctgggttcaa

SEQ ID NO: 317736 - DNA, 25 bp, Mus musculus
cagcttgtacccagtgaccaataaa

SEQ ID NO: 317737 - DNA, 25 bp, Mus musculus
cagcttgtaccctgtgaccaataaa

SEQ ID NO: 317738 - DNA, 25 bp, Mus musculus
cagcttgtactgagctctgtgctag

SEQ ID NO: 317739 - DNA, 25 bp, Mus musculus
cagcttgtactgtgctctgtgctag

SEQ ID NO: 317740 - DNA, 25 bp, Mus musculus
cagcttgtagaaacctttttgcctt

SEQ ID NO: 317741 - DNA, 25 bp, Mus musculus
cagcttgtagaatcctttttgcctt

SEQ ID NO: 317742 - DNA, 25 bp, Mus musculus
cagcttgtcatcaggaagatccgag

SEQ ID NO: 317743 - DNA, 25 bp, Mus musculus
cagcttgtcatctggaagatccgag

SEQ ID NO: 317744 - DNA, 25 bp, Mus musculus
cagcttgtctgtccaaccgtgaatg

SEQ ID NO: 317745 - DNA, 25 bp, Mus musculus
cagcttgtctgtgcaaccgtgaatg

SEQ ID NO: 317746 - DNA, 25 bp, Mus musculus
cagcttgtcttcatagtgagttcca

SEQ ID NO: 317747 - DNA, 25 bp, Mus musculus
cagcttgtcttcttagtgagttcca

SEQ ID NO: 317748 - DNA, 25 bp, Mus musculus
cagcttgtcttgatgtttgggtgga

SEQ ID NO: 317749 - DNA, 25 bp, Mus musculus
cagcttgtcttgttgtttgggtgga

SEQ ID NO: 317750 - DNA, 25 bp, Mus musculus
cagcttgtgagtagtctatgacttt

SEQ ID NO: 317751 - DNA, 25 bp, Mus musculus
cagcttgtgagttgtctatgacttt

SEQ ID NO: 317752 - DNA, 25 bp, Mus musculus
cagcttgtggtgactatgggccaga

SEQ ID NO: 317753 - DNA, 25 bp, Mus musculus
cagcttgtggtgtctatgggccaga

SEQ ID NO: 317754 - DNA, 25 bp, Mus musculus
cagcttgtgtgactgtatttctgga

SEQ ID NO: 317755 - DNA, 25 bp, Mus musculus
cagcttgtgtgagtgtatttctgga

SEQ ID NO: 317756 - DNA, 25 bp, Mus musculus
cagcttgttaagcatctcatcaaaa

SEQ ID NO: 317757 - DNA, 25 bp, Mus musculus
cagcttgttaaggatctcatcaaaa

SEQ ID NO: 317758 - DNA, 25 bp, Mus musculus
cagcttgttagtcttgggttcttac

SEQ ID NO: 317759 - DNA, 25 bp, Mus musculus
cagcttgttagtgttgggttcttac

SEQ ID NO: 317760 - DNA, 25 bp, Mus musculus
cagcttgtttgacgaagtgaggcaa

SEQ ID NO: 317761 - DNA, 25 bp, Mus musculus
cagcttgtttgaggaagtgaggcaa

SEQ ID NO: 317762 - DNA, 25 bp, Mus musculus
cagctttaaccaaagccgcagataa

SEQ ID NO: 317763 - DNA, 25 bp, Mus musculus
cagctttaaccatagccgcagataa

SEQ ID NO: 317764 - DNA, 25 bp, Mus musculus
cagctttaactacagctctaataaa

SEQ ID NO: 317765 - DNA, 25 bp, Mus musculus
cagctttaactagagctctaataaa

SEQ ID NO: 317766 - DNA, 25 bp, Mus musculus
cagctttaactgctccttggatatg

SEQ ID NO: 317767 - DNA, 25 bp, Mus musculus
cagctttaactggtccttggatatg

SEQ ID NO: 317768 - DNA, 25 bp, Mus musculus
cagctttaccagcacagtttctcag

SEQ ID NO: 317769 - DNA, 25 bp, Mus musculus
cagctttaccaggacagtttctcag

SEQ ID NO: 317770 - DNA, 25 bp, Mus musculus
cagctttaccctagagccgagtata

SEQ ID NO: 317771 - DNA, 25 bp, Mus musculus
cagctttacccttgagccgagtata

SEQ ID NO: 317772 - DNA, 25 bp, Mus musculus
cagctttactttagctacatgaaga

SEQ ID NO: 317773 - DNA, 25 bp, Mus musculus
cagctttacttttgctacatgaaga

SEQ ID NO: 317774 - DNA, 25 bp, Mus musculus
cagctttagcggcatcaggacagct

SEQ ID NO: 317775 - DNA, 25 bp, Mus musculus
cagctttagcgggatcaggacagct

SEQ ID NO: 317776 - DNA, 25 bp, Mus musculus
cagctttatataaaactctggcggg

SEQ ID NO: 317777 - DNA, 25 bp, Mus musculus
cagctttatatataactctggcggg

SEQ ID NO: 317778 - DNA, 25 bp, Mus musculus
cagctttattcaatgcttctggata

SEQ ID NO: 317779 - DNA, 25 bp, Mus musculus
cagctttattcattgcttctggata

SEQ ID NO: 317780 - DNA, 25 bp, Mus musculus
cagctttattccatccttaaccata

SEQ ID NO: 317781 - DNA, 25 bp, Mus musculus
cagctttattccttccttaaccata

SEQ ID NO: 317782 - DNA, 25 bp, Mus musculus
cagctttattcgatcccaggtataa

SEQ ID NO: 317783 - DNA, 25 bp, Mus musculus
cagctttattcgttcccaggtataa

SEQ ID NO: 317784 - DNA, 25 bp, Mus musculus
cagctttcacaaccaggccggacat

SEQ ID NO: 317785 - DNA, 25 bp, Mus musculus
cagctttcacaagcaggccggacat

SEQ ID NO: 317786 - DNA, 25 bp, Mus musculus
cagctttcacagaaaagtccggatt

SEQ ID NO: 317787 - DNA, 25 bp, Mus musculus
cagctttcacagtaaagtccggatt

SEQ ID NO: 317788 - DNA, 25 bp, Mus musculus
cagctttcacctcgtgagaatccca

SEQ ID NO: 317789 - DNA, 25 bp, Mus musculus
cagctttcacctggtgagaatccca

SEQ ID NO: 317790 - DNA, 25 bp, Mus musculus
cagctttcactcataccttaacggt

SEQ ID NO: 317791 - DNA, 25 bp, Mus musculus
cagctttcactcttaccttaacggt

SEQ ID NO: 317792 - DNA, 25 bp, Mus musculus
cagctttcagcaagtacctttggta

SEQ ID NO: 317793 - DNA, 25 bp, Mus musculus
cagctttcagcatgtacctttggta

SEQ ID NO: 317794 - DNA, 25 bp, Mus musculus
cagctttcagttacaattgagtaca

SEQ ID NO: 317795 - DNA, 25 bp, Mus musculus
cagctttcagtttcaattgagtaca

SEQ ID NO: 317796 - DNA, 25 bp, Mus musculus
cagctttcatctctgtgagtcgaca

SEQ ID NO: 317797 - DNA, 25 bp, Mus musculus
cagctttcatctgtgtgagtcgaca

SEQ ID NO: 317798 - DNA, 25 bp, Mus musculus
cagctttcatgtccagactgagcat

SEQ ID NO: 317799 - DNA, 25 bp, Mus musculus
cagctttcatgtgcagactgagcat

SEQ ID NO: 317800 - DNA, 25 bp, Mus musculus
cagctttccaacacagatgtatttt

SEQ ID NO: 317801 - DNA, 25 bp, Mus musculus
cagctttccaacacggaggtcattg

SEQ ID NO: 317802 - DNA, 25 bp, Mus musculus
cagctttccaactcagatgtatttt

SEQ ID NO: 317803 - DNA, 25 bp, Mus musculus
cagctttccaactcggaggtcattg

SEQ ID NO: 317804 - DNA, 25 bp, Mus musculus
cagctttccaatccactataacttg

SEQ ID NO: 317805 - DNA, 25 bp, Mus musculus
cagctttccaatgcactataacttg

SEQ ID NO: 317806 - DNA, 25 bp, Mus musculus
cagctttccacaagacattcacagt

SEQ ID NO: 317807 - DNA, 25 bp, Mus musculus
cagctttccacatgacattcacagt

SEQ ID NO: 317808 - DNA, 25 bp, Mus musculus
cagctttccagccttttggagtttt

SEQ ID NO: 317809 - DNA, 25 bp, Mus musculus
cagctttccagcgttttggagtttt

SEQ ID NO: 317810 - DNA, 25 bp, Mus musculus
cagctttccccgattaaagatcttg

SEQ ID NO: 317811 - DNA, 25 bp, Mus musculus
cagctttccccgtttaaagatcttg

SEQ ID NO: 317812 - DNA, 25 bp, Mus musculus
cagctttccctaccagaggtttttt

SEQ ID NO: 317813 - DNA, 25 bp, Mus musculus
cagctttccctagcagaggtttttt

SEQ ID NO: 317814 - DNA, 25 bp, Mus musculus
cagctttccctcacatgcagtgaga

SEQ ID NO: 317815 - DNA, 25 bp, Mus musculus
cagctttccctctcatgcagtgaga

SEQ ID NO: 317816 - DNA, 25 bp, Mus musculus
cagctttcccttctcaagttatttt

SEQ ID NO: 317817 - DNA, 25 bp, Mus musculus
cagctttcccttgtcaagttatttt

SEQ ID NO: 317818 - DNA, 25 bp, Mus musculus
cagctttccgtgaggtggataccga

SEQ ID NO: 317819 - DNA, 25 bp, Mus musculus
cagctttccgtgtggtggataccga

SEQ ID NO: 317820 - DNA, 25 bp, Mus musculus
cagctttcctacctgggatgagttt

SEQ ID NO: 317821 - DNA, 25 bp, Mus musculus
cagctttcctacgtgggatgagttt

SEQ ID NO: 317822 - DNA, 25 bp, Mus musculus
cagctttccttgagacccaggtttt

SEQ ID NO: 317823 - DNA, 25 bp, Mus musculus
cagctttccttgtgacccaggtttt

SEQ ID NO: 317824 - DNA, 25 bp, Mus musculus
cagctttctaatattaccccagtgg

SEQ ID NO: 317825 - DNA, 25 bp, Mus musculus
cagctttctaattttaccccagtgg

SEQ ID NO: 317826 - DNA, 25 bp, Mus musculus
cagctttctcctagtgtgctcagaa

SEQ ID NO: 317827 - DNA, 25 bp, Mus musculus
cagctttctccttgtgtgctcagaa

SEQ ID NO: 317828 - DNA, 25 bp, Mus musculus
cagctttctgcccaggtatttaggt

SEQ ID NO: 317829 - DNA, 25 bp, Mus musculus
cagctttctgccgaggtatttaggt

SEQ ID NO: 317830 - DNA, 25 bp, Mus musculus
cagctttctgtactaccatatggga

SEQ ID NO: 317831 - DNA, 25 bp, Mus musculus
cagctttctgtagtaccatatggga

SEQ ID NO: 317832 - DNA, 25 bp, Mus musculus
cagctttcttacagctccatgtgct

SEQ ID NO: 317833 - DNA, 25 bp, Mus musculus
cagctttcttactgctccatgtgct

SEQ ID NO: 317834 - DNA, 25 bp, Mus musculus
cagctttgaattcccgctctgtaga

SEQ ID NO: 317835 - DNA, 25 bp, Mus musculus
cagctttgaattgccgctctgtaga

SEQ ID NO: 317836 - DNA, 25 bp, Mus musculus
cagctttgacggaaccgtatgggtt

SEQ ID NO: 317837 - DNA, 25 bp, Mus musculus
cagctttgacggtaccgtatgggtt

SEQ ID NO: 317838 - DNA, 25 bp, Mus musculus
cagctttgagaaccccttggcccaa

SEQ ID NO: 317839 - DNA, 25 bp, Mus musculus
cagctttgagaagcccttggcccaa

SEQ ID NO: 317840 - DNA, 25 bp, Mus musculus
cagctttgagacaagtgcctatgtg

SEQ ID NO: 317841 - DNA, 25 bp, Mus musculus
cagctttgagactagtgcctatgtg

SEQ ID NO: 317842 - DNA, 25 bp, Mus musculus
cagctttgatgtatgacccctcact

SEQ ID NO: 317843 - DNA, 25 bp, Mus musculus
cagctttgatgtttgacccctcact

SEQ ID NO: 317844 - DNA, 25 bp, Mus musculus
cagctttgctgaagccatagtgggc

SEQ ID NO: 317845 - DNA, 25 bp, Mus musculus
cagctttgctgacagaggccaaccc

SEQ ID NO: 317846 - DNA, 25 bp, Mus musculus
cagctttgctgagagaggccaaccc

SEQ ID NO: 317847 - DNA, 25 bp, Mus musculus
cagctttgctgatgccatagtgggc

SEQ ID NO: 317848 - DNA, 25 bp, Mus musculus
cagctttggaaaatgctgcttccac

SEQ ID NO: 317849 - DNA, 25 bp, Mus musculus
cagctttggaaattgctgcttccac

SEQ ID NO: 317850 - DNA, 25 bp, Mus musculus
cagctttgggagaagaataaacctg

SEQ ID NO: 317851 - DNA, 25 bp, Mus musculus
cagctttgggagtagaataaacctg

SEQ ID NO: 317852 - DNA, 25 bp, Mus musculus
cagctttgggatcactgcttataaa

SEQ ID NO: 317853 - DNA, 25 bp, Mus musculus
cagctttgggatgactgcttataaa

SEQ ID NO: 317854 - DNA, 25 bp, Mus musculus
cagctttggtttcctgctggttgtt

SEQ ID NO: 317855 - DNA, 25 bp, Mus musculus
cagctttggtttgctgctggttgtt

SEQ ID NO: 317856 - DNA, 25 bp, Mus musculus
cagctttgtacaacagcaccaagaa

SEQ ID NO: 317857 - DNA, 25 bp, Mus musculus
cagctttgtacatcagcaccaagaa

SEQ ID NO: 317858 - DNA, 25 bp, Mus musculus
cagctttgtattcatgcaggtctcc

SEQ ID NO: 317859 - DNA, 25 bp, Mus musculus
cagctttgtattgatgcaggtctcc

SEQ ID NO: 317860 - DNA, 25 bp, Mus musculus
cagctttgtggtcaatctgaggcca

SEQ ID NO: 317861 - DNA, 25 bp, Mus musculus
cagctttgtggtgaatctgaggcca

SEQ ID NO: 317862 - DNA, 25 bp, Mus musculus
cagctttgtgttacctgttcaactg

SEQ ID NO: 317863 - DNA, 25 bp, Mus musculus
cagctttgtgtttcctgttcaactg

SEQ ID NO: 317864 - DNA, 25 bp, Mus musculus
cagctttgtttcagaatggctataa

SEQ ID NO: 317865 - DNA, 25 bp, Mus musculus
cagctttgtttctgaatggctataa

SEQ ID NO: 317866 - DNA, 25 bp, Mus musculus
cagcttttacgacgtgtccagttgt

SEQ ID NO: 317867 - DNA, 25 bp, Mus musculus
cagcttttacgaggtgtccagttgt

SEQ ID NO: 317868 - DNA, 25 bp, Mus musculus
cagcttttacttcagcaccacacaa

SEQ ID NO: 317869 - DNA, 25 bp, Mus musculus
cagcttttacttgagcaccacacaa

SEQ ID NO: 317870 - DNA, 25 bp, Mus musculus
cagcttttagagacccagggtgggg

SEQ ID NO: 317871 - DNA, 25 bp, Mus musculus
cagcttttagagtcccagggtgggg

SEQ ID NO: 317872 - DNA, 25 bp, Mus musculus
cagcttttccttctagtgtgaattt

SEQ ID NO: 317873 - DNA, 25 bp, Mus musculus
cagcttttccttgtagtgtgaattt

SEQ ID NO: 317874 - DNA, 25 bp, Mus musculus
cagcttttctccctggaaatctaat

SEQ ID NO: 317875 - DNA, 25 bp, Mus musculus
cagcttttctccgtggaaatctaat

SEQ ID NO: 317876 - DNA, 25 bp, Mus musculus
cagcttttctcgaggtcatgtggaa

SEQ ID NO: 317877 - DNA, 25 bp, Mus musculus
cagcttttctcgtggtcatgtggaa

SEQ ID NO: 317878 - DNA, 25 bp, Mus musculus
cagcttttctggactacaatctttc

SEQ ID NO: 317879 - DNA, 25 bp, Mus musculus
cagcttttctggtctacaatctttc

SEQ ID NO: 317880 - DNA, 25 bp, Mus musculus
cagcttttcttgataggcctagtac

SEQ ID NO: 317881 - DNA, 25 bp, Mus musculus
cagcttttcttgttaggcctagtac

SEQ ID NO: 317882 - DNA, 25 bp, Mus musculus
cagcttttggacacattaattcaag

SEQ ID NO: 317883 - DNA, 25 bp, Mus musculus
cagcttttggactcattaattcaag

SEQ ID NO: 317884 - DNA, 25 bp, Mus musculus
cagcttttggcgcagaccagtttga

SEQ ID NO: 317885 - DNA, 25 bp, Mus musculus
cagcttttggcggagaccagtttga

SEQ ID NO: 317886 - DNA, 25 bp, Mus musculus
cagcttttggttatcattgggcatg

SEQ ID NO: 317887 - DNA, 25 bp, Mus musculus
cagcttttggttttcattgggcatg

SEQ ID NO: 317888 - DNA, 25 bp, Mus musculus
cagcttttgtgaagtttcaaattaa

SEQ ID NO: 317889 - DNA, 25 bp, Mus musculus
cagcttttgtgatgtttcaaattaa

SEQ ID NO: 317890 - DNA, 25 bp, Mus musculus
cagcttttgtggctttaccctgaac

SEQ ID NO: 317891 - DNA, 25 bp, Mus musculus
cagcttttgtgggtttaccctgaac

SEQ ID NO: 317892 - DNA, 25 bp, Mus musculus
cagctttttcagattgttattctca

SEQ ID NO: 317893 - DNA, 25 bp, Mus musculus
cagctttttcagtttgttattctca

SEQ ID NO: 317894 - DNA, 25 bp, Mus musculus
cagctttttcttcaccagagtgccc

SEQ ID NO: 317895 - DNA, 25 bp, Mus musculus
cagctttttcttgaccagagtgccc

SEQ ID NO: 317896 - DNA, 25 bp, Mus musculus
caggaaaacatcaaactagccatgt

SEQ ID NO: 317897 - DNA, 25 bp, Mus musculus
caggaaaacatctaactagccatgt

SEQ ID NO: 317898 - DNA, 25 bp, Mus musculus
caggaaaactatcatgtgtgcgcgc

SEQ ID NO: 317899 - DNA, 25 bp, Mus musculus
caggaaaactatgatgtgtgcgcgc

SEQ ID NO: 317900 - DNA, 25 bp, Mus musculus
caggaaaactggaactcagctccct

SEQ ID NO: 317901 - DNA, 25 bp, Mus musculus
caggaaaactggtactcagctccct

SEQ ID NO: 317902 - DNA, 25 bp, Mus musculus
caggaaaagaagctccagccaaggt

SEQ ID NO: 317903 - DNA, 25 bp, Mus musculus
caggaaaagaaggtccagccaaggt

SEQ ID NO: 317904 - DNA, 25 bp, Mus musculus
caggaaaagcgacgcttcgtttgtt

SEQ ID NO: 317905 - DNA, 25 bp, Mus musculus
caggaaaagcgaggcttcgtttgtt

SEQ ID NO: 317906 - DNA, 25 bp, Mus musculus
caggaaaagcgtcgccattttcaaa

SEQ ID NO: 317907 - DNA, 25 bp, Mus musculus
caggaaaagcgtggccattttcaaa

SEQ ID NO: 317908 - DNA, 25 bp, Mus musculus
caggaaaaggcgatcggcacacggt

SEQ ID NO: 317909 - DNA, 25 bp, Mus musculus
caggaaaaggcgttcggcacacggt

SEQ ID NO: 317910 - DNA, 25 bp, Mus musculus
caggaaaatggtactttctgccctt

SEQ ID NO: 317911 - DNA, 25 bp, Mus musculus
caggaaaatggtcgctctcttaata

SEQ ID NO: 317912 - DNA, 25 bp, Mus musculus
caggaaaatggtggctctcttaata

SEQ ID NO: 317913 - DNA, 25 bp, Mus musculus
caggaaaatggttctttctgccctt

SEQ ID NO: 317914 - DNA, 25 bp, Mus musculus
caggaaacacagaccttagcgattt

SEQ ID NO: 317915 - DNA, 25 bp, Mus musculus
caggaaacacagtccttagcgattt

SEQ ID NO: 317916 - DNA, 25 bp, Mus musculus
caggaaacagctaccaatacacttg

SEQ ID NO: 317917 - DNA, 25 bp, Mus musculus
caggaaacagcttccaatacacttg

SEQ ID NO: 317918 - DNA, 25 bp, Mus musculus
caggaaacagtgctacctcacccag

SEQ ID NO: 317919 - DNA, 25 bp, Mus musculus
caggaaacagtggtacctcacccag

SEQ ID NO: 317920 - DNA, 25 bp, Mus musculus
caggaaaccgtaatattcttgtgaa

SEQ ID NO: 317921 - DNA, 25 bp, Mus musculus
caggaaaccgtattattcttgtgaa

SEQ ID NO: 317922 - DNA, 25 bp, Mus musculus
caggaaacgcttctggtcttggacc

SEQ ID NO: 317923 - DNA, 25 bp, Mus musculus
caggaaacgcttgtggtcttggacc

SEQ ID NO: 317924 - DNA, 25 bp, Mus musculus
caggaaactatccagccaaatactt

SEQ ID NO: 317925 - DNA, 25 bp, Mus musculus
caggaaactatcgagccaaatactt

SEQ ID NO: 317926 - DNA, 25 bp, Mus musculus
caggaaactgcaatggtctgttgtt

SEQ ID NO: 317927 - DNA, 25 bp, Mus musculus
caggaaactgcattggtctgttgtt

SEQ ID NO: 317928 - DNA, 25 bp, Mus musculus
caggaaactgctacttgacaatatg

SEQ ID NO: 317929 - DNA, 25 bp, Mus musculus
caggaaactgcttcttgacaatatg

SEQ ID NO: 317930 - DNA, 25 bp, Mus musculus
caggaaagagagacaccacgggcat

SEQ ID NO: 317931 - DNA, 25 bp, Mus musculus
caggaaagagagtcaccacgggcat

SEQ ID NO: 317932 - DNA, 25 bp, Mus musculus
caggaaagccaccactgtgtgctgt

SEQ ID NO: 317933 - DNA, 25 bp, Mus musculus
caggaaagccacgactgtgtgctgt

SEQ ID NO: 317934 - DNA, 25 bp, Mus musculus
caggaaagcccaccagaatcggaga

SEQ ID NO: 317935 - DNA, 25 bp, Mus musculus
caggaaagcccagcagaatcggaga

SEQ ID NO: 317936 - DNA, 25 bp, Mus musculus
caggaaagctttctctcgtaagtcc

SEQ ID NO: 317937 - DNA, 25 bp, Mus musculus
caggaaagctttgtctcgtaagtcc

SEQ ID NO: 317938 - DNA, 25 bp, Mus musculus
caggaaaggaccaggtaagagtaga

SEQ ID NO: 317939 - DNA, 25 bp, Mus musculus
caggaaaggacctggtaagagtaga

SEQ ID NO: 317940 - DNA, 25 bp, Mus musculus
caggaaaggattctttgtgatgcct

SEQ ID NO: 317941 - DNA, 25 bp, Mus musculus
caggaaaggattgtttgtgatgcct

SEQ ID NO: 317942 - DNA, 25 bp, Mus musculus
caggaaaggctgattcctaccttgg

SEQ ID NO: 317943 - DNA, 25 bp, Mus musculus
caggaaaggctgtttcctaccttgg

SEQ ID NO: 317944 - DNA, 25 bp, Mus musculus
caggaaaggtgtactcgggcatctc

SEQ ID NO: 317945 - DNA, 25 bp, Mus musculus
caggaaaggtgttctcgggcatctc

SEQ ID NO: 317946 - DNA, 25 bp, Mus musculus
caggaaagtccccactagcaaatgg

SEQ ID NO: 317947 - DNA, 25 bp, Mus musculus
caggaaagtcccgactagcaaatgg

SEQ ID NO: 317948 - DNA, 25 bp, Mus musculus
caggaaagtggcagtcccgagcaga

SEQ ID NO: 317949 - DNA, 25 bp, Mus musculus
caggaaagtggctgtcccgagcaga

SEQ ID NO: 317950 - DNA, 25 bp, Mus musculus
caggaaatacacatgcttccaatta

SEQ ID NO: 317951 - DNA, 25 bp, Mus musculus
caggaaatacacttgcttccaatta

SEQ ID NO: 317952 - DNA, 25 bp, Mus musculus
caggaaatcactaccctgcttggct

SEQ ID NO: 317953 - DNA, 25 bp, Mus musculus
caggaaatcacttccctgcttggct

SEQ ID NO: 317954 - DNA, 25 bp, Mus musculus
caggaaatcgaccttacaaatgcag

SEQ ID NO: 317955 - DNA, 25 bp, Mus musculus
caggaaatcgacgttacaaatgcag

SEQ ID NO: 317956 - DNA, 25 bp, Mus musculus
caggaaattataaaagtgccttttt

SEQ ID NO: 317957 - DNA, 25 bp, Mus musculus
caggaaattatataagtgccttttt

SEQ ID NO: 317958 - DNA, 25 bp, Mus musculus
caggaaatttgcaccagctgggcat

SEQ ID NO: 317959 - DNA, 25 bp, Mus musculus
caggaaatttgctccagctgggcat

SEQ ID NO: 317960 - DNA, 25 bp, Mus musculus
caggaacacgaacatctccttcaaa

SEQ ID NO: 317961 - DNA, 25 bp, Mus musculus
caggaacacgaagatctccttcaaa

SEQ ID NO: 317962 - DNA, 25 bp, Mus musculus
caggaacacgatagaaggacaaggt

SEQ ID NO: 317963 - DNA, 25 bp, Mus musculus
caggaacacgattgaaggacaaggt

SEQ ID NO: 317964 - DNA, 25 bp, Mus musculus
caggaacacggacatctctttcaag

SEQ ID NO: 317965 - DNA, 25 bp, Mus musculus
caggaacacggagatctctttcaag

SEQ ID NO: 317966 - DNA, 25 bp, Mus musculus
caggaacacttaatgccctaacctc

SEQ ID NO: 317967 - DNA, 25 bp, Mus musculus
caggaacacttattgccctaacctc

SEQ ID NO: 317968 - DNA, 25 bp, Mus musculus
caggaacagaacagtactgactgcc

SEQ ID NO: 317969 - DNA, 25 bp, Mus musculus
caggaacagaactgtactgactgcc

SEQ ID NO: 317970 - DNA, 25 bp, Mus musculus
caggaacagcatcggtaacagtgaa

SEQ ID NO: 317971 - DNA, 25 bp, Mus musculus
caggaacagcatgggtaacagtgaa

SEQ ID NO: 317972 - DNA, 25 bp, Mus musculus
caggaacagcctctgtttgccaaga

SEQ ID NO: 317973 - DNA, 25 bp, Mus musculus
caggaacagcctgtgtttgccaaga

SEQ ID NO: 317974 - DNA, 25 bp, Mus musculus
caggaacatttaatttttgagcaag

SEQ ID NO: 317975 - DNA, 25 bp, Mus musculus
caggaacatttattttttgagcaag

SEQ ID NO: 317976 - DNA, 25 bp, Mus musculus
caggaaccactcactaaggagcaaa

SEQ ID NO: 317977 - DNA, 25 bp, Mus musculus
caggaaccactctctaaggagcaaa

SEQ ID NO: 317978 - DNA, 25 bp, Mus musculus
caggaaccagcactagcagggacaa

SEQ ID NO: 317979 - DNA, 25 bp, Mus musculus
caggaaccagcagtagcagggacaa

SEQ ID NO: 317980 - DNA, 25 bp, Mus musculus
caggaacccaacacgcattgtgaat

SEQ ID NO: 317981 - DNA, 25 bp, Mus musculus
caggaacccaactcgcattgtgaat

SEQ ID NO: 317982 - DNA, 25 bp, Mus musculus
caggaacccagacacccaacgttgt

SEQ ID NO: 317983 - DNA, 25 bp, Mus musculus
caggaacccagagacccaacgttgt

SEQ ID NO: 317984 - DNA, 25 bp, Mus musculus
caggaacccagtactaaagctgctt

SEQ ID NO: 317985 - DNA, 25 bp, Mus musculus
caggaacccagttctaaagctgctt

SEQ ID NO: 317986 - DNA, 25 bp, Mus musculus
caggaacccatgctttttaggttgt

SEQ ID NO: 317987 - DNA, 25 bp, Mus musculus
caggaacccatggtttttaggttgt

SEQ ID NO: 317988 - DNA, 25 bp, Mus musculus
caggaacccctcagatgcaaggcaa

SEQ ID NO: 317989 - DNA, 25 bp, Mus musculus
caggaacccctctgatgcaaggcaa

SEQ ID NO: 317990 - DNA, 25 bp, Mus musculus
caggaaccctgcaagcacggttggt

SEQ ID NO: 317991 - DNA, 25 bp, Mus musculus
caggaaccctgctagcacggttggt

SEQ ID NO: 317992 - DNA, 25 bp, Mus musculus
caggaaccggaactcatcgcggact

SEQ ID NO: 317993 - DNA, 25 bp, Mus musculus
caggaaccggaagtcatcgcggact

SEQ ID NO: 317994 - DNA, 25 bp, Mus musculus
caggaacctcacaagtagttcttag

SEQ ID NO: 317995 - DNA, 25 bp, Mus musculus
caggaacctcactagtagttcttag

SEQ ID NO: 317996 - DNA, 25 bp, Mus musculus
caggaacgatgtcgaagggatataa

SEQ ID NO: 317997 - DNA, 25 bp, Mus musculus
caggaacgatgtggaagggatataa

SEQ ID NO: 317998 - DNA, 25 bp, Mus musculus
caggaacggaatcgccttgttgctt

SEQ ID NO: 317999 - DNA, 25 bp, Mus musculus
caggaacggaatggccttgttgctt

SEQ ID NO: 318000 - DNA, 25 bp, Mus musculus
caggaacgtctccagtagctaatag

SEQ ID NO: 318001 - DNA, 25 bp, Mus musculus
caggaacgtctcgagtagctaatag

SEQ ID NO: 318002 - DNA, 25 bp, Mus musculus
caggaacgtggccttgattgatcca

SEQ ID NO: 318003 - DNA, 25 bp, Mus musculus
caggaacgtggcgttgattgatcca

SEQ ID NO: 318004 - DNA, 25 bp, Mus musculus
caggaactacctatctgaacccgcg

SEQ ID NO: 318005 - DNA, 25 bp, Mus musculus
caggaactacctttctgaacccgcg

SEQ ID NO: 318006 - DNA, 25 bp, Mus musculus
caggaactcaatataactattattt

SEQ ID NO: 318007 - DNA, 25 bp, Mus musculus
caggaactcaatcccctctgctggg

SEQ ID NO: 318008 - DNA, 25 bp, Mus musculus
caggaactcaatgccctctgctggg

SEQ ID NO: 318009 - DNA, 25 bp, Mus musculus
caggaactcaatttaactattattt

SEQ ID NO: 318010 - DNA, 25 bp, Mus musculus
caggaactcacacaaaacccatgga

SEQ ID NO: 318011 - DNA, 25 bp, Mus musculus
caggaactcacagaaaacccatgga

SEQ ID NO: 318012 - DNA, 25 bp, Mus musculus
caggaactccttcaggccctgattt

SEQ ID NO: 318013 - DNA, 25 bp, Mus musculus
caggaactccttgaggccctgattt

SEQ ID NO: 318014 - DNA, 25 bp, Mus musculus
caggaactctcaatcatttgccaga

SEQ ID NO: 318015 - DNA, 25 bp, Mus musculus
caggaactctcattcatttgccaga

SEQ ID NO: 318016 - DNA, 25 bp, Mus musculus
caggaactctttatcctcctaggat

SEQ ID NO: 318017 - DNA, 25 bp, Mus musculus
caggaactctttttcctcctaggat

SEQ ID NO: 318018 - DNA, 25 bp, Mus musculus
caggaactgcaacatttgtgtacca

SEQ ID NO: 318019 - DNA, 25 bp, Mus musculus
caggaactgcaagatttgtgtacca

SEQ ID NO: 318020 - DNA, 25 bp, Mus musculus
caggaactgcccacctttcctaagg

SEQ ID NO: 318021 - DNA, 25 bp, Mus musculus
caggaactgccctcctttcctaagg

SEQ ID NO: 318022 - DNA, 25 bp, Mus musculus
caggaactgcctctccgaggaatga

SEQ ID NO: 318023 - DNA, 25 bp, Mus musculus
caggaactgcctgtccgaggaatga

SEQ ID NO: 318024 - DNA, 25 bp, Mus musculus
caggaactggaaccctctttgcaga

SEQ ID NO: 318025 - DNA, 25 bp, Mus musculus
caggaactggaagcctctttgcaga

SEQ ID NO: 318026 - DNA, 25 bp, Mus musculus
caggaactgtggctgctgttgcctt

SEQ ID NO: 318027 - DNA, 25 bp, Mus musculus
caggaactgtgggtgctgttgcctt

SEQ ID NO: 318028 - DNA, 25 bp, Mus musculus
caggaactgtgtagtagttacatca

SEQ ID NO: 318029 - DNA, 25 bp, Mus musculus
caggaactgtgttgtagttacatca

SEQ ID NO: 318030 - DNA, 25 bp, Mus musculus
caggaacttaccctctgacttggaa

SEQ ID NO: 318031 - DNA, 25 bp, Mus musculus
caggaacttaccgtctgacttggaa

SEQ ID NO: 318032 - DNA, 25 bp, Mus musculus
caggaacttctaagtggacggccac

SEQ ID NO: 318033 - DNA, 25 bp, Mus musculus
caggaacttctatgtggacggccac

SEQ ID NO: 318034 - DNA, 25 bp, Mus musculus
caggaacttggcagcactgaatgca

SEQ ID NO: 318035 - DNA, 25 bp, Mus musculus
caggaacttggctgcactgaatgca

SEQ ID NO: 318036 - DNA, 25 bp, Mus musculus
caggaacttgttagtgcccattcac

SEQ ID NO: 318037 - DNA, 25 bp, Mus musculus
caggaacttgtttgtgcccattcac

SEQ ID NO: 318038 - DNA, 25 bp, Mus musculus
caggaactttccctgacccaagaag

SEQ ID NO: 318039 - DNA, 25 bp, Mus musculus
caggaactttccgtgacccaagaag

SEQ ID NO: 318040 - DNA, 25 bp, Mus musculus
caggaagaacctactgcggctgcag

SEQ ID NO: 318041 - DNA, 25 bp, Mus musculus
caggaagaacctcgctcgcatgcag

SEQ ID NO: 318042 - DNA, 25 bp, Mus musculus
caggaagaacctggctcgcatgcag

SEQ ID NO: 318043 - DNA, 25 bp, Mus musculus
caggaagaaccttctgcggctgcag

SEQ ID NO: 318044 - DNA, 25 bp, Mus musculus
caggaagaccttagaagggaaagtg

SEQ ID NO: 318045 - DNA, 25 bp, Mus musculus
caggaagacctttgaagggaaagtg

SEQ ID NO: 318046 - DNA, 25 bp, Mus musculus
caggaagacggccacatgatttgtg

SEQ ID NO: 318047 - DNA, 25 bp, Mus musculus
caggaagacggcgacatgatttgtg

SEQ ID NO: 318048 - DNA, 25 bp, Mus musculus
caggaagagcttctggcatcaacca

SEQ ID NO: 318049 - DNA, 25 bp, Mus musculus
caggaagagcttgtggcatcaacca

SEQ ID NO: 318050 - DNA, 25 bp, Mus musculus
caggaagaggagacagcgcactgac

SEQ ID NO: 318051 - DNA, 25 bp, Mus musculus
caggaagaggagtcagcgcactgac

SEQ ID NO: 318052 - DNA, 25 bp, Mus musculus
caggaagagtgccagcctaggcttc

SEQ ID NO: 318053 - DNA, 25 bp, Mus musculus
caggaagagtgccgacaccctgtgg

SEQ ID NO: 318054 - DNA, 25 bp, Mus musculus
caggaagagtgcgagcctaggcttc

SEQ ID NO: 318055 - DNA, 25 bp, Mus musculus
caggaagagtgcggacaccctgtgg

SEQ ID NO: 318056 - DNA, 25 bp, Mus musculus
caggaagatctcagttcaacagctc

SEQ ID NO: 318057 - DNA, 25 bp, Mus musculus
caggaagatctctgttcaacagctc

SEQ ID NO: 318058 - DNA, 25 bp, Mus musculus
caggaagcagttaagctgtgtgaca

SEQ ID NO: 318059 - DNA, 25 bp, Mus musculus
caggaagcagttagaagccaggcag

SEQ ID NO: 318060 - DNA, 25 bp, Mus musculus
caggaagcagtttagctgtgtgaca

SEQ ID NO: 318061 - DNA, 25 bp, Mus musculus
caggaagcagtttgaagccaggcag

SEQ ID NO: 318062 - DNA, 25 bp, Mus musculus
caggaagccactaataggcccatgg

SEQ ID NO: 318063 - DNA, 25 bp, Mus musculus
caggaagccacttataggcccatgg

SEQ ID NO: 318064 - DNA, 25 bp, Mus musculus
caggaagcccctcaagggaactctt

SEQ ID NO: 318065 - DNA, 25 bp, Mus musculus
caggaagcccctgaagggaactctt

SEQ ID NO: 318066 - DNA, 25 bp, Mus musculus
caggaagccgaactgggtgtggagc

SEQ ID NO: 318067 - DNA, 25 bp, Mus musculus
caggaagccgaagtgggtgtggagc

SEQ ID NO: 318068 - DNA, 25 bp, Mus musculus
caggaagccggcactggcgtcagta

SEQ ID NO: 318069 - DNA, 25 bp, Mus musculus
caggaagccggcagagtgactgtta

SEQ ID NO: 318070 - DNA, 25 bp, Mus musculus
caggaagccggctctggcgtcagta

SEQ ID NO: 318071 - DNA, 25 bp, Mus musculus
caggaagccggctgagtgactgtta

SEQ ID NO: 318072 - DNA, 25 bp, Mus musculus
caggaagcctctcgccttaggaatt

SEQ ID NO: 318073 - DNA, 25 bp, Mus musculus
caggaagcctctggccttaggaatt

SEQ ID NO: 318074 - DNA, 25 bp, Mus musculus
caggaagcctggctgtttttgactt

SEQ ID NO: 318075 - DNA, 25 bp, Mus musculus
caggaagcctgggtgtttttgactt

SEQ ID NO: 318076 - DNA, 25 bp, Mus musculus
caggaagccttcagctccgaagaag

SEQ ID NO: 318077 - DNA, 25 bp, Mus musculus
caggaagccttctgctccgaagaag

SEQ ID NO: 318078 - DNA, 25 bp, Mus musculus
caggaagcgcgtctgcagatttttt

SEQ ID NO: 318079 - DNA, 25 bp, Mus musculus
caggaagcgcgtgtgcagatttttt

SEQ ID NO: 318080 - DNA, 25 bp, Mus musculus
caggaagctctgctttactgtcagt

SEQ ID NO: 318081 - DNA, 25 bp, Mus musculus
caggaagctctggtttactgtcagt

SEQ ID NO: 318082 - DNA, 25 bp, Mus musculus
caggaagctgaaaccgtgttggcac

SEQ ID NO: 318083 - DNA, 25 bp, Mus musculus
caggaagctgaatccgtgttggcac

SEQ ID NO: 318084 - DNA, 25 bp, Mus musculus
caggaagcttccatgcaggacagga

SEQ ID NO: 318085 - DNA, 25 bp, Mus musculus
caggaagcttccttgcaggacagga

SEQ ID NO: 318086 - DNA, 25 bp, Mus musculus
caggaaggaatgagcttagccagga

SEQ ID NO: 318087 - DNA, 25 bp, Mus musculus
caggaaggaatgtgcttagccagga

SEQ ID NO: 318088 - DNA, 25 bp, Mus musculus
caggaaggagccatggccatttttc

SEQ ID NO: 318089 - DNA, 25 bp, Mus musculus
caggaaggagccttggccatttttc

SEQ ID NO: 318090 - DNA, 25 bp, Mus musculus
caggaaggcaagctgttccaattat

SEQ ID NO: 318091 - DNA, 25 bp, Mus musculus
caggaaggcaaggtgttccaattat

SEQ ID NO: 318092 - DNA, 25 bp, Mus musculus
caggaaggccctcagctcacagaaa

SEQ ID NO: 318093 - DNA, 25 bp, Mus musculus
caggaaggccctgagctcacagaaa

SEQ ID NO: 318094 - DNA, 25 bp, Mus musculus
caggaaggccttactacaggcatat

SEQ ID NO: 318095 - DNA, 25 bp, Mus musculus
caggaaggcctttctacaggcatat

SEQ ID NO: 318096 - DNA, 25 bp, Mus musculus
caggaaggcttcatcaacctgctga

SEQ ID NO: 318097 - DNA, 25 bp, Mus musculus
caggaaggcttcttcaacctgctga

SEQ ID NO: 318098 - DNA, 25 bp, Mus musculus
caggaagggcctcattttcgtctcc

SEQ ID NO: 318099 - DNA, 25 bp, Mus musculus
caggaagggcctgattttcgtctcc

SEQ ID NO: 318100 - DNA, 25 bp, Mus musculus
caggaaggtcctagatttctaagta

SEQ ID NO: 318101 - DNA, 25 bp, Mus musculus
caggaaggtccttgatttctaagta

SEQ ID NO: 318102 - DNA, 25 bp, Mus musculus
caggaaggtcgcaagttcaaggcta

SEQ ID NO: 318103 - DNA, 25 bp, Mus musculus
caggaaggtcgctagttcaaggcta

SEQ ID NO: 318104 - DNA, 25 bp, Mus musculus
caggaaggtctccaggctctgtttg

SEQ ID NO: 318105 - DNA, 25 bp, Mus musculus
caggaaggtctcgaggctctgtttg

SEQ ID NO: 318106 - DNA, 25 bp, Mus musculus
caggaaggtctgcgtagcttttaag

SEQ ID NO: 318107 - DNA, 25 bp, Mus musculus
caggaaggtctgggtagcttttaag

SEQ ID NO: 318108 - DNA, 25 bp, Mus musculus
caggaaggtgacattctgtaatcat

SEQ ID NO: 318109 - DNA, 25 bp, Mus musculus
caggaaggtgactttctgtaatcat

SEQ ID NO: 318110 - DNA, 25 bp, Mus musculus
caggaaggttgcaaggtcagagcta

SEQ ID NO: 318111 - DNA, 25 bp, Mus musculus
caggaaggttgctaggtcagagcta

SEQ ID NO: 318112 - DNA, 25 bp, Mus musculus
caggaagtaagtacaaaccggcaga

SEQ ID NO: 318113 - DNA, 25 bp, Mus musculus
caggaagtaagttcaaaccggcaga

SEQ ID NO: 318114 - DNA, 25 bp, Mus musculus
caggaagtcacgaagacctttcaaa

SEQ ID NO: 318115 - DNA, 25 bp, Mus musculus
caggaagtcacgtagacctttcaaa

SEQ ID NO: 318116 - DNA, 25 bp, Mus musculus
caggaagtccttacatcaccaggag

SEQ ID NO: 318117 - DNA, 25 bp, Mus musculus
caggaagtcctttcatcaccaggag

SEQ ID NO: 318118 - DNA, 25 bp, Mus musculus
caggaagtcgctaatttgtcacaac

SEQ ID NO: 318119 - DNA, 25 bp, Mus musculus
caggaagtcgcttatttgtcacaac

SEQ ID NO: 318120 - DNA, 25 bp, Mus musculus
caggaagtgaacactatgtgtgtgg

SEQ ID NO: 318121 - DNA, 25 bp, Mus musculus
caggaagtgaactctatgtgtgtgg

SEQ ID NO: 318122 - DNA, 25 bp, Mus musculus
caggaagtgatgctgaccctagacc

SEQ ID NO: 318123 - DNA, 25 bp, Mus musculus
caggaagtgatggtgaccctagacc

SEQ ID NO: 318124 - DNA, 25 bp, Mus musculus
caggaagtgttcatactgtcgccag

SEQ ID NO: 318125 - DNA, 25 bp, Mus musculus
caggaagtgttcttactgtcgccag

SEQ ID NO: 318126 - DNA, 25 bp, Mus musculus
caggaagttatgagctgcccagtgt

SEQ ID NO: 318127 - DNA, 25 bp, Mus musculus
caggaagttatgtgctgcccagtgt

SEQ ID NO: 318128 - DNA, 25 bp, Mus musculus
caggaagttgcaattttccatagga

SEQ ID NO: 318129 - DNA, 25 bp, Mus musculus
caggaagttgcatttttccatagga

SEQ ID NO: 318130 - DNA, 25 bp, Mus musculus
caggaagttggaccgcaggccacac

SEQ ID NO: 318131 - DNA, 25 bp, Mus musculus
caggaagttggagcgcaggccacac

SEQ ID NO: 318132 - DNA, 25 bp, Mus musculus
caggaagtttgcactctctcatttt

SEQ ID NO: 318133 - DNA, 25 bp, Mus musculus
caggaagtttgctctctctcatttt

SEQ ID NO: 318134 - DNA, 25 bp, Mus musculus
caggaatagcacacccatttcaagc

SEQ ID NO: 318135 - DNA, 25 bp, Mus musculus
caggaatagcactcccatttcaagc

SEQ ID NO: 318136 - DNA, 25 bp, Mus musculus
caggaatatatcacacgtggcatgt

SEQ ID NO: 318137 - DNA, 25 bp, Mus musculus
caggaatatatctcacgtggcatgt

SEQ ID NO: 318138 - DNA, 25 bp, Mus musculus
caggaatatcaacgctgcacctcct

SEQ ID NO: 318139 - DNA, 25 bp, Mus musculus
caggaatatcaaggctgcacctcct

SEQ ID NO: 318140 - DNA, 25 bp, Mus musculus
caggaatatgaccttggctatgaca

SEQ ID NO: 318141 - DNA, 25 bp, Mus musculus
caggaatatgacgttggctatgaca

SEQ ID NO: 318142 - DNA, 25 bp, Mus musculus
caggaatatgcacagctcactcgct

SEQ ID NO: 318143 - DNA, 25 bp, Mus musculus
caggaatatgcagagctcactcgct

SEQ ID NO: 318144 - DNA, 25 bp, Mus musculus
caggaatattccagttcccagaggc

SEQ ID NO: 318145 - DNA, 25 bp, Mus musculus
caggaatattcctgttcccagaggc

SEQ ID NO: 318146 - DNA, 25 bp, Mus musculus
caggaatattttctggcagccggaa

SEQ ID NO: 318147 - DNA, 25 bp, Mus musculus
caggaatattttgtggcagccggaa

SEQ ID NO: 318148 - DNA, 25 bp, Mus musculus
caggaatcacatcttctatcatttt

SEQ ID NO: 318149 - DNA, 25 bp, Mus musculus
caggaatcacatgttctatcatttt

SEQ ID NO: 318150 - DNA, 25 bp, Mus musculus
caggaatccgggatttcatggtcac

SEQ ID NO: 318151 - DNA, 25 bp, Mus musculus
caggaatccgggttttcatggtcac

SEQ ID NO: 318152 - DNA, 25 bp, Mus musculus
caggaatcctgacctctgtgaagag

SEQ ID NO: 318153 - DNA, 25 bp, Mus musculus
caggaatcctgagctctgtgaagag

SEQ ID NO: 318154 - DNA, 25 bp, Mus musculus
caggaatcctttctataaactaaca

SEQ ID NO: 318155 - DNA, 25 bp, Mus musculus
caggaatcctttgtataaactaaca

SEQ ID NO: 318156 - DNA, 25 bp, Mus musculus
caggaatcgtccatgttgcctgatt

SEQ ID NO: 318157 - DNA, 25 bp, Mus musculus
caggaatcgtccttgttgcctgatt

SEQ ID NO: 318158 - DNA, 25 bp, Mus musculus
caggaatcgtgaaccccctagacca

SEQ ID NO: 318159 - DNA, 25 bp, Mus musculus
caggaatcgtgatccccctagacca

SEQ ID NO: 318160 - DNA, 25 bp, Mus musculus
caggaatcttctctagtatcttcag

SEQ ID NO: 318161 - DNA, 25 bp, Mus musculus
caggaatcttctgtagtatcttcag

SEQ ID NO: 318162 - DNA, 25 bp, Mus musculus
caggaatgagttacacagttttatt

SEQ ID NO: 318163 - DNA, 25 bp, Mus musculus
caggaatgagtttcacagttttatt

SEQ ID NO: 318164 - DNA, 25 bp, Mus musculus
caggaatgtgacagggcacaggtta

SEQ ID NO: 318165 - DNA, 25 bp, Mus musculus
caggaatgtgactgggcacaggtta

SEQ ID NO: 318166 - DNA, 25 bp, Mus musculus
caggaatgtgttaccttctctccac

SEQ ID NO: 318167 - DNA, 25 bp, Mus musculus
caggaatgtgtttccttctctccac

SEQ ID NO: 318168 - DNA, 25 bp, Mus musculus
caggaatgttctctcaatggtccat

SEQ ID NO: 318169 - DNA, 25 bp, Mus musculus
caggaatgttctgtcaatggtccat

SEQ ID NO: 318170 - DNA, 25 bp, Mus musculus
caggaattagaacgctttatggctt

SEQ ID NO: 318171 - DNA, 25 bp, Mus musculus
caggaattagaaggctttatggctt

SEQ ID NO: 318172 - DNA, 25 bp, Mus musculus
caggaattcacgatgctgtacagaa

SEQ ID NO: 318173 - DNA, 25 bp, Mus musculus
caggaattcacgttgctgtacagaa

SEQ ID NO: 318174 - DNA, 25 bp, Mus musculus
caggaattccaaatgtcaagtcaca

SEQ ID NO: 318175 - DNA, 25 bp, Mus musculus
caggaattccaattgtcaagtcaca

SEQ ID NO: 318176 - DNA, 25 bp, Mus musculus
caggaattcctcacctaagttcttt

SEQ ID NO: 318177 - DNA, 25 bp, Mus musculus
caggaattcctctcctaagttcttt

SEQ ID NO: 318178 - DNA, 25 bp, Mus musculus
caggaattcgcccttttcggtggca

SEQ ID NO: 318179 - DNA, 25 bp, Mus musculus
caggaattcgccgttttcggtggca

SEQ ID NO: 318180 - DNA, 25 bp, Mus musculus
caggaattctggatccttctccagc

SEQ ID NO: 318181 - DNA, 25 bp, Mus musculus
caggaattctggttccttctccagc

SEQ ID NO: 318182 - DNA, 25 bp, Mus musculus
caggaattgaatatgactcatttta

SEQ ID NO: 318183 - DNA, 25 bp, Mus musculus
caggaattgaatttgactcatttta

SEQ ID NO: 318184 - DNA, 25 bp, Mus musculus
caggaattggtcctttgtgcatact

SEQ ID NO: 318185 - DNA, 25 bp, Mus musculus
caggaattggtcgtttgtgcatact

SEQ ID NO: 318186 - DNA, 25 bp, Mus musculus
caggaatttgagattccttcactcc

SEQ ID NO: 318187 - DNA, 25 bp, Mus musculus
caggaatttgagtttccttcactcc

SEQ ID NO: 318188 - DNA, 25 bp, Mus musculus
caggaatttgctctctctggccctc

SEQ ID NO: 318189 - DNA, 25 bp, Mus musculus
caggaatttgctgtctctggccctc

SEQ ID NO: 318190 - DNA, 25 bp, Mus musculus
caggacaaagatcctgctactccag

SEQ ID NO: 318191 - DNA, 25 bp, Mus musculus
caggacaaagatgctgctactccag

SEQ ID NO: 318192 - DNA, 25 bp, Mus musculus
caggacaactacagttttctaaagg

SEQ ID NO: 318193 - DNA, 25 bp, Mus musculus
caggacaactactgttttctaaagg

SEQ ID NO: 318194 - DNA, 25 bp, Mus musculus
caggacaactagactgtgttcaaaa

SEQ ID NO: 318195 - DNA, 25 bp, Mus musculus
caggacaactagtctgtgttcaaaa

SEQ ID NO: 318196 - DNA, 25 bp, Mus musculus
caggacaagattcggcccctctgga

SEQ ID NO: 318197 - DNA, 25 bp, Mus musculus
caggacaagattgggcccctctgga

SEQ ID NO: 318198 - DNA, 25 bp, Mus musculus
caggacaagcccctctggatggagt

SEQ ID NO: 318199 - DNA, 25 bp, Mus musculus
caggacaagcccgtctggatggagt

SEQ ID NO: 318200 - DNA, 25 bp, Mus musculus
caggacaatacactgcccctatgtg

SEQ ID NO: 318201 - DNA, 25 bp, Mus musculus
caggacaatacagtgcccctatgtg

SEQ ID NO: 318202 - DNA, 25 bp, Mus musculus
caggacaatcccaagcagtgctgta

SEQ ID NO: 318203 - DNA, 25 bp, Mus musculus
caggacaatccctagcagtgctgta

SEQ ID NO: 318204 - DNA, 25 bp, Mus musculus
caggacaattagcaattgccgtcat

SEQ ID NO: 318205 - DNA, 25 bp, Mus musculus
caggacaattaggaattgccgtcat

SEQ ID NO: 318206 - DNA, 25 bp, Mus musculus
caggacacactgacgtagatttgct

SEQ ID NO: 318207 - DNA, 25 bp, Mus musculus
caggacacactgtcgtagatttgct

SEQ ID NO: 318208 - DNA, 25 bp, Mus musculus
caggacacaggtaagacagtattct

SEQ ID NO: 318209 - DNA, 25 bp, Mus musculus
caggacacaggttagacagtattct

SEQ ID NO: 318210 - DNA, 25 bp, Mus musculus
caggacacatagacactcgtatact

SEQ ID NO: 318211 - DNA, 25 bp, Mus musculus
caggacacatagtcactcgtatact

SEQ ID NO: 318212 - DNA, 25 bp, Mus musculus
caggacacatgaatgaacccgtttc

SEQ ID NO: 318213 - DNA, 25 bp, Mus musculus
caggacacatgattgaacccgtttc

SEQ ID NO: 318214 - DNA, 25 bp, Mus musculus
caggacaccacaacgtttctattga

SEQ ID NO: 318215 - DNA, 25 bp, Mus musculus
caggacaccacatcgtttctattga

SEQ ID NO: 318216 - DNA, 25 bp, Mus musculus
caggacacctatctttaccacatag

SEQ ID NO: 318217 - DNA, 25 bp, Mus musculus
caggacacctatgtttaccacatag

SEQ ID NO: 318218 - DNA, 25 bp, Mus musculus
caggacactgggaggatttggttta

SEQ ID NO: 318219 - DNA, 25 bp, Mus musculus
caggacactgggtggatttggttta

SEQ ID NO: 318220 - DNA, 25 bp, Mus musculus
caggacactgtcatatgttcgcgtt

SEQ ID NO: 318221 - DNA, 25 bp, Mus musculus
caggacactgtcttatgttcgcgtt

SEQ ID NO: 318222 - DNA, 25 bp, Mus musculus
caggacacttagacactccagagtc

SEQ ID NO: 318223 - DNA, 25 bp, Mus musculus
caggacacttagtcactccagagtc

SEQ ID NO: 318224 - DNA, 25 bp, Mus musculus
caggacacttccagacaatcctttc

SEQ ID NO: 318225 - DNA, 25 bp, Mus musculus
caggacacttcctgacaatcctttc

SEQ ID NO: 318226 - DNA, 25 bp, Mus musculus
caggacagaatccagagatttcttt

SEQ ID NO: 318227 - DNA, 25 bp, Mus musculus
caggacagaatcgagagatttcttt

SEQ ID NO: 318228 - DNA, 25 bp, Mus musculus
caggacagacccatgtaaagcacta

SEQ ID NO: 318229 - DNA, 25 bp, Mus musculus
caggacagacccttgtaaagcacta

SEQ ID NO: 318230 - DNA, 25 bp, Mus musculus
caggacagacctcgacagctgatac

SEQ ID NO: 318231 - DNA, 25 bp, Mus musculus
caggacagacctggacagctgatac

SEQ ID NO: 318232 - DNA, 25 bp, Mus musculus
caggacagagcaactaacagacatt

SEQ ID NO: 318233 - DNA, 25 bp, Mus musculus
caggacagagcatctaacagacatt

SEQ ID NO: 318234 - DNA, 25 bp, Mus musculus
caggacagagccctaactggtttgt

SEQ ID NO: 318235 - DNA, 25 bp, Mus musculus
caggacagagccgtaactggtttgt

SEQ ID NO: 318236 - DNA, 25 bp, Mus musculus
caggacagatacacaactatttgag

SEQ ID NO: 318237 - DNA, 25 bp, Mus musculus
caggacagatactcaactatttgag

SEQ ID NO: 318238 - DNA, 25 bp, Mus musculus
caggacagcaatctggaagcccagt

SEQ ID NO: 318239 - DNA, 25 bp, Mus musculus
caggacagcaatgtggaagcccagt

SEQ ID NO: 318240 - DNA, 25 bp, Mus musculus
caggacagcctcctacagtgggaga

SEQ ID NO: 318241 - DNA, 25 bp, Mus musculus
caggacagcctcgtacagtgggaga

SEQ ID NO: 318242 - DNA, 25 bp, Mus musculus
caggacagcttgaggaaggtctttc

SEQ ID NO: 318243 - DNA, 25 bp, Mus musculus
caggacagcttgtggaaggtctttc

SEQ ID NO: 318244 - DNA, 25 bp, Mus musculus
caggacagtcttaatctcttgcaag

SEQ ID NO: 318245 - DNA, 25 bp, Mus musculus
caggacagtctttatctcttgcaag

SEQ ID NO: 318246 - DNA, 25 bp, Mus musculus
caggacagttctccccaggtttggc

SEQ ID NO: 318247 - DNA, 25 bp, Mus musculus
caggacagttctcccttgggactct

SEQ ID NO: 318248 - DNA, 25 bp, Mus musculus
caggacagttctgcccaggtttggc

SEQ ID NO: 318249 - DNA, 25 bp, Mus musculus
caggacagttctgccttgggactct

SEQ ID NO: 318250 - DNA, 25 bp, Mus musculus
caggacataggcactgagaccttgt

SEQ ID NO: 318251 - DNA, 25 bp, Mus musculus
caggacataggctctgagaccttgt

SEQ ID NO: 318252 - DNA, 25 bp, Mus musculus
caggacatcacacccagcaatggat

SEQ ID NO: 318253 - DNA, 25 bp, Mus musculus
caggacatcacagccagcaatggat

SEQ ID NO: 318254 - DNA, 25 bp, Mus musculus
caggacatcacccttgcaatgcaag

SEQ ID NO: 318255 - DNA, 25 bp, Mus musculus
caggacatcaccgttgcaatgcaag

SEQ ID NO: 318256 - DNA, 25 bp, Mus musculus
caggacatcattcccatcttgggta

SEQ ID NO: 318257 - DNA, 25 bp, Mus musculus
caggacatcattgccatcttgggta

SEQ ID NO: 318258 - DNA, 25 bp, Mus musculus
caggacatccagcaatcttttcatg

SEQ ID NO: 318259 - DNA, 25 bp, Mus musculus
caggacatccaggaatcttttcatg

SEQ ID NO: 318260 - DNA, 25 bp, Mus musculus
caggacatggaaccgtacttgccac

SEQ ID NO: 318261 - DNA, 25 bp, Mus musculus
caggacatggaagcgtacttgccac

SEQ ID NO: 318262 - DNA, 25 bp, Mus musculus
caggacatggctagttagcttgggc

SEQ ID NO: 318263 - DNA, 25 bp, Mus musculus
caggacatggcttgttagcttgggc

SEQ ID NO: 318264 - DNA, 25 bp, Mus musculus
caggacattactcccaatcaatggg

SEQ ID NO: 318265 - DNA, 25 bp, Mus musculus
caggacattactgccaatcaatggg

SEQ ID NO: 318266 - DNA, 25 bp, Mus musculus
caggacatttggctggctccagtac

SEQ ID NO: 318267 - DNA, 25 bp, Mus musculus
caggacatttgggtggctccagtac

SEQ ID NO: 318268 - DNA, 25 bp, Mus musculus
caggacattttaactctgtgcaaag

SEQ ID NO: 318269 - DNA, 25 bp, Mus musculus
caggacattttatctctgtgcaaag

SEQ ID NO: 318270 - DNA, 25 bp, Mus musculus
caggaccacaggctagtcatttggg

SEQ ID NO: 318271 - DNA, 25 bp, Mus musculus
caggaccacagggtagtcatttggg

SEQ ID NO: 318272 - DNA, 25 bp, Mus musculus
caggaccaccagcactgccgtgggt

SEQ ID NO: 318273 - DNA, 25 bp, Mus musculus
caggaccaccaggactgccgtgggt

SEQ ID NO: 318274 - DNA, 25 bp, Mus musculus
caggaccacccacaggctaaggaat

SEQ ID NO: 318275 - DNA, 25 bp, Mus musculus
caggaccacccagaggctaaggaat

SEQ ID NO: 318276 - DNA, 25 bp, Mus musculus
caggaccacggaagatgctgctctt

SEQ ID NO: 318277 - DNA, 25 bp, Mus musculus
caggaccacggatgatgctgctctt

SEQ ID NO: 318278 - DNA, 25 bp, Mus musculus
caggaccagcaccatttcctaaggt

SEQ ID NO: 318279 - DNA, 25 bp, Mus musculus
caggaccagcacgatttcctaaggt

SEQ ID NO: 318280 - DNA, 25 bp, Mus musculus
caggaccaggagcattgttctaggc

SEQ ID NO: 318281 - DNA, 25 bp, Mus musculus
caggaccaggaggattgttctaggc

SEQ ID NO: 318282 - DNA, 25 bp, Mus musculus
caggaccaggccagtgtacatttca

SEQ ID NO: 318283 - DNA, 25 bp, Mus musculus
caggaccaggcctgtgtacatttca

SEQ ID NO: 318284 - DNA, 25 bp, Mus musculus
caggaccaggtcattttgatgccct

SEQ ID NO: 318285 - DNA, 25 bp, Mus musculus
caggaccaggtctttttgatgccct

SEQ ID NO: 318286 - DNA, 25 bp, Mus musculus
caggaccattccaggttccgtataa

SEQ ID NO: 318287 - DNA, 25 bp, Mus musculus
caggaccattcctggttccgtataa

SEQ ID NO: 318288 - DNA, 25 bp, Mus musculus
caggaccattggctttatgtagtaa

SEQ ID NO: 318289 - DNA, 25 bp, Mus musculus
caggaccattgggtttatgtagtaa

SEQ ID NO: 318290 - DNA, 25 bp, Mus musculus
caggacccaccaatctgggtaggtt

SEQ ID NO: 318291 - DNA, 25 bp, Mus musculus
caggacccaccattctgggtaggtt

SEQ ID NO: 318292 - DNA, 25 bp, Mus musculus
caggacccagttcttggcctatttt

SEQ ID NO: 318293 - DNA, 25 bp, Mus musculus
caggacccagttgttggcctatttt

SEQ ID NO: 318294 - DNA, 25 bp, Mus musculus
caggacccatacacagtttttgagt

SEQ ID NO: 318295 - DNA, 25 bp, Mus musculus
caggacccatactcagtttttgagt

SEQ ID NO: 318296 - DNA, 25 bp, Mus musculus
caggacccatggatttgacaagccc

SEQ ID NO: 318297 - DNA, 25 bp, Mus musculus
caggacccatggttttgacaagccc

SEQ ID NO: 318298 - DNA, 25 bp, Mus musculus
caggaccccagcaggtatagttaaa

SEQ ID NO: 318299 - DNA, 25 bp, Mus musculus
caggaccccagctggtatagttaaa

SEQ ID NO: 318300 - DNA, 25 bp, Mus musculus
caggacccctgacttttggtccagt

SEQ ID NO: 318301 - DNA, 25 bp, Mus musculus
caggacccctgagttttggtccagt

SEQ ID NO: 318302 - DNA, 25 bp, Mus musculus
caggacccctgcctgtagtagagct

SEQ ID NO: 318303 - DNA, 25 bp, Mus musculus
caggacccctgcgtgtagtagagct

SEQ ID NO: 318304 - DNA, 25 bp, Mus musculus
caggaccccttccacgtaaagatga

SEQ ID NO: 318305 - DNA, 25 bp, Mus musculus
caggaccccttcgacgtaaagatga

SEQ ID NO: 318306 - DNA, 25 bp, Mus musculus
caggacccctttcggattcctatag

SEQ ID NO: 318307 - DNA, 25 bp, Mus musculus
caggacccctttgggattcctatag

SEQ ID NO: 318308 - DNA, 25 bp, Mus musculus
caggacccgctcaaggatctggtgt

SEQ ID NO: 318309 - DNA, 25 bp, Mus musculus
caggacccgctctaggatctggtgt

SEQ ID NO: 318310 - DNA, 25 bp, Mus musculus
caggaccctgtgacagccagtctga

SEQ ID NO: 318311 - DNA, 25 bp, Mus musculus
caggaccctgtgtcagccagtctga

SEQ ID NO: 318312 - DNA, 25 bp, Mus musculus
caggaccgaaacacatagcctcatt

SEQ ID NO: 318313 - DNA, 25 bp, Mus musculus
caggaccgaaactcatagcctcatt

SEQ ID NO: 318314 - DNA, 25 bp, Mus musculus
caggaccgccttaaacatgctcagt

SEQ ID NO: 318315 - DNA, 25 bp, Mus musculus
caggaccgcctttaacatgctcagt

SEQ ID NO: 318316 - DNA, 25 bp, Mus musculus
caggacctaggaccctctgggactc

SEQ ID NO: 318317 - DNA, 25 bp, Mus musculus
caggacctaggagcctctgggactc

SEQ ID NO: 318318 - DNA, 25 bp, Mus musculus
caggacctcttaagttcagggccac

SEQ ID NO: 318319 - DNA, 25 bp, Mus musculus
caggacctcttatgttcagggccac

SEQ ID NO: 318320 - DNA, 25 bp, Mus musculus
caggacctggagacagcagctcaaa

SEQ ID NO: 318321 - DNA, 25 bp, Mus musculus
caggacctggagtcagcagctcaaa

SEQ ID NO: 318322 - DNA, 25 bp, Mus musculus
caggacctggctacggtggaccaag

SEQ ID NO: 318323 - DNA, 25 bp, Mus musculus
caggacctggcttcggtggaccaag

SEQ ID NO: 318324 - DNA, 25 bp, Mus musculus
caggacctgggcacatggtcacatt

SEQ ID NO: 318325 - DNA, 25 bp, Mus musculus
caggacctgggctcatggtcacatt

SEQ ID NO: 318326 - DNA, 25 bp, Mus musculus
caggaccttcccactgacaagagga

SEQ ID NO: 318327 - DNA, 25 bp, Mus musculus
caggaccttccctctgacaagagga

SEQ ID NO: 318328 - DNA, 25 bp, Mus musculus
caggaccttctgactccaaatagag

SEQ ID NO: 318329 - DNA, 25 bp, Mus musculus
caggaccttctgtctccaaatagag

SEQ ID NO: 318330 - DNA, 25 bp, Mus musculus
caggacctttgtcgagtgttgaata

SEQ ID NO: 318331 - DNA, 25 bp, Mus musculus
caggacctttgtggagtgttgaata

SEQ ID NO: 318332 - DNA, 25 bp, Mus musculus
caggaccttttcatagctgactaag

SEQ ID NO: 318333 - DNA, 25 bp, Mus musculus
caggaccttttcttagctgactaag

SEQ ID NO: 318334 - DNA, 25 bp, Mus musculus
caggacctttttagcgctgctgccg

SEQ ID NO: 318335 - DNA, 25 bp, Mus musculus
caggaccttttttgcgctgctgccg

SEQ ID NO: 318336 - DNA, 25 bp, Mus musculus
caggacgacagaagagcaggagaaa

SEQ ID NO: 318337 - DNA, 25 bp, Mus musculus
caggacgacagatgagcaggagaaa

SEQ ID NO: 318338 - DNA, 25 bp, Mus musculus
caggacgcagtcaagcagcccgggt

SEQ ID NO: 318339 - DNA, 25 bp, Mus musculus
caggacgcagtctagcagcccgggt

SEQ ID NO: 318340 - DNA, 25 bp, Mus musculus
caggacgcgaggaagcccttatgaa

SEQ ID NO: 318341 - DNA, 25 bp, Mus musculus
caggacgcgaggtagcccttatgaa

SEQ ID NO: 318342 - DNA, 25 bp, Mus musculus
caggacgtcagtcggacctcacagg

SEQ ID NO: 318343 - DNA, 25 bp, Mus musculus
caggacgtcagtgggacctcacagg

SEQ ID NO: 318344 - DNA, 25 bp, Mus musculus
caggacgtgtctactgacccttgag

SEQ ID NO: 318345 - DNA, 25 bp, Mus musculus
caggacgtgtcttctgacccttgag

SEQ ID NO: 318346 - DNA, 25 bp, Mus musculus
caggacgttcccaggctgagctctt

SEQ ID NO: 318347 - DNA, 25 bp, Mus musculus
caggacgttccctggctgagctctt

SEQ ID NO: 318348 - DNA, 25 bp, Mus musculus
caggactaaactagtgatttggaat

SEQ ID NO: 318349 - DNA, 25 bp, Mus musculus
caggactaaacttgtgatttggaat

SEQ ID NO: 318350 - DNA, 25 bp, Mus musculus
caggactaaagacaccccatctcag

SEQ ID NO: 318351 - DNA, 25 bp, Mus musculus
caggactaaagagaccccatctcag

SEQ ID NO: 318352 - DNA, 25 bp, Mus musculus
caggactacatacttcaactgtgct

SEQ ID NO: 318353 - DNA, 25 bp, Mus musculus
caggactacatagttcaactgtgct

SEQ ID NO: 318354 - DNA, 25 bp, Mus musculus
caggactacattcccttcctttggg

SEQ ID NO: 318355 - DNA, 25 bp, Mus musculus
caggactacattgccttcctttggg

SEQ ID NO: 318356 - DNA, 25 bp, Mus musculus
caggactacctgctctgtaaggaat

SEQ ID NO: 318357 - DNA, 25 bp, Mus musculus
caggactacctggtctgtaaggaat

SEQ ID NO: 318358 - DNA, 25 bp, Mus musculus
caggactactgcatcgaggtgacaa

SEQ ID NO: 318359 - DNA, 25 bp, Mus musculus
caggactactgcttcgaggtgacaa

SEQ ID NO: 318360 - DNA, 25 bp, Mus musculus
caggactagaatctgtgtcactctt

SEQ ID NO: 318361 - DNA, 25 bp, Mus musculus
caggactagaatgtgtgtcactctt

SEQ ID NO: 318362 - DNA, 25 bp, Mus musculus
caggactagcagaatgacctgccag

SEQ ID NO: 318363 - DNA, 25 bp, Mus musculus
caggactagcagtatgacctgccag

SEQ ID NO: 318364 - DNA, 25 bp, Mus musculus
caggactcaagaagggactctgctt

SEQ ID NO: 318365 - DNA, 25 bp, Mus musculus
caggactcaagatgggactctgctt

SEQ ID NO: 318366 - DNA, 25 bp, Mus musculus
caggactcacagcagaccctttcag

SEQ ID NO: 318367 - DNA, 25 bp, Mus musculus
caggactcacaggagaccctttcag

SEQ ID NO: 318368 - DNA, 25 bp, Mus musculus
caggactcaggccatcacatttttc

SEQ ID NO: 318369 - DNA, 25 bp, Mus musculus
caggactcaggcgatcacatttttc

SEQ ID NO: 318370 - DNA, 25 bp, Mus musculus
caggactccatgagcaaaactggca

SEQ ID NO: 318371 - DNA, 25 bp, Mus musculus
caggactccatgtgcaaaactggca

SEQ ID NO: 318372 - DNA, 25 bp, Mus musculus
caggactccctgcttgatggtgtgc

SEQ ID NO: 318373 - DNA, 25 bp, Mus musculus
caggactccctggttgatggtgtgc

SEQ ID NO: 318374 - DNA, 25 bp, Mus musculus
caggactcgcacagggcaggatgct

SEQ ID NO: 318375 - DNA, 25 bp, Mus musculus
caggactcgcactgggcaggatgct

SEQ ID NO: 318376 - DNA, 25 bp, Mus musculus
caggactcgctgactcccgggcaga

SEQ ID NO: 318377 - DNA, 25 bp, Mus musculus
caggactcgctgtctcccgggcaga

SEQ ID NO: 318378 - DNA, 25 bp, Mus musculus
caggactcggtcaactggaagggct

SEQ ID NO: 318379 - DNA, 25 bp, Mus musculus
caggactcggtctactggaagggct

SEQ ID NO: 318380 - DNA, 25 bp, Mus musculus
caggactctcccagggtttcctata

SEQ ID NO: 318381 - DNA, 25 bp, Mus musculus
caggactctccctgggtttcctata

SEQ ID NO: 318382 - DNA, 25 bp, Mus musculus
caggactctgccagtgtccggagag

SEQ ID NO: 318383 - DNA, 25 bp, Mus musculus
caggactctgcctgtgtccggagag

SEQ ID NO: 318384 - DNA, 25 bp, Mus musculus
caggactcttggaaatctatgtgaa

SEQ ID NO: 318385 - DNA, 25 bp, Mus musculus
caggactcttggtaatctatgtgaa

SEQ ID NO: 318386 - DNA, 25 bp, Mus musculus
caggactctttgcattgtttttggt

SEQ ID NO: 318387 - DNA, 25 bp, Mus musculus
caggactctttggattgtttttggt

SEQ ID NO: 318388 - DNA, 25 bp, Mus musculus
caggactgaaataagattctaccaa

SEQ ID NO: 318389 - DNA, 25 bp, Mus musculus
caggactgaaattagattctaccaa

SEQ ID NO: 318390 - DNA, 25 bp, Mus musculus
caggactgaaccaaactgtccccaa

SEQ ID NO: 318391 - DNA, 25 bp, Mus musculus
caggactgaacctaactgtccccaa

SEQ ID NO: 318392 - DNA, 25 bp, Mus musculus
caggactgaggacctggacacagcc

SEQ ID NO: 318393 - DNA, 25 bp, Mus musculus
caggactgaggagctggacacagcc

SEQ ID NO: 318394 - DNA, 25 bp, Mus musculus
caggactgaggtcgcatttctatgt

SEQ ID NO: 318395 - DNA, 25 bp, Mus musculus
caggactgaggtggcatttctatgt

SEQ ID NO: 318396 - DNA, 25 bp, Mus musculus
caggactgcagtatgcgcatgcgca

SEQ ID NO: 318397 - DNA, 25 bp, Mus musculus
caggactgcagtttgcgcatgcgca

SEQ ID NO: 318398 - DNA, 25 bp, Mus musculus
caggactgccagaaaatagtgggaa

SEQ ID NO: 318399 - DNA, 25 bp, Mus musculus
caggactgccagtaaatagtgggaa

SEQ ID NO: 318400 - DNA, 25 bp, Mus musculus
caggactgctcgaccactatcatca

SEQ ID NO: 318401 - DNA, 25 bp, Mus musculus
caggactgctcgtccactatcatca

SEQ ID NO: 318402 - DNA, 25 bp, Mus musculus
caggactgctgcatcgatcggctcc

SEQ ID NO: 318403 - DNA, 25 bp, Mus musculus
caggactgctgcttcgatcggctcc

SEQ ID NO: 318404 - DNA, 25 bp, Mus musculus
caggactggctgacctcatggagga

SEQ ID NO: 318405 - DNA, 25 bp, Mus musculus
caggactggctgtcctcatggagga

SEQ ID NO: 318406 - DNA, 25 bp, Mus musculus
caggactgggccacatgaggttaaa

SEQ ID NO: 318407 - DNA, 25 bp, Mus musculus
caggactgggcctcatgaggttaaa

SEQ ID NO: 318408 - DNA, 25 bp, Mus musculus
caggactgggtgaagaggcccacct

SEQ ID NO: 318409 - DNA, 25 bp, Mus musculus
caggactgggtgtagaggcccacct

SEQ ID NO: 318410 - DNA, 25 bp, Mus musculus
caggactggtgtactgctgaatgca

SEQ ID NO: 318411 - DNA, 25 bp, Mus musculus
caggactggtgttctgctgaatgca

SEQ ID NO: 318412 - DNA, 25 bp, Mus musculus
caggactgtcaaagggctcagtgct

SEQ ID NO: 318413 - DNA, 25 bp, Mus musculus
caggactgtcaatgggctcagtgct

SEQ ID NO: 318414 - DNA, 25 bp, Mus musculus
caggactgtcacattgttccggacc

SEQ ID NO: 318415 - DNA, 25 bp, Mus musculus
caggactgtcactttgttccggacc

SEQ ID NO: 318416 - DNA, 25 bp, Mus musculus
caggactgttctagcctgggtcagt

SEQ ID NO: 318417 - DNA, 25 bp, Mus musculus
caggactgttcttgcctgggtcagt

SEQ ID NO: 318418 - DNA, 25 bp, Mus musculus
caggacttaattcttccttgtgttg

SEQ ID NO: 318419 - DNA, 25 bp, Mus musculus
caggacttaattgttccttgtgttg

SEQ ID NO: 318420 - DNA, 25 bp, Mus musculus
caggacttacccatgttggtagaca

SEQ ID NO: 318421 - DNA, 25 bp, Mus musculus
caggacttacccttgttggtagaca

SEQ ID NO: 318422 - DNA, 25 bp, Mus musculus
caggacttcacacattcactttcta

SEQ ID NO: 318423 - DNA, 25 bp, Mus musculus
caggacttcacagattcactttcta

SEQ ID NO: 318424 - DNA, 25 bp, Mus musculus
caggacttccaacctctagagtgat

SEQ ID NO: 318425 - DNA, 25 bp, Mus musculus
caggacttccaagctctagagtgat

SEQ ID NO: 318426 - DNA, 25 bp, Mus musculus
caggacttcccgaactacatagacc

SEQ ID NO: 318427 - DNA, 25 bp, Mus musculus
caggacttcccgtactacatagacc

SEQ ID NO: 318428 - DNA, 25 bp, Mus musculus
caggacttggtgcaagctttgtgta

SEQ ID NO: 318429 - DNA, 25 bp, Mus musculus
caggacttggtggaagctttgtgta

SEQ ID NO: 318430 - DNA, 25 bp, Mus musculus
caggactttctcaaggatccacaga

SEQ ID NO: 318431 - DNA, 25 bp, Mus musculus
caggactttctctaggatccacaga

SEQ ID NO: 318432 - DNA, 25 bp, Mus musculus
caggactttgccactggttgggttt

SEQ ID NO: 318433 - DNA, 25 bp, Mus musculus
caggactttgccctcactaagcaaa

SEQ ID NO: 318434 - DNA, 25 bp, Mus musculus
caggactttgccgtcactaagcaaa

SEQ ID NO: 318435 - DNA, 25 bp, Mus musculus
caggactttgcctctggttgggttt

SEQ ID NO: 318436 - DNA, 25 bp, Mus musculus
caggactttggcagggactgatcaa

SEQ ID NO: 318437 - DNA, 25 bp, Mus musculus
caggactttggctgggactgatcaa

SEQ ID NO: 318438 - DNA, 25 bp, Mus musculus
caggactttgttcaagagacttctt

SEQ ID NO: 318439 - DNA, 25 bp, Mus musculus
caggactttgttctctgagtcactt

SEQ ID NO: 318440 - DNA, 25 bp, Mus musculus
caggactttgttgaagagacttctt

SEQ ID NO: 318441 - DNA, 25 bp, Mus musculus
caggactttgttgtctgagtcactt

SEQ ID NO: 318442 - DNA, 25 bp, Mus musculus
caggacttttacagaagaagcccta

SEQ ID NO: 318443 - DNA, 25 bp, Mus musculus
caggacttttactgaagaagcccta

SEQ ID NO: 318444 - DNA, 25 bp, Mus musculus
caggacttttccacttctgaagaat

SEQ ID NO: 318445 - DNA, 25 bp, Mus musculus
caggacttttcctcttctgaagaat

SEQ ID NO: 318446 - DNA, 25 bp, Mus musculus
caggacttttgtagcatgactttat

SEQ ID NO: 318447 - DNA, 25 bp, Mus musculus
caggacttttgttgcatgactttat

SEQ ID NO: 318448 - DNA, 25 bp, Mus musculus
caggagaaaagacgcccttgttact

SEQ ID NO: 318449 - DNA, 25 bp, Mus musculus
caggagaaaagaggcccttgttact

SEQ ID NO: 318450 - DNA, 25 bp, Mus musculus
caggagaaactgactttgtaccagg

SEQ ID NO: 318451 - DNA, 25 bp, Mus musculus
caggagaaactgtctttgtaccagg

SEQ ID NO: 318452 - DNA, 25 bp, Mus musculus
caggagaaaggtaccacctcatgta

SEQ ID NO: 318453 - DNA, 25 bp, Mus musculus
caggagaaaggttccacctcatgta

SEQ ID NO: 318454 - DNA, 25 bp, Mus musculus
caggagaaccatctacttagttgat

SEQ ID NO: 318455 - DNA, 25 bp, Mus musculus
caggagaaccatgtacttagttgat

SEQ ID NO: 318456 - DNA, 25 bp, Mus musculus
caggagaactatatgtgggaatttt

SEQ ID NO: 318457 - DNA, 25 bp, Mus musculus
caggagaactatttgtgggaatttt

SEQ ID NO: 318458 - DNA, 25 bp, Mus musculus
caggagaactcccttcagcggtgca

SEQ ID NO: 318459 - DNA, 25 bp, Mus musculus
caggagaactccctttagcggtgca

SEQ ID NO: 318460 - DNA, 25 bp, Mus musculus
caggagaactccgttcagcggtgca

SEQ ID NO: 318461 - DNA, 25 bp, Mus musculus
caggagaactccgtttagcggtgca

SEQ ID NO: 318462 - DNA, 25 bp, Mus musculus
caggagaactcgcataaacagctag

SEQ ID NO: 318463 - DNA, 25 bp, Mus musculus
caggagaactcggataaacagctag

SEQ ID NO: 318464 - DNA, 25 bp, Mus musculus
caggagaagagcatccccaggaagt

SEQ ID NO: 318465 - DNA, 25 bp, Mus musculus
caggagaagagcttccccaggaagt

SEQ ID NO: 318466 - DNA, 25 bp, Mus musculus
caggagaagatcagcgccgctgcga

SEQ ID NO: 318467 - DNA, 25 bp, Mus musculus
caggagaagatctgcgccgctgcga

SEQ ID NO: 318468 - DNA, 25 bp, Mus musculus
caggagaagcgcagccccttgggca

SEQ ID NO: 318469 - DNA, 25 bp, Mus musculus
caggagaagcgctgccccttgggca

SEQ ID NO: 318470 - DNA, 25 bp, Mus musculus
caggagaaggtcaacactctaggta

SEQ ID NO: 318471 - DNA, 25 bp, Mus musculus
caggagaaggtctacactctaggta

SEQ ID NO: 318472 - DNA, 25 bp, Mus musculus
caggagaatcgcaggctttattaaa

SEQ ID NO: 318473 - DNA, 25 bp, Mus musculus
caggagaatcgctggctttattaaa

SEQ ID NO: 318474 - DNA, 25 bp, Mus musculus
caggagaatcgtcccttcagaggta

SEQ ID NO: 318475 - DNA, 25 bp, Mus musculus
caggagaatcgtgccttcagaggta

SEQ ID NO: 318476 - DNA, 25 bp, Mus musculus
caggagaatctgaacatgagtggca

SEQ ID NO: 318477 - DNA, 25 bp, Mus musculus
caggagaatctgtacatgagtggca

SEQ ID NO: 318478 - DNA, 25 bp, Mus musculus
caggagaatcttcagggcttcagaa

SEQ ID NO: 318479 - DNA, 25 bp, Mus musculus
caggagaatcttgagggcttcagaa

SEQ ID NO: 318480 - DNA, 25 bp, Mus musculus
caggagaatgctcgcctcttgggcc

SEQ ID NO: 318481 - DNA, 25 bp, Mus musculus
caggagaatgctggcctcttgggcc

SEQ ID NO: 318482 - DNA, 25 bp, Mus musculus
caggagaatgttcatggaaccaaat

SEQ ID NO: 318483 - DNA, 25 bp, Mus musculus
caggagaatgttgatggaaccaaat

SEQ ID NO: 318484 - DNA, 25 bp, Mus musculus
caggagacaccgcttagagacattc

SEQ ID NO: 318485 - DNA, 25 bp, Mus musculus
caggagacaccggttagagacattc

SEQ ID NO: 318486 - DNA, 25 bp, Mus musculus
caggagacccttatgtactgatggg

SEQ ID NO: 318487 - DNA, 25 bp, Mus musculus
caggagacccttttgtactgatggg

SEQ ID NO: 318488 - DNA, 25 bp, Mus musculus
caggagacctacatccagcagctgg

SEQ ID NO: 318489 - DNA, 25 bp, Mus musculus
caggagacctacttccagcagctgg

SEQ ID NO: 318490 - DNA, 25 bp, Mus musculus
caggagaccttcatgggaatacaaa

SEQ ID NO: 318491 - DNA, 25 bp, Mus musculus
caggagaccttcttgggaatacaaa

SEQ ID NO: 318492 - DNA, 25 bp, Mus musculus
caggagacggtcaagattttgcagt

SEQ ID NO: 318493 - DNA, 25 bp, Mus musculus
caggagacggtctagattttgcagt

SEQ ID NO: 318494 - DNA, 25 bp, Mus musculus
caggagacttgaccctcggtagtaa

SEQ ID NO: 318495 - DNA, 25 bp, Mus musculus
caggagacttgagcctcggtagtaa

SEQ ID NO: 318496 - DNA, 25 bp, Mus musculus
caggagactttaacctgacactatt

SEQ ID NO: 318497 - DNA, 25 bp, Mus musculus
caggagactttatcctgacactatt

SEQ ID NO: 318498 - DNA, 25 bp, Mus musculus
caggagagccggagccctcttcagg

SEQ ID NO: 318499 - DNA, 25 bp, Mus musculus
caggagagccggtgccctcttcagg

SEQ ID NO: 318500 - DNA, 25 bp, Mus musculus
caggagagctcccaagctgggacct

SEQ ID NO: 318501 - DNA, 25 bp, Mus musculus
caggagagctccgaagctgggacct

SEQ ID NO: 318502 - DNA, 25 bp, Mus musculus
caggagagctggcttgctttccatt

SEQ ID NO: 318503 - DNA, 25 bp, Mus musculus
caggagagctgggttgctttccatt

SEQ ID NO: 318504 - DNA, 25 bp, Mus musculus
caggagaggcctccccggtagacac

SEQ ID NO: 318505 - DNA, 25 bp, Mus musculus
caggagaggcctgcccggtagacac

SEQ ID NO: 318506 - DNA, 25 bp, Mus musculus
caggagaggcttacgttgtttgttt

SEQ ID NO: 318507 - DNA, 25 bp, Mus musculus
caggagaggcttattgtatactttt

SEQ ID NO: 318508 - DNA, 25 bp, Mus musculus
caggagaggctttcgttgtttgttt

SEQ ID NO: 318509 - DNA, 25 bp, Mus musculus
caggagaggctttttgtatactttt

SEQ ID NO: 318510 - DNA, 25 bp, Mus musculus
caggagagggatcaagccattgcta

SEQ ID NO: 318511 - DNA, 25 bp, Mus musculus
caggagagggatgaagccattgcta

SEQ ID NO: 318512 - DNA, 25 bp, Mus musculus
caggagaggtttacttagcccttct

SEQ ID NO: 318513 - DNA, 25 bp, Mus musculus
caggagaggttttcttagcccttct

SEQ ID NO: 318514 - DNA, 25 bp, Mus musculus
caggagagtaacaaggcccagcact

SEQ ID NO: 318515 - DNA, 25 bp, Mus musculus
caggagagtaactaggcccagcact

SEQ ID NO: 318516 - DNA, 25 bp, Mus musculus
caggagagttataagcaccacggat

SEQ ID NO: 318517 - DNA, 25 bp, Mus musculus
caggagagttattagcaccacggat

SEQ ID NO: 318518 - DNA, 25 bp, Mus musculus
caggagagtttgagacctgtttttt

SEQ ID NO: 318519 - DNA, 25 bp, Mus musculus
caggagagtttgtgacctgtttttt

SEQ ID NO: 318520 - DNA, 25 bp, Mus musculus
caggagagttttacagccacccctt

SEQ ID NO: 318521 - DNA, 25 bp, Mus musculus
caggagagttttcctagcagcacta

SEQ ID NO: 318522 - DNA, 25 bp, Mus musculus
caggagagttttgctagcagcacta

SEQ ID NO: 318523 - DNA, 25 bp, Mus musculus
caggagagtttttcagccacccctt

SEQ ID NO: 318524 - DNA, 25 bp, Mus musculus
caggagatatggacccctattcaga

SEQ ID NO: 318525 - DNA, 25 bp, Mus musculus
caggagatatggtcccctattcaga

SEQ ID NO: 318526 - DNA, 25 bp, Mus musculus
caggagatcagtcctggttccccga

SEQ ID NO: 318527 - DNA, 25 bp, Mus musculus
caggagatcagtgctggttccccga

SEQ ID NO: 318528 - DNA, 25 bp, Mus musculus
caggagatcatcacaagcgcgagag

SEQ ID NO: 318529 - DNA, 25 bp, Mus musculus
caggagatcatctcaagcgcgagag

SEQ ID NO: 318530 - DNA, 25 bp, Mus musculus
caggagatgcaccttctgaggagaa

SEQ ID NO: 318531 - DNA, 25 bp, Mus musculus
caggagatgcacgttctgaggagaa

SEQ ID NO: 318532 - DNA, 25 bp, Mus musculus
caggagatgcatatcgttgacgtgt

SEQ ID NO: 318533 - DNA, 25 bp, Mus musculus
caggagatgcatttcgttgacgtgt

SEQ ID NO: 318534 - DNA, 25 bp, Mus musculus
caggagatggccactgccgcatcct

SEQ ID NO: 318535 - DNA, 25 bp, Mus musculus
caggagatggcctctgccgcatcct

SEQ ID NO: 318536 - DNA, 25 bp, Mus musculus
caggagatgtagattccagctttcc

SEQ ID NO: 318537 - DNA, 25 bp, Mus musculus
caggagatgtagtttccagctttcc

SEQ ID NO: 318538 - DNA, 25 bp, Mus musculus
caggagatttaaagccctcttgtgg

SEQ ID NO: 318539 - DNA, 25 bp, Mus musculus
caggagatttaatgccctcttgtgg

SEQ ID NO: 318540 - DNA, 25 bp, Mus musculus
caggagatttctaatgatttgtggc

SEQ ID NO: 318541 - DNA, 25 bp, Mus musculus
caggagatttcttatgatttgtggc

SEQ ID NO: 318542 - DNA, 25 bp, Mus musculus
caggagcaaaacagaaggtggataa

SEQ ID NO: 318543 - DNA, 25 bp, Mus musculus
caggagcaaaactgaaggtggataa

SEQ ID NO: 318544 - DNA, 25 bp, Mus musculus
caggagcaaagtaccccatatctag

SEQ ID NO: 318545 - DNA, 25 bp, Mus musculus
caggagcaaagttccccatatctag

SEQ ID NO: 318546 - DNA, 25 bp, Mus musculus
caggagcacctacagtttccagttt

SEQ ID NO: 318547 - DNA, 25 bp, Mus musculus
caggagcacctagagtttccagttt

SEQ ID NO: 318548 - DNA, 25 bp, Mus musculus
caggagcacctcacagctgctgagt

SEQ ID NO: 318549 - DNA, 25 bp, Mus musculus
caggagcacctctcagctgctgagt

SEQ ID NO: 318550 - DNA, 25 bp, Mus musculus
caggagcacggaccacttgaaggat

SEQ ID NO: 318551 - DNA, 25 bp, Mus musculus
caggagcacggagcacttgaaggat

SEQ ID NO: 318552 - DNA, 25 bp, Mus musculus
caggagcactgtcagcacggatgtt

SEQ ID NO: 318553 - DNA, 25 bp, Mus musculus
caggagcactgtgagcacggatgtt

SEQ ID NO: 318554 - DNA, 25 bp, Mus musculus
caggagcagattcacaggctgtctt

SEQ ID NO: 318555 - DNA, 25 bp, Mus musculus
caggagcagattgacaggctgtctt

SEQ ID NO: 318556 - DNA, 25 bp, Mus musculus
caggagcagccaccctggagtacac

SEQ ID NO: 318557 - DNA, 25 bp, Mus musculus
caggagcagccagcctggagtacac

SEQ ID NO: 318558 - DNA, 25 bp, Mus musculus
caggagcagctgacgctagagcctt

SEQ ID NO: 318559 - DNA, 25 bp, Mus musculus
caggagcagctgtcgctagagcctt

SEQ ID NO: 318560 - DNA, 25 bp, Mus musculus
caggagcagcttcaaattaggaaag

SEQ ID NO: 318561 - DNA, 25 bp, Mus musculus
caggagcagcttgaaattaggaaag

SEQ ID NO: 318562 - DNA, 25 bp, Mus musculus
caggagcaggaaacgttttcttcta

SEQ ID NO: 318563 - DNA, 25 bp, Mus musculus
caggagcaggaatcgttttcttcta

SEQ ID NO: 318564 - DNA, 25 bp, Mus musculus
caggagcaggatcagactcggtctc

SEQ ID NO: 318565 - DNA, 25 bp, Mus musculus
caggagcaggatgagactcggtctc

SEQ ID NO: 318566 - DNA, 25 bp, Mus musculus
caggagcatccactgcatgtggtgt

SEQ ID NO: 318567 - DNA, 25 bp, Mus musculus
caggagcatccagtgcatgtggtgt

SEQ ID NO: 318568 - DNA, 25 bp, Mus musculus
caggagcatggccaacaggttcatt

SEQ ID NO: 318569 - DNA, 25 bp, Mus musculus
caggagcatggcgaacaggttcatt

SEQ ID NO: 318570 - DNA, 25 bp, Mus musculus
caggagccaaggatgttcaggaaca

SEQ ID NO: 318571 - DNA, 25 bp, Mus musculus
caggagccaaggttgttcaggaaca

SEQ ID NO: 318572 - DNA, 25 bp, Mus musculus
caggagccaggaacatcttctttgg

SEQ ID NO: 318573 - DNA, 25 bp, Mus musculus
caggagccaggatcatcttctttgg

SEQ ID NO: 318574 - DNA, 25 bp, Mus musculus
caggagcccacacccctgagaaggt

SEQ ID NO: 318575 - DNA, 25 bp, Mus musculus
caggagcccacagccctgagaaggt

SEQ ID NO: 318576 - DNA, 25 bp, Mus musculus
caggagcccagccaggtcgcctttg

SEQ ID NO: 318577 - DNA, 25 bp, Mus musculus
caggagcccagcgaggtcgcctttg

SEQ ID NO: 318578 - DNA, 25 bp, Mus musculus
caggagccccggcaggctaaactga

SEQ ID NO: 318579 - DNA, 25 bp, Mus musculus
caggagccccgggaggctaaactga

SEQ ID NO: 318580 - DNA, 25 bp, Mus musculus
caggagccccttatgtcaaaactaa

SEQ ID NO: 318581 - DNA, 25 bp, Mus musculus
caggagccccttttgtcaaaactaa

SEQ ID NO: 318582 - DNA, 25 bp, Mus musculus
caggagccgagcagtgagcctttga

SEQ ID NO: 318583 - DNA, 25 bp, Mus musculus
caggagccgagctgtgagcctttga

SEQ ID NO: 318584 - DNA, 25 bp, Mus musculus
caggagccgggtctgactttcccct

SEQ ID NO: 318585 - DNA, 25 bp, Mus musculus
caggagccgggtgtgactttcccct

SEQ ID NO: 318586 - DNA, 25 bp, Mus musculus
caggagcctcaactcagcaggatat

SEQ ID NO: 318587 - DNA, 25 bp, Mus musculus
caggagcctcaagtcagcaggatat

SEQ ID NO: 318588 - DNA, 25 bp, Mus musculus
caggagcctcctatcaaactgtgaa

SEQ ID NO: 318589 - DNA, 25 bp, Mus musculus
caggagcctcctttcaaactgtgaa

SEQ ID NO: 318590 - DNA, 25 bp, Mus musculus
caggagcctctcaccagcggagaag

SEQ ID NO: 318591 - DNA, 25 bp, Mus musculus
caggagcctctctccagcggagaag

SEQ ID NO: 318592 - DNA, 25 bp, Mus musculus
caggagcctctgaagcttggtggaa

SEQ ID NO: 318593 - DNA, 25 bp, Mus musculus
caggagcctctgtagcttggtggaa

SEQ ID NO: 318594 - DNA, 25 bp, Mus musculus
caggagcctggtattagcccggaga

SEQ ID NO: 318595 - DNA, 25 bp, Mus musculus
caggagcctggttttagcccggaga

SEQ ID NO: 318596 - DNA, 25 bp, Mus musculus
caggagccttttccagtggtctgta

SEQ ID NO: 318597 - DNA, 25 bp, Mus musculus
caggagccttttgcagtggtctgta

SEQ ID NO: 318598 - DNA, 25 bp, Mus musculus
caggagcgcaagatagatttggaat

SEQ ID NO: 318599 - DNA, 25 bp, Mus musculus
caggagcgcaagttagatttggaat

SEQ ID NO: 318600 - DNA, 25 bp, Mus musculus
caggagcggataattcaacttgaac

SEQ ID NO: 318601 - DNA, 25 bp, Mus musculus
caggagcggatatttcaacttgaac

SEQ ID NO: 318602 - DNA, 25 bp, Mus musculus
caggagcgggccagattccctccaa

SEQ ID NO: 318603 - DNA, 25 bp, Mus musculus
caggagcgggcctgattccctccaa

SEQ ID NO: 318604 - DNA, 25 bp, Mus musculus
caggagcggttcagagcggttacac

SEQ ID NO: 318605 - DNA, 25 bp, Mus musculus
caggagcggttctgagcggttacac

SEQ ID NO: 318606 - DNA, 25 bp, Mus musculus
caggagctactgaggccattaaaga

SEQ ID NO: 318607 - DNA, 25 bp, Mus musculus
caggagctactgtggccattaaaga

SEQ ID NO: 318608 - DNA, 25 bp, Mus musculus
caggagctctaactttcccaatgct

SEQ ID NO: 318609 - DNA, 25 bp, Mus musculus
caggagctctaagtttcccaatgct

SEQ ID NO: 318610 - DNA, 25 bp, Mus musculus
caggagctctctacggcttggtggc

SEQ ID NO: 318611 - DNA, 25 bp, Mus musculus
caggagctctcttcggcttggtggc

SEQ ID NO: 318612 - DNA, 25 bp, Mus musculus
caggagctgctgcaatcctcggaga

SEQ ID NO: 318613 - DNA, 25 bp, Mus musculus
caggagctgctggaatcctcggaga

SEQ ID NO: 318614 - DNA, 25 bp, Mus musculus
caggagctggctcctatctgttatg

SEQ ID NO: 318615 - DNA, 25 bp, Mus musculus
caggagctggctgctatctgttatg

SEQ ID NO: 318616 - DNA, 25 bp, Mus musculus
caggagctgtcaccatgtcggagaa

SEQ ID NO: 318617 - DNA, 25 bp, Mus musculus
caggagctgtcagcatgtcggagaa

SEQ ID NO: 318618 - DNA, 25 bp, Mus musculus
caggagctgtgtatcgtggtttacc

SEQ ID NO: 318619 - DNA, 25 bp, Mus musculus
caggagctgtgtttcgtggtttacc

SEQ ID NO: 318620 - DNA, 25 bp, Mus musculus
caggagcttctgaatgtacgccaag

SEQ ID NO: 318621 - DNA, 25 bp, Mus musculus
caggagcttctgtatgtacgccaag

SEQ ID NO: 318622 - DNA, 25 bp, Mus musculus
caggagcttcttatgtgcaaggaca

SEQ ID NO: 318623 - DNA, 25 bp, Mus musculus
caggagcttcttttgtgcaaggaca

SEQ ID NO: 318624 - DNA, 25 bp, Mus musculus
caggagcttgtcactgtcccatgac

SEQ ID NO: 318625 - DNA, 25 bp, Mus musculus
caggagcttgtctctgtcccatgac

SEQ ID NO: 318626 - DNA, 25 bp, Mus musculus
caggaggaagccaggttcacagcag

SEQ ID NO: 318627 - DNA, 25 bp, Mus musculus
caggaggaagcctggttcacagcag

SEQ ID NO: 318628 - DNA, 25 bp, Mus musculus
caggaggacaagcttggtgtgtgta

SEQ ID NO: 318629 - DNA, 25 bp, Mus musculus
caggaggacaaggttggtgtgtgta

SEQ ID NO: 318630 - DNA, 25 bp, Mus musculus
caggaggacagcagttagcctagtt

SEQ ID NO: 318631 - DNA, 25 bp, Mus musculus
caggaggacagctgttagcctagtt

SEQ ID NO: 318632 - DNA, 25 bp, Mus musculus
caggaggacccacgcgaaatatcca

SEQ ID NO: 318633 - DNA, 25 bp, Mus musculus
caggaggacccaggcgaaatatcca

SEQ ID NO: 318634 - DNA, 25 bp, Mus musculus
caggaggacggcatgggaccttcaa

SEQ ID NO: 318635 - DNA, 25 bp, Mus musculus
caggaggacggcttgggaccttcaa

SEQ ID NO: 318636 - DNA, 25 bp, Mus musculus
caggaggactcccttgcagtcacag

SEQ ID NO: 318637 - DNA, 25 bp, Mus musculus
caggaggactccgttgcagtcacag

SEQ ID NO: 318638 - DNA, 25 bp, Mus musculus
caggaggactctagcagggttttgt

SEQ ID NO: 318639 - DNA, 25 bp, Mus musculus
caggaggactctattaccctccagc

SEQ ID NO: 318640 - DNA, 25 bp, Mus musculus
caggaggactcttgcagggttttgt

SEQ ID NO: 318641 - DNA, 25 bp, Mus musculus
caggaggactcttttaccctccagc

SEQ ID NO: 318642 - DNA, 25 bp, Mus musculus
caggaggatcaaaaccatgtgggct

SEQ ID NO: 318643 - DNA, 25 bp, Mus musculus
caggaggatcaataccatgtgggct

SEQ ID NO: 318644 - DNA, 25 bp, Mus musculus
caggaggatcacataagccctggga

SEQ ID NO: 318645 - DNA, 25 bp, Mus musculus
caggaggatcacttaagccctggga

SEQ ID NO: 318646 - DNA, 25 bp, Mus musculus
caggaggatgcgcagccttctccag

SEQ ID NO: 318647 - DNA, 25 bp, Mus musculus
caggaggatgcggagccttctccag

SEQ ID NO: 318648 - DNA, 25 bp, Mus musculus
caggaggatgtgactctgctctggt

SEQ ID NO: 318649 - DNA, 25 bp, Mus musculus
caggaggatgtgtctctgctctggt

SEQ ID NO: 318650 - DNA, 25 bp, Mus musculus
caggaggattgcaaagtgttctagg

SEQ ID NO: 318651 - DNA, 25 bp, Mus musculus
caggaggattgctaagtgttctagg

SEQ ID NO: 318652 - DNA, 25 bp, Mus musculus
caggaggcaccccaaccaacccttg

SEQ ID NO: 318653 - DNA, 25 bp, Mus musculus
caggaggcacccgaaccaacccttg

SEQ ID NO: 318654 - DNA, 25 bp, Mus musculus
caggaggcaccgcatccaagggaaa

SEQ ID NO: 318655 - DNA, 25 bp, Mus musculus
caggaggcaccggatccaagggaaa

SEQ ID NO: 318656 - DNA, 25 bp, Mus musculus
caggaggcacctatttgagtaccaa

SEQ ID NO: 318657 - DNA, 25 bp, Mus musculus
caggaggcacctttttgagtaccaa

SEQ ID NO: 318658 - DNA, 25 bp, Mus musculus
caggaggcaggaccattggacattc

SEQ ID NO: 318659 - DNA, 25 bp, Mus musculus
caggaggcaggagcattggacattc

SEQ ID NO: 318660 - DNA, 25 bp, Mus musculus
caggaggccctcactggcgagtgta

SEQ ID NO: 318661 - DNA, 25 bp, Mus musculus
caggaggccctctctggcgagtgta

SEQ ID NO: 318662 - DNA, 25 bp, Mus musculus
caggaggccgctccttcaggcttag

SEQ ID NO: 318663 - DNA, 25 bp, Mus musculus
caggaggccgctgcttcaggcttag

SEQ ID NO: 318664 - DNA, 25 bp, Mus musculus
caggaggcgcctactaaggatcaat

SEQ ID NO: 318665 - DNA, 25 bp, Mus musculus
caggaggcgccttctaaggatcaat

SEQ ID NO: 318666 - DNA, 25 bp, Mus musculus
caggaggctctcaactgcttagtta

SEQ ID NO: 318667 - DNA, 25 bp, Mus musculus
caggaggctctctactgcttagtta

SEQ ID NO: 318668 - DNA, 25 bp, Mus musculus
caggagggcagcattatggcaatgt

SEQ ID NO: 318669 - DNA, 25 bp, Mus musculus
caggagggcagctttatggcaatgt

SEQ ID NO: 318670 - DNA, 25 bp, Mus musculus
caggagggcagtatgagtcgctcac

SEQ ID NO: 318671 - DNA, 25 bp, Mus musculus
caggagggcagtttgagtcgctcac

SEQ ID NO: 318672 - DNA, 25 bp, Mus musculus
caggagggcgtaatcattgccactt

SEQ ID NO: 318673 - DNA, 25 bp, Mus musculus
caggagggcgtattcattgccactt

SEQ ID NO: 318674 - DNA, 25 bp, Mus musculus
caggagggtatgacggccagtatta

SEQ ID NO: 318675 - DNA, 25 bp, Mus musculus
caggagggtatgtcggccagtatta

SEQ ID NO: 318676 - DNA, 25 bp, Mus musculus
caggagggttgaagtctccagtccc

SEQ ID NO: 318677 - DNA, 25 bp, Mus musculus
caggagggttgatgtctccagtccc

SEQ ID NO: 318678 - DNA, 25 bp, Mus musculus
caggagggtttcaaatgttttgcac

SEQ ID NO: 318679 - DNA, 25 bp, Mus musculus
caggagggtttctaatgttttgcac

SEQ ID NO: 318680 - DNA, 25 bp, Mus musculus
caggaggtatttattctaggcttga

SEQ ID NO: 318681 - DNA, 25 bp, Mus musculus
caggaggtattttttctaggcttga

SEQ ID NO: 318682 - DNA, 25 bp, Mus musculus
caggaggtccttcgcccatgttcat

SEQ ID NO: 318683 - DNA, 25 bp, Mus musculus
caggaggtccttggcccatgttcat

SEQ ID NO: 318684 - DNA, 25 bp, Mus musculus
caggaggtcgtgactcttttataaa

SEQ ID NO: 318685 - DNA, 25 bp, Mus musculus
caggaggtcgtgtctcttttataaa

SEQ ID NO: 318686 - DNA, 25 bp, Mus musculus
caggaggtgcaaaagctgaagaagc

SEQ ID NO: 318687 - DNA, 25 bp, Mus musculus
caggaggtgcaatagctgaagaagc

SEQ ID NO: 318688 - DNA, 25 bp, Mus musculus
caggaggtgctcaacaggctgacca

SEQ ID NO: 318689 - DNA, 25 bp, Mus musculus
caggaggtgctcaagaatttcttgt

SEQ ID NO: 318690 - DNA, 25 bp, Mus musculus
caggaggtgctctacaggctgacca

SEQ ID NO: 318691 - DNA, 25 bp, Mus musculus
caggaggtgctctagaatttcttgt

SEQ ID NO: 318692 - DNA, 25 bp, Mus musculus
caggaggtgctgagtctgctaaacc

SEQ ID NO: 318693 - DNA, 25 bp, Mus musculus
caggaggtgctgtgtctgctaaacc

SEQ ID NO: 318694 - DNA, 25 bp, Mus musculus
caggaggtgtgtcttcagaagcaaa

SEQ ID NO: 318695 - DNA, 25 bp, Mus musculus
caggaggtgtgtgttcagaagcaaa

SEQ ID NO: 318696 - DNA, 25 bp, Mus musculus
caggaggttgtgataaccactgaac

SEQ ID NO: 318697 - DNA, 25 bp, Mus musculus
caggaggttgtgttaaccactgaac

SEQ ID NO: 318698 - DNA, 25 bp, Mus musculus
caggagtaatccatttataccatgg

SEQ ID NO: 318699 - DNA, 25 bp, Mus musculus
caggagtaatccttttataccatgg

SEQ ID NO: 318700 - DNA, 25 bp, Mus musculus
caggagtacagaagtggcccaacac

SEQ ID NO: 318701 - DNA, 25 bp, Mus musculus
caggagtacagatgtggcccaacac

SEQ ID NO: 318702 - DNA, 25 bp, Mus musculus
caggagtaccatccttgctctgatg

SEQ ID NO: 318703 - DNA, 25 bp, Mus musculus
caggagtaccatgcttgctctgatg

SEQ ID NO: 318704 - DNA, 25 bp, Mus musculus
caggagtacgaccaggctggcccct

SEQ ID NO: 318705 - DNA, 25 bp, Mus musculus
caggagtacgacgaggctggcccct

SEQ ID NO: 318706 - DNA, 25 bp, Mus musculus
caggagtactacattctggagttat

SEQ ID NO: 318707 - DNA, 25 bp, Mus musculus
caggagtactactttctggagttat

SEQ ID NO: 318708 - DNA, 25 bp, Mus musculus
caggagtatctgaggctcccagagt

SEQ ID NO: 318709 - DNA, 25 bp, Mus musculus
caggagtatctgtggctcccagagt

SEQ ID NO: 318710 - DNA, 25 bp, Mus musculus
caggagtattcgattttattttcaa

SEQ ID NO: 318711 - DNA, 25 bp, Mus musculus
caggagtattcgtttttattttcaa

SEQ ID NO: 318712 - DNA, 25 bp, Mus musculus
caggagtcagaacctcgaggtcatc

SEQ ID NO: 318713 - DNA, 25 bp, Mus musculus
caggagtcagaagctcgaggtcatc

SEQ ID NO: 318714 - DNA, 25 bp, Mus musculus
caggagtcagcacctactttctgtc

SEQ ID NO: 318715 - DNA, 25 bp, Mus musculus
caggagtcagcagctactttctgtc

SEQ ID NO: 318716 - DNA, 25 bp, Mus musculus
caggagtcagttagctagtggataa

SEQ ID NO: 318717 - DNA, 25 bp, Mus musculus
caggagtcagtttgctagtggataa

SEQ ID NO: 318718 - DNA, 25 bp, Mus musculus
caggagtccacacgcattgcctctg

SEQ ID NO: 318719 - DNA, 25 bp, Mus musculus
caggagtccacaggcattgcctctg

SEQ ID NO: 318720 - DNA, 25 bp, Mus musculus
caggagtccatgaaacttgccatat

SEQ ID NO: 318721 - DNA, 25 bp, Mus musculus
caggagtccatgtaacttgccatat

SEQ ID NO: 318722 - DNA, 25 bp, Mus musculus
caggagtctccaccatttgagtatt

SEQ ID NO: 318723 - DNA, 25 bp, Mus musculus
caggagtctccactatgctaggcaa

SEQ ID NO: 318724 - DNA, 25 bp, Mus musculus
caggagtctccagcatttgagtatt

SEQ ID NO: 318725 - DNA, 25 bp, Mus musculus
caggagtctccagtatgctaggcaa

SEQ ID NO: 318726 - DNA, 25 bp, Mus musculus
caggagtctgcactctgtgaatagc

SEQ ID NO: 318727 - DNA, 25 bp, Mus musculus
caggagtctgcagtctgtgaatagc

SEQ ID NO: 318728 - DNA, 25 bp, Mus musculus
caggagtgacagcttaacctcttca

SEQ ID NO: 318729 - DNA, 25 bp, Mus musculus
caggagtgacaggttaacctcttca

SEQ ID NO: 318730 - DNA, 25 bp, Mus musculus
caggagtgacctcccgtgtggctat

SEQ ID NO: 318731 - DNA, 25 bp, Mus musculus
caggagtgacctgccgtgtggctat

SEQ ID NO: 318732 - DNA, 25 bp, Mus musculus
caggagtgcacaaggctacagccct

SEQ ID NO: 318733 - DNA, 25 bp, Mus musculus
caggagtgcacatggctacagccct

SEQ ID NO: 318734 - DNA, 25 bp, Mus musculus
caggagtgctttaatttctctatcg

SEQ ID NO: 318735 - DNA, 25 bp, Mus musculus
caggagtgcttttatttctctatcg

SEQ ID NO: 318736 - DNA, 25 bp, Mus musculus
caggagtggcagcaacccctctgag

SEQ ID NO: 318737 - DNA, 25 bp, Mus musculus
caggagtggcaggaacccctctgag

SEQ ID NO: 318738 - DNA, 25 bp, Mus musculus
caggagtggtttccccggtacttca

SEQ ID NO: 318739 - DNA, 25 bp, Mus musculus
caggagtggtttgcccggtacttca

SEQ ID NO: 318740 - DNA, 25 bp, Mus musculus
caggagtgtaacagcttgccggaca

SEQ ID NO: 318741 - DNA, 25 bp, Mus musculus
caggagtgtaactgcttgccggaca

SEQ ID NO: 318742 - DNA, 25 bp, Mus musculus
caggagtgtaagaccagcctgtctt

SEQ ID NO: 318743 - DNA, 25 bp, Mus musculus
caggagtgtaagtccagcctgtctt

SEQ ID NO: 318744 - DNA, 25 bp, Mus musculus
caggagtgtggaagcctactgtgta

SEQ ID NO: 318745 - DNA, 25 bp, Mus musculus
caggagtgtggatgcctactgtgta

SEQ ID NO: 318746 - DNA, 25 bp, Mus musculus
caggagtgtttgaggctcgtgtcac

SEQ ID NO: 318747 - DNA, 25 bp, Mus musculus
caggagtgtttgtggctcgtgtcac

SEQ ID NO: 318748 - DNA, 25 bp, Mus musculus
caggagttcaagacactctgagcta

SEQ ID NO: 318749 - DNA, 25 bp, Mus musculus
caggagttcaagtcactctgagcta

SEQ ID NO: 318750 - DNA, 25 bp, Mus musculus
caggagttcttgactggtgtacaaa

SEQ ID NO: 318751 - DNA, 25 bp, Mus musculus
caggagttcttgtctggtgtacaaa

SEQ ID NO: 318752 - DNA, 25 bp, Mus musculus
caggagttctttcgacttgcgtttc

SEQ ID NO: 318753 - DNA, 25 bp, Mus musculus
caggagttctttggacttgcgtttc

SEQ ID NO: 318754 - DNA, 25 bp, Mus musculus
caggagttgcttacctctgaagtaa

SEQ ID NO: 318755 - DNA, 25 bp, Mus musculus
caggagttgctttcctctgaagtaa

SEQ ID NO: 318756 - DNA, 25 bp, Mus musculus
caggagttggagagcccaagccaaa

SEQ ID NO: 318757 - DNA, 25 bp, Mus musculus
caggagttggagtgcccaagccaaa

SEQ ID NO: 318758 - DNA, 25 bp, Mus musculus
caggagttttaaatcttgccagtga

SEQ ID NO: 318759 - DNA, 25 bp, Mus musculus
caggagttttaattcttgccagtga

SEQ ID NO: 318760 - DNA, 25 bp, Mus musculus
caggataaacagcacctcgtactgt

SEQ ID NO: 318761 - DNA, 25 bp, Mus musculus
caggataaacaggacctcgtactgt

SEQ ID NO: 318762 - DNA, 25 bp, Mus musculus
caggataattaactctttgcatggg

SEQ ID NO: 318763 - DNA, 25 bp, Mus musculus
caggataattaagtctttgcatggg

SEQ ID NO: 318764 - DNA, 25 bp, Mus musculus
caggataattttctgcgtcagctca

SEQ ID NO: 318765 - DNA, 25 bp, Mus musculus
caggataattttgtgcgtcagctca

SEQ ID NO: 318766 - DNA, 25 bp, Mus musculus
caggataccgagcaggaacttgtca

SEQ ID NO: 318767 - DNA, 25 bp, Mus musculus
caggataccgaggaggaacttgtca

SEQ ID NO: 318768 - DNA, 25 bp, Mus musculus
caggatacgaaccagcaagctcaca

SEQ ID NO: 318769 - DNA, 25 bp, Mus musculus
caggatacgaacgagcaagctcaca

SEQ ID NO: 318770 - DNA, 25 bp, Mus musculus
caggatacgggtcggctaacagtca

SEQ ID NO: 318771 - DNA, 25 bp, Mus musculus
caggatacgggtgggctaacagtca

SEQ ID NO: 318772 - DNA, 25 bp, Mus musculus
caggatagacttcccttaattaaag

SEQ ID NO: 318773 - DNA, 25 bp, Mus musculus
caggatagacttgccttaattaaag

SEQ ID NO: 318774 - DNA, 25 bp, Mus musculus
caggataggactagctatgtggtca

SEQ ID NO: 318775 - DNA, 25 bp, Mus musculus
caggataggacttgctatgtggtca

SEQ ID NO: 318776 - DNA, 25 bp, Mus musculus
caggatataatgaatgaggctgcat

SEQ ID NO: 318777 - DNA, 25 bp, Mus musculus
caggatataatgtatgaggctgcat

SEQ ID NO: 318778 - DNA, 25 bp, Mus musculus
caggatatccctataagttacttgg

SEQ ID NO: 318779 - DNA, 25 bp, Mus musculus
caggatatccctttaagttacttgg

SEQ ID NO: 318780 - DNA, 25 bp, Mus musculus
caggatatcctcagatgtcttttga

SEQ ID NO: 318781 - DNA, 25 bp, Mus musculus
caggatatcctctgatgtcttttga

SEQ ID NO: 318782 - DNA, 25 bp, Mus musculus
caggatatcctgacttacgtgggta

SEQ ID NO: 318783 - DNA, 25 bp, Mus musculus
caggatatcctgtcttacgtgggta

SEQ ID NO: 318784 - DNA, 25 bp, Mus musculus
caggatatctgtctgttacgaagca

SEQ ID NO: 318785 - DNA, 25 bp, Mus musculus
caggatatctgtgtgttacgaagca

SEQ ID NO: 318786 - DNA, 25 bp, Mus musculus
caggatatggcccagttcatacata

SEQ ID NO: 318787 - DNA, 25 bp, Mus musculus
caggatatggccgagttcatacata

SEQ ID NO: 318788 - DNA, 25 bp, Mus musculus
caggatcaatcaatttacaccatga

SEQ ID NO: 318789 - DNA, 25 bp, Mus musculus
caggatcaatcattttacaccatga

SEQ ID NO: 318790 - DNA, 25 bp, Mus musculus
caggatcacaatatcaaggtttgcc

SEQ ID NO: 318791 - DNA, 25 bp, Mus musculus
caggatcacaatttcaaggtttgcc

SEQ ID NO: 318792 - DNA, 25 bp, Mus musculus
caggatcacccgctttaataaaatt

SEQ ID NO: 318793 - DNA, 25 bp, Mus musculus
caggatcacccggtttaataaaatt

SEQ ID NO: 318794 - DNA, 25 bp, Mus musculus
caggatcagatcagccgtgttcatg

SEQ ID NO: 318795 - DNA, 25 bp, Mus musculus
caggatcagatctgccgtgttcatg

SEQ ID NO: 318796 - DNA, 25 bp, Mus musculus
caggatcatccaagctgttgtaaat

SEQ ID NO: 318797 - DNA, 25 bp, Mus musculus
caggatcatccatgctgttgtaaat

SEQ ID NO: 318798 - DNA, 25 bp, Mus musculus
caggatccagccagttggaagcagg

SEQ ID NO: 318799 - DNA, 25 bp, Mus musculus
caggatccagcctgttggaagcagg

SEQ ID NO: 318800 - DNA, 25 bp, Mus musculus
caggatccagctctgagcagatgga

SEQ ID NO: 318801 - DNA, 25 bp, Mus musculus
caggatccagctgtgagcagatgga

SEQ ID NO: 318802 - DNA, 25 bp, Mus musculus
caggatcctggcagcagtagtagaa

SEQ ID NO: 318803 - DNA, 25 bp, Mus musculus
caggatcctggctgcagtagtagaa

SEQ ID NO: 318804 - DNA, 25 bp, Mus musculus
caggatccttagaggctccgggagt

SEQ ID NO: 318805 - DNA, 25 bp, Mus musculus
caggatccttagtggctccgggagt

SEQ ID NO: 318806 - DNA, 25 bp, Mus musculus
caggatcggtggcagcagatgctgt

SEQ ID NO: 318807 - DNA, 25 bp, Mus musculus
caggatcggtgggagcagatgctgt

SEQ ID NO: 318808 - DNA, 25 bp, Mus musculus
caggatctaaggctttaccctcggg

SEQ ID NO: 318809 - DNA, 25 bp, Mus musculus
caggatctaagggtttaccctcggg

SEQ ID NO: 318810 - DNA, 25 bp, Mus musculus
caggatctacgcaagcaagcagaca

SEQ ID NO: 318811 - DNA, 25 bp, Mus musculus
caggatctacgctagcaagcagaca

SEQ ID NO: 318812 - DNA, 25 bp, Mus musculus
caggatctagctcgctattgggata

SEQ ID NO: 318813 - DNA, 25 bp, Mus musculus
caggatctagctggctattgggata

SEQ ID NO: 318814 - DNA, 25 bp, Mus musculus
caggatctagtcacacatctcaggg

SEQ ID NO: 318815 - DNA, 25 bp, Mus musculus
caggatctagtctcacatctcaggg

SEQ ID NO: 318816 - DNA, 25 bp, Mus musculus
caggatctagtgactcctggtccaa

SEQ ID NO: 318817 - DNA, 25 bp, Mus musculus
caggatctagtgtctcctggtccaa

SEQ ID NO: 318818 - DNA, 25 bp, Mus musculus
caggatctatttattggaggtttat

SEQ ID NO: 318819 - DNA, 25 bp, Mus musculus
caggatctattttttggaggtttat

SEQ ID NO: 318820 - DNA, 25 bp, Mus musculus
caggatctcagcagggaccgggata

SEQ ID NO: 318821 - DNA, 25 bp, Mus musculus
caggatctcagctgggaccgggata

SEQ ID NO: 318822 - DNA, 25 bp, Mus musculus
caggatctcatgaactataggctag

SEQ ID NO: 318823 - DNA, 25 bp, Mus musculus
caggatctcatgtactataggctag

SEQ ID NO: 318824 - DNA, 25 bp, Mus musculus
caggatctctaacggccatagggct

SEQ ID NO: 318825 - DNA, 25 bp, Mus musculus
caggatctctaagggccatagggct

SEQ ID NO: 318826 - DNA, 25 bp, Mus musculus
caggatctctatatgaactgcggat

SEQ ID NO: 318827 - DNA, 25 bp, Mus musculus
caggatctctatttgaactgcggat

SEQ ID NO: 318828 - DNA, 25 bp, Mus musculus
caggatctctgcatggtaacaatga

SEQ ID NO: 318829 - DNA, 25 bp, Mus musculus
caggatctctgcttggtaacaatga

SEQ ID NO: 318830 - DNA, 25 bp, Mus musculus
caggatctctttccttgcaagagca

SEQ ID NO: 318831 - DNA, 25 bp, Mus musculus
caggatctctttcttaatggtgctc

SEQ ID NO: 318832 - DNA, 25 bp, Mus musculus
caggatctctttgcttgcaagagca

SEQ ID NO: 318833 - DNA, 25 bp, Mus musculus
caggatctctttgttaatggtgctc

SEQ ID NO: 318834 - DNA, 25 bp, Mus musculus
caggatctgactcactgcttacagg

SEQ ID NO: 318835 - DNA, 25 bp, Mus musculus
caggatctgactgactgcttacagg

SEQ ID NO: 318836 - DNA, 25 bp, Mus musculus
caggatctgagaatttcttctcgaa

SEQ ID NO: 318837 - DNA, 25 bp, Mus musculus
caggatctgagattttcttctcgaa

SEQ ID NO: 318838 - DNA, 25 bp, Mus musculus
caggatctgagtagtttcttccagg

SEQ ID NO: 318839 - DNA, 25 bp, Mus musculus
caggatctgagttgtttcttccagg

SEQ ID NO: 318840 - DNA, 25 bp, Mus musculus
caggatctgattaacctacgagaaa

SEQ ID NO: 318841 - DNA, 25 bp, Mus musculus
caggatctgatttacctacgagaaa

SEQ ID NO: 318842 - DNA, 25 bp, Mus musculus
caggatcttcacaagtttggggcca

SEQ ID NO: 318843 - DNA, 25 bp, Mus musculus
caggatcttcactagtttggggcca

SEQ ID NO: 318844 - DNA, 25 bp, Mus musculus
caggatctttgcctctcattaaaag

SEQ ID NO: 318845 - DNA, 25 bp, Mus musculus
caggatctttgcgtctcattaaaag

SEQ ID NO: 318846 - DNA, 25 bp, Mus musculus
caggatctttgtagcccaagcaggc

SEQ ID NO: 318847 - DNA, 25 bp, Mus musculus
caggatctttgttgcccaagcaggc

SEQ ID NO: 318848 - DNA, 25 bp, Mus musculus
caggatcttttgaggttctatataa

SEQ ID NO: 318849 - DNA, 25 bp, Mus musculus
caggatcttttgtggttctatataa

SEQ ID NO: 318850 - DNA, 25 bp, Mus musculus
caggatgaatgactggagagagaag

SEQ ID NO: 318851 - DNA, 25 bp, Mus musculus
caggatgaatgagtggagagagaag

SEQ ID NO: 318852 - DNA, 25 bp, Mus musculus
caggatgaccctcgagaaagcccca

SEQ ID NO: 318853 - DNA, 25 bp, Mus musculus
caggatgaccctggagaaagcccca

SEQ ID NO: 318854 - DNA, 25 bp, Mus musculus
caggatgactccatagattccaaga

SEQ ID NO: 318855 - DNA, 25 bp, Mus musculus
caggatgactccttagattccaaga

SEQ ID NO: 318856 - DNA, 25 bp, Mus musculus
caggatgagactaggccagatggct

SEQ ID NO: 318857 - DNA, 25 bp, Mus musculus
caggatgagacttggccagatggct

SEQ ID NO: 318858 - DNA, 25 bp, Mus musculus
caggatgagccacaggtgccagtaa

SEQ ID NO: 318859 - DNA, 25 bp, Mus musculus
caggatgagccagaggtgccagtaa

SEQ ID NO: 318860 - DNA, 25 bp, Mus musculus
caggatgagcctcagcttcccggga

SEQ ID NO: 318861 - DNA, 25 bp, Mus musculus
caggatgagcctgagcttcccggga

SEQ ID NO: 318862 - DNA, 25 bp, Mus musculus
caggatgaggtacttctttatctaa

SEQ ID NO: 318863 - DNA, 25 bp, Mus musculus
caggatgaggtagttctttatctaa

SEQ ID NO: 318864 - DNA, 25 bp, Mus musculus
caggatgcagcccacaagttgtgaa

SEQ ID NO: 318865 - DNA, 25 bp, Mus musculus
caggatgcagccgacaagttgtgaa

SEQ ID NO: 318866 - DNA, 25 bp, Mus musculus
caggatgccttcatgtgtcatgaga

SEQ ID NO: 318867 - DNA, 25 bp, Mus musculus
caggatgccttcttgtgtcatgaga

SEQ ID NO: 318868 - DNA, 25 bp, Mus musculus
caggatgcggtacccctgctgcagc

SEQ ID NO: 318869 - DNA, 25 bp, Mus musculus
caggatgcggtagccctgctgcagc

SEQ ID NO: 318870 - DNA, 25 bp, Mus musculus
caggatgctgagctgtgcaactaag

SEQ ID NO: 318871 - DNA, 25 bp, Mus musculus
caggatgctgaggtgtgcaactaag

SEQ ID NO: 318872 - DNA, 25 bp, Mus musculus
caggatgctgccaaacctagttcat

SEQ ID NO: 318873 - DNA, 25 bp, Mus musculus
caggatgctgccaagtgtctctctc

SEQ ID NO: 318874 - DNA, 25 bp, Mus musculus
caggatgctgcccactcgattgtta

SEQ ID NO: 318875 - DNA, 25 bp, Mus musculus
caggatgctgccgactcgattgtta

SEQ ID NO: 318876 - DNA, 25 bp, Mus musculus
caggatgctgcctaacctagttcat

SEQ ID NO: 318877 - DNA, 25 bp, Mus musculus
caggatgctgcctagtgtctctctc

SEQ ID NO: 318878 - DNA, 25 bp, Mus musculus
caggatgctgctagtgctaggaaca

SEQ ID NO: 318879 - DNA, 25 bp, Mus musculus
caggatgctgcttgtgctaggaaca

SEQ ID NO: 318880 - DNA, 25 bp, Mus musculus
caggatgcttgcagaagtcggacaa

SEQ ID NO: 318881 - DNA, 25 bp, Mus musculus
caggatgcttgctgaagtcggacaa

SEQ ID NO: 318882 - DNA, 25 bp, Mus musculus
caggatgcttttcggtctgcagttt

SEQ ID NO: 318883 - DNA, 25 bp, Mus musculus
caggatgcttttgggtctgcagttt

SEQ ID NO: 318884 - DNA, 25 bp, Mus musculus
caggatggagaaccacccgctgtgt

SEQ ID NO: 318885 - DNA, 25 bp, Mus musculus
caggatggagaagcacccgctgtgt

SEQ ID NO: 318886 - DNA, 25 bp, Mus musculus
caggatggagagagccagtccccgt

SEQ ID NO: 318887 - DNA, 25 bp, Mus musculus
caggatggagagtgccagtccccgt

SEQ ID NO: 318888 - DNA, 25 bp, Mus musculus
caggatggattgcttgtagtcccaa

SEQ ID NO: 318889 - DNA, 25 bp, Mus musculus
caggatggattggttgtagtcccaa

SEQ ID NO: 318890 - DNA, 25 bp, Mus musculus
caggatggccatattttatacatgt

SEQ ID NO: 318891 - DNA, 25 bp, Mus musculus
caggatggccattttttatacatgt

SEQ ID NO: 318892 - DNA, 25 bp, Mus musculus
caggatgggaagctcagttgcaaat

SEQ ID NO: 318893 - DNA, 25 bp, Mus musculus
caggatgggaaggtcagttgcaaat

SEQ ID NO: 318894 - DNA, 25 bp, Mus musculus
caggatgggtttacctaagtagatg

SEQ ID NO: 318895 - DNA, 25 bp, Mus musculus
caggatgggttttcctaagtagatg

SEQ ID NO: 318896 - DNA, 25 bp, Mus musculus
caggatggtccacccttgggatgaa

SEQ ID NO: 318897 - DNA, 25 bp, Mus musculus
caggatggtccagccttgggatgaa

SEQ ID NO: 318898 - DNA, 25 bp, Mus musculus
caggatggtcctattgtttgagaga

SEQ ID NO: 318899 - DNA, 25 bp, Mus musculus
caggatggtccttttgtttgagaga

SEQ ID NO: 318900 - DNA, 25 bp, Mus musculus
caggatggtgctcatgtctccagcg

SEQ ID NO: 318901 - DNA, 25 bp, Mus musculus
caggatggtgctgatgtctccagcg

SEQ ID NO: 318902 - DNA, 25 bp, Mus musculus
caggatggttttcttgtcttttgtg

SEQ ID NO: 318903 - DNA, 25 bp, Mus musculus
caggatggttttgttgtcttttgtg

SEQ ID NO: 318904 - DNA, 25 bp, Mus musculus
caggatgtcagtagcccaggtacat

SEQ ID NO: 318905 - DNA, 25 bp, Mus musculus
caggatgtcagttgcccaggtacat

SEQ ID NO: 318906 - DNA, 25 bp, Mus musculus
caggatgtcataaaatcaacccagt

SEQ ID NO: 318907 - DNA, 25 bp, Mus musculus
caggatgtcatataatcaacccagt

SEQ ID NO: 318908 - DNA, 25 bp, Mus musculus
caggatgtcattccaggacgtcact

SEQ ID NO: 318909 - DNA, 25 bp, Mus musculus
caggatgtcattgcaggacgtcact

SEQ ID NO: 318910 - DNA, 25 bp, Mus musculus
caggatgtccaaagccctttgtact

SEQ ID NO: 318911 - DNA, 25 bp, Mus musculus
caggatgtccaatgccctttgtact

SEQ ID NO: 318912 - DNA, 25 bp, Mus musculus
caggatgtcctcaaaactcacgatc

SEQ ID NO: 318913 - DNA, 25 bp, Mus musculus
caggatgtcctctaaactcacgatc

SEQ ID NO: 318914 - DNA, 25 bp, Mus musculus
caggatgtcctgactgatgtgtgga

SEQ ID NO: 318915 - DNA, 25 bp, Mus musculus
caggatgtcctgtctgatgtgtgga

SEQ ID NO: 318916 - DNA, 25 bp, Mus musculus
caggatgtcgcaagacctcgggaga

SEQ ID NO: 318917 - DNA, 25 bp, Mus musculus
caggatgtcgcatgacctcgggaga

SEQ ID NO: 318918 - DNA, 25 bp, Mus musculus
caggatgtgaaaccccagcgcagcc

SEQ ID NO: 318919 - DNA, 25 bp, Mus musculus
caggatgtgaaagcccagcgcagcc

SEQ ID NO: 318920 - DNA, 25 bp, Mus musculus
caggatgtgagtactgctgtagcct

SEQ ID NO: 318921 - DNA, 25 bp, Mus musculus
caggatgtgagttctgctgtagcct

SEQ ID NO: 318922 - DNA, 25 bp, Mus musculus
caggatgtggagattgcccgatgcc

SEQ ID NO: 318923 - DNA, 25 bp, Mus musculus
caggatgtggagtttgcccgatgcc

SEQ ID NO: 318924 - DNA, 25 bp, Mus musculus
caggatgtggccagccgtcagacag

SEQ ID NO: 318925 - DNA, 25 bp, Mus musculus
caggatgtggcctgccgtcagacag

SEQ ID NO: 318926 - DNA, 25 bp, Mus musculus
caggatgtgggcattcagctccgac

SEQ ID NO: 318927 - DNA, 25 bp, Mus musculus
caggatgtgggctttcagctccgac

SEQ ID NO: 318928 - DNA, 25 bp, Mus musculus
caggatgttatacggcagagcaagt

SEQ ID NO: 318929 - DNA, 25 bp, Mus musculus
caggatgttatagggcagagcaagt

SEQ ID NO: 318930 - DNA, 25 bp, Mus musculus
caggatgttcaaccctccagaaata

SEQ ID NO: 318931 - DNA, 25 bp, Mus musculus
caggatgttcaagcctccagaaata

SEQ ID NO: 318932 - DNA, 25 bp, Mus musculus
caggatgttcctccagtcatgaatg

SEQ ID NO: 318933 - DNA, 25 bp, Mus musculus
caggatgttcctgcagtcatgaatg

SEQ ID NO: 318934 - DNA, 25 bp, Mus musculus
caggatgttctcaggtttcctgtcc

SEQ ID NO: 318935 - DNA, 25 bp, Mus musculus
caggatgttctctggtttcctgtcc

SEQ ID NO: 318936 - DNA, 25 bp, Mus musculus
caggattaactaagtggcttcaaga

SEQ ID NO: 318937 - DNA, 25 bp, Mus musculus
caggattaactatgtggcttcaaga

SEQ ID NO: 318938 - DNA, 25 bp, Mus musculus
caggattaccccatttgtcgtgatc

SEQ ID NO: 318939 - DNA, 25 bp, Mus musculus
caggattaccccttttgtcgtgatc

SEQ ID NO: 318940 - DNA, 25 bp, Mus musculus
caggattcactaaccctctaatgga

SEQ ID NO: 318941 - DNA, 25 bp, Mus musculus
caggattcactatccctctaatgga

SEQ ID NO: 318942 - DNA, 25 bp, Mus musculus
caggattcagagatcaggcccgtgt

SEQ ID NO: 318943 - DNA, 25 bp, Mus musculus
caggattcagagttcaggcccgtgt

SEQ ID NO: 318944 - DNA, 25 bp, Mus musculus
caggattcagcccagtttgtgctca

SEQ ID NO: 318945 - DNA, 25 bp, Mus musculus
caggattcagccgagtttgtgctca

SEQ ID NO: 318946 - DNA, 25 bp, Mus musculus
caggattcaggacaataaaaccctt

SEQ ID NO: 318947 - DNA, 25 bp, Mus musculus
caggattcaggagaataaaaccctt

SEQ ID NO: 318948 - DNA, 25 bp, Mus musculus
caggattcattcatgttgcagacta

SEQ ID NO: 318949 - DNA, 25 bp, Mus musculus
caggattcattcttgttgcagacta

SEQ ID NO: 318950 - DNA, 25 bp, Mus musculus
caggattcccaaacttttagggtca

SEQ ID NO: 318951 - DNA, 25 bp, Mus musculus
caggattcccaatcttttagggtca

SEQ ID NO: 318952 - DNA, 25 bp, Mus musculus
caggattcccttattgtcacagatt

SEQ ID NO: 318953 - DNA, 25 bp, Mus musculus
caggattccctttttgtcacagatt

SEQ ID NO: 318954 - DNA, 25 bp, Mus musculus
caggattcctggaaccgggtggact

SEQ ID NO: 318955 - DNA, 25 bp, Mus musculus
caggattcctggtaccgggtggact

SEQ ID NO: 318956 - DNA, 25 bp, Mus musculus
caggattcctttatcttgctgaagt

SEQ ID NO: 318957 - DNA, 25 bp, Mus musculus
caggattcctttttcttgctgaagt

SEQ ID NO: 318958 - DNA, 25 bp, Mus musculus
caggattctgctactgacagtttca

SEQ ID NO: 318959 - DNA, 25 bp, Mus musculus
caggattctgcttctgacagtttca

SEQ ID NO: 318960 - DNA, 25 bp, Mus musculus
caggattgagcccagttcacatacc

SEQ ID NO: 318961 - DNA, 25 bp, Mus musculus
caggattgagccgagttcacatacc

SEQ ID NO: 318962 - DNA, 25 bp, Mus musculus
caggattgagtcaggctgcctcgca

SEQ ID NO: 318963 - DNA, 25 bp, Mus musculus
caggattgagtctggctgcctcgca

SEQ ID NO: 318964 - DNA, 25 bp, Mus musculus
caggattgagtgacagctgctcctc

SEQ ID NO: 318965 - DNA, 25 bp, Mus musculus
caggattgagtgtcagctgctcctc

SEQ ID NO: 318966 - DNA, 25 bp, Mus musculus
caggattgctcaaggtgctggcact

SEQ ID NO: 318967 - DNA, 25 bp, Mus musculus
caggattgctcatggtgctggcact

SEQ ID NO: 318968 - DNA, 25 bp, Mus musculus
caggattgctggcaacactatggta

SEQ ID NO: 318969 - DNA, 25 bp, Mus musculus
caggattgctgggaacactatggta

SEQ ID NO: 318970 - DNA, 25 bp, Mus musculus
caggattggctgacacgtgacacaa

SEQ ID NO: 318971 - DNA, 25 bp, Mus musculus
caggattggctgtcacgtgacacaa

SEQ ID NO: 318972 - DNA, 25 bp, Mus musculus
caggatttccttccgtgctaacgaa

SEQ ID NO: 318973 - DNA, 25 bp, Mus musculus
caggatttccttgcgtgctaacgaa

SEQ ID NO: 318974 - DNA, 25 bp, Mus musculus
caggatttctcaaccctttatggaa

SEQ ID NO: 318975 - DNA, 25 bp, Mus musculus
caggatttctcatccctttatggaa

SEQ ID NO: 318976 - DNA, 25 bp, Mus musculus
caggatttctgtcatgtaaagacca

SEQ ID NO: 318977 - DNA, 25 bp, Mus musculus
caggatttctgtgatgtaaagacca

SEQ ID NO: 318978 - DNA, 25 bp, Mus musculus
caggatttcttaattagctttggag

SEQ ID NO: 318979 - DNA, 25 bp, Mus musculus
caggatttcttatttagctttggag

SEQ ID NO: 318980 - DNA, 25 bp, Mus musculus
caggatttggacattctaccatgaa

SEQ ID NO: 318981 - DNA, 25 bp, Mus musculus
caggatttggactttctaccatgaa

SEQ ID NO: 318982 - DNA, 25 bp, Mus musculus
caggatttggatcttctactcccag

SEQ ID NO: 318983 - DNA, 25 bp, Mus musculus
caggatttggatgttctactcccag

SEQ ID NO: 318984 - DNA, 25 bp, Mus musculus
caggattttacgcttccgttcacgt

SEQ ID NO: 318985 - DNA, 25 bp, Mus musculus
caggattttacggttccgttcacgt

SEQ ID NO: 318986 - DNA, 25 bp, Mus musculus
caggattttagtagctcacggttgg

SEQ ID NO: 318987 - DNA, 25 bp, Mus musculus
caggattttagttgctcacggttgg

SEQ ID NO: 318988 - DNA, 25 bp, Mus musculus
caggattttctgatccccaagggca

SEQ ID NO: 318989 - DNA, 25 bp, Mus musculus
caggattttctgttccccaagggca

SEQ ID NO: 318990 - DNA, 25 bp, Mus musculus
caggattttgaaaagctccagctcc

SEQ ID NO: 318991 - DNA, 25 bp, Mus musculus
caggattttgaatagctccagctcc

SEQ ID NO: 318992 - DNA, 25 bp, Mus musculus
caggatttttaacatacacatggat

SEQ ID NO: 318993 - DNA, 25 bp, Mus musculus
caggatttttaagatacacatggat

SEQ ID NO: 318994 - DNA, 25 bp, Mus musculus
caggcaaaaaagaggcagacctttg

SEQ ID NO: 318995 - DNA, 25 bp, Mus musculus
caggcaaaaaagtggcagacctttg

SEQ ID NO: 318996 - DNA, 25 bp, Mus musculus
caggcaaaagccactatgatacata

SEQ ID NO: 318997 - DNA, 25 bp, Mus musculus
caggcaaaagcctctatgatacata

SEQ ID NO: 318998 - DNA, 25 bp, Mus musculus
caggcaaacaggaatcttctgtagt

SEQ ID NO: 318999 - DNA, 25 bp, Mus musculus
caggcaaacaggtatcttctgtagt

SEQ ID NO: 319000 - DNA, 25 bp, Mus musculus
caggcaaacgttaacctttttgctg

SEQ ID NO: 319001 - DNA, 25 bp, Mus musculus
caggcaaacgtttacctttttgctg

SEQ ID NO: 319002 - DNA, 25 bp, Mus musculus
caggcaaactacagctacttttccc

SEQ ID NO: 319003 - DNA, 25 bp, Mus musculus
caggcaaactactgctacttttccc

SEQ ID NO: 319004 - DNA, 25 bp, Mus musculus
caggcaaagcacacaagcacagaga

SEQ ID NO: 319005 - DNA, 25 bp, Mus musculus
caggcaaagcacagaaacacatttt

SEQ ID NO: 319006 - DNA, 25 bp, Mus musculus
caggcaaagcactcaagcacagaga

SEQ ID NO: 319007 - DNA, 25 bp, Mus musculus
caggcaaagcactgaaacacatttt

SEQ ID NO: 319008 - DNA, 25 bp, Mus musculus
caggcaaagctaatttaaccagcat

SEQ ID NO: 319009 - DNA, 25 bp, Mus musculus
caggcaaagctattttaaccagcat

SEQ ID NO: 319010 - DNA, 25 bp, Mus musculus
caggcaaagctgctccacagagatc

SEQ ID NO: 319011 - DNA, 25 bp, Mus musculus
caggcaaagctggtccacagagatc

SEQ ID NO: 319012 - DNA, 25 bp, Mus musculus
caggcaaaggccacatgcctcagac

SEQ ID NO: 319013 - DNA, 25 bp, Mus musculus
caggcaaaggcctcatgcctcagac

SEQ ID NO: 319014 - DNA, 25 bp, Mus musculus
caggcaaagtcacccagcgaggcgc

SEQ ID NO: 319015 - DNA, 25 bp, Mus musculus
caggcaaagtcagccagcgaggcgc

SEQ ID NO: 319016 - DNA, 25 bp, Mus musculus
caggcaaatgacaataagaaggctt

SEQ ID NO: 319017 - DNA, 25 bp, Mus musculus
caggcaaatgactataagaaggctt

SEQ ID NO: 319018 - DNA, 25 bp, Mus musculus
caggcaaatgggacttaggatccct

SEQ ID NO: 319019 - DNA, 25 bp, Mus musculus
caggcaaatgggtcttaggatccct

SEQ ID NO: 319020 - DNA, 25 bp, Mus musculus
caggcaacatgaacagtatcaggtt

SEQ ID NO: 319021 - DNA, 25 bp, Mus musculus
caggcaacatgatcagtatcaggtt

SEQ ID NO: 319022 - DNA, 25 bp, Mus musculus
caggcaacatttcagctactggctg

SEQ ID NO: 319023 - DNA, 25 bp, Mus musculus
caggcaacatttcagtggagacttc

SEQ ID NO: 319024 - DNA, 25 bp, Mus musculus
caggcaacatttgagctactggctg

SEQ ID NO: 319025 - DNA, 25 bp, Mus musculus
caggcaacatttgagtggagacttc

SEQ ID NO: 319026 - DNA, 25 bp, Mus musculus
caggcaaccgtaattcaagcagaac

SEQ ID NO: 319027 - DNA, 25 bp, Mus musculus
caggcaaccgtatttcaagcagaac

SEQ ID NO: 319028 - DNA, 25 bp, Mus musculus
caggcaaccgtcatactccgtgatt

SEQ ID NO: 319029 - DNA, 25 bp, Mus musculus
caggcaaccgtcttactccgtgatt

SEQ ID NO: 319030 - DNA, 25 bp, Mus musculus
caggcaacgtttcctggatcattgc

SEQ ID NO: 319031 - DNA, 25 bp, Mus musculus
caggcaacgtttgctggatcattgc

SEQ ID NO: 319032 - DNA, 25 bp, Mus musculus
caggcaactctgaggatcctagggc

SEQ ID NO: 319033 - DNA, 25 bp, Mus musculus
caggcaactctgtggatcctagggc

SEQ ID NO: 319034 - DNA, 25 bp, Mus musculus
caggcaacttgaccagacaactgtt

SEQ ID NO: 319035 - DNA, 25 bp, Mus musculus
caggcaacttgagcagacaactgtt

SEQ ID NO: 319036 - DNA, 25 bp, Mus musculus
caggcaagactcagactctccacag

SEQ ID NO: 319037 - DNA, 25 bp, Mus musculus
caggcaagactctgactctccacag

SEQ ID NO: 319038 - DNA, 25 bp, Mus musculus
caggcaagcaagcagccatgaacca

SEQ ID NO: 319039 - DNA, 25 bp, Mus musculus
caggcaagcaaggagccatgaacca

SEQ ID NO: 319040 - DNA, 25 bp, Mus musculus
caggcaagccaaattttaggtgaca

SEQ ID NO: 319041 - DNA, 25 bp, Mus musculus
caggcaagccaatttttaggtgaca

SEQ ID NO: 319042 - DNA, 25 bp, Mus musculus
caggcaagccctcatttgaagacaa

SEQ ID NO: 319043 - DNA, 25 bp, Mus musculus
caggcaagccctgatttgaagacaa

SEQ ID NO: 319044 - DNA, 25 bp, Mus musculus
caggcaagctgacataccgttcatt

SEQ ID NO: 319045 - DNA, 25 bp, Mus musculus
caggcaagctgagataccgttcatt

SEQ ID NO: 319046 - DNA, 25 bp, Mus musculus
caggcaaggaacaccaaagacagaa

SEQ ID NO: 319047 - DNA, 25 bp, Mus musculus
caggcaaggaactccaaagacagaa

SEQ ID NO: 319048 - DNA, 25 bp, Mus musculus
caggcaaggctcacgctcagcagct

SEQ ID NO: 319049 - DNA, 25 bp, Mus musculus
caggcaaggctctcgctcagcagct

SEQ ID NO: 319050 - DNA, 25 bp, Mus musculus
caggcaaggtacacttcatgttggt

SEQ ID NO: 319051 - DNA, 25 bp, Mus musculus
caggcaaggtactcttcatgttggt

SEQ ID NO: 319052 - DNA, 25 bp, Mus musculus
caggcaaggtggcacaggactttaa

SEQ ID NO: 319053 - DNA, 25 bp, Mus musculus
caggcaaggtgggacaggactttaa

SEQ ID NO: 319054 - DNA, 25 bp, Mus musculus
caggcaagtacactgtggtgcacac

SEQ ID NO: 319055 - DNA, 25 bp, Mus musculus
caggcaagtacagtgtggtgcacac

SEQ ID NO: 319056 - DNA, 25 bp, Mus musculus
caggcaagtccgacccgtcctgaga

SEQ ID NO: 319057 - DNA, 25 bp, Mus musculus
caggcaagtccgtcccgtcctgaga

SEQ ID NO: 319058 - DNA, 25 bp, Mus musculus
caggcaataagcatgtccaggtatt

SEQ ID NO: 319059 - DNA, 25 bp, Mus musculus
caggcaataagcttgtccaggtatt

SEQ ID NO: 319060 - DNA, 25 bp, Mus musculus
caggcaatcaaacctcttctccagt

SEQ ID NO: 319061 - DNA, 25 bp, Mus musculus
caggcaatcaaagctcttctccagt

SEQ ID NO: 319062 - DNA, 25 bp, Mus musculus
caggcaatcacgacataggcggtta

SEQ ID NO: 319063 - DNA, 25 bp, Mus musculus
caggcaatcacgtcataggcggtta

SEQ ID NO: 319064 - DNA, 25 bp, Mus musculus
caggcaatcactaggtatcccttta

SEQ ID NO: 319065 - DNA, 25 bp, Mus musculus
caggcaatcacttggtatcccttta

SEQ ID NO: 319066 - DNA, 25 bp, Mus musculus
caggcaattttgctttctgagaaat

SEQ ID NO: 319067 - DNA, 25 bp, Mus musculus
caggcaattttggtttctgagaaat

SEQ ID NO: 319068 - DNA, 25 bp, Mus musculus
caggcacaagttacaacgctgttcc

SEQ ID NO: 319069 - DNA, 25 bp, Mus musculus
caggcacaagtttcaacgctgttcc

SEQ ID NO: 319070 - DNA, 25 bp, Mus musculus
caggcacagtatcataggcacacac

SEQ ID NO: 319071 - DNA, 25 bp, Mus musculus
caggcacagtatgataggcacacac

SEQ ID NO: 319072 - DNA, 25 bp, Mus musculus
caggcacatgctatctccagaggac

SEQ ID NO: 319073 - DNA, 25 bp, Mus musculus
caggcacatgctttctccagaggac

SEQ ID NO: 319074 - DNA, 25 bp, Mus musculus
caggcacatggaaaattgggacatt

SEQ ID NO: 319075 - DNA, 25 bp, Mus musculus
caggcacatggataattgggacatt

SEQ ID NO: 319076 - DNA, 25 bp, Mus musculus
caggcacattgaccagatgctctca

SEQ ID NO: 319077 - DNA, 25 bp, Mus musculus
caggcacattgagcagatgctctca

SEQ ID NO: 319078 - DNA, 25 bp, Mus musculus
caggcacatttacggcagactgcta

SEQ ID NO: 319079 - DNA, 25 bp, Mus musculus
caggcacatttagggcagactgcta

SEQ ID NO: 319080 - DNA, 25 bp, Mus musculus
caggcaccaaacatgtacataatac

SEQ ID NO: 319081 - DNA, 25 bp, Mus musculus
caggcaccaaacttgtacataatac

SEQ ID NO: 319082 - DNA, 25 bp, Mus musculus
caggcaccagtcagaccgatatgtg

SEQ ID NO: 319083 - DNA, 25 bp, Mus musculus
caggcaccagtctgaccgatatgtg

SEQ ID NO: 319084 - DNA, 25 bp, Mus musculus
caggcaccatgccaaagactggatg

SEQ ID NO: 319085 - DNA, 25 bp, Mus musculus
caggcaccatgcgaaagactggatg

SEQ ID NO: 319086 - DNA, 25 bp, Mus musculus
caggcaccccacagagaacatgttg

SEQ ID NO: 319087 - DNA, 25 bp, Mus musculus
caggcaccccactgagaacatgttg

SEQ ID NO: 319088 - DNA, 25 bp, Mus musculus
caggcaccctggagcttgttactac

SEQ ID NO: 319089 - DNA, 25 bp, Mus musculus
caggcaccctggtgcttgttactac

SEQ ID NO: 319090 - DNA, 25 bp, Mus musculus
caggcaccgaccagaagggtcacaa

SEQ ID NO: 319091 - DNA, 25 bp, Mus musculus
caggcaccgacctgaagggtcacaa

SEQ ID NO: 319092 - DNA, 25 bp, Mus musculus
caggcacctgggatgagtattttga

SEQ ID NO: 319093 - DNA, 25 bp, Mus musculus
caggcacctgggttgagtattttga

SEQ ID NO: 319094 - DNA, 25 bp, Mus musculus
caggcacgctgaaggctccttctct

SEQ ID NO: 319095 - DNA, 25 bp, Mus musculus
caggcacgctgatggctccttctct

SEQ ID NO: 319096 - DNA, 25 bp, Mus musculus
caggcacgcttgactgctggcggaa

SEQ ID NO: 319097 - DNA, 25 bp, Mus musculus
caggcacgcttgtctgctggcggaa

SEQ ID NO: 319098 - DNA, 25 bp, Mus musculus
caggcacgtgtaaacccaggaggga

SEQ ID NO: 319099 - DNA, 25 bp, Mus musculus
caggcacgtgtatacccaggaggga

SEQ ID NO: 319100 - DNA, 25 bp, Mus musculus
caggcactaaagctaatgttatttt

SEQ ID NO: 319101 - DNA, 25 bp, Mus musculus
caggcactaaaggtaatgttatttt

SEQ ID NO: 319102 - DNA, 25 bp, Mus musculus
caggcactacagactcgacgtccaa

SEQ ID NO: 319103 - DNA, 25 bp, Mus musculus
caggcactacagtctcgacgtccaa

SEQ ID NO: 319104 - DNA, 25 bp, Mus musculus
caggcactactaacaagacaggcat

SEQ ID NO: 319105 - DNA, 25 bp, Mus musculus
caggcactactatcaagacaggcat

SEQ ID NO: 319106 - DNA, 25 bp, Mus musculus
caggcactatttaacagagggagga

SEQ ID NO: 319107 - DNA, 25 bp, Mus musculus
caggcactattttacagagggagga

SEQ ID NO: 319108 - DNA, 25 bp, Mus musculus
caggcactgcacacggtgttcagga

SEQ ID NO: 319109 - DNA, 25 bp, Mus musculus
caggcactgcactcggtgttcagga

SEQ ID NO: 319110 - DNA, 25 bp, Mus musculus
caggcactgcgacacaactctacaa

SEQ ID NO: 319111 - DNA, 25 bp, Mus musculus
caggcactgcgagacaactctacaa

SEQ ID NO: 319112 - DNA, 25 bp, Mus musculus
caggcactggacatgaagcggcact

SEQ ID NO: 319113 - DNA, 25 bp, Mus musculus
caggcactggacttgaagcggcact

SEQ ID NO: 319114 - DNA, 25 bp, Mus musculus
caggcactggcacccactgaagctg

SEQ ID NO: 319115 - DNA, 25 bp, Mus musculus
caggcactggcagccactgaagctg

SEQ ID NO: 319116 - DNA, 25 bp, Mus musculus
caggcactgggcaccggaggactca

SEQ ID NO: 319117 - DNA, 25 bp, Mus musculus
caggcactgggctccggaggactca

SEQ ID NO: 319118 - DNA, 25 bp, Mus musculus
caggcactgtgactatttcagggtt

SEQ ID NO: 319119 - DNA, 25 bp, Mus musculus
caggcactgtgagtatttcagggtt

SEQ ID NO: 319120 - DNA, 25 bp, Mus musculus
caggcactgtttagtttcggttaga

SEQ ID NO: 319121 - DNA, 25 bp, Mus musculus
caggcactgtttccacggctgaagt

SEQ ID NO: 319122 - DNA, 25 bp, Mus musculus
caggcactgtttgcacggctgaagt

SEQ ID NO: 319123 - DNA, 25 bp, Mus musculus
caggcactgttttgtttcggttaga

SEQ ID NO: 319124 - DNA, 25 bp, Mus musculus
caggcagaacatcggtagtacttga

SEQ ID NO: 319125 - DNA, 25 bp, Mus musculus
caggcagaacatgggtagtacttga

SEQ ID NO: 319126 - DNA, 25 bp, Mus musculus
caggcagaatatcgtctgtgtccaa

SEQ ID NO: 319127 - DNA, 25 bp, Mus musculus
caggcagaatatggtctgtgtccaa

SEQ ID NO: 319128 - DNA, 25 bp, Mus musculus
caggcagacagaattatgggttcaa

SEQ ID NO: 319129 - DNA, 25 bp, Mus musculus
caggcagacagatttatgggttcaa

SEQ ID NO: 319130 - DNA, 25 bp, Mus musculus
caggcagacatcattgtgcatctct

SEQ ID NO: 319131 - DNA, 25 bp, Mus musculus
caggcagacatctttgtgcatctct

SEQ ID NO: 319132 - DNA, 25 bp, Mus musculus
caggcagactgcaattttgtgatta

SEQ ID NO: 319133 - DNA, 25 bp, Mus musculus
caggcagactgctattttgtgatta

SEQ ID NO: 319134 - DNA, 25 bp, Mus musculus
caggcagactttatgttcgtttaga

SEQ ID NO: 319135 - DNA, 25 bp, Mus musculus
caggcagactttttgttcgtttaga

SEQ ID NO: 319136 - DNA, 25 bp, Mus musculus
caggcagagacacgacctttatcta

SEQ ID NO: 319137 - DNA, 25 bp, Mus musculus
caggcagagacaggacctttatcta

SEQ ID NO: 319138 - DNA, 25 bp, Mus musculus
caggcagagatactgaccttcctct

SEQ ID NO: 319139 - DNA, 25 bp, Mus musculus
caggcagagatagtgaccttcctct

SEQ ID NO: 319140 - DNA, 25 bp, Mus musculus
caggcagaggcccacttaatagaca

SEQ ID NO: 319141 - DNA, 25 bp, Mus musculus
caggcagaggccgacttaatagaca

SEQ ID NO: 319142 - DNA, 25 bp, Mus musculus
caggcagagtctcttctagaagaaa

SEQ ID NO: 319143 - DNA, 25 bp, Mus musculus
caggcagagtctgttctagaagaaa

SEQ ID NO: 319144 - DNA, 25 bp, Mus musculus
caggcagagtttcctgcttccgtct

SEQ ID NO: 319145 - DNA, 25 bp, Mus musculus
caggcagagtttgctgcttccgtct

SEQ ID NO: 319146 - DNA, 25 bp, Mus musculus
caggcagatagtactgatcaaaatc

SEQ ID NO: 319147 - DNA, 25 bp, Mus musculus
caggcagatagttctgatcaaaatc

SEQ ID NO: 319148 - DNA, 25 bp, Mus musculus
caggcagcaagcactgtgggttcat

SEQ ID NO: 319149 - DNA, 25 bp, Mus musculus
caggcagcaagctctgtgggttcat

SEQ ID NO: 319150 - DNA, 25 bp, Mus musculus
caggcagcaatcagtatatataatt

SEQ ID NO: 319151 - DNA, 25 bp, Mus musculus
caggcagcaatctgtatatataatt

SEQ ID NO: 319152 - DNA, 25 bp, Mus musculus
caggcagcagctcctatgagccgag

SEQ ID NO: 319153 - DNA, 25 bp, Mus musculus
caggcagcagctctttcctccagaa

SEQ ID NO: 319154 - DNA, 25 bp, Mus musculus
caggcagcagctgctatgagccgag

SEQ ID NO: 319155 - DNA, 25 bp, Mus musculus
caggcagcagctgtttcctccagaa

SEQ ID NO: 319156 - DNA, 25 bp, Mus musculus
caggcagccacacagatttctgagc

SEQ ID NO: 319157 - DNA, 25 bp, Mus musculus
caggcagccacagagatttctgagc

SEQ ID NO: 319158 - DNA, 25 bp, Mus musculus
caggcagccatgattccaggtgttc

SEQ ID NO: 319159 - DNA, 25 bp, Mus musculus
caggcagccatgtttccaggtgttc

SEQ ID NO: 319160 - DNA, 25 bp, Mus musculus
caggcagccccacaagagagacatt

SEQ ID NO: 319161 - DNA, 25 bp, Mus musculus
caggcagccccagaagagagacatt

SEQ ID NO: 319162 - DNA, 25 bp, Mus musculus
caggcagccccgagtgctcggaaat

SEQ ID NO: 319163 - DNA, 25 bp, Mus musculus
caggcagccccgtgtgctcggaaat

SEQ ID NO: 319164 - DNA, 25 bp, Mus musculus
caggcagcccgacctggtgagatca

SEQ ID NO: 319165 - DNA, 25 bp, Mus musculus
caggcagcccgagctggtgagatca

SEQ ID NO: 319166 - DNA, 25 bp, Mus musculus
caggcagcctacaggacaggttgag

SEQ ID NO: 319167 - DNA, 25 bp, Mus musculus
caggcagcctactggacaggttgag

SEQ ID NO: 319168 - DNA, 25 bp, Mus musculus
caggcagcctgcaactccaataaag

SEQ ID NO: 319169 - DNA, 25 bp, Mus musculus
caggcagcctgctactccaataaag

SEQ ID NO: 319170 - DNA, 25 bp, Mus musculus
caggcagcgagacgcattttcgcgt

SEQ ID NO: 319171 - DNA, 25 bp, Mus musculus
caggcagcgagaggcattttcgcgt

SEQ ID NO: 319172 - DNA, 25 bp, Mus musculus
caggcagcggaaccatctgttgttt

SEQ ID NO: 319173 - DNA, 25 bp, Mus musculus
caggcagcggaagcatctgttgttt

SEQ ID NO: 319174 - DNA, 25 bp, Mus musculus
caggcagcgggcatccagctcaatg

SEQ ID NO: 319175 - DNA, 25 bp, Mus musculus
caggcagcgggcttccagctcaatg

SEQ ID NO: 319176 - DNA, 25 bp, Mus musculus
caggcagctaggactctttggaaat

SEQ ID NO: 319177 - DNA, 25 bp, Mus musculus
caggcagctaggatcttaaagggtc

SEQ ID NO: 319178 - DNA, 25 bp, Mus musculus
caggcagctaggtctctttggaaat

SEQ ID NO: 319179 - DNA, 25 bp, Mus musculus
caggcagctaggttcttaaagggtc

SEQ ID NO: 319180 - DNA, 25 bp, Mus musculus
caggcagctcataatgtttctctga

SEQ ID NO: 319181 - DNA, 25 bp, Mus musculus
caggcagctcataattgcccataag

SEQ ID NO: 319182 - DNA, 25 bp, Mus musculus
caggcagctcattatgtttctctga

SEQ ID NO: 319183 - DNA, 25 bp, Mus musculus
caggcagctcattattgcccataag

SEQ ID NO: 319184 - DNA, 25 bp, Mus musculus
caggcagctccaatacagcgtatgt

SEQ ID NO: 319185 - DNA, 25 bp, Mus musculus
caggcagctccattacagcgtatgt

SEQ ID NO: 319186 - DNA, 25 bp, Mus musculus
caggcagctcccaacttggataaaa

SEQ ID NO: 319187 - DNA, 25 bp, Mus musculus
caggcagctccctacttggataaaa

SEQ ID NO: 319188 - DNA, 25 bp, Mus musculus
caggcagctgaactgaccacaacag

SEQ ID NO: 319189 - DNA, 25 bp, Mus musculus
caggcagctgaagtgaccacaacag

SEQ ID NO: 319190 - DNA, 25 bp, Mus musculus
caggcagctgacaaggagggcatca

SEQ ID NO: 319191 - DNA, 25 bp, Mus musculus
caggcagctgactaggagggcatca

SEQ ID NO: 319192 - DNA, 25 bp, Mus musculus
caggcagctgagaatgtcaatttca

SEQ ID NO: 319193 - DNA, 25 bp, Mus musculus
caggcagctgagtatgtcaatttca

SEQ ID NO: 319194 - DNA, 25 bp, Mus musculus
caggcagctgcgagtaggtatcttg

SEQ ID NO: 319195 - DNA, 25 bp, Mus musculus
caggcagctgcgtgtaggtatcttg

SEQ ID NO: 319196 - DNA, 25 bp, Mus musculus
caggcaggaaaacgtggatgattac

SEQ ID NO: 319197 - DNA, 25 bp, Mus musculus
caggcaggaaaaggtggatgattac

SEQ ID NO: 319198 - DNA, 25 bp, Mus musculus
caggcaggagatacatgtgggttca

SEQ ID NO: 319199 - DNA, 25 bp, Mus musculus
caggcaggagattcatgtgggttca

SEQ ID NO: 319200 - DNA, 25 bp, Mus musculus
caggcaggatgactttcgtctgtaa

SEQ ID NO: 319201 - DNA, 25 bp, Mus musculus
caggcaggatgagtttcgtctgtaa

SEQ ID NO: 319202 - DNA, 25 bp, Mus musculus
caggcaggcacaccgaggacctcgt

SEQ ID NO: 319203 - DNA, 25 bp, Mus musculus
caggcaggcacagcgaggacctcgt

SEQ ID NO: 319204 - DNA, 25 bp, Mus musculus
caggcaggcagtaagcttgctgttt

SEQ ID NO: 319205 - DNA, 25 bp, Mus musculus
caggcaggcagttagcttgctgttt

SEQ ID NO: 319206 - DNA, 25 bp, Mus musculus
caggcaggccaaatcagtgtgcttt

SEQ ID NO: 319207 - DNA, 25 bp, Mus musculus
caggcaggccaattcagtgtgcttt

SEQ ID NO: 319208 - DNA, 25 bp, Mus musculus
caggcaggccttagtctgagtagct

SEQ ID NO: 319209 - DNA, 25 bp, Mus musculus
caggcaggcctttgtctgagtagct

SEQ ID NO: 319210 - DNA, 25 bp, Mus musculus
caggcaggctgacctacccatggta

SEQ ID NO: 319211 - DNA, 25 bp, Mus musculus
caggcaggctgagctacccatggta

SEQ ID NO: 319212 - DNA, 25 bp, Mus musculus
caggcaggctggctctttacaacaa

SEQ ID NO: 319213 - DNA, 25 bp, Mus musculus
caggcaggctgggtctttacaacaa

SEQ ID NO: 319214 - DNA, 25 bp, Mus musculus
caggcaggcttgaggagtttagtca

SEQ ID NO: 319215 - DNA, 25 bp, Mus musculus
caggcaggcttgctgaagtcacgca

SEQ ID NO: 319216 - DNA, 25 bp, Mus musculus
caggcaggcttggtgaagtcacgca

SEQ ID NO: 319217 - DNA, 25 bp, Mus musculus
caggcaggcttgtggagtttagtca

SEQ ID NO: 319218 - DNA, 25 bp, Mus musculus
caggcagggaacactgcagatcctt

SEQ ID NO: 319219 - DNA, 25 bp, Mus musculus
caggcagggaaccagctacaagcta

SEQ ID NO: 319220 - DNA, 25 bp, Mus musculus
caggcagggaacgagctacaagcta

SEQ ID NO: 319221 - DNA, 25 bp, Mus musculus
caggcagggaactctgcagatcctt

SEQ ID NO: 319222 - DNA, 25 bp, Mus musculus
caggcagggcaaaaaacaaaagttt

SEQ ID NO: 319223 - DNA, 25 bp, Mus musculus
caggcagggcaataaacaaaagttt

SEQ ID NO: 319224 - DNA, 25 bp, Mus musculus
caggcagggccaacttatctaaagt

SEQ ID NO: 319225 - DNA, 25 bp, Mus musculus
caggcagggccatcttatctaaagt

SEQ ID NO: 319226 - DNA, 25 bp, Mus musculus
caggcagggcctcatcaaatccagc

SEQ ID NO: 319227 - DNA, 25 bp, Mus musculus
caggcagggcctgatcaaatccagc

SEQ ID NO: 319228 - DNA, 25 bp, Mus musculus
caggcagggctgctaacacttttta

SEQ ID NO: 319229 - DNA, 25 bp, Mus musculus
caggcagggctggtaacacttttta

SEQ ID NO: 319230 - DNA, 25 bp, Mus musculus
caggcagggtccaagatgtgcgtca

SEQ ID NO: 319231 - DNA, 25 bp, Mus musculus
caggcagggtcctagatgtgcgtca

SEQ ID NO: 319232 - DNA, 25 bp, Mus musculus
caggcagggtggatgcctcatcacc

SEQ ID NO: 319233 - DNA, 25 bp, Mus musculus
caggcagggtggcttttggtgtagg

SEQ ID NO: 319234 - DNA, 25 bp, Mus musculus
caggcagggtgggttttggtgtagg

SEQ ID NO: 319235 - DNA, 25 bp, Mus musculus
caggcagggtggttgcctcatcacc

SEQ ID NO: 319236 - DNA, 25 bp, Mus musculus
caggcaggtgcccaacagcaatcct

SEQ ID NO: 319237 - DNA, 25 bp, Mus musculus
caggcaggtgccgaacagcaatcct

SEQ ID NO: 319238 - DNA, 25 bp, Mus musculus
caggcaggttcaatcgatctcagac

SEQ ID NO: 319239 - DNA, 25 bp, Mus musculus
caggcaggttcattcgatctcagac

SEQ ID NO: 319240 - DNA, 25 bp, Mus musculus
caggcaggttttcgtatttggtcgt

SEQ ID NO: 319241 - DNA, 25 bp, Mus musculus
caggcaggttttggtatttggtcgt

SEQ ID NO: 319242 - DNA, 25 bp, Mus musculus
caggcagtaaatcctattcctccca

SEQ ID NO: 319243 - DNA, 25 bp, Mus musculus
caggcagtaaatgctattcctccca

SEQ ID NO: 319244 - DNA, 25 bp, Mus musculus
caggcagtaactcgataccttttat

SEQ ID NO: 319245 - DNA, 25 bp, Mus musculus
caggcagtaactggataccttttat

SEQ ID NO: 319246 - DNA, 25 bp, Mus musculus
caggcagtagagcagccgtccatat

SEQ ID NO: 319247 - DNA, 25 bp, Mus musculus
caggcagtagaggagccgtccatat

SEQ ID NO: 319248 - DNA, 25 bp, Mus musculus
caggcagtagctcccatcgtgtgca

SEQ ID NO: 319249 - DNA, 25 bp, Mus musculus
caggcagtagctgccatcgtgtgca

SEQ ID NO: 319250 - DNA, 25 bp, Mus musculus
caggcagtcagcctttagatgtaga

SEQ ID NO: 319251 - DNA, 25 bp, Mus musculus
caggcagtcagcgtttagatgtaga

SEQ ID NO: 319252 - DNA, 25 bp, Mus musculus
caggcagtcatcattatcaacacca

SEQ ID NO: 319253 - DNA, 25 bp, Mus musculus
caggcagtcatctttatcaacacca

SEQ ID NO: 319254 - DNA, 25 bp, Mus musculus
caggcagtcatgagcatcttgatgt

SEQ ID NO: 319255 - DNA, 25 bp, Mus musculus
caggcagtcatgtgcatcttgatgt

SEQ ID NO: 319256 - DNA, 25 bp, Mus musculus
caggcagtccctatggtggtggcta

SEQ ID NO: 319257 - DNA, 25 bp, Mus musculus
caggcagtccctttggtggtggcta

SEQ ID NO: 319258 - DNA, 25 bp, Mus musculus
caggcagtctcgatgttatattgaa

SEQ ID NO: 319259 - DNA, 25 bp, Mus musculus
caggcagtctcgttgttatattgaa

SEQ ID NO: 319260 - DNA, 25 bp, Mus musculus
caggcagtcttgacccttgtaataa

SEQ ID NO: 319261 - DNA, 25 bp, Mus musculus
caggcagtcttgtcccttgtaataa

SEQ ID NO: 319262 - DNA, 25 bp, Mus musculus
caggcagtgaatactgtcaccaaga

SEQ ID NO: 319263 - DNA, 25 bp, Mus musculus
caggcagtgaattctgtcaccaaga

SEQ ID NO: 319264 - DNA, 25 bp, Mus musculus
caggcagtgatgattagagcaagca

SEQ ID NO: 319265 - DNA, 25 bp, Mus musculus
caggcagtgatgtttagagcaagca

SEQ ID NO: 319266 - DNA, 25 bp, Mus musculus
caggcagtgcggagctttacagaat

SEQ ID NO: 319267 - DNA, 25 bp, Mus musculus
caggcagtgcggtgctttacagaat

SEQ ID NO: 319268 - DNA, 25 bp, Mus musculus
caggcagtgggcagctcacttgctg

SEQ ID NO: 319269 - DNA, 25 bp, Mus musculus
caggcagtgggctgctcacttgctg

SEQ ID NO: 319270 - DNA, 25 bp, Mus musculus
caggcagtgtggactctacttgaaa

SEQ ID NO: 319271 - DNA, 25 bp, Mus musculus
caggcagtgtggtctctacttgaaa

SEQ ID NO: 319272 - DNA, 25 bp, Mus musculus
caggcagttccaaatccattagtac

SEQ ID NO: 319273 - DNA, 25 bp, Mus musculus
caggcagttccatatccattagtac

SEQ ID NO: 319274 - DNA, 25 bp, Mus musculus
caggcagttggtcttttggtacctt

SEQ ID NO: 319275 - DNA, 25 bp, Mus musculus
caggcagttggtgttttggtacctt

SEQ ID NO: 319276 - DNA, 25 bp, Mus musculus
caggcagtttgtaacgcttgcatga

SEQ ID NO: 319277 - DNA, 25 bp, Mus musculus
caggcagtttgttacgcttgcatga

SEQ ID NO: 319278 - DNA, 25 bp, Mus musculus
caggcatactgaaattgttctaaac

SEQ ID NO: 319279 - DNA, 25 bp, Mus musculus
caggcatactgatattgttctaaac

SEQ ID NO: 319280 - DNA, 25 bp, Mus musculus
caggcatagtatatctgttcaggaa

SEQ ID NO: 319281 - DNA, 25 bp, Mus musculus
caggcatagtatttctgttcaggaa

SEQ ID NO: 319282 - DNA, 25 bp, Mus musculus
caggcatatgaaatgcacctccaat

SEQ ID NO: 319283 - DNA, 25 bp, Mus musculus
caggcatatgaattgcacctccaat

SEQ ID NO: 319284 - DNA, 25 bp, Mus musculus
caggcatatgcgacatcacatgtat

SEQ ID NO: 319285 - DNA, 25 bp, Mus musculus
caggcatatgcgtcatcacatgtat

SEQ ID NO: 319286 - DNA, 25 bp, Mus musculus
caggcatatggcagagaccctgggt

SEQ ID NO: 319287 - DNA, 25 bp, Mus musculus
caggcatatggctgagaccctgggt

SEQ ID NO: 319288 - DNA, 25 bp, Mus musculus
caggcatcatacagacccatctcta

SEQ ID NO: 319289 - DNA, 25 bp, Mus musculus
caggcatcatactgacccatctcta

SEQ ID NO: 319290 - DNA, 25 bp, Mus musculus
caggcatcatttcatgagcatgatt

SEQ ID NO: 319291 - DNA, 25 bp, Mus musculus
caggcatcatttgatgagcatgatt

SEQ ID NO: 319292 - DNA, 25 bp, Mus musculus
caggcatcggtacggctctcctgtg

SEQ ID NO: 319293 - DNA, 25 bp, Mus musculus
caggcatcggtagggctctcctgtg

SEQ ID NO: 319294 - DNA, 25 bp, Mus musculus
caggcatctcctcaggcatcgagat

SEQ ID NO: 319295 - DNA, 25 bp, Mus musculus
caggcatctcctgaggcatcgagat

SEQ ID NO: 319296 - DNA, 25 bp, Mus musculus
caggcatctgctactggaatgtttc

SEQ ID NO: 319297 - DNA, 25 bp, Mus musculus
caggcatctgcttctggaatgtttc

SEQ ID NO: 319298 - DNA, 25 bp, Mus musculus
caggcatctggaacaacctctgatc

SEQ ID NO: 319299 - DNA, 25 bp, Mus musculus
caggcatctggatcaacctctgatc

SEQ ID NO: 319300 - DNA, 25 bp, Mus musculus
caggcatctgtccagctaccagaga

SEQ ID NO: 319301 - DNA, 25 bp, Mus musculus
caggcatctgtcgagctaccagaga

SEQ ID NO: 319302 - DNA, 25 bp, Mus musculus
caggcatgaggcatcatctgtgcaa

SEQ ID NO: 319303 - DNA, 25 bp, Mus musculus
caggcatgaggcttcatctgtgcaa

SEQ ID NO: 319304 - DNA, 25 bp, Mus musculus
caggcatgatgcaggtgtagctgct

SEQ ID NO: 319305 - DNA, 25 bp, Mus musculus
caggcatgatgctggtgtagctgct

SEQ ID NO: 319306 - DNA, 25 bp, Mus musculus
caggcatgcagcagtcaactcaggc

SEQ ID NO: 319307 - DNA, 25 bp, Mus musculus
caggcatgcagctgtcaactcaggc

SEQ ID NO: 319308 - DNA, 25 bp, Mus musculus
caggcatgccctaagagcatggtgt

SEQ ID NO: 319309 - DNA, 25 bp, Mus musculus
caggcatgcccttagagcatggtgt

SEQ ID NO: 319310 - DNA, 25 bp, Mus musculus
caggcatgctgacatgtgtctgtaa

SEQ ID NO: 319311 - DNA, 25 bp, Mus musculus
caggcatgctgagatgtgtctgtaa

SEQ ID NO: 319312 - DNA, 25 bp, Mus musculus
caggcatggaaaattctagggaatg

SEQ ID NO: 319313 - DNA, 25 bp, Mus musculus
caggcatggaaatttctagggaatg

SEQ ID NO: 319314 - DNA, 25 bp, Mus musculus
caggcatggaccactggacagtgtt

SEQ ID NO: 319315 - DNA, 25 bp, Mus musculus
caggcatggacctctggacagtgtt

SEQ ID NO: 319316 - DNA, 25 bp, Mus musculus
caggcatggattactgcatctctgc

SEQ ID NO: 319317 - DNA, 25 bp, Mus musculus
caggcatggatttctgcatctctgc

SEQ ID NO: 319318 - DNA, 25 bp, Mus musculus
caggcatggcctctgtgccagaaga

SEQ ID NO: 319319 - DNA, 25 bp, Mus musculus
caggcatggcctgtgtgccagaaga

SEQ ID NO: 319320 - DNA, 25 bp, Mus musculus
caggcatggcggcatcctggaacta

SEQ ID NO: 319321 - DNA, 25 bp, Mus musculus
caggcatggcgggatcctggaacta

SEQ ID NO: 319322 - DNA, 25 bp, Mus musculus
caggcatgggccacaactggctgga

SEQ ID NO: 319323 - DNA, 25 bp, Mus musculus
caggcatgggcctcaactggctgga

SEQ ID NO: 319324 - DNA, 25 bp, Mus musculus
caggcatggtatctgcattggtgac

SEQ ID NO: 319325 - DNA, 25 bp, Mus musculus
caggcatggtatgtgcattggtgac

SEQ ID NO: 319326 - DNA, 25 bp, Mus musculus
caggcatggtgaatcacacctctat

SEQ ID NO: 319327 - DNA, 25 bp, Mus musculus
caggcatggtgattcacacctctat

SEQ ID NO: 319328 - DNA, 25 bp, Mus musculus
caggcatgtccactggtcaccaaag

SEQ ID NO: 319329 - DNA, 25 bp, Mus musculus
caggcatgtccagtggtcaccaaag

SEQ ID NO: 319330 - DNA, 25 bp, Mus musculus
caggcatgtcctaaaaccacacagc

SEQ ID NO: 319331 - DNA, 25 bp, Mus musculus
caggcatgtccttaaaccacacagc

SEQ ID NO: 319332 - DNA, 25 bp, Mus musculus
caggcatgtcggcagtgtgcaccaa

SEQ ID NO: 319333 - DNA, 25 bp, Mus musculus
caggcatgtcgggagtgtgcaccaa

SEQ ID NO: 319334 - DNA, 25 bp, Mus musculus
caggcattcataaccctaggtgttc

SEQ ID NO: 319335 - DNA, 25 bp, Mus musculus
caggcattcatatccctaggtgttc

SEQ ID NO: 319336 - DNA, 25 bp, Mus musculus
caggcattccacatattaaacccac

SEQ ID NO: 319337 - DNA, 25 bp, Mus musculus
caggcattccacttattaaacccac

SEQ ID NO: 319338 - DNA, 25 bp, Mus musculus
caggcattcctgctacagactacaa

SEQ ID NO: 319339 - DNA, 25 bp, Mus musculus
caggcattcctggtacagactacaa

SEQ ID NO: 319340 - DNA, 25 bp, Mus musculus
caggcattggctagttgtgggtttc

SEQ ID NO: 319341 - DNA, 25 bp, Mus musculus
caggcattggcttgttgtgggtttc

SEQ ID NO: 319342 - DNA, 25 bp, Mus musculus
caggcatttctgacatggtgttctt

SEQ ID NO: 319343 - DNA, 25 bp, Mus musculus
caggcatttctgtcatggtgttctt

SEQ ID NO: 319344 - DNA, 25 bp, Mus musculus
caggcatttgtgagggagccagcca

SEQ ID NO: 319345 - DNA, 25 bp, Mus musculus
caggcatttgtgtgggagccagcca

SEQ ID NO: 319346 - DNA, 25 bp, Mus musculus
caggcattttcgcaattccagttaa

SEQ ID NO: 319347 - DNA, 25 bp, Mus musculus
caggcattttcggaattccagttaa

SEQ ID NO: 319348 - DNA, 25 bp, Mus musculus
caggcatttttcactatgcccacat

SEQ ID NO: 319349 - DNA, 25 bp, Mus musculus
caggcatttttctctatgcccacat

SEQ ID NO: 319350 - DNA, 25 bp, Mus musculus
caggccaaactgctaagcttcagga

SEQ ID NO: 319351 - DNA, 25 bp, Mus musculus
caggccaaactggtaagcttcagga

SEQ ID NO: 319352 - DNA, 25 bp, Mus musculus
caggccaaacttaatcaacctcggg

SEQ ID NO: 319353 - DNA, 25 bp, Mus musculus
caggccaaactttatcaacctcggg

SEQ ID NO: 319354 - DNA, 25 bp, Mus musculus
caggccaacagccactctatggtgg

SEQ ID NO: 319355 - DNA, 25 bp, Mus musculus
caggccaacagcgactctatggtgg

SEQ ID NO: 319356 - DNA, 25 bp, Mus musculus
caggccaaccacaacgcatgatggg

SEQ ID NO: 319357 - DNA, 25 bp, Mus musculus
caggccaaccactacgcatgatggg

SEQ ID NO: 319358 - DNA, 25 bp, Mus musculus
caggccaagacgctcatctcagctg

SEQ ID NO: 319359 - DNA, 25 bp, Mus musculus
caggccaagacggtcatctcagctg

SEQ ID NO: 319360 - DNA, 25 bp, Mus musculus
caggccaagtggatacagtgacaat

SEQ ID NO: 319361 - DNA, 25 bp, Mus musculus
caggccaagtggttacagtgacaat

SEQ ID NO: 319362 - DNA, 25 bp, Mus musculus
caggccaatcggagcttgtgaactt

SEQ ID NO: 319363 - DNA, 25 bp, Mus musculus
caggccaatcggtgcttgtgaactt

SEQ ID NO: 319364 - DNA, 25 bp, Mus musculus
caggccaatggcagggagacagcac

SEQ ID NO: 319365 - DNA, 25 bp, Mus musculus
caggccaatggccttttccagtaaa

SEQ ID NO: 319366 - DNA, 25 bp, Mus musculus
caggccaatggcgttttccagtaaa

SEQ ID NO: 319367 - DNA, 25 bp, Mus musculus
caggccaatggctgggagacagcac

SEQ ID NO: 319368 - DNA, 25 bp, Mus musculus
caggccaattcactgtgctttggtt

SEQ ID NO: 319369 - DNA, 25 bp, Mus musculus
caggccaattcagtgtgctttggtt

SEQ ID NO: 319370 - DNA, 25 bp, Mus musculus
caggccacacaaagctgtagagact

SEQ ID NO: 319371 - DNA, 25 bp, Mus musculus
caggccacacaaaggaccacctttc

SEQ ID NO: 319372 - DNA, 25 bp, Mus musculus
caggccacacaatgctgtagagact

SEQ ID NO: 319373 - DNA, 25 bp, Mus musculus
caggccacacaatggaccacctttc

SEQ ID NO: 319374 - DNA, 25 bp, Mus musculus
caggccacacagatcaaagtaggaa

SEQ ID NO: 319375 - DNA, 25 bp, Mus musculus
caggccacacagttcaaagtaggaa

SEQ ID NO: 319376 - DNA, 25 bp, Mus musculus
caggccacagacctgctgaatgaat

SEQ ID NO: 319377 - DNA, 25 bp, Mus musculus
caggccacagacgtgctgaatgaat

SEQ ID NO: 319378 - DNA, 25 bp, Mus musculus
caggccacatggctaaaatacacat

SEQ ID NO: 319379 - DNA, 25 bp, Mus musculus
caggccacatgggtaaaatacacat

SEQ ID NO: 319380 - DNA, 25 bp, Mus musculus
caggccaccacgcagacaagaaatg

SEQ ID NO: 319381 - DNA, 25 bp, Mus musculus
caggccaccacggagacaagaaatg

SEQ ID NO: 319382 - DNA, 25 bp, Mus musculus
caggccacccatatggtcttaagac

SEQ ID NO: 319383 - DNA, 25 bp, Mus musculus
caggccacccatttggtcttaagac

SEQ ID NO: 319384 - DNA, 25 bp, Mus musculus
caggccacctcaaaatctaggtctt

SEQ ID NO: 319385 - DNA, 25 bp, Mus musculus
caggccacctcataatctaggtctt

SEQ ID NO: 319386 - DNA, 25 bp, Mus musculus
caggccacggaaacagtctatgcaa

SEQ ID NO: 319387 - DNA, 25 bp, Mus musculus
caggccacggaatcagtctatgcaa

SEQ ID NO: 319388 - DNA, 25 bp, Mus musculus
caggccacgtttcctttttctggag

SEQ ID NO: 319389 - DNA, 25 bp, Mus musculus
caggccacgtttgctttttctggag

SEQ ID NO: 319390 - DNA, 25 bp, Mus musculus
caggccactgttctgtttattcctt

SEQ ID NO: 319391 - DNA, 25 bp, Mus musculus
caggccactgttgtgtttattcctt

SEQ ID NO: 319392 - DNA, 25 bp, Mus musculus
caggccacttctatggaagcagcca

SEQ ID NO: 319393 - DNA, 25 bp, Mus musculus
caggccacttctttggaagcagcca

SEQ ID NO: 319394 - DNA, 25 bp, Mus musculus
caggccagaaccaacccagggagga

SEQ ID NO: 319395 - DNA, 25 bp, Mus musculus
caggccagaacctacccagggagga

SEQ ID NO: 319396 - DNA, 25 bp, Mus musculus
caggccagactacactcattttgag

SEQ ID NO: 319397 - DNA, 25 bp, Mus musculus
caggccagactagactcattttgag

SEQ ID NO: 319398 - DNA, 25 bp, Mus musculus
caggccagactgctctttcagaaca

SEQ ID NO: 319399 - DNA, 25 bp, Mus musculus
caggccagactggtctttcagaaca

SEQ ID NO: 319400 - DNA, 25 bp, Mus musculus
caggccagagagatccgaagtgttc

SEQ ID NO: 319401 - DNA, 25 bp, Mus musculus
caggccagagagttccgaagtgttc

SEQ ID NO: 319402 - DNA, 25 bp, Mus musculus
caggccagatagatccacgtgaggt

SEQ ID NO: 319403 - DNA, 25 bp, Mus musculus
caggccagatagcagtgatctcctt

SEQ ID NO: 319404 - DNA, 25 bp, Mus musculus
caggccagataggagtgatctcctt

SEQ ID NO: 319405 - DNA, 25 bp, Mus musculus
caggccagatagttccacgtgaggt

SEQ ID NO: 319406 - DNA, 25 bp, Mus musculus
caggccagcataatgaatccattga

SEQ ID NO: 319407 - DNA, 25 bp, Mus musculus
caggccagcatattgaatccattga

SEQ ID NO: 319408 - DNA, 25 bp, Mus musculus
caggccagccaaagatacacaagga

SEQ ID NO: 319409 - DNA, 25 bp, Mus musculus
caggccagccaatgatacacaagga

SEQ ID NO: 319410 - DNA, 25 bp, Mus musculus
caggccagcgtgagctagctacaaa

SEQ ID NO: 319411 - DNA, 25 bp, Mus musculus
caggccagcgtgtgctagctacaaa

SEQ ID NO: 319412 - DNA, 25 bp, Mus musculus
caggccagctaacgtatataatgag

SEQ ID NO: 319413 - DNA, 25 bp, Mus musculus
caggccagctaaggtatataatgag

SEQ ID NO: 319414 - DNA, 25 bp, Mus musculus
caggccagctgtaggtttttatcag

SEQ ID NO: 319415 - DNA, 25 bp, Mus musculus
caggccagctgttggtttttatcag

SEQ ID NO: 319416 - DNA, 25 bp, Mus musculus
caggccaggaggatacgggtctcta

SEQ ID NO: 319417 - DNA, 25 bp, Mus musculus
caggccaggaggttacgggtctcta

SEQ ID NO: 319418 - DNA, 25 bp, Mus musculus
caggccaggccgcattgacagaaag

SEQ ID NO: 319419 - DNA, 25 bp, Mus musculus
caggccaggccggattgacagaaag

SEQ ID NO: 319420 - DNA, 25 bp, Mus musculus
caggccaggctgaaccacgctcttg

SEQ ID NO: 319421 - DNA, 25 bp, Mus musculus
caggccaggctgtaccacgctcttg

SEQ ID NO: 319422 - DNA, 25 bp, Mus musculus
caggccagtacaacaggacagaggt

SEQ ID NO: 319423 - DNA, 25 bp, Mus musculus
caggccagtacatcaggacagaggt

SEQ ID NO: 319424 - DNA, 25 bp, Mus musculus
caggccagtctcagctatgttggtg

SEQ ID NO: 319425 - DNA, 25 bp, Mus musculus
caggccagtctctgctatgttggtg

SEQ ID NO: 319426 - DNA, 25 bp, Mus musculus
caggccagtgtaatggtggagtcta

SEQ ID NO: 319427 - DNA, 25 bp, Mus musculus
caggccagtgtattggtggagtcta

SEQ ID NO: 319428 - DNA, 25 bp, Mus musculus
caggccagtgtgatgagccactttg

SEQ ID NO: 319429 - DNA, 25 bp, Mus musculus
caggccagtgtgttgagccactttg

SEQ ID NO: 319430 - DNA, 25 bp, Mus musculus
caggccagttctcaacaagacaagg

SEQ ID NO: 319431 - DNA, 25 bp, Mus musculus
caggccagttctgaacaagacaagg

SEQ ID NO: 319432 - DNA, 25 bp, Mus musculus
caggccatatggagaataagacgaa

SEQ ID NO: 319433 - DNA, 25 bp, Mus musculus
caggccatatggtgaataagacgaa

SEQ ID NO: 319434 - DNA, 25 bp, Mus musculus
caggccatcaaacgaagagcagcta

SEQ ID NO: 319435 - DNA, 25 bp, Mus musculus
caggccatcaaaggaagagcagcta

SEQ ID NO: 319436 - DNA, 25 bp, Mus musculus
caggccatcatgcttatcaccgatg

SEQ ID NO: 319437 - DNA, 25 bp, Mus musculus
caggccatcatggttatcaccgatg

SEQ ID NO: 319438 - DNA, 25 bp, Mus musculus
caggccatcattcctgatccaaaga

SEQ ID NO: 319439 - DNA, 25 bp, Mus musculus
caggccatcattgctgatccaaaga

SEQ ID NO: 319440 - DNA, 25 bp, Mus musculus
caggccatcttcagtcttgttttta

SEQ ID NO: 319441 - DNA, 25 bp, Mus musculus
caggccatcttctgtcttgttttta

SEQ ID NO: 319442 - DNA, 25 bp, Mus musculus
caggccatgaacagggagtgcgata

SEQ ID NO: 319443 - DNA, 25 bp, Mus musculus
caggccatgaactgggagtgcgata

SEQ ID NO: 319444 - DNA, 25 bp, Mus musculus
caggccatgagacttcacagccttg

SEQ ID NO: 319445 - DNA, 25 bp, Mus musculus
caggccatgagagttcacagccttg

SEQ ID NO: 319446 - DNA, 25 bp, Mus musculus
caggccatggagacacagggtttct

SEQ ID NO: 319447 - DNA, 25 bp, Mus musculus
caggccatggagtcacagggtttct

SEQ ID NO: 319448 - DNA, 25 bp, Mus musculus
caggccatggataagaggctgtgca

SEQ ID NO: 319449 - DNA, 25 bp, Mus musculus
caggccatggattagaggctgtgca

SEQ ID NO: 319450 - DNA, 25 bp, Mus musculus
caggccatgtgcagggaaacctttc

SEQ ID NO: 319451 - DNA, 25 bp, Mus musculus
caggccatgtgctgggaaacctttc

SEQ ID NO: 319452 - DNA, 25 bp, Mus musculus
caggccatgtgtattcctatatgta

SEQ ID NO: 319453 - DNA, 25 bp, Mus musculus
caggccatgtgttttcctatatgta

SEQ ID NO: 319454 - DNA, 25 bp, Mus musculus
caggcccaaggcactgctttagtgc

SEQ ID NO: 319455 - DNA, 25 bp, Mus musculus
caggcccaaggctctgctttagtgc

SEQ ID NO: 319456 - DNA, 25 bp, Mus musculus
caggcccacacacctgggattgggt

SEQ ID NO: 319457 - DNA, 25 bp, Mus musculus
caggcccacacagctgggattgggt

SEQ ID NO: 319458 - DNA, 25 bp, Mus musculus
caggcccacatgctcttgtgaggga

SEQ ID NO: 319459 - DNA, 25 bp, Mus musculus
caggcccacatggtcttgtgaggga

SEQ ID NO: 319460 - DNA, 25 bp, Mus musculus
caggcccagagcaagttaaagatac

SEQ ID NO: 319461 - DNA, 25 bp, Mus musculus
caggcccagagctagttaaagatac

SEQ ID NO: 319462 - DNA, 25 bp, Mus musculus
caggcccagaggattacaagtttct

SEQ ID NO: 319463 - DNA, 25 bp, Mus musculus
caggcccagaggtttacaagtttct

SEQ ID NO: 319464 - DNA, 25 bp, Mus musculus
caggcccagcatcggacactgtgag

SEQ ID NO: 319465 - DNA, 25 bp, Mus musculus
caggcccagcatgggacactgtgag

SEQ ID NO: 319466 - DNA, 25 bp, Mus musculus
caggcccagtccaagtggtttgaag

SEQ ID NO: 319467 - DNA, 25 bp, Mus musculus
caggcccagtcctagtggtttgaag

SEQ ID NO: 319468 - DNA, 25 bp, Mus musculus
caggcccagtgcaaaaagaacaaaa

SEQ ID NO: 319469 - DNA, 25 bp, Mus musculus
caggcccagtgctaaaagaacaaaa

SEQ ID NO: 319470 - DNA, 25 bp, Mus musculus
caggcccagttgcacagcatccaag

SEQ ID NO: 319471 - DNA, 25 bp, Mus musculus
caggcccagttggacagcatccaag

SEQ ID NO: 319472 - DNA, 25 bp, Mus musculus
caggcccatagcatggggcttggct

SEQ ID NO: 319473 - DNA, 25 bp, Mus musculus
caggcccatagcttggggcttggct

SEQ ID NO: 319474 - DNA, 25 bp, Mus musculus
caggcccattggagttagtgagcag

SEQ ID NO: 319475 - DNA, 25 bp, Mus musculus
caggcccattggtgttagtgagcag

SEQ ID NO: 319476 - DNA, 25 bp, Mus musculus
caggccccaagtaaatgtgaccagt

SEQ ID NO: 319477 - DNA, 25 bp, Mus musculus
caggccccaagttaatgtgaccagt

SEQ ID NO: 319478 - DNA, 25 bp, Mus musculus
caggccccactcagaaagggactgg

SEQ ID NO: 319479 - DNA, 25 bp, Mus musculus
caggccccactctgaaagggactgg

SEQ ID NO: 319480 - DNA, 25 bp, Mus musculus
caggccccactgaagcacaaagata

SEQ ID NO: 319481 - DNA, 25 bp, Mus musculus
caggccccactgaataggctgaaga

SEQ ID NO: 319482 - DNA, 25 bp, Mus musculus
caggccccactgtagcacaaagata

SEQ ID NO: 319483 - DNA, 25 bp, Mus musculus
caggccccactgtataggctgaaga

SEQ ID NO: 319484 - DNA, 25 bp, Mus musculus
caggccccagcgagtcattgaagac

SEQ ID NO: 319485 - DNA, 25 bp, Mus musculus
caggccccagcgtgtcattgaagac

SEQ ID NO: 319486 - DNA, 25 bp, Mus musculus
caggccccattgatgctttgagtgc

SEQ ID NO: 319487 - DNA, 25 bp, Mus musculus
caggccccattgttgctttgagtgc

SEQ ID NO: 319488 - DNA, 25 bp, Mus musculus
caggcccccaatatttcagaagaga

SEQ ID NO: 319489 - DNA, 25 bp, Mus musculus
caggcccccaatttttcagaagaga

SEQ ID NO: 319490 - DNA, 25 bp, Mus musculus
caggccccgccaaatgggagcgcag

SEQ ID NO: 319491 - DNA, 25 bp, Mus musculus
caggccccgccatatgggagcgcag

SEQ ID NO: 319492 - DNA, 25 bp, Mus musculus
caggcccctcagcatttttattaaa

SEQ ID NO: 319493 - DNA, 25 bp, Mus musculus
caggcccctcaggatttttattaaa

SEQ ID NO: 319494 - DNA, 25 bp, Mus musculus
caggcccctggaatgaaagcaagag

SEQ ID NO: 319495 - DNA, 25 bp, Mus musculus
caggcccctggattgaaagcaagag

SEQ ID NO: 319496 - DNA, 25 bp, Mus musculus
caggcccgactgattcttggaagta

SEQ ID NO: 319497 - DNA, 25 bp, Mus musculus
caggcccgactgtttcttggaagta

SEQ ID NO: 319498 - DNA, 25 bp, Mus musculus
caggcccgggtcctccagcgttgaa

SEQ ID NO: 319499 - DNA, 25 bp, Mus musculus
caggcccgggtcgtccagcgttgaa

SEQ ID NO: 319500 - DNA, 25 bp, Mus musculus
caggccctaaaaatggttcttgata

SEQ ID NO: 319501 - DNA, 25 bp, Mus musculus
caggccctaaaattggttcttgata

SEQ ID NO: 319502 - DNA, 25 bp, Mus musculus
caggccctagagagatagcttagta

SEQ ID NO: 319503 - DNA, 25 bp, Mus musculus
caggccctagagtgatagcttagta

SEQ ID NO: 319504 - DNA, 25 bp, Mus musculus
caggccctcggtccgtgcatgaaga

SEQ ID NO: 319505 - DNA, 25 bp, Mus musculus
caggccctcggtgcgtgcatgaaga

SEQ ID NO: 319506 - DNA, 25 bp, Mus musculus
caggccctctgacccagaaacagaa

SEQ ID NO: 319507 - DNA, 25 bp, Mus musculus
caggccctctgagccagaaacagaa

SEQ ID NO: 319508 - DNA, 25 bp, Mus musculus
caggccctctttagggagcatgtga

SEQ ID NO: 319509 - DNA, 25 bp, Mus musculus
caggccctcttttgggagcatgtga

SEQ ID NO: 319510 - DNA, 25 bp, Mus musculus
caggccctgagcaggtgtgttgaat

SEQ ID NO: 319511 - DNA, 25 bp, Mus musculus
caggccctgagctggtgtgttgaat

SEQ ID NO: 319512 - DNA, 25 bp, Mus musculus
caggccctgaggagcatccagcagg

SEQ ID NO: 319513 - DNA, 25 bp, Mus musculus
caggccctgaggtgcatccagcagg

SEQ ID NO: 319514 - DNA, 25 bp, Mus musculus
caggccctgagtattgtgaccaaag

SEQ ID NO: 319515 - DNA, 25 bp, Mus musculus
caggccctgagttttgtgaccaaag

SEQ ID NO: 319516 - DNA, 25 bp, Mus musculus
caggccctgctcagattaggaacat

SEQ ID NO: 319517 - DNA, 25 bp, Mus musculus
caggccctgctctgattaggaacat

SEQ ID NO: 319518 - DNA, 25 bp, Mus musculus
caggccctggagacatgcagttcct

SEQ ID NO: 319519 - DNA, 25 bp, Mus musculus
caggccctggagtcatgcagttcct

SEQ ID NO: 319520 - DNA, 25 bp, Mus musculus
caggccctggtacagaactggtgtt

SEQ ID NO: 319521 - DNA, 25 bp, Mus musculus
caggccctggtagagaactggtgtt

SEQ ID NO: 319522 - DNA, 25 bp, Mus musculus
caggccctggttatgacccaacagt

SEQ ID NO: 319523 - DNA, 25 bp, Mus musculus
caggccctggttttgacccaacagt

SEQ ID NO: 319524 - DNA, 25 bp, Mus musculus
caggcccttctgagtgcttgggtag

SEQ ID NO: 319525 - DNA, 25 bp, Mus musculus
caggcccttctgtgtgcttgggtag

SEQ ID NO: 319526 - DNA, 25 bp, Mus musculus
caggcccttcttcataacgatctta

SEQ ID NO: 319527 - DNA, 25 bp, Mus musculus
caggcccttcttgataacgatctta

SEQ ID NO: 319528 - DNA, 25 bp, Mus musculus
caggcccttgagcttgctcttggaa

SEQ ID NO: 319529 - DNA, 25 bp, Mus musculus
caggcccttgaggttgctcttggaa

SEQ ID NO: 319530 - DNA, 25 bp, Mus musculus
caggcccttgctatcttcgaaggac

SEQ ID NO: 319531 - DNA, 25 bp, Mus musculus
caggcccttgctttcttcgaaggac

SEQ ID NO: 319532 - DNA, 25 bp, Mus musculus
caggccgagcttcccaagtgggcct

SEQ ID NO: 319533 - DNA, 25 bp, Mus musculus
caggccgagcttgccaagtgggcct

SEQ ID NO: 319534 - DNA, 25 bp, Mus musculus
caggccgcacatagcagcatgcatg

SEQ ID NO: 319535 - DNA, 25 bp, Mus musculus
caggccgcacattgcagcatgcatg

SEQ ID NO: 319536 - DNA, 25 bp, Mus musculus
caggccgccgataaatttatcccaa

SEQ ID NO: 319537 - DNA, 25 bp, Mus musculus
caggccgccgattaatttatcccaa

SEQ ID NO: 319538 - DNA, 25 bp, Mus musculus
caggccgcctggcatcgctttcttt

SEQ ID NO: 319539 - DNA, 25 bp, Mus musculus
caggccgcctgggatcgctttcttt

SEQ ID NO: 319540 - DNA, 25 bp, Mus musculus
caggccgcgctacaaaatgctacta

SEQ ID NO: 319541 - DNA, 25 bp, Mus musculus
caggccgcgctagaaaatgctacta

SEQ ID NO: 319542 - DNA, 25 bp, Mus musculus
caggccgcggttacttaatgtagta

SEQ ID NO: 319543 - DNA, 25 bp, Mus musculus
caggccgcggtttcttaatgtagta

SEQ ID NO: 319544 - DNA, 25 bp, Mus musculus
caggccgctgctattgttgatcaaa

SEQ ID NO: 319545 - DNA, 25 bp, Mus musculus
caggccgctgcttttgttgatcaaa

SEQ ID NO: 319546 - DNA, 25 bp, Mus musculus
caggccggaaggaggcattcccact

SEQ ID NO: 319547 - DNA, 25 bp, Mus musculus
caggccggaaggtggcattcccact

SEQ ID NO: 319548 - DNA, 25 bp, Mus musculus
caggccggcacacagaacttatgaa

SEQ ID NO: 319549 - DNA, 25 bp, Mus musculus
caggccggcacagagaacttatgaa

SEQ ID NO: 319550 - DNA, 25 bp, Mus musculus
caggccgggatgattggttcttcaa

SEQ ID NO: 319551 - DNA, 25 bp, Mus musculus
caggccgggatgtttggttcttcaa

SEQ ID NO: 319552 - DNA, 25 bp, Mus musculus
caggccggtgacacaagtgctttat

SEQ ID NO: 319553 - DNA, 25 bp, Mus musculus
caggccggtgactcaagtgctttat

SEQ ID NO: 319554 - DNA, 25 bp, Mus musculus
caggccggtggtactaagttactat

SEQ ID NO: 319555 - DNA, 25 bp, Mus musculus
caggccggtggttctaagttactat

SEQ ID NO: 319556 - DNA, 25 bp, Mus musculus
caggccggtttcacgatgtctagaa

SEQ ID NO: 319557 - DNA, 25 bp, Mus musculus
caggccggtttctcgatgtctagaa

SEQ ID NO: 319558 - DNA, 25 bp, Mus musculus
caggccgtgataaagactctccgag

SEQ ID NO: 319559 - DNA, 25 bp, Mus musculus
caggccgtgatatagactctccgag

SEQ ID NO: 319560 - DNA, 25 bp, Mus musculus
caggccgttatgatttacaagccat

SEQ ID NO: 319561 - DNA, 25 bp, Mus musculus
caggccgttatgttttacaagccat

SEQ ID NO: 319562 - DNA, 25 bp, Mus musculus
caggcctaactcatgagaagggata

SEQ ID NO: 319563 - DNA, 25 bp, Mus musculus
caggcctaactcttgagaagggata

SEQ ID NO: 319564 - DNA, 25 bp, Mus musculus
caggcctaagctcccacgtgttggg

SEQ ID NO: 319565 - DNA, 25 bp, Mus musculus
caggcctaagctgccacgtgttggg

SEQ ID NO: 319566 - DNA, 25 bp, Mus musculus
caggcctacagacgcggcttctcag

SEQ ID NO: 319567 - DNA, 25 bp, Mus musculus
caggcctacagaggcggcttctcag

SEQ ID NO: 319568 - DNA, 25 bp, Mus musculus
caggcctacgggaccgtgtgccgct

SEQ ID NO: 319569 - DNA, 25 bp, Mus musculus
caggcctacgggtccgtgtgccgct

SEQ ID NO: 319570 - DNA, 25 bp, Mus musculus
caggcctagaaaccttggtgtcttt

SEQ ID NO: 319571 - DNA, 25 bp, Mus musculus
caggcctagaaagcttggtgtcttt

SEQ ID NO: 319572 - DNA, 25 bp, Mus musculus
caggcctagaggacgtcacagttga

SEQ ID NO: 319573 - DNA, 25 bp, Mus musculus
caggcctagaggtcgtcacagttga

SEQ ID NO: 319574 - DNA, 25 bp, Mus musculus
caggcctcagagatgtggcatatca

SEQ ID NO: 319575 - DNA, 25 bp, Mus musculus
caggcctcagagttgtggcatatca

SEQ ID NO: 319576 - DNA, 25 bp, Mus musculus
caggcctcaggcatggatgactatc

SEQ ID NO: 319577 - DNA, 25 bp, Mus musculus
caggcctcaggcttggatgactatc

SEQ ID NO: 319578 - DNA, 25 bp, Mus musculus
caggcctcagttcggcagaggcttt

SEQ ID NO: 319579 - DNA, 25 bp, Mus musculus
caggcctcagttgggcagaggcttt

SEQ ID NO: 319580 - DNA, 25 bp, Mus musculus
caggcctcatttactgcgtttagaa

SEQ ID NO: 319581 - DNA, 25 bp, Mus musculus
caggcctcattttctgcgtttagaa

SEQ ID NO: 319582 - DNA, 25 bp, Mus musculus
caggcctctcatctcaggaaggagt

SEQ ID NO: 319583 - DNA, 25 bp, Mus musculus
caggcctctcatgtcaggaaggagt

SEQ ID NO: 319584 - DNA, 25 bp, Mus musculus
caggcctctcgacccatgatagaga

SEQ ID NO: 319585 - DNA, 25 bp, Mus musculus
caggcctctcgagccatgatagaga

SEQ ID NO: 319586 - DNA, 25 bp, Mus musculus
caggcctctctgctgggtattttat

SEQ ID NO: 319587 - DNA, 25 bp, Mus musculus
caggcctctctggtgggtattttat

SEQ ID NO: 319588 - DNA, 25 bp, Mus musculus
caggcctctgctcgtgactaagata

SEQ ID NO: 319589 - DNA, 25 bp, Mus musculus
caggcctctgctggtgactaagata

SEQ ID NO: 319590 - DNA, 25 bp, Mus musculus
caggcctctggaagcttctaagcat

SEQ ID NO: 319591 - DNA, 25 bp, Mus musculus
caggcctctggatgcttctaagcat

SEQ ID NO: 319592 - DNA, 25 bp, Mus musculus
caggcctctgttataatctaccaag

SEQ ID NO: 319593 - DNA, 25 bp, Mus musculus
caggcctctgttttaatctaccaag

SEQ ID NO: 319594 - DNA, 25 bp, Mus musculus
caggcctcttgaccaggctggaaga

SEQ ID NO: 319595 - DNA, 25 bp, Mus musculus
caggcctcttgagcaggctggaaga

SEQ ID NO: 319596 - DNA, 25 bp, Mus musculus
caggcctctttgctcttttgataga

SEQ ID NO: 319597 - DNA, 25 bp, Mus musculus
caggcctctttggtcttttgataga

SEQ ID NO: 319598 - DNA, 25 bp, Mus musculus
caggcctgacacctttgacagtgaa

SEQ ID NO: 319599 - DNA, 25 bp, Mus musculus
caggcctgacacgtttgacagtgaa

SEQ ID NO: 319600 - DNA, 25 bp, Mus musculus
caggcctgaggtccaagagacttgt

SEQ ID NO: 319601 - DNA, 25 bp, Mus musculus
caggcctgaggtgcaagagacttgt

SEQ ID NO: 319602 - DNA, 25 bp, Mus musculus
caggcctgatggattctatagactc

SEQ ID NO: 319603 - DNA, 25 bp, Mus musculus
caggcctgatggtttctatagactc

SEQ ID NO: 319604 - DNA, 25 bp, Mus musculus
caggcctgcccgaaacagatttttt

SEQ ID NO: 319605 - DNA, 25 bp, Mus musculus
caggcctgcccgtaacagatttttt

SEQ ID NO: 319606 - DNA, 25 bp, Mus musculus
caggcctgccgtatggttattgaaa

SEQ ID NO: 319607 - DNA, 25 bp, Mus musculus
caggcctgccgtttggttattgaaa

SEQ ID NO: 319608 - DNA, 25 bp, Mus musculus
caggcctgctggcacttaagctatg

SEQ ID NO: 319609 - DNA, 25 bp, Mus musculus
caggcctgctgggacttaagctatg

SEQ ID NO: 319610 - DNA, 25 bp, Mus musculus
caggcctgctgtcgacagaagtcca

SEQ ID NO: 319611 - DNA, 25 bp, Mus musculus
caggcctgctgtggacagaagtcca

SEQ ID NO: 319612 - DNA, 25 bp, Mus musculus
caggcctggaatacaggctgtgcgc

SEQ ID NO: 319613 - DNA, 25 bp, Mus musculus
caggcctggaattcaggctgtgcgc

SEQ ID NO: 319614 - DNA, 25 bp, Mus musculus
caggcctggagcaacccttctgggt

SEQ ID NO: 319615 - DNA, 25 bp, Mus musculus
caggcctggagctacccttctgggt

SEQ ID NO: 319616 - DNA, 25 bp, Mus musculus
caggcctggatgcagtagttcttca

SEQ ID NO: 319617 - DNA, 25 bp, Mus musculus
caggcctggatggagtagttcttca

SEQ ID NO: 319618 - DNA, 25 bp, Mus musculus
caggcctggccaattgtaaccaaag

SEQ ID NO: 319619 - DNA, 25 bp, Mus musculus
caggcctggccatttgtaaccaaag

SEQ ID NO: 319620 - DNA, 25 bp, Mus musculus
caggcctggcccaccctttggttag

SEQ ID NO: 319621 - DNA, 25 bp, Mus musculus
caggcctggccctccctttggttag

SEQ ID NO: 319622 - DNA, 25 bp, Mus musculus
caggcctggcctatgagaagctaat

SEQ ID NO: 319623 - DNA, 25 bp, Mus musculus
caggcctggcctttgagaagctaat

SEQ ID NO: 319624 - DNA, 25 bp, Mus musculus
caggcctgggttcccatggataccg

SEQ ID NO: 319625 - DNA, 25 bp, Mus musculus
caggcctgggttgccatggataccg

SEQ ID NO: 319626 - DNA, 25 bp, Mus musculus
caggcctggtgacacagaacccatc

SEQ ID NO: 319627 - DNA, 25 bp, Mus musculus
caggcctggtgagacagaacccatc

SEQ ID NO: 319628 - DNA, 25 bp, Mus musculus
caggcctgtatcaggtgcatttaca

SEQ ID NO: 319629 - DNA, 25 bp, Mus musculus
caggcctgtatctggtgcatttaca

SEQ ID NO: 319630 - DNA, 25 bp, Mus musculus
caggcctgtgagatcagacttggat

SEQ ID NO: 319631 - DNA, 25 bp, Mus musculus
caggcctgtgagttcagacttggat

SEQ ID NO: 319632 - DNA, 25 bp, Mus musculus
caggcctgttgtattgttcaaaaag

SEQ ID NO: 319633 - DNA, 25 bp, Mus musculus
caggcctgttgttttgttcaaaaag

SEQ ID NO: 319634 - DNA, 25 bp, Mus musculus
caggccttaatcactgaccgtacag

SEQ ID NO: 319635 - DNA, 25 bp, Mus musculus
caggccttaatctctgaccgtacag

SEQ ID NO: 319636 - DNA, 25 bp, Mus musculus
caggccttacttctctatacaatat

SEQ ID NO: 319637 - DNA, 25 bp, Mus musculus
caggccttacttgtctatacaatat

SEQ ID NO: 319638 - DNA, 25 bp, Mus musculus
caggccttagagatagcgaatgtta

SEQ ID NO: 319639 - DNA, 25 bp, Mus musculus
caggccttagagttagcgaatgtta

SEQ ID NO: 319640 - DNA, 25 bp, Mus musculus
caggccttaggcagtctttcttagg

SEQ ID NO: 319641 - DNA, 25 bp, Mus musculus
caggccttaggctgtctttcttagg

SEQ ID NO: 319642 - DNA, 25 bp, Mus musculus
caggccttagtgacacgcaggttta

SEQ ID NO: 319643 - DNA, 25 bp, Mus musculus
caggccttagtgtcacgcaggttta

SEQ ID NO: 319644 - DNA, 25 bp, Mus musculus
caggccttattccggtgctatgagt

SEQ ID NO: 319645 - DNA, 25 bp, Mus musculus
caggccttattcgggtgctatgagt

SEQ ID NO: 319646 - DNA, 25 bp, Mus musculus
caggccttccgaaaatgcgcggctt

SEQ ID NO: 319647 - DNA, 25 bp, Mus musculus
caggccttccgataatgcgcggctt

SEQ ID NO: 319648 - DNA, 25 bp, Mus musculus
caggccttctgcaggcatgactggg

SEQ ID NO: 319649 - DNA, 25 bp, Mus musculus
caggccttctgctggcatgactggg

SEQ ID NO: 319650 - DNA, 25 bp, Mus musculus
caggccttctggagatggaactttt

SEQ ID NO: 319651 - DNA, 25 bp, Mus musculus
caggccttctggtgatggaactttt

SEQ ID NO: 319652 - DNA, 25 bp, Mus musculus
caggccttgaatcaggaatccttct

SEQ ID NO: 319653 - DNA, 25 bp, Mus musculus
caggccttgaatgaggaatccttct

SEQ ID NO: 319654 - DNA, 25 bp, Mus musculus
caggccttgccaaccttggagaaaa

SEQ ID NO: 319655 - DNA, 25 bp, Mus musculus
caggccttgccatccttggagaaaa

SEQ ID NO: 319656 - DNA, 25 bp, Mus musculus
caggccttggcgacacaggtgcagt

SEQ ID NO: 319657 - DNA, 25 bp, Mus musculus
caggccttggcgtcacaggtgcagt

SEQ ID NO: 319658 - DNA, 25 bp, Mus musculus
caggccttgtcaaggagcactttga

SEQ ID NO: 319659 - DNA, 25 bp, Mus musculus
caggccttgtcatggagcactttga

SEQ ID NO: 319660 - DNA, 25 bp, Mus musculus
caggccttgtggcaattgtttgatt

SEQ ID NO: 319661 - DNA, 25 bp, Mus musculus
caggccttgtgggaattgtttgatt

SEQ ID NO: 319662 - DNA, 25 bp, Mus musculus
caggcctttgacacccagttggttg

SEQ ID NO: 319663 - DNA, 25 bp, Mus musculus
caggcctttgactcccagttggttg

SEQ ID NO: 319664 - DNA, 25 bp, Mus musculus
caggcctttggaaggtttggctaaa

SEQ ID NO: 319665 - DNA, 25 bp, Mus musculus
caggcctttggatggtttggctaaa

SEQ ID NO: 319666 - DNA, 25 bp, Mus musculus
caggcctttgggaacatagttacaa

SEQ ID NO: 319667 - DNA, 25 bp, Mus musculus
caggcctttgggtacatagttacaa

SEQ ID NO: 319668 - DNA, 25 bp, Mus musculus
caggccttttacacagatctccttg

SEQ ID NO: 319669 - DNA, 25 bp, Mus musculus
caggccttttactcagatctccttg

SEQ ID NO: 319670 - DNA, 25 bp, Mus musculus
caggcgacatctaccaccagaagtg

SEQ ID NO: 319671 - DNA, 25 bp, Mus musculus
caggcgacatcttccaccagaagtg

SEQ ID NO: 319672 - DNA, 25 bp, Mus musculus
caggcgactaggaaagtctccagtt

SEQ ID NO: 319673 - DNA, 25 bp, Mus musculus
caggcgactaggtaagtctccagtt

SEQ ID NO: 319674 - DNA, 25 bp, Mus musculus
caggcgactgacaatacgggtgcat

SEQ ID NO: 319675 - DNA, 25 bp, Mus musculus
caggcgactgactatacgggtgcat

SEQ ID NO: 319676 - DNA, 25 bp, Mus musculus
caggcgagacaccatgtccaggttg

SEQ ID NO: 319677 - DNA, 25 bp, Mus musculus
caggcgagacacgatgtccaggttg

SEQ ID NO: 319678 - DNA, 25 bp, Mus musculus
caggcgagacttcaggccccaccgt

SEQ ID NO: 319679 - DNA, 25 bp, Mus musculus
caggcgagacttgaggccccaccgt

SEQ ID NO: 319680 - DNA, 25 bp, Mus musculus
caggcgagagaccattcaaatgcaa

SEQ ID NO: 319681 - DNA, 25 bp, Mus musculus
caggcgagagacgattcaaatgcaa

SEQ ID NO: 319682 - DNA, 25 bp, Mus musculus
caggcgagagcgctcactggacaaa

SEQ ID NO: 319683 - DNA, 25 bp, Mus musculus
caggcgagagcggtcactggacaaa

SEQ ID NO: 319684 - DNA, 25 bp, Mus musculus
caggcgatgtacaaacataccagat

SEQ ID NO: 319685 - DNA, 25 bp, Mus musculus
caggcgatgtactaacataccagat

SEQ ID NO: 319686 - DNA, 25 bp, Mus musculus
caggcgcaattgcatctgacttcat

SEQ ID NO: 319687 - DNA, 25 bp, Mus musculus
caggcgcaattggatctgacttcat

SEQ ID NO: 319688 - DNA, 25 bp, Mus musculus
caggcgcacatccttgagtcaggga

SEQ ID NO: 319689 - DNA, 25 bp, Mus musculus
caggcgcacatcgttgagtcaggga

SEQ ID NO: 319690 - DNA, 25 bp, Mus musculus
caggcgcacatgaggtggcatctta

SEQ ID NO: 319691 - DNA, 25 bp, Mus musculus
caggcgcacatgtggtggcatctta

SEQ ID NO: 319692 - DNA, 25 bp, Mus musculus
caggcgcactatcaaatccggagaa

SEQ ID NO: 319693 - DNA, 25 bp, Mus musculus
caggcgcactatgaaatccggagaa

SEQ ID NO: 319694 - DNA, 25 bp, Mus musculus
caggcgcagaagcgttagctccaga

SEQ ID NO: 319695 - DNA, 25 bp, Mus musculus
caggcgcagaagggttagctccaga

SEQ ID NO: 319696 - DNA, 25 bp, Mus musculus
caggcgcagagtctgaacatcccaa

SEQ ID NO: 319697 - DNA, 25 bp, Mus musculus
caggcgcagagtgtgaacatcccaa

SEQ ID NO: 319698 - DNA, 25 bp, Mus musculus
caggcgcagttcacacacatgggtg

SEQ ID NO: 319699 - DNA, 25 bp, Mus musculus
caggcgcagttctcacacatgggtg

SEQ ID NO: 319700 - DNA, 25 bp, Mus musculus
caggcgcccacactgctaggagaat

SEQ ID NO: 319701 - DNA, 25 bp, Mus musculus
caggcgcccacagtgctaggagaat

SEQ ID NO: 319702 - DNA, 25 bp, Mus musculus
caggcgcggtgtctaaggtctaatc

SEQ ID NO: 319703 - DNA, 25 bp, Mus musculus
caggcgcggtgtgtaaggtctaatc

SEQ ID NO: 319704 - DNA, 25 bp, Mus musculus
caggcgctacttaccaagctgtgaa

SEQ ID NO: 319705 - DNA, 25 bp, Mus musculus
caggcgctactttccaagctgtgaa

SEQ ID NO: 319706 - DNA, 25 bp, Mus musculus
caggcgctagctaagtggctggaca

SEQ ID NO: 319707 - DNA, 25 bp, Mus musculus
caggcgctagcttagtggctggaca

SEQ ID NO: 319708 - DNA, 25 bp, Mus musculus
caggcggaaagtcttgtaccagcgt

SEQ ID NO: 319709 - DNA, 25 bp, Mus musculus
caggcggaaagtgttgtaccagcgt

SEQ ID NO: 319710 - DNA, 25 bp, Mus musculus
caggcggaaccccacggcatctgag

SEQ ID NO: 319711 - DNA, 25 bp, Mus musculus
caggcggaacccgacggcatctgag

SEQ ID NO: 319712 - DNA, 25 bp, Mus musculus
caggcggacctgagtacctttatta

SEQ ID NO: 319713 - DNA, 25 bp, Mus musculus
caggcggacctgtgtacctttatta

SEQ ID NO: 319714 - DNA, 25 bp, Mus musculus
caggcggatgggatccaggcctcaa

SEQ ID NO: 319715 - DNA, 25 bp, Mus musculus
caggcggatgggttccaggcctcaa

SEQ ID NO: 319716 - DNA, 25 bp, Mus musculus
caggcggcacctcctattgaccatg

SEQ ID NO: 319717 - DNA, 25 bp, Mus musculus
caggcggcacctgctattgaccatg

SEQ ID NO: 319718 - DNA, 25 bp, Mus musculus
caggcggcccgacgtgtgcacattt

SEQ ID NO: 319719 - DNA, 25 bp, Mus musculus
caggcggcccgaggtgtgcacattt

SEQ ID NO: 319720 - DNA, 25 bp, Mus musculus
caggcggcctctccatgtatgtaca

SEQ ID NO: 319721 - DNA, 25 bp, Mus musculus
caggcggcctctgcatgtatgtaca

SEQ ID NO: 319722 - DNA, 25 bp, Mus musculus
caggcgggatgaatgctgctctctc

SEQ ID NO: 319723 - DNA, 25 bp, Mus musculus
caggcgggatgattgctgctctctc

SEQ ID NO: 319724 - DNA, 25 bp, Mus musculus
caggcgggcactctgtttgtcaaca

SEQ ID NO: 319725 - DNA, 25 bp, Mus musculus
caggcgggcactgtgtttgtcaaca

SEQ ID NO: 319726 - DNA, 25 bp, Mus musculus
caggcgggcagcactcagatgtaaa

SEQ ID NO: 319727 - DNA, 25 bp, Mus musculus
caggcgggcagctctcagatgtaaa

SEQ ID NO: 319728 - DNA, 25 bp, Mus musculus
caggcgggtgatcgcttgactctaa

SEQ ID NO: 319729 - DNA, 25 bp, Mus musculus
caggcgggtgatggcttgactctaa

SEQ ID NO: 319730 - DNA, 25 bp, Mus musculus
caggcgggttcacggctaaagcaat

SEQ ID NO: 319731 - DNA, 25 bp, Mus musculus
caggcgggttcagggctaaagcaat

SEQ ID NO: 319732 - DNA, 25 bp, Mus musculus
caggcggtagtccatgcagaacacg

SEQ ID NO: 319733 - DNA, 25 bp, Mus musculus
caggcggtagtcgatgcagaacacg

SEQ ID NO: 319734 - DNA, 25 bp, Mus musculus
caggcggtgagaactgtagacatgc

SEQ ID NO: 319735 - DNA, 25 bp, Mus musculus
caggcggtgagatctgtagacatgc

SEQ ID NO: 319736 - DNA, 25 bp, Mus musculus
caggcgtacacacagtttggaggca

SEQ ID NO: 319737 - DNA, 25 bp, Mus musculus
caggcgtacacagagtttggaggca

SEQ ID NO: 319738 - DNA, 25 bp, Mus musculus
caggcgtatcctctggtcaaaagaa

SEQ ID NO: 319739 - DNA, 25 bp, Mus musculus
caggcgtatcctgtggtcaaaagaa

SEQ ID NO: 319740 - DNA, 25 bp, Mus musculus
caggcgtatgttcaatatgttttct

SEQ ID NO: 319741 - DNA, 25 bp, Mus musculus
caggcgtatgttgaatatgttttct

SEQ ID NO: 319742 - DNA, 25 bp, Mus musculus
caggcgtccccgcaaagctggtgat

SEQ ID NO: 319743 - DNA, 25 bp, Mus musculus
caggcgtccccggaaagctggtgat

SEQ ID NO: 319744 - DNA, 25 bp, Mus musculus
caggcgtcctgtctgactttgcaca

SEQ ID NO: 319745 - DNA, 25 bp, Mus musculus
caggcgtcctgtgtgactttgcaca

SEQ ID NO: 319746 - DNA, 25 bp, Mus musculus
caggcgtcgctgagcaagggatctt

SEQ ID NO: 319747 - DNA, 25 bp, Mus musculus
caggcgtcgctgtgcaagggatctt

SEQ ID NO: 319748 - DNA, 25 bp, Mus musculus
caggcgtcttcacaaaacttattaa

SEQ ID NO: 319749 - DNA, 25 bp, Mus musculus
caggcgtcttcagaaaacttattaa

SEQ ID NO: 319750 - DNA, 25 bp, Mus musculus
caggcgtgacacactcagttgaaga

SEQ ID NO: 319751 - DNA, 25 bp, Mus musculus
caggcgtgacactctcagttgaaga

SEQ ID NO: 319752 - DNA, 25 bp, Mus musculus
caggcgtgggatccgaacacccatt

SEQ ID NO: 319753 - DNA, 25 bp, Mus musculus
caggcgtgggatgcgaacacccatt

SEQ ID NO: 319754 - DNA, 25 bp, Mus musculus
caggctaaccttagactcatagtcc

SEQ ID NO: 319755 - DNA, 25 bp, Mus musculus
caggctaacctttgactcatagtcc

SEQ ID NO: 319756 - DNA, 25 bp, Mus musculus
caggctaatgtgcttgtatatcttc

SEQ ID NO: 319757 - DNA, 25 bp, Mus musculus
caggctaatgtggttgtatatcttc

SEQ ID NO: 319758 - DNA, 25 bp, Mus musculus
caggctacacagaccacacagatga

SEQ ID NO: 319759 - DNA, 25 bp, Mus musculus
caggctacacagtccacacagatga

SEQ ID NO: 319760 - DNA, 25 bp, Mus musculus
caggctacacggacctcataggaga

SEQ ID NO: 319761 - DNA, 25 bp, Mus musculus
caggctacacggtcctcataggaga

SEQ ID NO: 319762 - DNA, 25 bp, Mus musculus
caggctacagccaagactcgttctt

SEQ ID NO: 319763 - DNA, 25 bp, Mus musculus
caggctacagcctagactcgttctt

SEQ ID NO: 319764 - DNA, 25 bp, Mus musculus
caggctacagggacttatttcttaa

SEQ ID NO: 319765 - DNA, 25 bp, Mus musculus
caggctacagggtcttatttcttaa

SEQ ID NO: 319766 - DNA, 25 bp, Mus musculus
caggctaccctccagagtgagttag

SEQ ID NO: 319767 - DNA, 25 bp, Mus musculus
caggctaccctcgagagtgagttag

SEQ ID NO: 319768 - DNA, 25 bp, Mus musculus
caggctactggcagccaccgatgct

SEQ ID NO: 319769 - DNA, 25 bp, Mus musculus
caggctactggctgccaccgatgct

SEQ ID NO: 319770 - DNA, 25 bp, Mus musculus
caggctactgggatggtgtccgata

SEQ ID NO: 319771 - DNA, 25 bp, Mus musculus
caggctactgggttggtgtccgata

SEQ ID NO: 319772 - DNA, 25 bp, Mus musculus
caggctagacttacgtgctactgta

SEQ ID NO: 319773 - DNA, 25 bp, Mus musculus
caggctagactttcgtgctactgta

SEQ ID NO: 319774 - DNA, 25 bp, Mus musculus
caggctagccttaattcactctata

SEQ ID NO: 319775 - DNA, 25 bp, Mus musculus
caggctagcctttattcactctata

SEQ ID NO: 319776 - DNA, 25 bp, Mus musculus
caggctagctgcattttttcctacc

SEQ ID NO: 319777 - DNA, 25 bp, Mus musculus
caggctagctgctttttttcctacc

SEQ ID NO: 319778 - DNA, 25 bp, Mus musculus
caggctagcttaacatacttgttca

SEQ ID NO: 319779 - DNA, 25 bp, Mus musculus
caggctagcttatcatacttgttca

SEQ ID NO: 319780 - DNA, 25 bp, Mus musculus
caggctaggcaaagcagtgaacaca

SEQ ID NO: 319781 - DNA, 25 bp, Mus musculus
caggctaggcaatgcagtgaacaca

SEQ ID NO: 319782 - DNA, 25 bp, Mus musculus
caggctaggctaaattactttttca

SEQ ID NO: 319783 - DNA, 25 bp, Mus musculus
caggctaggctatattactttttca

SEQ ID NO: 319784 - DNA, 25 bp, Mus musculus
caggctagggagattcgggcacatt

SEQ ID NO: 319785 - DNA, 25 bp, Mus musculus
caggctagggagtttcgggcacatt

SEQ ID NO: 319786 - DNA, 25 bp, Mus musculus
caggctagtcttaaacttgctctat

SEQ ID NO: 319787 - DNA, 25 bp, Mus musculus
caggctagtctttaacttgctctat

SEQ ID NO: 319788 - DNA, 25 bp, Mus musculus
caggctagttagaactacgcagtaa

SEQ ID NO: 319789 - DNA, 25 bp, Mus musculus
caggctagttagtactacgcagtaa

SEQ ID NO: 319790 - DNA, 25 bp, Mus musculus
caggctataggcacagtcaacattt

SEQ ID NO: 319791 - DNA, 25 bp, Mus musculus
caggctataggctcagtcaacattt

SEQ ID NO: 319792 - DNA, 25 bp, Mus musculus
caggctatatgaacattcacaccaa

SEQ ID NO: 319793 - DNA, 25 bp, Mus musculus
caggctatatgatcattcacaccaa

SEQ ID NO: 319794 - DNA, 25 bp, Mus musculus
caggctatatttattgccagagaat

SEQ ID NO: 319795 - DNA, 25 bp, Mus musculus
caggctatattttttgccagagaat

SEQ ID NO: 319796 - DNA, 25 bp, Mus musculus
caggctatcaccatcagtcctagta

SEQ ID NO: 319797 - DNA, 25 bp, Mus musculus
caggctatcaccttcagtcctagta

SEQ ID NO: 319798 - DNA, 25 bp, Mus musculus
caggctatccttatagtcatttcag

SEQ ID NO: 319799 - DNA, 25 bp, Mus musculus
caggctatccttttagtcatttcag

SEQ ID NO: 319800 - DNA, 25 bp, Mus musculus
caggctatctagactgagcttcaga

SEQ ID NO: 319801 - DNA, 25 bp, Mus musculus
caggctatctagtctgagcttcaga

SEQ ID NO: 319802 - DNA, 25 bp, Mus musculus
caggctatggccatgcagtactgag

SEQ ID NO: 319803 - DNA, 25 bp, Mus musculus
caggctatggccttgcagtactgag

SEQ ID NO: 319804 - DNA, 25 bp, Mus musculus
caggctatggctacgctgaatactt

SEQ ID NO: 319805 - DNA, 25 bp, Mus musculus
caggctatggcttcgctgaatactt

SEQ ID NO: 319806 - DNA, 25 bp, Mus musculus
caggctatgtggcaaatgtggacta

SEQ ID NO: 319807 - DNA, 25 bp, Mus musculus
caggctatgtgggaaatgtggacta

SEQ ID NO: 319808 - DNA, 25 bp, Mus musculus
caggctattgtgcagctcactctgt

SEQ ID NO: 319809 - DNA, 25 bp, Mus musculus
caggctattgtggagctcactctgt

SEQ ID NO: 319810 - DNA, 25 bp, Mus musculus
caggctatttctaggctgggcaatt

SEQ ID NO: 319811 - DNA, 25 bp, Mus musculus
caggctatttcttggctgggcaatt

SEQ ID NO: 319812 - DNA, 25 bp, Mus musculus
caggctatttttacctaacctagat

SEQ ID NO: 319813 - DNA, 25 bp, Mus musculus
caggctattttttcctaacctagat

SEQ ID NO: 319814 - DNA, 25 bp, Mus musculus
caggctcaaatgaatgtacataagg

SEQ ID NO: 319815 - DNA, 25 bp, Mus musculus
caggctcaaatgtatgtacataagg

SEQ ID NO: 319816 - DNA, 25 bp, Mus musculus
caggctcaacaacattttgcccata

SEQ ID NO: 319817 - DNA, 25 bp, Mus musculus
caggctcaacaagattttgcccata

SEQ ID NO: 319818 - DNA, 25 bp, Mus musculus
caggctcaacagagcttcggagcaa

SEQ ID NO: 319819 - DNA, 25 bp, Mus musculus
caggctcaacagtgcttcggagcaa

SEQ ID NO: 319820 - DNA, 25 bp, Mus musculus
caggctcaactgcattttaatctct

SEQ ID NO: 319821 - DNA, 25 bp, Mus musculus
caggctcaactggattttaatctct

SEQ ID NO: 319822 - DNA, 25 bp, Mus musculus
caggctcaagttacattgtccctcc

SEQ ID NO: 319823 - DNA, 25 bp, Mus musculus
caggctcaagtttcattgtccctcc

SEQ ID NO: 319824 - DNA, 25 bp, Mus musculus
caggctcacaaccatgaatgatgga

SEQ ID NO: 319825 - DNA, 25 bp, Mus musculus
caggctcacaacgatgaatgatgga

SEQ ID NO: 319826 - DNA, 25 bp, Mus musculus
caggctcacatgctttgtacaataa

SEQ ID NO: 319827 - DNA, 25 bp, Mus musculus
caggctcacatggtttgtacaataa

SEQ ID NO: 319828 - DNA, 25 bp, Mus musculus
caggctcaccctaaattattaaatt

SEQ ID NO: 319829 - DNA, 25 bp, Mus musculus
caggctcacccttaattattaaatt

SEQ ID NO: 319830 - DNA, 25 bp, Mus musculus
caggctcaccggagatgtgttggct

SEQ ID NO: 319831 - DNA, 25 bp, Mus musculus
caggctcaccggtgatgtgttggct

SEQ ID NO: 319832 - DNA, 25 bp, Mus musculus
caggctcactggaggttcagagcag

SEQ ID NO: 319833 - DNA, 25 bp, Mus musculus
caggctcactggtggttcagagcag

SEQ ID NO: 319834 - DNA, 25 bp, Mus musculus
caggctcagacacccaaggttcagc

SEQ ID NO: 319835 - DNA, 25 bp, Mus musculus
caggctcagacagccaaggttcagc

SEQ ID NO: 319836 - DNA, 25 bp, Mus musculus
caggctcagactcggttaggtttta

SEQ ID NO: 319837 - DNA, 25 bp, Mus musculus
caggctcagactgggttaggtttta

SEQ ID NO: 319838 - DNA, 25 bp, Mus musculus
caggctcagcctagcacaggagaca

SEQ ID NO: 319839 - DNA, 25 bp, Mus musculus
caggctcagccttgcacaggagaca

SEQ ID NO: 319840 - DNA, 25 bp, Mus musculus
caggctcaggacatcctcacctagt

SEQ ID NO: 319841 - DNA, 25 bp, Mus musculus
caggctcaggacttcctcacctagt

SEQ ID NO: 319842 - DNA, 25 bp, Mus musculus
caggctcagggactttactgttgtt

SEQ ID NO: 319843 - DNA, 25 bp, Mus musculus
caggctcagggagtttactgttgtt

SEQ ID NO: 319844 - DNA, 25 bp, Mus musculus
caggctcaggtgaacaggttcttct

SEQ ID NO: 319845 - DNA, 25 bp, Mus musculus
caggctcaggtgtacaggttcttct

SEQ ID NO: 319846 - DNA, 25 bp, Mus musculus
caggctcaggttcctcataaagtcg

SEQ ID NO: 319847 - DNA, 25 bp, Mus musculus
caggctcaggttgctcataaagtcg

SEQ ID NO: 319848 - DNA, 25 bp, Mus musculus
caggctcagtgacctcctgaaggag

SEQ ID NO: 319849 - DNA, 25 bp, Mus musculus
caggctcagtgagctcctgaaggag

SEQ ID NO: 319850 - DNA, 25 bp, Mus musculus
caggctcatccaacagcttttacgg

SEQ ID NO: 319851 - DNA, 25 bp, Mus musculus
caggctcatccatcagcttttacgg

SEQ ID NO: 319852 - DNA, 25 bp, Mus musculus
caggctcatttaacactcgcaaagg

SEQ ID NO: 319853 - DNA, 25 bp, Mus musculus
caggctcatttatcactcgcaaagg

SEQ ID NO: 319854 - DNA, 25 bp, Mus musculus
caggctccagggaggacacatgcta

SEQ ID NO: 319855 - DNA, 25 bp, Mus musculus
caggctccagggtggacacatgcta

SEQ ID NO: 319856 - DNA, 25 bp, Mus musculus
caggctccagttcatccaaacaaaa

SEQ ID NO: 319857 - DNA, 25 bp, Mus musculus
caggctccagttgatccaaacaaaa

SEQ ID NO: 319858 - DNA, 25 bp, Mus musculus
caggctcccactaaatgcctaaggg

SEQ ID NO: 319859 - DNA, 25 bp, Mus musculus
caggctcccacttaatgcctaaggg

SEQ ID NO: 319860 - DNA, 25 bp, Mus musculus
caggctccccgaaaggttctgagaa

SEQ ID NO: 319861 - DNA, 25 bp, Mus musculus
caggctccccgaagcgagtcacaaa

SEQ ID NO: 319862 - DNA, 25 bp, Mus musculus
caggctccccgataggttctgagaa

SEQ ID NO: 319863 - DNA, 25 bp, Mus musculus
caggctccccgatgcgagtcacaaa

SEQ ID NO: 319864 - DNA, 25 bp, Mus musculus
caggctccgagccactgtcatagag

SEQ ID NO: 319865 - DNA, 25 bp, Mus musculus
caggctccgagcgactgtcatagag

SEQ ID NO: 319866 - DNA, 25 bp, Mus musculus
caggctccggaacgtcgccaaggca

SEQ ID NO: 319867 - DNA, 25 bp, Mus musculus
caggctccggaactatgtcccagag

SEQ ID NO: 319868 - DNA, 25 bp, Mus musculus
caggctccggaaggtcgccaaggca

SEQ ID NO: 319869 - DNA, 25 bp, Mus musculus
caggctccggaagtatgtcccagag

SEQ ID NO: 319870 - DNA, 25 bp, Mus musculus
caggctccggcccttaaagcaaagc

SEQ ID NO: 319871 - DNA, 25 bp, Mus musculus
caggctccggccgttaaagcaaagc

SEQ ID NO: 319872 - DNA, 25 bp, Mus musculus
caggctcctacacacaagactatat

SEQ ID NO: 319873 - DNA, 25 bp, Mus musculus
caggctcctacagacaagactatat

SEQ ID NO: 319874 - DNA, 25 bp, Mus musculus
caggctcctataagttcatctccag

SEQ ID NO: 319875 - DNA, 25 bp, Mus musculus
caggctcctatatgttcatctccag

SEQ ID NO: 319876 - DNA, 25 bp, Mus musculus
caggctcctatgaatcctcttaggg

SEQ ID NO: 319877 - DNA, 25 bp, Mus musculus
caggctcctatgtatcctcttaggg

SEQ ID NO: 319878 - DNA, 25 bp, Mus musculus
caggctcctgcgaagttgtgactgc

SEQ ID NO: 319879 - DNA, 25 bp, Mus musculus
caggctcctgcgtagttgtgactgc

SEQ ID NO: 319880 - DNA, 25 bp, Mus musculus
caggctcctggcagacggacaagag

SEQ ID NO: 319881 - DNA, 25 bp, Mus musculus
caggctcctggctgacggacaagag

SEQ ID NO: 319882 - DNA, 25 bp, Mus musculus
caggctccttggagacaagtccaga

SEQ ID NO: 319883 - DNA, 25 bp, Mus musculus
caggctccttggtgacaagtccaga

SEQ ID NO: 319884 - DNA, 25 bp, Mus musculus
caggctcgagctcagagaaccttat

SEQ ID NO: 319885 - DNA, 25 bp, Mus musculus
caggctcgagctgagagaaccttat

SEQ ID NO: 319886 - DNA, 25 bp, Mus musculus
caggctcgccaacctggatgaagat

SEQ ID NO: 319887 - DNA, 25 bp, Mus musculus
caggctcgccaagctggatgaagat

SEQ ID NO: 319888 - DNA, 25 bp, Mus musculus
caggctcgggttcatgtgctagaac

SEQ ID NO: 319889 - DNA, 25 bp, Mus musculus
caggctcgggttgatgtgctagaac

SEQ ID NO: 319890 - DNA, 25 bp, Mus musculus
caggctcggtgaaggaccttgtgtc

SEQ ID NO: 319891 - DNA, 25 bp, Mus musculus
caggctcggtgatggaccttgtgtc

SEQ ID NO: 319892 - DNA, 25 bp, Mus musculus
caggctctaaagattgctgtccttt

SEQ ID NO: 319893 - DNA, 25 bp, Mus musculus
caggctctaaagtttgctgtccttt

SEQ ID NO: 319894 - DNA, 25 bp, Mus musculus
caggctctagacacagtcctcagaa

SEQ ID NO: 319895 - DNA, 25 bp, Mus musculus
caggctctagactcagtcctcagaa

SEQ ID NO: 319896 - DNA, 25 bp, Mus musculus
caggctctagctacagaggcttccc

SEQ ID NO: 319897 - DNA, 25 bp, Mus musculus
caggctctagctataaagcacactt

SEQ ID NO: 319898 - DNA, 25 bp, Mus musculus
caggctctagcttcagaggcttccc

SEQ ID NO: 319899 - DNA, 25 bp, Mus musculus
caggctctagctttaaagcacactt

SEQ ID NO: 319900 - DNA, 25 bp, Mus musculus
caggctctcaacagtggtcaatgct

SEQ ID NO: 319901 - DNA, 25 bp, Mus musculus
caggctctcaactgtggtcaatgct

SEQ ID NO: 319902 - DNA, 25 bp, Mus musculus
caggctctccttagtaaactactag

SEQ ID NO: 319903 - DNA, 25 bp, Mus musculus
caggctctcctttgtaaactactag

SEQ ID NO: 319904 - DNA, 25 bp, Mus musculus
caggctctcttacaagttccttgtt

SEQ ID NO: 319905 - DNA, 25 bp, Mus musculus
caggctctcttagaagttccttgtt

SEQ ID NO: 319906 - DNA, 25 bp, Mus musculus
caggctctgagactgtgccacataa

SEQ ID NO: 319907 - DNA, 25 bp, Mus musculus
caggctctgagagtgtgccacataa

SEQ ID NO: 319908 - DNA, 25 bp, Mus musculus
caggctctgagccaacacttaaaga

SEQ ID NO: 319909 - DNA, 25 bp, Mus musculus
caggctctgagcgaacacttaaaga

SEQ ID NO: 319910 - DNA, 25 bp, Mus musculus
caggctctgctcaattcttcaggat

SEQ ID NO: 319911 - DNA, 25 bp, Mus musculus
caggctctgctctattcttcaggat

SEQ ID NO: 319912 - DNA, 25 bp, Mus musculus
caggctctggacacacaaagacctc

SEQ ID NO: 319913 - DNA, 25 bp, Mus musculus
caggctctggacattgtaggtcact

SEQ ID NO: 319914 - DNA, 25 bp, Mus musculus
caggctctggactcacaaagacctc

SEQ ID NO: 319915 - DNA, 25 bp, Mus musculus
caggctctggactttgtaggtcact

SEQ ID NO: 319916 - DNA, 25 bp, Mus musculus
caggctctggccaaaagagtgggct

SEQ ID NO: 319917 - DNA, 25 bp, Mus musculus
caggctctggcctaaagagtgggct

SEQ ID NO: 319918 - DNA, 25 bp, Mus musculus
caggctctgggaacgggctgtttgt

SEQ ID NO: 319919 - DNA, 25 bp, Mus musculus
caggctctgggatcgggctgtttgt

SEQ ID NO: 319920 - DNA, 25 bp, Mus musculus
caggctctgtagaggatctgcccaa

SEQ ID NO: 319921 - DNA, 25 bp, Mus musculus
caggctctgtagtggatctgcccaa

SEQ ID NO: 319922 - DNA, 25 bp, Mus musculus
caggctctgtggcttatgaaacaat

SEQ ID NO: 319923 - DNA, 25 bp, Mus musculus
caggctctgtgggttatgaaacaat

SEQ ID NO: 319924 - DNA, 25 bp, Mus musculus
caggctctgttgcagatggttctcc

SEQ ID NO: 319925 - DNA, 25 bp, Mus musculus
caggctctgttggagatggttctcc

SEQ ID NO: 319926 - DNA, 25 bp, Mus musculus
caggctcttagaatggacaccatcc

SEQ ID NO: 319927 - DNA, 25 bp, Mus musculus
caggctcttagattggacaccatcc

SEQ ID NO: 319928 - DNA, 25 bp, Mus musculus
caggctgaattcatgtgagttcgag

SEQ ID NO: 319929 - DNA, 25 bp, Mus musculus
caggctgaattcttgtgagttcgag

SEQ ID NO: 319930 - DNA, 25 bp, Mus musculus
caggctgaccacatcattggaaact

SEQ ID NO: 319931 - DNA, 25 bp, Mus musculus
caggctgaccacttcattggaaact

SEQ ID NO: 319932 - DNA, 25 bp, Mus musculus
caggctgaccctattaacttgcctt

SEQ ID NO: 319933 - DNA, 25 bp, Mus musculus
caggctgacccttttaacttgcctt

SEQ ID NO: 319934 - DNA, 25 bp, Mus musculus
caggctgacctccaatttagagctt

SEQ ID NO: 319935 - DNA, 25 bp, Mus musculus
caggctgacctcgaatttagagctt

SEQ ID NO: 319936 - DNA, 25 bp, Mus musculus
caggctgacctgaaaaactcccatt

SEQ ID NO: 319937 - DNA, 25 bp, Mus musculus
caggctgacctgtaaaactcccatt

SEQ ID NO: 319938 - DNA, 25 bp, Mus musculus
caggctgaccttcaggcatggactg

SEQ ID NO: 319939 - DNA, 25 bp, Mus musculus
caggctgaccttgaggcatggactg

SEQ ID NO: 319940 - DNA, 25 bp, Mus musculus
caggctgactgcaaacatggtatat

SEQ ID NO: 319941 - DNA, 25 bp, Mus musculus
caggctgactgctaacatggtatat

SEQ ID NO: 319942 - DNA, 25 bp, Mus musculus
caggctgacttgcagacttctgaca

SEQ ID NO: 319943 - DNA, 25 bp, Mus musculus
caggctgacttggagacttctgaca

SEQ ID NO: 319944 - DNA, 25 bp, Mus musculus
caggctgagaaccaaagttttagac

SEQ ID NO: 319945 - DNA, 25 bp, Mus musculus
caggctgagaacgaaagttttagac

SEQ ID NO: 319946 - DNA, 25 bp, Mus musculus
caggctgagcggctgagtaaccatc

SEQ ID NO: 319947 - DNA, 25 bp, Mus musculus
caggctgagcgggtgagtaaccatc

SEQ ID NO: 319948 - DNA, 25 bp, Mus musculus
caggctgaggcgaggagatccaccc

SEQ ID NO: 319949 - DNA, 25 bp, Mus musculus
caggctgaggcgtggagatccaccc

SEQ ID NO: 319950 - DNA, 25 bp, Mus musculus
caggctgaggctacagtggtctgca

SEQ ID NO: 319951 - DNA, 25 bp, Mus musculus
caggctgaggcttcagtggtctgca

SEQ ID NO: 319952 - DNA, 25 bp, Mus musculus
caggctgagtgaccttgtggaacac

SEQ ID NO: 319953 - DNA, 25 bp, Mus musculus
caggctgagtgagcttgtggaacac

SEQ ID NO: 319954 - DNA, 25 bp, Mus musculus
caggctgatcaaactcaccatcttc

SEQ ID NO: 319955 - DNA, 25 bp, Mus musculus
caggctgatcaatctcaccatcttc

SEQ ID NO: 319956 - DNA, 25 bp, Mus musculus
caggctgcaaggagccatttgtggc

SEQ ID NO: 319957 - DNA, 25 bp, Mus musculus
caggctgcaaggtgccatttgtggc

SEQ ID NO: 319958 - DNA, 25 bp, Mus musculus
caggctgcaatcctggtctatgata

SEQ ID NO: 319959 - DNA, 25 bp, Mus musculus
caggctgcaatcgtggtctatgata

SEQ ID NO: 319960 - DNA, 25 bp, Mus musculus
caggctgcacaaattagtttgctaa

SEQ ID NO: 319961 - DNA, 25 bp, Mus musculus
caggctgcacaatttagtttgctaa

SEQ ID NO: 319962 - DNA, 25 bp, Mus musculus
caggctgcacatatcctagtgtatc

SEQ ID NO: 319963 - DNA, 25 bp, Mus musculus
caggctgcacatttcctagtgtatc

SEQ ID NO: 319964 - DNA, 25 bp, Mus musculus
caggctgcacttcctatcattataa

SEQ ID NO: 319965 - DNA, 25 bp, Mus musculus
caggctgcacttgctatcattataa

SEQ ID NO: 319966 - DNA, 25 bp, Mus musculus
caggctgcagacaggattcgcatca

SEQ ID NO: 319967 - DNA, 25 bp, Mus musculus
caggctgcagactggattcgcatca

SEQ ID NO: 319968 - DNA, 25 bp, Mus musculus
caggctgcagccagagacctggact

SEQ ID NO: 319969 - DNA, 25 bp, Mus musculus
caggctgcagcctgagacctggact

SEQ ID NO: 319970 - DNA, 25 bp, Mus musculus
caggctgcagttagagtttgaaccc

SEQ ID NO: 319971 - DNA, 25 bp, Mus musculus
caggctgcagtttgagtttgaaccc

SEQ ID NO: 319972 - DNA, 25 bp, Mus musculus
caggctgccaggcatctgcaagact

SEQ ID NO: 319973 - DNA, 25 bp, Mus musculus
caggctgccagggatctgcaagact

SEQ ID NO: 319974 - DNA, 25 bp, Mus musculus
caggctgccatgaccgaaaagaaat

SEQ ID NO: 319975 - DNA, 25 bp, Mus musculus
caggctgccatgtccgaaaagaaat

SEQ ID NO: 319976 - DNA, 25 bp, Mus musculus
caggctgcccagctaggccacagag

SEQ ID NO: 319977 - DNA, 25 bp, Mus musculus
caggctgcccaggtaggccacagag

SEQ ID NO: 319978 - DNA, 25 bp, Mus musculus
caggctgcctggacctcacggaagt

SEQ ID NO: 319979 - DNA, 25 bp, Mus musculus
caggctgcctggtcctcacggaagt

SEQ ID NO: 319980 - DNA, 25 bp, Mus musculus
caggctgcctgtagattgtatgact

SEQ ID NO: 319981 - DNA, 25 bp, Mus musculus
caggctgcctgttgattgtatgact

SEQ ID NO: 319982 - DNA, 25 bp, Mus musculus
caggctgcctttatgctgagctatg

SEQ ID NO: 319983 - DNA, 25 bp, Mus musculus
caggctgcctttttgctgagctatg

SEQ ID NO: 319984 - DNA, 25 bp, Mus musculus
caggctgcgcgcaccaggctgggtg

SEQ ID NO: 319985 - DNA, 25 bp, Mus musculus
caggctgcgcgctccaggctgggtg

SEQ ID NO: 319986 - DNA, 25 bp, Mus musculus
caggctgcgtggcatttttgccata

SEQ ID NO: 319987 - DNA, 25 bp, Mus musculus
caggctgcgtgggatttttgccata

SEQ ID NO: 319988 - DNA, 25 bp, Mus musculus
caggctgctcatattcacagtaggc

SEQ ID NO: 319989 - DNA, 25 bp, Mus musculus
caggctgctcattttcacagtaggc

SEQ ID NO: 319990 - DNA, 25 bp, Mus musculus
caggctgctccaagggccgcatgag

SEQ ID NO: 319991 - DNA, 25 bp, Mus musculus
caggctgctccatgggccgcatgag

SEQ ID NO: 319992 - DNA, 25 bp, Mus musculus
caggctgctctgaggatagtcttaa

SEQ ID NO: 319993 - DNA, 25 bp, Mus musculus
caggctgctctgtggatagtcttaa

SEQ ID NO: 319994 - DNA, 25 bp, Mus musculus
caggctgctgagacaatctgaaagc

SEQ ID NO: 319995 - DNA, 25 bp, Mus musculus
caggctgctgagtcaatctgaaagc

SEQ ID NO: 319996 - DNA, 25 bp, Mus musculus
caggctgcttagatccctcagcttt

SEQ ID NO: 319997 - DNA, 25 bp, Mus musculus
caggctgcttagttccctcagcttt

SEQ ID NO: 319998 - DNA, 25 bp, Mus musculus
caggctgcttataatctaaatcgat

SEQ ID NO: 319999 - DNA, 25 bp, Mus musculus
caggctgcttattatctaaatcgat

SEQ ID NO: 320000 - DNA, 25 bp, Mus musculus
caggctgcttcacggatgctgtgta

SEQ ID NO: 320001 - DNA, 25 bp, Mus musculus
caggctgcttcagggatgctgtgta

SEQ ID NO: 320002 - DNA, 25 bp, Mus musculus
caggctgcttccataatcaagaaaa

SEQ ID NO: 320003 - DNA, 25 bp, Mus musculus
caggctgcttccttaatcaagaaaa

SEQ ID NO: 320004 - DNA, 25 bp, Mus musculus
caggctgcttgcaggtcaagacacc

SEQ ID NO: 320005 - DNA, 25 bp, Mus musculus
caggctgcttgctggtcaagacacc

SEQ ID NO: 320006 - DNA, 25 bp, Mus musculus
caggctgctttgatgtaagtgctag

SEQ ID NO: 320007 - DNA, 25 bp, Mus musculus
caggctgctttgttgtaagtgctag

SEQ ID NO: 320008 - DNA, 25 bp, Mus musculus
caggctggaatcacggaatgggaaa

SEQ ID NO: 320009 - DNA, 25 bp, Mus musculus
caggctggaatctcggaatgggaaa

SEQ ID NO: 320010 - DNA, 25 bp, Mus musculus
caggctggagtcagtgttatctgtc

SEQ ID NO: 320011 - DNA, 25 bp, Mus musculus
caggctggagtctgtgttatctgtc

SEQ ID NO: 320012 - DNA, 25 bp, Mus musculus
caggctggcaatctgtctatctatc

SEQ ID NO: 320013 - DNA, 25 bp, Mus musculus
caggctggcaatgtgtctatctatc

SEQ ID NO: 320014 - DNA, 25 bp, Mus musculus
caggctggcatcagatggaactgtt

SEQ ID NO: 320015 - DNA, 25 bp, Mus musculus
caggctggcatctgatggaactgtt

SEQ ID NO: 320016 - DNA, 25 bp, Mus musculus
caggctggccaactgtgcgtaacca

SEQ ID NO: 320017 - DNA, 25 bp, Mus musculus
caggctggccaagtgtgcgtaacca

SEQ ID NO: 320018 - DNA, 25 bp, Mus musculus
caggctggccacagcacgtctgggc

SEQ ID NO: 320019 - DNA, 25 bp, Mus musculus
caggctggccactgcacgtctgggc

SEQ ID NO: 320020 - DNA, 25 bp, Mus musculus
caggctggccagaacactatatagt

SEQ ID NO: 320021 - DNA, 25 bp, Mus musculus
caggctggccagtacactatatagt

SEQ ID NO: 320022 - DNA, 25 bp, Mus musculus
caggctggccatcaaaaaatctttt

SEQ ID NO: 320023 - DNA, 25 bp, Mus musculus
caggctggccatgaaaaaatctttt

SEQ ID NO: 320024 - DNA, 25 bp, Mus musculus
caggctggccctatactcaagaggt

SEQ ID NO: 320025 - DNA, 25 bp, Mus musculus
caggctggccctttactcaagaggt

SEQ ID NO: 320026 - DNA, 25 bp, Mus musculus
caggctggcctcagttaggattaaa

SEQ ID NO: 320027 - DNA, 25 bp, Mus musculus
caggctggcctctgttaggattaaa

SEQ ID NO: 320028 - DNA, 25 bp, Mus musculus
caggctggctacaacttgctgtgta

SEQ ID NO: 320029 - DNA, 25 bp, Mus musculus
caggctggctactacttgctgtgta

SEQ ID NO: 320030 - DNA, 25 bp, Mus musculus
caggctggctgaacctgtgatggct

SEQ ID NO: 320031 - DNA, 25 bp, Mus musculus
caggctggctgatcctgtgatggct

SEQ ID NO: 320032 - DNA, 25 bp, Mus musculus
caggctgggcagcatacacctttac

SEQ ID NO: 320033 - DNA, 25 bp, Mus musculus
caggctgggcaggatacacctttac

SEQ ID NO: 320034 - DNA, 25 bp, Mus musculus
caggctgggctcaagaggtctgtct

SEQ ID NO: 320035 - DNA, 25 bp, Mus musculus
caggctgggctctagaggtctgtct

SEQ ID NO: 320036 - DNA, 25 bp, Mus musculus
caggctgggcttcagctcagagacc

SEQ ID NO: 320037 - DNA, 25 bp, Mus musculus
caggctgggcttgagctcagagacc

SEQ ID NO: 320038 - DNA, 25 bp, Mus musculus
caggctggggcgacattgataatga

SEQ ID NO: 320039 - DNA, 25 bp, Mus musculus
caggctggggcgtcattgataatga

SEQ ID NO: 320040 - DNA, 25 bp, Mus musculus
caggctgggtgtagtttgtaatcaa

SEQ ID NO: 320041 - DNA, 25 bp, Mus musculus
caggctgggtgttgtttgtaatcaa

SEQ ID NO: 320042 - DNA, 25 bp, Mus musculus
caggctggtgatcatagtattcgca

SEQ ID NO: 320043 - DNA, 25 bp, Mus musculus
caggctggtgatgatagtattcgca

SEQ ID NO: 320044 - DNA, 25 bp, Mus musculus
caggctggttggatgcttcctcgtc

SEQ ID NO: 320045 - DNA, 25 bp, Mus musculus
caggctggttggttgcttcctcgtc

SEQ ID NO: 320046 - DNA, 25 bp, Mus musculus
caggctggttgtcgttggattttct

SEQ ID NO: 320047 - DNA, 25 bp, Mus musculus
caggctggttgtggttggattttct

SEQ ID NO: 320048 - DNA, 25 bp, Mus musculus
caggctgtatctcgaccggacaaga

SEQ ID NO: 320049 - DNA, 25 bp, Mus musculus
caggctgtatctggaccggacaaga

SEQ ID NO: 320050 - DNA, 25 bp, Mus musculus
caggctgtatgtctgtcaccttaag

SEQ ID NO: 320051 - DNA, 25 bp, Mus musculus
caggctgtatgtgtgtcaccttaag

SEQ ID NO: 320052 - DNA, 25 bp, Mus musculus
caggctgtcacacgcaagcgagcac

SEQ ID NO: 320053 - DNA, 25 bp, Mus musculus
caggctgtcacaggcaagcgagcac

SEQ ID NO: 320054 - DNA, 25 bp, Mus musculus
caggctgtcacccagtgtatttcta

SEQ ID NO: 320055 - DNA, 25 bp, Mus musculus
caggctgtcaccgagtgtatttcta

SEQ ID NO: 320056 - DNA, 25 bp, Mus musculus
caggctgtcagtccatagcccattg

SEQ ID NO: 320057 - DNA, 25 bp, Mus musculus
caggctgtcagtgcatagcccattg

SEQ ID NO: 320058 - DNA, 25 bp, Mus musculus
caggctgtcattactttgttgtgtt

SEQ ID NO: 320059 - DNA, 25 bp, Mus musculus
caggctgtcatttctttgttgtgtt

SEQ ID NO: 320060 - DNA, 25 bp, Mus musculus
caggctgtcgaacataagcccaggg

SEQ ID NO: 320061 - DNA, 25 bp, Mus musculus
caggctgtcgaagataagcccaggg

SEQ ID NO: 320062 - DNA, 25 bp, Mus musculus
caggctgtctctacagtggtgaaaa

SEQ ID NO: 320063 - DNA, 25 bp, Mus musculus
caggctgtctcttcagtggtgaaaa

SEQ ID NO: 320064 - DNA, 25 bp, Mus musculus
caggctgtgactattccatggatat

SEQ ID NO: 320065 - DNA, 25 bp, Mus musculus
caggctgtgacttttccatggatat

SEQ ID NO: 320066 - DNA, 25 bp, Mus musculus
caggctgtggaacggcatatccttc

SEQ ID NO: 320067 - DNA, 25 bp, Mus musculus
caggctgtggaagggcatatccttc

SEQ ID NO: 320068 - DNA, 25 bp, Mus musculus
caggctgtgtcactttcttcaagca

SEQ ID NO: 320069 - DNA, 25 bp, Mus musculus
caggctgtgtcagtttcttcaagca

SEQ ID NO: 320070 - DNA, 25 bp, Mus musculus
caggctgtgtggaggatcttctatt

SEQ ID NO: 320071 - DNA, 25 bp, Mus musculus
caggctgtgtggtggatcttctatt

SEQ ID NO: 320072 - DNA, 25 bp, Mus musculus
caggctgttatgagtcctgtgacat

SEQ ID NO: 320073 - DNA, 25 bp, Mus musculus
caggctgttatgtgtcctgtgacat

SEQ ID NO: 320074 - DNA, 25 bp, Mus musculus
caggctgttcccagtatgcaaacaa

SEQ ID NO: 320075 - DNA, 25 bp, Mus musculus
caggctgttccctgtatgcaaacaa

SEQ ID NO: 320076 - DNA, 25 bp, Mus musculus
caggctgttgacatttgaatccatg

SEQ ID NO: 320077 - DNA, 25 bp, Mus musculus
caggctgttgacttttgaatccatg

SEQ ID NO: 320078 - DNA, 25 bp, Mus musculus
caggctgtttcgatgtcttttcatg

SEQ ID NO: 320079 - DNA, 25 bp, Mus musculus
caggctgtttcgttgtcttttcatg

SEQ ID NO: 320080 - DNA, 25 bp, Mus musculus
caggcttaaaccagcaagaggtctt

SEQ ID NO: 320081 - DNA, 25 bp, Mus musculus
caggcttaaacctgcaagaggtctt

SEQ ID NO: 320082 - DNA, 25 bp, Mus musculus
caggcttagaatcagtgacagtgta

SEQ ID NO: 320083 - DNA, 25 bp, Mus musculus
caggcttagaatgagtgacagtgta

SEQ ID NO: 320084 - DNA, 25 bp, Mus musculus
caggcttagattcctctagtaagag

SEQ ID NO: 320085 - DNA, 25 bp, Mus musculus
caggcttagattgctctagtaagag

SEQ ID NO: 320086 - DNA, 25 bp, Mus musculus
caggcttagctcattggatgtgtcc

SEQ ID NO: 320087 - DNA, 25 bp, Mus musculus
caggcttagctctttggatgtgtcc

SEQ ID NO: 320088 - DNA, 25 bp, Mus musculus
caggcttaggctacgggtccagatc

SEQ ID NO: 320089 - DNA, 25 bp, Mus musculus
caggcttaggcttcgggtccagatc

SEQ ID NO: 320090 - DNA, 25 bp, Mus musculus
caggcttaggttctgtccctagaga

SEQ ID NO: 320091 - DNA, 25 bp, Mus musculus
caggcttaggttgtgtccctagaga

SEQ ID NO: 320092 - DNA, 25 bp, Mus musculus
caggcttataagacctttccctcct

SEQ ID NO: 320093 - DNA, 25 bp, Mus musculus
caggcttataagtcctttccctcct

SEQ ID NO: 320094 - DNA, 25 bp, Mus musculus
caggcttatcagcaacacaggaatt

SEQ ID NO: 320095 - DNA, 25 bp, Mus musculus
caggcttatcaggaacacaggaatt

SEQ ID NO: 320096 - DNA, 25 bp, Mus musculus
caggcttatcatccatcccttttaa

SEQ ID NO: 320097 - DNA, 25 bp, Mus musculus
caggcttatcatgcatcccttttaa

SEQ ID NO: 320098 - DNA, 25 bp, Mus musculus
caggcttattgcatttacagttctt

SEQ ID NO: 320099 - DNA, 25 bp, Mus musculus
caggcttattgcttttacagttctt

SEQ ID NO: 320100 - DNA, 25 bp, Mus musculus
caggcttcacaaaattgtacacaaa

SEQ ID NO: 320101 - DNA, 25 bp, Mus musculus
caggcttcacaatattgtacacaaa

SEQ ID NO: 320102 - DNA, 25 bp, Mus musculus
caggcttcagttacctgaatgctag

SEQ ID NO: 320103 - DNA, 25 bp, Mus musculus
caggcttcagtttcctgaatgctag

SEQ ID NO: 320104 - DNA, 25 bp, Mus musculus
caggcttcataaacgaggttgttgt

SEQ ID NO: 320105 - DNA, 25 bp, Mus musculus
caggcttcataatcgaggttgttgt

SEQ ID NO: 320106 - DNA, 25 bp, Mus musculus
caggcttccaacagccatcataatg

SEQ ID NO: 320107 - DNA, 25 bp, Mus musculus
caggcttccaactgccatcataatg

SEQ ID NO: 320108 - DNA, 25 bp, Mus musculus
caggcttcccccagcattggtggca

SEQ ID NO: 320109 - DNA, 25 bp, Mus musculus
caggcttccccctgcattggtggca

SEQ ID NO: 320110 - DNA, 25 bp, Mus musculus
caggcttccgtcactctgagaaaca

SEQ ID NO: 320111 - DNA, 25 bp, Mus musculus
caggcttccgtctctctgagaaaca

SEQ ID NO: 320112 - DNA, 25 bp, Mus musculus
caggcttccgttatcttagatcatc

SEQ ID NO: 320113 - DNA, 25 bp, Mus musculus
caggcttccgttttcttagatcatc

SEQ ID NO: 320114 - DNA, 25 bp, Mus musculus
caggcttcctgaatgttaaccacgg

SEQ ID NO: 320115 - DNA, 25 bp, Mus musculus
caggcttcctgattgttaaccacgg

SEQ ID NO: 320116 - DNA, 25 bp, Mus musculus
caggcttcctgcagtagtatttgtg

SEQ ID NO: 320117 - DNA, 25 bp, Mus musculus
caggcttcctgctgtagtatttgtg

SEQ ID NO: 320118 - DNA, 25 bp, Mus musculus
caggcttctacaacctacagtggaa

SEQ ID NO: 320119 - DNA, 25 bp, Mus musculus
caggcttctacatcctacagtggaa

SEQ ID NO: 320120 - DNA, 25 bp, Mus musculus
caggcttctcctcgcaagatggctt

SEQ ID NO: 320121 - DNA, 25 bp, Mus musculus
caggcttctcctggcaagatggctt

SEQ ID NO: 320122 - DNA, 25 bp, Mus musculus
caggcttctggcagttccgggaaat

SEQ ID NO: 320123 - DNA, 25 bp, Mus musculus
caggcttctggctgttccgggaaat

SEQ ID NO: 320124 - DNA, 25 bp, Mus musculus
caggcttctggtattggccagtgag

SEQ ID NO: 320125 - DNA, 25 bp, Mus musculus
caggcttctggttttggccagtgag

SEQ ID NO: 320126 - DNA, 25 bp, Mus musculus
caggcttctgtactgctcttaatca

SEQ ID NO: 320127 - DNA, 25 bp, Mus musculus
caggcttctgtagtgctcttaatca

SEQ ID NO: 320128 - DNA, 25 bp, Mus musculus
caggcttgacttagttgccactaag

SEQ ID NO: 320129 - DNA, 25 bp, Mus musculus
caggcttgactttgttgccactaag

SEQ ID NO: 320130 - DNA, 25 bp, Mus musculus
caggcttgagaccagtcagcatcat

SEQ ID NO: 320131 - DNA, 25 bp, Mus musculus
caggcttgagacgagtcagcatcat

SEQ ID NO: 320132 - DNA, 25 bp, Mus musculus
caggcttgccacagtcttaatgaag

SEQ ID NO: 320133 - DNA, 25 bp, Mus musculus
caggcttgccactgtcttaatgaag

SEQ ID NO: 320134 - DNA, 25 bp, Mus musculus
caggcttggatccacatgggttcaa

SEQ ID NO: 320135 - DNA, 25 bp, Mus musculus
caggcttggatcgacatgggttcaa

SEQ ID NO: 320136 - DNA, 25 bp, Mus musculus
caggcttggcaccattacgaccata

SEQ ID NO: 320137 - DNA, 25 bp, Mus musculus
caggcttggcacgattacgaccata

SEQ ID NO: 320138 - DNA, 25 bp, Mus musculus
caggcttggcctcagtctgaaaagt

SEQ ID NO: 320139 - DNA, 25 bp, Mus musculus
caggcttggcctcattcggcgaata

SEQ ID NO: 320140 - DNA, 25 bp, Mus musculus
caggcttggcctgagtctgaaaagt

SEQ ID NO: 320141 - DNA, 25 bp, Mus musculus
caggcttggcctgattcggcgaata

SEQ ID NO: 320142 - DNA, 25 bp, Mus musculus
caggcttgggccactctactaggag

SEQ ID NO: 320143 - DNA, 25 bp, Mus musculus
caggcttgggcctctctactaggag

SEQ ID NO: 320144 - DNA, 25 bp, Mus musculus
caggcttgggtcaggaatgccacct

SEQ ID NO: 320145 - DNA, 25 bp, Mus musculus
caggcttgggtctggaatgccacct

SEQ ID NO: 320146 - DNA, 25 bp, Mus musculus
caggcttggtttagcagctgtgcaa

SEQ ID NO: 320147 - DNA, 25 bp, Mus musculus
caggcttggttttgcagctgtgcaa

SEQ ID NO: 320148 - DNA, 25 bp, Mus musculus
caggcttgtcctcttaggaccgaaa

SEQ ID NO: 320149 - DNA, 25 bp, Mus musculus
caggcttgtcctgttaggaccgaaa

SEQ ID NO: 320150 - DNA, 25 bp, Mus musculus
caggcttgtgttctaactttgcttt

SEQ ID NO: 320151 - DNA, 25 bp, Mus musculus
caggcttgtgttgtaactttgcttt

SEQ ID NO: 320152 - DNA, 25 bp, Mus musculus
caggctttagacaatctgcagcaaa

SEQ ID NO: 320153 - DNA, 25 bp, Mus musculus
caggctttagactatctgcagcaaa

SEQ ID NO: 320154 - DNA, 25 bp, Mus musculus
caggctttatagattgggagggcct

SEQ ID NO: 320155 - DNA, 25 bp, Mus musculus
caggctttatagtttgggagggcct

SEQ ID NO: 320156 - DNA, 25 bp, Mus musculus
caggctttatgcattccacgtgaat

SEQ ID NO: 320157 - DNA, 25 bp, Mus musculus
caggctttatgctttccacgtgaat

SEQ ID NO: 320158 - DNA, 25 bp, Mus musculus
caggctttcagtatgattggggaca

SEQ ID NO: 320159 - DNA, 25 bp, Mus musculus
caggctttcagtttgattggggaca

SEQ ID NO: 320160 - DNA, 25 bp, Mus musculus
caggctttcctcagttgaggtaata

SEQ ID NO: 320161 - DNA, 25 bp, Mus musculus
caggctttcctctgttgaggtaata

SEQ ID NO: 320162 - DNA, 25 bp, Mus musculus
caggctttcctgacaagaccgtaac

SEQ ID NO: 320163 - DNA, 25 bp, Mus musculus
caggctttcctgtcaagaccgtaac

SEQ ID NO: 320164 - DNA, 25 bp, Mus musculus
caggctttccttaacctagtgaatg

SEQ ID NO: 320165 - DNA, 25 bp, Mus musculus
caggctttcctttacctagtgaatg

SEQ ID NO: 320166 - DNA, 25 bp, Mus musculus
caggctttcggtcctgtgctgtaca

SEQ ID NO: 320167 - DNA, 25 bp, Mus musculus
caggctttcggtgctgtgctgtaca

SEQ ID NO: 320168 - DNA, 25 bp, Mus musculus
caggctttgagtagctggccacatc

SEQ ID NO: 320169 - DNA, 25 bp, Mus musculus
caggctttgagttgctggccacatc

SEQ ID NO: 320170 - DNA, 25 bp, Mus musculus
caggctttggcccattgtgactttt

SEQ ID NO: 320171 - DNA, 25 bp, Mus musculus
caggctttggccgattgtgactttt

SEQ ID NO: 320172 - DNA, 25 bp, Mus musculus
caggctttgtgtctagttcacttac

SEQ ID NO: 320173 - DNA, 25 bp, Mus musculus
caggctttgtgtgtagttcacttac

SEQ ID NO: 320174 - DNA, 25 bp, Mus musculus
caggctttgttacgcacccaggtaa

SEQ ID NO: 320175 - DNA, 25 bp, Mus musculus
caggctttgttaggcacccaggtaa

SEQ ID NO: 320176 - DNA, 25 bp, Mus musculus
caggctttgttgaggcagcgcttgt

SEQ ID NO: 320177 - DNA, 25 bp, Mus musculus
caggctttgttgctatgaccccgcc

SEQ ID NO: 320178 - DNA, 25 bp, Mus musculus
caggctttgttggtatgaccccgcc

SEQ ID NO: 320179 - DNA, 25 bp, Mus musculus
caggctttgttgtggcagcgcttgt

SEQ ID NO: 320180 - DNA, 25 bp, Mus musculus
caggcttttaaacctagcattcggg

SEQ ID NO: 320181 - DNA, 25 bp, Mus musculus
caggcttttaaagctagcattcggg

SEQ ID NO: 320182 - DNA, 25 bp, Mus musculus
caggcttttggcacaccgagtagaa

SEQ ID NO: 320183 - DNA, 25 bp, Mus musculus
caggcttttggctcaccgagtagaa

SEQ ID NO: 320184 - DNA, 25 bp, Mus musculus
cagggaaacagacaagtctccctta

SEQ ID NO: 320185 - DNA, 25 bp, Mus musculus
cagggaaacagagaagtctccctta

SEQ ID NO: 320186 - DNA, 25 bp, Mus musculus
cagggaaagcacacttgagtgactt

SEQ ID NO: 320187 - DNA, 25 bp, Mus musculus
cagggaaagcactcttgagtgactt

SEQ ID NO: 320188 - DNA, 25 bp, Mus musculus
cagggaaagcctccagattgttact

SEQ ID NO: 320189 - DNA, 25 bp, Mus musculus
cagggaaagcctgcagattgttact

SEQ ID NO: 320190 - DNA, 25 bp, Mus musculus
cagggaaagctgcatagggacattt

SEQ ID NO: 320191 - DNA, 25 bp, Mus musculus
cagggaaagctggatagggacattt

SEQ ID NO: 320192 - DNA, 25 bp, Mus musculus
cagggaaaggtgaaccagcctgcct

SEQ ID NO: 320193 - DNA, 25 bp, Mus musculus
cagggaaaggtgtaccagcctgcct

SEQ ID NO: 320194 - DNA, 25 bp, Mus musculus
cagggaaatagcaatacaaagtgtc

SEQ ID NO: 320195 - DNA, 25 bp, Mus musculus
cagggaaatagctatacaaagtgtc

SEQ ID NO: 320196 - DNA, 25 bp, Mus musculus
cagggaaatgacactctagggttat

SEQ ID NO: 320197 - DNA, 25 bp, Mus musculus
cagggaaatgactctctagggttat

SEQ ID NO: 320198 - DNA, 25 bp, Mus musculus
cagggaaatgttattcactgccctt

SEQ ID NO: 320199 - DNA, 25 bp, Mus musculus
cagggaaatgtttttcactgccctt

SEQ ID NO: 320200 - DNA, 25 bp, Mus musculus
cagggaacaacgagcactgtgccaa

SEQ ID NO: 320201 - DNA, 25 bp, Mus musculus
cagggaacaacgtgcactgtgccaa

SEQ ID NO: 320202 - DNA, 25 bp, Mus musculus
cagggaacaactcgctgtgggttta

SEQ ID NO: 320203 - DNA, 25 bp, Mus musculus
cagggaacaactggctgtgggttta

SEQ ID NO: 320204 - DNA, 25 bp, Mus musculus
cagggaacagttataggagatgctc

SEQ ID NO: 320205 - DNA, 25 bp, Mus musculus
cagggaacagttttaggagatgctc

SEQ ID NO: 320206 - DNA, 25 bp, Mus musculus
cagggaacatgtagagctctgatca

SEQ ID NO: 320207 - DNA, 25 bp, Mus musculus
cagggaacatgttgagctctgatca

SEQ ID NO: 320208 - DNA, 25 bp, Mus musculus
cagggaacattaatcctcctgatgt

SEQ ID NO: 320209 - DNA, 25 bp, Mus musculus
cagggaacattattcctcctgatgt

SEQ ID NO: 320210 - DNA, 25 bp, Mus musculus
cagggaaccggacttgagccactct

SEQ ID NO: 320211 - DNA, 25 bp, Mus musculus
cagggaaccggagttgagccactct

SEQ ID NO: 320212 - DNA, 25 bp, Mus musculus
cagggaacctcaccagtagtatgtg

SEQ ID NO: 320213 - DNA, 25 bp, Mus musculus
cagggaacctcagcagtagtatgtg

SEQ ID NO: 320214 - DNA, 25 bp, Mus musculus
cagggaacctccactagagctgaaa

SEQ ID NO: 320215 - DNA, 25 bp, Mus musculus
cagggaacctcctctagagctgaaa

SEQ ID NO: 320216 - DNA, 25 bp, Mus musculus
cagggaactcccactggaatagaat

SEQ ID NO: 320217 - DNA, 25 bp, Mus musculus
cagggaactccctctggaatagaat

SEQ ID NO: 320218 - DNA, 25 bp, Mus musculus
cagggaactgagatcctgggttctg

SEQ ID NO: 320219 - DNA, 25 bp, Mus musculus
cagggaactgagttcctgggttctg

SEQ ID NO: 320220 - DNA, 25 bp, Mus musculus
cagggaagacttcattaacacaggt

SEQ ID NO: 320221 - DNA, 25 bp, Mus musculus
cagggaagacttgattaacacaggt

SEQ ID NO: 320222 - DNA, 25 bp, Mus musculus
cagggaagagccaattcagccaggt

SEQ ID NO: 320223 - DNA, 25 bp, Mus musculus
cagggaagagcctattcagccaggt

SEQ ID NO: 320224 - DNA, 25 bp, Mus musculus
cagggaagagtgaaggtgtgttctc

SEQ ID NO: 320225 - DNA, 25 bp, Mus musculus
cagggaagagtgtaggtgtgttctc

SEQ ID NO: 320226 - DNA, 25 bp, Mus musculus
cagggaagcatcagagaggctagca

SEQ ID NO: 320227 - DNA, 25 bp, Mus musculus
cagggaagcatcctactcgggataa

SEQ ID NO: 320228 - DNA, 25 bp, Mus musculus
cagggaagcatcgtactcgggataa

SEQ ID NO: 320229 - DNA, 25 bp, Mus musculus
cagggaagcatctgagaggctagca

SEQ ID NO: 320230 - DNA, 25 bp, Mus musculus
cagggaagcattcttgagtcctcta

SEQ ID NO: 320231 - DNA, 25 bp, Mus musculus
cagggaagcattgttgagtcctcta

SEQ ID NO: 320232 - DNA, 25 bp, Mus musculus
cagggaagccaacgtccatcgggtt

SEQ ID NO: 320233 - DNA, 25 bp, Mus musculus
cagggaagccaaggtccatcgggtt

SEQ ID NO: 320234 - DNA, 25 bp, Mus musculus
cagggaagcctgatcctgggaccca

SEQ ID NO: 320235 - DNA, 25 bp, Mus musculus
cagggaagcctgttcctgggaccca

SEQ ID NO: 320236 - DNA, 25 bp, Mus musculus
cagggaagcgctcaattaccttgaa

SEQ ID NO: 320237 - DNA, 25 bp, Mus musculus
cagggaagcgctgaattaccttgaa

SEQ ID NO: 320238 - DNA, 25 bp, Mus musculus
cagggaaggcgaaaacattgtacat

SEQ ID NO: 320239 - DNA, 25 bp, Mus musculus
cagggaaggcgataacattgtacat

SEQ ID NO: 320240 - DNA, 25 bp, Mus musculus
cagggaagtgtgattctagtgtaac

SEQ ID NO: 320241 - DNA, 25 bp, Mus musculus
cagggaagtgtgtttctagtgtaac

SEQ ID NO: 320242 - DNA, 25 bp, Mus musculus
cagggaataatcagctaacaagagt

SEQ ID NO: 320243 - DNA, 25 bp, Mus musculus
cagggaataatctgctaacaagagt

SEQ ID NO: 320244 - DNA, 25 bp, Mus musculus
cagggaatactgaagtaggctccaa

SEQ ID NO: 320245 - DNA, 25 bp, Mus musculus
cagggaatactgtagtaggctccaa

SEQ ID NO: 320246 - DNA, 25 bp, Mus musculus
cagggaatatgaagcttcttctgac

SEQ ID NO: 320247 - DNA, 25 bp, Mus musculus
cagggaatatgatgcttcttctgac

SEQ ID NO: 320248 - DNA, 25 bp, Mus musculus
cagggaatcctcatggtatatgata

SEQ ID NO: 320249 - DNA, 25 bp, Mus musculus
cagggaatcctcttggtatatgata

SEQ ID NO: 320250 - DNA, 25 bp, Mus musculus
cagggaattcatattccctttaagg

SEQ ID NO: 320251 - DNA, 25 bp, Mus musculus
cagggaattcattttccctttaagg

SEQ ID NO: 320252 - DNA, 25 bp, Mus musculus
cagggacaaggcagaaattttagaa

SEQ ID NO: 320253 - DNA, 25 bp, Mus musculus
cagggacaaggctgaaattttagaa

SEQ ID NO: 320254 - DNA, 25 bp, Mus musculus
cagggacacagacgaccagaaccgt

SEQ ID NO: 320255 - DNA, 25 bp, Mus musculus
cagggacacagaggaccagaaccgt

SEQ ID NO: 320256 - DNA, 25 bp, Mus musculus
cagggacacggaatggaccacggac

SEQ ID NO: 320257 - DNA, 25 bp, Mus musculus
cagggacacggattggaccacggac

SEQ ID NO: 320258 - DNA, 25 bp, Mus musculus
cagggacagaaacaacaagggactt

SEQ ID NO: 320259 - DNA, 25 bp, Mus musculus
cagggacagaaagaacaagggactt

SEQ ID NO: 320260 - DNA, 25 bp, Mus musculus
cagggacagcataggttgccaggca

SEQ ID NO: 320261 - DNA, 25 bp, Mus musculus
cagggacagcattggttgccaggca

SEQ ID NO: 320262 - DNA, 25 bp, Mus musculus
cagggacaggcaaacaagttcagat

SEQ ID NO: 320263 - DNA, 25 bp, Mus musculus
cagggacaggcatacaagttcagat

SEQ ID NO: 320264 - DNA, 25 bp, Mus musculus
cagggacatcccagagtaggtttta

SEQ ID NO: 320265 - DNA, 25 bp, Mus musculus
cagggacatccctgagtaggtttta

SEQ ID NO: 320266 - DNA, 25 bp, Mus musculus
cagggacatggaatcagctgccttt

SEQ ID NO: 320267 - DNA, 25 bp, Mus musculus
cagggacatggattcagctgccttt

SEQ ID NO: 320268 - DNA, 25 bp, Mus musculus
cagggacattgccttcagttcaagg

SEQ ID NO: 320269 - DNA, 25 bp, Mus musculus
cagggacattgcgttcagttcaagg

SEQ ID NO: 320270 - DNA, 25 bp, Mus musculus
cagggacattgtccctgaagctctt

SEQ ID NO: 320271 - DNA, 25 bp, Mus musculus
cagggacattgtgcctgaagctctt

SEQ ID NO: 320272 - DNA, 25 bp, Mus musculus
cagggacatttgaactccactgttt

SEQ ID NO: 320273 - DNA, 25 bp, Mus musculus
cagggacatttgtactccactgttt

SEQ ID NO: 320274 - DNA, 25 bp, Mus musculus
cagggaccaagcctgagaccgacct

SEQ ID NO: 320275 - DNA, 25 bp, Mus musculus
cagggaccaagcgtgagaccgacct

SEQ ID NO: 320276 - DNA, 25 bp, Mus musculus
cagggaccacctctggcggaagcac

SEQ ID NO: 320277 - DNA, 25 bp, Mus musculus
cagggaccacctgtggcggaagcac

SEQ ID NO: 320278 - DNA, 25 bp, Mus musculus
cagggaccagtgattgacaggcgct

SEQ ID NO: 320279 - DNA, 25 bp, Mus musculus
cagggaccagtgtttgacaggcgct

SEQ ID NO: 320280 - DNA, 25 bp, Mus musculus
cagggaccatccatttttgtaacat

SEQ ID NO: 320281 - DNA, 25 bp, Mus musculus
cagggaccatccttttttgtaacat

SEQ ID NO: 320282 - DNA, 25 bp, Mus musculus
cagggaccattgaaatgaacttatt

SEQ ID NO: 320283 - DNA, 25 bp, Mus musculus
cagggaccattgatgctcacgagat

SEQ ID NO: 320284 - DNA, 25 bp, Mus musculus
cagggaccattgtaatgaacttatt

SEQ ID NO: 320285 - DNA, 25 bp, Mus musculus
cagggaccattgttgctcacgagat

SEQ ID NO: 320286 - DNA, 25 bp, Mus musculus
cagggacccaaaacaagtaacatgg

SEQ ID NO: 320287 - DNA, 25 bp, Mus musculus
cagggacccaaatcaagtaacatgg

SEQ ID NO: 320288 - DNA, 25 bp, Mus musculus
cagggacccatcaataaatttcagt

SEQ ID NO: 320289 - DNA, 25 bp, Mus musculus
cagggacccatctataaatttcagt

SEQ ID NO: 320290 - DNA, 25 bp, Mus musculus
cagggacccgcaaccattttaatgg

SEQ ID NO: 320291 - DNA, 25 bp, Mus musculus
cagggacccgcatccattttaatgg

SEQ ID NO: 320292 - DNA, 25 bp, Mus musculus
cagggaccgcccatcaggtggagcc

SEQ ID NO: 320293 - DNA, 25 bp, Mus musculus
cagggaccgcccttcaggtggagcc

SEQ ID NO: 320294 - DNA, 25 bp, Mus musculus
cagggaccttgcaggtgtagtcttt

SEQ ID NO: 320295 - DNA, 25 bp, Mus musculus
cagggaccttgctggtgtagtcttt

SEQ ID NO: 320296 - DNA, 25 bp, Mus musculus
cagggacgggtcacagctcaaagtt

SEQ ID NO: 320297 - DNA, 25 bp, Mus musculus
cagggacgggtctcagctcaaagtt

SEQ ID NO: 320298 - DNA, 25 bp, Mus musculus
cagggacgtggcaggccccacgttt

SEQ ID NO: 320299 - DNA, 25 bp, Mus musculus
cagggacgtggctggccccacgttt

SEQ ID NO: 320300 - DNA, 25 bp, Mus musculus
cagggacgttatctgactgcactca

SEQ ID NO: 320301 - DNA, 25 bp, Mus musculus
cagggacgttatgtgactgcactca

SEQ ID NO: 320302 - DNA, 25 bp, Mus musculus
cagggactcaacctcttgcgtggta

SEQ ID NO: 320303 - DNA, 25 bp, Mus musculus
cagggactcaacgtcttgcgtggta

SEQ ID NO: 320304 - DNA, 25 bp, Mus musculus
cagggactcacaactgaatccgttt

SEQ ID NO: 320305 - DNA, 25 bp, Mus musculus
cagggactcacatctgaatccgttt

SEQ ID NO: 320306 - DNA, 25 bp, Mus musculus
cagggactccagactaatgctccta

SEQ ID NO: 320307 - DNA, 25 bp, Mus musculus
cagggactccagtctaatgctccta

SEQ ID NO: 320308 - DNA, 25 bp, Mus musculus
cagggactcccacgtgggaactgct

SEQ ID NO: 320309 - DNA, 25 bp, Mus musculus
cagggactcccactgcagaagcagc

SEQ ID NO: 320310 - DNA, 25 bp, Mus musculus
cagggactcccaggtgggaactgct

SEQ ID NO: 320311 - DNA, 25 bp, Mus musculus
cagggactcccagtgcagaagcagc

SEQ ID NO: 320312 - DNA, 25 bp, Mus musculus
cagggactcctgcatcttgagtagt

SEQ ID NO: 320313 - DNA, 25 bp, Mus musculus
cagggactcctggatcttgagtagt

SEQ ID NO: 320314 - DNA, 25 bp, Mus musculus
cagggactgagcatgcactgtgtgt

SEQ ID NO: 320315 - DNA, 25 bp, Mus musculus
cagggactgagcttgcactgtgtgt

SEQ ID NO: 320316 - DNA, 25 bp, Mus musculus
cagggactgatactttgtgcctgtg

SEQ ID NO: 320317 - DNA, 25 bp, Mus musculus
cagggactgatagtttgtgcctgtg

SEQ ID NO: 320318 - DNA, 25 bp, Mus musculus
cagggactgcctcagttataaagaa

SEQ ID NO: 320319 - DNA, 25 bp, Mus musculus
cagggactgcctgagttataaagaa

SEQ ID NO: 320320 - DNA, 25 bp, Mus musculus
cagggactggacacgaagctagaac

SEQ ID NO: 320321 - DNA, 25 bp, Mus musculus
cagggactggactcgaagctagaac

SEQ ID NO: 320322 - DNA, 25 bp, Mus musculus
cagggactgggcaagcacagcttac

SEQ ID NO: 320323 - DNA, 25 bp, Mus musculus
cagggactgggcaattcctagtgag

SEQ ID NO: 320324 - DNA, 25 bp, Mus musculus
cagggactgggctagcacagcttac

SEQ ID NO: 320325 - DNA, 25 bp, Mus musculus
cagggactgggctattcctagtgag

SEQ ID NO: 320326 - DNA, 25 bp, Mus musculus
cagggacttaggattatctcgttat

SEQ ID NO: 320327 - DNA, 25 bp, Mus musculus
cagggacttaggtttatctcgttat

SEQ ID NO: 320328 - DNA, 25 bp, Mus musculus
cagggacttcaaaagtagctattgt

SEQ ID NO: 320329 - DNA, 25 bp, Mus musculus
cagggacttcaaccctgcaaggact

SEQ ID NO: 320330 - DNA, 25 bp, Mus musculus
cagggacttcaagcctgcaaggact

SEQ ID NO: 320331 - DNA, 25 bp, Mus musculus
cagggacttcaatagtagctattgt

SEQ ID NO: 320332 - DNA, 25 bp, Mus musculus
cagggacttctaagtggtgggcaca

SEQ ID NO: 320333 - DNA, 25 bp, Mus musculus
cagggacttctaatgccaggactat

SEQ ID NO: 320334 - DNA, 25 bp, Mus musculus
cagggacttctatgtggtgggcaca

SEQ ID NO: 320335 - DNA, 25 bp, Mus musculus
cagggacttctattgccaggactat

SEQ ID NO: 320336 - DNA, 25 bp, Mus musculus
cagggacttctgaggacctggaagt

SEQ ID NO: 320337 - DNA, 25 bp, Mus musculus
cagggacttctgcaggcttgtgcaa

SEQ ID NO: 320338 - DNA, 25 bp, Mus musculus
cagggacttctggaggcttgtgcaa

SEQ ID NO: 320339 - DNA, 25 bp, Mus musculus
cagggacttctgtggacctggaagt

SEQ ID NO: 320340 - DNA, 25 bp, Mus musculus
cagggacttgctatgttgtataggc

SEQ ID NO: 320341 - DNA, 25 bp, Mus musculus
cagggacttgctcatgtggcccata

SEQ ID NO: 320342 - DNA, 25 bp, Mus musculus
cagggacttgctgatgtggcccata

SEQ ID NO: 320343 - DNA, 25 bp, Mus musculus
cagggacttgctttgttgtataggc

SEQ ID NO: 320344 - DNA, 25 bp, Mus musculus
cagggacttggcactgaggcgtctc

SEQ ID NO: 320345 - DNA, 25 bp, Mus musculus
cagggacttggctctgaggcgtctc

SEQ ID NO: 320346 - DNA, 25 bp, Mus musculus
cagggacttgtacaattgagctaca

SEQ ID NO: 320347 - DNA, 25 bp, Mus musculus
cagggacttgtagaattgagctaca

SEQ ID NO: 320348 - DNA, 25 bp, Mus musculus
cagggagacggaagccaaaagccta

SEQ ID NO: 320349 - DNA, 25 bp, Mus musculus
cagggagacggatgccaaaagccta

SEQ ID NO: 320350 - DNA, 25 bp, Mus musculus
cagggagactacatgggaggcacca

SEQ ID NO: 320351 - DNA, 25 bp, Mus musculus
cagggagactacttgggaggcacca

SEQ ID NO: 320352 - DNA, 25 bp, Mus musculus
cagggagaggtactggtttccataa

SEQ ID NO: 320353 - DNA, 25 bp, Mus musculus
cagggagaggtagtggtttccataa

SEQ ID NO: 320354 - DNA, 25 bp, Mus musculus
cagggagagttcactgccagagtga

SEQ ID NO: 320355 - DNA, 25 bp, Mus musculus
cagggagagttctctgccagagtga

SEQ ID NO: 320356 - DNA, 25 bp, Mus musculus
cagggagatggtatagtcattctaa

SEQ ID NO: 320357 - DNA, 25 bp, Mus musculus
cagggagatggtttagtcattctaa

SEQ ID NO: 320358 - DNA, 25 bp, Mus musculus
cagggagcacatcattgacacgttt

SEQ ID NO: 320359 - DNA, 25 bp, Mus musculus
cagggagcacatgattgacacgttt

SEQ ID NO: 320360 - DNA, 25 bp, Mus musculus
cagggagcacgaccagtcatcttct

SEQ ID NO: 320361 - DNA, 25 bp, Mus musculus
cagggagcacgagcagtcatcttct

SEQ ID NO: 320362 - DNA, 25 bp, Mus musculus
cagggagcagcaactagctcccggg

SEQ ID NO: 320363 - DNA, 25 bp, Mus musculus
cagggagcagcatctagctcccggg

SEQ ID NO: 320364 - DNA, 25 bp, Mus musculus
cagggagcagctctcaagtcttcca

SEQ ID NO: 320365 - DNA, 25 bp, Mus musculus
cagggagcagctgtcaagtcttcca

SEQ ID NO: 320366 - DNA, 25 bp, Mus musculus
cagggagcatcaaccatccatctct

SEQ ID NO: 320367 - DNA, 25 bp, Mus musculus
cagggagcatcatccatccatctct

SEQ ID NO: 320368 - DNA, 25 bp, Mus musculus
cagggagcatggactcttggtatct

SEQ ID NO: 320369 - DNA, 25 bp, Mus musculus
cagggagcatggtctcttggtatct

SEQ ID NO: 320370 - DNA, 25 bp, Mus musculus
cagggagccacccatgcctttgtct

SEQ ID NO: 320371 - DNA, 25 bp, Mus musculus
cagggagccaccgatgcctttgtct

SEQ ID NO: 320372 - DNA, 25 bp, Mus musculus
cagggagccattcgaaaccagtgag

SEQ ID NO: 320373 - DNA, 25 bp, Mus musculus
cagggagccattggaaaccagtgag

SEQ ID NO: 320374 - DNA, 25 bp, Mus musculus
cagggagccctacgatcagagcact

SEQ ID NO: 320375 - DNA, 25 bp, Mus musculus
cagggagccctaggatcagagcact

SEQ ID NO: 320376 - DNA, 25 bp, Mus musculus
cagggagcctacactgagctctgag

SEQ ID NO: 320377 - DNA, 25 bp, Mus musculus
cagggagcctactctgagctctgag

SEQ ID NO: 320378 - DNA, 25 bp, Mus musculus
cagggagcctgcaatttcagttaca

SEQ ID NO: 320379 - DNA, 25 bp, Mus musculus
cagggagcctgctatttcagttaca

SEQ ID NO: 320380 - DNA, 25 bp, Mus musculus
cagggagcgaggaccacacaggcct

SEQ ID NO: 320381 - DNA, 25 bp, Mus musculus
cagggagcgaggtccacacaggcct

SEQ ID NO: 320382 - DNA, 25 bp, Mus musculus
cagggagctctacgagtactggcta

SEQ ID NO: 320383 - DNA, 25 bp, Mus musculus
cagggagctctaggagtactggcta

SEQ ID NO: 320384 - DNA, 25 bp, Mus musculus
cagggagcttggagctggaacacaa

SEQ ID NO: 320385 - DNA, 25 bp, Mus musculus
cagggagcttggtgctggaacacaa

SEQ ID NO: 320386 - DNA, 25 bp, Mus musculus
cagggaggacaaacaacacctaccg

SEQ ID NO: 320387 - DNA, 25 bp, Mus musculus
cagggaggacaatcaacacctaccg

SEQ ID NO: 320388 - DNA, 25 bp, Mus musculus
cagggaggtttcaagtccctctcta

SEQ ID NO: 320389 - DNA, 25 bp, Mus musculus
cagggaggtttctagtccctctcta

SEQ ID NO: 320390 - DNA, 25 bp, Mus musculus
cagggagtcatccagaccctaggat

SEQ ID NO: 320391 - DNA, 25 bp, Mus musculus
cagggagtcatcgagaccctaggat

SEQ ID NO: 320392 - DNA, 25 bp, Mus musculus
cagggagtgagtctgacctctttca

SEQ ID NO: 320393 - DNA, 25 bp, Mus musculus
cagggagtgagtgtgacctctttca

SEQ ID NO: 320394 - DNA, 25 bp, Mus musculus
cagggagtgcccaaggaagcaatca

SEQ ID NO: 320395 - DNA, 25 bp, Mus musculus
cagggagtgccctaggaagcaatca

SEQ ID NO: 320396 - DNA, 25 bp, Mus musculus
cagggagtttagacatcagttggga

SEQ ID NO: 320397 - DNA, 25 bp, Mus musculus
cagggagtttagtcatcagttggga

SEQ ID NO: 320398 - DNA, 25 bp, Mus musculus
cagggatactggacttgacgacaca

SEQ ID NO: 320399 - DNA, 25 bp, Mus musculus
cagggatactggtcttgacgacaca

SEQ ID NO: 320400 - DNA, 25 bp, Mus musculus
cagggatagcttagtgttctcaaat

SEQ ID NO: 320401 - DNA, 25 bp, Mus musculus
cagggatagcttcccagcccaattt

SEQ ID NO: 320402 - DNA, 25 bp, Mus musculus
cagggatagcttgccagcccaattt

SEQ ID NO: 320403 - DNA, 25 bp, Mus musculus
cagggatagctttgtgttctcaaat

SEQ ID NO: 320404 - DNA, 25 bp, Mus musculus
cagggatagtccactctggaagcac

SEQ ID NO: 320405 - DNA, 25 bp, Mus musculus
cagggatagtcctctctggaagcac

SEQ ID NO: 320406 - DNA, 25 bp, Mus musculus
cagggatatacacatcttctcccac

SEQ ID NO: 320407 - DNA, 25 bp, Mus musculus
cagggatatacagatcttctcccac

SEQ ID NO: 320408 - DNA, 25 bp, Mus musculus
cagggatatagcacacttatggtga

SEQ ID NO: 320409 - DNA, 25 bp, Mus musculus
cagggatatagctcacttatggtga

SEQ ID NO: 320410 - DNA, 25 bp, Mus musculus
cagggatcagaaaagatggtacagt

SEQ ID NO: 320411 - DNA, 25 bp, Mus musculus
cagggatcagaatagatggtacagt

SEQ ID NO: 320412 - DNA, 25 bp, Mus musculus
cagggatcaggcagtgagacgacat

SEQ ID NO: 320413 - DNA, 25 bp, Mus musculus
cagggatcaggctgtgagacgacat

SEQ ID NO: 320414 - DNA, 25 bp, Mus musculus
cagggatcaggtcttgctgttcgaa

SEQ ID NO: 320415 - DNA, 25 bp, Mus musculus
cagggatcaggtgttgctgttcgaa

SEQ ID NO: 320416 - DNA, 25 bp, Mus musculus
cagggatccacaagactattggctt

SEQ ID NO: 320417 - DNA, 25 bp, Mus musculus
cagggatccacatgactattggctt

SEQ ID NO: 320418 - DNA, 25 bp, Mus musculus
cagggatccactacttaatcctaaa

SEQ ID NO: 320419 - DNA, 25 bp, Mus musculus
cagggatccacttcttaatcctaaa

SEQ ID NO: 320420 - DNA, 25 bp, Mus musculus
cagggatcggccaggattaccatgc

SEQ ID NO: 320421 - DNA, 25 bp, Mus musculus
cagggatcggcctggattaccatgc

SEQ ID NO: 320422 - DNA, 25 bp, Mus musculus
cagggatctacgcactgcccgggaa

SEQ ID NO: 320423 - DNA, 25 bp, Mus musculus
cagggatctacggactgcccgggaa

SEQ ID NO: 320424 - DNA, 25 bp, Mus musculus
cagggatctaggacaaactgcttca

SEQ ID NO: 320425 - DNA, 25 bp, Mus musculus
cagggatctaggtcaaactgcttca

SEQ ID NO: 320426 - DNA, 25 bp, Mus musculus
cagggatctctcatcaaaaggtttc

SEQ ID NO: 320427 - DNA, 25 bp, Mus musculus
cagggatctctcttcaaaaggtttc

SEQ ID NO: 320428 - DNA, 25 bp, Mus musculus
cagggatctgcaagctgctgtacca

SEQ ID NO: 320429 - DNA, 25 bp, Mus musculus
cagggatctgcatgctgctgtacca

SEQ ID NO: 320430 - DNA, 25 bp, Mus musculus
cagggatgacccctttgctgggcct

SEQ ID NO: 320431 - DNA, 25 bp, Mus musculus
cagggatgacccgtttgctgggcct

SEQ ID NO: 320432 - DNA, 25 bp, Mus musculus
cagggatgatctattgagcatttta

SEQ ID NO: 320433 - DNA, 25 bp, Mus musculus
cagggatgatcttttgagcatttta

SEQ ID NO: 320434 - DNA, 25 bp, Mus musculus
cagggatgcaccacctcttttgtaa

SEQ ID NO: 320435 - DNA, 25 bp, Mus musculus
cagggatgcacctcctcttttgtaa

SEQ ID NO: 320436 - DNA, 25 bp, Mus musculus
cagggatgcatcatatctcttctct

SEQ ID NO: 320437 - DNA, 25 bp, Mus musculus
cagggatgcatcttatctcttctct

SEQ ID NO: 320438 - DNA, 25 bp, Mus musculus
cagggatgcctgcactcaacgaaat

SEQ ID NO: 320439 - DNA, 25 bp, Mus musculus
cagggatgcctggactcaacgaaat

SEQ ID NO: 320440 - DNA, 25 bp, Mus musculus
cagggatgctgtctaaatcgtatca

SEQ ID NO: 320441 - DNA, 25 bp, Mus musculus
cagggatgctgtgtaaatcgtatca

SEQ ID NO: 320442 - DNA, 25 bp, Mus musculus
cagggatggcctatacacactatgc

SEQ ID NO: 320443 - DNA, 25 bp, Mus musculus
cagggatggcctttacacactatgc

SEQ ID NO: 320444 - DNA, 25 bp, Mus musculus
cagggatggtgcaagatgtgtctct

SEQ ID NO: 320445 - DNA, 25 bp, Mus musculus
cagggatggtgctagatgtgtctct

SEQ ID NO: 320446 - DNA, 25 bp, Mus musculus
cagggattaaacactattattagca

SEQ ID NO: 320447 - DNA, 25 bp, Mus musculus
cagggattaaactctattattagca

SEQ ID NO: 320448 - DNA, 25 bp, Mus musculus
cagggattagtcacacttggtggga

SEQ ID NO: 320449 - DNA, 25 bp, Mus musculus
cagggattagtctcacttggtggga

SEQ ID NO: 320450 - DNA, 25 bp, Mus musculus
cagggattccatctctgctgaggat

SEQ ID NO: 320451 - DNA, 25 bp, Mus musculus
cagggattccatgtctgctgaggat

SEQ ID NO: 320452 - DNA, 25 bp, Mus musculus
cagggattcctcaggtcagctggat

SEQ ID NO: 320453 - DNA, 25 bp, Mus musculus
cagggattcctctggtcagctggat

SEQ ID NO: 320454 - DNA, 25 bp, Mus musculus
cagggattctgcaggtgcactgaag

SEQ ID NO: 320455 - DNA, 25 bp, Mus musculus
cagggattctgctggtgcactgaag

SEQ ID NO: 320456 - DNA, 25 bp, Mus musculus
cagggattctgtctttcattgagga

SEQ ID NO: 320457 - DNA, 25 bp, Mus musculus
cagggattctgtgtttcattgagga

SEQ ID NO: 320458 - DNA, 25 bp, Mus musculus
cagggattgaaaattgtcttctaca

SEQ ID NO: 320459 - DNA, 25 bp, Mus musculus
cagggattgaaatttgtcttctaca

SEQ ID NO: 320460 - DNA, 25 bp, Mus musculus
cagggatttgtaattctgtagtatt

SEQ ID NO: 320461 - DNA, 25 bp, Mus musculus
cagggatttgtatttctgtagtatt

SEQ ID NO: 320462 - DNA, 25 bp, Mus musculus
cagggatttgtgcattccttgcgcc

SEQ ID NO: 320463 - DNA, 25 bp, Mus musculus
cagggatttgtggattccttgcgcc

SEQ ID NO: 320464 - DNA, 25 bp, Mus musculus
cagggattttgcagggcgcttccag

SEQ ID NO: 320465 - DNA, 25 bp, Mus musculus
cagggattttgctgggcgcttccag

SEQ ID NO: 320466 - DNA, 25 bp, Mus musculus
cagggattttttcttgccatcatat

SEQ ID NO: 320467 - DNA, 25 bp, Mus musculus
cagggattttttgttgccatcatat

SEQ ID NO: 320468 - DNA, 25 bp, Mus musculus
cagggcaaaacaaggcctccaatgt

SEQ ID NO: 320469 - DNA, 25 bp, Mus musculus
cagggcaaaacatggcctccaatgt

SEQ ID NO: 320470 - DNA, 25 bp, Mus musculus
cagggcaaatgcagtcctttctcta

SEQ ID NO: 320471 - DNA, 25 bp, Mus musculus
cagggcaaatgctgtcctttctcta

SEQ ID NO: 320472 - DNA, 25 bp, Mus musculus
cagggcaacacactcaaactgtcaa

SEQ ID NO: 320473 - DNA, 25 bp, Mus musculus
cagggcaacacagtcaaactgtcaa

SEQ ID NO: 320474 - DNA, 25 bp, Mus musculus
cagggcaactgcattaggagtcgtt

SEQ ID NO: 320475 - DNA, 25 bp, Mus musculus
cagggcaactgctttaggagtcgtt

SEQ ID NO: 320476 - DNA, 25 bp, Mus musculus
cagggcaagaaaagccccttctcct

SEQ ID NO: 320477 - DNA, 25 bp, Mus musculus
cagggcaagaaatgccccttctcct

SEQ ID NO: 320478 - DNA, 25 bp, Mus musculus
cagggcaagcacctctgagcatata

SEQ ID NO: 320479 - DNA, 25 bp, Mus musculus
cagggcaagcacgtctgagcatata

SEQ ID NO: 320480 - DNA, 25 bp, Mus musculus
cagggcaagctcatagcacatgttt

SEQ ID NO: 320481 - DNA, 25 bp, Mus musculus
cagggcaagctcttagcacatgttt

SEQ ID NO: 320482 - DNA, 25 bp, Mus musculus
cagggcaaggccctttattttatct

SEQ ID NO: 320483 - DNA, 25 bp, Mus musculus
cagggcaaggccgtttattttatct

SEQ ID NO: 320484 - DNA, 25 bp, Mus musculus
cagggcaaggtgagatattggttta

SEQ ID NO: 320485 - DNA, 25 bp, Mus musculus
cagggcaaggtgtgatattggttta

SEQ ID NO: 320486 - DNA, 25 bp, Mus musculus
cagggcaagtctcctgggagtctta

SEQ ID NO: 320487 - DNA, 25 bp, Mus musculus
cagggcaagtctgctgggagtctta

SEQ ID NO: 320488 - DNA, 25 bp, Mus musculus
cagggcacaggtaagagtcatgcta

SEQ ID NO: 320489 - DNA, 25 bp, Mus musculus
cagggcacaggttagagtcatgcta

SEQ ID NO: 320490 - DNA, 25 bp, Mus musculus
cagggcacagttaagtgtcccgtta

SEQ ID NO: 320491 - DNA, 25 bp, Mus musculus
cagggcacagtttagtgtcccgtta

SEQ ID NO: 320492 - DNA, 25 bp, Mus musculus
cagggcacatagaacattgctatcc

SEQ ID NO: 320493 - DNA, 25 bp, Mus musculus
cagggcacatagtacattgctatcc

SEQ ID NO: 320494 - DNA, 25 bp, Mus musculus
cagggcaccatccaaaggctttgtg

SEQ ID NO: 320495 - DNA, 25 bp, Mus musculus
cagggcaccatcgaaaggctttgtg

SEQ ID NO: 320496 - DNA, 25 bp, Mus musculus
cagggcacccgacctacacaatgag

SEQ ID NO: 320497 - DNA, 25 bp, Mus musculus
cagggcacccgagctacacaatgag

SEQ ID NO: 320498 - DNA, 25 bp, Mus musculus
cagggcaccgagcattagctactga

SEQ ID NO: 320499 - DNA, 25 bp, Mus musculus
cagggcaccgaggattagctactga

SEQ ID NO: 320500 - DNA, 25 bp, Mus musculus
cagggcacctccctgagtttgatct

SEQ ID NO: 320501 - DNA, 25 bp, Mus musculus
cagggcacctccgtgagtttgatct

SEQ ID NO: 320502 - DNA, 25 bp, Mus musculus
cagggcacgtggctcttgagtttca

SEQ ID NO: 320503 - DNA, 25 bp, Mus musculus
cagggcacgtgggtcttgagtttca

SEQ ID NO: 320504 - DNA, 25 bp, Mus musculus
cagggcacttgacaagtccttctta

SEQ ID NO: 320505 - DNA, 25 bp, Mus musculus
cagggcacttgagaagtccttctta

SEQ ID NO: 320506 - DNA, 25 bp, Mus musculus
cagggcagagctaggactcaccagt

SEQ ID NO: 320507 - DNA, 25 bp, Mus musculus
cagggcagagcttggactcaccagt

SEQ ID NO: 320508 - DNA, 25 bp, Mus musculus
cagggcagagtcctcattgctgagt

SEQ ID NO: 320509 - DNA, 25 bp, Mus musculus
cagggcagagtcgtcattgctgagt

SEQ ID NO: 320510 - DNA, 25 bp, Mus musculus
cagggcagatgaacaagccttctta

SEQ ID NO: 320511 - DNA, 25 bp, Mus musculus
cagggcagatgatcaagccttctta

SEQ ID NO: 320512 - DNA, 25 bp, Mus musculus
cagggcagatgcacaggcagaaagc

SEQ ID NO: 320513 - DNA, 25 bp, Mus musculus
cagggcagatgctcaggcagaaagc

SEQ ID NO: 320514 - DNA, 25 bp, Mus musculus
cagggcagcaggacccagttctggt

SEQ ID NO: 320515 - DNA, 25 bp, Mus musculus
cagggcagcaggtcccagttctggt

SEQ ID NO: 320516 - DNA, 25 bp, Mus musculus
cagggcagccaaagaagcctggaca

SEQ ID NO: 320517 - DNA, 25 bp, Mus musculus
cagggcagccaatgaagcctggaca

SEQ ID NO: 320518 - DNA, 25 bp, Mus musculus
cagggcagccacatcagaagacaga

SEQ ID NO: 320519 - DNA, 25 bp, Mus musculus
cagggcagccacttcagaagacaga

SEQ ID NO: 320520 - DNA, 25 bp, Mus musculus
cagggcagcctgattgtctaaagtc

SEQ ID NO: 320521 - DNA, 25 bp, Mus musculus
cagggcagcctgtttgtctaaagtc

SEQ ID NO: 320522 - DNA, 25 bp, Mus musculus
cagggcagctcaatttcaggtttat

SEQ ID NO: 320523 - DNA, 25 bp, Mus musculus
cagggcagctcattttcaggtttat

SEQ ID NO: 320524 - DNA, 25 bp, Mus musculus
cagggcagctccagtatattccaga

SEQ ID NO: 320525 - DNA, 25 bp, Mus musculus
cagggcagctcctgtatattccaga

SEQ ID NO: 320526 - DNA, 25 bp, Mus musculus
cagggcaggcacacagggtagaaac

SEQ ID NO: 320527 - DNA, 25 bp, Mus musculus
cagggcaggcactcagggtagaaac

SEQ ID NO: 320528 - DNA, 25 bp, Mus musculus
cagggcaggcagagtgcgcttaact

SEQ ID NO: 320529 - DNA, 25 bp, Mus musculus
cagggcaggcagtgtgcgcttaact

SEQ ID NO: 320530 - DNA, 25 bp, Mus musculus
cagggcagggctcctttaacaggca

SEQ ID NO: 320531 - DNA, 25 bp, Mus musculus
cagggcagggctgctttaacaggca

SEQ ID NO: 320532 - DNA, 25 bp, Mus musculus
cagggcaggtaccacttccttggga

SEQ ID NO: 320533 - DNA, 25 bp, Mus musculus
cagggcaggtacgacttccttggga

SEQ ID NO: 320534 - DNA, 25 bp, Mus musculus
cagggcaggtgtagcttactgagaa

SEQ ID NO: 320535 - DNA, 25 bp, Mus musculus
cagggcaggtgttgcttactgagaa

SEQ ID NO: 320536 - DNA, 25 bp, Mus musculus
cagggcagtgaaagtagtatgttgt

SEQ ID NO: 320537 - DNA, 25 bp, Mus musculus
cagggcagtgaatgtagtatgttgt

SEQ ID NO: 320538 - DNA, 25 bp, Mus musculus
cagggcagtgacaccaaatggctaa

SEQ ID NO: 320539 - DNA, 25 bp, Mus musculus
cagggcagtgactccaaatggctaa

SEQ ID NO: 320540 - DNA, 25 bp, Mus musculus
cagggcagtttgacaaccttgatgt

SEQ ID NO: 320541 - DNA, 25 bp, Mus musculus
cagggcagtttgtcaaccttgatgt

SEQ ID NO: 320542 - DNA, 25 bp, Mus musculus
cagggcataccaagggattctattt

SEQ ID NO: 320543 - DNA, 25 bp, Mus musculus
cagggcataccatgggattctattt

SEQ ID NO: 320544 - DNA, 25 bp, Mus musculus
cagggcatacctcggtttgccagta

SEQ ID NO: 320545 - DNA, 25 bp, Mus musculus
cagggcatacctgggtttgccagta

SEQ ID NO: 320546 - DNA, 25 bp, Mus musculus
cagggcatatttacctgctaaaatt

SEQ ID NO: 320547 - DNA, 25 bp, Mus musculus
cagggcatattttcctgctaaaatt

SEQ ID NO: 320548 - DNA, 25 bp, Mus musculus
cagggcattctaaatgtcagtcttt

SEQ ID NO: 320549 - DNA, 25 bp, Mus musculus
cagggcattctatatgtcagtcttt

SEQ ID NO: 320550 - DNA, 25 bp, Mus musculus
cagggcatttggagtgttgtaagct

SEQ ID NO: 320551 - DNA, 25 bp, Mus musculus
cagggcatttggtgtgttgtaagct

SEQ ID NO: 320552 - DNA, 25 bp, Mus musculus
cagggcattttaaccctccctgctt

SEQ ID NO: 320553 - DNA, 25 bp, Mus musculus
cagggcattttatccctccctgctt

SEQ ID NO: 320554 - DNA, 25 bp, Mus musculus
cagggccaaacaaacattccatact

SEQ ID NO: 320555 - DNA, 25 bp, Mus musculus
cagggccaaacatacattccatact

SEQ ID NO: 320556 - DNA, 25 bp, Mus musculus
cagggccaacaaccctagactagaa

SEQ ID NO: 320557 - DNA, 25 bp, Mus musculus
cagggccaacaagcctagactagaa

SEQ ID NO: 320558 - DNA, 25 bp, Mus musculus
cagggccaactgacagtcagtgctg

SEQ ID NO: 320559 - DNA, 25 bp, Mus musculus
cagggccaactgtcagtcagtgctg

SEQ ID NO: 320560 - DNA, 25 bp, Mus musculus
cagggccacaatagccatgggcagc

SEQ ID NO: 320561 - DNA, 25 bp, Mus musculus
cagggccacaattgccatgggcagc

SEQ ID NO: 320562 - DNA, 25 bp, Mus musculus
cagggccacatgcttgtgctctaga

SEQ ID NO: 320563 - DNA, 25 bp, Mus musculus
cagggccacatggttgtgctctaga

SEQ ID NO: 320564 - DNA, 25 bp, Mus musculus
cagggccacattcctccatttgttg

SEQ ID NO: 320565 - DNA, 25 bp, Mus musculus
cagggccacattgctccatttgttg

SEQ ID NO: 320566 - DNA, 25 bp, Mus musculus
cagggccaccgaacagacaagcaga

SEQ ID NO: 320567 - DNA, 25 bp, Mus musculus
cagggccaccgatcagacaagcaga

SEQ ID NO: 320568 - DNA, 25 bp, Mus musculus
cagggccacggactcgcgacaactt

SEQ ID NO: 320569 - DNA, 25 bp, Mus musculus
cagggccacggagtcgcgacaactt

SEQ ID NO: 320570 - DNA, 25 bp, Mus musculus
cagggccactgaaagcagtgcccaa

SEQ ID NO: 320571 - DNA, 25 bp, Mus musculus
cagggccactgatagcagtgcccaa

SEQ ID NO: 320572 - DNA, 25 bp, Mus musculus
cagggccactggactgtctggaaac

SEQ ID NO: 320573 - DNA, 25 bp, Mus musculus
cagggccactggtctgtctggaaac

SEQ ID NO: 320574 - DNA, 25 bp, Mus musculus
cagggccagactctgccaaaatgca

SEQ ID NO: 320575 - DNA, 25 bp, Mus musculus
cagggccagactgtgccaaaatgca

SEQ ID NO: 320576 - DNA, 25 bp, Mus musculus
cagggccagatgagctccttggaaa

SEQ ID NO: 320577 - DNA, 25 bp, Mus musculus
cagggccagatgtgctccttggaaa

SEQ ID NO: 320578 - DNA, 25 bp, Mus musculus
cagggccagccactgatagtgatgc

SEQ ID NO: 320579 - DNA, 25 bp, Mus musculus
cagggccagccagtgatagtgatgc

SEQ ID NO: 320580 - DNA, 25 bp, Mus musculus
cagggccagcctatcttatatatag

SEQ ID NO: 320581 - DNA, 25 bp, Mus musculus
cagggccagcctttcttatatatag

SEQ ID NO: 320582 - DNA, 25 bp, Mus musculus
cagggccaggccagtaaatcagggc

SEQ ID NO: 320583 - DNA, 25 bp, Mus musculus
cagggccaggcctgtaaatcagggc

SEQ ID NO: 320584 - DNA, 25 bp, Mus musculus
cagggccagtcacaatgctcagata

SEQ ID NO: 320585 - DNA, 25 bp, Mus musculus
cagggccagtcagaatgctcagata

SEQ ID NO: 320586 - DNA, 25 bp, Mus musculus
cagggccagtgcacagtgatctcag

SEQ ID NO: 320587 - DNA, 25 bp, Mus musculus
cagggccagtgctcagtgatctcag

SEQ ID NO: 320588 - DNA, 25 bp, Mus musculus
cagggccatcctcgtgatttaggat

SEQ ID NO: 320589 - DNA, 25 bp, Mus musculus
cagggccatcctggtgatttaggat

SEQ ID NO: 320590 - DNA, 25 bp, Mus musculus
cagggccatgtcaatccagtgttaa

SEQ ID NO: 320591 - DNA, 25 bp, Mus musculus
cagggccatgtctatccagtgttaa

SEQ ID NO: 320592 - DNA, 25 bp, Mus musculus
cagggccccaggaatgcgatgaagt

SEQ ID NO: 320593 - DNA, 25 bp, Mus musculus
cagggccccaggtatgcgatgaagt

SEQ ID NO: 320594 - DNA, 25 bp, Mus musculus
cagggcccgaacacgagcaatgcat

SEQ ID NO: 320595 - DNA, 25 bp, Mus musculus
cagggcccgaactcgagcaatgcat

SEQ ID NO: 320596 - DNA, 25 bp, Mus musculus
cagggccctgagaaccaaataagcc

SEQ ID NO: 320597 - DNA, 25 bp, Mus musculus
cagggccctgagtaccaaataagcc

SEQ ID NO: 320598 - DNA, 25 bp, Mus musculus
cagggccctgtgagttgagatcatg

SEQ ID NO: 320599 - DNA, 25 bp, Mus musculus
cagggccctgtgtgttgagatcatg

SEQ ID NO: 320600 - DNA, 25 bp, Mus musculus
cagggccgatcgcagcacagctgaa

SEQ ID NO: 320601 - DNA, 25 bp, Mus musculus
cagggccgatcggagcacagctgaa

SEQ ID NO: 320602 - DNA, 25 bp, Mus musculus
cagggccgcggaacctgcagagtct

SEQ ID NO: 320603 - DNA, 25 bp, Mus musculus
cagggccgcggatcctgcagagtct

SEQ ID NO: 320604 - DNA, 25 bp, Mus musculus
cagggccggtgcatgtatgaactca

SEQ ID NO: 320605 - DNA, 25 bp, Mus musculus
cagggccggtgcttgtatgaactca

SEQ ID NO: 320606 - DNA, 25 bp, Mus musculus
cagggcctacttaccttccattttg

SEQ ID NO: 320607 - DNA, 25 bp, Mus musculus
cagggcctactttccttccattttg

SEQ ID NO: 320608 - DNA, 25 bp, Mus musculus
cagggcctattgctgcatgagctgc

SEQ ID NO: 320609 - DNA, 25 bp, Mus musculus
cagggcctattggtgcatgagctgc

SEQ ID NO: 320610 - DNA, 25 bp, Mus musculus
cagggcctcacaagtgctcggcaag

SEQ ID NO: 320611 - DNA, 25 bp, Mus musculus
cagggcctcacatgtgctcggcaag

SEQ ID NO: 320612 - DNA, 25 bp, Mus musculus
cagggcctcagtagttaatttgact

SEQ ID NO: 320613 - DNA, 25 bp, Mus musculus
cagggcctcagttgttaatttgact

SEQ ID NO: 320614 - DNA, 25 bp, Mus musculus
cagggcctcctaccaggatcttaga

SEQ ID NO: 320615 - DNA, 25 bp, Mus musculus
cagggcctcctagcaggatcttaga

SEQ ID NO: 320616 - DNA, 25 bp, Mus musculus
cagggcctcgtaaacccaaggatat

SEQ ID NO: 320617 - DNA, 25 bp, Mus musculus
cagggcctcgtatacccaaggatat

SEQ ID NO: 320618 - DNA, 25 bp, Mus musculus
cagggcctcttaaatctcgacagaa

SEQ ID NO: 320619 - DNA, 25 bp, Mus musculus
cagggcctcttaagcctttggtaaa

SEQ ID NO: 320620 - DNA, 25 bp, Mus musculus
cagggcctcttatatctcgacagaa

SEQ ID NO: 320621 - DNA, 25 bp, Mus musculus
cagggcctcttatgcctttggtaaa

SEQ ID NO: 320622 - DNA, 25 bp, Mus musculus
cagggcctgaacacaatcgcagaga

SEQ ID NO: 320623 - DNA, 25 bp, Mus musculus
cagggcctgaactcaatcgcagaga

SEQ ID NO: 320624 - DNA, 25 bp, Mus musculus
cagggcctgagacctacgtggctca

SEQ ID NO: 320625 - DNA, 25 bp, Mus musculus
cagggcctgagagctacgtggctca

SEQ ID NO: 320626 - DNA, 25 bp, Mus musculus
cagggcctgcaactctgtggacaga

SEQ ID NO: 320627 - DNA, 25 bp, Mus musculus
cagggcctgcaagtctgtggacaga

SEQ ID NO: 320628 - DNA, 25 bp, Mus musculus
cagggcctgcagaacgagtagatga

SEQ ID NO: 320629 - DNA, 25 bp, Mus musculus
cagggcctgcagtacgagtagatga

SEQ ID NO: 320630 - DNA, 25 bp, Mus musculus
cagggcctgccaaagtctactaaaa

SEQ ID NO: 320631 - DNA, 25 bp, Mus musculus
cagggcctgccatagtctactaaaa

SEQ ID NO: 320632 - DNA, 25 bp, Mus musculus
cagggcctgcctagggacactaaaa

SEQ ID NO: 320633 - DNA, 25 bp, Mus musculus
cagggcctgccttgggacactaaaa

SEQ ID NO: 320634 - DNA, 25 bp, Mus musculus
cagggcctgctcatgggacaggaaa

SEQ ID NO: 320635 - DNA, 25 bp, Mus musculus
cagggcctgctcttgggacaggaaa

SEQ ID NO: 320636 - DNA, 25 bp, Mus musculus
cagggcctggaaatgatcctttcaa

SEQ ID NO: 320637 - DNA, 25 bp, Mus musculus
cagggcctggaattgatcctttcaa

SEQ ID NO: 320638 - DNA, 25 bp, Mus musculus
cagggcctggtcatcagagtgctgt

SEQ ID NO: 320639 - DNA, 25 bp, Mus musculus
cagggcctggtcttcagagtgctgt

SEQ ID NO: 320640 - DNA, 25 bp, Mus musculus
cagggccttaacatcatattgcctt

SEQ ID NO: 320641 - DNA, 25 bp, Mus musculus
cagggccttaacttcatattgcctt

SEQ ID NO: 320642 - DNA, 25 bp, Mus musculus
cagggccttcagcaccagatcaggt

SEQ ID NO: 320643 - DNA, 25 bp, Mus musculus
cagggccttcaggaccagatcaggt

SEQ ID NO: 320644 - DNA, 25 bp, Mus musculus
cagggccttcgtcccatccgggaag

SEQ ID NO: 320645 - DNA, 25 bp, Mus musculus
cagggccttcgtgccatccgggaag

SEQ ID NO: 320646 - DNA, 25 bp, Mus musculus
cagggccttggtcttattcagtgaa

SEQ ID NO: 320647 - DNA, 25 bp, Mus musculus
cagggccttggtgttattcagtgaa

SEQ ID NO: 320648 - DNA, 25 bp, Mus musculus
cagggcgaaattccaactatcttag

SEQ ID NO: 320649 - DNA, 25 bp, Mus musculus
cagggcgaaattgcaactatcttag

SEQ ID NO: 320650 - DNA, 25 bp, Mus musculus
cagggcgatcggatggaggagcagc

SEQ ID NO: 320651 - DNA, 25 bp, Mus musculus
cagggcgatcggttggaggagcagc

SEQ ID NO: 320652 - DNA, 25 bp, Mus musculus
cagggcgccttgaatatgctagaca

SEQ ID NO: 320653 - DNA, 25 bp, Mus musculus
cagggcgccttgtatatgctagaca

SEQ ID NO: 320654 - DNA, 25 bp, Mus musculus
cagggcggattcaggatgaagttca

SEQ ID NO: 320655 - DNA, 25 bp, Mus musculus
cagggcggattctggatgaagttca

SEQ ID NO: 320656 - DNA, 25 bp, Mus musculus
cagggcggggtgatgaggttataaa

SEQ ID NO: 320657 - DNA, 25 bp, Mus musculus
cagggcggggtgttgaggttataaa

SEQ ID NO: 320658 - DNA, 25 bp, Mus musculus
cagggcggtcagcacaaatttgtat

SEQ ID NO: 320659 - DNA, 25 bp, Mus musculus
cagggcggtcaggacaaatttgtat

SEQ ID NO: 320660 - DNA, 25 bp, Mus musculus
cagggcgtatctattttagcttgaa

SEQ ID NO: 320661 - DNA, 25 bp, Mus musculus
cagggcgtatcttttttagcttgaa

SEQ ID NO: 320662 - DNA, 25 bp, Mus musculus
cagggcgtgtgacatggacaccgtc

SEQ ID NO: 320663 - DNA, 25 bp, Mus musculus
cagggcgtgtgagatggacaccgtc

SEQ ID NO: 320664 - DNA, 25 bp, Mus musculus
cagggcgttaaactagctcatttca

SEQ ID NO: 320665 - DNA, 25 bp, Mus musculus
cagggcgttaaagtagctcatttca

SEQ ID NO: 320666 - DNA, 25 bp, Mus musculus
cagggctacggactaagatgctgtc

SEQ ID NO: 320667 - DNA, 25 bp, Mus musculus
cagggctacggagtaagatgctgtc

SEQ ID NO: 320668 - DNA, 25 bp, Mus musculus
cagggctacggcaaatactggtaac

SEQ ID NO: 320669 - DNA, 25 bp, Mus musculus
cagggctacggctaatactggtaac

SEQ ID NO: 320670 - DNA, 25 bp, Mus musculus
cagggctagcccacagtagctgcag

SEQ ID NO: 320671 - DNA, 25 bp, Mus musculus
cagggctagccctcagtagctgcag

SEQ ID NO: 320672 - DNA, 25 bp, Mus musculus
cagggctagcgactttgctctcatt

SEQ ID NO: 320673 - DNA, 25 bp, Mus musculus
cagggctagcgagtttgctctcatt

SEQ ID NO: 320674 - DNA, 25 bp, Mus musculus
cagggctagggaagccccttacatt

SEQ ID NO: 320675 - DNA, 25 bp, Mus musculus
cagggctagggatgccccttacatt

SEQ ID NO: 320676 - DNA, 25 bp, Mus musculus
cagggctagggtcgaccatgccaaa

SEQ ID NO: 320677 - DNA, 25 bp, Mus musculus
cagggctagggtggaccatgccaaa

SEQ ID NO: 320678 - DNA, 25 bp, Mus musculus
cagggctagtaccagttccttaagc

SEQ ID NO: 320679 - DNA, 25 bp, Mus musculus
cagggctagtacgagttccttaagc

SEQ ID NO: 320680 - DNA, 25 bp, Mus musculus
cagggctagtggctatctttccatt

SEQ ID NO: 320681 - DNA, 25 bp, Mus musculus
cagggctagtgggtatctttccatt

SEQ ID NO: 320682 - DNA, 25 bp, Mus musculus
cagggctcaagcaagaagatcacaa

SEQ ID NO: 320683 - DNA, 25 bp, Mus musculus
cagggctcaagctagaagatcacaa

SEQ ID NO: 320684 - DNA, 25 bp, Mus musculus
cagggctcaaggatattaatggtgt

SEQ ID NO: 320685 - DNA, 25 bp, Mus musculus
cagggctcaaggttattaatggtgt

SEQ ID NO: 320686 - DNA, 25 bp, Mus musculus
cagggctcacacacagagatccacc

SEQ ID NO: 320687 - DNA, 25 bp, Mus musculus
cagggctcacactcagagatccacc

SEQ ID NO: 320688 - DNA, 25 bp, Mus musculus
cagggctcagagacccgtagggaaa

SEQ ID NO: 320689 - DNA, 25 bp, Mus musculus
cagggctcagagtcccgtagggaaa

SEQ ID NO: 320690 - DNA, 25 bp, Mus musculus
cagggctcaggactgctctgaaaca

SEQ ID NO: 320691 - DNA, 25 bp, Mus musculus
cagggctcaggagtgctctgaaaca

SEQ ID NO: 320692 - DNA, 25 bp, Mus musculus
cagggctcattcagaacggtgagta

SEQ ID NO: 320693 - DNA, 25 bp, Mus musculus
cagggctcattctgaacggtgagta

SEQ ID NO: 320694 - DNA, 25 bp, Mus musculus
cagggctccctcataagttactgga

SEQ ID NO: 320695 - DNA, 25 bp, Mus musculus
cagggctccctcttaagttactgga

SEQ ID NO: 320696 - DNA, 25 bp, Mus musculus
cagggctccctgacttggatagaga

SEQ ID NO: 320697 - DNA, 25 bp, Mus musculus
cagggctccctgagacaggcaagta

SEQ ID NO: 320698 - DNA, 25 bp, Mus musculus
cagggctccctgtcttggatagaga

SEQ ID NO: 320699 - DNA, 25 bp, Mus musculus
cagggctccctgtgacaggcaagta

SEQ ID NO: 320700 - DNA, 25 bp, Mus musculus
cagggctcctgcagtgactcagagt

SEQ ID NO: 320701 - DNA, 25 bp, Mus musculus
cagggctcctgctgtgactcagagt

SEQ ID NO: 320702 - DNA, 25 bp, Mus musculus
cagggctcgggcagttgcttccagc

SEQ ID NO: 320703 - DNA, 25 bp, Mus musculus
cagggctcgggctgttgcttccagc

SEQ ID NO: 320704 - DNA, 25 bp, Mus musculus
cagggctctaccatgggctaaatcc

SEQ ID NO: 320705 - DNA, 25 bp, Mus musculus
cagggctctaccttgggctaaatcc

SEQ ID NO: 320706 - DNA, 25 bp, Mus musculus
cagggctctactaggattgcacaat

SEQ ID NO: 320707 - DNA, 25 bp, Mus musculus
cagggctctacttggattgcacaat

SEQ ID NO: 320708 - DNA, 25 bp, Mus musculus
cagggctctgcgaatgcaagcatca

SEQ ID NO: 320709 - DNA, 25 bp, Mus musculus
cagggctctgcgtatgcaagcatca

SEQ ID NO: 320710 - DNA, 25 bp, Mus musculus
cagggctcttggaatggaacaggat

SEQ ID NO: 320711 - DNA, 25 bp, Mus musculus
cagggctcttggtatggaacaggat

SEQ ID NO: 320712 - DNA, 25 bp, Mus musculus
cagggctgacgcagggttgttccac

SEQ ID NO: 320713 - DNA, 25 bp, Mus musculus
cagggctgacgctgggttgttccac

SEQ ID NO: 320714 - DNA, 25 bp, Mus musculus
cagggctgcaggaggagttcatcaa

SEQ ID NO: 320715 - DNA, 25 bp, Mus musculus
cagggctgcaggtggagttcatcaa

SEQ ID NO: 320716 - DNA, 25 bp, Mus musculus
cagggctgctgtcctaatacaaagc

SEQ ID NO: 320717 - DNA, 25 bp, Mus musculus
cagggctgctgtgctaatacaaagc

SEQ ID NO: 320718 - DNA, 25 bp, Mus musculus
cagggctgcttgatcatcgacaaaa

SEQ ID NO: 320719 - DNA, 25 bp, Mus musculus
cagggctgcttgttcatcgacaaaa

SEQ ID NO: 320720 - DNA, 25 bp, Mus musculus
cagggctggagcacagtattcctat

SEQ ID NO: 320721 - DNA, 25 bp, Mus musculus
cagggctggagctcagtattcctat

SEQ ID NO: 320722 - DNA, 25 bp, Mus musculus
cagggctggattagcctcagctaca

SEQ ID NO: 320723 - DNA, 25 bp, Mus musculus
cagggctggatttgcctcagctaca

SEQ ID NO: 320724 - DNA, 25 bp, Mus musculus
cagggctggcagcattctccaggct

SEQ ID NO: 320725 - DNA, 25 bp, Mus musculus
cagggctggcaggattctccaggct

SEQ ID NO: 320726 - DNA, 25 bp, Mus musculus
cagggctggttcagttcatatccaa

SEQ ID NO: 320727 - DNA, 25 bp, Mus musculus
cagggctggttctgttcatatccaa

SEQ ID NO: 320728 - DNA, 25 bp, Mus musculus
cagggctgtctacatgtttcgcatg

SEQ ID NO: 320729 - DNA, 25 bp, Mus musculus
cagggctgtctagatgtttcgcatg

SEQ ID NO: 320730 - DNA, 25 bp, Mus musculus
cagggcttaccacttgtacggcacc

SEQ ID NO: 320731 - DNA, 25 bp, Mus musculus
cagggcttaccagttgtacggcacc

SEQ ID NO: 320732 - DNA, 25 bp, Mus musculus
cagggcttagagatgatgcagccgc

SEQ ID NO: 320733 - DNA, 25 bp, Mus musculus
cagggcttagagttgatgcagccgc

SEQ ID NO: 320734 - DNA, 25 bp, Mus musculus
cagggcttatacacggaaaaactca

SEQ ID NO: 320735 - DNA, 25 bp, Mus musculus
cagggcttatactcggaaaaactca

SEQ ID NO: 320736 - DNA, 25 bp, Mus musculus
cagggcttcagaaacaaactgacct

SEQ ID NO: 320737 - DNA, 25 bp, Mus musculus
cagggcttcagatacaaactgacct

SEQ ID NO: 320738 - DNA, 25 bp, Mus musculus
cagggcttccacacaattatttatt

SEQ ID NO: 320739 - DNA, 25 bp, Mus musculus
cagggcttccactcaattatttatt

SEQ ID NO: 320740 - DNA, 25 bp, Mus musculus
cagggcttctctagctgtgtttgac

SEQ ID NO: 320741 - DNA, 25 bp, Mus musculus
cagggcttctcttgctgtgtttgac

SEQ ID NO: 320742 - DNA, 25 bp, Mus musculus
cagggcttctggcattctaggaaaa

SEQ ID NO: 320743 - DNA, 25 bp, Mus musculus
cagggcttctgggattctaggaaaa

SEQ ID NO: 320744 - DNA, 25 bp, Mus musculus
cagggcttcttcaatgaaaaacgat

SEQ ID NO: 320745 - DNA, 25 bp, Mus musculus
cagggcttcttctatgaaaaacgat

SEQ ID NO: 320746 - DNA, 25 bp, Mus musculus
cagggcttgcacaaaagaattgtca

SEQ ID NO: 320747 - DNA, 25 bp, Mus musculus
cagggcttgcactaaagaattgtca

SEQ ID NO: 320748 - DNA, 25 bp, Mus musculus
cagggcttgcctctgtaaactacaa

SEQ ID NO: 320749 - DNA, 25 bp, Mus musculus
cagggcttgcctgtgtaaactacaa

SEQ ID NO: 320750 - DNA, 25 bp, Mus musculus
cagggcttgtgacttgaacatgaga

SEQ ID NO: 320751 - DNA, 25 bp, Mus musculus
cagggcttgtgagttgaacatgaga

SEQ ID NO: 320752 - DNA, 25 bp, Mus musculus
cagggcttgtttcgactggtcatta

SEQ ID NO: 320753 - DNA, 25 bp, Mus musculus
cagggcttgtttggactggtcatta

SEQ ID NO: 320754 - DNA, 25 bp, Mus musculus
cagggctttatacgttgtgactact

SEQ ID NO: 320755 - DNA, 25 bp, Mus musculus
cagggctttataggttgtgactact

SEQ ID NO: 320756 - DNA, 25 bp, Mus musculus
cagggctttccactttagcttgttt

SEQ ID NO: 320757 - DNA, 25 bp, Mus musculus
cagggctttccagtttagcttgttt

SEQ ID NO: 320758 - DNA, 25 bp, Mus musculus
cagggctttcctctacacttgtaac

SEQ ID NO: 320759 - DNA, 25 bp, Mus musculus
cagggctttcctgtacacttgtaac

SEQ ID NO: 320760 - DNA, 25 bp, Mus musculus
cagggctttgagatgccgggcccca

SEQ ID NO: 320761 - DNA, 25 bp, Mus musculus
cagggctttgagttgccgggcccca

SEQ ID NO: 320762 - DNA, 25 bp, Mus musculus
cagggctttgctcgctccgcagaag

SEQ ID NO: 320763 - DNA, 25 bp, Mus musculus
cagggctttgctggctccgcagaag

SEQ ID NO: 320764 - DNA, 25 bp, Mus musculus
cagggcttttttcttgtggtatagg

SEQ ID NO: 320765 - DNA, 25 bp, Mus musculus
cagggcttttttgttgtggtatagg

SEQ ID NO: 320766 - DNA, 25 bp, Mus musculus
caggggttcctgaccagctgttttt

SEQ ID NO: 320767 - DNA, 25 bp, Mus musculus
caggggttcctgtccagctgttttt

SEQ ID NO: 320768 - DNA, 25 bp, Mus musculus
cagggtaaaactcattccatactgg

SEQ ID NO: 320769 - DNA, 25 bp, Mus musculus
cagggtaaaactgattccatactgg

SEQ ID NO: 320770 - DNA, 25 bp, Mus musculus
cagggtaaagttcaaccactctggt

SEQ ID NO: 320771 - DNA, 25 bp, Mus musculus
cagggtaaagttgaaccactctggt

SEQ ID NO: 320772 - DNA, 25 bp, Mus musculus
cagggtaaattgacactcatccata

SEQ ID NO: 320773 - DNA, 25 bp, Mus musculus
cagggtaaattgtcactcatccata

SEQ ID NO: 320774 - DNA, 25 bp, Mus musculus
cagggtaactgtccagcccgagaac

SEQ ID NO: 320775 - DNA, 25 bp, Mus musculus
cagggtaactgtgcagcccgagaac

SEQ ID NO: 320776 - DNA, 25 bp, Mus musculus
cagggtacagttatagggattcatc

SEQ ID NO: 320777 - DNA, 25 bp, Mus musculus
cagggtacagttttagggattcatc

SEQ ID NO: 320778 - DNA, 25 bp, Mus musculus
cagggtacccatcgctaggagcagt

SEQ ID NO: 320779 - DNA, 25 bp, Mus musculus
cagggtacccatggctaggagcagt

SEQ ID NO: 320780 - DNA, 25 bp, Mus musculus
cagggtacctgcagtgtgttcactt

SEQ ID NO: 320781 - DNA, 25 bp, Mus musculus
cagggtacctgctgtgtgttcactt

SEQ ID NO: 320782 - DNA, 25 bp, Mus musculus
cagggtactgacagctggcgtagct

SEQ ID NO: 320783 - DNA, 25 bp, Mus musculus
cagggtactgactgctggcgtagct

SEQ ID NO: 320784 - DNA, 25 bp, Mus musculus
cagggtagaactagccgaaaatcga

SEQ ID NO: 320785 - DNA, 25 bp, Mus musculus
cagggtagaacttgccgaaaatcga

SEQ ID NO: 320786 - DNA, 25 bp, Mus musculus
cagggtagatcacgctggtttcgaa

SEQ ID NO: 320787 - DNA, 25 bp, Mus musculus
cagggtagatcaggctggtttcgaa

SEQ ID NO: 320788 - DNA, 25 bp, Mus musculus
cagggtagcagccagtatgcttgta

SEQ ID NO: 320789 - DNA, 25 bp, Mus musculus
cagggtagcagcgagtatgcttgta

SEQ ID NO: 320790 - DNA, 25 bp, Mus musculus
cagggtagcattctggtcagtttta

SEQ ID NO: 320791 - DNA, 25 bp, Mus musculus
cagggtagcattgtggtcagtttta

SEQ ID NO: 320792 - DNA, 25 bp, Mus musculus
cagggtaggactcaatgcttcacga

SEQ ID NO: 320793 - DNA, 25 bp, Mus musculus
cagggtaggactgaatgcttcacga

SEQ ID NO: 320794 - DNA, 25 bp, Mus musculus
cagggtaggcttacaattgctcaga

SEQ ID NO: 320795 - DNA, 25 bp, Mus musculus
cagggtaggctttcaattgctcaga

SEQ ID NO: 320796 - DNA, 25 bp, Mus musculus
cagggtatcatcactgccttttcca

SEQ ID NO: 320797 - DNA, 25 bp, Mus musculus
cagggtatcatctctgccttttcca

SEQ ID NO: 320798 - DNA, 25 bp, Mus musculus
cagggtatccctcctatggaaccaa

SEQ ID NO: 320799 - DNA, 25 bp, Mus musculus
cagggtatccctgctatggaaccaa

SEQ ID NO: 320800 - DNA, 25 bp, Mus musculus
cagggtatctagcttgcatgtgtct

SEQ ID NO: 320801 - DNA, 25 bp, Mus musculus
cagggtatctaggttgcatgtgtct

SEQ ID NO: 320802 - DNA, 25 bp, Mus musculus
cagggtatgcacagactgactgcca

SEQ ID NO: 320803 - DNA, 25 bp, Mus musculus
cagggtatgcactgactgactgcca

SEQ ID NO: 320804 - DNA, 25 bp, Mus musculus
cagggtatggatcacagctcaactt

SEQ ID NO: 320805 - DNA, 25 bp, Mus musculus
cagggtatggatgacagctcaactt

SEQ ID NO: 320806 - DNA, 25 bp, Mus musculus
cagggtcaaggacctaggccacagc

SEQ ID NO: 320807 - DNA, 25 bp, Mus musculus
cagggtcaaggagctaggccacagc

SEQ ID NO: 320808 - DNA, 25 bp, Mus musculus
cagggtcactcaactaaagtctagt

SEQ ID NO: 320809 - DNA, 25 bp, Mus musculus
cagggtcactcatctaaagtctagt

SEQ ID NO: 320810 - DNA, 25 bp, Mus musculus
cagggtcactgaatcttttctccat

SEQ ID NO: 320811 - DNA, 25 bp, Mus musculus
cagggtcactgattcttttctccat

SEQ ID NO: 320812 - DNA, 25 bp, Mus musculus
cagggtcagcagcatgcagtaaaaa

SEQ ID NO: 320813 - DNA, 25 bp, Mus musculus
cagggtcagcaggatgcagtaaaaa

SEQ ID NO: 320814 - DNA, 25 bp, Mus musculus
cagggtcaggccaggcacatcaaag

SEQ ID NO: 320815 - DNA, 25 bp, Mus musculus
cagggtcaggcctggcacatcaaag

SEQ ID NO: 320816 - DNA, 25 bp, Mus musculus
cagggtcatcctaaactacatattg

SEQ ID NO: 320817 - DNA, 25 bp, Mus musculus
cagggtcatccttaactacatattg

SEQ ID NO: 320818 - DNA, 25 bp, Mus musculus
cagggtcatctgactttgatttcca

SEQ ID NO: 320819 - DNA, 25 bp, Mus musculus
cagggtcatctgtctttgatttcca

SEQ ID NO: 320820 - DNA, 25 bp, Mus musculus
cagggtcatggaatgaactcccaaa

SEQ ID NO: 320821 - DNA, 25 bp, Mus musculus
cagggtcatggattgaactcccaaa

SEQ ID NO: 320822 - DNA, 25 bp, Mus musculus
cagggtccaatgatatgccgttcca

SEQ ID NO: 320823 - DNA, 25 bp, Mus musculus
cagggtccaatgttatgccgttcca

SEQ ID NO: 320824 - DNA, 25 bp, Mus musculus
cagggtccactactcaatttcactt

SEQ ID NO: 320825 - DNA, 25 bp, Mus musculus
cagggtccactagtcaatttcactt

SEQ ID NO: 320826 - DNA, 25 bp, Mus musculus
cagggtccagatacaactcgcaagc

SEQ ID NO: 320827 - DNA, 25 bp, Mus musculus
cagggtccagattcaactcgcaagc

SEQ ID NO: 320828 - DNA, 25 bp, Mus musculus
cagggtccagggaacttgaccatgc

SEQ ID NO: 320829 - DNA, 25 bp, Mus musculus
cagggtccagggtacttgaccatgc

SEQ ID NO: 320830 - DNA, 25 bp, Mus musculus
cagggtccattcaagtccaagtgtg

SEQ ID NO: 320831 - DNA, 25 bp, Mus musculus
cagggtccattctagtccaagtgtg

SEQ ID NO: 320832 - DNA, 25 bp, Mus musculus
cagggtcccaaaagatgcccagcat

SEQ ID NO: 320833 - DNA, 25 bp, Mus musculus
cagggtcccaaatgatgcccagcat

SEQ ID NO: 320834 - DNA, 25 bp, Mus musculus
cagggtcccggaacttacagcacaa

SEQ ID NO: 320835 - DNA, 25 bp, Mus musculus
cagggtcccggatcttacagcacaa

SEQ ID NO: 320836 - DNA, 25 bp, Mus musculus
cagggtccctcaattaactggaagc

SEQ ID NO: 320837 - DNA, 25 bp, Mus musculus
cagggtccctcatttaactggaagc

SEQ ID NO: 320838 - DNA, 25 bp, Mus musculus
cagggtccctgaactcagccaaagc

SEQ ID NO: 320839 - DNA, 25 bp, Mus musculus
cagggtccctgatctcagccaaagc

SEQ ID NO: 320840 - DNA, 25 bp, Mus musculus
cagggtccctgcaggaaagagcctg

SEQ ID NO: 320841 - DNA, 25 bp, Mus musculus
cagggtccctgctggaaagagcctg

SEQ ID NO: 320842 - DNA, 25 bp, Mus musculus
cagggtcctcttaaaagctttctgg

SEQ ID NO: 320843 - DNA, 25 bp, Mus musculus
cagggtcctctttaaagctttctgg

SEQ ID NO: 320844 - DNA, 25 bp, Mus musculus
cagggtcgaacacaagggcagcttt

SEQ ID NO: 320845 - DNA, 25 bp, Mus musculus
cagggtcgaacagaagggcagcttt

SEQ ID NO: 320846 - DNA, 25 bp, Mus musculus
cagggtctaagaagcaaacgcttct

SEQ ID NO: 320847 - DNA, 25 bp, Mus musculus
cagggtctaagatgcaaacgcttct

SEQ ID NO: 320848 - DNA, 25 bp, Mus musculus
cagggtctacagatggtgctattaa

SEQ ID NO: 320849 - DNA, 25 bp, Mus musculus
cagggtctacagttggtgctattaa

SEQ ID NO: 320850 - DNA, 25 bp, Mus musculus
cagggtctacctatgcactgagaat

SEQ ID NO: 320851 - DNA, 25 bp, Mus musculus
cagggtctacctttgcactgagaat

SEQ ID NO: 320852 - DNA, 25 bp, Mus musculus
cagggtctcaacaatattgtcctag

SEQ ID NO: 320853 - DNA, 25 bp, Mus musculus
cagggtctcaactatattgtcctag

SEQ ID NO: 320854 - DNA, 25 bp, Mus musculus
cagggtctcattaggaacatttttc

SEQ ID NO: 320855 - DNA, 25 bp, Mus musculus
cagggtctcatttggaacatttttc

SEQ ID NO: 320856 - DNA, 25 bp, Mus musculus
cagggtctcctcattccgtaagaat

SEQ ID NO: 320857 - DNA, 25 bp, Mus musculus
cagggtctcctctttccgtaagaat

SEQ ID NO: 320858 - DNA, 25 bp, Mus musculus
cagggtctctggatcaagatagcta

SEQ ID NO: 320859 - DNA, 25 bp, Mus musculus
cagggtctctggttcaagatagcta

SEQ ID NO: 320860 - DNA, 25 bp, Mus musculus
cagggtctctgtagctatggtaaaa

SEQ ID NO: 320861 - DNA, 25 bp, Mus musculus
cagggtctctgttgctatggtaaaa

SEQ ID NO: 320862 - DNA, 25 bp, Mus musculus
cagggtctgggcaccataaagcgga

SEQ ID NO: 320863 - DNA, 25 bp, Mus musculus
cagggtctgggctccataaagcgga

SEQ ID NO: 320864 - DNA, 25 bp, Mus musculus
cagggtcttacacgctggcatctgc

SEQ ID NO: 320865 - DNA, 25 bp, Mus musculus
cagggtcttacaggctggcatctgc

SEQ ID NO: 320866 - DNA, 25 bp, Mus musculus
cagggtcttctgagaaggcagctca

SEQ ID NO: 320867 - DNA, 25 bp, Mus musculus
cagggtcttctgtgaaggcagctca

SEQ ID NO: 320868 - DNA, 25 bp, Mus musculus
cagggtcttgacacattccaagatt

SEQ ID NO: 320869 - DNA, 25 bp, Mus musculus
cagggtcttgactcattccaagatt

SEQ ID NO: 320870 - DNA, 25 bp, Mus musculus
cagggtgaacccaagactctatgta

SEQ ID NO: 320871 - DNA, 25 bp, Mus musculus
cagggtgaaccctagactctatgta

SEQ ID NO: 320872 - DNA, 25 bp, Mus musculus
cagggtgacagactcagggccccat

SEQ ID NO: 320873 - DNA, 25 bp, Mus musculus
cagggtgacagagtcagggccccat

SEQ ID NO: 320874 - DNA, 25 bp, Mus musculus
cagggtgacatacagagtgagacta

SEQ ID NO: 320875 - DNA, 25 bp, Mus musculus
cagggtgacatagagagtgagacta

SEQ ID NO: 320876 - DNA, 25 bp, Mus musculus
cagggtgaccccataatctagaaga

SEQ ID NO: 320877 - DNA, 25 bp, Mus musculus
cagggtgaccccttaatctagaaga

SEQ ID NO: 320878 - DNA, 25 bp, Mus musculus
cagggtgaccttctgacatcaggaa

SEQ ID NO: 320879 - DNA, 25 bp, Mus musculus
cagggtgaccttgtgacatcaggaa

SEQ ID NO: 320880 - DNA, 25 bp, Mus musculus
cagggtgagatgctacacacctata

SEQ ID NO: 320881 - DNA, 25 bp, Mus musculus
cagggtgagatggtacacacctata

SEQ ID NO: 320882 - DNA, 25 bp, Mus musculus
cagggtgagctcatgtttccttaaa

SEQ ID NO: 320883 - DNA, 25 bp, Mus musculus
cagggtgagctcttgtttccttaaa

SEQ ID NO: 320884 - DNA, 25 bp, Mus musculus
cagggtgatctgcttcagggcattt

SEQ ID NO: 320885 - DNA, 25 bp, Mus musculus
cagggtgatctggttcagggcattt

SEQ ID NO: 320886 - DNA, 25 bp, Mus musculus
cagggtgatgaaagccggtatgtat

SEQ ID NO: 320887 - DNA, 25 bp, Mus musculus
cagggtgatgaatgccggtatgtat

SEQ ID NO: 320888 - DNA, 25 bp, Mus musculus
cagggtgatttaacttactgccaaa

SEQ ID NO: 320889 - DNA, 25 bp, Mus musculus
cagggtgatttatcttactgccaaa

SEQ ID NO: 320890 - DNA, 25 bp, Mus musculus
cagggtgcaccgagttagagctcaa

SEQ ID NO: 320891 - DNA, 25 bp, Mus musculus
cagggtgcaccgtgttagagctcaa

SEQ ID NO: 320892 - DNA, 25 bp, Mus musculus
cagggtgcacttcgtctcatgtact

SEQ ID NO: 320893 - DNA, 25 bp, Mus musculus
cagggtgcacttggtctcatgtact

SEQ ID NO: 320894 - DNA, 25 bp, Mus musculus
cagggtgcagccagagggtttaaaa

SEQ ID NO: 320895 - DNA, 25 bp, Mus musculus
cagggtgcagcctgagggtttaaaa

SEQ ID NO: 320896 - DNA, 25 bp, Mus musculus
cagggtgccccgacacagtgaggaa

SEQ ID NO: 320897 - DNA, 25 bp, Mus musculus
cagggtgccccgtcacagtgaggaa

SEQ ID NO: 320898 - DNA, 25 bp, Mus musculus
cagggtgccctccagctcttttgtc

SEQ ID NO: 320899 - DNA, 25 bp, Mus musculus
cagggtgccctcgagctcttttgtc

SEQ ID NO: 320900 - DNA, 25 bp, Mus musculus
cagggtgctaagacagtgctagatc

SEQ ID NO: 320901 - DNA, 25 bp, Mus musculus
cagggtgctaagtcagtgctagatc

SEQ ID NO: 320902 - DNA, 25 bp, Mus musculus
cagggtgctcacctctgtctaggag

SEQ ID NO: 320903 - DNA, 25 bp, Mus musculus
cagggtgctcacgtctgtctaggag

SEQ ID NO: 320904 - DNA, 25 bp, Mus musculus
cagggtgctgagcttaaacggcttt

SEQ ID NO: 320905 - DNA, 25 bp, Mus musculus
cagggtgctgaggttaaacggcttt

SEQ ID NO: 320906 - DNA, 25 bp, Mus musculus
cagggtggcagaatgaaggtttttc

SEQ ID NO: 320907 - DNA, 25 bp, Mus musculus
cagggtggcagattgaaggtttttc

SEQ ID NO: 320908 - DNA, 25 bp, Mus musculus
cagggtgggagtcggagggcctccg

SEQ ID NO: 320909 - DNA, 25 bp, Mus musculus
cagggtgggagtgggagggcctccg

SEQ ID NO: 320910 - DNA, 25 bp, Mus musculus
cagggtgggcgtatgctgctgccac

SEQ ID NO: 320911 - DNA, 25 bp, Mus musculus
cagggtgggcgtttgctgctgccac

SEQ ID NO: 320912 - DNA, 25 bp, Mus musculus
cagggtgggtctacaatcgcaacga

SEQ ID NO: 320913 - DNA, 25 bp, Mus musculus
cagggtgggtcttcaatcgcaacga

SEQ ID NO: 320914 - DNA, 25 bp, Mus musculus
cagggtggtatcagccaaggcctct

SEQ ID NO: 320915 - DNA, 25 bp, Mus musculus
cagggtggtatctgccaaggcctct

SEQ ID NO: 320916 - DNA, 25 bp, Mus musculus
cagggtggtgatcacccgtgacctt

SEQ ID NO: 320917 - DNA, 25 bp, Mus musculus
cagggtggtgatgacccgtgacctt

SEQ ID NO: 320918 - DNA, 25 bp, Mus musculus
cagggtggtgtcaatcttgatctaa

SEQ ID NO: 320919 - DNA, 25 bp, Mus musculus
cagggtggtgtcagcctccagggag

SEQ ID NO: 320920 - DNA, 25 bp, Mus musculus
cagggtggtgtctatcttgatctaa

SEQ ID NO: 320921 - DNA, 25 bp, Mus musculus
cagggtggtgtctgcctccagggag

SEQ ID NO: 320922 - DNA, 25 bp, Mus musculus
cagggtggttacaggacacatgtcc

SEQ ID NO: 320923 - DNA, 25 bp, Mus musculus
cagggtggttactggacacatgtcc

SEQ ID NO: 320924 - DNA, 25 bp, Mus musculus
cagggtggtttccacacactgggaa

SEQ ID NO: 320925 - DNA, 25 bp, Mus musculus
cagggtggtttcgacacactgggaa

SEQ ID NO: 320926 - DNA, 25 bp, Mus musculus
cagggtgtaacacagttctctcata

SEQ ID NO: 320927 - DNA, 25 bp, Mus musculus
cagggtgtaacagagttctctcata

SEQ ID NO: 320928 - DNA, 25 bp, Mus musculus
cagggtgtctgaaaagtcaccttct

SEQ ID NO: 320929 - DNA, 25 bp, Mus musculus
cagggtgtctgataagtcaccttct

SEQ ID NO: 320930 - DNA, 25 bp, Mus musculus
cagggtgtctgcatggtggctctaa

SEQ ID NO: 320931 - DNA, 25 bp, Mus musculus
cagggtgtctgcttggtggctctaa

SEQ ID NO: 320932 - DNA, 25 bp, Mus musculus
cagggtgtctgtcaggctttgtcca

SEQ ID NO: 320933 - DNA, 25 bp, Mus musculus
cagggtgtctgtgaggctttgtcca

SEQ ID NO: 320934 - DNA, 25 bp, Mus musculus
cagggtgtgcccaaatgactcagaa

SEQ ID NO: 320935 - DNA, 25 bp, Mus musculus
cagggtgtgccctaatgactcagaa

SEQ ID NO: 320936 - DNA, 25 bp, Mus musculus
cagggtgtggacacttcaaatccca

SEQ ID NO: 320937 - DNA, 25 bp, Mus musculus
cagggtgtggactcttcaaatccca

SEQ ID NO: 320938 - DNA, 25 bp, Mus musculus
cagggtgtgtccatcggtctgttca

SEQ ID NO: 320939 - DNA, 25 bp, Mus musculus
cagggtgtgtccttcggtctgttca

SEQ ID NO: 320940 - DNA, 25 bp, Mus musculus
cagggtgtgttcacgagactccagt

SEQ ID NO: 320941 - DNA, 25 bp, Mus musculus
cagggtgtgttctcgagactccagt

SEQ ID NO: 320942 - DNA, 25 bp, Mus musculus
cagggtgtttacaaactctggtgaa

SEQ ID NO: 320943 - DNA, 25 bp, Mus musculus
cagggtgtttactaactctggtgaa

SEQ ID NO: 320944 - DNA, 25 bp, Mus musculus
cagggttaatcgcaggagccagttt

SEQ ID NO: 320945 - DNA, 25 bp, Mus musculus
cagggttaatcggaggagccagttt

SEQ ID NO: 320946 - DNA, 25 bp, Mus musculus
cagggttacagtacattctagtctt

SEQ ID NO: 320947 - DNA, 25 bp, Mus musculus
cagggttacagttcattctagtctt

SEQ ID NO: 320948 - DNA, 25 bp, Mus musculus
cagggttactagacatttgatgctc

SEQ ID NO: 320949 - DNA, 25 bp, Mus musculus
cagggttactagtcatttgatgctc

SEQ ID NO: 320950 - DNA, 25 bp, Mus musculus
cagggttaggtgatttgcattgatg

SEQ ID NO: 320951 - DNA, 25 bp, Mus musculus
cagggttaggtgttttgcattgatg

SEQ ID NO: 320952 - DNA, 25 bp, Mus musculus
cagggttatagcaataggacttggg

SEQ ID NO: 320953 - DNA, 25 bp, Mus musculus
cagggttatagctataggacttggg

SEQ ID NO: 320954 - DNA, 25 bp, Mus musculus
cagggttatttaccactggacaact

SEQ ID NO: 320955 - DNA, 25 bp, Mus musculus
cagggttatttagcactggacaact

SEQ ID NO: 320956 - DNA, 25 bp, Mus musculus
cagggttcacggagcagcagcttct

SEQ ID NO: 320957 - DNA, 25 bp, Mus musculus
cagggttcacggtgcagcagcttct

SEQ ID NO: 320958 - DNA, 25 bp, Mus musculus
cagggttcagaaattatccagagta

SEQ ID NO: 320959 - DNA, 25 bp, Mus musculus
cagggttcagaatttatccagagta

SEQ ID NO: 320960 - DNA, 25 bp, Mus musculus
cagggttccaggagggctatcctta

SEQ ID NO: 320961 - DNA, 25 bp, Mus musculus
cagggttccaggtgggctatcctta

SEQ ID NO: 320962 - DNA, 25 bp, Mus musculus
cagggttccagtcatctgtatgtga

SEQ ID NO: 320963 - DNA, 25 bp, Mus musculus
cagggttccagtgatctgtatgtga

SEQ ID NO: 320964 - DNA, 25 bp, Mus musculus
cagggttccctgatgttatgtttat

SEQ ID NO: 320965 - DNA, 25 bp, Mus musculus
cagggttccctgttgttatgtttat

SEQ ID NO: 320966 - DNA, 25 bp, Mus musculus
cagggttccttgattctgatcaagt

SEQ ID NO: 320967 - DNA, 25 bp, Mus musculus
cagggttccttgtttctgatcaagt

SEQ ID NO: 320968 - DNA, 25 bp, Mus musculus
cagggttcggcaacaattccagata

SEQ ID NO: 320969 - DNA, 25 bp, Mus musculus
cagggttcggcatcaattccagata

SEQ ID NO: 320970 - DNA, 25 bp, Mus musculus
cagggttctctgcattcaggaggaa

SEQ ID NO: 320971 - DNA, 25 bp, Mus musculus
cagggttctctggattcaggaggaa

SEQ ID NO: 320972 - DNA, 25 bp, Mus musculus
cagggttctgagactcttggaagca

SEQ ID NO: 320973 - DNA, 25 bp, Mus musculus
cagggttctgagtctcttggaagca

SEQ ID NO: 320974 - DNA, 25 bp, Mus musculus
cagggttctggaatggtgttgcata

SEQ ID NO: 320975 - DNA, 25 bp, Mus musculus
cagggttctggattggtgttgcata

SEQ ID NO: 320976 - DNA, 25 bp, Mus musculus
cagggttctgttattcattgtgctt

SEQ ID NO: 320977 - DNA, 25 bp, Mus musculus
cagggttctgtttttcattgtgctt

SEQ ID NO: 320978 - DNA, 25 bp, Mus musculus
cagggttcttggcaagcacctgcat

SEQ ID NO: 320979 - DNA, 25 bp, Mus musculus
cagggttcttgggaagcacctgcat

SEQ ID NO: 320980 - DNA, 25 bp, Mus musculus
cagggttgacatcgcttgagctgct

SEQ ID NO: 320981 - DNA, 25 bp, Mus musculus
cagggttgacatggcttgagctgct

SEQ ID NO: 320982 - DNA, 25 bp, Mus musculus
cagggttgagggaaccccacagtgt

SEQ ID NO: 320983 - DNA, 25 bp, Mus musculus
cagggttgagggtaccccacagtgt

SEQ ID NO: 320984 - DNA, 25 bp, Mus musculus
cagggttgcatcacagaagggctcc

SEQ ID NO: 320985 - DNA, 25 bp, Mus musculus
cagggttgcatctcagaagggctcc

SEQ ID NO: 320986 - DNA, 25 bp, Mus musculus
cagggttgccagctgctgaacagat

SEQ ID NO: 320987 - DNA, 25 bp, Mus musculus
cagggttgccaggtgctgaacagat

SEQ ID NO: 320988 - DNA, 25 bp, Mus musculus
cagggttgctacaggagcctcctaa

SEQ ID NO: 320989 - DNA, 25 bp, Mus musculus
cagggttgctactggagcctcctaa

SEQ ID NO: 320990 - DNA, 25 bp, Mus musculus
cagggttgctatataaaaactcctg

SEQ ID NO: 320991 - DNA, 25 bp, Mus musculus
cagggttgctatttaaaaactcctg

SEQ ID NO: 320992 - DNA, 25 bp, Mus musculus
cagggttgctctcggtaaaagcctg

SEQ ID NO: 320993 - DNA, 25 bp, Mus musculus
cagggttgctctgggtaaaagcctg

SEQ ID NO: 320994 - DNA, 25 bp, Mus musculus
cagggttgtggcagctgcaatcaca

SEQ ID NO: 320995 - DNA, 25 bp, Mus musculus
cagggttgtggctgctgcaatcaca

SEQ ID NO: 320996 - DNA, 25 bp, Mus musculus
cagggtttacaaagattcctcagtc

SEQ ID NO: 320997 - DNA, 25 bp, Mus musculus
cagggtttacaatgattcctcagtc

SEQ ID NO: 320998 - DNA, 25 bp, Mus musculus
cagggtttactgaagcaactcccat

SEQ ID NO: 320999 - DNA, 25 bp, Mus musculus
cagggtttactgcaccagcaccagc

SEQ ID NO: 321000 - DNA, 25 bp, Mus musculus
cagggtttactggaccagcaccagc

SEQ ID NO: 321001 - DNA, 25 bp, Mus musculus
cagggtttactgtagcaactcccat

SEQ ID NO: 321002 - DNA, 25 bp, Mus musculus
cagggtttagataccaggcctggac

SEQ ID NO: 321003 - DNA, 25 bp, Mus musculus
cagggtttagattccaggcctggac

SEQ ID NO: 321004 - DNA, 25 bp, Mus musculus
cagggtttcactaattggttttctg

SEQ ID NO: 321005 - DNA, 25 bp, Mus musculus
cagggtttcacttattggttttctg

SEQ ID NO: 321006 - DNA, 25 bp, Mus musculus
cagggtttccagcttacctggatga

SEQ ID NO: 321007 - DNA, 25 bp, Mus musculus
cagggtttccaggttacctggatga

SEQ ID NO: 321008 - DNA, 25 bp, Mus musculus
cagggtttccatattcagggctata

SEQ ID NO: 321009 - DNA, 25 bp, Mus musculus
cagggtttccattttcagggctata

SEQ ID NO: 321010 - DNA, 25 bp, Mus musculus
cagggtttcctgcattccaagaatg

SEQ ID NO: 321011 - DNA, 25 bp, Mus musculus
cagggtttcctgcttctggtcattt

SEQ ID NO: 321012 - DNA, 25 bp, Mus musculus
cagggtttcctggattccaagaatg

SEQ ID NO: 321013 - DNA, 25 bp, Mus musculus
cagggtttcctggttctggtcattt

SEQ ID NO: 321014 - DNA, 25 bp, Mus musculus
cagggtttctgtaggatcttttgaa

SEQ ID NO: 321015 - DNA, 25 bp, Mus musculus
cagggtttctgttggatcttttgaa

SEQ ID NO: 321016 - DNA, 25 bp, Mus musculus
cagggtttctttacctcatagttct

SEQ ID NO: 321017 - DNA, 25 bp, Mus musculus
cagggtttcttttcctcatagttct

SEQ ID NO: 321018 - DNA, 25 bp, Mus musculus
cagggtttgactcccgatgtggaaa

SEQ ID NO: 321019 - DNA, 25 bp, Mus musculus
cagggtttgactgccgatgtggaaa

SEQ ID NO: 321020 - DNA, 25 bp, Mus musculus
cagggtttgcatattacctctacaa

SEQ ID NO: 321021 - DNA, 25 bp, Mus musculus
cagggtttgcattttacctctacaa

SEQ ID NO: 321022 - DNA, 25 bp, Mus musculus
cagggtttgtatacactgactccct

SEQ ID NO: 321023 - DNA, 25 bp, Mus musculus
cagggtttgtattcactgactccct

SEQ ID NO: 321024 - DNA, 25 bp, Mus musculus
cagggtttgtttacaacgaagcatt

SEQ ID NO: 321025 - DNA, 25 bp, Mus musculus
cagggtttgttttcaacgaagcatt

SEQ ID NO: 321026 - DNA, 25 bp, Mus musculus
cagggttttaagcacatttggacaa

SEQ ID NO: 321027 - DNA, 25 bp, Mus musculus
cagggttttaaggacatttggacaa

SEQ ID NO: 321028 - DNA, 25 bp, Mus musculus
cagggttttacaacagtcggtgctt

SEQ ID NO: 321029 - DNA, 25 bp, Mus musculus
cagggttttacatcagtcggtgctt

SEQ ID NO: 321030 - DNA, 25 bp, Mus musculus
cagggttttattctatcctgcaata

SEQ ID NO: 321031 - DNA, 25 bp, Mus musculus
cagggttttattgtatcctgcaata

SEQ ID NO: 321032 - DNA, 25 bp, Mus musculus
caggtaaagtttatgcagctctcag

SEQ ID NO: 321033 - DNA, 25 bp, Mus musculus
caggtaaagtttttgcagctctcag

SEQ ID NO: 321034 - DNA, 25 bp, Mus musculus
caggtaaataagcttgggcaagcac

SEQ ID NO: 321035 - DNA, 25 bp, Mus musculus
caggtaaataaggttgggcaagcac

SEQ ID NO: 321036 - DNA, 25 bp, Mus musculus
caggtaaatgtcaagaaatggaatt

SEQ ID NO: 321037 - DNA, 25 bp, Mus musculus
caggtaaatgtctagaaatggaatt

SEQ ID NO: 321038 - DNA, 25 bp, Mus musculus
caggtaaattcaagggcagagggta

SEQ ID NO: 321039 - DNA, 25 bp, Mus musculus
caggtaaattcatgggcagagggta

SEQ ID NO: 321040 - DNA, 25 bp, Mus musculus
caggtaaccattacttctgttaagg

SEQ ID NO: 321041 - DNA, 25 bp, Mus musculus
caggtaaccatttcttctgttaagg

SEQ ID NO: 321042 - DNA, 25 bp, Mus musculus
caggtaaccctgaagctagcataac

SEQ ID NO: 321043 - DNA, 25 bp, Mus musculus
caggtaaccctgtagctagcataac

SEQ ID NO: 321044 - DNA, 25 bp, Mus musculus
caggtaacgtgtattggaccgggct

SEQ ID NO: 321045 - DNA, 25 bp, Mus musculus
caggtaacgtgttttggaccgggct

SEQ ID NO: 321046 - DNA, 25 bp, Mus musculus
caggtaactaccaggactcggaagt

SEQ ID NO: 321047 - DNA, 25 bp, Mus musculus
caggtaactacctggactcggaagt

SEQ ID NO: 321048 - DNA, 25 bp, Mus musculus
caggtaagaggcagcagggcgggca

SEQ ID NO: 321049 - DNA, 25 bp, Mus musculus
caggtaagaggctgcagggcgggca

SEQ ID NO: 321050 - DNA, 25 bp, Mus musculus
caggtaagcactccagttttcttgt

SEQ ID NO: 321051 - DNA, 25 bp, Mus musculus
caggtaagcactgcagttttcttgt

SEQ ID NO: 321052 - DNA, 25 bp, Mus musculus
caggtaagcatcagttccaggacta

SEQ ID NO: 321053 - DNA, 25 bp, Mus musculus
caggtaagcatctgttccaggacta

SEQ ID NO: 321054 - DNA, 25 bp, Mus musculus
caggtaatccctcgtgagatgttaa

SEQ ID NO: 321055 - DNA, 25 bp, Mus musculus
caggtaatccctggtgagatgttaa

SEQ ID NO: 321056 - DNA, 25 bp, Mus musculus
caggtaattcctatgtagtgttgta

SEQ ID NO: 321057 - DNA, 25 bp, Mus musculus
caggtaattcctttgtagtgttgta

SEQ ID NO: 321058 - DNA, 25 bp, Mus musculus
caggtaattgagcaccatgattgga

SEQ ID NO: 321059 - DNA, 25 bp, Mus musculus
caggtaattgaggaccatgattgga

SEQ ID NO: 321060 - DNA, 25 bp, Mus musculus
caggtacaacctcatatggcaatgt

SEQ ID NO: 321061 - DNA, 25 bp, Mus musculus
caggtacaacctgatatggcaatgt

SEQ ID NO: 321062 - DNA, 25 bp, Mus musculus
caggtacaccatccggtgatgccaa

SEQ ID NO: 321063 - DNA, 25 bp, Mus musculus
caggtacaccatgcggtgatgccaa

SEQ ID NO: 321064 - DNA, 25 bp, Mus musculus
caggtacagatcacccttgttttta

SEQ ID NO: 321065 - DNA, 25 bp, Mus musculus
caggtacagatctcccttgttttta

SEQ ID NO: 321066 - DNA, 25 bp, Mus musculus
caggtacagctcacaggtttgtgga

SEQ ID NO: 321067 - DNA, 25 bp, Mus musculus
caggtacagctctcaggtttgtgga

SEQ ID NO: 321068 - DNA, 25 bp, Mus musculus
caggtacatagcacccagtcaagtg

SEQ ID NO: 321069 - DNA, 25 bp, Mus musculus
caggtacatagctcccagtcaagtg

SEQ ID NO: 321070 - DNA, 25 bp, Mus musculus
caggtaccaggaagccagtacatga

SEQ ID NO: 321071 - DNA, 25 bp, Mus musculus
caggtaccaggatgccagtacatga

SEQ ID NO: 321072 - DNA, 25 bp, Mus musculus
caggtaccagttcaaacgaaattct

SEQ ID NO: 321073 - DNA, 25 bp, Mus musculus
caggtaccagttgaaacgaaattct

SEQ ID NO: 321074 - DNA, 25 bp, Mus musculus
caggtacccaggactcagggatcaa

SEQ ID NO: 321075 - DNA, 25 bp, Mus musculus
caggtacccaggtctcagggatcaa

SEQ ID NO: 321076 - DNA, 25 bp, Mus musculus
caggtaccctgaacagtgctgaagt

SEQ ID NO: 321077 - DNA, 25 bp, Mus musculus
caggtaccctgatcagtgctgaagt

SEQ ID NO: 321078 - DNA, 25 bp, Mus musculus
caggtacctatactgcacacaacgc

SEQ ID NO: 321079 - DNA, 25 bp, Mus musculus
caggtacctatagtgcacacaacgc

SEQ ID NO: 321080 - DNA, 25 bp, Mus musculus
caggtacctgcaatcaacatgtgaa

SEQ ID NO: 321081 - DNA, 25 bp, Mus musculus
caggtacctgcattcaacatgtgaa

SEQ ID NO: 321082 - DNA, 25 bp, Mus musculus
caggtacctggtctagttagtggca

SEQ ID NO: 321083 - DNA, 25 bp, Mus musculus
caggtacctggtcttgcttttaact

SEQ ID NO: 321084 - DNA, 25 bp, Mus musculus
caggtacctggtgtagttagtggca

SEQ ID NO: 321085 - DNA, 25 bp, Mus musculus
caggtacctggtgttgcttttaact

SEQ ID NO: 321086 - DNA, 25 bp, Mus musculus
caggtaccttcactgcatgcacatg

SEQ ID NO: 321087 - DNA, 25 bp, Mus musculus
caggtaccttcagtgcatgcacatg

SEQ ID NO: 321088 - DNA, 25 bp, Mus musculus
caggtacgtcagattgattcctagc

SEQ ID NO: 321089 - DNA, 25 bp, Mus musculus
caggtacgtcagtttgattcctagc

SEQ ID NO: 321090 - DNA, 25 bp, Mus musculus
caggtactacagaccactgcaagcc

SEQ ID NO: 321091 - DNA, 25 bp, Mus musculus
caggtactacagtccactgcaagcc

SEQ ID NO: 321092 - DNA, 25 bp, Mus musculus
caggtactactaccttcctggagta

SEQ ID NO: 321093 - DNA, 25 bp, Mus musculus
caggtactactagcttcctggagta

SEQ ID NO: 321094 - DNA, 25 bp, Mus musculus
caggtactccatagtcagtgctagt

SEQ ID NO: 321095 - DNA, 25 bp, Mus musculus
caggtactccattgtcagtgctagt

SEQ ID NO: 321096 - DNA, 25 bp, Mus musculus
caggtactcggcaaagattctgcct

SEQ ID NO: 321097 - DNA, 25 bp, Mus musculus
caggtactcggctaagattctgcct

SEQ ID NO: 321098 - DNA, 25 bp, Mus musculus
caggtactggcaacttaagcctata

SEQ ID NO: 321099 - DNA, 25 bp, Mus musculus
caggtactggcatcttaagcctata

SEQ ID NO: 321100 - DNA, 25 bp, Mus musculus
caggtacttacaccaggaggtcagt

SEQ ID NO: 321101 - DNA, 25 bp, Mus musculus
caggtacttacagcaggaggtcagt

SEQ ID NO: 321102 - DNA, 25 bp, Mus musculus
caggtacttcagatacttgagcaaa

SEQ ID NO: 321103 - DNA, 25 bp, Mus musculus
caggtacttcagttacttgagcaaa

SEQ ID NO: 321104 - DNA, 25 bp, Mus musculus
caggtagacacaattgtttccccac

SEQ ID NO: 321105 - DNA, 25 bp, Mus musculus
caggtagacacatttgtttccccac

SEQ ID NO: 321106 - DNA, 25 bp, Mus musculus
caggtagagctgcatctggttcttt

SEQ ID NO: 321107 - DNA, 25 bp, Mus musculus
caggtagagctggatctggttcttt

SEQ ID NO: 321108 - DNA, 25 bp, Mus musculus
caggtagagtagaactgcccggtga

SEQ ID NO: 321109 - DNA, 25 bp, Mus musculus
caggtagagtagtactgcccggtga

SEQ ID NO: 321110 - DNA, 25 bp, Mus musculus
caggtagagtcacccgcgtgttcga

SEQ ID NO: 321111 - DNA, 25 bp, Mus musculus
caggtagagtcagccgcgtgttcga

SEQ ID NO: 321112 - DNA, 25 bp, Mus musculus
caggtagcacctaggatgtcactca

SEQ ID NO: 321113 - DNA, 25 bp, Mus musculus
caggtagcaccttggatgtcactca

SEQ ID NO: 321114 - DNA, 25 bp, Mus musculus
caggtagcactgatcagaagacccc

SEQ ID NO: 321115 - DNA, 25 bp, Mus musculus
caggtagcactgttcagaagacccc

SEQ ID NO: 321116 - DNA, 25 bp, Mus musculus
caggtagcagcaataggaaggacaa

SEQ ID NO: 321117 - DNA, 25 bp, Mus musculus
caggtagcagcattaggaaggacaa

SEQ ID NO: 321118 - DNA, 25 bp, Mus musculus
caggtagcagtaactcctcgatggc

SEQ ID NO: 321119 - DNA, 25 bp, Mus musculus
caggtagcagtatctcctcgatggc

SEQ ID NO: 321120 - DNA, 25 bp, Mus musculus
caggtagctctcactctgacttgtg

SEQ ID NO: 321121 - DNA, 25 bp, Mus musculus
caggtagctctctctctgacttgtg

SEQ ID NO: 321122 - DNA, 25 bp, Mus musculus
caggtagctgctcccctttcagaca

SEQ ID NO: 321123 - DNA, 25 bp, Mus musculus
caggtagctgctgccctttcagaca

SEQ ID NO: 321124 - DNA, 25 bp, Mus musculus
caggtagcttgtagctagtcggtaa

SEQ ID NO: 321125 - DNA, 25 bp, Mus musculus
caggtagcttgttgctagtcggtaa

SEQ ID NO: 321126 - DNA, 25 bp, Mus musculus
caggtaggacctacaacacccaaag

SEQ ID NO: 321127 - DNA, 25 bp, Mus musculus
caggtaggacctcatatttcggcga

SEQ ID NO: 321128 - DNA, 25 bp, Mus musculus
caggtaggacctgatatttcggcga

SEQ ID NO: 321129 - DNA, 25 bp, Mus musculus
caggtaggaccttcaacacccaaag

SEQ ID NO: 321130 - DNA, 25 bp, Mus musculus
caggtaggactgagaatgtatgtat

SEQ ID NO: 321131 - DNA, 25 bp, Mus musculus
caggtaggactgtgaatgtatgtat

SEQ ID NO: 321132 - DNA, 25 bp, Mus musculus
caggtaggcagtacccctgcgggct

SEQ ID NO: 321133 - DNA, 25 bp, Mus musculus
caggtaggcagttcccctgcgggct

SEQ ID NO: 321134 - DNA, 25 bp, Mus musculus
caggtaggcatgctccagctggtta

SEQ ID NO: 321135 - DNA, 25 bp, Mus musculus
caggtaggcatggtccagctggtta

SEQ ID NO: 321136 - DNA, 25 bp, Mus musculus
caggtaggctctagggaacaaataa

SEQ ID NO: 321137 - DNA, 25 bp, Mus musculus
caggtaggctcttgggaacaaataa

SEQ ID NO: 321138 - DNA, 25 bp, Mus musculus
caggtagggtgcagggcaactccca

SEQ ID NO: 321139 - DNA, 25 bp, Mus musculus
caggtagggtgctgggcaactccca

SEQ ID NO: 321140 - DNA, 25 bp, Mus musculus
caggtaggtagcacattttcaaggt

SEQ ID NO: 321141 - DNA, 25 bp, Mus musculus
caggtaggtagctcattttcaaggt

SEQ ID NO: 321142 - DNA, 25 bp, Mus musculus
caggtagtaggtattcacagtgtta

SEQ ID NO: 321143 - DNA, 25 bp, Mus musculus
caggtagtaggttttcacagtgtta

SEQ ID NO: 321144 - DNA, 25 bp, Mus musculus
caggtagtccctagtaacatcaaaa

SEQ ID NO: 321145 - DNA, 25 bp, Mus musculus
caggtagtcccttgtaacatcaaaa

SEQ ID NO: 321146 - DNA, 25 bp, Mus musculus
caggtagtctctagatgatccatcc

SEQ ID NO: 321147 - DNA, 25 bp, Mus musculus
caggtagtctcttgatgatccatcc

SEQ ID NO: 321148 - DNA, 25 bp, Mus musculus
caggtagttacccatgaacaccagg

SEQ ID NO: 321149 - DNA, 25 bp, Mus musculus
caggtagttaccgatgaacaccagg

SEQ ID NO: 321150 - DNA, 25 bp, Mus musculus
caggtagtttcactggtttcatttt

SEQ ID NO: 321151 - DNA, 25 bp, Mus musculus
caggtagtttcagtggtttcatttt

SEQ ID NO: 321152 - DNA, 25 bp, Mus musculus
caggtatacatccagcacacacgct

SEQ ID NO: 321153 - DNA, 25 bp, Mus musculus
caggtatacatcgagcacacacgct

SEQ ID NO: 321154 - DNA, 25 bp, Mus musculus
caggtatacgcgattttcctttcag

SEQ ID NO: 321155 - DNA, 25 bp, Mus musculus
caggtatacgcgtttttcctttcag

SEQ ID NO: 321156 - DNA, 25 bp, Mus musculus
caggtatactggcacttccatccca

SEQ ID NO: 321157 - DNA, 25 bp, Mus musculus
caggtatactgggacttccatccca

SEQ ID NO: 321158 - DNA, 25 bp, Mus musculus
caggtatagaccactctttaaccgc

SEQ ID NO: 321159 - DNA, 25 bp, Mus musculus
caggtatagacctctctttaaccgc

SEQ ID NO: 321160 - DNA, 25 bp, Mus musculus
caggtatagatgcttggaactcccc

SEQ ID NO: 321161 - DNA, 25 bp, Mus musculus
caggtatagatggttggaactcccc

SEQ ID NO: 321162 - DNA, 25 bp, Mus musculus
caggtatatctgcaaaagaatattt

SEQ ID NO: 321163 - DNA, 25 bp, Mus musculus
caggtatatctggaaaagaatattt

SEQ ID NO: 321164 - DNA, 25 bp, Mus musculus
caggtatcacacagttttctggtca

SEQ ID NO: 321165 - DNA, 25 bp, Mus musculus
caggtatcacactgttttctggtca

SEQ ID NO: 321166 - DNA, 25 bp, Mus musculus
caggtatccctgcgggtgtgaacca

SEQ ID NO: 321167 - DNA, 25 bp, Mus musculus
caggtatccctgggggtgtgaacca

SEQ ID NO: 321168 - DNA, 25 bp, Mus musculus
caggtatgcttgacttatctcttgg

SEQ ID NO: 321169 - DNA, 25 bp, Mus musculus
caggtatgcttgtcttatctcttgg

SEQ ID NO: 321170 - DNA, 25 bp, Mus musculus
caggtatgtcacaggctggttcagc

SEQ ID NO: 321171 - DNA, 25 bp, Mus musculus
caggtatgtcactggctggttcagc

SEQ ID NO: 321172 - DNA, 25 bp, Mus musculus
caggtattaaagcacgactccctcg

SEQ ID NO: 321173 - DNA, 25 bp, Mus musculus
caggtattaaaggacgactccctcg

SEQ ID NO: 321174 - DNA, 25 bp, Mus musculus
caggtattataaaacaaacagccaa

SEQ ID NO: 321175 - DNA, 25 bp, Mus musculus
caggtattataaccactgggccctt

SEQ ID NO: 321176 - DNA, 25 bp, Mus musculus
caggtattataagcactgggccctt

SEQ ID NO: 321177 - DNA, 25 bp, Mus musculus
caggtattataatacaaacagccaa

SEQ ID NO: 321178 - DNA, 25 bp, Mus musculus
caggtattgacacggatctgaatcc

SEQ ID NO: 321179 - DNA, 25 bp, Mus musculus
caggtattgacagggatctgaatcc

SEQ ID NO: 321180 - DNA, 25 bp, Mus musculus
caggtattgatcagcttttcagtta

SEQ ID NO: 321181 - DNA, 25 bp, Mus musculus
caggtattgatctgcttttcagtta

SEQ ID NO: 321182 - DNA, 25 bp, Mus musculus
caggtattgggcatcacacggttat

SEQ ID NO: 321183 - DNA, 25 bp, Mus musculus
caggtattgggcttcacacggttat

SEQ ID NO: 321184 - DNA, 25 bp, Mus musculus
caggtatttcctccactgtttggag

SEQ ID NO: 321185 - DNA, 25 bp, Mus musculus
caggtatttcctgcactgtttggag

SEQ ID NO: 321186 - DNA, 25 bp, Mus musculus
caggtcaatgcaacgttggctgaga

SEQ ID NO: 321187 - DNA, 25 bp, Mus musculus
caggtcaatgcatcgttggctgaga

SEQ ID NO: 321188 - DNA, 25 bp, Mus musculus
caggtcaatgctccgagtgggtaca

SEQ ID NO: 321189 - DNA, 25 bp, Mus musculus
caggtcaatgctgcgagtgggtaca

SEQ ID NO: 321190 - DNA, 25 bp, Mus musculus
caggtcaatgttcggcatcccataa

SEQ ID NO: 321191 - DNA, 25 bp, Mus musculus
caggtcaatgttgggcatcccataa

SEQ ID NO: 321192 - DNA, 25 bp, Mus musculus
caggtcacaacccatccatgtgtgg

SEQ ID NO: 321193 - DNA, 25 bp, Mus musculus
caggtcacaaccgatccatgtgtgg

SEQ ID NO: 321194 - DNA, 25 bp, Mus musculus
caggtcacacagacaggctttgaaa

SEQ ID NO: 321195 - DNA, 25 bp, Mus musculus
caggtcacacagtcaggctttgaaa

SEQ ID NO: 321196 - DNA, 25 bp, Mus musculus
caggtcacatatctcagtctgtgtg

SEQ ID NO: 321197 - DNA, 25 bp, Mus musculus
caggtcacatatgtcagtctgtgtg

SEQ ID NO: 321198 - DNA, 25 bp, Mus musculus
caggtcaccacactaatgcccgtta

SEQ ID NO: 321199 - DNA, 25 bp, Mus musculus
caggtcaccacagtaatgcccgtta

SEQ ID NO: 321200 - DNA, 25 bp, Mus musculus
caggtcaccctgcttaaactgcagt

SEQ ID NO: 321201 - DNA, 25 bp, Mus musculus
caggtcaccctggttaaactgcagt

SEQ ID NO: 321202 - DNA, 25 bp, Mus musculus
caggtcacgagtaaatgtatatcta

SEQ ID NO: 321203 - DNA, 25 bp, Mus musculus
caggtcacgagttaatgtatatcta

SEQ ID NO: 321204 - DNA, 25 bp, Mus musculus
caggtcacgtttaaatgtttcagaa

SEQ ID NO: 321205 - DNA, 25 bp, Mus musculus
caggtcacgttttaatgtttcagaa

SEQ ID NO: 321206 - DNA, 25 bp, Mus musculus
caggtcactctaatatttgagacta

SEQ ID NO: 321207 - DNA, 25 bp, Mus musculus
caggtcactctattatttgagacta

SEQ ID NO: 321208 - DNA, 25 bp, Mus musculus
caggtcagatgacagctggacttct

SEQ ID NO: 321209 - DNA, 25 bp, Mus musculus
caggtcagatgagagctggacttct

SEQ ID NO: 321210 - DNA, 25 bp, Mus musculus
caggtcagccctactagaatctaga

SEQ ID NO: 321211 - DNA, 25 bp, Mus musculus
caggtcagcccttctagaatctaga

SEQ ID NO: 321212 - DNA, 25 bp, Mus musculus
caggtcagctgaagaagacacgttt

SEQ ID NO: 321213 - DNA, 25 bp, Mus musculus
caggtcagctgatgaagacacgttt

SEQ ID NO: 321214 - DNA, 25 bp, Mus musculus
caggtcagggttaattctttattgg

SEQ ID NO: 321215 - DNA, 25 bp, Mus musculus
caggtcagggtttattctttattgg

SEQ ID NO: 321216 - DNA, 25 bp, Mus musculus
caggtcaggtgcctgctggagtcgc

SEQ ID NO: 321217 - DNA, 25 bp, Mus musculus
caggtcaggtgcgtgctggagtcgc

SEQ ID NO: 321218 - DNA, 25 bp, Mus musculus
caggtcagtcctaccaaagctttga

SEQ ID NO: 321219 - DNA, 25 bp, Mus musculus
caggtcagtccttccaaagctttga

SEQ ID NO: 321220 - DNA, 25 bp, Mus musculus
caggtcatcgggaggagctagccca

SEQ ID NO: 321221 - DNA, 25 bp, Mus musculus
caggtcatcgggtggagctagccca

SEQ ID NO: 321222 - DNA, 25 bp, Mus musculus
caggtcatctaaccctcacatgtgg

SEQ ID NO: 321223 - DNA, 25 bp, Mus musculus
caggtcatctaagcctcacatgtgg

SEQ ID NO: 321224 - DNA, 25 bp, Mus musculus
caggtcatgctgctacttcctgcca

SEQ ID NO: 321225 - DNA, 25 bp, Mus musculus
caggtcatgctggtacttcctgcca

SEQ ID NO: 321226 - DNA, 25 bp, Mus musculus
caggtcatggaccattctgtgttgt

SEQ ID NO: 321227 - DNA, 25 bp, Mus musculus
caggtcatggacgattctgtgttgt

SEQ ID NO: 321228 - DNA, 25 bp, Mus musculus
caggtcatggccactacctgtggag

SEQ ID NO: 321229 - DNA, 25 bp, Mus musculus
caggtcatggcctctacctgtggag

SEQ ID NO: 321230 - DNA, 25 bp, Mus musculus
caggtcatggtcacagccatgagca

SEQ ID NO: 321231 - DNA, 25 bp, Mus musculus
caggtcatggtctcagccatgagca

SEQ ID NO: 321232 - DNA, 25 bp, Mus musculus
caggtccacggactgcagggaaccc

SEQ ID NO: 321233 - DNA, 25 bp, Mus musculus
caggtccacggagtgcagggaaccc

SEQ ID NO: 321234 - DNA, 25 bp, Mus musculus
caggtccagcctcatgagcgaagaa

SEQ ID NO: 321235 - DNA, 25 bp, Mus musculus
caggtccagcctgatgagcgaagaa

SEQ ID NO: 321236 - DNA, 25 bp, Mus musculus
caggtccagggtatagttgctaagg

SEQ ID NO: 321237 - DNA, 25 bp, Mus musculus
caggtccagggtttagttgctaagg

SEQ ID NO: 321238 - DNA, 25 bp, Mus musculus
caggtccaggtccagaaagaaccta

SEQ ID NO: 321239 - DNA, 25 bp, Mus musculus
caggtccaggtcgagaaagaaccta

SEQ ID NO: 321240 - DNA, 25 bp, Mus musculus
caggtccagttcagtgcggcacgag

SEQ ID NO: 321241 - DNA, 25 bp, Mus musculus
caggtccagttctgtgcggcacgag

SEQ ID NO: 321242 - DNA, 25 bp, Mus musculus
caggtcccagcaccgatggcattcc

SEQ ID NO: 321243 - DNA, 25 bp, Mus musculus
caggtcccagcagcgatggcattcc

SEQ ID NO: 321244 - DNA, 25 bp, Mus musculus
caggtcccaggacctacttgataga

SEQ ID NO: 321245 - DNA, 25 bp, Mus musculus
caggtcccaggagctacttgataga

SEQ ID NO: 321246 - DNA, 25 bp, Mus musculus
caggtcccagggatgtacatgatat

SEQ ID NO: 321247 - DNA, 25 bp, Mus musculus
caggtcccagggttgtacatgatat

SEQ ID NO: 321248 - DNA, 25 bp, Mus musculus
caggtcccagtgatggaagcacgga

SEQ ID NO: 321249 - DNA, 25 bp, Mus musculus
caggtcccagtgttggaagcacgga

SEQ ID NO: 321250 - DNA, 25 bp, Mus musculus
caggtccccacgctagaacagtttt

SEQ ID NO: 321251 - DNA, 25 bp, Mus musculus
caggtccccacggtagaacagtttt

SEQ ID NO: 321252 - DNA, 25 bp, Mus musculus
caggtccccagaactagagttgagg

SEQ ID NO: 321253 - DNA, 25 bp, Mus musculus
caggtccccagatctagagttgagg

SEQ ID NO: 321254 - DNA, 25 bp, Mus musculus
caggtccccttactgcttatctgtg

SEQ ID NO: 321255 - DNA, 25 bp, Mus musculus
caggtccccttagtgcttatctgtg

SEQ ID NO: 321256 - DNA, 25 bp, Mus musculus
caggtccccttgcacagtttcctgg

SEQ ID NO: 321257 - DNA, 25 bp, Mus musculus
caggtccccttggacagtttcctgg

SEQ ID NO: 321258 - DNA, 25 bp, Mus musculus
caggtcccgatccagcgccgatgag

SEQ ID NO: 321259 - DNA, 25 bp, Mus musculus
caggtcccgatcgagcgccgatgag

SEQ ID NO: 321260 - DNA, 25 bp, Mus musculus
caggtccctcgaaggtccaataaac

SEQ ID NO: 321261 - DNA, 25 bp, Mus musculus
caggtccctcgatggtccaataaac

SEQ ID NO: 321262 - DNA, 25 bp, Mus musculus
caggtccctggcacggaattggaaa

SEQ ID NO: 321263 - DNA, 25 bp, Mus musculus
caggtccctggctcggaattggaaa

SEQ ID NO: 321264 - DNA, 25 bp, Mus musculus
caggtccctgggaatatccatagat

SEQ ID NO: 321265 - DNA, 25 bp, Mus musculus
caggtccctgggtatatccatagat

SEQ ID NO: 321266 - DNA, 25 bp, Mus musculus
caggtccctgttccgatttcatttg

SEQ ID NO: 321267 - DNA, 25 bp, Mus musculus
caggtccctgttgcgatttcatttg

SEQ ID NO: 321268 - DNA, 25 bp, Mus musculus
caggtcctaagtaaaattgctattc

SEQ ID NO: 321269 - DNA, 25 bp, Mus musculus
caggtcctaagttaaattgctattc

SEQ ID NO: 321270 - DNA, 25 bp, Mus musculus
caggtcctatggcaggtcactggta

SEQ ID NO: 321271 - DNA, 25 bp, Mus musculus
caggtcctatgggaggtcactggta

SEQ ID NO: 321272 - DNA, 25 bp, Mus musculus
caggtcctcagccttgtcagcatat

SEQ ID NO: 321273 - DNA, 25 bp, Mus musculus
caggtcctcagcgttgtcagcatat

SEQ ID NO: 321274 - DNA, 25 bp, Mus musculus
caggtcctcaggatctagcttcaag

SEQ ID NO: 321275 - DNA, 25 bp, Mus musculus
caggtcctcaggttctagcttcaag

SEQ ID NO: 321276 - DNA, 25 bp, Mus musculus
caggtcctcctacaaatctggtcct

SEQ ID NO: 321277 - DNA, 25 bp, Mus musculus
caggtcctcctagaaatctggtcct

SEQ ID NO: 321278 - DNA, 25 bp, Mus musculus
caggtcctcgtgaattgtgcaataa

SEQ ID NO: 321279 - DNA, 25 bp, Mus musculus
caggtcctcgtgtattgtgcaataa

SEQ ID NO: 321280 - DNA, 25 bp, Mus musculus
caggtcctctacactttagttaaca

SEQ ID NO: 321281 - DNA, 25 bp, Mus musculus
caggtcctctacattgttgatttga

SEQ ID NO: 321282 - DNA, 25 bp, Mus musculus
caggtcctctactctttagttaaca

SEQ ID NO: 321283 - DNA, 25 bp, Mus musculus
caggtcctctactttgttgatttga

SEQ ID NO: 321284 - DNA, 25 bp, Mus musculus
caggtcctctggaaaggcaagcagt

SEQ ID NO: 321285 - DNA, 25 bp, Mus musculus
caggtcctctggtaaggcaagcagt

SEQ ID NO: 321286 - DNA, 25 bp, Mus musculus
caggtcctgcagaggctgggcttca

SEQ ID NO: 321287 - DNA, 25 bp, Mus musculus
caggtcctgcagtggctgggcttca

SEQ ID NO: 321288 - DNA, 25 bp, Mus musculus
caggtcctggtgaatgctatcatca

SEQ ID NO: 321289 - DNA, 25 bp, Mus musculus
caggtcctggtgtatgctatcatca

SEQ ID NO: 321290 - DNA, 25 bp, Mus musculus
caggtccttcttctgttccgggaag

SEQ ID NO: 321291 - DNA, 25 bp, Mus musculus
caggtccttcttgtgttccgggaag

SEQ ID NO: 321292 - DNA, 25 bp, Mus musculus
caggtcgaatataccatttcaagtt

SEQ ID NO: 321293 - DNA, 25 bp, Mus musculus
caggtcgaatattccatttcaagtt

SEQ ID NO: 321294 - DNA, 25 bp, Mus musculus
caggtcgactttagacttcaagacc

SEQ ID NO: 321295 - DNA, 25 bp, Mus musculus
caggtcgacttttgacttcaagacc

SEQ ID NO: 321296 - DNA, 25 bp, Mus musculus
caggtcgcggtcaggtggtcggtga

SEQ ID NO: 321297 - DNA, 25 bp, Mus musculus
caggtcgcggtctggtggtcggtga

SEQ ID NO: 321298 - DNA, 25 bp, Mus musculus
caggtcgctacgattctacaacaaa

SEQ ID NO: 321299 - DNA, 25 bp, Mus musculus
caggtcgctacgtttctacaacaaa

SEQ ID NO: 321300 - DNA, 25 bp, Mus musculus
caggtcgctttgctttctcccttca

SEQ ID NO: 321301 - DNA, 25 bp, Mus musculus
caggtcgctttggtttctcccttca

SEQ ID NO: 321302 - DNA, 25 bp, Mus musculus
caggtcggaactctcccttaaggag

SEQ ID NO: 321303 - DNA, 25 bp, Mus musculus
caggtcggaactgtcccttaaggag

SEQ ID NO: 321304 - DNA, 25 bp, Mus musculus
caggtcggctctcagcaatacgggc

SEQ ID NO: 321305 - DNA, 25 bp, Mus musculus
caggtcggctctgagcaatacgggc

SEQ ID NO: 321306 - DNA, 25 bp, Mus musculus
caggtcggtctgattttggttccaa

SEQ ID NO: 321307 - DNA, 25 bp, Mus musculus
caggtcggtctgtttttggttccaa

SEQ ID NO: 321308 - DNA, 25 bp, Mus musculus
caggtctatcatatggtttgacaga

SEQ ID NO: 321309 - DNA, 25 bp, Mus musculus
caggtctatcatttggtttgacaga

SEQ ID NO: 321310 - DNA, 25 bp, Mus musculus
caggtctatgggaaccattagtatt

SEQ ID NO: 321311 - DNA, 25 bp, Mus musculus
caggtctatgggtaccattagtatt

SEQ ID NO: 321312 - DNA, 25 bp, Mus musculus
caggtctcaacgactccctagcggg

SEQ ID NO: 321313 - DNA, 25 bp, Mus musculus
caggtctcaacgtctccctagcggg

SEQ ID NO: 321314 - DNA, 25 bp, Mus musculus
caggtctccaacatgcctaacatta

SEQ ID NO: 321315 - DNA, 25 bp, Mus musculus
caggtctccaacttgcctaacatta

SEQ ID NO: 321316 - DNA, 25 bp, Mus musculus
caggtctctaaacccagtaccaggt

SEQ ID NO: 321317 - DNA, 25 bp, Mus musculus
caggtctctaaagccagtaccaggt

SEQ ID NO: 321318 - DNA, 25 bp, Mus musculus
caggtctctactctcattgctgtag

SEQ ID NO: 321319 - DNA, 25 bp, Mus musculus
caggtctctactgtcattgctgtag

SEQ ID NO: 321320 - DNA, 25 bp, Mus musculus
caggtctctcctatcattagatcaa

SEQ ID NO: 321321 - DNA, 25 bp, Mus musculus
caggtctctcctttcattagatcaa

SEQ ID NO: 321322 - DNA, 25 bp, Mus musculus
caggtctctggccatcattcagatt

SEQ ID NO: 321323 - DNA, 25 bp, Mus musculus
caggtctctggcgatcattcagatt

SEQ ID NO: 321324 - DNA, 25 bp, Mus musculus
caggtctgagtcaggtacatccctc

SEQ ID NO: 321325 - DNA, 25 bp, Mus musculus
caggtctgagtctggtacatccctc

SEQ ID NO: 321326 - DNA, 25 bp, Mus musculus
caggtctgagttctggttagtgctt

SEQ ID NO: 321327 - DNA, 25 bp, Mus musculus
caggtctgagttgtggttagtgctt

SEQ ID NO: 321328 - DNA, 25 bp, Mus musculus
caggtctgcggtactggacagccaa

SEQ ID NO: 321329 - DNA, 25 bp, Mus musculus
caggtctgcggttctggacagccaa

SEQ ID NO: 321330 - DNA, 25 bp, Mus musculus
caggtctggagtacgcttactcaga

SEQ ID NO: 321331 - DNA, 25 bp, Mus musculus
caggtctggagttcgcttactcaga

SEQ ID NO: 321332 - DNA, 25 bp, Mus musculus
caggtctggcccaccctcgggtggg

SEQ ID NO: 321333 - DNA, 25 bp, Mus musculus
caggtctggccctccctcgggtggg

SEQ ID NO: 321334 - DNA, 25 bp, Mus musculus
caggtctggcctccagtgggtttcc

SEQ ID NO: 321335 - DNA, 25 bp, Mus musculus
caggtctggcctgcagtgggtttcc

SEQ ID NO: 321336 - DNA, 25 bp, Mus musculus
caggtctggttccaggtccgaaatc

SEQ ID NO: 321337 - DNA, 25 bp, Mus musculus
caggtctggttcgaggtccgaaatc

SEQ ID NO: 321338 - DNA, 25 bp, Mus musculus
caggtctgtcagactttcgggttta

SEQ ID NO: 321339 - DNA, 25 bp, Mus musculus
caggtctgtcagtctttcgggttta

SEQ ID NO: 321340 - DNA, 25 bp, Mus musculus
caggtctgtggacctgcccctcaaa

SEQ ID NO: 321341 - DNA, 25 bp, Mus musculus
caggtctgtggagctgcccctcaaa

SEQ ID NO: 321342 - DNA, 25 bp, Mus musculus
caggtcttcagcacgcacaatggac

SEQ ID NO: 321343 - DNA, 25 bp, Mus musculus
caggtcttcagctcgcacaatggac

SEQ ID NO: 321344 - DNA, 25 bp, Mus musculus
caggtcttcctgcatgcaggtgtat

SEQ ID NO: 321345 - DNA, 25 bp, Mus musculus
caggtcttcctggatgcaggtgtat

SEQ ID NO: 321346 - DNA, 25 bp, Mus musculus
caggtcttcgtcctgtctgttttga

SEQ ID NO: 321347 - DNA, 25 bp, Mus musculus
caggtcttcgtcgtgtctgttttga

SEQ ID NO: 321348 - DNA, 25 bp, Mus musculus
caggtcttctcacacctgagctctg

SEQ ID NO: 321349 - DNA, 25 bp, Mus musculus
caggtcttctcagacctgagctctg

SEQ ID NO: 321350 - DNA, 25 bp, Mus musculus
caggtcttctggctttctaaaatct

SEQ ID NO: 321351 - DNA, 25 bp, Mus musculus
caggtcttctgggtttctaaaatct

SEQ ID NO: 321352 - DNA, 25 bp, Mus musculus
caggtcttgaaaacttggctccatt

SEQ ID NO: 321353 - DNA, 25 bp, Mus musculus
caggtcttgaaatcttggctccatt

SEQ ID NO: 321354 - DNA, 25 bp, Mus musculus
caggtcttggagacttccgtttata

SEQ ID NO: 321355 - DNA, 25 bp, Mus musculus
caggtcttggagtcttccgtttata

SEQ ID NO: 321356 - DNA, 25 bp, Mus musculus
caggtcttggctcctaatctgaggc

SEQ ID NO: 321357 - DNA, 25 bp, Mus musculus
caggtcttggctgctaatctgaggc

SEQ ID NO: 321358 - DNA, 25 bp, Mus musculus
caggtcttttttcctgttgtgtctg

SEQ ID NO: 321359 - DNA, 25 bp, Mus musculus
caggtcttttttgctgttgtgtctg

SEQ ID NO: 321360 - DNA, 25 bp, Mus musculus
caggtgaaaagccatatgcatatga

SEQ ID NO: 321361 - DNA, 25 bp, Mus musculus
caggtgaaaagcgatatgcatatga

SEQ ID NO: 321362 - DNA, 25 bp, Mus musculus
caggtgaacaggagtctagcgagac

SEQ ID NO: 321363 - DNA, 25 bp, Mus musculus
caggtgaacaggtgtctagcgagac

SEQ ID NO: 321364 - DNA, 25 bp, Mus musculus
caggtgaaccgcagggtatgcgaaa

SEQ ID NO: 321365 - DNA, 25 bp, Mus musculus
caggtgaaccgctgggtatgcgaaa

SEQ ID NO: 321366 - DNA, 25 bp, Mus musculus
caggtgaactatccacatggccaaa

SEQ ID NO: 321367 - DNA, 25 bp, Mus musculus
caggtgaactatgcacatggccaaa

SEQ ID NO: 321368 - DNA, 25 bp, Mus musculus
caggtgaatggccttcgcacatgaa

SEQ ID NO: 321369 - DNA, 25 bp, Mus musculus
caggtgaatggcgttcgcacatgaa

SEQ ID NO: 321370 - DNA, 25 bp, Mus musculus
caggtgacagctccgggaccagcca

SEQ ID NO: 321371 - DNA, 25 bp, Mus musculus
caggtgacagctgcgggaccagcca

SEQ ID NO: 321372 - DNA, 25 bp, Mus musculus
caggtgaccctgaggcacagccaga

SEQ ID NO: 321373 - DNA, 25 bp, Mus musculus
caggtgaccctgtggcacagccaga

SEQ ID NO: 321374 - DNA, 25 bp, Mus musculus
caggtgactgggaagccattcgctg

SEQ ID NO: 321375 - DNA, 25 bp, Mus musculus
caggtgactgggtagccattcgctg

SEQ ID NO: 321376 - DNA, 25 bp, Mus musculus
caggtgacttctactctgagtgcaa

SEQ ID NO: 321377 - DNA, 25 bp, Mus musculus
caggtgacttcttctctgagtgcaa

SEQ ID NO: 321378 - DNA, 25 bp, Mus musculus
caggtgagagccctctggatgacac

SEQ ID NO: 321379 - DNA, 25 bp, Mus musculus
caggtgagagccgtctggatgacac

SEQ ID NO: 321380 - DNA, 25 bp, Mus musculus
caggtgagctttccttatgtagttt

SEQ ID NO: 321381 - DNA, 25 bp, Mus musculus
caggtgagctttgcttatgtagttt

SEQ ID NO: 321382 - DNA, 25 bp, Mus musculus
caggtgagggcaattgttttgttta

SEQ ID NO: 321383 - DNA, 25 bp, Mus musculus
caggtgagggcatttgttttgttta

SEQ ID NO: 321384 - DNA, 25 bp, Mus musculus
caggtgagtagtattagtataattt

SEQ ID NO: 321385 - DNA, 25 bp, Mus musculus
caggtgagtagttttagtataattt

SEQ ID NO: 321386 - DNA, 25 bp, Mus musculus
caggtgagtgaacaacttgctttcc

SEQ ID NO: 321387 - DNA, 25 bp, Mus musculus
caggtgagtgaagaacttgctttcc

SEQ ID NO: 321388 - DNA, 25 bp, Mus musculus
caggtgatacagattctaggtgtgc

SEQ ID NO: 321389 - DNA, 25 bp, Mus musculus
caggtgatacagtttctaggtgtgc

SEQ ID NO: 321390 - DNA, 25 bp, Mus musculus
caggtgatctgtatgagttcaaggc

SEQ ID NO: 321391 - DNA, 25 bp, Mus musculus
caggtgatctgtttgagttcaaggc

SEQ ID NO: 321392 - DNA, 25 bp, Mus musculus
caggtgatgtgaccctatccccaca

SEQ ID NO: 321393 - DNA, 25 bp, Mus musculus
caggtgatgtgagcctatccccaca

SEQ ID NO: 321394 - DNA, 25 bp, Mus musculus
caggtgatgttcctagttcctttgt

SEQ ID NO: 321395 - DNA, 25 bp, Mus musculus
caggtgatgttcgtagttcctttgt

SEQ ID NO: 321396 - DNA, 25 bp, Mus musculus
caggtgattctcacttgggcacttt

SEQ ID NO: 321397 - DNA, 25 bp, Mus musculus
caggtgattctctcttgggcacttt

SEQ ID NO: 321398 - DNA, 25 bp, Mus musculus
caggtgatttgtaaatctctgcatc

SEQ ID NO: 321399 - DNA, 25 bp, Mus musculus
caggtgatttgttaatctctgcatc

SEQ ID NO: 321400 - DNA, 25 bp, Mus musculus
caggtgcaacttccccagtggcaga

SEQ ID NO: 321401 - DNA, 25 bp, Mus musculus
caggtgcaacttgcccagtggcaga

SEQ ID NO: 321402 - DNA, 25 bp, Mus musculus
caggtgcacttactattgcagggta

SEQ ID NO: 321403 - DNA, 25 bp, Mus musculus
caggtgcacttagtattgcagggta

SEQ ID NO: 321404 - DNA, 25 bp, Mus musculus
caggtgcagcacagcatgcttgttc

SEQ ID NO: 321405 - DNA, 25 bp, Mus musculus
caggtgcagcactgcatgcttgttc

SEQ ID NO: 321406 - DNA, 25 bp, Mus musculus
caggtgccagaacagtccatataga

SEQ ID NO: 321407 - DNA, 25 bp, Mus musculus
caggtgccagaagagtccatataga

SEQ ID NO: 321408 - DNA, 25 bp, Mus musculus
caggtgccagcgcagctgtaaatag

SEQ ID NO: 321409 - DNA, 25 bp, Mus musculus
caggtgccagcggagctgtaaatag

SEQ ID NO: 321410 - DNA, 25 bp, Mus musculus
caggtgccaggaaacggtgcgactt

SEQ ID NO: 321411 - DNA, 25 bp, Mus musculus
caggtgccaggatacggtgcgactt

SEQ ID NO: 321412 - DNA, 25 bp, Mus musculus
caggtgccatttcttctcagaaggc

SEQ ID NO: 321413 - DNA, 25 bp, Mus musculus
caggtgccatttgttctcagaaggc

SEQ ID NO: 321414 - DNA, 25 bp, Mus musculus
caggtgccctgtcttgtgtcactgt

SEQ ID NO: 321415 - DNA, 25 bp, Mus musculus
caggtgccctgtgttgtgtcactgt

SEQ ID NO: 321416 - DNA, 25 bp, Mus musculus
caggtgccgtgtactcattgtgaca

SEQ ID NO: 321417 - DNA, 25 bp, Mus musculus
caggtgccgtgttctcattgtgaca

SEQ ID NO: 321418 - DNA, 25 bp, Mus musculus
caggtgcctcccagcacggagagag

SEQ ID NO: 321419 - DNA, 25 bp, Mus musculus
caggtgcctccctgcacggagagag

SEQ ID NO: 321420 - DNA, 25 bp, Mus musculus
caggtgcctctgctttggaaggaca

SEQ ID NO: 321421 - DNA, 25 bp, Mus musculus
caggtgcctctggtttggaaggaca

SEQ ID NO: 321422 - DNA, 25 bp, Mus musculus
caggtgcctgaactcattgaagttc

SEQ ID NO: 321423 - DNA, 25 bp, Mus musculus
caggtgcctgaagtcattgaagttc

SEQ ID NO: 321424 - DNA, 25 bp, Mus musculus
caggtgcctgttacatagtcagtga

SEQ ID NO: 321425 - DNA, 25 bp, Mus musculus
caggtgcctgtttcatagtcagtga

SEQ ID NO: 321426 - DNA, 25 bp, Mus musculus
caggtgcctttgaggcctttgatac

SEQ ID NO: 321427 - DNA, 25 bp, Mus musculus
caggtgcctttgtggcctttgatac

SEQ ID NO: 321428 - DNA, 25 bp, Mus musculus
caggtgcgagaacgcaacctgaacc

SEQ ID NO: 321429 - DNA, 25 bp, Mus musculus
caggtgcgagaaggcaacctgaacc

SEQ ID NO: 321430 - DNA, 25 bp, Mus musculus
caggtgctaactctggttcccaggc

SEQ ID NO: 321431 - DNA, 25 bp, Mus musculus
caggtgctaactgtggttcccaggc

SEQ ID NO: 321432 - DNA, 25 bp, Mus musculus
caggtgctaagtatcagtgctaaat

SEQ ID NO: 321433 - DNA, 25 bp, Mus musculus
caggtgctaagtttcagtgctaaat

SEQ ID NO: 321434 - DNA, 25 bp, Mus musculus
caggtgctagttatgagaaggccca

SEQ ID NO: 321435 - DNA, 25 bp, Mus musculus
caggtgctagttttgagaaggccca

SEQ ID NO: 321436 - DNA, 25 bp, Mus musculus
caggtgctccctaccaagccgtggg

SEQ ID NO: 321437 - DNA, 25 bp, Mus musculus
caggtgctcccttccaagccgtggg

SEQ ID NO: 321438 - DNA, 25 bp, Mus musculus
caggtgctgaggcactcgttcattg

SEQ ID NO: 321439 - DNA, 25 bp, Mus musculus
caggtgctgagggactcgttcattg

SEQ ID NO: 321440 - DNA, 25 bp, Mus musculus
caggtgctgatcagctactactgaa

SEQ ID NO: 321441 - DNA, 25 bp, Mus musculus
caggtgctgatctgctactactgaa

SEQ ID NO: 321442 - DNA, 25 bp, Mus musculus
caggtgctgcttcccacactaggtt

SEQ ID NO: 321443 - DNA, 25 bp, Mus musculus
caggtgctgcttgccacactaggtt

SEQ ID NO: 321444 - DNA, 25 bp, Mus musculus
caggtgctgggcaactgctcagagc

SEQ ID NO: 321445 - DNA, 25 bp, Mus musculus
caggtgctgggctactgctcagagc

SEQ ID NO: 321446 - DNA, 25 bp, Mus musculus
caggtgcttatacagacgtataggc

SEQ ID NO: 321447 - DNA, 25 bp, Mus musculus
caggtgcttatagagacgtataggc

SEQ ID NO: 321448 - DNA, 25 bp, Mus musculus
caggtgctttgtccttgtacatatt

SEQ ID NO: 321449 - DNA, 25 bp, Mus musculus
caggtgctttgtgcttgtacatatt

SEQ ID NO: 321450 - DNA, 25 bp, Mus musculus
caggtggaatgaaagtgttcacccc

SEQ ID NO: 321451 - DNA, 25 bp, Mus musculus
caggtggaatgatagtgttcacccc

SEQ ID NO: 321452 - DNA, 25 bp, Mus musculus
caggtggagaagagtggctatcctt

SEQ ID NO: 321453 - DNA, 25 bp, Mus musculus
caggtggagaagtgtggctatcctt

SEQ ID NO: 321454 - DNA, 25 bp, Mus musculus
caggtggagacaataaggtgaccct

SEQ ID NO: 321455 - DNA, 25 bp, Mus musculus
caggtggagacattaaggtgaccct

SEQ ID NO: 321456 - DNA, 25 bp, Mus musculus
caggtggagccgctcagccagctaa

SEQ ID NO: 321457 - DNA, 25 bp, Mus musculus
caggtggagccggtcagccagctaa

SEQ ID NO: 321458 - DNA, 25 bp, Mus musculus
caggtggaggtcatacatcgccatt

SEQ ID NO: 321459 - DNA, 25 bp, Mus musculus
caggtggaggtcttacatcgccatt

SEQ ID NO: 321460 - DNA, 25 bp, Mus musculus
caggtggataatccggtttctgttt

SEQ ID NO: 321461 - DNA, 25 bp, Mus musculus
caggtggataatgcggtttctgttt

SEQ ID NO: 321462 - DNA, 25 bp, Mus musculus
caggtggatcctacacatggactgt

SEQ ID NO: 321463 - DNA, 25 bp, Mus musculus
caggtggatccttcacatggactgt

SEQ ID NO: 321464 - DNA, 25 bp, Mus musculus
caggtggatctaattcatgtttttg

SEQ ID NO: 321465 - DNA, 25 bp, Mus musculus
caggtggatctatttcatgtttttg

SEQ ID NO: 321466 - DNA, 25 bp, Mus musculus
caggtggatctcatgggcttgaggg

SEQ ID NO: 321467 - DNA, 25 bp, Mus musculus
caggtggatctcttgggcttgaggg

SEQ ID NO: 321468 - DNA, 25 bp, Mus musculus
caggtggatctgactatctacatga

SEQ ID NO: 321469 - DNA, 25 bp, Mus musculus
caggtggatctgtctatctacatga

SEQ ID NO: 321470 - DNA, 25 bp, Mus musculus
caggtggattaacagccccgatggt

SEQ ID NO: 321471 - DNA, 25 bp, Mus musculus
caggtggattaagagccccgatggt

SEQ ID NO: 321472 - DNA, 25 bp, Mus musculus
caggtggcaaagagagcccttgttt

SEQ ID NO: 321473 - DNA, 25 bp, Mus musculus
caggtggcaaagtgagcccttgttt

SEQ ID NO: 321474 - DNA, 25 bp, Mus musculus
caggtggcacccagttaggaggcta

SEQ ID NO: 321475 - DNA, 25 bp, Mus musculus
caggtggcaccctgttaggaggcta

SEQ ID NO: 321476 - DNA, 25 bp, Mus musculus
caggtggcagctacaagtttcccaa

SEQ ID NO: 321477 - DNA, 25 bp, Mus musculus
caggtggcagcttcaagtttcccaa

SEQ ID NO: 321478 - DNA, 25 bp, Mus musculus
caggtggccaaactgcggctccgca

SEQ ID NO: 321479 - DNA, 25 bp, Mus musculus
caggtggccaaagtgcggctccgca

SEQ ID NO: 321480 - DNA, 25 bp, Mus musculus
caggtggccacaaccagcaaagata

SEQ ID NO: 321481 - DNA, 25 bp, Mus musculus
caggtggccacatccagcaaagata

SEQ ID NO: 321482 - DNA, 25 bp, Mus musculus
caggtggcctccatttctgagagga

SEQ ID NO: 321483 - DNA, 25 bp, Mus musculus
caggtggcctccttttctgagagga

SEQ ID NO: 321484 - DNA, 25 bp, Mus musculus
caggtggcgcgcactacccttcttc

SEQ ID NO: 321485 - DNA, 25 bp, Mus musculus
caggtggcgcgctctacccttcttc

SEQ ID NO: 321486 - DNA, 25 bp, Mus musculus
caggtggcgggacgctcattcatct

SEQ ID NO: 321487 - DNA, 25 bp, Mus musculus
caggtggcgggaggctcattcatct

SEQ ID NO: 321488 - DNA, 25 bp, Mus musculus
caggtggctattcgttgtgaatcta

SEQ ID NO: 321489 - DNA, 25 bp, Mus musculus
caggtggctattggttgtgaatcta

SEQ ID NO: 321490 - DNA, 25 bp, Mus musculus
caggtggctcataacaacctacagc

SEQ ID NO: 321491 - DNA, 25 bp, Mus musculus
caggtggctcattacaacctacagc

SEQ ID NO: 321492 - DNA, 25 bp, Mus musculus
caggtggctcgacgttttcctttca

SEQ ID NO: 321493 - DNA, 25 bp, Mus musculus
caggtggctcgaggttttcctttca

SEQ ID NO: 321494 - DNA, 25 bp, Mus musculus
caggtggctgacacagctagggcct

SEQ ID NO: 321495 - DNA, 25 bp, Mus musculus
caggtggctgactcagctagggcct

SEQ ID NO: 321496 - DNA, 25 bp, Mus musculus
caggtgggaggcaccgccaaagttc

SEQ ID NO: 321497 - DNA, 25 bp, Mus musculus
caggtgggaggctccgccaaagttc

SEQ ID NO: 321498 - DNA, 25 bp, Mus musculus
caggtgggattccattgtctatgga

SEQ ID NO: 321499 - DNA, 25 bp, Mus musculus
caggtgggattcgattgtctatgga

SEQ ID NO: 321500 - DNA, 25 bp, Mus musculus
caggtgggccatcactttaggagca

SEQ ID NO: 321501 - DNA, 25 bp, Mus musculus
caggtgggccatgactttaggagca

SEQ ID NO: 321502 - DNA, 25 bp, Mus musculus
caggtgggcttactaactaggttgt

SEQ ID NO: 321503 - DNA, 25 bp, Mus musculus
caggtgggcttagtaactaggttgt

SEQ ID NO: 321504 - DNA, 25 bp, Mus musculus
caggtgggttttctcagttattgaa

SEQ ID NO: 321505 - DNA, 25 bp, Mus musculus
caggtgggttttgtcagttattgaa

SEQ ID NO: 321506 - DNA, 25 bp, Mus musculus
caggtggtaccgctttcatgccaga

SEQ ID NO: 321507 - DNA, 25 bp, Mus musculus
caggtggtaccggtttcatgccaga

SEQ ID NO: 321508 - DNA, 25 bp, Mus musculus
caggtggtagaactttcctcccagg

SEQ ID NO: 321509 - DNA, 25 bp, Mus musculus
caggtggtagaagtttcctcccagg

SEQ ID NO: 321510 - DNA, 25 bp, Mus musculus
caggtggtcctgagactaaaccatt

SEQ ID NO: 321511 - DNA, 25 bp, Mus musculus
caggtggtcctgtgactaaaccatt

SEQ ID NO: 321512 - DNA, 25 bp, Mus musculus
caggtggtctagcttccttccagcc

SEQ ID NO: 321513 - DNA, 25 bp, Mus musculus
caggtggtctaggttccttccagcc

SEQ ID NO: 321514 - DNA, 25 bp, Mus musculus
caggtggtgatgctgcgtaccttta

SEQ ID NO: 321515 - DNA, 25 bp, Mus musculus
caggtggtgatggtgcgtaccttta

SEQ ID NO: 321516 - DNA, 25 bp, Mus musculus
caggtggttacacttgcttggcttc

SEQ ID NO: 321517 - DNA, 25 bp, Mus musculus
caggtggttacagttgcttggcttc

SEQ ID NO: 321518 - DNA, 25 bp, Mus musculus
caggtggttcccctgggtctcctcg

SEQ ID NO: 321519 - DNA, 25 bp, Mus musculus
caggtggttcccgtgggtctcctcg

SEQ ID NO: 321520 - DNA, 25 bp, Mus musculus
caggtggttgtaaggcggaagtagt

SEQ ID NO: 321521 - DNA, 25 bp, Mus musculus
caggtggttgtatggcggaagtagt

SEQ ID NO: 321522 - DNA, 25 bp, Mus musculus
caggtggtttcgatcattcaattaa

SEQ ID NO: 321523 - DNA, 25 bp, Mus musculus
caggtggtttcgttcattcaattaa

SEQ ID NO: 321524 - DNA, 25 bp, Mus musculus
caggtggtttggatatttttgtact

SEQ ID NO: 321525 - DNA, 25 bp, Mus musculus
caggtggtttggttatttttgtact

SEQ ID NO: 321526 - DNA, 25 bp, Mus musculus
caggtggtttgtatggattagcagt

SEQ ID NO: 321527 - DNA, 25 bp, Mus musculus
caggtggtttgtttggattagcagt

SEQ ID NO: 321528 - DNA, 25 bp, Mus musculus
caggtgtaacggcttgagctgtccc

SEQ ID NO: 321529 - DNA, 25 bp, Mus musculus
caggtgtaacgggttgagctgtccc

SEQ ID NO: 321530 - DNA, 25 bp, Mus musculus
caggtgtacacgatggcatctccaa

SEQ ID NO: 321531 - DNA, 25 bp, Mus musculus
caggtgtacacgttggcatctccaa

SEQ ID NO: 321532 - DNA, 25 bp, Mus musculus
caggtgtacatcacactggtcaggt

SEQ ID NO: 321533 - DNA, 25 bp, Mus musculus
caggtgtacatctcactggtcaggt

SEQ ID NO: 321534 - DNA, 25 bp, Mus musculus
caggtgtacggaccgccacatttgc

SEQ ID NO: 321535 - DNA, 25 bp, Mus musculus
caggtgtacggagcgccacatttgc

SEQ ID NO: 321536 - DNA, 25 bp, Mus musculus
caggtgtactttatggagcttattt

SEQ ID NO: 321537 - DNA, 25 bp, Mus musculus
caggtgtactttttggagcttattt

SEQ ID NO: 321538 - DNA, 25 bp, Mus musculus
caggtgtcaccgcatgaagtagctt

SEQ ID NO: 321539 - DNA, 25 bp, Mus musculus
caggtgtcaccggatgaagtagctt

SEQ ID NO: 321540 - DNA, 25 bp, Mus musculus
caggtgtccaggagcacaggcacag

SEQ ID NO: 321541 - DNA, 25 bp, Mus musculus
caggtgtccaggtgcacaggcacag

SEQ ID NO: 321542 - DNA, 25 bp, Mus musculus
caggtgtcctctctgtttcagaata

SEQ ID NO: 321543 - DNA, 25 bp, Mus musculus
caggtgtcctctgtgtttcagaata

SEQ ID NO: 321544 - DNA, 25 bp, Mus musculus
caggtgtccttgctggtcatgacaa

SEQ ID NO: 321545 - DNA, 25 bp, Mus musculus
caggtgtccttggtggtcatgacaa

SEQ ID NO: 321546 - DNA, 25 bp, Mus musculus
caggtgtcgaatcgagcccagcagt

SEQ ID NO: 321547 - DNA, 25 bp, Mus musculus
caggtgtcgaatggagcccagcagt

SEQ ID NO: 321548 - DNA, 25 bp, Mus musculus
caggtgtctcaaccttgtgttttta

SEQ ID NO: 321549 - DNA, 25 bp, Mus musculus
caggtgtctcaagcttgtgttttta

SEQ ID NO: 321550 - DNA, 25 bp, Mus musculus
caggtgtctccactgggcaaaagaa

SEQ ID NO: 321551 - DNA, 25 bp, Mus musculus
caggtgtctccagtgggcaaaagaa

SEQ ID NO: 321552 - DNA, 25 bp, Mus musculus
caggtgtctggtccctcacggtgat

SEQ ID NO: 321553 - DNA, 25 bp, Mus musculus
caggtgtctggtgcctcacggtgat

SEQ ID NO: 321554 - DNA, 25 bp, Mus musculus
caggtgtctgtcaatggaagaagga

SEQ ID NO: 321555 - DNA, 25 bp, Mus musculus
caggtgtctgtctatggaagaagga

SEQ ID NO: 321556 - DNA, 25 bp, Mus musculus
caggtgtctgttagccagtggcagc

SEQ ID NO: 321557 - DNA, 25 bp, Mus musculus
caggtgtctgtttgccagtggcagc

SEQ ID NO: 321558 - DNA, 25 bp, Mus musculus
caggtgtcttgtaacagtgactcac

SEQ ID NO: 321559 - DNA, 25 bp, Mus musculus
caggtgtcttgttacagtgactcac

SEQ ID NO: 321560 - DNA, 25 bp, Mus musculus
caggtgtgacttaatggttgacttt

SEQ ID NO: 321561 - DNA, 25 bp, Mus musculus
caggtgtgactttatggttgacttt

SEQ ID NO: 321562 - DNA, 25 bp, Mus musculus
caggtgtgagtaccaccttcctgga

SEQ ID NO: 321563 - DNA, 25 bp, Mus musculus
caggtgtgagtagcaccttcctgga

SEQ ID NO: 321564 - DNA, 25 bp, Mus musculus
caggtgtgattgctttttgctcgta

SEQ ID NO: 321565 - DNA, 25 bp, Mus musculus
caggtgtgattggtttttgctcgta

SEQ ID NO: 321566 - DNA, 25 bp, Mus musculus
caggtgtgcaccactgggacggcat

SEQ ID NO: 321567 - DNA, 25 bp, Mus musculus
caggtgtgcacctctgggacggcat

SEQ ID NO: 321568 - DNA, 25 bp, Mus musculus
caggtgtgcggaaactctggataca

SEQ ID NO: 321569 - DNA, 25 bp, Mus musculus
caggtgtgcggatactctggataca

SEQ ID NO: 321570 - DNA, 25 bp, Mus musculus
caggtgtggcctagtctgtatttat

SEQ ID NO: 321571 - DNA, 25 bp, Mus musculus
caggtgtggccttgtctgtatttat

SEQ ID NO: 321572 - DNA, 25 bp, Mus musculus
caggtgtggctacgcatgacagctc

SEQ ID NO: 321573 - DNA, 25 bp, Mus musculus
caggtgtggctaggcatgacagctc

SEQ ID NO: 321574 - DNA, 25 bp, Mus musculus
caggtgtgggctacctgtaagacct

SEQ ID NO: 321575 - DNA, 25 bp, Mus musculus
caggtgtgggcttcctgtaagacct

SEQ ID NO: 321576 - DNA, 25 bp, Mus musculus
caggtgtggtgacccatgtctctaa

SEQ ID NO: 321577 - DNA, 25 bp, Mus musculus
caggtgtggtgagccatgtctctaa

SEQ ID NO: 321578 - DNA, 25 bp, Mus musculus
caggtgtgtgtgaccagtgttttat

SEQ ID NO: 321579 - DNA, 25 bp, Mus musculus
caggtgtgtgtgtccagtgttttat

SEQ ID NO: 321580 - DNA, 25 bp, Mus musculus
caggtgtgttgtattaagcagccac

SEQ ID NO: 321581 - DNA, 25 bp, Mus musculus
caggtgtgttgttttaagcagccac

SEQ ID NO: 321582 - DNA, 25 bp, Mus musculus
caggtgtgtttcaagttggttttct

SEQ ID NO: 321583 - DNA, 25 bp, Mus musculus
caggtgtgtttctagttggttttct

SEQ ID NO: 321584 - DNA, 25 bp, Mus musculus
caggtgttaacaagtgaaagtcttt

SEQ ID NO: 321585 - DNA, 25 bp, Mus musculus
caggtgttaacatgtgaaagtcttt

SEQ ID NO: 321586 - DNA, 25 bp, Mus musculus
caggtgttacctagagatgttaaac

SEQ ID NO: 321587 - DNA, 25 bp, Mus musculus
caggtgttaccttgagatgttaaac

SEQ ID NO: 321588 - DNA, 25 bp, Mus musculus
caggtgttatggagcactcccagaa

SEQ ID NO: 321589 - DNA, 25 bp, Mus musculus
caggtgttatggtgcactcccagaa

SEQ ID NO: 321590 - DNA, 25 bp, Mus musculus
caggtgttcacaaaagacccatctc

SEQ ID NO: 321591 - DNA, 25 bp, Mus musculus
caggtgttcacataagacccatctc

SEQ ID NO: 321592 - DNA, 25 bp, Mus musculus
caggtgttcagtcgcatgtgcttaa

SEQ ID NO: 321593 - DNA, 25 bp, Mus musculus
caggtgttcagtggcatgtgcttaa

SEQ ID NO: 321594 - DNA, 25 bp, Mus musculus
caggtgttcctgagcagtgtggtac

SEQ ID NO: 321595 - DNA, 25 bp, Mus musculus
caggtgttcctgtgcagtgtggtac

SEQ ID NO: 321596 - DNA, 25 bp, Mus musculus
caggtgttctagacctgtggccatc

SEQ ID NO: 321597 - DNA, 25 bp, Mus musculus
caggtgttctagtcctgtggccatc

SEQ ID NO: 321598 - DNA, 25 bp, Mus musculus
caggtgttctgtcagcttgcttgtg

SEQ ID NO: 321599 - DNA, 25 bp, Mus musculus
caggtgttctgtgagcttgcttgtg

SEQ ID NO: 321600 - DNA, 25 bp, Mus musculus
caggtgttcttgaaatggcatagaa

SEQ ID NO: 321601 - DNA, 25 bp, Mus musculus
caggtgttcttgtaatggcatagaa

SEQ ID NO: 321602 - DNA, 25 bp, Mus musculus
caggtgttgcatactagtcagatat

SEQ ID NO: 321603 - DNA, 25 bp, Mus musculus
caggtgttgcattctagtcagatat

SEQ ID NO: 321604 - DNA, 25 bp, Mus musculus
caggtgttggacagcaggaatcagt

SEQ ID NO: 321605 - DNA, 25 bp, Mus musculus
caggtgttggactgcaggaatcagt

SEQ ID NO: 321606 - DNA, 25 bp, Mus musculus
caggtgttgtttcctcttttgagac

SEQ ID NO: 321607 - DNA, 25 bp, Mus musculus
caggtgttgtttgctcttttgagac

SEQ ID NO: 321608 - DNA, 25 bp, Mus musculus
caggtgtttctgctgttgaagattc

SEQ ID NO: 321609 - DNA, 25 bp, Mus musculus
caggtgtttctggtgttgaagattc

SEQ ID NO: 321610 - DNA, 25 bp, Mus musculus
caggtgtttttccaaatcccttcag

SEQ ID NO: 321611 - DNA, 25 bp, Mus musculus
caggtgtttttcgaaatcccttcag

SEQ ID NO: 321612 - DNA, 25 bp, Mus musculus
caggttaaccctagcaatgcagagc

SEQ ID NO: 321613 - DNA, 25 bp, Mus musculus
caggttaacccttgcaatgcagagc

SEQ ID NO: 321614 - DNA, 25 bp, Mus musculus
caggttaaccttcgcagtgtgtaca

SEQ ID NO: 321615 - DNA, 25 bp, Mus musculus
caggttaaccttggcagtgtgtaca

SEQ ID NO: 321616 - DNA, 25 bp, Mus musculus
caggttaagcccactgatcacataa

SEQ ID NO: 321617 - DNA, 25 bp, Mus musculus
caggttaagccctctgatcacataa

SEQ ID NO: 321618 - DNA, 25 bp, Mus musculus
caggttaagtggacaacttgcccca

SEQ ID NO: 321619 - DNA, 25 bp, Mus musculus
caggttaagtggtcaacttgcccca

SEQ ID NO: 321620 - DNA, 25 bp, Mus musculus
caggttacaacacgatgctcactaa

SEQ ID NO: 321621 - DNA, 25 bp, Mus musculus
caggttacaacaggatgctcactaa

SEQ ID NO: 321622 - DNA, 25 bp, Mus musculus
caggttacgggacactgggactcct

SEQ ID NO: 321623 - DNA, 25 bp, Mus musculus
caggttacgggagactgggactcct

SEQ ID NO: 321624 - DNA, 25 bp, Mus musculus
caggttactcatccgtgtgtccata

SEQ ID NO: 321625 - DNA, 25 bp, Mus musculus
caggttactcatgcgtgtgtccata

SEQ ID NO: 321626 - DNA, 25 bp, Mus musculus
caggttacttgaacggttgtttatc

SEQ ID NO: 321627 - DNA, 25 bp, Mus musculus
caggttacttgatcggttgtttatc

SEQ ID NO: 321628 - DNA, 25 bp, Mus musculus
caggttagcctcaggttgattccca

SEQ ID NO: 321629 - DNA, 25 bp, Mus musculus
caggttagcctctggttgattccca

SEQ ID NO: 321630 - DNA, 25 bp, Mus musculus
caggttagctcacccttttccaaaa

SEQ ID NO: 321631 - DNA, 25 bp, Mus musculus
caggttagctcagccttttccaaaa

SEQ ID NO: 321632 - DNA, 25 bp, Mus musculus
caggttaggaccagcggccagcaac

SEQ ID NO: 321633 - DNA, 25 bp, Mus musculus
caggttaggacctgcggccagcaac

SEQ ID NO: 321634 - DNA, 25 bp, Mus musculus
caggttagtacaattttccatgcaa

SEQ ID NO: 321635 - DNA, 25 bp, Mus musculus
caggttagtacatttttccatgcaa

SEQ ID NO: 321636 - DNA, 25 bp, Mus musculus
caggttagtattcgctctgagtctc

SEQ ID NO: 321637 - DNA, 25 bp, Mus musculus
caggttagtattggctctgagtctc

SEQ ID NO: 321638 - DNA, 25 bp, Mus musculus
caggttagtggtagccaatatggta

SEQ ID NO: 321639 - DNA, 25 bp, Mus musculus
caggttagtggttgccaatatggta

SEQ ID NO: 321640 - DNA, 25 bp, Mus musculus
caggttagttgcattgtggatttct

SEQ ID NO: 321641 - DNA, 25 bp, Mus musculus
caggttagttgctttgtggatttct

SEQ ID NO: 321642 - DNA, 25 bp, Mus musculus
caggttatccttcagcttttgttct

SEQ ID NO: 321643 - DNA, 25 bp, Mus musculus
caggttatccttgagcttttgttct

SEQ ID NO: 321644 - DNA, 25 bp, Mus musculus
caggttatgatcagctggccatgta

SEQ ID NO: 321645 - DNA, 25 bp, Mus musculus
caggttatgatctgctggccatgta

SEQ ID NO: 321646 - DNA, 25 bp, Mus musculus
caggttcaatggaaaccctgttgta

SEQ ID NO: 321647 - DNA, 25 bp, Mus musculus
caggttcaatggtaaccctgttgta

SEQ ID NO: 321648 - DNA, 25 bp, Mus musculus
caggttcaccggaccaggaaggctt

SEQ ID NO: 321649 - DNA, 25 bp, Mus musculus
caggttcaccggtccaggaaggctt

SEQ ID NO: 321650 - DNA, 25 bp, Mus musculus
caggttcactgtcgtccaggaagca

SEQ ID NO: 321651 - DNA, 25 bp, Mus musculus
caggttcactgtggtccaggaagca

SEQ ID NO: 321652 - DNA, 25 bp, Mus musculus
caggttcagagcactgttttttctt

SEQ ID NO: 321653 - DNA, 25 bp, Mus musculus
caggttcagagctctgttttttctt

SEQ ID NO: 321654 - DNA, 25 bp, Mus musculus
caggttcaggaaccactgtgagctc

SEQ ID NO: 321655 - DNA, 25 bp, Mus musculus
caggttcaggaagcactgtgagctc

SEQ ID NO: 321656 - DNA, 25 bp, Mus musculus
caggttcagtcccatgtgcacatgg

SEQ ID NO: 321657 - DNA, 25 bp, Mus musculus
caggttcagtccgatgtgcacatgg

SEQ ID NO: 321658 - DNA, 25 bp, Mus musculus
caggttcagtgaagtactacagagt

SEQ ID NO: 321659 - DNA, 25 bp, Mus musculus
caggttcagtgacagcatcagttat

SEQ ID NO: 321660 - DNA, 25 bp, Mus musculus
caggttcagtgagagcatcagttat

SEQ ID NO: 321661 - DNA, 25 bp, Mus musculus
caggttcagtgatgtactacagagt

SEQ ID NO: 321662 - DNA, 25 bp, Mus musculus
caggttcagttgagtgtctctggaa

SEQ ID NO: 321663 - DNA, 25 bp, Mus musculus
caggttcagttgtgtgtctctggaa

SEQ ID NO: 321664 - DNA, 25 bp, Mus musculus
caggttccaagcaggcagtaggcat

SEQ ID NO: 321665 - DNA, 25 bp, Mus musculus
caggttccaagctggcagtaggcat

SEQ ID NO: 321666 - DNA, 25 bp, Mus musculus
caggttccaaggctggttctgttta

SEQ ID NO: 321667 - DNA, 25 bp, Mus musculus
caggttccaagggtggttctgttta

SEQ ID NO: 321668 - DNA, 25 bp, Mus musculus
caggttccacctctggctgtcagag

SEQ ID NO: 321669 - DNA, 25 bp, Mus musculus
caggttccacctgtggctgtcagag

SEQ ID NO: 321670 - DNA, 25 bp, Mus musculus
caggttccactgctctcacagaagt

SEQ ID NO: 321671 - DNA, 25 bp, Mus musculus
caggttccactgctgacattgtgct

SEQ ID NO: 321672 - DNA, 25 bp, Mus musculus
caggttccactggtctcacagaagt

SEQ ID NO: 321673 - DNA, 25 bp, Mus musculus
caggttccactggtgacattgtgct

SEQ ID NO: 321674 - DNA, 25 bp, Mus musculus
caggttccagtgacaagtgactcat

SEQ ID NO: 321675 - DNA, 25 bp, Mus musculus
caggttccagtgagtgcccagggat

SEQ ID NO: 321676 - DNA, 25 bp, Mus musculus
caggttccagtgtcaagtgactcat

SEQ ID NO: 321677 - DNA, 25 bp, Mus musculus
caggttccagtgtgtgcccagggat

SEQ ID NO: 321678 - DNA, 25 bp, Mus musculus
caggttcccagaactgcacgctgag

SEQ ID NO: 321679 - DNA, 25 bp, Mus musculus
caggttcccagatctgcacgctgag

SEQ ID NO: 321680 - DNA, 25 bp, Mus musculus
caggttccccgtaggctccgagaat

SEQ ID NO: 321681 - DNA, 25 bp, Mus musculus
caggttccccgttggctccgagaat

SEQ ID NO: 321682 - DNA, 25 bp, Mus musculus
caggttcccggtctctagtagttag

SEQ ID NO: 321683 - DNA, 25 bp, Mus musculus
caggttcccggtgtctagtagttag

SEQ ID NO: 321684 - DNA, 25 bp, Mus musculus
caggttccctttcctacactttgta

SEQ ID NO: 321685 - DNA, 25 bp, Mus musculus
caggttccctttgctacactttgta

SEQ ID NO: 321686 - DNA, 25 bp, Mus musculus
caggttcctattcgtggttagaaca

SEQ ID NO: 321687 - DNA, 25 bp, Mus musculus
caggttcctattggtggttagaaca

SEQ ID NO: 321688 - DNA, 25 bp, Mus musculus
caggttcctcagaaccagggtgtgt

SEQ ID NO: 321689 - DNA, 25 bp, Mus musculus
caggttcctcagtaccagggtgtgt

SEQ ID NO: 321690 - DNA, 25 bp, Mus musculus
caggttcctccacaaatgagataca

SEQ ID NO: 321691 - DNA, 25 bp, Mus musculus
caggttcctccagaaatgagataca

SEQ ID NO: 321692 - DNA, 25 bp, Mus musculus
caggttcctgagagcctctggtgga

SEQ ID NO: 321693 - DNA, 25 bp, Mus musculus
caggttcctgagtgcctctggtgga

SEQ ID NO: 321694 - DNA, 25 bp, Mus musculus
caggttcctgcccaggaggctcttt

SEQ ID NO: 321695 - DNA, 25 bp, Mus musculus
caggttcctgccgaggaggctcttt

SEQ ID NO: 321696 - DNA, 25 bp, Mus musculus
caggttcctgtgattcaattggtgt

SEQ ID NO: 321697 - DNA, 25 bp, Mus musculus
caggttcctgtgtttcaattggtgt

SEQ ID NO: 321698 - DNA, 25 bp, Mus musculus
caggttcggcacaggactcctttta

SEQ ID NO: 321699 - DNA, 25 bp, Mus musculus
caggttcggcactggactcctttta

SEQ ID NO: 321700 - DNA, 25 bp, Mus musculus
caggttctagggattctcaggttat

SEQ ID NO: 321701 - DNA, 25 bp, Mus musculus
caggttctagggtttctcaggttat

SEQ ID NO: 321702 - DNA, 25 bp, Mus musculus
caggttctagttaatggatgtttcc

SEQ ID NO: 321703 - DNA, 25 bp, Mus musculus
caggttctagtttatggatgtttcc

SEQ ID NO: 321704 - DNA, 25 bp, Mus musculus
caggttctcactcgttgctgctggg

SEQ ID NO: 321705 - DNA, 25 bp, Mus musculus
caggttctcactggttgctgctggg

SEQ ID NO: 321706 - DNA, 25 bp, Mus musculus
caggttctcagccattgtcggaatg

SEQ ID NO: 321707 - DNA, 25 bp, Mus musculus
caggttctcagcgattgtcggaatg

SEQ ID NO: 321708 - DNA, 25 bp, Mus musculus
caggttctcagtatatggttctagt

SEQ ID NO: 321709 - DNA, 25 bp, Mus musculus
caggttctcagtttatggttctagt

SEQ ID NO: 321710 - DNA, 25 bp, Mus musculus
caggttctcgtacattctgtcatga

SEQ ID NO: 321711 - DNA, 25 bp, Mus musculus
caggttctcgtagattctgtcatga

SEQ ID NO: 321712 - DNA, 25 bp, Mus musculus
caggttctctctacattagattcag

SEQ ID NO: 321713 - DNA, 25 bp, Mus musculus
caggttctctcttcattagattcag

SEQ ID NO: 321714 - DNA, 25 bp, Mus musculus
caggttctgagcaggtaactgatac

SEQ ID NO: 321715 - DNA, 25 bp, Mus musculus
caggttctgagctggtaactgatac

SEQ ID NO: 321716 - DNA, 25 bp, Mus musculus
caggttctgcatcggatttactcac

SEQ ID NO: 321717 - DNA, 25 bp, Mus musculus
caggttctgcatgggatttactcac

SEQ ID NO: 321718 - DNA, 25 bp, Mus musculus
caggttctgcctctgtggattaaca

SEQ ID NO: 321719 - DNA, 25 bp, Mus musculus
caggttctgcctgtgtggattaaca

SEQ ID NO: 321720 - DNA, 25 bp, Mus musculus
caggttctgcttctagtgtccttgg

SEQ ID NO: 321721 - DNA, 25 bp, Mus musculus
caggttctgcttgtagtgtccttgg

SEQ ID NO: 321722 - DNA, 25 bp, Mus musculus
caggttctgtgtctcaaagtagatc

SEQ ID NO: 321723 - DNA, 25 bp, Mus musculus
caggttctgtgtgtcaaagtagatc

SEQ ID NO: 321724 - DNA, 25 bp, Mus musculus
caggttctgtttctggagtcatttt

SEQ ID NO: 321725 - DNA, 25 bp, Mus musculus
caggttctgtttgtggagtcatttt

SEQ ID NO: 321726 - DNA, 25 bp, Mus musculus
caggttcttagcaaaaatgtggccc

SEQ ID NO: 321727 - DNA, 25 bp, Mus musculus
caggttcttagctaaaatgtggccc

SEQ ID NO: 321728 - DNA, 25 bp, Mus musculus
caggttcttccaattggcttttgag

SEQ ID NO: 321729 - DNA, 25 bp, Mus musculus
caggttcttccatttggcttttgag

SEQ ID NO: 321730 - DNA, 25 bp, Mus musculus
caggttcttgaaccacatccaactt

SEQ ID NO: 321731 - DNA, 25 bp, Mus musculus
caggttcttgaagcacatccaactt

SEQ ID NO: 321732 - DNA, 25 bp, Mus musculus
caggttctttacagaattgcttcaa

SEQ ID NO: 321733 - DNA, 25 bp, Mus musculus
caggttctttactgaattgcttcaa

SEQ ID NO: 321734 - DNA, 25 bp, Mus musculus
caggttctttccagagcactgcaaa

SEQ ID NO: 321735 - DNA, 25 bp, Mus musculus
caggttctttcctgagcactgcaaa

SEQ ID NO: 321736 - DNA, 25 bp, Mus musculus
caggttctttttctcctatgcagag

SEQ ID NO: 321737 - DNA, 25 bp, Mus musculus
caggttctttttgtcctatgcagag

SEQ ID NO: 321738 - DNA, 25 bp, Mus musculus
caggttgaacggatgcagatgatca

SEQ ID NO: 321739 - DNA, 25 bp, Mus musculus
caggttgaacggttgcagatgatca

SEQ ID NO: 321740 - DNA, 25 bp, Mus musculus
caggttgacctgacagcgttgcaga

SEQ ID NO: 321741 - DNA, 25 bp, Mus musculus
caggttgacctgtcagcgttgcaga

SEQ ID NO: 321742 - DNA, 25 bp, Mus musculus
caggttgagcatccaagcgccatta

SEQ ID NO: 321743 - DNA, 25 bp, Mus musculus
caggttgagcatgcaagcgccatta

SEQ ID NO: 321744 - DNA, 25 bp, Mus musculus
caggttgaggctctcatttgcaaag

SEQ ID NO: 321745 - DNA, 25 bp, Mus musculus
caggttgaggctgtcatttgcaaag

SEQ ID NO: 321746 - DNA, 25 bp, Mus musculus
caggttgagtggatcacaactctat

SEQ ID NO: 321747 - DNA, 25 bp, Mus musculus
caggttgagtggttcacaactctat

SEQ ID NO: 321748 - DNA, 25 bp, Mus musculus
caggttgatcccagtgtgtgcgcca

SEQ ID NO: 321749 - DNA, 25 bp, Mus musculus
caggttgatccctgtgtgtgcgcca

SEQ ID NO: 321750 - DNA, 25 bp, Mus musculus
caggttgattcaccccaaactcaaa

SEQ ID NO: 321751 - DNA, 25 bp, Mus musculus
caggttgattcagcccaaactcaaa

SEQ ID NO: 321752 - DNA, 25 bp, Mus musculus
caggttgatttaatccatttggatt

SEQ ID NO: 321753 - DNA, 25 bp, Mus musculus
caggttgatttattccatttggatt

SEQ ID NO: 321754 - DNA, 25 bp, Mus musculus
caggttgcagcaagatgttcataat

SEQ ID NO: 321755 - DNA, 25 bp, Mus musculus
caggttgcagcatgatgttcataat

SEQ ID NO: 321756 - DNA, 25 bp, Mus musculus
caggttgcccgaccctggattcatt

SEQ ID NO: 321757 - DNA, 25 bp, Mus musculus
caggttgcccgagcctggattcatt

SEQ ID NO: 321758 - DNA, 25 bp, Mus musculus
caggttgcggtgaatctcagtgaca

SEQ ID NO: 321759 - DNA, 25 bp, Mus musculus
caggttgcggtgtatctcagtgaca

SEQ ID NO: 321760 - DNA, 25 bp, Mus musculus
caggttgctgatatctgtgtggttt

SEQ ID NO: 321761 - DNA, 25 bp, Mus musculus
caggttgctgatttctgtgtggttt

SEQ ID NO: 321762 - DNA, 25 bp, Mus musculus
caggttgctgtcactgcgctgataa

SEQ ID NO: 321763 - DNA, 25 bp, Mus musculus
caggttgctgtctctgcgctgataa

SEQ ID NO: 321764 - DNA, 25 bp, Mus musculus
caggttgcttggactaagccaggca

SEQ ID NO: 321765 - DNA, 25 bp, Mus musculus
caggttgcttggtctaagccaggca

SEQ ID NO: 321766 - DNA, 25 bp, Mus musculus
caggttggactcacaatgtgaaccc

SEQ ID NO: 321767 - DNA, 25 bp, Mus musculus
caggttggactctcaatgtgaaccc

SEQ ID NO: 321768 - DNA, 25 bp, Mus musculus
caggttggagatactgccagccggc

SEQ ID NO: 321769 - DNA, 25 bp, Mus musculus
caggttggagattctgccagccggc

SEQ ID NO: 321770 - DNA, 25 bp, Mus musculus
caggttggcagtacaccagttactt

SEQ ID NO: 321771 - DNA, 25 bp, Mus musculus
caggttggcagttcaccagttactt

SEQ ID NO: 321772 - DNA, 25 bp, Mus musculus
caggttggcattacagaagcatggg

SEQ ID NO: 321773 - DNA, 25 bp, Mus musculus
caggttggcatttcagaagcatggg

SEQ ID NO: 321774 - DNA, 25 bp, Mus musculus
caggttggcccacaatagttacaca

SEQ ID NO: 321775 - DNA, 25 bp, Mus musculus
caggttggcccagaatagttacaca

SEQ ID NO: 321776 - DNA, 25 bp, Mus musculus
caggttggccttactgaccttctgc

SEQ ID NO: 321777 - DNA, 25 bp, Mus musculus
caggttggcctttctgaccttctgc

SEQ ID NO: 321778 - DNA, 25 bp, Mus musculus
caggttgggaagagcccttgctgaa

SEQ ID NO: 321779 - DNA, 25 bp, Mus musculus
caggttgggaagtgcccttgctgaa

SEQ ID NO: 321780 - DNA, 25 bp, Mus musculus
caggttggtctgagaggatgtctat

SEQ ID NO: 321781 - DNA, 25 bp, Mus musculus
caggttggtctgtgaggatgtctat

SEQ ID NO: 321782 - DNA, 25 bp, Mus musculus
caggttgtcacgctactcaatgaac

SEQ ID NO: 321783 - DNA, 25 bp, Mus musculus
caggttgtcacggtactcaatgaac

SEQ ID NO: 321784 - DNA, 25 bp, Mus musculus
caggttgtcaggattagtagcaatc

SEQ ID NO: 321785 - DNA, 25 bp, Mus musculus
caggttgtcaggtttagtagcaatc

SEQ ID NO: 321786 - DNA, 25 bp, Mus musculus
caggttgtcagtcgtggcagcaatt

SEQ ID NO: 321787 - DNA, 25 bp, Mus musculus
caggttgtcagtggtggcagcaatt

SEQ ID NO: 321788 - DNA, 25 bp, Mus musculus
caggttgtcataaccttctatgagg

SEQ ID NO: 321789 - DNA, 25 bp, Mus musculus
caggttgtcatatccttctatgagg

SEQ ID NO: 321790 - DNA, 25 bp, Mus musculus
caggttgtccttatggacctcagtc

SEQ ID NO: 321791 - DNA, 25 bp, Mus musculus
caggttgtccttttggacctcagtc

SEQ ID NO: 321792 - DNA, 25 bp, Mus musculus
caggttgtctccagcgacttcaaca

SEQ ID NO: 321793 - DNA, 25 bp, Mus musculus
caggttgtctcctgcgacttcaaca

SEQ ID NO: 321794 - DNA, 25 bp, Mus musculus
caggttgtgagcatctggtctggta

SEQ ID NO: 321795 - DNA, 25 bp, Mus musculus
caggttgtgagcttctggtctggta

SEQ ID NO: 321796 - DNA, 25 bp, Mus musculus
caggttgttcctccaattcttggga

SEQ ID NO: 321797 - DNA, 25 bp, Mus musculus
caggttgttcctgcaattcttggga

SEQ ID NO: 321798 - DNA, 25 bp, Mus musculus
caggttgttctaatccttagaggtc

SEQ ID NO: 321799 - DNA, 25 bp, Mus musculus
caggttgttctattccttagaggtc

SEQ ID NO: 321800 - DNA, 25 bp, Mus musculus
caggttgttctcagagtgctttaca

SEQ ID NO: 321801 - DNA, 25 bp, Mus musculus
caggttgttctctgagtgctttaca

SEQ ID NO: 321802 - DNA, 25 bp, Mus musculus
caggttgttctgatagtatcatttc

SEQ ID NO: 321803 - DNA, 25 bp, Mus musculus
caggttgttctgttagtatcatttc

SEQ ID NO: 321804 - DNA, 25 bp, Mus musculus
caggttgtttacaagaatccaactg

SEQ ID NO: 321805 - DNA, 25 bp, Mus musculus
caggttgtttactagaatccaactg

SEQ ID NO: 321806 - DNA, 25 bp, Mus musculus
caggttgttttccttagctgtccgt

SEQ ID NO: 321807 - DNA, 25 bp, Mus musculus
caggttgttttcgttagctgtccgt

SEQ ID NO: 321808 - DNA, 25 bp, Mus musculus
caggttgtttttccctcagttattg

SEQ ID NO: 321809 - DNA, 25 bp, Mus musculus
caggttgtttttgcctcagttattg

SEQ ID NO: 321810 - DNA, 25 bp, Mus musculus
caggtttacacgaactccggttgat

SEQ ID NO: 321811 - DNA, 25 bp, Mus musculus
caggtttacacgtactccggttgat

SEQ ID NO: 321812 - DNA, 25 bp, Mus musculus
caggtttacatcaggcttggattca

SEQ ID NO: 321813 - DNA, 25 bp, Mus musculus
caggtttacatctggcttggattca

SEQ ID NO: 321814 - DNA, 25 bp, Mus musculus
caggtttactaaatctcggaggctt

SEQ ID NO: 321815 - DNA, 25 bp, Mus musculus
caggtttactaattctcggaggctt

SEQ ID NO: 321816 - DNA, 25 bp, Mus musculus
caggtttagagtacgcaccaggtgg

SEQ ID NO: 321817 - DNA, 25 bp, Mus musculus
caggtttagagttcgcaccaggtgg

SEQ ID NO: 321818 - DNA, 25 bp, Mus musculus
caggtttatggtatctgctccttgc

SEQ ID NO: 321819 - DNA, 25 bp, Mus musculus
caggtttatggtttctgctccttgc

SEQ ID NO: 321820 - DNA, 25 bp, Mus musculus
caggtttattcactcccagagtcaa

SEQ ID NO: 321821 - DNA, 25 bp, Mus musculus
caggtttattcagtcccagagtcaa

SEQ ID NO: 321822 - DNA, 25 bp, Mus musculus
caggtttcacttatgtttggcacaa

SEQ ID NO: 321823 - DNA, 25 bp, Mus musculus
caggtttcacttttgtttggcacaa

SEQ ID NO: 321824 - DNA, 25 bp, Mus musculus
caggtttcagatccccttactaaca

SEQ ID NO: 321825 - DNA, 25 bp, Mus musculus
caggtttcagatgcccttactaaca

SEQ ID NO: 321826 - DNA, 25 bp, Mus musculus
caggtttcccagatcgtggcgtttg

SEQ ID NO: 321827 - DNA, 25 bp, Mus musculus
caggtttcccagttcgtggcgtttg

SEQ ID NO: 321828 - DNA, 25 bp, Mus musculus
caggtttccccaaattcttaagcat

SEQ ID NO: 321829 - DNA, 25 bp, Mus musculus
caggtttccccatattcttaagcat

SEQ ID NO: 321830 - DNA, 25 bp, Mus musculus
caggtttcctgtatcctttagtagg

SEQ ID NO: 321831 - DNA, 25 bp, Mus musculus
caggtttcctgtttcctttagtagg

SEQ ID NO: 321832 - DNA, 25 bp, Mus musculus
caggtttctcctaaggctgggtgag

SEQ ID NO: 321833 - DNA, 25 bp, Mus musculus
caggtttctccttaggctgggtgag

SEQ ID NO: 321834 - DNA, 25 bp, Mus musculus
caggtttctcgtatatgtgtgtact

SEQ ID NO: 321835 - DNA, 25 bp, Mus musculus
caggtttctcgtttatgtgtgtact

SEQ ID NO: 321836 - DNA, 25 bp, Mus musculus
caggtttctgatcgtgtgcgcagca

SEQ ID NO: 321837 - DNA, 25 bp, Mus musculus
caggtttctgatggtgtgcgcagca

SEQ ID NO: 321838 - DNA, 25 bp, Mus musculus
caggtttctgcaacttgcactttga

SEQ ID NO: 321839 - DNA, 25 bp, Mus musculus
caggtttctgcatcttgcactttga

SEQ ID NO: 321840 - DNA, 25 bp, Mus musculus
caggtttcttccaagatggctaaga

SEQ ID NO: 321841 - DNA, 25 bp, Mus musculus
caggtttcttcctagatggctaaga

SEQ ID NO: 321842 - DNA, 25 bp, Mus musculus
caggtttgaatgacaccggcatcat

SEQ ID NO: 321843 - DNA, 25 bp, Mus musculus
caggtttgaatgtcaccggcatcat

SEQ ID NO: 321844 - DNA, 25 bp, Mus musculus
caggtttgacagagccggaattatt

SEQ ID NO: 321845 - DNA, 25 bp, Mus musculus
caggtttgacagtgccggaattatt

SEQ ID NO: 321846 - DNA, 25 bp, Mus musculus
caggtttgatttactgcgctctcag

SEQ ID NO: 321847 - DNA, 25 bp, Mus musculus
caggtttgattttctgcgctctcag

SEQ ID NO: 321848 - DNA, 25 bp, Mus musculus
caggtttgctctctggtgcttagga

SEQ ID NO: 321849 - DNA, 25 bp, Mus musculus
caggtttgctctgtggtgcttagga

SEQ ID NO: 321850 - DNA, 25 bp, Mus musculus
caggtttgctgcagttccgggtgca

SEQ ID NO: 321851 - DNA, 25 bp, Mus musculus
caggtttgctgctgttccgggtgca

SEQ ID NO: 321852 - DNA, 25 bp, Mus musculus
caggtttgctgtctgagcccataag

SEQ ID NO: 321853 - DNA, 25 bp, Mus musculus
caggtttgctgtgtgagcccataag

SEQ ID NO: 321854 - DNA, 25 bp, Mus musculus
caggtttggcttatggcttgaacag

SEQ ID NO: 321855 - DNA, 25 bp, Mus musculus
caggtttggcttttggcttgaacag

SEQ ID NO: 321856 - DNA, 25 bp, Mus musculus
caggtttgtttaaccatcatctgtg

SEQ ID NO: 321857 - DNA, 25 bp, Mus musculus
caggtttgtttaatatcatcttttc

SEQ ID NO: 321858 - DNA, 25 bp, Mus musculus
caggtttgtttaccagatcagacag

SEQ ID NO: 321859 - DNA, 25 bp, Mus musculus
caggtttgtttagcagatcagacag

SEQ ID NO: 321860 - DNA, 25 bp, Mus musculus
caggtttgtttatccatcatctgtg

SEQ ID NO: 321861 - DNA, 25 bp, Mus musculus
caggtttgtttattatcatcttttc

SEQ ID NO: 321862 - DNA, 25 bp, Mus musculus
caggttttattgaccctttgagcag

SEQ ID NO: 321863 - DNA, 25 bp, Mus musculus
caggttttattgtccctttgagcag

SEQ ID NO: 321864 - DNA, 25 bp, Mus musculus
caggttttcagtcggcaaagcctcc

SEQ ID NO: 321865 - DNA, 25 bp, Mus musculus
caggttttcagtgggcaaagcctcc

SEQ ID NO: 321866 - DNA, 25 bp, Mus musculus
caggttttcattatgatggtagaat

SEQ ID NO: 321867 - DNA, 25 bp, Mus musculus
caggttttcattttgatggtagaat

SEQ ID NO: 321868 - DNA, 25 bp, Mus musculus
caggttttctgtacaatggcgtgtc

SEQ ID NO: 321869 - DNA, 25 bp, Mus musculus
caggttttctgttcaatggcgtgtc

SEQ ID NO: 321870 - DNA, 25 bp, Mus musculus
caggttttcttgctgttctgataaa

SEQ ID NO: 321871 - DNA, 25 bp, Mus musculus
caggttttcttggtgttctgataaa

SEQ ID NO: 321872 - DNA, 25 bp, Mus musculus
caggttttgagacccggttttgcac

SEQ ID NO: 321873 - DNA, 25 bp, Mus musculus
caggttttgagagccggttttgcac

SEQ ID NO: 321874 - DNA, 25 bp, Mus musculus
caggttttgatgcagctagcttcat

SEQ ID NO: 321875 - DNA, 25 bp, Mus musculus
caggttttgatggagctagcttcat

SEQ ID NO: 321876 - DNA, 25 bp, Mus musculus
caggttttgcctcgctgtggttccc

SEQ ID NO: 321877 - DNA, 25 bp, Mus musculus
caggttttgcctggctgtggttccc

SEQ ID NO: 321878 - DNA, 25 bp, Mus musculus
caggttttgtgtcaggtctttgatc

SEQ ID NO: 321879 - DNA, 25 bp, Mus musculus
caggttttgtgtgaggtctttgatc

SEQ ID NO: 321880 - DNA, 25 bp, Mus musculus
caggtttttcataagaaccccacag

SEQ ID NO: 321881 - DNA, 25 bp, Mus musculus
caggtttttcattagaaccccacag

SEQ ID NO: 321882 - DNA, 25 bp, Mus musculus
cagtaaaactcaaggttcttcaaag

SEQ ID NO: 321883 - DNA, 25 bp, Mus musculus
cagtaaaactcatggttcttcaaag

SEQ ID NO: 321884 - DNA, 25 bp, Mus musculus
cagtaaaagaggatcttgtgctcct

SEQ ID NO: 321885 - DNA, 25 bp, Mus musculus
cagtaaaagaggttcttgtgctcct

SEQ ID NO: 321886 - DNA, 25 bp, Mus musculus
cagtaaaccttaccgtactctacag

SEQ ID NO: 321887 - DNA, 25 bp, Mus musculus
cagtaaaccttagcgtactctacag

SEQ ID NO: 321888 - DNA, 25 bp, Mus musculus
cagtaaactgtaccgactcgaggat

SEQ ID NO: 321889 - DNA, 25 bp, Mus musculus
cagtaaactgtagcgactcgaggat

SEQ ID NO: 321890 - DNA, 25 bp, Mus musculus
cagtaaagctaccaattgagctgga

SEQ ID NO: 321891 - DNA, 25 bp, Mus musculus
cagtaaagctacgaattgagctgga

SEQ ID NO: 321892 - DNA, 25 bp, Mus musculus
cagtaaagggtccagcctcatctgt

SEQ ID NO: 321893 - DNA, 25 bp, Mus musculus
cagtaaagggtcgagcctcatctgt

SEQ ID NO: 321894 - DNA, 25 bp, Mus musculus
cagtaaaggtcaaggaaacaagtta

SEQ ID NO: 321895 - DNA, 25 bp, Mus musculus
cagtaaaggtcatggaaacaagtta

SEQ ID NO: 321896 - DNA, 25 bp, Mus musculus
cagtaaatatctcaccaacttgtta

SEQ ID NO: 321897 - DNA, 25 bp, Mus musculus
cagtaaatatctgaccaacttgtta

SEQ ID NO: 321898 - DNA, 25 bp, Mus musculus
cagtaaatgcccatgctgatcaagg

SEQ ID NO: 321899 - DNA, 25 bp, Mus musculus
cagtaaatgcccttgctgatcaagg

SEQ ID NO: 321900 - DNA, 25 bp, Mus musculus
cagtaaatggctcttagcacagctt

SEQ ID NO: 321901 - DNA, 25 bp, Mus musculus
cagtaaatggctgttagcacagctt

SEQ ID NO: 321902 - DNA, 25 bp, Mus musculus
cagtaaatgggaattccagttcctc

SEQ ID NO: 321903 - DNA, 25 bp, Mus musculus
cagtaaatgggatttccagttcctc

SEQ ID NO: 321904 - DNA, 25 bp, Mus musculus
cagtaaatgtatagagccgtgtaac

SEQ ID NO: 321905 - DNA, 25 bp, Mus musculus
cagtaaatgtattgagccgtgtaac

SEQ ID NO: 321906 - DNA, 25 bp, Mus musculus
cagtaacaaccacttagagccgctt

SEQ ID NO: 321907 - DNA, 25 bp, Mus musculus
cagtaacaaccagttagagccgctt

SEQ ID NO: 321908 - DNA, 25 bp, Mus musculus
cagtaacaacctctagagatgtgtt

SEQ ID NO: 321909 - DNA, 25 bp, Mus musculus
cagtaacaacctgtagagatgtgtt

SEQ ID NO: 321910 - DNA, 25 bp, Mus musculus
cagtaacaagcacttcctgttcttc

SEQ ID NO: 321911 - DNA, 25 bp, Mus musculus
cagtaacaagcagttcctgttcttc

SEQ ID NO: 321912 - DNA, 25 bp, Mus musculus
cagtaacaagttctccaacctttgc

SEQ ID NO: 321913 - DNA, 25 bp, Mus musculus
cagtaacaagttgtccaacctttgc

SEQ ID NO: 321914 - DNA, 25 bp, Mus musculus
cagtaacaccctcttttatattcct

SEQ ID NO: 321915 - DNA, 25 bp, Mus musculus
cagtaacaccctgttttatattcct

SEQ ID NO: 321916 - DNA, 25 bp, Mus musculus
cagtaacattagaattccgtaaaat

SEQ ID NO: 321917 - DNA, 25 bp, Mus musculus
cagtaacattagtattccgtaaaat

SEQ ID NO: 321918 - DNA, 25 bp, Mus musculus
cagtaacattgtccacatctccaac

SEQ ID NO: 321919 - DNA, 25 bp, Mus musculus
cagtaacattgtgcacatctccaac

SEQ ID NO: 321920 - DNA, 25 bp, Mus musculus
cagtaaccaccaatgtgctttccat

SEQ ID NO: 321921 - DNA, 25 bp, Mus musculus
cagtaaccaccattgtgctttccat

SEQ ID NO: 321922 - DNA, 25 bp, Mus musculus
cagtaaccccagctggaacaacaat

SEQ ID NO: 321923 - DNA, 25 bp, Mus musculus
cagtaaccccaggtggaacaacaat

SEQ ID NO: 321924 - DNA, 25 bp, Mus musculus
cagtaaccctgccacttagaaggtg

SEQ ID NO: 321925 - DNA, 25 bp, Mus musculus
cagtaaccctgcgacttagaaggtg

SEQ ID NO: 321926 - DNA, 25 bp, Mus musculus
cagtaacgcagcagcgcagtgcgtg

SEQ ID NO: 321927 - DNA, 25 bp, Mus musculus
cagtaacgcagctgcgcagtgcgtg

SEQ ID NO: 321928 - DNA, 25 bp, Mus musculus
cagtaacgggatatcaattccgacg

SEQ ID NO: 321929 - DNA, 25 bp, Mus musculus
cagtaacgggatttcaattccgacg

SEQ ID NO: 321930 - DNA, 25 bp, Mus musculus
cagtaactatggattgtgcccgtcc

SEQ ID NO: 321931 - DNA, 25 bp, Mus musculus
cagtaactatggtttgtgcccgtcc

SEQ ID NO: 321932 - DNA, 25 bp, Mus musculus
cagtaagactggctgttctcctcaa

SEQ ID NO: 321933 - DNA, 25 bp, Mus musculus
cagtaagactgggtgttctcctcaa

SEQ ID NO: 321934 - DNA, 25 bp, Mus musculus
cagtaagagtctccaggagccctgt

SEQ ID NO: 321935 - DNA, 25 bp, Mus musculus
cagtaagagtctgcaggagccctgt

SEQ ID NO: 321936 - DNA, 25 bp, Mus musculus
cagtaagatgacaccgtgtggcgga

SEQ ID NO: 321937 - DNA, 25 bp, Mus musculus
cagtaagatgactccgtgtggcgga

SEQ ID NO: 321938 - DNA, 25 bp, Mus musculus
cagtaagcagaaatcctcaatggtt

SEQ ID NO: 321939 - DNA, 25 bp, Mus musculus
cagtaagcagaattcctcaatggtt

SEQ ID NO: 321940 - DNA, 25 bp, Mus musculus
cagtaagcagcaagtcacctgtggg

SEQ ID NO: 321941 - DNA, 25 bp, Mus musculus
cagtaagcagcatgtcacctgtggg

SEQ ID NO: 321942 - DNA, 25 bp, Mus musculus
cagtaagcagctaaacaggagcatt

SEQ ID NO: 321943 - DNA, 25 bp, Mus musculus
cagtaagcagcttaacaggagcatt

SEQ ID NO: 321944 - DNA, 25 bp, Mus musculus
cagtaagcagttagtggaggtccag

SEQ ID NO: 321945 - DNA, 25 bp, Mus musculus
cagtaagcagtttgtggaggtccag

SEQ ID NO: 321946 - DNA, 25 bp, Mus musculus
cagtaagccaccagcaaaaggaccc

SEQ ID NO: 321947 - DNA, 25 bp, Mus musculus
cagtaagccacctgcaaaaggaccc

SEQ ID NO: 321948 - DNA, 25 bp, Mus musculus
cagtaagcgtaacattttaagctct

SEQ ID NO: 321949 - DNA, 25 bp, Mus musculus
cagtaagcgtaagattttaagctct

SEQ ID NO: 321950 - DNA, 25 bp, Mus musculus
cagtaagcgtcaacctggtctctta

SEQ ID NO: 321951 - DNA, 25 bp, Mus musculus
cagtaagcgtcatcctggtctctta

SEQ ID NO: 321952 - DNA, 25 bp, Mus musculus
cagtaagcgtgtcggcaacctcatc

SEQ ID NO: 321953 - DNA, 25 bp, Mus musculus
cagtaagcgtgtgggcaacctcatc

SEQ ID NO: 321954 - DNA, 25 bp, Mus musculus
cagtaagcttttcagtagatgtgac

SEQ ID NO: 321955 - DNA, 25 bp, Mus musculus
cagtaagcttttgagtagatgtgac

SEQ ID NO: 321956 - DNA, 25 bp, Mus musculus
cagtaaggatgtagtctgctctcag

SEQ ID NO: 321957 - DNA, 25 bp, Mus musculus
cagtaaggatgttgtctgctctcag

SEQ ID NO: 321958 - DNA, 25 bp, Mus musculus
cagtaaggtattactgatccttgct

SEQ ID NO: 321959 - DNA, 25 bp, Mus musculus
cagtaaggtatttctgatccttgct

SEQ ID NO: 321960 - DNA, 25 bp, Mus musculus
cagtaagtcagccttagtttcccct

SEQ ID NO: 321961 - DNA, 25 bp, Mus musculus
cagtaagtcagcgttagtttcccct

SEQ ID NO: 321962 - DNA, 25 bp, Mus musculus
cagtaagtggtacaatgtgggtccc

SEQ ID NO: 321963 - DNA, 25 bp, Mus musculus
cagtaagtggtagaatgtgggtccc

SEQ ID NO: 321964 - DNA, 25 bp, Mus musculus
cagtaagtggtgctttgtagtttct

SEQ ID NO: 321965 - DNA, 25 bp, Mus musculus
cagtaagtggtggtttgtagtttct

SEQ ID NO: 321966 - DNA, 25 bp, Mus musculus
cagtaatacataaccctacctacct

SEQ ID NO: 321967 - DNA, 25 bp, Mus musculus
cagtaatacatatccctacctacct

SEQ ID NO: 321968 - DNA, 25 bp, Mus musculus
cagtaatactgtcaagcaggagttt

SEQ ID NO: 321969 - DNA, 25 bp, Mus musculus
cagtaatactgtgaagcaggagttt

SEQ ID NO: 321970 - DNA, 25 bp, Mus musculus
cagtaatatcacatgcctctatgca

SEQ ID NO: 321971 - DNA, 25 bp, Mus musculus
cagtaatatcacttgcctctatgca

SEQ ID NO: 321972 - DNA, 25 bp, Mus musculus
cagtaatatcccaggaacccaactt

SEQ ID NO: 321973 - DNA, 25 bp, Mus musculus
cagtaatatccctggaacccaactt

SEQ ID NO: 321974 - DNA, 25 bp, Mus musculus
cagtaatcagtaatatggtgtcagt

SEQ ID NO: 321975 - DNA, 25 bp, Mus musculus
cagtaatcagtattatggtgtcagt

SEQ ID NO: 321976 - DNA, 25 bp, Mus musculus
cagtaatccgggaagcatctgctgg

SEQ ID NO: 321977 - DNA, 25 bp, Mus musculus
cagtaatccgggtagcatctgctgg

SEQ ID NO: 321978 - DNA, 25 bp, Mus musculus
cagtaatcttttacagccctgatct

SEQ ID NO: 321979 - DNA, 25 bp, Mus musculus
cagtaatctttttcagccctgatct

SEQ ID NO: 321980 - DNA, 25 bp, Mus musculus
cagtaatgacctaacatcaaaggta

SEQ ID NO: 321981 - DNA, 25 bp, Mus musculus
cagtaatgaccttacatcaaaggta

SEQ ID NO: 321982 - DNA, 25 bp, Mus musculus
cagtaatgctggagcccctagctgt

SEQ ID NO: 321983 - DNA, 25 bp, Mus musculus
cagtaatgctggtgcccctagctgt

SEQ ID NO: 321984 - DNA, 25 bp, Mus musculus
cagtaattcagccaaggtcatcctt

SEQ ID NO: 321985 - DNA, 25 bp, Mus musculus
cagtaattcagcgaaggtcatcctt

SEQ ID NO: 321986 - DNA, 25 bp, Mus musculus
cagtaattcagtcctcaatacccca

SEQ ID NO: 321987 - DNA, 25 bp, Mus musculus
cagtaattcagtgctcaatacccca

SEQ ID NO: 321988 - DNA, 25 bp, Mus musculus
cagtaattcctcatgcgtgctttgc

SEQ ID NO: 321989 - DNA, 25 bp, Mus musculus
cagtaattcctcttgcgtgctttgc

SEQ ID NO: 321990 - DNA, 25 bp, Mus musculus
cagtaattctgtacgggtctctcct

SEQ ID NO: 321991 - DNA, 25 bp, Mus musculus
cagtaattctgttcgggtctctcct

SEQ ID NO: 321992 - DNA, 25 bp, Mus musculus
cagtaattggatatggagcctctca

SEQ ID NO: 321993 - DNA, 25 bp, Mus musculus
cagtaattggatttggagcctctca

SEQ ID NO: 321994 - DNA, 25 bp, Mus musculus
cagtaattgtctctcttccttgaaa

SEQ ID NO: 321995 - DNA, 25 bp, Mus musculus
cagtaattgtctgtcttccttgaaa

SEQ ID NO: 321996 - DNA, 25 bp, Mus musculus
cagtaattttgtatgactcatcaga

SEQ ID NO: 321997 - DNA, 25 bp, Mus musculus
cagtaattttgtttgactcatcaga

SEQ ID NO: 321998 - DNA, 25 bp, Mus musculus
cagtacaagaaaccccacttgggca

SEQ ID NO: 321999 - DNA, 25 bp, Mus musculus
cagtacaagaaagcccacttgggca

SEQ ID NO: 322000 - DNA, 25 bp, Mus musculus
cagtacaagccaaaagaacctgtga

SEQ ID NO: 322001 - DNA, 25 bp, Mus musculus
cagtacaagccataagaacctgtga

SEQ ID NO: 322002 - DNA, 25 bp, Mus musculus
cagtacacacctagcttcttgactg

SEQ ID NO: 322003 - DNA, 25 bp, Mus musculus
cagtacacaccttgcttcttgactg

SEQ ID NO: 322004 - DNA, 25 bp, Mus musculus
cagtacacactcagaccacacatat

SEQ ID NO: 322005 - DNA, 25 bp, Mus musculus
cagtacacactctgaccacacatat

SEQ ID NO: 322006 - DNA, 25 bp, Mus musculus
cagtacactgacacctttaatgata

SEQ ID NO: 322007 - DNA, 25 bp, Mus musculus
cagtacactgactcctttaatgata

SEQ ID NO: 322008 - DNA, 25 bp, Mus musculus
cagtacagaatacgccatcatttca

SEQ ID NO: 322009 - DNA, 25 bp, Mus musculus
cagtacagaataggccatcatttca

SEQ ID NO: 322010 - DNA, 25 bp, Mus musculus
cagtacagcagtagtggcaggctta

SEQ ID NO: 322011 - DNA, 25 bp, Mus musculus
cagtacagcagttgtggcaggctta

SEQ ID NO: 322012 - DNA, 25 bp, Mus musculus
cagtacagccatcgtgaatgatggg

SEQ ID NO: 322013 - DNA, 25 bp, Mus musculus
cagtacagccatggtgaatgatggg

SEQ ID NO: 322014 - DNA, 25 bp, Mus musculus
cagtacagcgctaggtgtgcaggca

SEQ ID NO: 322015 - DNA, 25 bp, Mus musculus
cagtacagcgcttggtgtgcaggca

SEQ ID NO: 322016 - DNA, 25 bp, Mus musculus
cagtacagctctatgcccaggttaa

SEQ ID NO: 322017 - DNA, 25 bp, Mus musculus
cagtacagctctttgcccaggttaa

SEQ ID NO: 322018 - DNA, 25 bp, Mus musculus
cagtacagtagcagtgtccttttct

SEQ ID NO: 322019 - DNA, 25 bp, Mus musculus
cagtacagtagctgtgtccttttct

SEQ ID NO: 322020 - DNA, 25 bp, Mus musculus
cagtacatagccagttgtatggtta

SEQ ID NO: 322021 - DNA, 25 bp, Mus musculus
cagtacatagcctgttgtatggtta

SEQ ID NO: 322022 - DNA, 25 bp, Mus musculus
cagtacattgtactgtgtgctttat

SEQ ID NO: 322023 - DNA, 25 bp, Mus musculus
cagtacattgtagtgtgtgctttat

SEQ ID NO: 322024 - DNA, 25 bp, Mus musculus
cagtacattttgcaagcttgaaacc

SEQ ID NO: 322025 - DNA, 25 bp, Mus musculus
cagtacattttggaagcttgaaacc

SEQ ID NO: 322026 - DNA, 25 bp, Mus musculus
cagtaccagaataagccgctttttt

SEQ ID NO: 322027 - DNA, 25 bp, Mus musculus
cagtaccagaattagccgctttttt

SEQ ID NO: 322028 - DNA, 25 bp, Mus musculus
cagtaccagggtagagattcagtct

SEQ ID NO: 322029 - DNA, 25 bp, Mus musculus
cagtaccagggttgagattcagtct

SEQ ID NO: 322030 - DNA, 25 bp, Mus musculus
cagtaccaggtccagttctggaaga

SEQ ID NO: 322031 - DNA, 25 bp, Mus musculus
cagtaccaggtcgagttctggaaga

SEQ ID NO: 322032 - DNA, 25 bp, Mus musculus
cagtaccatggtagcgatctttgag

SEQ ID NO: 322033 - DNA, 25 bp, Mus musculus
cagtaccatggttgcgatctttgag

SEQ ID NO: 322034 - DNA, 25 bp, Mus musculus
cagtaccattacatttgtctctttc

SEQ ID NO: 322035 - DNA, 25 bp, Mus musculus
cagtaccattacttttgtctctttc

SEQ ID NO: 322036 - DNA, 25 bp, Mus musculus
cagtaccattccctggaggttggac

SEQ ID NO: 322037 - DNA, 25 bp, Mus musculus
cagtaccattccgtggaggttggac

SEQ ID NO: 322038 - DNA, 25 bp, Mus musculus
cagtacccaaacaactgttccttca

SEQ ID NO: 322039 - DNA, 25 bp, Mus musculus
cagtacccaaactactgttccttca

SEQ ID NO: 322040 - DNA, 25 bp, Mus musculus
cagtacccacatcaggtaacataaa

SEQ ID NO: 322041 - DNA, 25 bp, Mus musculus
cagtacccacatgaggtaacataaa

SEQ ID NO: 322042 - DNA, 25 bp, Mus musculus
cagtacccaccaagcatttaatgct

SEQ ID NO: 322043 - DNA, 25 bp, Mus musculus
cagtacccaccatgcatttaatgct

SEQ ID NO: 322044 - DNA, 25 bp, Mus musculus
cagtacccatgacgagatcagaaga

SEQ ID NO: 322045 - DNA, 25 bp, Mus musculus
cagtacccatgaggagatcagaaga

SEQ ID NO: 322046 - DNA, 25 bp, Mus musculus
cagtaccctcgtcactcttaataaa

SEQ ID NO: 322047 - DNA, 25 bp, Mus musculus
cagtaccctcgtgactcttaataaa

SEQ ID NO: 322048 - DNA, 25 bp, Mus musculus
cagtaccgacttacagtggaaccaa

SEQ ID NO: 322049 - DNA, 25 bp, Mus musculus
cagtaccgactttcagtggaaccaa

SEQ ID NO: 322050 - DNA, 25 bp, Mus musculus
cagtacctaggactctgaggtcagt

SEQ ID NO: 322051 - DNA, 25 bp, Mus musculus
cagtacctaggagtctgaggtcagt

SEQ ID NO: 322052 - DNA, 25 bp, Mus musculus
cagtacctccttcagcggaaaacct

SEQ ID NO: 322053 - DNA, 25 bp, Mus musculus
cagtacctccttgagcggaaaacct

SEQ ID NO: 322054 - DNA, 25 bp, Mus musculus
cagtacctctcaccgtattattcag

SEQ ID NO: 322055 - DNA, 25 bp, Mus musculus
cagtacctctcagcgtattattcag

SEQ ID NO: 322056 - DNA, 25 bp, Mus musculus
cagtacctgctgaacatgagtgtcc

SEQ ID NO: 322057 - DNA, 25 bp, Mus musculus
cagtacctgctgaacttgagtgcca

SEQ ID NO: 322058 - DNA, 25 bp, Mus musculus
cagtacctgctgtacatgagtgtcc

SEQ ID NO: 322059 - DNA, 25 bp, Mus musculus
cagtacctgctgtacttgagtgcca

SEQ ID NO: 322060 - DNA, 25 bp, Mus musculus
cagtacctggacctagaggacctat

SEQ ID NO: 322061 - DNA, 25 bp, Mus musculus
cagtacctggacgtagaggacctat

SEQ ID NO: 322062 - DNA, 25 bp, Mus musculus
cagtacctgggtcaatatgatttaa

SEQ ID NO: 322063 - DNA, 25 bp, Mus musculus
cagtacctgggtgaatatgatttaa

SEQ ID NO: 322064 - DNA, 25 bp, Mus musculus
cagtaccttcatcttcctttgggaa

SEQ ID NO: 322065 - DNA, 25 bp, Mus musculus
cagtaccttcatgttcctttgggaa

SEQ ID NO: 322066 - DNA, 25 bp, Mus musculus
cagtaccttcctactttgcaggaaa

SEQ ID NO: 322067 - DNA, 25 bp, Mus musculus
cagtaccttccttctttgcaggaaa

SEQ ID NO: 322068 - DNA, 25 bp, Mus musculus
cagtaccttgacacactggcagagt

SEQ ID NO: 322069 - DNA, 25 bp, Mus musculus
cagtaccttgactcactggcagagt

SEQ ID NO: 322070 - DNA, 25 bp, Mus musculus
cagtaccttgtcactgtttgttagg

SEQ ID NO: 322071 - DNA, 25 bp, Mus musculus
cagtaccttgtctctgtttgttagg

SEQ ID NO: 322072 - DNA, 25 bp, Mus musculus
cagtaccttgttctgggtccttata

SEQ ID NO: 322073 - DNA, 25 bp, Mus musculus
cagtaccttgttgtgggtccttata

SEQ ID NO: 322074 - DNA, 25 bp, Mus musculus
cagtacgctgtaagctgaggctgta

SEQ ID NO: 322075 - DNA, 25 bp, Mus musculus
cagtacgctgtatgctgaggctgta

SEQ ID NO: 322076 - DNA, 25 bp, Mus musculus
cagtacggacagcttctcggtgcac

SEQ ID NO: 322077 - DNA, 25 bp, Mus musculus
cagtacggacaggttctcggtgcac

SEQ ID NO: 322078 - DNA, 25 bp, Mus musculus
cagtacggtactacaggagccagcc

SEQ ID NO: 322079 - DNA, 25 bp, Mus musculus
cagtacggtacttcaggagccagcc

SEQ ID NO: 322080 - DNA, 25 bp, Mus musculus
cagtacggtatcctggagtgctaaa

SEQ ID NO: 322081 - DNA, 25 bp, Mus musculus
cagtacggtatcgtggagtgctaaa

SEQ ID NO: 322082 - DNA, 25 bp, Mus musculus
cagtacggtcttcagagatggctct

SEQ ID NO: 322083 - DNA, 25 bp, Mus musculus
cagtacggtcttgagagatggctct

SEQ ID NO: 322084 - DNA, 25 bp, Mus musculus
cagtacgtagtcctggagtgctaaa

SEQ ID NO: 322085 - DNA, 25 bp, Mus musculus
cagtacgtagtcgtggagtgctaaa

SEQ ID NO: 322086 - DNA, 25 bp, Mus musculus
cagtactaagcaccctcggagcatg

SEQ ID NO: 322087 - DNA, 25 bp, Mus musculus
cagtactaagcagcctcggagcatg

SEQ ID NO: 322088 - DNA, 25 bp, Mus musculus
cagtactaagttattgaagggcatc

SEQ ID NO: 322089 - DNA, 25 bp, Mus musculus
cagtactaagtttttgaagggcatc

SEQ ID NO: 322090 - DNA, 25 bp, Mus musculus
cagtactagagacggcatggctgcc

SEQ ID NO: 322091 - DNA, 25 bp, Mus musculus
cagtactagagagggcatggctgcc

SEQ ID NO: 322092 - DNA, 25 bp, Mus musculus
cagtactagggaatgcttccagcaa

SEQ ID NO: 322093 - DNA, 25 bp, Mus musculus
cagtactagggattgcttccagcaa

SEQ ID NO: 322094 - DNA, 25 bp, Mus musculus
cagtactcacctatgaccagatgga

SEQ ID NO: 322095 - DNA, 25 bp, Mus musculus
cagtactcacctttgaccagatgga

SEQ ID NO: 322096 - DNA, 25 bp, Mus musculus
cagtactcagcaccctcaataaatg

SEQ ID NO: 322097 - DNA, 25 bp, Mus musculus
cagtactcagcagcctcaataaatg

SEQ ID NO: 322098 - DNA, 25 bp, Mus musculus
cagtactccaaaatctgcataggga

SEQ ID NO: 322099 - DNA, 25 bp, Mus musculus
cagtactccaaattctgcataggga

SEQ ID NO: 322100 - DNA, 25 bp, Mus musculus
cagtactccagaagtctacactcaa

SEQ ID NO: 322101 - DNA, 25 bp, Mus musculus
cagtactccagatgtctacactcaa

SEQ ID NO: 322102 - DNA, 25 bp, Mus musculus
cagtactcccgcagcctcaggaaag

SEQ ID NO: 322103 - DNA, 25 bp, Mus musculus
cagtactcccgctgcctcaggaaag

SEQ ID NO: 322104 - DNA, 25 bp, Mus musculus
cagtactccgtgaatttctatccga

SEQ ID NO: 322105 - DNA, 25 bp, Mus musculus
cagtactccgtgtatttctatccga

SEQ ID NO: 322106 - DNA, 25 bp, Mus musculus
cagtactgacggcaactcttccaga

SEQ ID NO: 322107 - DNA, 25 bp, Mus musculus
cagtactgacgggaactcttccaga

SEQ ID NO: 322108 - DNA, 25 bp, Mus musculus
cagtactgctgtcagttcatcccac

SEQ ID NO: 322109 - DNA, 25 bp, Mus musculus
cagtactgctgtgagttcatcccac

SEQ ID NO: 322110 - DNA, 25 bp, Mus musculus
cagtactgggcacagctcagggaca

SEQ ID NO: 322111 - DNA, 25 bp, Mus musculus
cagtactgggcagagctcagggaca

SEQ ID NO: 322112 - DNA, 25 bp, Mus musculus
cagtactgggtgagagacctggcct

SEQ ID NO: 322113 - DNA, 25 bp, Mus musculus
cagtactgggtgtgagacctggcct

SEQ ID NO: 322114 - DNA, 25 bp, Mus musculus
cagtacttactcagatgttagtatg

SEQ ID NO: 322115 - DNA, 25 bp, Mus musculus
cagtacttactctgatgttagtatg

SEQ ID NO: 322116 - DNA, 25 bp, Mus musculus
cagtacttcctgagacgtggagagt

SEQ ID NO: 322117 - DNA, 25 bp, Mus musculus
cagtacttcctgtgacgtggagagt

SEQ ID NO: 322118 - DNA, 25 bp, Mus musculus
cagtacttgcttctggagtagtgaa

SEQ ID NO: 322119 - DNA, 25 bp, Mus musculus
cagtacttgcttgtggagtagtgaa

SEQ ID NO: 322120 - DNA, 25 bp, Mus musculus
cagtacttgggcagacataagctct

SEQ ID NO: 322121 - DNA, 25 bp, Mus musculus
cagtacttgggctgacataagctct

SEQ ID NO: 322122 - DNA, 25 bp, Mus musculus
cagtacttgtccaagcaggcgggaa

SEQ ID NO: 322123 - DNA, 25 bp, Mus musculus
cagtacttgtcctagcaggcgggaa

SEQ ID NO: 322124 - DNA, 25 bp, Mus musculus
cagtactttgagatcgagtttgagg

SEQ ID NO: 322125 - DNA, 25 bp, Mus musculus
cagtactttgagttcgagtttgagg

SEQ ID NO: 322126 - DNA, 25 bp, Mus musculus
cagtactttgtaaaacttcccctca

SEQ ID NO: 322127 - DNA, 25 bp, Mus musculus
cagtactttgtataacttcccctca

SEQ ID NO: 322128 - DNA, 25 bp, Mus musculus
cagtactttttcctgtttgtgtaat

SEQ ID NO: 322129 - DNA, 25 bp, Mus musculus
cagtactttttcgtgtttgtgtaat

SEQ ID NO: 322130 - DNA, 25 bp, Mus musculus
cagtagaactaaatcccctccaggt

SEQ ID NO: 322131 - DNA, 25 bp, Mus musculus
cagtagaactaattcccctccaggt

SEQ ID NO: 322132 - DNA, 25 bp, Mus musculus
cagtagaagcatctgtcagctcagt

SEQ ID NO: 322133 - DNA, 25 bp, Mus musculus
cagtagaagcatgtgtcagctcagt

SEQ ID NO: 322134 - DNA, 25 bp, Mus musculus
cagtagaagcgtagaaaccccagcc

SEQ ID NO: 322135 - DNA, 25 bp, Mus musculus
cagtagaagcgttgaaaccccagcc

SEQ ID NO: 322136 - DNA, 25 bp, Mus musculus
cagtagaatgcgctgactattttca

SEQ ID NO: 322137 - DNA, 25 bp, Mus musculus
cagtagaatgcggtgactattttca

SEQ ID NO: 322138 - DNA, 25 bp, Mus musculus
cagtagacattaatatggtggcccc

SEQ ID NO: 322139 - DNA, 25 bp, Mus musculus
cagtagacattattatggtggcccc

SEQ ID NO: 322140 - DNA, 25 bp, Mus musculus
cagtagacattcataaaattcttga

SEQ ID NO: 322141 - DNA, 25 bp, Mus musculus
cagtagacattcttaaaattcttga

SEQ ID NO: 322142 - DNA, 25 bp, Mus musculus
cagtagacctgaactgttagactca

SEQ ID NO: 322143 - DNA, 25 bp, Mus musculus
cagtagacctgatctgttagactca

SEQ ID NO: 322144 - DNA, 25 bp, Mus musculus
cagtagactgtaaactgtcccaggg

SEQ ID NO: 322145 - DNA, 25 bp, Mus musculus
cagtagactgtatactgtcccaggg

SEQ ID NO: 322146 - DNA, 25 bp, Mus musculus
cagtagagacacactgttctccatt

SEQ ID NO: 322147 - DNA, 25 bp, Mus musculus
cagtagagacactctgttctccatt

SEQ ID NO: 322148 - DNA, 25 bp, Mus musculus
cagtagagaccactgcaatttgcat

SEQ ID NO: 322149 - DNA, 25 bp, Mus musculus
cagtagagaccagtgcaatttgcat

SEQ ID NO: 322150 - DNA, 25 bp, Mus musculus
cagtagagggtgatctttccccaga

SEQ ID NO: 322151 - DNA, 25 bp, Mus musculus
cagtagagggtgttctttccccaga

SEQ ID NO: 322152 - DNA, 25 bp, Mus musculus
cagtagagtggaaaaggaggctatt

SEQ ID NO: 322153 - DNA, 25 bp, Mus musculus
cagtagagtggataaggaggctatt

SEQ ID NO: 322154 - DNA, 25 bp, Mus musculus
cagtagataccaacgtggcggtcat

SEQ ID NO: 322155 - DNA, 25 bp, Mus musculus
cagtagataccatcgtggcggtcat

SEQ ID NO: 322156 - DNA, 25 bp, Mus musculus
cagtagatctggatcagttcctagt

SEQ ID NO: 322157 - DNA, 25 bp, Mus musculus
cagtagatctggttcagttcctagt

SEQ ID NO: 322158 - DNA, 25 bp, Mus musculus
cagtagatgaacactgctgacactg

SEQ ID NO: 322159 - DNA, 25 bp, Mus musculus
cagtagatgaactctgctgacactg

SEQ ID NO: 322160 - DNA, 25 bp, Mus musculus
cagtagatgggtccctcctctcaga

SEQ ID NO: 322161 - DNA, 25 bp, Mus musculus
cagtagatgggtgcctcctctcaga

SEQ ID NO: 322162 - DNA, 25 bp, Mus musculus
cagtagattgtgagcagacccagaa

SEQ ID NO: 322163 - DNA, 25 bp, Mus musculus
cagtagattgtgtgcagacccagaa

SEQ ID NO: 322164 - DNA, 25 bp, Mus musculus
cagtagatttagagccgatgtggtg

SEQ ID NO: 322165 - DNA, 25 bp, Mus musculus
cagtagatttagtgccgatgtggtg

SEQ ID NO: 322166 - DNA, 25 bp, Mus musculus
cagtagcagatgccgttcaaaaggt

SEQ ID NO: 322167 - DNA, 25 bp, Mus musculus
cagtagcagatggcgttcaaaaggt

SEQ ID NO: 322168 - DNA, 25 bp, Mus musculus
cagtagcatttacgcacaacgtgat

SEQ ID NO: 322169 - DNA, 25 bp, Mus musculus
cagtagcatttaggcacaacgtgat

SEQ ID NO: 322170 - DNA, 25 bp, Mus musculus
cagtagccaaggagtttcttccagc

SEQ ID NO: 322171 - DNA, 25 bp, Mus musculus
cagtagccaaggtgtttcttccagc

SEQ ID NO: 322172 - DNA, 25 bp, Mus musculus
cagtagccactgaaatttcaaaccc

SEQ ID NO: 322173 - DNA, 25 bp, Mus musculus
cagtagccactgtaatttcaaaccc

SEQ ID NO: 322174 - DNA, 25 bp, Mus musculus
cagtagccgcaaatgggagcaacct

SEQ ID NO: 322175 - DNA, 25 bp, Mus musculus
cagtagccgcaattgggagcaacct

SEQ ID NO: 322176 - DNA, 25 bp, Mus musculus
cagtagccggctatgtgtgcagatg

SEQ ID NO: 322177 - DNA, 25 bp, Mus musculus
cagtagccggctttgtgtgcagatg

SEQ ID NO: 322178 - DNA, 25 bp, Mus musculus
cagtagccgtgacagaaatctcttt

SEQ ID NO: 322179 - DNA, 25 bp, Mus musculus
cagtagccgtgagagaaatctcttt

SEQ ID NO: 322180 - DNA, 25 bp, Mus musculus
cagtagcctctgagtgtgcgtaata

SEQ ID NO: 322181 - DNA, 25 bp, Mus musculus
cagtagcctctgtgtgtgcgtaata

SEQ ID NO: 322182 - DNA, 25 bp, Mus musculus
cagtagcggctcatagcgccctgcg

SEQ ID NO: 322183 - DNA, 25 bp, Mus musculus
cagtagcggctcttagcgccctgcg

SEQ ID NO: 322184 - DNA, 25 bp, Mus musculus
cagtagctactcatccaagtgttat

SEQ ID NO: 322185 - DNA, 25 bp, Mus musculus
cagtagctactcttccaagtgttat

SEQ ID NO: 322186 - DNA, 25 bp, Mus musculus
cagtagctatgaatcttgtttctcc

SEQ ID NO: 322187 - DNA, 25 bp, Mus musculus
cagtagctatgattcttgtttctcc

SEQ ID NO: 322188 - DNA, 25 bp, Mus musculus
cagtagctctgcagttggccatggg

SEQ ID NO: 322189 - DNA, 25 bp, Mus musculus
cagtagctctgctgttggccatggg

SEQ ID NO: 322190 - DNA, 25 bp, Mus musculus
cagtagctctgtctttgatggatga

SEQ ID NO: 322191 - DNA, 25 bp, Mus musculus
cagtagctctgtgtttgatggatga

SEQ ID NO: 322192 - DNA, 25 bp, Mus musculus
cagtagctggctccctggtcagata

SEQ ID NO: 322193 - DNA, 25 bp, Mus musculus
cagtagctggctgcctggtcagata

SEQ ID NO: 322194 - DNA, 25 bp, Mus musculus
cagtagctgtgcatgtattccctaa

SEQ ID NO: 322195 - DNA, 25 bp, Mus musculus
cagtagctgtgcttgtattccctaa

SEQ ID NO: 322196 - DNA, 25 bp, Mus musculus
cagtagcttataatatctgtaactc

SEQ ID NO: 322197 - DNA, 25 bp, Mus musculus
cagtagcttatattatctgtaactc

SEQ ID NO: 322198 - DNA, 25 bp, Mus musculus
cagtagcttcctagttccagtgaaa

SEQ ID NO: 322199 - DNA, 25 bp, Mus musculus
cagtagcttcctccctgggagatgg

SEQ ID NO: 322200 - DNA, 25 bp, Mus musculus
cagtagcttcctgcctgggagatgg

SEQ ID NO: 322201 - DNA, 25 bp, Mus musculus
cagtagcttccttgttccagtgaaa

SEQ ID NO: 322202 - DNA, 25 bp, Mus musculus
cagtagcttgccctaatattttaat

SEQ ID NO: 322203 - DNA, 25 bp, Mus musculus
cagtagcttgccgtaatattttaat

SEQ ID NO: 322204 - DNA, 25 bp, Mus musculus
cagtagcttggaacagatgctttta

SEQ ID NO: 322205 - DNA, 25 bp, Mus musculus
cagtagcttggatcagatgctttta

SEQ ID NO: 322206 - DNA, 25 bp, Mus musculus
cagtagctttccagatcgttttcgc

SEQ ID NO: 322207 - DNA, 25 bp, Mus musculus
cagtagctttcctgatcgttttcgc

SEQ ID NO: 322208 - DNA, 25 bp, Mus musculus
cagtagctttctaggcttacagagt

SEQ ID NO: 322209 - DNA, 25 bp, Mus musculus
cagtagctttcttggcttacagagt

SEQ ID NO: 322210 - DNA, 25 bp, Mus musculus
cagtaggacacaattacccaggcca

SEQ ID NO: 322211 - DNA, 25 bp, Mus musculus
cagtaggacacatttacccaggcca

SEQ ID NO: 322212 - DNA, 25 bp, Mus musculus
cagtaggacttgcttcccaggattc

SEQ ID NO: 322213 - DNA, 25 bp, Mus musculus
cagtaggacttggttcccaggattc

SEQ ID NO: 322214 - DNA, 25 bp, Mus musculus
cagtaggcaggccatgcacgactcc

SEQ ID NO: 322215 - DNA, 25 bp, Mus musculus
cagtaggcaggcgatgcacgactcc

SEQ ID NO: 322216 - DNA, 25 bp, Mus musculus
cagtagggcacgagtaacctgcatc

SEQ ID NO: 322217 - DNA, 25 bp, Mus musculus
cagtagggcacgtgtaacctgcatc

SEQ ID NO: 322218 - DNA, 25 bp, Mus musculus
cagtagggctaactagtcttctgtt

SEQ ID NO: 322219 - DNA, 25 bp, Mus musculus
cagtagggctaagtagtcttctgtt

SEQ ID NO: 322220 - DNA, 25 bp, Mus musculus
cagtaggtcctaaatgggcccattc

SEQ ID NO: 322221 - DNA, 25 bp, Mus musculus
cagtaggtcctatatgggcccattc

SEQ ID NO: 322222 - DNA, 25 bp, Mus musculus
cagtaggtctcgacggtgttctcta

SEQ ID NO: 322223 - DNA, 25 bp, Mus musculus
cagtaggtctcgtcggtgttctcta

SEQ ID NO: 322224 - DNA, 25 bp, Mus musculus
cagtaggtctggcacgatttggaac

SEQ ID NO: 322225 - DNA, 25 bp, Mus musculus
cagtaggtctgggacgatttggaac

SEQ ID NO: 322226 - DNA, 25 bp, Mus musculus
cagtaggttcagacatacaaccagg

SEQ ID NO: 322227 - DNA, 25 bp, Mus musculus
cagtaggttcagtcatacaaccagg

SEQ ID NO: 322228 - DNA, 25 bp, Mus musculus
cagtagtagggactgtggcctttct

SEQ ID NO: 322229 - DNA, 25 bp, Mus musculus
cagtagtagggagtgtggcctttct

SEQ ID NO: 322230 - DNA, 25 bp, Mus musculus
cagtagtccagaacgagcagccata

SEQ ID NO: 322231 - DNA, 25 bp, Mus musculus
cagtagtccagatcgagcagccata

SEQ ID NO: 322232 - DNA, 25 bp, Mus musculus
cagtagtctcctaccaactggaaag

SEQ ID NO: 322233 - DNA, 25 bp, Mus musculus
cagtagtctccttccaactggaaag

SEQ ID NO: 322234 - DNA, 25 bp, Mus musculus
cagtagtcttggcactagctgaaaa

SEQ ID NO: 322235 - DNA, 25 bp, Mus musculus
cagtagtcttgggactagctgaaaa

SEQ ID NO: 322236 - DNA, 25 bp, Mus musculus
cagtagtgactgctcttaagaatca

SEQ ID NO: 322237 - DNA, 25 bp, Mus musculus
cagtagtgactggtcttaagaatca

SEQ ID NO: 322238 - DNA, 25 bp, Mus musculus
cagtagtgatgaattcctccagggt

SEQ ID NO: 322239 - DNA, 25 bp, Mus musculus
cagtagtgatgatttcctccagggt

SEQ ID NO: 322240 - DNA, 25 bp, Mus musculus
cagtagtgccgcagacctttgatcc

SEQ ID NO: 322241 - DNA, 25 bp, Mus musculus
cagtagtgccgctgacctttgatcc

SEQ ID NO: 322242 - DNA, 25 bp, Mus musculus
cagtagtgcctgaggtttagcccgc

SEQ ID NO: 322243 - DNA, 25 bp, Mus musculus
cagtagtgcctgtggtttagcccgc

SEQ ID NO: 322244 - DNA, 25 bp, Mus musculus
cagtagtgcggaagatattagctaa

SEQ ID NO: 322245 - DNA, 25 bp, Mus musculus
cagtagtgcggatgatattagctaa

SEQ ID NO: 322246 - DNA, 25 bp, Mus musculus
cagtagtgggttatcacgggtgcct

SEQ ID NO: 322247 - DNA, 25 bp, Mus musculus
cagtagtgggttttcacgggtgcct

SEQ ID NO: 322248 - DNA, 25 bp, Mus musculus
cagtagtggtgtacaggtttttcca

SEQ ID NO: 322249 - DNA, 25 bp, Mus musculus
cagtagtggtgttcaggtttttcca

SEQ ID NO: 322250 - DNA, 25 bp, Mus musculus
cagtagtgtgctagtctagcaggca

SEQ ID NO: 322251 - DNA, 25 bp, Mus musculus
cagtagtgtgcttgtctagcaggca

SEQ ID NO: 322252 - DNA, 25 bp, Mus musculus
cagtagttatttacaccatttctta

SEQ ID NO: 322253 - DNA, 25 bp, Mus musculus
cagtagttattttcaccatttctta

SEQ ID NO: 322254 - DNA, 25 bp, Mus musculus
cagtagttcattctggactcctatt

SEQ ID NO: 322255 - DNA, 25 bp, Mus musculus
cagtagttcattgtggactcctatt

SEQ ID NO: 322256 - DNA, 25 bp, Mus musculus
cagtagttcctcagtccgagtgtaa

SEQ ID NO: 322257 - DNA, 25 bp, Mus musculus
cagtagttcctctgtccgagtgtaa

SEQ ID NO: 322258 - DNA, 25 bp, Mus musculus
cagtagtttagtacacaacccctgt

SEQ ID NO: 322259 - DNA, 25 bp, Mus musculus
cagtagtttagttcacaacccctgt

SEQ ID NO: 322260 - DNA, 25 bp, Mus musculus
cagtataagtttatcctacatagta

SEQ ID NO: 322261 - DNA, 25 bp, Mus musculus
cagtataagtttttcctacatagta

SEQ ID NO: 322262 - DNA, 25 bp, Mus musculus
cagtataatttgagctcctccagag

SEQ ID NO: 322263 - DNA, 25 bp, Mus musculus
cagtataatttgtgctcctccagag

SEQ ID NO: 322264 - DNA, 25 bp, Mus musculus
cagtatacaacaagtctgtctctgt

SEQ ID NO: 322265 - DNA, 25 bp, Mus musculus
cagtatacaacatgtctgtctctgt

SEQ ID NO: 322266 - DNA, 25 bp, Mus musculus
cagtatacacacatgcagaccgcgg

SEQ ID NO: 322267 - DNA, 25 bp, Mus musculus
cagtatacacacttgcagaccgcgg

SEQ ID NO: 322268 - DNA, 25 bp, Mus musculus
cagtatacacatccctcttcgggtg

SEQ ID NO: 322269 - DNA, 25 bp, Mus musculus
cagtatacacatgcctcttcgggtg

SEQ ID NO: 322270 - DNA, 25 bp, Mus musculus
cagtatacccgtcaacaagtaatgt

SEQ ID NO: 322271 - DNA, 25 bp, Mus musculus
cagtatacccgtgaacaagtaatgt

SEQ ID NO: 322272 - DNA, 25 bp, Mus musculus
cagtatagctggctgaacatctcta

SEQ ID NO: 322273 - DNA, 25 bp, Mus musculus
cagtatagctgggtgaacatctcta

SEQ ID NO: 322274 - DNA, 25 bp, Mus musculus
cagtatagtcttcccacagtgtcag

SEQ ID NO: 322275 - DNA, 25 bp, Mus musculus
cagtatagtcttgccacagtgtcag

SEQ ID NO: 322276 - DNA, 25 bp, Mus musculus
cagtatagtgcactcaactctctga

SEQ ID NO: 322277 - DNA, 25 bp, Mus musculus
cagtatagtgcagtcaactctctga

SEQ ID NO: 322278 - DNA, 25 bp, Mus musculus
cagtatatacccatgtcatgagaaa

SEQ ID NO: 322279 - DNA, 25 bp, Mus musculus
cagtatatacccttgtcatgagaaa

SEQ ID NO: 322280 - DNA, 25 bp, Mus musculus
cagtatatatgtagctttagcgata

SEQ ID NO: 322281 - DNA, 25 bp, Mus musculus
cagtatatatgttgctttagcgata

SEQ ID NO: 322282 - DNA, 25 bp, Mus musculus
cagtatatttcgcacagagcgtata

SEQ ID NO: 322283 - DNA, 25 bp, Mus musculus
cagtatatttcggacagagcgtata

SEQ ID NO: 322284 - DNA, 25 bp, Mus musculus
cagtatattttcagcttctgcatgt

SEQ ID NO: 322285 - DNA, 25 bp, Mus musculus
cagtatattttctgcttctgcatgt

SEQ ID NO: 322286 - DNA, 25 bp, Mus musculus
cagtatcagaagctcctgtgaagtt

SEQ ID NO: 322287 - DNA, 25 bp, Mus musculus
cagtatcagaaggtcctgtgaagtt

SEQ ID NO: 322288 - DNA, 25 bp, Mus musculus
cagtatcagaatatggttaccagca

SEQ ID NO: 322289 - DNA, 25 bp, Mus musculus
cagtatcagaatttggttaccagca

SEQ ID NO: 322290 - DNA, 25 bp, Mus musculus
cagtatcagagtcgcaggcaggccc

SEQ ID NO: 322291 - DNA, 25 bp, Mus musculus
cagtatcagagtggcaggcaggccc

SEQ ID NO: 322292 - DNA, 25 bp, Mus musculus
cagtatcagtttcccctcttgttag

SEQ ID NO: 322293 - DNA, 25 bp, Mus musculus
cagtatcagtttgccctcttgttag

SEQ ID NO: 322294 - DNA, 25 bp, Mus musculus
cagtatcatgctctagcctaggctg

SEQ ID NO: 322295 - DNA, 25 bp, Mus musculus
cagtatcatgctgtagcctaggctg

SEQ ID NO: 322296 - DNA, 25 bp, Mus musculus
cagtatccaccaaggttttcaataa

SEQ ID NO: 322297 - DNA, 25 bp, Mus musculus
cagtatccaccatggttttcaataa

SEQ ID NO: 322298 - DNA, 25 bp, Mus musculus
cagtatcccagaaagctggtgtgat

SEQ ID NO: 322299 - DNA, 25 bp, Mus musculus
cagtatcccagatagctggtgtgat

SEQ ID NO: 322300 - DNA, 25 bp, Mus musculus
cagtatccgaaaaaaccacccatta

SEQ ID NO: 322301 - DNA, 25 bp, Mus musculus
cagtatccgaaataaccacccatta

SEQ ID NO: 322302 - DNA, 25 bp, Mus musculus
cagtatccgatacgaatgaagagtg

SEQ ID NO: 322303 - DNA, 25 bp, Mus musculus
cagtatccgataggaatgaagagtg

SEQ ID NO: 322304 - DNA, 25 bp, Mus musculus
cagtatccgtatattcctgcacata

SEQ ID NO: 322305 - DNA, 25 bp, Mus musculus
cagtatccgtattttcctgcacata

SEQ ID NO: 322306 - DNA, 25 bp, Mus musculus
cagtatcggtgcattggccttaggc

SEQ ID NO: 322307 - DNA, 25 bp, Mus musculus
cagtatcggtgctttggccttaggc

SEQ ID NO: 322308 - DNA, 25 bp, Mus musculus
cagtatctaaaaagagccctccttg

SEQ ID NO: 322309 - DNA, 25 bp, Mus musculus
cagtatctaaaatgagccctccttg

SEQ ID NO: 322310 - DNA, 25 bp, Mus musculus
cagtatctactgatgtgaacctagt

SEQ ID NO: 322311 - DNA, 25 bp, Mus musculus
cagtatctactgttgtgaacctagt

SEQ ID NO: 322312 - DNA, 25 bp, Mus musculus
cagtatctcagtaattcttcatttg

SEQ ID NO: 322313 - DNA, 25 bp, Mus musculus
cagtatctcagttattcttcatttg

SEQ ID NO: 322314 - DNA, 25 bp, Mus musculus
cagtatctgattcaaagtgcctgcc

SEQ ID NO: 322315 - DNA, 25 bp, Mus musculus
cagtatctgattgaaagtgcctgcc

SEQ ID NO: 322316 - DNA, 25 bp, Mus musculus
cagtatctgcggcagtccaggcagt

SEQ ID NO: 322317 - DNA, 25 bp, Mus musculus
cagtatctgcgggagtccaggcagt

SEQ ID NO: 322318 - DNA, 25 bp, Mus musculus
cagtatctgttcacataatgtattt

SEQ ID NO: 322319 - DNA, 25 bp, Mus musculus
cagtatctgttctcataatgtattt

SEQ ID NO: 322320 - DNA, 25 bp, Mus musculus
cagtatctttctatgaactcatgtc

SEQ ID NO: 322321 - DNA, 25 bp, Mus musculus
cagtatctttctttgaactcatgtc

SEQ ID NO: 322322 - DNA, 25 bp, Mus musculus
cagtatctttgccaagcagcttggt

SEQ ID NO: 322323 - DNA, 25 bp, Mus musculus
cagtatctttgcgaagcagcttggt

SEQ ID NO: 322324 - DNA, 25 bp, Mus musculus
cagtatctttgtacccgtttgtaat

SEQ ID NO: 322325 - DNA, 25 bp, Mus musculus
cagtatctttgtatttcccattcat

SEQ ID NO: 322326 - DNA, 25 bp, Mus musculus
cagtatctttgttcccgtttgtaat

SEQ ID NO: 322327 - DNA, 25 bp, Mus musculus
cagtatctttgtttttcccattcat

SEQ ID NO: 322328 - DNA, 25 bp, Mus musculus
cagtatgaaatcctctgacagagat

SEQ ID NO: 322329 - DNA, 25 bp, Mus musculus
cagtatgaaatcgtctgacagagat

SEQ ID NO: 322330 - DNA, 25 bp, Mus musculus
cagtatgaagatattttcctctcaa

SEQ ID NO: 322331 - DNA, 25 bp, Mus musculus
cagtatgaagattttttcctctcaa

SEQ ID NO: 322332 - DNA, 25 bp, Mus musculus
cagtatgaatgccatgtcttaatca

SEQ ID NO: 322333 - DNA, 25 bp, Mus musculus
cagtatgaatgcgatgtcttaatca

SEQ ID NO: 322334 - DNA, 25 bp, Mus musculus
cagtatgagagtatgcaaatgccgt

SEQ ID NO: 322335 - DNA, 25 bp, Mus musculus
cagtatgagagtttgcaaatgccgt

SEQ ID NO: 322336 - DNA, 25 bp, Mus musculus
cagtatgagggcaattgacatccat

SEQ ID NO: 322337 - DNA, 25 bp, Mus musculus
cagtatgagggctattgacatccat

SEQ ID NO: 322338 - DNA, 25 bp, Mus musculus
cagtatgattctctatgattgtcaa

SEQ ID NO: 322339 - DNA, 25 bp, Mus musculus
cagtatgattctgtatgattgtcaa

SEQ ID NO: 322340 - DNA, 25 bp, Mus musculus
cagtatgcagcacagagcgtacccc

SEQ ID NO: 322341 - DNA, 25 bp, Mus musculus
cagtatgcagcagagagcgtacccc

SEQ ID NO: 322342 - DNA, 25 bp, Mus musculus
cagtatgcagccatgaccttagcag

SEQ ID NO: 322343 - DNA, 25 bp, Mus musculus
cagtatgcagccttgaccttagcag

SEQ ID NO: 322344 - DNA, 25 bp, Mus musculus
cagtatgcagtccaccggccggtgt

SEQ ID NO: 322345 - DNA, 25 bp, Mus musculus
cagtatgcagtcgaccggccggtgt

SEQ ID NO: 322346 - DNA, 25 bp, Mus musculus
cagtatgccctccaagccctttgtt

SEQ ID NO: 322347 - DNA, 25 bp, Mus musculus
cagtatgccctcgaagccctttgtt

SEQ ID NO: 322348 - DNA, 25 bp, Mus musculus
cagtatggaccaagagaccctattt

SEQ ID NO: 322349 - DNA, 25 bp, Mus musculus
cagtatggaccatgagaccctattt

SEQ ID NO: 322350 - DNA, 25 bp, Mus musculus
cagtatgggcccctggctctgtgta

SEQ ID NO: 322351 - DNA, 25 bp, Mus musculus
cagtatgggcccgtggctctgtgta

SEQ ID NO: 322352 - DNA, 25 bp, Mus musculus
cagtatggtgccacaggatccagag

SEQ ID NO: 322353 - DNA, 25 bp, Mus musculus
cagtatggtgcctcaggatccagag

SEQ ID NO: 322354 - DNA, 25 bp, Mus musculus
cagtatgtatgcctcgaacagccat

SEQ ID NO: 322355 - DNA, 25 bp, Mus musculus
cagtatgtatgcgtcgaacagccat

SEQ ID NO: 322356 - DNA, 25 bp, Mus musculus
cagtatgtcagtaacccataaatga

SEQ ID NO: 322357 - DNA, 25 bp, Mus musculus
cagtatgtcagttacccataaatga

SEQ ID NO: 322358 - DNA, 25 bp, Mus musculus
cagtatgtccatcagtgggttcaca

SEQ ID NO: 322359 - DNA, 25 bp, Mus musculus
cagtatgtccatcgagtgtttttaa

SEQ ID NO: 322360 - DNA, 25 bp, Mus musculus
cagtatgtccatgagtgggttcaca

SEQ ID NO: 322361 - DNA, 25 bp, Mus musculus
cagtatgtccatggagtgtttttaa

SEQ ID NO: 322362 - DNA, 25 bp, Mus musculus
cagtatgtcgtaatgtaactccagc

SEQ ID NO: 322363 - DNA, 25 bp, Mus musculus
cagtatgtcgtattgtaactccagc

SEQ ID NO: 322364 - DNA, 25 bp, Mus musculus
cagtatgtctgaagcaccacaggcc

SEQ ID NO: 322365 - DNA, 25 bp, Mus musculus
cagtatgtctgatgcaccacaggcc

SEQ ID NO: 322366 - DNA, 25 bp, Mus musculus
cagtatgtgctccttgctgcattag

SEQ ID NO: 322367 - DNA, 25 bp, Mus musculus
cagtatgtgctcgttgctgcattag

SEQ ID NO: 322368 - DNA, 25 bp, Mus musculus
cagtatgtgcttacttgtgttcaag

SEQ ID NO: 322369 - DNA, 25 bp, Mus musculus
cagtatgtgctttcttgtgttcaag

SEQ ID NO: 322370 - DNA, 25 bp, Mus musculus
cagtatgtgtatctgctgcatgcca

SEQ ID NO: 322371 - DNA, 25 bp, Mus musculus
cagtatgtgtatgtgctgcatgcca

SEQ ID NO: 322372 - DNA, 25 bp, Mus musculus
cagtatgtgtgtcgcttgttaaaga

SEQ ID NO: 322373 - DNA, 25 bp, Mus musculus
cagtatgtgtgtggcttgttaaaga

SEQ ID NO: 322374 - DNA, 25 bp, Mus musculus
cagtatgttagcacattgtttggta

SEQ ID NO: 322375 - DNA, 25 bp, Mus musculus
cagtatgttagctcattgtttggta

SEQ ID NO: 322376 - DNA, 25 bp, Mus musculus
cagtatgttcatatggttttcagat

SEQ ID NO: 322377 - DNA, 25 bp, Mus musculus
cagtatgttcatttggttttcagat

SEQ ID NO: 322378 - DNA, 25 bp, Mus musculus
cagtatgttgctcggaacggccttc

SEQ ID NO: 322379 - DNA, 25 bp, Mus musculus
cagtatgttgctgggaacggccttc

SEQ ID NO: 322380 - DNA, 25 bp, Mus musculus
cagtatgttttgaggatcgcagggc

SEQ ID NO: 322381 - DNA, 25 bp, Mus musculus
cagtatgttttgtggatcgcagggc

SEQ ID NO: 322382 - DNA, 25 bp, Mus musculus
cagtattacacacaagttattgagt

SEQ ID NO: 322383 - DNA, 25 bp, Mus musculus
cagtattacacagaagttattgagt

SEQ ID NO: 322384 - DNA, 25 bp, Mus musculus
cagtattacctgcttgtctttgtta

SEQ ID NO: 322385 - DNA, 25 bp, Mus musculus
cagtattacctggttgtctttgtta

SEQ ID NO: 322386 - DNA, 25 bp, Mus musculus
cagtattactatcacaccaacagcc

SEQ ID NO: 322387 - DNA, 25 bp, Mus musculus
cagtattactatgacaccaacagcc

SEQ ID NO: 322388 - DNA, 25 bp, Mus musculus
cagtattactggaatttttcaataa

SEQ ID NO: 322389 - DNA, 25 bp, Mus musculus
cagtattactggtatttttcaataa

SEQ ID NO: 322390 - DNA, 25 bp, Mus musculus
cagtattatattaacggtacatgac

SEQ ID NO: 322391 - DNA, 25 bp, Mus musculus
cagtattatatttacggtacatgac

SEQ ID NO: 322392 - DNA, 25 bp, Mus musculus
cagtattatcttaaaactttggaat

SEQ ID NO: 322393 - DNA, 25 bp, Mus musculus
cagtattatctttaaactttggaat

SEQ ID NO: 322394 - DNA, 25 bp, Mus musculus
cagtattcagatagtgtgtctttct

SEQ ID NO: 322395 - DNA, 25 bp, Mus musculus
cagtattcagattgtgtgtctttct

SEQ ID NO: 322396 - DNA, 25 bp, Mus musculus
cagtattcattcctgccctctccag

SEQ ID NO: 322397 - DNA, 25 bp, Mus musculus
cagtattcattcgtgccctctccag

SEQ ID NO: 322398 - DNA, 25 bp, Mus musculus
cagtattccctcaagatcaacagcc

SEQ ID NO: 322399 - DNA, 25 bp, Mus musculus
cagtattccctctagatcaacagcc

SEQ ID NO: 322400 - DNA, 25 bp, Mus musculus
cagtattcttcaaaggcacaaatga

SEQ ID NO: 322401 - DNA, 25 bp, Mus musculus
cagtattcttcataggcacaaatga

SEQ ID NO: 322402 - DNA, 25 bp, Mus musculus
cagtattgatttctctgctctcaca

SEQ ID NO: 322403 - DNA, 25 bp, Mus musculus
cagtattgatttgtctgctctcaca

SEQ ID NO: 322404 - DNA, 25 bp, Mus musculus
cagtattgccctcattttttacttt

SEQ ID NO: 322405 - DNA, 25 bp, Mus musculus
cagtattgccctgattttttacttt

SEQ ID NO: 322406 - DNA, 25 bp, Mus musculus
cagtattgctgtataatcggcttct

SEQ ID NO: 322407 - DNA, 25 bp, Mus musculus
cagtattgctgtttaatcggcttct

SEQ ID NO: 322408 - DNA, 25 bp, Mus musculus
cagtattggccacaaccctcagaaa

SEQ ID NO: 322409 - DNA, 25 bp, Mus musculus
cagtattggccagaaccctcagaaa

SEQ ID NO: 322410 - DNA, 25 bp, Mus musculus
cagtattgtggacttcccggtcgta

SEQ ID NO: 322411 - DNA, 25 bp, Mus musculus
cagtattgtggagttcccggtcgta

SEQ ID NO: 322412 - DNA, 25 bp, Mus musculus
cagtatttatcccatctattgagag

SEQ ID NO: 322413 - DNA, 25 bp, Mus musculus
cagtatttatccgatctattgagag

SEQ ID NO: 322414 - DNA, 25 bp, Mus musculus
cagtatttcccccttattggacata

SEQ ID NO: 322415 - DNA, 25 bp, Mus musculus
cagtatttccccgttattggacata

SEQ ID NO: 322416 - DNA, 25 bp, Mus musculus
cagtatttcctcaccaaactacctt

SEQ ID NO: 322417 - DNA, 25 bp, Mus musculus
cagtatttcctctccaaactacctt

SEQ ID NO: 322418 - DNA, 25 bp, Mus musculus
cagtatttccttaccgattgcagta

SEQ ID NO: 322419 - DNA, 25 bp, Mus musculus
cagtatttcctttccgattgcagta

SEQ ID NO: 322420 - DNA, 25 bp, Mus musculus
cagtatttcgtcatatgcagtgttc

SEQ ID NO: 322421 - DNA, 25 bp, Mus musculus
cagtatttcgtcttatgcagtgttc

SEQ ID NO: 322422 - DNA, 25 bp, Mus musculus
cagtatttctggatgtatgcgtggt

SEQ ID NO: 322423 - DNA, 25 bp, Mus musculus
cagtatttctggttgtatgcgtggt

SEQ ID NO: 322424 - DNA, 25 bp, Mus musculus
cagtatttgactcctggaccattta

SEQ ID NO: 322425 - DNA, 25 bp, Mus musculus
cagtatttgactgctggaccattta

SEQ ID NO: 322426 - DNA, 25 bp, Mus musculus
cagtatttggtgaggcagccctgca

SEQ ID NO: 322427 - DNA, 25 bp, Mus musculus
cagtatttggtgtggcagccctgca

SEQ ID NO: 322428 - DNA, 25 bp, Mus musculus
cagtattttaacaaggatcctttct

SEQ ID NO: 322429 - DNA, 25 bp, Mus musculus
cagtattttaactaggatcctttct

SEQ ID NO: 322430 - DNA, 25 bp, Mus musculus
cagtattttactaactggccgtggt

SEQ ID NO: 322431 - DNA, 25 bp, Mus musculus
cagtattttacttactggccgtggt

SEQ ID NO: 322432 - DNA, 25 bp, Mus musculus
cagtattttagcagtcactcgtaaa

SEQ ID NO: 322433 - DNA, 25 bp, Mus musculus
cagtattttagctgtcactcgtaaa

SEQ ID NO: 322434 - DNA, 25 bp, Mus musculus
cagtattttttgctgcagcctcaga

SEQ ID NO: 322435 - DNA, 25 bp, Mus musculus
cagtattttttggtgcagcctcaga

SEQ ID NO: 322436 - DNA, 25 bp, Mus musculus
cagtcaaaggttctccgtgcaaagg

SEQ ID NO: 322437 - DNA, 25 bp, Mus musculus
cagtcaaaggttgtccgtgcaaagg

SEQ ID NO: 322438 - DNA, 25 bp, Mus musculus
cagtcaaatggtatcctgagaatga

SEQ ID NO: 322439 - DNA, 25 bp, Mus musculus
cagtcaaatggtttcctgagaatga

SEQ ID NO: 322440 - DNA, 25 bp, Mus musculus
cagtcaacccacaagtcacttttat

SEQ ID NO: 322441 - DNA, 25 bp, Mus musculus
cagtcaacccactagtcacttttat

SEQ ID NO: 322442 - DNA, 25 bp, Mus musculus
cagtcaaccgacatgcttttattag

SEQ ID NO: 322443 - DNA, 25 bp, Mus musculus
cagtcaaccgacttgcttttattag

SEQ ID NO: 322444 - DNA, 25 bp, Mus musculus
cagtcaacgcgaaggttggtggatt

SEQ ID NO: 322445 - DNA, 25 bp, Mus musculus
cagtcaacgcgatggttggtggatt

SEQ ID NO: 322446 - DNA, 25 bp, Mus musculus
cagtcaactgttccttttcgttttt

SEQ ID NO: 322447 - DNA, 25 bp, Mus musculus
cagtcaactgttgcttttcgttttt

SEQ ID NO: 322448 - DNA, 25 bp, Mus musculus
cagtcaagcccaagcagcctttatt

SEQ ID NO: 322449 - DNA, 25 bp, Mus musculus
cagtcaagcccatgcagcctttatt

SEQ ID NO: 322450 - DNA, 25 bp, Mus musculus
cagtcaagtgagcttcagggtccca

SEQ ID NO: 322451 - DNA, 25 bp, Mus musculus
cagtcaagtgaggttcagggtccca

SEQ ID NO: 322452 - DNA, 25 bp, Mus musculus
cagtcaagtgtcagaagagcggcaa

SEQ ID NO: 322453 - DNA, 25 bp, Mus musculus
cagtcaagtgtcatatctggctgaa

SEQ ID NO: 322454 - DNA, 25 bp, Mus musculus
cagtcaagtgtctgaagagcggcaa

SEQ ID NO: 322455 - DNA, 25 bp, Mus musculus
cagtcaagtgtcttatctggctgaa

SEQ ID NO: 322456 - DNA, 25 bp, Mus musculus
cagtcaatagggagaagggtacctt

SEQ ID NO: 322457 - DNA, 25 bp, Mus musculus
cagtcaatagggtgaagggtacctt

SEQ ID NO: 322458 - DNA, 25 bp, Mus musculus
cagtcaatcctgcaaacctgtaatt

SEQ ID NO: 322459 - DNA, 25 bp, Mus musculus
cagtcaatcctggaaacctgtaatt

SEQ ID NO: 322460 - DNA, 25 bp, Mus musculus
cagtcaatctgtagtgggccgcaaa

SEQ ID NO: 322461 - DNA, 25 bp, Mus musculus
cagtcaatctgttgtgggccgcaaa

SEQ ID NO: 322462 - DNA, 25 bp, Mus musculus
cagtcaatgaccacgggacggtgga

SEQ ID NO: 322463 - DNA, 25 bp, Mus musculus
cagtcaatgacctcgggacggtgga

SEQ ID NO: 322464 - DNA, 25 bp, Mus musculus
cagtcaatggagacacttggcccct

SEQ ID NO: 322465 - DNA, 25 bp, Mus musculus
cagtcaatggagtcacttggcccct

SEQ ID NO: 322466 - DNA, 25 bp, Mus musculus
cagtcaatgtggagggcgattcttt

SEQ ID NO: 322467 - DNA, 25 bp, Mus musculus
cagtcaatgtggtgggcgattcttt

SEQ ID NO: 322468 - DNA, 25 bp, Mus musculus
cagtcaattaccacctcagtaggac

SEQ ID NO: 322469 - DNA, 25 bp, Mus musculus
cagtcaattacctcctcagtaggac

SEQ ID NO: 322470 - DNA, 25 bp, Mus musculus
cagtcacaaaaactccttatgggaa

SEQ ID NO: 322471 - DNA, 25 bp, Mus musculus
cagtcacaaaaagtccttatgggaa

SEQ ID NO: 322472 - DNA, 25 bp, Mus musculus
cagtcacaacacctggattatacta

SEQ ID NO: 322473 - DNA, 25 bp, Mus musculus
cagtcacaacacgtggattatacta

SEQ ID NO: 322474 - DNA, 25 bp, Mus musculus
cagtcacaaggcctcttatagtcca

SEQ ID NO: 322475 - DNA, 25 bp, Mus musculus
cagtcacaaggcgtcttatagtcca

SEQ ID NO: 322476 - DNA, 25 bp, Mus musculus
cagtcacagaaaacaacctgttaat

SEQ ID NO: 322477 - DNA, 25 bp, Mus musculus
cagtcacagaaatcaacctgttaat

SEQ ID NO: 322478 - DNA, 25 bp, Mus musculus
cagtcacagtacatgctggtccaga

SEQ ID NO: 322479 - DNA, 25 bp, Mus musculus
cagtcacagtacttgctggtccaga

SEQ ID NO: 322480 - DNA, 25 bp, Mus musculus
cagtcacagtcaattactgcaaagg

SEQ ID NO: 322481 - DNA, 25 bp, Mus musculus
cagtcacagtcatttactgcaaagg

SEQ ID NO: 322482 - DNA, 25 bp, Mus musculus
cagtcacagtgtccctttcccattg

SEQ ID NO: 322483 - DNA, 25 bp, Mus musculus
cagtcacagtgtgcctttcccattg

SEQ ID NO: 322484 - DNA, 25 bp, Mus musculus
cagtcacatcccatagttttctaat

SEQ ID NO: 322485 - DNA, 25 bp, Mus musculus
cagtcacatcccttagttttctaat

SEQ ID NO: 322486 - DNA, 25 bp, Mus musculus
cagtcacatgcaaagtagaccggaa

SEQ ID NO: 322487 - DNA, 25 bp, Mus musculus
cagtcacatgcatagtagaccggaa

SEQ ID NO: 322488 - DNA, 25 bp, Mus musculus
cagtcacatgccagttccgagagga

SEQ ID NO: 322489 - DNA, 25 bp, Mus musculus
cagtcacatgcctgttccgagagga

SEQ ID NO: 322490 - DNA, 25 bp, Mus musculus
cagtcaccaggcatttgtctgtaat

SEQ ID NO: 322491 - DNA, 25 bp, Mus musculus
cagtcaccaggcttttgtctgtaat

SEQ ID NO: 322492 - DNA, 25 bp, Mus musculus
cagtcaccccaaagatcattgcagg

SEQ ID NO: 322493 - DNA, 25 bp, Mus musculus
cagtcaccccaatgatcattgcagg

SEQ ID NO: 322494 - DNA, 25 bp, Mus musculus
cagtcaccctctatggaaagttcca

SEQ ID NO: 322495 - DNA, 25 bp, Mus musculus
cagtcaccctctttggaaagttcca

SEQ ID NO: 322496 - DNA, 25 bp, Mus musculus
cagtcacctctgaatgtgcccagaa

SEQ ID NO: 322497 - DNA, 25 bp, Mus musculus
cagtcacctctgcaagtcagtttca

SEQ ID NO: 322498 - DNA, 25 bp, Mus musculus
cagtcacctctggaagtcagtttca

SEQ ID NO: 322499 - DNA, 25 bp, Mus musculus
cagtcacctctgtatgtgcccagaa

SEQ ID NO: 322500 - DNA, 25 bp, Mus musculus
cagtcacctgaacatgtggctgtag

SEQ ID NO: 322501 - DNA, 25 bp, Mus musculus
cagtcacctgaagatgtggctgtag

SEQ ID NO: 322502 - DNA, 25 bp, Mus musculus
cagtcacctgcgaaaacacagttat

SEQ ID NO: 322503 - DNA, 25 bp, Mus musculus
cagtcacctgcgtaaacacagttat

SEQ ID NO: 322504 - DNA, 25 bp, Mus musculus
cagtcacgtacccttgtaatgcagt

SEQ ID NO: 322505 - DNA, 25 bp, Mus musculus
cagtcacgtaccgttgtaatgcagt

SEQ ID NO: 322506 - DNA, 25 bp, Mus musculus
cagtcactagatctgattgattgtg

SEQ ID NO: 322507 - DNA, 25 bp, Mus musculus
cagtcactagatgtgattgattgtg

SEQ ID NO: 322508 - DNA, 25 bp, Mus musculus
cagtcactattgctatctctttttt

SEQ ID NO: 322509 - DNA, 25 bp, Mus musculus
cagtcactattggtatctctttttt

SEQ ID NO: 322510 - DNA, 25 bp, Mus musculus
cagtcactcactatgaaggaggttc

SEQ ID NO: 322511 - DNA, 25 bp, Mus musculus
cagtcactcactttgaaggaggttc

SEQ ID NO: 322512 - DNA, 25 bp, Mus musculus
cagtcactgaagctttagttggacc

SEQ ID NO: 322513 - DNA, 25 bp, Mus musculus
cagtcactgaaggtttagttggacc

SEQ ID NO: 322514 - DNA, 25 bp, Mus musculus
cagtcactgactcgtgggtttgtaa

SEQ ID NO: 322515 - DNA, 25 bp, Mus musculus
cagtcactgactggtgggtttgtaa

SEQ ID NO: 322516 - DNA, 25 bp, Mus musculus
cagtcactgcatccaaagtggttaa

SEQ ID NO: 322517 - DNA, 25 bp, Mus musculus
cagtcactgcatgcaaagtggttaa

SEQ ID NO: 322518 - DNA, 25 bp, Mus musculus
cagtcactgcgacctctctgagagc

SEQ ID NO: 322519 - DNA, 25 bp, Mus musculus
cagtcactgcgagctctctgagagc

SEQ ID NO: 322520 - DNA, 25 bp, Mus musculus
cagtcactgggtcacttttggatgc

SEQ ID NO: 322521 - DNA, 25 bp, Mus musculus
cagtcactgggtgacttttggatgc

SEQ ID NO: 322522 - DNA, 25 bp, Mus musculus
cagtcactggtgagagttctaccca

SEQ ID NO: 322523 - DNA, 25 bp, Mus musculus
cagtcactggtgtgagttctaccca

SEQ ID NO: 322524 - DNA, 25 bp, Mus musculus
cagtcacttaagacctgaggttctt

SEQ ID NO: 322525 - DNA, 25 bp, Mus musculus
cagtcacttaagtcctgaggttctt

SEQ ID NO: 322526 - DNA, 25 bp, Mus musculus
cagtcacttgacatgaagcactcca

SEQ ID NO: 322527 - DNA, 25 bp, Mus musculus
cagtcacttgacttgaagcactcca

SEQ ID NO: 322528 - DNA, 25 bp, Mus musculus
cagtcacttgctcactttgaagcga

SEQ ID NO: 322529 - DNA, 25 bp, Mus musculus
cagtcacttgctgactttgaagcga

SEQ ID NO: 322530 - DNA, 25 bp, Mus musculus
cagtcactttagaactgactcagca

SEQ ID NO: 322531 - DNA, 25 bp, Mus musculus
cagtcactttagtactgactcagca

SEQ ID NO: 322532 - DNA, 25 bp, Mus musculus
cagtcagaaccaagtactgctgata

SEQ ID NO: 322533 - DNA, 25 bp, Mus musculus
cagtcagaaccatgtactgctgata

SEQ ID NO: 322534 - DNA, 25 bp, Mus musculus
cagtcagaacgacctctcggacttc

SEQ ID NO: 322535 - DNA, 25 bp, Mus musculus
cagtcagaacgagctctcggacttc

SEQ ID NO: 322536 - DNA, 25 bp, Mus musculus
cagtcagacatcatggagtacctaa

SEQ ID NO: 322537 - DNA, 25 bp, Mus musculus
cagtcagacatcttggagtacctaa

SEQ ID NO: 322538 - DNA, 25 bp, Mus musculus
cagtcagaggatacgagggccctgc

SEQ ID NO: 322539 - DNA, 25 bp, Mus musculus
cagtcagaggattcgagggccctgc

SEQ ID NO: 322540 - DNA, 25 bp, Mus musculus
cagtcagaggcacaggtacaggcac

SEQ ID NO: 322541 - DNA, 25 bp, Mus musculus
cagtcagaggcagaggtacaggcac

SEQ ID NO: 322542 - DNA, 25 bp, Mus musculus
cagtcagatcctcagtgcttctttt

SEQ ID NO: 322543 - DNA, 25 bp, Mus musculus
cagtcagatcctgagtgcttctttt

SEQ ID NO: 322544 - DNA, 25 bp, Mus musculus
cagtcagcactcctctggttataaa

SEQ ID NO: 322545 - DNA, 25 bp, Mus musculus
cagtcagcactcgtctggttataaa

SEQ ID NO: 322546 - DNA, 25 bp, Mus musculus
cagtcagcagccagtggaacagtct

SEQ ID NO: 322547 - DNA, 25 bp, Mus musculus
cagtcagcagcctgtggaacagtct

SEQ ID NO: 322548 - DNA, 25 bp, Mus musculus
cagtcagccaaaagtgccacagaga

SEQ ID NO: 322549 - DNA, 25 bp, Mus musculus
cagtcagccaaatgtgccacagaga

SEQ ID NO: 322550 - DNA, 25 bp, Mus musculus
cagtcagccctgcaaacagacatat

SEQ ID NO: 322551 - DNA, 25 bp, Mus musculus
cagtcagccctgcttatatttgtga

SEQ ID NO: 322552 - DNA, 25 bp, Mus musculus
cagtcagccctggaaacagacatat

SEQ ID NO: 322553 - DNA, 25 bp, Mus musculus
cagtcagccctggttatatttgtga

SEQ ID NO: 322554 - DNA, 25 bp, Mus musculus
cagtcagcgtgaccctgagcgttgt

SEQ ID NO: 322555 - DNA, 25 bp, Mus musculus
cagtcagcgtgagcctgagcgttgt

SEQ ID NO: 322556 - DNA, 25 bp, Mus musculus
cagtcagctctacccatctgagaaa

SEQ ID NO: 322557 - DNA, 25 bp, Mus musculus
cagtcagctctagccatctgagaaa

SEQ ID NO: 322558 - DNA, 25 bp, Mus musculus
cagtcagcttacatgcacagcaata

SEQ ID NO: 322559 - DNA, 25 bp, Mus musculus
cagtcagcttacttgcacagcaata

SEQ ID NO: 322560 - DNA, 25 bp, Mus musculus
cagtcaggacgactacatcaccaag

SEQ ID NO: 322561 - DNA, 25 bp, Mus musculus
cagtcaggacgagtacatcaccaag

SEQ ID NO: 322562 - DNA, 25 bp, Mus musculus
cagtcaggacttcgttggcccaaac

SEQ ID NO: 322563 - DNA, 25 bp, Mus musculus
cagtcaggacttggttggcccaaac

SEQ ID NO: 322564 - DNA, 25 bp, Mus musculus
cagtcaggatggaacagtgctacaa

SEQ ID NO: 322565 - DNA, 25 bp, Mus musculus
cagtcaggatggtacagtgctacaa

SEQ ID NO: 322566 - DNA, 25 bp, Mus musculus
cagtcaggcccaagcaggaaagagt

SEQ ID NO: 322567 - DNA, 25 bp, Mus musculus
cagtcaggcccatgcaggaaagagt

SEQ ID NO: 322568 - DNA, 25 bp, Mus musculus
cagtcagggtggactggccctgtta

SEQ ID NO: 322569 - DNA, 25 bp, Mus musculus
cagtcagggtggtctggccctgtta

SEQ ID NO: 322570 - DNA, 25 bp, Mus musculus
cagtcaggtcttctacagtaatccc

SEQ ID NO: 322571 - DNA, 25 bp, Mus musculus
cagtcaggtcttgtacagtaatccc

SEQ ID NO: 322572 - DNA, 25 bp, Mus musculus
cagtcaggtgtcatcctccgaaacc

SEQ ID NO: 322573 - DNA, 25 bp, Mus musculus
cagtcaggtgtcttcctccgaaacc

SEQ ID NO: 322574 - DNA, 25 bp, Mus musculus
cagtcagtaaacaaacccataggga

SEQ ID NO: 322575 - DNA, 25 bp, Mus musculus
cagtcagtaaactaacccataggga

SEQ ID NO: 322576 - DNA, 25 bp, Mus musculus
cagtcagtatccagcccagtttgcc

SEQ ID NO: 322577 - DNA, 25 bp, Mus musculus
cagtcagtatcctgcccagtttgcc

SEQ ID NO: 322578 - DNA, 25 bp, Mus musculus
cagtcagtgcctccatcaaaacggg

SEQ ID NO: 322579 - DNA, 25 bp, Mus musculus
cagtcagtgcctgcatcaaaacggg

SEQ ID NO: 322580 - DNA, 25 bp, Mus musculus
cagtcagtggttccagttgtagcct

SEQ ID NO: 322581 - DNA, 25 bp, Mus musculus
cagtcagtggttgcagttgtagcct

SEQ ID NO: 322582 - DNA, 25 bp, Mus musculus
cagtcagtgtcaactcccgggtgaa

SEQ ID NO: 322583 - DNA, 25 bp, Mus musculus
cagtcagtgtcatctcccgggtgaa

SEQ ID NO: 322584 - DNA, 25 bp, Mus musculus
cagtcagttgttcttctgcctcttg

SEQ ID NO: 322585 - DNA, 25 bp, Mus musculus
cagtcagttgttgttctgcctcttg

SEQ ID NO: 322586 - DNA, 25 bp, Mus musculus
cagtcagtttaaagtttgttcctct

SEQ ID NO: 322587 - DNA, 25 bp, Mus musculus
cagtcagtttaatgtttgttcctct

SEQ ID NO: 322588 - DNA, 25 bp, Mus musculus
cagtcagttttaatctggttgtaaa

SEQ ID NO: 322589 - DNA, 25 bp, Mus musculus
cagtcagttttattctggttgtaaa

SEQ ID NO: 322590 - DNA, 25 bp, Mus musculus
cagtcagttttgaaattggccttta

SEQ ID NO: 322591 - DNA, 25 bp, Mus musculus
cagtcagttttgtaattggccttta

SEQ ID NO: 322592 - DNA, 25 bp, Mus musculus
cagtcatcagctagcttcaggttta

SEQ ID NO: 322593 - DNA, 25 bp, Mus musculus
cagtcatcagcttgcttcaggttta

SEQ ID NO: 322594 - DNA, 25 bp, Mus musculus
cagtcatcctggctgtgatgatcga

SEQ ID NO: 322595 - DNA, 25 bp, Mus musculus
cagtcatcctgggtgtgatgatcga

SEQ ID NO: 322596 - DNA, 25 bp, Mus musculus
cagtcatctcataaatataccgaaa

SEQ ID NO: 322597 - DNA, 25 bp, Mus musculus
cagtcatctcattaatataccgaaa

SEQ ID NO: 322598 - DNA, 25 bp, Mus musculus
cagtcatctgtaaccccaattccag

SEQ ID NO: 322599 - DNA, 25 bp, Mus musculus
cagtcatctgtatccccaattccag

SEQ ID NO: 322600 - DNA, 25 bp, Mus musculus
cagtcatctgtgaagctagcgtgca

SEQ ID NO: 322601 - DNA, 25 bp, Mus musculus
cagtcatctgtgtagctagcgtgca

SEQ ID NO: 322602 - DNA, 25 bp, Mus musculus
cagtcatgagctcgccaaagcccag

SEQ ID NO: 322603 - DNA, 25 bp, Mus musculus
cagtcatgagctggccaaagcccag

SEQ ID NO: 322604 - DNA, 25 bp, Mus musculus
cagtcatgagggagtagctgtcctt

SEQ ID NO: 322605 - DNA, 25 bp, Mus musculus
cagtcatgagggtgtagctgtcctt

SEQ ID NO: 322606 - DNA, 25 bp, Mus musculus
cagtcatgccaaccttgagcagagt

SEQ ID NO: 322607 - DNA, 25 bp, Mus musculus
cagtcatgccaagcttgagcagagt

SEQ ID NO: 322608 - DNA, 25 bp, Mus musculus
cagtcatggcatcccctctggatca

SEQ ID NO: 322609 - DNA, 25 bp, Mus musculus
cagtcatggcatgccctctggatca

SEQ ID NO: 322610 - DNA, 25 bp, Mus musculus
cagtcatgggctcggtgctcgattc

SEQ ID NO: 322611 - DNA, 25 bp, Mus musculus
cagtcatgggctgggtgctcgattc

SEQ ID NO: 322612 - DNA, 25 bp, Mus musculus
cagtcatggtcaacagggagtttga

SEQ ID NO: 322613 - DNA, 25 bp, Mus musculus
cagtcatggtcatcagggagtttga

SEQ ID NO: 322614 - DNA, 25 bp, Mus musculus
cagtcatgtctaattgctgaagaac

SEQ ID NO: 322615 - DNA, 25 bp, Mus musculus
cagtcatgtctatttgctgaagaac

SEQ ID NO: 322616 - DNA, 25 bp, Mus musculus
cagtcatgtgataggcttttgccct

SEQ ID NO: 322617 - DNA, 25 bp, Mus musculus
cagtcatgtgattggcttttgccct

SEQ ID NO: 322618 - DNA, 25 bp, Mus musculus
cagtcatgtgccatctatttggtga

SEQ ID NO: 322619 - DNA, 25 bp, Mus musculus
cagtcatgtgccttctatttggtga

SEQ ID NO: 322620 - DNA, 25 bp, Mus musculus
cagtcattcttcaatttacccggtg

SEQ ID NO: 322621 - DNA, 25 bp, Mus musculus
cagtcattcttctatttacccggtg

SEQ ID NO: 322622 - DNA, 25 bp, Mus musculus
cagtcattgacacgctagacccaaa

SEQ ID NO: 322623 - DNA, 25 bp, Mus musculus
cagtcattgacaggctagacccaaa

SEQ ID NO: 322624 - DNA, 25 bp, Mus musculus
cagtcattgatgagcccgagcccta

SEQ ID NO: 322625 - DNA, 25 bp, Mus musculus
cagtcattgatgtgcccgagcccta

SEQ ID NO: 322626 - DNA, 25 bp, Mus musculus
cagtcattgcacataacctcaggag

SEQ ID NO: 322627 - DNA, 25 bp, Mus musculus
cagtcattgcacttaacctcaggag

SEQ ID NO: 322628 - DNA, 25 bp, Mus musculus
cagtcattgctccagtttaaattac

SEQ ID NO: 322629 - DNA, 25 bp, Mus musculus
cagtcattgctcgagtttaaattac

SEQ ID NO: 322630 - DNA, 25 bp, Mus musculus
cagtcattgtatcttcttcccttca

SEQ ID NO: 322631 - DNA, 25 bp, Mus musculus
cagtcattgtatgttcttcccttca

SEQ ID NO: 322632 - DNA, 25 bp, Mus musculus
cagtcatttaagctcatagtcccaa

SEQ ID NO: 322633 - DNA, 25 bp, Mus musculus
cagtcatttaaggtcatagtcccaa

SEQ ID NO: 322634 - DNA, 25 bp, Mus musculus
cagtcatttgtactctccatgcaat

SEQ ID NO: 322635 - DNA, 25 bp, Mus musculus
cagtcatttgtagtctccatgcaat

SEQ ID NO: 322636 - DNA, 25 bp, Mus musculus
cagtccaaagccatcatgtttgtca

SEQ ID NO: 322637 - DNA, 25 bp, Mus musculus
cagtccaaagccctctgcggaaaaa

SEQ ID NO: 322638 - DNA, 25 bp, Mus musculus
cagtccaaagccgtctgcggaaaaa

SEQ ID NO: 322639 - DNA, 25 bp, Mus musculus
cagtccaaagccttcatgtttgtca

SEQ ID NO: 322640 - DNA, 25 bp, Mus musculus
cagtccaacagtcctttccagtaga

SEQ ID NO: 322641 - DNA, 25 bp, Mus musculus
cagtccaacagtgctttccagtaga

SEQ ID NO: 322642 - DNA, 25 bp, Mus musculus
cagtccaagaacaacccaggcagga

SEQ ID NO: 322643 - DNA, 25 bp, Mus musculus
cagtccaagaactacccaggcagga

SEQ ID NO: 322644 - DNA, 25 bp, Mus musculus
cagtccaagagaaggcgcgatgcgt

SEQ ID NO: 322645 - DNA, 25 bp, Mus musculus
cagtccaagagatggcgcgatgcgt

SEQ ID NO: 322646 - DNA, 25 bp, Mus musculus
cagtccaatcccaattcacttttat

SEQ ID NO: 322647 - DNA, 25 bp, Mus musculus
cagtccaatccctattcacttttat

SEQ ID NO: 322648 - DNA, 25 bp, Mus musculus
cagtccaatctcagagtgcaagatg

SEQ ID NO: 322649 - DNA, 25 bp, Mus musculus
cagtccaatctctgagtgcaagatg

SEQ ID NO: 322650 - DNA, 25 bp, Mus musculus
cagtccacagatataagggcctttt

SEQ ID NO: 322651 - DNA, 25 bp, Mus musculus
cagtccacagatttaagggcctttt

SEQ ID NO: 322652 - DNA, 25 bp, Mus musculus
cagtccacatcacagaaacagtagg

SEQ ID NO: 322653 - DNA, 25 bp, Mus musculus
cagtccacatcagagaaacagtagg

SEQ ID NO: 322654 - DNA, 25 bp, Mus musculus
cagtccaccacaaatccgagataaa

SEQ ID NO: 322655 - DNA, 25 bp, Mus musculus
cagtccaccacatatccgagataaa

SEQ ID NO: 322656 - DNA, 25 bp, Mus musculus
cagtccagaccccatcagaggagag

SEQ ID NO: 322657 - DNA, 25 bp, Mus musculus
cagtccagacccgatcagaggagag

SEQ ID NO: 322658 - DNA, 25 bp, Mus musculus
cagtccagggaaaagaggtgtcttc

SEQ ID NO: 322659 - DNA, 25 bp, Mus musculus
cagtccagggaatagaggtgtcttc

SEQ ID NO: 322660 - DNA, 25 bp, Mus musculus
cagtccagggcaagtcgcaggagca

SEQ ID NO: 322661 - DNA, 25 bp, Mus musculus
cagtccagggcatgtcgcaggagca

SEQ ID NO: 322662 - DNA, 25 bp, Mus musculus
cagtccagtgccctgtacgcttttc

SEQ ID NO: 322663 - DNA, 25 bp, Mus musculus
cagtccagtgccgtgtacgcttttc

SEQ ID NO: 322664 - DNA, 25 bp, Mus musculus
cagtccatactgatccaatccttaa

SEQ ID NO: 322665 - DNA, 25 bp, Mus musculus
cagtccatactgctgatgcttgcta

SEQ ID NO: 322666 - DNA, 25 bp, Mus musculus
cagtccatactggtgatgcttgcta

SEQ ID NO: 322667 - DNA, 25 bp, Mus musculus
cagtccatactgttccaatccttaa

SEQ ID NO: 322668 - DNA, 25 bp, Mus musculus
cagtccataggcctcagcaaacaag

SEQ ID NO: 322669 - DNA, 25 bp, Mus musculus
cagtccataggcgtcagcaaacaag

SEQ ID NO: 322670 - DNA, 25 bp, Mus musculus
cagtccatcatgagtgttaattaaa

SEQ ID NO: 322671 - DNA, 25 bp, Mus musculus
cagtccatcatgtgtgttaattaaa

SEQ ID NO: 322672 - DNA, 25 bp, Mus musculus
cagtccatcattatactctcttgaa

SEQ ID NO: 322673 - DNA, 25 bp, Mus musculus
cagtccatcattttactctcttgaa

SEQ ID NO: 322674 - DNA, 25 bp, Mus musculus
cagtccatccatagctcacaatgag

SEQ ID NO: 322675 - DNA, 25 bp, Mus musculus
cagtccatccattgctcacaatgag

SEQ ID NO: 322676 - DNA, 25 bp, Mus musculus
cagtccatgaggagttctgtgtact

SEQ ID NO: 322677 - DNA, 25 bp, Mus musculus
cagtccatgaggtgttctgtgtact

SEQ ID NO: 322678 - DNA, 25 bp, Mus musculus
cagtccatggacatattctatttca

SEQ ID NO: 322679 - DNA, 25 bp, Mus musculus
cagtccatggacttattctatttca

SEQ ID NO: 322680 - DNA, 25 bp, Mus musculus
cagtccatgtcaatgtctctctaat

SEQ ID NO: 322681 - DNA, 25 bp, Mus musculus
cagtccatgtcattgtctctctaat

SEQ ID NO: 322682 - DNA, 25 bp, Mus musculus
cagtccatttcaaaattcccctaga

SEQ ID NO: 322683 - DNA, 25 bp, Mus musculus
cagtccatttcataattcccctaga

SEQ ID NO: 322684 - DNA, 25 bp, Mus musculus
cagtcccaagcgcagtgaatcaaat

SEQ ID NO: 322685 - DNA, 25 bp, Mus musculus
cagtcccaagcggagtgaatcaaat

SEQ ID NO: 322686 - DNA, 25 bp, Mus musculus
cagtcccaaggacagtgtttcctaa

SEQ ID NO: 322687 - DNA, 25 bp, Mus musculus
cagtcccaaggagagtgtttcctaa

SEQ ID NO: 322688 - DNA, 25 bp, Mus musculus
cagtcccactacagtaatgtccgag

SEQ ID NO: 322689 - DNA, 25 bp, Mus musculus
cagtcccactactgtaatgtccgag

SEQ ID NO: 322690 - DNA, 25 bp, Mus musculus
cagtcccactccattagatttgatg

SEQ ID NO: 322691 - DNA, 25 bp, Mus musculus
cagtcccactcctttagatttgatg

SEQ ID NO: 322692 - DNA, 25 bp, Mus musculus
cagtcccactctactaacataaaaa

SEQ ID NO: 322693 - DNA, 25 bp, Mus musculus
cagtcccactcttctaacataaaaa

SEQ ID NO: 322694 - DNA, 25 bp, Mus musculus
cagtcccactgcaggcaatgaatgg

SEQ ID NO: 322695 - DNA, 25 bp, Mus musculus
cagtcccactgctggcaatgaatgg

SEQ ID NO: 322696 - DNA, 25 bp, Mus musculus
cagtcccagcttacttgaaaccaag

SEQ ID NO: 322697 - DNA, 25 bp, Mus musculus
cagtcccagctttcttgaaaccaag

SEQ ID NO: 322698 - DNA, 25 bp, Mus musculus
cagtcccaggcaattaaggctgcca

SEQ ID NO: 322699 - DNA, 25 bp, Mus musculus
cagtcccaggcatttaaggctgcca

SEQ ID NO: 322700 - DNA, 25 bp, Mus musculus
cagtcccaggtgatgctaagccagc

SEQ ID NO: 322701 - DNA, 25 bp, Mus musculus
cagtcccaggtgttgctaagccagc

SEQ ID NO: 322702 - DNA, 25 bp, Mus musculus
cagtcccataacaaacaccaagtat

SEQ ID NO: 322703 - DNA, 25 bp, Mus musculus
cagtcccataactaacaccaagtat

SEQ ID NO: 322704 - DNA, 25 bp, Mus musculus
cagtcccatcgcaatatccagtggg

SEQ ID NO: 322705 - DNA, 25 bp, Mus musculus
cagtcccatcgctatatccagtggg

SEQ ID NO: 322706 - DNA, 25 bp, Mus musculus
cagtccccaaaccacatagttttga

SEQ ID NO: 322707 - DNA, 25 bp, Mus musculus
cagtccccaaacgacatagttttga

SEQ ID NO: 322708 - DNA, 25 bp, Mus musculus
cagtccccagaacagtccagttaat

SEQ ID NO: 322709 - DNA, 25 bp, Mus musculus
cagtccccagaagagtccagttaat

SEQ ID NO: 322710 - DNA, 25 bp, Mus musculus
cagtccccattacttacacttaggt

SEQ ID NO: 322711 - DNA, 25 bp, Mus musculus
cagtccccattagttacacttaggt

SEQ ID NO: 322712 - DNA, 25 bp, Mus musculus
cagtccccgataattatctctttac

SEQ ID NO: 322713 - DNA, 25 bp, Mus musculus
cagtccccgatatttatctctttac

SEQ ID NO: 322714 - DNA, 25 bp, Mus musculus
cagtccccgggtcttggtgcgcctt

SEQ ID NO: 322715 - DNA, 25 bp, Mus musculus
cagtccccgggtgttggtgcgcctt

SEQ ID NO: 322716 - DNA, 25 bp, Mus musculus
cagtcccctaatctagtcacttggt

SEQ ID NO: 322717 - DNA, 25 bp, Mus musculus
cagtcccctaatgtagtcacttggt

SEQ ID NO: 322718 - DNA, 25 bp, Mus musculus
cagtcccctcctcggaagtgcaggg

SEQ ID NO: 322719 - DNA, 25 bp, Mus musculus
cagtcccctcctgggaagtgcaggg

SEQ ID NO: 322720 - DNA, 25 bp, Mus musculus
cagtcccgagaacttcacctatgag

SEQ ID NO: 322721 - DNA, 25 bp, Mus musculus
cagtcccgagaagttcacctatgag

SEQ ID NO: 322722 - DNA, 25 bp, Mus musculus
cagtcccgtagcctcttcttttctt

SEQ ID NO: 322723 - DNA, 25 bp, Mus musculus
cagtcccgtagcgtcttcttttctt

SEQ ID NO: 322724 - DNA, 25 bp, Mus musculus
cagtcccgtggaatgtacaaagcct

SEQ ID NO: 322725 - DNA, 25 bp, Mus musculus
cagtcccgtggattgtacaaagcct

SEQ ID NO: 322726 - DNA, 25 bp, Mus musculus
cagtccctcctgcagtcagactgaa

SEQ ID NO: 322727 - DNA, 25 bp, Mus musculus
cagtccctcctgctcataaagtcag

SEQ ID NO: 322728 - DNA, 25 bp, Mus musculus
cagtccctcctggagtcagactgaa

SEQ ID NO: 322729 - DNA, 25 bp, Mus musculus
cagtccctcctggtcataaagtcag

SEQ ID NO: 322730 - DNA, 25 bp, Mus musculus
cagtccctctagattgattttcctc

SEQ ID NO: 322731 - DNA, 25 bp, Mus musculus
cagtccctctagtttgattttcctc

SEQ ID NO: 322732 - DNA, 25 bp, Mus musculus
cagtccctctctctttagtaggaat

SEQ ID NO: 322733 - DNA, 25 bp, Mus musculus
cagtccctctctgtttagtaggaat

SEQ ID NO: 322734 - DNA, 25 bp, Mus musculus
cagtccctctggctagtttcatcag

SEQ ID NO: 322735 - DNA, 25 bp, Mus musculus
cagtccctctgggtagtttcatcag

SEQ ID NO: 322736 - DNA, 25 bp, Mus musculus
cagtccctgcaaacttttgttttat

SEQ ID NO: 322737 - DNA, 25 bp, Mus musculus
cagtccctgcaatcttttgttttat

SEQ ID NO: 322738 - DNA, 25 bp, Mus musculus
cagtccctgctaacaatggagcatt

SEQ ID NO: 322739 - DNA, 25 bp, Mus musculus
cagtccctgctatcaatggagcatt

SEQ ID NO: 322740 - DNA, 25 bp, Mus musculus
cagtccctggaacctacatgtctaa

SEQ ID NO: 322741 - DNA, 25 bp, Mus musculus
cagtccctggaagctacatgtctaa

SEQ ID NO: 322742 - DNA, 25 bp, Mus musculus
cagtccctggatcgcatttacttcc

SEQ ID NO: 322743 - DNA, 25 bp, Mus musculus
cagtccctggatggcatttacttcc

SEQ ID NO: 322744 - DNA, 25 bp, Mus musculus
cagtccctgggacttcatattgttg

SEQ ID NO: 322745 - DNA, 25 bp, Mus musculus
cagtccctgggagttcatattgttg

SEQ ID NO: 322746 - DNA, 25 bp, Mus musculus
cagtccctgggtaggacctaggaca

SEQ ID NO: 322747 - DNA, 25 bp, Mus musculus
cagtccctgggttggacctaggaca

SEQ ID NO: 322748 - DNA, 25 bp, Mus musculus
cagtccctggtcagcactgagaatg

SEQ ID NO: 322749 - DNA, 25 bp, Mus musculus
cagtccctggtctgcactgagaatg

SEQ ID NO: 322750 - DNA, 25 bp, Mus musculus
cagtccctttcacaattgcttgata

SEQ ID NO: 322751 - DNA, 25 bp, Mus musculus
cagtccctttcagaattgcttgata

SEQ ID NO: 322752 - DNA, 25 bp, Mus musculus
cagtccgcagggctgttcagtcgct

SEQ ID NO: 322753 - DNA, 25 bp, Mus musculus
cagtccgcaggggtgttcagtcgct

SEQ ID NO: 322754 - DNA, 25 bp, Mus musculus
cagtccgcatccatacacagaaggg

SEQ ID NO: 322755 - DNA, 25 bp, Mus musculus
cagtccgcatccttacacagaaggg

SEQ ID NO: 322756 - DNA, 25 bp, Mus musculus
cagtccgcccccatcggcacctagg

SEQ ID NO: 322757 - DNA, 25 bp, Mus musculus
cagtccgcccccttcggcacctagg

SEQ ID NO: 322758 - DNA, 25 bp, Mus musculus
cagtccgctcggaatttcagacctt

SEQ ID NO: 322759 - DNA, 25 bp, Mus musculus
cagtccgctcggtatttcagacctt

SEQ ID NO: 322760 - DNA, 25 bp, Mus musculus
cagtccggtgagctcagctcatgaa

SEQ ID NO: 322761 - DNA, 25 bp, Mus musculus
cagtccggtgaggtcagctcatgaa

SEQ ID NO: 322762 - DNA, 25 bp, Mus musculus
cagtccgttattcttggtgcatagc

SEQ ID NO: 322763 - DNA, 25 bp, Mus musculus
cagtccgttattgttggtgcatagc

SEQ ID NO: 322764 - DNA, 25 bp, Mus musculus
cagtccgttcttacctagcgtggaa

SEQ ID NO: 322765 - DNA, 25 bp, Mus musculus
cagtccgttctttcctagcgtggaa

SEQ ID NO: 322766 - DNA, 25 bp, Mus musculus
cagtcctaaaataggctgtcgtaaa

SEQ ID NO: 322767 - DNA, 25 bp, Mus musculus
cagtcctaaaattggctgtcgtaaa

SEQ ID NO: 322768 - DNA, 25 bp, Mus musculus
cagtcctaaagaccacagccttcta

SEQ ID NO: 322769 - DNA, 25 bp, Mus musculus
cagtcctaaagagcacagccttcta

SEQ ID NO: 322770 - DNA, 25 bp, Mus musculus
cagtcctaagctctccactggagac

SEQ ID NO: 322771 - DNA, 25 bp, Mus musculus
cagtcctaagctgtccactggagac

SEQ ID NO: 322772 - DNA, 25 bp, Mus musculus
cagtcctacacaataacctcggttt

SEQ ID NO: 322773 - DNA, 25 bp, Mus musculus
cagtcctacacattaacctcggttt

SEQ ID NO: 322774 - DNA, 25 bp, Mus musculus
cagtcctaccagatggatttcaaca

SEQ ID NO: 322775 - DNA, 25 bp, Mus musculus
cagtcctaccagttggatttcaaca

SEQ ID NO: 322776 - DNA, 25 bp, Mus musculus
cagtcctagatcaaatcccttttga

SEQ ID NO: 322777 - DNA, 25 bp, Mus musculus
cagtcctagatctaatcccttttga

SEQ ID NO: 322778 - DNA, 25 bp, Mus musculus
cagtcctaggaacctaatctgggct

SEQ ID NO: 322779 - DNA, 25 bp, Mus musculus
cagtcctaggaagctaatctgggct

SEQ ID NO: 322780 - DNA, 25 bp, Mus musculus
cagtcctatataacagtcacggcat

SEQ ID NO: 322781 - DNA, 25 bp, Mus musculus
cagtcctatatatcagtcacggcat

SEQ ID NO: 322782 - DNA, 25 bp, Mus musculus
cagtcctatttgacctatttcattc

SEQ ID NO: 322783 - DNA, 25 bp, Mus musculus
cagtcctatttgtcctatttcattc

SEQ ID NO: 322784 - DNA, 25 bp, Mus musculus
cagtcctcagacatatgcacaaata

SEQ ID NO: 322785 - DNA, 25 bp, Mus musculus
cagtcctcagacttatgcacaaata

SEQ ID NO: 322786 - DNA, 25 bp, Mus musculus
cagtcctcagatcttgtcctagtaa

SEQ ID NO: 322787 - DNA, 25 bp, Mus musculus
cagtcctcagatgttgtcctagtaa

SEQ ID NO: 322788 - DNA, 25 bp, Mus musculus
cagtcctcataaaatttctatccct

SEQ ID NO: 322789 - DNA, 25 bp, Mus musculus
cagtcctcataatatttctatccct

SEQ ID NO: 322790 - DNA, 25 bp, Mus musculus
cagtcctcccgcatgaattttatag

SEQ ID NO: 322791 - DNA, 25 bp, Mus musculus
cagtcctcccgcttgaattttatag

SEQ ID NO: 322792 - DNA, 25 bp, Mus musculus
cagtcctcctcgcaagctagtgaag

SEQ ID NO: 322793 - DNA, 25 bp, Mus musculus
cagtcctcctcggaagctagtgaag

SEQ ID NO: 322794 - DNA, 25 bp, Mus musculus
cagtcctctgatagtgccccagtgt

SEQ ID NO: 322795 - DNA, 25 bp, Mus musculus
cagtcctctgattgtgccccagtgt

SEQ ID NO: 322796 - DNA, 25 bp, Mus musculus
cagtcctcttaccacttgtcaaata

SEQ ID NO: 322797 - DNA, 25 bp, Mus musculus
cagtcctcttacgacttgtcaaata

SEQ ID NO: 322798 - DNA, 25 bp, Mus musculus
cagtcctgcccaaggctctgtcttt

SEQ ID NO: 322799 - DNA, 25 bp, Mus musculus
cagtcctgcccatggctctgtcttt

SEQ ID NO: 322800 - DNA, 25 bp, Mus musculus
cagtcctgtcagcaacagtgcttca

SEQ ID NO: 322801 - DNA, 25 bp, Mus musculus
cagtcctgtcaggaacagtgcttca

SEQ ID NO: 322802 - DNA, 25 bp, Mus musculus
cagtcctgtgacacgggtgtatgta

SEQ ID NO: 322803 - DNA, 25 bp, Mus musculus
cagtcctgtgaccaagtgagcatag

SEQ ID NO: 322804 - DNA, 25 bp, Mus musculus
cagtcctgtgacgaagtgagcatag

SEQ ID NO: 322805 - DNA, 25 bp, Mus musculus
cagtcctgtgactcgggtgtatgta

SEQ ID NO: 322806 - DNA, 25 bp, Mus musculus
cagtcctgtgagcaatttggtcctt

SEQ ID NO: 322807 - DNA, 25 bp, Mus musculus
cagtcctgtgaggaatttggtcctt

SEQ ID NO: 322808 - DNA, 25 bp, Mus musculus
cagtcctgttcaacctagcttttga

SEQ ID NO: 322809 - DNA, 25 bp, Mus musculus
cagtcctgttcatcctagcttttga

SEQ ID NO: 322810 - DNA, 25 bp, Mus musculus
cagtcctgttctcgaagcctggcca

SEQ ID NO: 322811 - DNA, 25 bp, Mus musculus
cagtcctgttctggaagcctggcca

SEQ ID NO: 322812 - DNA, 25 bp, Mus musculus
cagtccttagaaccacgtggtagga

SEQ ID NO: 322813 - DNA, 25 bp, Mus musculus
cagtccttagaagcacgtggtagga

SEQ ID NO: 322814 - DNA, 25 bp, Mus musculus
cagtccttccgcatggcaatgggaa

SEQ ID NO: 322815 - DNA, 25 bp, Mus musculus
cagtccttccgcttggcaatgggaa

SEQ ID NO: 322816 - DNA, 25 bp, Mus musculus
cagtccttcgtcactaatgtcgtat

SEQ ID NO: 322817 - DNA, 25 bp, Mus musculus
cagtccttcgtctctaatgtcgtat

SEQ ID NO: 322818 - DNA, 25 bp, Mus musculus
cagtccttcttaaagctttagttta

SEQ ID NO: 322819 - DNA, 25 bp, Mus musculus
cagtccttcttatagctttagttta

SEQ ID NO: 322820 - DNA, 25 bp, Mus musculus
cagtccttgagcagtcctatagaag

SEQ ID NO: 322821 - DNA, 25 bp, Mus musculus
cagtccttgagctgtcctatagaag

SEQ ID NO: 322822 - DNA, 25 bp, Mus musculus
cagtccttgttaaataccattggtt

SEQ ID NO: 322823 - DNA, 25 bp, Mus musculus
cagtccttgttatataccattggtt

SEQ ID NO: 322824 - DNA, 25 bp, Mus musculus
cagtcctttatcacctgtataattt

SEQ ID NO: 322825 - DNA, 25 bp, Mus musculus
cagtcctttatctcctgtataattt

SEQ ID NO: 322826 - DNA, 25 bp, Mus musculus
cagtcctttcaaattcaggctcaaa

SEQ ID NO: 322827 - DNA, 25 bp, Mus musculus
cagtcctttcaatttcaggctcaaa

SEQ ID NO: 322828 - DNA, 25 bp, Mus musculus
cagtcctttgcacaatgtcacactc

SEQ ID NO: 322829 - DNA, 25 bp, Mus musculus
cagtcctttgcagaatgtcacactc

SEQ ID NO: 322830 - DNA, 25 bp, Mus musculus
cagtcctttggcagtcccaaacaaa

SEQ ID NO: 322831 - DNA, 25 bp, Mus musculus
cagtcctttggctgtcccaaacaaa

SEQ ID NO: 322832 - DNA, 25 bp, Mus musculus
cagtcgacttttcttccctgggaga

SEQ ID NO: 322833 - DNA, 25 bp, Mus musculus
cagtcgacttttgttccctgggaga

SEQ ID NO: 322834 - DNA, 25 bp, Mus musculus
cagtcgatcaggatggtgcttccaa

SEQ ID NO: 322835 - DNA, 25 bp, Mus musculus
cagtcgatcaggttggtgcttccaa

SEQ ID NO: 322836 - DNA, 25 bp, Mus musculus
cagtcgatgcttagacttgtttttc

SEQ ID NO: 322837 - DNA, 25 bp, Mus musculus
cagtcgatgctttgacttgtttttc

SEQ ID NO: 322838 - DNA, 25 bp, Mus musculus
cagtcgcaacctcagggtgttgttg

SEQ ID NO: 322839 - DNA, 25 bp, Mus musculus
cagtcgcaacctgagggtgttgttg

SEQ ID NO: 322840 - DNA, 25 bp, Mus musculus
cagtcgcaggacatctagccagagg

SEQ ID NO: 322841 - DNA, 25 bp, Mus musculus
cagtcgcaggacttctagccagagg

SEQ ID NO: 322842 - DNA, 25 bp, Mus musculus
cagtcgccctgtattgaggtctcaa

SEQ ID NO: 322843 - DNA, 25 bp, Mus musculus
cagtcgccctgttttgaggtctcaa

SEQ ID NO: 322844 - DNA, 25 bp, Mus musculus
cagtcgcctctgcgccaaaggtgac

SEQ ID NO: 322845 - DNA, 25 bp, Mus musculus
cagtcgcctctgggccaaaggtgac

SEQ ID NO: 322846 - DNA, 25 bp, Mus musculus
cagtcgccttttacagtgcagtaga

SEQ ID NO: 322847 - DNA, 25 bp, Mus musculus
cagtcgcctttttcagtgcagtaga

SEQ ID NO: 322848 - DNA, 25 bp, Mus musculus
cagtcgcgggacctgcgagcaaata

SEQ ID NO: 322849 - DNA, 25 bp, Mus musculus
cagtcgcgggacgtgcgagcaaata

SEQ ID NO: 322850 - DNA, 25 bp, Mus musculus
cagtcgctggtaaccgctgcgtgtg

SEQ ID NO: 322851 - DNA, 25 bp, Mus musculus
cagtcgctggtatccgctgcgtgtg

SEQ ID NO: 322852 - DNA, 25 bp, Mus musculus
cagtcgctggtgctgaaatatctgt

SEQ ID NO: 322853 - DNA, 25 bp, Mus musculus
cagtcgctggtggtgaaatatctgt

SEQ ID NO: 322854 - DNA, 25 bp, Mus musculus
cagtcgctgtgactacctcatggag

SEQ ID NO: 322855 - DNA, 25 bp, Mus musculus
cagtcgctgtgagtacctcatggag

SEQ ID NO: 322856 - DNA, 25 bp, Mus musculus
cagtcggaggcaatggtagttatat

SEQ ID NO: 322857 - DNA, 25 bp, Mus musculus
cagtcggaggcattggtagttatat

SEQ ID NO: 322858 - DNA, 25 bp, Mus musculus
cagtcggagtttcctgtggctgaca

SEQ ID NO: 322859 - DNA, 25 bp, Mus musculus
cagtcggagtttgctgtggctgaca

SEQ ID NO: 322860 - DNA, 25 bp, Mus musculus
cagtcggatgcacccacaccagtgg

SEQ ID NO: 322861 - DNA, 25 bp, Mus musculus
cagtcggatgcagccacaccagtgg

SEQ ID NO: 322862 - DNA, 25 bp, Mus musculus
cagtcgggcaacaaattatacccaa

SEQ ID NO: 322863 - DNA, 25 bp, Mus musculus
cagtcgggcaactaattatacccaa

SEQ ID NO: 322864 - DNA, 25 bp, Mus musculus
cagtcgggtcgacctccaaggatga

SEQ ID NO: 322865 - DNA, 25 bp, Mus musculus
cagtcgggtcgagctccaaggatga

SEQ ID NO: 322866 - DNA, 25 bp, Mus musculus
cagtcggtccagcacgaagcctgtt

SEQ ID NO: 322867 - DNA, 25 bp, Mus musculus
cagtcggtccaggacgaagcctgtt

SEQ ID NO: 322868 - DNA, 25 bp, Mus musculus
cagtcggtgctcatccttactgagc

SEQ ID NO: 322869 - DNA, 25 bp, Mus musculus
cagtcggtgctcttccttactgagc

SEQ ID NO: 322870 - DNA, 25 bp, Mus musculus
cagtcggtggttagtttactatgaa

SEQ ID NO: 322871 - DNA, 25 bp, Mus musculus
cagtcggtggtttgtttactatgaa

SEQ ID NO: 322872 - DNA, 25 bp, Mus musculus
cagtcggttggcatggtcaggctca

SEQ ID NO: 322873 - DNA, 25 bp, Mus musculus
cagtcggttggcttggtcaggctca

SEQ ID NO: 322874 - DNA, 25 bp, Mus musculus
cagtcgtagccaccgcgagaagtcg

SEQ ID NO: 322875 - DNA, 25 bp, Mus musculus
cagtcgtagccagcgcgagaagtcg

SEQ ID NO: 322876 - DNA, 25 bp, Mus musculus
cagtcgtctctcagttcttgaggta

SEQ ID NO: 322877 - DNA, 25 bp, Mus musculus
cagtcgtctctctgttcttgaggta

SEQ ID NO: 322878 - DNA, 25 bp, Mus musculus
cagtcgtctggacaatcatgccttc

SEQ ID NO: 322879 - DNA, 25 bp, Mus musculus
cagtcgtctggagaatcatgccttc

SEQ ID NO: 322880 - DNA, 25 bp, Mus musculus
cagtcgtgagctaggccgtgcagca

SEQ ID NO: 322881 - DNA, 25 bp, Mus musculus
cagtcgtgagcttggccgtgcagca

SEQ ID NO: 322882 - DNA, 25 bp, Mus musculus
cagtcgtgtgtaatatgagaggatc

SEQ ID NO: 322883 - DNA, 25 bp, Mus musculus
cagtcgtgtgtattatgagaggatc

SEQ ID NO: 322884 - DNA, 25 bp, Mus musculus
cagtcgttacagatactgaagcttt

SEQ ID NO: 322885 - DNA, 25 bp, Mus musculus
cagtcgttacagttactgaagcttt

SEQ ID NO: 322886 - DNA, 25 bp, Mus musculus
cagtcgttagctcccatgttgatac

SEQ ID NO: 322887 - DNA, 25 bp, Mus musculus
cagtcgttagctgccatgttgatac

SEQ ID NO: 322888 - DNA, 25 bp, Mus musculus
cagtcgtttctgcaggtcagcctgg

SEQ ID NO: 322889 - DNA, 25 bp, Mus musculus
cagtcgtttctggaggtcagcctgg

SEQ ID NO: 322890 - DNA, 25 bp, Mus musculus
cagtcgtttgtaaattgtgttccag

SEQ ID NO: 322891 - DNA, 25 bp, Mus musculus
cagtcgtttgtatattgtgttccag

SEQ ID NO: 322892 - DNA, 25 bp, Mus musculus
cagtcgttttatacctgaatgccca

SEQ ID NO: 322893 - DNA, 25 bp, Mus musculus
cagtcgttttattcctgaatgccca

SEQ ID NO: 322894 - DNA, 25 bp, Mus musculus
cagtctaactgtaactttcctctta

SEQ ID NO: 322895 - DNA, 25 bp, Mus musculus
cagtctaactgttactttcctctta

SEQ ID NO: 322896 - DNA, 25 bp, Mus musculus
cagtctaagaatcctcatcttcacc

SEQ ID NO: 322897 - DNA, 25 bp, Mus musculus
cagtctaagaatgctcatcttcacc

SEQ ID NO: 322898 - DNA, 25 bp, Mus musculus
cagtctaagcagcagcgggctcatc

SEQ ID NO: 322899 - DNA, 25 bp, Mus musculus
cagtctaagcaggagcgggctcatc

SEQ ID NO: 322900 - DNA, 25 bp, Mus musculus
cagtctaagcctcattacctgagtt

SEQ ID NO: 322901 - DNA, 25 bp, Mus musculus
cagtctaagcctgattacctgagtt

SEQ ID NO: 322902 - DNA, 25 bp, Mus musculus
cagtctaaggtacccagcttgtgcc

SEQ ID NO: 322903 - DNA, 25 bp, Mus musculus
cagtctaaggtagccagcttgtgcc

SEQ ID NO: 322904 - DNA, 25 bp, Mus musculus
cagtctaatacaaaagcccttcctt

SEQ ID NO: 322905 - DNA, 25 bp, Mus musculus
cagtctaatacataagcccttcctt

SEQ ID NO: 322906 - DNA, 25 bp, Mus musculus
cagtctaatgagagaccttgcttca

SEQ ID NO: 322907 - DNA, 25 bp, Mus musculus
cagtctaatgagtgaccttgcttca

SEQ ID NO: 322908 - DNA, 25 bp, Mus musculus
cagtctacattgatgggctagcggt

SEQ ID NO: 322909 - DNA, 25 bp, Mus musculus
cagtctacattgttgggctagcggt

SEQ ID NO: 322910 - DNA, 25 bp, Mus musculus
cagtctactactcgcacccggtggt

SEQ ID NO: 322911 - DNA, 25 bp, Mus musculus
cagtctactactggcacccggtggt

SEQ ID NO: 322912 - DNA, 25 bp, Mus musculus
cagtctagaattacagcatcatttt

SEQ ID NO: 322913 - DNA, 25 bp, Mus musculus
cagtctagaatttcagcatcatttt

SEQ ID NO: 322914 - DNA, 25 bp, Mus musculus
cagtctagccgaaacagggagcccc

SEQ ID NO: 322915 - DNA, 25 bp, Mus musculus
cagtctagccgatacagggagcccc

SEQ ID NO: 322916 - DNA, 25 bp, Mus musculus
cagtctagccgcaatcatgctgaga

SEQ ID NO: 322917 - DNA, 25 bp, Mus musculus
cagtctagccgctatcatgctgaga

SEQ ID NO: 322918 - DNA, 25 bp, Mus musculus
cagtctaggttaccgctggcattct

SEQ ID NO: 322919 - DNA, 25 bp, Mus musculus
cagtctaggttagcgctggcattct

SEQ ID NO: 322920 - DNA, 25 bp, Mus musculus
cagtctagtactctctgaatcccag

SEQ ID NO: 322921 - DNA, 25 bp, Mus musculus
cagtctagtactgtctgaatcccag

SEQ ID NO: 322922 - DNA, 25 bp, Mus musculus
cagtctatagtcagcaggcccctgg

SEQ ID NO: 322923 - DNA, 25 bp, Mus musculus
cagtctatagtctgcaggcccctgg

SEQ ID NO: 322924 - DNA, 25 bp, Mus musculus
cagtctatgaacactcagggcttta

SEQ ID NO: 322925 - DNA, 25 bp, Mus musculus
cagtctatgaactctcagggcttta

SEQ ID NO: 322926 - DNA, 25 bp, Mus musculus
cagtctatttagctaagccaggaac

SEQ ID NO: 322927 - DNA, 25 bp, Mus musculus
cagtctatttaggtaagccaggaac

SEQ ID NO: 322928 - DNA, 25 bp, Mus musculus
cagtctcaaggaagcctggctcaca

SEQ ID NO: 322929 - DNA, 25 bp, Mus musculus
cagtctcaaggatgcctggctcaca

SEQ ID NO: 322930 - DNA, 25 bp, Mus musculus
cagtctcaaggtccttttgctgagc

SEQ ID NO: 322931 - DNA, 25 bp, Mus musculus
cagtctcaaggtgcttttgctgagc

SEQ ID NO: 322932 - DNA, 25 bp, Mus musculus
cagtctcaattcactaccttgtgta

SEQ ID NO: 322933 - DNA, 25 bp, Mus musculus
cagtctcaattctctaccttgtgta

SEQ ID NO: 322934 - DNA, 25 bp, Mus musculus
cagtctcacaagctcagcgtctgag

SEQ ID NO: 322935 - DNA, 25 bp, Mus musculus
cagtctcacaaggtcagcgtctgag

SEQ ID NO: 322936 - DNA, 25 bp, Mus musculus
cagtctcacagcctgagttcattga

SEQ ID NO: 322937 - DNA, 25 bp, Mus musculus
cagtctcacagcgtgagttcattga

SEQ ID NO: 322938 - DNA, 25 bp, Mus musculus
cagtctcacctcagatgtatgctac

SEQ ID NO: 322939 - DNA, 25 bp, Mus musculus
cagtctcacctctgatgtatgctac

SEQ ID NO: 322940 - DNA, 25 bp, Mus musculus
cagtctcagaagaggatggaacgca

SEQ ID NO: 322941 - DNA, 25 bp, Mus musculus
cagtctcagaagtggatggaacgca

SEQ ID NO: 322942 - DNA, 25 bp, Mus musculus
cagtctcagaatccaagttctgaaa

SEQ ID NO: 322943 - DNA, 25 bp, Mus musculus
cagtctcagaatgcaagttctgaaa

SEQ ID NO: 322944 - DNA, 25 bp, Mus musculus
cagtctcagcccctctgaggaggag

SEQ ID NO: 322945 - DNA, 25 bp, Mus musculus
cagtctcagcccgtctgaggaggag

SEQ ID NO: 322946 - DNA, 25 bp, Mus musculus
cagtctcagcttagaaggaccatcc

SEQ ID NO: 322947 - DNA, 25 bp, Mus musculus
cagtctcagctttgaaggaccatcc

SEQ ID NO: 322948 - DNA, 25 bp, Mus musculus
cagtctcaggtgatcggttggattc

SEQ ID NO: 322949 - DNA, 25 bp, Mus musculus
cagtctcaggtgttcggttggattc

SEQ ID NO: 322950 - DNA, 25 bp, Mus musculus
cagtctcatcagaggtattcctggg

SEQ ID NO: 322951 - DNA, 25 bp, Mus musculus
cagtctcatcagtggtattcctggg

SEQ ID NO: 322952 - DNA, 25 bp, Mus musculus
cagtctcatgacctttcgtgtggag

SEQ ID NO: 322953 - DNA, 25 bp, Mus musculus
cagtctcatgacgtttcgtgtggag

SEQ ID NO: 322954 - DNA, 25 bp, Mus musculus
cagtctcatggacaatacatgtcag

SEQ ID NO: 322955 - DNA, 25 bp, Mus musculus
cagtctcatggacccctgtagcagg

SEQ ID NO: 322956 - DNA, 25 bp, Mus musculus
cagtctcatggagaatacatgtcag

SEQ ID NO: 322957 - DNA, 25 bp, Mus musculus
cagtctcatggagccctgtagcagg

SEQ ID NO: 322958 - DNA, 25 bp, Mus musculus
cagtctccacacaagccttttatct

SEQ ID NO: 322959 - DNA, 25 bp, Mus musculus
cagtctccacacattatgtgctgag

SEQ ID NO: 322960 - DNA, 25 bp, Mus musculus
cagtctccacactagccttttatct

SEQ ID NO: 322961 - DNA, 25 bp, Mus musculus
cagtctccacactttatgtgctgag

SEQ ID NO: 322962 - DNA, 25 bp, Mus musculus
cagtctccactaccatacagtgata

SEQ ID NO: 322963 - DNA, 25 bp, Mus musculus
cagtctccactagcatacagtgata

SEQ ID NO: 322964 - DNA, 25 bp, Mus musculus
cagtctccactcagcagacaaggca

SEQ ID NO: 322965 - DNA, 25 bp, Mus musculus
cagtctccactcagcctgaatgatc

SEQ ID NO: 322966 - DNA, 25 bp, Mus musculus
cagtctccactctgcagacaaggca

SEQ ID NO: 322967 - DNA, 25 bp, Mus musculus
cagtctccactctgcctgaatgatc

SEQ ID NO: 322968 - DNA, 25 bp, Mus musculus
cagtctccaggaaccacacagtggg

SEQ ID NO: 322969 - DNA, 25 bp, Mus musculus
cagtctccaggatccacacagtggg

SEQ ID NO: 322970 - DNA, 25 bp, Mus musculus
cagtctcccaagcagaacaggccag

SEQ ID NO: 322971 - DNA, 25 bp, Mus musculus
cagtctcccaaggagaacaggccag

SEQ ID NO: 322972 - DNA, 25 bp, Mus musculus
cagtctcccaataactgggactaaa

SEQ ID NO: 322973 - DNA, 25 bp, Mus musculus
cagtctcccaattactgggactaaa

SEQ ID NO: 322974 - DNA, 25 bp, Mus musculus
cagtctccctagagcaggcagtaaa

SEQ ID NO: 322975 - DNA, 25 bp, Mus musculus
cagtctccctagtgcaggcagtaaa

SEQ ID NO: 322976 - DNA, 25 bp, Mus musculus
cagtctccgaaaccctcaagagaga

SEQ ID NO: 322977 - DNA, 25 bp, Mus musculus
cagtctccgaaagcctcaagagaga

SEQ ID NO: 322978 - DNA, 25 bp, Mus musculus
cagtctccgagaagtgttccagcta

SEQ ID NO: 322979 - DNA, 25 bp, Mus musculus
cagtctccgagatgtgttccagcta

SEQ ID NO: 322980 - DNA, 25 bp, Mus musculus
cagtctccgtggaggttgatgattt

SEQ ID NO: 322981 - DNA, 25 bp, Mus musculus
cagtctccgtggtggttgatgattt

SEQ ID NO: 322982 - DNA, 25 bp, Mus musculus
cagtctcctaacagtgtccatggct

SEQ ID NO: 322983 - DNA, 25 bp, Mus musculus
cagtctcctaactgtgtccatggct

SEQ ID NO: 322984 - DNA, 25 bp, Mus musculus
cagtctcctctcagtaatacatctt

SEQ ID NO: 322985 - DNA, 25 bp, Mus musculus
cagtctcctctctgtaatacatctt

SEQ ID NO: 322986 - DNA, 25 bp, Mus musculus
cagtctcctgaaaatagtggcctta

SEQ ID NO: 322987 - DNA, 25 bp, Mus musculus
cagtctcctgaatatagtggcctta

SEQ ID NO: 322988 - DNA, 25 bp, Mus musculus
cagtctcctgagatgcatgaaagtg

SEQ ID NO: 322989 - DNA, 25 bp, Mus musculus
cagtctcctgagttgcatgaaagtg

SEQ ID NO: 322990 - DNA, 25 bp, Mus musculus
cagtctcctgtgaaaattacagtaa

SEQ ID NO: 322991 - DNA, 25 bp, Mus musculus
cagtctcctgtgtaaattacagtaa

SEQ ID NO: 322992 - DNA, 25 bp, Mus musculus
cagtctctacacctttatctttgat

SEQ ID NO: 322993 - DNA, 25 bp, Mus musculus
cagtctctacacgtttatctttgat

SEQ ID NO: 322994 - DNA, 25 bp, Mus musculus
cagtctctatgtacatgttctccat

SEQ ID NO: 322995 - DNA, 25 bp, Mus musculus
cagtctctatgttcatgttctccat

SEQ ID NO: 322996 - DNA, 25 bp, Mus musculus
cagtctctcagcatctaagatcttc

SEQ ID NO: 322997 - DNA, 25 bp, Mus musculus
cagtctctcagcttctaagatcttc

SEQ ID NO: 322998 - DNA, 25 bp, Mus musculus
cagtctctcagtagctcacaggatt

SEQ ID NO: 322999 - DNA, 25 bp, Mus musculus
cagtctctcagttgctcacaggatt

SEQ ID NO: 323000 - DNA, 25 bp, Mus musculus
cagtctctcatgaatattgagcggc

SEQ ID NO: 323001 - DNA, 25 bp, Mus musculus
cagtctctcatgtatattgagcggc

SEQ ID NO: 323002 - DNA, 25 bp, Mus musculus
cagtctctccggcagtgtatttata

SEQ ID NO: 323003 - DNA, 25 bp, Mus musculus
cagtctctccgggagtgtatttata

SEQ ID NO: 323004 - DNA, 25 bp, Mus musculus
cagtctctccgtcacagcatagagt

SEQ ID NO: 323005 - DNA, 25 bp, Mus musculus
cagtctctccgtgacagcatagagt

SEQ ID NO: 323006 - DNA, 25 bp, Mus musculus
cagtctctctcaatgttctagtttt

SEQ ID NO: 323007 - DNA, 25 bp, Mus musculus
cagtctctctcattgttctagtttt

SEQ ID NO: 323008 - DNA, 25 bp, Mus musculus
cagtctctcttgaacccggatgaat

SEQ ID NO: 323009 - DNA, 25 bp, Mus musculus
cagtctctcttgtacccggatgaat

SEQ ID NO: 323010 - DNA, 25 bp, Mus musculus
cagtctctgagcagtgcgtttgtac

SEQ ID NO: 323011 - DNA, 25 bp, Mus musculus
cagtctctgagctgtgcgtttgtac

SEQ ID NO: 323012 - DNA, 25 bp, Mus musculus
cagtctctgcttattggtcatgtac

SEQ ID NO: 323013 - DNA, 25 bp, Mus musculus
cagtctctgctttttggtcatgtac

SEQ ID NO: 323014 - DNA, 25 bp, Mus musculus
cagtctctggagatcaatgtcttct

SEQ ID NO: 323015 - DNA, 25 bp, Mus musculus
cagtctctggagttcaatgtcttct

SEQ ID NO: 323016 - DNA, 25 bp, Mus musculus
cagtctctggtacaagttctgagga

SEQ ID NO: 323017 - DNA, 25 bp, Mus musculus
cagtctctggtagaagttctgagga

SEQ ID NO: 323018 - DNA, 25 bp, Mus musculus
cagtctctggttctagaggctcttc

SEQ ID NO: 323019 - DNA, 25 bp, Mus musculus
cagtctctggttgtagaggctcttc

SEQ ID NO: 323020 - DNA, 25 bp, Mus musculus
cagtctctgtgacaagctcaactaa

SEQ ID NO: 323021 - DNA, 25 bp, Mus musculus
cagtctctgtgagaagctcaactaa

SEQ ID NO: 323022 - DNA, 25 bp, Mus musculus
cagtctcttacaacatgttgtcgat

SEQ ID NO: 323023 - DNA, 25 bp, Mus musculus
cagtctcttacatcatgttgtcgat

SEQ ID NO: 323024 - DNA, 25 bp, Mus musculus
cagtctcttcatagctaataataat

SEQ ID NO: 323025 - DNA, 25 bp, Mus musculus
cagtctcttcataggaccacaagct

SEQ ID NO: 323026 - DNA, 25 bp, Mus musculus
cagtctcttcattgctaataataat

SEQ ID NO: 323027 - DNA, 25 bp, Mus musculus
cagtctcttcattggaccacaagct

SEQ ID NO: 323028 - DNA, 25 bp, Mus musculus
cagtctcttctccagcgtaaggaat

SEQ ID NO: 323029 - DNA, 25 bp, Mus musculus
cagtctcttctcgagcgtaaggaat

SEQ ID NO: 323030 - DNA, 25 bp, Mus musculus
cagtctcttctgaatgcgtgtcact

SEQ ID NO: 323031 - DNA, 25 bp, Mus musculus
cagtctcttctgcatgttaccaaat

SEQ ID NO: 323032 - DNA, 25 bp, Mus musculus
cagtctcttctggatgttaccaaat

SEQ ID NO: 323033 - DNA, 25 bp, Mus musculus
cagtctcttctgtatgcgtgtcact

SEQ ID NO: 323034 - DNA, 25 bp, Mus musculus
cagtctcttggccacatacgaaaat

SEQ ID NO: 323035 - DNA, 25 bp, Mus musculus
cagtctcttggcgacatacgaaaat

SEQ ID NO: 323036 - DNA, 25 bp, Mus musculus
cagtctctttaacgaatcaaccctt

SEQ ID NO: 323037 - DNA, 25 bp, Mus musculus
cagtctctttaaggaatcaaccctt

SEQ ID NO: 323038 - DNA, 25 bp, Mus musculus
cagtctctttgtcccctaaacttag

SEQ ID NO: 323039 - DNA, 25 bp, Mus musculus
cagtctctttgtgccctaaacttag

SEQ ID NO: 323040 - DNA, 25 bp, Mus musculus
cagtctctttttcgaggctaattag

SEQ ID NO: 323041 - DNA, 25 bp, Mus musculus
cagtctctttttggaggctaattag

SEQ ID NO: 323042 - DNA, 25 bp, Mus musculus
cagtctgaacagctctctttgtaaa

SEQ ID NO: 323043 - DNA, 25 bp, Mus musculus
cagtctgaacaggtctctttgtaaa

SEQ ID NO: 323044 - DNA, 25 bp, Mus musculus
cagtctgaagacatcctctgcagaa

SEQ ID NO: 323045 - DNA, 25 bp, Mus musculus
cagtctgaagacttcctctgcagaa

SEQ ID NO: 323046 - DNA, 25 bp, Mus musculus
cagtctgacatcaactactctgtgg

SEQ ID NO: 323047 - DNA, 25 bp, Mus musculus
cagtctgacatctactactctgtgg

SEQ ID NO: 323048 - DNA, 25 bp, Mus musculus
cagtctgacctacggatactttgcc

SEQ ID NO: 323049 - DNA, 25 bp, Mus musculus
cagtctgacctagggatactttgcc

SEQ ID NO: 323050 - DNA, 25 bp, Mus musculus
cagtctgactggagcctaccataaa

SEQ ID NO: 323051 - DNA, 25 bp, Mus musculus
cagtctgactggtgcctaccataaa

SEQ ID NO: 323052 - DNA, 25 bp, Mus musculus
cagtctgagaccactaggcactagt

SEQ ID NO: 323053 - DNA, 25 bp, Mus musculus
cagtctgagacctctaggcactagt

SEQ ID NO: 323054 - DNA, 25 bp, Mus musculus
cagtctgagatgagcctttcctttg

SEQ ID NO: 323055 - DNA, 25 bp, Mus musculus
cagtctgagatgtgcctttcctttg

SEQ ID NO: 323056 - DNA, 25 bp, Mus musculus
cagtctgaggacacccttaacaagg

SEQ ID NO: 323057 - DNA, 25 bp, Mus musculus
cagtctgaggactcccttaacaagg

SEQ ID NO: 323058 - DNA, 25 bp, Mus musculus
cagtctgagggcatccctaaagtgg

SEQ ID NO: 323059 - DNA, 25 bp, Mus musculus
cagtctgagggcatgagcctccagt

SEQ ID NO: 323060 - DNA, 25 bp, Mus musculus
cagtctgagggccacatttcagatt

SEQ ID NO: 323061 - DNA, 25 bp, Mus musculus
cagtctgagggcgacatttcagatt
